United States Patent 11,492,591 (UNIVERSAL DONOR STEM CELLS AND RELATED METHODS) - sequence listing, part 4

SEQ ID NO: 96226 - DNA, 20 bp, Artificial
  CRISPR gRNA sequence
ggtattcaagagagtagagt

SEQ ID NO: 96227 - DNA, 20 bp, Artificial
  CRISPR gRNA sequence
aagagagtagagtgagtgaa

SEQ ID NO: 96228 - DNA, 20 bp, Artificial
  CRISPR gRNA sequence
agagtagagtgagtgaatgg

SEQ ID NO: 96229 - DNA, 20 bp, Artificial
  CRISPR gRNA sequence
agtagagtgagtgaatggtg

SEQ ID NO: 96230 - DNA, 20 bp, Artificial
  CRISPR gRNA sequence
gtgagtgaatggtggagtcc

SEQ ID NO: 96231 - DNA, 20 bp, Artificial
  CRISPR gRNA sequence
tgagtgaatggtggagtccc

SEQ ID NO: 96232 - DNA, 20 bp, Artificial
  CRISPR gRNA sequence
ggagtcccaggcactgcctt

SEQ ID NO: 96233 - DNA, 20 bp, Artificial
  CRISPR gRNA sequence
gtcccaggcactgcctttgg

SEQ ID NO: 96234 - DNA, 20 bp, Artificial
  CRISPR gRNA sequence
gcactgcctttggtagctcc

SEQ ID NO: 96235 - DNA, 20 bp, Artificial
  CRISPR gRNA sequence
ctttggtagctccaagaccc

SEQ ID NO: 96236 - DNA, 20 bp, Artificial
  CRISPR gRNA sequence
tttggtagctccaagacccc

SEQ ID NO: 96237 - DNA, 20 bp, Artificial
  CRISPR gRNA sequence
ttggtagctccaagacccca

SEQ ID NO: 96238 - DNA, 20 bp, Artificial
  CRISPR gRNA sequence
ggtagctccaagaccccagg

SEQ ID NO: 96239 - DNA, 20 bp, Artificial
  CRISPR gRNA sequence
aagaccccagggagataccg

SEQ ID NO: 96240 - DNA, 20 bp, Artificial
  CRISPR gRNA sequence
agaccccagggagataccga

SEQ ID NO: 96241 - DNA, 20 bp, Artificial
  CRISPR gRNA sequence
ccccagggagataccgaagg

SEQ ID NO: 96242 - DNA, 20 bp, Artificial
  CRISPR gRNA sequence
cagggagataccgaaggcag

SEQ ID NO: 96243 - DNA, 20 bp, Artificial
  CRISPR gRNA sequence
agataccgaaggcagtagca

SEQ ID NO: 96244 - DNA, 20 bp, Artificial
  CRISPR gRNA sequence
taccgaaggcagtagcatgg

SEQ ID NO: 96245 - DNA, 20 bp, Artificial
  CRISPR gRNA sequence
gtagctcatgcctgtaatcc

SEQ ID NO: 96246 - DNA, 20 bp, Artificial
  CRISPR gRNA sequence
tgcctgtaatcccagcactt

SEQ ID NO: 96247 - DNA, 20 bp, Artificial
  CRISPR gRNA sequence
gcctgtaatcccagcacttt

SEQ ID NO: 96248 - DNA, 20 bp, Artificial
  CRISPR gRNA sequence
ctgtaatcccagcactttgg

SEQ ID NO: 96249 - DNA, 20 bp, Artificial
  CRISPR gRNA sequence
tgtaatcccagcactttggg

SEQ ID NO: 96250 - DNA, 20 bp, Artificial
  CRISPR gRNA sequence
cccagcactttgggaggcca

SEQ ID NO: 96251 - DNA, 20 bp, Artificial
  CRISPR gRNA sequence
agcactttgggaggccacgg

SEQ ID NO: 96252 - DNA, 20 bp, Artificial
  CRISPR gRNA sequence
gcactttgggaggccacggc

SEQ ID NO: 96253 - DNA, 20 bp, Artificial
  CRISPR gRNA sequence
actttgggaggccacggcag

SEQ ID NO: 96254 - DNA, 20 bp, Artificial
  CRISPR gRNA sequence
ccacggcaggagaattgctt

SEQ ID NO: 96255 - DNA, 20 bp, Artificial
  CRISPR gRNA sequence
gcaggagaattgcttgagcc

SEQ ID NO: 96256 - DNA, 20 bp, Artificial
  CRISPR gRNA sequence
caggagaattgcttgagccc

SEQ ID NO: 96257 - DNA, 20 bp, Artificial
  CRISPR gRNA sequence
ggagaattgcttgagcccag

SEQ ID NO: 96258 - DNA, 20 bp, Artificial
  CRISPR gRNA sequence
ttgcttgagcccaggagttt

SEQ ID NO: 96259 - DNA, 20 bp, Artificial
  CRISPR gRNA sequence
tgagcccaggagtttgagac

SEQ ID NO: 96260 - DNA, 20 bp, Artificial
  CRISPR gRNA sequence
ccaggagtttgagaccagcc

SEQ ID NO: 96261 - DNA, 20 bp, Artificial
  CRISPR gRNA sequence
caggagtttgagaccagcct

SEQ ID NO: 96262 - DNA, 20 bp, Artificial
  CRISPR gRNA sequence
tttgagaccagcctgggcga

SEQ ID NO: 96263 - DNA, 20 bp, Artificial
  CRISPR gRNA sequence
tgagaccagcctgggcgaca

SEQ ID NO: 96264 - DNA, 20 bp, Artificial
  CRISPR gRNA sequence
accagcctgggcgacagagc

SEQ ID NO: 96265 - DNA, 20 bp, Artificial
  CRISPR gRNA sequence
tatatatatttttaatttgc

SEQ ID NO: 96266 - DNA, 20 bp, Artificial
  CRISPR gRNA sequence
atatatatttttaatttgct

SEQ ID NO: 96267 - DNA, 20 bp, Artificial
  CRISPR gRNA sequence
tatttttaatttgctgggta

SEQ ID NO: 96268 - DNA, 20 bp, Artificial
  CRISPR gRNA sequence
ttttaatttgctgggtatgg

SEQ ID NO: 96269 - DNA, 20 bp, Artificial
  CRISPR gRNA sequence
gctgggtatggtggcacctg

SEQ ID NO: 96270 - DNA, 20 bp, Artificial
  CRISPR gRNA sequence
tatggtggcacctgtagttt

SEQ ID NO: 96271 - DNA, 20 bp, Artificial
  CRISPR gRNA sequence
cacctgtagtttcagctgct

SEQ ID NO: 96272 - DNA, 20 bp, Artificial
  CRISPR gRNA sequence
acctgtagtttcagctgctc

SEQ ID NO: 96273 - DNA, 20 bp, Artificial
  CRISPR gRNA sequence
ctgtagtttcagctgctcag

SEQ ID NO: 96274 - DNA, 20 bp, Artificial
  CRISPR gRNA sequence
tgtagtttcagctgctcagg

SEQ ID NO: 96275 - DNA, 20 bp, Artificial
  CRISPR gRNA sequence
tttcagctgctcaggaggct

SEQ ID NO: 96276 - DNA, 20 bp, Artificial
  CRISPR gRNA sequence
ttcagctgctcaggaggctg

SEQ ID NO: 96277 - DNA, 20 bp, Artificial
  CRISPR gRNA sequence
agctgctcaggaggctgagg

SEQ ID NO: 96278 - DNA, 20 bp, Artificial
  CRISPR gRNA sequence
gctgctcaggaggctgaggt

SEQ ID NO: 96279 - DNA, 20 bp, Artificial
  CRISPR gRNA sequence
tgctcaggaggctgaggtgg

SEQ ID NO: 96280 - DNA, 20 bp, Artificial
  CRISPR gRNA sequence
gctcaggaggctgaggtggg

SEQ ID NO: 96281 - DNA, 20 bp, Artificial
  CRISPR gRNA sequence
aggaggctgaggtgggaggt

SEQ ID NO: 96282 - DNA, 20 bp, Artificial
  CRISPR gRNA sequence
ctgaggtgggaggttggctt

SEQ ID NO: 96283 - DNA, 20 bp, Artificial
  CRISPR gRNA sequence
gtgggaggttggcttgagcc

SEQ ID NO: 96284 - DNA, 20 bp, Artificial
  CRISPR gRNA sequence
tgggaggttggcttgagccc

SEQ ID NO: 96285 - DNA, 20 bp, Artificial
  CRISPR gRNA sequence
ggaggttggcttgagcccag

SEQ ID NO: 96286 - DNA, 20 bp, Artificial
  CRISPR gRNA sequence
gaggttggcttgagcccagg

SEQ ID NO: 96287 - DNA, 20 bp, Artificial
  CRISPR gRNA sequence
tggcttgagcccaggaggtt

SEQ ID NO: 96288 - DNA, 20 bp, Artificial
  CRISPR gRNA sequence
ggcttgagcccaggaggttg

SEQ ID NO: 96289 - DNA, 20 bp, Artificial
  CRISPR gRNA sequence
agcccaggaggttgaggctg

SEQ ID NO: 96290 - DNA, 20 bp, Artificial
  CRISPR gRNA sequence
gtgatcacaccaccgcactc

SEQ ID NO: 96291 - DNA, 20 bp, Artificial
  CRISPR gRNA sequence
cacaccaccgcactccagcc

SEQ ID NO: 96292 - DNA, 20 bp, Artificial
  CRISPR gRNA sequence
ccgcactccagcctggacaa

SEQ ID NO: 96293 - DNA, 20 bp, Artificial
  CRISPR gRNA sequence
gcactccagcctggacaaca

SEQ ID NO: 96294 - DNA, 20 bp, Artificial
  CRISPR gRNA sequence
tccagcctggacaacagagc

SEQ ID NO: 96295 - DNA, 20 bp, Artificial
  CRISPR gRNA sequence
aaaaaaaaaaaaaaccccaa

SEQ ID NO: 96296 - DNA, 20 bp, Artificial
  CRISPR gRNA sequence
aaaaaaaaaaccccaatagc

SEQ ID NO: 96297 - DNA, 20 bp, Artificial
  CRISPR gRNA sequence
aaaaaaaaaccccaatagct

SEQ ID NO: 96298 - DNA, 20 bp, Artificial
  CRISPR gRNA sequence
aaaaccccaatagctgggtg

SEQ ID NO: 96299 - DNA, 20 bp, Artificial
  CRISPR gRNA sequence
accccaatagctgggtgtgg

SEQ ID NO: 96300 - DNA, 20 bp, Artificial
  CRISPR gRNA sequence
gtggctcatgcctataatcc

SEQ ID NO: 96301 - DNA, 20 bp, Artificial
  CRISPR gRNA sequence
tgcctataatcccagcactt

SEQ ID NO: 96302 - DNA, 20 bp, Artificial
  CRISPR gRNA sequence
gcctataatcccagcacttt

SEQ ID NO: 96303 - DNA, 20 bp, Artificial
  CRISPR gRNA sequence
ctataatcccagcactttgg

SEQ ID NO: 96304 - DNA, 20 bp, Artificial
  CRISPR gRNA sequence
tataatcccagcactttggg

SEQ ID NO: 96305 - DNA, 20 bp, Artificial
  CRISPR gRNA sequence
tcccagcactttgggaggct

SEQ ID NO: 96306 - DNA, 20 bp, Artificial
  CRISPR gRNA sequence
cccagcactttgggaggctg

SEQ ID NO: 96307 - DNA, 20 bp, Artificial
  CRISPR gRNA sequence
agcactttgggaggctgagg

SEQ ID NO: 96308 - DNA, 20 bp, Artificial
  CRISPR gRNA sequence
gcactttgggaggctgaggc

SEQ ID NO: 96309 - DNA, 20 bp, Artificial
  CRISPR gRNA sequence
ctttgggaggctgaggcagg

SEQ ID NO: 96310 - DNA, 20 bp, Artificial
  CRISPR gRNA sequence
ctgaggcaggtggatgattt

SEQ ID NO: 96311 - DNA, 20 bp, Artificial
  CRISPR gRNA sequence
tgaggcaggtggatgatttg

SEQ ID NO: 96312 - DNA, 20 bp, Artificial
  CRISPR gRNA sequence
gcaggtggatgatttgaggt

SEQ ID NO: 96313 - DNA, 20 bp, Artificial
  CRISPR gRNA sequence
caggtggatgatttgaggtc

SEQ ID NO: 96314 - DNA, 20 bp, Artificial
  CRISPR gRNA sequence
ggtggatgatttgaggtcag

SEQ ID NO: 96315 - DNA, 20 bp, Artificial
  CRISPR gRNA sequence
tgaggtcaggagtttgaaat

SEQ ID NO: 96316 - DNA, 20 bp, Artificial
  CRISPR gRNA sequence
tcaggagtttgaaattagcc

SEQ ID NO: 96317 - DNA, 20 bp, Artificial
  CRISPR gRNA sequence
tgaaattagcctggccaaca

SEQ ID NO: 96318 - DNA, 20 bp, Artificial
  CRISPR gRNA sequence
tctacttaaaatacaaaaat

SEQ ID NO: 96319 - DNA, 20 bp, Artificial
  CRISPR gRNA sequence
cttaaaatacaaaaattagc

SEQ ID NO: 96320 - DNA, 20 bp, Artificial
  CRISPR gRNA sequence
ttaaaatacaaaaattagcc

SEQ ID NO: 96321 - DNA, 20 bp, Artificial
  CRISPR gRNA sequence
atacaaaaattagccaggtg

SEQ ID NO: 96322 - DNA, 20 bp, Artificial
  CRISPR gRNA sequence
caaaaattagccaggtgtgg

SEQ ID NO: 96323 - DNA, 20 bp, Artificial
  CRISPR gRNA sequence
aaattagccaggtgtggtgg

SEQ ID NO: 96324 - DNA, 20 bp, Artificial
  CRISPR gRNA sequence
aattagccaggtgtggtggt

SEQ ID NO: 96325 - DNA, 20 bp, Artificial
  CRISPR gRNA sequence
gtggtgggcgcctatgatcc

SEQ ID NO: 96326 - DNA, 20 bp, Artificial
  CRISPR gRNA sequence
cgcctatgatcccagctact

SEQ ID NO: 96327 - DNA, 20 bp, Artificial
  CRISPR gRNA sequence
gcctatgatcccagctactc

SEQ ID NO: 96328 - DNA, 20 bp, Artificial
  CRISPR gRNA sequence
ctatgatcccagctactcgg

SEQ ID NO: 96329 - DNA, 20 bp, Artificial
  CRISPR gRNA sequence
tatgatcccagctactcggg

SEQ ID NO: 96330 - DNA, 20 bp, Artificial
  CRISPR gRNA sequence
tcccagctactcgggaggct

SEQ ID NO: 96331 - DNA, 20 bp, Artificial
  CRISPR gRNA sequence
cccagctactcgggaggctg

SEQ ID NO: 96332 - DNA, 20 bp, Artificial
  CRISPR gRNA sequence
tactcgggaggctgaggcac

SEQ ID NO: 96333 - DNA, 20 bp, Artificial
  CRISPR gRNA sequence
gcacaagaatcgcttgaacc

SEQ ID NO: 96334 - DNA, 20 bp, Artificial
  CRISPR gRNA sequence
cacaagaatcgcttgaaccc

SEQ ID NO: 96335 - DNA, 20 bp, Artificial
  CRISPR gRNA sequence
caagaatcgcttgaacccag

SEQ ID NO: 96336 - DNA, 20 bp, Artificial
  CRISPR gRNA sequence
aagaatcgcttgaacccagg

SEQ ID NO: 96337 - DNA, 20 bp, Artificial
  CRISPR gRNA sequence
aatcgcttgaacccaggagg

SEQ ID NO: 96338 - DNA, 20 bp, Artificial
  CRISPR gRNA sequence
tcgcttgaacccaggaggca

SEQ ID NO: 96339 - DNA, 20 bp, Artificial
  CRISPR gRNA sequence
cgcttgaacccaggaggcag

SEQ ID NO: 96340 - DNA, 20 bp, Artificial
  CRISPR gRNA sequence
aacccaggaggcagaggttg

SEQ ID NO: 96341 - DNA, 20 bp, Artificial
  CRISPR gRNA sequence
caggaggcagaggttgcagt

SEQ ID NO: 96342 - DNA, 20 bp, Artificial
  CRISPR gRNA sequence
ggcagaggttgcagtgagcc

SEQ ID NO: 96343 - DNA, 20 bp, Artificial
  CRISPR gRNA sequence
gagatcacgccactgtactc

SEQ ID NO: 96344 - DNA, 20 bp, Artificial
  CRISPR gRNA sequence
cacgccactgtactccagcc

SEQ ID NO: 96345 - DNA, 20 bp, Artificial
  CRISPR gRNA sequence
acgccactgtactccagcct

SEQ ID NO: 96346 - DNA, 20 bp, Artificial
  CRISPR gRNA sequence
cgccactgtactccagcctg

SEQ ID NO: 96347 - DNA, 20 bp, Artificial
  CRISPR gRNA sequence
gccactgtactccagcctgg

SEQ ID NO: 96348 - DNA, 20 bp, Artificial
  CRISPR gRNA sequence
ctgtactccagcctggggga

SEQ ID NO: 96349 - DNA, 20 bp, Artificial
  CRISPR gRNA sequence
actccagcctgggggacaga

SEQ ID NO: 96350 - DNA, 20 bp, Artificial
  CRISPR gRNA sequence
tccagcctgggggacagacg

SEQ ID NO: 96351 - DNA, 20 bp, Artificial
  CRISPR gRNA sequence
gactccatctcaaacaacaa

SEQ ID NO: 96352 - DNA, 20 bp, Artificial
  CRISPR gRNA sequence
acaacagcaacaaaaaaaaa

SEQ ID NO: 96353 - DNA, 20 bp, Artificial
  CRISPR gRNA sequence
cagcaacaaaaaaaaacaga

SEQ ID NO: 96354 - DNA, 20 bp, Artificial
  CRISPR gRNA sequence
agcaacaaaaaaaaacagat

SEQ ID NO: 96355 - DNA, 20 bp, Artificial
  CRISPR gRNA sequence
acagatgggcttctgtcctg

SEQ ID NO: 96356 - DNA, 20 bp, Artificial
  CRISPR gRNA sequence
gggcttctgtcctgaagcct

SEQ ID NO: 96357 - DNA, 20 bp, Artificial
  CRISPR gRNA sequence
gcttctgtcctgaagcctca

SEQ ID NO: 96358 - DNA, 20 bp, Artificial
  CRISPR gRNA sequence
aagcctcagagacatctact

SEQ ID NO: 96359 - DNA, 20 bp, Artificial
  CRISPR gRNA sequence
agcctcagagacatctactg

SEQ ID NO: 96360 - DNA, 20 bp, Artificial
  CRISPR gRNA sequence
gcctcagagacatctactga

SEQ ID NO: 96361 - DNA, 20 bp, Artificial
  CRISPR gRNA sequence
cctcagagacatctactgag

SEQ ID NO: 96362 - DNA, 20 bp, Artificial
  CRISPR gRNA sequence
gacgcctgttgtctgtttcc

SEQ ID NO: 96363 - DNA, 20 bp, Artificial
  CRISPR gRNA sequence
gcctgttgtctgtttcccag

SEQ ID NO: 96364 - DNA, 20 bp, Artificial
  CRISPR gRNA sequence
cctgttgtctgtttcccagc

SEQ ID NO: 96365 - DNA, 20 bp, Artificial
  CRISPR gRNA sequence
gttgtctgtttcccagcagg

SEQ ID NO: 96366 - DNA, 20 bp, Artificial
  CRISPR gRNA sequence
tcccagcaggcagctccctg

SEQ ID NO: 96367 - DNA, 20 bp, Artificial
  CRISPR gRNA sequence
actccaccactctcaccaac

SEQ ID NO: 96368 - DNA, 20 bp, Artificial
  CRISPR gRNA sequence
ccaccactctcaccaaccgg

SEQ ID NO: 96369 - DNA, 20 bp, Artificial
  CRISPR gRNA sequence
cactctcaccaaccggcagc

SEQ ID NO: 96370 - DNA, 20 bp, Artificial
  CRISPR gRNA sequence
actctcaccaaccggcagcg

SEQ ID NO: 96371 - DNA, 20 bp, Artificial
  CRISPR gRNA sequence
ctctcaccaaccggcagcga

SEQ ID NO: 96372 - DNA, 20 bp, Artificial
  CRISPR gRNA sequence
ccaaccggcagcgagggaac

SEQ ID NO: 96373 - DNA, 20 bp, Artificial
  CRISPR gRNA sequence
caaccggcagcgagggaacg

SEQ ID NO: 96374 - DNA, 20 bp, Artificial
  CRISPR gRNA sequence
gcagcgagggaacgaggtgt

SEQ ID NO: 96375 - DNA, 20 bp, Artificial
  CRISPR gRNA sequence
gaacgaggtgtcagctctgc

SEQ ID NO: 96376 - DNA, 20 bp, Artificial
  CRISPR gRNA sequence
gtcagctctgccggccaccc

SEQ ID NO: 96377 - DNA, 20 bp, Artificial
  CRISPR gRNA sequence
tgccggccaccctagactgt

SEQ ID NO: 96378 - DNA, 20 bp, Artificial
  CRISPR gRNA sequence
cggccaccctagactgtgag

SEQ ID NO: 96379 - DNA, 20 bp, Artificial
  CRISPR gRNA sequence
ggccaccctagactgtgagt

SEQ ID NO: 96380 - DNA, 20 bp, Artificial
  CRISPR gRNA sequence
ctagactgtgagtgggccca

SEQ ID NO: 96381 - DNA, 20 bp, Artificial
  CRISPR gRNA sequence
gtgggcccacggtccccaac

SEQ ID NO: 96382 - DNA, 20 bp, Artificial
  CRISPR gRNA sequence
tgggcccacggtccccaaca

SEQ ID NO: 96383 - DNA, 20 bp, Artificial
  CRISPR gRNA sequence
ggcccacggtccccaacaag

SEQ ID NO: 96384 - DNA, 20 bp, Artificial
  CRISPR gRNA sequence
cccacggtccccaacaagga

SEQ ID NO: 96385 - DNA, 20 bp, Artificial
  CRISPR gRNA sequence
ccacggtccccaacaaggag

SEQ ID NO: 96386 - DNA, 20 bp, Artificial
  CRISPR gRNA sequence
acggtccccaacaaggagag

SEQ ID NO: 96387 - DNA, 20 bp, Artificial
  CRISPR gRNA sequence
gtccccaacaaggagaggag

SEQ ID NO: 96388 - DNA, 20 bp, Artificial
  CRISPR gRNA sequence
tccccaacaaggagaggagt

SEQ ID NO: 96389 - DNA, 20 bp, Artificial
  CRISPR gRNA sequence
cccaacaaggagaggagtag

SEQ ID NO: 96390 - DNA, 20 bp, Artificial
  CRISPR gRNA sequence
ccaacaaggagaggagtagg

SEQ ID NO: 96391 - DNA, 20 bp, Artificial
  CRISPR gRNA sequence
caacaaggagaggagtagga

SEQ ID NO: 96392 - DNA, 20 bp, Artificial
  CRISPR gRNA sequence
caaggagaggagtaggaggg

SEQ ID NO: 96393 - DNA, 20 bp, Artificial
  CRISPR gRNA sequence
aaggagaggagtaggagggt

SEQ ID NO: 96394 - DNA, 20 bp, Artificial
  CRISPR gRNA sequence
ggagaggagtaggagggtgg

SEQ ID NO: 96395 - DNA, 20 bp, Artificial
  CRISPR gRNA sequence
gagaggagtaggagggtggg

SEQ ID NO: 96396 - DNA, 20 bp, Artificial
  CRISPR gRNA sequence
agaggagtaggagggtggga

SEQ ID NO: 96397 - DNA, 20 bp, Artificial
  CRISPR gRNA sequence
aggagggtgggagggcctgt

SEQ ID NO: 96398 - DNA, 20 bp, Artificial
  CRISPR gRNA sequence
ggagggtgggagggcctgtg

SEQ ID NO: 96399 - DNA, 20 bp, Artificial
  CRISPR gRNA sequence
agggtgggagggcctgtgag

SEQ ID NO: 96400 - DNA, 20 bp, Artificial
  CRISPR gRNA sequence
gggcctgtgaggagcaatcg

SEQ ID NO: 96401 - DNA, 20 bp, Artificial
  CRISPR gRNA sequence
ctgtgaggagcaatcgtgga

SEQ ID NO: 96402 - DNA, 20 bp, Artificial
  CRISPR gRNA sequence
gtgaggagcaatcgtggaca

SEQ ID NO: 96403 - DNA, 20 bp, Artificial
  CRISPR gRNA sequence
tgaggagcaatcgtggacag

SEQ ID NO: 96404 - DNA, 20 bp, Artificial
  CRISPR gRNA sequence
gaggagcaatcgtggacaga

SEQ ID NO: 96405 - DNA, 20 bp, Artificial
  CRISPR gRNA sequence
tcgtggacagagggtaaact

SEQ ID NO: 96406 - DNA, 20 bp, Artificial
  CRISPR gRNA sequence
cgtggacagagggtaaactg

SEQ ID NO: 96407 - DNA, 20 bp, Artificial
  CRISPR gRNA sequence
acagagggtaaactgaggca

SEQ ID NO: 96408 - DNA, 20 bp, Artificial
  CRISPR gRNA sequence
agagggtaaactgaggcaca

SEQ ID NO: 96409 - DNA, 20 bp, Artificial
  CRISPR gRNA sequence
gggtaaactgaggcacagag

SEQ ID NO: 96410 - DNA, 20 bp, Artificial
  CRISPR gRNA sequence
aaactgaggcacagagaagc

SEQ ID NO: 96411 - DNA, 20 bp, Artificial
  CRISPR gRNA sequence
aactgaggcacagagaagca

SEQ ID NO: 96412 - DNA, 20 bp, Artificial
  CRISPR gRNA sequence
actgaggcacagagaagcaa

SEQ ID NO: 96413 - DNA, 20 bp, Artificial
  CRISPR gRNA sequence
ctgaggcacagagaagcaag

SEQ ID NO: 96414 - DNA, 20 bp, Artificial
  CRISPR gRNA sequence
gcacagagaagcaaggggat

SEQ ID NO: 96415 - DNA, 20 bp, Artificial
  CRISPR gRNA sequence
agagaagcaaggggatgagt

SEQ ID NO: 96416 - DNA, 20 bp, Artificial
  CRISPR gRNA sequence
gagaagcaaggggatgagtg

SEQ ID NO: 96417 - DNA, 20 bp, Artificial
  CRISPR gRNA sequence
actctgcctctgtcctgccc

SEQ ID NO: 96418 - DNA, 20 bp, Artificial
  CRISPR gRNA sequence
ccccagccctgtccatccac

SEQ ID NO: 96419 - DNA, 20 bp, Artificial
  CRISPR gRNA sequence
cctgtccatccaccagctcg

SEQ ID NO: 96420 - DNA, 20 bp, Artificial
  CRISPR gRNA sequence
ccatccaccagctcgcagca

SEQ ID NO: 96421 - DNA, 20 bp, Artificial
  CRISPR gRNA sequence
catccaccagctcgcagcac

SEQ ID NO: 96422 - DNA, 20 bp, Artificial
  CRISPR gRNA sequence
atccaccagctcgcagcaca

SEQ ID NO: 96423 - DNA, 20 bp, Artificial
  CRISPR gRNA sequence
tccaccagctcgcagcacag

SEQ ID NO: 96424 - DNA, 20 bp, Artificial
  CRISPR gRNA sequence
ccaccagctcgcagcacagg

SEQ ID NO: 96425 - DNA, 20 bp, Artificial
  CRISPR gRNA sequence
accagctcgcagcacagggg

SEQ ID NO: 96426 - DNA, 20 bp, Artificial
  CRISPR gRNA sequence
gctcgcagcacagggggagc

SEQ ID NO: 96427 - DNA, 20 bp, Artificial
  CRISPR gRNA sequence
cagcacagggggagctggac

SEQ ID NO: 96428 - DNA, 20 bp, Artificial
  CRISPR gRNA sequence
agggggagctggaccagctg

SEQ ID NO: 96429 - DNA, 20 bp, Artificial
  CRISPR gRNA sequence
gggggagctggaccagctga

SEQ ID NO: 96430 - DNA, 20 bp, Artificial
  CRISPR gRNA sequence
gggagctggaccagctgaag

SEQ ID NO: 96431 - DNA, 20 bp, Artificial
  CRISPR gRNA sequence
accagctgaaggagcatttg

SEQ ID NO: 96432 - DNA, 20 bp, Artificial
  CRISPR gRNA sequence
gctgaaggagcatttgcgga

SEQ ID NO: 96433 - DNA, 20 bp, Artificial
  CRISPR gRNA sequence
ctgaaggagcatttgcggaa

SEQ ID NO: 96434 - DNA, 20 bp, Artificial
  CRISPR gRNA sequence
gcgtgtccacacacatgtgc

SEQ ID NO: 96435 - DNA, 20 bp, Artificial
  CRISPR gRNA sequence
tgtgctggcatgtctgcacc

SEQ ID NO: 96436 - DNA, 20 bp, Artificial
  CRISPR gRNA sequence
ctggcatgtctgcacctggc

SEQ ID NO: 96437 - DNA, 20 bp, Artificial
  CRISPR gRNA sequence
acctggctggtgtgtgcata

SEQ ID NO: 96438 - DNA, 20 bp, Artificial
  CRISPR gRNA sequence
cctggctggtgtgtgcatat

SEQ ID NO: 96439 - DNA, 20 bp, Artificial
  CRISPR gRNA sequence
ccactcatgacgtgacctgt

SEQ ID NO: 96440 - DNA, 20 bp, Artificial
  CRISPR gRNA sequence
ctcattcccctgtctaaccc

SEQ ID NO: 96441 - DNA, 20 bp, Artificial
  CRISPR gRNA sequence
ccccccacctcgtccccatt

SEQ ID NO: 96442 - DNA, 20 bp, Artificial
  CRISPR gRNA sequence
cccacctcgtccccatttgg

SEQ ID NO: 96443 - DNA, 20 bp, Artificial
  CRISPR gRNA sequence
tcgtccccatttggcagcac

SEQ ID NO: 96444 - DNA, 20 bp, Artificial
  CRISPR gRNA sequence
cgtccccatttggcagcact

SEQ ID NO: 96445 - DNA, 20 bp, Artificial
  CRISPR gRNA sequence
gtccccatttggcagcactg

SEQ ID NO: 96446 - DNA, 20 bp, Artificial
  CRISPR gRNA sequence
ccatttggcagcactgggga

SEQ ID NO: 96447 - DNA, 20 bp, Artificial
  CRISPR gRNA sequence
catttggcagcactggggat

SEQ ID NO: 96448 - DNA, 20 bp, Artificial
  CRISPR gRNA sequence
atttggcagcactggggata

SEQ ID NO: 96449 - DNA, 20 bp, Artificial
  CRISPR gRNA sequence
tttggcagcactggggatag

SEQ ID NO: 96450 - DNA, 20 bp, Artificial
  CRISPR gRNA sequence
ttggcagcactggggatagg

SEQ ID NO: 96451 - DNA, 20 bp, Artificial
  CRISPR gRNA sequence
gcagcactggggataggggg

SEQ ID NO: 96452 - DNA, 20 bp, Artificial
  CRISPR gRNA sequence
cagcactggggatagggggc

SEQ ID NO: 96453 - DNA, 20 bp, Artificial
  CRISPR gRNA sequence
agcactggggatagggggca

SEQ ID NO: 96454 - DNA, 20 bp, Artificial
  CRISPR gRNA sequence
gcactggggatagggggcag

SEQ ID NO: 96455 - DNA, 20 bp, Artificial
  CRISPR gRNA sequence
ggggatagggggcaggggtg

SEQ ID NO: 96456 - DNA, 20 bp, Artificial
  CRISPR gRNA sequence
tagggggcaggggtgcagcc

SEQ ID NO: 96457 - DNA, 20 bp, Artificial
  CRISPR gRNA sequence
ggggcaggggtgcagcctgg

SEQ ID NO: 96458 - DNA, 20 bp, Artificial
  CRISPR gRNA sequence
tattgcccgcctcctcctgc

SEQ ID NO: 96459 - DNA, 20 bp, Artificial
  CRISPR gRNA sequence
attgcccgcctcctcctgcc

SEQ ID NO: 96460 - DNA, 20 bp, Artificial
  CRISPR gRNA sequence
caggtgacaacctcgtcaac

SEQ ID NO: 96461 - DNA, 20 bp, Artificial
  CRISPR gRNA sequence
tgacaacctcgtcaacaagc

SEQ ID NO: 96462 - DNA, 20 bp, Artificial
  CRISPR gRNA sequence
acctcgtcaacaagccagac

SEQ ID NO: 96463 - DNA, 20 bp, Artificial
  CRISPR gRNA sequence
gtcaacaagccagacgagcg

SEQ ID NO: 96464 - DNA, 20 bp, Artificial
  CRISPR gRNA sequence
gcggcttcacccccctcatc

SEQ ID NO: 96465 - DNA, 20 bp, Artificial
  CRISPR gRNA sequence
cggcttcacccccctcatct

SEQ ID NO: 96466 - DNA, 20 bp, Artificial
  CRISPR gRNA sequence
ctcatctgggcctccgcctt

SEQ ID NO: 96467 - DNA, 20 bp, Artificial
  CRISPR gRNA sequence
catctgggcctccgcctttg

SEQ ID NO: 96468 - DNA, 20 bp, Artificial
  CRISPR gRNA sequence
tctgggcctccgcctttgga

SEQ ID NO: 96469 - DNA, 20 bp, Artificial
  CRISPR gRNA sequence
cctccgcctttggagagatt

SEQ ID NO: 96470 - DNA, 20 bp, Artificial
  CRISPR gRNA sequence
tgagaccgttcgcttcctgc

SEQ ID NO: 96471 - DNA, 20 bp, Artificial
  CRISPR gRNA sequence
agaccgttcgcttcctgctg

SEQ ID NO: 96472 - DNA, 20 bp, Artificial
  CRISPR gRNA sequence
ccgttcgcttcctgctggag

SEQ ID NO: 96473 - DNA, 20 bp, Artificial
  CRISPR gRNA sequence
cgttcgcttcctgctggagt

SEQ ID NO: 96474 - DNA, 20 bp, Artificial
  CRISPR gRNA sequence
ctgctggagtgggtgcgtcc

SEQ ID NO: 96475 - DNA, 20 bp, Artificial
  CRISPR gRNA sequence
ggagtgggtgcgtcccagcc

SEQ ID NO: 96476 - DNA, 20 bp, Artificial
  CRISPR gRNA sequence
tgggtgcgtcccagcccagc

SEQ ID NO: 96477 - DNA, 20 bp, Artificial
  CRISPR gRNA sequence
gggtgcgtcccagcccagct

SEQ ID NO: 96478 - DNA, 20 bp, Artificial
  CRISPR gRNA sequence
tgcgtcccagcccagctggg

SEQ ID NO: 96479 - DNA, 20 bp, Artificial
  CRISPR gRNA sequence
tcccagcccagctgggcagc

SEQ ID NO: 96480 - DNA, 20 bp, Artificial
  CRISPR gRNA sequence
cccagcccagctgggcagct

SEQ ID NO: 96481 - DNA, 20 bp, Artificial
  CRISPR gRNA sequence
ccagcccagctgggcagctg

SEQ ID NO: 96482 - DNA, 20 bp, Artificial
  CRISPR gRNA sequence
cagcccagctgggcagctgg

SEQ ID NO: 96483 - DNA, 20 bp, Artificial
  CRISPR gRNA sequence
agcccagctgggcagctggg

SEQ ID NO: 96484 - DNA, 20 bp, Artificial
  CRISPR gRNA sequence
ctgggcagctggggggttcc

SEQ ID NO: 96485 - DNA, 20 bp, Artificial
  CRISPR gRNA sequence
tgggcagctggggggttccc

SEQ ID NO: 96486 - DNA, 20 bp, Artificial
  CRISPR gRNA sequence
gggcagctggggggttcccg

SEQ ID NO: 96487 - DNA, 20 bp, Artificial
  CRISPR gRNA sequence
ggcagctggggggttcccgg

SEQ ID NO: 96488 - DNA, 20 bp, Artificial
  CRISPR gRNA sequence
tggggggttcccgggggcct

SEQ ID NO: 96489 - DNA, 20 bp, Artificial
  CRISPR gRNA sequence
ggggggttcccgggggcctt

SEQ ID NO: 96490 - DNA, 20 bp, Artificial
  CRISPR gRNA sequence
gggggttcccgggggcctta

SEQ ID NO: 96491 - DNA, 20 bp, Artificial
  CRISPR gRNA sequence
ggttcccgggggccttaggg

SEQ ID NO: 96492 - DNA, 20 bp, Artificial
  CRISPR gRNA sequence
gttcccgggggccttagggt

SEQ ID NO: 96493 - DNA, 20 bp, Artificial
  CRISPR gRNA sequence
ccgggggccttagggtgggc

SEQ ID NO: 96494 - DNA, 20 bp, Artificial
  CRISPR gRNA sequence
cgggggccttagggtgggct

SEQ ID NO: 96495 - DNA, 20 bp, Artificial
  CRISPR gRNA sequence
gggggccttagggtgggctg

SEQ ID NO: 96496 - DNA, 20 bp, Artificial
  CRISPR gRNA sequence
cttagggtgggctggggttt

SEQ ID NO: 96497 - DNA, 20 bp, Artificial
  CRISPR gRNA sequence
ggggttttggctgtgtctgc

SEQ ID NO: 96498 - DNA, 20 bp, Artificial
  CRISPR gRNA sequence
tctgctggcgccttgtcttt

SEQ ID NO: 96499 - DNA, 20 bp, Artificial
  CRISPR gRNA sequence
ggcgccttgtctttgagatg

SEQ ID NO: 96500 - DNA, 20 bp, Artificial
  CRISPR gRNA sequence
tgtctttgagatgcggctgc

SEQ ID NO: 96501 - DNA, 20 bp, Artificial
  CRISPR gRNA sequence
tttgagatgcggctgctggc

SEQ ID NO: 96502 - DNA, 20 bp, Artificial
  CRISPR gRNA sequence
ttgagatgcggctgctggct

SEQ ID NO: 96503 - DNA, 20 bp, Artificial
  CRISPR gRNA sequence
atgcggctgctggctgggtg

SEQ ID NO: 96504 - DNA, 20 bp, Artificial
  CRISPR gRNA sequence
cggctgctggctgggtgcag

SEQ ID NO: 96505 - DNA, 20 bp, Artificial
  CRISPR gRNA sequence
gtggctcatgcctgtaatcc

SEQ ID NO: 96506 - DNA, 20 bp, Artificial
  CRISPR gRNA sequence
tgcctgtaatcccagcactt

SEQ ID NO: 96507 - DNA, 20 bp, Artificial
  CRISPR gRNA sequence
gcctgtaatcccagcacttt

SEQ ID NO: 96508 - DNA, 20 bp, Artificial
  CRISPR gRNA sequence
ctgtaatcccagcactttgg

SEQ ID NO: 96509 - DNA, 20 bp, Artificial
  CRISPR gRNA sequence
tgtaatcccagcactttggg

SEQ ID NO: 96510 - DNA, 20 bp, Artificial
  CRISPR gRNA sequence
tcccagcactttgggaggcc

SEQ ID NO: 96511 - DNA, 20 bp, Artificial
  CRISPR gRNA sequence
cccagcactttgggaggccg

SEQ ID NO: 96512 - DNA, 20 bp, Artificial
  CRISPR gRNA sequence
agcactttgggaggccgagg

SEQ ID NO: 96513 - DNA, 20 bp, Artificial
  CRISPR gRNA sequence
gcactttgggaggccgaggc

SEQ ID NO: 96514 - DNA, 20 bp, Artificial
  CRISPR gRNA sequence
ctttgggaggccgaggcggg

SEQ ID NO: 96515 - DNA, 20 bp, Artificial
  CRISPR gRNA sequence
ccgaggcgggtggatcactt

SEQ ID NO: 96516 - DNA, 20 bp, Artificial
  CRISPR gRNA sequence
cgaggcgggtggatcacttg

SEQ ID NO: 96517 - DNA, 20 bp, Artificial
  CRISPR gRNA sequence
gcgggtggatcacttgaggt

SEQ ID NO: 96518 - DNA, 20 bp, Artificial
  CRISPR gRNA sequence
cgggtggatcacttgaggtc

SEQ ID NO: 96519 - DNA, 20 bp, Artificial
  CRISPR gRNA sequence
ggtggatcacttgaggtcag

SEQ ID NO: 96520 - DNA, 20 bp, Artificial
  CRISPR gRNA sequence
tcacttgaggtcaggagttc

SEQ ID NO: 96521 - DNA, 20 bp, Artificial
  CRISPR gRNA sequence
tgaggtcaggagttcaagac

SEQ ID NO: 96522 - DNA, 20 bp, Artificial
  CRISPR gRNA sequence
tcaggagttcaagaccagcc

SEQ ID NO: 96523 - DNA, 20 bp, Artificial
  CRISPR gRNA sequence
caagaccagcccggccaaca

SEQ ID NO: 96524 - DNA, 20 bp, Artificial
  CRISPR gRNA sequence
aagaccagcccggccaacat

SEQ ID NO: 96525 - DNA, 20 bp, Artificial
  CRISPR gRNA sequence
tactaaaaaaatacaaaaat

SEQ ID NO: 96526 - DNA, 20 bp, Artificial
  CRISPR gRNA sequence
aaaaaaatacaaaaattagc

SEQ ID NO: 96527 - DNA, 20 bp, Artificial
  CRISPR gRNA sequence
aaaaaatacaaaaattagcc

SEQ ID NO: 96528 - DNA, 20 bp, Artificial
  CRISPR gRNA sequence
caaaaattagccaggcgtcg

SEQ ID NO: 96529 - DNA, 20 bp, Artificial
  CRISPR gRNA sequence
aaattagccaggcgtcgtgg

SEQ ID NO: 96530 - DNA, 20 bp, Artificial
  CRISPR gRNA sequence
aattagccaggcgtcgtggt

SEQ ID NO: 96531 - DNA, 20 bp, Artificial
  CRISPR gRNA sequence
gtggtgggtgcctgtaatcc

SEQ ID NO: 96532 - DNA, 20 bp, Artificial
  CRISPR gRNA sequence
tggtgggtgcctgtaatccc

SEQ ID NO: 96533 - DNA, 20 bp, Artificial
  CRISPR gRNA sequence
gcctgtaatcccaggtactc

SEQ ID NO: 96534 - DNA, 20 bp, Artificial
  CRISPR gRNA sequence
ctgtaatcccaggtactctg

SEQ ID NO: 96535 - DNA, 20 bp, Artificial
  CRISPR gRNA sequence
tgtaatcccaggtactctgg

SEQ ID NO: 96536 - DNA, 20 bp, Artificial
  CRISPR gRNA sequence
tcccaggtactctggaggct

SEQ ID NO: 96537 - DNA, 20 bp, Artificial
  CRISPR gRNA sequence
cccaggtactctggaggctg

SEQ ID NO: 96538 - DNA, 20 bp, Artificial
  CRISPR gRNA sequence
aggtactctggaggctgagg

SEQ ID NO: 96539 - DNA, 20 bp, Artificial
  CRISPR gRNA sequence
ggtactctggaggctgaggt

SEQ ID NO: 96540 - DNA, 20 bp, Artificial
  CRISPR gRNA sequence
tactctggaggctgaggtgg

SEQ ID NO: 96541 - DNA, 20 bp, Artificial
  CRISPR gRNA sequence
gtgggagaactgtgtgaacc

SEQ ID NO: 96542 - DNA, 20 bp, Artificial
  CRISPR gRNA sequence
tgggagaactgtgtgaacct

SEQ ID NO: 96543 - DNA, 20 bp, Artificial
  CRISPR gRNA sequence
ggagaactgtgtgaacctgg

SEQ ID NO: 96544 - DNA, 20 bp, Artificial
  CRISPR gRNA sequence
gagaactgtgtgaacctggg

SEQ ID NO: 96545 - DNA, 20 bp, Artificial
  CRISPR gRNA sequence
aactgtgtgaacctgggagg

SEQ ID NO: 96546 - DNA, 20 bp, Artificial
  CRISPR gRNA sequence
ctgtgtgaacctgggaggcg

SEQ ID NO: 96547 - DNA, 20 bp, Artificial
  CRISPR gRNA sequence
tgtgtgaacctgggaggcgg

SEQ ID NO: 96548 - DNA, 20 bp, Artificial
  CRISPR gRNA sequence
gtgaacctgggaggcggagg

SEQ ID NO: 96549 - DNA, 20 bp, Artificial
  CRISPR gRNA sequence
aacctgggaggcggaggtag

SEQ ID NO: 96550 - DNA, 20 bp, Artificial
  CRISPR gRNA sequence
tgggaggcggaggtagcagt

SEQ ID NO: 96551 - DNA, 20 bp, Artificial
  CRISPR gRNA sequence
ggcggaggtagcagtgagcc

SEQ ID NO: 96552 - DNA, 20 bp, Artificial
  CRISPR gRNA sequence
gagattgcgccactgcactc

SEQ ID NO: 96553 - DNA, 20 bp, Artificial
  CRISPR gRNA sequence
tgcgccactgcactccagcc

SEQ ID NO: 96554 - DNA, 20 bp, Artificial
  CRISPR gRNA sequence
gcgccactgcactccagcct

SEQ ID NO: 96555 - DNA, 20 bp, Artificial
  CRISPR gRNA sequence
ctgcactccagcctgggcaa

SEQ ID NO: 96556 - DNA, 20 bp, Artificial
  CRISPR gRNA sequence
gcactccagcctgggcaaca

SEQ ID NO: 96557 - DNA, 20 bp, Artificial
  CRISPR gRNA sequence
tccagcctgggcaacagagc

SEQ ID NO: 96558 - DNA, 20 bp, Artificial
  CRISPR gRNA sequence
tatctccaaaaaaaaaaaaa

SEQ ID NO: 96559 - DNA, 20 bp, Artificial
  CRISPR gRNA sequence
caaaaaaaaaaaaaaagatg

SEQ ID NO: 96560 - DNA, 20 bp, Artificial
  CRISPR gRNA sequence
aaaaaaagatgcggctgctg

SEQ ID NO: 96561 - DNA, 20 bp, Artificial
  CRISPR gRNA sequence
aaaaaagatgcggctgctgt

SEQ ID NO: 96562 - DNA, 20 bp, Artificial
  CRISPR gRNA sequence
tgcggctgctgtgggtaccc

SEQ ID NO: 96563 - DNA, 20 bp, Artificial
  CRISPR gRNA sequence
gcggctgctgtgggtacccc

SEQ ID NO: 96564 - DNA, 20 bp, Artificial
  CRISPR gRNA sequence
tgtgggtaccccaggattcc

SEQ ID NO: 96565 - DNA, 20 bp, Artificial
  CRISPR gRNA sequence
actgtcccttcttctccctg

SEQ ID NO: 96566 - DNA, 20 bp, Artificial
  CRISPR gRNA sequence
ctgtcccttcttctccctgc

SEQ ID NO: 96567 - DNA, 20 bp, Artificial
  CRISPR gRNA sequence
tgtcccttcttctccctgca

SEQ ID NO: 96568 - DNA, 20 bp, Artificial
  CRISPR gRNA sequence
gggtgccgacccccacatcc

SEQ ID NO: 96569 - DNA, 20 bp, Artificial
  CRISPR gRNA sequence
cgacccccacatcctggcaa

SEQ ID NO: 96570 - DNA, 20 bp, Artificial
  CRISPR gRNA sequence
acccccacatcctggcaaaa

SEQ ID NO: 96571 - DNA, 20 bp, Artificial
  CRISPR gRNA sequence
ccacatcctggcaaaagagc

SEQ ID NO: 96572 - DNA, 20 bp, Artificial
  CRISPR gRNA sequence
acatcctggcaaaagagcga

SEQ ID NO: 96573 - DNA, 20 bp, Artificial
  CRISPR gRNA sequence
atcctggcaaaagagcgaga

SEQ ID NO: 96574 - DNA, 20 bp, Artificial
  CRISPR gRNA sequence
gcgagagagcgccctgtcgc

SEQ ID NO: 96575 - DNA, 20 bp, Artificial
  CRISPR gRNA sequence
gagagcgccctgtcgctggc

SEQ ID NO: 96576 - DNA, 20 bp, Artificial
  CRISPR gRNA sequence
cgccctgtcgctggccagca

SEQ ID NO: 96577 - DNA, 20 bp, Artificial
  CRISPR gRNA sequence
gccctgtcgctggccagcac

SEQ ID NO: 96578 - DNA, 20 bp, Artificial
  CRISPR gRNA sequence
ctgtcgctggccagcacagg

SEQ ID NO: 96579 - DNA, 20 bp, Artificial
  CRISPR gRNA sequence
ggccagcacaggcggctaca

SEQ ID NO: 96580 - DNA, 20 bp, Artificial
  CRISPR gRNA sequence
aggcggctacacagacattg

SEQ ID NO: 96581 - DNA, 20 bp, Artificial
  CRISPR gRNA sequence
ggcggctacacagacattgt

SEQ ID NO: 96582 - DNA, 20 bp, Artificial
  CRISPR gRNA sequence
gcggctacacagacattgtg

SEQ ID NO: 96583 - DNA, 20 bp, Artificial
  CRISPR gRNA sequence
agacattgtggggctgctgc

SEQ ID NO: 96584 - DNA, 20 bp, Artificial
  CRISPR gRNA sequence
acattgtggggctgctgctg

SEQ ID NO: 96585 - DNA, 20 bp, Artificial
  CRISPR gRNA sequence
gctgctgctggagcgtgacg

SEQ ID NO: 96586 - DNA, 20 bp, Artificial
  CRISPR gRNA sequence
tggacatcaacatctatgat

SEQ ID NO: 96587 - DNA, 20 bp, Artificial
  CRISPR gRNA sequence
ggacatcaacatctatgatt

SEQ ID NO: 96588 - DNA, 20 bp, Artificial
  CRISPR gRNA sequence
atcaacatctatgattgggt

SEQ ID NO: 96589 - DNA, 20 bp, Artificial
  CRISPR gRNA sequence
tcaacatctatgattgggtg

SEQ ID NO: 96590 - DNA, 20 bp, Artificial
  CRISPR gRNA sequence
caacatctatgattgggtga

SEQ ID NO: 96591 - DNA, 20 bp, Artificial
  CRISPR gRNA sequence
ggtgagggactgcccatccc

SEQ ID NO: 96592 - DNA, 20 bp, Artificial
  CRISPR gRNA sequence
gtgagggactgcccatcccc

SEQ ID NO: 96593 - DNA, 20 bp, Artificial
  CRISPR gRNA sequence
tgcccatccccaggacctct

SEQ ID NO: 96594 - DNA, 20 bp, Artificial
  CRISPR gRNA sequence
cccaggacctctcagcctcc

SEQ ID NO: 96595 - DNA, 20 bp, Artificial
  CRISPR gRNA sequence
attcctgcctcaaatgttca

SEQ ID NO: 96596 - DNA, 20 bp, Artificial
  CRISPR gRNA sequence
tcctgcctcaaatgttcaca

SEQ ID NO: 96597 - DNA, 20 bp, Artificial
  CRISPR gRNA sequence
aatgttcacagagtacttga

SEQ ID NO: 96598 - DNA, 20 bp, Artificial
  CRISPR gRNA sequence
atgttcacagagtacttgaa

SEQ ID NO: 96599 - DNA, 20 bp, Artificial
  CRISPR gRNA sequence
cacagagtacttgaaaggtg

SEQ ID NO: 96600 - DNA, 20 bp, Artificial
  CRISPR gRNA sequence
acagagtacttgaaaggtgc

SEQ ID NO: 96601 - DNA, 20 bp, Artificial
  CRISPR gRNA sequence
tgaaaggtgcaggcctgctc

SEQ ID NO: 96602 - DNA, 20 bp, Artificial
  CRISPR gRNA sequence
gaaaggtgcaggcctgctct

SEQ ID NO: 96603 - DNA, 20 bp, Artificial
  CRISPR gRNA sequence
gcaggcctgctctaggtgcc

SEQ ID NO: 96604 - DNA, 20 bp, Artificial
  CRISPR gRNA sequence
gctctaggtgccgagaacac

SEQ ID NO: 96605 - DNA, 20 bp, Artificial
  CRISPR gRNA sequence
taggtgccgagaacacgaga

SEQ ID NO: 96606 - DNA, 20 bp, Artificial
  CRISPR gRNA sequence
acacgagacagccccattcc

SEQ ID NO: 96607 - DNA, 20 bp, Artificial
  CRISPR gRNA sequence
cagccccattcccagcctca

SEQ ID NO: 96608 - DNA, 20 bp, Artificial
  CRISPR gRNA sequence
gccccattcccagcctcaca

SEQ ID NO: 96609 - DNA, 20 bp, Artificial
  CRISPR gRNA sequence
ccattcccagcctcacagag

SEQ ID NO: 96610 - DNA, 20 bp, Artificial
  CRISPR gRNA sequence
attcccagcctcacagagca

SEQ ID NO: 96611 - DNA, 20 bp, Artificial
  CRISPR gRNA sequence
acagagcagagctccccatg

SEQ ID NO: 96612 - DNA, 20 bp, Artificial
  CRISPR gRNA sequence
cagagcagagctccccatgc

SEQ ID NO: 96613 - DNA, 20 bp, Artificial
  CRISPR gRNA sequence
agagcagagctccccatgca

SEQ ID NO: 96614 - DNA, 20 bp, Artificial
  CRISPR gRNA sequence
gcagagctccccatgcaggg

SEQ ID NO: 96615 - DNA, 20 bp, Artificial
  CRISPR gRNA sequence
cagagctccccatgcaggga

SEQ ID NO: 96616 - DNA, 20 bp, Artificial
  CRISPR gRNA sequence
agctccccatgcagggaagg

SEQ ID NO: 96617 - DNA, 20 bp, Artificial
  CRISPR gRNA sequence
ccatgcagggaaggcagaca

SEQ ID NO: 96618 - DNA, 20 bp, Artificial
  CRISPR gRNA sequence
agggaaggcagacatggaaa

SEQ ID NO: 96619 - DNA, 20 bp, Artificial
  CRISPR gRNA sequence
gggaaggcagacatggaaac

SEQ ID NO: 96620 - DNA, 20 bp, Artificial
  CRISPR gRNA sequence
aaggcagacatggaaacagg

SEQ ID NO: 96621 - DNA, 20 bp, Artificial
  CRISPR gRNA sequence
agacatggaaacaggcagct

SEQ ID NO: 96622 - DNA, 20 bp, Artificial
  CRISPR gRNA sequence
ggaaacaggcagctgagatg

SEQ ID NO: 96623 - DNA, 20 bp, Artificial
  CRISPR gRNA sequence
tgcagtgaactgcgctgcga

SEQ ID NO: 96624 - DNA, 20 bp, Artificial
  CRISPR gRNA sequence
agtgaactgcgctgcgatgg

SEQ ID NO: 96625 - DNA, 20 bp, Artificial
  CRISPR gRNA sequence
gcgctgcgatggcagatgca

SEQ ID NO: 96626 - DNA, 20 bp, Artificial
  CRISPR gRNA sequence
cgctgcgatggcagatgcac

SEQ ID NO: 96627 - DNA, 20 bp, Artificial
  CRISPR gRNA sequence
tgcgatggcagatgcacagg

SEQ ID NO: 96628 - DNA, 20 bp, Artificial
  CRISPR gRNA sequence
gcagatgcacaggtggctac

SEQ ID NO: 96629 - DNA, 20 bp, Artificial
  CRISPR gRNA sequence
agatgcacaggtggctacaa

SEQ ID NO: 96630 - DNA, 20 bp, Artificial
  CRISPR gRNA sequence
gtggctacaagagccccatg

SEQ ID NO: 96631 - DNA, 20 bp, Artificial
  CRISPR gRNA sequence
tggctacaagagccccatgt

SEQ ID NO: 96632 - DNA, 20 bp, Artificial
  CRISPR gRNA sequence
tacaagagccccatgtgggc

SEQ ID NO: 96633 - DNA, 20 bp, Artificial
  CRISPR gRNA sequence
acaagagccccatgtgggca

SEQ ID NO: 96634 - DNA, 20 bp, Artificial
  CRISPR gRNA sequence
caagagccccatgtgggcaa

SEQ ID NO: 96635 - DNA, 20 bp, Artificial
  CRISPR gRNA sequence
cccatgtgggcaagggaaat

SEQ ID NO: 96636 - DNA, 20 bp, Artificial
  CRISPR gRNA sequence
catgtgggcaagggaaatca

SEQ ID NO: 96637 - DNA, 20 bp, Artificial
  CRISPR gRNA sequence
tgtgggcaagggaaatcaga

SEQ ID NO: 96638 - DNA, 20 bp, Artificial
  CRISPR gRNA sequence
gtgggcaagggaaatcagag

SEQ ID NO: 96639 - DNA, 20 bp, Artificial
  CRISPR gRNA sequence
ggaaatcagagaggtcttcc

SEQ ID NO: 96640 - DNA, 20 bp, Artificial
  CRISPR gRNA sequence
aaatcagagaggtcttcctg

SEQ ID NO: 96641 - DNA, 20 bp, Artificial
  CRISPR gRNA sequence
aatcagagaggtcttcctgg

SEQ ID NO: 96642 - DNA, 20 bp, Artificial
  CRISPR gRNA sequence
cagagaggtcttcctggagg

SEQ ID NO: 96643 - DNA, 20 bp, Artificial
  CRISPR gRNA sequence
agagaggtcttcctggagga

SEQ ID NO: 96644 - DNA, 20 bp, Artificial
  CRISPR gRNA sequence
cttcctggaggaaggtgtct

SEQ ID NO: 96645 - DNA, 20 bp, Artificial
  CRISPR gRNA sequence
ggaggaaggtgtctaagctt

SEQ ID NO: 96646 - DNA, 20 bp, Artificial
  CRISPR gRNA sequence
ggtgtctaagcttgagaccc

SEQ ID NO: 96647 - DNA, 20 bp, Artificial
  CRISPR gRNA sequence
tctaagcttgagaccccaga

SEQ ID NO: 96648 - DNA, 20 bp, Artificial
  CRISPR gRNA sequence
agcttgagaccccagaaagt

SEQ ID NO: 96649 - DNA, 20 bp, Artificial
  CRISPR gRNA sequence
tgagaccccagaaagtgaga

SEQ ID NO: 96650 - DNA, 20 bp, Artificial
  CRISPR gRNA sequence
gagaccccagaaagtgagat

SEQ ID NO: 96651 - DNA, 20 bp, Artificial
  CRISPR gRNA sequence
cccagaaagtgagatgggcc

SEQ ID NO: 96652 - DNA, 20 bp, Artificial
  CRISPR gRNA sequence
agtgagatgggcccagtgat

SEQ ID NO: 96653 - DNA, 20 bp, Artificial
  CRISPR gRNA sequence
gagatgggcccagtgatgag

SEQ ID NO: 96654 - DNA, 20 bp, Artificial
  CRISPR gRNA sequence
agatgggcccagtgatgagc

SEQ ID NO: 96655 - DNA, 20 bp, Artificial
  CRISPR gRNA sequence
atgggcccagtgatgagcag

SEQ ID NO: 96656 - DNA, 20 bp, Artificial
  CRISPR gRNA sequence
tgggcccagtgatgagcagg

SEQ ID NO: 96657 - DNA, 20 bp, Artificial
  CRISPR gRNA sequence
caggaggaaccacgttcaac

SEQ ID NO: 96658 - DNA, 20 bp, Artificial
  CRISPR gRNA sequence
ggaggaaccacgttcaactg

SEQ ID NO: 96659 - DNA, 20 bp, Artificial
  CRISPR gRNA sequence
gaggaaccacgttcaactgg

SEQ ID NO: 96660 - DNA, 20 bp, Artificial
  CRISPR gRNA sequence
aaccacgttcaactggaggc

SEQ ID NO: 96661 - DNA, 20 bp, Artificial
  CRISPR gRNA sequence
ccacgttcaactggaggcca

SEQ ID NO: 96662 - DNA, 20 bp, Artificial
  CRISPR gRNA sequence
acgttcaactggaggccaga

SEQ ID NO: 96663 - DNA, 20 bp, Artificial
  CRISPR gRNA sequence
aactggaggccagagagtac

SEQ ID NO: 96664 - DNA, 20 bp, Artificial
  CRISPR gRNA sequence
actggaggccagagagtaca

SEQ ID NO: 96665 - DNA, 20 bp, Artificial
  CRISPR gRNA sequence
cagagagtacaaggcatttt

SEQ ID NO: 96666 - DNA, 20 bp, Artificial
  CRISPR gRNA sequence
gtacaaggcattttgagaat

SEQ ID NO: 96667 - DNA, 20 bp, Artificial
  CRISPR gRNA sequence
tacaaggcattttgagaatg

SEQ ID NO: 96668 - DNA, 20 bp, Artificial
  CRISPR gRNA sequence
aaggcattttgagaatgagg

SEQ ID NO: 96669 - DNA, 20 bp, Artificial
  CRISPR gRNA sequence
ggcattttgagaatgaggaa

SEQ ID NO: 96670 - DNA, 20 bp, Artificial
  CRISPR gRNA sequence
gcattttgagaatgaggaag

SEQ ID NO: 96671 - DNA, 20 bp, Artificial
  CRISPR gRNA sequence
atgaggaagaggtaaacctt

SEQ ID NO: 96672 - DNA, 20 bp, Artificial
  CRISPR gRNA sequence
tctcctgcccctacccacga

SEQ ID NO: 96673 - DNA, 20 bp, Artificial
  CRISPR gRNA sequence
tgcccctacccacgacagaa

SEQ ID NO: 96674 - DNA, 20 bp, Artificial
  CRISPR gRNA sequence
cccctacccacgacagaatg

SEQ ID NO: 96675 - DNA, 20 bp, Artificial
  CRISPR gRNA sequence
ccctacccacgacagaatgg

SEQ ID NO: 96676 - DNA, 20 bp, Artificial
  CRISPR gRNA sequence
cctacccacgacagaatgga

SEQ ID NO: 96677 - DNA, 20 bp, Artificial
  CRISPR gRNA sequence
ccactgctgtacgctgtgcg

SEQ ID NO: 96678 - DNA, 20 bp, Artificial
  CRISPR gRNA sequence
cactgctgtacgctgtgcgc

SEQ ID NO: 96679 - DNA, 20 bp, Artificial
  CRISPR gRNA sequence
ggaaccacgtgaaatgcgtt

SEQ ID NO: 96680 - DNA, 20 bp, Artificial
  CRISPR gRNA sequence
gaaccacgtgaaatgcgttg

SEQ ID NO: 96681 - DNA, 20 bp, Artificial
  CRISPR gRNA sequence
gaaatgcgttgaggccttgc

SEQ ID NO: 96682 - DNA, 20 bp, Artificial
  CRISPR gRNA sequence
aaatgcgttgaggccttgct

SEQ ID NO: 96683 - DNA, 20 bp, Artificial
  CRISPR gRNA sequence
gcgttgaggccttgctgggt

SEQ ID NO: 96684 - DNA, 20 bp, Artificial
  CRISPR gRNA sequence
ttgaggccttgctgggtgag

SEQ ID NO: 96685 - DNA, 20 bp, Artificial
  CRISPR gRNA sequence
tgaggccttgctgggtgagt

SEQ ID NO: 96686 - DNA, 20 bp, Artificial
  CRISPR gRNA sequence
aggccttgctgggtgagtgg

SEQ ID NO: 96687 - DNA, 20 bp, Artificial
  CRISPR gRNA sequence
cttgctgggtgagtgggagt

SEQ ID NO: 96688 - DNA, 20 bp, Artificial
  CRISPR gRNA sequence
ttgctgggtgagtgggagtc

SEQ ID NO: 96689 - DNA, 20 bp, Artificial
  CRISPR gRNA sequence
gctgggtgagtgggagtcgg

SEQ ID NO: 96690 - DNA, 20 bp, Artificial
  CRISPR gRNA sequence
gggtgagtgggagtcgggag

SEQ ID NO: 96691 - DNA, 20 bp, Artificial
  CRISPR gRNA sequence
gtgggagtcgggagtggccc

SEQ ID NO: 96692 - DNA, 20 bp, Artificial
  CRISPR gRNA sequence
tgggagtcgggagtggccct

SEQ ID NO: 96693 - DNA, 20 bp, Artificial
  CRISPR gRNA sequence
gggagtcgggagtggccctg

SEQ ID NO: 96694 - DNA, 20 bp, Artificial
  CRISPR gRNA sequence
ggagtcgggagtggccctgg

SEQ ID NO: 96695 - DNA, 20 bp, Artificial
  CRISPR gRNA sequence
gggagtggccctgggggccc

SEQ ID NO: 96696 - DNA, 20 bp, Artificial
  CRISPR gRNA sequence
ccctgggggccccagcactc

SEQ ID NO: 96697 - DNA, 20 bp, Artificial
  CRISPR gRNA sequence
tgggggccccagcactccag

SEQ ID NO: 96698 - DNA, 20 bp, Artificial
  CRISPR gRNA sequence
gggggccccagcactccagc

SEQ ID NO: 96699 - DNA, 20 bp, Artificial
  CRISPR gRNA sequence
cagcactccagcgggccctg

SEQ ID NO: 96700 - DNA, 20 bp, Artificial
  CRISPR gRNA sequence
agcactccagcgggccctgc

SEQ ID NO: 96701 - DNA, 20 bp, Artificial
  CRISPR gRNA sequence
gcgggccctgcgggaatcct

SEQ ID NO: 96702 - DNA, 20 bp, Artificial
  CRISPR gRNA sequence
cgggccctgcgggaatcctg

SEQ ID NO: 96703 - DNA, 20 bp, Artificial
  CRISPR gRNA sequence
gggccctgcgggaatcctga

SEQ ID NO: 96704 - DNA, 20 bp, Artificial
  CRISPR gRNA sequence
ccctgcgggaatcctgaggg

SEQ ID NO: 96705 - DNA, 20 bp, Artificial
  CRISPR gRNA sequence
cctgcgggaatcctgagggc

SEQ ID NO: 96706 - DNA, 20 bp, Artificial
  CRISPR gRNA sequence
ctgcgggaatcctgagggca

SEQ ID NO: 96707 - DNA, 20 bp, Artificial
  CRISPR gRNA sequence
gcgggaatcctgagggcagg

SEQ ID NO: 96708 - DNA, 20 bp, Artificial
  CRISPR gRNA sequence
ctgagggcagggagacgccc

SEQ ID NO: 96709 - DNA, 20 bp, Artificial
  CRISPR gRNA sequence
agacgcccaagtgttgcttg

SEQ ID NO: 96710 - DNA, 20 bp, Artificial
  CRISPR gRNA sequence
acgcccaagtgttgcttgaa

SEQ ID NO: 96711 - DNA, 20 bp, Artificial
  CRISPR gRNA sequence
agtgttgcttgaagagttct

SEQ ID NO: 96712 - DNA, 20 bp, Artificial
  CRISPR gRNA sequence
tgttgcttgaagagttcttg

SEQ ID NO: 96713 - DNA, 20 bp, Artificial
  CRISPR gRNA sequence
tgcttgaagagttcttggag

SEQ ID NO: 96714 - DNA, 20 bp, Artificial
  CRISPR gRNA sequence
gcttgaagagttcttggagc

SEQ ID NO: 96715 - DNA, 20 bp, Artificial
  CRISPR gRNA sequence
tgaagagttcttggagcagg

SEQ ID NO: 96716 - DNA, 20 bp, Artificial
  CRISPR gRNA sequence
tagtccctgcctgctcttct

SEQ ID NO: 96717 - DNA, 20 bp, Artificial
  CRISPR gRNA sequence
gtccctgcctgctcttctcg

SEQ ID NO: 96718 - DNA, 20 bp, Artificial
  CRISPR gRNA sequence
tccctgcctgctcttctcgg

SEQ ID NO: 96719 - DNA, 20 bp, Artificial
  CRISPR gRNA sequence
tgcctgctcttctcggagga

SEQ ID NO: 96720 - DNA, 20 bp, Artificial
  CRISPR gRNA sequence
gctcttctcggaggatggat

SEQ ID NO: 96721 - DNA, 20 bp, Artificial
  CRISPR gRNA sequence
tcttctcggaggatggatca

SEQ ID NO: 96722 - DNA, 20 bp, Artificial
  CRISPR gRNA sequence
cttctcggaggatggatcag

SEQ ID NO: 96723 - DNA, 20 bp, Artificial
  CRISPR gRNA sequence
ttctcggaggatggatcaga

SEQ ID NO: 96724 - DNA, 20 bp, Artificial
  CRISPR gRNA sequence
tctcggaggatggatcagag

SEQ ID NO: 96725 - DNA, 20 bp, Artificial
  CRISPR gRNA sequence
tcggaggatggatcagaggg

SEQ ID NO: 96726 - DNA, 20 bp, Artificial
  CRISPR gRNA sequence
cggaggatggatcagagggg

SEQ ID NO: 96727 - DNA, 20 bp, Artificial
  CRISPR gRNA sequence
gaggatggatcagaggggag

SEQ ID NO: 96728 - DNA, 20 bp, Artificial
  CRISPR gRNA sequence
aggatggatcagaggggagg

SEQ ID NO: 96729 - DNA, 20 bp, Artificial
  CRISPR gRNA sequence
atggatcagaggggaggagg

SEQ ID NO: 96730 - DNA, 20 bp, Artificial
  CRISPR gRNA sequence
gatcagaggggaggaggtgg

SEQ ID NO: 96731 - DNA, 20 bp, Artificial
  CRISPR gRNA sequence
atcagaggggaggaggtggt

SEQ ID NO: 96732 - DNA, 20 bp, Artificial
  CRISPR gRNA sequence
gaggaggtggtaggaccaca

SEQ ID NO: 96733 - DNA, 20 bp, Artificial
  CRISPR gRNA sequence
aggaggtggtaggaccacac

SEQ ID NO: 96734 - DNA, 20 bp, Artificial
  CRISPR gRNA sequence
gaggtggtaggaccacacgg

SEQ ID NO: 96735 - DNA, 20 bp, Artificial
  CRISPR gRNA sequence
tggtaggaccacacgggagt

SEQ ID NO: 96736 - DNA, 20 bp, Artificial
  CRISPR gRNA sequence
ggtaggaccacacgggagtc

SEQ ID NO: 96737 - DNA, 20 bp, Artificial
  CRISPR gRNA sequence
gtaggaccacacgggagtcg

SEQ ID NO: 96738 - DNA, 20 bp, Artificial
  CRISPR gRNA sequence
accacacgggagtcggggtc

SEQ ID NO: 96739 - DNA, 20 bp, Artificial
  CRISPR gRNA sequence
ccacacgggagtcggggtct

SEQ ID NO: 96740 - DNA, 20 bp, Artificial
  CRISPR gRNA sequence
cgggagtcggggtctgggtt

SEQ ID NO: 96741 - DNA, 20 bp, Artificial
  CRISPR gRNA sequence
gggagtcggggtctgggttt

SEQ ID NO: 96742 - DNA, 20 bp, Artificial
  CRISPR gRNA sequence
cggggtctgggtttaggatc

SEQ ID NO: 96743 - DNA, 20 bp, Artificial
  CRISPR gRNA sequence
tctgggtttaggatctggcc

SEQ ID NO: 96744 - DNA, 20 bp, Artificial
  CRISPR gRNA sequence
tgggtttaggatctggccaa

SEQ ID NO: 96745 - DNA, 20 bp, Artificial
  CRISPR gRNA sequence
gggtttaggatctggccaag

SEQ ID NO: 96746 - DNA, 20 bp, Artificial
  CRISPR gRNA sequence
taggatctggccaagaggct

SEQ ID NO: 96747 - DNA, 20 bp, Artificial
  CRISPR gRNA sequence
ctaagcacctccatcctcca

SEQ ID NO: 96748 - DNA, 20 bp, Artificial
  CRISPR gRNA sequence
cacctccatcctccatggtt

SEQ ID NO: 96749 - DNA, 20 bp, Artificial
  CRISPR gRNA sequence
cctccatcctccatggttca

SEQ ID NO: 96750 - DNA, 20 bp, Artificial
  CRISPR gRNA sequence
tccatggttcagagaccctt

SEQ ID NO: 96751 - DNA, 20 bp, Artificial
  CRISPR gRNA sequence
gacccttcagccacgttctt

SEQ ID NO: 96752 - DNA, 20 bp, Artificial
  CRISPR gRNA sequence
ccttcagccacgttcttcag

SEQ ID NO: 96753 - DNA, 20 bp, Artificial
  CRISPR gRNA sequence
ttcagccacgttcttcagtg

SEQ ID NO: 96754 - DNA, 20 bp, Artificial
  CRISPR gRNA sequence
cacgttcttcagtggagacc

SEQ ID NO: 96755 - DNA, 20 bp, Artificial
  CRISPR gRNA sequence
ttcttcagtggagaccaaga

SEQ ID NO: 96756 - DNA, 20 bp, Artificial
  CRISPR gRNA sequence
ttcagtggagaccaagatag

SEQ ID NO: 96757 - DNA, 20 bp, Artificial
  CRISPR gRNA sequence
cagtggagaccaagatagca

SEQ ID NO: 96758 - DNA, 20 bp, Artificial
  CRISPR gRNA sequence
agtggagaccaagatagcag

SEQ ID NO: 96759 - DNA, 20 bp, Artificial
  CRISPR gRNA sequence
gagaccaagatagcagaggt

SEQ ID NO: 96760 - DNA, 20 bp, Artificial
  CRISPR gRNA sequence
cagaggttggacccttgtca

SEQ ID NO: 96761 - DNA, 20 bp, Artificial
  CRISPR gRNA sequence
agaggttggacccttgtcaa

SEQ ID NO: 96762 - DNA, 20 bp, Artificial
  CRISPR gRNA sequence
gacccttgtcaaaggccaca

SEQ ID NO: 96763 - DNA, 20 bp, Artificial
  CRISPR gRNA sequence
acccttgtcaaaggccacat

SEQ ID NO: 96764 - DNA, 20 bp, Artificial
  CRISPR gRNA sequence
gtcaaaggccacatgggcaa

SEQ ID NO: 96765 - DNA, 20 bp, Artificial
  CRISPR gRNA sequence
tcaaaggccacatgggcaac

SEQ ID NO: 96766 - DNA, 20 bp, Artificial
  CRISPR gRNA sequence
aaggccacatgggcaacggg

SEQ ID NO: 96767 - DNA, 20 bp, Artificial
  CRISPR gRNA sequence
atgggcaacgggcagaccca

SEQ ID NO: 96768 - DNA, 20 bp, Artificial
  CRISPR gRNA sequence
gcagacccacggctgcattg

SEQ ID NO: 96769 - DNA, 20 bp, Artificial
  CRISPR gRNA sequence
cagacccacggctgcattgt

SEQ ID NO: 96770 - DNA, 20 bp, Artificial
  CRISPR gRNA sequence
agacccacggctgcattgtg

SEQ ID NO: 96771 - DNA, 20 bp, Artificial
  CRISPR gRNA sequence
acggctgcattgtggggaat

SEQ ID NO: 96772 - DNA, 20 bp, Artificial
  CRISPR gRNA sequence
cggctgcattgtggggaatg

SEQ ID NO: 96773 - DNA, 20 bp, Artificial
  CRISPR gRNA sequence
ggctgcattgtggggaatga

SEQ ID NO: 96774 - DNA, 20 bp, Artificial
  CRISPR gRNA sequence
gctgcattgtggggaatgag

SEQ ID NO: 96775 - DNA, 20 bp, Artificial
  CRISPR gRNA sequence
gtggggaatgaggggtgcca

SEQ ID NO: 96776 - DNA, 20 bp, Artificial
  CRISPR gRNA sequence
tggggaatgaggggtgccat

SEQ ID NO: 96777 - DNA, 20 bp, Artificial
  CRISPR gRNA sequence
aggggtgccatgggatctcc

SEQ ID NO: 96778 - DNA, 20 bp, Artificial
  CRISPR gRNA sequence
ggggtgccatgggatctccc

SEQ ID NO: 96779 - DNA, 20 bp, Artificial
  CRISPR gRNA sequence
catgggatctcccaggtccc

SEQ ID NO: 96780 - DNA, 20 bp, Artificial
  CRISPR gRNA sequence
caggtccccagaccccattc

SEQ ID NO: 96781 - DNA, 20 bp, Artificial
  CRISPR gRNA sequence
cagaccccattctggactcc

SEQ ID NO: 96782 - DNA, 20 bp, Artificial
  CRISPR gRNA sequence
agaccccattctggactccc

SEQ ID NO: 96783 - DNA, 20 bp, Artificial
  CRISPR gRNA sequence
gactcccaggccccaccctc

SEQ ID NO: 96784 - DNA, 20 bp, Artificial
  CRISPR gRNA sequence
gcgccctcccctctcctttg

SEQ ID NO: 96785 - DNA, 20 bp, Artificial
  CRISPR gRNA sequence
tcccctctcctttgcagccc

SEQ ID NO: 96786 - DNA, 20 bp, Artificial
  CRISPR gRNA sequence
cccctctcctttgcagcccg

SEQ ID NO: 96787 - DNA, 20 bp, Artificial
  CRISPR gRNA sequence
aggcgctgacctcaccaccg

SEQ ID NO: 96788 - DNA, 20 bp, Artificial
  CRISPR gRNA sequence
ctcaccaccgaagccgactc

SEQ ID NO: 96789 - DNA, 20 bp, Artificial
  CRISPR gRNA sequence
cgactctggctacaccccga

SEQ ID NO: 96790 - DNA, 20 bp, Artificial
  CRISPR gRNA sequence
caccccgatggaccttgccg

SEQ ID NO: 96791 - DNA, 20 bp, Artificial
  CRISPR gRNA sequence
gatggaccttgccgtggccc

SEQ ID NO: 96792 - DNA, 20 bp, Artificial
  CRISPR gRNA sequence
atggaccttgccgtggccct

SEQ ID NO: 96793 - DNA, 20 bp, Artificial
  CRISPR gRNA sequence
ttgccgtggccctgggatac

SEQ ID NO: 96794 - DNA, 20 bp, Artificial
  CRISPR gRNA sequence
cgtggccctgggataccgga

SEQ ID NO: 96795 - DNA, 20 bp, Artificial
  CRISPR gRNA sequence
gtggccctgggataccggaa

SEQ ID NO: 96796 - DNA, 20 bp, Artificial
  CRISPR gRNA sequence
ccctgggataccggaaaggt

SEQ ID NO: 96797 - DNA, 20 bp, Artificial
  CRISPR gRNA sequence
gataccggaaaggtcagcct

SEQ ID NO: 96798 - DNA, 20 bp, Artificial
  CRISPR gRNA sequence
aaaggtcagcctgagacaca

SEQ ID NO: 96799 - DNA, 20 bp, Artificial
  CRISPR gRNA sequence
aggtcagcctgagacacaca

SEQ ID NO: 96800 - DNA, 20 bp, Artificial
  CRISPR gRNA sequence
tcagcctgagacacacagag

SEQ ID NO: 96801 - DNA, 20 bp, Artificial
  CRISPR gRNA sequence
cagcctgagacacacagagc

SEQ ID NO: 96802 - DNA, 20 bp, Artificial
  CRISPR gRNA sequence
agcctgagacacacagagca

SEQ ID NO: 96803 - DNA, 20 bp, Artificial
  CRISPR gRNA sequence
gcctgagacacacagagcag

SEQ ID NO: 96804 - DNA, 20 bp, Artificial
  CRISPR gRNA sequence
tgagacacacagagcagggg

SEQ ID NO: 96805 - DNA, 20 bp, Artificial
  CRISPR gRNA sequence
gagacacacagagcaggggt

SEQ ID NO: 96806 - DNA, 20 bp, Artificial
  CRISPR gRNA sequence
agacacacagagcaggggtg

SEQ ID NO: 96807 - DNA, 20 bp, Artificial
  CRISPR gRNA sequence
caggggtggggtcccttcca

SEQ ID NO: 96808 - DNA, 20 bp, Artificial
  CRISPR gRNA sequence
aggggtggggtcccttccat

SEQ ID NO: 96809 - DNA, 20 bp, Artificial
  CRISPR gRNA sequence
ggtggggtcccttccatagg

SEQ ID NO: 96810 - DNA, 20 bp, Artificial
  CRISPR gRNA sequence
gtggggtcccttccataggc

SEQ ID NO: 96811 - DNA, 20 bp, Artificial
  CRISPR gRNA sequence
tggggtcccttccataggca

SEQ ID NO: 96812 - DNA, 20 bp, Artificial
  CRISPR gRNA sequence
ccataggcagggtgaccata

SEQ ID NO: 96813 - DNA, 20 bp, Artificial
  CRISPR gRNA sequence
cataggcagggtgaccataa

SEQ ID NO: 96814 - DNA, 20 bp, Artificial
  CRISPR gRNA sequence
ataggcagggtgaccataaa

SEQ ID NO: 96815 - DNA, 20 bp, Artificial
  CRISPR gRNA sequence
taggcagggtgaccataaag

SEQ ID NO: 96816 - DNA, 20 bp, Artificial
  CRISPR gRNA sequence
ggtgaccataaaggggtaca

SEQ ID NO: 96817 - DNA, 20 bp, Artificial
  CRISPR gRNA sequence
gtgaccataaaggggtacat

SEQ ID NO: 96818 - DNA, 20 bp, Artificial
  CRISPR gRNA sequence
gggtacatgggacacccctt

SEQ ID NO: 96819 - DNA, 20 bp, Artificial
  CRISPR gRNA sequence
tacatgggacaccccttcag

SEQ ID NO: 96820 - DNA, 20 bp, Artificial
  CRISPR gRNA sequence
ccccttcagtggtcatacgc

SEQ ID NO: 96821 - DNA, 20 bp, Artificial
  CRISPR gRNA sequence
cttcagtggtcatacgccgg

SEQ ID NO: 96822 - DNA, 20 bp, Artificial
  CRISPR gRNA sequence
agtggtcatacgccggcagc

SEQ ID NO: 96823 - DNA, 20 bp, Artificial
  CRISPR gRNA sequence
tggtcatacgccggcagcga

SEQ ID NO: 96824 - DNA, 20 bp, Artificial
  CRISPR gRNA sequence
cggcagcgagagtgtgttga

SEQ ID NO: 96825 - DNA, 20 bp, Artificial
  CRISPR gRNA sequence
ggcagcgagagtgtgttgac

SEQ ID NO: 96826 - DNA, 20 bp, Artificial
  CRISPR gRNA sequence
agagtgtgttgacaggtgtt

SEQ ID NO: 96827 - DNA, 20 bp, Artificial
  CRISPR gRNA sequence
gcactgctgtgtatcccgcc

SEQ ID NO: 96828 - DNA, 20 bp, Artificial
  CRISPR gRNA sequence
cactgctgtgtatcccgcct

SEQ ID NO: 96829 - DNA, 20 bp, Artificial
  CRISPR gRNA sequence
tatcccgcctgggaacatcc

SEQ ID NO: 96830 - DNA, 20 bp, Artificial
  CRISPR gRNA sequence
gcctgggaacatcccagtcc

SEQ ID NO: 96831 - DNA, 20 bp, Artificial
  CRISPR gRNA sequence
aacatcccagtcctggctcc

SEQ ID NO: 96832 - DNA, 20 bp, Artificial
  CRISPR gRNA sequence
acatcccagtcctggctcct

SEQ ID NO: 96833 - DNA, 20 bp, Artificial
  CRISPR gRNA sequence
catcccagtcctggctcctg

SEQ ID NO: 96834 - DNA, 20 bp, Artificial
  CRISPR gRNA sequence
tcctggggctccacatgtgc

SEQ ID NO: 96835 - DNA, 20 bp, Artificial
  CRISPR gRNA sequence
cctggggctccacatgtgct

SEQ ID NO: 96836 - DNA, 20 bp, Artificial
  CRISPR gRNA sequence
ctggggctccacatgtgctg

SEQ ID NO: 96837 - DNA, 20 bp, Artificial
  CRISPR gRNA sequence
gggctccacatgtgctgggg

SEQ ID NO: 96838 - DNA, 20 bp, Artificial
  CRISPR gRNA sequence
ggctccacatgtgctggggt

SEQ ID NO: 96839 - DNA, 20 bp, Artificial
  CRISPR gRNA sequence
gctccacatgtgctggggta

SEQ ID NO: 96840 - DNA, 20 bp, Artificial
  CRISPR gRNA sequence
tccacatgtgctggggtagg

SEQ ID NO: 96841 - DNA, 20 bp, Artificial
  CRISPR gRNA sequence
ccacatgtgctggggtaggg

SEQ ID NO: 96842 - DNA, 20 bp, Artificial
  CRISPR gRNA sequence
tgctggggtagggaggacaa

SEQ ID NO: 96843 - DNA, 20 bp, Artificial
  CRISPR gRNA sequence
gctggggtagggaggacaat

SEQ ID NO: 96844 - DNA, 20 bp, Artificial
  CRISPR gRNA sequence
gtagggaggacaatgggtgt

SEQ ID NO: 96845 - DNA, 20 bp, Artificial
  CRISPR gRNA sequence
gggaggacaatgggtgtcag

SEQ ID NO: 96846 - DNA, 20 bp, Artificial
  CRISPR gRNA sequence
acaatgggtgtcagtggctg

SEQ ID NO: 96847 - DNA, 20 bp, Artificial
  CRISPR gRNA sequence
gtcagtggctgtggccatga

SEQ ID NO: 96848 - DNA, 20 bp, Artificial
  CRISPR gRNA sequence
tcagtggctgtggccatgat

SEQ ID NO: 96849 - DNA, 20 bp, Artificial
  CRISPR gRNA sequence
cagtggctgtggccatgatg

SEQ ID NO: 96850 - DNA, 20 bp, Artificial
  CRISPR gRNA sequence
agtggctgtggccatgatgg

SEQ ID NO: 96851 - DNA, 20 bp, Artificial
  CRISPR gRNA sequence
tggccatgatgggggacaca

SEQ ID NO: 96852 - DNA, 20 bp, Artificial
  CRISPR gRNA sequence
ggccatgatgggggacacat

SEQ ID NO: 96853 - DNA, 20 bp, Artificial
  CRISPR gRNA sequence
gatgggggacacataggcat

SEQ ID NO: 96854 - DNA, 20 bp, Artificial
  CRISPR gRNA sequence
tgggggacacataggcatga

SEQ ID NO: 96855 - DNA, 20 bp, Artificial
  CRISPR gRNA sequence
gggggacacataggcatgag

SEQ ID NO: 96856 - DNA, 20 bp, Artificial
  CRISPR gRNA sequence
acataggcatgagaggccga

SEQ ID NO: 96857 - DNA, 20 bp, Artificial
  CRISPR gRNA sequence
ataggcatgagaggccgaaa

SEQ ID NO: 96858 - DNA, 20 bp, Artificial
  CRISPR gRNA sequence
taggcatgagaggccgaaag

SEQ ID NO: 96859 - DNA, 20 bp, Artificial
  CRISPR gRNA sequence
aggcatgagaggccgaaaga

SEQ ID NO: 96860 - DNA, 20 bp, Artificial
  CRISPR gRNA sequence
ggcatgagaggccgaaagag

SEQ ID NO: 96861 - DNA, 20 bp, Artificial
  CRISPR gRNA sequence
gaaagaggggcctctcatca

SEQ ID NO: 96862 - DNA, 20 bp, Artificial
  CRISPR gRNA sequence
aagaggggcctctcatcaaa

SEQ ID NO: 96863 - DNA, 20 bp, Artificial
  CRISPR gRNA sequence
cctctcatcaaagagcccca

SEQ ID NO: 96864 - DNA, 20 bp, Artificial
  CRISPR gRNA sequence
ctcatcaaagagccccaaag

SEQ ID NO: 96865 - DNA, 20 bp, Artificial
  CRISPR gRNA sequence
aagagccccaaagtggccaa

SEQ ID NO: 96866 - DNA, 20 bp, Artificial
  CRISPR gRNA sequence
agccccaaagtggccaacag

SEQ ID NO: 96867 - DNA, 20 bp, Artificial
  CRISPR gRNA sequence
ccaaagtggccaacagaagt

SEQ ID NO: 96868 - DNA, 20 bp, Artificial
  CRISPR gRNA sequence
aaagtggccaacagaagtca

SEQ ID NO: 96869 - DNA, 20 bp, Artificial
  CRISPR gRNA sequence
agtggccaacagaagtcaga

SEQ ID NO: 96870 - DNA, 20 bp, Artificial
  CRISPR gRNA sequence
gtggccaacagaagtcagag

SEQ ID NO: 96871 - DNA, 20 bp, Artificial
  CRISPR gRNA sequence
cagaagtcagagaggcttcc

SEQ ID NO: 96872 - DNA, 20 bp, Artificial
  CRISPR gRNA sequence
gaagtcagagaggcttcctg

SEQ ID NO: 96873 - DNA, 20 bp, Artificial
  CRISPR gRNA sequence
aagtcagagaggcttcctgg

SEQ ID NO: 96874 - DNA, 20 bp, Artificial
  CRISPR gRNA sequence
tcagagaggcttcctggagg

SEQ ID NO: 96875 - DNA, 20 bp, Artificial
  CRISPR gRNA sequence
cagagaggcttcctggagga

SEQ ID NO: 96876 - DNA, 20 bp, Artificial
  CRISPR gRNA sequence
ttcctggaggaaggtgtctt

SEQ ID NO: 96877 - DNA, 20 bp, Artificial
  CRISPR gRNA sequence
tcctggaggaaggtgtctta

SEQ ID NO: 96878 - DNA, 20 bp, Artificial
  CRISPR gRNA sequence
gaggaaggtgtcttaaggtt

SEQ ID NO: 96879 - DNA, 20 bp, Artificial
  CRISPR gRNA sequence
tgtcttaaggttgagacccc

SEQ ID NO: 96880 - DNA, 20 bp, Artificial
  CRISPR gRNA sequence
cttaaggttgagaccccgag

SEQ ID NO: 96881 - DNA, 20 bp, Artificial
  CRISPR gRNA sequence
aggttgagaccccgagaagt

SEQ ID NO: 96882 - DNA, 20 bp, Artificial
  CRISPR gRNA sequence
ggttgagaccccgagaagtg

SEQ ID NO: 96883 - DNA, 20 bp, Artificial
  CRISPR gRNA sequence
tgagaccccgagaagtgagg

SEQ ID NO: 96884 - DNA, 20 bp, Artificial
  CRISPR gRNA sequence
gagaccccgagaagtgaggt

SEQ ID NO: 96885 - DNA, 20 bp, Artificial
  CRISPR gRNA sequence
cccgagaagtgaggtgggcc

SEQ ID NO: 96886 - DNA, 20 bp, Artificial
  CRISPR gRNA sequence
aagtgaggtgggcccagccc

SEQ ID NO: 96887 - DNA, 20 bp, Artificial
  CRISPR gRNA sequence
agtgaggtgggcccagccct

SEQ ID NO: 96888 - DNA, 20 bp, Artificial
  CRISPR gRNA sequence
aggtgggcccagccctggga

SEQ ID NO: 96889 - DNA, 20 bp, Artificial
  CRISPR gRNA sequence
ggtgggcccagccctgggat

SEQ ID NO: 96890 - DNA, 20 bp, Artificial
  CRISPR gRNA sequence
gtgggcccagccctgggatg

SEQ ID NO: 96891 - DNA, 20 bp, Artificial
  CRISPR gRNA sequence
gggcccagccctgggatggg

SEQ ID NO: 96892 - DNA, 20 bp, Artificial
  CRISPR gRNA sequence
ggcccagccctgggatgggg

SEQ ID NO: 96893 - DNA, 20 bp, Artificial
  CRISPR gRNA sequence
cagccctgggatggggaggt

SEQ ID NO: 96894 - DNA, 20 bp, Artificial
  CRISPR gRNA sequence
agccctgggatggggaggtc

SEQ ID NO: 96895 - DNA, 20 bp, Artificial
  CRISPR gRNA sequence
gccctgggatggggaggtca

SEQ ID NO: 96896 - DNA, 20 bp, Artificial
  CRISPR gRNA sequence
ctgggatggggaggtcaggg

SEQ ID NO: 96897 - DNA, 20 bp, Artificial
  CRISPR gRNA sequence
tgggatggggaggtcaggga

SEQ ID NO: 96898 - DNA, 20 bp, Artificial
  CRISPR gRNA sequence
gggaggtcagggaaggattc

SEQ ID NO: 96899 - DNA, 20 bp, Artificial
  CRISPR gRNA sequence
ggaggtcagggaaggattct

SEQ ID NO: 96900 - DNA, 20 bp, Artificial
  CRISPR gRNA sequence
gaggtcagggaaggattctg

SEQ ID NO: 96901 - DNA, 20 bp, Artificial
  CRISPR gRNA sequence
aggtcagggaaggattctgg

SEQ ID NO: 96902 - DNA, 20 bp, Artificial
  CRISPR gRNA sequence
gaaggattctgggggacctg

SEQ ID NO: 96903 - DNA, 20 bp, Artificial
  CRISPR gRNA sequence
aaggattctgggggacctga

SEQ ID NO: 96904 - DNA, 20 bp, Artificial
  CRISPR gRNA sequence
aggattctgggggacctgaa

SEQ ID NO: 96905 - DNA, 20 bp, Artificial
  CRISPR gRNA sequence
gattctgggggacctgaagg

SEQ ID NO: 96906 - DNA, 20 bp, Artificial
  CRISPR gRNA sequence
attctgggggacctgaaggg

SEQ ID NO: 96907 - DNA, 20 bp, Artificial
  CRISPR gRNA sequence
ttctgggggacctgaaggga

SEQ ID NO: 96908 - DNA, 20 bp, Artificial
  CRISPR gRNA sequence
ctgggggacctgaagggagg

SEQ ID NO: 96909 - DNA, 20 bp, Artificial
  CRISPR gRNA sequence
ggacctgaagggagggagaa

SEQ ID NO: 96910 - DNA, 20 bp, Artificial
  CRISPR gRNA sequence
aagggagggagaatggcatc

SEQ ID NO: 96911 - DNA, 20 bp, Artificial
  CRISPR gRNA sequence
agggagggagaatggcatcc

SEQ ID NO: 96912 - DNA, 20 bp, Artificial
  CRISPR gRNA sequence
gagggagaatggcatccagg

SEQ ID NO: 96913 - DNA, 20 bp, Artificial
  CRISPR gRNA sequence
agggagaatggcatccaggt

SEQ ID NO: 96914 - DNA, 20 bp, Artificial
  CRISPR gRNA sequence
ggagaatggcatccaggtgg

SEQ ID NO: 96915 - DNA, 20 bp, Artificial
  CRISPR gRNA sequence
gagaatggcatccaggtggg

SEQ ID NO: 96916 - DNA, 20 bp, Artificial
  CRISPR gRNA sequence
gaatggcatccaggtgggag

SEQ ID NO: 96917 - DNA, 20 bp, Artificial
  CRISPR gRNA sequence
tggcatccaggtgggaggag

SEQ ID NO: 96918 - DNA, 20 bp, Artificial
  CRISPR gRNA sequence
ggtgggaggagtggcccctg

SEQ ID NO: 96919 - DNA, 20 bp, Artificial
  CRISPR gRNA sequence
tgggaggagtggcccctgcg

SEQ ID NO: 96920 - DNA, 20 bp, Artificial
  CRISPR gRNA sequence
gggaggagtggcccctgcgg

SEQ ID NO: 96921 - DNA, 20 bp, Artificial
  CRISPR gRNA sequence
gagtggcccctgcggaggcc

SEQ ID NO: 96922 - DNA, 20 bp, Artificial
  CRISPR gRNA sequence
tggcccctgcggaggcctgg

SEQ ID NO: 96923 - DNA, 20 bp, Artificial
  CRISPR gRNA sequence
ccctgcggaggcctggcagt

SEQ ID NO: 96924 - DNA, 20 bp, Artificial
  CRISPR gRNA sequence
cctgcggaggcctggcagtg

SEQ ID NO: 96925 - DNA, 20 bp, Artificial
  CRISPR gRNA sequence
ggcctggcagtgaggacacc

SEQ ID NO: 96926 - DNA, 20 bp, Artificial
  CRISPR gRNA sequence
gcctggcagtgaggacacca

SEQ ID NO: 96927 - DNA, 20 bp, Artificial
  CRISPR gRNA sequence
cctggcagtgaggacaccaa

SEQ ID NO: 96928 - DNA, 20 bp, Artificial
  CRISPR gRNA sequence
ctggcagtgaggacaccaag

SEQ ID NO: 96929 - DNA, 20 bp, Artificial
  CRISPR gRNA sequence
gcagtgaggacaccaagggg

SEQ ID NO: 96930 - DNA, 20 bp, Artificial
  CRISPR gRNA sequence
cagtgaggacaccaaggggt

SEQ ID NO: 96931 - DNA, 20 bp, Artificial
  CRISPR gRNA sequence
gacaccaaggggtaggcgac

SEQ ID NO: 96932 - DNA, 20 bp, Artificial
  CRISPR gRNA sequence
acaccaaggggtaggcgacc

SEQ ID NO: 96933 - DNA, 20 bp, Artificial
  CRISPR gRNA sequence
aggggtaggcgaccaggcca

SEQ ID NO: 96934 - DNA, 20 bp, Artificial
  CRISPR gRNA sequence
ggcgaccaggccatagtgca

SEQ ID NO: 96935 - DNA, 20 bp, Artificial
  CRISPR gRNA sequence
cgaccaggccatagtgcaca

SEQ ID NO: 96936 - DNA, 20 bp, Artificial
  CRISPR gRNA sequence
ggccatagtgcacagagcca

SEQ ID NO: 96937 - DNA, 20 bp, Artificial
  CRISPR gRNA sequence
ccatagtgcacagagccaca

SEQ ID NO: 96938 - DNA, 20 bp, Artificial
  CRISPR gRNA sequence
catagtgcacagagccacag

SEQ ID NO: 96939 - DNA, 20 bp, Artificial
  CRISPR gRNA sequence
acagaggccatccctctccg

SEQ ID NO: 96940 - DNA, 20 bp, Artificial
  CRISPR gRNA sequence
gaggccatccctctccgtgg

SEQ ID NO: 96941 - DNA, 20 bp, Artificial
  CRISPR gRNA sequence
aggccatccctctccgtggc

SEQ ID NO: 96942 - DNA, 20 bp, Artificial
  CRISPR gRNA sequence
ccatccctctccgtggcggg

SEQ ID NO: 96943 - DNA, 20 bp, Artificial
  CRISPR gRNA sequence
tccctctccgtggcgggcag

SEQ ID NO: 96944 - DNA, 20 bp, Artificial
  CRISPR gRNA sequence
ccctctccgtggcgggcagt

SEQ ID NO: 96945 - DNA, 20 bp, Artificial
  CRISPR gRNA sequence
tggcgggcagtgggtttgaa

SEQ ID NO: 96946 - DNA, 20 bp, Artificial
  CRISPR gRNA sequence
ggcgggcagtgggtttgaac

SEQ ID NO: 96947 - DNA, 20 bp, Artificial
  CRISPR gRNA sequence
gcgggcagtgggtttgaaca

SEQ ID NO: 96948 - DNA, 20 bp, Artificial
  CRISPR gRNA sequence
cgggcagtgggtttgaacag

SEQ ID NO: 96949 - DNA, 20 bp, Artificial
  CRISPR gRNA sequence
gtgggtttgaacaggggcca

SEQ ID NO: 96950 - DNA, 20 bp, Artificial
  CRISPR gRNA sequence
tgggtttgaacaggggccat

SEQ ID NO: 96951 - DNA, 20 bp, Artificial
  CRISPR gRNA sequence
gtttgaacaggggccatagg

SEQ ID NO: 96952 - DNA, 20 bp, Artificial
  CRISPR gRNA sequence
caggggccataggcagaccc

SEQ ID NO: 96953 - DNA, 20 bp, Artificial
  CRISPR gRNA sequence
ctccattttctctgtcacaa

SEQ ID NO: 96954 - DNA, 20 bp, Artificial
  CRISPR gRNA sequence
tccattttctctgtcacaat

SEQ ID NO: 96955 - DNA, 20 bp, Artificial
  CRISPR gRNA sequence
caacttccccatccataaaa

SEQ ID NO: 96956 - DNA, 20 bp, Artificial
  CRISPR gRNA sequence
aacttccccatccataaaat

SEQ ID NO: 96957 - DNA, 20 bp, Artificial
  CRISPR gRNA sequence
acttccccatccataaaatg

SEQ ID NO: 96958 - DNA, 20 bp, Artificial
  CRISPR gRNA sequence
ttccccatccataaaatggg

SEQ ID NO: 96959 - DNA, 20 bp, Artificial
  CRISPR gRNA sequence
tcccaattgaaccgaccccc

SEQ ID NO: 96960 - DNA, 20 bp, Artificial
  CRISPR gRNA sequence
cccaattgaaccgaccccct

SEQ ID NO: 96961 - DNA, 20 bp, Artificial
  CRISPR gRNA sequence
ccaattgaaccgaccccctg

SEQ ID NO: 96962 - DNA, 20 bp, Artificial
  CRISPR gRNA sequence
gaaccgaccccctggggtca

SEQ ID NO: 96963 - DNA, 20 bp, Artificial
  CRISPR gRNA sequence
ccgaccccctggggtcatgg

SEQ ID NO: 96964 - DNA, 20 bp, Artificial
  CRISPR gRNA sequence
gaccccctggggtcatggta

SEQ ID NO: 96965 - DNA, 20 bp, Artificial
  CRISPR gRNA sequence
ccctggggtcatggtagaga

SEQ ID NO: 96966 - DNA, 20 bp, Artificial
  CRISPR gRNA sequence
cctggggtcatggtagagat

SEQ ID NO: 96967 - DNA, 20 bp, Artificial
  CRISPR gRNA sequence
ctggggtcatggtagagatg

SEQ ID NO: 96968 - DNA, 20 bp, Artificial
  CRISPR gRNA sequence
catggtagagatggggtgct

SEQ ID NO: 96969 - DNA, 20 bp, Artificial
  CRISPR gRNA sequence
atggtagagatggggtgctt

SEQ ID NO: 96970 - DNA, 20 bp, Artificial
  CRISPR gRNA sequence
aaatatccccctccttcctt

SEQ ID NO: 96971 - DNA, 20 bp, Artificial
  CRISPR gRNA sequence
atatccccctccttccttca

SEQ ID NO: 96972 - DNA, 20 bp, Artificial
  CRISPR gRNA sequence
cttcagagttttactgtgtt

SEQ ID NO: 96973 - DNA, 20 bp, Artificial
  CRISPR gRNA sequence
ttcagagttttactgtgttt

SEQ ID NO: 96974 - DNA, 20 bp, Artificial
  CRISPR gRNA sequence
gagttttactgtgtttggga

SEQ ID NO: 96975 - DNA, 20 bp, Artificial
  CRISPR gRNA sequence
ctcttccctcctcatgtttt

SEQ ID NO: 96976 - DNA, 20 bp, Artificial
  CRISPR gRNA sequence
tcttccctcctcatgttttc

SEQ ID NO: 96977 - DNA, 20 bp, Artificial
  CRISPR gRNA sequence
cttccctcctcatgttttcg

SEQ ID NO: 96978 - DNA, 20 bp, Artificial
  CRISPR gRNA sequence
ttccctcctcatgttttcgg

SEQ ID NO: 96979 - DNA, 20 bp, Artificial
  CRISPR gRNA sequence
tccctcctcatgttttcggg

SEQ ID NO: 96980 - DNA, 20 bp, Artificial
  CRISPR gRNA sequence
gggggtttgtttttttgttc

SEQ ID NO: 96981 - DNA, 20 bp, Artificial
  CRISPR gRNA sequence
ggggtttgtttttttgttcg

SEQ ID NO: 96982 - DNA, 20 bp, Artificial
  CRISPR gRNA sequence
gtttgtttttttgttcgagg

SEQ ID NO: 96983 - DNA, 20 bp, Artificial
  CRISPR gRNA sequence
gtttttttgttcgaggcaga

SEQ ID NO: 96984 - DNA, 20 bp, Artificial
  CRISPR gRNA sequence
gaaagtcttgctctatcacc

SEQ ID NO: 96985 - DNA, 20 bp, Artificial
  CRISPR gRNA sequence
aaagtcttgctctatcaccc

SEQ ID NO: 96986 - DNA, 20 bp, Artificial
  CRISPR gRNA sequence
tcttgctctatcacccaggc

SEQ ID NO: 96987 - DNA, 20 bp, Artificial
  CRISPR gRNA sequence
ctatcacccaggctggaatg

SEQ ID NO: 96988 - DNA, 20 bp, Artificial
  CRISPR gRNA sequence
tcacccaggctggaatgaag

SEQ ID NO: 96989 - DNA, 20 bp, Artificial
  CRISPR gRNA sequence
caggctggaatgaagtggtg

SEQ ID NO: 96990 - DNA, 20 bp, Artificial
  CRISPR gRNA sequence
aggctggaatgaagtggtgc

SEQ ID NO: 96991 - DNA, 20 bp, Artificial
  CRISPR gRNA sequence
ggaatgaagtggtgcaggca

SEQ ID NO: 96992 - DNA, 20 bp, Artificial
  CRISPR gRNA sequence
ggtgcaggcacagcttactg

SEQ ID NO: 96993 - DNA, 20 bp, Artificial
  CRISPR gRNA sequence
ttactgcagcctcgatctcc

SEQ ID NO: 96994 - DNA, 20 bp, Artificial
  CRISPR gRNA sequence
tactgcagcctcgatctccc

SEQ ID NO: 96995 - DNA, 20 bp, Artificial
  CRISPR gRNA sequence
agcctcgatctcccaggctc

SEQ ID NO: 96996 - DNA, 20 bp, Artificial
  CRISPR gRNA sequence
ctcaagtgatcctcccacca

SEQ ID NO: 96997 - DNA, 20 bp, Artificial
  CRISPR gRNA sequence
tcctcccaccacagcctccc

SEQ ID NO: 96998 - DNA, 20 bp, Artificial
  CRISPR gRNA sequence
tcccaccacagcctcccgag

SEQ ID NO: 96999 - DNA, 20 bp, Artificial
  CRISPR gRNA sequence
accacagcctcccgagtagc

SEQ ID NO: 97000 - DNA, 20 bp, Artificial
  CRISPR gRNA sequence
ccacagcctcccgagtagct

SEQ ID NO: 97001 - DNA, 20 bp, Artificial
  CRISPR gRNA sequence
ctcccgagtagctgggacca

SEQ ID NO: 97002 - DNA, 20 bp, Artificial
  CRISPR gRNA sequence
tcccgagtagctgggaccac

SEQ ID NO: 97003 - DNA, 20 bp, Artificial
  CRISPR gRNA sequence
caggcattcgtcaccatgcc

SEQ ID NO: 97004 - DNA, 20 bp, Artificial
  CRISPR gRNA sequence
gctttttttttttttttttt

SEQ ID NO: 97005 - DNA, 20 bp, Artificial
  CRISPR gRNA sequence
tttttttttttttttggaca

SEQ ID NO: 97006 - DNA, 20 bp, Artificial
  CRISPR gRNA sequence
tttttttttttttggacatg

SEQ ID NO: 97007 - DNA, 20 bp, Artificial
  CRISPR gRNA sequence
tggagtctcgcgctgtcacc

SEQ ID NO: 97008 - DNA, 20 bp, Artificial
  CRISPR gRNA sequence
ggagtctcgcgctgtcaccc

SEQ ID NO: 97009 - DNA, 20 bp, Artificial
  CRISPR gRNA sequence
tctcgcgctgtcacccaggc

SEQ ID NO: 97010 - DNA, 20 bp, Artificial
  CRISPR gRNA sequence
tcgcgctgtcacccaggctg

SEQ ID NO: 97011 - DNA, 20 bp, Artificial
  CRISPR gRNA sequence
tcacccaggctggagtgcaa

SEQ ID NO: 97012 - DNA, 20 bp, Artificial
  CRISPR gRNA sequence
ggagtgcaatggcgccatct

SEQ ID NO: 97013 - DNA, 20 bp, Artificial
  CRISPR gRNA sequence
tcactgcaacttccacctcc

SEQ ID NO: 97014 - DNA, 20 bp, Artificial
  CRISPR gRNA sequence
cactgcaacttccacctccc

SEQ ID NO: 97015 - DNA, 20 bp, Artificial
  CRISPR gRNA sequence
aacttccacctcccaggttc

SEQ ID NO: 97016 - DNA, 20 bp, Artificial
  CRISPR gRNA sequence
ttcaagcgattctcctgcct

SEQ ID NO: 97017 - DNA, 20 bp, Artificial
  CRISPR gRNA sequence
ttctcctgcctcagcctcct

SEQ ID NO: 97018 - DNA, 20 bp, Artificial
  CRISPR gRNA sequence
tcctgcctcagcctcctgag

SEQ ID NO: 97019 - DNA, 20 bp, Artificial
  CRISPR gRNA sequence
gcctcagcctcctgagtagc

SEQ ID NO: 97020 - DNA, 20 bp, Artificial
  CRISPR gRNA sequence
cctcagcctcctgagtagct

SEQ ID NO: 97021 - DNA, 20 bp, Artificial
  CRISPR gRNA sequence
ctcctgagtagctgggacca

SEQ ID NO: 97022 - DNA, 20 bp, Artificial
  CRISPR gRNA sequence
tcctgagtagctgggaccac

SEQ ID NO: 97023 - DNA, 20 bp, Artificial
  CRISPR gRNA sequence
caggtgcacaccatgacgcc

SEQ ID NO: 97024 - DNA, 20 bp, Artificial
  CRISPR gRNA sequence
ccggctaatttttatatttt

SEQ ID NO: 97025 - DNA, 20 bp, Artificial
  CRISPR gRNA sequence
gctaatttttatatttttag

SEQ ID NO: 97026 - DNA, 20 bp, Artificial
  CRISPR gRNA sequence
taatttttatatttttagta

SEQ ID NO: 97027 - DNA, 20 bp, Artificial
  CRISPR gRNA sequence
ttttatatttttagtagaga

SEQ ID NO: 97028 - DNA, 20 bp, Artificial
  CRISPR gRNA sequence
tttatatttttagtagagac

SEQ ID NO: 97029 - DNA, 20 bp, Artificial
  CRISPR gRNA sequence
ttatatttttagtagagacg

SEQ ID NO: 97030 - DNA, 20 bp, Artificial
  CRISPR gRNA sequence
gagacggggtttcaccatgt

SEQ ID NO: 97031 - DNA, 20 bp, Artificial
  CRISPR gRNA sequence
cggggtttcaccatgttggt

SEQ ID NO: 97032 - DNA, 20 bp, Artificial
  CRISPR gRNA sequence
ggggtttcaccatgttggtc

SEQ ID NO: 97033 - DNA, 20 bp, Artificial
  CRISPR gRNA sequence
tttcaccatgttggtcaggc

SEQ ID NO: 97034 - DNA, 20 bp, Artificial
  CRISPR gRNA sequence
accttgtgatccgcctgtgt

SEQ ID NO: 97035 - DNA, 20 bp, Artificial
  CRISPR gRNA sequence
ccgcctgtgttggcctccca

SEQ ID NO: 97036 - DNA, 20 bp, Artificial
  CRISPR gRNA sequence
gtgttggcctcccaaagtgc

SEQ ID NO: 97037 - DNA, 20 bp, Artificial
  CRISPR gRNA sequence
tgttggcctcccaaagtgct

SEQ ID NO: 97038 - DNA, 20 bp, Artificial
  CRISPR gRNA sequence
ctcccaaagtgctgggatta

SEQ ID NO: 97039 - DNA, 20 bp, Artificial
  CRISPR gRNA sequence
tcccaaagtgctgggattac

SEQ ID NO: 97040 - DNA, 20 bp, Artificial
  CRISPR gRNA sequence
agtgctgggattacaggtgt

SEQ ID NO: 97041 - DNA, 20 bp, Artificial
  CRISPR gRNA sequence
caggtgtgagccaccacgcc

SEQ ID NO: 97042 - DNA, 20 bp, Artificial
  CRISPR gRNA sequence
tggctgtgttgttgtttttt

SEQ ID NO: 97043 - DNA, 20 bp, Artificial
  CRISPR gRNA sequence
ctgtgttgttgtttttttag

SEQ ID NO: 97044 - DNA, 20 bp, Artificial
  CRISPR gRNA sequence
gtgttgttgtttttttagaa

SEQ ID NO: 97045 - DNA, 20 bp, Artificial
  CRISPR gRNA sequence
tgttgtttttttagaagaga

SEQ ID NO: 97046 - DNA, 20 bp, Artificial
  CRISPR gRNA sequence
gttgtttttttagaagagac

SEQ ID NO: 97047 - DNA, 20 bp, Artificial
  CRISPR gRNA sequence
ttgtttttttagaagagaca

SEQ ID NO: 97048 - DNA, 20 bp, Artificial
  CRISPR gRNA sequence
cagggtctcgctatgttgcc

SEQ ID NO: 97049 - DNA, 20 bp, Artificial
  CRISPR gRNA sequence
agggtctcgctatgttgccc

SEQ ID NO: 97050 - DNA, 20 bp, Artificial
  CRISPR gRNA sequence
tctcgctatgttgcccaggc

SEQ ID NO: 97051 - DNA, 20 bp, Artificial
  CRISPR gRNA sequence
ccaggctggtctcaaactcc

SEQ ID NO: 97052 - DNA, 20 bp, Artificial
  CRISPR gRNA sequence
caggctggtctcaaactcct

SEQ ID NO: 97053 - DNA, 20 bp, Artificial
  CRISPR gRNA sequence
ggtctcaaactcctgggctc

SEQ ID NO: 97054 - DNA, 20 bp, Artificial
  CRISPR gRNA sequence
ctcaagtgatccttcttccc

SEQ ID NO: 97055 - DNA, 20 bp, Artificial
  CRISPR gRNA sequence
tccttcttccccagcctcct

SEQ ID NO: 97056 - DNA, 20 bp, Artificial
  CRISPR gRNA sequence
ttcttccccagcctcctgag

SEQ ID NO: 97057 - DNA, 20 bp, Artificial
  CRISPR gRNA sequence
tccccagcctcctgagtagc

SEQ ID NO: 97058 - DNA, 20 bp, Artificial
  CRISPR gRNA sequence
ccccagcctcctgagtagct

SEQ ID NO: 97059 - DNA, 20 bp, Artificial
  CRISPR gRNA sequence
ctcctgagtagctgggacta

SEQ ID NO: 97060 - DNA, 20 bp, Artificial
  CRISPR gRNA sequence
tcctgagtagctgggactac

SEQ ID NO: 97061 - DNA, 20 bp, Artificial
  CRISPR gRNA sequence
caggcatgtaccactctacc

SEQ ID NO: 97062 - DNA, 20 bp, Artificial
  CRISPR gRNA sequence
atcttttttatttatttttt

SEQ ID NO: 97063 - DNA, 20 bp, Artificial
  CRISPR gRNA sequence
tttttatttattttttgaga

SEQ ID NO: 97064 - DNA, 20 bp, Artificial
  CRISPR gRNA sequence
tttatttattttttgagaca

SEQ ID NO: 97065 - DNA, 20 bp, Artificial
  CRISPR gRNA sequence
cagagtctcgctctgtcacc

SEQ ID NO: 97066 - DNA, 20 bp, Artificial
  CRISPR gRNA sequence
agagtctcgctctgtcaccc

SEQ ID NO: 97067 - DNA, 20 bp, Artificial
  CRISPR gRNA sequence
tctcgctctgtcacccaggc

SEQ ID NO: 97068 - DNA, 20 bp, Artificial
  CRISPR gRNA sequence
tcgctctgtcacccaggctg

SEQ ID NO: 97069 - DNA, 20 bp, Artificial
  CRISPR gRNA sequence
ctgtcacccaggctggagtg

SEQ ID NO: 97070 - DNA, 20 bp, Artificial
  CRISPR gRNA sequence
tcacccaggctggagtgcag

SEQ ID NO: 97071 - DNA, 20 bp, Artificial
  CRISPR gRNA sequence
ggagtgcagtggcacaatct

SEQ ID NO: 97072 - DNA, 20 bp, Artificial
  CRISPR gRNA sequence
tcactgcaacctctgcctcc

SEQ ID NO: 97073 - DNA, 20 bp, Artificial
  CRISPR gRNA sequence
cactgcaacctctgcctccc

SEQ ID NO: 97074 - DNA, 20 bp, Artificial
  CRISPR gRNA sequence
ggcaaacaattctcctgcct

SEQ ID NO: 97075 - DNA, 20 bp, Artificial
  CRISPR gRNA sequence
tcctgcctcagcctcctgaa

SEQ ID NO: 97076 - DNA, 20 bp, Artificial
  CRISPR gRNA sequence
gcctcagcctcctgaatagc

SEQ ID NO: 97077 - DNA, 20 bp, Artificial
  CRISPR gRNA sequence
cctcagcctcctgaatagct

SEQ ID NO: 97078 - DNA, 20 bp, Artificial
  CRISPR gRNA sequence
tcctgaatagctgggattac

SEQ ID NO: 97079 - DNA, 20 bp, Artificial
  CRISPR gRNA sequence
caagtgcctgccaccacacc

SEQ ID NO: 97080 - DNA, 20 bp, Artificial
  CRISPR gRNA sequence
tttttttttttttttttttt

SEQ ID NO: 97081 - DNA, 20 bp, Artificial
  CRISPR gRNA sequence
ttttttttttttttttgaga

SEQ ID NO: 97082 - DNA, 20 bp, Artificial
  CRISPR gRNA sequence
ttttttttttttttgagatg

SEQ ID NO: 97083 - DNA, 20 bp, Artificial
  CRISPR gRNA sequence
ggagtttcgctcttgttgcc

SEQ ID NO: 97084 - DNA, 20 bp, Artificial
  CRISPR gRNA sequence
gagtttcgctcttgttgccc

SEQ ID NO: 97085 - DNA, 20 bp, Artificial
  CRISPR gRNA sequence
ttcgctcttgttgcccaggc

SEQ ID NO: 97086 - DNA, 20 bp, Artificial
  CRISPR gRNA sequence
cgctcttgttgcccaggctg

SEQ ID NO: 97087 - DNA, 20 bp, Artificial
  CRISPR gRNA sequence
ttgcccaggctggagtgcta

SEQ ID NO: 97088 - DNA, 20 bp, Artificial
  CRISPR gRNA sequence
ggagtgctatggcgtgatct

SEQ ID NO: 97089 - DNA, 20 bp, Artificial
  CRISPR gRNA sequence
tcactgcaacttccgcctcc

SEQ ID NO: 97090 - DNA, 20 bp, Artificial
  CRISPR gRNA sequence
cactgcaacttccgcctccc

SEQ ID NO: 97091 - DNA, 20 bp, Artificial
  CRISPR gRNA sequence
aacttccgcctcccaggttc

SEQ ID NO: 97092 - DNA, 20 bp, Artificial
  CRISPR gRNA sequence
ttcaagcaattctcctgcct

SEQ ID NO: 97093 - DNA, 20 bp, Artificial
  CRISPR gRNA sequence
ttctcctgcctcagcctccc

SEQ ID NO: 97094 - DNA, 20 bp, Artificial
  CRISPR gRNA sequence
tcctgcctcagcctcccaag

SEQ ID NO: 97095 - DNA, 20 bp, Artificial
  CRISPR gRNA sequence
gcctcagcctcccaagtagc

SEQ ID NO: 97096 - DNA, 20 bp, Artificial
  CRISPR gRNA sequence
cctcagcctcccaagtagct

SEQ ID NO: 97097 - DNA, 20 bp, Artificial
  CRISPR gRNA sequence
ctcccaagtagctgggatta

SEQ ID NO: 97098 - DNA, 20 bp, Artificial
  CRISPR gRNA sequence
tcccaagtagctgggattac

SEQ ID NO: 97099 - DNA, 20 bp, Artificial
  CRISPR gRNA sequence
caactaattttttgcatttt

SEQ ID NO: 97100 - DNA, 20 bp, Artificial
  CRISPR gRNA sequence
ctaattttttgcatttttag

SEQ ID NO: 97101 - DNA, 20 bp, Artificial
  CRISPR gRNA sequence
aattttttgcatttttagta

SEQ ID NO: 97102 - DNA, 20 bp, Artificial
  CRISPR gRNA sequence
ttttgcatttttagtagagt

SEQ ID NO: 97103 - DNA, 20 bp, Artificial
  CRISPR gRNA sequence
tttgcatttttagtagagtc

SEQ ID NO: 97104 - DNA, 20 bp, Artificial
  CRISPR gRNA sequence
ttgcatttttagtagagtca

SEQ ID NO: 97105 - DNA, 20 bp, Artificial
  CRISPR gRNA sequence
gagtcagggtttctccatgt

SEQ ID NO: 97106 - DNA, 20 bp, Artificial
  CRISPR gRNA sequence
cagggtttctccatgttggt

SEQ ID NO: 97107 - DNA, 20 bp, Artificial
  CRISPR gRNA sequence
agggtttctccatgttggtc

SEQ ID NO: 97108 - DNA, 20 bp, Artificial
  CRISPR gRNA sequence
tgatctcaaactcccgacct

SEQ ID NO: 97109 - DNA, 20 bp, Artificial
  CRISPR gRNA sequence
gatctcaaactcccgacctc

SEQ ID NO: 97110 - DNA, 20 bp, Artificial
  CRISPR gRNA sequence
ctcaggtgatccacccgcct

SEQ ID NO: 97111 - DNA, 20 bp, Artificial
  CRISPR gRNA sequence
ccacccgcctcagcttccca

SEQ ID NO: 97112 - DNA, 20 bp, Artificial
  CRISPR gRNA sequence
gcctcagcttcccaaagtgc

SEQ ID NO: 97113 - DNA, 20 bp, Artificial
  CRISPR gRNA sequence
cctcagcttcccaaagtgct

SEQ ID NO: 97114 - DNA, 20 bp, Artificial
  CRISPR gRNA sequence
ttcccaaagtgctgggatta

SEQ ID NO: 97115 - DNA, 20 bp, Artificial
  CRISPR gRNA sequence
tcccaaagtgctgggattac

SEQ ID NO: 97116 - DNA, 20 bp, Artificial
  CRISPR gRNA sequence
agtgctgggattacaggcat

SEQ ID NO: 97117 - DNA, 20 bp, Artificial
  CRISPR gRNA sequence
caggcatgagccaccacacc

SEQ ID NO: 97118 - DNA, 20 bp, Artificial
  CRISPR gRNA sequence
ccaccacacccggctgcacc

SEQ ID NO: 97119 - DNA, 20 bp, Artificial
  CRISPR gRNA sequence
ctgcacctggctaatttttg

SEQ ID NO: 97120 - DNA, 20 bp, Artificial
  CRISPR gRNA sequence
ctggctaatttttgtagttt

SEQ ID NO: 97121 - DNA, 20 bp, Artificial
  CRISPR gRNA sequence
gctaatttttgtagttttag

SEQ ID NO: 97122 - DNA, 20 bp, Artificial
  CRISPR gRNA sequence
taatttttgtagttttagta

SEQ ID NO: 97123 - DNA, 20 bp, Artificial
  CRISPR gRNA sequence
ttttgtagttttagtagaga

SEQ ID NO: 97124 - DNA, 20 bp, Artificial
  CRISPR gRNA sequence
tttgtagttttagtagagat

SEQ ID NO: 97125 - DNA, 20 bp, Artificial
  CRISPR gRNA sequence
ttgtagttttagtagagatg

SEQ ID NO: 97126 - DNA, 20 bp, Artificial
  CRISPR gRNA sequence
gagatggggtttcatcatgt

SEQ ID NO: 97127 - DNA, 20 bp, Artificial
  CRISPR gRNA sequence
tggggtttcatcatgttggt

SEQ ID NO: 97128 - DNA, 20 bp, Artificial
  CRISPR gRNA sequence
ggggtttcatcatgttggtc

SEQ ID NO: 97129 - DNA, 20 bp, Artificial
  CRISPR gRNA sequence
tttcatcatgttggtcaggc

SEQ ID NO: 97130 - DNA, 20 bp, Artificial
  CRISPR gRNA sequence
ggctggcctttcctgacttc

SEQ ID NO: 97131 - DNA, 20 bp, Artificial
  CRISPR gRNA sequence
ttcaagtgatccacctacct

SEQ ID NO: 97132 - DNA, 20 bp, Artificial
  CRISPR gRNA sequence
ccacctaccttggcctccca

SEQ ID NO: 97133 - DNA, 20 bp, Artificial
  CRISPR gRNA sequence
accttggcctcccaaagtgc

SEQ ID NO: 97134 - DNA, 20 bp, Artificial
  CRISPR gRNA sequence
ccttggcctcccaaagtgct

SEQ ID NO: 97135 - DNA, 20 bp, Artificial
  CRISPR gRNA sequence
ctcccaaagtgctaggatta

SEQ ID NO: 97136 - DNA, 20 bp, Artificial
  CRISPR gRNA sequence
tcccaaagtgctaggattac

SEQ ID NO: 97137 - DNA, 20 bp, Artificial
  CRISPR gRNA sequence
agtgctaggattacaggtgt

SEQ ID NO: 97138 - DNA, 20 bp, Artificial
  CRISPR gRNA sequence
gattacaggtgtgagccacc

SEQ ID NO: 97139 - DNA, 20 bp, Artificial
  CRISPR gRNA sequence
caggtgtgagccaccaagcc

SEQ ID NO: 97140 - DNA, 20 bp, Artificial
  CRISPR gRNA sequence
gcctaatttttaaatttttt

SEQ ID NO: 97141 - DNA, 20 bp, Artificial
  CRISPR gRNA sequence
taatttttaaatttttttgg

SEQ ID NO: 97142 - DNA, 20 bp, Artificial
  CRISPR gRNA sequence
atttttaaatttttttggta

SEQ ID NO: 97143 - DNA, 20 bp, Artificial
  CRISPR gRNA sequence
ttaaatttttttggtagaga

SEQ ID NO: 97144 - DNA, 20 bp, Artificial
  CRISPR gRNA sequence
agcgttttgctctgttgccc

SEQ ID NO: 97145 - DNA, 20 bp, Artificial
  CRISPR gRNA sequence
ttttgctctgttgcccaagc

SEQ ID NO: 97146 - DNA, 20 bp, Artificial
  CRISPR gRNA sequence
caagctggcctcaaattcct

SEQ ID NO: 97147 - DNA, 20 bp, Artificial
  CRISPR gRNA sequence
ggcctcaaattcctgagctc

SEQ ID NO: 97148 - DNA, 20 bp, Artificial
  CRISPR gRNA sequence
ctcaaattcctgagctcaag

SEQ ID NO: 97149 - DNA, 20 bp, Artificial
  CRISPR gRNA sequence
gctcaagcagtcctccccac

SEQ ID NO: 97150 - DNA, 20 bp, Artificial
  CRISPR gRNA sequence
cctccccactggacctccca

SEQ ID NO: 97151 - DNA, 20 bp, Artificial
  CRISPR gRNA sequence
cactggacctcccaaagtgc

SEQ ID NO: 97152 - DNA, 20 bp, Artificial
  CRISPR gRNA sequence
actggacctcccaaagtgct

SEQ ID NO: 97153 - DNA, 20 bp, Artificial
  CRISPR gRNA sequence
ctcccaaagtgctgggatta

SEQ ID NO: 97154 - DNA, 20 bp, Artificial
  CRISPR gRNA sequence
tcccaaagtgctgggattat

SEQ ID NO: 97155 - DNA, 20 bp, Artificial
  CRISPR gRNA sequence
agtgctgggattataggtgt

SEQ ID NO: 97156 - DNA, 20 bp, Artificial
  CRISPR gRNA sequence
taggtgtgagccaccatgcc

SEQ ID NO: 97157 - DNA, 20 bp, Artificial
  CRISPR gRNA sequence
aggtgtgagccaccatgccc

SEQ ID NO: 97158 - DNA, 20 bp, Artificial
  CRISPR gRNA sequence
ccaggctcatcttttcatga

SEQ ID NO: 97159 - DNA, 20 bp, Artificial
  CRISPR gRNA sequence
cacaattcacacattttgct

SEQ ID NO: 97160 - DNA, 20 bp, Artificial
  CRISPR gRNA sequence
aattcacacattttgcttgg

SEQ ID NO: 97161 - DNA, 20 bp, Artificial
  CRISPR gRNA sequence
attcacacattttgcttggt

SEQ ID NO: 97162 - DNA, 20 bp, Artificial
  CRISPR gRNA sequence
atttttatattaattctgaa

SEQ ID NO: 97163 - DNA, 20 bp, Artificial
  CRISPR gRNA sequence
ttaattctgaaaagctacaa

SEQ ID NO: 97164 - DNA, 20 bp, Artificial
  CRISPR gRNA sequence
aaagtgcatttttacaaact

SEQ ID NO: 97165 - DNA, 20 bp, Artificial
  CRISPR gRNA sequence
aagtgcatttttacaaactt

SEQ ID NO: 97166 - DNA, 20 bp, Artificial
  CRISPR gRNA sequence
agtgcatttttacaaactta

SEQ ID NO: 97167 - DNA, 20 bp, Artificial
  CRISPR gRNA sequence
gtgcatttttacaaacttag

SEQ ID NO: 97168 - DNA, 20 bp, Artificial
  CRISPR gRNA sequence
catttttacaaacttagggg

SEQ ID NO: 97169 - DNA, 20 bp, Artificial
  CRISPR gRNA sequence
ttacaaacttaggggaagtt

SEQ ID NO: 97170 - DNA, 20 bp, Artificial
  CRISPR gRNA sequence
tacaaacttaggggaagttg

SEQ ID NO: 97171 - DNA, 20 bp, Artificial
  CRISPR gRNA sequence
ttaggggaagttgaggttcc

SEQ ID NO: 97172 - DNA, 20 bp, Artificial
  CRISPR gRNA sequence
taggggaagttgaggttcct

SEQ ID NO: 97173 - DNA, 20 bp, Artificial
  CRISPR gRNA sequence
aggggaagttgaggttcctg

SEQ ID NO: 97174 - DNA, 20 bp, Artificial
  CRISPR gRNA sequence
gaagttgaggttcctggggt

SEQ ID NO: 97175 - DNA, 20 bp, Artificial
  CRISPR gRNA sequence
aggttcctggggtgagtcct

SEQ ID NO: 97176 - DNA, 20 bp, Artificial
  CRISPR gRNA sequence
gggtgagtcctcggttctcc

SEQ ID NO: 97177 - DNA, 20 bp, Artificial
  CRISPR gRNA sequence
cccagctttgctctgtaatg

SEQ ID NO: 97178 - DNA, 20 bp, Artificial
  CRISPR gRNA sequence
ccagctttgctctgtaatgc

SEQ ID NO: 97179 - DNA, 20 bp, Artificial
  CRISPR gRNA sequence
tctgtaatgcaggtctctgc

SEQ ID NO: 97180 - DNA, 20 bp, Artificial
  CRISPR gRNA sequence
ctgtaatgcaggtctctgca

SEQ ID NO: 97181 - DNA, 20 bp, Artificial
  CRISPR gRNA sequence
tgtaatgcaggtctctgcaa

SEQ ID NO: 97182 - DNA, 20 bp, Artificial
  CRISPR gRNA sequence
agggtccctgtttgtcccct

SEQ ID NO: 97183 - DNA, 20 bp, Artificial
  CRISPR gRNA sequence
gggtccctgtttgtccccta

SEQ ID NO: 97184 - DNA, 20 bp, Artificial
  CRISPR gRNA sequence
ggtccctgtttgtcccctaa

SEQ ID NO: 97185 - DNA, 20 bp, Artificial
  CRISPR gRNA sequence
gtccctgtttgtcccctaag

SEQ ID NO: 97186 - DNA, 20 bp, Artificial
  CRISPR gRNA sequence
ccctgtttgtcccctaaggg

SEQ ID NO: 97187 - DNA, 20 bp, Artificial
  CRISPR gRNA sequence
ctgtttgtcccctaagggga

SEQ ID NO: 97188 - DNA, 20 bp, Artificial
  CRISPR gRNA sequence
tgtcccctaaggggagagcg

SEQ ID NO: 97189 - DNA, 20 bp, Artificial
  CRISPR gRNA sequence
gtcccctaaggggagagcgc

SEQ ID NO: 97190 - DNA, 20 bp, Artificial
  CRISPR gRNA sequence
cctaaggggagagcgcaggt

SEQ ID NO: 97191 - DNA, 20 bp, Artificial
  CRISPR gRNA sequence
ctccaccccactcccgattc

SEQ ID NO: 97192 - DNA, 20 bp, Artificial
  CRISPR gRNA sequence
ccactcccgattcaagctca

SEQ ID NO: 97193 - DNA, 20 bp, Artificial
  CRISPR gRNA sequence
accttttccctgccccatct

SEQ ID NO: 97194 - DNA, 20 bp, Artificial
  CRISPR gRNA sequence
cctgccccatctcagtgcaa

SEQ ID NO: 97195 - DNA, 20 bp, Artificial
  CRISPR gRNA sequence
ctgccccatctcagtgcaac

SEQ ID NO: 97196 - DNA, 20 bp, Artificial
  CRISPR gRNA sequence
tctcagtgcaacaggtgatc

SEQ ID NO: 97197 - DNA, 20 bp, Artificial
  CRISPR gRNA sequence
tgatcgagaaccacatcctc

SEQ ID NO: 97198 - DNA, 20 bp, Artificial
  CRISPR gRNA sequence
accacatcctcaagctcttc

SEQ ID NO: 97199 - DNA, 20 bp, Artificial
  CRISPR gRNA sequence
cacatcctcaagctcttcca

SEQ ID NO: 97200 - DNA, 20 bp, Artificial
  CRISPR gRNA sequence
caagctcttccagagcaacc

SEQ ID NO: 97201 - DNA, 20 bp, Artificial
  CRISPR gRNA sequence
acctggtgcccgctgaccct

SEQ ID NO: 97202 - DNA, 20 bp, Artificial
  CRISPR gRNA sequence
gtgcccgctgaccctgagtg

SEQ ID NO: 97203 - DNA, 20 bp, Artificial
  CRISPR gRNA sequence
tgcccgctgaccctgagtga

SEQ ID NO: 97204 - DNA, 20 bp, Artificial
  CRISPR gRNA sequence
cctgagtgaaggccgcctgc

SEQ ID NO: 97205 - DNA, 20 bp, Artificial
  CRISPR gRNA sequence
ctgagtgaaggccgcctgcc

SEQ ID NO: 97206 - DNA, 20 bp, Artificial
  CRISPR gRNA sequence
tgagtgaaggccgcctgccg

SEQ ID NO: 97207 - DNA, 20 bp, Artificial
  CRISPR gRNA sequence
aaggccgcctgccggggact

SEQ ID NO: 97208 - DNA, 20 bp, Artificial
  CRISPR gRNA sequence
ctgccggggactcagacact

SEQ ID NO: 97209 - DNA, 20 bp, Artificial
  CRISPR gRNA sequence
tgccggggactcagacactc

SEQ ID NO: 97210 - DNA, 20 bp, Artificial
  CRISPR gRNA sequence
gccggggactcagacactca

SEQ ID NO: 97211 - DNA, 20 bp, Artificial
  CRISPR gRNA sequence
cagacactcagggaacaaaa

SEQ ID NO: 97212 - DNA, 20 bp, Artificial
  CRISPR gRNA sequence
cactcagggaacaaaatggt

SEQ ID NO: 97213 - DNA, 20 bp, Artificial
  CRISPR gRNA sequence
cagggaacaaaatggtcagc

SEQ ID NO: 97214 - DNA, 20 bp, Artificial
  CRISPR gRNA sequence
gggaacaaaatggtcagcca

SEQ ID NO: 97215 - DNA, 20 bp, Artificial
  CRISPR gRNA sequence
acaaaatggtcagccagagc

SEQ ID NO: 97216 - DNA, 20 bp, Artificial
  CRISPR gRNA sequence
caaaatggtcagccagagct

SEQ ID NO: 97217 - DNA, 20 bp, Artificial
  CRISPR gRNA sequence
aaaatggtcagccagagctg

SEQ ID NO: 97218 - DNA, 20 bp, Artificial
  CRISPR gRNA sequence
cagccagagctggggaaacc

SEQ ID NO: 97219 - DNA, 20 bp, Artificial
  CRISPR gRNA sequence
gaaacccagaactgacttca

SEQ ID NO: 97220 - DNA, 20 bp, Artificial
  CRISPR gRNA sequence
aaacccagaactgacttcaa

SEQ ID NO: 97221 - DNA, 20 bp, Artificial
  CRISPR gRNA sequence
cccagaactgacttcaaagg

SEQ ID NO: 97222 - DNA, 20 bp, Artificial
  CRISPR gRNA sequence
ctgacttcaaaggcagcttc

SEQ ID NO: 97223 - DNA, 20 bp, Artificial
  CRISPR gRNA sequence
cttcaaaggcagcttctgga

SEQ ID NO: 97224 - DNA, 20 bp, Artificial
  CRISPR gRNA sequence
ttcaaaggcagcttctggac

SEQ ID NO: 97225 - DNA, 20 bp, Artificial
  CRISPR gRNA sequence
aaaggcagcttctggacagg

SEQ ID NO: 97226 - DNA, 20 bp, Artificial
  CRISPR gRNA sequence
ggcagcttctggacaggtgg

SEQ ID NO: 97227 - DNA, 20 bp, Artificial
  CRISPR gRNA sequence
gcagcttctggacaggtggt

SEQ ID NO: 97228 - DNA, 20 bp, Artificial
  CRISPR gRNA sequence
agcttctggacaggtggtgg

SEQ ID NO: 97229 - DNA, 20 bp, Artificial
  CRISPR gRNA sequence
gcttctggacaggtggtggg

SEQ ID NO: 97230 - DNA, 20 bp, Artificial
  CRISPR gRNA sequence
cttctggacaggtggtggga

SEQ ID NO: 97231 - DNA, 20 bp, Artificial
  CRISPR gRNA sequence
ttctggacaggtggtgggag

SEQ ID NO: 97232 - DNA, 20 bp, Artificial
  CRISPR gRNA sequence
ggtgggaggggacccttccc

SEQ ID NO: 97233 - DNA, 20 bp, Artificial
  CRISPR gRNA sequence
tgggaggggacccttcccaa

SEQ ID NO: 97234 - DNA, 20 bp, Artificial
  CRISPR gRNA sequence
gggaggggacccttcccaag

SEQ ID NO: 97235 - DNA, 20 bp, Artificial
  CRISPR gRNA sequence
gaaccaataaaccttctgtg

SEQ ID NO: 97236 - DNA, 20 bp, Artificial
  CRISPR gRNA sequence
ataaaccttctgtgcagaat

SEQ ID NO: 97237 - DNA, 20 bp, Artificial
  CRISPR gRNA sequence
taaaccttctgtgcagaatg

SEQ ID NO: 97238 - DNA, 20 bp, Artificial
  CRISPR gRNA sequence
aaaccttctgtgcagaatga

SEQ ID NO: 97239 - DNA, 20 bp, Artificial
  CRISPR gRNA sequence
agggactttgctgtgcttcc

SEQ ID NO: 97240 - DNA, 20 bp, Artificial
  CRISPR gRNA sequence
ggactttgctgtgcttcccg

SEQ ID NO: 97241 - DNA, 20 bp, Artificial
  CRISPR gRNA sequence
gactttgctgtgcttcccgg

SEQ ID NO: 97242 - DNA, 20 bp, Artificial
  CRISPR gRNA sequence
actttgctgtgcttcccgga

SEQ ID NO: 97243 - DNA, 20 bp, Artificial
  CRISPR gRNA sequence
gtgcttcccggagggcttcc

SEQ ID NO: 97244 - DNA, 20 bp, Artificial
  CRISPR gRNA sequence
gcttcccggagggcttcctg

SEQ ID NO: 97245 - DNA, 20 bp, Artificial
  CRISPR gRNA sequence
cttcccggagggcttcctgg

SEQ ID NO: 97246 - DNA, 20 bp, Artificial
  CRISPR gRNA sequence
tcccggagggcttcctggag

SEQ ID NO: 97247 - DNA, 20 bp, Artificial
  CRISPR gRNA sequence
ggagggcttcctggaggaga

SEQ ID NO: 97248 - DNA, 20 bp, Artificial
  CRISPR gRNA sequence
ttcctggaggagacagcccc

SEQ ID NO: 97249 - DNA, 20 bp, Artificial
  CRISPR gRNA sequence
cctggaggagacagccccta

SEQ ID NO: 97250 - DNA, 20 bp, Artificial
  CRISPR gRNA sequence
ctggaggagacagcccctag

SEQ ID NO: 97251 - DNA, 20 bp, Artificial
  CRISPR gRNA sequence
aggtctcacaccttctcccc

SEQ ID NO: 97252 - DNA, 20 bp, Artificial
  CRISPR gRNA sequence
accttctccccaagcacccg

SEQ ID NO: 97253 - DNA, 20 bp, Artificial
  CRISPR gRNA sequence
ccttctccccaagcacccgc

SEQ ID NO: 97254 - DNA, 20 bp, Artificial
  CRISPR gRNA sequence
tctccccaagcacccgcagg

SEQ ID NO: 97255 - DNA, 20 bp, Artificial
  CRISPR gRNA sequence
ccccaagcacccgcaggtgg

SEQ ID NO: 97256 - DNA, 20 bp, Artificial
  CRISPR gRNA sequence
gtgtggtcatctaccacctg

SEQ ID NO: 97257 - DNA, 20 bp, Artificial
  CRISPR gRNA sequence
tgtggtcatctaccacctgc

SEQ ID NO: 97258 - DNA, 20 bp, Artificial
  CRISPR gRNA sequence
atctaccacctgcgggtgct

SEQ ID NO: 97259 - DNA, 20 bp, Artificial
  CRISPR gRNA sequence
tctaccacctgcgggtgctt

SEQ ID NO: 97260 - DNA, 20 bp, Artificial
  CRISPR gRNA sequence
ctaccacctgcgggtgcttg

SEQ ID NO: 97261 - DNA, 20 bp, Artificial
  CRISPR gRNA sequence
accacctgcgggtgcttggg

SEQ ID NO: 97262 - DNA, 20 bp, Artificial
  CRISPR gRNA sequence
acctgcgggtgcttggggag

SEQ ID NO: 97263 - DNA, 20 bp, Artificial
  CRISPR gRNA sequence
cctgcgggtgcttggggaga

SEQ ID NO: 97264 - DNA, 20 bp, Artificial
  CRISPR gRNA sequence
ggtgcttggggagaaggtgt

SEQ ID NO: 97265 - DNA, 20 bp, Artificial
  CRISPR gRNA sequence
gggagaaggtgtgagacctc

SEQ ID NO: 97266 - DNA, 20 bp, Artificial
  CRISPR gRNA sequence
ggagaaggtgtgagacctct

SEQ ID NO: 97267 - DNA, 20 bp, Artificial
  CRISPR gRNA sequence
gagaaggtgtgagacctcta

SEQ ID NO: 97268 - DNA, 20 bp, Artificial
  CRISPR gRNA sequence
agaaggtgtgagacctctag

SEQ ID NO: 97269 - DNA, 20 bp, Artificial
  CRISPR gRNA sequence
cctctaggggctgtctcctc

SEQ ID NO: 97270 - DNA, 20 bp, Artificial
  CRISPR gRNA sequence
ctctaggggctgtctcctcc

SEQ ID NO: 97271 - DNA, 20 bp, Artificial
  CRISPR gRNA sequence
taggggctgtctcctccagg

SEQ ID NO: 97272 - DNA, 20 bp, Artificial
  CRISPR gRNA sequence
gtctcctccaggaagccctc

SEQ ID NO: 97273 - DNA, 20 bp, Artificial
  CRISPR gRNA sequence
tctcctccaggaagccctcc

SEQ ID NO: 97274 - DNA, 20 bp, Artificial
  CRISPR gRNA sequence
cctccaggaagccctccggg

SEQ ID NO: 97275 - DNA, 20 bp, Artificial
  CRISPR gRNA sequence
aggaagccctccgggaagca

SEQ ID NO: 97276 - DNA, 20 bp, Artificial
  CRISPR gRNA sequence
gccctccgggaagcacagca

SEQ ID NO: 97277 - DNA, 20 bp, Artificial
  CRISPR gRNA sequence
gcaaagtccctcattctgca

SEQ ID NO: 97278 - DNA, 20 bp, Artificial
  CRISPR gRNA sequence
aagtccctcattctgcacag

SEQ ID NO: 97279 - DNA, 20 bp, Artificial
  CRISPR gRNA sequence
agtccctcattctgcacaga

SEQ ID NO: 97280 - DNA, 20 bp, Artificial
  CRISPR gRNA sequence
attctgcacagaaggtttat

SEQ ID NO: 97281 - DNA, 20 bp, Artificial
  CRISPR gRNA sequence
gaaggtttattggttcctct

SEQ ID NO: 97282 - DNA, 20 bp, Artificial
  CRISPR gRNA sequence
aaggtttattggttcctctt

SEQ ID NO: 97283 - DNA, 20 bp, Artificial
  CRISPR gRNA sequence
gtttattggttcctcttggg

SEQ ID NO: 97284 - DNA, 20 bp, Artificial
  CRISPR gRNA sequence
tttattggttcctcttggga

SEQ ID NO: 97285 - DNA, 20 bp, Artificial
  CRISPR gRNA sequence
ttattggttcctcttgggaa

SEQ ID NO: 97286 - DNA, 20 bp, Artificial
  CRISPR gRNA sequence
gtcccctcccaccacctgtc

SEQ ID NO: 97287 - DNA, 20 bp, Artificial
  CRISPR gRNA sequence
ccctcccaccacctgtccag

SEQ ID NO: 97288 - DNA, 20 bp, Artificial
  CRISPR gRNA sequence
ctgtccagaagctgcctttg

SEQ ID NO: 97289 - DNA, 20 bp, Artificial
  CRISPR gRNA sequence
ccagaagctgcctttgaagt

SEQ ID NO: 97290 - DNA, 20 bp, Artificial
  CRISPR gRNA sequence
gctgcctttgaagtcagttc

SEQ ID NO: 97291 - DNA, 20 bp, Artificial
  CRISPR gRNA sequence
ctgcctttgaagtcagttct

SEQ ID NO: 97292 - DNA, 20 bp, Artificial
  CRISPR gRNA sequence
aagtcagttctgggtttccc

SEQ ID NO: 97293 - DNA, 20 bp, Artificial
  CRISPR gRNA sequence
gttctgggtttccccagctc

SEQ ID NO: 97294 - DNA, 20 bp, Artificial
  CRISPR gRNA sequence
ggctgaccattttgttccct

SEQ ID NO: 97295 - DNA, 20 bp, Artificial
  CRISPR gRNA sequence
attttgttccctgagtgtct

SEQ ID NO: 97296 - DNA, 20 bp, Artificial
  CRISPR gRNA sequence
tccctgagtgtctgagtccc

SEQ ID NO: 97297 - DNA, 20 bp, Artificial
  CRISPR gRNA sequence
ctgagtgtctgagtccccgg

SEQ ID NO: 97298 - DNA, 20 bp, Artificial
  CRISPR gRNA sequence
tgagtgtctgagtccccggc

SEQ ID NO: 97299 - DNA, 20 bp, Artificial
  CRISPR gRNA sequence
gtgtctgagtccccggcagg

SEQ ID NO: 97300 - DNA, 20 bp, Artificial
  CRISPR gRNA sequence
cccggcaggcggccttcact

SEQ ID NO: 97301 - DNA, 20 bp, Artificial
  CRISPR gRNA sequence
ccggcaggcggccttcactc

SEQ ID NO: 97302 - DNA, 20 bp, Artificial
  CRISPR gRNA sequence
cggcaggcggccttcactca

SEQ ID NO: 97303 - DNA, 20 bp, Artificial
  CRISPR gRNA sequence
aggcggccttcactcagggt

SEQ ID NO: 97304 - DNA, 20 bp, Artificial
  CRISPR gRNA sequence
cggccttcactcagggtcag

SEQ ID NO: 97305 - DNA, 20 bp, Artificial
  CRISPR gRNA sequence
ggccttcactcagggtcagc

SEQ ID NO: 97306 - DNA, 20 bp, Artificial
  CRISPR gRNA sequence
cactcagggtcagcgggcac

SEQ ID NO: 97307 - DNA, 20 bp, Artificial
  CRISPR gRNA sequence
actcagggtcagcgggcacc

SEQ ID NO: 97308 - DNA, 20 bp, Artificial
  CRISPR gRNA sequence
cagcgggcaccaggttgctc

SEQ ID NO: 97309 - DNA, 20 bp, Artificial
  CRISPR gRNA sequence
cgggcaccaggttgctctgg

SEQ ID NO: 97310 - DNA, 20 bp, Artificial
  CRISPR gRNA sequence
ggcaccaggttgctctggaa

SEQ ID NO: 97311 - DNA, 20 bp, Artificial
  CRISPR gRNA sequence
aggttgctctggaagagctt

SEQ ID NO: 97312 - DNA, 20 bp, Artificial
  CRISPR gRNA sequence
ggttgctctggaagagcttg

SEQ ID NO: 97313 - DNA, 20 bp, Artificial
  CRISPR gRNA sequence
tctggaagagcttgaggatg

SEQ ID NO: 97314 - DNA, 20 bp, Artificial
  CRISPR gRNA sequence
tctcgatcacctgttgcact

SEQ ID NO: 97315 - DNA, 20 bp, Artificial
  CRISPR gRNA sequence
gatcacctgttgcactgaga

SEQ ID NO: 97316 - DNA, 20 bp, Artificial
  CRISPR gRNA sequence
atcacctgttgcactgagat

SEQ ID NO: 97317 - DNA, 20 bp, Artificial
  CRISPR gRNA sequence
tcacctgttgcactgagatg

SEQ ID NO: 97318 - DNA, 20 bp, Artificial
  CRISPR gRNA sequence
cctgttgcactgagatgggg

SEQ ID NO: 97319 - DNA, 20 bp, Artificial
  CRISPR gRNA sequence
ctgttgcactgagatggggc

SEQ ID NO: 97320 - DNA, 20 bp, Artificial
  CRISPR gRNA sequence
tgttgcactgagatggggca

SEQ ID NO: 97321 - DNA, 20 bp, Artificial
  CRISPR gRNA sequence
cactgagatggggcagggaa

SEQ ID NO: 97322 - DNA, 20 bp, Artificial
  CRISPR gRNA sequence
actgagatggggcagggaaa

SEQ ID NO: 97323 - DNA, 20 bp, Artificial
  CRISPR gRNA sequence
gagatggggcagggaaaagg

SEQ ID NO: 97324 - DNA, 20 bp, Artificial
  CRISPR gRNA sequence
agatggggcagggaaaaggt

SEQ ID NO: 97325 - DNA, 20 bp, Artificial
  CRISPR gRNA sequence
gcagggaaaaggtgggctgt

SEQ ID NO: 97326 - DNA, 20 bp, Artificial
  CRISPR gRNA sequence
ggtgggctgtgagcttgaat

SEQ ID NO: 97327 - DNA, 20 bp, Artificial
  CRISPR gRNA sequence
gtgggctgtgagcttgaatc

SEQ ID NO: 97328 - DNA, 20 bp, Artificial
  CRISPR gRNA sequence
gggctgtgagcttgaatcgg

SEQ ID NO: 97329 - DNA, 20 bp, Artificial
  CRISPR gRNA sequence
ctgtgagcttgaatcgggag

SEQ ID NO: 97330 - DNA, 20 bp, Artificial
  CRISPR gRNA sequence
tgtgagcttgaatcgggagt

SEQ ID NO: 97331 - DNA, 20 bp, Artificial
  CRISPR gRNA sequence
gtgagcttgaatcgggagtg

SEQ ID NO: 97332 - DNA, 20 bp, Artificial
  CRISPR gRNA sequence
agcttgaatcgggagtgggg

SEQ ID NO: 97333 - DNA, 20 bp, Artificial
  CRISPR gRNA sequence
cttgaatcgggagtggggtg

SEQ ID NO: 97334 - DNA, 20 bp, Artificial
  CRISPR gRNA sequence
ttgaatcgggagtggggtgg

SEQ ID NO: 97335 - DNA, 20 bp, Artificial
  CRISPR gRNA sequence
tcgggagtggggtggaggca

SEQ ID NO: 97336 - DNA, 20 bp, Artificial
  CRISPR gRNA sequence
cgggagtggggtggaggcac

SEQ ID NO: 97337 - DNA, 20 bp, Artificial
  CRISPR gRNA sequence
gccaacctgcgctctcccct

SEQ ID NO: 97338 - DNA, 20 bp, Artificial
  CRISPR gRNA sequence
ccaacctgcgctctcccctt

SEQ ID NO: 97339 - DNA, 20 bp, Artificial
  CRISPR gRNA sequence
caacctgcgctctcccctta

SEQ ID NO: 97340 - DNA, 20 bp, Artificial
  CRISPR gRNA sequence
aacctgcgctctccccttag

SEQ ID NO: 97341 - DNA, 20 bp, Artificial
  CRISPR gRNA sequence
ctctccccttaggggacaaa

SEQ ID NO: 97342 - DNA, 20 bp, Artificial
  CRISPR gRNA sequence
tctccccttaggggacaaac

SEQ ID NO: 97343 - DNA, 20 bp, Artificial
  CRISPR gRNA sequence
ctccccttaggggacaaaca

SEQ ID NO: 97344 - DNA, 20 bp, Artificial
  CRISPR gRNA sequence
gggacaaacagggacccttg

SEQ ID NO: 97345 - DNA, 20 bp, Artificial
  CRISPR gRNA sequence
gacaaacagggacccttgca

SEQ ID NO: 97346 - DNA, 20 bp, Artificial
  CRISPR gRNA sequence
ccttgcagagacctgcatta

SEQ ID NO: 97347 - DNA, 20 bp, Artificial
  CRISPR gRNA sequence
ttgcagagacctgcattaca

SEQ ID NO: 97348 - DNA, 20 bp, Artificial
  CRISPR gRNA sequence
gagacctgcattacagagca

SEQ ID NO: 97349 - DNA, 20 bp, Artificial
  CRISPR gRNA sequence
cctgcattacagagcaaagc

SEQ ID NO: 97350 - DNA, 20 bp, Artificial
  CRISPR gRNA sequence
ctgcattacagagcaaagct

SEQ ID NO: 97351 - DNA, 20 bp, Artificial
  CRISPR gRNA sequence
gcattacagagcaaagctgg

SEQ ID NO: 97352 - DNA, 20 bp, Artificial
  CRISPR gRNA sequence
agagcaaagctgggagaacc

SEQ ID NO: 97353 - DNA, 20 bp, Artificial
  CRISPR gRNA sequence
gagcaaagctgggagaaccg

SEQ ID NO: 97354 - DNA, 20 bp, Artificial
  CRISPR gRNA sequence
ggagaaccgaggactcaccc

SEQ ID NO: 97355 - DNA, 20 bp, Artificial
  CRISPR gRNA sequence
gagaaccgaggactcacccc

SEQ ID NO: 97356 - DNA, 20 bp, Artificial
  CRISPR gRNA sequence
caggaacctcaacttcccct

SEQ ID NO: 97357 - DNA, 20 bp, Artificial
  CRISPR gRNA sequence
tttgtaaaaatgcacttttg

SEQ ID NO: 97358 - DNA, 20 bp, Artificial
  CRISPR gRNA sequence
aatgcacttttgtagctttt

SEQ ID NO: 97359 - DNA, 20 bp, Artificial
  CRISPR gRNA sequence
atataaaaatatttcctacc

SEQ ID NO: 97360 - DNA, 20 bp, Artificial
  CRISPR gRNA sequence
tgaattgtgactttcatgaa

SEQ ID NO: 97361 - DNA, 20 bp, Artificial
  CRISPR gRNA sequence
tgtgactttcatgaaaagat

SEQ ID NO: 97362 - DNA, 20 bp, Artificial
  CRISPR gRNA sequence
ctttcatgaaaagatgagcc

SEQ ID NO: 97363 - DNA, 20 bp, Artificial
  CRISPR gRNA sequence
tttcatgaaaagatgagcct

SEQ ID NO: 97364 - DNA, 20 bp, Artificial
  CRISPR gRNA sequence
tgaaaagatgagcctgggca

SEQ ID NO: 97365 - DNA, 20 bp, Artificial
  CRISPR gRNA sequence
aaagatgagcctgggcatgg

SEQ ID NO: 97366 - DNA, 20 bp, Artificial
  CRISPR gRNA sequence
gtggctcacacctataatcc

SEQ ID NO: 97367 - DNA, 20 bp, Artificial
  CRISPR gRNA sequence
cacctataatcccagcactt

SEQ ID NO: 97368 - DNA, 20 bp, Artificial
  CRISPR gRNA sequence
acctataatcccagcacttt

SEQ ID NO: 97369 - DNA, 20 bp, Artificial
  CRISPR gRNA sequence
ctataatcccagcactttgg

SEQ ID NO: 97370 - DNA, 20 bp, Artificial
  CRISPR gRNA sequence
tataatcccagcactttggg

SEQ ID NO: 97371 - DNA, 20 bp, Artificial
  CRISPR gRNA sequence
tcccagcactttgggaggtc

SEQ ID NO: 97372 - DNA, 20 bp, Artificial
  CRISPR gRNA sequence
cagcactttgggaggtccag

SEQ ID NO: 97373 - DNA, 20 bp, Artificial
  CRISPR gRNA sequence
agcactttgggaggtccagt

SEQ ID NO: 97374 - DNA, 20 bp, Artificial
  CRISPR gRNA sequence
gcactttgggaggtccagtg

SEQ ID NO: 97375 - DNA, 20 bp, Artificial
  CRISPR gRNA sequence
actttgggaggtccagtggg

SEQ ID NO: 97376 - DNA, 20 bp, Artificial
  CRISPR gRNA sequence
ctttgggaggtccagtgggg

SEQ ID NO: 97377 - DNA, 20 bp, Artificial
  CRISPR gRNA sequence
tccagtggggaggactgctt

SEQ ID NO: 97378 - DNA, 20 bp, Artificial
  CRISPR gRNA sequence
tggggaggactgcttgagct

SEQ ID NO: 97379 - DNA, 20 bp, Artificial
  CRISPR gRNA sequence
ggggaggactgcttgagctc

SEQ ID NO: 97380 - DNA, 20 bp, Artificial
  CRISPR gRNA sequence
ctgcttgagctcaggaattt

SEQ ID NO: 97381 - DNA, 20 bp, Artificial
  CRISPR gRNA sequence
tgcttgagctcaggaatttg

SEQ ID NO: 97382 - DNA, 20 bp, Artificial
  CRISPR gRNA sequence
tgagctcaggaatttgaggc

SEQ ID NO: 97383 - DNA, 20 bp, Artificial
  CRISPR gRNA sequence
tcaggaatttgaggccagct

SEQ ID NO: 97384 - DNA, 20 bp, Artificial
  CRISPR gRNA sequence
caggaatttgaggccagctt

SEQ ID NO: 97385 - DNA, 20 bp, Artificial
  CRISPR gRNA sequence
tttgaggccagcttgggcaa

SEQ ID NO: 97386 - DNA, 20 bp, Artificial
  CRISPR gRNA sequence
tgaggccagcttgggcaaca

SEQ ID NO: 97387 - DNA, 20 bp, Artificial
  CRISPR gRNA sequence
taccaaaaaaatttaaaaat

SEQ ID NO: 97388 - DNA, 20 bp, Artificial
  CRISPR gRNA sequence
accaaaaaaatttaaaaatt

SEQ ID NO: 97389 - DNA, 20 bp, Artificial
  CRISPR gRNA sequence
aaaaaatttaaaaattaggc

SEQ ID NO: 97390 - DNA, 20 bp, Artificial
  CRISPR gRNA sequence
aaaaatttaaaaattaggct

SEQ ID NO: 97391 - DNA, 20 bp, Artificial
  CRISPR gRNA sequence
tttaaaaattaggctgggct

SEQ ID NO: 97392 - DNA, 20 bp, Artificial
  CRISPR gRNA sequence
aaaaattaggctgggcttgg

SEQ ID NO: 97393 - DNA, 20 bp, Artificial
  CRISPR gRNA sequence
gtggctcacacctgtaatcc

SEQ ID NO: 97394 - DNA, 20 bp, Artificial
  CRISPR gRNA sequence
cacctgtaatcctagcactt

SEQ ID NO: 97395 - DNA, 20 bp, Artificial
  CRISPR gRNA sequence
acctgtaatcctagcacttt

SEQ ID NO: 97396 - DNA, 20 bp, Artificial
  CRISPR gRNA sequence
ctgtaatcctagcactttgg

SEQ ID NO: 97397 - DNA, 20 bp, Artificial
  CRISPR gRNA sequence
tgtaatcctagcactttggg

SEQ ID NO: 97398 - DNA, 20 bp, Artificial
  CRISPR gRNA sequence
tcctagcactttgggaggcc

SEQ ID NO: 97399 - DNA, 20 bp, Artificial
  CRISPR gRNA sequence
cctagcactttgggaggcca

SEQ ID NO: 97400 - DNA, 20 bp, Artificial
  CRISPR gRNA sequence
agcactttgggaggccaagg

SEQ ID NO: 97401 - DNA, 20 bp, Artificial
  CRISPR gRNA sequence
gcactttgggaggccaaggt

SEQ ID NO: 97402 - DNA, 20 bp, Artificial
  CRISPR gRNA sequence
ctttgggaggccaaggtagg

SEQ ID NO: 97403 - DNA, 20 bp, Artificial
  CRISPR gRNA sequence
caaggtaggtggatcacttg

SEQ ID NO: 97404 - DNA, 20 bp, Artificial
  CRISPR gRNA sequence
gtaggtggatcacttgaagt

SEQ ID NO: 97405 - DNA, 20 bp, Artificial
  CRISPR gRNA sequence
taggtggatcacttgaagtc

SEQ ID NO: 97406 - DNA, 20 bp, Artificial
  CRISPR gRNA sequence
tggatcacttgaagtcagga

SEQ ID NO: 97407 - DNA, 20 bp, Artificial
  CRISPR gRNA sequence
ggatcacttgaagtcaggaa

SEQ ID NO: 97408 - DNA, 20 bp, Artificial
  CRISPR gRNA sequence
cacttgaagtcaggaaaggc

SEQ ID NO: 97409 - DNA, 20 bp, Artificial
  CRISPR gRNA sequence
tctactaaaactacaaaaat

SEQ ID NO: 97410 - DNA, 20 bp, Artificial
  CRISPR gRNA sequence
ctaaaactacaaaaattagc

SEQ ID NO: 97411 - DNA, 20 bp, Artificial
  CRISPR gRNA sequence
taaaactacaaaaattagcc

SEQ ID NO: 97412 - DNA, 20 bp, Artificial
  CRISPR gRNA sequence
ctacaaaaattagccaggtg

SEQ ID NO: 97413 - DNA, 20 bp, Artificial
  CRISPR gRNA sequence
aaaaattagccaggtgcagc

SEQ ID NO: 97414 - DNA, 20 bp, Artificial
  CRISPR gRNA sequence
aaaattagccaggtgcagcc

SEQ ID NO: 97415 - DNA, 20 bp, Artificial
  CRISPR gRNA sequence
tagccaggtgcagccgggtg

SEQ ID NO: 97416 - DNA, 20 bp, Artificial
  CRISPR gRNA sequence
ccaggtgcagccgggtgtgg

SEQ ID NO: 97417 - DNA, 20 bp, Artificial
  CRISPR gRNA sequence
gtggctcatgcctgtaatcc

SEQ ID NO: 97418 - DNA, 20 bp, Artificial
  CRISPR gRNA sequence
tgcctgtaatcccagcactt

SEQ ID NO: 97419 - DNA, 20 bp, Artificial
  CRISPR gRNA sequence
gcctgtaatcccagcacttt

SEQ ID NO: 97420 - DNA, 20 bp, Artificial
  CRISPR gRNA sequence
tgtaatcccagcactttggg

SEQ ID NO: 97421 - DNA, 20 bp, Artificial
  CRISPR gRNA sequence
tcccagcactttgggaagct

SEQ ID NO: 97422 - DNA, 20 bp, Artificial
  CRISPR gRNA sequence
cccagcactttgggaagctg

SEQ ID NO: 97423 - DNA, 20 bp, Artificial
  CRISPR gRNA sequence
agcactttgggaagctgagg

SEQ ID NO: 97424 - DNA, 20 bp, Artificial
  CRISPR gRNA sequence
gcactttgggaagctgaggc

SEQ ID NO: 97425 - DNA, 20 bp, Artificial
  CRISPR gRNA sequence
ctttgggaagctgaggcggg

SEQ ID NO: 97426 - DNA, 20 bp, Artificial
  CRISPR gRNA sequence
ctgaggcgggtggatcacct

SEQ ID NO: 97427 - DNA, 20 bp, Artificial
  CRISPR gRNA sequence
tgaggcgggtggatcacctg

SEQ ID NO: 97428 - DNA, 20 bp, Artificial
  CRISPR gRNA sequence
gcgggtggatcacctgaggt

SEQ ID NO: 97429 - DNA, 20 bp, Artificial
  CRISPR gRNA sequence
cgggtggatcacctgaggtc

SEQ ID NO: 97430 - DNA, 20 bp, Artificial
  CRISPR gRNA sequence
ggtggatcacctgaggtcgg

SEQ ID NO: 97431 - DNA, 20 bp, Artificial
  CRISPR gRNA sequence
tcacctgaggtcgggagttt

SEQ ID NO: 97432 - DNA, 20 bp, Artificial
  CRISPR gRNA sequence
ttgagatcacctgaccaaca

SEQ ID NO: 97433 - DNA, 20 bp, Artificial
  CRISPR gRNA sequence
gagatcacctgaccaacatg

SEQ ID NO: 97434 - DNA, 20 bp, Artificial
  CRISPR gRNA sequence
ctactaaaaatgcaaaaaat

SEQ ID NO: 97435 - DNA, 20 bp, Artificial
  CRISPR gRNA sequence
taaaaatgcaaaaaattagt

SEQ ID NO: 97436 - DNA, 20 bp, Artificial
  CRISPR gRNA sequence
aaaaatgcaaaaaattagtt

SEQ ID NO: 97437 - DNA, 20 bp, Artificial
  CRISPR gRNA sequence
tgcaaaaaattagttgggca

SEQ ID NO: 97438 - DNA, 20 bp, Artificial
  CRISPR gRNA sequence
aaaaaattagttgggcatgg

SEQ ID NO: 97439 - DNA, 20 bp, Artificial
  CRISPR gRNA sequence
gtggtgcatgcctgtaatcc

SEQ ID NO: 97440 - DNA, 20 bp, Artificial
  CRISPR gRNA sequence
tgcctgtaatcccagctact

SEQ ID NO: 97441 - DNA, 20 bp, Artificial
  CRISPR gRNA sequence
gcctgtaatcccagctactt

SEQ ID NO: 97442 - DNA, 20 bp, Artificial
  CRISPR gRNA sequence
ctgtaatcccagctacttgg

SEQ ID NO: 97443 - DNA, 20 bp, Artificial
  CRISPR gRNA sequence
tgtaatcccagctacttggg

SEQ ID NO: 97444 - DNA, 20 bp, Artificial
  CRISPR gRNA sequence
tcccagctacttgggaggct

SEQ ID NO: 97445 - DNA, 20 bp, Artificial
  CRISPR gRNA sequence
cccagctacttgggaggctg

SEQ ID NO: 97446 - DNA, 20 bp, Artificial
  CRISPR gRNA sequence
agctacttgggaggctgagg

SEQ ID NO: 97447 - DNA, 20 bp, Artificial
  CRISPR gRNA sequence
gctacttgggaggctgaggc

SEQ ID NO: 97448 - DNA, 20 bp, Artificial
  CRISPR gRNA sequence
tacttgggaggctgaggcag

SEQ ID NO: 97449 - DNA, 20 bp, Artificial
  CRISPR gRNA sequence
gcaggagaattgcttgaacc

SEQ ID NO: 97450 - DNA, 20 bp, Artificial
  CRISPR gRNA sequence
caggagaattgcttgaacct

SEQ ID NO: 97451 - DNA, 20 bp, Artificial
  CRISPR gRNA sequence
ggagaattgcttgaacctgg

SEQ ID NO: 97452 - DNA, 20 bp, Artificial
  CRISPR gRNA sequence
gagaattgcttgaacctggg

SEQ ID NO: 97453 - DNA, 20 bp, Artificial
  CRISPR gRNA sequence
aattgcttgaacctgggagg

SEQ ID NO: 97454 - DNA, 20 bp, Artificial
  CRISPR gRNA sequence
tgcttgaacctgggaggcgg

SEQ ID NO: 97455 - DNA, 20 bp, Artificial
  CRISPR gRNA sequence
aacctgggaggcggaagttg

SEQ ID NO: 97456 - DNA, 20 bp, Artificial
  CRISPR gRNA sequence
tgggaggcggaagttgcagt

SEQ ID NO: 97457 - DNA, 20 bp, Artificial
  CRISPR gRNA sequence
ggcggaagttgcagtgagcc

SEQ ID NO: 97458 - DNA, 20 bp, Artificial
  CRISPR gRNA sequence
agtgagccgagatcacgcca

SEQ ID NO: 97459 - DNA, 20 bp, Artificial
  CRISPR gRNA sequence
gagatcacgccatagcactc

SEQ ID NO: 97460 - DNA, 20 bp, Artificial
  CRISPR gRNA sequence
cacgccatagcactccagcc

SEQ ID NO: 97461 - DNA, 20 bp, Artificial
  CRISPR gRNA sequence
acgccatagcactccagcct

SEQ ID NO: 97462 - DNA, 20 bp, Artificial
  CRISPR gRNA sequence
agcactccagcctgggcaac

SEQ ID NO: 97463 - DNA, 20 bp, Artificial
  CRISPR gRNA sequence
cactccagcctgggcaacaa

SEQ ID NO: 97464 - DNA, 20 bp, Artificial
  CRISPR gRNA sequence
aaaaaaaaaaaaaaaaaaat

SEQ ID NO: 97465 - DNA, 20 bp, Artificial
  CRISPR gRNA sequence
aaaaaaaaaaaaaaattagc

SEQ ID NO: 97466 - DNA, 20 bp, Artificial
  CRISPR gRNA sequence
aaaaaaaaaaaaaattagcc

SEQ ID NO: 97467 - DNA, 20 bp, Artificial
  CRISPR gRNA sequence
aaaaaaaaattagccaggtg

SEQ ID NO: 97468 - DNA, 20 bp, Artificial
  CRISPR gRNA sequence
aaaaaattagccaggtgtgg

SEQ ID NO: 97469 - DNA, 20 bp, Artificial
  CRISPR gRNA sequence
aaattagccaggtgtggtgg

SEQ ID NO: 97470 - DNA, 20 bp, Artificial
  CRISPR gRNA sequence
aattagccaggtgtggtggc

SEQ ID NO: 97471 - DNA, 20 bp, Artificial
  CRISPR gRNA sequence
gtggcaggcacttgtaatcc

SEQ ID NO: 97472 - DNA, 20 bp, Artificial
  CRISPR gRNA sequence
cacttgtaatcccagctatt

SEQ ID NO: 97473 - DNA, 20 bp, Artificial
  CRISPR gRNA sequence
acttgtaatcccagctattc

SEQ ID NO: 97474 - DNA, 20 bp, Artificial
  CRISPR gRNA sequence
ttgtaatcccagctattcag

SEQ ID NO: 97475 - DNA, 20 bp, Artificial
  CRISPR gRNA sequence
tgtaatcccagctattcagg

SEQ ID NO: 97476 - DNA, 20 bp, Artificial
  CRISPR gRNA sequence
tcccagctattcaggaggct

SEQ ID NO: 97477 - DNA, 20 bp, Artificial
  CRISPR gRNA sequence
cccagctattcaggaggctg

SEQ ID NO: 97478 - DNA, 20 bp, Artificial
  CRISPR gRNA sequence
agctattcaggaggctgagg

SEQ ID NO: 97479 - DNA, 20 bp, Artificial
  CRISPR gRNA sequence
gctattcaggaggctgaggc

SEQ ID NO: 97480 - DNA, 20 bp, Artificial
  CRISPR gRNA sequence
tattcaggaggctgaggcag

SEQ ID NO: 97481 - DNA, 20 bp, Artificial
  CRISPR gRNA sequence
aggcaggagaattgtttgcc

SEQ ID NO: 97482 - DNA, 20 bp, Artificial
  CRISPR gRNA sequence
ggcaggagaattgtttgcct

SEQ ID NO: 97483 - DNA, 20 bp, Artificial
  CRISPR gRNA sequence
caggagaattgtttgcctgg

SEQ ID NO: 97484 - DNA, 20 bp, Artificial
  CRISPR gRNA sequence
aggagaattgtttgcctggg

SEQ ID NO: 97485 - DNA, 20 bp, Artificial
  CRISPR gRNA sequence
agaattgtttgcctgggagg

SEQ ID NO: 97486 - DNA, 20 bp, Artificial
  CRISPR gRNA sequence
aattgtttgcctgggaggca

SEQ ID NO: 97487 - DNA, 20 bp, Artificial
  CRISPR gRNA sequence
attgtttgcctgggaggcag

SEQ ID NO: 97488 - DNA, 20 bp, Artificial
  CRISPR gRNA sequence
tgcctgggaggcagaggttg

SEQ ID NO: 97489 - DNA, 20 bp, Artificial
  CRISPR gRNA sequence
tgggaggcagaggttgcagt

SEQ ID NO: 97490 - DNA, 20 bp, Artificial
  CRISPR gRNA sequence
ggcagaggttgcagtgagcc

SEQ ID NO: 97491 - DNA, 20 bp, Artificial
  CRISPR gRNA sequence
gagattgtgccactgcactc

SEQ ID NO: 97492 - DNA, 20 bp, Artificial
  CRISPR gRNA sequence
tgtgccactgcactccagcc

SEQ ID NO: 97493 - DNA, 20 bp, Artificial
  CRISPR gRNA sequence
gtgccactgcactccagcct

SEQ ID NO: 97494 - DNA, 20 bp, Artificial
  CRISPR gRNA sequence
ctgcactccagcctgggtga

SEQ ID NO: 97495 - DNA, 20 bp, Artificial
  CRISPR gRNA sequence
gcactccagcctgggtgaca

SEQ ID NO: 97496 - DNA, 20 bp, Artificial
  CRISPR gRNA sequence
tccagcctgggtgacagagc

SEQ ID NO: 97497 - DNA, 20 bp, Artificial
  CRISPR gRNA sequence
gtctcaaaaaataaataaaa

SEQ ID NO: 97498 - DNA, 20 bp, Artificial
  CRISPR gRNA sequence
ataaaaaagattttaaaaat

SEQ ID NO: 97499 - DNA, 20 bp, Artificial
  CRISPR gRNA sequence
aaaagattttaaaaattagc

SEQ ID NO: 97500 - DNA, 20 bp, Artificial
  CRISPR gRNA sequence
aaagattttaaaaattagct

SEQ ID NO: 97501 - DNA, 20 bp, Artificial
  CRISPR gRNA sequence
gattttaaaaattagctggg

SEQ ID NO: 97502 - DNA, 20 bp, Artificial
  CRISPR gRNA sequence
ttttaaaaattagctgggta

SEQ ID NO: 97503 - DNA, 20 bp, Artificial
  CRISPR gRNA sequence
taaaaattagctgggtagag

SEQ ID NO: 97504 - DNA, 20 bp, Artificial
  CRISPR gRNA sequence
ggtagagtggtacatgcctg

SEQ ID NO: 97505 - DNA, 20 bp, Artificial
  CRISPR gRNA sequence
gtggtacatgcctgtagtcc

SEQ ID NO: 97506 - DNA, 20 bp, Artificial
  CRISPR gRNA sequence
tgcctgtagtcccagctact

SEQ ID NO: 97507 - DNA, 20 bp, Artificial
  CRISPR gRNA sequence
gcctgtagtcccagctactc

SEQ ID NO: 97508 - DNA, 20 bp, Artificial
  CRISPR gRNA sequence
ctgtagtcccagctactcag

SEQ ID NO: 97509 - DNA, 20 bp, Artificial
  CRISPR gRNA sequence
tgtagtcccagctactcagg

SEQ ID NO: 97510 - DNA, 20 bp, Artificial
  CRISPR gRNA sequence
gtcccagctactcaggaggc

SEQ ID NO: 97511 - DNA, 20 bp, Artificial
  CRISPR gRNA sequence
tcccagctactcaggaggct

SEQ ID NO: 97512 - DNA, 20 bp, Artificial
  CRISPR gRNA sequence
cccagctactcaggaggctg

SEQ ID NO: 97513 - DNA, 20 bp, Artificial
  CRISPR gRNA sequence
agctactcaggaggctgggg

SEQ ID NO: 97514 - DNA, 20 bp, Artificial
  CRISPR gRNA sequence
tactcaggaggctggggaag

SEQ ID NO: 97515 - DNA, 20 bp, Artificial
  CRISPR gRNA sequence
actcaggaggctggggaaga

SEQ ID NO: 97516 - DNA, 20 bp, Artificial
  CRISPR gRNA sequence
ctggggaagaaggatcactt

SEQ ID NO: 97517 - DNA, 20 bp, Artificial
  CRISPR gRNA sequence
gaagaaggatcacttgagcc

SEQ ID NO: 97518 - DNA, 20 bp, Artificial
  CRISPR gRNA sequence
aagaaggatcacttgagccc

SEQ ID NO: 97519 - DNA, 20 bp, Artificial
  CRISPR gRNA sequence
gaaggatcacttgagcccag

SEQ ID NO: 97520 - DNA, 20 bp, Artificial
  CRISPR gRNA sequence
tcacttgagcccaggagttt

SEQ ID NO: 97521 - DNA, 20 bp, Artificial
  CRISPR gRNA sequence
tgagcccaggagtttgagac

SEQ ID NO: 97522 - DNA, 20 bp, Artificial
  CRISPR gRNA sequence
ccaggagtttgagaccagcc

SEQ ID NO: 97523 - DNA, 20 bp, Artificial
  CRISPR gRNA sequence
caggagtttgagaccagcct

SEQ ID NO: 97524 - DNA, 20 bp, Artificial
  CRISPR gRNA sequence
tgagaccagcctgggcaaca

SEQ ID NO: 97525 - DNA, 20 bp, Artificial
  CRISPR gRNA sequence
accagcctgggcaacatagc

SEQ ID NO: 97526 - DNA, 20 bp, Artificial
  CRISPR gRNA sequence
cttctaaaaaaacaacaaca

SEQ ID NO: 97527 - DNA, 20 bp, Artificial
  CRISPR gRNA sequence
taaaaaaacaacaacacagc

SEQ ID NO: 97528 - DNA, 20 bp, Artificial
  CRISPR gRNA sequence
aaaaaaacaacaacacagcc

SEQ ID NO: 97529 - DNA, 20 bp, Artificial
  CRISPR gRNA sequence
aacaacaacacagccaggcg

SEQ ID NO: 97530 - DNA, 20 bp, Artificial
  CRISPR gRNA sequence
aacaacacagccaggcgtgg

SEQ ID NO: 97531 - DNA, 20 bp, Artificial
  CRISPR gRNA sequence
gtggctcacacctgtaatcc

SEQ ID NO: 97532 - DNA, 20 bp, Artificial
  CRISPR gRNA sequence
cacctgtaatcccagcactt

SEQ ID NO: 97533 - DNA, 20 bp, Artificial
  CRISPR gRNA sequence
acctgtaatcccagcacttt

SEQ ID NO: 97534 - DNA, 20 bp, Artificial
  CRISPR gRNA sequence
ctgtaatcccagcactttgg

SEQ ID NO: 97535 - DNA, 20 bp, Artificial
  CRISPR gRNA sequence
tgtaatcccagcactttggg

SEQ ID NO: 97536 - DNA, 20 bp, Artificial
  CRISPR gRNA sequence
agcactttgggaggccaaca

SEQ ID NO: 97537 - DNA, 20 bp, Artificial
  CRISPR gRNA sequence
gcactttgggaggccaacac

SEQ ID NO: 97538 - DNA, 20 bp, Artificial
  CRISPR gRNA sequence
ctttgggaggccaacacagg

SEQ ID NO: 97539 - DNA, 20 bp, Artificial
  CRISPR gRNA sequence
ggccaacacaggcggatcac

SEQ ID NO: 97540 - DNA, 20 bp, Artificial
  CRISPR gRNA sequence
gccaacacaggcggatcaca

SEQ ID NO: 97541 - DNA, 20 bp, Artificial
  CRISPR gRNA sequence
acacaggcggatcacaaggt

SEQ ID NO: 97542 - DNA, 20 bp, Artificial
  CRISPR gRNA sequence
cacaggcggatcacaaggtc

SEQ ID NO: 97543 - DNA, 20 bp, Artificial
  CRISPR gRNA sequence
caggcggatcacaaggtcag

SEQ ID NO: 97544 - DNA, 20 bp, Artificial
  CRISPR gRNA sequence
gatcacaaggtcaggagttc

SEQ ID NO: 97545 - DNA, 20 bp, Artificial
  CRISPR gRNA sequence
caaggtcaggagttcaagac

SEQ ID NO: 97546 - DNA, 20 bp, Artificial
  CRISPR gRNA sequence
caagaccagcctgaccaaca

SEQ ID NO: 97547 - DNA, 20 bp, Artificial
  CRISPR gRNA sequence
tctactaaaaatataaaaat

SEQ ID NO: 97548 - DNA, 20 bp, Artificial
  CRISPR gRNA sequence
ctaaaaatataaaaattagc

SEQ ID NO: 97549 - DNA, 20 bp, Artificial
  CRISPR gRNA sequence
taaaaatataaaaattagcc

SEQ ID NO: 97550 - DNA, 20 bp, Artificial
  CRISPR gRNA sequence
taaaaattagccgggcgtca

SEQ ID NO: 97551 - DNA, 20 bp, Artificial
  CRISPR gRNA sequence
ggcgtcatggtgtgcacctg

SEQ ID NO: 97552 - DNA, 20 bp, Artificial
  CRISPR gRNA sequence
atggtgtgcacctgtggtcc

SEQ ID NO: 97553 - DNA, 20 bp, Artificial
  CRISPR gRNA sequence
cacctgtggtcccagctact

SEQ ID NO: 97554 - DNA, 20 bp, Artificial
  CRISPR gRNA sequence
acctgtggtcccagctactc

SEQ ID NO: 97555 - DNA, 20 bp, Artificial
  CRISPR gRNA sequence
ctgtggtcccagctactcag

SEQ ID NO: 97556 - DNA, 20 bp, Artificial
  CRISPR gRNA sequence
tgtggtcccagctactcagg

SEQ ID NO: 97557 - DNA, 20 bp, Artificial
  CRISPR gRNA sequence
tcccagctactcaggaggct

SEQ ID NO: 97558 - DNA, 20 bp, Artificial
  CRISPR gRNA sequence
cccagctactcaggaggctg

SEQ ID NO: 97559 - DNA, 20 bp, Artificial
  CRISPR gRNA sequence
agctactcaggaggctgagg

SEQ ID NO: 97560 - DNA, 20 bp, Artificial
  CRISPR gRNA sequence
gctactcaggaggctgaggc

SEQ ID NO: 97561 - DNA, 20 bp, Artificial
  CRISPR gRNA sequence
tactcaggaggctgaggcag

SEQ ID NO: 97562 - DNA, 20 bp, Artificial
  CRISPR gRNA sequence
gcaggagaatcgcttgaacc

SEQ ID NO: 97563 - DNA, 20 bp, Artificial
  CRISPR gRNA sequence
caggagaatcgcttgaacct

SEQ ID NO: 97564 - DNA, 20 bp, Artificial
  CRISPR gRNA sequence
ggagaatcgcttgaacctgg

SEQ ID NO: 97565 - DNA, 20 bp, Artificial
  CRISPR gRNA sequence
gagaatcgcttgaacctggg

SEQ ID NO: 97566 - DNA, 20 bp, Artificial
  CRISPR gRNA sequence
aatcgcttgaacctgggagg

SEQ ID NO: 97567 - DNA, 20 bp, Artificial
  CRISPR gRNA sequence
cgcttgaacctgggaggtgg

SEQ ID NO: 97568 - DNA, 20 bp, Artificial
  CRISPR gRNA sequence
aacctgggaggtggaagttg

SEQ ID NO: 97569 - DNA, 20 bp, Artificial
  CRISPR gRNA sequence
tgggaggtggaagttgcagt

SEQ ID NO: 97570 - DNA, 20 bp, Artificial
  CRISPR gRNA sequence
ggtggaagttgcagtgagcc

SEQ ID NO: 97571 - DNA, 20 bp, Artificial
  CRISPR gRNA sequence
gaagttgcagtgagccgaga

SEQ ID NO: 97572 - DNA, 20 bp, Artificial
  CRISPR gRNA sequence
gagatggcgccattgcactc

SEQ ID NO: 97573 - DNA, 20 bp, Artificial
  CRISPR gRNA sequence
ggcgccattgcactccagcc

SEQ ID NO: 97574 - DNA, 20 bp, Artificial
  CRISPR gRNA sequence
gcgccattgcactccagcct

SEQ ID NO: 97575 - DNA, 20 bp, Artificial
  CRISPR gRNA sequence
ttgcactccagcctgggtga

SEQ ID NO: 97576 - DNA, 20 bp, Artificial
  CRISPR gRNA sequence
tccagcctgggtgacagcgc

SEQ ID NO: 97577 - DNA, 20 bp, Artificial
  CRISPR gRNA sequence
tccaaaaaaaaaaaaaaaaa

SEQ ID NO: 97578 - DNA, 20 bp, Artificial
  CRISPR gRNA sequence
aaaaagcaacaacaaaaaat

SEQ ID NO: 97579 - DNA, 20 bp, Artificial
  CRISPR gRNA sequence
agcaacaacaaaaaattagc

SEQ ID NO: 97580 - DNA, 20 bp, Artificial
  CRISPR gRNA sequence
gcaacaacaaaaaattagcc

SEQ ID NO: 97581 - DNA, 20 bp, Artificial
  CRISPR gRNA sequence
aacaaaaaattagccaggca

SEQ ID NO: 97582 - DNA, 20 bp, Artificial
  CRISPR gRNA sequence
ggcatggtgacgaatgcctg

SEQ ID NO: 97583 - DNA, 20 bp, Artificial
  CRISPR gRNA sequence
gtgacgaatgcctgtggtcc

SEQ ID NO: 97584 - DNA, 20 bp, Artificial
  CRISPR gRNA sequence
tgcctgtggtcccagctact

SEQ ID NO: 97585 - DNA, 20 bp, Artificial
  CRISPR gRNA sequence
gcctgtggtcccagctactc

SEQ ID NO: 97586 - DNA, 20 bp, Artificial
  CRISPR gRNA sequence
ctgtggtcccagctactcgg

SEQ ID NO: 97587 - DNA, 20 bp, Artificial
  CRISPR gRNA sequence
tgtggtcccagctactcggg

SEQ ID NO: 97588 - DNA, 20 bp, Artificial
  CRISPR gRNA sequence
cccagctactcgggaggctg

SEQ ID NO: 97589 - DNA, 20 bp, Artificial
  CRISPR gRNA sequence
agctactcgggaggctgtgg

SEQ ID NO: 97590 - DNA, 20 bp, Artificial
  CRISPR gRNA sequence
gctactcgggaggctgtggt

SEQ ID NO: 97591 - DNA, 20 bp, Artificial
  CRISPR gRNA sequence
tactcgggaggctgtggtgg

SEQ ID NO: 97592 - DNA, 20 bp, Artificial
  CRISPR gRNA sequence
actcgggaggctgtggtggg

SEQ ID NO: 97593 - DNA, 20 bp, Artificial
  CRISPR gRNA sequence
ctgtggtgggaggatcactt

SEQ ID NO: 97594 - DNA, 20 bp, Artificial
  CRISPR gRNA sequence
gtgggaggatcacttgagcc

SEQ ID NO: 97595 - DNA, 20 bp, Artificial
  CRISPR gRNA sequence
tgggaggatcacttgagcct

SEQ ID NO: 97596 - DNA, 20 bp, Artificial
  CRISPR gRNA sequence
ggaggatcacttgagcctgg

SEQ ID NO: 97597 - DNA, 20 bp, Artificial
  CRISPR gRNA sequence
tcacttgagcctgggagatc

SEQ ID NO: 97598 - DNA, 20 bp, Artificial
  CRISPR gRNA sequence
cacttgagcctgggagatcg

SEQ ID NO: 97599 - DNA, 20 bp, Artificial
  CRISPR gRNA sequence
agcctgggagatcgaggctg

SEQ ID NO: 97600 - DNA, 20 bp, Artificial
  CRISPR gRNA sequence
tgggagatcgaggctgcagt

SEQ ID NO: 97601 - DNA, 20 bp, Artificial
  CRISPR gRNA sequence
gtgcctgcaccacttcattc

SEQ ID NO: 97602 - DNA, 20 bp, Artificial
  CRISPR gRNA sequence
tgcaccacttcattccagcc

SEQ ID NO: 97603 - DNA, 20 bp, Artificial
  CRISPR gRNA sequence
gcaccacttcattccagcct

SEQ ID NO: 97604 - DNA, 20 bp, Artificial
  CRISPR gRNA sequence
cttcattccagcctgggtga

SEQ ID NO: 97605 - DNA, 20 bp, Artificial
  CRISPR gRNA sequence
tcattccagcctgggtgata

SEQ ID NO: 97606 - DNA, 20 bp, Artificial
  CRISPR gRNA sequence
tccagcctgggtgatagagc

SEQ ID NO: 97607 - DNA, 20 bp, Artificial
  CRISPR gRNA sequence
aacaaaccccccgaaaacat

SEQ ID NO: 97608 - DNA, 20 bp, Artificial
  CRISPR gRNA sequence
acaaaccccccgaaaacatg

SEQ ID NO: 97609 - DNA, 20 bp, Artificial
  CRISPR gRNA sequence
aaaccccccgaaaacatgag

SEQ ID NO: 97610 - DNA, 20 bp, Artificial
  CRISPR gRNA sequence
aaccccccgaaaacatgagg

SEQ ID NO: 97611 - DNA, 20 bp, Artificial
  CRISPR gRNA sequence
accccccgaaaacatgagga

SEQ ID NO: 97612 - DNA, 20 bp, Artificial
  CRISPR gRNA sequence
ccccgaaaacatgaggaggg

SEQ ID NO: 97613 - DNA, 20 bp, Artificial
  CRISPR gRNA sequence
ccgaaaacatgaggagggaa

SEQ ID NO: 97614 - DNA, 20 bp, Artificial
  CRISPR gRNA sequence
cgaaaacatgaggagggaag

SEQ ID NO: 97615 - DNA, 20 bp, Artificial
  CRISPR gRNA sequence
aatgatttctgtcccaaaca

SEQ ID NO: 97616 - DNA, 20 bp, Artificial
  CRISPR gRNA sequence
ccaaacacagtaaaactctg

SEQ ID NO: 97617 - DNA, 20 bp, Artificial
  CRISPR gRNA sequence
caaacacagtaaaactctga

SEQ ID NO: 97618 - DNA, 20 bp, Artificial
  CRISPR gRNA sequence
acacagtaaaactctgaagg

SEQ ID NO: 97619 - DNA, 20 bp, Artificial
  CRISPR gRNA sequence
cacagtaaaactctgaagga

SEQ ID NO: 97620 - DNA, 20 bp, Artificial
  CRISPR gRNA sequence
cagtaaaactctgaaggaag

SEQ ID NO: 97621 - DNA, 20 bp, Artificial
  CRISPR gRNA sequence
agtaaaactctgaaggaagg

SEQ ID NO: 97622 - DNA, 20 bp, Artificial
  CRISPR gRNA sequence
gtaaaactctgaaggaagga

SEQ ID NO: 97623 - DNA, 20 bp, Artificial
  CRISPR gRNA sequence
taaaactctgaaggaaggag

SEQ ID NO: 97624 - DNA, 20 bp, Artificial
  CRISPR gRNA sequence
aaaactctgaaggaaggagg

SEQ ID NO: 97625 - DNA, 20 bp, Artificial
  CRISPR gRNA sequence
gaaggagggggatatttcct

SEQ ID NO: 97626 - DNA, 20 bp, Artificial
  CRISPR gRNA sequence
ccccatctctaccatgaccc

SEQ ID NO: 97627 - DNA, 20 bp, Artificial
  CRISPR gRNA sequence
cccatctctaccatgacccc

SEQ ID NO: 97628 - DNA, 20 bp, Artificial
  CRISPR gRNA sequence
ccatctctaccatgacccca

SEQ ID NO: 97629 - DNA, 20 bp, Artificial
  CRISPR gRNA sequence
catctctaccatgaccccag

SEQ ID NO: 97630 - DNA, 20 bp, Artificial
  CRISPR gRNA sequence
atctctaccatgaccccagg

SEQ ID NO: 97631 - DNA, 20 bp, Artificial
  CRISPR gRNA sequence
ctaccatgaccccagggggt

SEQ ID NO: 97632 - DNA, 20 bp, Artificial
  CRISPR gRNA sequence
ccccagggggtcggttcaat

SEQ ID NO: 97633 - DNA, 20 bp, Artificial
  CRISPR gRNA sequence
cccagggggtcggttcaatt

SEQ ID NO: 97634 - DNA, 20 bp, Artificial
  CRISPR gRNA sequence
attgggatctccccatttta

SEQ ID NO: 97635 - DNA, 20 bp, Artificial
  CRISPR gRNA sequence
ggatctccccattttatgga

SEQ ID NO: 97636 - DNA, 20 bp, Artificial
  CRISPR gRNA sequence
gatctccccattttatggat

SEQ ID NO: 97637 - DNA, 20 bp, Artificial
  CRISPR gRNA sequence
atctccccattttatggatg

SEQ ID NO: 97638 - DNA, 20 bp, Artificial
  CRISPR gRNA sequence
tccccattttatggatgggg

SEQ ID NO: 97639 - DNA, 20 bp, Artificial
  CRISPR gRNA sequence
cattttatggatggggaagt

SEQ ID NO: 97640 - DNA, 20 bp, Artificial
  CRISPR gRNA sequence
attttatggatggggaagtt

SEQ ID NO: 97641 - DNA, 20 bp, Artificial
  CRISPR gRNA sequence
ttttatggatggggaagttg

SEQ ID NO: 97642 - DNA, 20 bp, Artificial
  CRISPR gRNA sequence
aagttggggtcccattgtga

SEQ ID NO: 97643 - DNA, 20 bp, Artificial
  CRISPR gRNA sequence
gttggggtcccattgtgaca

SEQ ID NO: 97644 - DNA, 20 bp, Artificial
  CRISPR gRNA sequence
tcccattgtgacagagaaaa

SEQ ID NO: 97645 - DNA, 20 bp, Artificial
  CRISPR gRNA sequence
ccattgtgacagagaaaatg

SEQ ID NO: 97646 - DNA, 20 bp, Artificial
  CRISPR gRNA sequence
cagagaaaatggagtcaaac

SEQ ID NO: 97647 - DNA, 20 bp, Artificial
  CRISPR gRNA sequence
agagaaaatggagtcaaact

SEQ ID NO: 97648 - DNA, 20 bp, Artificial
  CRISPR gRNA sequence
gagaaaatggagtcaaactg

SEQ ID NO: 97649 - DNA, 20 bp, Artificial
  CRISPR gRNA sequence
gtcaaactggggtctgccta

SEQ ID NO: 97650 - DNA, 20 bp, Artificial
  CRISPR gRNA sequence
ttcaaacccactgcccgcca

SEQ ID NO: 97651 - DNA, 20 bp, Artificial
  CRISPR gRNA sequence
caaacccactgcccgccacg

SEQ ID NO: 97652 - DNA, 20 bp, Artificial
  CRISPR gRNA sequence
aacccactgcccgccacgga

SEQ ID NO: 97653 - DNA, 20 bp, Artificial
  CRISPR gRNA sequence
acccactgcccgccacggag

SEQ ID NO: 97654 - DNA, 20 bp, Artificial
  CRISPR gRNA sequence
cccactgcccgccacggaga

SEQ ID NO: 97655 - DNA, 20 bp, Artificial
  CRISPR gRNA sequence
ctgcccgccacggagaggga

SEQ ID NO: 97656 - DNA, 20 bp, Artificial
  CRISPR gRNA sequence
acggagagggatggcctctg

SEQ ID NO: 97657 - DNA, 20 bp, Artificial
  CRISPR gRNA sequence
ctctgtggctctgtgcacta

SEQ ID NO: 97658 - DNA, 20 bp, Artificial
  CRISPR gRNA sequence
tggctctgtgcactatggcc

SEQ ID NO: 97659 - DNA, 20 bp, Artificial
  CRISPR gRNA sequence
tggcctggtcgcctacccct

SEQ ID NO: 97660 - DNA, 20 bp, Artificial
  CRISPR gRNA sequence
ccccttggtgtcctcactgc

SEQ ID NO: 97661 - DNA, 20 bp, Artificial
  CRISPR gRNA sequence
cccttggtgtcctcactgcc

SEQ ID NO: 97662 - DNA, 20 bp, Artificial
  CRISPR gRNA sequence
tcctcactgccaggcctccg

SEQ ID NO: 97663 - DNA, 20 bp, Artificial
  CRISPR gRNA sequence
cctcactgccaggcctccgc

SEQ ID NO: 97664 - DNA, 20 bp, Artificial
  CRISPR gRNA sequence
ctcactgccaggcctccgca

SEQ ID NO: 97665 - DNA, 20 bp, Artificial
  CRISPR gRNA sequence
tcactgccaggcctccgcag

SEQ ID NO: 97666 - DNA, 20 bp, Artificial
  CRISPR gRNA sequence
caggggccactcctcccacc

SEQ ID NO: 97667 - DNA, 20 bp, Artificial
  CRISPR gRNA sequence
gatgccattctccctccctt

SEQ ID NO: 97668 - DNA, 20 bp, Artificial
  CRISPR gRNA sequence
atgccattctccctcccttc

SEQ ID NO: 97669 - DNA, 20 bp, Artificial
  CRISPR gRNA sequence
ctccctcccttcaggtcccc

SEQ ID NO: 97670 - DNA, 20 bp, Artificial
  CRISPR gRNA sequence
cttccctgacctccccatcc

SEQ ID NO: 97671 - DNA, 20 bp, Artificial
  CRISPR gRNA sequence
ttccctgacctccccatccc

SEQ ID NO: 97672 - DNA, 20 bp, Artificial
  CRISPR gRNA sequence
tccctgacctccccatccca

SEQ ID NO: 97673 - DNA, 20 bp, Artificial
  CRISPR gRNA sequence
tgacctccccatcccagggc

SEQ ID NO: 97674 - DNA, 20 bp, Artificial
  CRISPR gRNA sequence
gacctccccatcccagggct

SEQ ID NO: 97675 - DNA, 20 bp, Artificial
  CRISPR gRNA sequence
gctgggcccacctcacttct

SEQ ID NO: 97676 - DNA, 20 bp, Artificial
  CRISPR gRNA sequence
ctgggcccacctcacttctc

SEQ ID NO: 97677 - DNA, 20 bp, Artificial
  CRISPR gRNA sequence
tgggcccacctcacttctcg

SEQ ID NO: 97678 - DNA, 20 bp, Artificial
  CRISPR gRNA sequence
cttctcggggtctcaacctt

SEQ ID NO: 97679 - DNA, 20 bp, Artificial
  CRISPR gRNA sequence
aaccttaagacaccttcctc

SEQ ID NO: 97680 - DNA, 20 bp, Artificial
  CRISPR gRNA sequence
accttaagacaccttcctcc

SEQ ID NO: 97681 - DNA, 20 bp, Artificial
  CRISPR gRNA sequence
ttaagacaccttcctccagg

SEQ ID NO: 97682 - DNA, 20 bp, Artificial
  CRISPR gRNA sequence
gaagcctctctgacttctgt

SEQ ID NO: 97683 - DNA, 20 bp, Artificial
  CRISPR gRNA sequence
ctgacttctgttggccactt

SEQ ID NO: 97684 - DNA, 20 bp, Artificial
  CRISPR gRNA sequence
tgacttctgttggccacttt

SEQ ID NO: 97685 - DNA, 20 bp, Artificial
  CRISPR gRNA sequence
gacttctgttggccactttg

SEQ ID NO: 97686 - DNA, 20 bp, Artificial
  CRISPR gRNA sequence
ccactttggggctctttgat

SEQ ID NO: 97687 - DNA, 20 bp, Artificial
  CRISPR gRNA sequence
actttggggctctttgatga

SEQ ID NO: 97688 - DNA, 20 bp, Artificial
  CRISPR gRNA sequence
ctttggggctctttgatgag

SEQ ID NO: 97689 - DNA, 20 bp, Artificial
  CRISPR gRNA sequence
ttgatgagaggcccctcttt

SEQ ID NO: 97690 - DNA, 20 bp, Artificial
  CRISPR gRNA sequence
tgcctatgtgtcccccatca

SEQ ID NO: 97691 - DNA, 20 bp, Artificial
  CRISPR gRNA sequence
tgtgtcccccatcatggcca

SEQ ID NO: 97692 - DNA, 20 bp, Artificial
  CRISPR gRNA sequence
acccattgtcctccctaccc

SEQ ID NO: 97693 - DNA, 20 bp, Artificial
  CRISPR gRNA sequence
cctccctaccccagcacatg

SEQ ID NO: 97694 - DNA, 20 bp, Artificial
  CRISPR gRNA sequence
tccctaccccagcacatgtg

SEQ ID NO: 97695 - DNA, 20 bp, Artificial
  CRISPR gRNA sequence
ccccagcacatgtggagccc

SEQ ID NO: 97696 - DNA, 20 bp, Artificial
  CRISPR gRNA sequence
cccagcacatgtggagcccc

SEQ ID NO: 97697 - DNA, 20 bp, Artificial
  CRISPR gRNA sequence
cagcacatgtggagccccag

SEQ ID NO: 97698 - DNA, 20 bp, Artificial
  CRISPR gRNA sequence
acatgtggagccccaggagc

SEQ ID NO: 97699 - DNA, 20 bp, Artificial
  CRISPR gRNA sequence
catgtggagccccaggagcc

SEQ ID NO: 97700 - DNA, 20 bp, Artificial
  CRISPR gRNA sequence
ggagccccaggagccaggac

SEQ ID NO: 97701 - DNA, 20 bp, Artificial
  CRISPR gRNA sequence
gagccccaggagccaggact

SEQ ID NO: 97702 - DNA, 20 bp, Artificial
  CRISPR gRNA sequence
agccaggactgggatgttcc

SEQ ID NO: 97703 - DNA, 20 bp, Artificial
  CRISPR gRNA sequence
gccaggactgggatgttccc

SEQ ID NO: 97704 - DNA, 20 bp, Artificial
  CRISPR gRNA sequence
aggactgggatgttcccagg

SEQ ID NO: 97705 - DNA, 20 bp, Artificial
  CRISPR gRNA sequence
ggactgggatgttcccaggc

SEQ ID NO: 97706 - DNA, 20 bp, Artificial
  CRISPR gRNA sequence
atgttcccaggcgggataca

SEQ ID NO: 97707 - DNA, 20 bp, Artificial
  CRISPR gRNA sequence
ttcccaggcgggatacacag

SEQ ID NO: 97708 - DNA, 20 bp, Artificial
  CRISPR gRNA sequence
tgtcaacacactctcgctgc

SEQ ID NO: 97709 - DNA, 20 bp, Artificial
  CRISPR gRNA sequence
ctgccggcgtatgaccactg

SEQ ID NO: 97710 - DNA, 20 bp, Artificial
  CRISPR gRNA sequence
tgccggcgtatgaccactga

SEQ ID NO: 97711 - DNA, 20 bp, Artificial
  CRISPR gRNA sequence
gccggcgtatgaccactgaa

SEQ ID NO: 97712 - DNA, 20 bp, Artificial
  CRISPR gRNA sequence
ccggcgtatgaccactgaag

SEQ ID NO: 97713 - DNA, 20 bp, Artificial
  CRISPR gRNA sequence
gtgtcccatgtaccccttta

SEQ ID NO: 97714 - DNA, 20 bp, Artificial
  CRISPR gRNA sequence
ctttatggtcaccctgccta

SEQ ID NO: 97715 - DNA, 20 bp, Artificial
  CRISPR gRNA sequence
tatggtcaccctgcctatgg

SEQ ID NO: 97716 - DNA, 20 bp, Artificial
  CRISPR gRNA sequence
atggtcaccctgcctatgga

SEQ ID NO: 97717 - DNA, 20 bp, Artificial
  CRISPR gRNA sequence
tggtcaccctgcctatggaa

SEQ ID NO: 97718 - DNA, 20 bp, Artificial
  CRISPR gRNA sequence
cacccctgctctgtgtgtct

SEQ ID NO: 97719 - DNA, 20 bp, Artificial
  CRISPR gRNA sequence
acccctgctctgtgtgtctc

SEQ ID NO: 97720 - DNA, 20 bp, Artificial
  CRISPR gRNA sequence
gtgtctcaggctgacctttc

SEQ ID NO: 97721 - DNA, 20 bp, Artificial
  CRISPR gRNA sequence
ggctgacctttccggtatcc

SEQ ID NO: 97722 - DNA, 20 bp, Artificial
  CRISPR gRNA sequence
gctgacctttccggtatccc

SEQ ID NO: 97723 - DNA, 20 bp, Artificial
  CRISPR gRNA sequence
ctgacctttccggtatccca

SEQ ID NO: 97724 - DNA, 20 bp, Artificial
  CRISPR gRNA sequence
tttccggtatcccagggcca

SEQ ID NO: 97725 - DNA, 20 bp, Artificial
  CRISPR gRNA sequence
cggtatcccagggccacggc

SEQ ID NO: 97726 - DNA, 20 bp, Artificial
  CRISPR gRNA sequence
ggtatcccagggccacggca

SEQ ID NO: 97727 - DNA, 20 bp, Artificial
  CRISPR gRNA sequence
agggccacggcaaggtccat

SEQ ID NO: 97728 - DNA, 20 bp, Artificial
  CRISPR gRNA sequence
gggccacggcaaggtccatc

SEQ ID NO: 97729 - DNA, 20 bp, Artificial
  CRISPR gRNA sequence
ggccacggcaaggtccatcg

SEQ ID NO: 97730 - DNA, 20 bp, Artificial
  CRISPR gRNA sequence
cggcaaggtccatcggggtg

SEQ ID NO: 97731 - DNA, 20 bp, Artificial
  CRISPR gRNA sequence
aaggtccatcggggtgtagc

SEQ ID NO: 97732 - DNA, 20 bp, Artificial
  CRISPR gRNA sequence
ggtccatcggggtgtagcca

SEQ ID NO: 97733 - DNA, 20 bp, Artificial
  CRISPR gRNA sequence
catcggggtgtagccagagt

SEQ ID NO: 97734 - DNA, 20 bp, Artificial
  CRISPR gRNA sequence
ggtgtagccagagtcggctt

SEQ ID NO: 97735 - DNA, 20 bp, Artificial
  CRISPR gRNA sequence
gtagccagagtcggcttcgg

SEQ ID NO: 97736 - DNA, 20 bp, Artificial
  CRISPR gRNA sequence
ccagagtcggcttcggtggt

SEQ ID NO: 97737 - DNA, 20 bp, Artificial
  CRISPR gRNA sequence
cagagtcggcttcggtggtg

SEQ ID NO: 97738 - DNA, 20 bp, Artificial
  CRISPR gRNA sequence
gtcggcttcggtggtgaggt

SEQ ID NO: 97739 - DNA, 20 bp, Artificial
  CRISPR gRNA sequence
cggtggtgaggtcagcgcct

SEQ ID NO: 97740 - DNA, 20 bp, Artificial
  CRISPR gRNA sequence
ggtggtgaggtcagcgcctc

SEQ ID NO: 97741 - DNA, 20 bp, Artificial
  CRISPR gRNA sequence
ggtcagcgcctcgggctgca

SEQ ID NO: 97742 - DNA, 20 bp, Artificial
  CRISPR gRNA sequence
gtcagcgcctcgggctgcaa

SEQ ID NO: 97743 - DNA, 20 bp, Artificial
  CRISPR gRNA sequence
cagcgcctcgggctgcaaag

SEQ ID NO: 97744 - DNA, 20 bp, Artificial
  CRISPR gRNA sequence
gcgcctcgggctgcaaagga

SEQ ID NO: 97745 - DNA, 20 bp, Artificial
  CRISPR gRNA sequence
cgcctcgggctgcaaaggag

SEQ ID NO: 97746 - DNA, 20 bp, Artificial
  CRISPR gRNA sequence
gcctcgggctgcaaaggaga

SEQ ID NO: 97747 - DNA, 20 bp, Artificial
  CRISPR gRNA sequence
cctcgggctgcaaaggagag

SEQ ID NO: 97748 - DNA, 20 bp, Artificial
  CRISPR gRNA sequence
tcgggctgcaaaggagaggg

SEQ ID NO: 97749 - DNA, 20 bp, Artificial
  CRISPR gRNA sequence
cgggctgcaaaggagagggg

SEQ ID NO: 97750 - DNA, 20 bp, Artificial
  CRISPR gRNA sequence
gggctgcaaaggagagggga

SEQ ID NO: 97751 - DNA, 20 bp, Artificial
  CRISPR gRNA sequence
caaaggagaggggagggcgc

SEQ ID NO: 97752 - DNA, 20 bp, Artificial
  CRISPR gRNA sequence
aaggagaggggagggcgctg

SEQ ID NO: 97753 - DNA, 20 bp, Artificial
  CRISPR gRNA sequence
aggagaggggagggcgctgg

SEQ ID NO: 97754 - DNA, 20 bp, Artificial
  CRISPR gRNA sequence
ggagaggggagggcgctgga

SEQ ID NO: 97755 - DNA, 20 bp, Artificial
  CRISPR gRNA sequence
gaggggagggcgctggaggg

SEQ ID NO: 97756 - DNA, 20 bp, Artificial
  CRISPR gRNA sequence
aggggagggcgctggagggt

SEQ ID NO: 97757 - DNA, 20 bp, Artificial
  CRISPR gRNA sequence
ggggagggcgctggagggtg

SEQ ID NO: 97758 - DNA, 20 bp, Artificial
  CRISPR gRNA sequence
gggcgctggagggtggggcc

SEQ ID NO: 97759 - DNA, 20 bp, Artificial
  CRISPR gRNA sequence
ggcgctggagggtggggcct

SEQ ID NO: 97760 - DNA, 20 bp, Artificial
  CRISPR gRNA sequence
cgctggagggtggggcctgg

SEQ ID NO: 97761 - DNA, 20 bp, Artificial
  CRISPR gRNA sequence
gagggtggggcctgggagtc

SEQ ID NO: 97762 - DNA, 20 bp, Artificial
  CRISPR gRNA sequence
tggggcctgggagtccagaa

SEQ ID NO: 97763 - DNA, 20 bp, Artificial
  CRISPR gRNA sequence
ggggcctgggagtccagaat

SEQ ID NO: 97764 - DNA, 20 bp, Artificial
  CRISPR gRNA sequence
gggcctgggagtccagaatg

SEQ ID NO: 97765 - DNA, 20 bp, Artificial
  CRISPR gRNA sequence
tgggagtccagaatggggtc

SEQ ID NO: 97766 - DNA, 20 bp, Artificial
  CRISPR gRNA sequence
gggagtccagaatggggtct

SEQ ID NO: 97767 - DNA, 20 bp, Artificial
  CRISPR gRNA sequence
ggagtccagaatggggtctg

SEQ ID NO: 97768 - DNA, 20 bp, Artificial
  CRISPR gRNA sequence
cagaatggggtctggggacc

SEQ ID NO: 97769 - DNA, 20 bp, Artificial
  CRISPR gRNA sequence
agaatggggtctggggacct

SEQ ID NO: 97770 - DNA, 20 bp, Artificial
  CRISPR gRNA sequence
aatggggtctggggacctgg

SEQ ID NO: 97771 - DNA, 20 bp, Artificial
  CRISPR gRNA sequence
tggggacctgggagatccca

SEQ ID NO: 97772 - DNA, 20 bp, Artificial
  CRISPR gRNA sequence
acccctcattccccacaatg

SEQ ID NO: 97773 - DNA, 20 bp, Artificial
  CRISPR gRNA sequence
cattccccacaatgcagccg

SEQ ID NO: 97774 - DNA, 20 bp, Artificial
  CRISPR gRNA sequence
attccccacaatgcagccgt

SEQ ID NO: 97775 - DNA, 20 bp, Artificial
  CRISPR gRNA sequence
gggtctgcccgttgcccatg

SEQ ID NO: 97776 - DNA, 20 bp, Artificial
  CRISPR gRNA sequence
ttgcccatgtggcctttgac

SEQ ID NO: 97777 - DNA, 20 bp, Artificial
  CRISPR gRNA sequence
tgcccatgtggcctttgaca

SEQ ID NO: 97778 - DNA, 20 bp, Artificial
  CRISPR gRNA sequence
gcccatgtggcctttgacaa

SEQ ID NO: 97779 - DNA, 20 bp, Artificial
  CRISPR gRNA sequence
gggtccaacctctgctatct

SEQ ID NO: 97780 - DNA, 20 bp, Artificial
  CRISPR gRNA sequence
tgctatcttggtctccactg

SEQ ID NO: 97781 - DNA, 20 bp, Artificial
  CRISPR gRNA sequence
ttggtctccactgaagaacg

SEQ ID NO: 97782 - DNA, 20 bp, Artificial
  CRISPR gRNA sequence
tccactgaagaacgtggctg

SEQ ID NO: 97783 - DNA, 20 bp, Artificial
  CRISPR gRNA sequence
ccactgaagaacgtggctga

SEQ ID NO: 97784 - DNA, 20 bp, Artificial
  CRISPR gRNA sequence
cactgaagaacgtggctgaa

SEQ ID NO: 97785 - DNA, 20 bp, Artificial
  CRISPR gRNA sequence
gctgaagggtctctgaacca

SEQ ID NO: 97786 - DNA, 20 bp, Artificial
  CRISPR gRNA sequence
tgaagggtctctgaaccatg

SEQ ID NO: 97787 - DNA, 20 bp, Artificial
  CRISPR gRNA sequence
gaagggtctctgaaccatgg

SEQ ID NO: 97788 - DNA, 20 bp, Artificial
  CRISPR gRNA sequence
ggtctctgaaccatggagga

SEQ ID NO: 97789 - DNA, 20 bp, Artificial
  CRISPR gRNA sequence
tctctgaaccatggaggatg

SEQ ID NO: 97790 - DNA, 20 bp, Artificial
  CRISPR gRNA sequence
ctctgaaccatggaggatgg

SEQ ID NO: 97791 - DNA, 20 bp, Artificial
  CRISPR gRNA sequence
ccatggaggatggaggtgct

SEQ ID NO: 97792 - DNA, 20 bp, Artificial
  CRISPR gRNA sequence
gatggaggtgcttagcctct

SEQ ID NO: 97793 - DNA, 20 bp, Artificial
  CRISPR gRNA sequence
gaggtgcttagcctcttggc

SEQ ID NO: 97794 - DNA, 20 bp, Artificial
  CRISPR gRNA sequence
tcttggccagatcctaaacc

SEQ ID NO: 97795 - DNA, 20 bp, Artificial
  CRISPR gRNA sequence
cccagaccccgactcccgtg

SEQ ID NO: 97796 - DNA, 20 bp, Artificial
  CRISPR gRNA sequence
tcccctctgatccatcctcc

SEQ ID NO: 97797 - DNA, 20 bp, Artificial
  CRISPR gRNA sequence
cctctgatccatcctccgag

SEQ ID NO: 97798 - DNA, 20 bp, Artificial
  CRISPR gRNA sequence
tctgatccatcctccgagaa

SEQ ID NO: 97799 - DNA, 20 bp, Artificial
  CRISPR gRNA sequence
gatccatcctccgagaagag

SEQ ID NO: 97800 - DNA, 20 bp, Artificial
  CRISPR gRNA sequence
atccatcctccgagaagagc

SEQ ID NO: 97801 - DNA, 20 bp, Artificial
  CRISPR gRNA sequence
catcctccgagaagagcagg

SEQ ID NO: 97802 - DNA, 20 bp, Artificial
  CRISPR gRNA sequence
atcctccgagaagagcaggc

SEQ ID NO: 97803 - DNA, 20 bp, Artificial
  CRISPR gRNA sequence
tcctccgagaagagcaggca

SEQ ID NO: 97804 - DNA, 20 bp, Artificial
  CRISPR gRNA sequence
aggcagggactacctgctcc

SEQ ID NO: 97805 - DNA, 20 bp, Artificial
  CRISPR gRNA sequence
acctgctccaagaactcttc

SEQ ID NO: 97806 - DNA, 20 bp, Artificial
  CRISPR gRNA sequence
agaactcttcaagcaacact

SEQ ID NO: 97807 - DNA, 20 bp, Artificial
  CRISPR gRNA sequence
gaactcttcaagcaacactt

SEQ ID NO: 97808 - DNA, 20 bp, Artificial
  CRISPR gRNA sequence
cttgggcgtctccctgccct

SEQ ID NO: 97809 - DNA, 20 bp, Artificial
  CRISPR gRNA sequence
ttgggcgtctccctgccctc

SEQ ID NO: 97810 - DNA, 20 bp, Artificial
  CRISPR gRNA sequence
ccctgccctcaggattcccg

SEQ ID NO: 97811 - DNA, 20 bp, Artificial
  CRISPR gRNA sequence
cctgccctcaggattcccgc

SEQ ID NO: 97812 - DNA, 20 bp, Artificial
  CRISPR gRNA sequence
ctgccctcaggattcccgca

SEQ ID NO: 97813 - DNA, 20 bp, Artificial
  CRISPR gRNA sequence
aggattcccgcagggcccgc

SEQ ID NO: 97814 - DNA, 20 bp, Artificial
  CRISPR gRNA sequence
gattcccgcagggcccgctg

SEQ ID NO: 97815 - DNA, 20 bp, Artificial
  CRISPR gRNA sequence
cgcagggcccgctggagtgc

SEQ ID NO: 97816 - DNA, 20 bp, Artificial
  CRISPR gRNA sequence
gcagggcccgctggagtgct

SEQ ID NO: 97817 - DNA, 20 bp, Artificial
  CRISPR gRNA sequence
cagggcccgctggagtgctg

SEQ ID NO: 97818 - DNA, 20 bp, Artificial
  CRISPR gRNA sequence
cgctggagtgctggggcccc

SEQ ID NO: 97819 - DNA, 20 bp, Artificial
  CRISPR gRNA sequence
gctggagtgctggggccccc

SEQ ID NO: 97820 - DNA, 20 bp, Artificial
  CRISPR gRNA sequence
ctggagtgctggggccccca

SEQ ID NO: 97821 - DNA, 20 bp, Artificial
  CRISPR gRNA sequence
actcccgactcccactcacc

SEQ ID NO: 97822 - DNA, 20 bp, Artificial
  CRISPR gRNA sequence
ccgactcccactcacccagc

SEQ ID NO: 97823 - DNA, 20 bp, Artificial
  CRISPR gRNA sequence
cgactcccactcacccagca

SEQ ID NO: 97824 - DNA, 20 bp, Artificial
  CRISPR gRNA sequence
aggcctcaacgcatttcacg

SEQ ID NO: 97825 - DNA, 20 bp, Artificial
  CRISPR gRNA sequence
tttcacgtggttcccgcgca

SEQ ID NO: 97826 - DNA, 20 bp, Artificial
  CRISPR gRNA sequence
tggttcccgcgcacagcgta

SEQ ID NO: 97827 - DNA, 20 bp, Artificial
  CRISPR gRNA sequence
ttcccgcgcacagcgtacag

SEQ ID NO: 97828 - DNA, 20 bp, Artificial
  CRISPR gRNA sequence
ccgcgcacagcgtacagcag

SEQ ID NO: 97829 - DNA, 20 bp, Artificial
  CRISPR gRNA sequence
ggcgtccctccattctgtcg

SEQ ID NO: 97830 - DNA, 20 bp, Artificial
  CRISPR gRNA sequence
gcgtccctccattctgtcgt

SEQ ID NO: 97831 - DNA, 20 bp, Artificial
  CRISPR gRNA sequence
tccctccattctgtcgtggg

SEQ ID NO: 97832 - DNA, 20 bp, Artificial
  CRISPR gRNA sequence
ccctccattctgtcgtgggt

SEQ ID NO: 97833 - DNA, 20 bp, Artificial
  CRISPR gRNA sequence
cctccattctgtcgtgggta

SEQ ID NO: 97834 - DNA, 20 bp, Artificial
  CRISPR gRNA sequence
ctccattctgtcgtgggtag

SEQ ID NO: 97835 - DNA, 20 bp, Artificial
  CRISPR gRNA sequence
cattctgtcgtgggtagggg

SEQ ID NO: 97836 - DNA, 20 bp, Artificial
  CRISPR gRNA sequence
attctgtcgtgggtaggggc

SEQ ID NO: 97837 - DNA, 20 bp, Artificial
  CRISPR gRNA sequence
tctgtcgtgggtaggggcag

SEQ ID NO: 97838 - DNA, 20 bp, Artificial
  CRISPR gRNA sequence
ggtaggggcaggagaaacca

SEQ ID NO: 97839 - DNA, 20 bp, Artificial
  CRISPR gRNA sequence
gtaggggcaggagaaaccaa

SEQ ID NO: 97840 - DNA, 20 bp, Artificial
  CRISPR gRNA sequence
tcaaaatgccttgtactctc

SEQ ID NO: 97841 - DNA, 20 bp, Artificial
  CRISPR gRNA sequence
gccttgtactctctggcctc

SEQ ID NO: 97842 - DNA, 20 bp, Artificial
  CRISPR gRNA sequence
ctctggcctccagttgaacg

SEQ ID NO: 97843 - DNA, 20 bp, Artificial
  CRISPR gRNA sequence
tggttcctcctgctcatcac

SEQ ID NO: 97844 - DNA, 20 bp, Artificial
  CRISPR gRNA sequence
ggttcctcctgctcatcact

SEQ ID NO: 97845 - DNA, 20 bp, Artificial
  CRISPR gRNA sequence
actgggcccatctcactttc

SEQ ID NO: 97846 - DNA, 20 bp, Artificial
  CRISPR gRNA sequence
ctgggcccatctcactttct

SEQ ID NO: 97847 - DNA, 20 bp, Artificial
  CRISPR gRNA sequence
tgggcccatctcactttctg

SEQ ID NO: 97848 - DNA, 20 bp, Artificial
  CRISPR gRNA sequence
atctcactttctggggtctc

SEQ ID NO: 97849 - DNA, 20 bp, Artificial
  CRISPR gRNA sequence
actttctggggtctcaagct

SEQ ID NO: 97850 - DNA, 20 bp, Artificial
  CRISPR gRNA sequence
caagcttagacaccttcctc

SEQ ID NO: 97851 - DNA, 20 bp, Artificial
  CRISPR gRNA sequence
aagcttagacaccttcctcc

SEQ ID NO: 97852 - DNA, 20 bp, Artificial
  CRISPR gRNA sequence
cttagacaccttcctccagg

SEQ ID NO: 97853 - DNA, 20 bp, Artificial
  CRISPR gRNA sequence
tctgatttcccttgcccaca

SEQ ID NO: 97854 - DNA, 20 bp, Artificial
  CRISPR gRNA sequence
ctgatttcccttgcccacat

SEQ ID NO: 97855 - DNA, 20 bp, Artificial
  CRISPR gRNA sequence
tgatttcccttgcccacatg

SEQ ID NO: 97856 - DNA, 20 bp, Artificial
  CRISPR gRNA sequence
ttgcccacatggggctcttg

SEQ ID NO: 97857 - DNA, 20 bp, Artificial
  CRISPR gRNA sequence
cacctgtgcatctgccatcg

SEQ ID NO: 97858 - DNA, 20 bp, Artificial
  CRISPR gRNA sequence
gtgcatctgccatcgcagcg

SEQ ID NO: 97859 - DNA, 20 bp, Artificial
  CRISPR gRNA sequence
cagcgcagttcactgcatct

SEQ ID NO: 97860 - DNA, 20 bp, Artificial
  CRISPR gRNA sequence
ccatgtctgccttccctgca

SEQ ID NO: 97861 - DNA, 20 bp, Artificial
  CRISPR gRNA sequence
catgtctgccttccctgcat

SEQ ID NO: 97862 - DNA, 20 bp, Artificial
  CRISPR gRNA sequence
atgtctgccttccctgcatg

SEQ ID NO: 97863 - DNA, 20 bp, Artificial
  CRISPR gRNA sequence
gtctgccttccctgcatggg

SEQ ID NO: 97864 - DNA, 20 bp, Artificial
  CRISPR gRNA sequence
catggggagctctgctctgt

SEQ ID NO: 97865 - DNA, 20 bp, Artificial
  CRISPR gRNA sequence
atggggagctctgctctgtg

SEQ ID NO: 97866 - DNA, 20 bp, Artificial
  CRISPR gRNA sequence
ggagctctgctctgtgaggc

SEQ ID NO: 97867 - DNA, 20 bp, Artificial
  CRISPR gRNA sequence
gagctctgctctgtgaggct

SEQ ID NO: 97868 - DNA, 20 bp, Artificial
  CRISPR gRNA sequence
ctgctctgtgaggctgggaa

SEQ ID NO: 97869 - DNA, 20 bp, Artificial
  CRISPR gRNA sequence
tgctctgtgaggctgggaat

SEQ ID NO: 97870 - DNA, 20 bp, Artificial
  CRISPR gRNA sequence
gctctgtgaggctgggaatg

SEQ ID NO: 97871 - DNA, 20 bp, Artificial
  CRISPR gRNA sequence
atggggctgtctcgtgttct

SEQ ID NO: 97872 - DNA, 20 bp, Artificial
  CRISPR gRNA sequence
tgtctcgtgttctcggcacc

SEQ ID NO: 97873 - DNA, 20 bp, Artificial
  CRISPR gRNA sequence
tctcgtgttctcggcaccta

SEQ ID NO: 97874 - DNA, 20 bp, Artificial
  CRISPR gRNA sequence
cgtgttctcggcacctagag

SEQ ID NO: 97875 - DNA, 20 bp, Artificial
  CRISPR gRNA sequence
gtgttctcggcacctagagc

SEQ ID NO: 97876 - DNA, 20 bp, Artificial
  CRISPR gRNA sequence
agagcaggcctgcacctttc

SEQ ID NO: 97877 - DNA, 20 bp, Artificial
  CRISPR gRNA sequence
caagtactctgtgaacattt

SEQ ID NO: 97878 - DNA, 20 bp, Artificial
  CRISPR gRNA sequence
aagtactctgtgaacatttg

SEQ ID NO: 97879 - DNA, 20 bp, Artificial
  CRISPR gRNA sequence
tactctgtgaacatttgagg

SEQ ID NO: 97880 - DNA, 20 bp, Artificial
  CRISPR gRNA sequence
actctgtgaacatttgaggc

SEQ ID NO: 97881 - DNA, 20 bp, Artificial
  CRISPR gRNA sequence
gaacatttgaggcaggaatg

SEQ ID NO: 97882 - DNA, 20 bp, Artificial
  CRISPR gRNA sequence
aacatttgaggcaggaatga

SEQ ID NO: 97883 - DNA, 20 bp, Artificial
  CRISPR gRNA sequence
tttgaggcaggaatgaaggc

SEQ ID NO: 97884 - DNA, 20 bp, Artificial
  CRISPR gRNA sequence
ttgaggcaggaatgaaggcc

SEQ ID NO: 97885 - DNA, 20 bp, Artificial
  CRISPR gRNA sequence
gaggcaggaatgaaggccag

SEQ ID NO: 97886 - DNA, 20 bp, Artificial
  CRISPR gRNA sequence
aggcaggaatgaaggccagg

SEQ ID NO: 97887 - DNA, 20 bp, Artificial
  CRISPR gRNA sequence
ggaatgaaggccaggaggct

SEQ ID NO: 97888 - DNA, 20 bp, Artificial
  CRISPR gRNA sequence
aatgaaggccaggaggctga

SEQ ID NO: 97889 - DNA, 20 bp, Artificial
  CRISPR gRNA sequence
atgaaggccaggaggctgag

SEQ ID NO: 97890 - DNA, 20 bp, Artificial
  CRISPR gRNA sequence
gccaggaggctgagaggtcc

SEQ ID NO: 97891 - DNA, 20 bp, Artificial
  CRISPR gRNA sequence
ccaggaggctgagaggtcct

SEQ ID NO: 97892 - DNA, 20 bp, Artificial
  CRISPR gRNA sequence
caggaggctgagaggtcctg

SEQ ID NO: 97893 - DNA, 20 bp, Artificial
  CRISPR gRNA sequence
aggctgagaggtcctgggga

SEQ ID NO: 97894 - DNA, 20 bp, Artificial
  CRISPR gRNA sequence
ggctgagaggtcctggggat

SEQ ID NO: 97895 - DNA, 20 bp, Artificial
  CRISPR gRNA sequence
tgagaggtcctggggatggg

SEQ ID NO: 97896 - DNA, 20 bp, Artificial
  CRISPR gRNA sequence
ggcagtccctcacccaatca

SEQ ID NO: 97897 - DNA, 20 bp, Artificial
  CRISPR gRNA sequence
ttgatgtccacgtcacgctc

SEQ ID NO: 97898 - DNA, 20 bp, Artificial
  CRISPR gRNA sequence
atgtccacgtcacgctccag

SEQ ID NO: 97899 - DNA, 20 bp, Artificial
  CRISPR gRNA sequence
tccacgtcacgctccagcag

SEQ ID NO: 97900 - DNA, 20 bp, Artificial
  CRISPR gRNA sequence
gcagccccacaatgtctgtg

SEQ ID NO: 97901 - DNA, 20 bp, Artificial
  CRISPR gRNA sequence
gtctgtgtagccgcctgtgc

SEQ ID NO: 97902 - DNA, 20 bp, Artificial
  CRISPR gRNA sequence
gtgtagccgcctgtgctggc

SEQ ID NO: 97903 - DNA, 20 bp, Artificial
  CRISPR gRNA sequence
ccgcctgtgctggccagcga

SEQ ID NO: 97904 - DNA, 20 bp, Artificial
  CRISPR gRNA sequence
cgcctgtgctggccagcgac

SEQ ID NO: 97905 - DNA, 20 bp, Artificial
  CRISPR gRNA sequence
gcctgtgctggccagcgaca

SEQ ID NO: 97906 - DNA, 20 bp, Artificial
  CRISPR gRNA sequence
gcgctctctcgctcttttgc

SEQ ID NO: 97907 - DNA, 20 bp, Artificial
  CRISPR gRNA sequence
cgctctctcgctcttttgcc

SEQ ID NO: 97908 - DNA, 20 bp, Artificial
  CRISPR gRNA sequence
ctcgctcttttgccaggatg

SEQ ID NO: 97909 - DNA, 20 bp, Artificial
  CRISPR gRNA sequence
tcgctcttttgccaggatgt

SEQ ID NO: 97910 - DNA, 20 bp, Artificial
  CRISPR gRNA sequence
cgctcttttgccaggatgtg

SEQ ID NO: 97911 - DNA, 20 bp, Artificial
  CRISPR gRNA sequence
gctcttttgccaggatgtgg

SEQ ID NO: 97912 - DNA, 20 bp, Artificial
  CRISPR gRNA sequence
ttttgccaggatgtgggggt

SEQ ID NO: 97913 - DNA, 20 bp, Artificial
  CRISPR gRNA sequence
atgtgggggtcggcaccctg

SEQ ID NO: 97914 - DNA, 20 bp, Artificial
  CRISPR gRNA sequence
tgtgggggtcggcaccctgc

SEQ ID NO: 97915 - DNA, 20 bp, Artificial
  CRISPR gRNA sequence
gtgggggtcggcaccctgca

SEQ ID NO: 97916 - DNA, 20 bp, Artificial
  CRISPR gRNA sequence
gggggtcggcaccctgcagg

SEQ ID NO: 97917 - DNA, 20 bp, Artificial
  CRISPR gRNA sequence
ggtcggcaccctgcagggag

SEQ ID NO: 97918 - DNA, 20 bp, Artificial
  CRISPR gRNA sequence
cggcaccctgcagggagaag

SEQ ID NO: 97919 - DNA, 20 bp, Artificial
  CRISPR gRNA sequence
ggcaccctgcagggagaaga

SEQ ID NO: 97920 - DNA, 20 bp, Artificial
  CRISPR gRNA sequence
gcaccctgcagggagaagaa

SEQ ID NO: 97921 - DNA, 20 bp, Artificial
  CRISPR gRNA sequence
cctgcagggagaagaaggga

SEQ ID NO: 97922 - DNA, 20 bp, Artificial
  CRISPR gRNA sequence
gcagggagaagaagggacag

SEQ ID NO: 97923 - DNA, 20 bp, Artificial
  CRISPR gRNA sequence
gggagaagaagggacagtgg

SEQ ID NO: 97924 - DNA, 20 bp, Artificial
  CRISPR gRNA sequence
ggagaagaagggacagtggt

SEQ ID NO: 97925 - DNA, 20 bp, Artificial
  CRISPR gRNA sequence
aagaagggacagtggtagga

SEQ ID NO: 97926 - DNA, 20 bp, Artificial
  CRISPR gRNA sequence
gggacagtggtaggatggat

SEQ ID NO: 97927 - DNA, 20 bp, Artificial
  CRISPR gRNA sequence
ggacagtggtaggatggatt

SEQ ID NO: 97928 - DNA, 20 bp, Artificial
  CRISPR gRNA sequence
gacagtggtaggatggattg

SEQ ID NO: 97929 - DNA, 20 bp, Artificial
  CRISPR gRNA sequence
aggatggattggggcataac

SEQ ID NO: 97930 - DNA, 20 bp, Artificial
  CRISPR gRNA sequence
ggatggattggggcataacc

SEQ ID NO: 97931 - DNA, 20 bp, Artificial
  CRISPR gRNA sequence
tggggcataaccaggaatcc

SEQ ID NO: 97932 - DNA, 20 bp, Artificial
  CRISPR gRNA sequence
ggggcataaccaggaatcct

SEQ ID NO: 97933 - DNA, 20 bp, Artificial
  CRISPR gRNA sequence
gggcataaccaggaatcctg

SEQ ID NO: 97934 - DNA, 20 bp, Artificial
  CRISPR gRNA sequence
caggaatcctggggtaccca

SEQ ID NO: 97935 - DNA, 20 bp, Artificial
  CRISPR gRNA sequence
gaatcctggggtacccacag

SEQ ID NO: 97936 - DNA, 20 bp, Artificial
  CRISPR gRNA sequence
cgcatctttttttttttttt

SEQ ID NO: 97937 - DNA, 20 bp, Artificial
  CRISPR gRNA sequence
catctttttttttttttttg

SEQ ID NO: 97938 - DNA, 20 bp, Artificial
  CRISPR gRNA sequence
tttttttttttttttggaga

SEQ ID NO: 97939 - DNA, 20 bp, Artificial
  CRISPR gRNA sequence
tttttttttttttggagata

SEQ ID NO: 97940 - DNA, 20 bp, Artificial
  CRISPR gRNA sequence
tagagtcttgctctgttgcc

SEQ ID NO: 97941 - DNA, 20 bp, Artificial
  CRISPR gRNA sequence
agagtcttgctctgttgccc

SEQ ID NO: 97942 - DNA, 20 bp, Artificial
  CRISPR gRNA sequence
tcttgctctgttgcccaggc

SEQ ID NO: 97943 - DNA, 20 bp, Artificial
  CRISPR gRNA sequence
ttgctctgttgcccaggctg

SEQ ID NO: 97944 - DNA, 20 bp, Artificial
  CRISPR gRNA sequence
ctgttgcccaggctggagtg

SEQ ID NO: 97945 - DNA, 20 bp, Artificial
  CRISPR gRNA sequence
ttgcccaggctggagtgcag

SEQ ID NO: 97946 - DNA, 20 bp, Artificial
  CRISPR gRNA sequence
ggagtgcagtggcgcaatct

SEQ ID NO: 97947 - DNA, 20 bp, Artificial
  CRISPR gRNA sequence
tcactgctacctccgcctcc

SEQ ID NO: 97948 - DNA, 20 bp, Artificial
  CRISPR gRNA sequence
cactgctacctccgcctccc

SEQ ID NO: 97949 - DNA, 20 bp, Artificial
  CRISPR gRNA sequence
ctccgcctcccaggttcaca

SEQ ID NO: 97950 - DNA, 20 bp, Artificial
  CRISPR gRNA sequence
ttcacacagttctcccacct

SEQ ID NO: 97951 - DNA, 20 bp, Artificial
  CRISPR gRNA sequence
agttctcccacctcagcctc

SEQ ID NO: 97952 - DNA, 20 bp, Artificial
  CRISPR gRNA sequence
ttctcccacctcagcctcca

SEQ ID NO: 97953 - DNA, 20 bp, Artificial
  CRISPR gRNA sequence
acctcagcctccagagtacc

SEQ ID NO: 97954 - DNA, 20 bp, Artificial
  CRISPR gRNA sequence
cctcagcctccagagtacct

SEQ ID NO: 97955 - DNA, 20 bp, Artificial
  CRISPR gRNA sequence
ctccagagtacctgggatta

SEQ ID NO: 97956 - DNA, 20 bp, Artificial
  CRISPR gRNA sequence
tccagagtacctgggattac

SEQ ID NO: 97957 - DNA, 20 bp, Artificial
  CRISPR gRNA sequence
caggcacccaccacgacgcc

SEQ ID NO: 97958 - DNA, 20 bp, Artificial
  CRISPR gRNA sequence
ggctaatttttgtatttttt

SEQ ID NO: 97959 - DNA, 20 bp, Artificial
  CRISPR gRNA sequence
taatttttgtatttttttag

SEQ ID NO: 97960 - DNA, 20 bp, Artificial
  CRISPR gRNA sequence
atttttgtatttttttagta

SEQ ID NO: 97961 - DNA, 20 bp, Artificial
  CRISPR gRNA sequence
ttgtatttttttagtagaga

SEQ ID NO: 97962 - DNA, 20 bp, Artificial
  CRISPR gRNA sequence
tgtatttttttagtagagac

SEQ ID NO: 97963 - DNA, 20 bp, Artificial
  CRISPR gRNA sequence
gtatttttttagtagagaca

SEQ ID NO: 97964 - DNA, 20 bp, Artificial
  CRISPR gRNA sequence
agacagggtttcacccatgt

SEQ ID NO: 97965 - DNA, 20 bp, Artificial
  CRISPR gRNA sequence
agggtttcacccatgttggc

SEQ ID NO: 97966 - DNA, 20 bp, Artificial
  CRISPR gRNA sequence
gggtttcacccatgttggcc

SEQ ID NO: 97967 - DNA, 20 bp, Artificial
  CRISPR gRNA sequence
ttcacccatgttggccgggc

SEQ ID NO: 97968 - DNA, 20 bp, Artificial
  CRISPR gRNA sequence
ggtcttgaactcctgacctc

SEQ ID NO: 97969 - DNA, 20 bp, Artificial
  CRISPR gRNA sequence
ctcaagtgatccacccgcct

SEQ ID NO: 97970 - DNA, 20 bp, Artificial
  CRISPR gRNA sequence
ccacccgcctcggcctccca

SEQ ID NO: 97971 - DNA, 20 bp, Artificial
  CRISPR gRNA sequence
gcctcggcctcccaaagtgc

SEQ ID NO: 97972 - DNA, 20 bp, Artificial
  CRISPR gRNA sequence
cctcggcctcccaaagtgct

SEQ ID NO: 97973 - DNA, 20 bp, Artificial
  CRISPR gRNA sequence
ctcccaaagtgctgggatta

SEQ ID NO: 97974 - DNA, 20 bp, Artificial
  CRISPR gRNA sequence
tcccaaagtgctgggattac

SEQ ID NO: 97975 - DNA, 20 bp, Artificial
  CRISPR gRNA sequence
agtgctgggattacaggcat

SEQ ID NO: 97976 - DNA, 20 bp, Artificial
  CRISPR gRNA sequence
caggcatgagccactgcacc

SEQ ID NO: 97977 - DNA, 20 bp, Artificial
  CRISPR gRNA sequence
catgagccactgcacccagc

SEQ ID NO: 97978 - DNA, 20 bp, Artificial
  CRISPR gRNA sequence
gagccactgcacccagccag

SEQ ID NO: 97979 - DNA, 20 bp, Artificial
  CRISPR gRNA sequence
cagccagcagccgcatctca

SEQ ID NO: 97980 - DNA, 20 bp, Artificial
  CRISPR gRNA sequence
agcagccgcatctcaaagac

SEQ ID NO: 97981 - DNA, 20 bp, Artificial
  CRISPR gRNA sequence
gcagccgcatctcaaagaca

SEQ ID NO: 97982 - DNA, 20 bp, Artificial
  CRISPR gRNA sequence
gcatctcaaagacaaggcgc

SEQ ID NO: 97983 - DNA, 20 bp, Artificial
  CRISPR gRNA sequence
tctcaaagacaaggcgccag

SEQ ID NO: 97984 - DNA, 20 bp, Artificial
  CRISPR gRNA sequence
agacaaggcgccagcagaca

SEQ ID NO: 97985 - DNA, 20 bp, Artificial
  CRISPR gRNA sequence
agcagacacagccaaaaccc

SEQ ID NO: 97986 - DNA, 20 bp, Artificial
  CRISPR gRNA sequence
ccaaaaccccagcccaccct

SEQ ID NO: 97987 - DNA, 20 bp, Artificial
  CRISPR gRNA sequence
caaaaccccagcccacccta

SEQ ID NO: 97988 - DNA, 20 bp, Artificial
  CRISPR gRNA sequence
ccagcccaccctaaggcccc

SEQ ID NO: 97989 - DNA, 20 bp, Artificial
  CRISPR gRNA sequence
cagcccaccctaaggccccc

SEQ ID NO: 97990 - DNA, 20 bp, Artificial
  CRISPR gRNA sequence
taaggcccccgggaaccccc

SEQ ID NO: 97991 - DNA, 20 bp, Artificial
  CRISPR gRNA sequence
ccgggaaccccccagctgcc

SEQ ID NO: 97992 - DNA, 20 bp, Artificial
  CRISPR gRNA sequence
gaaccccccagctgcccagc

SEQ ID NO: 97993 - DNA, 20 bp, Artificial
  CRISPR gRNA sequence
aaccccccagctgcccagct

SEQ ID NO: 97994 - DNA, 20 bp, Artificial
  CRISPR gRNA sequence
ccccagctgcccagctgggc

SEQ ID NO: 97995 - DNA, 20 bp, Artificial
  CRISPR gRNA sequence
cccagctgcccagctgggct

SEQ ID NO: 97996 - DNA, 20 bp, Artificial
  CRISPR gRNA sequence
gggctgggacgcacccactc

SEQ ID NO: 97997 - DNA, 20 bp, Artificial
  CRISPR gRNA sequence
ctgggacgcacccactccag

SEQ ID NO: 97998 - DNA, 20 bp, Artificial
  CRISPR gRNA sequence
tgggacgcacccactccagc

SEQ ID NO: 97999 - DNA, 20 bp, Artificial
  CRISPR gRNA sequence
gacgcacccactccagcagg

SEQ ID NO: 98000 - DNA, 20 bp, Artificial
  CRISPR gRNA sequence
ccactccagcaggaagcgaa

SEQ ID NO: 98001 - DNA, 20 bp, Artificial
  CRISPR gRNA sequence
gaacggtctcaatctctcca

SEQ ID NO: 98002 - DNA, 20 bp, Artificial
  CRISPR gRNA sequence
aacggtctcaatctctccaa

SEQ ID NO: 98003 - DNA, 20 bp, Artificial
  CRISPR gRNA sequence
ggtctcaatctctccaaagg

SEQ ID NO: 98004 - DNA, 20 bp, Artificial
  CRISPR gRNA sequence
tctcaatctctccaaaggcg

SEQ ID NO: 98005 - DNA, 20 bp, Artificial
  CRISPR gRNA sequence
ctcaatctctccaaaggcgg

SEQ ID NO: 98006 - DNA, 20 bp, Artificial
  CRISPR gRNA sequence
tctctccaaaggcggaggcc

SEQ ID NO: 98007 - DNA, 20 bp, Artificial
  CRISPR gRNA sequence
ccaaaggcggaggcccagat

SEQ ID NO: 98008 - DNA, 20 bp, Artificial
  CRISPR gRNA sequence
caaaggcggaggcccagatg

SEQ ID NO: 98009 - DNA, 20 bp, Artificial
  CRISPR gRNA sequence
aaaggcggaggcccagatga

SEQ ID NO: 98010 - DNA, 20 bp, Artificial
  CRISPR gRNA sequence
aaggcggaggcccagatgag

SEQ ID NO: 98011 - DNA, 20 bp, Artificial
  CRISPR gRNA sequence
aggcggaggcccagatgagg

SEQ ID NO: 98012 - DNA, 20 bp, Artificial
  CRISPR gRNA sequence
ggcggaggcccagatgaggg

SEQ ID NO: 98013 - DNA, 20 bp, Artificial
  CRISPR gRNA sequence
aggcccagatgaggggggtg

SEQ ID NO: 98014 - DNA, 20 bp, Artificial
  CRISPR gRNA sequence
ggggtgaagccgcgctcgtc

SEQ ID NO: 98015 - DNA, 20 bp, Artificial
  CRISPR gRNA sequence
cgctcgtctggcttgttgac

SEQ ID NO: 98016 - DNA, 20 bp, Artificial
  CRISPR gRNA sequence
gctcgtctggcttgttgacg

SEQ ID NO: 98017 - DNA, 20 bp, Artificial
  CRISPR gRNA sequence
ttgttgacgaggttgtcacc

SEQ ID NO: 98018 - DNA, 20 bp, Artificial
  CRISPR gRNA sequence
ttgacgaggttgtcacctgg

SEQ ID NO: 98019 - DNA, 20 bp, Artificial
  CRISPR gRNA sequence
tgacgaggttgtcacctggc

SEQ ID NO: 98020 - DNA, 20 bp, Artificial
  CRISPR gRNA sequence
acgaggttgtcacctggcag

SEQ ID NO: 98021 - DNA, 20 bp, Artificial
  CRISPR gRNA sequence
cgaggttgtcacctggcagg

SEQ ID NO: 98022 - DNA, 20 bp, Artificial
  CRISPR gRNA sequence
aggttgtcacctggcaggag

SEQ ID NO: 98023 - DNA, 20 bp, Artificial
  CRISPR gRNA sequence
ggttgtcacctggcaggagg

SEQ ID NO: 98024 - DNA, 20 bp, Artificial
  CRISPR gRNA sequence
tgtcacctggcaggaggagg

SEQ ID NO: 98025 - DNA, 20 bp, Artificial
  CRISPR gRNA sequence
gtcacctggcaggaggaggc

SEQ ID NO: 98026 - DNA, 20 bp, Artificial
  CRISPR gRNA sequence
gaggaggcgggcaataccac

SEQ ID NO: 98027 - DNA, 20 bp, Artificial
  CRISPR gRNA sequence
aggaggcgggcaataccacc

SEQ ID NO: 98028 - DNA, 20 bp, Artificial
  CRISPR gRNA sequence
gcacccctgccccctatccc

SEQ ID NO: 98029 - DNA, 20 bp, Artificial
  CRISPR gRNA sequence
ctatccccagtgctgccaaa

SEQ ID NO: 98030 - DNA, 20 bp, Artificial
  CRISPR gRNA sequence
tatccccagtgctgccaaat

SEQ ID NO: 98031 - DNA, 20 bp, Artificial
  CRISPR gRNA sequence
atccccagtgctgccaaatg

SEQ ID NO: 98032 - DNA, 20 bp, Artificial
  CRISPR gRNA sequence
cagtgctgccaaatggggac

SEQ ID NO: 98033 - DNA, 20 bp, Artificial
  CRISPR gRNA sequence
agtgctgccaaatggggacg

SEQ ID NO: 98034 - DNA, 20 bp, Artificial
  CRISPR gRNA sequence
gctgccaaatggggacgagg

SEQ ID NO: 98035 - DNA, 20 bp, Artificial
  CRISPR gRNA sequence
ctgccaaatggggacgaggt

SEQ ID NO: 98036 - DNA, 20 bp, Artificial
  CRISPR gRNA sequence
tgccaaatggggacgaggtg

SEQ ID NO: 98037 - DNA, 20 bp, Artificial
  CRISPR gRNA sequence
gccaaatggggacgaggtgg

SEQ ID NO: 98038 - DNA, 20 bp, Artificial
  CRISPR gRNA sequence
ccaaatggggacgaggtggg

SEQ ID NO: 98039 - DNA, 20 bp, Artificial
  CRISPR gRNA sequence
atggggacgaggtggggggc

SEQ ID NO: 98040 - DNA, 20 bp, Artificial
  CRISPR gRNA sequence
tggggacgaggtggggggct

SEQ ID NO: 98041 - DNA, 20 bp, Artificial
  CRISPR gRNA sequence
ggggacgaggtggggggctg

SEQ ID NO: 98042 - DNA, 20 bp, Artificial
  CRISPR gRNA sequence
acgaggtggggggctggggt

SEQ ID NO: 98043 - DNA, 20 bp, Artificial
  CRISPR gRNA sequence
ggtggggggctggggttaga

SEQ ID NO: 98044 - DNA, 20 bp, Artificial
  CRISPR gRNA sequence
gtggggggctggggttagac

SEQ ID NO: 98045 - DNA, 20 bp, Artificial
  CRISPR gRNA sequence
tggggggctggggttagaca

SEQ ID NO: 98046 - DNA, 20 bp, Artificial
  CRISPR gRNA sequence
ggggggctggggttagacag

SEQ ID NO: 98047 - DNA, 20 bp, Artificial
  CRISPR gRNA sequence
ctggggttagacaggggaat

SEQ ID NO: 98048 - DNA, 20 bp, Artificial
  CRISPR gRNA sequence
tggggttagacaggggaatg

SEQ ID NO: 98049 - DNA, 20 bp, Artificial
  CRISPR gRNA sequence
ggggttagacaggggaatga

SEQ ID NO: 98050 - DNA, 20 bp, Artificial
  CRISPR gRNA sequence
gggttagacaggggaatgag

SEQ ID NO: 98051 - DNA, 20 bp, Artificial
  CRISPR gRNA sequence
ggttagacaggggaatgagg

SEQ ID NO: 98052 - DNA, 20 bp, Artificial
  CRISPR gRNA sequence
ttagacaggggaatgagggg

SEQ ID NO: 98053 - DNA, 20 bp, Artificial
  CRISPR gRNA sequence
tgagggggagcgtatgttga

SEQ ID NO: 98054 - DNA, 20 bp, Artificial
  CRISPR gRNA sequence
ttgatggacatacatgaaca

SEQ ID NO: 98055 - DNA, 20 bp, Artificial
  CRISPR gRNA sequence
catgaacacggtcacacaca

SEQ ID NO: 98056 - DNA, 20 bp, Artificial
  CRISPR gRNA sequence
aacacggtcacacacacagt

SEQ ID NO: 98057 - DNA, 20 bp, Artificial
  CRISPR gRNA sequence
gttagatacaatcatacacg

SEQ ID NO: 98058 - DNA, 20 bp, Artificial
  CRISPR gRNA sequence
atcatacacgtggacactca

SEQ ID NO: 98059 - DNA, 20 bp, Artificial
  CRISPR gRNA sequence
tcatacacgtggacactcac

SEQ ID NO: 98060 - DNA, 20 bp, Artificial
  CRISPR gRNA sequence
acactcacaggtcacgtcat

SEQ ID NO: 98061 - DNA, 20 bp, Artificial
  CRISPR gRNA sequence
ctcacaggtcacgtcatgag

SEQ ID NO: 98062 - DNA, 20 bp, Artificial
  CRISPR gRNA sequence
tcacaggtcacgtcatgagt

SEQ ID NO: 98063 - DNA, 20 bp, Artificial
  CRISPR gRNA sequence
ggtcacgtcatgagtgggta

SEQ ID NO: 98064 - DNA, 20 bp, Artificial
  CRISPR gRNA sequence
ggacacccatatgcacacac

SEQ ID NO: 98065 - DNA, 20 bp, Artificial
  CRISPR gRNA sequence
acccatatgcacacaccagc

SEQ ID NO: 98066 - DNA, 20 bp, Artificial
  CRISPR gRNA sequence
cccatatgcacacaccagcc

SEQ ID NO: 98067 - DNA, 20 bp, Artificial
  CRISPR gRNA sequence
atgcacacaccagccaggtg

SEQ ID NO: 98068 - DNA, 20 bp, Artificial
  CRISPR gRNA sequence
ccagccaggtgcagacatgc

SEQ ID NO: 98069 - DNA, 20 bp, Artificial
  CRISPR gRNA sequence
gacatgccagcacatgtgtg

SEQ ID NO: 98070 - DNA, 20 bp, Artificial
  CRISPR gRNA sequence
cctttccgcaaatgctcctt

SEQ ID NO: 98071 - DNA, 20 bp, Artificial
  CRISPR gRNA sequence
tccgcaaatgctccttcagc

SEQ ID NO: 98072 - DNA, 20 bp, Artificial
  CRISPR gRNA sequence
aaatgctccttcagctggtc

SEQ ID NO: 98073 - DNA, 20 bp, Artificial
  CRISPR gRNA sequence
tccagctccccctgtgctgc

SEQ ID NO: 98074 - DNA, 20 bp, Artificial
  CRISPR gRNA sequence
gctccccctgtgctgcgagc

SEQ ID NO: 98075 - DNA, 20 bp, Artificial
  CRISPR gRNA sequence
ccccctgtgctgcgagctgg

SEQ ID NO: 98076 - DNA, 20 bp, Artificial
  CRISPR gRNA sequence
ctgtgctgcgagctggtgga

SEQ ID NO: 98077 - DNA, 20 bp, Artificial
  CRISPR gRNA sequence
gctgcgagctggtggatgga

SEQ ID NO: 98078 - DNA, 20 bp, Artificial
  CRISPR gRNA sequence
ctgcgagctggtggatggac

SEQ ID NO: 98079 - DNA, 20 bp, Artificial
  CRISPR gRNA sequence
tgcgagctggtggatggaca

SEQ ID NO: 98080 - DNA, 20 bp, Artificial
  CRISPR gRNA sequence
agctggtggatggacagggc

SEQ ID NO: 98081 - DNA, 20 bp, Artificial
  CRISPR gRNA sequence
gctggtggatggacagggct

SEQ ID NO: 98082 - DNA, 20 bp, Artificial
  CRISPR gRNA sequence
ctggtggatggacagggctg

SEQ ID NO: 98083 - DNA, 20 bp, Artificial
  CRISPR gRNA sequence
gtggatggacagggctgggg

SEQ ID NO: 98084 - DNA, 20 bp, Artificial
  CRISPR gRNA sequence
tggatggacagggctggggc

SEQ ID NO: 98085 - DNA, 20 bp, Artificial
  CRISPR gRNA sequence
tggacagggctggggcagga

SEQ ID NO: 98086 - DNA, 20 bp, Artificial
  CRISPR gRNA sequence
gacagggctggggcaggaca

SEQ ID NO: 98087 - DNA, 20 bp, Artificial
  CRISPR gRNA sequence
acagggctggggcaggacag

SEQ ID NO: 98088 - DNA, 20 bp, Artificial
  CRISPR gRNA sequence
gggctggggcaggacagagg

SEQ ID NO: 98089 - DNA, 20 bp, Artificial
  CRISPR gRNA sequence
gctggggcaggacagaggca

SEQ ID NO: 98090 - DNA, 20 bp, Artificial
  CRISPR gRNA sequence
ccccttgcttctctgtgcct

SEQ ID NO: 98091 - DNA, 20 bp, Artificial
  CRISPR gRNA sequence
ctgtccacgattgctcctca

SEQ ID NO: 98092 - DNA, 20 bp, Artificial
  CRISPR gRNA sequence
tgtccacgattgctcctcac

SEQ ID NO: 98093 - DNA, 20 bp, Artificial
  CRISPR gRNA sequence
cctcctactcctctccttgt

SEQ ID NO: 98094 - DNA, 20 bp, Artificial
  CRISPR gRNA sequence
ctcctactcctctccttgtt

SEQ ID NO: 98095 - DNA, 20 bp, Artificial
  CRISPR gRNA sequence
tcctactcctctccttgttg

SEQ ID NO: 98096 - DNA, 20 bp, Artificial
  CRISPR gRNA sequence
cctctccttgttggggaccg

SEQ ID NO: 98097 - DNA, 20 bp, Artificial
  CRISPR gRNA sequence
ctctccttgttggggaccgt

SEQ ID NO: 98098 - DNA, 20 bp, Artificial
  CRISPR gRNA sequence
ggggaccgtgggcccactca

SEQ ID NO: 98099 - DNA, 20 bp, Artificial
  CRISPR gRNA sequence
ccgtgggcccactcacagtc

SEQ ID NO: 98100 - DNA, 20 bp, Artificial
  CRISPR gRNA sequence
cgtgggcccactcacagtct

SEQ ID NO: 98101 - DNA, 20 bp, Artificial
  CRISPR gRNA sequence
gtgggcccactcacagtcta

SEQ ID NO: 98102 - DNA, 20 bp, Artificial
  CRISPR gRNA sequence
ggcccactcacagtctaggg

SEQ ID NO: 98103 - DNA, 20 bp, Artificial
  CRISPR gRNA sequence
cactcacagtctagggtggc

SEQ ID NO: 98104 - DNA, 20 bp, Artificial
  CRISPR gRNA sequence
tcacagtctagggtggccgg

SEQ ID NO: 98105 - DNA, 20 bp, Artificial
  CRISPR gRNA sequence
acagtctagggtggccggca

SEQ ID NO: 98106 - DNA, 20 bp, Artificial
  CRISPR gRNA sequence
acacctcgttccctcgctgc

SEQ ID NO: 98107 - DNA, 20 bp, Artificial
  CRISPR gRNA sequence
ctcgttccctcgctgccggt

SEQ ID NO: 98108 - DNA, 20 bp, Artificial
  CRISPR gRNA sequence
ttccctcgctgccggttggt

SEQ ID NO: 98109 - DNA, 20 bp, Artificial
  CRISPR gRNA sequence
ccctcgctgccggttggtga

SEQ ID NO: 98110 - DNA, 20 bp, Artificial
  CRISPR gRNA sequence
tcgctgccggttggtgagag

SEQ ID NO: 98111 - DNA, 20 bp, Artificial
  CRISPR gRNA sequence
ctgccggttggtgagagtgg

SEQ ID NO: 98112 - DNA, 20 bp, Artificial
  CRISPR gRNA sequence
gccggttggtgagagtggtg

SEQ ID NO: 98113 - DNA, 20 bp, Artificial
  CRISPR gRNA sequence
gtgagagtggtggagtgctt

SEQ ID NO: 98114 - DNA, 20 bp, Artificial
  CRISPR gRNA sequence
tgagagtggtggagtgcttc

SEQ ID NO: 98115 - DNA, 20 bp, Artificial
  CRISPR gRNA sequence
gagagtggtggagtgcttca

SEQ ID NO: 98116 - DNA, 20 bp, Artificial
  CRISPR gRNA sequence
gagtggtggagtgcttcagg

SEQ ID NO: 98117 - DNA, 20 bp, Artificial
  CRISPR gRNA sequence
tgcttcagggagctgcctgc

SEQ ID NO: 98118 - DNA, 20 bp, Artificial
  CRISPR gRNA sequence
gcttcagggagctgcctgct

SEQ ID NO: 98119 - DNA, 20 bp, Artificial
  CRISPR gRNA sequence
gggagctgcctgctgggaaa

SEQ ID NO: 98120 - DNA, 20 bp, Artificial
  CRISPR gRNA sequence
gcctgctgggaaacagacaa

SEQ ID NO: 98121 - DNA, 20 bp, Artificial
  CRISPR gRNA sequence
cctgctgggaaacagacaac

SEQ ID NO: 98122 - DNA, 20 bp, Artificial
  CRISPR gRNA sequence
gggaaacagacaacaggcgt

SEQ ID NO: 98123 - DNA, 20 bp, Artificial
  CRISPR gRNA sequence
aacaggcgtcagtttcccct

SEQ ID NO: 98124 - DNA, 20 bp, Artificial
  CRISPR gRNA sequence
aggcgtcagtttcccctcag

SEQ ID NO: 98125 - DNA, 20 bp, Artificial
  CRISPR gRNA sequence
tcccctcagtagatgtctct

SEQ ID NO: 98126 - DNA, 20 bp, Artificial
  CRISPR gRNA sequence
cccctcagtagatgtctctg

SEQ ID NO: 98127 - DNA, 20 bp, Artificial
  CRISPR gRNA sequence
agtagatgtctctgaggctt

SEQ ID NO: 98128 - DNA, 20 bp, Artificial
  CRISPR gRNA sequence
gtagatgtctctgaggcttc

SEQ ID NO: 98129 - DNA, 20 bp, Artificial
  CRISPR gRNA sequence
atgtctctgaggcttcagga

SEQ ID NO: 98130 - DNA, 20 bp, Artificial
  CRISPR gRNA sequence
tctctgaggcttcaggacag

SEQ ID NO: 98131 - DNA, 20 bp, Artificial
  CRISPR gRNA sequence
ttttgttgctgttgttgttt

SEQ ID NO: 98132 - DNA, 20 bp, Artificial
  CRISPR gRNA sequence
gttgctgttgttgtttgaga

SEQ ID NO: 98133 - DNA, 20 bp, Artificial
  CRISPR gRNA sequence
tgctgttgttgtttgagatg

SEQ ID NO: 98134 - DNA, 20 bp, Artificial
  CRISPR gRNA sequence
tggagtctccgtctgtcccc

SEQ ID NO: 98135 - DNA, 20 bp, Artificial
  CRISPR gRNA sequence
ggagtctccgtctgtccccc

SEQ ID NO: 98136 - DNA, 20 bp, Artificial
  CRISPR gRNA sequence
tctccgtctgtcccccaggc

SEQ ID NO: 98137 - DNA, 20 bp, Artificial
  CRISPR gRNA sequence
tccgtctgtcccccaggctg

SEQ ID NO: 98138 - DNA, 20 bp, Artificial
  CRISPR gRNA sequence
ctgtcccccaggctggagta

SEQ ID NO: 98139 - DNA, 20 bp, Artificial
  CRISPR gRNA sequence
tcccccaggctggagtacag

SEQ ID NO: 98140 - DNA, 20 bp, Artificial
  CRISPR gRNA sequence
ggagtacagtggcgtgatct

SEQ ID NO: 98141 - DNA, 20 bp, Artificial
  CRISPR gRNA sequence
tcactgcaacctctgcctcc

SEQ ID NO: 98142 - DNA, 20 bp, Artificial
  CRISPR gRNA sequence
cactgcaacctctgcctcct

SEQ ID NO: 98143 - DNA, 20 bp, Artificial
  CRISPR gRNA sequence
aacctctgcctcctgggttc

SEQ ID NO: 98144 - DNA, 20 bp, Artificial
  CRISPR gRNA sequence
ttcaagcgattcttgtgcct

SEQ ID NO: 98145 - DNA, 20 bp, Artificial
  CRISPR gRNA sequence
ttcttgtgcctcagcctccc

SEQ ID NO: 98146 - DNA, 20 bp, Artificial
  CRISPR gRNA sequence
ttgtgcctcagcctcccgag

SEQ ID NO: 98147 - DNA, 20 bp, Artificial
  CRISPR gRNA sequence
gcctcagcctcccgagtagc

SEQ ID NO: 98148 - DNA, 20 bp, Artificial
  CRISPR gRNA sequence
cctcagcctcccgagtagct

SEQ ID NO: 98149 - DNA, 20 bp, Artificial
  CRISPR gRNA sequence
ctcccgagtagctgggatca

SEQ ID NO: 98150 - DNA, 20 bp, Artificial
  CRISPR gRNA sequence
tcccgagtagctgggatcat

SEQ ID NO: 98151 - DNA, 20 bp, Artificial
  CRISPR gRNA sequence
taggcgcccaccaccacacc

SEQ ID NO: 98152 - DNA, 20 bp, Artificial
  CRISPR gRNA sequence
ctggctaatttttgtatttt

SEQ ID NO: 98153 - DNA, 20 bp, Artificial
  CRISPR gRNA sequence
gctaatttttgtattttaag

SEQ ID NO: 98154 - DNA, 20 bp, Artificial
  CRISPR gRNA sequence
taatttttgtattttaagta

SEQ ID NO: 98155 - DNA, 20 bp, Artificial
  CRISPR gRNA sequence
ttttgtattttaagtagaga

SEQ ID NO: 98156 - DNA, 20 bp, Artificial
  CRISPR gRNA sequence
tttgtattttaagtagagac

SEQ ID NO: 98157 - DNA, 20 bp, Artificial
  CRISPR gRNA sequence
ttgtattttaagtagagacg

SEQ ID NO: 98158 - DNA, 20 bp, Artificial
  CRISPR gRNA sequence
gagacggggtttcgctatgt

SEQ ID NO: 98159 - DNA, 20 bp, Artificial
  CRISPR gRNA sequence
cggggtttcgctatgttggc

SEQ ID NO: 98160 - DNA, 20 bp, Artificial
  CRISPR gRNA sequence
ggggtttcgctatgttggcc

SEQ ID NO: 98161 - DNA, 20 bp, Artificial
  CRISPR gRNA sequence
ctcaaatcatccacctgcct

SEQ ID NO: 98162 - DNA, 20 bp, Artificial
  CRISPR gRNA sequence
ccacctgcctcagcctccca

SEQ ID NO: 98163 - DNA, 20 bp, Artificial
  CRISPR gRNA sequence
gcctcagcctcccaaagtgc

SEQ ID NO: 98164 - DNA, 20 bp, Artificial
  CRISPR gRNA sequence
cctcagcctcccaaagtgct

SEQ ID NO: 98165 - DNA, 20 bp, Artificial
  CRISPR gRNA sequence
ctcccaaagtgctgggatta

SEQ ID NO: 98166 - DNA, 20 bp, Artificial
  CRISPR gRNA sequence
tcccaaagtgctgggattat

SEQ ID NO: 98167 - DNA, 20 bp, Artificial
  CRISPR gRNA sequence
agtgctgggattataggcat

SEQ ID NO: 98168 - DNA, 20 bp, Artificial
  CRISPR gRNA sequence
taggcatgagccaccacacc

SEQ ID NO: 98169 - DNA, 20 bp, Artificial
  CRISPR gRNA sequence
gagccaccacacccagctat

SEQ ID NO: 98170 - DNA, 20 bp, Artificial
  CRISPR gRNA sequence
agccaccacacccagctatt

SEQ ID NO: 98171 - DNA, 20 bp, Artificial
  CRISPR gRNA sequence
gccaccacacccagctattg

SEQ ID NO: 98172 - DNA, 20 bp, Artificial
  CRISPR gRNA sequence
ttggggtttttttttttttt

SEQ ID NO: 98173 - DNA, 20 bp, Artificial
  CRISPR gRNA sequence
ggttttttttttttttgaga

SEQ ID NO: 98174 - DNA, 20 bp, Artificial
  CRISPR gRNA sequence
ttttttttttttttgagaca

SEQ ID NO: 98175 - DNA, 20 bp, Artificial
  CRISPR gRNA sequence
cagagtcttgctctgttgtc

SEQ ID NO: 98176 - DNA, 20 bp, Artificial
  CRISPR gRNA sequence
agagtcttgctctgttgtcc

SEQ ID NO: 98177 - DNA, 20 bp, Artificial
  CRISPR gRNA sequence
tcttgctctgttgtccaggc

SEQ ID NO: 98178 - DNA, 20 bp, Artificial
  CRISPR gRNA sequence
ttgctctgttgtccaggctg

SEQ ID NO: 98179 - DNA, 20 bp, Artificial
  CRISPR gRNA sequence
ctgttgtccaggctggagtg

SEQ ID NO: 98180 - DNA, 20 bp, Artificial
  CRISPR gRNA sequence
ttgtccaggctggagtgcgg

SEQ ID NO: 98181 - DNA, 20 bp, Artificial
  CRISPR gRNA sequence
ggagtgcggtggtgtgatca

SEQ ID NO: 98182 - DNA, 20 bp, Artificial
  CRISPR gRNA sequence
ggtgtgatcacagttcactt

SEQ ID NO: 98183 - DNA, 20 bp, Artificial
  CRISPR gRNA sequence
tcacttcagcctcaacctcc

SEQ ID NO: 98184 - DNA, 20 bp, Artificial
  CRISPR gRNA sequence
cacttcagcctcaacctcct

SEQ ID NO: 98185 - DNA, 20 bp, Artificial
  CRISPR gRNA sequence
agcctcaacctcctgggctc

SEQ ID NO: 98186 - DNA, 20 bp, Artificial
  CRISPR gRNA sequence
ctcaagccaacctcccacct

SEQ ID NO: 98187 - DNA, 20 bp, Artificial
  CRISPR gRNA sequence
acctcccacctcagcctcct

SEQ ID NO: 98188 - DNA, 20 bp, Artificial
  CRISPR gRNA sequence
tcccacctcagcctcctgag

SEQ ID NO: 98189 - DNA, 20 bp, Artificial
  CRISPR gRNA sequence
ctcctgagcagctgaaacta

SEQ ID NO: 98190 - DNA, 20 bp, Artificial
  CRISPR gRNA sequence
tcctgagcagctgaaactac

SEQ ID NO: 98191 - DNA, 20 bp, Artificial
  CRISPR gRNA sequence
actacaggtgccaccatacc

SEQ ID NO: 98192 - DNA, 20 bp, Artificial
  CRISPR gRNA sequence
aattaaaaatatatatatat

SEQ ID NO: 98193 - DNA, 20 bp, Artificial
  CRISPR gRNA sequence
taaaaatatatatatattgg

SEQ ID NO: 98194 - DNA, 20 bp, Artificial
  CRISPR gRNA sequence
aaaatatatatatattggta

SEQ ID NO: 98195 - DNA, 20 bp, Artificial
  CRISPR gRNA sequence
tatatatatattggtagaga

SEQ ID NO: 98196 - DNA, 20 bp, Artificial
  CRISPR gRNA sequence
tatatatattggtagagatg

SEQ ID NO: 98197 - DNA, 20 bp, Artificial
  CRISPR gRNA sequence
tggagtcttgctctgtcgcc

SEQ ID NO: 98198 - DNA, 20 bp, Artificial
  CRISPR gRNA sequence
ggagtcttgctctgtcgccc

SEQ ID NO: 98199 - DNA, 20 bp, Artificial
  CRISPR gRNA sequence
tcttgctctgtcgcccaggc

SEQ ID NO: 98200 - DNA, 20 bp, Artificial
  CRISPR gRNA sequence
ccaggctggtctcaaactcc

SEQ ID NO: 98201 - DNA, 20 bp, Artificial
  CRISPR gRNA sequence
caggctggtctcaaactcct

SEQ ID NO: 98202 - DNA, 20 bp, Artificial
  CRISPR gRNA sequence
ggtctcaaactcctgggctc

SEQ ID NO: 98203 - DNA, 20 bp, Artificial
  CRISPR gRNA sequence
ctcaagcaattctcctgccg

SEQ ID NO: 98204 - DNA, 20 bp, Artificial
  CRISPR gRNA sequence
tctcctgccgtggcctccca

SEQ ID NO: 98205 - DNA, 20 bp, Artificial
  CRISPR gRNA sequence
gccgtggcctcccaaagtgc

SEQ ID NO: 98206 - DNA, 20 bp, Artificial
  CRISPR gRNA sequence
ccgtggcctcccaaagtgct

SEQ ID NO: 98207 - DNA, 20 bp, Artificial
  CRISPR gRNA sequence
ctcccaaagtgctgggatta

SEQ ID NO: 98208 - DNA, 20 bp, Artificial
  CRISPR gRNA sequence
tcccaaagtgctgggattac

SEQ ID NO: 98209 - DNA, 20 bp, Artificial
  CRISPR gRNA sequence
agtgctgggattacaggcat

SEQ ID NO: 98210 - DNA, 20 bp, Artificial
  CRISPR gRNA sequence
agctaccatgctactgcctt

SEQ ID NO: 98211 - DNA, 20 bp, Artificial
  CRISPR gRNA sequence
tactgccttcggtatctccc

SEQ ID NO: 98212 - DNA, 20 bp, Artificial
  CRISPR gRNA sequence
actgccttcggtatctccct

SEQ ID NO: 98213 - DNA, 20 bp, Artificial
  CRISPR gRNA sequence
ctgccttcggtatctccctg

SEQ ID NO: 98214 - DNA, 20 bp, Artificial
  CRISPR gRNA sequence
tcggtatctccctggggtct

SEQ ID NO: 98215 - DNA, 20 bp, Artificial
  CRISPR gRNA sequence
ggtatctccctggggtcttg

SEQ ID NO: 98216 - DNA, 20 bp, Artificial
  CRISPR gRNA sequence
ctggggtcttggagctacca

SEQ ID NO: 98217 - DNA, 20 bp, Artificial
  CRISPR gRNA sequence
tggggtcttggagctaccaa

SEQ ID NO: 98218 - DNA, 20 bp, Artificial
  CRISPR gRNA sequence
ggtcttggagctaccaaagg

SEQ ID NO: 98219 - DNA, 20 bp, Artificial
  CRISPR gRNA sequence
gagctaccaaaggcagtgcc

SEQ ID NO: 98220 - DNA, 20 bp, Artificial
  CRISPR gRNA sequence
agctaccaaaggcagtgcct

SEQ ID NO: 98221 - DNA, 20 bp, Artificial
  CRISPR gRNA sequence
actctactctcttgaatacc

SEQ ID NO: 98222 - DNA, 20 bp, Artificial
  CRISPR gRNA sequence
ctctactctcttgaataccc

SEQ ID NO: 98223 - DNA, 20 bp, Artificial
  CRISPR gRNA sequence
tctactctcttgaataccca

SEQ ID NO: 98224 - DNA, 20 bp, Artificial
  CRISPR gRNA sequence
gcatctttctcctccctgcc

SEQ ID NO: 98225 - DNA, 20 bp, Artificial
  CRISPR gRNA sequence
tccctgcctggcaatgttct

SEQ ID NO: 98226 - DNA, 20 bp, Artificial
  CRISPR gRNA sequence
tggcaatgttctgagcaaac

SEQ ID NO: 98227 - DNA, 20 bp, Artificial
  CRISPR gRNA sequence
tgttctgagcaaacaagaca

SEQ ID NO: 98228 - DNA, 20 bp, Artificial
  CRISPR gRNA sequence
aagacatagtttttgccctc

SEQ ID NO: 98229 - DNA, 20 bp, Artificial
  CRISPR gRNA sequence
agacatagtttttgccctct

SEQ ID NO: 98230 - DNA, 20 bp, Artificial
  CRISPR gRNA sequence
gacatagtttttgccctcta

SEQ ID NO: 98231 - DNA, 20 bp, Artificial
  CRISPR gRNA sequence
catagtttttgccctctagg

SEQ ID NO: 98232 - DNA, 20 bp, Artificial
  CRISPR gRNA sequence
gtttttgccctctagggagt

SEQ ID NO: 98233 - DNA, 20 bp, Artificial
  CRISPR gRNA sequence
tttttgccctctagggagtc

SEQ ID NO: 98234 - DNA, 20 bp, Artificial
  CRISPR gRNA sequence
ttttgccctctagggagtcg

SEQ ID NO: 98235 - DNA, 20 bp, Artificial
  CRISPR gRNA sequence
tttgccctctagggagtcgg

SEQ ID NO: 98236 - DNA, 20 bp, Artificial
  CRISPR gRNA sequence
cctctagggagtcgggggtc

SEQ ID NO: 98237 - DNA, 20 bp, Artificial
  CRISPR gRNA sequence
ctagggagtcgggggtcaag

SEQ ID NO: 98238 - DNA, 20 bp, Artificial
  CRISPR gRNA sequence
tagggagtcgggggtcaagt

SEQ ID NO: 98239 - DNA, 20 bp, Artificial
  CRISPR gRNA sequence
cgggggtcaagtaggtgcat

SEQ ID NO: 98240 - DNA, 20 bp, Artificial
  CRISPR gRNA sequence
tcaagtaggtgcatcagaca

SEQ ID NO: 98241 - DNA, 20 bp, Artificial
  CRISPR gRNA sequence
aagtaggtgcatcagacata

SEQ ID NO: 98242 - DNA, 20 bp, Artificial
  CRISPR gRNA sequence
gagaaataataaaaaacttc

SEQ ID NO: 98243 - DNA, 20 bp, Artificial
  CRISPR gRNA sequence
aaaaaacttcaagttgaaat

SEQ ID NO: 98244 - DNA, 20 bp, Artificial
  CRISPR gRNA sequence
aagttgaaataagtgttcaa

SEQ ID NO: 98245 - DNA, 20 bp, Artificial
  CRISPR gRNA sequence
ataagtgttcaaaagaactt

SEQ ID NO: 98246 - DNA, 20 bp, Artificial
  CRISPR gRNA sequence
taagtgttcaaaagaactta

SEQ ID NO: 98247 - DNA, 20 bp, Artificial
  CRISPR gRNA sequence
tgttcaaaagaacttaaggc

SEQ ID NO: 98248 - DNA, 20 bp, Artificial
  CRISPR gRNA sequence
gttcaaaagaacttaaggcc

SEQ ID NO: 98249 - DNA, 20 bp, Artificial
  CRISPR gRNA sequence
aaagaacttaaggccgggca

SEQ ID NO: 98250 - DNA, 20 bp, Artificial
  CRISPR gRNA sequence
gaacttaaggccgggcacag

SEQ ID NO: 98251 - DNA, 20 bp, Artificial
  CRISPR gRNA sequence
gtggctcatgcctgtaatcc

SEQ ID NO: 98252 - DNA, 20 bp, Artificial
  CRISPR gRNA sequence
tgcctgtaatcccagcactt

SEQ ID NO: 98253 - DNA, 20 bp, Artificial
  CRISPR gRNA sequence
gcctgtaatcccagcacttt

SEQ ID NO: 98254 - DNA, 20 bp, Artificial
  CRISPR gRNA sequence
ctgtaatcccagcactttgg

SEQ ID NO: 98255 - DNA, 20 bp, Artificial
  CRISPR gRNA sequence
tgtaatcccagcactttggg

SEQ ID NO: 98256 - DNA, 20 bp, Artificial
  CRISPR gRNA sequence
tcccagcactttgggaggct

SEQ ID NO: 98257 - DNA, 20 bp, Artificial
  CRISPR gRNA sequence
cccagcactttgggaggctg

SEQ ID NO: 98258 - DNA, 20 bp, Artificial
  CRISPR gRNA sequence
agcactttgggaggctgagg

SEQ ID NO: 98259 - DNA, 20 bp, Artificial
  CRISPR gRNA sequence
gcactttgggaggctgaggt

SEQ ID NO: 98260 - DNA, 20 bp, Artificial
  CRISPR gRNA sequence
ctttgggaggctgaggtggg

SEQ ID NO: 98261 - DNA, 20 bp, Artificial
  CRISPR gRNA sequence
ctgaggtgggtggatcacct

SEQ ID NO: 98262 - DNA, 20 bp, Artificial
  CRISPR gRNA sequence
tgaggtgggtggatcacctg

SEQ ID NO: 98263 - DNA, 20 bp, Artificial
  CRISPR gRNA sequence
gtgggtggatcacctgaggt

SEQ ID NO: 98264 - DNA, 20 bp, Artificial
  CRISPR gRNA sequence
tgggtggatcacctgaggtc

SEQ ID NO: 98265 - DNA, 20 bp, Artificial
  CRISPR gRNA sequence
ggtggatcacctgaggtcag

SEQ ID NO: 98266 - DNA, 20 bp, Artificial
  CRISPR gRNA sequence
tcacctgaggtcaggagttt

SEQ ID NO: 98267 - DNA, 20 bp, Artificial
  CRISPR gRNA sequence
tgaggtcaggagtttgagac

SEQ ID NO: 98268 - DNA, 20 bp, Artificial
  CRISPR gRNA sequence
tgagaccagcctgactaaca

SEQ ID NO: 98269 - DNA, 20 bp, Artificial
  CRISPR gRNA sequence
ctctactaaaaacacaaaat

SEQ ID NO: 98270 - DNA, 20 bp, Artificial
  CRISPR gRNA sequence
aacacaaaattagccatgca

SEQ ID NO: 98271 - DNA, 20 bp, Artificial
  CRISPR gRNA sequence
acaaaattagccatgcatgg

SEQ ID NO: 98272 - DNA, 20 bp, Artificial
  CRISPR gRNA sequence
aaattagccatgcatggtgg

SEQ ID NO: 98273 - DNA, 20 bp, Artificial
  CRISPR gRNA sequence
gtggcagatgcctgtaatcc

SEQ ID NO: 98274 - DNA, 20 bp, Artificial
  CRISPR gRNA sequence
tgcctgtaatcccagctact

SEQ ID NO: 98275 - DNA, 20 bp, Artificial
  CRISPR gRNA sequence
gcctgtaatcccagctactc

SEQ ID NO: 98276 - DNA, 20 bp, Artificial
  CRISPR gRNA sequence
ctgtaatcccagctactcgg

SEQ ID NO: 98277 - DNA, 20 bp, Artificial
  CRISPR gRNA sequence
tgtaatcccagctactcggg

SEQ ID NO: 98278 - DNA, 20 bp, Artificial
  CRISPR gRNA sequence
tcccagctactcgggaggct

SEQ ID NO: 98279 - DNA, 20 bp, Artificial
  CRISPR gRNA sequence
cccagctactcgggaggctg

SEQ ID NO: 98280 - DNA, 20 bp, Artificial
  CRISPR gRNA sequence
agctactcgggaggctgagg

SEQ ID NO: 98281 - DNA, 20 bp, Artificial
  CRISPR gRNA sequence
gctactcgggaggctgaggc

SEQ ID NO: 98282 - DNA, 20 bp, Artificial
  CRISPR gRNA sequence
tactcgggaggctgaggcag

SEQ ID NO: 98283 - DNA, 20 bp, Artificial
  CRISPR gRNA sequence
gcaggagaatcgcttgaatc

SEQ ID NO: 98284 - DNA, 20 bp, Artificial
  CRISPR gRNA sequence
caggagaatcgcttgaatcc

SEQ ID NO: 98285 - DNA, 20 bp, Artificial
  CRISPR gRNA sequence
ggagaatcgcttgaatccag

SEQ ID NO: 98286 - DNA, 20 bp, Artificial
  CRISPR gRNA sequence
gagaatcgcttgaatccagg

SEQ ID NO: 98287 - DNA, 20 bp, Artificial
  CRISPR gRNA sequence
aatcgcttgaatccaggagg

SEQ ID NO: 98288 - DNA, 20 bp, Artificial
  CRISPR gRNA sequence
tcgcttgaatccaggaggtg

SEQ ID NO: 98289 - DNA, 20 bp, Artificial
  CRISPR gRNA sequence
cgcttgaatccaggaggtgg

SEQ ID NO: 98290 - DNA, 20 bp, Artificial
  CRISPR gRNA sequence
aatccaggaggtggaggttg

SEQ ID NO: 98291 - DNA, 20 bp, Artificial
  CRISPR gRNA sequence
caggaggtggaggttgcagt

SEQ ID NO: 98292 - DNA, 20 bp, Artificial
  CRISPR gRNA sequence
ggaggtggaggttgcagtga

SEQ ID NO: 98293 - DNA, 20 bp, Artificial
  CRISPR gRNA sequence
aggtggaggttgcagtgaga

SEQ ID NO: 98294 - DNA, 20 bp, Artificial
  CRISPR gRNA sequence
gagatcacgccactgcactc

SEQ ID NO: 98295 - DNA, 20 bp, Artificial
  CRISPR gRNA sequence
cacgccactgcactccagcc

SEQ ID NO: 98296 - DNA, 20 bp, Artificial
  CRISPR gRNA sequence
acgccactgcactccagcct

SEQ ID NO: 98297 - DNA, 20 bp, Artificial
  CRISPR gRNA sequence
tgcactccagcctgggcaac

SEQ ID NO: 98298 - DNA, 20 bp, Artificial
  CRISPR gRNA sequence
cactccagcctgggcaacaa

SEQ ID NO: 98299 - DNA, 20 bp, Artificial
  CRISPR gRNA sequence
ccagcctgggcaacaagagt

SEQ ID NO: 98300 - DNA, 20 bp, Artificial
  CRISPR gRNA sequence
aaaaaaaaaaaaaaatttaa

SEQ ID NO: 98301 - DNA, 20 bp, Artificial
  CRISPR gRNA sequence
aaaaaaaaaaaatttaaaag

SEQ ID NO: 98302 - DNA, 20 bp, Artificial
  CRISPR gRNA sequence
aaaaaaaaaaatttaaaagc

SEQ ID NO: 98303 - DNA, 20 bp, Artificial
  CRISPR gRNA sequence
aaaaaaaatttaaaagcagg

SEQ ID NO: 98304 - DNA, 20 bp, Artificial
  CRISPR gRNA sequence
aaaaatttaaaagcaggtag

SEQ ID NO: 98305 - DNA, 20 bp, Artificial
  CRISPR gRNA sequence
aaatttaaaagcaggtagaa

SEQ ID NO: 98306 - DNA, 20 bp, Artificial
  CRISPR gRNA sequence
aatttaaaagcaggtagaag

SEQ ID NO: 98307 - DNA, 20 bp, Artificial
  CRISPR gRNA sequence
agcaggtagaagaggatgaa

SEQ ID NO: 98308 - DNA, 20 bp, Artificial
  CRISPR gRNA sequence
gtagaagaggatgaaaagaa

SEQ ID NO: 98309 - DNA, 20 bp, Artificial
  CRISPR gRNA sequence
agaagaggatgaaaagaacg

SEQ ID NO: 98310 - DNA, 20 bp, Artificial
  CRISPR gRNA sequence
ggatgaaaagaacggagcac

SEQ ID NO: 98311 - DNA, 20 bp, Artificial
  CRISPR gRNA sequence
gatgaaaagaacggagcaca

SEQ ID NO: 98312 - DNA, 20 bp, Artificial
  CRISPR gRNA sequence
aagaacggagcacaaggaat

SEQ ID NO: 98313 - DNA, 20 bp, Artificial
  CRISPR gRNA sequence
cacaaggaataagtccttct

SEQ ID NO: 98314 - DNA, 20 bp, Artificial
  CRISPR gRNA sequence
ggaataagtccttcttagac

SEQ ID NO: 98315 - DNA, 20 bp, Artificial
  CRISPR gRNA sequence
gaataagtccttcttagaca

SEQ ID NO: 98316 - DNA, 20 bp, Artificial
  CRISPR gRNA sequence
taagtccttcttagacaagg

SEQ ID NO: 98317 - DNA, 20 bp, Artificial
  CRISPR gRNA sequence
cttcttagacaaggtggtaa

SEQ ID NO: 98318 - DNA, 20 bp, Artificial
  CRISPR gRNA sequence
ttcttagacaaggtggtaac

SEQ ID NO: 98319 - DNA, 20 bp, Artificial
  CRISPR gRNA sequence
cttagacaaggtggtaacag

SEQ ID NO: 98320 - DNA, 20 bp, Artificial
  CRISPR gRNA sequence
ttagacaaggtggtaacagg

SEQ ID NO: 98321 - DNA, 20 bp, Artificial
  CRISPR gRNA sequence
tagacaaggtggtaacagga

SEQ ID NO: 98322 - DNA, 20 bp, Artificial
  CRISPR gRNA sequence
ggtaacaggagggcctcccc

SEQ ID NO: 98323 - DNA, 20 bp, Artificial
  CRISPR gRNA sequence
gtaacaggagggcctcccca

SEQ ID NO: 98324 - DNA, 20 bp, Artificial
  CRISPR gRNA sequence
ctccccaaggtgacaccacc

SEQ ID NO: 98325 - DNA, 20 bp, Artificial
  CRISPR gRNA sequence
aggtgacaccaccgagatct

SEQ ID NO: 98326 - DNA, 20 bp, Artificial
  CRISPR gRNA sequence
ggtgacaccaccgagatctt

SEQ ID NO: 98327 - DNA, 20 bp, Artificial
  CRISPR gRNA sequence
gacaccaccgagatcttagg

SEQ ID NO: 98328 - DNA, 20 bp, Artificial
  CRISPR gRNA sequence
accgagatcttaggaagtca

SEQ ID NO: 98329 - DNA, 20 bp, Artificial
  CRISPR gRNA sequence
gaagtcaaagaaatccgcta

SEQ ID NO: 98330 - DNA, 20 bp, Artificial
  CRISPR gRNA sequence
aagtcaaagaaatccgctac

SEQ ID NO: 98331 - DNA, 20 bp, Artificial
  CRISPR gRNA sequence
agtcaaagaaatccgctaca

SEQ ID NO: 98332 - DNA, 20 bp, Artificial
  CRISPR gRNA sequence
aagaaatccgctacagggac

SEQ ID NO: 98333 - DNA, 20 bp, Artificial
  CRISPR gRNA sequence
agaaatccgctacagggact

SEQ ID NO: 98334 - DNA, 20 bp, Artificial
  CRISPR gRNA sequence
tccgctacagggactgggcg

SEQ ID NO: 98335 - DNA, 20 bp, Artificial
  CRISPR gRNA sequence
gctacagggactgggcgcgg

SEQ ID NO: 98336 - DNA, 20 bp, Artificial
  CRISPR gRNA sequence
gtggctcacgcctgtaatcc

SEQ ID NO: 98337 - DNA, 20 bp, Artificial
  CRISPR gRNA sequence
cgcctgtaatcccagcactt

SEQ ID NO: 98338 - DNA, 20 bp, Artificial
  CRISPR gRNA sequence
gcctgtaatcccagcacttt

SEQ ID NO: 98339 - DNA, 20 bp, Artificial
  CRISPR gRNA sequence
ctgtaatcccagcactttgg

SEQ ID NO: 98340 - DNA, 20 bp, Artificial
  CRISPR gRNA sequence
tgtaatcccagcactttggg

SEQ ID NO: 98341 - DNA, 20 bp, Artificial
  CRISPR gRNA sequence
tcccagcactttgggaggcc

SEQ ID NO: 98342 - DNA, 20 bp, Artificial
  CRISPR gRNA sequence
cccagcactttgggaggccg

SEQ ID NO: 98343 - DNA, 20 bp, Artificial
  CRISPR gRNA sequence
agcactttgggaggccgagg

SEQ ID NO: 98344 - DNA, 20 bp, Artificial
  CRISPR gRNA sequence
gcactttgggaggccgaggc

SEQ ID NO: 98345 - DNA, 20 bp, Artificial
  CRISPR gRNA sequence
gccgaggcgggcaatcacct

SEQ ID NO: 98346 - DNA, 20 bp, Artificial
  CRISPR gRNA sequence
ccgaggcgggcaatcacctg

SEQ ID NO: 98347 - DNA, 20 bp, Artificial
  CRISPR gRNA sequence
ggcgggcaatcacctgaggt

SEQ ID NO: 98348 - DNA, 20 bp, Artificial
  CRISPR gRNA sequence
gcgggcaatcacctgaggtc

SEQ ID NO: 98349 - DNA, 20 bp, Artificial
  CRISPR gRNA sequence
gggcaatcacctgaggtcag

SEQ ID NO: 98350 - DNA, 20 bp, Artificial
  CRISPR gRNA sequence
tcacctgaggtcaggagttc

SEQ ID NO: 98351 - DNA, 20 bp, Artificial
  CRISPR gRNA sequence
tgaggtcaggagttcgagac

SEQ ID NO: 98352 - DNA, 20 bp, Artificial
  CRISPR gRNA sequence
tcaggagttcgagaccagcc

SEQ ID NO: 98353 - DNA, 20 bp, Artificial
  CRISPR gRNA sequence
caggagttcgagaccagcct

SEQ ID NO: 98354 - DNA, 20 bp, Artificial
  CRISPR gRNA sequence
cgagaccagcctgggcaaca

SEQ ID NO: 98355 - DNA, 20 bp, Artificial
  CRISPR gRNA sequence
tctactaaaaacacaaaaat

SEQ ID NO: 98356 - DNA, 20 bp, Artificial
  CRISPR gRNA sequence
ctaaaaacacaaaaattagc

SEQ ID NO: 98357 - DNA, 20 bp, Artificial
  CRISPR gRNA sequence
acacaaaaattagctggatg

SEQ ID NO: 98358 - DNA, 20 bp, Artificial
  CRISPR gRNA sequence
caaaaattagctggatgtgg

SEQ ID NO: 98359 - DNA, 20 bp, Artificial
  CRISPR gRNA sequence
ctggatgtggtggtgcatgc

SEQ ID NO: 98360 - DNA, 20 bp, Artificial
  CRISPR gRNA sequence
ggtggtgcatgccagctact

SEQ ID NO: 98361 - DNA, 20 bp, Artificial
  CRISPR gRNA sequence
gtggtgcatgccagctactt

SEQ ID NO: 98362 - DNA, 20 bp, Artificial
  CRISPR gRNA sequence
ggtgcatgccagctacttgg

SEQ ID NO: 98363 - DNA, 20 bp, Artificial
  CRISPR gRNA sequence
gtgcatgccagctacttggg

SEQ ID NO: 98364 - DNA, 20 bp, Artificial
  CRISPR gRNA sequence
tgccagctacttgggaggct

SEQ ID NO: 98365 - DNA, 20 bp, Artificial
  CRISPR gRNA sequence
gccagctacttgggaggctg

SEQ ID NO: 98366 - DNA, 20 bp, Artificial
  CRISPR gRNA sequence
agctacttgggaggctgagg

SEQ ID NO: 98367 - DNA, 20 bp, Artificial
  CRISPR gRNA sequence
gctacttgggaggctgaggc

SEQ ID NO: 98368 - DNA, 20 bp, Artificial
  CRISPR gRNA sequence
tacttgggaggctgaggcag

SEQ ID NO: 98369 - DNA, 20 bp, Artificial
  CRISPR gRNA sequence
gcaggagaatcaccttaacc

SEQ ID NO: 98370 - DNA, 20 bp, Artificial
  CRISPR gRNA sequence
caggagaatcaccttaaccc

SEQ ID NO: 98371 - DNA, 20 bp, Artificial
  CRISPR gRNA sequence
ggagaatcaccttaacccag

SEQ ID NO: 98372 - DNA, 20 bp, Artificial
  CRISPR gRNA sequence
agaatcaccttaacccagga

SEQ ID NO: 98373 - DNA, 20 bp, Artificial
  CRISPR gRNA sequence
gaatcaccttaacccaggag

SEQ ID NO: 98374 - DNA, 20 bp, Artificial
  CRISPR gRNA sequence
aatcaccttaacccaggaga

SEQ ID NO: 98375 - DNA, 20 bp, Artificial
  CRISPR gRNA sequence
tcaccttaacccaggagagg

SEQ ID NO: 98376 - DNA, 20 bp, Artificial
  CRISPR gRNA sequence
taacccaggagagggagttg

SEQ ID NO: 98377 - DNA, 20 bp, Artificial
  CRISPR gRNA sequence
ccaggagagggagttgcagt

SEQ ID NO: 98378 - DNA, 20 bp, Artificial
  CRISPR gRNA sequence
agagggagttgcagtgagtc

SEQ ID NO: 98379 - DNA, 20 bp, Artificial
  CRISPR gRNA sequence
ggagttgcagtgagtcaaga

SEQ ID NO: 98380 - DNA, 20 bp, Artificial
  CRISPR gRNA sequence
agtgccactgcactccaccc

SEQ ID NO: 98381 - DNA, 20 bp, Artificial
  CRISPR gRNA sequence
ctgcactccaccctggacaa

SEQ ID NO: 98382 - DNA, 20 bp, Artificial
  CRISPR gRNA sequence
gcactccaccctggacaaca

SEQ ID NO: 98383 - DNA, 20 bp, Artificial
  CRISPR gRNA sequence
tccaccctggacaacagagc

SEQ ID NO: 98384 - DNA, 20 bp, Artificial
  CRISPR gRNA sequence
acagagcaagattctgtctc

SEQ ID NO: 98385 - DNA, 20 bp, Artificial
  CRISPR gRNA sequence
gagcaagattctgtctcaag

SEQ ID NO: 98386 - DNA, 20 bp, Artificial
  CRISPR gRNA sequence
gcaagattctgtctcaagaa

SEQ ID NO: 98387 - DNA, 20 bp, Artificial
  CRISPR gRNA sequence
aagattctgtctcaagaaga

SEQ ID NO: 98388 - DNA, 20 bp, Artificial
  CRISPR gRNA sequence
agattctgtctcaagaagag

SEQ ID NO: 98389 - DNA, 20 bp, Artificial
  CRISPR gRNA sequence
gattctgtctcaagaagaga

SEQ ID NO: 98390 - DNA, 20 bp, Artificial
  CRISPR gRNA sequence
attctgtctcaagaagagag

SEQ ID NO: 98391 - DNA, 20 bp, Artificial
  CRISPR gRNA sequence
tctcaagaagagaggggatc

SEQ ID NO: 98392 - DNA, 20 bp, Artificial
  CRISPR gRNA sequence
ctcaagaagagaggggatcc

SEQ ID NO: 98393 - DNA, 20 bp, Artificial
  CRISPR gRNA sequence
caagaagagaggggatccag

SEQ ID NO: 98394 - DNA, 20 bp, Artificial
  CRISPR gRNA sequence
aagaagagaggggatccagg

SEQ ID NO: 98395 - DNA, 20 bp, Artificial
  CRISPR gRNA sequence
ggggatccaggaggcgtctc

SEQ ID NO: 98396 - DNA, 20 bp, Artificial
  CRISPR gRNA sequence
ggatccaggaggcgtctcga

SEQ ID NO: 98397 - DNA, 20 bp, Artificial
  CRISPR gRNA sequence
tccaggaggcgtctcgagag

SEQ ID NO: 98398 - DNA, 20 bp, Artificial
  CRISPR gRNA sequence
ccaggaggcgtctcgagagt

SEQ ID NO: 98399 - DNA, 20 bp, Artificial
  CRISPR gRNA sequence
caggaggcgtctcgagagtg

SEQ ID NO: 98400 - DNA, 20 bp, Artificial
  CRISPR gRNA sequence
ggaggcgtctcgagagtggg

SEQ ID NO: 98401 - DNA, 20 bp, Artificial
  CRISPR gRNA sequence
aggcgtctcgagagtgggga

SEQ ID NO: 98402 - DNA, 20 bp, Artificial
  CRISPR gRNA sequence
ggcgtctcgagagtggggag

SEQ ID NO: 98403 - DNA, 20 bp, Artificial
  CRISPR gRNA sequence
gcgtctcgagagtggggaga

SEQ ID NO: 98404 - DNA, 20 bp, Artificial
  CRISPR gRNA sequence
cgtctcgagagtggggagag

SEQ ID NO: 98405 - DNA, 20 bp, Artificial
  CRISPR gRNA sequence
tcgagagtggggagagggga

SEQ ID NO: 98406 - DNA, 20 bp, Artificial
  CRISPR gRNA sequence
cgagagtggggagaggggaa

SEQ ID NO: 98407 - DNA, 20 bp, Artificial
  CRISPR gRNA sequence
agagtggggagaggggaaag

SEQ ID NO: 98408 - DNA, 20 bp, Artificial
  CRISPR gRNA sequence
gagtggggagaggggaaagg

SEQ ID NO: 98409 - DNA, 20 bp, Artificial
  CRISPR gRNA sequence
agtggggagaggggaaagga

SEQ ID NO: 98410 - DNA, 20 bp, Artificial
  CRISPR gRNA sequence
gtggggagaggggaaaggag

SEQ ID NO: 98411 - DNA, 20 bp, Artificial
  CRISPR gRNA sequence
ggggagaggggaaaggaggg

SEQ ID NO: 98412 - DNA, 20 bp, Artificial
  CRISPR gRNA sequence
gggagaggggaaaggagggg

SEQ ID NO: 98413 - DNA, 20 bp, Artificial
  CRISPR gRNA sequence
ggagaggggaaaggagggga

SEQ ID NO: 98414 - DNA, 20 bp, Artificial
  CRISPR gRNA sequence
gagaggggaaaggaggggag

SEQ ID NO: 98415 - DNA, 20 bp, Artificial
  CRISPR gRNA sequence
gaggggaaaggaggggaggg

SEQ ID NO: 98416 - DNA, 20 bp, Artificial
  CRISPR gRNA sequence
aggggaaaggaggggagggg

SEQ ID NO: 98417 - DNA, 20 bp, Artificial
  CRISPR gRNA sequence
gaaaggaggggaggggaggc

SEQ ID NO: 98418 - DNA, 20 bp, Artificial
  CRISPR gRNA sequence
aaaggaggggaggggaggcg

SEQ ID NO: 98419 - DNA, 20 bp, Artificial
  CRISPR gRNA sequence
aaggaggggaggggaggcga

SEQ ID NO: 98420 - DNA, 20 bp, Artificial
  CRISPR gRNA sequence
aggaggggaggggaggcgag

SEQ ID NO: 98421 - DNA, 20 bp, Artificial
  CRISPR gRNA sequence
gaggggaggggaggcgaggg

SEQ ID NO: 98422 - DNA, 20 bp, Artificial
  CRISPR gRNA sequence
aggggaggggaggcgagggg

SEQ ID NO: 98423 - DNA, 20 bp, Artificial
  CRISPR gRNA sequence
ggggaggggaggcgagggga

SEQ ID NO: 98424 - DNA, 20 bp, Artificial
  CRISPR gRNA sequence
gggaggggaggcgaggggag

SEQ ID NO: 98425 - DNA, 20 bp, Artificial
  CRISPR gRNA sequence
gaggggaggcgaggggaggg

SEQ ID NO: 98426 - DNA, 20 bp, Artificial
  CRISPR gRNA sequence
aggggaggcgaggggagggg

SEQ ID NO: 98427 - DNA, 20 bp, Artificial
  CRISPR gRNA sequence
ggggaggcgaggggagggga

SEQ ID NO: 98428 - DNA, 20 bp, Artificial
  CRISPR gRNA sequence
ggaggcgaggggaggggagg

SEQ ID NO: 98429 - DNA, 20 bp, Artificial
  CRISPR gRNA sequence
cgaggggaggggagggagcc

SEQ ID NO: 98430 - DNA, 20 bp, Artificial
  CRISPR gRNA sequence
gaggggaggggagggagcct

SEQ ID NO: 98431 - DNA, 20 bp, Artificial
  CRISPR gRNA sequence
ggagggagcctgggcaacaa

SEQ ID NO: 98432 - DNA, 20 bp, Artificial
  CRISPR gRNA sequence
tttaaaaaaaaaaaaaaaaa

SEQ ID NO: 98433 - DNA, 20 bp, Artificial
  CRISPR gRNA sequence
aaaaaaaaaaaaacggactg

SEQ ID NO: 98434 - DNA, 20 bp, Artificial
  CRISPR gRNA sequence
aaaaaaacggactgtagtcc

SEQ ID NO: 98435 - DNA, 20 bp, Artificial
  CRISPR gRNA sequence
ggactgtagtcccagctact

SEQ ID NO: 98436 - DNA, 20 bp, Artificial
  CRISPR gRNA sequence
gactgtagtcccagctactc

SEQ ID NO: 98437 - DNA, 20 bp, Artificial
  CRISPR gRNA sequence
ctgtagtcccagctactcgg

SEQ ID NO: 98438 - DNA, 20 bp, Artificial
  CRISPR gRNA sequence
tgtagtcccagctactcggg

SEQ ID NO: 98439 - DNA, 20 bp, Artificial
  CRISPR gRNA sequence
cccagctactcgggaggctg

SEQ ID NO: 98440 - DNA, 20 bp, Artificial
  CRISPR gRNA sequence
agctactcgggaggctgaag

SEQ ID NO: 98441 - DNA, 20 bp, Artificial
  CRISPR gRNA sequence
gctactcgggaggctgaagc

SEQ ID NO: 98442 - DNA, 20 bp, Artificial
  CRISPR gRNA sequence
tactcgggaggctgaagcag

SEQ ID NO: 98443 - DNA, 20 bp, Artificial
  CRISPR gRNA sequence
gggaggctgaagcaggagaa

SEQ ID NO: 98444 - DNA, 20 bp, Artificial
  CRISPR gRNA sequence
gcaggagaatggcgtgaaca

SEQ ID NO: 98445 - DNA, 20 bp, Artificial
  CRISPR gRNA sequence
caggagaatggcgtgaacac

SEQ ID NO: 98446 - DNA, 20 bp, Artificial
  CRISPR gRNA sequence
ggagaatggcgtgaacacgg

SEQ ID NO: 98447 - DNA, 20 bp, Artificial
  CRISPR gRNA sequence
gagaatggcgtgaacacggg

SEQ ID NO: 98448 - DNA, 20 bp, Artificial
  CRISPR gRNA sequence
aatggcgtgaacacgggagg

SEQ ID NO: 98449 - DNA, 20 bp, Artificial
  CRISPR gRNA sequence
tggcgtgaacacgggaggtg

SEQ ID NO: 98450 - DNA, 20 bp, Artificial
  CRISPR gRNA sequence
aacacgggaggtggagcttg

SEQ ID NO: 98451 - DNA, 20 bp, Artificial
  CRISPR gRNA sequence
cgggaggtggagcttgcagt

SEQ ID NO: 98452 - DNA, 20 bp, Artificial
  CRISPR gRNA sequence
ggtggagcttgcagtgagcc

SEQ ID NO: 98453 - DNA, 20 bp, Artificial
  CRISPR gRNA sequence
ccactgcactccatgcactc

SEQ ID NO: 98454 - DNA, 20 bp, Artificial
  CRISPR gRNA sequence
gcactccatgcactccagcc

SEQ ID NO: 98455 - DNA, 20 bp, Artificial
  CRISPR gRNA sequence
cactccatgcactccagcct

SEQ ID NO: 98456 - DNA, 20 bp, Artificial
  CRISPR gRNA sequence
atgcactccagcctgggcga

SEQ ID NO: 98457 - DNA, 20 bp, Artificial
  CRISPR gRNA sequence
gcactccagcctgggcgaca

SEQ ID NO: 98458 - DNA, 20 bp, Artificial
  CRISPR gRNA sequence
tccagcctgggcgacagagc

SEQ ID NO: 98459 - DNA, 20 bp, Artificial
  CRISPR gRNA sequence
gcgagactccatctcaaaaa

SEQ ID NO: 98460 - DNA, 20 bp, Artificial
  CRISPR gRNA sequence
gactccatctcaaaaaaaga

SEQ ID NO: 98461 - DNA, 20 bp, Artificial
  CRISPR gRNA sequence
ccatctcaaaaaaagaaaga

SEQ ID NO: 98462 - DNA, 20 bp, Artificial
  CRISPR gRNA sequence
ctcaaaaaaagaaagaaaga

SEQ ID NO: 98463 - DNA, 20 bp, Artificial
  CRISPR gRNA sequence
agaaagaaagaaaaaaaaaa

SEQ ID NO: 98464 - DNA, 20 bp, Artificial
  CRISPR gRNA sequence
aaagaaagaaaaaaaaaacg

SEQ ID NO: 98465 - DNA, 20 bp, Artificial
  CRISPR gRNA sequence
aagaaagaaaaaaaaaacgg

SEQ ID NO: 98466 - DNA, 20 bp, Artificial
  CRISPR gRNA sequence
aaagaaaaaaaaaacggagg

SEQ ID NO: 98467 - DNA, 20 bp, Artificial
  CRISPR gRNA sequence
aagaaaaaaaaaacggaggc

SEQ ID NO: 98468 - DNA, 20 bp, Artificial
  CRISPR gRNA sequence
aaaaaaaaaacggaggcggg

SEQ ID NO: 98469 - DNA, 20 bp, Artificial
  CRISPR gRNA sequence
aaaaaaaaacggaggcggga

SEQ ID NO: 98470 - DNA, 20 bp, Artificial
  CRISPR gRNA sequence
aaaaaaaacggaggcgggaa

SEQ ID NO: 98471 - DNA, 20 bp, Artificial
  CRISPR gRNA sequence
aaaaaacggaggcgggaagg

SEQ ID NO: 98472 - DNA, 20 bp, Artificial
  CRISPR gRNA sequence
aaaaacggaggcgggaaggg

SEQ ID NO: 98473 - DNA, 20 bp, Artificial
  CRISPR gRNA sequence
aaaacggaggcgggaaggga

SEQ ID NO: 98474 - DNA, 20 bp, Artificial
  CRISPR gRNA sequence
aacggaggcgggaagggagg

SEQ ID NO: 98475 - DNA, 20 bp, Artificial
  CRISPR gRNA sequence
acggaggcgggaagggaggg

SEQ ID NO: 98476 - DNA, 20 bp, Artificial
  CRISPR gRNA sequence
cggaggcgggaagggaggga

SEQ ID NO: 98477 - DNA, 20 bp, Artificial
  CRISPR gRNA sequence
ggaggcgggaagggagggag

SEQ ID NO: 98478 - DNA, 20 bp, Artificial
  CRISPR gRNA sequence
aggcgggaagggagggaggg

SEQ ID NO: 98479 - DNA, 20 bp, Artificial
  CRISPR gRNA sequence
ggcgggaagggagggagggg

SEQ ID NO: 98480 - DNA, 20 bp, Artificial
  CRISPR gRNA sequence
gcgggaagggagggagggga

SEQ ID NO: 98481 - DNA, 20 bp, Artificial
  CRISPR gRNA sequence
cgggaagggagggaggggag

SEQ ID NO: 98482 - DNA, 20 bp, Artificial
  CRISPR gRNA sequence
ggaagggagggaggggaggg

SEQ ID NO: 98483 - DNA, 20 bp, Artificial
  CRISPR gRNA sequence
gggagggaggggaggggagt

SEQ ID NO: 98484 - DNA, 20 bp, Artificial
  CRISPR gRNA sequence
gaggggaggggagtcagcta

SEQ ID NO: 98485 - DNA, 20 bp, Artificial
  CRISPR gRNA sequence
aggggaggggagtcagctat

SEQ ID NO: 98486 - DNA, 20 bp, Artificial
  CRISPR gRNA sequence
ggaggggagtcagctatagg

SEQ ID NO: 98487 - DNA, 20 bp, Artificial
  CRISPR gRNA sequence
ggggagtcagctataggaag

SEQ ID NO: 98488 - DNA, 20 bp, Artificial
  CRISPR gRNA sequence
gtcagctataggaagaagtg

SEQ ID NO: 98489 - DNA, 20 bp, Artificial
  CRISPR gRNA sequence
tcagctataggaagaagtgt

SEQ ID NO: 98490 - DNA, 20 bp, Artificial
  CRISPR gRNA sequence
gctataggaagaagtgtagg

SEQ ID NO: 98491 - DNA, 20 bp, Artificial
  CRISPR gRNA sequence
tataggaagaagtgtaggaa

SEQ ID NO: 98492 - DNA, 20 bp, Artificial
  CRISPR gRNA sequence
gaagtgtaggaagagcattc

SEQ ID NO: 98493 - DNA, 20 bp, Artificial
  CRISPR gRNA sequence
tgtaggaagagcattccaga

SEQ ID NO: 98494 - DNA, 20 bp, Artificial
  CRISPR gRNA sequence
gtaggaagagcattccagac

SEQ ID NO: 98495 - DNA, 20 bp, Artificial
  CRISPR gRNA sequence
aggaagagcattccagacag

SEQ ID NO: 98496 - DNA, 20 bp, Artificial
  CRISPR gRNA sequence
aagagcattccagacaggag

SEQ ID NO: 98497 - DNA, 20 bp, Artificial
  CRISPR gRNA sequence
agcattccagacaggagtgg

SEQ ID NO: 98498 - DNA, 20 bp, Artificial
  CRISPR gRNA sequence
agacaggagtggcagcaaca

SEQ ID NO: 98499 - DNA, 20 bp, Artificial
  CRISPR gRNA sequence
gacaggagtggcagcaacaa

SEQ ID NO: 98500 - DNA, 20 bp, Artificial
  CRISPR gRNA sequence
agtggcagcaacaaaggtcg

SEQ ID NO: 98501 - DNA, 20 bp, Artificial
  CRISPR gRNA sequence
gtggcagcaacaaaggtcgt

SEQ ID NO: 98502 - DNA, 20 bp, Artificial
  CRISPR gRNA sequence
ggcagcaacaaaggtcgtgg

SEQ ID NO: 98503 - DNA, 20 bp, Artificial
  CRISPR gRNA sequence
gcagcaacaaaggtcgtggg

SEQ ID NO: 98504 - DNA, 20 bp, Artificial
  CRISPR gRNA sequence
cagcaacaaaggtcgtggga

SEQ ID NO: 98505 - DNA, 20 bp, Artificial
  CRISPR gRNA sequence
gtcgtgggagggaactaaat

SEQ ID NO: 98506 - DNA, 20 bp, Artificial
  CRISPR gRNA sequence
tcgtgggagggaactaaatt

SEQ ID NO: 98507 - DNA, 20 bp, Artificial
  CRISPR gRNA sequence
aactaaattaggcatattct

SEQ ID NO: 98508 - DNA, 20 bp, Artificial
  CRISPR gRNA sequence
tccaatcaaaaataaatcct

SEQ ID NO: 98509 - DNA, 20 bp, Artificial
  CRISPR gRNA sequence
aaaataaatcctcagttcct

SEQ ID NO: 98510 - DNA, 20 bp, Artificial
  CRISPR gRNA sequence
taaatcctcagttcctcagt

SEQ ID NO: 98511 - DNA, 20 bp, Artificial
  CRISPR gRNA sequence
cagttcctcagtaagtaaaa

SEQ ID NO: 98512 - DNA, 20 bp, Artificial
  CRISPR gRNA sequence
agttcctcagtaagtaaaac

SEQ ID NO: 98513 - DNA, 20 bp, Artificial
  CRISPR gRNA sequence
aacaggatgaccatctgacc

SEQ ID NO: 98514 - DNA, 20 bp, Artificial
  CRISPR gRNA sequence
tgacccagtaatttcactcc

SEQ ID NO: 98515 - DNA, 20 bp, Artificial
  CRISPR gRNA sequence
ctcctagctatctaccctca

SEQ ID NO: 98516 - DNA, 20 bp, Artificial
  CRISPR gRNA sequence
cctagctatctaccctcaaa

SEQ ID NO: 98517 - DNA, 20 bp, Artificial
  CRISPR gRNA sequence
taccctcaaagagttaaaaa

SEQ ID NO: 98518 - DNA, 20 bp, Artificial
  CRISPR gRNA sequence
accctcaaagagttaaaaac

SEQ ID NO: 98519 - DNA, 20 bp, Artificial
  CRISPR gRNA sequence
aagagttaaaaacaggtgtg

SEQ ID NO: 98520 - DNA, 20 bp, Artificial
  CRISPR gRNA sequence
agagttaaaaacaggtgtga

SEQ ID NO: 98521 - DNA, 20 bp, Artificial
  CRISPR gRNA sequence
gagttaaaaacaggtgtgaa

SEQ ID NO: 98522 - DNA, 20 bp, Artificial
  CRISPR gRNA sequence
taaaaacaggtgtgaagggc

SEQ ID NO: 98523 - DNA, 20 bp, Artificial
  CRISPR gRNA sequence
aaaaacaggtgtgaagggcc

SEQ ID NO: 98524 - DNA, 20 bp, Artificial
  CRISPR gRNA sequence
gtgtgaagggccgggcactg

SEQ ID NO: 98525 - DNA, 20 bp, Artificial
  CRISPR gRNA sequence
gtggctcacacctgtaatcc

SEQ ID NO: 98526 - DNA, 20 bp, Artificial
  CRISPR gRNA sequence
acctgtaatcccagcacttt

SEQ ID NO: 98527 - DNA, 20 bp, Artificial
  CRISPR gRNA sequence
tgtaatcccagcactttcgg

SEQ ID NO: 98528 - DNA, 20 bp, Artificial
  CRISPR gRNA sequence
aatcccagcactttcggaag

SEQ ID NO: 98529 - DNA, 20 bp, Artificial
  CRISPR gRNA sequence
tcccagcactttcggaagtg

SEQ ID NO: 98530 - DNA, 20 bp, Artificial
  CRISPR gRNA sequence
cccagcactttcggaagtgg

SEQ ID NO: 98531 - DNA, 20 bp, Artificial
  CRISPR gRNA sequence
ctttcggaagtggaggcctg

SEQ ID NO: 98532 - DNA, 20 bp, Artificial
  CRISPR gRNA sequence
tggaggcctgcagatcactt

SEQ ID NO: 98533 - DNA, 20 bp, Artificial
  CRISPR gRNA sequence
gcctgcagatcacttgagcc

SEQ ID NO: 98534 - DNA, 20 bp, Artificial
  CRISPR gRNA sequence
cctgcagatcacttgagccc

SEQ ID NO: 98535 - DNA, 20 bp, Artificial
  CRISPR gRNA sequence
tgcagatcacttgagcccag

SEQ ID NO: 98536 - DNA, 20 bp, Artificial
  CRISPR gRNA sequence
gcagatcacttgagcccagg

SEQ ID NO: 98537 - DNA, 20 bp, Artificial
  CRISPR gRNA sequence
gatcacttgagcccaggagg

SEQ ID NO: 98538 - DNA, 20 bp, Artificial
  CRISPR gRNA sequence
tcacttgagcccaggaggtg

SEQ ID NO: 98539 - DNA, 20 bp, Artificial
  CRISPR gRNA sequence
tgagcccaggaggtggagac

SEQ ID NO: 98540 - DNA, 20 bp, Artificial
  CRISPR gRNA sequence
cccaaaaaaaaaaaaaaaat

SEQ ID NO: 98541 - DNA, 20 bp, Artificial
  CRISPR gRNA sequence
aaaaaaaaaaaaaaattagc

SEQ ID NO: 98542 - DNA, 20 bp, Artificial
  CRISPR gRNA sequence
aaaaaaaaaaaaaattagcc

SEQ ID NO: 98543 - DNA, 20 bp, Artificial
  CRISPR gRNA sequence
aaaaaaaaattagccaggtg

SEQ ID NO: 98544 - DNA, 20 bp, Artificial
  CRISPR gRNA sequence
caggtgtggttgcatgccta

SEQ ID NO: 98545 - DNA, 20 bp, Artificial
  CRISPR gRNA sequence
tggttgcatgcctatagtcc

SEQ ID NO: 98546 - DNA, 20 bp, Artificial
  CRISPR gRNA sequence
atgcctatagtcccagctcc

SEQ ID NO: 98547 - DNA, 20 bp, Artificial
  CRISPR gRNA sequence
tgcctatagtcccagctcct

SEQ ID NO: 98548 - DNA, 20 bp, Artificial
  CRISPR gRNA sequence
gcctatagtcccagctccta

SEQ ID NO: 98549 - DNA, 20 bp, Artificial
  CRISPR gRNA sequence
ctatagtcccagctcctagg

SEQ ID NO: 98550 - DNA, 20 bp, Artificial
  CRISPR gRNA sequence
tatagtcccagctcctaggg

SEQ ID NO: 98551 - DNA, 20 bp, Artificial
  CRISPR gRNA sequence
tcccagctcctagggaggct

SEQ ID NO: 98552 - DNA, 20 bp, Artificial
  CRISPR gRNA sequence
ctcctagggaggctgagtga

SEQ ID NO: 98553 - DNA, 20 bp, Artificial
  CRISPR gRNA sequence
gggaggctgagtgatggctt

SEQ ID NO: 98554 - DNA, 20 bp, Artificial
  CRISPR gRNA sequence
gctgagtgatggcttcagcc

SEQ ID NO: 98555 - DNA, 20 bp, Artificial
  CRISPR gRNA sequence
ctgagtgatggcttcagccc

SEQ ID NO: 98556 - DNA, 20 bp, Artificial
  CRISPR gRNA sequence
agtgatggcttcagcccagg

SEQ ID NO: 98557 - DNA, 20 bp, Artificial
  CRISPR gRNA sequence
tggcttcagcccaggaagtt

SEQ ID NO: 98558 - DNA, 20 bp, Artificial
  CRISPR gRNA sequence
ggcttcagcccaggaagttg

SEQ ID NO: 98559 - DNA, 20 bp, Artificial
  CRISPR gRNA sequence
agcccaggaagttgaggctg

SEQ ID NO: 98560 - DNA, 20 bp, Artificial
  CRISPR gRNA sequence
atgattgcatcactgcactc

SEQ ID NO: 98561 - DNA, 20 bp, Artificial
  CRISPR gRNA sequence
gcatcactgcactccagcct

SEQ ID NO: 98562 - DNA, 20 bp, Artificial
  CRISPR gRNA sequence
ctgcactccagccttagtaa

SEQ ID NO: 98563 - DNA, 20 bp, Artificial
  CRISPR gRNA sequence
gcactccagccttagtaaca

SEQ ID NO: 98564 - DNA, 20 bp, Artificial
  CRISPR gRNA sequence
tccagccttagtaacagagc

SEQ ID NO: 98565 - DNA, 20 bp, Artificial
  CRISPR gRNA sequence
cctgtatcaaaaaacaaaaa

SEQ ID NO: 98566 - DNA, 20 bp, Artificial
  CRISPR gRNA sequence
ctgtatcaaaaaacaaaaac

SEQ ID NO: 98567 - DNA, 20 bp, Artificial
  CRISPR gRNA sequence
atcaaaaaacaaaaacaggc

SEQ ID NO: 98568 - DNA, 20 bp, Artificial
  CRISPR gRNA sequence
tcaaaaaacaaaaacaggcc

SEQ ID NO: 98569 - DNA, 20 bp, Artificial
  CRISPR gRNA sequence
aaacaaaaacaggccgggca

SEQ ID NO: 98570 - DNA, 20 bp, Artificial
  CRISPR gRNA sequence
caaaaacaggccgggcacag

SEQ ID NO: 98571 - DNA, 20 bp, Artificial
  CRISPR gRNA sequence
gtggctcatgcctgtaatcc

SEQ ID NO: 98572 - DNA, 20 bp, Artificial
  CRISPR gRNA sequence
tgcctgtaatcccagcactt

SEQ ID NO: 98573 - DNA, 20 bp, Artificial
  CRISPR gRNA sequence
gcctgtaatcccagcacttt

SEQ ID NO: 98574 - DNA, 20 bp, Artificial
  CRISPR gRNA sequence
ctgtaatcccagcactttgg

SEQ ID NO: 98575 - DNA, 20 bp, Artificial
  CRISPR gRNA sequence
tgtaatcccagcactttggg

SEQ ID NO: 98576 - DNA, 20 bp, Artificial
  CRISPR gRNA sequence
tcccagcactttgggaggcc

SEQ ID NO: 98577 - DNA, 20 bp, Artificial
  CRISPR gRNA sequence
cccagcactttgggaggccg

SEQ ID NO: 98578 - DNA, 20 bp, Artificial
  CRISPR gRNA sequence
agcactttgggaggccgagg

SEQ ID NO: 98579 - DNA, 20 bp, Artificial
  CRISPR gRNA sequence
gcactttgggaggccgaggt

SEQ ID NO: 98580 - DNA, 20 bp, Artificial
  CRISPR gRNA sequence
ctttgggaggccgaggtggg

SEQ ID NO: 98581 - DNA, 20 bp, Artificial
  CRISPR gRNA sequence
ccgaggtgggcggatcacct

SEQ ID NO: 98582 - DNA, 20 bp, Artificial
  CRISPR gRNA sequence
cgaggtgggcggatcacctg

SEQ ID NO: 98583 - DNA, 20 bp, Artificial
  CRISPR gRNA sequence
gtgggcggatcacctgaggt

SEQ ID NO: 98584 - DNA, 20 bp, Artificial
  CRISPR gRNA sequence
tgggcggatcacctgaggtc

SEQ ID NO: 98585 - DNA, 20 bp, Artificial
  CRISPR gRNA sequence
ggcggatcacctgaggtcag

SEQ ID NO: 98586 - DNA, 20 bp, Artificial
  CRISPR gRNA sequence
tcacctgaggtcaggagttc

SEQ ID NO: 98587 - DNA, 20 bp, Artificial
  CRISPR gRNA sequence
tgaggtcaggagttcaagac

SEQ ID NO: 98588 - DNA, 20 bp, Artificial
  CRISPR gRNA sequence
tcaggagttcaagaccagcc

SEQ ID NO: 98589 - DNA, 20 bp, Artificial
  CRISPR gRNA sequence
caagaccagcctggccaaca

SEQ ID NO: 98590 - DNA, 20 bp, Artificial
  CRISPR gRNA sequence
actaaaaatacccaaaaaat

SEQ ID NO: 98591 - DNA, 20 bp, Artificial
  CRISPR gRNA sequence
aaaatacccaaaaaattagc

SEQ ID NO: 98592 - DNA, 20 bp, Artificial
  CRISPR gRNA sequence
aaatacccaaaaaattagct

SEQ ID NO: 98593 - DNA, 20 bp, Artificial
  CRISPR gRNA sequence
cccaaaaaattagctgggcg

SEQ ID NO: 98594 - DNA, 20 bp, Artificial
  CRISPR gRNA sequence
aaaaaattagctgggcgtag

SEQ ID NO: 98595 - DNA, 20 bp, Artificial
  CRISPR gRNA sequence
aaattagctgggcgtagtgg

SEQ ID NO: 98596 - DNA, 20 bp, Artificial
  CRISPR gRNA sequence
ttagctgggcgtagtggcgg

SEQ ID NO: 98597 - DNA, 20 bp, Artificial
  CRISPR gRNA sequence
gtggcggaagcctgtaatcc

SEQ ID NO: 98598 - DNA, 20 bp, Artificial
  CRISPR gRNA sequence
agcctgtaatcccagctact

SEQ ID NO: 98599 - DNA, 20 bp, Artificial
  CRISPR gRNA sequence
gcctgtaatcccagctactc

SEQ ID NO: 98600 - DNA, 20 bp, Artificial
  CRISPR gRNA sequence
ctgtaatcccagctactcag

SEQ ID NO: 98601 - DNA, 20 bp, Artificial
  CRISPR gRNA sequence
tgtaatcccagctactcagg

SEQ ID NO: 98602 - DNA, 20 bp, Artificial
  CRISPR gRNA sequence
tcccagctactcaggaggct

SEQ ID NO: 98603 - DNA, 20 bp, Artificial
  CRISPR gRNA sequence
agctactcaggaggctgaga

SEQ ID NO: 98604 - DNA, 20 bp, Artificial
  CRISPR gRNA sequence
gctactcaggaggctgagac

SEQ ID NO: 98605 - DNA, 20 bp, Artificial
  CRISPR gRNA sequence
tactcaggaggctgagacag

SEQ ID NO: 98606 - DNA, 20 bp, Artificial
  CRISPR gRNA sequence
ggaggctgagacaggagaat

SEQ ID NO: 98607 - DNA, 20 bp, Artificial
  CRISPR gRNA sequence
acaggagaatcagttgaacc

SEQ ID NO: 98608 - DNA, 20 bp, Artificial
  CRISPR gRNA sequence
caggagaatcagttgaaccc

SEQ ID NO: 98609 - DNA, 20 bp, Artificial
  CRISPR gRNA sequence
ggagaatcagttgaacccag

SEQ ID NO: 98610 - DNA, 20 bp, Artificial
  CRISPR gRNA sequence
gagaatcagttgaacccagg

SEQ ID NO: 98611 - DNA, 20 bp, Artificial
  CRISPR gRNA sequence
aatcagttgaacccaggagg

SEQ ID NO: 98612 - DNA, 20 bp, Artificial
  CRISPR gRNA sequence
tcagttgaacccaggaggca

SEQ ID NO: 98613 - DNA, 20 bp, Artificial
  CRISPR gRNA sequence
cagttgaacccaggaggcag

SEQ ID NO: 98614 - DNA, 20 bp, Artificial
  CRISPR gRNA sequence
aacccaggaggcagaggttg

SEQ ID NO: 98615 - DNA, 20 bp, Artificial
  CRISPR gRNA sequence
caggaggcagaggttgcagt

SEQ ID NO: 98616 - DNA, 20 bp, Artificial
  CRISPR gRNA sequence
ggcagaggttgcagtgagct

SEQ ID NO: 98617 - DNA, 20 bp, Artificial
  CRISPR gRNA sequence
gagatcacgccattgcactc

SEQ ID NO: 98618 - DNA, 20 bp, Artificial
  CRISPR gRNA sequence
cacgccattgcactccagca

SEQ ID NO: 98619 - DNA, 20 bp, Artificial
  CRISPR gRNA sequence
acgccattgcactccagcat

SEQ ID NO: 98620 - DNA, 20 bp, Artificial
  CRISPR gRNA sequence
tgcactccagcatgggcaac

SEQ ID NO: 98621 - DNA, 20 bp, Artificial
  CRISPR gRNA sequence
cactccagcatgggcaacaa

SEQ ID NO: 98622 - DNA, 20 bp, Artificial
  CRISPR gRNA sequence
acaaaacaaaacaaaaacga

SEQ ID NO: 98623 - DNA, 20 bp, Artificial
  CRISPR gRNA sequence
aacaaaacaaaaacgaaagc

SEQ ID NO: 98624 - DNA, 20 bp, Artificial
  CRISPR gRNA sequence
acaaaaacgaaagcaagaca

SEQ ID NO: 98625 - DNA, 20 bp, Artificial
  CRISPR gRNA sequence
caaaaacgaaagcaagacac

SEQ ID NO: 98626 - DNA, 20 bp, Artificial
  CRISPR gRNA sequence
gcaagacacaggttccatgt

SEQ ID NO: 98627 - DNA, 20 bp, Artificial
  CRISPR gRNA sequence
caagacacaggttccatgtg

SEQ ID NO: 98628 - DNA, 20 bp, Artificial
  CRISPR gRNA sequence
ggcctgacattccatcatca

SEQ ID NO: 98629 - DNA, 20 bp, Artificial
  CRISPR gRNA sequence
attccatcatcatggaatcc

SEQ ID NO: 98630 - DNA, 20 bp, Artificial
  CRISPR gRNA sequence
tccatcatcatggaatccca

SEQ ID NO: 98631 - DNA, 20 bp, Artificial
  CRISPR gRNA sequence
ccatcatcatggaatcccag

SEQ ID NO: 98632 - DNA, 20 bp, Artificial
  CRISPR gRNA sequence
catcatcatggaatcccaga

SEQ ID NO: 98633 - DNA, 20 bp, Artificial
  CRISPR gRNA sequence
gaatcccagagggctaatcc

SEQ ID NO: 98634 - DNA, 20 bp, Artificial
  CRISPR gRNA sequence
atcccagagggctaatccca

SEQ ID NO: 98635 - DNA, 20 bp, Artificial
  CRISPR gRNA sequence
tcccagagggctaatcccag

SEQ ID NO: 98636 - DNA, 20 bp, Artificial
  CRISPR gRNA sequence
ccagagggctaatcccagag

SEQ ID NO: 98637 - DNA, 20 bp, Artificial
  CRISPR gRNA sequence
cagagggctaatcccagagg

SEQ ID NO: 98638 - DNA, 20 bp, Artificial
  CRISPR gRNA sequence
agaggaggtatcctaccctg

SEQ ID NO: 98639 - DNA, 20 bp, Artificial
  CRISPR gRNA sequence
aggaggtatcctaccctgtg

SEQ ID NO: 98640 - DNA, 20 bp, Artificial
  CRISPR gRNA sequence
gaggtatcctaccctgtgga

SEQ ID NO: 98641 - DNA, 20 bp, Artificial
  CRISPR gRNA sequence
aggtatcctaccctgtggag

SEQ ID NO: 98642 - DNA, 20 bp, Artificial
  CRISPR gRNA sequence
accctgtggagaggaaacac

SEQ ID NO: 98643 - DNA, 20 bp, Artificial
  CRISPR gRNA sequence
ggagaggaaacactggcatc

SEQ ID NO: 98644 - DNA, 20 bp, Artificial
  CRISPR gRNA sequence
aacactggcatccggttgtg

SEQ ID NO: 98645 - DNA, 20 bp, Artificial
  CRISPR gRNA sequence
acactggcatccggttgtgc

SEQ ID NO: 98646 - DNA, 20 bp, Artificial
  CRISPR gRNA sequence
cactggcatccggttgtgca

SEQ ID NO: 98647 - DNA, 20 bp, Artificial
  CRISPR gRNA sequence
ggcatccggttgtgcaggga

SEQ ID NO: 98648 - DNA, 20 bp, Artificial
  CRISPR gRNA sequence
catccggttgtgcagggaaa

SEQ ID NO: 98649 - DNA, 20 bp, Artificial
  CRISPR gRNA sequence
gttgtgcagggaaagagact

SEQ ID NO: 98650 - DNA, 20 bp, Artificial
  CRISPR gRNA sequence
ttgtgcagggaaagagactg

SEQ ID NO: 98651 - DNA, 20 bp, Artificial
  CRISPR gRNA sequence
gggaaagagactgaggacca

SEQ ID NO: 98652 - DNA, 20 bp, Artificial
  CRISPR gRNA sequence
gactgaggaccacagtgtct

SEQ ID NO: 98653 - DNA, 20 bp, Artificial
  CRISPR gRNA sequence
cacagtgtctgagccatctg

SEQ ID NO: 98654 - DNA, 20 bp, Artificial
  CRISPR gRNA sequence
gccatctgcagcctcctctc

SEQ ID NO: 98655 - DNA, 20 bp, Artificial
  CRISPR gRNA sequence
ccatctgcagcctcctctcc

SEQ ID NO: 98656 - DNA, 20 bp, Artificial
  CRISPR gRNA sequence
catctgcagcctcctctccg

SEQ ID NO: 98657 - DNA, 20 bp, Artificial
  CRISPR gRNA sequence
agcctcctctccggggtctt

SEQ ID NO: 98658 - DNA, 20 bp, Artificial
  CRISPR gRNA sequence
gcctcctctccggggtcttc

SEQ ID NO: 98659 - DNA, 20 bp, Artificial
  CRISPR gRNA sequence
cctcctctccggggtcttca

SEQ ID NO: 98660 - DNA, 20 bp, Artificial
  CRISPR gRNA sequence
ccggggtcttcagggtcccc

SEQ ID NO: 98661 - DNA, 20 bp, Artificial
  CRISPR gRNA sequence
cttcagggtccccaagttct

SEQ ID NO: 98662 - DNA, 20 bp, Artificial
  CRISPR gRNA sequence
ttcagggtccccaagttctg

SEQ ID NO: 98663 - DNA, 20 bp, Artificial
  CRISPR gRNA sequence
agggtccccaagttctgagg

SEQ ID NO: 98664 - DNA, 20 bp, Artificial
  CRISPR gRNA sequence
gggtccccaagttctgaggc

SEQ ID NO: 98665 - DNA, 20 bp, Artificial
  CRISPR gRNA sequence
ggtccccaagttctgaggca

SEQ ID NO: 98666 - DNA, 20 bp, Artificial
  CRISPR gRNA sequence
gtccccaagttctgaggcag

SEQ ID NO: 98667 - DNA, 20 bp, Artificial
  CRISPR gRNA sequence
gttctgaggcaggggtctgc

SEQ ID NO: 98668 - DNA, 20 bp, Artificial
  CRISPR gRNA sequence
ttctgaggcaggggtctgct

SEQ ID NO: 98669 - DNA, 20 bp, Artificial
  CRISPR gRNA sequence
aggcaggggtctgctgggtc

SEQ ID NO: 98670 - DNA, 20 bp, Artificial
  CRISPR gRNA sequence
ggggtctgctgggtctggat

SEQ ID NO: 98671 - DNA, 20 bp, Artificial
  CRISPR gRNA sequence
gggtctgctgggtctggatg

SEQ ID NO: 98672 - DNA, 20 bp, Artificial
  CRISPR gRNA sequence
ggtctggatgaggtcttctg

SEQ ID NO: 98673 - DNA, 20 bp, Artificial
  CRISPR gRNA sequence
gtctggatgaggtcttctgc

SEQ ID NO: 98674 - DNA, 20 bp, Artificial
  CRISPR gRNA sequence
ggatgaggtcttctgcaggc

SEQ ID NO: 98675 - DNA, 20 bp, Artificial
  CRISPR gRNA sequence
gatgaggtcttctgcaggct

SEQ ID NO: 98676 - DNA, 20 bp, Artificial
  CRISPR gRNA sequence
aggtcttctgcaggctgggt

SEQ ID NO: 98677 - DNA, 20 bp, Artificial
  CRISPR gRNA sequence
tgcaggctgggtaagctcca

SEQ ID NO: 98678 - DNA, 20 bp, Artificial
  CRISPR gRNA sequence
gcaggctgggtaagctccat

SEQ ID NO: 98679 - DNA, 20 bp, Artificial
  CRISPR gRNA sequence
caggctgggtaagctccatg

SEQ ID NO: 98680 - DNA, 20 bp, Artificial
  CRISPR gRNA sequence
ctgggtaagctccatgggga

SEQ ID NO: 98681 - DNA, 20 bp, Artificial
  CRISPR gRNA sequence
gtaagctccatggggaaagc

SEQ ID NO: 98682 - DNA, 20 bp, Artificial
  CRISPR gRNA sequence
agctccatggggaaagctgg

SEQ ID NO: 98683 - DNA, 20 bp, Artificial
  CRISPR gRNA sequence
ctccatggggaaagctggcg

SEQ ID NO: 98684 - DNA, 20 bp, Artificial
  CRISPR gRNA sequence
tccatggggaaagctggcgg

SEQ ID NO: 98685 - DNA, 20 bp, Artificial
  CRISPR gRNA sequence
gggaaagctggcggaggtgt

SEQ ID NO: 98686 - DNA, 20 bp, Artificial
  CRISPR gRNA sequence
aaagctggcggaggtgtcag

SEQ ID NO: 98687 - DNA, 20 bp, Artificial
  CRISPR gRNA sequence
aagctggcggaggtgtcaga

SEQ ID NO: 98688 - DNA, 20 bp, Artificial
  CRISPR gRNA sequence
agctggcggaggtgtcagaa

SEQ ID NO: 98689 - DNA, 20 bp, Artificial
  CRISPR gRNA sequence
gctggcggaggtgtcagaag

SEQ ID NO: 98690 - DNA, 20 bp, Artificial
  CRISPR gRNA sequence
tggcggaggtgtcagaaggg

SEQ ID NO: 98691 - DNA, 20 bp, Artificial
  CRISPR gRNA sequence
gcggaggtgtcagaagggga

SEQ ID NO: 98692 - DNA, 20 bp, Artificial
  CRISPR gRNA sequence
gagatgacaataattatcaa

SEQ ID NO: 98693 - DNA, 20 bp, Artificial
  CRISPR gRNA sequence
aattatcaacagttataata

SEQ ID NO: 98694 - DNA, 20 bp, Artificial
  CRISPR gRNA sequence
tatcaacagttataataaag

SEQ ID NO: 98695 - DNA, 20 bp, Artificial
  CRISPR gRNA sequence
atcaacagttataataaagt

SEQ ID NO: 98696 - DNA, 20 bp, Artificial
  CRISPR gRNA sequence
gtaggcaccgactgcatacc

SEQ ID NO: 98697 - DNA, 20 bp, Artificial
  CRISPR gRNA sequence
catacctagccttgcactgt

SEQ ID NO: 98698 - DNA, 20 bp, Artificial
  CRISPR gRNA sequence
atacctagccttgcactgtg

SEQ ID NO: 98699 - DNA, 20 bp, Artificial
  CRISPR gRNA sequence
tacctagccttgcactgtga

SEQ ID NO: 98700 - DNA, 20 bp, Artificial
  CRISPR gRNA sequence
ctagccttgcactgtgaggg

SEQ ID NO: 98701 - DNA, 20 bp, Artificial
  CRISPR gRNA sequence
tagccttgcactgtgagggt

SEQ ID NO: 98702 - DNA, 20 bp, Artificial
  CRISPR gRNA sequence
actgtgagggtgggtaaact

SEQ ID NO: 98703 - DNA, 20 bp, Artificial
  CRISPR gRNA sequence
ctgtgagggtgggtaaactg

SEQ ID NO: 98704 - DNA, 20 bp, Artificial
  CRISPR gRNA sequence
agggtgggtaaactgaggtc

SEQ ID NO: 98705 - DNA, 20 bp, Artificial
  CRISPR gRNA sequence
gggtgggtaaactgaggtcc

SEQ ID NO: 98706 - DNA, 20 bp, Artificial
  CRISPR gRNA sequence
ctgaggtccaggttaattac

SEQ ID NO: 98707 - DNA, 20 bp, Artificial
  CRISPR gRNA sequence
gaggtccaggttaattacca

SEQ ID NO: 98708 - DNA, 20 bp, Artificial
  CRISPR gRNA sequence
tccaggttaattaccagagc

SEQ ID NO: 98709 - DNA, 20 bp, Artificial
  CRISPR gRNA sequence
ccaggttaattaccagagcc

SEQ ID NO: 98710 - DNA, 20 bp, Artificial
  CRISPR gRNA sequence
caggttaattaccagagcca

SEQ ID NO: 98711 - DNA, 20 bp, Artificial
  CRISPR gRNA sequence
agagccagggaaatgaaaac

SEQ ID NO: 98712 - DNA, 20 bp, Artificial
  CRISPR gRNA sequence
agccagggaaatgaaaacca

SEQ ID NO: 98713 - DNA, 20 bp, Artificial
  CRISPR gRNA sequence
accagagtccaactgctttc

SEQ ID NO: 98714 - DNA, 20 bp, Artificial
  CRISPR gRNA sequence
ccagagtccaactgctttcg

SEQ ID NO: 98715 - DNA, 20 bp, Artificial
  CRISPR gRNA sequence
tctaccattccccaccacca

SEQ ID NO: 98716 - DNA, 20 bp, Artificial
  CRISPR gRNA sequence
acctacaatgtgcaatgttt

SEQ ID NO: 98717 - DNA, 20 bp, Artificial
  CRISPR gRNA sequence
ctacaatgtgcaatgtttaa

SEQ ID NO: 98718 - DNA, 20 bp, Artificial
  CRISPR gRNA sequence
atgtgcaatgtttaagagcc

SEQ ID NO: 98719 - DNA, 20 bp, Artificial
  CRISPR gRNA sequence
tgtgcaatgtttaagagcct

SEQ ID NO: 98720 - DNA, 20 bp, Artificial
  CRISPR gRNA sequence
atgtttaagagcctgggctc

SEQ ID NO: 98721 - DNA, 20 bp, Artificial
  CRISPR gRNA sequence
tttaagagcctgggctctgg

SEQ ID NO: 98722 - DNA, 20 bp, Artificial
  CRISPR gRNA sequence
ttaagagcctgggctctggc

SEQ ID NO: 98723 - DNA, 20 bp, Artificial
  CRISPR gRNA sequence
taagagcctgggctctggca

SEQ ID NO: 98724 - DNA, 20 bp, Artificial
  CRISPR gRNA sequence
gcctgggctctggcagggca

SEQ ID NO: 98725 - DNA, 20 bp, Artificial
  CRISPR gRNA sequence
tgggctctggcagggcacag

SEQ ID NO: 98726 - DNA, 20 bp, Artificial
  CRISPR gRNA sequence
tggcagggcacagtggctca

SEQ ID NO: 98727 - DNA, 20 bp, Artificial
  CRISPR gRNA sequence
gtggctcacggctgtaatcc

SEQ ID NO: 98728 - DNA, 20 bp, Artificial
  CRISPR gRNA sequence
cggctgtaatcccagcactt

SEQ ID NO: 98729 - DNA, 20 bp, Artificial
  CRISPR gRNA sequence
ggctgtaatcccagcacttt

SEQ ID NO: 98730 - DNA, 20 bp, Artificial
  CRISPR gRNA sequence
ctgtaatcccagcactttgg

SEQ ID NO: 98731 - DNA, 20 bp, Artificial
  CRISPR gRNA sequence
tgtaatcccagcactttggg

SEQ ID NO: 98732 - DNA, 20 bp, Artificial
  CRISPR gRNA sequence
tcccagcactttgggaggcc

SEQ ID NO: 98733 - DNA, 20 bp, Artificial
  CRISPR gRNA sequence
cccagcactttgggaggccg

SEQ ID NO: 98734 - DNA, 20 bp, Artificial
  CRISPR gRNA sequence
cagcactttgggaggccgag

SEQ ID NO: 98735 - DNA, 20 bp, Artificial
  CRISPR gRNA sequence
agcactttgggaggccgagg

SEQ ID NO: 98736 - DNA, 20 bp, Artificial
  CRISPR gRNA sequence
gcactttgggaggccgagga

SEQ ID NO: 98737 - DNA, 20 bp, Artificial
  CRISPR gRNA sequence
ctttgggaggccgaggaggg

SEQ ID NO: 98738 - DNA, 20 bp, Artificial
  CRISPR gRNA sequence
ggccgaggagggtggatcat

SEQ ID NO: 98739 - DNA, 20 bp, Artificial
  CRISPR gRNA sequence
gccgaggagggtggatcatg

SEQ ID NO: 98740 - DNA, 20 bp, Artificial
  CRISPR gRNA sequence
aggagggtggatcatgaggt

SEQ ID NO: 98741 - DNA, 20 bp, Artificial
  CRISPR gRNA sequence
ggagggtggatcatgaggtc

SEQ ID NO: 98742 - DNA, 20 bp, Artificial
  CRISPR gRNA sequence
agggtggatcatgaggtcag

SEQ ID NO: 98743 - DNA, 20 bp, Artificial
  CRISPR gRNA sequence
gatcatgaggtcaggagttc

SEQ ID NO: 98744 - DNA, 20 bp, Artificial
  CRISPR gRNA sequence
tgaggtcaggagttcgagac

SEQ ID NO: 98745 - DNA, 20 bp, Artificial
  CRISPR gRNA sequence
gaggtcaggagttcgagacc

SEQ ID NO: 98746 - DNA, 20 bp, Artificial
  CRISPR gRNA sequence
tcaggagttcgagaccaggc

SEQ ID NO: 98747 - DNA, 20 bp, Artificial
  CRISPR gRNA sequence
cgagaccaggctggccacca

SEQ ID NO: 98748 - DNA, 20 bp, Artificial
  CRISPR gRNA sequence
tgtactaaaaatacaaaaat

SEQ ID NO: 98749 - DNA, 20 bp, Artificial
  CRISPR gRNA sequence
taaaaatacaaaaattagcc

SEQ ID NO: 98750 - DNA, 20 bp, Artificial
  CRISPR gRNA sequence
atacaaaaattagccaagcg

SEQ ID NO: 98751 - DNA, 20 bp, Artificial
  CRISPR gRNA sequence
caaaaattagccaagcgcgg

SEQ ID NO: 98752 - DNA, 20 bp, Artificial
  CRISPR gRNA sequence
aaattagccaagcgcggtgg

SEQ ID NO: 98753 - DNA, 20 bp, Artificial
  CRISPR gRNA sequence
aattagccaagcgcggtggc

SEQ ID NO: 98754 - DNA, 20 bp, Artificial
  CRISPR gRNA sequence
gtggcgggcgcctgtgatcc

SEQ ID NO: 98755 - DNA, 20 bp, Artificial
  CRISPR gRNA sequence
cgcctgtgatcccagctact

SEQ ID NO: 98756 - DNA, 20 bp, Artificial
  CRISPR gRNA sequence
gcctgtgatcccagctactc

SEQ ID NO: 98757 - DNA, 20 bp, Artificial
  CRISPR gRNA sequence
ctgtgatcccagctactcgg

SEQ ID NO: 98758 - DNA, 20 bp, Artificial
  CRISPR gRNA sequence
tgtgatcccagctactcggg

SEQ ID NO: 98759 - DNA, 20 bp, Artificial
  CRISPR gRNA sequence
tcccagctactcgggaggct

SEQ ID NO: 98760 - DNA, 20 bp, Artificial
  CRISPR gRNA sequence
cccagctactcgggaggctg

SEQ ID NO: 98761 - DNA, 20 bp, Artificial
  CRISPR gRNA sequence
agctactcgggaggctgagg

SEQ ID NO: 98762 - DNA, 20 bp, Artificial
  CRISPR gRNA sequence
gaggcagaattgcttgaact

SEQ ID NO: 98763 - DNA, 20 bp, Artificial
  CRISPR gRNA sequence
aggcagaattgcttgaactc

SEQ ID NO: 98764 - DNA, 20 bp, Artificial
  CRISPR gRNA sequence
gcagaattgcttgaactcgg

SEQ ID NO: 98765 - DNA, 20 bp, Artificial
  CRISPR gRNA sequence
cagaattgcttgaactcggg

SEQ ID NO: 98766 - DNA, 20 bp, Artificial
  CRISPR gRNA sequence
aattgcttgaactcgggagg

SEQ ID NO: 98767 - DNA, 20 bp, Artificial
  CRISPR gRNA sequence
ttgcttgaactcgggaggtg

SEQ ID NO: 98768 - DNA, 20 bp, Artificial
  CRISPR gRNA sequence
tgcttgaactcgggaggtgg

SEQ ID NO: 98769 - DNA, 20 bp, Artificial
  CRISPR gRNA sequence
aactcgggaggtggaggttg

SEQ ID NO: 98770 - DNA, 20 bp, Artificial
  CRISPR gRNA sequence
cgggaggtggaggttgcggt

SEQ ID NO: 98771 - DNA, 20 bp, Artificial
  CRISPR gRNA sequence
gaggtggaggttgcggtgag

SEQ ID NO: 98772 - DNA, 20 bp, Artificial
  CRISPR gRNA sequence
ggtggaggttgcggtgagca

SEQ ID NO: 98773 - DNA, 20 bp, Artificial
  CRISPR gRNA sequence
gagatcgcaccactgcactg

SEQ ID NO: 98774 - DNA, 20 bp, Artificial
  CRISPR gRNA sequence
tcgcaccactgcactgtagc

SEQ ID NO: 98775 - DNA, 20 bp, Artificial
  CRISPR gRNA sequence
cgcaccactgcactgtagct

SEQ ID NO: 98776 - DNA, 20 bp, Artificial
  CRISPR gRNA sequence
gcaccactgcactgtagctg

SEQ ID NO: 98777 - DNA, 20 bp, Artificial
  CRISPR gRNA sequence
ctgcactgtagctggggcga

SEQ ID NO: 98778 - DNA, 20 bp, Artificial
  CRISPR gRNA sequence
gcactgtagctggggcgaca

SEQ ID NO: 98779 - DNA, 20 bp, Artificial
  CRISPR gRNA sequence
tgtagctggggcgacagagc

SEQ ID NO: 98780 - DNA, 20 bp, Artificial
  CRISPR gRNA sequence
aaaaaaaaaaaaaaaaaaaa

SEQ ID NO: 98781 - DNA, 20 bp, Artificial
  CRISPR gRNA sequence
aaaaaaaaaaaaaaaaaaga

SEQ ID NO: 98782 - DNA, 20 bp, Artificial
  CRISPR gRNA sequence
aaaaaaaaaaaaaaaaagaa

SEQ ID NO: 98783 - DNA, 20 bp, Artificial
  CRISPR gRNA sequence
aaaaaaaagaaaggaaaaaa

SEQ ID NO: 98784 - DNA, 20 bp, Artificial
  CRISPR gRNA sequence
aaaagaaaggaaaaaaaagc

SEQ ID NO: 98785 - DNA, 20 bp, Artificial
  CRISPR gRNA sequence
aaagaaaggaaaaaaaagcc

SEQ ID NO: 98786 - DNA, 20 bp, Artificial
  CRISPR gRNA sequence
aagaaaggaaaaaaaagccg

SEQ ID NO: 98787 - DNA, 20 bp, Artificial
  CRISPR gRNA sequence
ggaaaaaaaagccggggctc

SEQ ID NO: 98788 - DNA, 20 bp, Artificial
  CRISPR gRNA sequence
gaaaaaaaagccggggctct

SEQ ID NO: 98789 - DNA, 20 bp, Artificial
  CRISPR gRNA sequence
aaaaaaaagccggggctctg

SEQ ID NO: 98790 - DNA, 20 bp, Artificial
  CRISPR gRNA sequence
aaaagccggggctctggggt

SEQ ID NO: 98791 - DNA, 20 bp, Artificial
  CRISPR gRNA sequence
gggctctggggtcagctgtc

SEQ ID NO: 98792 - DNA, 20 bp, Artificial
  CRISPR gRNA sequence
ggctctggggtcagctgtct

SEQ ID NO: 98793 - DNA, 20 bp, Artificial
  CRISPR gRNA sequence
ggttcgaatccctcaattta

SEQ ID NO: 98794 - DNA, 20 bp, Artificial
  CRISPR gRNA sequence
gttcgaatccctcaatttat

SEQ ID NO: 98795 - DNA, 20 bp, Artificial
  CRISPR gRNA sequence
tccctcaatttataggccgt

SEQ ID NO: 98796 - DNA, 20 bp, Artificial
  CRISPR gRNA sequence
atttataggccgtgagaact

SEQ ID NO: 98797 - DNA, 20 bp, Artificial
  CRISPR gRNA sequence
tttataggccgtgagaactt

SEQ ID NO: 98798 - DNA, 20 bp, Artificial
  CRISPR gRNA sequence
gggcacgtgacttaaccttt

SEQ ID NO: 98799 - DNA, 20 bp, Artificial
  CRISPR gRNA sequence
gtgacttaacctttgagcct

SEQ ID NO: 98800 - DNA, 20 bp, Artificial
  CRISPR gRNA sequence
gtttcctccacgacaaaatg

SEQ ID NO: 98801 - DNA, 20 bp, Artificial
  CRISPR gRNA sequence
ccacgacaaaatgtggaaat

SEQ ID NO: 98802 - DNA, 20 bp, Artificial
  CRISPR gRNA sequence
caacgaattatgtctgtaca

SEQ ID NO: 98803 - DNA, 20 bp, Artificial
  CRISPR gRNA sequence
tatgtctgtacatagcttat

SEQ ID NO: 98804 - DNA, 20 bp, Artificial
  CRISPR gRNA sequence
atgtctgtacatagcttatc

SEQ ID NO: 98805 - DNA, 20 bp, Artificial
  CRISPR gRNA sequence
tgtctgtacatagcttatcg

SEQ ID NO: 98806 - DNA, 20 bp, Artificial
  CRISPR gRNA sequence
gtctgtacatagcttatcgg

SEQ ID NO: 98807 - DNA, 20 bp, Artificial
  CRISPR gRNA sequence
agcttatcgggggatctgct

SEQ ID NO: 98808 - DNA, 20 bp, Artificial
  CRISPR gRNA sequence
atcgggggatctgctaagcg

SEQ ID NO: 98809 - DNA, 20 bp, Artificial
  CRISPR gRNA sequence
cgggggatctgctaagcgtg

SEQ ID NO: 98810 - DNA, 20 bp, Artificial
  CRISPR gRNA sequence
agctcaataaatattcgcta

SEQ ID NO: 98811 - DNA, 20 bp, Artificial
  CRISPR gRNA sequence
taaatattcgctatggttgt

SEQ ID NO: 98812 - DNA, 20 bp, Artificial
  CRISPR gRNA sequence
aaatattcgctatggttgtt

SEQ ID NO: 98813 - DNA, 20 bp, Artificial
  CRISPR gRNA sequence
atattcgctatggttgttgg

SEQ ID NO: 98814 - DNA, 20 bp, Artificial
  CRISPR gRNA sequence
tattcgctatggttgttggg

SEQ ID NO: 98815 - DNA, 20 bp, Artificial
  CRISPR gRNA sequence
attcgctatggttgttggga

SEQ ID NO: 98816 - DNA, 20 bp, Artificial
  CRISPR gRNA sequence
ttcgctatggttgttgggag

SEQ ID NO: 98817 - DNA, 20 bp, Artificial
  CRISPR gRNA sequence
tgggaggggctccccataat

SEQ ID NO: 98818 - DNA, 20 bp, Artificial
  CRISPR gRNA sequence
gggctccccataatgagtga

SEQ ID NO: 98819 - DNA, 20 bp, Artificial
  CRISPR gRNA sequence
taatgagtgacggctcaaca

SEQ ID NO: 98820 - DNA, 20 bp, Artificial
  CRISPR gRNA sequence
aatgagtgacggctcaacaa

SEQ ID NO: 98821 - DNA, 20 bp, Artificial
  CRISPR gRNA sequence
cggctcaacaaaggtgcgat

SEQ ID NO: 98822 - DNA, 20 bp, Artificial
  CRISPR gRNA sequence
aacaaaggtgcgattggtcc

SEQ ID NO: 98823 - DNA, 20 bp, Artificial
  CRISPR gRNA sequence
gattggtcccagtcccaccc

SEQ ID NO: 98824 - DNA, 20 bp, Artificial
  CRISPR gRNA sequence
ccgagcctcctaaatcgatc

SEQ ID NO: 98825 - DNA, 20 bp, Artificial
  CRISPR gRNA sequence
cgagcctcctaaatcgatcc

SEQ ID NO: 98826 - DNA, 20 bp, Artificial
  CRISPR gRNA sequence
agcctcctaaatcgatccag

SEQ ID NO: 98827 - DNA, 20 bp, Artificial
  CRISPR gRNA sequence
gcctcctaaatcgatccagg

SEQ ID NO: 98828 - DNA, 20 bp, Artificial
  CRISPR gRNA sequence
aggtccactcacctccccac

SEQ ID NO: 98829 - DNA, 20 bp, Artificial
  CRISPR gRNA sequence
cctctgtccccccgcgccga

SEQ ID NO: 98830 - DNA, 20 bp, Artificial
  CRISPR gRNA sequence
gtccccccgcgccgaaagcc

SEQ ID NO: 98831 - DNA, 20 bp, Artificial
  CRISPR gRNA sequence
agcccagttctctcaaaact

SEQ ID NO: 98832 - DNA, 20 bp, Artificial
  CRISPR gRNA sequence
gcccagttctctcaaaactt

SEQ ID NO: 98833 - DNA, 20 bp, Artificial
  CRISPR gRNA sequence
cccagttctctcaaaacttg

SEQ ID NO: 98834 - DNA, 20 bp, Artificial
  CRISPR gRNA sequence
ccagttctctcaaaacttgg

SEQ ID NO: 98835 - DNA, 20 bp, Artificial
  CRISPR gRNA sequence
ctctcaaaacttgggggccc

SEQ ID NO: 98836 - DNA, 20 bp, Artificial
  CRISPR gRNA sequence
cacaaacttttctcttccaa

SEQ ID NO: 98837 - DNA, 20 bp, Artificial
  CRISPR gRNA sequence
cttttctcttccaatggata

SEQ ID NO: 98838 - DNA, 20 bp, Artificial
  CRISPR gRNA sequence
ttctcttccaatggatatag

SEQ ID NO: 98839 - DNA, 20 bp, Artificial
  CRISPR gRNA sequence
tctcttccaatggatatagc

SEQ ID NO: 98840 - DNA, 20 bp, Artificial
  CRISPR gRNA sequence
tcttccaatggatatagcag

SEQ ID NO: 98841 - DNA, 20 bp, Artificial
  CRISPR gRNA sequence
cttccaatggatatagcagg

SEQ ID NO: 98842 - DNA, 20 bp, Artificial
  CRISPR gRNA sequence
ggatatagcaggaggcaaac

SEQ ID NO: 98843 - DNA, 20 bp, Artificial
  CRISPR gRNA sequence
atatagcaggaggcaaactg

SEQ ID NO: 98844 - DNA, 20 bp, Artificial
  CRISPR gRNA sequence
gcaggaggcaaactggagac

SEQ ID NO: 98845 - DNA, 20 bp, Artificial
  CRISPR gRNA sequence
caaactggagaccggaccct

SEQ ID NO: 98846 - DNA, 20 bp, Artificial
  CRISPR gRNA sequence
agaccggaccctcagcgatc

SEQ ID NO: 98847 - DNA, 20 bp, Artificial
  CRISPR gRNA sequence
agcgatctggcttcctctgc

SEQ ID NO: 98848 - DNA, 20 bp, Artificial
  CRISPR gRNA sequence
gcgatctggcttcctctgcc

SEQ ID NO: 98849 - DNA, 20 bp, Artificial
  CRISPR gRNA sequence
tctggcttcctctgccggga

SEQ ID NO: 98850 - DNA, 20 bp, Artificial
  CRISPR gRNA sequence
gcttcctctgccgggacaga

SEQ ID NO: 98851 - DNA, 20 bp, Artificial
  CRISPR gRNA sequence
ctcgaccgctacccccaccc

SEQ ID NO: 98852 - DNA, 20 bp, Artificial
  CRISPR gRNA sequence
cgaccgctacccccacccca

SEQ ID NO: 98853 - DNA, 20 bp, Artificial
  CRISPR gRNA sequence
tgcgcacccccgccccccaa

SEQ ID NO: 98854 - DNA, 20 bp, Artificial
  CRISPR gRNA sequence
cacccccgccccccaaaagt

SEQ ID NO: 98855 - DNA, 20 bp, Artificial
  CRISPR gRNA sequence
acccccgccccccaaaagtg

SEQ ID NO: 98856 - DNA, 20 bp, Artificial
  CRISPR gRNA sequence
cccgccccccaaaagtgagg

SEQ ID NO: 98857 - DNA, 20 bp, Artificial
  CRISPR gRNA sequence
ccgccccccaaaagtgagga

SEQ ID NO: 98858 - DNA, 20 bp, Artificial
  CRISPR gRNA sequence
cgccccccaaaagtgaggaa

SEQ ID NO: 98859 - DNA, 20 bp, Artificial
  CRISPR gRNA sequence
cccaaaagtgaggaagggcc

SEQ ID NO: 98860 - DNA, 20 bp, Artificial
  CRISPR gRNA sequence
ccaaaagtgaggaagggccc

SEQ ID NO: 98861 - DNA, 20 bp, Artificial
  CRISPR gRNA sequence
aaagtgaggaagggcccggg

SEQ ID NO: 98862 - DNA, 20 bp, Artificial
  CRISPR gRNA sequence
tgaggaagggcccgggcagt

SEQ ID NO: 98863 - DNA, 20 bp, Artificial
  CRISPR gRNA sequence
cgggcagtaagtgctgcctc

SEQ ID NO: 98864 - DNA, 20 bp, Artificial
  CRISPR gRNA sequence
agtgctgcctctggcccttt

SEQ ID NO: 98865 - DNA, 20 bp, Artificial
  CRISPR gRNA sequence
gcctctggccctttaagact

SEQ ID NO: 98866 - DNA, 20 bp, Artificial
  CRISPR gRNA sequence
cctctggccctttaagactt

SEQ ID NO: 98867 - DNA, 20 bp, Artificial
  CRISPR gRNA sequence
ctctggccctttaagactta

SEQ ID NO: 98868 - DNA, 20 bp, Artificial
  CRISPR gRNA sequence
tctggccctttaagacttag

SEQ ID NO: 98869 - DNA, 20 bp, Artificial
  CRISPR gRNA sequence
tggccctttaagacttaggg

SEQ ID NO: 98870 - DNA, 20 bp, Artificial
  CRISPR gRNA sequence
ggccctttaagacttagggg

SEQ ID NO: 98871 - DNA, 20 bp, Artificial
  CRISPR gRNA sequence
gccctttaagacttagggga

SEQ ID NO: 98872 - DNA, 20 bp, Artificial
  CRISPR gRNA sequence
ttaagacttaggggagggcg

SEQ ID NO: 98873 - DNA, 20 bp, Artificial
  CRISPR gRNA sequence
taagacttaggggagggcgt

SEQ ID NO: 98874 - DNA, 20 bp, Artificial
  CRISPR gRNA sequence
ggggagggcgtgggttccgc

SEQ ID NO: 98875 - DNA, 20 bp, Artificial
  CRISPR gRNA sequence
gggagggcgtgggttccgct

SEQ ID NO: 98876 - DNA, 20 bp, Artificial
  CRISPR gRNA sequence
ggagggcgtgggttccgctg

SEQ ID NO: 98877 - DNA, 20 bp, Artificial
  CRISPR gRNA sequence
cgtgggttccgctggggtcc

SEQ ID NO: 98878 - DNA, 20 bp, Artificial
  CRISPR gRNA sequence
gtgggttccgctggggtcct

SEQ ID NO: 98879 - DNA, 20 bp, Artificial
  CRISPR gRNA sequence
gggttccgctggggtcctgg

SEQ ID NO: 98880 - DNA, 20 bp, Artificial
  CRISPR gRNA sequence
ggttccgctggggtcctggg

SEQ ID NO: 98881 - DNA, 20 bp, Artificial
  CRISPR gRNA sequence
gttccgctggggtcctggga

SEQ ID NO: 98882 - DNA, 20 bp, Artificial
  CRISPR gRNA sequence
ccgctggggtcctgggaggg

SEQ ID NO: 98883 - DNA, 20 bp, Artificial
  CRISPR gRNA sequence
ttttcccctcctcaccgact

SEQ ID NO: 98884 - DNA, 20 bp, Artificial
  CRISPR gRNA sequence
ttcccctcctcaccgactcg

SEQ ID NO: 98885 - DNA, 20 bp, Artificial
  CRISPR gRNA sequence
tcccctcctcaccgactcgg

SEQ ID NO: 98886 - DNA, 20 bp, Artificial
  CRISPR gRNA sequence
cccctcctcaccgactcgga

SEQ ID NO: 98887 - DNA, 20 bp, Artificial
  CRISPR gRNA sequence
cctcaccgactcggagggaa

SEQ ID NO: 98888 - DNA, 20 bp, Artificial
  CRISPR gRNA sequence
ctcaccgactcggagggaat

SEQ ID NO: 98889 - DNA, 20 bp, Artificial
  CRISPR gRNA sequence
accgactcggagggaatggg

SEQ ID NO: 98890 - DNA, 20 bp, Artificial
  CRISPR gRNA sequence
ccgactcggagggaatgggc

SEQ ID NO: 98891 - DNA, 20 bp, Artificial
  CRISPR gRNA sequence
cgactcggagggaatgggcg

SEQ ID NO: 98892 - DNA, 20 bp, Artificial
  CRISPR gRNA sequence
gagggaatgggcggggccta

SEQ ID NO: 98893 - DNA, 20 bp, Artificial
  CRISPR gRNA sequence
agggaatgggcggggcctaa

SEQ ID NO: 98894 - DNA, 20 bp, Artificial
  CRISPR gRNA sequence
gggaatgggcggggcctaaa

SEQ ID NO: 98895 - DNA, 20 bp, Artificial
  CRISPR gRNA sequence
ggcggggcctaaagggctct

SEQ ID NO: 98896 - DNA, 20 bp, Artificial
  CRISPR gRNA sequence
gctcacctttaccctgccca

SEQ ID NO: 98897 - DNA, 20 bp, Artificial
  CRISPR gRNA sequence
accctgcccacagatttttc

SEQ ID NO: 98898 - DNA, 20 bp, Artificial
  CRISPR gRNA sequence
cctgcccacagatttttcca

SEQ ID NO: 98899 - DNA, 20 bp, Artificial
  CRISPR gRNA sequence
ctgcccacagatttttccag

SEQ ID NO: 98900 - DNA, 20 bp, Artificial
  CRISPR gRNA sequence
tgcccacagatttttccaga

SEQ ID NO: 98901 - DNA, 20 bp, Artificial
  CRISPR gRNA sequence
cccacagatttttccagagg

SEQ ID NO: 98902 - DNA, 20 bp, Artificial
  CRISPR gRNA sequence
tttttccagagggagccaat

SEQ ID NO: 98903 - DNA, 20 bp, Artificial
  CRISPR gRNA sequence
cagagggagccaattggctc

SEQ ID NO: 98904 - DNA, 20 bp, Artificial
  CRISPR gRNA sequence
gagccaattggctccggctt

SEQ ID NO: 98905 - DNA, 20 bp, Artificial
  CRISPR gRNA sequence
agccaattggctccggcttc

SEQ ID NO: 98906 - DNA, 20 bp, Artificial
  CRISPR gRNA sequence
caattggctccggcttcggg

SEQ ID NO: 98907 - DNA, 20 bp, Artificial
  CRISPR gRNA sequence
tggctccggcttcgggtaga

SEQ ID NO: 98908 - DNA, 20 bp, Artificial
  CRISPR gRNA sequence
ggctccggcttcgggtagat

SEQ ID NO: 98909 - DNA, 20 bp, Artificial
  CRISPR gRNA sequence
tccggcttcgggtagatggg

SEQ ID NO: 98910 - DNA, 20 bp, Artificial
  CRISPR gRNA sequence
ccggcttcgggtagatgggc

SEQ ID NO: 98911 - DNA, 20 bp, Artificial
  CRISPR gRNA sequence
cggcttcgggtagatgggcg

SEQ ID NO: 98912 - DNA, 20 bp, Artificial
  CRISPR gRNA sequence
tagatgggcggggctatctc

SEQ ID NO: 98913 - DNA, 20 bp, Artificial
  CRISPR gRNA sequence
atgggcggggctatctcaag

SEQ ID NO: 98914 - DNA, 20 bp, Artificial
  CRISPR gRNA sequence
ggcggggctatctcaagaag

SEQ ID NO: 98915 - DNA, 20 bp, Artificial
  CRISPR gRNA sequence
ggggctatctcaagaagaag

SEQ ID NO: 98916 - DNA, 20 bp, Artificial
  CRISPR gRNA sequence
gctatctcaagaagaagaag

SEQ ID NO: 98917 - DNA, 20 bp, Artificial
  CRISPR gRNA sequence
ctatctcaagaagaagaagt

SEQ ID NO: 98918 - DNA, 20 bp, Artificial
  CRISPR gRNA sequence
tatctcaagaagaagaagta

SEQ ID NO: 98919 - DNA, 20 bp, Artificial
  CRISPR gRNA sequence
atctcaagaagaagaagtag

SEQ ID NO: 98920 - DNA, 20 bp, Artificial
  CRISPR gRNA sequence
tcaagaagaagaagtagggg

SEQ ID NO: 98921 - DNA, 20 bp, Artificial
  CRISPR gRNA sequence
gaagaagtaggggaagtacg

SEQ ID NO: 98922 - DNA, 20 bp, Artificial
  CRISPR gRNA sequence
aagaagtaggggaagtacgc

SEQ ID NO: 98923 - DNA, 20 bp, Artificial
  CRISPR gRNA sequence
agaagtaggggaagtacgcg

SEQ ID NO: 98924 - DNA, 20 bp, Artificial
  CRISPR gRNA sequence
ggggaagtacgcggggcgtc

SEQ ID NO: 98925 - DNA, 20 bp, Artificial
  CRISPR gRNA sequence
cgcggggcgtctggaactta

SEQ ID NO: 98926 - DNA, 20 bp, Artificial
  CRISPR gRNA sequence
gcggggcgtctggaacttaa

SEQ ID NO: 98927 - DNA, 20 bp, Artificial
  CRISPR gRNA sequence
cggggcgtctggaacttaaa

SEQ ID NO: 98928 - DNA, 20 bp, Artificial
  CRISPR gRNA sequence
ggggcgtctggaacttaaag

SEQ ID NO: 98929 - DNA, 20 bp, Artificial
  CRISPR gRNA sequence
gcgtctggaacttaaagggg

SEQ ID NO: 98930 - DNA, 20 bp, Artificial
  CRISPR gRNA sequence
cttaaaggggcagcgtacct

SEQ ID NO: 98931 - DNA, 20 bp, Artificial
  CRISPR gRNA sequence
tggccgtcccgttccacaac

SEQ ID NO: 98932 - DNA, 20 bp, Artificial
  CRISPR gRNA sequence
ggccgtcccgttccacaaca

SEQ ID NO: 98933 - DNA, 20 bp, Artificial
  CRISPR gRNA sequence
ccacaacaaggtcccttctg

SEQ ID NO: 98934 - DNA, 20 bp, Artificial
  CRISPR gRNA sequence
aggtcccttctgcggtctca

SEQ ID NO: 98935 - DNA, 20 bp, Artificial
  CRISPR gRNA sequence
ggtcccttctgcggtctcaa

SEQ ID NO: 98936 - DNA, 20 bp, Artificial
  CRISPR gRNA sequence
ctgcggtctcaaaggcttat

SEQ ID NO: 98937 - DNA, 20 bp, Artificial
  CRISPR gRNA sequence
ggtctcaaaggcttataagc

SEQ ID NO: 98938 - DNA, 20 bp, Artificial
  CRISPR gRNA sequence
gtctcaaaggcttataagca

SEQ ID NO: 98939 - DNA, 20 bp, Artificial
  CRISPR gRNA sequence
tctcaaaggcttataagcaa

SEQ ID NO: 98940 - DNA, 20 bp, Artificial
  CRISPR gRNA sequence
caaaggcttataagcaaggg

SEQ ID NO: 98941 - DNA, 20 bp, Artificial
  CRISPR gRNA sequence
aaaggcttataagcaagggc

SEQ ID NO: 98942 - DNA, 20 bp, Artificial
  CRISPR gRNA sequence
aaggcttataagcaagggcg

SEQ ID NO: 98943 - DNA, 20 bp, Artificial
  CRISPR gRNA sequence
aggcttataagcaagggcgg

SEQ ID NO: 98944 - DNA, 20 bp, Artificial
  CRISPR gRNA sequence
cttataagcaagggcggggg

SEQ ID NO: 98945 - DNA, 20 bp, Artificial
  CRISPR gRNA sequence
tataagcaagggcgggggca

SEQ ID NO: 98946 - DNA, 20 bp, Artificial
  CRISPR gRNA sequence
ataagcaagggcgggggcag

SEQ ID NO: 98947 - DNA, 20 bp, Artificial
  CRISPR gRNA sequence
taagcaagggcgggggcaga

SEQ ID NO: 98948 - DNA, 20 bp, Artificial
  CRISPR gRNA sequence
agggcgggggcagagggcta

SEQ ID NO: 98949 - DNA, 20 bp, Artificial
  CRISPR gRNA sequence
gcgggggcagagggctaaag

SEQ ID NO: 98950 - DNA, 20 bp, Artificial
  CRISPR gRNA sequence
cgggggcagagggctaaaga

SEQ ID NO: 98951 - DNA, 20 bp, Artificial
  CRISPR gRNA sequence
gggggcagagggctaaagaa

SEQ ID NO: 98952 - DNA, 20 bp, Artificial
  CRISPR gRNA sequence
gggcagagggctaaagaagg

SEQ ID NO: 98953 - DNA, 20 bp, Artificial
  CRISPR gRNA sequence
gctaaagaagggagtttttg

SEQ ID NO: 98954 - DNA, 20 bp, Artificial
  CRISPR gRNA sequence
gaagggagtttttgcggccc

SEQ ID NO: 98955 - DNA, 20 bp, Artificial
  CRISPR gRNA sequence
gggagtttttgcggcccgag

SEQ ID NO: 98956 - DNA, 20 bp, Artificial
  CRISPR gRNA sequence
ggagtttttgcggcccgagt

SEQ ID NO: 98957 - DNA, 20 bp, Artificial
  CRISPR gRNA sequence
cggcccgagtgggtaatgcg

SEQ ID NO: 98958 - DNA, 20 bp, Artificial
  CRISPR gRNA sequence
gcccgagtgggtaatgcgtg

SEQ ID NO: 98959 - DNA, 20 bp, Artificial
  CRISPR gRNA sequence
cccgagtgggtaatgcgtgg

SEQ ID NO: 98960 - DNA, 20 bp, Artificial
  CRISPR gRNA sequence
actcccccaactcgtctctc

SEQ ID NO: 98961 - DNA, 20 bp, Artificial
  CRISPR gRNA sequence
ctcccccaactcgtctctca

SEQ ID NO: 98962 - DNA, 20 bp, Artificial
  CRISPR gRNA sequence
ccaactcgtctctcaaggaa

SEQ ID NO: 98963 - DNA, 20 bp, Artificial
  CRISPR gRNA sequence
caactcgtctctcaaggaaa

SEQ ID NO: 98964 - DNA, 20 bp, Artificial
  CRISPR gRNA sequence
aactcgtctctcaaggaaaa

SEQ ID NO: 98965 - DNA, 20 bp, Artificial
  CRISPR gRNA sequence
actcgtctctcaaggaaaag

SEQ ID NO: 98966 - DNA, 20 bp, Artificial
  CRISPR gRNA sequence
ctcgtctctcaaggaaaagg

SEQ ID NO: 98967 - DNA, 20 bp, Artificial
  CRISPR gRNA sequence
ctctcaaggaaaagggggtt

SEQ ID NO: 98968 - DNA, 20 bp, Artificial
  CRISPR gRNA sequence
caaggaaaagggggttcaga

SEQ ID NO: 98969 - DNA, 20 bp, Artificial
  CRISPR gRNA sequence
aaggaaaagggggttcagaa

SEQ ID NO: 98970 - DNA, 20 bp, Artificial
  CRISPR gRNA sequence
aggaaaagggggttcagaaa

SEQ ID NO: 98971 - DNA, 20 bp, Artificial
  CRISPR gRNA sequence
gaaaagggggttcagaaagg

SEQ ID NO: 98972 - DNA, 20 bp, Artificial
  CRISPR gRNA sequence
aaagggggttcagaaaggga

SEQ ID NO: 98973 - DNA, 20 bp, Artificial
  CRISPR gRNA sequence
agggggttcagaaagggaga

SEQ ID NO: 98974 - DNA, 20 bp, Artificial
  CRISPR gRNA sequence
gttcttccccctctcctgcc

SEQ ID NO: 98975 - DNA, 20 bp, Artificial
  CRISPR gRNA sequence
ttcttccccctctcctgcct

SEQ ID NO: 98976 - DNA, 20 bp, Artificial
  CRISPR gRNA sequence
ctgcctgggtgtcgctccac

SEQ ID NO: 98977 - DNA, 20 bp, Artificial
  CRISPR gRNA sequence
gtgtcgctccaccagcctcc

SEQ ID NO: 98978 - DNA, 20 bp, Artificial
  CRISPR gRNA sequence
cctcctcactgcgccacccc

SEQ ID NO: 98979 - DNA, 20 bp, Artificial
  CRISPR gRNA sequence
ctcctcactgcgccaccccc

SEQ ID NO: 98980 - DNA, 20 bp, Artificial
  CRISPR gRNA sequence
ctccttccctgcgtctcaca

SEQ ID NO: 98981 - DNA, 20 bp, Artificial
  CRISPR gRNA sequence
cagcccctttcttgtccgca

SEQ ID NO: 98982 - DNA, 20 bp, Artificial
  CRISPR gRNA sequence
ctttcttgtccgcaaagact

SEQ ID NO: 98983 - DNA, 20 bp, Artificial
  CRISPR gRNA sequence
tttcttgtccgcaaagactg

SEQ ID NO: 98984 - DNA, 20 bp, Artificial
  CRISPR gRNA sequence
tcttgtccgcaaagactgag

SEQ ID NO: 98985 - DNA, 20 bp, Artificial
  CRISPR gRNA sequence
tgtccgcaaagactgaggag

SEQ ID NO: 98986 - DNA, 20 bp, Artificial
  CRISPR gRNA sequence
gtccgcaaagactgaggagc

SEQ ID NO: 98987 - DNA, 20 bp, Artificial
  CRISPR gRNA sequence
tccgcaaagactgaggagcg

SEQ ID NO: 98988 - DNA, 20 bp, Artificial
  CRISPR gRNA sequence
cgcaaagactgaggagcggg

SEQ ID NO: 98989 - DNA, 20 bp, Artificial
  CRISPR gRNA sequence
gcaaagactgaggagcgggg

SEQ ID NO: 98990 - DNA, 20 bp, Artificial
  CRISPR gRNA sequence
caaagactgaggagcgggga

SEQ ID NO: 98991 - DNA, 20 bp, Artificial
  CRISPR gRNA sequence
agactgaggagcggggaggg

SEQ ID NO: 98992 - DNA, 20 bp, Artificial
  CRISPR gRNA sequence
gactgaggagcggggagggc

SEQ ID NO: 98993 - DNA, 20 bp, Artificial
  CRISPR gRNA sequence
gagggcgggccctctgacac

SEQ ID NO: 98994 - DNA, 20 bp, Artificial
  CRISPR gRNA sequence
cgggccctctgacaccggaa

SEQ ID NO: 98995 - DNA, 20 bp, Artificial
  CRISPR gRNA sequence
gggccctctgacaccggaac

SEQ ID NO: 98996 - DNA, 20 bp, Artificial
  CRISPR gRNA sequence
gccctctgacaccggaacag

SEQ ID NO: 98997 - DNA, 20 bp, Artificial
  CRISPR gRNA sequence
acaccggaacaggagccgtg

SEQ ID NO: 98998 - DNA, 20 bp, Artificial
  CRISPR gRNA sequence
aacaggagccgtgcggcgtc

SEQ ID NO: 98999 - DNA, 20 bp, Artificial
  CRISPR gRNA sequence
agccgtgcggcgtccggttt

SEQ ID NO: 99000 - DNA, 20 bp, Artificial
  CRISPR gRNA sequence
cgtgcggcgtccggtttcag

SEQ ID NO: 99001 - DNA, 20 bp, Artificial
  CRISPR gRNA sequence
gtgcggcgtccggtttcagc

SEQ ID NO: 99002 - DNA, 20 bp, Artificial
  CRISPR gRNA sequence
tgcggcgtccggtttcagca

SEQ ID NO: 99003 - DNA, 20 bp, Artificial
  CRISPR gRNA sequence
ggcgtccggtttcagcaggg

SEQ ID NO: 99004 - DNA, 20 bp, Artificial
  CRISPR gRNA sequence
gcgtccggtttcagcaggga

SEQ ID NO: 99005 - DNA, 20 bp, Artificial
  CRISPR gRNA sequence
cggtttcagcagggaaggct

SEQ ID NO: 99006 - DNA, 20 bp, Artificial
  CRISPR gRNA sequence
ggtttcagcagggaaggctt

SEQ ID NO: 99007 - DNA, 20 bp, Artificial
  CRISPR gRNA sequence
ttcagcagggaaggcttagg

SEQ ID NO: 99008 - DNA, 20 bp, Artificial
  CRISPR gRNA sequence
tcagcagggaaggcttaggc

SEQ ID NO: 99009 - DNA, 20 bp, Artificial
  CRISPR gRNA sequence
taggcgggcgtcccaacctc

SEQ ID NO: 99010 - DNA, 20 bp, Artificial
  CRISPR gRNA sequence
aggcgggcgtcccaacctcc

SEQ ID NO: 99011 - DNA, 20 bp, Artificial
  CRISPR gRNA sequence
cgtcccaacctccgggcttc

SEQ ID NO: 99012 - DNA, 20 bp, Artificial
  CRISPR gRNA sequence
gggcttccggtgccgtttcc

SEQ ID NO: 99013 - DNA, 20 bp, Artificial
  CRISPR gRNA sequence
gtgccgtttcccggttcgct

SEQ ID NO: 99014 - DNA, 20 bp, Artificial
  CRISPR gRNA sequence
tttcccggttcgctcggccg

SEQ ID NO: 99015 - DNA, 20 bp, Artificial
  CRISPR gRNA sequence
tcgctcggccgcggtcgcta

SEQ ID NO: 99016 - DNA, 20 bp, Artificial
  CRISPR gRNA sequence
gctcggccgcggtcgctatg

SEQ ID NO: 99017 - DNA, 20 bp, Artificial
  CRISPR gRNA sequence
ctcggccgcggtcgctatgg

SEQ ID NO: 99018 - DNA, 20 bp, Artificial
  CRISPR gRNA sequence
cggccgcggtcgctatggag

SEQ ID NO: 99019 - DNA, 20 bp, Artificial
  CRISPR gRNA sequence
cgcggtcgctatggaggagc

SEQ ID NO: 99020 - DNA, 20 bp, Artificial
  CRISPR gRNA sequence
cggtcgctatggaggagccg

SEQ ID NO: 99021 - DNA, 20 bp, Artificial
  CRISPR gRNA sequence
gcagggaaggaggcacaccc

SEQ ID NO: 99022 - DNA, 20 bp, Artificial
  CRISPR gRNA sequence
aacccccttttccttgagag

SEQ ID NO: 99023 - DNA, 20 bp, Artificial
  CRISPR gRNA sequence
ttccttgagagacgagttgg

SEQ ID NO: 99024 - DNA, 20 bp, Artificial
  CRISPR gRNA sequence
cctctggaaaaatctgtggg

SEQ ID NO: 99025 - DNA, 20 bp, Artificial
  CRISPR gRNA sequence
ttaggccccgcccattccct

SEQ ID NO: 99026 - DNA, 20 bp, Artificial
  CRISPR gRNA sequence
cttcctcacttttggggggc

SEQ ID NO: 99027 - DNA, 20 bp, Artificial
  CRISPR gRNA sequence
caagcgcagtgggggagctc

SEQ ID NO: 99028 - DNA, 20 bp, Artificial
  CRISPR gRNA sequence
cagtgggggagctctggggt

SEQ ID NO: 99029 - DNA, 20 bp, Artificial
  CRISPR gRNA sequence
ctctggggtgggggtagcgg

SEQ ID NO: 99030 - DNA, 20 bp, Artificial
  CRISPR gRNA sequence
gcagaggaagccagatcgct

SEQ ID NO: 99031 - DNA, 20 bp, Artificial
  CRISPR gRNA sequence
cagaggaggctcgtggggag

SEQ ID NO: 99032 - DNA, 20 bp, Artificial
  CRISPR gRNA sequence
tggggaggtgagtggacctc

SEQ ID NO: 99033 - DNA, 20 bp, Artificial
  CRISPR gRNA sequence
cctggatcgatttaggaggc

SEQ ID NO: 99034 - DNA, 20 bp, Artificial
  CRISPR gRNA sequence
agcccctcccaacaaccata

SEQ ID NO: 99035 - DNA, 20 bp, Artificial
  CRISPR gRNA sequence
ttctcacggcctataaattg

SEQ ID NO: 99036 - DNA, 20 bp, Artificial
  CRISPR gRNA sequence
ttttttttttttttttgaga

SEQ ID NO: 99037 - DNA, 20 bp, Artificial
  CRISPR gRNA sequence
ctcaccgcaacctccacctc

SEQ ID NO: 99038 - DNA, 20 bp, Artificial
  CRISPR gRNA sequence
agcaattctgcctcagcctc

SEQ ID NO: 99039 - DNA, 20 bp, Artificial
  CRISPR gRNA sequence
gcctcagcctcccgagtagc

SEQ ID NO: 99040 - DNA, 20 bp, Artificial
  CRISPR gRNA sequence
ttttgtatttttagtacaga

SEQ ID NO: 99041 - DNA, 20 bp, Artificial
  CRISPR gRNA sequence
tcctcggcctcccaaagtgc

SEQ ID NO: 99042 - DNA, 20 bp, Artificial
  CRISPR gRNA sequence
ttgtaggtgctttggtggtg

SEQ ID NO: 99043 - DNA, 20 bp, Artificial
  CRISPR gRNA sequence
cagtctctttccctgcacaa

SEQ ID NO: 99044 - DNA, 20 bp, Artificial
  CRISPR gRNA sequence
atgccagtgtttcctctcca

SEQ ID NO: 99045 - DNA, 20 bp, Artificial
  CRISPR gRNA sequence
agtgtttcctctccacaggg

SEQ ID NO: 99046 - DNA, 20 bp, Artificial
  CRISPR gRNA sequence
acagggtaggatacctcctc

SEQ ID NO: 99047 - DNA, 20 bp, Artificial
  CRISPR gRNA sequence
ctcctctgggattagccctc

SEQ ID NO: 99048 - DNA, 20 bp, Artificial
  CRISPR gRNA sequence
cctctgggattccatgatga

SEQ ID NO: 99049 - DNA, 20 bp, Artificial
  CRISPR gRNA sequence
tgttttgttgttttttgaga

SEQ ID NO: 99050 - DNA, 20 bp, Artificial
  CRISPR gRNA sequence
tttgctcttgttgcccatgc

SEQ ID NO: 99051 - DNA, 20 bp, Artificial
  CRISPR gRNA sequence
ctcactgcaacctctgcctc

SEQ ID NO: 99052 - DNA, 20 bp, Artificial
  CRISPR gRNA sequence
gattctcctgtctcagcctc

SEQ ID NO: 99053 - DNA, 20 bp, Artificial
  CRISPR gRNA sequence
gtctcagcctcctgagtagc

SEQ ID NO: 99054 - DNA, 20 bp, Artificial
  CRISPR gRNA sequence
cactacgcccagctaatttt

SEQ ID NO: 99055 - DNA, 20 bp, Artificial
  CRISPR gRNA sequence
ttgggtatttttagtagaga

SEQ ID NO: 99056 - DNA, 20 bp, Artificial
  CRISPR gRNA sequence
acctcggcctcccaaagtgc

SEQ ID NO: 99057 - DNA, 20 bp, Artificial
  CRISPR gRNA sequence
cctgtttttgttttttgata

SEQ ID NO: 99058 - DNA, 20 bp, Artificial
  CRISPR gRNA sequence
tctcgctctgttactaaggc

SEQ ID NO: 99059 - DNA, 20 bp, Artificial
  CRISPR gRNA sequence
gcctccacttccgaaagtgc

SEQ ID NO: 99060 - DNA, 20 bp, Artificial
  CRISPR gRNA sequence
acacctgtttttaactcttt

SEQ ID NO: 99061 - DNA, 20 bp, Artificial
  CRISPR gRNA sequence
ctctttgagggtagatagct

SEQ ID NO: 99062 - DNA, 20 bp, Artificial
  CRISPR gRNA sequence
gatagctaggagtgaaatta

SEQ ID NO: 99063 - DNA, 20 bp, Artificial
  CRISPR gRNA sequence
gttttacttactgaggaact

SEQ ID NO: 99064 - DNA, 20 bp, Artificial
  CRISPR gRNA sequence
actgaggatttatttttgat

SEQ ID NO: 99065 - DNA, 20 bp, Artificial
  CRISPR gRNA sequence
tttatttttgattggagtcc

SEQ ID NO: 99066 - DNA, 20 bp, Artificial
  CRISPR gRNA sequence
ttgttgctgccactcctgtc

SEQ ID NO: 99067 - DNA, 20 bp, Artificial
  CRISPR gRNA sequence
ctttctttctttttttgaga

SEQ ID NO: 99068 - DNA, 20 bp, Artificial
  CRISPR gRNA sequence
tctcgctctgtcgcccaggc

SEQ ID NO: 99069 - DNA, 20 bp, Artificial
  CRISPR gRNA sequence
gtcgcccaggctggagtgca

SEQ ID NO: 99070 - DNA, 20 bp, Artificial
  CRISPR gRNA sequence
cattctcctgcttcagcctc

SEQ ID NO: 99071 - DNA, 20 bp, Artificial
  CRISPR gRNA sequence
ccccactctcgagacgcctc

SEQ ID NO: 99072 - DNA, 20 bp, Artificial
  CRISPR gRNA sequence
gatcccctctcttcttgaga

SEQ ID NO: 99073 - DNA, 20 bp, Artificial
  CRISPR gRNA sequence
cagaatcttgctctgttgtc

SEQ ID NO: 99074 - DNA, 20 bp, Artificial
  CRISPR gRNA sequence
tcttgctctgttgtccaggg

SEQ ID NO: 99075 - DNA, 20 bp, Artificial
  CRISPR gRNA sequence
actcactgcaactccctctc

SEQ ID NO: 99076 - DNA, 20 bp, Artificial
  CRISPR gRNA sequence
ttttgtgtttttagtagaga

SEQ ID NO: 99077 - DNA, 20 bp, Artificial
  CRISPR gRNA sequence
gcctcggcctcccaaagtgc

SEQ ID NO: 99078 - DNA, 20 bp, Artificial
  CRISPR gRNA sequence
caccgcgcccagtccctgta

SEQ ID NO: 99079 - DNA, 20 bp, Artificial
  CRISPR gRNA sequence
ttttttttttttttttgaga

SEQ ID NO: 99080 - DNA, 20 bp, Artificial
  CRISPR gRNA sequence
ctcactcttgttgcccaggc

SEQ ID NO: 99081 - DNA, 20 bp, Artificial
  CRISPR gRNA sequence
ctcactgcaacctccacctc

SEQ ID NO: 99082 - DNA, 20 bp, Artificial
  CRISPR gRNA sequence
gattctcctgcctcagcctc

SEQ ID NO: 99083 - DNA, 20 bp, Artificial
  CRISPR gRNA sequence
gcctcagcctcccgagtagc

SEQ ID NO: 99084 - DNA, 20 bp, Artificial
  CRISPR gRNA sequence
ttttgtgtttttagtagagg

SEQ ID NO: 99085 - DNA, 20 bp, Artificial
  CRISPR gRNA sequence
acctcagcctcccaaagtgc

SEQ ID NO: 99086 - DNA, 20 bp, Artificial
  CRISPR gRNA sequence
agggaggagaaagatgcacc

SEQ ID NO: 99087 - DNA, 20 bp, Artificial
  CRISPR gRNA sequence
gatgcaccctgggtattcaa

SEQ ID NO: 99088 - DNA, 20 bp, Artificial
  CRISPR gRNA sequence
accctgggtattcaagagag

SEQ ID NO: 99089 - DNA, 20 bp, Artificial
  CRISPR gRNA sequence
tgggtattcaagagagtaga

SEQ ID NO: 99090 - DNA, 20 bp, Artificial
  CRISPR gRNA sequence
tattcaagagagtagagtga

SEQ ID NO: 99091 - DNA, 20 bp, Artificial
  CRISPR gRNA sequence
agagtagagtgagtgaatgg

SEQ ID NO: 99092 - DNA, 20 bp, Artificial
  CRISPR gRNA sequence
actttgggaggccacggcag

SEQ ID NO: 99093 - DNA, 20 bp, Artificial
  CRISPR gRNA sequence
caggagaattgcttgagccc

SEQ ID NO: 99094 - DNA, 20 bp, Artificial
  CRISPR gRNA sequence
atatatatatttttaatttg

SEQ ID NO: 99095 - DNA, 20 bp, Artificial
  CRISPR gRNA sequence
aaaaaaaaaaaccccaatag

SEQ ID NO: 99096 - DNA, 20 bp, Artificial
  CRISPR gRNA sequence
actttgggaggctgaggcag

SEQ ID NO: 99097 - DNA, 20 bp, Artificial
  CRISPR gRNA sequence
caggtggatgatttgaggtc

SEQ ID NO: 99098 - DNA, 20 bp, Artificial
  CRISPR gRNA sequence
tactcgggaggctgaggcac

SEQ ID NO: 99099 - DNA, 20 bp, Artificial
  CRISPR gRNA sequence
tctgccggccaccctagact

SEQ ID NO: 99100 - DNA, 20 bp, Artificial
  CRISPR gRNA sequence
ccacggtccccaacaaggag

SEQ ID NO: 99101 - DNA, 20 bp, Artificial
  CRISPR gRNA sequence
cccaacaaggagaggagtag

SEQ ID NO: 99102 - DNA, 20 bp, Artificial
  CRISPR gRNA sequence
gtgaggagcaatcgtggaca

SEQ ID NO: 99103 - DNA, 20 bp, Artificial
  CRISPR gRNA sequence
actgaggcacagagaagcaa

SEQ ID NO: 99104 - DNA, 20 bp, Artificial
  CRISPR gRNA sequence
aggcacagagaagcaagggg

SEQ ID NO: 99105 - DNA, 20 bp, Artificial
  CRISPR gRNA sequence
cacctggctggtgtgtgcat

SEQ ID NO: 99106 - DNA, 20 bp, Artificial
  CRISPR gRNA sequence
acccactcatgacgtgacct

SEQ ID NO: 99107 - DNA, 20 bp, Artificial
  CRISPR gRNA sequence
cgtccccatttggcagcact

SEQ ID NO: 99108 - DNA, 20 bp, Artificial
  CRISPR gRNA sequence
cagcactggggatagggggc

SEQ ID NO: 99109 - DNA, 20 bp, Artificial
  CRISPR gRNA sequence
tgagaccgttcgcttcctgc

SEQ ID NO: 99110 - DNA, 20 bp, Artificial
  CRISPR gRNA sequence
accgttcgcttcctgctgga

SEQ ID NO: 99111 - DNA, 20 bp, Artificial
  CRISPR gRNA sequence
ccagcccagctgggcagctg

SEQ ID NO: 99112 - DNA, 20 bp, Artificial
  CRISPR gRNA sequence
tggggggttcccgggggcct

SEQ ID NO: 99113 - DNA, 20 bp, Artificial
  CRISPR gRNA sequence
ccgggggccttagggtgggc

SEQ ID NO: 99114 - DNA, 20 bp, Artificial
  CRISPR gRNA sequence
ctttgagatgcggctgctgg

SEQ ID NO: 99115 - DNA, 20 bp, Artificial
  CRISPR gRNA sequence
cagcactttgggaggccgag

SEQ ID NO: 99116 - DNA, 20 bp, Artificial
  CRISPR gRNA sequence
actttgggaggccgaggcgg

SEQ ID NO: 99117 - DNA, 20 bp, Artificial
  CRISPR gRNA sequence
cgggtggatcacttgaggtc

SEQ ID NO: 99118 - DNA, 20 bp, Artificial
  CRISPR gRNA sequence
tcaagaccagcccggccaac

SEQ ID NO: 99119 - DNA, 20 bp, Artificial
  CRISPR gRNA sequence
aaaattagccaggcgtcgtg

SEQ ID NO: 99120 - DNA, 20 bp, Artificial
  CRISPR gRNA sequence
aaaaaaaagatgcggctgct

SEQ ID NO: 99121 - DNA, 20 bp, Artificial
  CRISPR gRNA sequence
tgcggctgctgtgggtaccc

SEQ ID NO: 99122 - DNA, 20 bp, Artificial
  CRISPR gRNA sequence
actgtcccttcttctccctg

SEQ ID NO: 99123 - DNA, 20 bp, Artificial
  CRISPR gRNA sequence
gtggacatcaacatctatga

SEQ ID NO: 99124 - DNA, 20 bp, Artificial
  CRISPR gRNA sequence
attcctgcctcaaatgttca

SEQ ID NO: 99125 - DNA, 20 bp, Artificial
  CRISPR gRNA sequence
ccacgttcaactggaggcca

SEQ ID NO: 99126 - DNA, 20 bp, Artificial
  CRISPR gRNA sequence
cagagagtacaaggcatttt

SEQ ID NO: 99127 - DNA, 20 bp, Artificial
  CRISPR gRNA sequence
tctcctgcccctacccacga

SEQ ID NO: 99128 - DNA, 20 bp, Artificial
  CRISPR gRNA sequence
tgaaatgcgttgaggccttg

SEQ ID NO: 99129 - DNA, 20 bp, Artificial
  CRISPR gRNA sequence
atgcgttgaggccttgctgg

SEQ ID NO: 99130 - DNA, 20 bp, Artificial
  CRISPR gRNA sequence
tgaggccttgctgggtgagt

SEQ ID NO: 99131 - DNA, 20 bp, Artificial
  CRISPR gRNA sequence
ttgctgggtgagtgggagtc

SEQ ID NO: 99132 - DNA, 20 bp, Artificial
  CRISPR gRNA sequence
agcactccagcgggccctgc

SEQ ID NO: 99133 - DNA, 20 bp, Artificial
  CRISPR gRNA sequence
agacgcccaagtgttgcttg

SEQ ID NO: 99134 - DNA, 20 bp, Artificial
  CRISPR gRNA sequence
gtccctgcctgctcttctcg

SEQ ID NO: 99135 - DNA, 20 bp, Artificial
  CRISPR gRNA sequence
ctgcctgctcttctcggagg

SEQ ID NO: 99136 - DNA, 20 bp, Artificial
  CRISPR gRNA sequence
aggaggtggtaggaccacac

SEQ ID NO: 99137 - DNA, 20 bp, Artificial
  CRISPR gRNA sequence
tggtaggaccacacgggagt

SEQ ID NO: 99138 - DNA, 20 bp, Artificial
  CRISPR gRNA sequence
gaccacacgggagtcggggt

SEQ ID NO: 99139 - DNA, 20 bp, Artificial
  CRISPR gRNA sequence
cgggagtcggggtctgggtt

SEQ ID NO: 99140 - DNA, 20 bp, Artificial
  CRISPR gRNA sequence
agacccacggctgcattgtg

SEQ ID NO: 99141 - DNA, 20 bp, Artificial
  CRISPR gRNA sequence
cggctgcattgtggggaatg

SEQ ID NO: 99142 - DNA, 20 bp, Artificial
  CRISPR gRNA sequence
gtggggaatgaggggtgcca

SEQ ID NO: 99143 - DNA, 20 bp, Artificial
  CRISPR gRNA sequence
gatggaccttgccgtggccc

SEQ ID NO: 99144 - DNA, 20 bp, Artificial
  CRISPR gRNA sequence
cagcctgagacacacagagc

SEQ ID NO: 99145 - DNA, 20 bp, Artificial
  CRISPR gRNA sequence
tgagacacacagagcagggg

SEQ ID NO: 99146 - DNA, 20 bp, Artificial
  CRISPR gRNA sequence
ggtggggtcccttccatagg

SEQ ID NO: 99147 - DNA, 20 bp, Artificial
  CRISPR gRNA sequence
cataggcagggtgaccataa

SEQ ID NO: 99148 - DNA, 20 bp, Artificial
  CRISPR gRNA sequence
agtggtcatacgccggcagc

SEQ ID NO: 99149 - DNA, 20 bp, Artificial
  CRISPR gRNA sequence
tcctggggctccacatgtgc

SEQ ID NO: 99150 - DNA, 20 bp, Artificial
  CRISPR gRNA sequence
gtgctggggtagggaggaca

SEQ ID NO: 99151 - DNA, 20 bp, Artificial
  CRISPR gRNA sequence
aagtgaggtgggcccagccc

SEQ ID NO: 99152 - DNA, 20 bp, Artificial
  CRISPR gRNA sequence
ctgggatggggaggtcaggg

SEQ ID NO: 99153 - DNA, 20 bp, Artificial
  CRISPR gRNA sequence
ctgggggacctgaagggagg

SEQ ID NO: 99154 - DNA, 20 bp, Artificial
  CRISPR gRNA sequence
gagaatggcatccaggtggg

SEQ ID NO: 99155 - DNA, 20 bp, Artificial
  CRISPR gRNA sequence
gcctggcagtgaggacacca

SEQ ID NO: 99156 - DNA, 20 bp, Artificial
  CRISPR gRNA sequence
atccctctccgtggcgggca

SEQ ID NO: 99157 - DNA, 20 bp, Artificial
  CRISPR gRNA sequence
tcccaattgaaccgaccccc

SEQ ID NO: 99158 - DNA, 20 bp, Artificial
  CRISPR gRNA sequence
ccctggggtcatggtagaga

SEQ ID NO: 99159 - DNA, 20 bp, Artificial
  CRISPR gRNA sequence
aaatatccccctccttcctt

SEQ ID NO: 99160 - DNA, 20 bp, Artificial
  CRISPR gRNA sequence
cttccctcctcatgttttcg

SEQ ID NO: 99161 - DNA, 20 bp, Artificial
  CRISPR gRNA sequence
tcttgctctatcacccaggc

SEQ ID NO: 99162 - DNA, 20 bp, Artificial
  CRISPR gRNA sequence
gatcctcccaccacagcctc

SEQ ID NO: 99163 - DNA, 20 bp, Artificial
  CRISPR gRNA sequence
tttttttttttttttggaca

SEQ ID NO: 99164 - DNA, 20 bp, Artificial
  CRISPR gRNA sequence
tctcgcgctgtcacccaggc

SEQ ID NO: 99165 - DNA, 20 bp, Artificial
  CRISPR gRNA sequence
gattctcctgcctcagcctc

SEQ ID NO: 99166 - DNA, 20 bp, Artificial
  CRISPR gRNA sequence
ttttatatttttagtagaga

SEQ ID NO: 99167 - DNA, 20 bp, Artificial
  CRISPR gRNA sequence
gtgttggcctcccaaagtgc

SEQ ID NO: 99168 - DNA, 20 bp, Artificial
  CRISPR gRNA sequence
tgttgtttttttagaagaga

SEQ ID NO: 99169 - DNA, 20 bp, Artificial
  CRISPR gRNA sequence
gatccttcttccccagcctc

SEQ ID NO: 99170 - DNA, 20 bp, Artificial
  CRISPR gRNA sequence
tttttatttattttttgaga

SEQ ID NO: 99171 - DNA, 20 bp, Artificial
  CRISPR gRNA sequence
tctcgctctgtcacccaggc

SEQ ID NO: 99172 - DNA, 20 bp, Artificial
  CRISPR gRNA sequence
aattctcctgcctcagcctc

SEQ ID NO: 99173 - DNA, 20 bp, Artificial
  CRISPR gRNA sequence
gcctcagcctcctgaatagc

SEQ ID NO: 99174 - DNA, 20 bp, Artificial
  CRISPR gRNA sequence
ttttttttttttttttgaga

SEQ ID NO: 99175 - DNA, 20 bp, Artificial
  CRISPR gRNA sequence
ttcgctcttgttgcccaggc

SEQ ID NO: 99176 - DNA, 20 bp, Artificial
  CRISPR gRNA sequence
gcctcagcctcccaagtagc

SEQ ID NO: 99177 - DNA, 20 bp, Artificial
  CRISPR gRNA sequence
ctaattttttgcatttttag

SEQ ID NO: 99178 - DNA, 20 bp, Artificial
  CRISPR gRNA sequence
ttttgcatttttagtagagt

SEQ ID NO: 99179 - DNA, 20 bp, Artificial
  CRISPR gRNA sequence
gcctcagcttcccaaagtgc

SEQ ID NO: 99180 - DNA, 20 bp, Artificial
  CRISPR gRNA sequence
ttttgtagttttagtagaga

SEQ ID NO: 99181 - DNA, 20 bp, Artificial
  CRISPR gRNA sequence
accttggcctcccaaagtgc

SEQ ID NO: 99182 - DNA, 20 bp, Artificial
  CRISPR gRNA sequence
cactggacctcccaaagtgc

SEQ ID NO: 99183 - DNA, 20 bp, Artificial
  CRISPR gRNA sequence
ttaggggaagttgaggttcc

SEQ ID NO: 99184 - DNA, 20 bp, Artificial
  CRISPR gRNA sequence
gggaagttgaggttcctggg

SEQ ID NO: 99185 - DNA, 20 bp, Artificial
  CRISPR gRNA sequence
tctgtaatgcaggtctctgc

SEQ ID NO: 99186 - DNA, 20 bp, Artificial
  CRISPR gRNA sequence
caacctggtgcccgctgacc

SEQ ID NO: 99187 - DNA, 20 bp, Artificial
  CRISPR gRNA sequence
gaaccaataaaccttctgtg

SEQ ID NO: 99188 - DNA, 20 bp, Artificial
  CRISPR gRNA sequence
cgtgtggtcatctaccacct

SEQ ID NO: 99189 - DNA, 20 bp, Artificial
  CRISPR gRNA sequence
gtttattggttcctcttggg

SEQ ID NO: 99190 - DNA, 20 bp, Artificial
  CRISPR gRNA sequence
agctgcctttgaagtcagtt

SEQ ID NO: 99191 - DNA, 20 bp, Artificial
  CRISPR gRNA sequence
ctggctgaccattttgttcc

SEQ ID NO: 99192 - DNA, 20 bp, Artificial
  CRISPR gRNA sequence
ccattttgttccctgagtgt

SEQ ID NO: 99193 - DNA, 20 bp, Artificial
  CRISPR gRNA sequence
cccggcaggcggccttcact

SEQ ID NO: 99194 - DNA, 20 bp, Artificial
  CRISPR gRNA sequence
aggttgctctggaagagctt

SEQ ID NO: 99195 - DNA, 20 bp, Artificial
  CRISPR gRNA sequence
ggaaaaggtgggctgtgagc

SEQ ID NO: 99196 - DNA, 20 bp, Artificial
  CRISPR gRNA sequence
gtgggctgtgagcttgaatc

SEQ ID NO: 99197 - DNA, 20 bp, Artificial
  CRISPR gRNA sequence
ctgtgagcttgaatcgggag

SEQ ID NO: 99198 - DNA, 20 bp, Artificial
  CRISPR gRNA sequence
aatgcacttttgtagctttt

SEQ ID NO: 99199 - DNA, 20 bp, Artificial
  CRISPR gRNA sequence
tttcctaccaagcaaaatgt

SEQ ID NO: 99200 - DNA, 20 bp, Artificial
  CRISPR gRNA sequence
ggggaggactgcttgagctc

SEQ ID NO: 99201 - DNA, 20 bp, Artificial
  CRISPR gRNA sequence
actttgggaggccaaggtag

SEQ ID NO: 99202 - DNA, 20 bp, Artificial
  CRISPR gRNA sequence
caaaaattagccaggtgcag

SEQ ID NO: 99203 - DNA, 20 bp, Artificial
  CRISPR gRNA sequence
cagcactttgggaagctgag

SEQ ID NO: 99204 - DNA, 20 bp, Artificial
  CRISPR gRNA sequence
actttgggaagctgaggcgg

SEQ ID NO: 99205 - DNA, 20 bp, Artificial
  CRISPR gRNA sequence
cgggtggatcacctgaggtc

SEQ ID NO: 99206 - DNA, 20 bp, Artificial
  CRISPR gRNA sequence
tacttgggaggctgaggcag

SEQ ID NO: 99207 - DNA, 20 bp, Artificial
  CRISPR gRNA sequence
tattcaggaggctgaggcag

SEQ ID NO: 99208 - DNA, 20 bp, Artificial
  CRISPR gRNA sequence
ttgtgccactgcactccagc

SEQ ID NO: 99209 - DNA, 20 bp, Artificial
  CRISPR gRNA sequence
aaaaagattttaaaaattag

SEQ ID NO: 99210 - DNA, 20 bp, Artificial
  CRISPR gRNA sequence
gattttaaaaattagctggg

SEQ ID NO: 99211 - DNA, 20 bp, Artificial
  CRISPR gRNA sequence
tactcaggaggctggggaag

SEQ ID NO: 99212 - DNA, 20 bp, Artificial
  CRISPR gRNA sequence
aagaaggatcacttgagccc

SEQ ID NO: 99213 - DNA, 20 bp, Artificial
  CRISPR gRNA sequence
actttgggaggccaacacag

SEQ ID NO: 99214 - DNA, 20 bp, Artificial
  CRISPR gRNA sequence
cacaggcggatcacaaggtc

SEQ ID NO: 99215 - DNA, 20 bp, Artificial
  CRISPR gRNA sequence
tactcaggaggctgaggcag

SEQ ID NO: 99216 - DNA, 20 bp, Artificial
  CRISPR gRNA sequence
tggcgccattgcactccagc

SEQ ID NO: 99217 - DNA, 20 bp, Artificial
  CRISPR gRNA sequence
aaaattagccaggcatggtg

SEQ ID NO: 99218 - DNA, 20 bp, Artificial
  CRISPR gRNA sequence
tactcgggaggctgtggtgg

SEQ ID NO: 99219 - DNA, 20 bp, Artificial
  CRISPR gRNA sequence
ctgcaccacttcattccagc

SEQ ID NO: 99220 - DNA, 20 bp, Artificial
  CRISPR gRNA sequence
cgaaaacatgaggagggaag

SEQ ID NO: 99221 - DNA, 20 bp, Artificial
  CRISPR gRNA sequence
taaaactctgaaggaaggag

SEQ ID NO: 99222 - DNA, 20 bp, Artificial
  CRISPR gRNA sequence
ccatctctaccatgacccca

SEQ ID NO: 99223 - DNA, 20 bp, Artificial
  CRISPR gRNA sequence
ccccagggggtcggttcaat

SEQ ID NO: 99224 - DNA, 20 bp, Artificial
  CRISPR gRNA sequence
aattgggatctccccatttt

SEQ ID NO: 99225 - DNA, 20 bp, Artificial
  CRISPR gRNA sequence
cattttatggatggggaagt

SEQ ID NO: 99226 - DNA, 20 bp, Artificial
  CRISPR gRNA sequence
tcccattgtgacagagaaaa

SEQ ID NO: 99227 - DNA, 20 bp, Artificial
  CRISPR gRNA sequence
cagagaaaatggagtcaaac

SEQ ID NO: 99228 - DNA, 20 bp, Artificial
  CRISPR gRNA sequence
acccactgcccgccacggag

SEQ ID NO: 99229 - DNA, 20 bp, Artificial
  CRISPR gRNA sequence
gcaggggccactcctcccac

SEQ ID NO: 99230 - DNA, 20 bp, Artificial
  CRISPR gRNA sequence
ctccctcccttcaggtcccc

SEQ ID NO: 99231 - DNA, 20 bp, Artificial
  CRISPR gRNA sequence
gctgggcccacctcacttct

SEQ ID NO: 99232 - DNA, 20 bp, Artificial
  CRISPR gRNA sequence
ggagccccaggagccaggac

SEQ ID NO: 99233 - DNA, 20 bp, Artificial
  CRISPR gRNA sequence
aggactgggatgttcccagg

SEQ ID NO: 99234 - DNA, 20 bp, Artificial
  CRISPR gRNA sequence
tgccggcgtatgaccactga

SEQ ID NO: 99235 - DNA, 20 bp, Artificial
  CRISPR gRNA sequence
agggccacggcaaggtccat

SEQ ID NO: 99236 - DNA, 20 bp, Artificial
  CRISPR gRNA sequence
aaggtccatcggggtgtagc

SEQ ID NO: 99237 - DNA, 20 bp, Artificial
  CRISPR gRNA sequence
aaggagaggggagggcgctg

SEQ ID NO: 99238 - DNA, 20 bp, Artificial
  CRISPR gRNA sequence
ggcgctggagggtggggcct

SEQ ID NO: 99239 - DNA, 20 bp, Artificial
  CRISPR gRNA sequence
gagggtggggcctgggagtc

SEQ ID NO: 99240 - DNA, 20 bp, Artificial
  CRISPR gRNA sequence
tggggcctgggagtccagaa

SEQ ID NO: 99241 - DNA, 20 bp, Artificial
  CRISPR gRNA sequence
tcattccccacaatgcagcc

SEQ ID NO: 99242 - DNA, 20 bp, Artificial
  CRISPR gRNA sequence
ttgcccatgtggcctttgac

SEQ ID NO: 99243 - DNA, 20 bp, Artificial
  CRISPR gRNA sequence
tccactgaagaacgtggctg

SEQ ID NO: 99244 - DNA, 20 bp, Artificial
  CRISPR gRNA sequence
tgaagggtctctgaaccatg

SEQ ID NO: 99245 - DNA, 20 bp, Artificial
  CRISPR gRNA sequence
cttgggcgtctccctgccct

SEQ ID NO: 99246 - DNA, 20 bp, Artificial
  CRISPR gRNA sequence
aggattcccgcagggcccgc

SEQ ID NO: 99247 - DNA, 20 bp, Artificial
  CRISPR gRNA sequence
tggcgtccctccattctgtc

SEQ ID NO: 99248 - DNA, 20 bp, Artificial
  CRISPR gRNA sequence
actgggcccatctcactttc

SEQ ID NO: 99249 - DNA, 20 bp, Artificial
  CRISPR gRNA sequence
gagctctgctctgtgaggct

SEQ ID NO: 99250 - DNA, 20 bp, Artificial
  CRISPR gRNA sequence
actctgtgaacatttgaggc

SEQ ID NO: 99251 - DNA, 20 bp, Artificial
  CRISPR gRNA sequence
ccaggaggctgagaggtcct

SEQ ID NO: 99252 - DNA, 20 bp, Artificial
  CRISPR gRNA sequence
gcgctctctcgctcttttgc

SEQ ID NO: 99253 - DNA, 20 bp, Artificial
  CRISPR gRNA sequence
tcgctcttttgccaggatgt

SEQ ID NO: 99254 - DNA, 20 bp, Artificial
  CRISPR gRNA sequence
gggagaagaagggacagtgg

SEQ ID NO: 99255 - DNA, 20 bp, Artificial
  CRISPR gRNA sequence
gaagaagggacagtggtagg

SEQ ID NO: 99256 - DNA, 20 bp, Artificial
  CRISPR gRNA sequence
ggatggattggggcataacc

SEQ ID NO: 99257 - DNA, 20 bp, Artificial
  CRISPR gRNA sequence
tggggcataaccaggaatcc

SEQ ID NO: 99258 - DNA, 20 bp, Artificial
  CRISPR gRNA sequence
tttttttttttttttggaga

SEQ ID NO: 99259 - DNA, 20 bp, Artificial
  CRISPR gRNA sequence
tcttgctctgttgcccaggc

SEQ ID NO: 99260 - DNA, 20 bp, Artificial
  CRISPR gRNA sequence
agttctcccacctcagcctc

SEQ ID NO: 99261 - DNA, 20 bp, Artificial
  CRISPR gRNA sequence
acctcagcctccagagtacc

SEQ ID NO: 99262 - DNA, 20 bp, Artificial
  CRISPR gRNA sequence
ttgtatttttttagtagaga

SEQ ID NO: 99263 - DNA, 20 bp, Artificial
  CRISPR gRNA sequence
gcctcggcctcccaaagtgc

SEQ ID NO: 99264 - DNA, 20 bp, Artificial
  CRISPR gRNA sequence
aaggcggaggcccagatgag

SEQ ID NO: 99265 - DNA, 20 bp, Artificial
  CRISPR gRNA sequence
atggggacgaggtggggggc

SEQ ID NO: 99266 - DNA, 20 bp, Artificial
  CRISPR gRNA sequence
ggggggctggggttagacag

SEQ ID NO: 99267 - DNA, 20 bp, Artificial
  CRISPR gRNA sequence
ggacactcacaggtcacgtc

SEQ ID NO: 99268 - DNA, 20 bp, Artificial
  CRISPR gRNA sequence
actcacaggtcacgtcatga

SEQ ID NO: 99269 - DNA, 20 bp, Artificial
  CRISPR gRNA sequence
tccccctgtgctgcgagctg

SEQ ID NO: 99270 - DNA, 20 bp, Artificial
  CRISPR gRNA sequence
gggctggggcaggacagagg

SEQ ID NO: 99271 - DNA, 20 bp, Artificial
  CRISPR gRNA sequence
ccgtgggcccactcacagtc

SEQ ID NO: 99272 - DNA, 20 bp, Artificial
  CRISPR gRNA sequence
ttccctcgctgccggttggt

SEQ ID NO: 99273 - DNA, 20 bp, Artificial
  CRISPR gRNA sequence
ctgccggttggtgagagtgg

SEQ ID NO: 99274 - DNA, 20 bp, Artificial
  CRISPR gRNA sequence
gttgctgttgttgtttgaga

SEQ ID NO: 99275 - DNA, 20 bp, Artificial
  CRISPR gRNA sequence
tctccgtctgtcccccaggc

SEQ ID NO: 99276 - DNA, 20 bp, Artificial
  CRISPR gRNA sequence
ctcactgcaacctctgcctc

SEQ ID NO: 99277 - DNA, 20 bp, Artificial
  CRISPR gRNA sequence
gattcttgtgcctcagcctc

SEQ ID NO: 99278 - DNA, 20 bp, Artificial
  CRISPR gRNA sequence
gcctcagcctcccgagtagc

SEQ ID NO: 99279 - DNA, 20 bp, Artificial
  CRISPR gRNA sequence
ttttgtattttaagtagaga

SEQ ID NO: 99280 - DNA, 20 bp, Artificial
  CRISPR gRNA sequence
gcctcagcctcccaaagtgc

SEQ ID NO: 99281 - DNA, 20 bp, Artificial
  CRISPR gRNA sequence
gagccaccacacccagctat

SEQ ID NO: 99282 - DNA, 20 bp, Artificial
  CRISPR gRNA sequence
ggttttttttttttttgaga

SEQ ID NO: 99283 - DNA, 20 bp, Artificial
  CRISPR gRNA sequence
tcttgctctgttgtccaggc

SEQ ID NO: 99284 - DNA, 20 bp, Artificial
  CRISPR gRNA sequence
tatatatatattggtagaga

SEQ ID NO: 99285 - DNA, 20 bp, Artificial
  CRISPR gRNA sequence
gccgtggcctcccaaagtgc

SEQ ID NO: 99286 - DNA, 20 bp, Artificial
  CRISPR gRNA sequence
tactgccttcggtatctccc

SEQ ID NO: 99287 - DNA, 20 bp, Artificial
  CRISPR gRNA sequence
cattcactcactctactctc

SEQ ID NO: 99288 - DNA, 20 bp, Artificial
  CRISPR gRNA sequence
actctactctcttgaatacc

SEQ ID NO: 99289 - DNA, 20 bp, Artificial
  CRISPR gRNA sequence
gacatagtttttgccctcta

SEQ ID NO: 99290 - DNA, 20 bp, Artificial
  CRISPR gRNA sequence
tttttgccctctagggagtc

SEQ ID NO: 99291 - DNA, 20 bp, Artificial
  CRISPR gRNA sequence
cagcactttgggaggctgag

SEQ ID NO: 99292 - DNA, 20 bp, Artificial
  CRISPR gRNA sequence
actttgggaggctgaggtgg

SEQ ID NO: 99293 - DNA, 20 bp, Artificial
  CRISPR gRNA sequence
tgggtggatcacctgaggtc

SEQ ID NO: 99294 - DNA, 20 bp, Artificial
  CRISPR gRNA sequence
tactcgggaggctgaggcag

SEQ ID NO: 99295 - DNA, 20 bp, Artificial
  CRISPR gRNA sequence
ggctgaggcaggagaatcgc

SEQ ID NO: 99296 - DNA, 20 bp, Artificial
  CRISPR gRNA sequence
tgcactccagcctgggcaac

SEQ ID NO: 99297 - DNA, 20 bp, Artificial
  CRISPR gRNA sequence
aaatttaaaagcaggtagaa

SEQ ID NO: 99298 - DNA, 20 bp, Artificial
  CRISPR gRNA sequence
gatgaaaagaacggagcaca

SEQ ID NO: 99299 - DNA, 20 bp, Artificial
  CRISPR gRNA sequence
gcgggcaatcacctgaggtc

SEQ ID NO: 99300 - DNA, 20 bp, Artificial
  CRISPR gRNA sequence
actaaaaacacaaaaattag

SEQ ID NO: 99301 - DNA, 20 bp, Artificial
  CRISPR gRNA sequence
tacttgggaggctgaggcag

SEQ ID NO: 99302 - DNA, 20 bp, Artificial
  CRISPR gRNA sequence
aatcaccttaacccaggaga

SEQ ID NO: 99303 - DNA, 20 bp, Artificial
  CRISPR gRNA sequence
acccaggagagggagttgca

SEQ ID NO: 99304 - DNA, 20 bp, Artificial
  CRISPR gRNA sequence
gattctgtctcaagaagaga

SEQ ID NO: 99305 - DNA, 20 bp, Artificial
  CRISPR gRNA sequence
ggggatccaggaggcgtctc

SEQ ID NO: 99306 - DNA, 20 bp, Artificial
  CRISPR gRNA sequence
tactcgggaggctgaagcag

SEQ ID NO: 99307 - DNA, 20 bp, Artificial
  CRISPR gRNA sequence
cgggaagggagggaggggag

SEQ ID NO: 99308 - DNA, 20 bp, Artificial
  CRISPR gRNA sequence
gtaggaagagcattccagac

SEQ ID NO: 99309 - DNA, 20 bp, Artificial
  CRISPR gRNA sequence
cagttcctcagtaagtaaaa

SEQ ID NO: 99310 - DNA, 20 bp, Artificial
  CRISPR gRNA sequence
ctcctagctatctaccctca

SEQ ID NO: 99311 - DNA, 20 bp, Artificial
  CRISPR gRNA sequence
agtcccagctcctagggagg

SEQ ID NO: 99312 - DNA, 20 bp, Artificial
  CRISPR gRNA sequence
actttgggaggccgaggtgg

SEQ ID NO: 99313 - DNA, 20 bp, Artificial
  CRISPR gRNA sequence
tgggcggatcacctgaggtc

SEQ ID NO: 99314 - DNA, 20 bp, Artificial
  CRISPR gRNA sequence
tactcaggaggctgagacag

SEQ ID NO: 99315 - DNA, 20 bp, Artificial
  CRISPR gRNA sequence
ggcctgacattccatcatca

SEQ ID NO: 99316 - DNA, 20 bp, Artificial
  CRISPR gRNA sequence
gccatctgcagcctcctctc

SEQ ID NO: 99317 - DNA, 20 bp, Artificial
  CRISPR gRNA sequence
agcctcctctccggggtctt

SEQ ID NO: 99318 - DNA, 20 bp, Artificial
  CRISPR gRNA sequence
gggtccccaagttctgaggc

SEQ ID NO: 99319 - DNA, 20 bp, Artificial
  CRISPR gRNA sequence
agttctgaggcaggggtctg

SEQ ID NO: 99320 - DNA, 20 bp, Artificial
  CRISPR gRNA sequence
gaggcaggggtctgctgggt

SEQ ID NO: 99321 - DNA, 20 bp, Artificial
  CRISPR gRNA sequence
tggatgaggtcttctgcagg

SEQ ID NO: 99322 - DNA, 20 bp, Artificial
  CRISPR gRNA sequence
catacctagccttgcactgt

SEQ ID NO: 99323 - DNA, 20 bp, Artificial
  CRISPR gRNA sequence
cctagccttgcactgtgagg

SEQ ID NO: 99324 - DNA, 20 bp, Artificial
  CRISPR gRNA sequence
agagccagggaaatgaaaac

SEQ ID NO: 99325 - DNA, 20 bp, Artificial
  CRISPR gRNA sequence
cagcactttgggaggccgag

SEQ ID NO: 99326 - DNA, 20 bp, Artificial
  CRISPR gRNA sequence
actttgggaggccgaggagg

SEQ ID NO: 99327 - DNA, 20 bp, Artificial
  CRISPR gRNA sequence
ggagggtggatcatgaggtc

SEQ ID NO: 99328 - DNA, 20 bp, Artificial
  CRISPR gRNA sequence
agctactcgggaggctgagg

SEQ ID NO: 99329 - DNA, 20 bp, Artificial
  CRISPR gRNA sequence
ggaaaaaaaagccggggctc

SEQ ID NO: 99330 - DNA, 20 bp, Artificial
  CRISPR gRNA sequence
ggggctctggggtcagctgt

SEQ ID NO: 99331 - DNA, 20 bp, Artificial
  CRISPR gRNA sequence
ctggggtcagctgtctgggt

SEQ ID NO: 99332 - DNA, 20 bp, Artificial
  CRISPR gRNA sequence
atgtggaaatgagacctaca

SEQ ID NO: 99333 - DNA, 20 bp, Artificial
  CRISPR gRNA sequence
tgtctgtacatagcttatcg

SEQ ID NO: 99334 - DNA, 20 bp, Artificial
  CRISPR gRNA sequence
gttgggaggggctccccata

SEQ ID NO: 99335 - DNA, 20 bp, Artificial
  CRISPR gRNA sequence
tcacaaacttttctcttcca

SEQ ID NO: 99336 - DNA, 20 bp, Artificial
  CRISPR gRNA sequence
tttaagacttaggggagggc

SEQ ID NO: 99337 - DNA, 20 bp, Artificial
  CRISPR gRNA sequence
ggggagggcgtgggttccgc

SEQ ID NO: 99338 - DNA, 20 bp, Artificial
  CRISPR gRNA sequence
cccctcctcaccgactcgga

SEQ ID NO: 99339 - DNA, 20 bp, Artificial
  CRISPR gRNA sequence
ggcggggcctaaagggctct

SEQ ID NO: 99340 - DNA, 20 bp, Artificial
  CRISPR gRNA sequence
ggagccaattggctccggct

SEQ ID NO: 99341 - DNA, 20 bp, Artificial
  CRISPR gRNA sequence
gggggcagagggctaaagaa

SEQ ID NO: 99342 - DNA, 20 bp, Artificial
  CRISPR gRNA sequence
aagaagggagtttttgcggc

SEQ ID NO: 99343 - DNA, 20 bp, Artificial
  CRISPR gRNA sequence
agggagtttttgcggcccga

SEQ ID NO: 99344 - DNA, 20 bp, Artificial
  CRISPR gRNA sequence
aactcgtctctcaaggaaaa

SEQ ID NO: 99345 - DNA, 20 bp, Artificial
  CRISPR gRNA sequence
aaagggggttcagaaaggga

SEQ ID NO: 99346 - DNA, 20 bp, Artificial
  CRISPR gRNA sequence
agttcttccccctctcctgc

SEQ ID NO: 99347 - DNA, 20 bp, Artificial
  CRISPR gRNA sequence
ccctcctcactgcgccaccc

SEQ ID NO: 99348 - DNA, 20 bp, Artificial
  CRISPR gRNA sequence
ctttagccctctgcccccgc

SEQ ID NO: 99349 - DNA, 20 bp, Artificial
  CRISPR gRNA sequence
ggggtagcggtcgagtatca

SEQ ID NO: 99350 - DNA, 20 bp, Artificial
  CRISPR gRNA sequence
agatcgctgagggtccggtc

SEQ ID NO: 99351 - DNA, 20 bp, Artificial
  CRISPR gRNA sequence
tgctatatccattggaagag

SEQ ID NO: 99352 - DNA, 20 bp, Artificial
  CRISPR gRNA sequence
aaagtttgtgacttgggccc

SEQ ID NO: 99353 - DNA, 20 bp, Artificial
  CRISPR gRNA sequence
gcccccaagttttgagagaa

SEQ ID NO: 99354 - DNA, 20 bp, Artificial
  CRISPR gRNA sequence
ggaggtgagtggacctcctg

SEQ ID NO: 99355 - DNA, 20 bp, Artificial
  CRISPR gRNA sequence
tagcgaatatttattgagct

SEQ ID NO: 99356 - DNA, 20 bp, Artificial
  CRISPR gRNA sequence
gttctcacggcctataaatt

SEQ ID NO: 99357 - DNA, 20 bp, Artificial
  CRISPR gRNA sequence
cagacagctgaccccagagc

SEQ ID NO: 99358 - DNA, 20 bp, Artificial
  CRISPR gRNA sequence
gggatcacaggcgcccgcca

SEQ ID NO: 99359 - DNA, 20 bp, Artificial
  CRISPR gRNA sequence
ttttgtatttttagtacaga

SEQ ID NO: 99360 - DNA, 20 bp, Artificial
  CRISPR gRNA sequence
ctcctcggcctcccaaagtg

SEQ ID NO: 99361 - DNA, 20 bp, Artificial
  CRISPR gRNA sequence
tcttaaacattgcacattgt

SEQ ID NO: 99362 - DNA, 20 bp, Artificial
  CRISPR gRNA sequence
gacctcgaaagcagttggac

SEQ ID NO: 99363 - DNA, 20 bp, Artificial
  CRISPR gRNA sequence
ctctggtaattaacctggac

SEQ ID NO: 99364 - DNA, 20 bp, Artificial
  CRISPR gRNA sequence
tctccccttctgacacctcc

SEQ ID NO: 99365 - DNA, 20 bp, Artificial
  CRISPR gRNA sequence
acctccgccagctttcccca

SEQ ID NO: 99366 - DNA, 20 bp, Artificial
  CRISPR gRNA sequence
ttccctgcacaaccggatgc

SEQ ID NO: 99367 - DNA, 20 bp, Artificial
  CRISPR gRNA sequence
cacagggtaggatacctcct

SEQ ID NO: 99368 - DNA, 20 bp, Artificial
  CRISPR gRNA sequence
cctcctctgggattagccct

SEQ ID NO: 99369 - DNA, 20 bp, Artificial
  CRISPR gRNA sequence
ggcctcacatggaacctgtg

SEQ ID NO: 99370 - DNA, 20 bp, Artificial
  CRISPR gRNA sequence
acatggaacctgtgtcttgc

SEQ ID NO: 99371 - DNA, 20 bp, Artificial
  CRISPR gRNA sequence
aacctgtgtcttgctttcgt

SEQ ID NO: 99372 - DNA, 20 bp, Artificial
  CRISPR gRNA sequence
gtgtcttgctttcgtttttg

SEQ ID NO: 99373 - DNA, 20 bp, Artificial
  CRISPR gRNA sequence
ttgctttcgtttttgttttg

SEQ ID NO: 99374 - DNA, 20 bp, Artificial
  CRISPR gRNA sequence
gtttttgttttgttttgttt

SEQ ID NO: 99375 - DNA, 20 bp, Artificial
  CRISPR gRNA sequence
tgttttgttgttttttgaga

SEQ ID NO: 99376 - DNA, 20 bp, Artificial
  CRISPR gRNA sequence
aacctctgcctcctgggttc

SEQ ID NO: 99377 - DNA, 20 bp, Artificial
  CRISPR gRNA sequence
tgtctcagcctcctgagtag

SEQ ID NO: 99378 - DNA, 20 bp, Artificial
  CRISPR gRNA sequence
cctcctgagtagctgggatt

SEQ ID NO: 99379 - DNA, 20 bp, Artificial
  CRISPR gRNA sequence
ttgggtatttttagtagaga

SEQ ID NO: 99380 - DNA, 20 bp, Artificial
  CRISPR gRNA sequence
cacctcggcctcccaaagtg

SEQ ID NO: 99381 - DNA, 20 bp, Artificial
  CRISPR gRNA sequence
ggcatgagccactgtgcccg

SEQ ID NO: 99382 - DNA, 20 bp, Artificial
  CRISPR gRNA sequence
agccactgtgcccggcctgt

SEQ ID NO: 99383 - DNA, 20 bp, Artificial
  CRISPR gRNA sequence
ggcctccacttccgaaagtg

SEQ ID NO: 99384 - DNA, 20 bp, Artificial
  CRISPR gRNA sequence
cacagtgcccggcccttcac

SEQ ID NO: 99385 - DNA, 20 bp, Artificial
  CRISPR gRNA sequence
attactgggtcagatggtca

SEQ ID NO: 99386 - DNA, 20 bp, Artificial
  CRISPR gRNA sequence
tgttttacttactgaggaac

SEQ ID NO: 99387 - DNA, 20 bp, Artificial
  CRISPR gRNA sequence
ctgaggaactgaggatttat

SEQ ID NO: 99388 - DNA, 20 bp, Artificial
  CRISPR gRNA sequence
tcccctccctcccttcccgc

SEQ ID NO: 99389 - DNA, 20 bp, Artificial
  CRISPR gRNA sequence
ctcccgtgttcacgccattc

SEQ ID NO: 99390 - DNA, 20 bp, Artificial
  CRISPR gRNA sequence
cccgagtagctgggactaca

SEQ ID NO: 99391 - DNA, 20 bp, Artificial
  CRISPR gRNA sequence
ttttttttttttttttaaat

SEQ ID NO: 99392 - DNA, 20 bp, Artificial
  CRISPR gRNA sequence
ttttttttttttaaatggag

SEQ ID NO: 99393 - DNA, 20 bp, Artificial
  CRISPR gRNA sequence
caactccctctcctgggtta

SEQ ID NO: 99394 - DNA, 20 bp, Artificial
  CRISPR gRNA sequence
ccaccacatccagctaattt

SEQ ID NO: 99395 - DNA, 20 bp, Artificial
  CRISPR gRNA sequence
ttttgtgtttttagtagaga

SEQ ID NO: 99396 - DNA, 20 bp, Artificial
  CRISPR gRNA sequence
ggtctcgaactcctgacctc

SEQ ID NO: 99397 - DNA, 20 bp, Artificial
  CRISPR gRNA sequence
cgcctcggcctcccaaagtg

SEQ ID NO: 99398 - DNA, 20 bp, Artificial
  CRISPR gRNA sequence
ccaccgcgcccagtccctgt

SEQ ID NO: 99399 - DNA, 20 bp, Artificial
  CRISPR gRNA sequence
cgttcttttcatcctcttct

SEQ ID NO: 99400 - DNA, 20 bp, Artificial
  CRISPR gRNA sequence
tctcactgcaacctccacct

SEQ ID NO: 99401 - DNA, 20 bp, Artificial
  CRISPR gRNA sequence
aacctccacctcctggattc

SEQ ID NO: 99402 - DNA, 20 bp, Artificial
  CRISPR gRNA sequence
tgcctcagcctcccgagtag

SEQ ID NO: 99403 - DNA, 20 bp, Artificial
  CRISPR gRNA sequence
gccaccatgcatggctaatt

SEQ ID NO: 99404 - DNA, 20 bp, Artificial
  CRISPR gRNA sequence
cacctcagcctcccaaagtg

SEQ ID NO: 99405 - DNA, 20 bp, Artificial
  CRISPR gRNA sequence
tttgaacacttatttcaact

SEQ ID NO: 99406 - DNA, 20 bp, Artificial
  CRISPR gRNA sequence
cctagagggcaaaaactatg

SEQ ID NO: 99407 - DNA, 20 bp, Artificial
  CRISPR gRNA sequence
ttgggaggccacggcaggag

SEQ ID NO: 99408 - DNA, 20 bp, Artificial
  CRISPR gRNA sequence
caggagaattgcttgagccc

SEQ ID NO: 99409 - DNA, 20 bp, Artificial
  CRISPR gRNA sequence
ttgctgggtatggtggcacc

SEQ ID NO: 99410 - DNA, 20 bp, Artificial
  CRISPR gRNA sequence
tcaggaggctgaggtgggag

SEQ ID NO: 99411 - DNA, 20 bp, Artificial
  CRISPR gRNA sequence
tttgggaggctgaggcaggt

SEQ ID NO: 99412 - DNA, 20 bp, Artificial
  CRISPR gRNA sequence
caggtggatgatttgaggtc

SEQ ID NO: 99413 - DNA, 20 bp, Artificial
  CRISPR gRNA sequence
tcgggaggctgaggcacaag

SEQ ID NO: 99414 - DNA, 20 bp, Artificial
  CRISPR gRNA sequence
acagcaacaaaaaaaaacag

SEQ ID NO: 99415 - DNA, 20 bp, Artificial
  CRISPR gRNA sequence
aggggaaactgacgcctgtt

SEQ ID NO: 99416 - DNA, 20 bp, Artificial
  CRISPR gRNA sequence
tgacctgtgagtgtccacgt

SEQ ID NO: 99417 - DNA, 20 bp, Artificial
  CRISPR gRNA sequence
tcgtcaacaagccagacgag

SEQ ID NO: 99418 - DNA, 20 bp, Artificial
  CRISPR gRNA sequence
catctgggcctccgcctttg

SEQ ID NO: 99419 - DNA, 20 bp, Artificial
  CRISPR gRNA sequence
cctttggagagattgagacc

SEQ ID NO: 99420 - DNA, 20 bp, Artificial
  CRISPR gRNA sequence
ccgggggccttagggtgggc

SEQ ID NO: 99421 - DNA, 20 bp, Artificial
  CRISPR gRNA sequence
gaggcggaggtagcagtgag

SEQ ID NO: 99422 - DNA, 20 bp, Artificial
  CRISPR gRNA sequence
atgcggctgctgtgggtacc

SEQ ID NO: 99423 - DNA, 20 bp, Artificial
  CRISPR gRNA sequence
cgtgacgtggacatcaacat

SEQ ID NO: 99424 - DNA, 20 bp, Artificial
  CRISPR gRNA sequence
gtcttcctggaggaaggtgt

SEQ ID NO: 99425 - DNA, 20 bp, Artificial
  CRISPR gRNA sequence
gaatgaggaagaggtaaacc

SEQ ID NO: 99426 - DNA, 20 bp, Artificial
  CRISPR gRNA sequence
agggcagggagacgcccaag

SEQ ID NO: 99427 - DNA, 20 bp, Artificial
  CRISPR gRNA sequence
gaccacacgggagtcggggt

SEQ ID NO: 99428 - DNA, 20 bp, Artificial
  CRISPR gRNA sequence
aagtggccaacagaagtcag

SEQ ID NO: 99429 - DNA, 20 bp, Artificial
  CRISPR gRNA sequence
cctgggatggggaggtcagg

SEQ ID NO: 99430 - DNA, 20 bp, Artificial
  CRISPR gRNA sequence
atccctctccgtggcgggca

SEQ ID NO: 99431 - DNA, 20 bp, Artificial
  CRISPR gRNA sequence
aacaggggccataggcagac

SEQ ID NO: 99432 - DNA, 20 bp, Artificial
  CRISPR gRNA sequence
ctggggtcatggtagagatg

SEQ ID NO: 99433 - DNA, 20 bp, Artificial
  CRISPR gRNA sequence
aaatatccccctccttcctt

SEQ ID NO: 99434 - DNA, 20 bp, Artificial
  CRISPR gRNA sequence
ctccttccttcagagtttta

SEQ ID NO: 99435 - DNA, 20 bp, Artificial
  CRISPR gRNA sequence
aaatcattcctcttccctcc

SEQ ID NO: 99436 - DNA, 20 bp, Artificial
  CRISPR gRNA sequence
cttccctcctcatgttttcg

SEQ ID NO: 99437 - DNA, 20 bp, Artificial
  CRISPR gRNA sequence
cctcctcatgttttcggggg

SEQ ID NO: 99438 - DNA, 20 bp, Artificial
  CRISPR gRNA sequence
ctggaatgaagtggtgcagg

SEQ ID NO: 99439 - DNA, 20 bp, Artificial
  CRISPR gRNA sequence
atgcctggctaattttttgt

SEQ ID NO: 99440 - DNA, 20 bp, Artificial
  CRISPR gRNA sequence
aacttccacctcccaggttc

SEQ ID NO: 99441 - DNA, 20 bp, Artificial
  CRISPR gRNA sequence
ttttatatttttagtagaga

SEQ ID NO: 99442 - DNA, 20 bp, Artificial
  CRISPR gRNA sequence
tgtgttggcctcccaaagtg

SEQ ID NO: 99443 - DNA, 20 bp, Artificial
  CRISPR gRNA sequence
gccaccacgcctggctgtgt

SEQ ID NO: 99444 - DNA, 20 bp, Artificial
  CRISPR gRNA sequence
tgcctcagcctcctgaatag

SEQ ID NO: 99445 - DNA, 20 bp, Artificial
  CRISPR gRNA sequence
ttttttttttttttttgaga

SEQ ID NO: 99446 - DNA, 20 bp, Artificial
  CRISPR gRNA sequence
tgcctcagcctcccaagtag

SEQ ID NO: 99447 - DNA, 20 bp, Artificial
  CRISPR gRNA sequence
ttttgcatttttagtagagt

SEQ ID NO: 99448 - DNA, 20 bp, Artificial
  CRISPR gRNA sequence
acctcaggtgatccacccgc

SEQ ID NO: 99449 - DNA, 20 bp, Artificial
  CRISPR gRNA sequence
cgcctcagcttcccaaagtg

SEQ ID NO: 99450 - DNA, 20 bp, Artificial
  CRISPR gRNA sequence
ggctgcacctggctaatttt

SEQ ID NO: 99451 - DNA, 20 bp, Artificial
  CRISPR gRNA sequence
ttttgtagttttagtagaga

SEQ ID NO: 99452 - DNA, 20 bp, Artificial
  CRISPR gRNA sequence
taccttggcctcccaaagtg

SEQ ID NO: 99453 - DNA, 20 bp, Artificial
  CRISPR gRNA sequence
ttaaatttttttggtagaga

SEQ ID NO: 99454 - DNA, 20 bp, Artificial
  CRISPR gRNA sequence
ccactggacctcccaaagtg

SEQ ID NO: 99455 - DNA, 20 bp, Artificial
  CRISPR gRNA sequence
tgaaagtcacaattcacaca

SEQ ID NO: 99456 - DNA, 20 bp, Artificial
  CRISPR gRNA sequence
tggggtgagtcctcggttct

SEQ ID NO: 99457 - DNA, 20 bp, Artificial
  CRISPR gRNA sequence
atgcaggtctctgcaagggt

SEQ ID NO: 99458 - DNA, 20 bp, Artificial
  CRISPR gRNA sequence
ggcctgtgcctccaccccac

SEQ ID NO: 99459 - DNA, 20 bp, Artificial
  CRISPR gRNA sequence
aacccagaactgacttcaaa

SEQ ID NO: 99460 - DNA, 20 bp, Artificial
  CRISPR gRNA sequence
gtgcagaatgagggactttg

SEQ ID NO: 99461 - DNA, 20 bp, Artificial
  CRISPR gRNA sequence
ggactttgctgtgcttcccg

SEQ ID NO: 99462 - DNA, 20 bp, Artificial
  CRISPR gRNA sequence
tgtggtcatctaccacctgc

SEQ ID NO: 99463 - DNA, 20 bp, Artificial
  CRISPR gRNA sequence
aaagtccctcattctgcaca

SEQ ID NO: 99464 - DNA, 20 bp, Artificial
  CRISPR gRNA sequence
agctgcctttgaagtcagtt

SEQ ID NO: 99465 - DNA, 20 bp, Artificial
  CRISPR gRNA sequence
cgggcaccaggttgctctgg

SEQ ID NO: 99466 - DNA, 20 bp, Artificial
  CRISPR gRNA sequence
gggcagggaaaaggtgggct

SEQ ID NO: 99467 - DNA, 20 bp, Artificial
  CRISPR gRNA sequence
cccaggaacctcaacttccc

SEQ ID NO: 99468 - DNA, 20 bp, Artificial
  CRISPR gRNA sequence
agtttgtaaaaatgcacttt

SEQ ID NO: 99469 - DNA, 20 bp, Artificial
  CRISPR gRNA sequence
ttgggaggtccagtggggag

SEQ ID NO: 99470 - DNA, 20 bp, Artificial
  CRISPR gRNA sequence
cttgagctcaggaatttgag

SEQ ID NO: 99471 - DNA, 20 bp, Artificial
  CRISPR gRNA sequence
aaaaaaatttaaaaattagg

SEQ ID NO: 99472 - DNA, 20 bp, Artificial
  CRISPR gRNA sequence
cgggtggatcacctgaggtc

SEQ ID NO: 99473 - DNA, 20 bp, Artificial
  CRISPR gRNA sequence
ttgggaggctgaggcaggag

SEQ ID NO: 99474 - DNA, 20 bp, Artificial
  CRISPR gRNA sequence
tcaggaggctgaggcaggag

SEQ ID NO: 99475 - DNA, 20 bp, Artificial
  CRISPR gRNA sequence
gaggcagaggttgcagtgag

SEQ ID NO: 99476 - DNA, 20 bp, Artificial
  CRISPR gRNA sequence
ctgtctcaaaaaataaataa

SEQ ID NO: 99477 - DNA, 20 bp, Artificial
  CRISPR gRNA sequence
aagaaggatcacttgagccc

SEQ ID NO: 99478 - DNA, 20 bp, Artificial
  CRISPR gRNA sequence
tcaggaggctgaggcaggag

SEQ ID NO: 99479 - DNA, 20 bp, Artificial
  CRISPR gRNA sequence
aaaacatgaggagggaagag

SEQ ID NO: 99480 - DNA, 20 bp, Artificial
  CRISPR gRNA sequence
tccatcggggtgtagccaga

SEQ ID NO: 99481 - DNA, 20 bp, Artificial
  CRISPR gRNA sequence
ctctgaaccatggaggatgg

SEQ ID NO: 99482 - DNA, 20 bp, Artificial
  CRISPR gRNA sequence
acttgggcgtctccctgccc

SEQ ID NO: 99483 - DNA, 20 bp, Artificial
  CRISPR gRNA sequence
gggtaggggcaggagaaacc

SEQ ID NO: 99484 - DNA, 20 bp, Artificial
  CRISPR gRNA sequence
ccatctcactttctggggtc

SEQ ID NO: 99485 - DNA, 20 bp, Artificial
  CRISPR gRNA sequence
accttcctccaggaagacct

SEQ ID NO: 99486 - DNA, 20 bp, Artificial
  CRISPR gRNA sequence
cagttcactgcatctcagct

SEQ ID NO: 99487 - DNA, 20 bp, Artificial
  CRISPR gRNA sequence
agaagaagggacagtggtag

SEQ ID NO: 99488 - DNA, 20 bp, Artificial
  CRISPR gRNA sequence
cacctcagcctccagagtac

SEQ ID NO: 99489 - DNA, 20 bp, Artificial
  CRISPR gRNA sequence
ttgtatttttttagtagaga

SEQ ID NO: 99490 - DNA, 20 bp, Artificial
  CRISPR gRNA sequence
cgcctcggcctcccaaagtg

SEQ ID NO: 99491 - DNA, 20 bp, Artificial
  CRISPR gRNA sequence
ggggggtgaagccgcgctcg

SEQ ID NO: 99492 - DNA, 20 bp, Artificial
  CRISPR gRNA sequence
ggcagagtcctcactcatcc

SEQ ID NO: 99493 - DNA, 20 bp, Artificial
  CRISPR gRNA sequence
atccccttgcttctctgtgc

SEQ ID NO: 99494 - DNA, 20 bp, Artificial
  CRISPR gRNA sequence
tgcctcagtttaccctctgt

SEQ ID NO: 99495 - DNA, 20 bp, Artificial
  CRISPR gRNA sequence
gccggttggtgagagtggtg

SEQ ID NO: 99496 - DNA, 20 bp, Artificial
  CRISPR gRNA sequence
ctgggaaacagacaacaggc

SEQ ID NO: 99497 - DNA, 20 bp, Artificial
  CRISPR gRNA sequence
ttcccctcagtagatgtctc

SEQ ID NO: 99498 - DNA, 20 bp, Artificial
  CRISPR gRNA sequence
aggcttcaggacagaagccc

SEQ ID NO: 99499 - DNA, 20 bp, Artificial
  CRISPR gRNA sequence
ctgtttttttttgttgctgt

SEQ ID NO: 99500 - DNA, 20 bp, Artificial
  CRISPR gRNA sequence
aacctctgcctcctgggttc

SEQ ID NO: 99501 - DNA, 20 bp, Artificial
  CRISPR gRNA sequence
ttttgtattttaagtagaga

SEQ ID NO: 99502 - DNA, 20 bp, Artificial
  CRISPR gRNA sequence
tgcctcagcctcccaaagtg

SEQ ID NO: 99503 - DNA, 20 bp, Artificial
  CRISPR gRNA sequence
gagccaccacacccagctat

SEQ ID NO: 99504 - DNA, 20 bp, Artificial
  CRISPR gRNA sequence
tgccgtggcctcccaaagtg

SEQ ID NO: 99505 - DNA, 20 bp, Artificial
  CRISPR gRNA sequence
aatgttctgagcaaacaaga

SEQ ID NO: 99506 - DNA, 20 bp, Artificial
  CRISPR gRNA sequence
tgggtggatcacctgaggtc

SEQ ID NO: 99507 - DNA, 20 bp, Artificial
  CRISPR gRNA sequence
tcgggaggctgaggcaggag

SEQ ID NO: 99508 - DNA, 20 bp, Artificial
  CRISPR gRNA sequence
actccaccctggacaacaga

SEQ ID NO: 99509 - DNA, 20 bp, Artificial
  CRISPR gRNA sequence
aatggcgtgaacacgggagg

SEQ ID NO: 99510 - DNA, 20 bp, Artificial
  CRISPR gRNA sequence
gaggtggagcttgcagtgag

SEQ ID NO: 99511 - DNA, 20 bp, Artificial
  CRISPR gRNA sequence
agctcctagggaggctgagt

SEQ ID NO: 99512 - DNA, 20 bp, Artificial
  CRISPR gRNA sequence
gaagttgaggctgcagtgaa

SEQ ID NO: 99513 - DNA, 20 bp, Artificial
  CRISPR gRNA sequence
ggaaatgaaaaccagagtcc

SEQ ID NO: 99514 - DNA, 20 bp, Artificial
  CRISPR gRNA sequence
accaaagcacctacaatgtg

SEQ ID NO: 99515 - DNA, 20 bp, Artificial
  CRISPR gRNA sequence
tactcgggaggctgaggcag

SEQ ID NO: 99516 - DNA, 20 bp, Artificial
  CRISPR gRNA sequence
acgtgacttaacctttgagc

SEQ ID NO: 99517 - DNA, 20 bp, Artificial
  CRISPR gRNA sequence
tacaacgaattatgtctgta

SEQ ID NO: 99518 - DNA, 20 bp, Artificial
  CRISPR gRNA sequence
tgagtgacggctcaacaaag

SEQ ID NO: 99519 - DNA, 20 bp, Artificial
  CRISPR gRNA sequence
ggagaccggaccctcagcga

SEQ ID NO: 99520 - DNA, 20 bp, Artificial
  CRISPR gRNA sequence
cccaccccagagctccccca

SEQ ID NO: 99521 - DNA, 20 bp, Artificial
  CRISPR gRNA sequence
ccgctcacctttaccctgcc

SEQ ID NO: 99522 - DNA, 20 bp, Artificial
  CRISPR gRNA sequence
tccagagggagccaattggc

SEQ ID NO: 99523 - DNA, 20 bp, Artificial
  CRISPR gRNA sequence
aaggtcccttctgcggtctc

SEQ ID NO: 99524 - DNA, 20 bp, Artificial
  CRISPR gRNA sequence
gggggcagagggctaaagaa

SEQ ID NO: 99525 - DNA, 20 bp, Artificial
  CRISPR gRNA sequence
ggaacaggagccgtgcggcg

SEQ ID NO: 99526 - DNA, 20 bp, Artificial
  CRISPR gRNA sequence
cggcgtccggtttcagcagg

SEQ ID NO: 99527 - DNA, 20 bp, Artificial
  CRISPR gRNA sequence
ttaggcgggcgtcccaacct

SEQ ID NO: 99528 - DNA, 20 bp, Artificial
  CRISPR gRNA sequence
cccaacctccgggcttccgg

SEQ ID NO: 99529 - DNA, 20 bp, Artificial
  CRISPR gRNA sequence
cgctcctcagtctttgcgga

SEQ ID NO: 99530 - DNA, 20 bp, Artificial
  CRISPR gRNA sequence
ctcctgctatatccattgga

SEQ ID NO: 99531 - DNA, 20 bp, Artificial
  CRISPR gRNA sequence
atttatttttgattggagtc

SEQ ID NO: 99532 - DNA, 20 bp, Artificial
  CRISPR gRNA sequence
ggatcccctctcttcttgag

SEQ ID NO: 99533 - DNA, 20 bp, Artificial
  CRISPR gRNA sequence
agaacattgccaggcaggga

SEQ ID NO: 99534 - DNA, 20 bp, Artificial
  CRISPR gRNA sequence
cactttgggaggccacggca

SEQ ID NO: 99535 - DNA, 20 bp, Artificial
  CRISPR gRNA sequence
ctactcgggaggctgaggca

SEQ ID NO: 99536 - DNA, 20 bp, Artificial
  CRISPR gRNA sequence
aggtgtctaagcttgagacc

SEQ ID NO: 99537 - DNA, 20 bp, Artificial
  CRISPR gRNA sequence
ccagagagtacaaggcattt

SEQ ID NO: 99538 - DNA, 20 bp, Artificial
  CRISPR gRNA sequence
ttctcctgcccctacccacg

SEQ ID NO: 99539 - DNA, 20 bp, Artificial
  CRISPR gRNA sequence
tctgggggacctgaagggag

SEQ ID NO: 99540 - DNA, 20 bp, Artificial
  CRISPR gRNA sequence
agagttttactgtgtttggg

SEQ ID NO: 99541 - DNA, 20 bp, Artificial
  CRISPR gRNA sequence
ggtttgtttttttgttcgag

SEQ ID NO: 99542 - DNA, 20 bp, Artificial
  CRISPR gRNA sequence
ggaaccaataaaccttctgt

SEQ ID NO: 99543 - DNA, 20 bp, Artificial
  CRISPR gRNA sequence
aaatgcacttttgtagcttt

SEQ ID NO: 99544 - DNA, 20 bp, Artificial
  CRISPR gRNA sequence
tgagatcacctgaccaacat

SEQ ID NO: 99545 - DNA, 20 bp, Artificial
  CRISPR gRNA sequence
ctacttgggaggctgaggca

SEQ ID NO: 99546 - DNA, 20 bp, Artificial
  CRISPR gRNA sequence
ctattcaggaggctgaggca

SEQ ID NO: 99547 - DNA, 20 bp, Artificial
  CRISPR gRNA sequence
ctactcaggaggctgaggca

SEQ ID NO: 99548 - DNA, 20 bp, Artificial
  CRISPR gRNA sequence
agttggggtcccattgtgac

SEQ ID NO: 99549 - DNA, 20 bp, Artificial
  CRISPR gRNA sequence
tctccctcccttcaggtccc

SEQ ID NO: 99550 - DNA, 20 bp, Artificial
  CRISPR gRNA sequence
ggagggtggggcctgggagt

SEQ ID NO: 99551 - DNA, 20 bp, Artificial
  CRISPR gRNA sequence
ttctgtcgtgggtaggggca

SEQ ID NO: 99552 - DNA, 20 bp, Artificial
  CRISPR gRNA sequence
caagtaggtgcatcagacat

SEQ ID NO: 99553 - DNA, 20 bp, Artificial
  CRISPR gRNA sequence
ctactcgggaggctgaggca

SEQ ID NO: 99554 - DNA, 20 bp, Artificial
  CRISPR gRNA sequence
caccgagatcttaggaagtc

SEQ ID NO: 99555 - DNA, 20 bp, Artificial
  CRISPR gRNA sequence
ctacttgggaggctgaggca

SEQ ID NO: 99556 - DNA, 20 bp, Artificial
  CRISPR gRNA sequence
ctactcgggaggctgaagca

SEQ ID NO: 99557 - DNA, 20 bp, Artificial
  CRISPR gRNA sequence
agcgagactccatctcaaaa

SEQ ID NO: 99558 - DNA, 20 bp, Artificial
  CRISPR gRNA sequence
agactccatctcaaaaaaag

SEQ ID NO: 99559 - DNA, 20 bp, Artificial
  CRISPR gRNA sequence
tccatctcaaaaaaagaaag

SEQ ID NO: 99560 - DNA, 20 bp, Artificial
  CRISPR gRNA sequence
tctcaaaaaaagaaagaaag

SEQ ID NO: 99561 - DNA, 20 bp, Artificial
  CRISPR gRNA sequence
ctactcaggaggctgagaca

SEQ ID NO: 99562 - DNA, 20 bp, Artificial
  CRISPR gRNA sequence
cagctactcgggaggctgag

SEQ ID NO: 99563 - DNA, 20 bp, Artificial
  CRISPR gRNA sequence
aaaaaaaaaaaaaaaaaaaa

SEQ ID NO: 99564 - DNA, 20 bp, Artificial
  CRISPR gRNA sequence
atctggcttcctctgccggg

SEQ ID NO: 99565 - DNA, 20 bp, Artificial
  CRISPR gRNA sequence
gggcggggcctaaagggctc

SEQ ID NO: 99566 - DNA, 20 bp, Artificial
  CRISPR gRNA sequence
tctctcaaggaaaagggggt

SEQ ID NO: 99567 - DNA, 20 bp, Artificial
  CRISPR gRNA sequence
gcattacccactcgggccgc

SEQ ID NO: 99568 - DNA, 20 bp, Artificial
  CRISPR gRNA sequence
cccccgactccctagagggc

SEQ ID NO: 99569 - DNA, 20 bp, Artificial
  CRISPR gRNA sequence
gactctgtctcaaaaaaaaa

SEQ ID NO: 99570 - DNA, 20 bp, Artificial
  CRISPR gRNA sequence
aaacaacaacagcaacaaaa

SEQ ID NO: 99571 - DNA, 20 bp, Artificial
  CRISPR gRNA sequence
ggccagcttgggcaacagag

SEQ ID NO: 99572 - DNA, 20 bp, Artificial
  CRISPR gRNA sequence
tgatgaaaccccatctctac

SEQ ID NO: 99573 - DNA, 20 bp, Artificial
  CRISPR gRNA sequence
cgagaccctgtctcttctaa

SEQ ID NO: 99574 - DNA, 20 bp, Artificial
  CRISPR gRNA sequence
agactttctgcctcgaacaa

SEQ ID NO: 99575 - DNA, 20 bp, Artificial
  CRISPR gRNA sequence
aacaaaaaaacaaacccccc

SEQ ID NO: 99576 - DNA, 20 bp, Artificial
  CRISPR gRNA sequence
gatttctgtcccaaacacag

SEQ ID NO: 99577 - DNA, 20 bp, Artificial
  CRISPR gRNA sequence
aaggcgccagcagacacagc

SEQ ID NO: 99578 - DNA, 20 bp, Artificial
  CRISPR gRNA sequence
tcagacatagagaaataata

SEQ ID NO: 99579 - DNA, 20 bp, Artificial
  CRISPR gRNA sequence
ggtgaaattccacctctact

SEQ ID NO: 99580 - DNA, 20 bp, Artificial
  CRISPR gRNA sequence
gaccagcctgggcaacatgg

SEQ ID NO: 99581 - DNA, 20 bp, Artificial
  CRISPR gRNA sequence
ggcaaaactccatctctact

SEQ ID NO: 99582 - DNA, 20 bp, Artificial
  CRISPR gRNA sequence
ctccatttaaaaaaaaaaaa

SEQ ID NO: 99583 - DNA, 20 bp, Artificial
  CRISPR gRNA sequence
aagaaagaaagaaagaaaaa

SEQ ID NO: 99584 - DNA, 20 bp, Artificial
  CRISPR gRNA sequence
atcctcagttcctcagtaag

SEQ ID NO: 99585 - DNA, 20 bp, Artificial
  CRISPR gRNA sequence
ctatctaccctcaaagagtt

SEQ ID NO: 99586 - DNA, 20 bp, Artificial
  CRISPR gRNA sequence
cagagcgagaccctgtatca

SEQ ID NO: 99587 - DNA, 20 bp, Artificial
  CRISPR gRNA sequence
gagaccctgtatcaaaaaac

SEQ ID NO: 99588 - DNA, 20 bp, Artificial
  CRISPR gRNA sequence
tccagcatgggcaacaagag

SEQ ID NO: 99589 - DNA, 20 bp, Artificial
  CRISPR gRNA sequence
aagagcaaaactccatctca

SEQ ID NO: 99590 - DNA, 20 bp, Artificial
  CRISPR gRNA sequence
aactccatctcaaaaaacaa

SEQ ID NO: 99591 - DNA, 20 bp, Artificial
  CRISPR gRNA sequence
catctcaaaaaacaacaaaa

SEQ ID NO: 99592 - DNA, 20 bp, Artificial
  CRISPR gRNA sequence
caaaaaacaacaaaacaaaa

SEQ ID NO: 99593 - DNA, 20 bp, Artificial
  CRISPR gRNA sequence
acaacaaaacaaaacaaaac

SEQ ID NO: 99594 - DNA, 20 bp, Artificial
  CRISPR gRNA sequence
attaccagagccagggaaat

SEQ ID NO: 99595 - DNA, 20 bp, Artificial
  CRISPR gRNA sequence
cgccgaaagcccagttctct

SEQ ID NO: 99596 - DNA, 20 bp, Artificial
  CRISPR gRNA sequence
cggctcctccatagcgaccg

SEQ ID NO: 99597 - DNA, 20 bp, Artificial
  CRISPR gRNA sequence
ctccatagcgaccgcggccg

SEQ ID NO: 99598 - DNA, 20 bp, Artificial
  CRISPR gRNA sequence
catagcgaccgcggccgagc

SEQ ID NO: 99599 - DNA, 20 bp, Artificial
  CRISPR gRNA sequence
ggacgcccgcctaagccttc

SEQ ID NO: 99600 - DNA, 20 bp, Artificial
  CRISPR gRNA sequence
agccttccctgctgaaaccg

SEQ ID NO: 99601 - DNA, 20 bp, Artificial
  CRISPR gRNA sequence
ccctgctgaaaccggacgcc

SEQ ID NO: 99602 - DNA, 20 bp, Artificial
  CRISPR gRNA sequence
cctgctgaaaccggacgccg

SEQ ID NO: 99603 - DNA, 20 bp, Artificial
  CRISPR gRNA sequence
ctgaaaccggacgccgcacg

SEQ ID NO: 99604 - DNA, 20 bp, Artificial
  CRISPR gRNA sequence
aaaccggacgccgcacggct

SEQ ID NO: 99605 - DNA, 20 bp, Artificial
  CRISPR gRNA sequence
ctgttccggtgtcagagggc

SEQ ID NO: 99606 - DNA, 20 bp, Artificial
  CRISPR gRNA sequence
ttccggtgtcagagggcccg

SEQ ID NO: 99607 - DNA, 20 bp, Artificial
  CRISPR gRNA sequence
cggtgtcagagggcccgccc

SEQ ID NO: 99608 - DNA, 20 bp, Artificial
  CRISPR gRNA sequence
cccgctcctcagtctttgcg

SEQ ID NO: 99609 - DNA, 20 bp, Artificial
  CRISPR gRNA sequence
ctcagtctttgcggacaaga

SEQ ID NO: 99610 - DNA, 20 bp, Artificial
  CRISPR gRNA sequence
agtctttgcggacaagaaag

SEQ ID NO: 99611 - DNA, 20 bp, Artificial
  CRISPR gRNA sequence
tgcggacaagaaaggggctg

SEQ ID NO: 99612 - DNA, 20 bp, Artificial
  CRISPR gRNA sequence
gcggacaagaaaggggctgt

SEQ ID NO: 99613 - DNA, 20 bp, Artificial
  CRISPR gRNA sequence
cggacaagaaaggggctgtg

SEQ ID NO: 99614 - DNA, 20 bp, Artificial
  CRISPR gRNA sequence
tgtgagacgcagggaaggag

SEQ ID NO: 99615 - DNA, 20 bp, Artificial
  CRISPR gRNA sequence
gtggagcgacacccaggcag

SEQ ID NO: 99616 - DNA, 20 bp, Artificial
  CRISPR gRNA sequence
tctccctttctgaaccccct

SEQ ID NO: 99617 - DNA, 20 bp, Artificial
  CRISPR gRNA sequence
tccctttctgaacccccttt

SEQ ID NO: 99618 - DNA, 20 bp, Artificial
  CRISPR gRNA sequence
cctttctgaacccccttttc

SEQ ID NO: 99619 - DNA, 20 bp, Artificial
  CRISPR gRNA sequence
tctgaacccccttttccttg

SEQ ID NO: 99620 - DNA, 20 bp, Artificial
  CRISPR gRNA sequence
ctgaacccccttttccttga

SEQ ID NO: 99621 - DNA, 20 bp, Artificial
  CRISPR gRNA sequence
tgaacccccttttccttgag

SEQ ID NO: 99622 - DNA, 20 bp, Artificial
  CRISPR gRNA sequence
aacccccttttccttgagag

SEQ ID NO: 99623 - DNA, 20 bp, Artificial
  CRISPR gRNA sequence
ttccttgagagacgagttgg

SEQ ID NO: 99624 - DNA, 20 bp, Artificial
  CRISPR gRNA sequence
tccttgagagacgagttggg

SEQ ID NO: 99625 - DNA, 20 bp, Artificial
  CRISPR gRNA sequence
ccttgagagacgagttgggg

SEQ ID NO: 99626 - DNA, 20 bp, Artificial
  CRISPR gRNA sequence
cttgagagacgagttggggg

SEQ ID NO: 99627 - DNA, 20 bp, Artificial
  CRISPR gRNA sequence
gagagacgagttgggggagt

SEQ ID NO: 99628 - DNA, 20 bp, Artificial
  CRISPR gRNA sequence
agagacgagttgggggagtc

SEQ ID NO: 99629 - DNA, 20 bp, Artificial
  CRISPR gRNA sequence
ggggagtcctccacgcatta

SEQ ID NO: 99630 - DNA, 20 bp, Artificial
  CRISPR gRNA sequence
cacgcattacccactcgggc

SEQ ID NO: 99631 - DNA, 20 bp, Artificial
  CRISPR gRNA sequence
cccactcgggccgcaaaaac

SEQ ID NO: 99632 - DNA, 20 bp, Artificial
  CRISPR gRNA sequence
gggccgcaaaaactcccttc

SEQ ID NO: 99633 - DNA, 20 bp, Artificial
  CRISPR gRNA sequence
ccttctttagccctctgccc

SEQ ID NO: 99634 - DNA, 20 bp, Artificial
  CRISPR gRNA sequence
ctttagccctctgcccccgc

SEQ ID NO: 99635 - DNA, 20 bp, Artificial
  CRISPR gRNA sequence
tttagccctctgcccccgcc

SEQ ID NO: 99636 - DNA, 20 bp, Artificial
  CRISPR gRNA sequence
tagccctctgcccccgccct

SEQ ID NO: 99637 - DNA, 20 bp, Artificial
  CRISPR gRNA sequence
agccctctgcccccgccctt

SEQ ID NO: 99638 - DNA, 20 bp, Artificial
  CRISPR gRNA sequence
gccctctgcccccgcccttg

SEQ ID NO: 99639 - DNA, 20 bp, Artificial
  CRISPR gRNA sequence
tgcccccgcccttgcttata

SEQ ID NO: 99640 - DNA, 20 bp, Artificial
  CRISPR gRNA sequence
cccccgcccttgcttataag

SEQ ID NO: 99641 - DNA, 20 bp, Artificial
  CRISPR gRNA sequence
gcttataagcctttgagacc

SEQ ID NO: 99642 - DNA, 20 bp, Artificial
  CRISPR gRNA sequence
cttataagcctttgagaccg

SEQ ID NO: 99643 - DNA, 20 bp, Artificial
  CRISPR gRNA sequence
ataagcctttgagaccgcag

SEQ ID NO: 99644 - DNA, 20 bp, Artificial
  CRISPR gRNA sequence
taagcctttgagaccgcaga

SEQ ID NO: 99645 - DNA, 20 bp, Artificial
  CRISPR gRNA sequence
tgagaccgcagaagggacct

SEQ ID NO: 99646 - DNA, 20 bp, Artificial
  CRISPR gRNA sequence
gagaccgcagaagggacctt

SEQ ID NO: 99647 - DNA, 20 bp, Artificial
  CRISPR gRNA sequence
agaccgcagaagggaccttg

SEQ ID NO: 99648 - DNA, 20 bp, Artificial
  CRISPR gRNA sequence
gttgtggaacgggacggcca

SEQ ID NO: 99649 - DNA, 20 bp, Artificial
  CRISPR gRNA sequence
ttgtggaacgggacggccaa

SEQ ID NO: 99650 - DNA, 20 bp, Artificial
  CRISPR gRNA sequence
tggaacgggacggccaaggt

SEQ ID NO: 99651 - DNA, 20 bp, Artificial
  CRISPR gRNA sequence
cccctttaagttccagacgc

SEQ ID NO: 99652 - DNA, 20 bp, Artificial
  CRISPR gRNA sequence
taagttccagacgccccgcg

SEQ ID NO: 99653 - DNA, 20 bp, Artificial
  CRISPR gRNA sequence
aagttccagacgccccgcgt

SEQ ID NO: 99654 - DNA, 20 bp, Artificial
  CRISPR gRNA sequence
agttccagacgccccgcgta

SEQ ID NO: 99655 - DNA, 20 bp, Artificial
  CRISPR gRNA sequence
cagacgccccgcgtacttcc

SEQ ID NO: 99656 - DNA, 20 bp, Artificial
  CRISPR gRNA sequence
cccctacttcttcttcttga

SEQ ID NO: 99657 - DNA, 20 bp, Artificial
  CRISPR gRNA sequence
ccctacttcttcttcttgag

SEQ ID NO: 99658 - DNA, 20 bp, Artificial
  CRISPR gRNA sequence
cttcttcttcttgagatagc

SEQ ID NO: 99659 - DNA, 20 bp, Artificial
  CRISPR gRNA sequence
cttcttcttgagatagcccc

SEQ ID NO: 99660 - DNA, 20 bp, Artificial
  CRISPR gRNA sequence
ttcttcttgagatagccccg

SEQ ID NO: 99661 - DNA, 20 bp, Artificial
  CRISPR gRNA sequence
cttcttgagatagccccgcc

SEQ ID NO: 99662 - DNA, 20 bp, Artificial
  CRISPR gRNA sequence
ttcttgagatagccccgccc

SEQ ID NO: 99663 - DNA, 20 bp, Artificial
  CRISPR gRNA sequence
cttgagatagccccgcccat

SEQ ID NO: 99664 - DNA, 20 bp, Artificial
  CRISPR gRNA sequence
ttgagatagccccgcccatc

SEQ ID NO: 99665 - DNA, 20 bp, Artificial
  CRISPR gRNA sequence
gagatagccccgcccatcta

SEQ ID NO: 99666 - DNA, 20 bp, Artificial
  CRISPR gRNA sequence
agatagccccgcccatctac

SEQ ID NO: 99667 - DNA, 20 bp, Artificial
  CRISPR gRNA sequence
cccgaagccggagccaattg

SEQ ID NO: 99668 - DNA, 20 bp, Artificial
  CRISPR gRNA sequence
gctccctctggaaaaatctg

SEQ ID NO: 99669 - DNA, 20 bp, Artificial
  CRISPR gRNA sequence
cctctggaaaaatctgtggg

SEQ ID NO: 99670 - DNA, 20 bp, Artificial
  CRISPR gRNA sequence
tggaaaaatctgtgggcagg

SEQ ID NO: 99671 - DNA, 20 bp, Artificial
  CRISPR gRNA sequence
gaaaaatctgtgggcagggt

SEQ ID NO: 99672 - DNA, 20 bp, Artificial
  CRISPR gRNA sequence
tgggcagggtaaaggtgagc

SEQ ID NO: 99673 - DNA, 20 bp, Artificial
  CRISPR gRNA sequence
tcagagccctttaggccccg

SEQ ID NO: 99674 - DNA, 20 bp, Artificial
  CRISPR gRNA sequence
agagccctttaggccccgcc

SEQ ID NO: 99675 - DNA, 20 bp, Artificial
  CRISPR gRNA sequence
taggccccgcccattccctc

SEQ ID NO: 99676 - DNA, 20 bp, Artificial
  CRISPR gRNA sequence
aggccccgcccattccctcc

SEQ ID NO: 99677 - DNA, 20 bp, Artificial
  CRISPR gRNA sequence
ggccccgcccattccctccg

SEQ ID NO: 99678 - DNA, 20 bp, Artificial
  CRISPR gRNA sequence
cctccgagtcggtgaggagg

SEQ ID NO: 99679 - DNA, 20 bp, Artificial
  CRISPR gRNA sequence
cgagtcggtgaggaggggaa

SEQ ID NO: 99680 - DNA, 20 bp, Artificial
  CRISPR gRNA sequence
ccctcccaggaccccagcgg

SEQ ID NO: 99681 - DNA, 20 bp, Artificial
  CRISPR gRNA sequence
ccaggaccccagcggaaccc

SEQ ID NO: 99682 - DNA, 20 bp, Artificial
  CRISPR gRNA sequence
ccctaagtcttaaagggcca

SEQ ID NO: 99683 - DNA, 20 bp, Artificial
  CRISPR gRNA sequence
agtcttaaagggccagaggc

SEQ ID NO: 99684 - DNA, 20 bp, Artificial
  CRISPR gRNA sequence
aaagggccagaggcagcact

SEQ ID NO: 99685 - DNA, 20 bp, Artificial
  CRISPR gRNA sequence
aagggccagaggcagcactt

SEQ ID NO: 99686 - DNA, 20 bp, Artificial
  CRISPR gRNA sequence
actgcccgggcccttcctca

SEQ ID NO: 99687 - DNA, 20 bp, Artificial
  CRISPR gRNA sequence
ctgcccgggcccttcctcac

SEQ ID NO: 99688 - DNA, 20 bp, Artificial
  CRISPR gRNA sequence
cccgggcccttcctcacttt

SEQ ID NO: 99689 - DNA, 20 bp, Artificial
  CRISPR gRNA sequence
cctcacttttggggggcggg

SEQ ID NO: 99690 - DNA, 20 bp, Artificial
  CRISPR gRNA sequence
ctcacttttggggggcgggg

SEQ ID NO: 99691 - DNA, 20 bp, Artificial
  CRISPR gRNA sequence
acttttggggggcgggggtg

SEQ ID NO: 99692 - DNA, 20 bp, Artificial
  CRISPR gRNA sequence
ttggggggcgggggtgcgca

SEQ ID NO: 99693 - DNA, 20 bp, Artificial
  CRISPR gRNA sequence
tggggggcgggggtgcgcaa

SEQ ID NO: 99694 - DNA, 20 bp, Artificial
  CRISPR gRNA sequence
ggggggcgggggtgcgcaag

SEQ ID NO: 99695 - DNA, 20 bp, Artificial
  CRISPR gRNA sequence
gggggcgggggtgcgcaagc

SEQ ID NO: 99696 - DNA, 20 bp, Artificial
  CRISPR gRNA sequence
tggggtgggggtagcggtcg

SEQ ID NO: 99697 - DNA, 20 bp, Artificial
  CRISPR gRNA sequence
gggtgggggtagcggtcgag

SEQ ID NO: 99698 - DNA, 20 bp, Artificial
  CRISPR gRNA sequence
ctttctgtcccggcagagga

SEQ ID NO: 99699 - DNA, 20 bp, Artificial
  CRISPR gRNA sequence
tctgtcccggcagaggaagc

SEQ ID NO: 99700 - DNA, 20 bp, Artificial
  CRISPR gRNA sequence
ctgtcccggcagaggaagcc

SEQ ID NO: 99701 - DNA, 20 bp, Artificial
  CRISPR gRNA sequence
tgtcccggcagaggaagcca

SEQ ID NO: 99702 - DNA, 20 bp, Artificial
  CRISPR gRNA sequence
tcccggcagaggaagccaga

SEQ ID NO: 99703 - DNA, 20 bp, Artificial
  CRISPR gRNA sequence
agggtccggtctccagtttg

SEQ ID NO: 99704 - DNA, 20 bp, Artificial
  CRISPR gRNA sequence
cagtttgcctcctgctatat

SEQ ID NO: 99705 - DNA, 20 bp, Artificial
  CRISPR gRNA sequence
gcctcctgctatatccattg

SEQ ID NO: 99706 - DNA, 20 bp, Artificial
  CRISPR gRNA sequence
cctcctgctatatccattgg

SEQ ID NO: 99707 - DNA, 20 bp, Artificial
  CRISPR gRNA sequence
ctgctatatccattggaaga

SEQ ID NO: 99708 - DNA, 20 bp, Artificial
  CRISPR gRNA sequence
ctatatccattggaagagaa

SEQ ID NO: 99709 - DNA, 20 bp, Artificial
  CRISPR gRNA sequence
tatccattggaagagaaaag

SEQ ID NO: 99710 - DNA, 20 bp, Artificial
  CRISPR gRNA sequence
gaagagaaaagtttgtgact

SEQ ID NO: 99711 - DNA, 20 bp, Artificial
  CRISPR gRNA sequence
gtgacttgggcccccaagtt

SEQ ID NO: 99712 - DNA, 20 bp, Artificial
  CRISPR gRNA sequence
tgacttgggcccccaagttt

SEQ ID NO: 99713 - DNA, 20 bp, Artificial
  CRISPR gRNA sequence
gggcccccaagttttgagag

SEQ ID NO: 99714 - DNA, 20 bp, Artificial
  CRISPR gRNA sequence
ggcccccaagttttgagaga

SEQ ID NO: 99715 - DNA, 20 bp, Artificial
  CRISPR gRNA sequence
tgagagaactgggctttcgg

SEQ ID NO: 99716 - DNA, 20 bp, Artificial
  CRISPR gRNA sequence
gagagaactgggctttcggc

SEQ ID NO: 99717 - DNA, 20 bp, Artificial
  CRISPR gRNA sequence
agagaactgggctttcggcg

SEQ ID NO: 99718 - DNA, 20 bp, Artificial
  CRISPR gRNA sequence
ggctttcggcgcggggggac

SEQ ID NO: 99719 - DNA, 20 bp, Artificial
  CRISPR gRNA sequence
tcggcgcggggggacagagg

SEQ ID NO: 99720 - DNA, 20 bp, Artificial
  CRISPR gRNA sequence
cggcgcggggggacagagga

SEQ ID NO: 99721 - DNA, 20 bp, Artificial
  CRISPR gRNA sequence
ggcgcggggggacagaggag

SEQ ID NO: 99722 - DNA, 20 bp, Artificial
  CRISPR gRNA sequence
gtggggaggtgagtggacct

SEQ ID NO: 99723 - DNA, 20 bp, Artificial
  CRISPR gRNA sequence
ctggatcgatttaggaggct

SEQ ID NO: 99724 - DNA, 20 bp, Artificial
  CRISPR gRNA sequence
gatcgatttaggaggctcgg

SEQ ID NO: 99725 - DNA, 20 bp, Artificial
  CRISPR gRNA sequence
aggaggctcgggtgggactg

SEQ ID NO: 99726 - DNA, 20 bp, Artificial
  CRISPR gRNA sequence
ggaggctcgggtgggactgg

SEQ ID NO: 99727 - DNA, 20 bp, Artificial
  CRISPR gRNA sequence
gggtgggactgggaccaatc

SEQ ID NO: 99728 - DNA, 20 bp, Artificial
  CRISPR gRNA sequence
ggaccaatcgcacctttgtt

SEQ ID NO: 99729 - DNA, 20 bp, Artificial
  CRISPR gRNA sequence
tgttgagccgtcactcatta

SEQ ID NO: 99730 - DNA, 20 bp, Artificial
  CRISPR gRNA sequence
gttgagccgtcactcattat

SEQ ID NO: 99731 - DNA, 20 bp, Artificial
  CRISPR gRNA sequence
ttgagccgtcactcattatg

SEQ ID NO: 99732 - DNA, 20 bp, Artificial
  CRISPR gRNA sequence
agccgtcactcattatgggg

SEQ ID NO: 99733 - DNA, 20 bp, Artificial
  CRISPR gRNA sequence
attatggggagcccctccca

SEQ ID NO: 99734 - DNA, 20 bp, Artificial
  CRISPR gRNA sequence
tggggagcccctcccaacaa

SEQ ID NO: 99735 - DNA, 20 bp, Artificial
  CRISPR gRNA sequence
ccaacaaccatagcgaatat

SEQ ID NO: 99736 - DNA, 20 bp, Artificial
  CRISPR gRNA sequence
attgagctccacgcttagca

SEQ ID NO: 99737 - DNA, 20 bp, Artificial
  CRISPR gRNA sequence
ttgagctccacgcttagcag

SEQ ID NO: 99738 - DNA, 20 bp, Artificial
  CRISPR gRNA sequence
agctccacgcttagcagatc

SEQ ID NO: 99739 - DNA, 20 bp, Artificial
  CRISPR gRNA sequence
cacgcttagcagatcccccg

SEQ ID NO: 99740 - DNA, 20 bp, Artificial
  CRISPR gRNA sequence
agcagatcccccgataagct

SEQ ID NO: 99741 - DNA, 20 bp, Artificial
  CRISPR gRNA sequence
gcagatcccccgataagcta

SEQ ID NO: 99742 - DNA, 20 bp, Artificial
  CRISPR gRNA sequence
tgtacagacataattcgttg

SEQ ID NO: 99743 - DNA, 20 bp, Artificial
  CRISPR gRNA sequence
gttgtaggtctcatttccac

SEQ ID NO: 99744 - DNA, 20 bp, Artificial
  CRISPR gRNA sequence
taggtctcatttccacattt

SEQ ID NO: 99745 - DNA, 20 bp, Artificial
  CRISPR gRNA sequence
atttccacattttgtcgtgg

SEQ ID NO: 99746 - DNA, 20 bp, Artificial
  CRISPR gRNA sequence
ccacattttgtcgtggagga

SEQ ID NO: 99747 - DNA, 20 bp, Artificial
  CRISPR gRNA sequence
cacattttgtcgtggaggaa

SEQ ID NO: 99748 - DNA, 20 bp, Artificial
  CRISPR gRNA sequence
tgtcgtggaggaaactgagg

SEQ ID NO: 99749 - DNA, 20 bp, Artificial
  CRISPR gRNA sequence
gtcgtggaggaaactgaggc

SEQ ID NO: 99750 - DNA, 20 bp, Artificial
  CRISPR gRNA sequence
tcgtggaggaaactgaggct

SEQ ID NO: 99751 - DNA, 20 bp, Artificial
  CRISPR gRNA sequence
aggctcaaaggttaagtcac

SEQ ID NO: 99752 - DNA, 20 bp, Artificial
  CRISPR gRNA sequence
aaaggttaagtcacgtgccc

SEQ ID NO: 99753 - DNA, 20 bp, Artificial
  CRISPR gRNA sequence
agtcacgtgcccaagttctc

SEQ ID NO: 99754 - DNA, 20 bp, Artificial
  CRISPR gRNA sequence
tcacggcctataaattgagg

SEQ ID NO: 99755 - DNA, 20 bp, Artificial
  CRISPR gRNA sequence
acggcctataaattgaggga

SEQ ID NO: 99756 - DNA, 20 bp, Artificial
  CRISPR gRNA sequence
taaattgagggattcgaacc

SEQ ID NO: 99757 - DNA, 20 bp, Artificial
  CRISPR gRNA sequence
agggattcgaacccagacag

SEQ ID NO: 99758 - DNA, 20 bp, Artificial
  CRISPR gRNA sequence
gaacccagacagctgacccc

SEQ ID NO: 99759 - DNA, 20 bp, Artificial
  CRISPR gRNA sequence
accccagagccccggctttt

SEQ ID NO: 99760 - DNA, 20 bp, Artificial
  CRISPR gRNA sequence
ttttttcctttctttttttt

SEQ ID NO: 99761 - DNA, 20 bp, Artificial
  CRISPR gRNA sequence
tttttcctttcttttttttt

SEQ ID NO: 99762 - DNA, 20 bp, Artificial
  CRISPR gRNA sequence
ttttcctttctttttttttt

SEQ ID NO: 99763 - DNA, 20 bp, Artificial
  CRISPR gRNA sequence
tttcctttcttttttttttt

SEQ ID NO: 99764 - DNA, 20 bp, Artificial
  CRISPR gRNA sequence
ttcctttctttttttttttt

SEQ ID NO: 99765 - DNA, 20 bp, Artificial
  CRISPR gRNA sequence
tcctttcttttttttttttt

SEQ ID NO: 99766 - DNA, 20 bp, Artificial
  CRISPR gRNA sequence
cctttctttttttttttttt

SEQ ID NO: 99767 - DNA, 20 bp, Artificial
  CRISPR gRNA sequence
ctttcttttttttttttttt

SEQ ID NO: 99768 - DNA, 20 bp, Artificial
  CRISPR gRNA sequence
tctttttttttttttttttt

SEQ ID NO: 99769 - DNA, 20 bp, Artificial
  CRISPR gRNA sequence
cttttttttttttttttttt

SEQ ID NO: 99770 - DNA, 20 bp, Artificial
  CRISPR gRNA sequence
tttttttttttttttttttt

SEQ ID NO: 99771 - DNA, 20 bp, Artificial
  CRISPR gRNA sequence
tttttttttttttttttttt

SEQ ID NO: 99772 - DNA, 20 bp, Artificial
  CRISPR gRNA sequence
tttttttttttttttttttt

SEQ ID NO: 99773 - DNA, 20 bp, Artificial
  CRISPR gRNA sequence
tttttttttttttttttttt

SEQ ID NO: 99774 - DNA, 20 bp, Artificial
  CRISPR gRNA sequence
tttttttttttttttttttg

SEQ ID NO: 99775 - DNA, 20 bp, Artificial
  CRISPR gRNA sequence
ttttttttttttttttttga

SEQ ID NO: 99776 - DNA, 20 bp, Artificial
  CRISPR gRNA sequence
tttttttttttttttttgag

SEQ ID NO: 99777 - DNA, 20 bp, Artificial
  CRISPR gRNA sequence
ttttttttttttttttgaga

SEQ ID NO: 99778 - DNA, 20 bp, Artificial
  CRISPR gRNA sequence
tttttttttttttttgagac

SEQ ID NO: 99779 - DNA, 20 bp, Artificial
  CRISPR gRNA sequence
ttttttttttttttgagaca

SEQ ID NO: 99780 - DNA, 20 bp, Artificial
  CRISPR gRNA sequence
tttttttttttttgagacag

SEQ ID NO: 99781 - DNA, 20 bp, Artificial
  CRISPR gRNA sequence
ttttttttttttgagacaga

SEQ ID NO: 99782 - DNA, 20 bp, Artificial
  CRISPR gRNA sequence
tttttttttttgagacagag

SEQ ID NO: 99783 - DNA, 20 bp, Artificial
  CRISPR gRNA sequence
ttttttttttgagacagagt

SEQ ID NO: 99784 - DNA, 20 bp, Artificial
  CRISPR gRNA sequence
tttttttttgagacagagtc

SEQ ID NO: 99785 - DNA, 20 bp, Artificial
  CRISPR gRNA sequence
ttttttttgagacagagtct

SEQ ID NO: 99786 - DNA, 20 bp, Artificial
  CRISPR gRNA sequence
tttttttgagacagagtctt

SEQ ID NO: 99787 - DNA, 20 bp, Artificial
  CRISPR gRNA sequence
ttttttgagacagagtcttg

SEQ ID NO: 99788 - DNA, 20 bp, Artificial
  CRISPR gRNA sequence
tttttgagacagagtcttgc

SEQ ID NO: 99789 - DNA, 20 bp, Artificial
  CRISPR gRNA sequence
ttttgagacagagtcttgct

SEQ ID NO: 99790 - DNA, 20 bp, Artificial
  CRISPR gRNA sequence
tttgagacagagtcttgctc

SEQ ID NO: 99791 - DNA, 20 bp, Artificial
  CRISPR gRNA sequence
ttgagacagagtcttgctct

SEQ ID NO: 99792 - DNA, 20 bp, Artificial
  CRISPR gRNA sequence
tgagacagagtcttgctctg

SEQ ID NO: 99793 - DNA, 20 bp, Artificial
  CRISPR gRNA sequence
gagacagagtcttgctctgt

SEQ ID NO: 99794 - DNA, 20 bp, Artificial
  CRISPR gRNA sequence
agacagagtcttgctctgtc

SEQ ID NO: 99795 - DNA, 20 bp, Artificial
  CRISPR gRNA sequence
gctctgtcgccccagctaca

SEQ ID NO: 99796 - DNA, 20 bp, Artificial
  CRISPR gRNA sequence
ctctgtcgccccagctacag

SEQ ID NO: 99797 - DNA, 20 bp, Artificial
  CRISPR gRNA sequence
tgtcgccccagctacagtgc

SEQ ID NO: 99798 - DNA, 20 bp, Artificial
  CRISPR gRNA sequence
tcgccccagctacagtgcag

SEQ ID NO: 99799 - DNA, 20 bp, Artificial
  CRISPR gRNA sequence
cagtgcagtggtgcgatctc

SEQ ID NO: 99800 - DNA, 20 bp, Artificial
  CRISPR gRNA sequence
tgctcaccgcaacctccacc

SEQ ID NO: 99801 - DNA, 20 bp, Artificial
  CRISPR gRNA sequence
ctcaccgcaacctccacctc

SEQ ID NO: 99802 - DNA, 20 bp, Artificial
  CRISPR gRNA sequence
accgcaacctccacctcccg

SEQ ID NO: 99803 - DNA, 20 bp, Artificial
  CRISPR gRNA sequence
cacctcccgagttcaagcaa

SEQ ID NO: 99804 - DNA, 20 bp, Artificial
  CRISPR gRNA sequence
ccgagttcaagcaattctgc

SEQ ID NO: 99805 - DNA, 20 bp, Artificial
  CRISPR gRNA sequence
aagcaattctgcctcagcct

SEQ ID NO: 99806 - DNA, 20 bp, Artificial
  CRISPR gRNA sequence
tgcctcagcctcccgagtag

SEQ ID NO: 99807 - DNA, 20 bp, Artificial
  CRISPR gRNA sequence
cctcagcctcccgagtagct

SEQ ID NO: 99808 - DNA, 20 bp, Artificial
  CRISPR gRNA sequence
agcctcccgagtagctggga

SEQ ID NO: 99809 - DNA, 20 bp, Artificial
  CRISPR gRNA sequence
ccgagtagctgggatcacag

SEQ ID NO: 99810 - DNA, 20 bp, Artificial
  CRISPR gRNA sequence
ggatcacaggcgcccgccac

SEQ ID NO: 99811 - DNA, 20 bp, Artificial
  CRISPR gRNA sequence
ggctaatttttgtattttta

SEQ ID NO: 99812 - DNA, 20 bp, Artificial
  CRISPR gRNA sequence
gctaatttttgtatttttag

SEQ ID NO: 99813 - DNA, 20 bp, Artificial
  CRISPR gRNA sequence
atttttgtatttttagtaca

SEQ ID NO: 99814 - DNA, 20 bp, Artificial
  CRISPR gRNA sequence
ttgtatttttagtacagatg

SEQ ID NO: 99815 - DNA, 20 bp, Artificial
  CRISPR gRNA sequence
tgtatttttagtacagatgg

SEQ ID NO: 99816 - DNA, 20 bp, Artificial
  CRISPR gRNA sequence
gtatttttagtacagatggg

SEQ ID NO: 99817 - DNA, 20 bp, Artificial
  CRISPR gRNA sequence
tatttttagtacagatgggg

SEQ ID NO: 99818 - DNA, 20 bp, Artificial
  CRISPR gRNA sequence
ttagtacagatggggtttca

SEQ ID NO: 99819 - DNA, 20 bp, Artificial
  CRISPR gRNA sequence
tagtacagatggggtttcac

SEQ ID NO: 99820 - DNA, 20 bp, Artificial
  CRISPR gRNA sequence
agtacagatggggtttcacc

SEQ ID NO: 99821 - DNA, 20 bp, Artificial
  CRISPR gRNA sequence
gtacagatggggtttcacca

SEQ ID NO: 99822 - DNA, 20 bp, Artificial
  CRISPR gRNA sequence
caccatggtggccagcctgg

SEQ ID NO: 99823 - DNA, 20 bp, Artificial
  CRISPR gRNA sequence
accatggtggccagcctggt

SEQ ID NO: 99824 - DNA, 20 bp, Artificial
  CRISPR gRNA sequence
gtctcgaactcctgacctca

SEQ ID NO: 99825 - DNA, 20 bp, Artificial
  CRISPR gRNA sequence
gaactcctgacctcatgatc

SEQ ID NO: 99826 - DNA, 20 bp, Artificial
  CRISPR gRNA sequence
ctgacctcatgatccaccct

SEQ ID NO: 99827 - DNA, 20 bp, Artificial
  CRISPR gRNA sequence
acctcatgatccaccctcct

SEQ ID NO: 99828 - DNA, 20 bp, Artificial
  CRISPR gRNA sequence
atgatccaccctcctcggcc

SEQ ID NO: 99829 - DNA, 20 bp, Artificial
  CRISPR gRNA sequence
ctcggcctcccaaagtgctg

SEQ ID NO: 99830 - DNA, 20 bp, Artificial
  CRISPR gRNA sequence
ggcctcccaaagtgctggga

SEQ ID NO: 99831 - DNA, 20 bp, Artificial
  CRISPR gRNA sequence
ccaaagtgctgggattacag

SEQ ID NO: 99832 - DNA, 20 bp, Artificial
  CRISPR gRNA sequence
ggattacagccgtgagccac

SEQ ID NO: 99833 - DNA, 20 bp, Artificial
  CRISPR gRNA sequence
cagccgtgagccactgtgcc

SEQ ID NO: 99834 - DNA, 20 bp, Artificial
  CRISPR gRNA sequence
tgccctgccagagcccaggc

SEQ ID NO: 99835 - DNA, 20 bp, Artificial
  CRISPR gRNA sequence
ccagagcccaggctcttaaa

SEQ ID NO: 99836 - DNA, 20 bp, Artificial
  CRISPR gRNA sequence
ttaaacattgcacattgtag

SEQ ID NO: 99837 - DNA, 20 bp, Artificial
  CRISPR gRNA sequence
aaacattgcacattgtaggt

SEQ ID NO: 99838 - DNA, 20 bp, Artificial
  CRISPR gRNA sequence
aacattgcacattgtaggtg

SEQ ID NO: 99839 - DNA, 20 bp, Artificial
  CRISPR gRNA sequence
cacattgtaggtgctttggt

SEQ ID NO: 99840 - DNA, 20 bp, Artificial
  CRISPR gRNA sequence
taggtgctttggtggtgggg

SEQ ID NO: 99841 - DNA, 20 bp, Artificial
  CRISPR gRNA sequence
tggtggtggggaatggtaga

SEQ ID NO: 99842 - DNA, 20 bp, Artificial
  CRISPR gRNA sequence
ggtggtggggaatggtagac

SEQ ID NO: 99843 - DNA, 20 bp, Artificial
  CRISPR gRNA sequence
gtggtggggaatggtagacc

SEQ ID NO: 99844 - DNA, 20 bp, Artificial
  CRISPR gRNA sequence
gaaagcagttggactctggt

SEQ ID NO: 99845 - DNA, 20 bp, Artificial
  CRISPR gRNA sequence
gactctggttttcatttccc

SEQ ID NO: 99846 - DNA, 20 bp, Artificial
  CRISPR gRNA sequence
tggttttcatttccctggct

SEQ ID NO: 99847 - DNA, 20 bp, Artificial
  CRISPR gRNA sequence
gttttcatttccctggctct

SEQ ID NO: 99848 - DNA, 20 bp, Artificial
  CRISPR gRNA sequence
tcatttccctggctctggta

SEQ ID NO: 99849 - DNA, 20 bp, Artificial
  CRISPR gRNA sequence
catttccctggctctggtaa

SEQ ID NO: 99850 - DNA, 20 bp, Artificial
  CRISPR gRNA sequence
atttccctggctctggtaat

SEQ ID NO: 99851 - DNA, 20 bp, Artificial
  CRISPR gRNA sequence
ccctggctctggtaattaac

SEQ ID NO: 99852 - DNA, 20 bp, Artificial
  CRISPR gRNA sequence
cctggctctggtaattaacc

SEQ ID NO: 99853 - DNA, 20 bp, Artificial
  CRISPR gRNA sequence
gctctggtaattaacctgga

SEQ ID NO: 99854 - DNA, 20 bp, Artificial
  CRISPR gRNA sequence
tggtaattaacctggacctc

SEQ ID NO: 99855 - DNA, 20 bp, Artificial
  CRISPR gRNA sequence
gtaattaacctggacctcag

SEQ ID NO: 99856 - DNA, 20 bp, Artificial
  CRISPR gRNA sequence
acctggacctcagtttaccc

SEQ ID NO: 99857 - DNA, 20 bp, Artificial
  CRISPR gRNA sequence
gacctcagtttacccaccct

SEQ ID NO: 99858 - DNA, 20 bp, Artificial
  CRISPR gRNA sequence
agtttacccaccctcacagt

SEQ ID NO: 99859 - DNA, 20 bp, Artificial
  CRISPR gRNA sequence
acccaccctcacagtgcaag

SEQ ID NO: 99860 - DNA, 20 bp, Artificial
  CRISPR gRNA sequence
cccaccctcacagtgcaagg

SEQ ID NO: 99861 - DNA, 20 bp, Artificial
  CRISPR gRNA sequence
acagtgcaaggctaggtatg

SEQ ID NO: 99862 - DNA, 20 bp, Artificial
  CRISPR gRNA sequence
ggtatgcagtcggtgcctac

SEQ ID NO: 99863 - DNA, 20 bp, Artificial
  CRISPR gRNA sequence
ctttattataactgttgata

SEQ ID NO: 99864 - DNA, 20 bp, Artificial
  CRISPR gRNA sequence
tattataactgttgataatt

SEQ ID NO: 99865 - DNA, 20 bp, Artificial
  CRISPR gRNA sequence
attataactgttgataatta

SEQ ID NO: 99866 - DNA, 20 bp, Artificial
  CRISPR gRNA sequence
ttataactgttgataattat

SEQ ID NO: 99867 - DNA, 20 bp, Artificial
  CRISPR gRNA sequence
taactgttgataattattgt

SEQ ID NO: 99868 - DNA, 20 bp, Artificial
  CRISPR gRNA sequence
ttgataattattgtcatctc

SEQ ID NO: 99869 - DNA, 20 bp, Artificial
  CRISPR gRNA sequence
ataattattgtcatctctcc

SEQ ID NO: 99870 - DNA, 20 bp, Artificial
  CRISPR gRNA sequence
ttgtcatctctccccttctg

SEQ ID NO: 99871 - DNA, 20 bp, Artificial
  CRISPR gRNA sequence
tcatctctccccttctgaca

SEQ ID NO: 99872 - DNA, 20 bp, Artificial
  CRISPR gRNA sequence
tccccttctgacacctccgc

SEQ ID NO: 99873 - DNA, 20 bp, Artificial
  CRISPR gRNA sequence
cccttctgacacctccgcca

SEQ ID NO: 99874 - DNA, 20 bp, Artificial
  CRISPR gRNA sequence
ctgacacctccgccagcttt

SEQ ID NO: 99875 - DNA, 20 bp, Artificial
  CRISPR gRNA sequence
tgacacctccgccagctttc

SEQ ID NO: 99876 - DNA, 20 bp, Artificial
  CRISPR gRNA sequence
acacctccgccagctttccc

SEQ ID NO: 99877 - DNA, 20 bp, Artificial
  CRISPR gRNA sequence
cgccagctttccccatggag

SEQ ID NO: 99878 - DNA, 20 bp, Artificial
  CRISPR gRNA sequence
tccccatggagcttacccag

SEQ ID NO: 99879 - DNA, 20 bp, Artificial
  CRISPR gRNA sequence
ccccatggagcttacccagc

SEQ ID NO: 99880 - DNA, 20 bp, Artificial
  CRISPR gRNA sequence
cccatggagcttacccagcc

SEQ ID NO: 99881 - DNA, 20 bp, Artificial
  CRISPR gRNA sequence
acccagcctgcagaagacct

SEQ ID NO: 99882 - DNA, 20 bp, Artificial
  CRISPR gRNA sequence
cccagcctgcagaagacctc

SEQ ID NO: 99883 - DNA, 20 bp, Artificial
  CRISPR gRNA sequence
cagaagacctcatccagacc

SEQ ID NO: 99884 - DNA, 20 bp, Artificial
  CRISPR gRNA sequence
atccagacccagcagacccc

SEQ ID NO: 99885 - DNA, 20 bp, Artificial
  CRISPR gRNA sequence
cctcagaacttggggaccct

SEQ ID NO: 99886 - DNA, 20 bp, Artificial
  CRISPR gRNA sequence
agaacttggggaccctgaag

SEQ ID NO: 99887 - DNA, 20 bp, Artificial
  CRISPR gRNA sequence
ggggaccctgaagaccccgg

SEQ ID NO: 99888 - DNA, 20 bp, Artificial
  CRISPR gRNA sequence
gggaccctgaagaccccgga

SEQ ID NO: 99889 - DNA, 20 bp, Artificial
  CRISPR gRNA sequence
aagaccccggagaggaggct

SEQ ID NO: 99890 - DNA, 20 bp, Artificial
  CRISPR gRNA sequence
cagatggctcagacactgtg

SEQ ID NO: 99891 - DNA, 20 bp, Artificial
  CRISPR gRNA sequence
agacactgtggtcctcagtc

SEQ ID NO: 99892 - DNA, 20 bp, Artificial
  CRISPR gRNA sequence
tggtcctcagtctctttccc

SEQ ID NO: 99893 - DNA, 20 bp, Artificial
  CRISPR gRNA sequence
agtctctttccctgcacaac

SEQ ID NO: 99894 - DNA, 20 bp, Artificial
  CRISPR gRNA sequence
tttccctgcacaaccggatg

SEQ ID NO: 99895 - DNA, 20 bp, Artificial
  CRISPR gRNA sequence
tccctgcacaaccggatgcc

SEQ ID NO: 99896 - DNA, 20 bp, Artificial
  CRISPR gRNA sequence
ccctgcacaaccggatgcca

SEQ ID NO: 99897 - DNA, 20 bp, Artificial
  CRISPR gRNA sequence
cctgcacaaccggatgccag

SEQ ID NO: 99898 - DNA, 20 bp, Artificial
  CRISPR gRNA sequence
cacaaccggatgccagtgtt

SEQ ID NO: 99899 - DNA, 20 bp, Artificial
  CRISPR gRNA sequence
cctctccacagggtaggata

SEQ ID NO: 99900 - DNA, 20 bp, Artificial
  CRISPR gRNA sequence
ctctccacagggtaggatac

SEQ ID NO: 99901 - DNA, 20 bp, Artificial
  CRISPR gRNA sequence
tccacagggtaggatacctc

SEQ ID NO: 99902 - DNA, 20 bp, Artificial
  CRISPR gRNA sequence
cacagggtaggatacctcct

SEQ ID NO: 99903 - DNA, 20 bp, Artificial
  CRISPR gRNA sequence
ctctgggattagccctctgg

SEQ ID NO: 99904 - DNA, 20 bp, Artificial
  CRISPR gRNA sequence
tgggattagccctctgggat

SEQ ID NO: 99905 - DNA, 20 bp, Artificial
  CRISPR gRNA sequence
ggattagccctctgggattc

SEQ ID NO: 99906 - DNA, 20 bp, Artificial
  CRISPR gRNA sequence
gccctctgggattccatgat

SEQ ID NO: 99907 - DNA, 20 bp, Artificial
  CRISPR gRNA sequence
tgggattccatgatgatgga

SEQ ID NO: 99908 - DNA, 20 bp, Artificial
  CRISPR gRNA sequence
ggattccatgatgatggaat

SEQ ID NO: 99909 - DNA, 20 bp, Artificial
  CRISPR gRNA sequence
catgatgatggaatgtcagg

SEQ ID NO: 99910 - DNA, 20 bp, Artificial
  CRISPR gRNA sequence
acatggaacctgtgtcttgc

SEQ ID NO: 99911 - DNA, 20 bp, Artificial
  CRISPR gRNA sequence
tgtcttgctttcgtttttgt

SEQ ID NO: 99912 - DNA, 20 bp, Artificial
  CRISPR gRNA sequence
gctttcgtttttgttttgtt

SEQ ID NO: 99913 - DNA, 20 bp, Artificial
  CRISPR gRNA sequence
ctttcgtttttgttttgttt

SEQ ID NO: 99914 - DNA, 20 bp, Artificial
  CRISPR gRNA sequence
tcgtttttgttttgttttgt

SEQ ID NO: 99915 - DNA, 20 bp, Artificial
  CRISPR gRNA sequence
cgtttttgttttgttttgtt

SEQ ID NO: 99916 - DNA, 20 bp, Artificial
  CRISPR gRNA sequence
gtttttgttttgttttgttt

SEQ ID NO: 99917 - DNA, 20 bp, Artificial
  CRISPR gRNA sequence
ttgttttgttttgttttgtt

SEQ ID NO: 99918 - DNA, 20 bp, Artificial
  CRISPR gRNA sequence
tgttttgttttgttttgttg

SEQ ID NO: 99919 - DNA, 20 bp, Artificial
  CRISPR gRNA sequence
gttttgttttgttttgttgt

SEQ ID NO: 99920 - DNA, 20 bp, Artificial
  CRISPR gRNA sequence
ttttgttttgttttgttgtt

SEQ ID NO: 99921 - DNA, 20 bp, Artificial
  CRISPR gRNA sequence
tgttttgttttgttgttttt

SEQ ID NO: 99922 - DNA, 20 bp, Artificial
  CRISPR gRNA sequence
gttttgttttgttgtttttt

SEQ ID NO: 99923 - DNA, 20 bp, Artificial
  CRISPR gRNA sequence
ttttgttttgttgttttttg

SEQ ID NO: 99924 - DNA, 20 bp, Artificial
  CRISPR gRNA sequence
tgttttgttgttttttgaga

SEQ ID NO: 99925 - DNA, 20 bp, Artificial
  CRISPR gRNA sequence
gttttgttgttttttgagat

SEQ ID NO: 99926 - DNA, 20 bp, Artificial
  CRISPR gRNA sequence
ttttgttgttttttgagatg

SEQ ID NO: 99927 - DNA, 20 bp, Artificial
  CRISPR gRNA sequence
tgttgttttttgagatggag

SEQ ID NO: 99928 - DNA, 20 bp, Artificial
  CRISPR gRNA sequence
gttgttttttgagatggagt

SEQ ID NO: 99929 - DNA, 20 bp, Artificial
  CRISPR gRNA sequence
ttgttttttgagatggagtt

SEQ ID NO: 99930 - DNA, 20 bp, Artificial
  CRISPR gRNA sequence
ttttttgagatggagttttg

SEQ ID NO: 99931 - DNA, 20 bp, Artificial
  CRISPR gRNA sequence
tttgagatggagttttgctc

SEQ ID NO: 99932 - DNA, 20 bp, Artificial
  CRISPR gRNA sequence
ttgagatggagttttgctct

SEQ ID NO: 99933 - DNA, 20 bp, Artificial
  CRISPR gRNA sequence
tgagatggagttttgctctt

SEQ ID NO: 99934 - DNA, 20 bp, Artificial
  CRISPR gRNA sequence
gagatggagttttgctcttg

SEQ ID NO: 99935 - DNA, 20 bp, Artificial
  CRISPR gRNA sequence
agatggagttttgctcttgt

SEQ ID NO: 99936 - DNA, 20 bp, Artificial
  CRISPR gRNA sequence
tgctcttgttgcccatgctg

SEQ ID NO: 99937 - DNA, 20 bp, Artificial
  CRISPR gRNA sequence
gctcttgttgcccatgctgg

SEQ ID NO: 99938 - DNA, 20 bp, Artificial
  CRISPR gRNA sequence
ctcttgttgcccatgctgga

SEQ ID NO: 99939 - DNA, 20 bp, Artificial
  CRISPR gRNA sequence
ttgttgcccatgctggagtg

SEQ ID NO: 99940 - DNA, 20 bp, Artificial
  CRISPR gRNA sequence
gttgcccatgctggagtgca

SEQ ID NO: 99941 - DNA, 20 bp, Artificial
  CRISPR gRNA sequence
ttgcccatgctggagtgcaa

SEQ ID NO: 99942 - DNA, 20 bp, Artificial
  CRISPR gRNA sequence
cccatgctggagtgcaatgg

SEQ ID NO: 99943 - DNA, 20 bp, Artificial
  CRISPR gRNA sequence
gagtgcaatggcgtgatctc

SEQ ID NO: 99944 - DNA, 20 bp, Artificial
  CRISPR gRNA sequence
agctcactgcaacctctgcc

SEQ ID NO: 99945 - DNA, 20 bp, Artificial
  CRISPR gRNA sequence
actgcaacctctgcctcctg

SEQ ID NO: 99946 - DNA, 20 bp, Artificial
  CRISPR gRNA sequence
caacctctgcctcctgggtt

SEQ ID NO: 99947 - DNA, 20 bp, Artificial
  CRISPR gRNA sequence
tgcctcctgggttcaactga

SEQ ID NO: 99948 - DNA, 20 bp, Artificial
  CRISPR gRNA sequence
cctcctgggttcaactgatt

SEQ ID NO: 99949 - DNA, 20 bp, Artificial
  CRISPR gRNA sequence
ctgggttcaactgattctcc

SEQ ID NO: 99950 - DNA, 20 bp, Artificial
  CRISPR gRNA sequence
ggttcaactgattctcctgt

SEQ ID NO: 99951 - DNA, 20 bp, Artificial
  CRISPR gRNA sequence
aactgattctcctgtctcag

SEQ ID NO: 99952 - DNA, 20 bp, Artificial
  CRISPR gRNA sequence
attctcctgtctcagcctcc

SEQ ID NO: 99953 - DNA, 20 bp, Artificial
  CRISPR gRNA sequence
tcctgtctcagcctcctgag

SEQ ID NO: 99954 - DNA, 20 bp, Artificial
  CRISPR gRNA sequence
ctgtctcagcctcctgagta

SEQ ID NO: 99955 - DNA, 20 bp, Artificial
  CRISPR gRNA sequence
tctcagcctcctgagtagct

SEQ ID NO: 99956 - DNA, 20 bp, Artificial
  CRISPR gRNA sequence
agcctcctgagtagctggga

SEQ ID NO: 99957 - DNA, 20 bp, Artificial
  CRISPR gRNA sequence
ctgagtagctgggattacag

SEQ ID NO: 99958 - DNA, 20 bp, Artificial
  CRISPR gRNA sequence
agtagctgggattacaggct

SEQ ID NO: 99959 - DNA, 20 bp, Artificial
  CRISPR gRNA sequence
ggattacaggcttccgccac

SEQ ID NO: 99960 - DNA, 20 bp, Artificial
  CRISPR gRNA sequence
caggcttccgccactacgcc

SEQ ID NO: 99961 - DNA, 20 bp, Artificial
  CRISPR gRNA sequence
ccgccactacgcccagctaa

SEQ ID NO: 99962 - DNA, 20 bp, Artificial
  CRISPR gRNA sequence
cgccactacgcccagctaat

SEQ ID NO: 99963 - DNA, 20 bp, Artificial
  CRISPR gRNA sequence
cgcccagctaattttttggg

SEQ ID NO: 99964 - DNA, 20 bp, Artificial
  CRISPR gRNA sequence
attttttgggtatttttagt

SEQ ID NO: 99965 - DNA, 20 bp, Artificial
  CRISPR gRNA sequence
tttgggtatttttagtagag

SEQ ID NO: 99966 - DNA, 20 bp, Artificial
  CRISPR gRNA sequence
ttgggtatttttagtagaga

SEQ ID NO: 99967 - DNA, 20 bp, Artificial
  CRISPR gRNA sequence
tgggtatttttagtagagac

SEQ ID NO: 99968 - DNA, 20 bp, Artificial
  CRISPR gRNA sequence
gggtatttttagtagagacg

SEQ ID NO: 99969 - DNA, 20 bp, Artificial
  CRISPR gRNA sequence
ggtatttttagtagagacgg

SEQ ID NO: 99970 - DNA, 20 bp, Artificial
  CRISPR gRNA sequence
ttagtagagacggggtttca

SEQ ID NO: 99971 - DNA, 20 bp, Artificial
  CRISPR gRNA sequence
tagtagagacggggtttcac

SEQ ID NO: 99972 - DNA, 20 bp, Artificial
  CRISPR gRNA sequence
agtagagacggggtttcacc

SEQ ID NO: 99973 - DNA, 20 bp, Artificial
  CRISPR gRNA sequence
gtagagacggggtttcacca

SEQ ID NO: 99974 - DNA, 20 bp, Artificial
  CRISPR gRNA sequence
caccatgttggccaggctgg

SEQ ID NO: 99975 - DNA, 20 bp, Artificial
  CRISPR gRNA sequence
accatgttggccaggctggt

SEQ ID NO: 99976 - DNA, 20 bp, Artificial
  CRISPR gRNA sequence
gccaggctggtcttgaactc

SEQ ID NO: 99977 - DNA, 20 bp, Artificial
  CRISPR gRNA sequence
gtcttgaactcctgacctca

SEQ ID NO: 99978 - DNA, 20 bp, Artificial
  CRISPR gRNA sequence
gaactcctgacctcaggtga

SEQ ID NO: 99979 - DNA, 20 bp, Artificial
  CRISPR gRNA sequence
aactcctgacctcaggtgat

SEQ ID NO: 99980 - DNA, 20 bp, Artificial
  CRISPR gRNA sequence
ctgacctcaggtgatccgcc

SEQ ID NO: 99981 - DNA, 20 bp, Artificial
  CRISPR gRNA sequence
acctcaggtgatccgcccac

SEQ ID NO: 99982 - DNA, 20 bp, Artificial
  CRISPR gRNA sequence
aggtgatccgcccacctcgg

SEQ ID NO: 99983 - DNA, 20 bp, Artificial
  CRISPR gRNA sequence
ggcctcccaaagtgctggga

SEQ ID NO: 99984 - DNA, 20 bp, Artificial
  CRISPR gRNA sequence
ccaaagtgctgggattacag

SEQ ID NO: 99985 - DNA, 20 bp, Artificial
  CRISPR gRNA sequence
ggattacaggcatgagccac

SEQ ID NO: 99986 - DNA, 20 bp, Artificial
  CRISPR gRNA sequence
caggcatgagccactgtgcc

SEQ ID NO: 99987 - DNA, 20 bp, Artificial
  CRISPR gRNA sequence
tgcccggcctgtttttgttt

SEQ ID NO: 99988 - DNA, 20 bp, Artificial
  CRISPR gRNA sequence
tttttgttttttgatacagg

SEQ ID NO: 99989 - DNA, 20 bp, Artificial
  CRISPR gRNA sequence
ttgttttttgatacagggtc

SEQ ID NO: 99990 - DNA, 20 bp, Artificial
  CRISPR gRNA sequence
tgttttttgatacagggtct

SEQ ID NO: 99991 - DNA, 20 bp, Artificial
  CRISPR gRNA sequence
gttttttgatacagggtctc

SEQ ID NO: 99992 - DNA, 20 bp, Artificial
  CRISPR gRNA sequence
ttttttgatacagggtctcg

SEQ ID NO: 99993 - DNA, 20 bp, Artificial
  CRISPR gRNA sequence
tttgatacagggtctcgctc

SEQ ID NO: 99994 - DNA, 20 bp, Artificial
  CRISPR gRNA sequence
ttgatacagggtctcgctct

SEQ ID NO: 99995 - DNA, 20 bp, Artificial
  CRISPR gRNA sequence
tgatacagggtctcgctctg

SEQ ID NO: 99996 - DNA, 20 bp, Artificial
  CRISPR gRNA sequence
gatacagggtctcgctctgt

SEQ ID NO: 99997 - DNA, 20 bp, Artificial
  CRISPR gRNA sequence
atacagggtctcgctctgtt

SEQ ID NO: 99998 - DNA, 20 bp, Artificial
  CRISPR gRNA sequence
gctctgttactaaggctgga

SEQ ID NO: 99999 - DNA, 20 bp, Artificial
  CRISPR gRNA sequence
tgttactaaggctggagtgc

SEQ ID NO: 100000 - DNA, 20 bp, Artificial
  CRISPR gRNA sequence
ttactaaggctggagtgcag

SEQ ID NO: 100001 - DNA, 20 bp, Artificial
  CRISPR gRNA sequence
ctaaggctggagtgcagtga

SEQ ID NO: 100002 - DNA, 20 bp, Artificial
  CRISPR gRNA sequence
aggctggagtgcagtgatgc

SEQ ID NO: 100003 - DNA, 20 bp, Artificial
  CRISPR gRNA sequence
gagtgcagtgatgcaatcat

SEQ ID NO: 100004 - DNA, 20 bp, Artificial
  CRISPR gRNA sequence
actgcagcctcaacttcctg

SEQ ID NO: 100005 - DNA, 20 bp, Artificial
  CRISPR gRNA sequence
cagcctcaacttcctgggct

SEQ ID NO: 100006 - DNA, 20 bp, Artificial
  CRISPR gRNA sequence
aacttcctgggctgaagcca

SEQ ID NO: 100007 - DNA, 20 bp, Artificial
  CRISPR gRNA sequence
cctgggctgaagccatcact

SEQ ID NO: 100008 - DNA, 20 bp, Artificial
  CRISPR gRNA sequence
ctgggctgaagccatcactc

SEQ ID NO: 100009 - DNA, 20 bp, Artificial
  CRISPR gRNA sequence
ggctgaagccatcactcagc

SEQ ID NO: 100010 - DNA, 20 bp, Artificial
  CRISPR gRNA sequence
aagccatcactcagcctccc

SEQ ID NO: 100011 - DNA, 20 bp, Artificial
  CRISPR gRNA sequence
agcctccctaggagctggga

SEQ ID NO: 100012 - DNA, 20 bp, Artificial
  CRISPR gRNA sequence
cctaggagctgggactatag

SEQ ID NO: 100013 - DNA, 20 bp, Artificial
  CRISPR gRNA sequence
ggagctgggactataggcat

SEQ ID NO: 100014 - DNA, 20 bp, Artificial
  CRISPR gRNA sequence
ggactataggcatgcaacca

SEQ ID NO: 100015 - DNA, 20 bp, Artificial
  CRISPR gRNA sequence
taggcatgcaaccacacctg

SEQ ID NO: 100016 - DNA, 20 bp, Artificial
  CRISPR gRNA sequence
gctaattttttttttttttt

SEQ ID NO: 100017 - DNA, 20 bp, Artificial
  CRISPR gRNA sequence
attttttttttttttttggg

SEQ ID NO: 100018 - DNA, 20 bp, Artificial
  CRISPR gRNA sequence
tttttttttttttgggaggc

SEQ ID NO: 100019 - DNA, 20 bp, Artificial
  CRISPR gRNA sequence
ttttttttttttgggaggct

SEQ ID NO: 100020 - DNA, 20 bp, Artificial
  CRISPR gRNA sequence
tttttttttttgggaggctg

SEQ ID NO: 100021 - DNA, 20 bp, Artificial
  CRISPR gRNA sequence
ttttttttttgggaggctgg

SEQ ID NO: 100022 - DNA, 20 bp, Artificial
  CRISPR gRNA sequence
tttttttttgggaggctggt

SEQ ID NO: 100023 - DNA, 20 bp, Artificial
  CRISPR gRNA sequence
ttttttttgggaggctggtc

SEQ ID NO: 100024 - DNA, 20 bp, Artificial
  CRISPR gRNA sequence
tttttttgggaggctggtct

SEQ ID NO: 100025 - DNA, 20 bp, Artificial
  CRISPR gRNA sequence
ttttttgggaggctggtctc

SEQ ID NO: 100026 - DNA, 20 bp, Artificial
  CRISPR gRNA sequence
tttttgggaggctggtctcc

SEQ ID NO: 100027 - DNA, 20 bp, Artificial
  CRISPR gRNA sequence
ttttgggaggctggtctcca

SEQ ID NO: 100028 - DNA, 20 bp, Artificial
  CRISPR gRNA sequence
tttgggaggctggtctccac

SEQ ID NO: 100029 - DNA, 20 bp, Artificial
  CRISPR gRNA sequence
ttgggaggctggtctccacc

SEQ ID NO: 100030 - DNA, 20 bp, Artificial
  CRISPR gRNA sequence
tgggaggctggtctccacct

SEQ ID NO: 100031 - DNA, 20 bp, Artificial
  CRISPR gRNA sequence
gggaggctggtctccacctc

SEQ ID NO: 100032 - DNA, 20 bp, Artificial
  CRISPR gRNA sequence
ggaggctggtctccacctcc

SEQ ID NO: 100033 - DNA, 20 bp, Artificial
  CRISPR gRNA sequence
gtctccacctcctgggctca

SEQ ID NO: 100034 - DNA, 20 bp, Artificial
  CRISPR gRNA sequence
cacctcctgggctcaagtga

SEQ ID NO: 100035 - DNA, 20 bp, Artificial
  CRISPR gRNA sequence
ctgggctcaagtgatctgca

SEQ ID NO: 100036 - DNA, 20 bp, Artificial
  CRISPR gRNA sequence
ggctcaagtgatctgcaggc

SEQ ID NO: 100037 - DNA, 20 bp, Artificial
  CRISPR gRNA sequence
aagtgatctgcaggcctcca

SEQ ID NO: 100038 - DNA, 20 bp, Artificial
  CRISPR gRNA sequence
caggcctccacttccgaaag

SEQ ID NO: 100039 - DNA, 20 bp, Artificial
  CRISPR gRNA sequence
cacttccgaaagtgctggga

SEQ ID NO: 100040 - DNA, 20 bp, Artificial
  CRISPR gRNA sequence
ccgaaagtgctgggattaca

SEQ ID NO: 100041 - DNA, 20 bp, Artificial
  CRISPR gRNA sequence
cgaaagtgctgggattacag

SEQ ID NO: 100042 - DNA, 20 bp, Artificial
  CRISPR gRNA sequence
ggattacaggtgtgagccac

SEQ ID NO: 100043 - DNA, 20 bp, Artificial
  CRISPR gRNA sequence
caggtgtgagccacagtgcc

SEQ ID NO: 100044 - DNA, 20 bp, Artificial
  CRISPR gRNA sequence
cacacctgtttttaactctt

SEQ ID NO: 100045 - DNA, 20 bp, Artificial
  CRISPR gRNA sequence
acacctgtttttaactcttt

SEQ ID NO: 100046 - DNA, 20 bp, Artificial
  CRISPR gRNA sequence
tttttaactctttgagggta

SEQ ID NO: 100047 - DNA, 20 bp, Artificial
  CRISPR gRNA sequence
ttaactctttgagggtagat

SEQ ID NO: 100048 - DNA, 20 bp, Artificial
  CRISPR gRNA sequence
taactctttgagggtagata

SEQ ID NO: 100049 - DNA, 20 bp, Artificial
  CRISPR gRNA sequence
aactctttgagggtagatag

SEQ ID NO: 100050 - DNA, 20 bp, Artificial
  CRISPR gRNA sequence
actctttgagggtagatagc

SEQ ID NO: 100051 - DNA, 20 bp, Artificial
  CRISPR gRNA sequence
tttgagggtagatagctagg

SEQ ID NO: 100052 - DNA, 20 bp, Artificial
  CRISPR gRNA sequence
tgagggtagatagctaggag

SEQ ID NO: 100053 - DNA, 20 bp, Artificial
  CRISPR gRNA sequence
gagggtagatagctaggagt

SEQ ID NO: 100054 - DNA, 20 bp, Artificial
  CRISPR gRNA sequence
agggtagatagctaggagtg

SEQ ID NO: 100055 - DNA, 20 bp, Artificial
  CRISPR gRNA sequence
ggagtgaaattactgggtca

SEQ ID NO: 100056 - DNA, 20 bp, Artificial
  CRISPR gRNA sequence
ctgggtcagatggtcatcct

SEQ ID NO: 100057 - DNA, 20 bp, Artificial
  CRISPR gRNA sequence
ggtcagatggtcatcctgtt

SEQ ID NO: 100058 - DNA, 20 bp, Artificial
  CRISPR gRNA sequence
ttttacttactgaggaactg

SEQ ID NO: 100059 - DNA, 20 bp, Artificial
  CRISPR gRNA sequence
tacttactgaggaactgagg

SEQ ID NO: 100060 - DNA, 20 bp, Artificial
  CRISPR gRNA sequence
acttactgaggaactgagga

SEQ ID NO: 100061 - DNA, 20 bp, Artificial
  CRISPR gRNA sequence
cttactgaggaactgaggat

SEQ ID NO: 100062 - DNA, 20 bp, Artificial
  CRISPR gRNA sequence
actgaggaactgaggattta

SEQ ID NO: 100063 - DNA, 20 bp, Artificial
  CRISPR gRNA sequence
ctgaggaactgaggatttat

SEQ ID NO: 100064 - DNA, 20 bp, Artificial
  CRISPR gRNA sequence
aggaactgaggatttatttt

SEQ ID NO: 100065 - DNA, 20 bp, Artificial
  CRISPR gRNA sequence
aggatttatttttgattgga

SEQ ID NO: 100066 - DNA, 20 bp, Artificial
  CRISPR gRNA sequence
atttttgattggagtccaag

SEQ ID NO: 100067 - DNA, 20 bp, Artificial
  CRISPR gRNA sequence
tttttgattggagtccaaga

SEQ ID NO: 100068 - DNA, 20 bp, Artificial
  CRISPR gRNA sequence
ttgattggagtccaagaata

SEQ ID NO: 100069 - DNA, 20 bp, Artificial
  CRISPR gRNA sequence
tgattggagtccaagaatat

SEQ ID NO: 100070 - DNA, 20 bp, Artificial
  CRISPR gRNA sequence
gattggagtccaagaatatg

SEQ ID NO: 100071 - DNA, 20 bp, Artificial
  CRISPR gRNA sequence
attggagtccaagaatatgc

SEQ ID NO: 100072 - DNA, 20 bp, Artificial
  CRISPR gRNA sequence
gagtccaagaatatgcctaa

SEQ ID NO: 100073 - DNA, 20 bp, Artificial
  CRISPR gRNA sequence
atttagttccctcccacgac

SEQ ID NO: 100074 - DNA, 20 bp, Artificial
  CRISPR gRNA sequence
agttccctcccacgaccttt

SEQ ID NO: 100075 - DNA, 20 bp, Artificial
  CRISPR gRNA sequence
gttccctcccacgacctttg

SEQ ID NO: 100076 - DNA, 20 bp, Artificial
  CRISPR gRNA sequence
cctcccacgacctttgttgc

SEQ ID NO: 100077 - DNA, 20 bp, Artificial
  CRISPR gRNA sequence
ccacgacctttgttgctgcc

SEQ ID NO: 100078 - DNA, 20 bp, Artificial
  CRISPR gRNA sequence
tgttgctgccactcctgtct

SEQ ID NO: 100079 - DNA, 20 bp, Artificial
  CRISPR gRNA sequence
gttgctgccactcctgtctg

SEQ ID NO: 100080 - DNA, 20 bp, Artificial
  CRISPR gRNA sequence
ttgctgccactcctgtctgg

SEQ ID NO: 100081 - DNA, 20 bp, Artificial
  CRISPR gRNA sequence
ctgccactcctgtctggaat

SEQ ID NO: 100082 - DNA, 20 bp, Artificial
  CRISPR gRNA sequence
ccactcctgtctggaatgct

SEQ ID NO: 100083 - DNA, 20 bp, Artificial
  CRISPR gRNA sequence
ctgtctggaatgctcttcct

SEQ ID NO: 100084 - DNA, 20 bp, Artificial
  CRISPR gRNA sequence
tctggaatgctcttcctaca

SEQ ID NO: 100085 - DNA, 20 bp, Artificial
  CRISPR gRNA sequence
gaatgctcttcctacacttc

SEQ ID NO: 100086 - DNA, 20 bp, Artificial
  CRISPR gRNA sequence
ttcctacacttcttcctata

SEQ ID NO: 100087 - DNA, 20 bp, Artificial
  CRISPR gRNA sequence
cctacacttcttcctatagc

SEQ ID NO: 100088 - DNA, 20 bp, Artificial
  CRISPR gRNA sequence
ctacacttcttcctatagct

SEQ ID NO: 100089 - DNA, 20 bp, Artificial
  CRISPR gRNA sequence
cacttcttcctatagctgac

SEQ ID NO: 100090 - DNA, 20 bp, Artificial
  CRISPR gRNA sequence
cttcctatagctgactcccc

SEQ ID NO: 100091 - DNA, 20 bp, Artificial
  CRISPR gRNA sequence
ttcctatagctgactcccct

SEQ ID NO: 100092 - DNA, 20 bp, Artificial
  CRISPR gRNA sequence
cctatagctgactcccctcc

SEQ ID NO: 100093 - DNA, 20 bp, Artificial
  CRISPR gRNA sequence
ctatagctgactcccctccc

SEQ ID NO: 100094 - DNA, 20 bp, Artificial
  CRISPR gRNA sequence
tagctgactcccctcccctc

SEQ ID NO: 100095 - DNA, 20 bp, Artificial
  CRISPR gRNA sequence
actcccctcccctccctccc

SEQ ID NO: 100096 - DNA, 20 bp, Artificial
  CRISPR gRNA sequence
ccctcccctccctcccttcc

SEQ ID NO: 100097 - DNA, 20 bp, Artificial
  CRISPR gRNA sequence
ccctccctcccttcccgcct

SEQ ID NO: 100098 - DNA, 20 bp, Artificial
  CRISPR gRNA sequence
cctcccttcccgcctccgtt

SEQ ID NO: 100099 - DNA, 20 bp, Artificial
  CRISPR gRNA sequence
ccttcccgcctccgtttttt

SEQ ID NO: 100100 - DNA, 20 bp, Artificial
  CRISPR gRNA sequence
cccgcctccgtttttttttt

SEQ ID NO: 100101 - DNA, 20 bp, Artificial
  CRISPR gRNA sequence
ccgcctccgttttttttttc

SEQ ID NO: 100102 - DNA, 20 bp, Artificial
  CRISPR gRNA sequence
cgttttttttttctttcttt

SEQ ID NO: 100103 - DNA, 20 bp, Artificial
  CRISPR gRNA sequence
tttttttctttctttctttc

SEQ ID NO: 100104 - DNA, 20 bp, Artificial
  CRISPR gRNA sequence
ttttttctttctttctttct

SEQ ID NO: 100105 - DNA, 20 bp, Artificial
  CRISPR gRNA sequence
tttttctttctttctttctt

SEQ ID NO: 100106 - DNA, 20 bp, Artificial
  CRISPR gRNA sequence
ttttctttctttctttcttt

SEQ ID NO: 100107 - DNA, 20 bp, Artificial
  CRISPR gRNA sequence
tttctttctttctttctttt

SEQ ID NO: 100108 - DNA, 20 bp, Artificial
  CRISPR gRNA sequence
ttctttctttctttcttttt

SEQ ID NO: 100109 - DNA, 20 bp, Artificial
  CRISPR gRNA sequence
tctttctttctttctttttt

SEQ ID NO: 100110 - DNA, 20 bp, Artificial
  CRISPR gRNA sequence
ctttctttctttcttttttt

SEQ ID NO: 100111 - DNA, 20 bp, Artificial
  CRISPR gRNA sequence
tttctttctttctttttttg

SEQ ID NO: 100112 - DNA, 20 bp, Artificial
  CRISPR gRNA sequence
tctttctttctttttttgag

SEQ ID NO: 100113 - DNA, 20 bp, Artificial
  CRISPR gRNA sequence
ctttctttctttttttgaga

SEQ ID NO: 100114 - DNA, 20 bp, Artificial
  CRISPR gRNA sequence
tttctttctttttttgagat

SEQ ID NO: 100115 - DNA, 20 bp, Artificial
  CRISPR gRNA sequence
tctttctttttttgagatgg

SEQ ID NO: 100116 - DNA, 20 bp, Artificial
  CRISPR gRNA sequence
ctttctttttttgagatgga

SEQ ID NO: 100117 - DNA, 20 bp, Artificial
  CRISPR gRNA sequence
tttctttttttgagatggag

SEQ ID NO: 100118 - DNA, 20 bp, Artificial
  CRISPR gRNA sequence
tctttttttgagatggagtc

SEQ ID NO: 100119 - DNA, 20 bp, Artificial
  CRISPR gRNA sequence
ctttttttgagatggagtct

SEQ ID NO: 100120 - DNA, 20 bp, Artificial
  CRISPR gRNA sequence
tttttttgagatggagtctc

SEQ ID NO: 100121 - DNA, 20 bp, Artificial
  CRISPR gRNA sequence
tttttgagatggagtctcgc

SEQ ID NO: 100122 - DNA, 20 bp, Artificial
  CRISPR gRNA sequence
ttttgagatggagtctcgct

SEQ ID NO: 100123 - DNA, 20 bp, Artificial
  CRISPR gRNA sequence
tttgagatggagtctcgctc

SEQ ID NO: 100124 - DNA, 20 bp, Artificial
  CRISPR gRNA sequence
ttgagatggagtctcgctct

SEQ ID NO: 100125 - DNA, 20 bp, Artificial
  CRISPR gRNA sequence
tgagatggagtctcgctctg

SEQ ID NO: 100126 - DNA, 20 bp, Artificial
  CRISPR gRNA sequence
gagatggagtctcgctctgt

SEQ ID NO: 100127 - DNA, 20 bp, Artificial
  CRISPR gRNA sequence
agatggagtctcgctctgtc

SEQ ID NO: 100128 - DNA, 20 bp, Artificial
  CRISPR gRNA sequence
gctctgtcgcccaggctgga

SEQ ID NO: 100129 - DNA, 20 bp, Artificial
  CRISPR gRNA sequence
tgtcgcccaggctggagtgc

SEQ ID NO: 100130 - DNA, 20 bp, Artificial
  CRISPR gRNA sequence
tcgcccaggctggagtgcat

SEQ ID NO: 100131 - DNA, 20 bp, Artificial
  CRISPR gRNA sequence
gagtgcatggagtgcagtgg

SEQ ID NO: 100132 - DNA, 20 bp, Artificial
  CRISPR gRNA sequence
ggctcactgcaagctccacc

SEQ ID NO: 100133 - DNA, 20 bp, Artificial
  CRISPR gRNA sequence
gctcactgcaagctccacct

SEQ ID NO: 100134 - DNA, 20 bp, Artificial
  CRISPR gRNA sequence
actgcaagctccacctcccg

SEQ ID NO: 100135 - DNA, 20 bp, Artificial
  CRISPR gRNA sequence
caagctccacctcccgtgtt

SEQ ID NO: 100136 - DNA, 20 bp, Artificial
  CRISPR gRNA sequence
cacctcccgtgttcacgcca

SEQ ID NO: 100137 - DNA, 20 bp, Artificial
  CRISPR gRNA sequence
ccgtgttcacgccattctcc

SEQ ID NO: 100138 - DNA, 20 bp, Artificial
  CRISPR gRNA sequence
acgccattctcctgcttcag

SEQ ID NO: 100139 - DNA, 20 bp, Artificial
  CRISPR gRNA sequence
tcctgcttcagcctcccgag

SEQ ID NO: 100140 - DNA, 20 bp, Artificial
  CRISPR gRNA sequence
ctgcttcagcctcccgagta

SEQ ID NO: 100141 - DNA, 20 bp, Artificial
  CRISPR gRNA sequence
cttcagcctcccgagtagct

SEQ ID NO: 100142 - DNA, 20 bp, Artificial
  CRISPR gRNA sequence
cagcctcccgagtagctggg

SEQ ID NO: 100143 - DNA, 20 bp, Artificial
  CRISPR gRNA sequence
agcctcccgagtagctggga

SEQ ID NO: 100144 - DNA, 20 bp, Artificial
  CRISPR gRNA sequence
ccgagtagctgggactacag

SEQ ID NO: 100145 - DNA, 20 bp, Artificial
  CRISPR gRNA sequence
ggactacagtccgttttttt

SEQ ID NO: 100146 - DNA, 20 bp, Artificial
  CRISPR gRNA sequence
cagtccgttttttttttttt

SEQ ID NO: 100147 - DNA, 20 bp, Artificial
  CRISPR gRNA sequence
ttttttttttttttaaatgg

SEQ ID NO: 100148 - DNA, 20 bp, Artificial
  CRISPR gRNA sequence
tttttttttttttaaatgga

SEQ ID NO: 100149 - DNA, 20 bp, Artificial
  CRISPR gRNA sequence
ttttttttttttaaatggag

SEQ ID NO: 100150 - DNA, 20 bp, Artificial
  CRISPR gRNA sequence
tttttttttttaaatggagg

SEQ ID NO: 100151 - DNA, 20 bp, Artificial
  CRISPR gRNA sequence
ttttttttttaaatggaggt

SEQ ID NO: 100152 - DNA, 20 bp, Artificial
  CRISPR gRNA sequence
tttttttttaaatggaggtt

SEQ ID NO: 100153 - DNA, 20 bp, Artificial
  CRISPR gRNA sequence
ttttttttaaatggaggttt

SEQ ID NO: 100154 - DNA, 20 bp, Artificial
  CRISPR gRNA sequence
tttttttaaatggaggtttg

SEQ ID NO: 100155 - DNA, 20 bp, Artificial
  CRISPR gRNA sequence
ttttttaaatggaggtttgc

SEQ ID NO: 100156 - DNA, 20 bp, Artificial
  CRISPR gRNA sequence
tttttaaatggaggtttgct

SEQ ID NO: 100157 - DNA, 20 bp, Artificial
  CRISPR gRNA sequence
ttttaaatggaggtttgctt

SEQ ID NO: 100158 - DNA, 20 bp, Artificial
  CRISPR gRNA sequence
tttaaatggaggtttgcttt

SEQ ID NO: 100159 - DNA, 20 bp, Artificial
  CRISPR gRNA sequence
ttaaatggaggtttgctttt

SEQ ID NO: 100160 - DNA, 20 bp, Artificial
  CRISPR gRNA sequence
taaatggaggtttgcttttg

SEQ ID NO: 100161 - DNA, 20 bp, Artificial
  CRISPR gRNA sequence
aaatggaggtttgcttttgt

SEQ ID NO: 100162 - DNA, 20 bp, Artificial
  CRISPR gRNA sequence
aatggaggtttgcttttgtt

SEQ ID NO: 100163 - DNA, 20 bp, Artificial
  CRISPR gRNA sequence
gcttttgttgcccaggctcc

SEQ ID NO: 100164 - DNA, 20 bp, Artificial
  CRISPR gRNA sequence
cttttgttgcccaggctccc

SEQ ID NO: 100165 - DNA, 20 bp, Artificial
  CRISPR gRNA sequence
ttgttgcccaggctccctcc

SEQ ID NO: 100166 - DNA, 20 bp, Artificial
  CRISPR gRNA sequence
tgttgcccaggctccctccc

SEQ ID NO: 100167 - DNA, 20 bp, Artificial
  CRISPR gRNA sequence
gttgcccaggctccctcccc

SEQ ID NO: 100168 - DNA, 20 bp, Artificial
  CRISPR gRNA sequence
ttgcccaggctccctcccct

SEQ ID NO: 100169 - DNA, 20 bp, Artificial
  CRISPR gRNA sequence
cccaggctccctcccctccc

SEQ ID NO: 100170 - DNA, 20 bp, Artificial
  CRISPR gRNA sequence
cctcccctcccctcgcctcc

SEQ ID NO: 100171 - DNA, 20 bp, Artificial
  CRISPR gRNA sequence
ccctcccctcgcctcccctc

SEQ ID NO: 100172 - DNA, 20 bp, Artificial
  CRISPR gRNA sequence
ccctcgcctcccctcccctc

SEQ ID NO: 100173 - DNA, 20 bp, Artificial
  CRISPR gRNA sequence
gcctcccctcccctcctttc

SEQ ID NO: 100174 - DNA, 20 bp, Artificial
  CRISPR gRNA sequence
ccctcccctcctttcccctc

SEQ ID NO: 100175 - DNA, 20 bp, Artificial
  CRISPR gRNA sequence
ccctcctttcccctctcccc

SEQ ID NO: 100176 - DNA, 20 bp, Artificial
  CRISPR gRNA sequence
ctttcccctctccccactct

SEQ ID NO: 100177 - DNA, 20 bp, Artificial
  CRISPR gRNA sequence
tcccctctccccactctcga

SEQ ID NO: 100178 - DNA, 20 bp, Artificial
  CRISPR gRNA sequence
cccctctccccactctcgag

SEQ ID NO: 100179 - DNA, 20 bp, Artificial
  CRISPR gRNA sequence
ccctctccccactctcgaga

SEQ ID NO: 100180 - DNA, 20 bp, Artificial
  CRISPR gRNA sequence
tccccactctcgagacgcct

SEQ ID NO: 100181 - DNA, 20 bp, Artificial
  CRISPR gRNA sequence
cccactctcgagacgcctcc

SEQ ID NO: 100182 - DNA, 20 bp, Artificial
  CRISPR gRNA sequence
tcgagacgcctcctggatcc

SEQ ID NO: 100183 - DNA, 20 bp, Artificial
  CRISPR gRNA sequence
gagacgcctcctggatcccc

SEQ ID NO: 100184 - DNA, 20 bp, Artificial
  CRISPR gRNA sequence
ctggatcccctctcttcttg

SEQ ID NO: 100185 - DNA, 20 bp, Artificial
  CRISPR gRNA sequence
gatcccctctcttcttgaga

SEQ ID NO: 100186 - DNA, 20 bp, Artificial
  CRISPR gRNA sequence
tcttcttgagacagaatctt

SEQ ID NO: 100187 - DNA, 20 bp, Artificial
  CRISPR gRNA sequence
ttcttgagacagaatcttgc

SEQ ID NO: 100188 - DNA, 20 bp, Artificial
  CRISPR gRNA sequence
cttgagacagaatcttgctc

SEQ ID NO: 100189 - DNA, 20 bp, Artificial
  CRISPR gRNA sequence
ttgagacagaatcttgctct

SEQ ID NO: 100190 - DNA, 20 bp, Artificial
  CRISPR gRNA sequence
gagacagaatcttgctctgt

SEQ ID NO: 100191 - DNA, 20 bp, Artificial
  CRISPR gRNA sequence
agacagaatcttgctctgtt

SEQ ID NO: 100192 - DNA, 20 bp, Artificial
  CRISPR gRNA sequence
gctctgttgtccagggtgga

SEQ ID NO: 100193 - DNA, 20 bp, Artificial
  CRISPR gRNA sequence
ctctgttgtccagggtggag

SEQ ID NO: 100194 - DNA, 20 bp, Artificial
  CRISPR gRNA sequence
tgttgtccagggtggagtgc

SEQ ID NO: 100195 - DNA, 20 bp, Artificial
  CRISPR gRNA sequence
ttgtccagggtggagtgcag

SEQ ID NO: 100196 - DNA, 20 bp, Artificial
  CRISPR gRNA sequence
tccagggtggagtgcagtgg

SEQ ID NO: 100197 - DNA, 20 bp, Artificial
  CRISPR gRNA sequence
tcttgactcactgcaactcc

SEQ ID NO: 100198 - DNA, 20 bp, Artificial
  CRISPR gRNA sequence
gactcactgcaactccctct

SEQ ID NO: 100199 - DNA, 20 bp, Artificial
  CRISPR gRNA sequence
actcactgcaactccctctc

SEQ ID NO: 100200 - DNA, 20 bp, Artificial
  CRISPR gRNA sequence
actgcaactccctctcctgg

SEQ ID NO: 100201 - DNA, 20 bp, Artificial
  CRISPR gRNA sequence
caactccctctcctgggtta

SEQ ID NO: 100202 - DNA, 20 bp, Artificial
  CRISPR gRNA sequence
cctctcctgggttaaggtga

SEQ ID NO: 100203 - DNA, 20 bp, Artificial
  CRISPR gRNA sequence
tcctgggttaaggtgattct

SEQ ID NO: 100204 - DNA, 20 bp, Artificial
  CRISPR gRNA sequence
ctgggttaaggtgattctcc

SEQ ID NO: 100205 - DNA, 20 bp, Artificial
  CRISPR gRNA sequence
ggttaaggtgattctcctgc

SEQ ID NO: 100206 - DNA, 20 bp, Artificial
  CRISPR gRNA sequence
aggtgattctcctgcctcag

SEQ ID NO: 100207 - DNA, 20 bp, Artificial
  CRISPR gRNA sequence
tcctgcctcagcctcccaag

SEQ ID NO: 100208 - DNA, 20 bp, Artificial
  CRISPR gRNA sequence
ctgcctcagcctcccaagta

SEQ ID NO: 100209 - DNA, 20 bp, Artificial
  CRISPR gRNA sequence
cctcagcctcccaagtagct

SEQ ID NO: 100210 - DNA, 20 bp, Artificial
  CRISPR gRNA sequence
agcctcccaagtagctggca

SEQ ID NO: 100211 - DNA, 20 bp, Artificial
  CRISPR gRNA sequence
ccaagtagctggcatgcacc

SEQ ID NO: 100212 - DNA, 20 bp, Artificial
  CRISPR gRNA sequence
gcatgcaccaccacatccag

SEQ ID NO: 100213 - DNA, 20 bp, Artificial
  CRISPR gRNA sequence
atttttgtgtttttagtaga

SEQ ID NO: 100214 - DNA, 20 bp, Artificial
  CRISPR gRNA sequence
ttgtgtttttagtagagatg

SEQ ID NO: 100215 - DNA, 20 bp, Artificial
  CRISPR gRNA sequence
tgtgtttttagtagagatgg

SEQ ID NO: 100216 - DNA, 20 bp, Artificial
  CRISPR gRNA sequence
gtgtttttagtagagatgga

SEQ ID NO: 100217 - DNA, 20 bp, Artificial
  CRISPR gRNA sequence
tgtttttagtagagatggag

SEQ ID NO: 100218 - DNA, 20 bp, Artificial
  CRISPR gRNA sequence
ttagtagagatggagttttg

SEQ ID NO: 100219 - DNA, 20 bp, Artificial
  CRISPR gRNA sequence
tagtagagatggagttttgc

SEQ ID NO: 100220 - DNA, 20 bp, Artificial
  CRISPR gRNA sequence
agtagagatggagttttgcc

SEQ ID NO: 100221 - DNA, 20 bp, Artificial
  CRISPR gRNA sequence
gtagagatggagttttgcca

SEQ ID NO: 100222 - DNA, 20 bp, Artificial
  CRISPR gRNA sequence
tgccatgttgcccaggctgg

SEQ ID NO: 100223 - DNA, 20 bp, Artificial
  CRISPR gRNA sequence
gccatgttgcccaggctggt

SEQ ID NO: 100224 - DNA, 20 bp, Artificial
  CRISPR gRNA sequence
ccatgttgcccaggctggtc

SEQ ID NO: 100225 - DNA, 20 bp, Artificial
  CRISPR gRNA sequence
cccaggctggtctcgaactc

SEQ ID NO: 100226 - DNA, 20 bp, Artificial
  CRISPR gRNA sequence
gtctcgaactcctgacctca

SEQ ID NO: 100227 - DNA, 20 bp, Artificial
  CRISPR gRNA sequence
gaactcctgacctcaggtga

SEQ ID NO: 100228 - DNA, 20 bp, Artificial
  CRISPR gRNA sequence
ctgacctcaggtgattgccc

SEQ ID NO: 100229 - DNA, 20 bp, Artificial
  CRISPR gRNA sequence
acctcaggtgattgcccgcc

SEQ ID NO: 100230 - DNA, 20 bp, Artificial
  CRISPR gRNA sequence
aggtgattgcccgcctcggc

SEQ ID NO: 100231 - DNA, 20 bp, Artificial
  CRISPR gRNA sequence
cccgcctcggcctcccaaag

SEQ ID NO: 100232 - DNA, 20 bp, Artificial
  CRISPR gRNA sequence
ggcctcccaaagtgctggga

SEQ ID NO: 100233 - DNA, 20 bp, Artificial
  CRISPR gRNA sequence
ccaaagtgctgggattacag

SEQ ID NO: 100234 - DNA, 20 bp, Artificial
  CRISPR gRNA sequence
ggattacaggcgtgagccac

SEQ ID NO: 100235 - DNA, 20 bp, Artificial
  CRISPR gRNA sequence
caggcgtgagccaccgcgcc

SEQ ID NO: 100236 - DNA, 20 bp, Artificial
  CRISPR gRNA sequence
tagcggatttctttgacttc

SEQ ID NO: 100237 - DNA, 20 bp, Artificial
  CRISPR gRNA sequence
ctttgacttcctaagatctc

SEQ ID NO: 100238 - DNA, 20 bp, Artificial
  CRISPR gRNA sequence
tttgacttcctaagatctcg

SEQ ID NO: 100239 - DNA, 20 bp, Artificial
  CRISPR gRNA sequence
tgacttcctaagatctcggt

SEQ ID NO: 100240 - DNA, 20 bp, Artificial
  CRISPR gRNA sequence
gacttcctaagatctcggtg

SEQ ID NO: 100241 - DNA, 20 bp, Artificial
  CRISPR gRNA sequence
acttcctaagatctcggtgg

SEQ ID NO: 100242 - DNA, 20 bp, Artificial
  CRISPR gRNA sequence
cctaagatctcggtggtgtc

SEQ ID NO: 100243 - DNA, 20 bp, Artificial
  CRISPR gRNA sequence
ctaagatctcggtggtgtca

SEQ ID NO: 100244 - DNA, 20 bp, Artificial
  CRISPR gRNA sequence
agatctcggtggtgtcacct

SEQ ID NO: 100245 - DNA, 20 bp, Artificial
  CRISPR gRNA sequence
ggtggtgtcaccttggggag

SEQ ID NO: 100246 - DNA, 20 bp, Artificial
  CRISPR gRNA sequence
ggggaggccctcctgttacc

SEQ ID NO: 100247 - DNA, 20 bp, Artificial
  CRISPR gRNA sequence
gggaggccctcctgttacca

SEQ ID NO: 100248 - DNA, 20 bp, Artificial
  CRISPR gRNA sequence
ctgttaccaccttgtctaag

SEQ ID NO: 100249 - DNA, 20 bp, Artificial
  CRISPR gRNA sequence
ttaccaccttgtctaagaag

SEQ ID NO: 100250 - DNA, 20 bp, Artificial
  CRISPR gRNA sequence
ccaccttgtctaagaaggac

SEQ ID NO: 100251 - DNA, 20 bp, Artificial
  CRISPR gRNA sequence
gtctaagaaggacttattcc

SEQ ID NO: 100252 - DNA, 20 bp, Artificial
  CRISPR gRNA sequence
tctaagaaggacttattcct

SEQ ID NO: 100253 - DNA, 20 bp, Artificial
  CRISPR gRNA sequence
agaaggacttattccttgtg

SEQ ID NO: 100254 - DNA, 20 bp, Artificial
  CRISPR gRNA sequence
attccttgtgctccgttctt

SEQ ID NO: 100255 - DNA, 20 bp, Artificial
  CRISPR gRNA sequence
ttccttgtgctccgttcttt

SEQ ID NO: 100256 - DNA, 20 bp, Artificial
  CRISPR gRNA sequence
cttgtgctccgttcttttca

SEQ ID NO: 100257 - DNA, 20 bp, Artificial
  CRISPR gRNA sequence
gtgctccgttcttttcatcc

SEQ ID NO: 100258 - DNA, 20 bp, Artificial
  CRISPR gRNA sequence
tgctccgttcttttcatcct

SEQ ID NO: 100259 - DNA, 20 bp, Artificial
  CRISPR gRNA sequence
cgttcttttcatcctcttct

SEQ ID NO: 100260 - DNA, 20 bp, Artificial
  CRISPR gRNA sequence
ttttcatcctcttctacctg

SEQ ID NO: 100261 - DNA, 20 bp, Artificial
  CRISPR gRNA sequence
ttcatcctcttctacctgct

SEQ ID NO: 100262 - DNA, 20 bp, Artificial
  CRISPR gRNA sequence
tcatcctcttctacctgctt

SEQ ID NO: 100263 - DNA, 20 bp, Artificial
  CRISPR gRNA sequence
catcctcttctacctgcttt

SEQ ID NO: 100264 - DNA, 20 bp, Artificial
  CRISPR gRNA sequence
atcctcttctacctgctttt

SEQ ID NO: 100265 - DNA, 20 bp, Artificial
  CRISPR gRNA sequence
ttctacctgcttttaaattt

SEQ ID NO: 100266 - DNA, 20 bp, Artificial
  CRISPR gRNA sequence
ctacctgcttttaaattttt

SEQ ID NO: 100267 - DNA, 20 bp, Artificial
  CRISPR gRNA sequence
tacctgcttttaaatttttt

SEQ ID NO: 100268 - DNA, 20 bp, Artificial
  CRISPR gRNA sequence
cctgcttttaaatttttttt

SEQ ID NO: 100269 - DNA, 20 bp, Artificial
  CRISPR gRNA sequence
cttttaaatttttttttttt

SEQ ID NO: 100270 - DNA, 20 bp, Artificial
  CRISPR gRNA sequence
ttaaattttttttttttttt

SEQ ID NO: 100271 - DNA, 20 bp, Artificial
  CRISPR gRNA sequence
taaatttttttttttttttt

SEQ ID NO: 100272 - DNA, 20 bp, Artificial
  CRISPR gRNA sequence
aaattttttttttttttttt

SEQ ID NO: 100273 - DNA, 20 bp, Artificial
  CRISPR gRNA sequence
aatttttttttttttttttt

SEQ ID NO: 100274 - DNA, 20 bp, Artificial
  CRISPR gRNA sequence
tttttttttttttttttttt

SEQ ID NO: 100275 - DNA, 20 bp, Artificial
  CRISPR gRNA sequence
tttttttttttttttttttg

SEQ ID NO: 100276 - DNA, 20 bp, Artificial
  CRISPR gRNA sequence
ttttttttttttttttttga

SEQ ID NO: 100277 - DNA, 20 bp, Artificial
  CRISPR gRNA sequence
tttttttttttttttttgag

SEQ ID NO: 100278 - DNA, 20 bp, Artificial
  CRISPR gRNA sequence
ttttttttttttttttgaga

SEQ ID NO: 100279 - DNA, 20 bp, Artificial
  CRISPR gRNA sequence
tttttttttttttttgagat

SEQ ID NO: 100280 - DNA, 20 bp, Artificial
  CRISPR gRNA sequence
ttttttttttttttgagatg

SEQ ID NO: 100281 - DNA, 20 bp, Artificial
  CRISPR gRNA sequence
tttttttttttttgagatgg

SEQ ID NO: 100282 - DNA, 20 bp, Artificial
  CRISPR gRNA sequence
ttttttttttttgagatgga

SEQ ID NO: 100283 - DNA, 20 bp, Artificial
  CRISPR gRNA sequence
tttttttttttgagatggag

SEQ ID NO: 100284 - DNA, 20 bp, Artificial
  CRISPR gRNA sequence
ttttttttttgagatggagt

SEQ ID NO: 100285 - DNA, 20 bp, Artificial
  CRISPR gRNA sequence
tttttttttgagatggagtc

SEQ ID NO: 100286 - DNA, 20 bp, Artificial
  CRISPR gRNA sequence
ttttttttgagatggagtct

SEQ ID NO: 100287 - DNA, 20 bp, Artificial
  CRISPR gRNA sequence
tttttttgagatggagtctc

SEQ ID NO: 100288 - DNA, 20 bp, Artificial
  CRISPR gRNA sequence
ttttttgagatggagtctca

SEQ ID NO: 100289 - DNA, 20 bp, Artificial
  CRISPR gRNA sequence
tttttgagatggagtctcac

SEQ ID NO: 100290 - DNA, 20 bp, Artificial
  CRISPR gRNA sequence
ttttgagatggagtctcact

SEQ ID NO: 100291 - DNA, 20 bp, Artificial
  CRISPR gRNA sequence
tttgagatggagtctcactc

SEQ ID NO: 100292 - DNA, 20 bp, Artificial
  CRISPR gRNA sequence
ttgagatggagtctcactct

SEQ ID NO: 100293 - DNA, 20 bp, Artificial
  CRISPR gRNA sequence
tgagatggagtctcactctt

SEQ ID NO: 100294 - DNA, 20 bp, Artificial
  CRISPR gRNA sequence
gagatggagtctcactcttg

SEQ ID NO: 100295 - DNA, 20 bp, Artificial
  CRISPR gRNA sequence
agatggagtctcactcttgt

SEQ ID NO: 100296 - DNA, 20 bp, Artificial
  CRISPR gRNA sequence
actcttgttgcccaggctgg

SEQ ID NO: 100297 - DNA, 20 bp, Artificial
  CRISPR gRNA sequence
ttgttgcccaggctggagtg

SEQ ID NO: 100298 - DNA, 20 bp, Artificial
  CRISPR gRNA sequence
gttgcccaggctggagtgca

SEQ ID NO: 100299 - DNA, 20 bp, Artificial
  CRISPR gRNA sequence
ttgcccaggctggagtgcag

SEQ ID NO: 100300 - DNA, 20 bp, Artificial
  CRISPR gRNA sequence
cccaggctggagtgcagtgg

SEQ ID NO: 100301 - DNA, 20 bp, Artificial
  CRISPR gRNA sequence
gagtgcagtggcgtgatctc

SEQ ID NO: 100302 - DNA, 20 bp, Artificial
  CRISPR gRNA sequence
tctcactgcaacctccacct

SEQ ID NO: 100303 - DNA, 20 bp, Artificial
  CRISPR gRNA sequence
tcactgcaacctccacctcc

SEQ ID NO: 100304 - DNA, 20 bp, Artificial
  CRISPR gRNA sequence
actgcaacctccacctcctg

SEQ ID NO: 100305 - DNA, 20 bp, Artificial
  CRISPR gRNA sequence
caacctccacctcctggatt

SEQ ID NO: 100306 - DNA, 20 bp, Artificial
  CRISPR gRNA sequence
cacctcctggattcaagcga

SEQ ID NO: 100307 - DNA, 20 bp, Artificial
  CRISPR gRNA sequence
ctggattcaagcgattctcc

SEQ ID NO: 100308 - DNA, 20 bp, Artificial
  CRISPR gRNA sequence
gattcaagcgattctcctgc

SEQ ID NO: 100309 - DNA, 20 bp, Artificial
  CRISPR gRNA sequence
aagcgattctcctgcctcag

SEQ ID NO: 100310 - DNA, 20 bp, Artificial
  CRISPR gRNA sequence
tcctgcctcagcctcccgag

SEQ ID NO: 100311 - DNA, 20 bp, Artificial
  CRISPR gRNA sequence
ctgcctcagcctcccgagta

SEQ ID NO: 100312 - DNA, 20 bp, Artificial
  CRISPR gRNA sequence
cctcagcctcccgagtagct

SEQ ID NO: 100313 - DNA, 20 bp, Artificial
  CRISPR gRNA sequence
agcctcccgagtagctggga

SEQ ID NO: 100314 - DNA, 20 bp, Artificial
  CRISPR gRNA sequence
ccgagtagctgggattacag

SEQ ID NO: 100315 - DNA, 20 bp, Artificial
  CRISPR gRNA sequence
ggattacaggcatctgccac

SEQ ID NO: 100316 - DNA, 20 bp, Artificial
  CRISPR gRNA sequence
caggcatctgccaccatgca

SEQ ID NO: 100317 - DNA, 20 bp, Artificial
  CRISPR gRNA sequence
ccaccatgcatggctaattt

SEQ ID NO: 100318 - DNA, 20 bp, Artificial
  CRISPR gRNA sequence
attttgtgtttttagtagag

SEQ ID NO: 100319 - DNA, 20 bp, Artificial
  CRISPR gRNA sequence
tgtgtttttagtagaggtgg

SEQ ID NO: 100320 - DNA, 20 bp, Artificial
  CRISPR gRNA sequence
gtgtttttagtagaggtgga

SEQ ID NO: 100321 - DNA, 20 bp, Artificial
  CRISPR gRNA sequence
tgtttttagtagaggtggaa

SEQ ID NO: 100322 - DNA, 20 bp, Artificial
  CRISPR gRNA sequence
ttagtagaggtggaatttca

SEQ ID NO: 100323 - DNA, 20 bp, Artificial
  CRISPR gRNA sequence
tagtagaggtggaatttcac

SEQ ID NO: 100324 - DNA, 20 bp, Artificial
  CRISPR gRNA sequence
agtagaggtggaatttcacc

SEQ ID NO: 100325 - DNA, 20 bp, Artificial
  CRISPR gRNA sequence
gtagaggtggaatttcacca

SEQ ID NO: 100326 - DNA, 20 bp, Artificial
  CRISPR gRNA sequence
caccatgttagtcaggctgg

SEQ ID NO: 100327 - DNA, 20 bp, Artificial
  CRISPR gRNA sequence
accatgttagtcaggctggt

SEQ ID NO: 100328 - DNA, 20 bp, Artificial
  CRISPR gRNA sequence
gtcaggctggtctcaaactc

SEQ ID NO: 100329 - DNA, 20 bp, Artificial
  CRISPR gRNA sequence
gtctcaaactcctgacctca

SEQ ID NO: 100330 - DNA, 20 bp, Artificial
  CRISPR gRNA sequence
aaactcctgacctcaggtga

SEQ ID NO: 100331 - DNA, 20 bp, Artificial
  CRISPR gRNA sequence
ctgacctcaggtgatccacc

SEQ ID NO: 100332 - DNA, 20 bp, Artificial
  CRISPR gRNA sequence
acctcaggtgatccacccac

SEQ ID NO: 100333 - DNA, 20 bp, Artificial
  CRISPR gRNA sequence
aggtgatccacccacctcag

SEQ ID NO: 100334 - DNA, 20 bp, Artificial
  CRISPR gRNA sequence
agcctcccaaagtgctggga

SEQ ID NO: 100335 - DNA, 20 bp, Artificial
  CRISPR gRNA sequence
ccaaagtgctgggattacag

SEQ ID NO: 100336 - DNA, 20 bp, Artificial
  CRISPR gRNA sequence
ggattacaggcatgagccac

SEQ ID NO: 100337 - DNA, 20 bp, Artificial
  CRISPR gRNA sequence
caggcatgagccactgtgcc

SEQ ID NO: 100338 - DNA, 20 bp, Artificial
  CRISPR gRNA sequence
tgcccggccttaagttcttt

SEQ ID NO: 100339 - DNA, 20 bp, Artificial
  CRISPR gRNA sequence
aagttcttttgaacacttat

SEQ ID NO: 100340 - DNA, 20 bp, Artificial
  CRISPR gRNA sequence
agttcttttgaacacttatt

SEQ ID NO: 100341 - DNA, 20 bp, Artificial
  CRISPR gRNA sequence
ttttgaacacttatttcaac

SEQ ID NO: 100342 - DNA, 20 bp, Artificial
  CRISPR gRNA sequence
ttgaacacttatttcaactt

SEQ ID NO: 100343 - DNA, 20 bp, Artificial
  CRISPR gRNA sequence
tgaacacttatttcaacttg

SEQ ID NO: 100344 - DNA, 20 bp, Artificial
  CRISPR gRNA sequence
gaacacttatttcaacttga

SEQ ID NO: 100345 - DNA, 20 bp, Artificial
  CRISPR gRNA sequence
aacacttatttcaacttgaa

SEQ ID NO: 100346 - DNA, 20 bp, Artificial
  CRISPR gRNA sequence
atttcaacttgaagtttttt

SEQ ID NO: 100347 - DNA, 20 bp, Artificial
  CRISPR gRNA sequence
tttcaacttgaagtttttta

SEQ ID NO: 100348 - DNA, 20 bp, Artificial
  CRISPR gRNA sequence
caacttgaagttttttatta

SEQ ID NO: 100349 - DNA, 20 bp, Artificial
  CRISPR gRNA sequence
aacttgaagttttttattat

SEQ ID NO: 100350 - DNA, 20 bp, Artificial
  CRISPR gRNA sequence
gaagttttttattatttctc

SEQ ID NO: 100351 - DNA, 20 bp, Artificial
  CRISPR gRNA sequence
aagttttttattatttctct

SEQ ID NO: 100352 - DNA, 20 bp, Artificial
  CRISPR gRNA sequence
tttattatttctctatgtct

SEQ ID NO: 100353 - DNA, 20 bp, Artificial
  CRISPR gRNA sequence
ttattatttctctatgtctg

SEQ ID NO: 100354 - DNA, 20 bp, Artificial
  CRISPR gRNA sequence
tattatttctctatgtctga

SEQ ID NO: 100355 - DNA, 20 bp, Artificial
  CRISPR gRNA sequence
attatttctctatgtctgat

SEQ ID NO: 100356 - DNA, 20 bp, Artificial
  CRISPR gRNA sequence
ttatttctctatgtctgatg

SEQ ID NO: 100357 - DNA, 20 bp, Artificial
  CRISPR gRNA sequence
tttctctatgtctgatgcac

SEQ ID NO: 100358 - DNA, 20 bp, Artificial
  CRISPR gRNA sequence
ctctatgtctgatgcaccta

SEQ ID NO: 100359 - DNA, 20 bp, Artificial
  CRISPR gRNA sequence
tctatgtctgatgcacctac

SEQ ID NO: 100360 - DNA, 20 bp, Artificial
  CRISPR gRNA sequence
tatgtctgatgcacctactt

SEQ ID NO: 100361 - DNA, 20 bp, Artificial
  CRISPR gRNA sequence
tgtctgatgcacctacttga

SEQ ID NO: 100362 - DNA, 20 bp, Artificial
  CRISPR gRNA sequence
atgcacctacttgacccccg

SEQ ID NO: 100363 - DNA, 20 bp, Artificial
  CRISPR gRNA sequence
cttgacccccgactccctag

SEQ ID NO: 100364 - DNA, 20 bp, Artificial
  CRISPR gRNA sequence
gacccccgactccctagagg

SEQ ID NO: 100365 - DNA, 20 bp, Artificial
  CRISPR gRNA sequence
acccccgactccctagaggg

SEQ ID NO: 100366 - DNA, 20 bp, Artificial
  CRISPR gRNA sequence
cctagagggcaaaaactatg

SEQ ID NO: 100367 - DNA, 20 bp, Artificial
  CRISPR gRNA sequence
gagggcaaaaactatgtctt

SEQ ID NO: 100368 - DNA, 20 bp, Artificial
  CRISPR gRNA sequence
tgtcttgtttgctcagaaca

SEQ ID NO: 100369 - DNA, 20 bp, Artificial
  CRISPR gRNA sequence
gtttgctcagaacattgcca

SEQ ID NO: 100370 - DNA, 20 bp, Artificial
  CRISPR gRNA sequence
tttgctcagaacattgccag

SEQ ID NO: 100371 - DNA, 20 bp, Artificial
  CRISPR gRNA sequence
gctcagaacattgccaggca

SEQ ID NO: 100372 - DNA, 20 bp, Artificial
  CRISPR gRNA sequence
ctcagaacattgccaggcag

SEQ ID NO: 100373 - DNA, 20 bp, Artificial
  CRISPR gRNA sequence
agaacattgccaggcaggga

SEQ ID NO: 100374 - DNA, 20 bp, Artificial
  CRISPR gRNA sequence
ccaggcagggaggagaaaga

SEQ ID NO: 100375 - DNA, 20 bp, Artificial
  CRISPR gRNA sequence
ggtattcaagagagtagagt

SEQ ID NO: 100376 - DNA, 20 bp, Artificial
  CRISPR gRNA sequence
aagagagtagagtgagtgaa

SEQ ID NO: 100377 - DNA, 20 bp, Artificial
  CRISPR gRNA sequence
cctttggtagctccaagacc

SEQ ID NO: 100378 - DNA, 20 bp, Artificial
  CRISPR gRNA sequence
tggtagctccaagaccccag

SEQ ID NO: 100379 - DNA, 20 bp, Artificial
  CRISPR gRNA sequence
ggtagctccaagaccccagg

SEQ ID NO: 100380 - DNA, 20 bp, Artificial
  CRISPR gRNA sequence
gtagctccaagaccccaggg

SEQ ID NO: 100381 - DNA, 20 bp, Artificial
  CRISPR gRNA sequence
caagaccccagggagatacc

SEQ ID NO: 100382 - DNA, 20 bp, Artificial
  CRISPR gRNA sequence
atgcctgtaatcccagcact

SEQ ID NO: 100383 - DNA, 20 bp, Artificial
  CRISPR gRNA sequence
taatcccagcactttgggag

SEQ ID NO: 100384 - DNA, 20 bp, Artificial
  CRISPR gRNA sequence
tgggaggccacggcaggaga

SEQ ID NO: 100385 - DNA, 20 bp, Artificial
  CRISPR gRNA sequence
gggaggccacggcaggagaa

SEQ ID NO: 100386 - DNA, 20 bp, Artificial
  CRISPR gRNA sequence
ggaggccacggcaggagaat

SEQ ID NO: 100387 - DNA, 20 bp, Artificial
  CRISPR gRNA sequence
cttgagcccaggagtttgag

SEQ ID NO: 100388 - DNA, 20 bp, Artificial
  CRISPR gRNA sequence
gagcccaggagtttgagacc

SEQ ID NO: 100389 - DNA, 20 bp, Artificial
  CRISPR gRNA sequence
agcccaggagtttgagacca

SEQ ID NO: 100390 - DNA, 20 bp, Artificial
  CRISPR gRNA sequence
gagaccagcctgggcgacag

SEQ ID NO: 100391 - DNA, 20 bp, Artificial
  CRISPR gRNA sequence
agaccagcctgggcgacaga

SEQ ID NO: 100392 - DNA, 20 bp, Artificial
  CRISPR gRNA sequence
ggcgacagagcaagactcca

SEQ ID NO: 100393 - DNA, 20 bp, Artificial
  CRISPR gRNA sequence
catctctaccaatatatata

SEQ ID NO: 100394 - DNA, 20 bp, Artificial
  CRISPR gRNA sequence
taccaatatatatatatttt

SEQ ID NO: 100395 - DNA, 20 bp, Artificial
  CRISPR gRNA sequence
ccaatatatatatattttta

SEQ ID NO: 100396 - DNA, 20 bp, Artificial
  CRISPR gRNA sequence
ttaatttgctgggtatggtg

SEQ ID NO: 100397 - DNA, 20 bp, Artificial
  CRISPR gRNA sequence
taatttgctgggtatggtgg

SEQ ID NO: 100398 - DNA, 20 bp, Artificial
  CRISPR gRNA sequence
aatttgctgggtatggtggc

SEQ ID NO: 100399 - DNA, 20 bp, Artificial
  CRISPR gRNA sequence
atttgctgggtatggtggca

SEQ ID NO: 100400 - DNA, 20 bp, Artificial
  CRISPR gRNA sequence
gctgggtatggtggcacctg

SEQ ID NO: 100401 - DNA, 20 bp, Artificial
  CRISPR gRNA sequence
ctgggtatggtggcacctgt

SEQ ID NO: 100402 - DNA, 20 bp, Artificial
  CRISPR gRNA sequence
ggtatggtggcacctgtagt

SEQ ID NO: 100403 - DNA, 20 bp, Artificial
  CRISPR gRNA sequence
tagtttcagctgctcaggag

SEQ ID NO: 100404 - DNA, 20 bp, Artificial
  CRISPR gRNA sequence
cagctgctcaggaggctgag

SEQ ID NO: 100405 - DNA, 20 bp, Artificial
  CRISPR gRNA sequence
agctgctcaggaggctgagg

SEQ ID NO: 100406 - DNA, 20 bp, Artificial
  CRISPR gRNA sequence
ctcaggaggctgaggtggga

SEQ ID NO: 100407 - DNA, 20 bp, Artificial
  CRISPR gRNA sequence
aggaggctgaggtgggaggt

SEQ ID NO: 100408 - DNA, 20 bp, Artificial
  CRISPR gRNA sequence
aggtgggaggttggcttgag

SEQ ID NO: 100409 - DNA, 20 bp, Artificial
  CRISPR gRNA sequence
gcttgagcccaggaggttga

SEQ ID NO: 100410 - DNA, 20 bp, Artificial
  CRISPR gRNA sequence
gagcccaggaggttgaggct

SEQ ID NO: 100411 - DNA, 20 bp, Artificial
  CRISPR gRNA sequence
agcccaggaggttgaggctg

SEQ ID NO: 100412 - DNA, 20 bp, Artificial
  CRISPR gRNA sequence
aggctgaagtgaactgtgat

SEQ ID NO: 100413 - DNA, 20 bp, Artificial
  CRISPR gRNA sequence
aagtgaactgtgatcacacc

SEQ ID NO: 100414 - DNA, 20 bp, Artificial
  CRISPR gRNA sequence
tgatcacaccaccgcactcc

SEQ ID NO: 100415 - DNA, 20 bp, Artificial
  CRISPR gRNA sequence
cagcctggacaacagagcaa

SEQ ID NO: 100416 - DNA, 20 bp, Artificial
  CRISPR gRNA sequence
gacaacagagcaagactctg

SEQ ID NO: 100417 - DNA, 20 bp, Artificial
  CRISPR gRNA sequence
tgtctcaaaaaaaaaaaaaa

SEQ ID NO: 100418 - DNA, 20 bp, Artificial
  CRISPR gRNA sequence
tctcaaaaaaaaaaaaaacc

SEQ ID NO: 100419 - DNA, 20 bp, Artificial
  CRISPR gRNA sequence
aaaaaaaaaaaaaaccccaa

SEQ ID NO: 100420 - DNA, 20 bp, Artificial
  CRISPR gRNA sequence
ggtgtggtggctcatgccta

SEQ ID NO: 100421 - DNA, 20 bp, Artificial
  CRISPR gRNA sequence
atgcctataatcccagcact

SEQ ID NO: 100422 - DNA, 20 bp, Artificial
  CRISPR gRNA sequence
taatcccagcactttgggag

SEQ ID NO: 100423 - DNA, 20 bp, Artificial
  CRISPR gRNA sequence
tgggaggctgaggcaggtgg

SEQ ID NO: 100424 - DNA, 20 bp, Artificial
  CRISPR gRNA sequence
gggaggctgaggcaggtgga

SEQ ID NO: 100425 - DNA, 20 bp, Artificial
  CRISPR gRNA sequence
ggaggctgaggcaggtggat

SEQ ID NO: 100426 - DNA, 20 bp, Artificial
  CRISPR gRNA sequence
aggcaggtggatgatttgag

SEQ ID NO: 100427 - DNA, 20 bp, Artificial
  CRISPR gRNA sequence
gaggtcaggagtttgaaatt

SEQ ID NO: 100428 - DNA, 20 bp, Artificial
  CRISPR gRNA sequence
aggtcaggagtttgaaatta

SEQ ID NO: 100429 - DNA, 20 bp, Artificial
  CRISPR gRNA sequence
gaaattagcctggccaacat

SEQ ID NO: 100430 - DNA, 20 bp, Artificial
  CRISPR gRNA sequence
aaattagcctggccaacata

SEQ ID NO: 100431 - DNA, 20 bp, Artificial
  CRISPR gRNA sequence
gcctggccaacatagcgaaa

SEQ ID NO: 100432 - DNA, 20 bp, Artificial
  CRISPR gRNA sequence
gccaacatagcgaaaccccg

SEQ ID NO: 100433 - DNA, 20 bp, Artificial
  CRISPR gRNA sequence
tacttaaaatacaaaaatta

SEQ ID NO: 100434 - DNA, 20 bp, Artificial
  CRISPR gRNA sequence
cttaaaatacaaaaattagc

SEQ ID NO: 100435 - DNA, 20 bp, Artificial
  CRISPR gRNA sequence
aaaatacaaaaattagccag

SEQ ID NO: 100436 - DNA, 20 bp, Artificial
  CRISPR gRNA sequence
aaatacaaaaattagccagg

SEQ ID NO: 100437 - DNA, 20 bp, Artificial
  CRISPR gRNA sequence
gccaggtgtggtggtgggcg

SEQ ID NO: 100438 - DNA, 20 bp, Artificial
  CRISPR gRNA sequence
tgatcccagctactcgggag

SEQ ID NO: 100439 - DNA, 20 bp, Artificial
  CRISPR gRNA sequence
ctcgggaggctgaggcacaa

SEQ ID NO: 100440 - DNA, 20 bp, Artificial
  CRISPR gRNA sequence
gggaggctgaggcacaagaa

SEQ ID NO: 100441 - DNA, 20 bp, Artificial
  CRISPR gRNA sequence
aggcacaagaatcgcttgaa

SEQ ID NO: 100442 - DNA, 20 bp, Artificial
  CRISPR gRNA sequence
gaacccaggaggcagaggtt

SEQ ID NO: 100443 - DNA, 20 bp, Artificial
  CRISPR gRNA sequence
aacccaggaggcagaggttg

SEQ ID NO: 100444 - DNA, 20 bp, Artificial
  CRISPR gRNA sequence
cagtgagccgagatcacgcc

SEQ ID NO: 100445 - DNA, 20 bp, Artificial
  CRISPR gRNA sequence
tactccagcctgggggacag

SEQ ID NO: 100446 - DNA, 20 bp, Artificial
  CRISPR gRNA sequence
cagcctgggggacagacgga

SEQ ID NO: 100447 - DNA, 20 bp, Artificial
  CRISPR gRNA sequence
ggggacagacggagactcca

SEQ ID NO: 100448 - DNA, 20 bp, Artificial
  CRISPR gRNA sequence
catctcaaacaacaacagca

SEQ ID NO: 100449 - DNA, 20 bp, Artificial
  CRISPR gRNA sequence
aaacaacaacagcaacaaaa

SEQ ID NO: 100450 - DNA, 20 bp, Artificial
  CRISPR gRNA sequence
ctgtcctgaagcctcagaga

SEQ ID NO: 100451 - DNA, 20 bp, Artificial
  CRISPR gRNA sequence
tgtcctgaagcctcagagac

SEQ ID NO: 100452 - DNA, 20 bp, Artificial
  CRISPR gRNA sequence
tcctgaagcctcagagacat

SEQ ID NO: 100453 - DNA, 20 bp, Artificial
  CRISPR gRNA sequence
aagcctcagagacatctact

SEQ ID NO: 100454 - DNA, 20 bp, Artificial
  CRISPR gRNA sequence
agagacatctactgagggga

SEQ ID NO: 100455 - DNA, 20 bp, Artificial
  CRISPR gRNA sequence
ctgaggggaaactgacgcct

SEQ ID NO: 100456 - DNA, 20 bp, Artificial
  CRISPR gRNA sequence
aggggaaactgacgcctgtt

SEQ ID NO: 100457 - DNA, 20 bp, Artificial
  CRISPR gRNA sequence
acgcctgttgtctgtttccc

SEQ ID NO: 100458 - DNA, 20 bp, Artificial
  CRISPR gRNA sequence
ttgtctgtttcccagcaggc

SEQ ID NO: 100459 - DNA, 20 bp, Artificial
  CRISPR gRNA sequence
tctgtttcccagcaggcagc

SEQ ID NO: 100460 - DNA, 20 bp, Artificial
  CRISPR gRNA sequence
tttcccagcaggcagctccc

SEQ ID NO: 100461 - DNA, 20 bp, Artificial
  CRISPR gRNA sequence
cccagcaggcagctccctga

SEQ ID NO: 100462 - DNA, 20 bp, Artificial
  CRISPR gRNA sequence
ccagcaggcagctccctgaa

SEQ ID NO: 100463 - DNA, 20 bp, Artificial
  CRISPR gRNA sequence
cctgaagcactccaccactc

SEQ ID NO: 100464 - DNA, 20 bp, Artificial
  CRISPR gRNA sequence
aagcactccaccactctcac

SEQ ID NO: 100465 - DNA, 20 bp, Artificial
  CRISPR gRNA sequence
caccactctcaccaaccggc

SEQ ID NO: 100466 - DNA, 20 bp, Artificial
  CRISPR gRNA sequence
tcaccaaccggcagcgaggg

SEQ ID NO: 100467 - DNA, 20 bp, Artificial
  CRISPR gRNA sequence
accaaccggcagcgagggaa

SEQ ID NO: 100468 - DNA, 20 bp, Artificial
  CRISPR gRNA sequence
tgccggccaccctagactgt

SEQ ID NO: 100469 - DNA, 20 bp, Artificial
  CRISPR gRNA sequence
ccggccaccctagactgtga

SEQ ID NO: 100470 - DNA, 20 bp, Artificial
  CRISPR gRNA sequence
gactgtgagtgggcccacgg

SEQ ID NO: 100471 - DNA, 20 bp, Artificial
  CRISPR gRNA sequence
tgagtgggcccacggtcccc

SEQ ID NO: 100472 - DNA, 20 bp, Artificial
  CRISPR gRNA sequence
tgaggagcaatcgtggacag

SEQ ID NO: 100473 - DNA, 20 bp, Artificial
  CRISPR gRNA sequence
aggcacagagaagcaagggg

SEQ ID NO: 100474 - DNA, 20 bp, Artificial
  CRISPR gRNA sequence
tgcctctgtcctgccccagc

SEQ ID NO: 100475 - DNA, 20 bp, Artificial
  CRISPR gRNA sequence
cctctgtcctgccccagccc

SEQ ID NO: 100476 - DNA, 20 bp, Artificial
  CRISPR gRNA sequence
tgtcctgccccagccctgtc

SEQ ID NO: 100477 - DNA, 20 bp, Artificial
  CRISPR gRNA sequence
tcctgccccagccctgtcca

SEQ ID NO: 100478 - DNA, 20 bp, Artificial
  CRISPR gRNA sequence
ccccagccctgtccatccac

SEQ ID NO: 100479 - DNA, 20 bp, Artificial
  CRISPR gRNA sequence
tccatccaccagctcgcagc

SEQ ID NO: 100480 - DNA, 20 bp, Artificial
  CRISPR gRNA sequence
gcagcacagggggagctgga

SEQ ID NO: 100481 - DNA, 20 bp, Artificial
  CRISPR gRNA sequence
gaccagctgaaggagcattt

SEQ ID NO: 100482 - DNA, 20 bp, Artificial
  CRISPR gRNA sequence
aaggagcatttgcggaaagg

SEQ ID NO: 100483 - DNA, 20 bp, Artificial
  CRISPR gRNA sequence
gcggaaaggtgcgtgtccac

SEQ ID NO: 100484 - DNA, 20 bp, Artificial
  CRISPR gRNA sequence
cggaaaggtgcgtgtccaca

SEQ ID NO: 100485 - DNA, 20 bp, Artificial
  CRISPR gRNA sequence
gcatgtctgcacctggctgg

SEQ ID NO: 100486 - DNA, 20 bp, Artificial
  CRISPR gRNA sequence
cacctggctggtgtgtgcat

SEQ ID NO: 100487 - DNA, 20 bp, Artificial
  CRISPR gRNA sequence
gctggtgtgtgcatatgggt

SEQ ID NO: 100488 - DNA, 20 bp, Artificial
  CRISPR gRNA sequence
gtgtgtgcatatgggtgtcc

SEQ ID NO: 100489 - DNA, 20 bp, Artificial
  CRISPR gRNA sequence
atgacgtgacctgtgagtgt

SEQ ID NO: 100490 - DNA, 20 bp, Artificial
  CRISPR gRNA sequence
tgagtgtccacgtgtatgat

SEQ ID NO: 100491 - DNA, 20 bp, Artificial
  CRISPR gRNA sequence
tatctaactgtgtgtgtgac

SEQ ID NO: 100492 - DNA, 20 bp, Artificial
  CRISPR gRNA sequence
actgtgtgtgtgaccgtgtt

SEQ ID NO: 100493 - DNA, 20 bp, Artificial
  CRISPR gRNA sequence
tgtgtgtgaccgtgttcatg

SEQ ID NO: 100494 - DNA, 20 bp, Artificial
  CRISPR gRNA sequence
atgtatgtccatcaacatac

SEQ ID NO: 100495 - DNA, 20 bp, Artificial
  CRISPR gRNA sequence
cccctcattcccctgtctaa

SEQ ID NO: 100496 - DNA, 20 bp, Artificial
  CRISPR gRNA sequence
attcccctgtctaaccccag

SEQ ID NO: 100497 - DNA, 20 bp, Artificial
  CRISPR gRNA sequence
ccctgtctaaccccagcccc

SEQ ID NO: 100498 - DNA, 20 bp, Artificial
  CRISPR gRNA sequence
tctaaccccagccccccacc

SEQ ID NO: 100499 - DNA, 20 bp, Artificial
  CRISPR gRNA sequence
accccagccccccacctcgt

SEQ ID NO: 100500 - DNA, 20 bp, Artificial
  CRISPR gRNA sequence
gtccccatttggcagcactg

SEQ ID NO: 100501 - DNA, 20 bp, Artificial
  CRISPR gRNA sequence
ggcagcactggggatagggg

SEQ ID NO: 100502 - DNA, 20 bp, Artificial
  CRISPR gRNA sequence
gcagcactggggataggggg

SEQ ID NO: 100503 - DNA, 20 bp, Artificial
  CRISPR gRNA sequence
gggatagggggcaggggtgc

SEQ ID NO: 100504 - DNA, 20 bp, Artificial
  CRISPR gRNA sequence
gtggtattgcccgcctcctc

SEQ ID NO: 100505 - DNA, 20 bp, Artificial
  CRISPR gRNA sequence
cccgcctcctcctgccaggt

SEQ ID NO: 100506 - DNA, 20 bp, Artificial
  CRISPR gRNA sequence
ctcctgccaggtgacaacct

SEQ ID NO: 100507 - DNA, 20 bp, Artificial
  CRISPR gRNA sequence
ctgccaggtgacaacctcgt

SEQ ID NO: 100508 - DNA, 20 bp, Artificial
  CRISPR gRNA sequence
ccaggtgacaacctcgtcaa

SEQ ID NO: 100509 - DNA, 20 bp, Artificial
  CRISPR gRNA sequence
gtcaacaagccagacgagcg

SEQ ID NO: 100510 - DNA, 20 bp, Artificial
  CRISPR gRNA sequence
cacccccctcatctgggcct

SEQ ID NO: 100511 - DNA, 20 bp, Artificial
  CRISPR gRNA sequence
acccccctcatctgggcctc

SEQ ID NO: 100512 - DNA, 20 bp, Artificial
  CRISPR gRNA sequence
atctgggcctccgcctttgg

SEQ ID NO: 100513 - DNA, 20 bp, Artificial
  CRISPR gRNA sequence
ggcctccgcctttggagaga

SEQ ID NO: 100514 - DNA, 20 bp, Artificial
  CRISPR gRNA sequence
cgcctttggagagattgaga

SEQ ID NO: 100515 - DNA, 20 bp, Artificial
  CRISPR gRNA sequence
tggagagattgagaccgttc

SEQ ID NO: 100516 - DNA, 20 bp, Artificial
  CRISPR gRNA sequence
ggagagattgagaccgttcg

SEQ ID NO: 100517 - DNA, 20 bp, Artificial
  CRISPR gRNA sequence
gagagattgagaccgttcgc

SEQ ID NO: 100518 - DNA, 20 bp, Artificial
  CRISPR gRNA sequence
agaccgttcgcttcctgctg

SEQ ID NO: 100519 - DNA, 20 bp, Artificial
  CRISPR gRNA sequence
gcttcctgctggagtgggtg

SEQ ID NO: 100520 - DNA, 20 bp, Artificial
  CRISPR gRNA sequence
cctgctggagtgggtgcgtc

SEQ ID NO: 100521 - DNA, 20 bp, Artificial
  CRISPR gRNA sequence
ctgctggagtgggtgcgtcc

SEQ ID NO: 100522 - DNA, 20 bp, Artificial
  CRISPR gRNA sequence
ctggagtgggtgcgtcccag

SEQ ID NO: 100523 - DNA, 20 bp, Artificial
  CRISPR gRNA sequence
gagtgggtgcgtcccagccc

SEQ ID NO: 100524 - DNA, 20 bp, Artificial
  CRISPR gRNA sequence
ggcagctggggggttcccgg

SEQ ID NO: 100525 - DNA, 20 bp, Artificial
  CRISPR gRNA sequence
gggggttcccgggggcctta

SEQ ID NO: 100526 - DNA, 20 bp, Artificial
  CRISPR gRNA sequence
ccgggggccttagggtgggc

SEQ ID NO: 100527 - DNA, 20 bp, Artificial
  CRISPR gRNA sequence
agggtgggctggggttttgg

SEQ ID NO: 100528 - DNA, 20 bp, Artificial
  CRISPR gRNA sequence
gggtgggctggggttttggc

SEQ ID NO: 100529 - DNA, 20 bp, Artificial
  CRISPR gRNA sequence
gggttttggctgtgtctgct

SEQ ID NO: 100530 - DNA, 20 bp, Artificial
  CRISPR gRNA sequence
tggctgtgtctgctggcgcc

SEQ ID NO: 100531 - DNA, 20 bp, Artificial
  CRISPR gRNA sequence
ggctgtgtctgctggcgcct

SEQ ID NO: 100532 - DNA, 20 bp, Artificial
  CRISPR gRNA sequence
gctgtgtctgctggcgcctt

SEQ ID NO: 100533 - DNA, 20 bp, Artificial
  CRISPR gRNA sequence
tgtctgctggcgccttgtct

SEQ ID NO: 100534 - DNA, 20 bp, Artificial
  CRISPR gRNA sequence
ctggcgccttgtctttgaga

SEQ ID NO: 100535 - DNA, 20 bp, Artificial
  CRISPR gRNA sequence
gcgccttgtctttgagatgc

SEQ ID NO: 100536 - DNA, 20 bp, Artificial
  CRISPR gRNA sequence
gtctttgagatgcggctgct

SEQ ID NO: 100537 - DNA, 20 bp, Artificial
  CRISPR gRNA sequence
tctttgagatgcggctgctg

SEQ ID NO: 100538 - DNA, 20 bp, Artificial
  CRISPR gRNA sequence
tgagatgcggctgctggctg

SEQ ID NO: 100539 - DNA, 20 bp, Artificial
  CRISPR gRNA sequence
gagatgcggctgctggctgg

SEQ ID NO: 100540 - DNA, 20 bp, Artificial
  CRISPR gRNA sequence
agatgcggctgctggctggg

SEQ ID NO: 100541 - DNA, 20 bp, Artificial
  CRISPR gRNA sequence
ctggctgggtgcagtggctc

SEQ ID NO: 100542 - DNA, 20 bp, Artificial
  CRISPR gRNA sequence
gctgggtgcagtggctcatg

SEQ ID NO: 100543 - DNA, 20 bp, Artificial
  CRISPR gRNA sequence
ggtgcagtggctcatgcctg

SEQ ID NO: 100544 - DNA, 20 bp, Artificial
  CRISPR gRNA sequence
atgcctgtaatcccagcact

SEQ ID NO: 100545 - DNA, 20 bp, Artificial
  CRISPR gRNA sequence
taatcccagcactttgggag

SEQ ID NO: 100546 - DNA, 20 bp, Artificial
  CRISPR gRNA sequence
tgggaggccgaggcgggtgg

SEQ ID NO: 100547 - DNA, 20 bp, Artificial
  CRISPR gRNA sequence
gggaggccgaggcgggtgga

SEQ ID NO: 100548 - DNA, 20 bp, Artificial
  CRISPR gRNA sequence
ggaggccgaggcgggtggat

SEQ ID NO: 100549 - DNA, 20 bp, Artificial
  CRISPR gRNA sequence
gaggtcaggagttcaagacc

SEQ ID NO: 100550 - DNA, 20 bp, Artificial
  CRISPR gRNA sequence
aggtcaggagttcaagacca

SEQ ID NO: 100551 - DNA, 20 bp, Artificial
  CRISPR gRNA sequence
aagaccagcccggccaacat

SEQ ID NO: 100552 - DNA, 20 bp, Artificial
  CRISPR gRNA sequence
tctctactaaaaaaatacaa

SEQ ID NO: 100553 - DNA, 20 bp, Artificial
  CRISPR gRNA sequence
tactaaaaaaatacaaaaat

SEQ ID NO: 100554 - DNA, 20 bp, Artificial
  CRISPR gRNA sequence
ctaaaaaaatacaaaaatta

SEQ ID NO: 100555 - DNA, 20 bp, Artificial
  CRISPR gRNA sequence
aaaaaatacaaaaattagcc

SEQ ID NO: 100556 - DNA, 20 bp, Artificial
  CRISPR gRNA sequence
gccaggcgtcgtggtgggtg

SEQ ID NO: 100557 - DNA, 20 bp, Artificial
  CRISPR gRNA sequence
taatcccaggtactctggag

SEQ ID NO: 100558 - DNA, 20 bp, Artificial
  CRISPR gRNA sequence
tggaggctgaggtgggagaa

SEQ ID NO: 100559 - DNA, 20 bp, Artificial
  CRISPR gRNA sequence
gaggctgaggtgggagaact

SEQ ID NO: 100560 - DNA, 20 bp, Artificial
  CRISPR gRNA sequence
aggtgggagaactgtgtgaa

SEQ ID NO: 100561 - DNA, 20 bp, Artificial
  CRISPR gRNA sequence
tgtgaacctgggaggcggag

SEQ ID NO: 100562 - DNA, 20 bp, Artificial
  CRISPR gRNA sequence
ggaggcggaggtagcagtga

SEQ ID NO: 100563 - DNA, 20 bp, Artificial
  CRISPR gRNA sequence
cgccactgcactccagcctg

SEQ ID NO: 100564 - DNA, 20 bp, Artificial
  CRISPR gRNA sequence
cactccagcctgggcaacag

SEQ ID NO: 100565 - DNA, 20 bp, Artificial
  CRISPR gRNA sequence
cagcctgggcaacagagcaa

SEQ ID NO: 100566 - DNA, 20 bp, Artificial
  CRISPR gRNA sequence
ggcaacagagcaagactcta

SEQ ID NO: 100567 - DNA, 20 bp, Artificial
  CRISPR gRNA sequence
tatctccaaaaaaaaaaaaa

SEQ ID NO: 100568 - DNA, 20 bp, Artificial
  CRISPR gRNA sequence
tctccaaaaaaaaaaaaaaa

SEQ ID NO: 100569 - DNA, 20 bp, Artificial
  CRISPR gRNA sequence
caaaaaaaaaaaaaaagatg

SEQ ID NO: 100570 - DNA, 20 bp, Artificial
  CRISPR gRNA sequence
ctgtgggtaccccaggattc

SEQ ID NO: 100571 - DNA, 20 bp, Artificial
  CRISPR gRNA sequence
tgggtaccccaggattcctg

SEQ ID NO: 100572 - DNA, 20 bp, Artificial
  CRISPR gRNA sequence
ctggttatgccccaatccat

SEQ ID NO: 100573 - DNA, 20 bp, Artificial
  CRISPR gRNA sequence
gttatgccccaatccatcct

SEQ ID NO: 100574 - DNA, 20 bp, Artificial
  CRISPR gRNA sequence
tgccccaatccatcctacca

SEQ ID NO: 100575 - DNA, 20 bp, Artificial
  CRISPR gRNA sequence
ccactgtcccttcttctccc

SEQ ID NO: 100576 - DNA, 20 bp, Artificial
  CRISPR gRNA sequence
tcccttcttctccctgcagg

SEQ ID NO: 100577 - DNA, 20 bp, Artificial
  CRISPR gRNA sequence
cttctccctgcagggtgccg

SEQ ID NO: 100578 - DNA, 20 bp, Artificial
  CRISPR gRNA sequence
ttctccctgcagggtgccga

SEQ ID NO: 100579 - DNA, 20 bp, Artificial
  CRISPR gRNA sequence
ctccctgcagggtgccgacc

SEQ ID NO: 100580 - DNA, 20 bp, Artificial
  CRISPR gRNA sequence
tccctgcagggtgccgaccc

SEQ ID NO: 100581 - DNA, 20 bp, Artificial
  CRISPR gRNA sequence
cctgcagggtgccgaccccc

SEQ ID NO: 100582 - DNA, 20 bp, Artificial
  CRISPR gRNA sequence
cagggtgccgacccccacat

SEQ ID NO: 100583 - DNA, 20 bp, Artificial
  CRISPR gRNA sequence
gcaaaagagcgagagagcgc

SEQ ID NO: 100584 - DNA, 20 bp, Artificial
  CRISPR gRNA sequence
tcgctggccagcacaggcgg

SEQ ID NO: 100585 - DNA, 20 bp, Artificial
  CRISPR gRNA sequence
gccagcacaggcggctacac

SEQ ID NO: 100586 - DNA, 20 bp, Artificial
  CRISPR gRNA sequence
cacagacattgtggggctgc

SEQ ID NO: 100587 - DNA, 20 bp, Artificial
  CRISPR gRNA sequence
tggggctgctgctggagcgt

SEQ ID NO: 100588 - DNA, 20 bp, Artificial
  CRISPR gRNA sequence
ctgctggagcgtgacgtgga

SEQ ID NO: 100589 - DNA, 20 bp, Artificial
  CRISPR gRNA sequence
ctggagcgtgacgtggacat

SEQ ID NO: 100590 - DNA, 20 bp, Artificial
  CRISPR gRNA sequence
gagcgtgacgtggacatcaa

SEQ ID NO: 100591 - DNA, 20 bp, Artificial
  CRISPR gRNA sequence
tgattgggtgagggactgcc

SEQ ID NO: 100592 - DNA, 20 bp, Artificial
  CRISPR gRNA sequence
ggtgagggactgcccatccc

SEQ ID NO: 100593 - DNA, 20 bp, Artificial
  CRISPR gRNA sequence
cccatccccaggacctctca

SEQ ID NO: 100594 - DNA, 20 bp, Artificial
  CRISPR gRNA sequence
tcagcctcctggccttcatt

SEQ ID NO: 100595 - DNA, 20 bp, Artificial
  CRISPR gRNA sequence
agcctcctggccttcattcc

SEQ ID NO: 100596 - DNA, 20 bp, Artificial
  CRISPR gRNA sequence
ctggccttcattcctgcctc

SEQ ID NO: 100597 - DNA, 20 bp, Artificial
  CRISPR gRNA sequence
gccttcattcctgcctcaaa

SEQ ID NO: 100598 - DNA, 20 bp, Artificial
  CRISPR gRNA sequence
cattcctgcctcaaatgttc

SEQ ID NO: 100599 - DNA, 20 bp, Artificial
  CRISPR gRNA sequence
attcctgcctcaaatgttca

SEQ ID NO: 100600 - DNA, 20 bp, Artificial
  CRISPR gRNA sequence
ctgcctcaaatgttcacaga

SEQ ID NO: 100601 - DNA, 20 bp, Artificial
  CRISPR gRNA sequence
cctcaaatgttcacagagta

SEQ ID NO: 100602 - DNA, 20 bp, Artificial
  CRISPR gRNA sequence
aaatgttcacagagtacttg

SEQ ID NO: 100603 - DNA, 20 bp, Artificial
  CRISPR gRNA sequence
acagagtacttgaaaggtgc

SEQ ID NO: 100604 - DNA, 20 bp, Artificial
  CRISPR gRNA sequence
gaaaggtgcaggcctgctct

SEQ ID NO: 100605 - DNA, 20 bp, Artificial
  CRISPR gRNA sequence
aaaggtgcaggcctgctcta

SEQ ID NO: 100606 - DNA, 20 bp, Artificial
  CRISPR gRNA sequence
ctctaggtgccgagaacacg

SEQ ID NO: 100607 - DNA, 20 bp, Artificial
  CRISPR gRNA sequence
taggtgccgagaacacgaga

SEQ ID NO: 100608 - DNA, 20 bp, Artificial
  CRISPR gRNA sequence
ggtgccgagaacacgagaca

SEQ ID NO: 100609 - DNA, 20 bp, Artificial
  CRISPR gRNA sequence
ccagcctcacagagcagagc

SEQ ID NO: 100610 - DNA, 20 bp, Artificial
  CRISPR gRNA sequence
acagagcagagctccccatg

SEQ ID NO: 100611 - DNA, 20 bp, Artificial
  CRISPR gRNA sequence
cccatgcagggaaggcagac

SEQ ID NO: 100612 - DNA, 20 bp, Artificial
  CRISPR gRNA sequence
agatgcagtgaactgcgctg

SEQ ID NO: 100613 - DNA, 20 bp, Artificial
  CRISPR gRNA sequence
cgctgcgatggcagatgcac

SEQ ID NO: 100614 - DNA, 20 bp, Artificial
  CRISPR gRNA sequence
cgatggcagatgcacaggtg

SEQ ID NO: 100615 - DNA, 20 bp, Artificial
  CRISPR gRNA sequence
caagagccccatgtgggcaa

SEQ ID NO: 100616 - DNA, 20 bp, Artificial
  CRISPR gRNA sequence
cctggaggaaggtgtctaag

SEQ ID NO: 100617 - DNA, 20 bp, Artificial
  CRISPR gRNA sequence
ctggaggaaggtgtctaagc

SEQ ID NO: 100618 - DNA, 20 bp, Artificial
  CRISPR gRNA sequence
gaggaaggtgtctaagcttg

SEQ ID NO: 100619 - DNA, 20 bp, Artificial
  CRISPR gRNA sequence
agcttgagaccccagaaagt

SEQ ID NO: 100620 - DNA, 20 bp, Artificial
  CRISPR gRNA sequence
gagaccccagaaagtgagat

SEQ ID NO: 100621 - DNA, 20 bp, Artificial
  CRISPR gRNA sequence
agaccccagaaagtgagatg

SEQ ID NO: 100622 - DNA, 20 bp, Artificial
  CRISPR gRNA sequence
aactggaggccagagagtac

SEQ ID NO: 100623 - DNA, 20 bp, Artificial
  CRISPR gRNA sequence
gaggccagagagtacaaggc

SEQ ID NO: 100624 - DNA, 20 bp, Artificial
  CRISPR gRNA sequence
tgagaatgaggaagaggtaa

SEQ ID NO: 100625 - DNA, 20 bp, Artificial
  CRISPR gRNA sequence
gagaatgaggaagaggtaaa

SEQ ID NO: 100626 - DNA, 20 bp, Artificial
  CRISPR gRNA sequence
agaatgaggaagaggtaaac

SEQ ID NO: 100627 - DNA, 20 bp, Artificial
  CRISPR gRNA sequence
tggtttctcctgcccctacc

SEQ ID NO: 100628 - DNA, 20 bp, Artificial
  CRISPR gRNA sequence
ggtttctcctgcccctaccc

SEQ ID NO: 100629 - DNA, 20 bp, Artificial
  CRISPR gRNA sequence
gtttctcctgcccctaccca

SEQ ID NO: 100630 - DNA, 20 bp, Artificial
  CRISPR gRNA sequence
ctcctgcccctacccacgac

SEQ ID NO: 100631 - DNA, 20 bp, Artificial
  CRISPR gRNA sequence
tcctgcccctacccacgaca

SEQ ID NO: 100632 - DNA, 20 bp, Artificial
  CRISPR gRNA sequence
ctgcccctacccacgacaga

SEQ ID NO: 100633 - DNA, 20 bp, Artificial
  CRISPR gRNA sequence
cccctacccacgacagaatg

SEQ ID NO: 100634 - DNA, 20 bp, Artificial
  CRISPR gRNA sequence
cccacgacagaatggaggga

SEQ ID NO: 100635 - DNA, 20 bp, Artificial
  CRISPR gRNA sequence
ctgtacgctgtgcgcgggaa

SEQ ID NO: 100636 - DNA, 20 bp, Artificial
  CRISPR gRNA sequence
tacgctgtgcgcgggaacca

SEQ ID NO: 100637 - DNA, 20 bp, Artificial
  CRISPR gRNA sequence
tgcgcgggaaccacgtgaaa

SEQ ID NO: 100638 - DNA, 20 bp, Artificial
  CRISPR gRNA sequence
aggccttgctgggtgagtgg

SEQ ID NO: 100639 - DNA, 20 bp, Artificial
  CRISPR gRNA sequence
gctgggtgagtgggagtcgg

SEQ ID NO: 100640 - DNA, 20 bp, Artificial
  CRISPR gRNA sequence
ctgggtgagtgggagtcggg

SEQ ID NO: 100641 - DNA, 20 bp, Artificial
  CRISPR gRNA sequence
ggtgagtgggagtcgggagt

SEQ ID NO: 100642 - DNA, 20 bp, Artificial
  CRISPR gRNA sequence
ggggccccagcactccagcg

SEQ ID NO: 100643 - DNA, 20 bp, Artificial
  CRISPR gRNA sequence
cagcgggccctgcgggaatc

SEQ ID NO: 100644 - DNA, 20 bp, Artificial
  CRISPR gRNA sequence
cgggaatcctgagggcaggg

SEQ ID NO: 100645 - DNA, 20 bp, Artificial
  CRISPR gRNA sequence
agggcagggagacgcccaag

SEQ ID NO: 100646 - DNA, 20 bp, Artificial
  CRISPR gRNA sequence
cttgaagagttcttggagca

SEQ ID NO: 100647 - DNA, 20 bp, Artificial
  CRISPR gRNA sequence
gaagagttcttggagcaggt

SEQ ID NO: 100648 - DNA, 20 bp, Artificial
  CRISPR gRNA sequence
aagagttcttggagcaggta

SEQ ID NO: 100649 - DNA, 20 bp, Artificial
  CRISPR gRNA sequence
ttggagcaggtagtccctgc

SEQ ID NO: 100650 - DNA, 20 bp, Artificial
  CRISPR gRNA sequence
ggagcaggtagtccctgcct

SEQ ID NO: 100651 - DNA, 20 bp, Artificial
  CRISPR gRNA sequence
gagcaggtagtccctgcctg

SEQ ID NO: 100652 - DNA, 20 bp, Artificial
  CRISPR gRNA sequence
cctgctcttctcggaggatg

SEQ ID NO: 100653 - DNA, 20 bp, Artificial
  CRISPR gRNA sequence
ctcttctcggaggatggatc

SEQ ID NO: 100654 - DNA, 20 bp, Artificial
  CRISPR gRNA sequence
ttctcggaggatggatcaga

SEQ ID NO: 100655 - DNA, 20 bp, Artificial
  CRISPR gRNA sequence
ctcggaggatggatcagagg

SEQ ID NO: 100656 - DNA, 20 bp, Artificial
  CRISPR gRNA sequence
tcggaggatggatcagaggg

SEQ ID NO: 100657 - DNA, 20 bp, Artificial
  CRISPR gRNA sequence
ggaggatggatcagagggga

SEQ ID NO: 100658 - DNA, 20 bp, Artificial
  CRISPR gRNA sequence
ggtttaggatctggccaaga

SEQ ID NO: 100659 - DNA, 20 bp, Artificial
  CRISPR gRNA sequence
aggatctggccaagaggcta

SEQ ID NO: 100660 - DNA, 20 bp, Artificial
  CRISPR gRNA sequence
ggatctggccaagaggctaa

SEQ ID NO: 100661 - DNA, 20 bp, Artificial
  CRISPR gRNA sequence
gccaagaggctaagcacctc

SEQ ID NO: 100662 - DNA, 20 bp, Artificial
  CRISPR gRNA sequence
agcacctccatcctccatgg

SEQ ID NO: 100663 - DNA, 20 bp, Artificial
  CRISPR gRNA sequence
catcctccatggttcagaga

SEQ ID NO: 100664 - DNA, 20 bp, Artificial
  CRISPR gRNA sequence
catggttcagagacccttca

SEQ ID NO: 100665 - DNA, 20 bp, Artificial
  CRISPR gRNA sequence
agagacccttcagccacgtt

SEQ ID NO: 100666 - DNA, 20 bp, Artificial
  CRISPR gRNA sequence
cagccacgttcttcagtgga

SEQ ID NO: 100667 - DNA, 20 bp, Artificial
  CRISPR gRNA sequence
agccacgttcttcagtggag

SEQ ID NO: 100668 - DNA, 20 bp, Artificial
  CRISPR gRNA sequence
ttcagtggagaccaagatag

SEQ ID NO: 100669 - DNA, 20 bp, Artificial
  CRISPR gRNA sequence
cagtggagaccaagatagca

SEQ ID NO: 100670 - DNA, 20 bp, Artificial
  CRISPR gRNA sequence
agtggagaccaagatagcag

SEQ ID NO: 100671 - DNA, 20 bp, Artificial
  CRISPR gRNA sequence
gacccttgtcaaaggccaca

SEQ ID NO: 100672 - DNA, 20 bp, Artificial
  CRISPR gRNA sequence
gtcaaaggccacatgggcaa

SEQ ID NO: 100673 - DNA, 20 bp, Artificial
  CRISPR gRNA sequence
tcaaaggccacatgggcaac

SEQ ID NO: 100674 - DNA, 20 bp, Artificial
  CRISPR gRNA sequence
cattgtggggaatgaggggt

SEQ ID NO: 100675 - DNA, 20 bp, Artificial
  CRISPR gRNA sequence
tggggaatgaggggtgccat

SEQ ID NO: 100676 - DNA, 20 bp, Artificial
  CRISPR gRNA sequence
ccaggtccccagaccccatt

SEQ ID NO: 100677 - DNA, 20 bp, Artificial
  CRISPR gRNA sequence
tggactcccaggccccaccc

SEQ ID NO: 100678 - DNA, 20 bp, Artificial
  CRISPR gRNA sequence
gactcccaggccccaccctc

SEQ ID NO: 100679 - DNA, 20 bp, Artificial
  CRISPR gRNA sequence
ccaggccccaccctccagcg

SEQ ID NO: 100680 - DNA, 20 bp, Artificial
  CRISPR gRNA sequence
cagcgccctcccctctcctt

SEQ ID NO: 100681 - DNA, 20 bp, Artificial
  CRISPR gRNA sequence
ccctctcctttgcagcccga

SEQ ID NO: 100682 - DNA, 20 bp, Artificial
  CRISPR gRNA sequence
tcctttgcagcccgaggcgc

SEQ ID NO: 100683 - DNA, 20 bp, Artificial
  CRISPR gRNA sequence
ctttgcagcccgaggcgctg

SEQ ID NO: 100684 - DNA, 20 bp, Artificial
  CRISPR gRNA sequence
tgcagcccgaggcgctgacc

SEQ ID NO: 100685 - DNA, 20 bp, Artificial
  CRISPR gRNA sequence
gcagcccgaggcgctgacct

SEQ ID NO: 100686 - DNA, 20 bp, Artificial
  CRISPR gRNA sequence
cagcccgaggcgctgacctc

SEQ ID NO: 100687 - DNA, 20 bp, Artificial
  CRISPR gRNA sequence
acctcaccaccgaagccgac

SEQ ID NO: 100688 - DNA, 20 bp, Artificial
  CRISPR gRNA sequence
accaccgaagccgactctgg

SEQ ID NO: 100689 - DNA, 20 bp, Artificial
  CRISPR gRNA sequence
tggctacaccccgatggacc

SEQ ID NO: 100690 - DNA, 20 bp, Artificial
  CRISPR gRNA sequence
gctacaccccgatggacctt

SEQ ID NO: 100691 - DNA, 20 bp, Artificial
  CRISPR gRNA sequence
caccccgatggaccttgccg

SEQ ID NO: 100692 - DNA, 20 bp, Artificial
  CRISPR gRNA sequence
gccgtggccctgggataccg

SEQ ID NO: 100693 - DNA, 20 bp, Artificial
  CRISPR gRNA sequence
ccgtggccctgggataccgg

SEQ ID NO: 100694 - DNA, 20 bp, Artificial
  CRISPR gRNA sequence
ggataccggaaaggtcagcc

SEQ ID NO: 100695 - DNA, 20 bp, Artificial
  CRISPR gRNA sequence
agacacacagagcaggggtg

SEQ ID NO: 100696 - DNA, 20 bp, Artificial
  CRISPR gRNA sequence
ccataggcagggtgaccata

SEQ ID NO: 100697 - DNA, 20 bp, Artificial
  CRISPR gRNA sequence
cataggcagggtgaccataa

SEQ ID NO: 100698 - DNA, 20 bp, Artificial
  CRISPR gRNA sequence
cagtggtcatacgccggcag

SEQ ID NO: 100699 - DNA, 20 bp, Artificial
  CRISPR gRNA sequence
agtggtcatacgccggcagc

SEQ ID NO: 100700 - DNA, 20 bp, Artificial
  CRISPR gRNA sequence
acaggtgttgagcactgctg

SEQ ID NO: 100701 - DNA, 20 bp, Artificial
  CRISPR gRNA sequence
agcactgctgtgtatcccgc

SEQ ID NO: 100702 - DNA, 20 bp, Artificial
  CRISPR gRNA sequence
ctgtgtatcccgcctgggaa

SEQ ID NO: 100703 - DNA, 20 bp, Artificial
  CRISPR gRNA sequence
tgtatcccgcctgggaacat

SEQ ID NO: 100704 - DNA, 20 bp, Artificial
  CRISPR gRNA sequence
ggaacatcccagtcctggct

SEQ ID NO: 100705 - DNA, 20 bp, Artificial
  CRISPR gRNA sequence
gctcctggggctccacatgt

SEQ ID NO: 100706 - DNA, 20 bp, Artificial
  CRISPR gRNA sequence
ctggggctccacatgtgctg

SEQ ID NO: 100707 - DNA, 20 bp, Artificial
  CRISPR gRNA sequence
gggctccacatgtgctgggg

SEQ ID NO: 100708 - DNA, 20 bp, Artificial
  CRISPR gRNA sequence
cacatgtgctggggtaggga

SEQ ID NO: 100709 - DNA, 20 bp, Artificial
  CRISPR gRNA sequence
gggtagggaggacaatgggt

SEQ ID NO: 100710 - DNA, 20 bp, Artificial
  CRISPR gRNA sequence
tggccatgatgggggacaca

SEQ ID NO: 100711 - DNA, 20 bp, Artificial
  CRISPR gRNA sequence
tcatcaaagagccccaaagt

SEQ ID NO: 100712 - DNA, 20 bp, Artificial
  CRISPR gRNA sequence
atcaaagagccccaaagtgg

SEQ ID NO: 100713 - DNA, 20 bp, Artificial
  CRISPR gRNA sequence
cctggaggaaggtgtcttaa

SEQ ID NO: 100714 - DNA, 20 bp, Artificial
  CRISPR gRNA sequence
ctggaggaaggtgtcttaag

SEQ ID NO: 100715 - DNA, 20 bp, Artificial
  CRISPR gRNA sequence
gaggaaggtgtcttaaggtt

SEQ ID NO: 100716 - DNA, 20 bp, Artificial
  CRISPR gRNA sequence
aaggttgagaccccgagaag

SEQ ID NO: 100717 - DNA, 20 bp, Artificial
  CRISPR gRNA sequence
aggttgagaccccgagaagt

SEQ ID NO: 100718 - DNA, 20 bp, Artificial
  CRISPR gRNA sequence
agaccccgagaagtgaggtg

SEQ ID NO: 100719 - DNA, 20 bp, Artificial
  CRISPR gRNA sequence
ggatggggaggtcagggaag

SEQ ID NO: 100720 - DNA, 20 bp, Artificial
  CRISPR gRNA sequence
tgggggacctgaagggaggg

SEQ ID NO: 100721 - DNA, 20 bp, Artificial
  CRISPR gRNA sequence
ggggacctgaagggagggag

SEQ ID NO: 100722 - DNA, 20 bp, Artificial
  CRISPR gRNA sequence
aagggagggagaatggcatc

SEQ ID NO: 100723 - DNA, 20 bp, Artificial
  CRISPR gRNA sequence
cggaggcctggcagtgagga

SEQ ID NO: 100724 - DNA, 20 bp, Artificial
  CRISPR gRNA sequence
gcagtgaggacaccaagggg

SEQ ID NO: 100725 - DNA, 20 bp, Artificial
  CRISPR gRNA sequence
tccgtggcgggcagtgggtt

SEQ ID NO: 100726 - DNA, 20 bp, Artificial
  CRISPR gRNA sequence
cgtggcgggcagtgggtttg

SEQ ID NO: 100727 - DNA, 20 bp, Artificial
  CRISPR gRNA sequence
gaacaggggccataggcaga

SEQ ID NO: 100728 - DNA, 20 bp, Artificial
  CRISPR gRNA sequence
aacaggggccataggcagac

SEQ ID NO: 100729 - DNA, 20 bp, Artificial
  CRISPR gRNA sequence
gactccattttctctgtcac

SEQ ID NO: 100730 - DNA, 20 bp, Artificial
  CRISPR gRNA sequence
actccattttctctgtcaca

SEQ ID NO: 100731 - DNA, 20 bp, Artificial
  CRISPR gRNA sequence
cattttctctgtcacaatgg

SEQ ID NO: 100732 - DNA, 20 bp, Artificial
  CRISPR gRNA sequence
tctctgtcacaatgggaccc

SEQ ID NO: 100733 - DNA, 20 bp, Artificial
  CRISPR gRNA sequence
ctctgtcacaatgggacccc

SEQ ID NO: 100734 - DNA, 20 bp, Artificial
  CRISPR gRNA sequence
tctgtcacaatgggacccca

SEQ ID NO: 100735 - DNA, 20 bp, Artificial
  CRISPR gRNA sequence
tgtcacaatgggaccccaac

SEQ ID NO: 100736 - DNA, 20 bp, Artificial
  CRISPR gRNA sequence
tcacaatgggaccccaactt

SEQ ID NO: 100737 - DNA, 20 bp, Artificial
  CRISPR gRNA sequence
ccccatccataaaatgggga

SEQ ID NO: 100738 - DNA, 20 bp, Artificial
  CRISPR gRNA sequence
cccatccataaaatggggag

SEQ ID NO: 100739 - DNA, 20 bp, Artificial
  CRISPR gRNA sequence
aaccgaccccctggggtcat

SEQ ID NO: 100740 - DNA, 20 bp, Artificial
  CRISPR gRNA sequence
gggtcatggtagagatgggg

SEQ ID NO: 100741 - DNA, 20 bp, Artificial
  CRISPR gRNA sequence
aggaaatatccccctccttc

SEQ ID NO: 100742 - DNA, 20 bp, Artificial
  CRISPR gRNA sequence
ggaaatatccccctccttcc

SEQ ID NO: 100743 - DNA, 20 bp, Artificial
  CRISPR gRNA sequence
cttccttcagagttttactg

SEQ ID NO: 100744 - DNA, 20 bp, Artificial
  CRISPR gRNA sequence
ccttcagagttttactgtgt

SEQ ID NO: 100745 - DNA, 20 bp, Artificial
  CRISPR gRNA sequence
cttcagagttttactgtgtt

SEQ ID NO: 100746 - DNA, 20 bp, Artificial
  CRISPR gRNA sequence
cagagttttactgtgtttgg

SEQ ID NO: 100747 - DNA, 20 bp, Artificial
  CRISPR gRNA sequence
agagttttactgtgtttggg

SEQ ID NO: 100748 - DNA, 20 bp, Artificial
  CRISPR gRNA sequence
tactgtgtttgggacagaaa

SEQ ID NO: 100749 - DNA, 20 bp, Artificial
  CRISPR gRNA sequence
actgtgtttgggacagaaat

SEQ ID NO: 100750 - DNA, 20 bp, Artificial
  CRISPR gRNA sequence
ctgtgtttgggacagaaatc

SEQ ID NO: 100751 - DNA, 20 bp, Artificial
  CRISPR gRNA sequence
tgtttgggacagaaatcatt

SEQ ID NO: 100752 - DNA, 20 bp, Artificial
  CRISPR gRNA sequence
gggacagaaatcattcctct

SEQ ID NO: 100753 - DNA, 20 bp, Artificial
  CRISPR gRNA sequence
ggacagaaatcattcctctt

SEQ ID NO: 100754 - DNA, 20 bp, Artificial
  CRISPR gRNA sequence
ctcttccctcctcatgtttt

SEQ ID NO: 100755 - DNA, 20 bp, Artificial
  CRISPR gRNA sequence
ttccctcctcatgttttcgg

SEQ ID NO: 100756 - DNA, 20 bp, Artificial
  CRISPR gRNA sequence
ccctcctcatgttttcgggg

SEQ ID NO: 100757 - DNA, 20 bp, Artificial
  CRISPR gRNA sequence
cctcctcatgttttcggggg

SEQ ID NO: 100758 - DNA, 20 bp, Artificial
  CRISPR gRNA sequence
ctcatgttttcggggggttt

SEQ ID NO: 100759 - DNA, 20 bp, Artificial
  CRISPR gRNA sequence
atgttttcggggggtttgtt

SEQ ID NO: 100760 - DNA, 20 bp, Artificial
  CRISPR gRNA sequence
tcggggggtttgtttttttg

SEQ ID NO: 100761 - DNA, 20 bp, Artificial
  CRISPR gRNA sequence
cggggggtttgtttttttgt

SEQ ID NO: 100762 - DNA, 20 bp, Artificial
  CRISPR gRNA sequence
ggggggtttgtttttttgtt

SEQ ID NO: 100763 - DNA, 20 bp, Artificial
  CRISPR gRNA sequence
gtttttttgttcgaggcaga

SEQ ID NO: 100764 - DNA, 20 bp, Artificial
  CRISPR gRNA sequence
tttttttgttcgaggcagaa

SEQ ID NO: 100765 - DNA, 20 bp, Artificial
  CRISPR gRNA sequence
ttttgttcgaggcagaaagt

SEQ ID NO: 100766 - DNA, 20 bp, Artificial
  CRISPR gRNA sequence
tttgttcgaggcagaaagtc

SEQ ID NO: 100767 - DNA, 20 bp, Artificial
  CRISPR gRNA sequence
ttgttcgaggcagaaagtct

SEQ ID NO: 100768 - DNA, 20 bp, Artificial
  CRISPR gRNA sequence
tgttcgaggcagaaagtctt

SEQ ID NO: 100769 - DNA, 20 bp, Artificial
  CRISPR gRNA sequence
gttcgaggcagaaagtcttg

SEQ ID NO: 100770 - DNA, 20 bp, Artificial
  CRISPR gRNA sequence
ttcgaggcagaaagtcttgc

SEQ ID NO: 100771 - DNA, 20 bp, Artificial
  CRISPR gRNA sequence
gaggcagaaagtcttgctct

SEQ ID NO: 100772 - DNA, 20 bp, Artificial
  CRISPR gRNA sequence
gctctatcacccaggctgga

SEQ ID NO: 100773 - DNA, 20 bp, Artificial
  CRISPR gRNA sequence
ctctatcacccaggctggaa

SEQ ID NO: 100774 - DNA, 20 bp, Artificial
  CRISPR gRNA sequence
tatcacccaggctggaatga

SEQ ID NO: 100775 - DNA, 20 bp, Artificial
  CRISPR gRNA sequence
tcacccaggctggaatgaag

SEQ ID NO: 100776 - DNA, 20 bp, Artificial
  CRISPR gRNA sequence
gaatgaagtggtgcaggcac

SEQ ID NO: 100777 - DNA, 20 bp, Artificial
  CRISPR gRNA sequence
actgcagcctcgatctccca

SEQ ID NO: 100778 - DNA, 20 bp, Artificial
  CRISPR gRNA sequence
ctgcagcctcgatctcccag

SEQ ID NO: 100779 - DNA, 20 bp, Artificial
  CRISPR gRNA sequence
cagcctcgatctcccaggct

SEQ ID NO: 100780 - DNA, 20 bp, Artificial
  CRISPR gRNA sequence
gatctcccaggctcaagtga

SEQ ID NO: 100781 - DNA, 20 bp, Artificial
  CRISPR gRNA sequence
ccaggctcaagtgatcctcc

SEQ ID NO: 100782 - DNA, 20 bp, Artificial
  CRISPR gRNA sequence
aagtgatcctcccaccacag

SEQ ID NO: 100783 - DNA, 20 bp, Artificial
  CRISPR gRNA sequence
ccaccacagcctcccgagta

SEQ ID NO: 100784 - DNA, 20 bp, Artificial
  CRISPR gRNA sequence
ccgagtagctgggaccacag

SEQ ID NO: 100785 - DNA, 20 bp, Artificial
  CRISPR gRNA sequence
ggaccacaggcattcgtcac

SEQ ID NO: 100786 - DNA, 20 bp, Artificial
  CRISPR gRNA sequence
gtcaccatgcctggctaatt

SEQ ID NO: 100787 - DNA, 20 bp, Artificial
  CRISPR gRNA sequence
gctaattttttgttgttgct

SEQ ID NO: 100788 - DNA, 20 bp, Artificial
  CRISPR gRNA sequence
attttttgttgttgcttttt

SEQ ID NO: 100789 - DNA, 20 bp, Artificial
  CRISPR gRNA sequence
tttgttgttgcttttttttt

SEQ ID NO: 100790 - DNA, 20 bp, Artificial
  CRISPR gRNA sequence
ttgttgttgctttttttttt

SEQ ID NO: 100791 - DNA, 20 bp, Artificial
  CRISPR gRNA sequence
tgttgttgcttttttttttt

SEQ ID NO: 100792 - DNA, 20 bp, Artificial
  CRISPR gRNA sequence
gttgttgctttttttttttt

SEQ ID NO: 100793 - DNA, 20 bp, Artificial
  CRISPR gRNA sequence
ttgttgcttttttttttttt

SEQ ID NO: 100794 - DNA, 20 bp, Artificial
  CRISPR gRNA sequence
ttgctttttttttttttttt

SEQ ID NO: 100795 - DNA, 20 bp, Artificial
  CRISPR gRNA sequence
cttttttttttttttttttt

SEQ ID NO: 100796 - DNA, 20 bp, Artificial
  CRISPR gRNA sequence
tttttttttttttttttgga

SEQ ID NO: 100797 - DNA, 20 bp, Artificial
  CRISPR gRNA sequence
ttttttttttttttttggac

SEQ ID NO: 100798 - DNA, 20 bp, Artificial
  CRISPR gRNA sequence
tttttttttttttttggaca

SEQ ID NO: 100799 - DNA, 20 bp, Artificial
  CRISPR gRNA sequence
ttttttttttttttggacat

SEQ ID NO: 100800 - DNA, 20 bp, Artificial
  CRISPR gRNA sequence
tttttttttttttggacatg

SEQ ID NO: 100801 - DNA, 20 bp, Artificial
  CRISPR gRNA sequence
ttttttttttttggacatgg

SEQ ID NO: 100802 - DNA, 20 bp, Artificial
  CRISPR gRNA sequence
tttttttttttggacatgga

SEQ ID NO: 100803 - DNA, 20 bp, Artificial
  CRISPR gRNA sequence
ttttttttttggacatggag

SEQ ID NO: 100804 - DNA, 20 bp, Artificial
  CRISPR gRNA sequence
tttttttttggacatggagt

SEQ ID NO: 100805 - DNA, 20 bp, Artificial
  CRISPR gRNA sequence
ttttttttggacatggagtc

SEQ ID NO: 100806 - DNA, 20 bp, Artificial
  CRISPR gRNA sequence
tttttttggacatggagtct

SEQ ID NO: 100807 - DNA, 20 bp, Artificial
  CRISPR gRNA sequence
ttttttggacatggagtctc

SEQ ID NO: 100808 - DNA, 20 bp, Artificial
  CRISPR gRNA sequence
tttttggacatggagtctcg

SEQ ID NO: 100809 - DNA, 20 bp, Artificial
  CRISPR gRNA sequence
ttttggacatggagtctcgc

SEQ ID NO: 100810 - DNA, 20 bp, Artificial
  CRISPR gRNA sequence
tttggacatggagtctcgcg

SEQ ID NO: 100811 - DNA, 20 bp, Artificial
  CRISPR gRNA sequence
ttggacatggagtctcgcgc

SEQ ID NO: 100812 - DNA, 20 bp, Artificial
  CRISPR gRNA sequence
tggacatggagtctcgcgct

SEQ ID NO: 100813 - DNA, 20 bp, Artificial
  CRISPR gRNA sequence
ggacatggagtctcgcgctg

SEQ ID NO: 100814 - DNA, 20 bp, Artificial
  CRISPR gRNA sequence
gacatggagtctcgcgctgt

SEQ ID NO: 100815 - DNA, 20 bp, Artificial
  CRISPR gRNA sequence
gcgctgtcacccaggctgga

SEQ ID NO: 100816 - DNA, 20 bp, Artificial
  CRISPR gRNA sequence
tcacccaggctggagtgcaa

SEQ ID NO: 100817 - DNA, 20 bp, Artificial
  CRISPR gRNA sequence
gagtgcaatggcgccatctc

SEQ ID NO: 100818 - DNA, 20 bp, Artificial
  CRISPR gRNA sequence
ggctcactgcaacttccacc

SEQ ID NO: 100819 - DNA, 20 bp, Artificial
  CRISPR gRNA sequence
actgcaacttccacctccca

SEQ ID NO: 100820 - DNA, 20 bp, Artificial
  CRISPR gRNA sequence
caacttccacctcccaggtt

SEQ ID NO: 100821 - DNA, 20 bp, Artificial
  CRISPR gRNA sequence
ccacctcccaggttcaagcg

SEQ ID NO: 100822 - DNA, 20 bp, Artificial
  CRISPR gRNA sequence
cacctcccaggttcaagcga

SEQ ID NO: 100823 - DNA, 20 bp, Artificial
  CRISPR gRNA sequence
ccaggttcaagcgattctcc

SEQ ID NO: 100824 - DNA, 20 bp, Artificial
  CRISPR gRNA sequence
aagcgattctcctgcctcag

SEQ ID NO: 100825 - DNA, 20 bp, Artificial
  CRISPR gRNA sequence
tcctgcctcagcctcctgag

SEQ ID NO: 100826 - DNA, 20 bp, Artificial
  CRISPR gRNA sequence
ctgcctcagcctcctgagta

SEQ ID NO: 100827 - DNA, 20 bp, Artificial
  CRISPR gRNA sequence
cctcagcctcctgagtagct

SEQ ID NO: 100828 - DNA, 20 bp, Artificial
  CRISPR gRNA sequence
agcctcctgagtagctggga

SEQ ID NO: 100829 - DNA, 20 bp, Artificial
  CRISPR gRNA sequence
ctgagtagctgggaccacag

SEQ ID NO: 100830 - DNA, 20 bp, Artificial
  CRISPR gRNA sequence
agtagctgggaccacaggtg

SEQ ID NO: 100831 - DNA, 20 bp, Artificial
  CRISPR gRNA sequence
ggaccacaggtgcacaccat

SEQ ID NO: 100832 - DNA, 20 bp, Artificial
  CRISPR gRNA sequence
atttttatatttttagtaga

SEQ ID NO: 100833 - DNA, 20 bp, Artificial
  CRISPR gRNA sequence
ttatatttttagtagagacg

SEQ ID NO: 100834 - DNA, 20 bp, Artificial
  CRISPR gRNA sequence
tatatttttagtagagacgg

SEQ ID NO: 100835 - DNA, 20 bp, Artificial
  CRISPR gRNA sequence
atatttttagtagagacggg

SEQ ID NO: 100836 - DNA, 20 bp, Artificial
  CRISPR gRNA sequence
tatttttagtagagacgggg

SEQ ID NO: 100837 - DNA, 20 bp, Artificial
  CRISPR gRNA sequence
ttagtagagacggggtttca

SEQ ID NO: 100838 - DNA, 20 bp, Artificial
  CRISPR gRNA sequence
tagtagagacggggtttcac

SEQ ID NO: 100839 - DNA, 20 bp, Artificial
  CRISPR gRNA sequence
agtagagacggggtttcacc

SEQ ID NO: 100840 - DNA, 20 bp, Artificial
  CRISPR gRNA sequence
gtagagacggggtttcacca

SEQ ID NO: 100841 - DNA, 20 bp, Artificial
  CRISPR gRNA sequence
caccatgttggtcaggctgg

SEQ ID NO: 100842 - DNA, 20 bp, Artificial
  CRISPR gRNA sequence
accatgttggtcaggctggt

SEQ ID NO: 100843 - DNA, 20 bp, Artificial
  CRISPR gRNA sequence
gtcaggctggtcttgaactc

SEQ ID NO: 100844 - DNA, 20 bp, Artificial
  CRISPR gRNA sequence
gtcttgaactcctgaccttg

SEQ ID NO: 100845 - DNA, 20 bp, Artificial
  CRISPR gRNA sequence
gaactcctgaccttgtgatc

SEQ ID NO: 100846 - DNA, 20 bp, Artificial
  CRISPR gRNA sequence
aactcctgaccttgtgatcc

SEQ ID NO: 100847 - DNA, 20 bp, Artificial
  CRISPR gRNA sequence
ctgaccttgtgatccgcctg

SEQ ID NO: 100848 - DNA, 20 bp, Artificial
  CRISPR gRNA sequence
accttgtgatccgcctgtgt

SEQ ID NO: 100849 - DNA, 20 bp, Artificial
  CRISPR gRNA sequence
gtgatccgcctgtgttggcc

SEQ ID NO: 100850 - DNA, 20 bp, Artificial
  CRISPR gRNA sequence
tgatccgcctgtgttggcct

SEQ ID NO: 100851 - DNA, 20 bp, Artificial
  CRISPR gRNA sequence
tgttggcctcccaaagtgct

SEQ ID NO: 100852 - DNA, 20 bp, Artificial
  CRISPR gRNA sequence
gcctcccaaagtgctgggat

SEQ ID NO: 100853 - DNA, 20 bp, Artificial
  CRISPR gRNA sequence
ccaaagtgctgggattacag

SEQ ID NO: 100854 - DNA, 20 bp, Artificial
  CRISPR gRNA sequence
ggattacaggtgtgagccac

SEQ ID NO: 100855 - DNA, 20 bp, Artificial
  CRISPR gRNA sequence
caggtgtgagccaccacgcc

SEQ ID NO: 100856 - DNA, 20 bp, Artificial
  CRISPR gRNA sequence
gctgtgttgttgttttttta

SEQ ID NO: 100857 - DNA, 20 bp, Artificial
  CRISPR gRNA sequence
tgttgttgtttttttagaag

SEQ ID NO: 100858 - DNA, 20 bp, Artificial
  CRISPR gRNA sequence
ttgtttttttagaagagaca

SEQ ID NO: 100859 - DNA, 20 bp, Artificial
  CRISPR gRNA sequence
tttttttagaagagacaggg

SEQ ID NO: 100860 - DNA, 20 bp, Artificial
  CRISPR gRNA sequence
ttttagaagagacagggtct

SEQ ID NO: 100861 - DNA, 20 bp, Artificial
  CRISPR gRNA sequence
tttagaagagacagggtctc

SEQ ID NO: 100862 - DNA, 20 bp, Artificial
  CRISPR gRNA sequence
ttagaagagacagggtctcg

SEQ ID NO: 100863 - DNA, 20 bp, Artificial
  CRISPR gRNA sequence
tagaagagacagggtctcgc

SEQ ID NO: 100864 - DNA, 20 bp, Artificial
  CRISPR gRNA sequence
agaagagacagggtctcgct

SEQ ID NO: 100865 - DNA, 20 bp, Artificial
  CRISPR gRNA sequence
gaagagacagggtctcgcta

SEQ ID NO: 100866 - DNA, 20 bp, Artificial
  CRISPR gRNA sequence
gctatgttgcccaggctggt

SEQ ID NO: 100867 - DNA, 20 bp, Artificial
  CRISPR gRNA sequence
tgttgcccaggctggtctca

SEQ ID NO: 100868 - DNA, 20 bp, Artificial
  CRISPR gRNA sequence
cccaggctggtctcaaactc

SEQ ID NO: 100869 - DNA, 20 bp, Artificial
  CRISPR gRNA sequence
gtctcaaactcctgggctca

SEQ ID NO: 100870 - DNA, 20 bp, Artificial
  CRISPR gRNA sequence
aaactcctgggctcaagtga

SEQ ID NO: 100871 - DNA, 20 bp, Artificial
  CRISPR gRNA sequence
ctgggctcaagtgatccttc

SEQ ID NO: 100872 - DNA, 20 bp, Artificial
  CRISPR gRNA sequence
ggctcaagtgatccttcttc

SEQ ID NO: 100873 - DNA, 20 bp, Artificial
  CRISPR gRNA sequence
aagtgatccttcttccccag

SEQ ID NO: 100874 - DNA, 20 bp, Artificial
  CRISPR gRNA sequence
cttccccagcctcctgagta

SEQ ID NO: 100875 - DNA, 20 bp, Artificial
  CRISPR gRNA sequence
ttccccagcctcctgagtag

SEQ ID NO: 100876 - DNA, 20 bp, Artificial
  CRISPR gRNA sequence
ccccagcctcctgagtagct

SEQ ID NO: 100877 - DNA, 20 bp, Artificial
  CRISPR gRNA sequence
cccagcctcctgagtagctg

SEQ ID NO: 100878 - DNA, 20 bp, Artificial
  CRISPR gRNA sequence
ctgagtagctgggactacag

SEQ ID NO: 100879 - DNA, 20 bp, Artificial
  CRISPR gRNA sequence
agtagctgggactacaggca

SEQ ID NO: 100880 - DNA, 20 bp, Artificial
  CRISPR gRNA sequence
ggactacaggcatgtaccac

SEQ ID NO: 100881 - DNA, 20 bp, Artificial
  CRISPR gRNA sequence
caggcatgtaccactctacc

SEQ ID NO: 100882 - DNA, 20 bp, Artificial
  CRISPR gRNA sequence
tacccagctaatttttaaaa

SEQ ID NO: 100883 - DNA, 20 bp, Artificial
  CRISPR gRNA sequence
cccagctaatttttaaaatc

SEQ ID NO: 100884 - DNA, 20 bp, Artificial
  CRISPR gRNA sequence
atttttaaaatcttttttat

SEQ ID NO: 100885 - DNA, 20 bp, Artificial
  CRISPR gRNA sequence
ttaaaatcttttttatttat

SEQ ID NO: 100886 - DNA, 20 bp, Artificial
  CRISPR gRNA sequence
taaaatcttttttatttatt

SEQ ID NO: 100887 - DNA, 20 bp, Artificial
  CRISPR gRNA sequence
aaaatcttttttatttattt

SEQ ID NO: 100888 - DNA, 20 bp, Artificial
  CRISPR gRNA sequence
aaatcttttttatttatttt

SEQ ID NO: 100889 - DNA, 20 bp, Artificial
  CRISPR gRNA sequence
ttttatttattttttgagac

SEQ ID NO: 100890 - DNA, 20 bp, Artificial
  CRISPR gRNA sequence
tttatttattttttgagaca

SEQ ID NO: 100891 - DNA, 20 bp, Artificial
  CRISPR gRNA sequence
ttatttattttttgagacag

SEQ ID NO: 100892 - DNA, 20 bp, Artificial
  CRISPR gRNA sequence
tatttattttttgagacaga

SEQ ID NO: 100893 - DNA, 20 bp, Artificial
  CRISPR gRNA sequence
atttattttttgagacagag

SEQ ID NO: 100894 - DNA, 20 bp, Artificial
  CRISPR gRNA sequence
tttattttttgagacagagt

SEQ ID NO: 100895 - DNA, 20 bp, Artificial
  CRISPR gRNA sequence
attttttgagacagagtctc

SEQ ID NO: 100896 - DNA, 20 bp, Artificial
  CRISPR gRNA sequence
ttttttgagacagagtctcg

SEQ ID NO: 100897 - DNA, 20 bp, Artificial
  CRISPR gRNA sequence
tttgagacagagtctcgctc

SEQ ID NO: 100898 - DNA, 20 bp, Artificial
  CRISPR gRNA sequence
ttgagacagagtctcgctct

SEQ ID NO: 100899 - DNA, 20 bp, Artificial
  CRISPR gRNA sequence
tgagacagagtctcgctctg

SEQ ID NO: 100900 - DNA, 20 bp, Artificial
  CRISPR gRNA sequence
gagacagagtctcgctctgt

SEQ ID NO: 100901 - DNA, 20 bp, Artificial
  CRISPR gRNA sequence
agacagagtctcgctctgtc

SEQ ID NO: 100902 - DNA, 20 bp, Artificial
  CRISPR gRNA sequence
gctctgtcacccaggctgga

SEQ ID NO: 100903 - DNA, 20 bp, Artificial
  CRISPR gRNA sequence
tgtcacccaggctggagtgc

SEQ ID NO: 100904 - DNA, 20 bp, Artificial
  CRISPR gRNA sequence
tcacccaggctggagtgcag

SEQ ID NO: 100905 - DNA, 20 bp, Artificial
  CRISPR gRNA sequence
gagtgcagtggcacaatctc

SEQ ID NO: 100906 - DNA, 20 bp, Artificial
  CRISPR gRNA sequence
ggctcactgcaacctctgcc

SEQ ID NO: 100907 - DNA, 20 bp, Artificial
  CRISPR gRNA sequence
actgcaacctctgcctccca

SEQ ID NO: 100908 - DNA, 20 bp, Artificial
  CRISPR gRNA sequence
caacctctgcctcccaggca

SEQ ID NO: 100909 - DNA, 20 bp, Artificial
  CRISPR gRNA sequence
tgcctcccaggcaaacaatt

SEQ ID NO: 100910 - DNA, 20 bp, Artificial
  CRISPR gRNA sequence
cctcccaggcaaacaattct

SEQ ID NO: 100911 - DNA, 20 bp, Artificial
  CRISPR gRNA sequence
ccaggcaaacaattctcctg

SEQ ID NO: 100912 - DNA, 20 bp, Artificial
  CRISPR gRNA sequence
tcctgcctcagcctcctgaa

SEQ ID NO: 100913 - DNA, 20 bp, Artificial
  CRISPR gRNA sequence
ctgcctcagcctcctgaata

SEQ ID NO: 100914 - DNA, 20 bp, Artificial
  CRISPR gRNA sequence
cctcagcctcctgaatagct

SEQ ID NO: 100915 - DNA, 20 bp, Artificial
  CRISPR gRNA sequence
agcctcctgaatagctggga

SEQ ID NO: 100916 - DNA, 20 bp, Artificial
  CRISPR gRNA sequence
ctgaatagctgggattacaa

SEQ ID NO: 100917 - DNA, 20 bp, Artificial
  CRISPR gRNA sequence
aatagctgggattacaagtg

SEQ ID NO: 100918 - DNA, 20 bp, Artificial
  CRISPR gRNA sequence
ggattacaagtgcctgccac

SEQ ID NO: 100919 - DNA, 20 bp, Artificial
  CRISPR gRNA sequence
caagtgcctgccaccacacc

SEQ ID NO: 100920 - DNA, 20 bp, Artificial
  CRISPR gRNA sequence
ccaccacacctggctaattt

SEQ ID NO: 100921 - DNA, 20 bp, Artificial
  CRISPR gRNA sequence
gctaattttttttttttttt

SEQ ID NO: 100922 - DNA, 20 bp, Artificial
  CRISPR gRNA sequence
attttttttttttttttttt

SEQ ID NO: 100923 - DNA, 20 bp, Artificial
  CRISPR gRNA sequence
tttttttttttttttttttt

SEQ ID NO: 100924 - DNA, 20 bp, Artificial
  CRISPR gRNA sequence
tttttttttttttttttttt

SEQ ID NO: 100925 - DNA, 20 bp, Artificial
  CRISPR gRNA sequence
tttttttttttttttttttt

SEQ ID NO: 100926 - DNA, 20 bp, Artificial
  CRISPR gRNA sequence
tttttttttttttttttttt

SEQ ID NO: 100927 - DNA, 20 bp, Artificial
  CRISPR gRNA sequence
tttttttttttttttttttt

SEQ ID NO: 100928 - DNA, 20 bp, Artificial
  CRISPR gRNA sequence
tttttttttttttttttttg

SEQ ID NO: 100929 - DNA, 20 bp, Artificial
  CRISPR gRNA sequence
ttttttttttttttttttga

SEQ ID NO: 100930 - DNA, 20 bp, Artificial
  CRISPR gRNA sequence
tttttttttttttttttgag

SEQ ID NO: 100931 - DNA, 20 bp, Artificial
  CRISPR gRNA sequence
ttttttttttttttttgaga

SEQ ID NO: 100932 - DNA, 20 bp, Artificial
  CRISPR gRNA sequence
tttttttttttttttgagat

SEQ ID NO: 100933 - DNA, 20 bp, Artificial
  CRISPR gRNA sequence
ttttttttttttttgagatg

SEQ ID NO: 100934 - DNA, 20 bp, Artificial
  CRISPR gRNA sequence
tttttttttttttgagatgg

SEQ ID NO: 100935 - DNA, 20 bp, Artificial
  CRISPR gRNA sequence
ttttttttttttgagatgga

SEQ ID NO: 100936 - DNA, 20 bp, Artificial
  CRISPR gRNA sequence
tttttttttttgagatggag

SEQ ID NO: 100937 - DNA, 20 bp, Artificial
  CRISPR gRNA sequence
ttttttttttgagatggagt

SEQ ID NO: 100938 - DNA, 20 bp, Artificial
  CRISPR gRNA sequence
tttttttttgagatggagtt

SEQ ID NO: 100939 - DNA, 20 bp, Artificial
  CRISPR gRNA sequence
ttttttttgagatggagttt

SEQ ID NO: 100940 - DNA, 20 bp, Artificial
  CRISPR gRNA sequence
tttttttgagatggagtttc

SEQ ID NO: 100941 - DNA, 20 bp, Artificial
  CRISPR gRNA sequence
ttttttgagatggagtttcg

SEQ ID NO: 100942 - DNA, 20 bp, Artificial
  CRISPR gRNA sequence
tttttgagatggagtttcgc

SEQ ID NO: 100943 - DNA, 20 bp, Artificial
  CRISPR gRNA sequence
ttttgagatggagtttcgct

SEQ ID NO: 100944 - DNA, 20 bp, Artificial
  CRISPR gRNA sequence
tttgagatggagtttcgctc

SEQ ID NO: 100945 - DNA, 20 bp, Artificial
  CRISPR gRNA sequence
ttgagatggagtttcgctct

SEQ ID NO: 100946 - DNA, 20 bp, Artificial
  CRISPR gRNA sequence
tgagatggagtttcgctctt

SEQ ID NO: 100947 - DNA, 20 bp, Artificial
  CRISPR gRNA sequence
gagatggagtttcgctcttg

SEQ ID NO: 100948 - DNA, 20 bp, Artificial
  CRISPR gRNA sequence
agatggagtttcgctcttgt

SEQ ID NO: 100949 - DNA, 20 bp, Artificial
  CRISPR gRNA sequence
cgctcttgttgcccaggctg

SEQ ID NO: 100950 - DNA, 20 bp, Artificial
  CRISPR gRNA sequence
gctcttgttgcccaggctgg

SEQ ID NO: 100951 - DNA, 20 bp, Artificial
  CRISPR gRNA sequence
ttgttgcccaggctggagtg

SEQ ID NO: 100952 - DNA, 20 bp, Artificial
  CRISPR gRNA sequence
gttgcccaggctggagtgct

SEQ ID NO: 100953 - DNA, 20 bp, Artificial
  CRISPR gRNA sequence
ttgcccaggctggagtgcta

SEQ ID NO: 100954 - DNA, 20 bp, Artificial
  CRISPR gRNA sequence
cccaggctggagtgctatgg

SEQ ID NO: 100955 - DNA, 20 bp, Artificial
  CRISPR gRNA sequence
gagtgctatggcgtgatctc

SEQ ID NO: 100956 - DNA, 20 bp, Artificial
  CRISPR gRNA sequence
tggcgtgatctcggctcact

SEQ ID NO: 100957 - DNA, 20 bp, Artificial
  CRISPR gRNA sequence
ggctcactgcaacttccgcc

SEQ ID NO: 100958 - DNA, 20 bp, Artificial
  CRISPR gRNA sequence
actgcaacttccgcctccca

SEQ ID NO: 100959 - DNA, 20 bp, Artificial
  CRISPR gRNA sequence
caacttccgcctcccaggtt

SEQ ID NO: 100960 - DNA, 20 bp, Artificial
  CRISPR gRNA sequence
ccgcctcccaggttcaagca

SEQ ID NO: 100961 - DNA, 20 bp, Artificial
  CRISPR gRNA sequence
cgcctcccaggttcaagcaa

SEQ ID NO: 100962 - DNA, 20 bp, Artificial
  CRISPR gRNA sequence
ccaggttcaagcaattctcc

SEQ ID NO: 100963 - DNA, 20 bp, Artificial
  CRISPR gRNA sequence
aagcaattctcctgcctcag

SEQ ID NO: 100964 - DNA, 20 bp, Artificial
  CRISPR gRNA sequence
tcctgcctcagcctcccaag

SEQ ID NO: 100965 - DNA, 20 bp, Artificial
  CRISPR gRNA sequence
ctgcctcagcctcccaagta

SEQ ID NO: 100966 - DNA, 20 bp, Artificial
  CRISPR gRNA sequence
cctcagcctcccaagtagct

SEQ ID NO: 100967 - DNA, 20 bp, Artificial
  CRISPR gRNA sequence
agcctcccaagtagctggga

SEQ ID NO: 100968 - DNA, 20 bp, Artificial
  CRISPR gRNA sequence
ccaagtagctgggattacag

SEQ ID NO: 100969 - DNA, 20 bp, Artificial
  CRISPR gRNA sequence
ggattacaggcatgcaccac

SEQ ID NO: 100970 - DNA, 20 bp, Artificial
  CRISPR gRNA sequence
caggcatgcaccaccatgcc

SEQ ID NO: 100971 - DNA, 20 bp, Artificial
  CRISPR gRNA sequence
attttttgcatttttagtag

SEQ ID NO: 100972 - DNA, 20 bp, Artificial
  CRISPR gRNA sequence
tttgcatttttagtagagtc

SEQ ID NO: 100973 - DNA, 20 bp, Artificial
  CRISPR gRNA sequence
ttgcatttttagtagagtca

SEQ ID NO: 100974 - DNA, 20 bp, Artificial
  CRISPR gRNA sequence
tgcatttttagtagagtcag

SEQ ID NO: 100975 - DNA, 20 bp, Artificial
  CRISPR gRNA sequence
gcatttttagtagagtcagg

SEQ ID NO: 100976 - DNA, 20 bp, Artificial
  CRISPR gRNA sequence
catttttagtagagtcaggg

SEQ ID NO: 100977 - DNA, 20 bp, Artificial
  CRISPR gRNA sequence
ttagtagagtcagggtttct

SEQ ID NO: 100978 - DNA, 20 bp, Artificial
  CRISPR gRNA sequence
tagtagagtcagggtttctc

SEQ ID NO: 100979 - DNA, 20 bp, Artificial
  CRISPR gRNA sequence
agtagagtcagggtttctcc

SEQ ID NO: 100980 - DNA, 20 bp, Artificial
  CRISPR gRNA sequence
gtagagtcagggtttctcca

SEQ ID NO: 100981 - DNA, 20 bp, Artificial
  CRISPR gRNA sequence
ctccatgttggtcaggtgat

SEQ ID NO: 100982 - DNA, 20 bp, Artificial
  CRISPR gRNA sequence
tccatgttggtcaggtgatc

SEQ ID NO: 100983 - DNA, 20 bp, Artificial
  CRISPR gRNA sequence
catgttggtcaggtgatctc

SEQ ID NO: 100984 - DNA, 20 bp, Artificial
  CRISPR gRNA sequence
gtcaggtgatctcaaactcc

SEQ ID NO: 100985 - DNA, 20 bp, Artificial
  CRISPR gRNA sequence
aaactcccgacctcaggtga

SEQ ID NO: 100986 - DNA, 20 bp, Artificial
  CRISPR gRNA sequence
ccgacctcaggtgatccacc

SEQ ID NO: 100987 - DNA, 20 bp, Artificial
  CRISPR gRNA sequence
aggtgatccacccgcctcag

SEQ ID NO: 100988 - DNA, 20 bp, Artificial
  CRISPR gRNA sequence
agcttcccaaagtgctggga

SEQ ID NO: 100989 - DNA, 20 bp, Artificial
  CRISPR gRNA sequence
cccaaagtgctgggattaca

SEQ ID NO: 100990 - DNA, 20 bp, Artificial
  CRISPR gRNA sequence
ccaaagtgctgggattacag

SEQ ID NO: 100991 - DNA, 20 bp, Artificial
  CRISPR gRNA sequence
ggattacaggcatgagccac

SEQ ID NO: 100992 - DNA, 20 bp, Artificial
  CRISPR gRNA sequence
caggcatgagccaccacacc

SEQ ID NO: 100993 - DNA, 20 bp, Artificial
  CRISPR gRNA sequence
cacctggctaatttttgtag

SEQ ID NO: 100994 - DNA, 20 bp, Artificial
  CRISPR gRNA sequence
gctaatttttgtagttttag

SEQ ID NO: 100995 - DNA, 20 bp, Artificial
  CRISPR gRNA sequence
atttttgtagttttagtaga

SEQ ID NO: 100996 - DNA, 20 bp, Artificial
  CRISPR gRNA sequence
ttgtagttttagtagagatg

SEQ ID NO: 100997 - DNA, 20 bp, Artificial
  CRISPR gRNA sequence
tgtagttttagtagagatgg

SEQ ID NO: 100998 - DNA, 20 bp, Artificial
  CRISPR gRNA sequence
gtagttttagtagagatggg

SEQ ID NO: 100999 - DNA, 20 bp, Artificial
  CRISPR gRNA sequence
tagttttagtagagatgggg

SEQ ID NO: 101000 - DNA, 20 bp, Artificial
  CRISPR gRNA sequence
tagtagagatggggtttcat

SEQ ID NO: 101001 - DNA, 20 bp, Artificial
  CRISPR gRNA sequence
agtagagatggggtttcatc

SEQ ID NO: 101002 - DNA, 20 bp, Artificial
  CRISPR gRNA sequence
gtagagatggggtttcatca

SEQ ID NO: 101003 - DNA, 20 bp, Artificial
  CRISPR gRNA sequence
catcatgttggtcaggctgg

SEQ ID NO: 101004 - DNA, 20 bp, Artificial
  CRISPR gRNA sequence
atcatgttggtcaggctggc

SEQ ID NO: 101005 - DNA, 20 bp, Artificial
  CRISPR gRNA sequence
gtcaggctggcctttcctga

SEQ ID NO: 101006 - DNA, 20 bp, Artificial
  CRISPR gRNA sequence
gcctttcctgacttcaagtg

SEQ ID NO: 101007 - DNA, 20 bp, Artificial
  CRISPR gRNA sequence
tcctgacttcaagtgatcca

SEQ ID NO: 101008 - DNA, 20 bp, Artificial
  CRISPR gRNA sequence
cctgacttcaagtgatccac

SEQ ID NO: 101009 - DNA, 20 bp, Artificial
  CRISPR gRNA sequence
ctgacttcaagtgatccacc

SEQ ID NO: 101010 - DNA, 20 bp, Artificial
  CRISPR gRNA sequence
acttcaagtgatccacctac

SEQ ID NO: 101011 - DNA, 20 bp, Artificial
  CRISPR gRNA sequence
caagtgatccacctaccttg

SEQ ID NO: 101012 - DNA, 20 bp, Artificial
  CRISPR gRNA sequence
aagtgatccacctaccttgg

SEQ ID NO: 101013 - DNA, 20 bp, Artificial
  CRISPR gRNA sequence
ccttggcctcccaaagtgct

SEQ ID NO: 101014 - DNA, 20 bp, Artificial
  CRISPR gRNA sequence
ggcctcccaaagtgctagga

SEQ ID NO: 101015 - DNA, 20 bp, Artificial
  CRISPR gRNA sequence
gcctcccaaagtgctaggat

SEQ ID NO: 101016 - DNA, 20 bp, Artificial
  CRISPR gRNA sequence
ccaaagtgctaggattacag

SEQ ID NO: 101017 - DNA, 20 bp, Artificial
  CRISPR gRNA sequence
ggattacaggtgtgagccac

SEQ ID NO: 101018 - DNA, 20 bp, Artificial
  CRISPR gRNA sequence
caggtgtgagccaccaagcc

SEQ ID NO: 101019 - DNA, 20 bp, Artificial
  CRISPR gRNA sequence
atttttaaatttttttggta

SEQ ID NO: 101020 - DNA, 20 bp, Artificial
  CRISPR gRNA sequence
ttaaatttttttggtagaga

SEQ ID NO: 101021 - DNA, 20 bp, Artificial
  CRISPR gRNA sequence
taaatttttttggtagagac

SEQ ID NO: 101022 - DNA, 20 bp, Artificial
  CRISPR gRNA sequence
aaatttttttggtagagaca

SEQ ID NO: 101023 - DNA, 20 bp, Artificial
  CRISPR gRNA sequence
aatttttttggtagagacag

SEQ ID NO: 101024 - DNA, 20 bp, Artificial
  CRISPR gRNA sequence
ttttggtagagacagcgttt

SEQ ID NO: 101025 - DNA, 20 bp, Artificial
  CRISPR gRNA sequence
tttggtagagacagcgtttt

SEQ ID NO: 101026 - DNA, 20 bp, Artificial
  CRISPR gRNA sequence
ttggtagagacagcgttttg

SEQ ID NO: 101027 - DNA, 20 bp, Artificial
  CRISPR gRNA sequence
tggtagagacagcgttttgc

SEQ ID NO: 101028 - DNA, 20 bp, Artificial
  CRISPR gRNA sequence
ggtagagacagcgttttgct

SEQ ID NO: 101029 - DNA, 20 bp, Artificial
  CRISPR gRNA sequence
gtagagacagcgttttgctc

SEQ ID NO: 101030 - DNA, 20 bp, Artificial
  CRISPR gRNA sequence
tgctctgttgcccaagctgg

SEQ ID NO: 101031 - DNA, 20 bp, Artificial
  CRISPR gRNA sequence
gctctgttgcccaagctggc

SEQ ID NO: 101032 - DNA, 20 bp, Artificial
  CRISPR gRNA sequence
ctctgttgcccaagctggcc

SEQ ID NO: 101033 - DNA, 20 bp, Artificial
  CRISPR gRNA sequence
tgttgcccaagctggcctca

SEQ ID NO: 101034 - DNA, 20 bp, Artificial
  CRISPR gRNA sequence
ttgcccaagctggcctcaaa

SEQ ID NO: 101035 - DNA, 20 bp, Artificial
  CRISPR gRNA sequence
cccaagctggcctcaaattc

SEQ ID NO: 101036 - DNA, 20 bp, Artificial
  CRISPR gRNA sequence
gcctcaaattcctgagctca

SEQ ID NO: 101037 - DNA, 20 bp, Artificial
  CRISPR gRNA sequence
aaattcctgagctcaagcag

SEQ ID NO: 101038 - DNA, 20 bp, Artificial
  CRISPR gRNA sequence
ctgagctcaagcagtcctcc

SEQ ID NO: 101039 - DNA, 20 bp, Artificial
  CRISPR gRNA sequence
agctcaagcagtcctcccca

SEQ ID NO: 101040 - DNA, 20 bp, Artificial
  CRISPR gRNA sequence
aagcagtcctccccactgga

SEQ ID NO: 101041 - DNA, 20 bp, Artificial
  CRISPR gRNA sequence
cccactggacctcccaaagt

SEQ ID NO: 101042 - DNA, 20 bp, Artificial
  CRISPR gRNA sequence
gacctcccaaagtgctggga

SEQ ID NO: 101043 - DNA, 20 bp, Artificial
  CRISPR gRNA sequence
ccaaagtgctgggattatag

SEQ ID NO: 101044 - DNA, 20 bp, Artificial
  CRISPR gRNA sequence
ggattataggtgtgagccac

SEQ ID NO: 101045 - DNA, 20 bp, Artificial
  CRISPR gRNA sequence
taggtgtgagccaccatgcc

SEQ ID NO: 101046 - DNA, 20 bp, Artificial
  CRISPR gRNA sequence
atcttttcatgaaagtcaca

SEQ ID NO: 101047 - DNA, 20 bp, Artificial
  CRISPR gRNA sequence
ttcatgaaagtcacaattca

SEQ ID NO: 101048 - DNA, 20 bp, Artificial
  CRISPR gRNA sequence
tcatgaaagtcacaattcac

SEQ ID NO: 101049 - DNA, 20 bp, Artificial
  CRISPR gRNA sequence
catgaaagtcacaattcaca

SEQ ID NO: 101050 - DNA, 20 bp, Artificial
  CRISPR gRNA sequence
atgaaagtcacaattcacac

SEQ ID NO: 101051 - DNA, 20 bp, Artificial
  CRISPR gRNA sequence
acacattttgcttggtagga

SEQ ID NO: 101052 - DNA, 20 bp, Artificial
  CRISPR gRNA sequence
tgcttggtaggaaatatttt

SEQ ID NO: 101053 - DNA, 20 bp, Artificial
  CRISPR gRNA sequence
gcttggtaggaaatattttt

SEQ ID NO: 101054 - DNA, 20 bp, Artificial
  CRISPR gRNA sequence
cttggtaggaaatattttta

SEQ ID NO: 101055 - DNA, 20 bp, Artificial
  CRISPR gRNA sequence
ggtaggaaatatttttatat

SEQ ID NO: 101056 - DNA, 20 bp, Artificial
  CRISPR gRNA sequence
gtaggaaatatttttatatt

SEQ ID NO: 101057 - DNA, 20 bp, Artificial
  CRISPR gRNA sequence
ttatattaattctgaaaagc

SEQ ID NO: 101058 - DNA, 20 bp, Artificial
  CRISPR gRNA sequence
tatattaattctgaaaagct

SEQ ID NO: 101059 - DNA, 20 bp, Artificial
  CRISPR gRNA sequence
atattaattctgaaaagcta

SEQ ID NO: 101060 - DNA, 20 bp, Artificial
  CRISPR gRNA sequence
tattaattctgaaaagctac

SEQ ID NO: 101061 - DNA, 20 bp, Artificial
  CRISPR gRNA sequence
attctgaaaagctacaaaag

SEQ ID NO: 101062 - DNA, 20 bp, Artificial
  CRISPR gRNA sequence
tgaaaagctacaaaagtgca

SEQ ID NO: 101063 - DNA, 20 bp, Artificial
  CRISPR gRNA sequence
aaaagctacaaaagtgcatt

SEQ ID NO: 101064 - DNA, 20 bp, Artificial
  CRISPR gRNA sequence
caaaagtgcatttttacaaa

SEQ ID NO: 101065 - DNA, 20 bp, Artificial
  CRISPR gRNA sequence
ttacaaacttaggggaagtt

SEQ ID NO: 101066 - DNA, 20 bp, Artificial
  CRISPR gRNA sequence
tacaaacttaggggaagttg

SEQ ID NO: 101067 - DNA, 20 bp, Artificial
  CRISPR gRNA sequence
acaaacttaggggaagttga

SEQ ID NO: 101068 - DNA, 20 bp, Artificial
  CRISPR gRNA sequence
caaacttaggggaagttgag

SEQ ID NO: 101069 - DNA, 20 bp, Artificial
  CRISPR gRNA sequence
aggggaagttgaggttcctg

SEQ ID NO: 101070 - DNA, 20 bp, Artificial
  CRISPR gRNA sequence
ggggaagttgaggttcctgg

SEQ ID NO: 101071 - DNA, 20 bp, Artificial
  CRISPR gRNA sequence
aggttcctggggtgagtcct

SEQ ID NO: 101072 - DNA, 20 bp, Artificial
  CRISPR gRNA sequence
ctggggtgagtcctcggttc

SEQ ID NO: 101073 - DNA, 20 bp, Artificial
  CRISPR gRNA sequence
gggtgagtcctcggttctcc

SEQ ID NO: 101074 - DNA, 20 bp, Artificial
  CRISPR gRNA sequence
ggttctcccagctttgctct

SEQ ID NO: 101075 - DNA, 20 bp, Artificial
  CRISPR gRNA sequence
tcccagctttgctctgtaat

SEQ ID NO: 101076 - DNA, 20 bp, Artificial
  CRISPR gRNA sequence
ccagctttgctctgtaatgc

SEQ ID NO: 101077 - DNA, 20 bp, Artificial
  CRISPR gRNA sequence
tgctctgtaatgcaggtctc

SEQ ID NO: 101078 - DNA, 20 bp, Artificial
  CRISPR gRNA sequence
gctctgtaatgcaggtctct

SEQ ID NO: 101079 - DNA, 20 bp, Artificial
  CRISPR gRNA sequence
ctctgtaatgcaggtctctg

SEQ ID NO: 101080 - DNA, 20 bp, Artificial
  CRISPR gRNA sequence
tgtaatgcaggtctctgcaa

SEQ ID NO: 101081 - DNA, 20 bp, Artificial
  CRISPR gRNA sequence
taatgcaggtctctgcaagg

SEQ ID NO: 101082 - DNA, 20 bp, Artificial
  CRISPR gRNA sequence
tgcaagggtccctgtttgtc

SEQ ID NO: 101083 - DNA, 20 bp, Artificial
  CRISPR gRNA sequence
caagggtccctgtttgtccc

SEQ ID NO: 101084 - DNA, 20 bp, Artificial
  CRISPR gRNA sequence
tttgtcccctaaggggagag

SEQ ID NO: 101085 - DNA, 20 bp, Artificial
  CRISPR gRNA sequence
gtcccctaaggggagagcgc

SEQ ID NO: 101086 - DNA, 20 bp, Artificial
  CRISPR gRNA sequence
tcccctaaggggagagcgca

SEQ ID NO: 101087 - DNA, 20 bp, Artificial
  CRISPR gRNA sequence
aggggagagcgcaggttggc

SEQ ID NO: 101088 - DNA, 20 bp, Artificial
  CRISPR gRNA sequence
gcctgtgcctccaccccact

SEQ ID NO: 101089 - DNA, 20 bp, Artificial
  CRISPR gRNA sequence
tgcctccaccccactcccga

SEQ ID NO: 101090 - DNA, 20 bp, Artificial
  CRISPR gRNA sequence
caccccactcccgattcaag

SEQ ID NO: 101091 - DNA, 20 bp, Artificial
  CRISPR gRNA sequence
ccgattcaagctcacagccc

SEQ ID NO: 101092 - DNA, 20 bp, Artificial
  CRISPR gRNA sequence
aagctcacagcccacctttt

SEQ ID NO: 101093 - DNA, 20 bp, Artificial
  CRISPR gRNA sequence
acagcccaccttttccctgc

SEQ ID NO: 101094 - DNA, 20 bp, Artificial
  CRISPR gRNA sequence
ttccctgccccatctcagtg

SEQ ID NO: 101095 - DNA, 20 bp, Artificial
  CRISPR gRNA sequence
tccctgccccatctcagtgc

SEQ ID NO: 101096 - DNA, 20 bp, Artificial
  CRISPR gRNA sequence
ccctgccccatctcagtgca

SEQ ID NO: 101097 - DNA, 20 bp, Artificial
  CRISPR gRNA sequence
cctgccccatctcagtgcaa

SEQ ID NO: 101098 - DNA, 20 bp, Artificial
  CRISPR gRNA sequence
ccccatctcagtgcaacagg

SEQ ID NO: 101099 - DNA, 20 bp, Artificial
  CRISPR gRNA sequence
agtgcaacaggtgatcgaga

SEQ ID NO: 101100 - DNA, 20 bp, Artificial
  CRISPR gRNA sequence
aagctcttccagagcaacct

SEQ ID NO: 101101 - DNA, 20 bp, Artificial
  CRISPR gRNA sequence
ttccagagcaacctggtgcc

SEQ ID NO: 101102 - DNA, 20 bp, Artificial
  CRISPR gRNA sequence
ccagagcaacctggtgcccg

SEQ ID NO: 101103 - DNA, 20 bp, Artificial
  CRISPR gRNA sequence
cagagcaacctggtgcccgc

SEQ ID NO: 101104 - DNA, 20 bp, Artificial
  CRISPR gRNA sequence
gtgcccgctgaccctgagtg

SEQ ID NO: 101105 - DNA, 20 bp, Artificial
  CRISPR gRNA sequence
accctgagtgaaggccgcct

SEQ ID NO: 101106 - DNA, 20 bp, Artificial
  CRISPR gRNA sequence
agtgaaggccgcctgccggg

SEQ ID NO: 101107 - DNA, 20 bp, Artificial
  CRISPR gRNA sequence
ccggggactcagacactcag

SEQ ID NO: 101108 - DNA, 20 bp, Artificial
  CRISPR gRNA sequence
agacactcagggaacaaaat

SEQ ID NO: 101109 - DNA, 20 bp, Artificial
  CRISPR gRNA sequence
agggaacaaaatggtcagcc

SEQ ID NO: 101110 - DNA, 20 bp, Artificial
  CRISPR gRNA sequence
gggaaacccagaactgactt

SEQ ID NO: 101111 - DNA, 20 bp, Artificial
  CRISPR gRNA sequence
acttcaaaggcagcttctgg

SEQ ID NO: 101112 - DNA, 20 bp, Artificial
  CRISPR gRNA sequence
caaaggcagcttctggacag

SEQ ID NO: 101113 - DNA, 20 bp, Artificial
  CRISPR gRNA sequence
aaaggcagcttctggacagg

SEQ ID NO: 101114 - DNA, 20 bp, Artificial
  CRISPR gRNA sequence
ctggacaggtggtgggaggg

SEQ ID NO: 101115 - DNA, 20 bp, Artificial
  CRISPR gRNA sequence
tggacaggtggtgggagggg

SEQ ID NO: 101116 - DNA, 20 bp, Artificial
  CRISPR gRNA sequence
gacaggtggtgggaggggac

SEQ ID NO: 101117 - DNA, 20 bp, Artificial
  CRISPR gRNA sequence
cccaagaggaaccaataaac

SEQ ID NO: 101118 - DNA, 20 bp, Artificial
  CRISPR gRNA sequence
ccaagaggaaccaataaacc

SEQ ID NO: 101119 - DNA, 20 bp, Artificial
  CRISPR gRNA sequence
ctgtgcagaatgagggactt

SEQ ID NO: 101120 - DNA, 20 bp, Artificial
  CRISPR gRNA sequence
tgtgcagaatgagggacttt

SEQ ID NO: 101121 - DNA, 20 bp, Artificial
  CRISPR gRNA sequence
tgcagaatgagggactttgc

SEQ ID NO: 101122 - DNA, 20 bp, Artificial
  CRISPR gRNA sequence
tgctgtgcttcccggagggc

SEQ ID NO: 101123 - DNA, 20 bp, Artificial
  CRISPR gRNA sequence
gctgtgcttcccggagggct

SEQ ID NO: 101124 - DNA, 20 bp, Artificial
  CRISPR gRNA sequence
ctgtgcttcccggagggctt

SEQ ID NO: 101125 - DNA, 20 bp, Artificial
  CRISPR gRNA sequence
tgcttcccggagggcttcct

SEQ ID NO: 101126 - DNA, 20 bp, Artificial
  CRISPR gRNA sequence
cccggagggcttcctggagg

SEQ ID NO: 101127 - DNA, 20 bp, Artificial
  CRISPR gRNA sequence
ccggagggcttcctggagga

SEQ ID NO: 101128 - DNA, 20 bp, Artificial
  CRISPR gRNA sequence
cctggaggagacagccccta

SEQ ID NO: 101129 - DNA, 20 bp, Artificial
  CRISPR gRNA sequence
ctggaggagacagcccctag

SEQ ID NO: 101130 - DNA, 20 bp, Artificial
  CRISPR gRNA sequence
gaggagacagcccctagagg

SEQ ID NO: 101131 - DNA, 20 bp, Artificial
  CRISPR gRNA sequence
gaggtctcacaccttctccc

SEQ ID NO: 101132 - DNA, 20 bp, Artificial
  CRISPR gRNA sequence
acaccttctccccaagcacc

SEQ ID NO: 101133 - DNA, 20 bp, Artificial
  CRISPR gRNA sequence
ctccccaagcacccgcaggt

SEQ ID NO: 101134 - DNA, 20 bp, Artificial
  CRISPR gRNA sequence
tccccaagcacccgcaggtg

SEQ ID NO: 101135 - DNA, 20 bp, Artificial
  CRISPR gRNA sequence
cccaagcacccgcaggtggt

SEQ ID NO: 101136 - DNA, 20 bp, Artificial
  CRISPR gRNA sequence
ccacctgcgggtgcttgggg

SEQ ID NO: 101137 - DNA, 20 bp, Artificial
  CRISPR gRNA sequence
cgggtgcttggggagaaggt

SEQ ID NO: 101138 - DNA, 20 bp, Artificial
  CRISPR gRNA sequence
ggggagaaggtgtgagacct

SEQ ID NO: 101139 - DNA, 20 bp, Artificial
  CRISPR gRNA sequence
gggagaaggtgtgagacctc

SEQ ID NO: 101140 - DNA, 20 bp, Artificial
  CRISPR gRNA sequence
taggggctgtctcctccagg

SEQ ID NO: 101141 - DNA, 20 bp, Artificial
  CRISPR gRNA sequence
ggggctgtctcctccaggaa

SEQ ID NO: 101142 - DNA, 20 bp, Artificial
  CRISPR gRNA sequence
tctcctccaggaagccctcc

SEQ ID NO: 101143 - DNA, 20 bp, Artificial
  CRISPR gRNA sequence
ctccaggaagccctccggga

SEQ ID NO: 101144 - DNA, 20 bp, Artificial
  CRISPR gRNA sequence
caggaagccctccgggaagc

SEQ ID NO: 101145 - DNA, 20 bp, Artificial
  CRISPR gRNA sequence
cgggaagcacagcaaagtcc

SEQ ID NO: 101146 - DNA, 20 bp, Artificial
  CRISPR gRNA sequence
attctgcacagaaggtttat

SEQ ID NO: 101147 - DNA, 20 bp, Artificial
  CRISPR gRNA sequence
tgcacagaaggtttattggt

SEQ ID NO: 101148 - DNA, 20 bp, Artificial
  CRISPR gRNA sequence
cacagaaggtttattggttc

SEQ ID NO: 101149 - DNA, 20 bp, Artificial
  CRISPR gRNA sequence
attggttcctcttgggaagg

SEQ ID NO: 101150 - DNA, 20 bp, Artificial
  CRISPR gRNA sequence
ttggttcctcttgggaaggg

SEQ ID NO: 101151 - DNA, 20 bp, Artificial
  CRISPR gRNA sequence
gttcctcttgggaagggtcc

SEQ ID NO: 101152 - DNA, 20 bp, Artificial
  CRISPR gRNA sequence
ctcttgggaagggtcccctc

SEQ ID NO: 101153 - DNA, 20 bp, Artificial
  CRISPR gRNA sequence
ttgggaagggtcccctccca

SEQ ID NO: 101154 - DNA, 20 bp, Artificial
  CRISPR gRNA sequence
gggaagggtcccctcccacc

SEQ ID NO: 101155 - DNA, 20 bp, Artificial
  CRISPR gRNA sequence
ggaagggtcccctcccacca

SEQ ID NO: 101156 - DNA, 20 bp, Artificial
  CRISPR gRNA sequence
ccaccacctgtccagaagct

SEQ ID NO: 101157 - DNA, 20 bp, Artificial
  CRISPR gRNA sequence
tccagaagctgcctttgaag

SEQ ID NO: 101158 - DNA, 20 bp, Artificial
  CRISPR gRNA sequence
cctttgaagtcagttctggg

SEQ ID NO: 101159 - DNA, 20 bp, Artificial
  CRISPR gRNA sequence
tgaagtcagttctgggtttc

SEQ ID NO: 101160 - DNA, 20 bp, Artificial
  CRISPR gRNA sequence
gaagtcagttctgggtttcc

SEQ ID NO: 101161 - DNA, 20 bp, Artificial
  CRISPR gRNA sequence
aagtcagttctgggtttccc

SEQ ID NO: 101162 - DNA, 20 bp, Artificial
  CRISPR gRNA sequence
tgggtttccccagctctggc

SEQ ID NO: 101163 - DNA, 20 bp, Artificial
  CRISPR gRNA sequence
ggtttccccagctctggctg

SEQ ID NO: 101164 - DNA, 20 bp, Artificial
  CRISPR gRNA sequence
ccccagctctggctgaccat

SEQ ID NO: 101165 - DNA, 20 bp, Artificial
  CRISPR gRNA sequence
cccagctctggctgaccatt

SEQ ID NO: 101166 - DNA, 20 bp, Artificial
  CRISPR gRNA sequence
tggctgaccattttgttccc

SEQ ID NO: 101167 - DNA, 20 bp, Artificial
  CRISPR gRNA sequence
gctgaccattttgttccctg

SEQ ID NO: 101168 - DNA, 20 bp, Artificial
  CRISPR gRNA sequence
accattttgttccctgagtg

SEQ ID NO: 101169 - DNA, 20 bp, Artificial
  CRISPR gRNA sequence
tgttccctgagtgtctgagt

SEQ ID NO: 101170 - DNA, 20 bp, Artificial
  CRISPR gRNA sequence
gttccctgagtgtctgagtc

SEQ ID NO: 101171 - DNA, 20 bp, Artificial
  CRISPR gRNA sequence
ttccctgagtgtctgagtcc

SEQ ID NO: 101172 - DNA, 20 bp, Artificial
  CRISPR gRNA sequence
cctgagtgtctgagtccccg

SEQ ID NO: 101173 - DNA, 20 bp, Artificial
  CRISPR gRNA sequence
agtgtctgagtccccggcag

SEQ ID NO: 101174 - DNA, 20 bp, Artificial
  CRISPR gRNA sequence
agtccccggcaggcggcctt

SEQ ID NO: 101175 - DNA, 20 bp, Artificial
  CRISPR gRNA sequence
cactcagggtcagcgggcac

SEQ ID NO: 101176 - DNA, 20 bp, Artificial
  CRISPR gRNA sequence
actcagggtcagcgggcacc

SEQ ID NO: 101177 - DNA, 20 bp, Artificial
  CRISPR gRNA sequence
agggtcagcgggcaccaggt

SEQ ID NO: 101178 - DNA, 20 bp, Artificial
  CRISPR gRNA sequence
ctctggaagagcttgaggat

SEQ ID NO: 101179 - DNA, 20 bp, Artificial
  CRISPR gRNA sequence
tggaagagcttgaggatgtg

SEQ ID NO: 101180 - DNA, 20 bp, Artificial
  CRISPR gRNA sequence
gaagagcttgaggatgtggt

SEQ ID NO: 101181 - DNA, 20 bp, Artificial
  CRISPR gRNA sequence
gaggatgtggttctcgatca

SEQ ID NO: 101182 - DNA, 20 bp, Artificial
  CRISPR gRNA sequence
aggatgtggttctcgatcac

SEQ ID NO: 101183 - DNA, 20 bp, Artificial
  CRISPR gRNA sequence
tcgatcacctgttgcactga

SEQ ID NO: 101184 - DNA, 20 bp, Artificial
  CRISPR gRNA sequence
gatcacctgttgcactgaga

SEQ ID NO: 101185 - DNA, 20 bp, Artificial
  CRISPR gRNA sequence
ttgcactgagatggggcagg

SEQ ID NO: 101186 - DNA, 20 bp, Artificial
  CRISPR gRNA sequence
cactgagatggggcagggaa

SEQ ID NO: 101187 - DNA, 20 bp, Artificial
  CRISPR gRNA sequence
agatggggcagggaaaaggt

SEQ ID NO: 101188 - DNA, 20 bp, Artificial
  CRISPR gRNA sequence
tgagcttgaatcgggagtgg

SEQ ID NO: 101189 - DNA, 20 bp, Artificial
  CRISPR gRNA sequence
gaatcgggagtggggtggag

SEQ ID NO: 101190 - DNA, 20 bp, Artificial
  CRISPR gRNA sequence
aatcgggagtggggtggagg

SEQ ID NO: 101191 - DNA, 20 bp, Artificial
  CRISPR gRNA sequence
cgctctccccttaggggaca

SEQ ID NO: 101192 - DNA, 20 bp, Artificial
  CRISPR gRNA sequence
tccccttaggggacaaacag

SEQ ID NO: 101193 - DNA, 20 bp, Artificial
  CRISPR gRNA sequence
cccttaggggacaaacaggg

SEQ ID NO: 101194 - DNA, 20 bp, Artificial
  CRISPR gRNA sequence
aggggacaaacagggaccct

SEQ ID NO: 101195 - DNA, 20 bp, Artificial
  CRISPR gRNA sequence
ggggacaaacagggaccctt

SEQ ID NO: 101196 - DNA, 20 bp, Artificial
  CRISPR gRNA sequence
gcagagacctgcattacaga

SEQ ID NO: 101197 - DNA, 20 bp, Artificial
  CRISPR gRNA sequence
cagagacctgcattacagag

SEQ ID NO: 101198 - DNA, 20 bp, Artificial
  CRISPR gRNA sequence
cattacagagcaaagctggg

SEQ ID NO: 101199 - DNA, 20 bp, Artificial
  CRISPR gRNA sequence
cagagcaaagctgggagaac

SEQ ID NO: 101200 - DNA, 20 bp, Artificial
  CRISPR gRNA sequence
ggagaaccgaggactcaccc

SEQ ID NO: 101201 - DNA, 20 bp, Artificial
  CRISPR gRNA sequence
accccaggaacctcaacttc

SEQ ID NO: 101202 - DNA, 20 bp, Artificial
  CRISPR gRNA sequence
aacttcccctaagtttgtaa

SEQ ID NO: 101203 - DNA, 20 bp, Artificial
  CRISPR gRNA sequence
cccctaagtttgtaaaaatg

SEQ ID NO: 101204 - DNA, 20 bp, Artificial
  CRISPR gRNA sequence
ccctaagtttgtaaaaatgc

SEQ ID NO: 101205 - DNA, 20 bp, Artificial
  CRISPR gRNA sequence
agtttgtaaaaatgcacttt

SEQ ID NO: 101206 - DNA, 20 bp, Artificial
  CRISPR gRNA sequence
gtaaaaatgcacttttgtag

SEQ ID NO: 101207 - DNA, 20 bp, Artificial
  CRISPR gRNA sequence
taaaaatgcacttttgtagc

SEQ ID NO: 101208 - DNA, 20 bp, Artificial
  CRISPR gRNA sequence
ttgtagcttttcagaattaa

SEQ ID NO: 101209 - DNA, 20 bp, Artificial
  CRISPR gRNA sequence
tgtagcttttcagaattaat

SEQ ID NO: 101210 - DNA, 20 bp, Artificial
  CRISPR gRNA sequence
gtagcttttcagaattaata

SEQ ID NO: 101211 - DNA, 20 bp, Artificial
  CRISPR gRNA sequence
tagcttttcagaattaatat

SEQ ID NO: 101212 - DNA, 20 bp, Artificial
  CRISPR gRNA sequence
ttcagaattaatataaaaat

SEQ ID NO: 101213 - DNA, 20 bp, Artificial
  CRISPR gRNA sequence
tcagaattaatataaaaata

SEQ ID NO: 101214 - DNA, 20 bp, Artificial
  CRISPR gRNA sequence
cagaattaatataaaaatat

SEQ ID NO: 101215 - DNA, 20 bp, Artificial
  CRISPR gRNA sequence
agaattaatataaaaatatt

SEQ ID NO: 101216 - DNA, 20 bp, Artificial
  CRISPR gRNA sequence
atataaaaatatttcctacc

SEQ ID NO: 101217 - DNA, 20 bp, Artificial
  CRISPR gRNA sequence
cctaccaagcaaaatgtgtg

SEQ ID NO: 101218 - DNA, 20 bp, Artificial
  CRISPR gRNA sequence
ctaccaagcaaaatgtgtga

SEQ ID NO: 101219 - DNA, 20 bp, Artificial
  CRISPR gRNA sequence
ccaagcaaaatgtgtgaatt

SEQ ID NO: 101220 - DNA, 20 bp, Artificial
  CRISPR gRNA sequence
tgactttcatgaaaagatga

SEQ ID NO: 101221 - DNA, 20 bp, Artificial
  CRISPR gRNA sequence
tcatgaaaagatgagcctgg

SEQ ID NO: 101222 - DNA, 20 bp, Artificial
  CRISPR gRNA sequence
catgaaaagatgagcctggg

SEQ ID NO: 101223 - DNA, 20 bp, Artificial
  CRISPR gRNA sequence
atgaaaagatgagcctgggc

SEQ ID NO: 101224 - DNA, 20 bp, Artificial
  CRISPR gRNA sequence
ggcatggtggctcacaccta

SEQ ID NO: 101225 - DNA, 20 bp, Artificial
  CRISPR gRNA sequence
acacctataatcccagcact

SEQ ID NO: 101226 - DNA, 20 bp, Artificial
  CRISPR gRNA sequence
taatcccagcactttgggag

SEQ ID NO: 101227 - DNA, 20 bp, Artificial
  CRISPR gRNA sequence
tgggaggtccagtggggagg

SEQ ID NO: 101228 - DNA, 20 bp, Artificial
  CRISPR gRNA sequence
gggaggtccagtggggagga

SEQ ID NO: 101229 - DNA, 20 bp, Artificial
  CRISPR gRNA sequence
ggaggtccagtggggaggac

SEQ ID NO: 101230 - DNA, 20 bp, Artificial
  CRISPR gRNA sequence
cttgagctcaggaatttgag

SEQ ID NO: 101231 - DNA, 20 bp, Artificial
  CRISPR gRNA sequence
gagctcaggaatttgaggcc

SEQ ID NO: 101232 - DNA, 20 bp, Artificial
  CRISPR gRNA sequence
agctcaggaatttgaggcca

SEQ ID NO: 101233 - DNA, 20 bp, Artificial
  CRISPR gRNA sequence
aggaatttgaggccagcttg

SEQ ID NO: 101234 - DNA, 20 bp, Artificial
  CRISPR gRNA sequence
gaggccagcttgggcaacag

SEQ ID NO: 101235 - DNA, 20 bp, Artificial
  CRISPR gRNA sequence
aggccagcttgggcaacaga

SEQ ID NO: 101236 - DNA, 20 bp, Artificial
  CRISPR gRNA sequence
gggcaacagagcaaaacgct

SEQ ID NO: 101237 - DNA, 20 bp, Artificial
  CRISPR gRNA sequence
ggcaacagagcaaaacgctg

SEQ ID NO: 101238 - DNA, 20 bp, Artificial
  CRISPR gRNA sequence
tctctaccaaaaaaatttaa

SEQ ID NO: 101239 - DNA, 20 bp, Artificial
  CRISPR gRNA sequence
taccaaaaaaatttaaaaat

SEQ ID NO: 101240 - DNA, 20 bp, Artificial
  CRISPR gRNA sequence
ccaaaaaaatttaaaaatta

SEQ ID NO: 101241 - DNA, 20 bp, Artificial
  CRISPR gRNA sequence
aaaaattaggctgggcttgg

SEQ ID NO: 101242 - DNA, 20 bp, Artificial
  CRISPR gRNA sequence
aaaattaggctgggcttggt

SEQ ID NO: 101243 - DNA, 20 bp, Artificial
  CRISPR gRNA sequence
ggctgggcttggtggctcac

SEQ ID NO: 101244 - DNA, 20 bp, Artificial
  CRISPR gRNA sequence
ggcttggtggctcacacctg

SEQ ID NO: 101245 - DNA, 20 bp, Artificial
  CRISPR gRNA sequence
ggtggctcacacctgtaatc

SEQ ID NO: 101246 - DNA, 20 bp, Artificial
  CRISPR gRNA sequence
gtggctcacacctgtaatcc

SEQ ID NO: 101247 - DNA, 20 bp, Artificial
  CRISPR gRNA sequence
acacctgtaatcctagcact

SEQ ID NO: 101248 - DNA, 20 bp, Artificial
  CRISPR gRNA sequence
taatcctagcactttgggag

SEQ ID NO: 101249 - DNA, 20 bp, Artificial
  CRISPR gRNA sequence
gcactttgggaggccaaggt

SEQ ID NO: 101250 - DNA, 20 bp, Artificial
  CRISPR gRNA sequence
tgggaggccaaggtaggtgg

SEQ ID NO: 101251 - DNA, 20 bp, Artificial
  CRISPR gRNA sequence
gggaggccaaggtaggtgga

SEQ ID NO: 101252 - DNA, 20 bp, Artificial
  CRISPR gRNA sequence
ggaggccaaggtaggtggat

SEQ ID NO: 101253 - DNA, 20 bp, Artificial
  CRISPR gRNA sequence
gaagtcaggaaaggccagcc

SEQ ID NO: 101254 - DNA, 20 bp, Artificial
  CRISPR gRNA sequence
aagtcaggaaaggccagcct

SEQ ID NO: 101255 - DNA, 20 bp, Artificial
  CRISPR gRNA sequence
accaacatgatgaaacccca

SEQ ID NO: 101256 - DNA, 20 bp, Artificial
  CRISPR gRNA sequence
tactaaaactacaaaaatta

SEQ ID NO: 101257 - DNA, 20 bp, Artificial
  CRISPR gRNA sequence
ctaaaactacaaaaattagc

SEQ ID NO: 101258 - DNA, 20 bp, Artificial
  CRISPR gRNA sequence
aaactacaaaaattagccag

SEQ ID NO: 101259 - DNA, 20 bp, Artificial
  CRISPR gRNA sequence
caaaaattagccaggtgcag

SEQ ID NO: 101260 - DNA, 20 bp, Artificial
  CRISPR gRNA sequence
gccaggtgcagccgggtgtg

SEQ ID NO: 101261 - DNA, 20 bp, Artificial
  CRISPR gRNA sequence
atgcctgtaatcccagcact

SEQ ID NO: 101262 - DNA, 20 bp, Artificial
  CRISPR gRNA sequence
taatcccagcactttgggaa

SEQ ID NO: 101263 - DNA, 20 bp, Artificial
  CRISPR gRNA sequence
tgggaagctgaggcgggtgg

SEQ ID NO: 101264 - DNA, 20 bp, Artificial
  CRISPR gRNA sequence
gggaagctgaggcgggtgga

SEQ ID NO: 101265 - DNA, 20 bp, Artificial
  CRISPR gRNA sequence
ggaagctgaggcgggtggat

SEQ ID NO: 101266 - DNA, 20 bp, Artificial
  CRISPR gRNA sequence
aggcgggtggatcacctgag

SEQ ID NO: 101267 - DNA, 20 bp, Artificial
  CRISPR gRNA sequence
aggtcgggagtttgagatca

SEQ ID NO: 101268 - DNA, 20 bp, Artificial
  CRISPR gRNA sequence
gagatcacctgaccaacatg

SEQ ID NO: 101269 - DNA, 20 bp, Artificial
  CRISPR gRNA sequence
agatcacctgaccaacatgg

SEQ ID NO: 101270 - DNA, 20 bp, Artificial
  CRISPR gRNA sequence
accaacatggagaaaccctg

SEQ ID NO: 101271 - DNA, 20 bp, Artificial
  CRISPR gRNA sequence
actctactaaaaatgcaaaa

SEQ ID NO: 101272 - DNA, 20 bp, Artificial
  CRISPR gRNA sequence
tactaaaaatgcaaaaaatt

SEQ ID NO: 101273 - DNA, 20 bp, Artificial
  CRISPR gRNA sequence
ctaaaaatgcaaaaaattag

SEQ ID NO: 101274 - DNA, 20 bp, Artificial
  CRISPR gRNA sequence
aaaatgcaaaaaattagttg

SEQ ID NO: 101275 - DNA, 20 bp, Artificial
  CRISPR gRNA sequence
gttgggcatggtggtgcatg

SEQ ID NO: 101276 - DNA, 20 bp, Artificial
  CRISPR gRNA sequence
ggcatggtggtgcatgcctg

SEQ ID NO: 101277 - DNA, 20 bp, Artificial
  CRISPR gRNA sequence
taatcccagctacttgggag

SEQ ID NO: 101278 - DNA, 20 bp, Artificial
  CRISPR gRNA sequence
cttgggaggctgaggcagga

SEQ ID NO: 101279 - DNA, 20 bp, Artificial
  CRISPR gRNA sequence
gggaggctgaggcaggagaa

SEQ ID NO: 101280 - DNA, 20 bp, Artificial
  CRISPR gRNA sequence
ggaggctgaggcaggagaat

SEQ ID NO: 101281 - DNA, 20 bp, Artificial
  CRISPR gRNA sequence
aggcaggagaattgcttgaa

SEQ ID NO: 101282 - DNA, 20 bp, Artificial
  CRISPR gRNA sequence
cttgaacctgggaggcggaa

SEQ ID NO: 101283 - DNA, 20 bp, Artificial
  CRISPR gRNA sequence
gaacctgggaggcggaagtt

SEQ ID NO: 101284 - DNA, 20 bp, Artificial
  CRISPR gRNA sequence
aacctgggaggcggaagttg

SEQ ID NO: 101285 - DNA, 20 bp, Artificial
  CRISPR gRNA sequence
ggaggcggaagttgcagtga

SEQ ID NO: 101286 - DNA, 20 bp, Artificial
  CRISPR gRNA sequence
cagtgagccgagatcacgcc

SEQ ID NO: 101287 - DNA, 20 bp, Artificial
  CRISPR gRNA sequence
cagcctgggcaacaagagcg

SEQ ID NO: 101288 - DNA, 20 bp, Artificial
  CRISPR gRNA sequence
ggcaacaagagcgaaactcc

SEQ ID NO: 101289 - DNA, 20 bp, Artificial
  CRISPR gRNA sequence
catctcaaaaaaaaaaaaaa

SEQ ID NO: 101290 - DNA, 20 bp, Artificial
  CRISPR gRNA sequence
aaaaaaaaaaaaaaaaaaaa

SEQ ID NO: 101291 - DNA, 20 bp, Artificial
  CRISPR gRNA sequence
gccaggtgtggtggcaggca

SEQ ID NO: 101292 - DNA, 20 bp, Artificial
  CRISPR gRNA sequence
gtaatcccagctattcagga

SEQ ID NO: 101293 - DNA, 20 bp, Artificial
  CRISPR gRNA sequence
taatcccagctattcaggag

SEQ ID NO: 101294 - DNA, 20 bp, Artificial
  CRISPR gRNA sequence
ttcaggaggctgaggcagga

SEQ ID NO: 101295 - DNA, 20 bp, Artificial
  CRISPR gRNA sequence
aggaggctgaggcaggagaa

SEQ ID NO: 101296 - DNA, 20 bp, Artificial
  CRISPR gRNA sequence
aggcaggagaattgtttgcc

SEQ ID NO: 101297 - DNA, 20 bp, Artificial
  CRISPR gRNA sequence
tttgcctgggaggcagaggt

SEQ ID NO: 101298 - DNA, 20 bp, Artificial
  CRISPR gRNA sequence
gcctgggaggcagaggttgc

SEQ ID NO: 101299 - DNA, 20 bp, Artificial
  CRISPR gRNA sequence
cctgggaggcagaggttgca

SEQ ID NO: 101300 - DNA, 20 bp, Artificial
  CRISPR gRNA sequence
ggaggcagaggttgcagtga

SEQ ID NO: 101301 - DNA, 20 bp, Artificial
  CRISPR gRNA sequence
cagtgagccgagattgtgcc

SEQ ID NO: 101302 - DNA, 20 bp, Artificial
  CRISPR gRNA sequence
tgccactgcactccagcctg

SEQ ID NO: 101303 - DNA, 20 bp, Artificial
  CRISPR gRNA sequence
cactccagcctgggtgacag

SEQ ID NO: 101304 - DNA, 20 bp, Artificial
  CRISPR gRNA sequence
cagcctgggtgacagagcga

SEQ ID NO: 101305 - DNA, 20 bp, Artificial
  CRISPR gRNA sequence
ggtgacagagcgagactctg

SEQ ID NO: 101306 - DNA, 20 bp, Artificial
  CRISPR gRNA sequence
tgtctcaaaaaataaataaa

SEQ ID NO: 101307 - DNA, 20 bp, Artificial
  CRISPR gRNA sequence
tctcaaaaaataaataaaaa

SEQ ID NO: 101308 - DNA, 20 bp, Artificial
  CRISPR gRNA sequence
aaaaaataaataaaaaagat

SEQ ID NO: 101309 - DNA, 20 bp, Artificial
  CRISPR gRNA sequence
taaaaattagctgggtagag

SEQ ID NO: 101310 - DNA, 20 bp, Artificial
  CRISPR gRNA sequence
aaaaattagctgggtagagt

SEQ ID NO: 101311 - DNA, 20 bp, Artificial
  CRISPR gRNA sequence
aaaattagctgggtagagtg

SEQ ID NO: 101312 - DNA, 20 bp, Artificial
  CRISPR gRNA sequence
gctgggtagagtggtacatg

SEQ ID NO: 101313 - DNA, 20 bp, Artificial
  CRISPR gRNA sequence
ggtagagtggtacatgcctg

SEQ ID NO: 101314 - DNA, 20 bp, Artificial
  CRISPR gRNA sequence
tagtcccagctactcaggag

SEQ ID NO: 101315 - DNA, 20 bp, Artificial
  CRISPR gRNA sequence
ctcaggaggctggggaagaa

SEQ ID NO: 101316 - DNA, 20 bp, Artificial
  CRISPR gRNA sequence
aggaggctggggaagaagga

SEQ ID NO: 101317 - DNA, 20 bp, Artificial
  CRISPR gRNA sequence
gggaagaaggatcacttgag

SEQ ID NO: 101318 - DNA, 20 bp, Artificial
  CRISPR gRNA sequence
gagcccaggagtttgagacc

SEQ ID NO: 101319 - DNA, 20 bp, Artificial
  CRISPR gRNA sequence
agcccaggagtttgagacca

SEQ ID NO: 101320 - DNA, 20 bp, Artificial
  CRISPR gRNA sequence
gagaccagcctgggcaacat

SEQ ID NO: 101321 - DNA, 20 bp, Artificial
  CRISPR gRNA sequence
agaccagcctgggcaacata

SEQ ID NO: 101322 - DNA, 20 bp, Artificial
  CRISPR gRNA sequence
ggcaacatagcgagaccctg

SEQ ID NO: 101323 - DNA, 20 bp, Artificial
  CRISPR gRNA sequence
tctcttctaaaaaaacaaca

SEQ ID NO: 101324 - DNA, 20 bp, Artificial
  CRISPR gRNA sequence
ttctaaaaaaacaacaacac

SEQ ID NO: 101325 - DNA, 20 bp, Artificial
  CRISPR gRNA sequence
ctaaaaaaacaacaacacag

SEQ ID NO: 101326 - DNA, 20 bp, Artificial
  CRISPR gRNA sequence
taaaaaaacaacaacacagc

SEQ ID NO: 101327 - DNA, 20 bp, Artificial
  CRISPR gRNA sequence
aaaaaacaacaacacagcca

SEQ ID NO: 101328 - DNA, 20 bp, Artificial
  CRISPR gRNA sequence
acacctgtaatcccagcact

SEQ ID NO: 101329 - DNA, 20 bp, Artificial
  CRISPR gRNA sequence
taatcccagcactttgggag

SEQ ID NO: 101330 - DNA, 20 bp, Artificial
  CRISPR gRNA sequence
tgggaggccaacacaggcgg

SEQ ID NO: 101331 - DNA, 20 bp, Artificial
  CRISPR gRNA sequence
gggaggccaacacaggcgga

SEQ ID NO: 101332 - DNA, 20 bp, Artificial
  CRISPR gRNA sequence
ggaggccaacacaggcggat

SEQ ID NO: 101333 - DNA, 20 bp, Artificial
  CRISPR gRNA sequence
aagaccagcctgaccaacat

SEQ ID NO: 101334 - DNA, 20 bp, Artificial
  CRISPR gRNA sequence
accaacatggtgaaaccccg

SEQ ID NO: 101335 - DNA, 20 bp, Artificial
  CRISPR gRNA sequence
tactaaaaatataaaaatta

SEQ ID NO: 101336 - DNA, 20 bp, Artificial
  CRISPR gRNA sequence
ctaaaaatataaaaattagc

SEQ ID NO: 101337 - DNA, 20 bp, Artificial
  CRISPR gRNA sequence
aaaatataaaaattagccgg

SEQ ID NO: 101338 - DNA, 20 bp, Artificial
  CRISPR gRNA sequence
gccgggcgtcatggtgtgca

SEQ ID NO: 101339 - DNA, 20 bp, Artificial
  CRISPR gRNA sequence
tggtcccagctactcaggag

SEQ ID NO: 101340 - DNA, 20 bp, Artificial
  CRISPR gRNA sequence
ctcaggaggctgaggcagga

SEQ ID NO: 101341 - DNA, 20 bp, Artificial
  CRISPR gRNA sequence
aggaggctgaggcaggagaa

SEQ ID NO: 101342 - DNA, 20 bp, Artificial
  CRISPR gRNA sequence
aggcaggagaatcgcttgaa

SEQ ID NO: 101343 - DNA, 20 bp, Artificial
  CRISPR gRNA sequence
gaacctgggaggtggaagtt

SEQ ID NO: 101344 - DNA, 20 bp, Artificial
  CRISPR gRNA sequence
aacctgggaggtggaagttg

SEQ ID NO: 101345 - DNA, 20 bp, Artificial
  CRISPR gRNA sequence
ggaggtggaagttgcagtga

SEQ ID NO: 101346 - DNA, 20 bp, Artificial
  CRISPR gRNA sequence
cagtgagccgagatggcgcc

SEQ ID NO: 101347 - DNA, 20 bp, Artificial
  CRISPR gRNA sequence
cactccagcctgggtgacag

SEQ ID NO: 101348 - DNA, 20 bp, Artificial
  CRISPR gRNA sequence
cagcctgggtgacagcgcga

SEQ ID NO: 101349 - DNA, 20 bp, Artificial
  CRISPR gRNA sequence
ggtgacagcgcgagactcca

SEQ ID NO: 101350 - DNA, 20 bp, Artificial
  CRISPR gRNA sequence
catgtccaaaaaaaaaaaaa

SEQ ID NO: 101351 - DNA, 20 bp, Artificial
  CRISPR gRNA sequence
gccaggcatggtgacgaatg

SEQ ID NO: 101352 - DNA, 20 bp, Artificial
  CRISPR gRNA sequence
tggtcccagctactcgggag

SEQ ID NO: 101353 - DNA, 20 bp, Artificial
  CRISPR gRNA sequence
ctcgggaggctgtggtggga

SEQ ID NO: 101354 - DNA, 20 bp, Artificial
  CRISPR gRNA sequence
gggaggctgtggtgggagga

SEQ ID NO: 101355 - DNA, 20 bp, Artificial
  CRISPR gRNA sequence
tggtgggaggatcacttgag

SEQ ID NO: 101356 - DNA, 20 bp, Artificial
  CRISPR gRNA sequence
gagcctgggagatcgaggct

SEQ ID NO: 101357 - DNA, 20 bp, Artificial
  CRISPR gRNA sequence
agcctgggagatcgaggctg

SEQ ID NO: 101358 - DNA, 20 bp, Artificial
  CRISPR gRNA sequence
ggagatcgaggctgcagtaa

SEQ ID NO: 101359 - DNA, 20 bp, Artificial
  CRISPR gRNA sequence
cagtaagctgtgcctgcacc

SEQ ID NO: 101360 - DNA, 20 bp, Artificial
  CRISPR gRNA sequence
tgcctgcaccacttcattcc

SEQ ID NO: 101361 - DNA, 20 bp, Artificial
  CRISPR gRNA sequence
caccacttcattccagcctg

SEQ ID NO: 101362 - DNA, 20 bp, Artificial
  CRISPR gRNA sequence
cattccagcctgggtgatag

SEQ ID NO: 101363 - DNA, 20 bp, Artificial
  CRISPR gRNA sequence
attccagcctgggtgataga

SEQ ID NO: 101364 - DNA, 20 bp, Artificial
  CRISPR gRNA sequence
cagcctgggtgatagagcaa

SEQ ID NO: 101365 - DNA, 20 bp, Artificial
  CRISPR gRNA sequence
ggtgatagagcaagactttc

SEQ ID NO: 101366 - DNA, 20 bp, Artificial
  CRISPR gRNA sequence
tctgcctcgaacaaaaaaac

SEQ ID NO: 101367 - DNA, 20 bp, Artificial
  CRISPR gRNA sequence
ctgcctcgaacaaaaaaaca

SEQ ID NO: 101368 - DNA, 20 bp, Artificial
  CRISPR gRNA sequence
tgcctcgaacaaaaaaacaa

SEQ ID NO: 101369 - DNA, 20 bp, Artificial
  CRISPR gRNA sequence
cctcgaacaaaaaaacaaac

SEQ ID NO: 101370 - DNA, 20 bp, Artificial
  CRISPR gRNA sequence
gaacaaaaaaacaaaccccc

SEQ ID NO: 101371 - DNA, 20 bp, Artificial
  CRISPR gRNA sequence
ctgtcccaaacacagtaaaa

SEQ ID NO: 101372 - DNA, 20 bp, Artificial
  CRISPR gRNA sequence
tgtcccaaacacagtaaaac

SEQ ID NO: 101373 - DNA, 20 bp, Artificial
  CRISPR gRNA sequence
tcccaaacacagtaaaactc

SEQ ID NO: 101374 - DNA, 20 bp, Artificial
  CRISPR gRNA sequence
tgaaggaaggagggggatat

SEQ ID NO: 101375 - DNA, 20 bp, Artificial
  CRISPR gRNA sequence
aaggaaggagggggatattt

SEQ ID NO: 101376 - DNA, 20 bp, Artificial
  CRISPR gRNA sequence
cctaagcaccccatctctac

SEQ ID NO: 101377 - DNA, 20 bp, Artificial
  CRISPR gRNA sequence
ctaagcaccccatctctacc

SEQ ID NO: 101378 - DNA, 20 bp, Artificial
  CRISPR gRNA sequence
agcaccccatctctaccatg

SEQ ID NO: 101379 - DNA, 20 bp, Artificial
  CRISPR gRNA sequence
taccatgaccccagggggtc

SEQ ID NO: 101380 - DNA, 20 bp, Artificial
  CRISPR gRNA sequence
ccatgaccccagggggtcgg

SEQ ID NO: 101381 - DNA, 20 bp, Artificial
  CRISPR gRNA sequence
aattgggatctccccatttt

SEQ ID NO: 101382 - DNA, 20 bp, Artificial
  CRISPR gRNA sequence
ggatctccccattttatgga

SEQ ID NO: 101383 - DNA, 20 bp, Artificial
  CRISPR gRNA sequence
cccattttatggatggggaa

SEQ ID NO: 101384 - DNA, 20 bp, Artificial
  CRISPR gRNA sequence
tatggatggggaagttgggg

SEQ ID NO: 101385 - DNA, 20 bp, Artificial
  CRISPR gRNA sequence
atggatggggaagttggggt

SEQ ID NO: 101386 - DNA, 20 bp, Artificial
  CRISPR gRNA sequence
tggatggggaagttggggtc

SEQ ID NO: 101387 - DNA, 20 bp, Artificial
  CRISPR gRNA sequence
gggtcccattgtgacagaga

SEQ ID NO: 101388 - DNA, 20 bp, Artificial
  CRISPR gRNA sequence
tgacagagaaaatggagtca

SEQ ID NO: 101389 - DNA, 20 bp, Artificial
  CRISPR gRNA sequence
gggtctgcctatggcccctg

SEQ ID NO: 101390 - DNA, 20 bp, Artificial
  CRISPR gRNA sequence
cctatggcccctgttcaaac

SEQ ID NO: 101391 - DNA, 20 bp, Artificial
  CRISPR gRNA sequence
tggcccctgttcaaacccac

SEQ ID NO: 101392 - DNA, 20 bp, Artificial
  CRISPR gRNA sequence
ttcaaacccactgcccgcca

SEQ ID NO: 101393 - DNA, 20 bp, Artificial
  CRISPR gRNA sequence
aaacccactgcccgccacgg

SEQ ID NO: 101394 - DNA, 20 bp, Artificial
  CRISPR gRNA sequence
cccgccacggagagggatgg

SEQ ID NO: 101395 - DNA, 20 bp, Artificial
  CRISPR gRNA sequence
tgtggctctgtgcactatgg

SEQ ID NO: 101396 - DNA, 20 bp, Artificial
  CRISPR gRNA sequence
tggctctgtgcactatggcc

SEQ ID NO: 101397 - DNA, 20 bp, Artificial
  CRISPR gRNA sequence
tgtgcactatggcctggtcg

SEQ ID NO: 101398 - DNA, 20 bp, Artificial
  CRISPR gRNA sequence
tgcactatggcctggtcgcc

SEQ ID NO: 101399 - DNA, 20 bp, Artificial
  CRISPR gRNA sequence
tggcctggtcgcctacccct

SEQ ID NO: 101400 - DNA, 20 bp, Artificial
  CRISPR gRNA sequence
gtcgcctaccccttggtgtc

SEQ ID NO: 101401 - DNA, 20 bp, Artificial
  CRISPR gRNA sequence
ccccttggtgtcctcactgc

SEQ ID NO: 101402 - DNA, 20 bp, Artificial
  CRISPR gRNA sequence
ggtgtcctcactgccaggcc

SEQ ID NO: 101403 - DNA, 20 bp, Artificial
  CRISPR gRNA sequence
gtgtcctcactgccaggcct

SEQ ID NO: 101404 - DNA, 20 bp, Artificial
  CRISPR gRNA sequence
actgccaggcctccgcaggg

SEQ ID NO: 101405 - DNA, 20 bp, Artificial
  CRISPR gRNA sequence
ccaggcctccgcaggggcca

SEQ ID NO: 101406 - DNA, 20 bp, Artificial
  CRISPR gRNA sequence
cgcaggggccactcctccca

SEQ ID NO: 101407 - DNA, 20 bp, Artificial
  CRISPR gRNA sequence
ctcccacctggatgccattc

SEQ ID NO: 101408 - DNA, 20 bp, Artificial
  CRISPR gRNA sequence
ccacctggatgccattctcc

SEQ ID NO: 101409 - DNA, 20 bp, Artificial
  CRISPR gRNA sequence
gatgccattctccctccctt

SEQ ID NO: 101410 - DNA, 20 bp, Artificial
  CRISPR gRNA sequence
tccctcccttcaggtccccc

SEQ ID NO: 101411 - DNA, 20 bp, Artificial
  CRISPR gRNA sequence
cctcccttcaggtcccccag

SEQ ID NO: 101412 - DNA, 20 bp, Artificial
  CRISPR gRNA sequence
ccttcaggtcccccagaatc

SEQ ID NO: 101413 - DNA, 20 bp, Artificial
  CRISPR gRNA sequence
caggtcccccagaatccttc

SEQ ID NO: 101414 - DNA, 20 bp, Artificial
  CRISPR gRNA sequence
aggtcccccagaatccttcc

SEQ ID NO: 101415 - DNA, 20 bp, Artificial
  CRISPR gRNA sequence
ccctgacctccccatcccag

SEQ ID NO: 101416 - DNA, 20 bp, Artificial
  CRISPR gRNA sequence
cctgacctccccatcccagg

SEQ ID NO: 101417 - DNA, 20 bp, Artificial
  CRISPR gRNA sequence
acctccccatcccagggctg

SEQ ID NO: 101418 - DNA, 20 bp, Artificial
  CRISPR gRNA sequence
cccatcccagggctgggccc

SEQ ID NO: 101419 - DNA, 20 bp, Artificial
  CRISPR gRNA sequence
ggcccacctcacttctcggg

SEQ ID NO: 101420 - DNA, 20 bp, Artificial
  CRISPR gRNA sequence
acttctcggggtctcaacct

SEQ ID NO: 101421 - DNA, 20 bp, Artificial
  CRISPR gRNA sequence
ctcggggtctcaaccttaag

SEQ ID NO: 101422 - DNA, 20 bp, Artificial
  CRISPR gRNA sequence
tcggggtctcaaccttaaga

SEQ ID NO: 101423 - DNA, 20 bp, Artificial
  CRISPR gRNA sequence
ggggtctcaaccttaagaca

SEQ ID NO: 101424 - DNA, 20 bp, Artificial
  CRISPR gRNA sequence
aaccttaagacaccttcctc

SEQ ID NO: 101425 - DNA, 20 bp, Artificial
  CRISPR gRNA sequence
aagacaccttcctccaggaa

SEQ ID NO: 101426 - DNA, 20 bp, Artificial
  CRISPR gRNA sequence
agacaccttcctccaggaag

SEQ ID NO: 101427 - DNA, 20 bp, Artificial
  CRISPR gRNA sequence
cctccaggaagcctctctga

SEQ ID NO: 101428 - DNA, 20 bp, Artificial
  CRISPR gRNA sequence
ctccaggaagcctctctgac

SEQ ID NO: 101429 - DNA, 20 bp, Artificial
  CRISPR gRNA sequence
caggaagcctctctgacttc

SEQ ID NO: 101430 - DNA, 20 bp, Artificial
  CRISPR gRNA sequence
tctgacttctgttggccact

SEQ ID NO: 101431 - DNA, 20 bp, Artificial
  CRISPR gRNA sequence
tgacttctgttggccacttt

SEQ ID NO: 101432 - DNA, 20 bp, Artificial
  CRISPR gRNA sequence
acttctgttggccactttgg

SEQ ID NO: 101433 - DNA, 20 bp, Artificial
  CRISPR gRNA sequence
ctgttggccactttggggct

SEQ ID NO: 101434 - DNA, 20 bp, Artificial
  CRISPR gRNA sequence
tgttggccactttggggctc

SEQ ID NO: 101435 - DNA, 20 bp, Artificial
  CRISPR gRNA sequence
ttggccactttggggctctt

SEQ ID NO: 101436 - DNA, 20 bp, Artificial
  CRISPR gRNA sequence
gccactttggggctctttga

SEQ ID NO: 101437 - DNA, 20 bp, Artificial
  CRISPR gRNA sequence
tggggctctttgatgagagg

SEQ ID NO: 101438 - DNA, 20 bp, Artificial
  CRISPR gRNA sequence
ggggctctttgatgagaggc

SEQ ID NO: 101439 - DNA, 20 bp, Artificial
  CRISPR gRNA sequence
gggctctttgatgagaggcc

SEQ ID NO: 101440 - DNA, 20 bp, Artificial
  CRISPR gRNA sequence
tttgatgagaggcccctctt

SEQ ID NO: 101441 - DNA, 20 bp, Artificial
  CRISPR gRNA sequence
tgatgagaggcccctctttc

SEQ ID NO: 101442 - DNA, 20 bp, Artificial
  CRISPR gRNA sequence
gatgagaggcccctctttcg

SEQ ID NO: 101443 - DNA, 20 bp, Artificial
  CRISPR gRNA sequence
atgagaggcccctctttcgg

SEQ ID NO: 101444 - DNA, 20 bp, Artificial
  CRISPR gRNA sequence
tttcggcctctcatgcctat

SEQ ID NO: 101445 - DNA, 20 bp, Artificial
  CRISPR gRNA sequence
tcggcctctcatgcctatgt

SEQ ID NO: 101446 - DNA, 20 bp, Artificial
  CRISPR gRNA sequence
cggcctctcatgcctatgtg

SEQ ID NO: 101447 - DNA, 20 bp, Artificial
  CRISPR gRNA sequence
ggcctctcatgcctatgtgt

SEQ ID NO: 101448 - DNA, 20 bp, Artificial
  CRISPR gRNA sequence
tcatgcctatgtgtccccca

SEQ ID NO: 101449 - DNA, 20 bp, Artificial
  CRISPR gRNA sequence
atgcctatgtgtcccccatc

SEQ ID NO: 101450 - DNA, 20 bp, Artificial
  CRISPR gRNA sequence
tgtgtcccccatcatggcca

SEQ ID NO: 101451 - DNA, 20 bp, Artificial
  CRISPR gRNA sequence
acacccattgtcctccctac

SEQ ID NO: 101452 - DNA, 20 bp, Artificial
  CRISPR gRNA sequence
tcctccctaccccagcacat

SEQ ID NO: 101453 - DNA, 20 bp, Artificial
  CRISPR gRNA sequence
cctaccccagcacatgtgga

SEQ ID NO: 101454 - DNA, 20 bp, Artificial
  CRISPR gRNA sequence
ccccagcacatgtggagccc

SEQ ID NO: 101455 - DNA, 20 bp, Artificial
  CRISPR gRNA sequence
ggatgttcccaggcgggata

SEQ ID NO: 101456 - DNA, 20 bp, Artificial
  CRISPR gRNA sequence
ccaggcgggatacacagcag

SEQ ID NO: 101457 - DNA, 20 bp, Artificial
  CRISPR gRNA sequence
aacacctgtcaacacactct

SEQ ID NO: 101458 - DNA, 20 bp, Artificial
  CRISPR gRNA sequence
tcaacacactctcgctgccg

SEQ ID NO: 101459 - DNA, 20 bp, Artificial
  CRISPR gRNA sequence
tcgctgccggcgtatgacca

SEQ ID NO: 101460 - DNA, 20 bp, Artificial
  CRISPR gRNA sequence
gctgccggcgtatgaccact

SEQ ID NO: 101461 - DNA, 20 bp, Artificial
  CRISPR gRNA sequence
ccggcgtatgaccactgaag

SEQ ID NO: 101462 - DNA, 20 bp, Artificial
  CRISPR gRNA sequence
aaggggtgtcccatgtaccc

SEQ ID NO: 101463 - DNA, 20 bp, Artificial
  CRISPR gRNA sequence
tatggtcaccctgcctatgg

SEQ ID NO: 101464 - DNA, 20 bp, Artificial
  CRISPR gRNA sequence
atggtcaccctgcctatgga

SEQ ID NO: 101465 - DNA, 20 bp, Artificial
  CRISPR gRNA sequence
tggtcaccctgcctatggaa

SEQ ID NO: 101466 - DNA, 20 bp, Artificial
  CRISPR gRNA sequence
cctatggaagggaccccacc

SEQ ID NO: 101467 - DNA, 20 bp, Artificial
  CRISPR gRNA sequence
tggaagggaccccacccctg

SEQ ID NO: 101468 - DNA, 20 bp, Artificial
  CRISPR gRNA sequence
ctctgtgtgtctcaggctga

SEQ ID NO: 101469 - DNA, 20 bp, Artificial
  CRISPR gRNA sequence
tgtgtgtctcaggctgacct

SEQ ID NO: 101470 - DNA, 20 bp, Artificial
  CRISPR gRNA sequence
tgtgtctcaggctgaccttt

SEQ ID NO: 101471 - DNA, 20 bp, Artificial
  CRISPR gRNA sequence
aggctgacctttccggtatc

SEQ ID NO: 101472 - DNA, 20 bp, Artificial
  CRISPR gRNA sequence
acctttccggtatcccaggg

SEQ ID NO: 101473 - DNA, 20 bp, Artificial
  CRISPR gRNA sequence
tccggtatcccagggccacg

SEQ ID NO: 101474 - DNA, 20 bp, Artificial
  CRISPR gRNA sequence
ccggtatcccagggccacgg

SEQ ID NO: 101475 - DNA, 20 bp, Artificial
  CRISPR gRNA sequence
cggtatcccagggccacggc

SEQ ID NO: 101476 - DNA, 20 bp, Artificial
  CRISPR gRNA sequence
cggtggtgaggtcagcgcct

SEQ ID NO: 101477 - DNA, 20 bp, Artificial
  CRISPR gRNA sequence
ggtggtgaggtcagcgcctc

SEQ ID NO: 101478 - DNA, 20 bp, Artificial
  CRISPR gRNA sequence
gggctgcaaaggagagggga

SEQ ID NO: 101479 - DNA, 20 bp, Artificial
  CRISPR gRNA sequence
caaaggagaggggagggcgc

SEQ ID NO: 101480 - DNA, 20 bp, Artificial
  CRISPR gRNA sequence
gagggtggggcctgggagtc

SEQ ID NO: 101481 - DNA, 20 bp, Artificial
  CRISPR gRNA sequence
ggagtccagaatggggtctg

SEQ ID NO: 101482 - DNA, 20 bp, Artificial
  CRISPR gRNA sequence
gggacctgggagatcccatg

SEQ ID NO: 101483 - DNA, 20 bp, Artificial
  CRISPR gRNA sequence
ggagatcccatggcacccct

SEQ ID NO: 101484 - DNA, 20 bp, Artificial
  CRISPR gRNA sequence
attccccacaatgcagccgt

SEQ ID NO: 101485 - DNA, 20 bp, Artificial
  CRISPR gRNA sequence
cccacaatgcagccgtgggt

SEQ ID NO: 101486 - DNA, 20 bp, Artificial
  CRISPR gRNA sequence
cccgttgcccatgtggcctt

SEQ ID NO: 101487 - DNA, 20 bp, Artificial
  CRISPR gRNA sequence
cccatgtggcctttgacaag

SEQ ID NO: 101488 - DNA, 20 bp, Artificial
  CRISPR gRNA sequence
tgacaagggtccaacctctg

SEQ ID NO: 101489 - DNA, 20 bp, Artificial
  CRISPR gRNA sequence
gacaagggtccaacctctgc

SEQ ID NO: 101490 - DNA, 20 bp, Artificial
  CRISPR gRNA sequence
acaagggtccaacctctgct

SEQ ID NO: 101491 - DNA, 20 bp, Artificial
  CRISPR gRNA sequence
tgctatcttggtctccactg

SEQ ID NO: 101492 - DNA, 20 bp, Artificial
  CRISPR gRNA sequence
ctatcttggtctccactgaa

SEQ ID NO: 101493 - DNA, 20 bp, Artificial
  CRISPR gRNA sequence
tcttggtctccactgaagaa

SEQ ID NO: 101494 - DNA, 20 bp, Artificial
  CRISPR gRNA sequence
ggtctccactgaagaacgtg

SEQ ID NO: 101495 - DNA, 20 bp, Artificial
  CRISPR gRNA sequence
gtctccactgaagaacgtgg

SEQ ID NO: 101496 - DNA, 20 bp, Artificial
  CRISPR gRNA sequence
cactgaagaacgtggctgaa

SEQ ID NO: 101497 - DNA, 20 bp, Artificial
  CRISPR gRNA sequence
aagaacgtggctgaagggtc

SEQ ID NO: 101498 - DNA, 20 bp, Artificial
  CRISPR gRNA sequence
aagggtctctgaaccatgga

SEQ ID NO: 101499 - DNA, 20 bp, Artificial
  CRISPR gRNA sequence
tgaaccatggaggatggagg

SEQ ID NO: 101500 - DNA, 20 bp, Artificial
  CRISPR gRNA sequence
aaccatggaggatggaggtg

SEQ ID NO: 101501 - DNA, 20 bp, Artificial
  CRISPR gRNA sequence
agcctcttggccagatccta

SEQ ID NO: 101502 - DNA, 20 bp, Artificial
  CRISPR gRNA sequence
gcctcttggccagatcctaa

SEQ ID NO: 101503 - DNA, 20 bp, Artificial
  CRISPR gRNA sequence
ttggccagatcctaaaccca

SEQ ID NO: 101504 - DNA, 20 bp, Artificial
  CRISPR gRNA sequence
ggccagatcctaaacccaga

SEQ ID NO: 101505 - DNA, 20 bp, Artificial
  CRISPR gRNA sequence
gccagatcctaaacccagac

SEQ ID NO: 101506 - DNA, 20 bp, Artificial
  CRISPR gRNA sequence
aacccagaccccgactcccg

SEQ ID NO: 101507 - DNA, 20 bp, Artificial
  CRISPR gRNA sequence
ccgtgtggtcctaccacctc

SEQ ID NO: 101508 - DNA, 20 bp, Artificial
  CRISPR gRNA sequence
ccacctcctcccctctgatc

SEQ ID NO: 101509 - DNA, 20 bp, Artificial
  CRISPR gRNA sequence
ctcccctctgatccatcctc

SEQ ID NO: 101510 - DNA, 20 bp, Artificial
  CRISPR gRNA sequence
ccctctgatccatcctccga

SEQ ID NO: 101511 - DNA, 20 bp, Artificial
  CRISPR gRNA sequence
tgatccatcctccgagaaga

SEQ ID NO: 101512 - DNA, 20 bp, Artificial
  CRISPR gRNA sequence
atccatcctccgagaagagc

SEQ ID NO: 101513 - DNA, 20 bp, Artificial
  CRISPR gRNA sequence
cgagaagagcaggcagggac

SEQ ID NO: 101514 - DNA, 20 bp, Artificial
  CRISPR gRNA sequence
cctgctccaagaactcttca

SEQ ID NO: 101515 - DNA, 20 bp, Artificial
  CRISPR gRNA sequence
ctccaagaactcttcaagca

SEQ ID NO: 101516 - DNA, 20 bp, Artificial
  CRISPR gRNA sequence
caagaactcttcaagcaaca

SEQ ID NO: 101517 - DNA, 20 bp, Artificial
  CRISPR gRNA sequence
ttcaagcaacacttgggcgt

SEQ ID NO: 101518 - DNA, 20 bp, Artificial
  CRISPR gRNA sequence
caagcaacacttgggcgtct

SEQ ID NO: 101519 - DNA, 20 bp, Artificial
  CRISPR gRNA sequence
aagcaacacttgggcgtctc

SEQ ID NO: 101520 - DNA, 20 bp, Artificial
  CRISPR gRNA sequence
gggcgtctccctgccctcag

SEQ ID NO: 101521 - DNA, 20 bp, Artificial
  CRISPR gRNA sequence
ggcgtctccctgccctcagg

SEQ ID NO: 101522 - DNA, 20 bp, Artificial
  CRISPR gRNA sequence
cctgccctcaggattcccgc

SEQ ID NO: 101523 - DNA, 20 bp, Artificial
  CRISPR gRNA sequence
ccctcaggattcccgcaggg

SEQ ID NO: 101524 - DNA, 20 bp, Artificial
  CRISPR gRNA sequence
aggattcccgcagggcccgc

SEQ ID NO: 101525 - DNA, 20 bp, Artificial
  CRISPR gRNA sequence
ccgcagggcccgctggagtg

SEQ ID NO: 101526 - DNA, 20 bp, Artificial
  CRISPR gRNA sequence
gagtgctggggcccccaggg

SEQ ID NO: 101527 - DNA, 20 bp, Artificial
  CRISPR gRNA sequence
gggcccccagggccactccc

SEQ ID NO: 101528 - DNA, 20 bp, Artificial
  CRISPR gRNA sequence
ccgactcccactcacccagc

SEQ ID NO: 101529 - DNA, 20 bp, Artificial
  CRISPR gRNA sequence
ccactcacccagcaaggcct

SEQ ID NO: 101530 - DNA, 20 bp, Artificial
  CRISPR gRNA sequence
acccagcaaggcctcaacgc

SEQ ID NO: 101531 - DNA, 20 bp, Artificial
  CRISPR gRNA sequence
aacgcatttcacgtggttcc

SEQ ID NO: 101532 - DNA, 20 bp, Artificial
  CRISPR gRNA sequence
cacgtggttcccgcgcacag

SEQ ID NO: 101533 - DNA, 20 bp, Artificial
  CRISPR gRNA sequence
acgtggttcccgcgcacagc

SEQ ID NO: 101534 - DNA, 20 bp, Artificial
  CRISPR gRNA sequence
ccgcgcacagcgtacagcag

SEQ ID NO: 101535 - DNA, 20 bp, Artificial
  CRISPR gRNA sequence
cattctgtcgtgggtagggg

SEQ ID NO: 101536 - DNA, 20 bp, Artificial
  CRISPR gRNA sequence
tgtcgtgggtaggggcagga

SEQ ID NO: 101537 - DNA, 20 bp, Artificial
  CRISPR gRNA sequence
tcgtgggtaggggcaggaga

SEQ ID NO: 101538 - DNA, 20 bp, Artificial
  CRISPR gRNA sequence
acctcttcctcattctcaaa

SEQ ID NO: 101539 - DNA, 20 bp, Artificial
  CRISPR gRNA sequence
cctcttcctcattctcaaaa

SEQ ID NO: 101540 - DNA, 20 bp, Artificial
  CRISPR gRNA sequence
ttcctcattctcaaaatgcc

SEQ ID NO: 101541 - DNA, 20 bp, Artificial
  CRISPR gRNA sequence
cctcattctcaaaatgcctt

SEQ ID NO: 101542 - DNA, 20 bp, Artificial
  CRISPR gRNA sequence
ctcattctcaaaatgccttg

SEQ ID NO: 101543 - DNA, 20 bp, Artificial
  CRISPR gRNA sequence
attctcaaaatgccttgtac

SEQ ID NO: 101544 - DNA, 20 bp, Artificial
  CRISPR gRNA sequence
tcaaaatgccttgtactctc

SEQ ID NO: 101545 - DNA, 20 bp, Artificial
  CRISPR gRNA sequence
aaaatgccttgtactctctg

SEQ ID NO: 101546 - DNA, 20 bp, Artificial
  CRISPR gRNA sequence
gtactctctggcctccagtt

SEQ ID NO: 101547 - DNA, 20 bp, Artificial
  CRISPR gRNA sequence
tactctctggcctccagttg

SEQ ID NO: 101548 - DNA, 20 bp, Artificial
  CRISPR gRNA sequence
tctggcctccagttgaacgt

SEQ ID NO: 101549 - DNA, 20 bp, Artificial
  CRISPR gRNA sequence
tggcctccagttgaacgtgg

SEQ ID NO: 101550 - DNA, 20 bp, Artificial
  CRISPR gRNA sequence
gcctccagttgaacgtggtt

SEQ ID NO: 101551 - DNA, 20 bp, Artificial
  CRISPR gRNA sequence
cagttgaacgtggttcctcc

SEQ ID NO: 101552 - DNA, 20 bp, Artificial
  CRISPR gRNA sequence
aacgtggttcctcctgctca

SEQ ID NO: 101553 - DNA, 20 bp, Artificial
  CRISPR gRNA sequence
ctcctgctcatcactgggcc

SEQ ID NO: 101554 - DNA, 20 bp, Artificial
  CRISPR gRNA sequence
ctgctcatcactgggcccat

SEQ ID NO: 101555 - DNA, 20 bp, Artificial
  CRISPR gRNA sequence
ctcatcactgggcccatctc

SEQ ID NO: 101556 - DNA, 20 bp, Artificial
  CRISPR gRNA sequence
atcactgggcccatctcact

SEQ ID NO: 101557 - DNA, 20 bp, Artificial
  CRISPR gRNA sequence
ggcccatctcactttctggg

SEQ ID NO: 101558 - DNA, 20 bp, Artificial
  CRISPR gRNA sequence
actttctggggtctcaagct

SEQ ID NO: 101559 - DNA, 20 bp, Artificial
  CRISPR gRNA sequence
tctggggtctcaagcttaga

SEQ ID NO: 101560 - DNA, 20 bp, Artificial
  CRISPR gRNA sequence
ctggggtctcaagcttagac

SEQ ID NO: 101561 - DNA, 20 bp, Artificial
  CRISPR gRNA sequence
tggggtctcaagcttagaca

SEQ ID NO: 101562 - DNA, 20 bp, Artificial
  CRISPR gRNA sequence
gggtctcaagcttagacacc

SEQ ID NO: 101563 - DNA, 20 bp, Artificial
  CRISPR gRNA sequence
aagcttagacaccttcctcc

SEQ ID NO: 101564 - DNA, 20 bp, Artificial
  CRISPR gRNA sequence
agacaccttcctccaggaag

SEQ ID NO: 101565 - DNA, 20 bp, Artificial
  CRISPR gRNA sequence
gacaccttcctccaggaaga

SEQ ID NO: 101566 - DNA, 20 bp, Artificial
  CRISPR gRNA sequence
cctccaggaagacctctctg

SEQ ID NO: 101567 - DNA, 20 bp, Artificial
  CRISPR gRNA sequence
ctccaggaagacctctctga

SEQ ID NO: 101568 - DNA, 20 bp, Artificial
  CRISPR gRNA sequence
caggaagacctctctgattt

SEQ ID NO: 101569 - DNA, 20 bp, Artificial
  CRISPR gRNA sequence
tctgatttcccttgcccaca

SEQ ID NO: 101570 - DNA, 20 bp, Artificial
  CRISPR gRNA sequence
tgatttcccttgcccacatg

SEQ ID NO: 101571 - DNA, 20 bp, Artificial
  CRISPR gRNA sequence
atttcccttgcccacatggg

SEQ ID NO: 101572 - DNA, 20 bp, Artificial
  CRISPR gRNA sequence
cccttgcccacatggggctc

SEQ ID NO: 101573 - DNA, 20 bp, Artificial
  CRISPR gRNA sequence
ccttgcccacatggggctct

SEQ ID NO: 101574 - DNA, 20 bp, Artificial
  CRISPR gRNA sequence
gcccacatggggctcttgta

SEQ ID NO: 101575 - DNA, 20 bp, Artificial
  CRISPR gRNA sequence
cccacatggggctcttgtag

SEQ ID NO: 101576 - DNA, 20 bp, Artificial
  CRISPR gRNA sequence
ttgtagccacctgtgcatct

SEQ ID NO: 101577 - DNA, 20 bp, Artificial
  CRISPR gRNA sequence
gtagccacctgtgcatctgc

SEQ ID NO: 101578 - DNA, 20 bp, Artificial
  CRISPR gRNA sequence
tagccacctgtgcatctgcc

SEQ ID NO: 101579 - DNA, 20 bp, Artificial
  CRISPR gRNA sequence
tgcatctgccatcgcagcgc

SEQ ID NO: 101580 - DNA, 20 bp, Artificial
  CRISPR gRNA sequence
ccatcgcagcgcagttcact

SEQ ID NO: 101581 - DNA, 20 bp, Artificial
  CRISPR gRNA sequence
actgcatctcagctgcctgt

SEQ ID NO: 101582 - DNA, 20 bp, Artificial
  CRISPR gRNA sequence
catctcagctgcctgtttcc

SEQ ID NO: 101583 - DNA, 20 bp, Artificial
  CRISPR gRNA sequence
agctgcctgtttccatgtct

SEQ ID NO: 101584 - DNA, 20 bp, Artificial
  CRISPR gRNA sequence
cctgtttccatgtctgcctt

SEQ ID NO: 101585 - DNA, 20 bp, Artificial
  CRISPR gRNA sequence
tttccatgtctgccttccct

SEQ ID NO: 101586 - DNA, 20 bp, Artificial
  CRISPR gRNA sequence
ccatgtctgccttccctgca

SEQ ID NO: 101587 - DNA, 20 bp, Artificial
  CRISPR gRNA sequence
catgtctgccttccctgcat

SEQ ID NO: 101588 - DNA, 20 bp, Artificial
  CRISPR gRNA sequence
ccttccctgcatggggagct

SEQ ID NO: 101589 - DNA, 20 bp, Artificial
  CRISPR gRNA sequence
ccctgcatggggagctctgc

SEQ ID NO: 101590 - DNA, 20 bp, Artificial
  CRISPR gRNA sequence
cctgcatggggagctctgct

SEQ ID NO: 101591 - DNA, 20 bp, Artificial
  CRISPR gRNA sequence
catggggagctctgctctgt

SEQ ID NO: 101592 - DNA, 20 bp, Artificial
  CRISPR gRNA sequence
tgctctgtgaggctgggaat

SEQ ID NO: 101593 - DNA, 20 bp, Artificial
  CRISPR gRNA sequence
ctctgtgaggctgggaatgg

SEQ ID NO: 101594 - DNA, 20 bp, Artificial
  CRISPR gRNA sequence
tgtgaggctgggaatggggc

SEQ ID NO: 101595 - DNA, 20 bp, Artificial
  CRISPR gRNA sequence
tgaggctgggaatggggctg

SEQ ID NO: 101596 - DNA, 20 bp, Artificial
  CRISPR gRNA sequence
ggaatggggctgtctcgtgt

SEQ ID NO: 101597 - DNA, 20 bp, Artificial
  CRISPR gRNA sequence
tctcgtgttctcggcaccta

SEQ ID NO: 101598 - DNA, 20 bp, Artificial
  CRISPR gRNA sequence
gtgttctcggcacctagagc

SEQ ID NO: 101599 - DNA, 20 bp, Artificial
  CRISPR gRNA sequence
tcggcacctagagcaggcct

SEQ ID NO: 101600 - DNA, 20 bp, Artificial
  CRISPR gRNA sequence
ggcacctagagcaggcctgc

SEQ ID NO: 101601 - DNA, 20 bp, Artificial
  CRISPR gRNA sequence
gagcaggcctgcacctttca

SEQ ID NO: 101602 - DNA, 20 bp, Artificial
  CRISPR gRNA sequence
cacctttcaagtactctgtg

SEQ ID NO: 101603 - DNA, 20 bp, Artificial
  CRISPR gRNA sequence
tcaagtactctgtgaacatt

SEQ ID NO: 101604 - DNA, 20 bp, Artificial
  CRISPR gRNA sequence
caagtactctgtgaacattt

SEQ ID NO: 101605 - DNA, 20 bp, Artificial
  CRISPR gRNA sequence
aagtactctgtgaacatttg

SEQ ID NO: 101606 - DNA, 20 bp, Artificial
  CRISPR gRNA sequence
tgtgaacatttgaggcagga

SEQ ID NO: 101607 - DNA, 20 bp, Artificial
  CRISPR gRNA sequence
tgaacatttgaggcaggaat

SEQ ID NO: 101608 - DNA, 20 bp, Artificial
  CRISPR gRNA sequence
gaggcaggaatgaaggccag

SEQ ID NO: 101609 - DNA, 20 bp, Artificial
  CRISPR gRNA sequence
aggcaggaatgaaggccagg

SEQ ID NO: 101610 - DNA, 20 bp, Artificial
  CRISPR gRNA sequence
agaggtcctggggatgggca

SEQ ID NO: 101611 - DNA, 20 bp, Artificial
  CRISPR gRNA sequence
gggatgggcagtccctcacc

SEQ ID NO: 101612 - DNA, 20 bp, Artificial
  CRISPR gRNA sequence
acccaatcatagatgttgat

SEQ ID NO: 101613 - DNA, 20 bp, Artificial
  CRISPR gRNA sequence
atgtccacgtcacgctccag

SEQ ID NO: 101614 - DNA, 20 bp, Artificial
  CRISPR gRNA sequence
cagcagcagccccacaatgt

SEQ ID NO: 101615 - DNA, 20 bp, Artificial
  CRISPR gRNA sequence
tgtagccgcctgtgctggcc

SEQ ID NO: 101616 - DNA, 20 bp, Artificial
  CRISPR gRNA sequence
tgctggccagcgacagggcg

SEQ ID NO: 101617 - DNA, 20 bp, Artificial
  CRISPR gRNA sequence
gccagcgacagggcgctctc

SEQ ID NO: 101618 - DNA, 20 bp, Artificial
  CRISPR gRNA sequence
tctcgctcttttgccaggat

SEQ ID NO: 101619 - DNA, 20 bp, Artificial
  CRISPR gRNA sequence
tcgctcttttgccaggatgt

SEQ ID NO: 101620 - DNA, 20 bp, Artificial
  CRISPR gRNA sequence
gctcttttgccaggatgtgg

SEQ ID NO: 101621 - DNA, 20 bp, Artificial
  CRISPR gRNA sequence
ttttgccaggatgtgggggt

SEQ ID NO: 101622 - DNA, 20 bp, Artificial
  CRISPR gRNA sequence
ttgccaggatgtgggggtcg

SEQ ID NO: 101623 - DNA, 20 bp, Artificial
  CRISPR gRNA sequence
tgccaggatgtgggggtcgg

SEQ ID NO: 101624 - DNA, 20 bp, Artificial
  CRISPR gRNA sequence
gccaggatgtgggggtcggc

SEQ ID NO: 101625 - DNA, 20 bp, Artificial
  CRISPR gRNA sequence
ccaggatgtgggggtcggca

SEQ ID NO: 101626 - DNA, 20 bp, Artificial
  CRISPR gRNA sequence
cagggagaagaagggacagt

SEQ ID NO: 101627 - DNA, 20 bp, Artificial
  CRISPR gRNA sequence
gggcataaccaggaatcctg

SEQ ID NO: 101628 - DNA, 20 bp, Artificial
  CRISPR gRNA sequence
gggtacccacagcagccgca

SEQ ID NO: 101629 - DNA, 20 bp, Artificial
  CRISPR gRNA sequence
tttttttttttttggagata

SEQ ID NO: 101630 - DNA, 20 bp, Artificial
  CRISPR gRNA sequence
ttttttttttttggagatag

SEQ ID NO: 101631 - DNA, 20 bp, Artificial
  CRISPR gRNA sequence
tttttttttttggagataga

SEQ ID NO: 101632 - DNA, 20 bp, Artificial
  CRISPR gRNA sequence
ttttttttttggagatagag

SEQ ID NO: 101633 - DNA, 20 bp, Artificial
  CRISPR gRNA sequence
tttttttttggagatagagt

SEQ ID NO: 101634 - DNA, 20 bp, Artificial
  CRISPR gRNA sequence
ttttttttggagatagagtc

SEQ ID NO: 101635 - DNA, 20 bp, Artificial
  CRISPR gRNA sequence
tttttttggagatagagtct

SEQ ID NO: 101636 - DNA, 20 bp, Artificial
  CRISPR gRNA sequence
ttttttggagatagagtctt

SEQ ID NO: 101637 - DNA, 20 bp, Artificial
  CRISPR gRNA sequence
tttttggagatagagtcttg

SEQ ID NO: 101638 - DNA, 20 bp, Artificial
  CRISPR gRNA sequence
ttttggagatagagtcttgc

SEQ ID NO: 101639 - DNA, 20 bp, Artificial
  CRISPR gRNA sequence
tttggagatagagtcttgct

SEQ ID NO: 101640 - DNA, 20 bp, Artificial
  CRISPR gRNA sequence
ttggagatagagtcttgctc

SEQ ID NO: 101641 - DNA, 20 bp, Artificial
  CRISPR gRNA sequence
tggagatagagtcttgctct

SEQ ID NO: 101642 - DNA, 20 bp, Artificial
  CRISPR gRNA sequence
ggagatagagtcttgctctg

SEQ ID NO: 101643 - DNA, 20 bp, Artificial
  CRISPR gRNA sequence
gagatagagtcttgctctgt

SEQ ID NO: 101644 - DNA, 20 bp, Artificial
  CRISPR gRNA sequence
gctctgttgcccaggctgga

SEQ ID NO: 101645 - DNA, 20 bp, Artificial
  CRISPR gRNA sequence
ctctgttgcccaggctggag

SEQ ID NO: 101646 - DNA, 20 bp, Artificial
  CRISPR gRNA sequence
tgttgcccaggctggagtgc

SEQ ID NO: 101647 - DNA, 20 bp, Artificial
  CRISPR gRNA sequence
ttgcccaggctggagtgcag

SEQ ID NO: 101648 - DNA, 20 bp, Artificial
  CRISPR gRNA sequence
cccaggctggagtgcagtgg

SEQ ID NO: 101649 - DNA, 20 bp, Artificial
  CRISPR gRNA sequence
gagtgcagtggcgcaatctc

SEQ ID NO: 101650 - DNA, 20 bp, Artificial
  CRISPR gRNA sequence
ggctcactgctacctccgcc

SEQ ID NO: 101651 - DNA, 20 bp, Artificial
  CRISPR gRNA sequence
actgctacctccgcctccca

SEQ ID NO: 101652 - DNA, 20 bp, Artificial
  CRISPR gRNA sequence
ctacctccgcctcccaggtt

SEQ ID NO: 101653 - DNA, 20 bp, Artificial
  CRISPR gRNA sequence
cctccgcctcccaggttcac

SEQ ID NO: 101654 - DNA, 20 bp, Artificial
  CRISPR gRNA sequence
cgcctcccaggttcacacag

SEQ ID NO: 101655 - DNA, 20 bp, Artificial
  CRISPR gRNA sequence
ccaggttcacacagttctcc

SEQ ID NO: 101656 - DNA, 20 bp, Artificial
  CRISPR gRNA sequence
acacagttctcccacctcag

SEQ ID NO: 101657 - DNA, 20 bp, Artificial
  CRISPR gRNA sequence
tcccacctcagcctccagag

SEQ ID NO: 101658 - DNA, 20 bp, Artificial
  CRISPR gRNA sequence
ccacctcagcctccagagta

SEQ ID NO: 101659 - DNA, 20 bp, Artificial
  CRISPR gRNA sequence
agcctccagagtacctggga

SEQ ID NO: 101660 - DNA, 20 bp, Artificial
  CRISPR gRNA sequence
cagagtacctgggattacag

SEQ ID NO: 101661 - DNA, 20 bp, Artificial
  CRISPR gRNA sequence
ggattacaggcacccaccac

SEQ ID NO: 101662 - DNA, 20 bp, Artificial
  CRISPR gRNA sequence
caggcacccaccacgacgcc

SEQ ID NO: 101663 - DNA, 20 bp, Artificial
  CRISPR gRNA sequence
gctaatttttgtattttttt

SEQ ID NO: 101664 - DNA, 20 bp, Artificial
  CRISPR gRNA sequence
atttttgtatttttttagta

SEQ ID NO: 101665 - DNA, 20 bp, Artificial
  CRISPR gRNA sequence
ttgtatttttttagtagaga

SEQ ID NO: 101666 - DNA, 20 bp, Artificial
  CRISPR gRNA sequence
tgtatttttttagtagagac

SEQ ID NO: 101667 - DNA, 20 bp, Artificial
  CRISPR gRNA sequence
gtatttttttagtagagaca

SEQ ID NO: 101668 - DNA, 20 bp, Artificial
  CRISPR gRNA sequence
tatttttttagtagagacag

SEQ ID NO: 101669 - DNA, 20 bp, Artificial
  CRISPR gRNA sequence
ttttagtagagacagggttt

SEQ ID NO: 101670 - DNA, 20 bp, Artificial
  CRISPR gRNA sequence
tttagtagagacagggtttc

SEQ ID NO: 101671 - DNA, 20 bp, Artificial
  CRISPR gRNA sequence
ttagtagagacagggtttca

SEQ ID NO: 101672 - DNA, 20 bp, Artificial
  CRISPR gRNA sequence
tagtagagacagggtttcac

SEQ ID NO: 101673 - DNA, 20 bp, Artificial
  CRISPR gRNA sequence
agtagagacagggtttcacc

SEQ ID NO: 101674 - DNA, 20 bp, Artificial
  CRISPR gRNA sequence
gtagagacagggtttcaccc

SEQ ID NO: 101675 - DNA, 20 bp, Artificial
  CRISPR gRNA sequence
cacccatgttggccgggctg

SEQ ID NO: 101676 - DNA, 20 bp, Artificial
  CRISPR gRNA sequence
acccatgttggccgggctgg

SEQ ID NO: 101677 - DNA, 20 bp, Artificial
  CRISPR gRNA sequence
gccgggctggtcttgaactc

SEQ ID NO: 101678 - DNA, 20 bp, Artificial
  CRISPR gRNA sequence
gtcttgaactcctgacctca

SEQ ID NO: 101679 - DNA, 20 bp, Artificial
  CRISPR gRNA sequence
gaactcctgacctcaagtga

SEQ ID NO: 101680 - DNA, 20 bp, Artificial
  CRISPR gRNA sequence
aactcctgacctcaagtgat

SEQ ID NO: 101681 - DNA, 20 bp, Artificial
  CRISPR gRNA sequence
ctgacctcaagtgatccacc

SEQ ID NO: 101682 - DNA, 20 bp, Artificial
  CRISPR gRNA sequence
acctcaagtgatccacccgc

SEQ ID NO: 101683 - DNA, 20 bp, Artificial
  CRISPR gRNA sequence
aagtgatccacccgcctcgg

SEQ ID NO: 101684 - DNA, 20 bp, Artificial
  CRISPR gRNA sequence
ggcctcccaaagtgctggga

SEQ ID NO: 101685 - DNA, 20 bp, Artificial
  CRISPR gRNA sequence
ccaaagtgctgggattacag

SEQ ID NO: 101686 - DNA, 20 bp, Artificial
  CRISPR gRNA sequence
ggattacaggcatgagccac

SEQ ID NO: 101687 - DNA, 20 bp, Artificial
  CRISPR gRNA sequence
caggcatgagccactgcacc

SEQ ID NO: 101688 - DNA, 20 bp, Artificial
  CRISPR gRNA sequence
cacccagccagcagccgcat

SEQ ID NO: 101689 - DNA, 20 bp, Artificial
  CRISPR gRNA sequence
aaagacaaggcgccagcaga

SEQ ID NO: 101690 - DNA, 20 bp, Artificial
  CRISPR gRNA sequence
aggcccccgggaacccccca

SEQ ID NO: 101691 - DNA, 20 bp, Artificial
  CRISPR gRNA sequence
cccagctgggctgggacgca

SEQ ID NO: 101692 - DNA, 20 bp, Artificial
  CRISPR gRNA sequence
ggctgggacgcacccactcc

SEQ ID NO: 101693 - DNA, 20 bp, Artificial
  CRISPR gRNA sequence
ggacgcacccactccagcag

SEQ ID NO: 101694 - DNA, 20 bp, Artificial
  CRISPR gRNA sequence
cagcaggaagcgaacggtct

SEQ ID NO: 101695 - DNA, 20 bp, Artificial
  CRISPR gRNA sequence
aatctctccaaaggcggagg

SEQ ID NO: 101696 - DNA, 20 bp, Artificial
  CRISPR gRNA sequence
tccaaaggcggaggcccaga

SEQ ID NO: 101697 - DNA, 20 bp, Artificial
  CRISPR gRNA sequence
caaaggcggaggcccagatg

SEQ ID NO: 101698 - DNA, 20 bp, Artificial
  CRISPR gRNA sequence
gtctggcttgttgacgaggt

SEQ ID NO: 101699 - DNA, 20 bp, Artificial
  CRISPR gRNA sequence
gcttgttgacgaggttgtca

SEQ ID NO: 101700 - DNA, 20 bp, Artificial
  CRISPR gRNA sequence
gttgacgaggttgtcacctg

SEQ ID NO: 101701 - DNA, 20 bp, Artificial
  CRISPR gRNA sequence
ttgacgaggttgtcacctgg

SEQ ID NO: 101702 - DNA, 20 bp, Artificial
  CRISPR gRNA sequence
acgaggttgtcacctggcag

SEQ ID NO: 101703 - DNA, 20 bp, Artificial
  CRISPR gRNA sequence
tcacctggcaggaggaggcg

SEQ ID NO: 101704 - DNA, 20 bp, Artificial
  CRISPR gRNA sequence
gcaggaggaggcgggcaata

SEQ ID NO: 101705 - DNA, 20 bp, Artificial
  CRISPR gRNA sequence
cacccctgccccctatcccc

SEQ ID NO: 101706 - DNA, 20 bp, Artificial
  CRISPR gRNA sequence
ccccctatccccagtgctgc

SEQ ID NO: 101707 - DNA, 20 bp, Artificial
  CRISPR gRNA sequence
tccccagtgctgccaaatgg

SEQ ID NO: 101708 - DNA, 20 bp, Artificial
  CRISPR gRNA sequence
ccaaatggggacgaggtggg

SEQ ID NO: 101709 - DNA, 20 bp, Artificial
  CRISPR gRNA sequence
gggttagacaggggaatgag

SEQ ID NO: 101710 - DNA, 20 bp, Artificial
  CRISPR gRNA sequence
gacaggggaatgagggggag

SEQ ID NO: 101711 - DNA, 20 bp, Artificial
  CRISPR gRNA sequence
atggacatacatgaacacgg

SEQ ID NO: 101712 - DNA, 20 bp, Artificial
  CRISPR gRNA sequence
gatacaatcatacacgtgga

SEQ ID NO: 101713 - DNA, 20 bp, Artificial
  CRISPR gRNA sequence
acaggtcacgtcatgagtgg

SEQ ID NO: 101714 - DNA, 20 bp, Artificial
  CRISPR gRNA sequence
tccgcaaatgctccttcagc

SEQ ID NO: 101715 - DNA, 20 bp, Artificial
  CRISPR gRNA sequence
ccgcaaatgctccttcagct

SEQ ID NO: 101716 - DNA, 20 bp, Artificial
  CRISPR gRNA sequence
cgcaaatgctccttcagctg

SEQ ID NO: 101717 - DNA, 20 bp, Artificial
  CRISPR gRNA sequence
cttcagctggtccagctccc

SEQ ID NO: 101718 - DNA, 20 bp, Artificial
  CRISPR gRNA sequence
cagctggtccagctccccct

SEQ ID NO: 101719 - DNA, 20 bp, Artificial
  CRISPR gRNA sequence
agctggtccagctccccctg

SEQ ID NO: 101720 - DNA, 20 bp, Artificial
  CRISPR gRNA sequence
gtccagctccccctgtgctg

SEQ ID NO: 101721 - DNA, 20 bp, Artificial
  CRISPR gRNA sequence
cccctgtgctgcgagctggt

SEQ ID NO: 101722 - DNA, 20 bp, Artificial
  CRISPR gRNA sequence
tgctgcgagctggtggatgg

SEQ ID NO: 101723 - DNA, 20 bp, Artificial
  CRISPR gRNA sequence
cgagctggtggatggacagg

SEQ ID NO: 101724 - DNA, 20 bp, Artificial
  CRISPR gRNA sequence
gtggatggacagggctgggg

SEQ ID NO: 101725 - DNA, 20 bp, Artificial
  CRISPR gRNA sequence
gggcaggacagaggcagagt

SEQ ID NO: 101726 - DNA, 20 bp, Artificial
  CRISPR gRNA sequence
actcatccccttgcttctct

SEQ ID NO: 101727 - DNA, 20 bp, Artificial
  CRISPR gRNA sequence
atccccttgcttctctgtgc

SEQ ID NO: 101728 - DNA, 20 bp, Artificial
  CRISPR gRNA sequence
gcttctctgtgcctcagttt

SEQ ID NO: 101729 - DNA, 20 bp, Artificial
  CRISPR gRNA sequence
cttctctgtgcctcagttta

SEQ ID NO: 101730 - DNA, 20 bp, Artificial
  CRISPR gRNA sequence
ctctgtgcctcagtttaccc

SEQ ID NO: 101731 - DNA, 20 bp, Artificial
  CRISPR gRNA sequence
tctgtgcctcagtttaccct

SEQ ID NO: 101732 - DNA, 20 bp, Artificial
  CRISPR gRNA sequence
tgtgcctcagtttaccctct

SEQ ID NO: 101733 - DNA, 20 bp, Artificial
  CRISPR gRNA sequence
tgcctcagtttaccctctgt

SEQ ID NO: 101734 - DNA, 20 bp, Artificial
  CRISPR gRNA sequence
agtttaccctctgtccacga

SEQ ID NO: 101735 - DNA, 20 bp, Artificial
  CRISPR gRNA sequence
accctctgtccacgattgct

SEQ ID NO: 101736 - DNA, 20 bp, Artificial
  CRISPR gRNA sequence
ccctctgtccacgattgctc

SEQ ID NO: 101737 - DNA, 20 bp, Artificial
  CRISPR gRNA sequence
tgtccacgattgctcctcac

SEQ ID NO: 101738 - DNA, 20 bp, Artificial
  CRISPR gRNA sequence
tccacgattgctcctcacag

SEQ ID NO: 101739 - DNA, 20 bp, Artificial
  CRISPR gRNA sequence
ctcctcacaggccctcccac

SEQ ID NO: 101740 - DNA, 20 bp, Artificial
  CRISPR gRNA sequence
ctcacaggccctcccaccct

SEQ ID NO: 101741 - DNA, 20 bp, Artificial
  CRISPR gRNA sequence
acaggccctcccaccctcct

SEQ ID NO: 101742 - DNA, 20 bp, Artificial
  CRISPR gRNA sequence
ccaccctcctactcctctcc

SEQ ID NO: 101743 - DNA, 20 bp, Artificial
  CRISPR gRNA sequence
ctactcctctccttgttggg

SEQ ID NO: 101744 - DNA, 20 bp, Artificial
  CRISPR gRNA sequence
ctcctctccttgttggggac

SEQ ID NO: 101745 - DNA, 20 bp, Artificial
  CRISPR gRNA sequence
ctctccttgttggggaccgt

SEQ ID NO: 101746 - DNA, 20 bp, Artificial
  CRISPR gRNA sequence
tccttgttggggaccgtggg

SEQ ID NO: 101747 - DNA, 20 bp, Artificial
  CRISPR gRNA sequence
cttgttggggaccgtgggcc

SEQ ID NO: 101748 - DNA, 20 bp, Artificial
  CRISPR gRNA sequence
gttggggaccgtgggcccac

SEQ ID NO: 101749 - DNA, 20 bp, Artificial
  CRISPR gRNA sequence
ttggggaccgtgggcccact

SEQ ID NO: 101750 - DNA, 20 bp, Artificial
  CRISPR gRNA sequence
gggaccgtgggcccactcac

SEQ ID NO: 101751 - DNA, 20 bp, Artificial
  CRISPR gRNA sequence
acagtctagggtggccggca

SEQ ID NO: 101752 - DNA, 20 bp, Artificial
  CRISPR gRNA sequence
gggtggccggcagagctgac

SEQ ID NO: 101753 - DNA, 20 bp, Artificial
  CRISPR gRNA sequence
acacctcgttccctcgctgc

SEQ ID NO: 101754 - DNA, 20 bp, Artificial
  CRISPR gRNA sequence
gttccctcgctgccggttgg

SEQ ID NO: 101755 - DNA, 20 bp, Artificial
  CRISPR gRNA sequence
cctcgctgccggttggtgag

SEQ ID NO: 101756 - DNA, 20 bp, Artificial
  CRISPR gRNA sequence
gctgccggttggtgagagtg

SEQ ID NO: 101757 - DNA, 20 bp, Artificial
  CRISPR gRNA sequence
ccggttggtgagagtggtgg

SEQ ID NO: 101758 - DNA, 20 bp, Artificial
  CRISPR gRNA sequence
gtgagagtggtggagtgctt

SEQ ID NO: 101759 - DNA, 20 bp, Artificial
  CRISPR gRNA sequence
cagggagctgcctgctggga

SEQ ID NO: 101760 - DNA, 20 bp, Artificial
  CRISPR gRNA sequence
agggagctgcctgctgggaa

SEQ ID NO: 101761 - DNA, 20 bp, Artificial
  CRISPR gRNA sequence
cctgctgggaaacagacaac

SEQ ID NO: 101762 - DNA, 20 bp, Artificial
  CRISPR gRNA sequence
ctgggaaacagacaacaggc

SEQ ID NO: 101763 - DNA, 20 bp, Artificial
  CRISPR gRNA sequence
ggaaacagacaacaggcgtc

SEQ ID NO: 101764 - DNA, 20 bp, Artificial
  CRISPR gRNA sequence
cccctcagtagatgtctctg

SEQ ID NO: 101765 - DNA, 20 bp, Artificial
  CRISPR gRNA sequence
ccctcagtagatgtctctga

SEQ ID NO: 101766 - DNA, 20 bp, Artificial
  CRISPR gRNA sequence
agtagatgtctctgaggctt

SEQ ID NO: 101767 - DNA, 20 bp, Artificial
  CRISPR gRNA sequence
tgaggcttcaggacagaagc

SEQ ID NO: 101768 - DNA, 20 bp, Artificial
  CRISPR gRNA sequence
aggcttcaggacagaagccc

SEQ ID NO: 101769 - DNA, 20 bp, Artificial
  CRISPR gRNA sequence
caggacagaagcccatctgt

SEQ ID NO: 101770 - DNA, 20 bp, Artificial
  CRISPR gRNA sequence
aggacagaagcccatctgtt

SEQ ID NO: 101771 - DNA, 20 bp, Artificial
  CRISPR gRNA sequence
tttttttttgttgctgttgt

SEQ ID NO: 101772 - DNA, 20 bp, Artificial
  CRISPR gRNA sequence
ttttttgttgctgttgttgt

SEQ ID NO: 101773 - DNA, 20 bp, Artificial
  CRISPR gRNA sequence
tttttgttgctgttgttgtt

SEQ ID NO: 101774 - DNA, 20 bp, Artificial
  CRISPR gRNA sequence
ttttgttgctgttgttgttt

SEQ ID NO: 101775 - DNA, 20 bp, Artificial
  CRISPR gRNA sequence
tttgttgctgttgttgtttg

SEQ ID NO: 101776 - DNA, 20 bp, Artificial
  CRISPR gRNA sequence
ttgttgctgttgttgtttga

SEQ ID NO: 101777 - DNA, 20 bp, Artificial
  CRISPR gRNA sequence
tgttgctgttgttgtttgag

SEQ ID NO: 101778 - DNA, 20 bp, Artificial
  CRISPR gRNA sequence
gttgctgttgttgtttgaga

SEQ ID NO: 101779 - DNA, 20 bp, Artificial
  CRISPR gRNA sequence
ttgctgttgttgtttgagat

SEQ ID NO: 101780 - DNA, 20 bp, Artificial
  CRISPR gRNA sequence
ctgttgttgtttgagatgga

SEQ ID NO: 101781 - DNA, 20 bp, Artificial
  CRISPR gRNA sequence
ttgttgtttgagatggagtc

SEQ ID NO: 101782 - DNA, 20 bp, Artificial
  CRISPR gRNA sequence
ttgtttgagatggagtctcc

SEQ ID NO: 101783 - DNA, 20 bp, Artificial
  CRISPR gRNA sequence
tttgagatggagtctccgtc

SEQ ID NO: 101784 - DNA, 20 bp, Artificial
  CRISPR gRNA sequence
gagatggagtctccgtctgt

SEQ ID NO: 101785 - DNA, 20 bp, Artificial
  CRISPR gRNA sequence
agatggagtctccgtctgtc

SEQ ID NO: 101786 - DNA, 20 bp, Artificial
  CRISPR gRNA sequence
cgtctgtcccccaggctgga

SEQ ID NO: 101787 - DNA, 20 bp, Artificial
  CRISPR gRNA sequence
tcccccaggctggagtacag

SEQ ID NO: 101788 - DNA, 20 bp, Artificial
  CRISPR gRNA sequence
gagtacagtggcgtgatctc

SEQ ID NO: 101789 - DNA, 20 bp, Artificial
  CRISPR gRNA sequence
ggctcactgcaacctctgcc

SEQ ID NO: 101790 - DNA, 20 bp, Artificial
  CRISPR gRNA sequence
actgcaacctctgcctcctg

SEQ ID NO: 101791 - DNA, 20 bp, Artificial
  CRISPR gRNA sequence
caacctctgcctcctgggtt

SEQ ID NO: 101792 - DNA, 20 bp, Artificial
  CRISPR gRNA sequence
tgcctcctgggttcaagcga

SEQ ID NO: 101793 - DNA, 20 bp, Artificial
  CRISPR gRNA sequence
cctcctgggttcaagcgatt

SEQ ID NO: 101794 - DNA, 20 bp, Artificial
  CRISPR gRNA sequence
ctgggttcaagcgattcttg

SEQ ID NO: 101795 - DNA, 20 bp, Artificial
  CRISPR gRNA sequence
ggttcaagcgattcttgtgc

SEQ ID NO: 101796 - DNA, 20 bp, Artificial
  CRISPR gRNA sequence
aagcgattcttgtgcctcag

SEQ ID NO: 101797 - DNA, 20 bp, Artificial
  CRISPR gRNA sequence
ttgtgcctcagcctcccgag

SEQ ID NO: 101798 - DNA, 20 bp, Artificial
  CRISPR gRNA sequence
gtgcctcagcctcccgagta

SEQ ID NO: 101799 - DNA, 20 bp, Artificial
  CRISPR gRNA sequence
tgcctcagcctcccgagtag

SEQ ID NO: 101800 - DNA, 20 bp, Artificial
  CRISPR gRNA sequence
agcctcccgagtagctggga

SEQ ID NO: 101801 - DNA, 20 bp, Artificial
  CRISPR gRNA sequence
ccgagtagctgggatcatag

SEQ ID NO: 101802 - DNA, 20 bp, Artificial
  CRISPR gRNA sequence
ggatcataggcgcccaccac

SEQ ID NO: 101803 - DNA, 20 bp, Artificial
  CRISPR gRNA sequence
gctaatttttgtattttaag

SEQ ID NO: 101804 - DNA, 20 bp, Artificial
  CRISPR gRNA sequence
atttttgtattttaagtaga

SEQ ID NO: 101805 - DNA, 20 bp, Artificial
  CRISPR gRNA sequence
ttgtattttaagtagagacg

SEQ ID NO: 101806 - DNA, 20 bp, Artificial
  CRISPR gRNA sequence
tgtattttaagtagagacgg

SEQ ID NO: 101807 - DNA, 20 bp, Artificial
  CRISPR gRNA sequence
gtattttaagtagagacggg

SEQ ID NO: 101808 - DNA, 20 bp, Artificial
  CRISPR gRNA sequence
tattttaagtagagacgggg

SEQ ID NO: 101809 - DNA, 20 bp, Artificial
  CRISPR gRNA sequence
taagtagagacggggtttcg

SEQ ID NO: 101810 - DNA, 20 bp, Artificial
  CRISPR gRNA sequence
aagtagagacggggtttcgc

SEQ ID NO: 101811 - DNA, 20 bp, Artificial
  CRISPR gRNA sequence
agtagagacggggtttcgct

SEQ ID NO: 101812 - DNA, 20 bp, Artificial
  CRISPR gRNA sequence
cgctatgttggccaggctaa

SEQ ID NO: 101813 - DNA, 20 bp, Artificial
  CRISPR gRNA sequence
gctatgttggccaggctaat

SEQ ID NO: 101814 - DNA, 20 bp, Artificial
  CRISPR gRNA sequence
tgttggccaggctaatttca

SEQ ID NO: 101815 - DNA, 20 bp, Artificial
  CRISPR gRNA sequence
gccaggctaatttcaaactc

SEQ ID NO: 101816 - DNA, 20 bp, Artificial
  CRISPR gRNA sequence
atttcaaactcctgacctca

SEQ ID NO: 101817 - DNA, 20 bp, Artificial
  CRISPR gRNA sequence
caaactcctgacctcaaatc

SEQ ID NO: 101818 - DNA, 20 bp, Artificial
  CRISPR gRNA sequence
aaactcctgacctcaaatca

SEQ ID NO: 101819 - DNA, 20 bp, Artificial
  CRISPR gRNA sequence
ctgacctcaaatcatccacc

SEQ ID NO: 101820 - DNA, 20 bp, Artificial
  CRISPR gRNA sequence
acctcaaatcatccacctgc

SEQ ID NO: 101821 - DNA, 20 bp, Artificial
  CRISPR gRNA sequence
aaatcatccacctgcctcag

SEQ ID NO: 101822 - DNA, 20 bp, Artificial
  CRISPR gRNA sequence
cctcagcctcccaaagtgct

SEQ ID NO: 101823 - DNA, 20 bp, Artificial
  CRISPR gRNA sequence
agcctcccaaagtgctggga

SEQ ID NO: 101824 - DNA, 20 bp, Artificial
  CRISPR gRNA sequence
ccaaagtgctgggattatag

SEQ ID NO: 101825 - DNA, 20 bp, Artificial
  CRISPR gRNA sequence
ggattataggcatgagccac

SEQ ID NO: 101826 - DNA, 20 bp, Artificial
  CRISPR gRNA sequence
taggcatgagccaccacacc

SEQ ID NO: 101827 - DNA, 20 bp, Artificial
  CRISPR gRNA sequence
ttggggtttttttttttttt

SEQ ID NO: 101828 - DNA, 20 bp, Artificial
  CRISPR gRNA sequence
gggttttttttttttttgag

SEQ ID NO: 101829 - DNA, 20 bp, Artificial
  CRISPR gRNA sequence
tttttttttttgagacagag

SEQ ID NO: 101830 - DNA, 20 bp, Artificial
  CRISPR gRNA sequence
ttttttttttgagacagagt

SEQ ID NO: 101831 - DNA, 20 bp, Artificial
  CRISPR gRNA sequence
tttttttttgagacagagtc

SEQ ID NO: 101832 - DNA, 20 bp, Artificial
  CRISPR gRNA sequence
ttttttttgagacagagtct

SEQ ID NO: 101833 - DNA, 20 bp, Artificial
  CRISPR gRNA sequence
tttttttgagacagagtctt

SEQ ID NO: 101834 - DNA, 20 bp, Artificial
  CRISPR gRNA sequence
ttttttgagacagagtcttg

SEQ ID NO: 101835 - DNA, 20 bp, Artificial
  CRISPR gRNA sequence
tttttgagacagagtcttgc

SEQ ID NO: 101836 - DNA, 20 bp, Artificial
  CRISPR gRNA sequence
ttttgagacagagtcttgct

SEQ ID NO: 101837 - DNA, 20 bp, Artificial
  CRISPR gRNA sequence
tttgagacagagtcttgctc

SEQ ID NO: 101838 - DNA, 20 bp, Artificial
  CRISPR gRNA sequence
ttgagacagagtcttgctct

SEQ ID NO: 101839 - DNA, 20 bp, Artificial
  CRISPR gRNA sequence
tgagacagagtcttgctctg

SEQ ID NO: 101840 - DNA, 20 bp, Artificial
  CRISPR gRNA sequence
gagacagagtcttgctctgt

SEQ ID NO: 101841 - DNA, 20 bp, Artificial
  CRISPR gRNA sequence
agacagagtcttgctctgtt

SEQ ID NO: 101842 - DNA, 20 bp, Artificial
  CRISPR gRNA sequence
gctctgttgtccaggctgga

SEQ ID NO: 101843 - DNA, 20 bp, Artificial
  CRISPR gRNA sequence
ctctgttgtccaggctggag

SEQ ID NO: 101844 - DNA, 20 bp, Artificial
  CRISPR gRNA sequence
tgttgtccaggctggagtgc

SEQ ID NO: 101845 - DNA, 20 bp, Artificial
  CRISPR gRNA sequence
ttgtccaggctggagtgcgg

SEQ ID NO: 101846 - DNA, 20 bp, Artificial
  CRISPR gRNA sequence
tccaggctggagtgcggtgg

SEQ ID NO: 101847 - DNA, 20 bp, Artificial
  CRISPR gRNA sequence
gagtgcggtggtgtgatcac

SEQ ID NO: 101848 - DNA, 20 bp, Artificial
  CRISPR gRNA sequence
acttcagcctcaacctcctg

SEQ ID NO: 101849 - DNA, 20 bp, Artificial
  CRISPR gRNA sequence
cagcctcaacctcctgggct

SEQ ID NO: 101850 - DNA, 20 bp, Artificial
  CRISPR gRNA sequence
agcctcaacctcctgggctc

SEQ ID NO: 101851 - DNA, 20 bp, Artificial
  CRISPR gRNA sequence
aacctcctgggctcaagcca

SEQ ID NO: 101852 - DNA, 20 bp, Artificial
  CRISPR gRNA sequence
ctgggctcaagccaacctcc

SEQ ID NO: 101853 - DNA, 20 bp, Artificial
  CRISPR gRNA sequence
ggctcaagccaacctcccac

SEQ ID NO: 101854 - DNA, 20 bp, Artificial
  CRISPR gRNA sequence
aagccaacctcccacctcag

SEQ ID NO: 101855 - DNA, 20 bp, Artificial
  CRISPR gRNA sequence
ccacctcagcctcctgagca

SEQ ID NO: 101856 - DNA, 20 bp, Artificial
  CRISPR gRNA sequence
agcctcctgagcagctgaaa

SEQ ID NO: 101857 - DNA, 20 bp, Artificial
  CRISPR gRNA sequence
ctgagcagctgaaactacag

SEQ ID NO: 101858 - DNA, 20 bp, Artificial
  CRISPR gRNA sequence
agcagctgaaactacaggtg

SEQ ID NO: 101859 - DNA, 20 bp, Artificial
  CRISPR gRNA sequence
aaactacaggtgccaccata

SEQ ID NO: 101860 - DNA, 20 bp, Artificial
  CRISPR gRNA sequence
caggtgccaccatacccagc

SEQ ID NO: 101861 - DNA, 20 bp, Artificial
  CRISPR gRNA sequence
aaaatatatatatattggta

SEQ ID NO: 101862 - DNA, 20 bp, Artificial
  CRISPR gRNA sequence
gtagagatggagtcttgctc

SEQ ID NO: 101863 - DNA, 20 bp, Artificial
  CRISPR gRNA sequence
gctctgtcgcccaggctggt

SEQ ID NO: 101864 - DNA, 20 bp, Artificial
  CRISPR gRNA sequence
ctctgtcgcccaggctggtc

SEQ ID NO: 101865 - DNA, 20 bp, Artificial
  CRISPR gRNA sequence
tgtcgcccaggctggtctca

SEQ ID NO: 101866 - DNA, 20 bp, Artificial
  CRISPR gRNA sequence
tcgcccaggctggtctcaaa

SEQ ID NO: 101867 - DNA, 20 bp, Artificial
  CRISPR gRNA sequence
gtctcaaactcctgggctca

SEQ ID NO: 101868 - DNA, 20 bp, Artificial
  CRISPR gRNA sequence
aaactcctgggctcaagcaa

SEQ ID NO: 101869 - DNA, 20 bp, Artificial
  CRISPR gRNA sequence
ctgggctcaagcaattctcc

SEQ ID NO: 101870 - DNA, 20 bp, Artificial
  CRISPR gRNA sequence
ggctcaagcaattctcctgc

SEQ ID NO: 101871 - DNA, 20 bp, Artificial
  CRISPR gRNA sequence
aagcaattctcctgccgtgg

SEQ ID NO: 101872 - DNA, 20 bp, Artificial
  CRISPR gRNA sequence
tcctgccgtggcctcccaaa

SEQ ID NO: 101873 - DNA, 20 bp, Artificial
  CRISPR gRNA sequence
ctgccgtggcctcccaaagt

SEQ ID NO: 101874 - DNA, 20 bp, Artificial
  CRISPR gRNA sequence
ccgtggcctcccaaagtgct

SEQ ID NO: 101875 - DNA, 20 bp, Artificial
  CRISPR gRNA sequence
ccaaagtgctgggattacag

SEQ ID NO: 101876 - DNA, 20 bp, Artificial
  CRISPR gRNA sequence
ggattacaggcatgagctac

SEQ ID NO: 101877 - DNA, 20 bp, Artificial
  CRISPR gRNA sequence
caggcatgagctaccatgct

SEQ ID NO: 101878 - DNA, 20 bp, Artificial
  CRISPR gRNA sequence
ccatgctactgccttcggta

SEQ ID NO: 101879 - DNA, 20 bp, Artificial
  CRISPR gRNA sequence
ctgccttcggtatctccctg

SEQ ID NO: 101880 - DNA, 20 bp, Artificial
  CRISPR gRNA sequence
ccttcggtatctccctgggg

SEQ ID NO: 101881 - DNA, 20 bp, Artificial
  CRISPR gRNA sequence
cggtatctccctggggtctt

SEQ ID NO: 101882 - DNA, 20 bp, Artificial
  CRISPR gRNA sequence
ggtatctccctggggtcttg

SEQ ID NO: 101883 - DNA, 20 bp, Artificial
  CRISPR gRNA sequence
cctggggtcttggagctacc

SEQ ID NO: 101884 - DNA, 20 bp, Artificial
  CRISPR gRNA sequence
gggtcttggagctaccaaag

SEQ ID NO: 101885 - DNA, 20 bp, Artificial
  CRISPR gRNA sequence
ggagctaccaaaggcagtgc

SEQ ID NO: 101886 - DNA, 20 bp, Artificial
  CRISPR gRNA sequence
gagctaccaaaggcagtgcc

SEQ ID NO: 101887 - DNA, 20 bp, Artificial
  CRISPR gRNA sequence
ccaaaggcagtgcctgggac

SEQ ID NO: 101888 - DNA, 20 bp, Artificial
  CRISPR gRNA sequence
ggactccaccattcactcac

SEQ ID NO: 101889 - DNA, 20 bp, Artificial
  CRISPR gRNA sequence
caccattcactcactctact

SEQ ID NO: 101890 - DNA, 20 bp, Artificial
  CRISPR gRNA sequence
actcactctactctcttgaa

SEQ ID NO: 101891 - DNA, 20 bp, Artificial
  CRISPR gRNA sequence
actctactctcttgaatacc

SEQ ID NO: 101892 - DNA, 20 bp, Artificial
  CRISPR gRNA sequence
tactctcttgaatacccagg

SEQ ID NO: 101893 - DNA, 20 bp, Artificial
  CRISPR gRNA sequence
ctctcttgaatacccagggt

SEQ ID NO: 101894 - DNA, 20 bp, Artificial
  CRISPR gRNA sequence
tcttgaatacccagggtgca

SEQ ID NO: 101895 - DNA, 20 bp, Artificial
  CRISPR gRNA sequence
ttgaatacccagggtgcatc

SEQ ID NO: 101896 - DNA, 20 bp, Artificial
  CRISPR gRNA sequence
gaatacccagggtgcatctt

SEQ ID NO: 101897 - DNA, 20 bp, Artificial
  CRISPR gRNA sequence
aatacccagggtgcatcttt

SEQ ID NO: 101898 - DNA, 20 bp, Artificial
  CRISPR gRNA sequence
tctcctccctgcctggcaat

SEQ ID NO: 101899 - DNA, 20 bp, Artificial
  CRISPR gRNA sequence
ctcctccctgcctggcaatg

SEQ ID NO: 101900 - DNA, 20 bp, Artificial
  CRISPR gRNA sequence
tcctccctgcctggcaatgt

SEQ ID NO: 101901 - DNA, 20 bp, Artificial
  CRISPR gRNA sequence
ctccctgcctggcaatgttc

SEQ ID NO: 101902 - DNA, 20 bp, Artificial
  CRISPR gRNA sequence
cctgcctggcaatgttctga

SEQ ID NO: 101903 - DNA, 20 bp, Artificial
  CRISPR gRNA sequence
cctggcaatgttctgagcaa

SEQ ID NO: 101904 - DNA, 20 bp, Artificial
  CRISPR gRNA sequence
gcaatgttctgagcaaacaa

SEQ ID NO: 101905 - DNA, 20 bp, Artificial
  CRISPR gRNA sequence
tgagcaaacaagacatagtt

SEQ ID NO: 101906 - DNA, 20 bp, Artificial
  CRISPR gRNA sequence
agcaaacaagacatagtttt

SEQ ID NO: 101907 - DNA, 20 bp, Artificial
  CRISPR gRNA sequence
ttgccctctagggagtcggg

SEQ ID NO: 101908 - DNA, 20 bp, Artificial
  CRISPR gRNA sequence
tgccctctagggagtcgggg

SEQ ID NO: 101909 - DNA, 20 bp, Artificial
  CRISPR gRNA sequence
gccctctagggagtcggggg

SEQ ID NO: 101910 - DNA, 20 bp, Artificial
  CRISPR gRNA sequence
ccctctagggagtcgggggt

SEQ ID NO: 101911 - DNA, 20 bp, Artificial
  CRISPR gRNA sequence
tagggagtcgggggtcaagt

SEQ ID NO: 101912 - DNA, 20 bp, Artificial
  CRISPR gRNA sequence
gggagtcgggggtcaagtag

SEQ ID NO: 101913 - DNA, 20 bp, Artificial
  CRISPR gRNA sequence
caagttgaaataagtgttca

SEQ ID NO: 101914 - DNA, 20 bp, Artificial
  CRISPR gRNA sequence
aagttgaaataagtgttcaa

SEQ ID NO: 101915 - DNA, 20 bp, Artificial
  CRISPR gRNA sequence
aaataagtgttcaaaagaac

SEQ ID NO: 101916 - DNA, 20 bp, Artificial
  CRISPR gRNA sequence
aaaagaacttaaggccgggc

SEQ ID NO: 101917 - DNA, 20 bp, Artificial
  CRISPR gRNA sequence
aaggccgggcacagtggctc

SEQ ID NO: 101918 - DNA, 20 bp, Artificial
  CRISPR gRNA sequence
aggccgggcacagtggctca

SEQ ID NO: 101919 - DNA, 20 bp, Artificial
  CRISPR gRNA sequence
atgcctgtaatcccagcact

SEQ ID NO: 101920 - DNA, 20 bp, Artificial
  CRISPR gRNA sequence
taatcccagcactttgggag

SEQ ID NO: 101921 - DNA, 20 bp, Artificial
  CRISPR gRNA sequence
tgggaggctgaggtgggtgg

SEQ ID NO: 101922 - DNA, 20 bp, Artificial
  CRISPR gRNA sequence
gggaggctgaggtgggtgga

SEQ ID NO: 101923 - DNA, 20 bp, Artificial
  CRISPR gRNA sequence
ggaggctgaggtgggtggat

SEQ ID NO: 101924 - DNA, 20 bp, Artificial
  CRISPR gRNA sequence
aggtgggtggatcacctgag

SEQ ID NO: 101925 - DNA, 20 bp, Artificial
  CRISPR gRNA sequence
aggtcaggagtttgagacca

SEQ ID NO: 101926 - DNA, 20 bp, Artificial
  CRISPR gRNA sequence
gagaccagcctgactaacat

SEQ ID NO: 101927 - DNA, 20 bp, Artificial
  CRISPR gRNA sequence
agaccagcctgactaacatg

SEQ ID NO: 101928 - DNA, 20 bp, Artificial
  CRISPR gRNA sequence
actaacatggtgaaattcca

SEQ ID NO: 101929 - DNA, 20 bp, Artificial
  CRISPR gRNA sequence
acatggtgaaattccacctc

SEQ ID NO: 101930 - DNA, 20 bp, Artificial
  CRISPR gRNA sequence
cacctctactaaaaacacaa

SEQ ID NO: 101931 - DNA, 20 bp, Artificial
  CRISPR gRNA sequence
tactaaaaacacaaaattag

SEQ ID NO: 101932 - DNA, 20 bp, Artificial
  CRISPR gRNA sequence
ctaaaaacacaaaattagcc

SEQ ID NO: 101933 - DNA, 20 bp, Artificial
  CRISPR gRNA sequence
aaaacacaaaattagccatg

SEQ ID NO: 101934 - DNA, 20 bp, Artificial
  CRISPR gRNA sequence
gccatgcatggtggcagatg

SEQ ID NO: 101935 - DNA, 20 bp, Artificial
  CRISPR gRNA sequence
taatcccagctactcgggag

SEQ ID NO: 101936 - DNA, 20 bp, Artificial
  CRISPR gRNA sequence
ctcgggaggctgaggcagga

SEQ ID NO: 101937 - DNA, 20 bp, Artificial
  CRISPR gRNA sequence
gggaggctgaggcaggagaa

SEQ ID NO: 101938 - DNA, 20 bp, Artificial
  CRISPR gRNA sequence
aggcaggagaatcgcttgaa

SEQ ID NO: 101939 - DNA, 20 bp, Artificial
  CRISPR gRNA sequence
gaatccaggaggtggaggtt

SEQ ID NO: 101940 - DNA, 20 bp, Artificial
  CRISPR gRNA sequence
aatccaggaggtggaggttg

SEQ ID NO: 101941 - DNA, 20 bp, Artificial
  CRISPR gRNA sequence
cagtgagagagatcacgcca

SEQ ID NO: 101942 - DNA, 20 bp, Artificial
  CRISPR gRNA sequence
cactccagcctgggcaacaa

SEQ ID NO: 101943 - DNA, 20 bp, Artificial
  CRISPR gRNA sequence
cagcctgggcaacaagagtg

SEQ ID NO: 101944 - DNA, 20 bp, Artificial
  CRISPR gRNA sequence
ggcaacaagagtgagactcc

SEQ ID NO: 101945 - DNA, 20 bp, Artificial
  CRISPR gRNA sequence
catctcaaaaaaaaaaaaaa

SEQ ID NO: 101946 - DNA, 20 bp, Artificial
  CRISPR gRNA sequence
aaaaaaaaaaaaaaaaaaaa

SEQ ID NO: 101947 - DNA, 20 bp, Artificial
  CRISPR gRNA sequence
aaaagcaggtagaagaggat

SEQ ID NO: 101948 - DNA, 20 bp, Artificial
  CRISPR gRNA sequence
aaagcaggtagaagaggatg

SEQ ID NO: 101949 - DNA, 20 bp, Artificial
  CRISPR gRNA sequence
cttagacaaggtggtaacag

SEQ ID NO: 101950 - DNA, 20 bp, Artificial
  CRISPR gRNA sequence
ttagacaaggtggtaacagg

SEQ ID NO: 101951 - DNA, 20 bp, Artificial
  CRISPR gRNA sequence
agacaaggtggtaacaggag

SEQ ID NO: 101952 - DNA, 20 bp, Artificial
  CRISPR gRNA sequence
gacaaggtggtaacaggagg

SEQ ID NO: 101953 - DNA, 20 bp, Artificial
  CRISPR gRNA sequence
cccaaggtgacaccaccgag

SEQ ID NO: 101954 - DNA, 20 bp, Artificial
  CRISPR gRNA sequence
aggaagtcaaagaaatccgc

SEQ ID NO: 101955 - DNA, 20 bp, Artificial
  CRISPR gRNA sequence
ggaagtcaaagaaatccgct

SEQ ID NO: 101956 - DNA, 20 bp, Artificial
  CRISPR gRNA sequence
cagggactgggcgcggtggc

SEQ ID NO: 101957 - DNA, 20 bp, Artificial
  CRISPR gRNA sequence
ggcgcggtggctcacgcctg

SEQ ID NO: 101958 - DNA, 20 bp, Artificial
  CRISPR gRNA sequence
acgcctgtaatcccagcact

SEQ ID NO: 101959 - DNA, 20 bp, Artificial
  CRISPR gRNA sequence
taatcccagcactttgggag

SEQ ID NO: 101960 - DNA, 20 bp, Artificial
  CRISPR gRNA sequence
tgggaggccgaggcgggcaa

SEQ ID NO: 101961 - DNA, 20 bp, Artificial
  CRISPR gRNA sequence
gggaggccgaggcgggcaat

SEQ ID NO: 101962 - DNA, 20 bp, Artificial
  CRISPR gRNA sequence
ggaggccgaggcgggcaatc

SEQ ID NO: 101963 - DNA, 20 bp, Artificial
  CRISPR gRNA sequence
aggtcaggagttcgagacca

SEQ ID NO: 101964 - DNA, 20 bp, Artificial
  CRISPR gRNA sequence
gagaccagcctgggcaacat

SEQ ID NO: 101965 - DNA, 20 bp, Artificial
  CRISPR gRNA sequence
ggcaacatggcaaaactcca

SEQ ID NO: 101966 - DNA, 20 bp, Artificial
  CRISPR gRNA sequence
catctctactaaaaacacaa

SEQ ID NO: 101967 - DNA, 20 bp, Artificial
  CRISPR gRNA sequence
tactaaaaacacaaaaatta

SEQ ID NO: 101968 - DNA, 20 bp, Artificial
  CRISPR gRNA sequence
ctaaaaacacaaaaattagc

SEQ ID NO: 101969 - DNA, 20 bp, Artificial
  CRISPR gRNA sequence
aaaacacaaaaattagctgg

SEQ ID NO: 101970 - DNA, 20 bp, Artificial
  CRISPR gRNA sequence
gctggatgtggtggtgcatg

SEQ ID NO: 101971 - DNA, 20 bp, Artificial
  CRISPR gRNA sequence
gatgtggtggtgcatgccag

SEQ ID NO: 101972 - DNA, 20 bp, Artificial
  CRISPR gRNA sequence
cttgggaggctgaggcagga

SEQ ID NO: 101973 - DNA, 20 bp, Artificial
  CRISPR gRNA sequence
gggaggctgaggcaggagaa

SEQ ID NO: 101974 - DNA, 20 bp, Artificial
  CRISPR gRNA sequence
ggaggctgaggcaggagaat

SEQ ID NO: 101975 - DNA, 20 bp, Artificial
  CRISPR gRNA sequence
aggcaggagaatcaccttaa

SEQ ID NO: 101976 - DNA, 20 bp, Artificial
  CRISPR gRNA sequence
aacccaggagagggagttgc

SEQ ID NO: 101977 - DNA, 20 bp, Artificial
  CRISPR gRNA sequence
acccaggagagggagttgca

SEQ ID NO: 101978 - DNA, 20 bp, Artificial
  CRISPR gRNA sequence
cagtgagtcaagatagtgcc

SEQ ID NO: 101979 - DNA, 20 bp, Artificial
  CRISPR gRNA sequence
cactccaccctggacaacag

SEQ ID NO: 101980 - DNA, 20 bp, Artificial
  CRISPR gRNA sequence
caccctggacaacagagcaa

SEQ ID NO: 101981 - DNA, 20 bp, Artificial
  CRISPR gRNA sequence
gacaacagagcaagattctg

SEQ ID NO: 101982 - DNA, 20 bp, Artificial
  CRISPR gRNA sequence
tgtctcaagaagagagggga

SEQ ID NO: 101983 - DNA, 20 bp, Artificial
  CRISPR gRNA sequence
tctcaagaagagaggggatc

SEQ ID NO: 101984 - DNA, 20 bp, Artificial
  CRISPR gRNA sequence
aagaagagaggggatccagg

SEQ ID NO: 101985 - DNA, 20 bp, Artificial
  CRISPR gRNA sequence
gagagtggggagaggggaaa

SEQ ID NO: 101986 - DNA, 20 bp, Artificial
  CRISPR gRNA sequence
ggcaacaaaagcaaacctcc

SEQ ID NO: 101987 - DNA, 20 bp, Artificial
  CRISPR gRNA sequence
catttaaaaaaaaaaaaaaa

SEQ ID NO: 101988 - DNA, 20 bp, Artificial
  CRISPR gRNA sequence
aaaaaaaaaaaaaaaaacgg

SEQ ID NO: 101989 - DNA, 20 bp, Artificial
  CRISPR gRNA sequence
aaaaaaaaaaaaaaaacgga

SEQ ID NO: 101990 - DNA, 20 bp, Artificial
  CRISPR gRNA sequence
tagtcccagctactcgggag

SEQ ID NO: 101991 - DNA, 20 bp, Artificial
  CRISPR gRNA sequence
ctcgggaggctgaagcagga

SEQ ID NO: 101992 - DNA, 20 bp, Artificial
  CRISPR gRNA sequence
gggaggctgaagcaggagaa

SEQ ID NO: 101993 - DNA, 20 bp, Artificial
  CRISPR gRNA sequence
aagcaggagaatggcgtgaa

SEQ ID NO: 101994 - DNA, 20 bp, Artificial
  CRISPR gRNA sequence
gcagtgagccaagattgcgc

SEQ ID NO: 101995 - DNA, 20 bp, Artificial
  CRISPR gRNA sequence
cagtgagccaagattgcgcc

SEQ ID NO: 101996 - DNA, 20 bp, Artificial
  CRISPR gRNA sequence
cgccactgcactccatgcac

SEQ ID NO: 101997 - DNA, 20 bp, Artificial
  CRISPR gRNA sequence
cactccatgcactccagcct

SEQ ID NO: 101998 - DNA, 20 bp, Artificial
  CRISPR gRNA sequence
catgcactccagcctgggcg

SEQ ID NO: 101999 - DNA, 20 bp, Artificial
  CRISPR gRNA sequence
cagcctgggcgacagagcga

SEQ ID NO: 102000 - DNA, 20 bp, Artificial
  CRISPR gRNA sequence
ggcgacagagcgagactcca

SEQ ID NO: 102001 - DNA, 20 bp, Artificial
  CRISPR gRNA sequence
catctcaaaaaaagaaagaa

SEQ ID NO: 102002 - DNA, 20 bp, Artificial
  CRISPR gRNA sequence
aaaaaaagaaagaaagaaag

SEQ ID NO: 102003 - DNA, 20 bp, Artificial
  CRISPR gRNA sequence
taggaagaagtgtaggaaga

SEQ ID NO: 102004 - DNA, 20 bp, Artificial
  CRISPR gRNA sequence
cagacaggagtggcagcaac

SEQ ID NO: 102005 - DNA, 20 bp, Artificial
  CRISPR gRNA sequence
aattaggcatattcttggac

SEQ ID NO: 102006 - DNA, 20 bp, Artificial
  CRISPR gRNA sequence
ggcatattcttggactccaa

SEQ ID NO: 102007 - DNA, 20 bp, Artificial
  CRISPR gRNA sequence
ttggactccaatcaaaaata

SEQ ID NO: 102008 - DNA, 20 bp, Artificial
  CRISPR gRNA sequence
ggactccaatcaaaaataaa

SEQ ID NO: 102009 - DNA, 20 bp, Artificial
  CRISPR gRNA sequence
gactccaatcaaaaataaat

SEQ ID NO: 102010 - DNA, 20 bp, Artificial
  CRISPR gRNA sequence
caatcaaaaataaatcctca

SEQ ID NO: 102011 - DNA, 20 bp, Artificial
  CRISPR gRNA sequence
agttcctcagtaagtaaaac

SEQ ID NO: 102012 - DNA, 20 bp, Artificial
  CRISPR gRNA sequence
ctcagtaagtaaaacaggat

SEQ ID NO: 102013 - DNA, 20 bp, Artificial
  CRISPR gRNA sequence
agtaagtaaaacaggatgac

SEQ ID NO: 102014 - DNA, 20 bp, Artificial
  CRISPR gRNA sequence
acccagtaatttcactccta

SEQ ID NO: 102015 - DNA, 20 bp, Artificial
  CRISPR gRNA sequence
cactcctagctatctaccct

SEQ ID NO: 102016 - DNA, 20 bp, Artificial
  CRISPR gRNA sequence
actcctagctatctaccctc

SEQ ID NO: 102017 - DNA, 20 bp, Artificial
  CRISPR gRNA sequence
ctagctatctaccctcaaag

SEQ ID NO: 102018 - DNA, 20 bp, Artificial
  CRISPR gRNA sequence
gctatctaccctcaaagagt

SEQ ID NO: 102019 - DNA, 20 bp, Artificial
  CRISPR gRNA sequence
tctaccctcaaagagttaaa

SEQ ID NO: 102020 - DNA, 20 bp, Artificial
  CRISPR gRNA sequence
ccctcaaagagttaaaaaca

SEQ ID NO: 102021 - DNA, 20 bp, Artificial
  CRISPR gRNA sequence
aaagagttaaaaacaggtgt

SEQ ID NO: 102022 - DNA, 20 bp, Artificial
  CRISPR gRNA sequence
aaaacaggtgtgaagggccg

SEQ ID NO: 102023 - DNA, 20 bp, Artificial
  CRISPR gRNA sequence
tggctcacacctgtaatccc

SEQ ID NO: 102024 - DNA, 20 bp, Artificial
  CRISPR gRNA sequence
acacctgtaatcccagcact

SEQ ID NO: 102025 - DNA, 20 bp, Artificial
  CRISPR gRNA sequence
taatcccagcactttcggaa

SEQ ID NO: 102026 - DNA, 20 bp, Artificial
  CRISPR gRNA sequence
tcggaagtggaggcctgcag

SEQ ID NO: 102027 - DNA, 20 bp, Artificial
  CRISPR gRNA sequence
cggaagtggaggcctgcaga

SEQ ID NO: 102028 - DNA, 20 bp, Artificial
  CRISPR gRNA sequence
ggaagtggaggcctgcagat

SEQ ID NO: 102029 - DNA, 20 bp, Artificial
  CRISPR gRNA sequence
cagatcacttgagcccagga

SEQ ID NO: 102030 - DNA, 20 bp, Artificial
  CRISPR gRNA sequence
gagcccaggaggtggagacc

SEQ ID NO: 102031 - DNA, 20 bp, Artificial
  CRISPR gRNA sequence
agcccaggaggtggagacca

SEQ ID NO: 102032 - DNA, 20 bp, Artificial
  CRISPR gRNA sequence
ccaaaaaaaaaaaaaaaatt

SEQ ID NO: 102033 - DNA, 20 bp, Artificial
  CRISPR gRNA sequence
gccaggtgtggttgcatgcc

SEQ ID NO: 102034 - DNA, 20 bp, Artificial
  CRISPR gRNA sequence
catgcctatagtcccagctc

SEQ ID NO: 102035 - DNA, 20 bp, Artificial
  CRISPR gRNA sequence
tagtcccagctcctagggag

SEQ ID NO: 102036 - DNA, 20 bp, Artificial
  CRISPR gRNA sequence
ctagggaggctgagtgatgg

SEQ ID NO: 102037 - DNA, 20 bp, Artificial
  CRISPR gRNA sequence
gggaggctgagtgatggctt

SEQ ID NO: 102038 - DNA, 20 bp, Artificial
  CRISPR gRNA sequence
agtgatggcttcagcccagg

SEQ ID NO: 102039 - DNA, 20 bp, Artificial
  CRISPR gRNA sequence
cagcccaggaagttgaggct

SEQ ID NO: 102040 - DNA, 20 bp, Artificial
  CRISPR gRNA sequence
agcccaggaagttgaggctg

SEQ ID NO: 102041 - DNA, 20 bp, Artificial
  CRISPR gRNA sequence
aggctgcagtgaactatgat

SEQ ID NO: 102042 - DNA, 20 bp, Artificial
  CRISPR gRNA sequence
cagtgaactatgattgcatc

SEQ ID NO: 102043 - DNA, 20 bp, Artificial
  CRISPR gRNA sequence
tgattgcatcactgcactcc

SEQ ID NO: 102044 - DNA, 20 bp, Artificial
  CRISPR gRNA sequence
catcactgcactccagcctt

SEQ ID NO: 102045 - DNA, 20 bp, Artificial
  CRISPR gRNA sequence
cactccagccttagtaacag

SEQ ID NO: 102046 - DNA, 20 bp, Artificial
  CRISPR gRNA sequence
cagccttagtaacagagcga

SEQ ID NO: 102047 - DNA, 20 bp, Artificial
  CRISPR gRNA sequence
agtaacagagcgagaccctg

SEQ ID NO: 102048 - DNA, 20 bp, Artificial
  CRISPR gRNA sequence
gtaacagagcgagaccctgt

SEQ ID NO: 102049 - DNA, 20 bp, Artificial
  CRISPR gRNA sequence
tatcaaaaaacaaaaacagg

SEQ ID NO: 102050 - DNA, 20 bp, Artificial
  CRISPR gRNA sequence
atgcctgtaatcccagcact

SEQ ID NO: 102051 - DNA, 20 bp, Artificial
  CRISPR gRNA sequence
taatcccagcactttgggag

SEQ ID NO: 102052 - DNA, 20 bp, Artificial
  CRISPR gRNA sequence
tgggaggccgaggtgggcgg

SEQ ID NO: 102053 - DNA, 20 bp, Artificial
  CRISPR gRNA sequence
gggaggccgaggtgggcgga

SEQ ID NO: 102054 - DNA, 20 bp, Artificial
  CRISPR gRNA sequence
ggaggccgaggtgggcggat

SEQ ID NO: 102055 - DNA, 20 bp, Artificial
  CRISPR gRNA sequence
aggtcaggagttcaagacca

SEQ ID NO: 102056 - DNA, 20 bp, Artificial
  CRISPR gRNA sequence
aagaccagcctggccaacat

SEQ ID NO: 102057 - DNA, 20 bp, Artificial
  CRISPR gRNA sequence
gccaacatggtgaaaccccg

SEQ ID NO: 102058 - DNA, 20 bp, Artificial
  CRISPR gRNA sequence
tactaaaaatacccaaaaaa

SEQ ID NO: 102059 - DNA, 20 bp, Artificial
  CRISPR gRNA sequence
ctaaaaatacccaaaaaatt

SEQ ID NO: 102060 - DNA, 20 bp, Artificial
  CRISPR gRNA sequence
aaaatacccaaaaaattagc

SEQ ID NO: 102061 - DNA, 20 bp, Artificial
  CRISPR gRNA sequence
gctgggcgtagtggcggaag

SEQ ID NO: 102062 - DNA, 20 bp, Artificial
  CRISPR gRNA sequence
ggcgtagtggcggaagcctg

SEQ ID NO: 102063 - DNA, 20 bp, Artificial
  CRISPR gRNA sequence
taatcccagctactcaggag

SEQ ID NO: 102064 - DNA, 20 bp, Artificial
  CRISPR gRNA sequence
ctcaggaggctgagacagga

SEQ ID NO: 102065 - DNA, 20 bp, Artificial
  CRISPR gRNA sequence
aggaggctgagacaggagaa

SEQ ID NO: 102066 - DNA, 20 bp, Artificial
  CRISPR gRNA sequence
agacaggagaatcagttgaa

SEQ ID NO: 102067 - DNA, 20 bp, Artificial
  CRISPR gRNA sequence
aacccaggaggcagaggttg

SEQ ID NO: 102068 - DNA, 20 bp, Artificial
  CRISPR gRNA sequence
cagtgagctgagatcacgcc

SEQ ID NO: 102069 - DNA, 20 bp, Artificial
  CRISPR gRNA sequence
agatcacgccattgcactcc

SEQ ID NO: 102070 - DNA, 20 bp, Artificial
  CRISPR gRNA sequence
cactccagcatgggcaacaa

SEQ ID NO: 102071 - DNA, 20 bp, Artificial
  CRISPR gRNA sequence
cagcatgggcaacaagagca

SEQ ID NO: 102072 - DNA, 20 bp, Artificial
  CRISPR gRNA sequence
catctcaaaaaacaacaaaa

SEQ ID NO: 102073 - DNA, 20 bp, Artificial
  CRISPR gRNA sequence
aaaaaacaacaaaacaaaac

SEQ ID NO: 102074 - DNA, 20 bp, Artificial
  CRISPR gRNA sequence
catgtgaggcctgacattcc

SEQ ID NO: 102075 - DNA, 20 bp, Artificial
  CRISPR gRNA sequence
acattccatcatcatggaat

SEQ ID NO: 102076 - DNA, 20 bp, Artificial
  CRISPR gRNA sequence
catcatcatggaatcccaga

SEQ ID NO: 102077 - DNA, 20 bp, Artificial
  CRISPR gRNA sequence
atcccagaggaggtatccta

SEQ ID NO: 102078 - DNA, 20 bp, Artificial
  CRISPR gRNA sequence
ccctgtggagaggaaacact

SEQ ID NO: 102079 - DNA, 20 bp, Artificial
  CRISPR gRNA sequence
tggagaggaaacactggcat

SEQ ID NO: 102080 - DNA, 20 bp, Artificial
  CRISPR gRNA sequence
gcatccggttgtgcagggaa

SEQ ID NO: 102081 - DNA, 20 bp, Artificial
  CRISPR gRNA sequence
tgcagggaaagagactgagg

SEQ ID NO: 102082 - DNA, 20 bp, Artificial
  CRISPR gRNA sequence
aggaccacagtgtctgagcc

SEQ ID NO: 102083 - DNA, 20 bp, Artificial
  CRISPR gRNA sequence
agccatctgcagcctcctct

SEQ ID NO: 102084 - DNA, 20 bp, Artificial
  CRISPR gRNA sequence
cagcctcctctccggggtct

SEQ ID NO: 102085 - DNA, 20 bp, Artificial
  CRISPR gRNA sequence
ctctccggggtcttcagggt

SEQ ID NO: 102086 - DNA, 20 bp, Artificial
  CRISPR gRNA sequence
tccggggtcttcagggtccc

SEQ ID NO: 102087 - DNA, 20 bp, Artificial
  CRISPR gRNA sequence
cggggtcttcagggtcccca

SEQ ID NO: 102088 - DNA, 20 bp, Artificial
  CRISPR gRNA sequence
cagggtccccaagttctgag

SEQ ID NO: 102089 - DNA, 20 bp, Artificial
  CRISPR gRNA sequence
agggtccccaagttctgagg

SEQ ID NO: 102090 - DNA, 20 bp, Artificial
  CRISPR gRNA sequence
tgaggcaggggtctgctggg

SEQ ID NO: 102091 - DNA, 20 bp, Artificial
  CRISPR gRNA sequence
aggcaggggtctgctgggtc

SEQ ID NO: 102092 - DNA, 20 bp, Artificial
  CRISPR gRNA sequence
ctgggtctggatgaggtctt

SEQ ID NO: 102093 - DNA, 20 bp, Artificial
  CRISPR gRNA sequence
ggtctggatgaggtcttctg

SEQ ID NO: 102094 - DNA, 20 bp, Artificial
  CRISPR gRNA sequence
gatgaggtcttctgcaggct

SEQ ID NO: 102095 - DNA, 20 bp, Artificial
  CRISPR gRNA sequence
ctgcaggctgggtaagctcc

SEQ ID NO: 102096 - DNA, 20 bp, Artificial
  CRISPR gRNA sequence
tgcaggctgggtaagctcca

SEQ ID NO: 102097 - DNA, 20 bp, Artificial
  CRISPR gRNA sequence
caggctgggtaagctccatg

SEQ ID NO: 102098 - DNA, 20 bp, Artificial
  CRISPR gRNA sequence
ggtaagctccatggggaaag

SEQ ID NO: 102099 - DNA, 20 bp, Artificial
  CRISPR gRNA sequence
catggggaaagctggcggag

SEQ ID NO: 102100 - DNA, 20 bp, Artificial
  CRISPR gRNA sequence
gcggaggtgtcagaagggga

SEQ ID NO: 102101 - DNA, 20 bp, Artificial
  CRISPR gRNA sequence
tcaacagttataataaagta

SEQ ID NO: 102102 - DNA, 20 bp, Artificial
  CRISPR gRNA sequence
taataaagtaggcaccgact

SEQ ID NO: 102103 - DNA, 20 bp, Artificial
  CRISPR gRNA sequence
catacctagccttgcactgt

SEQ ID NO: 102104 - DNA, 20 bp, Artificial
  CRISPR gRNA sequence
gccttgcactgtgagggtgg

SEQ ID NO: 102105 - DNA, 20 bp, Artificial
  CRISPR gRNA sequence
gcactgtgagggtgggtaaa

SEQ ID NO: 102106 - DNA, 20 bp, Artificial
  CRISPR gRNA sequence
cactgtgagggtgggtaaac

SEQ ID NO: 102107 - DNA, 20 bp, Artificial
  CRISPR gRNA sequence
tgagggtgggtaaactgagg

SEQ ID NO: 102108 - DNA, 20 bp, Artificial
  CRISPR gRNA sequence
aggtccaggttaattaccag

SEQ ID NO: 102109 - DNA, 20 bp, Artificial
  CRISPR gRNA sequence
attaccagagccagggaaat

SEQ ID NO: 102110 - DNA, 20 bp, Artificial
  CRISPR gRNA sequence
ccagagccagggaaatgaaa

SEQ ID NO: 102111 - DNA, 20 bp, Artificial
  CRISPR gRNA sequence
ctttcgaggtctaccattcc

SEQ ID NO: 102112 - DNA, 20 bp, Artificial
  CRISPR gRNA sequence
tcgaggtctaccattcccca

SEQ ID NO: 102113 - DNA, 20 bp, Artificial
  CRISPR gRNA sequence
cgaggtctaccattccccac

SEQ ID NO: 102114 - DNA, 20 bp, Artificial
  CRISPR gRNA sequence
gaggtctaccattccccacc

SEQ ID NO: 102115 - DNA, 20 bp, Artificial
  CRISPR gRNA sequence
ccattccccaccaccaaagc

SEQ ID NO: 102116 - DNA, 20 bp, Artificial
  CRISPR gRNA sequence
cccaccaccaaagcacctac

SEQ ID NO: 102117 - DNA, 20 bp, Artificial
  CRISPR gRNA sequence
caatgtgcaatgtttaagag

SEQ ID NO: 102118 - DNA, 20 bp, Artificial
  CRISPR gRNA sequence
aagagcctgggctctggcag

SEQ ID NO: 102119 - DNA, 20 bp, Artificial
  CRISPR gRNA sequence
agagcctgggctctggcagg

SEQ ID NO: 102120 - DNA, 20 bp, Artificial
  CRISPR gRNA sequence
ggctctggcagggcacagtg

SEQ ID NO: 102121 - DNA, 20 bp, Artificial
  CRISPR gRNA sequence
tggcagggcacagtggctca

SEQ ID NO: 102122 - DNA, 20 bp, Artificial
  CRISPR gRNA sequence
gcagggcacagtggctcacg

SEQ ID NO: 102123 - DNA, 20 bp, Artificial
  CRISPR gRNA sequence
acggctgtaatcccagcact

SEQ ID NO: 102124 - DNA, 20 bp, Artificial
  CRISPR gRNA sequence
taatcccagcactttgggag

SEQ ID NO: 102125 - DNA, 20 bp, Artificial
  CRISPR gRNA sequence
tgggaggccgaggagggtgg

SEQ ID NO: 102126 - DNA, 20 bp, Artificial
  CRISPR gRNA sequence
gggaggccgaggagggtgga

SEQ ID NO: 102127 - DNA, 20 bp, Artificial
  CRISPR gRNA sequence
ggaggccgaggagggtggat

SEQ ID NO: 102128 - DNA, 20 bp, Artificial
  CRISPR gRNA sequence
gagaccaggctggccaccat

SEQ ID NO: 102129 - DNA, 20 bp, Artificial
  CRISPR gRNA sequence
gccaccatggtgaaacccca

SEQ ID NO: 102130 - DNA, 20 bp, Artificial
  CRISPR gRNA sequence
tactaaaaatacaaaaatta

SEQ ID NO: 102131 - DNA, 20 bp, Artificial
  CRISPR gRNA sequence
aaaatacaaaaattagccaa

SEQ ID NO: 102132 - DNA, 20 bp, Artificial
  CRISPR gRNA sequence
gccaagcgcggtggcgggcg

SEQ ID NO: 102133 - DNA, 20 bp, Artificial
  CRISPR gRNA sequence
tgatcccagctactcgggag

SEQ ID NO: 102134 - DNA, 20 bp, Artificial
  CRISPR gRNA sequence
ctcgggaggctgaggcagaa

SEQ ID NO: 102135 - DNA, 20 bp, Artificial
  CRISPR gRNA sequence
gggaggctgaggcagaattg

SEQ ID NO: 102136 - DNA, 20 bp, Artificial
  CRISPR gRNA sequence
aggcagaattgcttgaactc

SEQ ID NO: 102137 - DNA, 20 bp, Artificial
  CRISPR gRNA sequence
cttgaactcgggaggtggag

SEQ ID NO: 102138 - DNA, 20 bp, Artificial
  CRISPR gRNA sequence
gaactcgggaggtggaggtt

SEQ ID NO: 102139 - DNA, 20 bp, Artificial
  CRISPR gRNA sequence
aactcgggaggtggaggttg

SEQ ID NO: 102140 - DNA, 20 bp, Artificial
  CRISPR gRNA sequence
gggaggtggaggttgcggtg

SEQ ID NO: 102141 - DNA, 20 bp, Artificial
  CRISPR gRNA sequence
cggtgagcagagatcgcacc

SEQ ID NO: 102142 - DNA, 20 bp, Artificial
  CRISPR gRNA sequence
cactgtagctggggcgacag

SEQ ID NO: 102143 - DNA, 20 bp, Artificial
  CRISPR gRNA sequence
tagctggggcgacagagcaa

SEQ ID NO: 102144 - DNA, 20 bp, Artificial
  CRISPR gRNA sequence
gggcgacagagcaagactct

SEQ ID NO: 102145 - DNA, 20 bp, Artificial
  CRISPR gRNA sequence
tgtctcaaaaaaaaaaaaaa

SEQ ID NO: 102146 - DNA, 20 bp, Artificial
  CRISPR gRNA sequence
tctcaaaaaaaaaaaaaaaa

SEQ ID NO: 102147 - DNA, 20 bp, Artificial
  CRISPR gRNA sequence
aaaaaaaaaaaaaaaaaaaa

SEQ ID NO: 102148 - DNA, 20 bp, Artificial
  CRISPR gRNA sequence
tggggtcagctgtctgggtt

SEQ ID NO: 102149 - DNA, 20 bp, Artificial
  CRISPR gRNA sequence
gggtcagctgtctgggttcg

SEQ ID NO: 102150 - DNA, 20 bp, Artificial
  CRISPR gRNA sequence
tctgggttcgaatccctcaa

SEQ ID NO: 102151 - DNA, 20 bp, Artificial
  CRISPR gRNA sequence
ggttcgaatccctcaattta

SEQ ID NO: 102152 - DNA, 20 bp, Artificial
  CRISPR gRNA sequence
gaatccctcaatttataggc

SEQ ID NO: 102153 - DNA, 20 bp, Artificial
  CRISPR gRNA sequence
aatttataggccgtgagaac

SEQ ID NO: 102154 - DNA, 20 bp, Artificial
  CRISPR gRNA sequence
ataggccgtgagaacttggg

SEQ ID NO: 102155 - DNA, 20 bp, Artificial
  CRISPR gRNA sequence
taggccgtgagaacttgggc

SEQ ID NO: 102156 - DNA, 20 bp, Artificial
  CRISPR gRNA sequence
gggcacgtgacttaaccttt

SEQ ID NO: 102157 - DNA, 20 bp, Artificial
  CRISPR gRNA sequence
ggcacgtgacttaacctttg

SEQ ID NO: 102158 - DNA, 20 bp, Artificial
  CRISPR gRNA sequence
aacctttgagcctcagtttc

SEQ ID NO: 102159 - DNA, 20 bp, Artificial
  CRISPR gRNA sequence
acctttgagcctcagtttcc

SEQ ID NO: 102160 - DNA, 20 bp, Artificial
  CRISPR gRNA sequence
tgagcctcagtttcctccac

SEQ ID NO: 102161 - DNA, 20 bp, Artificial
  CRISPR gRNA sequence
gagcctcagtttcctccacg

SEQ ID NO: 102162 - DNA, 20 bp, Artificial
  CRISPR gRNA sequence
agcctcagtttcctccacga

SEQ ID NO: 102163 - DNA, 20 bp, Artificial
  CRISPR gRNA sequence
agtttcctccacgacaaaat

SEQ ID NO: 102164 - DNA, 20 bp, Artificial
  CRISPR gRNA sequence
cctccacgacaaaatgtgga

SEQ ID NO: 102165 - DNA, 20 bp, Artificial
  CRISPR gRNA sequence
ctccacgacaaaatgtggaa

SEQ ID NO: 102166 - DNA, 20 bp, Artificial
  CRISPR gRNA sequence
cacgacaaaatgtggaaatg

SEQ ID NO: 102167 - DNA, 20 bp, Artificial
  CRISPR gRNA sequence
caacgaattatgtctgtaca

SEQ ID NO: 102168 - DNA, 20 bp, Artificial
  CRISPR gRNA sequence
tgtctgtacatagcttatcg

SEQ ID NO: 102169 - DNA, 20 bp, Artificial
  CRISPR gRNA sequence
tacatagcttatcgggggat

SEQ ID NO: 102170 - DNA, 20 bp, Artificial
  CRISPR gRNA sequence
atcgggggatctgctaagcg

SEQ ID NO: 102171 - DNA, 20 bp, Artificial
  CRISPR gRNA sequence
tcgggggatctgctaagcgt

SEQ ID NO: 102172 - DNA, 20 bp, Artificial
  CRISPR gRNA sequence
ctaagcgtggagctcaataa

SEQ ID NO: 102173 - DNA, 20 bp, Artificial
  CRISPR gRNA sequence
agcgtggagctcaataaata

SEQ ID NO: 102174 - DNA, 20 bp, Artificial
  CRISPR gRNA sequence
aataaatattcgctatggtt

SEQ ID NO: 102175 - DNA, 20 bp, Artificial
  CRISPR gRNA sequence
gctatggttgttgggagggg

SEQ ID NO: 102176 - DNA, 20 bp, Artificial
  CRISPR gRNA sequence
tggttgttgggaggggctcc

SEQ ID NO: 102177 - DNA, 20 bp, Artificial
  CRISPR gRNA sequence
ttgggaggggctccccataa

SEQ ID NO: 102178 - DNA, 20 bp, Artificial
  CRISPR gRNA sequence
ggaggggctccccataatga

SEQ ID NO: 102179 - DNA, 20 bp, Artificial
  CRISPR gRNA sequence
cccataatgagtgacggctc

SEQ ID NO: 102180 - DNA, 20 bp, Artificial
  CRISPR gRNA sequence
aacaaaggtgcgattggtcc

SEQ ID NO: 102181 - DNA, 20 bp, Artificial
  CRISPR gRNA sequence
gtcccagtcccacccgagcc

SEQ ID NO: 102182 - DNA, 20 bp, Artificial
  CRISPR gRNA sequence
ctaaatcgatccaggaggtc

SEQ ID NO: 102183 - DNA, 20 bp, Artificial
  CRISPR gRNA sequence
aatcgatccaggaggtccac

SEQ ID NO: 102184 - DNA, 20 bp, Artificial
  CRISPR gRNA sequence
acctccccacgagcctcctc

SEQ ID NO: 102185 - DNA, 20 bp, Artificial
  CRISPR gRNA sequence
cccacgagcctcctctgtcc

SEQ ID NO: 102186 - DNA, 20 bp, Artificial
  CRISPR gRNA sequence
ctctgtccccccgcgccgaa

SEQ ID NO: 102187 - DNA, 20 bp, Artificial
  CRISPR gRNA sequence
tgtccccccgcgccgaaagc

SEQ ID NO: 102188 - DNA, 20 bp, Artificial
  CRISPR gRNA sequence
tccccccgcgccgaaagccc

SEQ ID NO: 102189 - DNA, 20 bp, Artificial
  CRISPR gRNA sequence
tctcaaaacttgggggccca

SEQ ID NO: 102190 - DNA, 20 bp, Artificial
  CRISPR gRNA sequence
tcaaaacttgggggcccaag

SEQ ID NO: 102191 - DNA, 20 bp, Artificial
  CRISPR gRNA sequence
aaaacttgggggcccaagtc

SEQ ID NO: 102192 - DNA, 20 bp, Artificial
  CRISPR gRNA sequence
gggggcccaagtcacaaact

SEQ ID NO: 102193 - DNA, 20 bp, Artificial
  CRISPR gRNA sequence
ggggcccaagtcacaaactt

SEQ ID NO: 102194 - DNA, 20 bp, Artificial
  CRISPR gRNA sequence
ttctcttccaatggatatag

SEQ ID NO: 102195 - DNA, 20 bp, Artificial
  CRISPR gRNA sequence
tctcttccaatggatatagc

SEQ ID NO: 102196 - DNA, 20 bp, Artificial
  CRISPR gRNA sequence
ctcttccaatggatatagca

SEQ ID NO: 102197 - DNA, 20 bp, Artificial
  CRISPR gRNA sequence
tcttccaatggatatagcag

SEQ ID NO: 102198 - DNA, 20 bp, Artificial
  CRISPR gRNA sequence
ttccaatggatatagcagga

SEQ ID NO: 102199 - DNA, 20 bp, Artificial
  CRISPR gRNA sequence
ccaatggatatagcaggagg

SEQ ID NO: 102200 - DNA, 20 bp, Artificial
  CRISPR gRNA sequence
caatggatatagcaggaggc

SEQ ID NO: 102201 - DNA, 20 bp, Artificial
  CRISPR gRNA sequence
gagaccggaccctcagcgat

SEQ ID NO: 102202 - DNA, 20 bp, Artificial
  CRISPR gRNA sequence
agcgatctggcttcctctgc

SEQ ID NO: 102203 - DNA, 20 bp, Artificial
  CRISPR gRNA sequence
gcttcctctgccgggacaga

SEQ ID NO: 102204 - DNA, 20 bp, Artificial
  CRISPR gRNA sequence
cctctgccgggacagaaagc

SEQ ID NO: 102205 - DNA, 20 bp, Artificial
  CRISPR gRNA sequence
ctctgccgggacagaaagca

SEQ ID NO: 102206 - DNA, 20 bp, Artificial
  CRISPR gRNA sequence
tgccgggacagaaagcaact

SEQ ID NO: 102207 - DNA, 20 bp, Artificial
  CRISPR gRNA sequence
ccgggacagaaagcaacttg

SEQ ID NO: 102208 - DNA, 20 bp, Artificial
  CRISPR gRNA sequence
gatactcgaccgctaccccc

SEQ ID NO: 102209 - DNA, 20 bp, Artificial
  CRISPR gRNA sequence
atactcgaccgctaccccca

SEQ ID NO: 102210 - DNA, 20 bp, Artificial
  CRISPR gRNA sequence
gaccgctacccccaccccag

SEQ ID NO: 102211 - DNA, 20 bp, Artificial
  CRISPR gRNA sequence
cccccaccccagagctcccc

SEQ ID NO: 102212 - DNA, 20 bp, Artificial
  CRISPR gRNA sequence
ccccactgcgcttgcgcacc

SEQ ID NO: 102213 - DNA, 20 bp, Artificial
  CRISPR gRNA sequence
cgcttgcgcacccccgcccc

SEQ ID NO: 102214 - DNA, 20 bp, Artificial
  CRISPR gRNA sequence
gcgcacccccgccccccaaa

SEQ ID NO: 102215 - DNA, 20 bp, Artificial
  CRISPR gRNA sequence
cgcacccccgccccccaaaa

SEQ ID NO: 102216 - DNA, 20 bp, Artificial
  CRISPR gRNA sequence
cctctggccctttaagactt

SEQ ID NO: 102217 - DNA, 20 bp, Artificial
  CRISPR gRNA sequence
tggccctttaagacttaggg

SEQ ID NO: 102218 - DNA, 20 bp, Artificial
  CRISPR gRNA sequence
gccctttaagacttagggga

SEQ ID NO: 102219 - DNA, 20 bp, Artificial
  CRISPR gRNA sequence
taagacttaggggagggcgt

SEQ ID NO: 102220 - DNA, 20 bp, Artificial
  CRISPR gRNA sequence
aagacttaggggagggcgtg

SEQ ID NO: 102221 - DNA, 20 bp, Artificial
  CRISPR gRNA sequence
agacttaggggagggcgtgg

SEQ ID NO: 102222 - DNA, 20 bp, Artificial
  CRISPR gRNA sequence
aggggagggcgtgggttccg

SEQ ID NO: 102223 - DNA, 20 bp, Artificial
  CRISPR gRNA sequence
ggggagggcgtgggttccgc

SEQ ID NO: 102224 - DNA, 20 bp, Artificial
  CRISPR gRNA sequence
cgctggggtcctgggagggc

SEQ ID NO: 102225 - DNA, 20 bp, Artificial
  CRISPR gRNA sequence
gggtcctgggagggcagttg

SEQ ID NO: 102226 - DNA, 20 bp, Artificial
  CRISPR gRNA sequence
ggagggcagttgcgcctgcg

SEQ ID NO: 102227 - DNA, 20 bp, Artificial
  CRISPR gRNA sequence
cgcctgcgccttcttttccc

SEQ ID NO: 102228 - DNA, 20 bp, Artificial
  CRISPR gRNA sequence
cgccttcttttcccctcctc

SEQ ID NO: 102229 - DNA, 20 bp, Artificial
  CRISPR gRNA sequence
cttttcccctcctcaccgac

SEQ ID NO: 102230 - DNA, 20 bp, Artificial
  CRISPR gRNA sequence
ttttcccctcctcaccgact

SEQ ID NO: 102231 - DNA, 20 bp, Artificial
  CRISPR gRNA sequence
ttcccctcctcaccgactcg

SEQ ID NO: 102232 - DNA, 20 bp, Artificial
  CRISPR gRNA sequence
tcccctcctcaccgactcgg

SEQ ID NO: 102233 - DNA, 20 bp, Artificial
  CRISPR gRNA sequence
cccctcctcaccgactcgga

SEQ ID NO: 102234 - DNA, 20 bp, Artificial
  CRISPR gRNA sequence
ccctcctcaccgactcggag

SEQ ID NO: 102235 - DNA, 20 bp, Artificial
  CRISPR gRNA sequence
ctcaccgactcggagggaat

SEQ ID NO: 102236 - DNA, 20 bp, Artificial
  CRISPR gRNA sequence
accgactcggagggaatggg

SEQ ID NO: 102237 - DNA, 20 bp, Artificial
  CRISPR gRNA sequence
ggagggaatgggcggggcct

SEQ ID NO: 102238 - DNA, 20 bp, Artificial
  CRISPR gRNA sequence
aagggctctgagaatttcac

SEQ ID NO: 102239 - DNA, 20 bp, Artificial
  CRISPR gRNA sequence
tgagaatttcactacgcctg

SEQ ID NO: 102240 - DNA, 20 bp, Artificial
  CRISPR gRNA sequence
agaatttcactacgcctgcg

SEQ ID NO: 102241 - DNA, 20 bp, Artificial
  CRISPR gRNA sequence
cactacgcctgcgcccgctc

SEQ ID NO: 102242 - DNA, 20 bp, Artificial
  CRISPR gRNA sequence
actacgcctgcgcccgctca

SEQ ID NO: 102243 - DNA, 20 bp, Artificial
  CRISPR gRNA sequence
cgcctgcgcccgctcacctt

SEQ ID NO: 102244 - DNA, 20 bp, Artificial
  CRISPR gRNA sequence
cgcccgctcacctttaccct

SEQ ID NO: 102245 - DNA, 20 bp, Artificial
  CRISPR gRNA sequence
acctttaccctgcccacaga

SEQ ID NO: 102246 - DNA, 20 bp, Artificial
  CRISPR gRNA sequence
taccctgcccacagattttt

SEQ ID NO: 102247 - DNA, 20 bp, Artificial
  CRISPR gRNA sequence
accctgcccacagatttttc

SEQ ID NO: 102248 - DNA, 20 bp, Artificial
  CRISPR gRNA sequence
ccctgcccacagatttttcc

SEQ ID NO: 102249 - DNA, 20 bp, Artificial
  CRISPR gRNA sequence
cccacagatttttccagagg

SEQ ID NO: 102250 - DNA, 20 bp, Artificial
  CRISPR gRNA sequence
ttccagagggagccaattgg

SEQ ID NO: 102251 - DNA, 20 bp, Artificial
  CRISPR gRNA sequence
tccagagggagccaattggc

SEQ ID NO: 102252 - DNA, 20 bp, Artificial
  CRISPR gRNA sequence
ccagagggagccaattggct

SEQ ID NO: 102253 - DNA, 20 bp, Artificial
  CRISPR gRNA sequence
cagagggagccaattggctc

SEQ ID NO: 102254 - DNA, 20 bp, Artificial
  CRISPR gRNA sequence
gctccggcttcgggtagatg

SEQ ID NO: 102255 - DNA, 20 bp, Artificial
  CRISPR gRNA sequence
cggcttcgggtagatgggcg

SEQ ID NO: 102256 - DNA, 20 bp, Artificial
  CRISPR gRNA sequence
cgggtagatgggcggggcta

SEQ ID NO: 102257 - DNA, 20 bp, Artificial
  CRISPR gRNA sequence
gggtagatgggcggggctat

SEQ ID NO: 102258 - DNA, 20 bp, Artificial
  CRISPR gRNA sequence
tctcaagaagaagaagtagg

SEQ ID NO: 102259 - DNA, 20 bp, Artificial
  CRISPR gRNA sequence
aagaagaagaagtaggggaa

SEQ ID NO: 102260 - DNA, 20 bp, Artificial
  CRISPR gRNA sequence
gaacttaaaggggcagcgta

SEQ ID NO: 102261 - DNA, 20 bp, Artificial
  CRISPR gRNA sequence
aaaggggcagcgtaccttgg

SEQ ID NO: 102262 - DNA, 20 bp, Artificial
  CRISPR gRNA sequence
aaggggcagcgtaccttggc

SEQ ID NO: 102263 - DNA, 20 bp, Artificial
  CRISPR gRNA sequence
ggccgtcccgttccacaaca

SEQ ID NO: 102264 - DNA, 20 bp, Artificial
  CRISPR gRNA sequence
gccgtcccgttccacaacaa

SEQ ID NO: 102265 - DNA, 20 bp, Artificial
  CRISPR gRNA sequence
cacaacaaggtcccttctgc

SEQ ID NO: 102266 - DNA, 20 bp, Artificial
  CRISPR gRNA sequence
ctgcggtctcaaaggcttat

SEQ ID NO: 102267 - DNA, 20 bp, Artificial
  CRISPR gRNA sequence
tgcggtctcaaaggcttata

SEQ ID NO: 102268 - DNA, 20 bp, Artificial
  CRISPR gRNA sequence
cggtctcaaaggcttataag

SEQ ID NO: 102269 - DNA, 20 bp, Artificial
  CRISPR gRNA sequence
aaaggcttataagcaagggc

SEQ ID NO: 102270 - DNA, 20 bp, Artificial
  CRISPR gRNA sequence
ataagcaagggcgggggcag

SEQ ID NO: 102271 - DNA, 20 bp, Artificial
  CRISPR gRNA sequence
taagcaagggcgggggcaga

SEQ ID NO: 102272 - DNA, 20 bp, Artificial
  CRISPR gRNA sequence
aagaagggagtttttgcggc

SEQ ID NO: 102273 - DNA, 20 bp, Artificial
  CRISPR gRNA sequence
ttgcggcccgagtgggtaat

SEQ ID NO: 102274 - DNA, 20 bp, Artificial
  CRISPR gRNA sequence
tgcggcccgagtgggtaatg

SEQ ID NO: 102275 - DNA, 20 bp, Artificial
  CRISPR gRNA sequence
gcggcccgagtgggtaatgc

SEQ ID NO: 102276 - DNA, 20 bp, Artificial
  CRISPR gRNA sequence
cggcccgagtgggtaatgcg

SEQ ID NO: 102277 - DNA, 20 bp, Artificial
  CRISPR gRNA sequence
ccccaactcgtctctcaagg

SEQ ID NO: 102278 - DNA, 20 bp, Artificial
  CRISPR gRNA sequence
gtctctcaaggaaaaggggg

SEQ ID NO: 102279 - DNA, 20 bp, Artificial
  CRISPR gRNA sequence
tcaaggaaaagggggttcag

SEQ ID NO: 102280 - DNA, 20 bp, Artificial
  CRISPR gRNA sequence
aaggaaaagggggttcagaa

SEQ ID NO: 102281 - DNA, 20 bp, Artificial
  CRISPR gRNA sequence
agaaagggagagagttcttc

SEQ ID NO: 102282 - DNA, 20 bp, Artificial
  CRISPR gRNA sequence
ttccccctctcctgcctggg

SEQ ID NO: 102283 - DNA, 20 bp, Artificial
  CRISPR gRNA sequence
ccccctctcctgcctgggtg

SEQ ID NO: 102284 - DNA, 20 bp, Artificial
  CRISPR gRNA sequence
cccctctcctgcctgggtgt

SEQ ID NO: 102285 - DNA, 20 bp, Artificial
  CRISPR gRNA sequence
tcctgcctgggtgtcgctcc

SEQ ID NO: 102286 - DNA, 20 bp, Artificial
  CRISPR gRNA sequence
ctgcctgggtgtcgctccac

SEQ ID NO: 102287 - DNA, 20 bp, Artificial
  CRISPR gRNA sequence
cctgggtgtcgctccaccag

SEQ ID NO: 102288 - DNA, 20 bp, Artificial
  CRISPR gRNA sequence
ggtgtcgctccaccagcctc

SEQ ID NO: 102289 - DNA, 20 bp, Artificial
  CRISPR gRNA sequence
caccagcctcctggccgtcg

SEQ ID NO: 102290 - DNA, 20 bp, Artificial
  CRISPR gRNA sequence
ctggccgtcgcgccccctcc

SEQ ID NO: 102291 - DNA, 20 bp, Artificial
  CRISPR gRNA sequence
gccgtcgcgccccctcctca

SEQ ID NO: 102292 - DNA, 20 bp, Artificial
  CRISPR gRNA sequence
ctcactgcgccacccccggg

SEQ ID NO: 102293 - DNA, 20 bp, Artificial
  CRISPR gRNA sequence
actgcgccacccccgggtgt

SEQ ID NO: 102294 - DNA, 20 bp, Artificial
  CRISPR gRNA sequence
cgccacccccgggtgtgcct

SEQ ID NO: 102295 - DNA, 20 bp, Artificial
  CRISPR gRNA sequence
cttccctgcgtctcacacag

SEQ ID NO: 102296 - DNA, 20 bp, Artificial
  CRISPR gRNA sequence
ccctgcgtctcacacagccc

SEQ ID NO: 102297 - DNA, 20 bp, Artificial
  CRISPR gRNA sequence
cctgcgtctcacacagcccc

SEQ ID NO: 102298 - DNA, 20 bp, Artificial
  CRISPR gRNA sequence
cgtctcacacagcccctttc

SEQ ID NO: 102299 - DNA, 20 bp, Artificial
  CRISPR gRNA sequence
acacagcccctttcttgtcc

SEQ ID NO: 102300 - DNA, 20 bp, Artificial
  CRISPR gRNA sequence
tcttgtccgcaaagactgag

SEQ ID NO: 102301 - DNA, 20 bp, Artificial
  CRISPR gRNA sequence
cttgtccgcaaagactgagg

SEQ ID NO: 102302 - DNA, 20 bp, Artificial
  CRISPR gRNA sequence
ttgtccgcaaagactgagga

SEQ ID NO: 102303 - DNA, 20 bp, Artificial
  CRISPR gRNA sequence
gtccgcaaagactgaggagc

SEQ ID NO: 102304 - DNA, 20 bp, Artificial
  CRISPR gRNA sequence
tccgcaaagactgaggagcg

SEQ ID NO: 102305 - DNA, 20 bp, Artificial
  CRISPR gRNA sequence
aggagcggggagggcgggcc

SEQ ID NO: 102306 - DNA, 20 bp, Artificial
  CRISPR gRNA sequence
tgacaccggaacaggagccg

SEQ ID NO: 102307 - DNA, 20 bp, Artificial
  CRISPR gRNA sequence
acaccggaacaggagccgtg

SEQ ID NO: 102308 - DNA, 20 bp, Artificial
  CRISPR gRNA sequence
cagcagggaaggcttaggcg

SEQ ID NO: 102309 - DNA, 20 bp, Artificial
  CRISPR gRNA sequence
agcagggaaggcttaggcgg

SEQ ID NO: 102310 - DNA, 20 bp, Artificial
  CRISPR gRNA sequence
aggcgggcgtcccaacctcc

SEQ ID NO: 102311 - DNA, 20 bp, Artificial
  CRISPR gRNA sequence
ggcgggcgtcccaacctccg

SEQ ID NO: 102312 - DNA, 20 bp, Artificial
  CRISPR gRNA sequence
cgggcttccggtgccgtttc

SEQ ID NO: 102313 - DNA, 20 bp, Artificial
  CRISPR gRNA sequence
ccggtgccgtttcccggttc

SEQ ID NO: 102314 - DNA, 20 bp, Artificial
  CRISPR gRNA sequence
cggtgccgtttcccggttcg

SEQ ID NO: 102315 - DNA, 20 bp, Artificial
  CRISPR gRNA sequence
cccggttcgctcggccgcgg

SEQ ID NO: 102316 - DNA, 20 bp, Artificial
  CRISPR gRNA sequence
ccggttcgctcggccgcggt

SEQ ID NO: 102317 - DNA, 20 bp, Artificial
  CRISPR gRNA sequence
gctcggccgcggtcgctatg

SEQ ID NO: 102318 - DNA, 20 bp, Artificial
  CRISPR gRNA sequence
ggccgcggtcgctatggagg

SEQ ID NO: 102319 - DNA, 20 bp, Artificial
  CRISPR gRNA sequence
gtggggcgatccctgaactg

SEQ ID NO: 102320 - DNA, 20 bp, Artificial
  CRISPR gRNA sequence
ggcgatccctgaactggagt

SEQ ID NO: 102321 - DNA, 20 bp, Artificial
  CRISPR gRNA sequence
gatccctgaactggagttag

SEQ ID NO: 102322 - DNA, 20 bp, Artificial
  CRISPR gRNA sequence
atccctgaactggagttagt

SEQ ID NO: 102323 - DNA, 20 bp, Artificial
  CRISPR gRNA sequence
tgaactggagttagtgggcg

SEQ ID NO: 102324 - DNA, 20 bp, Artificial
  CRISPR gRNA sequence
ggagttagtgggcgtggcct

SEQ ID NO: 102325 - DNA, 20 bp, Artificial
  CRISPR gRNA sequence
agttagtgggcgtggcctca

SEQ ID NO: 102326 - DNA, 20 bp, Artificial
  CRISPR gRNA sequence
gttagtgggcgtggcctcag

SEQ ID NO: 102327 - DNA, 20 bp, Artificial
  CRISPR gRNA sequence
tggcctcagaggcgcctgcg

SEQ ID NO: 102328 - DNA, 20 bp, Artificial
  CRISPR gRNA sequence
gcctcagaggcgcctgcgcg

SEQ ID NO: 102329 - DNA, 20 bp, Artificial
  CRISPR gRNA sequence
cctcagaggcgcctgcgcgg

SEQ ID NO: 102330 - DNA, 20 bp, Artificial
  CRISPR gRNA sequence
cagaggcgcctgcgcggagg

SEQ ID NO: 102331 - DNA, 20 bp, Artificial
  CRISPR gRNA sequence
ggcgcctgcgcggaggcggt

SEQ ID NO: 102332 - DNA, 20 bp, Artificial
  CRISPR gRNA sequence
cgcctgcgcggaggcggttg

SEQ ID NO: 102333 - DNA, 20 bp, Artificial
  CRISPR gRNA sequence
gcctgcgcggaggcggttgg

SEQ ID NO: 102334 - DNA, 20 bp, Artificial
  CRISPR gRNA sequence
cctgcgcggaggcggttgga

SEQ ID NO: 102335 - DNA, 20 bp, Artificial
  CRISPR gRNA sequence
tgcgcggaggcggttggagg

SEQ ID NO: 102336 - DNA, 20 bp, Artificial
  CRISPR gRNA sequence
gcgcggaggcggttggaggg

SEQ ID NO: 102337 - DNA, 20 bp, Artificial
  CRISPR gRNA sequence
aggcccgattcccctttgtt

SEQ ID NO: 102338 - DNA, 20 bp, Artificial
  CRISPR gRNA sequence
ggcccgattcccctttgttc

SEQ ID NO: 102339 - DNA, 20 bp, Artificial
  CRISPR gRNA sequence
gttcgggttcgccattttgc

SEQ ID NO: 102340 - DNA, 20 bp, Artificial
  CRISPR gRNA sequence
ttcgggttcgccattttgct

SEQ ID NO: 102341 - DNA, 20 bp, Artificial
  CRISPR gRNA sequence
gggttcgccattttgctagg

SEQ ID NO: 102342 - DNA, 20 bp, Artificial
  CRISPR gRNA sequence
ttcgccattttgctaggcag

SEQ ID NO: 102343 - DNA, 20 bp, Artificial
  CRISPR gRNA sequence
gccattttgctaggcagcgg

SEQ ID NO: 102344 - DNA, 20 bp, Artificial
  CRISPR gRNA sequence
attttgctaggcagcggcag

SEQ ID NO: 102345 - DNA, 20 bp, Artificial
  CRISPR gRNA sequence
ttgctaggcagcggcagtgg

SEQ ID NO: 102346 - DNA, 20 bp, Artificial
  CRISPR gRNA sequence
ctaggcagcggcagtggcgg

SEQ ID NO: 102347 - DNA, 20 bp, Artificial
  CRISPR gRNA sequence
ggcagcggcagtggcggcgg

SEQ ID NO: 102348 - DNA, 20 bp, Artificial
  CRISPR gRNA sequence
agcggcagtggcggcggcag

SEQ ID NO: 102349 - DNA, 20 bp, Artificial
  CRISPR gRNA sequence
ggcagtggcggcggcagcgg

SEQ ID NO: 102350 - DNA, 20 bp, Artificial
  CRISPR gRNA sequence
gtggcggcggcagcggcggc

SEQ ID NO: 102351 - DNA, 20 bp, Artificial
  CRISPR gRNA sequence
ggcggcggcagcggcggctg

SEQ ID NO: 102352 - DNA, 20 bp, Artificial
  CRISPR gRNA sequence
cggcggctggagcctctgat

SEQ ID NO: 102353 - DNA, 20 bp, Artificial
  CRISPR gRNA sequence
ggcggctggagcctctgatt

SEQ ID NO: 102354 - DNA, 20 bp, Artificial
  CRISPR gRNA sequence
tggagcctctgattgggttt

SEQ ID NO: 102355 - DNA, 20 bp, Artificial
  CRISPR gRNA sequence
gagcctctgattgggtttcg

SEQ ID NO: 102356 - DNA, 20 bp, Artificial
  CRISPR gRNA sequence
tctgattgggtttcggagtc

SEQ ID NO: 102357 - DNA, 20 bp, Artificial
  CRISPR gRNA sequence
tgggtttcggagtccggtac

SEQ ID NO: 102358 - DNA, 20 bp, Artificial
  CRISPR gRNA sequence
ggtttcggagtccggtactg

SEQ ID NO: 102359 - DNA, 20 bp, Artificial
  CRISPR gRNA sequence
agtccggtactggagccaat

SEQ ID NO: 102360 - DNA, 20 bp, Artificial
  CRISPR gRNA sequence
ggtactggagccaatcagcg

SEQ ID NO: 102361 - DNA, 20 bp, Artificial
  CRISPR gRNA sequence
gtactggagccaatcagcgc

SEQ ID NO: 102362 - DNA, 20 bp, Artificial
  CRISPR gRNA sequence
ctggagccaatcagcgcggg

SEQ ID NO: 102363 - DNA, 20 bp, Artificial
  CRISPR gRNA sequence
aatcagcgcgggcagcgaac

SEQ ID NO: 102364 - DNA, 20 bp, Artificial
  CRISPR gRNA sequence
atcagcgcgggcagcgaacc

SEQ ID NO: 102365 - DNA, 20 bp, Artificial
  CRISPR gRNA sequence
tcagcgcgggcagcgaaccg

SEQ ID NO: 102366 - DNA, 20 bp, Artificial
  CRISPR gRNA sequence
cagcgcgggcagcgaaccgg

SEQ ID NO: 102367 - DNA, 20 bp, Artificial
  CRISPR gRNA sequence
gcgcgggcagcgaaccgggg

SEQ ID NO: 102368 - DNA, 20 bp, Artificial
  CRISPR gRNA sequence
gggcagcgaaccgggggagc

SEQ ID NO: 102369 - DNA, 20 bp, Artificial
  CRISPR gRNA sequence
ggcagcgaaccgggggagcg

SEQ ID NO: 102370 - DNA, 20 bp, Artificial
  CRISPR gRNA sequence
cgaaccgggggagcgaggca

SEQ ID NO: 102371 - DNA, 20 bp, Artificial
  CRISPR gRNA sequence
ccgggggagcgaggcacggt

SEQ ID NO: 102372 - DNA, 20 bp, Artificial
  CRISPR gRNA sequence
gagcgaggcacggtgagtgt

SEQ ID NO: 102373 - DNA, 20 bp, Artificial
  CRISPR gRNA sequence
agcgaggcacggtgagtgtg

SEQ ID NO: 102374 - DNA, 20 bp, Artificial
  CRISPR gRNA sequence
cgaggcacggtgagtgtgag

SEQ ID NO: 102375 - DNA, 20 bp, Artificial
  CRISPR gRNA sequence
gagtgtgaggagccaatatc

SEQ ID NO: 102376 - DNA, 20 bp, Artificial
  CRISPR gRNA sequence
tgtgaggagccaatatccag

SEQ ID NO: 102377 - DNA, 20 bp, Artificial
  CRISPR gRNA sequence
ggagccaatatccagcggcc

SEQ ID NO: 102378 - DNA, 20 bp, Artificial
  CRISPR gRNA sequence
agccaatatccagcggccca

SEQ ID NO: 102379 - DNA, 20 bp, Artificial
  CRISPR gRNA sequence
aatatccagcggcccagagc

SEQ ID NO: 102380 - DNA, 20 bp, Artificial
  CRISPR gRNA sequence
cagcggcccagagccggccc

SEQ ID NO: 102381 - DNA, 20 bp, Artificial
  CRISPR gRNA sequence
gccggccccagcgccccgat

SEQ ID NO: 102382 - DNA, 20 bp, Artificial
  CRISPR gRNA sequence
ggccccagcgccccgattgg

SEQ ID NO: 102383 - DNA, 20 bp, Artificial
  CRISPR gRNA sequence
gccccagcgccccgattggc

SEQ ID NO: 102384 - DNA, 20 bp, Artificial
  CRISPR gRNA sequence
ggcgggtctcgctgaccact

SEQ ID NO: 102385 - DNA, 20 bp, Artificial
  CRISPR gRNA sequence
gcgggtctcgctgaccactc

SEQ ID NO: 102386 - DNA, 20 bp, Artificial
  CRISPR gRNA sequence
gggtctcgctgaccactcag

SEQ ID NO: 102387 - DNA, 20 bp, Artificial
  CRISPR gRNA sequence
gtctcgctgaccactcagga

SEQ ID NO: 102388 - DNA, 20 bp, Artificial
  CRISPR gRNA sequence
tctcgctgaccactcaggag

SEQ ID NO: 102389 - DNA, 20 bp, Artificial
  CRISPR gRNA sequence
ctgaccactcaggagaggcc

SEQ ID NO: 102390 - DNA, 20 bp, Artificial
  CRISPR gRNA sequence
tgaccactcaggagaggccc

SEQ ID NO: 102391 - DNA, 20 bp, Artificial
  CRISPR gRNA sequence
gagaggcccaggcgcccgtc

SEQ ID NO: 102392 - DNA, 20 bp, Artificial
  CRISPR gRNA sequence
gcccaggcgcccgtcgagcc

SEQ ID NO: 102393 - DNA, 20 bp, Artificial
  CRISPR gRNA sequence
cccaggcgcccgtcgagccc

SEQ ID NO: 102394 - DNA, 20 bp, Artificial
  CRISPR gRNA sequence
ccaggcgcccgtcgagcccg

SEQ ID NO: 102395 - DNA, 20 bp, Artificial
  CRISPR gRNA sequence
aggcgcccgtcgagcccggg

SEQ ID NO: 102396 - DNA, 20 bp, Artificial
  CRISPR gRNA sequence
cccgtcgagcccggggagtc

SEQ ID NO: 102397 - DNA, 20 bp, Artificial
  CRISPR gRNA sequence
cgagcccggggagtcgagct

SEQ ID NO: 102398 - DNA, 20 bp, Artificial
  CRISPR gRNA sequence
ccggggagtcgagctgagcc

SEQ ID NO: 102399 - DNA, 20 bp, Artificial
  CRISPR gRNA sequence
gagtcgagctgagcctagcc

SEQ ID NO: 102400 - DNA, 20 bp, Artificial
  CRISPR gRNA sequence
cgagctgagcctagccgagc

SEQ ID NO: 102401 - DNA, 20 bp, Artificial
  CRISPR gRNA sequence
gagctgagcctagccgagcc

SEQ ID NO: 102402 - DNA, 20 bp, Artificial
  CRISPR gRNA sequence
ctgagcctagccgagccggg

SEQ ID NO: 102403 - DNA, 20 bp, Artificial
  CRISPR gRNA sequence
gcctagccgagccgggcggc

SEQ ID NO: 102404 - DNA, 20 bp, Artificial
  CRISPR gRNA sequence
tagccgagccgggcggccag

SEQ ID NO: 102405 - DNA, 20 bp, Artificial
  CRISPR gRNA sequence
agccgggcggccagcggccc

SEQ ID NO: 102406 - DNA, 20 bp, Artificial
  CRISPR gRNA sequence
ggcggccagcggccccggcc

SEQ ID NO: 102407 - DNA, 20 bp, Artificial
  CRISPR gRNA sequence
gcggccagcggccccggccc

SEQ ID NO: 102408 - DNA, 20 bp, Artificial
  CRISPR gRNA sequence
cggccagcggccccggcccg

SEQ ID NO: 102409 - DNA, 20 bp, Artificial
  CRISPR gRNA sequence
ggccccggcccggggcctgc

SEQ ID NO: 102410 - DNA, 20 bp, Artificial
  CRISPR gRNA sequence
cccggggcctgcgagcgcct

SEQ ID NO: 102411 - DNA, 20 bp, Artificial
  CRISPR gRNA sequence
ccggggcctgcgagcgcctc

SEQ ID NO: 102412 - DNA, 20 bp, Artificial
  CRISPR gRNA sequence
cggggcctgcgagcgcctcg

SEQ ID NO: 102413 - DNA, 20 bp, Artificial
  CRISPR gRNA sequence
cgagcgcctcggggcactcc

SEQ ID NO: 102414 - DNA, 20 bp, Artificial
  CRISPR gRNA sequence
gcctcggggcactcccggcc

SEQ ID NO: 102415 - DNA, 20 bp, Artificial
  CRISPR gRNA sequence
cctcggggcactcccggccg

SEQ ID NO: 102416 - DNA, 20 bp, Artificial
  CRISPR gRNA sequence
gcactcccggccgaggcctg

SEQ ID NO: 102417 - DNA, 20 bp, Artificial
  CRISPR gRNA sequence
cactcccggccgaggcctgc

SEQ ID NO: 102418 - DNA, 20 bp, Artificial
  CRISPR gRNA sequence
actcccggccgaggcctgca

SEQ ID NO: 102419 - DNA, 20 bp, Artificial
  CRISPR gRNA sequence
ctcccggccgaggcctgcag

SEQ ID NO: 102420 - DNA, 20 bp, Artificial
  CRISPR gRNA sequence
cctgcaggggccgccccgcg

SEQ ID NO: 102421 - DNA, 20 bp, Artificial
  CRISPR gRNA sequence
ctgcaggggccgccccgcgc

SEQ ID NO: 102422 - DNA, 20 bp, Artificial
  CRISPR gRNA sequence
tgcaggggccgccccgcgcg

SEQ ID NO: 102423 - DNA, 20 bp, Artificial
  CRISPR gRNA sequence
ggggccgccccgcgcgggga

SEQ ID NO: 102424 - DNA, 20 bp, Artificial
  CRISPR gRNA sequence
cccgcgcggggatggcgcct

SEQ ID NO: 102425 - DNA, 20 bp, Artificial
  CRISPR gRNA sequence
ccgcgcggggatggcgcctc

SEQ ID NO: 102426 - DNA, 20 bp, Artificial
  CRISPR gRNA sequence
cgcgcggggatggcgcctcg

SEQ ID NO: 102427 - DNA, 20 bp, Artificial
  CRISPR gRNA sequence
cgcggggatggcgcctcggg

SEQ ID NO: 102428 - DNA, 20 bp, Artificial
  CRISPR gRNA sequence
ggggatggcgcctcggggag

SEQ ID NO: 102429 - DNA, 20 bp, Artificial
  CRISPR gRNA sequence
gggatggcgcctcggggagc

SEQ ID NO: 102430 - DNA, 20 bp, Artificial
  CRISPR gRNA sequence
gcctcggggagcaggcacct

SEQ ID NO: 102431 - DNA, 20 bp, Artificial
  CRISPR gRNA sequence
cctcggggagcaggcacctc

SEQ ID NO: 102432 - DNA, 20 bp, Artificial
  CRISPR gRNA sequence
ctcggggagcaggcacctcg

SEQ ID NO: 102433 - DNA, 20 bp, Artificial
  CRISPR gRNA sequence
cctcggggctccgaccctcg

SEQ ID NO: 102434 - DNA, 20 bp, Artificial
  CRISPR gRNA sequence
ctcggggctccgaccctcgc

SEQ ID NO: 102435 - DNA, 20 bp, Artificial
  CRISPR gRNA sequence
tcggggctccgaccctcgca

SEQ ID NO: 102436 - DNA, 20 bp, Artificial
  CRISPR gRNA sequence
ctccgaccctcgcagggtgc

SEQ ID NO: 102437 - DNA, 20 bp, Artificial
  CRISPR gRNA sequence
tccgaccctcgcagggtgcc

SEQ ID NO: 102438 - DNA, 20 bp, Artificial
  CRISPR gRNA sequence
ccgaccctcgcagggtgcca

SEQ ID NO: 102439 - DNA, 20 bp, Artificial
  CRISPR gRNA sequence
ccctcgcagggtgccagggc

SEQ ID NO: 102440 - DNA, 20 bp, Artificial
  CRISPR gRNA sequence
cgcagggtgccagggccagt

SEQ ID NO: 102441 - DNA, 20 bp, Artificial
  CRISPR gRNA sequence
gcagggtgccagggccagtt

SEQ ID NO: 102442 - DNA, 20 bp, Artificial
  CRISPR gRNA sequence
tgcgtccctgttccccgact

SEQ ID NO: 102443 - DNA, 20 bp, Artificial
  CRISPR gRNA sequence
gcgtccctgttccccgactc

SEQ ID NO: 102444 - DNA, 20 bp, Artificial
  CRISPR gRNA sequence
cctgttccccgactcaggcc

SEQ ID NO: 102445 - DNA, 20 bp, Artificial
  CRISPR gRNA sequence
ctgttccccgactcaggccc

SEQ ID NO: 102446 - DNA, 20 bp, Artificial
  CRISPR gRNA sequence
ccgactcaggcccaggttct

SEQ ID NO: 102447 - DNA, 20 bp, Artificial
  CRISPR gRNA sequence
cgactcaggcccaggttctc

SEQ ID NO: 102448 - DNA, 20 bp, Artificial
  CRISPR gRNA sequence
aggcccaggttctcaggccc

SEQ ID NO: 102449 - DNA, 20 bp, Artificial
  CRISPR gRNA sequence
ggcccaggttctcaggcccc

SEQ ID NO: 102450 - DNA, 20 bp, Artificial
  CRISPR gRNA sequence
aggttctcaggccccaggcc

SEQ ID NO: 102451 - DNA, 20 bp, Artificial
  CRISPR gRNA sequence
ggttctcaggccccaggcct

SEQ ID NO: 102452 - DNA, 20 bp, Artificial
  CRISPR gRNA sequence
gttctcaggccccaggcctg

SEQ ID NO: 102453 - DNA, 20 bp, Artificial
  CRISPR gRNA sequence
cccaggcctggggccacgaa

SEQ ID NO: 102454 - DNA, 20 bp, Artificial
  CRISPR gRNA sequence
ggccacgaatggccctacac

SEQ ID NO: 102455 - DNA, 20 bp, Artificial
  CRISPR gRNA sequence
gccacgaatggccctacact

SEQ ID NO: 102456 - DNA, 20 bp, Artificial
  CRISPR gRNA sequence
ccacgaatggccctacacta

SEQ ID NO: 102457 - DNA, 20 bp, Artificial
  CRISPR gRNA sequence
cacgaatggccctacactag

SEQ ID NO: 102458 - DNA, 20 bp, Artificial
  CRISPR gRNA sequence
taggggacacatgcgcgccc

SEQ ID NO: 102459 - DNA, 20 bp, Artificial
  CRISPR gRNA sequence
aggggacacatgcgcgccct

SEQ ID NO: 102460 - DNA, 20 bp, Artificial
  CRISPR gRNA sequence
cacatgcgcgccctgggcct

SEQ ID NO: 102461 - DNA, 20 bp, Artificial
  CRISPR gRNA sequence
gggcctcggcgatttcctcc

SEQ ID NO: 102462 - DNA, 20 bp, Artificial
  CRISPR gRNA sequence
cgatttcctcctggtcgttc

SEQ ID NO: 102463 - DNA, 20 bp, Artificial
  CRISPR gRNA sequence
cccttgcactctccactctc

SEQ ID NO: 102464 - DNA, 20 bp, Artificial
  CRISPR gRNA sequence
actctccactctccggccct

SEQ ID NO: 102465 - DNA, 20 bp, Artificial
  CRISPR gRNA sequence
ctctccactctccggccctt

SEQ ID NO: 102466 - DNA, 20 bp, Artificial
  CRISPR gRNA sequence
ccactctccggcccttggga

SEQ ID NO: 102467 - DNA, 20 bp, Artificial
  CRISPR gRNA sequence
cactctccggcccttgggac

SEQ ID NO: 102468 - DNA, 20 bp, Artificial
  CRISPR gRNA sequence
tctccggcccttgggacagg

SEQ ID NO: 102469 - DNA, 20 bp, Artificial
  CRISPR gRNA sequence
cttgggacaggaagcctccc

SEQ ID NO: 102470 - DNA, 20 bp, Artificial
  CRISPR gRNA sequence
ttgggacaggaagcctcccc

SEQ ID NO: 102471 - DNA, 20 bp, Artificial
  CRISPR gRNA sequence
tgggacaggaagcctccccg

SEQ ID NO: 102472 - DNA, 20 bp, Artificial
  CRISPR gRNA sequence
cgccccccgctccccgctcc

SEQ ID NO: 102473 - DNA, 20 bp, Artificial
  CRISPR gRNA sequence
ccccgctccccgctcccagc

SEQ ID NO: 102474 - DNA, 20 bp, Artificial
  CRISPR gRNA sequence
gctccccgctcccagcgagc

SEQ ID NO: 102475 - DNA, 20 bp, Artificial
  CRISPR gRNA sequence
ctccccgctcccagcgagcc

SEQ ID NO: 102476 - DNA, 20 bp, Artificial
  CRISPR gRNA sequence
agccgggtctgtcttatctg

SEQ ID NO: 102477 - DNA, 20 bp, Artificial
  CRISPR gRNA sequence
tgtcttatctgcagcccctc

SEQ ID NO: 102478 - DNA, 20 bp, Artificial
  CRISPR gRNA sequence
gtcttatctgcagcccctct

SEQ ID NO: 102479 - DNA, 20 bp, Artificial
  CRISPR gRNA sequence
tatctgcagcccctctaggt

SEQ ID NO: 102480 - DNA, 20 bp, Artificial
  CRISPR gRNA sequence
atctgcagcccctctaggtc

SEQ ID NO: 102481 - DNA, 20 bp, Artificial
  CRISPR gRNA sequence
ctgcagcccctctaggtcgg

SEQ ID NO: 102482 - DNA, 20 bp, Artificial
  CRISPR gRNA sequence
tgcagcccctctaggtcggg

SEQ ID NO: 102483 - DNA, 20 bp, Artificial
  CRISPR gRNA sequence
gcagcccctctaggtcggga

SEQ ID NO: 102484 - DNA, 20 bp, Artificial
  CRISPR gRNA sequence
agcccctctaggtcgggagg

SEQ ID NO: 102485 - DNA, 20 bp, Artificial
  CRISPR gRNA sequence
gcccctctaggtcgggaggg

SEQ ID NO: 102486 - DNA, 20 bp, Artificial
  CRISPR gRNA sequence
tctaggtcgggagggaggcc

SEQ ID NO: 102487 - DNA, 20 bp, Artificial
  CRISPR gRNA sequence
ctaggtcgggagggaggcct

SEQ ID NO: 102488 - DNA, 20 bp, Artificial
  CRISPR gRNA sequence
taggtcgggagggaggcctg

SEQ ID NO: 102489 - DNA, 20 bp, Artificial
  CRISPR gRNA sequence
ggtcgggagggaggcctggg

SEQ ID NO: 102490 - DNA, 20 bp, Artificial
  CRISPR gRNA sequence
gtcgggagggaggcctgggg

SEQ ID NO: 102491 - DNA, 20 bp, Artificial
  CRISPR gRNA sequence
tcgggagggaggcctgggga

SEQ ID NO: 102492 - DNA, 20 bp, Artificial
  CRISPR gRNA sequence
cctggggagggtgcgcgccg

SEQ ID NO: 102493 - DNA, 20 bp, Artificial
  CRISPR gRNA sequence
gagggtgcgcgccgcggccg

SEQ ID NO: 102494 - DNA, 20 bp, Artificial
  CRISPR gRNA sequence
agggtgcgcgccgcggccgc

SEQ ID NO: 102495 - DNA, 20 bp, Artificial
  CRISPR gRNA sequence
gggtgcgcgccgcggccgcg

SEQ ID NO: 102496 - DNA, 20 bp, Artificial
  CRISPR gRNA sequence
cggccgcggggtcccgtgtg

SEQ ID NO: 102497 - DNA, 20 bp, Artificial
  CRISPR gRNA sequence
cgcggggtcccgtgtgcggc

SEQ ID NO: 102498 - DNA, 20 bp, Artificial
  CRISPR gRNA sequence
gtcccgtgtgcggctggcaa

SEQ ID NO: 102499 - DNA, 20 bp, Artificial
  CRISPR gRNA sequence
tcccgtgtgcggctggcaac

SEQ ID NO: 102500 - DNA, 20 bp, Artificial
  CRISPR gRNA sequence
cccgtgtgcggctggcaacg

SEQ ID NO: 102501 - DNA, 20 bp, Artificial
  CRISPR gRNA sequence
tgtgcggctggcaacggggc

SEQ ID NO: 102502 - DNA, 20 bp, Artificial
  CRISPR gRNA sequence
gggctggcccgcccacgcct

SEQ ID NO: 102503 - DNA, 20 bp, Artificial
  CRISPR gRNA sequence
gctggcccgcccacgcctcg

SEQ ID NO: 102504 - DNA, 20 bp, Artificial
  CRISPR gRNA sequence
gcccacgcctcggagcccta

SEQ ID NO: 102505 - DNA, 20 bp, Artificial
  CRISPR gRNA sequence
cccacgcctcggagccctat

SEQ ID NO: 102506 - DNA, 20 bp, Artificial
  CRISPR gRNA sequence
gcccgcccccgctgtctccc

SEQ ID NO: 102507 - DNA, 20 bp, Artificial
  CRISPR gRNA sequence
cgcccccgctgtctccctgg

SEQ ID NO: 102508 - DNA, 20 bp, Artificial
  CRISPR gRNA sequence
gcccccgctgtctccctggt

SEQ ID NO: 102509 - DNA, 20 bp, Artificial
  CRISPR gRNA sequence
cccccgctgtctccctggtg

SEQ ID NO: 102510 - DNA, 20 bp, Artificial
  CRISPR gRNA sequence
cccgctgtctccctggtggg

SEQ ID NO: 102511 - DNA, 20 bp, Artificial
  CRISPR gRNA sequence
cgctgtctccctggtgggga

SEQ ID NO: 102512 - DNA, 20 bp, Artificial
  CRISPR gRNA sequence
gctgtctccctggtggggag

SEQ ID NO: 102513 - DNA, 20 bp, Artificial
  CRISPR gRNA sequence
ctgtctccctggtggggaga

SEQ ID NO: 102514 - DNA, 20 bp, Artificial
  CRISPR gRNA sequence
tgtctccctggtggggagag

SEQ ID NO: 102515 - DNA, 20 bp, Artificial
  CRISPR gRNA sequence
gtctccctggtggggagagg

SEQ ID NO: 102516 - DNA, 20 bp, Artificial
  CRISPR gRNA sequence
tggtggggagagggggccgt

SEQ ID NO: 102517 - DNA, 20 bp, Artificial
  CRISPR gRNA sequence
ctccgccgcgcccctcctcc

SEQ ID NO: 102518 - DNA, 20 bp, Artificial
  CRISPR gRNA sequence
tcctcccagcccgctccgcc

SEQ ID NO: 102519 - DNA, 20 bp, Artificial
  CRISPR gRNA sequence
cctcccagcccgctccgccc

SEQ ID NO: 102520 - DNA, 20 bp, Artificial
  CRISPR gRNA sequence
gcccgctccgcccgggtctc

SEQ ID NO: 102521 - DNA, 20 bp, Artificial
  CRISPR gRNA sequence
ctccgcccgggtctccggcc

SEQ ID NO: 102522 - DNA, 20 bp, Artificial
  CRISPR gRNA sequence
ggcgccgttaccaccccttt

SEQ ID NO: 102523 - DNA, 20 bp, Artificial
  CRISPR gRNA sequence
tctcttccccgccccgttcg

SEQ ID NO: 102524 - DNA, 20 bp, Artificial
  CRISPR gRNA sequence
cttccccgccccgttcgcag

SEQ ID NO: 102525 - DNA, 20 bp, Artificial
  CRISPR gRNA sequence
ccccgccccgttcgcagtgg

SEQ ID NO: 102526 - DNA, 20 bp, Artificial
  CRISPR gRNA sequence
cccgccccgttcgcagtggc

SEQ ID NO: 102527 - DNA, 20 bp, Artificial
  CRISPR gRNA sequence
aggaccgcacacctccgtct

SEQ ID NO: 102528 - DNA, 20 bp, Artificial
  CRISPR gRNA sequence
gaccgcacacctccgtcttg

SEQ ID NO: 102529 - DNA, 20 bp, Artificial
  CRISPR gRNA sequence
ctccgtcttggagcccaacc

SEQ ID NO: 102530 - DNA, 20 bp, Artificial
  CRISPR gRNA sequence
cgtcttggagcccaaccaag

SEQ ID NO: 102531 - DNA, 20 bp, Artificial
  CRISPR gRNA sequence
agcggtctccgtttcttgtc

SEQ ID NO: 102532 - DNA, 20 bp, Artificial
  CRISPR gRNA sequence
gcggtctccgtttcttgtcc

SEQ ID NO: 102533 - DNA, 20 bp, Artificial
  CRISPR gRNA sequence
ccgtttcttgtccgggctgt

SEQ ID NO: 102534 - DNA, 20 bp, Artificial
  CRISPR gRNA sequence
tcttgtccgggctgtaagac

SEQ ID NO: 102535 - DNA, 20 bp, Artificial
  CRISPR gRNA sequence
ggctgtaagaccagtccatt

SEQ ID NO: 102536 - DNA, 20 bp, Artificial
  CRISPR gRNA sequence
agaccagtccattcggtgcc

SEQ ID NO: 102537 - DNA, 20 bp, Artificial
  CRISPR gRNA sequence
ggtgcctggaacctcactct

SEQ ID NO: 102538 - DNA, 20 bp, Artificial
  CRISPR gRNA sequence
gcctggaacctcactcttag

SEQ ID NO: 102539 - DNA, 20 bp, Artificial
  CRISPR gRNA sequence
atacccttgcgcattctttc

SEQ ID NO: 102540 - DNA, 20 bp, Artificial
  CRISPR gRNA sequence
acccttgcgcattctttccg

SEQ ID NO: 102541 - DNA, 20 bp, Artificial
  CRISPR gRNA sequence
cccttgcgcattctttccgg

SEQ ID NO: 102542 - DNA, 20 bp, Artificial
  CRISPR gRNA sequence
tttgtgaaatctccctccct

SEQ ID NO: 102543 - DNA, 20 bp, Artificial
  CRISPR gRNA sequence
ttgtgaaatctccctccctt

SEQ ID NO: 102544 - DNA, 20 bp, Artificial
  CRISPR gRNA sequence
atctccctcccttgggaata

SEQ ID NO: 102545 - DNA, 20 bp, Artificial
  CRISPR gRNA sequence
cctcccttgggaatatagta

SEQ ID NO: 102546 - DNA, 20 bp, Artificial
  CRISPR gRNA sequence
ttgggaatatagtacagttt

SEQ ID NO: 102547 - DNA, 20 bp, Artificial
  CRISPR gRNA sequence
tgggaatatagtacagtttt

SEQ ID NO: 102548 - DNA, 20 bp, Artificial
  CRISPR gRNA sequence
gggaatatagtacagttttg

SEQ ID NO: 102549 - DNA, 20 bp, Artificial
  CRISPR gRNA sequence
ggaatatagtacagttttgg

SEQ ID NO: 102550 - DNA, 20 bp, Artificial
  CRISPR gRNA sequence
ctttctatgttactttgtgt

SEQ ID NO: 102551 - DNA, 20 bp, Artificial
  CRISPR gRNA sequence
tttctatgttactttgtgtc

SEQ ID NO: 102552 - DNA, 20 bp, Artificial
  CRISPR gRNA sequence
actttgtgtcaggcttgacc

SEQ ID NO: 102553 - DNA, 20 bp, Artificial
  CRISPR gRNA sequence
gacccagtccactcatctct

SEQ ID NO: 102554 - DNA, 20 bp, Artificial
  CRISPR gRNA sequence
tgtttttctgatacactttc

SEQ ID NO: 102555 - DNA, 20 bp, Artificial
  CRISPR gRNA sequence
gtcctgtgttaacgttttct

SEQ ID NO: 102556 - DNA, 20 bp, Artificial
  CRISPR gRNA sequence
ctgtgttaacgttttctcag

SEQ ID NO: 102557 - DNA, 20 bp, Artificial
  CRISPR gRNA sequence
acgttttctcagcagatgtt

SEQ ID NO: 102558 - DNA, 20 bp, Artificial
  CRISPR gRNA sequence
agcagatgtttagaaactaa

SEQ ID NO: 102559 - DNA, 20 bp, Artificial
  CRISPR gRNA sequence
tttagaaactaacagtgttg

SEQ ID NO: 102560 - DNA, 20 bp, Artificial
  CRISPR gRNA sequence
ttagaaactaacagtgttgt

SEQ ID NO: 102561 - DNA, 20 bp, Artificial
  CRISPR gRNA sequence
tagaaactaacagtgttgtg

SEQ ID NO: 102562 - DNA, 20 bp, Artificial
  CRISPR gRNA sequence
cagtgttgtggggttttcct

SEQ ID NO: 102563 - DNA, 20 bp, Artificial
  CRISPR gRNA sequence
agtgttgtggggttttcctt

SEQ ID NO: 102564 - DNA, 20 bp, Artificial
  CRISPR gRNA sequence
gtgttgtggggttttcctta

SEQ ID NO: 102565 - DNA, 20 bp, Artificial
  CRISPR gRNA sequence
tgtggggttttccttagggt

SEQ ID NO: 102566 - DNA, 20 bp, Artificial
  CRISPR gRNA sequence
tggggttttccttagggtga

SEQ ID NO: 102567 - DNA, 20 bp, Artificial
  CRISPR gRNA sequence
ggggttttccttagggtgag

SEQ ID NO: 102568 - DNA, 20 bp, Artificial
  CRISPR gRNA sequence
ttagggtgagaggttgctgt

SEQ ID NO: 102569 - DNA, 20 bp, Artificial
  CRISPR gRNA sequence
gctgttggcaaccaattatc

SEQ ID NO: 102570 - DNA, 20 bp, Artificial
  CRISPR gRNA sequence
gttggcaaccaattatccag

SEQ ID NO: 102571 - DNA, 20 bp, Artificial
  CRISPR gRNA sequence
gcaaccaattatccagcagt

SEQ ID NO: 102572 - DNA, 20 bp, Artificial
  CRISPR gRNA sequence
atccagcagttagtatatgc

SEQ ID NO: 102573 - DNA, 20 bp, Artificial
  CRISPR gRNA sequence
tccagcagttagtatatgcc

SEQ ID NO: 102574 - DNA, 20 bp, Artificial
  CRISPR gRNA sequence
gccaggtataatccgtgtgt

SEQ ID NO: 102575 - DNA, 20 bp, Artificial
  CRISPR gRNA sequence
ccaggtataatccgtgtgtt

SEQ ID NO: 102576 - DNA, 20 bp, Artificial
  CRISPR gRNA sequence
caggtataatccgtgtgtta

SEQ ID NO: 102577 - DNA, 20 bp, Artificial
  CRISPR gRNA sequence
ggtataatccgtgtgttagg

SEQ ID NO: 102578 - DNA, 20 bp, Artificial
  CRISPR gRNA sequence
gtataatccgtgtgttaggg

SEQ ID NO: 102579 - DNA, 20 bp, Artificial
  CRISPR gRNA sequence
tataatccgtgtgttaggga

SEQ ID NO: 102580 - DNA, 20 bp, Artificial
  CRISPR gRNA sequence
taatccgtgtgttagggagg

SEQ ID NO: 102581 - DNA, 20 bp, Artificial
  CRISPR gRNA sequence
tgtgttagggagggagtacg

SEQ ID NO: 102582 - DNA, 20 bp, Artificial
  CRISPR gRNA sequence
tgttagggagggagtacgta

SEQ ID NO: 102583 - DNA, 20 bp, Artificial
  CRISPR gRNA sequence
gttagggagggagtacgtag

SEQ ID NO: 102584 - DNA, 20 bp, Artificial
  CRISPR gRNA sequence
gggagtacgtagaggtcaat

SEQ ID NO: 102585 - DNA, 20 bp, Artificial
  CRISPR gRNA sequence
taagaactgtgcctacctga

SEQ ID NO: 102586 - DNA, 20 bp, Artificial
  CRISPR gRNA sequence
gcctacctgatggaaattga

SEQ ID NO: 102587 - DNA, 20 bp, Artificial
  CRISPR gRNA sequence
cctacctgatggaaattgac

SEQ ID NO: 102588 - DNA, 20 bp, Artificial
  CRISPR gRNA sequence
gatggaaattgacaggtgaa

SEQ ID NO: 102589 - DNA, 20 bp, Artificial
  CRISPR gRNA sequence
atggaaattgacaggtgaac

SEQ ID NO: 102590 - DNA, 20 bp, Artificial
  CRISPR gRNA sequence
gaaattgacaggtgaacagg

SEQ ID NO: 102591 - DNA, 20 bp, Artificial
  CRISPR gRNA sequence
aacaggtagttaatacctaa

SEQ ID NO: 102592 - DNA, 20 bp, Artificial
  CRISPR gRNA sequence
ggtagttaatacctaacggt

SEQ ID NO: 102593 - DNA, 20 bp, Artificial
  CRISPR gRNA sequence
acctaacggttagtgctata

SEQ ID NO: 102594 - DNA, 20 bp, Artificial
  CRISPR gRNA sequence
cctaacggttagtgctataa

SEQ ID NO: 102595 - DNA, 20 bp, Artificial
  CRISPR gRNA sequence
ctaacggttagtgctataaa

SEQ ID NO: 102596 - DNA, 20 bp, Artificial
  CRISPR gRNA sequence
taacggttagtgctataaag

SEQ ID NO: 102597 - DNA, 20 bp, Artificial
  CRISPR gRNA sequence
gttagtgctataaaggggcc

SEQ ID NO: 102598 - DNA, 20 bp, Artificial
  CRISPR gRNA sequence
tgctataaaggggccaagtt

SEQ ID NO: 102599 - DNA, 20 bp, Artificial
  CRISPR gRNA sequence
ggccaagttcagttgctgtg

SEQ ID NO: 102600 - DNA, 20 bp, Artificial
  CRISPR gRNA sequence
gctgtgaagtatccatgcgt

SEQ ID NO: 102601 - DNA, 20 bp, Artificial
  CRISPR gRNA sequence
tgaagtatccatgcgtgagc

SEQ ID NO: 102602 - DNA, 20 bp, Artificial
  CRISPR gRNA sequence
gcgtgagctagcctccgtga

SEQ ID NO: 102603 - DNA, 20 bp, Artificial
  CRISPR gRNA sequence
cgtgagctagcctccgtgaa

SEQ ID NO: 102604 - DNA, 20 bp, Artificial
  CRISPR gRNA sequence
atcaccaccgcacttttgac

SEQ ID NO: 102605 - DNA, 20 bp, Artificial
  CRISPR gRNA sequence
cgcacttttgactggccttg

SEQ ID NO: 102606 - DNA, 20 bp, Artificial
  CRISPR gRNA sequence
tgactggccttgaagaatga

SEQ ID NO: 102607 - DNA, 20 bp, Artificial
  CRISPR gRNA sequence
gaatgatggtaattcttcca

SEQ ID NO: 102608 - DNA, 20 bp, Artificial
  CRISPR gRNA sequence
aatgatggtaattcttccac

SEQ ID NO: 102609 - DNA, 20 bp, Artificial
  CRISPR gRNA sequence
atggtaattcttccacagga

SEQ ID NO: 102610 - DNA, 20 bp, Artificial
  CRISPR gRNA sequence
taattcttccacaggaaaga

SEQ ID NO: 102611 - DNA, 20 bp, Artificial
  CRISPR gRNA sequence
ttcttccacaggaaagatgg

SEQ ID NO: 102612 - DNA, 20 bp, Artificial
  CRISPR gRNA sequence
cttccacaggaaagatggaa

SEQ ID NO: 102613 - DNA, 20 bp, Artificial
  CRISPR gRNA sequence
aagatggaagagcttgctcg

SEQ ID NO: 102614 - DNA, 20 bp, Artificial
  CRISPR gRNA sequence
gatggaagagcttgctcgaa

SEQ ID NO: 102615 - DNA, 20 bp, Artificial
  CRISPR gRNA sequence
ggaagagcttgctcgaagag

SEQ ID NO: 102616 - DNA, 20 bp, Artificial
  CRISPR gRNA sequence
agcttgctcgaagagaagaa

SEQ ID NO: 102617 - DNA, 20 bp, Artificial
  CRISPR gRNA sequence
gaagagaagaaaagcatgtg

SEQ ID NO: 102618 - DNA, 20 bp, Artificial
  CRISPR gRNA sequence
agagaagaaaagcatgtgca

SEQ ID NO: 102619 - DNA, 20 bp, Artificial
  CRISPR gRNA sequence
gagaagaaaagcatgtgcag

SEQ ID NO: 102620 - DNA, 20 bp, Artificial
  CRISPR gRNA sequence
gaggaatcaaattacactgt

SEQ ID NO: 102621 - DNA, 20 bp, Artificial
  CRISPR gRNA sequence
ggaatcaaattacactgttg

SEQ ID NO: 102622 - DNA, 20 bp, Artificial
  CRISPR gRNA sequence
gaatcaaattacactgttgg

SEQ ID NO: 102623 - DNA, 20 bp, Artificial
  CRISPR gRNA sequence
tcaaattacactgttggagg

SEQ ID NO: 102624 - DNA, 20 bp, Artificial
  CRISPR gRNA sequence
caaattacactgttggaggc

SEQ ID NO: 102625 - DNA, 20 bp, Artificial
  CRISPR gRNA sequence
attacactgttggaggcagg

SEQ ID NO: 102626 - DNA, 20 bp, Artificial
  CRISPR gRNA sequence
cactgttggaggcaggaaga

SEQ ID NO: 102627 - DNA, 20 bp, Artificial
  CRISPR gRNA sequence
actgttggaggcaggaagat

SEQ ID NO: 102628 - DNA, 20 bp, Artificial
  CRISPR gRNA sequence
ttggaggcaggaagatggga

SEQ ID NO: 102629 - DNA, 20 bp, Artificial
  CRISPR gRNA sequence
tggaggcaggaagatgggat

SEQ ID NO: 102630 - DNA, 20 bp, Artificial
  CRISPR gRNA sequence
ggaggcaggaagatgggata

SEQ ID NO: 102631 - DNA, 20 bp, Artificial
  CRISPR gRNA sequence
ggcaggaagatgggataggg

SEQ ID NO: 102632 - DNA, 20 bp, Artificial
  CRISPR gRNA sequence
aggaagatgggatagggaag

SEQ ID NO: 102633 - DNA, 20 bp, Artificial
  CRISPR gRNA sequence
ggaagatgggatagggaagt

SEQ ID NO: 102634 - DNA, 20 bp, Artificial
  CRISPR gRNA sequence
agatgggatagggaagtggg

SEQ ID NO: 102635 - DNA, 20 bp, Artificial
  CRISPR gRNA sequence
tgggatagggaagtgggcag

SEQ ID NO: 102636 - DNA, 20 bp, Artificial
  CRISPR gRNA sequence
gaagtgggcagtagttgtga

SEQ ID NO: 102637 - DNA, 20 bp, Artificial
  CRISPR gRNA sequence
gggcagtagttgtgatagtt

SEQ ID NO: 102638 - DNA, 20 bp, Artificial
  CRISPR gRNA sequence
ggcagtagttgtgatagttt

SEQ ID NO: 102639 - DNA, 20 bp, Artificial
  CRISPR gRNA sequence
gcagtagttgtgatagttta

SEQ ID NO: 102640 - DNA, 20 bp, Artificial
  CRISPR gRNA sequence
cagtagttgtgatagtttag

SEQ ID NO: 102641 - DNA, 20 bp, Artificial
  CRISPR gRNA sequence
agtagttgtgatagtttagg

SEQ ID NO: 102642 - DNA, 20 bp, Artificial
  CRISPR gRNA sequence
gtagttgtgatagtttaggg

SEQ ID NO: 102643 - DNA, 20 bp, Artificial
  CRISPR gRNA sequence
ttgtgatagtttagggggga

SEQ ID NO: 102644 - DNA, 20 bp, Artificial
  CRISPR gRNA sequence
atagtttaggggggaaagcc

SEQ ID NO: 102645 - DNA, 20 bp, Artificial
  CRISPR gRNA sequence
tttaggggggaaagcccagt

SEQ ID NO: 102646 - DNA, 20 bp, Artificial
  CRISPR gRNA sequence
aaatacttgtatatcttgct

SEQ ID NO: 102647 - DNA, 20 bp, Artificial
  CRISPR gRNA sequence
aatacttgtatatcttgcta

SEQ ID NO: 102648 - DNA, 20 bp, Artificial
  CRISPR gRNA sequence
tatcttgctaaggaatattt

SEQ ID NO: 102649 - DNA, 20 bp, Artificial
  CRISPR gRNA sequence
gctaaggaatattttggaaa

SEQ ID NO: 102650 - DNA, 20 bp, Artificial
  CRISPR gRNA sequence
gaaacagttattattttgta

SEQ ID NO: 102651 - DNA, 20 bp, Artificial
  CRISPR gRNA sequence
aacagttattattttgtatg

SEQ ID NO: 102652 - DNA, 20 bp, Artificial
  CRISPR gRNA sequence
acagttattattttgtatgg

SEQ ID NO: 102653 - DNA, 20 bp, Artificial
  CRISPR gRNA sequence
attattttgtatggaggttc

SEQ ID NO: 102654 - DNA, 20 bp, Artificial
  CRISPR gRNA sequence
attttgtatggaggttcaag

SEQ ID NO: 102655 - DNA, 20 bp, Artificial
  CRISPR gRNA sequence
ttgtatggaggttcaagtag

SEQ ID NO: 102656 - DNA, 20 bp, Artificial
  CRISPR gRNA sequence
tgtatggaggttcaagtaga

SEQ ID NO: 102657 - DNA, 20 bp, Artificial
  CRISPR gRNA sequence
gtatggaggttcaagtagaa

SEQ ID NO: 102658 - DNA, 20 bp, Artificial
  CRISPR gRNA sequence
aggttcaagtagaagggatc

SEQ ID NO: 102659 - DNA, 20 bp, Artificial
  CRISPR gRNA sequence
gttcaagtagaagggatcta

SEQ ID NO: 102660 - DNA, 20 bp, Artificial
  CRISPR gRNA sequence
ctagagctatattttttcct

SEQ ID NO: 102661 - DNA, 20 bp, Artificial
  CRISPR gRNA sequence
tttcctaagattgaaaaaac

SEQ ID NO: 102662 - DNA, 20 bp, Artificial
  CRISPR gRNA sequence
acgagtttctgacttgttta

SEQ ID NO: 102663 - DNA, 20 bp, Artificial
  CRISPR gRNA sequence
cgagtttctgacttgtttat

SEQ ID NO: 102664 - DNA, 20 bp, Artificial
  CRISPR gRNA sequence
ttatgggttctgccccgtga

SEQ ID NO: 102665 - DNA, 20 bp, Artificial
  CRISPR gRNA sequence
tgggttctgccccgtgatag

SEQ ID NO: 102666 - DNA, 20 bp, Artificial
  CRISPR gRNA sequence
tctgccccgtgatagtggct

SEQ ID NO: 102667 - DNA, 20 bp, Artificial
  CRISPR gRNA sequence
gtgatagtggctgagttctt

SEQ ID NO: 102668 - DNA, 20 bp, Artificial
  CRISPR gRNA sequence
tgatagtggctgagttcttt

SEQ ID NO: 102669 - DNA, 20 bp, Artificial
  CRISPR gRNA sequence
gatagtggctgagttctttg

SEQ ID NO: 102670 - DNA, 20 bp, Artificial
  CRISPR gRNA sequence
ggctgagttctttggggatg

SEQ ID NO: 102671 - DNA, 20 bp, Artificial
  CRISPR gRNA sequence
ctgagttctttggggatgaa

SEQ ID NO: 102672 - DNA, 20 bp, Artificial
  CRISPR gRNA sequence
tgagttctttggggatgaag

SEQ ID NO: 102673 - DNA, 20 bp, Artificial
  CRISPR gRNA sequence
agttctttggggatgaagag

SEQ ID NO: 102674 - DNA, 20 bp, Artificial
  CRISPR gRNA sequence
gatgaagaggagacttgtcc

SEQ ID NO: 102675 - DNA, 20 bp, Artificial
  CRISPR gRNA sequence
atgaagaggagacttgtcct

SEQ ID NO: 102676 - DNA, 20 bp, Artificial
  CRISPR gRNA sequence
ttttactcatgtgaatcatc

SEQ ID NO: 102677 - DNA, 20 bp, Artificial
  CRISPR gRNA sequence
gaatcatctagtgcattccc

SEQ ID NO: 102678 - DNA, 20 bp, Artificial
  CRISPR gRNA sequence
agtgcattccctggcacata

SEQ ID NO: 102679 - DNA, 20 bp, Artificial
  CRISPR gRNA sequence
gtgcattccctggcacataa

SEQ ID NO: 102680 - DNA, 20 bp, Artificial
  CRISPR gRNA sequence
ccctggcacataaaggtctt

SEQ ID NO: 102681 - DNA, 20 bp, Artificial
  CRISPR gRNA sequence
acataaaggtcttaagtatc

SEQ ID NO: 102682 - DNA, 20 bp, Artificial
  CRISPR gRNA sequence
atttaatgttatacaactaa

SEQ ID NO: 102683 - DNA, 20 bp, Artificial
  CRISPR gRNA sequence
tttaatgttatacaactaat

SEQ ID NO: 102684 - DNA, 20 bp, Artificial
  CRISPR gRNA sequence
gttatacaactaataggttt

SEQ ID NO: 102685 - DNA, 20 bp, Artificial
  CRISPR gRNA sequence
gtttcagaaaactcgtattc

SEQ ID NO: 102686 - DNA, 20 bp, Artificial
  CRISPR gRNA sequence
ctctttcattactaaaactt

SEQ ID NO: 102687 - DNA, 20 bp, Artificial
  CRISPR gRNA sequence
tctttcattactaaaacttc

SEQ ID NO: 102688 - DNA, 20 bp, Artificial
  CRISPR gRNA sequence
ctttcattactaaaacttcg

SEQ ID NO: 102689 - DNA, 20 bp, Artificial
  CRISPR gRNA sequence
cattactaaaacttcgggga

SEQ ID NO: 102690 - DNA, 20 bp, Artificial
  CRISPR gRNA sequence
attactaaaacttcggggac

SEQ ID NO: 102691 - DNA, 20 bp, Artificial
  CRISPR gRNA sequence
caggttttattttcactttt

SEQ ID NO: 102692 - DNA, 20 bp, Artificial
  CRISPR gRNA sequence
aggttttattttcacttttt

SEQ ID NO: 102693 - DNA, 20 bp, Artificial
  CRISPR gRNA sequence
ggttttattttcacttttta

SEQ ID NO: 102694 - DNA, 20 bp, Artificial
  CRISPR gRNA sequence
ttattttcactttttagggt

SEQ ID NO: 102695 - DNA, 20 bp, Artificial
  CRISPR gRNA sequence
tgagtttttcattgttgctt

SEQ ID NO: 102696 - DNA, 20 bp, Artificial
  CRISPR gRNA sequence
gattgtcacgttatccgcat

SEQ ID NO: 102697 - DNA, 20 bp, Artificial
  CRISPR gRNA sequence
tgtcacgttatccgcattag

SEQ ID NO: 102698 - DNA, 20 bp, Artificial
  CRISPR gRNA sequence
cgttatccgcattagcagat

SEQ ID NO: 102699 - DNA, 20 bp, Artificial
  CRISPR gRNA sequence
cgcattagcagatgagatga

SEQ ID NO: 102700 - DNA, 20 bp, Artificial
  CRISPR gRNA sequence
cattagcagatgagatgata

SEQ ID NO: 102701 - DNA, 20 bp, Artificial
  CRISPR gRNA sequence
cagatgagatgatagagctt

SEQ ID NO: 102702 - DNA, 20 bp, Artificial
  CRISPR gRNA sequence
atgagatgatagagcttaag

SEQ ID NO: 102703 - DNA, 20 bp, Artificial
  CRISPR gRNA sequence
aaaacatgtatatttgcctt

SEQ ID NO: 102704 - DNA, 20 bp, Artificial
  CRISPR gRNA sequence
aacgtttttttgtttgtttt

SEQ ID NO: 102705 - DNA, 20 bp, Artificial
  CRISPR gRNA sequence
tttttgtttgtttttggata

SEQ ID NO: 102706 - DNA, 20 bp, Artificial
  CRISPR gRNA sequence
ttttgtttgtttttggatac

SEQ ID NO: 102707 - DNA, 20 bp, Artificial
  CRISPR gRNA sequence
tttgtttgtttttggataca

SEQ ID NO: 102708 - DNA, 20 bp, Artificial
  CRISPR gRNA sequence
cagggctttcctctgtcatc

SEQ ID NO: 102709 - DNA, 20 bp, Artificial
  CRISPR gRNA sequence
agggctttcctctgtcatcc

SEQ ID NO: 102710 - DNA, 20 bp, Artificial
  CRISPR gRNA sequence
ctttcctctgtcatccaggc

SEQ ID NO: 102711 - DNA, 20 bp, Artificial
  CRISPR gRNA sequence
ttcctctgtcatccaggctg

SEQ ID NO: 102712 - DNA, 20 bp, Artificial
  CRISPR gRNA sequence
ctgtcatccaggctggagta

SEQ ID NO: 102713 - DNA, 20 bp, Artificial
  CRISPR gRNA sequence
tcatccaggctggagtacag

SEQ ID NO: 102714 - DNA, 20 bp, Artificial
  CRISPR gRNA sequence
ggagtacagtggcgcaatcg

SEQ ID NO: 102715 - DNA, 20 bp, Artificial
  CRISPR gRNA sequence
gcaatcgtagctcactaacc

SEQ ID NO: 102716 - DNA, 20 bp, Artificial
  CRISPR gRNA sequence
gctcactaacctggaactcc

SEQ ID NO: 102717 - DNA, 20 bp, Artificial
  CRISPR gRNA sequence
ctcactaacctggaactcct

SEQ ID NO: 102718 - DNA, 20 bp, Artificial
  CRISPR gRNA sequence
aacctggaactcctgggctc

SEQ ID NO: 102719 - DNA, 20 bp, Artificial
  CRISPR gRNA sequence
ttcttgttctcccaaaacgt

SEQ ID NO: 102720 - DNA, 20 bp, Artificial
  CRISPR gRNA sequence
tcttgttctcccaaaacgtt

SEQ ID NO: 102721 - DNA, 20 bp, Artificial
  CRISPR gRNA sequence
ctcccaaaacgttgggatta

SEQ ID NO: 102722 - DNA, 20 bp, Artificial
  CRISPR gRNA sequence
tcccaaaacgttgggattac

SEQ ID NO: 102723 - DNA, 20 bp, Artificial
  CRISPR gRNA sequence
aacgttgggattacaggcat

SEQ ID NO: 102724 - DNA, 20 bp, Artificial
  CRISPR gRNA sequence
cactgcgtcctgacctgaaa

SEQ ID NO: 102725 - DNA, 20 bp, Artificial
  CRISPR gRNA sequence
tgaaatagatgttttaacct

SEQ ID NO: 102726 - DNA, 20 bp, Artificial
  CRISPR gRNA sequence
ttaaccttagtatttaaaaa

SEQ ID NO: 102727 - DNA, 20 bp, Artificial
  CRISPR gRNA sequence
taaccttagtatttaaaaat

SEQ ID NO: 102728 - DNA, 20 bp, Artificial
  CRISPR gRNA sequence
atttaaaaataggtatgttc

SEQ ID NO: 102729 - DNA, 20 bp, Artificial
  CRISPR gRNA sequence
aatcactaaatacttttgct

SEQ ID NO: 102730 - DNA, 20 bp, Artificial
  CRISPR gRNA sequence
tttgcttggcatctttctaa

SEQ ID NO: 102731 - DNA, 20 bp, Artificial
  CRISPR gRNA sequence
ttgcttggcatctttctaaa

SEQ ID NO: 102732 - DNA, 20 bp, Artificial
  CRISPR gRNA sequence
ttctaaaaggcattataatc

SEQ ID NO: 102733 - DNA, 20 bp, Artificial
  CRISPR gRNA sequence
ttttttgctaaataccttac

SEQ ID NO: 102734 - DNA, 20 bp, Artificial
  CRISPR gRNA sequence
aataccttacaagcttccac

SEQ ID NO: 102735 - DNA, 20 bp, Artificial
  CRISPR gRNA sequence
tacaagcttccaccagtctg

SEQ ID NO: 102736 - DNA, 20 bp, Artificial
  CRISPR gRNA sequence
aagcttccaccagtctgcag

SEQ ID NO: 102737 - DNA, 20 bp, Artificial
  CRISPR gRNA sequence
atttctttgtctgacatttt

SEQ ID NO: 102738 - DNA, 20 bp, Artificial
  CRISPR gRNA sequence
ttctttgtctgacattttga

SEQ ID NO: 102739 - DNA, 20 bp, Artificial
  CRISPR gRNA sequence
ttgtctgacattttgagaga

SEQ ID NO: 102740 - DNA, 20 bp, Artificial
  CRISPR gRNA sequence
tctgacattttgagagaaag

SEQ ID NO: 102741 - DNA, 20 bp, Artificial
  CRISPR gRNA sequence
cattttgagagaaagtagtg

SEQ ID NO: 102742 - DNA, 20 bp, Artificial
  CRISPR gRNA sequence
agagaaagtagtgtggcccc

SEQ ID NO: 102743 - DNA, 20 bp, Artificial
  CRISPR gRNA sequence
cccaagctttttttcctgtt

SEQ ID NO: 102744 - DNA, 20 bp, Artificial
  CRISPR gRNA sequence
ttttatgctctcttgatttg

SEQ ID NO: 102745 - DNA, 20 bp, Artificial
  CRISPR gRNA sequence
ccttcctccacatcatcaca

SEQ ID NO: 102746 - DNA, 20 bp, Artificial
  CRISPR gRNA sequence
gctaaatctttctcacactt

SEQ ID NO: 102747 - DNA, 20 bp, Artificial
  CRISPR gRNA sequence
atctttctcacacttaagac

SEQ ID NO: 102748 - DNA, 20 bp, Artificial
  CRISPR gRNA sequence
cttaagaccagttcatcctg

SEQ ID NO: 102749 - DNA, 20 bp, Artificial
  CRISPR gRNA sequence
ttaagaccagttcatcctgc

SEQ ID NO: 102750 - DNA, 20 bp, Artificial
  CRISPR gRNA sequence
ttcatcctgcaggcctctga

SEQ ID NO: 102751 - DNA, 20 bp, Artificial
  CRISPR gRNA sequence
cctgcaggcctctgatagca

SEQ ID NO: 102752 - DNA, 20 bp, Artificial
  CRISPR gRNA sequence
tctgatagcaaagaaaaaaa

SEQ ID NO: 102753 - DNA, 20 bp, Artificial
  CRISPR gRNA sequence
agcaaagaaaaaaaaagttc

SEQ ID NO: 102754 - DNA, 20 bp, Artificial
  CRISPR gRNA sequence
aaagaaaaaaaaagttcaag

SEQ ID NO: 102755 - DNA, 20 bp, Artificial
  CRISPR gRNA sequence
agtagtaccttttttttttt

SEQ ID NO: 102756 - DNA, 20 bp, Artificial
  CRISPR gRNA sequence
aagccttgttgatttatccc

SEQ ID NO: 102757 - DNA, 20 bp, Artificial
  CRISPR gRNA sequence
cttgttgatttatccccagc

SEQ ID NO: 102758 - DNA, 20 bp, Artificial
  CRISPR gRNA sequence
tcccatatcactttatctct

SEQ ID NO: 102759 - DNA, 20 bp, Artificial
  CRISPR gRNA sequence
cccatatcactttatctctt

SEQ ID NO: 102760 - DNA, 20 bp, Artificial
  CRISPR gRNA sequence
cactttatctcttaggattc

SEQ ID NO: 102761 - DNA, 20 bp, Artificial
  CRISPR gRNA sequence
tatctcttaggattccagta

SEQ ID NO: 102762 - DNA, 20 bp, Artificial
  CRISPR gRNA sequence
atctcttaggattccagtat

SEQ ID NO: 102763 - DNA, 20 bp, Artificial
  CRISPR gRNA sequence
aggattccagtataggtttt

SEQ ID NO: 102764 - DNA, 20 bp, Artificial
  CRISPR gRNA sequence
ttagtccattactaaactta

SEQ ID NO: 102765 - DNA, 20 bp, Artificial
  CRISPR gRNA sequence
ctaaacttaaagactctttg

SEQ ID NO: 102766 - DNA, 20 bp, Artificial
  CRISPR gRNA sequence
tttgaagtttgaatcttcgt

SEQ ID NO: 102767 - DNA, 20 bp, Artificial
  CRISPR gRNA sequence
tgaagtttgaatcttcgtca

SEQ ID NO: 102768 - DNA, 20 bp, Artificial
  CRISPR gRNA sequence
ctttttatttttaaaacctt

SEQ ID NO: 102769 - DNA, 20 bp, Artificial
  CRISPR gRNA sequence
tatttttaaaaccttcagaa

SEQ ID NO: 102770 - DNA, 20 bp, Artificial
  CRISPR gRNA sequence
aaaaccttcagaacagtgtc

SEQ ID NO: 102771 - DNA, 20 bp, Artificial
  CRISPR gRNA sequence
tcagaacagtgtctggcaca

SEQ ID NO: 102772 - DNA, 20 bp, Artificial
  CRISPR gRNA sequence
tctggcacatggtacataat

SEQ ID NO: 102773 - DNA, 20 bp, Artificial
  CRISPR gRNA sequence
ggcacatggtacataattag

SEQ ID NO: 102774 - DNA, 20 bp, Artificial
  CRISPR gRNA sequence
cacatggtacataattagtg

SEQ ID NO: 102775 - DNA, 20 bp, Artificial
  CRISPR gRNA sequence
catggtacataattagtgga

SEQ ID NO: 102776 - DNA, 20 bp, Artificial
  CRISPR gRNA sequence
ggtacataattagtggagag

SEQ ID NO: 102777 - DNA, 20 bp, Artificial
  CRISPR gRNA sequence
attagtggagagaagtgcat

SEQ ID NO: 102778 - DNA, 20 bp, Artificial
  CRISPR gRNA sequence
gtggagagaagtgcattaga

SEQ ID NO: 102779 - DNA, 20 bp, Artificial
  CRISPR gRNA sequence
tgcattagaaagctccaatc

SEQ ID NO: 102780 - DNA, 20 bp, Artificial
  CRISPR gRNA sequence
agctccaatccagaaatctg

SEQ ID NO: 102781 - DNA, 20 bp, Artificial
  CRISPR gRNA sequence
gctccaatccagaaatctgt

SEQ ID NO: 102782 - DNA, 20 bp, Artificial
  CRISPR gRNA sequence
tccagaaatctgtaggatga

SEQ ID NO: 102783 - DNA, 20 bp, Artificial
  CRISPR gRNA sequence
ccagaaatctgtaggatgat

SEQ ID NO: 102784 - DNA, 20 bp, Artificial
  CRISPR gRNA sequence
cagaaatctgtaggatgatg

SEQ ID NO: 102785 - DNA, 20 bp, Artificial
  CRISPR gRNA sequence
aaatctgtaggatgatgggg

SEQ ID NO: 102786 - DNA, 20 bp, Artificial
  CRISPR gRNA sequence
ctgtaggatgatggggaagc

SEQ ID NO: 102787 - DNA, 20 bp, Artificial
  CRISPR gRNA sequence
aggatgatggggaagctgga

SEQ ID NO: 102788 - DNA, 20 bp, Artificial
  CRISPR gRNA sequence
agctggacagccctttgttg

SEQ ID NO: 102789 - DNA, 20 bp, Artificial
  CRISPR gRNA sequence
gacagccctttgttgtagtc

SEQ ID NO: 102790 - DNA, 20 bp, Artificial
  CRISPR gRNA sequence
ttgtagtctagtctttcatc

SEQ ID NO: 102791 - DNA, 20 bp, Artificial
  CRISPR gRNA sequence
gtctttcatcaagcgtctat

SEQ ID NO: 102792 - DNA, 20 bp, Artificial
  CRISPR gRNA sequence
tctttcatcaagcgtctatc

SEQ ID NO: 102793 - DNA, 20 bp, Artificial
  CRISPR gRNA sequence
tctatcaggacccacttgtt

SEQ ID NO: 102794 - DNA, 20 bp, Artificial
  CRISPR gRNA sequence
acccacttgttgagttgtga

SEQ ID NO: 102795 - DNA, 20 bp, Artificial
  CRISPR gRNA sequence
gttgagttgtgaaagaaatt

SEQ ID NO: 102796 - DNA, 20 bp, Artificial
  CRISPR gRNA sequence
agttgtgaaagaaattgagt

SEQ ID NO: 102797 - DNA, 20 bp, Artificial
  CRISPR gRNA sequence
gaaattgagtgagccaatgc

SEQ ID NO: 102798 - DNA, 20 bp, Artificial
  CRISPR gRNA sequence
aaattgagtgagccaatgct

SEQ ID NO: 102799 - DNA, 20 bp, Artificial
  CRISPR gRNA sequence
tgctgggaatttttaaataa

SEQ ID NO: 102800 - DNA, 20 bp, Artificial
  CRISPR gRNA sequence
ggaatttttaaataatagaa

SEQ ID NO: 102801 - DNA, 20 bp, Artificial
  CRISPR gRNA sequence
atagaatagaaaatatctgc

SEQ ID NO: 102802 - DNA, 20 bp, Artificial
  CRISPR gRNA sequence
tagaatagaaaatatctgcc

SEQ ID NO: 102803 - DNA, 20 bp, Artificial
  CRISPR gRNA sequence
atatctgccaggcatgatga

SEQ ID NO: 102804 - DNA, 20 bp, Artificial
  CRISPR gRNA sequence
atggctcacgactgtaatcc

SEQ ID NO: 102805 - DNA, 20 bp, Artificial
  CRISPR gRNA sequence
cgactgtaatcccagcactt

SEQ ID NO: 102806 - DNA, 20 bp, Artificial
  CRISPR gRNA sequence
gactgtaatcccagcacttt

SEQ ID NO: 102807 - DNA, 20 bp, Artificial
  CRISPR gRNA sequence
tgtaatcccagcactttggg

SEQ ID NO: 102808 - DNA, 20 bp, Artificial
  CRISPR gRNA sequence
cccagcactttgggaagccg

SEQ ID NO: 102809 - DNA, 20 bp, Artificial
  CRISPR gRNA sequence
agcactttgggaagccgaag

SEQ ID NO: 102810 - DNA, 20 bp, Artificial
  CRISPR gRNA sequence
gcactttgggaagccgaagt

SEQ ID NO: 102811 - DNA, 20 bp, Artificial
  CRISPR gRNA sequence
actttgggaagccgaagtgg

SEQ ID NO: 102812 - DNA, 20 bp, Artificial
  CRISPR gRNA sequence
ccgaagtgggagaatccttt

SEQ ID NO: 102813 - DNA, 20 bp, Artificial
  CRISPR gRNA sequence
gtgggagaatcctttgagct

SEQ ID NO: 102814 - DNA, 20 bp, Artificial
  CRISPR gRNA sequence
tgggagaatcctttgagctc

SEQ ID NO: 102815 - DNA, 20 bp, Artificial
  CRISPR gRNA sequence
ggagaatcctttgagctcag

SEQ ID NO: 102816 - DNA, 20 bp, Artificial
  CRISPR gRNA sequence
tcctttgagctcaggagttt

SEQ ID NO: 102817 - DNA, 20 bp, Artificial
  CRISPR gRNA sequence
tgagctcaggagtttgagac

SEQ ID NO: 102818 - DNA, 20 bp, Artificial
  CRISPR gRNA sequence
tcaggagtttgagaccagcc

SEQ ID NO: 102819 - DNA, 20 bp, Artificial
  CRISPR gRNA sequence
caggagtttgagaccagcct

SEQ ID NO: 102820 - DNA, 20 bp, Artificial
  CRISPR gRNA sequence
gagtttgagaccagcctggg

SEQ ID NO: 102821 - DNA, 20 bp, Artificial
  CRISPR gRNA sequence
tgagaccagcctgggtagca

SEQ ID NO: 102822 - DNA, 20 bp, Artificial
  CRISPR gRNA sequence
gagaccagcctgggtagcat

SEQ ID NO: 102823 - DNA, 20 bp, Artificial
  CRISPR gRNA sequence
agaccagcctgggtagcata

SEQ ID NO: 102824 - DNA, 20 bp, Artificial
  CRISPR gRNA sequence
accagcctgggtagcatagg

SEQ ID NO: 102825 - DNA, 20 bp, Artificial
  CRISPR gRNA sequence
agggagaccccctctcttaa

SEQ ID NO: 102826 - DNA, 20 bp, Artificial
  CRISPR gRNA sequence
ccctctcttaaaagaaaaaa

SEQ ID NO: 102827 - DNA, 20 bp, Artificial
  CRISPR gRNA sequence
tcttaaaagaaaaaaaagaa

SEQ ID NO: 102828 - DNA, 20 bp, Artificial
  CRISPR gRNA sequence
aaaaagaatagaaaatacca

SEQ ID NO: 102829 - DNA, 20 bp, Artificial
  CRISPR gRNA sequence
agtgcatcttgtgttgtata

SEQ ID NO: 102830 - DNA, 20 bp, Artificial
  CRISPR gRNA sequence
gtgcatcttgtgttgtataa

SEQ ID NO: 102831 - DNA, 20 bp, Artificial
  CRISPR gRNA sequence
gtttcatgaaactttcattt

SEQ ID NO: 102832 - DNA, 20 bp, Artificial
  CRISPR gRNA sequence
gctttatacatgtgtgcact

SEQ ID NO: 102833 - DNA, 20 bp, Artificial
  CRISPR gRNA sequence
aatgaaatgtgtttcttact

SEQ ID NO: 102834 - DNA, 20 bp, Artificial
  CRISPR gRNA sequence
atgaaatgtgtttcttacta

SEQ ID NO: 102835 - DNA, 20 bp, Artificial
  CRISPR gRNA sequence
tgaaatgtgtttcttactaa

SEQ ID NO: 102836 - DNA, 20 bp, Artificial
  CRISPR gRNA sequence
gtgtttcttactaagggttg

SEQ ID NO: 102837 - DNA, 20 bp, Artificial
  CRISPR gRNA sequence
actaagggttgtggtcaaaa

SEQ ID NO: 102838 - DNA, 20 bp, Artificial
  CRISPR gRNA sequence
ttgtggtcaaaaaagttaaa

SEQ ID NO: 102839 - DNA, 20 bp, Artificial
  CRISPR gRNA sequence
aagttaaaaagctactgttc

SEQ ID NO: 102840 - DNA, 20 bp, Artificial
  CRISPR gRNA sequence
agttaaaaagctactgttct

SEQ ID NO: 102841 - DNA, 20 bp, Artificial
  CRISPR gRNA sequence
ctactgttctaggctttgcc

SEQ ID NO: 102842 - DNA, 20 bp, Artificial
  CRISPR gRNA sequence
ctgttctaggctttgcctgg

SEQ ID NO: 102843 - DNA, 20 bp, Artificial
  CRISPR gRNA sequence
tatcaactgtgataatccta

SEQ ID NO: 102844 - DNA, 20 bp, Artificial
  CRISPR gRNA sequence
ggcttttcatatgcttacac

SEQ ID NO: 102845 - DNA, 20 bp, Artificial
  CRISPR gRNA sequence
ttcatatgcttacactagtt

SEQ ID NO: 102846 - DNA, 20 bp, Artificial
  CRISPR gRNA sequence
ttacactagttgagtttctg

SEQ ID NO: 102847 - DNA, 20 bp, Artificial
  CRISPR gRNA sequence
acactagttgagtttctgaa

SEQ ID NO: 102848 - DNA, 20 bp, Artificial
  CRISPR gRNA sequence
cactagttgagtttctgaag

SEQ ID NO: 102849 - DNA, 20 bp, Artificial
  CRISPR gRNA sequence
ttgagtttctgaagaggttt

SEQ ID NO: 102850 - DNA, 20 bp, Artificial
  CRISPR gRNA sequence
ttctgaagaggttttagctt

SEQ ID NO: 102851 - DNA, 20 bp, Artificial
  CRISPR gRNA sequence
ctgaagaggttttagctttg

SEQ ID NO: 102852 - DNA, 20 bp, Artificial
  CRISPR gRNA sequence
ttttagctttggagtttgtg

SEQ ID NO: 102853 - DNA, 20 bp, Artificial
  CRISPR gRNA sequence
tttagctttggagtttgtgt

SEQ ID NO: 102854 - DNA, 20 bp, Artificial
  CRISPR gRNA sequence
ggagtttgtgtaggtccaca

SEQ ID NO: 102855 - DNA, 20 bp, Artificial
  CRISPR gRNA sequence
ttgtgtaggtccacatagaa

SEQ ID NO: 102856 - DNA, 20 bp, Artificial
  CRISPR gRNA sequence
tgtgtaggtccacatagaat

SEQ ID NO: 102857 - DNA, 20 bp, Artificial
  CRISPR gRNA sequence
gtccacatagaatgggttcc

SEQ ID NO: 102858 - DNA, 20 bp, Artificial
  CRISPR gRNA sequence
acatagaatgggttcctagt

SEQ ID NO: 102859 - DNA, 20 bp, Artificial
  CRISPR gRNA sequence
tagaatgggttcctagtaag

SEQ ID NO: 102860 - DNA, 20 bp, Artificial
  CRISPR gRNA sequence
atgggttcctagtaagtggt

SEQ ID NO: 102861 - DNA, 20 bp, Artificial
  CRISPR gRNA sequence
ttcctagtaagtggttggct

SEQ ID NO: 102862 - DNA, 20 bp, Artificial
  CRISPR gRNA sequence
gtaagtggttggctaagtct

SEQ ID NO: 102863 - DNA, 20 bp, Artificial
  CRISPR gRNA sequence
aagtctcagcttttgcacct

SEQ ID NO: 102864 - DNA, 20 bp, Artificial
  CRISPR gRNA sequence
tcagcttttgcaccttggaa

SEQ ID NO: 102865 - DNA, 20 bp, Artificial
  CRISPR gRNA sequence
gcttttgcaccttggaatag

SEQ ID NO: 102866 - DNA, 20 bp, Artificial
  CRISPR gRNA sequence
cttttgcaccttggaatagt

SEQ ID NO: 102867 - DNA, 20 bp, Artificial
  CRISPR gRNA sequence
ttttgcaccttggaatagtg

SEQ ID NO: 102868 - DNA, 20 bp, Artificial
  CRISPR gRNA sequence
caccttggaatagtggggca

SEQ ID NO: 102869 - DNA, 20 bp, Artificial
  CRISPR gRNA sequence
ccttggaatagtggggcaaa

SEQ ID NO: 102870 - DNA, 20 bp, Artificial
  CRISPR gRNA sequence
ggggcaaagagaattgcact

SEQ ID NO: 102871 - DNA, 20 bp, Artificial
  CRISPR gRNA sequence
gcaaagagaattgcactgag

SEQ ID NO: 102872 - DNA, 20 bp, Artificial
  CRISPR gRNA sequence
aaagagaattgcactgagaa

SEQ ID NO: 102873 - DNA, 20 bp, Artificial
  CRISPR gRNA sequence
gcactgagaagagaatgcac

SEQ ID NO: 102874 - DNA, 20 bp, Artificial
  CRISPR gRNA sequence
cactgagaagagaatgcact

SEQ ID NO: 102875 - DNA, 20 bp, Artificial
  CRISPR gRNA sequence
tgagaagagaatgcactagg

SEQ ID NO: 102876 - DNA, 20 bp, Artificial
  CRISPR gRNA sequence
agaagagaatgcactaggaa

SEQ ID NO: 102877 - DNA, 20 bp, Artificial
  CRISPR gRNA sequence
taggaagagaattttcatgc

SEQ ID NO: 102878 - DNA, 20 bp, Artificial
  CRISPR gRNA sequence
aagagaattttcatgctagc

SEQ ID NO: 102879 - DNA, 20 bp, Artificial
  CRISPR gRNA sequence
ttatttgtttctctctcttt

SEQ ID NO: 102880 - DNA, 20 bp, Artificial
  CRISPR gRNA sequence
tatttgtttctctctctttg

SEQ ID NO: 102881 - DNA, 20 bp, Artificial
  CRISPR gRNA sequence
accattcaaaactttgtgtt

SEQ ID NO: 102882 - DNA, 20 bp, Artificial
  CRISPR gRNA sequence
cattcaaaactttgtgttaa

SEQ ID NO: 102883 - DNA, 20 bp, Artificial
  CRISPR gRNA sequence
caaaactttgtgttaagagc

SEQ ID NO: 102884 - DNA, 20 bp, Artificial
  CRISPR gRNA sequence
aaactttgtgttaagagcaa

SEQ ID NO: 102885 - DNA, 20 bp, Artificial
  CRISPR gRNA sequence
tttgtgttaagagcaagagc

SEQ ID NO: 102886 - DNA, 20 bp, Artificial
  CRISPR gRNA sequence
tgttaagagcaagagctaga

SEQ ID NO: 102887 - DNA, 20 bp, Artificial
  CRISPR gRNA sequence
agagctagacagactaaatc

SEQ ID NO: 102888 - DNA, 20 bp, Artificial
  CRISPR gRNA sequence
tagacagactaaatctggct

SEQ ID NO: 102889 - DNA, 20 bp, Artificial
  CRISPR gRNA sequence
ggcttagtttgtcataatct

SEQ ID NO: 102890 - DNA, 20 bp, Artificial
  CRISPR gRNA sequence
gcttagtttgtcataatctt

SEQ ID NO: 102891 - DNA, 20 bp, Artificial
  CRISPR gRNA sequence
gtttgtcataatcttgggca

SEQ ID NO: 102892 - DNA, 20 bp, Artificial
  CRISPR gRNA sequence
ttgtcataatcttgggcaaa

SEQ ID NO: 102893 - DNA, 20 bp, Artificial
  CRISPR gRNA sequence
tgtcataatcttgggcaaag

SEQ ID NO: 102894 - DNA, 20 bp, Artificial
  CRISPR gRNA sequence
tcttgggcaaagaggcactt

SEQ ID NO: 102895 - DNA, 20 bp, Artificial
  CRISPR gRNA sequence
cttgggcaaagaggcacttt

SEQ ID NO: 102896 - DNA, 20 bp, Artificial
  CRISPR gRNA sequence
ggcaaagaggcactttggga

SEQ ID NO: 102897 - DNA, 20 bp, Artificial
  CRISPR gRNA sequence
aagactatcgaattgtattg

SEQ ID NO: 102898 - DNA, 20 bp, Artificial
  CRISPR gRNA sequence
tattgcagtcttgctaactg

SEQ ID NO: 102899 - DNA, 20 bp, Artificial
  CRISPR gRNA sequence
gtcttgctaactgaagctca

SEQ ID NO: 102900 - DNA, 20 bp, Artificial
  CRISPR gRNA sequence
ttgctaactgaagctcacag

SEQ ID NO: 102901 - DNA, 20 bp, Artificial
  CRISPR gRNA sequence
ctaactgaagctcacagtag

SEQ ID NO: 102902 - DNA, 20 bp, Artificial
  CRISPR gRNA sequence
taactgaagctcacagtagt

SEQ ID NO: 102903 - DNA, 20 bp, Artificial
  CRISPR gRNA sequence
aggaacatatgactttactg

SEQ ID NO: 102904 - DNA, 20 bp, Artificial
  CRISPR gRNA sequence
acatatgactttactgaagc

SEQ ID NO: 102905 - DNA, 20 bp, Artificial
  CRISPR gRNA sequence
ttactgaagccagttgctta

SEQ ID NO: 102906 - DNA, 20 bp, Artificial
  CRISPR gRNA sequence
cttatagcattaaccattaa

SEQ ID NO: 102907 - DNA, 20 bp, Artificial
  CRISPR gRNA sequence
acagtatcaatatcatgata

SEQ ID NO: 102908 - DNA, 20 bp, Artificial
  CRISPR gRNA sequence
cagtatcaatatcatgatac

SEQ ID NO: 102909 - DNA, 20 bp, Artificial
  CRISPR gRNA sequence
aatcactctgtcattaatgt

SEQ ID NO: 102910 - DNA, 20 bp, Artificial
  CRISPR gRNA sequence
tcactctgtcattaatgtga

SEQ ID NO: 102911 - DNA, 20 bp, Artificial
  CRISPR gRNA sequence
actctgtcattaatgtgaga

SEQ ID NO: 102912 - DNA, 20 bp, Artificial
  CRISPR gRNA sequence
atgtgagagagaattgctgc

SEQ ID NO: 102913 - DNA, 20 bp, Artificial
  CRISPR gRNA sequence
gagaattgctgctagatttg

SEQ ID NO: 102914 - DNA, 20 bp, Artificial
  CRISPR gRNA sequence
tcaaatcttgatactcttca

SEQ ID NO: 102915 - DNA, 20 bp, Artificial
  CRISPR gRNA sequence
aaatttaaatattgctaaat

SEQ ID NO: 102916 - DNA, 20 bp, Artificial
  CRISPR gRNA sequence
aattggttcatttgtattac

SEQ ID NO: 102917 - DNA, 20 bp, Artificial
  CRISPR gRNA sequence
tttgtattaccagaataaac

SEQ ID NO: 102918 - DNA, 20 bp, Artificial
  CRISPR gRNA sequence
attaccagaataaactagtt

SEQ ID NO: 102919 - DNA, 20 bp, Artificial
  CRISPR gRNA sequence
accagaataaactagttaag

SEQ ID NO: 102920 - DNA, 20 bp, Artificial
  CRISPR gRNA sequence
aatctgtacgttacatatat

SEQ ID NO: 102921 - DNA, 20 bp, Artificial
  CRISPR gRNA sequence
tattagtcattatgtgcttc

SEQ ID NO: 102922 - DNA, 20 bp, Artificial
  CRISPR gRNA sequence
tatgtgcttcaagttatatt

SEQ ID NO: 102923 - DNA, 20 bp, Artificial
  CRISPR gRNA sequence
aagttatatttagtcttgta

SEQ ID NO: 102924 - DNA, 20 bp, Artificial
  CRISPR gRNA sequence
cttgtaaagatgtaaacttc

SEQ ID NO: 102925 - DNA, 20 bp, Artificial
  CRISPR gRNA sequence
agatgtaaacttctggatat

SEQ ID NO: 102926 - DNA, 20 bp, Artificial
  CRISPR gRNA sequence
taaacttctggatattagtc

SEQ ID NO: 102927 - DNA, 20 bp, Artificial
  CRISPR gRNA sequence
aaacttctggatattagtca

SEQ ID NO: 102928 - DNA, 20 bp, Artificial
  CRISPR gRNA sequence
tcaaggaaaaaatctcatat

SEQ ID NO: 102929 - DNA, 20 bp, Artificial
  CRISPR gRNA sequence
aggaaaaaatctcatataag

SEQ ID NO: 102930 - DNA, 20 bp, Artificial
  CRISPR gRNA sequence
ggaaaaaatctcatataaga

SEQ ID NO: 102931 - DNA, 20 bp, Artificial
  CRISPR gRNA sequence
tctcatataagaaggaaatt

SEQ ID NO: 102932 - DNA, 20 bp, Artificial
  CRISPR gRNA sequence
tcatataagaaggaaatttg

SEQ ID NO: 102933 - DNA, 20 bp, Artificial
  CRISPR gRNA sequence
ataagaaggaaatttggagt

SEQ ID NO: 102934 - DNA, 20 bp, Artificial
  CRISPR gRNA sequence
taagaaggaaatttggagtt

SEQ ID NO: 102935 - DNA, 20 bp, Artificial
  CRISPR gRNA sequence
aagaaggaaatttggagttg

SEQ ID NO: 102936 - DNA, 20 bp, Artificial
  CRISPR gRNA sequence
gaaggaaatttggagttggg

SEQ ID NO: 102937 - DNA, 20 bp, Artificial
  CRISPR gRNA sequence
aaggaaatttggagttgggg

SEQ ID NO: 102938 - DNA, 20 bp, Artificial
  CRISPR gRNA sequence
ggggaggcgttgaaacctaa

SEQ ID NO: 102939 - DNA, 20 bp, Artificial
  CRISPR gRNA sequence
ttttttaaaatcaatttatt

SEQ ID NO: 102940 - DNA, 20 bp, Artificial
  CRISPR gRNA sequence
ttttaaaatcaatttattga

SEQ ID NO: 102941 - DNA, 20 bp, Artificial
  CRISPR gRNA sequence
caatttattgagagatactt

SEQ ID NO: 102942 - DNA, 20 bp, Artificial
  CRISPR gRNA sequence
tgagagatactttagaaaca

SEQ ID NO: 102943 - DNA, 20 bp, Artificial
  CRISPR gRNA sequence
ttttaaatgtgtattttgat

SEQ ID NO: 102944 - DNA, 20 bp, Artificial
  CRISPR gRNA sequence
gtgcaactgctaccacaatg

SEQ ID NO: 102945 - DNA, 20 bp, Artificial
  CRISPR gRNA sequence
catcaccctacaatgttcct

SEQ ID NO: 102946 - DNA, 20 bp, Artificial
  CRISPR gRNA sequence
atcaccctacaatgttccta

SEQ ID NO: 102947 - DNA, 20 bp, Artificial
  CRISPR gRNA sequence
atgttcctaaggctccatgc

SEQ ID NO: 102948 - DNA, 20 bp, Artificial
  CRISPR gRNA sequence
tccctgtattctccactccc

SEQ ID NO: 102949 - DNA, 20 bp, Artificial
  CRISPR gRNA sequence
ccctgtattctccactccca

SEQ ID NO: 102950 - DNA, 20 bp, Artificial
  CRISPR gRNA sequence
actgatccattttctgtctc

SEQ ID NO: 102951 - DNA, 20 bp, Artificial
  CRISPR gRNA sequence
tctagattactgatgtcttt

SEQ ID NO: 102952 - DNA, 20 bp, Artificial
  CRISPR gRNA sequence
tagattactgatgtcttttg

SEQ ID NO: 102953 - DNA, 20 bp, Artificial
  CRISPR gRNA sequence
ttttggagattttatataaa

SEQ ID NO: 102954 - DNA, 20 bp, Artificial
  CRISPR gRNA sequence
catcataaccttaattttat

SEQ ID NO: 102955 - DNA, 20 bp, Artificial
  CRISPR gRNA sequence
accttaattttattagttta

SEQ ID NO: 102956 - DNA, 20 bp, Artificial
  CRISPR gRNA sequence
gccataaatgtattgtgtat

SEQ ID NO: 102957 - DNA, 20 bp, Artificial
  CRISPR gRNA sequence
cataaatgtattgtgtatta

SEQ ID NO: 102958 - DNA, 20 bp, Artificial
  CRISPR gRNA sequence
atgtattgtgtattagagac

SEQ ID NO: 102959 - DNA, 20 bp, Artificial
  CRISPR gRNA sequence
attgtgtattagagacaaga

SEQ ID NO: 102960 - DNA, 20 bp, Artificial
  CRISPR gRNA sequence
attagagacaagatagaatt

SEQ ID NO: 102961 - DNA, 20 bp, Artificial
  CRISPR gRNA sequence
ttagagacaagatagaattt

SEQ ID NO: 102962 - DNA, 20 bp, Artificial
  CRISPR gRNA sequence
tagagacaagatagaattta

SEQ ID NO: 102963 - DNA, 20 bp, Artificial
  CRISPR gRNA sequence
agacaagatagaatttaggg

SEQ ID NO: 102964 - DNA, 20 bp, Artificial
  CRISPR gRNA sequence
tagaatttagggaagcctgt

SEQ ID NO: 102965 - DNA, 20 bp, Artificial
  CRISPR gRNA sequence
aagcctgttagtgcccctaa

SEQ ID NO: 102966 - DNA, 20 bp, Artificial
  CRISPR gRNA sequence
tagtgcccctaacagactca

SEQ ID NO: 102967 - DNA, 20 bp, Artificial
  CRISPR gRNA sequence
cccctaacagactcacagtc

SEQ ID NO: 102968 - DNA, 20 bp, Artificial
  CRISPR gRNA sequence
ctgattttctattctatacc

SEQ ID NO: 102969 - DNA, 20 bp, Artificial
  CRISPR gRNA sequence
attctatacccagaatctct

SEQ ID NO: 102970 - DNA, 20 bp, Artificial
  CRISPR gRNA sequence
ttctatacccagaatctctg

SEQ ID NO: 102971 - DNA, 20 bp, Artificial
  CRISPR gRNA sequence
ctatacccagaatctctgag

SEQ ID NO: 102972 - DNA, 20 bp, Artificial
  CRISPR gRNA sequence
tacccagaatctctgaggag

SEQ ID NO: 102973 - DNA, 20 bp, Artificial
  CRISPR gRNA sequence
gaatctctgaggagcagact

SEQ ID NO: 102974 - DNA, 20 bp, Artificial
  CRISPR gRNA sequence
gacttagtcaaccaattcca

SEQ ID NO: 102975 - DNA, 20 bp, Artificial
  CRISPR gRNA sequence
cttagtcaaccaattccaaa

SEQ ID NO: 102976 - DNA, 20 bp, Artificial
  CRISPR gRNA sequence
tcaaccaattccaaagagac

SEQ ID NO: 102977 - DNA, 20 bp, Artificial
  CRISPR gRNA sequence
aaagagactggtgtaaaaat

SEQ ID NO: 102978 - DNA, 20 bp, Artificial
  CRISPR gRNA sequence
tggtgtaaaaatcagaaaac

SEQ ID NO: 102979 - DNA, 20 bp, Artificial
  CRISPR gRNA sequence
tgattatatttgctccctgt

SEQ ID NO: 102980 - DNA, 20 bp, Artificial
  CRISPR gRNA sequence
ctatatgtaaatccaaatta

SEQ ID NO: 102981 - DNA, 20 bp, Artificial
  CRISPR gRNA sequence
atgtaaatccaaattatagc

SEQ ID NO: 102982 - DNA, 20 bp, Artificial
  CRISPR gRNA sequence
attatagctagaaatttacc

SEQ ID NO: 102983 - DNA, 20 bp, Artificial
  CRISPR gRNA sequence
tagctagaaatttacctagc

SEQ ID NO: 102984 - DNA, 20 bp, Artificial
  CRISPR gRNA sequence
ttacctagcgagcattccat

SEQ ID NO: 102985 - DNA, 20 bp, Artificial
  CRISPR gRNA sequence
agcgagcattccattagatc

SEQ ID NO: 102986 - DNA, 20 bp, Artificial
  CRISPR gRNA sequence
gcgagcattccattagatca

SEQ ID NO: 102987 - DNA, 20 bp, Artificial
  CRISPR gRNA sequence
cgagcattccattagatcaa

SEQ ID NO: 102988 - DNA, 20 bp, Artificial
  CRISPR gRNA sequence
gcattccattagatcaaggg

SEQ ID NO: 102989 - DNA, 20 bp, Artificial
  CRISPR gRNA sequence
ttagatcaagggcagtgctt

SEQ ID NO: 102990 - DNA, 20 bp, Artificial
  CRISPR gRNA sequence
agatcaagggcagtgctttg

SEQ ID NO: 102991 - DNA, 20 bp, Artificial
  CRISPR gRNA sequence
cagtgctttggagaaccata

SEQ ID NO: 102992 - DNA, 20 bp, Artificial
  CRISPR gRNA sequence
ttggagaaccatatggccac

SEQ ID NO: 102993 - DNA, 20 bp, Artificial
  CRISPR gRNA sequence
gtcctcttgctgtgatgaca

SEQ ID NO: 102994 - DNA, 20 bp, Artificial
  CRISPR gRNA sequence
atgacatagcctgttattta

SEQ ID NO: 102995 - DNA, 20 bp, Artificial
  CRISPR gRNA sequence
agcctgttatttatggctca

SEQ ID NO: 102996 - DNA, 20 bp, Artificial
  CRISPR gRNA sequence
ttcttatgttgtatccattt

SEQ ID NO: 102997 - DNA, 20 bp, Artificial
  CRISPR gRNA sequence
gttgtatccattttggttat

SEQ ID NO: 102998 - DNA, 20 bp, Artificial
  CRISPR gRNA sequence
tccattttggttatgagtaa

SEQ ID NO: 102999 - DNA, 20 bp, Artificial
  CRISPR gRNA sequence
ccattttggttatgagtaat

SEQ ID NO: 103000 - DNA, 20 bp, Artificial
  CRISPR gRNA sequence
cattttggttatgagtaatg

SEQ ID NO: 103001 - DNA, 20 bp, Artificial
  CRISPR gRNA sequence
ctaacattccaacattcatt

SEQ ID NO: 103002 - DNA, 20 bp, Artificial
  CRISPR gRNA sequence
taacattccaacattcattt

SEQ ID NO: 103003 - DNA, 20 bp, Artificial
  CRISPR gRNA sequence
ccaacattcatttgggaaat

SEQ ID NO: 103004 - DNA, 20 bp, Artificial
  CRISPR gRNA sequence
atttctcaaaattcttattc

SEQ ID NO: 103005 - DNA, 20 bp, Artificial
  CRISPR gRNA sequence
aaaattcttattctagaaat

SEQ ID NO: 103006 - DNA, 20 bp, Artificial
  CRISPR gRNA sequence
ttctagaaataagaattttc

SEQ ID NO: 103007 - DNA, 20 bp, Artificial
  CRISPR gRNA sequence
aataagaattttcaagtgtg

SEQ ID NO: 103008 - DNA, 20 bp, Artificial
  CRISPR gRNA sequence
tcaagtgtgcagtgaaatca

SEQ ID NO: 103009 - DNA, 20 bp, Artificial
  CRISPR gRNA sequence
caagtgtgcagtgaaatcaa

SEQ ID NO: 103010 - DNA, 20 bp, Artificial
  CRISPR gRNA sequence
ataaacacctgtatacctgc

SEQ ID NO: 103011 - DNA, 20 bp, Artificial
  CRISPR gRNA sequence
acacctgtatacctgccagt

SEQ ID NO: 103012 - DNA, 20 bp, Artificial
  CRISPR gRNA sequence
cacctgtatacctgccagtt

SEQ ID NO: 103013 - DNA, 20 bp, Artificial
  CRISPR gRNA sequence
acctgtatacctgccagtta

SEQ ID NO: 103014 - DNA, 20 bp, Artificial
  CRISPR gRNA sequence
tcttactataattgccttac

SEQ ID NO: 103015 - DNA, 20 bp, Artificial
  CRISPR gRNA sequence
ccattttttgatgcatttca

SEQ ID NO: 103016 - DNA, 20 bp, Artificial
  CRISPR gRNA sequence
atgcatttcaaagtaaattt

SEQ ID NO: 103017 - DNA, 20 bp, Artificial
  CRISPR gRNA sequence
atatcaatacacttctttct

SEQ ID NO: 103018 - DNA, 20 bp, Artificial
  CRISPR gRNA sequence
tacacttctttctaagtact

SEQ ID NO: 103019 - DNA, 20 bp, Artificial
  CRISPR gRNA sequence
tttctaagtacttggacata

SEQ ID NO: 103020 - DNA, 20 bp, Artificial
  CRISPR gRNA sequence
acatatagttgcacatattt

SEQ ID NO: 103021 - DNA, 20 bp, Artificial
  CRISPR gRNA sequence
ttcttctttcacactgtatt

SEQ ID NO: 103022 - DNA, 20 bp, Artificial
  CRISPR gRNA sequence
ttgcaaatgattaattccac

SEQ ID NO: 103023 - DNA, 20 bp, Artificial
  CRISPR gRNA sequence
attaattccaccagcatgtg

SEQ ID NO: 103024 - DNA, 20 bp, Artificial
  CRISPR gRNA sequence
caccagcatgtgtggattta

SEQ ID NO: 103025 - DNA, 20 bp, Artificial
  CRISPR gRNA sequence
ccagcatgtgtggatttatg

SEQ ID NO: 103026 - DNA, 20 bp, Artificial
  CRISPR gRNA sequence
agcatgtgtggatttatgga

SEQ ID NO: 103027 - DNA, 20 bp, Artificial
  CRISPR gRNA sequence
atgtgtggatttatggagag

SEQ ID NO: 103028 - DNA, 20 bp, Artificial
  CRISPR gRNA sequence
ctgtactttgccacgataat

SEQ ID NO: 103029 - DNA, 20 bp, Artificial
  CRISPR gRNA sequence
tactttgccacgataatgag

SEQ ID NO: 103030 - DNA, 20 bp, Artificial
  CRISPR gRNA sequence
tgccacgataatgagcagct

SEQ ID NO: 103031 - DNA, 20 bp, Artificial
  CRISPR gRNA sequence
acgataatgagcagctcagt

SEQ ID NO: 103032 - DNA, 20 bp, Artificial
  CRISPR gRNA sequence
cgataatgagcagctcagtt

SEQ ID NO: 103033 - DNA, 20 bp, Artificial
  CRISPR gRNA sequence
ggtcacgtcattttattatt

SEQ ID NO: 103034 - DNA, 20 bp, Artificial
  CRISPR gRNA sequence
tcattttattattcagatgt

SEQ ID NO: 103035 - DNA, 20 bp, Artificial
  CRISPR gRNA sequence
attcagatgttggaatttat

SEQ ID NO: 103036 - DNA, 20 bp, Artificial
  CRISPR gRNA sequence
ttcagatgttggaatttatg

SEQ ID NO: 103037 - DNA, 20 bp, Artificial
  CRISPR gRNA sequence
tcagatgttggaatttatga

SEQ ID NO: 103038 - DNA, 20 bp, Artificial
  CRISPR gRNA sequence
tgttggaatttatgagggcc

SEQ ID NO: 103039 - DNA, 20 bp, Artificial
  CRISPR gRNA sequence
atgagggcctagtgaaaaat

SEQ ID NO: 103040 - DNA, 20 bp, Artificial
  CRISPR gRNA sequence
gagggcctagtgaaaaatca

SEQ ID NO: 103041 - DNA, 20 bp, Artificial
  CRISPR gRNA sequence
gggcctagtgaaaaatcaga

SEQ ID NO: 103042 - DNA, 20 bp, Artificial
  CRISPR gRNA sequence
ctagtgaaaaatcagagaga

SEQ ID NO: 103043 - DNA, 20 bp, Artificial
  CRISPR gRNA sequence
gtcctccctcccatatttcc

SEQ ID NO: 103044 - DNA, 20 bp, Artificial
  CRISPR gRNA sequence
atcattttaattttttaatg

SEQ ID NO: 103045 - DNA, 20 bp, Artificial
  CRISPR gRNA sequence
ttttaatgaagtctttatta

SEQ ID NO: 103046 - DNA, 20 bp, Artificial
  CRISPR gRNA sequence
tttaatgaagtctttattaa

SEQ ID NO: 103047 - DNA, 20 bp, Artificial
  CRISPR gRNA sequence
aagtctttattaaaggttct

SEQ ID NO: 103048 - DNA, 20 bp, Artificial
  CRISPR gRNA sequence
aaaggttctcagatatcatt

SEQ ID NO: 103049 - DNA, 20 bp, Artificial
  CRISPR gRNA sequence
aattgtatccttatttttaa

SEQ ID NO: 103050 - DNA, 20 bp, Artificial
  CRISPR gRNA sequence
tgtatccttatttttaaaag

SEQ ID NO: 103051 - DNA, 20 bp, Artificial
  CRISPR gRNA sequence
aagtggatcttcaactctta

SEQ ID NO: 103052 - DNA, 20 bp, Artificial
  CRISPR gRNA sequence
cttcaactcttaaagtctat

SEQ ID NO: 103053 - DNA, 20 bp, Artificial
  CRISPR gRNA sequence
caactcttaaagtctatgag

SEQ ID NO: 103054 - DNA, 20 bp, Artificial
  CRISPR gRNA sequence
aactcttaaagtctatgaga

SEQ ID NO: 103055 - DNA, 20 bp, Artificial
  CRISPR gRNA sequence
actcttaaagtctatgagaa

SEQ ID NO: 103056 - DNA, 20 bp, Artificial
  CRISPR gRNA sequence
taaattttgcctaccatatg

SEQ ID NO: 103057 - DNA, 20 bp, Artificial
  CRISPR gRNA sequence
attttgcctaccatatgtag

SEQ ID NO: 103058 - DNA, 20 bp, Artificial
  CRISPR gRNA sequence
ctaccatatgtagtggacct

SEQ ID NO: 103059 - DNA, 20 bp, Artificial
  CRISPR gRNA sequence
gtggacctgagtaacatgtt

SEQ ID NO: 103060 - DNA, 20 bp, Artificial
  CRISPR gRNA sequence
gacctgagtaacatgtttgg

SEQ ID NO: 103061 - DNA, 20 bp, Artificial
  CRISPR gRNA sequence
acctgagtaacatgtttggt

SEQ ID NO: 103062 - DNA, 20 bp, Artificial
  CRISPR gRNA sequence
tgagtaacatgtttggtggg

SEQ ID NO: 103063 - DNA, 20 bp, Artificial
  CRISPR gRNA sequence
caattacgtgttacaactta

SEQ ID NO: 103064 - DNA, 20 bp, Artificial
  CRISPR gRNA sequence
ttacgtgttacaacttaaag

SEQ ID NO: 103065 - DNA, 20 bp, Artificial
  CRISPR gRNA sequence
taaagaagctttattctcta

SEQ ID NO: 103066 - DNA, 20 bp, Artificial
  CRISPR gRNA sequence
atatgtgcaaacctgaaaat

SEQ ID NO: 103067 - DNA, 20 bp, Artificial
  CRISPR gRNA sequence
gcaaacctgaaaatcagtgt

SEQ ID NO: 103068 - DNA, 20 bp, Artificial
  CRISPR gRNA sequence
caaacctgaaaatcagtgtt

SEQ ID NO: 103069 - DNA, 20 bp, Artificial
  CRISPR gRNA sequence
gttaggtatgccttgtatca

SEQ ID NO: 103070 - DNA, 20 bp, Artificial
  CRISPR gRNA sequence
tgccttgtatcaaagtgatg

SEQ ID NO: 103071 - DNA, 20 bp, Artificial
  CRISPR gRNA sequence
tcaaagtgatgtagcttaac

SEQ ID NO: 103072 - DNA, 20 bp, Artificial
  CRISPR gRNA sequence
gtagcttaacgagtatctct

SEQ ID NO: 103073 - DNA, 20 bp, Artificial
  CRISPR gRNA sequence
tagcttaacgagtatctctt

SEQ ID NO: 103074 - DNA, 20 bp, Artificial
  CRISPR gRNA sequence
aacgagtatctcttaggtgc

SEQ ID NO: 103075 - DNA, 20 bp, Artificial
  CRISPR gRNA sequence
aggtgcaagtattgctctga

SEQ ID NO: 103076 - DNA, 20 bp, Artificial
  CRISPR gRNA sequence
tattgctctgacagtattga

SEQ ID NO: 103077 - DNA, 20 bp, Artificial
  CRISPR gRNA sequence
attgctctgacagtattgaa

SEQ ID NO: 103078 - DNA, 20 bp, Artificial
  CRISPR gRNA sequence
ctctgacagtattgaaaggt

SEQ ID NO: 103079 - DNA, 20 bp, Artificial
  CRISPR gRNA sequence
tctgacagtattgaaaggta

SEQ ID NO: 103080 - DNA, 20 bp, Artificial
  CRISPR gRNA sequence
gtattgaaaggtaaggttgc

SEQ ID NO: 103081 - DNA, 20 bp, Artificial
  CRISPR gRNA sequence
taaggttgccagtatactga

SEQ ID NO: 103082 - DNA, 20 bp, Artificial
  CRISPR gRNA sequence
ccagtatactgaaagcattt

SEQ ID NO: 103083 - DNA, 20 bp, Artificial
  CRISPR gRNA sequence
gcattttagaaacgtgaaaa

SEQ ID NO: 103084 - DNA, 20 bp, Artificial
  CRISPR gRNA sequence
atgattgtgccatgtaatcc

SEQ ID NO: 103085 - DNA, 20 bp, Artificial
  CRISPR gRNA sequence
ttaaaaatgatactgaatat

SEQ ID NO: 103086 - DNA, 20 bp, Artificial
  CRISPR gRNA sequence
atcctgttttcttgcaaata

SEQ ID NO: 103087 - DNA, 20 bp, Artificial
  CRISPR gRNA sequence
gttttcttgcaaataaagta

SEQ ID NO: 103088 - DNA, 20 bp, Artificial
  CRISPR gRNA sequence
aagtacagtgataaattatc

SEQ ID NO: 103089 - DNA, 20 bp, Artificial
  CRISPR gRNA sequence
agtacagtgataaattatcc

SEQ ID NO: 103090 - DNA, 20 bp, Artificial
  CRISPR gRNA sequence
aattatccaggttaattgtc

SEQ ID NO: 103091 - DNA, 20 bp, Artificial
  CRISPR gRNA sequence
atccaggttaattgtctggt

SEQ ID NO: 103092 - DNA, 20 bp, Artificial
  CRISPR gRNA sequence
tccaggttaattgtctggta

SEQ ID NO: 103093 - DNA, 20 bp, Artificial
  CRISPR gRNA sequence
ctttattgacaatctcactt

SEQ ID NO: 103094 - DNA, 20 bp, Artificial
  CRISPR gRNA sequence
ttctttccccacctttctaa

SEQ ID NO: 103095 - DNA, 20 bp, Artificial
  CRISPR gRNA sequence
tctttccccacctttctaac

SEQ ID NO: 103096 - DNA, 20 bp, Artificial
  CRISPR gRNA sequence
tttccccacctttctaacag

SEQ ID NO: 103097 - DNA, 20 bp, Artificial
  CRISPR gRNA sequence
tctaacaggagtgtacctca

SEQ ID NO: 103098 - DNA, 20 bp, Artificial
  CRISPR gRNA sequence
gagtgtacctcacagccttc

SEQ ID NO: 103099 - DNA, 20 bp, Artificial
  CRISPR gRNA sequence
agtgtacctcacagccttct

SEQ ID NO: 103100 - DNA, 20 bp, Artificial
  CRISPR gRNA sequence
tcacagccttctaggatctc

SEQ ID NO: 103101 - DNA, 20 bp, Artificial
  CRISPR gRNA sequence
acagccttctaggatctcca

SEQ ID NO: 103102 - DNA, 20 bp, Artificial
  CRISPR gRNA sequence
gccttctaggatctccagag

SEQ ID NO: 103103 - DNA, 20 bp, Artificial
  CRISPR gRNA sequence
tctaggatctccagagtgga

SEQ ID NO: 103104 - DNA, 20 bp, Artificial
  CRISPR gRNA sequence
ctaggatctccagagtggac

SEQ ID NO: 103105 - DNA, 20 bp, Artificial
  CRISPR gRNA sequence
gagtggacaggaatctcact

SEQ ID NO: 103106 - DNA, 20 bp, Artificial
  CRISPR gRNA sequence
gtggacaggaatctcacttg

SEQ ID NO: 103107 - DNA, 20 bp, Artificial
  CRISPR gRNA sequence
tggacaggaatctcacttgg

SEQ ID NO: 103108 - DNA, 20 bp, Artificial
  CRISPR gRNA sequence
ggacaggaatctcacttgga

SEQ ID NO: 103109 - DNA, 20 bp, Artificial
  CRISPR gRNA sequence
aatctcacttggagggacca

SEQ ID NO: 103110 - DNA, 20 bp, Artificial
  CRISPR gRNA sequence
tctcacttggagggaccatg

SEQ ID NO: 103111 - DNA, 20 bp, Artificial
  CRISPR gRNA sequence
cacttggagggaccatggag

SEQ ID NO: 103112 - DNA, 20 bp, Artificial
  CRISPR gRNA sequence
agggaccatggagcagtata

SEQ ID NO: 103113 - DNA, 20 bp, Artificial
  CRISPR gRNA sequence
atggagcagtatacagcaaa

SEQ ID NO: 103114 - DNA, 20 bp, Artificial
  CRISPR gRNA sequence
cagtatacagcaaacagcaa

SEQ ID NO: 103115 - DNA, 20 bp, Artificial
  CRISPR gRNA sequence
agcaaacagcaatagttcga

SEQ ID NO: 103116 - DNA, 20 bp, Artificial
  CRISPR gRNA sequence
caaacagcaatagttcgaca

SEQ ID NO: 103117 - DNA, 20 bp, Artificial
  CRISPR gRNA sequence
acagcaatagttcgacagag

SEQ ID NO: 103118 - DNA, 20 bp, Artificial
  CRISPR gRNA sequence
cgacagagcagattgttgtc

SEQ ID NO: 103119 - DNA, 20 bp, Artificial
  CRISPR gRNA sequence
gacagagcagattgttgtcc

SEQ ID NO: 103120 - DNA, 20 bp, Artificial
  CRISPR gRNA sequence
agagcagattgttgtccagg

SEQ ID NO: 103121 - DNA, 20 bp, Artificial
  CRISPR gRNA sequence
gagcagattgttgtccaggc

SEQ ID NO: 103122 - DNA, 20 bp, Artificial
  CRISPR gRNA sequence
agattgttgtccaggcagga

SEQ ID NO: 103123 - DNA, 20 bp, Artificial
  CRISPR gRNA sequence
ttgtccaggcaggacagatt

SEQ ID NO: 103124 - DNA, 20 bp, Artificial
  CRISPR gRNA sequence
tccaggcaggacagattcag

SEQ ID NO: 103125 - DNA, 20 bp, Artificial
  CRISPR gRNA sequence
aggcaggacagattcagcag

SEQ ID NO: 103126 - DNA, 20 bp, Artificial
  CRISPR gRNA sequence
ggcaggacagattcagcagc

SEQ ID NO: 103127 - DNA, 20 bp, Artificial
  CRISPR gRNA sequence
gacagattcagcagcaggta

SEQ ID NO: 103128 - DNA, 20 bp, Artificial
  CRISPR gRNA sequence
agattcagcagcaggtatgg

SEQ ID NO: 103129 - DNA, 20 bp, Artificial
  CRISPR gRNA sequence
caaaactgctttaaacatta

SEQ ID NO: 103130 - DNA, 20 bp, Artificial
  CRISPR gRNA sequence
tacagcaatgaaactgataa

SEQ ID NO: 103131 - DNA, 20 bp, Artificial
  CRISPR gRNA sequence
tgataacagcaccactcaat

SEQ ID NO: 103132 - DNA, 20 bp, Artificial
  CRISPR gRNA sequence
aacagcaccactcaattggt

SEQ ID NO: 103133 - DNA, 20 bp, Artificial
  CRISPR gRNA sequence
aattggttggtctattgccc

SEQ ID NO: 103134 - DNA, 20 bp, Artificial
  CRISPR gRNA sequence
attggttggtctattgccct

SEQ ID NO: 103135 - DNA, 20 bp, Artificial
  CRISPR gRNA sequence
ttggttggtctattgccctg

SEQ ID NO: 103136 - DNA, 20 bp, Artificial
  CRISPR gRNA sequence
tgccctggggaattatttga

SEQ ID NO: 103137 - DNA, 20 bp, Artificial
  CRISPR gRNA sequence
gggaattatttgaaagatac

SEQ ID NO: 103138 - DNA, 20 bp, Artificial
  CRISPR gRNA sequence
tgaaagataccagatcttgt

SEQ ID NO: 103139 - DNA, 20 bp, Artificial
  CRISPR gRNA sequence
taccagatcttgtgagatat

SEQ ID NO: 103140 - DNA, 20 bp, Artificial
  CRISPR gRNA sequence
accagatcttgtgagatatt

SEQ ID NO: 103141 - DNA, 20 bp, Artificial
  CRISPR gRNA sequence
ttgtgagatattgggtctga

SEQ ID NO: 103142 - DNA, 20 bp, Artificial
  CRISPR gRNA sequence
ttgtgctgaaatgccatgtc

SEQ ID NO: 103143 - DNA, 20 bp, Artificial
  CRISPR gRNA sequence
atgtctagcccatgaccact

SEQ ID NO: 103144 - DNA, 20 bp, Artificial
  CRISPR gRNA sequence
cacttagaatctactcttca

SEQ ID NO: 103145 - DNA, 20 bp, Artificial
  CRISPR gRNA sequence
acttagaatctactcttcat

SEQ ID NO: 103146 - DNA, 20 bp, Artificial
  CRISPR gRNA sequence
atctactcttcatgggtgcc

SEQ ID NO: 103147 - DNA, 20 bp, Artificial
  CRISPR gRNA sequence
tcttcatgggtgcctggtta

SEQ ID NO: 103148 - DNA, 20 bp, Artificial
  CRISPR gRNA sequence
tgcctcttttatctcatttt

SEQ ID NO: 103149 - DNA, 20 bp, Artificial
  CRISPR gRNA sequence
tcattttaagtaaaaacatc

SEQ ID NO: 103150 - DNA, 20 bp, Artificial
  CRISPR gRNA sequence
ttaagtaaaaacatctagtc

SEQ ID NO: 103151 - DNA, 20 bp, Artificial
  CRISPR gRNA sequence
aaaacatctagtctggtttt

SEQ ID NO: 103152 - DNA, 20 bp, Artificial
  CRISPR gRNA sequence
catctagtctggttttcaga

SEQ ID NO: 103153 - DNA, 20 bp, Artificial
  CRISPR gRNA sequence
ctggttttcagatggaaatt

SEQ ID NO: 103154 - DNA, 20 bp, Artificial
  CRISPR gRNA sequence
tttggactttaaaatttttc

SEQ ID NO: 103155 - DNA, 20 bp, Artificial
  CRISPR gRNA sequence
aaatttttctggattctatt

SEQ ID NO: 103156 - DNA, 20 bp, Artificial
  CRISPR gRNA sequence
gtctttttctcttcttgttt

SEQ ID NO: 103157 - DNA, 20 bp, Artificial
  CRISPR gRNA sequence
gtttgagctaacttgtgatt

SEQ ID NO: 103158 - DNA, 20 bp, Artificial
  CRISPR gRNA sequence
gagctaacttgtgatttagt

SEQ ID NO: 103159 - DNA, 20 bp, Artificial
  CRISPR gRNA sequence
cttgtgatttagtaagtctt

SEQ ID NO: 103160 - DNA, 20 bp, Artificial
  CRISPR gRNA sequence
tagtaagtctttggccacaa

SEQ ID NO: 103161 - DNA, 20 bp, Artificial
  CRISPR gRNA sequence
ccacaacagacaaaccaaca

SEQ ID NO: 103162 - DNA, 20 bp, Artificial
  CRISPR gRNA sequence
aaatcttctgttttttgatt

SEQ ID NO: 103163 - DNA, 20 bp, Artificial
  CRISPR gRNA sequence
ggtctgccacattttttatt

SEQ ID NO: 103164 - DNA, 20 bp, Artificial
  CRISPR gRNA sequence
gccacattttttattcagaa

SEQ ID NO: 103165 - DNA, 20 bp, Artificial
  CRISPR gRNA sequence
ttttttattcagaaaagctc

SEQ ID NO: 103166 - DNA, 20 bp, Artificial
  CRISPR gRNA sequence
gaaaagctctggtttaacat

SEQ ID NO: 103167 - DNA, 20 bp, Artificial
  CRISPR gRNA sequence
aaaagctctggtttaacatt

SEQ ID NO: 103168 - DNA, 20 bp, Artificial
  CRISPR gRNA sequence
tttaacattaggataatatt

SEQ ID NO: 103169 - DNA, 20 bp, Artificial
  CRISPR gRNA sequence
acattaggataatatttaga

SEQ ID NO: 103170 - DNA, 20 bp, Artificial
  CRISPR gRNA sequence
tatttagacagccattctta

SEQ ID NO: 103171 - DNA, 20 bp, Artificial
  CRISPR gRNA sequence
agacagccattcttatggat

SEQ ID NO: 103172 - DNA, 20 bp, Artificial
  CRISPR gRNA sequence
ttcttatggataagacatac

SEQ ID NO: 103173 - DNA, 20 bp, Artificial
  CRISPR gRNA sequence
tatggataagacatactaga

SEQ ID NO: 103174 - DNA, 20 bp, Artificial
  CRISPR gRNA sequence
atggataagacatactagaa

SEQ ID NO: 103175 - DNA, 20 bp, Artificial
  CRISPR gRNA sequence
agaaaggaattccctgctgc

SEQ ID NO: 103176 - DNA, 20 bp, Artificial
  CRISPR gRNA sequence
gctggtttattcctaattaa

SEQ ID NO: 103177 - DNA, 20 bp, Artificial
  CRISPR gRNA sequence
tgctttcttgaatttataca

SEQ ID NO: 103178 - DNA, 20 bp, Artificial
  CRISPR gRNA sequence
gctttcttgaatttatacac

SEQ ID NO: 103179 - DNA, 20 bp, Artificial
  CRISPR gRNA sequence
attttctgatgctttatgct

SEQ ID NO: 103180 - DNA, 20 bp, Artificial
  CRISPR gRNA sequence
ttttctgatgctttatgctt

SEQ ID NO: 103181 - DNA, 20 bp, Artificial
  CRISPR gRNA sequence
ctttatgcttgggtttatta

SEQ ID NO: 103182 - DNA, 20 bp, Artificial
  CRISPR gRNA sequence
tttcacttttttccccaccc

SEQ ID NO: 103183 - DNA, 20 bp, Artificial
  CRISPR gRNA sequence
cacttttttccccaccccag

SEQ ID NO: 103184 - DNA, 20 bp, Artificial
  CRISPR gRNA sequence
attatgtttctatttgacct

SEQ ID NO: 103185 - DNA, 20 bp, Artificial
  CRISPR gRNA sequence
ttatgtttctatttgacctt

SEQ ID NO: 103186 - DNA, 20 bp, Artificial
  CRISPR gRNA sequence
tttctatttgaccttaggcc

SEQ ID NO: 103187 - DNA, 20 bp, Artificial
  CRISPR gRNA sequence
ttaggccaagattgatattt

SEQ ID NO: 103188 - DNA, 20 bp, Artificial
  CRISPR gRNA sequence
gaaatactttgttttcaaaa

SEQ ID NO: 103189 - DNA, 20 bp, Artificial
  CRISPR gRNA sequence
tttgttttcaaaatggaatt

SEQ ID NO: 103190 - DNA, 20 bp, Artificial
  CRISPR gRNA sequence
aaaatggaatttagctaata

SEQ ID NO: 103191 - DNA, 20 bp, Artificial
  CRISPR gRNA sequence
ggaatttagctaatatagaa

SEQ ID NO: 103192 - DNA, 20 bp, Artificial
  CRISPR gRNA sequence
atttagctaatatagaaaag

SEQ ID NO: 103193 - DNA, 20 bp, Artificial
  CRISPR gRNA sequence
tagctaatatagaaaagtag

SEQ ID NO: 103194 - DNA, 20 bp, Artificial
  CRISPR gRNA sequence
agctaatatagaaaagtagt

SEQ ID NO: 103195 - DNA, 20 bp, Artificial
  CRISPR gRNA sequence
gctaatatagaaaagtagta

SEQ ID NO: 103196 - DNA, 20 bp, Artificial
  CRISPR gRNA sequence
aatatagaaaagtagtaggg

SEQ ID NO: 103197 - DNA, 20 bp, Artificial
  CRISPR gRNA sequence
atatagaaaagtagtaggga

SEQ ID NO: 103198 - DNA, 20 bp, Artificial
  CRISPR gRNA sequence
tatagaaaagtagtagggaa

SEQ ID NO: 103199 - DNA, 20 bp, Artificial
  CRISPR gRNA sequence
gaaaagtagtagggaaggga

SEQ ID NO: 103200 - DNA, 20 bp, Artificial
  CRISPR gRNA sequence
aaaagtagtagggaagggaa

SEQ ID NO: 103201 - DNA, 20 bp, Artificial
  CRISPR gRNA sequence
agtagtagggaagggaaagg

SEQ ID NO: 103202 - DNA, 20 bp, Artificial
  CRISPR gRNA sequence
ggaaaggtagtattgatgat

SEQ ID NO: 103203 - DNA, 20 bp, Artificial
  CRISPR gRNA sequence
tttttcccgtctaatgatca

SEQ ID NO: 103204 - DNA, 20 bp, Artificial
  CRISPR gRNA sequence
tcaaagacgaactcccctga

SEQ ID NO: 103205 - DNA, 20 bp, Artificial
  CRISPR gRNA sequence
tgatagctttcccttccata

SEQ ID NO: 103206 - DNA, 20 bp, Artificial
  CRISPR gRNA sequence
tcccttccatacagctgctg

SEQ ID NO: 103207 - DNA, 20 bp, Artificial
  CRISPR gRNA sequence
ccatacagctgctgtggctc

SEQ ID NO: 103208 - DNA, 20 bp, Artificial
  CRISPR gRNA sequence
tacagctgctgtggctctgg

SEQ ID NO: 103209 - DNA, 20 bp, Artificial
  CRISPR gRNA sequence
gtttccttcaactgcctttt

SEQ ID NO: 103210 - DNA, 20 bp, Artificial
  CRISPR gRNA sequence
ttccttcaactgccttttta

SEQ ID NO: 103211 - DNA, 20 bp, Artificial
  CRISPR gRNA sequence
tccttcaactgcctttttag

SEQ ID NO: 103212 - DNA, 20 bp, Artificial
  CRISPR gRNA sequence
ttcaactgcctttttagagg

SEQ ID NO: 103213 - DNA, 20 bp, Artificial
  CRISPR gRNA sequence
tcaactgcctttttagagga

SEQ ID NO: 103214 - DNA, 20 bp, Artificial
  CRISPR gRNA sequence
caactgcctttttagaggaa

SEQ ID NO: 103215 - DNA, 20 bp, Artificial
  CRISPR gRNA sequence
ttagaggaagggattccaca

SEQ ID NO: 103216 - DNA, 20 bp, Artificial
  CRISPR gRNA sequence
tagaggaagggattccacaa

SEQ ID NO: 103217 - DNA, 20 bp, Artificial
  CRISPR gRNA sequence
agaggaagggattccacaaa

SEQ ID NO: 103218 - DNA, 20 bp, Artificial
  CRISPR gRNA sequence
aaagggccctccattcacac

SEQ ID NO: 103219 - DNA, 20 bp, Artificial
  CRISPR gRNA sequence
ctccattcacaccagtgccc

SEQ ID NO: 103220 - DNA, 20 bp, Artificial
  CRISPR gRNA sequence
ccattcacaccagtgccctg

SEQ ID NO: 103221 - DNA, 20 bp, Artificial
  CRISPR gRNA sequence
cattcacaccagtgccctgg

SEQ ID NO: 103222 - DNA, 20 bp, Artificial
  CRISPR gRNA sequence
attcacaccagtgccctgga

SEQ ID NO: 103223 - DNA, 20 bp, Artificial
  CRISPR gRNA sequence
cacaccagtgccctggaggg

SEQ ID NO: 103224 - DNA, 20 bp, Artificial
  CRISPR gRNA sequence
acaccagtgccctggagggt

SEQ ID NO: 103225 - DNA, 20 bp, Artificial
  CRISPR gRNA sequence
agggtgggtttttattcttt

SEQ ID NO: 103226 - DNA, 20 bp, Artificial
  CRISPR gRNA sequence
attctttcagaatttgccat

SEQ ID NO: 103227 - DNA, 20 bp, Artificial
  CRISPR gRNA sequence
ctttcagaatttgccattag

SEQ ID NO: 103228 - DNA, 20 bp, Artificial
  CRISPR gRNA sequence
ccattagtggatgtaaaaat

SEQ ID NO: 103229 - DNA, 20 bp, Artificial
  CRISPR gRNA sequence
cattagtggatgtaaaaata

SEQ ID NO: 103230 - DNA, 20 bp, Artificial
  CRISPR gRNA sequence
aggttgaatcattgaaaaca

SEQ ID NO: 103231 - DNA, 20 bp, Artificial
  CRISPR gRNA sequence
cattgaaaacatggctctta

SEQ ID NO: 103232 - DNA, 20 bp, Artificial
  CRISPR gRNA sequence
tgaaaacatggctcttaaag

SEQ ID NO: 103233 - DNA, 20 bp, Artificial
  CRISPR gRNA sequence
acatggctcttaaagcagtc

SEQ ID NO: 103234 - DNA, 20 bp, Artificial
  CRISPR gRNA sequence
ggctcttaaagcagtccagt

SEQ ID NO: 103235 - DNA, 20 bp, Artificial
  CRISPR gRNA sequence
gctcttaaagcagtccagtt

SEQ ID NO: 103236 - DNA, 20 bp, Artificial
  CRISPR gRNA sequence
cttaaagcagtccagttggg

SEQ ID NO: 103237 - DNA, 20 bp, Artificial
  CRISPR gRNA sequence
cagttgggtagaaataatct

SEQ ID NO: 103238 - DNA, 20 bp, Artificial
  CRISPR gRNA sequence
tagaaataatcttagttttg

SEQ ID NO: 103239 - DNA, 20 bp, Artificial
  CRISPR gRNA sequence
aataatcttagttttgaagc

SEQ ID NO: 103240 - DNA, 20 bp, Artificial
  CRISPR gRNA sequence
ataatcttagttttgaagct

SEQ ID NO: 103241 - DNA, 20 bp, Artificial
  CRISPR gRNA sequence
cttagttttgaagctgggca

SEQ ID NO: 103242 - DNA, 20 bp, Artificial
  CRISPR gRNA sequence
gtgctgcatgcctgtaatcc

SEQ ID NO: 103243 - DNA, 20 bp, Artificial
  CRISPR gRNA sequence
gcctgtaatcccagctactc

SEQ ID NO: 103244 - DNA, 20 bp, Artificial
  CRISPR gRNA sequence
ctgtaatcccagctactctg

SEQ ID NO: 103245 - DNA, 20 bp, Artificial
  CRISPR gRNA sequence
tgtaatcccagctactctgg

SEQ ID NO: 103246 - DNA, 20 bp, Artificial
  CRISPR gRNA sequence
tcccagctactctggaggct

SEQ ID NO: 103247 - DNA, 20 bp, Artificial
  CRISPR gRNA sequence
agctactctggaggctgaga

SEQ ID NO: 103248 - DNA, 20 bp, Artificial
  CRISPR gRNA sequence
gctactctggaggctgagac

SEQ ID NO: 103249 - DNA, 20 bp, Artificial
  CRISPR gRNA sequence
actctggaggctgagacagg

SEQ ID NO: 103250 - DNA, 20 bp, Artificial
  CRISPR gRNA sequence
ctctggaggctgagacagga

SEQ ID NO: 103251 - DNA, 20 bp, Artificial
  CRISPR gRNA sequence
ggaggctgagacaggaaggt

SEQ ID NO: 103252 - DNA, 20 bp, Artificial
  CRISPR gRNA sequence
tgagacaggaaggttggctt

SEQ ID NO: 103253 - DNA, 20 bp, Artificial
  CRISPR gRNA sequence
caggaaggttggcttaagcc

SEQ ID NO: 103254 - DNA, 20 bp, Artificial
  CRISPR gRNA sequence
aggaaggttggcttaagccc

SEQ ID NO: 103255 - DNA, 20 bp, Artificial
  CRISPR gRNA sequence
tggcttaagcccaggaattc

SEQ ID NO: 103256 - DNA, 20 bp, Artificial
  CRISPR gRNA sequence
taagcccaggaattcaagac

SEQ ID NO: 103257 - DNA, 20 bp, Artificial
  CRISPR gRNA sequence
ccaggaattcaagaccagcc

SEQ ID NO: 103258 - DNA, 20 bp, Artificial
  CRISPR gRNA sequence
caggaattcaagaccagcct

SEQ ID NO: 103259 - DNA, 20 bp, Artificial
  CRISPR gRNA sequence
caagaccagcctgggcaaaa

SEQ ID NO: 103260 - DNA, 20 bp, Artificial
  CRISPR gRNA sequence
accagcctgggcaaaacagc

SEQ ID NO: 103261 - DNA, 20 bp, Artificial
  CRISPR gRNA sequence
gcaagaccccatctcaaaat

SEQ ID NO: 103262 - DNA, 20 bp, Artificial
  CRISPR gRNA sequence
tcaaaataagtacataaata

SEQ ID NO: 103263 - DNA, 20 bp, Artificial
  CRISPR gRNA sequence
taaataaagtttaaaaaaaa

SEQ ID NO: 103264 - DNA, 20 bp, Artificial
  CRISPR gRNA sequence
gtttaaaaaaaaaagaatct

SEQ ID NO: 103265 - DNA, 20 bp, Artificial
  CRISPR gRNA sequence
aaaaaaaagaatcttagttt

SEQ ID NO: 103266 - DNA, 20 bp, Artificial
  CRISPR gRNA sequence
aaaaaaagaatcttagtttt

SEQ ID NO: 103267 - DNA, 20 bp, Artificial
  CRISPR gRNA sequence
gaatcttagttttgggacat

SEQ ID NO: 103268 - DNA, 20 bp, Artificial
  CRISPR gRNA sequence
atcttagttttgggacatga

SEQ ID NO: 103269 - DNA, 20 bp, Artificial
  CRISPR gRNA sequence
atgagagcattgacgtcatg

SEQ ID NO: 103270 - DNA, 20 bp, Artificial
  CRISPR gRNA sequence
tgacgtcatgaagatgattt

SEQ ID NO: 103271 - DNA, 20 bp, Artificial
  CRISPR gRNA sequence
atgaagatgatttcggttca

SEQ ID NO: 103272 - DNA, 20 bp, Artificial
  CRISPR gRNA sequence
attaattactcctcctttct

SEQ ID NO: 103273 - DNA, 20 bp, Artificial
  CRISPR gRNA sequence
ctttcttggtgattgcattt

SEQ ID NO: 103274 - DNA, 20 bp, Artificial
  CRISPR gRNA sequence
ttggtgattgcatttaagcc

SEQ ID NO: 103275 - DNA, 20 bp, Artificial
  CRISPR gRNA sequence
tttaagcccagaatttttta

SEQ ID NO: 103276 - DNA, 20 bp, Artificial
  CRISPR gRNA sequence
aagcccagaattttttatgg

SEQ ID NO: 103277 - DNA, 20 bp, Artificial
  CRISPR gRNA sequence
agaattttttatggtagttt

SEQ ID NO: 103278 - DNA, 20 bp, Artificial
  CRISPR gRNA sequence
gaattttttatggtagtttc

SEQ ID NO: 103279 - DNA, 20 bp, Artificial
  CRISPR gRNA sequence
aattttttatggtagtttca

SEQ ID NO: 103280 - DNA, 20 bp, Artificial
  CRISPR gRNA sequence
tttttcttgtgaactcatct

SEQ ID NO: 103281 - DNA, 20 bp, Artificial
  CRISPR gRNA sequence
ttttcttgtgaactcatctg

SEQ ID NO: 103282 - DNA, 20 bp, Artificial
  CRISPR gRNA sequence
ttcttgtgaactcatctgag

SEQ ID NO: 103283 - DNA, 20 bp, Artificial
  CRISPR gRNA sequence
aactcatctgaggagataaa

SEQ ID NO: 103284 - DNA, 20 bp, Artificial
  CRISPR gRNA sequence
actcatctgaggagataaaa

SEQ ID NO: 103285 - DNA, 20 bp, Artificial
  CRISPR gRNA sequence
ctcatctgaggagataaaaa

SEQ ID NO: 103286 - DNA, 20 bp, Artificial
  CRISPR gRNA sequence
agggcattaaacaattgtgt

SEQ ID NO: 103287 - DNA, 20 bp, Artificial
  CRISPR gRNA sequence
gcattaaacaattgtgtaag

SEQ ID NO: 103288 - DNA, 20 bp, Artificial
  CRISPR gRNA sequence
ttaaacaattgtgtaagtag

SEQ ID NO: 103289 - DNA, 20 bp, Artificial
  CRISPR gRNA sequence
aattgtgtaagtagaagtgt

SEQ ID NO: 103290 - DNA, 20 bp, Artificial
  CRISPR gRNA sequence
aagtgtcagattcctgtttc

SEQ ID NO: 103291 - DNA, 20 bp, Artificial
  CRISPR gRNA sequence
gtgtcagattcctgtttctg

SEQ ID NO: 103292 - DNA, 20 bp, Artificial
  CRISPR gRNA sequence
tgtcagattcctgtttctgg

SEQ ID NO: 103293 - DNA, 20 bp, Artificial
  CRISPR gRNA sequence
gtcagattcctgtttctgga

SEQ ID NO: 103294 - DNA, 20 bp, Artificial
  CRISPR gRNA sequence
gattcctgtttctggaggga

SEQ ID NO: 103295 - DNA, 20 bp, Artificial
  CRISPR gRNA sequence
ttaatgatgacaactgtttt

SEQ ID NO: 103296 - DNA, 20 bp, Artificial
  CRISPR gRNA sequence
gacaactgttttgagttttt

SEQ ID NO: 103297 - DNA, 20 bp, Artificial
  CRISPR gRNA sequence
agtttttgagtcaaattttt

SEQ ID NO: 103298 - DNA, 20 bp, Artificial
  CRISPR gRNA sequence
gtttttgagtcaaatttttg

SEQ ID NO: 103299 - DNA, 20 bp, Artificial
  CRISPR gRNA sequence
caaatttttgaggtccactc

SEQ ID NO: 103300 - DNA, 20 bp, Artificial
  CRISPR gRNA sequence
aatttttgaggtccactctg

SEQ ID NO: 103301 - DNA, 20 bp, Artificial
  CRISPR gRNA sequence
tgaggtccactctggagaca

SEQ ID NO: 103302 - DNA, 20 bp, Artificial
  CRISPR gRNA sequence
gaggtccactctggagacaa

SEQ ID NO: 103303 - DNA, 20 bp, Artificial
  CRISPR gRNA sequence
aggtccactctggagacaaa

SEQ ID NO: 103304 - DNA, 20 bp, Artificial
  CRISPR gRNA sequence
tcctactaccttcaacaaaa

SEQ ID NO: 103305 - DNA, 20 bp, Artificial
  CRISPR gRNA sequence
tcaacaaaacagcttcaata

SEQ ID NO: 103306 - DNA, 20 bp, Artificial
  CRISPR gRNA sequence
caacaaaacagcttcaatat

SEQ ID NO: 103307 - DNA, 20 bp, Artificial
  CRISPR gRNA sequence
aacaaaacagcttcaatata

SEQ ID NO: 103308 - DNA, 20 bp, Artificial
  CRISPR gRNA sequence
caaaacagcttcaatatagg

SEQ ID NO: 103309 - DNA, 20 bp, Artificial
  CRISPR gRNA sequence
agggagtctgtacattttga

SEQ ID NO: 103310 - DNA, 20 bp, Artificial
  CRISPR gRNA sequence
tgtacattttgaaagtcctt

SEQ ID NO: 103311 - DNA, 20 bp, Artificial
  CRISPR gRNA sequence
gtacattttgaaagtccttc

SEQ ID NO: 103312 - DNA, 20 bp, Artificial
  CRISPR gRNA sequence
ggcttccgtctctctcctcc

SEQ ID NO: 103313 - DNA, 20 bp, Artificial
  CRISPR gRNA sequence
cttccgtctctctcctccaa

SEQ ID NO: 103314 - DNA, 20 bp, Artificial
  CRISPR gRNA sequence
ttccgtctctctcctccaag

SEQ ID NO: 103315 - DNA, 20 bp, Artificial
  CRISPR gRNA sequence
gtctctctcctccaagaggt

SEQ ID NO: 103316 - DNA, 20 bp, Artificial
  CRISPR gRNA sequence
tctctctcctccaagaggta

SEQ ID NO: 103317 - DNA, 20 bp, Artificial
  CRISPR gRNA sequence
tttccttcctgacatatttc

SEQ ID NO: 103318 - DNA, 20 bp, Artificial
  CRISPR gRNA sequence
gctcttcctgttcctgttct

SEQ ID NO: 103319 - DNA, 20 bp, Artificial
  CRISPR gRNA sequence
cttcctgttcctgttctcag

SEQ ID NO: 103320 - DNA, 20 bp, Artificial
  CRISPR gRNA sequence
cctgttcctgttctcagcag

SEQ ID NO: 103321 - DNA, 20 bp, Artificial
  CRISPR gRNA sequence
ctgttcctgttctcagcagc

SEQ ID NO: 103322 - DNA, 20 bp, Artificial
  CRISPR gRNA sequence
tgttcctgttctcagcagca

SEQ ID NO: 103323 - DNA, 20 bp, Artificial
  CRISPR gRNA sequence
tcctgttctcagcagcaggg

SEQ ID NO: 103324 - DNA, 20 bp, Artificial
  CRISPR gRNA sequence
agggtggtgtcactgctgtg

SEQ ID NO: 103325 - DNA, 20 bp, Artificial
  CRISPR gRNA sequence
gtgtcactgctgtgcagttg

SEQ ID NO: 103326 - DNA, 20 bp, Artificial
  CRISPR gRNA sequence
ctgctgtgcagttgcagact

SEQ ID NO: 103327 - DNA, 20 bp, Artificial
  CRISPR gRNA sequence
tgctgtgcagttgcagactg

SEQ ID NO: 103328 - DNA, 20 bp, Artificial
  CRISPR gRNA sequence
tgcagttgcagactgaggcc

SEQ ID NO: 103329 - DNA, 20 bp, Artificial
  CRISPR gRNA sequence
gcagttgcagactgaggccc

SEQ ID NO: 103330 - DNA, 20 bp, Artificial
  CRISPR gRNA sequence
gttgcagactgaggcccagg

SEQ ID NO: 103331 - DNA, 20 bp, Artificial
  CRISPR gRNA sequence
ggcccaggtggcatccgcct

SEQ ID NO: 103332 - DNA, 20 bp, Artificial
  CRISPR gRNA sequence
gcccaggtggcatccgcctc

SEQ ID NO: 103333 - DNA, 20 bp, Artificial
  CRISPR gRNA sequence
aggtggcatccgcctcaggc

SEQ ID NO: 103334 - DNA, 20 bp, Artificial
  CRISPR gRNA sequence
ggcatccgcctcaggccagc

SEQ ID NO: 103335 - DNA, 20 bp, Artificial
  CRISPR gRNA sequence
ccgcctcaggccagcaagtc

SEQ ID NO: 103336 - DNA, 20 bp, Artificial
  CRISPR gRNA sequence
gccagcaagtccagaccctc

SEQ ID NO: 103337 - DNA, 20 bp, Artificial
  CRISPR gRNA sequence
ccagcaagtccagaccctcc

SEQ ID NO: 103338 - DNA, 20 bp, Artificial
  CRISPR gRNA sequence
gcaagtccagaccctccagg

SEQ ID NO: 103339 - DNA, 20 bp, Artificial
  CRISPR gRNA sequence
agtccagaccctccaggtag

SEQ ID NO: 103340 - DNA, 20 bp, Artificial
  CRISPR gRNA sequence
taccctctctgattctctgt

SEQ ID NO: 103341 - DNA, 20 bp, Artificial
  CRISPR gRNA sequence
acttctcctctcctcatgtc

SEQ ID NO: 103342 - DNA, 20 bp, Artificial
  CRISPR gRNA sequence
atgtctggtgctgtttgtgt

SEQ ID NO: 103343 - DNA, 20 bp, Artificial
  CRISPR gRNA sequence
tgtctggtgctgtttgtgtt

SEQ ID NO: 103344 - DNA, 20 bp, Artificial
  CRISPR gRNA sequence
gctgtttgtgttaggatctc

SEQ ID NO: 103345 - DNA, 20 bp, Artificial
  CRISPR gRNA sequence
gtttgtgttaggatctccag

SEQ ID NO: 103346 - DNA, 20 bp, Artificial
  CRISPR gRNA sequence
tttgtgttaggatctccagt

SEQ ID NO: 103347 - DNA, 20 bp, Artificial
  CRISPR gRNA sequence
gttaggatctccagtaggaa

SEQ ID NO: 103348 - DNA, 20 bp, Artificial
  CRISPR gRNA sequence
gatctccagtaggaatggca

SEQ ID NO: 103349 - DNA, 20 bp, Artificial
  CRISPR gRNA sequence
tccagtaggaatggcaaagt

SEQ ID NO: 103350 - DNA, 20 bp, Artificial
  CRISPR gRNA sequence
gatgctgctaacttgtcttt

SEQ ID NO: 103351 - DNA, 20 bp, Artificial
  CRISPR gRNA sequence
atgctgctaacttgtctttg

SEQ ID NO: 103352 - DNA, 20 bp, Artificial
  CRISPR gRNA sequence
aacttgtctttgaggcttat

SEQ ID NO: 103353 - DNA, 20 bp, Artificial
  CRISPR gRNA sequence
ctttgaggcttataagatgc

SEQ ID NO: 103354 - DNA, 20 bp, Artificial
  CRISPR gRNA sequence
gtttcctaatatttcatgcc

SEQ ID NO: 103355 - DNA, 20 bp, Artificial
  CRISPR gRNA sequence
atatttcatgccaagtcata

SEQ ID NO: 103356 - DNA, 20 bp, Artificial
  CRISPR gRNA sequence
atttcatgccaagtcatata

SEQ ID NO: 103357 - DNA, 20 bp, Artificial
  CRISPR gRNA sequence
agaccccgtatcaactttct

SEQ ID NO: 103358 - DNA, 20 bp, Artificial
  CRISPR gRNA sequence
cgtatcaactttctgagaat

SEQ ID NO: 103359 - DNA, 20 bp, Artificial
  CRISPR gRNA sequence
ttctgagaattggatttgac

SEQ ID NO: 103360 - DNA, 20 bp, Artificial
  CRISPR gRNA sequence
tttgactagcatgtttcttt

SEQ ID NO: 103361 - DNA, 20 bp, Artificial
  CRISPR gRNA sequence
catgtttctttgagaatgcc

SEQ ID NO: 103362 - DNA, 20 bp, Artificial
  CRISPR gRNA sequence
ttctttgagaatgcctggaa

SEQ ID NO: 103363 - DNA, 20 bp, Artificial
  CRISPR gRNA sequence
gagaatgcctggaaaagaaa

SEQ ID NO: 103364 - DNA, 20 bp, Artificial
  CRISPR gRNA sequence
gcctggaaaagaaatggtat

SEQ ID NO: 103365 - DNA, 20 bp, Artificial
  CRISPR gRNA sequence
aaaagaaatggtataagtga

SEQ ID NO: 103366 - DNA, 20 bp, Artificial
  CRISPR gRNA sequence
aaagaaatggtataagtgac

SEQ ID NO: 103367 - DNA, 20 bp, Artificial
  CRISPR gRNA sequence
gaaatggtataagtgacagg

SEQ ID NO: 103368 - DNA, 20 bp, Artificial
  CRISPR gRNA sequence
tgacaggaagaaattcttat

SEQ ID NO: 103369 - DNA, 20 bp, Artificial
  CRISPR gRNA sequence
gaaattcttataagtgacat

SEQ ID NO: 103370 - DNA, 20 bp, Artificial
  CRISPR gRNA sequence
aagtgacattagaatttatt

SEQ ID NO: 103371 - DNA, 20 bp, Artificial
  CRISPR gRNA sequence
agtgacattagaatttattc

SEQ ID NO: 103372 - DNA, 20 bp, Artificial
  CRISPR gRNA sequence
gtgacattagaatttattca

SEQ ID NO: 103373 - DNA, 20 bp, Artificial
  CRISPR gRNA sequence
attagaatttattcagggct

SEQ ID NO: 103374 - DNA, 20 bp, Artificial
  CRISPR gRNA sequence
gaatttattcagggctcggc

SEQ ID NO: 103375 - DNA, 20 bp, Artificial
  CRISPR gRNA sequence
aatttattcagggctcggcc

SEQ ID NO: 103376 - DNA, 20 bp, Artificial
  CRISPR gRNA sequence
attcagggctcggccgggcg

SEQ ID NO: 103377 - DNA, 20 bp, Artificial
  CRISPR gRNA sequence
cagggctcggccgggcgcgg

SEQ ID NO: 103378 - DNA, 20 bp, Artificial
  CRISPR gRNA sequence
gtggctcacgcctgtaatcc

SEQ ID NO: 103379 - DNA, 20 bp, Artificial
  CRISPR gRNA sequence
cgcctgtaatcccagcactt

SEQ ID NO: 103380 - DNA, 20 bp, Artificial
  CRISPR gRNA sequence
gcctgtaatcccagcacttt

SEQ ID NO: 103381 - DNA, 20 bp, Artificial
  CRISPR gRNA sequence
ctgtaatcccagcactttgg

SEQ ID NO: 103382 - DNA, 20 bp, Artificial
  CRISPR gRNA sequence
tgtaatcccagcactttggg

SEQ ID NO: 103383 - DNA, 20 bp, Artificial
  CRISPR gRNA sequence
tcccagcactttgggaggcc

SEQ ID NO: 103384 - DNA, 20 bp, Artificial
  CRISPR gRNA sequence
cccagcactttgggaggccg

SEQ ID NO: 103385 - DNA, 20 bp, Artificial
  CRISPR gRNA sequence
agcactttgggaggccgagg

SEQ ID NO: 103386 - DNA, 20 bp, Artificial
  CRISPR gRNA sequence
gcactttgggaggccgaggc

SEQ ID NO: 103387 - DNA, 20 bp, Artificial
  CRISPR gRNA sequence
ctttgggaggccgaggcagg

SEQ ID NO: 103388 - DNA, 20 bp, Artificial
  CRISPR gRNA sequence
ggccgaggcaggcggatcac

SEQ ID NO: 103389 - DNA, 20 bp, Artificial
  CRISPR gRNA sequence
gccgaggcaggcggatcacg

SEQ ID NO: 103390 - DNA, 20 bp, Artificial
  CRISPR gRNA sequence
aggcaggcggatcacgaggt

SEQ ID NO: 103391 - DNA, 20 bp, Artificial
  CRISPR gRNA sequence
ggcaggcggatcacgaggtc

SEQ ID NO: 103392 - DNA, 20 bp, Artificial
  CRISPR gRNA sequence
caggcggatcacgaggtcag

SEQ ID NO: 103393 - DNA, 20 bp, Artificial
  CRISPR gRNA sequence
gatcacgaggtcaggagatc

SEQ ID NO: 103394 - DNA, 20 bp, Artificial
  CRISPR gRNA sequence
tcaggagatcgagaccatcc

SEQ ID NO: 103395 - DNA, 20 bp, Artificial
  CRISPR gRNA sequence
cgagaccatcctggcaaaca

SEQ ID NO: 103396 - DNA, 20 bp, Artificial
  CRISPR gRNA sequence
tactaaaaatacaaaaaaat

SEQ ID NO: 103397 - DNA, 20 bp, Artificial
  CRISPR gRNA sequence
aaaaatacaaaaaaattagc

SEQ ID NO: 103398 - DNA, 20 bp, Artificial
  CRISPR gRNA sequence
aaaatacaaaaaaattagcc

SEQ ID NO: 103399 - DNA, 20 bp, Artificial
  CRISPR gRNA sequence
acaaaaaaattagccgggca

SEQ ID NO: 103400 - DNA, 20 bp, Artificial
  CRISPR gRNA sequence
aaaaaattagccgggcatgg

SEQ ID NO: 103401 - DNA, 20 bp, Artificial
  CRISPR gRNA sequence
aaattagccgggcatggtgg

SEQ ID NO: 103402 - DNA, 20 bp, Artificial
  CRISPR gRNA sequence
aattagccgggcatggtggc

SEQ ID NO: 103403 - DNA, 20 bp, Artificial
  CRISPR gRNA sequence
ggcatggtggcgggcacctg

SEQ ID NO: 103404 - DNA, 20 bp, Artificial
  CRISPR gRNA sequence
gtggcgggcacctgtagtcc

SEQ ID NO: 103405 - DNA, 20 bp, Artificial
  CRISPR gRNA sequence
cacctgtagtcccagctact

SEQ ID NO: 103406 - DNA, 20 bp, Artificial
  CRISPR gRNA sequence
acctgtagtcccagctactt

SEQ ID NO: 103407 - DNA, 20 bp, Artificial
  CRISPR gRNA sequence
ctgtagtcccagctacttgg

SEQ ID NO: 103408 - DNA, 20 bp, Artificial
  CRISPR gRNA sequence
tgtagtcccagctacttggg

SEQ ID NO: 103409 - DNA, 20 bp, Artificial
  CRISPR gRNA sequence
gtcccagctacttgggaggc

SEQ ID NO: 103410 - DNA, 20 bp, Artificial
  CRISPR gRNA sequence
cccagctacttgggaggctg

SEQ ID NO: 103411 - DNA, 20 bp, Artificial
  CRISPR gRNA sequence
agctacttgggaggctggag

SEQ ID NO: 103412 - DNA, 20 bp, Artificial
  CRISPR gRNA sequence
gctacttgggaggctggagc

SEQ ID NO: 103413 - DNA, 20 bp, Artificial
  CRISPR gRNA sequence
tacttgggaggctggagcag

SEQ ID NO: 103414 - DNA, 20 bp, Artificial
  CRISPR gRNA sequence
gggaggctggagcaggagaa

SEQ ID NO: 103415 - DNA, 20 bp, Artificial
  CRISPR gRNA sequence
gcaggagaatggcgtgaacc

SEQ ID NO: 103416 - DNA, 20 bp, Artificial
  CRISPR gRNA sequence
caggagaatggcgtgaaccc

SEQ ID NO: 103417 - DNA, 20 bp, Artificial
  CRISPR gRNA sequence
ggagaatggcgtgaacccag

SEQ ID NO: 103418 - DNA, 20 bp, Artificial
  CRISPR gRNA sequence
gagaatggcgtgaacccagg

SEQ ID NO: 103419 - DNA, 20 bp, Artificial
  CRISPR gRNA sequence
aatggcgtgaacccaggagg

SEQ ID NO: 103420 - DNA, 20 bp, Artificial
  CRISPR gRNA sequence
tggcgtgaacccaggaggca

SEQ ID NO: 103421 - DNA, 20 bp, Artificial
  CRISPR gRNA sequence
aacccaggaggcagagcttg

SEQ ID NO: 103422 - DNA, 20 bp, Artificial
  CRISPR gRNA sequence
caggaggcagagcttgcagt

SEQ ID NO: 103423 - DNA, 20 bp, Artificial
  CRISPR gRNA sequence
gaggcagagcttgcagtgag

SEQ ID NO: 103424 - DNA, 20 bp, Artificial
  CRISPR gRNA sequence
ggcagagcttgcagtgagca

SEQ ID NO: 103425 - DNA, 20 bp, Artificial
  CRISPR gRNA sequence
gagattgcgccactgcactc

SEQ ID NO: 103426 - DNA, 20 bp, Artificial
  CRISPR gRNA sequence
tgcgccactgcactccagcc

SEQ ID NO: 103427 - DNA, 20 bp, Artificial
  CRISPR gRNA sequence
gcgccactgcactccagcct

SEQ ID NO: 103428 - DNA, 20 bp, Artificial
  CRISPR gRNA sequence
ctgcactccagcctgggtga

SEQ ID NO: 103429 - DNA, 20 bp, Artificial
  CRISPR gRNA sequence
gcactccagcctgggtgaca

SEQ ID NO: 103430 - DNA, 20 bp, Artificial
  CRISPR gRNA sequence
tccagcctgggtgacagagc

SEQ ID NO: 103431 - DNA, 20 bp, Artificial
  CRISPR gRNA sequence
tccgtctcaaaaaaaaaaaa

SEQ ID NO: 103432 - DNA, 20 bp, Artificial
  CRISPR gRNA sequence
aaaaaaaaaaagaatttatt

SEQ ID NO: 103433 - DNA, 20 bp, Artificial
  CRISPR gRNA sequence
aaaaaaaaaagaatttattc

SEQ ID NO: 103434 - DNA, 20 bp, Artificial
  CRISPR gRNA sequence
aaaaaaaaagaatttattca

SEQ ID NO: 103435 - DNA, 20 bp, Artificial
  CRISPR gRNA sequence
ctctgatccaattaattgca

SEQ ID NO: 103436 - DNA, 20 bp, Artificial
  CRISPR gRNA sequence
tttgtgtatttgtgttacaa

SEQ ID NO: 103437 - DNA, 20 bp, Artificial
  CRISPR gRNA sequence
tgtgtatttgtgttacaatg

SEQ ID NO: 103438 - DNA, 20 bp, Artificial
  CRISPR gRNA sequence
gtatttgtgttacaatggag

SEQ ID NO: 103439 - DNA, 20 bp, Artificial
  CRISPR gRNA sequence
tatttgtgttacaatggaga

SEQ ID NO: 103440 - DNA, 20 bp, Artificial
  CRISPR gRNA sequence
gaaggaaatatatacatata

SEQ ID NO: 103441 - DNA, 20 bp, Artificial
  CRISPR gRNA sequence
atatacagacacacataaac

SEQ ID NO: 103442 - DNA, 20 bp, Artificial
  CRISPR gRNA sequence
tatacagacacacataaact

SEQ ID NO: 103443 - DNA, 20 bp, Artificial
  CRISPR gRNA sequence
cagacacacataaactaggc

SEQ ID NO: 103444 - DNA, 20 bp, Artificial
  CRISPR gRNA sequence
agacacacataaactaggct

SEQ ID NO: 103445 - DNA, 20 bp, Artificial
  CRISPR gRNA sequence
gctgtgctttatttttattc

SEQ ID NO: 103446 - DNA, 20 bp, Artificial
  CRISPR gRNA sequence
ctgtgctttatttttattca

SEQ ID NO: 103447 - DNA, 20 bp, Artificial
  CRISPR gRNA sequence
tgtgctttatttttattcaa

SEQ ID NO: 103448 - DNA, 20 bp, Artificial
  CRISPR gRNA sequence
gtgctttatttttattcaag

SEQ ID NO: 103449 - DNA, 20 bp, Artificial
  CRISPR gRNA sequence
tgaaaaataatcattgcact

SEQ ID NO: 103450 - DNA, 20 bp, Artificial
  CRISPR gRNA sequence
aaataatcattgcacttggc

SEQ ID NO: 103451 - DNA, 20 bp, Artificial
  CRISPR gRNA sequence
aataatcattgcacttggca

SEQ ID NO: 103452 - DNA, 20 bp, Artificial
  CRISPR gRNA sequence
gcacttggcaaggtttatct

SEQ ID NO: 103453 - DNA, 20 bp, Artificial
  CRISPR gRNA sequence
attgtttccactacctttcc

SEQ ID NO: 103454 - DNA, 20 bp, Artificial
  CRISPR gRNA sequence
ttgtttccactacctttcct

SEQ ID NO: 103455 - DNA, 20 bp, Artificial
  CRISPR gRNA sequence
tgtttccactacctttcctg

SEQ ID NO: 103456 - DNA, 20 bp, Artificial
  CRISPR gRNA sequence
gtttccactacctttcctgg

SEQ ID NO: 103457 - DNA, 20 bp, Artificial
  CRISPR gRNA sequence
cactacctttcctgggggaa

SEQ ID NO: 103458 - DNA, 20 bp, Artificial
  CRISPR gRNA sequence
atagtgacctgtcttattac

SEQ ID NO: 103459 - DNA, 20 bp, Artificial
  CRISPR gRNA sequence
gtcttattactagatctgca

SEQ ID NO: 103460 - DNA, 20 bp, Artificial
  CRISPR gRNA sequence
tagatctgcaaagattaccc

SEQ ID NO: 103461 - DNA, 20 bp, Artificial
  CRISPR gRNA sequence
agattaccccagatacctct

SEQ ID NO: 103462 - DNA, 20 bp, Artificial
  CRISPR gRNA sequence
taccccagatacctcttggt

SEQ ID NO: 103463 - DNA, 20 bp, Artificial
  CRISPR gRNA sequence
accccagatacctcttggtt

SEQ ID NO: 103464 - DNA, 20 bp, Artificial
  CRISPR gRNA sequence
ccagatacctcttggttagg

SEQ ID NO: 103465 - DNA, 20 bp, Artificial
  CRISPR gRNA sequence
gatacctcttggttaggcag

SEQ ID NO: 103466 - DNA, 20 bp, Artificial
  CRISPR gRNA sequence
acctcttggttaggcagaag

SEQ ID NO: 103467 - DNA, 20 bp, Artificial
  CRISPR gRNA sequence
cctcttggttaggcagaagc

SEQ ID NO: 103468 - DNA, 20 bp, Artificial
  CRISPR gRNA sequence
aagcaggatgtgctttctgt

SEQ ID NO: 103469 - DNA, 20 bp, Artificial
  CRISPR gRNA sequence
gatgtgctttctgtaagtct

SEQ ID NO: 103470 - DNA, 20 bp, Artificial
  CRISPR gRNA sequence
atgtgctttctgtaagtctt

SEQ ID NO: 103471 - DNA, 20 bp, Artificial
  CRISPR gRNA sequence
tctgtaagtcttaggtgtta

SEQ ID NO: 103472 - DNA, 20 bp, Artificial
  CRISPR gRNA sequence
aaagccactgtgataattct

SEQ ID NO: 103473 - DNA, 20 bp, Artificial
  CRISPR gRNA sequence
taattcttggttaatcaata

SEQ ID NO: 103474 - DNA, 20 bp, Artificial
  CRISPR gRNA sequence
ggttaatcaatacagttctt

SEQ ID NO: 103475 - DNA, 20 bp, Artificial
  CRISPR gRNA sequence
cagttctttagcatcgtgta

SEQ ID NO: 103476 - DNA, 20 bp, Artificial
  CRISPR gRNA sequence
ctttagcatcgtgtatggct

SEQ ID NO: 103477 - DNA, 20 bp, Artificial
  CRISPR gRNA sequence
tatggctaagtatcctaaat

SEQ ID NO: 103478 - DNA, 20 bp, Artificial
  CRISPR gRNA sequence
atggctaagtatcctaaatt

SEQ ID NO: 103479 - DNA, 20 bp, Artificial
  CRISPR gRNA sequence
tcctaaattgggttctaatt

SEQ ID NO: 103480 - DNA, 20 bp, Artificial
  CRISPR gRNA sequence
aaattgggttctaatttggc

SEQ ID NO: 103481 - DNA, 20 bp, Artificial
  CRISPR gRNA sequence
tggccagttcctataaaaca

SEQ ID NO: 103482 - DNA, 20 bp, Artificial
  CRISPR gRNA sequence
ggccagttcctataaaacac

SEQ ID NO: 103483 - DNA, 20 bp, Artificial
  CRISPR gRNA sequence
ccagttcctataaaacacag

SEQ ID NO: 103484 - DNA, 20 bp, Artificial
  CRISPR gRNA sequence
gttcctataaaacacaggag

SEQ ID NO: 103485 - DNA, 20 bp, Artificial
  CRISPR gRNA sequence
cctataaaacacaggagtag

SEQ ID NO: 103486 - DNA, 20 bp, Artificial
  CRISPR gRNA sequence
aaacacaggagtagcagcac

SEQ ID NO: 103487 - DNA, 20 bp, Artificial
  CRISPR gRNA sequence
actagtctactctgtgtatg

SEQ ID NO: 103488 - DNA, 20 bp, Artificial
  CRISPR gRNA sequence
ctagtctactctgtgtatgt

SEQ ID NO: 103489 - DNA, 20 bp, Artificial
  CRISPR gRNA sequence
attaaaataactctattttt

SEQ ID NO: 103490 - DNA, 20 bp, Artificial
  CRISPR gRNA sequence
taactctatttttgagaaat

SEQ ID NO: 103491 - DNA, 20 bp, Artificial
  CRISPR gRNA sequence
tctatttttgagaaattggc

SEQ ID NO: 103492 - DNA, 20 bp, Artificial
  CRISPR gRNA sequence
tttgagaaattggcaagatt

SEQ ID NO: 103493 - DNA, 20 bp, Artificial
  CRISPR gRNA sequence
ttgagaaattggcaagattt

SEQ ID NO: 103494 - DNA, 20 bp, Artificial
  CRISPR gRNA sequence
actttttccctccattgaat

SEQ ID NO: 103495 - DNA, 20 bp, Artificial
  CRISPR gRNA sequence
attgaattagaaatgattca

SEQ ID NO: 103496 - DNA, 20 bp, Artificial
  CRISPR gRNA sequence
gaattagaaatgattcaaag

SEQ ID NO: 103497 - DNA, 20 bp, Artificial
  CRISPR gRNA sequence
aaatgattcaaagtagaatc

SEQ ID NO: 103498 - DNA, 20 bp, Artificial
  CRISPR gRNA sequence
tcaaagtagaatctagaatg

SEQ ID NO: 103499 - DNA, 20 bp, Artificial
  CRISPR gRNA sequence
tagaatctagaatgtagaac

SEQ ID NO: 103500 - DNA, 20 bp, Artificial
  CRISPR gRNA sequence
ctggcatctcactttattgc

SEQ ID NO: 103501 - DNA, 20 bp, Artificial
  CRISPR gRNA sequence
actttattgctagtgctgct

SEQ ID NO: 103502 - DNA, 20 bp, Artificial
  CRISPR gRNA sequence
tgctagtgctgctaagcatc

SEQ ID NO: 103503 - DNA, 20 bp, Artificial
  CRISPR gRNA sequence
tagtgctgctaagcatccag

SEQ ID NO: 103504 - DNA, 20 bp, Artificial
  CRISPR gRNA sequence
acccctacccctgccaccaa

SEQ ID NO: 103505 - DNA, 20 bp, Artificial
  CRISPR gRNA sequence
cccctgccaccaatagtgtt

SEQ ID NO: 103506 - DNA, 20 bp, Artificial
  CRISPR gRNA sequence
tagtgtttggtaatgatgta

SEQ ID NO: 103507 - DNA, 20 bp, Artificial
  CRISPR gRNA sequence
gccaactttgaacataaatt

SEQ ID NO: 103508 - DNA, 20 bp, Artificial
  CRISPR gRNA sequence
ttgaacataaattaagccga

SEQ ID NO: 103509 - DNA, 20 bp, Artificial
  CRISPR gRNA sequence
aaattaagccgaaagaaact

SEQ ID NO: 103510 - DNA, 20 bp, Artificial
  CRISPR gRNA sequence
gccgaaagaaactgagcttg

SEQ ID NO: 103511 - DNA, 20 bp, Artificial
  CRISPR gRNA sequence
ccgaaagaaactgagcttgt

SEQ ID NO: 103512 - DNA, 20 bp, Artificial
  CRISPR gRNA sequence
aaaattgtgttcaaatctca

SEQ ID NO: 103513 - DNA, 20 bp, Artificial
  CRISPR gRNA sequence
gttcaaatctcacagtccaa

SEQ ID NO: 103514 - DNA, 20 bp, Artificial
  CRISPR gRNA sequence
catcttactcatatataaaa

SEQ ID NO: 103515 - DNA, 20 bp, Artificial
  CRISPR gRNA sequence
tcatatataaaacagtattt

SEQ ID NO: 103516 - DNA, 20 bp, Artificial
  CRISPR gRNA sequence
ggattgtcattaaccccttg

SEQ ID NO: 103517 - DNA, 20 bp, Artificial
  CRISPR gRNA sequence
gtcattaaccccttgtggaa

SEQ ID NO: 103518 - DNA, 20 bp, Artificial
  CRISPR gRNA sequence
tcattaaccccttgtggaat

SEQ ID NO: 103519 - DNA, 20 bp, Artificial
  CRISPR gRNA sequence
gtaacatgctcttaactgta

SEQ ID NO: 103520 - DNA, 20 bp, Artificial
  CRISPR gRNA sequence
acatttttctgttgtaaata

SEQ ID NO: 103521 - DNA, 20 bp, Artificial
  CRISPR gRNA sequence
ttttctgttgtaaatacagt

SEQ ID NO: 103522 - DNA, 20 bp, Artificial
  CRISPR gRNA sequence
tgtaaatacagtgagctctt

SEQ ID NO: 103523 - DNA, 20 bp, Artificial
  CRISPR gRNA sequence
taaatacagtgagctctttg

SEQ ID NO: 103524 - DNA, 20 bp, Artificial
  CRISPR gRNA sequence
tcatttatcatgtgcacgaa

SEQ ID NO: 103525 - DNA, 20 bp, Artificial
  CRISPR gRNA sequence
tgcacgaatagcacatcaat

SEQ ID NO: 103526 - DNA, 20 bp, Artificial
  CRISPR gRNA sequence
gcacgaatagcacatcaatt

SEQ ID NO: 103527 - DNA, 20 bp, Artificial
  CRISPR gRNA sequence
cacgaatagcacatcaattg

SEQ ID NO: 103528 - DNA, 20 bp, Artificial
  CRISPR gRNA sequence
cgaatagcacatcaattggg

SEQ ID NO: 103529 - DNA, 20 bp, Artificial
  CRISPR gRNA sequence
gaatagcacatcaattgggg

SEQ ID NO: 103530 - DNA, 20 bp, Artificial
  CRISPR gRNA sequence
catcaattggggaggaaatt

SEQ ID NO: 103531 - DNA, 20 bp, Artificial
  CRISPR gRNA sequence
gaggaaattaagatgatgaa

SEQ ID NO: 103532 - DNA, 20 bp, Artificial
  CRISPR gRNA sequence
aaattaagatgatgaataga

SEQ ID NO: 103533 - DNA, 20 bp, Artificial
  CRISPR gRNA sequence
aatagatagaaaattattaa

SEQ ID NO: 103534 - DNA, 20 bp, Artificial
  CRISPR gRNA sequence
acttgtgtttcctacttaca

SEQ ID NO: 103535 - DNA, 20 bp, Artificial
  CRISPR gRNA sequence
cttacatagattttatttaa

SEQ ID NO: 103536 - DNA, 20 bp, Artificial
  CRISPR gRNA sequence
acatagattttatttaaaag

SEQ ID NO: 103537 - DNA, 20 bp, Artificial
  CRISPR gRNA sequence
tagattttatttaaaagaag

SEQ ID NO: 103538 - DNA, 20 bp, Artificial
  CRISPR gRNA sequence
aaagaagtggaaacacttta

SEQ ID NO: 103539 - DNA, 20 bp, Artificial
  CRISPR gRNA sequence
gaaacactttatggaaataa

SEQ ID NO: 103540 - DNA, 20 bp, Artificial
  CRISPR gRNA sequence
aataatagaaacctttcctc

SEQ ID NO: 103541 - DNA, 20 bp, Artificial
  CRISPR gRNA sequence
ataatagaaacctttcctct

SEQ ID NO: 103542 - DNA, 20 bp, Artificial
  CRISPR gRNA sequence
taatagaaacctttcctcta

SEQ ID NO: 103543 - DNA, 20 bp, Artificial
  CRISPR gRNA sequence
ctctagggatctgattattt

SEQ ID NO: 103544 - DNA, 20 bp, Artificial
  CRISPR gRNA sequence
tctagggatctgattatttt

SEQ ID NO: 103545 - DNA, 20 bp, Artificial
  CRISPR gRNA sequence
tagggatctgattattttgg

SEQ ID NO: 103546 - DNA, 20 bp, Artificial
  CRISPR gRNA sequence
tattttgggagaattttaaa

SEQ ID NO: 103547 - DNA, 20 bp, Artificial
  CRISPR gRNA sequence
agaattttaaatagttattt

SEQ ID NO: 103548 - DNA, 20 bp, Artificial
  CRISPR gRNA sequence
attcttgctatatgtattct

SEQ ID NO: 103549 - DNA, 20 bp, Artificial
  CRISPR gRNA sequence
ctgagaaatctttcttgata

SEQ ID NO: 103550 - DNA, 20 bp, Artificial
  CRISPR gRNA sequence
tttcttgatacagaatatgc

SEQ ID NO: 103551 - DNA, 20 bp, Artificial
  CRISPR gRNA sequence
atacagaatatgcaagcatt

SEQ ID NO: 103552 - DNA, 20 bp, Artificial
  CRISPR gRNA sequence
gaatatgcaagcatttggtg

SEQ ID NO: 103553 - DNA, 20 bp, Artificial
  CRISPR gRNA sequence
tgcaagcatttggtgtagca

SEQ ID NO: 103554 - DNA, 20 bp, Artificial
  CRISPR gRNA sequence
gcaagcatttggtgtagcaa

SEQ ID NO: 103555 - DNA, 20 bp, Artificial
  CRISPR gRNA sequence
caagcatttggtgtagcaaa

SEQ ID NO: 103556 - DNA, 20 bp, Artificial
  CRISPR gRNA sequence
aagcatttggtgtagcaaag

SEQ ID NO: 103557 - DNA, 20 bp, Artificial
  CRISPR gRNA sequence
gtagcaaaggggatttgatt

SEQ ID NO: 103558 - DNA, 20 bp, Artificial
  CRISPR gRNA sequence
aaaggggatttgatttggaa

SEQ ID NO: 103559 - DNA, 20 bp, Artificial
  CRISPR gRNA sequence
aaggggatttgatttggaat

SEQ ID NO: 103560 - DNA, 20 bp, Artificial
  CRISPR gRNA sequence
aggggatttgatttggaatg

SEQ ID NO: 103561 - DNA, 20 bp, Artificial
  CRISPR gRNA sequence
ttgatttggaatggggaaat

SEQ ID NO: 103562 - DNA, 20 bp, Artificial
  CRISPR gRNA sequence
tgatttggaatggggaaata

SEQ ID NO: 103563 - DNA, 20 bp, Artificial
  CRISPR gRNA sequence
gatttggaatggggaaataa

SEQ ID NO: 103564 - DNA, 20 bp, Artificial
  CRISPR gRNA sequence
tggaatggggaaataaggga

SEQ ID NO: 103565 - DNA, 20 bp, Artificial
  CRISPR gRNA sequence
gaatggggaaataagggaaa

SEQ ID NO: 103566 - DNA, 20 bp, Artificial
  CRISPR gRNA sequence
ggggaaataagggaaagaga

SEQ ID NO: 103567 - DNA, 20 bp, Artificial
  CRISPR gRNA sequence
ataagggaaagagatagcat

SEQ ID NO: 103568 - DNA, 20 bp, Artificial
  CRISPR gRNA sequence
aagggaaagagatagcatga

SEQ ID NO: 103569 - DNA, 20 bp, Artificial
  CRISPR gRNA sequence
gggaaagagatagcatgaga

SEQ ID NO: 103570 - DNA, 20 bp, Artificial
  CRISPR gRNA sequence
aagagatagcatgagagagt

SEQ ID NO: 103571 - DNA, 20 bp, Artificial
  CRISPR gRNA sequence
agagatagcatgagagagtc

SEQ ID NO: 103572 - DNA, 20 bp, Artificial
  CRISPR gRNA sequence
catgagagagtcaggctgta

SEQ ID NO: 103573 - DNA, 20 bp, Artificial
  CRISPR gRNA sequence
aggctgtaaagtccttaaaa

SEQ ID NO: 103574 - DNA, 20 bp, Artificial
  CRISPR gRNA sequence
gtaaagtccttaaaaaagta

SEQ ID NO: 103575 - DNA, 20 bp, Artificial
  CRISPR gRNA sequence
gtccttaaaaaagtaaagta

SEQ ID NO: 103576 - DNA, 20 bp, Artificial
  CRISPR gRNA sequence
tccttaaaaaagtaaagtaa

SEQ ID NO: 103577 - DNA, 20 bp, Artificial
  CRISPR gRNA sequence
agtaaagtaaaggttctcaa

SEQ ID NO: 103578 - DNA, 20 bp, Artificial
  CRISPR gRNA sequence
aagtaaaggttctcaatgga

SEQ ID NO: 103579 - DNA, 20 bp, Artificial
  CRISPR gRNA sequence
atggacagtttaacaaaact

SEQ ID NO: 103580 - DNA, 20 bp, Artificial
  CRISPR gRNA sequence
tggacagtttaacaaaactt

SEQ ID NO: 103581 - DNA, 20 bp, Artificial
  CRISPR gRNA sequence
acttaggatttcaatgttcc

SEQ ID NO: 103582 - DNA, 20 bp, Artificial
  CRISPR gRNA sequence
tcctggtgattctaatacat

SEQ ID NO: 103583 - DNA, 20 bp, Artificial
  CRISPR gRNA sequence
tggtgattctaatacattag

SEQ ID NO: 103584 - DNA, 20 bp, Artificial
  CRISPR gRNA sequence
tgattctaatacattagtgg

SEQ ID NO: 103585 - DNA, 20 bp, Artificial
  CRISPR gRNA sequence
ttctaatacattagtggtgg

SEQ ID NO: 103586 - DNA, 20 bp, Artificial
  CRISPR gRNA sequence
taatacattagtggtggtgg

SEQ ID NO: 103587 - DNA, 20 bp, Artificial
  CRISPR gRNA sequence
tacattagtggtggtggcag

SEQ ID NO: 103588 - DNA, 20 bp, Artificial
  CRISPR gRNA sequence
attagtggtggtggcagtgg

SEQ ID NO: 103589 - DNA, 20 bp, Artificial
  CRISPR gRNA sequence
agtggtggtggcagtggcgg

SEQ ID NO: 103590 - DNA, 20 bp, Artificial
  CRISPR gRNA sequence
ggtggtggcagtggcggcgg

SEQ ID NO: 103591 - DNA, 20 bp, Artificial
  CRISPR gRNA sequence
ggtggcagtggcggcggtgg

SEQ ID NO: 103592 - DNA, 20 bp, Artificial
  CRISPR gRNA sequence
ggcagtggcggcggtggtgg

SEQ ID NO: 103593 - DNA, 20 bp, Artificial
  CRISPR gRNA sequence
ggcggtggtggtggtgattg

SEQ ID NO: 103594 - DNA, 20 bp, Artificial
  CRISPR gRNA sequence
gcggtggtggtggtgattgt

SEQ ID NO: 103595 - DNA, 20 bp, Artificial
  CRISPR gRNA sequence
ggtggtggtggtgattgtag

SEQ ID NO: 103596 - DNA, 20 bp, Artificial
  CRISPR gRNA sequence
gtggtggtggtgattgtagg

SEQ ID NO: 103597 - DNA, 20 bp, Artificial
  CRISPR gRNA sequence
tactatctaacctactcatc

SEQ ID NO: 103598 - DNA, 20 bp, Artificial
  CRISPR gRNA sequence
actatctaacctactcatct

SEQ ID NO: 103599 - DNA, 20 bp, Artificial
  CRISPR gRNA sequence
tctaacctactcatctagga

SEQ ID NO: 103600 - DNA, 20 bp, Artificial
  CRISPR gRNA sequence
tacttgcacatactttcatt

SEQ ID NO: 103601 - DNA, 20 bp, Artificial
  CRISPR gRNA sequence
ttcattaagtgtgaatattt

SEQ ID NO: 103602 - DNA, 20 bp, Artificial
  CRISPR gRNA sequence
agtcatgaatattctgttct

SEQ ID NO: 103603 - DNA, 20 bp, Artificial
  CRISPR gRNA sequence
gttctaagtaatttctgtca

SEQ ID NO: 103604 - DNA, 20 bp, Artificial
  CRISPR gRNA sequence
taagtaatttctgtcaaaga

SEQ ID NO: 103605 - DNA, 20 bp, Artificial
  CRISPR gRNA sequence
agtaatttctgtcaaagata

SEQ ID NO: 103606 - DNA, 20 bp, Artificial
  CRISPR gRNA sequence
gagtctgaaaatgaaaattt

SEQ ID NO: 103607 - DNA, 20 bp, Artificial
  CRISPR gRNA sequence
gaaaattttggactattcca

SEQ ID NO: 103608 - DNA, 20 bp, Artificial
  CRISPR gRNA sequence
gactattccatggatcatta

SEQ ID NO: 103609 - DNA, 20 bp, Artificial
  CRISPR gRNA sequence
atcattacagtttacttcta

SEQ ID NO: 103610 - DNA, 20 bp, Artificial
  CRISPR gRNA sequence
ttacttctaaagcactttta

SEQ ID NO: 103611 - DNA, 20 bp, Artificial
  CRISPR gRNA sequence
aagcacttttaaagtgcttc

SEQ ID NO: 103612 - DNA, 20 bp, Artificial
  CRISPR gRNA sequence
acttttaaagtgcttccaga

SEQ ID NO: 103613 - DNA, 20 bp, Artificial
  CRISPR gRNA sequence
gcttccagaaagcattctat

SEQ ID NO: 103614 - DNA, 20 bp, Artificial
  CRISPR gRNA sequence
cttccagaaagcattctatt

SEQ ID NO: 103615 - DNA, 20 bp, Artificial
  CRISPR gRNA sequence
tctattaggtatttttgtat

SEQ ID NO: 103616 - DNA, 20 bp, Artificial
  CRISPR gRNA sequence
ctattaggtatttttgtatt

SEQ ID NO: 103617 - DNA, 20 bp, Artificial
  CRISPR gRNA sequence
gtatttttgtattgggactt

SEQ ID NO: 103618 - DNA, 20 bp, Artificial
  CRISPR gRNA sequence
tattgggacttaagatgtga

SEQ ID NO: 103619 - DNA, 20 bp, Artificial
  CRISPR gRNA sequence
ttgggacttaagatgtgaca

SEQ ID NO: 103620 - DNA, 20 bp, Artificial
  CRISPR gRNA sequence
aagatgtgacagagcacttg

SEQ ID NO: 103621 - DNA, 20 bp, Artificial
  CRISPR gRNA sequence
acagagcacttgtagtgacc

SEQ ID NO: 103622 - DNA, 20 bp, Artificial
  CRISPR gRNA sequence
ttgtagtgacctggctccta

SEQ ID NO: 103623 - DNA, 20 bp, Artificial
  CRISPR gRNA sequence
tagtgacctggctcctacag

SEQ ID NO: 103624 - DNA, 20 bp, Artificial
  CRISPR gRNA sequence
tacagtagtctgtttactca

SEQ ID NO: 103625 - DNA, 20 bp, Artificial
  CRISPR gRNA sequence
acagtagtctgtttactcat

SEQ ID NO: 103626 - DNA, 20 bp, Artificial
  CRISPR gRNA sequence
agtagtctgtttactcatag

SEQ ID NO: 103627 - DNA, 20 bp, Artificial
  CRISPR gRNA sequence
atttgttgttgcttctgata

SEQ ID NO: 103628 - DNA, 20 bp, Artificial
  CRISPR gRNA sequence
ataaagctaaaataaccatg

SEQ ID NO: 103629 - DNA, 20 bp, Artificial
  CRISPR gRNA sequence
aaataaccatgtggatatta

SEQ ID NO: 103630 - DNA, 20 bp, Artificial
  CRISPR gRNA sequence
ataaccatgtggatattata

SEQ ID NO: 103631 - DNA, 20 bp, Artificial
  CRISPR gRNA sequence
taaccatgtggatattatag

SEQ ID NO: 103632 - DNA, 20 bp, Artificial
  CRISPR gRNA sequence
catgtggatattatagaggc

SEQ ID NO: 103633 - DNA, 20 bp, Artificial
  CRISPR gRNA sequence
tggatattatagaggccagt

SEQ ID NO: 103634 - DNA, 20 bp, Artificial
  CRISPR gRNA sequence
ggatattatagaggccagtg

SEQ ID NO: 103635 - DNA, 20 bp, Artificial
  CRISPR gRNA sequence
gccagtgaggaattccacca

SEQ ID NO: 103636 - DNA, 20 bp, Artificial
  CRISPR gRNA sequence
cagtgaggaattccaccatg

SEQ ID NO: 103637 - DNA, 20 bp, Artificial
  CRISPR gRNA sequence
catggagactgcaaactgac

SEQ ID NO: 103638 - DNA, 20 bp, Artificial
  CRISPR gRNA sequence
gagactgcaaactgaccaga

SEQ ID NO: 103639 - DNA, 20 bp, Artificial
  CRISPR gRNA sequence
actgaccagaaagtgctttt

SEQ ID NO: 103640 - DNA, 20 bp, Artificial
  CRISPR gRNA sequence
aagtgcttttaagaaatctt

SEQ ID NO: 103641 - DNA, 20 bp, Artificial
  CRISPR gRNA sequence
tgcttttaagaaatctttag

SEQ ID NO: 103642 - DNA, 20 bp, Artificial
  CRISPR gRNA sequence
tttaagaaatctttagtagt

SEQ ID NO: 103643 - DNA, 20 bp, Artificial
  CRISPR gRNA sequence
gtttaaacaacaaacatatc

SEQ ID NO: 103644 - DNA, 20 bp, Artificial
  CRISPR gRNA sequence
acaaacatatctagaattca

SEQ ID NO: 103645 - DNA, 20 bp, Artificial
  CRISPR gRNA sequence
aaacatatctagaattcaca

SEQ ID NO: 103646 - DNA, 20 bp, Artificial
  CRISPR gRNA sequence
tagaattcacagagtaaaat

SEQ ID NO: 103647 - DNA, 20 bp, Artificial
  CRISPR gRNA sequence
aattcacagagtaaaatgag

SEQ ID NO: 103648 - DNA, 20 bp, Artificial
  CRISPR gRNA sequence
attcacagagtaaaatgagc

SEQ ID NO: 103649 - DNA, 20 bp, Artificial
  CRISPR gRNA sequence
agagtaaaatgagcaggata

SEQ ID NO: 103650 - DNA, 20 bp, Artificial
  CRISPR gRNA sequence
gagtaaaatgagcaggataa

SEQ ID NO: 103651 - DNA, 20 bp, Artificial
  CRISPR gRNA sequence
atacatttgacatttcattt

SEQ ID NO: 103652 - DNA, 20 bp, Artificial
  CRISPR gRNA sequence
ttgacatttcattttagctt

SEQ ID NO: 103653 - DNA, 20 bp, Artificial
  CRISPR gRNA sequence
gacatttcattttagcttga

SEQ ID NO: 103654 - DNA, 20 bp, Artificial
  CRISPR gRNA sequence
cattttagcttgagagactg

SEQ ID NO: 103655 - DNA, 20 bp, Artificial
  CRISPR gRNA sequence
attttagcttgagagactgt

SEQ ID NO: 103656 - DNA, 20 bp, Artificial
  CRISPR gRNA sequence
ttttagcttgagagactgta

SEQ ID NO: 103657 - DNA, 20 bp, Artificial
  CRISPR gRNA sequence
ttgagagactgtagggaaaa

SEQ ID NO: 103658 - DNA, 20 bp, Artificial
  CRISPR gRNA sequence
tgagagactgtagggaaaaa

SEQ ID NO: 103659 - DNA, 20 bp, Artificial
  CRISPR gRNA sequence
gagagactgtagggaaaaaa

SEQ ID NO: 103660 - DNA, 20 bp, Artificial
  CRISPR gRNA sequence
aaaagggtcatcctctacat

SEQ ID NO: 103661 - DNA, 20 bp, Artificial
  CRISPR gRNA sequence
tcatcctctacataagcttc

SEQ ID NO: 103662 - DNA, 20 bp, Artificial
  CRISPR gRNA sequence
atcctctacataagcttcca

SEQ ID NO: 103663 - DNA, 20 bp, Artificial
  CRISPR gRNA sequence
ttccagagctgcttgctacc

SEQ ID NO: 103664 - DNA, 20 bp, Artificial
  CRISPR gRNA sequence
ctgcttgctacccagcctcc

SEQ ID NO: 103665 - DNA, 20 bp, Artificial
  CRISPR gRNA sequence
gcttgctacccagcctccta

SEQ ID NO: 103666 - DNA, 20 bp, Artificial
  CRISPR gRNA sequence
cagcctcctagagtcattgc

SEQ ID NO: 103667 - DNA, 20 bp, Artificial
  CRISPR gRNA sequence
agcctcctagagtcattgct

SEQ ID NO: 103668 - DNA, 20 bp, Artificial
  CRISPR gRNA sequence
cctagagtcattgctgggta

SEQ ID NO: 103669 - DNA, 20 bp, Artificial
  CRISPR gRNA sequence
tttaccttcttcactttatt

SEQ ID NO: 103670 - DNA, 20 bp, Artificial
  CRISPR gRNA sequence
ccctctcattgccttctctc

SEQ ID NO: 103671 - DNA, 20 bp, Artificial
  CRISPR gRNA sequence
cttctctccagccttcacta

SEQ ID NO: 103672 - DNA, 20 bp, Artificial
  CRISPR gRNA sequence
ccttcactacagaccattcc

SEQ ID NO: 103673 - DNA, 20 bp, Artificial
  CRISPR gRNA sequence
actacagaccattcctggat

SEQ ID NO: 103674 - DNA, 20 bp, Artificial
  CRISPR gRNA sequence
cattcctggattggtttaaa

SEQ ID NO: 103675 - DNA, 20 bp, Artificial
  CRISPR gRNA sequence
attcctggattggtttaaac

SEQ ID NO: 103676 - DNA, 20 bp, Artificial
  CRISPR gRNA sequence
ttatgattaaatgtttgtca

SEQ ID NO: 103677 - DNA, 20 bp, Artificial
  CRISPR gRNA sequence
ttaaatgtttgtcatggatt

SEQ ID NO: 103678 - DNA, 20 bp, Artificial
  CRISPR gRNA sequence
tcatggatttagcccgtgtt

SEQ ID NO: 103679 - DNA, 20 bp, Artificial
  CRISPR gRNA sequence
acaaatgccttatatctatt

SEQ ID NO: 103680 - DNA, 20 bp, Artificial
  CRISPR gRNA sequence
atatctattgagacttctca

SEQ ID NO: 103681 - DNA, 20 bp, Artificial
  CRISPR gRNA sequence
ttgagacttctcaaagactc

SEQ ID NO: 103682 - DNA, 20 bp, Artificial
  CRISPR gRNA sequence
ctccattatgtctgacctta

SEQ ID NO: 103683 - DNA, 20 bp, Artificial
  CRISPR gRNA sequence
atgtctgaccttaaagtatt

SEQ ID NO: 103684 - DNA, 20 bp, Artificial
  CRISPR gRNA sequence
tgaccttaaagtattgagct

SEQ ID NO: 103685 - DNA, 20 bp, Artificial
  CRISPR gRNA sequence
aaagtattgagcttggcatt

SEQ ID NO: 103686 - DNA, 20 bp, Artificial
  CRISPR gRNA sequence
ttgagcttggcatttagtaa

SEQ ID NO: 103687 - DNA, 20 bp, Artificial
  CRISPR gRNA sequence
tgagcttggcatttagtaac

SEQ ID NO: 103688 - DNA, 20 bp, Artificial
  CRISPR gRNA sequence
gcatttagtaacaggattca

SEQ ID NO: 103689 - DNA, 20 bp, Artificial
  CRISPR gRNA sequence
acaggattcatagatattta

SEQ ID NO: 103690 - DNA, 20 bp, Artificial
  CRISPR gRNA sequence
tagatatttaaagataactt

SEQ ID NO: 103691 - DNA, 20 bp, Artificial
  CRISPR gRNA sequence
agatatttaaagataacttg

SEQ ID NO: 103692 - DNA, 20 bp, Artificial
  CRISPR gRNA sequence
taaagataacttgaggactt

SEQ ID NO: 103693 - DNA, 20 bp, Artificial
  CRISPR gRNA sequence
acttgagacatatattttct

SEQ ID NO: 103694 - DNA, 20 bp, Artificial
  CRISPR gRNA sequence
ttttctaccttttccttttc

SEQ ID NO: 103695 - DNA, 20 bp, Artificial
  CRISPR gRNA sequence
ctaccttttccttttctagc

SEQ ID NO: 103696 - DNA, 20 bp, Artificial
  CRISPR gRNA sequence
taccttttccttttctagca

SEQ ID NO: 103697 - DNA, 20 bp, Artificial
  CRISPR gRNA sequence
cttttccttttctagcaagg

SEQ ID NO: 103698 - DNA, 20 bp, Artificial
  CRISPR gRNA sequence
ttccttttctagcaaggcag

SEQ ID NO: 103699 - DNA, 20 bp, Artificial
  CRISPR gRNA sequence
tttctagcaaggcagcagaa

SEQ ID NO: 103700 - DNA, 20 bp, Artificial
  CRISPR gRNA sequence
gcaaggcagcagaatagttc

SEQ ID NO: 103701 - DNA, 20 bp, Artificial
  CRISPR gRNA sequence
tagttccagtgattgtcttt

SEQ ID NO: 103702 - DNA, 20 bp, Artificial
  CRISPR gRNA sequence
gttcttattttatttcattc

SEQ ID NO: 103703 - DNA, 20 bp, Artificial
  CRISPR gRNA sequence
ttcttattttatttcattct

SEQ ID NO: 103704 - DNA, 20 bp, Artificial
  CRISPR gRNA sequence
ttttatttcattctaggtcc

SEQ ID NO: 103705 - DNA, 20 bp, Artificial
  CRISPR gRNA sequence
tttatttcattctaggtcca

SEQ ID NO: 103706 - DNA, 20 bp, Artificial
  CRISPR gRNA sequence
ttatttcattctaggtccaa

SEQ ID NO: 103707 - DNA, 20 bp, Artificial
  CRISPR gRNA sequence
tttcattctaggtccaaggg

SEQ ID NO: 103708 - DNA, 20 bp, Artificial
  CRISPR gRNA sequence
ggtccaagggcagccattaa

SEQ ID NO: 103709 - DNA, 20 bp, Artificial
  CRISPR gRNA sequence
aagggcagccattaatggtg

SEQ ID NO: 103710 - DNA, 20 bp, Artificial
  CRISPR gRNA sequence
agggcagccattaatggtgc

SEQ ID NO: 103711 - DNA, 20 bp, Artificial
  CRISPR gRNA sequence
cagccattaatggtgcaggt

SEQ ID NO: 103712 - DNA, 20 bp, Artificial
  CRISPR gRNA sequence
ccattaatggtgcaggtcag

SEQ ID NO: 103713 - DNA, 20 bp, Artificial
  CRISPR gRNA sequence
attaatggtgcaggtcagtg

SEQ ID NO: 103714 - DNA, 20 bp, Artificial
  CRISPR gRNA sequence
ttaatggtgcaggtcagtgg

SEQ ID NO: 103715 - DNA, 20 bp, Artificial
  CRISPR gRNA sequence
tggtgcaggtcagtggaggc

SEQ ID NO: 103716 - DNA, 20 bp, Artificial
  CRISPR gRNA sequence
ggccagctaatcacatcaac

SEQ ID NO: 103717 - DNA, 20 bp, Artificial
  CRISPR gRNA sequence
atcaactggccaacccatca

SEQ ID NO: 103718 - DNA, 20 bp, Artificial
  CRISPR gRNA sequence
ctggccaacccatcatggtc

SEQ ID NO: 103719 - DNA, 20 bp, Artificial
  CRISPR gRNA sequence
tggccaacccatcatggtcc

SEQ ID NO: 103720 - DNA, 20 bp, Artificial
  CRISPR gRNA sequence
atcatggtccaggctgtccc

SEQ ID NO: 103721 - DNA, 20 bp, Artificial
  CRISPR gRNA sequence
atggtccaggctgtccctgg

SEQ ID NO: 103722 - DNA, 20 bp, Artificial
  CRISPR gRNA sequence
ccaggctgtccctggtggac

SEQ ID NO: 103723 - DNA, 20 bp, Artificial
  CRISPR gRNA sequence
caggctgtccctggtggaca

SEQ ID NO: 103724 - DNA, 20 bp, Artificial
  CRISPR gRNA sequence
acaaggtcaaaccatcatgc

SEQ ID NO: 103725 - DNA, 20 bp, Artificial
  CRISPR gRNA sequence
atcatgcaagtacctgtttc

SEQ ID NO: 103726 - DNA, 20 bp, Artificial
  CRISPR gRNA sequence
aagtacctgtttctggaaca

SEQ ID NO: 103727 - DNA, 20 bp, Artificial
  CRISPR gRNA sequence
agtacctgtttctggaacac

SEQ ID NO: 103728 - DNA, 20 bp, Artificial
  CRISPR gRNA sequence
gtacctgtttctggaacaca

SEQ ID NO: 103729 - DNA, 20 bp, Artificial
  CRISPR gRNA sequence
tttctggaacacagggtttg

SEQ ID NO: 103730 - DNA, 20 bp, Artificial
  CRISPR gRNA sequence
tggaacacagggtttgcagc

SEQ ID NO: 103731 - DNA, 20 bp, Artificial
  CRISPR gRNA sequence
acacagggtttgcagcaagt

SEQ ID NO: 103732 - DNA, 20 bp, Artificial
  CRISPR gRNA sequence
gagtaatatttaaaaatatt

SEQ ID NO: 103733 - DNA, 20 bp, Artificial
  CRISPR gRNA sequence
taatatttaaaaatattgag

SEQ ID NO: 103734 - DNA, 20 bp, Artificial
  CRISPR gRNA sequence
aaaaatattgagcagtatat

SEQ ID NO: 103735 - DNA, 20 bp, Artificial
  CRISPR gRNA sequence
aaatattgagcagtatatca

SEQ ID NO: 103736 - DNA, 20 bp, Artificial
  CRISPR gRNA sequence
aatattgagcagtatatcag

SEQ ID NO: 103737 - DNA, 20 bp, Artificial
  CRISPR gRNA sequence
tattgagcagtatatcagag

SEQ ID NO: 103738 - DNA, 20 bp, Artificial
  CRISPR gRNA sequence
ttgagcagtatatcagagga

SEQ ID NO: 103739 - DNA, 20 bp, Artificial
  CRISPR gRNA sequence
tgagcagtatatcagaggag

SEQ ID NO: 103740 - DNA, 20 bp, Artificial
  CRISPR gRNA sequence
atatcagaggagaggtttca

SEQ ID NO: 103741 - DNA, 20 bp, Artificial
  CRISPR gRNA sequence
agaggagaggtttcaaagaa

SEQ ID NO: 103742 - DNA, 20 bp, Artificial
  CRISPR gRNA sequence
cctaacccacattttgcatt

SEQ ID NO: 103743 - DNA, 20 bp, Artificial
  CRISPR gRNA sequence
cagttgattttctgccttta

SEQ ID NO: 103744 - DNA, 20 bp, Artificial
  CRISPR gRNA sequence
attttctgcctttatagtac

SEQ ID NO: 103745 - DNA, 20 bp, Artificial
  CRISPR gRNA sequence
atagtaccagtgatataaac

SEQ ID NO: 103746 - DNA, 20 bp, Artificial
  CRISPR gRNA sequence
tgatataaactagaactatg

SEQ ID NO: 103747 - DNA, 20 bp, Artificial
  CRISPR gRNA sequence
aactagaactatgcagaaat

SEQ ID NO: 103748 - DNA, 20 bp, Artificial
  CRISPR gRNA sequence
agaactatgcagaaattgga

SEQ ID NO: 103749 - DNA, 20 bp, Artificial
  CRISPR gRNA sequence
atgcagaaattggacagctc

SEQ ID NO: 103750 - DNA, 20 bp, Artificial
  CRISPR gRNA sequence
ggacagctccagtaatgact

SEQ ID NO: 103751 - DNA, 20 bp, Artificial
  CRISPR gRNA sequence
tccagtaatgactaagatat

SEQ ID NO: 103752 - DNA, 20 bp, Artificial
  CRISPR gRNA sequence
ccagtaatgactaagatatt

SEQ ID NO: 103753 - DNA, 20 bp, Artificial
  CRISPR gRNA sequence
catgatcttgaattgctgta

SEQ ID NO: 103754 - DNA, 20 bp, Artificial
  CRISPR gRNA sequence
gaattgctgtaaagtatatg

SEQ ID NO: 103755 - DNA, 20 bp, Artificial
  CRISPR gRNA sequence
attgctgtaaagtatatgaa

SEQ ID NO: 103756 - DNA, 20 bp, Artificial
  CRISPR gRNA sequence
ttgctgtaaagtatatgaag

SEQ ID NO: 103757 - DNA, 20 bp, Artificial
  CRISPR gRNA sequence
tgtaaagtatatgaagaggt

SEQ ID NO: 103758 - DNA, 20 bp, Artificial
  CRISPR gRNA sequence
tatatgaagaggttagaatc

SEQ ID NO: 103759 - DNA, 20 bp, Artificial
  CRISPR gRNA sequence
agaggttagaatctagttta

SEQ ID NO: 103760 - DNA, 20 bp, Artificial
  CRISPR gRNA sequence
tatagtatattttattttaa

SEQ ID NO: 103761 - DNA, 20 bp, Artificial
  CRISPR gRNA sequence
attttaaaagaaacaaaaat

SEQ ID NO: 103762 - DNA, 20 bp, Artificial
  CRISPR gRNA sequence
aagaaacaaaaatgagtatt

SEQ ID NO: 103763 - DNA, 20 bp, Artificial
  CRISPR gRNA sequence
aacaaaaatgagtatttaga

SEQ ID NO: 103764 - DNA, 20 bp, Artificial
  CRISPR gRNA sequence
aaaatgagtatttagaaagt

SEQ ID NO: 103765 - DNA, 20 bp, Artificial
  CRISPR gRNA sequence
agttagaaaaataacaaaac

SEQ ID NO: 103766 - DNA, 20 bp, Artificial
  CRISPR gRNA sequence
aaaataacaaaacgagcaaa

SEQ ID NO: 103767 - DNA, 20 bp, Artificial
  CRISPR gRNA sequence
ataacaaaacgagcaaaaag

SEQ ID NO: 103768 - DNA, 20 bp, Artificial
  CRISPR gRNA sequence
taacaaaacgagcaaaaagt

SEQ ID NO: 103769 - DNA, 20 bp, Artificial
  CRISPR gRNA sequence
aaagtgggtccaaattaatt

SEQ ID NO: 103770 - DNA, 20 bp, Artificial
  CRISPR gRNA sequence
gtgggtccaaattaattaag

SEQ ID NO: 103771 - DNA, 20 bp, Artificial
  CRISPR gRNA sequence
ttaagtagaaaactgacgta

SEQ ID NO: 103772 - DNA, 20 bp, Artificial
  CRISPR gRNA sequence
gtagaaaactgacgtataga

SEQ ID NO: 103773 - DNA, 20 bp, Artificial
  CRISPR gRNA sequence
tagaaaactgacgtatagaa

SEQ ID NO: 103774 - DNA, 20 bp, Artificial
  CRISPR gRNA sequence
tagaaaggataaataaaatc

SEQ ID NO: 103775 - DNA, 20 bp, Artificial
  CRISPR gRNA sequence
aaataaaatctagattgttt

SEQ ID NO: 103776 - DNA, 20 bp, Artificial
  CRISPR gRNA sequence
taaaatctagattgtttaag

SEQ ID NO: 103777 - DNA, 20 bp, Artificial
  CRISPR gRNA sequence
gtttaagcagaccaataaaa

SEQ ID NO: 103778 - DNA, 20 bp, Artificial
  CRISPR gRNA sequence
tttaagcagaccaataaaac

SEQ ID NO: 103779 - DNA, 20 bp, Artificial
  CRISPR gRNA sequence
accaataaaacaggtaaatc

SEQ ID NO: 103780 - DNA, 20 bp, Artificial
  CRISPR gRNA sequence
atccagttgaaacactgatt

SEQ ID NO: 103781 - DNA, 20 bp, Artificial
  CRISPR gRNA sequence
ttgaaacactgattgagaaa

SEQ ID NO: 103782 - DNA, 20 bp, Artificial
  CRISPR gRNA sequence
gattgagaaacagaaaacaa

SEQ ID NO: 103783 - DNA, 20 bp, Artificial
  CRISPR gRNA sequence
gagaaacagaaaacaaaagt

SEQ ID NO: 103784 - DNA, 20 bp, Artificial
  CRISPR gRNA sequence
acagaaaacaaaagtaagca

SEQ ID NO: 103785 - DNA, 20 bp, Artificial
  CRISPR gRNA sequence
aacaaaagtaagcaaagatg

SEQ ID NO: 103786 - DNA, 20 bp, Artificial
  CRISPR gRNA sequence
aaaagtaagcaaagatgtag

SEQ ID NO: 103787 - DNA, 20 bp, Artificial
  CRISPR gRNA sequence
aagtaagcaaagatgtagaa

SEQ ID NO: 103788 - DNA, 20 bp, Artificial
  CRISPR gRNA sequence
caaagatgtagaagagatta

SEQ ID NO: 103789 - DNA, 20 bp, Artificial
  CRISPR gRNA sequence
aaagatgtagaagagattaa

SEQ ID NO: 103790 - DNA, 20 bp, Artificial
  CRISPR gRNA sequence
gatgtagaagagattaaagg

SEQ ID NO: 103791 - DNA, 20 bp, Artificial
  CRISPR gRNA sequence
atgtagaagagattaaagga

SEQ ID NO: 103792 - DNA, 20 bp, Artificial
  CRISPR gRNA sequence
agaagagattaaaggaaggc

SEQ ID NO: 103793 - DNA, 20 bp, Artificial
  CRISPR gRNA sequence
gaagagattaaaggaaggcc

SEQ ID NO: 103794 - DNA, 20 bp, Artificial
  CRISPR gRNA sequence
gattaaaggaaggccaggcg

SEQ ID NO: 103795 - DNA, 20 bp, Artificial
  CRISPR gRNA sequence
taaaggaaggccaggcgcag

SEQ ID NO: 103796 - DNA, 20 bp, Artificial
  CRISPR gRNA sequence
gtggctcatgcctgtgatcc

SEQ ID NO: 103797 - DNA, 20 bp, Artificial
  CRISPR gRNA sequence
atgcctgtgatcccagcact

SEQ ID NO: 103798 - DNA, 20 bp, Artificial
  CRISPR gRNA sequence
tgcctgtgatcccagcactt

SEQ ID NO: 103799 - DNA, 20 bp, Artificial
  CRISPR gRNA sequence
gcctgtgatcccagcacttg

SEQ ID NO: 103800 - DNA, 20 bp, Artificial
  CRISPR gRNA sequence
ctgtgatcccagcacttggg

SEQ ID NO: 103801 - DNA, 20 bp, Artificial
  CRISPR gRNA sequence
tgtgatcccagcacttgggg

SEQ ID NO: 103802 - DNA, 20 bp, Artificial
  CRISPR gRNA sequence
tcccagcacttggggaggcc

SEQ ID NO: 103803 - DNA, 20 bp, Artificial
  CRISPR gRNA sequence
cccagcacttggggaggcca

SEQ ID NO: 103804 - DNA, 20 bp, Artificial
  CRISPR gRNA sequence
agcacttggggaggccaagg

SEQ ID NO: 103805 - DNA, 20 bp, Artificial
  CRISPR gRNA sequence
gcacttggggaggccaaggc

SEQ ID NO: 103806 - DNA, 20 bp, Artificial
  CRISPR gRNA sequence
cttggggaggccaaggcagg

SEQ ID NO: 103807 - DNA, 20 bp, Artificial
  CRISPR gRNA sequence
ccaaggcaggtggatcactt

SEQ ID NO: 103808 - DNA, 20 bp, Artificial
  CRISPR gRNA sequence
caaggcaggtggatcacttg

SEQ ID NO: 103809 - DNA, 20 bp, Artificial
  CRISPR gRNA sequence
gcaggtggatcacttgaggc

SEQ ID NO: 103810 - DNA, 20 bp, Artificial
  CRISPR gRNA sequence
caggtggatcacttgaggcc

SEQ ID NO: 103811 - DNA, 20 bp, Artificial
  CRISPR gRNA sequence
ggtggatcacttgaggccag

SEQ ID NO: 103812 - DNA, 20 bp, Artificial
  CRISPR gRNA sequence
tcacttgaggccaggagttc

SEQ ID NO: 103813 - DNA, 20 bp, Artificial
  CRISPR gRNA sequence
tgaggccaggagttcaagac

SEQ ID NO: 103814 - DNA, 20 bp, Artificial
  CRISPR gRNA sequence
ccaggagttcaagaccagcc

SEQ ID NO: 103815 - DNA, 20 bp, Artificial
  CRISPR gRNA sequence
ctctactaaaaataaaaaat

SEQ ID NO: 103816 - DNA, 20 bp, Artificial
  CRISPR gRNA sequence
actaaaaataaaaaattagc

SEQ ID NO: 103817 - DNA, 20 bp, Artificial
  CRISPR gRNA sequence
ctaaaaataaaaaattagcc

SEQ ID NO: 103818 - DNA, 20 bp, Artificial
  CRISPR gRNA sequence
aataaaaaattagccgggcg

SEQ ID NO: 103819 - DNA, 20 bp, Artificial
  CRISPR gRNA sequence
aaaaaattagccgggcgtgg

SEQ ID NO: 103820 - DNA, 20 bp, Artificial
  CRISPR gRNA sequence
gtggcacgcacctgtaatcc

SEQ ID NO: 103821 - DNA, 20 bp, Artificial
  CRISPR gRNA sequence
cacctgtaatcccagctact

SEQ ID NO: 103822 - DNA, 20 bp, Artificial
  CRISPR gRNA sequence
acctgtaatcccagctactt

SEQ ID NO: 103823 - DNA, 20 bp, Artificial
  CRISPR gRNA sequence
cctgtaatcccagctacttg

SEQ ID NO: 103824 - DNA, 20 bp, Artificial
  CRISPR gRNA sequence
ctgtaatcccagctacttgg

SEQ ID NO: 103825 - DNA, 20 bp, Artificial
  CRISPR gRNA sequence
tgtaatcccagctacttggg

SEQ ID NO: 103826 - DNA, 20 bp, Artificial
  CRISPR gRNA sequence
tcccagctacttggggggtt

SEQ ID NO: 103827 - DNA, 20 bp, Artificial
  CRISPR gRNA sequence
cccagctacttggggggttg

SEQ ID NO: 103828 - DNA, 20 bp, Artificial
  CRISPR gRNA sequence
tacttggggggttgaggcat

SEQ ID NO: 103829 - DNA, 20 bp, Artificial
  CRISPR gRNA sequence
ggcataagatatcttgaacc

SEQ ID NO: 103830 - DNA, 20 bp, Artificial
  CRISPR gRNA sequence
gcataagatatcttgaaccc

SEQ ID NO: 103831 - DNA, 20 bp, Artificial
  CRISPR gRNA sequence
ataagatatcttgaacccag

SEQ ID NO: 103832 - DNA, 20 bp, Artificial
  CRISPR gRNA sequence
taagatatcttgaacccagg

SEQ ID NO: 103833 - DNA, 20 bp, Artificial
  CRISPR gRNA sequence
gatatcttgaacccaggagg

SEQ ID NO: 103834 - DNA, 20 bp, Artificial
  CRISPR gRNA sequence
tatcttgaacccaggaggcg

SEQ ID NO: 103835 - DNA, 20 bp, Artificial
  CRISPR gRNA sequence
atcttgaacccaggaggcgg

SEQ ID NO: 103836 - DNA, 20 bp, Artificial
  CRISPR gRNA sequence
aacccaggaggcggaggttg

SEQ ID NO: 103837 - DNA, 20 bp, Artificial
  CRISPR gRNA sequence
caggaggcggaggttgcagt

SEQ ID NO: 103838 - DNA, 20 bp, Artificial
  CRISPR gRNA sequence
ggcggaggttgcagtaagcc

SEQ ID NO: 103839 - DNA, 20 bp, Artificial
  CRISPR gRNA sequence
aagattgtgccactgcactc

SEQ ID NO: 103840 - DNA, 20 bp, Artificial
  CRISPR gRNA sequence
agattgtgccactgcactcc

SEQ ID NO: 103841 - DNA, 20 bp, Artificial
  CRISPR gRNA sequence
tgtgccactgcactccaggc

SEQ ID NO: 103842 - DNA, 20 bp, Artificial
  CRISPR gRNA sequence
gtgccactgcactccaggct

SEQ ID NO: 103843 - DNA, 20 bp, Artificial
  CRISPR gRNA sequence
ctgcactccaggctgggcac

SEQ ID NO: 103844 - DNA, 20 bp, Artificial
  CRISPR gRNA sequence
gcactccaggctgggcacca

SEQ ID NO: 103845 - DNA, 20 bp, Artificial
  CRISPR gRNA sequence
tccaggctgggcaccagagc

SEQ ID NO: 103846 - DNA, 20 bp, Artificial
  CRISPR gRNA sequence
aagattctgtctcaaaaaaa

SEQ ID NO: 103847 - DNA, 20 bp, Artificial
  CRISPR gRNA sequence
attctgtctcaaaaaaaaag

SEQ ID NO: 103848 - DNA, 20 bp, Artificial
  CRISPR gRNA sequence
tctgtctcaaaaaaaaagaa

SEQ ID NO: 103849 - DNA, 20 bp, Artificial
  CRISPR gRNA sequence
aaaaaaaaagaagagattaa

SEQ ID NO: 103850 - DNA, 20 bp, Artificial
  CRISPR gRNA sequence
aagagattaacagaaatatg

SEQ ID NO: 103851 - DNA, 20 bp, Artificial
  CRISPR gRNA sequence
aaatgttacatacaactctg

SEQ ID NO: 103852 - DNA, 20 bp, Artificial
  CRISPR gRNA sequence
gtggcatcatattttaaaat

SEQ ID NO: 103853 - DNA, 20 bp, Artificial
  CRISPR gRNA sequence
aaaattagatatttctcatc

SEQ ID NO: 103854 - DNA, 20 bp, Artificial
  CRISPR gRNA sequence
ttagatatttctcatcgaga

SEQ ID NO: 103855 - DNA, 20 bp, Artificial
  CRISPR gRNA sequence
agatggcaaaaaaaaacaaa

SEQ ID NO: 103856 - DNA, 20 bp, Artificial
  CRISPR gRNA sequence
aaagtcattatatccactgt

SEQ ID NO: 103857 - DNA, 20 bp, Artificial
  CRISPR gRNA sequence
aagtcattatatccactgtt

SEQ ID NO: 103858 - DNA, 20 bp, Artificial
  CRISPR gRNA sequence
cattatatccactgttagga

SEQ ID NO: 103859 - DNA, 20 bp, Artificial
  CRISPR gRNA sequence
atccactgttaggatggatg

SEQ ID NO: 103860 - DNA, 20 bp, Artificial
  CRISPR gRNA sequence
ccactgttaggatggatgtg

SEQ ID NO: 103861 - DNA, 20 bp, Artificial
  CRISPR gRNA sequence
ttaggatggatgtggagaaa

SEQ ID NO: 103862 - DNA, 20 bp, Artificial
  CRISPR gRNA sequence
aaagaattaatcattatttt

SEQ ID NO: 103863 - DNA, 20 bp, Artificial
  CRISPR gRNA sequence
tttttggtaatttaaaactg

SEQ ID NO: 103864 - DNA, 20 bp, Artificial
  CRISPR gRNA sequence
tttggtaatttaaaactgta

SEQ ID NO: 103865 - DNA, 20 bp, Artificial
  CRISPR gRNA sequence
ttaaaactgtagagttattt

SEQ ID NO: 103866 - DNA, 20 bp, Artificial
  CRISPR gRNA sequence
aactgtagagttattttgga

SEQ ID NO: 103867 - DNA, 20 bp, Artificial
  CRISPR gRNA sequence
actgtagagttattttggaa

SEQ ID NO: 103868 - DNA, 20 bp, Artificial
  CRISPR gRNA sequence
gttaaatacaatgaatattt

SEQ ID NO: 103869 - DNA, 20 bp, Artificial
  CRISPR gRNA sequence
aatacaatgaatatttgagc

SEQ ID NO: 103870 - DNA, 20 bp, Artificial
  CRISPR gRNA sequence
acaatgaatatttgagctag

SEQ ID NO: 103871 - DNA, 20 bp, Artificial
  CRISPR gRNA sequence
gagctagcagtcccacttct

SEQ ID NO: 103872 - DNA, 20 bp, Artificial
  CRISPR gRNA sequence
acttctgagaatctgtccta

SEQ ID NO: 103873 - DNA, 20 bp, Artificial
  CRISPR gRNA sequence
cttctgagaatctgtcctat

SEQ ID NO: 103874 - DNA, 20 bp, Artificial
  CRISPR gRNA sequence
ctgagaatctgtcctatagg

SEQ ID NO: 103875 - DNA, 20 bp, Artificial
  CRISPR gRNA sequence
aatctgtcctataggaagaa

SEQ ID NO: 103876 - DNA, 20 bp, Artificial
  CRISPR gRNA sequence
tataggaagaaaagcatcaa

SEQ ID NO: 103877 - DNA, 20 bp, Artificial
  CRISPR gRNA sequence
aggaagaaaagcatcaatag

SEQ ID NO: 103878 - DNA, 20 bp, Artificial
  CRISPR gRNA sequence
ggaagaaaagcatcaatagt

SEQ ID NO: 103879 - DNA, 20 bp, Artificial
  CRISPR gRNA sequence
gaagaaaagcatcaatagta

SEQ ID NO: 103880 - DNA, 20 bp, Artificial
  CRISPR gRNA sequence
aagaaaagcatcaatagtag

SEQ ID NO: 103881 - DNA, 20 bp, Artificial
  CRISPR gRNA sequence
agaaaagcatcaatagtagg

SEQ ID NO: 103882 - DNA, 20 bp, Artificial
  CRISPR gRNA sequence
aatagtagggggaaattaca

SEQ ID NO: 103883 - DNA, 20 bp, Artificial
  CRISPR gRNA sequence
aattacaaagacacttttca

SEQ ID NO: 103884 - DNA, 20 bp, Artificial
  CRISPR gRNA sequence
cacttttcatagcattgtac

SEQ ID NO: 103885 - DNA, 20 bp, Artificial
  CRISPR gRNA sequence
aaaaaataaaattgcaatct

SEQ ID NO: 103886 - DNA, 20 bp, Artificial
  CRISPR gRNA sequence
caatctgagtgtccattaat

SEQ ID NO: 103887 - DNA, 20 bp, Artificial
  CRISPR gRNA sequence
gagtgtccattaataagaat

SEQ ID NO: 103888 - DNA, 20 bp, Artificial
  CRISPR gRNA sequence
agtgtccattaataagaata

SEQ ID NO: 103889 - DNA, 20 bp, Artificial
  CRISPR gRNA sequence
cattaataagaataaggaaa

SEQ ID NO: 103890 - DNA, 20 bp, Artificial
  CRISPR gRNA sequence
aataagaataaggaaatggt

SEQ ID NO: 103891 - DNA, 20 bp, Artificial
  CRISPR gRNA sequence
aataaatcataatatattca

SEQ ID NO: 103892 - DNA, 20 bp, Artificial
  CRISPR gRNA sequence
ataaatcataatatattcat

SEQ ID NO: 103893 - DNA, 20 bp, Artificial
  CRISPR gRNA sequence
taaatcataatatattcata

SEQ ID NO: 103894 - DNA, 20 bp, Artificial
  CRISPR gRNA sequence
gaatattgcatcatcattaa

SEQ ID NO: 103895 - DNA, 20 bp, Artificial
  CRISPR gRNA sequence
aaagaaatgaactgttgact

SEQ ID NO: 103896 - DNA, 20 bp, Artificial
  CRISPR gRNA sequence
aagaaatgaactgttgactt

SEQ ID NO: 103897 - DNA, 20 bp, Artificial
  CRISPR gRNA sequence
agaaatgaactgttgacttg

SEQ ID NO: 103898 - DNA, 20 bp, Artificial
  CRISPR gRNA sequence
aatgaactgttgacttgggg

SEQ ID NO: 103899 - DNA, 20 bp, Artificial
  CRISPR gRNA sequence
atgaactgttgacttggggt

SEQ ID NO: 103900 - DNA, 20 bp, Artificial
  CRISPR gRNA sequence
ggttaatattgaaatatttt

SEQ ID NO: 103901 - DNA, 20 bp, Artificial
  CRISPR gRNA sequence
taatattgaaatatttttag

SEQ ID NO: 103902 - DNA, 20 bp, Artificial
  CRISPR gRNA sequence
tttttagtggaaataatttg

SEQ ID NO: 103903 - DNA, 20 bp, Artificial
  CRISPR gRNA sequence
tttagtggaaataatttgca

SEQ ID NO: 103904 - DNA, 20 bp, Artificial
  CRISPR gRNA sequence
ggaaataatttgcagagaaa

SEQ ID NO: 103905 - DNA, 20 bp, Artificial
  CRISPR gRNA sequence
attcataaccaaccccccat

SEQ ID NO: 103906 - DNA, 20 bp, Artificial
  CRISPR gRNA sequence
cccccatgagtatatgttta

SEQ ID NO: 103907 - DNA, 20 bp, Artificial
  CRISPR gRNA sequence
tgagtatatgtttatagtca

SEQ ID NO: 103908 - DNA, 20 bp, Artificial
  CRISPR gRNA sequence
atatgtttatagtcatggaa

SEQ ID NO: 103909 - DNA, 20 bp, Artificial
  CRISPR gRNA sequence
atgtttatagtcatggaaaa

SEQ ID NO: 103910 - DNA, 20 bp, Artificial
  CRISPR gRNA sequence
gtttatagtcatggaaaaga

SEQ ID NO: 103911 - DNA, 20 bp, Artificial
  CRISPR gRNA sequence
agtcatggaaaagagagtat

SEQ ID NO: 103912 - DNA, 20 bp, Artificial
  CRISPR gRNA sequence
agagagtatgagataactat

SEQ ID NO: 103913 - DNA, 20 bp, Artificial
  CRISPR gRNA sequence
aaatgtttatattgtttcaa

SEQ ID NO: 103914 - DNA, 20 bp, Artificial
  CRISPR gRNA sequence
ttatattgtttcaacagtta

SEQ ID NO: 103915 - DNA, 20 bp, Artificial
  CRISPR gRNA sequence
tattgtttcaacagttacag

SEQ ID NO: 103916 - DNA, 20 bp, Artificial
  CRISPR gRNA sequence
cagcagtcatattaatgtct

SEQ ID NO: 103917 - DNA, 20 bp, Artificial
  CRISPR gRNA sequence
atattaatgtcttagttttc

SEQ ID NO: 103918 - DNA, 20 bp, Artificial
  CRISPR gRNA sequence
attaatgtcttagttttctg

SEQ ID NO: 103919 - DNA, 20 bp, Artificial
  CRISPR gRNA sequence
ttaatgtcttagttttctgg

SEQ ID NO: 103920 - DNA, 20 bp, Artificial
  CRISPR gRNA sequence
ttagttttctggaggaattt

SEQ ID NO: 103921 - DNA, 20 bp, Artificial
  CRISPR gRNA sequence
ggaggaatttaagttgaaaa

SEQ ID NO: 103922 - DNA, 20 bp, Artificial
  CRISPR gRNA sequence
ggaatttaagttgaaaaaag

SEQ ID NO: 103923 - DNA, 20 bp, Artificial
  CRISPR gRNA sequence
gtgtttttatgcataatttt

SEQ ID NO: 103924 - DNA, 20 bp, Artificial
  CRISPR gRNA sequence
tgtttttatgcataattttt

SEQ ID NO: 103925 - DNA, 20 bp, Artificial
  CRISPR gRNA sequence
gcataattgtaccatgcatg

SEQ ID NO: 103926 - DNA, 20 bp, Artificial
  CRISPR gRNA sequence
cataattgtaccatgcatgt

SEQ ID NO: 103927 - DNA, 20 bp, Artificial
  CRISPR gRNA sequence
ataattgtaccatgcatgtg

SEQ ID NO: 103928 - DNA, 20 bp, Artificial
  CRISPR gRNA sequence
tttaattctttcataatgtt

SEQ ID NO: 103929 - DNA, 20 bp, Artificial
  CRISPR gRNA sequence
gttcagtcaacttgatgaat

SEQ ID NO: 103930 - DNA, 20 bp, Artificial
  CRISPR gRNA sequence
aatttctaatttataaaata

SEQ ID NO: 103931 - DNA, 20 bp, Artificial
  CRISPR gRNA sequence
ctaatttataaaatatagtt

SEQ ID NO: 103932 - DNA, 20 bp, Artificial
  CRISPR gRNA sequence
taatttataaaatatagtta

SEQ ID NO: 103933 - DNA, 20 bp, Artificial
  CRISPR gRNA sequence
taaaatatagttaaggattt

SEQ ID NO: 103934 - DNA, 20 bp, Artificial
  CRISPR gRNA sequence
ttggttttcatttgcctttg

SEQ ID NO: 103935 - DNA, 20 bp, Artificial
  CRISPR gRNA sequence
tggttttcatttgcctttgt

SEQ ID NO: 103936 - DNA, 20 bp, Artificial
  CRISPR gRNA sequence
tgcctttgtaggtaaacatt

SEQ ID NO: 103937 - DNA, 20 bp, Artificial
  CRISPR gRNA sequence
gcctttgtaggtaaacattt

SEQ ID NO: 103938 - DNA, 20 bp, Artificial
  CRISPR gRNA sequence
aggtaaacatttgggcacga

SEQ ID NO: 103939 - DNA, 20 bp, Artificial
  CRISPR gRNA sequence
ttatttttcaactgaattct

SEQ ID NO: 103940 - DNA, 20 bp, Artificial
  CRISPR gRNA sequence
tatttttcaactgaattctc

SEQ ID NO: 103941 - DNA, 20 bp, Artificial
  CRISPR gRNA sequence
aattctcaggataatttctt

SEQ ID NO: 103942 - DNA, 20 bp, Artificial
  CRISPR gRNA sequence
tcaggataatttctttggat

SEQ ID NO: 103943 - DNA, 20 bp, Artificial
  CRISPR gRNA sequence
caggataatttctttggatt

SEQ ID NO: 103944 - DNA, 20 bp, Artificial
  CRISPR gRNA sequence
aggataatttctttggattg

SEQ ID NO: 103945 - DNA, 20 bp, Artificial
  CRISPR gRNA sequence
tctttggattggggattgct

SEQ ID NO: 103946 - DNA, 20 bp, Artificial
  CRISPR gRNA sequence
ctttggattggggattgctt

SEQ ID NO: 103947 - DNA, 20 bp, Artificial
  CRISPR gRNA sequence
gattggggattgcttgggta

SEQ ID NO: 103948 - DNA, 20 bp, Artificial
  CRISPR gRNA sequence
attggggattgcttgggtaa

SEQ ID NO: 103949 - DNA, 20 bp, Artificial
  CRISPR gRNA sequence
ttggggattgcttgggtaaa

SEQ ID NO: 103950 - DNA, 20 bp, Artificial
  CRISPR gRNA sequence
ggattgcttgggtaaagggt

SEQ ID NO: 103951 - DNA, 20 bp, Artificial
  CRISPR gRNA sequence
attgcttgggtaaagggtaa

SEQ ID NO: 103952 - DNA, 20 bp, Artificial
  CRISPR gRNA sequence
taaagggtaagagtatattt

SEQ ID NO: 103953 - DNA, 20 bp, Artificial
  CRISPR gRNA sequence
aagagtatatttgagcccac

SEQ ID NO: 103954 - DNA, 20 bp, Artificial
  CRISPR gRNA sequence
cccactggcatatttttgcc

SEQ ID NO: 103955 - DNA, 20 bp, Artificial
  CRISPR gRNA sequence
ctggcatatttttgccaaga

SEQ ID NO: 103956 - DNA, 20 bp, Artificial
  CRISPR gRNA sequence
tgccaagatagaattgtact

SEQ ID NO: 103957 - DNA, 20 bp, Artificial
  CRISPR gRNA sequence
gccaagatagaattgtactt

SEQ ID NO: 103958 - DNA, 20 bp, Artificial
  CRISPR gRNA sequence
attgtacttgggattaaaaa

SEQ ID NO: 103959 - DNA, 20 bp, Artificial
  CRISPR gRNA sequence
ttctctttgcataaatatat

SEQ ID NO: 103960 - DNA, 20 bp, Artificial
  CRISPR gRNA sequence
tctctttgcataaatatatg

SEQ ID NO: 103961 - DNA, 20 bp, Artificial
  CRISPR gRNA sequence
tgaggctttaaatatctttt

SEQ ID NO: 103962 - DNA, 20 bp, Artificial
  CRISPR gRNA sequence
ttctctctttgcttcctctc

SEQ ID NO: 103963 - DNA, 20 bp, Artificial
  CRISPR gRNA sequence
gctgcgccttctccactgtt

SEQ ID NO: 103964 - DNA, 20 bp, Artificial
  CRISPR gRNA sequence
gcgccttctccactgttgag

SEQ ID NO: 103965 - DNA, 20 bp, Artificial
  CRISPR gRNA sequence
gccttctccactgttgagta

SEQ ID NO: 103966 - DNA, 20 bp, Artificial
  CRISPR gRNA sequence
actgttgagtagagacaatg

SEQ ID NO: 103967 - DNA, 20 bp, Artificial
  CRISPR gRNA sequence
tgagtagagacaatgtggta

SEQ ID NO: 103968 - DNA, 20 bp, Artificial
  CRISPR gRNA sequence
tagagacaatgtggtatagt

SEQ ID NO: 103969 - DNA, 20 bp, Artificial
  CRISPR gRNA sequence
agagacaatgtggtatagtt

SEQ ID NO: 103970 - DNA, 20 bp, Artificial
  CRISPR gRNA sequence
caatgtggtatagttaggaa

SEQ ID NO: 103971 - DNA, 20 bp, Artificial
  CRISPR gRNA sequence
agttaggaacagtatactgt

SEQ ID NO: 103972 - DNA, 20 bp, Artificial
  CRISPR gRNA sequence
ggaacagtatactgtgagtg

SEQ ID NO: 103973 - DNA, 20 bp, Artificial
  CRISPR gRNA sequence
acagtatactgtgagtgtag

SEQ ID NO: 103974 - DNA, 20 bp, Artificial
  CRISPR gRNA sequence
tactgtgagtgtagtggtcc

SEQ ID NO: 103975 - DNA, 20 bp, Artificial
  CRISPR gRNA sequence
gtggtccaagctttcattac

SEQ ID NO: 103976 - DNA, 20 bp, Artificial
  CRISPR gRNA sequence
tggtccaagctttcattacc

SEQ ID NO: 103977 - DNA, 20 bp, Artificial
  CRISPR gRNA sequence
taccaggtctgccattaaat

SEQ ID NO: 103978 - DNA, 20 bp, Artificial
  CRISPR gRNA sequence
ttaaataagcattctgatct

SEQ ID NO: 103979 - DNA, 20 bp, Artificial
  CRISPR gRNA sequence
taagcattctgatcttggcc

SEQ ID NO: 103980 - DNA, 20 bp, Artificial
  CRISPR gRNA sequence
tggccaagttatttaattgt

SEQ ID NO: 103981 - DNA, 20 bp, Artificial
  CRISPR gRNA sequence
tccaaaaataaaatttatat

SEQ ID NO: 103982 - DNA, 20 bp, Artificial
  CRISPR gRNA sequence
aatttatatgagatgatatc

SEQ ID NO: 103983 - DNA, 20 bp, Artificial
  CRISPR gRNA sequence
atttatatgagatgatatct

SEQ ID NO: 103984 - DNA, 20 bp, Artificial
  CRISPR gRNA sequence
tttatatgagatgatatcta

SEQ ID NO: 103985 - DNA, 20 bp, Artificial
  CRISPR gRNA sequence
atgatatctagggttcattc

SEQ ID NO: 103986 - DNA, 20 bp, Artificial
  CRISPR gRNA sequence
tctaaattctgtgattttta

SEQ ID NO: 103987 - DNA, 20 bp, Artificial
  CRISPR gRNA sequence
ctaaattctgtgatttttat

SEQ ID NO: 103988 - DNA, 20 bp, Artificial
  CRISPR gRNA sequence
taaattctgtgatttttatg

SEQ ID NO: 103989 - DNA, 20 bp, Artificial
  CRISPR gRNA sequence
atggggttttattttgctat

SEQ ID NO: 103990 - DNA, 20 bp, Artificial
  CRISPR gRNA sequence
tggggttttattttgctata

SEQ ID NO: 103991 - DNA, 20 bp, Artificial
  CRISPR gRNA sequence
tgctataaggaaccttcaaa

SEQ ID NO: 103992 - DNA, 20 bp, Artificial
  CRISPR gRNA sequence
atagttatttccctgcttcc

SEQ ID NO: 103993 - DNA, 20 bp, Artificial
  CRISPR gRNA sequence
gttatttccctgcttccaag

SEQ ID NO: 103994 - DNA, 20 bp, Artificial
  CRISPR gRNA sequence
ttatttccctgcttccaagt

SEQ ID NO: 103995 - DNA, 20 bp, Artificial
  CRISPR gRNA sequence
tatttccctgcttccaagta

SEQ ID NO: 103996 - DNA, 20 bp, Artificial
  CRISPR gRNA sequence
aagtagggctataactaacc

SEQ ID NO: 103997 - DNA, 20 bp, Artificial
  CRISPR gRNA sequence
tatattctgttacgtaaata

SEQ ID NO: 103998 - DNA, 20 bp, Artificial
  CRISPR gRNA sequence
gttacgtaaataaagctctc

SEQ ID NO: 103999 - DNA, 20 bp, Artificial
  CRISPR gRNA sequence
ttacgtaaataaagctctct

SEQ ID NO: 104000 - DNA, 20 bp, Artificial
  CRISPR gRNA sequence
gtaaataaagctctctaggt

SEQ ID NO: 104001 - DNA, 20 bp, Artificial
  CRISPR gRNA sequence
gctctctaggtgagattcca

SEQ ID NO: 104002 - DNA, 20 bp, Artificial
  CRISPR gRNA sequence
tagcctcccttacaatactt

SEQ ID NO: 104003 - DNA, 20 bp, Artificial
  CRISPR gRNA sequence
agcctcccttacaatactta

SEQ ID NO: 104004 - DNA, 20 bp, Artificial
  CRISPR gRNA sequence
aggctttaatcccctttgta

SEQ ID NO: 104005 - DNA, 20 bp, Artificial
  CRISPR gRNA sequence
ggctttaatcccctttgtat

SEQ ID NO: 104006 - DNA, 20 bp, Artificial
  CRISPR gRNA sequence
ctttaatcccctttgtatag

SEQ ID NO: 104007 - DNA, 20 bp, Artificial
  CRISPR gRNA sequence
ataggagttttttttctcat

SEQ ID NO: 104008 - DNA, 20 bp, Artificial
  CRISPR gRNA sequence
ttttttttctcattagtgtt

SEQ ID NO: 104009 - DNA, 20 bp, Artificial
  CRISPR gRNA sequence
tttttctcattagtgttgag

SEQ ID NO: 104010 - DNA, 20 bp, Artificial
  CRISPR gRNA sequence
tgttgagtagccatttttta

SEQ ID NO: 104011 - DNA, 20 bp, Artificial
  CRISPR gRNA sequence
tgagtagccattttttaaag

SEQ ID NO: 104012 - DNA, 20 bp, Artificial
  CRISPR gRNA sequence
ttgaattgtattctctattt

SEQ ID NO: 104013 - DNA, 20 bp, Artificial
  CRISPR gRNA sequence
tattctctattttagaatcc

SEQ ID NO: 104014 - DNA, 20 bp, Artificial
  CRISPR gRNA sequence
tctattttagaatcctagta

SEQ ID NO: 104015 - DNA, 20 bp, Artificial
  CRISPR gRNA sequence
tagtaaagcttgcaccctct

SEQ ID NO: 104016 - DNA, 20 bp, Artificial
  CRISPR gRNA sequence
agcttgcaccctctaagaaa

SEQ ID NO: 104017 - DNA, 20 bp, Artificial
  CRISPR gRNA sequence
ttgcaccctctaagaaaaag

SEQ ID NO: 104018 - DNA, 20 bp, Artificial
  CRISPR gRNA sequence
gcaccctctaagaaaaagta

SEQ ID NO: 104019 - DNA, 20 bp, Artificial
  CRISPR gRNA sequence
taagaaaaagtagagatgtc

SEQ ID NO: 104020 - DNA, 20 bp, Artificial
  CRISPR gRNA sequence
aaaaattctgcatataattt

SEQ ID NO: 104021 - DNA, 20 bp, Artificial
  CRISPR gRNA sequence
taattttagattaaaatcct

SEQ ID NO: 104022 - DNA, 20 bp, Artificial
  CRISPR gRNA sequence
tagattaaaatccttggcct

SEQ ID NO: 104023 - DNA, 20 bp, Artificial
  CRISPR gRNA sequence
ttaaaatccttggcctgaga

SEQ ID NO: 104024 - DNA, 20 bp, Artificial
  CRISPR gRNA sequence
ccttggcctgagaaagatac

SEQ ID NO: 104025 - DNA, 20 bp, Artificial
  CRISPR gRNA sequence
cctgagaaagatactggaac

SEQ ID NO: 104026 - DNA, 20 bp, Artificial
  CRISPR gRNA sequence
tgagaaagatactggaacca

SEQ ID NO: 104027 - DNA, 20 bp, Artificial
  CRISPR gRNA sequence
agaaagatactggaaccaga

SEQ ID NO: 104028 - DNA, 20 bp, Artificial
  CRISPR gRNA sequence
agatactggaaccagagaga

SEQ ID NO: 104029 - DNA, 20 bp, Artificial
  CRISPR gRNA sequence
ctggaaccagagagacagcc

SEQ ID NO: 104030 - DNA, 20 bp, Artificial
  CRISPR gRNA sequence
ccagagagacagccaagaaa

SEQ ID NO: 104031 - DNA, 20 bp, Artificial
  CRISPR gRNA sequence
agagacagccaagaaataga

SEQ ID NO: 104032 - DNA, 20 bp, Artificial
  CRISPR gRNA sequence
gacagccaagaaatagatag

SEQ ID NO: 104033 - DNA, 20 bp, Artificial
  CRISPR gRNA sequence
agaaatagatagaagaatat

SEQ ID NO: 104034 - DNA, 20 bp, Artificial
  CRISPR gRNA sequence
aatagatagaagaatattgg

SEQ ID NO: 104035 - DNA, 20 bp, Artificial
  CRISPR gRNA sequence
gatagaagaatattggaagt

SEQ ID NO: 104036 - DNA, 20 bp, Artificial
  CRISPR gRNA sequence
tggaagttggcatataataa

SEQ ID NO: 104037 - DNA, 20 bp, Artificial
  CRISPR gRNA sequence
aagttggcatataataaaag

SEQ ID NO: 104038 - DNA, 20 bp, Artificial
  CRISPR gRNA sequence
gtggtataaacatatcaatg

SEQ ID NO: 104039 - DNA, 20 bp, Artificial
  CRISPR gRNA sequence
taaacatatcaatgaagaaa

SEQ ID NO: 104040 - DNA, 20 bp, Artificial
  CRISPR gRNA sequence
tatcaatgaagaaatggctg

SEQ ID NO: 104041 - DNA, 20 bp, Artificial
  CRISPR gRNA sequence
gaaatggctgaagaatgata

SEQ ID NO: 104042 - DNA, 20 bp, Artificial
  CRISPR gRNA sequence
ggctgaagaatgatacagaa

SEQ ID NO: 104043 - DNA, 20 bp, Artificial
  CRISPR gRNA sequence
gtattttaaaaaatatttgc

SEQ ID NO: 104044 - DNA, 20 bp, Artificial
  CRISPR gRNA sequence
tattttaaaaaatatttgct

SEQ ID NO: 104045 - DNA, 20 bp, Artificial
  CRISPR gRNA sequence
tttaaaaaatatttgctagg

SEQ ID NO: 104046 - DNA, 20 bp, Artificial
  CRISPR gRNA sequence
aatatttgctaggtggatta

SEQ ID NO: 104047 - DNA, 20 bp, Artificial
  CRISPR gRNA sequence
gtggattaaagatctaaatg

SEQ ID NO: 104048 - DNA, 20 bp, Artificial
  CRISPR gRNA sequence
ttaaagatctaaatgtagaa

SEQ ID NO: 104049 - DNA, 20 bp, Artificial
  CRISPR gRNA sequence
taaatgtagaaaagtaaact

SEQ ID NO: 104050 - DNA, 20 bp, Artificial
  CRISPR gRNA sequence
agtaaacttggaaaattcaa

SEQ ID NO: 104051 - DNA, 20 bp, Artificial
  CRISPR gRNA sequence
gaaaattcaaaagaaaatat

SEQ ID NO: 104052 - DNA, 20 bp, Artificial
  CRISPR gRNA sequence
atataagaatttttatgcta

SEQ ID NO: 104053 - DNA, 20 bp, Artificial
  CRISPR gRNA sequence
ataagaatttttatgctata

SEQ ID NO: 104054 - DNA, 20 bp, Artificial
  CRISPR gRNA sequence
agaatttttatgctatagag

SEQ ID NO: 104055 - DNA, 20 bp, Artificial
  CRISPR gRNA sequence
gaatttttatgctatagaga

SEQ ID NO: 104056 - DNA, 20 bp, Artificial
  CRISPR gRNA sequence
cattgaaatacatcaaataa

SEQ ID NO: 104057 - DNA, 20 bp, Artificial
  CRISPR gRNA sequence
tacatcaaataaaagtaaac

SEQ ID NO: 104058 - DNA, 20 bp, Artificial
  CRISPR gRNA sequence
acatcaaataaaagtaaaca

SEQ ID NO: 104059 - DNA, 20 bp, Artificial
  CRISPR gRNA sequence
aagtaaacaaggtgaaaact

SEQ ID NO: 104060 - DNA, 20 bp, Artificial
  CRISPR gRNA sequence
aacaaggtgaaaacttggaa

SEQ ID NO: 104061 - DNA, 20 bp, Artificial
  CRISPR gRNA sequence
tatttttaatacatacaacc

SEQ ID NO: 104062 - DNA, 20 bp, Artificial
  CRISPR gRNA sequence
catacaaccgagtttgtatt

SEQ ID NO: 104063 - DNA, 20 bp, Artificial
  CRISPR gRNA sequence
tttatgtatttatacaaaaa

SEQ ID NO: 104064 - DNA, 20 bp, Artificial
  CRISPR gRNA sequence
ttatgtatttatacaaaaat

SEQ ID NO: 104065 - DNA, 20 bp, Artificial
  CRISPR gRNA sequence
tttatacaaaaataggaaaa

SEQ ID NO: 104066 - DNA, 20 bp, Artificial
  CRISPR gRNA sequence
ttatacaaaaataggaaaat

SEQ ID NO: 104067 - DNA, 20 bp, Artificial
  CRISPR gRNA sequence
caaaaataggaaaatgggcg

SEQ ID NO: 104068 - DNA, 20 bp, Artificial
  CRISPR gRNA sequence
aaatgggcgaagaatatgaa

SEQ ID NO: 104069 - DNA, 20 bp, Artificial
  CRISPR gRNA sequence
gggcgaagaatatgaataga

SEQ ID NO: 104070 - DNA, 20 bp, Artificial
  CRISPR gRNA sequence
cgaagaatatgaatagatgg

SEQ ID NO: 104071 - DNA, 20 bp, Artificial
  CRISPR gRNA sequence
aagaatatgaatagatggaa

SEQ ID NO: 104072 - DNA, 20 bp, Artificial
  CRISPR gRNA sequence
agaatatgaatagatggaag

SEQ ID NO: 104073 - DNA, 20 bp, Artificial
  CRISPR gRNA sequence
gatggaagaggaaatcctaa

SEQ ID NO: 104074 - DNA, 20 bp, Artificial
  CRISPR gRNA sequence
cctaacagccaatataaact

SEQ ID NO: 104075 - DNA, 20 bp, Artificial
  CRISPR gRNA sequence
ccaatataaacttagaaatg

SEQ ID NO: 104076 - DNA, 20 bp, Artificial
  CRISPR gRNA sequence
tataaacttagaaatgaagt

SEQ ID NO: 104077 - DNA, 20 bp, Artificial
  CRISPR gRNA sequence
atgaagttggttcacataac

SEQ ID NO: 104078 - DNA, 20 bp, Artificial
  CRISPR gRNA sequence
actttctgaatgccaattat

SEQ ID NO: 104079 - DNA, 20 bp, Artificial
  CRISPR gRNA sequence
ctgaatgccaattatgagct

SEQ ID NO: 104080 - DNA, 20 bp, Artificial
  CRISPR gRNA sequence
ccaattatgagctgagtatt

SEQ ID NO: 104081 - DNA, 20 bp, Artificial
  CRISPR gRNA sequence
agtatttggaaaaaataatt

SEQ ID NO: 104082 - DNA, 20 bp, Artificial
  CRISPR gRNA sequence
atttggaaaaaataattcag

SEQ ID NO: 104083 - DNA, 20 bp, Artificial
  CRISPR gRNA sequence
aaaaaataattcagaagacc

SEQ ID NO: 104084 - DNA, 20 bp, Artificial
  CRISPR gRNA sequence
aaaaataattcagaagacct

SEQ ID NO: 104085 - DNA, 20 bp, Artificial
  CRISPR gRNA sequence
aggcaatctatcccctaaca

SEQ ID NO: 104086 - DNA, 20 bp, Artificial
  CRISPR gRNA sequence
caatctatcccctaacaaag

SEQ ID NO: 104087 - DNA, 20 bp, Artificial
  CRISPR gRNA sequence
aatctatcccctaacaaagt

SEQ ID NO: 104088 - DNA, 20 bp, Artificial
  CRISPR gRNA sequence
taggatccatgaatgtctct

SEQ ID NO: 104089 - DNA, 20 bp, Artificial
  CRISPR gRNA sequence
ccatgaatgtctctaagaca

SEQ ID NO: 104090 - DNA, 20 bp, Artificial
  CRISPR gRNA sequence
ttttttcaccttccttccat

SEQ ID NO: 104091 - DNA, 20 bp, Artificial
  CRISPR gRNA sequence
tttcaccttccttccatcag

SEQ ID NO: 104092 - DNA, 20 bp, Artificial
  CRISPR gRNA sequence
tcagtagtcctttttcctat

SEQ ID NO: 104093 - DNA, 20 bp, Artificial
  CRISPR gRNA sequence
tagtcctttttcctatcagc

SEQ ID NO: 104094 - DNA, 20 bp, Artificial
  CRISPR gRNA sequence
tcctttttcctatcagctgg

SEQ ID NO: 104095 - DNA, 20 bp, Artificial
  CRISPR gRNA sequence
ggtagactttgtgataactt

SEQ ID NO: 104096 - DNA, 20 bp, Artificial
  CRISPR gRNA sequence
gtagactttgtgataactta

SEQ ID NO: 104097 - DNA, 20 bp, Artificial
  CRISPR gRNA sequence
tttgtgataacttaaggttc

SEQ ID NO: 104098 - DNA, 20 bp, Artificial
  CRISPR gRNA sequence
ttgtgataacttaaggttct

SEQ ID NO: 104099 - DNA, 20 bp, Artificial
  CRISPR gRNA sequence
tctaggcatgttcttctttc

SEQ ID NO: 104100 - DNA, 20 bp, Artificial
  CRISPR gRNA sequence
catgttcttctttccagacc

SEQ ID NO: 104101 - DNA, 20 bp, Artificial
  CRISPR gRNA sequence
atgttcttctttccagacca

SEQ ID NO: 104102 - DNA, 20 bp, Artificial
  CRISPR gRNA sequence
ttcttctttccagaccaagg

SEQ ID NO: 104103 - DNA, 20 bp, Artificial
  CRISPR gRNA sequence
ttccagaccaaggtggtccc

SEQ ID NO: 104104 - DNA, 20 bp, Artificial
  CRISPR gRNA sequence
gtggtcccaagttgaaatta

SEQ ID NO: 104105 - DNA, 20 bp, Artificial
  CRISPR gRNA sequence
tcccaagttgaaattatgga

SEQ ID NO: 104106 - DNA, 20 bp, Artificial
  CRISPR gRNA sequence
aagttgaaattatggatgga

SEQ ID NO: 104107 - DNA, 20 bp, Artificial
  CRISPR gRNA sequence
attatggatggaaagtgacc

SEQ ID NO: 104108 - DNA, 20 bp, Artificial
  CRISPR gRNA sequence
ataaaaatctatctttctga

SEQ ID NO: 104109 - DNA, 20 bp, Artificial
  CRISPR gRNA sequence
ttctgaaagtatcctccttc

SEQ ID NO: 104110 - DNA, 20 bp, Artificial
  CRISPR gRNA sequence
ccagactgccatctatgttg

SEQ ID NO: 104111 - DNA, 20 bp, Artificial
  CRISPR gRNA sequence
aagcaatgctcaaataaaaa

SEQ ID NO: 104112 - DNA, 20 bp, Artificial
  CRISPR gRNA sequence
aaataaaaaaagtttgttga

SEQ ID NO: 104113 - DNA, 20 bp, Artificial
  CRISPR gRNA sequence
aagtttgttgatggaattaa

SEQ ID NO: 104114 - DNA, 20 bp, Artificial
  CRISPR gRNA sequence
gttgatggaattaatggtca

SEQ ID NO: 104115 - DNA, 20 bp, Artificial
  CRISPR gRNA sequence
gatggaattaatggtcaaag

SEQ ID NO: 104116 - DNA, 20 bp, Artificial
  CRISPR gRNA sequence
aattaatggtcaaagaagca

SEQ ID NO: 104117 - DNA, 20 bp, Artificial
  CRISPR gRNA sequence
ttaatggtcaaagaagcaaa

SEQ ID NO: 104118 - DNA, 20 bp, Artificial
  CRISPR gRNA sequence
atggtcaaagaagcaaagag

SEQ ID NO: 104119 - DNA, 20 bp, Artificial
  CRISPR gRNA sequence
tggtcaaagaagcaaagaga

SEQ ID NO: 104120 - DNA, 20 bp, Artificial
  CRISPR gRNA sequence
gaagcaaagagaaggttact

SEQ ID NO: 104121 - DNA, 20 bp, Artificial
  CRISPR gRNA sequence
aagagaaggttacttagtac

SEQ ID NO: 104122 - DNA, 20 bp, Artificial
  CRISPR gRNA sequence
ttagtactagccatgtattc

SEQ ID NO: 104123 - DNA, 20 bp, Artificial
  CRISPR gRNA sequence
agccatgtattctggctttt

SEQ ID NO: 104124 - DNA, 20 bp, Artificial
  CRISPR gRNA sequence
tgtattctggcttttaagtt

SEQ ID NO: 104125 - DNA, 20 bp, Artificial
  CRISPR gRNA sequence
gtattctggcttttaagttt

SEQ ID NO: 104126 - DNA, 20 bp, Artificial
  CRISPR gRNA sequence
attctggcttttaagtttgg

SEQ ID NO: 104127 - DNA, 20 bp, Artificial
  CRISPR gRNA sequence
ttctggcttttaagtttggg

SEQ ID NO: 104128 - DNA, 20 bp, Artificial
  CRISPR gRNA sequence
tattcttgaatataaaatac

SEQ ID NO: 104129 - DNA, 20 bp, Artificial
  CRISPR gRNA sequence
tataaaatacaagacatttt

SEQ ID NO: 104130 - DNA, 20 bp, Artificial
  CRISPR gRNA sequence
atacaagacattttgagcta

SEQ ID NO: 104131 - DNA, 20 bp, Artificial
  CRISPR gRNA sequence
tacaagacattttgagctat

SEQ ID NO: 104132 - DNA, 20 bp, Artificial
  CRISPR gRNA sequence
acaagacattttgagctatg

SEQ ID NO: 104133 - DNA, 20 bp, Artificial
  CRISPR gRNA sequence
tcttttgcacttaaaaaaaa

SEQ ID NO: 104134 - DNA, 20 bp, Artificial
  CRISPR gRNA sequence
ttaaaaaaaaaagtgttcac

SEQ ID NO: 104135 - DNA, 20 bp, Artificial
  CRISPR gRNA sequence
gttcactagttatatgaaaa

SEQ ID NO: 104136 - DNA, 20 bp, Artificial
  CRISPR gRNA sequence
ttcactagttatatgaaaat

SEQ ID NO: 104137 - DNA, 20 bp, Artificial
  CRISPR gRNA sequence
ttttgtacacccaacattta

SEQ ID NO: 104138 - DNA, 20 bp, Artificial
  CRISPR gRNA sequence
tttgtacacccaacatttaa

SEQ ID NO: 104139 - DNA, 20 bp, Artificial
  CRISPR gRNA sequence
ttgtacacccaacatttaaa

SEQ ID NO: 104140 - DNA, 20 bp, Artificial
  CRISPR gRNA sequence
acatttaaagggttgtattg

SEQ ID NO: 104141 - DNA, 20 bp, Artificial
  CRISPR gRNA sequence
agggttgtattgcagttttt

SEQ ID NO: 104142 - DNA, 20 bp, Artificial
  CRISPR gRNA sequence
agttttttagttccaaaatt

SEQ ID NO: 104143 - DNA, 20 bp, Artificial
  CRISPR gRNA sequence
ttttttagttccaaaattta

SEQ ID NO: 104144 - DNA, 20 bp, Artificial
  CRISPR gRNA sequence
aatttagagaaatatttttc

SEQ ID NO: 104145 - DNA, 20 bp, Artificial
  CRISPR gRNA sequence
atatttttcaagcttcttgt

SEQ ID NO: 104146 - DNA, 20 bp, Artificial
  CRISPR gRNA sequence
tatttttcaagcttcttgtc

SEQ ID NO: 104147 - DNA, 20 bp, Artificial
  CRISPR gRNA sequence
ttctgataacactcctaata

SEQ ID NO: 104148 - DNA, 20 bp, Artificial
  CRISPR gRNA sequence
tgataacactcctaataaag

SEQ ID NO: 104149 - DNA, 20 bp, Artificial
  CRISPR gRNA sequence
cactcctaataaagtggcta

SEQ ID NO: 104150 - DNA, 20 bp, Artificial
  CRISPR gRNA sequence
tggctatagccattaaaaaa

SEQ ID NO: 104151 - DNA, 20 bp, Artificial
  CRISPR gRNA sequence
tatagccattaaaaaaaaga

SEQ ID NO: 104152 - DNA, 20 bp, Artificial
  CRISPR gRNA sequence
agccattaaaaaaaagaaag

SEQ ID NO: 104153 - DNA, 20 bp, Artificial
  CRISPR gRNA sequence
attaaaaaaaagaaagaaga

SEQ ID NO: 104154 - DNA, 20 bp, Artificial
  CRISPR gRNA sequence
aaaaagaaagaagatagatt

SEQ ID NO: 104155 - DNA, 20 bp, Artificial
  CRISPR gRNA sequence
agaaagaagatagatttgga

SEQ ID NO: 104156 - DNA, 20 bp, Artificial
  CRISPR gRNA sequence
gctttccataattgctttat

SEQ ID NO: 104157 - DNA, 20 bp, Artificial
  CRISPR gRNA sequence
ctttccataattgctttata

SEQ ID NO: 104158 - DNA, 20 bp, Artificial
  CRISPR gRNA sequence
cataattgctttataaggtt

SEQ ID NO: 104159 - DNA, 20 bp, Artificial
  CRISPR gRNA sequence
aaggtttagctatccaatcc

SEQ ID NO: 104160 - DNA, 20 bp, Artificial
  CRISPR gRNA sequence
aggtttagctatccaatcct

SEQ ID NO: 104161 - DNA, 20 bp, Artificial
  CRISPR gRNA sequence
tatccaatcctaggaccaaa

SEQ ID NO: 104162 - DNA, 20 bp, Artificial
  CRISPR gRNA sequence
atccaatcctaggaccaaat

SEQ ID NO: 104163 - DNA, 20 bp, Artificial
  CRISPR gRNA sequence
ccaatcctaggaccaaatag

SEQ ID NO: 104164 - DNA, 20 bp, Artificial
  CRISPR gRNA sequence
aatttgacaaacattaatga

SEQ ID NO: 104165 - DNA, 20 bp, Artificial
  CRISPR gRNA sequence
ttgacaaacattaatgacag

SEQ ID NO: 104166 - DNA, 20 bp, Artificial
  CRISPR gRNA sequence
caaacattaatgacagtagt

SEQ ID NO: 104167 - DNA, 20 bp, Artificial
  CRISPR gRNA sequence
ttaatgacagtagtgagtat

SEQ ID NO: 104168 - DNA, 20 bp, Artificial
  CRISPR gRNA sequence
cagtagtgagtattggtaat

SEQ ID NO: 104169 - DNA, 20 bp, Artificial
  CRISPR gRNA sequence
tattggtaattggaaactaa

SEQ ID NO: 104170 - DNA, 20 bp, Artificial
  CRISPR gRNA sequence
attggtaattggaaactaat

SEQ ID NO: 104171 - DNA, 20 bp, Artificial
  CRISPR gRNA sequence
tggtaattggaaactaatag

SEQ ID NO: 104172 - DNA, 20 bp, Artificial
  CRISPR gRNA sequence
ggtaattggaaactaatagg

SEQ ID NO: 104173 - DNA, 20 bp, Artificial
  CRISPR gRNA sequence
taccatataacaaattatcc

SEQ ID NO: 104174 - DNA, 20 bp, Artificial
  CRISPR gRNA sequence
catataacaaattatcctag

SEQ ID NO: 104175 - DNA, 20 bp, Artificial
  CRISPR gRNA sequence
taacaaattatcctagaagt

SEQ ID NO: 104176 - DNA, 20 bp, Artificial
  CRISPR gRNA sequence
caaattatcctagaagttag

SEQ ID NO: 104177 - DNA, 20 bp, Artificial
  CRISPR gRNA sequence
agcttaaaacaacaaacatt

SEQ ID NO: 104178 - DNA, 20 bp, Artificial
  CRISPR gRNA sequence
taaaacaacaaacatttggc

SEQ ID NO: 104179 - DNA, 20 bp, Artificial
  CRISPR gRNA sequence
caacaaacatttggccggtg

SEQ ID NO: 104180 - DNA, 20 bp, Artificial
  CRISPR gRNA sequence
caaacatttggccggtgcgg

SEQ ID NO: 104181 - DNA, 20 bp, Artificial
  CRISPR gRNA sequence
gtggcccacacctgtaatcc

SEQ ID NO: 104182 - DNA, 20 bp, Artificial
  CRISPR gRNA sequence
cacctgtaatcccagcactt

SEQ ID NO: 104183 - DNA, 20 bp, Artificial
  CRISPR gRNA sequence
acctgtaatcccagcacttt

SEQ ID NO: 104184 - DNA, 20 bp, Artificial
  CRISPR gRNA sequence
tgtaatcccagcactttggg

SEQ ID NO: 104185 - DNA, 20 bp, Artificial
  CRISPR gRNA sequence
tcccagcactttgggtggcc

SEQ ID NO: 104186 - DNA, 20 bp, Artificial
  CRISPR gRNA sequence
cccagcactttgggtggccg

SEQ ID NO: 104187 - DNA, 20 bp, Artificial
  CRISPR gRNA sequence
agcactttgggtggccgagg

SEQ ID NO: 104188 - DNA, 20 bp, Artificial
  CRISPR gRNA sequence
gcactttgggtggccgaggc

SEQ ID NO: 104189 - DNA, 20 bp, Artificial
  CRISPR gRNA sequence
ctttgggtggccgaggcggg

SEQ ID NO: 104190 - DNA, 20 bp, Artificial
  CRISPR gRNA sequence
ggccgaggcgggtggatcac

SEQ ID NO: 104191 - DNA, 20 bp, Artificial
  CRISPR gRNA sequence
gccgaggcgggtggatcaca

SEQ ID NO: 104192 - DNA, 20 bp, Artificial
  CRISPR gRNA sequence
aggcgggtggatcacaaggt

SEQ ID NO: 104193 - DNA, 20 bp, Artificial
  CRISPR gRNA sequence
ggcgggtggatcacaaggtc

SEQ ID NO: 104194 - DNA, 20 bp, Artificial
  CRISPR gRNA sequence
cgggtggatcacaaggtcag

SEQ ID NO: 104195 - DNA, 20 bp, Artificial
  CRISPR gRNA sequence
gatcacaaggtcaggagatc

SEQ ID NO: 104196 - DNA, 20 bp, Artificial
  CRISPR gRNA sequence
tcaggagatcgagaccatcc

SEQ ID NO: 104197 - DNA, 20 bp, Artificial
  CRISPR gRNA sequence
cgagaccatcctggttaaca

SEQ ID NO: 104198 - DNA, 20 bp, Artificial
  CRISPR gRNA sequence
gaaaccccgtctctactaaa

SEQ ID NO: 104199 - DNA, 20 bp, Artificial
  CRISPR gRNA sequence
aaaaagacaaaaaaaaaatt

SEQ ID NO: 104200 - DNA, 20 bp, Artificial
  CRISPR gRNA sequence
agacaaaaaaaaaattaagc

SEQ ID NO: 104201 - DNA, 20 bp, Artificial
  CRISPR gRNA sequence
gacaaaaaaaaaattaagcc

SEQ ID NO: 104202 - DNA, 20 bp, Artificial
  CRISPR gRNA sequence
aaaaattaagccaggcgtga

SEQ ID NO: 104203 - DNA, 20 bp, Artificial
  CRISPR gRNA sequence
aattaagccaggcgtgatgg

SEQ ID NO: 104204 - DNA, 20 bp, Artificial
  CRISPR gRNA sequence
ggcgtgatggcggacgcctg

SEQ ID NO: 104205 - DNA, 20 bp, Artificial
  CRISPR gRNA sequence
atggcggacgcctgtagtcc

SEQ ID NO: 104206 - DNA, 20 bp, Artificial
  CRISPR gRNA sequence
cgcctgtagtcccagctact

SEQ ID NO: 104207 - DNA, 20 bp, Artificial
  CRISPR gRNA sequence
gcctgtagtcccagctactc

SEQ ID NO: 104208 - DNA, 20 bp, Artificial
  CRISPR gRNA sequence
ctgtagtcccagctactcgg

SEQ ID NO: 104209 - DNA, 20 bp, Artificial
  CRISPR gRNA sequence
tgtagtcccagctactcggg

SEQ ID NO: 104210 - DNA, 20 bp, Artificial
  CRISPR gRNA sequence
tcccagctactcgggaggct

SEQ ID NO: 104211 - DNA, 20 bp, Artificial
  CRISPR gRNA sequence
cccagctactcgggaggctg

SEQ ID NO: 104212 - DNA, 20 bp, Artificial
  CRISPR gRNA sequence
agctactcgggaggctgagg

SEQ ID NO: 104213 - DNA, 20 bp, Artificial
  CRISPR gRNA sequence
gctactcgggaggctgaggc

SEQ ID NO: 104214 - DNA, 20 bp, Artificial
  CRISPR gRNA sequence
tactcgggaggctgaggcag

SEQ ID NO: 104215 - DNA, 20 bp, Artificial
  CRISPR gRNA sequence
gggaggctgaggcaggagaa

SEQ ID NO: 104216 - DNA, 20 bp, Artificial
  CRISPR gRNA sequence
gcaggagaatggcatgaacc

SEQ ID NO: 104217 - DNA, 20 bp, Artificial
  CRISPR gRNA sequence
caggagaatggcatgaaccc

SEQ ID NO: 104218 - DNA, 20 bp, Artificial
  CRISPR gRNA sequence
ggagaatggcatgaacccag

SEQ ID NO: 104219 - DNA, 20 bp, Artificial
  CRISPR gRNA sequence
gagaatggcatgaacccagg

SEQ ID NO: 104220 - DNA, 20 bp, Artificial
  CRISPR gRNA sequence
aatggcatgaacccaggagg

SEQ ID NO: 104221 - DNA, 20 bp, Artificial
  CRISPR gRNA sequence
tggcatgaacccaggaggcg

SEQ ID NO: 104222 - DNA, 20 bp, Artificial
  CRISPR gRNA sequence
aacccaggaggcggagcttg

SEQ ID NO: 104223 - DNA, 20 bp, Artificial
  CRISPR gRNA sequence
caggaggcggagcttgcagt

SEQ ID NO: 104224 - DNA, 20 bp, Artificial
  CRISPR gRNA sequence
ggcggagcttgcagtgagcc

SEQ ID NO: 104225 - DNA, 20 bp, Artificial
  CRISPR gRNA sequence
aagatcacaccactgcactc

SEQ ID NO: 104226 - DNA, 20 bp, Artificial
  CRISPR gRNA sequence
acaccactgcactccagcct

SEQ ID NO: 104227 - DNA, 20 bp, Artificial
  CRISPR gRNA sequence
ctgcactccagcctgagcca

SEQ ID NO: 104228 - DNA, 20 bp, Artificial
  CRISPR gRNA sequence
gcactccagcctgagccaca

SEQ ID NO: 104229 - DNA, 20 bp, Artificial
  CRISPR gRNA sequence
aaaaaaaaaaatttatttta

SEQ ID NO: 104230 - DNA, 20 bp, Artificial
  CRISPR gRNA sequence
atttattttatagtttctgt

SEQ ID NO: 104231 - DNA, 20 bp, Artificial
  CRISPR gRNA sequence
attttatagtttctgtgagt

SEQ ID NO: 104232 - DNA, 20 bp, Artificial
  CRISPR gRNA sequence
ttttatagtttctgtgagtt

SEQ ID NO: 104233 - DNA, 20 bp, Artificial
  CRISPR gRNA sequence
gtgagttaggaatcctgaca

SEQ ID NO: 104234 - DNA, 20 bp, Artificial
  CRISPR gRNA sequence
gaatcctgacacagctgtgt

SEQ ID NO: 104235 - DNA, 20 bp, Artificial
  CRISPR gRNA sequence
cagctgtgttggattctttc

SEQ ID NO: 104236 - DNA, 20 bp, Artificial
  CRISPR gRNA sequence
agctgtgttggattctttca

SEQ ID NO: 104237 - DNA, 20 bp, Artificial
  CRISPR gRNA sequence
gattctttcaaggtcctctc

SEQ ID NO: 104238 - DNA, 20 bp, Artificial
  CRISPR gRNA sequence
attctttcaaggtcctctca

SEQ ID NO: 104239 - DNA, 20 bp, Artificial
  CRISPR gRNA sequence
gtcctctcaaggcccttatc

SEQ ID NO: 104240 - DNA, 20 bp, Artificial
  CRISPR gRNA sequence
tcctctcaaggcccttatca

SEQ ID NO: 104241 - DNA, 20 bp, Artificial
  CRISPR gRNA sequence
cccttatcaaggtgttgtcc

SEQ ID NO: 104242 - DNA, 20 bp, Artificial
  CRISPR gRNA sequence
ccttatcaaggtgttgtcct

SEQ ID NO: 104243 - DNA, 20 bp, Artificial
  CRISPR gRNA sequence
caaggtgttgtcctgggctg

SEQ ID NO: 104244 - DNA, 20 bp, Artificial
  CRISPR gRNA sequence
gggctgcagtcacatttgac

SEQ ID NO: 104245 - DNA, 20 bp, Artificial
  CRISPR gRNA sequence
gctgcagtcacatttgacta

SEQ ID NO: 104246 - DNA, 20 bp, Artificial
  CRISPR gRNA sequence
gcagtcacatttgactagag

SEQ ID NO: 104247 - DNA, 20 bp, Artificial
  CRISPR gRNA sequence
gactagagtagaatacattt

SEQ ID NO: 104248 - DNA, 20 bp, Artificial
  CRISPR gRNA sequence
actagagtagaatacatttt

SEQ ID NO: 104249 - DNA, 20 bp, Artificial
  CRISPR gRNA sequence
ttttctttgtttgttttttt

SEQ ID NO: 104250 - DNA, 20 bp, Artificial
  CRISPR gRNA sequence
ctttgtttgtttttttgaga

SEQ ID NO: 104251 - DNA, 20 bp, Artificial
  CRISPR gRNA sequence
cagttactcgctctgttgcc

SEQ ID NO: 104252 - DNA, 20 bp, Artificial
  CRISPR gRNA sequence
agttactcgctctgttgcct

SEQ ID NO: 104253 - DNA, 20 bp, Artificial
  CRISPR gRNA sequence
actcgctctgttgcctaggc

SEQ ID NO: 104254 - DNA, 20 bp, Artificial
  CRISPR gRNA sequence
ctgttgcctaggctggaatg

SEQ ID NO: 104255 - DNA, 20 bp, Artificial
  CRISPR gRNA sequence
ttgcctaggctggaatgcag

SEQ ID NO: 104256 - DNA, 20 bp, Artificial
  CRISPR gRNA sequence
taggctggaatgcagtggtg

SEQ ID NO: 104257 - DNA, 20 bp, Artificial
  CRISPR gRNA sequence
gaatgcagtggtgcggatct

SEQ ID NO: 104258 - DNA, 20 bp, Artificial
  CRISPR gRNA sequence
tcactgcaacctctgcctcc

SEQ ID NO: 104259 - DNA, 20 bp, Artificial
  CRISPR gRNA sequence
cactgcaacctctgcctccc

SEQ ID NO: 104260 - DNA, 20 bp, Artificial
  CRISPR gRNA sequence
ctcaaatgatcctcccacct

SEQ ID NO: 104261 - DNA, 20 bp, Artificial
  CRISPR gRNA sequence
tcctcccacctcagttcccc

SEQ ID NO: 104262 - DNA, 20 bp, Artificial
  CRISPR gRNA sequence
tcccacctcagttccccaag

SEQ ID NO: 104263 - DNA, 20 bp, Artificial
  CRISPR gRNA sequence
acctcagttccccaagtagc

SEQ ID NO: 104264 - DNA, 20 bp, Artificial
  CRISPR gRNA sequence
cctcagttccccaagtagct

SEQ ID NO: 104265 - DNA, 20 bp, Artificial
  CRISPR gRNA sequence
tccccaagtagctgggacca

SEQ ID NO: 104266 - DNA, 20 bp, Artificial
  CRISPR gRNA sequence
ccccaagtagctgggaccac

SEQ ID NO: 104267 - DNA, 20 bp, Artificial
  CRISPR gRNA sequence
caggcatgtcctaccatgcc

SEQ ID NO: 104268 - DNA, 20 bp, Artificial
  CRISPR gRNA sequence
tggataatttttgtattttt

SEQ ID NO: 104269 - DNA, 20 bp, Artificial
  CRISPR gRNA sequence
ataatttttgtatttttcag

SEQ ID NO: 104270 - DNA, 20 bp, Artificial
  CRISPR gRNA sequence
tttgtatttttcagtagata

SEQ ID NO: 104271 - DNA, 20 bp, Artificial
  CRISPR gRNA sequence
ttgtatttttcagtagatac

SEQ ID NO: 104272 - DNA, 20 bp, Artificial
  CRISPR gRNA sequence
tgtatttttcagtagataca

SEQ ID NO: 104273 - DNA, 20 bp, Artificial
  CRISPR gRNA sequence
cagggttttgccatgttgcc

SEQ ID NO: 104274 - DNA, 20 bp, Artificial
  CRISPR gRNA sequence
agggttttgccatgttgccc

SEQ ID NO: 104275 - DNA, 20 bp, Artificial
  CRISPR gRNA sequence
ttttgccatgttgcccaggc

SEQ ID NO: 104276 - DNA, 20 bp, Artificial
  CRISPR gRNA sequence
ctgacctaatctgctcgcct

SEQ ID NO: 104277 - DNA, 20 bp, Artificial
  CRISPR gRNA sequence
ctgctcgcctcagcctcctg

SEQ ID NO: 104278 - DNA, 20 bp, Artificial
  CRISPR gRNA sequence
gcctcagcctcctgaagtgc

SEQ ID NO: 104279 - DNA, 20 bp, Artificial
  CRISPR gRNA sequence
cctcagcctcctgaagtgct

SEQ ID NO: 104280 - DNA, 20 bp, Artificial
  CRISPR gRNA sequence
ctcctgaagtgctgggatta

SEQ ID NO: 104281 - DNA, 20 bp, Artificial
  CRISPR gRNA sequence
tcctgaagtgctgggattat

SEQ ID NO: 104282 - DNA, 20 bp, Artificial
  CRISPR gRNA sequence
agtgctgggattatgggcat

SEQ ID NO: 104283 - DNA, 20 bp, Artificial
  CRISPR gRNA sequence
tgggcataagccattgtacc

SEQ ID NO: 104284 - DNA, 20 bp, Artificial
  CRISPR gRNA sequence
aagccattgtacccggcttt

SEQ ID NO: 104285 - DNA, 20 bp, Artificial
  CRISPR gRNA sequence
ttcagcatttttaatatata

SEQ ID NO: 104286 - DNA, 20 bp, Artificial
  CRISPR gRNA sequence
atagtatttcctctgtaaaa

SEQ ID NO: 104287 - DNA, 20 bp, Artificial
  CRISPR gRNA sequence
tacttcatcattcaccaaaa

SEQ ID NO: 104288 - DNA, 20 bp, Artificial
  CRISPR gRNA sequence
tcatcattcaccaaaatggc

SEQ ID NO: 104289 - DNA, 20 bp, Artificial
  CRISPR gRNA sequence
aagattaaaaaataataata

SEQ ID NO: 104290 - DNA, 20 bp, Artificial
  CRISPR gRNA sequence
aaaataataataaagcactt

SEQ ID NO: 104291 - DNA, 20 bp, Artificial
  CRISPR gRNA sequence
aataataataaagcacttta

SEQ ID NO: 104292 - DNA, 20 bp, Artificial
  CRISPR gRNA sequence
ttttatttttttattttttt

SEQ ID NO: 104293 - DNA, 20 bp, Artificial
  CRISPR gRNA sequence
atttttttatttttttgaga

SEQ ID NO: 104294 - DNA, 20 bp, Artificial
  CRISPR gRNA sequence
cggaatctcgctctgtcgcc

SEQ ID NO: 104295 - DNA, 20 bp, Artificial
  CRISPR gRNA sequence
ggaatctcgctctgtcgccc

SEQ ID NO: 104296 - DNA, 20 bp, Artificial
  CRISPR gRNA sequence
tctcgctctgtcgcccaggc

SEQ ID NO: 104297 - DNA, 20 bp, Artificial
  CRISPR gRNA sequence
tcgctctgtcgcccaggctg

SEQ ID NO: 104298 - DNA, 20 bp, Artificial
  CRISPR gRNA sequence
ctgtcgcccaggctggagtg

SEQ ID NO: 104299 - DNA, 20 bp, Artificial
  CRISPR gRNA sequence
tcgcccaggctggagtgcag

SEQ ID NO: 104300 - DNA, 20 bp, Artificial
  CRISPR gRNA sequence
ggagtgcagtggcgtgatct

SEQ ID NO: 104301 - DNA, 20 bp, Artificial
  CRISPR gRNA sequence
ctcactgcaacctccgcctc

SEQ ID NO: 104302 - DNA, 20 bp, Artificial
  CRISPR gRNA sequence
gcaacctccgcctccggttc

SEQ ID NO: 104303 - DNA, 20 bp, Artificial
  CRISPR gRNA sequence
ctccggttcaagtgattttc

SEQ ID NO: 104304 - DNA, 20 bp, Artificial
  CRISPR gRNA sequence
ttcaagtgattttccggcct

SEQ ID NO: 104305 - DNA, 20 bp, Artificial
  CRISPR gRNA sequence
ttttccggcctcagtctccc

SEQ ID NO: 104306 - DNA, 20 bp, Artificial
  CRISPR gRNA sequence
tccggcctcagtctcccaag

SEQ ID NO: 104307 - DNA, 20 bp, Artificial
  CRISPR gRNA sequence
gcctcagtctcccaagtagc

SEQ ID NO: 104308 - DNA, 20 bp, Artificial
  CRISPR gRNA sequence
cctcagtctcccaagtagct

SEQ ID NO: 104309 - DNA, 20 bp, Artificial
  CRISPR gRNA sequence
ctcccaagtagctgggatta

SEQ ID NO: 104310 - DNA, 20 bp, Artificial
  CRISPR gRNA sequence
tcccaagtagctgggattac

SEQ ID NO: 104311 - DNA, 20 bp, Artificial
  CRISPR gRNA sequence
caggcatgcaccaccatgcc

SEQ ID NO: 104312 - DNA, 20 bp, Artificial
  CRISPR gRNA sequence
ccggctaatctttgtatttt

SEQ ID NO: 104313 - DNA, 20 bp, Artificial
  CRISPR gRNA sequence
gctaatctttgtatttttag

SEQ ID NO: 104314 - DNA, 20 bp, Artificial
  CRISPR gRNA sequence
taatctttgtatttttagta

SEQ ID NO: 104315 - DNA, 20 bp, Artificial
  CRISPR gRNA sequence
ctttgtatttttagtagaga

SEQ ID NO: 104316 - DNA, 20 bp, Artificial
  CRISPR gRNA sequence
tttgtatttttagtagagac

SEQ ID NO: 104317 - DNA, 20 bp, Artificial
  CRISPR gRNA sequence
ttgtatttttagtagagaca

SEQ ID NO: 104318 - DNA, 20 bp, Artificial
  CRISPR gRNA sequence
gagacagggtttcatcatgt

SEQ ID NO: 104319 - DNA, 20 bp, Artificial
  CRISPR gRNA sequence
cagggtttcatcatgttggc

SEQ ID NO: 104320 - DNA, 20 bp, Artificial
  CRISPR gRNA sequence
agggtttcatcatgttggcc

SEQ ID NO: 104321 - DNA, 20 bp, Artificial
  CRISPR gRNA sequence
tttcatcatgttggccaggc

SEQ ID NO: 104322 - DNA, 20 bp, Artificial
  CRISPR gRNA sequence
ggtctcgaactcctgacctc

SEQ ID NO: 104323 - DNA, 20 bp, Artificial
  CRISPR gRNA sequence
ctcaagtgatccacccacct

SEQ ID NO: 104324 - DNA, 20 bp, Artificial
  CRISPR gRNA sequence
ccacccacctcggccttcca

SEQ ID NO: 104325 - DNA, 20 bp, Artificial
  CRISPR gRNA sequence
acctcggccttccaaagtgc

SEQ ID NO: 104326 - DNA, 20 bp, Artificial
  CRISPR gRNA sequence
cctcggccttccaaagtgca

SEQ ID NO: 104327 - DNA, 20 bp, Artificial
  CRISPR gRNA sequence
cttccaaagtgcaaggatta

SEQ ID NO: 104328 - DNA, 20 bp, Artificial
  CRISPR gRNA sequence
ttccaaagtgcaaggattac

SEQ ID NO: 104329 - DNA, 20 bp, Artificial
  CRISPR gRNA sequence
agtgcaaggattacaggcgt

SEQ ID NO: 104330 - DNA, 20 bp, Artificial
  CRISPR gRNA sequence
caggcgtgagccaccacacc

SEQ ID NO: 104331 - DNA, 20 bp, Artificial
  CRISPR gRNA sequence
gtgagccaccacacccagcc

SEQ ID NO: 104332 - DNA, 20 bp, Artificial
  CRISPR gRNA sequence
gagccaccacacccagccca

SEQ ID NO: 104333 - DNA, 20 bp, Artificial
  CRISPR gRNA sequence
cgacattgatttgttaatat

SEQ ID NO: 104334 - DNA, 20 bp, Artificial
  CRISPR gRNA sequence
gacattgatttgttaatatc

SEQ ID NO: 104335 - DNA, 20 bp, Artificial
  CRISPR gRNA sequence
atttgttaatatcaggtatc

SEQ ID NO: 104336 - DNA, 20 bp, Artificial
  CRISPR gRNA sequence
gttaatatcaggtatccaga

SEQ ID NO: 104337 - DNA, 20 bp, Artificial
  CRISPR gRNA sequence
ttccctatttgtttcataaa

SEQ ID NO: 104338 - DNA, 20 bp, Artificial
  CRISPR gRNA sequence
ttgtttcataaatggaaaat

SEQ ID NO: 104339 - DNA, 20 bp, Artificial
  CRISPR gRNA sequence
aagttgtgtctacttcataa

SEQ ID NO: 104340 - DNA, 20 bp, Artificial
  CRISPR gRNA sequence
gttgtgtctacttcataatg

SEQ ID NO: 104341 - DNA, 20 bp, Artificial
  CRISPR gRNA sequence
ttgtgtctacttcataatgg

SEQ ID NO: 104342 - DNA, 20 bp, Artificial
  CRISPR gRNA sequence
tgtgtctacttcataatgga

SEQ ID NO: 104343 - DNA, 20 bp, Artificial
  CRISPR gRNA sequence
gtctacttcataatggaggg

SEQ ID NO: 104344 - DNA, 20 bp, Artificial
  CRISPR gRNA sequence
ctacttcataatggagggca

SEQ ID NO: 104345 - DNA, 20 bp, Artificial
  CRISPR gRNA sequence
cttcataatggagggcagag

SEQ ID NO: 104346 - DNA, 20 bp, Artificial
  CRISPR gRNA sequence
ttcataatggagggcagagc

SEQ ID NO: 104347 - DNA, 20 bp, Artificial
  CRISPR gRNA sequence
aggacttcttttttcctctt

SEQ ID NO: 104348 - DNA, 20 bp, Artificial
  CRISPR gRNA sequence
tcagaacattttctgctttc

SEQ ID NO: 104349 - DNA, 20 bp, Artificial
  CRISPR gRNA sequence
agaacattttctgctttcta

SEQ ID NO: 104350 - DNA, 20 bp, Artificial
  CRISPR gRNA sequence
ttctgctttctagagaaatg

SEQ ID NO: 104351 - DNA, 20 bp, Artificial
  CRISPR gRNA sequence
agagaaatgtggataactct

SEQ ID NO: 104352 - DNA, 20 bp, Artificial
  CRISPR gRNA sequence
gagaaatgtggataactctc

SEQ ID NO: 104353 - DNA, 20 bp, Artificial
  CRISPR gRNA sequence
agaaatgtggataactctcg

SEQ ID NO: 104354 - DNA, 20 bp, Artificial
  CRISPR gRNA sequence
tggataactctcggggacca

SEQ ID NO: 104355 - DNA, 20 bp, Artificial
  CRISPR gRNA sequence
ggataactctcggggaccaa

SEQ ID NO: 104356 - DNA, 20 bp, Artificial
  CRISPR gRNA sequence
ataactctcggggaccaaag

SEQ ID NO: 104357 - DNA, 20 bp, Artificial
  CRISPR gRNA sequence
tctcggggaccaaaggagac

SEQ ID NO: 104358 - DNA, 20 bp, Artificial
  CRISPR gRNA sequence
ggaccaaaggagaccagtgt

SEQ ID NO: 104359 - DNA, 20 bp, Artificial
  CRISPR gRNA sequence
ccaaaggagaccagtgtcag

SEQ ID NO: 104360 - DNA, 20 bp, Artificial
  CRISPR gRNA sequence
aaaggagaccagtgtcagta

SEQ ID NO: 104361 - DNA, 20 bp, Artificial
  CRISPR gRNA sequence
tttttttatgttcttttctg

SEQ ID NO: 104362 - DNA, 20 bp, Artificial
  CRISPR gRNA sequence
tatgttcttttctgcagata

SEQ ID NO: 104363 - DNA, 20 bp, Artificial
  CRISPR gRNA sequence
ttcttttctgcagatacagt

SEQ ID NO: 104364 - DNA, 20 bp, Artificial
  CRISPR gRNA sequence
cagatacagttggtcccacc

SEQ ID NO: 104365 - DNA, 20 bp, Artificial
  CRISPR gRNA sequence
tacagttggtcccacctgga

SEQ ID NO: 104366 - DNA, 20 bp, Artificial
  CRISPR gRNA sequence
tggtcccacctggacagatc

SEQ ID NO: 104367 - DNA, 20 bp, Artificial
  CRISPR gRNA sequence
cacctggacagatccagatc

SEQ ID NO: 104368 - DNA, 20 bp, Artificial
  CRISPR gRNA sequence
acctggacagatccagatcc

SEQ ID NO: 104369 - DNA, 20 bp, Artificial
  CRISPR gRNA sequence
cctggacagatccagatcca

SEQ ID NO: 104370 - DNA, 20 bp, Artificial
  CRISPR gRNA sequence
ggacagatccagatccaggg

SEQ ID NO: 104371 - DNA, 20 bp, Artificial
  CRISPR gRNA sequence
agatccagatccagggtgga

SEQ ID NO: 104372 - DNA, 20 bp, Artificial
  CRISPR gRNA sequence
gatccagatccagggtggac

SEQ ID NO: 104373 - DNA, 20 bp, Artificial
  CRISPR gRNA sequence
tccagggtggacaggctgtg

SEQ ID NO: 104374 - DNA, 20 bp, Artificial
  CRISPR gRNA sequence
ccagggtggacaggctgtgc

SEQ ID NO: 104375 - DNA, 20 bp, Artificial
  CRISPR gRNA sequence
gtggacaggctgtgcaggtg

SEQ ID NO: 104376 - DNA, 20 bp, Artificial
  CRISPR gRNA sequence
tggacaggctgtgcaggtgc

SEQ ID NO: 104377 - DNA, 20 bp, Artificial
  CRISPR gRNA sequence
ggacaggctgtgcaggtgca

SEQ ID NO: 104378 - DNA, 20 bp, Artificial
  CRISPR gRNA sequence
aggctgtgcaggtgcagggc

SEQ ID NO: 104379 - DNA, 20 bp, Artificial
  CRISPR gRNA sequence
ctgtgcaggtgcagggccag

SEQ ID NO: 104380 - DNA, 20 bp, Artificial
  CRISPR gRNA sequence
tgtgcaggtgcagggccagc

SEQ ID NO: 104381 - DNA, 20 bp, Artificial
  CRISPR gRNA sequence
gtgcaggtgcagggccagca

SEQ ID NO: 104382 - DNA, 20 bp, Artificial
  CRISPR gRNA sequence
aggtgcagggccagcagggc

SEQ ID NO: 104383 - DNA, 20 bp, Artificial
  CRISPR gRNA sequence
agggccagcagggccagacc

SEQ ID NO: 104384 - DNA, 20 bp, Artificial
  CRISPR gRNA sequence
gccagcagggccagacccag

SEQ ID NO: 104385 - DNA, 20 bp, Artificial
  CRISPR gRNA sequence
agacccagcagatcatcatc

SEQ ID NO: 104386 - DNA, 20 bp, Artificial
  CRISPR gRNA sequence
cccagcagatcatcatccag

SEQ ID NO: 104387 - DNA, 20 bp, Artificial
  CRISPR gRNA sequence
agatcatcatccagcagccc

SEQ ID NO: 104388 - DNA, 20 bp, Artificial
  CRISPR gRNA sequence
catcatccagcagccccaga

SEQ ID NO: 104389 - DNA, 20 bp, Artificial
  CRISPR gRNA sequence
ccccagacggctgtcactgc

SEQ ID NO: 104390 - DNA, 20 bp, Artificial
  CRISPR gRNA sequence
agacggctgtcactgctggc

SEQ ID NO: 104391 - DNA, 20 bp, Artificial
  CRISPR gRNA sequence
ctgtcactgctggccagact

SEQ ID NO: 104392 - DNA, 20 bp, Artificial
  CRISPR gRNA sequence
tgtcactgctggccagactc

SEQ ID NO: 104393 - DNA, 20 bp, Artificial
  CRISPR gRNA sequence
ccagactcaggtaattccac

SEQ ID NO: 104394 - DNA, 20 bp, Artificial
  CRISPR gRNA sequence
attccactagctctgtcaca

SEQ ID NO: 104395 - DNA, 20 bp, Artificial
  CRISPR gRNA sequence
ttccactagctctgtcacac

SEQ ID NO: 104396 - DNA, 20 bp, Artificial
  CRISPR gRNA sequence
ccactagctctgtcacacag

SEQ ID NO: 104397 - DNA, 20 bp, Artificial
  CRISPR gRNA sequence
acacaggagcaaaactgatt

SEQ ID NO: 104398 - DNA, 20 bp, Artificial
  CRISPR gRNA sequence
caggagcaaaactgatttgg

SEQ ID NO: 104399 - DNA, 20 bp, Artificial
  CRISPR gRNA sequence
ggagcaaaactgatttggaa

SEQ ID NO: 104400 - DNA, 20 bp, Artificial
  CRISPR gRNA sequence
caaaactgatttggaagagt

SEQ ID NO: 104401 - DNA, 20 bp, Artificial
  CRISPR gRNA sequence
tttggaagagtcagataact

SEQ ID NO: 104402 - DNA, 20 bp, Artificial
  CRISPR gRNA sequence
gaagagtcagataactgagt

SEQ ID NO: 104403 - DNA, 20 bp, Artificial
  CRISPR gRNA sequence
tgagtcagatatttcatgta

SEQ ID NO: 104404 - DNA, 20 bp, Artificial
  CRISPR gRNA sequence
tatttcatgtatagcatgta

SEQ ID NO: 104405 - DNA, 20 bp, Artificial
  CRISPR gRNA sequence
ttcatgtatagcatgtatag

SEQ ID NO: 104406 - DNA, 20 bp, Artificial
  CRISPR gRNA sequence
gtatagcatgtatagtagaa

SEQ ID NO: 104407 - DNA, 20 bp, Artificial
  CRISPR gRNA sequence
tatagcatgtatagtagaaa

SEQ ID NO: 104408 - DNA, 20 bp, Artificial
  CRISPR gRNA sequence
atagcatgtatagtagaaaa

SEQ ID NO: 104409 - DNA, 20 bp, Artificial
  CRISPR gRNA sequence
tagcatgtatagtagaaaag

SEQ ID NO: 104410 - DNA, 20 bp, Artificial
  CRISPR gRNA sequence
accataaaaaaatatatttt

SEQ ID NO: 104411 - DNA, 20 bp, Artificial
  CRISPR gRNA sequence
taaaaaaatatatttttggc

SEQ ID NO: 104412 - DNA, 20 bp, Artificial
  CRISPR gRNA sequence
aaaaaaatatatttttggcc

SEQ ID NO: 104413 - DNA, 20 bp, Artificial
  CRISPR gRNA sequence
aatatatttttggccgggcg

SEQ ID NO: 104414 - DNA, 20 bp, Artificial
  CRISPR gRNA sequence
atatttttggccgggcgcgg

SEQ ID NO: 104415 - DNA, 20 bp, Artificial
  CRISPR gRNA sequence
gtggctcatgcctgtaatcc

SEQ ID NO: 104416 - DNA, 20 bp, Artificial
  CRISPR gRNA sequence
gcctgtaatcccagcacttt

SEQ ID NO: 104417 - DNA, 20 bp, Artificial
  CRISPR gRNA sequence
ctgtaatcccagcactttga

SEQ ID NO: 104418 - DNA, 20 bp, Artificial
  CRISPR gRNA sequence
tgtaatcccagcactttgag

SEQ ID NO: 104419 - DNA, 20 bp, Artificial
  CRISPR gRNA sequence
tcccagcactttgagaggcc

SEQ ID NO: 104420 - DNA, 20 bp, Artificial
  CRISPR gRNA sequence
cccagcactttgagaggccg

SEQ ID NO: 104421 - DNA, 20 bp, Artificial
  CRISPR gRNA sequence
gcactttgagaggccgaggc

SEQ ID NO: 104422 - DNA, 20 bp, Artificial
  CRISPR gRNA sequence
ggccgaggcaagctgatcac

SEQ ID NO: 104423 - DNA, 20 bp, Artificial
  CRISPR gRNA sequence
gccgaggcaagctgatcaca

SEQ ID NO: 104424 - DNA, 20 bp, Artificial
  CRISPR gRNA sequence
ggcaagctgatcacaaggtc

SEQ ID NO: 104425 - DNA, 20 bp, Artificial
  CRISPR gRNA sequence
caagctgatcacaaggtcaa

SEQ ID NO: 104426 - DNA, 20 bp, Artificial
  CRISPR gRNA sequence
gatcacaaggtcaagagatc

SEQ ID NO: 104427 - DNA, 20 bp, Artificial
  CRISPR gRNA sequence
tcaagagatcaagaacatcc

SEQ ID NO: 104428 - DNA, 20 bp, Artificial
  CRISPR gRNA sequence
caagaacatcctggccaaca

SEQ ID NO: 104429 - DNA, 20 bp, Artificial
  CRISPR gRNA sequence
acatcctggccaacatggtg

SEQ ID NO: 104430 - DNA, 20 bp, Artificial
  CRISPR gRNA sequence
ccccgtcaaaatacaaaaat

SEQ ID NO: 104431 - DNA, 20 bp, Artificial
  CRISPR gRNA sequence
cccgtcaaaatacaaaaatt

SEQ ID NO: 104432 - DNA, 20 bp, Artificial
  CRISPR gRNA sequence
gtcaaaatacaaaaattagg

SEQ ID NO: 104433 - DNA, 20 bp, Artificial
  CRISPR gRNA sequence
tcaaaatacaaaaattaggt

SEQ ID NO: 104434 - DNA, 20 bp, Artificial
  CRISPR gRNA sequence
atacaaaaattaggtgggca

SEQ ID NO: 104435 - DNA, 20 bp, Artificial
  CRISPR gRNA sequence
caaaaattaggtgggcatgg

SEQ ID NO: 104436 - DNA, 20 bp, Artificial
  CRISPR gRNA sequence
gtggcgcatgcctgtaatcc

SEQ ID NO: 104437 - DNA, 20 bp, Artificial
  CRISPR gRNA sequence
tgcctgtaatcccagctact

SEQ ID NO: 104438 - DNA, 20 bp, Artificial
  CRISPR gRNA sequence
gcctgtaatcccagctactc

SEQ ID NO: 104439 - DNA, 20 bp, Artificial
  CRISPR gRNA sequence
ctgtaatcccagctactcgg

SEQ ID NO: 104440 - DNA, 20 bp, Artificial
  CRISPR gRNA sequence
tgtaatcccagctactcggg

SEQ ID NO: 104441 - DNA, 20 bp, Artificial
  CRISPR gRNA sequence
tcccagctactcgggaggct

SEQ ID NO: 104442 - DNA, 20 bp, Artificial
  CRISPR gRNA sequence
cccagctactcgggaggctg

SEQ ID NO: 104443 - DNA, 20 bp, Artificial
  CRISPR gRNA sequence
agctactcgggaggctgagg

SEQ ID NO: 104444 - DNA, 20 bp, Artificial
  CRISPR gRNA sequence
ctactcgggaggctgaggca

SEQ ID NO: 104445 - DNA, 20 bp, Artificial
  CRISPR gRNA sequence
ggcagagaatcgcttgaacc

SEQ ID NO: 104446 - DNA, 20 bp, Artificial
  CRISPR gRNA sequence
gcagagaatcgcttgaaccc

SEQ ID NO: 104447 - DNA, 20 bp, Artificial
  CRISPR gRNA sequence
agagaatcgcttgaacccag

SEQ ID NO: 104448 - DNA, 20 bp, Artificial
  CRISPR gRNA sequence
gagaatcgcttgaacccagg

SEQ ID NO: 104449 - DNA, 20 bp, Artificial
  CRISPR gRNA sequence
aatcgcttgaacccaggagg

SEQ ID NO: 104450 - DNA, 20 bp, Artificial
  CRISPR gRNA sequence
tcgcttgaacccaggaggcg

SEQ ID NO: 104451 - DNA, 20 bp, Artificial
  CRISPR gRNA sequence
cgcttgaacccaggaggcgg

SEQ ID NO: 104452 - DNA, 20 bp, Artificial
  CRISPR gRNA sequence
aacccaggaggcggaggttg

SEQ ID NO: 104453 - DNA, 20 bp, Artificial
  CRISPR gRNA sequence
caggaggcggaggttgcagt

SEQ ID NO: 104454 - DNA, 20 bp, Artificial
  CRISPR gRNA sequence
ggcggaggttgcagtgagct

SEQ ID NO: 104455 - DNA, 20 bp, Artificial
  CRISPR gRNA sequence
tgcgccactgcactgcactc

SEQ ID NO: 104456 - DNA, 20 bp, Artificial
  CRISPR gRNA sequence
cactgcactgcactccagcc

SEQ ID NO: 104457 - DNA, 20 bp, Artificial
  CRISPR gRNA sequence
actgcactccagcctggcga

SEQ ID NO: 104458 - DNA, 20 bp, Artificial
  CRISPR gRNA sequence
tgcactccagcctggcgaca

SEQ ID NO: 104459 - DNA, 20 bp, Artificial
  CRISPR gRNA sequence
ctccagcctggcgacagagt

SEQ ID NO: 104460 - DNA, 20 bp, Artificial
  CRISPR gRNA sequence
aaaaaataattttttttttt

SEQ ID NO: 104461 - DNA, 20 bp, Artificial
  CRISPR gRNA sequence
aaaaataattttttttttta

SEQ ID NO: 104462 - DNA, 20 bp, Artificial
  CRISPR gRNA sequence
aggactacatcgttctttgt

SEQ ID NO: 104463 - DNA, 20 bp, Artificial
  CRISPR gRNA sequence
tcgttctttgttagtatctt

SEQ ID NO: 104464 - DNA, 20 bp, Artificial
  CRISPR gRNA sequence
cgttctttgttagtatcttt

SEQ ID NO: 104465 - DNA, 20 bp, Artificial
  CRISPR gRNA sequence
gtgtcattacttatttcctc

SEQ ID NO: 104466 - DNA, 20 bp, Artificial
  CRISPR gRNA sequence
ttacttatttcctccagaca

SEQ ID NO: 104467 - DNA, 20 bp, Artificial
  CRISPR gRNA sequence
cttatttcctccagacacag

SEQ ID NO: 104468 - DNA, 20 bp, Artificial
  CRISPR gRNA sequence
atttcctccagacacagcag

SEQ ID NO: 104469 - DNA, 20 bp, Artificial
  CRISPR gRNA sequence
cacagcagcagattgctgtc

SEQ ID NO: 104470 - DNA, 20 bp, Artificial
  CRISPR gRNA sequence
acagcagcagattgctgtcc

SEQ ID NO: 104471 - DNA, 20 bp, Artificial
  CRISPR gRNA sequence
cagcagcagattgctgtcca

SEQ ID NO: 104472 - DNA, 20 bp, Artificial
  CRISPR gRNA sequence
agcagattgctgtccaggga

SEQ ID NO: 104473 - DNA, 20 bp, Artificial
  CRISPR gRNA sequence
gattgctgtccagggacagc

SEQ ID NO: 104474 - DNA, 20 bp, Artificial
  CRISPR gRNA sequence
tgctgtccagggacagcaag

SEQ ID NO: 104475 - DNA, 20 bp, Artificial
  CRISPR gRNA sequence
tccagggacagcaagtggca

SEQ ID NO: 104476 - DNA, 20 bp, Artificial
  CRISPR gRNA sequence
gcaagtggcacagactgctg

SEQ ID NO: 104477 - DNA, 20 bp, Artificial
  CRISPR gRNA sequence
caagtggcacagactgctga

SEQ ID NO: 104478 - DNA, 20 bp, Artificial
  CRISPR gRNA sequence
aagtggcacagactgctgaa

SEQ ID NO: 104479 - DNA, 20 bp, Artificial
  CRISPR gRNA sequence
tggcacagactgctgaaggg

SEQ ID NO: 104480 - DNA, 20 bp, Artificial
  CRISPR gRNA sequence
gcagaccatcgtctatcaac

SEQ ID NO: 104481 - DNA, 20 bp, Artificial
  CRISPR gRNA sequence
cgtctatcaaccagttaatg

SEQ ID NO: 104482 - DNA, 20 bp, Artificial
  CRISPR gRNA sequence
tatcaaccagttaatgcaga

SEQ ID NO: 104483 - DNA, 20 bp, Artificial
  CRISPR gRNA sequence
atgcagatggcaccattctc

SEQ ID NO: 104484 - DNA, 20 bp, Artificial
  CRISPR gRNA sequence
agatggcaccattctccagc

SEQ ID NO: 104485 - DNA, 20 bp, Artificial
  CRISPR gRNA sequence
gatggcaccattctccagca

SEQ ID NO: 104486 - DNA, 20 bp, Artificial
  CRISPR gRNA sequence
gcaccattctccagcaaggt

SEQ ID NO: 104487 - DNA, 20 bp, Artificial
  CRISPR gRNA sequence
agcaaggtaagtgtacccat

SEQ ID NO: 104488 - DNA, 20 bp, Artificial
  CRISPR gRNA sequence
agtgtacccataagcttccc

SEQ ID NO: 104489 - DNA, 20 bp, Artificial
  CRISPR gRNA sequence
gtgtacccataagcttccct

SEQ ID NO: 104490 - DNA, 20 bp, Artificial
  CRISPR gRNA sequence
taagcttccctaggactttt

SEQ ID NO: 104491 - DNA, 20 bp, Artificial
  CRISPR gRNA sequence
aagcttccctaggacttttt

SEQ ID NO: 104492 - DNA, 20 bp, Artificial
  CRISPR gRNA sequence
agcttccctaggactttttg

SEQ ID NO: 104493 - DNA, 20 bp, Artificial
  CRISPR gRNA sequence
ggggcaacttttttgtccct

SEQ ID NO: 104494 - DNA, 20 bp, Artificial
  CRISPR gRNA sequence
ccttagacaactgacatctt

SEQ ID NO: 104495 - DNA, 20 bp, Artificial
  CRISPR gRNA sequence
aactgacatctttagaattt

SEQ ID NO: 104496 - DNA, 20 bp, Artificial
  CRISPR gRNA sequence
tgacatctttagaatttgag

SEQ ID NO: 104497 - DNA, 20 bp, Artificial
  CRISPR gRNA sequence
acttgacactacatattttt

SEQ ID NO: 104498 - DNA, 20 bp, Artificial
  CRISPR gRNA sequence
ttttttggacaaaaaaaaaa

SEQ ID NO: 104499 - DNA, 20 bp, Artificial
  CRISPR gRNA sequence
aaaaaaaaaaagatttcctc

SEQ ID NO: 104500 - DNA, 20 bp, Artificial
  CRISPR gRNA sequence
tctagctctccattgattgt

SEQ ID NO: 104501 - DNA, 20 bp, Artificial
  CRISPR gRNA sequence
ttgtcaccatctgtgaccaa

SEQ ID NO: 104502 - DNA, 20 bp, Artificial
  CRISPR gRNA sequence
accaacagtgattccatgtg

SEQ ID NO: 104503 - DNA, 20 bp, Artificial
  CRISPR gRNA sequence
aacagtgattccatgtgtag

SEQ ID NO: 104504 - DNA, 20 bp, Artificial
  CRISPR gRNA sequence
tccatgtgtagcagtttcta

SEQ ID NO: 104505 - DNA, 20 bp, Artificial
  CRISPR gRNA sequence
atgtgtagcagtttctatag

SEQ ID NO: 104506 - DNA, 20 bp, Artificial
  CRISPR gRNA sequence
ttctatagtggttgctaatc

SEQ ID NO: 104507 - DNA, 20 bp, Artificial
  CRISPR gRNA sequence
tctatagtggttgctaatct

SEQ ID NO: 104508 - DNA, 20 bp, Artificial
  CRISPR gRNA sequence
ctatagtggttgctaatcta

SEQ ID NO: 104509 - DNA, 20 bp, Artificial
  CRISPR gRNA sequence
tgctaatctagggattgtgt

SEQ ID NO: 104510 - DNA, 20 bp, Artificial
  CRISPR gRNA sequence
ctagggattgtgtaagcttt

SEQ ID NO: 104511 - DNA, 20 bp, Artificial
  CRISPR gRNA sequence
tagggattgtgtaagctttt

SEQ ID NO: 104512 - DNA, 20 bp, Artificial
  CRISPR gRNA sequence
agggattgtgtaagctttta

SEQ ID NO: 104513 - DNA, 20 bp, Artificial
  CRISPR gRNA sequence
gattgtgtaagcttttaggg

SEQ ID NO: 104514 - DNA, 20 bp, Artificial
  CRISPR gRNA sequence
tgtgtaagcttttagggaag

SEQ ID NO: 104515 - DNA, 20 bp, Artificial
  CRISPR gRNA sequence
agggaagaagtgtttctaaa

SEQ ID NO: 104516 - DNA, 20 bp, Artificial
  CRISPR gRNA sequence
gaagaagtgtttctaaacag

SEQ ID NO: 104517 - DNA, 20 bp, Artificial
  CRISPR gRNA sequence
agtgtttctaaacagaagaa

SEQ ID NO: 104518 - DNA, 20 bp, Artificial
  CRISPR gRNA sequence
tctaaacagaagaatagaaa

SEQ ID NO: 104519 - DNA, 20 bp, Artificial
  CRISPR gRNA sequence
ctaaacagaagaatagaaat

SEQ ID NO: 104520 - DNA, 20 bp, Artificial
  CRISPR gRNA sequence
taaacagaagaatagaaata

SEQ ID NO: 104521 - DNA, 20 bp, Artificial
  CRISPR gRNA sequence
aacagaagaatagaaatagg

SEQ ID NO: 104522 - DNA, 20 bp, Artificial
  CRISPR gRNA sequence
aatagaaatagggagttcat

SEQ ID NO: 104523 - DNA, 20 bp, Artificial
  CRISPR gRNA sequence
aaatagggagttcattggta

SEQ ID NO: 104524 - DNA, 20 bp, Artificial
  CRISPR gRNA sequence
atagggagttcattggtaaa

SEQ ID NO: 104525 - DNA, 20 bp, Artificial
  CRISPR gRNA sequence
agggagttcattggtaaaga

SEQ ID NO: 104526 - DNA, 20 bp, Artificial
  CRISPR gRNA sequence
ttcattggtaaagagagaaa

SEQ ID NO: 104527 - DNA, 20 bp, Artificial
  CRISPR gRNA sequence
agagaaatagatcaaaaatc

SEQ ID NO: 104528 - DNA, 20 bp, Artificial
  CRISPR gRNA sequence
aaatagatcaaaaatcaagt

SEQ ID NO: 104529 - DNA, 20 bp, Artificial
  CRISPR gRNA sequence
atcaaaaatcaagttggctt

SEQ ID NO: 104530 - DNA, 20 bp, Artificial
  CRISPR gRNA sequence
caaaaatcaagttggcttta

SEQ ID NO: 104531 - DNA, 20 bp, Artificial
  CRISPR gRNA sequence
ttgctgcttatgtttttttc

SEQ ID NO: 104532 - DNA, 20 bp, Artificial
  CRISPR gRNA sequence
tgctgcttatgtttttttct

SEQ ID NO: 104533 - DNA, 20 bp, Artificial
  CRISPR gRNA sequence
ttaaatgactattatgtata

SEQ ID NO: 104534 - DNA, 20 bp, Artificial
  CRISPR gRNA sequence
atgtatacagcacttttact

SEQ ID NO: 104535 - DNA, 20 bp, Artificial
  CRISPR gRNA sequence
tatacagcacttttactaag

SEQ ID NO: 104536 - DNA, 20 bp, Artificial
  CRISPR gRNA sequence
atacagcacttttactaaga

SEQ ID NO: 104537 - DNA, 20 bp, Artificial
  CRISPR gRNA sequence
tacagcacttttactaagaa

SEQ ID NO: 104538 - DNA, 20 bp, Artificial
  CRISPR gRNA sequence
tttactaagaagggtcctca

SEQ ID NO: 104539 - DNA, 20 bp, Artificial
  CRISPR gRNA sequence
tactaagaagggtcctcaaa

SEQ ID NO: 104540 - DNA, 20 bp, Artificial
  CRISPR gRNA sequence
aagggtcctcaaagagcctc

SEQ ID NO: 104541 - DNA, 20 bp, Artificial
  CRISPR gRNA sequence
tcctcaaagagcctctagtc

SEQ ID NO: 104542 - DNA, 20 bp, Artificial
  CRISPR gRNA sequence
caaagagcctctagtctagt

SEQ ID NO: 104543 - DNA, 20 bp, Artificial
  CRISPR gRNA sequence
gagcctctagtctagtaaga

SEQ ID NO: 104544 - DNA, 20 bp, Artificial
  CRISPR gRNA sequence
gtgaacaaataaatacaatg

SEQ ID NO: 104545 - DNA, 20 bp, Artificial
  CRISPR gRNA sequence
tgaacaaataaatacaatgc

SEQ ID NO: 104546 - DNA, 20 bp, Artificial
  CRISPR gRNA sequence
gaacaaataaatacaatgca

SEQ ID NO: 104547 - DNA, 20 bp, Artificial
  CRISPR gRNA sequence
aatacaatgcagggccctca

SEQ ID NO: 104548 - DNA, 20 bp, Artificial
  CRISPR gRNA sequence
acaatgcagggccctcatgg

SEQ ID NO: 104549 - DNA, 20 bp, Artificial
  CRISPR gRNA sequence
gccctcatggaagtatgttc

SEQ ID NO: 104550 - DNA, 20 bp, Artificial
  CRISPR gRNA sequence
ccctcatggaagtatgttct

SEQ ID NO: 104551 - DNA, 20 bp, Artificial
  CRISPR gRNA sequence
atggaagtatgttctaggaa

SEQ ID NO: 104552 - DNA, 20 bp, Artificial
  CRISPR gRNA sequence
ggaatagataacataaataa

SEQ ID NO: 104553 - DNA, 20 bp, Artificial
  CRISPR gRNA sequence
taacataaataatagatgtt

SEQ ID NO: 104554 - DNA, 20 bp, Artificial
  CRISPR gRNA sequence
taaataatagatgtttggtc

SEQ ID NO: 104555 - DNA, 20 bp, Artificial
  CRISPR gRNA sequence
aaataatagatgtttggtct

SEQ ID NO: 104556 - DNA, 20 bp, Artificial
  CRISPR gRNA sequence
ataatagatgtttggtctgg

SEQ ID NO: 104557 - DNA, 20 bp, Artificial
  CRISPR gRNA sequence
taatagatgtttggtctggg

SEQ ID NO: 104558 - DNA, 20 bp, Artificial
  CRISPR gRNA sequence
atagatgtttggtctgggag

SEQ ID NO: 104559 - DNA, 20 bp, Artificial
  CRISPR gRNA sequence
tagatgtttggtctgggagg

SEQ ID NO: 104560 - DNA, 20 bp, Artificial
  CRISPR gRNA sequence
gatgtttggtctgggaggag

SEQ ID NO: 104561 - DNA, 20 bp, Artificial
  CRISPR gRNA sequence
ttggtctgggaggaggagtg

SEQ ID NO: 104562 - DNA, 20 bp, Artificial
  CRISPR gRNA sequence
gagtgcagaaactgaacttg

SEQ ID NO: 104563 - DNA, 20 bp, Artificial
  CRISPR gRNA sequence
agtgcagaaactgaacttga

SEQ ID NO: 104564 - DNA, 20 bp, Artificial
  CRISPR gRNA sequence
aaactgaacttgaaggcttt

SEQ ID NO: 104565 - DNA, 20 bp, Artificial
  CRISPR gRNA sequence
ctgaacttgaaggcttttgg

SEQ ID NO: 104566 - DNA, 20 bp, Artificial
  CRISPR gRNA sequence
aggcttttggaagcacctgt

SEQ ID NO: 104567 - DNA, 20 bp, Artificial
  CRISPR gRNA sequence
ggaagcacctgttagtcaaa

SEQ ID NO: 104568 - DNA, 20 bp, Artificial
  CRISPR gRNA sequence
gtcaaatagttaaatcaaaa

SEQ ID NO: 104569 - DNA, 20 bp, Artificial
  CRISPR gRNA sequence
tcaaatagttaaatcaaaaa

SEQ ID NO: 104570 - DNA, 20 bp, Artificial
  CRISPR gRNA sequence
tcaaaaaaggacatctttgt

SEQ ID NO: 104571 - DNA, 20 bp, Artificial
  CRISPR gRNA sequence
gattgcaaatttgcaatata

SEQ ID NO: 104572 - DNA, 20 bp, Artificial
  CRISPR gRNA sequence
attgcaaatttgcaatatac

SEQ ID NO: 104573 - DNA, 20 bp, Artificial
  CRISPR gRNA sequence
aatttgcaatatacaggatc

SEQ ID NO: 104574 - DNA, 20 bp, Artificial
  CRISPR gRNA sequence
tttgcaatatacaggatcca

SEQ ID NO: 104575 - DNA, 20 bp, Artificial
  CRISPR gRNA sequence
tgcaatatacaggatccaga

SEQ ID NO: 104576 - DNA, 20 bp, Artificial
  CRISPR gRNA sequence
tgtgtgctcttgtattactc

SEQ ID NO: 104577 - DNA, 20 bp, Artificial
  CRISPR gRNA sequence
gtgtgctcttgtattactcc

SEQ ID NO: 104578 - DNA, 20 bp, Artificial
  CRISPR gRNA sequence
tgtgctcttgtattactcca

SEQ ID NO: 104579 - DNA, 20 bp, Artificial
  CRISPR gRNA sequence
tgctcttgtattactccagg

SEQ ID NO: 104580 - DNA, 20 bp, Artificial
  CRISPR gRNA sequence
gctcttgtattactccaggg

SEQ ID NO: 104581 - DNA, 20 bp, Artificial
  CRISPR gRNA sequence
actccagggaggccctgaac

SEQ ID NO: 104582 - DNA, 20 bp, Artificial
  CRISPR gRNA sequence
gggaggccctgaactggatt

SEQ ID NO: 104583 - DNA, 20 bp, Artificial
  CRISPR gRNA sequence
gccctgaactggattgagcc

SEQ ID NO: 104584 - DNA, 20 bp, Artificial
  CRISPR gRNA sequence
ccctgaactggattgagccc

SEQ ID NO: 104585 - DNA, 20 bp, Artificial
  CRISPR gRNA sequence
gaactggattgagcccaggc

SEQ ID NO: 104586 - DNA, 20 bp, Artificial
  CRISPR gRNA sequence
actggattgagcccaggcaa

SEQ ID NO: 104587 - DNA, 20 bp, Artificial
  CRISPR gRNA sequence
agcccaggcaagagctcaaa

SEQ ID NO: 104588 - DNA, 20 bp, Artificial
  CRISPR gRNA sequence
aggcaagagctcaaacagaa

SEQ ID NO: 104589 - DNA, 20 bp, Artificial
  CRISPR gRNA sequence
agaatggtgaacaaatcctc

SEQ ID NO: 104590 - DNA, 20 bp, Artificial
  CRISPR gRNA sequence
tcctcaagtgctgctattga

SEQ ID NO: 104591 - DNA, 20 bp, Artificial
  CRISPR gRNA sequence
aagtgctgctattgatagtc

SEQ ID NO: 104592 - DNA, 20 bp, Artificial
  CRISPR gRNA sequence
agtgctgctattgatagtct

SEQ ID NO: 104593 - DNA, 20 bp, Artificial
  CRISPR gRNA sequence
gtgctgctattgatagtctg

SEQ ID NO: 104594 - DNA, 20 bp, Artificial
  CRISPR gRNA sequence
ctattgatagtctggggact

SEQ ID NO: 104595 - DNA, 20 bp, Artificial
  CRISPR gRNA sequence
gtctggggacttggaatgct

SEQ ID NO: 104596 - DNA, 20 bp, Artificial
  CRISPR gRNA sequence
ggaatgcttggtttaatttt

SEQ ID NO: 104597 - DNA, 20 bp, Artificial
  CRISPR gRNA sequence
tactacaactgactcattgt

SEQ ID NO: 104598 - DNA, 20 bp, Artificial
  CRISPR gRNA sequence
aactgactcattgtcagttt

SEQ ID NO: 104599 - DNA, 20 bp, Artificial
  CRISPR gRNA sequence
ttgtcagtttgagataaaca

SEQ ID NO: 104600 - DNA, 20 bp, Artificial
  CRISPR gRNA sequence
gtttgagataaacaaagtat

SEQ ID NO: 104601 - DNA, 20 bp, Artificial
  CRISPR gRNA sequence
gttttaaaatctctgtcctg

SEQ ID NO: 104602 - DNA, 20 bp, Artificial
  CRISPR gRNA sequence
ttaaaatctctgtcctgaag

SEQ ID NO: 104603 - DNA, 20 bp, Artificial
  CRISPR gRNA sequence
gcagattgctcattatgtac

SEQ ID NO: 104604 - DNA, 20 bp, Artificial
  CRISPR gRNA sequence
agattgctcattatgtacaa

SEQ ID NO: 104605 - DNA, 20 bp, Artificial
  CRISPR gRNA sequence
ttgctcattatgtacaagag

SEQ ID NO: 104606 - DNA, 20 bp, Artificial
  CRISPR gRNA sequence
ctcattatgtacaagagcag

SEQ ID NO: 104607 - DNA, 20 bp, Artificial
  CRISPR gRNA sequence
tcattatgtacaagagcagt

SEQ ID NO: 104608 - DNA, 20 bp, Artificial
  CRISPR gRNA sequence
atgtacaagagcagtaggta

SEQ ID NO: 104609 - DNA, 20 bp, Artificial
  CRISPR gRNA sequence
aagagcagtaggtatagctg

SEQ ID NO: 104610 - DNA, 20 bp, Artificial
  CRISPR gRNA sequence
gcagtaggtatagctgtagt

SEQ ID NO: 104611 - DNA, 20 bp, Artificial
  CRISPR gRNA sequence
gctgtagtcagactgacctg

SEQ ID NO: 104612 - DNA, 20 bp, Artificial
  CRISPR gRNA sequence
gtagtcagactgacctgtag

SEQ ID NO: 104613 - DNA, 20 bp, Artificial
  CRISPR gRNA sequence
agtcagactgacctgtagaa

SEQ ID NO: 104614 - DNA, 20 bp, Artificial
  CRISPR gRNA sequence
gtcagactgacctgtagaag

SEQ ID NO: 104615 - DNA, 20 bp, Artificial
  CRISPR gRNA sequence
cagactgacctgtagaagag

SEQ ID NO: 104616 - DNA, 20 bp, Artificial
  CRISPR gRNA sequence
agactgacctgtagaagagg

SEQ ID NO: 104617 - DNA, 20 bp, Artificial
  CRISPR gRNA sequence
ttcaccttttgaaaactgct

SEQ ID NO: 104618 - DNA, 20 bp, Artificial
  CRISPR gRNA sequence
tcaccttttgaaaactgcta

SEQ ID NO: 104619 - DNA, 20 bp, Artificial
  CRISPR gRNA sequence
cttttgaaaactgctaagga

SEQ ID NO: 104620 - DNA, 20 bp, Artificial
  CRISPR gRNA sequence
tttgaaaactgctaaggata

SEQ ID NO: 104621 - DNA, 20 bp, Artificial
  CRISPR gRNA sequence
aggatagagttactcaaaac

SEQ ID NO: 104622 - DNA, 20 bp, Artificial
  CRISPR gRNA sequence
ggatagagttactcaaaact

SEQ ID NO: 104623 - DNA, 20 bp, Artificial
  CRISPR gRNA sequence
agttactcaaaactgggacc

SEQ ID NO: 104624 - DNA, 20 bp, Artificial
  CRISPR gRNA sequence
actcaaaactgggacctaga

SEQ ID NO: 104625 - DNA, 20 bp, Artificial
  CRISPR gRNA sequence
actgggacctagacagttaa

SEQ ID NO: 104626 - DNA, 20 bp, Artificial
  CRISPR gRNA sequence
agacagttaatagaatttca

SEQ ID NO: 104627 - DNA, 20 bp, Artificial
  CRISPR gRNA sequence
tttcaaagattgtgattact

SEQ ID NO: 104628 - DNA, 20 bp, Artificial
  CRISPR gRNA sequence
gtgattacttagattatata

SEQ ID NO: 104629 - DNA, 20 bp, Artificial
  CRISPR gRNA sequence
agattatatatagcacacca

SEQ ID NO: 104630 - DNA, 20 bp, Artificial
  CRISPR gRNA sequence
ttatatatagcacaccacag

SEQ ID NO: 104631 - DNA, 20 bp, Artificial
  CRISPR gRNA sequence
tatatatagcacaccacagt

SEQ ID NO: 104632 - DNA, 20 bp, Artificial
  CRISPR gRNA sequence
tatatagcacaccacagtgg

SEQ ID NO: 104633 - DNA, 20 bp, Artificial
  CRISPR gRNA sequence
tatagcacaccacagtggga

SEQ ID NO: 104634 - DNA, 20 bp, Artificial
  CRISPR gRNA sequence
ttttctccccttgtgttttt

SEQ ID NO: 104635 - DNA, 20 bp, Artificial
  CRISPR gRNA sequence
tgtttttcagtgtgttttgc

SEQ ID NO: 104636 - DNA, 20 bp, Artificial
  CRISPR gRNA sequence
gtttttcagtgtgttttgcc

SEQ ID NO: 104637 - DNA, 20 bp, Artificial
  CRISPR gRNA sequence
tcagtgtgttttgccaggat

SEQ ID NO: 104638 - DNA, 20 bp, Artificial
  CRISPR gRNA sequence
tgtgttttgccaggatcggt

SEQ ID NO: 104639 - DNA, 20 bp, Artificial
  CRISPR gRNA sequence
caggatcggtgagtgtatac

SEQ ID NO: 104640 - DNA, 20 bp, Artificial
  CRISPR gRNA sequence
atcggtgagtgtataccaga

SEQ ID NO: 104641 - DNA, 20 bp, Artificial
  CRISPR gRNA sequence
ggtgagtgtataccagatag

SEQ ID NO: 104642 - DNA, 20 bp, Artificial
  CRISPR gRNA sequence
tgagtgtataccagatagaa

SEQ ID NO: 104643 - DNA, 20 bp, Artificial
  CRISPR gRNA sequence
gagtgtataccagatagaag

SEQ ID NO: 104644 - DNA, 20 bp, Artificial
  CRISPR gRNA sequence
agtgtataccagatagaaga

SEQ ID NO: 104645 - DNA, 20 bp, Artificial
  CRISPR gRNA sequence
ttttatgttttgttttctta

SEQ ID NO: 104646 - DNA, 20 bp, Artificial
  CRISPR gRNA sequence
gttttgttttcttaaagtta

SEQ ID NO: 104647 - DNA, 20 bp, Artificial
  CRISPR gRNA sequence
taaagttacagtccctgttt

SEQ ID NO: 104648 - DNA, 20 bp, Artificial
  CRISPR gRNA sequence
aaagttacagtccctgtttc

SEQ ID NO: 104649 - DNA, 20 bp, Artificial
  CRISPR gRNA sequence
ttcaggcatgatcactatcc

SEQ ID NO: 104650 - DNA, 20 bp, Artificial
  CRISPR gRNA sequence
aggcatgatcactatcccag

SEQ ID NO: 104651 - DNA, 20 bp, Artificial
  CRISPR gRNA sequence
atgatcactatcccagcagc

SEQ ID NO: 104652 - DNA, 20 bp, Artificial
  CRISPR gRNA sequence
cactatcccagcagccagtt

SEQ ID NO: 104653 - DNA, 20 bp, Artificial
  CRISPR gRNA sequence
tatcccagcagccagtttgg

SEQ ID NO: 104654 - DNA, 20 bp, Artificial
  CRISPR gRNA sequence
atcccagcagccagtttggc

SEQ ID NO: 104655 - DNA, 20 bp, Artificial
  CRISPR gRNA sequence
cccagcagccagtttggcag

SEQ ID NO: 104656 - DNA, 20 bp, Artificial
  CRISPR gRNA sequence
cagccagtttggcaggagca

SEQ ID NO: 104657 - DNA, 20 bp, Artificial
  CRISPR gRNA sequence
aggagcacagattgttcaaa

SEQ ID NO: 104658 - DNA, 20 bp, Artificial
  CRISPR gRNA sequence
ggagcacagattgttcaaac

SEQ ID NO: 104659 - DNA, 20 bp, Artificial
  CRISPR gRNA sequence
agcacagattgttcaaacag

SEQ ID NO: 104660 - DNA, 20 bp, Artificial
  CRISPR gRNA sequence
ggagccaataccaacacaac

SEQ ID NO: 104661 - DNA, 20 bp, Artificial
  CRISPR gRNA sequence
gccaataccaacacaaccag

SEQ ID NO: 104662 - DNA, 20 bp, Artificial
  CRISPR gRNA sequence
aataccaacacaaccagcag

SEQ ID NO: 104663 - DNA, 20 bp, Artificial
  CRISPR gRNA sequence
ataccaacacaaccagcagt

SEQ ID NO: 104664 - DNA, 20 bp, Artificial
  CRISPR gRNA sequence
caacacaaccagcagtgggc

SEQ ID NO: 104665 - DNA, 20 bp, Artificial
  CRISPR gRNA sequence
aacacaaccagcagtgggca

SEQ ID NO: 104666 - DNA, 20 bp, Artificial
  CRISPR gRNA sequence
acacaaccagcagtgggcaa

SEQ ID NO: 104667 - DNA, 20 bp, Artificial
  CRISPR gRNA sequence
gactgtcactgtgacactac

SEQ ID NO: 104668 - DNA, 20 bp, Artificial
  CRISPR gRNA sequence
tgtcactgtgacactaccag

SEQ ID NO: 104669 - DNA, 20 bp, Artificial
  CRISPR gRNA sequence
cactgtgacactaccagtgg

SEQ ID NO: 104670 - DNA, 20 bp, Artificial
  CRISPR gRNA sequence
actgtgacactaccagtggc

SEQ ID NO: 104671 - DNA, 20 bp, Artificial
  CRISPR gRNA sequence
actaccagtggcaggcaatg

SEQ ID NO: 104672 - DNA, 20 bp, Artificial
  CRISPR gRNA sequence
ggcaggcaatgtggtcaatt

SEQ ID NO: 104673 - DNA, 20 bp, Artificial
  CRISPR gRNA sequence
gcaggcaatgtggtcaattc

SEQ ID NO: 104674 - DNA, 20 bp, Artificial
  CRISPR gRNA sequence
aggcaatgtggtcaattcag

SEQ ID NO: 104675 - DNA, 20 bp, Artificial
  CRISPR gRNA sequence
ggcaatgtggtcaattcagg

SEQ ID NO: 104676 - DNA, 20 bp, Artificial
  CRISPR gRNA sequence
gcaatgtggtcaattcagga

SEQ ID NO: 104677 - DNA, 20 bp, Artificial
  CRISPR gRNA sequence
tgtggtcaattcaggaggga

SEQ ID NO: 104678 - DNA, 20 bp, Artificial
  CRISPR gRNA sequence
caattcaggagggatggtca

SEQ ID NO: 104679 - DNA, 20 bp, Artificial
  CRISPR gRNA sequence
tcaggagggatggtcatggt

SEQ ID NO: 104680 - DNA, 20 bp, Artificial
  CRISPR gRNA sequence
tggtaagaaaatgtattttt

SEQ ID NO: 104681 - DNA, 20 bp, Artificial
  CRISPR gRNA sequence
aatttattatgttgacctct

SEQ ID NO: 104682 - DNA, 20 bp, Artificial
  CRISPR gRNA sequence
atttattatgttgacctctt

SEQ ID NO: 104683 - DNA, 20 bp, Artificial
  CRISPR gRNA sequence
tatgttgacctcttgggatt

SEQ ID NO: 104684 - DNA, 20 bp, Artificial
  CRISPR gRNA sequence
tgggattgagatcgatcctt

SEQ ID NO: 104685 - DNA, 20 bp, Artificial
  CRISPR gRNA sequence
gggattgagatcgatcctta

SEQ ID NO: 104686 - DNA, 20 bp, Artificial
  CRISPR gRNA sequence
atcgatccttaaggcactgt

SEQ ID NO: 104687 - DNA, 20 bp, Artificial
  CRISPR gRNA sequence
gacaaaccataattcattct

SEQ ID NO: 104688 - DNA, 20 bp, Artificial
  CRISPR gRNA sequence
tctgagcacctactatgtgc

SEQ ID NO: 104689 - DNA, 20 bp, Artificial
  CRISPR gRNA sequence
ctgagcacctactatgtgcc

SEQ ID NO: 104690 - DNA, 20 bp, Artificial
  CRISPR gRNA sequence
tgagcacctactatgtgcca

SEQ ID NO: 104691 - DNA, 20 bp, Artificial
  CRISPR gRNA sequence
atgtgccagggactattcac

SEQ ID NO: 104692 - DNA, 20 bp, Artificial
  CRISPR gRNA sequence
tgtgccagggactattcacc

SEQ ID NO: 104693 - DNA, 20 bp, Artificial
  CRISPR gRNA sequence
gtgccagggactattcacca

SEQ ID NO: 104694 - DNA, 20 bp, Artificial
  CRISPR gRNA sequence
ctattcaccagggactattc

SEQ ID NO: 104695 - DNA, 20 bp, Artificial
  CRISPR gRNA sequence
ccagggactattctagatgc

SEQ ID NO: 104696 - DNA, 20 bp, Artificial
  CRISPR gRNA sequence
agggactattctagatgctg

SEQ ID NO: 104697 - DNA, 20 bp, Artificial
  CRISPR gRNA sequence
tattctagatgctggagata

SEQ ID NO: 104698 - DNA, 20 bp, Artificial
  CRISPR gRNA sequence
agatgctggagataaagcaa

SEQ ID NO: 104699 - DNA, 20 bp, Artificial
  CRISPR gRNA sequence
gagataaagcaatggataaa

SEQ ID NO: 104700 - DNA, 20 bp, Artificial
  CRISPR gRNA sequence
atggataaatagtgatttta

SEQ ID NO: 104701 - DNA, 20 bp, Artificial
  CRISPR gRNA sequence
tgattttatggaattctttt

SEQ ID NO: 104702 - DNA, 20 bp, Artificial
  CRISPR gRNA sequence
ttttcagaattcaaataacg

SEQ ID NO: 104703 - DNA, 20 bp, Artificial
  CRISPR gRNA sequence
tttcagaattcaaataacga

SEQ ID NO: 104704 - DNA, 20 bp, Artificial
  CRISPR gRNA sequence
ttcagaattcaaataacgaa

SEQ ID NO: 104705 - DNA, 20 bp, Artificial
  CRISPR gRNA sequence
ggaattatatactaatcttt

SEQ ID NO: 104706 - DNA, 20 bp, Artificial
  CRISPR gRNA sequence
attatatactaatctttgag

SEQ ID NO: 104707 - DNA, 20 bp, Artificial
  CRISPR gRNA sequence
atatactaatctttgagaag

SEQ ID NO: 104708 - DNA, 20 bp, Artificial
  CRISPR gRNA sequence
actaatctttgagaagtgga

SEQ ID NO: 104709 - DNA, 20 bp, Artificial
  CRISPR gRNA sequence
aatctttgagaagtggaaag

SEQ ID NO: 104710 - DNA, 20 bp, Artificial
  CRISPR gRNA sequence
gaaagtagtattgcccatga

SEQ ID NO: 104711 - DNA, 20 bp, Artificial
  CRISPR gRNA sequence
ttgcccatgatggacaaaat

SEQ ID NO: 104712 - DNA, 20 bp, Artificial
  CRISPR gRNA sequence
tgatggacaaaataagaaat

SEQ ID NO: 104713 - DNA, 20 bp, Artificial
  CRISPR gRNA sequence
ataagaaataagctaaaaat

SEQ ID NO: 104714 - DNA, 20 bp, Artificial
  CRISPR gRNA sequence
gaaataagctaaaaattaga

SEQ ID NO: 104715 - DNA, 20 bp, Artificial
  CRISPR gRNA sequence
attagaaagattgtaattga

SEQ ID NO: 104716 - DNA, 20 bp, Artificial
  CRISPR gRNA sequence
tagaaagattgtaattgata

SEQ ID NO: 104717 - DNA, 20 bp, Artificial
  CRISPR gRNA sequence
tgatagagaaaccaaaaaaa

SEQ ID NO: 104718 - DNA, 20 bp, Artificial
  CRISPR gRNA sequence
aaagtgtcatgtaaatgtat

SEQ ID NO: 104719 - DNA, 20 bp, Artificial
  CRISPR gRNA sequence
aagtgtcatgtaaatgtatt

SEQ ID NO: 104720 - DNA, 20 bp, Artificial
  CRISPR gRNA sequence
tgtcatgtaaatgtattggg

SEQ ID NO: 104721 - DNA, 20 bp, Artificial
  CRISPR gRNA sequence
atgtaaatgtattgggaaga

SEQ ID NO: 104722 - DNA, 20 bp, Artificial
  CRISPR gRNA sequence
tgtaaatgtattgggaagat

SEQ ID NO: 104723 - DNA, 20 bp, Artificial
  CRISPR gRNA sequence
aaatgtattgggaagatagg

SEQ ID NO: 104724 - DNA, 20 bp, Artificial
  CRISPR gRNA sequence
attgggaagataggaagatt

SEQ ID NO: 104725 - DNA, 20 bp, Artificial
  CRISPR gRNA sequence
ttgggaagataggaagattt

SEQ ID NO: 104726 - DNA, 20 bp, Artificial
  CRISPR gRNA sequence
ggaagataggaagatttggg

SEQ ID NO: 104727 - DNA, 20 bp, Artificial
  CRISPR gRNA sequence
gatttgggtggtgtaactga

SEQ ID NO: 104728 - DNA, 20 bp, Artificial
  CRISPR gRNA sequence
taaatcctcatatgtcaaaa

SEQ ID NO: 104729 - DNA, 20 bp, Artificial
  CRISPR gRNA sequence
aaatcctcatatgtcaaaat

SEQ ID NO: 104730 - DNA, 20 bp, Artificial
  CRISPR gRNA sequence
gatgttaaaatgcataaatt

SEQ ID NO: 104731 - DNA, 20 bp, Artificial
  CRISPR gRNA sequence
aaaatgcataaattaagaat

SEQ ID NO: 104732 - DNA, 20 bp, Artificial
  CRISPR gRNA sequence
cataaattaagaatgagtaa

SEQ ID NO: 104733 - DNA, 20 bp, Artificial
  CRISPR gRNA sequence
aaattaagaatgagtaacag

SEQ ID NO: 104734 - DNA, 20 bp, Artificial
  CRISPR gRNA sequence
atgagtaacagaagtctgca

SEQ ID NO: 104735 - DNA, 20 bp, Artificial
  CRISPR gRNA sequence
gagtaacagaagtctgcaca

SEQ ID NO: 104736 - DNA, 20 bp, Artificial
  CRISPR gRNA sequence
agtaacagaagtctgcacag

SEQ ID NO: 104737 - DNA, 20 bp, Artificial
  CRISPR gRNA sequence
aacagaagtctgcacagagg

SEQ ID NO: 104738 - DNA, 20 bp, Artificial
  CRISPR gRNA sequence
cagaagtctgcacagaggtg

SEQ ID NO: 104739 - DNA, 20 bp, Artificial
  CRISPR gRNA sequence
agaagtctgcacagaggtgg

SEQ ID NO: 104740 - DNA, 20 bp, Artificial
  CRISPR gRNA sequence
agtctgcacagaggtggagg

SEQ ID NO: 104741 - DNA, 20 bp, Artificial
  CRISPR gRNA sequence
gaggtggaggaagctatgaa

SEQ ID NO: 104742 - DNA, 20 bp, Artificial
  CRISPR gRNA sequence
gaggaagctatgaaaagaaa

SEQ ID NO: 104743 - DNA, 20 bp, Artificial
  CRISPR gRNA sequence
aaaagaaacagaaccaaccc

SEQ ID NO: 104744 - DNA, 20 bp, Artificial
  CRISPR gRNA sequence
aaacagaaccaaccctggct

SEQ ID NO: 104745 - DNA, 20 bp, Artificial
  CRISPR gRNA sequence
cagaaccaaccctggctcag

SEQ ID NO: 104746 - DNA, 20 bp, Artificial
  CRISPR gRNA sequence
ggctcagtggcatgcacctg

SEQ ID NO: 104747 - DNA, 20 bp, Artificial
  CRISPR gRNA sequence
gtggcatgcacctgtagtcc

SEQ ID NO: 104748 - DNA, 20 bp, Artificial
  CRISPR gRNA sequence
cacctgtagtcctagctact

SEQ ID NO: 104749 - DNA, 20 bp, Artificial
  CRISPR gRNA sequence
acctgtagtcctagctactt

SEQ ID NO: 104750 - DNA, 20 bp, Artificial
  CRISPR gRNA sequence
ctgtagtcctagctacttgg

SEQ ID NO: 104751 - DNA, 20 bp, Artificial
  CRISPR gRNA sequence
tgtagtcctagctacttggg

SEQ ID NO: 104752 - DNA, 20 bp, Artificial
  CRISPR gRNA sequence
agctacttgggaggctaatc

SEQ ID NO: 104753 - DNA, 20 bp, Artificial
  CRISPR gRNA sequence
gctacttgggaggctaatcc

SEQ ID NO: 104754 - DNA, 20 bp, Artificial
  CRISPR gRNA sequence
tacttgggaggctaatccag

SEQ ID NO: 104755 - DNA, 20 bp, Artificial
  CRISPR gRNA sequence
acttgggaggctaatccagg

SEQ ID NO: 104756 - DNA, 20 bp, Artificial
  CRISPR gRNA sequence
gggaggctaatccaggagga

SEQ ID NO: 104757 - DNA, 20 bp, Artificial
  CRISPR gRNA sequence
ctaatccaggaggatggctt

SEQ ID NO: 104758 - DNA, 20 bp, Artificial
  CRISPR gRNA sequence
ccaggaggatggcttaagtc

SEQ ID NO: 104759 - DNA, 20 bp, Artificial
  CRISPR gRNA sequence
caggaggatggcttaagtcc

SEQ ID NO: 104760 - DNA, 20 bp, Artificial
  CRISPR gRNA sequence
ggaggatggcttaagtccag

SEQ ID NO: 104761 - DNA, 20 bp, Artificial
  CRISPR gRNA sequence
tggcttaagtccaggagttt

SEQ ID NO: 104762 - DNA, 20 bp, Artificial
  CRISPR gRNA sequence
taagtccaggagtttgagct

SEQ ID NO: 104763 - DNA, 20 bp, Artificial
  CRISPR gRNA sequence
ccaggagtttgagctcagcc

SEQ ID NO: 104764 - DNA, 20 bp, Artificial
  CRISPR gRNA sequence
caggagtttgagctcagcct

SEQ ID NO: 104765 - DNA, 20 bp, Artificial
  CRISPR gRNA sequence
tgagctcagcctgggcaatg

SEQ ID NO: 104766 - DNA, 20 bp, Artificial
  CRISPR gRNA sequence
agctcagcctgggcaatgta

SEQ ID NO: 104767 - DNA, 20 bp, Artificial
  CRISPR gRNA sequence
ctcagcctgggcaatgtaga

SEQ ID NO: 104768 - DNA, 20 bp, Artificial
  CRISPR gRNA sequence
aaaataaataatttttataa

SEQ ID NO: 104769 - DNA, 20 bp, Artificial
  CRISPR gRNA sequence
tttttataaaagattcaata

SEQ ID NO: 104770 - DNA, 20 bp, Artificial
  CRISPR gRNA sequence
agattcaatacagttattca

SEQ ID NO: 104771 - DNA, 20 bp, Artificial
  CRISPR gRNA sequence
ttcaatacagttattcaaag

SEQ ID NO: 104772 - DNA, 20 bp, Artificial
  CRISPR gRNA sequence
ttattcaaagcggttgtatt

SEQ ID NO: 104773 - DNA, 20 bp, Artificial
  CRISPR gRNA sequence
tattcaaagcggttgtattt

SEQ ID NO: 104774 - DNA, 20 bp, Artificial
  CRISPR gRNA sequence
caaagcggttgtatttggga

SEQ ID NO: 104775 - DNA, 20 bp, Artificial
  CRISPR gRNA sequence
aagcggttgtatttgggaaa

SEQ ID NO: 104776 - DNA, 20 bp, Artificial
  CRISPR gRNA sequence
ttgtatttgggaaagagctg

SEQ ID NO: 104777 - DNA, 20 bp, Artificial
  CRISPR gRNA sequence
tgtatttgggaaagagctgt

SEQ ID NO: 104778 - DNA, 20 bp, Artificial
  CRISPR gRNA sequence
gtatttgggaaagagctgtg

SEQ ID NO: 104779 - DNA, 20 bp, Artificial
  CRISPR gRNA sequence
tgggaaagagctgtggggta

SEQ ID NO: 104780 - DNA, 20 bp, Artificial
  CRISPR gRNA sequence
gggaaagagctgtggggtac

SEQ ID NO: 104781 - DNA, 20 bp, Artificial
  CRISPR gRNA sequence
tacttgtttttacctacatt

SEQ ID NO: 104782 - DNA, 20 bp, Artificial
  CRISPR gRNA sequence
gtttttacctacatttagta

SEQ ID NO: 104783 - DNA, 20 bp, Artificial
  CRISPR gRNA sequence
ctacatttagtacagtgttt

SEQ ID NO: 104784 - DNA, 20 bp, Artificial
  CRISPR gRNA sequence
acagtgttttggtgtttttt

SEQ ID NO: 104785 - DNA, 20 bp, Artificial
  CRISPR gRNA sequence
tggtgttttttaagaaaaat

SEQ ID NO: 104786 - DNA, 20 bp, Artificial
  CRISPR gRNA sequence
ggtgttttttaagaaaaatt

SEQ ID NO: 104787 - DNA, 20 bp, Artificial
  CRISPR gRNA sequence
aaaaattaggattgaattat

SEQ ID NO: 104788 - DNA, 20 bp, Artificial
  CRISPR gRNA sequence
aactattatttttataaata

SEQ ID NO: 104789 - DNA, 20 bp, Artificial
  CRISPR gRNA sequence
actattatttttataaatat

SEQ ID NO: 104790 - DNA, 20 bp, Artificial
  CRISPR gRNA sequence
tttttataaatataggcatt

SEQ ID NO: 104791 - DNA, 20 bp, Artificial
  CRISPR gRNA sequence
ttataaatataggcatttag

SEQ ID NO: 104792 - DNA, 20 bp, Artificial
  CRISPR gRNA sequence
tataggcatttagtagcact

SEQ ID NO: 104793 - DNA, 20 bp, Artificial
  CRISPR gRNA sequence
tgactactgttcctgaccat

SEQ ID NO: 104794 - DNA, 20 bp, Artificial
  CRISPR gRNA sequence
tactgttcctgaccattaga

SEQ ID NO: 104795 - DNA, 20 bp, Artificial
  CRISPR gRNA sequence
tgttcctgaccattagatgg

SEQ ID NO: 104796 - DNA, 20 bp, Artificial
  CRISPR gRNA sequence
tcctgaccattagatggcag

SEQ ID NO: 104797 - DNA, 20 bp, Artificial
  CRISPR gRNA sequence
tagatggcagcagaaatatc

SEQ ID NO: 104798 - DNA, 20 bp, Artificial
  CRISPR gRNA sequence
gatggcagcagaaatatcta

SEQ ID NO: 104799 - DNA, 20 bp, Artificial
  CRISPR gRNA sequence
agcagaaatatctagagcca

SEQ ID NO: 104800 - DNA, 20 bp, Artificial
  CRISPR gRNA sequence
gcagaaatatctagagccat

SEQ ID NO: 104801 - DNA, 20 bp, Artificial
  CRISPR gRNA sequence
gaaatatctagagccatggg

SEQ ID NO: 104802 - DNA, 20 bp, Artificial
  CRISPR gRNA sequence
agccatgggtggacatgaat

SEQ ID NO: 104803 - DNA, 20 bp, Artificial
  CRISPR gRNA sequence
gccatgggtggacatgaatt

SEQ ID NO: 104804 - DNA, 20 bp, Artificial
  CRISPR gRNA sequence
ccatgggtggacatgaatta

SEQ ID NO: 104805 - DNA, 20 bp, Artificial
  CRISPR gRNA sequence
ggtggacatgaattagggca

SEQ ID NO: 104806 - DNA, 20 bp, Artificial
  CRISPR gRNA sequence
tgaattagggcatggttata

SEQ ID NO: 104807 - DNA, 20 bp, Artificial
  CRISPR gRNA sequence
ggcatggttatatagtttct

SEQ ID NO: 104808 - DNA, 20 bp, Artificial
  CRISPR gRNA sequence
catggttatatagtttctca

SEQ ID NO: 104809 - DNA, 20 bp, Artificial
  CRISPR gRNA sequence
ggttatatagtttctcagag

SEQ ID NO: 104810 - DNA, 20 bp, Artificial
  CRISPR gRNA sequence
cacctgaatctcctatgaca

SEQ ID NO: 104811 - DNA, 20 bp, Artificial
  CRISPR gRNA sequence
tctcctatgacacagtcatc

SEQ ID NO: 104812 - DNA, 20 bp, Artificial
  CRISPR gRNA sequence
ctcctatgacacagtcatct

SEQ ID NO: 104813 - DNA, 20 bp, Artificial
  CRISPR gRNA sequence
tcctatgacacagtcatctg

SEQ ID NO: 104814 - DNA, 20 bp, Artificial
  CRISPR gRNA sequence
tcatctggggtgtttgttta

SEQ ID NO: 104815 - DNA, 20 bp, Artificial
  CRISPR gRNA sequence
tggggtgtttgtttaaagtg

SEQ ID NO: 104816 - DNA, 20 bp, Artificial
  CRISPR gRNA sequence
ttgtttaaagtgcagatctt

SEQ ID NO: 104817 - DNA, 20 bp, Artificial
  CRISPR gRNA sequence
atctttagtataaatttctc

SEQ ID NO: 104818 - DNA, 20 bp, Artificial
  CRISPR gRNA sequence
tctttagtataaatttctcc

SEQ ID NO: 104819 - DNA, 20 bp, Artificial
  CRISPR gRNA sequence
ctttagtataaatttctcca

SEQ ID NO: 104820 - DNA, 20 bp, Artificial
  CRISPR gRNA sequence
ccagggatccgcatttaccc

SEQ ID NO: 104821 - DNA, 20 bp, Artificial
  CRISPR gRNA sequence
cctataaaaattactttttg

SEQ ID NO: 104822 - DNA, 20 bp, Artificial
  CRISPR gRNA sequence
tgtggcatttacaaaaaaaa

SEQ ID NO: 104823 - DNA, 20 bp, Artificial
  CRISPR gRNA sequence
atttacaaaaaaaatggatg

SEQ ID NO: 104824 - DNA, 20 bp, Artificial
  CRISPR gRNA sequence
ttacaaaaaaaatggatgaa

SEQ ID NO: 104825 - DNA, 20 bp, Artificial
  CRISPR gRNA sequence
tacaaaaaaaatggatgaag

SEQ ID NO: 104826 - DNA, 20 bp, Artificial
  CRISPR gRNA sequence
aaaatggatgaagaggaacc

SEQ ID NO: 104827 - DNA, 20 bp, Artificial
  CRISPR gRNA sequence
ccatacttcatgccaccaat

SEQ ID NO: 104828 - DNA, 20 bp, Artificial
  CRISPR gRNA sequence
ttcatgccaccaataagctc

SEQ ID NO: 104829 - DNA, 20 bp, Artificial
  CRISPR gRNA sequence
gctctggtttcctgttcaca

SEQ ID NO: 104830 - DNA, 20 bp, Artificial
  CRISPR gRNA sequence
tggtttcctgttcacacaga

SEQ ID NO: 104831 - DNA, 20 bp, Artificial
  CRISPR gRNA sequence
ctgttcacacagatggttcc

SEQ ID NO: 104832 - DNA, 20 bp, Artificial
  CRISPR gRNA sequence
tgttcacacagatggttcct

SEQ ID NO: 104833 - DNA, 20 bp, Artificial
  CRISPR gRNA sequence
gttcacacagatggttcctg

SEQ ID NO: 104834 - DNA, 20 bp, Artificial
  CRISPR gRNA sequence
acacagatggttcctggggc

SEQ ID NO: 104835 - DNA, 20 bp, Artificial
  CRISPR gRNA sequence
ggctctgtgcctgctatcca

SEQ ID NO: 104836 - DNA, 20 bp, Artificial
  CRISPR gRNA sequence
atccaaagaatccctctacc

SEQ ID NO: 104837 - DNA, 20 bp, Artificial
  CRISPR gRNA sequence
ccaaagaatccctctacctg

SEQ ID NO: 104838 - DNA, 20 bp, Artificial
  CRISPR gRNA sequence
aagaatccctctacctggag

SEQ ID NO: 104839 - DNA, 20 bp, Artificial
  CRISPR gRNA sequence
gaatccctctacctggagca

SEQ ID NO: 104840 - DNA, 20 bp, Artificial
  CRISPR gRNA sequence
acctggagcagagatgcttg

SEQ ID NO: 104841 - DNA, 20 bp, Artificial
  CRISPR gRNA sequence
tggagcagagatgcttgaag

SEQ ID NO: 104842 - DNA, 20 bp, Artificial
  CRISPR gRNA sequence
gagcagagatgcttgaagaa

SEQ ID NO: 104843 - DNA, 20 bp, Artificial
  CRISPR gRNA sequence
aacaataccaccgtattctt

SEQ ID NO: 104844 - DNA, 20 bp, Artificial
  CRISPR gRNA sequence
caataccaccgtattcttaa

SEQ ID NO: 104845 - DNA, 20 bp, Artificial
  CRISPR gRNA sequence
aataccaccgtattcttaag

SEQ ID NO: 104846 - DNA, 20 bp, Artificial
  CRISPR gRNA sequence
taccaccgtattcttaagag

SEQ ID NO: 104847 - DNA, 20 bp, Artificial
  CRISPR gRNA sequence
accaccgtattcttaagagg

SEQ ID NO: 104848 - DNA, 20 bp, Artificial
  CRISPR gRNA sequence
ccgtattcttaagaggaggc

SEQ ID NO: 104849 - DNA, 20 bp, Artificial
  CRISPR gRNA sequence
tcttaagaggaggcaagccc

SEQ ID NO: 104850 - DNA, 20 bp, Artificial
  CRISPR gRNA sequence
gaggcaagcccgagctaaac

SEQ ID NO: 104851 - DNA, 20 bp, Artificial
  CRISPR gRNA sequence
ggcaagcccgagctaaacta

SEQ ID NO: 104852 - DNA, 20 bp, Artificial
  CRISPR gRNA sequence
gcaagcccgagctaaactag

SEQ ID NO: 104853 - DNA, 20 bp, Artificial
  CRISPR gRNA sequence
agcccgagctaaactagagg

SEQ ID NO: 104854 - DNA, 20 bp, Artificial
  CRISPR gRNA sequence
ccgagctaaactagaggcag

SEQ ID NO: 104855 - DNA, 20 bp, Artificial
  CRISPR gRNA sequence
cgagctaaactagaggcaga

SEQ ID NO: 104856 - DNA, 20 bp, Artificial
  CRISPR gRNA sequence
gagctaaactagaggcagaa

SEQ ID NO: 104857 - DNA, 20 bp, Artificial
  CRISPR gRNA sequence
aggcagaagggaaaattcca

SEQ ID NO: 104858 - DNA, 20 bp, Artificial
  CRISPR gRNA sequence
ggcagaagggaaaattccaa

SEQ ID NO: 104859 - DNA, 20 bp, Artificial
  CRISPR gRNA sequence
cagaagggaaaattccaaag

SEQ ID NO: 104860 - DNA, 20 bp, Artificial
  CRISPR gRNA sequence
gaagggaaaattccaaagga

SEQ ID NO: 104861 - DNA, 20 bp, Artificial
  CRISPR gRNA sequence
gggaaaattccaaaggagag

SEQ ID NO: 104862 - DNA, 20 bp, Artificial
  CRISPR gRNA sequence
ggaaaattccaaaggagaga

SEQ ID NO: 104863 - DNA, 20 bp, Artificial
  CRISPR gRNA sequence
gaaaattccaaaggagagaa

SEQ ID NO: 104864 - DNA, 20 bp, Artificial
  CRISPR gRNA sequence
gagaagggtatgtataacat

SEQ ID NO: 104865 - DNA, 20 bp, Artificial
  CRISPR gRNA sequence
agaagggtatgtataacatt

SEQ ID NO: 104866 - DNA, 20 bp, Artificial
  CRISPR gRNA sequence
agggtatgtataacattggg

SEQ ID NO: 104867 - DNA, 20 bp, Artificial
  CRISPR gRNA sequence
gggtatgtataacattggga

SEQ ID NO: 104868 - DNA, 20 bp, Artificial
  CRISPR gRNA sequence
gtataacattgggaaggata

SEQ ID NO: 104869 - DNA, 20 bp, Artificial
  CRISPR gRNA sequence
tataacattgggaaggatat

SEQ ID NO: 104870 - DNA, 20 bp, Artificial
  CRISPR gRNA sequence
acattgggaaggatatagga

SEQ ID NO: 104871 - DNA, 20 bp, Artificial
  CRISPR gRNA sequence
cattgggaaggatataggaa

SEQ ID NO: 104872 - DNA, 20 bp, Artificial
  CRISPR gRNA sequence
ttgggaaggatataggaaag

SEQ ID NO: 104873 - DNA, 20 bp, Artificial
  CRISPR gRNA sequence
aaggatataggaaaggagaa

SEQ ID NO: 104874 - DNA, 20 bp, Artificial
  CRISPR gRNA sequence
gatataggaaaggagaatag

SEQ ID NO: 104875 - DNA, 20 bp, Artificial
  CRISPR gRNA sequence
atataggaaaggagaatagc

SEQ ID NO: 104876 - DNA, 20 bp, Artificial
  CRISPR gRNA sequence
tataggaaaggagaatagca

SEQ ID NO: 104877 - DNA, 20 bp, Artificial
  CRISPR gRNA sequence
ttttgaaattatcttttata

SEQ ID NO: 104878 - DNA, 20 bp, Artificial
  CRISPR gRNA sequence
accttccaaacaattgacgt

SEQ ID NO: 104879 - DNA, 20 bp, Artificial
  CRISPR gRNA sequence
atacttgttgtctcttttgt

SEQ ID NO: 104880 - DNA, 20 bp, Artificial
  CRISPR gRNA sequence
acttgttgtctcttttgtaa

SEQ ID NO: 104881 - DNA, 20 bp, Artificial
  CRISPR gRNA sequence
gttgtctcttttgtaagagt

SEQ ID NO: 104882 - DNA, 20 bp, Artificial
  CRISPR gRNA sequence
catttgttattactaatatg

SEQ ID NO: 104883 - DNA, 20 bp, Artificial
  CRISPR gRNA sequence
ttattactaatatgcagctg

SEQ ID NO: 104884 - DNA, 20 bp, Artificial
  CRISPR gRNA sequence
gttataataacgaaaacaaa

SEQ ID NO: 104885 - DNA, 20 bp, Artificial
  CRISPR gRNA sequence
ataataacgaaaacaaacag

SEQ ID NO: 104886 - DNA, 20 bp, Artificial
  CRISPR gRNA sequence
aaacaaacagtggcttaaat

SEQ ID NO: 104887 - DNA, 20 bp, Artificial
  CRISPR gRNA sequence
ttattccttttcatacataa

SEQ ID NO: 104888 - DNA, 20 bp, Artificial
  CRISPR gRNA sequence
ttccttttcatacataaaag

SEQ ID NO: 104889 - DNA, 20 bp, Artificial
  CRISPR gRNA sequence
tttcatacataaaagtagtc

SEQ ID NO: 104890 - DNA, 20 bp, Artificial
  CRISPR gRNA sequence
tcatacataaaagtagtcca

SEQ ID NO: 104891 - DNA, 20 bp, Artificial
  CRISPR gRNA sequence
agtccagagataaattatcc

SEQ ID NO: 104892 - DNA, 20 bp, Artificial
  CRISPR gRNA sequence
agagataaattatcctggac

SEQ ID NO: 104893 - DNA, 20 bp, Artificial
  CRISPR gRNA sequence
gataaattatcctggactgg

SEQ ID NO: 104894 - DNA, 20 bp, Artificial
  CRISPR gRNA sequence
ggactggtagcacattttca

SEQ ID NO: 104895 - DNA, 20 bp, Artificial
  CRISPR gRNA sequence
agcacattttcacagttctc

SEQ ID NO: 104896 - DNA, 20 bp, Artificial
  CRISPR gRNA sequence
tttcactgctttaatattgc

SEQ ID NO: 104897 - DNA, 20 bp, Artificial
  CRISPR gRNA sequence
tattgctagtgtgctgttca

SEQ ID NO: 104898 - DNA, 20 bp, Artificial
  CRISPR gRNA sequence
tagtgtgctgttcatggtcc

SEQ ID NO: 104899 - DNA, 20 bp, Artificial
  CRISPR gRNA sequence
catggtccaagattcctgct

SEQ ID NO: 104900 - DNA, 20 bp, Artificial
  CRISPR gRNA sequence
atggtccaagattcctgctt

SEQ ID NO: 104901 - DNA, 20 bp, Artificial
  CRISPR gRNA sequence
caagattcctgcttaggctc

SEQ ID NO: 104902 - DNA, 20 bp, Artificial
  CRISPR gRNA sequence
ttcctgcttaggctccagcc

SEQ ID NO: 104903 - DNA, 20 bp, Artificial
  CRISPR gRNA sequence
tcctgcttaggctccagcct

SEQ ID NO: 104904 - DNA, 20 bp, Artificial
  CRISPR gRNA sequence
tgcttaggctccagcctagg

SEQ ID NO: 104905 - DNA, 20 bp, Artificial
  CRISPR gRNA sequence
taggctccagcctaggaaga

SEQ ID NO: 104906 - DNA, 20 bp, Artificial
  CRISPR gRNA sequence
aggctccagcctaggaagaa

SEQ ID NO: 104907 - DNA, 20 bp, Artificial
  CRISPR gRNA sequence
ggctccagcctaggaagaaa

SEQ ID NO: 104908 - DNA, 20 bp, Artificial
  CRISPR gRNA sequence
agcctaggaagaaagggaac

SEQ ID NO: 104909 - DNA, 20 bp, Artificial
  CRISPR gRNA sequence
taggaagaaagggaacaaga

SEQ ID NO: 104910 - DNA, 20 bp, Artificial
  CRISPR gRNA sequence
aggaagaaagggaacaagaa

SEQ ID NO: 104911 - DNA, 20 bp, Artificial
  CRISPR gRNA sequence
ttcttttttttttttttcct

SEQ ID NO: 104912 - DNA, 20 bp, Artificial
  CRISPR gRNA sequence
tttttttttttcctgagact

SEQ ID NO: 104913 - DNA, 20 bp, Artificial
  CRISPR gRNA sequence
ctcagtcttgctctgtcatc

SEQ ID NO: 104914 - DNA, 20 bp, Artificial
  CRISPR gRNA sequence
tcagtcttgctctgtcatcc

SEQ ID NO: 104915 - DNA, 20 bp, Artificial
  CRISPR gRNA sequence
tcttgctctgtcatccaggc

SEQ ID NO: 104916 - DNA, 20 bp, Artificial
  CRISPR gRNA sequence
ttgctctgtcatccaggccg

SEQ ID NO: 104917 - DNA, 20 bp, Artificial
  CRISPR gRNA sequence
ctgtcatccaggccggagtg

SEQ ID NO: 104918 - DNA, 20 bp, Artificial
  CRISPR gRNA sequence
tcatccaggccggagtgcag

SEQ ID NO: 104919 - DNA, 20 bp, Artificial
  CRISPR gRNA sequence
ggagtgcagtggcacaatct

SEQ ID NO: 104920 - DNA, 20 bp, Artificial
  CRISPR gRNA sequence
aacctgcaccttccatgttc

SEQ ID NO: 104921 - DNA, 20 bp, Artificial
  CRISPR gRNA sequence
ttcaagtgattctcctgcct

SEQ ID NO: 104922 - DNA, 20 bp, Artificial
  CRISPR gRNA sequence
ttctcctgcctcagcctcct

SEQ ID NO: 104923 - DNA, 20 bp, Artificial
  CRISPR gRNA sequence
tcctgcctcagcctcctgag

SEQ ID NO: 104924 - DNA, 20 bp, Artificial
  CRISPR gRNA sequence
gcctcagcctcctgagtagc

SEQ ID NO: 104925 - DNA, 20 bp, Artificial
  CRISPR gRNA sequence
cctcagcctcctgagtagct

SEQ ID NO: 104926 - DNA, 20 bp, Artificial
  CRISPR gRNA sequence
ctcctgagtagctgggatta

SEQ ID NO: 104927 - DNA, 20 bp, Artificial
  CRISPR gRNA sequence
tcctgagtagctgggattac

SEQ ID NO: 104928 - DNA, 20 bp, Artificial
  CRISPR gRNA sequence
caggtgtgcgccaccacgcc

SEQ ID NO: 104929 - DNA, 20 bp, Artificial
  CRISPR gRNA sequence
ccagcttatttttgtgtttt

SEQ ID NO: 104930 - DNA, 20 bp, Artificial
  CRISPR gRNA sequence
gcttatttttgtgtttttag

SEQ ID NO: 104931 - DNA, 20 bp, Artificial
  CRISPR gRNA sequence
ttatttttgtgtttttagta

SEQ ID NO: 104932 - DNA, 20 bp, Artificial
  CRISPR gRNA sequence
ttttgtgtttttagtagaga

SEQ ID NO: 104933 - DNA, 20 bp, Artificial
  CRISPR gRNA sequence
tttgtgtttttagtagagac

SEQ ID NO: 104934 - DNA, 20 bp, Artificial
  CRISPR gRNA sequence
ttgtgtttttagtagagacg

SEQ ID NO: 104935 - DNA, 20 bp, Artificial
  CRISPR gRNA sequence
gagacggggtttcaccatgt

SEQ ID NO: 104936 - DNA, 20 bp, Artificial
  CRISPR gRNA sequence
cggggtttcaccatgttggc

SEQ ID NO: 104937 - DNA, 20 bp, Artificial
  CRISPR gRNA sequence
ggggtttcaccatgttggcc

SEQ ID NO: 104938 - DNA, 20 bp, Artificial
  CRISPR gRNA sequence
tttcaccatgttggccaggc

SEQ ID NO: 104939 - DNA, 20 bp, Artificial
  CRISPR gRNA sequence
tggtctcgaactcctgacct

SEQ ID NO: 104940 - DNA, 20 bp, Artificial
  CRISPR gRNA sequence
ggtctcgaactcctgacctc

SEQ ID NO: 104941 - DNA, 20 bp, Artificial
  CRISPR gRNA sequence
cctcaggtgatccacctgcc

SEQ ID NO: 104942 - DNA, 20 bp, Artificial
  CRISPR gRNA sequence
ctcaggtgatccacctgcct

SEQ ID NO: 104943 - DNA, 20 bp, Artificial
  CRISPR gRNA sequence
ccacctgcctgggcctccca

SEQ ID NO: 104944 - DNA, 20 bp, Artificial
  CRISPR gRNA sequence
gcctgggcctcccaaagtgc

SEQ ID NO: 104945 - DNA, 20 bp, Artificial
  CRISPR gRNA sequence
cctgggcctcccaaagtgcc

SEQ ID NO: 104946 - DNA, 20 bp, Artificial
  CRISPR gRNA sequence
ctcccaaagtgccgggatta

SEQ ID NO: 104947 - DNA, 20 bp, Artificial
  CRISPR gRNA sequence
tcccaaagtgccgggattat

SEQ ID NO: 104948 - DNA, 20 bp, Artificial
  CRISPR gRNA sequence
agtgccgggattataggcgt

SEQ ID NO: 104949 - DNA, 20 bp, Artificial
  CRISPR gRNA sequence
taggcgtgagccaccatacc

SEQ ID NO: 104950 - DNA, 20 bp, Artificial
  CRISPR gRNA sequence
cgtgagccaccatacccggc

SEQ ID NO: 104951 - DNA, 20 bp, Artificial
  CRISPR gRNA sequence
gtgagccaccatacccggcc

SEQ ID NO: 104952 - DNA, 20 bp, Artificial
  CRISPR gRNA sequence
ggccaggtaccctttctttc

SEQ ID NO: 104953 - DNA, 20 bp, Artificial
  CRISPR gRNA sequence
gccaggtaccctttctttca

SEQ ID NO: 104954 - DNA, 20 bp, Artificial
  CRISPR gRNA sequence
tttctttcaaggaaactttg

SEQ ID NO: 104955 - DNA, 20 bp, Artificial
  CRISPR gRNA sequence
ctttcaaggaaactttgaag

SEQ ID NO: 104956 - DNA, 20 bp, Artificial
  CRISPR gRNA sequence
agaagttgtgtaccttccac

SEQ ID NO: 104957 - DNA, 20 bp, Artificial
  CRISPR gRNA sequence
gttgtgtaccttccactagc

SEQ ID NO: 104958 - DNA, 20 bp, Artificial
  CRISPR gRNA sequence
accttccactagccggaatt

SEQ ID NO: 104959 - DNA, 20 bp, Artificial
  CRISPR gRNA sequence
acctgatcacacctaacatg

SEQ ID NO: 104960 - DNA, 20 bp, Artificial
  CRISPR gRNA sequence
atcacacctaacatgcagat

SEQ ID NO: 104961 - DNA, 20 bp, Artificial
  CRISPR gRNA sequence
tcacacctaacatgcagata

SEQ ID NO: 104962 - DNA, 20 bp, Artificial
  CRISPR gRNA sequence
acctaacatgcagataaggc

SEQ ID NO: 104963 - DNA, 20 bp, Artificial
  CRISPR gRNA sequence
cctaacatgcagataaggct

SEQ ID NO: 104964 - DNA, 20 bp, Artificial
  CRISPR gRNA sequence
acatgcagataaggctagga

SEQ ID NO: 104965 - DNA, 20 bp, Artificial
  CRISPR gRNA sequence
cagataaggctaggaaagtc

SEQ ID NO: 104966 - DNA, 20 bp, Artificial
  CRISPR gRNA sequence
aaggctaggaaagtccagcc

SEQ ID NO: 104967 - DNA, 20 bp, Artificial
  CRISPR gRNA sequence
taggaaagtccagcctggtg

SEQ ID NO: 104968 - DNA, 20 bp, Artificial
  CRISPR gRNA sequence
gaaagtccagcctggtgtgg

SEQ ID NO: 104969 - DNA, 20 bp, Artificial
  CRISPR gRNA sequence
ggtgtggtggcaaatgcctg

SEQ ID NO: 104970 - DNA, 20 bp, Artificial
  CRISPR gRNA sequence
caaatgcctgtagtcctact

SEQ ID NO: 104971 - DNA, 20 bp, Artificial
  CRISPR gRNA sequence
atgcctgtagtcctacttgg

SEQ ID NO: 104972 - DNA, 20 bp, Artificial
  CRISPR gRNA sequence
tgcctgtagtcctacttgga

SEQ ID NO: 104973 - DNA, 20 bp, Artificial
  CRISPR gRNA sequence
ctgtagtcctacttggaagg

SEQ ID NO: 104974 - DNA, 20 bp, Artificial
  CRISPR gRNA sequence
gtagtcctacttggaaggca

SEQ ID NO: 104975 - DNA, 20 bp, Artificial
  CRISPR gRNA sequence
tagtcctacttggaaggcag

SEQ ID NO: 104976 - DNA, 20 bp, Artificial
  CRISPR gRNA sequence
tcctacttggaaggcagagg

SEQ ID NO: 104977 - DNA, 20 bp, Artificial
  CRISPR gRNA sequence
cctacttggaaggcagaggc

SEQ ID NO: 104978 - DNA, 20 bp, Artificial
  CRISPR gRNA sequence
tacttggaaggcagaggcag

SEQ ID NO: 104979 - DNA, 20 bp, Artificial
  CRISPR gRNA sequence
acttggaaggcagaggcagg

SEQ ID NO: 104980 - DNA, 20 bp, Artificial
  CRISPR gRNA sequence
cagaggcaggaggatcacat

SEQ ID NO: 104981 - DNA, 20 bp, Artificial
  CRISPR gRNA sequence
gcaggaggatcacatgagcc

SEQ ID NO: 104982 - DNA, 20 bp, Artificial
  CRISPR gRNA sequence
caggaggatcacatgagccg

SEQ ID NO: 104983 - DNA, 20 bp, Artificial
  CRISPR gRNA sequence
tcacatgagccgaggaattc

SEQ ID NO: 104984 - DNA, 20 bp, Artificial
  CRISPR gRNA sequence
cacatgagccgaggaattca

SEQ ID NO: 104985 - DNA, 20 bp, Artificial
  CRISPR gRNA sequence
agccgaggaattcaaggctg

SEQ ID NO: 104986 - DNA, 20 bp, Artificial
  CRISPR gRNA sequence
gattcatgatcatgccactg

SEQ ID NO: 104987 - DNA, 20 bp, Artificial
  CRISPR gRNA sequence
atcatgccactgcagtccaa

SEQ ID NO: 104988 - DNA, 20 bp, Artificial
  CRISPR gRNA sequence
tgccactgcagtccaacagc

SEQ ID NO: 104989 - DNA, 20 bp, Artificial
  CRISPR gRNA sequence
gccactgcagtccaacagca

SEQ ID NO: 104990 - DNA, 20 bp, Artificial
  CRISPR gRNA sequence
ccactgcagtccaacagcaa

SEQ ID NO: 104991 - DNA, 20 bp, Artificial
  CRISPR gRNA sequence
cagtccaacagcaagggtgt

SEQ ID NO: 104992 - DNA, 20 bp, Artificial
  CRISPR gRNA sequence
gtccaacagcaagggtgtca

SEQ ID NO: 104993 - DNA, 20 bp, Artificial
  CRISPR gRNA sequence
tcagagtgaaaccctgtttc

SEQ ID NO: 104994 - DNA, 20 bp, Artificial
  CRISPR gRNA sequence
ataataataaactttaatgc

SEQ ID NO: 104995 - DNA, 20 bp, Artificial
  CRISPR gRNA sequence
taataataaactttaatgct

SEQ ID NO: 104996 - DNA, 20 bp, Artificial
  CRISPR gRNA sequence
aataaactttaatgctagga

SEQ ID NO: 104997 - DNA, 20 bp, Artificial
  CRISPR gRNA sequence
tcatttgctcaaacgaaatt

SEQ ID NO: 104998 - DNA, 20 bp, Artificial
  CRISPR gRNA sequence
cgaaatttggcctgttatta

SEQ ID NO: 104999 - DNA, 20 bp, Artificial
  CRISPR gRNA sequence
aatttggcctgttattaaag

SEQ ID NO: 105000 - DNA, 20 bp, Artificial
  CRISPR gRNA sequence
tttggcctgttattaaagca

SEQ ID NO: 105001 - DNA, 20 bp, Artificial
  CRISPR gRNA sequence
ttggcctgttattaaagcag

SEQ ID NO: 105002 - DNA, 20 bp, Artificial
  CRISPR gRNA sequence
cctgttattaaagcagagga

SEQ ID NO: 105003 - DNA, 20 bp, Artificial
  CRISPR gRNA sequence
aggaaagtgtatatattgtg

SEQ ID NO: 105004 - DNA, 20 bp, Artificial
  CRISPR gRNA sequence
agtgtatatattgtgaagtg

SEQ ID NO: 105005 - DNA, 20 bp, Artificial
  CRISPR gRNA sequence
gtgtatatattgtgaagtgt

SEQ ID NO: 105006 - DNA, 20 bp, Artificial
  CRISPR gRNA sequence
tatatattgtgaagtgtagg

SEQ ID NO: 105007 - DNA, 20 bp, Artificial
  CRISPR gRNA sequence
atattgtgaagtgtaggtgg

SEQ ID NO: 105008 - DNA, 20 bp, Artificial
  CRISPR gRNA sequence
ttaaaaaaaattcatactat

SEQ ID NO: 105009 - DNA, 20 bp, Artificial
  CRISPR gRNA sequence
attcatactataagcattca

SEQ ID NO: 105010 - DNA, 20 bp, Artificial
  CRISPR gRNA sequence
tataagcattcacagtctta

SEQ ID NO: 105011 - DNA, 20 bp, Artificial
  CRISPR gRNA sequence
aagcattcacagtcttacag

SEQ ID NO: 105012 - DNA, 20 bp, Artificial
  CRISPR gRNA sequence
agtcttacagtagttatata

SEQ ID NO: 105013 - DNA, 20 bp, Artificial
  CRISPR gRNA sequence
ttacagtagttatatatggt

SEQ ID NO: 105014 - DNA, 20 bp, Artificial
  CRISPR gRNA sequence
tggttagctatattacttac

SEQ ID NO: 105015 - DNA, 20 bp, Artificial
  CRISPR gRNA sequence
ggttagctatattacttact

SEQ ID NO: 105016 - DNA, 20 bp, Artificial
  CRISPR gRNA sequence
cttactaggtgttttctcca

SEQ ID NO: 105017 - DNA, 20 bp, Artificial
  CRISPR gRNA sequence
aaagcttccatcgtcattct

SEQ ID NO: 105018 - DNA, 20 bp, Artificial
  CRISPR gRNA sequence
gtcccttgtgactttgatcc

SEQ ID NO: 105019 - DNA, 20 bp, Artificial
  CRISPR gRNA sequence
atcccagctgtcttaaactt

SEQ ID NO: 105020 - DNA, 20 bp, Artificial
  CRISPR gRNA sequence
cccagctgtcttaaactttg

SEQ ID NO: 105021 - DNA, 20 bp, Artificial
  CRISPR gRNA sequence
ctgtcttaaactttggagaa

SEQ ID NO: 105022 - DNA, 20 bp, Artificial
  CRISPR gRNA sequence
ggagaatggaatttgtgcac

SEQ ID NO: 105023 - DNA, 20 bp, Artificial
  CRISPR gRNA sequence
tgtgcactagataactgtgc

SEQ ID NO: 105024 - DNA, 20 bp, Artificial
  CRISPR gRNA sequence
ctagataactgtgctggttc

SEQ ID NO: 105025 - DNA, 20 bp, Artificial
  CRISPR gRNA sequence
ataactgtgctggttctgga

SEQ ID NO: 105026 - DNA, 20 bp, Artificial
  CRISPR gRNA sequence
ctggttctggatagtattaa

SEQ ID NO: 105027 - DNA, 20 bp, Artificial
  CRISPR gRNA sequence
ggatagtattaatagttaaa

SEQ ID NO: 105028 - DNA, 20 bp, Artificial
  CRISPR gRNA sequence
aatggttttatttctcgttt

SEQ ID NO: 105029 - DNA, 20 bp, Artificial
  CRISPR gRNA sequence
cgttttagaaatacctgcat

SEQ ID NO: 105030 - DNA, 20 bp, Artificial
  CRISPR gRNA sequence
agaaatacctgcatgagtct

SEQ ID NO: 105031 - DNA, 20 bp, Artificial
  CRISPR gRNA sequence
gtctcggcaccgtcatgcca

SEQ ID NO: 105032 - DNA, 20 bp, Artificial
  CRISPR gRNA sequence
ggcaccgtcatgccatggca

SEQ ID NO: 105033 - DNA, 20 bp, Artificial
  CRISPR gRNA sequence
accgtcatgccatggcacgg

SEQ ID NO: 105034 - DNA, 20 bp, Artificial
  CRISPR gRNA sequence
catgccatggcacggaagcg

SEQ ID NO: 105035 - DNA, 20 bp, Artificial
  CRISPR gRNA sequence
catggcacggaagcgtggtg

SEQ ID NO: 105036 - DNA, 20 bp, Artificial
  CRISPR gRNA sequence
atggcacggaagcgtggtga

SEQ ID NO: 105037 - DNA, 20 bp, Artificial
  CRISPR gRNA sequence
gcacggaagcgtggtgaagg

SEQ ID NO: 105038 - DNA, 20 bp, Artificial
  CRISPR gRNA sequence
gtggacgatttttctctcca

SEQ ID NO: 105039 - DNA, 20 bp, Artificial
  CRISPR gRNA sequence
tggacgatttttctctccaa

SEQ ID NO: 105040 - DNA, 20 bp, Artificial
  CRISPR gRNA sequence
gatttttctctccaaaggaa

SEQ ID NO: 105041 - DNA, 20 bp, Artificial
  CRISPR gRNA sequence
atttttctctccaaaggaaa

SEQ ID NO: 105042 - DNA, 20 bp, Artificial
  CRISPR gRNA sequence
ttctctccaaaggaaaagga

SEQ ID NO: 105043 - DNA, 20 bp, Artificial
  CRISPR gRNA sequence
aaaaggatagtccccatatg

SEQ ID NO: 105044 - DNA, 20 bp, Artificial
  CRISPR gRNA sequence
aaaggatagtccccatatgc

SEQ ID NO: 105045 - DNA, 20 bp, Artificial
  CRISPR gRNA sequence
ggatagtccccatatgcagg

SEQ ID NO: 105046 - DNA, 20 bp, Artificial
  CRISPR gRNA sequence
gatagtccccatatgcaggt

SEQ ID NO: 105047 - DNA, 20 bp, Artificial
  CRISPR gRNA sequence
agtccccatatgcaggtagg

SEQ ID NO: 105048 - DNA, 20 bp, Artificial
  CRISPR gRNA sequence
ttattaccttgtattgactt

SEQ ID NO: 105049 - DNA, 20 bp, Artificial
  CRISPR gRNA sequence
ccttgtattgacttgagttg

SEQ ID NO: 105050 - DNA, 20 bp, Artificial
  CRISPR gRNA sequence
ttgacttgagttgaagcctt

SEQ ID NO: 105051 - DNA, 20 bp, Artificial
  CRISPR gRNA sequence
acttgagttgaagccttcag

SEQ ID NO: 105052 - DNA, 20 bp, Artificial
  CRISPR gRNA sequence
ctcttgctattttcctactc

SEQ ID NO: 105053 - DNA, 20 bp, Artificial
  CRISPR gRNA sequence
tcttgctattttcctactct

SEQ ID NO: 105054 - DNA, 20 bp, Artificial
  CRISPR gRNA sequence
actactcacattctctaaac

SEQ ID NO: 105055 - DNA, 20 bp, Artificial
  CRISPR gRNA sequence
gatgcaatcttatgtctctt

SEQ ID NO: 105056 - DNA, 20 bp, Artificial
  CRISPR gRNA sequence
atcttttatcttaaaaccac

SEQ ID NO: 105057 - DNA, 20 bp, Artificial
  CRISPR gRNA sequence
tcttttatcttaaaaccact

SEQ ID NO: 105058 - DNA, 20 bp, Artificial
  CRISPR gRNA sequence
ttatcttaaaaccactaggc

SEQ ID NO: 105059 - DNA, 20 bp, Artificial
  CRISPR gRNA sequence
taaaaccactaggccagact

SEQ ID NO: 105060 - DNA, 20 bp, Artificial
  CRISPR gRNA sequence
aaccactaggccagacttgg

SEQ ID NO: 105061 - DNA, 20 bp, Artificial
  CRISPR gRNA sequence
tgcctgtaatcccaacactt

SEQ ID NO: 105062 - DNA, 20 bp, Artificial
  CRISPR gRNA sequence
gcctgtaatcccaacacttt

SEQ ID NO: 105063 - DNA, 20 bp, Artificial
  CRISPR gRNA sequence
ctgtaatcccaacactttgg

SEQ ID NO: 105064 - DNA, 20 bp, Artificial
  CRISPR gRNA sequence
tgtaatcccaacactttggg

SEQ ID NO: 105065 - DNA, 20 bp, Artificial
  CRISPR gRNA sequence
tcccaacactttgggaggct

SEQ ID NO: 105066 - DNA, 20 bp, Artificial
  CRISPR gRNA sequence
cccaacactttgggaggctg

SEQ ID NO: 105067 - DNA, 20 bp, Artificial
  CRISPR gRNA sequence
aacactttgggaggctgagg

SEQ ID NO: 105068 - DNA, 20 bp, Artificial
  CRISPR gRNA sequence
acactttgggaggctgaggt

SEQ ID NO: 105069 - DNA, 20 bp, Artificial
  CRISPR gRNA sequence
ctttgggaggctgaggtggg

SEQ ID NO: 105070 - DNA, 20 bp, Artificial
  CRISPR gRNA sequence
ggaggctgaggtgggaagcc

SEQ ID NO: 105071 - DNA, 20 bp, Artificial
  CRISPR gRNA sequence
gaggctgaggtgggaagccc

SEQ ID NO: 105072 - DNA, 20 bp, Artificial
  CRISPR gRNA sequence
ggtgggaagcccaggatttc

SEQ ID NO: 105073 - DNA, 20 bp, Artificial
  CRISPR gRNA sequence
gaagcccaggatttcaagac

SEQ ID NO: 105074 - DNA, 20 bp, Artificial
  CRISPR gRNA sequence
ccaggatttcaagaccagcc

SEQ ID NO: 105075 - DNA, 20 bp, Artificial
  CRISPR gRNA sequence
caggatttcaagaccagcct

SEQ ID NO: 105076 - DNA, 20 bp, Artificial
  CRISPR gRNA sequence
caagaccagcctgggcaaca

SEQ ID NO: 105077 - DNA, 20 bp, Artificial
  CRISPR gRNA sequence
ctacaaaaaaatacaaaaac

SEQ ID NO: 105078 - DNA, 20 bp, Artificial
  CRISPR gRNA sequence
aaaaaaatacaaaaactagc

SEQ ID NO: 105079 - DNA, 20 bp, Artificial
  CRISPR gRNA sequence
aaaaaatacaaaaactagcc

SEQ ID NO: 105080 - DNA, 20 bp, Artificial
  CRISPR gRNA sequence
atacaaaaactagccaggcc

SEQ ID NO: 105081 - DNA, 20 bp, Artificial
  CRISPR gRNA sequence
ggcctggtgatgcatgcctg

SEQ ID NO: 105082 - DNA, 20 bp, Artificial
  CRISPR gRNA sequence
gtgatgcatgcctgtagtcc

SEQ ID NO: 105083 - DNA, 20 bp, Artificial
  CRISPR gRNA sequence
tgcctgtagtcccagctact

SEQ ID NO: 105084 - DNA, 20 bp, Artificial
  CRISPR gRNA sequence
cctgtagtcccagctacttg

SEQ ID NO: 105085 - DNA, 20 bp, Artificial
  CRISPR gRNA sequence
ctgtagtcccagctacttgg

SEQ ID NO: 105086 - DNA, 20 bp, Artificial
  CRISPR gRNA sequence
tgtagtcccagctacttgga

SEQ ID NO: 105087 - DNA, 20 bp, Artificial
  CRISPR gRNA sequence
tcccagctacttggagggtt

SEQ ID NO: 105088 - DNA, 20 bp, Artificial
  CRISPR gRNA sequence
tcacacttttcttaattttc

SEQ ID NO: 105089 - DNA, 20 bp, Artificial
  CRISPR gRNA sequence
cacacttttcttaattttca

SEQ ID NO: 105090 - DNA, 20 bp, Artificial
  CRISPR gRNA sequence
tttcttaattttcaaggaac

SEQ ID NO: 105091 - DNA, 20 bp, Artificial
  CRISPR gRNA sequence
caagttttatttttattgaa

SEQ ID NO: 105092 - DNA, 20 bp, Artificial
  CRISPR gRNA sequence
aagttttatttttattgaac

SEQ ID NO: 105093 - DNA, 20 bp, Artificial
  CRISPR gRNA sequence
ttttcccttctaactgatgt

SEQ ID NO: 105094 - DNA, 20 bp, Artificial
  CRISPR gRNA sequence
ccttctaactgatgtgagcc

SEQ ID NO: 105095 - DNA, 20 bp, Artificial
  CRISPR gRNA sequence
tggtctaatcctctcttctt

SEQ ID NO: 105096 - DNA, 20 bp, Artificial
  CRISPR gRNA sequence
taatcctctcttctttggct

SEQ ID NO: 105097 - DNA, 20 bp, Artificial
  CRISPR gRNA sequence
tttggcttagatttataaaa

SEQ ID NO: 105098 - DNA, 20 bp, Artificial
  CRISPR gRNA sequence
tataaaatagctgcttaatt

SEQ ID NO: 105099 - DNA, 20 bp, Artificial
  CRISPR gRNA sequence
cttccacttttgttcccctc

SEQ ID NO: 105100 - DNA, 20 bp, Artificial
  CRISPR gRNA sequence
ctagcctactctccacatcc

SEQ ID NO: 105101 - DNA, 20 bp, Artificial
  CRISPR gRNA sequence
tttaaaatgtttatcctatc

SEQ ID NO: 105102 - DNA, 20 bp, Artificial
  CRISPR gRNA sequence
atcaagtccctgttctgctc

SEQ ID NO: 105103 - DNA, 20 bp, Artificial
  CRISPR gRNA sequence
taccctttcccatttgcact

SEQ ID NO: 105104 - DNA, 20 bp, Artificial
  CRISPR gRNA sequence
tgcacttagactgacatcca

SEQ ID NO: 105105 - DNA, 20 bp, Artificial
  CRISPR gRNA sequence
aaagtgcttactactatgcc

SEQ ID NO: 105106 - DNA, 20 bp, Artificial
  CRISPR gRNA sequence
gcttactactatgcccagca

SEQ ID NO: 105107 - DNA, 20 bp, Artificial
  CRISPR gRNA sequence
cagcaaagccttacatgctc

SEQ ID NO: 105108 - DNA, 20 bp, Artificial
  CRISPR gRNA sequence
ctaactgcatttctacttct

SEQ ID NO: 105109 - DNA, 20 bp, Artificial
  CRISPR gRNA sequence
tgctgctgtttactgttcat

SEQ ID NO: 105110 - DNA, 20 bp, Artificial
  CRISPR gRNA sequence
cattggtctacttcctgcca

SEQ ID NO: 105111 - DNA, 20 bp, Artificial
  CRISPR gRNA sequence
attggtctacttcctgccac

SEQ ID NO: 105112 - DNA, 20 bp, Artificial
  CRISPR gRNA sequence
ctgccacgggtctttgtcct

SEQ ID NO: 105113 - DNA, 20 bp, Artificial
  CRISPR gRNA sequence
gtctttgtccttagaatttt

SEQ ID NO: 105114 - DNA, 20 bp, Artificial
  CRISPR gRNA sequence
atgtctatctccctatctgt

SEQ ID NO: 105115 - DNA, 20 bp, Artificial
  CRISPR gRNA sequence
tgtctatctccctatctgtt

SEQ ID NO: 105116 - DNA, 20 bp, Artificial
  CRISPR gRNA sequence
atctccctatctgttaggtc

SEQ ID NO: 105117 - DNA, 20 bp, Artificial
  CRISPR gRNA sequence
tctccctatctgttaggtct

SEQ ID NO: 105118 - DNA, 20 bp, Artificial
  CRISPR gRNA sequence
gtttaattaaataccctatc

SEQ ID NO: 105119 - DNA, 20 bp, Artificial
  CRISPR gRNA sequence
attaaataccctatctagaa

SEQ ID NO: 105120 - DNA, 20 bp, Artificial
  CRISPR gRNA sequence
agaatagatctcttctctct

SEQ ID NO: 105121 - DNA, 20 bp, Artificial
  CRISPR gRNA sequence
tacaacatcttttctttttt

SEQ ID NO: 105122 - DNA, 20 bp, Artificial
  CRISPR gRNA sequence
caacatcttttctttttttg

SEQ ID NO: 105123 - DNA, 20 bp, Artificial
  CRISPR gRNA sequence
aacatcttttctttttttgg

SEQ ID NO: 105124 - DNA, 20 bp, Artificial
  CRISPR gRNA sequence
atcttttctttttttggagg

SEQ ID NO: 105125 - DNA, 20 bp, Artificial
  CRISPR gRNA sequence
ttttctttttttggaggcag

SEQ ID NO: 105126 - DNA, 20 bp, Artificial
  CRISPR gRNA sequence
tggaggcagtggtgtgatta

SEQ ID NO: 105127 - DNA, 20 bp, Artificial
  CRISPR gRNA sequence
ggtgtgattatggctcactt

SEQ ID NO: 105128 - DNA, 20 bp, Artificial
  CRISPR gRNA sequence
tcactttagtcttgacctcc

SEQ ID NO: 105129 - DNA, 20 bp, Artificial
  CRISPR gRNA sequence
tagtcttgacctcccagctc

SEQ ID NO: 105130 - DNA, 20 bp, Artificial
  CRISPR gRNA sequence
ctcaagtgatcctcccactt

SEQ ID NO: 105131 - DNA, 20 bp, Artificial
  CRISPR gRNA sequence
tcaagtgatcctcccacttt

SEQ ID NO: 105132 - DNA, 20 bp, Artificial
  CRISPR gRNA sequence
tcctcccactttaggctccc

SEQ ID NO: 105133 - DNA, 20 bp, Artificial
  CRISPR gRNA sequence
tcccactttaggctcccgag

SEQ ID NO: 105134 - DNA, 20 bp, Artificial
  CRISPR gRNA sequence
actttaggctcccgagtagc

SEQ ID NO: 105135 - DNA, 20 bp, Artificial
  CRISPR gRNA sequence
ctttaggctcccgagtagct

SEQ ID NO: 105136 - DNA, 20 bp, Artificial
  CRISPR gRNA sequence
ctcccgagtagctgggacta

SEQ ID NO: 105137 - DNA, 20 bp, Artificial
  CRISPR gRNA sequence
tagccacgcaccaccatgcc

SEQ ID NO: 105138 - DNA, 20 bp, Artificial
  CRISPR gRNA sequence
gctaatttttaaattttttg

SEQ ID NO: 105139 - DNA, 20 bp, Artificial
  CRISPR gRNA sequence
ttttaaattttttgtagaaa

SEQ ID NO: 105140 - DNA, 20 bp, Artificial
  CRISPR gRNA sequence
ttaaattttttgtagaaatg

SEQ ID NO: 105141 - DNA, 20 bp, Artificial
  CRISPR gRNA sequence
tggagtctcactttgttgcc

SEQ ID NO: 105142 - DNA, 20 bp, Artificial
  CRISPR gRNA sequence
ggagtctcactttgttgccc

SEQ ID NO: 105143 - DNA, 20 bp, Artificial
  CRISPR gRNA sequence
gtctcactttgttgcccagg

SEQ ID NO: 105144 - DNA, 20 bp, Artificial
  CRISPR gRNA sequence
tctcactttgttgcccaggc

SEQ ID NO: 105145 - DNA, 20 bp, Artificial
  CRISPR gRNA sequence
ccaggcaggtctcaaactcc

SEQ ID NO: 105146 - DNA, 20 bp, Artificial
  CRISPR gRNA sequence
caggcaggtctcaaactcct

SEQ ID NO: 105147 - DNA, 20 bp, Artificial
  CRISPR gRNA sequence
ggtctcaaactcctaggctc

SEQ ID NO: 105148 - DNA, 20 bp, Artificial
  CRISPR gRNA sequence
ctcaagcgatcctctcgcct

SEQ ID NO: 105149 - DNA, 20 bp, Artificial
  CRISPR gRNA sequence
cctctcgccttggcctccca

SEQ ID NO: 105150 - DNA, 20 bp, Artificial
  CRISPR gRNA sequence
gccttggcctcccaaagtgc

SEQ ID NO: 105151 - DNA, 20 bp, Artificial
  CRISPR gRNA sequence
ccttggcctcccaaagtgct

SEQ ID NO: 105152 - DNA, 20 bp, Artificial
  CRISPR gRNA sequence
ctcccaaagtgctaggatta

SEQ ID NO: 105153 - DNA, 20 bp, Artificial
  CRISPR gRNA sequence
tcccaaagtgctaggattac

SEQ ID NO: 105154 - DNA, 20 bp, Artificial
  CRISPR gRNA sequence
caggcgcacaccattgcact

SEQ ID NO: 105155 - DNA, 20 bp, Artificial
  CRISPR gRNA sequence
gcacttggcccttttcttta

SEQ ID NO: 105156 - DNA, 20 bp, Artificial
  CRISPR gRNA sequence
tttacagtgtaataatattt

SEQ ID NO: 105157 - DNA, 20 bp, Artificial
  CRISPR gRNA sequence
tttaagttgttgaatttttc

SEQ ID NO: 105158 - DNA, 20 bp, Artificial
  CRISPR gRNA sequence
ttcaagattgtttccttcac

SEQ ID NO: 105159 - DNA, 20 bp, Artificial
  CRISPR gRNA sequence
tgtttccttcactagactgt

SEQ ID NO: 105160 - DNA, 20 bp, Artificial
  CRISPR gRNA sequence
tcactagactgtaagttgta

SEQ ID NO: 105161 - DNA, 20 bp, Artificial
  CRISPR gRNA sequence
actagactgtaagttgtata

SEQ ID NO: 105162 - DNA, 20 bp, Artificial
  CRISPR gRNA sequence
ctagactgtaagttgtatag

SEQ ID NO: 105163 - DNA, 20 bp, Artificial
  CRISPR gRNA sequence
tagactgtaagttgtataga

SEQ ID NO: 105164 - DNA, 20 bp, Artificial
  CRISPR gRNA sequence
actgtaagttgtatagaggg

SEQ ID NO: 105165 - DNA, 20 bp, Artificial
  CRISPR gRNA sequence
tgtaagttgtatagagggta

SEQ ID NO: 105166 - DNA, 20 bp, Artificial
  CRISPR gRNA sequence
gtaagttgtatagagggtag

SEQ ID NO: 105167 - DNA, 20 bp, Artificial
  CRISPR gRNA sequence
tcgttctctgttatatttat

SEQ ID NO: 105168 - DNA, 20 bp, Artificial
  CRISPR gRNA sequence
tattggacttaattctattt

SEQ ID NO: 105169 - DNA, 20 bp, Artificial
  CRISPR gRNA sequence
ggacttaattctatttaagt

SEQ ID NO: 105170 - DNA, 20 bp, Artificial
  CRISPR gRNA sequence
tatttaagtaagttgtattt

SEQ ID NO: 105171 - DNA, 20 bp, Artificial
  CRISPR gRNA sequence
gttgtatttaagtactgact

SEQ ID NO: 105172 - DNA, 20 bp, Artificial
  CRISPR gRNA sequence
actgacttagatgtatttgt

SEQ ID NO: 105173 - DNA, 20 bp, Artificial
  CRISPR gRNA sequence
ctgacttagatgtatttgtt

SEQ ID NO: 105174 - DNA, 20 bp, Artificial
  CRISPR gRNA sequence
ttagatgtatttgttgggtt

SEQ ID NO: 105175 - DNA, 20 bp, Artificial
  CRISPR gRNA sequence
tatttgttgggtttagtatc

SEQ ID NO: 105176 - DNA, 20 bp, Artificial
  CRISPR gRNA sequence
ttagtatccagttctgaacc

SEQ ID NO: 105177 - DNA, 20 bp, Artificial
  CRISPR gRNA sequence
ccagttctgaaccaagcaat

SEQ ID NO: 105178 - DNA, 20 bp, Artificial
  CRISPR gRNA sequence
atcagtgtttcttgaattaa

SEQ ID NO: 105179 - DNA, 20 bp, Artificial
  CRISPR gRNA sequence
atatccatcaaattaatctc

SEQ ID NO: 105180 - DNA, 20 bp, Artificial
  CRISPR gRNA sequence
aatctccagtctcctctaat

SEQ ID NO: 105181 - DNA, 20 bp, Artificial
  CRISPR gRNA sequence
ctcctctaattggccttata

SEQ ID NO: 105182 - DNA, 20 bp, Artificial
  CRISPR gRNA sequence
ggccttatatagtacttata

SEQ ID NO: 105183 - DNA, 20 bp, Artificial
  CRISPR gRNA sequence
tatagtacttatacagtaca

SEQ ID NO: 105184 - DNA, 20 bp, Artificial
  CRISPR gRNA sequence
acttatacagtacatggtta

SEQ ID NO: 105185 - DNA, 20 bp, Artificial
  CRISPR gRNA sequence
aagtgttttttttaacctgc

SEQ ID NO: 105186 - DNA, 20 bp, Artificial
  CRISPR gRNA sequence
ttttttaacctgccagtccc

SEQ ID NO: 105187 - DNA, 20 bp, Artificial
  CRISPR gRNA sequence
tttttaacctgccagtcccc

SEQ ID NO: 105188 - DNA, 20 bp, Artificial
  CRISPR gRNA sequence
aacctgccagtccccaggtc

SEQ ID NO: 105189 - DNA, 20 bp, Artificial
  CRISPR gRNA sequence
acctgccagtccccaggtca

SEQ ID NO: 105190 - DNA, 20 bp, Artificial
  CRISPR gRNA sequence
tcaaggatgcatgctattaa

SEQ ID NO: 105191 - DNA, 20 bp, Artificial
  CRISPR gRNA sequence
actatttctgtataacatct

SEQ ID NO: 105192 - DNA, 20 bp, Artificial
  CRISPR gRNA sequence
caccccctcaacaatcaaac

SEQ ID NO: 105193 - DNA, 20 bp, Artificial
  CRISPR gRNA sequence
accccctcaacaatcaaact

SEQ ID NO: 105194 - DNA, 20 bp, Artificial
  CRISPR gRNA sequence
acaatcaaactaggtttcct

SEQ ID NO: 105195 - DNA, 20 bp, Artificial
  CRISPR gRNA sequence
atgaacactaacaactcttt

SEQ ID NO: 105196 - DNA, 20 bp, Artificial
  CRISPR gRNA sequence
gtgctattaatcctcacctg

SEQ ID NO: 105197 - DNA, 20 bp, Artificial
  CRISPR gRNA sequence
ttaatcctcacctgtagtgt

SEQ ID NO: 105198 - DNA, 20 bp, Artificial
  CRISPR gRNA sequence
aatcctcacctgtagtgtga

SEQ ID NO: 105199 - DNA, 20 bp, Artificial
  CRISPR gRNA sequence
tcattgctattcattcataa

SEQ ID NO: 105200 - DNA, 20 bp, Artificial
  CRISPR gRNA sequence
ttcataacggtgtatgaatg

SEQ ID NO: 105201 - DNA, 20 bp, Artificial
  CRISPR gRNA sequence
tcataacggtgtatgaatgt

SEQ ID NO: 105202 - DNA, 20 bp, Artificial
  CRISPR gRNA sequence
gtgtatgaatgtgggcctga

SEQ ID NO: 105203 - DNA, 20 bp, Artificial
  CRISPR gRNA sequence
tgtgggcctgacagctattg

SEQ ID NO: 105204 - DNA, 20 bp, Artificial
  CRISPR gRNA sequence
gggcctgacagctattgtgg

SEQ ID NO: 105205 - DNA, 20 bp, Artificial
  CRISPR gRNA sequence
ggcctgacagctattgtggc

SEQ ID NO: 105206 - DNA, 20 bp, Artificial
  CRISPR gRNA sequence
cctgacagctattgtggcag

SEQ ID NO: 105207 - DNA, 20 bp, Artificial
  CRISPR gRNA sequence
ctgacagctattgtggcagg

SEQ ID NO: 105208 - DNA, 20 bp, Artificial
  CRISPR gRNA sequence
tgacagctattgtggcagga

SEQ ID NO: 105209 - DNA, 20 bp, Artificial
  CRISPR gRNA sequence
gtggcaggagggcattgtgc

SEQ ID NO: 105210 - DNA, 20 bp, Artificial
  CRISPR gRNA sequence
tggcaggagggcattgtgcc

SEQ ID NO: 105211 - DNA, 20 bp, Artificial
  CRISPR gRNA sequence
gtgtgctaacaatatgatct

SEQ ID NO: 105212 - DNA, 20 bp, Artificial
  CRISPR gRNA sequence
caatatgatcttggtcaatt

SEQ ID NO: 105213 - DNA, 20 bp, Artificial
  CRISPR gRNA sequence
ctcttttatttttatctgta

SEQ ID NO: 105214 - DNA, 20 bp, Artificial
  CRISPR gRNA sequence
ttttatttttatctgtaaag

SEQ ID NO: 105215 - DNA, 20 bp, Artificial
  CRISPR gRNA sequence
ggaatactgttgatacttca

SEQ ID NO: 105216 - DNA, 20 bp, Artificial
  CRISPR gRNA sequence
gatacttcacagcaatgttg

SEQ ID NO: 105217 - DNA, 20 bp, Artificial
  CRISPR gRNA sequence
atacttcacagcaatgttgt

SEQ ID NO: 105218 - DNA, 20 bp, Artificial
  CRISPR gRNA sequence
tacttcacagcaatgttgta

SEQ ID NO: 105219 - DNA, 20 bp, Artificial
  CRISPR gRNA sequence
aatgttgtagggatttcatt

SEQ ID NO: 105220 - DNA, 20 bp, Artificial
  CRISPR gRNA sequence
tttcattcagtaatccacat

SEQ ID NO: 105221 - DNA, 20 bp, Artificial
  CRISPR gRNA sequence
ttcattcagtaatccacatt

SEQ ID NO: 105222 - DNA, 20 bp, Artificial
  CRISPR gRNA sequence
atccacattaggcatctgtg

SEQ ID NO: 105223 - DNA, 20 bp, Artificial
  CRISPR gRNA sequence
catctgtgtagcaccatacc

SEQ ID NO: 105224 - DNA, 20 bp, Artificial
  CRISPR gRNA sequence
gtagcaccatacctagtgca

SEQ ID NO: 105225 - DNA, 20 bp, Artificial
  CRISPR gRNA sequence
caccatacctagtgcatggt

SEQ ID NO: 105226 - DNA, 20 bp, Artificial
  CRISPR gRNA sequence
tacctagtgcatggtgagtt

SEQ ID NO: 105227 - DNA, 20 bp, Artificial
  CRISPR gRNA sequence
atggtgagttcagtaaatgc

SEQ ID NO: 105228 - DNA, 20 bp, Artificial
  CRISPR gRNA sequence
gttgtttttgctcattgttc

SEQ ID NO: 105229 - DNA, 20 bp, Artificial
  CRISPR gRNA sequence
tttgctcattgttcaagacc

SEQ ID NO: 105230 - DNA, 20 bp, Artificial
  CRISPR gRNA sequence
cattgttcaagacccagttc

SEQ ID NO: 105231 - DNA, 20 bp, Artificial
  CRISPR gRNA sequence
cagttccagtcttccatctc

SEQ ID NO: 105232 - DNA, 20 bp, Artificial
  CRISPR gRNA sequence
ttccagtcttccatctccag

SEQ ID NO: 105233 - DNA, 20 bp, Artificial
  CRISPR gRNA sequence
tccagtcttccatctccaga

SEQ ID NO: 105234 - DNA, 20 bp, Artificial
  CRISPR gRNA sequence
ttccatctccagaaggcttt

SEQ ID NO: 105235 - DNA, 20 bp, Artificial
  CRISPR gRNA sequence
gaaggctttcagctttttct

SEQ ID NO: 105236 - DNA, 20 bp, Artificial
  CRISPR gRNA sequence
tttctcagatcctgcctacc

SEQ ID NO: 105237 - DNA, 20 bp, Artificial
  CRISPR gRNA sequence
ttctcagatcctgcctacca

SEQ ID NO: 105238 - DNA, 20 bp, Artificial
  CRISPR gRNA sequence
gatcctgcctaccaaggctt

SEQ ID NO: 105239 - DNA, 20 bp, Artificial
  CRISPR gRNA sequence
tcctgcctaccaaggcttca

SEQ ID NO: 105240 - DNA, 20 bp, Artificial
  CRISPR gRNA sequence
ctaccaaggcttcagagcct

SEQ ID NO: 105241 - DNA, 20 bp, Artificial
  CRISPR gRNA sequence
aaggcttcagagccttggta

SEQ ID NO: 105242 - DNA, 20 bp, Artificial
  CRISPR gRNA sequence
aggcttcagagccttggtat

SEQ ID NO: 105243 - DNA, 20 bp, Artificial
  CRISPR gRNA sequence
ggcttcagagccttggtatg

SEQ ID NO: 105244 - DNA, 20 bp, Artificial
  CRISPR gRNA sequence
gcttcagagccttggtatgg

SEQ ID NO: 105245 - DNA, 20 bp, Artificial
  CRISPR gRNA sequence
gccttggtatgggggaacta

SEQ ID NO: 105246 - DNA, 20 bp, Artificial
  CRISPR gRNA sequence
ccttggtatgggggaactaa

SEQ ID NO: 105247 - DNA, 20 bp, Artificial
  CRISPR gRNA sequence
tggtatgggggaactaaagg

SEQ ID NO: 105248 - DNA, 20 bp, Artificial
  CRISPR gRNA sequence
ggaactaaaggtggttcttg

SEQ ID NO: 105249 - DNA, 20 bp, Artificial
  CRISPR gRNA sequence
aactaaaggtggttcttgcg

SEQ ID NO: 105250 - DNA, 20 bp, Artificial
  CRISPR gRNA sequence
ttcttgcggagtgttgcaaa

SEQ ID NO: 105251 - DNA, 20 bp, Artificial
  CRISPR gRNA sequence
gagtgttgcaaaaagcttcc

SEQ ID NO: 105252 - DNA, 20 bp, Artificial
  CRISPR gRNA sequence
agtgttgcaaaaagcttcca

SEQ ID NO: 105253 - DNA, 20 bp, Artificial
  CRISPR gRNA sequence
gatttatccttgtgttaaca

SEQ ID NO: 105254 - DNA, 20 bp, Artificial
  CRISPR gRNA sequence
ttatccttgtgttaacacgg

SEQ ID NO: 105255 - DNA, 20 bp, Artificial
  CRISPR gRNA sequence
tatccttgtgttaacacggt

SEQ ID NO: 105256 - DNA, 20 bp, Artificial
  CRISPR gRNA sequence
gtgttaacacggtaggtctt

SEQ ID NO: 105257 - DNA, 20 bp, Artificial
  CRISPR gRNA sequence
taacacggtaggtcttaagt

SEQ ID NO: 105258 - DNA, 20 bp, Artificial
  CRISPR gRNA sequence
ggtaggtcttaagtgagaaa

SEQ ID NO: 105259 - DNA, 20 bp, Artificial
  CRISPR gRNA sequence
cttaagtgagaaacagcata

SEQ ID NO: 105260 - DNA, 20 bp, Artificial
  CRISPR gRNA sequence
taagtgagaaacagcatata

SEQ ID NO: 105261 - DNA, 20 bp, Artificial
  CRISPR gRNA sequence
gagaaacagcatatagagtt

SEQ ID NO: 105262 - DNA, 20 bp, Artificial
  CRISPR gRNA sequence
aaacagcatatagagtttag

SEQ ID NO: 105263 - DNA, 20 bp, Artificial
  CRISPR gRNA sequence
agcatatagagtttagtgga

SEQ ID NO: 105264 - DNA, 20 bp, Artificial
  CRISPR gRNA sequence
atatagagtttagtggaaag

SEQ ID NO: 105265 - DNA, 20 bp, Artificial
  CRISPR gRNA sequence
ttagtggaaagaagatgaaa

SEQ ID NO: 105266 - DNA, 20 bp, Artificial
  CRISPR gRNA sequence
tagtggaaagaagatgaaat

SEQ ID NO: 105267 - DNA, 20 bp, Artificial
  CRISPR gRNA sequence
gtggaaagaagatgaaatgg

SEQ ID NO: 105268 - DNA, 20 bp, Artificial
  CRISPR gRNA sequence
aaagaagatgaaatgggagt

SEQ ID NO: 105269 - DNA, 20 bp, Artificial
  CRISPR gRNA sequence
aagaagatgaaatgggagtc

SEQ ID NO: 105270 - DNA, 20 bp, Artificial
  CRISPR gRNA sequence
gaagatgaaatgggagtcag

SEQ ID NO: 105271 - DNA, 20 bp, Artificial
  CRISPR gRNA sequence
gaaatgggagtcaggagatt

SEQ ID NO: 105272 - DNA, 20 bp, Artificial
  CRISPR gRNA sequence
aaatgggagtcaggagattt

SEQ ID NO: 105273 - DNA, 20 bp, Artificial
  CRISPR gRNA sequence
atgggagtcaggagatttgg

SEQ ID NO: 105274 - DNA, 20 bp, Artificial
  CRISPR gRNA sequence
gagtcaggagatttgggagt

SEQ ID NO: 105275 - DNA, 20 bp, Artificial
  CRISPR gRNA sequence
atttgggagttagcccttgc

SEQ ID NO: 105276 - DNA, 20 bp, Artificial
  CRISPR gRNA sequence
taactttctgaccctgaccc

SEQ ID NO: 105277 - DNA, 20 bp, Artificial
  CRISPR gRNA sequence
cgcaaatcactttacccatc

SEQ ID NO: 105278 - DNA, 20 bp, Artificial
  CRISPR gRNA sequence
cactttacccatctggcctt

SEQ ID NO: 105279 - DNA, 20 bp, Artificial
  CRISPR gRNA sequence
ttcagatttatctgtaaaac

SEQ ID NO: 105280 - DNA, 20 bp, Artificial
  CRISPR gRNA sequence
tctgtaaaacgagtacatta

SEQ ID NO: 105281 - DNA, 20 bp, Artificial
  CRISPR gRNA sequence
aacgagtacattaaagtgta

SEQ ID NO: 105282 - DNA, 20 bp, Artificial
  CRISPR gRNA sequence
tagattctaatgattctttc

SEQ ID NO: 105283 - DNA, 20 bp, Artificial
  CRISPR gRNA sequence
tgattctttctagccctgct

SEQ ID NO: 105284 - DNA, 20 bp, Artificial
  CRISPR gRNA sequence
ttctagccctgctaagtact

SEQ ID NO: 105285 - DNA, 20 bp, Artificial
  CRISPR gRNA sequence
tttaaatgatgatcaaaaaa

SEQ ID NO: 105286 - DNA, 20 bp, Artificial
  CRISPR gRNA sequence
aaaaaacagtgacaaaaata

SEQ ID NO: 105287 - DNA, 20 bp, Artificial
  CRISPR gRNA sequence
gacaaaaatacagcatgaca

SEQ ID NO: 105288 - DNA, 20 bp, Artificial
  CRISPR gRNA sequence
acagcatgacatggtttctc

SEQ ID NO: 105289 - DNA, 20 bp, Artificial
  CRISPR gRNA sequence
cagcatgacatggtttctct

SEQ ID NO: 105290 - DNA, 20 bp, Artificial
  CRISPR gRNA sequence
gtttctctgggtcttttcct

SEQ ID NO: 105291 - DNA, 20 bp, Artificial
  CRISPR gRNA sequence
tctgaatactcttaaccctt

SEQ ID NO: 105292 - DNA, 20 bp, Artificial
  CRISPR gRNA sequence
atactcttaacccttaagta

SEQ ID NO: 105293 - DNA, 20 bp, Artificial
  CRISPR gRNA sequence
actcttaacccttaagtata

SEQ ID NO: 105294 - DNA, 20 bp, Artificial
  CRISPR gRNA sequence
ttaagtatagagaacaacac

SEQ ID NO: 105295 - DNA, 20 bp, Artificial
  CRISPR gRNA sequence
taagtatagagaacaacaca

SEQ ID NO: 105296 - DNA, 20 bp, Artificial
  CRISPR gRNA sequence
agagaacaacacaaggttct

SEQ ID NO: 105297 - DNA, 20 bp, Artificial
  CRISPR gRNA sequence
gagaacaacacaaggttctt

SEQ ID NO: 105298 - DNA, 20 bp, Artificial
  CRISPR gRNA sequence
acaacacaaggttcttagga

SEQ ID NO: 105299 - DNA, 20 bp, Artificial
  CRISPR gRNA sequence
aacacaaggttcttaggaaa

SEQ ID NO: 105300 - DNA, 20 bp, Artificial
  CRISPR gRNA sequence
ttaggaaagagatacactaa

SEQ ID NO: 105301 - DNA, 20 bp, Artificial
  CRISPR gRNA sequence
gagatacactaacagccctg

SEQ ID NO: 105302 - DNA, 20 bp, Artificial
  CRISPR gRNA sequence
agccctgcagtgtttcacca

SEQ ID NO: 105303 - DNA, 20 bp, Artificial
  CRISPR gRNA sequence
ccctgcagtgtttcaccatg

SEQ ID NO: 105304 - DNA, 20 bp, Artificial
  CRISPR gRNA sequence
cagtgtttcaccatggagtg

SEQ ID NO: 105305 - DNA, 20 bp, Artificial
  CRISPR gRNA sequence
agtgtttcaccatggagtgc

SEQ ID NO: 105306 - DNA, 20 bp, Artificial
  CRISPR gRNA sequence
tttcaccatggagtgcaggc

SEQ ID NO: 105307 - DNA, 20 bp, Artificial
  CRISPR gRNA sequence
gccagactttaaattatttt

SEQ ID NO: 105308 - DNA, 20 bp, Artificial
  CRISPR gRNA sequence
ctttaaattattttaagaat

SEQ ID NO: 105309 - DNA, 20 bp, Artificial
  CRISPR gRNA sequence
tttaaattattttaagaata

SEQ ID NO: 105310 - DNA, 20 bp, Artificial
  CRISPR gRNA sequence
tattgtctcttctttcctaa

SEQ ID NO: 105311 - DNA, 20 bp, Artificial
  CRISPR gRNA sequence
attgtctcttctttcctaat

SEQ ID NO: 105312 - DNA, 20 bp, Artificial
  CRISPR gRNA sequence
ttgtctcttctttcctaatg

SEQ ID NO: 105313 - DNA, 20 bp, Artificial
  CRISPR gRNA sequence
tcctaatggggctacacttt

SEQ ID NO: 105314 - DNA, 20 bp, Artificial
  CRISPR gRNA sequence
tacactttaagccatgtatg

SEQ ID NO: 105315 - DNA, 20 bp, Artificial
  CRISPR gRNA sequence
taagccatgtatgcagactt

SEQ ID NO: 105316 - DNA, 20 bp, Artificial
  CRISPR gRNA sequence
gcagacttaagatgtattac

SEQ ID NO: 105317 - DNA, 20 bp, Artificial
  CRISPR gRNA sequence
ttacaagcctttgatttact

SEQ ID NO: 105318 - DNA, 20 bp, Artificial
  CRISPR gRNA sequence
agcctttgatttacttggta

SEQ ID NO: 105319 - DNA, 20 bp, Artificial
  CRISPR gRNA sequence
taaagttatgtgtattctct

SEQ ID NO: 105320 - DNA, 20 bp, Artificial
  CRISPR gRNA sequence
aaagttatgtgtattctctt

SEQ ID NO: 105321 - DNA, 20 bp, Artificial
  CRISPR gRNA sequence
aagttatgtgtattctcttg

SEQ ID NO: 105322 - DNA, 20 bp, Artificial
  CRISPR gRNA sequence
agttatgtgtattctcttgg

SEQ ID NO: 105323 - DNA, 20 bp, Artificial
  CRISPR gRNA sequence
gttatgtgtattctcttggg

SEQ ID NO: 105324 - DNA, 20 bp, Artificial
  CRISPR gRNA sequence
gtgtattctcttggggggat

SEQ ID NO: 105325 - DNA, 20 bp, Artificial
  CRISPR gRNA sequence
tattctcttggggggataag

SEQ ID NO: 105326 - DNA, 20 bp, Artificial
  CRISPR gRNA sequence
ctcttggggggataagtagt

SEQ ID NO: 105327 - DNA, 20 bp, Artificial
  CRISPR gRNA sequence
cttggggggataagtagtga

SEQ ID NO: 105328 - DNA, 20 bp, Artificial
  CRISPR gRNA sequence
ggataagtagtgagagccat

SEQ ID NO: 105329 - DNA, 20 bp, Artificial
  CRISPR gRNA sequence
gagttcctgttgcttttgca

SEQ ID NO: 105330 - DNA, 20 bp, Artificial
  CRISPR gRNA sequence
agttcctgttgcttttgcaa

SEQ ID NO: 105331 - DNA, 20 bp, Artificial
  CRISPR gRNA sequence
catcatgtcatctttgtctc

SEQ ID NO: 105332 - DNA, 20 bp, Artificial
  CRISPR gRNA sequence
atcatgtcatctttgtctct

SEQ ID NO: 105333 - DNA, 20 bp, Artificial
  CRISPR gRNA sequence
ttgtctctaggatccaaacc

SEQ ID NO: 105334 - DNA, 20 bp, Artificial
  CRISPR gRNA sequence
ggatccaaaccaagccgatg

SEQ ID NO: 105335 - DNA, 20 bp, Artificial
  CRISPR gRNA sequence
tccaaaccaagccgatgaag

SEQ ID NO: 105336 - DNA, 20 bp, Artificial
  CRISPR gRNA sequence
ccgatgaagaagcaatgaca

SEQ ID NO: 105337 - DNA, 20 bp, Artificial
  CRISPR gRNA sequence
agcaatgacacagatcatcc

SEQ ID NO: 105338 - DNA, 20 bp, Artificial
  CRISPR gRNA sequence
cctaaccccacgccatgtga

SEQ ID NO: 105339 - DNA, 20 bp, Artificial
  CRISPR gRNA sequence
taaccccacgccatgtgatg

SEQ ID NO: 105340 - DNA, 20 bp, Artificial
  CRISPR gRNA sequence
gccatgtgatggagctgatc

SEQ ID NO: 105341 - DNA, 20 bp, Artificial
  CRISPR gRNA sequence
ccatgtgatggagctgatca

SEQ ID NO: 105342 - DNA, 20 bp, Artificial
  CRISPR gRNA sequence
ggtcatgtttctcactgttc

SEQ ID NO: 105343 - DNA, 20 bp, Artificial
  CRISPR gRNA sequence
gtcatgtttctcactgttcc

SEQ ID NO: 105344 - DNA, 20 bp, Artificial
  CRISPR gRNA sequence
aaattgatcaactcttccaa

SEQ ID NO: 105345 - DNA, 20 bp, Artificial
  CRISPR gRNA sequence
aattgatcaactcttccaat

SEQ ID NO: 105346 - DNA, 20 bp, Artificial
  CRISPR gRNA sequence
tcacattctgccctttacta

SEQ ID NO: 105347 - DNA, 20 bp, Artificial
  CRISPR gRNA sequence
cacattctgccctttactac

SEQ ID NO: 105348 - DNA, 20 bp, Artificial
  CRISPR gRNA sequence
ttctgccctttactacagga

SEQ ID NO: 105349 - DNA, 20 bp, Artificial
  CRISPR gRNA sequence
actacaggacagaaaccact

SEQ ID NO: 105350 - DNA, 20 bp, Artificial
  CRISPR gRNA sequence
gaaaccacttagtttttaat

SEQ ID NO: 105351 - DNA, 20 bp, Artificial
  CRISPR gRNA sequence
accacttagtttttaataag

SEQ ID NO: 105352 - DNA, 20 bp, Artificial
  CRISPR gRNA sequence
ttagtttttaataagtggct

SEQ ID NO: 105353 - DNA, 20 bp, Artificial
  CRISPR gRNA sequence
gtggctcagtattacaattg

SEQ ID NO: 105354 - DNA, 20 bp, Artificial
  CRISPR gRNA sequence
attacaattgcagcgatgcc

SEQ ID NO: 105355 - DNA, 20 bp, Artificial
  CRISPR gRNA sequence
cagcgatgcctggcaaattg

SEQ ID NO: 105356 - DNA, 20 bp, Artificial
  CRISPR gRNA sequence
gcctggcaaattgaagttgc

SEQ ID NO: 105357 - DNA, 20 bp, Artificial
  CRISPR gRNA sequence
aagcctttgtcttactcttt

SEQ ID NO: 105358 - DNA, 20 bp, Artificial
  CRISPR gRNA sequence
ctttgtcttactctttcagt

SEQ ID NO: 105359 - DNA, 20 bp, Artificial
  CRISPR gRNA sequence
tttgtcttactctttcagtc

SEQ ID NO: 105360 - DNA, 20 bp, Artificial
  CRISPR gRNA sequence
ctttcagtcaggacctattt

SEQ ID NO: 105361 - DNA, 20 bp, Artificial
  CRISPR gRNA sequence
ttgatgacattgacatttca

SEQ ID NO: 105362 - DNA, 20 bp, Artificial
  CRISPR gRNA sequence
acattgacatttcatggatt

SEQ ID NO: 105363 - DNA, 20 bp, Artificial
  CRISPR gRNA sequence
ttcatggattcggatgatgc

SEQ ID NO: 105364 - DNA, 20 bp, Artificial
  CRISPR gRNA sequence
tcatggattcggatgatgca

SEQ ID NO: 105365 - DNA, 20 bp, Artificial
  CRISPR gRNA sequence
atggattcggatgatgcaag

SEQ ID NO: 105366 - DNA, 20 bp, Artificial
  CRISPR gRNA sequence
caaggagacacatgccaccc

SEQ ID NO: 105367 - DNA, 20 bp, Artificial
  CRISPR gRNA sequence
ggagacacatgccaccccag

SEQ ID NO: 105368 - DNA, 20 bp, Artificial
  CRISPR gRNA sequence
tgccaccccagcagtacaca

SEQ ID NO: 105369 - DNA, 20 bp, Artificial
  CRISPR gRNA sequence
cacaaagcacttaccttgac

SEQ ID NO: 105370 - DNA, 20 bp, Artificial
  CRISPR gRNA sequence
agcacttaccttgactggtg

SEQ ID NO: 105371 - DNA, 20 bp, Artificial
  CRISPR gRNA sequence
cttaccttgactggtgaagt

SEQ ID NO: 105372 - DNA, 20 bp, Artificial
  CRISPR gRNA sequence
ccttgactggtgaagtcagc

SEQ ID NO: 105373 - DNA, 20 bp, Artificial
  CRISPR gRNA sequence
gtgaagtcagccagccatct

SEQ ID NO: 105374 - DNA, 20 bp, Artificial
  CRISPR gRNA sequence
aagtcagccagccatctcag

SEQ ID NO: 105375 - DNA, 20 bp, Artificial
  CRISPR gRNA sequence
agtcagccagccatctcagc

SEQ ID NO: 105376 - DNA, 20 bp, Artificial
  CRISPR gRNA sequence
gtcagccagccatctcagca

SEQ ID NO: 105377 - DNA, 20 bp, Artificial
  CRISPR gRNA sequence
agccagccatctcagcaggg

SEQ ID NO: 105378 - DNA, 20 bp, Artificial
  CRISPR gRNA sequence
ttctcaaccaaaactgcaat

SEQ ID NO: 105379 - DNA, 20 bp, Artificial
  CRISPR gRNA sequence
tctcaaccaaaactgcaatc

SEQ ID NO: 105380 - DNA, 20 bp, Artificial
  CRISPR gRNA sequence
aaccaaaactgcaatcagga

SEQ ID NO: 105381 - DNA, 20 bp, Artificial
  CRISPR gRNA sequence
caaaactgcaatcaggaaag

SEQ ID NO: 105382 - DNA, 20 bp, Artificial
  CRISPR gRNA sequence
aactgcaatcaggaaagcag

SEQ ID NO: 105383 - DNA, 20 bp, Artificial
  CRISPR gRNA sequence
cagcagcccactccttccca

SEQ ID NO: 105384 - DNA, 20 bp, Artificial
  CRISPR gRNA sequence
ccactccttcccatggaatc

SEQ ID NO: 105385 - DNA, 20 bp, Artificial
  CRISPR gRNA sequence
tccttcccatggaatctaga

SEQ ID NO: 105386 - DNA, 20 bp, Artificial
  CRISPR gRNA sequence
ctagacagcatttatccctc

SEQ ID NO: 105387 - DNA, 20 bp, Artificial
  CRISPR gRNA sequence
gacagcatttatccctctgg

SEQ ID NO: 105388 - DNA, 20 bp, Artificial
  CRISPR gRNA sequence
acagcatttatccctctggt

SEQ ID NO: 105389 - DNA, 20 bp, Artificial
  CRISPR gRNA sequence
cagcatttatccctctggtg

SEQ ID NO: 105390 - DNA, 20 bp, Artificial
  CRISPR gRNA sequence
agcatttatccctctggtgg

SEQ ID NO: 105391 - DNA, 20 bp, Artificial
  CRISPR gRNA sequence
tctcacactgactaactgaa

SEQ ID NO: 105392 - DNA, 20 bp, Artificial
  CRISPR gRNA sequence
ctgaatggacgctttgtatt

SEQ ID NO: 105393 - DNA, 20 bp, Artificial
  CRISPR gRNA sequence
gaatggacgctttgtattca

SEQ ID NO: 105394 - DNA, 20 bp, Artificial
  CRISPR gRNA sequence
ggacgctttgtattcagaga

SEQ ID NO: 105395 - DNA, 20 bp, Artificial
  CRISPR gRNA sequence
ttgtattcagagatggcttc

SEQ ID NO: 105396 - DNA, 20 bp, Artificial
  CRISPR gRNA sequence
tgtattcagagatggcttcc

SEQ ID NO: 105397 - DNA, 20 bp, Artificial
  CRISPR gRNA sequence
ttcagagatggcttccaggc

SEQ ID NO: 105398 - DNA, 20 bp, Artificial
  CRISPR gRNA sequence
tcagagatggcttccaggca

SEQ ID NO: 105399 - DNA, 20 bp, Artificial
  CRISPR gRNA sequence
gagatggcttccaggcaagg

SEQ ID NO: 105400 - DNA, 20 bp, Artificial
  CRISPR gRNA sequence
ggaagttctatcttgtgata

SEQ ID NO: 105401 - DNA, 20 bp, Artificial
  CRISPR gRNA sequence
tacggaaacaataaattcct

SEQ ID NO: 105402 - DNA, 20 bp, Artificial
  CRISPR gRNA sequence
agatacattcttccaatctg

SEQ ID NO: 105403 - DNA, 20 bp, Artificial
  CRISPR gRNA sequence
ttccaatctgtggtaataat

SEQ ID NO: 105404 - DNA, 20 bp, Artificial
  CRISPR gRNA sequence
aataagaattcctctctgcc

SEQ ID NO: 105405 - DNA, 20 bp, Artificial
  CRISPR gRNA sequence
agaattcctctctgcccaga

SEQ ID NO: 105406 - DNA, 20 bp, Artificial
  CRISPR gRNA sequence
attcctctctgcccagatgg

SEQ ID NO: 105407 - DNA, 20 bp, Artificial
  CRISPR gRNA sequence
ttcctctctgcccagatggt

SEQ ID NO: 105408 - DNA, 20 bp, Artificial
  CRISPR gRNA sequence
agatggtaggttgatatttc

SEQ ID NO: 105409 - DNA, 20 bp, Artificial
  CRISPR gRNA sequence
aggttgatatttctggactc

SEQ ID NO: 105410 - DNA, 20 bp, Artificial
  CRISPR gRNA sequence
gatatttctggactctagcc

SEQ ID NO: 105411 - DNA, 20 bp, Artificial
  CRISPR gRNA sequence
tctggactctagccaagaaa

SEQ ID NO: 105412 - DNA, 20 bp, Artificial
  CRISPR gRNA sequence
agccaagaaaaagctaattc

SEQ ID NO: 105413 - DNA, 20 bp, Artificial
  CRISPR gRNA sequence
gccaagaaaaagctaattct

SEQ ID NO: 105414 - DNA, 20 bp, Artificial
  CRISPR gRNA sequence
ccaagaaaaagctaattctg

SEQ ID NO: 105415 - DNA, 20 bp, Artificial
  CRISPR gRNA sequence
gaaaaagctaattctgggga

SEQ ID NO: 105416 - DNA, 20 bp, Artificial
  CRISPR gRNA sequence
ttctggggatagaatgataa

SEQ ID NO: 105417 - DNA, 20 bp, Artificial
  CRISPR gRNA sequence
gatagaatgataaaagactc

SEQ ID NO: 105418 - DNA, 20 bp, Artificial
  CRISPR gRNA sequence
cattgccgaatctctttttc

SEQ ID NO: 105419 - DNA, 20 bp, Artificial
  CRISPR gRNA sequence
tctctttttctagctttgaa

SEQ ID NO: 105420 - DNA, 20 bp, Artificial
  CRISPR gRNA sequence
tttctagctttgaaaagttg

SEQ ID NO: 105421 - DNA, 20 bp, Artificial
  CRISPR gRNA sequence
ctgcttgtccctctgttgac

SEQ ID NO: 105422 - DNA, 20 bp, Artificial
  CRISPR gRNA sequence
ccctctgttgactggtcatc

SEQ ID NO: 105423 - DNA, 20 bp, Artificial
  CRISPR gRNA sequence
ctggaccatcgtacttgctg

SEQ ID NO: 105424 - DNA, 20 bp, Artificial
  CRISPR gRNA sequence
tacttgctgtggctacttct

SEQ ID NO: 105425 - DNA, 20 bp, Artificial
  CRISPR gRNA sequence
tggctacttctaagacaatg

SEQ ID NO: 105426 - DNA, 20 bp, Artificial
  CRISPR gRNA sequence
gctacttctaagacaatgta

SEQ ID NO: 105427 - DNA, 20 bp, Artificial
  CRISPR gRNA sequence
ctacttctaagacaatgtag

SEQ ID NO: 105428 - DNA, 20 bp, Artificial
  CRISPR gRNA sequence
tacttctaagacaatgtaga

SEQ ID NO: 105429 - DNA, 20 bp, Artificial
  CRISPR gRNA sequence
accttgaaactgcctttcct

SEQ ID NO: 105430 - DNA, 20 bp, Artificial
  CRISPR gRNA sequence
ttgaaactgcctttcctaag

SEQ ID NO: 105431 - DNA, 20 bp, Artificial
  CRISPR gRNA sequence
gaaactgcctttcctaagta

SEQ ID NO: 105432 - DNA, 20 bp, Artificial
  CRISPR gRNA sequence
gcctttcctaagtagagaac

SEQ ID NO: 105433 - DNA, 20 bp, Artificial
  CRISPR gRNA sequence
attcaacaacttctttgctg

SEQ ID NO: 105434 - DNA, 20 bp, Artificial
  CRISPR gRNA sequence
aacttctttgctgaagcact

SEQ ID NO: 105435 - DNA, 20 bp, Artificial
  CRISPR gRNA sequence
acttctttgctgaagcactg

SEQ ID NO: 105436 - DNA, 20 bp, Artificial
  CRISPR gRNA sequence
ttctttgctgaagcactgag

SEQ ID NO: 105437 - DNA, 20 bp, Artificial
  CRISPR gRNA sequence
ggagatttgtaatactccta

SEQ ID NO: 105438 - DNA, 20 bp, Artificial
  CRISPR gRNA sequence
gagatttgtaatactcctaa

SEQ ID NO: 105439 - DNA, 20 bp, Artificial
  CRISPR gRNA sequence
atttgtaatactcctaaagg

SEQ ID NO: 105440 - DNA, 20 bp, Artificial
  CRISPR gRNA sequence
tttgtaatactcctaaagga

SEQ ID NO: 105441 - DNA, 20 bp, Artificial
  CRISPR gRNA sequence
ttgtaatactcctaaaggaa

SEQ ID NO: 105442 - DNA, 20 bp, Artificial
  CRISPR gRNA sequence
tcctaaaggaagggccaaac

SEQ ID NO: 105443 - DNA, 20 bp, Artificial
  CRISPR gRNA sequence
ctaaaggaagggccaaacta

SEQ ID NO: 105444 - DNA, 20 bp, Artificial
  CRISPR gRNA sequence
aaactagagattttcaatca

SEQ ID NO: 105445 - DNA, 20 bp, Artificial
  CRISPR gRNA sequence
ttcaatcatagactttgtga

SEQ ID NO: 105446 - DNA, 20 bp, Artificial
  CRISPR gRNA sequence
atagactttgtgacagcatt

SEQ ID NO: 105447 - DNA, 20 bp, Artificial
  CRISPR gRNA sequence
tagactttgtgacagcattt

SEQ ID NO: 105448 - DNA, 20 bp, Artificial
  CRISPR gRNA sequence
agactttgtgacagcatttg

SEQ ID NO: 105449 - DNA, 20 bp, Artificial
  CRISPR gRNA sequence
gacagcatttggggaactaa

SEQ ID NO: 105450 - DNA, 20 bp, Artificial
  CRISPR gRNA sequence
actaaaagattcatgtgttt

SEQ ID NO: 105451 - DNA, 20 bp, Artificial
  CRISPR gRNA sequence
aagattcatgtgtttcagcc

SEQ ID NO: 105452 - DNA, 20 bp, Artificial
  CRISPR gRNA sequence
attcatgtgtttcagcctag

SEQ ID NO: 105453 - DNA, 20 bp, Artificial
  CRISPR gRNA sequence
ttcatgtgtttcagcctagt

SEQ ID NO: 105454 - DNA, 20 bp, Artificial
  CRISPR gRNA sequence
catgtgtttcagcctagtgg

SEQ ID NO: 105455 - DNA, 20 bp, Artificial
  CRISPR gRNA sequence
tgtgtttcagcctagtggga

SEQ ID NO: 105456 - DNA, 20 bp, Artificial
  CRISPR gRNA sequence
tgtttcagcctagtgggaga

SEQ ID NO: 105457 - DNA, 20 bp, Artificial
  CRISPR gRNA sequence
ttcagcctagtgggagagag

SEQ ID NO: 105458 - DNA, 20 bp, Artificial
  CRISPR gRNA sequence
tcagcctagtgggagagagt

SEQ ID NO: 105459 - DNA, 20 bp, Artificial
  CRISPR gRNA sequence
cagcctagtgggagagagtg

SEQ ID NO: 105460 - DNA, 20 bp, Artificial
  CRISPR gRNA sequence
agcctagtgggagagagtgg

SEQ ID NO: 105461 - DNA, 20 bp, Artificial
  CRISPR gRNA sequence
cctagtgggagagagtgggg

SEQ ID NO: 105462 - DNA, 20 bp, Artificial
  CRISPR gRNA sequence
tagtgggagagagtggggga

SEQ ID NO: 105463 - DNA, 20 bp, Artificial
  CRISPR gRNA sequence
agtgggagagagtgggggag

SEQ ID NO: 105464 - DNA, 20 bp, Artificial
  CRISPR gRNA sequence
gggagagagtgggggagagg

SEQ ID NO: 105465 - DNA, 20 bp, Artificial
  CRISPR gRNA sequence
gagagagtgggggagaggaa

SEQ ID NO: 105466 - DNA, 20 bp, Artificial
  CRISPR gRNA sequence
gagagtgggggagaggaaga

SEQ ID NO: 105467 - DNA, 20 bp, Artificial
  CRISPR gRNA sequence
gagtgggggagaggaagaga

SEQ ID NO: 105468 - DNA, 20 bp, Artificial
  CRISPR gRNA sequence
gtgggggagaggaagagaga

SEQ ID NO: 105469 - DNA, 20 bp, Artificial
  CRISPR gRNA sequence
gggggagaggaagagagaga

SEQ ID NO: 105470 - DNA, 20 bp, Artificial
  CRISPR gRNA sequence
gggagaggaagagagagaga

SEQ ID NO: 105471 - DNA, 20 bp, Artificial
  CRISPR gRNA sequence
tgtatacccgtatgttatca

SEQ ID NO: 105472 - DNA, 20 bp, Artificial
  CRISPR gRNA sequence
tatacccgtatgttatcata

SEQ ID NO: 105473 - DNA, 20 bp, Artificial
  CRISPR gRNA sequence
tatcatagagcacgattctc

SEQ ID NO: 105474 - DNA, 20 bp, Artificial
  CRISPR gRNA sequence
catagagcacgattctccag

SEQ ID NO: 105475 - DNA, 20 bp, Artificial
  CRISPR gRNA sequence
gagcacgattctccagtgga

SEQ ID NO: 105476 - DNA, 20 bp, Artificial
  CRISPR gRNA sequence
ttctccagtggatggatacc

SEQ ID NO: 105477 - DNA, 20 bp, Artificial
  CRISPR gRNA sequence
cagtggatggatacctggaa

SEQ ID NO: 105478 - DNA, 20 bp, Artificial
  CRISPR gRNA sequence
gatacctggaatggatcatt

SEQ ID NO: 105479 - DNA, 20 bp, Artificial
  CRISPR gRNA sequence
tggaatggatcattaagatg

SEQ ID NO: 105480 - DNA, 20 bp, Artificial
  CRISPR gRNA sequence
gaatggatcattaagatgaa

SEQ ID NO: 105481 - DNA, 20 bp, Artificial
  CRISPR gRNA sequence
atggatcattaagatgaaga

SEQ ID NO: 105482 - DNA, 20 bp, Artificial
  CRISPR gRNA sequence
agagtaattcacatttactc

SEQ ID NO: 105483 - DNA, 20 bp, Artificial
  CRISPR gRNA sequence
tttactctagaacctttaac

SEQ ID NO: 105484 - DNA, 20 bp, Artificial
  CRISPR gRNA sequence
gaacctttaacaagcactga

SEQ ID NO: 105485 - DNA, 20 bp, Artificial
  CRISPR gRNA sequence
aacctttaacaagcactgaa

SEQ ID NO: 105486 - DNA, 20 bp, Artificial
  CRISPR gRNA sequence
ctttaacaagcactgaaagg

SEQ ID NO: 105487 - DNA, 20 bp, Artificial
  CRISPR gRNA sequence
taacaagcactgaaaggaag

SEQ ID NO: 105488 - DNA, 20 bp, Artificial
  CRISPR gRNA sequence
gcactgaaaggaagaagcct

SEQ ID NO: 105489 - DNA, 20 bp, Artificial
  CRISPR gRNA sequence
atttgatccttgacaatttc

SEQ ID NO: 105490 - DNA, 20 bp, Artificial
  CRISPR gRNA sequence
gatccttgacaatttctgga

SEQ ID NO: 105491 - DNA, 20 bp, Artificial
  CRISPR gRNA sequence
tgacaatttctggaaagcac

SEQ ID NO: 105492 - DNA, 20 bp, Artificial
  CRISPR gRNA sequence
aatttctggaaagcactggt

SEQ ID NO: 105493 - DNA, 20 bp, Artificial
  CRISPR gRNA sequence
actggtcagtcacactgtcc

SEQ ID NO: 105494 - DNA, 20 bp, Artificial
  CRISPR gRNA sequence
gtcagtcacactgtcctgga

SEQ ID NO: 105495 - DNA, 20 bp, Artificial
  CRISPR gRNA sequence
cagtcacactgtcctggaca

SEQ ID NO: 105496 - DNA, 20 bp, Artificial
  CRISPR gRNA sequence
cactgtcctggacagagtcc

SEQ ID NO: 105497 - DNA, 20 bp, Artificial
  CRISPR gRNA sequence
agagtccaagttacccacta

SEQ ID NO: 105498 - DNA, 20 bp, Artificial
  CRISPR gRNA sequence
caagttacccactaaagctt

SEQ ID NO: 105499 - DNA, 20 bp, Artificial
  CRISPR gRNA sequence
aagttacccactaaagcttg

SEQ ID NO: 105500 - DNA, 20 bp, Artificial
  CRISPR gRNA sequence
ttacccactaaagcttgagg

SEQ ID NO: 105501 - DNA, 20 bp, Artificial
  CRISPR gRNA sequence
ctaaagcttgaggtggatgt

SEQ ID NO: 105502 - DNA, 20 bp, Artificial
  CRISPR gRNA sequence
ggatgttggcttcactcctg

SEQ ID NO: 105503 - DNA, 20 bp, Artificial
  CRISPR gRNA sequence
tcactcctgcagcacaatgc

SEQ ID NO: 105504 - DNA, 20 bp, Artificial
  CRISPR gRNA sequence
ctgcagcacaatgctggccc

SEQ ID NO: 105505 - DNA, 20 bp, Artificial
  CRISPR gRNA sequence
agcacaatgctggccctaga

SEQ ID NO: 105506 - DNA, 20 bp, Artificial
  CRISPR gRNA sequence
caatgctggccctagaaagc

SEQ ID NO: 105507 - DNA, 20 bp, Artificial
  CRISPR gRNA sequence
gagcattttcattcttccca

SEQ ID NO: 105508 - DNA, 20 bp, Artificial
  CRISPR gRNA sequence
cattttcattcttcccatgg

SEQ ID NO: 105509 - DNA, 20 bp, Artificial
  CRISPR gRNA sequence
tcccatggcagctgattctt

SEQ ID NO: 105510 - DNA, 20 bp, Artificial
  CRISPR gRNA sequence
ggcagctgattctttggtgc

SEQ ID NO: 105511 - DNA, 20 bp, Artificial
  CRISPR gRNA sequence
cagttttcatgttttctcca

SEQ ID NO: 105512 - DNA, 20 bp, Artificial
  CRISPR gRNA sequence
agttttcatgttttctccat

SEQ ID NO: 105513 - DNA, 20 bp, Artificial
  CRISPR gRNA sequence
ttttctccataggccttgtg

SEQ ID NO: 105514 - DNA, 20 bp, Artificial
  CRISPR gRNA sequence
ctccataggccttgtgcaga

SEQ ID NO: 105515 - DNA, 20 bp, Artificial
  CRISPR gRNA sequence
tccataggccttgtgcagaa

SEQ ID NO: 105516 - DNA, 20 bp, Artificial
  CRISPR gRNA sequence
tctcattgcatccatactgt

SEQ ID NO: 105517 - DNA, 20 bp, Artificial
  CRISPR gRNA sequence
catactgtgagaataaactg

SEQ ID NO: 105518 - DNA, 20 bp, Artificial
  CRISPR gRNA sequence
gagaataaactgcagactga

SEQ ID NO: 105519 - DNA, 20 bp, Artificial
  CRISPR gRNA sequence
gactgaaagaaacatgcctg

SEQ ID NO: 105520 - DNA, 20 bp, Artificial
  CRISPR gRNA sequence
actgaaagaaacatgcctgc

SEQ ID NO: 105521 - DNA, 20 bp, Artificial
  CRISPR gRNA sequence
ctgaaagaaacatgcctgca

SEQ ID NO: 105522 - DNA, 20 bp, Artificial
  CRISPR gRNA sequence
aagaaacatgcctgcagggt

SEQ ID NO: 105523 - DNA, 20 bp, Artificial
  CRISPR gRNA sequence
agaaacatgcctgcagggtc

SEQ ID NO: 105524 - DNA, 20 bp, Artificial
  CRISPR gRNA sequence
atgcctgcagggtcaggaac

SEQ ID NO: 105525 - DNA, 20 bp, Artificial
  CRISPR gRNA sequence
tgcctgcagggtcaggaact

SEQ ID NO: 105526 - DNA, 20 bp, Artificial
  CRISPR gRNA sequence
aggaactgggccactgttcc

SEQ ID NO: 105527 - DNA, 20 bp, Artificial
  CRISPR gRNA sequence
ctgggccactgttcccagaa

SEQ ID NO: 105528 - DNA, 20 bp, Artificial
  CRISPR gRNA sequence
tgggccactgttcccagaac

SEQ ID NO: 105529 - DNA, 20 bp, Artificial
  CRISPR gRNA sequence
tcccagaacgggttgtgcct

SEQ ID NO: 105530 - DNA, 20 bp, Artificial
  CRISPR gRNA sequence
tcagaaatctatttctcttt

SEQ ID NO: 105531 - DNA, 20 bp, Artificial
  CRISPR gRNA sequence
tcttttagatgttgaaccct

SEQ ID NO: 105532 - DNA, 20 bp, Artificial
  CRISPR gRNA sequence
ttttagatgttgaaccctga

SEQ ID NO: 105533 - DNA, 20 bp, Artificial
  CRISPR gRNA sequence
tgttgaaccctgagagaact

SEQ ID NO: 105534 - DNA, 20 bp, Artificial
  CRISPR gRNA sequence
agagaactaagatgatattt

SEQ ID NO: 105535 - DNA, 20 bp, Artificial
  CRISPR gRNA sequence
gaactaagatgatatttcag

SEQ ID NO: 105536 - DNA, 20 bp, Artificial
  CRISPR gRNA sequence
actaagatgatatttcagaa

SEQ ID NO: 105537 - DNA, 20 bp, Artificial
  CRISPR gRNA sequence
agatgatatttcagaagagt

SEQ ID NO: 105538 - DNA, 20 bp, Artificial
  CRISPR gRNA sequence
gaagagttggctgccttctc

SEQ ID NO: 105539 - DNA, 20 bp, Artificial
  CRISPR gRNA sequence
tggctgccttctctggaaac

SEQ ID NO: 105540 - DNA, 20 bp, Artificial
  CRISPR gRNA sequence
ggctgccttctctggaaaca

SEQ ID NO: 105541 - DNA, 20 bp, Artificial
  CRISPR gRNA sequence
aaggaaaacccaataattcc

SEQ ID NO: 105542 - DNA, 20 bp, Artificial
  CRISPR gRNA sequence
aggaaaacccaataattccg

SEQ ID NO: 105543 - DNA, 20 bp, Artificial
  CRISPR gRNA sequence
ccaataattccgaggaacat

SEQ ID NO: 105544 - DNA, 20 bp, Artificial
  CRISPR gRNA sequence
caataattccgaggaacatt

SEQ ID NO: 105545 - DNA, 20 bp, Artificial
  CRISPR gRNA sequence
aataattccgaggaacattg

SEQ ID NO: 105546 - DNA, 20 bp, Artificial
  CRISPR gRNA sequence
ataattccgaggaacattgg

SEQ ID NO: 105547 - DNA, 20 bp, Artificial
  CRISPR gRNA sequence
aacattgggggttaaatacc

SEQ ID NO: 105548 - DNA, 20 bp, Artificial
  CRISPR gRNA sequence
taaataccaagaataaaaat

SEQ ID NO: 105549 - DNA, 20 bp, Artificial
  CRISPR gRNA sequence
aattggttcttctttgactt

SEQ ID NO: 105550 - DNA, 20 bp, Artificial
  CRISPR gRNA sequence
gacttcagcttaactgtatt

SEQ ID NO: 105551 - DNA, 20 bp, Artificial
  CRISPR gRNA sequence
tcagcttaactgtattaaga

SEQ ID NO: 105552 - DNA, 20 bp, Artificial
  CRISPR gRNA sequence
actgtattaagacagaaatt

SEQ ID NO: 105553 - DNA, 20 bp, Artificial
  CRISPR gRNA sequence
agccctctaaaaacaccaca

SEQ ID NO: 105554 - DNA, 20 bp, Artificial
  CRISPR gRNA sequence
ccctctaaaaacaccacaaa

SEQ ID NO: 105555 - DNA, 20 bp, Artificial
  CRISPR gRNA sequence
ctctaaaaacaccacaaaga

SEQ ID NO: 105556 - DNA, 20 bp, Artificial
  CRISPR gRNA sequence
aagagagatgattgtaatga

SEQ ID NO: 105557 - DNA, 20 bp, Artificial
  CRISPR gRNA sequence
gatgattgtaatgatagaaa

SEQ ID NO: 105558 - DNA, 20 bp, Artificial
  CRISPR gRNA sequence
tgattgtaatgatagaaata

SEQ ID NO: 105559 - DNA, 20 bp, Artificial
  CRISPR gRNA sequence
gattgtaatgatagaaatag

SEQ ID NO: 105560 - DNA, 20 bp, Artificial
  CRISPR gRNA sequence
taatgatagaaatagaggta

SEQ ID NO: 105561 - DNA, 20 bp, Artificial
  CRISPR gRNA sequence
atgatagaaatagaggtaca

SEQ ID NO: 105562 - DNA, 20 bp, Artificial
  CRISPR gRNA sequence
tagaggtacagagctatgca

SEQ ID NO: 105563 - DNA, 20 bp, Artificial
  CRISPR gRNA sequence
agaggtacagagctatgcaa

SEQ ID NO: 105564 - DNA, 20 bp, Artificial
  CRISPR gRNA sequence
acagagctatgcaaaggaaa

SEQ ID NO: 105565 - DNA, 20 bp, Artificial
  CRISPR gRNA sequence
cagagctatgcaaaggaaac

SEQ ID NO: 105566 - DNA, 20 bp, Artificial
  CRISPR gRNA sequence
agctatgcaaaggaaacagg

SEQ ID NO: 105567 - DNA, 20 bp, Artificial
  CRISPR gRNA sequence
aacaggaagtgaaatattcc

SEQ ID NO: 105568 - DNA, 20 bp, Artificial
  CRISPR gRNA sequence
aagtgaaatattcctagtcc

SEQ ID NO: 105569 - DNA, 20 bp, Artificial
  CRISPR gRNA sequence
agtgaaatattcctagtccc

SEQ ID NO: 105570 - DNA, 20 bp, Artificial
  CRISPR gRNA sequence
gtgaaatattcctagtccca

SEQ ID NO: 105571 - DNA, 20 bp, Artificial
  CRISPR gRNA sequence
tattcctagtcccagggatc

SEQ ID NO: 105572 - DNA, 20 bp, Artificial
  CRISPR gRNA sequence
agggatctggtaatcgctcc

SEQ ID NO: 105573 - DNA, 20 bp, Artificial
  CRISPR gRNA sequence
tggtaatcgctcctggcttc

SEQ ID NO: 105574 - DNA, 20 bp, Artificial
  CRISPR gRNA sequence
ctcctggcttccagatgtca

SEQ ID NO: 105575 - DNA, 20 bp, Artificial
  CRISPR gRNA sequence
tcctggcttccagatgtcaa

SEQ ID NO: 105576 - DNA, 20 bp, Artificial
  CRISPR gRNA sequence
atgtcaaaggactgatcctt

SEQ ID NO: 105577 - DNA, 20 bp, Artificial
  CRISPR gRNA sequence
caaaggactgatcctttggt

SEQ ID NO: 105578 - DNA, 20 bp, Artificial
  CRISPR gRNA sequence
tgatcctttggtaagctcac

SEQ ID NO: 105579 - DNA, 20 bp, Artificial
  CRISPR gRNA sequence
gtaagctcactagaaacttc

SEQ ID NO: 105580 - DNA, 20 bp, Artificial
  CRISPR gRNA sequence
ctagaaacttctagctctac

SEQ ID NO: 105581 - DNA, 20 bp, Artificial
  CRISPR gRNA sequence
agaaacttctagctctacaa

SEQ ID NO: 105582 - DNA, 20 bp, Artificial
  CRISPR gRNA sequence
cttctagctctacaagagtt

SEQ ID NO: 105583 - DNA, 20 bp, Artificial
  CRISPR gRNA sequence
ttctagctctacaagagttt

SEQ ID NO: 105584 - DNA, 20 bp, Artificial
  CRISPR gRNA sequence
tttgggatattaatgttatt

SEQ ID NO: 105585 - DNA, 20 bp, Artificial
  CRISPR gRNA sequence
ggatattaatgttattcagt

SEQ ID NO: 105586 - DNA, 20 bp, Artificial
  CRISPR gRNA sequence
aatgttattcagtaagtccc

SEQ ID NO: 105587 - DNA, 20 bp, Artificial
  CRISPR gRNA sequence
tcagtaagtcccaagttttt

SEQ ID NO: 105588 - DNA, 20 bp, Artificial
  CRISPR gRNA sequence
agtaagtcccaagtttttca

SEQ ID NO: 105589 - DNA, 20 bp, Artificial
  CRISPR gRNA sequence
gtcccaagtttttcagagaa

SEQ ID NO: 105590 - DNA, 20 bp, Artificial
  CRISPR gRNA sequence
gagaatagattactaacaat

SEQ ID NO: 105591 - DNA, 20 bp, Artificial
  CRISPR gRNA sequence
agaatagattactaacaatg

SEQ ID NO: 105592 - DNA, 20 bp, Artificial
  CRISPR gRNA sequence
aatgaggaatttatattcct

SEQ ID NO: 105593 - DNA, 20 bp, Artificial
  CRISPR gRNA sequence
tttatattccttggttaatt

SEQ ID NO: 105594 - DNA, 20 bp, Artificial
  CRISPR gRNA sequence
ttatattccttggttaattt

SEQ ID NO: 105595 - DNA, 20 bp, Artificial
  CRISPR gRNA sequence
atattccttggttaatttag

SEQ ID NO: 105596 - DNA, 20 bp, Artificial
  CRISPR gRNA sequence
cttggttaatttaggagtct

SEQ ID NO: 105597 - DNA, 20 bp, Artificial
  CRISPR gRNA sequence
taatttaggagtctaagatg

SEQ ID NO: 105598 - DNA, 20 bp, Artificial
  CRISPR gRNA sequence
atttaggagtctaagatgca

SEQ ID NO: 105599 - DNA, 20 bp, Artificial
  CRISPR gRNA sequence
ggagtctaagatgcagagtt

SEQ ID NO: 105600 - DNA, 20 bp, Artificial
  CRISPR gRNA sequence
tctaagatgcagagttcaga

SEQ ID NO: 105601 - DNA, 20 bp, Artificial
  CRISPR gRNA sequence
gagttcagaaagaaattact

SEQ ID NO: 105602 - DNA, 20 bp, Artificial
  CRISPR gRNA sequence
aattactcagacctaacttt

SEQ ID NO: 105603 - DNA, 20 bp, Artificial
  CRISPR gRNA sequence
agacctaactttgagtgctt

SEQ ID NO: 105604 - DNA, 20 bp, Artificial
  CRISPR gRNA sequence
ttgagtgcttaagctgccaa

SEQ ID NO: 105605 - DNA, 20 bp, Artificial
  CRISPR gRNA sequence
gtgcttaagctgccaacagt

SEQ ID NO: 105606 - DNA, 20 bp, Artificial
  CRISPR gRNA sequence
cttaagctgccaacagttag

SEQ ID NO: 105607 - DNA, 20 bp, Artificial
  CRISPR gRNA sequence
tgctatttatttgtgtctgt

SEQ ID NO: 105608 - DNA, 20 bp, Artificial
  CRISPR gRNA sequence
tgtgtctgtaagtttgtaca

SEQ ID NO: 105609 - DNA, 20 bp, Artificial
  CRISPR gRNA sequence
aagtttgtacatagtaatgc

SEQ ID NO: 105610 - DNA, 20 bp, Artificial
  CRISPR gRNA sequence
ttgttgctgaattttttatt

SEQ ID NO: 105611 - DNA, 20 bp, Artificial
  CRISPR gRNA sequence
tgttgctgaattttttattt

SEQ ID NO: 105612 - DNA, 20 bp, Artificial
  CRISPR gRNA sequence
gttgctgaattttttatttg

SEQ ID NO: 105613 - DNA, 20 bp, Artificial
  CRISPR gRNA sequence
ttgctgaattttttatttgg

SEQ ID NO: 105614 - DNA, 20 bp, Artificial
  CRISPR gRNA sequence
tgctgaattttttatttggg

SEQ ID NO: 105615 - DNA, 20 bp, Artificial
  CRISPR gRNA sequence
ctgaattttttatttggggg

SEQ ID NO: 105616 - DNA, 20 bp, Artificial
  CRISPR gRNA sequence
gaattttgtttgaaatgctt

SEQ ID NO: 105617 - DNA, 20 bp, Artificial
  CRISPR gRNA sequence
ttttgtcattgcatttcaaa

SEQ ID NO: 105618 - DNA, 20 bp, Artificial
  CRISPR gRNA sequence
agctcatgacccttttcttg

SEQ ID NO: 105619 - DNA, 20 bp, Artificial
  CRISPR gRNA sequence
cccttttcttgtggtcactt

SEQ ID NO: 105620 - DNA, 20 bp, Artificial
  CRISPR gRNA sequence
gtggtcactttggcacacca

SEQ ID NO: 105621 - DNA, 20 bp, Artificial
  CRISPR gRNA sequence
gtcactttggcacaccatag

SEQ ID NO: 105622 - DNA, 20 bp, Artificial
  CRISPR gRNA sequence
gcacaccatagtagcccaca

SEQ ID NO: 105623 - DNA, 20 bp, Artificial
  CRISPR gRNA sequence
caccatagtagcccacaaag

SEQ ID NO: 105624 - DNA, 20 bp, Artificial
  CRISPR gRNA sequence
accatagtagcccacaaagt

SEQ ID NO: 105625 - DNA, 20 bp, Artificial
  CRISPR gRNA sequence
ccatagtagcccacaaagtg

SEQ ID NO: 105626 - DNA, 20 bp, Artificial
  CRISPR gRNA sequence
catagtagcccacaaagtgg

SEQ ID NO: 105627 - DNA, 20 bp, Artificial
  CRISPR gRNA sequence
agtagcccacaaagtggggg

SEQ ID NO: 105628 - DNA, 20 bp, Artificial
  CRISPR gRNA sequence
gtagcccacaaagtgggggc

SEQ ID NO: 105629 - DNA, 20 bp, Artificial
  CRISPR gRNA sequence
tagcccacaaagtgggggca

SEQ ID NO: 105630 - DNA, 20 bp, Artificial
  CRISPR gRNA sequence
gggggcagggtattgacatt

SEQ ID NO: 105631 - DNA, 20 bp, Artificial
  CRISPR gRNA sequence
ttggattttttctttgatac

SEQ ID NO: 105632 - DNA, 20 bp, Artificial
  CRISPR gRNA sequence
ttcatttttatttgtgactg

SEQ ID NO: 105633 - DNA, 20 bp, Artificial
  CRISPR gRNA sequence
tgactgtagtgataacttta

SEQ ID NO: 105634 - DNA, 20 bp, Artificial
  CRISPR gRNA sequence
tgtagtgataactttacaga

SEQ ID NO: 105635 - DNA, 20 bp, Artificial
  CRISPR gRNA sequence
tagtgataactttacagatg

SEQ ID NO: 105636 - DNA, 20 bp, Artificial
  CRISPR gRNA sequence
gataactttacagatggaga

SEQ ID NO: 105637 - DNA, 20 bp, Artificial
  CRISPR gRNA sequence
taactttacagatggagaaa

SEQ ID NO: 105638 - DNA, 20 bp, Artificial
  CRISPR gRNA sequence
acagatggagaaagagtgaa

SEQ ID NO: 105639 - DNA, 20 bp, Artificial
  CRISPR gRNA sequence
tgaatggatgaatgaataat

SEQ ID NO: 105640 - DNA, 20 bp, Artificial
  CRISPR gRNA sequence
tgaataattggtttaatgcc

SEQ ID NO: 105641 - DNA, 20 bp, Artificial
  CRISPR gRNA sequence
aatgcctagttatgcaactt

SEQ ID NO: 105642 - DNA, 20 bp, Artificial
  CRISPR gRNA sequence
agtgcttttttttttttttg

SEQ ID NO: 105643 - DNA, 20 bp, Artificial
  CRISPR gRNA sequence
gtgcttttttttttttttgc

SEQ ID NO: 105644 - DNA, 20 bp, Artificial
  CRISPR gRNA sequence
tttttttgcaggataatttt

SEQ ID NO: 105645 - DNA, 20 bp, Artificial
  CRISPR gRNA sequence
tgtatatattttaactgcac

SEQ ID NO: 105646 - DNA, 20 bp, Artificial
  CRISPR gRNA sequence
cactggtacattgaacatgt

SEQ ID NO: 105647 - DNA, 20 bp, Artificial
  CRISPR gRNA sequence
catgtcagtgtcgatgccac

SEQ ID NO: 105648 - DNA, 20 bp, Artificial
  CRISPR gRNA sequence
tgtcgatgccactggaccaa

SEQ ID NO: 105649 - DNA, 20 bp, Artificial
  CRISPR gRNA sequence
tcgatgccactggaccaaca

SEQ ID NO: 105650 - DNA, 20 bp, Artificial
  CRISPR gRNA sequence
tggaccaacagagcattttg

SEQ ID NO: 105651 - DNA, 20 bp, Artificial
  CRISPR gRNA sequence
aacagagcattttgtggcta

SEQ ID NO: 105652 - DNA, 20 bp, Artificial
  CRISPR gRNA sequence
acagagcattttgtggctat

SEQ ID NO: 105653 - DNA, 20 bp, Artificial
  CRISPR gRNA sequence
cagagcattttgtggctata

SEQ ID NO: 105654 - DNA, 20 bp, Artificial
  CRISPR gRNA sequence
ataatgtcttgatttttctt

SEQ ID NO: 105655 - DNA, 20 bp, Artificial
  CRISPR gRNA sequence
taatgtcttgatttttcttt

SEQ ID NO: 105656 - DNA, 20 bp, Artificial
  CRISPR gRNA sequence
tttgggattcaactatatcg

SEQ ID NO: 105657 - DNA, 20 bp, Artificial
  CRISPR gRNA sequence
ttgggattcaactatatcga

SEQ ID NO: 105658 - DNA, 20 bp, Artificial
  CRISPR gRNA sequence
tatatcgaaggtttttcccc

SEQ ID NO: 105659 - DNA, 20 bp, Artificial
  CRISPR gRNA sequence
atcgaaggtttttcccccag

SEQ ID NO: 105660 - DNA, 20 bp, Artificial
  CRISPR gRNA sequence
aggtttttcccccagcagta

SEQ ID NO: 105661 - DNA, 20 bp, Artificial
  CRISPR gRNA sequence
ggtttttcccccagcagtat

SEQ ID NO: 105662 - DNA, 20 bp, Artificial
  CRISPR gRNA sequence
gtttttcccccagcagtatg

SEQ ID NO: 105663 - DNA, 20 bp, Artificial
  CRISPR gRNA sequence
tttttcccccagcagtatgg

SEQ ID NO: 105664 - DNA, 20 bp, Artificial
  CRISPR gRNA sequence
cccagcagtatgggggcgta

SEQ ID NO: 105665 - DNA, 20 bp, Artificial
  CRISPR gRNA sequence
ccagcagtatgggggcgtac

SEQ ID NO: 105666 - DNA, 20 bp, Artificial
  CRISPR gRNA sequence
aatttataaaaataaccgaa

SEQ ID NO: 105667 - DNA, 20 bp, Artificial
  CRISPR gRNA sequence
cgaaaagtaatgtgactttt

SEQ ID NO: 105668 - DNA, 20 bp, Artificial
  CRISPR gRNA sequence
gaaaagtaatgtgacttttg

SEQ ID NO: 105669 - DNA, 20 bp, Artificial
  CRISPR gRNA sequence
tttgaggaatctgcaactcc

SEQ ID NO: 105670 - DNA, 20 bp, Artificial
  CRISPR gRNA sequence
ttgaggaatctgcaactcct

SEQ ID NO: 105671 - DNA, 20 bp, Artificial
  CRISPR gRNA sequence
aatctgcaactcctgggttc

SEQ ID NO: 105672 - DNA, 20 bp, Artificial
  CRISPR gRNA sequence
tgggttctagtttgtgtttc

SEQ ID NO: 105673 - DNA, 20 bp, Artificial
  CRISPR gRNA sequence
aaattttgatctcccccgac

SEQ ID NO: 105674 - DNA, 20 bp, Artificial
  CRISPR gRNA sequence
cccgacaagacttgtctgca

SEQ ID NO: 105675 - DNA, 20 bp, Artificial
  CRISPR gRNA sequence
acaagacttgtctgcatgga

SEQ ID NO: 105676 - DNA, 20 bp, Artificial
  CRISPR gRNA sequence
atggacggtgtctctgtaaa

SEQ ID NO: 105677 - DNA, 20 bp, Artificial
  CRISPR gRNA sequence
gtatcaaacttgtaatgtct

SEQ ID NO: 105678 - DNA, 20 bp, Artificial
  CRISPR gRNA sequence
cttgtaatgtctgagcctct

SEQ ID NO: 105679 - DNA, 20 bp, Artificial
  CRISPR gRNA sequence
ccccttaatttcttcccttt

SEQ ID NO: 105680 - DNA, 20 bp, Artificial
  CRISPR gRNA sequence
tttggcccttccaccctgtt

SEQ ID NO: 105681 - DNA, 20 bp, Artificial
  CRISPR gRNA sequence
ttggcccttccaccctgttg

SEQ ID NO: 105682 - DNA, 20 bp, Artificial
  CRISPR gRNA sequence
ggcccttccaccctgttgag

SEQ ID NO: 105683 - DNA, 20 bp, Artificial
  CRISPR gRNA sequence
gagattttttctgtcacctg

SEQ ID NO: 105684 - DNA, 20 bp, Artificial
  CRISPR gRNA sequence
agattttttctgtcacctgc

SEQ ID NO: 105685 - DNA, 20 bp, Artificial
  CRISPR gRNA sequence
acatttgatgctactactga

SEQ ID NO: 105686 - DNA, 20 bp, Artificial
  CRISPR gRNA sequence
gtgtttatcaaaatgtgatg

SEQ ID NO: 105687 - DNA, 20 bp, Artificial
  CRISPR gRNA sequence
atgtgatgaagtaattccat

SEQ ID NO: 105688 - DNA, 20 bp, Artificial
  CRISPR gRNA sequence
tgtgatgaagtaattccatg

SEQ ID NO: 105689 - DNA, 20 bp, Artificial
  CRISPR gRNA sequence
agtaattccatgaggaaaat

SEQ ID NO: 105690 - DNA, 20 bp, Artificial
  CRISPR gRNA sequence
attagccgttatcacaaaaa

SEQ ID NO: 105691 - DNA, 20 bp, Artificial
  CRISPR gRNA sequence
gttatcacaaaaacagcctt

SEQ ID NO: 105692 - DNA, 20 bp, Artificial
  CRISPR gRNA sequence
aaaaacagccttaagtattg

SEQ ID NO: 105693 - DNA, 20 bp, Artificial
  CRISPR gRNA sequence
ccttaagtattgtagaattt

SEQ ID NO: 105694 - DNA, 20 bp, Artificial
  CRISPR gRNA sequence
cttaagtattgtagaatttc

SEQ ID NO: 105695 - DNA, 20 bp, Artificial
  CRISPR gRNA sequence
aagtattgtagaatttcagg

SEQ ID NO: 105696 - DNA, 20 bp, Artificial
  CRISPR gRNA sequence
ttgtagaatttcaggtagtg

SEQ ID NO: 105697 - DNA, 20 bp, Artificial
  CRISPR gRNA sequence
atgtactatttacgttttgt

SEQ ID NO: 105698 - DNA, 20 bp, Artificial
  CRISPR gRNA sequence
cgttttgttagattttgttt

SEQ ID NO: 105699 - DNA, 20 bp, Artificial
  CRISPR gRNA sequence
tttgttagattttgttttgg

SEQ ID NO: 105700 - DNA, 20 bp, Artificial
  CRISPR gRNA sequence
gttagattttgttttggcag

SEQ ID NO: 105701 - DNA, 20 bp, Artificial
  CRISPR gRNA sequence
ttggcagaagaccaaaacaa

SEQ ID NO: 105702 - DNA, 20 bp, Artificial
  CRISPR gRNA sequence
ttctgattgttaaaaatcca

SEQ ID NO: 105703 - DNA, 20 bp, Artificial
  CRISPR gRNA sequence
cttgttactgttttacctta

SEQ ID NO: 105704 - DNA, 20 bp, Artificial
  CRISPR gRNA sequence
ctgttttaccttacggtcgc

SEQ ID NO: 105705 - DNA, 20 bp, Artificial
  CRISPR gRNA sequence
tgttttaccttacggtcgct

SEQ ID NO: 105706 - DNA, 20 bp, Artificial
  CRISPR gRNA sequence
cttacggtcgctgggaatct

SEQ ID NO: 105707 - DNA, 20 bp, Artificial
  CRISPR gRNA sequence
cgctgggaatctaagcaaca

SEQ ID NO: 105708 - DNA, 20 bp, Artificial
  CRISPR gRNA sequence
ggaatctaagcaacaaagac

SEQ ID NO: 105709 - DNA, 20 bp, Artificial
  CRISPR gRNA sequence
atctaagcaacaaagactag

SEQ ID NO: 105710 - DNA, 20 bp, Artificial
  CRISPR gRNA sequence
atatgccattatcaacacac

SEQ ID NO: 105711 - DNA, 20 bp, Artificial
  CRISPR gRNA sequence
atgccattatcaacacacaa

SEQ ID NO: 105712 - DNA, 20 bp, Artificial
  CRISPR gRNA sequence
atcaacacacaagagacaaa

SEQ ID NO: 105713 - DNA, 20 bp, Artificial
  CRISPR gRNA sequence
acacaagagacaaacagccc

SEQ ID NO: 105714 - DNA, 20 bp, Artificial
  CRISPR gRNA sequence
cacaagagacaaacagcccg

SEQ ID NO: 105715 - DNA, 20 bp, Artificial
  CRISPR gRNA sequence
aagagacaaacagcccgagg

SEQ ID NO: 105716 - DNA, 20 bp, Artificial
  CRISPR gRNA sequence
ccgaggaagcactcaatgat

SEQ ID NO: 105717 - DNA, 20 bp, Artificial
  CRISPR gRNA sequence
gaggaagcactcaatgatga

SEQ ID NO: 105718 - DNA, 20 bp, Artificial
  CRISPR gRNA sequence
gaagcactcaatgatgagag

SEQ ID NO: 105719 - DNA, 20 bp, Artificial
  CRISPR gRNA sequence
gcactcaatgatgagagcag

SEQ ID NO: 105720 - DNA, 20 bp, Artificial
  CRISPR gRNA sequence
tgagagcagtagacctgccc

SEQ ID NO: 105721 - DNA, 20 bp, Artificial
  CRISPR gRNA sequence
gagcagtagacctgccctgg

SEQ ID NO: 105722 - DNA, 20 bp, Artificial
  CRISPR gRNA sequence
gtagacctgccctggcagat

SEQ ID NO: 105723 - DNA, 20 bp, Artificial
  CRISPR gRNA sequence
agacctgccctggcagatga

SEQ ID NO: 105724 - DNA, 20 bp, Artificial
  CRISPR gRNA sequence
acctgccctggcagatgaga

SEQ ID NO: 105725 - DNA, 20 bp, Artificial
  CRISPR gRNA sequence
cctgccctggcagatgagag

SEQ ID NO: 105726 - DNA, 20 bp, Artificial
  CRISPR gRNA sequence
tgccctggcagatgagagag

SEQ ID NO: 105727 - DNA, 20 bp, Artificial
  CRISPR gRNA sequence
aggagaaactctccacaatg

SEQ ID NO: 105728 - DNA, 20 bp, Artificial
  CRISPR gRNA sequence
ggagaaactctccacaatga

SEQ ID NO: 105729 - DNA, 20 bp, Artificial
  CRISPR gRNA sequence
aactctccacaatgaaggaa

SEQ ID NO: 105730 - DNA, 20 bp, Artificial
  CRISPR gRNA sequence
caatgaaggaaaagcactga

SEQ ID NO: 105731 - DNA, 20 bp, Artificial
  CRISPR gRNA sequence
aaagcactgacagtatttga

SEQ ID NO: 105732 - DNA, 20 bp, Artificial
  CRISPR gRNA sequence
ctgacagtatttgatagctt

SEQ ID NO: 105733 - DNA, 20 bp, Artificial
  CRISPR gRNA sequence
gctttagtcaaactgtgctt

SEQ ID NO: 105734 - DNA, 20 bp, Artificial
  CRISPR gRNA sequence
agtcaaactgtgcttgagtt

SEQ ID NO: 105735 - DNA, 20 bp, Artificial
  CRISPR gRNA sequence
aactgtgcttgagtttggct

SEQ ID NO: 105736 - DNA, 20 bp, Artificial
  CRISPR gRNA sequence
agtttggcttagatttatgc

SEQ ID NO: 105737 - DNA, 20 bp, Artificial
  CRISPR gRNA sequence
ttggcttagatttatgccag

SEQ ID NO: 105738 - DNA, 20 bp, Artificial
  CRISPR gRNA sequence
gaacctgtccttaccaaatt

SEQ ID NO: 105739 - DNA, 20 bp, Artificial
  CRISPR gRNA sequence
acctgtccttaccaaattca

SEQ ID NO: 105740 - DNA, 20 bp, Artificial
  CRISPR gRNA sequence
accaaattcagagatgaccc

SEQ ID NO: 105741 - DNA, 20 bp, Artificial
  CRISPR gRNA sequence
tgacccaagattctactctg

SEQ ID NO: 105742 - DNA, 20 bp, Artificial
  CRISPR gRNA sequence
aagattctactctgtggtat

SEQ ID NO: 105743 - DNA, 20 bp, Artificial
  CRISPR gRNA sequence
agattctactctgtggtatg

SEQ ID NO: 105744 - DNA, 20 bp, Artificial
  CRISPR gRNA sequence
gattctactctgtggtatga

SEQ ID NO: 105745 - DNA, 20 bp, Artificial
  CRISPR gRNA sequence
ctactctgtggtatgaggga

SEQ ID NO: 105746 - DNA, 20 bp, Artificial
  CRISPR gRNA sequence
cgatatttatctcacaccaa

SEQ ID NO: 105747 - DNA, 20 bp, Artificial
  CRISPR gRNA sequence
tcacaccaacggctttatcg

SEQ ID NO: 105748 - DNA, 20 bp, Artificial
  CRISPR gRNA sequence
cacaccaacggctttatcgt

SEQ ID NO: 105749 - DNA, 20 bp, Artificial
  CRISPR gRNA sequence
caccaacggctttatcgtag

SEQ ID NO: 105750 - DNA, 20 bp, Artificial
  CRISPR gRNA sequence
gtcttcgcctcccccgtttc

SEQ ID NO: 105751 - DNA, 20 bp, Artificial
  CRISPR gRNA sequence
ttcgcctcccccgtttccag

SEQ ID NO: 105752 - DNA, 20 bp, Artificial
  CRISPR gRNA sequence
ctcccccgtttccagtagaa

SEQ ID NO: 105753 - DNA, 20 bp, Artificial
  CRISPR gRNA sequence
cccgtttccagtagaaaaga

SEQ ID NO: 105754 - DNA, 20 bp, Artificial
  CRISPR gRNA sequence
agacagctttgctcctttga

SEQ ID NO: 105755 - DNA, 20 bp, Artificial
  CRISPR gRNA sequence
gctttgctcctttgaaagcg

SEQ ID NO: 105756 - DNA, 20 bp, Artificial
  CRISPR gRNA sequence
agcgcagaccgccgcacctc

SEQ ID NO: 105757 - DNA, 20 bp, Artificial
  CRISPR gRNA sequence
cacctccagccccttctccc

SEQ ID NO: 105758 - DNA, 20 bp, Artificial
  CRISPR gRNA sequence
acctccagccccttctcccc

SEQ ID NO: 105759 - DNA, 20 bp, Artificial
  CRISPR gRNA sequence
cctccagccccttctccccg

SEQ ID NO: 105760 - DNA, 20 bp, Artificial
  CRISPR gRNA sequence
ccagccccttctccccgggg

SEQ ID NO: 105761 - DNA, 20 bp, Artificial
  CRISPR gRNA sequence
gccccttctccccggggaag

SEQ ID NO: 105762 - DNA, 20 bp, Artificial
  CRISPR gRNA sequence
ccccttctccccggggaagt

SEQ ID NO: 105763 - DNA, 20 bp, Artificial
  CRISPR gRNA sequence
ccggggaagtaggccccgct

SEQ ID NO: 105764 - DNA, 20 bp, Artificial
  CRISPR gRNA sequence
agtaggccccgctaagaatg

SEQ ID NO: 105765 - DNA, 20 bp, Artificial
  CRISPR gRNA sequence
gtaggccccgctaagaatgt

SEQ ID NO: 105766 - DNA, 20 bp, Artificial
  CRISPR gRNA sequence
ggccccgctaagaatgtggg

SEQ ID NO: 105767 - DNA, 20 bp, Artificial
  CRISPR gRNA sequence
gccccgctaagaatgtggga

SEQ ID NO: 105768 - DNA, 20 bp, Artificial
  CRISPR gRNA sequence
ccgctaagaatgtgggaagg

SEQ ID NO: 105769 - DNA, 20 bp, Artificial
  CRISPR gRNA sequence
ctaagaatgtgggaaggtgg

SEQ ID NO: 105770 - DNA, 20 bp, Artificial
  CRISPR gRNA sequence
taagaatgtgggaaggtggt

SEQ ID NO: 105771 - DNA, 20 bp, Artificial
  CRISPR gRNA sequence
aagaatgtgggaaggtggtg

SEQ ID NO: 105772 - DNA, 20 bp, Artificial
  CRISPR gRNA sequence
aatgtgggaaggtggtgggg

SEQ ID NO: 105773 - DNA, 20 bp, Artificial
  CRISPR gRNA sequence
aggtggtggggcggcgactg

SEQ ID NO: 105774 - DNA, 20 bp, Artificial
  CRISPR gRNA sequence
cgactgaagtcgcttccgat

SEQ ID NO: 105775 - DNA, 20 bp, Artificial
  CRISPR gRNA sequence
cttccgattggcgttgtccc

SEQ ID NO: 105776 - DNA, 20 bp, Artificial
  CRISPR gRNA sequence
ttccgattggcgttgtccca

SEQ ID NO: 105777 - DNA, 20 bp, Artificial
  CRISPR gRNA sequence
cgattggcgttgtcccaagg

SEQ ID NO: 105778 - DNA, 20 bp, Artificial
  CRISPR gRNA sequence
ttgtcccaaggaagcctgcg

SEQ ID NO: 105779 - DNA, 20 bp, Artificial
  CRISPR gRNA sequence
ggaagcctgcgcggattgat

SEQ ID NO: 105780 - DNA, 20 bp, Artificial
  CRISPR gRNA sequence
agcctgcgcggattgatcgg

SEQ ID NO: 105781 - DNA, 20 bp, Artificial
  CRISPR gRNA sequence
ctgcgcggattgatcggcgg

SEQ ID NO: 105782 - DNA, 20 bp, Artificial
  CRISPR gRNA sequence
tgcgcggattgatcggcggc

SEQ ID NO: 105783 - DNA, 20 bp, Artificial
  CRISPR gRNA sequence
gatcggcggcaggcctccaa

SEQ ID NO: 105784 - DNA, 20 bp, Artificial
  CRISPR gRNA sequence
tcggcggcaggcctccaata

SEQ ID NO: 105785 - DNA, 20 bp, Artificial
  CRISPR gRNA sequence
aggcctccaatagagcctgc

SEQ ID NO: 105786 - DNA, 20 bp, Artificial
  CRISPR gRNA sequence
ggcctccaatagagcctgct

SEQ ID NO: 105787 - DNA, 20 bp, Artificial
  CRISPR gRNA sequence
ctccaatagagcctgctagg

SEQ ID NO: 105788 - DNA, 20 bp, Artificial
  CRISPR gRNA sequence
atagagcctgctaggcggat

SEQ ID NO: 105789 - DNA, 20 bp, Artificial
  CRISPR gRNA sequence
taggcggattggctgctacg

SEQ ID NO: 105790 - DNA, 20 bp, Artificial
  CRISPR gRNA sequence
cggattggctgctacgcggc

SEQ ID NO: 105791 - DNA, 20 bp, Artificial
  CRISPR gRNA sequence
ggattggctgctacgcggct

SEQ ID NO: 105792 - DNA, 20 bp, Artificial
  CRISPR gRNA sequence
acgcggctgggccctgtttc

SEQ ID NO: 105793 - DNA, 20 bp, Artificial
  CRISPR gRNA sequence
tgggccctgtttccggtacc

SEQ ID NO: 105794 - DNA, 20 bp, Artificial
  CRISPR gRNA sequence
gggccctgtttccggtacct

SEQ ID NO: 105795 - DNA, 20 bp, Artificial
  CRISPR gRNA sequence
ccctgtttccggtacctagg

SEQ ID NO: 105796 - DNA, 20 bp, Artificial
  CRISPR gRNA sequence
cctgtttccggtacctaggc

SEQ ID NO: 105797 - DNA, 20 bp, Artificial
  CRISPR gRNA sequence
gtttccggtacctaggcggg

SEQ ID NO: 105798 - DNA, 20 bp, Artificial
  CRISPR gRNA sequence
ggtacctaggcgggcagcca

SEQ ID NO: 105799 - DNA, 20 bp, Artificial
  CRISPR gRNA sequence
aggcgggcagccatggtgac

SEQ ID NO: 105800 - DNA, 20 bp, Artificial
  CRISPR gRNA sequence
gggcagccatggtgaccggc

SEQ ID NO: 105801 - DNA, 20 bp, Artificial
  CRISPR gRNA sequence
cagccatggtgaccggcgag

SEQ ID NO: 105802 - DNA, 20 bp, Artificial
  CRISPR gRNA sequence
ggcatgcgacgccgcctctg

SEQ ID NO: 105803 - DNA, 20 bp, Artificial
  CRISPR gRNA sequence
gacgccgcctctgtggcctg

SEQ ID NO: 105804 - DNA, 20 bp, Artificial
  CRISPR gRNA sequence
cgccgcctctgtggcctgtg

SEQ ID NO: 105805 - DNA, 20 bp, Artificial
  CRISPR gRNA sequence
gccgcctctgtggcctgtgg

SEQ ID NO: 105806 - DNA, 20 bp, Artificial
  CRISPR gRNA sequence
gtggcctgtggaggcccgct

SEQ ID NO: 105807 - DNA, 20 bp, Artificial
  CRISPR gRNA sequence
gcctgtggaggcccgcttgg

SEQ ID NO: 105808 - DNA, 20 bp, Artificial
  CRISPR gRNA sequence
ggcgctgcttcccgacctac

SEQ ID NO: 105809 - DNA, 20 bp, Artificial
  CRISPR gRNA sequence
ttcccgacctactggtcttt

SEQ ID NO: 105810 - DNA, 20 bp, Artificial
  CRISPR gRNA sequence
ccgacctactggtctttcgg

SEQ ID NO: 105811 - DNA, 20 bp, Artificial
  CRISPR gRNA sequence
tactggtctttcggaagcct

SEQ ID NO: 105812 - DNA, 20 bp, Artificial
  CRISPR gRNA sequence
actggtctttcggaagcctc

SEQ ID NO: 105813 - DNA, 20 bp, Artificial
  CRISPR gRNA sequence
ctggtctttcggaagcctcg

SEQ ID NO: 105814 - DNA, 20 bp, Artificial
  CRISPR gRNA sequence
tctttcggaagcctcgggga

SEQ ID NO: 105815 - DNA, 20 bp, Artificial
  CRISPR gRNA sequence
ctttcggaagcctcggggat

SEQ ID NO: 105816 - DNA, 20 bp, Artificial
  CRISPR gRNA sequence
agcctcggggatgggaaccc

SEQ ID NO: 105817 - DNA, 20 bp, Artificial
  CRISPR gRNA sequence
atgggaacccgagctcgcca

SEQ ID NO: 105818 - DNA, 20 bp, Artificial
  CRISPR gRNA sequence
aacccgagctcgccacggcc

SEQ ID NO: 105819 - DNA, 20 bp, Artificial
  CRISPR gRNA sequence
acccgagctcgccacggccc

SEQ ID NO: 105820 - DNA, 20 bp, Artificial
  CRISPR gRNA sequence
cccgagctcgccacggccca

SEQ ID NO: 105821 - DNA, 20 bp, Artificial
  CRISPR gRNA sequence
cacggcccagggcgtcctcc

SEQ ID NO: 105822 - DNA, 20 bp, Artificial
  CRISPR gRNA sequence
acggcccagggcgtcctcct

SEQ ID NO: 105823 - DNA, 20 bp, Artificial
  CRISPR gRNA sequence
cctcctaggcgtccatgtga

SEQ ID NO: 105824 - DNA, 20 bp, Artificial
  CRISPR gRNA sequence
ctcctaggcgtccatgtgac

SEQ ID NO: 105825 - DNA, 20 bp, Artificial
  CRISPR gRNA sequence
taggcgtccatgtgacgggt

SEQ ID NO: 105826 - DNA, 20 bp, Artificial
  CRISPR gRNA sequence
aggcgtccatgtgacgggtg

SEQ ID NO: 105827 - DNA, 20 bp, Artificial
  CRISPR gRNA sequence
ggcgtccatgtgacgggtga

SEQ ID NO: 105828 - DNA, 20 bp, Artificial
  CRISPR gRNA sequence
catgtgacgggtgagggcga

SEQ ID NO: 105829 - DNA, 20 bp, Artificial
  CRISPR gRNA sequence
tgacgggtgagggcgacggc

SEQ ID NO: 105830 - DNA, 20 bp, Artificial
  CRISPR gRNA sequence
gacggccggcacttgcactt

SEQ ID NO: 105831 - DNA, 20 bp, Artificial
  CRISPR gRNA sequence
gcacttgcacttaagtctcc

SEQ ID NO: 105832 - DNA, 20 bp, Artificial
  CRISPR gRNA sequence
cacttaagtctcctggcctg

SEQ ID NO: 105833 - DNA, 20 bp, Artificial
  CRISPR gRNA sequence
acttaagtctcctggcctgc

SEQ ID NO: 105834 - DNA, 20 bp, Artificial
  CRISPR gRNA sequence
ttaagtctcctggcctgcgg

SEQ ID NO: 105835 - DNA, 20 bp, Artificial
  CRISPR gRNA sequence
aagtctcctggcctgcggga

SEQ ID NO: 105836 - DNA, 20 bp, Artificial
  CRISPR gRNA sequence
agtctcctggcctgcgggag

SEQ ID NO: 105837 - DNA, 20 bp, Artificial
  CRISPR gRNA sequence
ctcctggcctgcgggagagg

SEQ ID NO: 105838 - DNA, 20 bp, Artificial
  CRISPR gRNA sequence
cctgcgggagaggcggccgt

SEQ ID NO: 105839 - DNA, 20 bp, Artificial
  CRISPR gRNA sequence
ctgcgggagaggcggccgtt

SEQ ID NO: 105840 - DNA, 20 bp, Artificial
  CRISPR gRNA sequence
gagaggcggccgttgggtct

SEQ ID NO: 105841 - DNA, 20 bp, Artificial
  CRISPR gRNA sequence
ggccgttgggtctaagcccc

SEQ ID NO: 105842 - DNA, 20 bp, Artificial
  CRISPR gRNA sequence
ccgttgggtctaagcccctg

SEQ ID NO: 105843 - DNA, 20 bp, Artificial
  CRISPR gRNA sequence
cgttgggtctaagcccctgg

SEQ ID NO: 105844 - DNA, 20 bp, Artificial
  CRISPR gRNA sequence
taagcccctggaggcctcga

SEQ ID NO: 105845 - DNA, 20 bp, Artificial
  CRISPR gRNA sequence
cctggaggcctcgacggtta

SEQ ID NO: 105846 - DNA, 20 bp, Artificial
  CRISPR gRNA sequence
ctggaggcctcgacggttac

SEQ ID NO: 105847 - DNA, 20 bp, Artificial
  CRISPR gRNA sequence
ggcctcgacggttacaggcc

SEQ ID NO: 105848 - DNA, 20 bp, Artificial
  CRISPR gRNA sequence
ttacaggcctagcctcccgc

SEQ ID NO: 105849 - DNA, 20 bp, Artificial
  CRISPR gRNA sequence
ggcctagcctcccgcgagct

SEQ ID NO: 105850 - DNA, 20 bp, Artificial
  CRISPR gRNA sequence
gcctagcctcccgcgagcta

SEQ ID NO: 105851 - DNA, 20 bp, Artificial
  CRISPR gRNA sequence
gcctcccgcgagctaaggca

SEQ ID NO: 105852 - DNA, 20 bp, Artificial
  CRISPR gRNA sequence
cacagtttaacttcgtgctg

SEQ ID NO: 105853 - DNA, 20 bp, Artificial
  CRISPR gRNA sequence
acttcgtgctgcggcttcct

SEQ ID NO: 105854 - DNA, 20 bp, Artificial
  CRISPR gRNA sequence
cttcgtgctgcggcttcctt

SEQ ID NO: 105855 - DNA, 20 bp, Artificial
  CRISPR gRNA sequence
cggcttccttaggaaacttt

SEQ ID NO: 105856 - DNA, 20 bp, Artificial
  CRISPR gRNA sequence
aactttgagtatcttcgttt

SEQ ID NO: 105857 - DNA, 20 bp, Artificial
  CRISPR gRNA sequence
tgagtatcttcgttttagcg

SEQ ID NO: 105858 - DNA, 20 bp, Artificial
  CRISPR gRNA sequence
gagtatcttcgttttagcgt

SEQ ID NO: 105859 - DNA, 20 bp, Artificial
  CRISPR gRNA sequence
gtatcttcgttttagcgtgg

SEQ ID NO: 105860 - DNA, 20 bp, Artificial
  CRISPR gRNA sequence
tatcttcgttttagcgtggg

SEQ ID NO: 105861 - DNA, 20 bp, Artificial
  CRISPR gRNA sequence
tagcgtgggaggacatcttt

SEQ ID NO: 105862 - DNA, 20 bp, Artificial
  CRISPR gRNA sequence
agcgtgggaggacatctttt

SEQ ID NO: 105863 - DNA, 20 bp, Artificial
  CRISPR gRNA sequence
ggacatcttttgggatgaac

SEQ ID NO: 105864 - DNA, 20 bp, Artificial
  CRISPR gRNA sequence
tcttttgggatgaaccggct

SEQ ID NO: 105865 - DNA, 20 bp, Artificial
  CRISPR gRNA sequence
gatgaaccggctcagtcctt

SEQ ID NO: 105866 - DNA, 20 bp, Artificial
  CRISPR gRNA sequence
cagtccttgagctcacccca

SEQ ID NO: 105867 - DNA, 20 bp, Artificial
  CRISPR gRNA sequence
aagatgatgaaattgaaact

SEQ ID NO: 105868 - DNA, 20 bp, Artificial
  CRISPR gRNA sequence
gatgatgaaattgaaactca

SEQ ID NO: 105869 - DNA, 20 bp, Artificial
  CRISPR gRNA sequence
atgatgaaattgaaactcag

SEQ ID NO: 105870 - DNA, 20 bp, Artificial
  CRISPR gRNA sequence
tgaaattgaaactcagagga

SEQ ID NO: 105871 - DNA, 20 bp, Artificial
  CRISPR gRNA sequence
gaaattgaaactcagaggaa

SEQ ID NO: 105872 - DNA, 20 bp, Artificial
  CRISPR gRNA sequence
ctcagaggaaaggattttta

SEQ ID NO: 105873 - DNA, 20 bp, Artificial
  CRISPR gRNA sequence
tcagaggaaaggatttttac

SEQ ID NO: 105874 - DNA, 20 bp, Artificial
  CRISPR gRNA sequence
atttttacaggaccacgccc

SEQ ID NO: 105875 - DNA, 20 bp, Artificial
  CRISPR gRNA sequence
tttttacaggaccacgcccc

SEQ ID NO: 105876 - DNA, 20 bp, Artificial
  CRISPR gRNA sequence
aacccgtttttcccaacccc

SEQ ID NO: 105877 - DNA, 20 bp, Artificial
  CRISPR gRNA sequence
aaccccgagcattttctatt

SEQ ID NO: 105878 - DNA, 20 bp, Artificial
  CRISPR gRNA sequence
tttcaattattttattcgtt

SEQ ID NO: 105879 - DNA, 20 bp, Artificial
  CRISPR gRNA sequence
tcgttcagttaattcgttct

SEQ ID NO: 105880 - DNA, 20 bp, Artificial
  CRISPR gRNA sequence
taattcgttcttggcgtcat

SEQ ID NO: 105881 - DNA, 20 bp, Artificial
  CRISPR gRNA sequence
gtatatgcccgccgttgttc

SEQ ID NO: 105882 - DNA, 20 bp, Artificial
  CRISPR gRNA sequence
gcccgccgttgttctggccg

SEQ ID NO: 105883 - DNA, 20 bp, Artificial
  CRISPR gRNA sequence
ttgttctggccgtagctatc

SEQ ID NO: 105884 - DNA, 20 bp, Artificial
  CRISPR gRNA sequence
ttctggccgtagctatctag

SEQ ID NO: 105885 - DNA, 20 bp, Artificial
  CRISPR gRNA sequence
ctatctagcagccactccgc

SEQ ID NO: 105886 - DNA, 20 bp, Artificial
  CRISPR gRNA sequence
aacaaatacttactctgtgt

SEQ ID NO: 105887 - DNA, 20 bp, Artificial
  CRISPR gRNA sequence
acaaatacttactctgtgtc

SEQ ID NO: 105888 - DNA, 20 bp, Artificial
  CRISPR gRNA sequence
caaatacttactctgtgtca

SEQ ID NO: 105889 - DNA, 20 bp, Artificial
  CRISPR gRNA sequence
tactctgtgtcagggatatg

SEQ ID NO: 105890 - DNA, 20 bp, Artificial
  CRISPR gRNA sequence
ctgtgtcagggatatgaaga

SEQ ID NO: 105891 - DNA, 20 bp, Artificial
  CRISPR gRNA sequence
tgtgtcagggatatgaagat

SEQ ID NO: 105892 - DNA, 20 bp, Artificial
  CRISPR gRNA sequence
gatatgaagatgggtaatac

SEQ ID NO: 105893 - DNA, 20 bp, Artificial
  CRISPR gRNA sequence
atatgaagatgggtaatacc

SEQ ID NO: 105894 - DNA, 20 bp, Artificial
  CRISPR gRNA sequence
ggtgcctgtcctcactgtgt

SEQ ID NO: 105895 - DNA, 20 bp, Artificial
  CRISPR gRNA sequence
gcctgtcctcactgtgtgag

SEQ ID NO: 105896 - DNA, 20 bp, Artificial
  CRISPR gRNA sequence
tcactgtgtgagtggttctc

SEQ ID NO: 105897 - DNA, 20 bp, Artificial
  CRISPR gRNA sequence
tgtgtgagtggttctctagc

SEQ ID NO: 105898 - DNA, 20 bp, Artificial
  CRISPR gRNA sequence
gtggttctctagccagacat

SEQ ID NO: 105899 - DNA, 20 bp, Artificial
  CRISPR gRNA sequence
tggttctctagccagacatg

SEQ ID NO: 105900 - DNA, 20 bp, Artificial
  CRISPR gRNA sequence
gttctctagccagacatgag

SEQ ID NO: 105901 - DNA, 20 bp, Artificial
  CRISPR gRNA sequence
ttctctagccagacatgagg

SEQ ID NO: 105902 - DNA, 20 bp, Artificial
  CRISPR gRNA sequence
tctctagccagacatgagga

SEQ ID NO: 105903 - DNA, 20 bp, Artificial
  CRISPR gRNA sequence
agggatcctattgtttccca

SEQ ID NO: 105904 - DNA, 20 bp, Artificial
  CRISPR gRNA sequence
atcctattgtttcccatagc

SEQ ID NO: 105905 - DNA, 20 bp, Artificial
  CRISPR gRNA sequence
tcctattgtttcccatagct

SEQ ID NO: 105906 - DNA, 20 bp, Artificial
  CRISPR gRNA sequence
tattgtttcccatagctagg

SEQ ID NO: 105907 - DNA, 20 bp, Artificial
  CRISPR gRNA sequence
ttcccatagctaggcagcct

SEQ ID NO: 105908 - DNA, 20 bp, Artificial
  CRISPR gRNA sequence
cccatagctaggcagcctaa

SEQ ID NO: 105909 - DNA, 20 bp, Artificial
  CRISPR gRNA sequence
catagctaggcagcctaaga

SEQ ID NO: 105910 - DNA, 20 bp, Artificial
  CRISPR gRNA sequence
agctaggcagcctaagagag

SEQ ID NO: 105911 - DNA, 20 bp, Artificial
  CRISPR gRNA sequence
gctaggcagcctaagagagt

SEQ ID NO: 105912 - DNA, 20 bp, Artificial
  CRISPR gRNA sequence
ctaggcagcctaagagagta

SEQ ID NO: 105913 - DNA, 20 bp, Artificial
  CRISPR gRNA sequence
taggcagcctaagagagtag

SEQ ID NO: 105914 - DNA, 20 bp, Artificial
  CRISPR gRNA sequence
cagcctaagagagtagggga

SEQ ID NO: 105915 - DNA, 20 bp, Artificial
  CRISPR gRNA sequence
gcctaagagagtaggggaaa

SEQ ID NO: 105916 - DNA, 20 bp, Artificial
  CRISPR gRNA sequence
aagagagtaggggaaagagc

SEQ ID NO: 105917 - DNA, 20 bp, Artificial
  CRISPR gRNA sequence
gtaggggaaagagctggctc

SEQ ID NO: 105918 - DNA, 20 bp, Artificial
  CRISPR gRNA sequence
aagagctggctccagatgaa

SEQ ID NO: 105919 - DNA, 20 bp, Artificial
  CRISPR gRNA sequence
agagctggctccagatgaaa

SEQ ID NO: 105920 - DNA, 20 bp, Artificial
  CRISPR gRNA sequence
gagctggctccagatgaaaa

SEQ ID NO: 105921 - DNA, 20 bp, Artificial
  CRISPR gRNA sequence
gatgaaaagggcaccatctc

SEQ ID NO: 105922 - DNA, 20 bp, Artificial
  CRISPR gRNA sequence
agggcaccatctccagctct

SEQ ID NO: 105923 - DNA, 20 bp, Artificial
  CRISPR gRNA sequence
gcaccatctccagctcttgg

SEQ ID NO: 105924 - DNA, 20 bp, Artificial
  CRISPR gRNA sequence
ccatctccagctcttggaag

SEQ ID NO: 105925 - DNA, 20 bp, Artificial
  CRISPR gRNA sequence
atctccagctcttggaagca

SEQ ID NO: 105926 - DNA, 20 bp, Artificial
  CRISPR gRNA sequence
ctccagctcttggaagcaga

SEQ ID NO: 105927 - DNA, 20 bp, Artificial
  CRISPR gRNA sequence
tccagctcttggaagcagag

SEQ ID NO: 105928 - DNA, 20 bp, Artificial
  CRISPR gRNA sequence
ccagctcttggaagcagaga

SEQ ID NO: 105929 - DNA, 20 bp, Artificial
  CRISPR gRNA sequence
gctcttggaagcagagaggg

SEQ ID NO: 105930 - DNA, 20 bp, Artificial
  CRISPR gRNA sequence
aagcagagagggtggtcctt

SEQ ID NO: 105931 - DNA, 20 bp, Artificial
  CRISPR gRNA sequence
agggtggtcctttggattcc

SEQ ID NO: 105932 - DNA, 20 bp, Artificial
  CRISPR gRNA sequence
gtggtcctttggattcccag

SEQ ID NO: 105933 - DNA, 20 bp, Artificial
  CRISPR gRNA sequence
gtcctttggattcccagtgg

SEQ ID NO: 105934 - DNA, 20 bp, Artificial
  CRISPR gRNA sequence
ctttggattcccagtggcag

SEQ ID NO: 105935 - DNA, 20 bp, Artificial
  CRISPR gRNA sequence
agtggcagcagcaaccaacc

SEQ ID NO: 105936 - DNA, 20 bp, Artificial
  CRISPR gRNA sequence
gcagcaaccaacctggccct

SEQ ID NO: 105937 - DNA, 20 bp, Artificial
  CRISPR gRNA sequence
gcaaccaacctggcccttag

SEQ ID NO: 105938 - DNA, 20 bp, Artificial
  CRISPR gRNA sequence
cctggcccttagtagtttct

SEQ ID NO: 105939 - DNA, 20 bp, Artificial
  CRISPR gRNA sequence
tctaagttacaccatgttaa

SEQ ID NO: 105940 - DNA, 20 bp, Artificial
  CRISPR gRNA sequence
ttacaccatgttaatggata

SEQ ID NO: 105941 - DNA, 20 bp, Artificial
  CRISPR gRNA sequence
tacaccatgttaatggataa

SEQ ID NO: 105942 - DNA, 20 bp, Artificial
  CRISPR gRNA sequence
taatggataaaggaattact

SEQ ID NO: 105943 - DNA, 20 bp, Artificial
  CRISPR gRNA sequence
taaaggaattactcagcttg

SEQ ID NO: 105944 - DNA, 20 bp, Artificial
  CRISPR gRNA sequence
aaaggaattactcagcttga

SEQ ID NO: 105945 - DNA, 20 bp, Artificial
  CRISPR gRNA sequence
aaggaattactcagcttgaa

SEQ ID NO: 105946 - DNA, 20 bp, Artificial
  CRISPR gRNA sequence
gggatctgtttcctttacac

SEQ ID NO: 105947 - DNA, 20 bp, Artificial
  CRISPR gRNA sequence
ctttacactggcctgatgtg

SEQ ID NO: 105948 - DNA, 20 bp, Artificial
  CRISPR gRNA sequence
tttacactggcctgatgtgt

SEQ ID NO: 105949 - DNA, 20 bp, Artificial
  CRISPR gRNA sequence
ttacactggcctgatgtgtg

SEQ ID NO: 105950 - DNA, 20 bp, Artificial
  CRISPR gRNA sequence
acactggcctgatgtgtggg

SEQ ID NO: 105951 - DNA, 20 bp, Artificial
  CRISPR gRNA sequence
tggcctgatgtgtggggaga

SEQ ID NO: 105952 - DNA, 20 bp, Artificial
  CRISPR gRNA sequence
ggcctgatgtgtggggagaa

SEQ ID NO: 105953 - DNA, 20 bp, Artificial
  CRISPR gRNA sequence
gcctgatgtgtggggagaaa

SEQ ID NO: 105954 - DNA, 20 bp, Artificial
  CRISPR gRNA sequence
cctgatgtgtggggagaaag

SEQ ID NO: 105955 - DNA, 20 bp, Artificial
  CRISPR gRNA sequence
gtggggagaaaggggccaaa

SEQ ID NO: 105956 - DNA, 20 bp, Artificial
  CRISPR gRNA sequence
gagaaaggggccaaaaagtt

SEQ ID NO: 105957 - DNA, 20 bp, Artificial
  CRISPR gRNA sequence
agaaaggggccaaaaagttt

SEQ ID NO: 105958 - DNA, 20 bp, Artificial
  CRISPR gRNA sequence
gggccaaaaagtttaggatt

SEQ ID NO: 105959 - DNA, 20 bp, Artificial
  CRISPR gRNA sequence
gccaaaaagtttaggatttg

SEQ ID NO: 105960 - DNA, 20 bp, Artificial
  CRISPR gRNA sequence
catcgtaatttctgctttgt

SEQ ID NO: 105961 - DNA, 20 bp, Artificial
  CRISPR gRNA sequence
gtaatttctgctttgttggt

SEQ ID NO: 105962 - DNA, 20 bp, Artificial
  CRISPR gRNA sequence
taatttctgctttgttggtc

SEQ ID NO: 105963 - DNA, 20 bp, Artificial
  CRISPR gRNA sequence
aatttctgctttgttggtca

SEQ ID NO: 105964 - DNA, 20 bp, Artificial
  CRISPR gRNA sequence
gctttgttggtcagggttta

SEQ ID NO: 105965 - DNA, 20 bp, Artificial
  CRISPR gRNA sequence
gtcagggtttacagcattaa

SEQ ID NO: 105966 - DNA, 20 bp, Artificial
  CRISPR gRNA sequence
gggtttacagcattaatgga

SEQ ID NO: 105967 - DNA, 20 bp, Artificial
  CRISPR gRNA sequence
ggtttacagcattaatggac

SEQ ID NO: 105968 - DNA, 20 bp, Artificial
  CRISPR gRNA sequence
acaggttcaccctgacctac

SEQ ID NO: 105969 - DNA, 20 bp, Artificial
  CRISPR gRNA sequence
gttcaccctgacctacaagt

SEQ ID NO: 105970 - DNA, 20 bp, Artificial
  CRISPR gRNA sequence
ctacaagtcggaacgtgaca

SEQ ID NO: 105971 - DNA, 20 bp, Artificial
  CRISPR gRNA sequence
ggaacgtgacatggacaaac

SEQ ID NO: 105972 - DNA, 20 bp, Artificial
  CRISPR gRNA sequence
gacaaactggcccatatctt

SEQ ID NO: 105973 - DNA, 20 bp, Artificial
  CRISPR gRNA sequence
catatcttcagttattacat

SEQ ID NO: 105974 - DNA, 20 bp, Artificial
  CRISPR gRNA sequence
ttattacattagtgacatcg

SEQ ID NO: 105975 - DNA, 20 bp, Artificial
  CRISPR gRNA sequence
attacattagtgacatcgtg

SEQ ID NO: 105976 - DNA, 20 bp, Artificial
  CRISPR gRNA sequence
ttagtgacatcgtggagcgt

SEQ ID NO: 105977 - DNA, 20 bp, Artificial
  CRISPR gRNA sequence
tggagcgtgagtgatcattg

SEQ ID NO: 105978 - DNA, 20 bp, Artificial
  CRISPR gRNA sequence
ggagcgtgagtgatcattgt

SEQ ID NO: 105979 - DNA, 20 bp, Artificial
  CRISPR gRNA sequence
gagcgtgagtgatcattgta

SEQ ID NO: 105980 - DNA, 20 bp, Artificial
  CRISPR gRNA sequence
agtgatcattgtagggtaac

SEQ ID NO: 105981 - DNA, 20 bp, Artificial
  CRISPR gRNA sequence
gtgatcattgtagggtaaca

SEQ ID NO: 105982 - DNA, 20 bp, Artificial
  CRISPR gRNA sequence
cattgtagggtaacaaggtg

SEQ ID NO: 105983 - DNA, 20 bp, Artificial
  CRISPR gRNA sequence
agggtaacaaggtgtggtgc

SEQ ID NO: 105984 - DNA, 20 bp, Artificial
  CRISPR gRNA sequence
gggtaacaaggtgtggtgct

SEQ ID NO: 105985 - DNA, 20 bp, Artificial
  CRISPR gRNA sequence
aaggtgtggtgctgggctcc

SEQ ID NO: 105986 - DNA, 20 bp, Artificial
  CRISPR gRNA sequence
aggtgtggtgctgggctcct

SEQ ID NO: 105987 - DNA, 20 bp, Artificial
  CRISPR gRNA sequence
ggtgtggtgctgggctcctg

SEQ ID NO: 105988 - DNA, 20 bp, Artificial
  CRISPR gRNA sequence
gtgtggtgctgggctcctgg

SEQ ID NO: 105989 - DNA, 20 bp, Artificial
  CRISPR gRNA sequence
gggctcctgggggtttataa

SEQ ID NO: 105990 - DNA, 20 bp, Artificial
  CRISPR gRNA sequence
ctcctgggggtttataaaag

SEQ ID NO: 105991 - DNA, 20 bp, Artificial
  CRISPR gRNA sequence
tcctgggggtttataaaaga

SEQ ID NO: 105992 - DNA, 20 bp, Artificial
  CRISPR gRNA sequence
cctgggggtttataaaagaa

SEQ ID NO: 105993 - DNA, 20 bp, Artificial
  CRISPR gRNA sequence
ctgggggtttataaaagaag

SEQ ID NO: 105994 - DNA, 20 bp, Artificial
  CRISPR gRNA sequence
tgggggtttataaaagaagg

SEQ ID NO: 105995 - DNA, 20 bp, Artificial
  CRISPR gRNA sequence
ggtttataaaagaagggggc

SEQ ID NO: 105996 - DNA, 20 bp, Artificial
  CRISPR gRNA sequence
ttataaaagaagggggccag

SEQ ID NO: 105997 - DNA, 20 bp, Artificial
  CRISPR gRNA sequence
gggccagaagtactttaaaa

SEQ ID NO: 105998 - DNA, 20 bp, Artificial
  CRISPR gRNA sequence
ggccagaagtactttaaaac

SEQ ID NO: 105999 - DNA, 20 bp, Artificial
  CRISPR gRNA sequence
gtactttaaaacaggtacca

SEQ ID NO: 106000 - DNA, 20 bp, Artificial
  CRISPR gRNA sequence
tactttaaaacaggtaccaa

SEQ ID NO: 106001 - DNA, 20 bp, Artificial
  CRISPR gRNA sequence
actttaaaacaggtaccaaa

SEQ ID NO: 106002 - DNA, 20 bp, Artificial
  CRISPR gRNA sequence
gtaccaaagggtcattcctt

SEQ ID NO: 106003 - DNA, 20 bp, Artificial
  CRISPR gRNA sequence
cctttagcatcattcatctt

SEQ ID NO: 106004 - DNA, 20 bp, Artificial
  CRISPR gRNA sequence
cattcatctttggtttcttc

SEQ ID NO: 106005 - DNA, 20 bp, Artificial
  CRISPR gRNA sequence
ttcttcaagttgccactgaa

SEQ ID NO: 106006 - DNA, 20 bp, Artificial
  CRISPR gRNA sequence
tcaagttgccactgaaaagc

SEQ ID NO: 106007 - DNA, 20 bp, Artificial
  CRISPR gRNA sequence
ctattatctgctaatctacc

SEQ ID NO: 106008 - DNA, 20 bp, Artificial
  CRISPR gRNA sequence
ttctattgactcattgttca

SEQ ID NO: 106009 - DNA, 20 bp, Artificial
  CRISPR gRNA sequence
tctattgactcattgttcaa

SEQ ID NO: 106010 - DNA, 20 bp, Artificial
  CRISPR gRNA sequence
ctattgactcattgttcaaa

SEQ ID NO: 106011 - DNA, 20 bp, Artificial
  CRISPR gRNA sequence
tattgactcattgttcaaag

SEQ ID NO: 106012 - DNA, 20 bp, Artificial
  CRISPR gRNA sequence
attgactcattgttcaaagg

SEQ ID NO: 106013 - DNA, 20 bp, Artificial
  CRISPR gRNA sequence
ttgactcattgttcaaaggg

SEQ ID NO: 106014 - DNA, 20 bp, Artificial
  CRISPR gRNA sequence
tgactcattgttcaaagggg

SEQ ID NO: 106015 - DNA, 20 bp, Artificial
  CRISPR gRNA sequence
ctcattgttcaaaggggggg

SEQ ID NO: 106016 - DNA, 20 bp, Artificial
  CRISPR gRNA sequence
tcattgttcaaagggggggc

SEQ ID NO: 106017 - DNA, 20 bp, Artificial
  CRISPR gRNA sequence
attgttcaaagggggggcag

SEQ ID NO: 106018 - DNA, 20 bp, Artificial
  CRISPR gRNA sequence
ttgttcaaagggggggcagg

SEQ ID NO: 106019 - DNA, 20 bp, Artificial
  CRISPR gRNA sequence
gttcaaagggggggcaggag

SEQ ID NO: 106020 - DNA, 20 bp, Artificial
  CRISPR gRNA sequence
ttgtattttatttcaaaata

SEQ ID NO: 106021 - DNA, 20 bp, Artificial
  CRISPR gRNA sequence
ttctaacaataacgtatctc

SEQ ID NO: 106022 - DNA, 20 bp, Artificial
  CRISPR gRNA sequence
acgtatctcaagtgtgtatt

SEQ ID NO: 106023 - DNA, 20 bp, Artificial
  CRISPR gRNA sequence
ttattatattttgatcctgt

SEQ ID NO: 106024 - DNA, 20 bp, Artificial
  CRISPR gRNA sequence
tattatattttgatcctgtg

SEQ ID NO: 106025 - DNA, 20 bp, Artificial
  CRISPR gRNA sequence
tatattttgatcctgtgagg

SEQ ID NO: 106026 - DNA, 20 bp, Artificial
  CRISPR gRNA sequence
atattttgatcctgtgagga

SEQ ID NO: 106027 - DNA, 20 bp, Artificial
  CRISPR gRNA sequence
ttgatcctgtgaggaaggaa

SEQ ID NO: 106028 - DNA, 20 bp, Artificial
  CRISPR gRNA sequence
tgatcctgtgaggaaggaat

SEQ ID NO: 106029 - DNA, 20 bp, Artificial
  CRISPR gRNA sequence
aaacacctattccttcctca

SEQ ID NO: 106030 - DNA, 20 bp, Artificial
  CRISPR gRNA sequence
aacacctattccttcctcac

SEQ ID NO: 106031 - DNA, 20 bp, Artificial
  CRISPR gRNA sequence
gatcaaaatataataataaa

SEQ ID NO: 106032 - DNA, 20 bp, Artificial
  CRISPR gRNA sequence
ttttgtctgaatacacactt

SEQ ID NO: 106033 - DNA, 20 bp, Artificial
  CRISPR gRNA sequence
cacttgagatacgttattgt

SEQ ID NO: 106034 - DNA, 20 bp, Artificial
  CRISPR gRNA sequence
ttgagatacgttattgttag

SEQ ID NO: 106035 - DNA, 20 bp, Artificial
  CRISPR gRNA sequence
gagatacgttattgttagaa

SEQ ID NO: 106036 - DNA, 20 bp, Artificial
  CRISPR gRNA sequence
aaataaaatacaaatgtgca

SEQ ID NO: 106037 - DNA, 20 bp, Artificial
  CRISPR gRNA sequence
aataaaatacaaatgtgcaa

SEQ ID NO: 106038 - DNA, 20 bp, Artificial
  CRISPR gRNA sequence
tacaaatgtgcaaaggaaat

SEQ ID NO: 106039 - DNA, 20 bp, Artificial
  CRISPR gRNA sequence
ctgccccccctttgaacaat

SEQ ID NO: 106040 - DNA, 20 bp, Artificial
  CRISPR gRNA sequence
ccctttgaacaatgagtcaa

SEQ ID NO: 106041 - DNA, 20 bp, Artificial
  CRISPR gRNA sequence
acaatgagtcaatagaatgt

SEQ ID NO: 106042 - DNA, 20 bp, Artificial
  CRISPR gRNA sequence
gagtcaatagaatgtgagac

SEQ ID NO: 106043 - DNA, 20 bp, Artificial
  CRISPR gRNA sequence
agtcaatagaatgtgagact

SEQ ID NO: 106044 - DNA, 20 bp, Artificial
  CRISPR gRNA sequence
caatagaatgtgagactggg

SEQ ID NO: 106045 - DNA, 20 bp, Artificial
  CRISPR gRNA sequence
gaatgtgagactgggtagat

SEQ ID NO: 106046 - DNA, 20 bp, Artificial
  CRISPR gRNA sequence
tgtgagactgggtagattag

SEQ ID NO: 106047 - DNA, 20 bp, Artificial
  CRISPR gRNA sequence
ctgggtagattagcagataa

SEQ ID NO: 106048 - DNA, 20 bp, Artificial
  CRISPR gRNA sequence
tgggtagattagcagataat

SEQ ID NO: 106049 - DNA, 20 bp, Artificial
  CRISPR gRNA sequence
agattagcagataataggca

SEQ ID NO: 106050 - DNA, 20 bp, Artificial
  CRISPR gRNA sequence
gattagcagataataggcaa

SEQ ID NO: 106051 - DNA, 20 bp, Artificial
  CRISPR gRNA sequence
gcagataataggcaaaggtc

SEQ ID NO: 106052 - DNA, 20 bp, Artificial
  CRISPR gRNA sequence
taggcaaaggtctagctttt

SEQ ID NO: 106053 - DNA, 20 bp, Artificial
  CRISPR gRNA sequence
gcaaaggtctagcttttcag

SEQ ID NO: 106054 - DNA, 20 bp, Artificial
  CRISPR gRNA sequence
agcttttcagtggcaacttg

SEQ ID NO: 106055 - DNA, 20 bp, Artificial
  CRISPR gRNA sequence
gtggcaacttgaagaaacca

SEQ ID NO: 106056 - DNA, 20 bp, Artificial
  CRISPR gRNA sequence
accaaagatgaatgatgcta

SEQ ID NO: 106057 - DNA, 20 bp, Artificial
  CRISPR gRNA sequence
ccaaagatgaatgatgctaa

SEQ ID NO: 106058 - DNA, 20 bp, Artificial
  CRISPR gRNA sequence
atgctaaaggaatgaccctt

SEQ ID NO: 106059 - DNA, 20 bp, Artificial
  CRISPR gRNA sequence
accctttggtacctgtttta

SEQ ID NO: 106060 - DNA, 20 bp, Artificial
  CRISPR gRNA sequence
tacctgttttaaagtacttc

SEQ ID NO: 106061 - DNA, 20 bp, Artificial
  CRISPR gRNA sequence
ccccttcttttataaacccc

SEQ ID NO: 106062 - DNA, 20 bp, Artificial
  CRISPR gRNA sequence
cccttcttttataaaccccc

SEQ ID NO: 106063 - DNA, 20 bp, Artificial
  CRISPR gRNA sequence
cttcttttataaacccccag

SEQ ID NO: 106064 - DNA, 20 bp, Artificial
  CRISPR gRNA sequence
tttataaacccccaggagcc

SEQ ID NO: 106065 - DNA, 20 bp, Artificial
  CRISPR gRNA sequence
tgtcactaatgtaataactg

SEQ ID NO: 106066 - DNA, 20 bp, Artificial
  CRISPR gRNA sequence
taatgtaataactgaagata

SEQ ID NO: 106067 - DNA, 20 bp, Artificial
  CRISPR gRNA sequence
aatgtaataactgaagatat

SEQ ID NO: 106068 - DNA, 20 bp, Artificial
  CRISPR gRNA sequence
taataactgaagatatgggc

SEQ ID NO: 106069 - DNA, 20 bp, Artificial
  CRISPR gRNA sequence
ccatgtcacgttccgacttg

SEQ ID NO: 106070 - DNA, 20 bp, Artificial
  CRISPR gRNA sequence
catgtcacgttccgacttgt

SEQ ID NO: 106071 - DNA, 20 bp, Artificial
  CRISPR gRNA sequence
tcacgttccgacttgtaggt

SEQ ID NO: 106072 - DNA, 20 bp, Artificial
  CRISPR gRNA sequence
cacgttccgacttgtaggtc

SEQ ID NO: 106073 - DNA, 20 bp, Artificial
  CRISPR gRNA sequence
acgttccgacttgtaggtca

SEQ ID NO: 106074 - DNA, 20 bp, Artificial
  CRISPR gRNA sequence
gctgtaaaccctgaccaaca

SEQ ID NO: 106075 - DNA, 20 bp, Artificial
  CRISPR gRNA sequence
gtaaaccctgaccaacaaag

SEQ ID NO: 106076 - DNA, 20 bp, Artificial
  CRISPR gRNA sequence
actccaaatcctaaactttt

SEQ ID NO: 106077 - DNA, 20 bp, Artificial
  CRISPR gRNA sequence
gcccctttctccccacacat

SEQ ID NO: 106078 - DNA, 20 bp, Artificial
  CRISPR gRNA sequence
cccctttctccccacacatc

SEQ ID NO: 106079 - DNA, 20 bp, Artificial
  CRISPR gRNA sequence
tttctccccacacatcaggc

SEQ ID NO: 106080 - DNA, 20 bp, Artificial
  CRISPR gRNA sequence
ccacacatcaggccagtgta

SEQ ID NO: 106081 - DNA, 20 bp, Artificial
  CRISPR gRNA sequence
cacacatcaggccagtgtaa

SEQ ID NO: 106082 - DNA, 20 bp, Artificial
  CRISPR gRNA sequence
tcaggccagtgtaaaggaaa

SEQ ID NO: 106083 - DNA, 20 bp, Artificial
  CRISPR gRNA sequence
taaaggaaacagatcccttc

SEQ ID NO: 106084 - DNA, 20 bp, Artificial
  CRISPR gRNA sequence
gaaacagatcccttcaagct

SEQ ID NO: 106085 - DNA, 20 bp, Artificial
  CRISPR gRNA sequence
aattcctttatccattaaca

SEQ ID NO: 106086 - DNA, 20 bp, Artificial
  CRISPR gRNA sequence
tccattaacatggtgtaact

SEQ ID NO: 106087 - DNA, 20 bp, Artificial
  CRISPR gRNA sequence
ggtgtaacttagaaactact

SEQ ID NO: 106088 - DNA, 20 bp, Artificial
  CRISPR gRNA sequence
gtgtaacttagaaactacta

SEQ ID NO: 106089 - DNA, 20 bp, Artificial
  CRISPR gRNA sequence
tgtaacttagaaactactaa

SEQ ID NO: 106090 - DNA, 20 bp, Artificial
  CRISPR gRNA sequence
acttagaaactactaagggc

SEQ ID NO: 106091 - DNA, 20 bp, Artificial
  CRISPR gRNA sequence
cttagaaactactaagggcc

SEQ ID NO: 106092 - DNA, 20 bp, Artificial
  CRISPR gRNA sequence
gaaactactaagggccaggt

SEQ ID NO: 106093 - DNA, 20 bp, Artificial
  CRISPR gRNA sequence
aggttggttgctgctgccac

SEQ ID NO: 106094 - DNA, 20 bp, Artificial
  CRISPR gRNA sequence
ggttggttgctgctgccact

SEQ ID NO: 106095 - DNA, 20 bp, Artificial
  CRISPR gRNA sequence
ctgctgccactgggaatcca

SEQ ID NO: 106096 - DNA, 20 bp, Artificial
  CRISPR gRNA sequence
tgctgccactgggaatccaa

SEQ ID NO: 106097 - DNA, 20 bp, Artificial
  CRISPR gRNA sequence
ggaccaccctctctgcttcc

SEQ ID NO: 106098 - DNA, 20 bp, Artificial
  CRISPR gRNA sequence
accaccctctctgcttccaa

SEQ ID NO: 106099 - DNA, 20 bp, Artificial
  CRISPR gRNA sequence
ccctctctgcttccaagagc

SEQ ID NO: 106100 - DNA, 20 bp, Artificial
  CRISPR gRNA sequence
ctctctgcttccaagagctg

SEQ ID NO: 106101 - DNA, 20 bp, Artificial
  CRISPR gRNA sequence
ctgcttccaagagctggaga

SEQ ID NO: 106102 - DNA, 20 bp, Artificial
  CRISPR gRNA sequence
gagatggtgcccttttcatc

SEQ ID NO: 106103 - DNA, 20 bp, Artificial
  CRISPR gRNA sequence
gatggtgcccttttcatctg

SEQ ID NO: 106104 - DNA, 20 bp, Artificial
  CRISPR gRNA sequence
gtgcccttttcatctggagc

SEQ ID NO: 106105 - DNA, 20 bp, Artificial
  CRISPR gRNA sequence
agctctttcccctactctct

SEQ ID NO: 106106 - DNA, 20 bp, Artificial
  CRISPR gRNA sequence
gctctttcccctactctctt

SEQ ID NO: 106107 - DNA, 20 bp, Artificial
  CRISPR gRNA sequence
ccctactctcttaggctgcc

SEQ ID NO: 106108 - DNA, 20 bp, Artificial
  CRISPR gRNA sequence
tctcttaggctgcctagcta

SEQ ID NO: 106109 - DNA, 20 bp, Artificial
  CRISPR gRNA sequence
ctcttaggctgcctagctat

SEQ ID NO: 106110 - DNA, 20 bp, Artificial
  CRISPR gRNA sequence
tgcctagctatgggaaacaa

SEQ ID NO: 106111 - DNA, 20 bp, Artificial
  CRISPR gRNA sequence
gcctagctatgggaaacaat

SEQ ID NO: 106112 - DNA, 20 bp, Artificial
  CRISPR gRNA sequence
ataggatccctcctcatgtc

SEQ ID NO: 106113 - DNA, 20 bp, Artificial
  CRISPR gRNA sequence
gatccctcctcatgtctggc

SEQ ID NO: 106114 - DNA, 20 bp, Artificial
  CRISPR gRNA sequence
tccctcctcatgtctggcta

SEQ ID NO: 106115 - DNA, 20 bp, Artificial
  CRISPR gRNA sequence
tggctagagaaccactcaca

SEQ ID NO: 106116 - DNA, 20 bp, Artificial
  CRISPR gRNA sequence
tagagaaccactcacacagt

SEQ ID NO: 106117 - DNA, 20 bp, Artificial
  CRISPR gRNA sequence
agagaaccactcacacagtg

SEQ ID NO: 106118 - DNA, 20 bp, Artificial
  CRISPR gRNA sequence
aaccactcacacagtgagga

SEQ ID NO: 106119 - DNA, 20 bp, Artificial
  CRISPR gRNA sequence
accactcacacagtgaggac

SEQ ID NO: 106120 - DNA, 20 bp, Artificial
  CRISPR gRNA sequence
acacagtgaggacaggcacc

SEQ ID NO: 106121 - DNA, 20 bp, Artificial
  CRISPR gRNA sequence
ccatcttcatatccctgaca

SEQ ID NO: 106122 - DNA, 20 bp, Artificial
  CRISPR gRNA sequence
atcttcatatccctgacaca

SEQ ID NO: 106123 - DNA, 20 bp, Artificial
  CRISPR gRNA sequence
tcatatccctgacacagagt

SEQ ID NO: 106124 - DNA, 20 bp, Artificial
  CRISPR gRNA sequence
tttgttaaatgaacgactcg

SEQ ID NO: 106125 - DNA, 20 bp, Artificial
  CRISPR gRNA sequence
tgttaaatgaacgactcgcg

SEQ ID NO: 106126 - DNA, 20 bp, Artificial
  CRISPR gRNA sequence
taaatgaacgactcgcggag

SEQ ID NO: 106127 - DNA, 20 bp, Artificial
  CRISPR gRNA sequence
acgactcgcggagtggctgc

SEQ ID NO: 106128 - DNA, 20 bp, Artificial
  CRISPR gRNA sequence
ctcgcggagtggctgctaga

SEQ ID NO: 106129 - DNA, 20 bp, Artificial
  CRISPR gRNA sequence
gagtggctgctagatagcta

SEQ ID NO: 106130 - DNA, 20 bp, Artificial
  CRISPR gRNA sequence
ggctgctagatagctacggc

SEQ ID NO: 106131 - DNA, 20 bp, Artificial
  CRISPR gRNA sequence
gatagctacggccagaacaa

SEQ ID NO: 106132 - DNA, 20 bp, Artificial
  CRISPR gRNA sequence
agctacggccagaacaacgg

SEQ ID NO: 106133 - DNA, 20 bp, Artificial
  CRISPR gRNA sequence
gctacggccagaacaacggc

SEQ ID NO: 106134 - DNA, 20 bp, Artificial
  CRISPR gRNA sequence
gggcatatacttatgacgcc

SEQ ID NO: 106135 - DNA, 20 bp, Artificial
  CRISPR gRNA sequence
aacgaataaaataattgaaa

SEQ ID NO: 106136 - DNA, 20 bp, Artificial
  CRISPR gRNA sequence
aattgaaacagaacgcttaa

SEQ ID NO: 106137 - DNA, 20 bp, Artificial
  CRISPR gRNA sequence
aacgcttaatagaaaatgct

SEQ ID NO: 106138 - DNA, 20 bp, Artificial
  CRISPR gRNA sequence
acgcttaatagaaaatgctc

SEQ ID NO: 106139 - DNA, 20 bp, Artificial
  CRISPR gRNA sequence
cgcttaatagaaaatgctcg

SEQ ID NO: 106140 - DNA, 20 bp, Artificial
  CRISPR gRNA sequence
taatagaaaatgctcggggt

SEQ ID NO: 106141 - DNA, 20 bp, Artificial
  CRISPR gRNA sequence
aatagaaaatgctcggggtt

SEQ ID NO: 106142 - DNA, 20 bp, Artificial
  CRISPR gRNA sequence
atgctcggggttgggaaaaa

SEQ ID NO: 106143 - DNA, 20 bp, Artificial
  CRISPR gRNA sequence
tgctcggggttgggaaaaac

SEQ ID NO: 106144 - DNA, 20 bp, Artificial
  CRISPR gRNA sequence
ggttgggaaaaacgggttca

SEQ ID NO: 106145 - DNA, 20 bp, Artificial
  CRISPR gRNA sequence
ggaaaaacgggttcaaagcc

SEQ ID NO: 106146 - DNA, 20 bp, Artificial
  CRISPR gRNA sequence
gaaaaacgggttcaaagccc

SEQ ID NO: 106147 - DNA, 20 bp, Artificial
  CRISPR gRNA sequence
aaaaacgggttcaaagcccg

SEQ ID NO: 106148 - DNA, 20 bp, Artificial
  CRISPR gRNA sequence
cgggttcaaagcccggggcg

SEQ ID NO: 106149 - DNA, 20 bp, Artificial
  CRISPR gRNA sequence
ctgtaaaaatcctttcctct

SEQ ID NO: 106150 - DNA, 20 bp, Artificial
  CRISPR gRNA sequence
agtttcaatttcatcatctt

SEQ ID NO: 106151 - DNA, 20 bp, Artificial
  CRISPR gRNA sequence
gtttcaatttcatcatcttt

SEQ ID NO: 106152 - DNA, 20 bp, Artificial
  CRISPR gRNA sequence
tttcaatttcatcatctttg

SEQ ID NO: 106153 - DNA, 20 bp, Artificial
  CRISPR gRNA sequence
aatttcatcatctttggggt

SEQ ID NO: 106154 - DNA, 20 bp, Artificial
  CRISPR gRNA sequence
atcatctttggggtgagctc

SEQ ID NO: 106155 - DNA, 20 bp, Artificial
  CRISPR gRNA sequence
tcatctttggggtgagctca

SEQ ID NO: 106156 - DNA, 20 bp, Artificial
  CRISPR gRNA sequence
ttggggtgagctcaaggact

SEQ ID NO: 106157 - DNA, 20 bp, Artificial
  CRISPR gRNA sequence
ggtgagctcaaggactgagc

SEQ ID NO: 106158 - DNA, 20 bp, Artificial
  CRISPR gRNA sequence
actgagccggttcatcccaa

SEQ ID NO: 106159 - DNA, 20 bp, Artificial
  CRISPR gRNA sequence
tgtcctcccacgctaaaacg

SEQ ID NO: 106160 - DNA, 20 bp, Artificial
  CRISPR gRNA sequence
cgctaaaacgaagatactca

SEQ ID NO: 106161 - DNA, 20 bp, Artificial
  CRISPR gRNA sequence
gaagatactcaaagtttcct

SEQ ID NO: 106162 - DNA, 20 bp, Artificial
  CRISPR gRNA sequence
aagatactcaaagtttccta

SEQ ID NO: 106163 - DNA, 20 bp, Artificial
  CRISPR gRNA sequence
atactcaaagtttcctaagg

SEQ ID NO: 106164 - DNA, 20 bp, Artificial
  CRISPR gRNA sequence
aaagtttcctaaggaagccg

SEQ ID NO: 106165 - DNA, 20 bp, Artificial
  CRISPR gRNA sequence
cctaaggaagccgcagcacg

SEQ ID NO: 106166 - DNA, 20 bp, Artificial
  CRISPR gRNA sequence
cacgaagttaaactgtgcct

SEQ ID NO: 106167 - DNA, 20 bp, Artificial
  CRISPR gRNA sequence
ttaaactgtgccttagctcg

SEQ ID NO: 106168 - DNA, 20 bp, Artificial
  CRISPR gRNA sequence
taaactgtgccttagctcgc

SEQ ID NO: 106169 - DNA, 20 bp, Artificial
  CRISPR gRNA sequence
aactgtgccttagctcgcgg

SEQ ID NO: 106170 - DNA, 20 bp, Artificial
  CRISPR gRNA sequence
actgtgccttagctcgcggg

SEQ ID NO: 106171 - DNA, 20 bp, Artificial
  CRISPR gRNA sequence
tgccttagctcgcgggaggc

SEQ ID NO: 106172 - DNA, 20 bp, Artificial
  CRISPR gRNA sequence
gccttagctcgcgggaggct

SEQ ID NO: 106173 - DNA, 20 bp, Artificial
  CRISPR gRNA sequence
aggctaggcctgtaaccgtc

SEQ ID NO: 106174 - DNA, 20 bp, Artificial
  CRISPR gRNA sequence
ggctaggcctgtaaccgtcg

SEQ ID NO: 106175 - DNA, 20 bp, Artificial
  CRISPR gRNA sequence
cctgtaaccgtcgaggcctc

SEQ ID NO: 106176 - DNA, 20 bp, Artificial
  CRISPR gRNA sequence
ctgtaaccgtcgaggcctcc

SEQ ID NO: 106177 - DNA, 20 bp, Artificial
  CRISPR gRNA sequence
tgtaaccgtcgaggcctcca

SEQ ID NO: 106178 - DNA, 20 bp, Artificial
  CRISPR gRNA sequence
gtaaccgtcgaggcctccag

SEQ ID NO: 106179 - DNA, 20 bp, Artificial
  CRISPR gRNA sequence
cgtcgaggcctccaggggct

SEQ ID NO: 106180 - DNA, 20 bp, Artificial
  CRISPR gRNA sequence
ctccaggggcttagacccaa

SEQ ID NO: 106181 - DNA, 20 bp, Artificial
  CRISPR gRNA sequence
cccaacggccgcctctcccg

SEQ ID NO: 106182 - DNA, 20 bp, Artificial
  CRISPR gRNA sequence
ccaacggccgcctctcccgc

SEQ ID NO: 106183 - DNA, 20 bp, Artificial
  CRISPR gRNA sequence
cggccgcctctcccgcaggc

SEQ ID NO: 106184 - DNA, 20 bp, Artificial
  CRISPR gRNA sequence
ggccgcctctcccgcaggcc

SEQ ID NO: 106185 - DNA, 20 bp, Artificial
  CRISPR gRNA sequence
ccgcctctcccgcaggccag

SEQ ID NO: 106186 - DNA, 20 bp, Artificial
  CRISPR gRNA sequence
tcccgcaggccaggagactt

SEQ ID NO: 106187 - DNA, 20 bp, Artificial
  CRISPR gRNA sequence
aggccaggagacttaagtgc

SEQ ID NO: 106188 - DNA, 20 bp, Artificial
  CRISPR gRNA sequence
ggagacttaagtgcaagtgc

SEQ ID NO: 106189 - DNA, 20 bp, Artificial
  CRISPR gRNA sequence
cgtcgccctcacccgtcaca

SEQ ID NO: 106190 - DNA, 20 bp, Artificial
  CRISPR gRNA sequence
tcacccgtcacatggacgcc

SEQ ID NO: 106191 - DNA, 20 bp, Artificial
  CRISPR gRNA sequence
cacccgtcacatggacgcct

SEQ ID NO: 106192 - DNA, 20 bp, Artificial
  CRISPR gRNA sequence
cccgtcacatggacgcctag

SEQ ID NO: 106193 - DNA, 20 bp, Artificial
  CRISPR gRNA sequence
ccgtcacatggacgcctagg

SEQ ID NO: 106194 - DNA, 20 bp, Artificial
  CRISPR gRNA sequence
ggacgcctaggaggacgccc

SEQ ID NO: 106195 - DNA, 20 bp, Artificial
  CRISPR gRNA sequence
gacgcctaggaggacgccct

SEQ ID NO: 106196 - DNA, 20 bp, Artificial
  CRISPR gRNA sequence
taggaggacgccctgggccg

SEQ ID NO: 106197 - DNA, 20 bp, Artificial
  CRISPR gRNA sequence
aggacgccctgggccgtggc

SEQ ID NO: 106198 - DNA, 20 bp, Artificial
  CRISPR gRNA sequence
gccctgggccgtggcgagct

SEQ ID NO: 106199 - DNA, 20 bp, Artificial
  CRISPR gRNA sequence
ccctgggccgtggcgagctc

SEQ ID NO: 106200 - DNA, 20 bp, Artificial
  CRISPR gRNA sequence
gagctcgggttcccatcccc

SEQ ID NO: 106201 - DNA, 20 bp, Artificial
  CRISPR gRNA sequence
agctcgggttcccatccccg

SEQ ID NO: 106202 - DNA, 20 bp, Artificial
  CRISPR gRNA sequence
cccatccccgaggcttccga

SEQ ID NO: 106203 - DNA, 20 bp, Artificial
  CRISPR gRNA sequence
ccccgaggcttccgaaagac

SEQ ID NO: 106204 - DNA, 20 bp, Artificial
  CRISPR gRNA sequence
cgaggcttccgaaagaccag

SEQ ID NO: 106205 - DNA, 20 bp, Artificial
  CRISPR gRNA sequence
gaggcttccgaaagaccagt

SEQ ID NO: 106206 - DNA, 20 bp, Artificial
  CRISPR gRNA sequence
cttccgaaagaccagtaggt

SEQ ID NO: 106207 - DNA, 20 bp, Artificial
  CRISPR gRNA sequence
ttccgaaagaccagtaggtc

SEQ ID NO: 106208 - DNA, 20 bp, Artificial
  CRISPR gRNA sequence
cgaaagaccagtaggtcggg

SEQ ID NO: 106209 - DNA, 20 bp, Artificial
  CRISPR gRNA sequence
aagaccagtaggtcgggaag

SEQ ID NO: 106210 - DNA, 20 bp, Artificial
  CRISPR gRNA sequence
ggtcgggaagcagcgccgcc

SEQ ID NO: 106211 - DNA, 20 bp, Artificial
  CRISPR gRNA sequence
cgggaagcagcgccgccaag

SEQ ID NO: 106212 - DNA, 20 bp, Artificial
  CRISPR gRNA sequence
gggaagcagcgccgccaagc

SEQ ID NO: 106213 - DNA, 20 bp, Artificial
  CRISPR gRNA sequence
cgccgccaagcgggcctcca

SEQ ID NO: 106214 - DNA, 20 bp, Artificial
  CRISPR gRNA sequence
gccgccaagcgggcctccac

SEQ ID NO: 106215 - DNA, 20 bp, Artificial
  CRISPR gRNA sequence
aagcgggcctccacaggcca

SEQ ID NO: 106216 - DNA, 20 bp, Artificial
  CRISPR gRNA sequence
gcgggcctccacaggccaca

SEQ ID NO: 106217 - DNA, 20 bp, Artificial
  CRISPR gRNA sequence
cgggcctccacaggccacag

SEQ ID NO: 106218 - DNA, 20 bp, Artificial
  CRISPR gRNA sequence
gcctccacaggccacagagg

SEQ ID NO: 106219 - DNA, 20 bp, Artificial
  CRISPR gRNA sequence
cggcgtcgcatgccgctcgc

SEQ ID NO: 106220 - DNA, 20 bp, Artificial
  CRISPR gRNA sequence
atgccgctcgccggtcacca

SEQ ID NO: 106221 - DNA, 20 bp, Artificial
  CRISPR gRNA sequence
ggtcaccatggctgcccgcc

SEQ ID NO: 106222 - DNA, 20 bp, Artificial
  CRISPR gRNA sequence
gtcaccatggctgcccgcct

SEQ ID NO: 106223 - DNA, 20 bp, Artificial
  CRISPR gRNA sequence
atggctgcccgcctaggtac

SEQ ID NO: 106224 - DNA, 20 bp, Artificial
  CRISPR gRNA sequence
gcccgcctaggtaccggaaa

SEQ ID NO: 106225 - DNA, 20 bp, Artificial
  CRISPR gRNA sequence
cccgcctaggtaccggaaac

SEQ ID NO: 106226 - DNA, 20 bp, Artificial
  CRISPR gRNA sequence
ccgcctaggtaccggaaaca

SEQ ID NO: 106227 - DNA, 20 bp, Artificial
  CRISPR gRNA sequence
taggtaccggaaacagggcc

SEQ ID NO: 106228 - DNA, 20 bp, Artificial
  CRISPR gRNA sequence
ggaaacagggcccagccgcg

SEQ ID NO: 106229 - DNA, 20 bp, Artificial
  CRISPR gRNA sequence
aacagggcccagccgcgtag

SEQ ID NO: 106230 - DNA, 20 bp, Artificial
  CRISPR gRNA sequence
cgcgtagcagccaatccgcc

SEQ ID NO: 106231 - DNA, 20 bp, Artificial
  CRISPR gRNA sequence
gtagcagccaatccgcctag

SEQ ID NO: 106232 - DNA, 20 bp, Artificial
  CRISPR gRNA sequence
tagcagccaatccgcctagc

SEQ ID NO: 106233 - DNA, 20 bp, Artificial
  CRISPR gRNA sequence
atccgcctagcaggctctat

SEQ ID NO: 106234 - DNA, 20 bp, Artificial
  CRISPR gRNA sequence
ccgcctagcaggctctattg

SEQ ID NO: 106235 - DNA, 20 bp, Artificial
  CRISPR gRNA sequence
cgcctagcaggctctattgg

SEQ ID NO: 106236 - DNA, 20 bp, Artificial
  CRISPR gRNA sequence
ctgccgccgatcaatccgcg

SEQ ID NO: 106237 - DNA, 20 bp, Artificial
  CRISPR gRNA sequence
tgccgccgatcaatccgcgc

SEQ ID NO: 106238 - DNA, 20 bp, Artificial
  CRISPR gRNA sequence
tcaatccgcgcaggcttcct

SEQ ID NO: 106239 - DNA, 20 bp, Artificial
  CRISPR gRNA sequence
caatccgcgcaggcttcctt

SEQ ID NO: 106240 - DNA, 20 bp, Artificial
  CRISPR gRNA sequence
ttccttgggacaacgccaat

SEQ ID NO: 106241 - DNA, 20 bp, Artificial
  CRISPR gRNA sequence
cttgggacaacgccaatcgg

SEQ ID NO: 106242 - DNA, 20 bp, Artificial
  CRISPR gRNA sequence
acgccaatcggaagcgactt

SEQ ID NO: 106243 - DNA, 20 bp, Artificial
  CRISPR gRNA sequence
ccaccaccttcccacattct

SEQ ID NO: 106244 - DNA, 20 bp, Artificial
  CRISPR gRNA sequence
ccaccttcccacattcttag

SEQ ID NO: 106245 - DNA, 20 bp, Artificial
  CRISPR gRNA sequence
caccttcccacattcttagc

SEQ ID NO: 106246 - DNA, 20 bp, Artificial
  CRISPR gRNA sequence
accttcccacattcttagcg

SEQ ID NO: 106247 - DNA, 20 bp, Artificial
  CRISPR gRNA sequence
cttagcggggcctacttccc

SEQ ID NO: 106248 - DNA, 20 bp, Artificial
  CRISPR gRNA sequence
ttagcggggcctacttcccc

SEQ ID NO: 106249 - DNA, 20 bp, Artificial
  CRISPR gRNA sequence
tagcggggcctacttccccg

SEQ ID NO: 106250 - DNA, 20 bp, Artificial
  CRISPR gRNA sequence
gcggggcctacttccccggg

SEQ ID NO: 106251 - DNA, 20 bp, Artificial
  CRISPR gRNA sequence
gggcctacttccccggggag

SEQ ID NO: 106252 - DNA, 20 bp, Artificial
  CRISPR gRNA sequence
ggcctacttccccggggaga

SEQ ID NO: 106253 - DNA, 20 bp, Artificial
  CRISPR gRNA sequence
gcctacttccccggggagaa

SEQ ID NO: 106254 - DNA, 20 bp, Artificial
  CRISPR gRNA sequence
cctacttccccggggagaag

SEQ ID NO: 106255 - DNA, 20 bp, Artificial
  CRISPR gRNA sequence
cttccccggggagaaggggc

SEQ ID NO: 106256 - DNA, 20 bp, Artificial
  CRISPR gRNA sequence
tccccggggagaaggggctg

SEQ ID NO: 106257 - DNA, 20 bp, Artificial
  CRISPR gRNA sequence
ccccggggagaaggggctgg

SEQ ID NO: 106258 - DNA, 20 bp, Artificial
  CRISPR gRNA sequence
gggagaaggggctggaggtg

SEQ ID NO: 106259 - DNA, 20 bp, Artificial
  CRISPR gRNA sequence
agaaggggctggaggtgcgg

SEQ ID NO: 106260 - DNA, 20 bp, Artificial
  CRISPR gRNA sequence
tgcggcggtctgcgctttca

SEQ ID NO: 106261 - DNA, 20 bp, Artificial
  CRISPR gRNA sequence
gcggcggtctgcgctttcaa

SEQ ID NO: 106262 - DNA, 20 bp, Artificial
  CRISPR gRNA sequence
ggcggtctgcgctttcaaag

SEQ ID NO: 106263 - DNA, 20 bp, Artificial
  CRISPR gRNA sequence
tctgcgctttcaaaggagca

SEQ ID NO: 106264 - DNA, 20 bp, Artificial
  CRISPR gRNA sequence
agcaaagctgtcttttctac

SEQ ID NO: 106265 - DNA, 20 bp, Artificial
  CRISPR gRNA sequence
gctgtcttttctactggaaa

SEQ ID NO: 106266 - DNA, 20 bp, Artificial
  CRISPR gRNA sequence
ctgtcttttctactggaaac

SEQ ID NO: 106267 - DNA, 20 bp, Artificial
  CRISPR gRNA sequence
tgtcttttctactggaaacg

SEQ ID NO: 106268 - DNA, 20 bp, Artificial
  CRISPR gRNA sequence
gtcttttctactggaaacgg

SEQ ID NO: 106269 - DNA, 20 bp, Artificial
  CRISPR gRNA sequence
cttttctactggaaacgggg

SEQ ID NO: 106270 - DNA, 20 bp, Artificial
  CRISPR gRNA sequence
ttttctactggaaacggggg

SEQ ID NO: 106271 - DNA, 20 bp, Artificial
  CRISPR gRNA sequence
tactggaaacgggggaggcg

SEQ ID NO: 106272 - DNA, 20 bp, Artificial
  CRISPR gRNA sequence
gcgaagacgctcctacgata

SEQ ID NO: 106273 - DNA, 20 bp, Artificial
  CRISPR gRNA sequence
cgctcctacgataaagccgt

SEQ ID NO: 106274 - DNA, 20 bp, Artificial
  CRISPR gRNA sequence
tacgataaagccgttggtgt

SEQ ID NO: 106275 - DNA, 20 bp, Artificial
  CRISPR gRNA sequence
gttggtgtgagataaatatc

SEQ ID NO: 106276 - DNA, 20 bp, Artificial
  CRISPR gRNA sequence
tggtgtgagataaatatcga

SEQ ID NO: 106277 - DNA, 20 bp, Artificial
  CRISPR gRNA sequence
ggtgtgagataaatatcgag

SEQ ID NO: 106278 - DNA, 20 bp, Artificial
  CRISPR gRNA sequence
gaggtctttccctcatacca

SEQ ID NO: 106279 - DNA, 20 bp, Artificial
  CRISPR gRNA sequence
ggtctttccctcataccaca

SEQ ID NO: 106280 - DNA, 20 bp, Artificial
  CRISPR gRNA sequence
ctttccctcataccacagag

SEQ ID NO: 106281 - DNA, 20 bp, Artificial
  CRISPR gRNA sequence
cataccacagagtagaatct

SEQ ID NO: 106282 - DNA, 20 bp, Artificial
  CRISPR gRNA sequence
ataccacagagtagaatctt

SEQ ID NO: 106283 - DNA, 20 bp, Artificial
  CRISPR gRNA sequence
tcttgggtcatctctgaatt

SEQ ID NO: 106284 - DNA, 20 bp, Artificial
  CRISPR gRNA sequence
gggtcatctctgaatttggt

SEQ ID NO: 106285 - DNA, 20 bp, Artificial
  CRISPR gRNA sequence
ggtcatctctgaatttggta

SEQ ID NO: 106286 - DNA, 20 bp, Artificial
  CRISPR gRNA sequence
atctctgaatttggtaagga

SEQ ID NO: 106287 - DNA, 20 bp, Artificial
  CRISPR gRNA sequence
tctctgaatttggtaaggac

SEQ ID NO: 106288 - DNA, 20 bp, Artificial
  CRISPR gRNA sequence
ttggtaaggacaggttccac

SEQ ID NO: 106289 - DNA, 20 bp, Artificial
  CRISPR gRNA sequence
ggttccactggcataaatct

SEQ ID NO: 106290 - DNA, 20 bp, Artificial
  CRISPR gRNA sequence
cataaatctaagccaaactc

SEQ ID NO: 106291 - DNA, 20 bp, Artificial
  CRISPR gRNA sequence
atctaagccaaactcaagca

SEQ ID NO: 106292 - DNA, 20 bp, Artificial
  CRISPR gRNA sequence
actcaagcacagtttgacta

SEQ ID NO: 106293 - DNA, 20 bp, Artificial
  CRISPR gRNA sequence
ctaaagctatcaaatactgt

SEQ ID NO: 106294 - DNA, 20 bp, Artificial
  CRISPR gRNA sequence
tcagtgcttttccttcattg

SEQ ID NO: 106295 - DNA, 20 bp, Artificial
  CRISPR gRNA sequence
agtgcttttccttcattgtg

SEQ ID NO: 106296 - DNA, 20 bp, Artificial
  CRISPR gRNA sequence
tgcttttccttcattgtgga

SEQ ID NO: 106297 - DNA, 20 bp, Artificial
  CRISPR gRNA sequence
gtttctcctctctcatctgc

SEQ ID NO: 106298 - DNA, 20 bp, Artificial
  CRISPR gRNA sequence
tttctcctctctcatctgcc

SEQ ID NO: 106299 - DNA, 20 bp, Artificial
  CRISPR gRNA sequence
ttctcctctctcatctgcca

SEQ ID NO: 106300 - DNA, 20 bp, Artificial
  CRISPR gRNA sequence
tcctctctcatctgccaggg

SEQ ID NO: 106301 - DNA, 20 bp, Artificial
  CRISPR gRNA sequence
cctctctcatctgccagggc

SEQ ID NO: 106302 - DNA, 20 bp, Artificial
  CRISPR gRNA sequence
ggtctactgctctcatcatt

SEQ ID NO: 106303 - DNA, 20 bp, Artificial
  CRISPR gRNA sequence
ctcatcattgagtgcttcct

SEQ ID NO: 106304 - DNA, 20 bp, Artificial
  CRISPR gRNA sequence
tcatcattgagtgcttcctc

SEQ ID NO: 106305 - DNA, 20 bp, Artificial
  CRISPR gRNA sequence
tgtctcttgtgtgttgataa

SEQ ID NO: 106306 - DNA, 20 bp, Artificial
  CRISPR gRNA sequence
gtgtgttgataatggcatat

SEQ ID NO: 106307 - DNA, 20 bp, Artificial
  CRISPR gRNA sequence
gtgttgataatggcatatcg

SEQ ID NO: 106308 - DNA, 20 bp, Artificial
  CRISPR gRNA sequence
tgttgataatggcatatcgg

SEQ ID NO: 106309 - DNA, 20 bp, Artificial
  CRISPR gRNA sequence
aatggcatatcggaggcttc

SEQ ID NO: 106310 - DNA, 20 bp, Artificial
  CRISPR gRNA sequence
ggcttctagtctttgttgct

SEQ ID NO: 106311 - DNA, 20 bp, Artificial
  CRISPR gRNA sequence
gtctttgttgcttagattcc

SEQ ID NO: 106312 - DNA, 20 bp, Artificial
  CRISPR gRNA sequence
cttagattcccagcgaccgt

SEQ ID NO: 106313 - DNA, 20 bp, Artificial
  CRISPR gRNA sequence
ttagattcccagcgaccgta

SEQ ID NO: 106314 - DNA, 20 bp, Artificial
  CRISPR gRNA sequence
ccagcgaccgtaaggtaaaa

SEQ ID NO: 106315 - DNA, 20 bp, Artificial
  CRISPR gRNA sequence
ccgtaaggtaaaacagtaac

SEQ ID NO: 106316 - DNA, 20 bp, Artificial
  CRISPR gRNA sequence
cgtaaggtaaaacagtaaca

SEQ ID NO: 106317 - DNA, 20 bp, Artificial
  CRISPR gRNA sequence
aggtaaaacagtaacaaggt

SEQ ID NO: 106318 - DNA, 20 bp, Artificial
  CRISPR gRNA sequence
gtaacaaggtgagcatgctg

SEQ ID NO: 106319 - DNA, 20 bp, Artificial
  CRISPR gRNA sequence
tgctgtggatttttaacaat

SEQ ID NO: 106320 - DNA, 20 bp, Artificial
  CRISPR gRNA sequence
tggatttttaacaatcagaa

SEQ ID NO: 106321 - DNA, 20 bp, Artificial
  CRISPR gRNA sequence
tcagaaaagtacttttgttt

SEQ ID NO: 106322 - DNA, 20 bp, Artificial
  CRISPR gRNA sequence
aaaatctaacaaaacgtaaa

SEQ ID NO: 106323 - DNA, 20 bp, Artificial
  CRISPR gRNA sequence
cctgaaattctacaatactt

SEQ ID NO: 106324 - DNA, 20 bp, Artificial
  CRISPR gRNA sequence
ctgaaattctacaatactta

SEQ ID NO: 106325 - DNA, 20 bp, Artificial
  CRISPR gRNA sequence
taaggctgtttttgtgataa

SEQ ID NO: 106326 - DNA, 20 bp, Artificial
  CRISPR gRNA sequence
ataacggctaattttcctca

SEQ ID NO: 106327 - DNA, 20 bp, Artificial
  CRISPR gRNA sequence
cacattttgataaacacttt

SEQ ID NO: 106328 - DNA, 20 bp, Artificial
  CRISPR gRNA sequence
attttgataaacactttcag

SEQ ID NO: 106329 - DNA, 20 bp, Artificial
  CRISPR gRNA sequence
ttgataaacactttcagtag

SEQ ID NO: 106330 - DNA, 20 bp, Artificial
  CRISPR gRNA sequence
agtagcatcaaatgtatgat

SEQ ID NO: 106331 - DNA, 20 bp, Artificial
  CRISPR gRNA sequence
tcaaatgtatgatcagcctg

SEQ ID NO: 106332 - DNA, 20 bp, Artificial
  CRISPR gRNA sequence
caaatgtatgatcagcctgc

SEQ ID NO: 106333 - DNA, 20 bp, Artificial
  CRISPR gRNA sequence
tatgatcagcctgcaggtga

SEQ ID NO: 106334 - DNA, 20 bp, Artificial
  CRISPR gRNA sequence
gacagaaaaaatctcctcaa

SEQ ID NO: 106335 - DNA, 20 bp, Artificial
  CRISPR gRNA sequence
acagaaaaaatctcctcaac

SEQ ID NO: 106336 - DNA, 20 bp, Artificial
  CRISPR gRNA sequence
cagaaaaaatctcctcaaca

SEQ ID NO: 106337 - DNA, 20 bp, Artificial
  CRISPR gRNA sequence
aaaaaatctcctcaacaggg

SEQ ID NO: 106338 - DNA, 20 bp, Artificial
  CRISPR gRNA sequence
aaatctcctcaacagggtgg

SEQ ID NO: 106339 - DNA, 20 bp, Artificial
  CRISPR gRNA sequence
aatctcctcaacagggtgga

SEQ ID NO: 106340 - DNA, 20 bp, Artificial
  CRISPR gRNA sequence
atctcctcaacagggtggaa

SEQ ID NO: 106341 - DNA, 20 bp, Artificial
  CRISPR gRNA sequence
caacagggtggaagggccaa

SEQ ID NO: 106342 - DNA, 20 bp, Artificial
  CRISPR gRNA sequence
aacagggtggaagggccaaa

SEQ ID NO: 106343 - DNA, 20 bp, Artificial
  CRISPR gRNA sequence
acagggtggaagggccaaaa

SEQ ID NO: 106344 - DNA, 20 bp, Artificial
  CRISPR gRNA sequence
gggtggaagggccaaaaggg

SEQ ID NO: 106345 - DNA, 20 bp, Artificial
  CRISPR gRNA sequence
gggccaaaagggaagaaatt

SEQ ID NO: 106346 - DNA, 20 bp, Artificial
  CRISPR gRNA sequence
ggccaaaagggaagaaatta

SEQ ID NO: 106347 - DNA, 20 bp, Artificial
  CRISPR gRNA sequence
gccaaaagggaagaaattaa

SEQ ID NO: 106348 - DNA, 20 bp, Artificial
  CRISPR gRNA sequence
ccaaaagggaagaaattaag

SEQ ID NO: 106349 - DNA, 20 bp, Artificial
  CRISPR gRNA sequence
aaaagggaagaaattaaggg

SEQ ID NO: 106350 - DNA, 20 bp, Artificial
  CRISPR gRNA sequence
gaagaaattaaggggagata

SEQ ID NO: 106351 - DNA, 20 bp, Artificial
  CRISPR gRNA sequence
aattaaggggagataaagct

SEQ ID NO: 106352 - DNA, 20 bp, Artificial
  CRISPR gRNA sequence
ttaaggggagataaagctaa

SEQ ID NO: 106353 - DNA, 20 bp, Artificial
  CRISPR gRNA sequence
taaggggagataaagctaag

SEQ ID NO: 106354 - DNA, 20 bp, Artificial
  CRISPR gRNA sequence
ggagataaagctaagaggct

SEQ ID NO: 106355 - DNA, 20 bp, Artificial
  CRISPR gRNA sequence
ctaagaggctcagacattac

SEQ ID NO: 106356 - DNA, 20 bp, Artificial
  CRISPR gRNA sequence
tacaagtttgatactgttta

SEQ ID NO: 106357 - DNA, 20 bp, Artificial
  CRISPR gRNA sequence
caagtttgatactgtttaca

SEQ ID NO: 106358 - DNA, 20 bp, Artificial
  CRISPR gRNA sequence
ttacagagacaccgtccatg

SEQ ID NO: 106359 - DNA, 20 bp, Artificial
  CRISPR gRNA sequence
gagacaccgtccatgcagac

SEQ ID NO: 106360 - DNA, 20 bp, Artificial
  CRISPR gRNA sequence
tccatgcagacaagtcttgt

SEQ ID NO: 106361 - DNA, 20 bp, Artificial
  CRISPR gRNA sequence
ccatgcagacaagtcttgtc

SEQ ID NO: 106362 - DNA, 20 bp, Artificial
  CRISPR gRNA sequence
catgcagacaagtcttgtcg

SEQ ID NO: 106363 - DNA, 20 bp, Artificial
  CRISPR gRNA sequence
atgcagacaagtcttgtcgg

SEQ ID NO: 106364 - DNA, 20 bp, Artificial
  CRISPR gRNA sequence
gcagacaagtcttgtcgggg

SEQ ID NO: 106365 - DNA, 20 bp, Artificial
  CRISPR gRNA sequence
ggagatcaaaatttcaacac

SEQ ID NO: 106366 - DNA, 20 bp, Artificial
  CRISPR gRNA sequence
tcaacactggaaacacaaac

SEQ ID NO: 106367 - DNA, 20 bp, Artificial
  CRISPR gRNA sequence
tggaaacacaaactagaacc

SEQ ID NO: 106368 - DNA, 20 bp, Artificial
  CRISPR gRNA sequence
ggaaacacaaactagaaccc

SEQ ID NO: 106369 - DNA, 20 bp, Artificial
  CRISPR gRNA sequence
aaacacaaactagaacccag

SEQ ID NO: 106370 - DNA, 20 bp, Artificial
  CRISPR gRNA sequence
aaactagaacccaggagttg

SEQ ID NO: 106371 - DNA, 20 bp, Artificial
  CRISPR gRNA sequence
aggagttgcagattcctcaa

SEQ ID NO: 106372 - DNA, 20 bp, Artificial
  CRISPR gRNA sequence
tcaaaagtcacattactttt

SEQ ID NO: 106373 - DNA, 20 bp, Artificial
  CRISPR gRNA sequence
cctgtacgcccccatactgc

SEQ ID NO: 106374 - DNA, 20 bp, Artificial
  CRISPR gRNA sequence
ctgtacgcccccatactgct

SEQ ID NO: 106375 - DNA, 20 bp, Artificial
  CRISPR gRNA sequence
tgtacgcccccatactgctg

SEQ ID NO: 106376 - DNA, 20 bp, Artificial
  CRISPR gRNA sequence
gtacgcccccatactgctgg

SEQ ID NO: 106377 - DNA, 20 bp, Artificial
  CRISPR gRNA sequence
tgggggaaaaaccttcgata

SEQ ID NO: 106378 - DNA, 20 bp, Artificial
  CRISPR gRNA sequence
ttcgatatagttgaatccca

SEQ ID NO: 106379 - DNA, 20 bp, Artificial
  CRISPR gRNA sequence
ttgaatcccaaagaaaaatc

SEQ ID NO: 106380 - DNA, 20 bp, Artificial
  CRISPR gRNA sequence
aaaaatcaagacattattat

SEQ ID NO: 106381 - DNA, 20 bp, Artificial
  CRISPR gRNA sequence
aaaatcaagacattattatc

SEQ ID NO: 106382 - DNA, 20 bp, Artificial
  CRISPR gRNA sequence
cattattatcaggcacccta

SEQ ID NO: 106383 - DNA, 20 bp, Artificial
  CRISPR gRNA sequence
atagccacaaaatgctctgt

SEQ ID NO: 106384 - DNA, 20 bp, Artificial
  CRISPR gRNA sequence
cacaaaatgctctgttggtc

SEQ ID NO: 106385 - DNA, 20 bp, Artificial
  CRISPR gRNA sequence
aaaatgctctgttggtccag

SEQ ID NO: 106386 - DNA, 20 bp, Artificial
  CRISPR gRNA sequence
cactgacatgttcaatgtac

SEQ ID NO: 106387 - DNA, 20 bp, Artificial
  CRISPR gRNA sequence
acatgttcaatgtaccagtg

SEQ ID NO: 106388 - DNA, 20 bp, Artificial
  CRISPR gRNA sequence
tatcctgcaaaaaaaaaaaa

SEQ ID NO: 106389 - DNA, 20 bp, Artificial
  CRISPR gRNA sequence
aaaaaaaaaaaaaagcactc

SEQ ID NO: 106390 - DNA, 20 bp, Artificial
  CRISPR gRNA sequence
aagcactcaagttgcataac

SEQ ID NO: 106391 - DNA, 20 bp, Artificial
  CRISPR gRNA sequence
agcactcaagttgcataact

SEQ ID NO: 106392 - DNA, 20 bp, Artificial
  CRISPR gRNA sequence
tcactctttctccatctgta

SEQ ID NO: 106393 - DNA, 20 bp, Artificial
  CRISPR gRNA sequence
catctgtaaagttatcacta

SEQ ID NO: 106394 - DNA, 20 bp, Artificial
  CRISPR gRNA sequence
tcacaaataaaaatgaataa

SEQ ID NO: 106395 - DNA, 20 bp, Artificial
  CRISPR gRNA sequence
ataaaaatgaataaaagaac

SEQ ID NO: 106396 - DNA, 20 bp, Artificial
  CRISPR gRNA sequence
gaataaaagaactagtatca

SEQ ID NO: 106397 - DNA, 20 bp, Artificial
  CRISPR gRNA sequence
aataccctgcccccactttg

SEQ ID NO: 106398 - DNA, 20 bp, Artificial
  CRISPR gRNA sequence
ataccctgcccccactttgt

SEQ ID NO: 106399 - DNA, 20 bp, Artificial
  CRISPR gRNA sequence
ccccactttgtgggctacta

SEQ ID NO: 106400 - DNA, 20 bp, Artificial
  CRISPR gRNA sequence
tgggctactatggtgtgcca

SEQ ID NO: 106401 - DNA, 20 bp, Artificial
  CRISPR gRNA sequence
tggtgtgccaaagtgaccac

SEQ ID NO: 106402 - DNA, 20 bp, Artificial
  CRISPR gRNA sequence
tgccaaagtgaccacaagaa

SEQ ID NO: 106403 - DNA, 20 bp, Artificial
  CRISPR gRNA sequence
gccaaagtgaccacaagaaa

SEQ ID NO: 106404 - DNA, 20 bp, Artificial
  CRISPR gRNA sequence
ccaaagtgaccacaagaaaa

SEQ ID NO: 106405 - DNA, 20 bp, Artificial
  CRISPR gRNA sequence
gaccacaagaaaagggtcat

SEQ ID NO: 106406 - DNA, 20 bp, Artificial
  CRISPR gRNA sequence
caatgacaaaatgacaactg

SEQ ID NO: 106407 - DNA, 20 bp, Artificial
  CRISPR gRNA sequence
agcatttcaaacaaaattca

SEQ ID NO: 106408 - DNA, 20 bp, Artificial
  CRISPR gRNA sequence
ctccccccaaataaaaaatt

SEQ ID NO: 106409 - DNA, 20 bp, Artificial
  CRISPR gRNA sequence
caaataaaaaattcagcaac

SEQ ID NO: 106410 - DNA, 20 bp, Artificial
  CRISPR gRNA sequence
aaataaaaaattcagcaaca

SEQ ID NO: 106411 - DNA, 20 bp, Artificial
  CRISPR gRNA sequence
aaaaaattcagcaacaaggc

SEQ ID NO: 106412 - DNA, 20 bp, Artificial
  CRISPR gRNA sequence
cattactatgtacaaactta

SEQ ID NO: 106413 - DNA, 20 bp, Artificial
  CRISPR gRNA sequence
aacttacagacacaaataaa

SEQ ID NO: 106414 - DNA, 20 bp, Artificial
  CRISPR gRNA sequence
aaatagcatcttctaactgt

SEQ ID NO: 106415 - DNA, 20 bp, Artificial
  CRISPR gRNA sequence
tagcatcttctaactgttgg

SEQ ID NO: 106416 - DNA, 20 bp, Artificial
  CRISPR gRNA sequence
cttctaactgttggcagctt

SEQ ID NO: 106417 - DNA, 20 bp, Artificial
  CRISPR gRNA sequence
gttggcagcttaagcactca

SEQ ID NO: 106418 - DNA, 20 bp, Artificial
  CRISPR gRNA sequence
gcagcttaagcactcaaagt

SEQ ID NO: 106419 - DNA, 20 bp, Artificial
  CRISPR gRNA sequence
cagcttaagcactcaaagtt

SEQ ID NO: 106420 - DNA, 20 bp, Artificial
  CRISPR gRNA sequence
aagcactcaaagttaggtct

SEQ ID NO: 106421 - DNA, 20 bp, Artificial
  CRISPR gRNA sequence
tctttctgaactctgcatct

SEQ ID NO: 106422 - DNA, 20 bp, Artificial
  CRISPR gRNA sequence
cttagactcctaaattaacc

SEQ ID NO: 106423 - DNA, 20 bp, Artificial
  CRISPR gRNA sequence
ttagactcctaaattaacca

SEQ ID NO: 106424 - DNA, 20 bp, Artificial
  CRISPR gRNA sequence
gaatataaattcctcattgt

SEQ ID NO: 106425 - DNA, 20 bp, Artificial
  CRISPR gRNA sequence
aatctattctctgaaaaact

SEQ ID NO: 106426 - DNA, 20 bp, Artificial
  CRISPR gRNA sequence
atctattctctgaaaaactt

SEQ ID NO: 106427 - DNA, 20 bp, Artificial
  CRISPR gRNA sequence
attaatatcccaaactcttg

SEQ ID NO: 106428 - DNA, 20 bp, Artificial
  CRISPR gRNA sequence
taatatcccaaactcttgta

SEQ ID NO: 106429 - DNA, 20 bp, Artificial
  CRISPR gRNA sequence
atcccaaactcttgtagagc

SEQ ID NO: 106430 - DNA, 20 bp, Artificial
  CRISPR gRNA sequence
ccaaactcttgtagagctag

SEQ ID NO: 106431 - DNA, 20 bp, Artificial
  CRISPR gRNA sequence
cttgtagagctagaagtttc

SEQ ID NO: 106432 - DNA, 20 bp, Artificial
  CRISPR gRNA sequence
tagagctagaagtttctagt

SEQ ID NO: 106433 - DNA, 20 bp, Artificial
  CRISPR gRNA sequence
agtttctagtgagcttacca

SEQ ID NO: 106434 - DNA, 20 bp, Artificial
  CRISPR gRNA sequence
gtttctagtgagcttaccaa

SEQ ID NO: 106435 - DNA, 20 bp, Artificial
  CRISPR gRNA sequence
tagtgagcttaccaaaggat

SEQ ID NO: 106436 - DNA, 20 bp, Artificial
  CRISPR gRNA sequence
aggatcagtcctttgacatc

SEQ ID NO: 106437 - DNA, 20 bp, Artificial
  CRISPR gRNA sequence
atcagtcctttgacatctgg

SEQ ID NO: 106438 - DNA, 20 bp, Artificial
  CRISPR gRNA sequence
gtcctttgacatctggaagc

SEQ ID NO: 106439 - DNA, 20 bp, Artificial
  CRISPR gRNA sequence
tcctttgacatctggaagcc

SEQ ID NO: 106440 - DNA, 20 bp, Artificial
  CRISPR gRNA sequence
ctttgacatctggaagccag

SEQ ID NO: 106441 - DNA, 20 bp, Artificial
  CRISPR gRNA sequence
tggaagccaggagcgattac

SEQ ID NO: 106442 - DNA, 20 bp, Artificial
  CRISPR gRNA sequence
aggagcgattaccagatccc

SEQ ID NO: 106443 - DNA, 20 bp, Artificial
  CRISPR gRNA sequence
ggagcgattaccagatccct

SEQ ID NO: 106444 - DNA, 20 bp, Artificial
  CRISPR gRNA sequence
gattaccagatccctgggac

SEQ ID NO: 106445 - DNA, 20 bp, Artificial
  CRISPR gRNA sequence
attaccagatccctgggact

SEQ ID NO: 106446 - DNA, 20 bp, Artificial
  CRISPR gRNA sequence
cacttcctgtttcctttgca

SEQ ID NO: 106447 - DNA, 20 bp, Artificial
  CRISPR gRNA sequence
attacaatcatctctctttg

SEQ ID NO: 106448 - DNA, 20 bp, Artificial
  CRISPR gRNA sequence
atctctctttgtggtgtttt

SEQ ID NO: 106449 - DNA, 20 bp, Artificial
  CRISPR gRNA sequence
ctctctttgtggtgttttta

SEQ ID NO: 106450 - DNA, 20 bp, Artificial
  CRISPR gRNA sequence
tctctttgtggtgtttttag

SEQ ID NO: 106451 - DNA, 20 bp, Artificial
  CRISPR gRNA sequence
ctctttgtggtgtttttaga

SEQ ID NO: 106452 - DNA, 20 bp, Artificial
  CRISPR gRNA sequence
gcttaatttctgtcttaata

SEQ ID NO: 106453 - DNA, 20 bp, Artificial
  CRISPR gRNA sequence
atttctgtcttaatacagtt

SEQ ID NO: 106454 - DNA, 20 bp, Artificial
  CRISPR gRNA sequence
gtcttaatacagttaagctg

SEQ ID NO: 106455 - DNA, 20 bp, Artificial
  CRISPR gRNA sequence
atacagttaagctgaagtca

SEQ ID NO: 106456 - DNA, 20 bp, Artificial
  CRISPR gRNA sequence
cagttaagctgaagtcaaag

SEQ ID NO: 106457 - DNA, 20 bp, Artificial
  CRISPR gRNA sequence
gaagaaccaatttttattct

SEQ ID NO: 106458 - DNA, 20 bp, Artificial
  CRISPR gRNA sequence
atttaacccccaatgttcct

SEQ ID NO: 106459 - DNA, 20 bp, Artificial
  CRISPR gRNA sequence
ccaatgttcctcggaattat

SEQ ID NO: 106460 - DNA, 20 bp, Artificial
  CRISPR gRNA sequence
caatgttcctcggaattatt

SEQ ID NO: 106461 - DNA, 20 bp, Artificial
  CRISPR gRNA sequence
tattgggttttccttgtttc

SEQ ID NO: 106462 - DNA, 20 bp, Artificial
  CRISPR gRNA sequence
ttgggttttccttgtttcca

SEQ ID NO: 106463 - DNA, 20 bp, Artificial
  CRISPR gRNA sequence
ggttttccttgtttccagag

SEQ ID NO: 106464 - DNA, 20 bp, Artificial
  CRISPR gRNA sequence
gttttccttgtttccagaga

SEQ ID NO: 106465 - DNA, 20 bp, Artificial
  CRISPR gRNA sequence
ttccttgtttccagagaagg

SEQ ID NO: 106466 - DNA, 20 bp, Artificial
  CRISPR gRNA sequence
actcttctgaaatatcatct

SEQ ID NO: 106467 - DNA, 20 bp, Artificial
  CRISPR gRNA sequence
aaatatcatcttagttctct

SEQ ID NO: 106468 - DNA, 20 bp, Artificial
  CRISPR gRNA sequence
aatatcatcttagttctctc

SEQ ID NO: 106469 - DNA, 20 bp, Artificial
  CRISPR gRNA sequence
atatcatcttagttctctca

SEQ ID NO: 106470 - DNA, 20 bp, Artificial
  CRISPR gRNA sequence
tctcagggttcaacatctaa

SEQ ID NO: 106471 - DNA, 20 bp, Artificial
  CRISPR gRNA sequence
tcagggttcaacatctaaaa

SEQ ID NO: 106472 - DNA, 20 bp, Artificial
  CRISPR gRNA sequence
ttcaacatctaaaagagaaa

SEQ ID NO: 106473 - DNA, 20 bp, Artificial
  CRISPR gRNA sequence
taaaagagaaatagatttct

SEQ ID NO: 106474 - DNA, 20 bp, Artificial
  CRISPR gRNA sequence
aaaagagaaatagatttctg

SEQ ID NO: 106475 - DNA, 20 bp, Artificial
  CRISPR gRNA sequence
ttctgaggcacaacccgttc

SEQ ID NO: 106476 - DNA, 20 bp, Artificial
  CRISPR gRNA sequence
tctgaggcacaacccgttct

SEQ ID NO: 106477 - DNA, 20 bp, Artificial
  CRISPR gRNA sequence
ggcacaacccgttctgggaa

SEQ ID NO: 106478 - DNA, 20 bp, Artificial
  CRISPR gRNA sequence
acaacccgttctgggaacag

SEQ ID NO: 106479 - DNA, 20 bp, Artificial
  CRISPR gRNA sequence
ccgttctgggaacagtggcc

SEQ ID NO: 106480 - DNA, 20 bp, Artificial
  CRISPR gRNA sequence
tggcccagttcctgaccctg

SEQ ID NO: 106481 - DNA, 20 bp, Artificial
  CRISPR gRNA sequence
ggcccagttcctgaccctgc

SEQ ID NO: 106482 - DNA, 20 bp, Artificial
  CRISPR gRNA sequence
ccctgcaggcatgtttcttt

SEQ ID NO: 106483 - DNA, 20 bp, Artificial
  CRISPR gRNA sequence
ggcatgtttctttcagtctg

SEQ ID NO: 106484 - DNA, 20 bp, Artificial
  CRISPR gRNA sequence
cagtctgcagtttattctca

SEQ ID NO: 106485 - DNA, 20 bp, Artificial
  CRISPR gRNA sequence
tgcagtttattctcacagta

SEQ ID NO: 106486 - DNA, 20 bp, Artificial
  CRISPR gRNA sequence
tctcacagtatggatgcaat

SEQ ID NO: 106487 - DNA, 20 bp, Artificial
  CRISPR gRNA sequence
atgagaaaacctttctgcac

SEQ ID NO: 106488 - DNA, 20 bp, Artificial
  CRISPR gRNA sequence
tgagaaaacctttctgcaca

SEQ ID NO: 106489 - DNA, 20 bp, Artificial
  CRISPR gRNA sequence
acctttctgcacaaggccta

SEQ ID NO: 106490 - DNA, 20 bp, Artificial
  CRISPR gRNA sequence
ctttctgcacaaggcctatg

SEQ ID NO: 106491 - DNA, 20 bp, Artificial
  CRISPR gRNA sequence
tatggagaaaacatgaaaac

SEQ ID NO: 106492 - DNA, 20 bp, Artificial
  CRISPR gRNA sequence
aaacatgaaaactggcacca

SEQ ID NO: 106493 - DNA, 20 bp, Artificial
  CRISPR gRNA sequence
gaaaactggcaccaaagaat

SEQ ID NO: 106494 - DNA, 20 bp, Artificial
  CRISPR gRNA sequence
caccaaagaatcagctgcca

SEQ ID NO: 106495 - DNA, 20 bp, Artificial
  CRISPR gRNA sequence
accaaagaatcagctgccat

SEQ ID NO: 106496 - DNA, 20 bp, Artificial
  CRISPR gRNA sequence
aaagaatcagctgccatggg

SEQ ID NO: 106497 - DNA, 20 bp, Artificial
  CRISPR gRNA sequence
gaatgaaaatgctcgctttc

SEQ ID NO: 106498 - DNA, 20 bp, Artificial
  CRISPR gRNA sequence
aatgaaaatgctcgctttct

SEQ ID NO: 106499 - DNA, 20 bp, Artificial
  CRISPR gRNA sequence
atgaaaatgctcgctttcta

SEQ ID NO: 106500 - DNA, 20 bp, Artificial
  CRISPR gRNA sequence
aaatgctcgctttctagggc

SEQ ID NO: 106501 - DNA, 20 bp, Artificial
  CRISPR gRNA sequence
ctagggccagcattgtgctg

SEQ ID NO: 106502 - DNA, 20 bp, Artificial
  CRISPR gRNA sequence
tagggccagcattgtgctgc

SEQ ID NO: 106503 - DNA, 20 bp, Artificial
  CRISPR gRNA sequence
gggccagcattgtgctgcag

SEQ ID NO: 106504 - DNA, 20 bp, Artificial
  CRISPR gRNA sequence
agcattgtgctgcaggagtg

SEQ ID NO: 106505 - DNA, 20 bp, Artificial
  CRISPR gRNA sequence
gtgaagccaacatccacctc

SEQ ID NO: 106506 - DNA, 20 bp, Artificial
  CRISPR gRNA sequence
ccaacatccacctcaagctt

SEQ ID NO: 106507 - DNA, 20 bp, Artificial
  CRISPR gRNA sequence
acatccacctcaagctttag

SEQ ID NO: 106508 - DNA, 20 bp, Artificial
  CRISPR gRNA sequence
catccacctcaagctttagt

SEQ ID NO: 106509 - DNA, 20 bp, Artificial
  CRISPR gRNA sequence
tcaagctttagtgggtaact

SEQ ID NO: 106510 - DNA, 20 bp, Artificial
  CRISPR gRNA sequence
tgggtaacttggactctgtc

SEQ ID NO: 106511 - DNA, 20 bp, Artificial
  CRISPR gRNA sequence
gggtaacttggactctgtcc

SEQ ID NO: 106512 - DNA, 20 bp, Artificial
  CRISPR gRNA sequence
aacttggactctgtccagga

SEQ ID NO: 106513 - DNA, 20 bp, Artificial
  CRISPR gRNA sequence
tccaggacagtgtgactgac

SEQ ID NO: 106514 - DNA, 20 bp, Artificial
  CRISPR gRNA sequence
tgtgactgaccagtgctttc

SEQ ID NO: 106515 - DNA, 20 bp, Artificial
  CRISPR gRNA sequence
agtgctttccagaaattgtc

SEQ ID NO: 106516 - DNA, 20 bp, Artificial
  CRISPR gRNA sequence
gtgctttccagaaattgtca

SEQ ID NO: 106517 - DNA, 20 bp, Artificial
  CRISPR gRNA sequence
aattgtcaaggatcaaatct

SEQ ID NO: 106518 - DNA, 20 bp, Artificial
  CRISPR gRNA sequence
attgtcaaggatcaaatctc

SEQ ID NO: 106519 - DNA, 20 bp, Artificial
  CRISPR gRNA sequence
aatctcaggcttcttccttt

SEQ ID NO: 106520 - DNA, 20 bp, Artificial
  CRISPR gRNA sequence
cttcctttcagtgcttgtta

SEQ ID NO: 106521 - DNA, 20 bp, Artificial
  CRISPR gRNA sequence
ttcctttcagtgcttgttaa

SEQ ID NO: 106522 - DNA, 20 bp, Artificial
  CRISPR gRNA sequence
tcagtgcttgttaaaggttc

SEQ ID NO: 106523 - DNA, 20 bp, Artificial
  CRISPR gRNA sequence
agtgcttgttaaaggttcta

SEQ ID NO: 106524 - DNA, 20 bp, Artificial
  CRISPR gRNA sequence
ttcatcttaatgatccattc

SEQ ID NO: 106525 - DNA, 20 bp, Artificial
  CRISPR gRNA sequence
tcatcttaatgatccattcc

SEQ ID NO: 106526 - DNA, 20 bp, Artificial
  CRISPR gRNA sequence
cattccaggtatccatccac

SEQ ID NO: 106527 - DNA, 20 bp, Artificial
  CRISPR gRNA sequence
ttccaggtatccatccactg

SEQ ID NO: 106528 - DNA, 20 bp, Artificial
  CRISPR gRNA sequence
tcgtgctctatgataacata

SEQ ID NO: 106529 - DNA, 20 bp, Artificial
  CRISPR gRNA sequence
cgtgctctatgataacatac

SEQ ID NO: 106530 - DNA, 20 bp, Artificial
  CRISPR gRNA sequence
tctcccccactctctcccac

SEQ ID NO: 106531 - DNA, 20 bp, Artificial
  CRISPR gRNA sequence
ctcccccactctctcccact

SEQ ID NO: 106532 - DNA, 20 bp, Artificial
  CRISPR gRNA sequence
gctgaaacacatgaatcttt

SEQ ID NO: 106533 - DNA, 20 bp, Artificial
  CRISPR gRNA sequence
gttccccaaatgctgtcaca

SEQ ID NO: 106534 - DNA, 20 bp, Artificial
  CRISPR gRNA sequence
agtctatgattgaaaatctc

SEQ ID NO: 106535 - DNA, 20 bp, Artificial
  CRISPR gRNA sequence
atgattgaaaatctctagtt

SEQ ID NO: 106536 - DNA, 20 bp, Artificial
  CRISPR gRNA sequence
ctctagtttggcccttcctt

SEQ ID NO: 106537 - DNA, 20 bp, Artificial
  CRISPR gRNA sequence
tctagtttggcccttccttt

SEQ ID NO: 106538 - DNA, 20 bp, Artificial
  CRISPR gRNA sequence
tagtttggcccttcctttag

SEQ ID NO: 106539 - DNA, 20 bp, Artificial
  CRISPR gRNA sequence
aggagtattacaaatctcct

SEQ ID NO: 106540 - DNA, 20 bp, Artificial
  CRISPR gRNA sequence
tacaaatctcctcagtgctt

SEQ ID NO: 106541 - DNA, 20 bp, Artificial
  CRISPR gRNA sequence
atctcctcagtgcttcagca

SEQ ID NO: 106542 - DNA, 20 bp, Artificial
  CRISPR gRNA sequence
tcctcagtgcttcagcaaag

SEQ ID NO: 106543 - DNA, 20 bp, Artificial
  CRISPR gRNA sequence
tcagcaaagaagttgttgaa

SEQ ID NO: 106544 - DNA, 20 bp, Artificial
  CRISPR gRNA sequence
gaatagtcttgttctctact

SEQ ID NO: 106545 - DNA, 20 bp, Artificial
  CRISPR gRNA sequence
aatagtcttgttctctactt

SEQ ID NO: 106546 - DNA, 20 bp, Artificial
  CRISPR gRNA sequence
gtcttgttctctacttagga

SEQ ID NO: 106547 - DNA, 20 bp, Artificial
  CRISPR gRNA sequence
tcttgttctctacttaggaa

SEQ ID NO: 106548 - DNA, 20 bp, Artificial
  CRISPR gRNA sequence
tgttctctacttaggaaagg

SEQ ID NO: 106549 - DNA, 20 bp, Artificial
  CRISPR gRNA sequence
tacttaggaaaggcagtttc

SEQ ID NO: 106550 - DNA, 20 bp, Artificial
  CRISPR gRNA sequence
acttaggaaaggcagtttca

SEQ ID NO: 106551 - DNA, 20 bp, Artificial
  CRISPR gRNA sequence
aataaccctctacattgtct

SEQ ID NO: 106552 - DNA, 20 bp, Artificial
  CRISPR gRNA sequence
aaccctctacattgtcttag

SEQ ID NO: 106553 - DNA, 20 bp, Artificial
  CRISPR gRNA sequence
cctctacattgtcttagaag

SEQ ID NO: 106554 - DNA, 20 bp, Artificial
  CRISPR gRNA sequence
cattgtcttagaagtagcca

SEQ ID NO: 106555 - DNA, 20 bp, Artificial
  CRISPR gRNA sequence
gtcttagaagtagccacagc

SEQ ID NO: 106556 - DNA, 20 bp, Artificial
  CRISPR gRNA sequence
agtagccacagcaagtacga

SEQ ID NO: 106557 - DNA, 20 bp, Artificial
  CRISPR gRNA sequence
ccacagcaagtacgatggtc

SEQ ID NO: 106558 - DNA, 20 bp, Artificial
  CRISPR gRNA sequence
agtacgatggtccagatgac

SEQ ID NO: 106559 - DNA, 20 bp, Artificial
  CRISPR gRNA sequence
tggtccagatgaccagtcaa

SEQ ID NO: 106560 - DNA, 20 bp, Artificial
  CRISPR gRNA sequence
gtccagatgaccagtcaaca

SEQ ID NO: 106561 - DNA, 20 bp, Artificial
  CRISPR gRNA sequence
tccagatgaccagtcaacag

SEQ ID NO: 106562 - DNA, 20 bp, Artificial
  CRISPR gRNA sequence
ccagatgaccagtcaacaga

SEQ ID NO: 106563 - DNA, 20 bp, Artificial
  CRISPR gRNA sequence
tgaccagtcaacagagggac

SEQ ID NO: 106564 - DNA, 20 bp, Artificial
  CRISPR gRNA sequence
ccagtcaacagagggacaag

SEQ ID NO: 106565 - DNA, 20 bp, Artificial
  CRISPR gRNA sequence
cagtcaacagagggacaagc

SEQ ID NO: 106566 - DNA, 20 bp, Artificial
  CRISPR gRNA sequence
aagcaggccacaacttttca

SEQ ID NO: 106567 - DNA, 20 bp, Artificial
  CRISPR gRNA sequence
aggccacaacttttcaaagc

SEQ ID NO: 106568 - DNA, 20 bp, Artificial
  CRISPR gRNA sequence
caacttttcaaagctagaaa

SEQ ID NO: 106569 - DNA, 20 bp, Artificial
  CRISPR gRNA sequence
acttttcaaagctagaaaaa

SEQ ID NO: 106570 - DNA, 20 bp, Artificial
  CRISPR gRNA sequence
caaagctagaaaaagagatt

SEQ ID NO: 106571 - DNA, 20 bp, Artificial
  CRISPR gRNA sequence
gattcggcaatgtatatttt

SEQ ID NO: 106572 - DNA, 20 bp, Artificial
  CRISPR gRNA sequence
aatgtatatttttagtgctt

SEQ ID NO: 106573 - DNA, 20 bp, Artificial
  CRISPR gRNA sequence
gtcttttatcattctatccc

SEQ ID NO: 106574 - DNA, 20 bp, Artificial
  CRISPR gRNA sequence
tatcattctatccccagaat

SEQ ID NO: 106575 - DNA, 20 bp, Artificial
  CRISPR gRNA sequence
ccccagaattagctttttct

SEQ ID NO: 106576 - DNA, 20 bp, Artificial
  CRISPR gRNA sequence
agaattagctttttcttggc

SEQ ID NO: 106577 - DNA, 20 bp, Artificial
  CRISPR gRNA sequence
aattagctttttcttggcta

SEQ ID NO: 106578 - DNA, 20 bp, Artificial
  CRISPR gRNA sequence
gctttttcttggctagagtc

SEQ ID NO: 106579 - DNA, 20 bp, Artificial
  CRISPR gRNA sequence
agaaatatcaacctaccatc

SEQ ID NO: 106580 - DNA, 20 bp, Artificial
  CRISPR gRNA sequence
gaaatatcaacctaccatct

SEQ ID NO: 106581 - DNA, 20 bp, Artificial
  CRISPR gRNA sequence
atatcaacctaccatctggg

SEQ ID NO: 106582 - DNA, 20 bp, Artificial
  CRISPR gRNA sequence
atcaacctaccatctgggca

SEQ ID NO: 106583 - DNA, 20 bp, Artificial
  CRISPR gRNA sequence
caacctaccatctgggcaga

SEQ ID NO: 106584 - DNA, 20 bp, Artificial
  CRISPR gRNA sequence
aacctaccatctgggcagag

SEQ ID NO: 106585 - DNA, 20 bp, Artificial
  CRISPR gRNA sequence
aggaattcttattattacca

SEQ ID NO: 106586 - DNA, 20 bp, Artificial
  CRISPR gRNA sequence
ttcttattattaccacagat

SEQ ID NO: 106587 - DNA, 20 bp, Artificial
  CRISPR gRNA sequence
ttattattaccacagattgg

SEQ ID NO: 106588 - DNA, 20 bp, Artificial
  CRISPR gRNA sequence
cagattggaagaatgtatct

SEQ ID NO: 106589 - DNA, 20 bp, Artificial
  CRISPR gRNA sequence
agattggaagaatgtatctc

SEQ ID NO: 106590 - DNA, 20 bp, Artificial
  CRISPR gRNA sequence
atttattgtttccgtatcac

SEQ ID NO: 106591 - DNA, 20 bp, Artificial
  CRISPR gRNA sequence
attgtttccgtatcacaaga

SEQ ID NO: 106592 - DNA, 20 bp, Artificial
  CRISPR gRNA sequence
caagatagaacttccttgcc

SEQ ID NO: 106593 - DNA, 20 bp, Artificial
  CRISPR gRNA sequence
gatagaacttccttgcctgg

SEQ ID NO: 106594 - DNA, 20 bp, Artificial
  CRISPR gRNA sequence
ggaagccatctctgaataca

SEQ ID NO: 106595 - DNA, 20 bp, Artificial
  CRISPR gRNA sequence
ctgaatacaaagcgtccatt

SEQ ID NO: 106596 - DNA, 20 bp, Artificial
  CRISPR gRNA sequence
atacaaagcgtccattcagt

SEQ ID NO: 106597 - DNA, 20 bp, Artificial
  CRISPR gRNA sequence
aaagcgtccattcagttagt

SEQ ID NO: 106598 - DNA, 20 bp, Artificial
  CRISPR gRNA sequence
tccattcagttagtcagtgt

SEQ ID NO: 106599 - DNA, 20 bp, Artificial
  CRISPR gRNA sequence
tcagtgtgagattcccccac

SEQ ID NO: 106600 - DNA, 20 bp, Artificial
  CRISPR gRNA sequence
agtgtgagattcccccacca

SEQ ID NO: 106601 - DNA, 20 bp, Artificial
  CRISPR gRNA sequence
gtgtgagattcccccaccag

SEQ ID NO: 106602 - DNA, 20 bp, Artificial
  CRISPR gRNA sequence
tgtgagattcccccaccaga

SEQ ID NO: 106603 - DNA, 20 bp, Artificial
  CRISPR gRNA sequence
ccagagggataaatgctgtc

SEQ ID NO: 106604 - DNA, 20 bp, Artificial
  CRISPR gRNA sequence
taaatgctgtctagattcca

SEQ ID NO: 106605 - DNA, 20 bp, Artificial
  CRISPR gRNA sequence
aaatgctgtctagattccat

SEQ ID NO: 106606 - DNA, 20 bp, Artificial
  CRISPR gRNA sequence
tgctgtctagattccatggg

SEQ ID NO: 106607 - DNA, 20 bp, Artificial
  CRISPR gRNA sequence
gctgtctagattccatggga

SEQ ID NO: 106608 - DNA, 20 bp, Artificial
  CRISPR gRNA sequence
tgtctagattccatgggaag

SEQ ID NO: 106609 - DNA, 20 bp, Artificial
  CRISPR gRNA sequence
ctagattccatgggaaggag

SEQ ID NO: 106610 - DNA, 20 bp, Artificial
  CRISPR gRNA sequence
tagattccatgggaaggagt

SEQ ID NO: 106611 - DNA, 20 bp, Artificial
  CRISPR gRNA sequence
ggctgctgctttcctgattg

SEQ ID NO: 106612 - DNA, 20 bp, Artificial
  CRISPR gRNA sequence
tgctttcctgattgcagttt

SEQ ID NO: 106613 - DNA, 20 bp, Artificial
  CRISPR gRNA sequence
tcctgattgcagttttggtt

SEQ ID NO: 106614 - DNA, 20 bp, Artificial
  CRISPR gRNA sequence
tgattgcagttttggttgag

SEQ ID NO: 106615 - DNA, 20 bp, Artificial
  CRISPR gRNA sequence
gattgcagttttggttgaga

SEQ ID NO: 106616 - DNA, 20 bp, Artificial
  CRISPR gRNA sequence
gaaggttgttcttccctgct

SEQ ID NO: 106617 - DNA, 20 bp, Artificial
  CRISPR gRNA sequence
gttgttcttccctgctgaga

SEQ ID NO: 106618 - DNA, 20 bp, Artificial
  CRISPR gRNA sequence
ttcttccctgctgagatggc

SEQ ID NO: 106619 - DNA, 20 bp, Artificial
  CRISPR gRNA sequence
agatggctggctgacttcac

SEQ ID NO: 106620 - DNA, 20 bp, Artificial
  CRISPR gRNA sequence
gctggctgacttcaccagtc

SEQ ID NO: 106621 - DNA, 20 bp, Artificial
  CRISPR gRNA sequence
ctggctgacttcaccagtca

SEQ ID NO: 106622 - DNA, 20 bp, Artificial
  CRISPR gRNA sequence
ctgacttcaccagtcaaggt

SEQ ID NO: 106623 - DNA, 20 bp, Artificial
  CRISPR gRNA sequence
gtaagtgctttgtgtactgc

SEQ ID NO: 106624 - DNA, 20 bp, Artificial
  CRISPR gRNA sequence
taagtgctttgtgtactgct

SEQ ID NO: 106625 - DNA, 20 bp, Artificial
  CRISPR gRNA sequence
aagtgctttgtgtactgctg

SEQ ID NO: 106626 - DNA, 20 bp, Artificial
  CRISPR gRNA sequence
tgctttgtgtactgctgggg

SEQ ID NO: 106627 - DNA, 20 bp, Artificial
  CRISPR gRNA sequence
tgaaatgtcaatgtcatcaa

SEQ ID NO: 106628 - DNA, 20 bp, Artificial
  CRISPR gRNA sequence
atgtcatcaacagtctgaaa

SEQ ID NO: 106629 - DNA, 20 bp, Artificial
  CRISPR gRNA sequence
tgtcatcaacagtctgaaat

SEQ ID NO: 106630 - DNA, 20 bp, Artificial
  CRISPR gRNA sequence
ctgaaataggtcctgactga

SEQ ID NO: 106631 - DNA, 20 bp, Artificial
  CRISPR gRNA sequence
gaaataggtcctgactgaaa

SEQ ID NO: 106632 - DNA, 20 bp, Artificial
  CRISPR gRNA sequence
taggtcctgactgaaagagt

SEQ ID NO: 106633 - DNA, 20 bp, Artificial
  CRISPR gRNA sequence
ctgactgaaagagtaagaca

SEQ ID NO: 106634 - DNA, 20 bp, Artificial
  CRISPR gRNA sequence
tgactgaaagagtaagacaa

SEQ ID NO: 106635 - DNA, 20 bp, Artificial
  CRISPR gRNA sequence
ggcttgcaacttcaatttgc

SEQ ID NO: 106636 - DNA, 20 bp, Artificial
  CRISPR gRNA sequence
gcttgcaacttcaatttgcc

SEQ ID NO: 106637 - DNA, 20 bp, Artificial
  CRISPR gRNA sequence
atcgctgcaattgtaatact

SEQ ID NO: 106638 - DNA, 20 bp, Artificial
  CRISPR gRNA sequence
tgagccacttattaaaaact

SEQ ID NO: 106639 - DNA, 20 bp, Artificial
  CRISPR gRNA sequence
gccacttattaaaaactaag

SEQ ID NO: 106640 - DNA, 20 bp, Artificial
  CRISPR gRNA sequence
actaagtggtttctgtcctg

SEQ ID NO: 106641 - DNA, 20 bp, Artificial
  CRISPR gRNA sequence
gtggtttctgtcctgtagta

SEQ ID NO: 106642 - DNA, 20 bp, Artificial
  CRISPR gRNA sequence
tggtttctgtcctgtagtaa

SEQ ID NO: 106643 - DNA, 20 bp, Artificial
  CRISPR gRNA sequence
ggtttctgtcctgtagtaaa

SEQ ID NO: 106644 - DNA, 20 bp, Artificial
  CRISPR gRNA sequence
ttctgtcctgtagtaaaggg

SEQ ID NO: 106645 - DNA, 20 bp, Artificial
  CRISPR gRNA sequence
tgtgatcatcaatgtcccat

SEQ ID NO: 106646 - DNA, 20 bp, Artificial
  CRISPR gRNA sequence
gatcatcaatgtcccattgg

SEQ ID NO: 106647 - DNA, 20 bp, Artificial
  CRISPR gRNA sequence
tcatcaatgtcccattggaa

SEQ ID NO: 106648 - DNA, 20 bp, Artificial
  CRISPR gRNA sequence
ggaagagttgatcaatttcc

SEQ ID NO: 106649 - DNA, 20 bp, Artificial
  CRISPR gRNA sequence
agttgatcaatttcctggaa

SEQ ID NO: 106650 - DNA, 20 bp, Artificial
  CRISPR gRNA sequence
gatcaatttcctggaacagt

SEQ ID NO: 106651 - DNA, 20 bp, Artificial
  CRISPR gRNA sequence
gtgagaaacatgaccttgat

SEQ ID NO: 106652 - DNA, 20 bp, Artificial
  CRISPR gRNA sequence
ccttgatcagctccatcaca

SEQ ID NO: 106653 - DNA, 20 bp, Artificial
  CRISPR gRNA sequence
atcagctccatcacatggcg

SEQ ID NO: 106654 - DNA, 20 bp, Artificial
  CRISPR gRNA sequence
tcagctccatcacatggcgt

SEQ ID NO: 106655 - DNA, 20 bp, Artificial
  CRISPR gRNA sequence
cagctccatcacatggcgtg

SEQ ID NO: 106656 - DNA, 20 bp, Artificial
  CRISPR gRNA sequence
tccatcacatggcgtggggt

SEQ ID NO: 106657 - DNA, 20 bp, Artificial
  CRISPR gRNA sequence
ccatcacatggcgtggggtt

SEQ ID NO: 106658 - DNA, 20 bp, Artificial
  CRISPR gRNA sequence
tggcgtggggttaggacact

SEQ ID NO: 106659 - DNA, 20 bp, Artificial
  CRISPR gRNA sequence
ctgtgtcattgcttcttcat

SEQ ID NO: 106660 - DNA, 20 bp, Artificial
  CRISPR gRNA sequence
tcattgcttcttcatcggct

SEQ ID NO: 106661 - DNA, 20 bp, Artificial
  CRISPR gRNA sequence
gcttcttcatcggcttggtt

SEQ ID NO: 106662 - DNA, 20 bp, Artificial
  CRISPR gRNA sequence
catcggcttggtttggatcc

SEQ ID NO: 106663 - DNA, 20 bp, Artificial
  CRISPR gRNA sequence
tcggcttggtttggatccta

SEQ ID NO: 106664 - DNA, 20 bp, Artificial
  CRISPR gRNA sequence
tggtttggatcctagagaca

SEQ ID NO: 106665 - DNA, 20 bp, Artificial
  CRISPR gRNA sequence
caaagatgacatgatgatta

SEQ ID NO: 106666 - DNA, 20 bp, Artificial
  CRISPR gRNA sequence
atgattaaagtcctttgcaa

SEQ ID NO: 106667 - DNA, 20 bp, Artificial
  CRISPR gRNA sequence
aaagtcctttgcaaaagcaa

SEQ ID NO: 106668 - DNA, 20 bp, Artificial
  CRISPR gRNA sequence
aagtcctttgcaaaagcaac

SEQ ID NO: 106669 - DNA, 20 bp, Artificial
  CRISPR gRNA sequence
gcaaaagcaacaggaactca

SEQ ID NO: 106670 - DNA, 20 bp, Artificial
  CRISPR gRNA sequence
ctctcactacttatcccccc

SEQ ID NO: 106671 - DNA, 20 bp, Artificial
  CRISPR gRNA sequence
ctcactacttatccccccaa

SEQ ID NO: 106672 - DNA, 20 bp, Artificial
  CRISPR gRNA sequence
agaatacacataactttacc

SEQ ID NO: 106673 - DNA, 20 bp, Artificial
  CRISPR gRNA sequence
taactttaccaagtaaatca

SEQ ID NO: 106674 - DNA, 20 bp, Artificial
  CRISPR gRNA sequence
aactttaccaagtaaatcaa

SEQ ID NO: 106675 - DNA, 20 bp, Artificial
  CRISPR gRNA sequence
aaaggcttgtaatacatctt

SEQ ID NO: 106676 - DNA, 20 bp, Artificial
  CRISPR gRNA sequence
acatcttaagtctgcataca

SEQ ID NO: 106677 - DNA, 20 bp, Artificial
  CRISPR gRNA sequence
aagtctgcatacatggctta

SEQ ID NO: 106678 - DNA, 20 bp, Artificial
  CRISPR gRNA sequence
tgcatacatggcttaaagtg

SEQ ID NO: 106679 - DNA, 20 bp, Artificial
  CRISPR gRNA sequence
ggcttaaagtgtagccccat

SEQ ID NO: 106680 - DNA, 20 bp, Artificial
  CRISPR gRNA sequence
gcttaaagtgtagccccatt

SEQ ID NO: 106681 - DNA, 20 bp, Artificial
  CRISPR gRNA sequence
aaagtgtagccccattagga

SEQ ID NO: 106682 - DNA, 20 bp, Artificial
  CRISPR gRNA sequence
gtgtagccccattaggaaag

SEQ ID NO: 106683 - DNA, 20 bp, Artificial
  CRISPR gRNA sequence
gtagccccattaggaaagaa

SEQ ID NO: 106684 - DNA, 20 bp, Artificial
  CRISPR gRNA sequence
cttattcttaaaataattta

SEQ ID NO: 106685 - DNA, 20 bp, Artificial
  CRISPR gRNA sequence
tcttaaaataatttaaagtc

SEQ ID NO: 106686 - DNA, 20 bp, Artificial
  CRISPR gRNA sequence
aaagtctggcctgcactcca

SEQ ID NO: 106687 - DNA, 20 bp, Artificial
  CRISPR gRNA sequence
cactccatggtgaaacactg

SEQ ID NO: 106688 - DNA, 20 bp, Artificial
  CRISPR gRNA sequence
actccatggtgaaacactgc

SEQ ID NO: 106689 - DNA, 20 bp, Artificial
  CRISPR gRNA sequence
ctccatggtgaaacactgca

SEQ ID NO: 106690 - DNA, 20 bp, Artificial
  CRISPR gRNA sequence
gtgaaacactgcagggctgt

SEQ ID NO: 106691 - DNA, 20 bp, Artificial
  CRISPR gRNA sequence
tgttagtgtatctctttcct

SEQ ID NO: 106692 - DNA, 20 bp, Artificial
  CRISPR gRNA sequence
ttgtgttgttctctatactt

SEQ ID NO: 106693 - DNA, 20 bp, Artificial
  CRISPR gRNA sequence
tgtgttgttctctatactta

SEQ ID NO: 106694 - DNA, 20 bp, Artificial
  CRISPR gRNA sequence
gtgttgttctctatacttaa

SEQ ID NO: 106695 - DNA, 20 bp, Artificial
  CRISPR gRNA sequence
gttctctatacttaagggtt

SEQ ID NO: 106696 - DNA, 20 bp, Artificial
  CRISPR gRNA sequence
tctctatacttaagggttaa

SEQ ID NO: 106697 - DNA, 20 bp, Artificial
  CRISPR gRNA sequence
acttaagggttaagagtatt

SEQ ID NO: 106698 - DNA, 20 bp, Artificial
  CRISPR gRNA sequence
gggttaagagtattcagatt

SEQ ID NO: 106699 - DNA, 20 bp, Artificial
  CRISPR gRNA sequence
ggttaagagtattcagattc

SEQ ID NO: 106700 - DNA, 20 bp, Artificial
  CRISPR gRNA sequence
gtattcagattcaggtgtct

SEQ ID NO: 106701 - DNA, 20 bp, Artificial
  CRISPR gRNA sequence
tattcagattcaggtgtcta

SEQ ID NO: 106702 - DNA, 20 bp, Artificial
  CRISPR gRNA sequence
agattcaggtgtctaaggaa

SEQ ID NO: 106703 - DNA, 20 bp, Artificial
  CRISPR gRNA sequence
aggtgtctaaggaaaagacc

SEQ ID NO: 106704 - DNA, 20 bp, Artificial
  CRISPR gRNA sequence
gtgtctaaggaaaagaccca

SEQ ID NO: 106705 - DNA, 20 bp, Artificial
  CRISPR gRNA sequence
ttgatcatcatttaaatact

SEQ ID NO: 106706 - DNA, 20 bp, Artificial
  CRISPR gRNA sequence
tcatttaaatactgagtact

SEQ ID NO: 106707 - DNA, 20 bp, Artificial
  CRISPR gRNA sequence
tttaaatactgagtacttag

SEQ ID NO: 106708 - DNA, 20 bp, Artificial
  CRISPR gRNA sequence
ttaaatactgagtacttagc

SEQ ID NO: 106709 - DNA, 20 bp, Artificial
  CRISPR gRNA sequence
taaatactgagtacttagca

SEQ ID NO: 106710 - DNA, 20 bp, Artificial
  CRISPR gRNA sequence
tactgagtacttagcagggc

SEQ ID NO: 106711 - DNA, 20 bp, Artificial
  CRISPR gRNA sequence
gagtacttagcagggctaga

SEQ ID NO: 106712 - DNA, 20 bp, Artificial
  CRISPR gRNA sequence
gcagggctagaaagaatcat

SEQ ID NO: 106713 - DNA, 20 bp, Artificial
  CRISPR gRNA sequence
actttaatgtactcgtttta

SEQ ID NO: 106714 - DNA, 20 bp, Artificial
  CRISPR gRNA sequence
tcgttttacagataaatctg

SEQ ID NO: 106715 - DNA, 20 bp, Artificial
  CRISPR gRNA sequence
cgttttacagataaatctga

SEQ ID NO: 106716 - DNA, 20 bp, Artificial
  CRISPR gRNA sequence
ttacagataaatctgaaggc

SEQ ID NO: 106717 - DNA, 20 bp, Artificial
  CRISPR gRNA sequence
agataaatctgaaggccaga

SEQ ID NO: 106718 - DNA, 20 bp, Artificial
  CRISPR gRNA sequence
gataaatctgaaggccagat

SEQ ID NO: 106719 - DNA, 20 bp, Artificial
  CRISPR gRNA sequence
atctgaaggccagatgggta

SEQ ID NO: 106720 - DNA, 20 bp, Artificial
  CRISPR gRNA sequence
gatgggtaaagtgatttgcg

SEQ ID NO: 106721 - DNA, 20 bp, Artificial
  CRISPR gRNA sequence
gtaaagtgatttgcgtggac

SEQ ID NO: 106722 - DNA, 20 bp, Artificial
  CRISPR gRNA sequence
taaagtgatttgcgtggact

SEQ ID NO: 106723 - DNA, 20 bp, Artificial
  CRISPR gRNA sequence
aaagtgatttgcgtggacta

SEQ ID NO: 106724 - DNA, 20 bp, Artificial
  CRISPR gRNA sequence
tgatttgcgtggactagggt

SEQ ID NO: 106725 - DNA, 20 bp, Artificial
  CRISPR gRNA sequence
gatttgcgtggactagggtc

SEQ ID NO: 106726 - DNA, 20 bp, Artificial
  CRISPR gRNA sequence
atttgcgtggactagggtca

SEQ ID NO: 106727 - DNA, 20 bp, Artificial
  CRISPR gRNA sequence
gcgtggactagggtcagggt

SEQ ID NO: 106728 - DNA, 20 bp, Artificial
  CRISPR gRNA sequence
ggactagggtcagggtcaga

SEQ ID NO: 106729 - DNA, 20 bp, Artificial
  CRISPR gRNA sequence
tagggtcagggtcagaaagt

SEQ ID NO: 106730 - DNA, 20 bp, Artificial
  CRISPR gRNA sequence
agggtcagggtcagaaagtt

SEQ ID NO: 106731 - DNA, 20 bp, Artificial
  CRISPR gRNA sequence
ggtcagggtcagaaagttag

SEQ ID NO: 106732 - DNA, 20 bp, Artificial
  CRISPR gRNA sequence
gggtcagaaagttaggagtc

SEQ ID NO: 106733 - DNA, 20 bp, Artificial
  CRISPR gRNA sequence
cagaaagttaggagtccagc

SEQ ID NO: 106734 - DNA, 20 bp, Artificial
  CRISPR gRNA sequence
agaaagttaggagtccagca

SEQ ID NO: 106735 - DNA, 20 bp, Artificial
  CRISPR gRNA sequence
gaaagttaggagtccagcaa

SEQ ID NO: 106736 - DNA, 20 bp, Artificial
  CRISPR gRNA sequence
ctatatgctgtttctcactt

SEQ ID NO: 106737 - DNA, 20 bp, Artificial
  CRISPR gRNA sequence
aagacctaccgtgttaacac

SEQ ID NO: 106738 - DNA, 20 bp, Artificial
  CRISPR gRNA sequence
agacctaccgtgttaacaca

SEQ ID NO: 106739 - DNA, 20 bp, Artificial
  CRISPR gRNA sequence
ttaacacaaggataaatcct

SEQ ID NO: 106740 - DNA, 20 bp, Artificial
  CRISPR gRNA sequence
acacaaggataaatccttgg

SEQ ID NO: 106741 - DNA, 20 bp, Artificial
  CRISPR gRNA sequence
agctttttgcaacactccgc

SEQ ID NO: 106742 - DNA, 20 bp, Artificial
  CRISPR gRNA sequence
cactccgcaagaaccacctt

SEQ ID NO: 106743 - DNA, 20 bp, Artificial
  CRISPR gRNA sequence
acctttagttcccccatacc

SEQ ID NO: 106744 - DNA, 20 bp, Artificial
  CRISPR gRNA sequence
cctttagttcccccatacca

SEQ ID NO: 106745 - DNA, 20 bp, Artificial
  CRISPR gRNA sequence
tcccccataccaaggctctg

SEQ ID NO: 106746 - DNA, 20 bp, Artificial
  CRISPR gRNA sequence
ataccaaggctctgaagcct

SEQ ID NO: 106747 - DNA, 20 bp, Artificial
  CRISPR gRNA sequence
ccaaggctctgaagccttgg

SEQ ID NO: 106748 - DNA, 20 bp, Artificial
  CRISPR gRNA sequence
caaggctctgaagccttggt

SEQ ID NO: 106749 - DNA, 20 bp, Artificial
  CRISPR gRNA sequence
ggctctgaagccttggtagg

SEQ ID NO: 106750 - DNA, 20 bp, Artificial
  CRISPR gRNA sequence
gctctgaagccttggtaggc

SEQ ID NO: 106751 - DNA, 20 bp, Artificial
  CRISPR gRNA sequence
agccttggtaggcaggatct

SEQ ID NO: 106752 - DNA, 20 bp, Artificial
  CRISPR gRNA sequence
ggtaggcaggatctgagaaa

SEQ ID NO: 106753 - DNA, 20 bp, Artificial
  CRISPR gRNA sequence
aggatctgagaaaaagctga

SEQ ID NO: 106754 - DNA, 20 bp, Artificial
  CRISPR gRNA sequence
agaaaaagctgaaagccttc

SEQ ID NO: 106755 - DNA, 20 bp, Artificial
  CRISPR gRNA sequence
aaaaagctgaaagccttctg

SEQ ID NO: 106756 - DNA, 20 bp, Artificial
  CRISPR gRNA sequence
agctgaaagccttctggaga

SEQ ID NO: 106757 - DNA, 20 bp, Artificial
  CRISPR gRNA sequence
tgaaagccttctggagatgg

SEQ ID NO: 106758 - DNA, 20 bp, Artificial
  CRISPR gRNA sequence
gccttctggagatggaagac

SEQ ID NO: 106759 - DNA, 20 bp, Artificial
  CRISPR gRNA sequence
tggagatggaagactggaac

SEQ ID NO: 106760 - DNA, 20 bp, Artificial
  CRISPR gRNA sequence
ggagatggaagactggaact

SEQ ID NO: 106761 - DNA, 20 bp, Artificial
  CRISPR gRNA sequence
ggaactgggtcttgaacaat

SEQ ID NO: 106762 - DNA, 20 bp, Artificial
  CRISPR gRNA sequence
gaacaatgagcaaaaacaac

SEQ ID NO: 106763 - DNA, 20 bp, Artificial
  CRISPR gRNA sequence
ttactgaactcaccatgcac

SEQ ID NO: 106764 - DNA, 20 bp, Artificial
  CRISPR gRNA sequence
tactgaactcaccatgcact

SEQ ID NO: 106765 - DNA, 20 bp, Artificial
  CRISPR gRNA sequence
aactcaccatgcactaggta

SEQ ID NO: 106766 - DNA, 20 bp, Artificial
  CRISPR gRNA sequence
gcactaggtatggtgctaca

SEQ ID NO: 106767 - DNA, 20 bp, Artificial
  CRISPR gRNA sequence
tgctacacagatgcctaatg

SEQ ID NO: 106768 - DNA, 20 bp, Artificial
  CRISPR gRNA sequence
atccctacaacattgctgtg

SEQ ID NO: 106769 - DNA, 20 bp, Artificial
  CRISPR gRNA sequence
acattgctgtgaagtatcaa

SEQ ID NO: 106770 - DNA, 20 bp, Artificial
  CRISPR gRNA sequence
atcaacagtattccacttta

SEQ ID NO: 106771 - DNA, 20 bp, Artificial
  CRISPR gRNA sequence
cactttacagataaaaataa

SEQ ID NO: 106772 - DNA, 20 bp, Artificial
  CRISPR gRNA sequence
ctttacagataaaaataaaa

SEQ ID NO: 106773 - DNA, 20 bp, Artificial
  CRISPR gRNA sequence
tttacagataaaaataaaag

SEQ ID NO: 106774 - DNA, 20 bp, Artificial
  CRISPR gRNA sequence
taaaagaggctgaattgacc

SEQ ID NO: 106775 - DNA, 20 bp, Artificial
  CRISPR gRNA sequence
attgaccaagatcatattgt

SEQ ID NO: 106776 - DNA, 20 bp, Artificial
  CRISPR gRNA sequence
aagatcatattgttagcaca

SEQ ID NO: 106777 - DNA, 20 bp, Artificial
  CRISPR gRNA sequence
atattgttagcacacagaat

SEQ ID NO: 106778 - DNA, 20 bp, Artificial
  CRISPR gRNA sequence
tattgttagcacacagaatg

SEQ ID NO: 106779 - DNA, 20 bp, Artificial
  CRISPR gRNA sequence
ttgttagcacacagaatgag

SEQ ID NO: 106780 - DNA, 20 bp, Artificial
  CRISPR gRNA sequence
gttagcacacagaatgagga

SEQ ID NO: 106781 - DNA, 20 bp, Artificial
  CRISPR gRNA sequence
cacagaatgaggagagttcc

SEQ ID NO: 106782 - DNA, 20 bp, Artificial
  CRISPR gRNA sequence
acaatgccctcctgccacaa

SEQ ID NO: 106783 - DNA, 20 bp, Artificial
  CRISPR gRNA sequence
cctcctgccacaatagctgt

SEQ ID NO: 106784 - DNA, 20 bp, Artificial
  CRISPR gRNA sequence
ctcctgccacaatagctgtc

SEQ ID NO: 106785 - DNA, 20 bp, Artificial
  CRISPR gRNA sequence
catacaccgttatgaatgaa

SEQ ID NO: 106786 - DNA, 20 bp, Artificial
  CRISPR gRNA sequence
cgttatgaatgaatagcaat

SEQ ID NO: 106787 - DNA, 20 bp, Artificial
  CRISPR gRNA sequence
atgaatgaatagcaatgaga

SEQ ID NO: 106788 - DNA, 20 bp, Artificial
  CRISPR gRNA sequence
tgaatgaatagcaatgagaa

SEQ ID NO: 106789 - DNA, 20 bp, Artificial
  CRISPR gRNA sequence
aatgaatagcaatgagaaag

SEQ ID NO: 106790 - DNA, 20 bp, Artificial
  CRISPR gRNA sequence
atgaatagcaatgagaaagg

SEQ ID NO: 106791 - DNA, 20 bp, Artificial
  CRISPR gRNA sequence
tgaatagcaatgagaaagga

SEQ ID NO: 106792 - DNA, 20 bp, Artificial
  CRISPR gRNA sequence
gaatagcaatgagaaaggag

SEQ ID NO: 106793 - DNA, 20 bp, Artificial
  CRISPR gRNA sequence
aaggaggggctctcacacta

SEQ ID NO: 106794 - DNA, 20 bp, Artificial
  CRISPR gRNA sequence
aggaggggctctcacactac

SEQ ID NO: 106795 - DNA, 20 bp, Artificial
  CRISPR gRNA sequence
ggggctctcacactacaggt

SEQ ID NO: 106796 - DNA, 20 bp, Artificial
  CRISPR gRNA sequence
gggctctcacactacaggtg

SEQ ID NO: 106797 - DNA, 20 bp, Artificial
  CRISPR gRNA sequence
acactacaggtgaggattaa

SEQ ID NO: 106798 - DNA, 20 bp, Artificial
  CRISPR gRNA sequence
gtgaggattaatagcactga

SEQ ID NO: 106799 - DNA, 20 bp, Artificial
  CRISPR gRNA sequence
gaggattaatagcactgaaa

SEQ ID NO: 106800 - DNA, 20 bp, Artificial
  CRISPR gRNA sequence
aatagcactgaaagagttgt

SEQ ID NO: 106801 - DNA, 20 bp, Artificial
  CRISPR gRNA sequence
gagttgttagtgttcatgtg

SEQ ID NO: 106802 - DNA, 20 bp, Artificial
  CRISPR gRNA sequence
agttgttagtgttcatgtgt

SEQ ID NO: 106803 - DNA, 20 bp, Artificial
  CRISPR gRNA sequence
gttgttagtgttcatgtgtg

SEQ ID NO: 106804 - DNA, 20 bp, Artificial
  CRISPR gRNA sequence
tgttcatgtgtggggacact

SEQ ID NO: 106805 - DNA, 20 bp, Artificial
  CRISPR gRNA sequence
gttcatgtgtggggacactg

SEQ ID NO: 106806 - DNA, 20 bp, Artificial
  CRISPR gRNA sequence
gtggggacactgaggaaacc

SEQ ID NO: 106807 - DNA, 20 bp, Artificial
  CRISPR gRNA sequence
ggaaacctagtttgattgtt

SEQ ID NO: 106808 - DNA, 20 bp, Artificial
  CRISPR gRNA sequence
gaaacctagtttgattgttg

SEQ ID NO: 106809 - DNA, 20 bp, Artificial
  CRISPR gRNA sequence
aaacctagtttgattgttga

SEQ ID NO: 106810 - DNA, 20 bp, Artificial
  CRISPR gRNA sequence
aacctagtttgattgttgag

SEQ ID NO: 106811 - DNA, 20 bp, Artificial
  CRISPR gRNA sequence
acctagtttgattgttgagg

SEQ ID NO: 106812 - DNA, 20 bp, Artificial
  CRISPR gRNA sequence
ttgattgttgagggggtgat

SEQ ID NO: 106813 - DNA, 20 bp, Artificial
  CRISPR gRNA sequence
tgattgttgagggggtgata

SEQ ID NO: 106814 - DNA, 20 bp, Artificial
  CRISPR gRNA sequence
gttgagggggtgataaggca

SEQ ID NO: 106815 - DNA, 20 bp, Artificial
  CRISPR gRNA sequence
ggtgataaggcaaagttgct

SEQ ID NO: 106816 - DNA, 20 bp, Artificial
  CRISPR gRNA sequence
aaagttgcttagatgttata

SEQ ID NO: 106817 - DNA, 20 bp, Artificial
  CRISPR gRNA sequence
gcttagatgttatacagaaa

SEQ ID NO: 106818 - DNA, 20 bp, Artificial
  CRISPR gRNA sequence
atgttatacagaaatagttt

SEQ ID NO: 106819 - DNA, 20 bp, Artificial
  CRISPR gRNA sequence
aaatagtttgagatttgatg

SEQ ID NO: 106820 - DNA, 20 bp, Artificial
  CRISPR gRNA sequence
gtttgagatttgatgcagtt

SEQ ID NO: 106821 - DNA, 20 bp, Artificial
  CRISPR gRNA sequence
atttgatgcagttaagaaat

SEQ ID NO: 106822 - DNA, 20 bp, Artificial
  CRISPR gRNA sequence
taagaaatgagaactattaa

SEQ ID NO: 106823 - DNA, 20 bp, Artificial
  CRISPR gRNA sequence
aatagcatgcatccttgacc

SEQ ID NO: 106824 - DNA, 20 bp, Artificial
  CRISPR gRNA sequence
atagcatgcatccttgacct

SEQ ID NO: 106825 - DNA, 20 bp, Artificial
  CRISPR gRNA sequence
tagcatgcatccttgacctg

SEQ ID NO: 106826 - DNA, 20 bp, Artificial
  CRISPR gRNA sequence
tgcatccttgacctggggac

SEQ ID NO: 106827 - DNA, 20 bp, Artificial
  CRISPR gRNA sequence
atccttgacctggggactgg

SEQ ID NO: 106828 - DNA, 20 bp, Artificial
  CRISPR gRNA sequence
tccttgacctggggactggc

SEQ ID NO: 106829 - DNA, 20 bp, Artificial
  CRISPR gRNA sequence
actttaaccatgtactgtat

SEQ ID NO: 106830 - DNA, 20 bp, Artificial
  CRISPR gRNA sequence
gtactgtataagtactatat

SEQ ID NO: 106831 - DNA, 20 bp, Artificial
  CRISPR gRNA sequence
tactgtataagtactatata

SEQ ID NO: 106832 - DNA, 20 bp, Artificial
  CRISPR gRNA sequence
aagtactatataaggccaat

SEQ ID NO: 106833 - DNA, 20 bp, Artificial
  CRISPR gRNA sequence
gtactatataaggccaatta

SEQ ID NO: 106834 - DNA, 20 bp, Artificial
  CRISPR gRNA sequence
tactatataaggccaattag

SEQ ID NO: 106835 - DNA, 20 bp, Artificial
  CRISPR gRNA sequence
ctatataaggccaattagag

SEQ ID NO: 106836 - DNA, 20 bp, Artificial
  CRISPR gRNA sequence
taaggccaattagaggagac

SEQ ID NO: 106837 - DNA, 20 bp, Artificial
  CRISPR gRNA sequence
aggccaattagaggagactg

SEQ ID NO: 106838 - DNA, 20 bp, Artificial
  CRISPR gRNA sequence
gagactggagattaatttga

SEQ ID NO: 106839 - DNA, 20 bp, Artificial
  CRISPR gRNA sequence
taatttgatggatattgcaa

SEQ ID NO: 106840 - DNA, 20 bp, Artificial
  CRISPR gRNA sequence
gatggatattgcaatagtgc

SEQ ID NO: 106841 - DNA, 20 bp, Artificial
  CRISPR gRNA sequence
ggatattgcaatagtgcaag

SEQ ID NO: 106842 - DNA, 20 bp, Artificial
  CRISPR gRNA sequence
agtggaatgtgatgttaata

SEQ ID NO: 106843 - DNA, 20 bp, Artificial
  CRISPR gRNA sequence
aatgtgatgttaatatagaa

SEQ ID NO: 106844 - DNA, 20 bp, Artificial
  CRISPR gRNA sequence
tgtgatgttaatatagaatg

SEQ ID NO: 106845 - DNA, 20 bp, Artificial
  CRISPR gRNA sequence
gttaatatagaatggagtat

SEQ ID NO: 106846 - DNA, 20 bp, Artificial
  CRISPR gRNA sequence
tagaatggagtatcagcaaa

SEQ ID NO: 106847 - DNA, 20 bp, Artificial
  CRISPR gRNA sequence
agaatggagtatcagcaaat

SEQ ID NO: 106848 - DNA, 20 bp, Artificial
  CRISPR gRNA sequence
aatggagtatcagcaaatgg

SEQ ID NO: 106849 - DNA, 20 bp, Artificial
  CRISPR gRNA sequence
atggagtatcagcaaatggg

SEQ ID NO: 106850 - DNA, 20 bp, Artificial
  CRISPR gRNA sequence
tgggaggaatctattaattc

SEQ ID NO: 106851 - DNA, 20 bp, Artificial
  CRISPR gRNA sequence
ttcaagaaacactgattgct

SEQ ID NO: 106852 - DNA, 20 bp, Artificial
  CRISPR gRNA sequence
gaaacactgattgcttggtt

SEQ ID NO: 106853 - DNA, 20 bp, Artificial
  CRISPR gRNA sequence
ctgattgcttggttcagaac

SEQ ID NO: 106854 - DNA, 20 bp, Artificial
  CRISPR gRNA sequence
taaacccaacaaatacatct

SEQ ID NO: 106855 - DNA, 20 bp, Artificial
  CRISPR gRNA sequence
cccaacaaatacatctaagt

SEQ ID NO: 106856 - DNA, 20 bp, Artificial
  CRISPR gRNA sequence
ttaaatacaacttacttaaa

SEQ ID NO: 106857 - DNA, 20 bp, Artificial
  CRISPR gRNA sequence
caacttacttaaatagaatt

SEQ ID NO: 106858 - DNA, 20 bp, Artificial
  CRISPR gRNA sequence
attaagtccaataaatataa

SEQ ID NO: 106859 - DNA, 20 bp, Artificial
  CRISPR gRNA sequence
taagtccaataaatataaca

SEQ ID NO: 106860 - DNA, 20 bp, Artificial
  CRISPR gRNA sequence
tctaccctctatacaactta

SEQ ID NO: 106861 - DNA, 20 bp, Artificial
  CRISPR gRNA sequence
cctctatacaacttacagtc

SEQ ID NO: 106862 - DNA, 20 bp, Artificial
  CRISPR gRNA sequence
atacaacttacagtctagtg

SEQ ID NO: 106863 - DNA, 20 bp, Artificial
  CRISPR gRNA sequence
tacaacttacagtctagtga

SEQ ID NO: 106864 - DNA, 20 bp, Artificial
  CRISPR gRNA sequence
ttaaatattattacactgta

SEQ ID NO: 106865 - DNA, 20 bp, Artificial
  CRISPR gRNA sequence
tattattacactgtaaagaa

SEQ ID NO: 106866 - DNA, 20 bp, Artificial
  CRISPR gRNA sequence
attattacactgtaaagaaa

SEQ ID NO: 106867 - DNA, 20 bp, Artificial
  CRISPR gRNA sequence
ttattacactgtaaagaaaa

SEQ ID NO: 106868 - DNA, 20 bp, Artificial
  CRISPR gRNA sequence
acactgtaaagaaaagggcc

SEQ ID NO: 106869 - DNA, 20 bp, Artificial
  CRISPR gRNA sequence
aagaaaagggccaagtgcaa

SEQ ID NO: 106870 - DNA, 20 bp, Artificial
  CRISPR gRNA sequence
atggtgtgcgcctgtaatcc

SEQ ID NO: 106871 - DNA, 20 bp, Artificial
  CRISPR gRNA sequence
cgcctgtaatcctagcactt

SEQ ID NO: 106872 - DNA, 20 bp, Artificial
  CRISPR gRNA sequence
gcctgtaatcctagcacttt

SEQ ID NO: 106873 - DNA, 20 bp, Artificial
  CRISPR gRNA sequence
ctgtaatcctagcactttgg

SEQ ID NO: 106874 - DNA, 20 bp, Artificial
  CRISPR gRNA sequence
tgtaatcctagcactttggg

SEQ ID NO: 106875 - DNA, 20 bp, Artificial
  CRISPR gRNA sequence
tcctagcactttgggaggcc

SEQ ID NO: 106876 - DNA, 20 bp, Artificial
  CRISPR gRNA sequence
cctagcactttgggaggcca

SEQ ID NO: 106877 - DNA, 20 bp, Artificial
  CRISPR gRNA sequence
gcactttgggaggccaaggc

SEQ ID NO: 106878 - DNA, 20 bp, Artificial
  CRISPR gRNA sequence
actttgggaggccaaggcga

SEQ ID NO: 106879 - DNA, 20 bp, Artificial
  CRISPR gRNA sequence
ctttgggaggccaaggcgag

SEQ ID NO: 106880 - DNA, 20 bp, Artificial
  CRISPR gRNA sequence
ccaaggcgagaggatcgctt

SEQ ID NO: 106881 - DNA, 20 bp, Artificial
  CRISPR gRNA sequence
gcgagaggatcgcttgagcc

SEQ ID NO: 106882 - DNA, 20 bp, Artificial
  CRISPR gRNA sequence
cgagaggatcgcttgagcct

SEQ ID NO: 106883 - DNA, 20 bp, Artificial
  CRISPR gRNA sequence
agaggatcgcttgagcctag

SEQ ID NO: 106884 - DNA, 20 bp, Artificial
  CRISPR gRNA sequence
tcgcttgagcctaggagttt

SEQ ID NO: 106885 - DNA, 20 bp, Artificial
  CRISPR gRNA sequence
ctaggagtttgagacctgcc

SEQ ID NO: 106886 - DNA, 20 bp, Artificial
  CRISPR gRNA sequence
taggagtttgagacctgcct

SEQ ID NO: 106887 - DNA, 20 bp, Artificial
  CRISPR gRNA sequence
tgagacctgcctgggcaaca

SEQ ID NO: 106888 - DNA, 20 bp, Artificial
  CRISPR gRNA sequence
acctgcctgggcaacaaagt

SEQ ID NO: 106889 - DNA, 20 bp, Artificial
  CRISPR gRNA sequence
tctacaaaaaatttaaaaat

SEQ ID NO: 106890 - DNA, 20 bp, Artificial
  CRISPR gRNA sequence
caaaaaatttaaaaattagc

SEQ ID NO: 106891 - DNA, 20 bp, Artificial
  CRISPR gRNA sequence
aaaaaatttaaaaattagct

SEQ ID NO: 106892 - DNA, 20 bp, Artificial
  CRISPR gRNA sequence
atttaaaaattagctgggca

SEQ ID NO: 106893 - DNA, 20 bp, Artificial
  CRISPR gRNA sequence
taaaaattagctgggcatgg

SEQ ID NO: 106894 - DNA, 20 bp, Artificial
  CRISPR gRNA sequence
tagctgggcatggtggtgcg

SEQ ID NO: 106895 - DNA, 20 bp, Artificial
  CRISPR gRNA sequence
ggcatggtggtgcgtggcta

SEQ ID NO: 106896 - DNA, 20 bp, Artificial
  CRISPR gRNA sequence
gtggtgcgtggctatagtcc

SEQ ID NO: 106897 - DNA, 20 bp, Artificial
  CRISPR gRNA sequence
tggctatagtcccagctact

SEQ ID NO: 106898 - DNA, 20 bp, Artificial
  CRISPR gRNA sequence
ggctatagtcccagctactc

SEQ ID NO: 106899 - DNA, 20 bp, Artificial
  CRISPR gRNA sequence
ctatagtcccagctactcgg

SEQ ID NO: 106900 - DNA, 20 bp, Artificial
  CRISPR gRNA sequence
cccagctactcgggagccta

SEQ ID NO: 106901 - DNA, 20 bp, Artificial
  CRISPR gRNA sequence
agctactcgggagcctaaag

SEQ ID NO: 106902 - DNA, 20 bp, Artificial
  CRISPR gRNA sequence
gctactcgggagcctaaagt

SEQ ID NO: 106903 - DNA, 20 bp, Artificial
  CRISPR gRNA sequence
tactcgggagcctaaagtgg

SEQ ID NO: 106904 - DNA, 20 bp, Artificial
  CRISPR gRNA sequence
actcgggagcctaaagtggg

SEQ ID NO: 106905 - DNA, 20 bp, Artificial
  CRISPR gRNA sequence
ctaaagtgggaggatcactt

SEQ ID NO: 106906 - DNA, 20 bp, Artificial
  CRISPR gRNA sequence
agtgggaggatcacttgagc

SEQ ID NO: 106907 - DNA, 20 bp, Artificial
  CRISPR gRNA sequence
gtgggaggatcacttgagct

SEQ ID NO: 106908 - DNA, 20 bp, Artificial
  CRISPR gRNA sequence
gggaggatcacttgagctgg

SEQ ID NO: 106909 - DNA, 20 bp, Artificial
  CRISPR gRNA sequence
ggaggatcacttgagctggg

SEQ ID NO: 106910 - DNA, 20 bp, Artificial
  CRISPR gRNA sequence
atcacttgagctgggaggtc

SEQ ID NO: 106911 - DNA, 20 bp, Artificial
  CRISPR gRNA sequence
gagctgggaggtcaagacta

SEQ ID NO: 106912 - DNA, 20 bp, Artificial
  CRISPR gRNA sequence
tgggaggtcaagactaaagt

SEQ ID NO: 106913 - DNA, 20 bp, Artificial
  CRISPR gRNA sequence
cacaccactgcctccaaaaa

SEQ ID NO: 106914 - DNA, 20 bp, Artificial
  CRISPR gRNA sequence
cactgcctccaaaaaaagaa

SEQ ID NO: 106915 - DNA, 20 bp, Artificial
  CRISPR gRNA sequence
aaaaaaagaaaagatgttgt

SEQ ID NO: 106916 - DNA, 20 bp, Artificial
  CRISPR gRNA sequence
agatgttgtaagaacatact

SEQ ID NO: 106917 - DNA, 20 bp, Artificial
  CRISPR gRNA sequence
atgttgtaagaacatactga

SEQ ID NO: 106918 - DNA, 20 bp, Artificial
  CRISPR gRNA sequence
gttgtaagaacatactgaga

SEQ ID NO: 106919 - DNA, 20 bp, Artificial
  CRISPR gRNA sequence
gtaagaacatactgagagag

SEQ ID NO: 106920 - DNA, 20 bp, Artificial
  CRISPR gRNA sequence
aagaacatactgagagagaa

SEQ ID NO: 106921 - DNA, 20 bp, Artificial
  CRISPR gRNA sequence
gagagagaagagatctattc

SEQ ID NO: 106922 - DNA, 20 bp, Artificial
  CRISPR gRNA sequence
gagaagagatctattctaga

SEQ ID NO: 106923 - DNA, 20 bp, Artificial
  CRISPR gRNA sequence
agaagagatctattctagat

SEQ ID NO: 106924 - DNA, 20 bp, Artificial
  CRISPR gRNA sequence
gaagagatctattctagata

SEQ ID NO: 106925 - DNA, 20 bp, Artificial
  CRISPR gRNA sequence
atagggtatttaattaaacc

SEQ ID NO: 106926 - DNA, 20 bp, Artificial
  CRISPR gRNA sequence
ttaattaaacccagacctaa

SEQ ID NO: 106927 - DNA, 20 bp, Artificial
  CRISPR gRNA sequence
ttaaacccagacctaacaga

SEQ ID NO: 106928 - DNA, 20 bp, Artificial
  CRISPR gRNA sequence
taaacccagacctaacagat

SEQ ID NO: 106929 - DNA, 20 bp, Artificial
  CRISPR gRNA sequence
aaacccagacctaacagata

SEQ ID NO: 106930 - DNA, 20 bp, Artificial
  CRISPR gRNA sequence
acccagacctaacagatagg

SEQ ID NO: 106931 - DNA, 20 bp, Artificial
  CRISPR gRNA sequence
agacctaacagatagggaga

SEQ ID NO: 106932 - DNA, 20 bp, Artificial
  CRISPR gRNA sequence
ggagatagacatgcatgaaa

SEQ ID NO: 106933 - DNA, 20 bp, Artificial
  CRISPR gRNA sequence
agacatgcatgaaaaagata

SEQ ID NO: 106934 - DNA, 20 bp, Artificial
  CRISPR gRNA sequence
gacatgcatgaaaaagataa

SEQ ID NO: 106935 - DNA, 20 bp, Artificial
  CRISPR gRNA sequence
acatgcatgaaaaagataaa

SEQ ID NO: 106936 - DNA, 20 bp, Artificial
  CRISPR gRNA sequence
tgaaaaagataaagggcata

SEQ ID NO: 106937 - DNA, 20 bp, Artificial
  CRISPR gRNA sequence
gcatacagactgaaaattct

SEQ ID NO: 106938 - DNA, 20 bp, Artificial
  CRISPR gRNA sequence
catacagactgaaaattcta

SEQ ID NO: 106939 - DNA, 20 bp, Artificial
  CRISPR gRNA sequence
gactgaaaattctaaggaca

SEQ ID NO: 106940 - DNA, 20 bp, Artificial
  CRISPR gRNA sequence
attctaaggacaaagacccg

SEQ ID NO: 106941 - DNA, 20 bp, Artificial
  CRISPR gRNA sequence
ctaaggacaaagacccgtgg

SEQ ID NO: 106942 - DNA, 20 bp, Artificial
  CRISPR gRNA sequence
taaggacaaagacccgtggc

SEQ ID NO: 106943 - DNA, 20 bp, Artificial
  CRISPR gRNA sequence
ggacaaagacccgtggcagg

SEQ ID NO: 106944 - DNA, 20 bp, Artificial
  CRISPR gRNA sequence
caaagacccgtggcaggaag

SEQ ID NO: 106945 - DNA, 20 bp, Artificial
  CRISPR gRNA sequence
gcaggaagtagaccaatgaa

SEQ ID NO: 106946 - DNA, 20 bp, Artificial
  CRISPR gRNA sequence
gtagaccaatgaacagtaaa

SEQ ID NO: 106947 - DNA, 20 bp, Artificial
  CRISPR gRNA sequence
gaccaatgaacagtaaacag

SEQ ID NO: 106948 - DNA, 20 bp, Artificial
  CRISPR gRNA sequence
atgaacagtaaacagcagca

SEQ ID NO: 106949 - DNA, 20 bp, Artificial
  CRISPR gRNA sequence
gaacagtaaacagcagcata

SEQ ID NO: 106950 - DNA, 20 bp, Artificial
  CRISPR gRNA sequence
taaacagcagcatagagacc

SEQ ID NO: 106951 - DNA, 20 bp, Artificial
  CRISPR gRNA sequence
acagcagcatagagaccaag

SEQ ID NO: 106952 - DNA, 20 bp, Artificial
  CRISPR gRNA sequence
gcagcatagagaccaagaag

SEQ ID NO: 106953 - DNA, 20 bp, Artificial
  CRISPR gRNA sequence
gagaccaagaagtagaaatg

SEQ ID NO: 106954 - DNA, 20 bp, Artificial
  CRISPR gRNA sequence
ccaagaagtagaaatgcagt

SEQ ID NO: 106955 - DNA, 20 bp, Artificial
  CRISPR gRNA sequence
aagaagtagaaatgcagtta

SEQ ID NO: 106956 - DNA, 20 bp, Artificial
  CRISPR gRNA sequence
agaagtagaaatgcagttag

SEQ ID NO: 106957 - DNA, 20 bp, Artificial
  CRISPR gRNA sequence
agtagaaatgcagttagagg

SEQ ID NO: 106958 - DNA, 20 bp, Artificial
  CRISPR gRNA sequence
gaaatgcagttagaggtaga

SEQ ID NO: 106959 - DNA, 20 bp, Artificial
  CRISPR gRNA sequence
aaatgcagttagaggtagac

SEQ ID NO: 106960 - DNA, 20 bp, Artificial
  CRISPR gRNA sequence
atgcagttagaggtagacag

SEQ ID NO: 106961 - DNA, 20 bp, Artificial
  CRISPR gRNA sequence
agttagaggtagacaggagc

SEQ ID NO: 106962 - DNA, 20 bp, Artificial
  CRISPR gRNA sequence
ttagaggtagacaggagctg

SEQ ID NO: 106963 - DNA, 20 bp, Artificial
  CRISPR gRNA sequence
agacaggagctggagcatgt

SEQ ID NO: 106964 - DNA, 20 bp, Artificial
  CRISPR gRNA sequence
gacaggagctggagcatgta

SEQ ID NO: 106965 - DNA, 20 bp, Artificial
  CRISPR gRNA sequence
tggagcatgtaaggctttgc

SEQ ID NO: 106966 - DNA, 20 bp, Artificial
  CRISPR gRNA sequence
ggagcatgtaaggctttgct

SEQ ID NO: 106967 - DNA, 20 bp, Artificial
  CRISPR gRNA sequence
atgtaaggctttgctgggca

SEQ ID NO: 106968 - DNA, 20 bp, Artificial
  CRISPR gRNA sequence
taaggctttgctgggcatag

SEQ ID NO: 106969 - DNA, 20 bp, Artificial
  CRISPR gRNA sequence
gctttgctgggcatagtagt

SEQ ID NO: 106970 - DNA, 20 bp, Artificial
  CRISPR gRNA sequence
gggcatagtagtaagcactt

SEQ ID NO: 106971 - DNA, 20 bp, Artificial
  CRISPR gRNA sequence
gtagtaagcactttggatgt

SEQ ID NO: 106972 - DNA, 20 bp, Artificial
  CRISPR gRNA sequence
agcactttggatgtcagtct

SEQ ID NO: 106973 - DNA, 20 bp, Artificial
  CRISPR gRNA sequence
gatgtcagtctaagtgcaaa

SEQ ID NO: 106974 - DNA, 20 bp, Artificial
  CRISPR gRNA sequence
atgtcagtctaagtgcaaat

SEQ ID NO: 106975 - DNA, 20 bp, Artificial
  CRISPR gRNA sequence
cagtctaagtgcaaatggga

SEQ ID NO: 106976 - DNA, 20 bp, Artificial
  CRISPR gRNA sequence
agtctaagtgcaaatgggaa

SEQ ID NO: 106977 - DNA, 20 bp, Artificial
  CRISPR gRNA sequence
gtctaagtgcaaatgggaaa

SEQ ID NO: 106978 - DNA, 20 bp, Artificial
  CRISPR gRNA sequence
taagtgcaaatgggaaaggg

SEQ ID NO: 106979 - DNA, 20 bp, Artificial
  CRISPR gRNA sequence
aagtgcaaatgggaaagggt

SEQ ID NO: 106980 - DNA, 20 bp, Artificial
  CRISPR gRNA sequence
agtgcaaatgggaaagggta

SEQ ID NO: 106981 - DNA, 20 bp, Artificial
  CRISPR gRNA sequence
gtgcaaatgggaaagggtag

SEQ ID NO: 106982 - DNA, 20 bp, Artificial
  CRISPR gRNA sequence
atgggaaagggtaggggttg

SEQ ID NO: 106983 - DNA, 20 bp, Artificial
  CRISPR gRNA sequence
tgggaaagggtaggggttga

SEQ ID NO: 106984 - DNA, 20 bp, Artificial
  CRISPR gRNA sequence
ggaaagggtaggggttgaag

SEQ ID NO: 106985 - DNA, 20 bp, Artificial
  CRISPR gRNA sequence
ggtaggggttgaaggagctt

SEQ ID NO: 106986 - DNA, 20 bp, Artificial
  CRISPR gRNA sequence
aggggttgaaggagcttgag

SEQ ID NO: 106987 - DNA, 20 bp, Artificial
  CRISPR gRNA sequence
ttgaaggagcttgagcagaa

SEQ ID NO: 106988 - DNA, 20 bp, Artificial
  CRISPR gRNA sequence
tgaaggagcttgagcagaac

SEQ ID NO: 106989 - DNA, 20 bp, Artificial
  CRISPR gRNA sequence
gaaggagcttgagcagaaca

SEQ ID NO: 106990 - DNA, 20 bp, Artificial
  CRISPR gRNA sequence
tgagcagaacagggacttga

SEQ ID NO: 106991 - DNA, 20 bp, Artificial
  CRISPR gRNA sequence
gagcagaacagggacttgat

SEQ ID NO: 106992 - DNA, 20 bp, Artificial
  CRISPR gRNA sequence
gataggataaacattttaaa

SEQ ID NO: 106993 - DNA, 20 bp, Artificial
  CRISPR gRNA sequence
acattttaaaaagatcacac

SEQ ID NO: 106994 - DNA, 20 bp, Artificial
  CRISPR gRNA sequence
cattttaaaaagatcacact

SEQ ID NO: 106995 - DNA, 20 bp, Artificial
  CRISPR gRNA sequence
aaaaagatcacactaggatg

SEQ ID NO: 106996 - DNA, 20 bp, Artificial
  CRISPR gRNA sequence
aaagatcacactaggatgtg

SEQ ID NO: 106997 - DNA, 20 bp, Artificial
  CRISPR gRNA sequence
agatcacactaggatgtgga

SEQ ID NO: 106998 - DNA, 20 bp, Artificial
  CRISPR gRNA sequence
tcacactaggatgtggagag

SEQ ID NO: 106999 - DNA, 20 bp, Artificial
  CRISPR gRNA sequence
cacactaggatgtggagagt

SEQ ID NO: 107000 - DNA, 20 bp, Artificial
  CRISPR gRNA sequence
ctaggatgtggagagtaggc

SEQ ID NO: 107001 - DNA, 20 bp, Artificial
  CRISPR gRNA sequence
aggatgtggagagtaggcta

SEQ ID NO: 107002 - DNA, 20 bp, Artificial
  CRISPR gRNA sequence
ggatgtggagagtaggctag

SEQ ID NO: 107003 - DNA, 20 bp, Artificial
  CRISPR gRNA sequence
gatgtggagagtaggctaga

SEQ ID NO: 107004 - DNA, 20 bp, Artificial
  CRISPR gRNA sequence
atgtggagagtaggctagag

SEQ ID NO: 107005 - DNA, 20 bp, Artificial
  CRISPR gRNA sequence
agtaggctagaggggaacaa

SEQ ID NO: 107006 - DNA, 20 bp, Artificial
  CRISPR gRNA sequence
aggctagaggggaacaaaag

SEQ ID NO: 107007 - DNA, 20 bp, Artificial
  CRISPR gRNA sequence
ctagaggggaacaaaagtgg

SEQ ID NO: 107008 - DNA, 20 bp, Artificial
  CRISPR gRNA sequence
gaggggaacaaaagtggaag

SEQ ID NO: 107009 - DNA, 20 bp, Artificial
  CRISPR gRNA sequence
aggggaacaaaagtggaaga

SEQ ID NO: 107010 - DNA, 20 bp, Artificial
  CRISPR gRNA sequence
ggggaacaaaagtggaagaa

SEQ ID NO: 107011 - DNA, 20 bp, Artificial
  CRISPR gRNA sequence
ggaagaagggaaaccaaatt

SEQ ID NO: 107012 - DNA, 20 bp, Artificial
  CRISPR gRNA sequence
agaagggaaaccaaattaag

SEQ ID NO: 107013 - DNA, 20 bp, Artificial
  CRISPR gRNA sequence
agcagctattttataaatct

SEQ ID NO: 107014 - DNA, 20 bp, Artificial
  CRISPR gRNA sequence
tattttataaatctaagcca

SEQ ID NO: 107015 - DNA, 20 bp, Artificial
  CRISPR gRNA sequence
tttataaatctaagccaaag

SEQ ID NO: 107016 - DNA, 20 bp, Artificial
  CRISPR gRNA sequence
tataaatctaagccaaagaa

SEQ ID NO: 107017 - DNA, 20 bp, Artificial
  CRISPR gRNA sequence
taaatctaagccaaagaaga

SEQ ID NO: 107018 - DNA, 20 bp, Artificial
  CRISPR gRNA sequence
aaatctaagccaaagaagag

SEQ ID NO: 107019 - DNA, 20 bp, Artificial
  CRISPR gRNA sequence
taagccaaagaagagaggat

SEQ ID NO: 107020 - DNA, 20 bp, Artificial
  CRISPR gRNA sequence
caaagaagagaggattagac

SEQ ID NO: 107021 - DNA, 20 bp, Artificial
  CRISPR gRNA sequence
aaagaagagaggattagacc

SEQ ID NO: 107022 - DNA, 20 bp, Artificial
  CRISPR gRNA sequence
ggattagaccaggctcacat

SEQ ID NO: 107023 - DNA, 20 bp, Artificial
  CRISPR gRNA sequence
tagaccaggctcacatcagt

SEQ ID NO: 107024 - DNA, 20 bp, Artificial
  CRISPR gRNA sequence
accaggctcacatcagttag

SEQ ID NO: 107025 - DNA, 20 bp, Artificial
  CRISPR gRNA sequence
ccaggctcacatcagttaga

SEQ ID NO: 107026 - DNA, 20 bp, Artificial
  CRISPR gRNA sequence
caggctcacatcagttagaa

SEQ ID NO: 107027 - DNA, 20 bp, Artificial
  CRISPR gRNA sequence
acatcagttagaagggaaaa

SEQ ID NO: 107028 - DNA, 20 bp, Artificial
  CRISPR gRNA sequence
cattcaaattatatttgtga

SEQ ID NO: 107029 - DNA, 20 bp, Artificial
  CRISPR gRNA sequence
attcaaattatatttgtgat

SEQ ID NO: 107030 - DNA, 20 bp, Artificial
  CRISPR gRNA sequence
ttcaaattatatttgtgatg

SEQ ID NO: 107031 - DNA, 20 bp, Artificial
  CRISPR gRNA sequence
aaacttgttccttgaaaatt

SEQ ID NO: 107032 - DNA, 20 bp, Artificial
  CRISPR gRNA sequence
tgttccttgaaaattaagaa

SEQ ID NO: 107033 - DNA, 20 bp, Artificial
  CRISPR gRNA sequence
ttaagaaaagtgtgattttc

SEQ ID NO: 107034 - DNA, 20 bp, Artificial
  CRISPR gRNA sequence
gaaaagtgtgattttcaaga

SEQ ID NO: 107035 - DNA, 20 bp, Artificial
  CRISPR gRNA sequence
gattttcaagaaagaatgaa

SEQ ID NO: 107036 - DNA, 20 bp, Artificial
  CRISPR gRNA sequence
aagaaagaatgaatagtaat

SEQ ID NO: 107037 - DNA, 20 bp, Artificial
  CRISPR gRNA sequence
atgaatagtaataagtgaca

SEQ ID NO: 107038 - DNA, 20 bp, Artificial
  CRISPR gRNA sequence
agtaataagtgacaaagacg

SEQ ID NO: 107039 - DNA, 20 bp, Artificial
  CRISPR gRNA sequence
taataagtgacaaagacgaa

SEQ ID NO: 107040 - DNA, 20 bp, Artificial
  CRISPR gRNA sequence
gaagagcatctcaaccctcc

SEQ ID NO: 107041 - DNA, 20 bp, Artificial
  CRISPR gRNA sequence
gagcatctcaaccctccaag

SEQ ID NO: 107042 - DNA, 20 bp, Artificial
  CRISPR gRNA sequence
atctcaaccctccaagtagc

SEQ ID NO: 107043 - DNA, 20 bp, Artificial
  CRISPR gRNA sequence
tctcaaccctccaagtagct

SEQ ID NO: 107044 - DNA, 20 bp, Artificial
  CRISPR gRNA sequence
cctccaagtagctgggacta

SEQ ID NO: 107045 - DNA, 20 bp, Artificial
  CRISPR gRNA sequence
ctccaagtagctgggactac

SEQ ID NO: 107046 - DNA, 20 bp, Artificial
  CRISPR gRNA sequence
ggactacaggcatgcatcac

SEQ ID NO: 107047 - DNA, 20 bp, Artificial
  CRISPR gRNA sequence
gactacaggcatgcatcacc

SEQ ID NO: 107048 - DNA, 20 bp, Artificial
  CRISPR gRNA sequence
caggcatgcatcaccaggcc

SEQ ID NO: 107049 - DNA, 20 bp, Artificial
  CRISPR gRNA sequence
catgcatcaccaggcctggc

SEQ ID NO: 107050 - DNA, 20 bp, Artificial
  CRISPR gRNA sequence
ctagtttttgtatttttttg

SEQ ID NO: 107051 - DNA, 20 bp, Artificial
  CRISPR gRNA sequence
agtttttgtatttttttgta

SEQ ID NO: 107052 - DNA, 20 bp, Artificial
  CRISPR gRNA sequence
tttgtatttttttgtagaga

SEQ ID NO: 107053 - DNA, 20 bp, Artificial
  CRISPR gRNA sequence
tgtatttttttgtagagatg

SEQ ID NO: 107054 - DNA, 20 bp, Artificial
  CRISPR gRNA sequence
tggagttttgccatgttgcc

SEQ ID NO: 107055 - DNA, 20 bp, Artificial
  CRISPR gRNA sequence
ggagttttgccatgttgccc

SEQ ID NO: 107056 - DNA, 20 bp, Artificial
  CRISPR gRNA sequence
ttttgccatgttgcccaggc

SEQ ID NO: 107057 - DNA, 20 bp, Artificial
  CRISPR gRNA sequence
ccaggctggtcttgaaatcc

SEQ ID NO: 107058 - DNA, 20 bp, Artificial
  CRISPR gRNA sequence
caggctggtcttgaaatcct

SEQ ID NO: 107059 - DNA, 20 bp, Artificial
  CRISPR gRNA sequence
aaatcctgggcttcccacct

SEQ ID NO: 107060 - DNA, 20 bp, Artificial
  CRISPR gRNA sequence
cttcccacctcagcctccca

SEQ ID NO: 107061 - DNA, 20 bp, Artificial
  CRISPR gRNA sequence
acctcagcctcccaaagtgt

SEQ ID NO: 107062 - DNA, 20 bp, Artificial
  CRISPR gRNA sequence
cctcagcctcccaaagtgtt

SEQ ID NO: 107063 - DNA, 20 bp, Artificial
  CRISPR gRNA sequence
ctcccaaagtgttgggatta

SEQ ID NO: 107064 - DNA, 20 bp, Artificial
  CRISPR gRNA sequence
tcccaaagtgttgggattac

SEQ ID NO: 107065 - DNA, 20 bp, Artificial
  CRISPR gRNA sequence
agtgttgggattacaggcat

SEQ ID NO: 107066 - DNA, 20 bp, Artificial
  CRISPR gRNA sequence
gattacaggcatgagccacc

SEQ ID NO: 107067 - DNA, 20 bp, Artificial
  CRISPR gRNA sequence
caggcatgagccaccaagtc

SEQ ID NO: 107068 - DNA, 20 bp, Artificial
  CRISPR gRNA sequence
atgagccaccaagtctggcc

SEQ ID NO: 107069 - DNA, 20 bp, Artificial
  CRISPR gRNA sequence
agccaccaagtctggcctag

SEQ ID NO: 107070 - DNA, 20 bp, Artificial
  CRISPR gRNA sequence
aagtctggcctagtggtttt

SEQ ID NO: 107071 - DNA, 20 bp, Artificial
  CRISPR gRNA sequence
gcctagtggttttaagataa

SEQ ID NO: 107072 - DNA, 20 bp, Artificial
  CRISPR gRNA sequence
ttaagataaaagataatcta

SEQ ID NO: 107073 - DNA, 20 bp, Artificial
  CRISPR gRNA sequence
aagataaaagataatctaaa

SEQ ID NO: 107074 - DNA, 20 bp, Artificial
  CRISPR gRNA sequence
aagataatctaaagagacat

SEQ ID NO: 107075 - DNA, 20 bp, Artificial
  CRISPR gRNA sequence
aagagacataagattgcatc

SEQ ID NO: 107076 - DNA, 20 bp, Artificial
  CRISPR gRNA sequence
acataagattgcatccagtt

SEQ ID NO: 107077 - DNA, 20 bp, Artificial
  CRISPR gRNA sequence
ataagattgcatccagttta

SEQ ID NO: 107078 - DNA, 20 bp, Artificial
  CRISPR gRNA sequence
gcatccagtttagagaatgt

SEQ ID NO: 107079 - DNA, 20 bp, Artificial
  CRISPR gRNA sequence
tccagtttagagaatgtgag

SEQ ID NO: 107080 - DNA, 20 bp, Artificial
  CRISPR gRNA sequence
ttagagaatgtgagtagtcc

SEQ ID NO: 107081 - DNA, 20 bp, Artificial
  CRISPR gRNA sequence
agagaatgtgagtagtccca

SEQ ID NO: 107082 - DNA, 20 bp, Artificial
  CRISPR gRNA sequence
gaatgtgagtagtcccagag

SEQ ID NO: 107083 - DNA, 20 bp, Artificial
  CRISPR gRNA sequence
aatgtgagtagtcccagagt

SEQ ID NO: 107084 - DNA, 20 bp, Artificial
  CRISPR gRNA sequence
gtagtcccagagtaggaaaa

SEQ ID NO: 107085 - DNA, 20 bp, Artificial
  CRISPR gRNA sequence
tcccagagtaggaaaatagc

SEQ ID NO: 107086 - DNA, 20 bp, Artificial
  CRISPR gRNA sequence
ccagagtaggaaaatagcaa

SEQ ID NO: 107087 - DNA, 20 bp, Artificial
  CRISPR gRNA sequence
cagagtaggaaaatagcaag

SEQ ID NO: 107088 - DNA, 20 bp, Artificial
  CRISPR gRNA sequence
atagcaagaggacactgctg

SEQ ID NO: 107089 - DNA, 20 bp, Artificial
  CRISPR gRNA sequence
tagcaagaggacactgctga

SEQ ID NO: 107090 - DNA, 20 bp, Artificial
  CRISPR gRNA sequence
actgctgaaggcttcaactc

SEQ ID NO: 107091 - DNA, 20 bp, Artificial
  CRISPR gRNA sequence
gcttcaactcaagtcaatac

SEQ ID NO: 107092 - DNA, 20 bp, Artificial
  CRISPR gRNA sequence
cttcaactcaagtcaataca

SEQ ID NO: 107093 - DNA, 20 bp, Artificial
  CRISPR gRNA sequence
caagtcaatacaaggtaata

SEQ ID NO: 107094 - DNA, 20 bp, Artificial
  CRISPR gRNA sequence
agtcaatacaaggtaataaa

SEQ ID NO: 107095 - DNA, 20 bp, Artificial
  CRISPR gRNA sequence
caatacaaggtaataaagag

SEQ ID NO: 107096 - DNA, 20 bp, Artificial
  CRISPR gRNA sequence
tatgtcttcctacctgcata

SEQ ID NO: 107097 - DNA, 20 bp, Artificial
  CRISPR gRNA sequence
atgtcttcctacctgcatat

SEQ ID NO: 107098 - DNA, 20 bp, Artificial
  CRISPR gRNA sequence
tgtcttcctacctgcatatg

SEQ ID NO: 107099 - DNA, 20 bp, Artificial
  CRISPR gRNA sequence
tggggactatccttttcctt

SEQ ID NO: 107100 - DNA, 20 bp, Artificial
  CRISPR gRNA sequence
gggactatccttttcctttg

SEQ ID NO: 107101 - DNA, 20 bp, Artificial
  CRISPR gRNA sequence
gactatccttttcctttgga

SEQ ID NO: 107102 - DNA, 20 bp, Artificial
  CRISPR gRNA sequence
ttcaccacgcttccgtgcca

SEQ ID NO: 107103 - DNA, 20 bp, Artificial
  CRISPR gRNA sequence
gcttccgtgccatggcatga

SEQ ID NO: 107104 - DNA, 20 bp, Artificial
  CRISPR gRNA sequence
tgccatggcatgacggtgcc

SEQ ID NO: 107105 - DNA, 20 bp, Artificial
  CRISPR gRNA sequence
tgacggtgccgagactcatg

SEQ ID NO: 107106 - DNA, 20 bp, Artificial
  CRISPR gRNA sequence
gacggtgccgagactcatgc

SEQ ID NO: 107107 - DNA, 20 bp, Artificial
  CRISPR gRNA sequence
catgcaggtatttctaaaac

SEQ ID NO: 107108 - DNA, 20 bp, Artificial
  CRISPR gRNA sequence
atttaactattaatactatc

SEQ ID NO: 107109 - DNA, 20 bp, Artificial
  CRISPR gRNA sequence
ctattaatactatccagaac

SEQ ID NO: 107110 - DNA, 20 bp, Artificial
  CRISPR gRNA sequence
aatactatccagaaccagca

SEQ ID NO: 107111 - DNA, 20 bp, Artificial
  CRISPR gRNA sequence
ccagaaccagcacagttatc

SEQ ID NO: 107112 - DNA, 20 bp, Artificial
  CRISPR gRNA sequence
tgcacaaattccattctcca

SEQ ID NO: 107113 - DNA, 20 bp, Artificial
  CRISPR gRNA sequence
aattccattctccaaagttt

SEQ ID NO: 107114 - DNA, 20 bp, Artificial
  CRISPR gRNA sequence
ccattctccaaagtttaaga

SEQ ID NO: 107115 - DNA, 20 bp, Artificial
  CRISPR gRNA sequence
tctccaaagtttaagacagc

SEQ ID NO: 107116 - DNA, 20 bp, Artificial
  CRISPR gRNA sequence
ctccaaagtttaagacagct

SEQ ID NO: 107117 - DNA, 20 bp, Artificial
  CRISPR gRNA sequence
gtttaagacagctgggatca

SEQ ID NO: 107118 - DNA, 20 bp, Artificial
  CRISPR gRNA sequence
acagctgggatcaaagtcac

SEQ ID NO: 107119 - DNA, 20 bp, Artificial
  CRISPR gRNA sequence
cagctgggatcaaagtcaca

SEQ ID NO: 107120 - DNA, 20 bp, Artificial
  CRISPR gRNA sequence
agctgggatcaaagtcacaa

SEQ ID NO: 107121 - DNA, 20 bp, Artificial
  CRISPR gRNA sequence
cacaagggacaattatgact

SEQ ID NO: 107122 - DNA, 20 bp, Artificial
  CRISPR gRNA sequence
attatgacttagaatgacga

SEQ ID NO: 107123 - DNA, 20 bp, Artificial
  CRISPR gRNA sequence
atgacttagaatgacgatgg

SEQ ID NO: 107124 - DNA, 20 bp, Artificial
  CRISPR gRNA sequence
tagaatgacgatggaagctt

SEQ ID NO: 107125 - DNA, 20 bp, Artificial
  CRISPR gRNA sequence
gaatgacgatggaagctttg

SEQ ID NO: 107126 - DNA, 20 bp, Artificial
  CRISPR gRNA sequence
gaagctttggagaaaacacc

SEQ ID NO: 107127 - DNA, 20 bp, Artificial
  CRISPR gRNA sequence
ctttggagaaaacacctagt

SEQ ID NO: 107128 - DNA, 20 bp, Artificial
  CRISPR gRNA sequence
aaaacacctagtaagtaata

SEQ ID NO: 107129 - DNA, 20 bp, Artificial
  CRISPR gRNA sequence
taaccatatataactactgt

SEQ ID NO: 107130 - DNA, 20 bp, Artificial
  CRISPR gRNA sequence
tgtaagactgtgaatgctta

SEQ ID NO: 107131 - DNA, 20 bp, Artificial
  CRISPR gRNA sequence
attttttttaaaaaaaataa

SEQ ID NO: 107132 - DNA, 20 bp, Artificial
  CRISPR gRNA sequence
actttcctctgctttaataa

SEQ ID NO: 107133 - DNA, 20 bp, Artificial
  CRISPR gRNA sequence
ctttcctctgctttaataac

SEQ ID NO: 107134 - DNA, 20 bp, Artificial
  CRISPR gRNA sequence
taacaggccaaatttcgttt

SEQ ID NO: 107135 - DNA, 20 bp, Artificial
  CRISPR gRNA sequence
caaatttcgtttgagcaaat

SEQ ID NO: 107136 - DNA, 20 bp, Artificial
  CRISPR gRNA sequence
cgtttgagcaaatgagtgtt

SEQ ID NO: 107137 - DNA, 20 bp, Artificial
  CRISPR gRNA sequence
gcaaatgagtgttcagtaaa

SEQ ID NO: 107138 - DNA, 20 bp, Artificial
  CRISPR gRNA sequence
gttcagtaaaaagactttcc

SEQ ID NO: 107139 - DNA, 20 bp, Artificial
  CRISPR gRNA sequence
aaaagactttcctagcatta

SEQ ID NO: 107140 - DNA, 20 bp, Artificial
  CRISPR gRNA sequence
agtttattattattattttc

SEQ ID NO: 107141 - DNA, 20 bp, Artificial
  CRISPR gRNA sequence
ttattattattttctagaaa

SEQ ID NO: 107142 - DNA, 20 bp, Artificial
  CRISPR gRNA sequence
tattattattttctagaaac

SEQ ID NO: 107143 - DNA, 20 bp, Artificial
  CRISPR gRNA sequence
attattattttctagaaaca

SEQ ID NO: 107144 - DNA, 20 bp, Artificial
  CRISPR gRNA sequence
cactctgacacccttgctgt

SEQ ID NO: 107145 - DNA, 20 bp, Artificial
  CRISPR gRNA sequence
acacccttgctgttggactg

SEQ ID NO: 107146 - DNA, 20 bp, Artificial
  CRISPR gRNA sequence
cccttgctgttggactgcag

SEQ ID NO: 107147 - DNA, 20 bp, Artificial
  CRISPR gRNA sequence
ggcatgatcatgaatcactg

SEQ ID NO: 107148 - DNA, 20 bp, Artificial
  CRISPR gRNA sequence
cactgcagccttgaattcct

SEQ ID NO: 107149 - DNA, 20 bp, Artificial
  CRISPR gRNA sequence
tcctcctgcctctgccttcc

SEQ ID NO: 107150 - DNA, 20 bp, Artificial
  CRISPR gRNA sequence
tcctgcctctgccttccaag

SEQ ID NO: 107151 - DNA, 20 bp, Artificial
  CRISPR gRNA sequence
cctgcctctgccttccaagt

SEQ ID NO: 107152 - DNA, 20 bp, Artificial
  CRISPR gRNA sequence
ctgccttccaagtaggacta

SEQ ID NO: 107153 - DNA, 20 bp, Artificial
  CRISPR gRNA sequence
tgccttccaagtaggactac

SEQ ID NO: 107154 - DNA, 20 bp, Artificial
  CRISPR gRNA sequence
acaggcatttgccaccacac

SEQ ID NO: 107155 - DNA, 20 bp, Artificial
  CRISPR gRNA sequence
caggcatttgccaccacacc

SEQ ID NO: 107156 - DNA, 20 bp, Artificial
  CRISPR gRNA sequence
catttgccaccacaccaggc

SEQ ID NO: 107157 - DNA, 20 bp, Artificial
  CRISPR gRNA sequence
cacaccaggctggactttcc

SEQ ID NO: 107158 - DNA, 20 bp, Artificial
  CRISPR gRNA sequence
tcctagccttatctgcatgt

SEQ ID NO: 107159 - DNA, 20 bp, Artificial
  CRISPR gRNA sequence
cctagccttatctgcatgtt

SEQ ID NO: 107160 - DNA, 20 bp, Artificial
  CRISPR gRNA sequence
atctgcatgttaggtgtgat

SEQ ID NO: 107161 - DNA, 20 bp, Artificial
  CRISPR gRNA sequence
tctgcatgttaggtgtgatc

SEQ ID NO: 107162 - DNA, 20 bp, Artificial
  CRISPR gRNA sequence
gtgatcaggtaactaaattc

SEQ ID NO: 107163 - DNA, 20 bp, Artificial
  CRISPR gRNA sequence
tcaggtaactaaattccggc

SEQ ID NO: 107164 - DNA, 20 bp, Artificial
  CRISPR gRNA sequence
ggtaactaaattccggctag

SEQ ID NO: 107165 - DNA, 20 bp, Artificial
  CRISPR gRNA sequence
aactaaattccggctagtgg

SEQ ID NO: 107166 - DNA, 20 bp, Artificial
  CRISPR gRNA sequence
actaaattccggctagtgga

SEQ ID NO: 107167 - DNA, 20 bp, Artificial
  CRISPR gRNA sequence
gaaggtacacaacttcttca

SEQ ID NO: 107168 - DNA, 20 bp, Artificial
  CRISPR gRNA sequence
cttcttcaaagtttccttga

SEQ ID NO: 107169 - DNA, 20 bp, Artificial
  CRISPR gRNA sequence
ttcaaagtttccttgaaaga

SEQ ID NO: 107170 - DNA, 20 bp, Artificial
  CRISPR gRNA sequence
tcaaagtttccttgaaagaa

SEQ ID NO: 107171 - DNA, 20 bp, Artificial
  CRISPR gRNA sequence
caaagtttccttgaaagaaa

SEQ ID NO: 107172 - DNA, 20 bp, Artificial
  CRISPR gRNA sequence
tccttgaaagaaagggtacc

SEQ ID NO: 107173 - DNA, 20 bp, Artificial
  CRISPR gRNA sequence
tgaaagaaagggtacctggc

SEQ ID NO: 107174 - DNA, 20 bp, Artificial
  CRISPR gRNA sequence
gaaagaaagggtacctggcc

SEQ ID NO: 107175 - DNA, 20 bp, Artificial
  CRISPR gRNA sequence
aaagggtacctggccgggta

SEQ ID NO: 107176 - DNA, 20 bp, Artificial
  CRISPR gRNA sequence
gggtacctggccgggtatgg

SEQ ID NO: 107177 - DNA, 20 bp, Artificial
  CRISPR gRNA sequence
gtggctcacgcctataatcc

SEQ ID NO: 107178 - DNA, 20 bp, Artificial
  CRISPR gRNA sequence
cgcctataatcccggcactt

SEQ ID NO: 107179 - DNA, 20 bp, Artificial
  CRISPR gRNA sequence
gcctataatcccggcacttt

SEQ ID NO: 107180 - DNA, 20 bp, Artificial
  CRISPR gRNA sequence
ctataatcccggcactttgg

SEQ ID NO: 107181 - DNA, 20 bp, Artificial
  CRISPR gRNA sequence
tataatcccggcactttggg

SEQ ID NO: 107182 - DNA, 20 bp, Artificial
  CRISPR gRNA sequence
tcccggcactttgggaggcc

SEQ ID NO: 107183 - DNA, 20 bp, Artificial
  CRISPR gRNA sequence
cccggcactttgggaggccc

SEQ ID NO: 107184 - DNA, 20 bp, Artificial
  CRISPR gRNA sequence
ggcactttgggaggcccagg

SEQ ID NO: 107185 - DNA, 20 bp, Artificial
  CRISPR gRNA sequence
gcactttgggaggcccaggc

SEQ ID NO: 107186 - DNA, 20 bp, Artificial
  CRISPR gRNA sequence
ctttgggaggcccaggcagg

SEQ ID NO: 107187 - DNA, 20 bp, Artificial
  CRISPR gRNA sequence
cccaggcaggtggatcacct

SEQ ID NO: 107188 - DNA, 20 bp, Artificial
  CRISPR gRNA sequence
ccaggcaggtggatcacctg

SEQ ID NO: 107189 - DNA, 20 bp, Artificial
  CRISPR gRNA sequence
gcaggtggatcacctgaggt

SEQ ID NO: 107190 - DNA, 20 bp, Artificial
  CRISPR gRNA sequence
caggtggatcacctgaggtc

SEQ ID NO: 107191 - DNA, 20 bp, Artificial
  CRISPR gRNA sequence
ggtggatcacctgaggtcag

SEQ ID NO: 107192 - DNA, 20 bp, Artificial
  CRISPR gRNA sequence
tcacctgaggtcaggagttc

SEQ ID NO: 107193 - DNA, 20 bp, Artificial
  CRISPR gRNA sequence
tgaggtcaggagttcgagac

SEQ ID NO: 107194 - DNA, 20 bp, Artificial
  CRISPR gRNA sequence
tcaggagttcgagaccagcc

SEQ ID NO: 107195 - DNA, 20 bp, Artificial
  CRISPR gRNA sequence
cgagaccagcctggccaaca

SEQ ID NO: 107196 - DNA, 20 bp, Artificial
  CRISPR gRNA sequence
tctactaaaaacacaaaaat

SEQ ID NO: 107197 - DNA, 20 bp, Artificial
  CRISPR gRNA sequence
ctaaaaacacaaaaataagc

SEQ ID NO: 107198 - DNA, 20 bp, Artificial
  CRISPR gRNA sequence
taaaaacacaaaaataagct

SEQ ID NO: 107199 - DNA, 20 bp, Artificial
  CRISPR gRNA sequence
acacaaaaataagctgggcg

SEQ ID NO: 107200 - DNA, 20 bp, Artificial
  CRISPR gRNA sequence
caaaaataagctgggcgtgg

SEQ ID NO: 107201 - DNA, 20 bp, Artificial
  CRISPR gRNA sequence
gtggcgcacacctgtaatcc

SEQ ID NO: 107202 - DNA, 20 bp, Artificial
  CRISPR gRNA sequence
cacctgtaatcccagctact

SEQ ID NO: 107203 - DNA, 20 bp, Artificial
  CRISPR gRNA sequence
acctgtaatcccagctactc

SEQ ID NO: 107204 - DNA, 20 bp, Artificial
  CRISPR gRNA sequence
ctgtaatcccagctactcag

SEQ ID NO: 107205 - DNA, 20 bp, Artificial
  CRISPR gRNA sequence
tgtaatcccagctactcagg

SEQ ID NO: 107206 - DNA, 20 bp, Artificial
  CRISPR gRNA sequence
tcccagctactcaggaggct

SEQ ID NO: 107207 - DNA, 20 bp, Artificial
  CRISPR gRNA sequence
cccagctactcaggaggctg

SEQ ID NO: 107208 - DNA, 20 bp, Artificial
  CRISPR gRNA sequence
agctactcaggaggctgagg

SEQ ID NO: 107209 - DNA, 20 bp, Artificial
  CRISPR gRNA sequence
gctactcaggaggctgaggc

SEQ ID NO: 107210 - DNA, 20 bp, Artificial
  CRISPR gRNA sequence
tactcaggaggctgaggcag

SEQ ID NO: 107211 - DNA, 20 bp, Artificial
  CRISPR gRNA sequence
gcaggagaatcacttgaaca

SEQ ID NO: 107212 - DNA, 20 bp, Artificial
  CRISPR gRNA sequence
ggagaatcacttgaacatgg

SEQ ID NO: 107213 - DNA, 20 bp, Artificial
  CRISPR gRNA sequence
gagaatcacttgaacatgga

SEQ ID NO: 107214 - DNA, 20 bp, Artificial
  CRISPR gRNA sequence
tcacttgaacatggaaggtg

SEQ ID NO: 107215 - DNA, 20 bp, Artificial
  CRISPR gRNA sequence
cacttgaacatggaaggtgc

SEQ ID NO: 107216 - DNA, 20 bp, Artificial
  CRISPR gRNA sequence
aacatggaaggtgcaggttg

SEQ ID NO: 107217 - DNA, 20 bp, Artificial
  CRISPR gRNA sequence
tggaaggtgcaggttgcagt

SEQ ID NO: 107218 - DNA, 20 bp, Artificial
  CRISPR gRNA sequence
ggtgcaggttgcagtgagct

SEQ ID NO: 107219 - DNA, 20 bp, Artificial
  CRISPR gRNA sequence
gagattgtgccactgcactc

SEQ ID NO: 107220 - DNA, 20 bp, Artificial
  CRISPR gRNA sequence
tgtgccactgcactccggcc

SEQ ID NO: 107221 - DNA, 20 bp, Artificial
  CRISPR gRNA sequence
ctgcactccggcctggatga

SEQ ID NO: 107222 - DNA, 20 bp, Artificial
  CRISPR gRNA sequence
gcactccggcctggatgaca

SEQ ID NO: 107223 - DNA, 20 bp, Artificial
  CRISPR gRNA sequence
tccggcctggatgacagagc

SEQ ID NO: 107224 - DNA, 20 bp, Artificial
  CRISPR gRNA sequence
ctggatgacagagcaagact

SEQ ID NO: 107225 - DNA, 20 bp, Artificial
  CRISPR gRNA sequence
gacagagcaagactgagtct

SEQ ID NO: 107226 - DNA, 20 bp, Artificial
  CRISPR gRNA sequence
acagagcaagactgagtctc

SEQ ID NO: 107227 - DNA, 20 bp, Artificial
  CRISPR gRNA sequence
gtctcaggaaaaaaaaaaaa

SEQ ID NO: 107228 - DNA, 20 bp, Artificial
  CRISPR gRNA sequence
caggaaaaaaaaaaaaaaga

SEQ ID NO: 107229 - DNA, 20 bp, Artificial
  CRISPR gRNA sequence
aggaaaaaaaaaaaaaagaa

SEQ ID NO: 107230 - DNA, 20 bp, Artificial
  CRISPR gRNA sequence
ggaaaaaaaaaaaaaagaaa

SEQ ID NO: 107231 - DNA, 20 bp, Artificial
  CRISPR gRNA sequence
tttcttgttccctttcttcc

SEQ ID NO: 107232 - DNA, 20 bp, Artificial
  CRISPR gRNA sequence
ttcttgttccctttcttcct

SEQ ID NO: 107233 - DNA, 20 bp, Artificial
  CRISPR gRNA sequence
tgttccctttcttcctaggc

SEQ ID NO: 107234 - DNA, 20 bp, Artificial
  CRISPR gRNA sequence
ttccctttcttcctaggctg

SEQ ID NO: 107235 - DNA, 20 bp, Artificial
  CRISPR gRNA sequence
ttcttcctaggctggagcct

SEQ ID NO: 107236 - DNA, 20 bp, Artificial
  CRISPR gRNA sequence
ttcctaggctggagcctaag

SEQ ID NO: 107237 - DNA, 20 bp, Artificial
  CRISPR gRNA sequence
tcctaggctggagcctaagc

SEQ ID NO: 107238 - DNA, 20 bp, Artificial
  CRISPR gRNA sequence
tggagcctaagcaggaatct

SEQ ID NO: 107239 - DNA, 20 bp, Artificial
  CRISPR gRNA sequence
caggaatcttggaccatgaa

SEQ ID NO: 107240 - DNA, 20 bp, Artificial
  CRISPR gRNA sequence
ttggaccatgaacagcacac

SEQ ID NO: 107241 - DNA, 20 bp, Artificial
  CRISPR gRNA sequence
acagcacactagcaatatta

SEQ ID NO: 107242 - DNA, 20 bp, Artificial
  CRISPR gRNA sequence
gcacactagcaatattaaag

SEQ ID NO: 107243 - DNA, 20 bp, Artificial
  CRISPR gRNA sequence
gcaatattaaagcagtgaaa

SEQ ID NO: 107244 - DNA, 20 bp, Artificial
  CRISPR gRNA sequence
caatattaaagcagtgaaac

SEQ ID NO: 107245 - DNA, 20 bp, Artificial
  CRISPR gRNA sequence
aaagcagtgaaacaggtctt

SEQ ID NO: 107246 - DNA, 20 bp, Artificial
  CRISPR gRNA sequence
gaactgtgaaaatgtgctac

SEQ ID NO: 107247 - DNA, 20 bp, Artificial
  CRISPR gRNA sequence
gtgaaaatgtgctaccagtc

SEQ ID NO: 107248 - DNA, 20 bp, Artificial
  CRISPR gRNA sequence
tgaaaatgtgctaccagtcc

SEQ ID NO: 107249 - DNA, 20 bp, Artificial
  CRISPR gRNA sequence
agtccaggataatttatctc

SEQ ID NO: 107250 - DNA, 20 bp, Artificial
  CRISPR gRNA sequence
ggactacttttatgtatgaa

SEQ ID NO: 107251 - DNA, 20 bp, Artificial
  CRISPR gRNA sequence
gactacttttatgtatgaaa

SEQ ID NO: 107252 - DNA, 20 bp, Artificial
  CRISPR gRNA sequence
aaaggaataacatcttattt

SEQ ID NO: 107253 - DNA, 20 bp, Artificial
  CRISPR gRNA sequence
tgttttcgttattataactg

SEQ ID NO: 107254 - DNA, 20 bp, Artificial
  CRISPR gRNA sequence
ttataactgcagctgcatat

SEQ ID NO: 107255 - DNA, 20 bp, Artificial
  CRISPR gRNA sequence
acaaatgctaactcttacaa

SEQ ID NO: 107256 - DNA, 20 bp, Artificial
  CRISPR gRNA sequence
aaatgctaactcttacaaaa

SEQ ID NO: 107257 - DNA, 20 bp, Artificial
  CRISPR gRNA sequence
actcttacaaaagagacaac

SEQ ID NO: 107258 - DNA, 20 bp, Artificial
  CRISPR gRNA sequence
agtatctaacgtcaattgtt

SEQ ID NO: 107259 - DNA, 20 bp, Artificial
  CRISPR gRNA sequence
atctaacgtcaattgtttgg

SEQ ID NO: 107260 - DNA, 20 bp, Artificial
  CRISPR gRNA sequence
tctaacgtcaattgtttgga

SEQ ID NO: 107261 - DNA, 20 bp, Artificial
  CRISPR gRNA sequence
caattgtttggaaggtacgt

SEQ ID NO: 107262 - DNA, 20 bp, Artificial
  CRISPR gRNA sequence
tggaaggtacgtgagaaaac

SEQ ID NO: 107263 - DNA, 20 bp, Artificial
  CRISPR gRNA sequence
tgagaaaacaagccatataa

SEQ ID NO: 107264 - DNA, 20 bp, Artificial
  CRISPR gRNA sequence
catataaaagataatttcaa

SEQ ID NO: 107265 - DNA, 20 bp, Artificial
  CRISPR gRNA sequence
ataaaagataatttcaaaag

SEQ ID NO: 107266 - DNA, 20 bp, Artificial
  CRISPR gRNA sequence
atacatacccttctctcctt

SEQ ID NO: 107267 - DNA, 20 bp, Artificial
  CRISPR gRNA sequence
ggaattttcccttctgcctc

SEQ ID NO: 107268 - DNA, 20 bp, Artificial
  CRISPR gRNA sequence
tttcccttctgcctctagtt

SEQ ID NO: 107269 - DNA, 20 bp, Artificial
  CRISPR gRNA sequence
cttctgcctctagtttagct

SEQ ID NO: 107270 - DNA, 20 bp, Artificial
  CRISPR gRNA sequence
ttctgcctctagtttagctc

SEQ ID NO: 107271 - DNA, 20 bp, Artificial
  CRISPR gRNA sequence
gctcgggcttgcctcctctt

SEQ ID NO: 107272 - DNA, 20 bp, Artificial
  CRISPR gRNA sequence
cttgcctcctcttaagaata

SEQ ID NO: 107273 - DNA, 20 bp, Artificial
  CRISPR gRNA sequence
gcctcctcttaagaatacgg

SEQ ID NO: 107274 - DNA, 20 bp, Artificial
  CRISPR gRNA sequence
aagaatacggtggtattgtt

SEQ ID NO: 107275 - DNA, 20 bp, Artificial
  CRISPR gRNA sequence
ggtattgtttggcattcacg

SEQ ID NO: 107276 - DNA, 20 bp, Artificial
  CRISPR gRNA sequence
tattgtttggcattcacgta

SEQ ID NO: 107277 - DNA, 20 bp, Artificial
  CRISPR gRNA sequence
ttgtttggcattcacgtaga

SEQ ID NO: 107278 - DNA, 20 bp, Artificial
  CRISPR gRNA sequence
tgtttggcattcacgtagag

SEQ ID NO: 107279 - DNA, 20 bp, Artificial
  CRISPR gRNA sequence
acgtagagaggctcttcttc

SEQ ID NO: 107280 - DNA, 20 bp, Artificial
  CRISPR gRNA sequence
ttcttcaagcatctctgctc

SEQ ID NO: 107281 - DNA, 20 bp, Artificial
  CRISPR gRNA sequence
tcttcaagcatctctgctcc

SEQ ID NO: 107282 - DNA, 20 bp, Artificial
  CRISPR gRNA sequence
tcaagcatctctgctccagg

SEQ ID NO: 107283 - DNA, 20 bp, Artificial
  CRISPR gRNA sequence
aagcatctctgctccaggta

SEQ ID NO: 107284 - DNA, 20 bp, Artificial
  CRISPR gRNA sequence
agcatctctgctccaggtag

SEQ ID NO: 107285 - DNA, 20 bp, Artificial
  CRISPR gRNA sequence
gcatctctgctccaggtaga

SEQ ID NO: 107286 - DNA, 20 bp, Artificial
  CRISPR gRNA sequence
ctccaggtagagggattctt

SEQ ID NO: 107287 - DNA, 20 bp, Artificial
  CRISPR gRNA sequence
aggtagagggattctttgga

SEQ ID NO: 107288 - DNA, 20 bp, Artificial
  CRISPR gRNA sequence
tagagggattctttggatag

SEQ ID NO: 107289 - DNA, 20 bp, Artificial
  CRISPR gRNA sequence
agagggattctttggatagc

SEQ ID NO: 107290 - DNA, 20 bp, Artificial
  CRISPR gRNA sequence
gattctttggatagcaggca

SEQ ID NO: 107291 - DNA, 20 bp, Artificial
  CRISPR gRNA sequence
ttctttggatagcaggcaca

SEQ ID NO: 107292 - DNA, 20 bp, Artificial
  CRISPR gRNA sequence
ttggatagcaggcacagagc

SEQ ID NO: 107293 - DNA, 20 bp, Artificial
  CRISPR gRNA sequence
agcaggcacagagccagccc

SEQ ID NO: 107294 - DNA, 20 bp, Artificial
  CRISPR gRNA sequence
gcaggcacagagccagcccc

SEQ ID NO: 107295 - DNA, 20 bp, Artificial
  CRISPR gRNA sequence
ccaggaaccatctgtgtgaa

SEQ ID NO: 107296 - DNA, 20 bp, Artificial
  CRISPR gRNA sequence
caggaaccatctgtgtgaac

SEQ ID NO: 107297 - DNA, 20 bp, Artificial
  CRISPR gRNA sequence
catctgtgtgaacaggaaac

SEQ ID NO: 107298 - DNA, 20 bp, Artificial
  CRISPR gRNA sequence
tctgtgtgaacaggaaacca

SEQ ID NO: 107299 - DNA, 20 bp, Artificial
  CRISPR gRNA sequence
aacaggaaaccagagcttat

SEQ ID NO: 107300 - DNA, 20 bp, Artificial
  CRISPR gRNA sequence
aggaaaccagagcttattgg

SEQ ID NO: 107301 - DNA, 20 bp, Artificial
  CRISPR gRNA sequence
cagagcttattggtggcatg

SEQ ID NO: 107302 - DNA, 20 bp, Artificial
  CRISPR gRNA sequence
cttattggtggcatgaagta

SEQ ID NO: 107303 - DNA, 20 bp, Artificial
  CRISPR gRNA sequence
ggtggcatgaagtatggaca

SEQ ID NO: 107304 - DNA, 20 bp, Artificial
  CRISPR gRNA sequence
atgaagtatggacatagaaa

SEQ ID NO: 107305 - DNA, 20 bp, Artificial
  CRISPR gRNA sequence
tggacatagaaacagtttct

SEQ ID NO: 107306 - DNA, 20 bp, Artificial
  CRISPR gRNA sequence
ttttttgtaaatgccacaaa

SEQ ID NO: 107307 - DNA, 20 bp, Artificial
  CRISPR gRNA sequence
gccacaaaaagtaattttta

SEQ ID NO: 107308 - DNA, 20 bp, Artificial
  CRISPR gRNA sequence
ccacaaaaagtaatttttat

SEQ ID NO: 107309 - DNA, 20 bp, Artificial
  CRISPR gRNA sequence
cacaaaaagtaatttttata

SEQ ID NO: 107310 - DNA, 20 bp, Artificial
  CRISPR gRNA sequence
agtaatttttatagggtact

SEQ ID NO: 107311 - DNA, 20 bp, Artificial
  CRISPR gRNA sequence
gtaatttttatagggtactt

SEQ ID NO: 107312 - DNA, 20 bp, Artificial
  CRISPR gRNA sequence
atagggtacttgggtaaatg

SEQ ID NO: 107313 - DNA, 20 bp, Artificial
  CRISPR gRNA sequence
cttgggtaaatgcggatccc

SEQ ID NO: 107314 - DNA, 20 bp, Artificial
  CRISPR gRNA sequence
tgggtaaatgcggatccctg

SEQ ID NO: 107315 - DNA, 20 bp, Artificial
  CRISPR gRNA sequence
ccctggagaaatttatacta

SEQ ID NO: 107316 - DNA, 20 bp, Artificial
  CRISPR gRNA sequence
tgcactttaaacaaacaccc

SEQ ID NO: 107317 - DNA, 20 bp, Artificial
  CRISPR gRNA sequence
caccccagatgactgtgtca

SEQ ID NO: 107318 - DNA, 20 bp, Artificial
  CRISPR gRNA sequence
accccagatgactgtgtcat

SEQ ID NO: 107319 - DNA, 20 bp, Artificial
  CRISPR gRNA sequence
cccagatgactgtgtcatag

SEQ ID NO: 107320 - DNA, 20 bp, Artificial
  CRISPR gRNA sequence
tgactgtgtcataggagatt

SEQ ID NO: 107321 - DNA, 20 bp, Artificial
  CRISPR gRNA sequence
gactgtgtcataggagattc

SEQ ID NO: 107322 - DNA, 20 bp, Artificial
  CRISPR gRNA sequence
ggagattcaggtgccactct

SEQ ID NO: 107323 - DNA, 20 bp, Artificial
  CRISPR gRNA sequence
ccctaattcatgtccaccca

SEQ ID NO: 107324 - DNA, 20 bp, Artificial
  CRISPR gRNA sequence
ttcatgtccacccatggctc

SEQ ID NO: 107325 - DNA, 20 bp, Artificial
  CRISPR gRNA sequence
atatttctgctgccatctaa

SEQ ID NO: 107326 - DNA, 20 bp, Artificial
  CRISPR gRNA sequence
ttctgctgccatctaatggt

SEQ ID NO: 107327 - DNA, 20 bp, Artificial
  CRISPR gRNA sequence
tctgctgccatctaatggtc

SEQ ID NO: 107328 - DNA, 20 bp, Artificial
  CRISPR gRNA sequence
tgccatctaatggtcaggaa

SEQ ID NO: 107329 - DNA, 20 bp, Artificial
  CRISPR gRNA sequence
catctaatggtcaggaacag

SEQ ID NO: 107330 - DNA, 20 bp, Artificial
  CRISPR gRNA sequence
tggtcaggaacagtagtcat

SEQ ID NO: 107331 - DNA, 20 bp, Artificial
  CRISPR gRNA sequence
gtagtcataagacaaaaaaa

SEQ ID NO: 107332 - DNA, 20 bp, Artificial
  CRISPR gRNA sequence
acaaaaaaacagcacaaaaa

SEQ ID NO: 107333 - DNA, 20 bp, Artificial
  CRISPR gRNA sequence
aaaaacagcacaaaaataga

SEQ ID NO: 107334 - DNA, 20 bp, Artificial
  CRISPR gRNA sequence
agcacaaaaatagatagacc

SEQ ID NO: 107335 - DNA, 20 bp, Artificial
  CRISPR gRNA sequence
gcctatatttataaaaataa

SEQ ID NO: 107336 - DNA, 20 bp, Artificial
  CRISPR gRNA sequence
ccaaaacactgtactaaatg

SEQ ID NO: 107337 - DNA, 20 bp, Artificial
  CRISPR gRNA sequence
caaaacactgtactaaatgt

SEQ ID NO: 107338 - DNA, 20 bp, Artificial
  CRISPR gRNA sequence
tactaaatgtaggtaaaaac

SEQ ID NO: 107339 - DNA, 20 bp, Artificial
  CRISPR gRNA sequence
atgtaggtaaaaacaagtaa

SEQ ID NO: 107340 - DNA, 20 bp, Artificial
  CRISPR gRNA sequence
gtaggtaaaaacaagtaaca

SEQ ID NO: 107341 - DNA, 20 bp, Artificial
  CRISPR gRNA sequence
taacagagtcctgtacccca

SEQ ID NO: 107342 - DNA, 20 bp, Artificial
  CRISPR gRNA sequence
tttatttttcattcaattcg

SEQ ID NO: 107343 - DNA, 20 bp, Artificial
  CRISPR gRNA sequence
ttcattcaattcgtagaaac

SEQ ID NO: 107344 - DNA, 20 bp, Artificial
  CRISPR gRNA sequence
tcattcaattcgtagaaacg

SEQ ID NO: 107345 - DNA, 20 bp, Artificial
  CRISPR gRNA sequence
cgaggtctctctacattgcc

SEQ ID NO: 107346 - DNA, 20 bp, Artificial
  CRISPR gRNA sequence
gaggtctctctacattgccc

SEQ ID NO: 107347 - DNA, 20 bp, Artificial
  CRISPR gRNA sequence
ctctctacattgcccaggct

SEQ ID NO: 107348 - DNA, 20 bp, Artificial
  CRISPR gRNA sequence
ccaggctgagctcaaactcc

SEQ ID NO: 107349 - DNA, 20 bp, Artificial
  CRISPR gRNA sequence
gagctcaaactcctggactt

SEQ ID NO: 107350 - DNA, 20 bp, Artificial
  CRISPR gRNA sequence
ctggacttaagccatcctcc

SEQ ID NO: 107351 - DNA, 20 bp, Artificial
  CRISPR gRNA sequence
cttaagccatcctcctggat

SEQ ID NO: 107352 - DNA, 20 bp, Artificial
  CRISPR gRNA sequence
tcctcctggattagcctccc

SEQ ID NO: 107353 - DNA, 20 bp, Artificial
  CRISPR gRNA sequence
tcctggattagcctcccaag

SEQ ID NO: 107354 - DNA, 20 bp, Artificial
  CRISPR gRNA sequence
ggattagcctcccaagtagc

SEQ ID NO: 107355 - DNA, 20 bp, Artificial
  CRISPR gRNA sequence
gattagcctcccaagtagct

SEQ ID NO: 107356 - DNA, 20 bp, Artificial
  CRISPR gRNA sequence
ctcccaagtagctaggacta

SEQ ID NO: 107357 - DNA, 20 bp, Artificial
  CRISPR gRNA sequence
tcccaagtagctaggactac

SEQ ID NO: 107358 - DNA, 20 bp, Artificial
  CRISPR gRNA sequence
gactacaggtgcatgccact

SEQ ID NO: 107359 - DNA, 20 bp, Artificial
  CRISPR gRNA sequence
acaggtgcatgccactgagc

SEQ ID NO: 107360 - DNA, 20 bp, Artificial
  CRISPR gRNA sequence
caggtgcatgccactgagcc

SEQ ID NO: 107361 - DNA, 20 bp, Artificial
  CRISPR gRNA sequence
aggtgcatgccactgagcca

SEQ ID NO: 107362 - DNA, 20 bp, Artificial
  CRISPR gRNA sequence
gcatgccactgagccagggt

SEQ ID NO: 107363 - DNA, 20 bp, Artificial
  CRISPR gRNA sequence
gttggttctgtttcttttca

SEQ ID NO: 107364 - DNA, 20 bp, Artificial
  CRISPR gRNA sequence
tagcttcctccacctctgtg

SEQ ID NO: 107365 - DNA, 20 bp, Artificial
  CRISPR gRNA sequence
aacatcctattttgacatat

SEQ ID NO: 107366 - DNA, 20 bp, Artificial
  CRISPR gRNA sequence
acatcctattttgacatatg

SEQ ID NO: 107367 - DNA, 20 bp, Artificial
  CRISPR gRNA sequence
tattttgacatatgaggatt

SEQ ID NO: 107368 - DNA, 20 bp, Artificial
  CRISPR gRNA sequence
acatatgaggatttagcttt

SEQ ID NO: 107369 - DNA, 20 bp, Artificial
  CRISPR gRNA sequence
tttacatgacactttttttt

SEQ ID NO: 107370 - DNA, 20 bp, Artificial
  CRISPR gRNA sequence
attacaatctttctaatttt

SEQ ID NO: 107371 - DNA, 20 bp, Artificial
  CRISPR gRNA sequence
atttcttattttgtccatca

SEQ ID NO: 107372 - DNA, 20 bp, Artificial
  CRISPR gRNA sequence
tttcttattttgtccatcat

SEQ ID NO: 107373 - DNA, 20 bp, Artificial
  CRISPR gRNA sequence
atactactttccacttctca

SEQ ID NO: 107374 - DNA, 20 bp, Artificial
  CRISPR gRNA sequence
actttccacttctcaaagat

SEQ ID NO: 107375 - DNA, 20 bp, Artificial
  CRISPR gRNA sequence
ttcgttatttgaattctgaa

SEQ ID NO: 107376 - DNA, 20 bp, Artificial
  CRISPR gRNA sequence
tttatccattgctttatctc

SEQ ID NO: 107377 - DNA, 20 bp, Artificial
  CRISPR gRNA sequence
attgctttatctccagcatc

SEQ ID NO: 107378 - DNA, 20 bp, Artificial
  CRISPR gRNA sequence
tttatctccagcatctagaa

SEQ ID NO: 107379 - DNA, 20 bp, Artificial
  CRISPR gRNA sequence
ccagcatctagaatagtccc

SEQ ID NO: 107380 - DNA, 20 bp, Artificial
  CRISPR gRNA sequence
ctagaatagtccctggtgaa

SEQ ID NO: 107381 - DNA, 20 bp, Artificial
  CRISPR gRNA sequence
agtccctggtgaatagtccc

SEQ ID NO: 107382 - DNA, 20 bp, Artificial
  CRISPR gRNA sequence
ggtgaatagtccctggcaca

SEQ ID NO: 107383 - DNA, 20 bp, Artificial
  CRISPR gRNA sequence
gaatagtccctggcacatag

SEQ ID NO: 107384 - DNA, 20 bp, Artificial
  CRISPR gRNA sequence
aatagtccctggcacatagt

SEQ ID NO: 107385 - DNA, 20 bp, Artificial
  CRISPR gRNA sequence
cctggcacatagtaggtgct

SEQ ID NO: 107386 - DNA, 20 bp, Artificial
  CRISPR gRNA sequence
taggtgctcagaatgaatta

SEQ ID NO: 107387 - DNA, 20 bp, Artificial
  CRISPR gRNA sequence
ttgtcataatgttattgtca

SEQ ID NO: 107388 - DNA, 20 bp, Artificial
  CRISPR gRNA sequence
tcataatgttattgtcaaag

SEQ ID NO: 107389 - DNA, 20 bp, Artificial
  CRISPR gRNA sequence
ttgtcaaagtagattaccga

SEQ ID NO: 107390 - DNA, 20 bp, Artificial
  CRISPR gRNA sequence
tagattaccgacagtgcctt

SEQ ID NO: 107391 - DNA, 20 bp, Artificial
  CRISPR gRNA sequence
agattaccgacagtgcctta

SEQ ID NO: 107392 - DNA, 20 bp, Artificial
  CRISPR gRNA sequence
taaggatcgatctcaatccc

SEQ ID NO: 107393 - DNA, 20 bp, Artificial
  CRISPR gRNA sequence
aggatcgatctcaatcccaa

SEQ ID NO: 107394 - DNA, 20 bp, Artificial
  CRISPR gRNA sequence
ggatcgatctcaatcccaag

SEQ ID NO: 107395 - DNA, 20 bp, Artificial
  CRISPR gRNA sequence
gaggtcaacataataaattt

SEQ ID NO: 107396 - DNA, 20 bp, Artificial
  CRISPR gRNA sequence
aggtcaacataataaatttt

SEQ ID NO: 107397 - DNA, 20 bp, Artificial
  CRISPR gRNA sequence
gtcaacataataaattttag

SEQ ID NO: 107398 - DNA, 20 bp, Artificial
  CRISPR gRNA sequence
tcaacataataaattttagg

SEQ ID NO: 107399 - DNA, 20 bp, Artificial
  CRISPR gRNA sequence
aataaattttaggaggcatc

SEQ ID NO: 107400 - DNA, 20 bp, Artificial
  CRISPR gRNA sequence
aggcatcaagttgcatgttc

SEQ ID NO: 107401 - DNA, 20 bp, Artificial
  CRISPR gRNA sequence
gcatgttcaagaaaatttca

SEQ ID NO: 107402 - DNA, 20 bp, Artificial
  CRISPR gRNA sequence
tcaagaaaatttcaaagaca

SEQ ID NO: 107403 - DNA, 20 bp, Artificial
  CRISPR gRNA sequence
ttgaccacattgcctgccac

SEQ ID NO: 107404 - DNA, 20 bp, Artificial
  CRISPR gRNA sequence
accacattgcctgccactgg

SEQ ID NO: 107405 - DNA, 20 bp, Artificial
  CRISPR gRNA sequence
gcctgccactggtagtgtca

SEQ ID NO: 107406 - DNA, 20 bp, Artificial
  CRISPR gRNA sequence
cactggtagtgtcacagtga

SEQ ID NO: 107407 - DNA, 20 bp, Artificial
  CRISPR gRNA sequence
gacagtcccttgcccactgc

SEQ ID NO: 107408 - DNA, 20 bp, Artificial
  CRISPR gRNA sequence
ttgcccactgctggttgtgt

SEQ ID NO: 107409 - DNA, 20 bp, Artificial
  CRISPR gRNA sequence
actgctggttgtgttggtat

SEQ ID NO: 107410 - DNA, 20 bp, Artificial
  CRISPR gRNA sequence
aatctgtgctcctgccaaac

SEQ ID NO: 107411 - DNA, 20 bp, Artificial
  CRISPR gRNA sequence
gctcctgccaaactggctgc

SEQ ID NO: 107412 - DNA, 20 bp, Artificial
  CRISPR gRNA sequence
ctcctgccaaactggctgct

SEQ ID NO: 107413 - DNA, 20 bp, Artificial
  CRISPR gRNA sequence
tgccaaactggctgctggga

SEQ ID NO: 107414 - DNA, 20 bp, Artificial
  CRISPR gRNA sequence
gatagtgatcatgcctgaaa

SEQ ID NO: 107415 - DNA, 20 bp, Artificial
  CRISPR gRNA sequence
atagtgatcatgcctgaaac

SEQ ID NO: 107416 - DNA, 20 bp, Artificial
  CRISPR gRNA sequence
tagtgatcatgcctgaaaca

SEQ ID NO: 107417 - DNA, 20 bp, Artificial
  CRISPR gRNA sequence
gaaacagggactgtaacttt

SEQ ID NO: 107418 - DNA, 20 bp, Artificial
  CRISPR gRNA sequence
aacataaaacaaacaaaaaa

SEQ ID NO: 107419 - DNA, 20 bp, Artificial
  CRISPR gRNA sequence
acataaaacaaacaaaaaac

SEQ ID NO: 107420 - DNA, 20 bp, Artificial
  CRISPR gRNA sequence
acaaacaaaaaacaggcaca

SEQ ID NO: 107421 - DNA, 20 bp, Artificial
  CRISPR gRNA sequence
caaaaaacaggcacacagaa

SEQ ID NO: 107422 - DNA, 20 bp, Artificial
  CRISPR gRNA sequence
aaacaggcacacagaacaga

SEQ ID NO: 107423 - DNA, 20 bp, Artificial
  CRISPR gRNA sequence
caggcacacagaacagaaag

SEQ ID NO: 107424 - DNA, 20 bp, Artificial
  CRISPR gRNA sequence
aggcacacagaacagaaaga

SEQ ID NO: 107425 - DNA, 20 bp, Artificial
  CRISPR gRNA sequence
ggcacacagaacagaaagaa

SEQ ID NO: 107426 - DNA, 20 bp, Artificial
  CRISPR gRNA sequence
agaacagaaagaagggaaca

SEQ ID NO: 107427 - DNA, 20 bp, Artificial
  CRISPR gRNA sequence
cagaaagaagggaacatagt

SEQ ID NO: 107428 - DNA, 20 bp, Artificial
  CRISPR gRNA sequence
tagttagtccctcttctatc

SEQ ID NO: 107429 - DNA, 20 bp, Artificial
  CRISPR gRNA sequence
tggtatacactcaccgatcc

SEQ ID NO: 107430 - DNA, 20 bp, Artificial
  CRISPR gRNA sequence
caaaacacactgaaaaacac

SEQ ID NO: 107431 - DNA, 20 bp, Artificial
  CRISPR gRNA sequence
aaaacacactgaaaaacaca

SEQ ID NO: 107432 - DNA, 20 bp, Artificial
  CRISPR gRNA sequence
aaacacactgaaaaacacaa

SEQ ID NO: 107433 - DNA, 20 bp, Artificial
  CRISPR gRNA sequence
aacacactgaaaaacacaag

SEQ ID NO: 107434 - DNA, 20 bp, Artificial
  CRISPR gRNA sequence
cacactgaaaaacacaaggg

SEQ ID NO: 107435 - DNA, 20 bp, Artificial
  CRISPR gRNA sequence
gaaaaacacaaggggagaaa

SEQ ID NO: 107436 - DNA, 20 bp, Artificial
  CRISPR gRNA sequence
gaaaaagtactctcccactg

SEQ ID NO: 107437 - DNA, 20 bp, Artificial
  CRISPR gRNA sequence
tggtgtgctatatataatct

SEQ ID NO: 107438 - DNA, 20 bp, Artificial
  CRISPR gRNA sequence
ttgaaattctattaactgtc

SEQ ID NO: 107439 - DNA, 20 bp, Artificial
  CRISPR gRNA sequence
tgaaattctattaactgtct

SEQ ID NO: 107440 - DNA, 20 bp, Artificial
  CRISPR gRNA sequence
tctattaactgtctaggtcc

SEQ ID NO: 107441 - DNA, 20 bp, Artificial
  CRISPR gRNA sequence
actgtctaggtcccagtttt

SEQ ID NO: 107442 - DNA, 20 bp, Artificial
  CRISPR gRNA sequence
gttttgagtaactctatcct

SEQ ID NO: 107443 - DNA, 20 bp, Artificial
  CRISPR gRNA sequence
ttgagtaactctatccttag

SEQ ID NO: 107444 - DNA, 20 bp, Artificial
  CRISPR gRNA sequence
ctatccttagcagttttcaa

SEQ ID NO: 107445 - DNA, 20 bp, Artificial
  CRISPR gRNA sequence
tatccttagcagttttcaaa

SEQ ID NO: 107446 - DNA, 20 bp, Artificial
  CRISPR gRNA sequence
agcagttttcaaaaggtgaa

SEQ ID NO: 107447 - DNA, 20 bp, Artificial
  CRISPR gRNA sequence
gcagttttcaaaaggtgaaa

SEQ ID NO: 107448 - DNA, 20 bp, Artificial
  CRISPR gRNA sequence
tttcaaaaggtgaaaaggtt

SEQ ID NO: 107449 - DNA, 20 bp, Artificial
  CRISPR gRNA sequence
tcaaaaggtgaaaaggtttg

SEQ ID NO: 107450 - DNA, 20 bp, Artificial
  CRISPR gRNA sequence
caaaaggtgaaaaggtttgg

SEQ ID NO: 107451 - DNA, 20 bp, Artificial
  CRISPR gRNA sequence
tttggaggcctcctcttcta

SEQ ID NO: 107452 - DNA, 20 bp, Artificial
  CRISPR gRNA sequence
ttggaggcctcctcttctac

SEQ ID NO: 107453 - DNA, 20 bp, Artificial
  CRISPR gRNA sequence
aggcctcctcttctacaggt

SEQ ID NO: 107454 - DNA, 20 bp, Artificial
  CRISPR gRNA sequence
tctacaggtcagtctgacta

SEQ ID NO: 107455 - DNA, 20 bp, Artificial
  CRISPR gRNA sequence
ctactgctcttgtacataat

SEQ ID NO: 107456 - DNA, 20 bp, Artificial
  CRISPR gRNA sequence
acataatgagcaatctgctt

SEQ ID NO: 107457 - DNA, 20 bp, Artificial
  CRISPR gRNA sequence
cataatgagcaatctgcttc

SEQ ID NO: 107458 - DNA, 20 bp, Artificial
  CRISPR gRNA sequence
atgagcaatctgcttcagga

SEQ ID NO: 107459 - DNA, 20 bp, Artificial
  CRISPR gRNA sequence
gagcaatctgcttcaggaca

SEQ ID NO: 107460 - DNA, 20 bp, Artificial
  CRISPR gRNA sequence
gtttatctcaaactgacaat

SEQ ID NO: 107461 - DNA, 20 bp, Artificial
  CRISPR gRNA sequence
atctcaaactgacaatgagt

SEQ ID NO: 107462 - DNA, 20 bp, Artificial
  CRISPR gRNA sequence
aactgacaatgagtcagttg

SEQ ID NO: 107463 - DNA, 20 bp, Artificial
  CRISPR gRNA sequence
ttaaaacttaaaattaaacc

SEQ ID NO: 107464 - DNA, 20 bp, Artificial
  CRISPR gRNA sequence
aaaattaaaccaagcattcc

SEQ ID NO: 107465 - DNA, 20 bp, Artificial
  CRISPR gRNA sequence
aaccaagcattccaagtccc

SEQ ID NO: 107466 - DNA, 20 bp, Artificial
  CRISPR gRNA sequence
ccaagtccccagactatcaa

SEQ ID NO: 107467 - DNA, 20 bp, Artificial
  CRISPR gRNA sequence
agtccccagactatcaatag

SEQ ID NO: 107468 - DNA, 20 bp, Artificial
  CRISPR gRNA sequence
gactatcaatagcagcactt

SEQ ID NO: 107469 - DNA, 20 bp, Artificial
  CRISPR gRNA sequence
actatcaatagcagcacttg

SEQ ID NO: 107470 - DNA, 20 bp, Artificial
  CRISPR gRNA sequence
atttgttcaccattctgttt

SEQ ID NO: 107471 - DNA, 20 bp, Artificial
  CRISPR gRNA sequence
attctgtttgagctcttgcc

SEQ ID NO: 107472 - DNA, 20 bp, Artificial
  CRISPR gRNA sequence
ttctgtttgagctcttgcct

SEQ ID NO: 107473 - DNA, 20 bp, Artificial
  CRISPR gRNA sequence
gctcttgcctgggctcaatc

SEQ ID NO: 107474 - DNA, 20 bp, Artificial
  CRISPR gRNA sequence
tgcctgggctcaatccagtt

SEQ ID NO: 107475 - DNA, 20 bp, Artificial
  CRISPR gRNA sequence
gcctgggctcaatccagttc

SEQ ID NO: 107476 - DNA, 20 bp, Artificial
  CRISPR gRNA sequence
cctgggctcaatccagttca

SEQ ID NO: 107477 - DNA, 20 bp, Artificial
  CRISPR gRNA sequence
aatccagttcagggcctccc

SEQ ID NO: 107478 - DNA, 20 bp, Artificial
  CRISPR gRNA sequence
tccagttcagggcctccctg

SEQ ID NO: 107479 - DNA, 20 bp, Artificial
  CRISPR gRNA sequence
gggcctccctggagtaatac

SEQ ID NO: 107480 - DNA, 20 bp, Artificial
  CRISPR gRNA sequence
gcctccctggagtaatacaa

SEQ ID NO: 107481 - DNA, 20 bp, Artificial
  CRISPR gRNA sequence
tggagtaatacaagagcaca

SEQ ID NO: 107482 - DNA, 20 bp, Artificial
  CRISPR gRNA sequence
gtaatacaagagcacacagt

SEQ ID NO: 107483 - DNA, 20 bp, Artificial
  CRISPR gRNA sequence
cacacagttagtgcactctc

SEQ ID NO: 107484 - DNA, 20 bp, Artificial
  CRISPR gRNA sequence
attgcaaatttgcaatcaca

SEQ ID NO: 107485 - DNA, 20 bp, Artificial
  CRISPR gRNA sequence
aatttgcaatcacaaagtca

SEQ ID NO: 107486 - DNA, 20 bp, Artificial
  CRISPR gRNA sequence
caaagtcatggaatctaaca

SEQ ID NO: 107487 - DNA, 20 bp, Artificial
  CRISPR gRNA sequence
tgatttaactatttgactaa

SEQ ID NO: 107488 - DNA, 20 bp, Artificial
  CRISPR gRNA sequence
gatttaactatttgactaac

SEQ ID NO: 107489 - DNA, 20 bp, Artificial
  CRISPR gRNA sequence
tgactaacaggtgcttccaa

SEQ ID NO: 107490 - DNA, 20 bp, Artificial
  CRISPR gRNA sequence
aggtgcttccaaaagccttc

SEQ ID NO: 107491 - DNA, 20 bp, Artificial
  CRISPR gRNA sequence
cttccaaaagccttcaagtt

SEQ ID NO: 107492 - DNA, 20 bp, Artificial
  CRISPR gRNA sequence
agtttctgcactcctcctcc

SEQ ID NO: 107493 - DNA, 20 bp, Artificial
  CRISPR gRNA sequence
ttatttatgttatctattcc

SEQ ID NO: 107494 - DNA, 20 bp, Artificial
  CRISPR gRNA sequence
ttcctagaacatacttccat

SEQ ID NO: 107495 - DNA, 20 bp, Artificial
  CRISPR gRNA sequence
tcctagaacatacttccatg

SEQ ID NO: 107496 - DNA, 20 bp, Artificial
  CRISPR gRNA sequence
cctagaacatacttccatga

SEQ ID NO: 107497 - DNA, 20 bp, Artificial
  CRISPR gRNA sequence
tttgttcacgtctttcttac

SEQ ID NO: 107498 - DNA, 20 bp, Artificial
  CRISPR gRNA sequence
tcacgtctttcttactagac

SEQ ID NO: 107499 - DNA, 20 bp, Artificial
  CRISPR gRNA sequence
acgtctttcttactagacta

SEQ ID NO: 107500 - DNA, 20 bp, Artificial
  CRISPR gRNA sequence
cgtctttcttactagactag

SEQ ID NO: 107501 - DNA, 20 bp, Artificial
  CRISPR gRNA sequence
tactagactagaggctcttt

SEQ ID NO: 107502 - DNA, 20 bp, Artificial
  CRISPR gRNA sequence
actagactagaggctctttg

SEQ ID NO: 107503 - DNA, 20 bp, Artificial
  CRISPR gRNA sequence
ggctctttgaggacccttct

SEQ ID NO: 107504 - DNA, 20 bp, Artificial
  CRISPR gRNA sequence
ttgaggacccttcttagtaa

SEQ ID NO: 107505 - DNA, 20 bp, Artificial
  CRISPR gRNA sequence
taaaagtgctgtatacataa

SEQ ID NO: 107506 - DNA, 20 bp, Artificial
  CRISPR gRNA sequence
gtatacataatagtcattta

SEQ ID NO: 107507 - DNA, 20 bp, Artificial
  CRISPR gRNA sequence
ataatagtcatttaaagtaa

SEQ ID NO: 107508 - DNA, 20 bp, Artificial
  CRISPR gRNA sequence
tttaaagtaatggaatgacc

SEQ ID NO: 107509 - DNA, 20 bp, Artificial
  CRISPR gRNA sequence
aatgacccagaaaaaaacat

SEQ ID NO: 107510 - DNA, 20 bp, Artificial
  CRISPR gRNA sequence
gacccagaaaaaaacataag

SEQ ID NO: 107511 - DNA, 20 bp, Artificial
  CRISPR gRNA sequence
gaaaaaaacataagcagcaa

SEQ ID NO: 107512 - DNA, 20 bp, Artificial
  CRISPR gRNA sequence
taagcagcaatagcactcta

SEQ ID NO: 107513 - DNA, 20 bp, Artificial
  CRISPR gRNA sequence
cctatttctattcttctgtt

SEQ ID NO: 107514 - DNA, 20 bp, Artificial
  CRISPR gRNA sequence
tagaaacacttcttccctaa

SEQ ID NO: 107515 - DNA, 20 bp, Artificial
  CRISPR gRNA sequence
ctaaaagcttacacaatccc

SEQ ID NO: 107516 - DNA, 20 bp, Artificial
  CRISPR gRNA sequence
agcttacacaatccctagat

SEQ ID NO: 107517 - DNA, 20 bp, Artificial
  CRISPR gRNA sequence
ccctagattagcaaccacta

SEQ ID NO: 107518 - DNA, 20 bp, Artificial
  CRISPR gRNA sequence
actatagaaactgctacaca

SEQ ID NO: 107519 - DNA, 20 bp, Artificial
  CRISPR gRNA sequence
gctacacatggaatcactgt

SEQ ID NO: 107520 - DNA, 20 bp, Artificial
  CRISPR gRNA sequence
catggaatcactgttggtca

SEQ ID NO: 107521 - DNA, 20 bp, Artificial
  CRISPR gRNA sequence
gaatcactgttggtcacaga

SEQ ID NO: 107522 - DNA, 20 bp, Artificial
  CRISPR gRNA sequence
tgttggtcacagatggtgac

SEQ ID NO: 107523 - DNA, 20 bp, Artificial
  CRISPR gRNA sequence
gacaagaaaccaacaatcaa

SEQ ID NO: 107524 - DNA, 20 bp, Artificial
  CRISPR gRNA sequence
caagaaaccaacaatcaatg

SEQ ID NO: 107525 - DNA, 20 bp, Artificial
  CRISPR gRNA sequence
agaaaccaacaatcaatgga

SEQ ID NO: 107526 - DNA, 20 bp, Artificial
  CRISPR gRNA sequence
accaacaatcaatggagagc

SEQ ID NO: 107527 - DNA, 20 bp, Artificial
  CRISPR gRNA sequence
caacaatcaatggagagcta

SEQ ID NO: 107528 - DNA, 20 bp, Artificial
  CRISPR gRNA sequence
aacaatcaatggagagctag

SEQ ID NO: 107529 - DNA, 20 bp, Artificial
  CRISPR gRNA sequence
ttttttgtccaaaaaatatg

SEQ ID NO: 107530 - DNA, 20 bp, Artificial
  CRISPR gRNA sequence
tccaaaaaatatgtagtgtc

SEQ ID NO: 107531 - DNA, 20 bp, Artificial
  CRISPR gRNA sequence
agttcaccactcaaattcta

SEQ ID NO: 107532 - DNA, 20 bp, Artificial
  CRISPR gRNA sequence
cactcaaattctaaagatgt

SEQ ID NO: 107533 - DNA, 20 bp, Artificial
  CRISPR gRNA sequence
tctaaagatgtcagttgtct

SEQ ID NO: 107534 - DNA, 20 bp, Artificial
  CRISPR gRNA sequence
ctaaagatgtcagttgtcta

SEQ ID NO: 107535 - DNA, 20 bp, Artificial
  CRISPR gRNA sequence
taaagatgtcagttgtctaa

SEQ ID NO: 107536 - DNA, 20 bp, Artificial
  CRISPR gRNA sequence
cagttgtctaagggacaaaa

SEQ ID NO: 107537 - DNA, 20 bp, Artificial
  CRISPR gRNA sequence
gacaaaaaagttgccccaaa

SEQ ID NO: 107538 - DNA, 20 bp, Artificial
  CRISPR gRNA sequence
aaagttgccccaaaaagtcc

SEQ ID NO: 107539 - DNA, 20 bp, Artificial
  CRISPR gRNA sequence
aagttgccccaaaaagtcct

SEQ ID NO: 107540 - DNA, 20 bp, Artificial
  CRISPR gRNA sequence
agttgccccaaaaagtccta

SEQ ID NO: 107541 - DNA, 20 bp, Artificial
  CRISPR gRNA sequence
tgccccaaaaagtcctaggg

SEQ ID NO: 107542 - DNA, 20 bp, Artificial
  CRISPR gRNA sequence
aaaagtcctagggaagctta

SEQ ID NO: 107543 - DNA, 20 bp, Artificial
  CRISPR gRNA sequence
aaagtcctagggaagcttat

SEQ ID NO: 107544 - DNA, 20 bp, Artificial
  CRISPR gRNA sequence
tatgggtacacttaccttgc

SEQ ID NO: 107545 - DNA, 20 bp, Artificial
  CRISPR gRNA sequence
tgggtacacttaccttgctg

SEQ ID NO: 107546 - DNA, 20 bp, Artificial
  CRISPR gRNA sequence
acacttaccttgctggagaa

SEQ ID NO: 107547 - DNA, 20 bp, Artificial
  CRISPR gRNA sequence
atggtgccatctgcattaac

SEQ ID NO: 107548 - DNA, 20 bp, Artificial
  CRISPR gRNA sequence
catctgcattaactggttga

SEQ ID NO: 107549 - DNA, 20 bp, Artificial
  CRISPR gRNA sequence
attaactggttgatagacga

SEQ ID NO: 107550 - DNA, 20 bp, Artificial
  CRISPR gRNA sequence
atagacgatggtctgccctt

SEQ ID NO: 107551 - DNA, 20 bp, Artificial
  CRISPR gRNA sequence
gacgatggtctgcccttcag

SEQ ID NO: 107552 - DNA, 20 bp, Artificial
  CRISPR gRNA sequence
tctgtgccacttgctgtccc

SEQ ID NO: 107553 - DNA, 20 bp, Artificial
  CRISPR gRNA sequence
tgccacttgctgtccctgga

SEQ ID NO: 107554 - DNA, 20 bp, Artificial
  CRISPR gRNA sequence
cagcaatctgctgctgtgtc

SEQ ID NO: 107555 - DNA, 20 bp, Artificial
  CRISPR gRNA sequence
gcaatctgctgctgtgtctg

SEQ ID NO: 107556 - DNA, 20 bp, Artificial
  CRISPR gRNA sequence
caatctgctgctgtgtctgg

SEQ ID NO: 107557 - DNA, 20 bp, Artificial
  CRISPR gRNA sequence
ctgctgtgtctggaggaaat

SEQ ID NO: 107558 - DNA, 20 bp, Artificial
  CRISPR gRNA sequence
taagtaatgacacaattcaa

SEQ ID NO: 107559 - DNA, 20 bp, Artificial
  CRISPR gRNA sequence
acacaattcaacagatccca

SEQ ID NO: 107560 - DNA, 20 bp, Artificial
  CRISPR gRNA sequence
agatcccaaagatactaaca

SEQ ID NO: 107561 - DNA, 20 bp, Artificial
  CRISPR gRNA sequence
gatactaacaaagaacgatg

SEQ ID NO: 107562 - DNA, 20 bp, Artificial
  CRISPR gRNA sequence
aaaaaaaaaattattttttt

SEQ ID NO: 107563 - DNA, 20 bp, Artificial
  CRISPR gRNA sequence
aaaaaattatttttttgaga

SEQ ID NO: 107564 - DNA, 20 bp, Artificial
  CRISPR gRNA sequence
aaaattatttttttgagaca

SEQ ID NO: 107565 - DNA, 20 bp, Artificial
  CRISPR gRNA sequence
acagagtctcactctgtcgc

SEQ ID NO: 107566 - DNA, 20 bp, Artificial
  CRISPR gRNA sequence
cagagtctcactctgtcgcc

SEQ ID NO: 107567 - DNA, 20 bp, Artificial
  CRISPR gRNA sequence
gtctcactctgtcgccaggc

SEQ ID NO: 107568 - DNA, 20 bp, Artificial
  CRISPR gRNA sequence
ctcactctgtcgccaggctg

SEQ ID NO: 107569 - DNA, 20 bp, Artificial
  CRISPR gRNA sequence
tctgtcgccaggctggagtg

SEQ ID NO: 107570 - DNA, 20 bp, Artificial
  CRISPR gRNA sequence
cgccaggctggagtgcagtg

SEQ ID NO: 107571 - DNA, 20 bp, Artificial
  CRISPR gRNA sequence
caggctggagtgcagtgcag

SEQ ID NO: 107572 - DNA, 20 bp, Artificial
  CRISPR gRNA sequence
gcagtgcagtggcgcaatct

SEQ ID NO: 107573 - DNA, 20 bp, Artificial
  CRISPR gRNA sequence
tcactgcaacctccgcctcc

SEQ ID NO: 107574 - DNA, 20 bp, Artificial
  CRISPR gRNA sequence
cactgcaacctccgcctcct

SEQ ID NO: 107575 - DNA, 20 bp, Artificial
  CRISPR gRNA sequence
aacctccgcctcctgggttc

SEQ ID NO: 107576 - DNA, 20 bp, Artificial
  CRISPR gRNA sequence
gttcaagcgattctctgcct

SEQ ID NO: 107577 - DNA, 20 bp, Artificial
  CRISPR gRNA sequence
attctctgcctcagcctccc

SEQ ID NO: 107578 - DNA, 20 bp, Artificial
  CRISPR gRNA sequence
ctctgcctcagcctcccgag

SEQ ID NO: 107579 - DNA, 20 bp, Artificial
  CRISPR gRNA sequence
gcctcagcctcccgagtagc

SEQ ID NO: 107580 - DNA, 20 bp, Artificial
  CRISPR gRNA sequence
cctcagcctcccgagtagct

SEQ ID NO: 107581 - DNA, 20 bp, Artificial
  CRISPR gRNA sequence
ctcccgagtagctgggatta

SEQ ID NO: 107582 - DNA, 20 bp, Artificial
  CRISPR gRNA sequence
tcccgagtagctgggattac

SEQ ID NO: 107583 - DNA, 20 bp, Artificial
  CRISPR gRNA sequence
acctaatttttgtattttga

SEQ ID NO: 107584 - DNA, 20 bp, Artificial
  CRISPR gRNA sequence
cctaatttttgtattttgac

SEQ ID NO: 107585 - DNA, 20 bp, Artificial
  CRISPR gRNA sequence
ctaatttttgtattttgacg

SEQ ID NO: 107586 - DNA, 20 bp, Artificial
  CRISPR gRNA sequence
ttgacggggcttcaccatgt

SEQ ID NO: 107587 - DNA, 20 bp, Artificial
  CRISPR gRNA sequence
cggggcttcaccatgttggc

SEQ ID NO: 107588 - DNA, 20 bp, Artificial
  CRISPR gRNA sequence
ggggcttcaccatgttggcc

SEQ ID NO: 107589 - DNA, 20 bp, Artificial
  CRISPR gRNA sequence
tgatctcttgaccttgtgat

SEQ ID NO: 107590 - DNA, 20 bp, Artificial
  CRISPR gRNA sequence
accttgtgatcagcttgcct

SEQ ID NO: 107591 - DNA, 20 bp, Artificial
  CRISPR gRNA sequence
cagcttgcctcggcctctca

SEQ ID NO: 107592 - DNA, 20 bp, Artificial
  CRISPR gRNA sequence
gcctcggcctctcaaagtgc

SEQ ID NO: 107593 - DNA, 20 bp, Artificial
  CRISPR gRNA sequence
cctcggcctctcaaagtgct

SEQ ID NO: 107594 - DNA, 20 bp, Artificial
  CRISPR gRNA sequence
ctctcaaagtgctgggatta

SEQ ID NO: 107595 - DNA, 20 bp, Artificial
  CRISPR gRNA sequence
tctcaaagtgctgggattac

SEQ ID NO: 107596 - DNA, 20 bp, Artificial
  CRISPR gRNA sequence
agtgctgggattacaggcat

SEQ ID NO: 107597 - DNA, 20 bp, Artificial
  CRISPR gRNA sequence
caggcatgagccaccgcgcc

SEQ ID NO: 107598 - DNA, 20 bp, Artificial
  CRISPR gRNA sequence
gccaaaaatatattttttta

SEQ ID NO: 107599 - DNA, 20 bp, Artificial
  CRISPR gRNA sequence
tatacatgaaatatctgact

SEQ ID NO: 107600 - DNA, 20 bp, Artificial
  CRISPR gRNA sequence
gttatctgactcttccaaat

SEQ ID NO: 107601 - DNA, 20 bp, Artificial
  CRISPR gRNA sequence
tcagttttgctcctgtgtga

SEQ ID NO: 107602 - DNA, 20 bp, Artificial
  CRISPR gRNA sequence
agttttgctcctgtgtgaca

SEQ ID NO: 107603 - DNA, 20 bp, Artificial
  CRISPR gRNA sequence
ttgctcctgtgtgacagagc

SEQ ID NO: 107604 - DNA, 20 bp, Artificial
  CRISPR gRNA sequence
ctcctgtgtgacagagctag

SEQ ID NO: 107605 - DNA, 20 bp, Artificial
  CRISPR gRNA sequence
cagagctagtggaattacct

SEQ ID NO: 107606 - DNA, 20 bp, Artificial
  CRISPR gRNA sequence
ctagtggaattacctgagtc

SEQ ID NO: 107607 - DNA, 20 bp, Artificial
  CRISPR gRNA sequence
tggaattacctgagtctggc

SEQ ID NO: 107608 - DNA, 20 bp, Artificial
  CRISPR gRNA sequence
aattacctgagtctggccag

SEQ ID NO: 107609 - DNA, 20 bp, Artificial
  CRISPR gRNA sequence
ctgagtctggccagcagtga

SEQ ID NO: 107610 - DNA, 20 bp, Artificial
  CRISPR gRNA sequence
ggccagcagtgacagccgtc

SEQ ID NO: 107611 - DNA, 20 bp, Artificial
  CRISPR gRNA sequence
gccagcagtgacagccgtct

SEQ ID NO: 107612 - DNA, 20 bp, Artificial
  CRISPR gRNA sequence
ccagcagtgacagccgtctg

SEQ ID NO: 107613 - DNA, 20 bp, Artificial
  CRISPR gRNA sequence
tgacagccgtctggggctgc

SEQ ID NO: 107614 - DNA, 20 bp, Artificial
  CRISPR gRNA sequence
gctgctggatgatgatctgc

SEQ ID NO: 107615 - DNA, 20 bp, Artificial
  CRISPR gRNA sequence
ctgctggatgatgatctgct

SEQ ID NO: 107616 - DNA, 20 bp, Artificial
  CRISPR gRNA sequence
ggatgatgatctgctgggtc

SEQ ID NO: 107617 - DNA, 20 bp, Artificial
  CRISPR gRNA sequence
tctgctgggtctggccctgc

SEQ ID NO: 107618 - DNA, 20 bp, Artificial
  CRISPR gRNA sequence
ctgctggccctgcacctgca

SEQ ID NO: 107619 - DNA, 20 bp, Artificial
  CRISPR gRNA sequence
cctgcacagcctgtccaccc

SEQ ID NO: 107620 - DNA, 20 bp, Artificial
  CRISPR gRNA sequence
cagcctgtccaccctggatc

SEQ ID NO: 107621 - DNA, 20 bp, Artificial
  CRISPR gRNA sequence
accctggatctggatctgtc

SEQ ID NO: 107622 - DNA, 20 bp, Artificial
  CRISPR gRNA sequence
ccctggatctggatctgtcc

SEQ ID NO: 107623 - DNA, 20 bp, Artificial
  CRISPR gRNA sequence
tggatctggatctgtccagg

SEQ ID NO: 107624 - DNA, 20 bp, Artificial
  CRISPR gRNA sequence
ggatctggatctgtccaggt

SEQ ID NO: 107625 - DNA, 20 bp, Artificial
  CRISPR gRNA sequence
ggtgggaccaactgtatctg

SEQ ID NO: 107626 - DNA, 20 bp, Artificial
  CRISPR gRNA sequence
gaccaactgtatctgcagaa

SEQ ID NO: 107627 - DNA, 20 bp, Artificial
  CRISPR gRNA sequence
tgcagaaaagaacataaaaa

SEQ ID NO: 107628 - DNA, 20 bp, Artificial
  CRISPR gRNA sequence
gcagaaaagaacataaaaaa

SEQ ID NO: 107629 - DNA, 20 bp, Artificial
  CRISPR gRNA sequence
ggattgtactctactgacac

SEQ ID NO: 107630 - DNA, 20 bp, Artificial
  CRISPR gRNA sequence
ctactgacactggtctcctt

SEQ ID NO: 107631 - DNA, 20 bp, Artificial
  CRISPR gRNA sequence
actggtctcctttggtcccc

SEQ ID NO: 107632 - DNA, 20 bp, Artificial
  CRISPR gRNA sequence
tggtctcctttggtccccga

SEQ ID NO: 107633 - DNA, 20 bp, Artificial
  CRISPR gRNA sequence
gagagttatccacatttctc

SEQ ID NO: 107634 - DNA, 20 bp, Artificial
  CRISPR gRNA sequence
gttatccacatttctctaga

SEQ ID NO: 107635 - DNA, 20 bp, Artificial
  CRISPR gRNA sequence
atccacatttctctagaaag

SEQ ID NO: 107636 - DNA, 20 bp, Artificial
  CRISPR gRNA sequence
agaaagcagaaaatgttctg

SEQ ID NO: 107637 - DNA, 20 bp, Artificial
  CRISPR gRNA sequence
aaagcagaaaatgttctgaa

SEQ ID NO: 107638 - DNA, 20 bp, Artificial
  CRISPR gRNA sequence
aagcagaaaatgttctgaag

SEQ ID NO: 107639 - DNA, 20 bp, Artificial
  CRISPR gRNA sequence
aaatgttctgaagaggaaaa

SEQ ID NO: 107640 - DNA, 20 bp, Artificial
  CRISPR gRNA sequence
tgttctgaagaggaaaaaag

SEQ ID NO: 107641 - DNA, 20 bp, Artificial
  CRISPR gRNA sequence
ctgctctgccctccattatg

SEQ ID NO: 107642 - DNA, 20 bp, Artificial
  CRISPR gRNA sequence
ctctgccctccattatgaag

SEQ ID NO: 107643 - DNA, 20 bp, Artificial
  CRISPR gRNA sequence
ttttccatttatgaaacaaa

SEQ ID NO: 107644 - DNA, 20 bp, Artificial
  CRISPR gRNA sequence
tttccatttatgaaacaaat

SEQ ID NO: 107645 - DNA, 20 bp, Artificial
  CRISPR gRNA sequence
ttccatttatgaaacaaata

SEQ ID NO: 107646 - DNA, 20 bp, Artificial
  CRISPR gRNA sequence
tagggaatttcgacactgtc

SEQ ID NO: 107647 - DNA, 20 bp, Artificial
  CRISPR gRNA sequence
tgatattaacaaatcaatgt

SEQ ID NO: 107648 - DNA, 20 bp, Artificial
  CRISPR gRNA sequence
atcaatgtcggtttttatga

SEQ ID NO: 107649 - DNA, 20 bp, Artificial
  CRISPR gRNA sequence
atgtcggtttttatgaaaga

SEQ ID NO: 107650 - DNA, 20 bp, Artificial
  CRISPR gRNA sequence
tcggtttttatgaaagatag

SEQ ID NO: 107651 - DNA, 20 bp, Artificial
  CRISPR gRNA sequence
gtttttatgaaagatagcag

SEQ ID NO: 107652 - DNA, 20 bp, Artificial
  CRISPR gRNA sequence
gtatgattatatatattgaa

SEQ ID NO: 107653 - DNA, 20 bp, Artificial
  CRISPR gRNA sequence
tgcatatttaaaatacactc

SEQ ID NO: 107654 - DNA, 20 bp, Artificial
  CRISPR gRNA sequence
gcatatttaaaatacactct

SEQ ID NO: 107655 - DNA, 20 bp, Artificial
  CRISPR gRNA sequence
atttaaaatacactctgggc

SEQ ID NO: 107656 - DNA, 20 bp, Artificial
  CRISPR gRNA sequence
tttaaaatacactctgggct

SEQ ID NO: 107657 - DNA, 20 bp, Artificial
  CRISPR gRNA sequence
aatacactctgggctgggtg

SEQ ID NO: 107658 - DNA, 20 bp, Artificial
  CRISPR gRNA sequence
acactctgggctgggtgtgg

SEQ ID NO: 107659 - DNA, 20 bp, Artificial
  CRISPR gRNA sequence
cgcctgtaatccttgcactt

SEQ ID NO: 107660 - DNA, 20 bp, Artificial
  CRISPR gRNA sequence
ctgtaatccttgcactttgg

SEQ ID NO: 107661 - DNA, 20 bp, Artificial
  CRISPR gRNA sequence
tgtaatccttgcactttgga

SEQ ID NO: 107662 - DNA, 20 bp, Artificial
  CRISPR gRNA sequence
tccttgcactttggaaggcc

SEQ ID NO: 107663 - DNA, 20 bp, Artificial
  CRISPR gRNA sequence
ccttgcactttggaaggccg

SEQ ID NO: 107664 - DNA, 20 bp, Artificial
  CRISPR gRNA sequence
tgcactttggaaggccgagg

SEQ ID NO: 107665 - DNA, 20 bp, Artificial
  CRISPR gRNA sequence
gcactttggaaggccgaggt

SEQ ID NO: 107666 - DNA, 20 bp, Artificial
  CRISPR gRNA sequence
ctttggaaggccgaggtggg

SEQ ID NO: 107667 - DNA, 20 bp, Artificial
  CRISPR gRNA sequence
ccgaggtgggtggatcactt

SEQ ID NO: 107668 - DNA, 20 bp, Artificial
  CRISPR gRNA sequence
cgaggtgggtggatcacttg

SEQ ID NO: 107669 - DNA, 20 bp, Artificial
  CRISPR gRNA sequence
gtgggtggatcacttgaggt

SEQ ID NO: 107670 - DNA, 20 bp, Artificial
  CRISPR gRNA sequence
tgggtggatcacttgaggtc

SEQ ID NO: 107671 - DNA, 20 bp, Artificial
  CRISPR gRNA sequence
ggtggatcacttgaggtcag

SEQ ID NO: 107672 - DNA, 20 bp, Artificial
  CRISPR gRNA sequence
tcacttgaggtcaggagttc

SEQ ID NO: 107673 - DNA, 20 bp, Artificial
  CRISPR gRNA sequence
tgaggtcaggagttcgagac

SEQ ID NO: 107674 - DNA, 20 bp, Artificial
  CRISPR gRNA sequence
tcaggagttcgagaccagcc

SEQ ID NO: 107675 - DNA, 20 bp, Artificial
  CRISPR gRNA sequence
ctgtctctactaaaaataca

SEQ ID NO: 107676 - DNA, 20 bp, Artificial
  CRISPR gRNA sequence
tctactaaaaatacaaagat

SEQ ID NO: 107677 - DNA, 20 bp, Artificial
  CRISPR gRNA sequence
ctaaaaatacaaagattagc

SEQ ID NO: 107678 - DNA, 20 bp, Artificial
  CRISPR gRNA sequence
taaaaatacaaagattagcc

SEQ ID NO: 107679 - DNA, 20 bp, Artificial
  CRISPR gRNA sequence
atacaaagattagccgggca

SEQ ID NO: 107680 - DNA, 20 bp, Artificial
  CRISPR gRNA sequence
caaagattagccgggcatgg

SEQ ID NO: 107681 - DNA, 20 bp, Artificial
  CRISPR gRNA sequence
gtggtgcatgcctgtaatcc

SEQ ID NO: 107682 - DNA, 20 bp, Artificial
  CRISPR gRNA sequence
tgcctgtaatcccagctact

SEQ ID NO: 107683 - DNA, 20 bp, Artificial
  CRISPR gRNA sequence
gcctgtaatcccagctactt

SEQ ID NO: 107684 - DNA, 20 bp, Artificial
  CRISPR gRNA sequence
ctgtaatcccagctacttgg

SEQ ID NO: 107685 - DNA, 20 bp, Artificial
  CRISPR gRNA sequence
tcccagctacttgggagact

SEQ ID NO: 107686 - DNA, 20 bp, Artificial
  CRISPR gRNA sequence
cccagctacttgggagactg

SEQ ID NO: 107687 - DNA, 20 bp, Artificial
  CRISPR gRNA sequence
gctacttgggagactgaggc

SEQ ID NO: 107688 - DNA, 20 bp, Artificial
  CRISPR gRNA sequence
ggccggaaaatcacttgaac

SEQ ID NO: 107689 - DNA, 20 bp, Artificial
  CRISPR gRNA sequence
ccggaaaatcacttgaaccg

SEQ ID NO: 107690 - DNA, 20 bp, Artificial
  CRISPR gRNA sequence
cggaaaatcacttgaaccgg

SEQ ID NO: 107691 - DNA, 20 bp, Artificial
  CRISPR gRNA sequence
aaaatcacttgaaccggagg

SEQ ID NO: 107692 - DNA, 20 bp, Artificial
  CRISPR gRNA sequence
aatcacttgaaccggaggcg

SEQ ID NO: 107693 - DNA, 20 bp, Artificial
  CRISPR gRNA sequence
atcacttgaaccggaggcgg

SEQ ID NO: 107694 - DNA, 20 bp, Artificial
  CRISPR gRNA sequence
tgaaccggaggcggaggttg

SEQ ID NO: 107695 - DNA, 20 bp, Artificial
  CRISPR gRNA sequence
ccggaggcggaggttgcagt

SEQ ID NO: 107696 - DNA, 20 bp, Artificial
  CRISPR gRNA sequence
ggcggaggttgcagtgagcc

SEQ ID NO: 107697 - DNA, 20 bp, Artificial
  CRISPR gRNA sequence
gagatcacgccactgcactc

SEQ ID NO: 107698 - DNA, 20 bp, Artificial
  CRISPR gRNA sequence
cacgccactgcactccagcc

SEQ ID NO: 107699 - DNA, 20 bp, Artificial
  CRISPR gRNA sequence
acgccactgcactccagcct

SEQ ID NO: 107700 - DNA, 20 bp, Artificial
  CRISPR gRNA sequence
ctgcactccagcctgggcga

SEQ ID NO: 107701 - DNA, 20 bp, Artificial
  CRISPR gRNA sequence
gcactccagcctgggcgaca

SEQ ID NO: 107702 - DNA, 20 bp, Artificial
  CRISPR gRNA sequence
tccagcctgggcgacagagc

SEQ ID NO: 107703 - DNA, 20 bp, Artificial
  CRISPR gRNA sequence
aaaaaataaaatacactcta

SEQ ID NO: 107704 - DNA, 20 bp, Artificial
  CRISPR gRNA sequence
attttttaatcttgccattt

SEQ ID NO: 107705 - DNA, 20 bp, Artificial
  CRISPR gRNA sequence
tgccattttggtgaatgatg

SEQ ID NO: 107706 - DNA, 20 bp, Artificial
  CRISPR gRNA sequence
aatgatgaagtactttttta

SEQ ID NO: 107707 - DNA, 20 bp, Artificial
  CRISPR gRNA sequence
tgatgaagtacttttttaca

SEQ ID NO: 107708 - DNA, 20 bp, Artificial
  CRISPR gRNA sequence
gatgaagtacttttttacag

SEQ ID NO: 107709 - DNA, 20 bp, Artificial
  CRISPR gRNA sequence
atatatattaaaaatgctga

SEQ ID NO: 107710 - DNA, 20 bp, Artificial
  CRISPR gRNA sequence
atattaaaaatgctgaaagc

SEQ ID NO: 107711 - DNA, 20 bp, Artificial
  CRISPR gRNA sequence
tattaaaaatgctgaaagcc

SEQ ID NO: 107712 - DNA, 20 bp, Artificial
  CRISPR gRNA sequence
atgctgaaagccgggtacaa

SEQ ID NO: 107713 - DNA, 20 bp, Artificial
  CRISPR gRNA sequence
atggcttatgcccataatcc

SEQ ID NO: 107714 - DNA, 20 bp, Artificial
  CRISPR gRNA sequence
tgcccataatcccagcactt

SEQ ID NO: 107715 - DNA, 20 bp, Artificial
  CRISPR gRNA sequence
gcccataatcccagcacttc

SEQ ID NO: 107716 - DNA, 20 bp, Artificial
  CRISPR gRNA sequence
ccataatcccagcacttcag

SEQ ID NO: 107717 - DNA, 20 bp, Artificial
  CRISPR gRNA sequence
cataatcccagcacttcagg

SEQ ID NO: 107718 - DNA, 20 bp, Artificial
  CRISPR gRNA sequence
tcccagcacttcaggaggct

SEQ ID NO: 107719 - DNA, 20 bp, Artificial
  CRISPR gRNA sequence
cccagcacttcaggaggctg

SEQ ID NO: 107720 - DNA, 20 bp, Artificial
  CRISPR gRNA sequence
gcacttcaggaggctgaggc

SEQ ID NO: 107721 - DNA, 20 bp, Artificial
  CRISPR gRNA sequence
cttcaggaggctgaggcgag

SEQ ID NO: 107722 - DNA, 20 bp, Artificial
  CRISPR gRNA sequence
ggaggctgaggcgagcagat

SEQ ID NO: 107723 - DNA, 20 bp, Artificial
  CRISPR gRNA sequence
gaggctgaggcgagcagatt

SEQ ID NO: 107724 - DNA, 20 bp, Artificial
  CRISPR gRNA sequence
ctgaggcgagcagattaggt

SEQ ID NO: 107725 - DNA, 20 bp, Artificial
  CRISPR gRNA sequence
tgaggcgagcagattaggtc

SEQ ID NO: 107726 - DNA, 20 bp, Artificial
  CRISPR gRNA sequence
aggcgagcagattaggtcag

SEQ ID NO: 107727 - DNA, 20 bp, Artificial
  CRISPR gRNA sequence
gcagattaggtcaggagttc

SEQ ID NO: 107728 - DNA, 20 bp, Artificial
  CRISPR gRNA sequence
ttaggtcaggagttcgagac

SEQ ID NO: 107729 - DNA, 20 bp, Artificial
  CRISPR gRNA sequence
tcaggagttcgagaccagcc

SEQ ID NO: 107730 - DNA, 20 bp, Artificial
  CRISPR gRNA sequence
caggagttcgagaccagcct

SEQ ID NO: 107731 - DNA, 20 bp, Artificial
  CRISPR gRNA sequence
cgagaccagcctgggcaaca

SEQ ID NO: 107732 - DNA, 20 bp, Artificial
  CRISPR gRNA sequence
tgaaaaatacaaaaattatc

SEQ ID NO: 107733 - DNA, 20 bp, Artificial
  CRISPR gRNA sequence
gaaaaatacaaaaattatcc

SEQ ID NO: 107734 - DNA, 20 bp, Artificial
  CRISPR gRNA sequence
atacaaaaattatccaggca

SEQ ID NO: 107735 - DNA, 20 bp, Artificial
  CRISPR gRNA sequence
caaaaattatccaggcatgg

SEQ ID NO: 107736 - DNA, 20 bp, Artificial
  CRISPR gRNA sequence
aaaaattatccaggcatggt

SEQ ID NO: 107737 - DNA, 20 bp, Artificial
  CRISPR gRNA sequence
ggcatggtaggacatgcctg

SEQ ID NO: 107738 - DNA, 20 bp, Artificial
  CRISPR gRNA sequence
gtaggacatgcctgtggtcc

SEQ ID NO: 107739 - DNA, 20 bp, Artificial
  CRISPR gRNA sequence
tgcctgtggtcccagctact

SEQ ID NO: 107740 - DNA, 20 bp, Artificial
  CRISPR gRNA sequence
gcctgtggtcccagctactt

SEQ ID NO: 107741 - DNA, 20 bp, Artificial
  CRISPR gRNA sequence
cctgtggtcccagctacttg

SEQ ID NO: 107742 - DNA, 20 bp, Artificial
  CRISPR gRNA sequence
tcccagctacttggggaact

SEQ ID NO: 107743 - DNA, 20 bp, Artificial
  CRISPR gRNA sequence
cccagctacttggggaactg

SEQ ID NO: 107744 - DNA, 20 bp, Artificial
  CRISPR gRNA sequence
agctacttggggaactgagg

SEQ ID NO: 107745 - DNA, 20 bp, Artificial
  CRISPR gRNA sequence
gctacttggggaactgaggt

SEQ ID NO: 107746 - DNA, 20 bp, Artificial
  CRISPR gRNA sequence
tacttggggaactgaggtgg

SEQ ID NO: 107747 - DNA, 20 bp, Artificial
  CRISPR gRNA sequence
acttggggaactgaggtggg

SEQ ID NO: 107748 - DNA, 20 bp, Artificial
  CRISPR gRNA sequence
ctgaggtgggaggatcattt

SEQ ID NO: 107749 - DNA, 20 bp, Artificial
  CRISPR gRNA sequence
gtgggaggatcatttgagcc

SEQ ID NO: 107750 - DNA, 20 bp, Artificial
  CRISPR gRNA sequence
tgggaggatcatttgagcct

SEQ ID NO: 107751 - DNA, 20 bp, Artificial
  CRISPR gRNA sequence
ggaggatcatttgagcctgg

SEQ ID NO: 107752 - DNA, 20 bp, Artificial
  CRISPR gRNA sequence
gaggatcatttgagcctggg

SEQ ID NO: 107753 - DNA, 20 bp, Artificial
  CRISPR gRNA sequence
gatcatttgagcctgggagg

SEQ ID NO: 107754 - DNA, 20 bp, Artificial
  CRISPR gRNA sequence
tcatttgagcctgggaggca

SEQ ID NO: 107755 - DNA, 20 bp, Artificial
  CRISPR gRNA sequence
catttgagcctgggaggcag

SEQ ID NO: 107756 - DNA, 20 bp, Artificial
  CRISPR gRNA sequence
agcctgggaggcagaggttg

SEQ ID NO: 107757 - DNA, 20 bp, Artificial
  CRISPR gRNA sequence
tgggaggcagaggttgcagt

SEQ ID NO: 107758 - DNA, 20 bp, Artificial
  CRISPR gRNA sequence
ggcagaggttgcagtgagcc

SEQ ID NO: 107759 - DNA, 20 bp, Artificial
  CRISPR gRNA sequence
agatccgcaccactgcattc

SEQ ID NO: 107760 - DNA, 20 bp, Artificial
  CRISPR gRNA sequence
cgcaccactgcattccagcc

SEQ ID NO: 107761 - DNA, 20 bp, Artificial
  CRISPR gRNA sequence
gcaccactgcattccagcct

SEQ ID NO: 107762 - DNA, 20 bp, Artificial
  CRISPR gRNA sequence
ctgcattccagcctaggcaa

SEQ ID NO: 107763 - DNA, 20 bp, Artificial
  CRISPR gRNA sequence
gcattccagcctaggcaaca

SEQ ID NO: 107764 - DNA, 20 bp, Artificial
  CRISPR gRNA sequence
tccagcctaggcaacagagc

SEQ ID NO: 107765 - DNA, 20 bp, Artificial
  CRISPR gRNA sequence
ctgtctcaaaaaaacaaaca

SEQ ID NO: 107766 - DNA, 20 bp, Artificial
  CRISPR gRNA sequence
acccaaaatgtattctactc

SEQ ID NO: 107767 - DNA, 20 bp, Artificial
  CRISPR gRNA sequence
actctagtcaaatgtgactg

SEQ ID NO: 107768 - DNA, 20 bp, Artificial
  CRISPR gRNA sequence
agtcaaatgtgactgcagcc

SEQ ID NO: 107769 - DNA, 20 bp, Artificial
  CRISPR gRNA sequence
gtcaaatgtgactgcagccc

SEQ ID NO: 107770 - DNA, 20 bp, Artificial
  CRISPR gRNA sequence
gcccaggacaacaccttgat

SEQ ID NO: 107771 - DNA, 20 bp, Artificial
  CRISPR gRNA sequence
cccaggacaacaccttgata

SEQ ID NO: 107772 - DNA, 20 bp, Artificial
  CRISPR gRNA sequence
ccaggacaacaccttgataa

SEQ ID NO: 107773 - DNA, 20 bp, Artificial
  CRISPR gRNA sequence
aacaccttgataagggcctt

SEQ ID NO: 107774 - DNA, 20 bp, Artificial
  CRISPR gRNA sequence
caccttgataagggccttga

SEQ ID NO: 107775 - DNA, 20 bp, Artificial
  CRISPR gRNA sequence
accttgataagggccttgag

SEQ ID NO: 107776 - DNA, 20 bp, Artificial
  CRISPR gRNA sequence
gggccttgagaggaccttga

SEQ ID NO: 107777 - DNA, 20 bp, Artificial
  CRISPR gRNA sequence
gaccttgaaagaatccaaca

SEQ ID NO: 107778 - DNA, 20 bp, Artificial
  CRISPR gRNA sequence
agaatccaacacagctgtgt

SEQ ID NO: 107779 - DNA, 20 bp, Artificial
  CRISPR gRNA sequence
gaatccaacacagctgtgtc

SEQ ID NO: 107780 - DNA, 20 bp, Artificial
  CRISPR gRNA sequence
gtgtcaggattcctaactca

SEQ ID NO: 107781 - DNA, 20 bp, Artificial
  CRISPR gRNA sequence
tttttttttttttttttttt

SEQ ID NO: 107782 - DNA, 20 bp, Artificial
  CRISPR gRNA sequence
tttttttttttttttttttg

SEQ ID NO: 107783 - DNA, 20 bp, Artificial
  CRISPR gRNA sequence
tttttttttttttttggaga

SEQ ID NO: 107784 - DNA, 20 bp, Artificial
  CRISPR gRNA sequence
tttttttttttttggagacg

SEQ ID NO: 107785 - DNA, 20 bp, Artificial
  CRISPR gRNA sequence
ggagacggagtgtcgctctg

SEQ ID NO: 107786 - DNA, 20 bp, Artificial
  CRISPR gRNA sequence
cggagtgtcgctctgtggct

SEQ ID NO: 107787 - DNA, 20 bp, Artificial
  CRISPR gRNA sequence
ggagtgtcgctctgtggctc

SEQ ID NO: 107788 - DNA, 20 bp, Artificial
  CRISPR gRNA sequence
tgtcgctctgtggctcaggc

SEQ ID NO: 107789 - DNA, 20 bp, Artificial
  CRISPR gRNA sequence
tcgctctgtggctcaggctg

SEQ ID NO: 107790 - DNA, 20 bp, Artificial
  CRISPR gRNA sequence
ctgtggctcaggctggagtg

SEQ ID NO: 107791 - DNA, 20 bp, Artificial
  CRISPR gRNA sequence
tggctcaggctggagtgcag

SEQ ID NO: 107792 - DNA, 20 bp, Artificial
  CRISPR gRNA sequence
ggagtgcagtggtgtgatct

SEQ ID NO: 107793 - DNA, 20 bp, Artificial
  CRISPR gRNA sequence
gtgtgatcttggctcactgc

SEQ ID NO: 107794 - DNA, 20 bp, Artificial
  CRISPR gRNA sequence
tcactgcaagctccgcctcc

SEQ ID NO: 107795 - DNA, 20 bp, Artificial
  CRISPR gRNA sequence
cactgcaagctccgcctcct

SEQ ID NO: 107796 - DNA, 20 bp, Artificial
  CRISPR gRNA sequence
ttcatgccattctcctgcct

SEQ ID NO: 107797 - DNA, 20 bp, Artificial
  CRISPR gRNA sequence
ttctcctgcctcagcctccc

SEQ ID NO: 107798 - DNA, 20 bp, Artificial
  CRISPR gRNA sequence
tcctgcctcagcctcccgag

SEQ ID NO: 107799 - DNA, 20 bp, Artificial
  CRISPR gRNA sequence
gcctcagcctcccgagtagc

SEQ ID NO: 107800 - DNA, 20 bp, Artificial
  CRISPR gRNA sequence
cctcagcctcccgagtagct

SEQ ID NO: 107801 - DNA, 20 bp, Artificial
  CRISPR gRNA sequence
ctcccgagtagctgggacta

SEQ ID NO: 107802 - DNA, 20 bp, Artificial
  CRISPR gRNA sequence
tcccgagtagctgggactac

SEQ ID NO: 107803 - DNA, 20 bp, Artificial
  CRISPR gRNA sequence
caggcgtccgccatcacgcc

SEQ ID NO: 107804 - DNA, 20 bp, Artificial
  CRISPR gRNA sequence
taattttttttttgtctttt

SEQ ID NO: 107805 - DNA, 20 bp, Artificial
  CRISPR gRNA sequence
ttttttttttgtctttttag

SEQ ID NO: 107806 - DNA, 20 bp, Artificial
  CRISPR gRNA sequence
ttttttttgtctttttagta

SEQ ID NO: 107807 - DNA, 20 bp, Artificial
  CRISPR gRNA sequence
ttttgtctttttagtagaga

SEQ ID NO: 107808 - DNA, 20 bp, Artificial
  CRISPR gRNA sequence
tttgtctttttagtagagac

SEQ ID NO: 107809 - DNA, 20 bp, Artificial
  CRISPR gRNA sequence
ttgtctttttagtagagacg

SEQ ID NO: 107810 - DNA, 20 bp, Artificial
  CRISPR gRNA sequence
cggggtttcactgtgttaac

SEQ ID NO: 107811 - DNA, 20 bp, Artificial
  CRISPR gRNA sequence
ggggtttcactgtgttaacc

SEQ ID NO: 107812 - DNA, 20 bp, Artificial
  CRISPR gRNA sequence
tttcactgtgttaaccagga

SEQ ID NO: 107813 - DNA, 20 bp, Artificial
  CRISPR gRNA sequence
accttgtgatccacccgcct

SEQ ID NO: 107814 - DNA, 20 bp, Artificial
  CRISPR gRNA sequence
ccacccgcctcggccaccca

SEQ ID NO: 107815 - DNA, 20 bp, Artificial
  CRISPR gRNA sequence
gcctcggccacccaaagtgc

SEQ ID NO: 107816 - DNA, 20 bp, Artificial
  CRISPR gRNA sequence
cctcggccacccaaagtgct

SEQ ID NO: 107817 - DNA, 20 bp, Artificial
  CRISPR gRNA sequence
cacccaaagtgctgggatta

SEQ ID NO: 107818 - DNA, 20 bp, Artificial
  CRISPR gRNA sequence
acccaaagtgctgggattac

SEQ ID NO: 107819 - DNA, 20 bp, Artificial
  CRISPR gRNA sequence
aagtgctgggattacaggtg

SEQ ID NO: 107820 - DNA, 20 bp, Artificial
  CRISPR gRNA sequence
agtgctgggattacaggtgt

SEQ ID NO: 107821 - DNA, 20 bp, Artificial
  CRISPR gRNA sequence
acaggtgtgggccaccgcac

SEQ ID NO: 107822 - DNA, 20 bp, Artificial
  CRISPR gRNA sequence
ggccaaatgtttgttgtttt

SEQ ID NO: 107823 - DNA, 20 bp, Artificial
  CRISPR gRNA sequence
tgttttaagctgctaacttc

SEQ ID NO: 107824 - DNA, 20 bp, Artificial
  CRISPR gRNA sequence
gttttaagctgctaacttct

SEQ ID NO: 107825 - DNA, 20 bp, Artificial
  CRISPR gRNA sequence
ttctaggataatttgttata

SEQ ID NO: 107826 - DNA, 20 bp, Artificial
  CRISPR gRNA sequence
gataatttgttatatggtaa

SEQ ID NO: 107827 - DNA, 20 bp, Artificial
  CRISPR gRNA sequence
ttatatggtaatagataatt

SEQ ID NO: 107828 - DNA, 20 bp, Artificial
  CRISPR gRNA sequence
tatatggtaatagataatta

SEQ ID NO: 107829 - DNA, 20 bp, Artificial
  CRISPR gRNA sequence
agataattaaggcaatgtga

SEQ ID NO: 107830 - DNA, 20 bp, Artificial
  CRISPR gRNA sequence
acagattatattcctcctat

SEQ ID NO: 107831 - DNA, 20 bp, Artificial
  CRISPR gRNA sequence
tttaatttgtatctcctatt

SEQ ID NO: 107832 - DNA, 20 bp, Artificial
  CRISPR gRNA sequence
ttgtatctcctatttggtcc

SEQ ID NO: 107833 - DNA, 20 bp, Artificial
  CRISPR gRNA sequence
tgtatctcctatttggtcct

SEQ ID NO: 107834 - DNA, 20 bp, Artificial
  CRISPR gRNA sequence
ctcctatttggtcctaggat

SEQ ID NO: 107835 - DNA, 20 bp, Artificial
  CRISPR gRNA sequence
tatttggtcctaggattgga

SEQ ID NO: 107836 - DNA, 20 bp, Artificial
  CRISPR gRNA sequence
ttggatagctaaaccttata

SEQ ID NO: 107837 - DNA, 20 bp, Artificial
  CRISPR gRNA sequence
taaaccttataaagcaatta

SEQ ID NO: 107838 - DNA, 20 bp, Artificial
  CRISPR gRNA sequence
ccttataaagcaattatgga

SEQ ID NO: 107839 - DNA, 20 bp, Artificial
  CRISPR gRNA sequence
ataaagcaattatggaaagc

SEQ ID NO: 107840 - DNA, 20 bp, Artificial
  CRISPR gRNA sequence
taaagcaattatggaaagca

SEQ ID NO: 107841 - DNA, 20 bp, Artificial
  CRISPR gRNA sequence
aaagcaattatggaaagcaa

SEQ ID NO: 107842 - DNA, 20 bp, Artificial
  CRISPR gRNA sequence
atcttctttcttttttttaa

SEQ ID NO: 107843 - DNA, 20 bp, Artificial
  CRISPR gRNA sequence
tttcttttttttaatggcta

SEQ ID NO: 107844 - DNA, 20 bp, Artificial
  CRISPR gRNA sequence
aatggctatagccactttat

SEQ ID NO: 107845 - DNA, 20 bp, Artificial
  CRISPR gRNA sequence
atggctatagccactttatt

SEQ ID NO: 107846 - DNA, 20 bp, Artificial
  CRISPR gRNA sequence
ggctatagccactttattag

SEQ ID NO: 107847 - DNA, 20 bp, Artificial
  CRISPR gRNA sequence
cactttattaggagtgttat

SEQ ID NO: 107848 - DNA, 20 bp, Artificial
  CRISPR gRNA sequence
agtgttatcagaaacctgac

SEQ ID NO: 107849 - DNA, 20 bp, Artificial
  CRISPR gRNA sequence
gttatcagaaacctgacaag

SEQ ID NO: 107850 - DNA, 20 bp, Artificial
  CRISPR gRNA sequence
aaaaatatttctctaaattt

SEQ ID NO: 107851 - DNA, 20 bp, Artificial
  CRISPR gRNA sequence
caatacaaccctttaaatgt

SEQ ID NO: 107852 - DNA, 20 bp, Artificial
  CRISPR gRNA sequence
aatacaaccctttaaatgtt

SEQ ID NO: 107853 - DNA, 20 bp, Artificial
  CRISPR gRNA sequence
aaatcctattttcatataac

SEQ ID NO: 107854 - DNA, 20 bp, Artificial
  CRISPR gRNA sequence
tagtgaacactttttttttt

SEQ ID NO: 107855 - DNA, 20 bp, Artificial
  CRISPR gRNA sequence
acttttttttttaagtgcaa

SEQ ID NO: 107856 - DNA, 20 bp, Artificial
  CRISPR gRNA sequence
ttttttttttaagtgcaaaa

SEQ ID NO: 107857 - DNA, 20 bp, Artificial
  CRISPR gRNA sequence
ttttttaagtgcaaaagaga

SEQ ID NO: 107858 - DNA, 20 bp, Artificial
  CRISPR gRNA sequence
tttaagtgcaaaagagaaag

SEQ ID NO: 107859 - DNA, 20 bp, Artificial
  CRISPR gRNA sequence
agtgcaaaagagaaagcagt

SEQ ID NO: 107860 - DNA, 20 bp, Artificial
  CRISPR gRNA sequence
gtgcaaaagagaaagcagtg

SEQ ID NO: 107861 - DNA, 20 bp, Artificial
  CRISPR gRNA sequence
gcaaaagagaaagcagtgag

SEQ ID NO: 107862 - DNA, 20 bp, Artificial
  CRISPR gRNA sequence
aaaagagaaagcagtgagga

SEQ ID NO: 107863 - DNA, 20 bp, Artificial
  CRISPR gRNA sequence
aagcagtgaggagagcccca

SEQ ID NO: 107864 - DNA, 20 bp, Artificial
  CRISPR gRNA sequence
atgtcttgtattttatattc

SEQ ID NO: 107865 - DNA, 20 bp, Artificial
  CRISPR gRNA sequence
agaatacctcccaaacttaa

SEQ ID NO: 107866 - DNA, 20 bp, Artificial
  CRISPR gRNA sequence
tacctcccaaacttaaaagc

SEQ ID NO: 107867 - DNA, 20 bp, Artificial
  CRISPR gRNA sequence
aacttaaaagccagaataca

SEQ ID NO: 107868 - DNA, 20 bp, Artificial
  CRISPR gRNA sequence
taaaagccagaatacatggc

SEQ ID NO: 107869 - DNA, 20 bp, Artificial
  CRISPR gRNA sequence
cagaatacatggctagtact

SEQ ID NO: 107870 - DNA, 20 bp, Artificial
  CRISPR gRNA sequence
tcaacaaactttttttattt

SEQ ID NO: 107871 - DNA, 20 bp, Artificial
  CRISPR gRNA sequence
atttgagcattgcttcaaca

SEQ ID NO: 107872 - DNA, 20 bp, Artificial
  CRISPR gRNA sequence
gagcattgcttcaacataga

SEQ ID NO: 107873 - DNA, 20 bp, Artificial
  CRISPR gRNA sequence
cattgcttcaacatagatgg

SEQ ID NO: 107874 - DNA, 20 bp, Artificial
  CRISPR gRNA sequence
cttcaacatagatggcagtc

SEQ ID NO: 107875 - DNA, 20 bp, Artificial
  CRISPR gRNA sequence
caacatagatggcagtctgg

SEQ ID NO: 107876 - DNA, 20 bp, Artificial
  CRISPR gRNA sequence
aacatagatggcagtctgga

SEQ ID NO: 107877 - DNA, 20 bp, Artificial
  CRISPR gRNA sequence
catagatggcagtctggaag

SEQ ID NO: 107878 - DNA, 20 bp, Artificial
  CRISPR gRNA sequence
atagatggcagtctggaagg

SEQ ID NO: 107879 - DNA, 20 bp, Artificial
  CRISPR gRNA sequence
gtctggaaggaggatacttt

SEQ ID NO: 107880 - DNA, 20 bp, Artificial
  CRISPR gRNA sequence
ggaaggaggatactttcaga

SEQ ID NO: 107881 - DNA, 20 bp, Artificial
  CRISPR gRNA sequence
ggaggatactttcagaaaga

SEQ ID NO: 107882 - DNA, 20 bp, Artificial
  CRISPR gRNA sequence
ttcagaaagatagattttta

SEQ ID NO: 107883 - DNA, 20 bp, Artificial
  CRISPR gRNA sequence
gaaagatagatttttatagc

SEQ ID NO: 107884 - DNA, 20 bp, Artificial
  CRISPR gRNA sequence
aaagatagatttttatagcc

SEQ ID NO: 107885 - DNA, 20 bp, Artificial
  CRISPR gRNA sequence
ttccatccataatttcaact

SEQ ID NO: 107886 - DNA, 20 bp, Artificial
  CRISPR gRNA sequence
tccatccataatttcaactt

SEQ ID NO: 107887 - DNA, 20 bp, Artificial
  CRISPR gRNA sequence
atttcaacttgggaccacct

SEQ ID NO: 107888 - DNA, 20 bp, Artificial
  CRISPR gRNA sequence
aacttgggaccaccttggtc

SEQ ID NO: 107889 - DNA, 20 bp, Artificial
  CRISPR gRNA sequence
tgggaccaccttggtctgga

SEQ ID NO: 107890 - DNA, 20 bp, Artificial
  CRISPR gRNA sequence
gaccaccttggtctggaaag

SEQ ID NO: 107891 - DNA, 20 bp, Artificial
  CRISPR gRNA sequence
tctggaaagaagaacatgcc

SEQ ID NO: 107892 - DNA, 20 bp, Artificial
  CRISPR gRNA sequence
aagaacatgcctagaacctt

SEQ ID NO: 107893 - DNA, 20 bp, Artificial
  CRISPR gRNA sequence
tagaaccttaagttatcaca

SEQ ID NO: 107894 - DNA, 20 bp, Artificial
  CRISPR gRNA sequence
taagttatcacaaagtctac

SEQ ID NO: 107895 - DNA, 20 bp, Artificial
  CRISPR gRNA sequence
tcacaaagtctaccagctga

SEQ ID NO: 107896 - DNA, 20 bp, Artificial
  CRISPR gRNA sequence
cacaaagtctaccagctgat

SEQ ID NO: 107897 - DNA, 20 bp, Artificial
  CRISPR gRNA sequence
gtctaccagctgataggaaa

SEQ ID NO: 107898 - DNA, 20 bp, Artificial
  CRISPR gRNA sequence
tctaccagctgataggaaaa

SEQ ID NO: 107899 - DNA, 20 bp, Artificial
  CRISPR gRNA sequence
ataggaaaaaggactactga

SEQ ID NO: 107900 - DNA, 20 bp, Artificial
  CRISPR gRNA sequence
ggaaaaaggactactgatgg

SEQ ID NO: 107901 - DNA, 20 bp, Artificial
  CRISPR gRNA sequence
gaaaaaggactactgatgga

SEQ ID NO: 107902 - DNA, 20 bp, Artificial
  CRISPR gRNA sequence
aaaggactactgatggaagg

SEQ ID NO: 107903 - DNA, 20 bp, Artificial
  CRISPR gRNA sequence
aaggactactgatggaagga

SEQ ID NO: 107904 - DNA, 20 bp, Artificial
  CRISPR gRNA sequence
tggaaggaaggtgaaaaaaa

SEQ ID NO: 107905 - DNA, 20 bp, Artificial
  CRISPR gRNA sequence
ggaaggaaggtgaaaaaaac

SEQ ID NO: 107906 - DNA, 20 bp, Artificial
  CRISPR gRNA sequence
aggtgaaaaaaacaggtcaa

SEQ ID NO: 107907 - DNA, 20 bp, Artificial
  CRISPR gRNA sequence
ggtgaaaaaaacaggtcaat

SEQ ID NO: 107908 - DNA, 20 bp, Artificial
  CRISPR gRNA sequence
ggtcaatgggttccatgtct

SEQ ID NO: 107909 - DNA, 20 bp, Artificial
  CRISPR gRNA sequence
tcaatgggttccatgtctta

SEQ ID NO: 107910 - DNA, 20 bp, Artificial
  CRISPR gRNA sequence
ccatgtcttagagacattca

SEQ ID NO: 107911 - DNA, 20 bp, Artificial
  CRISPR gRNA sequence
attcatggatcctactttgt

SEQ ID NO: 107912 - DNA, 20 bp, Artificial
  CRISPR gRNA sequence
ttcatggatcctactttgtt

SEQ ID NO: 107913 - DNA, 20 bp, Artificial
  CRISPR gRNA sequence
tcatggatcctactttgtta

SEQ ID NO: 107914 - DNA, 20 bp, Artificial
  CRISPR gRNA sequence
catggatcctactttgttag

SEQ ID NO: 107915 - DNA, 20 bp, Artificial
  CRISPR gRNA sequence
gatcctactttgttagggga

SEQ ID NO: 107916 - DNA, 20 bp, Artificial
  CRISPR gRNA sequence
ttgttaggggatagattgcc

SEQ ID NO: 107917 - DNA, 20 bp, Artificial
  CRISPR gRNA sequence
tgttaggggatagattgcct

SEQ ID NO: 107918 - DNA, 20 bp, Artificial
  CRISPR gRNA sequence
aattattttttccaaatact

SEQ ID NO: 107919 - DNA, 20 bp, Artificial
  CRISPR gRNA sequence
ccaaatactcagctcataat

SEQ ID NO: 107920 - DNA, 20 bp, Artificial
  CRISPR gRNA sequence
ctcagctcataattggcatt

SEQ ID NO: 107921 - DNA, 20 bp, Artificial
  CRISPR gRNA sequence
gctcataattggcattcaga

SEQ ID NO: 107922 - DNA, 20 bp, Artificial
  CRISPR gRNA sequence
aattggcattcagaaagtat

SEQ ID NO: 107923 - DNA, 20 bp, Artificial
  CRISPR gRNA sequence
gaaagtattggcaaataaat

SEQ ID NO: 107924 - DNA, 20 bp, Artificial
  CRISPR gRNA sequence
aataagtaaacaaatttatc

SEQ ID NO: 107925 - DNA, 20 bp, Artificial
  CRISPR gRNA sequence
tgtgaaccaacttcatttct

SEQ ID NO: 107926 - DNA, 20 bp, Artificial
  CRISPR gRNA sequence
cttcatttctaagtttatat

SEQ ID NO: 107927 - DNA, 20 bp, Artificial
  CRISPR gRNA sequence
tctaagtttatattggctgt

SEQ ID NO: 107928 - DNA, 20 bp, Artificial
  CRISPR gRNA sequence
ctaagtttatattggctgtt

SEQ ID NO: 107929 - DNA, 20 bp, Artificial
  CRISPR gRNA sequence
acatattctgaatacaaact

SEQ ID NO: 107930 - DNA, 20 bp, Artificial
  CRISPR gRNA sequence
gtattaaaaatatcttttcc

SEQ ID NO: 107931 - DNA, 20 bp, Artificial
  CRISPR gRNA sequence
tttcaatgcatattatgttt

SEQ ID NO: 107932 - DNA, 20 bp, Artificial
  CRISPR gRNA sequence
tttaaaaatatccttctcta

SEQ ID NO: 107933 - DNA, 20 bp, Artificial
  CRISPR gRNA sequence
tattttcttttgaattttcc

SEQ ID NO: 107934 - DNA, 20 bp, Artificial
  CRISPR gRNA sequence
caagtttacttttctacatt

SEQ ID NO: 107935 - DNA, 20 bp, Artificial
  CRISPR gRNA sequence
atttagatctttaatccacc

SEQ ID NO: 107936 - DNA, 20 bp, Artificial
  CRISPR gRNA sequence
agcaaatattttttaaaata

SEQ ID NO: 107937 - DNA, 20 bp, Artificial
  CRISPR gRNA sequence
ttttaaaatacagtatgaat

SEQ ID NO: 107938 - DNA, 20 bp, Artificial
  CRISPR gRNA sequence
atacagtatgaattagaaat

SEQ ID NO: 107939 - DNA, 20 bp, Artificial
  CRISPR gRNA sequence
ttcttttctgtatcattctt

SEQ ID NO: 107940 - DNA, 20 bp, Artificial
  CRISPR gRNA sequence
atattcttctatctatttct

SEQ ID NO: 107941 - DNA, 20 bp, Artificial
  CRISPR gRNA sequence
ctatttcttggctgtctctc

SEQ ID NO: 107942 - DNA, 20 bp, Artificial
  CRISPR gRNA sequence
cttggctgtctctctggttc

SEQ ID NO: 107943 - DNA, 20 bp, Artificial
  CRISPR gRNA sequence
tctggttccagtatctttct

SEQ ID NO: 107944 - DNA, 20 bp, Artificial
  CRISPR gRNA sequence
ctggttccagtatctttctc

SEQ ID NO: 107945 - DNA, 20 bp, Artificial
  CRISPR gRNA sequence
tccagtatctttctcaggcc

SEQ ID NO: 107946 - DNA, 20 bp, Artificial
  CRISPR gRNA sequence
ccagtatctttctcaggcca

SEQ ID NO: 107947 - DNA, 20 bp, Artificial
  CRISPR gRNA sequence
ttttaatctaaaattatatg

SEQ ID NO: 107948 - DNA, 20 bp, Artificial
  CRISPR gRNA sequence
ttatatgcagaatttttcat

SEQ ID NO: 107949 - DNA, 20 bp, Artificial
  CRISPR gRNA sequence
tgcagaatttttcatgagac

SEQ ID NO: 107950 - DNA, 20 bp, Artificial
  CRISPR gRNA sequence
tggacatctctactttttct

SEQ ID NO: 107951 - DNA, 20 bp, Artificial
  CRISPR gRNA sequence
gacatctctactttttctta

SEQ ID NO: 107952 - DNA, 20 bp, Artificial
  CRISPR gRNA sequence
acatctctactttttcttag

SEQ ID NO: 107953 - DNA, 20 bp, Artificial
  CRISPR gRNA sequence
catctctactttttcttaga

SEQ ID NO: 107954 - DNA, 20 bp, Artificial
  CRISPR gRNA sequence
tactttttcttagagggtgc

SEQ ID NO: 107955 - DNA, 20 bp, Artificial
  CRISPR gRNA sequence
ttagagggtgcaagctttac

SEQ ID NO: 107956 - DNA, 20 bp, Artificial
  CRISPR gRNA sequence
tagagggtgcaagctttact

SEQ ID NO: 107957 - DNA, 20 bp, Artificial
  CRISPR gRNA sequence
gctttactaggattctaaaa

SEQ ID NO: 107958 - DNA, 20 bp, Artificial
  CRISPR gRNA sequence
tttactaggattctaaaata

SEQ ID NO: 107959 - DNA, 20 bp, Artificial
  CRISPR gRNA sequence
atagagaatacaattcaaaa

SEQ ID NO: 107960 - DNA, 20 bp, Artificial
  CRISPR gRNA sequence
tagagaatacaattcaaaaa

SEQ ID NO: 107961 - DNA, 20 bp, Artificial
  CRISPR gRNA sequence
aatacaattcaaaaaaggtt

SEQ ID NO: 107962 - DNA, 20 bp, Artificial
  CRISPR gRNA sequence
acaattcaaaaaaggttaag

SEQ ID NO: 107963 - DNA, 20 bp, Artificial
  CRISPR gRNA sequence
attcaaaaaaggttaagaag

SEQ ID NO: 107964 - DNA, 20 bp, Artificial
  CRISPR gRNA sequence
aagtagtcttctttaaaaaa

SEQ ID NO: 107965 - DNA, 20 bp, Artificial
  CRISPR gRNA sequence
aatggctactcaacactaat

SEQ ID NO: 107966 - DNA, 20 bp, Artificial
  CRISPR gRNA sequence
agaaaaaaaactcctataca

SEQ ID NO: 107967 - DNA, 20 bp, Artificial
  CRISPR gRNA sequence
gaaaaaaaactcctatacaa

SEQ ID NO: 107968 - DNA, 20 bp, Artificial
  CRISPR gRNA sequence
aaaaaaaactcctatacaaa

SEQ ID NO: 107969 - DNA, 20 bp, Artificial
  CRISPR gRNA sequence
aaaaaaactcctatacaaag

SEQ ID NO: 107970 - DNA, 20 bp, Artificial
  CRISPR gRNA sequence
ctcctatacaaaggggatta

SEQ ID NO: 107971 - DNA, 20 bp, Artificial
  CRISPR gRNA sequence
acaaaggggattaaagcctt

SEQ ID NO: 107972 - DNA, 20 bp, Artificial
  CRISPR gRNA sequence
attaaagccttaagtattgt

SEQ ID NO: 107973 - DNA, 20 bp, Artificial
  CRISPR gRNA sequence
ttaaagccttaagtattgta

SEQ ID NO: 107974 - DNA, 20 bp, Artificial
  CRISPR gRNA sequence
taaagccttaagtattgtaa

SEQ ID NO: 107975 - DNA, 20 bp, Artificial
  CRISPR gRNA sequence
aagccttaagtattgtaagg

SEQ ID NO: 107976 - DNA, 20 bp, Artificial
  CRISPR gRNA sequence
agccttaagtattgtaaggg

SEQ ID NO: 107977 - DNA, 20 bp, Artificial
  CRISPR gRNA sequence
aagtattgtaagggaggcta

SEQ ID NO: 107978 - DNA, 20 bp, Artificial
  CRISPR gRNA sequence
ggaggctatggaatctcacc

SEQ ID NO: 107979 - DNA, 20 bp, Artificial
  CRISPR gRNA sequence
aggctatggaatctcaccta

SEQ ID NO: 107980 - DNA, 20 bp, Artificial
  CRISPR gRNA sequence
gctatggaatctcacctaga

SEQ ID NO: 107981 - DNA, 20 bp, Artificial
  CRISPR gRNA sequence
agagagctttatttacgtaa

SEQ ID NO: 107982 - DNA, 20 bp, Artificial
  CRISPR gRNA sequence
gtaacagaatatattttttt

SEQ ID NO: 107983 - DNA, 20 bp, Artificial
  CRISPR gRNA sequence
agaatatatttttttcagct

SEQ ID NO: 107984 - DNA, 20 bp, Artificial
  CRISPR gRNA sequence
tatatttttttcagcttggt

SEQ ID NO: 107985 - DNA, 20 bp, Artificial
  CRISPR gRNA sequence
tttttcagcttggttagtta

SEQ ID NO: 107986 - DNA, 20 bp, Artificial
  CRISPR gRNA sequence
tggttagttatagccctact

SEQ ID NO: 107987 - DNA, 20 bp, Artificial
  CRISPR gRNA sequence
ttagttatagccctacttgg

SEQ ID NO: 107988 - DNA, 20 bp, Artificial
  CRISPR gRNA sequence
gttatagccctacttggaag

SEQ ID NO: 107989 - DNA, 20 bp, Artificial
  CRISPR gRNA sequence
ttatagccctacttggaagc

SEQ ID NO: 107990 - DNA, 20 bp, Artificial
  CRISPR gRNA sequence
tatagccctacttggaagca

SEQ ID NO: 107991 - DNA, 20 bp, Artificial
  CRISPR gRNA sequence
agcagggaaataactatttg

SEQ ID NO: 107992 - DNA, 20 bp, Artificial
  CRISPR gRNA sequence
gcagggaaataactatttga

SEQ ID NO: 107993 - DNA, 20 bp, Artificial
  CRISPR gRNA sequence
aactatttgaaggttcctta

SEQ ID NO: 107994 - DNA, 20 bp, Artificial
  CRISPR gRNA sequence
ataaaaccccataaaaatca

SEQ ID NO: 107995 - DNA, 20 bp, Artificial
  CRISPR gRNA sequence
cccataaaaatcacagaatt

SEQ ID NO: 107996 - DNA, 20 bp, Artificial
  CRISPR gRNA sequence
cataaaaatcacagaattta

SEQ ID NO: 107997 - DNA, 20 bp, Artificial
  CRISPR gRNA sequence
aaaatcacagaatttagagc

SEQ ID NO: 107998 - DNA, 20 bp, Artificial
  CRISPR gRNA sequence
tttagagctagaatgaaccc

SEQ ID NO: 107999 - DNA, 20 bp, Artificial
  CRISPR gRNA sequence
tctcatataaattttatttt

SEQ ID NO: 108000 - DNA, 20 bp, Artificial
  CRISPR gRNA sequence
tataaattttatttttggat

SEQ ID NO: 108001 - DNA, 20 bp, Artificial
  CRISPR gRNA sequence
aaaccgacaattaaataact

SEQ ID NO: 108002 - DNA, 20 bp, Artificial
  CRISPR gRNA sequence
gacaattaaataacttggcc

SEQ ID NO: 108003 - DNA, 20 bp, Artificial
  CRISPR gRNA sequence
ttaaataacttggccaagat

SEQ ID NO: 108004 - DNA, 20 bp, Artificial
  CRISPR gRNA sequence
agatcagaatgcttatttaa

SEQ ID NO: 108005 - DNA, 20 bp, Artificial
  CRISPR gRNA sequence
tcagaatgcttatttaatgg

SEQ ID NO: 108006 - DNA, 20 bp, Artificial
  CRISPR gRNA sequence
tgcttatttaatggcagacc

SEQ ID NO: 108007 - DNA, 20 bp, Artificial
  CRISPR gRNA sequence
aatggcagacctggtaatga

SEQ ID NO: 108008 - DNA, 20 bp, Artificial
  CRISPR gRNA sequence
cagacctggtaatgaaagct

SEQ ID NO: 108009 - DNA, 20 bp, Artificial
  CRISPR gRNA sequence
agcttggaccactacactca

SEQ ID NO: 108010 - DNA, 20 bp, Artificial
  CRISPR gRNA sequence
accacattgtctctactcaa

SEQ ID NO: 108011 - DNA, 20 bp, Artificial
  CRISPR gRNA sequence
acattgtctctactcaacag

SEQ ID NO: 108012 - DNA, 20 bp, Artificial
  CRISPR gRNA sequence
attgtctctactcaacagtg

SEQ ID NO: 108013 - DNA, 20 bp, Artificial
  CRISPR gRNA sequence
gtctctactcaacagtggag

SEQ ID NO: 108014 - DNA, 20 bp, Artificial
  CRISPR gRNA sequence
tctctactcaacagtggaga

SEQ ID NO: 108015 - DNA, 20 bp, Artificial
  CRISPR gRNA sequence
actcaacagtggagaaggcg

SEQ ID NO: 108016 - DNA, 20 bp, Artificial
  CRISPR gRNA sequence
aacagtggagaaggcgcagc

SEQ ID NO: 108017 - DNA, 20 bp, Artificial
  CRISPR gRNA sequence
acagtggagaaggcgcagca

SEQ ID NO: 108018 - DNA, 20 bp, Artificial
  CRISPR gRNA sequence
cagtggagaaggcgcagcaa

SEQ ID NO: 108019 - DNA, 20 bp, Artificial
  CRISPR gRNA sequence
agtggagaaggcgcagcaag

SEQ ID NO: 108020 - DNA, 20 bp, Artificial
  CRISPR gRNA sequence
gtggagaaggcgcagcaagg

SEQ ID NO: 108021 - DNA, 20 bp, Artificial
  CRISPR gRNA sequence
gaaggcgcagcaagggggac

SEQ ID NO: 108022 - DNA, 20 bp, Artificial
  CRISPR gRNA sequence
aggcgcagcaagggggactg

SEQ ID NO: 108023 - DNA, 20 bp, Artificial
  CRISPR gRNA sequence
gcgcagcaagggggactgga

SEQ ID NO: 108024 - DNA, 20 bp, Artificial
  CRISPR gRNA sequence
cgcagcaagggggactggag

SEQ ID NO: 108025 - DNA, 20 bp, Artificial
  CRISPR gRNA sequence
agcaagggggactggagagg

SEQ ID NO: 108026 - DNA, 20 bp, Artificial
  CRISPR gRNA sequence
gggggactggagaggaagca

SEQ ID NO: 108027 - DNA, 20 bp, Artificial
  CRISPR gRNA sequence
gggactggagaggaagcaaa

SEQ ID NO: 108028 - DNA, 20 bp, Artificial
  CRISPR gRNA sequence
gactggagaggaagcaaaga

SEQ ID NO: 108029 - DNA, 20 bp, Artificial
  CRISPR gRNA sequence
tggagaggaagcaaagagag

SEQ ID NO: 108030 - DNA, 20 bp, Artificial
  CRISPR gRNA sequence
aggaagcaaagagagaagaa

SEQ ID NO: 108031 - DNA, 20 bp, Artificial
  CRISPR gRNA sequence
agcaaagagagaagaacaga

SEQ ID NO: 108032 - DNA, 20 bp, Artificial
  CRISPR gRNA sequence
gcaaagagagaagaacagaa

SEQ ID NO: 108033 - DNA, 20 bp, Artificial
  CRISPR gRNA sequence
agagaagaacagaaaggata

SEQ ID NO: 108034 - DNA, 20 bp, Artificial
  CRISPR gRNA sequence
gaacagaaaggatatagcaa

SEQ ID NO: 108035 - DNA, 20 bp, Artificial
  CRISPR gRNA sequence
aacagaaaggatatagcaat

SEQ ID NO: 108036 - DNA, 20 bp, Artificial
  CRISPR gRNA sequence
acagaaaggatatagcaata

SEQ ID NO: 108037 - DNA, 20 bp, Artificial
  CRISPR gRNA sequence
ggatatagcaatagggaatc

SEQ ID NO: 108038 - DNA, 20 bp, Artificial
  CRISPR gRNA sequence
gatatagcaatagggaatca

SEQ ID NO: 108039 - DNA, 20 bp, Artificial
  CRISPR gRNA sequence
tagcaatagggaatcaagga

SEQ ID NO: 108040 - DNA, 20 bp, Artificial
  CRISPR gRNA sequence
caaggaaagcacatgctgaa

SEQ ID NO: 108041 - DNA, 20 bp, Artificial
  CRISPR gRNA sequence
acatgctgaaaagatattta

SEQ ID NO: 108042 - DNA, 20 bp, Artificial
  CRISPR gRNA sequence
aagcctcatatatttatgca

SEQ ID NO: 108043 - DNA, 20 bp, Artificial
  CRISPR gRNA sequence
gcctcatatatttatgcaaa

SEQ ID NO: 108044 - DNA, 20 bp, Artificial
  CRISPR gRNA sequence
tgaaaactatttttaatccc

SEQ ID NO: 108045 - DNA, 20 bp, Artificial
  CRISPR gRNA sequence
tcccaagtacaattctatct

SEQ ID NO: 108046 - DNA, 20 bp, Artificial
  CRISPR gRNA sequence
ctatcttggcaaaaatatgc

SEQ ID NO: 108047 - DNA, 20 bp, Artificial
  CRISPR gRNA sequence
tcttggcaaaaatatgccag

SEQ ID NO: 108048 - DNA, 20 bp, Artificial
  CRISPR gRNA sequence
cttggcaaaaatatgccagt

SEQ ID NO: 108049 - DNA, 20 bp, Artificial
  CRISPR gRNA sequence
tatactcttaccctttaccc

SEQ ID NO: 108050 - DNA, 20 bp, Artificial
  CRISPR gRNA sequence
cccaagcaatccccaatcca

SEQ ID NO: 108051 - DNA, 20 bp, Artificial
  CRISPR gRNA sequence
caatccaaagaaattatcct

SEQ ID NO: 108052 - DNA, 20 bp, Artificial
  CRISPR gRNA sequence
aagaaattatcctgagaatt

SEQ ID NO: 108053 - DNA, 20 bp, Artificial
  CRISPR gRNA sequence
tgcccaaatgtttacctaca

SEQ ID NO: 108054 - DNA, 20 bp, Artificial
  CRISPR gRNA sequence
gcccaaatgtttacctacaa

SEQ ID NO: 108055 - DNA, 20 bp, Artificial
  CRISPR gRNA sequence
cttaactatattttataaat

SEQ ID NO: 108056 - DNA, 20 bp, Artificial
  CRISPR gRNA sequence
attagaaattctgattcatc

SEQ ID NO: 108057 - DNA, 20 bp, Artificial
  CRISPR gRNA sequence
aagttgactgaacattatga

SEQ ID NO: 108058 - DNA, 20 bp, Artificial
  CRISPR gRNA sequence
aaaacacaaccccacatgca

SEQ ID NO: 108059 - DNA, 20 bp, Artificial
  CRISPR gRNA sequence
aattatgcataaaaacacaa

SEQ ID NO: 108060 - DNA, 20 bp, Artificial
  CRISPR gRNA sequence
aacacaaaagaatacacaaa

SEQ ID NO: 108061 - DNA, 20 bp, Artificial
  CRISPR gRNA sequence
aaagaatacacaaaaagtac

SEQ ID NO: 108062 - DNA, 20 bp, Artificial
  CRISPR gRNA sequence
aaagtacaagtttgatttat

SEQ ID NO: 108063 - DNA, 20 bp, Artificial
  CRISPR gRNA sequence
gtacaagtttgatttatgag

SEQ ID NO: 108064 - DNA, 20 bp, Artificial
  CRISPR gRNA sequence
caagtttgatttatgagcag

SEQ ID NO: 108065 - DNA, 20 bp, Artificial
  CRISPR gRNA sequence
aagtttgatttatgagcagt

SEQ ID NO: 108066 - DNA, 20 bp, Artificial
  CRISPR gRNA sequence
atttatgagcagtgggatca

SEQ ID NO: 108067 - DNA, 20 bp, Artificial
  CRISPR gRNA sequence
tttttcaacttaaattcctc

SEQ ID NO: 108068 - DNA, 20 bp, Artificial
  CRISPR gRNA sequence
ttaaattcctccagaaaact

SEQ ID NO: 108069 - DNA, 20 bp, Artificial
  CRISPR gRNA sequence
gttgaaacaatataaacatt

SEQ ID NO: 108070 - DNA, 20 bp, Artificial
  CRISPR gRNA sequence
aaacaatataaacatttaga

SEQ ID NO: 108071 - DNA, 20 bp, Artificial
  CRISPR gRNA sequence
acaatataaacatttagata

SEQ ID NO: 108072 - DNA, 20 bp, Artificial
  CRISPR gRNA sequence
catttagatagagtaactaa

SEQ ID NO: 108073 - DNA, 20 bp, Artificial
  CRISPR gRNA sequence
tgactataaacatatactca

SEQ ID NO: 108074 - DNA, 20 bp, Artificial
  CRISPR gRNA sequence
gactataaacatatactcat

SEQ ID NO: 108075 - DNA, 20 bp, Artificial
  CRISPR gRNA sequence
actataaacatatactcatg

SEQ ID NO: 108076 - DNA, 20 bp, Artificial
  CRISPR gRNA sequence
ctataaacatatactcatgg

SEQ ID NO: 108077 - DNA, 20 bp, Artificial
  CRISPR gRNA sequence
tataaacatatactcatggg

SEQ ID NO: 108078 - DNA, 20 bp, Artificial
  CRISPR gRNA sequence
aacatatactcatggggggt

SEQ ID NO: 108079 - DNA, 20 bp, Artificial
  CRISPR gRNA sequence
ggggttggttatgaattaca

SEQ ID NO: 108080 - DNA, 20 bp, Artificial
  CRISPR gRNA sequence
tggttatgaattacaaagat

SEQ ID NO: 108081 - DNA, 20 bp, Artificial
  CRISPR gRNA sequence
tttcaatattaacccacccc

SEQ ID NO: 108082 - DNA, 20 bp, Artificial
  CRISPR gRNA sequence
attaacccaccccaagtcaa

SEQ ID NO: 108083 - DNA, 20 bp, Artificial
  CRISPR gRNA sequence
catttccttattcttattaa

SEQ ID NO: 108084 - DNA, 20 bp, Artificial
  CRISPR gRNA sequence
tattcttattaatggacact

SEQ ID NO: 108085 - DNA, 20 bp, Artificial
  CRISPR gRNA sequence
attgcaattttattttttgc

SEQ ID NO: 108086 - DNA, 20 bp, Artificial
  CRISPR gRNA sequence
tgctagtacaatgctatgaa

SEQ ID NO: 108087 - DNA, 20 bp, Artificial
  CRISPR gRNA sequence
tattgatgcttttcttccta

SEQ ID NO: 108088 - DNA, 20 bp, Artificial
  CRISPR gRNA sequence
attgatgcttttcttcctat

SEQ ID NO: 108089 - DNA, 20 bp, Artificial
  CRISPR gRNA sequence
atgcttttcttcctatagga

SEQ ID NO: 108090 - DNA, 20 bp, Artificial
  CRISPR gRNA sequence
cttcctataggacagattct

SEQ ID NO: 108091 - DNA, 20 bp, Artificial
  CRISPR gRNA sequence
cctataggacagattctcag

SEQ ID NO: 108092 - DNA, 20 bp, Artificial
  CRISPR gRNA sequence
ataggacagattctcagaag

SEQ ID NO: 108093 - DNA, 20 bp, Artificial
  CRISPR gRNA sequence
taggacagattctcagaagt

SEQ ID NO: 108094 - DNA, 20 bp, Artificial
  CRISPR gRNA sequence
attctcagaagtgggactgc

SEQ ID NO: 108095 - DNA, 20 bp, Artificial
  CRISPR gRNA sequence
caaatattcattgtatttaa

SEQ ID NO: 108096 - DNA, 20 bp, Artificial
  CRISPR gRNA sequence
tattcattgtatttaacaga

SEQ ID NO: 108097 - DNA, 20 bp, Artificial
  CRISPR gRNA sequence
cattgtatttaacagatagt

SEQ ID NO: 108098 - DNA, 20 bp, Artificial
  CRISPR gRNA sequence
attgtatttaacagatagtg

SEQ ID NO: 108099 - DNA, 20 bp, Artificial
  CRISPR gRNA sequence
gcctttccaaaataactcta

SEQ ID NO: 108100 - DNA, 20 bp, Artificial
  CRISPR gRNA sequence
tttctccacatccatcctaa

SEQ ID NO: 108101 - DNA, 20 bp, Artificial
  CRISPR gRNA sequence
ctccacatccatcctaacag

SEQ ID NO: 108102 - DNA, 20 bp, Artificial
  CRISPR gRNA sequence
tttttttttgccatctcgat

SEQ ID NO: 108103 - DNA, 20 bp, Artificial
  CRISPR gRNA sequence
aattttaaaatatgatgcca

SEQ ID NO: 108104 - DNA, 20 bp, Artificial
  CRISPR gRNA sequence
ttttaaaatatgatgccaca

SEQ ID NO: 108105 - DNA, 20 bp, Artificial
  CRISPR gRNA sequence
ttaatctcttcttttttttt

SEQ ID NO: 108106 - DNA, 20 bp, Artificial
  CRISPR gRNA sequence
tctcttctttttttttgaga

SEQ ID NO: 108107 - DNA, 20 bp, Artificial
  CRISPR gRNA sequence
tttgagacagaatcttgctc

SEQ ID NO: 108108 - DNA, 20 bp, Artificial
  CRISPR gRNA sequence
cagaatcttgctctggtgcc

SEQ ID NO: 108109 - DNA, 20 bp, Artificial
  CRISPR gRNA sequence
tcttgctctggtgcccagcc

SEQ ID NO: 108110 - DNA, 20 bp, Artificial
  CRISPR gRNA sequence
ttgctctggtgcccagcctg

SEQ ID NO: 108111 - DNA, 20 bp, Artificial
  CRISPR gRNA sequence
ctggtgcccagcctggagtg

SEQ ID NO: 108112 - DNA, 20 bp, Artificial
  CRISPR gRNA sequence
gtgcccagcctggagtgcag

SEQ ID NO: 108113 - DNA, 20 bp, Artificial
  CRISPR gRNA sequence
ggagtgcagtggcacaatct

SEQ ID NO: 108114 - DNA, 20 bp, Artificial
  CRISPR gRNA sequence
ttactgcaacctccgcctcc

SEQ ID NO: 108115 - DNA, 20 bp, Artificial
  CRISPR gRNA sequence
tactgcaacctccgcctcct

SEQ ID NO: 108116 - DNA, 20 bp, Artificial
  CRISPR gRNA sequence
aacctccgcctcctgggttc

SEQ ID NO: 108117 - DNA, 20 bp, Artificial
  CRISPR gRNA sequence
atcttatgcctcaacccccc

SEQ ID NO: 108118 - DNA, 20 bp, Artificial
  CRISPR gRNA sequence
ttatgcctcaaccccccaag

SEQ ID NO: 108119 - DNA, 20 bp, Artificial
  CRISPR gRNA sequence
gcctcaaccccccaagtagc

SEQ ID NO: 108120 - DNA, 20 bp, Artificial
  CRISPR gRNA sequence
cctcaaccccccaagtagct

SEQ ID NO: 108121 - DNA, 20 bp, Artificial
  CRISPR gRNA sequence
cccccaagtagctgggatta

SEQ ID NO: 108122 - DNA, 20 bp, Artificial
  CRISPR gRNA sequence
ccccaagtagctgggattac

SEQ ID NO: 108123 - DNA, 20 bp, Artificial
  CRISPR gRNA sequence
caggtgcgtgccaccacgcc

SEQ ID NO: 108124 - DNA, 20 bp, Artificial
  CRISPR gRNA sequence
cccggctaattttttatttt

SEQ ID NO: 108125 - DNA, 20 bp, Artificial
  CRISPR gRNA sequence
ggctaattttttatttttag

SEQ ID NO: 108126 - DNA, 20 bp, Artificial
  CRISPR gRNA sequence
ctaattttttatttttagta

SEQ ID NO: 108127 - DNA, 20 bp, Artificial
  CRISPR gRNA sequence
ttttttatttttagtagaga

SEQ ID NO: 108128 - DNA, 20 bp, Artificial
  CRISPR gRNA sequence
tttttatttttagtagagat

SEQ ID NO: 108129 - DNA, 20 bp, Artificial
  CRISPR gRNA sequence
ttttatttttagtagagatg

SEQ ID NO: 108130 - DNA, 20 bp, Artificial
  CRISPR gRNA sequence
gagatggggttttgtcatgt

SEQ ID NO: 108131 - DNA, 20 bp, Artificial
  CRISPR gRNA sequence
tggggttttgtcatgttggc

SEQ ID NO: 108132 - DNA, 20 bp, Artificial
  CRISPR gRNA sequence
ggggttttgtcatgttggcc

SEQ ID NO: 108133 - DNA, 20 bp, Artificial
  CRISPR gRNA sequence
ttttgtcatgttggccaggc

SEQ ID NO: 108134 - DNA, 20 bp, Artificial
  CRISPR gRNA sequence
ccaggctggtcttgaactcc

SEQ ID NO: 108135 - DNA, 20 bp, Artificial
  CRISPR gRNA sequence
ggtcttgaactcctggcctc

SEQ ID NO: 108136 - DNA, 20 bp, Artificial
  CRISPR gRNA sequence
ctcaagtgatccacctgcct

SEQ ID NO: 108137 - DNA, 20 bp, Artificial
  CRISPR gRNA sequence
ccacctgccttggcctcccc

SEQ ID NO: 108138 - DNA, 20 bp, Artificial
  CRISPR gRNA sequence
gccttggcctccccaagtgc

SEQ ID NO: 108139 - DNA, 20 bp, Artificial
  CRISPR gRNA sequence
ccttggcctccccaagtgct

SEQ ID NO: 108140 - DNA, 20 bp, Artificial
  CRISPR gRNA sequence
ctccccaagtgctgggatca

SEQ ID NO: 108141 - DNA, 20 bp, Artificial
  CRISPR gRNA sequence
tccccaagtgctgggatcac

SEQ ID NO: 108142 - DNA, 20 bp, Artificial
  CRISPR gRNA sequence
agtgctgggatcacaggcat

SEQ ID NO: 108143 - DNA, 20 bp, Artificial
  CRISPR gRNA sequence
caggcatgagccactgcgcc

SEQ ID NO: 108144 - DNA, 20 bp, Artificial
  CRISPR gRNA sequence
tttgttttctgtttctcaat

SEQ ID NO: 108145 - DNA, 20 bp, Artificial
  CRISPR gRNA sequence
ttctcaatcagtgtttcaac

SEQ ID NO: 108146 - DNA, 20 bp, Artificial
  CRISPR gRNA sequence
actggatttacctgttttat

SEQ ID NO: 108147 - DNA, 20 bp, Artificial
  CRISPR gRNA sequence
attggtctgcttaaacaatc

SEQ ID NO: 108148 - DNA, 20 bp, Artificial
  CRISPR gRNA sequence
tatttatcctttctatacgt

SEQ ID NO: 108149 - DNA, 20 bp, Artificial
  CRISPR gRNA sequence
agttttctacttaattaatt

SEQ ID NO: 108150 - DNA, 20 bp, Artificial
  CRISPR gRNA sequence
aaataaaatatactataaac

SEQ ID NO: 108151 - DNA, 20 bp, Artificial
  CRISPR gRNA sequence
taacctcttcatatacttta

SEQ ID NO: 108152 - DNA, 20 bp, Artificial
  CRISPR gRNA sequence
catatactttacagcaattc

SEQ ID NO: 108153 - DNA, 20 bp, Artificial
  CRISPR gRNA sequence
caagatcatgcctaatatct

SEQ ID NO: 108154 - DNA, 20 bp, Artificial
  CRISPR gRNA sequence
cctaatatcttagtcattac

SEQ ID NO: 108155 - DNA, 20 bp, Artificial
  CRISPR gRNA sequence
taatatcttagtcattactg

SEQ ID NO: 108156 - DNA, 20 bp, Artificial
  CRISPR gRNA sequence
ggagctgtccaatttctgca

SEQ ID NO: 108157 - DNA, 20 bp, Artificial
  CRISPR gRNA sequence
gtccaatttctgcatagttc

SEQ ID NO: 108158 - DNA, 20 bp, Artificial
  CRISPR gRNA sequence
atagttctagtttatatcac

SEQ ID NO: 108159 - DNA, 20 bp, Artificial
  CRISPR gRNA sequence
tttatatcactggtactata

SEQ ID NO: 108160 - DNA, 20 bp, Artificial
  CRISPR gRNA sequence
ttatatcactggtactataa

SEQ ID NO: 108161 - DNA, 20 bp, Artificial
  CRISPR gRNA sequence
tatcactggtactataaagg

SEQ ID NO: 108162 - DNA, 20 bp, Artificial
  CRISPR gRNA sequence
aatcaactgaatgcaaaatg

SEQ ID NO: 108163 - DNA, 20 bp, Artificial
  CRISPR gRNA sequence
atcaactgaatgcaaaatgt

SEQ ID NO: 108164 - DNA, 20 bp, Artificial
  CRISPR gRNA sequence
actgaatgcaaaatgtgggt

SEQ ID NO: 108165 - DNA, 20 bp, Artificial
  CRISPR gRNA sequence
ctgaatgcaaaatgtgggtt

SEQ ID NO: 108166 - DNA, 20 bp, Artificial
  CRISPR gRNA sequence
aatgcaaaatgtgggttagg

SEQ ID NO: 108167 - DNA, 20 bp, Artificial
  CRISPR gRNA sequence
gcaaaatgtgggttaggaag

SEQ ID NO: 108168 - DNA, 20 bp, Artificial
  CRISPR gRNA sequence
atgcaatatcaattatcaaa

SEQ ID NO: 108169 - DNA, 20 bp, Artificial
  CRISPR gRNA sequence
tgcaatatcaattatcaaat

SEQ ID NO: 108170 - DNA, 20 bp, Artificial
  CRISPR gRNA sequence
ttgctgcaaaccctgtgttc

SEQ ID NO: 108171 - DNA, 20 bp, Artificial
  CRISPR gRNA sequence
caaaccctgtgttccagaaa

SEQ ID NO: 108172 - DNA, 20 bp, Artificial
  CRISPR gRNA sequence
aaaccctgtgttccagaaac

SEQ ID NO: 108173 - DNA, 20 bp, Artificial
  CRISPR gRNA sequence
agaaacaggtacttgcatga

SEQ ID NO: 108174 - DNA, 20 bp, Artificial
  CRISPR gRNA sequence
gatggtttgaccttgtccac

SEQ ID NO: 108175 - DNA, 20 bp, Artificial
  CRISPR gRNA sequence
atggtttgaccttgtccacc

SEQ ID NO: 108176 - DNA, 20 bp, Artificial
  CRISPR gRNA sequence
tggtttgaccttgtccacca

SEQ ID NO: 108177 - DNA, 20 bp, Artificial
  CRISPR gRNA sequence
ttgaccttgtccaccaggga

SEQ ID NO: 108178 - DNA, 20 bp, Artificial
  CRISPR gRNA sequence
cttgtccaccagggacagcc

SEQ ID NO: 108179 - DNA, 20 bp, Artificial
  CRISPR gRNA sequence
agggacagcctggaccatga

SEQ ID NO: 108180 - DNA, 20 bp, Artificial
  CRISPR gRNA sequence
gggacagcctggaccatgat

SEQ ID NO: 108181 - DNA, 20 bp, Artificial
  CRISPR gRNA sequence
cagcctggaccatgatgggt

SEQ ID NO: 108182 - DNA, 20 bp, Artificial
  CRISPR gRNA sequence
ctggaccatgatgggttggc

SEQ ID NO: 108183 - DNA, 20 bp, Artificial
  CRISPR gRNA sequence
ggttggccagttgatgtgat

SEQ ID NO: 108184 - DNA, 20 bp, Artificial
  CRISPR gRNA sequence
ggccagttgatgtgattagc

SEQ ID NO: 108185 - DNA, 20 bp, Artificial
  CRISPR gRNA sequence
ccactgacctgcaccattaa

SEQ ID NO: 108186 - DNA, 20 bp, Artificial
  CRISPR gRNA sequence
gcaccattaatggctgccct

SEQ ID NO: 108187 - DNA, 20 bp, Artificial
  CRISPR gRNA sequence
ttaatggctgcccttggacc

SEQ ID NO: 108188 - DNA, 20 bp, Artificial
  CRISPR gRNA sequence
gacctagaatgaaataaaat

SEQ ID NO: 108189 - DNA, 20 bp, Artificial
  CRISPR gRNA sequence
taagaacaatgaaataacat

SEQ ID NO: 108190 - DNA, 20 bp, Artificial
  CRISPR gRNA sequence
aaataacataagacacaaaa

SEQ ID NO: 108191 - DNA, 20 bp, Artificial
  CRISPR gRNA sequence
cacaaaatggtttttaccaa

SEQ ID NO: 108192 - DNA, 20 bp, Artificial
  CRISPR gRNA sequence
ttttaccaaaagacaatcac

SEQ ID NO: 108193 - DNA, 20 bp, Artificial
  CRISPR gRNA sequence
gaactattctgctgccttgc

SEQ ID NO: 108194 - DNA, 20 bp, Artificial
  CRISPR gRNA sequence
attctgctgccttgctagaa

SEQ ID NO: 108195 - DNA, 20 bp, Artificial
  CRISPR gRNA sequence
ttctgctgccttgctagaaa

SEQ ID NO: 108196 - DNA, 20 bp, Artificial
  CRISPR gRNA sequence
ctgccttgctagaaaaggaa

SEQ ID NO: 108197 - DNA, 20 bp, Artificial
  CRISPR gRNA sequence
tgccttgctagaaaaggaaa

SEQ ID NO: 108198 - DNA, 20 bp, Artificial
  CRISPR gRNA sequence
cttgctagaaaaggaaaagg

SEQ ID NO: 108199 - DNA, 20 bp, Artificial
  CRISPR gRNA sequence
tagaaaaggaaaaggtagaa

SEQ ID NO: 108200 - DNA, 20 bp, Artificial
  CRISPR gRNA sequence
aggaaaaggtagaaaagact

SEQ ID NO: 108201 - DNA, 20 bp, Artificial
  CRISPR gRNA sequence
actaagaaaatatatgtctc

SEQ ID NO: 108202 - DNA, 20 bp, Artificial
  CRISPR gRNA sequence
aatatatgtctcaagtcctc

SEQ ID NO: 108203 - DNA, 20 bp, Artificial
  CRISPR gRNA sequence
gaatcctgttactaaatgcc

SEQ ID NO: 108204 - DNA, 20 bp, Artificial
  CRISPR gRNA sequence
aatgccaagctcaatacttt

SEQ ID NO: 108205 - DNA, 20 bp, Artificial
  CRISPR gRNA sequence
atgccaagctcaatacttta

SEQ ID NO: 108206 - DNA, 20 bp, Artificial
  CRISPR gRNA sequence
caagctcaatactttaaggt

SEQ ID NO: 108207 - DNA, 20 bp, Artificial
  CRISPR gRNA sequence
tactttaaggtcagacataa

SEQ ID NO: 108208 - DNA, 20 bp, Artificial
  CRISPR gRNA sequence
ctttaaggtcagacataatg

SEQ ID NO: 108209 - DNA, 20 bp, Artificial
  CRISPR gRNA sequence
cagacataatggagaatatc

SEQ ID NO: 108210 - DNA, 20 bp, Artificial
  CRISPR gRNA sequence
gacataatggagaatatcca

SEQ ID NO: 108211 - DNA, 20 bp, Artificial
  CRISPR gRNA sequence
ggagaatatccagagtcttt

SEQ ID NO: 108212 - DNA, 20 bp, Artificial
  CRISPR gRNA sequence
gaatatccagagtctttgag

SEQ ID NO: 108213 - DNA, 20 bp, Artificial
  CRISPR gRNA sequence
gagtctttgagaagtctcaa

SEQ ID NO: 108214 - DNA, 20 bp, Artificial
  CRISPR gRNA sequence
tgagaagtctcaatagatat

SEQ ID NO: 108215 - DNA, 20 bp, Artificial
  CRISPR gRNA sequence
gagaagtctcaatagatata

SEQ ID NO: 108216 - DNA, 20 bp, Artificial
  CRISPR gRNA sequence
aaggcatttgtcaccaaaca

SEQ ID NO: 108217 - DNA, 20 bp, Artificial
  CRISPR gRNA sequence
aggcatttgtcaccaaacac

SEQ ID NO: 108218 - DNA, 20 bp, Artificial
  CRISPR gRNA sequence
tgacaaacatttaatcataa

SEQ ID NO: 108219 - DNA, 20 bp, Artificial
  CRISPR gRNA sequence
aaacatttaatcataatggc

SEQ ID NO: 108220 - DNA, 20 bp, Artificial
  CRISPR gRNA sequence
aacatttaatcataatggca

SEQ ID NO: 108221 - DNA, 20 bp, Artificial
  CRISPR gRNA sequence
tttaatcataatggcaaggt

SEQ ID NO: 108222 - DNA, 20 bp, Artificial
  CRISPR gRNA sequence
gttgcctgtttaaaccaatc

SEQ ID NO: 108223 - DNA, 20 bp, Artificial
  CRISPR gRNA sequence
ttgcctgtttaaaccaatcc

SEQ ID NO: 108224 - DNA, 20 bp, Artificial
  CRISPR gRNA sequence
tgtttaaaccaatccaggaa

SEQ ID NO: 108225 - DNA, 20 bp, Artificial
  CRISPR gRNA sequence
accaatccaggaatggtctg

SEQ ID NO: 108226 - DNA, 20 bp, Artificial
  CRISPR gRNA sequence
tccaggaatggtctgtagtg

SEQ ID NO: 108227 - DNA, 20 bp, Artificial
  CRISPR gRNA sequence
ccaggaatggtctgtagtga

SEQ ID NO: 108228 - DNA, 20 bp, Artificial
  CRISPR gRNA sequence
gaatggtctgtagtgaaggc

SEQ ID NO: 108229 - DNA, 20 bp, Artificial
  CRISPR gRNA sequence
atggtctgtagtgaaggctg

SEQ ID NO: 108230 - DNA, 20 bp, Artificial
  CRISPR gRNA sequence
ggtctgtagtgaaggctgga

SEQ ID NO: 108231 - DNA, 20 bp, Artificial
  CRISPR gRNA sequence
ctgtagtgaaggctggagag

SEQ ID NO: 108232 - DNA, 20 bp, Artificial
  CRISPR gRNA sequence
tgtagtgaaggctggagaga

SEQ ID NO: 108233 - DNA, 20 bp, Artificial
  CRISPR gRNA sequence
aaggctggagagaaggcaat

SEQ ID NO: 108234 - DNA, 20 bp, Artificial
  CRISPR gRNA sequence
ggctggagagaaggcaatga

SEQ ID NO: 108235 - DNA, 20 bp, Artificial
  CRISPR gRNA sequence
gctggagagaaggcaatgag

SEQ ID NO: 108236 - DNA, 20 bp, Artificial
  CRISPR gRNA sequence
ctggagagaaggcaatgaga

SEQ ID NO: 108237 - DNA, 20 bp, Artificial
  CRISPR gRNA sequence
agagaaggcaatgagaggga

SEQ ID NO: 108238 - DNA, 20 bp, Artificial
  CRISPR gRNA sequence
gagaaggcaatgagagggaa

SEQ ID NO: 108239 - DNA, 20 bp, Artificial
  CRISPR gRNA sequence
gcaatgagagggaaaggtga

SEQ ID NO: 108240 - DNA, 20 bp, Artificial
  CRISPR gRNA sequence
atgagagggaaaggtgatgg

SEQ ID NO: 108241 - DNA, 20 bp, Artificial
  CRISPR gRNA sequence
gggaaaggtgatggtggtga

SEQ ID NO: 108242 - DNA, 20 bp, Artificial
  CRISPR gRNA sequence
aaaggtgatggtggtgatgg

SEQ ID NO: 108243 - DNA, 20 bp, Artificial
  CRISPR gRNA sequence
tgatggtggtgatggtggtt

SEQ ID NO: 108244 - DNA, 20 bp, Artificial
  CRISPR gRNA sequence
ttgagtacaaattctaaata

SEQ ID NO: 108245 - DNA, 20 bp, Artificial
  CRISPR gRNA sequence
tacaaattctaaataaagtg

SEQ ID NO: 108246 - DNA, 20 bp, Artificial
  CRISPR gRNA sequence
aaattctaaataaagtgaag

SEQ ID NO: 108247 - DNA, 20 bp, Artificial
  CRISPR gRNA sequence
aattctaaataaagtgaaga

SEQ ID NO: 108248 - DNA, 20 bp, Artificial
  CRISPR gRNA sequence
aaggtaaatcaaactgtacc

SEQ ID NO: 108249 - DNA, 20 bp, Artificial
  CRISPR gRNA sequence
actgtacccagcaatgactc

SEQ ID NO: 108250 - DNA, 20 bp, Artificial
  CRISPR gRNA sequence
ctgtacccagcaatgactct

SEQ ID NO: 108251 - DNA, 20 bp, Artificial
  CRISPR gRNA sequence
gtacccagcaatgactctag

SEQ ID NO: 108252 - DNA, 20 bp, Artificial
  CRISPR gRNA sequence
tacccagcaatgactctagg

SEQ ID NO: 108253 - DNA, 20 bp, Artificial
  CRISPR gRNA sequence
cagcaatgactctaggaggc

SEQ ID NO: 108254 - DNA, 20 bp, Artificial
  CRISPR gRNA sequence
agcaatgactctaggaggct

SEQ ID NO: 108255 - DNA, 20 bp, Artificial
  CRISPR gRNA sequence
aatgactctaggaggctggg

SEQ ID NO: 108256 - DNA, 20 bp, Artificial
  CRISPR gRNA sequence
actctaggaggctgggtagc

SEQ ID NO: 108257 - DNA, 20 bp, Artificial
  CRISPR gRNA sequence
ctaggaggctgggtagcaag

SEQ ID NO: 108258 - DNA, 20 bp, Artificial
  CRISPR gRNA sequence
ggctgggtagcaagcagctc

SEQ ID NO: 108259 - DNA, 20 bp, Artificial
  CRISPR gRNA sequence
tgggtagcaagcagctctgg

SEQ ID NO: 108260 - DNA, 20 bp, Artificial
  CRISPR gRNA sequence
agcagctctggaagcttatg

SEQ ID NO: 108261 - DNA, 20 bp, Artificial
  CRISPR gRNA sequence
cagctctggaagcttatgta

SEQ ID NO: 108262 - DNA, 20 bp, Artificial
  CRISPR gRNA sequence
agctctggaagcttatgtag

SEQ ID NO: 108263 - DNA, 20 bp, Artificial
  CRISPR gRNA sequence
ggatgacccttttttcccta

SEQ ID NO: 108264 - DNA, 20 bp, Artificial
  CRISPR gRNA sequence
ttttttccctacagtctctc

SEQ ID NO: 108265 - DNA, 20 bp, Artificial
  CRISPR gRNA sequence
tcattttactctgtgaattc

SEQ ID NO: 108266 - DNA, 20 bp, Artificial
  CRISPR gRNA sequence
gttgtttaaactcactacta

SEQ ID NO: 108267 - DNA, 20 bp, Artificial
  CRISPR gRNA sequence
cactactaaagatttcttaa

SEQ ID NO: 108268 - DNA, 20 bp, Artificial
  CRISPR gRNA sequence
gatttcttaaaagcactttc

SEQ ID NO: 108269 - DNA, 20 bp, Artificial
  CRISPR gRNA sequence
tcttaaaagcactttctggt

SEQ ID NO: 108270 - DNA, 20 bp, Artificial
  CRISPR gRNA sequence
agcactttctggtcagtttg

SEQ ID NO: 108271 - DNA, 20 bp, Artificial
  CRISPR gRNA sequence
tggtcagtttgcagtctcca

SEQ ID NO: 108272 - DNA, 20 bp, Artificial
  CRISPR gRNA sequence
tcagtttgcagtctccatgg

SEQ ID NO: 108273 - DNA, 20 bp, Artificial
  CRISPR gRNA sequence
tccatggtggaattcctcac

SEQ ID NO: 108274 - DNA, 20 bp, Artificial
  CRISPR gRNA sequence
tggcctctataatatccaca

SEQ ID NO: 108275 - DNA, 20 bp, Artificial
  CRISPR gRNA sequence
taatatccacatggttattt

SEQ ID NO: 108276 - DNA, 20 bp, Artificial
  CRISPR gRNA sequence
catggttattttagctttat

SEQ ID NO: 108277 - DNA, 20 bp, Artificial
  CRISPR gRNA sequence
ggttattttagctttatcag

SEQ ID NO: 108278 - DNA, 20 bp, Artificial
  CRISPR gRNA sequence
caacaaatattgaaattaca

SEQ ID NO: 108279 - DNA, 20 bp, Artificial
  CRISPR gRNA sequence
acaaatattgaaattacaca

SEQ ID NO: 108280 - DNA, 20 bp, Artificial
  CRISPR gRNA sequence
aatattgaaattacacagag

SEQ ID NO: 108281 - DNA, 20 bp, Artificial
  CRISPR gRNA sequence
tgaaattacacagagcagtc

SEQ ID NO: 108282 - DNA, 20 bp, Artificial
  CRISPR gRNA sequence
cagtcaagtgtacaaatttc

SEQ ID NO: 108283 - DNA, 20 bp, Artificial
  CRISPR gRNA sequence
tacaaatttcaagctcctat

SEQ ID NO: 108284 - DNA, 20 bp, Artificial
  CRISPR gRNA sequence
ttcaagctcctatgagtaaa

SEQ ID NO: 108285 - DNA, 20 bp, Artificial
  CRISPR gRNA sequence
tatgagtaaacagactactg

SEQ ID NO: 108286 - DNA, 20 bp, Artificial
  CRISPR gRNA sequence
atgagtaaacagactactgt

SEQ ID NO: 108287 - DNA, 20 bp, Artificial
  CRISPR gRNA sequence
gagtaaacagactactgtag

SEQ ID NO: 108288 - DNA, 20 bp, Artificial
  CRISPR gRNA sequence
aaacagactactgtaggagc

SEQ ID NO: 108289 - DNA, 20 bp, Artificial
  CRISPR gRNA sequence
aacagactactgtaggagcc

SEQ ID NO: 108290 - DNA, 20 bp, Artificial
  CRISPR gRNA sequence
tgtaggagccaggtcactac

SEQ ID NO: 108291 - DNA, 20 bp, Artificial
  CRISPR gRNA sequence
caagtgctctgtcacatctt

SEQ ID NO: 108292 - DNA, 20 bp, Artificial
  CRISPR gRNA sequence
cccaatacaaaaatacctaa

SEQ ID NO: 108293 - DNA, 20 bp, Artificial
  CRISPR gRNA sequence
atacctaatagaatgctttc

SEQ ID NO: 108294 - DNA, 20 bp, Artificial
  CRISPR gRNA sequence
cctaatagaatgctttctgg

SEQ ID NO: 108295 - DNA, 20 bp, Artificial
  CRISPR gRNA sequence
gctttctggaagcactttaa

SEQ ID NO: 108296 - DNA, 20 bp, Artificial
  CRISPR gRNA sequence
gaagcactttaaaagtgctt

SEQ ID NO: 108297 - DNA, 20 bp, Artificial
  CRISPR gRNA sequence
gcactttaaaagtgctttag

SEQ ID NO: 108298 - DNA, 20 bp, Artificial
  CRISPR gRNA sequence
aagtaaactgtaatgatcca

SEQ ID NO: 108299 - DNA, 20 bp, Artificial
  CRISPR gRNA sequence
aactgtaatgatccatggaa

SEQ ID NO: 108300 - DNA, 20 bp, Artificial
  CRISPR gRNA sequence
tagtccaaaattttcatttt

SEQ ID NO: 108301 - DNA, 20 bp, Artificial
  CRISPR gRNA sequence
ttttcagactctatctttga

SEQ ID NO: 108302 - DNA, 20 bp, Artificial
  CRISPR gRNA sequence
tatctttgacagaaattact

SEQ ID NO: 108303 - DNA, 20 bp, Artificial
  CRISPR gRNA sequence
ttgacagaaattacttagaa

SEQ ID NO: 108304 - DNA, 20 bp, Artificial
  CRISPR gRNA sequence
gaaatattcacacttaatga

SEQ ID NO: 108305 - DNA, 20 bp, Artificial
  CRISPR gRNA sequence
cacttaatgaaagtatgtgc

SEQ ID NO: 108306 - DNA, 20 bp, Artificial
  CRISPR gRNA sequence
atgaaagtatgtgcaagtaa

SEQ ID NO: 108307 - DNA, 20 bp, Artificial
  CRISPR gRNA sequence
tatgtgcaagtaacagcaat

SEQ ID NO: 108308 - DNA, 20 bp, Artificial
  CRISPR gRNA sequence
aagtaacagcaattagttaa

SEQ ID NO: 108309 - DNA, 20 bp, Artificial
  CRISPR gRNA sequence
gttaacagatcattctgtcc

SEQ ID NO: 108310 - DNA, 20 bp, Artificial
  CRISPR gRNA sequence
cagatcattctgtcctagat

SEQ ID NO: 108311 - DNA, 20 bp, Artificial
  CRISPR gRNA sequence
atcattctgtcctagatgag

SEQ ID NO: 108312 - DNA, 20 bp, Artificial
  CRISPR gRNA sequence
tcattctgtcctagatgagt

SEQ ID NO: 108313 - DNA, 20 bp, Artificial
  CRISPR gRNA sequence
tctgtcctagatgagtaggt

SEQ ID NO: 108314 - DNA, 20 bp, Artificial
  CRISPR gRNA sequence
tcctagatgagtaggttaga

SEQ ID NO: 108315 - DNA, 20 bp, Artificial
  CRISPR gRNA sequence
agatgagtaggttagatagt

SEQ ID NO: 108316 - DNA, 20 bp, Artificial
  CRISPR gRNA sequence
gatgagtaggttagatagta

SEQ ID NO: 108317 - DNA, 20 bp, Artificial
  CRISPR gRNA sequence
tgccaccaccactaatgtat

SEQ ID NO: 108318 - DNA, 20 bp, Artificial
  CRISPR gRNA sequence
cactaatgtattagaatcac

SEQ ID NO: 108319 - DNA, 20 bp, Artificial
  CRISPR gRNA sequence
actaatgtattagaatcacc

SEQ ID NO: 108320 - DNA, 20 bp, Artificial
  CRISPR gRNA sequence
accaggaacattgaaatcct

SEQ ID NO: 108321 - DNA, 20 bp, Artificial
  CRISPR gRNA sequence
gttttgttaaactgtccatt

SEQ ID NO: 108322 - DNA, 20 bp, Artificial
  CRISPR gRNA sequence
aacctttactttactttttt

SEQ ID NO: 108323 - DNA, 20 bp, Artificial
  CRISPR gRNA sequence
acctttactttactttttta

SEQ ID NO: 108324 - DNA, 20 bp, Artificial
  CRISPR gRNA sequence
ttacttttttaaggacttta

SEQ ID NO: 108325 - DNA, 20 bp, Artificial
  CRISPR gRNA sequence
atgcttgcatattctgtatc

SEQ ID NO: 108326 - DNA, 20 bp, Artificial
  CRISPR gRNA sequence
ttgcatattctgtatcaaga

SEQ ID NO: 108327 - DNA, 20 bp, Artificial
  CRISPR gRNA sequence
ctgtatcaagaaagatttct

SEQ ID NO: 108328 - DNA, 20 bp, Artificial
  CRISPR gRNA sequence
aagatttctcagaatacata

SEQ ID NO: 108329 - DNA, 20 bp, Artificial
  CRISPR gRNA sequence
tttctcagaatacatatagc

SEQ ID NO: 108330 - DNA, 20 bp, Artificial
  CRISPR gRNA sequence
taaaattctcccaaaataat

SEQ ID NO: 108331 - DNA, 20 bp, Artificial
  CRISPR gRNA sequence
tcccaaaataatcagatccc

SEQ ID NO: 108332 - DNA, 20 bp, Artificial
  CRISPR gRNA sequence
ccaaaataatcagatcccta

SEQ ID NO: 108333 - DNA, 20 bp, Artificial
  CRISPR gRNA sequence
caaaataatcagatccctag

SEQ ID NO: 108334 - DNA, 20 bp, Artificial
  CRISPR gRNA sequence
ataatcagatccctagagga

SEQ ID NO: 108335 - DNA, 20 bp, Artificial
  CRISPR gRNA sequence
taatcagatccctagaggaa

SEQ ID NO: 108336 - DNA, 20 bp, Artificial
  CRISPR gRNA sequence
aggtttctattatttccata

SEQ ID NO: 108337 - DNA, 20 bp, Artificial
  CRISPR gRNA sequence
cttttaaataaaatctatgt

SEQ ID NO: 108338 - DNA, 20 bp, Artificial
  CRISPR gRNA sequence
ttaaataaaatctatgtaag

SEQ ID NO: 108339 - DNA, 20 bp, Artificial
  CRISPR gRNA sequence
taaataaaatctatgtaagt

SEQ ID NO: 108340 - DNA, 20 bp, Artificial
  CRISPR gRNA sequence
tctatgtaagtaggaaacac

SEQ ID NO: 108341 - DNA, 20 bp, Artificial
  CRISPR gRNA sequence
aagtaggaaacacaagtttt

SEQ ID NO: 108342 - DNA, 20 bp, Artificial
  CRISPR gRNA sequence
gaaacacaagttttaagata

SEQ ID NO: 108343 - DNA, 20 bp, Artificial
  CRISPR gRNA sequence
gtgcacatgataaatgattt

SEQ ID NO: 108344 - DNA, 20 bp, Artificial
  CRISPR gRNA sequence
ataaatgatttgagactcca

SEQ ID NO: 108345 - DNA, 20 bp, Artificial
  CRISPR gRNA sequence
aaatgatttgagactccaaa

SEQ ID NO: 108346 - DNA, 20 bp, Artificial
  CRISPR gRNA sequence
agagctcactgtatttacaa

SEQ ID NO: 108347 - DNA, 20 bp, Artificial
  CRISPR gRNA sequence
tacaacagaaaaatgttaca

SEQ ID NO: 108348 - DNA, 20 bp, Artificial
  CRISPR gRNA sequence
caaagacacatgcatcaaac

SEQ ID NO: 108349 - DNA, 20 bp, Artificial
  CRISPR gRNA sequence
agacacatgcatcaaacaag

SEQ ID NO: 108350 - DNA, 20 bp, Artificial
  CRISPR gRNA sequence
gcatcaaacaagaagccata

SEQ ID NO: 108351 - DNA, 20 bp, Artificial
  CRISPR gRNA sequence
aaacaagaagccatacagtt

SEQ ID NO: 108352 - DNA, 20 bp, Artificial
  CRISPR gRNA sequence
acaagaagccatacagttaa

SEQ ID NO: 108353 - DNA, 20 bp, Artificial
  CRISPR gRNA sequence
atgttacattcctattccac

SEQ ID NO: 108354 - DNA, 20 bp, Artificial
  CRISPR gRNA sequence
tgttacattcctattccaca

SEQ ID NO: 108355 - DNA, 20 bp, Artificial
  CRISPR gRNA sequence
gttacattcctattccacaa

SEQ ID NO: 108356 - DNA, 20 bp, Artificial
  CRISPR gRNA sequence
ttacattcctattccacaag

SEQ ID NO: 108357 - DNA, 20 bp, Artificial
  CRISPR gRNA sequence
caaaatactgttttatatat

SEQ ID NO: 108358 - DNA, 20 bp, Artificial
  CRISPR gRNA sequence
atactgttttatatatgagt

SEQ ID NO: 108359 - DNA, 20 bp, Artificial
  CRISPR gRNA sequence
ttttatatatgagtaagatg

SEQ ID NO: 108360 - DNA, 20 bp, Artificial
  CRISPR gRNA sequence
atatatgagtaagatgaagc

SEQ ID NO: 108361 - DNA, 20 bp, Artificial
  CRISPR gRNA sequence
caagcatgaaaaacattaac

SEQ ID NO: 108362 - DNA, 20 bp, Artificial
  CRISPR gRNA sequence
gaaaaacattaacaagctgt

SEQ ID NO: 108363 - DNA, 20 bp, Artificial
  CRISPR gRNA sequence
ttaacaagctgttggactgt

SEQ ID NO: 108364 - DNA, 20 bp, Artificial
  CRISPR gRNA sequence
gtgagatttgaacacaattt

SEQ ID NO: 108365 - DNA, 20 bp, Artificial
  CRISPR gRNA sequence
cacaattttggaatgcctac

SEQ ID NO: 108366 - DNA, 20 bp, Artificial
  CRISPR gRNA sequence
ttttggaatgcctacaagct

SEQ ID NO: 108367 - DNA, 20 bp, Artificial
  CRISPR gRNA sequence
cctacaagctcagtttcttt

SEQ ID NO: 108368 - DNA, 20 bp, Artificial
  CRISPR gRNA sequence
ttcggcttaatttatgttca

SEQ ID NO: 108369 - DNA, 20 bp, Artificial
  CRISPR gRNA sequence
gcttaatttatgttcaaagt

SEQ ID NO: 108370 - DNA, 20 bp, Artificial
  CRISPR gRNA sequence
acatcattaccaaacactat

SEQ ID NO: 108371 - DNA, 20 bp, Artificial
  CRISPR gRNA sequence
tcattaccaaacactattgg

SEQ ID NO: 108372 - DNA, 20 bp, Artificial
  CRISPR gRNA sequence
ttaccaaacactattggtgg

SEQ ID NO: 108373 - DNA, 20 bp, Artificial
  CRISPR gRNA sequence
taccaaacactattggtggc

SEQ ID NO: 108374 - DNA, 20 bp, Artificial
  CRISPR gRNA sequence
accaaacactattggtggca

SEQ ID NO: 108375 - DNA, 20 bp, Artificial
  CRISPR gRNA sequence
ccaaacactattggtggcag

SEQ ID NO: 108376 - DNA, 20 bp, Artificial
  CRISPR gRNA sequence
aacactattggtggcagggg

SEQ ID NO: 108377 - DNA, 20 bp, Artificial
  CRISPR gRNA sequence
acactattggtggcaggggt

SEQ ID NO: 108378 - DNA, 20 bp, Artificial
  CRISPR gRNA sequence
cactattggtggcaggggta

SEQ ID NO: 108379 - DNA, 20 bp, Artificial
  CRISPR gRNA sequence
actattggtggcaggggtag

SEQ ID NO: 108380 - DNA, 20 bp, Artificial
  CRISPR gRNA sequence
attggtggcaggggtagggg

SEQ ID NO: 108381 - DNA, 20 bp, Artificial
  CRISPR gRNA sequence
ttggtggcaggggtaggggt

SEQ ID NO: 108382 - DNA, 20 bp, Artificial
  CRISPR gRNA sequence
aggggtaggggtgggattga

SEQ ID NO: 108383 - DNA, 20 bp, Artificial
  CRISPR gRNA sequence
ggggtaggggtgggattgaa

SEQ ID NO: 108384 - DNA, 20 bp, Artificial
  CRISPR gRNA sequence
ggggtgggattgaaaggata

SEQ ID NO: 108385 - DNA, 20 bp, Artificial
  CRISPR gRNA sequence
aaggataaagtgatgacaat

SEQ ID NO: 108386 - DNA, 20 bp, Artificial
  CRISPR gRNA sequence
ggataaagtgatgacaataa

SEQ ID NO: 108387 - DNA, 20 bp, Artificial
  CRISPR gRNA sequence
gataaagtgatgacaataag

SEQ ID NO: 108388 - DNA, 20 bp, Artificial
  CRISPR gRNA sequence
aaagtgatgacaataagagg

SEQ ID NO: 108389 - DNA, 20 bp, Artificial
  CRISPR gRNA sequence
aataagaggtagttatctgc

SEQ ID NO: 108390 - DNA, 20 bp, Artificial
  CRISPR gRNA sequence
gtagttatctgctggatgct

SEQ ID NO: 108391 - DNA, 20 bp, Artificial
  CRISPR gRNA sequence
gttatctgctggatgcttag

SEQ ID NO: 108392 - DNA, 20 bp, Artificial
  CRISPR gRNA sequence
tgctggatgcttagcagcac

SEQ ID NO: 108393 - DNA, 20 bp, Artificial
  CRISPR gRNA sequence
gcttagcagcactagcaata

SEQ ID NO: 108394 - DNA, 20 bp, Artificial
  CRISPR gRNA sequence
agcagcactagcaataaagt

SEQ ID NO: 108395 - DNA, 20 bp, Artificial
  CRISPR gRNA sequence
ctagcaataaagtgagatgc

SEQ ID NO: 108396 - DNA, 20 bp, Artificial
  CRISPR gRNA sequence
gagatgccagttctacattc

SEQ ID NO: 108397 - DNA, 20 bp, Artificial
  CRISPR gRNA sequence
ttgaatcatttctaattcaa

SEQ ID NO: 108398 - DNA, 20 bp, Artificial
  CRISPR gRNA sequence
gaatcatttctaattcaatg

SEQ ID NO: 108399 - DNA, 20 bp, Artificial
  CRISPR gRNA sequence
aatcatttctaattcaatgg

SEQ ID NO: 108400 - DNA, 20 bp, Artificial
  CRISPR gRNA sequence
atcatttctaattcaatgga

SEQ ID NO: 108401 - DNA, 20 bp, Artificial
  CRISPR gRNA sequence
tctaattcaatggagggaaa

SEQ ID NO: 108402 - DNA, 20 bp, Artificial
  CRISPR gRNA sequence
aattcaatggagggaaaaag

SEQ ID NO: 108403 - DNA, 20 bp, Artificial
  CRISPR gRNA sequence
attcaatggagggaaaaagt

SEQ ID NO: 108404 - DNA, 20 bp, Artificial
  CRISPR gRNA sequence
ttcaatggagggaaaaagta

SEQ ID NO: 108405 - DNA, 20 bp, Artificial
  CRISPR gRNA sequence
tcttgccaatttctcaaaaa

SEQ ID NO: 108406 - DNA, 20 bp, Artificial
  CRISPR gRNA sequence
ttgccaatttctcaaaaata

SEQ ID NO: 108407 - DNA, 20 bp, Artificial
  CRISPR gRNA sequence
aaatagagttattttaataa

SEQ ID NO: 108408 - DNA, 20 bp, Artificial
  CRISPR gRNA sequence
ataaaagtaacctacataca

SEQ ID NO: 108409 - DNA, 20 bp, Artificial
  CRISPR gRNA sequence
aaaagtaacctacatacaca

SEQ ID NO: 108410 - DNA, 20 bp, Artificial
  CRISPR gRNA sequence
agtaacctacatacacagag

SEQ ID NO: 108411 - DNA, 20 bp, Artificial
  CRISPR gRNA sequence
cctacatacacagagtagac

SEQ ID NO: 108412 - DNA, 20 bp, Artificial
  CRISPR gRNA sequence
gctgctactcctgtgtttta

SEQ ID NO: 108413 - DNA, 20 bp, Artificial
  CRISPR gRNA sequence
ctgctactcctgtgttttat

SEQ ID NO: 108414 - DNA, 20 bp, Artificial
  CRISPR gRNA sequence
ctcctgtgttttataggaac

SEQ ID NO: 108415 - DNA, 20 bp, Artificial
  CRISPR gRNA sequence
tttataggaactggccaaat

SEQ ID NO: 108416 - DNA, 20 bp, Artificial
  CRISPR gRNA sequence
ggccaaattagaacccaatt

SEQ ID NO: 108417 - DNA, 20 bp, Artificial
  CRISPR gRNA sequence
gccaaattagaacccaattt

SEQ ID NO: 108418 - DNA, 20 bp, Artificial
  CRISPR gRNA sequence
agaacccaatttaggatact

SEQ ID NO: 108419 - DNA, 20 bp, Artificial
  CRISPR gRNA sequence
cttagccatacacgatgcta

SEQ ID NO: 108420 - DNA, 20 bp, Artificial
  CRISPR gRNA sequence
aagaactgtattgattaacc

SEQ ID NO: 108421 - DNA, 20 bp, Artificial
  CRISPR gRNA sequence
tgattaaccaagaattatca

SEQ ID NO: 108422 - DNA, 20 bp, Artificial
  CRISPR gRNA sequence
ttaaccaagaattatcacag

SEQ ID NO: 108423 - DNA, 20 bp, Artificial
  CRISPR gRNA sequence
tcacagtggctttaacacct

SEQ ID NO: 108424 - DNA, 20 bp, Artificial
  CRISPR gRNA sequence
gctttaacacctaagactta

SEQ ID NO: 108425 - DNA, 20 bp, Artificial
  CRISPR gRNA sequence
taacacctaagacttacaga

SEQ ID NO: 108426 - DNA, 20 bp, Artificial
  CRISPR gRNA sequence
catcctgcttctgcctaacc

SEQ ID NO: 108427 - DNA, 20 bp, Artificial
  CRISPR gRNA sequence
tcctgcttctgcctaaccaa

SEQ ID NO: 108428 - DNA, 20 bp, Artificial
  CRISPR gRNA sequence
cctgcttctgcctaaccaag

SEQ ID NO: 108429 - DNA, 20 bp, Artificial
  CRISPR gRNA sequence
ctgcctaaccaagaggtatc

SEQ ID NO: 108430 - DNA, 20 bp, Artificial
  CRISPR gRNA sequence
tgcctaaccaagaggtatct

SEQ ID NO: 108431 - DNA, 20 bp, Artificial
  CRISPR gRNA sequence
gcctaaccaagaggtatctg

SEQ ID NO: 108432 - DNA, 20 bp, Artificial
  CRISPR gRNA sequence
ggtatctggggtaatctttg

SEQ ID NO: 108433 - DNA, 20 bp, Artificial
  CRISPR gRNA sequence
tggggtaatctttgcagatc

SEQ ID NO: 108434 - DNA, 20 bp, Artificial
  CRISPR gRNA sequence
atctttgcagatctagtaat

SEQ ID NO: 108435 - DNA, 20 bp, Artificial
  CRISPR gRNA sequence
ttgcagatctagtaataaga

SEQ ID NO: 108436 - DNA, 20 bp, Artificial
  CRISPR gRNA sequence
tgcagatctagtaataagac

SEQ ID NO: 108437 - DNA, 20 bp, Artificial
  CRISPR gRNA sequence
aagacaggtcactattcccc

SEQ ID NO: 108438 - DNA, 20 bp, Artificial
  CRISPR gRNA sequence
agacaggtcactattccccc

SEQ ID NO: 108439 - DNA, 20 bp, Artificial
  CRISPR gRNA sequence
aggtcactattcccccagga

SEQ ID NO: 108440 - DNA, 20 bp, Artificial
  CRISPR gRNA sequence
ggtcactattcccccaggaa

SEQ ID NO: 108441 - DNA, 20 bp, Artificial
  CRISPR gRNA sequence
cactattcccccaggaaagg

SEQ ID NO: 108442 - DNA, 20 bp, Artificial
  CRISPR gRNA sequence
tattcccccaggaaaggtag

SEQ ID NO: 108443 - DNA, 20 bp, Artificial
  CRISPR gRNA sequence
aggaaaggtagtggaaacaa

SEQ ID NO: 108444 - DNA, 20 bp, Artificial
  CRISPR gRNA sequence
aaaggtagtggaaacaatag

SEQ ID NO: 108445 - DNA, 20 bp, Artificial
  CRISPR gRNA sequence
tggaaacaatagcagttaac

SEQ ID NO: 108446 - DNA, 20 bp, Artificial
  CRISPR gRNA sequence
gaaacaatagcagttaacaa

SEQ ID NO: 108447 - DNA, 20 bp, Artificial
  CRISPR gRNA sequence
gcagttaacaagagattaac

SEQ ID NO: 108448 - DNA, 20 bp, Artificial
  CRISPR gRNA sequence
aacaagagattaacaagatt

SEQ ID NO: 108449 - DNA, 20 bp, Artificial
  CRISPR gRNA sequence
gattaacaagattcagtgct

SEQ ID NO: 108450 - DNA, 20 bp, Artificial
  CRISPR gRNA sequence
gtgcttagataaaccttgcc

SEQ ID NO: 108451 - DNA, 20 bp, Artificial
  CRISPR gRNA sequence
caagtgcaatgattattttt

SEQ ID NO: 108452 - DNA, 20 bp, Artificial
  CRISPR gRNA sequence
gcaatgattatttttcagtt

SEQ ID NO: 108453 - DNA, 20 bp, Artificial
  CRISPR gRNA sequence
ttgccccttgaataaaaata

SEQ ID NO: 108454 - DNA, 20 bp, Artificial
  CRISPR gRNA sequence
ccttgaataaaaataaagca

SEQ ID NO: 108455 - DNA, 20 bp, Artificial
  CRISPR gRNA sequence
aataaaaataaagcacagcc

SEQ ID NO: 108456 - DNA, 20 bp, Artificial
  CRISPR gRNA sequence
aaataaagcacagcctagcc

SEQ ID NO: 108457 - DNA, 20 bp, Artificial
  CRISPR gRNA sequence
atttttaccatgcaattaat

SEQ ID NO: 108458 - DNA, 20 bp, Artificial
  CRISPR gRNA sequence
taccatgcaattaattggat

SEQ ID NO: 108459 - DNA, 20 bp, Artificial
  CRISPR gRNA sequence
ccatgcaattaattggatca

SEQ ID NO: 108460 - DNA, 20 bp, Artificial
  CRISPR gRNA sequence
aattaattggatcagagtgt

SEQ ID NO: 108461 - DNA, 20 bp, Artificial
  CRISPR gRNA sequence
aaattctttttttttttttt

SEQ ID NO: 108462 - DNA, 20 bp, Artificial
  CRISPR gRNA sequence
tcttttttttttttttgaga

SEQ ID NO: 108463 - DNA, 20 bp, Artificial
  CRISPR gRNA sequence
ttttttttttttttgagacg

SEQ ID NO: 108464 - DNA, 20 bp, Artificial
  CRISPR gRNA sequence
cggagtctcgctctgtcacc

SEQ ID NO: 108465 - DNA, 20 bp, Artificial
  CRISPR gRNA sequence
ggagtctcgctctgtcaccc

SEQ ID NO: 108466 - DNA, 20 bp, Artificial
  CRISPR gRNA sequence
tctcgctctgtcacccaggc

SEQ ID NO: 108467 - DNA, 20 bp, Artificial
  CRISPR gRNA sequence
tcgctctgtcacccaggctg

SEQ ID NO: 108468 - DNA, 20 bp, Artificial
  CRISPR gRNA sequence
ctgtcacccaggctggagtg

SEQ ID NO: 108469 - DNA, 20 bp, Artificial
  CRISPR gRNA sequence
tcacccaggctggagtgcag

SEQ ID NO: 108470 - DNA, 20 bp, Artificial
  CRISPR gRNA sequence
gcgcaatctctgctcactgc

SEQ ID NO: 108471 - DNA, 20 bp, Artificial
  CRISPR gRNA sequence
tcactgcaagctctgcctcc

SEQ ID NO: 108472 - DNA, 20 bp, Artificial
  CRISPR gRNA sequence
cactgcaagctctgcctcct

SEQ ID NO: 108473 - DNA, 20 bp, Artificial
  CRISPR gRNA sequence
ttcacgccattctcctgctc

SEQ ID NO: 108474 - DNA, 20 bp, Artificial
  CRISPR gRNA sequence
ttctcctgctccagcctccc

SEQ ID NO: 108475 - DNA, 20 bp, Artificial
  CRISPR gRNA sequence
tcctgctccagcctcccaag

SEQ ID NO: 108476 - DNA, 20 bp, Artificial
  CRISPR gRNA sequence
gctccagcctcccaagtagc

SEQ ID NO: 108477 - DNA, 20 bp, Artificial
  CRISPR gRNA sequence
ctccagcctcccaagtagct

SEQ ID NO: 108478 - DNA, 20 bp, Artificial
  CRISPR gRNA sequence
ctcccaagtagctgggacta

SEQ ID NO: 108479 - DNA, 20 bp, Artificial
  CRISPR gRNA sequence
tcccaagtagctgggactac

SEQ ID NO: 108480 - DNA, 20 bp, Artificial
  CRISPR gRNA sequence
caggtgcccgccaccatgcc

SEQ ID NO: 108481 - DNA, 20 bp, Artificial
  CRISPR gRNA sequence
ggctaatttttttgtatttt

SEQ ID NO: 108482 - DNA, 20 bp, Artificial
  CRISPR gRNA sequence
taatttttttgtatttttag

SEQ ID NO: 108483 - DNA, 20 bp, Artificial
  CRISPR gRNA sequence
atttttttgtatttttagta

SEQ ID NO: 108484 - DNA, 20 bp, Artificial
  CRISPR gRNA sequence
ttttgtatttttagtagaga

SEQ ID NO: 108485 - DNA, 20 bp, Artificial
  CRISPR gRNA sequence
tttgtatttttagtagagac

SEQ ID NO: 108486 - DNA, 20 bp, Artificial
  CRISPR gRNA sequence
ttgtatttttagtagagaca

SEQ ID NO: 108487 - DNA, 20 bp, Artificial
  CRISPR gRNA sequence
cagggtttcaccatgtttgc

SEQ ID NO: 108488 - DNA, 20 bp, Artificial
  CRISPR gRNA sequence
agggtttcaccatgtttgcc

SEQ ID NO: 108489 - DNA, 20 bp, Artificial
  CRISPR gRNA sequence
tttcaccatgtttgccagga

SEQ ID NO: 108490 - DNA, 20 bp, Artificial
  CRISPR gRNA sequence
acctcgtgatccgcctgcct

SEQ ID NO: 108491 - DNA, 20 bp, Artificial
  CRISPR gRNA sequence
ccgcctgcctcggcctccca

SEQ ID NO: 108492 - DNA, 20 bp, Artificial
  CRISPR gRNA sequence
gcctcggcctcccaaagtgc

SEQ ID NO: 108493 - DNA, 20 bp, Artificial
  CRISPR gRNA sequence
cctcggcctcccaaagtgct

SEQ ID NO: 108494 - DNA, 20 bp, Artificial
  CRISPR gRNA sequence
ctcccaaagtgctgggatta

SEQ ID NO: 108495 - DNA, 20 bp, Artificial
  CRISPR gRNA sequence
tcccaaagtgctgggattac

SEQ ID NO: 108496 - DNA, 20 bp, Artificial
  CRISPR gRNA sequence
agtgctgggattacaggcgt

SEQ ID NO: 108497 - DNA, 20 bp, Artificial
  CRISPR gRNA sequence
caggcgtgagccaccgcgcc

SEQ ID NO: 108498 - DNA, 20 bp, Artificial
  CRISPR gRNA sequence
gtgagccaccgcgcccggcc

SEQ ID NO: 108499 - DNA, 20 bp, Artificial
  CRISPR gRNA sequence
taaattctaatgtcacttat

SEQ ID NO: 108500 - DNA, 20 bp, Artificial
  CRISPR gRNA sequence
cacttataccatttcttttc

SEQ ID NO: 108501 - DNA, 20 bp, Artificial
  CRISPR gRNA sequence
acttataccatttcttttcc

SEQ ID NO: 108502 - DNA, 20 bp, Artificial
  CRISPR gRNA sequence
ttcttttccaggcattctca

SEQ ID NO: 108503 - DNA, 20 bp, Artificial
  CRISPR gRNA sequence
gcattctcaaagaaacatgc

SEQ ID NO: 108504 - DNA, 20 bp, Artificial
  CRISPR gRNA sequence
tgctagtcaaatccaattct

SEQ ID NO: 108505 - DNA, 20 bp, Artificial
  CRISPR gRNA sequence
agtcaaatccaattctcaga

SEQ ID NO: 108506 - DNA, 20 bp, Artificial
  CRISPR gRNA sequence
caattctcagaaagttgata

SEQ ID NO: 108507 - DNA, 20 bp, Artificial
  CRISPR gRNA sequence
aattctcagaaagttgatac

SEQ ID NO: 108508 - DNA, 20 bp, Artificial
  CRISPR gRNA sequence
attctcagaaagttgatacg

SEQ ID NO: 108509 - DNA, 20 bp, Artificial
  CRISPR gRNA sequence
tacggggtctctatatgact

SEQ ID NO: 108510 - DNA, 20 bp, Artificial
  CRISPR gRNA sequence
tatgacttggcatgaaatat

SEQ ID NO: 108511 - DNA, 20 bp, Artificial
  CRISPR gRNA sequence
atgacttggcatgaaatatt

SEQ ID NO: 108512 - DNA, 20 bp, Artificial
  CRISPR gRNA sequence
ggcatgaaatattaggaaac

SEQ ID NO: 108513 - DNA, 20 bp, Artificial
  CRISPR gRNA sequence
ttaggaaactggcatcttat

SEQ ID NO: 108514 - DNA, 20 bp, Artificial
  CRISPR gRNA sequence
ctggcatcttataagcctca

SEQ ID NO: 108515 - DNA, 20 bp, Artificial
  CRISPR gRNA sequence
atcttataagcctcaaagac

SEQ ID NO: 108516 - DNA, 20 bp, Artificial
  CRISPR gRNA sequence
tataagcctcaaagacaagt

SEQ ID NO: 108517 - DNA, 20 bp, Artificial
  CRISPR gRNA sequence
aagcctcaaagacaagttag

SEQ ID NO: 108518 - DNA, 20 bp, Artificial
  CRISPR gRNA sequence
aagacaagttagcagcatca

SEQ ID NO: 108519 - DNA, 20 bp, Artificial
  CRISPR gRNA sequence
actgactttgccattcctac

SEQ ID NO: 108520 - DNA, 20 bp, Artificial
  CRISPR gRNA sequence
tgactttgccattcctactg

SEQ ID NO: 108521 - DNA, 20 bp, Artificial
  CRISPR gRNA sequence
actggagatcctaacacaaa

SEQ ID NO: 108522 - DNA, 20 bp, Artificial
  CRISPR gRNA sequence
gatcctaacacaaacagcac

SEQ ID NO: 108523 - DNA, 20 bp, Artificial
  CRISPR gRNA sequence
acacaaacagcaccagacat

SEQ ID NO: 108524 - DNA, 20 bp, Artificial
  CRISPR gRNA sequence
cacaaacagcaccagacatg

SEQ ID NO: 108525 - DNA, 20 bp, Artificial
  CRISPR gRNA sequence
caaacagcaccagacatgag

SEQ ID NO: 108526 - DNA, 20 bp, Artificial
  CRISPR gRNA sequence
aacagcaccagacatgagga

SEQ ID NO: 108527 - DNA, 20 bp, Artificial
  CRISPR gRNA sequence
acagcaccagacatgaggag

SEQ ID NO: 108528 - DNA, 20 bp, Artificial
  CRISPR gRNA sequence
agcaccagacatgaggagag

SEQ ID NO: 108529 - DNA, 20 bp, Artificial
  CRISPR gRNA sequence
accagacatgaggagaggag

SEQ ID NO: 108530 - DNA, 20 bp, Artificial
  CRISPR gRNA sequence
gaggagaggagaagttcatg

SEQ ID NO: 108531 - DNA, 20 bp, Artificial
  CRISPR gRNA sequence
agaagttcatgcagtgctca

SEQ ID NO: 108532 - DNA, 20 bp, Artificial
  CRISPR gRNA sequence
aagttcatgcagtgctcaca

SEQ ID NO: 108533 - DNA, 20 bp, Artificial
  CRISPR gRNA sequence
atgcagtgctcacagagaat

SEQ ID NO: 108534 - DNA, 20 bp, Artificial
  CRISPR gRNA sequence
gcagtgctcacagagaatca

SEQ ID NO: 108535 - DNA, 20 bp, Artificial
  CRISPR gRNA sequence
agtgctcacagagaatcaga

SEQ ID NO: 108536 - DNA, 20 bp, Artificial
  CRISPR gRNA sequence
gtgctcacagagaatcagag

SEQ ID NO: 108537 - DNA, 20 bp, Artificial
  CRISPR gRNA sequence
tgctcacagagaatcagaga

SEQ ID NO: 108538 - DNA, 20 bp, Artificial
  CRISPR gRNA sequence
tcagagagggtaccactacc

SEQ ID NO: 108539 - DNA, 20 bp, Artificial
  CRISPR gRNA sequence
agagagggtaccactacctg

SEQ ID NO: 108540 - DNA, 20 bp, Artificial
  CRISPR gRNA sequence
gagagggtaccactacctgg

SEQ ID NO: 108541 - DNA, 20 bp, Artificial
  CRISPR gRNA sequence
agagggtaccactacctgga

SEQ ID NO: 108542 - DNA, 20 bp, Artificial
  CRISPR gRNA sequence
gtaccactacctggagggtc

SEQ ID NO: 108543 - DNA, 20 bp, Artificial
  CRISPR gRNA sequence
cctggagggtctggacttgc

SEQ ID NO: 108544 - DNA, 20 bp, Artificial
  CRISPR gRNA sequence
gggtctggacttgctggcct

SEQ ID NO: 108545 - DNA, 20 bp, Artificial
  CRISPR gRNA sequence
ggtctggacttgctggcctg

SEQ ID NO: 108546 - DNA, 20 bp, Artificial
  CRISPR gRNA sequence
ctggacttgctggcctgagg

SEQ ID NO: 108547 - DNA, 20 bp, Artificial
  CRISPR gRNA sequence
ggcctgaggcggatgccacc

SEQ ID NO: 108548 - DNA, 20 bp, Artificial
  CRISPR gRNA sequence
gcctgaggcggatgccacct

SEQ ID NO: 108549 - DNA, 20 bp, Artificial
  CRISPR gRNA sequence
ggcggatgccacctgggcct

SEQ ID NO: 108550 - DNA, 20 bp, Artificial
  CRISPR gRNA sequence
ggcctcagtctgcaactgca

SEQ ID NO: 108551 - DNA, 20 bp, Artificial
  CRISPR gRNA sequence
ctcagtctgcaactgcacag

SEQ ID NO: 108552 - DNA, 20 bp, Artificial
  CRISPR gRNA sequence
agtgacaccaccctgctgct

SEQ ID NO: 108553 - DNA, 20 bp, Artificial
  CRISPR gRNA sequence
caccaccctgctgctgagaa

SEQ ID NO: 108554 - DNA, 20 bp, Artificial
  CRISPR gRNA sequence
accaccctgctgctgagaac

SEQ ID NO: 108555 - DNA, 20 bp, Artificial
  CRISPR gRNA sequence
cctgctgctgagaacaggaa

SEQ ID NO: 108556 - DNA, 20 bp, Artificial
  CRISPR gRNA sequence
ctgctgctgagaacaggaac

SEQ ID NO: 108557 - DNA, 20 bp, Artificial
  CRISPR gRNA sequence
ctgctgagaacaggaacagg

SEQ ID NO: 108558 - DNA, 20 bp, Artificial
  CRISPR gRNA sequence
gctgagaacaggaacaggaa

SEQ ID NO: 108559 - DNA, 20 bp, Artificial
  CRISPR gRNA sequence
aggaagagcttgaaatatgt

SEQ ID NO: 108560 - DNA, 20 bp, Artificial
  CRISPR gRNA sequence
ggaagagcttgaaatatgtc

SEQ ID NO: 108561 - DNA, 20 bp, Artificial
  CRISPR gRNA sequence
agagcttgaaatatgtcagg

SEQ ID NO: 108562 - DNA, 20 bp, Artificial
  CRISPR gRNA sequence
gagcttgaaatatgtcagga

SEQ ID NO: 108563 - DNA, 20 bp, Artificial
  CRISPR gRNA sequence
tatgtcaggaaggaaatgtg

SEQ ID NO: 108564 - DNA, 20 bp, Artificial
  CRISPR gRNA sequence
aggaaggaaatgtgtagttc

SEQ ID NO: 108565 - DNA, 20 bp, Artificial
  CRISPR gRNA sequence
gaaatgtgtagttcaagaca

SEQ ID NO: 108566 - DNA, 20 bp, Artificial
  CRISPR gRNA sequence
acacagatcaccttacctct

SEQ ID NO: 108567 - DNA, 20 bp, Artificial
  CRISPR gRNA sequence
acagatcaccttacctcttg

SEQ ID NO: 108568 - DNA, 20 bp, Artificial
  CRISPR gRNA sequence
cagatcaccttacctcttgg

SEQ ID NO: 108569 - DNA, 20 bp, Artificial
  CRISPR gRNA sequence
gatcaccttacctcttggag

SEQ ID NO: 108570 - DNA, 20 bp, Artificial
  CRISPR gRNA sequence
tcaccttacctcttggagga

SEQ ID NO: 108571 - DNA, 20 bp, Artificial
  CRISPR gRNA sequence
accttacctcttggaggaga

SEQ ID NO: 108572 - DNA, 20 bp, Artificial
  CRISPR gRNA sequence
tacctcttggaggagagaga

SEQ ID NO: 108573 - DNA, 20 bp, Artificial
  CRISPR gRNA sequence
ctcttggaggagagagacgg

SEQ ID NO: 108574 - DNA, 20 bp, Artificial
  CRISPR gRNA sequence
aggagagagacggaagcctg

SEQ ID NO: 108575 - DNA, 20 bp, Artificial
  CRISPR gRNA sequence
ggagagagacggaagcctga

SEQ ID NO: 108576 - DNA, 20 bp, Artificial
  CRISPR gRNA sequence
tgaaggactttcaaaatgta

SEQ ID NO: 108577 - DNA, 20 bp, Artificial
  CRISPR gRNA sequence
tgtacagactccctatattg

SEQ ID NO: 108578 - DNA, 20 bp, Artificial
  CRISPR gRNA sequence
atattgaagctgttttgttg

SEQ ID NO: 108579 - DNA, 20 bp, Artificial
  CRISPR gRNA sequence
tattgaagctgttttgttga

SEQ ID NO: 108580 - DNA, 20 bp, Artificial
  CRISPR gRNA sequence
tgaagctgttttgttgaagg

SEQ ID NO: 108581 - DNA, 20 bp, Artificial
  CRISPR gRNA sequence
agctgttttgttgaaggtag

SEQ ID NO: 108582 - DNA, 20 bp, Artificial
  CRISPR gRNA sequence
gctgttttgttgaaggtagt

SEQ ID NO: 108583 - DNA, 20 bp, Artificial
  CRISPR gRNA sequence
tgttgaaggtagtaggatta

SEQ ID NO: 108584 - DNA, 20 bp, Artificial
  CRISPR gRNA sequence
ggtagtaggattaaagatat

SEQ ID NO: 108585 - DNA, 20 bp, Artificial
  CRISPR gRNA sequence
agatattagccctttgtctc

SEQ ID NO: 108586 - DNA, 20 bp, Artificial
  CRISPR gRNA sequence
atattagccctttgtctcca

SEQ ID NO: 108587 - DNA, 20 bp, Artificial
  CRISPR gRNA sequence
ttagccctttgtctccagag

SEQ ID NO: 108588 - DNA, 20 bp, Artificial
  CRISPR gRNA sequence
tttgactcaaaaactcaaaa

SEQ ID NO: 108589 - DNA, 20 bp, Artificial
  CRISPR gRNA sequence
cagttgtcatcattaacaca

SEQ ID NO: 108590 - DNA, 20 bp, Artificial
  CRISPR gRNA sequence
tgtaatgcaatctttccctc

SEQ ID NO: 108591 - DNA, 20 bp, Artificial
  CRISPR gRNA sequence
gcaatctttccctccagaaa

SEQ ID NO: 108592 - DNA, 20 bp, Artificial
  CRISPR gRNA sequence
caatctttccctccagaaac

SEQ ID NO: 108593 - DNA, 20 bp, Artificial
  CRISPR gRNA sequence
taatgccctttttatctcct

SEQ ID NO: 108594 - DNA, 20 bp, Artificial
  CRISPR gRNA sequence
ccctttttatctcctcagat

SEQ ID NO: 108595 - DNA, 20 bp, Artificial
  CRISPR gRNA sequence
atctcctcagatgagttcac

SEQ ID NO: 108596 - DNA, 20 bp, Artificial
  CRISPR gRNA sequence
gttcacaagaaaaaaatgat

SEQ ID NO: 108597 - DNA, 20 bp, Artificial
  CRISPR gRNA sequence
ttcacaagaaaaaaatgatt

SEQ ID NO: 108598 - DNA, 20 bp, Artificial
  CRISPR gRNA sequence
aaaaaatgattaggttttaa

SEQ ID NO: 108599 - DNA, 20 bp, Artificial
  CRISPR gRNA sequence
gaaactaccataaaaaattc

SEQ ID NO: 108600 - DNA, 20 bp, Artificial
  CRISPR gRNA sequence
aaactaccataaaaaattct

SEQ ID NO: 108601 - DNA, 20 bp, Artificial
  CRISPR gRNA sequence
tgggcttaaatgcaatcacc

SEQ ID NO: 108602 - DNA, 20 bp, Artificial
  CRISPR gRNA sequence
cttaaatgcaatcaccaaga

SEQ ID NO: 108603 - DNA, 20 bp, Artificial
  CRISPR gRNA sequence
ttaaatgcaatcaccaagaa

SEQ ID NO: 108604 - DNA, 20 bp, Artificial
  CRISPR gRNA sequence
aaatgcaatcaccaagaaag

SEQ ID NO: 108605 - DNA, 20 bp, Artificial
  CRISPR gRNA sequence
aatgcaatcaccaagaaagg

SEQ ID NO: 108606 - DNA, 20 bp, Artificial
  CRISPR gRNA sequence
tgcaatcaccaagaaaggag

SEQ ID NO: 108607 - DNA, 20 bp, Artificial
  CRISPR gRNA sequence
tgctctcatgtcccaaaact

SEQ ID NO: 108608 - DNA, 20 bp, Artificial
  CRISPR gRNA sequence
tttatttatgtacttatttt

SEQ ID NO: 108609 - DNA, 20 bp, Artificial
  CRISPR gRNA sequence
tttatgtacttattttgaga

SEQ ID NO: 108610 - DNA, 20 bp, Artificial
  CRISPR gRNA sequence
ttatgtacttattttgagat

SEQ ID NO: 108611 - DNA, 20 bp, Artificial
  CRISPR gRNA sequence
tatgtacttattttgagatg

SEQ ID NO: 108612 - DNA, 20 bp, Artificial
  CRISPR gRNA sequence
tggggtcttgctgttttgcc

SEQ ID NO: 108613 - DNA, 20 bp, Artificial
  CRISPR gRNA sequence
ggggtcttgctgttttgccc

SEQ ID NO: 108614 - DNA, 20 bp, Artificial
  CRISPR gRNA sequence
tcttgctgttttgcccaggc

SEQ ID NO: 108615 - DNA, 20 bp, Artificial
  CRISPR gRNA sequence
ccaggctggtcttgaattcc

SEQ ID NO: 108616 - DNA, 20 bp, Artificial
  CRISPR gRNA sequence
caggctggtcttgaattcct

SEQ ID NO: 108617 - DNA, 20 bp, Artificial
  CRISPR gRNA sequence
ggtcttgaattcctgggctt

SEQ ID NO: 108618 - DNA, 20 bp, Artificial
  CRISPR gRNA sequence
ttaagccaaccttcctgtct

SEQ ID NO: 108619 - DNA, 20 bp, Artificial
  CRISPR gRNA sequence
aaccttcctgtctcagcctc

SEQ ID NO: 108620 - DNA, 20 bp, Artificial
  CRISPR gRNA sequence
ccttcctgtctcagcctcca

SEQ ID NO: 108621 - DNA, 20 bp, Artificial
  CRISPR gRNA sequence
tcctgtctcagcctccagag

SEQ ID NO: 108622 - DNA, 20 bp, Artificial
  CRISPR gRNA sequence
gtctcagcctccagagtagc

SEQ ID NO: 108623 - DNA, 20 bp, Artificial
  CRISPR gRNA sequence
tctcagcctccagagtagct

SEQ ID NO: 108624 - DNA, 20 bp, Artificial
  CRISPR gRNA sequence
ctccagagtagctgggatta

SEQ ID NO: 108625 - DNA, 20 bp, Artificial
  CRISPR gRNA sequence
tccagagtagctgggattac

SEQ ID NO: 108626 - DNA, 20 bp, Artificial
  CRISPR gRNA sequence
tagctgggattacaggcatg

SEQ ID NO: 108627 - DNA, 20 bp, Artificial
  CRISPR gRNA sequence
caggcatgcagcaccatgcc

SEQ ID NO: 108628 - DNA, 20 bp, Artificial
  CRISPR gRNA sequence
ccatgcccagcttcaaaact

SEQ ID NO: 108629 - DNA, 20 bp, Artificial
  CRISPR gRNA sequence
taagattatttctacccaac

SEQ ID NO: 108630 - DNA, 20 bp, Artificial
  CRISPR gRNA sequence
ctacccaactggactgcttt

SEQ ID NO: 108631 - DNA, 20 bp, Artificial
  CRISPR gRNA sequence
acccaactggactgctttaa

SEQ ID NO: 108632 - DNA, 20 bp, Artificial
  CRISPR gRNA sequence
cttatttttacatccactaa

SEQ ID NO: 108633 - DNA, 20 bp, Artificial
  CRISPR gRNA sequence
ccactaatggcaaattctga

SEQ ID NO: 108634 - DNA, 20 bp, Artificial
  CRISPR gRNA sequence
aagaataaaaacccaccctc

SEQ ID NO: 108635 - DNA, 20 bp, Artificial
  CRISPR gRNA sequence
agaataaaaacccaccctcc

SEQ ID NO: 108636 - DNA, 20 bp, Artificial
  CRISPR gRNA sequence
gaataaaaacccaccctcca

SEQ ID NO: 108637 - DNA, 20 bp, Artificial
  CRISPR gRNA sequence
aaacccaccctccagggcac

SEQ ID NO: 108638 - DNA, 20 bp, Artificial
  CRISPR gRNA sequence
ctccagggcactggtgtgaa

SEQ ID NO: 108639 - DNA, 20 bp, Artificial
  CRISPR gRNA sequence
ccagggcactggtgtgaatg

SEQ ID NO: 108640 - DNA, 20 bp, Artificial
  CRISPR gRNA sequence
cagggcactggtgtgaatgg

SEQ ID NO: 108641 - DNA, 20 bp, Artificial
  CRISPR gRNA sequence
agggcactggtgtgaatgga

SEQ ID NO: 108642 - DNA, 20 bp, Artificial
  CRISPR gRNA sequence
tgtgaatggagggccctttg

SEQ ID NO: 108643 - DNA, 20 bp, Artificial
  CRISPR gRNA sequence
gtggaatcccttcctctaaa

SEQ ID NO: 108644 - DNA, 20 bp, Artificial
  CRISPR gRNA sequence
tggaatcccttcctctaaaa

SEQ ID NO: 108645 - DNA, 20 bp, Artificial
  CRISPR gRNA sequence
aatcccttcctctaaaaagg

SEQ ID NO: 108646 - DNA, 20 bp, Artificial
  CRISPR gRNA sequence
ttcctctaaaaaggcagttg

SEQ ID NO: 108647 - DNA, 20 bp, Artificial
  CRISPR gRNA sequence
tcctctaaaaaggcagttga

SEQ ID NO: 108648 - DNA, 20 bp, Artificial
  CRISPR gRNA sequence
aggcagttgaaggaaactgc

SEQ ID NO: 108649 - DNA, 20 bp, Artificial
  CRISPR gRNA sequence
gcagttgaaggaaactgcca

SEQ ID NO: 108650 - DNA, 20 bp, Artificial
  CRISPR gRNA sequence
gaaggaaactgccagagcca

SEQ ID NO: 108651 - DNA, 20 bp, Artificial
  CRISPR gRNA sequence
ggaaactgccagagccacag

SEQ ID NO: 108652 - DNA, 20 bp, Artificial
  CRISPR gRNA sequence
ccagagccacagcagctgta

SEQ ID NO: 108653 - DNA, 20 bp, Artificial
  CRISPR gRNA sequence
gagccacagcagctgtatgg

SEQ ID NO: 108654 - DNA, 20 bp, Artificial
  CRISPR gRNA sequence
agccacagcagctgtatgga

SEQ ID NO: 108655 - DNA, 20 bp, Artificial
  CRISPR gRNA sequence
gccacagcagctgtatggaa

SEQ ID NO: 108656 - DNA, 20 bp, Artificial
  CRISPR gRNA sequence
cagcagctgtatggaaggga

SEQ ID NO: 108657 - DNA, 20 bp, Artificial
  CRISPR gRNA sequence
tgtatggaagggaaagctat

SEQ ID NO: 108658 - DNA, 20 bp, Artificial
  CRISPR gRNA sequence
gtatggaagggaaagctatc

SEQ ID NO: 108659 - DNA, 20 bp, Artificial
  CRISPR gRNA sequence
tatggaagggaaagctatca

SEQ ID NO: 108660 - DNA, 20 bp, Artificial
  CRISPR gRNA sequence
atggaagggaaagctatcag

SEQ ID NO: 108661 - DNA, 20 bp, Artificial
  CRISPR gRNA sequence
ggaagggaaagctatcaggg

SEQ ID NO: 108662 - DNA, 20 bp, Artificial
  CRISPR gRNA sequence
gggagttcgtctttgatcat

SEQ ID NO: 108663 - DNA, 20 bp, Artificial
  CRISPR gRNA sequence
gttcgtctttgatcattaga

SEQ ID NO: 108664 - DNA, 20 bp, Artificial
  CRISPR gRNA sequence
ttcgtctttgatcattagac

SEQ ID NO: 108665 - DNA, 20 bp, Artificial
  CRISPR gRNA sequence
tccctactacttttctatat

SEQ ID NO: 108666 - DNA, 20 bp, Artificial
  CRISPR gRNA sequence
taaattccattttgaaaaca

SEQ ID NO: 108667 - DNA, 20 bp, Artificial
  CRISPR gRNA sequence
tatttccaaaatatcaatct

SEQ ID NO: 108668 - DNA, 20 bp, Artificial
  CRISPR gRNA sequence
caaaatatcaatcttggcct

SEQ ID NO: 108669 - DNA, 20 bp, Artificial
  CRISPR gRNA sequence
aaaatatcaatcttggccta

SEQ ID NO: 108670 - DNA, 20 bp, Artificial
  CRISPR gRNA sequence
aatcttggcctaaggtcaaa

SEQ ID NO: 108671 - DNA, 20 bp, Artificial
  CRISPR gRNA sequence
cataatacatttttttcttc

SEQ ID NO: 108672 - DNA, 20 bp, Artificial
  CRISPR gRNA sequence
ataatacatttttttcttct

SEQ ID NO: 108673 - DNA, 20 bp, Artificial
  CRISPR gRNA sequence
taatacatttttttcttctg

SEQ ID NO: 108674 - DNA, 20 bp, Artificial
  CRISPR gRNA sequence
tacatttttttcttctgggg

SEQ ID NO: 108675 - DNA, 20 bp, Artificial
  CRISPR gRNA sequence
acatttttttcttctggggt

SEQ ID NO: 108676 - DNA, 20 bp, Artificial
  CRISPR gRNA sequence
catttttttcttctggggtg

SEQ ID NO: 108677 - DNA, 20 bp, Artificial
  CRISPR gRNA sequence
ttcttctggggtggggaaaa

SEQ ID NO: 108678 - DNA, 20 bp, Artificial
  CRISPR gRNA sequence
aattttactataataaaccc

SEQ ID NO: 108679 - DNA, 20 bp, Artificial
  CRISPR gRNA sequence
ctataataaacccaagcata

SEQ ID NO: 108680 - DNA, 20 bp, Artificial
  CRISPR gRNA sequence
taaacccaagcataaagcat

SEQ ID NO: 108681 - DNA, 20 bp, Artificial
  CRISPR gRNA sequence
tgtaacctgtgtataaattc

SEQ ID NO: 108682 - DNA, 20 bp, Artificial
  CRISPR gRNA sequence
acctgtgtataaattcaaga

SEQ ID NO: 108683 - DNA, 20 bp, Artificial
  CRISPR gRNA sequence
caagaaagcaatctattaat

SEQ ID NO: 108684 - DNA, 20 bp, Artificial
  CRISPR gRNA sequence
aagaaagcaatctattaatt

SEQ ID NO: 108685 - DNA, 20 bp, Artificial
  CRISPR gRNA sequence
tctattaattaggaataaac

SEQ ID NO: 108686 - DNA, 20 bp, Artificial
  CRISPR gRNA sequence
attaattaggaataaaccag

SEQ ID NO: 108687 - DNA, 20 bp, Artificial
  CRISPR gRNA sequence
aattaggaataaaccagcag

SEQ ID NO: 108688 - DNA, 20 bp, Artificial
  CRISPR gRNA sequence
attaggaataaaccagcagc

SEQ ID NO: 108689 - DNA, 20 bp, Artificial
  CRISPR gRNA sequence
ttaggaataaaccagcagca

SEQ ID NO: 108690 - DNA, 20 bp, Artificial
  CRISPR gRNA sequence
agcagcagggaattcctttc

SEQ ID NO: 108691 - DNA, 20 bp, Artificial
  CRISPR gRNA sequence
ttctagtatgtcttatccat

SEQ ID NO: 108692 - DNA, 20 bp, Artificial
  CRISPR gRNA sequence
gtatgtcttatccataagaa

SEQ ID NO: 108693 - DNA, 20 bp, Artificial
  CRISPR gRNA sequence
atattatcctaatgttaaac

SEQ ID NO: 108694 - DNA, 20 bp, Artificial
  CRISPR gRNA sequence
attatcctaatgttaaacca

SEQ ID NO: 108695 - DNA, 20 bp, Artificial
  CRISPR gRNA sequence
gcttttctgaataaaaaatg

SEQ ID NO: 108696 - DNA, 20 bp, Artificial
  CRISPR gRNA sequence
tttctgaataaaaaatgtgg

SEQ ID NO: 108697 - DNA, 20 bp, Artificial
  CRISPR gRNA sequence
tggcagaccaaatcaaaaaa

SEQ ID NO: 108698 - DNA, 20 bp, Artificial
  CRISPR gRNA sequence
cagaccaaatcaaaaaacag

SEQ ID NO: 108699 - DNA, 20 bp, Artificial
  CRISPR gRNA sequence
tcaaaaaacagaagatttat

SEQ ID NO: 108700 - DNA, 20 bp, Artificial
  CRISPR gRNA sequence
aaaaacagaagatttattgg

SEQ ID NO: 108701 - DNA, 20 bp, Artificial
  CRISPR gRNA sequence
agatttattggaagctatgt

SEQ ID NO: 108702 - DNA, 20 bp, Artificial
  CRISPR gRNA sequence
ctatgttggtttgtctgttg

SEQ ID NO: 108703 - DNA, 20 bp, Artificial
  CRISPR gRNA sequence
tggtttgtctgttgtggcca

SEQ ID NO: 108704 - DNA, 20 bp, Artificial
  CRISPR gRNA sequence
ccaaagacttactaaatcac

SEQ ID NO: 108705 - DNA, 20 bp, Artificial
  CRISPR gRNA sequence
agacttactaaatcacaagt

SEQ ID NO: 108706 - DNA, 20 bp, Artificial
  CRISPR gRNA sequence
aatcacaagttagctcaaac

SEQ ID NO: 108707 - DNA, 20 bp, Artificial
  CRISPR gRNA sequence
cacaagttagctcaaacaag

SEQ ID NO: 108708 - DNA, 20 bp, Artificial
  CRISPR gRNA sequence
caagttagctcaaacaagaa

SEQ ID NO: 108709 - DNA, 20 bp, Artificial
  CRISPR gRNA sequence
agctcaaacaagaagagaaa

SEQ ID NO: 108710 - DNA, 20 bp, Artificial
  CRISPR gRNA sequence
aagaagagaaaaagaccaaa

SEQ ID NO: 108711 - DNA, 20 bp, Artificial
  CRISPR gRNA sequence
gaaaaagaccaaatagaatc

SEQ ID NO: 108712 - DNA, 20 bp, Artificial
  CRISPR gRNA sequence
tagaatccagaaaaatttta

SEQ ID NO: 108713 - DNA, 20 bp, Artificial
  CRISPR gRNA sequence
ccaaatttccatctgaaaac

SEQ ID NO: 108714 - DNA, 20 bp, Artificial
  CRISPR gRNA sequence
tttccatctgaaaaccagac

SEQ ID NO: 108715 - DNA, 20 bp, Artificial
  CRISPR gRNA sequence
tagatgtttttacttaaaat

SEQ ID NO: 108716 - DNA, 20 bp, Artificial
  CRISPR gRNA sequence
ttttacttaaaatgagataa

SEQ ID NO: 108717 - DNA, 20 bp, Artificial
  CRISPR gRNA sequence
ttacttaaaatgagataaaa

SEQ ID NO: 108718 - DNA, 20 bp, Artificial
  CRISPR gRNA sequence
tacttaaaatgagataaaag

SEQ ID NO: 108719 - DNA, 20 bp, Artificial
  CRISPR gRNA sequence
aagaggcaatttactataac

SEQ ID NO: 108720 - DNA, 20 bp, Artificial
  CRISPR gRNA sequence
agaggcaatttactataacc

SEQ ID NO: 108721 - DNA, 20 bp, Artificial
  CRISPR gRNA sequence
actataaccaggcacccatg

SEQ ID NO: 108722 - DNA, 20 bp, Artificial
  CRISPR gRNA sequence
tataaccaggcacccatgaa

SEQ ID NO: 108723 - DNA, 20 bp, Artificial
  CRISPR gRNA sequence
aaccaggcacccatgaagag

SEQ ID NO: 108724 - DNA, 20 bp, Artificial
  CRISPR gRNA sequence
acccatgaagagtagattct

SEQ ID NO: 108725 - DNA, 20 bp, Artificial
  CRISPR gRNA sequence
catgaagagtagattctaag

SEQ ID NO: 108726 - DNA, 20 bp, Artificial
  CRISPR gRNA sequence
gagtagattctaagtggtca

SEQ ID NO: 108727 - DNA, 20 bp, Artificial
  CRISPR gRNA sequence
agtagattctaagtggtcat

SEQ ID NO: 108728 - DNA, 20 bp, Artificial
  CRISPR gRNA sequence
gattctaagtggtcatgggc

SEQ ID NO: 108729 - DNA, 20 bp, Artificial
  CRISPR gRNA sequence
aagtggtcatgggctagaca

SEQ ID NO: 108730 - DNA, 20 bp, Artificial
  CRISPR gRNA sequence
atgggctagacatggcattt

SEQ ID NO: 108731 - DNA, 20 bp, Artificial
  CRISPR gRNA sequence
tagacatggcatttcagcac

SEQ ID NO: 108732 - DNA, 20 bp, Artificial
  CRISPR gRNA sequence
ggcatttcagcacaagccat

SEQ ID NO: 108733 - DNA, 20 bp, Artificial
  CRISPR gRNA sequence
catcagacccaatatctcac

SEQ ID NO: 108734 - DNA, 20 bp, Artificial
  CRISPR gRNA sequence
acccaatatctcacaagatc

SEQ ID NO: 108735 - DNA, 20 bp, Artificial
  CRISPR gRNA sequence
gtatctttcaaataattccc

SEQ ID NO: 108736 - DNA, 20 bp, Artificial
  CRISPR gRNA sequence
tatctttcaaataattcccc

SEQ ID NO: 108737 - DNA, 20 bp, Artificial
  CRISPR gRNA sequence
atctttcaaataattcccca

SEQ ID NO: 108738 - DNA, 20 bp, Artificial
  CRISPR gRNA sequence
caaataattccccagggcaa

SEQ ID NO: 108739 - DNA, 20 bp, Artificial
  CRISPR gRNA sequence
gggcaatagaccaaccaatt

SEQ ID NO: 108740 - DNA, 20 bp, Artificial
  CRISPR gRNA sequence
caatagaccaaccaattgag

SEQ ID NO: 108741 - DNA, 20 bp, Artificial
  CRISPR gRNA sequence
caattgagtggtgctgttat

SEQ ID NO: 108742 - DNA, 20 bp, Artificial
  CRISPR gRNA sequence
tttcattgctgtaatgttta

SEQ ID NO: 108743 - DNA, 20 bp, Artificial
  CRISPR gRNA sequence
cattgctgtaatgtttaaag

SEQ ID NO: 108744 - DNA, 20 bp, Artificial
  CRISPR gRNA sequence
gctgctgaatctgtcctgcc

SEQ ID NO: 108745 - DNA, 20 bp, Artificial
  CRISPR gRNA sequence
gtttgctgtatactgctcca

SEQ ID NO: 108746 - DNA, 20 bp, Artificial
  CRISPR gRNA sequence
tactgctccatggtccctcc

SEQ ID NO: 108747 - DNA, 20 bp, Artificial
  CRISPR gRNA sequence
gctccatggtccctccaagt

SEQ ID NO: 108748 - DNA, 20 bp, Artificial
  CRISPR gRNA sequence
agtgagattcctgtccactc

SEQ ID NO: 108749 - DNA, 20 bp, Artificial
  CRISPR gRNA sequence
tgagattcctgtccactctg

SEQ ID NO: 108750 - DNA, 20 bp, Artificial
  CRISPR gRNA sequence
cctgtccactctggagatcc

SEQ ID NO: 108751 - DNA, 20 bp, Artificial
  CRISPR gRNA sequence
gtccactctggagatcctag

SEQ ID NO: 108752 - DNA, 20 bp, Artificial
  CRISPR gRNA sequence
tccactctggagatcctaga

SEQ ID NO: 108753 - DNA, 20 bp, Artificial
  CRISPR gRNA sequence
tggagatcctagaaggctgt

SEQ ID NO: 108754 - DNA, 20 bp, Artificial
  CRISPR gRNA sequence
ggagatcctagaaggctgtg

SEQ ID NO: 108755 - DNA, 20 bp, Artificial
  CRISPR gRNA sequence
gctgtgaggtacactcctgt

SEQ ID NO: 108756 - DNA, 20 bp, Artificial
  CRISPR gRNA sequence
tgaggtacactcctgttaga

SEQ ID NO: 108757 - DNA, 20 bp, Artificial
  CRISPR gRNA sequence
gaggtacactcctgttagaa

SEQ ID NO: 108758 - DNA, 20 bp, Artificial
  CRISPR gRNA sequence
gtacactcctgttagaaagg

SEQ ID NO: 108759 - DNA, 20 bp, Artificial
  CRISPR gRNA sequence
tacactcctgttagaaaggt

SEQ ID NO: 108760 - DNA, 20 bp, Artificial
  CRISPR gRNA sequence
acactcctgttagaaaggtg

SEQ ID NO: 108761 - DNA, 20 bp, Artificial
  CRISPR gRNA sequence
tcctgttagaaaggtgggga

SEQ ID NO: 108762 - DNA, 20 bp, Artificial
  CRISPR gRNA sequence
aaaggtggggaaagaaacta

SEQ ID NO: 108763 - DNA, 20 bp, Artificial
  CRISPR gRNA sequence
gtggggaaagaaactaaagt

SEQ ID NO: 108764 - DNA, 20 bp, Artificial
  CRISPR gRNA sequence
ctaaagtgagattgtcaata

SEQ ID NO: 108765 - DNA, 20 bp, Artificial
  CRISPR gRNA sequence
taaagtgagattgtcaataa

SEQ ID NO: 108766 - DNA, 20 bp, Artificial
  CRISPR gRNA sequence
attgtcaataaaggccttac

SEQ ID NO: 108767 - DNA, 20 bp, Artificial
  CRISPR gRNA sequence
gccttaccagacaattaacc

SEQ ID NO: 108768 - DNA, 20 bp, Artificial
  CRISPR gRNA sequence
tatcactgtactttatttgc

SEQ ID NO: 108769 - DNA, 20 bp, Artificial
  CRISPR gRNA sequence
gtactttatttgcaagaaaa

SEQ ID NO: 108770 - DNA, 20 bp, Artificial
  CRISPR gRNA sequence
tactttatttgcaagaaaac

SEQ ID NO: 108771 - DNA, 20 bp, Artificial
  CRISPR gRNA sequence
ttatttgcaagaaaacagga

SEQ ID NO: 108772 - DNA, 20 bp, Artificial
  CRISPR gRNA sequence
tatttgcaagaaaacaggat

SEQ ID NO: 108773 - DNA, 20 bp, Artificial
  CRISPR gRNA sequence
tttgcaagaaaacaggatag

SEQ ID NO: 108774 - DNA, 20 bp, Artificial
  CRISPR gRNA sequence
aagaaaacaggataggagaa

SEQ ID NO: 108775 - DNA, 20 bp, Artificial
  CRISPR gRNA sequence
agaaaacaggataggagaat

SEQ ID NO: 108776 - DNA, 20 bp, Artificial
  CRISPR gRNA sequence
gaataggaaatgcttatatt

SEQ ID NO: 108777 - DNA, 20 bp, Artificial
  CRISPR gRNA sequence
tattcagtatcatttttaac

SEQ ID NO: 108778 - DNA, 20 bp, Artificial
  CRISPR gRNA sequence
attcagtatcatttttaact

SEQ ID NO: 108779 - DNA, 20 bp, Artificial
  CRISPR gRNA sequence
catttttaactgggattaca

SEQ ID NO: 108780 - DNA, 20 bp, Artificial
  CRISPR gRNA sequence
tcacgtttctaaaatgcttt

SEQ ID NO: 108781 - DNA, 20 bp, Artificial
  CRISPR gRNA sequence
ctaaaatgctttcagtatac

SEQ ID NO: 108782 - DNA, 20 bp, Artificial
  CRISPR gRNA sequence
accttacctttcaatactgt

SEQ ID NO: 108783 - DNA, 20 bp, Artificial
  CRISPR gRNA sequence
cttacctttcaatactgtca

SEQ ID NO: 108784 - DNA, 20 bp, Artificial
  CRISPR gRNA sequence
tcagagcaatacttgcacct

SEQ ID NO: 108785 - DNA, 20 bp, Artificial
  CRISPR gRNA sequence
agagcaatacttgcacctaa

SEQ ID NO: 108786 - DNA, 20 bp, Artificial
  CRISPR gRNA sequence
gcacctaagagatactcgtt

SEQ ID NO: 108787 - DNA, 20 bp, Artificial
  CRISPR gRNA sequence
aagctacatcactttgatac

SEQ ID NO: 108788 - DNA, 20 bp, Artificial
  CRISPR gRNA sequence
agctacatcactttgataca

SEQ ID NO: 108789 - DNA, 20 bp, Artificial
  CRISPR gRNA sequence
gcatacctaacactgatttt

SEQ ID NO: 108790 - DNA, 20 bp, Artificial
  CRISPR gRNA sequence
catacctaacactgattttc

SEQ ID NO: 108791 - DNA, 20 bp, Artificial
  CRISPR gRNA sequence
tcaggtttgcacatatactt

SEQ ID NO: 108792 - DNA, 20 bp, Artificial
  CRISPR gRNA sequence
aggtttgcacatatacttta

SEQ ID NO: 108793 - DNA, 20 bp, Artificial
  CRISPR gRNA sequence
cacatatactttagagaata

SEQ ID NO: 108794 - DNA, 20 bp, Artificial
  CRISPR gRNA sequence
ttagagaataaagcttcttt

SEQ ID NO: 108795 - DNA, 20 bp, Artificial
  CRISPR gRNA sequence
ttcccaccaaacatgttact

SEQ ID NO: 108796 - DNA, 20 bp, Artificial
  CRISPR gRNA sequence
tcccaccaaacatgttactc

SEQ ID NO: 108797 - DNA, 20 bp, Artificial
  CRISPR gRNA sequence
ttactcaggtccactacata

SEQ ID NO: 108798 - DNA, 20 bp, Artificial
  CRISPR gRNA sequence
ctcaggtccactacatatgg

SEQ ID NO: 108799 - DNA, 20 bp, Artificial
  CRISPR gRNA sequence
tcaggtccactacatatggt

SEQ ID NO: 108800 - DNA, 20 bp, Artificial
  CRISPR gRNA sequence
ggcaaaatttacccttctca

SEQ ID NO: 108801 - DNA, 20 bp, Artificial
  CRISPR gRNA sequence
ttacccttctcatagacttt

SEQ ID NO: 108802 - DNA, 20 bp, Artificial
  CRISPR gRNA sequence
acccttctcatagactttaa

SEQ ID NO: 108803 - DNA, 20 bp, Artificial
  CRISPR gRNA sequence
ctcatagactttaagagttg

SEQ ID NO: 108804 - DNA, 20 bp, Artificial
  CRISPR gRNA sequence
gaagatccacttttaaaaat

SEQ ID NO: 108805 - DNA, 20 bp, Artificial
  CRISPR gRNA sequence
aagatccacttttaaaaata

SEQ ID NO: 108806 - DNA, 20 bp, Artificial
  CRISPR gRNA sequence
tttaaaaataaggatacaat

SEQ ID NO: 108807 - DNA, 20 bp, Artificial
  CRISPR gRNA sequence
agataaactgaatgatatct

SEQ ID NO: 108808 - DNA, 20 bp, Artificial
  CRISPR gRNA sequence
atatctgagaacctttaata

SEQ ID NO: 108809 - DNA, 20 bp, Artificial
  CRISPR gRNA sequence
ttaaaaaattaaaatgatat

SEQ ID NO: 108810 - DNA, 20 bp, Artificial
  CRISPR gRNA sequence
aaaattaaaatgatataagt

SEQ ID NO: 108811 - DNA, 20 bp, Artificial
  CRISPR gRNA sequence
aaatgatataagttagcaat

SEQ ID NO: 108812 - DNA, 20 bp, Artificial
  CRISPR gRNA sequence
tagcaatcggcaattcatct

SEQ ID NO: 108813 - DNA, 20 bp, Artificial
  CRISPR gRNA sequence
ggcaattcatcttggaaata

SEQ ID NO: 108814 - DNA, 20 bp, Artificial
  CRISPR gRNA sequence
gcaattcatcttggaaatat

SEQ ID NO: 108815 - DNA, 20 bp, Artificial
  CRISPR gRNA sequence
aattcatcttggaaatatgg

SEQ ID NO: 108816 - DNA, 20 bp, Artificial
  CRISPR gRNA sequence
attcatcttggaaatatggg

SEQ ID NO: 108817 - DNA, 20 bp, Artificial
  CRISPR gRNA sequence
ttcatcttggaaatatggga

SEQ ID NO: 108818 - DNA, 20 bp, Artificial
  CRISPR gRNA sequence
catcttggaaatatgggagg

SEQ ID NO: 108819 - DNA, 20 bp, Artificial
  CRISPR gRNA sequence
atcttggaaatatgggaggg

SEQ ID NO: 108820 - DNA, 20 bp, Artificial
  CRISPR gRNA sequence
tggaaatatgggagggagga

SEQ ID NO: 108821 - DNA, 20 bp, Artificial
  CRISPR gRNA sequence
cagatatataaacaaaaatg

SEQ ID NO: 108822 - DNA, 20 bp, Artificial
  CRISPR gRNA sequence
tatataaacaaaaatgtaga

SEQ ID NO: 108823 - DNA, 20 bp, Artificial
  CRISPR gRNA sequence
atataaacaaaaatgtagat

SEQ ID NO: 108824 - DNA, 20 bp, Artificial
  CRISPR gRNA sequence
ctttctctctgatttttcac

SEQ ID NO: 108825 - DNA, 20 bp, Artificial
  CRISPR gRNA sequence
tttctctctgatttttcact

SEQ ID NO: 108826 - DNA, 20 bp, Artificial
  CRISPR gRNA sequence
taaaatgacgtgacctaact

SEQ ID NO: 108827 - DNA, 20 bp, Artificial
  CRISPR gRNA sequence
aactgagctgctcattatcg

SEQ ID NO: 108828 - DNA, 20 bp, Artificial
  CRISPR gRNA sequence
agctgctcattatcgtggca

SEQ ID NO: 108829 - DNA, 20 bp, Artificial
  CRISPR gRNA sequence
ctcattatcgtggcaaagta

SEQ ID NO: 108830 - DNA, 20 bp, Artificial
  CRISPR gRNA sequence
ctccataaatccacacatgc

SEQ ID NO: 108831 - DNA, 20 bp, Artificial
  CRISPR gRNA sequence
cataaatccacacatgctgg

SEQ ID NO: 108832 - DNA, 20 bp, Artificial
  CRISPR gRNA sequence
tggtggaattaatcatttgc

SEQ ID NO: 108833 - DNA, 20 bp, Artificial
  CRISPR gRNA sequence
ggtggaattaatcatttgca

SEQ ID NO: 108834 - DNA, 20 bp, Artificial
  CRISPR gRNA sequence
atttgcaaggtgtctcaata

SEQ ID NO: 108835 - DNA, 20 bp, Artificial
  CRISPR gRNA sequence
ggtgtctcaatacagtgtga

SEQ ID NO: 108836 - DNA, 20 bp, Artificial
  CRISPR gRNA sequence
gtctcaatacagtgtgaaag

SEQ ID NO: 108837 - DNA, 20 bp, Artificial
  CRISPR gRNA sequence
atatgtgcaactatatgtcc

SEQ ID NO: 108838 - DNA, 20 bp, Artificial
  CRISPR gRNA sequence
caactatatgtccaagtact

SEQ ID NO: 108839 - DNA, 20 bp, Artificial
  CRISPR gRNA sequence
tatatgtccaagtacttaga

SEQ ID NO: 108840 - DNA, 20 bp, Artificial
  CRISPR gRNA sequence
atgtccaagtacttagaaag

SEQ ID NO: 108841 - DNA, 20 bp, Artificial
  CRISPR gRNA sequence
ctttgaaatgcatcaaaaaa

SEQ ID NO: 108842 - DNA, 20 bp, Artificial
  CRISPR gRNA sequence
tgcatcaaaaaatggatgaa

SEQ ID NO: 108843 - DNA, 20 bp, Artificial
  CRISPR gRNA sequence
gcatcaaaaaatggatgaat

SEQ ID NO: 108844 - DNA, 20 bp, Artificial
  CRISPR gRNA sequence
tcaaaaaatggatgaatggg

SEQ ID NO: 108845 - DNA, 20 bp, Artificial
  CRISPR gRNA sequence
aaaaaatggatgaatgggtg

SEQ ID NO: 108846 - DNA, 20 bp, Artificial
  CRISPR gRNA sequence
tgaatgggtggagaaatatc

SEQ ID NO: 108847 - DNA, 20 bp, Artificial
  CRISPR gRNA sequence
tgggtggagaaatatctggt

SEQ ID NO: 108848 - DNA, 20 bp, Artificial
  CRISPR gRNA sequence
gggtggagaaatatctggta

SEQ ID NO: 108849 - DNA, 20 bp, Artificial
  CRISPR gRNA sequence
aatatctggtaaggcaatta

SEQ ID NO: 108850 - DNA, 20 bp, Artificial
  CRISPR gRNA sequence
tctggtaaggcaattatagt

SEQ ID NO: 108851 - DNA, 20 bp, Artificial
  CRISPR gRNA sequence
caattatagtaagatgttaa

SEQ ID NO: 108852 - DNA, 20 bp, Artificial
  CRISPR gRNA sequence
agatgttaatagaccctaac

SEQ ID NO: 108853 - DNA, 20 bp, Artificial
  CRISPR gRNA sequence
tgttaatagaccctaactgg

SEQ ID NO: 108854 - DNA, 20 bp, Artificial
  CRISPR gRNA sequence
gttaatagaccctaactggc

SEQ ID NO: 108855 - DNA, 20 bp, Artificial
  CRISPR gRNA sequence
gaccctaactggcaggtata

SEQ ID NO: 108856 - DNA, 20 bp, Artificial
  CRISPR gRNA sequence
accctaactggcaggtatac

SEQ ID NO: 108857 - DNA, 20 bp, Artificial
  CRISPR gRNA sequence
cacttgaaaattcttatttc

SEQ ID NO: 108858 - DNA, 20 bp, Artificial
  CRISPR gRNA sequence
aaaattcttatttctagaat

SEQ ID NO: 108859 - DNA, 20 bp, Artificial
  CRISPR gRNA sequence
atttctagaataagaatttt

SEQ ID NO: 108860 - DNA, 20 bp, Artificial
  CRISPR gRNA sequence
cttatttcccaaatgaatgt

SEQ ID NO: 108861 - DNA, 20 bp, Artificial
  CRISPR gRNA sequence
ccaaatgaatgttggaatgt

SEQ ID NO: 108862 - DNA, 20 bp, Artificial
  CRISPR gRNA sequence
caaatgaatgttggaatgtt

SEQ ID NO: 108863 - DNA, 20 bp, Artificial
  CRISPR gRNA sequence
cccattactcataaccaaaa

SEQ ID NO: 108864 - DNA, 20 bp, Artificial
  CRISPR gRNA sequence
aaccaaaatggatacaacat

SEQ ID NO: 108865 - DNA, 20 bp, Artificial
  CRISPR gRNA sequence
gatacaacataagaatctat

SEQ ID NO: 108866 - DNA, 20 bp, Artificial
  CRISPR gRNA sequence
aatctatgagccataaataa

SEQ ID NO: 108867 - DNA, 20 bp, Artificial
  CRISPR gRNA sequence
atctatgagccataaataac

SEQ ID NO: 108868 - DNA, 20 bp, Artificial
  CRISPR gRNA sequence
aataacaggctatgtcatca

SEQ ID NO: 108869 - DNA, 20 bp, Artificial
  CRISPR gRNA sequence
acaggctatgtcatcacagc

SEQ ID NO: 108870 - DNA, 20 bp, Artificial
  CRISPR gRNA sequence
aggctatgtcatcacagcaa

SEQ ID NO: 108871 - DNA, 20 bp, Artificial
  CRISPR gRNA sequence
ggctatgtcatcacagcaag

SEQ ID NO: 108872 - DNA, 20 bp, Artificial
  CRISPR gRNA sequence
catcacagcaagaggacttg

SEQ ID NO: 108873 - DNA, 20 bp, Artificial
  CRISPR gRNA sequence
caagaggacttgtggccata

SEQ ID NO: 108874 - DNA, 20 bp, Artificial
  CRISPR gRNA sequence
tgtggccatatggttctcca

SEQ ID NO: 108875 - DNA, 20 bp, Artificial
  CRISPR gRNA sequence
aagcactgcccttgatctaa

SEQ ID NO: 108876 - DNA, 20 bp, Artificial
  CRISPR gRNA sequence
tgatctaatggaatgctcgc

SEQ ID NO: 108877 - DNA, 20 bp, Artificial
  CRISPR gRNA sequence
gatctaatggaatgctcgct

SEQ ID NO: 108878 - DNA, 20 bp, Artificial
  CRISPR gRNA sequence
atgctcgctaggtaaatttc

SEQ ID NO: 108879 - DNA, 20 bp, Artificial
  CRISPR gRNA sequence
gtaaatttctagctataatt

SEQ ID NO: 108880 - DNA, 20 bp, Artificial
  CRISPR gRNA sequence
ctataatttggatttacata

SEQ ID NO: 108881 - DNA, 20 bp, Artificial
  CRISPR gRNA sequence
atttggatttacatatagat

SEQ ID NO: 108882 - DNA, 20 bp, Artificial
  CRISPR gRNA sequence
tttacatatagattggccaa

SEQ ID NO: 108883 - DNA, 20 bp, Artificial
  CRISPR gRNA sequence
ttacatatagattggccaac

SEQ ID NO: 108884 - DNA, 20 bp, Artificial
  CRISPR gRNA sequence
tacatatagattggccaaca

SEQ ID NO: 108885 - DNA, 20 bp, Artificial
  CRISPR gRNA sequence
catatagattggccaacagg

SEQ ID NO: 108886 - DNA, 20 bp, Artificial
  CRISPR gRNA sequence
caacagggagcaaatataat

SEQ ID NO: 108887 - DNA, 20 bp, Artificial
  CRISPR gRNA sequence
taatcagcaacatgacaaac

SEQ ID NO: 108888 - DNA, 20 bp, Artificial
  CRISPR gRNA sequence
cggttttctgatttttacac

SEQ ID NO: 108889 - DNA, 20 bp, Artificial
  CRISPR gRNA sequence
gatttttacaccagtctctt

SEQ ID NO: 108890 - DNA, 20 bp, Artificial
  CRISPR gRNA sequence
tacaccagtctctttggaat

SEQ ID NO: 108891 - DNA, 20 bp, Artificial
  CRISPR gRNA sequence
ctctttggaattggttgact

SEQ ID NO: 108892 - DNA, 20 bp, Artificial
  CRISPR gRNA sequence
ggttgactaagtctgctcct

SEQ ID NO: 108893 - DNA, 20 bp, Artificial
  CRISPR gRNA sequence
ttgactaagtctgctcctca

SEQ ID NO: 108894 - DNA, 20 bp, Artificial
  CRISPR gRNA sequence
agtctgctcctcagagattc

SEQ ID NO: 108895 - DNA, 20 bp, Artificial
  CRISPR gRNA sequence
gtctgctcctcagagattct

SEQ ID NO: 108896 - DNA, 20 bp, Artificial
  CRISPR gRNA sequence
ctcctcagagattctgggta

SEQ ID NO: 108897 - DNA, 20 bp, Artificial
  CRISPR gRNA sequence
cagagattctgggtatagaa

SEQ ID NO: 108898 - DNA, 20 bp, Artificial
  CRISPR gRNA sequence
ctgggtatagaatagaaaat

SEQ ID NO: 108899 - DNA, 20 bp, Artificial
  CRISPR gRNA sequence
tgggtatagaatagaaaatc

SEQ ID NO: 108900 - DNA, 20 bp, Artificial
  CRISPR gRNA sequence
agaatagaaaatcaggtttt

SEQ ID NO: 108901 - DNA, 20 bp, Artificial
  CRISPR gRNA sequence
tagaaaatcaggttttcagc

SEQ ID NO: 108902 - DNA, 20 bp, Artificial
  CRISPR gRNA sequence
caggttttcagccagactgt

SEQ ID NO: 108903 - DNA, 20 bp, Artificial
  CRISPR gRNA sequence
cagccagactgtgagtctgt

SEQ ID NO: 108904 - DNA, 20 bp, Artificial
  CRISPR gRNA sequence
agccagactgtgagtctgtt

SEQ ID NO: 108905 - DNA, 20 bp, Artificial
  CRISPR gRNA sequence
gccagactgtgagtctgtta

SEQ ID NO: 108906 - DNA, 20 bp, Artificial
  CRISPR gRNA sequence
ccagactgtgagtctgttag

SEQ ID NO: 108907 - DNA, 20 bp, Artificial
  CRISPR gRNA sequence
gagtctgttaggggcactaa

SEQ ID NO: 108908 - DNA, 20 bp, Artificial
  CRISPR gRNA sequence
agtctgttaggggcactaac

SEQ ID NO: 108909 - DNA, 20 bp, Artificial
  CRISPR gRNA sequence
tctaatacacaatacattta

SEQ ID NO: 108910 - DNA, 20 bp, Artificial
  CRISPR gRNA sequence
ggctataaactaataaaatt

SEQ ID NO: 108911 - DNA, 20 bp, Artificial
  CRISPR gRNA sequence
gctataaactaataaaatta

SEQ ID NO: 108912 - DNA, 20 bp, Artificial
  CRISPR gRNA sequence
catttatataaaatctccaa

SEQ ID NO: 108913 - DNA, 20 bp, Artificial
  CRISPR gRNA sequence
ataaaatctccaaaagacat

SEQ ID NO: 108914 - DNA, 20 bp, Artificial
  CRISPR gRNA sequence
tccaaaagacatcagtaatc

SEQ ID NO: 108915 - DNA, 20 bp, Artificial
  CRISPR gRNA sequence
caaaagacatcagtaatcta

SEQ ID NO: 108916 - DNA, 20 bp, Artificial
  CRISPR gRNA sequence
agacatcagtaatctagaga

SEQ ID NO: 108917 - DNA, 20 bp, Artificial
  CRISPR gRNA sequence
agtaatctagagacagaaaa

SEQ ID NO: 108918 - DNA, 20 bp, Artificial
  CRISPR gRNA sequence
tctagagacagaaaatggat

SEQ ID NO: 108919 - DNA, 20 bp, Artificial
  CRISPR gRNA sequence
agagacagaaaatggatcag

SEQ ID NO: 108920 - DNA, 20 bp, Artificial
  CRISPR gRNA sequence
aaaatggatcagtggttcct

SEQ ID NO: 108921 - DNA, 20 bp, Artificial
  CRISPR gRNA sequence
aaatggatcagtggttcctt

SEQ ID NO: 108922 - DNA, 20 bp, Artificial
  CRISPR gRNA sequence
atggatcagtggttccttgg

SEQ ID NO: 108923 - DNA, 20 bp, Artificial
  CRISPR gRNA sequence
gatcagtggttccttgggag

SEQ ID NO: 108924 - DNA, 20 bp, Artificial
  CRISPR gRNA sequence
tcagtggttccttgggagtg

SEQ ID NO: 108925 - DNA, 20 bp, Artificial
  CRISPR gRNA sequence
ttccttgggagtggagaata

SEQ ID NO: 108926 - DNA, 20 bp, Artificial
  CRISPR gRNA sequence
tccttgggagtggagaatac

SEQ ID NO: 108927 - DNA, 20 bp, Artificial
  CRISPR gRNA sequence
ccttgggagtggagaataca

SEQ ID NO: 108928 - DNA, 20 bp, Artificial
  CRISPR gRNA sequence
ttgggagtggagaatacagg

SEQ ID NO: 108929 - DNA, 20 bp, Artificial
  CRISPR gRNA sequence
gagtggagaatacagggaga

SEQ ID NO: 108930 - DNA, 20 bp, Artificial
  CRISPR gRNA sequence
agtggagaatacagggagac

SEQ ID NO: 108931 - DNA, 20 bp, Artificial
  CRISPR gRNA sequence
gagaatacagggagacagga

SEQ ID NO: 108932 - DNA, 20 bp, Artificial
  CRISPR gRNA sequence
gaatacagggagacaggaaa

SEQ ID NO: 108933 - DNA, 20 bp, Artificial
  CRISPR gRNA sequence
aatacagggagacaggaaag

SEQ ID NO: 108934 - DNA, 20 bp, Artificial
  CRISPR gRNA sequence
atacagggagacaggaaaga

SEQ ID NO: 108935 - DNA, 20 bp, Artificial
  CRISPR gRNA sequence
acagggagacaggaaagagg

SEQ ID NO: 108936 - DNA, 20 bp, Artificial
  CRISPR gRNA sequence
cagggagacaggaaagaggg

SEQ ID NO: 108937 - DNA, 20 bp, Artificial
  CRISPR gRNA sequence
caggaaagagggaggttgac

SEQ ID NO: 108938 - DNA, 20 bp, Artificial
  CRISPR gRNA sequence
aagagggaggttgactggca

SEQ ID NO: 108939 - DNA, 20 bp, Artificial
  CRISPR gRNA sequence
gagggaggttgactggcatg

SEQ ID NO: 108940 - DNA, 20 bp, Artificial
  CRISPR gRNA sequence
ggttgactggcatggagcct

SEQ ID NO: 108941 - DNA, 20 bp, Artificial
  CRISPR gRNA sequence
gttgactggcatggagcctt

SEQ ID NO: 108942 - DNA, 20 bp, Artificial
  CRISPR gRNA sequence
atggagccttaggaacattg

SEQ ID NO: 108943 - DNA, 20 bp, Artificial
  CRISPR gRNA sequence
tggagccttaggaacattgt

SEQ ID NO: 108944 - DNA, 20 bp, Artificial
  CRISPR gRNA sequence
ggagccttaggaacattgta

SEQ ID NO: 108945 - DNA, 20 bp, Artificial
  CRISPR gRNA sequence
aatgttttatatcttcattg

SEQ ID NO: 108946 - DNA, 20 bp, Artificial
  CRISPR gRNA sequence
gttttatatcttcattgtgg

SEQ ID NO: 108947 - DNA, 20 bp, Artificial
  CRISPR gRNA sequence
ttatatcttcattgtggtag

SEQ ID NO: 108948 - DNA, 20 bp, Artificial
  CRISPR gRNA sequence
tcattgtggtagcagttgca

SEQ ID NO: 108949 - DNA, 20 bp, Artificial
  CRISPR gRNA sequence
cattgtggtagcagttgcac

SEQ ID NO: 108950 - DNA, 20 bp, Artificial
  CRISPR gRNA sequence
attattatactttgtttcta

SEQ ID NO: 108951 - DNA, 20 bp, Artificial
  CRISPR gRNA sequence
ataaattgattttaaaaaat

SEQ ID NO: 108952 - DNA, 20 bp, Artificial
  CRISPR gRNA sequence
taaattgattttaaaaaata

SEQ ID NO: 108953 - DNA, 20 bp, Artificial
  CRISPR gRNA sequence
ttaaaaaataaggatcatga

SEQ ID NO: 108954 - DNA, 20 bp, Artificial
  CRISPR gRNA sequence
taaaaaataaggatcatgaa

SEQ ID NO: 108955 - DNA, 20 bp, Artificial
  CRISPR gRNA sequence
atcatgaaaggaatgtcttt

SEQ ID NO: 108956 - DNA, 20 bp, Artificial
  CRISPR gRNA sequence
tcatgaaaggaatgtctttt

SEQ ID NO: 108957 - DNA, 20 bp, Artificial
  CRISPR gRNA sequence
tccaaatttccttcttatat

SEQ ID NO: 108958 - DNA, 20 bp, Artificial
  CRISPR gRNA sequence
ttttttccttgactaatatc

SEQ ID NO: 108959 - DNA, 20 bp, Artificial
  CRISPR gRNA sequence
tttccttgactaatatccag

SEQ ID NO: 108960 - DNA, 20 bp, Artificial
  CRISPR gRNA sequence
ccagaagtttacatctttac

SEQ ID NO: 108961 - DNA, 20 bp, Artificial
  CRISPR gRNA sequence
acaagactaaatataacttg

SEQ ID NO: 108962 - DNA, 20 bp, Artificial
  CRISPR gRNA sequence
tgactaatatatgtaacgta

SEQ ID NO: 108963 - DNA, 20 bp, Artificial
  CRISPR gRNA sequence
gtacagattttcttcttaac

SEQ ID NO: 108964 - DNA, 20 bp, Artificial
  CRISPR gRNA sequence
tcttcttaactagtttattc

SEQ ID NO: 108965 - DNA, 20 bp, Artificial
  CRISPR gRNA sequence
gtaatacaaatgaaccaatt

SEQ ID NO: 108966 - DNA, 20 bp, Artificial
  CRISPR gRNA sequence
atatttaaatttatactttg

SEQ ID NO: 108967 - DNA, 20 bp, Artificial
  CRISPR gRNA sequence
atttaaatttatactttgaa

SEQ ID NO: 108968 - DNA, 20 bp, Artificial
  CRISPR gRNA sequence
tttatactttgaagagtatc

SEQ ID NO: 108969 - DNA, 20 bp, Artificial
  CRISPR gRNA sequence
ttgaagagtatcaagatttg

SEQ ID NO: 108970 - DNA, 20 bp, Artificial
  CRISPR gRNA sequence
gaagagtatcaagatttgaa

SEQ ID NO: 108971 - DNA, 20 bp, Artificial
  CRISPR gRNA sequence
gagtatcaagatttgaagag

SEQ ID NO: 108972 - DNA, 20 bp, Artificial
  CRISPR gRNA sequence
ttgaagagcagcttcaaatc

SEQ ID NO: 108973 - DNA, 20 bp, Artificial
  CRISPR gRNA sequence
aagagcagcttcaaatctag

SEQ ID NO: 108974 - DNA, 20 bp, Artificial
  CRISPR gRNA sequence
attctctctcacattaatga

SEQ ID NO: 108975 - DNA, 20 bp, Artificial
  CRISPR gRNA sequence
tctctctcacattaatgaca

SEQ ID NO: 108976 - DNA, 20 bp, Artificial
  CRISPR gRNA sequence
acattaatgacagagtgatt

SEQ ID NO: 108977 - DNA, 20 bp, Artificial
  CRISPR gRNA sequence
catgatattgatactgttaa

SEQ ID NO: 108978 - DNA, 20 bp, Artificial
  CRISPR gRNA sequence
ctgttaatggttaatgctat

SEQ ID NO: 108979 - DNA, 20 bp, Artificial
  CRISPR gRNA sequence
tggttaatgctataagcaac

SEQ ID NO: 108980 - DNA, 20 bp, Artificial
  CRISPR gRNA sequence
atgctataagcaactggctt

SEQ ID NO: 108981 - DNA, 20 bp, Artificial
  CRISPR gRNA sequence
ataagcaactggcttcagta

SEQ ID NO: 108982 - DNA, 20 bp, Artificial
  CRISPR gRNA sequence
tcatatgttcctactactgt

SEQ ID NO: 108983 - DNA, 20 bp, Artificial
  CRISPR gRNA sequence
gttcctactactgtgagctt

SEQ ID NO: 108984 - DNA, 20 bp, Artificial
  CRISPR gRNA sequence
ctactactgtgagcttcagt

SEQ ID NO: 108985 - DNA, 20 bp, Artificial
  CRISPR gRNA sequence
tactgtgagcttcagttagc

SEQ ID NO: 108986 - DNA, 20 bp, Artificial
  CRISPR gRNA sequence
aagactgcaatacaattcga

SEQ ID NO: 108987 - DNA, 20 bp, Artificial
  CRISPR gRNA sequence
caattcgatagtctttccca

SEQ ID NO: 108988 - DNA, 20 bp, Artificial
  CRISPR gRNA sequence
cccaaagtgcctctttgccc

SEQ ID NO: 108989 - DNA, 20 bp, Artificial
  CRISPR gRNA sequence
gcccaagattatgacaaact

SEQ ID NO: 108990 - DNA, 20 bp, Artificial
  CRISPR gRNA sequence
aagattatgacaaactaagc

SEQ ID NO: 108991 - DNA, 20 bp, Artificial
  CRISPR gRNA sequence
atgacaaactaagccagatt

SEQ ID NO: 108992 - DNA, 20 bp, Artificial
  CRISPR gRNA sequence
taagccagatttagtctgtc

SEQ ID NO: 108993 - DNA, 20 bp, Artificial
  CRISPR gRNA sequence
tagctcttgctcttaacaca

SEQ ID NO: 108994 - DNA, 20 bp, Artificial
  CRISPR gRNA sequence
tcttaacacaaagttttgaa

SEQ ID NO: 108995 - DNA, 20 bp, Artificial
  CRISPR gRNA sequence
ttttgaatggtttttcctca

SEQ ID NO: 108996 - DNA, 20 bp, Artificial
  CRISPR gRNA sequence
ttgaatggtttttcctcaaa

SEQ ID NO: 108997 - DNA, 20 bp, Artificial
  CRISPR gRNA sequence
gaatggtttttcctcaaaga

SEQ ID NO: 108998 - DNA, 20 bp, Artificial
  CRISPR gRNA sequence
atggtttttcctcaaagaga

SEQ ID NO: 108999 - DNA, 20 bp, Artificial
  CRISPR gRNA sequence
aagagagagaaacaaataat

SEQ ID NO: 109000 - DNA, 20 bp, Artificial
  CRISPR gRNA sequence
caaataataagtgtttattc

SEQ ID NO: 109001 - DNA, 20 bp, Artificial
  CRISPR gRNA sequence
taataagtgtttattctggc

SEQ ID NO: 109002 - DNA, 20 bp, Artificial
  CRISPR gRNA sequence
tagcatgaaaattctcttcc

SEQ ID NO: 109003 - DNA, 20 bp, Artificial
  CRISPR gRNA sequence
ttcctagtgcattctcttct

SEQ ID NO: 109004 - DNA, 20 bp, Artificial
  CRISPR gRNA sequence
tctctttgccccactattcc

SEQ ID NO: 109005 - DNA, 20 bp, Artificial
  CRISPR gRNA sequence
ctctttgccccactattcca

SEQ ID NO: 109006 - DNA, 20 bp, Artificial
  CRISPR gRNA sequence
cccactattccaaggtgcaa

SEQ ID NO: 109007 - DNA, 20 bp, Artificial
  CRISPR gRNA sequence
tattccaaggtgcaaaagct

SEQ ID NO: 109008 - DNA, 20 bp, Artificial
  CRISPR gRNA sequence
aaggtgcaaaagctgagact

SEQ ID NO: 109009 - DNA, 20 bp, Artificial
  CRISPR gRNA sequence
agacttagccaaccacttac

SEQ ID NO: 109010 - DNA, 20 bp, Artificial
  CRISPR gRNA sequence
gacttagccaaccacttact

SEQ ID NO: 109011 - DNA, 20 bp, Artificial
  CRISPR gRNA sequence
tactaggaacccattctatg

SEQ ID NO: 109012 - DNA, 20 bp, Artificial
  CRISPR gRNA sequence
gtggacctacacaaactcca

SEQ ID NO: 109013 - DNA, 20 bp, Artificial
  CRISPR gRNA sequence
ctccaaagctaaaacctctt

SEQ ID NO: 109014 - DNA, 20 bp, Artificial
  CRISPR gRNA sequence
aacctcttcagaaactcaac

SEQ ID NO: 109015 - DNA, 20 bp, Artificial
  CRISPR gRNA sequence
ttcagaaactcaactagtgt

SEQ ID NO: 109016 - DNA, 20 bp, Artificial
  CRISPR gRNA sequence
aactagtgtaagcatatgaa

SEQ ID NO: 109017 - DNA, 20 bp, Artificial
  CRISPR gRNA sequence
tgtaagcatatgaaaagcca

SEQ ID NO: 109018 - DNA, 20 bp, Artificial
  CRISPR gRNA sequence
gtaagcatatgaaaagccat

SEQ ID NO: 109019 - DNA, 20 bp, Artificial
  CRISPR gRNA sequence
gaaaagccataggattatca

SEQ ID NO: 109020 - DNA, 20 bp, Artificial
  CRISPR gRNA sequence
tcacagttgataatcactac

SEQ ID NO: 109021 - DNA, 20 bp, Artificial
  CRISPR gRNA sequence
cacagttgataatcactacc

SEQ ID NO: 109022 - DNA, 20 bp, Artificial
  CRISPR gRNA sequence
ttgataatcactaccaggca

SEQ ID NO: 109023 - DNA, 20 bp, Artificial
  CRISPR gRNA sequence
aatcactaccaggcaaagcc

SEQ ID NO: 109024 - DNA, 20 bp, Artificial
  CRISPR gRNA sequence
ctaccaggcaaagcctagaa

SEQ ID NO: 109025 - DNA, 20 bp, Artificial
  CRISPR gRNA sequence
ccaggcaaagcctagaacag

SEQ ID NO: 109026 - DNA, 20 bp, Artificial
  CRISPR gRNA sequence
acttttttgaccacaaccct

SEQ ID NO: 109027 - DNA, 20 bp, Artificial
  CRISPR gRNA sequence
ttttgaccacaacccttagt

SEQ ID NO: 109028 - DNA, 20 bp, Artificial
  CRISPR gRNA sequence
cacatttcattatcacaact

SEQ ID NO: 109029 - DNA, 20 bp, Artificial
  CRISPR gRNA sequence
actcagtgcacacatgtata

SEQ ID NO: 109030 - DNA, 20 bp, Artificial
  CRISPR gRNA sequence
aaagcatgtaactgaaatga

SEQ ID NO: 109031 - DNA, 20 bp, Artificial
  CRISPR gRNA sequence
gaaatgaaagtttcatgaaa

SEQ ID NO: 109032 - DNA, 20 bp, Artificial
  CRISPR gRNA sequence
catttacctttatacaacac

SEQ ID NO: 109033 - DNA, 20 bp, Artificial
  CRISPR gRNA sequence
atacaacacaagatgcactt

SEQ ID NO: 109034 - DNA, 20 bp, Artificial
  CRISPR gRNA sequence
tctattcttttttttctttt

SEQ ID NO: 109035 - DNA, 20 bp, Artificial
  CRISPR gRNA sequence
tattcttttttttcttttaa

SEQ ID NO: 109036 - DNA, 20 bp, Artificial
  CRISPR gRNA sequence
ttcttttttttcttttaaga

SEQ ID NO: 109037 - DNA, 20 bp, Artificial
  CRISPR gRNA sequence
tcttttttttcttttaagag

SEQ ID NO: 109038 - DNA, 20 bp, Artificial
  CRISPR gRNA sequence
cttttttttcttttaagaga

SEQ ID NO: 109039 - DNA, 20 bp, Artificial
  CRISPR gRNA sequence
ttttttttcttttaagagag

SEQ ID NO: 109040 - DNA, 20 bp, Artificial
  CRISPR gRNA sequence
tttttttcttttaagagagg

SEQ ID NO: 109041 - DNA, 20 bp, Artificial
  CRISPR gRNA sequence
gggggtctccctatgctacc

SEQ ID NO: 109042 - DNA, 20 bp, Artificial
  CRISPR gRNA sequence
ggggtctccctatgctaccc

SEQ ID NO: 109043 - DNA, 20 bp, Artificial
  CRISPR gRNA sequence
tctccctatgctacccaggc

SEQ ID NO: 109044 - DNA, 20 bp, Artificial
  CRISPR gRNA sequence
caggctggtctcaaactcct

SEQ ID NO: 109045 - DNA, 20 bp, Artificial
  CRISPR gRNA sequence
gtctcaaactcctgagctca

SEQ ID NO: 109046 - DNA, 20 bp, Artificial
  CRISPR gRNA sequence
tctcaaactcctgagctcaa

SEQ ID NO: 109047 - DNA, 20 bp, Artificial
  CRISPR gRNA sequence
ctcaaaggattctcccactt

SEQ ID NO: 109048 - DNA, 20 bp, Artificial
  CRISPR gRNA sequence
tctcccacttcggcttccca

SEQ ID NO: 109049 - DNA, 20 bp, Artificial
  CRISPR gRNA sequence
acttcggcttcccaaagtgc

SEQ ID NO: 109050 - DNA, 20 bp, Artificial
  CRISPR gRNA sequence
cttcggcttcccaaagtgct

SEQ ID NO: 109051 - DNA, 20 bp, Artificial
  CRISPR gRNA sequence
ttcccaaagtgctgggatta

SEQ ID NO: 109052 - DNA, 20 bp, Artificial
  CRISPR gRNA sequence
agtgctgggattacagtcgt

SEQ ID NO: 109053 - DNA, 20 bp, Artificial
  CRISPR gRNA sequence
tcgtgagccatcatcatgcc

SEQ ID NO: 109054 - DNA, 20 bp, Artificial
  CRISPR gRNA sequence
tgagccatcatcatgcctgg

SEQ ID NO: 109055 - DNA, 20 bp, Artificial
  CRISPR gRNA sequence
ttctattatttaaaaattcc

SEQ ID NO: 109056 - DNA, 20 bp, Artificial
  CRISPR gRNA sequence
tatttaaaaattcccagcat

SEQ ID NO: 109057 - DNA, 20 bp, Artificial
  CRISPR gRNA sequence
aatttctttcacaactcaac

SEQ ID NO: 109058 - DNA, 20 bp, Artificial
  CRISPR gRNA sequence
ttctttcacaactcaacaag

SEQ ID NO: 109059 - DNA, 20 bp, Artificial
  CRISPR gRNA sequence
tctttcacaactcaacaagt

SEQ ID NO: 109060 - DNA, 20 bp, Artificial
  CRISPR gRNA sequence
actcaacaagtgggtcctga

SEQ ID NO: 109061 - DNA, 20 bp, Artificial
  CRISPR gRNA sequence
tcctgatagacgcttgatga

SEQ ID NO: 109062 - DNA, 20 bp, Artificial
  CRISPR gRNA sequence
atagacgcttgatgaaagac

SEQ ID NO: 109063 - DNA, 20 bp, Artificial
  CRISPR gRNA sequence
tgaaagactagactacaaca

SEQ ID NO: 109064 - DNA, 20 bp, Artificial
  CRISPR gRNA sequence
gaaagactagactacaacaa

SEQ ID NO: 109065 - DNA, 20 bp, Artificial
  CRISPR gRNA sequence
aaagactagactacaacaaa

SEQ ID NO: 109066 - DNA, 20 bp, Artificial
  CRISPR gRNA sequence
gactacaacaaagggctgtc

SEQ ID NO: 109067 - DNA, 20 bp, Artificial
  CRISPR gRNA sequence
ccagcttccccatcatccta

SEQ ID NO: 109068 - DNA, 20 bp, Artificial
  CRISPR gRNA sequence
cccatcatcctacagatttc

SEQ ID NO: 109069 - DNA, 20 bp, Artificial
  CRISPR gRNA sequence
catcctacagatttctggat

SEQ ID NO: 109070 - DNA, 20 bp, Artificial
  CRISPR gRNA sequence
tcctacagatttctggattg

SEQ ID NO: 109071 - DNA, 20 bp, Artificial
  CRISPR gRNA sequence
actaattatgtaccatgtgc

SEQ ID NO: 109072 - DNA, 20 bp, Artificial
  CRISPR gRNA sequence
atgtgccagacactgttctg

SEQ ID NO: 109073 - DNA, 20 bp, Artificial
  CRISPR gRNA sequence
tgtgccagacactgttctga

SEQ ID NO: 109074 - DNA, 20 bp, Artificial
  CRISPR gRNA sequence
ctgaaggttttaaaaataaa

SEQ ID NO: 109075 - DNA, 20 bp, Artificial
  CRISPR gRNA sequence
ataaaaagaaatctctgacg

SEQ ID NO: 109076 - DNA, 20 bp, Artificial
  CRISPR gRNA sequence
tgacgaagattcaaacttca

SEQ ID NO: 109077 - DNA, 20 bp, Artificial
  CRISPR gRNA sequence
acgaagattcaaacttcaaa

SEQ ID NO: 109078 - DNA, 20 bp, Artificial
  CRISPR gRNA sequence
tcaaacttcaaagagtcttt

SEQ ID NO: 109079 - DNA, 20 bp, Artificial
  CRISPR gRNA sequence
cttcaaagagtctttaagtt

SEQ ID NO: 109080 - DNA, 20 bp, Artificial
  CRISPR gRNA sequence
agagtctttaagtttagtaa

SEQ ID NO: 109081 - DNA, 20 bp, Artificial
  CRISPR gRNA sequence
aatggactaaaaacctatac

SEQ ID NO: 109082 - DNA, 20 bp, Artificial
  CRISPR gRNA sequence
aaaacctatactggaatcct

SEQ ID NO: 109083 - DNA, 20 bp, Artificial
  CRISPR gRNA sequence
aacctatactggaatcctaa

SEQ ID NO: 109084 - DNA, 20 bp, Artificial
  CRISPR gRNA sequence
tactggaatcctaagagata

SEQ ID NO: 109085 - DNA, 20 bp, Artificial
  CRISPR gRNA sequence
tcctaagagataaagtgata

SEQ ID NO: 109086 - DNA, 20 bp, Artificial
  CRISPR gRNA sequence
cctaagagataaagtgatat

SEQ ID NO: 109087 - DNA, 20 bp, Artificial
  CRISPR gRNA sequence
gataaagtgatatgggaatt

SEQ ID NO: 109088 - DNA, 20 bp, Artificial
  CRISPR gRNA sequence
taaagtgatatgggaatttg

SEQ ID NO: 109089 - DNA, 20 bp, Artificial
  CRISPR gRNA sequence
aaagtgatatgggaatttgg

SEQ ID NO: 109090 - DNA, 20 bp, Artificial
  CRISPR gRNA sequence
tgatatgggaatttggagga

SEQ ID NO: 109091 - DNA, 20 bp, Artificial
  CRISPR gRNA sequence
atatgggaatttggaggaca

SEQ ID NO: 109092 - DNA, 20 bp, Artificial
  CRISPR gRNA sequence
tggaggacagagatttgttc

SEQ ID NO: 109093 - DNA, 20 bp, Artificial
  CRISPR gRNA sequence
ggacagagatttgttccagc

SEQ ID NO: 109094 - DNA, 20 bp, Artificial
  CRISPR gRNA sequence
gacagagatttgttccagct

SEQ ID NO: 109095 - DNA, 20 bp, Artificial
  CRISPR gRNA sequence
acagagatttgttccagctg

SEQ ID NO: 109096 - DNA, 20 bp, Artificial
  CRISPR gRNA sequence
ccagctggggataaatcaac

SEQ ID NO: 109097 - DNA, 20 bp, Artificial
  CRISPR gRNA sequence
cagctggggataaatcaaca

SEQ ID NO: 109098 - DNA, 20 bp, Artificial
  CRISPR gRNA sequence
caacaaggcttaaaaaaaaa

SEQ ID NO: 109099 - DNA, 20 bp, Artificial
  CRISPR gRNA sequence
aacaaggcttaaaaaaaaaa

SEQ ID NO: 109100 - DNA, 20 bp, Artificial
  CRISPR gRNA sequence
actttttttttctttgctat

SEQ ID NO: 109101 - DNA, 20 bp, Artificial
  CRISPR gRNA sequence
tttttttttctttgctatca

SEQ ID NO: 109102 - DNA, 20 bp, Artificial
  CRISPR gRNA sequence
ttttttttctttgctatcag

SEQ ID NO: 109103 - DNA, 20 bp, Artificial
  CRISPR gRNA sequence
tctttgctatcagaggcctg

SEQ ID NO: 109104 - DNA, 20 bp, Artificial
  CRISPR gRNA sequence
ctttgctatcagaggcctgc

SEQ ID NO: 109105 - DNA, 20 bp, Artificial
  CRISPR gRNA sequence
cagaggcctgcaggatgaac

SEQ ID NO: 109106 - DNA, 20 bp, Artificial
  CRISPR gRNA sequence
ctgcaggatgaactggtctt

SEQ ID NO: 109107 - DNA, 20 bp, Artificial
  CRISPR gRNA sequence
gatgaactggtcttaagtgt

SEQ ID NO: 109108 - DNA, 20 bp, Artificial
  CRISPR gRNA sequence
aactggtcttaagtgtgaga

SEQ ID NO: 109109 - DNA, 20 bp, Artificial
  CRISPR gRNA sequence
tcttaagtgtgagaaagatt

SEQ ID NO: 109110 - DNA, 20 bp, Artificial
  CRISPR gRNA sequence
gatttagctatgtgatgatg

SEQ ID NO: 109111 - DNA, 20 bp, Artificial
  CRISPR gRNA sequence
tttagctatgtgatgatgtg

SEQ ID NO: 109112 - DNA, 20 bp, Artificial
  CRISPR gRNA sequence
ttagctatgtgatgatgtgg

SEQ ID NO: 109113 - DNA, 20 bp, Artificial
  CRISPR gRNA sequence
gctatgtgatgatgtggagg

SEQ ID NO: 109114 - DNA, 20 bp, Artificial
  CRISPR gRNA sequence
ctatgtgatgatgtggagga

SEQ ID NO: 109115 - DNA, 20 bp, Artificial
  CRISPR gRNA sequence
tgatgatgtggaggaaggtg

SEQ ID NO: 109116 - DNA, 20 bp, Artificial
  CRISPR gRNA sequence
aaggtgaagtactacaaatc

SEQ ID NO: 109117 - DNA, 20 bp, Artificial
  CRISPR gRNA sequence
ggtgaagtactacaaatcaa

SEQ ID NO: 109118 - DNA, 20 bp, Artificial
  CRISPR gRNA sequence
tgaagtactacaaatcaaga

SEQ ID NO: 109119 - DNA, 20 bp, Artificial
  CRISPR gRNA sequence
aatcaagagagcataaaaac

SEQ ID NO: 109120 - DNA, 20 bp, Artificial
  CRISPR gRNA sequence
agagagcataaaaacaagaa

SEQ ID NO: 109121 - DNA, 20 bp, Artificial
  CRISPR gRNA sequence
aaacaagaacagaaatattt

SEQ ID NO: 109122 - DNA, 20 bp, Artificial
  CRISPR gRNA sequence
gaaatatttcagcatgtgaa

SEQ ID NO: 109123 - DNA, 20 bp, Artificial
  CRISPR gRNA sequence
atatttcagcatgtgaacag

SEQ ID NO: 109124 - DNA, 20 bp, Artificial
  CRISPR gRNA sequence
catgtgaacagtggactaaa

SEQ ID NO: 109125 - DNA, 20 bp, Artificial
  CRISPR gRNA sequence
atgtgaacagtggactaaac

SEQ ID NO: 109126 - DNA, 20 bp, Artificial
  CRISPR gRNA sequence
agtggactaaacaggaaaaa

SEQ ID NO: 109127 - DNA, 20 bp, Artificial
  CRISPR gRNA sequence
actaaacaggaaaaaaagct

SEQ ID NO: 109128 - DNA, 20 bp, Artificial
  CRISPR gRNA sequence
ctaaacaggaaaaaaagctt

SEQ ID NO: 109129 - DNA, 20 bp, Artificial
  CRISPR gRNA sequence
taaacaggaaaaaaagcttg

SEQ ID NO: 109130 - DNA, 20 bp, Artificial
  CRISPR gRNA sequence
actactttctctcaaaatgt

SEQ ID NO: 109131 - DNA, 20 bp, Artificial
  CRISPR gRNA sequence
ttctctcaaaatgtcagaca

SEQ ID NO: 109132 - DNA, 20 bp, Artificial
  CRISPR gRNA sequence
cagacaaagaaattcttctg

SEQ ID NO: 109133 - DNA, 20 bp, Artificial
  CRISPR gRNA sequence
aaagaaattcttctgcagac

SEQ ID NO: 109134 - DNA, 20 bp, Artificial
  CRISPR gRNA sequence
gaaattcttctgcagactgg

SEQ ID NO: 109135 - DNA, 20 bp, Artificial
  CRISPR gRNA sequence
attcttctgcagactggtgg

SEQ ID NO: 109136 - DNA, 20 bp, Artificial
  CRISPR gRNA sequence
gcagactggtggaagcttgt

SEQ ID NO: 109137 - DNA, 20 bp, Artificial
  CRISPR gRNA sequence
cagactggtggaagcttgta

SEQ ID NO: 109138 - DNA, 20 bp, Artificial
  CRISPR gRNA sequence
gtggaagcttgtaaggtatt

SEQ ID NO: 109139 - DNA, 20 bp, Artificial
  CRISPR gRNA sequence
ttgtaaggtatttagcaaaa

SEQ ID NO: 109140 - DNA, 20 bp, Artificial
  CRISPR gRNA sequence
gtatttagcaaaaaagttac

SEQ ID NO: 109141 - DNA, 20 bp, Artificial
  CRISPR gRNA sequence
taccagattataatgccttt

SEQ ID NO: 109142 - DNA, 20 bp, Artificial
  CRISPR gRNA sequence
agattataatgccttttaga

SEQ ID NO: 109143 - DNA, 20 bp, Artificial
  CRISPR gRNA sequence
atgccttttagaaagatgcc

SEQ ID NO: 109144 - DNA, 20 bp, Artificial
  CRISPR gRNA sequence
tttagaaagatgccaagcaa

SEQ ID NO: 109145 - DNA, 20 bp, Artificial
  CRISPR gRNA sequence
agatgccaagcaaaagtatt

SEQ ID NO: 109146 - DNA, 20 bp, Artificial
  CRISPR gRNA sequence
aaaagtatttagtgattttg

SEQ ID NO: 109147 - DNA, 20 bp, Artificial
  CRISPR gRNA sequence
tttagtgattttgaagtgac

SEQ ID NO: 109148 - DNA, 20 bp, Artificial
  CRISPR gRNA sequence
catacctatttttaaatact

SEQ ID NO: 109149 - DNA, 20 bp, Artificial
  CRISPR gRNA sequence
atacctatttttaaatacta

SEQ ID NO: 109150 - DNA, 20 bp, Artificial
  CRISPR gRNA sequence
taaggttaaaacatctattt

SEQ ID NO: 109151 - DNA, 20 bp, Artificial
  CRISPR gRNA sequence
aaggttaaaacatctatttc

SEQ ID NO: 109152 - DNA, 20 bp, Artificial
  CRISPR gRNA sequence
ttaaaacatctatttcaggt

SEQ ID NO: 109153 - DNA, 20 bp, Artificial
  CRISPR gRNA sequence
taaaacatctatttcaggtc

SEQ ID NO: 109154 - DNA, 20 bp, Artificial
  CRISPR gRNA sequence
atctatttcaggtcaggacg

SEQ ID NO: 109155 - DNA, 20 bp, Artificial
  CRISPR gRNA sequence
tatttcaggtcaggacgcag

SEQ ID NO: 109156 - DNA, 20 bp, Artificial
  CRISPR gRNA sequence
tgcctgtaatcccaacgttt

SEQ ID NO: 109157 - DNA, 20 bp, Artificial
  CRISPR gRNA sequence
gcctgtaatcccaacgtttt

SEQ ID NO: 109158 - DNA, 20 bp, Artificial
  CRISPR gRNA sequence
ctgtaatcccaacgttttgg

SEQ ID NO: 109159 - DNA, 20 bp, Artificial
  CRISPR gRNA sequence
tcccaacgttttgggagaac

SEQ ID NO: 109160 - DNA, 20 bp, Artificial
  CRISPR gRNA sequence
caacgttttgggagaacaag

SEQ ID NO: 109161 - DNA, 20 bp, Artificial
  CRISPR gRNA sequence
aacgttttgggagaacaaga

SEQ ID NO: 109162 - DNA, 20 bp, Artificial
  CRISPR gRNA sequence
acgttttgggagaacaagaa

SEQ ID NO: 109163 - DNA, 20 bp, Artificial
  CRISPR gRNA sequence
gttttgggagaacaagaagg

SEQ ID NO: 109164 - DNA, 20 bp, Artificial
  CRISPR gRNA sequence
ttttgggagaacaagaaggg

SEQ ID NO: 109165 - DNA, 20 bp, Artificial
  CRISPR gRNA sequence
gggagaacaagaagggagga

SEQ ID NO: 109166 - DNA, 20 bp, Artificial
  CRISPR gRNA sequence
acaagaagggaggatggctt

SEQ ID NO: 109167 - DNA, 20 bp, Artificial
  CRISPR gRNA sequence
aagggaggatggcttgagcc

SEQ ID NO: 109168 - DNA, 20 bp, Artificial
  CRISPR gRNA sequence
agggaggatggcttgagccc

SEQ ID NO: 109169 - DNA, 20 bp, Artificial
  CRISPR gRNA sequence
ggaggatggcttgagcccag

SEQ ID NO: 109170 - DNA, 20 bp, Artificial
  CRISPR gRNA sequence
tggcttgagcccaggagttc

SEQ ID NO: 109171 - DNA, 20 bp, Artificial
  CRISPR gRNA sequence
ggcttgagcccaggagttcc

SEQ ID NO: 109172 - DNA, 20 bp, Artificial
  CRISPR gRNA sequence
tgagcccaggagttccaggt

SEQ ID NO: 109173 - DNA, 20 bp, Artificial
  CRISPR gRNA sequence
cccaggagttccaggttagt

SEQ ID NO: 109174 - DNA, 20 bp, Artificial
  CRISPR gRNA sequence
acgattgcgccactgtactc

SEQ ID NO: 109175 - DNA, 20 bp, Artificial
  CRISPR gRNA sequence
tgcgccactgtactccagcc

SEQ ID NO: 109176 - DNA, 20 bp, Artificial
  CRISPR gRNA sequence
ctgtactccagcctggatga

SEQ ID NO: 109177 - DNA, 20 bp, Artificial
  CRISPR gRNA sequence
gtactccagcctggatgaca

SEQ ID NO: 109178 - DNA, 20 bp, Artificial
  CRISPR gRNA sequence
tactccagcctggatgacag

SEQ ID NO: 109179 - DNA, 20 bp, Artificial
  CRISPR gRNA sequence
ccagcctggatgacagagga

SEQ ID NO: 109180 - DNA, 20 bp, Artificial
  CRISPR gRNA sequence
acaaacaaaaaaacgttcca

SEQ ID NO: 109181 - DNA, 20 bp, Artificial
  CRISPR gRNA sequence
caaacaaaaaaacgttccaa

SEQ ID NO: 109182 - DNA, 20 bp, Artificial
  CRISPR gRNA sequence
aggcaaatatacatgttttt

SEQ ID NO: 109183 - DNA, 20 bp, Artificial
  CRISPR gRNA sequence
acatgttttttagactactt

SEQ ID NO: 109184 - DNA, 20 bp, Artificial
  CRISPR gRNA sequence
tatcatctcatctgctaatg

SEQ ID NO: 109185 - DNA, 20 bp, Artificial
  CRISPR gRNA sequence
acgtgacaatcaaatgaatt

SEQ ID NO: 109186 - DNA, 20 bp, Artificial
  CRISPR gRNA sequence
atgaattaagaaaatcactt

SEQ ID NO: 109187 - DNA, 20 bp, Artificial
  CRISPR gRNA sequence
aatgaaaaactcaccctaaa

SEQ ID NO: 109188 - DNA, 20 bp, Artificial
  CRISPR gRNA sequence
gaaaataaaacctgtccccg

SEQ ID NO: 109189 - DNA, 20 bp, Artificial
  CRISPR gRNA sequence
aaaacctgtccccgaagttt

SEQ ID NO: 109190 - DNA, 20 bp, Artificial
  CRISPR gRNA sequence
ccccgaagttttagtaatga

SEQ ID NO: 109191 - DNA, 20 bp, Artificial
  CRISPR gRNA sequence
ccgaagttttagtaatgaaa

SEQ ID NO: 109192 - DNA, 20 bp, Artificial
  CRISPR gRNA sequence
ttttagtaatgaaagagcac

SEQ ID NO: 109193 - DNA, 20 bp, Artificial
  CRISPR gRNA sequence
atgaaagagcactggaatac

SEQ ID NO: 109194 - DNA, 20 bp, Artificial
  CRISPR gRNA sequence
acgagttttctgaaacctat

SEQ ID NO: 109195 - DNA, 20 bp, Artificial
  CRISPR gRNA sequence
tataacattaaatgtgaatt

SEQ ID NO: 109196 - DNA, 20 bp, Artificial
  CRISPR gRNA sequence
attaaatgtgaatttagaaa

SEQ ID NO: 109197 - DNA, 20 bp, Artificial
  CRISPR gRNA sequence
ttaaatgtgaatttagaaat

SEQ ID NO: 109198 - DNA, 20 bp, Artificial
  CRISPR gRNA sequence
gtgaatttagaaatgggcac

SEQ ID NO: 109199 - DNA, 20 bp, Artificial
  CRISPR gRNA sequence
gaaatgggcaccagatactt

SEQ ID NO: 109200 - DNA, 20 bp, Artificial
  CRISPR gRNA sequence
tacttaagacctttatgtgc

SEQ ID NO: 109201 - DNA, 20 bp, Artificial
  CRISPR gRNA sequence
acttaagacctttatgtgcc

SEQ ID NO: 109202 - DNA, 20 bp, Artificial
  CRISPR gRNA sequence
cttaagacctttatgtgcca

SEQ ID NO: 109203 - DNA, 20 bp, Artificial
  CRISPR gRNA sequence
ttatgtgccagggaatgcac

SEQ ID NO: 109204 - DNA, 20 bp, Artificial
  CRISPR gRNA sequence
atgcactagatgattcacat

SEQ ID NO: 109205 - DNA, 20 bp, Artificial
  CRISPR gRNA sequence
acatgagtaaaaataatttt

SEQ ID NO: 109206 - DNA, 20 bp, Artificial
  CRISPR gRNA sequence
atgagtaaaaataattttca

SEQ ID NO: 109207 - DNA, 20 bp, Artificial
  CRISPR gRNA sequence
aaaaataattttcagagtcc

SEQ ID NO: 109208 - DNA, 20 bp, Artificial
  CRISPR gRNA sequence
aaaataattttcagagtcct

SEQ ID NO: 109209 - DNA, 20 bp, Artificial
  CRISPR gRNA sequence
aattttcagagtcctaggac

SEQ ID NO: 109210 - DNA, 20 bp, Artificial
  CRISPR gRNA sequence
aagtctcctcttcatcccca

SEQ ID NO: 109211 - DNA, 20 bp, Artificial
  CRISPR gRNA sequence
ctcttcatccccaaagaact

SEQ ID NO: 109212 - DNA, 20 bp, Artificial
  CRISPR gRNA sequence
aaagaactcagccactatca

SEQ ID NO: 109213 - DNA, 20 bp, Artificial
  CRISPR gRNA sequence
aagaactcagccactatcac

SEQ ID NO: 109214 - DNA, 20 bp, Artificial
  CRISPR gRNA sequence
agaactcagccactatcacg

SEQ ID NO: 109215 - DNA, 20 bp, Artificial
  CRISPR gRNA sequence
actcagccactatcacgggg

SEQ ID NO: 109216 - DNA, 20 bp, Artificial
  CRISPR gRNA sequence
acggggcagaacccataaac

SEQ ID NO: 109217 - DNA, 20 bp, Artificial
  CRISPR gRNA sequence
ggcagaacccataaacaagt

SEQ ID NO: 109218 - DNA, 20 bp, Artificial
  CRISPR gRNA sequence
gaaactcgttttttcaatct

SEQ ID NO: 109219 - DNA, 20 bp, Artificial
  CRISPR gRNA sequence
aaactcgttttttcaatctt

SEQ ID NO: 109220 - DNA, 20 bp, Artificial
  CRISPR gRNA sequence
ttcaatcttaggaaaaaata

SEQ ID NO: 109221 - DNA, 20 bp, Artificial
  CRISPR gRNA sequence
cttaggaaaaaatatagctc

SEQ ID NO: 109222 - DNA, 20 bp, Artificial
  CRISPR gRNA sequence
actgtttccaaaatattcct

SEQ ID NO: 109223 - DNA, 20 bp, Artificial
  CRISPR gRNA sequence
tttccaaaatattccttagc

SEQ ID NO: 109224 - DNA, 20 bp, Artificial
  CRISPR gRNA sequence
tattccttagcaagatatac

SEQ ID NO: 109225 - DNA, 20 bp, Artificial
  CRISPR gRNA sequence
tatacaagtattttaccaac

SEQ ID NO: 109226 - DNA, 20 bp, Artificial
  CRISPR gRNA sequence
atacaagtattttaccaact

SEQ ID NO: 109227 - DNA, 20 bp, Artificial
  CRISPR gRNA sequence
tcccatcttcctgcctccaa

SEQ ID NO: 109228 - DNA, 20 bp, Artificial
  CRISPR gRNA sequence
cacatgcttttcttctcttc

SEQ ID NO: 109229 - DNA, 20 bp, Artificial
  CRISPR gRNA sequence
tgcttttcttctcttcgagc

SEQ ID NO: 109230 - DNA, 20 bp, Artificial
  CRISPR gRNA sequence
aagctcttccatctttcctg

SEQ ID NO: 109231 - DNA, 20 bp, Artificial
  CRISPR gRNA sequence
ctcttccatctttcctgtgg

SEQ ID NO: 109232 - DNA, 20 bp, Artificial
  CRISPR gRNA sequence
aagaattaccatcattcttc

SEQ ID NO: 109233 - DNA, 20 bp, Artificial
  CRISPR gRNA sequence
agaattaccatcattcttca

SEQ ID NO: 109234 - DNA, 20 bp, Artificial
  CRISPR gRNA sequence
ttaccatcattcttcaaggc

SEQ ID NO: 109235 - DNA, 20 bp, Artificial
  CRISPR gRNA sequence
cattcttcaaggccagtcaa

SEQ ID NO: 109236 - DNA, 20 bp, Artificial
  CRISPR gRNA sequence
ttcaaggccagtcaaaagtg

SEQ ID NO: 109237 - DNA, 20 bp, Artificial
  CRISPR gRNA sequence
aaggccagtcaaaagtgcgg

SEQ ID NO: 109238 - DNA, 20 bp, Artificial
  CRISPR gRNA sequence
gtcaaaagtgcggtggtgat

SEQ ID NO: 109239 - DNA, 20 bp, Artificial
  CRISPR gRNA sequence
cggtggtgataagcctttca

SEQ ID NO: 109240 - DNA, 20 bp, Artificial
  CRISPR gRNA sequence
gtggtgataagcctttcacg

SEQ ID NO: 109241 - DNA, 20 bp, Artificial
  CRISPR gRNA sequence
tggtgataagcctttcacgg

SEQ ID NO: 109242 - DNA, 20 bp, Artificial
  CRISPR gRNA sequence
gataagcctttcacggaggc

SEQ ID NO: 109243 - DNA, 20 bp, Artificial
  CRISPR gRNA sequence
cacggaggctagctcacgca

SEQ ID NO: 109244 - DNA, 20 bp, Artificial
  CRISPR gRNA sequence
gctcacgcatggatacttca

SEQ ID NO: 109245 - DNA, 20 bp, Artificial
  CRISPR gRNA sequence
tacttcacagcaactgaact

SEQ ID NO: 109246 - DNA, 20 bp, Artificial
  CRISPR gRNA sequence
aactgaacttggccccttta

SEQ ID NO: 109247 - DNA, 20 bp, Artificial
  CRISPR gRNA sequence
ccctttatagcactaaccgt

SEQ ID NO: 109248 - DNA, 20 bp, Artificial
  CRISPR gRNA sequence
cctttatagcactaaccgtt

SEQ ID NO: 109249 - DNA, 20 bp, Artificial
  CRISPR gRNA sequence
gttcacctgtcaatttccat

SEQ ID NO: 109250 - DNA, 20 bp, Artificial
  CRISPR gRNA sequence
ttcacctgtcaatttccatc

SEQ ID NO: 109251 - DNA, 20 bp, Artificial
  CRISPR gRNA sequence
acctgtcaatttccatcagg

SEQ ID NO: 109252 - DNA, 20 bp, Artificial
  CRISPR gRNA sequence
cctgtcaatttccatcaggt

SEQ ID NO: 109253 - DNA, 20 bp, Artificial
  CRISPR gRNA sequence
caatttccatcaggtaggca

SEQ ID NO: 109254 - DNA, 20 bp, Artificial
  CRISPR gRNA sequence
cgtactccctccctaacaca

SEQ ID NO: 109255 - DNA, 20 bp, Artificial
  CRISPR gRNA sequence
cctaacacacggattatacc

SEQ ID NO: 109256 - DNA, 20 bp, Artificial
  CRISPR gRNA sequence
acctggcatatactaactgc

SEQ ID NO: 109257 - DNA, 20 bp, Artificial
  CRISPR gRNA sequence
tatactaactgctggataat

SEQ ID NO: 109258 - DNA, 20 bp, Artificial
  CRISPR gRNA sequence
gctggataattggttgccaa

SEQ ID NO: 109259 - DNA, 20 bp, Artificial
  CRISPR gRNA sequence
caacagcaacctctcaccct

SEQ ID NO: 109260 - DNA, 20 bp, Artificial
  CRISPR gRNA sequence
aacagcaacctctcacccta

SEQ ID NO: 109261 - DNA, 20 bp, Artificial
  CRISPR gRNA sequence
ggaaaaccccacaacactgt

SEQ ID NO: 109262 - DNA, 20 bp, Artificial
  CRISPR gRNA sequence
ttagtttctaaacatctgct

SEQ ID NO: 109263 - DNA, 20 bp, Artificial
  CRISPR gRNA sequence
ctgctgagaaaacgttaaca

SEQ ID NO: 109264 - DNA, 20 bp, Artificial
  CRISPR gRNA sequence
tgctgagaaaacgttaacac

SEQ ID NO: 109265 - DNA, 20 bp, Artificial
  CRISPR gRNA sequence
aacgttaacacaggacttga

SEQ ID NO: 109266 - DNA, 20 bp, Artificial
  CRISPR gRNA sequence
cacaggacttgaaagtgtat

SEQ ID NO: 109267 - DNA, 20 bp, Artificial
  CRISPR gRNA sequence
gtatcagaaaaacataaacc

SEQ ID NO: 109268 - DNA, 20 bp, Artificial
  CRISPR gRNA sequence
atcagaaaaacataaaccaa

SEQ ID NO: 109269 - DNA, 20 bp, Artificial
  CRISPR gRNA sequence
aaaaacataaaccaagagat

SEQ ID NO: 109270 - DNA, 20 bp, Artificial
  CRISPR gRNA sequence
aacataaaccaagagatgag

SEQ ID NO: 109271 - DNA, 20 bp, Artificial
  CRISPR gRNA sequence
aaaccaagagatgagtggac

SEQ ID NO: 109272 - DNA, 20 bp, Artificial
  CRISPR gRNA sequence
aaccaagagatgagtggact

SEQ ID NO: 109273 - DNA, 20 bp, Artificial
  CRISPR gRNA sequence
agagatgagtggactgggtc

SEQ ID NO: 109274 - DNA, 20 bp, Artificial
  CRISPR gRNA sequence
actgggtcaagcctgacaca

SEQ ID NO: 109275 - DNA, 20 bp, Artificial
  CRISPR gRNA sequence
aagcctgacacaaagtaaca

SEQ ID NO: 109276 - DNA, 20 bp, Artificial
  CRISPR gRNA sequence
ctgacacaaagtaacataga

SEQ ID NO: 109277 - DNA, 20 bp, Artificial
  CRISPR gRNA sequence
tgacacaaagtaacatagaa

SEQ ID NO: 109278 - DNA, 20 bp, Artificial
  CRISPR gRNA sequence
caaagtaacatagaaaggcg

SEQ ID NO: 109279 - DNA, 20 bp, Artificial
  CRISPR gRNA sequence
aaagtaacatagaaaggcga

SEQ ID NO: 109280 - DNA, 20 bp, Artificial
  CRISPR gRNA sequence
gaaaggcgaaggcaaaaaca

SEQ ID NO: 109281 - DNA, 20 bp, Artificial
  CRISPR gRNA sequence
aaaggcgaaggcaaaaacaa

SEQ ID NO: 109282 - DNA, 20 bp, Artificial
  CRISPR gRNA sequence
aaggcgaaggcaaaaacaaa

SEQ ID NO: 109283 - DNA, 20 bp, Artificial
  CRISPR gRNA sequence
caaaactgtactatattccc

SEQ ID NO: 109284 - DNA, 20 bp, Artificial
  CRISPR gRNA sequence
aaaactgtactatattccca

SEQ ID NO: 109285 - DNA, 20 bp, Artificial
  CRISPR gRNA sequence
aaactgtactatattcccaa

SEQ ID NO: 109286 - DNA, 20 bp, Artificial
  CRISPR gRNA sequence
actgtactatattcccaagg

SEQ ID NO: 109287 - DNA, 20 bp, Artificial
  CRISPR gRNA sequence
ctgtactatattcccaaggg

SEQ ID NO: 109288 - DNA, 20 bp, Artificial
  CRISPR gRNA sequence
tgtactatattcccaaggga

SEQ ID NO: 109289 - DNA, 20 bp, Artificial
  CRISPR gRNA sequence
tactatattcccaagggagg

SEQ ID NO: 109290 - DNA, 20 bp, Artificial
  CRISPR gRNA sequence
ggagggagatttcacaaaat

SEQ ID NO: 109291 - DNA, 20 bp, Artificial
  CRISPR gRNA sequence
gggagatttcacaaaatgag

SEQ ID NO: 109292 - DNA, 20 bp, Artificial
  CRISPR gRNA sequence
agatttcacaaaatgagcag

SEQ ID NO: 109293 - DNA, 20 bp, Artificial
  CRISPR gRNA sequence
tcacaaaatgagcagtggat

SEQ ID NO: 109294 - DNA, 20 bp, Artificial
  CRISPR gRNA sequence
aaatgagcagtggataagat

SEQ ID NO: 109295 - DNA, 20 bp, Artificial
  CRISPR gRNA sequence
gataagattagtaatatgaa

SEQ ID NO: 109296 - DNA, 20 bp, Artificial
  CRISPR gRNA sequence
agattagtaatatgaacagc

SEQ ID NO: 109297 - DNA, 20 bp, Artificial
  CRISPR gRNA sequence
aatatgaacagcaagttgtg

SEQ ID NO: 109298 - DNA, 20 bp, Artificial
  CRISPR gRNA sequence
acagcaagttgtgcagcctc

SEQ ID NO: 109299 - DNA, 20 bp, Artificial
  CRISPR gRNA sequence
caagttgtgcagcctccgga

SEQ ID NO: 109300 - DNA, 20 bp, Artificial
  CRISPR gRNA sequence
agcctccggaaagaatgcgc

SEQ ID NO: 109301 - DNA, 20 bp, Artificial
  CRISPR gRNA sequence
gcctccggaaagaatgcgca

SEQ ID NO: 109302 - DNA, 20 bp, Artificial
  CRISPR gRNA sequence
cctccggaaagaatgcgcaa

SEQ ID NO: 109303 - DNA, 20 bp, Artificial
  CRISPR gRNA sequence
cgcaagggtatcaatcttct

SEQ ID NO: 109304 - DNA, 20 bp, Artificial
  CRISPR gRNA sequence
caagggtatcaatcttctaa

SEQ ID NO: 109305 - DNA, 20 bp, Artificial
  CRISPR gRNA sequence
ggtatcaatcttctaagagt

SEQ ID NO: 109306 - DNA, 20 bp, Artificial
  CRISPR gRNA sequence
gtatcaatcttctaagagtg

SEQ ID NO: 109307 - DNA, 20 bp, Artificial
  CRISPR gRNA sequence
atcttctaagagtgaggttc

SEQ ID NO: 109308 - DNA, 20 bp, Artificial
  CRISPR gRNA sequence
tcttctaagagtgaggttcc

SEQ ID NO: 109309 - DNA, 20 bp, Artificial
  CRISPR gRNA sequence
gtgaggttccaggcaccgaa

SEQ ID NO: 109310 - DNA, 20 bp, Artificial
  CRISPR gRNA sequence
gttccaggcaccgaatggac

SEQ ID NO: 109311 - DNA, 20 bp, Artificial
  CRISPR gRNA sequence
caccgaatggactggtctta

SEQ ID NO: 109312 - DNA, 20 bp, Artificial
  CRISPR gRNA sequence
aatggactggtcttacagcc

SEQ ID NO: 109313 - DNA, 20 bp, Artificial
  CRISPR gRNA sequence
actggtcttacagcccggac

SEQ ID NO: 109314 - DNA, 20 bp, Artificial
  CRISPR gRNA sequence
cttacagcccggacaagaaa

SEQ ID NO: 109315 - DNA, 20 bp, Artificial
  CRISPR gRNA sequence
tacagcccggacaagaaacg

SEQ ID NO: 109316 - DNA, 20 bp, Artificial
  CRISPR gRNA sequence
gacaagaaacggagaccgct

SEQ ID NO: 109317 - DNA, 20 bp, Artificial
  CRISPR gRNA sequence
agaaacggagaccgcttggt

SEQ ID NO: 109318 - DNA, 20 bp, Artificial
  CRISPR gRNA sequence
gaaacggagaccgcttggtt

SEQ ID NO: 109319 - DNA, 20 bp, Artificial
  CRISPR gRNA sequence
agaccgcttggttgggctcc

SEQ ID NO: 109320 - DNA, 20 bp, Artificial
  CRISPR gRNA sequence
cgcttggttgggctccaaga

SEQ ID NO: 109321 - DNA, 20 bp, Artificial
  CRISPR gRNA sequence
cttggttgggctccaagacg

SEQ ID NO: 109322 - DNA, 20 bp, Artificial
  CRISPR gRNA sequence
ttggttgggctccaagacgg

SEQ ID NO: 109323 - DNA, 20 bp, Artificial
  CRISPR gRNA sequence
ggctccaagacggaggtgtg

SEQ ID NO: 109324 - DNA, 20 bp, Artificial
  CRISPR gRNA sequence
tgcggtcctgccactgcgaa

SEQ ID NO: 109325 - DNA, 20 bp, Artificial
  CRISPR gRNA sequence
gcggtcctgccactgcgaac

SEQ ID NO: 109326 - DNA, 20 bp, Artificial
  CRISPR gRNA sequence
cggtcctgccactgcgaacg

SEQ ID NO: 109327 - DNA, 20 bp, Artificial
  CRISPR gRNA sequence
tcctgccactgcgaacgggg

SEQ ID NO: 109328 - DNA, 20 bp, Artificial
  CRISPR gRNA sequence
cctgccactgcgaacggggc

SEQ ID NO: 109329 - DNA, 20 bp, Artificial
  CRISPR gRNA sequence
ctgccactgcgaacggggcg

SEQ ID NO: 109330 - DNA, 20 bp, Artificial
  CRISPR gRNA sequence
ccactgcgaacggggcgggg

SEQ ID NO: 109331 - DNA, 20 bp, Artificial
  CRISPR gRNA sequence
actgcgaacggggcggggaa

SEQ ID NO: 109332 - DNA, 20 bp, Artificial
  CRISPR gRNA sequence
tgcgaacggggcggggaaga

SEQ ID NO: 109333 - DNA, 20 bp, Artificial
  CRISPR gRNA sequence
gcgaacggggcggggaagag

SEQ ID NO: 109334 - DNA, 20 bp, Artificial
  CRISPR gRNA sequence
cggggaagagaggaaatgac

SEQ ID NO: 109335 - DNA, 20 bp, Artificial
  CRISPR gRNA sequence
gagaggaaatgacgagccaa

SEQ ID NO: 109336 - DNA, 20 bp, Artificial
  CRISPR gRNA sequence
agaggaaatgacgagccaaa

SEQ ID NO: 109337 - DNA, 20 bp, Artificial
  CRISPR gRNA sequence
gaggaaatgacgagccaaaa

SEQ ID NO: 109338 - DNA, 20 bp, Artificial
  CRISPR gRNA sequence
aggaaatgacgagccaaaag

SEQ ID NO: 109339 - DNA, 20 bp, Artificial
  CRISPR gRNA sequence
aaatgacgagccaaaagggg

SEQ ID NO: 109340 - DNA, 20 bp, Artificial
  CRISPR gRNA sequence
cgagccaaaaggggtggtaa

SEQ ID NO: 109341 - DNA, 20 bp, Artificial
  CRISPR gRNA sequence
aaaaggggtggtaacggcgc

SEQ ID NO: 109342 - DNA, 20 bp, Artificial
  CRISPR gRNA sequence
aaaggggtggtaacggcgcc

SEQ ID NO: 109343 - DNA, 20 bp, Artificial
  CRISPR gRNA sequence
gggtggtaacggcgccgggc

SEQ ID NO: 109344 - DNA, 20 bp, Artificial
  CRISPR gRNA sequence
gtggtaacggcgccgggccg

SEQ ID NO: 109345 - DNA, 20 bp, Artificial
  CRISPR gRNA sequence
acggcgccgggccggagacc

SEQ ID NO: 109346 - DNA, 20 bp, Artificial
  CRISPR gRNA sequence
cggcgccgggccggagaccc

SEQ ID NO: 109347 - DNA, 20 bp, Artificial
  CRISPR gRNA sequence
cgccgggccggagacccggg

SEQ ID NO: 109348 - DNA, 20 bp, Artificial
  CRISPR gRNA sequence
ccgggccggagacccgggcg

SEQ ID NO: 109349 - DNA, 20 bp, Artificial
  CRISPR gRNA sequence
ggccggagacccgggcggag

SEQ ID NO: 109350 - DNA, 20 bp, Artificial
  CRISPR gRNA sequence
gccggagacccgggcggagc

SEQ ID NO: 109351 - DNA, 20 bp, Artificial
  CRISPR gRNA sequence
gagacccgggcggagcgggc

SEQ ID NO: 109352 - DNA, 20 bp, Artificial
  CRISPR gRNA sequence
agacccgggcggagcgggct

SEQ ID NO: 109353 - DNA, 20 bp, Artificial
  CRISPR gRNA sequence
acccgggcggagcgggctgg

SEQ ID NO: 109354 - DNA, 20 bp, Artificial
  CRISPR gRNA sequence
cccgggcggagcgggctggg

SEQ ID NO: 109355 - DNA, 20 bp, Artificial
  CRISPR gRNA sequence
cgggcggagcgggctgggag

SEQ ID NO: 109356 - DNA, 20 bp, Artificial
  CRISPR gRNA sequence
gggcggagcgggctgggagg

SEQ ID NO: 109357 - DNA, 20 bp, Artificial
  CRISPR gRNA sequence
ggcggagcgggctgggagga

SEQ ID NO: 109358 - DNA, 20 bp, Artificial
  CRISPR gRNA sequence
gcggagcgggctgggaggag

SEQ ID NO: 109359 - DNA, 20 bp, Artificial
  CRISPR gRNA sequence
gcgggctgggaggaggggcg

SEQ ID NO: 109360 - DNA, 20 bp, Artificial
  CRISPR gRNA sequence
ggctgggaggaggggcgcgg

SEQ ID NO: 109361 - DNA, 20 bp, Artificial
  CRISPR gRNA sequence
ctgggaggaggggcgcggcg

SEQ ID NO: 109362 - DNA, 20 bp, Artificial
  CRISPR gRNA sequence
ggaggaggggcgcggcggag

SEQ ID NO: 109363 - DNA, 20 bp, Artificial
  CRISPR gRNA sequence
gaggaggggcgcggcggagc

SEQ ID NO: 109364 - DNA, 20 bp, Artificial
  CRISPR gRNA sequence
aggaggggcgcggcggagca

SEQ ID NO: 109365 - DNA, 20 bp, Artificial
  CRISPR gRNA sequence
ggaggggcgcggcggagcag

SEQ ID NO: 109366 - DNA, 20 bp, Artificial
  CRISPR gRNA sequence
gaggggcgcggcggagcagg

SEQ ID NO: 109367 - DNA, 20 bp, Artificial
  CRISPR gRNA sequence
ggggcgcggcggagcagggg

SEQ ID NO: 109368 - DNA, 20 bp, Artificial
  CRISPR gRNA sequence
gcgcggcggagcagggggag

SEQ ID NO: 109369 - DNA, 20 bp, Artificial
  CRISPR gRNA sequence
cgcggcggagcagggggagt

SEQ ID NO: 109370 - DNA, 20 bp, Artificial
  CRISPR gRNA sequence
agggggagtgggcgaactaa

SEQ ID NO: 109371 - DNA, 20 bp, Artificial
  CRISPR gRNA sequence
taacggccccctctccccac

SEQ ID NO: 109372 - DNA, 20 bp, Artificial
  CRISPR gRNA sequence
aacggccccctctccccacc

SEQ ID NO: 109373 - DNA, 20 bp, Artificial
  CRISPR gRNA sequence
acggccccctctccccacca

SEQ ID NO: 109374 - DNA, 20 bp, Artificial
  CRISPR gRNA sequence
ggccccctctccccaccagg

SEQ ID NO: 109375 - DNA, 20 bp, Artificial
  CRISPR gRNA sequence
ccctctccccaccagggaga

SEQ ID NO: 109376 - DNA, 20 bp, Artificial
  CRISPR gRNA sequence
tctccccaccagggagacag

SEQ ID NO: 109377 - DNA, 20 bp, Artificial
  CRISPR gRNA sequence
ctccccaccagggagacagc

SEQ ID NO: 109378 - DNA, 20 bp, Artificial
  CRISPR gRNA sequence
tccccaccagggagacagcg

SEQ ID NO: 109379 - DNA, 20 bp, Artificial
  CRISPR gRNA sequence
ccccaccagggagacagcgg

SEQ ID NO: 109380 - DNA, 20 bp, Artificial
  CRISPR gRNA sequence
caccagggagacagcggggg

SEQ ID NO: 109381 - DNA, 20 bp, Artificial
  CRISPR gRNA sequence
accagggagacagcgggggc

SEQ ID NO: 109382 - DNA, 20 bp, Artificial
  CRISPR gRNA sequence
agacagcgggggcgggccca

SEQ ID NO: 109383 - DNA, 20 bp, Artificial
  CRISPR gRNA sequence
gacagcgggggcgggcccat

SEQ ID NO: 109384 - DNA, 20 bp, Artificial
  CRISPR gRNA sequence
acagcgggggcgggcccata

SEQ ID NO: 109385 - DNA, 20 bp, Artificial
  CRISPR gRNA sequence
gggcgggcccatagggctcc

SEQ ID NO: 109386 - DNA, 20 bp, Artificial
  CRISPR gRNA sequence
ggcgggcccatagggctccg

SEQ ID NO: 109387 - DNA, 20 bp, Artificial
  CRISPR gRNA sequence
gcccatagggctccgaggcg

SEQ ID NO: 109388 - DNA, 20 bp, Artificial
  CRISPR gRNA sequence
cccatagggctccgaggcgt

SEQ ID NO: 109389 - DNA, 20 bp, Artificial
  CRISPR gRNA sequence
atagggctccgaggcgtggg

SEQ ID NO: 109390 - DNA, 20 bp, Artificial
  CRISPR gRNA sequence
tagggctccgaggcgtgggc

SEQ ID NO: 109391 - DNA, 20 bp, Artificial
  CRISPR gRNA sequence
gctccgaggcgtgggcgggc

SEQ ID NO: 109392 - DNA, 20 bp, Artificial
  CRISPR gRNA sequence
gggcgggccagccccgttgc

SEQ ID NO: 109393 - DNA, 20 bp, Artificial
  CRISPR gRNA sequence
gccccgttgccagccgcaca

SEQ ID NO: 109394 - DNA, 20 bp, Artificial
  CRISPR gRNA sequence
ccccgttgccagccgcacac

SEQ ID NO: 109395 - DNA, 20 bp, Artificial
  CRISPR gRNA sequence
cagccgcacacgggaccccg

SEQ ID NO: 109396 - DNA, 20 bp, Artificial
  CRISPR gRNA sequence
cacacgggaccccgcggccg

SEQ ID NO: 109397 - DNA, 20 bp, Artificial
  CRISPR gRNA sequence
gccgcggcgcgcaccctccc

SEQ ID NO: 109398 - DNA, 20 bp, Artificial
  CRISPR gRNA sequence
ccgcggcgcgcaccctcccc

SEQ ID NO: 109399 - DNA, 20 bp, Artificial
  CRISPR gRNA sequence
cccaggcctccctcccgacc

SEQ ID NO: 109400 - DNA, 20 bp, Artificial
  CRISPR gRNA sequence
caggcctccctcccgaccta

SEQ ID NO: 109401 - DNA, 20 bp, Artificial
  CRISPR gRNA sequence
aggcctccctcccgacctag

SEQ ID NO: 109402 - DNA, 20 bp, Artificial
  CRISPR gRNA sequence
ggcctccctcccgacctaga

SEQ ID NO: 109403 - DNA, 20 bp, Artificial
  CRISPR gRNA sequence
gcctccctcccgacctagag

SEQ ID NO: 109404 - DNA, 20 bp, Artificial
  CRISPR gRNA sequence
ctcccgacctagaggggctg

SEQ ID NO: 109405 - DNA, 20 bp, Artificial
  CRISPR gRNA sequence
gacctagaggggctgcagat

SEQ ID NO: 109406 - DNA, 20 bp, Artificial
  CRISPR gRNA sequence
tagaggggctgcagataaga

SEQ ID NO: 109407 - DNA, 20 bp, Artificial
  CRISPR gRNA sequence
ggctgcagataagacagacc

SEQ ID NO: 109408 - DNA, 20 bp, Artificial
  CRISPR gRNA sequence
ataagacagacccggctcgc

SEQ ID NO: 109409 - DNA, 20 bp, Artificial
  CRISPR gRNA sequence
taagacagacccggctcgct

SEQ ID NO: 109410 - DNA, 20 bp, Artificial
  CRISPR gRNA sequence
agacagacccggctcgctgg

SEQ ID NO: 109411 - DNA, 20 bp, Artificial
  CRISPR gRNA sequence
cagacccggctcgctgggag

SEQ ID NO: 109412 - DNA, 20 bp, Artificial
  CRISPR gRNA sequence
agacccggctcgctgggagc

SEQ ID NO: 109413 - DNA, 20 bp, Artificial
  CRISPR gRNA sequence
gacccggctcgctgggagcg

SEQ ID NO: 109414 - DNA, 20 bp, Artificial
  CRISPR gRNA sequence
cccggctcgctgggagcggg

SEQ ID NO: 109415 - DNA, 20 bp, Artificial
  CRISPR gRNA sequence
ggctcgctgggagcggggag

SEQ ID NO: 109416 - DNA, 20 bp, Artificial
  CRISPR gRNA sequence
gctcgctgggagcggggagc

SEQ ID NO: 109417 - DNA, 20 bp, Artificial
  CRISPR gRNA sequence
ctcgctgggagcggggagcg

SEQ ID NO: 109418 - DNA, 20 bp, Artificial
  CRISPR gRNA sequence
tcgctgggagcggggagcgg

SEQ ID NO: 109419 - DNA, 20 bp, Artificial
  CRISPR gRNA sequence
cgctgggagcggggagcggg

SEQ ID NO: 109420 - DNA, 20 bp, Artificial
  CRISPR gRNA sequence
ggagcggggagcggggggcg

SEQ ID NO: 109421 - DNA, 20 bp, Artificial
  CRISPR gRNA sequence
gagcggggagcggggggcgc

SEQ ID NO: 109422 - DNA, 20 bp, Artificial
  CRISPR gRNA sequence
ggagcggggggcgcgggccc

SEQ ID NO: 109423 - DNA, 20 bp, Artificial
  CRISPR gRNA sequence
gagcggggggcgcgggcccc

SEQ ID NO: 109424 - DNA, 20 bp, Artificial
  CRISPR gRNA sequence
agcggggggcgcgggccccg

SEQ ID NO: 109425 - DNA, 20 bp, Artificial
  CRISPR gRNA sequence
cggggggcgcgggccccggg

SEQ ID NO: 109426 - DNA, 20 bp, Artificial
  CRISPR gRNA sequence
ggggggcgcgggccccgggg

SEQ ID NO: 109427 - DNA, 20 bp, Artificial
  CRISPR gRNA sequence
ccggggaggcttcctgtccc

SEQ ID NO: 109428 - DNA, 20 bp, Artificial
  CRISPR gRNA sequence
cggggaggcttcctgtccca

SEQ ID NO: 109429 - DNA, 20 bp, Artificial
  CRISPR gRNA sequence
ggggaggcttcctgtcccaa

SEQ ID NO: 109430 - DNA, 20 bp, Artificial
  CRISPR gRNA sequence
aggcttcctgtcccaagggc

SEQ ID NO: 109431 - DNA, 20 bp, Artificial
  CRISPR gRNA sequence
gcttcctgtcccaagggccg

SEQ ID NO: 109432 - DNA, 20 bp, Artificial
  CRISPR gRNA sequence
ttcctgtcccaagggccgga

SEQ ID NO: 109433 - DNA, 20 bp, Artificial
  CRISPR gRNA sequence
ctgtcccaagggccggagag

SEQ ID NO: 109434 - DNA, 20 bp, Artificial
  CRISPR gRNA sequence
gtcccaagggccggagagtg

SEQ ID NO: 109435 - DNA, 20 bp, Artificial
  CRISPR gRNA sequence
cccaagggccggagagtgga

SEQ ID NO: 109436 - DNA, 20 bp, Artificial
  CRISPR gRNA sequence
ggccggagagtggagagtgc

SEQ ID NO: 109437 - DNA, 20 bp, Artificial
  CRISPR gRNA sequence
gccggagagtggagagtgca

SEQ ID NO: 109438 - DNA, 20 bp, Artificial
  CRISPR gRNA sequence
ccggagagtggagagtgcaa

SEQ ID NO: 109439 - DNA, 20 bp, Artificial
  CRISPR gRNA sequence
gagagtggagagtgcaaggg

SEQ ID NO: 109440 - DNA, 20 bp, Artificial
  CRISPR gRNA sequence
agagtggagagtgcaagggc

SEQ ID NO: 109441 - DNA, 20 bp, Artificial
  CRISPR gRNA sequence
gagagtgcaagggcaggttt

SEQ ID NO: 109442 - DNA, 20 bp, Artificial
  CRISPR gRNA sequence
caagggcaggtttaagtttg

SEQ ID NO: 109443 - DNA, 20 bp, Artificial
  CRISPR gRNA sequence
ggcaggtttaagtttgcggc

SEQ ID NO: 109444 - DNA, 20 bp, Artificial
  CRISPR gRNA sequence
aagtttgcggccagaacgac

SEQ ID NO: 109445 - DNA, 20 bp, Artificial
  CRISPR gRNA sequence
agtttgcggccagaacgacc

SEQ ID NO: 109446 - DNA, 20 bp, Artificial
  CRISPR gRNA sequence
tttgcggccagaacgaccag

SEQ ID NO: 109447 - DNA, 20 bp, Artificial
  CRISPR gRNA sequence
ttgcggccagaacgaccagg

SEQ ID NO: 109448 - DNA, 20 bp, Artificial
  CRISPR gRNA sequence
acgaccaggaggaaatcgcc

SEQ ID NO: 109449 - DNA, 20 bp, Artificial
  CRISPR gRNA sequence
cgaccaggaggaaatcgccg

SEQ ID NO: 109450 - DNA, 20 bp, Artificial
  CRISPR gRNA sequence
aggaggaaatcgccgaggcc

SEQ ID NO: 109451 - DNA, 20 bp, Artificial
  CRISPR gRNA sequence
ggaggaaatcgccgaggccc

SEQ ID NO: 109452 - DNA, 20 bp, Artificial
  CRISPR gRNA sequence
gaggaaatcgccgaggccca

SEQ ID NO: 109453 - DNA, 20 bp, Artificial
  CRISPR gRNA sequence
cagggcgcgcatgtgtcccc

SEQ ID NO: 109454 - DNA, 20 bp, Artificial
  CRISPR gRNA sequence
cgcgcatgtgtcccctagtg

SEQ ID NO: 109455 - DNA, 20 bp, Artificial
  CRISPR gRNA sequence
gcgcatgtgtcccctagtgt

SEQ ID NO: 109456 - DNA, 20 bp, Artificial
  CRISPR gRNA sequence
cgcatgtgtcccctagtgta

SEQ ID NO: 109457 - DNA, 20 bp, Artificial
  CRISPR gRNA sequence
ccctagtgtagggccattcg

SEQ ID NO: 109458 - DNA, 20 bp, Artificial
  CRISPR gRNA sequence
tgtagggccattcgtggccc

SEQ ID NO: 109459 - DNA, 20 bp, Artificial
  CRISPR gRNA sequence
gtagggccattcgtggcccc

SEQ ID NO: 109460 - DNA, 20 bp, Artificial
  CRISPR gRNA sequence
gccattcgtggccccaggcc

SEQ ID NO: 109461 - DNA, 20 bp, Artificial
  CRISPR gRNA sequence
ccattcgtggccccaggcct

SEQ ID NO: 109462 - DNA, 20 bp, Artificial
  CRISPR gRNA sequence
cattcgtggccccaggcctg

SEQ ID NO: 109463 - DNA, 20 bp, Artificial
  CRISPR gRNA sequence
tggccccaggcctggggcct

SEQ ID NO: 109464 - DNA, 20 bp, Artificial
  CRISPR gRNA sequence
aggcctggggcctgagaacc

SEQ ID NO: 109465 - DNA, 20 bp, Artificial
  CRISPR gRNA sequence
ggcctggggcctgagaacct

SEQ ID NO: 109466 - DNA, 20 bp, Artificial
  CRISPR gRNA sequence
gggcctgagaacctgggcct

SEQ ID NO: 109467 - DNA, 20 bp, Artificial
  CRISPR gRNA sequence
ctgagaacctgggcctgagt

SEQ ID NO: 109468 - DNA, 20 bp, Artificial
  CRISPR gRNA sequence
tgagaacctgggcctgagtc

SEQ ID NO: 109469 - DNA, 20 bp, Artificial
  CRISPR gRNA sequence
gagaacctgggcctgagtcg

SEQ ID NO: 109470 - DNA, 20 bp, Artificial
  CRISPR gRNA sequence
cctgggcctgagtcggggaa

SEQ ID NO: 109471 - DNA, 20 bp, Artificial
  CRISPR gRNA sequence
ctgggcctgagtcggggaac

SEQ ID NO: 109472 - DNA, 20 bp, Artificial
  CRISPR gRNA sequence
tgggcctgagtcggggaaca

SEQ ID NO: 109473 - DNA, 20 bp, Artificial
  CRISPR gRNA sequence
aacagggacgcattcccaac

SEQ ID NO: 109474 - DNA, 20 bp, Artificial
  CRISPR gRNA sequence
gacgcattcccaactggccc

SEQ ID NO: 109475 - DNA, 20 bp, Artificial
  CRISPR gRNA sequence
aactggccctggcaccctgc

SEQ ID NO: 109476 - DNA, 20 bp, Artificial
  CRISPR gRNA sequence
actggccctggcaccctgcg

SEQ ID NO: 109477 - DNA, 20 bp, Artificial
  CRISPR gRNA sequence
ctggccctggcaccctgcga

SEQ ID NO: 109478 - DNA, 20 bp, Artificial
  CRISPR gRNA sequence
ccctggcaccctgcgagggt

SEQ ID NO: 109479 - DNA, 20 bp, Artificial
  CRISPR gRNA sequence
ctggcaccctgcgagggtcg

SEQ ID NO: 109480 - DNA, 20 bp, Artificial
  CRISPR gRNA sequence
cctgcgagggtcggagcccc

SEQ ID NO: 109481 - DNA, 20 bp, Artificial
  CRISPR gRNA sequence
ctgcgagggtcggagccccg

SEQ ID NO: 109482 - DNA, 20 bp, Artificial
  CRISPR gRNA sequence
ccccgaggtgcctgctcccc

SEQ ID NO: 109483 - DNA, 20 bp, Artificial
  CRISPR gRNA sequence
cccgaggtgcctgctccccg

SEQ ID NO: 109484 - DNA, 20 bp, Artificial
  CRISPR gRNA sequence
cccgaggcgccatccccgcg

SEQ ID NO: 109485 - DNA, 20 bp, Artificial
  CRISPR gRNA sequence
ccgaggcgccatccccgcgc

SEQ ID NO: 109486 - DNA, 20 bp, Artificial
  CRISPR gRNA sequence
cgaggcgccatccccgcgcg

SEQ ID NO: 109487 - DNA, 20 bp, Artificial
  CRISPR gRNA sequence
ggcgccatccccgcgcgggg

SEQ ID NO: 109488 - DNA, 20 bp, Artificial
  CRISPR gRNA sequence
cccgcgcggggcggcccctg

SEQ ID NO: 109489 - DNA, 20 bp, Artificial
  CRISPR gRNA sequence
ccgcgcggggcggcccctgc

SEQ ID NO: 109490 - DNA, 20 bp, Artificial
  CRISPR gRNA sequence
ggggcggcccctgcaggcct

SEQ ID NO: 109491 - DNA, 20 bp, Artificial
  CRISPR gRNA sequence
cggcccctgcaggcctcggc

SEQ ID NO: 109492 - DNA, 20 bp, Artificial
  CRISPR gRNA sequence
ggcccctgcaggcctcggcc

SEQ ID NO: 109493 - DNA, 20 bp, Artificial
  CRISPR gRNA sequence
cccctgcaggcctcggccgg

SEQ ID NO: 109494 - DNA, 20 bp, Artificial
  CRISPR gRNA sequence
gcctcggccgggagtgcccc

SEQ ID NO: 109495 - DNA, 20 bp, Artificial
  CRISPR gRNA sequence
cctcggccgggagtgccccg

SEQ ID NO: 109496 - DNA, 20 bp, Artificial
  CRISPR gRNA sequence
ggagtgccccgaggcgctcg

SEQ ID NO: 109497 - DNA, 20 bp, Artificial
  CRISPR gRNA sequence
gagtgccccgaggcgctcgc

SEQ ID NO: 109498 - DNA, 20 bp, Artificial
  CRISPR gRNA sequence
cccgaggcgctcgcaggccc

SEQ ID NO: 109499 - DNA, 20 bp, Artificial
  CRISPR gRNA sequence
ccgaggcgctcgcaggcccc

SEQ ID NO: 109500 - DNA, 20 bp, Artificial
  CRISPR gRNA sequence
ggcgctcgcaggccccgggc

SEQ ID NO: 109501 - DNA, 20 bp, Artificial
  CRISPR gRNA sequence
gcgctcgcaggccccgggcc

SEQ ID NO: 109502 - DNA, 20 bp, Artificial
  CRISPR gRNA sequence
cgctcgcaggccccgggccg

SEQ ID NO: 109503 - DNA, 20 bp, Artificial
  CRISPR gRNA sequence
aggccccgggccggggccgc

SEQ ID NO: 109504 - DNA, 20 bp, Artificial
  CRISPR gRNA sequence
ggccggggccgctggccgcc

SEQ ID NO: 109505 - DNA, 20 bp, Artificial
  CRISPR gRNA sequence
gggccgctggccgcccggct

SEQ ID NO: 109506 - DNA, 20 bp, Artificial
  CRISPR gRNA sequence
cgctggccgcccggctcggc

SEQ ID NO: 109507 - DNA, 20 bp, Artificial
  CRISPR gRNA sequence
gctggccgcccggctcggct

SEQ ID NO: 109508 - DNA, 20 bp, Artificial
  CRISPR gRNA sequence
ccgcccggctcggctaggct

SEQ ID NO: 109509 - DNA, 20 bp, Artificial
  CRISPR gRNA sequence
ctaggctcagctcgactccc

SEQ ID NO: 109510 - DNA, 20 bp, Artificial
  CRISPR gRNA sequence
taggctcagctcgactcccc

SEQ ID NO: 109511 - DNA, 20 bp, Artificial
  CRISPR gRNA sequence
gctcgactccccgggctcga

SEQ ID NO: 109512 - DNA, 20 bp, Artificial
  CRISPR gRNA sequence
ctcgactccccgggctcgac

SEQ ID NO: 109513 - DNA, 20 bp, Artificial
  CRISPR gRNA sequence
ccccgggctcgacgggcgcc

SEQ ID NO: 109514 - DNA, 20 bp, Artificial
  CRISPR gRNA sequence
cccgggctcgacgggcgcct

SEQ ID NO: 109515 - DNA, 20 bp, Artificial
  CRISPR gRNA sequence
cgggcgcctgggcctctcct

SEQ ID NO: 109516 - DNA, 20 bp, Artificial
  CRISPR gRNA sequence
gcgcctgggcctctcctgag

SEQ ID NO: 109517 - DNA, 20 bp, Artificial
  CRISPR gRNA sequence
ctgggcctctcctgagtggt

SEQ ID NO: 109518 - DNA, 20 bp, Artificial
  CRISPR gRNA sequence
gcctctcctgagtggtcagc

SEQ ID NO: 109519 - DNA, 20 bp, Artificial
  CRISPR gRNA sequence
ggtcagcgagacccgccaat

SEQ ID NO: 109520 - DNA, 20 bp, Artificial
  CRISPR gRNA sequence
gtcagcgagacccgccaatc

SEQ ID NO: 109521 - DNA, 20 bp, Artificial
  CRISPR gRNA sequence
tcagcgagacccgccaatcg

SEQ ID NO: 109522 - DNA, 20 bp, Artificial
  CRISPR gRNA sequence
agacccgccaatcggggcgc

SEQ ID NO: 109523 - DNA, 20 bp, Artificial
  CRISPR gRNA sequence
gacccgccaatcggggcgct

SEQ ID NO: 109524 - DNA, 20 bp, Artificial
  CRISPR gRNA sequence
acccgccaatcggggcgctg

SEQ ID NO: 109525 - DNA, 20 bp, Artificial
  CRISPR gRNA sequence
gccaatcggggcgctggggc

SEQ ID NO: 109526 - DNA, 20 bp, Artificial
  CRISPR gRNA sequence
cggggcgctggggccggctc

SEQ ID NO: 109527 - DNA, 20 bp, Artificial
  CRISPR gRNA sequence
ggggcgctggggccggctct

SEQ ID NO: 109528 - DNA, 20 bp, Artificial
  CRISPR gRNA sequence
tggggccggctctgggccgc

SEQ ID NO: 109529 - DNA, 20 bp, Artificial
  CRISPR gRNA sequence
ggctctgggccgctggatat

SEQ ID NO: 109530 - DNA, 20 bp, Artificial
  CRISPR gRNA sequence
ctcaccgtgcctcgctcccc

SEQ ID NO: 109531 - DNA, 20 bp, Artificial
  CRISPR gRNA sequence
ggttcgctgcccgcgctgat

SEQ ID NO: 109532 - DNA, 20 bp, Artificial
  CRISPR gRNA sequence
ctgcccgcgctgattggctc

SEQ ID NO: 109533 - DNA, 20 bp, Artificial
  CRISPR gRNA sequence
gcgctgattggctccagtac

SEQ ID NO: 109534 - DNA, 20 bp, Artificial
  CRISPR gRNA sequence
accggactccgaaacccaat

SEQ ID NO: 109535 - DNA, 20 bp, Artificial
  CRISPR gRNA sequence
cggactccgaaacccaatca

SEQ ID NO: 109536 - DNA, 20 bp, Artificial
  CRISPR gRNA sequence
ggactccgaaacccaatcag

SEQ ID NO: 109537 - DNA, 20 bp, Artificial
  CRISPR gRNA sequence
cgaaacccaatcagaggctc

SEQ ID NO: 109538 - DNA, 20 bp, Artificial
  CRISPR gRNA sequence
ccgccgccactgccgctgcc

SEQ ID NO: 109539 - DNA, 20 bp, Artificial
  CRISPR gRNA sequence
actgccgctgcctagcaaaa

SEQ ID NO: 109540 - DNA, 20 bp, Artificial
  CRISPR gRNA sequence
caaaatggcgaacccgaaca

SEQ ID NO: 109541 - DNA, 20 bp, Artificial
  CRISPR gRNA sequence
aaaatggcgaacccgaacaa

SEQ ID NO: 109542 - DNA, 20 bp, Artificial
  CRISPR gRNA sequence
aaatggcgaacccgaacaaa

SEQ ID NO: 109543 - DNA, 20 bp, Artificial
  CRISPR gRNA sequence
aatggcgaacccgaacaaag

SEQ ID NO: 109544 - DNA, 20 bp, Artificial
  CRISPR gRNA sequence
gaacccgaacaaaggggaat

SEQ ID NO: 109545 - DNA, 20 bp, Artificial
  CRISPR gRNA sequence
aacccgaacaaaggggaatc

SEQ ID NO: 109546 - DNA, 20 bp, Artificial
  CRISPR gRNA sequence
tccctccaaccgcctccgcg

SEQ ID NO: 109547 - DNA, 20 bp, Artificial
  CRISPR gRNA sequence
ccctccaaccgcctccgcgc

SEQ ID NO: 109548 - DNA, 20 bp, Artificial
  CRISPR gRNA sequence
gcctccgcgcaggcgcctct

SEQ ID NO: 109549 - DNA, 20 bp, Artificial
  CRISPR gRNA sequence
cctccgcgcaggcgcctctg

SEQ ID NO: 109550 - DNA, 20 bp, Artificial
  CRISPR gRNA sequence
gaggccacgcccactaactc

SEQ ID NO: 109551 - DNA, 20 bp, Artificial
  CRISPR gRNA sequence
cacgcccactaactccagtt

SEQ ID NO: 109552 - DNA, 20 bp, Artificial
  CRISPR gRNA sequence
acgcccactaactccagttc

SEQ ID NO: 109553 - DNA, 20 bp, Artificial
  CRISPR gRNA sequence
cgcccactaactccagttca

SEQ ID NO: 109554 - DNA, 20 bp, Artificial
  CRISPR gRNA sequence
gaggcccgattcccctttgt

SEQ ID NO: 109555 - DNA, 20 bp, Artificial
  CRISPR gRNA sequence
gcggcggctggagcctctga

SEQ ID NO: 109556 - DNA, 20 bp, Artificial
  CRISPR gRNA sequence
tggagcctctgattgggttt

SEQ ID NO: 109557 - DNA, 20 bp, Artificial
  CRISPR gRNA sequence
aaccgggggagcgaggcacg

SEQ ID NO: 109558 - DNA, 20 bp, Artificial
  CRISPR gRNA sequence
cggccccagcgccccgattg

SEQ ID NO: 109559 - DNA, 20 bp, Artificial
  CRISPR gRNA sequence
ccaggcgcccgtcgagcccg

SEQ ID NO: 109560 - DNA, 20 bp, Artificial
  CRISPR gRNA sequence
ctgcaggggccgccccgcgc

SEQ ID NO: 109561 - DNA, 20 bp, Artificial
  CRISPR gRNA sequence
cctcggggctccgaccctcg

SEQ ID NO: 109562 - DNA, 20 bp, Artificial
  CRISPR gRNA sequence
gcagggtgccagggccagtt

SEQ ID NO: 109563 - DNA, 20 bp, Artificial
  CRISPR gRNA sequence
caggccccaggcctggggcc

SEQ ID NO: 109564 - DNA, 20 bp, Artificial
  CRISPR gRNA sequence
cgctccccgctcccagcgag

SEQ ID NO: 109565 - DNA, 20 bp, Artificial
  CRISPR gRNA sequence
ggtcgggagggaggcctggg

SEQ ID NO: 109566 - DNA, 20 bp, Artificial
  CRISPR gRNA sequence
gagggtgcgcgccgcggccg

SEQ ID NO: 109567 - DNA, 20 bp, Artificial
  CRISPR gRNA sequence
ctcctcccagcccgctccgc

SEQ ID NO: 109568 - DNA, 20 bp, Artificial
  CRISPR gRNA sequence
ttgtgaaatctccctccctt

SEQ ID NO: 109569 - DNA, 20 bp, Artificial
  CRISPR gRNA sequence
tgggaatatagtacagtttt

SEQ ID NO: 109570 - DNA, 20 bp, Artificial
  CRISPR gRNA sequence
tttagaaactaacagtgttg

SEQ ID NO: 109571 - DNA, 20 bp, Artificial
  CRISPR gRNA sequence
cagtgttgtggggttttcct

SEQ ID NO: 109572 - DNA, 20 bp, Artificial
  CRISPR gRNA sequence
tataatccgtgtgttaggga

SEQ ID NO: 109573 - DNA, 20 bp, Artificial
  CRISPR gRNA sequence
cgcacttttgactggccttg

SEQ ID NO: 109574 - DNA, 20 bp, Artificial
  CRISPR gRNA sequence
gagaagaaaagcatgtgcag

SEQ ID NO: 109575 - DNA, 20 bp, Artificial
  CRISPR gRNA sequence
cactgttggaggcaggaaga

SEQ ID NO: 109576 - DNA, 20 bp, Artificial
  CRISPR gRNA sequence
aatacttgtatatcttgcta

SEQ ID NO: 109577 - DNA, 20 bp, Artificial
  CRISPR gRNA sequence
tgtatggaggttcaagtaga

SEQ ID NO: 109578 - DNA, 20 bp, Artificial
  CRISPR gRNA sequence
tttttcctaagattgaaaaa

SEQ ID NO: 109579 - DNA, 20 bp, Artificial
  CRISPR gRNA sequence
aacgagtttctgacttgttt

SEQ ID NO: 109580 - DNA, 20 bp, Artificial
  CRISPR gRNA sequence
gttctgccccgtgatagtgg

SEQ ID NO: 109581 - DNA, 20 bp, Artificial
  CRISPR gRNA sequence
tgatagtggctgagttcttt

SEQ ID NO: 109582 - DNA, 20 bp, Artificial
  CRISPR gRNA sequence
tgaaaattatttttactcat

SEQ ID NO: 109583 - DNA, 20 bp, Artificial
  CRISPR gRNA sequence
caggttttattttcactttt

SEQ ID NO: 109584 - DNA, 20 bp, Artificial
  CRISPR gRNA sequence
ttttattttcactttttagg

SEQ ID NO: 109585 - DNA, 20 bp, Artificial
  CRISPR gRNA sequence
gaacgtttttttgtttgttt

SEQ ID NO: 109586 - DNA, 20 bp, Artificial
  CRISPR gRNA sequence
ctttcctctgtcatccaggc

SEQ ID NO: 109587 - DNA, 20 bp, Artificial
  CRISPR gRNA sequence
ttcttgttctcccaaaacgt

SEQ ID NO: 109588 - DNA, 20 bp, Artificial
  CRISPR gRNA sequence
aagcttccaccagtctgcag

SEQ ID NO: 109589 - DNA, 20 bp, Artificial
  CRISPR gRNA sequence
tcccatatcactttatctct

SEQ ID NO: 109590 - DNA, 20 bp, Artificial
  CRISPR gRNA sequence
acttaaagactctttgaagt

SEQ ID NO: 109591 - DNA, 20 bp, Artificial
  CRISPR gRNA sequence
agctccaatccagaaatctg

SEQ ID NO: 109592 - DNA, 20 bp, Artificial
  CRISPR gRNA sequence
cgtctatcaggacccacttg

SEQ ID NO: 109593 - DNA, 20 bp, Artificial
  CRISPR gRNA sequence
ttgttgagttgtgaaagaaa

SEQ ID NO: 109594 - DNA, 20 bp, Artificial
  CRISPR gRNA sequence
aaattgagtgagccaatgct

SEQ ID NO: 109595 - DNA, 20 bp, Artificial
  CRISPR gRNA sequence
tgctgggaatttttaaataa

SEQ ID NO: 109596 - DNA, 20 bp, Artificial
  CRISPR gRNA sequence
actttgggaagccgaagtgg

SEQ ID NO: 109597 - DNA, 20 bp, Artificial
  CRISPR gRNA sequence
tgggagaatcctttgagctc

SEQ ID NO: 109598 - DNA, 20 bp, Artificial
  CRISPR gRNA sequence
ctcaggagtttgagaccagc

SEQ ID NO: 109599 - DNA, 20 bp, Artificial
  CRISPR gRNA sequence
ccctctcttaaaagaaaaaa

SEQ ID NO: 109600 - DNA, 20 bp, Artificial
  CRISPR gRNA sequence
atgctttatacatgtgtgca

SEQ ID NO: 109601 - DNA, 20 bp, Artificial
  CRISPR gRNA sequence
aatgaaatgtgtttcttact

SEQ ID NO: 109602 - DNA, 20 bp, Artificial
  CRISPR gRNA sequence
ttttcatatgcttacactag

SEQ ID NO: 109603 - DNA, 20 bp, Artificial
  CRISPR gRNA sequence
ttctgaagaggttttagctt

SEQ ID NO: 109604 - DNA, 20 bp, Artificial
  CRISPR gRNA sequence
ggagtttgtgtaggtccaca

SEQ ID NO: 109605 - DNA, 20 bp, Artificial
  CRISPR gRNA sequence
tttgtgtaggtccacataga

SEQ ID NO: 109606 - DNA, 20 bp, Artificial
  CRISPR gRNA sequence
aagtctcagcttttgcacct

SEQ ID NO: 109607 - DNA, 20 bp, Artificial
  CRISPR gRNA sequence
ccttggaatagtggggcaaa

SEQ ID NO: 109608 - DNA, 20 bp, Artificial
  CRISPR gRNA sequence
aaagagaattgcactgagaa

SEQ ID NO: 109609 - DNA, 20 bp, Artificial
  CRISPR gRNA sequence
agaagagaatgcactaggaa

SEQ ID NO: 109610 - DNA, 20 bp, Artificial
  CRISPR gRNA sequence
aagagaattttcatgctagc

SEQ ID NO: 109611 - DNA, 20 bp, Artificial
  CRISPR gRNA sequence
aggcactttgggaaagacta

SEQ ID NO: 109612 - DNA, 20 bp, Artificial
  CRISPR gRNA sequence
actctgtcattaatgtgaga

SEQ ID NO: 109613 - DNA, 20 bp, Artificial
  CRISPR gRNA sequence
aattggttcatttgtattac

SEQ ID NO: 109614 - DNA, 20 bp, Artificial
  CRISPR gRNA sequence
tcttgtaaagatgtaaactt

SEQ ID NO: 109615 - DNA, 20 bp, Artificial
  CRISPR gRNA sequence
tctcatataagaaggaaatt

SEQ ID NO: 109616 - DNA, 20 bp, Artificial
  CRISPR gRNA sequence
aattttaaatgtgtattttg

SEQ ID NO: 109617 - DNA, 20 bp, Artificial
  CRISPR gRNA sequence
ttttggagattttatataaa

SEQ ID NO: 109618 - DNA, 20 bp, Artificial
  CRISPR gRNA sequence
attgtgtattagagacaaga

SEQ ID NO: 109619 - DNA, 20 bp, Artificial
  CRISPR gRNA sequence
ctgattttctattctatacc

SEQ ID NO: 109620 - DNA, 20 bp, Artificial
  CRISPR gRNA sequence
atgttgtatccattttggtt

SEQ ID NO: 109621 - DNA, 20 bp, Artificial
  CRISPR gRNA sequence
tccattttggttatgagtaa

SEQ ID NO: 109622 - DNA, 20 bp, Artificial
  CRISPR gRNA sequence
ccaacattcatttgggaaat

SEQ ID NO: 109623 - DNA, 20 bp, Artificial
  CRISPR gRNA sequence
aaaattcttattctagaaat

SEQ ID NO: 109624 - DNA, 20 bp, Artificial
  CRISPR gRNA sequence
caagtgtgcagtgaaatcaa

SEQ ID NO: 109625 - DNA, 20 bp, Artificial
  CRISPR gRNA sequence
acacctgtatacctgccagt

SEQ ID NO: 109626 - DNA, 20 bp, Artificial
  CRISPR gRNA sequence
gattaattccaccagcatgt

SEQ ID NO: 109627 - DNA, 20 bp, Artificial
  CRISPR gRNA sequence
ccagcatgtgtggatttatg

SEQ ID NO: 109628 - DNA, 20 bp, Artificial
  CRISPR gRNA sequence
tcattttattattcagatgt

SEQ ID NO: 109629 - DNA, 20 bp, Artificial
  CRISPR gRNA sequence
ctccctcccatatttccaag

SEQ ID NO: 109630 - DNA, 20 bp, Artificial
  CRISPR gRNA sequence
ttgtatccttatttttaaaa

SEQ ID NO: 109631 - DNA, 20 bp, Artificial
  CRISPR gRNA sequence
caactcttaaagtctatgag

SEQ ID NO: 109632 - DNA, 20 bp, Artificial
  CRISPR gRNA sequence
gcctaccatatgtagtggac

SEQ ID NO: 109633 - DNA, 20 bp, Artificial
  CRISPR gRNA sequence
tatcaaagtgatgtagctta

SEQ ID NO: 109634 - DNA, 20 bp, Artificial
  CRISPR gRNA sequence
aatcccagttaaaaatgata

SEQ ID NO: 109635 - DNA, 20 bp, Artificial
  CRISPR gRNA sequence
tctttccccacctttctaac

SEQ ID NO: 109636 - DNA, 20 bp, Artificial
  CRISPR gRNA sequence
gagtgtacctcacagccttc

SEQ ID NO: 109637 - DNA, 20 bp, Artificial
  CRISPR gRNA sequence
tcacagccttctaggatctc

SEQ ID NO: 109638 - DNA, 20 bp, Artificial
  CRISPR gRNA sequence
ctaggatctccagagtggac

SEQ ID NO: 109639 - DNA, 20 bp, Artificial
  CRISPR gRNA sequence
ttggttggtctattgccctg

SEQ ID NO: 109640 - DNA, 20 bp, Artificial
  CRISPR gRNA sequence
ataccagatcttgtgagata

SEQ ID NO: 109641 - DNA, 20 bp, Artificial
  CRISPR gRNA sequence
atgtctagcccatgaccact

SEQ ID NO: 109642 - DNA, 20 bp, Artificial
  CRISPR gRNA sequence
ccacttagaatctactcttc

SEQ ID NO: 109643 - DNA, 20 bp, Artificial
  CRISPR gRNA sequence
atttggactttaaaattttt

SEQ ID NO: 109644 - DNA, 20 bp, Artificial
  CRISPR gRNA sequence
gaaaagctctggtttaacat

SEQ ID NO: 109645 - DNA, 20 bp, Artificial
  CRISPR gRNA sequence
atatttagacagccattctt

SEQ ID NO: 109646 - DNA, 20 bp, Artificial
  CRISPR gRNA sequence
atggataagacatactagaa

SEQ ID NO: 109647 - DNA, 20 bp, Artificial
  CRISPR gRNA sequence
ctaattaatagattgctttc

SEQ ID NO: 109648 - DNA, 20 bp, Artificial
  CRISPR gRNA sequence
cattttctgatgctttatgc

SEQ ID NO: 109649 - DNA, 20 bp, Artificial
  CRISPR gRNA sequence
gaaatactttgttttcaaaa

SEQ ID NO: 109650 - DNA, 20 bp, Artificial
  CRISPR gRNA sequence
agggaaaggtagtattgatg

SEQ ID NO: 109651 - DNA, 20 bp, Artificial
  CRISPR gRNA sequence
tcaactgcctttttagagga

SEQ ID NO: 109652 - DNA, 20 bp, Artificial
  CRISPR gRNA sequence
ccattcacaccagtgccctg

SEQ ID NO: 109653 - DNA, 20 bp, Artificial
  CRISPR gRNA sequence
tcacaccagtgccctggagg

SEQ ID NO: 109654 - DNA, 20 bp, Artificial
  CRISPR gRNA sequence
agggtgggtttttattcttt

SEQ ID NO: 109655 - DNA, 20 bp, Artificial
  CRISPR gRNA sequence
tctttcagaatttgccatta

SEQ ID NO: 109656 - DNA, 20 bp, Artificial
  CRISPR gRNA sequence
tagtggatgtaaaaataagg

SEQ ID NO: 109657 - DNA, 20 bp, Artificial
  CRISPR gRNA sequence
tggctcttaaagcagtccag

SEQ ID NO: 109658 - DNA, 20 bp, Artificial
  CRISPR gRNA sequence
aggaaggttggcttaagccc

SEQ ID NO: 109659 - DNA, 20 bp, Artificial
  CRISPR gRNA sequence
taaataaagtttaaaaaaaa

SEQ ID NO: 109660 - DNA, 20 bp, Artificial
  CRISPR gRNA sequence
ttggtgattgcatttaagcc

SEQ ID NO: 109661 - DNA, 20 bp, Artificial
  CRISPR gRNA sequence
tgttaatgatgacaactgtt

SEQ ID NO: 109662 - DNA, 20 bp, Artificial
  CRISPR gRNA sequence
atgacaactgttttgagttt

SEQ ID NO: 109663 - DNA, 20 bp, Artificial
  CRISPR gRNA sequence
aacaaaacagcttcaatata

SEQ ID NO: 109664 - DNA, 20 bp, Artificial
  CRISPR gRNA sequence
cctgttcctgttctcagcag

SEQ ID NO: 109665 - DNA, 20 bp, Artificial
  CRISPR gRNA sequence
atgtctggtgctgtttgtgt

SEQ ID NO: 109666 - DNA, 20 bp, Artificial
  CRISPR gRNA sequence
tttgtgttaggatctccagt

SEQ ID NO: 109667 - DNA, 20 bp, Artificial
  CRISPR gRNA sequence
agaccccgtatcaactttct

SEQ ID NO: 109668 - DNA, 20 bp, Artificial
  CRISPR gRNA sequence
ccgtatcaactttctgagaa

SEQ ID NO: 109669 - DNA, 20 bp, Artificial
  CRISPR gRNA sequence
tttgactagcatgtttcttt

SEQ ID NO: 109670 - DNA, 20 bp, Artificial
  CRISPR gRNA sequence
gaaattcttataagtgacat

SEQ ID NO: 109671 - DNA, 20 bp, Artificial
  CRISPR gRNA sequence
actttgggaggccgaggcag

SEQ ID NO: 109672 - DNA, 20 bp, Artificial
  CRISPR gRNA sequence
tacttgggaggctggagcag

SEQ ID NO: 109673 - DNA, 20 bp, Artificial
  CRISPR gRNA sequence
ttgcgccactgcactccagc

SEQ ID NO: 109674 - DNA, 20 bp, Artificial
  CRISPR gRNA sequence
tccgtctcaaaaaaaaaaaa

SEQ ID NO: 109675 - DNA, 20 bp, Artificial
  CRISPR gRNA sequence
tggcaaggtttatctaagca

SEQ ID NO: 109676 - DNA, 20 bp, Artificial
  CRISPR gRNA sequence
gtttccactacctttcctgg

SEQ ID NO: 109677 - DNA, 20 bp, Artificial
  CRISPR gRNA sequence
acctcttggttaggcagaag

SEQ ID NO: 109678 - DNA, 20 bp, Artificial
  CRISPR gRNA sequence
gtatggctaagtatcctaaa

SEQ ID NO: 109679 - DNA, 20 bp, Artificial
  CRISPR gRNA sequence
ggccagttcctataaaacac

SEQ ID NO: 109680 - DNA, 20 bp, Artificial
  CRISPR gRNA sequence
ttttgagaaattggcaagat

SEQ ID NO: 109681 - DNA, 20 bp, Artificial
  CRISPR gRNA sequence
taccctactttttccctcca

SEQ ID NO: 109682 - DNA, 20 bp, Artificial
  CRISPR gRNA sequence
gaattagaaatgattcaaag

SEQ ID NO: 109683 - DNA, 20 bp, Artificial
  CRISPR gRNA sequence
aaatgattcaaagtagaatc

SEQ ID NO: 109684 - DNA, 20 bp, Artificial
  CRISPR gRNA sequence
ctcatatataaaacagtatt

SEQ ID NO: 109685 - DNA, 20 bp, Artificial
  CRISPR gRNA sequence
ggattgtcattaaccccttg

SEQ ID NO: 109686 - DNA, 20 bp, Artificial
  CRISPR gRNA sequence
tcattaaccccttgtggaat

SEQ ID NO: 109687 - DNA, 20 bp, Artificial
  CRISPR gRNA sequence
tgtaaatacagtgagctctt

SEQ ID NO: 109688 - DNA, 20 bp, Artificial
  CRISPR gRNA sequence
tcaaatcatttatcatgtgc

SEQ ID NO: 109689 - DNA, 20 bp, Artificial
  CRISPR gRNA sequence
ttggggaggaaattaagatg

SEQ ID NO: 109690 - DNA, 20 bp, Artificial
  CRISPR gRNA sequence
ataatagaaacctttcctct

SEQ ID NO: 109691 - DNA, 20 bp, Artificial
  CRISPR gRNA sequence
tagggatctgattattttgg

SEQ ID NO: 109692 - DNA, 20 bp, Artificial
  CRISPR gRNA sequence
ctgagaaatctttcttgata

SEQ ID NO: 109693 - DNA, 20 bp, Artificial
  CRISPR gRNA sequence
caagcatttggtgtagcaaa

SEQ ID NO: 109694 - DNA, 20 bp, Artificial
  CRISPR gRNA sequence
gtagcaaaggggatttgatt

SEQ ID NO: 109695 - DNA, 20 bp, Artificial
  CRISPR gRNA sequence
aagggaaagagatagcatga

SEQ ID NO: 109696 - DNA, 20 bp, Artificial
  CRISPR gRNA sequence
atggacagtttaacaaaact

SEQ ID NO: 109697 - DNA, 20 bp, Artificial
  CRISPR gRNA sequence
tctaacctactcatctagga

SEQ ID NO: 109698 - DNA, 20 bp, Artificial
  CRISPR gRNA sequence
tgcacatactttcattaagt

SEQ ID NO: 109699 - DNA, 20 bp, Artificial
  CRISPR gRNA sequence
taagtgtgaatatttcagtc

SEQ ID NO: 109700 - DNA, 20 bp, Artificial
  CRISPR gRNA sequence
taagtaatttctgtcaaaga

SEQ ID NO: 109701 - DNA, 20 bp, Artificial
  CRISPR gRNA sequence
tgaaaattttggactattcc

SEQ ID NO: 109702 - DNA, 20 bp, Artificial
  CRISPR gRNA sequence
gataaagctaaaataaccat

SEQ ID NO: 109703 - DNA, 20 bp, Artificial
  CRISPR gRNA sequence
ggatattatagaggccagtg

SEQ ID NO: 109704 - DNA, 20 bp, Artificial
  CRISPR gRNA sequence
cttttaagaaatctttagta

SEQ ID NO: 109705 - DNA, 20 bp, Artificial
  CRISPR gRNA sequence
gtttaaacaacaaacatatc

SEQ ID NO: 109706 - DNA, 20 bp, Artificial
  CRISPR gRNA sequence
acaaacatatctagaattca

SEQ ID NO: 109707 - DNA, 20 bp, Artificial
  CRISPR gRNA sequence
aattcacagagtaaaatgag

SEQ ID NO: 109708 - DNA, 20 bp, Artificial
  CRISPR gRNA sequence
ttgagagactgtagggaaaa

SEQ ID NO: 109709 - DNA, 20 bp, Artificial
  CRISPR gRNA sequence
ctgcttgctacccagcctcc

SEQ ID NO: 109710 - DNA, 20 bp, Artificial
  CRISPR gRNA sequence
ccagcctcctagagtcattg

SEQ ID NO: 109711 - DNA, 20 bp, Artificial
  CRISPR gRNA sequence
tttaccttcttcactttatt

SEQ ID NO: 109712 - DNA, 20 bp, Artificial
  CRISPR gRNA sequence
gccttcactacagaccattc

SEQ ID NO: 109713 - DNA, 20 bp, Artificial
  CRISPR gRNA sequence
attatgattaaatgtttgtc

SEQ ID NO: 109714 - DNA, 20 bp, Artificial
  CRISPR gRNA sequence
attgagacttctcaaagact

SEQ ID NO: 109715 - DNA, 20 bp, Artificial
  CRISPR gRNA sequence
ttgagcttggcatttagtaa

SEQ ID NO: 109716 - DNA, 20 bp, Artificial
  CRISPR gRNA sequence
ttccttttctagcaaggcag

SEQ ID NO: 109717 - DNA, 20 bp, Artificial
  CRISPR gRNA sequence
aagtacctgtttctggaaca

SEQ ID NO: 109718 - DNA, 20 bp, Artificial
  CRISPR gRNA sequence
gaacacagggtttgcagcaa

SEQ ID NO: 109719 - DNA, 20 bp, Artificial
  CRISPR gRNA sequence
atatcagaggagaggtttca

SEQ ID NO: 109720 - DNA, 20 bp, Artificial
  CRISPR gRNA sequence
ctaagatattaggcatgatc

SEQ ID NO: 109721 - DNA, 20 bp, Artificial
  CRISPR gRNA sequence
tgtaaagtatatgaagaggt

SEQ ID NO: 109722 - DNA, 20 bp, Artificial
  CRISPR gRNA sequence
ttattttaaaagaaacaaaa

SEQ ID NO: 109723 - DNA, 20 bp, Artificial
  CRISPR gRNA sequence
aataacaaaacgagcaaaaa

SEQ ID NO: 109724 - DNA, 20 bp, Artificial
  CRISPR gRNA sequence
gtagaaaactgacgtataga

SEQ ID NO: 109725 - DNA, 20 bp, Artificial
  CRISPR gRNA sequence
acttggggaggccaaggcag

SEQ ID NO: 109726 - DNA, 20 bp, Artificial
  CRISPR gRNA sequence
caggtggatcacttgaggcc

SEQ ID NO: 109727 - DNA, 20 bp, Artificial
  CRISPR gRNA sequence
cctgtaatcccagctacttg

SEQ ID NO: 109728 - DNA, 20 bp, Artificial
  CRISPR gRNA sequence
aaagtcattatatccactgt

SEQ ID NO: 109729 - DNA, 20 bp, Artificial
  CRISPR gRNA sequence
tcattatatccactgttagg

SEQ ID NO: 109730 - DNA, 20 bp, Artificial
  CRISPR gRNA sequence
ttaggatggatgtggagaaa

SEQ ID NO: 109731 - DNA, 20 bp, Artificial
  CRISPR gRNA sequence
tttttggtaatttaaaactg

SEQ ID NO: 109732 - DNA, 20 bp, Artificial
  CRISPR gRNA sequence
ctcactatctgttaaataca

SEQ ID NO: 109733 - DNA, 20 bp, Artificial
  CRISPR gRNA sequence
gagctagcagtcccacttct

SEQ ID NO: 109734 - DNA, 20 bp, Artificial
  CRISPR gRNA sequence
gcaaaaaataaaattgcaat

SEQ ID NO: 109735 - DNA, 20 bp, Artificial
  CRISPR gRNA sequence
caatctgagtgtccattaat

SEQ ID NO: 109736 - DNA, 20 bp, Artificial
  CRISPR gRNA sequence
aataagaataaggaaatggt

SEQ ID NO: 109737 - DNA, 20 bp, Artificial
  CRISPR gRNA sequence
taaatcataatatattcata

SEQ ID NO: 109738 - DNA, 20 bp, Artificial
  CRISPR gRNA sequence
aaagaaatgaactgttgact

SEQ ID NO: 109739 - DNA, 20 bp, Artificial
  CRISPR gRNA sequence
aaatgaactgttgacttggg

SEQ ID NO: 109740 - DNA, 20 bp, Artificial
  CRISPR gRNA sequence
taattcataaccaacccccc

SEQ ID NO: 109741 - DNA, 20 bp, Artificial
  CRISPR gRNA sequence
atgtttatagtcatggaaaa

SEQ ID NO: 109742 - DNA, 20 bp, Artificial
  CRISPR gRNA sequence
ttaatgtcttagttttctgg

SEQ ID NO: 109743 - DNA, 20 bp, Artificial
  CRISPR gRNA sequence
gcataattgtaccatgcatg

SEQ ID NO: 109744 - DNA, 20 bp, Artificial
  CRISPR gRNA sequence
cataatgttcagtcaacttg

SEQ ID NO: 109745 - DNA, 20 bp, Artificial
  CRISPR gRNA sequence
gttcagtcaacttgatgaat

SEQ ID NO: 109746 - DNA, 20 bp, Artificial
  CRISPR gRNA sequence
ctaatttataaaatatagtt

SEQ ID NO: 109747 - DNA, 20 bp, Artificial
  CRISPR gRNA sequence
acgatagttttatttttcaa

SEQ ID NO: 109748 - DNA, 20 bp, Artificial
  CRISPR gRNA sequence
ttatttttcaactgaattct

SEQ ID NO: 109749 - DNA, 20 bp, Artificial
  CRISPR gRNA sequence
gaattctcaggataatttct

SEQ ID NO: 109750 - DNA, 20 bp, Artificial
  CRISPR gRNA sequence
caggataatttctttggatt

SEQ ID NO: 109751 - DNA, 20 bp, Artificial
  CRISPR gRNA sequence
ttctttggattggggattgc

SEQ ID NO: 109752 - DNA, 20 bp, Artificial
  CRISPR gRNA sequence
gattggggattgcttgggta

SEQ ID NO: 109753 - DNA, 20 bp, Artificial
  CRISPR gRNA sequence
ggattgcttgggtaaagggt

SEQ ID NO: 109754 - DNA, 20 bp, Artificial
  CRISPR gRNA sequence
ctggcatatttttgccaaga

SEQ ID NO: 109755 - DNA, 20 bp, Artificial
  CRISPR gRNA sequence
tgccaagatagaattgtact

SEQ ID NO: 109756 - DNA, 20 bp, Artificial
  CRISPR gRNA sequence
ttgctgcgccttctccactg

SEQ ID NO: 109757 - DNA, 20 bp, Artificial
  CRISPR gRNA sequence
atagttaggaacagtatact

SEQ ID NO: 109758 - DNA, 20 bp, Artificial
  CRISPR gRNA sequence
aatttatatgagatgatatc

SEQ ID NO: 109759 - DNA, 20 bp, Artificial
  CRISPR gRNA sequence
tctaaattctgtgattttta

SEQ ID NO: 109760 - DNA, 20 bp, Artificial
  CRISPR gRNA sequence
ggctttaatcccctttgtat

SEQ ID NO: 109761 - DNA, 20 bp, Artificial
  CRISPR gRNA sequence
agttttttttctcattagtg

SEQ ID NO: 109762 - DNA, 20 bp, Artificial
  CRISPR gRNA sequence
agactacttcttaacctttt

SEQ ID NO: 109763 - DNA, 20 bp, Artificial
  CRISPR gRNA sequence
ttgaattgtattctctattt

SEQ ID NO: 109764 - DNA, 20 bp, Artificial
  CRISPR gRNA sequence
gacagccaagaaatagatag

SEQ ID NO: 109765 - DNA, 20 bp, Artificial
  CRISPR gRNA sequence
tatcaatgaagaaatggctg

SEQ ID NO: 109766 - DNA, 20 bp, Artificial
  CRISPR gRNA sequence
ttttaaaaaatatttgctag

SEQ ID NO: 109767 - DNA, 20 bp, Artificial
  CRISPR gRNA sequence
gaaaattcaaaagaaaatat

SEQ ID NO: 109768 - DNA, 20 bp, Artificial
  CRISPR gRNA sequence
agaatttttatgctatagag

SEQ ID NO: 109769 - DNA, 20 bp, Artificial
  CRISPR gRNA sequence
gatatttttaatacatacaa

SEQ ID NO: 109770 - DNA, 20 bp, Artificial
  CRISPR gRNA sequence
catacaaccgagtttgtatt

SEQ ID NO: 109771 - DNA, 20 bp, Artificial
  CRISPR gRNA sequence
caaaaataggaaaatgggcg

SEQ ID NO: 109772 - DNA, 20 bp, Artificial
  CRISPR gRNA sequence
taggaaaatgggcgaagaat

SEQ ID NO: 109773 - DNA, 20 bp, Artificial
  CRISPR gRNA sequence
tatttatttgccaatacttt

SEQ ID NO: 109774 - DNA, 20 bp, Artificial
  CRISPR gRNA sequence
ttctgaatgccaattatgag

SEQ ID NO: 109775 - DNA, 20 bp, Artificial
  CRISPR gRNA sequence
caatctatcccctaacaaag

SEQ ID NO: 109776 - DNA, 20 bp, Artificial
  CRISPR gRNA sequence
cccctaacaaagtaggatcc

SEQ ID NO: 109777 - DNA, 20 bp, Artificial
  CRISPR gRNA sequence
ggtggtcccaagttgaaatt

SEQ ID NO: 109778 - DNA, 20 bp, Artificial
  CRISPR gRNA sequence
aaataaaaaaagtttgttga

SEQ ID NO: 109779 - DNA, 20 bp, Artificial
  CRISPR gRNA sequence
tttaagtttgggaggtattc

SEQ ID NO: 109780 - DNA, 20 bp, Artificial
  CRISPR gRNA sequence
gttcactagttatatgaaaa

SEQ ID NO: 109781 - DNA, 20 bp, Artificial
  CRISPR gRNA sequence
ttttgtacacccaacattta

SEQ ID NO: 109782 - DNA, 20 bp, Artificial
  CRISPR gRNA sequence
aaaaaagaaagaagatagat

SEQ ID NO: 109783 - DNA, 20 bp, Artificial
  CRISPR gRNA sequence
gacaaacattaatgacagta

SEQ ID NO: 109784 - DNA, 20 bp, Artificial
  CRISPR gRNA sequence
ggtaattggaaactaatagg

SEQ ID NO: 109785 - DNA, 20 bp, Artificial
  CRISPR gRNA sequence
acacctgtaatcccagcact

SEQ ID NO: 109786 - DNA, 20 bp, Artificial
  CRISPR gRNA sequence
cagcactttgggtggccgag

SEQ ID NO: 109787 - DNA, 20 bp, Artificial
  CRISPR gRNA sequence
actttgggtggccgaggcgg

SEQ ID NO: 109788 - DNA, 20 bp, Artificial
  CRISPR gRNA sequence
tactcgggaggctgaggcag

SEQ ID NO: 109789 - DNA, 20 bp, Artificial
  CRISPR gRNA sequence
aaatttattttatagtttct

SEQ ID NO: 109790 - DNA, 20 bp, Artificial
  CRISPR gRNA sequence
ttttatagtttctgtgagtt

SEQ ID NO: 109791 - DNA, 20 bp, Artificial
  CRISPR gRNA sequence
ggaatcctgacacagctgtg

SEQ ID NO: 109792 - DNA, 20 bp, Artificial
  CRISPR gRNA sequence
gggctgcagtcacatttgac

SEQ ID NO: 109793 - DNA, 20 bp, Artificial
  CRISPR gRNA sequence
gcagtcacatttgactagag

SEQ ID NO: 109794 - DNA, 20 bp, Artificial
  CRISPR gRNA sequence
tgactagagtagaatacatt

SEQ ID NO: 109795 - DNA, 20 bp, Artificial
  CRISPR gRNA sequence
actcgctctgttgcctaggc

SEQ ID NO: 109796 - DNA, 20 bp, Artificial
  CRISPR gRNA sequence
ctaggctggaatgcagtggt

SEQ ID NO: 109797 - DNA, 20 bp, Artificial
  CRISPR gRNA sequence
acaggcatgtcctaccatgc

SEQ ID NO: 109798 - DNA, 20 bp, Artificial
  CRISPR gRNA sequence
tttgtatttttcagtagata

SEQ ID NO: 109799 - DNA, 20 bp, Artificial
  CRISPR gRNA sequence
gcctcagcctcctgaagtgc

SEQ ID NO: 109800 - DNA, 20 bp, Artificial
  CRISPR gRNA sequence
aaaataataataaagcactt

SEQ ID NO: 109801 - DNA, 20 bp, Artificial
  CRISPR gRNA sequence
atttttttatttttttgaga

SEQ ID NO: 109802 - DNA, 20 bp, Artificial
  CRISPR gRNA sequence
tctcgctctgtcgcccaggc

SEQ ID NO: 109803 - DNA, 20 bp, Artificial
  CRISPR gRNA sequence
gcctcagtctcccaagtagc

SEQ ID NO: 109804 - DNA, 20 bp, Artificial
  CRISPR gRNA sequence
ctttgtatttttagtagaga

SEQ ID NO: 109805 - DNA, 20 bp, Artificial
  CRISPR gRNA sequence
acctcggccttccaaagtgc

SEQ ID NO: 109806 - DNA, 20 bp, Artificial
  CRISPR gRNA sequence
gtgagccaccacacccagcc

SEQ ID NO: 109807 - DNA, 20 bp, Artificial
  CRISPR gRNA sequence
tttctgctttctagagaaat

SEQ ID NO: 109808 - DNA, 20 bp, Artificial
  CRISPR gRNA sequence
ccaaaggagaccagtgtcag

SEQ ID NO: 109809 - DNA, 20 bp, Artificial
  CRISPR gRNA sequence
cacctggacagatccagatc

SEQ ID NO: 109810 - DNA, 20 bp, Artificial
  CRISPR gRNA sequence
caggagcaaaactgatttgg

SEQ ID NO: 109811 - DNA, 20 bp, Artificial
  CRISPR gRNA sequence
gatttggaagagtcagataa

SEQ ID NO: 109812 - DNA, 20 bp, Artificial
  CRISPR gRNA sequence
atagcatgtatagtagaaaa

SEQ ID NO: 109813 - DNA, 20 bp, Artificial
  CRISPR gRNA sequence
ctactcgggaggctgaggca

SEQ ID NO: 109814 - DNA, 20 bp, Artificial
  CRISPR gRNA sequence
actgcactccagcctggcga

SEQ ID NO: 109815 - DNA, 20 bp, Artificial
  CRISPR gRNA sequence
tcgttctttgttagtatctt

SEQ ID NO: 109816 - DNA, 20 bp, Artificial
  CRISPR gRNA sequence
gttagtatctttgggatctg

SEQ ID NO: 109817 - DNA, 20 bp, Artificial
  CRISPR gRNA sequence
ccttagacaactgacatctt

SEQ ID NO: 109818 - DNA, 20 bp, Artificial
  CRISPR gRNA sequence
acaactgacatctttagaat

SEQ ID NO: 109819 - DNA, 20 bp, Artificial
  CRISPR gRNA sequence
tctatagtggttgctaatct

SEQ ID NO: 109820 - DNA, 20 bp, Artificial
  CRISPR gRNA sequence
gaagaagtgtttctaaacag

SEQ ID NO: 109821 - DNA, 20 bp, Artificial
  CRISPR gRNA sequence
taaacagaagaatagaaata

SEQ ID NO: 109822 - DNA, 20 bp, Artificial
  CRISPR gRNA sequence
atcaaaaatcaagttggctt

SEQ ID NO: 109823 - DNA, 20 bp, Artificial
  CRISPR gRNA sequence
attgctgcttatgttttttt

SEQ ID NO: 109824 - DNA, 20 bp, Artificial
  CRISPR gRNA sequence
tatacagcacttttactaag

SEQ ID NO: 109825 - DNA, 20 bp, Artificial
  CRISPR gRNA sequence
ccctcatggaagtatgttct

SEQ ID NO: 109826 - DNA, 20 bp, Artificial
  CRISPR gRNA sequence
tagatgtttggtctgggagg

SEQ ID NO: 109827 - DNA, 20 bp, Artificial
  CRISPR gRNA sequence
gattgcaaatttgcaatata

SEQ ID NO: 109828 - DNA, 20 bp, Artificial
  CRISPR gRNA sequence
tttgcaatatacaggatcca

SEQ ID NO: 109829 - DNA, 20 bp, Artificial
  CRISPR gRNA sequence
tactccagggaggccctgaa

SEQ ID NO: 109830 - DNA, 20 bp, Artificial
  CRISPR gRNA sequence
agcccaggcaagagctcaaa

SEQ ID NO: 109831 - DNA, 20 bp, Artificial
  CRISPR gRNA sequence
ctattgatagtctggggact

SEQ ID NO: 109832 - DNA, 20 bp, Artificial
  CRISPR gRNA sequence
ttcaccttttgaaaactgct

SEQ ID NO: 109833 - DNA, 20 bp, Artificial
  CRISPR gRNA sequence
cttttgaaaactgctaagga

SEQ ID NO: 109834 - DNA, 20 bp, Artificial
  CRISPR gRNA sequence
actgggacctagacagttaa

SEQ ID NO: 109835 - DNA, 20 bp, Artificial
  CRISPR gRNA sequence
tatatagcacaccacagtgg

SEQ ID NO: 109836 - DNA, 20 bp, Artificial
  CRISPR gRNA sequence
tgtttttcagtgtgttttgc

SEQ ID NO: 109837 - DNA, 20 bp, Artificial
  CRISPR gRNA sequence
agtgtgttttgccaggatcg

SEQ ID NO: 109838 - DNA, 20 bp, Artificial
  CRISPR gRNA sequence
ggcaatgtggtcaattcagg

SEQ ID NO: 109839 - DNA, 20 bp, Artificial
  CRISPR gRNA sequence
aatttattatgttgacctct

SEQ ID NO: 109840 - DNA, 20 bp, Artificial
  CRISPR gRNA sequence
tagatgctggagataaagca

SEQ ID NO: 109841 - DNA, 20 bp, Artificial
  CRISPR gRNA sequence
atggataaatagtgatttta

SEQ ID NO: 109842 - DNA, 20 bp, Artificial
  CRISPR gRNA sequence
tgattttatggaattctttt

SEQ ID NO: 109843 - DNA, 20 bp, Artificial
  CRISPR gRNA sequence
ttcagaattcaaataacgaa

SEQ ID NO: 109844 - DNA, 20 bp, Artificial
  CRISPR gRNA sequence
tattgggaagataggaagat

SEQ ID NO: 109845 - DNA, 20 bp, Artificial
  CRISPR gRNA sequence
taaatcctcatatgtcaaaa

SEQ ID NO: 109846 - DNA, 20 bp, Artificial
  CRISPR gRNA sequence
gatgttaaaatgcataaatt

SEQ ID NO: 109847 - DNA, 20 bp, Artificial
  CRISPR gRNA sequence
ttaaaatgcataaattaaga

SEQ ID NO: 109848 - DNA, 20 bp, Artificial
  CRISPR gRNA sequence
tacttgggaggctaatccag

SEQ ID NO: 109849 - DNA, 20 bp, Artificial
  CRISPR gRNA sequence
caggaggatggcttaagtcc

SEQ ID NO: 109850 - DNA, 20 bp, Artificial
  CRISPR gRNA sequence
tgtagagagacctcgtttct

SEQ ID NO: 109851 - DNA, 20 bp, Artificial
  CRISPR gRNA sequence
agagacctcgtttctacgaa

SEQ ID NO: 109852 - DNA, 20 bp, Artificial
  CRISPR gRNA sequence
ttgtatttgggaaagagctg

SEQ ID NO: 109853 - DNA, 20 bp, Artificial
  CRISPR gRNA sequence
tggtgttttttaagaaaaat

SEQ ID NO: 109854 - DNA, 20 bp, Artificial
  CRISPR gRNA sequence
ttttttaagaaaaattagga

SEQ ID NO: 109855 - DNA, 20 bp, Artificial
  CRISPR gRNA sequence
cagcagaaatatctagagcc

SEQ ID NO: 109856 - DNA, 20 bp, Artificial
  CRISPR gRNA sequence
atctagagccatgggtggac

SEQ ID NO: 109857 - DNA, 20 bp, Artificial
  CRISPR gRNA sequence
ggcatggttatatagtttct

SEQ ID NO: 109858 - DNA, 20 bp, Artificial
  CRISPR gRNA sequence
atagtttctcagagtggcac

SEQ ID NO: 109859 - DNA, 20 bp, Artificial
  CRISPR gRNA sequence
tctcctatgacacagtcatc

SEQ ID NO: 109860 - DNA, 20 bp, Artificial
  CRISPR gRNA sequence
tctttagtataaatttctcc

SEQ ID NO: 109861 - DNA, 20 bp, Artificial
  CRISPR gRNA sequence
ttgtggcatttacaaaaaaa

SEQ ID NO: 109862 - DNA, 20 bp, Artificial
  CRISPR gRNA sequence
ggctctgtgcctgctatcca

SEQ ID NO: 109863 - DNA, 20 bp, Artificial
  CRISPR gRNA sequence
ttgaagaagagcctctctac

SEQ ID NO: 109864 - DNA, 20 bp, Artificial
  CRISPR gRNA sequence
gggaaaattccaaaggagag

SEQ ID NO: 109865 - DNA, 20 bp, Artificial
  CRISPR gRNA sequence
agggtatgtataacattggg

SEQ ID NO: 109866 - DNA, 20 bp, Artificial
  CRISPR gRNA sequence
ttgggaaggatataggaaag

SEQ ID NO: 109867 - DNA, 20 bp, Artificial
  CRISPR gRNA sequence
gatataggaaaggagaatag

SEQ ID NO: 109868 - DNA, 20 bp, Artificial
  CRISPR gRNA sequence
atacttgttgtctcttttgt

SEQ ID NO: 109869 - DNA, 20 bp, Artificial
  CRISPR gRNA sequence
tcttgctctgtcatccaggc

SEQ ID NO: 109870 - DNA, 20 bp, Artificial
  CRISPR gRNA sequence
gattctcctgcctcagcctc

SEQ ID NO: 109871 - DNA, 20 bp, Artificial
  CRISPR gRNA sequence
gcctcagcctcctgagtagc

SEQ ID NO: 109872 - DNA, 20 bp, Artificial
  CRISPR gRNA sequence
ttttgtgtttttagtagaga

SEQ ID NO: 109873 - DNA, 20 bp, Artificial
  CRISPR gRNA sequence
gcctgggcctcccaaagtgc

SEQ ID NO: 109874 - DNA, 20 bp, Artificial
  CRISPR gRNA sequence
gttgtgtaccttccactagc

SEQ ID NO: 109875 - DNA, 20 bp, Artificial
  CRISPR gRNA sequence
tacttggaaggcagaggcag

SEQ ID NO: 109876 - DNA, 20 bp, Artificial
  CRISPR gRNA sequence
caggaggatcacatgagccg

SEQ ID NO: 109877 - DNA, 20 bp, Artificial
  CRISPR gRNA sequence
tgccactgcagtccaacagc

SEQ ID NO: 109878 - DNA, 20 bp, Artificial
  CRISPR gRNA sequence
cagtccaacagcaagggtgt

SEQ ID NO: 109879 - DNA, 20 bp, Artificial
  CRISPR gRNA sequence
cccagctgtcttaaactttg

SEQ ID NO: 109880 - DNA, 20 bp, Artificial
  CRISPR gRNA sequence
ctgtcttaaactttggagaa

SEQ ID NO: 109881 - DNA, 20 bp, Artificial
  CRISPR gRNA sequence
actagataactgtgctggtt

SEQ ID NO: 109882 - DNA, 20 bp, Artificial
  CRISPR gRNA sequence
ctcgttttagaaatacctgc

SEQ ID NO: 109883 - DNA, 20 bp, Artificial
  CRISPR gRNA sequence
gatttttctctccaaaggaa

SEQ ID NO: 109884 - DNA, 20 bp, Artificial
  CRISPR gRNA sequence
ctttattaccttgtattgac

SEQ ID NO: 109885 - DNA, 20 bp, Artificial
  CRISPR gRNA sequence
gactactcacattctctaaa

SEQ ID NO: 109886 - DNA, 20 bp, Artificial
  CRISPR gRNA sequence
ggaggctgaggtgggaagcc

SEQ ID NO: 109887 - DNA, 20 bp, Artificial
  CRISPR gRNA sequence
cctgtagtcccagctacttg

SEQ ID NO: 109888 - DNA, 20 bp, Artificial
  CRISPR gRNA sequence
taccccatcacaaatataat

SEQ ID NO: 109889 - DNA, 20 bp, Artificial
  CRISPR gRNA sequence
tcattggtctacttcctgcc

SEQ ID NO: 109890 - DNA, 20 bp, Artificial
  CRISPR gRNA sequence
ctgccacgggtctttgtcct

SEQ ID NO: 109891 - DNA, 20 bp, Artificial
  CRISPR gRNA sequence
tatctccctatctgttaggt

SEQ ID NO: 109892 - DNA, 20 bp, Artificial
  CRISPR gRNA sequence
gtttaattaaataccctatc

SEQ ID NO: 109893 - DNA, 20 bp, Artificial
  CRISPR gRNA sequence
gatcctcccactttaggctc

SEQ ID NO: 109894 - DNA, 20 bp, Artificial
  CRISPR gRNA sequence
ttttaaattttttgtagaaa

SEQ ID NO: 109895 - DNA, 20 bp, Artificial
  CRISPR gRNA sequence
gccttggcctcccaaagtgc

SEQ ID NO: 109896 - DNA, 20 bp, Artificial
  CRISPR gRNA sequence
gtgtaataatatttaagttg

SEQ ID NO: 109897 - DNA, 20 bp, Artificial
  CRISPR gRNA sequence
actagactgtaagttgtata

SEQ ID NO: 109898 - DNA, 20 bp, Artificial
  CRISPR gRNA sequence
tgtaagttgtatagagggta

SEQ ID NO: 109899 - DNA, 20 bp, Artificial
  CRISPR gRNA sequence
tactgacttagatgtatttg

SEQ ID NO: 109900 - DNA, 20 bp, Artificial
  CRISPR gRNA sequence
aaccaagcaatcagtgtttc

SEQ ID NO: 109901 - DNA, 20 bp, Artificial
  CRISPR gRNA sequence
aacctgccagtccccaggtc

SEQ ID NO: 109902 - DNA, 20 bp, Artificial
  CRISPR gRNA sequence
ctattcattcataacggtgt

SEQ ID NO: 109903 - DNA, 20 bp, Artificial
  CRISPR gRNA sequence
ttttatttttatctgtaaag

SEQ ID NO: 109904 - DNA, 20 bp, Artificial
  CRISPR gRNA sequence
atacttcacagcaatgttgt

SEQ ID NO: 109905 - DNA, 20 bp, Artificial
  CRISPR gRNA sequence
agcaccatacctagtgcatg

SEQ ID NO: 109906 - DNA, 20 bp, Artificial
  CRISPR gRNA sequence
ggaactaaaggtggttcttg

SEQ ID NO: 109907 - DNA, 20 bp, Artificial
  CRISPR gRNA sequence
gagtgttgcaaaaagcttcc

SEQ ID NO: 109908 - DNA, 20 bp, Artificial
  CRISPR gRNA sequence
cttaagtgagaaacagcata

SEQ ID NO: 109909 - DNA, 20 bp, Artificial
  CRISPR gRNA sequence
tagtggaaagaagatgaaat

SEQ ID NO: 109910 - DNA, 20 bp, Artificial
  CRISPR gRNA sequence
aaatgggagtcaggagattt

SEQ ID NO: 109911 - DNA, 20 bp, Artificial
  CRISPR gRNA sequence
ccttcagatttatctgtaaa

SEQ ID NO: 109912 - DNA, 20 bp, Artificial
  CRISPR gRNA sequence
tacagcatgacatggtttct

SEQ ID NO: 109913 - DNA, 20 bp, Artificial
  CRISPR gRNA sequence
tgggtcttttccttagacac

SEQ ID NO: 109914 - DNA, 20 bp, Artificial
  CRISPR gRNA sequence
ttttccttagacacctgaat

SEQ ID NO: 109915 - DNA, 20 bp, Artificial
  CRISPR gRNA sequence
agccctgcagtgtttcacca

SEQ ID NO: 109916 - DNA, 20 bp, Artificial
  CRISPR gRNA sequence
gccagactttaaattatttt

SEQ ID NO: 109917 - DNA, 20 bp, Artificial
  CRISPR gRNA sequence
agttatgtgtattctcttgg

SEQ ID NO: 109918 - DNA, 20 bp, Artificial
  CRISPR gRNA sequence
ggggataagtagtgagagcc

SEQ ID NO: 109919 - DNA, 20 bp, Artificial
  CRISPR gRNA sequence
catcatgtcatctttgtctc

SEQ ID NO: 109920 - DNA, 20 bp, Artificial
  CRISPR gRNA sequence
gaagcaatgacacagatcat

SEQ ID NO: 109921 - DNA, 20 bp, Artificial
  CRISPR gRNA sequence
gttgatgacattgacatttc

SEQ ID NO: 109922 - DNA, 20 bp, Artificial
  CRISPR gRNA sequence
gacattgacatttcatggat

SEQ ID NO: 109923 - DNA, 20 bp, Artificial
  CRISPR gRNA sequence
cagcagcccactccttccca

SEQ ID NO: 109924 - DNA, 20 bp, Artificial
  CRISPR gRNA sequence
agcatttatccctctggtgg

SEQ ID NO: 109925 - DNA, 20 bp, Artificial
  CRISPR gRNA sequence
gggaatctcacactgactaa

SEQ ID NO: 109926 - DNA, 20 bp, Artificial
  CRISPR gRNA sequence
ttccaatctgtggtaataat

SEQ ID NO: 109927 - DNA, 20 bp, Artificial
  CRISPR gRNA sequence
gccaagaaaaagctaattct

SEQ ID NO: 109928 - DNA, 20 bp, Artificial
  CRISPR gRNA sequence
gaaaaagctaattctgggga

SEQ ID NO: 109929 - DNA, 20 bp, Artificial
  CRISPR gRNA sequence
agcactaaaaatatacattg

SEQ ID NO: 109930 - DNA, 20 bp, Artificial
  CRISPR gRNA sequence
gctacttctaagacaatgta

SEQ ID NO: 109931 - DNA, 20 bp, Artificial
  CRISPR gRNA sequence
tgtgtttcagcctagtggga

SEQ ID NO: 109932 - DNA, 20 bp, Artificial
  CRISPR gRNA sequence
tcatagagcacgattctcca

SEQ ID NO: 109933 - DNA, 20 bp, Artificial
  CRISPR gRNA sequence
agagcacgattctccagtgg

SEQ ID NO: 109934 - DNA, 20 bp, Artificial
  CRISPR gRNA sequence
ttctccagtggatggatacc

SEQ ID NO: 109935 - DNA, 20 bp, Artificial
  CRISPR gRNA sequence
ccagtggatggatacctgga

SEQ ID NO: 109936 - DNA, 20 bp, Artificial
  CRISPR gRNA sequence
gaatggatcattaagatgaa

SEQ ID NO: 109937 - DNA, 20 bp, Artificial
  CRISPR gRNA sequence
gtcagtcacactgtcctgga

SEQ ID NO: 109938 - DNA, 20 bp, Artificial
  CRISPR gRNA sequence
gttacccactaaagcttgag

SEQ ID NO: 109939 - DNA, 20 bp, Artificial
  CRISPR gRNA sequence
tctcattgcatccatactgt

SEQ ID NO: 109940 - DNA, 20 bp, Artificial
  CRISPR gRNA sequence
gactgaaagaaacatgcctg

SEQ ID NO: 109941 - DNA, 20 bp, Artificial
  CRISPR gRNA sequence
actgggccactgttcccaga

SEQ ID NO: 109942 - DNA, 20 bp, Artificial
  CRISPR gRNA sequence
gaactaagatgatatttcag

SEQ ID NO: 109943 - DNA, 20 bp, Artificial
  CRISPR gRNA sequence
caataattccgaggaacatt

SEQ ID NO: 109944 - DNA, 20 bp, Artificial
  CRISPR gRNA sequence
aacattgggggttaaatacc

SEQ ID NO: 109945 - DNA, 20 bp, Artificial
  CRISPR gRNA sequence
agtgaaatattcctagtccc

SEQ ID NO: 109946 - DNA, 20 bp, Artificial
  CRISPR gRNA sequence
ctagaaacttctagctctac

SEQ ID NO: 109947 - DNA, 20 bp, Artificial
  CRISPR gRNA sequence
cttctagctctacaagagtt

SEQ ID NO: 109948 - DNA, 20 bp, Artificial
  CRISPR gRNA sequence
agtaagtcccaagtttttca

SEQ ID NO: 109949 - DNA, 20 bp, Artificial
  CRISPR gRNA sequence
agaatagattactaacaatg

SEQ ID NO: 109950 - DNA, 20 bp, Artificial
  CRISPR gRNA sequence
ttatattccttggttaattt

SEQ ID NO: 109951 - DNA, 20 bp, Artificial
  CRISPR gRNA sequence
taatttaggagtctaagatg

SEQ ID NO: 109952 - DNA, 20 bp, Artificial
  CRISPR gRNA sequence
gaaattactcagacctaact

SEQ ID NO: 109953 - DNA, 20 bp, Artificial
  CRISPR gRNA sequence
tagtaatgccagccttgttg

SEQ ID NO: 109954 - DNA, 20 bp, Artificial
  CRISPR gRNA sequence
ttatttggggggagatgact

SEQ ID NO: 109955 - DNA, 20 bp, Artificial
  CRISPR gRNA sequence
agtagcccacaaagtggggg

SEQ ID NO: 109956 - DNA, 20 bp, Artificial
  CRISPR gRNA sequence
tgggggcagggtattgacat

SEQ ID NO: 109957 - DNA, 20 bp, Artificial
  CRISPR gRNA sequence
gataactttacagatggaga

SEQ ID NO: 109958 - DNA, 20 bp, Artificial
  CRISPR gRNA sequence
actttacagatggagaaaga

SEQ ID NO: 109959 - DNA, 20 bp, Artificial
  CRISPR gRNA sequence
tacagatggagaaagagtga

SEQ ID NO: 109960 - DNA, 20 bp, Artificial
  CRISPR gRNA sequence
gatggagaaagagtgaatgg

SEQ ID NO: 109961 - DNA, 20 bp, Artificial
  CRISPR gRNA sequence
gagaaagagtgaatggatga

SEQ ID NO: 109962 - DNA, 20 bp, Artificial
  CRISPR gRNA sequence
ttaatgcctagttatgcaac

SEQ ID NO: 109963 - DNA, 20 bp, Artificial
  CRISPR gRNA sequence
agtgcttttttttttttttg

SEQ ID NO: 109964 - DNA, 20 bp, Artificial
  CRISPR gRNA sequence
aacagagcattttgtggcta

SEQ ID NO: 109965 - DNA, 20 bp, Artificial
  CRISPR gRNA sequence
ataatgtcttgatttttctt

SEQ ID NO: 109966 - DNA, 20 bp, Artificial
  CRISPR gRNA sequence
gaaaagtaatgtgacttttg

SEQ ID NO: 109967 - DNA, 20 bp, Artificial
  CRISPR gRNA sequence
ttttgaggaatctgcaactc

SEQ ID NO: 109968 - DNA, 20 bp, Artificial
  CRISPR gRNA sequence
aaaaacagccttaagtattg

SEQ ID NO: 109969 - DNA, 20 bp, Artificial
  CRISPR gRNA sequence
tgttttaccttacggtcgct

SEQ ID NO: 109970 - DNA, 20 bp, Artificial
  CRISPR gRNA sequence
tagctttagtcaaactgtgc

SEQ ID NO: 109971 - DNA, 20 bp, Artificial
  CRISPR gRNA sequence
ccggggaagtaggccccgct

SEQ ID NO: 109972 - DNA, 20 bp, Artificial
  CRISPR gRNA sequence
gttgtcccaaggaagcctgc

SEQ ID NO: 109973 - DNA, 20 bp, Artificial
  CRISPR gRNA sequence
cctccaatagagcctgctag

SEQ ID NO: 109974 - DNA, 20 bp, Artificial
  CRISPR gRNA sequence
actggtctttcggaagcctc

SEQ ID NO: 109975 - DNA, 20 bp, Artificial
  CRISPR gRNA sequence
tcctcctaggcgtccatgtg

SEQ ID NO: 109976 - DNA, 20 bp, Artificial
  CRISPR gRNA sequence
gcctgcgggagaggcggccg

SEQ ID NO: 109977 - DNA, 20 bp, Artificial
  CRISPR gRNA sequence
tgcggcttccttaggaaact

SEQ ID NO: 109978 - DNA, 20 bp, Artificial
  CRISPR gRNA sequence
tagcgtgggaggacatcttt

SEQ ID NO: 109979 - DNA, 20 bp, Artificial
  CRISPR gRNA sequence
tgaaattgaaactcagagga

SEQ ID NO: 109980 - DNA, 20 bp, Artificial
  CRISPR gRNA sequence
agctatctagcagccactcc

SEQ ID NO: 109981 - DNA, 20 bp, Artificial
  CRISPR gRNA sequence
acaaatacttactctgtgtc

SEQ ID NO: 109982 - DNA, 20 bp, Artificial
  CRISPR gRNA sequence
tctgtgtcagggatatgaag

SEQ ID NO: 109983 - DNA, 20 bp, Artificial
  CRISPR gRNA sequence
caggtgcctgtcctcactgt

SEQ ID NO: 109984 - DNA, 20 bp, Artificial
  CRISPR gRNA sequence
ttctctagccagacatgagg

SEQ ID NO: 109985 - DNA, 20 bp, Artificial
  CRISPR gRNA sequence
cccatagctaggcagcctaa

SEQ ID NO: 109986 - DNA, 20 bp, Artificial
  CRISPR gRNA sequence
ctccagctcttggaagcaga

SEQ ID NO: 109987 - DNA, 20 bp, Artificial
  CRISPR gRNA sequence
gaagcagagagggtggtcct

SEQ ID NO: 109988 - DNA, 20 bp, Artificial
  CRISPR gRNA sequence
ttctaagttacaccatgtta

SEQ ID NO: 109989 - DNA, 20 bp, Artificial
  CRISPR gRNA sequence
tacaccatgttaatggataa

SEQ ID NO: 109990 - DNA, 20 bp, Artificial
  CRISPR gRNA sequence
aaaggaattactcagcttga

SEQ ID NO: 109991 - DNA, 20 bp, Artificial
  CRISPR gRNA sequence
gagaaaggggccaaaaagtt

SEQ ID NO: 109992 - DNA, 20 bp, Artificial
  CRISPR gRNA sequence
gggccaaaaagtttaggatt

SEQ ID NO: 109993 - DNA, 20 bp, Artificial
  CRISPR gRNA sequence
gtaatttctgctttgttggt

SEQ ID NO: 109994 - DNA, 20 bp, Artificial
  CRISPR gRNA sequence
cattagtgacatcgtggagc

SEQ ID NO: 109995 - DNA, 20 bp, Artificial
  CRISPR gRNA sequence
tggagcgtgagtgatcattg

SEQ ID NO: 109996 - DNA, 20 bp, Artificial
  CRISPR gRNA sequence
aggtgtggtgctgggctcct

SEQ ID NO: 109997 - DNA, 20 bp, Artificial
  CRISPR gRNA sequence
gtactttaaaacaggtacca

SEQ ID NO: 109998 - DNA, 20 bp, Artificial
  CRISPR gRNA sequence
atattttgatcctgtgagga

SEQ ID NO: 109999 - DNA, 20 bp, Artificial
  CRISPR gRNA sequence
aaacacctattccttcctca

SEQ ID NO: 110000 - DNA, 20 bp, Artificial
  CRISPR gRNA sequence
agatgttttataaattttgt

SEQ ID NO: 110001 - DNA, 20 bp, Artificial
  CRISPR gRNA sequence
gagatacgttattgttagaa

SEQ ID NO: 110002 - DNA, 20 bp, Artificial
  CRISPR gRNA sequence
tcctgccccccctttgaaca

SEQ ID NO: 110003 - DNA, 20 bp, Artificial
  CRISPR gRNA sequence
ccctttgaacaatgagtcaa

SEQ ID NO: 110004 - DNA, 20 bp, Artificial
  CRISPR gRNA sequence
tgagtcaatagaatgtgaga

SEQ ID NO: 110005 - DNA, 20 bp, Artificial
  CRISPR gRNA sequence
gcaacttgaagaaaccaaag

SEQ ID NO: 110006 - DNA, 20 bp, Artificial
  CRISPR gRNA sequence
ccaaagatgaatgatgctaa

SEQ ID NO: 110007 - DNA, 20 bp, Artificial
  CRISPR gRNA sequence
tcacgttccgacttgtaggt

SEQ ID NO: 110008 - DNA, 20 bp, Artificial
  CRISPR gRNA sequence
aggaaacagatcccttcaag

SEQ ID NO: 110009 - DNA, 20 bp, Artificial
  CRISPR gRNA sequence
ggttggttgctgctgccact

SEQ ID NO: 110010 - DNA, 20 bp, Artificial
  CRISPR gRNA sequence
tgcctagctatgggaaacaa

SEQ ID NO: 110011 - DNA, 20 bp, Artificial
  CRISPR gRNA sequence
ccatcttcatatccctgaca

SEQ ID NO: 110012 - DNA, 20 bp, Artificial
  CRISPR gRNA sequence
tttgttaaatgaacgactcg

SEQ ID NO: 110013 - DNA, 20 bp, Artificial
  CRISPR gRNA sequence
atatacttatgacgccaaga

SEQ ID NO: 110014 - DNA, 20 bp, Artificial
  CRISPR gRNA sequence
gccaagaacgaattaactga

SEQ ID NO: 110015 - DNA, 20 bp, Artificial
  CRISPR gRNA sequence
aacgcttaatagaaaatgct

SEQ ID NO: 110016 - DNA, 20 bp, Artificial
  CRISPR gRNA sequence
aatgctcggggttgggaaaa

SEQ ID NO: 110017 - DNA, 20 bp, Artificial
  CRISPR gRNA sequence
tcctgtaaaaatcctttcct

SEQ ID NO: 110018 - DNA, 20 bp, Artificial
  CRISPR gRNA sequence
agtttcaatttcatcatctt

SEQ ID NO: 110019 - DNA, 20 bp, Artificial
  CRISPR gRNA sequence
cgccctgggccgtggcgagc

SEQ ID NO: 110020 - DNA, 20 bp, Artificial
  CRISPR gRNA sequence
gaggtctttccctcatacca

SEQ ID NO: 110021 - DNA, 20 bp, Artificial
  CRISPR gRNA sequence
ctttccctcataccacagag

SEQ ID NO: 110022 - DNA, 20 bp, Artificial
  CRISPR gRNA sequence
tcataccacagagtagaatc

SEQ ID NO: 110023 - DNA, 20 bp, Artificial
  CRISPR gRNA sequence
agtagaatcttgggtcatct

SEQ ID NO: 110024 - DNA, 20 bp, Artificial
  CRISPR gRNA sequence
agtgcttttccttcattgtg

SEQ ID NO: 110025 - DNA, 20 bp, Artificial
  CRISPR gRNA sequence
caggtctactgctctcatca

SEQ ID NO: 110026 - DNA, 20 bp, Artificial
  CRISPR gRNA sequence
agtaacaaggtgagcatgct

SEQ ID NO: 110027 - DNA, 20 bp, Artificial
  CRISPR gRNA sequence
ataacggctaattttcctca

SEQ ID NO: 110028 - DNA, 20 bp, Artificial
  CRISPR gRNA sequence
gacagaaaaaatctcctcaa

SEQ ID NO: 110029 - DNA, 20 bp, Artificial
  CRISPR gRNA sequence
ggaaacacaaactagaaccc

SEQ ID NO: 110030 - DNA, 20 bp, Artificial
  CRISPR gRNA sequence
gggaaaaaccttcgatatag

SEQ ID NO: 110031 - DNA, 20 bp, Artificial
  CRISPR gRNA sequence
cactacagtcacaaataaaa

SEQ ID NO: 110032 - DNA, 20 bp, Artificial
  CRISPR gRNA sequence
tgccaaagtgaccacaagaa

SEQ ID NO: 110033 - DNA, 20 bp, Artificial
  CRISPR gRNA sequence
ttaagcactcaaagttaggt

SEQ ID NO: 110034 - DNA, 20 bp, Artificial
  CRISPR gRNA sequence
ttagactcctaaattaacca

SEQ ID NO: 110035 - DNA, 20 bp, Artificial
  CRISPR gRNA sequence
tctgaaaaacttgggactta

SEQ ID NO: 110036 - DNA, 20 bp, Artificial
  CRISPR gRNA sequence
agtttctagtgagcttacca

SEQ ID NO: 110037 - DNA, 20 bp, Artificial
  CRISPR gRNA sequence
attaccagatccctgggact

SEQ ID NO: 110038 - DNA, 20 bp, Artificial
  CRISPR gRNA sequence
atttaacccccaatgttcct

SEQ ID NO: 110039 - DNA, 20 bp, Artificial
  CRISPR gRNA sequence
cccaatgttcctcggaatta

SEQ ID NO: 110040 - DNA, 20 bp, Artificial
  CRISPR gRNA sequence
aaatatcatcttagttctct

SEQ ID NO: 110041 - DNA, 20 bp, Artificial
  CRISPR gRNA sequence
ctgcagtttattctcacagt

SEQ ID NO: 110042 - DNA, 20 bp, Artificial
  CRISPR gRNA sequence
aaacatgaaaactggcacca

SEQ ID NO: 110043 - DNA, 20 bp, Artificial
  CRISPR gRNA sequence
aaagaatcagctgccatggg

SEQ ID NO: 110044 - DNA, 20 bp, Artificial
  CRISPR gRNA sequence
tagggccagcattgtgctgc

SEQ ID NO: 110045 - DNA, 20 bp, Artificial
  CRISPR gRNA sequence
aacatccacctcaagcttta

SEQ ID NO: 110046 - DNA, 20 bp, Artificial
  CRISPR gRNA sequence
agtgctttccagaaattgtc

SEQ ID NO: 110047 - DNA, 20 bp, Artificial
  CRISPR gRNA sequence
tcagtgcttgttaaaggttc

SEQ ID NO: 110048 - DNA, 20 bp, Artificial
  CRISPR gRNA sequence
ttaaaggttctagagtaaat

SEQ ID NO: 110049 - DNA, 20 bp, Artificial
  CRISPR gRNA sequence
ttccaggtatccatccactg

SEQ ID NO: 110050 - DNA, 20 bp, Artificial
  CRISPR gRNA sequence
atcgtgctctatgataacat

SEQ ID NO: 110051 - DNA, 20 bp, Artificial
  CRISPR gRNA sequence
ctcccactaggctgaaacac

SEQ ID NO: 110052 - DNA, 20 bp, Artificial
  CRISPR gRNA sequence
tctagtttggcccttccttt

SEQ ID NO: 110053 - DNA, 20 bp, Artificial
  CRISPR gRNA sequence
gtgcttcagcaaagaagttg

SEQ ID NO: 110054 - DNA, 20 bp, Artificial
  CRISPR gRNA sequence
gcaatgtatatttttagtgc

SEQ ID NO: 110055 - DNA, 20 bp, Artificial
  CRISPR gRNA sequence
gtcttttatcattctatccc

SEQ ID NO: 110056 - DNA, 20 bp, Artificial
  CRISPR gRNA sequence
agaattagctttttcttggc

SEQ ID NO: 110057 - DNA, 20 bp, Artificial
  CRISPR gRNA sequence
aacctaccatctgggcagag

SEQ ID NO: 110058 - DNA, 20 bp, Artificial
  CRISPR gRNA sequence
ttattattaccacagattgg

SEQ ID NO: 110059 - DNA, 20 bp, Artificial
  CRISPR gRNA sequence
agattggaagaatgtatctc

SEQ ID NO: 110060 - DNA, 20 bp, Artificial
  CRISPR gRNA sequence
tccttgcctggaagccatct

SEQ ID NO: 110061 - DNA, 20 bp, Artificial
  CRISPR gRNA sequence
gtgtgagattcccccaccag

SEQ ID NO: 110062 - DNA, 20 bp, Artificial
  CRISPR gRNA sequence
gctgtctagattccatggga

SEQ ID NO: 110063 - DNA, 20 bp, Artificial
  CRISPR gRNA sequence
gtaagtgctttgtgtactgc

SEQ ID NO: 110064 - DNA, 20 bp, Artificial
  CRISPR gRNA sequence
catgtgtctccttgcatcat

SEQ ID NO: 110065 - DNA, 20 bp, Artificial
  CRISPR gRNA sequence
ctgaaataggtcctgactga

SEQ ID NO: 110066 - DNA, 20 bp, Artificial
  CRISPR gRNA sequence
ttctgtcctgtagtaaaggg

SEQ ID NO: 110067 - DNA, 20 bp, Artificial
  CRISPR gRNA sequence
gatcatcaatgtcccattgg

SEQ ID NO: 110068 - DNA, 20 bp, Artificial
  CRISPR gRNA sequence
atcagctccatcacatggcg

SEQ ID NO: 110069 - DNA, 20 bp, Artificial
  CRISPR gRNA sequence
atggcgtggggttaggacac

SEQ ID NO: 110070 - DNA, 20 bp, Artificial
  CRISPR gRNA sequence
tgcttcttcatcggcttggt

SEQ ID NO: 110071 - DNA, 20 bp, Artificial
  CRISPR gRNA sequence
ctcactacttatccccccaa

SEQ ID NO: 110072 - DNA, 20 bp, Artificial
  CRISPR gRNA sequence
ttgtgttgttctctatactt

SEQ ID NO: 110073 - DNA, 20 bp, Artificial
  CRISPR gRNA sequence
gttctctatacttaagggtt

SEQ ID NO: 110074 - DNA, 20 bp, Artificial
  CRISPR gRNA sequence
ttttgatcatcatttaaata

SEQ ID NO: 110075 - DNA, 20 bp, Artificial
  CRISPR gRNA sequence
gagtacttagcagggctaga

SEQ ID NO: 110076 - DNA, 20 bp, Artificial
  CRISPR gRNA sequence
gcagggctagaaagaatcat

SEQ ID NO: 110077 - DNA, 20 bp, Artificial
  CRISPR gRNA sequence
cagataaatctgaaggccag

SEQ ID NO: 110078 - DNA, 20 bp, Artificial
  CRISPR gRNA sequence
gtaaagtgatttgcgtggac

SEQ ID NO: 110079 - DNA, 20 bp, Artificial
  CRISPR gRNA sequence
tgatttgcgtggactagggt

SEQ ID NO: 110080 - DNA, 20 bp, Artificial
  CRISPR gRNA sequence
agggtcagggtcagaaagtt

SEQ ID NO: 110081 - DNA, 20 bp, Artificial
  CRISPR gRNA sequence
aagacctaccgtgttaacac

SEQ ID NO: 110082 - DNA, 20 bp, Artificial
  CRISPR gRNA sequence
ggctctgaagccttggtagg

SEQ ID NO: 110083 - DNA, 20 bp, Artificial
  CRISPR gRNA sequence
ctggagatggaagactggaa

SEQ ID NO: 110084 - DNA, 20 bp, Artificial
  CRISPR gRNA sequence
gtgctacacagatgcctaat

SEQ ID NO: 110085 - DNA, 20 bp, Artificial
  CRISPR gRNA sequence
cagatgcctaatgtggatta

SEQ ID NO: 110086 - DNA, 20 bp, Artificial
  CRISPR gRNA sequence
acagataaaaataaaagagg

SEQ ID NO: 110087 - DNA, 20 bp, Artificial
  CRISPR gRNA sequence
aagatcatattgttagcaca

SEQ ID NO: 110088 - DNA, 20 bp, Artificial
  CRISPR gRNA sequence
ttgttagcacacagaatgag

SEQ ID NO: 110089 - DNA, 20 bp, Artificial
  CRISPR gRNA sequence
gcccacattcatacaccgtt

SEQ ID NO: 110090 - DNA, 20 bp, Artificial
  CRISPR gRNA sequence
acattcatacaccgttatga

SEQ ID NO: 110091 - DNA, 20 bp, Artificial
  CRISPR gRNA sequence
ggggctctcacactacaggt

SEQ ID NO: 110092 - DNA, 20 bp, Artificial
  CRISPR gRNA sequence
gtgaggattaatagcactga

SEQ ID NO: 110093 - DNA, 20 bp, Artificial
  CRISPR gRNA sequence
aaacctagtttgattgttga

SEQ ID NO: 110094 - DNA, 20 bp, Artificial
  CRISPR gRNA sequence
ggagactggagattaatttg

SEQ ID NO: 110095 - DNA, 20 bp, Artificial
  CRISPR gRNA sequence
ggatattgcaatagtgcaag

SEQ ID NO: 110096 - DNA, 20 bp, Artificial
  CRISPR gRNA sequence
agtggaatgtgatgttaata

SEQ ID NO: 110097 - DNA, 20 bp, Artificial
  CRISPR gRNA sequence
aatgtgatgttaatatagaa

SEQ ID NO: 110098 - DNA, 20 bp, Artificial
  CRISPR gRNA sequence
atggagtatcagcaaatggg

SEQ ID NO: 110099 - DNA, 20 bp, Artificial
  CRISPR gRNA sequence
actgattgcttggttcagaa

SEQ ID NO: 110100 - DNA, 20 bp, Artificial
  CRISPR gRNA sequence
ttaaatacaacttacttaaa

SEQ ID NO: 110101 - DNA, 20 bp, Artificial
  CRISPR gRNA sequence
actttgggaggccaaggcga

SEQ ID NO: 110102 - DNA, 20 bp, Artificial
  CRISPR gRNA sequence
cgagaggatcgcttgagcct

SEQ ID NO: 110103 - DNA, 20 bp, Artificial
  CRISPR gRNA sequence
tactcgggagcctaaagtgg

SEQ ID NO: 110104 - DNA, 20 bp, Artificial
  CRISPR gRNA sequence
gagaagagatctattctaga

SEQ ID NO: 110105 - DNA, 20 bp, Artificial
  CRISPR gRNA sequence
tgggcatagtagtaagcact

SEQ ID NO: 110106 - DNA, 20 bp, Artificial
  CRISPR gRNA sequence
cagtctaagtgcaaatggga

SEQ ID NO: 110107 - DNA, 20 bp, Artificial
  CRISPR gRNA sequence
aagtgcaaatgggaaagggt

SEQ ID NO: 110108 - DNA, 20 bp, Artificial
  CRISPR gRNA sequence
tgagcagaacagggacttga

SEQ ID NO: 110109 - DNA, 20 bp, Artificial
  CRISPR gRNA sequence
acattttaaaaagatcacac

SEQ ID NO: 110110 - DNA, 20 bp, Artificial
  CRISPR gRNA sequence
aaagatcacactaggatgtg

SEQ ID NO: 110111 - DNA, 20 bp, Artificial
  CRISPR gRNA sequence
taaatctaagccaaagaaga

SEQ ID NO: 110112 - DNA, 20 bp, Artificial
  CRISPR gRNA sequence
cattcaaattatatttgtga

SEQ ID NO: 110113 - DNA, 20 bp, Artificial
  CRISPR gRNA sequence
gaaaagtgtgattttcaaga

SEQ ID NO: 110114 - DNA, 20 bp, Artificial
  CRISPR gRNA sequence
agtgtgattttcaagaaaga

SEQ ID NO: 110115 - DNA, 20 bp, Artificial
  CRISPR gRNA sequence
tttgtatttttttgtagaga

SEQ ID NO: 110116 - DNA, 20 bp, Artificial
  CRISPR gRNA sequence
acctcagcctcccaaagtgt

SEQ ID NO: 110117 - DNA, 20 bp, Artificial
  CRISPR gRNA sequence
ataagattgcatccagttta

SEQ ID NO: 110118 - DNA, 20 bp, Artificial
  CRISPR gRNA sequence
ttgcatccagtttagagaat

SEQ ID NO: 110119 - DNA, 20 bp, Artificial
  CRISPR gRNA sequence
ttagagaatgtgagtagtcc

SEQ ID NO: 110120 - DNA, 20 bp, Artificial
  CRISPR gRNA sequence
caatacaaggtaataaagag

SEQ ID NO: 110121 - DNA, 20 bp, Artificial
  CRISPR gRNA sequence
tctccaaagtttaagacagc

SEQ ID NO: 110122 - DNA, 20 bp, Artificial
  CRISPR gRNA sequence
cacaagggacaattatgact

SEQ ID NO: 110123 - DNA, 20 bp, Artificial
  CRISPR gRNA sequence
tatataactactgtaagact

SEQ ID NO: 110124 - DNA, 20 bp, Artificial
  CRISPR gRNA sequence
agactgtgaatgcttatagt

SEQ ID NO: 110125 - DNA, 20 bp, Artificial
  CRISPR gRNA sequence
gccaaatttcgtttgagcaa

SEQ ID NO: 110126 - DNA, 20 bp, Artificial
  CRISPR gRNA sequence
ttattattattttctagaaa

SEQ ID NO: 110127 - DNA, 20 bp, Artificial
  CRISPR gRNA sequence
tggactgcagtggcatgatc

SEQ ID NO: 110128 - DNA, 20 bp, Artificial
  CRISPR gRNA sequence
gatcatgaatcactgcagcc

SEQ ID NO: 110129 - DNA, 20 bp, Artificial
  CRISPR gRNA sequence
ttcaaagtttccttgaaaga

SEQ ID NO: 110130 - DNA, 20 bp, Artificial
  CRISPR gRNA sequence
ttgaaagaaagggtacctgg

SEQ ID NO: 110131 - DNA, 20 bp, Artificial
  CRISPR gRNA sequence
actttgggaggcccaggcag

SEQ ID NO: 110132 - DNA, 20 bp, Artificial
  CRISPR gRNA sequence
caggtggatcacctgaggtc

SEQ ID NO: 110133 - DNA, 20 bp, Artificial
  CRISPR gRNA sequence
tactcaggaggctgaggcag

SEQ ID NO: 110134 - DNA, 20 bp, Artificial
  CRISPR gRNA sequence
ttgtgccactgcactccggc

SEQ ID NO: 110135 - DNA, 20 bp, Artificial
  CRISPR gRNA sequence
gcctggatgacagagcaaga

SEQ ID NO: 110136 - DNA, 20 bp, Artificial
  CRISPR gRNA sequence
caggaaaaaaaaaaaaaaga

SEQ ID NO: 110137 - DNA, 20 bp, Artificial
  CRISPR gRNA sequence
tcctaggctggagcctaagc

SEQ ID NO: 110138 - DNA, 20 bp, Artificial
  CRISPR gRNA sequence
gtgaaaatgtgctaccagtc

SEQ ID NO: 110139 - DNA, 20 bp, Artificial
  CRISPR gRNA sequence
gactacttttatgtatgaaa

SEQ ID NO: 110140 - DNA, 20 bp, Artificial
  CRISPR gRNA sequence
atacatacccttctctcctt

SEQ ID NO: 110141 - DNA, 20 bp, Artificial
  CRISPR gRNA sequence
gctcgggcttgcctcctctt

SEQ ID NO: 110142 - DNA, 20 bp, Artificial
  CRISPR gRNA sequence
agcatctctgctccaggtag

SEQ ID NO: 110143 - DNA, 20 bp, Artificial
  CRISPR gRNA sequence
gctccaggtagagggattct

SEQ ID NO: 110144 - DNA, 20 bp, Artificial
  CRISPR gRNA sequence
gccacaaaaagtaattttta

SEQ ID NO: 110145 - DNA, 20 bp, Artificial
  CRISPR gRNA sequence
aagtaatttttatagggtac

SEQ ID NO: 110146 - DNA, 20 bp, Artificial
  CRISPR gRNA sequence
tatagggtacttgggtaaat

SEQ ID NO: 110147 - DNA, 20 bp, Artificial
  CRISPR gRNA sequence
atgtaggtaaaaacaagtaa

SEQ ID NO: 110148 - DNA, 20 bp, Artificial
  CRISPR gRNA sequence
ctttcccaaatacaaccgct

SEQ ID NO: 110149 - DNA, 20 bp, Artificial
  CRISPR gRNA sequence
aaccgctttgaataactgta

SEQ ID NO: 110150 - DNA, 20 bp, Artificial
  CRISPR gRNA sequence
cctggacttaagccatcctc

SEQ ID NO: 110151 - DNA, 20 bp, Artificial
  CRISPR gRNA sequence
acaggtgcatgccactgagc

SEQ ID NO: 110152 - DNA, 20 bp, Artificial
  CRISPR gRNA sequence
aacatcctattttgacatat

SEQ ID NO: 110153 - DNA, 20 bp, Artificial
  CRISPR gRNA sequence
tatataattcccttcgttat

SEQ ID NO: 110154 - DNA, 20 bp, Artificial
  CRISPR gRNA sequence
ttcgttatttgaattctgaa

SEQ ID NO: 110155 - DNA, 20 bp, Artificial
  CRISPR gRNA sequence
attgctttatctccagcatc

SEQ ID NO: 110156 - DNA, 20 bp, Artificial
  CRISPR gRNA sequence
agcatctagaatagtccctg

SEQ ID NO: 110157 - DNA, 20 bp, Artificial
  CRISPR gRNA sequence
cctggcacatagtaggtgct

SEQ ID NO: 110158 - DNA, 20 bp, Artificial
  CRISPR gRNA sequence
gcacatagtaggtgctcaga

SEQ ID NO: 110159 - DNA, 20 bp, Artificial
  CRISPR gRNA sequence
tagattaccgacagtgcctt

SEQ ID NO: 110160 - DNA, 20 bp, Artificial
  CRISPR gRNA sequence
tcttaccatgaccatccctc

SEQ ID NO: 110161 - DNA, 20 bp, Artificial
  CRISPR gRNA sequence
gctcctgccaaactggctgc

SEQ ID NO: 110162 - DNA, 20 bp, Artificial
  CRISPR gRNA sequence
taactgtctaggtcccagtt

SEQ ID NO: 110163 - DNA, 20 bp, Artificial
  CRISPR gRNA sequence
ttgtttatctcaaactgaca

SEQ ID NO: 110164 - DNA, 20 bp, Artificial
  CRISPR gRNA sequence
gactatcaatagcagcactt

SEQ ID NO: 110165 - DNA, 20 bp, Artificial
  CRISPR gRNA sequence
aatccagttcagggcctccc

SEQ ID NO: 110166 - DNA, 20 bp, Artificial
  CRISPR gRNA sequence
gcacacagttagtgcactct

SEQ ID NO: 110167 - DNA, 20 bp, Artificial
  CRISPR gRNA sequence
aatttgcaatcacaaagtca

SEQ ID NO: 110168 - DNA, 20 bp, Artificial
  CRISPR gRNA sequence
ataatagtcatttaaagtaa

SEQ ID NO: 110169 - DNA, 20 bp, Artificial
  CRISPR gRNA sequence
actatagaaactgctacaca

SEQ ID NO: 110170 - DNA, 20 bp, Artificial
  CRISPR gRNA sequence
aaaaagtcctagggaagctt

SEQ ID NO: 110171 - DNA, 20 bp, Artificial
  CRISPR gRNA sequence
tgggtacacttaccttgctg

SEQ ID NO: 110172 - DNA, 20 bp, Artificial
  CRISPR gRNA sequence
aaaaaattatttttttgaga

SEQ ID NO: 110173 - DNA, 20 bp, Artificial
  CRISPR gRNA sequence
gtctcactctgtcgccaggc

SEQ ID NO: 110174 - DNA, 20 bp, Artificial
  CRISPR gRNA sequence
ctcactgcaacctccgcctc

SEQ ID NO: 110175 - DNA, 20 bp, Artificial
  CRISPR gRNA sequence
cgattctctgcctcagcctc

SEQ ID NO: 110176 - DNA, 20 bp, Artificial
  CRISPR gRNA sequence
gcctcagcctcccgagtagc

SEQ ID NO: 110177 - DNA, 20 bp, Artificial
  CRISPR gRNA sequence
cggggcttcaccatgttggc

SEQ ID NO: 110178 - DNA, 20 bp, Artificial
  CRISPR gRNA sequence
gcctcggcctctcaaagtgc

SEQ ID NO: 110179 - DNA, 20 bp, Artificial
  CRISPR gRNA sequence
ctcctgtgtgacagagctag

SEQ ID NO: 110180 - DNA, 20 bp, Artificial
  CRISPR gRNA sequence
gacagagctagtggaattac

SEQ ID NO: 110181 - DNA, 20 bp, Artificial
  CRISPR gRNA sequence
gtgacagccgtctggggctg

SEQ ID NO: 110182 - DNA, 20 bp, Artificial
  CRISPR gRNA sequence
ggctgctggatgatgatctg

SEQ ID NO: 110183 - DNA, 20 bp, Artificial
  CRISPR gRNA sequence
acctgcacagcctgtccacc

SEQ ID NO: 110184 - DNA, 20 bp, Artificial
  CRISPR gRNA sequence
acagcctgtccaccctggat

SEQ ID NO: 110185 - DNA, 20 bp, Artificial
  CRISPR gRNA sequence
tgcagaaaagaacataaaaa

SEQ ID NO: 110186 - DNA, 20 bp, Artificial
  CRISPR gRNA sequence
actggtctcctttggtcccc

SEQ ID NO: 110187 - DNA, 20 bp, Artificial
  CRISPR gRNA sequence
ttccatttatgaaacaaata

SEQ ID NO: 110188 - DNA, 20 bp, Artificial
  CRISPR gRNA sequence
atagggaatttcgacactgt

SEQ ID NO: 110189 - DNA, 20 bp, Artificial
  CRISPR gRNA sequence
tatttaaaatacactctggg

SEQ ID NO: 110190 - DNA, 20 bp, Artificial
  CRISPR gRNA sequence
ttgcactttggaaggccgag

SEQ ID NO: 110191 - DNA, 20 bp, Artificial
  CRISPR gRNA sequence
actttggaaggccgaggtgg

SEQ ID NO: 110192 - DNA, 20 bp, Artificial
  CRISPR gRNA sequence
tgggtggatcacttgaggtc

SEQ ID NO: 110193 - DNA, 20 bp, Artificial
  CRISPR gRNA sequence
tttttaatcttgccattttg

SEQ ID NO: 110194 - DNA, 20 bp, Artificial
  CRISPR gRNA sequence
tatattaaaaatgctgaaag

SEQ ID NO: 110195 - DNA, 20 bp, Artificial
  CRISPR gRNA sequence
tgaggcgagcagattaggtc

SEQ ID NO: 110196 - DNA, 20 bp, Artificial
  CRISPR gRNA sequence
tacttggggaactgaggtgg

SEQ ID NO: 110197 - DNA, 20 bp, Artificial
  CRISPR gRNA sequence
attccagcctaggcaacaga

SEQ ID NO: 110198 - DNA, 20 bp, Artificial
  CRISPR gRNA sequence
gggccttgagaggaccttga

SEQ ID NO: 110199 - DNA, 20 bp, Artificial
  CRISPR gRNA sequence
agaatccaacacagctgtgt

SEQ ID NO: 110200 - DNA, 20 bp, Artificial
  CRISPR gRNA sequence
tttttttttttttttggaga

SEQ ID NO: 110201 - DNA, 20 bp, Artificial
  CRISPR gRNA sequence
tgtcgctctgtggctcaggc

SEQ ID NO: 110202 - DNA, 20 bp, Artificial
  CRISPR gRNA sequence
ctcactgcaagctccgcctc

SEQ ID NO: 110203 - DNA, 20 bp, Artificial
  CRISPR gRNA sequence
cattctcctgcctcagcctc

SEQ ID NO: 110204 - DNA, 20 bp, Artificial
  CRISPR gRNA sequence
ttttgtctttttagtagaga

SEQ ID NO: 110205 - DNA, 20 bp, Artificial
  CRISPR gRNA sequence
cggggtttcactgtgttaac

SEQ ID NO: 110206 - DNA, 20 bp, Artificial
  CRISPR gRNA sequence
gcctcggccacccaaagtgc

SEQ ID NO: 110207 - DNA, 20 bp, Artificial
  CRISPR gRNA sequence
tgttttaagctgctaacttc

SEQ ID NO: 110208 - DNA, 20 bp, Artificial
  CRISPR gRNA sequence
ttgtatctcctatttggtcc

SEQ ID NO: 110209 - DNA, 20 bp, Artificial
  CRISPR gRNA sequence
tctcctatttggtcctagga

SEQ ID NO: 110210 - DNA, 20 bp, Artificial
  CRISPR gRNA sequence
taaagcaattatggaaagca

SEQ ID NO: 110211 - DNA, 20 bp, Artificial
  CRISPR gRNA sequence
atggctatagccactttatt

SEQ ID NO: 110212 - DNA, 20 bp, Artificial
  CRISPR gRNA sequence
gcaatacaaccctttaaatg

SEQ ID NO: 110213 - DNA, 20 bp, Artificial
  CRISPR gRNA sequence
atgtcttgtattttatattc

SEQ ID NO: 110214 - DNA, 20 bp, Artificial
  CRISPR gRNA sequence
tacctcccaaacttaaaagc

SEQ ID NO: 110215 - DNA, 20 bp, Artificial
  CRISPR gRNA sequence
catagatggcagtctggaag

SEQ ID NO: 110216 - DNA, 20 bp, Artificial
  CRISPR gRNA sequence
aaggtgaaaaaaacaggtca

SEQ ID NO: 110217 - DNA, 20 bp, Artificial
  CRISPR gRNA sequence
tccatgtcttagagacattc

SEQ ID NO: 110218 - DNA, 20 bp, Artificial
  CRISPR gRNA sequence
tcatggatcctactttgtta

SEQ ID NO: 110219 - DNA, 20 bp, Artificial
  CRISPR gRNA sequence
ggatagattgcctaggtctt

SEQ ID NO: 110220 - DNA, 20 bp, Artificial
  CRISPR gRNA sequence
tctaagtttatattggctgt

SEQ ID NO: 110221 - DNA, 20 bp, Artificial
  CRISPR gRNA sequence
aaacgttatttatacatatt

SEQ ID NO: 110222 - DNA, 20 bp, Artificial
  CRISPR gRNA sequence
aaaaattcttatattttctt

SEQ ID NO: 110223 - DNA, 20 bp, Artificial
  CRISPR gRNA sequence
aatattttttaaaatacagt

SEQ ID NO: 110224 - DNA, 20 bp, Artificial
  CRISPR gRNA sequence
tccagtatctttctcaggcc

SEQ ID NO: 110225 - DNA, 20 bp, Artificial
  CRISPR gRNA sequence
ttttaatctaaaattatatg

SEQ ID NO: 110226 - DNA, 20 bp, Artificial
  CRISPR gRNA sequence
gacatctctactttttctta

SEQ ID NO: 110227 - DNA, 20 bp, Artificial
  CRISPR gRNA sequence
ttagagggtgcaagctttac

SEQ ID NO: 110228 - DNA, 20 bp, Artificial
  CRISPR gRNA sequence
tttactaggattctaaaata

SEQ ID NO: 110229 - DNA, 20 bp, Artificial
  CRISPR gRNA sequence
aaaaaaaactcctatacaaa

SEQ ID NO: 110230 - DNA, 20 bp, Artificial
  CRISPR gRNA sequence
aagtattgtaagggaggcta

SEQ ID NO: 110231 - DNA, 20 bp, Artificial
  CRISPR gRNA sequence
agagagctttatttacgtaa

SEQ ID NO: 110232 - DNA, 20 bp, Artificial
  CRISPR gRNA sequence
ataaaaccccataaaaatca

SEQ ID NO: 110233 - DNA, 20 bp, Artificial
  CRISPR gRNA sequence
aaaatcacagaatttagagc

SEQ ID NO: 110234 - DNA, 20 bp, Artificial
  CRISPR gRNA sequence
atctcatataaattttattt

SEQ ID NO: 110235 - DNA, 20 bp, Artificial
  CRISPR gRNA sequence
ttaaataacttggccaagat

SEQ ID NO: 110236 - DNA, 20 bp, Artificial
  CRISPR gRNA sequence
agcaaagagagaagaacaga

SEQ ID NO: 110237 - DNA, 20 bp, Artificial
  CRISPR gRNA sequence
acagaaaggatatagcaata

SEQ ID NO: 110238 - DNA, 20 bp, Artificial
  CRISPR gRNA sequence
caatccaaagaaattatcct

SEQ ID NO: 110239 - DNA, 20 bp, Artificial
  CRISPR gRNA sequence
aagttgactgaacattatga

SEQ ID NO: 110240 - DNA, 20 bp, Artificial
  CRISPR gRNA sequence
aattatgcataaaaacacaa

SEQ ID NO: 110241 - DNA, 20 bp, Artificial
  CRISPR gRNA sequence
caagtttgatttatgagcag

SEQ ID NO: 110242 - DNA, 20 bp, Artificial
  CRISPR gRNA sequence
aaacaatataaacatttaga

SEQ ID NO: 110243 - DNA, 20 bp, Artificial
  CRISPR gRNA sequence
actataaacatatactcatg

SEQ ID NO: 110244 - DNA, 20 bp, Artificial
  CRISPR gRNA sequence
atactcatggggggttggtt

SEQ ID NO: 110245 - DNA, 20 bp, Artificial
  CRISPR gRNA sequence
atgatgatgcaatattccct

SEQ ID NO: 110246 - DNA, 20 bp, Artificial
  CRISPR gRNA sequence
tctccacatccatcctaaca

SEQ ID NO: 110247 - DNA, 20 bp, Artificial
  CRISPR gRNA sequence
aattttaaaatatgatgcca

SEQ ID NO: 110248 - DNA, 20 bp, Artificial
  CRISPR gRNA sequence
tctcttctttttttttgaga

SEQ ID NO: 110249 - DNA, 20 bp, Artificial
  CRISPR gRNA sequence
tcttgctctggtgcccagcc

SEQ ID NO: 110250 - DNA, 20 bp, Artificial
  CRISPR gRNA sequence
cttactgcaacctccgcctc

SEQ ID NO: 110251 - DNA, 20 bp, Artificial
  CRISPR gRNA sequence
gcctcaaccccccaagtagc

SEQ ID NO: 110252 - DNA, 20 bp, Artificial
  CRISPR gRNA sequence
ttttttatttttagtagaga

SEQ ID NO: 110253 - DNA, 20 bp, Artificial
  CRISPR gRNA sequence
gccttggcctccccaagtgc

SEQ ID NO: 110254 - DNA, 20 bp, Artificial
  CRISPR gRNA sequence
tttctcaatcagtgtttcaa

SEQ ID NO: 110255 - DNA, 20 bp, Artificial
  CRISPR gRNA sequence
ctataaaggcagaaaatcaa

SEQ ID NO: 110256 - DNA, 20 bp, Artificial
  CRISPR gRNA sequence
aaatcaactgaatgcaaaat

SEQ ID NO: 110257 - DNA, 20 bp, Artificial
  CRISPR gRNA sequence
cagggacagcctggaccatg

SEQ ID NO: 110258 - DNA, 20 bp, Artificial
  CRISPR gRNA sequence
ttaatggctgcccttggacc

SEQ ID NO: 110259 - DNA, 20 bp, Artificial
  CRISPR gRNA sequence
caagttatctttaaatatct

SEQ ID NO: 110260 - DNA, 20 bp, Artificial
  CRISPR gRNA sequence
ctttaaggtcagacataatg

SEQ ID NO: 110261 - DNA, 20 bp, Artificial
  CRISPR gRNA sequence
cagacataatggagaatatc

SEQ ID NO: 110262 - DNA, 20 bp, Artificial
  CRISPR gRNA sequence
ttgcctgtttaaaccaatcc

SEQ ID NO: 110263 - DNA, 20 bp, Artificial
  CRISPR gRNA sequence
ggtgatggtggtgatggtgg

SEQ ID NO: 110264 - DNA, 20 bp, Artificial
  CRISPR gRNA sequence
ccagcaatgactctaggagg

SEQ ID NO: 110265 - DNA, 20 bp, Artificial
  CRISPR gRNA sequence
cagctctggaagcttatgta

SEQ ID NO: 110266 - DNA, 20 bp, Artificial
  CRISPR gRNA sequence
tatcctgctcattttactct

SEQ ID NO: 110267 - DNA, 20 bp, Artificial
  CRISPR gRNA sequence
tcagtttgcagtctccatgg

SEQ ID NO: 110268 - DNA, 20 bp, Artificial
  CRISPR gRNA sequence
tgtacaaatttcaagctcct

SEQ ID NO: 110269 - DNA, 20 bp, Artificial
  CRISPR gRNA sequence
cccaatacaaaaatacctaa

SEQ ID NO: 110270 - DNA, 20 bp, Artificial
  CRISPR gRNA sequence
aagtaaactgtaatgatcca

SEQ ID NO: 110271 - DNA, 20 bp, Artificial
  CRISPR gRNA sequence
ttgacagaaattacttagaa

SEQ ID NO: 110272 - DNA, 20 bp, Artificial
  CRISPR gRNA sequence
aacagatcattctgtcctag

SEQ ID NO: 110273 - DNA, 20 bp, Artificial
  CRISPR gRNA sequence
tgccaccaccactaatgtat

SEQ ID NO: 110274 - DNA, 20 bp, Artificial
  CRISPR gRNA sequence
ctgtatcaagaaagatttct

SEQ ID NO: 110275 - DNA, 20 bp, Artificial
  CRISPR gRNA sequence
tttctcagaatacatatagc

SEQ ID NO: 110276 - DNA, 20 bp, Artificial
  CRISPR gRNA sequence
tgttacattcctattccaca

SEQ ID NO: 110277 - DNA, 20 bp, Artificial
  CRISPR gRNA sequence
tccaaaatactgttttatat

SEQ ID NO: 110278 - DNA, 20 bp, Artificial
  CRISPR gRNA sequence
gtgagatttgaacacaattt

SEQ ID NO: 110279 - DNA, 20 bp, Artificial
  CRISPR gRNA sequence
taccaaacactattggtggc

SEQ ID NO: 110280 - DNA, 20 bp, Artificial
  CRISPR gRNA sequence
acactattggtggcaggggt

SEQ ID NO: 110281 - DNA, 20 bp, Artificial
  CRISPR gRNA sequence
attggtggcaggggtagggg

SEQ ID NO: 110282 - DNA, 20 bp, Artificial
  CRISPR gRNA sequence
aggggtaggggtgggattga

SEQ ID NO: 110283 - DNA, 20 bp, Artificial
  CRISPR gRNA sequence
caataagaggtagttatctg

SEQ ID NO: 110284 - DNA, 20 bp, Artificial
  CRISPR gRNA sequence
tctacattctagattctact

SEQ ID NO: 110285 - DNA, 20 bp, Artificial
  CRISPR gRNA sequence
aattcaatggagggaaaaag

SEQ ID NO: 110286 - DNA, 20 bp, Artificial
  CRISPR gRNA sequence
tcttgccaatttctcaaaaa

SEQ ID NO: 110287 - DNA, 20 bp, Artificial
  CRISPR gRNA sequence
ataaaagtaacctacataca

SEQ ID NO: 110288 - DNA, 20 bp, Artificial
  CRISPR gRNA sequence
ggccaaattagaacccaatt

SEQ ID NO: 110289 - DNA, 20 bp, Artificial
  CRISPR gRNA sequence
aagaactgtattgattaacc

SEQ ID NO: 110290 - DNA, 20 bp, Artificial
  CRISPR gRNA sequence
ctgcctaaccaagaggtatc

SEQ ID NO: 110291 - DNA, 20 bp, Artificial
  CRISPR gRNA sequence
gtgcaatgattatttttcag

SEQ ID NO: 110292 - DNA, 20 bp, Artificial
  CRISPR gRNA sequence
tttttcagttgagttgcccc

SEQ ID NO: 110293 - DNA, 20 bp, Artificial
  CRISPR gRNA sequence
aatttttaccatgcaattaa

SEQ ID NO: 110294 - DNA, 20 bp, Artificial
  CRISPR gRNA sequence
taccatgcaattaattggat

SEQ ID NO: 110295 - DNA, 20 bp, Artificial
  CRISPR gRNA sequence
attggatcagagtgtgagcc

SEQ ID NO: 110296 - DNA, 20 bp, Artificial
  CRISPR gRNA sequence
tcttttttttttttttgaga

SEQ ID NO: 110297 - DNA, 20 bp, Artificial
  CRISPR gRNA sequence
tctcgctctgtcacccaggc

SEQ ID NO: 110298 - DNA, 20 bp, Artificial
  CRISPR gRNA sequence
ctcactgcaagctctgcctc

SEQ ID NO: 110299 - DNA, 20 bp, Artificial
  CRISPR gRNA sequence
ttttgtatttttagtagaga

SEQ ID NO: 110300 - DNA, 20 bp, Artificial
  CRISPR gRNA sequence
cagggtttcaccatgtttgc

SEQ ID NO: 110301 - DNA, 20 bp, Artificial
  CRISPR gRNA sequence
gcctcggcctcccaaagtgc

SEQ ID NO: 110302 - DNA, 20 bp, Artificial
  CRISPR gRNA sequence
ccaccgcgcccggccgagcc

SEQ ID NO: 110303 - DNA, 20 bp, Artificial
  CRISPR gRNA sequence
taaattctaatgtcacttat

SEQ ID NO: 110304 - DNA, 20 bp, Artificial
  CRISPR gRNA sequence
caattctcagaaagttgata

SEQ ID NO: 110305 - DNA, 20 bp, Artificial
  CRISPR gRNA sequence
aagttcatgcagtgctcaca

SEQ ID NO: 110306 - DNA, 20 bp, Artificial
  CRISPR gRNA sequence
agtgctcacagagaatcaga

SEQ ID NO: 110307 - DNA, 20 bp, Artificial
  CRISPR gRNA sequence
agagagggtaccactacctg

SEQ ID NO: 110308 - DNA, 20 bp, Artificial
  CRISPR gRNA sequence
tctggacttgctggcctgag

SEQ ID NO: 110309 - DNA, 20 bp, Artificial
  CRISPR gRNA sequence
agctgttttgttgaaggtag

SEQ ID NO: 110310 - DNA, 20 bp, Artificial
  CRISPR gRNA sequence
agatattagccctttgtctc

SEQ ID NO: 110311 - DNA, 20 bp, Artificial
  CRISPR gRNA sequence
caatctttccctccagaaac

SEQ ID NO: 110312 - DNA, 20 bp, Artificial
  CRISPR gRNA sequence
tgccctttttatctcctcag

SEQ ID NO: 110313 - DNA, 20 bp, Artificial
  CRISPR gRNA sequence
aatgcaatcaccaagaaagg

SEQ ID NO: 110314 - DNA, 20 bp, Artificial
  CRISPR gRNA sequence
tttatgtacttattttgaga

SEQ ID NO: 110315 - DNA, 20 bp, Artificial
  CRISPR gRNA sequence
ctgttttgcccaggctggtc

SEQ ID NO: 110316 - DNA, 20 bp, Artificial
  CRISPR gRNA sequence
aaccttcctgtctcagcctc

SEQ ID NO: 110317 - DNA, 20 bp, Artificial
  CRISPR gRNA sequence
gtctcagcctccagagtagc

SEQ ID NO: 110318 - DNA, 20 bp, Artificial
  CRISPR gRNA sequence
ccactaatggcaaattctga

SEQ ID NO: 110319 - DNA, 20 bp, Artificial
  CRISPR gRNA sequence
ccaccctccagggcactggt

SEQ ID NO: 110320 - DNA, 20 bp, Artificial
  CRISPR gRNA sequence
tgtgaatggagggccctttg

SEQ ID NO: 110321 - DNA, 20 bp, Artificial
  CRISPR gRNA sequence
atggaagggaaagctatcag

SEQ ID NO: 110322 - DNA, 20 bp, Artificial
  CRISPR gRNA sequence
cataatacatttttttcttc

SEQ ID NO: 110323 - DNA, 20 bp, Artificial
  CRISPR gRNA sequence
aagaaagcaatctattaatt

SEQ ID NO: 110324 - DNA, 20 bp, Artificial
  CRISPR gRNA sequence
ttaggaataaaccagcagca

SEQ ID NO: 110325 - DNA, 20 bp, Artificial
  CRISPR gRNA sequence
ttctagtatgtcttatccat

SEQ ID NO: 110326 - DNA, 20 bp, Artificial
  CRISPR gRNA sequence
aatgttaaaccagagctttt

SEQ ID NO: 110327 - DNA, 20 bp, Artificial
  CRISPR gRNA sequence
aagaagagaaaaagaccaaa

SEQ ID NO: 110328 - DNA, 20 bp, Artificial
  CRISPR gRNA sequence
actataaccaggcacccatg

SEQ ID NO: 110329 - DNA, 20 bp, Artificial
  CRISPR gRNA sequence
cagggcaatagaccaaccaa

SEQ ID NO: 110330 - DNA, 20 bp, Artificial
  CRISPR gRNA sequence
ttttgcttccatacctgctg

SEQ ID NO: 110331 - DNA, 20 bp, Artificial
  CRISPR gRNA sequence
ggccttaccagacaattaac

SEQ ID NO: 110332 - DNA, 20 bp, Artificial
  CRISPR gRNA sequence
gtactttatttgcaagaaaa

SEQ ID NO: 110333 - DNA, 20 bp, Artificial
  CRISPR gRNA sequence
tttgcaagaaaacaggatag

SEQ ID NO: 110334 - DNA, 20 bp, Artificial
  CRISPR gRNA sequence
tattcagtatcatttttaac

SEQ ID NO: 110335 - DNA, 20 bp, Artificial
  CRISPR gRNA sequence
aggtttgcacatatacttta

SEQ ID NO: 110336 - DNA, 20 bp, Artificial
  CRISPR gRNA sequence
ttacccttctcatagacttt

SEQ ID NO: 110337 - DNA, 20 bp, Artificial
  CRISPR gRNA sequence
gaagatccacttttaaaaat

SEQ ID NO: 110338 - DNA, 20 bp, Artificial
  CRISPR gRNA sequence
taaggatacaattagataaa

SEQ ID NO: 110339 - DNA, 20 bp, Artificial
  CRISPR gRNA sequence
gccctcataaattccaacat

SEQ ID NO: 110340 - DNA, 20 bp, Artificial
  CRISPR gRNA sequence
cataaatccacacatgctgg

SEQ ID NO: 110341 - DNA, 20 bp, Artificial
  CRISPR gRNA sequence
actttgaaatgcatcaaaaa

SEQ ID NO: 110342 - DNA, 20 bp, Artificial
  CRISPR gRNA sequence
tgaaatgcatcaaaaaatgg

SEQ ID NO: 110343 - DNA, 20 bp, Artificial
  CRISPR gRNA sequence
atgcatcaaaaaatggatga

SEQ ID NO: 110344 - DNA, 20 bp, Artificial
  CRISPR gRNA sequence
cacttgaaaattcttatttc

SEQ ID NO: 110345 - DNA, 20 bp, Artificial
  CRISPR gRNA sequence
aaaattcttatttctagaat

SEQ ID NO: 110346 - DNA, 20 bp, Artificial
  CRISPR gRNA sequence
gagaaattcttatttcccaa

SEQ ID NO: 110347 - DNA, 20 bp, Artificial
  CRISPR gRNA sequence
cttatttcccaaatgaatgt

SEQ ID NO: 110348 - DNA, 20 bp, Artificial
  CRISPR gRNA sequence
ccccattactcataaccaaa

SEQ ID NO: 110349 - DNA, 20 bp, Artificial
  CRISPR gRNA sequence
aaccaaaatggatacaacat

SEQ ID NO: 110350 - DNA, 20 bp, Artificial
  CRISPR gRNA sequence
aagcactgcccttgatctaa

SEQ ID NO: 110351 - DNA, 20 bp, Artificial
  CRISPR gRNA sequence
ggtaaatttctagctataat

SEQ ID NO: 110352 - DNA, 20 bp, Artificial
  CRISPR gRNA sequence
gatttttacaccagtctctt

SEQ ID NO: 110353 - DNA, 20 bp, Artificial
  CRISPR gRNA sequence
aagtctgctcctcagagatt

SEQ ID NO: 110354 - DNA, 20 bp, Artificial
  CRISPR gRNA sequence
ctcctcagagattctgggta

SEQ ID NO: 110355 - DNA, 20 bp, Artificial
  CRISPR gRNA sequence
atcaggttttcagccagact

SEQ ID NO: 110356 - DNA, 20 bp, Artificial
  CRISPR gRNA sequence
aaattaaggttatgatgtaa

SEQ ID NO: 110357 - DNA, 20 bp, Artificial
  CRISPR gRNA sequence
cagtaatctagagacagaaa

SEQ ID NO: 110358 - DNA, 20 bp, Artificial
  CRISPR gRNA sequence
aaatggatcagtggttcctt

SEQ ID NO: 110359 - DNA, 20 bp, Artificial
  CRISPR gRNA sequence
tcagtggttccttgggagtg

SEQ ID NO: 110360 - DNA, 20 bp, Artificial
  CRISPR gRNA sequence
atggagccttaggaacattg

SEQ ID NO: 110361 - DNA, 20 bp, Artificial
  CRISPR gRNA sequence
ataaattgattttaaaaaat

SEQ ID NO: 110362 - DNA, 20 bp, Artificial
  CRISPR gRNA sequence
taaaaaataaggatcatgaa

SEQ ID NO: 110363 - DNA, 20 bp, Artificial
  CRISPR gRNA sequence
atatttaaatttatactttg

SEQ ID NO: 110364 - DNA, 20 bp, Artificial
  CRISPR gRNA sequence
attctctctcacattaatga

SEQ ID NO: 110365 - DNA, 20 bp, Artificial
  CRISPR gRNA sequence
cttgctcttaacacaaagtt

SEQ ID NO: 110366 - DNA, 20 bp, Artificial
  CRISPR gRNA sequence
tgtaagcatatgaaaagcca

SEQ ID NO: 110367 - DNA, 20 bp, Artificial
  CRISPR gRNA sequence
cttttttttcttttaagaga

SEQ ID NO: 110368 - DNA, 20 bp, Artificial
  CRISPR gRNA sequence
gtctcaaactcctgagctca

SEQ ID NO: 110369 - DNA, 20 bp, Artificial
  CRISPR gRNA sequence
acttcggcttcccaaagtgc

SEQ ID NO: 110370 - DNA, 20 bp, Artificial
  CRISPR gRNA sequence
tttctttcacaactcaacaa

SEQ ID NO: 110371 - DNA, 20 bp, Artificial
  CRISPR gRNA sequence
ccccatcatcctacagattt

SEQ ID NO: 110372 - DNA, 20 bp, Artificial
  CRISPR gRNA sequence
tgacgaagattcaaacttca

SEQ ID NO: 110373 - DNA, 20 bp, Artificial
  CRISPR gRNA sequence
aatggactaaaaacctatac

SEQ ID NO: 110374 - DNA, 20 bp, Artificial
  CRISPR gRNA sequence
cctaagagataaagtgatat

SEQ ID NO: 110375 - DNA, 20 bp, Artificial
  CRISPR gRNA sequence
gacagagatttgttccagct

SEQ ID NO: 110376 - DNA, 20 bp, Artificial
  CRISPR gRNA sequence
tctttgctatcagaggcctg

SEQ ID NO: 110377 - DNA, 20 bp, Artificial
  CRISPR gRNA sequence
gttttgggagaacaagaagg

SEQ ID NO: 110378 - DNA, 20 bp, Artificial
  CRISPR gRNA sequence
agggaggatggcttgagccc

SEQ ID NO: 110379 - DNA, 20 bp, Artificial
  CRISPR gRNA sequence
ttgcgccactgtactccagc

SEQ ID NO: 110380 - DNA, 20 bp, Artificial
  CRISPR gRNA sequence
ctatcatctcatctgctaat

SEQ ID NO: 110381 - DNA, 20 bp, Artificial
  CRISPR gRNA sequence
gcggataacgtgacaatcaa

SEQ ID NO: 110382 - DNA, 20 bp, Artificial
  CRISPR gRNA sequence
ttttagtaatgaaagagcac

SEQ ID NO: 110383 - DNA, 20 bp, Artificial
  CRISPR gRNA sequence
taatgaaagagcactggaat

SEQ ID NO: 110384 - DNA, 20 bp, Artificial
  CRISPR gRNA sequence
ttagttgtataacattaaat

SEQ ID NO: 110385 - DNA, 20 bp, Artificial
  CRISPR gRNA sequence
cttaagacctttatgtgcca

SEQ ID NO: 110386 - DNA, 20 bp, Artificial
  CRISPR gRNA sequence
gaatgcactagatgattcac

SEQ ID NO: 110387 - DNA, 20 bp, Artificial
  CRISPR gRNA sequence
acatgagtaaaaataatttt

SEQ ID NO: 110388 - DNA, 20 bp, Artificial
  CRISPR gRNA sequence
ctcttccatctttcctgtgg

SEQ ID NO: 110389 - DNA, 20 bp, Artificial
  CRISPR gRNA sequence
tcacggaggctagctcacgc

SEQ ID NO: 110390 - DNA, 20 bp, Artificial
  CRISPR gRNA sequence
acgtactccctccctaacac

SEQ ID NO: 110391 - DNA, 20 bp, Artificial
  CRISPR gRNA sequence
tacctggcatatactaactg

SEQ ID NO: 110392 - DNA, 20 bp, Artificial
  CRISPR gRNA sequence
agaaaaacataaaccaagag

SEQ ID NO: 110393 - DNA, 20 bp, Artificial
  CRISPR gRNA sequence
taaaccaagagatgagtgga

SEQ ID NO: 110394 - DNA, 20 bp, Artificial
  CRISPR gRNA sequence
gagatttcacaaaatgagca

SEQ ID NO: 110395 - DNA, 20 bp, Artificial
  CRISPR gRNA sequence
caagttgtgcagcctccgga

SEQ ID NO: 110396 - DNA, 20 bp, Artificial
  CRISPR gRNA sequence
agcctccggaaagaatgcgc

SEQ ID NO: 110397 - DNA, 20 bp, Artificial
  CRISPR gRNA sequence
cgcaagggtatcaatcttct

SEQ ID NO: 110398 - DNA, 20 bp, Artificial
  CRISPR gRNA sequence
taagagtgaggttccaggca

SEQ ID NO: 110399 - DNA, 20 bp, Artificial
  CRISPR gRNA sequence
agaggaaatgacgagccaaa

SEQ ID NO: 110400 - DNA, 20 bp, Artificial
  CRISPR gRNA sequence
gaggggcgcggcggagcagg

SEQ ID NO: 110401 - DNA, 20 bp, Artificial
  CRISPR gRNA sequence
gcttcctgtcccaagggccg

SEQ ID NO: 110402 - DNA, 20 bp, Artificial
  CRISPR gRNA sequence
gtcccaagggccggagagtg

SEQ ID NO: 110403 - DNA, 20 bp, Artificial
  CRISPR gRNA sequence
tggggcctgagaacctgggc

SEQ ID NO: 110404 - DNA, 20 bp, Artificial
  CRISPR gRNA sequence
aactggccctggcaccctgc

SEQ ID NO: 110405 - DNA, 20 bp, Artificial
  CRISPR gRNA sequence
ggcccctgcaggcctcggcc

SEQ ID NO: 110406 - DNA, 20 bp, Artificial
  CRISPR gRNA sequence
gacgggcgcctgggcctctc

SEQ ID NO: 110407 - DNA, 20 bp, Artificial
  CRISPR gRNA sequence
ctggggccggctctgggccg

SEQ ID NO: 110408 - DNA, 20 bp, Artificial
  CRISPR gRNA sequence
aatggcgaacccgaacaaag

SEQ ID NO: 110409 - DNA, 20 bp, Artificial
  CRISPR gRNA sequence
acgcccactaactccagttc

SEQ ID NO: 110410 - DNA, 20 bp, Artificial
  CRISPR gRNA sequence
gcggaggcggttggagggag

SEQ ID NO: 110411 - DNA, 20 bp, Artificial
  CRISPR gRNA sequence
gcggcagcggcggctggagc

SEQ ID NO: 110412 - DNA, 20 bp, Artificial
  CRISPR gRNA sequence
gcggcggctggagcctctga

SEQ ID NO: 110413 - DNA, 20 bp, Artificial
  CRISPR gRNA sequence
gcccagagccggccccagcg

SEQ ID NO: 110414 - DNA, 20 bp, Artificial
  CRISPR gRNA sequence
cacatgcgcgccctgggcct

SEQ ID NO: 110415 - DNA, 20 bp, Artificial
  CRISPR gRNA sequence
ttggagcccaaccaagcggt

SEQ ID NO: 110416 - DNA, 20 bp, Artificial
  CRISPR gRNA sequence
gtgcctggaacctcactctt

SEQ ID NO: 110417 - DNA, 20 bp, Artificial
  CRISPR gRNA sequence
tccctcccttgggaatatag

SEQ ID NO: 110418 - DNA, 20 bp, Artificial
  CRISPR gRNA sequence
tgggaatatagtacagtttt

SEQ ID NO: 110419 - DNA, 20 bp, Artificial
  CRISPR gRNA sequence
gttttgggggttttttttcc

SEQ ID NO: 110420 - DNA, 20 bp, Artificial
  CRISPR gRNA sequence
cctttctatgttactttgtg

SEQ ID NO: 110421 - DNA, 20 bp, Artificial
  CRISPR gRNA sequence
ttgacccagtccactcatct

SEQ ID NO: 110422 - DNA, 20 bp, Artificial
  CRISPR gRNA sequence
cagtccactcatctcttggt

SEQ ID NO: 110423 - DNA, 20 bp, Artificial
  CRISPR gRNA sequence
tacactttcaagtcctgtgt

SEQ ID NO: 110424 - DNA, 20 bp, Artificial
  CRISPR gRNA sequence
tgtgttaacgttttctcagc

SEQ ID NO: 110425 - DNA, 20 bp, Artificial
  CRISPR gRNA sequence
tttagaaactaacagtgttg

SEQ ID NO: 110426 - DNA, 20 bp, Artificial
  CRISPR gRNA sequence
tgcgtgagctagcctccgtg

SEQ ID NO: 110427 - DNA, 20 bp, Artificial
  CRISPR gRNA sequence
ttcttccacaggaaagatgg

SEQ ID NO: 110428 - DNA, 20 bp, Artificial
  CRISPR gRNA sequence
gggaagtgggcagtagttgt

SEQ ID NO: 110429 - DNA, 20 bp, Artificial
  CRISPR gRNA sequence
atctagagctatattttttc

SEQ ID NO: 110430 - DNA, 20 bp, Artificial
  CRISPR gRNA sequence
tttttcctaagattgaaaaa

SEQ ID NO: 110431 - DNA, 20 bp, Artificial
  CRISPR gRNA sequence
attgaaaaaacgagtttctg

SEQ ID NO: 110432 - DNA, 20 bp, Artificial
  CRISPR gRNA sequence
catttaatgttatacaacta

SEQ ID NO: 110433 - DNA, 20 bp, Artificial
  CRISPR gRNA sequence
tcattactaaaacttcgggg

SEQ ID NO: 110434 - DNA, 20 bp, Artificial
  CRISPR gRNA sequence
ttttattttcactttttagg

SEQ ID NO: 110435 - DNA, 20 bp, Artificial
  CRISPR gRNA sequence
ttttagggtgagtttttcat

SEQ ID NO: 110436 - DNA, 20 bp, Artificial
  CRISPR gRNA sequence
tgagtttttcattgttgctt

SEQ ID NO: 110437 - DNA, 20 bp, Artificial
  CRISPR gRNA sequence
ttaagtgattttcttaattc

SEQ ID NO: 110438 - DNA, 20 bp, Artificial
  CRISPR gRNA sequence
cgcattagcagatgagatga

SEQ ID NO: 110439 - DNA, 20 bp, Artificial
  CRISPR gRNA sequence
aacatgtatatttgcctttg

SEQ ID NO: 110440 - DNA, 20 bp, Artificial
  CRISPR gRNA sequence
tatttgcctttggaacgttt

SEQ ID NO: 110441 - DNA, 20 bp, Artificial
  CRISPR gRNA sequence
tgcctttggaacgttttttt

SEQ ID NO: 110442 - DNA, 20 bp, Artificial
  CRISPR gRNA sequence
tttttgtttgtttttggata

SEQ ID NO: 110443 - DNA, 20 bp, Artificial
  CRISPR gRNA sequence
cttcttgttctcccaaaacg

SEQ ID NO: 110444 - DNA, 20 bp, Artificial
  CRISPR gRNA sequence
actgcgtcctgacctgaaat

SEQ ID NO: 110445 - DNA, 20 bp, Artificial
  CRISPR gRNA sequence
acttcaaaatcactaaatac

SEQ ID NO: 110446 - DNA, 20 bp, Artificial
  CRISPR gRNA sequence
acttttttgctaaatacctt

SEQ ID NO: 110447 - DNA, 20 bp, Artificial
  CRISPR gRNA sequence
tgagagaaagtagtgtggcc

SEQ ID NO: 110448 - DNA, 20 bp, Artificial
  CRISPR gRNA sequence
gtgtggccccaagctttttt

SEQ ID NO: 110449 - DNA, 20 bp, Artificial
  CRISPR gRNA sequence
acatgctgaaatatttctgt

SEQ ID NO: 110450 - DNA, 20 bp, Artificial
  CRISPR gRNA sequence
ctgttcttgtttttatgctc

SEQ ID NO: 110451 - DNA, 20 bp, Artificial
  CRISPR gRNA sequence
acctttttttttttaagcct

SEQ ID NO: 110452 - DNA, 20 bp, Artificial
  CRISPR gRNA sequence
ttcccatatcactttatctc

SEQ ID NO: 110453 - DNA, 20 bp, Artificial
  CRISPR gRNA sequence
ttatctcttaggattccagt

SEQ ID NO: 110454 - DNA, 20 bp, Artificial
  CRISPR gRNA sequence
tactaaacttaaagactctt

SEQ ID NO: 110455 - DNA, 20 bp, Artificial
  CRISPR gRNA sequence
tttgaagtttgaatcttcgt

SEQ ID NO: 110456 - DNA, 20 bp, Artificial
  CRISPR gRNA sequence
tgggagaatcctttgagctc

SEQ ID NO: 110457 - DNA, 20 bp, Artificial
  CRISPR gRNA sequence
ttgtgttgtataaaggtaaa

SEQ ID NO: 110458 - DNA, 20 bp, Artificial
  CRISPR gRNA sequence
atgaaactttcatttcagtt

SEQ ID NO: 110459 - DNA, 20 bp, Artificial
  CRISPR gRNA sequence
cactgagttgtgataatgaa

SEQ ID NO: 110460 - DNA, 20 bp, Artificial
  CRISPR gRNA sequence
aaagttaaaaagctactgtt

SEQ ID NO: 110461 - DNA, 20 bp, Artificial
  CRISPR gRNA sequence
ctgttctaggctttgcctgg

SEQ ID NO: 110462 - DNA, 20 bp, Artificial
  CRISPR gRNA sequence
attatcaactgtgataatcc

SEQ ID NO: 110463 - DNA, 20 bp, Artificial
  CRISPR gRNA sequence
tgataatcctatggcttttc

SEQ ID NO: 110464 - DNA, 20 bp, Artificial
  CRISPR gRNA sequence
ttttcatatgcttacactag

SEQ ID NO: 110465 - DNA, 20 bp, Artificial
  CRISPR gRNA sequence
tacactagttgagtttctga

SEQ ID NO: 110466 - DNA, 20 bp, Artificial
  CRISPR gRNA sequence
agttgagtttctgaagaggt

SEQ ID NO: 110467 - DNA, 20 bp, Artificial
  CRISPR gRNA sequence
ttctgaagaggttttagctt

SEQ ID NO: 110468 - DNA, 20 bp, Artificial
  CRISPR gRNA sequence
tagtaagtggttggctaagt

SEQ ID NO: 110469 - DNA, 20 bp, Artificial
  CRISPR gRNA sequence
agccagaataaacacttatt

SEQ ID NO: 110470 - DNA, 20 bp, Artificial
  CRISPR gRNA sequence
caagagctagacagactaaa

SEQ ID NO: 110471 - DNA, 20 bp, Artificial
  CRISPR gRNA sequence
gctagacagactaaatctgg

SEQ ID NO: 110472 - DNA, 20 bp, Artificial
  CRISPR gRNA sequence
catatgactttactgaagcc

SEQ ID NO: 110473 - DNA, 20 bp, Artificial
  CRISPR gRNA sequence
taatgtgagagagaattgct

SEQ ID NO: 110474 - DNA, 20 bp, Artificial
  CRISPR gRNA sequence
cgttacatatattagtcatt

SEQ ID NO: 110475 - DNA, 20 bp, Artificial
  CRISPR gRNA sequence
aattttaaatgtgtattttg

SEQ ID NO: 110476 - DNA, 20 bp, Artificial
  CRISPR gRNA sequence
ccactgatccattttctgtc

SEQ ID NO: 110477 - DNA, 20 bp, Artificial
  CRISPR gRNA sequence
tctagattactgatgtcttt

SEQ ID NO: 110478 - DNA, 20 bp, Artificial
  CRISPR gRNA sequence
atataaatggaatcatatat

SEQ ID NO: 110479 - DNA, 20 bp, Artificial
  CRISPR gRNA sequence
tacatcataaccttaatttt

SEQ ID NO: 110480 - DNA, 20 bp, Artificial
  CRISPR gRNA sequence
gactcacagtctggctgaaa

SEQ ID NO: 110481 - DNA, 20 bp, Artificial
  CRISPR gRNA sequence
actggtgtaaaaatcagaaa

SEQ ID NO: 110482 - DNA, 20 bp, Artificial
  CRISPR gRNA sequence
agaaaaccggtttgtcatgt

SEQ ID NO: 110483 - DNA, 20 bp, Artificial
  CRISPR gRNA sequence
gcattccattagatcaaggg

SEQ ID NO: 110484 - DNA, 20 bp, Artificial
  CRISPR gRNA sequence
atagcctgttatttatggct

SEQ ID NO: 110485 - DNA, 20 bp, Artificial
  CRISPR gRNA sequence
attttggttatgagtaatgg

SEQ ID NO: 110486 - DNA, 20 bp, Artificial
  CRISPR gRNA sequence
atggggttgattaattttta

SEQ ID NO: 110487 - DNA, 20 bp, Artificial
  CRISPR gRNA sequence
ggacatatagttgcacatat

SEQ ID NO: 110488 - DNA, 20 bp, Artificial
  CRISPR gRNA sequence
actgtattgagacaccttgc

SEQ ID NO: 110489 - DNA, 20 bp, Artificial
  CRISPR gRNA sequence
tgattaattccaccagcatg

SEQ ID NO: 110490 - DNA, 20 bp, Artificial
  CRISPR gRNA sequence
agagaaagacctatctacat

SEQ ID NO: 110491 - DNA, 20 bp, Artificial
  CRISPR gRNA sequence
cccatatttccaagatgaat

SEQ ID NO: 110492 - DNA, 20 bp, Artificial
  CRISPR gRNA sequence
ttaaaggttctcagatatca

SEQ ID NO: 110493 - DNA, 20 bp, Artificial
  CRISPR gRNA sequence
atatgtagtggacctgagta

SEQ ID NO: 110494 - DNA, 20 bp, Artificial
  CRISPR gRNA sequence
aattacgtgttacaacttaa

SEQ ID NO: 110495 - DNA, 20 bp, Artificial
  CRISPR gRNA sequence
tatgccttgtatcaaagtga

SEQ ID NO: 110496 - DNA, 20 bp, Artificial
  CRISPR gRNA sequence
gtgaaaatagcattatgttg

SEQ ID NO: 110497 - DNA, 20 bp, Artificial
  CRISPR gRNA sequence
aagcatttcctattctccta

SEQ ID NO: 110498 - DNA, 20 bp, Artificial
  CRISPR gRNA sequence
gcctttattgacaatctcac

SEQ ID NO: 110499 - DNA, 20 bp, Artificial
  CRISPR gRNA sequence
aaacagcaatagttcgacag

SEQ ID NO: 110500 - DNA, 20 bp, Artificial
  CRISPR gRNA sequence
gcagattgttgtccaggcag

SEQ ID NO: 110501 - DNA, 20 bp, Artificial
  CRISPR gRNA sequence
agcagcaggtatggaagcaa

SEQ ID NO: 110502 - DNA, 20 bp, Artificial
  CRISPR gRNA sequence
tcttgtgagatattgggtct

SEQ ID NO: 110503 - DNA, 20 bp, Artificial
  CRISPR gRNA sequence
ttttaagtaaaaacatctag

SEQ ID NO: 110504 - DNA, 20 bp, Artificial
  CRISPR gRNA sequence
aatttggactttaaaatttt

SEQ ID NO: 110505 - DNA, 20 bp, Artificial
  CRISPR gRNA sequence
tctatttggtctttttctct

SEQ ID NO: 110506 - DNA, 20 bp, Artificial
  CRISPR gRNA sequence
ctcttcttgtttgagctaac

SEQ ID NO: 110507 - DNA, 20 bp, Artificial
  CRISPR gRNA sequence
ggccacaacagacaaaccaa

SEQ ID NO: 110508 - DNA, 20 bp, Artificial
  CRISPR gRNA sequence
aacatagcttccaataaatc

SEQ ID NO: 110509 - DNA, 20 bp, Artificial
  CRISPR gRNA sequence
cttccaataaatcttctgtt

SEQ ID NO: 110510 - DNA, 20 bp, Artificial
  CRISPR gRNA sequence
cattttttattcagaaaagc

SEQ ID NO: 110511 - DNA, 20 bp, Artificial
  CRISPR gRNA sequence
ctagaaaggaattccctgct

SEQ ID NO: 110512 - DNA, 20 bp, Artificial
  CRISPR gRNA sequence
ctgctggtttattcctaatt

SEQ ID NO: 110513 - DNA, 20 bp, Artificial
  CRISPR gRNA sequence
tggtttattcctaattaata

SEQ ID NO: 110514 - DNA, 20 bp, Artificial
  CRISPR gRNA sequence
tatacacaggttacattttc

SEQ ID NO: 110515 - DNA, 20 bp, Artificial
  CRISPR gRNA sequence
aggttacattttctgatgct

SEQ ID NO: 110516 - DNA, 20 bp, Artificial
  CRISPR gRNA sequence
cattttctgatgctttatgc

SEQ ID NO: 110517 - DNA, 20 bp, Artificial
  CRISPR gRNA sequence
ccccagaagaaaaaaatgta

SEQ ID NO: 110518 - DNA, 20 bp, Artificial
  CRISPR gRNA sequence
tgtttctatttgaccttagg

SEQ ID NO: 110519 - DNA, 20 bp, Artificial
  CRISPR gRNA sequence
agattgatattttggaaata

SEQ ID NO: 110520 - DNA, 20 bp, Artificial
  CRISPR gRNA sequence
agggaaaggtagtattgatg

SEQ ID NO: 110521 - DNA, 20 bp, Artificial
  CRISPR gRNA sequence
gatcaaagacgaactcccct

SEQ ID NO: 110522 - DNA, 20 bp, Artificial
  CRISPR gRNA sequence
catacagctgctgtggctct

SEQ ID NO: 110523 - DNA, 20 bp, Artificial
  CRISPR gRNA sequence
ttcaactgcctttttagagg

SEQ ID NO: 110524 - DNA, 20 bp, Artificial
  CRISPR gRNA sequence
tcacaccagtgccctggagg

SEQ ID NO: 110525 - DNA, 20 bp, Artificial
  CRISPR gRNA sequence
tccagttgggtagaaataat

SEQ ID NO: 110526 - DNA, 20 bp, Artificial
  CRISPR gRNA sequence
ctggaggctgagacaggaag

SEQ ID NO: 110527 - DNA, 20 bp, Artificial
  CRISPR gRNA sequence
tctcaaaataagtacataaa

SEQ ID NO: 110528 - DNA, 20 bp, Artificial
  CRISPR gRNA sequence
aagtttaaaaaaaaaagaat

SEQ ID NO: 110529 - DNA, 20 bp, Artificial
  CRISPR gRNA sequence
tgagagcattgacgtcatga

SEQ ID NO: 110530 - DNA, 20 bp, Artificial
  CRISPR gRNA sequence
atgaagatgatttcggttca

SEQ ID NO: 110531 - DNA, 20 bp, Artificial
  CRISPR gRNA sequence
attaattactcctcctttct

SEQ ID NO: 110532 - DNA, 20 bp, Artificial
  CRISPR gRNA sequence
ttaagcccagaattttttat

SEQ ID NO: 110533 - DNA, 20 bp, Artificial
  CRISPR gRNA sequence
acaattgtgtaagtagaagt

SEQ ID NO: 110534 - DNA, 20 bp, Artificial
  CRISPR gRNA sequence
tgtaagtagaagtgtcagat

SEQ ID NO: 110535 - DNA, 20 bp, Artificial
  CRISPR gRNA sequence
cagattcctgtttctggagg

SEQ ID NO: 110536 - DNA, 20 bp, Artificial
  CRISPR gRNA sequence
atctttgtgttaatgatgac

SEQ ID NO: 110537 - DNA, 20 bp, Artificial
  CRISPR gRNA sequence
tgttaatgatgacaactgtt

SEQ ID NO: 110538 - DNA, 20 bp, Artificial
  CRISPR gRNA sequence
aatcctactaccttcaacaa

SEQ ID NO: 110539 - DNA, 20 bp, Artificial
  CRISPR gRNA sequence
ctgtacattttgaaagtcct

SEQ ID NO: 110540 - DNA, 20 bp, Artificial
  CRISPR gRNA sequence
cctccaggtagtggtaccct

SEQ ID NO: 110541 - DNA, 20 bp, Artificial
  CRISPR gRNA sequence
tctcctctcctcatgtctgg

SEQ ID NO: 110542 - DNA, 20 bp, Artificial
  CRISPR gRNA sequence
tgatgctgctaacttgtctt

SEQ ID NO: 110543 - DNA, 20 bp, Artificial
  CRISPR gRNA sequence
gtctttgaggcttataagat

SEQ ID NO: 110544 - DNA, 20 bp, Artificial
  CRISPR gRNA sequence
cccgtatcaactttctgaga

SEQ ID NO: 110545 - DNA, 20 bp, Artificial
  CRISPR gRNA sequence
ctgagaattggatttgacta

SEQ ID NO: 110546 - DNA, 20 bp, Artificial
  CRISPR gRNA sequence
aatggcgtgaacccaggagg

SEQ ID NO: 110547 - DNA, 20 bp, Artificial
  CRISPR gRNA sequence
gaggcagagcttgcagtgag

SEQ ID NO: 110548 - DNA, 20 bp, Artificial
  CRISPR gRNA sequence
cacacataaactaggctagg

SEQ ID NO: 110549 - DNA, 20 bp, Artificial
  CRISPR gRNA sequence
aaaataatcattgcacttgg

SEQ ID NO: 110550 - DNA, 20 bp, Artificial
  CRISPR gRNA sequence
gttaatctcttgttaactgc

SEQ ID NO: 110551 - DNA, 20 bp, Artificial
  CRISPR gRNA sequence
ctgtcttattactagatctg

SEQ ID NO: 110552 - DNA, 20 bp, Artificial
  CRISPR gRNA sequence
cttggttaggcagaagcagg

SEQ ID NO: 110553 - DNA, 20 bp, Artificial
  CRISPR gRNA sequence
actctatttttgagaaattg

SEQ ID NO: 110554 - DNA, 20 bp, Artificial
  CRISPR gRNA sequence
ttttccctccattgaattag

SEQ ID NO: 110555 - DNA, 20 bp, Artificial
  CRISPR gRNA sequence
acccctacccctgccaccaa

SEQ ID NO: 110556 - DNA, 20 bp, Artificial
  CRISPR gRNA sequence
ataaattaagccgaaagaaa

SEQ ID NO: 110557 - DNA, 20 bp, Artificial
  CRISPR gRNA sequence
gtgttcaaatctcacagtcc

SEQ ID NO: 110558 - DNA, 20 bp, Artificial
  CRISPR gRNA sequence
ctcacagtccaacagcttgt

SEQ ID NO: 110559 - DNA, 20 bp, Artificial
  CRISPR gRNA sequence
caacagcttgttaatgtttt

SEQ ID NO: 110560 - DNA, 20 bp, Artificial
  CRISPR gRNA sequence
agcttgttaatgtttttcat

SEQ ID NO: 110561 - DNA, 20 bp, Artificial
  CRISPR gRNA sequence
actcatatataaaacagtat

SEQ ID NO: 110562 - DNA, 20 bp, Artificial
  CRISPR gRNA sequence
atgtaacatgctcttaactg

SEQ ID NO: 110563 - DNA, 20 bp, Artificial
  CRISPR gRNA sequence
atgctcttaactgtatggct

SEQ ID NO: 110564 - DNA, 20 bp, Artificial
  CRISPR gRNA sequence
taatagctgtatcttaaaac

SEQ ID NO: 110565 - DNA, 20 bp, Artificial
  CRISPR gRNA sequence
aaacttgtgtttcctactta

SEQ ID NO: 110566 - DNA, 20 bp, Artificial
  CRISPR gRNA sequence
tagaaacctttcctctaggg

SEQ ID NO: 110567 - DNA, 20 bp, Artificial
  CRISPR gRNA sequence
gcaagcatttggtgtagcaa

SEQ ID NO: 110568 - DNA, 20 bp, Artificial
  CRISPR gRNA sequence
catttggtgtagcaaagggg

SEQ ID NO: 110569 - DNA, 20 bp, Artificial
  CRISPR gRNA sequence
taaagtaaaggttctcaatg

SEQ ID NO: 110570 - DNA, 20 bp, Artificial
  CRISPR gRNA sequence
aatggacagtttaacaaaac

SEQ ID NO: 110571 - DNA, 20 bp, Artificial
  CRISPR gRNA sequence
acttaggatttcaatgttcc

SEQ ID NO: 110572 - DNA, 20 bp, Artificial
  CRISPR gRNA sequence
ggcagtggcggcggtggtgg

SEQ ID NO: 110573 - DNA, 20 bp, Artificial
  CRISPR gRNA sequence
tggactattccatggatcat

SEQ ID NO: 110574 - DNA, 20 bp, Artificial
  CRISPR gRNA sequence
ttacttctaaagcactttta

SEQ ID NO: 110575 - DNA, 20 bp, Artificial
  CRISPR gRNA sequence
gtgacctggctcctacagta

SEQ ID NO: 110576 - DNA, 20 bp, Artificial
  CRISPR gRNA sequence
acagtagtctgtttactcat

SEQ ID NO: 110577 - DNA, 20 bp, Artificial
  CRISPR gRNA sequence
tgtgtaatttcaatatttgt

SEQ ID NO: 110578 - DNA, 20 bp, Artificial
  CRISPR gRNA sequence
gagactgcaaactgaccaga

SEQ ID NO: 110579 - DNA, 20 bp, Artificial
  CRISPR gRNA sequence
cttttaagaaatctttagta

SEQ ID NO: 110580 - DNA, 20 bp, Artificial
  CRISPR gRNA sequence
gtatacatttgacatttcat

SEQ ID NO: 110581 - DNA, 20 bp, Artificial
  CRISPR gRNA sequence
aaaaaagggtcatcctctac

SEQ ID NO: 110582 - DNA, 20 bp, Artificial
  CRISPR gRNA sequence
tcctctacataagcttccag

SEQ ID NO: 110583 - DNA, 20 bp, Artificial
  CRISPR gRNA sequence
ctcctagagtcattgctggg

SEQ ID NO: 110584 - DNA, 20 bp, Artificial
  CRISPR gRNA sequence
tagagtcattgctgggtaca

SEQ ID NO: 110585 - DNA, 20 bp, Artificial
  CRISPR gRNA sequence
agccttcactacagaccatt

SEQ ID NO: 110586 - DNA, 20 bp, Artificial
  CRISPR gRNA sequence
tcactacagaccattcctgg

SEQ ID NO: 110587 - DNA, 20 bp, Artificial
  CRISPR gRNA sequence
acaggcaactaaccttgcca

SEQ ID NO: 110588 - DNA, 20 bp, Artificial
  CRISPR gRNA sequence
ctaaccttgccattatgatt

SEQ ID NO: 110589 - DNA, 20 bp, Artificial
  CRISPR gRNA sequence
cattatgattaaatgtttgt

SEQ ID NO: 110590 - DNA, 20 bp, Artificial
  CRISPR gRNA sequence
atgtttgtcatggatttagc

SEQ ID NO: 110591 - DNA, 20 bp, Artificial
  CRISPR gRNA sequence
ttatgtctgaccttaaagta

SEQ ID NO: 110592 - DNA, 20 bp, Artificial
  CRISPR gRNA sequence
attgagcttggcatttagta

SEQ ID NO: 110593 - DNA, 20 bp, Artificial
  CRISPR gRNA sequence
gcaaggcagcagaatagttc

SEQ ID NO: 110594 - DNA, 20 bp, Artificial
  CRISPR gRNA sequence
ggtcaaaccatcatgcaagt

SEQ ID NO: 110595 - DNA, 20 bp, Artificial
  CRISPR gRNA sequence
aagtacctgtttctggaaca

SEQ ID NO: 110596 - DNA, 20 bp, Artificial
  CRISPR gRNA sequence
attgagcagtatatcagagg

SEQ ID NO: 110597 - DNA, 20 bp, Artificial
  CRISPR gRNA sequence
tcagaggagaggtttcaaag

SEQ ID NO: 110598 - DNA, 20 bp, Artificial
  CRISPR gRNA sequence
tgataattgatattgcattt

SEQ ID NO: 110599 - DNA, 20 bp, Artificial
  CRISPR gRNA sequence
ctaacccacattttgcattc

SEQ ID NO: 110600 - DNA, 20 bp, Artificial
  CRISPR gRNA sequence
agtatatgaagaggttagaa

SEQ ID NO: 110601 - DNA, 20 bp, Artificial
  CRISPR gRNA sequence
tatagaaaggataaataaaa

SEQ ID NO: 110602 - DNA, 20 bp, Artificial
  CRISPR gRNA sequence
gaaaggataaataaaatcta

SEQ ID NO: 110603 - DNA, 20 bp, Artificial
  CRISPR gRNA sequence
acaggtaaatccagttgaaa

SEQ ID NO: 110604 - DNA, 20 bp, Artificial
  CRISPR gRNA sequence
aaaagtaagcaaagatgtag

SEQ ID NO: 110605 - DNA, 20 bp, Artificial
  CRISPR gRNA sequence
gaggcggaggttgcagtaag

SEQ ID NO: 110606 - DNA, 20 bp, Artificial
  CRISPR gRNA sequence
actccaggctgggcaccaga

SEQ ID NO: 110607 - DNA, 20 bp, Artificial
  CRISPR gRNA sequence
attctgtctcaaaaaaaaag

SEQ ID NO: 110608 - DNA, 20 bp, Artificial
  CRISPR gRNA sequence
ataaccaaccccccatgagt

SEQ ID NO: 110609 - DNA, 20 bp, Artificial
  CRISPR gRNA sequence
aactattagttactctatct

SEQ ID NO: 110610 - DNA, 20 bp, Artificial
  CRISPR gRNA sequence
ttactctatctaaatgttta

SEQ ID NO: 110611 - DNA, 20 bp, Artificial
  CRISPR gRNA sequence
tacagcagtcatattaatgt

SEQ ID NO: 110612 - DNA, 20 bp, Artificial
  CRISPR gRNA sequence
tgtactttttgtgtattctt

SEQ ID NO: 110613 - DNA, 20 bp, Artificial
  CRISPR gRNA sequence
attgtaccatgcatgtgggg

SEQ ID NO: 110614 - DNA, 20 bp, Artificial
  CRISPR gRNA sequence
tctaatttataaaatatagt

SEQ ID NO: 110615 - DNA, 20 bp, Artificial
  CRISPR gRNA sequence
tataaaatatagttaaggat

SEQ ID NO: 110616 - DNA, 20 bp, Artificial
  CRISPR gRNA sequence
gtaggtaaacatttgggcac

SEQ ID NO: 110617 - DNA, 20 bp, Artificial
  CRISPR gRNA sequence
tgaattctcaggataatttc

SEQ ID NO: 110618 - DNA, 20 bp, Artificial
  CRISPR gRNA sequence
tcaggataatttctttggat

SEQ ID NO: 110619 - DNA, 20 bp, Artificial
  CRISPR gRNA sequence
gataatttctttggattggg

SEQ ID NO: 110620 - DNA, 20 bp, Artificial
  CRISPR gRNA sequence
ttgccaagatagaattgtac

SEQ ID NO: 110621 - DNA, 20 bp, Artificial
  CRISPR gRNA sequence
gaattgtacttgggattaaa

SEQ ID NO: 110622 - DNA, 20 bp, Artificial
  CRISPR gRNA sequence
tttctctttgcataaatata

SEQ ID NO: 110623 - DNA, 20 bp, Artificial
  CRISPR gRNA sequence
gctttaaatatcttttcagc

SEQ ID NO: 110624 - DNA, 20 bp, Artificial
  CRISPR gRNA sequence
atcttttcagcatgtgcttt

SEQ ID NO: 110625 - DNA, 20 bp, Artificial
  CRISPR gRNA sequence
tatcctttctgttcttctct

SEQ ID NO: 110626 - DNA, 20 bp, Artificial
  CRISPR gRNA sequence
tatactgtgagtgtagtggt

SEQ ID NO: 110627 - DNA, 20 bp, Artificial
  CRISPR gRNA sequence
cttggccaagttatttaatt

SEQ ID NO: 110628 - DNA, 20 bp, Artificial
  CRISPR gRNA sequence
gttcattctagctctaaatt

SEQ ID NO: 110629 - DNA, 20 bp, Artificial
  CRISPR gRNA sequence
tctaaattctgtgattttta

SEQ ID NO: 110630 - DNA, 20 bp, Artificial
  CRISPR gRNA sequence
gaaccttcaaatagttattt

SEQ ID NO: 110631 - DNA, 20 bp, Artificial
  CRISPR gRNA sequence
acgtaaataaagctctctag

SEQ ID NO: 110632 - DNA, 20 bp, Artificial
  CRISPR gRNA sequence
atagcctcccttacaatact

SEQ ID NO: 110633 - DNA, 20 bp, Artificial
  CRISPR gRNA sequence
ggctttaatcccctttgtat

SEQ ID NO: 110634 - DNA, 20 bp, Artificial
  CRISPR gRNA sequence
tctctattttagaatcctag

SEQ ID NO: 110635 - DNA, 20 bp, Artificial
  CRISPR gRNA sequence
tgaaaaattctgcatataat

SEQ ID NO: 110636 - DNA, 20 bp, Artificial
  CRISPR gRNA sequence
gaagaatgatacagaaaaga

SEQ ID NO: 110637 - DNA, 20 bp, Artificial
  CRISPR gRNA sequence
attttaaaaaatatttgcta

SEQ ID NO: 110638 - DNA, 20 bp, Artificial
  CRISPR gRNA sequence
gatatttttaatacatacaa

SEQ ID NO: 110639 - DNA, 20 bp, Artificial
  CRISPR gRNA sequence
gtattcagaatatgtataaa

SEQ ID NO: 110640 - DNA, 20 bp, Artificial
  CRISPR gRNA sequence
tggttcacataaccagataa

SEQ ID NO: 110641 - DNA, 20 bp, Artificial
  CRISPR gRNA sequence
ctaagacatggaacccattg

SEQ ID NO: 110642 - DNA, 20 bp, Artificial
  CRISPR gRNA sequence
tgaagcaatgctcaaataaa

SEQ ID NO: 110643 - DNA, 20 bp, Artificial
  CRISPR gRNA sequence
acttagtactagccatgtat

SEQ ID NO: 110644 - DNA, 20 bp, Artificial
  CRISPR gRNA sequence
ctagccatgtattctggctt

SEQ ID NO: 110645 - DNA, 20 bp, Artificial
  CRISPR gRNA sequence
ttgagctatggggctctcct

SEQ ID NO: 110646 - DNA, 20 bp, Artificial
  CRISPR gRNA sequence
tgttcactagttatatgaaa

SEQ ID NO: 110647 - DNA, 20 bp, Artificial
  CRISPR gRNA sequence
caacatttaaagggttgtat

SEQ ID NO: 110648 - DNA, 20 bp, Artificial
  CRISPR gRNA sequence
aaaatttagagaaatatttt

SEQ ID NO: 110649 - DNA, 20 bp, Artificial
  CRISPR gRNA sequence
aatatttttcaagcttcttg

SEQ ID NO: 110650 - DNA, 20 bp, Artificial
  CRISPR gRNA sequence
ccattaaaaaaaagaaagaa

SEQ ID NO: 110651 - DNA, 20 bp, Artificial
  CRISPR gRNA sequence
gatttggatagcacacgatc

SEQ ID NO: 110652 - DNA, 20 bp, Artificial
  CRISPR gRNA sequence
cacgatcccttgctttccat

SEQ ID NO: 110653 - DNA, 20 bp, Artificial
  CRISPR gRNA sequence
tgctttccataattgcttta

SEQ ID NO: 110654 - DNA, 20 bp, Artificial
  CRISPR gRNA sequence
aacaaattatcctagaagtt

SEQ ID NO: 110655 - DNA, 20 bp, Artificial
  CRISPR gRNA sequence
aatggcatgaacccaggagg

SEQ ID NO: 110656 - DNA, 20 bp, Artificial
  CRISPR gRNA sequence
aaaaaaaaaaaaatttattt

SEQ ID NO: 110657 - DNA, 20 bp, Artificial
  CRISPR gRNA sequence
aggaatcctgacacagctgt

SEQ ID NO: 110658 - DNA, 20 bp, Artificial
  CRISPR gRNA sequence
tgactagagtagaatacatt

SEQ ID NO: 110659 - DNA, 20 bp, Artificial
  CRISPR gRNA sequence
gaatacattttgggtttttt

SEQ ID NO: 110660 - DNA, 20 bp, Artificial
  CRISPR gRNA sequence
acattttgggttttttcttt

SEQ ID NO: 110661 - DNA, 20 bp, Artificial
  CRISPR gRNA sequence
tttgtatttttcagtagata

SEQ ID NO: 110662 - DNA, 20 bp, Artificial
  CRISPR gRNA sequence
cgcctcagcctcctgaagtg

SEQ ID NO: 110663 - DNA, 20 bp, Artificial
  CRISPR gRNA sequence
tatgggcataagccattgta

SEQ ID NO: 110664 - DNA, 20 bp, Artificial
  CRISPR gRNA sequence
cttcatcattcaccaaaatg

SEQ ID NO: 110665 - DNA, 20 bp, Artificial
  CRISPR gRNA sequence
gcaacctccgcctccggttc

SEQ ID NO: 110666 - DNA, 20 bp, Artificial
  CRISPR gRNA sequence
ggcctcagtctcccaagtag

SEQ ID NO: 110667 - DNA, 20 bp, Artificial
  CRISPR gRNA sequence
ctttgtatttttagtagaga

SEQ ID NO: 110668 - DNA, 20 bp, Artificial
  CRISPR gRNA sequence
cacctcggccttccaaagtg

SEQ ID NO: 110669 - DNA, 20 bp, Artificial
  CRISPR gRNA sequence
ccagagtgtattttaaatat

SEQ ID NO: 110670 - DNA, 20 bp, Artificial
  CRISPR gRNA sequence
ctatctttcataaaaaccga

SEQ ID NO: 110671 - DNA, 20 bp, Artificial
  CRISPR gRNA sequence
agacagtgtcgaaattccct

SEQ ID NO: 110672 - DNA, 20 bp, Artificial
  CRISPR gRNA sequence
tttttcctcttcagaacatt

SEQ ID NO: 110673 - DNA, 20 bp, Artificial
  CRISPR gRNA sequence
gctctgtcacacaggagcaa

SEQ ID NO: 110674 - DNA, 20 bp, Artificial
  CRISPR gRNA sequence
ctcgggaggctgaggcagag

SEQ ID NO: 110675 - DNA, 20 bp, Artificial
  CRISPR gRNA sequence
gaggcggaggttgcagtgag

SEQ ID NO: 110676 - DNA, 20 bp, Artificial
  CRISPR gRNA sequence
ttatttcctccagacacagc

SEQ ID NO: 110677 - DNA, 20 bp, Artificial
  CRISPR gRNA sequence
ccagcaaggtaagtgtaccc

SEQ ID NO: 110678 - DNA, 20 bp, Artificial
  CRISPR gRNA sequence
tattttttggacaaaaaaaa

SEQ ID NO: 110679 - DNA, 20 bp, Artificial
  CRISPR gRNA sequence
aaagatttcctctagctctc

SEQ ID NO: 110680 - DNA, 20 bp, Artificial
  CRISPR gRNA sequence
cctctagctctccattgatt

SEQ ID NO: 110681 - DNA, 20 bp, Artificial
  CRISPR gRNA sequence
ttgtcaccatctgtgaccaa

SEQ ID NO: 110682 - DNA, 20 bp, Artificial
  CRISPR gRNA sequence
ccaacagtgattccatgtgt

SEQ ID NO: 110683 - DNA, 20 bp, Artificial
  CRISPR gRNA sequence
ttctatagtggttgctaatc

SEQ ID NO: 110684 - DNA, 20 bp, Artificial
  CRISPR gRNA sequence
gttgctaatctagggattgt

SEQ ID NO: 110685 - DNA, 20 bp, Artificial
  CRISPR gRNA sequence
tgtgtaagcttttagggaag

SEQ ID NO: 110686 - DNA, 20 bp, Artificial
  CRISPR gRNA sequence
agaaatagatcaaaaatcaa

SEQ ID NO: 110687 - DNA, 20 bp, Artificial
  CRISPR gRNA sequence
agttggctttagagtgctat

SEQ ID NO: 110688 - DNA, 20 bp, Artificial
  CRISPR gRNA sequence
ctttagagtgctattgctgc

SEQ ID NO: 110689 - DNA, 20 bp, Artificial
  CRISPR gRNA sequence
gaatagataacataaataat

SEQ ID NO: 110690 - DNA, 20 bp, Artificial
  CRISPR gRNA sequence
ggagtgcagaaactgaactt

SEQ ID NO: 110691 - DNA, 20 bp, Artificial
  CRISPR gRNA sequence
aatcaaaaaaggacatcttt

SEQ ID NO: 110692 - DNA, 20 bp, Artificial
  CRISPR gRNA sequence
ctttgttagattccatgact

SEQ ID NO: 110693 - DNA, 20 bp, Artificial
  CRISPR gRNA sequence
ttactccagggaggccctga

SEQ ID NO: 110694 - DNA, 20 bp, Artificial
  CRISPR gRNA sequence
attgatagtctggggacttg

SEQ ID NO: 110695 - DNA, 20 bp, Artificial
  CRISPR gRNA sequence
tagtctggggacttggaatg

SEQ ID NO: 110696 - DNA, 20 bp, Artificial
  CRISPR gRNA sequence
ttggaatgcttggtttaatt

SEQ ID NO: 110697 - DNA, 20 bp, Artificial
  CRISPR gRNA sequence
aatactacaactgactcatt

SEQ ID NO: 110698 - DNA, 20 bp, Artificial
  CRISPR gRNA sequence
cagtttgagataaacaaagt

SEQ ID NO: 110699 - DNA, 20 bp, Artificial
  CRISPR gRNA sequence
ttttaaaatctctgtcctga

SEQ ID NO: 110700 - DNA, 20 bp, Artificial
  CRISPR gRNA sequence
ctagacagttaatagaattt

SEQ ID NO: 110701 - DNA, 20 bp, Artificial
  CRISPR gRNA sequence
agttaatagaatttcaaaga

SEQ ID NO: 110702 - DNA, 20 bp, Artificial
  CRISPR gRNA sequence
aatttcaaagattgtgatta

SEQ ID NO: 110703 - DNA, 20 bp, Artificial
  CRISPR gRNA sequence
ggagagtactttttctcccc

SEQ ID NO: 110704 - DNA, 20 bp, Artificial
  CRISPR gRNA sequence
ttctccccttgtgtttttca

SEQ ID NO: 110705 - DNA, 20 bp, Artificial
  CRISPR gRNA sequence
cccttctttctgttctgtgt

SEQ ID NO: 110706 - DNA, 20 bp, Artificial
  CRISPR gRNA sequence
ttctgttctgtgtgcctgtt

SEQ ID NO: 110707 - DNA, 20 bp, Artificial
  CRISPR gRNA sequence
gttctgtgtgcctgtttttt

SEQ ID NO: 110708 - DNA, 20 bp, Artificial
  CRISPR gRNA sequence
gtgcctgttttttgtttgtt

SEQ ID NO: 110709 - DNA, 20 bp, Artificial
  CRISPR gRNA sequence
tgttttttgtttgttttatg

SEQ ID NO: 110710 - DNA, 20 bp, Artificial
  CRISPR gRNA sequence
tgttttcttaaagttacagt

SEQ ID NO: 110711 - DNA, 20 bp, Artificial
  CRISPR gRNA sequence
gcatgatcactatcccagca

SEQ ID NO: 110712 - DNA, 20 bp, Artificial
  CRISPR gRNA sequence
agcagccagtttggcaggag

SEQ ID NO: 110713 - DNA, 20 bp, Artificial
  CRISPR gRNA sequence
catggtaagaaaatgtattt

SEQ ID NO: 110714 - DNA, 20 bp, Artificial
  CRISPR gRNA sequence
aaatttattatgttgacctc

SEQ ID NO: 110715 - DNA, 20 bp, Artificial
  CRISPR gRNA sequence
gagataaagcaatggataaa

SEQ ID NO: 110716 - DNA, 20 bp, Artificial
  CRISPR gRNA sequence
aagaaataagctaaaaatta

SEQ ID NO: 110717 - DNA, 20 bp, Artificial
  CRISPR gRNA sequence
gtaaatgtattgggaagata

SEQ ID NO: 110718 - DNA, 20 bp, Artificial
  CRISPR gRNA sequence
ttgggaggctaatccaggag

SEQ ID NO: 110719 - DNA, 20 bp, Artificial
  CRISPR gRNA sequence
caggaggatggcttaagtcc

SEQ ID NO: 110720 - DNA, 20 bp, Artificial
  CRISPR gRNA sequence
gcctgggcaatgtagagaga

SEQ ID NO: 110721 - DNA, 20 bp, Artificial
  CRISPR gRNA sequence
gaaaaataaataatttttat

SEQ ID NO: 110722 - DNA, 20 bp, Artificial
  CRISPR gRNA sequence
gtggggtacaggactctgtt

SEQ ID NO: 110723 - DNA, 20 bp, Artificial
  CRISPR gRNA sequence
gtttttacctacatttagta

SEQ ID NO: 110724 - DNA, 20 bp, Artificial
  CRISPR gRNA sequence
ctacatttagtacagtgttt

SEQ ID NO: 110725 - DNA, 20 bp, Artificial
  CRISPR gRNA sequence
ttggtgttttttaagaaaaa

SEQ ID NO: 110726 - DNA, 20 bp, Artificial
  CRISPR gRNA sequence
acttggtctatctatttttg

SEQ ID NO: 110727 - DNA, 20 bp, Artificial
  CRISPR gRNA sequence
catgaattagggcatggtta

SEQ ID NO: 110728 - DNA, 20 bp, Artificial
  CRISPR gRNA sequence
tcctatgacacagtcatctg

SEQ ID NO: 110729 - DNA, 20 bp, Artificial
  CRISPR gRNA sequence
atgacacagtcatctggggt

SEQ ID NO: 110730 - DNA, 20 bp, Artificial
  CRISPR gRNA sequence
tggatgaagaggaaccaaga

SEQ ID NO: 110731 - DNA, 20 bp, Artificial
  CRISPR gRNA sequence
acttcatgccaccaataagc

SEQ ID NO: 110732 - DNA, 20 bp, Artificial
  CRISPR gRNA sequence
aatccctctacctggagcag

SEQ ID NO: 110733 - DNA, 20 bp, Artificial
  CRISPR gRNA sequence
acttttgaaattatctttta

SEQ ID NO: 110734 - DNA, 20 bp, Artificial
  CRISPR gRNA sequence
ttgaaattatcttttatatg

SEQ ID NO: 110735 - DNA, 20 bp, Artificial
  CRISPR gRNA sequence
ttataataacgaaaacaaac

SEQ ID NO: 110736 - DNA, 20 bp, Artificial
  CRISPR gRNA sequence
acattttcacagttctcaag

SEQ ID NO: 110737 - DNA, 20 bp, Artificial
  CRISPR gRNA sequence
acagttctcaagacctgttt

SEQ ID NO: 110738 - DNA, 20 bp, Artificial
  CRISPR gRNA sequence
gctagtgtgctgttcatggt

SEQ ID NO: 110739 - DNA, 20 bp, Artificial
  CRISPR gRNA sequence
tgctgttcatggtccaagat

SEQ ID NO: 110740 - DNA, 20 bp, Artificial
  CRISPR gRNA sequence
aacctgcaccttccatgttc

SEQ ID NO: 110741 - DNA, 20 bp, Artificial
  CRISPR gRNA sequence
tgcctcagcctcctgagtag

SEQ ID NO: 110742 - DNA, 20 bp, Artificial
  CRISPR gRNA sequence
tacaggtgtgcgccaccacg

SEQ ID NO: 110743 - DNA, 20 bp, Artificial
  CRISPR gRNA sequence
ccaccacgcccagcttattt

SEQ ID NO: 110744 - DNA, 20 bp, Artificial
  CRISPR gRNA sequence
ttttgtgtttttagtagaga

SEQ ID NO: 110745 - DNA, 20 bp, Artificial
  CRISPR gRNA sequence
tgcctgggcctcccaaagtg

SEQ ID NO: 110746 - DNA, 20 bp, Artificial
  CRISPR gRNA sequence
agccgaggaattcaaggctg

SEQ ID NO: 110747 - DNA, 20 bp, Artificial
  CRISPR gRNA sequence
gcaagggtgtcagagtgaaa

SEQ ID NO: 110748 - DNA, 20 bp, Artificial
  CRISPR gRNA sequence
ggttagctatattacttact

SEQ ID NO: 110749 - DNA, 20 bp, Artificial
  CRISPR gRNA sequence
tacttactaggtgttttctc

SEQ ID NO: 110750 - DNA, 20 bp, Artificial
  CRISPR gRNA sequence
ctggatagtattaatagtta

SEQ ID NO: 110751 - DNA, 20 bp, Artificial
  CRISPR gRNA sequence
aatagttaaatggttttatt

SEQ ID NO: 110752 - DNA, 20 bp, Artificial
  CRISPR gRNA sequence
cacggaagcgtggtgaaggt

SEQ ID NO: 110753 - DNA, 20 bp, Artificial
  CRISPR gRNA sequence
tggatgcaatcttatgtctc

SEQ ID NO: 110754 - DNA, 20 bp, Artificial
  CRISPR gRNA sequence
gggaggctgaggtgggaagc

SEQ ID NO: 110755 - DNA, 20 bp, Artificial
  CRISPR gRNA sequence
cttttcttaattttcaagga

SEQ ID NO: 110756 - DNA, 20 bp, Artificial
  CRISPR gRNA sequence
acaagttttatttttattga

SEQ ID NO: 110757 - DNA, 20 bp, Artificial
  CRISPR gRNA sequence
ccccatcacaaatataattt

SEQ ID NO: 110758 - DNA, 20 bp, Artificial
  CRISPR gRNA sequence
cctggtctaatcctctcttc

SEQ ID NO: 110759 - DNA, 20 bp, Artificial
  CRISPR gRNA sequence
tctaatcctctcttctttgg

SEQ ID NO: 110760 - DNA, 20 bp, Artificial
  CRISPR gRNA sequence
ttggcttagatttataaaat

SEQ ID NO: 110761 - DNA, 20 bp, Artificial
  CRISPR gRNA sequence
tttataaaatagctgcttaa

SEQ ID NO: 110762 - DNA, 20 bp, Artificial
  CRISPR gRNA sequence
atcctagtgtgatcttttta

SEQ ID NO: 110763 - DNA, 20 bp, Artificial
  CRISPR gRNA sequence
tgcacttagactgacatcca

SEQ ID NO: 110764 - DNA, 20 bp, Artificial
  CRISPR gRNA sequence
ctacttcttggtctctatgc

SEQ ID NO: 110765 - DNA, 20 bp, Artificial
  CRISPR gRNA sequence
tatctccctatctgttaggt

SEQ ID NO: 110766 - DNA, 20 bp, Artificial
  CRISPR gRNA sequence
ttctttttttggaggcagtg

SEQ ID NO: 110767 - DNA, 20 bp, Artificial
  CRISPR gRNA sequence
cgccttggcctcccaaagtg

SEQ ID NO: 110768 - DNA, 20 bp, Artificial
  CRISPR gRNA sequence
tatttaagttgttgaatttt

SEQ ID NO: 110769 - DNA, 20 bp, Artificial
  CRISPR gRNA sequence
taagttgttgaatttttcaa

SEQ ID NO: 110770 - DNA, 20 bp, Artificial
  CRISPR gRNA sequence
ctgtaagttgtatagagggt

SEQ ID NO: 110771 - DNA, 20 bp, Artificial
  CRISPR gRNA sequence
aagttgtatagagggtagag

SEQ ID NO: 110772 - DNA, 20 bp, Artificial
  CRISPR gRNA sequence
tactgacttagatgtatttg

SEQ ID NO: 110773 - DNA, 20 bp, Artificial
  CRISPR gRNA sequence
ccagttctgaaccaagcaat

SEQ ID NO: 110774 - DNA, 20 bp, Artificial
  CRISPR gRNA sequence
caatcagtgtttcttgaatt

SEQ ID NO: 110775 - DNA, 20 bp, Artificial
  CRISPR gRNA sequence
acttatacagtacatggtta

SEQ ID NO: 110776 - DNA, 20 bp, Artificial
  CRISPR gRNA sequence
tcaccccctcaacaatcaaa

SEQ ID NO: 110777 - DNA, 20 bp, Artificial
  CRISPR gRNA sequence
gatacttcacagcaatgttg

SEQ ID NO: 110778 - DNA, 20 bp, Artificial
  CRISPR gRNA sequence
tggtgagttcagtaaatgct

SEQ ID NO: 110779 - DNA, 20 bp, Artificial
  CRISPR gRNA sequence
gttccagtcttccatctcca

SEQ ID NO: 110780 - DNA, 20 bp, Artificial
  CRISPR gRNA sequence
tcttccatctccagaaggct

SEQ ID NO: 110781 - DNA, 20 bp, Artificial
  CRISPR gRNA sequence
ttttctcagatcctgcctac

SEQ ID NO: 110782 - DNA, 20 bp, Artificial
  CRISPR gRNA sequence
ggttcttgcggagtgttgca

SEQ ID NO: 110783 - DNA, 20 bp, Artificial
  CRISPR gRNA sequence
ggagtgttgcaaaaagcttc

SEQ ID NO: 110784 - DNA, 20 bp, Artificial
  CRISPR gRNA sequence
cttaagtgagaaacagcata

SEQ ID NO: 110785 - DNA, 20 bp, Artificial
  CRISPR gRNA sequence
aagaagatgaaatgggagtc

SEQ ID NO: 110786 - DNA, 20 bp, Artificial
  CRISPR gRNA sequence
atcactttacccatctggcc

SEQ ID NO: 110787 - DNA, 20 bp, Artificial
  CRISPR gRNA sequence
aaaacgagtacattaaagtg

SEQ ID NO: 110788 - DNA, 20 bp, Artificial
  CRISPR gRNA sequence
acattaaagtgtatagattc

SEQ ID NO: 110789 - DNA, 20 bp, Artificial
  CRISPR gRNA sequence
gtgacaaaaatacagcatga

SEQ ID NO: 110790 - DNA, 20 bp, Artificial
  CRISPR gRNA sequence
gagatacactaacagccctg

SEQ ID NO: 110791 - DNA, 20 bp, Artificial
  CRISPR gRNA sequence
actttaaattattttaagaa

SEQ ID NO: 110792 - DNA, 20 bp, Artificial
  CRISPR gRNA sequence
acttaagatgtattacaagc

SEQ ID NO: 110793 - DNA, 20 bp, Artificial
  CRISPR gRNA sequence
tagtgagagccatgagttcc

SEQ ID NO: 110794 - DNA, 20 bp, Artificial
  CRISPR gRNA sequence
tgtgatggagctgatcaagg

SEQ ID NO: 110795 - DNA, 20 bp, Artificial
  CRISPR gRNA sequence
ttactacaggacagaaacca

SEQ ID NO: 110796 - DNA, 20 bp, Artificial
  CRISPR gRNA sequence
tgttgatgacattgacattt

SEQ ID NO: 110797 - DNA, 20 bp, Artificial
  CRISPR gRNA sequence
ctcacactgactaactgaat

SEQ ID NO: 110798 - DNA, 20 bp, Artificial
  CRISPR gRNA sequence
atggacgctttgtattcaga

SEQ ID NO: 110799 - DNA, 20 bp, Artificial
  CRISPR gRNA sequence
tacattgccgaatctctttt

SEQ ID NO: 110800 - DNA, 20 bp, Artificial
  CRISPR gRNA sequence
tctagctttgaaaagttgtg

SEQ ID NO: 110801 - DNA, 20 bp, Artificial
  CRISPR gRNA sequence
acttctttgctgaagcactg

SEQ ID NO: 110802 - DNA, 20 bp, Artificial
  CRISPR gRNA sequence
tcctaaaggaagggccaaac

SEQ ID NO: 110803 - DNA, 20 bp, Artificial
  CRISPR gRNA sequence
gtgacagcatttggggaact

SEQ ID NO: 110804 - DNA, 20 bp, Artificial
  CRISPR gRNA sequence
tttggggaactaaaagattc

SEQ ID NO: 110805 - DNA, 20 bp, Artificial
  CRISPR gRNA sequence
tacccgtatgttatcataga

SEQ ID NO: 110806 - DNA, 20 bp, Artificial
  CRISPR gRNA sequence
aagcactgaaaggaagaagc

SEQ ID NO: 110807 - DNA, 20 bp, Artificial
  CRISPR gRNA sequence
acagagtccaagttacccac

SEQ ID NO: 110808 - DNA, 20 bp, Artificial
  CRISPR gRNA sequence
cactaaagcttgaggtggat

SEQ ID NO: 110809 - DNA, 20 bp, Artificial
  CRISPR gRNA sequence
attttcattcttcccatggc

SEQ ID NO: 110810 - DNA, 20 bp, Artificial
  CRISPR gRNA sequence
atggcagctgattctttggt

SEQ ID NO: 110811 - DNA, 20 bp, Artificial
  CRISPR gRNA sequence
tgattctttggtgccagttt

SEQ ID NO: 110812 - DNA, 20 bp, Artificial
  CRISPR gRNA sequence
tctccataggccttgtgcag

SEQ ID NO: 110813 - DNA, 20 bp, Artificial
  CRISPR gRNA sequence
aaaattggttcttctttgac

SEQ ID NO: 110814 - DNA, 20 bp, Artificial
  CRISPR gRNA sequence
tctaaaaacaccacaaagag

SEQ ID NO: 110815 - DNA, 20 bp, Artificial
  CRISPR gRNA sequence
ccagggatctggtaatcgct

SEQ ID NO: 110816 - DNA, 20 bp, Artificial
  CRISPR gRNA sequence
ctagaaacttctagctctac

SEQ ID NO: 110817 - DNA, 20 bp, Artificial
  CRISPR gRNA sequence
ttaatgttattcagtaagtc

SEQ ID NO: 110818 - DNA, 20 bp, Artificial
  CRISPR gRNA sequence
aagtcccaagtttttcagag

SEQ ID NO: 110819 - DNA, 20 bp, Artificial
  CRISPR gRNA sequence
aattactcagacctaacttt

SEQ ID NO: 110820 - DNA, 20 bp, Artificial
  CRISPR gRNA sequence
gatgctatttatttgtgtct

SEQ ID NO: 110821 - DNA, 20 bp, Artificial
  CRISPR gRNA sequence
tggggggagatgactttgaa

SEQ ID NO: 110822 - DNA, 20 bp, Artificial
  CRISPR gRNA sequence
atgactttgaattttgtttg

SEQ ID NO: 110823 - DNA, 20 bp, Artificial
  CRISPR gRNA sequence
gtgggggcagggtattgaca

SEQ ID NO: 110824 - DNA, 20 bp, Artificial
  CRISPR gRNA sequence
agtgaatggatgaatgaata

SEQ ID NO: 110825 - DNA, 20 bp, Artificial
  CRISPR gRNA sequence
aatgcctagttatgcaactt

SEQ ID NO: 110826 - DNA, 20 bp, Artificial
  CRISPR gRNA sequence
tagggtgcctgataataatg

SEQ ID NO: 110827 - DNA, 20 bp, Artificial
  CRISPR gRNA sequence
aataatgtcttgatttttct

SEQ ID NO: 110828 - DNA, 20 bp, Artificial
  CRISPR gRNA sequence
ctttgggattcaactatatc

SEQ ID NO: 110829 - DNA, 20 bp, Artificial
  CRISPR gRNA sequence
ggaatctgcaactcctgggt

SEQ ID NO: 110830 - DNA, 20 bp, Artificial
  CRISPR gRNA sequence
tgcaactcctgggttctagt

SEQ ID NO: 110831 - DNA, 20 bp, Artificial
  CRISPR gRNA sequence
aacttgtaatgtctgagcct

SEQ ID NO: 110832 - DNA, 20 bp, Artificial
  CRISPR gRNA sequence
ttggcccttccaccctgttg

SEQ ID NO: 110833 - DNA, 20 bp, Artificial
  CRISPR gRNA sequence
acatttgatgctactactga

SEQ ID NO: 110834 - DNA, 20 bp, Artificial
  CRISPR gRNA sequence
aggtagtgaagatgtactat

SEQ ID NO: 110835 - DNA, 20 bp, Artificial
  CRISPR gRNA sequence
agatgtactatttacgtttt

SEQ ID NO: 110836 - DNA, 20 bp, Artificial
  CRISPR gRNA sequence
actatttacgttttgttaga

SEQ ID NO: 110837 - DNA, 20 bp, Artificial
  CRISPR gRNA sequence
agaccaaaacaaaagtactt

SEQ ID NO: 110838 - DNA, 20 bp, Artificial
  CRISPR gRNA sequence
ccacagcatgctcaccttgt

SEQ ID NO: 110839 - DNA, 20 bp, Artificial
  CRISPR gRNA sequence
gaaaagcactgacagtattt

SEQ ID NO: 110840 - DNA, 20 bp, Artificial
  CRISPR gRNA sequence
atttgatagctttagtcaaa

SEQ ID NO: 110841 - DNA, 20 bp, Artificial
  CRISPR gRNA sequence
tagctttagtcaaactgtgc

SEQ ID NO: 110842 - DNA, 20 bp, Artificial
  CRISPR gRNA sequence
ttagtcaaactgtgcttgag

SEQ ID NO: 110843 - DNA, 20 bp, Artificial
  CRISPR gRNA sequence
caaactgtgcttgagtttgg

SEQ ID NO: 110844 - DNA, 20 bp, Artificial
  CRISPR gRNA sequence
ttaccaaattcagagatgac

SEQ ID NO: 110845 - DNA, 20 bp, Artificial
  CRISPR gRNA sequence
ctcgatatttatctcacacc

SEQ ID NO: 110846 - DNA, 20 bp, Artificial
  CRISPR gRNA sequence
cgtaggagcgtcttcgcctc

SEQ ID NO: 110847 - DNA, 20 bp, Artificial
  CRISPR gRNA sequence
cccccgtttccagtagaaaa

SEQ ID NO: 110848 - DNA, 20 bp, Artificial
  CRISPR gRNA sequence
ggtggtggggcggcgactga

SEQ ID NO: 110849 - DNA, 20 bp, Artificial
  CRISPR gRNA sequence
ggggcggcgactgaagtcgc

SEQ ID NO: 110850 - DNA, 20 bp, Artificial
  CRISPR gRNA sequence
cgttgtcccaaggaagcctg

SEQ ID NO: 110851 - DNA, 20 bp, Artificial
  CRISPR gRNA sequence
gcctccaatagagcctgcta

SEQ ID NO: 110852 - DNA, 20 bp, Artificial
  CRISPR gRNA sequence
ttggctgctacgcggctggg

SEQ ID NO: 110853 - DNA, 20 bp, Artificial
  CRISPR gRNA sequence
cgcctctgtggcctgtggag

SEQ ID NO: 110854 - DNA, 20 bp, Artificial
  CRISPR gRNA sequence
tgtggaggcccgcttggcgg

SEQ ID NO: 110855 - DNA, 20 bp, Artificial
  CRISPR gRNA sequence
tagcctcccgcgagctaagg

SEQ ID NO: 110856 - DNA, 20 bp, Artificial
  CRISPR gRNA sequence
ggcacagtttaacttcgtgc

SEQ ID NO: 110857 - DNA, 20 bp, Artificial
  CRISPR gRNA sequence
ccttaggaaactttgagtat

SEQ ID NO: 110858 - DNA, 20 bp, Artificial
  CRISPR gRNA sequence
atgaaattgaaactcagagg

SEQ ID NO: 110859 - DNA, 20 bp, Artificial
  CRISPR gRNA sequence
gatttttacaggaccacgcc

SEQ ID NO: 110860 - DNA, 20 bp, Artificial
  CRISPR gRNA sequence
gaccacgccccgggctttga

SEQ ID NO: 110861 - DNA, 20 bp, Artificial
  CRISPR gRNA sequence
cgagcattttctattaagcg

SEQ ID NO: 110862 - DNA, 20 bp, Artificial
  CRISPR gRNA sequence
ccagacatgaggagggatcc

SEQ ID NO: 110863 - DNA, 20 bp, Artificial
  CRISPR gRNA sequence
ggaagcagagagggtggtcc

SEQ ID NO: 110864 - DNA, 20 bp, Artificial
  CRISPR gRNA sequence
cagcaaccaacctggccctt

SEQ ID NO: 110865 - DNA, 20 bp, Artificial
  CRISPR gRNA sequence
gttaatggataaaggaatta

SEQ ID NO: 110866 - DNA, 20 bp, Artificial
  CRISPR gRNA sequence
gaattactcagcttgaaggg

SEQ ID NO: 110867 - DNA, 20 bp, Artificial
  CRISPR gRNA sequence
gtgtggggagaaaggggcca

SEQ ID NO: 110868 - DNA, 20 bp, Artificial
  CRISPR gRNA sequence
ggagaaaggggccaaaaagt

SEQ ID NO: 110869 - DNA, 20 bp, Artificial
  CRISPR gRNA sequence
tttggagttaacatcgtaat

SEQ ID NO: 110870 - DNA, 20 bp, Artificial
  CRISPR gRNA sequence
gtaatttctgctttgttggt

SEQ ID NO: 110871 - DNA, 20 bp, Artificial
  CRISPR gRNA sequence
aggtgtggtgctgggctcct

SEQ ID NO: 110872 - DNA, 20 bp, Artificial
  CRISPR gRNA sequence
ttcctttagcatcattcatc

SEQ ID NO: 110873 - DNA, 20 bp, Artificial
  CRISPR gRNA sequence
tgatcctgtgaggaaggaat

SEQ ID NO: 110874 - DNA, 20 bp, Artificial
  CRISPR gRNA sequence
atcaaaatataataataaaa

SEQ ID NO: 110875 - DNA, 20 bp, Artificial
  CRISPR gRNA sequence
gtcaatagaatgtgagactg

SEQ ID NO: 110876 - DNA, 20 bp, Artificial
  CRISPR gRNA sequence
tagcagataataggcaaagg

SEQ ID NO: 110877 - DNA, 20 bp, Artificial
  CRISPR gRNA sequence
taaaggaatgaccctttggt

SEQ ID NO: 110878 - DNA, 20 bp, Artificial
  CRISPR gRNA sequence
tgtaataactgaagatatgg

SEQ ID NO: 110879 - DNA, 20 bp, Artificial
  CRISPR gRNA sequence
ggaatccaaaggaccaccct

SEQ ID NO: 110880 - DNA, 20 bp, Artificial
  CRISPR gRNA sequence
cgaataaaataattgaaaca

SEQ ID NO: 110881 - DNA, 20 bp, Artificial
  CRISPR gRNA sequence
tcctgtaaaaatcctttcct

SEQ ID NO: 110882 - DNA, 20 bp, Artificial
  CRISPR gRNA sequence
cacgctaaaacgaagatact

SEQ ID NO: 110883 - DNA, 20 bp, Artificial
  CRISPR gRNA sequence
ctgtaaccgtcgaggcctcc

SEQ ID NO: 110884 - DNA, 20 bp, Artificial
  CRISPR gRNA sequence
cgagctcgggttcccatccc

SEQ ID NO: 110885 - DNA, 20 bp, Artificial
  CRISPR gRNA sequence
cctgccgccgatcaatccgc

SEQ ID NO: 110886 - DNA, 20 bp, Artificial
  CRISPR gRNA sequence
ggggctggaggtgcggcggt

SEQ ID NO: 110887 - DNA, 20 bp, Artificial
  CRISPR gRNA sequence
aaatctaagccaaactcaag

SEQ ID NO: 110888 - DNA, 20 bp, Artificial
  CRISPR gRNA sequence
ctaaagctatcaaatactgt

SEQ ID NO: 110889 - DNA, 20 bp, Artificial
  CRISPR gRNA sequence
agtgcttttccttcattgtg

SEQ ID NO: 110890 - DNA, 20 bp, Artificial
  CRISPR gRNA sequence
ggtctactgctctcatcatt

SEQ ID NO: 110891 - DNA, 20 bp, Artificial
  CRISPR gRNA sequence
catcattgagtgcttcctcg

SEQ ID NO: 110892 - DNA, 20 bp, Artificial
  CRISPR gRNA sequence
tgtgttgataatggcatatc

SEQ ID NO: 110893 - DNA, 20 bp, Artificial
  CRISPR gRNA sequence
tatcggaggcttctagtctt

SEQ ID NO: 110894 - DNA, 20 bp, Artificial
  CRISPR gRNA sequence
gaggcttctagtctttgttg

SEQ ID NO: 110895 - DNA, 20 bp, Artificial
  CRISPR gRNA sequence
cagtaacaaggtgagcatgc

SEQ ID NO: 110896 - DNA, 20 bp, Artificial
  CRISPR gRNA sequence
tttaacaatcagaaaagtac

SEQ ID NO: 110897 - DNA, 20 bp, Artificial
  CRISPR gRNA sequence
tgaaattctacaatacttaa

SEQ ID NO: 110898 - DNA, 20 bp, Artificial
  CRISPR gRNA sequence
agctaagaggctcagacatt

SEQ ID NO: 110899 - DNA, 20 bp, Artificial
  CRISPR gRNA sequence
ctcagacattacaagtttga

SEQ ID NO: 110900 - DNA, 20 bp, Artificial
  CRISPR gRNA sequence
acaaactagaacccaggagt

SEQ ID NO: 110901 - DNA, 20 bp, Artificial
  CRISPR gRNA sequence
aatagcatcttctaactgtt

SEQ ID NO: 110902 - DNA, 20 bp, Artificial
  CRISPR gRNA sequence
tcccaaactcttgtagagct

SEQ ID NO: 110903 - DNA, 20 bp, Artificial
  CRISPR gRNA sequence
tgtagagctagaagtttcta

SEQ ID NO: 110904 - DNA, 20 bp, Artificial
  CRISPR gRNA sequence
ctttgacatctggaagccag

SEQ ID NO: 110905 - DNA, 20 bp, Artificial
  CRISPR gRNA sequence
gggactaggaatatttcact

SEQ ID NO: 110906 - DNA, 20 bp, Artificial
  CRISPR gRNA sequence
attacaatcatctctctttg

SEQ ID NO: 110907 - DNA, 20 bp, Artificial
  CRISPR gRNA sequence
ctctctttgtggtgttttta

SEQ ID NO: 110908 - DNA, 20 bp, Artificial
  CRISPR gRNA sequence
cccaatgttcctcggaatta

SEQ ID NO: 110909 - DNA, 20 bp, Artificial
  CRISPR gRNA sequence
cctcggaattattgggtttt

SEQ ID NO: 110910 - DNA, 20 bp, Artificial
  CRISPR gRNA sequence
ggttcaacatctaaaagaga

SEQ ID NO: 110911 - DNA, 20 bp, Artificial
  CRISPR gRNA sequence
cccagttcctgaccctgcag

SEQ ID NO: 110912 - DNA, 20 bp, Artificial
  CRISPR gRNA sequence
caggcatgtttctttcagtc

SEQ ID NO: 110913 - DNA, 20 bp, Artificial
  CRISPR gRNA sequence
gccatgggaagaatgaaaat

SEQ ID NO: 110914 - DNA, 20 bp, Artificial
  CRISPR gRNA sequence
gagtgaagccaacatccacc

SEQ ID NO: 110915 - DNA, 20 bp, Artificial
  CRISPR gRNA sequence
tccaggacagtgtgactgac

SEQ ID NO: 110916 - DNA, 20 bp, Artificial
  CRISPR gRNA sequence
aaattgtcaaggatcaaatc

SEQ ID NO: 110917 - DNA, 20 bp, Artificial
  CRISPR gRNA sequence
aatctcaggcttcttccttt

SEQ ID NO: 110918 - DNA, 20 bp, Artificial
  CRISPR gRNA sequence
cccaaatgctgtcacaaagt

SEQ ID NO: 110919 - DNA, 20 bp, Artificial
  CRISPR gRNA sequence
aaagtctatgattgaaaatc

SEQ ID NO: 110920 - DNA, 20 bp, Artificial
  CRISPR gRNA sequence
aggagtattacaaatctcct

SEQ ID NO: 110921 - DNA, 20 bp, Artificial
  CRISPR gRNA sequence
cttgttctctacttaggaaa

SEQ ID NO: 110922 - DNA, 20 bp, Artificial
  CRISPR gRNA sequence
ctacttaggaaaggcagttt

SEQ ID NO: 110923 - DNA, 20 bp, Artificial
  CRISPR gRNA sequence
caacttttcaaagctagaaa

SEQ ID NO: 110924 - DNA, 20 bp, Artificial
  CRISPR gRNA sequence
gattcggcaatgtatatttt

SEQ ID NO: 110925 - DNA, 20 bp, Artificial
  CRISPR gRNA sequence
tttatcattctatccccaga

SEQ ID NO: 110926 - DNA, 20 bp, Artificial
  CRISPR gRNA sequence
agaggaattcttattattac

SEQ ID NO: 110927 - DNA, 20 bp, Artificial
  CRISPR gRNA sequence
aagaatgtatctcaggaatt

SEQ ID NO: 110928 - DNA, 20 bp, Artificial
  CRISPR gRNA sequence
cgtccattcagttagtcagt

SEQ ID NO: 110929 - DNA, 20 bp, Artificial
  CRISPR gRNA sequence
caccagagggataaatgctg

SEQ ID NO: 110930 - DNA, 20 bp, Artificial
  CRISPR gRNA sequence
ttccatgggaaggagtgggc

SEQ ID NO: 110931 - DNA, 20 bp, Artificial
  CRISPR gRNA sequence
gaaggagtgggctgctgctt

SEQ ID NO: 110932 - DNA, 20 bp, Artificial
  CRISPR gRNA sequence
tgggctgctgctttcctgat

SEQ ID NO: 110933 - DNA, 20 bp, Artificial
  CRISPR gRNA sequence
ctgacttcaccagtcaaggt

SEQ ID NO: 110934 - DNA, 20 bp, Artificial
  CRISPR gRNA sequence
cctgactgaaagagtaagac

SEQ ID NO: 110935 - DNA, 20 bp, Artificial
  CRISPR gRNA sequence
gagccacttattaaaaacta

SEQ ID NO: 110936 - DNA, 20 bp, Artificial
  CRISPR gRNA sequence
gacactcggatgatctgtgt

SEQ ID NO: 110937 - DNA, 20 bp, Artificial
  CRISPR gRNA sequence
atctgtgtcattgcttcttc

SEQ ID NO: 110938 - DNA, 20 bp, Artificial
  CRISPR gRNA sequence
tgtcattgcttcttcatcgg

SEQ ID NO: 110939 - DNA, 20 bp, Artificial
  CRISPR gRNA sequence
tcctagagacaaagatgaca

SEQ ID NO: 110940 - DNA, 20 bp, Artificial
  CRISPR gRNA sequence
ataactttaccaagtaaatc

SEQ ID NO: 110941 - DNA, 20 bp, Artificial
  CRISPR gRNA sequence
atacatcttaagtctgcata

SEQ ID NO: 110942 - DNA, 20 bp, Artificial
  CRISPR gRNA sequence
atacttaagggttaagagta

SEQ ID NO: 110943 - DNA, 20 bp, Artificial
  CRISPR gRNA sequence
atgtcatgctgtatttttgt

SEQ ID NO: 110944 - DNA, 20 bp, Artificial
  CRISPR gRNA sequence
gaatctatacactttaatgt

SEQ ID NO: 110945 - DNA, 20 bp, Artificial
  CRISPR gRNA sequence
atctgaaggccagatgggta

SEQ ID NO: 110946 - DNA, 20 bp, Artificial
  CRISPR gRNA sequence
tctttccactaaactctata

SEQ ID NO: 110947 - DNA, 20 bp, Artificial
  CRISPR gRNA sequence
taacacaaggataaatcctt

SEQ ID NO: 110948 - DNA, 20 bp, Artificial
  CRISPR gRNA sequence
ggtgctacacagatgcctaa

SEQ ID NO: 110949 - DNA, 20 bp, Artificial
  CRISPR gRNA sequence
aggggctctcacactacagg

SEQ ID NO: 110950 - DNA, 20 bp, Artificial
  CRISPR gRNA sequence
gtgtggggacactgaggaaa

SEQ ID NO: 110951 - DNA, 20 bp, Artificial
  CRISPR gRNA sequence
ggggacactgaggaaaccta

SEQ ID NO: 110952 - DNA, 20 bp, Artificial
  CRISPR gRNA sequence
ttgagggggtgataaggcaa

SEQ ID NO: 110953 - DNA, 20 bp, Artificial
  CRISPR gRNA sequence
ttgcttagatgttatacaga

SEQ ID NO: 110954 - DNA, 20 bp, Artificial
  CRISPR gRNA sequence
agatgttatacagaaatagt

SEQ ID NO: 110955 - DNA, 20 bp, Artificial
  CRISPR gRNA sequence
taaggccaattagaggagac

SEQ ID NO: 110956 - DNA, 20 bp, Artificial
  CRISPR gRNA sequence
gaatctattaattcaagaaa

SEQ ID NO: 110957 - DNA, 20 bp, Artificial
  CRISPR gRNA sequence
ctattaattcaagaaacact

SEQ ID NO: 110958 - DNA, 20 bp, Artificial
  CRISPR gRNA sequence
ttgggaggccaaggcgagag

SEQ ID NO: 110959 - DNA, 20 bp, Artificial
  CRISPR gRNA sequence
cgagaggatcgcttgagcct

SEQ ID NO: 110960 - DNA, 20 bp, Artificial
  CRISPR gRNA sequence
tagacaggagctggagcatg

SEQ ID NO: 110961 - DNA, 20 bp, Artificial
  CRISPR gRNA sequence
tgggaaagggtaggggttga

SEQ ID NO: 110962 - DNA, 20 bp, Artificial
  CRISPR gRNA sequence
ataaatctaagccaaagaag

SEQ ID NO: 110963 - DNA, 20 bp, Artificial
  CRISPR gRNA sequence
ttccttgaaaattaagaaaa

SEQ ID NO: 110964 - DNA, 20 bp, Artificial
  CRISPR gRNA sequence
ggcatgcatcaccaggcctg

SEQ ID NO: 110965 - DNA, 20 bp, Artificial
  CRISPR gRNA sequence
tttgtatttttttgtagaga

SEQ ID NO: 110966 - DNA, 20 bp, Artificial
  CRISPR gRNA sequence
cccaggctggtcttgaaatc

SEQ ID NO: 110967 - DNA, 20 bp, Artificial
  CRISPR gRNA sequence
cacctcagcctcccaaagtg

SEQ ID NO: 110968 - DNA, 20 bp, Artificial
  CRISPR gRNA sequence
tgagccaccaagtctggcct

SEQ ID NO: 110969 - DNA, 20 bp, Artificial
  CRISPR gRNA sequence
aaaagataatctaaagagac

SEQ ID NO: 110970 - DNA, 20 bp, Artificial
  CRISPR gRNA sequence
taaagagacataagattgca

SEQ ID NO: 110971 - DNA, 20 bp, Artificial
  CRISPR gRNA sequence
aatagcaagaggacactgct

SEQ ID NO: 110972 - DNA, 20 bp, Artificial
  CRISPR gRNA sequence
agaaaaatcgtccaccttca

SEQ ID NO: 110973 - DNA, 20 bp, Artificial
  CRISPR gRNA sequence
agtgcacaaattccattctc

SEQ ID NO: 110974 - DNA, 20 bp, Artificial
  CRISPR gRNA sequence
ttatgacttagaatgacgat

SEQ ID NO: 110975 - DNA, 20 bp, Artificial
  CRISPR gRNA sequence
tataactactgtaagactgt

SEQ ID NO: 110976 - DNA, 20 bp, Artificial
  CRISPR gRNA sequence
ttcacaatatatacactttc

SEQ ID NO: 110977 - DNA, 20 bp, Artificial
  CRISPR gRNA sequence
tgctttaataacaggccaaa

SEQ ID NO: 110978 - DNA, 20 bp, Artificial
  CRISPR gRNA sequence
taaaaagactttcctagcat

SEQ ID NO: 110979 - DNA, 20 bp, Artificial
  CRISPR gRNA sequence
ttattattattttctagaaa

SEQ ID NO: 110980 - DNA, 20 bp, Artificial
  CRISPR gRNA sequence
tggaaggtacacaacttctt

SEQ ID NO: 110981 - DNA, 20 bp, Artificial
  CRISPR gRNA sequence
aaggtgcaggttgcagtgag

SEQ ID NO: 110982 - DNA, 20 bp, Artificial
  CRISPR gRNA sequence
gaataacatcttatttaagc

SEQ ID NO: 110983 - DNA, 20 bp, Artificial
  CRISPR gRNA sequence
aacatcttatttaagccact

SEQ ID NO: 110984 - DNA, 20 bp, Artificial
  CRISPR gRNA sequence
gacaacaagtatctaacgtc

SEQ ID NO: 110985 - DNA, 20 bp, Artificial
  CRISPR gRNA sequence
ttggaattttcccttctgcc

SEQ ID NO: 110986 - DNA, 20 bp, Artificial
  CRISPR gRNA sequence
ccttctgcctctagtttagc

SEQ ID NO: 110987 - DNA, 20 bp, Artificial
  CRISPR gRNA sequence
tcctcttaagaatacggtgg

SEQ ID NO: 110988 - DNA, 20 bp, Artificial
  CRISPR gRNA sequence
aagcatctctgctccaggta

SEQ ID NO: 110989 - DNA, 20 bp, Artificial
  CRISPR gRNA sequence
catctgtgtgaacaggaaac

SEQ ID NO: 110990 - DNA, 20 bp, Artificial
  CRISPR gRNA sequence
gcatgaagtatggacataga

SEQ ID NO: 110991 - DNA, 20 bp, Artificial
  CRISPR gRNA sequence
accccagatgactgtgtcat

SEQ ID NO: 110992 - DNA, 20 bp, Artificial
  CRISPR gRNA sequence
cacagctctttcccaaatac

SEQ ID NO: 110993 - DNA, 20 bp, Artificial
  CRISPR gRNA sequence
tcctggacttaagccatcct

SEQ ID NO: 110994 - DNA, 20 bp, Artificial
  CRISPR gRNA sequence
tgccactgagccagggttgg

SEQ ID NO: 110995 - DNA, 20 bp, Artificial
  CRISPR gRNA sequence
gggttggttctgtttctttt

SEQ ID NO: 110996 - DNA, 20 bp, Artificial
  CRISPR gRNA sequence
taacatcctattttgacata

SEQ ID NO: 110997 - DNA, 20 bp, Artificial
  CRISPR gRNA sequence
cctattttgacatatgagga

SEQ ID NO: 110998 - DNA, 20 bp, Artificial
  CRISPR gRNA sequence
catttacatgacactttttt

SEQ ID NO: 110999 - DNA, 20 bp, Artificial
  CRISPR gRNA sequence
caattacaatctttctaatt

SEQ ID NO: 111000 - DNA, 20 bp, Artificial
  CRISPR gRNA sequence
caatactactttccacttct

SEQ ID NO: 111001 - DNA, 20 bp, Artificial
  CRISPR gRNA sequence
ccataaaatcactatttatc

SEQ ID NO: 111002 - DNA, 20 bp, Artificial
  CRISPR gRNA sequence
agtaggtgctcagaatgaat

SEQ ID NO: 111003 - DNA, 20 bp, Artificial
  CRISPR gRNA sequence
tgtcataatgttattgtcaa

SEQ ID NO: 111004 - DNA, 20 bp, Artificial
  CRISPR gRNA sequence
ctggttgtgttggtattggc

SEQ ID NO: 111005 - DNA, 20 bp, Artificial
  CRISPR gRNA sequence
attctattaactgtctaggt

SEQ ID NO: 111006 - DNA, 20 bp, Artificial
  CRISPR gRNA sequence
ttttgagtaactctatcctt

SEQ ID NO: 111007 - DNA, 20 bp, Artificial
  CRISPR gRNA sequence
tagcagttttcaaaaggtga

SEQ ID NO: 111008 - DNA, 20 bp, Artificial
  CRISPR gRNA sequence
gctcttgtacataatgagca

SEQ ID NO: 111009 - DNA, 20 bp, Artificial
  CRISPR gRNA sequence
atgagcaatctgcttcagga

SEQ ID NO: 111010 - DNA, 20 bp, Artificial
  CRISPR gRNA sequence
cagagattttaaaacttata

SEQ ID NO: 111011 - DNA, 20 bp, Artificial
  CRISPR gRNA sequence
agactatcaatagcagcact

SEQ ID NO: 111012 - DNA, 20 bp, Artificial
  CRISPR gRNA sequence
acttgaggatttgttcacca

SEQ ID NO: 111013 - DNA, 20 bp, Artificial
  CRISPR gRNA sequence
aatctaacaaagatgtcctt

SEQ ID NO: 111014 - DNA, 20 bp, Artificial
  CRISPR gRNA sequence
gatttaactatttgactaac

SEQ ID NO: 111015 - DNA, 20 bp, Artificial
  CRISPR gRNA sequence
tgcttccaaaagccttcaag

SEQ ID NO: 111016 - DNA, 20 bp, Artificial
  CRISPR gRNA sequence
gcaatagcactctaaagcca

SEQ ID NO: 111017 - DNA, 20 bp, Artificial
  CRISPR gRNA sequence
tgaactccctatttctattc

SEQ ID NO: 111018 - DNA, 20 bp, Artificial
  CRISPR gRNA sequence
tttagaaacacttcttccct

SEQ ID NO: 111019 - DNA, 20 bp, Artificial
  CRISPR gRNA sequence
ccctaaaagcttacacaatc

SEQ ID NO: 111020 - DNA, 20 bp, Artificial
  CRISPR gRNA sequence
gttgccccaaaaagtcctag

SEQ ID NO: 111021 - DNA, 20 bp, Artificial
  CRISPR gRNA sequence
aacctccgcctcctgggttc

SEQ ID NO: 111022 - DNA, 20 bp, Artificial
  CRISPR gRNA sequence
tgcctcagcctcccgagtag

SEQ ID NO: 111023 - DNA, 20 bp, Artificial
  CRISPR gRNA sequence
acctaatttttgtattttga

SEQ ID NO: 111024 - DNA, 20 bp, Artificial
  CRISPR gRNA sequence
cttgatctcttgaccttgtg

SEQ ID NO: 111025 - DNA, 20 bp, Artificial
  CRISPR gRNA sequence
tgcctcggcctctcaaagtg

SEQ ID NO: 111026 - DNA, 20 bp, Artificial
  CRISPR gRNA sequence
cggccaaaaatatatttttt

SEQ ID NO: 111027 - DNA, 20 bp, Artificial
  CRISPR gRNA sequence
cagttatctgactcttccaa

SEQ ID NO: 111028 - DNA, 20 bp, Artificial
  CRISPR gRNA sequence
ctgcagaaaagaacataaaa

SEQ ID NO: 111029 - DNA, 20 bp, Artificial
  CRISPR gRNA sequence
cctgatattaacaaatcaat

SEQ ID NO: 111030 - DNA, 20 bp, Artificial
  CRISPR gRNA sequence
ttttatgaaagatagcagtg

SEQ ID NO: 111031 - DNA, 20 bp, Artificial
  CRISPR gRNA sequence
ccctgtctctactaaaaata

SEQ ID NO: 111032 - DNA, 20 bp, Artificial
  CRISPR gRNA sequence
actccagcctgggcgacaga

SEQ ID NO: 111033 - DNA, 20 bp, Artificial
  CRISPR gRNA sequence
aaaaaataaaatacactcta

SEQ ID NO: 111034 - DNA, 20 bp, Artificial
  CRISPR gRNA sequence
aaatgctgaaagccgggtac

SEQ ID NO: 111035 - DNA, 20 bp, Artificial
  CRISPR gRNA sequence
cacttcaggaggctgaggcg

SEQ ID NO: 111036 - DNA, 20 bp, Artificial
  CRISPR gRNA sequence
aagaatccaacacagctgtg

SEQ ID NO: 111037 - DNA, 20 bp, Artificial
  CRISPR gRNA sequence
tacaggcgtccgccatcacg

SEQ ID NO: 111038 - DNA, 20 bp, Artificial
  CRISPR gRNA sequence
ttttgtctttttagtagaga

SEQ ID NO: 111039 - DNA, 20 bp, Artificial
  CRISPR gRNA sequence
cgcctcggccacccaaagtg

SEQ ID NO: 111040 - DNA, 20 bp, Artificial
  CRISPR gRNA sequence
tgtgggccaccgcaccggcc

SEQ ID NO: 111041 - DNA, 20 bp, Artificial
  CRISPR gRNA sequence
caccgcaccggccaaatgtt

SEQ ID NO: 111042 - DNA, 20 bp, Artificial
  CRISPR gRNA sequence
atagataattaaggcaatgt

SEQ ID NO: 111043 - DNA, 20 bp, Artificial
  CRISPR gRNA sequence
tgacagattatattcctcct

SEQ ID NO: 111044 - DNA, 20 bp, Artificial
  CRISPR gRNA sequence
ccaatactcactactgtcat

SEQ ID NO: 111045 - DNA, 20 bp, Artificial
  CRISPR gRNA sequence
attaatgtttgtcaaatttt

SEQ ID NO: 111046 - DNA, 20 bp, Artificial
  CRISPR gRNA sequence
tttgtatctcctatttggtc

SEQ ID NO: 111047 - DNA, 20 bp, Artificial
  CRISPR gRNA sequence
gtgttatcagaaacctgaca

SEQ ID NO: 111048 - DNA, 20 bp, Artificial
  CRISPR gRNA sequence
ctagtactaagtaaccttct

SEQ ID NO: 111049 - DNA, 20 bp, Artificial
  CRISPR gRNA sequence
acaaactttttttatttgag

SEQ ID NO: 111050 - DNA, 20 bp, Artificial
  CRISPR gRNA sequence
aaggaggatactttcagaaa

SEQ ID NO: 111051 - DNA, 20 bp, Artificial
  CRISPR gRNA sequence
tggatcctactttgttaggg

SEQ ID NO: 111052 - DNA, 20 bp, Artificial
  CRISPR gRNA sequence
tatgtgaaccaacttcattt

SEQ ID NO: 111053 - DNA, 20 bp, Artificial
  CRISPR gRNA sequence
ttctaagtttatattggctg

SEQ ID NO: 111054 - DNA, 20 bp, Artificial
  CRISPR gRNA sequence
atgtattaaaaatatctttt

SEQ ID NO: 111055 - DNA, 20 bp, Artificial
  CRISPR gRNA sequence
atatcttttccaagttttca

SEQ ID NO: 111056 - DNA, 20 bp, Artificial
  CRISPR gRNA sequence
ttgatgtatttcaatgcata

SEQ ID NO: 111057 - DNA, 20 bp, Artificial
  CRISPR gRNA sequence
tgcatattatgttttagtca

SEQ ID NO: 111058 - DNA, 20 bp, Artificial
  CRISPR gRNA sequence
tatattttcttttgaatttt

SEQ ID NO: 111059 - DNA, 20 bp, Artificial
  CRISPR gRNA sequence
aaatacagtatgaattagaa

SEQ ID NO: 111060 - DNA, 20 bp, Artificial
  CRISPR gRNA sequence
cttcagccatttcttcattg

SEQ ID NO: 111061 - DNA, 20 bp, Artificial
  CRISPR gRNA sequence
ttccagtatctttctcaggc

SEQ ID NO: 111062 - DNA, 20 bp, Artificial
  CRISPR gRNA sequence
tctactttttcttagagggt

SEQ ID NO: 111063 - DNA, 20 bp, Artificial
  CRISPR gRNA sequence
cttagagggtgcaagcttta

SEQ ID NO: 111064 - DNA, 20 bp, Artificial
  CRISPR gRNA sequence
gaaaaaaaactcctatacaa

SEQ ID NO: 111065 - DNA, 20 bp, Artificial
  CRISPR gRNA sequence
aggctatggaatctcaccta

SEQ ID NO: 111066 - DNA, 20 bp, Artificial
  CRISPR gRNA sequence
acgtaacagaatatattttt

SEQ ID NO: 111067 - DNA, 20 bp, Artificial
  CRISPR gRNA sequence
aaataacttggccaagatca

SEQ ID NO: 111068 - DNA, 20 bp, Artificial
  CRISPR gRNA sequence
ttaatggcagacctggtaat

SEQ ID NO: 111069 - DNA, 20 bp, Artificial
  CRISPR gRNA sequence
aaaataaaactatcgtgccc

SEQ ID NO: 111070 - DNA, 20 bp, Artificial
  CRISPR gRNA sequence
tatattttataaattagaaa

SEQ ID NO: 111071 - DNA, 20 bp, Artificial
  CRISPR gRNA sequence
caaaagaatacacaaaaagt

SEQ ID NO: 111072 - DNA, 20 bp, Artificial
  CRISPR gRNA sequence
agaatacacaaaaagtacaa

SEQ ID NO: 111073 - DNA, 20 bp, Artificial
  CRISPR gRNA sequence
tttatgagcagtgggatcat

SEQ ID NO: 111074 - DNA, 20 bp, Artificial
  CRISPR gRNA sequence
caatattccctatgaatata

SEQ ID NO: 111075 - DNA, 20 bp, Artificial
  CRISPR gRNA sequence
cttattcttattaatggaca

SEQ ID NO: 111076 - DNA, 20 bp, Artificial
  CRISPR gRNA sequence
ttgtaatttccccctactat

SEQ ID NO: 111077 - DNA, 20 bp, Artificial
  CRISPR gRNA sequence
tgatgcttttcttcctatag

SEQ ID NO: 111078 - DNA, 20 bp, Artificial
  CRISPR gRNA sequence
gtgcctttccaaaataactc

SEQ ID NO: 111079 - DNA, 20 bp, Artificial
  CRISPR gRNA sequence
cagttttaaattaccaaaaa

SEQ ID NO: 111080 - DNA, 20 bp, Artificial
  CRISPR gRNA sequence
taacagtggatataatgact

SEQ ID NO: 111081 - DNA, 20 bp, Artificial
  CRISPR gRNA sequence
ctggagtgcagtggcacaat

SEQ ID NO: 111082 - DNA, 20 bp, Artificial
  CRISPR gRNA sequence
tgcctcaaccccccaagtag

SEQ ID NO: 111083 - DNA, 20 bp, Artificial
  CRISPR gRNA sequence
ttttttatttttagtagaga

SEQ ID NO: 111084 - DNA, 20 bp, Artificial
  CRISPR gRNA sequence
tcctttaatctcttctacat

SEQ ID NO: 111085 - DNA, 20 bp, Artificial
  CRISPR gRNA sequence
tcttctacatctttgcttac

SEQ ID NO: 111086 - DNA, 20 bp, Artificial
  CRISPR gRNA sequence
catctttgcttacttttgtt

SEQ ID NO: 111087 - DNA, 20 bp, Artificial
  CRISPR gRNA sequence
tttgttttctgtttctcaat

SEQ ID NO: 111088 - DNA, 20 bp, Artificial
  CRISPR gRNA sequence
gtttctcaatcagtgtttca

SEQ ID NO: 111089 - DNA, 20 bp, Artificial
  CRISPR gRNA sequence
tcagtgtttcaactggattt

SEQ ID NO: 111090 - DNA, 20 bp, Artificial
  CRISPR gRNA sequence
tggatttacctgttttattg

SEQ ID NO: 111091 - DNA, 20 bp, Artificial
  CRISPR gRNA sequence
ttattggtctgcttaaacaa

SEQ ID NO: 111092 - DNA, 20 bp, Artificial
  CRISPR gRNA sequence
tttatttatcctttctatac

SEQ ID NO: 111093 - DNA, 20 bp, Artificial
  CRISPR gRNA sequence
ttaatttggacccacttttt

SEQ ID NO: 111094 - DNA, 20 bp, Artificial
  CRISPR gRNA sequence
ctaactttctaaatactcat

SEQ ID NO: 111095 - DNA, 20 bp, Artificial
  CRISPR gRNA sequence
taaaataaaatatactataa

SEQ ID NO: 111096 - DNA, 20 bp, Artificial
  CRISPR gRNA sequence
ctgtccaatttctgcatagt

SEQ ID NO: 111097 - DNA, 20 bp, Artificial
  CRISPR gRNA sequence
ccagaaacaggtacttgcat

SEQ ID NO: 111098 - DNA, 20 bp, Artificial
  CRISPR gRNA sequence
catgatgggttggccagttg

SEQ ID NO: 111099 - DNA, 20 bp, Artificial
  CRISPR gRNA sequence
tgaaataacataagacacaa

SEQ ID NO: 111100 - DNA, 20 bp, Artificial
  CRISPR gRNA sequence
tcataatggcaaggttagtt

SEQ ID NO: 111101 - DNA, 20 bp, Artificial
  CRISPR gRNA sequence
gctgggtagcaagcagctct

SEQ ID NO: 111102 - DNA, 20 bp, Artificial
  CRISPR gRNA sequence
ttttactctgtgaattctag

SEQ ID NO: 111103 - DNA, 20 bp, Artificial
  CRISPR gRNA sequence
ctgtgaattctagatatgtt

SEQ ID NO: 111104 - DNA, 20 bp, Artificial
  CRISPR gRNA sequence
ttgttgtttaaactcactac

SEQ ID NO: 111105 - DNA, 20 bp, Artificial
  CRISPR gRNA sequence
tttcttaaaagcactttctg

SEQ ID NO: 111106 - DNA, 20 bp, Artificial
  CRISPR gRNA sequence
tataatatccacatggttat

SEQ ID NO: 111107 - DNA, 20 bp, Artificial
  CRISPR gRNA sequence
caatacaaaaatacctaata

SEQ ID NO: 111108 - DNA, 20 bp, Artificial
  CRISPR gRNA sequence
gctttctggaagcactttaa

SEQ ID NO: 111109 - DNA, 20 bp, Artificial
  CRISPR gRNA sequence
tcaccaggaacattgaaatc

SEQ ID NO: 111110 - DNA, 20 bp, Artificial
  CRISPR gRNA sequence
caaatcccctttgctacacc

SEQ ID NO: 111111 - DNA, 20 bp, Artificial
  CRISPR gRNA sequence
gcttgcatattctgtatcaa

SEQ ID NO: 111112 - DNA, 20 bp, Artificial
  CRISPR gRNA sequence
aataatcagatccctagagg

SEQ ID NO: 111113 - DNA, 20 bp, Artificial
  CRISPR gRNA sequence
aggtttctattatttccata

SEQ ID NO: 111114 - DNA, 20 bp, Artificial
  CRISPR gRNA sequence
aatctatgtaagtaggaaac

SEQ ID NO: 111115 - DNA, 20 bp, Artificial
  CRISPR gRNA sequence
gtgctattcgtgcacatgat

SEQ ID NO: 111116 - DNA, 20 bp, Artificial
  CRISPR gRNA sequence
gggttaatgacaatccaaaa

SEQ ID NO: 111117 - DNA, 20 bp, Artificial
  CRISPR gRNA sequence
cattaacaagctgttggact

SEQ ID NO: 111118 - DNA, 20 bp, Artificial
  CRISPR gRNA sequence
aattttggaatgcctacaag

SEQ ID NO: 111119 - DNA, 20 bp, Artificial
  CRISPR gRNA sequence
tgcctacaagctcagtttct

SEQ ID NO: 111120 - DNA, 20 bp, Artificial
  CRISPR gRNA sequence
tattggtggcaggggtaggg

SEQ ID NO: 111121 - DNA, 20 bp, Artificial
  CRISPR gRNA sequence
ataagaggtagttatctgct

SEQ ID NO: 111122 - DNA, 20 bp, Artificial
  CRISPR gRNA sequence
gtgagatgccagttctacat

SEQ ID NO: 111123 - DNA, 20 bp, Artificial
  CRISPR gRNA sequence
gtagactagtgctgctactc

SEQ ID NO: 111124 - DNA, 20 bp, Artificial
  CRISPR gRNA sequence
tacacgatgctaaagaactg

SEQ ID NO: 111125 - DNA, 20 bp, Artificial
  CRISPR gRNA sequence
gattaaccaagaattatcac

SEQ ID NO: 111126 - DNA, 20 bp, Artificial
  CRISPR gRNA sequence
taagacttacagaaagcaca

SEQ ID NO: 111127 - DNA, 20 bp, Artificial
  CRISPR gRNA sequence
tggaaacaatagcagttaac

SEQ ID NO: 111128 - DNA, 20 bp, Artificial
  CRISPR gRNA sequence
tagcagttaacaagagatta

SEQ ID NO: 111129 - DNA, 20 bp, Artificial
  CRISPR gRNA sequence
aacaagagattaacaagatt

SEQ ID NO: 111130 - DNA, 20 bp, Artificial
  CRISPR gRNA sequence
tagataaaccttgccaagtg

SEQ ID NO: 111131 - DNA, 20 bp, Artificial
  CRISPR gRNA sequence
aaaaataaagcacagcctag

SEQ ID NO: 111132 - DNA, 20 bp, Artificial
  CRISPR gRNA sequence
ttttgtatttttagtagaga

SEQ ID NO: 111133 - DNA, 20 bp, Artificial
  CRISPR gRNA sequence
ttagtagagacagggtttca

SEQ ID NO: 111134 - DNA, 20 bp, Artificial
  CRISPR gRNA sequence
tgcctcggcctcccaaagtg

SEQ ID NO: 111135 - DNA, 20 bp, Artificial
  CRISPR gRNA sequence
ctgctgagaacaggaacagg

SEQ ID NO: 111136 - DNA, 20 bp, Artificial
  CRISPR gRNA sequence
gtacagactccctatattga

SEQ ID NO: 111137 - DNA, 20 bp, Artificial
  CRISPR gRNA sequence
aagctgttttgttgaaggta

SEQ ID NO: 111138 - DNA, 20 bp, Artificial
  CRISPR gRNA sequence
aacagttgtcatcattaaca

SEQ ID NO: 111139 - DNA, 20 bp, Artificial
  CRISPR gRNA sequence
tctgacacttctacttacac

SEQ ID NO: 111140 - DNA, 20 bp, Artificial
  CRISPR gRNA sequence
cagatgagttcacaagaaaa

SEQ ID NO: 111141 - DNA, 20 bp, Artificial
  CRISPR gRNA sequence
agttcacaagaaaaaaatga

SEQ ID NO: 111142 - DNA, 20 bp, Artificial
  CRISPR gRNA sequence
tgaaactaccataaaaaatt

SEQ ID NO: 111143 - DNA, 20 bp, Artificial
  CRISPR gRNA sequence
aatgctctcatgtcccaaaa

SEQ ID NO: 111144 - DNA, 20 bp, Artificial
  CRISPR gRNA sequence
cttattttgagatggggtct

SEQ ID NO: 111145 - DNA, 20 bp, Artificial
  CRISPR gRNA sequence
cccaggctggtcttgaattc

SEQ ID NO: 111146 - DNA, 20 bp, Artificial
  CRISPR gRNA sequence
tgtctcagcctccagagtag

SEQ ID NO: 111147 - DNA, 20 bp, Artificial
  CRISPR gRNA sequence
tacaggcatgcagcaccatg

SEQ ID NO: 111148 - DNA, 20 bp, Artificial
  CRISPR gRNA sequence
caccatgcccagcttcaaaa

SEQ ID NO: 111149 - DNA, 20 bp, Artificial
  CRISPR gRNA sequence
agattatttctacccaactg

SEQ ID NO: 111150 - DNA, 20 bp, Artificial
  CRISPR gRNA sequence
caactggactgctttaagag

SEQ ID NO: 111151 - DNA, 20 bp, Artificial
  CRISPR gRNA sequence
tgctttaagagccatgtttt

SEQ ID NO: 111152 - DNA, 20 bp, Artificial
  CRISPR gRNA sequence
atattatcctaatgttaaac

SEQ ID NO: 111153 - DNA, 20 bp, Artificial
  CRISPR gRNA sequence
ggcagaccaaatcaaaaaac

SEQ ID NO: 111154 - DNA, 20 bp, Artificial
  CRISPR gRNA sequence
gaagatttattggaagctat

SEQ ID NO: 111155 - DNA, 20 bp, Artificial
  CRISPR gRNA sequence
ttccatctgaaaaccagact

SEQ ID NO: 111156 - DNA, 20 bp, Artificial
  CRISPR gRNA sequence
ataaccaggcacccatgaag

SEQ ID NO: 111157 - DNA, 20 bp, Artificial
  CRISPR gRNA sequence
accaattgagtggtgctgtt

SEQ ID NO: 111158 - DNA, 20 bp, Artificial
  CRISPR gRNA sequence
tgttatcagtttcattgctg

SEQ ID NO: 111159 - DNA, 20 bp, Artificial
  CRISPR gRNA sequence
ttcattgctgtaatgtttaa

SEQ ID NO: 111160 - DNA, 20 bp, Artificial
  CRISPR gRNA sequence
tgctgtaatgtttaaagcag

SEQ ID NO: 111161 - DNA, 20 bp, Artificial
  CRISPR gRNA sequence
aatctgctctgtcgaactat

SEQ ID NO: 111162 - DNA, 20 bp, Artificial
  CRISPR gRNA sequence
ctgctccatggtccctccaa

SEQ ID NO: 111163 - DNA, 20 bp, Artificial
  CRISPR gRNA sequence
aggtggggaaagaaactaaa

SEQ ID NO: 111164 - DNA, 20 bp, Artificial
  CRISPR gRNA sequence
aaacaggataggagaatagg

SEQ ID NO: 111165 - DNA, 20 bp, Artificial
  CRISPR gRNA sequence
atattcagtatcatttttaa

SEQ ID NO: 111166 - DNA, 20 bp, Artificial
  CRISPR gRNA sequence
ataacaacataatgctattt

SEQ ID NO: 111167 - DNA, 20 bp, Artificial
  CRISPR gRNA sequence
atgctattttcacgtttcta

SEQ ID NO: 111168 - DNA, 20 bp, Artificial
  CRISPR gRNA sequence
ttgatacaaggcatacctaa

SEQ ID NO: 111169 - DNA, 20 bp, Artificial
  CRISPR gRNA sequence
ggcatacctaacactgattt

SEQ ID NO: 111170 - DNA, 20 bp, Artificial
  CRISPR gRNA sequence
tgcacatatactttagagaa

SEQ ID NO: 111171 - DNA, 20 bp, Artificial
  CRISPR gRNA sequence
ttctttaagttgtaacacgt

SEQ ID NO: 111172 - DNA, 20 bp, Artificial
  CRISPR gRNA sequence
aaatgtagataggtctttct

SEQ ID NO: 111173 - DNA, 20 bp, Artificial
  CRISPR gRNA sequence
accctaactggcaggtatac

SEQ ID NO: 111174 - DNA, 20 bp, Artificial
  CRISPR gRNA sequence
aggtgtttattttcaaattc

SEQ ID NO: 111175 - DNA, 20 bp, Artificial
  CRISPR gRNA sequence
aggtaaatttctagctataa

SEQ ID NO: 111176 - DNA, 20 bp, Artificial
  CRISPR gRNA sequence
agctataatttggatttaca

SEQ ID NO: 111177 - DNA, 20 bp, Artificial
  CRISPR gRNA sequence
tataatcagcaacatgacaa

SEQ ID NO: 111178 - DNA, 20 bp, Artificial
  CRISPR gRNA sequence
agcaacatgacaaaccggtt

SEQ ID NO: 111179 - DNA, 20 bp, Artificial
  CRISPR gRNA sequence
ggttgactaagtctgctcct

SEQ ID NO: 111180 - DNA, 20 bp, Artificial
  CRISPR gRNA sequence
tctgggtatagaatagaaaa

SEQ ID NO: 111181 - DNA, 20 bp, Artificial
  CRISPR gRNA sequence
tgagtctgttaggggcacta

SEQ ID NO: 111182 - DNA, 20 bp, Artificial
  CRISPR gRNA sequence
gttatgatgtaaacgaatat

SEQ ID NO: 111183 - DNA, 20 bp, Artificial
  CRISPR gRNA sequence
ggaacattgtagggtgatga

SEQ ID NO: 111184 - DNA, 20 bp, Artificial
  CRISPR gRNA sequence
acacatttaaaattattata

SEQ ID NO: 111185 - DNA, 20 bp, Artificial
  CRISPR gRNA sequence
ttctaaagtatctctcaata

SEQ ID NO: 111186 - DNA, 20 bp, Artificial
  CRISPR gRNA sequence
gatcatgaaaggaatgtctt

SEQ ID NO: 111187 - DNA, 20 bp, Artificial
  CRISPR gRNA sequence
actccaaatttccttcttat

SEQ ID NO: 111188 - DNA, 20 bp, Artificial
  CRISPR gRNA sequence
tttttccttgactaatatcc

SEQ ID NO: 111189 - DNA, 20 bp, Artificial
  CRISPR gRNA sequence
aatgactaatatatgtaacg

SEQ ID NO: 111190 - DNA, 20 bp, Artificial
  CRISPR gRNA sequence
acgtacagattttcttctta

SEQ ID NO: 111191 - DNA, 20 bp, Artificial
  CRISPR gRNA sequence
aatttatactttgaagagta

SEQ ID NO: 111192 - DNA, 20 bp, Artificial
  CRISPR gRNA sequence
aagagtatcaagatttgaag

SEQ ID NO: 111193 - DNA, 20 bp, Artificial
  CRISPR gRNA sequence
tctctctcacattaatgaca

SEQ ID NO: 111194 - DNA, 20 bp, Artificial
  CRISPR gRNA sequence
aatggttaatgctataagca

SEQ ID NO: 111195 - DNA, 20 bp, Artificial
  CRISPR gRNA sequence
agtcatatgttcctactact

SEQ ID NO: 111196 - DNA, 20 bp, Artificial
  CRISPR gRNA sequence
ttcccaaagtgcctctttgc

SEQ ID NO: 111197 - DNA, 20 bp, Artificial
  CRISPR gRNA sequence
ccaagattatgacaaactaa

SEQ ID NO: 111198 - DNA, 20 bp, Artificial
  CRISPR gRNA sequence
tctagctcttgctcttaaca

SEQ ID NO: 111199 - DNA, 20 bp, Artificial
  CRISPR gRNA sequence
gctcttaacacaaagttttg

SEQ ID NO: 111200 - DNA, 20 bp, Artificial
  CRISPR gRNA sequence
aagagagagaaacaaataat

SEQ ID NO: 111201 - DNA, 20 bp, Artificial
  CRISPR gRNA sequence
gtgtaagcatatgaaaagcc

SEQ ID NO: 111202 - DNA, 20 bp, Artificial
  CRISPR gRNA sequence
taccaggcaaagcctagaac

SEQ ID NO: 111203 - DNA, 20 bp, Artificial
  CRISPR gRNA sequence
ataaagcatgtaactgaaat

SEQ ID NO: 111204 - DNA, 20 bp, Artificial
  CRISPR gRNA sequence
ggtctcaaactcctgagctc

SEQ ID NO: 111205 - DNA, 20 bp, Artificial
  CRISPR gRNA sequence
agctcaaaggattctcccac

SEQ ID NO: 111206 - DNA, 20 bp, Artificial
  CRISPR gRNA sequence
cacttcggcttcccaaagtg

SEQ ID NO: 111207 - DNA, 20 bp, Artificial
  CRISPR gRNA sequence
ctcaacaagtgggtcctgat

SEQ ID NO: 111208 - DNA, 20 bp, Artificial
  CRISPR gRNA sequence
tagactacaacaaagggctg

SEQ ID NO: 111209 - DNA, 20 bp, Artificial
  CRISPR gRNA sequence
gtccagcttccccatcatcc

SEQ ID NO: 111210 - DNA, 20 bp, Artificial
  CRISPR gRNA sequence
tccccatcatcctacagatt

SEQ ID NO: 111211 - DNA, 20 bp, Artificial
  CRISPR gRNA sequence
catcctacagatttctggat

SEQ ID NO: 111212 - DNA, 20 bp, Artificial
  CRISPR gRNA sequence
catgtgccagacactgttct

SEQ ID NO: 111213 - DNA, 20 bp, Artificial
  CRISPR gRNA sequence
aaataaaaagaaatctctga

SEQ ID NO: 111214 - DNA, 20 bp, Artificial
  CRISPR gRNA sequence
attcaaacttcaaagagtct

SEQ ID NO: 111215 - DNA, 20 bp, Artificial
  CRISPR gRNA sequence
tgatatgggaatttggagga

SEQ ID NO: 111216 - DNA, 20 bp, Artificial
  CRISPR gRNA sequence
tccagctggggataaatcaa

SEQ ID NO: 111217 - DNA, 20 bp, Artificial
  CRISPR gRNA sequence
tgaactggtcttaagtgtga

SEQ ID NO: 111218 - DNA, 20 bp, Artificial
  CRISPR gRNA sequence
acagtggactaaacaggaaa

SEQ ID NO: 111219 - DNA, 20 bp, Artificial
  CRISPR gRNA sequence
aaattcttctgcagactggt

SEQ ID NO: 111220 - DNA, 20 bp, Artificial
  CRISPR gRNA sequence
aggtatttagcaaaaaagtt

SEQ ID NO: 111221 - DNA, 20 bp, Artificial
  CRISPR gRNA sequence
agatgccaagcaaaagtatt

SEQ ID NO: 111222 - DNA, 20 bp, Artificial
  CRISPR gRNA sequence
gtggctcatgcctgtaatcc

SEQ ID NO: 111223 - DNA, 20 bp, Artificial
  CRISPR gRNA sequence
ttgggagaacaagaagggag

SEQ ID NO: 111224 - DNA, 20 bp, Artificial
  CRISPR gRNA sequence
aggagttccaggttagtgag

SEQ ID NO: 111225 - DNA, 20 bp, Artificial
  CRISPR gRNA sequence
aacgttccaaaggcaaatat

SEQ ID NO: 111226 - DNA, 20 bp, Artificial
  CRISPR gRNA sequence
gtgaaaataaaacctgtccc

SEQ ID NO: 111227 - DNA, 20 bp, Artificial
  CRISPR gRNA sequence
taatgaaagagcactggaat

SEQ ID NO: 111228 - DNA, 20 bp, Artificial
  CRISPR gRNA sequence
tatgtgccagggaatgcact

SEQ ID NO: 111229 - DNA, 20 bp, Artificial
  CRISPR gRNA sequence
aacccataaacaagtcagaa

SEQ ID NO: 111230 - DNA, 20 bp, Artificial
  CRISPR gRNA sequence
gaacctccatacaaaataat

SEQ ID NO: 111231 - DNA, 20 bp, Artificial
  CRISPR gRNA sequence
atatacaagtattttaccaa

SEQ ID NO: 111232 - DNA, 20 bp, Artificial
  CRISPR gRNA sequence
ttcctgcctccaacagtgta

SEQ ID NO: 111233 - DNA, 20 bp, Artificial
  CRISPR gRNA sequence
gtgtaatttgattcctctgc

SEQ ID NO: 111234 - DNA, 20 bp, Artificial
  CRISPR gRNA sequence
tacgtactccctccctaaca

SEQ ID NO: 111235 - DNA, 20 bp, Artificial
  CRISPR gRNA sequence
aaggaaaaccccacaacact

SEQ ID NO: 111236 - DNA, 20 bp, Artificial
  CRISPR gRNA sequence
tgtactatattcccaaggga

SEQ ID NO: 111237 - DNA, 20 bp, Artificial
  CRISPR gRNA sequence
tttcacaaaatgagcagtgg

SEQ ID NO: 111238 - DNA, 20 bp, Artificial
  CRISPR gRNA sequence
cagcccggacaagaaacgga

SEQ ID NO: 111239 - DNA, 20 bp, Artificial
  CRISPR gRNA sequence
gcggggggcgcgggccccgg

SEQ ID NO: 111240 - DNA, 20 bp, Artificial
  CRISPR gRNA sequence
ggagagtggagagtgcaagg

SEQ ID NO: 111241 - DNA, 20 bp, Artificial
  CRISPR gRNA sequence
tggagagtgcaagggcaggt

SEQ ID NO: 111242 - DNA, 20 bp, Artificial
  CRISPR gRNA sequence
ctcccccggttcgctgcccg

SEQ ID NO: 111243 - DNA, 20 bp, Artificial
  CRISPR gRNA sequence
aacgttttctcagcagatgt

SEQ ID NO: 111244 - DNA, 20 bp, Artificial
  CRISPR gRNA sequence
ccgcacttttgactggcctt

SEQ ID NO: 111245 - DNA, 20 bp, Artificial
  CRISPR gRNA sequence
tggaagagcttgctcgaaga

SEQ ID NO: 111246 - DNA, 20 bp, Artificial
  CRISPR gRNA sequence
tgttatacaactaataggtt

SEQ ID NO: 111247 - DNA, 20 bp, Artificial
  CRISPR gRNA sequence
caagcttccaccagtctgca

SEQ ID NO: 111248 - DNA, 20 bp, Artificial
  CRISPR gRNA sequence
tttctttgtctgacattttg

SEQ ID NO: 111249 - DNA, 20 bp, Artificial
  CRISPR gRNA sequence
tcctgcaggcctctgatagc

SEQ ID NO: 111250 - DNA, 20 bp, Artificial
  CRISPR gRNA sequence
aattagtggagagaagtgca

SEQ ID NO: 111251 - DNA, 20 bp, Artificial
  CRISPR gRNA sequence
gtgcattagaaagctccaat

SEQ ID NO: 111252 - DNA, 20 bp, Artificial
  CRISPR gRNA sequence
gacccacttgttgagttgtg

SEQ ID NO: 111253 - DNA, 20 bp, Artificial
  CRISPR gRNA sequence
atgctgggaatttttaaata

SEQ ID NO: 111254 - DNA, 20 bp, Artificial
  CRISPR gRNA sequence
gggaatttttaaataataga

SEQ ID NO: 111255 - DNA, 20 bp, Artificial
  CRISPR gRNA sequence
cactttgggaagccgaagtg

SEQ ID NO: 111256 - DNA, 20 bp, Artificial
  CRISPR gRNA sequence
tagggagaccccctctctta

SEQ ID NO: 111257 - DNA, 20 bp, Artificial
  CRISPR gRNA sequence
cccctctcttaaaagaaaaa

SEQ ID NO: 111258 - DNA, 20 bp, Artificial
  CRISPR gRNA sequence
ctcttaaaagaaaaaaaaga

SEQ ID NO: 111259 - DNA, 20 bp, Artificial
  CRISPR gRNA sequence
tggagtttgtgtaggtccac

SEQ ID NO: 111260 - DNA, 20 bp, Artificial
  CRISPR gRNA sequence
accttggaatagtggggcaa

SEQ ID NO: 111261 - DNA, 20 bp, Artificial
  CRISPR gRNA sequence
caaagagaattgcactgaga

SEQ ID NO: 111262 - DNA, 20 bp, Artificial
  CRISPR gRNA sequence
gagaagagaatgcactagga

SEQ ID NO: 111263 - DNA, 20 bp, Artificial
  CRISPR gRNA sequence
gaagagaattttcatgctag

SEQ ID NO: 111264 - DNA, 20 bp, Artificial
  CRISPR gRNA sequence
cactctgtcattaatgtgag

SEQ ID NO: 111265 - DNA, 20 bp, Artificial
  CRISPR gRNA sequence
aaattggttcatttgtatta

SEQ ID NO: 111266 - DNA, 20 bp, Artificial
  CRISPR gRNA sequence
taccagaataaactagttaa

SEQ ID NO: 111267 - DNA, 20 bp, Artificial
  CRISPR gRNA sequence
tcaatttattgagagatact

SEQ ID NO: 111268 - DNA, 20 bp, Artificial
  CRISPR gRNA sequence
tattgtgtattagagacaag

SEQ ID NO: 111269 - DNA, 20 bp, Artificial
  CRISPR gRNA sequence
cctgattttctattctatac

SEQ ID NO: 111270 - DNA, 20 bp, Artificial
  CRISPR gRNA sequence
caaagagactggtgtaaaaa

SEQ ID NO: 111271 - DNA, 20 bp, Artificial
  CRISPR gRNA sequence
tatgtaaatccaaattatag

SEQ ID NO: 111272 - DNA, 20 bp, Artificial
  CRISPR gRNA sequence
tccaacattcatttgggaaa

SEQ ID NO: 111273 - DNA, 20 bp, Artificial
  CRISPR gRNA sequence
aatttctcaaaattcttatt

SEQ ID NO: 111274 - DNA, 20 bp, Artificial
  CRISPR gRNA sequence
caaaattcttattctagaaa

SEQ ID NO: 111275 - DNA, 20 bp, Artificial
  CRISPR gRNA sequence
agggcctagtgaaaaatcag

SEQ ID NO: 111276 - DNA, 20 bp, Artificial
  CRISPR gRNA sequence
gccagtatactgaaagcatt

SEQ ID NO: 111277 - DNA, 20 bp, Artificial
  CRISPR gRNA sequence
catgtctagcccatgaccac

SEQ ID NO: 111278 - DNA, 20 bp, Artificial
  CRISPR gRNA sequence
tggtctgccacattttttat

SEQ ID NO: 111279 - DNA, 20 bp, Artificial
  CRISPR gRNA sequence
attcttatggataagacata

SEQ ID NO: 111280 - DNA, 20 bp, Artificial
  CRISPR gRNA sequence
tcacttttttccccacccca

SEQ ID NO: 111281 - DNA, 20 bp, Artificial
  CRISPR gRNA sequence
caaaatggaatttagctaat

SEQ ID NO: 111282 - DNA, 20 bp, Artificial
  CRISPR gRNA sequence
gagggtgggtttttattctt

SEQ ID NO: 111283 - DNA, 20 bp, Artificial
  CRISPR gRNA sequence
tcttaaagcagtccagttgg

SEQ ID NO: 111284 - DNA, 20 bp, Artificial
  CRISPR gRNA sequence
ataaataaagtttaaaaaaa

SEQ ID NO: 111285 - DNA, 20 bp, Artificial
  CRISPR gRNA sequence
cttggtgattgcatttaagc

SEQ ID NO: 111286 - DNA, 20 bp, Artificial
  CRISPR gRNA sequence
gagaccccgtatcaactttc

SEQ ID NO: 111287 - DNA, 20 bp, Artificial
  CRISPR gRNA sequence
atttgactagcatgtttctt

SEQ ID NO: 111288 - DNA, 20 bp, Artificial
  CRISPR gRNA sequence
tttctttgagaatgcctgga

SEQ ID NO: 111289 - DNA, 20 bp, Artificial
  CRISPR gRNA sequence
agaaatggtataagtgacag

SEQ ID NO: 111290 - DNA, 20 bp, Artificial
  CRISPR gRNA sequence
agaaattcttataagtgaca

SEQ ID NO: 111291 - DNA, 20 bp, Artificial
  CRISPR gRNA sequence
ctacttgggaggctggagca

SEQ ID NO: 111292 - DNA, 20 bp, Artificial
  CRISPR gRNA sequence
ctccgtctcaaaaaaaaaaa

SEQ ID NO: 111293 - DNA, 20 bp, Artificial
  CRISPR gRNA sequence
tattaaaataactctatttt

SEQ ID NO: 111294 - DNA, 20 bp, Artificial
  CRISPR gRNA sequence
tactttttccctccattgaa

SEQ ID NO: 111295 - DNA, 20 bp, Artificial
  CRISPR gRNA sequence
tgaattagaaatgattcaaa

SEQ ID NO: 111296 - DNA, 20 bp, Artificial
  CRISPR gRNA sequence
gaaatgattcaaagtagaat

SEQ ID NO: 111297 - DNA, 20 bp, Artificial
  CRISPR gRNA sequence
tttgaacataaattaagccg

SEQ ID NO: 111298 - DNA, 20 bp, Artificial
  CRISPR gRNA sequence
gaaattaagatgatgaatag

SEQ ID NO: 111299 - DNA, 20 bp, Artificial
  CRISPR gRNA sequence
ggaaacactttatggaaata

SEQ ID NO: 111300 - DNA, 20 bp, Artificial
  CRISPR gRNA sequence
ctagggatctgattattttg

SEQ ID NO: 111301 - DNA, 20 bp, Artificial
  CRISPR gRNA sequence
tattcttgctatatgtattc

SEQ ID NO: 111302 - DNA, 20 bp, Artificial
  CRISPR gRNA sequence
tctgagaaatctttcttgat

SEQ ID NO: 111303 - DNA, 20 bp, Artificial
  CRISPR gRNA sequence
atctaacctactcatctagg

SEQ ID NO: 111304 - DNA, 20 bp, Artificial
  CRISPR gRNA sequence
aaagcacttttaaagtgctt

SEQ ID NO: 111305 - DNA, 20 bp, Artificial
  CRISPR gRNA sequence
ccatggagactgcaaactga

SEQ ID NO: 111306 - DNA, 20 bp, Artificial
  CRISPR gRNA sequence
aactgaccagaaagtgcttt

SEQ ID NO: 111307 - DNA, 20 bp, Artificial
  CRISPR gRNA sequence
agtttaaacaacaaacatat

SEQ ID NO: 111308 - DNA, 20 bp, Artificial
  CRISPR gRNA sequence
atttaccttcttcactttat

SEQ ID NO: 111309 - DNA, 20 bp, Artificial
  CRISPR gRNA sequence
tttccttttctagcaaggca

SEQ ID NO: 111310 - DNA, 20 bp, Artificial
  CRISPR gRNA sequence
tatatcagaggagaggtttc

SEQ ID NO: 111311 - DNA, 20 bp, Artificial
  CRISPR gRNA sequence
gtgatataaactagaactat

SEQ ID NO: 111312 - DNA, 20 bp, Artificial
  CRISPR gRNA sequence
ctgtaaagtatatgaagagg

SEQ ID NO: 111313 - DNA, 20 bp, Artificial
  CRISPR gRNA sequence
ttatagtatattttatttta

SEQ ID NO: 111314 - DNA, 20 bp, Artificial
  CRISPR gRNA sequence
aaagaaacaaaaatgagtat

SEQ ID NO: 111315 - DNA, 20 bp, Artificial
  CRISPR gRNA sequence
aaaaatgagtatttagaaag

SEQ ID NO: 111316 - DNA, 20 bp, Artificial
  CRISPR gRNA sequence
agtgggtccaaattaattaa

SEQ ID NO: 111317 - DNA, 20 bp, Artificial
  CRISPR gRNA sequence
attaagtagaaaactgacgt

SEQ ID NO: 111318 - DNA, 20 bp, Artificial
  CRISPR gRNA sequence
aatccagttgaaacactgat

SEQ ID NO: 111319 - DNA, 20 bp, Artificial
  CRISPR gRNA sequence
gttgaaacactgattgagaa

SEQ ID NO: 111320 - DNA, 20 bp, Artificial
  CRISPR gRNA sequence
caaaaaaaaagaagagatta

SEQ ID NO: 111321 - DNA, 20 bp, Artificial
  CRISPR gRNA sequence
gaagagattaacagaaatat

SEQ ID NO: 111322 - DNA, 20 bp, Artificial
  CRISPR gRNA sequence
tccactgttaggatggatgt

SEQ ID NO: 111323 - DNA, 20 bp, Artificial
  CRISPR gRNA sequence
gttaggatggatgtggagaa

SEQ ID NO: 111324 - DNA, 20 bp, Artificial
  CRISPR gRNA sequence
tgagctagcagtcccacttc

SEQ ID NO: 111325 - DNA, 20 bp, Artificial
  CRISPR gRNA sequence
tctgagaatctgtcctatag

SEQ ID NO: 111326 - DNA, 20 bp, Artificial
  CRISPR gRNA sequence
gcaatctgagtgtccattaa

SEQ ID NO: 111327 - DNA, 20 bp, Artificial
  CRISPR gRNA sequence
ggaatattgcatcatcatta

SEQ ID NO: 111328 - DNA, 20 bp, Artificial
  CRISPR gRNA sequence
ttttagtggaaataatttgc

SEQ ID NO: 111329 - DNA, 20 bp, Artificial
  CRISPR gRNA sequence
tgttcagtcaacttgatgaa

SEQ ID NO: 111330 - DNA, 20 bp, Artificial
  CRISPR gRNA sequence
actggcatatttttgccaag

SEQ ID NO: 111331 - DNA, 20 bp, Artificial
  CRISPR gRNA sequence
tttgaattgtattctctatt

SEQ ID NO: 111332 - DNA, 20 bp, Artificial
  CRISPR gRNA sequence
ctagtaaagcttgcaccctc

SEQ ID NO: 111333 - DNA, 20 bp, Artificial
  CRISPR gRNA sequence
ttagattaaaatccttggcc

SEQ ID NO: 111334 - DNA, 20 bp, Artificial
  CRISPR gRNA sequence
actggaaccagagagacagc

SEQ ID NO: 111335 - DNA, 20 bp, Artificial
  CRISPR gRNA sequence
agacagccaagaaatagata

SEQ ID NO: 111336 - DNA, 20 bp, Artificial
  CRISPR gRNA sequence
agtggtataaacatatcaat

SEQ ID NO: 111337 - DNA, 20 bp, Artificial
  CRISPR gRNA sequence
atatcaatgaagaaatggct

SEQ ID NO: 111338 - DNA, 20 bp, Artificial
  CRISPR gRNA sequence
agaaatggctgaagaatgat

SEQ ID NO: 111339 - DNA, 20 bp, Artificial
  CRISPR gRNA sequence
tggctgaagaatgatacaga

SEQ ID NO: 111340 - DNA, 20 bp, Artificial
  CRISPR gRNA sequence
ggtggattaaagatctaaat

SEQ ID NO: 111341 - DNA, 20 bp, Artificial
  CRISPR gRNA sequence
aagtaaacttggaaaattca

SEQ ID NO: 111342 - DNA, 20 bp, Artificial
  CRISPR gRNA sequence
ggaaaattcaaaagaaaata

SEQ ID NO: 111343 - DNA, 20 bp, Artificial
  CRISPR gRNA sequence
acatacaaccgagtttgtat

SEQ ID NO: 111344 - DNA, 20 bp, Artificial
  CRISPR gRNA sequence
acaaaaataggaaaatgggc

SEQ ID NO: 111345 - DNA, 20 bp, Artificial
  CRISPR gRNA sequence
tcctaacagccaatataaac

SEQ ID NO: 111346 - DNA, 20 bp, Artificial
  CRISPR gRNA sequence
gttttttagttccaaaattt

SEQ ID NO: 111347 - DNA, 20 bp, Artificial
  CRISPR gRNA sequence
gtggctatagccattaaaaa

SEQ ID NO: 111348 - DNA, 20 bp, Artificial
  CRISPR gRNA sequence
ctactcgggaggctgaggca

SEQ ID NO: 111349 - DNA, 20 bp, Artificial
  CRISPR gRNA sequence
tgcagtcacatttgactaga

SEQ ID NO: 111350 - DNA, 20 bp, Artificial
  CRISPR gRNA sequence
cagaacattttctgctttct

SEQ ID NO: 111351 - DNA, 20 bp, Artificial
  CRISPR gRNA sequence
tttcatgtatagcatgtata

SEQ ID NO: 111352 - DNA, 20 bp, Artificial
  CRISPR gRNA sequence
gctactcgggaggctgaggc

SEQ ID NO: 111353 - DNA, 20 bp, Artificial
  CRISPR gRNA sequence
cccttagacaactgacatct

SEQ ID NO: 111354 - DNA, 20 bp, Artificial
  CRISPR gRNA sequence
ggaagaagtgtttctaaaca

SEQ ID NO: 111355 - DNA, 20 bp, Artificial
  CRISPR gRNA sequence
aagtgtttctaaacagaaga

SEQ ID NO: 111356 - DNA, 20 bp, Artificial
  CRISPR gRNA sequence
tagggagttcattggtaaag

SEQ ID NO: 111357 - DNA, 20 bp, Artificial
  CRISPR gRNA sequence
tcaaagagcctctagtctag

SEQ ID NO: 111358 - DNA, 20 bp, Artificial
  CRISPR gRNA sequence
tttggtctgggaggaggagt

SEQ ID NO: 111359 - DNA, 20 bp, Artificial
  CRISPR gRNA sequence
gagcccaggcaagagctcaa

SEQ ID NO: 111360 - DNA, 20 bp, Artificial
  CRISPR gRNA sequence
aactgggacctagacagtta

SEQ ID NO: 111361 - DNA, 20 bp, Artificial
  CRISPR gRNA sequence
ttcaggagggatggtcatgg

SEQ ID NO: 111362 - DNA, 20 bp, Artificial
  CRISPR gRNA sequence
gtgattttatggaattcttt

SEQ ID NO: 111363 - DNA, 20 bp, Artificial
  CRISPR gRNA sequence
attgcccatgatggacaaaa

SEQ ID NO: 111364 - DNA, 20 bp, Artificial
  CRISPR gRNA sequence
aataagaaataagctaaaaa

SEQ ID NO: 111365 - DNA, 20 bp, Artificial
  CRISPR gRNA sequence
ttagaaagattgtaattgat

SEQ ID NO: 111366 - DNA, 20 bp, Artificial
  CRISPR gRNA sequence
ggatgttaaaatgcataaat

SEQ ID NO: 111367 - DNA, 20 bp, Artificial
  CRISPR gRNA sequence
agaggtggaggaagctatga

SEQ ID NO: 111368 - DNA, 20 bp, Artificial
  CRISPR gRNA sequence
tacagtgttttggtgttttt

SEQ ID NO: 111369 - DNA, 20 bp, Artificial
  CRISPR gRNA sequence
ttcctgaccattagatggca

SEQ ID NO: 111370 - DNA, 20 bp, Artificial
  CRISPR gRNA sequence
aaaaatggatgaagaggaac

SEQ ID NO: 111371 - DNA, 20 bp, Artificial
  CRISPR gRNA sequence
tggctctgtgcctgctatcc

SEQ ID NO: 111372 - DNA, 20 bp, Artificial
  CRISPR gRNA sequence
attgggaaggatataggaaa

SEQ ID NO: 111373 - DNA, 20 bp, Artificial
  CRISPR gRNA sequence
ctgcttaggctccagcctag

SEQ ID NO: 111374 - DNA, 20 bp, Artificial
  CRISPR gRNA sequence
cagcctaggaagaaagggaa

SEQ ID NO: 111375 - DNA, 20 bp, Artificial
  CRISPR gRNA sequence
gtcagagtgaaaccctgttt

SEQ ID NO: 111376 - DNA, 20 bp, Artificial
  CRISPR gRNA sequence
tcccagctgtcttaaacttt

SEQ ID NO: 111377 - DNA, 20 bp, Artificial
  CRISPR gRNA sequence
aaatggttttatttctcgtt

SEQ ID NO: 111378 - DNA, 20 bp, Artificial
  CRISPR gRNA sequence
cctgccacgggtctttgtcc

SEQ ID NO: 111379 - DNA, 20 bp, Artificial
  CRISPR gRNA sequence
ggtttaattaaataccctat

SEQ ID NO: 111380 - DNA, 20 bp, Artificial
  CRISPR gRNA sequence
agctaatttttaaatttttt

SEQ ID NO: 111381 - DNA, 20 bp, Artificial
  CRISPR gRNA sequence
ttaacacggtaggtcttaag

SEQ ID NO: 111382 - DNA, 20 bp, Artificial
  CRISPR gRNA sequence
ggccagactttaaattattt

SEQ ID NO: 111383 - DNA, 20 bp, Artificial
  CRISPR gRNA sequence
attctgccctttactacagg

SEQ ID NO: 111384 - DNA, 20 bp, Artificial
  CRISPR gRNA sequence
cttccaatctgtggtaataa

SEQ ID NO: 111385 - DNA, 20 bp, Artificial
  CRISPR gRNA sequence
tgatatttctggactctagc

SEQ ID NO: 111386 - DNA, 20 bp, Artificial
  CRISPR gRNA sequence
agaaaaagctaattctgggg

SEQ ID NO: 111387 - DNA, 20 bp, Artificial
  CRISPR gRNA sequence
cctgcagcacaatgctggcc

SEQ ID NO: 111388 - DNA, 20 bp, Artificial
  CRISPR gRNA sequence
gttttctccataggccttgt

SEQ ID NO: 111389 - DNA, 20 bp, Artificial
  CRISPR gRNA sequence
ttctcattgcatccatactg

SEQ ID NO: 111390 - DNA, 20 bp, Artificial
  CRISPR gRNA sequence
tgagaataaactgcagactg

SEQ ID NO: 111391 - DNA, 20 bp, Artificial
  CRISPR gRNA sequence
ttcccagaacgggttgtgcc

SEQ ID NO: 111392 - DNA, 20 bp, Artificial
  CRISPR gRNA sequence
gaacattgggggttaaatac

SEQ ID NO: 111393 - DNA, 20 bp, Artificial
  CRISPR gRNA sequence
ttcagcttaactgtattaag

SEQ ID NO: 111394 - DNA, 20 bp, Artificial
  CRISPR gRNA sequence
aaagagagatgattgtaatg

SEQ ID NO: 111395 - DNA, 20 bp, Artificial
  CRISPR gRNA sequence
ctgatcctttggtaagctca

SEQ ID NO: 111396 - DNA, 20 bp, Artificial
  CRISPR gRNA sequence
cagtaagtcccaagtttttc

SEQ ID NO: 111397 - DNA, 20 bp, Artificial
  CRISPR gRNA sequence
aggagtctaagatgcagagt

SEQ ID NO: 111398 - DNA, 20 bp, Artificial
  CRISPR gRNA sequence
gtctaagatgcagagttcag

SEQ ID NO: 111399 - DNA, 20 bp, Artificial
  CRISPR gRNA sequence
gtagtgataactttacagat

SEQ ID NO: 111400 - DNA, 20 bp, Artificial
  CRISPR gRNA sequence
caaaaacagccttaagtatt

SEQ ID NO: 111401 - DNA, 20 bp, Artificial
  CRISPR gRNA sequence
ctgccctggcagatgagaga

SEQ ID NO: 111402 - DNA, 20 bp, Artificial
  CRISPR gRNA sequence
cttcgcctcccccgtttcca

SEQ ID NO: 111403 - DNA, 20 bp, Artificial
  CRISPR gRNA sequence
cccggggaagtaggccccgc

SEQ ID NO: 111404 - DNA, 20 bp, Artificial
  CRISPR gRNA sequence
tacactggcctgatgtgtgg

SEQ ID NO: 111405 - DNA, 20 bp, Artificial
  CRISPR gRNA sequence
tgagatacgttattgttaga

SEQ ID NO: 111406 - DNA, 20 bp, Artificial
  CRISPR gRNA sequence
cccctttgaacaatgagtca

SEQ ID NO: 111407 - DNA, 20 bp, Artificial
  CRISPR gRNA sequence
tagcttttcagtggcaactt

SEQ ID NO: 111408 - DNA, 20 bp, Artificial
  CRISPR gRNA sequence
tgtaaaccctgaccaacaaa

SEQ ID NO: 111409 - DNA, 20 bp, Artificial
  CRISPR gRNA sequence
atccattaacatggtgtaac

SEQ ID NO: 111410 - DNA, 20 bp, Artificial
  CRISPR gRNA sequence
taattgaaacagaacgctta

SEQ ID NO: 111411 - DNA, 20 bp, Artificial
  CRISPR gRNA sequence
tctttccctcataccacaga

SEQ ID NO: 111412 - DNA, 20 bp, Artificial
  CRISPR gRNA sequence
atgctgtggatttttaacaa

SEQ ID NO: 111413 - DNA, 20 bp, Artificial
  CRISPR gRNA sequence
gtatgatcagcctgcaggtg

SEQ ID NO: 111414 - DNA, 20 bp, Artificial
  CRISPR gRNA sequence
agggtggaagggccaaaagg

SEQ ID NO: 111415 - DNA, 20 bp, Artificial
  CRISPR gRNA sequence
cttcgatatagttgaatccc

SEQ ID NO: 111416 - DNA, 20 bp, Artificial
  CRISPR gRNA sequence
tgaataaaagaactagtatc

SEQ ID NO: 111417 - DNA, 20 bp, Artificial
  CRISPR gRNA sequence
atggtgtgccaaagtgacca

SEQ ID NO: 111418 - DNA, 20 bp, Artificial
  CRISPR gRNA sequence
ctcagggttcaacatctaaa

SEQ ID NO: 111419 - DNA, 20 bp, Artificial
  CRISPR gRNA sequence
ttctcacagtatggatgcaa

SEQ ID NO: 111420 - DNA, 20 bp, Artificial
  CRISPR gRNA sequence
cctttctgcacaaggcctat

SEQ ID NO: 111421 - DNA, 20 bp, Artificial
  CRISPR gRNA sequence
aaaacatgaaaactggcacc

SEQ ID NO: 111422 - DNA, 20 bp, Artificial
  CRISPR gRNA sequence
caaagaatcagctgccatgg

SEQ ID NO: 111423 - DNA, 20 bp, Artificial
  CRISPR gRNA sequence
gtgtgactgaccagtgcttt

SEQ ID NO: 111424 - DNA, 20 bp, Artificial
  CRISPR gRNA sequence
attccaggtatccatccact

SEQ ID NO: 111425 - DNA, 20 bp, Artificial
  CRISPR gRNA sequence
caggccacaacttttcaaag

SEQ ID NO: 111426 - DNA, 20 bp, Artificial
  CRISPR gRNA sequence
agtcttttatcattctatcc

SEQ ID NO: 111427 - DNA, 20 bp, Artificial
  CRISPR gRNA sequence
agctttttcttggctagagt

SEQ ID NO: 111428 - DNA, 20 bp, Artificial
  CRISPR gRNA sequence
cttattattaccacagattg

SEQ ID NO: 111429 - DNA, 20 bp, Artificial
  CRISPR gRNA sequence
tttctgtcctgtagtaaagg

SEQ ID NO: 111430 - DNA, 20 bp, Artificial
  CRISPR gRNA sequence
tgatcaatttcctggaacag

SEQ ID NO: 111431 - DNA, 20 bp, Artificial
  CRISPR gRNA sequence
tctcactacttatcccccca

SEQ ID NO: 111432 - DNA, 20 bp, Artificial
  CRISPR gRNA sequence
ggtgtctaaggaaaagaccc

SEQ ID NO: 111433 - DNA, 20 bp, Artificial
  CRISPR gRNA sequence
atactgagtacttagcaggg

SEQ ID NO: 111434 - DNA, 20 bp, Artificial
  CRISPR gRNA sequence
tgagtacttagcagggctag

SEQ ID NO: 111435 - DNA, 20 bp, Artificial
  CRISPR gRNA sequence
agcagggctagaaagaatca

SEQ ID NO: 111436 - DNA, 20 bp, Artificial
  CRISPR gRNA sequence
tgcgtggactagggtcaggg

SEQ ID NO: 111437 - DNA, 20 bp, Artificial
  CRISPR gRNA sequence
aagccttggtaggcaggatc

SEQ ID NO: 111438 - DNA, 20 bp, Artificial
  CRISPR gRNA sequence
caagatcatattgttagcac

SEQ ID NO: 111439 - DNA, 20 bp, Artificial
  CRISPR gRNA sequence
ccgttatgaatgaatagcaa

SEQ ID NO: 111440 - DNA, 20 bp, Artificial
  CRISPR gRNA sequence
caaagttgcttagatgttat

SEQ ID NO: 111441 - DNA, 20 bp, Artificial
  CRISPR gRNA sequence
agtttgagatttgatgcagt

SEQ ID NO: 111442 - DNA, 20 bp, Artificial
  CRISPR gRNA sequence
aagtggaatgtgatgttaat

SEQ ID NO: 111443 - DNA, 20 bp, Artificial
  CRISPR gRNA sequence
atgggaggaatctattaatt

SEQ ID NO: 111444 - DNA, 20 bp, Artificial
  CRISPR gRNA sequence
cttaaatacaacttacttaa

SEQ ID NO: 111445 - DNA, 20 bp, Artificial
  CRISPR gRNA sequence
cttaaatattattacactgt

SEQ ID NO: 111446 - DNA, 20 bp, Artificial
  CRISPR gRNA sequence
tcacaccactgcctccaaaa

SEQ ID NO: 111447 - DNA, 20 bp, Artificial
  CRISPR gRNA sequence
agcagcatagagaccaagaa

SEQ ID NO: 111448 - DNA, 20 bp, Artificial
  CRISPR gRNA sequence
aaaacttgttccttgaaaat

SEQ ID NO: 111449 - DNA, 20 bp, Artificial
  CRISPR gRNA sequence
attaagaaaagtgtgatttt

SEQ ID NO: 111450 - DNA, 20 bp, Artificial
  CRISPR gRNA sequence
agaaaagtgtgattttcaag

SEQ ID NO: 111451 - DNA, 20 bp, Artificial
  CRISPR gRNA sequence
cataagattgcatccagttt

SEQ ID NO: 111452 - DNA, 20 bp, Artificial
  CRISPR gRNA sequence
tcaatacaaggtaataaaga

SEQ ID NO: 111453 - DNA, 20 bp, Artificial
  CRISPR gRNA sequence
ggactatccttttcctttgg

SEQ ID NO: 111454 - DNA, 20 bp, Artificial
  CRISPR gRNA sequence
tcatgcaggtatttctaaaa

SEQ ID NO: 111455 - DNA, 20 bp, Artificial
  CRISPR gRNA sequence
tcacaagggacaattatgac

SEQ ID NO: 111456 - DNA, 20 bp, Artificial
  CRISPR gRNA sequence
agaatgacgatggaagcttt

SEQ ID NO: 111457 - DNA, 20 bp, Artificial
  CRISPR gRNA sequence
aagtttattattattatttt

SEQ ID NO: 111458 - DNA, 20 bp, Artificial
  CRISPR gRNA sequence
acttcttcaaagtttccttg

SEQ ID NO: 111459 - DNA, 20 bp, Artificial
  CRISPR gRNA sequence
ctactcaggaggctgaggca

SEQ ID NO: 111460 - DNA, 20 bp, Artificial
  CRISPR gRNA sequence
agtctcaggaaaaaaaaaaa

SEQ ID NO: 111461 - DNA, 20 bp, Artificial
  CRISPR gRNA sequence
tcaattgtttggaaggtacg

SEQ ID NO: 111462 - DNA, 20 bp, Artificial
  CRISPR gRNA sequence
agctcgggcttgcctcctct

SEQ ID NO: 111463 - DNA, 20 bp, Artificial
  CRISPR gRNA sequence
tggtggcatgaagtatggac

SEQ ID NO: 111464 - DNA, 20 bp, Artificial
  CRISPR gRNA sequence
ttgggtaaatgcggatccct

SEQ ID NO: 111465 - DNA, 20 bp, Artificial
  CRISPR gRNA sequence
aggagattcaggtgccactc

SEQ ID NO: 111466 - DNA, 20 bp, Artificial
  CRISPR gRNA sequence
atttatttttcattcaattc

SEQ ID NO: 111467 - DNA, 20 bp, Artificial
  CRISPR gRNA sequence
cttcgttatttgaattctga

SEQ ID NO: 111468 - DNA, 20 bp, Artificial
  CRISPR gRNA sequence
cattgctttatctccagcat

SEQ ID NO: 111469 - DNA, 20 bp, Artificial
  CRISPR gRNA sequence
ccctggcacatagtaggtgc

SEQ ID NO: 111470 - DNA, 20 bp, Artificial
  CRISPR gRNA sequence
gaggcatcaagttgcatgtt

SEQ ID NO: 111471 - DNA, 20 bp, Artificial
  CRISPR gRNA sequence
tgaaacagggactgtaactt

SEQ ID NO: 111472 - DNA, 20 bp, Artificial
  CRISPR gRNA sequence
acaaaaaacaggcacacaga

SEQ ID NO: 111473 - DNA, 20 bp, Artificial
  CRISPR gRNA sequence
acacactgaaaaacacaagg

SEQ ID NO: 111474 - DNA, 20 bp, Artificial
  CRISPR gRNA sequence
atttaaagtaatggaatgac

SEQ ID NO: 111475 - DNA, 20 bp, Artificial
  CRISPR gRNA sequence
ccctatttctattcttctgt

SEQ ID NO: 111476 - DNA, 20 bp, Artificial
  CRISPR gRNA sequence
tccctagattagcaaccact

SEQ ID NO: 111477 - DNA, 20 bp, Artificial
  CRISPR gRNA sequence
ctgttggtcacagatggtga

SEQ ID NO: 111478 - DNA, 20 bp, Artificial
  CRISPR gRNA sequence
atgggtacacttaccttgct

SEQ ID NO: 111479 - DNA, 20 bp, Artificial
  CRISPR gRNA sequence
aggtgggaccaactgtatct

SEQ ID NO: 111480 - DNA, 20 bp, Artificial
  CRISPR gRNA sequence
cgagagttatccacatttct

SEQ ID NO: 111481 - DNA, 20 bp, Artificial
  CRISPR gRNA sequence
tatccacatttctctagaaa

SEQ ID NO: 111482 - DNA, 20 bp, Artificial
  CRISPR gRNA sequence
actgtctcaaaaaaacaaac

SEQ ID NO: 111483 - DNA, 20 bp, Artificial
  CRISPR gRNA sequence
agggccttgagaggaccttg

SEQ ID NO: 111484 - DNA, 20 bp, Artificial
  CRISPR gRNA sequence
tgtgtcaggattcctaactc

SEQ ID NO: 111485 - DNA, 20 bp, Artificial
  CRISPR gRNA sequence
ccactttattaggagtgtta

SEQ ID NO: 111486 - DNA, 20 bp, Artificial
  CRISPR gRNA sequence
cttttttttttaagtgcaaa

SEQ ID NO: 111487 - DNA, 20 bp, Artificial
  CRISPR gRNA sequence
aatgtcttgtattttatatt

SEQ ID NO: 111488 - DNA, 20 bp, Artificial
  CRISPR gRNA sequence
atacctcccaaacttaaaag

SEQ ID NO: 111489 - DNA, 20 bp, Artificial
  CRISPR gRNA sequence
agtctggaaggaggatactt

SEQ ID NO: 111490 - DNA, 20 bp, Artificial
  CRISPR gRNA sequence
actcagctcataattggcat

SEQ ID NO: 111491 - DNA, 20 bp, Artificial
  CRISPR gRNA sequence
tttttaaaatacagtatgaa

SEQ ID NO: 111492 - DNA, 20 bp, Artificial
  CRISPR gRNA sequence
attttaatctaaaattatat

SEQ ID NO: 111493 - DNA, 20 bp, Artificial
  CRISPR gRNA sequence
ctttactaggattctaaaat

SEQ ID NO: 111494 - DNA, 20 bp, Artificial
  CRISPR gRNA sequence
aaatggctactcaacactaa

SEQ ID NO: 111495 - DNA, 20 bp, Artificial
  CRISPR gRNA sequence
tagagagctttatttacgta

SEQ ID NO: 111496 - DNA, 20 bp, Artificial
  CRISPR gRNA sequence
aataaaaccccataaaaatc

SEQ ID NO: 111497 - DNA, 20 bp, Artificial
  CRISPR gRNA sequence
aaaaatcacagaatttagag

SEQ ID NO: 111498 - DNA, 20 bp, Artificial
  CRISPR gRNA sequence
attaaataacttggccaaga

SEQ ID NO: 111499 - DNA, 20 bp, Artificial
  CRISPR gRNA sequence
gaggaagcaaagagagaaga

SEQ ID NO: 111500 - DNA, 20 bp, Artificial
  CRISPR gRNA sequence
agcctcatatatttatgcaa

SEQ ID NO: 111501 - DNA, 20 bp, Artificial
  CRISPR gRNA sequence
acccaagcaatccccaatcc

SEQ ID NO: 111502 - DNA, 20 bp, Artificial
  CRISPR gRNA sequence
ccaatccaaagaaattatcc

SEQ ID NO: 111503 - DNA, 20 bp, Artificial
  CRISPR gRNA sequence
ccttaactatattttataaa

SEQ ID NO: 111504 - DNA, 20 bp, Artificial
  CRISPR gRNA sequence
caagttgactgaacattatg

SEQ ID NO: 111505 - DNA, 20 bp, Artificial
  CRISPR gRNA sequence
aaattatgcataaaaacaca

SEQ ID NO: 111506 - DNA, 20 bp, Artificial
  CRISPR gRNA sequence
ttttttcaacttaaattcct

SEQ ID NO: 111507 - DNA, 20 bp, Artificial
  CRISPR gRNA sequence
gtttttttttgccatctcga

SEQ ID NO: 111508 - DNA, 20 bp, Artificial
  CRISPR gRNA sequence
atctcttctttttttttgag

SEQ ID NO: 111509 - DNA, 20 bp, Artificial
  CRISPR gRNA sequence
atatcactggtactataaag

SEQ ID NO: 111510 - DNA, 20 bp, Artificial
  CRISPR gRNA sequence
cttgctgcaaaccctgtgtt

SEQ ID NO: 111511 - DNA, 20 bp, Artificial
  CRISPR gRNA sequence
attaatggctgcccttggac

SEQ ID NO: 111512 - DNA, 20 bp, Artificial
  CRISPR gRNA sequence
ggaactattctgctgccttg

SEQ ID NO: 111513 - DNA, 20 bp, Artificial
  CRISPR gRNA sequence
ccttgctagaaaaggaaaag

SEQ ID NO: 111514 - DNA, 20 bp, Artificial
  CRISPR gRNA sequence
aaggaaaaggtagaaaagac

SEQ ID NO: 111515 - DNA, 20 bp, Artificial
  CRISPR gRNA sequence
actttaaggtcagacataat

SEQ ID NO: 111516 - DNA, 20 bp, Artificial
  CRISPR gRNA sequence
tcccaatacaaaaataccta

SEQ ID NO: 111517 - DNA, 20 bp, Artificial
  CRISPR gRNA sequence
attttcagactctatctttg

SEQ ID NO: 111518 - DNA, 20 bp, Artificial
  CRISPR gRNA sequence
tttgacagaaattacttaga

SEQ ID NO: 111519 - DNA, 20 bp, Artificial
  CRISPR gRNA sequence
ctgccaccaccactaatgta

SEQ ID NO: 111520 - DNA, 20 bp, Artificial
  CRISPR gRNA sequence
aatgcttgcatattctgtat

SEQ ID NO: 111521 - DNA, 20 bp, Artificial
  CRISPR gRNA sequence
tctgtatcaagaaagatttc

SEQ ID NO: 111522 - DNA, 20 bp, Artificial
  CRISPR gRNA sequence
atttctcagaatacatatag

SEQ ID NO: 111523 - DNA, 20 bp, Artificial
  CRISPR gRNA sequence
aagagctcactgtatttaca

SEQ ID NO: 111524 - DNA, 20 bp, Artificial
  CRISPR gRNA sequence
aaagaactgtattgattaac

SEQ ID NO: 111525 - DNA, 20 bp, Artificial
  CRISPR gRNA sequence
ggctttaacacctaagactt

SEQ ID NO: 111526 - DNA, 20 bp, Artificial
  CRISPR gRNA sequence
ataaattctaatgtcactta

SEQ ID NO: 111527 - DNA, 20 bp, Artificial
  CRISPR gRNA sequence
tttcttttccaggcattctc

SEQ ID NO: 111528 - DNA, 20 bp, Artificial
  CRISPR gRNA sequence
atgctagtcaaatccaattc

SEQ ID NO: 111529 - DNA, 20 bp, Artificial
  CRISPR gRNA sequence
gaagttcatgcagtgctcac

SEQ ID NO: 111530 - DNA, 20 bp, Artificial
  CRISPR gRNA sequence
ttgtaatgcaatctttccct

SEQ ID NO: 111531 - DNA, 20 bp, Artificial
  CRISPR gRNA sequence
tatctcctcagatgagttca

SEQ ID NO: 111532 - DNA, 20 bp, Artificial
  CRISPR gRNA sequence
ctgggcttaaatgcaatcac

SEQ ID NO: 111533 - DNA, 20 bp, Artificial
  CRISPR gRNA sequence
tccactaatggcaaattctg

SEQ ID NO: 111534 - DNA, 20 bp, Artificial
  CRISPR gRNA sequence
caatcttggcctaaggtcaa

SEQ ID NO: 111535 - DNA, 20 bp, Artificial
  CRISPR gRNA sequence
ataaacccaagcataaagca

SEQ ID NO: 111536 - DNA, 20 bp, Artificial
  CRISPR gRNA sequence
atgtaacctgtgtataaatt

SEQ ID NO: 111537 - DNA, 20 bp, Artificial
  CRISPR gRNA sequence
tttctagtatgtcttatcca

SEQ ID NO: 111538 - DNA, 20 bp, Artificial
  CRISPR gRNA sequence
acaagttagctcaaacaaga

SEQ ID NO: 111539 - DNA, 20 bp, Artificial
  CRISPR gRNA sequence
caagaagagaaaaagaccaa

SEQ ID NO: 111540 - DNA, 20 bp, Artificial
  CRISPR gRNA sequence
agaaaaagaccaaatagaat

SEQ ID NO: 111541 - DNA, 20 bp, Artificial
  CRISPR gRNA sequence
ggctgtgaggtacactcctg

SEQ ID NO: 111542 - DNA, 20 bp, Artificial
  CRISPR gRNA sequence
ctcctgttagaaaggtgggg

SEQ ID NO: 111543 - DNA, 20 bp, Artificial
  CRISPR gRNA sequence
ttatcactgtactttatttg

SEQ ID NO: 111544 - DNA, 20 bp, Artificial
  CRISPR gRNA sequence
atttgcaagaaaacaggata

SEQ ID NO: 111545 - DNA, 20 bp, Artificial
  CRISPR gRNA sequence
caggtttgcacatatacttt

SEQ ID NO: 111546 - DNA, 20 bp, Artificial
  CRISPR gRNA sequence
tgtctcaatacagtgtgaaa

SEQ ID NO: 111547 - DNA, 20 bp, Artificial
  CRISPR gRNA sequence
gcaactatatgtccaagtac

SEQ ID NO: 111548 - DNA, 20 bp, Artificial
  CRISPR gRNA sequence
caaaaaatggatgaatgggt

SEQ ID NO: 111549 - DNA, 20 bp, Artificial
  CRISPR gRNA sequence
acacttgaaaattcttattt

SEQ ID NO: 111550 - DNA, 20 bp, Artificial
  CRISPR gRNA sequence
gaaaattcttatttctagaa

SEQ ID NO: 111551 - DNA, 20 bp, Artificial
  CRISPR gRNA sequence
tatttctagaataagaattt

SEQ ID NO: 111552 - DNA, 20 bp, Artificial
  CRISPR gRNA sequence
taaccaaaatggatacaaca

SEQ ID NO: 111553 - DNA, 20 bp, Artificial
  CRISPR gRNA sequence
gctcctcagagattctgggt

SEQ ID NO: 111554 - DNA, 20 bp, Artificial
  CRISPR gRNA sequence
tcagagattctgggtataga

SEQ ID NO: 111555 - DNA, 20 bp, Artificial
  CRISPR gRNA sequence
aagacatcagtaatctagag

SEQ ID NO: 111556 - DNA, 20 bp, Artificial
  CRISPR gRNA sequence
atcagtggttccttgggagt

SEQ ID NO: 111557 - DNA, 20 bp, Artificial
  CRISPR gRNA sequence
aatggtttttcctcaaagag

SEQ ID NO: 111558 - DNA, 20 bp, Artificial
  CRISPR gRNA sequence
actccaaagctaaaacctct

SEQ ID NO: 111559 - DNA, 20 bp, Artificial
  CRISPR gRNA sequence
tttttgaccacaacccttag

SEQ ID NO: 111560 - DNA, 20 bp, Artificial
  CRISPR gRNA sequence
tctgaaggttttaaaaataa

SEQ ID NO: 111561 - DNA, 20 bp, Artificial
  CRISPR gRNA sequence
ggatgaactggtcttaagtg

SEQ ID NO: 111562 - DNA, 20 bp, Artificial
  CRISPR gRNA sequence
aagagagcataaaaacaaga

SEQ ID NO: 111563 - DNA, 20 bp, Artificial
  CRISPR gRNA sequence
tttctctcaaaatgtcagac

SEQ ID NO: 111564 - DNA, 20 bp, Artificial
  CRISPR gRNA sequence
ttaccagattataatgcctt

SEQ ID NO: 111565 - DNA, 20 bp, Artificial
  CRISPR gRNA sequence
aacgtgacaatcaaatgaat

SEQ ID NO: 111566 - DNA, 20 bp, Artificial
  CRISPR gRNA sequence
gtataacattaaatgtgaat

SEQ ID NO: 111567 - DNA, 20 bp, Artificial
  CRISPR gRNA sequence
gggcagaacccataaacaag

SEQ ID NO: 111568 - DNA, 20 bp, Artificial
  CRISPR gRNA sequence
gctcttccatctttcctgtg

SEQ ID NO: 111569 - DNA, 20 bp, Artificial
  CRISPR gRNA sequence
gttagtttctaaacatctgc

SEQ ID NO: 111570 - DNA, 20 bp, Artificial
  CRISPR gRNA sequence
acacaggacttgaaagtgta

SEQ ID NO: 111571 - DNA, 20 bp, Artificial
  CRISPR gRNA sequence
caagcctgacacaaagtaac

SEQ ID NO: 111572 - DNA, 20 bp, Artificial
  CRISPR gRNA sequence
gcaagttgtgcagcctccgg

SEQ ID NO: 111573 - DNA, 20 bp, Artificial
  CRISPR gRNA sequence
gactggtcttacagcccgga

SEQ ID NO: 111574 - DNA, 20 bp, Artificial
  CRISPR gRNA sequence
atattttttcctaagattga

SEQ ID NO: 111575 - DNA, 20 bp, Artificial
  CRISPR gRNA sequence
tatacaactaataggtttca

SEQ ID NO: 111576 - DNA, 20 bp, Artificial
  CRISPR gRNA sequence
ttccagtgctctttcattac

SEQ ID NO: 111577 - DNA, 20 bp, Artificial
  CRISPR gRNA sequence
gatagagcttaagtagtcta

SEQ ID NO: 111578 - DNA, 20 bp, Artificial
  CRISPR gRNA sequence
atcctcccttcttgttctcc

SEQ ID NO: 111579 - DNA, 20 bp, Artificial
  CRISPR gRNA sequence
cagagatttctttttatttt

SEQ ID NO: 111580 - DNA, 20 bp, Artificial
  CRISPR gRNA sequence
ttgtttctctctctttgagg

SEQ ID NO: 111581 - DNA, 20 bp, Artificial
  CRISPR gRNA sequence
ctctttgaggaaaaaccatt

SEQ ID NO: 111582 - DNA, 20 bp, Artificial
  CRISPR gRNA sequence
ctgctaccacaatgaagata

SEQ ID NO: 111583 - DNA, 20 bp, Artificial
  CRISPR gRNA sequence
aacagactcacagtctggct

SEQ ID NO: 111584 - DNA, 20 bp, Artificial
  CRISPR gRNA sequence
agagactggtgtaaaaatca

SEQ ID NO: 111585 - DNA, 20 bp, Artificial
  CRISPR gRNA sequence
ttcagcagcaggtatggaag

SEQ ID NO: 111586 - DNA, 20 bp, Artificial
  CRISPR gRNA sequence
tcttttatctcattttaagt

SEQ ID NO: 111587 - DNA, 20 bp, Artificial
  CRISPR gRNA sequence
aaaaataaggttgaatcatt

SEQ ID NO: 111588 - DNA, 20 bp, Artificial
  CRISPR gRNA sequence
gaattcaagaccagcctggg

SEQ ID NO: 111589 - DNA, 20 bp, Artificial
  CRISPR gRNA sequence
tatggtagtttcagggctat

SEQ ID NO: 111590 - DNA, 20 bp, Artificial
  CRISPR gRNA sequence
tttaatcctactaccttcaa

SEQ ID NO: 111591 - DNA, 20 bp, Artificial
  CRISPR gRNA sequence
tctaatttggccagttccta

SEQ ID NO: 111592 - DNA, 20 bp, Artificial
  CRISPR gRNA sequence
tgcttcatcttactcatata

SEQ ID NO: 111593 - DNA, 20 bp, Artificial
  CRISPR gRNA sequence
aattattaatagctgtatct

SEQ ID NO: 111594 - DNA, 20 bp, Artificial
  CRISPR gRNA sequence
gttctcaatggacagtttaa

SEQ ID NO: 111595 - DNA, 20 bp, Artificial
  CRISPR gRNA sequence
tccagtgattgtcttttggt

SEQ ID NO: 111596 - DNA, 20 bp, Artificial
  CRISPR gRNA sequence
ttagaaagttagaaaaataa

SEQ ID NO: 111597 - DNA, 20 bp, Artificial
  CRISPR gRNA sequence
gggtccaaattaattaagta

SEQ ID NO: 111598 - DNA, 20 bp, Artificial
  CRISPR gRNA sequence
agattgtttaagcagaccaa

SEQ ID NO: 111599 - DNA, 20 bp, Artificial
  CRISPR gRNA sequence
gaaacactgattgagaaaca

SEQ ID NO: 111600 - DNA, 20 bp, Artificial
  CRISPR gRNA sequence
gaccagcctggccaacatga

SEQ ID NO: 111601 - DNA, 20 bp, Artificial
  CRISPR gRNA sequence
ttctcatcgagatggcaaaa

SEQ ID NO: 111602 - DNA, 20 bp, Artificial
  CRISPR gRNA sequence
aatcattatttttggtaatt

SEQ ID NO: 111603 - DNA, 20 bp, Artificial
  CRISPR gRNA sequence
ctatagagaaggatattttt

SEQ ID NO: 111604 - DNA, 20 bp, Artificial
  CRISPR gRNA sequence
atttttaaaaacaaattgac

SEQ ID NO: 111605 - DNA, 20 bp, Artificial
  CRISPR gRNA sequence
caaataaaagtaaacaaggt

SEQ ID NO: 111606 - DNA, 20 bp, Artificial
  CRISPR gRNA sequence
tatcctagaagttagcagct

SEQ ID NO: 111607 - DNA, 20 bp, Artificial
  CRISPR gRNA sequence
ataccactgctatctttcat

SEQ ID NO: 111608 - DNA, 20 bp, Artificial
  CRISPR gRNA sequence
ctagctctgtcacacaggag

SEQ ID NO: 111609 - DNA, 20 bp, Artificial
  CRISPR gRNA sequence
tgtatagtagaaaaggggat

SEQ ID NO: 111610 - DNA, 20 bp, Artificial
  CRISPR gRNA sequence
tccaaaccttttcacctttt

SEQ ID NO: 111611 - DNA, 20 bp, Artificial
  CRISPR gRNA sequence
ctgctaaggatagagttact

SEQ ID NO: 111612 - DNA, 20 bp, Artificial
  CRISPR gRNA sequence
gcagctgcagttataataac

SEQ ID NO: 111613 - DNA, 20 bp, Artificial
  CRISPR gRNA sequence
ctttagattatcttttatct

SEQ ID NO: 111614 - DNA, 20 bp, Artificial
  CRISPR gRNA sequence
gaccagcctgggcaacatgg

SEQ ID NO: 111615 - DNA, 20 bp, Artificial
  CRISPR gRNA sequence
ccatctctacaaaaaaatac

SEQ ID NO: 111616 - DNA, 20 bp, Artificial
  CRISPR gRNA sequence
ctggccttcagatttatctg

SEQ ID NO: 111617 - DNA, 20 bp, Artificial
  CRISPR gRNA sequence
cagtatttaaatgatgatca

SEQ ID NO: 111618 - DNA, 20 bp, Artificial
  CRISPR gRNA sequence
ggaagaacaaccttctcaac

SEQ ID NO: 111619 - DNA, 20 bp, Artificial
  CRISPR gRNA sequence
ctgccttctctggaaacaag

SEQ ID NO: 111620 - DNA, 20 bp, Artificial
  CRISPR gRNA sequence
agacagaaattaagccctct

SEQ ID NO: 111621 - DNA, 20 bp, Artificial
  CRISPR gRNA sequence
ggaaaattagccgttatcac

SEQ ID NO: 111622 - DNA, 20 bp, Artificial
  CRISPR gRNA sequence
attttgttttggcagaagac

SEQ ID NO: 111623 - DNA, 20 bp, Artificial
  CRISPR gRNA sequence
gaagggggccagaagtactt

SEQ ID NO: 111624 - DNA, 20 bp, Artificial
  CRISPR gRNA sequence
gtgtattcagacaaaattta

SEQ ID NO: 111625 - DNA, 20 bp, Artificial
  CRISPR gRNA sequence
agaaaatgctcggggttggg

SEQ ID NO: 111626 - DNA, 20 bp, Artificial
  CRISPR gRNA sequence
caaaagatgtcctcccacgc

SEQ ID NO: 111627 - DNA, 20 bp, Artificial
  CRISPR gRNA sequence
gattcccagcgaccgtaagg

SEQ ID NO: 111628 - DNA, 20 bp, Artificial
  CRISPR gRNA sequence
cttttgttttggtcttctgc

SEQ ID NO: 111629 - DNA, 20 bp, Artificial
  CRISPR gRNA sequence
tctgccaaaacaaaatctaa

SEQ ID NO: 111630 - DNA, 20 bp, Artificial
  CRISPR gRNA sequence
cgcccccatactgctggggg

SEQ ID NO: 111631 - DNA, 20 bp, Artificial
  CRISPR gRNA sequence
tgttagtaatctattctctg

SEQ ID NO: 111632 - DNA, 20 bp, Artificial
  CRISPR gRNA sequence
tcacagtatggatgcaatga

SEQ ID NO: 111633 - DNA, 20 bp, Artificial
  CRISPR gRNA sequence
ttctgcacaaggcctatgga

SEQ ID NO: 111634 - DNA, 20 bp, Artificial
  CRISPR gRNA sequence
aaggcctatggagaaaacat

SEQ ID NO: 111635 - DNA, 20 bp, Artificial
  CRISPR gRNA sequence
gtaatactgagccacttatt

SEQ ID NO: 111636 - DNA, 20 bp, Artificial
  CRISPR gRNA sequence
ctgggtcttgaacaatgagc

SEQ ID NO: 111637 - DNA, 20 bp, Artificial
  CRISPR gRNA sequence
ctggggactggcaggttaaa

SEQ ID NO: 111638 - DNA, 20 bp, Artificial
  CRISPR gRNA sequence
ttatatttgtgatggggtaa

SEQ ID NO: 111639 - DNA, 20 bp, Artificial
  CRISPR gRNA sequence
taaaacctgttcaataaaaa

SEQ ID NO: 111640 - DNA, 20 bp, Artificial
  CRISPR gRNA sequence
gagactcatgcaggtatttc

SEQ ID NO: 111641 - DNA, 20 bp, Artificial
  CRISPR gRNA sequence
ggtatttctaaaacgagaaa

SEQ ID NO: 111642 - DNA, 20 bp, Artificial
  CRISPR gRNA sequence
atgacgatggaagctttgga

SEQ ID NO: 111643 - DNA, 20 bp, Artificial
  CRISPR gRNA sequence
ggtgaaaccccgtctctact

SEQ ID NO: 111644 - DNA, 20 bp, Artificial
  CRISPR gRNA sequence
attgtttggaaggtacgtga

SEQ ID NO: 111645 - DNA, 20 bp, Artificial
  CRISPR gRNA sequence
gaacagtagtcataagacaa

SEQ ID NO: 111646 - DNA, 20 bp, Artificial
  CRISPR gRNA sequence
ttcaatcctaatttttctta

SEQ ID NO: 111647 - DNA, 20 bp, Artificial
  CRISPR gRNA sequence
taatttttcttaaaaaacac

SEQ ID NO: 111648 - DNA, 20 bp, Artificial
  CRISPR gRNA sequence
acactgtactaaatgtaggt

SEQ ID NO: 111649 - DNA, 20 bp, Artificial
  CRISPR gRNA sequence
aacagggactgtaactttaa

SEQ ID NO: 111650 - DNA, 20 bp, Artificial
  CRISPR gRNA sequence
ggactgtaactttaagaaaa

SEQ ID NO: 111651 - DNA, 20 bp, Artificial
  CRISPR gRNA sequence
aactttaagaaaacaaaaca

SEQ ID NO: 111652 - DNA, 20 bp, Artificial
  CRISPR gRNA sequence
aacaaaacataaaacaaaca

SEQ ID NO: 111653 - DNA, 20 bp, Artificial
  CRISPR gRNA sequence
tatacactcaccgatcctgg

SEQ ID NO: 111654 - DNA, 20 bp, Artificial
  CRISPR gRNA sequence
gatcctggcaaaacacactg

SEQ ID NO: 111655 - DNA, 20 bp, Artificial
  CRISPR gRNA sequence
ctgcttcaggacagagattt

SEQ ID NO: 111656 - DNA, 20 bp, Artificial
  CRISPR gRNA sequence
caatgagtcagttgtagtat

SEQ ID NO: 111657 - DNA, 20 bp, Artificial
  CRISPR gRNA sequence
agtaatggaatgacccagaa

SEQ ID NO: 111658 - DNA, 20 bp, Artificial
  CRISPR gRNA sequence
gaccagcctgggcaacatgg

SEQ ID NO: 111659 - DNA, 20 bp, Artificial
  CRISPR gRNA sequence
agagcgagtaactgtctcaa

SEQ ID NO: 111660 - DNA, 20 bp, Artificial
  CRISPR gRNA sequence
ctcaaaaaaacaaacaaaga

SEQ ID NO: 111661 - DNA, 20 bp, Artificial
  CRISPR gRNA sequence
ttctctaaattttggaacta

SEQ ID NO: 111662 - DNA, 20 bp, Artificial
  CRISPR gRNA sequence
actgatggaaggaaggtgaa

SEQ ID NO: 111663 - DNA, 20 bp, Artificial
  CRISPR gRNA sequence
tactcaacactaatgagaaa

SEQ ID NO: 111664 - DNA, 20 bp, Artificial
  CRISPR gRNA sequence
gaaggttccttatagcaaaa

SEQ ID NO: 111665 - DNA, 20 bp, Artificial
  CRISPR gRNA sequence
atttatgcaaagagaaatgt

SEQ ID NO: 111666 - DNA, 20 bp, Artificial
  CRISPR gRNA sequence
ctgagaattcagttgaaaaa

SEQ ID NO: 111667 - DNA, 20 bp, Artificial
  CRISPR gRNA sequence
gtttacctacaaaggcaaat

SEQ ID NO: 111668 - DNA, 20 bp, Artificial
  CRISPR gRNA sequence
aagaattaaaaaaaaaaaat

SEQ ID NO: 111669 - DNA, 20 bp, Artificial
  CRISPR gRNA sequence
tatgcccaaaaattatgcat

SEQ ID NO: 111670 - DNA, 20 bp, Artificial
  CRISPR gRNA sequence
tttcaacttaaattcctcca

SEQ ID NO: 111671 - DNA, 20 bp, Artificial
  CRISPR gRNA sequence
agtaagatgaagcaagcatg

SEQ ID NO: 111672 - DNA, 20 bp, Artificial
  CRISPR gRNA sequence
ggacctcaaaaatttgactc

SEQ ID NO: 111673 - DNA, 20 bp, Artificial
  CRISPR gRNA sequence
aaaaatttgactcaaaaact

SEQ ID NO: 111674 - DNA, 20 bp, Artificial
  CRISPR gRNA sequence
acgtcaatgctctcatgtcc

SEQ ID NO: 111675 - DNA, 20 bp, Artificial
  CRISPR gRNA sequence
tgcagcaccatgcccagctt

SEQ ID NO: 111676 - DNA, 20 bp, Artificial
  CRISPR gRNA sequence
atggcaaattctgaaagaat

SEQ ID NO: 111677 - DNA, 20 bp, Artificial
  CRISPR gRNA sequence
gtctttgatcattagacggg

SEQ ID NO: 111678 - DNA, 20 bp, Artificial
  CRISPR gRNA sequence
tattagctaaattccatttt

SEQ ID NO: 111679 - DNA, 20 bp, Artificial
  CRISPR gRNA sequence
aaatgtggcagaccaaatca

SEQ ID NO: 111680 - DNA, 20 bp, Artificial
  CRISPR gRNA sequence
taaagtccaaatttccatct

SEQ ID NO: 111681 - DNA, 20 bp, Artificial
  CRISPR gRNA sequence
tcactgtactttatttgcaa

SEQ ID NO: 111682 - DNA, 20 bp, Artificial
  CRISPR gRNA sequence
gcacaggtgtacaaatttgt

SEQ ID NO: 111683 - DNA, 20 bp, Artificial
  CRISPR gRNA sequence
acctacacaaactccaaagc

SEQ ID NO: 111684 - DNA, 20 bp, Artificial
  CRISPR gRNA sequence
tttaagtttagtaatggact

SEQ ID NO: 111685 - DNA, 20 bp, Artificial
  CRISPR gRNA sequence
actacaaatcaagagagcat

SEQ ID NO: 111686 - DNA, 20 bp, Artificial
  CRISPR gRNA sequence
ctatttttaaatactaaggt

SEQ ID NO: 111687 - DNA, 20 bp, Artificial
  CRISPR gRNA sequence
cagaggaaagccctgtatcc

SEQ ID NO: 111688 - DNA, 20 bp, Artificial
  CRISPR gRNA sequence
ctgtatccaaaaacaaacaa

SEQ ID NO: 111689 - DNA, 20 bp, Artificial
  CRISPR gRNA sequence
aaatcacttaagcaacaatg

SEQ ID NO: 111690 - DNA, 20 bp, Artificial
  CRISPR gRNA sequence
ctcaccctaaaaagtgaaaa

SEQ ID NO: 111691 - DNA, 20 bp, Artificial
  CRISPR gRNA sequence
cagcaacctctcaccctaag

SEQ ID NO: 111692 - DNA, 20 bp, Artificial
  CRISPR gRNA sequence
agtttctaaacatctgctga

SEQ ID NO: 111693 - DNA, 20 bp, Artificial
  CRISPR gRNA sequence
aggacttgaaagtgtatcag

SEQ ID NO: 111694 - DNA, 20 bp, Artificial
  CRISPR gRNA sequence
taacatagaaaggcgaaggc

SEQ ID NO: 111695 - DNA, 20 bp, Artificial
  CRISPR gRNA sequence
aaggcaaaaacaaagggaaa

SEQ ID NO: 111696 - DNA, 20 bp, Artificial
  CRISPR gRNA sequence
acaaagggaaaaaaaacccc

SEQ ID NO: 111697 - DNA, 20 bp, Artificial
  CRISPR gRNA sequence
aactggagttagtgggcgtg

SEQ ID NO: 111698 - DNA, 20 bp, Artificial
  CRISPR gRNA sequence
gagttagtgggcgtggcctc

SEQ ID NO: 111699 - DNA, 20 bp, Artificial
  CRISPR gRNA sequence
gtgggcgtggcctcagaggc

SEQ ID NO: 111700 - DNA, 20 bp, Artificial
  CRISPR gRNA sequence
agaggcgcctgcgcggaggc

SEQ ID NO: 111701 - DNA, 20 bp, Artificial
  CRISPR gRNA sequence
cgcggaggcggttggaggga

SEQ ID NO: 111702 - DNA, 20 bp, Artificial
  CRISPR gRNA sequence
gagggaggcccgattcccct

SEQ ID NO: 111703 - DNA, 20 bp, Artificial
  CRISPR gRNA sequence
ccctttgttcgggttcgcca

SEQ ID NO: 111704 - DNA, 20 bp, Artificial
  CRISPR gRNA sequence
tgttcgggttcgccattttg

SEQ ID NO: 111705 - DNA, 20 bp, Artificial
  CRISPR gRNA sequence
gttcgggttcgccattttgc

SEQ ID NO: 111706 - DNA, 20 bp, Artificial
  CRISPR gRNA sequence
ttcgggttcgccattttgct

SEQ ID NO: 111707 - DNA, 20 bp, Artificial
  CRISPR gRNA sequence
gggttcgccattttgctagg

SEQ ID NO: 111708 - DNA, 20 bp, Artificial
  CRISPR gRNA sequence
gccattttgctaggcagcgg

SEQ ID NO: 111709 - DNA, 20 bp, Artificial
  CRISPR gRNA sequence
tgctaggcagcggcagtggc

SEQ ID NO: 111710 - DNA, 20 bp, Artificial
  CRISPR gRNA sequence
gctaggcagcggcagtggcg

SEQ ID NO: 111711 - DNA, 20 bp, Artificial
  CRISPR gRNA sequence
ctaggcagcggcagtggcgg

SEQ ID NO: 111712 - DNA, 20 bp, Artificial
  CRISPR gRNA sequence
ggcagcggcagtggcggcgg

SEQ ID NO: 111713 - DNA, 20 bp, Artificial
  CRISPR gRNA sequence
gagcctctgattgggtttcg

SEQ ID NO: 111714 - DNA, 20 bp, Artificial
  CRISPR gRNA sequence
tgattgggtttcggagtccg

SEQ ID NO: 111715 - DNA, 20 bp, Artificial
  CRISPR gRNA sequence
attgggtttcggagtccggt

SEQ ID NO: 111716 - DNA, 20 bp, Artificial
  CRISPR gRNA sequence
ggtttcggagtccggtactg

SEQ ID NO: 111717 - DNA, 20 bp, Artificial
  CRISPR gRNA sequence
cggagtccggtactggagcc

SEQ ID NO: 111718 - DNA, 20 bp, Artificial
  CRISPR gRNA sequence
ggagtccggtactggagcca

SEQ ID NO: 111719 - DNA, 20 bp, Artificial
  CRISPR gRNA sequence
gagccaatcagcgcgggcag

SEQ ID NO: 111720 - DNA, 20 bp, Artificial
  CRISPR gRNA sequence
gcgggtctcgctgaccactc

SEQ ID NO: 111721 - DNA, 20 bp, Artificial
  CRISPR gRNA sequence
gctgaccactcaggagaggc

SEQ ID NO: 111722 - DNA, 20 bp, Artificial
  CRISPR gRNA sequence
accactcaggagaggcccag

SEQ ID NO: 111723 - DNA, 20 bp, Artificial
  CRISPR gRNA sequence
aggagaggcccaggcgcccg

SEQ ID NO: 111724 - DNA, 20 bp, Artificial
  CRISPR gRNA sequence
agcctagccgagccgggcgg

SEQ ID NO: 111725 - DNA, 20 bp, Artificial
  CRISPR gRNA sequence
gccgagccgggcggccagcg

SEQ ID NO: 111726 - DNA, 20 bp, Artificial
  CRISPR gRNA sequence
cgagcgcctcggggcactcc

SEQ ID NO: 111727 - DNA, 20 bp, Artificial
  CRISPR gRNA sequence
ggggcactcccggccgaggc

SEQ ID NO: 111728 - DNA, 20 bp, Artificial
  CRISPR gRNA sequence
ccggccgaggcctgcagggg

SEQ ID NO: 111729 - DNA, 20 bp, Artificial
  CRISPR gRNA sequence
caggggccgccccgcgcggg

SEQ ID NO: 111730 - DNA, 20 bp, Artificial
  CRISPR gRNA sequence
ggggagcaggcacctcgggg

SEQ ID NO: 111731 - DNA, 20 bp, Artificial
  CRISPR gRNA sequence
ggggctccgaccctcgcagg

SEQ ID NO: 111732 - DNA, 20 bp, Artificial
  CRISPR gRNA sequence
cgaccctcgcagggtgccag

SEQ ID NO: 111733 - DNA, 20 bp, Artificial
  CRISPR gRNA sequence
gcagggtgccagggccagtt

SEQ ID NO: 111734 - DNA, 20 bp, Artificial
  CRISPR gRNA sequence
ggaatgcgtccctgttcccc

SEQ ID NO: 111735 - DNA, 20 bp, Artificial
  CRISPR gRNA sequence
ttccccgactcaggcccagg

SEQ ID NO: 111736 - DNA, 20 bp, Artificial
  CRISPR gRNA sequence
cccgactcaggcccaggttc

SEQ ID NO: 111737 - DNA, 20 bp, Artificial
  CRISPR gRNA sequence
aggcccaggttctcaggccc

SEQ ID NO: 111738 - DNA, 20 bp, Artificial
  CRISPR gRNA sequence
tcaggccccaggcctggggc

SEQ ID NO: 111739 - DNA, 20 bp, Artificial
  CRISPR gRNA sequence
aggccccaggcctggggcca

SEQ ID NO: 111740 - DNA, 20 bp, Artificial
  CRISPR gRNA sequence
gggccacgaatggccctaca

SEQ ID NO: 111741 - DNA, 20 bp, Artificial
  CRISPR gRNA sequence
cactaggggacacatgcgcg

SEQ ID NO: 111742 - DNA, 20 bp, Artificial
  CRISPR gRNA sequence
ggggacacatgcgcgccctg

SEQ ID NO: 111743 - DNA, 20 bp, Artificial
  CRISPR gRNA sequence
ggcctcggcgatttcctcct

SEQ ID NO: 111744 - DNA, 20 bp, Artificial
  CRISPR gRNA sequence
ggcgatttcctcctggtcgt

SEQ ID NO: 111745 - DNA, 20 bp, Artificial
  CRISPR gRNA sequence
cctcctggtcgttctggccg

SEQ ID NO: 111746 - DNA, 20 bp, Artificial
  CRISPR gRNA sequence
ctcctggtcgttctggccgc

SEQ ID NO: 111747 - DNA, 20 bp, Artificial
  CRISPR gRNA sequence
ctggtcgttctggccgcaaa

SEQ ID NO: 111748 - DNA, 20 bp, Artificial
  CRISPR gRNA sequence
gtcgttctggccgcaaactt

SEQ ID NO: 111749 - DNA, 20 bp, Artificial
  CRISPR gRNA sequence
tggccgcaaacttaaacctg

SEQ ID NO: 111750 - DNA, 20 bp, Artificial
  CRISPR gRNA sequence
gccgcaaacttaaacctgcc

SEQ ID NO: 111751 - DNA, 20 bp, Artificial
  CRISPR gRNA sequence
aaacctgcccttgcactctc

SEQ ID NO: 111752 - DNA, 20 bp, Artificial
  CRISPR gRNA sequence
aacctgcccttgcactctcc

SEQ ID NO: 111753 - DNA, 20 bp, Artificial
  CRISPR gRNA sequence
cccttgcactctccactctc

SEQ ID NO: 111754 - DNA, 20 bp, Artificial
  CRISPR gRNA sequence
gcactctccactctccggcc

SEQ ID NO: 111755 - DNA, 20 bp, Artificial
  CRISPR gRNA sequence
cactctccactctccggccc

SEQ ID NO: 111756 - DNA, 20 bp, Artificial
  CRISPR gRNA sequence
tccactctccggcccttggg

SEQ ID NO: 111757 - DNA, 20 bp, Artificial
  CRISPR gRNA sequence
cactctccggcccttgggac

SEQ ID NO: 111758 - DNA, 20 bp, Artificial
  CRISPR gRNA sequence
tccggcccttgggacaggaa

SEQ ID NO: 111759 - DNA, 20 bp, Artificial
  CRISPR gRNA sequence
cggcccttgggacaggaagc

SEQ ID NO: 111760 - DNA, 20 bp, Artificial
  CRISPR gRNA sequence
gggacaggaagcctccccgg

SEQ ID NO: 111761 - DNA, 20 bp, Artificial
  CRISPR gRNA sequence
ggacaggaagcctccccggg

SEQ ID NO: 111762 - DNA, 20 bp, Artificial
  CRISPR gRNA sequence
cccggggcccgcgccccccg

SEQ ID NO: 111763 - DNA, 20 bp, Artificial
  CRISPR gRNA sequence
cccgctcccagcgagccggg

SEQ ID NO: 111764 - DNA, 20 bp, Artificial
  CRISPR gRNA sequence
ccagcgagccgggtctgtct

SEQ ID NO: 111765 - DNA, 20 bp, Artificial
  CRISPR gRNA sequence
tcttatctgcagcccctcta

SEQ ID NO: 111766 - DNA, 20 bp, Artificial
  CRISPR gRNA sequence
atctgcagcccctctaggtc

SEQ ID NO: 111767 - DNA, 20 bp, Artificial
  CRISPR gRNA sequence
tctgcagcccctctaggtcg

SEQ ID NO: 111768 - DNA, 20 bp, Artificial
  CRISPR gRNA sequence
cagcccctctaggtcgggag

SEQ ID NO: 111769 - DNA, 20 bp, Artificial
  CRISPR gRNA sequence
taggtcgggagggaggcctg

SEQ ID NO: 111770 - DNA, 20 bp, Artificial
  CRISPR gRNA sequence
ggtcgggagggaggcctggg

SEQ ID NO: 111771 - DNA, 20 bp, Artificial
  CRISPR gRNA sequence
gggagggtgcgcgccgcggc

SEQ ID NO: 111772 - DNA, 20 bp, Artificial
  CRISPR gRNA sequence
gcaacggggctggcccgccc

SEQ ID NO: 111773 - DNA, 20 bp, Artificial
  CRISPR gRNA sequence
gcccgcccacgcctcggagc

SEQ ID NO: 111774 - DNA, 20 bp, Artificial
  CRISPR gRNA sequence
ggagccctatgggcccgccc

SEQ ID NO: 111775 - DNA, 20 bp, Artificial
  CRISPR gRNA sequence
tgggcccgcccccgctgtct

SEQ ID NO: 111776 - DNA, 20 bp, Artificial
  CRISPR gRNA sequence
tctccctggtggggagaggg

SEQ ID NO: 111777 - DNA, 20 bp, Artificial
  CRISPR gRNA sequence
cctggtggggagagggggcc

SEQ ID NO: 111778 - DNA, 20 bp, Artificial
  CRISPR gRNA sequence
gtggggagagggggccgtta

SEQ ID NO: 111779 - DNA, 20 bp, Artificial
  CRISPR gRNA sequence
gttcgcccactccccctgct

SEQ ID NO: 111780 - DNA, 20 bp, Artificial
  CRISPR gRNA sequence
gcccactccccctgctccgc

SEQ ID NO: 111781 - DNA, 20 bp, Artificial
  CRISPR gRNA sequence
cccctgctccgccgcgcccc

SEQ ID NO: 111782 - DNA, 20 bp, Artificial
  CRISPR gRNA sequence
ctccgccgcgcccctcctcc

SEQ ID NO: 111783 - DNA, 20 bp, Artificial
  CRISPR gRNA sequence
cgccgcgcccctcctcccag

SEQ ID NO: 111784 - DNA, 20 bp, Artificial
  CRISPR gRNA sequence
ctcccagcccgctccgcccg

SEQ ID NO: 111785 - DNA, 20 bp, Artificial
  CRISPR gRNA sequence
ccagcccgctccgcccgggt

SEQ ID NO: 111786 - DNA, 20 bp, Artificial
  CRISPR gRNA sequence
cgcccgggtctccggcccgg

SEQ ID NO: 111787 - DNA, 20 bp, Artificial
  CRISPR gRNA sequence
cggcccggcgccgttaccac

SEQ ID NO: 111788 - DNA, 20 bp, Artificial
  CRISPR gRNA sequence
ccaccccttttggctcgtca

SEQ ID NO: 111789 - DNA, 20 bp, Artificial
  CRISPR gRNA sequence
ttggctcgtcatttcctctc

SEQ ID NO: 111790 - DNA, 20 bp, Artificial
  CRISPR gRNA sequence
tggctcgtcatttcctctct

SEQ ID NO: 111791 - DNA, 20 bp, Artificial
  CRISPR gRNA sequence
ggctcgtcatttcctctctt

SEQ ID NO: 111792 - DNA, 20 bp, Artificial
  CRISPR gRNA sequence
gctcgtcatttcctctcttc

SEQ ID NO: 111793 - DNA, 20 bp, Artificial
  CRISPR gRNA sequence
gtcatttcctctcttccccg

SEQ ID NO: 111794 - DNA, 20 bp, Artificial
  CRISPR gRNA sequence
cctctcttccccgccccgtt

SEQ ID NO: 111795 - DNA, 20 bp, Artificial
  CRISPR gRNA sequence
ctctcttccccgccccgttc

SEQ ID NO: 111796 - DNA, 20 bp, Artificial
  CRISPR gRNA sequence
tcttccccgccccgttcgca

SEQ ID NO: 111797 - DNA, 20 bp, Artificial
  CRISPR gRNA sequence
ttccccgccccgttcgcagt

SEQ ID NO: 111798 - DNA, 20 bp, Artificial
  CRISPR gRNA sequence
ccccgccccgttcgcagtgg

SEQ ID NO: 111799 - DNA, 20 bp, Artificial
  CRISPR gRNA sequence
cccgccccgttcgcagtggc

SEQ ID NO: 111800 - DNA, 20 bp, Artificial
  CRISPR gRNA sequence
gcagtggcaggaccgcacac

SEQ ID NO: 111801 - DNA, 20 bp, Artificial
  CRISPR gRNA sequence
cgtcttggagcccaaccaag

SEQ ID NO: 111802 - DNA, 20 bp, Artificial
  CRISPR gRNA sequence
ggagcccaaccaagcggtct

SEQ ID NO: 111803 - DNA, 20 bp, Artificial
  CRISPR gRNA sequence
gagcccaaccaagcggtctc

SEQ ID NO: 111804 - DNA, 20 bp, Artificial
  CRISPR gRNA sequence
cgtttcttgtccgggctgta

SEQ ID NO: 111805 - DNA, 20 bp, Artificial
  CRISPR gRNA sequence
cttgtccgggctgtaagacc

SEQ ID NO: 111806 - DNA, 20 bp, Artificial
  CRISPR gRNA sequence
ttgtccgggctgtaagacca

SEQ ID NO: 111807 - DNA, 20 bp, Artificial
  CRISPR gRNA sequence
gtccgggctgtaagaccagt

SEQ ID NO: 111808 - DNA, 20 bp, Artificial
  CRISPR gRNA sequence
tccgggctgtaagaccagtc

SEQ ID NO: 111809 - DNA, 20 bp, Artificial
  CRISPR gRNA sequence
taagaccagtccattcggtg

SEQ ID NO: 111810 - DNA, 20 bp, Artificial
  CRISPR gRNA sequence
ggtgcctggaacctcactct

SEQ ID NO: 111811 - DNA, 20 bp, Artificial
  CRISPR gRNA sequence
gaacctcactcttagaagat

SEQ ID NO: 111812 - DNA, 20 bp, Artificial
  CRISPR gRNA sequence
actcttagaagattgatacc

SEQ ID NO: 111813 - DNA, 20 bp, Artificial
  CRISPR gRNA sequence
ttagaagattgatacccttg

SEQ ID NO: 111814 - DNA, 20 bp, Artificial
  CRISPR gRNA sequence
agaagattgatacccttgcg

SEQ ID NO: 111815 - DNA, 20 bp, Artificial
  CRISPR gRNA sequence
gaagattgatacccttgcgc

SEQ ID NO: 111816 - DNA, 20 bp, Artificial
  CRISPR gRNA sequence
atacccttgcgcattctttc

SEQ ID NO: 111817 - DNA, 20 bp, Artificial
  CRISPR gRNA sequence
gcgcattctttccggaggct

SEQ ID NO: 111818 - DNA, 20 bp, Artificial
  CRISPR gRNA sequence
cgcattctttccggaggctg

SEQ ID NO: 111819 - DNA, 20 bp, Artificial
  CRISPR gRNA sequence
tttccggaggctgcacaact

SEQ ID NO: 111820 - DNA, 20 bp, Artificial
  CRISPR gRNA sequence
tccggaggctgcacaacttg

SEQ ID NO: 111821 - DNA, 20 bp, Artificial
  CRISPR gRNA sequence
ccggaggctgcacaacttgc

SEQ ID NO: 111822 - DNA, 20 bp, Artificial
  CRISPR gRNA sequence
cggaggctgcacaacttgct

SEQ ID NO: 111823 - DNA, 20 bp, Artificial
  CRISPR gRNA sequence
cacaacttgctgttcatatt

SEQ ID NO: 111824 - DNA, 20 bp, Artificial
  CRISPR gRNA sequence
gctgttcatattactaatct

SEQ ID NO: 111825 - DNA, 20 bp, Artificial
  CRISPR gRNA sequence
ctgttcatattactaatctt

SEQ ID NO: 111826 - DNA, 20 bp, Artificial
  CRISPR gRNA sequence
ttcatattactaatcttatc

SEQ ID NO: 111827 - DNA, 20 bp, Artificial
  CRISPR gRNA sequence
atattactaatcttatccac

SEQ ID NO: 111828 - DNA, 20 bp, Artificial
  CRISPR gRNA sequence
ctaatcttatccactgctca

SEQ ID NO: 111829 - DNA, 20 bp, Artificial
  CRISPR gRNA sequence
atcttatccactgctcattt

SEQ ID NO: 111830 - DNA, 20 bp, Artificial
  CRISPR gRNA sequence
atccactgctcattttgtga

SEQ ID NO: 111831 - DNA, 20 bp, Artificial
  CRISPR gRNA sequence
tccactgctcattttgtgaa

SEQ ID NO: 111832 - DNA, 20 bp, Artificial
  CRISPR gRNA sequence
ctcattttgtgaaatctccc

SEQ ID NO: 111833 - DNA, 20 bp, Artificial
  CRISPR gRNA sequence
attttgtgaaatctccctcc

SEQ ID NO: 111834 - DNA, 20 bp, Artificial
  CRISPR gRNA sequence
tgtgaaatctccctcccttg

SEQ ID NO: 111835 - DNA, 20 bp, Artificial
  CRISPR gRNA sequence
gtgaaatctccctcccttgg

SEQ ID NO: 111836 - DNA, 20 bp, Artificial
  CRISPR gRNA sequence
tgaaatctccctcccttggg

SEQ ID NO: 111837 - DNA, 20 bp, Artificial
  CRISPR gRNA sequence
cctcccttgggaatatagta

SEQ ID NO: 111838 - DNA, 20 bp, Artificial
  CRISPR gRNA sequence
ccttgggaatatagtacagt

SEQ ID NO: 111839 - DNA, 20 bp, Artificial
  CRISPR gRNA sequence
gggaatatagtacagttttg

SEQ ID NO: 111840 - DNA, 20 bp, Artificial
  CRISPR gRNA sequence
ggaatatagtacagttttgg

SEQ ID NO: 111841 - DNA, 20 bp, Artificial
  CRISPR gRNA sequence
tgggggttttttttcccttt

SEQ ID NO: 111842 - DNA, 20 bp, Artificial
  CRISPR gRNA sequence
gggggttttttttccctttg

SEQ ID NO: 111843 - DNA, 20 bp, Artificial
  CRISPR gRNA sequence
ggggttttttttccctttgt

SEQ ID NO: 111844 - DNA, 20 bp, Artificial
  CRISPR gRNA sequence
tttttccctttgtttttgcc

SEQ ID NO: 111845 - DNA, 20 bp, Artificial
  CRISPR gRNA sequence
ttttccctttgtttttgcct

SEQ ID NO: 111846 - DNA, 20 bp, Artificial
  CRISPR gRNA sequence
tttccctttgtttttgcctt

SEQ ID NO: 111847 - DNA, 20 bp, Artificial
  CRISPR gRNA sequence
ttccctttgtttttgccttc

SEQ ID NO: 111848 - DNA, 20 bp, Artificial
  CRISPR gRNA sequence
tccctttgtttttgccttcg

SEQ ID NO: 111849 - DNA, 20 bp, Artificial
  CRISPR gRNA sequence
ccctttgtttttgccttcgc

SEQ ID NO: 111850 - DNA, 20 bp, Artificial
  CRISPR gRNA sequence
cctttgtttttgccttcgcc

SEQ ID NO: 111851 - DNA, 20 bp, Artificial
  CRISPR gRNA sequence
tgtttttgccttcgcctttc

SEQ ID NO: 111852 - DNA, 20 bp, Artificial
  CRISPR gRNA sequence
gtttttgccttcgcctttct

SEQ ID NO: 111853 - DNA, 20 bp, Artificial
  CRISPR gRNA sequence
tttttgccttcgcctttcta

SEQ ID NO: 111854 - DNA, 20 bp, Artificial
  CRISPR gRNA sequence
ttgccttcgcctttctatgt

SEQ ID NO: 111855 - DNA, 20 bp, Artificial
  CRISPR gRNA sequence
tgccttcgcctttctatgtt

SEQ ID NO: 111856 - DNA, 20 bp, Artificial
  CRISPR gRNA sequence
gccttcgcctttctatgtta

SEQ ID NO: 111857 - DNA, 20 bp, Artificial
  CRISPR gRNA sequence
ccttcgcctttctatgttac

SEQ ID NO: 111858 - DNA, 20 bp, Artificial
  CRISPR gRNA sequence
cgcctttctatgttactttg

SEQ ID NO: 111859 - DNA, 20 bp, Artificial
  CRISPR gRNA sequence
gcctttctatgttactttgt

SEQ ID NO: 111860 - DNA, 20 bp, Artificial
  CRISPR gRNA sequence
tctatgttactttgtgtcag

SEQ ID NO: 111861 - DNA, 20 bp, Artificial
  CRISPR gRNA sequence
ctatgttactttgtgtcagg

SEQ ID NO: 111862 - DNA, 20 bp, Artificial
  CRISPR gRNA sequence
tatgttactttgtgtcaggc

SEQ ID NO: 111863 - DNA, 20 bp, Artificial
  CRISPR gRNA sequence
tgttactttgtgtcaggctt

SEQ ID NO: 111864 - DNA, 20 bp, Artificial
  CRISPR gRNA sequence
ctttgtgtcaggcttgaccc

SEQ ID NO: 111865 - DNA, 20 bp, Artificial
  CRISPR gRNA sequence
tgtgtcaggcttgacccagt

SEQ ID NO: 111866 - DNA, 20 bp, Artificial
  CRISPR gRNA sequence
gtgtcaggcttgacccagtc

SEQ ID NO: 111867 - DNA, 20 bp, Artificial
  CRISPR gRNA sequence
tgtcaggcttgacccagtcc

SEQ ID NO: 111868 - DNA, 20 bp, Artificial
  CRISPR gRNA sequence
gacccagtccactcatctct

SEQ ID NO: 111869 - DNA, 20 bp, Artificial
  CRISPR gRNA sequence
acccagtccactcatctctt

SEQ ID NO: 111870 - DNA, 20 bp, Artificial
  CRISPR gRNA sequence
atctcttggtttatgttttt

SEQ ID NO: 111871 - DNA, 20 bp, Artificial
  CRISPR gRNA sequence
ttggtttatgtttttctgat

SEQ ID NO: 111872 - DNA, 20 bp, Artificial
  CRISPR gRNA sequence
ggtttatgtttttctgatac

SEQ ID NO: 111873 - DNA, 20 bp, Artificial
  CRISPR gRNA sequence
gtttatgtttttctgataca

SEQ ID NO: 111874 - DNA, 20 bp, Artificial
  CRISPR gRNA sequence
atgtttttctgatacacttt

SEQ ID NO: 111875 - DNA, 20 bp, Artificial
  CRISPR gRNA sequence
tgtttttctgatacactttc

SEQ ID NO: 111876 - DNA, 20 bp, Artificial
  CRISPR gRNA sequence
ttctgatacactttcaagtc

SEQ ID NO: 111877 - DNA, 20 bp, Artificial
  CRISPR gRNA sequence
tctgatacactttcaagtcc

SEQ ID NO: 111878 - DNA, 20 bp, Artificial
  CRISPR gRNA sequence
ctgatacactttcaagtcct

SEQ ID NO: 111879 - DNA, 20 bp, Artificial
  CRISPR gRNA sequence
tgatacactttcaagtcctg

SEQ ID NO: 111880 - DNA, 20 bp, Artificial
  CRISPR gRNA sequence
atacactttcaagtcctgtg

SEQ ID NO: 111881 - DNA, 20 bp, Artificial
  CRISPR gRNA sequence
tcaagtcctgtgttaacgtt

SEQ ID NO: 111882 - DNA, 20 bp, Artificial
  CRISPR gRNA sequence
caagtcctgtgttaacgttt

SEQ ID NO: 111883 - DNA, 20 bp, Artificial
  CRISPR gRNA sequence
aagtcctgtgttaacgtttt

SEQ ID NO: 111884 - DNA, 20 bp, Artificial
  CRISPR gRNA sequence
tgttaacgttttctcagcag

SEQ ID NO: 111885 - DNA, 20 bp, Artificial
  CRISPR gRNA sequence
acgttttctcagcagatgtt

SEQ ID NO: 111886 - DNA, 20 bp, Artificial
  CRISPR gRNA sequence
tctcagcagatgtttagaaa

SEQ ID NO: 111887 - DNA, 20 bp, Artificial
  CRISPR gRNA sequence
ctcagcagatgtttagaaac

SEQ ID NO: 111888 - DNA, 20 bp, Artificial
  CRISPR gRNA sequence
tcagcagatgtttagaaact

SEQ ID NO: 111889 - DNA, 20 bp, Artificial
  CRISPR gRNA sequence
agcagatgtttagaaactaa

SEQ ID NO: 111890 - DNA, 20 bp, Artificial
  CRISPR gRNA sequence
agaaactaacagtgttgtgg

SEQ ID NO: 111891 - DNA, 20 bp, Artificial
  CRISPR gRNA sequence
gaaactaacagtgttgtggg

SEQ ID NO: 111892 - DNA, 20 bp, Artificial
  CRISPR gRNA sequence
acagtgttgtggggttttcc

SEQ ID NO: 111893 - DNA, 20 bp, Artificial
  CRISPR gRNA sequence
tggggttttccttagggtga

SEQ ID NO: 111894 - DNA, 20 bp, Artificial
  CRISPR gRNA sequence
tccttagggtgagaggttgc

SEQ ID NO: 111895 - DNA, 20 bp, Artificial
  CRISPR gRNA sequence
ccttagggtgagaggttgct

SEQ ID NO: 111896 - DNA, 20 bp, Artificial
  CRISPR gRNA sequence
cttagggtgagaggttgctg

SEQ ID NO: 111897 - DNA, 20 bp, Artificial
  CRISPR gRNA sequence
agggtgagaggttgctgttg

SEQ ID NO: 111898 - DNA, 20 bp, Artificial
  CRISPR gRNA sequence
gggtgagaggttgctgttgg

SEQ ID NO: 111899 - DNA, 20 bp, Artificial
  CRISPR gRNA sequence
ctgttggcaaccaattatcc

SEQ ID NO: 111900 - DNA, 20 bp, Artificial
  CRISPR gRNA sequence
ttggcaaccaattatccagc

SEQ ID NO: 111901 - DNA, 20 bp, Artificial
  CRISPR gRNA sequence
gcaaccaattatccagcagt

SEQ ID NO: 111902 - DNA, 20 bp, Artificial
  CRISPR gRNA sequence
tccagcagttagtatatgcc

SEQ ID NO: 111903 - DNA, 20 bp, Artificial
  CRISPR gRNA sequence
gtatatgccaggtataatcc

SEQ ID NO: 111904 - DNA, 20 bp, Artificial
  CRISPR gRNA sequence
gggagggagtacgtagaggt

SEQ ID NO: 111905 - DNA, 20 bp, Artificial
  CRISPR gRNA sequence
tgcctacctgatggaaattg

SEQ ID NO: 111906 - DNA, 20 bp, Artificial
  CRISPR gRNA sequence
cctgatggaaattgacaggt

SEQ ID NO: 111907 - DNA, 20 bp, Artificial
  CRISPR gRNA sequence
atggaaattgacaggtgaac

SEQ ID NO: 111908 - DNA, 20 bp, Artificial
  CRISPR gRNA sequence
acaggtgaacaggtagttaa

SEQ ID NO: 111909 - DNA, 20 bp, Artificial
  CRISPR gRNA sequence
atacctaacggttagtgcta

SEQ ID NO: 111910 - DNA, 20 bp, Artificial
  CRISPR gRNA sequence
acggttagtgctataaaggg

SEQ ID NO: 111911 - DNA, 20 bp, Artificial
  CRISPR gRNA sequence
gtgctataaaggggccaagt

SEQ ID NO: 111912 - DNA, 20 bp, Artificial
  CRISPR gRNA sequence
taaaggggccaagttcagtt

SEQ ID NO: 111913 - DNA, 20 bp, Artificial
  CRISPR gRNA sequence
agttgctgtgaagtatccat

SEQ ID NO: 111914 - DNA, 20 bp, Artificial
  CRISPR gRNA sequence
ctgtgaagtatccatgcgtg

SEQ ID NO: 111915 - DNA, 20 bp, Artificial
  CRISPR gRNA sequence
tgaagtatccatgcgtgagc

SEQ ID NO: 111916 - DNA, 20 bp, Artificial
  CRISPR gRNA sequence
gcctccgtgaaaggcttatc

SEQ ID NO: 111917 - DNA, 20 bp, Artificial
  CRISPR gRNA sequence
cgtgaaaggcttatcaccac

SEQ ID NO: 111918 - DNA, 20 bp, Artificial
  CRISPR gRNA sequence
atcaccaccgcacttttgac

SEQ ID NO: 111919 - DNA, 20 bp, Artificial
  CRISPR gRNA sequence
tcaccaccgcacttttgact

SEQ ID NO: 111920 - DNA, 20 bp, Artificial
  CRISPR gRNA sequence
ttgactggccttgaagaatg

SEQ ID NO: 111921 - DNA, 20 bp, Artificial
  CRISPR gRNA sequence
tgactggccttgaagaatga

SEQ ID NO: 111922 - DNA, 20 bp, Artificial
  CRISPR gRNA sequence
gactggccttgaagaatgat

SEQ ID NO: 111923 - DNA, 20 bp, Artificial
  CRISPR gRNA sequence
actggccttgaagaatgatg

SEQ ID NO: 111924 - DNA, 20 bp, Artificial
  CRISPR gRNA sequence
gccttgaagaatgatggtaa

SEQ ID NO: 111925 - DNA, 20 bp, Artificial
  CRISPR gRNA sequence
gaagaatgatggtaattctt

SEQ ID NO: 111926 - DNA, 20 bp, Artificial
  CRISPR gRNA sequence
aagaatgatggtaattcttc

SEQ ID NO: 111927 - DNA, 20 bp, Artificial
  CRISPR gRNA sequence
ttccacaggaaagatggaag

SEQ ID NO: 111928 - DNA, 20 bp, Artificial
  CRISPR gRNA sequence
ccacaggaaagatggaagag

SEQ ID NO: 111929 - DNA, 20 bp, Artificial
  CRISPR gRNA sequence
cacaggaaagatggaagagc

SEQ ID NO: 111930 - DNA, 20 bp, Artificial
  CRISPR gRNA sequence
gctcgaagagaagaaaagca

SEQ ID NO: 111931 - DNA, 20 bp, Artificial
  CRISPR gRNA sequence
ctcgaagagaagaaaagcat

SEQ ID NO: 111932 - DNA, 20 bp, Artificial
  CRISPR gRNA sequence
gaagagaagaaaagcatgtg

SEQ ID NO: 111933 - DNA, 20 bp, Artificial
  CRISPR gRNA sequence
cactgttggaggcaggaaga

SEQ ID NO: 111934 - DNA, 20 bp, Artificial
  CRISPR gRNA sequence
ttggaggcaggaagatggga

SEQ ID NO: 111935 - DNA, 20 bp, Artificial
  CRISPR gRNA sequence
gaggcaggaagatgggatag

SEQ ID NO: 111936 - DNA, 20 bp, Artificial
  CRISPR gRNA sequence
tgatagtttaggggggaaag

SEQ ID NO: 111937 - DNA, 20 bp, Artificial
  CRISPR gRNA sequence
aggggggaaagcccagttgg

SEQ ID NO: 111938 - DNA, 20 bp, Artificial
  CRISPR gRNA sequence
ggggggaaagcccagttggt

SEQ ID NO: 111939 - DNA, 20 bp, Artificial
  CRISPR gRNA sequence
gtaaaatacttgtatatctt

SEQ ID NO: 111940 - DNA, 20 bp, Artificial
  CRISPR gRNA sequence
gtatatcttgctaaggaata

SEQ ID NO: 111941 - DNA, 20 bp, Artificial
  CRISPR gRNA sequence
tatatcttgctaaggaatat

SEQ ID NO: 111942 - DNA, 20 bp, Artificial
  CRISPR gRNA sequence
gctaaggaatattttggaaa

SEQ ID NO: 111943 - DNA, 20 bp, Artificial
  CRISPR gRNA sequence
ctaaggaatattttggaaac

SEQ ID NO: 111944 - DNA, 20 bp, Artificial
  CRISPR gRNA sequence
aggaatattttggaaacagt

SEQ ID NO: 111945 - DNA, 20 bp, Artificial
  CRISPR gRNA sequence
tggaaacagttattattttg

SEQ ID NO: 111946 - DNA, 20 bp, Artificial
  CRISPR gRNA sequence
ggaaacagttattattttgt

SEQ ID NO: 111947 - DNA, 20 bp, Artificial
  CRISPR gRNA sequence
gaaacagttattattttgta

SEQ ID NO: 111948 - DNA, 20 bp, Artificial
  CRISPR gRNA sequence
ttattttgtatggaggttca

SEQ ID NO: 111949 - DNA, 20 bp, Artificial
  CRISPR gRNA sequence
ttttgtatggaggttcaagt

SEQ ID NO: 111950 - DNA, 20 bp, Artificial
  CRISPR gRNA sequence
tgtatggaggttcaagtaga

SEQ ID NO: 111951 - DNA, 20 bp, Artificial
  CRISPR gRNA sequence
gtatggaggttcaagtagaa

SEQ ID NO: 111952 - DNA, 20 bp, Artificial
  CRISPR gRNA sequence
tatggaggttcaagtagaag

SEQ ID NO: 111953 - DNA, 20 bp, Artificial
  CRISPR gRNA sequence
aagtagaagggatctagagc

SEQ ID NO: 111954 - DNA, 20 bp, Artificial
  CRISPR gRNA sequence
gagctatattttttcctaag

SEQ ID NO: 111955 - DNA, 20 bp, Artificial
  CRISPR gRNA sequence
tattttttcctaagattgaa

SEQ ID NO: 111956 - DNA, 20 bp, Artificial
  CRISPR gRNA sequence
tttcctaagattgaaaaaac

SEQ ID NO: 111957 - DNA, 20 bp, Artificial
  CRISPR gRNA sequence
ttcctaagattgaaaaaacg

SEQ ID NO: 111958 - DNA, 20 bp, Artificial
  CRISPR gRNA sequence
tcctaagattgaaaaaacga

SEQ ID NO: 111959 - DNA, 20 bp, Artificial
  CRISPR gRNA sequence
cctaagattgaaaaaacgag

SEQ ID NO: 111960 - DNA, 20 bp, Artificial
  CRISPR gRNA sequence
ctaagattgaaaaaacgagt

SEQ ID NO: 111961 - DNA, 20 bp, Artificial
  CRISPR gRNA sequence
agattgaaaaaacgagtttc

SEQ ID NO: 111962 - DNA, 20 bp, Artificial
  CRISPR gRNA sequence
aaaaaacgagtttctgactt

SEQ ID NO: 111963 - DNA, 20 bp, Artificial
  CRISPR gRNA sequence
ctgacttgtttatgggttct

SEQ ID NO: 111964 - DNA, 20 bp, Artificial
  CRISPR gRNA sequence
tgacttgtttatgggttctg

SEQ ID NO: 111965 - DNA, 20 bp, Artificial
  CRISPR gRNA sequence
acttgtttatgggttctgcc

SEQ ID NO: 111966 - DNA, 20 bp, Artificial
  CRISPR gRNA sequence
gtttatgggttctgccccgt

SEQ ID NO: 111967 - DNA, 20 bp, Artificial
  CRISPR gRNA sequence
tttatgggttctgccccgtg

SEQ ID NO: 111968 - DNA, 20 bp, Artificial
  CRISPR gRNA sequence
atgggttctgccccgtgata

SEQ ID NO: 111969 - DNA, 20 bp, Artificial
  CRISPR gRNA sequence
tgggttctgccccgtgatag

SEQ ID NO: 111970 - DNA, 20 bp, Artificial
  CRISPR gRNA sequence
tgccccgtgatagtggctga

SEQ ID NO: 111971 - DNA, 20 bp, Artificial
  CRISPR gRNA sequence
ccccgtgatagtggctgagt

SEQ ID NO: 111972 - DNA, 20 bp, Artificial
  CRISPR gRNA sequence
agttctttggggatgaagag

SEQ ID NO: 111973 - DNA, 20 bp, Artificial
  CRISPR gRNA sequence
tttggggatgaagaggagac

SEQ ID NO: 111974 - DNA, 20 bp, Artificial
  CRISPR gRNA sequence
tggggatgaagaggagactt

SEQ ID NO: 111975 - DNA, 20 bp, Artificial
  CRISPR gRNA sequence
ggggatgaagaggagacttg

SEQ ID NO: 111976 - DNA, 20 bp, Artificial
  CRISPR gRNA sequence
gggatgaagaggagacttgt

SEQ ID NO: 111977 - DNA, 20 bp, Artificial
  CRISPR gRNA sequence
gtcctaggactctgaaaatt

SEQ ID NO: 111978 - DNA, 20 bp, Artificial
  CRISPR gRNA sequence
tcctaggactctgaaaatta

SEQ ID NO: 111979 - DNA, 20 bp, Artificial
  CRISPR gRNA sequence
ggactctgaaaattattttt

SEQ ID NO: 111980 - DNA, 20 bp, Artificial
  CRISPR gRNA sequence
tgaaaattatttttactcat

SEQ ID NO: 111981 - DNA, 20 bp, Artificial
  CRISPR gRNA sequence
aaaattatttttactcatgt

SEQ ID NO: 111982 - DNA, 20 bp, Artificial
  CRISPR gRNA sequence
tttttactcatgtgaatcat

SEQ ID NO: 111983 - DNA, 20 bp, Artificial
  CRISPR gRNA sequence
ttactcatgtgaatcatcta

SEQ ID NO: 111984 - DNA, 20 bp, Artificial
  CRISPR gRNA sequence
tactcatgtgaatcatctag

SEQ ID NO: 111985 - DNA, 20 bp, Artificial
  CRISPR gRNA sequence
actcatgtgaatcatctagt

SEQ ID NO: 111986 - DNA, 20 bp, Artificial
  CRISPR gRNA sequence
ctcatgtgaatcatctagtg

SEQ ID NO: 111987 - DNA, 20 bp, Artificial
  CRISPR gRNA sequence
atgtgaatcatctagtgcat

SEQ ID NO: 111988 - DNA, 20 bp, Artificial
  CRISPR gRNA sequence
gtgcattccctggcacataa

SEQ ID NO: 111989 - DNA, 20 bp, Artificial
  CRISPR gRNA sequence
cctggcacataaaggtctta

SEQ ID NO: 111990 - DNA, 20 bp, Artificial
  CRISPR gRNA sequence
gcacataaaggtcttaagta

SEQ ID NO: 111991 - DNA, 20 bp, Artificial
  CRISPR gRNA sequence
aagtatctggtgcccatttc

SEQ ID NO: 111992 - DNA, 20 bp, Artificial
  CRISPR gRNA sequence
agtatctggtgcccatttct

SEQ ID NO: 111993 - DNA, 20 bp, Artificial
  CRISPR gRNA sequence
gtgcccatttctaaattcac

SEQ ID NO: 111994 - DNA, 20 bp, Artificial
  CRISPR gRNA sequence
ctaaattcacatttaatgtt

SEQ ID NO: 111995 - DNA, 20 bp, Artificial
  CRISPR gRNA sequence
taaattcacatttaatgtta

SEQ ID NO: 111996 - DNA, 20 bp, Artificial
  CRISPR gRNA sequence
aattcacatttaatgttata

SEQ ID NO: 111997 - DNA, 20 bp, Artificial
  CRISPR gRNA sequence
acatttaatgttatacaact

SEQ ID NO: 111998 - DNA, 20 bp, Artificial
  CRISPR gRNA sequence
aatgttatacaactaatagg

SEQ ID NO: 111999 - DNA, 20 bp, Artificial
  CRISPR gRNA sequence
atgttatacaactaataggt

SEQ ID NO: 112000 - DNA, 20 bp, Artificial
  CRISPR gRNA sequence
tacaactaataggtttcaga

SEQ ID NO: 112001 - DNA, 20 bp, Artificial
  CRISPR gRNA sequence
ataggtttcagaaaactcgt

SEQ ID NO: 112002 - DNA, 20 bp, Artificial
  CRISPR gRNA sequence
cagaaaactcgtattccagt

SEQ ID NO: 112003 - DNA, 20 bp, Artificial
  CRISPR gRNA sequence
agaaaactcgtattccagtg

SEQ ID NO: 112004 - DNA, 20 bp, Artificial
  CRISPR gRNA sequence
gtattccagtgctctttcat

SEQ ID NO: 112005 - DNA, 20 bp, Artificial
  CRISPR gRNA sequence
cagtgctctttcattactaa

SEQ ID NO: 112006 - DNA, 20 bp, Artificial
  CRISPR gRNA sequence
tttcattactaaaacttcgg

SEQ ID NO: 112007 - DNA, 20 bp, Artificial
  CRISPR gRNA sequence
tcattactaaaacttcgggg

SEQ ID NO: 112008 - DNA, 20 bp, Artificial
  CRISPR gRNA sequence
cattactaaaacttcgggga

SEQ ID NO: 112009 - DNA, 20 bp, Artificial
  CRISPR gRNA sequence
attactaaaacttcggggac

SEQ ID NO: 112010 - DNA, 20 bp, Artificial
  CRISPR gRNA sequence
ctaaaacttcggggacaggt

SEQ ID NO: 112011 - DNA, 20 bp, Artificial
  CRISPR gRNA sequence
aaacttcggggacaggtttt

SEQ ID NO: 112012 - DNA, 20 bp, Artificial
  CRISPR gRNA sequence
cggggacaggttttattttc

SEQ ID NO: 112013 - DNA, 20 bp, Artificial
  CRISPR gRNA sequence
ggggacaggttttattttca

SEQ ID NO: 112014 - DNA, 20 bp, Artificial
  CRISPR gRNA sequence
tattttcactttttagggtg

SEQ ID NO: 112015 - DNA, 20 bp, Artificial
  CRISPR gRNA sequence
attttcactttttagggtga

SEQ ID NO: 112016 - DNA, 20 bp, Artificial
  CRISPR gRNA sequence
ttttcactttttagggtgag

SEQ ID NO: 112017 - DNA, 20 bp, Artificial
  CRISPR gRNA sequence
tcactttttagggtgagttt

SEQ ID NO: 112018 - DNA, 20 bp, Artificial
  CRISPR gRNA sequence
cactttttagggtgagtttt

SEQ ID NO: 112019 - DNA, 20 bp, Artificial
  CRISPR gRNA sequence
actttttagggtgagttttt

SEQ ID NO: 112020 - DNA, 20 bp, Artificial
  CRISPR gRNA sequence
tttagggtgagtttttcatt

SEQ ID NO: 112021 - DNA, 20 bp, Artificial
  CRISPR gRNA sequence
ttagggtgagtttttcattg

SEQ ID NO: 112022 - DNA, 20 bp, Artificial
  CRISPR gRNA sequence
tagggtgagtttttcattgt

SEQ ID NO: 112023 - DNA, 20 bp, Artificial
  CRISPR gRNA sequence
agggtgagtttttcattgtt

SEQ ID NO: 112024 - DNA, 20 bp, Artificial
  CRISPR gRNA sequence
gggtgagtttttcattgttg

SEQ ID NO: 112025 - DNA, 20 bp, Artificial
  CRISPR gRNA sequence
ttcattgttgcttaagtgat

SEQ ID NO: 112026 - DNA, 20 bp, Artificial
  CRISPR gRNA sequence
tcattgttgcttaagtgatt

SEQ ID NO: 112027 - DNA, 20 bp, Artificial
  CRISPR gRNA sequence
cattgttgcttaagtgattt

SEQ ID NO: 112028 - DNA, 20 bp, Artificial
  CRISPR gRNA sequence
attgttgcttaagtgatttt

SEQ ID NO: 112029 - DNA, 20 bp, Artificial
  CRISPR gRNA sequence
ttgcttaagtgattttctta

SEQ ID NO: 112030 - DNA, 20 bp, Artificial
  CRISPR gRNA sequence
cttaagtgattttcttaatt

SEQ ID NO: 112031 - DNA, 20 bp, Artificial
  CRISPR gRNA sequence
aagtgattttcttaattcat

SEQ ID NO: 112032 - DNA, 20 bp, Artificial
  CRISPR gRNA sequence
agtgattttcttaattcatt

SEQ ID NO: 112033 - DNA, 20 bp, Artificial
  CRISPR gRNA sequence
tcttaattcatttgattgtc

SEQ ID NO: 112034 - DNA, 20 bp, Artificial
  CRISPR gRNA sequence
cttaattcatttgattgtca

SEQ ID NO: 112035 - DNA, 20 bp, Artificial
  CRISPR gRNA sequence
ttaattcatttgattgtcac

SEQ ID NO: 112036 - DNA, 20 bp, Artificial
  CRISPR gRNA sequence
aattcatttgattgtcacgt

SEQ ID NO: 112037 - DNA, 20 bp, Artificial
  CRISPR gRNA sequence
attcatttgattgtcacgtt

SEQ ID NO: 112038 - DNA, 20 bp, Artificial
  CRISPR gRNA sequence
atttgattgtcacgttatcc

SEQ ID NO: 112039 - DNA, 20 bp, Artificial
  CRISPR gRNA sequence
gattgtcacgttatccgcat

SEQ ID NO: 112040 - DNA, 20 bp, Artificial
  CRISPR gRNA sequence
attgtcacgttatccgcatt

SEQ ID NO: 112041 - DNA, 20 bp, Artificial
  CRISPR gRNA sequence
tcacgttatccgcattagca

SEQ ID NO: 112042 - DNA, 20 bp, Artificial
  CRISPR gRNA sequence
tccgcattagcagatgagat

SEQ ID NO: 112043 - DNA, 20 bp, Artificial
  CRISPR gRNA sequence
gcagatgagatgatagagct

SEQ ID NO: 112044 - DNA, 20 bp, Artificial
  CRISPR gRNA sequence
aagtagtctaaaaaacatgt

SEQ ID NO: 112045 - DNA, 20 bp, Artificial
  CRISPR gRNA sequence
agtagtctaaaaaacatgta

SEQ ID NO: 112046 - DNA, 20 bp, Artificial
  CRISPR gRNA sequence
aaaaacatgtatatttgcct

SEQ ID NO: 112047 - DNA, 20 bp, Artificial
  CRISPR gRNA sequence
gcctttggaacgtttttttg

SEQ ID NO: 112048 - DNA, 20 bp, Artificial
  CRISPR gRNA sequence
cctttggaacgtttttttgt

SEQ ID NO: 112049 - DNA, 20 bp, Artificial
  CRISPR gRNA sequence
tggaacgtttttttgtttgt

SEQ ID NO: 112050 - DNA, 20 bp, Artificial
  CRISPR gRNA sequence
ggaacgtttttttgtttgtt

SEQ ID NO: 112051 - DNA, 20 bp, Artificial
  CRISPR gRNA sequence
gaacgtttttttgtttgttt

SEQ ID NO: 112052 - DNA, 20 bp, Artificial
  CRISPR gRNA sequence
ttttgtttgtttttggatac

SEQ ID NO: 112053 - DNA, 20 bp, Artificial
  CRISPR gRNA sequence
tttgtttgtttttggataca

SEQ ID NO: 112054 - DNA, 20 bp, Artificial
  CRISPR gRNA sequence
ttgtttgtttttggatacag

SEQ ID NO: 112055 - DNA, 20 bp, Artificial
  CRISPR gRNA sequence
tgtttgtttttggatacagg

SEQ ID NO: 112056 - DNA, 20 bp, Artificial
  CRISPR gRNA sequence
gtttgtttttggatacaggg

SEQ ID NO: 112057 - DNA, 20 bp, Artificial
  CRISPR gRNA sequence
tttgtttttggatacagggc

SEQ ID NO: 112058 - DNA, 20 bp, Artificial
  CRISPR gRNA sequence
gtttttggatacagggcttt

SEQ ID NO: 112059 - DNA, 20 bp, Artificial
  CRISPR gRNA sequence
tttttggatacagggctttc

SEQ ID NO: 112060 - DNA, 20 bp, Artificial
  CRISPR gRNA sequence
ttggatacagggctttcctc

SEQ ID NO: 112061 - DNA, 20 bp, Artificial
  CRISPR gRNA sequence
tggatacagggctttcctct

SEQ ID NO: 112062 - DNA, 20 bp, Artificial
  CRISPR gRNA sequence
ggatacagggctttcctctg

SEQ ID NO: 112063 - DNA, 20 bp, Artificial
  CRISPR gRNA sequence
gatacagggctttcctctgt

SEQ ID NO: 112064 - DNA, 20 bp, Artificial
  CRISPR gRNA sequence
tcctctgtcatccaggctgg

SEQ ID NO: 112065 - DNA, 20 bp, Artificial
  CRISPR gRNA sequence
cctctgtcatccaggctgga

SEQ ID NO: 112066 - DNA, 20 bp, Artificial
  CRISPR gRNA sequence
ctctgtcatccaggctggag

SEQ ID NO: 112067 - DNA, 20 bp, Artificial
  CRISPR gRNA sequence
tgtcatccaggctggagtac

SEQ ID NO: 112068 - DNA, 20 bp, Artificial
  CRISPR gRNA sequence
tcatccaggctggagtacag

SEQ ID NO: 112069 - DNA, 20 bp, Artificial
  CRISPR gRNA sequence
gagtacagtggcgcaatcgt

SEQ ID NO: 112070 - DNA, 20 bp, Artificial
  CRISPR gRNA sequence
actaacctggaactcctggg

SEQ ID NO: 112071 - DNA, 20 bp, Artificial
  CRISPR gRNA sequence
acctggaactcctgggctca

SEQ ID NO: 112072 - DNA, 20 bp, Artificial
  CRISPR gRNA sequence
gaactcctgggctcaagcca

SEQ ID NO: 112073 - DNA, 20 bp, Artificial
  CRISPR gRNA sequence
ctgggctcaagccatcctcc

SEQ ID NO: 112074 - DNA, 20 bp, Artificial
  CRISPR gRNA sequence
ggctcaagccatcctccctt

SEQ ID NO: 112075 - DNA, 20 bp, Artificial
  CRISPR gRNA sequence
aagccatcctcccttcttgt

SEQ ID NO: 112076 - DNA, 20 bp, Artificial
  CRISPR gRNA sequence
ccttcttgttctcccaaaac

SEQ ID NO: 112077 - DNA, 20 bp, Artificial
  CRISPR gRNA sequence
cttgttctcccaaaacgttg

SEQ ID NO: 112078 - DNA, 20 bp, Artificial
  CRISPR gRNA sequence
ttgttctcccaaaacgttgg

SEQ ID NO: 112079 - DNA, 20 bp, Artificial
  CRISPR gRNA sequence
gttctcccaaaacgttggga

SEQ ID NO: 112080 - DNA, 20 bp, Artificial
  CRISPR gRNA sequence
ttctcccaaaacgttgggat

SEQ ID NO: 112081 - DNA, 20 bp, Artificial
  CRISPR gRNA sequence
tcccaaaacgttgggattac

SEQ ID NO: 112082 - DNA, 20 bp, Artificial
  CRISPR gRNA sequence
ccaaaacgttgggattacag

SEQ ID NO: 112083 - DNA, 20 bp, Artificial
  CRISPR gRNA sequence
ggattacaggcatgagccac

SEQ ID NO: 112084 - DNA, 20 bp, Artificial
  CRISPR gRNA sequence
caggcatgagccactgcgtc

SEQ ID NO: 112085 - DNA, 20 bp, Artificial
  CRISPR gRNA sequence
cgtcctgacctgaaatagat

SEQ ID NO: 112086 - DNA, 20 bp, Artificial
  CRISPR gRNA sequence
acctgaaatagatgttttaa

SEQ ID NO: 112087 - DNA, 20 bp, Artificial
  CRISPR gRNA sequence
aaatagatgttttaacctta

SEQ ID NO: 112088 - DNA, 20 bp, Artificial
  CRISPR gRNA sequence
taaccttagtatttaaaaat

SEQ ID NO: 112089 - DNA, 20 bp, Artificial
  CRISPR gRNA sequence
aaccttagtatttaaaaata

SEQ ID NO: 112090 - DNA, 20 bp, Artificial
  CRISPR gRNA sequence
accttagtatttaaaaatag

SEQ ID NO: 112091 - DNA, 20 bp, Artificial
  CRISPR gRNA sequence
agtatttaaaaataggtatg

SEQ ID NO: 112092 - DNA, 20 bp, Artificial
  CRISPR gRNA sequence
gtatttaaaaataggtatgt

SEQ ID NO: 112093 - DNA, 20 bp, Artificial
  CRISPR gRNA sequence
aaaaataggtatgttctggt

SEQ ID NO: 112094 - DNA, 20 bp, Artificial
  CRISPR gRNA sequence
aaaataggtatgttctggtc

SEQ ID NO: 112095 - DNA, 20 bp, Artificial
  CRISPR gRNA sequence
tggtcacttcaaaatcacta

SEQ ID NO: 112096 - DNA, 20 bp, Artificial
  CRISPR gRNA sequence
gtcacttcaaaatcactaaa

SEQ ID NO: 112097 - DNA, 20 bp, Artificial
  CRISPR gRNA sequence
caaaatcactaaatactttt

SEQ ID NO: 112098 - DNA, 20 bp, Artificial
  CRISPR gRNA sequence
aaaatcactaaatacttttg

SEQ ID NO: 112099 - DNA, 20 bp, Artificial
  CRISPR gRNA sequence
aatacttttgcttggcatct

SEQ ID NO: 112100 - DNA, 20 bp, Artificial
  CRISPR gRNA sequence
ttgcttggcatctttctaaa

SEQ ID NO: 112101 - DNA, 20 bp, Artificial
  CRISPR gRNA sequence
tgcttggcatctttctaaaa

SEQ ID NO: 112102 - DNA, 20 bp, Artificial
  CRISPR gRNA sequence
gcttggcatctttctaaaag

SEQ ID NO: 112103 - DNA, 20 bp, Artificial
  CRISPR gRNA sequence
cttggcatctttctaaaagg

SEQ ID NO: 112104 - DNA, 20 bp, Artificial
  CRISPR gRNA sequence
ggcatctttctaaaaggcat

SEQ ID NO: 112105 - DNA, 20 bp, Artificial
  CRISPR gRNA sequence
gcatctttctaaaaggcatt

SEQ ID NO: 112106 - DNA, 20 bp, Artificial
  CRISPR gRNA sequence
tctaaaaggcattataatct

SEQ ID NO: 112107 - DNA, 20 bp, Artificial
  CRISPR gRNA sequence
ctaaaaggcattataatctg

SEQ ID NO: 112108 - DNA, 20 bp, Artificial
  CRISPR gRNA sequence
taaaaggcattataatctgg

SEQ ID NO: 112109 - DNA, 20 bp, Artificial
  CRISPR gRNA sequence
aaaggcattataatctggta

SEQ ID NO: 112110 - DNA, 20 bp, Artificial
  CRISPR gRNA sequence
taatctggtaacttttttgc

SEQ ID NO: 112111 - DNA, 20 bp, Artificial
  CRISPR gRNA sequence
gtaacttttttgctaaatac

SEQ ID NO: 112112 - DNA, 20 bp, Artificial
  CRISPR gRNA sequence
ttttgctaaataccttacaa

SEQ ID NO: 112113 - DNA, 20 bp, Artificial
  CRISPR gRNA sequence
tttgctaaataccttacaag

SEQ ID NO: 112114 - DNA, 20 bp, Artificial
  CRISPR gRNA sequence
ttgctaaataccttacaagc

SEQ ID NO: 112115 - DNA, 20 bp, Artificial
  CRISPR gRNA sequence
tgctaaataccttacaagct

SEQ ID NO: 112116 - DNA, 20 bp, Artificial
  CRISPR gRNA sequence
gctaaataccttacaagctt

SEQ ID NO: 112117 - DNA, 20 bp, Artificial
  CRISPR gRNA sequence
ctaaataccttacaagcttc

SEQ ID NO: 112118 - DNA, 20 bp, Artificial
  CRISPR gRNA sequence
aataccttacaagcttccac

SEQ ID NO: 112119 - DNA, 20 bp, Artificial
  CRISPR gRNA sequence
acaagcttccaccagtctgc

SEQ ID NO: 112120 - DNA, 20 bp, Artificial
  CRISPR gRNA sequence
caagcttccaccagtctgca

SEQ ID NO: 112121 - DNA, 20 bp, Artificial
  CRISPR gRNA sequence
ccaccagtctgcagaagaat

SEQ ID NO: 112122 - DNA, 20 bp, Artificial
  CRISPR gRNA sequence
caccagtctgcagaagaatt

SEQ ID NO: 112123 - DNA, 20 bp, Artificial
  CRISPR gRNA sequence
cagaagaatttctttgtctg

SEQ ID NO: 112124 - DNA, 20 bp, Artificial
  CRISPR gRNA sequence
ctttgtctgacattttgaga

SEQ ID NO: 112125 - DNA, 20 bp, Artificial
  CRISPR gRNA sequence
tttgtctgacattttgagag

SEQ ID NO: 112126 - DNA, 20 bp, Artificial
  CRISPR gRNA sequence
tgtctgacattttgagagaa

SEQ ID NO: 112127 - DNA, 20 bp, Artificial
  CRISPR gRNA sequence
gtctgacattttgagagaaa

SEQ ID NO: 112128 - DNA, 20 bp, Artificial
  CRISPR gRNA sequence
tctgacattttgagagaaag

SEQ ID NO: 112129 - DNA, 20 bp, Artificial
  CRISPR gRNA sequence
acattttgagagaaagtagt

SEQ ID NO: 112130 - DNA, 20 bp, Artificial
  CRISPR gRNA sequence
tgagagaaagtagtgtggcc

SEQ ID NO: 112131 - DNA, 20 bp, Artificial
  CRISPR gRNA sequence
gagagaaagtagtgtggccc

SEQ ID NO: 112132 - DNA, 20 bp, Artificial
  CRISPR gRNA sequence
agagaaagtagtgtggcccc

SEQ ID NO: 112133 - DNA, 20 bp, Artificial
  CRISPR gRNA sequence
tttttcctgtttagtccact

SEQ ID NO: 112134 - DNA, 20 bp, Artificial
  CRISPR gRNA sequence
ttttcctgtttagtccactg

SEQ ID NO: 112135 - DNA, 20 bp, Artificial
  CRISPR gRNA sequence
tttcctgtttagtccactgt

SEQ ID NO: 112136 - DNA, 20 bp, Artificial
  CRISPR gRNA sequence
ttcctgtttagtccactgtt

SEQ ID NO: 112137 - DNA, 20 bp, Artificial
  CRISPR gRNA sequence
tcctgtttagtccactgttc

SEQ ID NO: 112138 - DNA, 20 bp, Artificial
  CRISPR gRNA sequence
cctgtttagtccactgttca

SEQ ID NO: 112139 - DNA, 20 bp, Artificial
  CRISPR gRNA sequence
ctgtttagtccactgttcac

SEQ ID NO: 112140 - DNA, 20 bp, Artificial
  CRISPR gRNA sequence
tttagtccactgttcacatg

SEQ ID NO: 112141 - DNA, 20 bp, Artificial
  CRISPR gRNA sequence
agtccactgttcacatgctg

SEQ ID NO: 112142 - DNA, 20 bp, Artificial
  CRISPR gRNA sequence
gtccactgttcacatgctga

SEQ ID NO: 112143 - DNA, 20 bp, Artificial
  CRISPR gRNA sequence
ttcacatgctgaaatatttc

SEQ ID NO: 112144 - DNA, 20 bp, Artificial
  CRISPR gRNA sequence
acatgctgaaatatttctgt

SEQ ID NO: 112145 - DNA, 20 bp, Artificial
  CRISPR gRNA sequence
aaatatttctgttcttgttt

SEQ ID NO: 112146 - DNA, 20 bp, Artificial
  CRISPR gRNA sequence
ctgttcttgtttttatgctc

SEQ ID NO: 112147 - DNA, 20 bp, Artificial
  CRISPR gRNA sequence
tgttcttgtttttatgctct

SEQ ID NO: 112148 - DNA, 20 bp, Artificial
  CRISPR gRNA sequence
ttcttgtttttatgctctct

SEQ ID NO: 112149 - DNA, 20 bp, Artificial
  CRISPR gRNA sequence
ttgtttttatgctctcttga

SEQ ID NO: 112150 - DNA, 20 bp, Artificial
  CRISPR gRNA sequence
gtttttatgctctcttgatt

SEQ ID NO: 112151 - DNA, 20 bp, Artificial
  CRISPR gRNA sequence
tttttatgctctcttgattt

SEQ ID NO: 112152 - DNA, 20 bp, Artificial
  CRISPR gRNA sequence
ttatgctctcttgatttgta

SEQ ID NO: 112153 - DNA, 20 bp, Artificial
  CRISPR gRNA sequence
tatgctctcttgatttgtag

SEQ ID NO: 112154 - DNA, 20 bp, Artificial
  CRISPR gRNA sequence
atgctctcttgatttgtagt

SEQ ID NO: 112155 - DNA, 20 bp, Artificial
  CRISPR gRNA sequence
tgctctcttgatttgtagta

SEQ ID NO: 112156 - DNA, 20 bp, Artificial
  CRISPR gRNA sequence
tcttgatttgtagtacttca

SEQ ID NO: 112157 - DNA, 20 bp, Artificial
  CRISPR gRNA sequence
ttgatttgtagtacttcacc

SEQ ID NO: 112158 - DNA, 20 bp, Artificial
  CRISPR gRNA sequence
gatttgtagtacttcacctt

SEQ ID NO: 112159 - DNA, 20 bp, Artificial
  CRISPR gRNA sequence
atttgtagtacttcaccttc

SEQ ID NO: 112160 - DNA, 20 bp, Artificial
  CRISPR gRNA sequence
gtagtacttcaccttcctcc

SEQ ID NO: 112161 - DNA, 20 bp, Artificial
  CRISPR gRNA sequence
tagtacttcaccttcctcca

SEQ ID NO: 112162 - DNA, 20 bp, Artificial
  CRISPR gRNA sequence
caccttcctccacatcatca

SEQ ID NO: 112163 - DNA, 20 bp, Artificial
  CRISPR gRNA sequence
accttcctccacatcatcac

SEQ ID NO: 112164 - DNA, 20 bp, Artificial
  CRISPR gRNA sequence
cctccacatcatcacatagc

SEQ ID NO: 112165 - DNA, 20 bp, Artificial
  CRISPR gRNA sequence
ctccacatcatcacatagct

SEQ ID NO: 112166 - DNA, 20 bp, Artificial
  CRISPR gRNA sequence
cacatcatcacatagctaaa

SEQ ID NO: 112167 - DNA, 20 bp, Artificial
  CRISPR gRNA sequence
aatctttctcacacttaaga

SEQ ID NO: 112168 - DNA, 20 bp, Artificial
  CRISPR gRNA sequence
tctcacacttaagaccagtt

SEQ ID NO: 112169 - DNA, 20 bp, Artificial
  CRISPR gRNA sequence
ctcacacttaagaccagttc

SEQ ID NO: 112170 - DNA, 20 bp, Artificial
  CRISPR gRNA sequence
tcacacttaagaccagttca

SEQ ID NO: 112171 - DNA, 20 bp, Artificial
  CRISPR gRNA sequence
acacttaagaccagttcatc

SEQ ID NO: 112172 - DNA, 20 bp, Artificial
  CRISPR gRNA sequence
aagaccagttcatcctgcag

SEQ ID NO: 112173 - DNA, 20 bp, Artificial
  CRISPR gRNA sequence
agaccagttcatcctgcagg

SEQ ID NO: 112174 - DNA, 20 bp, Artificial
  CRISPR gRNA sequence
atcctgcaggcctctgatag

SEQ ID NO: 112175 - DNA, 20 bp, Artificial
  CRISPR gRNA sequence
caggcctctgatagcaaaga

SEQ ID NO: 112176 - DNA, 20 bp, Artificial
  CRISPR gRNA sequence
tgatagcaaagaaaaaaaaa

SEQ ID NO: 112177 - DNA, 20 bp, Artificial
  CRISPR gRNA sequence
atagcaaagaaaaaaaaagt

SEQ ID NO: 112178 - DNA, 20 bp, Artificial
  CRISPR gRNA sequence
aagtagtacctttttttttt

SEQ ID NO: 112179 - DNA, 20 bp, Artificial
  CRISPR gRNA sequence
tttttttttaagccttgttg

SEQ ID NO: 112180 - DNA, 20 bp, Artificial
  CRISPR gRNA sequence
ttttttttaagccttgttga

SEQ ID NO: 112181 - DNA, 20 bp, Artificial
  CRISPR gRNA sequence
tttttttaagccttgttgat

SEQ ID NO: 112182 - DNA, 20 bp, Artificial
  CRISPR gRNA sequence
ttttttaagccttgttgatt

SEQ ID NO: 112183 - DNA, 20 bp, Artificial
  CRISPR gRNA sequence
tttttaagccttgttgattt

SEQ ID NO: 112184 - DNA, 20 bp, Artificial
  CRISPR gRNA sequence
ttttaagccttgttgattta

SEQ ID NO: 112185 - DNA, 20 bp, Artificial
  CRISPR gRNA sequence
tttaagccttgttgatttat

SEQ ID NO: 112186 - DNA, 20 bp, Artificial
  CRISPR gRNA sequence
ttaagccttgttgatttatc

SEQ ID NO: 112187 - DNA, 20 bp, Artificial
  CRISPR gRNA sequence
taagccttgttgatttatcc

SEQ ID NO: 112188 - DNA, 20 bp, Artificial
  CRISPR gRNA sequence
aagccttgttgatttatccc

SEQ ID NO: 112189 - DNA, 20 bp, Artificial
  CRISPR gRNA sequence
agccttgttgatttatcccc

SEQ ID NO: 112190 - DNA, 20 bp, Artificial
  CRISPR gRNA sequence
gttgatttatccccagctgg

SEQ ID NO: 112191 - DNA, 20 bp, Artificial
  CRISPR gRNA sequence
ttgatttatccccagctgga

SEQ ID NO: 112192 - DNA, 20 bp, Artificial
  CRISPR gRNA sequence
atttatccccagctggaaca

SEQ ID NO: 112193 - DNA, 20 bp, Artificial
  CRISPR gRNA sequence
atccccagctggaacaaatc

SEQ ID NO: 112194 - DNA, 20 bp, Artificial
  CRISPR gRNA sequence
tccccagctggaacaaatct

SEQ ID NO: 112195 - DNA, 20 bp, Artificial
  CRISPR gRNA sequence
gaacaaatctctgtcctcca

SEQ ID NO: 112196 - DNA, 20 bp, Artificial
  CRISPR gRNA sequence
tgtcctccaaattcccatat

SEQ ID NO: 112197 - DNA, 20 bp, Artificial
  CRISPR gRNA sequence
tcctccaaattcccatatca

SEQ ID NO: 112198 - DNA, 20 bp, Artificial
  CRISPR gRNA sequence
caaattcccatatcacttta

SEQ ID NO: 112199 - DNA, 20 bp, Artificial
  CRISPR gRNA sequence
ccatatcactttatctctta

SEQ ID NO: 112200 - DNA, 20 bp, Artificial
  CRISPR gRNA sequence
tatctcttaggattccagta

SEQ ID NO: 112201 - DNA, 20 bp, Artificial
  CRISPR gRNA sequence
atctcttaggattccagtat

SEQ ID NO: 112202 - DNA, 20 bp, Artificial
  CRISPR gRNA sequence
tctcttaggattccagtata

SEQ ID NO: 112203 - DNA, 20 bp, Artificial
  CRISPR gRNA sequence
ttaggattccagtataggtt

SEQ ID NO: 112204 - DNA, 20 bp, Artificial
  CRISPR gRNA sequence
aggattccagtataggtttt

SEQ ID NO: 112205 - DNA, 20 bp, Artificial
  CRISPR gRNA sequence
ggattccagtataggttttt

SEQ ID NO: 112206 - DNA, 20 bp, Artificial
  CRISPR gRNA sequence
cagtataggtttttagtcca

SEQ ID NO: 112207 - DNA, 20 bp, Artificial
  CRISPR gRNA sequence
ttagtccattactaaactta

SEQ ID NO: 112208 - DNA, 20 bp, Artificial
  CRISPR gRNA sequence
tagtccattactaaacttaa

SEQ ID NO: 112209 - DNA, 20 bp, Artificial
  CRISPR gRNA sequence
agtccattactaaacttaaa

SEQ ID NO: 112210 - DNA, 20 bp, Artificial
  CRISPR gRNA sequence
gtccattactaaacttaaag

SEQ ID NO: 112211 - DNA, 20 bp, Artificial
  CRISPR gRNA sequence
ctaaacttaaagactctttg

SEQ ID NO: 112212 - DNA, 20 bp, Artificial
  CRISPR gRNA sequence
aacttaaagactctttgaag

SEQ ID NO: 112213 - DNA, 20 bp, Artificial
  CRISPR gRNA sequence
aaagactctttgaagtttga

SEQ ID NO: 112214 - DNA, 20 bp, Artificial
  CRISPR gRNA sequence
aagactctttgaagtttgaa

SEQ ID NO: 112215 - DNA, 20 bp, Artificial
  CRISPR gRNA sequence
tttgaagtttgaatcttcgt

SEQ ID NO: 112216 - DNA, 20 bp, Artificial
  CRISPR gRNA sequence
tgaagtttgaatcttcgtca

SEQ ID NO: 112217 - DNA, 20 bp, Artificial
  CRISPR gRNA sequence
gaagtttgaatcttcgtcag

SEQ ID NO: 112218 - DNA, 20 bp, Artificial
  CRISPR gRNA sequence
aagtttgaatcttcgtcaga

SEQ ID NO: 112219 - DNA, 20 bp, Artificial
  CRISPR gRNA sequence
gaatcttcgtcagagatttc

SEQ ID NO: 112220 - DNA, 20 bp, Artificial
  CRISPR gRNA sequence
aatcttcgtcagagatttct

SEQ ID NO: 112221 - DNA, 20 bp, Artificial
  CRISPR gRNA sequence
cgtcagagatttctttttat

SEQ ID NO: 112222 - DNA, 20 bp, Artificial
  CRISPR gRNA sequence
gtcagagatttctttttatt

SEQ ID NO: 112223 - DNA, 20 bp, Artificial
  CRISPR gRNA sequence
ctttttatttttaaaacctt

SEQ ID NO: 112224 - DNA, 20 bp, Artificial
  CRISPR gRNA sequence
tttttatttttaaaaccttc

SEQ ID NO: 112225 - DNA, 20 bp, Artificial
  CRISPR gRNA sequence
tttatttttaaaaccttcag

SEQ ID NO: 112226 - DNA, 20 bp, Artificial
  CRISPR gRNA sequence
ttatttttaaaaccttcaga

SEQ ID NO: 112227 - DNA, 20 bp, Artificial
  CRISPR gRNA sequence
tatttttaaaaccttcagaa

SEQ ID NO: 112228 - DNA, 20 bp, Artificial
  CRISPR gRNA sequence
atttttaaaaccttcagaac

SEQ ID NO: 112229 - DNA, 20 bp, Artificial
  CRISPR gRNA sequence
tttttaaaaccttcagaaca

SEQ ID NO: 112230 - DNA, 20 bp, Artificial
  CRISPR gRNA sequence
ttaaaaccttcagaacagtg

SEQ ID NO: 112231 - DNA, 20 bp, Artificial
  CRISPR gRNA sequence
taaaaccttcagaacagtgt

SEQ ID NO: 112232 - DNA, 20 bp, Artificial
  CRISPR gRNA sequence
aaaaccttcagaacagtgtc

SEQ ID NO: 112233 - DNA, 20 bp, Artificial
  CRISPR gRNA sequence
aaaccttcagaacagtgtct

SEQ ID NO: 112234 - DNA, 20 bp, Artificial
  CRISPR gRNA sequence
cagaacagtgtctggcacat

SEQ ID NO: 112235 - DNA, 20 bp, Artificial
  CRISPR gRNA sequence
agaacagtgtctggcacatg

SEQ ID NO: 112236 - DNA, 20 bp, Artificial
  CRISPR gRNA sequence
gcacatggtacataattagt

SEQ ID NO: 112237 - DNA, 20 bp, Artificial
  CRISPR gRNA sequence
gtggagagaagtgcattaga

SEQ ID NO: 112238 - DNA, 20 bp, Artificial
  CRISPR gRNA sequence
gaaagctccaatccagaaat

SEQ ID NO: 112239 - DNA, 20 bp, Artificial
  CRISPR gRNA sequence
caatccagaaatctgtagga

SEQ ID NO: 112240 - DNA, 20 bp, Artificial
  CRISPR gRNA sequence
taggatgatggggaagctgg

SEQ ID NO: 112241 - DNA, 20 bp, Artificial
  CRISPR gRNA sequence
gacagccctttgttgtagtc

SEQ ID NO: 112242 - DNA, 20 bp, Artificial
  CRISPR gRNA sequence
tgttgtagtctagtctttca

SEQ ID NO: 112243 - DNA, 20 bp, Artificial
  CRISPR gRNA sequence
gttgtagtctagtctttcat

SEQ ID NO: 112244 - DNA, 20 bp, Artificial
  CRISPR gRNA sequence
ttgtagtctagtctttcatc

SEQ ID NO: 112245 - DNA, 20 bp, Artificial
  CRISPR gRNA sequence
tagtctagtctttcatcaag

SEQ ID NO: 112246 - DNA, 20 bp, Artificial
  CRISPR gRNA sequence
gtctttcatcaagcgtctat

SEQ ID NO: 112247 - DNA, 20 bp, Artificial
  CRISPR gRNA sequence
tcatcaagcgtctatcagga

SEQ ID NO: 112248 - DNA, 20 bp, Artificial
  CRISPR gRNA sequence
catcaagcgtctatcaggac

SEQ ID NO: 112249 - DNA, 20 bp, Artificial
  CRISPR gRNA sequence
atcaagcgtctatcaggacc

SEQ ID NO: 112250 - DNA, 20 bp, Artificial
  CRISPR gRNA sequence
tcaggacccacttgttgagt

SEQ ID NO: 112251 - DNA, 20 bp, Artificial
  CRISPR gRNA sequence
gttgagttgtgaaagaaatt

SEQ ID NO: 112252 - DNA, 20 bp, Artificial
  CRISPR gRNA sequence
ttgagttgtgaaagaaattg

SEQ ID NO: 112253 - DNA, 20 bp, Artificial
  CRISPR gRNA sequence
agttgtgaaagaaattgagt

SEQ ID NO: 112254 - DNA, 20 bp, Artificial
  CRISPR gRNA sequence
tgaaagaaattgagtgagcc

SEQ ID NO: 112255 - DNA, 20 bp, Artificial
  CRISPR gRNA sequence
agtgagccaatgctgggaat

SEQ ID NO: 112256 - DNA, 20 bp, Artificial
  CRISPR gRNA sequence
ggaatttttaaataatagaa

SEQ ID NO: 112257 - DNA, 20 bp, Artificial
  CRISPR gRNA sequence
ttaaataatagaatagaaaa

SEQ ID NO: 112258 - DNA, 20 bp, Artificial
  CRISPR gRNA sequence
taaataatagaatagaaaat

SEQ ID NO: 112259 - DNA, 20 bp, Artificial
  CRISPR gRNA sequence
aaataatagaatagaaaata

SEQ ID NO: 112260 - DNA, 20 bp, Artificial
  CRISPR gRNA sequence
aataatagaatagaaaatat

SEQ ID NO: 112261 - DNA, 20 bp, Artificial
  CRISPR gRNA sequence
ccaggcatgatgatggctca

SEQ ID NO: 112262 - DNA, 20 bp, Artificial
  CRISPR gRNA sequence
acgactgtaatcccagcact

SEQ ID NO: 112263 - DNA, 20 bp, Artificial
  CRISPR gRNA sequence
taatcccagcactttgggaa

SEQ ID NO: 112264 - DNA, 20 bp, Artificial
  CRISPR gRNA sequence
tgggaagccgaagtgggaga

SEQ ID NO: 112265 - DNA, 20 bp, Artificial
  CRISPR gRNA sequence
gggaagccgaagtgggagaa

SEQ ID NO: 112266 - DNA, 20 bp, Artificial
  CRISPR gRNA sequence
ggaagccgaagtgggagaat

SEQ ID NO: 112267 - DNA, 20 bp, Artificial
  CRISPR gRNA sequence
tgagctcaggagtttgagac

SEQ ID NO: 112268 - DNA, 20 bp, Artificial
  CRISPR gRNA sequence
gagctcaggagtttgagacc

SEQ ID NO: 112269 - DNA, 20 bp, Artificial
  CRISPR gRNA sequence
agctcaggagtttgagacca

SEQ ID NO: 112270 - DNA, 20 bp, Artificial
  CRISPR gRNA sequence
aggagtttgagaccagcctg

SEQ ID NO: 112271 - DNA, 20 bp, Artificial
  CRISPR gRNA sequence
gagaccagcctgggtagcat

SEQ ID NO: 112272 - DNA, 20 bp, Artificial
  CRISPR gRNA sequence
agaccagcctgggtagcata

SEQ ID NO: 112273 - DNA, 20 bp, Artificial
  CRISPR gRNA sequence
ggtagcatagggagaccccc

SEQ ID NO: 112274 - DNA, 20 bp, Artificial
  CRISPR gRNA sequence
tcttaaaagaaaaaaaagaa

SEQ ID NO: 112275 - DNA, 20 bp, Artificial
  CRISPR gRNA sequence
ttaaaagaaaaaaaagaata

SEQ ID NO: 112276 - DNA, 20 bp, Artificial
  CRISPR gRNA sequence
aaaagaaaaaaaagaataga

SEQ ID NO: 112277 - DNA, 20 bp, Artificial
  CRISPR gRNA sequence
aaagaaaaaaaagaatagaa

SEQ ID NO: 112278 - DNA, 20 bp, Artificial
  CRISPR gRNA sequence
gtgttgtataaaggtaaatg

SEQ ID NO: 112279 - DNA, 20 bp, Artificial
  CRISPR gRNA sequence
tgttgtataaaggtaaatgc

SEQ ID NO: 112280 - DNA, 20 bp, Artificial
  CRISPR gRNA sequence
tataaaggtaaatgctgttt

SEQ ID NO: 112281 - DNA, 20 bp, Artificial
  CRISPR gRNA sequence
tttcatgaaactttcatttc

SEQ ID NO: 112282 - DNA, 20 bp, Artificial
  CRISPR gRNA sequence
catgaaactttcatttcagt

SEQ ID NO: 112283 - DNA, 20 bp, Artificial
  CRISPR gRNA sequence
atgaaactttcatttcagtt

SEQ ID NO: 112284 - DNA, 20 bp, Artificial
  CRISPR gRNA sequence
tcatttcagttacatgcttt

SEQ ID NO: 112285 - DNA, 20 bp, Artificial
  CRISPR gRNA sequence
catttcagttacatgcttta

SEQ ID NO: 112286 - DNA, 20 bp, Artificial
  CRISPR gRNA sequence
atttcagttacatgctttat

SEQ ID NO: 112287 - DNA, 20 bp, Artificial
  CRISPR gRNA sequence
cagttacatgctttatacat

SEQ ID NO: 112288 - DNA, 20 bp, Artificial
  CRISPR gRNA sequence
agttacatgctttatacatg

SEQ ID NO: 112289 - DNA, 20 bp, Artificial
  CRISPR gRNA sequence
catgctttatacatgtgtgc

SEQ ID NO: 112290 - DNA, 20 bp, Artificial
  CRISPR gRNA sequence
tatacatgtgtgcactgagt

SEQ ID NO: 112291 - DNA, 20 bp, Artificial
  CRISPR gRNA sequence
atacatgtgtgcactgagtt

SEQ ID NO: 112292 - DNA, 20 bp, Artificial
  CRISPR gRNA sequence
tacatgtgtgcactgagttg

SEQ ID NO: 112293 - DNA, 20 bp, Artificial
  CRISPR gRNA sequence
agttgtgataatgaaatgtg

SEQ ID NO: 112294 - DNA, 20 bp, Artificial
  CRISPR gRNA sequence
tgataatgaaatgtgtttct

SEQ ID NO: 112295 - DNA, 20 bp, Artificial
  CRISPR gRNA sequence
cttactaagggttgtggtca

SEQ ID NO: 112296 - DNA, 20 bp, Artificial
  CRISPR gRNA sequence
ttactaagggttgtggtcaa

SEQ ID NO: 112297 - DNA, 20 bp, Artificial
  CRISPR gRNA sequence
actaagggttgtggtcaaaa

SEQ ID NO: 112298 - DNA, 20 bp, Artificial
  CRISPR gRNA sequence
ctaagggttgtggtcaaaaa

SEQ ID NO: 112299 - DNA, 20 bp, Artificial
  CRISPR gRNA sequence
agggttgtggtcaaaaaagt

SEQ ID NO: 112300 - DNA, 20 bp, Artificial
  CRISPR gRNA sequence
tggtcaaaaaagttaaaaag

SEQ ID NO: 112301 - DNA, 20 bp, Artificial
  CRISPR gRNA sequence
aaaagctactgttctaggct

SEQ ID NO: 112302 - DNA, 20 bp, Artificial
  CRISPR gRNA sequence
ctgttctaggctttgcctgg

SEQ ID NO: 112303 - DNA, 20 bp, Artificial
  CRISPR gRNA sequence
ttctaggctttgcctggtag

SEQ ID NO: 112304 - DNA, 20 bp, Artificial
  CRISPR gRNA sequence
taggctttgcctggtagtga

SEQ ID NO: 112305 - DNA, 20 bp, Artificial
  CRISPR gRNA sequence
ggctttgcctggtagtgatt

SEQ ID NO: 112306 - DNA, 20 bp, Artificial
  CRISPR gRNA sequence
tgcctggtagtgattatcaa

SEQ ID NO: 112307 - DNA, 20 bp, Artificial
  CRISPR gRNA sequence
gcctggtagtgattatcaac

SEQ ID NO: 112308 - DNA, 20 bp, Artificial
  CRISPR gRNA sequence
cctggtagtgattatcaact

SEQ ID NO: 112309 - DNA, 20 bp, Artificial
  CRISPR gRNA sequence
gtagtgattatcaactgtga

SEQ ID NO: 112310 - DNA, 20 bp, Artificial
  CRISPR gRNA sequence
tcaactgtgataatcctatg

SEQ ID NO: 112311 - DNA, 20 bp, Artificial
  CRISPR gRNA sequence
tgataatcctatggcttttc

SEQ ID NO: 112312 - DNA, 20 bp, Artificial
  CRISPR gRNA sequence
tggcttttcatatgcttaca

SEQ ID NO: 112313 - DNA, 20 bp, Artificial
  CRISPR gRNA sequence
ttcatatgcttacactagtt

SEQ ID NO: 112314 - DNA, 20 bp, Artificial
  CRISPR gRNA sequence
tcatatgcttacactagttg

SEQ ID NO: 112315 - DNA, 20 bp, Artificial
  CRISPR gRNA sequence
catatgcttacactagttga

SEQ ID NO: 112316 - DNA, 20 bp, Artificial
  CRISPR gRNA sequence
atatgcttacactagttgag

SEQ ID NO: 112317 - DNA, 20 bp, Artificial
  CRISPR gRNA sequence
acactagttgagtttctgaa

SEQ ID NO: 112318 - DNA, 20 bp, Artificial
  CRISPR gRNA sequence
cactagttgagtttctgaag

SEQ ID NO: 112319 - DNA, 20 bp, Artificial
  CRISPR gRNA sequence
gttgagtttctgaagaggtt

SEQ ID NO: 112320 - DNA, 20 bp, Artificial
  CRISPR gRNA sequence
agtttctgaagaggttttag

SEQ ID NO: 112321 - DNA, 20 bp, Artificial
  CRISPR gRNA sequence
ctgaagaggttttagctttg

SEQ ID NO: 112322 - DNA, 20 bp, Artificial
  CRISPR gRNA sequence
tgaagaggttttagctttgg

SEQ ID NO: 112323 - DNA, 20 bp, Artificial
  CRISPR gRNA sequence
aagaggttttagctttggag

SEQ ID NO: 112324 - DNA, 20 bp, Artificial
  CRISPR gRNA sequence
tagctttggagtttgtgtag

SEQ ID NO: 112325 - DNA, 20 bp, Artificial
  CRISPR gRNA sequence
agctttggagtttgtgtagg

SEQ ID NO: 112326 - DNA, 20 bp, Artificial
  CRISPR gRNA sequence
gctttggagtttgtgtaggt

SEQ ID NO: 112327 - DNA, 20 bp, Artificial
  CRISPR gRNA sequence
tggagtttgtgtaggtccac

SEQ ID NO: 112328 - DNA, 20 bp, Artificial
  CRISPR gRNA sequence
ggagtttgtgtaggtccaca

SEQ ID NO: 112329 - DNA, 20 bp, Artificial
  CRISPR gRNA sequence
gagtttgtgtaggtccacat

SEQ ID NO: 112330 - DNA, 20 bp, Artificial
  CRISPR gRNA sequence
gtgtaggtccacatagaatg

SEQ ID NO: 112331 - DNA, 20 bp, Artificial
  CRISPR gRNA sequence
tgtaggtccacatagaatgg

SEQ ID NO: 112332 - DNA, 20 bp, Artificial
  CRISPR gRNA sequence
ctagtaagtggttggctaag

SEQ ID NO: 112333 - DNA, 20 bp, Artificial
  CRISPR gRNA sequence
gtaagtggttggctaagtct

SEQ ID NO: 112334 - DNA, 20 bp, Artificial
  CRISPR gRNA sequence
gctaagtctcagcttttgca

SEQ ID NO: 112335 - DNA, 20 bp, Artificial
  CRISPR gRNA sequence
agtctcagcttttgcacctt

SEQ ID NO: 112336 - DNA, 20 bp, Artificial
  CRISPR gRNA sequence
agcttttgcaccttggaata

SEQ ID NO: 112337 - DNA, 20 bp, Artificial
  CRISPR gRNA sequence
ttgcaccttggaatagtggg

SEQ ID NO: 112338 - DNA, 20 bp, Artificial
  CRISPR gRNA sequence
tgcaccttggaatagtgggg

SEQ ID NO: 112339 - DNA, 20 bp, Artificial
  CRISPR gRNA sequence
gcaccttggaatagtggggc

SEQ ID NO: 112340 - DNA, 20 bp, Artificial
  CRISPR gRNA sequence
caccttggaatagtggggca

SEQ ID NO: 112341 - DNA, 20 bp, Artificial
  CRISPR gRNA sequence
ggaatagtggggcaaagaga

SEQ ID NO: 112342 - DNA, 20 bp, Artificial
  CRISPR gRNA sequence
gaatagtggggcaaagagaa

SEQ ID NO: 112343 - DNA, 20 bp, Artificial
  CRISPR gRNA sequence
cactgagaagagaatgcact

SEQ ID NO: 112344 - DNA, 20 bp, Artificial
  CRISPR gRNA sequence
agaagagaatgcactaggaa

SEQ ID NO: 112345 - DNA, 20 bp, Artificial
  CRISPR gRNA sequence
ggaagagaattttcatgcta

SEQ ID NO: 112346 - DNA, 20 bp, Artificial
  CRISPR gRNA sequence
tcatgctagccagaataaac

SEQ ID NO: 112347 - DNA, 20 bp, Artificial
  CRISPR gRNA sequence
catgctagccagaataaaca

SEQ ID NO: 112348 - DNA, 20 bp, Artificial
  CRISPR gRNA sequence
atgctagccagaataaacac

SEQ ID NO: 112349 - DNA, 20 bp, Artificial
  CRISPR gRNA sequence
gccagaataaacacttatta

SEQ ID NO: 112350 - DNA, 20 bp, Artificial
  CRISPR gRNA sequence
attatttgtttctctctctt

SEQ ID NO: 112351 - DNA, 20 bp, Artificial
  CRISPR gRNA sequence
ttatttgtttctctctcttt

SEQ ID NO: 112352 - DNA, 20 bp, Artificial
  CRISPR gRNA sequence
tttgtttctctctctttgag

SEQ ID NO: 112353 - DNA, 20 bp, Artificial
  CRISPR gRNA sequence
gtttctctctctttgaggaa

SEQ ID NO: 112354 - DNA, 20 bp, Artificial
  CRISPR gRNA sequence
tttctctctctttgaggaaa

SEQ ID NO: 112355 - DNA, 20 bp, Artificial
  CRISPR gRNA sequence
ctctctctttgaggaaaaac

SEQ ID NO: 112356 - DNA, 20 bp, Artificial
  CRISPR gRNA sequence
tctctctttgaggaaaaacc

SEQ ID NO: 112357 - DNA, 20 bp, Artificial
  CRISPR gRNA sequence
tctctttgaggaaaaaccat

SEQ ID NO: 112358 - DNA, 20 bp, Artificial
  CRISPR gRNA sequence
tctttgaggaaaaaccattc

SEQ ID NO: 112359 - DNA, 20 bp, Artificial
  CRISPR gRNA sequence
tttgaggaaaaaccattcaa

SEQ ID NO: 112360 - DNA, 20 bp, Artificial
  CRISPR gRNA sequence
tgaggaaaaaccattcaaaa

SEQ ID NO: 112361 - DNA, 20 bp, Artificial
  CRISPR gRNA sequence
gaggaaaaaccattcaaaac

SEQ ID NO: 112362 - DNA, 20 bp, Artificial
  CRISPR gRNA sequence
aggaaaaaccattcaaaact

SEQ ID NO: 112363 - DNA, 20 bp, Artificial
  CRISPR gRNA sequence
aaaactttgtgttaagagca

SEQ ID NO: 112364 - DNA, 20 bp, Artificial
  CRISPR gRNA sequence
tgtgttaagagcaagagcta

SEQ ID NO: 112365 - DNA, 20 bp, Artificial
  CRISPR gRNA sequence
gtgttaagagcaagagctag

SEQ ID NO: 112366 - DNA, 20 bp, Artificial
  CRISPR gRNA sequence
tgttaagagcaagagctaga

SEQ ID NO: 112367 - DNA, 20 bp, Artificial
  CRISPR gRNA sequence
agagcaagagctagacagac

SEQ ID NO: 112368 - DNA, 20 bp, Artificial
  CRISPR gRNA sequence
gacagactaaatctggctta

SEQ ID NO: 112369 - DNA, 20 bp, Artificial
  CRISPR gRNA sequence
aatctggcttagtttgtcat

SEQ ID NO: 112370 - DNA, 20 bp, Artificial
  CRISPR gRNA sequence
gcttagtttgtcataatctt

SEQ ID NO: 112371 - DNA, 20 bp, Artificial
  CRISPR gRNA sequence
agtttgtcataatcttgggc

SEQ ID NO: 112372 - DNA, 20 bp, Artificial
  CRISPR gRNA sequence
gtttgtcataatcttgggca

SEQ ID NO: 112373 - DNA, 20 bp, Artificial
  CRISPR gRNA sequence
gtcataatcttgggcaaaga

SEQ ID NO: 112374 - DNA, 20 bp, Artificial
  CRISPR gRNA sequence
tcataatcttgggcaaagag

SEQ ID NO: 112375 - DNA, 20 bp, Artificial
  CRISPR gRNA sequence
gggcaaagaggcactttggg

SEQ ID NO: 112376 - DNA, 20 bp, Artificial
  CRISPR gRNA sequence
ggcaaagaggcactttggga

SEQ ID NO: 112377 - DNA, 20 bp, Artificial
  CRISPR gRNA sequence
tgggaaagactatcgaattg

SEQ ID NO: 112378 - DNA, 20 bp, Artificial
  CRISPR gRNA sequence
gggaaagactatcgaattgt

SEQ ID NO: 112379 - DNA, 20 bp, Artificial
  CRISPR gRNA sequence
ggaaagactatcgaattgta

SEQ ID NO: 112380 - DNA, 20 bp, Artificial
  CRISPR gRNA sequence
tcgaattgtattgcagtctt

SEQ ID NO: 112381 - DNA, 20 bp, Artificial
  CRISPR gRNA sequence
tattgcagtcttgctaactg

SEQ ID NO: 112382 - DNA, 20 bp, Artificial
  CRISPR gRNA sequence
cagtcttgctaactgaagct

SEQ ID NO: 112383 - DNA, 20 bp, Artificial
  CRISPR gRNA sequence
gctaactgaagctcacagta

SEQ ID NO: 112384 - DNA, 20 bp, Artificial
  CRISPR gRNA sequence
ctaactgaagctcacagtag

SEQ ID NO: 112385 - DNA, 20 bp, Artificial
  CRISPR gRNA sequence
actgaagctcacagtagtag

SEQ ID NO: 112386 - DNA, 20 bp, Artificial
  CRISPR gRNA sequence
aagctcacagtagtaggaac

SEQ ID NO: 112387 - DNA, 20 bp, Artificial
  CRISPR gRNA sequence
acagtagtaggaacatatga

SEQ ID NO: 112388 - DNA, 20 bp, Artificial
  CRISPR gRNA sequence
tactgaagccagttgcttat

SEQ ID NO: 112389 - DNA, 20 bp, Artificial
  CRISPR gRNA sequence
actgaagccagttgcttata

SEQ ID NO: 112390 - DNA, 20 bp, Artificial
  CRISPR gRNA sequence
ctgaagccagttgcttatag

SEQ ID NO: 112391 - DNA, 20 bp, Artificial
  CRISPR gRNA sequence
aagccagttgcttatagcat

SEQ ID NO: 112392 - DNA, 20 bp, Artificial
  CRISPR gRNA sequence
cttatagcattaaccattaa

SEQ ID NO: 112393 - DNA, 20 bp, Artificial
  CRISPR gRNA sequence
atagcattaaccattaacag

SEQ ID NO: 112394 - DNA, 20 bp, Artificial
  CRISPR gRNA sequence
tagcattaaccattaacagt

SEQ ID NO: 112395 - DNA, 20 bp, Artificial
  CRISPR gRNA sequence
accattaacagtatcaatat

SEQ ID NO: 112396 - DNA, 20 bp, Artificial
  CRISPR gRNA sequence
acagtatcaatatcatgata

SEQ ID NO: 112397 - DNA, 20 bp, Artificial
  CRISPR gRNA sequence
aatcactctgtcattaatgt

SEQ ID NO: 112398 - DNA, 20 bp, Artificial
  CRISPR gRNA sequence
tgtcattaatgtgagagaga

SEQ ID NO: 112399 - DNA, 20 bp, Artificial
  CRISPR gRNA sequence
tcattaatgtgagagagaat

SEQ ID NO: 112400 - DNA, 20 bp, Artificial
  CRISPR gRNA sequence
atgtgagagagaattgctgc

SEQ ID NO: 112401 - DNA, 20 bp, Artificial
  CRISPR gRNA sequence
ctgctagatttgaagctgct

SEQ ID NO: 112402 - DNA, 20 bp, Artificial
  CRISPR gRNA sequence
ctagatttgaagctgctctt

SEQ ID NO: 112403 - DNA, 20 bp, Artificial
  CRISPR gRNA sequence
gatttgaagctgctcttcaa

SEQ ID NO: 112404 - DNA, 20 bp, Artificial
  CRISPR gRNA sequence
gaagctgctcttcaaatctt

SEQ ID NO: 112405 - DNA, 20 bp, Artificial
  CRISPR gRNA sequence
aagctgctcttcaaatcttg

SEQ ID NO: 112406 - DNA, 20 bp, Artificial
  CRISPR gRNA sequence
ctcttcaaatcttgatactc

SEQ ID NO: 112407 - DNA, 20 bp, Artificial
  CRISPR gRNA sequence
ttcaaatcttgatactcttc

SEQ ID NO: 112408 - DNA, 20 bp, Artificial
  CRISPR gRNA sequence
caaatcttgatactcttcaa

SEQ ID NO: 112409 - DNA, 20 bp, Artificial
  CRISPR gRNA sequence
aaatcttgatactcttcaaa

SEQ ID NO: 112410 - DNA, 20 bp, Artificial
  CRISPR gRNA sequence
gatactcttcaaagtataaa

SEQ ID NO: 112411 - DNA, 20 bp, Artificial
  CRISPR gRNA sequence
atactcttcaaagtataaat

SEQ ID NO: 112412 - DNA, 20 bp, Artificial
  CRISPR gRNA sequence
ttcaaagtataaatttaaat

SEQ ID NO: 112413 - DNA, 20 bp, Artificial
  CRISPR gRNA sequence
caaagtataaatttaaatat

SEQ ID NO: 112414 - DNA, 20 bp, Artificial
  CRISPR gRNA sequence
aaagtataaatttaaatatt

SEQ ID NO: 112415 - DNA, 20 bp, Artificial
  CRISPR gRNA sequence
aaatattgctaaattggttc

SEQ ID NO: 112416 - DNA, 20 bp, Artificial
  CRISPR gRNA sequence
aatattgctaaattggttca

SEQ ID NO: 112417 - DNA, 20 bp, Artificial
  CRISPR gRNA sequence
ctaaattggttcatttgtat

SEQ ID NO: 112418 - DNA, 20 bp, Artificial
  CRISPR gRNA sequence
aattggttcatttgtattac

SEQ ID NO: 112419 - DNA, 20 bp, Artificial
  CRISPR gRNA sequence
gttcatttgtattaccagaa

SEQ ID NO: 112420 - DNA, 20 bp, Artificial
  CRISPR gRNA sequence
atttgtattaccagaataaa

SEQ ID NO: 112421 - DNA, 20 bp, Artificial
  CRISPR gRNA sequence
gtattaccagaataaactag

SEQ ID NO: 112422 - DNA, 20 bp, Artificial
  CRISPR gRNA sequence
tattaccagaataaactagt

SEQ ID NO: 112423 - DNA, 20 bp, Artificial
  CRISPR gRNA sequence
ccagaataaactagttaaga

SEQ ID NO: 112424 - DNA, 20 bp, Artificial
  CRISPR gRNA sequence
gttaagaagaaaatctgtac

SEQ ID NO: 112425 - DNA, 20 bp, Artificial
  CRISPR gRNA sequence
agaagaaaatctgtacgtta

SEQ ID NO: 112426 - DNA, 20 bp, Artificial
  CRISPR gRNA sequence
tacgttacatatattagtca

SEQ ID NO: 112427 - DNA, 20 bp, Artificial
  CRISPR gRNA sequence
catatattagtcattatgtg

SEQ ID NO: 112428 - DNA, 20 bp, Artificial
  CRISPR gRNA sequence
gtcattatgtgcttcaagtt

SEQ ID NO: 112429 - DNA, 20 bp, Artificial
  CRISPR gRNA sequence
tgtgcttcaagttatattta

SEQ ID NO: 112430 - DNA, 20 bp, Artificial
  CRISPR gRNA sequence
caagttatatttagtcttgt

SEQ ID NO: 112431 - DNA, 20 bp, Artificial
  CRISPR gRNA sequence
aagttatatttagtcttgta

SEQ ID NO: 112432 - DNA, 20 bp, Artificial
  CRISPR gRNA sequence
tatttagtcttgtaaagatg

SEQ ID NO: 112433 - DNA, 20 bp, Artificial
  CRISPR gRNA sequence
agtcttgtaaagatgtaaac

SEQ ID NO: 112434 - DNA, 20 bp, Artificial
  CRISPR gRNA sequence
gtcttgtaaagatgtaaact

SEQ ID NO: 112435 - DNA, 20 bp, Artificial
  CRISPR gRNA sequence
gtaaagatgtaaacttctgg

SEQ ID NO: 112436 - DNA, 20 bp, Artificial
  CRISPR gRNA sequence
taaagatgtaaacttctgga

SEQ ID NO: 112437 - DNA, 20 bp, Artificial
  CRISPR gRNA sequence
ctggatattagtcaaggaaa

SEQ ID NO: 112438 - DNA, 20 bp, Artificial
  CRISPR gRNA sequence
tggatattagtcaaggaaaa

SEQ ID NO: 112439 - DNA, 20 bp, Artificial
  CRISPR gRNA sequence
gatattagtcaaggaaaaaa

SEQ ID NO: 112440 - DNA, 20 bp, Artificial
  CRISPR gRNA sequence
gtcaaggaaaaaatctcata

SEQ ID NO: 112441 - DNA, 20 bp, Artificial
  CRISPR gRNA sequence
atataagaaggaaatttgga

SEQ ID NO: 112442 - DNA, 20 bp, Artificial
  CRISPR gRNA sequence
ggagttggggaggcgttgaa

SEQ ID NO: 112443 - DNA, 20 bp, Artificial
  CRISPR gRNA sequence
gagttggggaggcgttgaaa

SEQ ID NO: 112444 - DNA, 20 bp, Artificial
  CRISPR gRNA sequence
gggaggcgttgaaacctaaa

SEQ ID NO: 112445 - DNA, 20 bp, Artificial
  CRISPR gRNA sequence
aaacctaaaagacattcctt

SEQ ID NO: 112446 - DNA, 20 bp, Artificial
  CRISPR gRNA sequence
aaagacattcctttcatgat

SEQ ID NO: 112447 - DNA, 20 bp, Artificial
  CRISPR gRNA sequence
ctttcatgatccttattttt

SEQ ID NO: 112448 - DNA, 20 bp, Artificial
  CRISPR gRNA sequence
tcatgatccttattttttaa

SEQ ID NO: 112449 - DNA, 20 bp, Artificial
  CRISPR gRNA sequence
catgatccttattttttaaa

SEQ ID NO: 112450 - DNA, 20 bp, Artificial
  CRISPR gRNA sequence
atgatccttattttttaaaa

SEQ ID NO: 112451 - DNA, 20 bp, Artificial
  CRISPR gRNA sequence
attttttaaaatcaatttat

SEQ ID NO: 112452 - DNA, 20 bp, Artificial
  CRISPR gRNA sequence
ttttttaaaatcaatttatt

SEQ ID NO: 112453 - DNA, 20 bp, Artificial
  CRISPR gRNA sequence
tttaaaatcaatttattgag

SEQ ID NO: 112454 - DNA, 20 bp, Artificial
  CRISPR gRNA sequence
ttaaaatcaatttattgaga

SEQ ID NO: 112455 - DNA, 20 bp, Artificial
  CRISPR gRNA sequence
taaaatcaatttattgagag

SEQ ID NO: 112456 - DNA, 20 bp, Artificial
  CRISPR gRNA sequence
aaaatcaatttattgagaga

SEQ ID NO: 112457 - DNA, 20 bp, Artificial
  CRISPR gRNA sequence
aaatcaatttattgagagat

SEQ ID NO: 112458 - DNA, 20 bp, Artificial
  CRISPR gRNA sequence
attgagagatactttagaaa

SEQ ID NO: 112459 - DNA, 20 bp, Artificial
  CRISPR gRNA sequence
ttgagagatactttagaaac

SEQ ID NO: 112460 - DNA, 20 bp, Artificial
  CRISPR gRNA sequence
agagatactttagaaacaaa

SEQ ID NO: 112461 - DNA, 20 bp, Artificial
  CRISPR gRNA sequence
tagaaacaaagtataataat

SEQ ID NO: 112462 - DNA, 20 bp, Artificial
  CRISPR gRNA sequence
agaaacaaagtataataatt

SEQ ID NO: 112463 - DNA, 20 bp, Artificial
  CRISPR gRNA sequence
gaaacaaagtataataattt

SEQ ID NO: 112464 - DNA, 20 bp, Artificial
  CRISPR gRNA sequence
taaatgtgtattttgatgag

SEQ ID NO: 112465 - DNA, 20 bp, Artificial
  CRISPR gRNA sequence
aaatgtgtattttgatgagt

SEQ ID NO: 112466 - DNA, 20 bp, Artificial
  CRISPR gRNA sequence
aatgtgtattttgatgagtt

SEQ ID NO: 112467 - DNA, 20 bp, Artificial
  CRISPR gRNA sequence
tgatgagttttgacaaattt

SEQ ID NO: 112468 - DNA, 20 bp, Artificial
  CRISPR gRNA sequence
gatgagttttgacaaatttg

SEQ ID NO: 112469 - DNA, 20 bp, Artificial
  CRISPR gRNA sequence
atgagttttgacaaatttgt

SEQ ID NO: 112470 - DNA, 20 bp, Artificial
  CRISPR gRNA sequence
tgacaaatttgtacacctgt

SEQ ID NO: 112471 - DNA, 20 bp, Artificial
  CRISPR gRNA sequence
gacaaatttgtacacctgtg

SEQ ID NO: 112472 - DNA, 20 bp, Artificial
  CRISPR gRNA sequence
acaaatttgtacacctgtgc

SEQ ID NO: 112473 - DNA, 20 bp, Artificial
  CRISPR gRNA sequence
gtacacctgtgcaactgcta

SEQ ID NO: 112474 - DNA, 20 bp, Artificial
  CRISPR gRNA sequence
tacacctgtgcaactgctac

SEQ ID NO: 112475 - DNA, 20 bp, Artificial
  CRISPR gRNA sequence
tgcaactgctaccacaatga

SEQ ID NO: 112476 - DNA, 20 bp, Artificial
  CRISPR gRNA sequence
ctaccacaatgaagatataa

SEQ ID NO: 112477 - DNA, 20 bp, Artificial
  CRISPR gRNA sequence
ccacaatgaagatataaaac

SEQ ID NO: 112478 - DNA, 20 bp, Artificial
  CRISPR gRNA sequence
tcatcaccctacaatgttcc

SEQ ID NO: 112479 - DNA, 20 bp, Artificial
  CRISPR gRNA sequence
catcaccctacaatgttcct

SEQ ID NO: 112480 - DNA, 20 bp, Artificial
  CRISPR gRNA sequence
atcaccctacaatgttccta

SEQ ID NO: 112481 - DNA, 20 bp, Artificial
  CRISPR gRNA sequence
caatgttcctaaggctccat

SEQ ID NO: 112482 - DNA, 20 bp, Artificial
  CRISPR gRNA sequence
ctaaggctccatgccagtca

SEQ ID NO: 112483 - DNA, 20 bp, Artificial
  CRISPR gRNA sequence
aggctccatgccagtcaacc

SEQ ID NO: 112484 - DNA, 20 bp, Artificial
  CRISPR gRNA sequence
catgccagtcaacctccctc

SEQ ID NO: 112485 - DNA, 20 bp, Artificial
  CRISPR gRNA sequence
cctctttcctgtctccctgt

SEQ ID NO: 112486 - DNA, 20 bp, Artificial
  CRISPR gRNA sequence
tttcctgtctccctgtattc

SEQ ID NO: 112487 - DNA, 20 bp, Artificial
  CRISPR gRNA sequence
tcctgtctccctgtattctc

SEQ ID NO: 112488 - DNA, 20 bp, Artificial
  CRISPR gRNA sequence
cctgtctccctgtattctcc

SEQ ID NO: 112489 - DNA, 20 bp, Artificial
  CRISPR gRNA sequence
ctgtctccctgtattctcca

SEQ ID NO: 112490 - DNA, 20 bp, Artificial
  CRISPR gRNA sequence
tctccctgtattctccactc

SEQ ID NO: 112491 - DNA, 20 bp, Artificial
  CRISPR gRNA sequence
cctgtattctccactcccaa

SEQ ID NO: 112492 - DNA, 20 bp, Artificial
  CRISPR gRNA sequence
tattctccactcccaaggaa

SEQ ID NO: 112493 - DNA, 20 bp, Artificial
  CRISPR gRNA sequence
tccactcccaaggaaccact

SEQ ID NO: 112494 - DNA, 20 bp, Artificial
  CRISPR gRNA sequence
cactcccaaggaaccactga

SEQ ID NO: 112495 - DNA, 20 bp, Artificial
  CRISPR gRNA sequence
ccaaggaaccactgatccat

SEQ ID NO: 112496 - DNA, 20 bp, Artificial
  CRISPR gRNA sequence
atccattttctgtctctaga

SEQ ID NO: 112497 - DNA, 20 bp, Artificial
  CRISPR gRNA sequence
tctgtctctagattactgat

SEQ ID NO: 112498 - DNA, 20 bp, Artificial
  CRISPR gRNA sequence
ctgtctctagattactgatg

SEQ ID NO: 112499 - DNA, 20 bp, Artificial
  CRISPR gRNA sequence
tgtctctagattactgatgt

SEQ ID NO: 112500 - DNA, 20 bp, Artificial
  CRISPR gRNA sequence
tctctagattactgatgtct

SEQ ID NO: 112501 - DNA, 20 bp, Artificial
  CRISPR gRNA sequence
tagattactgatgtcttttg

SEQ ID NO: 112502 - DNA, 20 bp, Artificial
  CRISPR gRNA sequence
gattactgatgtcttttgga

SEQ ID NO: 112503 - DNA, 20 bp, Artificial
  CRISPR gRNA sequence
ctgatgtcttttggagattt

SEQ ID NO: 112504 - DNA, 20 bp, Artificial
  CRISPR gRNA sequence
atgtcttttggagattttat

SEQ ID NO: 112505 - DNA, 20 bp, Artificial
  CRISPR gRNA sequence
ttggagattttatataaatg

SEQ ID NO: 112506 - DNA, 20 bp, Artificial
  CRISPR gRNA sequence
tggagattttatataaatgg

SEQ ID NO: 112507 - DNA, 20 bp, Artificial
  CRISPR gRNA sequence
ggagattttatataaatgga

SEQ ID NO: 112508 - DNA, 20 bp, Artificial
  CRISPR gRNA sequence
gagattttatataaatggaa

SEQ ID NO: 112509 - DNA, 20 bp, Artificial
  CRISPR gRNA sequence
tatataaatggaatcatata

SEQ ID NO: 112510 - DNA, 20 bp, Artificial
  CRISPR gRNA sequence
atataaatggaatcatatat

SEQ ID NO: 112511 - DNA, 20 bp, Artificial
  CRISPR gRNA sequence
tataaatggaatcatatata

SEQ ID NO: 112512 - DNA, 20 bp, Artificial
  CRISPR gRNA sequence
gtttacatcataaccttaat

SEQ ID NO: 112513 - DNA, 20 bp, Artificial
  CRISPR gRNA sequence
acatcataaccttaatttta

SEQ ID NO: 112514 - DNA, 20 bp, Artificial
  CRISPR gRNA sequence
catcataaccttaattttat

SEQ ID NO: 112515 - DNA, 20 bp, Artificial
  CRISPR gRNA sequence
aattttattagtttatagcc

SEQ ID NO: 112516 - DNA, 20 bp, Artificial
  CRISPR gRNA sequence
attttattagtttatagcca

SEQ ID NO: 112517 - DNA, 20 bp, Artificial
  CRISPR gRNA sequence
tattagtttatagccataaa

SEQ ID NO: 112518 - DNA, 20 bp, Artificial
  CRISPR gRNA sequence
attagtttatagccataaat

SEQ ID NO: 112519 - DNA, 20 bp, Artificial
  CRISPR gRNA sequence
ttagtttatagccataaatg

SEQ ID NO: 112520 - DNA, 20 bp, Artificial
  CRISPR gRNA sequence
gtttatagccataaatgtat

SEQ ID NO: 112521 - DNA, 20 bp, Artificial
  CRISPR gRNA sequence
atagccataaatgtattgtg

SEQ ID NO: 112522 - DNA, 20 bp, Artificial
  CRISPR gRNA sequence
tagccataaatgtattgtgt

SEQ ID NO: 112523 - DNA, 20 bp, Artificial
  CRISPR gRNA sequence
tgtattagagacaagataga

SEQ ID NO: 112524 - DNA, 20 bp, Artificial
  CRISPR gRNA sequence
gagacaagatagaatttagg

SEQ ID NO: 112525 - DNA, 20 bp, Artificial
  CRISPR gRNA sequence
agggaagcctgttagtgccc

SEQ ID NO: 112526 - DNA, 20 bp, Artificial
  CRISPR gRNA sequence
gggaagcctgttagtgcccc

SEQ ID NO: 112527 - DNA, 20 bp, Artificial
  CRISPR gRNA sequence
ttagtgcccctaacagactc

SEQ ID NO: 112528 - DNA, 20 bp, Artificial
  CRISPR gRNA sequence
gtgcccctaacagactcaca

SEQ ID NO: 112529 - DNA, 20 bp, Artificial
  CRISPR gRNA sequence
acagactcacagtctggctg

SEQ ID NO: 112530 - DNA, 20 bp, Artificial
  CRISPR gRNA sequence
acagtctggctgaaaacctg

SEQ ID NO: 112531 - DNA, 20 bp, Artificial
  CRISPR gRNA sequence
gctgaaaacctgattttcta

SEQ ID NO: 112532 - DNA, 20 bp, Artificial
  CRISPR gRNA sequence
aaaacctgattttctattct

SEQ ID NO: 112533 - DNA, 20 bp, Artificial
  CRISPR gRNA sequence
attttctattctatacccag

SEQ ID NO: 112534 - DNA, 20 bp, Artificial
  CRISPR gRNA sequence
tctattctatacccagaatc

SEQ ID NO: 112535 - DNA, 20 bp, Artificial
  CRISPR gRNA sequence
ctattctatacccagaatct

SEQ ID NO: 112536 - DNA, 20 bp, Artificial
  CRISPR gRNA sequence
tattctatacccagaatctc

SEQ ID NO: 112537 - DNA, 20 bp, Artificial
  CRISPR gRNA sequence
ttctatacccagaatctctg

SEQ ID NO: 112538 - DNA, 20 bp, Artificial
  CRISPR gRNA sequence
tatacccagaatctctgagg

SEQ ID NO: 112539 - DNA, 20 bp, Artificial
  CRISPR gRNA sequence
tacccagaatctctgaggag

SEQ ID NO: 112540 - DNA, 20 bp, Artificial
  CRISPR gRNA sequence
tgaggagcagacttagtcaa

SEQ ID NO: 112541 - DNA, 20 bp, Artificial
  CRISPR gRNA sequence
aggagcagacttagtcaacc

SEQ ID NO: 112542 - DNA, 20 bp, Artificial
  CRISPR gRNA sequence
agtcaaccaattccaaagag

SEQ ID NO: 112543 - DNA, 20 bp, Artificial
  CRISPR gRNA sequence
gtcaaccaattccaaagaga

SEQ ID NO: 112544 - DNA, 20 bp, Artificial
  CRISPR gRNA sequence
caaagagactggtgtaaaaa

SEQ ID NO: 112545 - DNA, 20 bp, Artificial
  CRISPR gRNA sequence
gtgtaaaaatcagaaaaccg

SEQ ID NO: 112546 - DNA, 20 bp, Artificial
  CRISPR gRNA sequence
gtcatgttgctgattatatt

SEQ ID NO: 112547 - DNA, 20 bp, Artificial
  CRISPR gRNA sequence
tcatgttgctgattatattt

SEQ ID NO: 112548 - DNA, 20 bp, Artificial
  CRISPR gRNA sequence
ctgattatatttgctccctg

SEQ ID NO: 112549 - DNA, 20 bp, Artificial
  CRISPR gRNA sequence
attatatttgctccctgttg

SEQ ID NO: 112550 - DNA, 20 bp, Artificial
  CRISPR gRNA sequence
tatttgctccctgttggcca

SEQ ID NO: 112551 - DNA, 20 bp, Artificial
  CRISPR gRNA sequence
gctccctgttggccaatcta

SEQ ID NO: 112552 - DNA, 20 bp, Artificial
  CRISPR gRNA sequence
ctccctgttggccaatctat

SEQ ID NO: 112553 - DNA, 20 bp, Artificial
  CRISPR gRNA sequence
cctgttggccaatctatatg

SEQ ID NO: 112554 - DNA, 20 bp, Artificial
  CRISPR gRNA sequence
ttggccaatctatatgtaaa

SEQ ID NO: 112555 - DNA, 20 bp, Artificial
  CRISPR gRNA sequence
gccaatctatatgtaaatcc

SEQ ID NO: 112556 - DNA, 20 bp, Artificial
  CRISPR gRNA sequence
tatgtaaatccaaattatag

SEQ ID NO: 112557 - DNA, 20 bp, Artificial
  CRISPR gRNA sequence
tagctagaaatttacctagc

SEQ ID NO: 112558 - DNA, 20 bp, Artificial
  CRISPR gRNA sequence
gaaatttacctagcgagcat

SEQ ID NO: 112559 - DNA, 20 bp, Artificial
  CRISPR gRNA sequence
acctagcgagcattccatta

SEQ ID NO: 112560 - DNA, 20 bp, Artificial
  CRISPR gRNA sequence
cctagcgagcattccattag

SEQ ID NO: 112561 - DNA, 20 bp, Artificial
  CRISPR gRNA sequence
gcgagcattccattagatca

SEQ ID NO: 112562 - DNA, 20 bp, Artificial
  CRISPR gRNA sequence
cattagatcaagggcagtgc

SEQ ID NO: 112563 - DNA, 20 bp, Artificial
  CRISPR gRNA sequence
gatcaagggcagtgctttgg

SEQ ID NO: 112564 - DNA, 20 bp, Artificial
  CRISPR gRNA sequence
tggagaaccatatggccaca

SEQ ID NO: 112565 - DNA, 20 bp, Artificial
  CRISPR gRNA sequence
ggagaaccatatggccacaa

SEQ ID NO: 112566 - DNA, 20 bp, Artificial
  CRISPR gRNA sequence
gagaaccatatggccacaag

SEQ ID NO: 112567 - DNA, 20 bp, Artificial
  CRISPR gRNA sequence
ttgctgtgatgacatagcct

SEQ ID NO: 112568 - DNA, 20 bp, Artificial
  CRISPR gRNA sequence
gctgtgatgacatagcctgt

SEQ ID NO: 112569 - DNA, 20 bp, Artificial
  CRISPR gRNA sequence
ctgtgatgacatagcctgtt

SEQ ID NO: 112570 - DNA, 20 bp, Artificial
  CRISPR gRNA sequence
tgatgacatagcctgttatt

SEQ ID NO: 112571 - DNA, 20 bp, Artificial
  CRISPR gRNA sequence
ttatttatggctcatagatt

SEQ ID NO: 112572 - DNA, 20 bp, Artificial
  CRISPR gRNA sequence
tttatggctcatagattctt

SEQ ID NO: 112573 - DNA, 20 bp, Artificial
  CRISPR gRNA sequence
atggctcatagattcttatg

SEQ ID NO: 112574 - DNA, 20 bp, Artificial
  CRISPR gRNA sequence
tggctcatagattcttatgt

SEQ ID NO: 112575 - DNA, 20 bp, Artificial
  CRISPR gRNA sequence
atagattcttatgttgtatc

SEQ ID NO: 112576 - DNA, 20 bp, Artificial
  CRISPR gRNA sequence
ttatgttgtatccattttgg

SEQ ID NO: 112577 - DNA, 20 bp, Artificial
  CRISPR gRNA sequence
atgttgtatccattttggtt

SEQ ID NO: 112578 - DNA, 20 bp, Artificial
  CRISPR gRNA sequence
tgttgtatccattttggtta

SEQ ID NO: 112579 - DNA, 20 bp, Artificial
  CRISPR gRNA sequence
tatccattttggttatgagt

SEQ ID NO: 112580 - DNA, 20 bp, Artificial
  CRISPR gRNA sequence
tggttatgagtaatggggtt

SEQ ID NO: 112581 - DNA, 20 bp, Artificial
  CRISPR gRNA sequence
ggttatgagtaatggggttg

SEQ ID NO: 112582 - DNA, 20 bp, Artificial
  CRISPR gRNA sequence
gttatgagtaatggggttga

SEQ ID NO: 112583 - DNA, 20 bp, Artificial
  CRISPR gRNA sequence
tgagtaatggggttgattaa

SEQ ID NO: 112584 - DNA, 20 bp, Artificial
  CRISPR gRNA sequence
attaatttttattttgatta

SEQ ID NO: 112585 - DNA, 20 bp, Artificial
  CRISPR gRNA sequence
atttttattttgattaaatt

SEQ ID NO: 112586 - DNA, 20 bp, Artificial
  CRISPR gRNA sequence
ttattttgattaaattttgt

SEQ ID NO: 112587 - DNA, 20 bp, Artificial
  CRISPR gRNA sequence
tattttgattaaattttgtt

SEQ ID NO: 112588 - DNA, 20 bp, Artificial
  CRISPR gRNA sequence
attttgattaaattttgtta

SEQ ID NO: 112589 - DNA, 20 bp, Artificial
  CRISPR gRNA sequence
ttttgattaaattttgttat

SEQ ID NO: 112590 - DNA, 20 bp, Artificial
  CRISPR gRNA sequence
tgattaaattttgttatatt

SEQ ID NO: 112591 - DNA, 20 bp, Artificial
  CRISPR gRNA sequence
gattaaattttgttatattt

SEQ ID NO: 112592 - DNA, 20 bp, Artificial
  CRISPR gRNA sequence
attaaattttgttatatttt

SEQ ID NO: 112593 - DNA, 20 bp, Artificial
  CRISPR gRNA sequence
aattttgttatatttttcct

SEQ ID NO: 112594 - DNA, 20 bp, Artificial
  CRISPR gRNA sequence
tgttatatttttcctaacat

SEQ ID NO: 112595 - DNA, 20 bp, Artificial
  CRISPR gRNA sequence
gttatatttttcctaacatt

SEQ ID NO: 112596 - DNA, 20 bp, Artificial
  CRISPR gRNA sequence
ttatatttttcctaacattc

SEQ ID NO: 112597 - DNA, 20 bp, Artificial
  CRISPR gRNA sequence
tatttttcctaacattccaa

SEQ ID NO: 112598 - DNA, 20 bp, Artificial
  CRISPR gRNA sequence
ttcctaacattccaacattc

SEQ ID NO: 112599 - DNA, 20 bp, Artificial
  CRISPR gRNA sequence
tcctaacattccaacattca

SEQ ID NO: 112600 - DNA, 20 bp, Artificial
  CRISPR gRNA sequence
cctaacattccaacattcat

SEQ ID NO: 112601 - DNA, 20 bp, Artificial
  CRISPR gRNA sequence
ctaacattccaacattcatt

SEQ ID NO: 112602 - DNA, 20 bp, Artificial
  CRISPR gRNA sequence
acattccaacattcatttgg

SEQ ID NO: 112603 - DNA, 20 bp, Artificial
  CRISPR gRNA sequence
caacattcatttgggaaata

SEQ ID NO: 112604 - DNA, 20 bp, Artificial
  CRISPR gRNA sequence
atttgggaaataagaatttc

SEQ ID NO: 112605 - DNA, 20 bp, Artificial
  CRISPR gRNA sequence
gggaaataagaatttctcaa

SEQ ID NO: 112606 - DNA, 20 bp, Artificial
  CRISPR gRNA sequence
ggaaataagaatttctcaaa

SEQ ID NO: 112607 - DNA, 20 bp, Artificial
  CRISPR gRNA sequence
ctcaaaattcttattctaga

SEQ ID NO: 112608 - DNA, 20 bp, Artificial
  CRISPR gRNA sequence
tcaaaattcttattctagaa

SEQ ID NO: 112609 - DNA, 20 bp, Artificial
  CRISPR gRNA sequence
aaaattcttattctagaaat

SEQ ID NO: 112610 - DNA, 20 bp, Artificial
  CRISPR gRNA sequence
ttattctagaaataagaatt

SEQ ID NO: 112611 - DNA, 20 bp, Artificial
  CRISPR gRNA sequence
attctagaaataagaatttt

SEQ ID NO: 112612 - DNA, 20 bp, Artificial
  CRISPR gRNA sequence
ttctagaaataagaattttc

SEQ ID NO: 112613 - DNA, 20 bp, Artificial
  CRISPR gRNA sequence
tagaaataagaattttcaag

SEQ ID NO: 112614 - DNA, 20 bp, Artificial
  CRISPR gRNA sequence
gaaataagaattttcaagtg

SEQ ID NO: 112615 - DNA, 20 bp, Artificial
  CRISPR gRNA sequence
tcaagtgtgcagtgaaatca

SEQ ID NO: 112616 - DNA, 20 bp, Artificial
  CRISPR gRNA sequence
caagtgtgcagtgaaatcaa

SEQ ID NO: 112617 - DNA, 20 bp, Artificial
  CRISPR gRNA sequence
aagtgtgcagtgaaatcaaa

SEQ ID NO: 112618 - DNA, 20 bp, Artificial
  CRISPR gRNA sequence
gaaaataaacacctgtatac

SEQ ID NO: 112619 - DNA, 20 bp, Artificial
  CRISPR gRNA sequence
aaaataaacacctgtatacc

SEQ ID NO: 112620 - DNA, 20 bp, Artificial
  CRISPR gRNA sequence
tatacctgccagttagggtc

SEQ ID NO: 112621 - DNA, 20 bp, Artificial
  CRISPR gRNA sequence
ccagttagggtctattaaca

SEQ ID NO: 112622 - DNA, 20 bp, Artificial
  CRISPR gRNA sequence
gggtctattaacatcttact

SEQ ID NO: 112623 - DNA, 20 bp, Artificial
  CRISPR gRNA sequence
ttaacatcttactataattg

SEQ ID NO: 112624 - DNA, 20 bp, Artificial
  CRISPR gRNA sequence
acatcttactataattgcct

SEQ ID NO: 112625 - DNA, 20 bp, Artificial
  CRISPR gRNA sequence
actataattgccttaccaga

SEQ ID NO: 112626 - DNA, 20 bp, Artificial
  CRISPR gRNA sequence
ctataattgccttaccagat

SEQ ID NO: 112627 - DNA, 20 bp, Artificial
  CRISPR gRNA sequence
taattgccttaccagatatt

SEQ ID NO: 112628 - DNA, 20 bp, Artificial
  CRISPR gRNA sequence
ccttaccagatatttctcca

SEQ ID NO: 112629 - DNA, 20 bp, Artificial
  CRISPR gRNA sequence
accagatatttctccaccca

SEQ ID NO: 112630 - DNA, 20 bp, Artificial
  CRISPR gRNA sequence
ccagatatttctccacccat

SEQ ID NO: 112631 - DNA, 20 bp, Artificial
  CRISPR gRNA sequence
ctccacccattcatccattt

SEQ ID NO: 112632 - DNA, 20 bp, Artificial
  CRISPR gRNA sequence
tccacccattcatccatttt

SEQ ID NO: 112633 - DNA, 20 bp, Artificial
  CRISPR gRNA sequence
cacccattcatccatttttt

SEQ ID NO: 112634 - DNA, 20 bp, Artificial
  CRISPR gRNA sequence
atccattttttgatgcattt

SEQ ID NO: 112635 - DNA, 20 bp, Artificial
  CRISPR gRNA sequence
tttgatgcatttcaaagtaa

SEQ ID NO: 112636 - DNA, 20 bp, Artificial
  CRISPR gRNA sequence
ttgatgcatttcaaagtaaa

SEQ ID NO: 112637 - DNA, 20 bp, Artificial
  CRISPR gRNA sequence
tgatgcatttcaaagtaaat

SEQ ID NO: 112638 - DNA, 20 bp, Artificial
  CRISPR gRNA sequence
gatgcatttcaaagtaaatt

SEQ ID NO: 112639 - DNA, 20 bp, Artificial
  CRISPR gRNA sequence
atgcatttcaaagtaaattt

SEQ ID NO: 112640 - DNA, 20 bp, Artificial
  CRISPR gRNA sequence
caaagtaaattttagatatc

SEQ ID NO: 112641 - DNA, 20 bp, Artificial
  CRISPR gRNA sequence
aaagtaaattttagatatca

SEQ ID NO: 112642 - DNA, 20 bp, Artificial
  CRISPR gRNA sequence
tagatatcaatacacttctt

SEQ ID NO: 112643 - DNA, 20 bp, Artificial
  CRISPR gRNA sequence
agatatcaatacacttcttt

SEQ ID NO: 112644 - DNA, 20 bp, Artificial
  CRISPR gRNA sequence
gatatcaatacacttctttc

SEQ ID NO: 112645 - DNA, 20 bp, Artificial
  CRISPR gRNA sequence
ctttctaagtacttggacat

SEQ ID NO: 112646 - DNA, 20 bp, Artificial
  CRISPR gRNA sequence
tttctaagtacttggacata

SEQ ID NO: 112647 - DNA, 20 bp, Artificial
  CRISPR gRNA sequence
tctaagtacttggacatata

SEQ ID NO: 112648 - DNA, 20 bp, Artificial
  CRISPR gRNA sequence
ctaagtacttggacatatag

SEQ ID NO: 112649 - DNA, 20 bp, Artificial
  CRISPR gRNA sequence
taagtacttggacatatagt

SEQ ID NO: 112650 - DNA, 20 bp, Artificial
  CRISPR gRNA sequence
agtacttggacatatagttg

SEQ ID NO: 112651 - DNA, 20 bp, Artificial
  CRISPR gRNA sequence
ggacatatagttgcacatat

SEQ ID NO: 112652 - DNA, 20 bp, Artificial
  CRISPR gRNA sequence
gacatatagttgcacatatt

SEQ ID NO: 112653 - DNA, 20 bp, Artificial
  CRISPR gRNA sequence
cacatattttggtttcttct

SEQ ID NO: 112654 - DNA, 20 bp, Artificial
  CRISPR gRNA sequence
tggtttcttctttcacactg

SEQ ID NO: 112655 - DNA, 20 bp, Artificial
  CRISPR gRNA sequence
ggtttcttctttcacactgt

SEQ ID NO: 112656 - DNA, 20 bp, Artificial
  CRISPR gRNA sequence
gtttcttctttcacactgta

SEQ ID NO: 112657 - DNA, 20 bp, Artificial
  CRISPR gRNA sequence
cttctttcacactgtattga

SEQ ID NO: 112658 - DNA, 20 bp, Artificial
  CRISPR gRNA sequence
ttctttcacactgtattgag

SEQ ID NO: 112659 - DNA, 20 bp, Artificial
  CRISPR gRNA sequence
ctttcacactgtattgagac

SEQ ID NO: 112660 - DNA, 20 bp, Artificial
  CRISPR gRNA sequence
tttcacactgtattgagaca

SEQ ID NO: 112661 - DNA, 20 bp, Artificial
  CRISPR gRNA sequence
tcacactgtattgagacacc

SEQ ID NO: 112662 - DNA, 20 bp, Artificial
  CRISPR gRNA sequence
cacactgtattgagacacct

SEQ ID NO: 112663 - DNA, 20 bp, Artificial
  CRISPR gRNA sequence
acactgtattgagacacctt

SEQ ID NO: 112664 - DNA, 20 bp, Artificial
  CRISPR gRNA sequence
tattgagacaccttgcaaat

SEQ ID NO: 112665 - DNA, 20 bp, Artificial
  CRISPR gRNA sequence
agacaccttgcaaatgatta

SEQ ID NO: 112666 - DNA, 20 bp, Artificial
  CRISPR gRNA sequence
gcaaatgattaattccacca

SEQ ID NO: 112667 - DNA, 20 bp, Artificial
  CRISPR gRNA sequence
caaatgattaattccaccag

SEQ ID NO: 112668 - DNA, 20 bp, Artificial
  CRISPR gRNA sequence
attccaccagcatgtgtgga

SEQ ID NO: 112669 - DNA, 20 bp, Artificial
  CRISPR gRNA sequence
caccagcatgtgtggattta

SEQ ID NO: 112670 - DNA, 20 bp, Artificial
  CRISPR gRNA sequence
atggagagtggtactgtact

SEQ ID NO: 112671 - DNA, 20 bp, Artificial
  CRISPR gRNA sequence
tggagagtggtactgtactt

SEQ ID NO: 112672 - DNA, 20 bp, Artificial
  CRISPR gRNA sequence
tactttgccacgataatgag

SEQ ID NO: 112673 - DNA, 20 bp, Artificial
  CRISPR gRNA sequence
tgccacgataatgagcagct

SEQ ID NO: 112674 - DNA, 20 bp, Artificial
  CRISPR gRNA sequence
gccacgataatgagcagctc

SEQ ID NO: 112675 - DNA, 20 bp, Artificial
  CRISPR gRNA sequence
ccacgataatgagcagctca

SEQ ID NO: 112676 - DNA, 20 bp, Artificial
  CRISPR gRNA sequence
agttaggtcacgtcatttta

SEQ ID NO: 112677 - DNA, 20 bp, Artificial
  CRISPR gRNA sequence
ggtcacgtcattttattatt

SEQ ID NO: 112678 - DNA, 20 bp, Artificial
  CRISPR gRNA sequence
tattattcagatgttggaat

SEQ ID NO: 112679 - DNA, 20 bp, Artificial
  CRISPR gRNA sequence
attattcagatgttggaatt

SEQ ID NO: 112680 - DNA, 20 bp, Artificial
  CRISPR gRNA sequence
ttattcagatgttggaattt

SEQ ID NO: 112681 - DNA, 20 bp, Artificial
  CRISPR gRNA sequence
ttcagatgttggaatttatg

SEQ ID NO: 112682 - DNA, 20 bp, Artificial
  CRISPR gRNA sequence
agatgttggaatttatgagg

SEQ ID NO: 112683 - DNA, 20 bp, Artificial
  CRISPR gRNA sequence
gaatttatgagggcctagtg

SEQ ID NO: 112684 - DNA, 20 bp, Artificial
  CRISPR gRNA sequence
atgagggcctagtgaaaaat

SEQ ID NO: 112685 - DNA, 20 bp, Artificial
  CRISPR gRNA sequence
tgagggcctagtgaaaaatc

SEQ ID NO: 112686 - DNA, 20 bp, Artificial
  CRISPR gRNA sequence
gtgaaaaatcagagagaaag

SEQ ID NO: 112687 - DNA, 20 bp, Artificial
  CRISPR gRNA sequence
tctacatttttgtttatata

SEQ ID NO: 112688 - DNA, 20 bp, Artificial
  CRISPR gRNA sequence
catttttgtttatatatctg

SEQ ID NO: 112689 - DNA, 20 bp, Artificial
  CRISPR gRNA sequence
ttgtttatatatctgtcctc

SEQ ID NO: 112690 - DNA, 20 bp, Artificial
  CRISPR gRNA sequence
tgtttatatatctgtcctcc

SEQ ID NO: 112691 - DNA, 20 bp, Artificial
  CRISPR gRNA sequence
gtttatatatctgtcctccc

SEQ ID NO: 112692 - DNA, 20 bp, Artificial
  CRISPR gRNA sequence
tttatatatctgtcctccct

SEQ ID NO: 112693 - DNA, 20 bp, Artificial
  CRISPR gRNA sequence
atatatctgtcctccctccc

SEQ ID NO: 112694 - DNA, 20 bp, Artificial
  CRISPR gRNA sequence
tatatctgtcctccctccca

SEQ ID NO: 112695 - DNA, 20 bp, Artificial
  CRISPR gRNA sequence
tcctccctcccatatttcca

SEQ ID NO: 112696 - DNA, 20 bp, Artificial
  CRISPR gRNA sequence
cctcccatatttccaagatg

SEQ ID NO: 112697 - DNA, 20 bp, Artificial
  CRISPR gRNA sequence
ccatatttccaagatgaatt

SEQ ID NO: 112698 - DNA, 20 bp, Artificial
  CRISPR gRNA sequence
ccaagatgaattgccgattg

SEQ ID NO: 112699 - DNA, 20 bp, Artificial
  CRISPR gRNA sequence
caagatgaattgccgattgc

SEQ ID NO: 112700 - DNA, 20 bp, Artificial
  CRISPR gRNA sequence
ccgattgctaacttatatca

SEQ ID NO: 112701 - DNA, 20 bp, Artificial
  CRISPR gRNA sequence
ctaacttatatcattttaat

SEQ ID NO: 112702 - DNA, 20 bp, Artificial
  CRISPR gRNA sequence
acttatatcattttaatttt

SEQ ID NO: 112703 - DNA, 20 bp, Artificial
  CRISPR gRNA sequence
atatcattttaattttttaa

SEQ ID NO: 112704 - DNA, 20 bp, Artificial
  CRISPR gRNA sequence
tatcattttaattttttaat

SEQ ID NO: 112705 - DNA, 20 bp, Artificial
  CRISPR gRNA sequence
taattttttaatgaagtctt

SEQ ID NO: 112706 - DNA, 20 bp, Artificial
  CRISPR gRNA sequence
aattttttaatgaagtcttt

SEQ ID NO: 112707 - DNA, 20 bp, Artificial
  CRISPR gRNA sequence
attttttaatgaagtcttta

SEQ ID NO: 112708 - DNA, 20 bp, Artificial
  CRISPR gRNA sequence
tttaatgaagtctttattaa

SEQ ID NO: 112709 - DNA, 20 bp, Artificial
  CRISPR gRNA sequence
ttaatgaagtctttattaaa

SEQ ID NO: 112710 - DNA, 20 bp, Artificial
  CRISPR gRNA sequence
taatgaagtctttattaaag

SEQ ID NO: 112711 - DNA, 20 bp, Artificial
  CRISPR gRNA sequence
aatgaagtctttattaaagg

SEQ ID NO: 112712 - DNA, 20 bp, Artificial
  CRISPR gRNA sequence
atgaagtctttattaaaggt

SEQ ID NO: 112713 - DNA, 20 bp, Artificial
  CRISPR gRNA sequence
tattaaaggttctcagatat

SEQ ID NO: 112714 - DNA, 20 bp, Artificial
  CRISPR gRNA sequence
attaaaggttctcagatatc

SEQ ID NO: 112715 - DNA, 20 bp, Artificial
  CRISPR gRNA sequence
ttaaaggttctcagatatca

SEQ ID NO: 112716 - DNA, 20 bp, Artificial
  CRISPR gRNA sequence
aaggttctcagatatcattc

SEQ ID NO: 112717 - DNA, 20 bp, Artificial
  CRISPR gRNA sequence
tcagatatcattcagtttat

SEQ ID NO: 112718 - DNA, 20 bp, Artificial
  CRISPR gRNA sequence
agatatcattcagtttatct

SEQ ID NO: 112719 - DNA, 20 bp, Artificial
  CRISPR gRNA sequence
agtttatctaattgtatcct

SEQ ID NO: 112720 - DNA, 20 bp, Artificial
  CRISPR gRNA sequence
atctaattgtatccttattt

SEQ ID NO: 112721 - DNA, 20 bp, Artificial
  CRISPR gRNA sequence
tctaattgtatccttatttt

SEQ ID NO: 112722 - DNA, 20 bp, Artificial
  CRISPR gRNA sequence
attgtatccttatttttaaa

SEQ ID NO: 112723 - DNA, 20 bp, Artificial
  CRISPR gRNA sequence
tatccttatttttaaaagtg

SEQ ID NO: 112724 - DNA, 20 bp, Artificial
  CRISPR gRNA sequence
atttttaaaagtggatcttc

SEQ ID NO: 112725 - DNA, 20 bp, Artificial
  CRISPR gRNA sequence
tttttaaaagtggatcttca

SEQ ID NO: 112726 - DNA, 20 bp, Artificial
  CRISPR gRNA sequence
ttaaaagtggatcttcaact

SEQ ID NO: 112727 - DNA, 20 bp, Artificial
  CRISPR gRNA sequence
taaaagtggatcttcaactc

SEQ ID NO: 112728 - DNA, 20 bp, Artificial
  CRISPR gRNA sequence
aaaagtggatcttcaactct

SEQ ID NO: 112729 - DNA, 20 bp, Artificial
  CRISPR gRNA sequence
aaagtggatcttcaactctt

SEQ ID NO: 112730 - DNA, 20 bp, Artificial
  CRISPR gRNA sequence
caactcttaaagtctatgag

SEQ ID NO: 112731 - DNA, 20 bp, Artificial
  CRISPR gRNA sequence
aactcttaaagtctatgaga

SEQ ID NO: 112732 - DNA, 20 bp, Artificial
  CRISPR gRNA sequence
ttaaagtctatgagaagggt

SEQ ID NO: 112733 - DNA, 20 bp, Artificial
  CRISPR gRNA sequence
aaagtctatgagaagggtaa

SEQ ID NO: 112734 - DNA, 20 bp, Artificial
  CRISPR gRNA sequence
aagtctatgagaagggtaaa

SEQ ID NO: 112735 - DNA, 20 bp, Artificial
  CRISPR gRNA sequence
tgagaagggtaaattttgcc

SEQ ID NO: 112736 - DNA, 20 bp, Artificial
  CRISPR gRNA sequence
tgcctaccatatgtagtgga

SEQ ID NO: 112737 - DNA, 20 bp, Artificial
  CRISPR gRNA sequence
gcctaccatatgtagtggac

SEQ ID NO: 112738 - DNA, 20 bp, Artificial
  CRISPR gRNA sequence
cctaccatatgtagtggacc

SEQ ID NO: 112739 - DNA, 20 bp, Artificial
  CRISPR gRNA sequence
ccatatgtagtggacctgag

SEQ ID NO: 112740 - DNA, 20 bp, Artificial
  CRISPR gRNA sequence
agtaacatgtttggtgggaa

SEQ ID NO: 112741 - DNA, 20 bp, Artificial
  CRISPR gRNA sequence
ggtgggaagcaattacgtgt

SEQ ID NO: 112742 - DNA, 20 bp, Artificial
  CRISPR gRNA sequence
gtgggaagcaattacgtgtt

SEQ ID NO: 112743 - DNA, 20 bp, Artificial
  CRISPR gRNA sequence
cgtgttacaacttaaagaag

SEQ ID NO: 112744 - DNA, 20 bp, Artificial
  CRISPR gRNA sequence
caacttaaagaagctttatt

SEQ ID NO: 112745 - DNA, 20 bp, Artificial
  CRISPR gRNA sequence
aaagaagctttattctctaa

SEQ ID NO: 112746 - DNA, 20 bp, Artificial
  CRISPR gRNA sequence
aagaagctttattctctaaa

SEQ ID NO: 112747 - DNA, 20 bp, Artificial
  CRISPR gRNA sequence
tattctctaaagtatatgtg

SEQ ID NO: 112748 - DNA, 20 bp, Artificial
  CRISPR gRNA sequence
attctctaaagtatatgtgc

SEQ ID NO: 112749 - DNA, 20 bp, Artificial
  CRISPR gRNA sequence
ttctctaaagtatatgtgca

SEQ ID NO: 112750 - DNA, 20 bp, Artificial
  CRISPR gRNA sequence
tctaaagtatatgtgcaaac

SEQ ID NO: 112751 - DNA, 20 bp, Artificial
  CRISPR gRNA sequence
taaagtatatgtgcaaacct

SEQ ID NO: 112752 - DNA, 20 bp, Artificial
  CRISPR gRNA sequence
aagtatatgtgcaaacctga

SEQ ID NO: 112753 - DNA, 20 bp, Artificial
  CRISPR gRNA sequence
aaaatcagtgttaggtatgc

SEQ ID NO: 112754 - DNA, 20 bp, Artificial
  CRISPR gRNA sequence
ggtatgccttgtatcaaagt

SEQ ID NO: 112755 - DNA, 20 bp, Artificial
  CRISPR gRNA sequence
gtatcaaagtgatgtagctt

SEQ ID NO: 112756 - DNA, 20 bp, Artificial
  CRISPR gRNA sequence
tatcaaagtgatgtagctta

SEQ ID NO: 112757 - DNA, 20 bp, Artificial
  CRISPR gRNA sequence
aacgagtatctcttaggtgc

SEQ ID NO: 112758 - DNA, 20 bp, Artificial
  CRISPR gRNA sequence
acgagtatctcttaggtgca

SEQ ID NO: 112759 - DNA, 20 bp, Artificial
  CRISPR gRNA sequence
ttaggtgcaagtattgctct

SEQ ID NO: 112760 - DNA, 20 bp, Artificial
  CRISPR gRNA sequence
aggtgcaagtattgctctga

SEQ ID NO: 112761 - DNA, 20 bp, Artificial
  CRISPR gRNA sequence
ggtgcaagtattgctctgac

SEQ ID NO: 112762 - DNA, 20 bp, Artificial
  CRISPR gRNA sequence
ctctgacagtattgaaaggt

SEQ ID NO: 112763 - DNA, 20 bp, Artificial
  CRISPR gRNA sequence
tgacagtattgaaaggtaag

SEQ ID NO: 112764 - DNA, 20 bp, Artificial
  CRISPR gRNA sequence
acagtattgaaaggtaaggt

SEQ ID NO: 112765 - DNA, 20 bp, Artificial
  CRISPR gRNA sequence
aaaggtaaggttgccagtat

SEQ ID NO: 112766 - DNA, 20 bp, Artificial
  CRISPR gRNA sequence
ccagtatactgaaagcattt

SEQ ID NO: 112767 - DNA, 20 bp, Artificial
  CRISPR gRNA sequence
aaagcattttagaaacgtga

SEQ ID NO: 112768 - DNA, 20 bp, Artificial
  CRISPR gRNA sequence
tagaaacgtgaaaatagcat

SEQ ID NO: 112769 - DNA, 20 bp, Artificial
  CRISPR gRNA sequence
agaaacgtgaaaatagcatt

SEQ ID NO: 112770 - DNA, 20 bp, Artificial
  CRISPR gRNA sequence
gaaacgtgaaaatagcatta

SEQ ID NO: 112771 - DNA, 20 bp, Artificial
  CRISPR gRNA sequence
tgttgttatgattgtgccat

SEQ ID NO: 112772 - DNA, 20 bp, Artificial
  CRISPR gRNA sequence
ttatgattgtgccatgtaat

SEQ ID NO: 112773 - DNA, 20 bp, Artificial
  CRISPR gRNA sequence
tgattgtgccatgtaatccc

SEQ ID NO: 112774 - DNA, 20 bp, Artificial
  CRISPR gRNA sequence
tgccatgtaatcccagttaa

SEQ ID NO: 112775 - DNA, 20 bp, Artificial
  CRISPR gRNA sequence
aaaatgatactgaatataag

SEQ ID NO: 112776 - DNA, 20 bp, Artificial
  CRISPR gRNA sequence
aatataagcatttcctattc

SEQ ID NO: 112777 - DNA, 20 bp, Artificial
  CRISPR gRNA sequence
cctattctcctatcctgttt

SEQ ID NO: 112778 - DNA, 20 bp, Artificial
  CRISPR gRNA sequence
ctattctcctatcctgtttt

SEQ ID NO: 112779 - DNA, 20 bp, Artificial
  CRISPR gRNA sequence
ttctcctatcctgttttctt

SEQ ID NO: 112780 - DNA, 20 bp, Artificial
  CRISPR gRNA sequence
tcctatcctgttttcttgca

SEQ ID NO: 112781 - DNA, 20 bp, Artificial
  CRISPR gRNA sequence
ctatcctgttttcttgcaaa

SEQ ID NO: 112782 - DNA, 20 bp, Artificial
  CRISPR gRNA sequence
tcctgttttcttgcaaataa

SEQ ID NO: 112783 - DNA, 20 bp, Artificial
  CRISPR gRNA sequence
ttttcttgcaaataaagtac

SEQ ID NO: 112784 - DNA, 20 bp, Artificial
  CRISPR gRNA sequence
tcttgcaaataaagtacagt

SEQ ID NO: 112785 - DNA, 20 bp, Artificial
  CRISPR gRNA sequence
cttgcaaataaagtacagtg

SEQ ID NO: 112786 - DNA, 20 bp, Artificial
  CRISPR gRNA sequence
ttgcaaataaagtacagtga

SEQ ID NO: 112787 - DNA, 20 bp, Artificial
  CRISPR gRNA sequence
gcaaataaagtacagtgata

SEQ ID NO: 112788 - DNA, 20 bp, Artificial
  CRISPR gRNA sequence
caaataaagtacagtgataa

SEQ ID NO: 112789 - DNA, 20 bp, Artificial
  CRISPR gRNA sequence
tccaggttaattgtctggta

SEQ ID NO: 112790 - DNA, 20 bp, Artificial
  CRISPR gRNA sequence
attgtctggtaaggccttta

SEQ ID NO: 112791 - DNA, 20 bp, Artificial
  CRISPR gRNA sequence
tctggtaaggcctttattga

SEQ ID NO: 112792 - DNA, 20 bp, Artificial
  CRISPR gRNA sequence
gtaaggcctttattgacaat

SEQ ID NO: 112793 - DNA, 20 bp, Artificial
  CRISPR gRNA sequence
tattgacaatctcactttag

SEQ ID NO: 112794 - DNA, 20 bp, Artificial
  CRISPR gRNA sequence
attgacaatctcactttagt

SEQ ID NO: 112795 - DNA, 20 bp, Artificial
  CRISPR gRNA sequence
ttgacaatctcactttagtt

SEQ ID NO: 112796 - DNA, 20 bp, Artificial
  CRISPR gRNA sequence
acaatctcactttagtttct

SEQ ID NO: 112797 - DNA, 20 bp, Artificial
  CRISPR gRNA sequence
actttagtttctttccccac

SEQ ID NO: 112798 - DNA, 20 bp, Artificial
  CRISPR gRNA sequence
tagtttctttccccaccttt

SEQ ID NO: 112799 - DNA, 20 bp, Artificial
  CRISPR gRNA sequence
agtttctttccccacctttc

SEQ ID NO: 112800 - DNA, 20 bp, Artificial
  CRISPR gRNA sequence
gtttctttccccacctttct

SEQ ID NO: 112801 - DNA, 20 bp, Artificial
  CRISPR gRNA sequence
ctttccccacctttctaaca

SEQ ID NO: 112802 - DNA, 20 bp, Artificial
  CRISPR gRNA sequence
tttccccacctttctaacag

SEQ ID NO: 112803 - DNA, 20 bp, Artificial
  CRISPR gRNA sequence
tccccacctttctaacagga

SEQ ID NO: 112804 - DNA, 20 bp, Artificial
  CRISPR gRNA sequence
ccccacctttctaacaggag

SEQ ID NO: 112805 - DNA, 20 bp, Artificial
  CRISPR gRNA sequence
cccacctttctaacaggagt

SEQ ID NO: 112806 - DNA, 20 bp, Artificial
  CRISPR gRNA sequence
tctaacaggagtgtacctca

SEQ ID NO: 112807 - DNA, 20 bp, Artificial
  CRISPR gRNA sequence
ctaacaggagtgtacctcac

SEQ ID NO: 112808 - DNA, 20 bp, Artificial
  CRISPR gRNA sequence
taacaggagtgtacctcaca

SEQ ID NO: 112809 - DNA, 20 bp, Artificial
  CRISPR gRNA sequence
acaggagtgtacctcacagc

SEQ ID NO: 112810 - DNA, 20 bp, Artificial
  CRISPR gRNA sequence
acagccttctaggatctcca

SEQ ID NO: 112811 - DNA, 20 bp, Artificial
  CRISPR gRNA sequence
ctaggatctccagagtggac

SEQ ID NO: 112812 - DNA, 20 bp, Artificial
  CRISPR gRNA sequence
taggatctccagagtggaca

SEQ ID NO: 112813 - DNA, 20 bp, Artificial
  CRISPR gRNA sequence
ggatctccagagtggacagg

SEQ ID NO: 112814 - DNA, 20 bp, Artificial
  CRISPR gRNA sequence
cagagtggacaggaatctca

SEQ ID NO: 112815 - DNA, 20 bp, Artificial
  CRISPR gRNA sequence
acttggagggaccatggagc

SEQ ID NO: 112816 - DNA, 20 bp, Artificial
  CRISPR gRNA sequence
ggagggaccatggagcagta

SEQ ID NO: 112817 - DNA, 20 bp, Artificial
  CRISPR gRNA sequence
gagggaccatggagcagtat

SEQ ID NO: 112818 - DNA, 20 bp, Artificial
  CRISPR gRNA sequence
gacagagcagattgttgtcc

SEQ ID NO: 112819 - DNA, 20 bp, Artificial
  CRISPR gRNA sequence
ttgtccaggcaggacagatt

SEQ ID NO: 112820 - DNA, 20 bp, Artificial
  CRISPR gRNA sequence
tccaggcaggacagattcag

SEQ ID NO: 112821 - DNA, 20 bp, Artificial
  CRISPR gRNA sequence
agcagcaggtatggaagcaa

SEQ ID NO: 112822 - DNA, 20 bp, Artificial
  CRISPR gRNA sequence
ctttaaacattacagcaatg

SEQ ID NO: 112823 - DNA, 20 bp, Artificial
  CRISPR gRNA sequence
taaacattacagcaatgaaa

SEQ ID NO: 112824 - DNA, 20 bp, Artificial
  CRISPR gRNA sequence
aaacattacagcaatgaaac

SEQ ID NO: 112825 - DNA, 20 bp, Artificial
  CRISPR gRNA sequence
aacattacagcaatgaaact

SEQ ID NO: 112826 - DNA, 20 bp, Artificial
  CRISPR gRNA sequence
cagcaatgaaactgataaca

SEQ ID NO: 112827 - DNA, 20 bp, Artificial
  CRISPR gRNA sequence
ataacagcaccactcaattg

SEQ ID NO: 112828 - DNA, 20 bp, Artificial
  CRISPR gRNA sequence
aattggttggtctattgccc

SEQ ID NO: 112829 - DNA, 20 bp, Artificial
  CRISPR gRNA sequence
gttggtctattgccctgggg

SEQ ID NO: 112830 - DNA, 20 bp, Artificial
  CRISPR gRNA sequence
gtctattgccctggggaatt

SEQ ID NO: 112831 - DNA, 20 bp, Artificial
  CRISPR gRNA sequence
ttgccctggggaattatttg

SEQ ID NO: 112832 - DNA, 20 bp, Artificial
  CRISPR gRNA sequence
ccctggggaattatttgaaa

SEQ ID NO: 112833 - DNA, 20 bp, Artificial
  CRISPR gRNA sequence
gggaattatttgaaagatac

SEQ ID NO: 112834 - DNA, 20 bp, Artificial
  CRISPR gRNA sequence
tttgaaagataccagatctt

SEQ ID NO: 112835 - DNA, 20 bp, Artificial
  CRISPR gRNA sequence
gaaagataccagatcttgtg

SEQ ID NO: 112836 - DNA, 20 bp, Artificial
  CRISPR gRNA sequence
aaagataccagatcttgtga

SEQ ID NO: 112837 - DNA, 20 bp, Artificial
  CRISPR gRNA sequence
gtgagatattgggtctgatg

SEQ ID NO: 112838 - DNA, 20 bp, Artificial
  CRISPR gRNA sequence
tgagatattgggtctgatgg

SEQ ID NO: 112839 - DNA, 20 bp, Artificial
  CRISPR gRNA sequence
ggtctgatggcttgtgctga

SEQ ID NO: 112840 - DNA, 20 bp, Artificial
  CRISPR gRNA sequence
atggcttgtgctgaaatgcc

SEQ ID NO: 112841 - DNA, 20 bp, Artificial
  CRISPR gRNA sequence
gtgctgaaatgccatgtcta

SEQ ID NO: 112842 - DNA, 20 bp, Artificial
  CRISPR gRNA sequence
tgctgaaatgccatgtctag

SEQ ID NO: 112843 - DNA, 20 bp, Artificial
  CRISPR gRNA sequence
aaatgccatgtctagcccat

SEQ ID NO: 112844 - DNA, 20 bp, Artificial
  CRISPR gRNA sequence
gcccatgaccacttagaatc

SEQ ID NO: 112845 - DNA, 20 bp, Artificial
  CRISPR gRNA sequence
agaatctactcttcatgggt

SEQ ID NO: 112846 - DNA, 20 bp, Artificial
  CRISPR gRNA sequence
gaatctactcttcatgggtg

SEQ ID NO: 112847 - DNA, 20 bp, Artificial
  CRISPR gRNA sequence
ctcttcatgggtgcctggtt

SEQ ID NO: 112848 - DNA, 20 bp, Artificial
  CRISPR gRNA sequence
ttcatgggtgcctggttata

SEQ ID NO: 112849 - DNA, 20 bp, Artificial
  CRISPR gRNA sequence
catgggtgcctggttatagt

SEQ ID NO: 112850 - DNA, 20 bp, Artificial
  CRISPR gRNA sequence
atgggtgcctggttatagta

SEQ ID NO: 112851 - DNA, 20 bp, Artificial
  CRISPR gRNA sequence
gttatagtaaattgcctctt

SEQ ID NO: 112852 - DNA, 20 bp, Artificial
  CRISPR gRNA sequence
tagtaaattgcctcttttat

SEQ ID NO: 112853 - DNA, 20 bp, Artificial
  CRISPR gRNA sequence
cctcttttatctcattttaa

SEQ ID NO: 112854 - DNA, 20 bp, Artificial
  CRISPR gRNA sequence
ttttatctcattttaagtaa

SEQ ID NO: 112855 - DNA, 20 bp, Artificial
  CRISPR gRNA sequence
ttatctcattttaagtaaaa

SEQ ID NO: 112856 - DNA, 20 bp, Artificial
  CRISPR gRNA sequence
tatctcattttaagtaaaaa

SEQ ID NO: 112857 - DNA, 20 bp, Artificial
  CRISPR gRNA sequence
atctcattttaagtaaaaac

SEQ ID NO: 112858 - DNA, 20 bp, Artificial
  CRISPR gRNA sequence
tctcattttaagtaaaaaca

SEQ ID NO: 112859 - DNA, 20 bp, Artificial
  CRISPR gRNA sequence
attttaagtaaaaacatcta

SEQ ID NO: 112860 - DNA, 20 bp, Artificial
  CRISPR gRNA sequence
taagtaaaaacatctagtct

SEQ ID NO: 112861 - DNA, 20 bp, Artificial
  CRISPR gRNA sequence
aagtaaaaacatctagtctg

SEQ ID NO: 112862 - DNA, 20 bp, Artificial
  CRISPR gRNA sequence
agtaaaaacatctagtctgg

SEQ ID NO: 112863 - DNA, 20 bp, Artificial
  CRISPR gRNA sequence
gtctggttttcagatggaaa

SEQ ID NO: 112864 - DNA, 20 bp, Artificial
  CRISPR gRNA sequence
gttttcagatggaaatttgg

SEQ ID NO: 112865 - DNA, 20 bp, Artificial
  CRISPR gRNA sequence
tcagatggaaatttggactt

SEQ ID NO: 112866 - DNA, 20 bp, Artificial
  CRISPR gRNA sequence
cagatggaaatttggacttt

SEQ ID NO: 112867 - DNA, 20 bp, Artificial
  CRISPR gRNA sequence
agatggaaatttggacttta

SEQ ID NO: 112868 - DNA, 20 bp, Artificial
  CRISPR gRNA sequence
ggactttaaaatttttctgg

SEQ ID NO: 112869 - DNA, 20 bp, Artificial
  CRISPR gRNA sequence
gactttaaaatttttctgga

SEQ ID NO: 112870 - DNA, 20 bp, Artificial
  CRISPR gRNA sequence
taaaatttttctggattcta

SEQ ID NO: 112871 - DNA, 20 bp, Artificial
  CRISPR gRNA sequence
aaaatttttctggattctat

SEQ ID NO: 112872 - DNA, 20 bp, Artificial
  CRISPR gRNA sequence
aaatttttctggattctatt

SEQ ID NO: 112873 - DNA, 20 bp, Artificial
  CRISPR gRNA sequence
ttctggattctatttggtct

SEQ ID NO: 112874 - DNA, 20 bp, Artificial
  CRISPR gRNA sequence
tctggattctatttggtctt

SEQ ID NO: 112875 - DNA, 20 bp, Artificial
  CRISPR gRNA sequence
ctggattctatttggtcttt

SEQ ID NO: 112876 - DNA, 20 bp, Artificial
  CRISPR gRNA sequence
tggattctatttggtctttt

SEQ ID NO: 112877 - DNA, 20 bp, Artificial
  CRISPR gRNA sequence
gattctatttggtctttttc

SEQ ID NO: 112878 - DNA, 20 bp, Artificial
  CRISPR gRNA sequence
tatttggtctttttctcttc

SEQ ID NO: 112879 - DNA, 20 bp, Artificial
  CRISPR gRNA sequence
tttggtctttttctcttctt

SEQ ID NO: 112880 - DNA, 20 bp, Artificial
  CRISPR gRNA sequence
ggtctttttctcttcttgtt

SEQ ID NO: 112881 - DNA, 20 bp, Artificial
  CRISPR gRNA sequence
gtctttttctcttcttgttt

SEQ ID NO: 112882 - DNA, 20 bp, Artificial
  CRISPR gRNA sequence
tttctcttcttgtttgagct

SEQ ID NO: 112883 - DNA, 20 bp, Artificial
  CRISPR gRNA sequence
ttctcttcttgtttgagcta

SEQ ID NO: 112884 - DNA, 20 bp, Artificial
  CRISPR gRNA sequence
tctcttcttgtttgagctaa

SEQ ID NO: 112885 - DNA, 20 bp, Artificial
  CRISPR gRNA sequence
ctcttcttgtttgagctaac

SEQ ID NO: 112886 - DNA, 20 bp, Artificial
  CRISPR gRNA sequence
tcttcttgtttgagctaact

SEQ ID NO: 112887 - DNA, 20 bp, Artificial
  CRISPR gRNA sequence
ttcttgtttgagctaacttg

SEQ ID NO: 112888 - DNA, 20 bp, Artificial
  CRISPR gRNA sequence
cttgtttgagctaacttgtg

SEQ ID NO: 112889 - DNA, 20 bp, Artificial
  CRISPR gRNA sequence
ttgtttgagctaacttgtga

SEQ ID NO: 112890 - DNA, 20 bp, Artificial
  CRISPR gRNA sequence
gtttgagctaacttgtgatt

SEQ ID NO: 112891 - DNA, 20 bp, Artificial
  CRISPR gRNA sequence
tttgagctaacttgtgattt

SEQ ID NO: 112892 - DNA, 20 bp, Artificial
  CRISPR gRNA sequence
gagctaacttgtgatttagt

SEQ ID NO: 112893 - DNA, 20 bp, Artificial
  CRISPR gRNA sequence
agctaacttgtgatttagta

SEQ ID NO: 112894 - DNA, 20 bp, Artificial
  CRISPR gRNA sequence
acttgtgatttagtaagtct

SEQ ID NO: 112895 - DNA, 20 bp, Artificial
  CRISPR gRNA sequence
gtgatttagtaagtctttgg

SEQ ID NO: 112896 - DNA, 20 bp, Artificial
  CRISPR gRNA sequence
tgatttagtaagtctttggc

SEQ ID NO: 112897 - DNA, 20 bp, Artificial
  CRISPR gRNA sequence
agtaagtctttggccacaac

SEQ ID NO: 112898 - DNA, 20 bp, Artificial
  CRISPR gRNA sequence
gtaagtctttggccacaaca

SEQ ID NO: 112899 - DNA, 20 bp, Artificial
  CRISPR gRNA sequence
tggccacaacagacaaacca

SEQ ID NO: 112900 - DNA, 20 bp, Artificial
  CRISPR gRNA sequence
ggccacaacagacaaaccaa

SEQ ID NO: 112901 - DNA, 20 bp, Artificial
  CRISPR gRNA sequence
gccacaacagacaaaccaac

SEQ ID NO: 112902 - DNA, 20 bp, Artificial
  CRISPR gRNA sequence
ccaataaatcttctgttttt

SEQ ID NO: 112903 - DNA, 20 bp, Artificial
  CRISPR gRNA sequence
caataaatcttctgtttttt

SEQ ID NO: 112904 - DNA, 20 bp, Artificial
  CRISPR gRNA sequence
ctgttttttgatttggtctg

SEQ ID NO: 112905 - DNA, 20 bp, Artificial
  CRISPR gRNA sequence
tgttttttgatttggtctgc

SEQ ID NO: 112906 - DNA, 20 bp, Artificial
  CRISPR gRNA sequence
ttttttgatttggtctgcca

SEQ ID NO: 112907 - DNA, 20 bp, Artificial
  CRISPR gRNA sequence
tttgatttggtctgccacat

SEQ ID NO: 112908 - DNA, 20 bp, Artificial
  CRISPR gRNA sequence
ttgatttggtctgccacatt

SEQ ID NO: 112909 - DNA, 20 bp, Artificial
  CRISPR gRNA sequence
tgatttggtctgccacattt

SEQ ID NO: 112910 - DNA, 20 bp, Artificial
  CRISPR gRNA sequence
gatttggtctgccacatttt

SEQ ID NO: 112911 - DNA, 20 bp, Artificial
  CRISPR gRNA sequence
atttggtctgccacattttt

SEQ ID NO: 112912 - DNA, 20 bp, Artificial
  CRISPR gRNA sequence
ggtctgccacattttttatt

SEQ ID NO: 112913 - DNA, 20 bp, Artificial
  CRISPR gRNA sequence
gtctgccacattttttattc

SEQ ID NO: 112914 - DNA, 20 bp, Artificial
  CRISPR gRNA sequence
ccacattttttattcagaaa

SEQ ID NO: 112915 - DNA, 20 bp, Artificial
  CRISPR gRNA sequence
tttattcagaaaagctctgg

SEQ ID NO: 112916 - DNA, 20 bp, Artificial
  CRISPR gRNA sequence
ttattcagaaaagctctggt

SEQ ID NO: 112917 - DNA, 20 bp, Artificial
  CRISPR gRNA sequence
tattcagaaaagctctggtt

SEQ ID NO: 112918 - DNA, 20 bp, Artificial
  CRISPR gRNA sequence
attcagaaaagctctggttt

SEQ ID NO: 112919 - DNA, 20 bp, Artificial
  CRISPR gRNA sequence
ttcagaaaagctctggttta

SEQ ID NO: 112920 - DNA, 20 bp, Artificial
  CRISPR gRNA sequence
agaaaagctctggtttaaca

SEQ ID NO: 112921 - DNA, 20 bp, Artificial
  CRISPR gRNA sequence
tggtttaacattaggataat

SEQ ID NO: 112922 - DNA, 20 bp, Artificial
  CRISPR gRNA sequence
gtttaacattaggataatat

SEQ ID NO: 112923 - DNA, 20 bp, Artificial
  CRISPR gRNA sequence
aacattaggataatatttag

SEQ ID NO: 112924 - DNA, 20 bp, Artificial
  CRISPR gRNA sequence
acattaggataatatttaga

SEQ ID NO: 112925 - DNA, 20 bp, Artificial
  CRISPR gRNA sequence
ggataatatttagacagcca

SEQ ID NO: 112926 - DNA, 20 bp, Artificial
  CRISPR gRNA sequence
agacagccattcttatggat

SEQ ID NO: 112927 - DNA, 20 bp, Artificial
  CRISPR gRNA sequence
gacagccattcttatggata

SEQ ID NO: 112928 - DNA, 20 bp, Artificial
  CRISPR gRNA sequence
ttatggataagacatactag

SEQ ID NO: 112929 - DNA, 20 bp, Artificial
  CRISPR gRNA sequence
atggataagacatactagaa

SEQ ID NO: 112930 - DNA, 20 bp, Artificial
  CRISPR gRNA sequence
tggataagacatactagaaa

SEQ ID NO: 112931 - DNA, 20 bp, Artificial
  CRISPR gRNA sequence
gaaaggaattccctgctgct

SEQ ID NO: 112932 - DNA, 20 bp, Artificial
  CRISPR gRNA sequence
cctgctgctggtttattcct

SEQ ID NO: 112933 - DNA, 20 bp, Artificial
  CRISPR gRNA sequence
ctgctggtttattcctaatt

SEQ ID NO: 112934 - DNA, 20 bp, Artificial
  CRISPR gRNA sequence
ctggtttattcctaattaat

SEQ ID NO: 112935 - DNA, 20 bp, Artificial
  CRISPR gRNA sequence
gtttattcctaattaataga

SEQ ID NO: 112936 - DNA, 20 bp, Artificial
  CRISPR gRNA sequence
attcctaattaatagattgc

SEQ ID NO: 112937 - DNA, 20 bp, Artificial
  CRISPR gRNA sequence
ttcctaattaatagattgct

SEQ ID NO: 112938 - DNA, 20 bp, Artificial
  CRISPR gRNA sequence
ctaattaatagattgctttc

SEQ ID NO: 112939 - DNA, 20 bp, Artificial
  CRISPR gRNA sequence
attaatagattgctttcttg

SEQ ID NO: 112940 - DNA, 20 bp, Artificial
  CRISPR gRNA sequence
atagattgctttcttgaatt

SEQ ID NO: 112941 - DNA, 20 bp, Artificial
  CRISPR gRNA sequence
ctttcttgaatttatacaca

SEQ ID NO: 112942 - DNA, 20 bp, Artificial
  CRISPR gRNA sequence
tcttgaatttatacacaggt

SEQ ID NO: 112943 - DNA, 20 bp, Artificial
  CRISPR gRNA sequence
cttgaatttatacacaggtt

SEQ ID NO: 112944 - DNA, 20 bp, Artificial
  CRISPR gRNA sequence
ttgaatttatacacaggtta

SEQ ID NO: 112945 - DNA, 20 bp, Artificial
  CRISPR gRNA sequence
gaatttatacacaggttaca

SEQ ID NO: 112946 - DNA, 20 bp, Artificial
  CRISPR gRNA sequence
aatttatacacaggttacat

SEQ ID NO: 112947 - DNA, 20 bp, Artificial
  CRISPR gRNA sequence
atacacaggttacattttct

SEQ ID NO: 112948 - DNA, 20 bp, Artificial
  CRISPR gRNA sequence
tacacaggttacattttctg

SEQ ID NO: 112949 - DNA, 20 bp, Artificial
  CRISPR gRNA sequence
cattttctgatgctttatgc

SEQ ID NO: 112950 - DNA, 20 bp, Artificial
  CRISPR gRNA sequence
tctgatgctttatgcttggg

SEQ ID NO: 112951 - DNA, 20 bp, Artificial
  CRISPR gRNA sequence
ctgatgctttatgcttgggt

SEQ ID NO: 112952 - DNA, 20 bp, Artificial
  CRISPR gRNA sequence
tgatgctttatgcttgggtt

SEQ ID NO: 112953 - DNA, 20 bp, Artificial
  CRISPR gRNA sequence
atgctttatgcttgggttta

SEQ ID NO: 112954 - DNA, 20 bp, Artificial
  CRISPR gRNA sequence
tatgcttgggtttattatag

SEQ ID NO: 112955 - DNA, 20 bp, Artificial
  CRISPR gRNA sequence
atgcttgggtttattatagt

SEQ ID NO: 112956 - DNA, 20 bp, Artificial
  CRISPR gRNA sequence
tgcttgggtttattatagta

SEQ ID NO: 112957 - DNA, 20 bp, Artificial
  CRISPR gRNA sequence
gggtttattatagtaaaatt

SEQ ID NO: 112958 - DNA, 20 bp, Artificial
  CRISPR gRNA sequence
ggtttattatagtaaaattt

SEQ ID NO: 112959 - DNA, 20 bp, Artificial
  CRISPR gRNA sequence
attatagtaaaatttcactt

SEQ ID NO: 112960 - DNA, 20 bp, Artificial
  CRISPR gRNA sequence
ttatagtaaaatttcacttt

SEQ ID NO: 112961 - DNA, 20 bp, Artificial
  CRISPR gRNA sequence
tagtaaaatttcactttttt

SEQ ID NO: 112962 - DNA, 20 bp, Artificial
  CRISPR gRNA sequence
cacttttttccccaccccag

SEQ ID NO: 112963 - DNA, 20 bp, Artificial
  CRISPR gRNA sequence
acttttttccccaccccaga

SEQ ID NO: 112964 - DNA, 20 bp, Artificial
  CRISPR gRNA sequence
ttttccccaccccagaagaa

SEQ ID NO: 112965 - DNA, 20 bp, Artificial
  CRISPR gRNA sequence
tttccccaccccagaagaaa

SEQ ID NO: 112966 - DNA, 20 bp, Artificial
  CRISPR gRNA sequence
ttccccaccccagaagaaaa

SEQ ID NO: 112967 - DNA, 20 bp, Artificial
  CRISPR gRNA sequence
tccccaccccagaagaaaaa

SEQ ID NO: 112968 - DNA, 20 bp, Artificial
  CRISPR gRNA sequence
ccccaccccagaagaaaaaa

SEQ ID NO: 112969 - DNA, 20 bp, Artificial
  CRISPR gRNA sequence
cccaccccagaagaaaaaaa

SEQ ID NO: 112970 - DNA, 20 bp, Artificial
  CRISPR gRNA sequence
tgtttctatttgaccttagg

SEQ ID NO: 112971 - DNA, 20 bp, Artificial
  CRISPR gRNA sequence
ctatttgaccttaggccaag

SEQ ID NO: 112972 - DNA, 20 bp, Artificial
  CRISPR gRNA sequence
tatttgaccttaggccaaga

SEQ ID NO: 112973 - DNA, 20 bp, Artificial
  CRISPR gRNA sequence
tttgaccttaggccaagatt

SEQ ID NO: 112974 - DNA, 20 bp, Artificial
  CRISPR gRNA sequence
gaccttaggccaagattgat

SEQ ID NO: 112975 - DNA, 20 bp, Artificial
  CRISPR gRNA sequence
accttaggccaagattgata

SEQ ID NO: 112976 - DNA, 20 bp, Artificial
  CRISPR gRNA sequence
aggccaagattgatattttg

SEQ ID NO: 112977 - DNA, 20 bp, Artificial
  CRISPR gRNA sequence
ggccaagattgatattttgg

SEQ ID NO: 112978 - DNA, 20 bp, Artificial
  CRISPR gRNA sequence
atattttggaaatactttgt

SEQ ID NO: 112979 - DNA, 20 bp, Artificial
  CRISPR gRNA sequence
tggaaatactttgttttcaa

SEQ ID NO: 112980 - DNA, 20 bp, Artificial
  CRISPR gRNA sequence
ggaaatactttgttttcaaa

SEQ ID NO: 112981 - DNA, 20 bp, Artificial
  CRISPR gRNA sequence
gaaatactttgttttcaaaa

SEQ ID NO: 112982 - DNA, 20 bp, Artificial
  CRISPR gRNA sequence
tgttttcaaaatggaattta

SEQ ID NO: 112983 - DNA, 20 bp, Artificial
  CRISPR gRNA sequence
gttttcaaaatggaatttag

SEQ ID NO: 112984 - DNA, 20 bp, Artificial
  CRISPR gRNA sequence
ttttcaaaatggaatttagc

SEQ ID NO: 112985 - DNA, 20 bp, Artificial
  CRISPR gRNA sequence
tcaaaatggaatttagctaa

SEQ ID NO: 112986 - DNA, 20 bp, Artificial
  CRISPR gRNA sequence
caaaatggaatttagctaat

SEQ ID NO: 112987 - DNA, 20 bp, Artificial
  CRISPR gRNA sequence
aaaatggaatttagctaata

SEQ ID NO: 112988 - DNA, 20 bp, Artificial
  CRISPR gRNA sequence
agctaatatagaaaagtagt

SEQ ID NO: 112989 - DNA, 20 bp, Artificial
  CRISPR gRNA sequence
gctaatatagaaaagtagta

SEQ ID NO: 112990 - DNA, 20 bp, Artificial
  CRISPR gRNA sequence
atatagaaaagtagtaggga

SEQ ID NO: 112991 - DNA, 20 bp, Artificial
  CRISPR gRNA sequence
atgatgagtttttcccgtct

SEQ ID NO: 112992 - DNA, 20 bp, Artificial
  CRISPR gRNA sequence
ttcccgtctaatgatcaaag

SEQ ID NO: 112993 - DNA, 20 bp, Artificial
  CRISPR gRNA sequence
tcccgtctaatgatcaaaga

SEQ ID NO: 112994 - DNA, 20 bp, Artificial
  CRISPR gRNA sequence
cccgtctaatgatcaaagac

SEQ ID NO: 112995 - DNA, 20 bp, Artificial
  CRISPR gRNA sequence
ccgtctaatgatcaaagacg

SEQ ID NO: 112996 - DNA, 20 bp, Artificial
  CRISPR gRNA sequence
atgatcaaagacgaactccc

SEQ ID NO: 112997 - DNA, 20 bp, Artificial
  CRISPR gRNA sequence
ccctgatagctttcccttcc

SEQ ID NO: 112998 - DNA, 20 bp, Artificial
  CRISPR gRNA sequence
atagctttcccttccataca

SEQ ID NO: 112999 - DNA, 20 bp, Artificial
  CRISPR gRNA sequence
tcccttccatacagctgctg

SEQ ID NO: 113000 - DNA, 20 bp, Artificial
  CRISPR gRNA sequence
cccttccatacagctgctgt

SEQ ID NO: 113001 - DNA, 20 bp, Artificial
  CRISPR gRNA sequence
ccttccatacagctgctgtg

SEQ ID NO: 113002 - DNA, 20 bp, Artificial
  CRISPR gRNA sequence
ccatacagctgctgtggctc

SEQ ID NO: 113003 - DNA, 20 bp, Artificial
  CRISPR gRNA sequence
catacagctgctgtggctct

SEQ ID NO: 113004 - DNA, 20 bp, Artificial
  CRISPR gRNA sequence
ctgtggctctggcagtttcc

SEQ ID NO: 113005 - DNA, 20 bp, Artificial
  CRISPR gRNA sequence
tggctctggcagtttccttc

SEQ ID NO: 113006 - DNA, 20 bp, Artificial
  CRISPR gRNA sequence
tggcagtttccttcaactgc

SEQ ID NO: 113007 - DNA, 20 bp, Artificial
  CRISPR gRNA sequence
gcagtttccttcaactgcct

SEQ ID NO: 113008 - DNA, 20 bp, Artificial
  CRISPR gRNA sequence
ccttcaactgcctttttaga

SEQ ID NO: 113009 - DNA, 20 bp, Artificial
  CRISPR gRNA sequence
cttcaactgcctttttagag

SEQ ID NO: 113010 - DNA, 20 bp, Artificial
  CRISPR gRNA sequence
caactgcctttttagaggaa

SEQ ID NO: 113011 - DNA, 20 bp, Artificial
  CRISPR gRNA sequence
aactgcctttttagaggaag

SEQ ID NO: 113012 - DNA, 20 bp, Artificial
  CRISPR gRNA sequence
cctttttagaggaagggatt

SEQ ID NO: 113013 - DNA, 20 bp, Artificial
  CRISPR gRNA sequence
tttagaggaagggattccac

SEQ ID NO: 113014 - DNA, 20 bp, Artificial
  CRISPR gRNA sequence
ttagaggaagggattccaca

SEQ ID NO: 113015 - DNA, 20 bp, Artificial
  CRISPR gRNA sequence
tagaggaagggattccacaa

SEQ ID NO: 113016 - DNA, 20 bp, Artificial
  CRISPR gRNA sequence
agaggaagggattccacaaa

SEQ ID NO: 113017 - DNA, 20 bp, Artificial
  CRISPR gRNA sequence
gaggaagggattccacaaag

SEQ ID NO: 113018 - DNA, 20 bp, Artificial
  CRISPR gRNA sequence
cacaaagggccctccattca

SEQ ID NO: 113019 - DNA, 20 bp, Artificial
  CRISPR gRNA sequence
cattcacaccagtgccctgg

SEQ ID NO: 113020 - DNA, 20 bp, Artificial
  CRISPR gRNA sequence
acaccagtgccctggagggt

SEQ ID NO: 113021 - DNA, 20 bp, Artificial
  CRISPR gRNA sequence
gagggtgggtttttattctt

SEQ ID NO: 113022 - DNA, 20 bp, Artificial
  CRISPR gRNA sequence
ttattctttcagaatttgcc

SEQ ID NO: 113023 - DNA, 20 bp, Artificial
  CRISPR gRNA sequence
tattctttcagaatttgcca

SEQ ID NO: 113024 - DNA, 20 bp, Artificial
  CRISPR gRNA sequence
attctttcagaatttgccat

SEQ ID NO: 113025 - DNA, 20 bp, Artificial
  CRISPR gRNA sequence
ttctttcagaatttgccatt

SEQ ID NO: 113026 - DNA, 20 bp, Artificial
  CRISPR gRNA sequence
tttcagaatttgccattagt

SEQ ID NO: 113027 - DNA, 20 bp, Artificial
  CRISPR gRNA sequence
tcagaatttgccattagtgg

SEQ ID NO: 113028 - DNA, 20 bp, Artificial
  CRISPR gRNA sequence
cagaatttgccattagtgga

SEQ ID NO: 113029 - DNA, 20 bp, Artificial
  CRISPR gRNA sequence
agaatttgccattagtggat

SEQ ID NO: 113030 - DNA, 20 bp, Artificial
  CRISPR gRNA sequence
gccattagtggatgtaaaaa

SEQ ID NO: 113031 - DNA, 20 bp, Artificial
  CRISPR gRNA sequence
ccattagtggatgtaaaaat

SEQ ID NO: 113032 - DNA, 20 bp, Artificial
  CRISPR gRNA sequence
gtggatgtaaaaataaggtt

SEQ ID NO: 113033 - DNA, 20 bp, Artificial
  CRISPR gRNA sequence
aatcattgaaaacatggctc

SEQ ID NO: 113034 - DNA, 20 bp, Artificial
  CRISPR gRNA sequence
aaaacatggctcttaaagca

SEQ ID NO: 113035 - DNA, 20 bp, Artificial
  CRISPR gRNA sequence
ttaaagcagtccagttgggt

SEQ ID NO: 113036 - DNA, 20 bp, Artificial
  CRISPR gRNA sequence
aaagcagtccagttgggtag

SEQ ID NO: 113037 - DNA, 20 bp, Artificial
  CRISPR gRNA sequence
aagcagtccagttgggtaga

SEQ ID NO: 113038 - DNA, 20 bp, Artificial
  CRISPR gRNA sequence
ggtagaaataatcttagttt

SEQ ID NO: 113039 - DNA, 20 bp, Artificial
  CRISPR gRNA sequence
agttttgaagctgggcatgg

SEQ ID NO: 113040 - DNA, 20 bp, Artificial
  CRISPR gRNA sequence
gttttgaagctgggcatggt

SEQ ID NO: 113041 - DNA, 20 bp, Artificial
  CRISPR gRNA sequence
tgaagctgggcatggtgctg

SEQ ID NO: 113042 - DNA, 20 bp, Artificial
  CRISPR gRNA sequence
gaagctgggcatggtgctgc

SEQ ID NO: 113043 - DNA, 20 bp, Artificial
  CRISPR gRNA sequence
aagctgggcatggtgctgca

SEQ ID NO: 113044 - DNA, 20 bp, Artificial
  CRISPR gRNA sequence
ggcatggtgctgcatgcctg

SEQ ID NO: 113045 - DNA, 20 bp, Artificial
  CRISPR gRNA sequence
catgcctgtaatcccagcta

SEQ ID NO: 113046 - DNA, 20 bp, Artificial
  CRISPR gRNA sequence
taatcccagctactctggag

SEQ ID NO: 113047 - DNA, 20 bp, Artificial
  CRISPR gRNA sequence
ctctggaggctgagacagga

SEQ ID NO: 113048 - DNA, 20 bp, Artificial
  CRISPR gRNA sequence
tggaggctgagacaggaagg

SEQ ID NO: 113049 - DNA, 20 bp, Artificial
  CRISPR gRNA sequence
gaggctgagacaggaaggtt

SEQ ID NO: 113050 - DNA, 20 bp, Artificial
  CRISPR gRNA sequence
agacaggaaggttggcttaa

SEQ ID NO: 113051 - DNA, 20 bp, Artificial
  CRISPR gRNA sequence
gcttaagcccaggaattcaa

SEQ ID NO: 113052 - DNA, 20 bp, Artificial
  CRISPR gRNA sequence
aagcccaggaattcaagacc

SEQ ID NO: 113053 - DNA, 20 bp, Artificial
  CRISPR gRNA sequence
agcccaggaattcaagacca

SEQ ID NO: 113054 - DNA, 20 bp, Artificial
  CRISPR gRNA sequence
aagaccagcctgggcaaaac

SEQ ID NO: 113055 - DNA, 20 bp, Artificial
  CRISPR gRNA sequence
ggcaaaacagcaagacccca

SEQ ID NO: 113056 - DNA, 20 bp, Artificial
  CRISPR gRNA sequence
aaaataagtacataaataaa

SEQ ID NO: 113057 - DNA, 20 bp, Artificial
  CRISPR gRNA sequence
aaaaaaaaaagaatcttagt

SEQ ID NO: 113058 - DNA, 20 bp, Artificial
  CRISPR gRNA sequence
aaaaaaaaagaatcttagtt

SEQ ID NO: 113059 - DNA, 20 bp, Artificial
  CRISPR gRNA sequence
agttttgggacatgagagca

SEQ ID NO: 113060 - DNA, 20 bp, Artificial
  CRISPR gRNA sequence
gttttgggacatgagagcat

SEQ ID NO: 113061 - DNA, 20 bp, Artificial
  CRISPR gRNA sequence
tgggacatgagagcattgac

SEQ ID NO: 113062 - DNA, 20 bp, Artificial
  CRISPR gRNA sequence
gggacatgagagcattgacg

SEQ ID NO: 113063 - DNA, 20 bp, Artificial
  CRISPR gRNA sequence
ggacatgagagcattgacgt

SEQ ID NO: 113064 - DNA, 20 bp, Artificial
  CRISPR gRNA sequence
acgtcatgaagatgatttcg

SEQ ID NO: 113065 - DNA, 20 bp, Artificial
  CRISPR gRNA sequence
cggttcatagtgattaatta

SEQ ID NO: 113066 - DNA, 20 bp, Artificial
  CRISPR gRNA sequence
ggttcatagtgattaattac

SEQ ID NO: 113067 - DNA, 20 bp, Artificial
  CRISPR gRNA sequence
atagtgattaattactcctc

SEQ ID NO: 113068 - DNA, 20 bp, Artificial
  CRISPR gRNA sequence
attactcctcctttcttggt

SEQ ID NO: 113069 - DNA, 20 bp, Artificial
  CRISPR gRNA sequence
ctcctcctttcttggtgatt

SEQ ID NO: 113070 - DNA, 20 bp, Artificial
  CRISPR gRNA sequence
ctcctttcttggtgattgca

SEQ ID NO: 113071 - DNA, 20 bp, Artificial
  CRISPR gRNA sequence
ctttcttggtgattgcattt

SEQ ID NO: 113072 - DNA, 20 bp, Artificial
  CRISPR gRNA sequence
tcttggtgattgcatttaag

SEQ ID NO: 113073 - DNA, 20 bp, Artificial
  CRISPR gRNA sequence
cttggtgattgcatttaagc

SEQ ID NO: 113074 - DNA, 20 bp, Artificial
  CRISPR gRNA sequence
ttggtgattgcatttaagcc

SEQ ID NO: 113075 - DNA, 20 bp, Artificial
  CRISPR gRNA sequence
ggtgattgcatttaagccca

SEQ ID NO: 113076 - DNA, 20 bp, Artificial
  CRISPR gRNA sequence
gtgattgcatttaagcccag

SEQ ID NO: 113077 - DNA, 20 bp, Artificial
  CRISPR gRNA sequence
catttaagcccagaattttt

SEQ ID NO: 113078 - DNA, 20 bp, Artificial
  CRISPR gRNA sequence
aagcccagaattttttatgg

SEQ ID NO: 113079 - DNA, 20 bp, Artificial
  CRISPR gRNA sequence
agcccagaattttttatggt

SEQ ID NO: 113080 - DNA, 20 bp, Artificial
  CRISPR gRNA sequence
tttatggtagtttcagggct

SEQ ID NO: 113081 - DNA, 20 bp, Artificial
  CRISPR gRNA sequence
ttatggtagtttcagggcta

SEQ ID NO: 113082 - DNA, 20 bp, Artificial
  CRISPR gRNA sequence
tatggtagtttcagggctat

SEQ ID NO: 113083 - DNA, 20 bp, Artificial
  CRISPR gRNA sequence
atggtagtttcagggctatt

SEQ ID NO: 113084 - DNA, 20 bp, Artificial
  CRISPR gRNA sequence
tggtagtttcagggctatta

SEQ ID NO: 113085 - DNA, 20 bp, Artificial
  CRISPR gRNA sequence
cagggctattaaaacctaat

SEQ ID NO: 113086 - DNA, 20 bp, Artificial
  CRISPR gRNA sequence
agggctattaaaacctaatc

SEQ ID NO: 113087 - DNA, 20 bp, Artificial
  CRISPR gRNA sequence
ttaaaacctaatcatttttt

SEQ ID NO: 113088 - DNA, 20 bp, Artificial
  CRISPR gRNA sequence
aaacctaatcatttttttct

SEQ ID NO: 113089 - DNA, 20 bp, Artificial
  CRISPR gRNA sequence
atcatttttttcttgtgaac

SEQ ID NO: 113090 - DNA, 20 bp, Artificial
  CRISPR gRNA sequence
ttttcttgtgaactcatctg

SEQ ID NO: 113091 - DNA, 20 bp, Artificial
  CRISPR gRNA sequence
tttcttgtgaactcatctga

SEQ ID NO: 113092 - DNA, 20 bp, Artificial
  CRISPR gRNA sequence
ttcttgtgaactcatctgag

SEQ ID NO: 113093 - DNA, 20 bp, Artificial
  CRISPR gRNA sequence
tcttgtgaactcatctgagg

SEQ ID NO: 113094 - DNA, 20 bp, Artificial
  CRISPR gRNA sequence
cttgtgaactcatctgagga

SEQ ID NO: 113095 - DNA, 20 bp, Artificial
  CRISPR gRNA sequence
ttgtgaactcatctgaggag

SEQ ID NO: 113096 - DNA, 20 bp, Artificial
  CRISPR gRNA sequence
gtgaactcatctgaggagat

SEQ ID NO: 113097 - DNA, 20 bp, Artificial
  CRISPR gRNA sequence
tgaactcatctgaggagata

SEQ ID NO: 113098 - DNA, 20 bp, Artificial
  CRISPR gRNA sequence
atctgaggagataaaaaggg

SEQ ID NO: 113099 - DNA, 20 bp, Artificial
  CRISPR gRNA sequence
aggagataaaaagggcatta

SEQ ID NO: 113100 - DNA, 20 bp, Artificial
  CRISPR gRNA sequence
aacaattgtgtaagtagaag

SEQ ID NO: 113101 - DNA, 20 bp, Artificial
  CRISPR gRNA sequence
tgtaagtagaagtgtcagat

SEQ ID NO: 113102 - DNA, 20 bp, Artificial
  CRISPR gRNA sequence
ctgtttctggagggaaagat

SEQ ID NO: 113103 - DNA, 20 bp, Artificial
  CRISPR gRNA sequence
tttctggagggaaagattgc

SEQ ID NO: 113104 - DNA, 20 bp, Artificial
  CRISPR gRNA sequence
ctggagggaaagattgcatt

SEQ ID NO: 113105 - DNA, 20 bp, Artificial
  CRISPR gRNA sequence
tggagggaaagattgcatta

SEQ ID NO: 113106 - DNA, 20 bp, Artificial
  CRISPR gRNA sequence
gagggaaagattgcattaca

SEQ ID NO: 113107 - DNA, 20 bp, Artificial
  CRISPR gRNA sequence
cattacaaatctttgtgtta

SEQ ID NO: 113108 - DNA, 20 bp, Artificial
  CRISPR gRNA sequence
caaatctttgtgttaatgat

SEQ ID NO: 113109 - DNA, 20 bp, Artificial
  CRISPR gRNA sequence
tgtgttaatgatgacaactg

SEQ ID NO: 113110 - DNA, 20 bp, Artificial
  CRISPR gRNA sequence
gtgttaatgatgacaactgt

SEQ ID NO: 113111 - DNA, 20 bp, Artificial
  CRISPR gRNA sequence
tgttaatgatgacaactgtt

SEQ ID NO: 113112 - DNA, 20 bp, Artificial
  CRISPR gRNA sequence
atgatgacaactgttttgag

SEQ ID NO: 113113 - DNA, 20 bp, Artificial
  CRISPR gRNA sequence
ttttgagtttttgagtcaaa

SEQ ID NO: 113114 - DNA, 20 bp, Artificial
  CRISPR gRNA sequence
tgagtttttgagtcaaattt

SEQ ID NO: 113115 - DNA, 20 bp, Artificial
  CRISPR gRNA sequence
gagtttttgagtcaaatttt

SEQ ID NO: 113116 - DNA, 20 bp, Artificial
  CRISPR gRNA sequence
agtttttgagtcaaattttt

SEQ ID NO: 113117 - DNA, 20 bp, Artificial
  CRISPR gRNA sequence
ttgagtcaaatttttgaggt

SEQ ID NO: 113118 - DNA, 20 bp, Artificial
  CRISPR gRNA sequence
tgagtcaaatttttgaggtc

SEQ ID NO: 113119 - DNA, 20 bp, Artificial
  CRISPR gRNA sequence
gagtcaaatttttgaggtcc

SEQ ID NO: 113120 - DNA, 20 bp, Artificial
  CRISPR gRNA sequence
agtcaaatttttgaggtcca

SEQ ID NO: 113121 - DNA, 20 bp, Artificial
  CRISPR gRNA sequence
ttgaggtccactctggagac

SEQ ID NO: 113122 - DNA, 20 bp, Artificial
  CRISPR gRNA sequence
tgaggtccactctggagaca

SEQ ID NO: 113123 - DNA, 20 bp, Artificial
  CRISPR gRNA sequence
gaggtccactctggagacaa

SEQ ID NO: 113124 - DNA, 20 bp, Artificial
  CRISPR gRNA sequence
aggtccactctggagacaaa

SEQ ID NO: 113125 - DNA, 20 bp, Artificial
  CRISPR gRNA sequence
tggagacaaagggctaatat

SEQ ID NO: 113126 - DNA, 20 bp, Artificial
  CRISPR gRNA sequence
gagacaaagggctaatatct

SEQ ID NO: 113127 - DNA, 20 bp, Artificial
  CRISPR gRNA sequence
atatctttaatcctactacc

SEQ ID NO: 113128 - DNA, 20 bp, Artificial
  CRISPR gRNA sequence
taatcctactaccttcaaca

SEQ ID NO: 113129 - DNA, 20 bp, Artificial
  CRISPR gRNA sequence
aatcctactaccttcaacaa

SEQ ID NO: 113130 - DNA, 20 bp, Artificial
  CRISPR gRNA sequence
atcctactaccttcaacaaa

SEQ ID NO: 113131 - DNA, 20 bp, Artificial
  CRISPR gRNA sequence
ctaccttcaacaaaacagct

SEQ ID NO: 113132 - DNA, 20 bp, Artificial
  CRISPR gRNA sequence
ccttcaacaaaacagcttca

SEQ ID NO: 113133 - DNA, 20 bp, Artificial
  CRISPR gRNA sequence
caacaaaacagcttcaatat

SEQ ID NO: 113134 - DNA, 20 bp, Artificial
  CRISPR gRNA sequence
aacaaaacagcttcaatata

SEQ ID NO: 113135 - DNA, 20 bp, Artificial
  CRISPR gRNA sequence
caatatagggagtctgtaca

SEQ ID NO: 113136 - DNA, 20 bp, Artificial
  CRISPR gRNA sequence
aatatagggagtctgtacat

SEQ ID NO: 113137 - DNA, 20 bp, Artificial
  CRISPR gRNA sequence
tacattttgaaagtccttca

SEQ ID NO: 113138 - DNA, 20 bp, Artificial
  CRISPR gRNA sequence
tgaaagtccttcaggcttcc

SEQ ID NO: 113139 - DNA, 20 bp, Artificial
  CRISPR gRNA sequence
gaaagtccttcaggcttccg

SEQ ID NO: 113140 - DNA, 20 bp, Artificial
  CRISPR gRNA sequence
aaagtccttcaggcttccgt

SEQ ID NO: 113141 - DNA, 20 bp, Artificial
  CRISPR gRNA sequence
caggcttccgtctctctcct

SEQ ID NO: 113142 - DNA, 20 bp, Artificial
  CRISPR gRNA sequence
aggcttccgtctctctcctc

SEQ ID NO: 113143 - DNA, 20 bp, Artificial
  CRISPR gRNA sequence
ccgtctctctcctccaagag

SEQ ID NO: 113144 - DNA, 20 bp, Artificial
  CRISPR gRNA sequence
cgtctctctcctccaagagg

SEQ ID NO: 113145 - DNA, 20 bp, Artificial
  CRISPR gRNA sequence
tctcctccaagaggtaaggt

SEQ ID NO: 113146 - DNA, 20 bp, Artificial
  CRISPR gRNA sequence
tcctccaagaggtaaggtga

SEQ ID NO: 113147 - DNA, 20 bp, Artificial
  CRISPR gRNA sequence
ctccaagaggtaaggtgatc

SEQ ID NO: 113148 - DNA, 20 bp, Artificial
  CRISPR gRNA sequence
caagaggtaaggtgatctgt

SEQ ID NO: 113149 - DNA, 20 bp, Artificial
  CRISPR gRNA sequence
tgtcttgaactacacatttc

SEQ ID NO: 113150 - DNA, 20 bp, Artificial
  CRISPR gRNA sequence
gaactacacatttccttcct

SEQ ID NO: 113151 - DNA, 20 bp, Artificial
  CRISPR gRNA sequence
aactacacatttccttcctg

SEQ ID NO: 113152 - DNA, 20 bp, Artificial
  CRISPR gRNA sequence
cacatttccttcctgacata

SEQ ID NO: 113153 - DNA, 20 bp, Artificial
  CRISPR gRNA sequence
ccttcctgacatatttcaag

SEQ ID NO: 113154 - DNA, 20 bp, Artificial
  CRISPR gRNA sequence
cttcctgacatatttcaagc

SEQ ID NO: 113155 - DNA, 20 bp, Artificial
  CRISPR gRNA sequence
cctgacatatttcaagctct

SEQ ID NO: 113156 - DNA, 20 bp, Artificial
  CRISPR gRNA sequence
ctgacatatttcaagctctt

SEQ ID NO: 113157 - DNA, 20 bp, Artificial
  CRISPR gRNA sequence
acatatttcaagctcttcct

SEQ ID NO: 113158 - DNA, 20 bp, Artificial
  CRISPR gRNA sequence
caagctcttcctgttcctgt

SEQ ID NO: 113159 - DNA, 20 bp, Artificial
  CRISPR gRNA sequence
aagctcttcctgttcctgtt

SEQ ID NO: 113160 - DNA, 20 bp, Artificial
  CRISPR gRNA sequence
ttcctgttcctgttctcagc

SEQ ID NO: 113161 - DNA, 20 bp, Artificial
  CRISPR gRNA sequence
cctgttcctgttctcagcag

SEQ ID NO: 113162 - DNA, 20 bp, Artificial
  CRISPR gRNA sequence
ctgttcctgttctcagcagc

SEQ ID NO: 113163 - DNA, 20 bp, Artificial
  CRISPR gRNA sequence
ttcctgttctcagcagcagg

SEQ ID NO: 113164 - DNA, 20 bp, Artificial
  CRISPR gRNA sequence
ctgttctcagcagcagggtg

SEQ ID NO: 113165 - DNA, 20 bp, Artificial
  CRISPR gRNA sequence
ttctcagcagcagggtggtg

SEQ ID NO: 113166 - DNA, 20 bp, Artificial
  CRISPR gRNA sequence
tcagcagcagggtggtgtca

SEQ ID NO: 113167 - DNA, 20 bp, Artificial
  CRISPR gRNA sequence
agcagcagggtggtgtcact

SEQ ID NO: 113168 - DNA, 20 bp, Artificial
  CRISPR gRNA sequence
ctgtgcagttgcagactgag

SEQ ID NO: 113169 - DNA, 20 bp, Artificial
  CRISPR gRNA sequence
tgcagttgcagactgaggcc

SEQ ID NO: 113170 - DNA, 20 bp, Artificial
  CRISPR gRNA sequence
cagactgaggcccaggtggc

SEQ ID NO: 113171 - DNA, 20 bp, Artificial
  CRISPR gRNA sequence
aggcccaggtggcatccgcc

SEQ ID NO: 113172 - DNA, 20 bp, Artificial
  CRISPR gRNA sequence
aggccagcaagtccagaccc

SEQ ID NO: 113173 - DNA, 20 bp, Artificial
  CRISPR gRNA sequence
caggtagtggtaccctctct

SEQ ID NO: 113174 - DNA, 20 bp, Artificial
  CRISPR gRNA sequence
tctgattctctgtgagcact

SEQ ID NO: 113175 - DNA, 20 bp, Artificial
  CRISPR gRNA sequence
tgattctctgtgagcactgc

SEQ ID NO: 113176 - DNA, 20 bp, Artificial
  CRISPR gRNA sequence
attctctgtgagcactgcat

SEQ ID NO: 113177 - DNA, 20 bp, Artificial
  CRISPR gRNA sequence
tctgtgagcactgcatgaac

SEQ ID NO: 113178 - DNA, 20 bp, Artificial
  CRISPR gRNA sequence
tgtgagcactgcatgaactt

SEQ ID NO: 113179 - DNA, 20 bp, Artificial
  CRISPR gRNA sequence
tgagcactgcatgaacttct

SEQ ID NO: 113180 - DNA, 20 bp, Artificial
  CRISPR gRNA sequence
catgaacttctcctctcctc

SEQ ID NO: 113181 - DNA, 20 bp, Artificial
  CRISPR gRNA sequence
ctcctctcctcatgtctggt

SEQ ID NO: 113182 - DNA, 20 bp, Artificial
  CRISPR gRNA sequence
tcctctcctcatgtctggtg

SEQ ID NO: 113183 - DNA, 20 bp, Artificial
  CRISPR gRNA sequence
ctctcctcatgtctggtgct

SEQ ID NO: 113184 - DNA, 20 bp, Artificial
  CRISPR gRNA sequence
tcctcatgtctggtgctgtt

SEQ ID NO: 113185 - DNA, 20 bp, Artificial
  CRISPR gRNA sequence
ctcatgtctggtgctgtttg

SEQ ID NO: 113186 - DNA, 20 bp, Artificial
  CRISPR gRNA sequence
atgtctggtgctgtttgtgt

SEQ ID NO: 113187 - DNA, 20 bp, Artificial
  CRISPR gRNA sequence
gtgctgtttgtgttaggatc

SEQ ID NO: 113188 - DNA, 20 bp, Artificial
  CRISPR gRNA sequence
tttgtgttaggatctccagt

SEQ ID NO: 113189 - DNA, 20 bp, Artificial
  CRISPR gRNA sequence
gtgttaggatctccagtagg

SEQ ID NO: 113190 - DNA, 20 bp, Artificial
  CRISPR gRNA sequence
tgttaggatctccagtagga

SEQ ID NO: 113191 - DNA, 20 bp, Artificial
  CRISPR gRNA sequence
ggatctccagtaggaatggc

SEQ ID NO: 113192 - DNA, 20 bp, Artificial
  CRISPR gRNA sequence
cagtaggaatggcaaagtca

SEQ ID NO: 113193 - DNA, 20 bp, Artificial
  CRISPR gRNA sequence
catgtctttgatgctgctaa

SEQ ID NO: 113194 - DNA, 20 bp, Artificial
  CRISPR gRNA sequence
tgatgctgctaacttgtctt

SEQ ID NO: 113195 - DNA, 20 bp, Artificial
  CRISPR gRNA sequence
gatgctgctaacttgtcttt

SEQ ID NO: 113196 - DNA, 20 bp, Artificial
  CRISPR gRNA sequence
atgctgctaacttgtctttg

SEQ ID NO: 113197 - DNA, 20 bp, Artificial
  CRISPR gRNA sequence
ctaacttgtctttgaggctt

SEQ ID NO: 113198 - DNA, 20 bp, Artificial
  CRISPR gRNA sequence
acttgtctttgaggcttata

SEQ ID NO: 113199 - DNA, 20 bp, Artificial
  CRISPR gRNA sequence
gtctttgaggcttataagat

SEQ ID NO: 113200 - DNA, 20 bp, Artificial
  CRISPR gRNA sequence
tctttgaggcttataagatg

SEQ ID NO: 113201 - DNA, 20 bp, Artificial
  CRISPR gRNA sequence
tgaggcttataagatgccag

SEQ ID NO: 113202 - DNA, 20 bp, Artificial
  CRISPR gRNA sequence
gaggcttataagatgccagt

SEQ ID NO: 113203 - DNA, 20 bp, Artificial
  CRISPR gRNA sequence
aggcttataagatgccagtt

SEQ ID NO: 113204 - DNA, 20 bp, Artificial
  CRISPR gRNA sequence
ataagatgccagtttcctaa

SEQ ID NO: 113205 - DNA, 20 bp, Artificial
  CRISPR gRNA sequence
taagatgccagtttcctaat

SEQ ID NO: 113206 - DNA, 20 bp, Artificial
  CRISPR gRNA sequence
cctaatatttcatgccaagt

SEQ ID NO: 113207 - DNA, 20 bp, Artificial
  CRISPR gRNA sequence
ctaatatttcatgccaagtc

SEQ ID NO: 113208 - DNA, 20 bp, Artificial
  CRISPR gRNA sequence
atatttcatgccaagtcata

SEQ ID NO: 113209 - DNA, 20 bp, Artificial
  CRISPR gRNA sequence
catgccaagtcatatagaga

SEQ ID NO: 113210 - DNA, 20 bp, Artificial
  CRISPR gRNA sequence
atgccaagtcatatagagac

SEQ ID NO: 113211 - DNA, 20 bp, Artificial
  CRISPR gRNA sequence
tctgagaattggatttgact

SEQ ID NO: 113212 - DNA, 20 bp, Artificial
  CRISPR gRNA sequence
ctgagaattggatttgacta

SEQ ID NO: 113213 - DNA, 20 bp, Artificial
  CRISPR gRNA sequence
tgagaattggatttgactag

SEQ ID NO: 113214 - DNA, 20 bp, Artificial
  CRISPR gRNA sequence
agaattggatttgactagca

SEQ ID NO: 113215 - DNA, 20 bp, Artificial
  CRISPR gRNA sequence
gatttgactagcatgtttct

SEQ ID NO: 113216 - DNA, 20 bp, Artificial
  CRISPR gRNA sequence
gactagcatgtttctttgag

SEQ ID NO: 113217 - DNA, 20 bp, Artificial
  CRISPR gRNA sequence
actagcatgtttctttgaga

SEQ ID NO: 113218 - DNA, 20 bp, Artificial
  CRISPR gRNA sequence
gcatgtttctttgagaatgc

SEQ ID NO: 113219 - DNA, 20 bp, Artificial
  CRISPR gRNA sequence
ctttgagaatgcctggaaaa

SEQ ID NO: 113220 - DNA, 20 bp, Artificial
  CRISPR gRNA sequence
tttgagaatgcctggaaaag

SEQ ID NO: 113221 - DNA, 20 bp, Artificial
  CRISPR gRNA sequence
tgagaatgcctggaaaagaa

SEQ ID NO: 113222 - DNA, 20 bp, Artificial
  CRISPR gRNA sequence
gagaatgcctggaaaagaaa

SEQ ID NO: 113223 - DNA, 20 bp, Artificial
  CRISPR gRNA sequence
agaatgcctggaaaagaaat

SEQ ID NO: 113224 - DNA, 20 bp, Artificial
  CRISPR gRNA sequence
gaaaagaaatggtataagtg

SEQ ID NO: 113225 - DNA, 20 bp, Artificial
  CRISPR gRNA sequence
ttataagtgacattagaatt

SEQ ID NO: 113226 - DNA, 20 bp, Artificial
  CRISPR gRNA sequence
ataagtgacattagaattta

SEQ ID NO: 113227 - DNA, 20 bp, Artificial
  CRISPR gRNA sequence
taagtgacattagaatttat

SEQ ID NO: 113228 - DNA, 20 bp, Artificial
  CRISPR gRNA sequence
gaatttattcagggctcggc

SEQ ID NO: 113229 - DNA, 20 bp, Artificial
  CRISPR gRNA sequence
attcagggctcggccgggcg

SEQ ID NO: 113230 - DNA, 20 bp, Artificial
  CRISPR gRNA sequence
ttcagggctcggccgggcgc

SEQ ID NO: 113231 - DNA, 20 bp, Artificial
  CRISPR gRNA sequence
agggctcggccgggcgcggt

SEQ ID NO: 113232 - DNA, 20 bp, Artificial
  CRISPR gRNA sequence
ggccgggcgcggtggctcac

SEQ ID NO: 113233 - DNA, 20 bp, Artificial
  CRISPR gRNA sequence
acgcctgtaatcccagcact

SEQ ID NO: 113234 - DNA, 20 bp, Artificial
  CRISPR gRNA sequence
taatcccagcactttgggag

SEQ ID NO: 113235 - DNA, 20 bp, Artificial
  CRISPR gRNA sequence
tgggaggccgaggcaggcgg

SEQ ID NO: 113236 - DNA, 20 bp, Artificial
  CRISPR gRNA sequence
gggaggccgaggcaggcgga

SEQ ID NO: 113237 - DNA, 20 bp, Artificial
  CRISPR gRNA sequence
ggaggccgaggcaggcggat

SEQ ID NO: 113238 - DNA, 20 bp, Artificial
  CRISPR gRNA sequence
gcaaacatggtgaaaccctg

SEQ ID NO: 113239 - DNA, 20 bp, Artificial
  CRISPR gRNA sequence
tctctactaaaaatacaaaa

SEQ ID NO: 113240 - DNA, 20 bp, Artificial
  CRISPR gRNA sequence
tactaaaaatacaaaaaaat

SEQ ID NO: 113241 - DNA, 20 bp, Artificial
  CRISPR gRNA sequence
ctaaaaatacaaaaaaatta

SEQ ID NO: 113242 - DNA, 20 bp, Artificial
  CRISPR gRNA sequence
aaaatacaaaaaaattagcc

SEQ ID NO: 113243 - DNA, 20 bp, Artificial
  CRISPR gRNA sequence
gccgggcatggtggcgggca

SEQ ID NO: 113244 - DNA, 20 bp, Artificial
  CRISPR gRNA sequence
tagtcccagctacttgggag

SEQ ID NO: 113245 - DNA, 20 bp, Artificial
  CRISPR gRNA sequence
cttgggaggctggagcagga

SEQ ID NO: 113246 - DNA, 20 bp, Artificial
  CRISPR gRNA sequence
gggaggctggagcaggagaa

SEQ ID NO: 113247 - DNA, 20 bp, Artificial
  CRISPR gRNA sequence
ggaggctggagcaggagaat

SEQ ID NO: 113248 - DNA, 20 bp, Artificial
  CRISPR gRNA sequence
gagcaggagaatggcgtgaa

SEQ ID NO: 113249 - DNA, 20 bp, Artificial
  CRISPR gRNA sequence
gcagtgagcagagattgcgc

SEQ ID NO: 113250 - DNA, 20 bp, Artificial
  CRISPR gRNA sequence
cagtgagcagagattgcgcc

SEQ ID NO: 113251 - DNA, 20 bp, Artificial
  CRISPR gRNA sequence
cgccactgcactccagcctg

SEQ ID NO: 113252 - DNA, 20 bp, Artificial
  CRISPR gRNA sequence
cactccagcctgggtgacag

SEQ ID NO: 113253 - DNA, 20 bp, Artificial
  CRISPR gRNA sequence
cagcctgggtgacagagcga

SEQ ID NO: 113254 - DNA, 20 bp, Artificial
  CRISPR gRNA sequence
ggtgacagagcgagactccg

SEQ ID NO: 113255 - DNA, 20 bp, Artificial
  CRISPR gRNA sequence
cgtctcaaaaaaaaaaaaaa

SEQ ID NO: 113256 - DNA, 20 bp, Artificial
  CRISPR gRNA sequence
aaaaaaaaaaaaaagaattt

SEQ ID NO: 113257 - DNA, 20 bp, Artificial
  CRISPR gRNA sequence
attcagggctcacactctga

SEQ ID NO: 113258 - DNA, 20 bp, Artificial
  CRISPR gRNA sequence
ttcagggctcacactctgat

SEQ ID NO: 113259 - DNA, 20 bp, Artificial
  CRISPR gRNA sequence
agggctcacactctgatcca

SEQ ID NO: 113260 - DNA, 20 bp, Artificial
  CRISPR gRNA sequence
acactctgatccaattaatt

SEQ ID NO: 113261 - DNA, 20 bp, Artificial
  CRISPR gRNA sequence
tgatccaattaattgcatgg

SEQ ID NO: 113262 - DNA, 20 bp, Artificial
  CRISPR gRNA sequence
atccaattaattgcatggta

SEQ ID NO: 113263 - DNA, 20 bp, Artificial
  CRISPR gRNA sequence
attgcatggtaaaaattttg

SEQ ID NO: 113264 - DNA, 20 bp, Artificial
  CRISPR gRNA sequence
catggtaaaaattttgtgta

SEQ ID NO: 113265 - DNA, 20 bp, Artificial
  CRISPR gRNA sequence
tgtgtatttgtgttacaatg

SEQ ID NO: 113266 - DNA, 20 bp, Artificial
  CRISPR gRNA sequence
gtgtatttgtgttacaatgg

SEQ ID NO: 113267 - DNA, 20 bp, Artificial
  CRISPR gRNA sequence
tgtatttgtgttacaatgga

SEQ ID NO: 113268 - DNA, 20 bp, Artificial
  CRISPR gRNA sequence
gtgttacaatggagaaggaa

SEQ ID NO: 113269 - DNA, 20 bp, Artificial
  CRISPR gRNA sequence
tgttacaatggagaaggaaa

SEQ ID NO: 113270 - DNA, 20 bp, Artificial
  CRISPR gRNA sequence
caatggagaaggaaatatat

SEQ ID NO: 113271 - DNA, 20 bp, Artificial
  CRISPR gRNA sequence
ggctaggctgtgctttattt

SEQ ID NO: 113272 - DNA, 20 bp, Artificial
  CRISPR gRNA sequence
ggctgtgctttatttttatt

SEQ ID NO: 113273 - DNA, 20 bp, Artificial
  CRISPR gRNA sequence
tgctttatttttattcaagg

SEQ ID NO: 113274 - DNA, 20 bp, Artificial
  CRISPR gRNA sequence
tatttttattcaaggggcaa

SEQ ID NO: 113275 - DNA, 20 bp, Artificial
  CRISPR gRNA sequence
atttttattcaaggggcaac

SEQ ID NO: 113276 - DNA, 20 bp, Artificial
  CRISPR gRNA sequence
tttttattcaaggggcaact

SEQ ID NO: 113277 - DNA, 20 bp, Artificial
  CRISPR gRNA sequence
ttattcaaggggcaactcaa

SEQ ID NO: 113278 - DNA, 20 bp, Artificial
  CRISPR gRNA sequence
tattcaaggggcaactcaac

SEQ ID NO: 113279 - DNA, 20 bp, Artificial
  CRISPR gRNA sequence
attcaaggggcaactcaact

SEQ ID NO: 113280 - DNA, 20 bp, Artificial
  CRISPR gRNA sequence
ttcaaggggcaactcaactg

SEQ ID NO: 113281 - DNA, 20 bp, Artificial
  CRISPR gRNA sequence
aaggggcaactcaactgaaa

SEQ ID NO: 113282 - DNA, 20 bp, Artificial
  CRISPR gRNA sequence
aactgaaaaataatcattgc

SEQ ID NO: 113283 - DNA, 20 bp, Artificial
  CRISPR gRNA sequence
aaaaataatcattgcacttg

SEQ ID NO: 113284 - DNA, 20 bp, Artificial
  CRISPR gRNA sequence
cacttggcaaggtttatcta

SEQ ID NO: 113285 - DNA, 20 bp, Artificial
  CRISPR gRNA sequence
ggcaaggtttatctaagcac

SEQ ID NO: 113286 - DNA, 20 bp, Artificial
  CRISPR gRNA sequence
gcaaggtttatctaagcact

SEQ ID NO: 113287 - DNA, 20 bp, Artificial
  CRISPR gRNA sequence
atctaagcactgaatcttgt

SEQ ID NO: 113288 - DNA, 20 bp, Artificial
  CRISPR gRNA sequence
tctaagcactgaatcttgtt

SEQ ID NO: 113289 - DNA, 20 bp, Artificial
  CRISPR gRNA sequence
agcactgaatcttgttaatc

SEQ ID NO: 113290 - DNA, 20 bp, Artificial
  CRISPR gRNA sequence
aatcttgttaatctcttgtt

SEQ ID NO: 113291 - DNA, 20 bp, Artificial
  CRISPR gRNA sequence
gttaatctcttgttaactgc

SEQ ID NO: 113292 - DNA, 20 bp, Artificial
  CRISPR gRNA sequence
ttaatctcttgttaactgct

SEQ ID NO: 113293 - DNA, 20 bp, Artificial
  CRISPR gRNA sequence
atctcttgttaactgctatt

SEQ ID NO: 113294 - DNA, 20 bp, Artificial
  CRISPR gRNA sequence
ttgttaactgctattgtttc

SEQ ID NO: 113295 - DNA, 20 bp, Artificial
  CRISPR gRNA sequence
gttaactgctattgtttcca

SEQ ID NO: 113296 - DNA, 20 bp, Artificial
  CRISPR gRNA sequence
ttaactgctattgtttccac

SEQ ID NO: 113297 - DNA, 20 bp, Artificial
  CRISPR gRNA sequence
actgctattgtttccactac

SEQ ID NO: 113298 - DNA, 20 bp, Artificial
  CRISPR gRNA sequence
ctattgtttccactaccttt

SEQ ID NO: 113299 - DNA, 20 bp, Artificial
  CRISPR gRNA sequence
ttgtttccactacctttcct

SEQ ID NO: 113300 - DNA, 20 bp, Artificial
  CRISPR gRNA sequence
tttccactacctttcctggg

SEQ ID NO: 113301 - DNA, 20 bp, Artificial
  CRISPR gRNA sequence
ccactacctttcctggggga

SEQ ID NO: 113302 - DNA, 20 bp, Artificial
  CRISPR gRNA sequence
cactacctttcctgggggaa

SEQ ID NO: 113303 - DNA, 20 bp, Artificial
  CRISPR gRNA sequence
cctttcctgggggaatagtg

SEQ ID NO: 113304 - DNA, 20 bp, Artificial
  CRISPR gRNA sequence
tcctgggggaatagtgacct

SEQ ID NO: 113305 - DNA, 20 bp, Artificial
  CRISPR gRNA sequence
cctgggggaatagtgacctg

SEQ ID NO: 113306 - DNA, 20 bp, Artificial
  CRISPR gRNA sequence
ctgggggaatagtgacctgt

SEQ ID NO: 113307 - DNA, 20 bp, Artificial
  CRISPR gRNA sequence
ggggaatagtgacctgtctt

SEQ ID NO: 113308 - DNA, 20 bp, Artificial
  CRISPR gRNA sequence
tcttattactagatctgcaa

SEQ ID NO: 113309 - DNA, 20 bp, Artificial
  CRISPR gRNA sequence
attactagatctgcaaagat

SEQ ID NO: 113310 - DNA, 20 bp, Artificial
  CRISPR gRNA sequence
ttactagatctgcaaagatt

SEQ ID NO: 113311 - DNA, 20 bp, Artificial
  CRISPR gRNA sequence
ctagatctgcaaagattacc

SEQ ID NO: 113312 - DNA, 20 bp, Artificial
  CRISPR gRNA sequence
gatctgcaaagattacccca

SEQ ID NO: 113313 - DNA, 20 bp, Artificial
  CRISPR gRNA sequence
caaagattaccccagatacc

SEQ ID NO: 113314 - DNA, 20 bp, Artificial
  CRISPR gRNA sequence
ccccagatacctcttggtta

SEQ ID NO: 113315 - DNA, 20 bp, Artificial
  CRISPR gRNA sequence
ttggttaggcagaagcagga

SEQ ID NO: 113316 - DNA, 20 bp, Artificial
  CRISPR gRNA sequence
ggttaggcagaagcaggatg

SEQ ID NO: 113317 - DNA, 20 bp, Artificial
  CRISPR gRNA sequence
gttaggcagaagcaggatgt

SEQ ID NO: 113318 - DNA, 20 bp, Artificial
  CRISPR gRNA sequence
ggcagaagcaggatgtgctt

SEQ ID NO: 113319 - DNA, 20 bp, Artificial
  CRISPR gRNA sequence
tctgtaagtcttaggtgtta

SEQ ID NO: 113320 - DNA, 20 bp, Artificial
  CRISPR gRNA sequence
ctgtaagtcttaggtgttaa

SEQ ID NO: 113321 - DNA, 20 bp, Artificial
  CRISPR gRNA sequence
tgtaagtcttaggtgttaaa

SEQ ID NO: 113322 - DNA, 20 bp, Artificial
  CRISPR gRNA sequence
taagtcttaggtgttaaagc

SEQ ID NO: 113323 - DNA, 20 bp, Artificial
  CRISPR gRNA sequence
aggtgttaaagccactgtga

SEQ ID NO: 113324 - DNA, 20 bp, Artificial
  CRISPR gRNA sequence
ggtgttaaagccactgtgat

SEQ ID NO: 113325 - DNA, 20 bp, Artificial
  CRISPR gRNA sequence
aagccactgtgataattctt

SEQ ID NO: 113326 - DNA, 20 bp, Artificial
  CRISPR gRNA sequence
tgataattcttggttaatca

SEQ ID NO: 113327 - DNA, 20 bp, Artificial
  CRISPR gRNA sequence
ttggttaatcaatacagttc

SEQ ID NO: 113328 - DNA, 20 bp, Artificial
  CRISPR gRNA sequence
ggttaatcaatacagttctt

SEQ ID NO: 113329 - DNA, 20 bp, Artificial
  CRISPR gRNA sequence
gttaatcaatacagttcttt

SEQ ID NO: 113330 - DNA, 20 bp, Artificial
  CRISPR gRNA sequence
atcaatacagttctttagca

SEQ ID NO: 113331 - DNA, 20 bp, Artificial
  CRISPR gRNA sequence
tttagcatcgtgtatggcta

SEQ ID NO: 113332 - DNA, 20 bp, Artificial
  CRISPR gRNA sequence
tagcatcgtgtatggctaag

SEQ ID NO: 113333 - DNA, 20 bp, Artificial
  CRISPR gRNA sequence
agcatcgtgtatggctaagt

SEQ ID NO: 113334 - DNA, 20 bp, Artificial
  CRISPR gRNA sequence
gcatcgtgtatggctaagta

SEQ ID NO: 113335 - DNA, 20 bp, Artificial
  CRISPR gRNA sequence
agtatcctaaattgggttct

SEQ ID NO: 113336 - DNA, 20 bp, Artificial
  CRISPR gRNA sequence
aattgggttctaatttggcc

SEQ ID NO: 113337 - DNA, 20 bp, Artificial
  CRISPR gRNA sequence
ggttctaatttggccagttc

SEQ ID NO: 113338 - DNA, 20 bp, Artificial
  CRISPR gRNA sequence
taatttggccagttcctata

SEQ ID NO: 113339 - DNA, 20 bp, Artificial
  CRISPR gRNA sequence
atttggccagttcctataaa

SEQ ID NO: 113340 - DNA, 20 bp, Artificial
  CRISPR gRNA sequence
ggccagttcctataaaacac

SEQ ID NO: 113341 - DNA, 20 bp, Artificial
  CRISPR gRNA sequence
gccagttcctataaaacaca

SEQ ID NO: 113342 - DNA, 20 bp, Artificial
  CRISPR gRNA sequence
ctataaaacacaggagtagc

SEQ ID NO: 113343 - DNA, 20 bp, Artificial
  CRISPR gRNA sequence
taaaacacaggagtagcagc

SEQ ID NO: 113344 - DNA, 20 bp, Artificial
  CRISPR gRNA sequence
gtctactctgtgtatgtagg

SEQ ID NO: 113345 - DNA, 20 bp, Artificial
  CRISPR gRNA sequence
ctctgtgtatgtaggttact

SEQ ID NO: 113346 - DNA, 20 bp, Artificial
  CRISPR gRNA sequence
tgtgtatgtaggttactttt

SEQ ID NO: 113347 - DNA, 20 bp, Artificial
  CRISPR gRNA sequence
tgtatgtaggttacttttat

SEQ ID NO: 113348 - DNA, 20 bp, Artificial
  CRISPR gRNA sequence
cttttattaaaataactcta

SEQ ID NO: 113349 - DNA, 20 bp, Artificial
  CRISPR gRNA sequence
ttattaaaataactctattt

SEQ ID NO: 113350 - DNA, 20 bp, Artificial
  CRISPR gRNA sequence
tattaaaataactctatttt

SEQ ID NO: 113351 - DNA, 20 bp, Artificial
  CRISPR gRNA sequence
attaaaataactctattttt

SEQ ID NO: 113352 - DNA, 20 bp, Artificial
  CRISPR gRNA sequence
ttaaaataactctatttttg

SEQ ID NO: 113353 - DNA, 20 bp, Artificial
  CRISPR gRNA sequence
aaataactctatttttgaga

SEQ ID NO: 113354 - DNA, 20 bp, Artificial
  CRISPR gRNA sequence
tatttttgagaaattggcaa

SEQ ID NO: 113355 - DNA, 20 bp, Artificial
  CRISPR gRNA sequence
tttttgagaaattggcaaga

SEQ ID NO: 113356 - DNA, 20 bp, Artificial
  CRISPR gRNA sequence
ttgagaaattggcaagattt

SEQ ID NO: 113357 - DNA, 20 bp, Artificial
  CRISPR gRNA sequence
tgagaaattggcaagatttg

SEQ ID NO: 113358 - DNA, 20 bp, Artificial
  CRISPR gRNA sequence
gagaaattggcaagatttgg

SEQ ID NO: 113359 - DNA, 20 bp, Artificial
  CRISPR gRNA sequence
agaaattggcaagatttggg

SEQ ID NO: 113360 - DNA, 20 bp, Artificial
  CRISPR gRNA sequence
gcaagatttgggtaccctac

SEQ ID NO: 113361 - DNA, 20 bp, Artificial
  CRISPR gRNA sequence
gggtaccctactttttccct

SEQ ID NO: 113362 - DNA, 20 bp, Artificial
  CRISPR gRNA sequence
ggtaccctactttttccctc

SEQ ID NO: 113363 - DNA, 20 bp, Artificial
  CRISPR gRNA sequence
ctttttccctccattgaatt

SEQ ID NO: 113364 - DNA, 20 bp, Artificial
  CRISPR gRNA sequence
tttccctccattgaattaga

SEQ ID NO: 113365 - DNA, 20 bp, Artificial
  CRISPR gRNA sequence
ttccctccattgaattagaa

SEQ ID NO: 113366 - DNA, 20 bp, Artificial
  CRISPR gRNA sequence
tccctccattgaattagaaa

SEQ ID NO: 113367 - DNA, 20 bp, Artificial
  CRISPR gRNA sequence
ccctccattgaattagaaat

SEQ ID NO: 113368 - DNA, 20 bp, Artificial
  CRISPR gRNA sequence
cctccattgaattagaaatg

SEQ ID NO: 113369 - DNA, 20 bp, Artificial
  CRISPR gRNA sequence
cattgaattagaaatgattc

SEQ ID NO: 113370 - DNA, 20 bp, Artificial
  CRISPR gRNA sequence
aattagaaatgattcaaagt

SEQ ID NO: 113371 - DNA, 20 bp, Artificial
  CRISPR gRNA sequence
gaaatgattcaaagtagaat

SEQ ID NO: 113372 - DNA, 20 bp, Artificial
  CRISPR gRNA sequence
aaagtagaatctagaatgta

SEQ ID NO: 113373 - DNA, 20 bp, Artificial
  CRISPR gRNA sequence
gaatgtagaactggcatctc

SEQ ID NO: 113374 - DNA, 20 bp, Artificial
  CRISPR gRNA sequence
gcatctcactttattgctag

SEQ ID NO: 113375 - DNA, 20 bp, Artificial
  CRISPR gRNA sequence
actttattgctagtgctgct

SEQ ID NO: 113376 - DNA, 20 bp, Artificial
  CRISPR gRNA sequence
tattgctagtgctgctaagc

SEQ ID NO: 113377 - DNA, 20 bp, Artificial
  CRISPR gRNA sequence
attgctagtgctgctaagca

SEQ ID NO: 113378 - DNA, 20 bp, Artificial
  CRISPR gRNA sequence
ttgctagtgctgctaagcat

SEQ ID NO: 113379 - DNA, 20 bp, Artificial
  CRISPR gRNA sequence
ctagtgctgctaagcatcca

SEQ ID NO: 113380 - DNA, 20 bp, Artificial
  CRISPR gRNA sequence
gtgctgctaagcatccagca

SEQ ID NO: 113381 - DNA, 20 bp, Artificial
  CRISPR gRNA sequence
ctaagcatccagcagataac

SEQ ID NO: 113382 - DNA, 20 bp, Artificial
  CRISPR gRNA sequence
agcatccagcagataactac

SEQ ID NO: 113383 - DNA, 20 bp, Artificial
  CRISPR gRNA sequence
cctcttattgtcatcacttt

SEQ ID NO: 113384 - DNA, 20 bp, Artificial
  CRISPR gRNA sequence
ttattgtcatcactttatcc

SEQ ID NO: 113385 - DNA, 20 bp, Artificial
  CRISPR gRNA sequence
attgtcatcactttatcctt

SEQ ID NO: 113386 - DNA, 20 bp, Artificial
  CRISPR gRNA sequence
ttgtcatcactttatccttt

SEQ ID NO: 113387 - DNA, 20 bp, Artificial
  CRISPR gRNA sequence
tcatcactttatcctttcaa

SEQ ID NO: 113388 - DNA, 20 bp, Artificial
  CRISPR gRNA sequence
tatcctttcaatcccacccc

SEQ ID NO: 113389 - DNA, 20 bp, Artificial
  CRISPR gRNA sequence
atcctttcaatcccacccct

SEQ ID NO: 113390 - DNA, 20 bp, Artificial
  CRISPR gRNA sequence
tcctttcaatcccaccccta

SEQ ID NO: 113391 - DNA, 20 bp, Artificial
  CRISPR gRNA sequence
tcaatcccacccctacccct

SEQ ID NO: 113392 - DNA, 20 bp, Artificial
  CRISPR gRNA sequence
caatcccacccctacccctg

SEQ ID NO: 113393 - DNA, 20 bp, Artificial
  CRISPR gRNA sequence
aatcccacccctacccctgc

SEQ ID NO: 113394 - DNA, 20 bp, Artificial
  CRISPR gRNA sequence
cccctgccaccaatagtgtt

SEQ ID NO: 113395 - DNA, 20 bp, Artificial
  CRISPR gRNA sequence
ccaccaatagtgtttggtaa

SEQ ID NO: 113396 - DNA, 20 bp, Artificial
  CRISPR gRNA sequence
ggtaatgatgtacagccaac

SEQ ID NO: 113397 - DNA, 20 bp, Artificial
  CRISPR gRNA sequence
gtaatgatgtacagccaact

SEQ ID NO: 113398 - DNA, 20 bp, Artificial
  CRISPR gRNA sequence
tgaacataaattaagccgaa

SEQ ID NO: 113399 - DNA, 20 bp, Artificial
  CRISPR gRNA sequence
gaacataaattaagccgaaa

SEQ ID NO: 113400 - DNA, 20 bp, Artificial
  CRISPR gRNA sequence
aacataaattaagccgaaag

SEQ ID NO: 113401 - DNA, 20 bp, Artificial
  CRISPR gRNA sequence
agccgaaagaaactgagctt

SEQ ID NO: 113402 - DNA, 20 bp, Artificial
  CRISPR gRNA sequence
agcttgtaggcattccaaaa

SEQ ID NO: 113403 - DNA, 20 bp, Artificial
  CRISPR gRNA sequence
gtaggcattccaaaattgtg

SEQ ID NO: 113404 - DNA, 20 bp, Artificial
  CRISPR gRNA sequence
taggcattccaaaattgtgt

SEQ ID NO: 113405 - DNA, 20 bp, Artificial
  CRISPR gRNA sequence
caaaattgtgttcaaatctc

SEQ ID NO: 113406 - DNA, 20 bp, Artificial
  CRISPR gRNA sequence
tgttcaaatctcacagtcca

SEQ ID NO: 113407 - DNA, 20 bp, Artificial
  CRISPR gRNA sequence
aaatctcacagtccaacagc

SEQ ID NO: 113408 - DNA, 20 bp, Artificial
  CRISPR gRNA sequence
acagtccaacagcttgttaa

SEQ ID NO: 113409 - DNA, 20 bp, Artificial
  CRISPR gRNA sequence
gttaatgtttttcatgcttg

SEQ ID NO: 113410 - DNA, 20 bp, Artificial
  CRISPR gRNA sequence
ttaatgtttttcatgcttgc

SEQ ID NO: 113411 - DNA, 20 bp, Artificial
  CRISPR gRNA sequence
atgtttttcatgcttgcttc

SEQ ID NO: 113412 - DNA, 20 bp, Artificial
  CRISPR gRNA sequence
ttcatgcttgcttcatctta

SEQ ID NO: 113413 - DNA, 20 bp, Artificial
  CRISPR gRNA sequence
tcatgcttgcttcatcttac

SEQ ID NO: 113414 - DNA, 20 bp, Artificial
  CRISPR gRNA sequence
catgcttgcttcatcttact

SEQ ID NO: 113415 - DNA, 20 bp, Artificial
  CRISPR gRNA sequence
atgcttgcttcatcttactc

SEQ ID NO: 113416 - DNA, 20 bp, Artificial
  CRISPR gRNA sequence
gcttcatcttactcatatat

SEQ ID NO: 113417 - DNA, 20 bp, Artificial
  CRISPR gRNA sequence
cttcatcttactcatatata

SEQ ID NO: 113418 - DNA, 20 bp, Artificial
  CRISPR gRNA sequence
catcttactcatatataaaa

SEQ ID NO: 113419 - DNA, 20 bp, Artificial
  CRISPR gRNA sequence
atcttactcatatataaaac

SEQ ID NO: 113420 - DNA, 20 bp, Artificial
  CRISPR gRNA sequence
actcatatataaaacagtat

SEQ ID NO: 113421 - DNA, 20 bp, Artificial
  CRISPR gRNA sequence
ctcatatataaaacagtatt

SEQ ID NO: 113422 - DNA, 20 bp, Artificial
  CRISPR gRNA sequence
atatataaaacagtattttg

SEQ ID NO: 113423 - DNA, 20 bp, Artificial
  CRISPR gRNA sequence
tggattgtcattaacccctt

SEQ ID NO: 113424 - DNA, 20 bp, Artificial
  CRISPR gRNA sequence
ggattgtcattaaccccttg

SEQ ID NO: 113425 - DNA, 20 bp, Artificial
  CRISPR gRNA sequence
gattgtcattaaccccttgt

SEQ ID NO: 113426 - DNA, 20 bp, Artificial
  CRISPR gRNA sequence
tcattaaccccttgtggaat

SEQ ID NO: 113427 - DNA, 20 bp, Artificial
  CRISPR gRNA sequence
accccttgtggaataggaat

SEQ ID NO: 113428 - DNA, 20 bp, Artificial
  CRISPR gRNA sequence
gtggaataggaatgtaacat

SEQ ID NO: 113429 - DNA, 20 bp, Artificial
  CRISPR gRNA sequence
tggaataggaatgtaacatg

SEQ ID NO: 113430 - DNA, 20 bp, Artificial
  CRISPR gRNA sequence
ttaactgtatggcttcttgt

SEQ ID NO: 113431 - DNA, 20 bp, Artificial
  CRISPR gRNA sequence
aactgtatggcttcttgttt

SEQ ID NO: 113432 - DNA, 20 bp, Artificial
  CRISPR gRNA sequence
actgtatggcttcttgtttg

SEQ ID NO: 113433 - DNA, 20 bp, Artificial
  CRISPR gRNA sequence
tatggcttcttgtttgatgc

SEQ ID NO: 113434 - DNA, 20 bp, Artificial
  CRISPR gRNA sequence
cttgtttgatgcatgtgtct

SEQ ID NO: 113435 - DNA, 20 bp, Artificial
  CRISPR gRNA sequence
ttgtttgatgcatgtgtctt

SEQ ID NO: 113436 - DNA, 20 bp, Artificial
  CRISPR gRNA sequence
gtttgatgcatgtgtctttg

SEQ ID NO: 113437 - DNA, 20 bp, Artificial
  CRISPR gRNA sequence
tttgatgcatgtgtctttgt

SEQ ID NO: 113438 - DNA, 20 bp, Artificial
  CRISPR gRNA sequence
gatgcatgtgtctttgtaac

SEQ ID NO: 113439 - DNA, 20 bp, Artificial
  CRISPR gRNA sequence
atgcatgtgtctttgtaaca

SEQ ID NO: 113440 - DNA, 20 bp, Artificial
  CRISPR gRNA sequence
tgtaacatttttctgttgta

SEQ ID NO: 113441 - DNA, 20 bp, Artificial
  CRISPR gRNA sequence
gtaacatttttctgttgtaa

SEQ ID NO: 113442 - DNA, 20 bp, Artificial
  CRISPR gRNA sequence
taacatttttctgttgtaaa

SEQ ID NO: 113443 - DNA, 20 bp, Artificial
  CRISPR gRNA sequence
ttctgttgtaaatacagtga

SEQ ID NO: 113444 - DNA, 20 bp, Artificial
  CRISPR gRNA sequence
tctgttgtaaatacagtgag

SEQ ID NO: 113445 - DNA, 20 bp, Artificial
  CRISPR gRNA sequence
ctgttgtaaatacagtgagc

SEQ ID NO: 113446 - DNA, 20 bp, Artificial
  CRISPR gRNA sequence
tgttgtaaatacagtgagct

SEQ ID NO: 113447 - DNA, 20 bp, Artificial
  CRISPR gRNA sequence
ttgtaaatacagtgagctct

SEQ ID NO: 113448 - DNA, 20 bp, Artificial
  CRISPR gRNA sequence
taaatacagtgagctctttg

SEQ ID NO: 113449 - DNA, 20 bp, Artificial
  CRISPR gRNA sequence
tttggagtctcaaatcattt

SEQ ID NO: 113450 - DNA, 20 bp, Artificial
  CRISPR gRNA sequence
tggagtctcaaatcatttat

SEQ ID NO: 113451 - DNA, 20 bp, Artificial
  CRISPR gRNA sequence
ggagtctcaaatcatttatc

SEQ ID NO: 113452 - DNA, 20 bp, Artificial
  CRISPR gRNA sequence
gagtctcaaatcatttatca

SEQ ID NO: 113453 - DNA, 20 bp, Artificial
  CRISPR gRNA sequence
aaatcatttatcatgtgcac

SEQ ID NO: 113454 - DNA, 20 bp, Artificial
  CRISPR gRNA sequence
atcatgtgcacgaatagcac

SEQ ID NO: 113455 - DNA, 20 bp, Artificial
  CRISPR gRNA sequence
tcatgtgcacgaatagcaca

SEQ ID NO: 113456 - DNA, 20 bp, Artificial
  CRISPR gRNA sequence
gggaggaaattaagatgatg

SEQ ID NO: 113457 - DNA, 20 bp, Artificial
  CRISPR gRNA sequence
agatgatgaatagatagaaa

SEQ ID NO: 113458 - DNA, 20 bp, Artificial
  CRISPR gRNA sequence
ttaatagctgtatcttaaaa

SEQ ID NO: 113459 - DNA, 20 bp, Artificial
  CRISPR gRNA sequence
atagctgtatcttaaaactt

SEQ ID NO: 113460 - DNA, 20 bp, Artificial
  CRISPR gRNA sequence
tatcttaaaacttgtgtttc

SEQ ID NO: 113461 - DNA, 20 bp, Artificial
  CRISPR gRNA sequence
aaaacttgtgtttcctactt

SEQ ID NO: 113462 - DNA, 20 bp, Artificial
  CRISPR gRNA sequence
aaacttgtgtttcctactta

SEQ ID NO: 113463 - DNA, 20 bp, Artificial
  CRISPR gRNA sequence
gtgtttcctacttacataga

SEQ ID NO: 113464 - DNA, 20 bp, Artificial
  CRISPR gRNA sequence
tgtttcctacttacatagat

SEQ ID NO: 113465 - DNA, 20 bp, Artificial
  CRISPR gRNA sequence
cctacttacatagattttat

SEQ ID NO: 113466 - DNA, 20 bp, Artificial
  CRISPR gRNA sequence
ctacttacatagattttatt

SEQ ID NO: 113467 - DNA, 20 bp, Artificial
  CRISPR gRNA sequence
cttacatagattttatttaa

SEQ ID NO: 113468 - DNA, 20 bp, Artificial
  CRISPR gRNA sequence
acatagattttatttaaaag

SEQ ID NO: 113469 - DNA, 20 bp, Artificial
  CRISPR gRNA sequence
catagattttatttaaaaga

SEQ ID NO: 113470 - DNA, 20 bp, Artificial
  CRISPR gRNA sequence
tatttaaaagaagtggaaac

SEQ ID NO: 113471 - DNA, 20 bp, Artificial
  CRISPR gRNA sequence
atttaaaagaagtggaaaca

SEQ ID NO: 113472 - DNA, 20 bp, Artificial
  CRISPR gRNA sequence
tttaaaagaagtggaaacac

SEQ ID NO: 113473 - DNA, 20 bp, Artificial
  CRISPR gRNA sequence
aaaagaagtggaaacacttt

SEQ ID NO: 113474 - DNA, 20 bp, Artificial
  CRISPR gRNA sequence
aaagaagtggaaacacttta

SEQ ID NO: 113475 - DNA, 20 bp, Artificial
  CRISPR gRNA sequence
tatggaaataatagaaacct

SEQ ID NO: 113476 - DNA, 20 bp, Artificial
  CRISPR gRNA sequence
atggaaataatagaaacctt

SEQ ID NO: 113477 - DNA, 20 bp, Artificial
  CRISPR gRNA sequence
tggaaataatagaaaccttt

SEQ ID NO: 113478 - DNA, 20 bp, Artificial
  CRISPR gRNA sequence
tcctctagggatctgattat

SEQ ID NO: 113479 - DNA, 20 bp, Artificial
  CRISPR gRNA sequence
cctctagggatctgattatt

SEQ ID NO: 113480 - DNA, 20 bp, Artificial
  CRISPR gRNA sequence
ctctagggatctgattattt

SEQ ID NO: 113481 - DNA, 20 bp, Artificial
  CRISPR gRNA sequence
tagggatctgattattttgg

SEQ ID NO: 113482 - DNA, 20 bp, Artificial
  CRISPR gRNA sequence
gggatctgattattttggga

SEQ ID NO: 113483 - DNA, 20 bp, Artificial
  CRISPR gRNA sequence
attattttgggagaatttta

SEQ ID NO: 113484 - DNA, 20 bp, Artificial
  CRISPR gRNA sequence
ttttgggagaattttaaata

SEQ ID NO: 113485 - DNA, 20 bp, Artificial
  CRISPR gRNA sequence
tgggagaattttaaatagtt

SEQ ID NO: 113486 - DNA, 20 bp, Artificial
  CRISPR gRNA sequence
gggagaattttaaatagtta

SEQ ID NO: 113487 - DNA, 20 bp, Artificial
  CRISPR gRNA sequence
ggagaattttaaatagttat

SEQ ID NO: 113488 - DNA, 20 bp, Artificial
  CRISPR gRNA sequence
taaatagttattttggttat

SEQ ID NO: 113489 - DNA, 20 bp, Artificial
  CRISPR gRNA sequence
aaatagttattttggttatt

SEQ ID NO: 113490 - DNA, 20 bp, Artificial
  CRISPR gRNA sequence
aatagttattttggttattc

SEQ ID NO: 113491 - DNA, 20 bp, Artificial
  CRISPR gRNA sequence
ttttggttattcttgctata

SEQ ID NO: 113492 - DNA, 20 bp, Artificial
  CRISPR gRNA sequence
tggttattcttgctatatgt

SEQ ID NO: 113493 - DNA, 20 bp, Artificial
  CRISPR gRNA sequence
ggttattcttgctatatgta

SEQ ID NO: 113494 - DNA, 20 bp, Artificial
  CRISPR gRNA sequence
gttattcttgctatatgtat

SEQ ID NO: 113495 - DNA, 20 bp, Artificial
  CRISPR gRNA sequence
ttcttgctatatgtattctg

SEQ ID NO: 113496 - DNA, 20 bp, Artificial
  CRISPR gRNA sequence
ttgctatatgtattctgaga

SEQ ID NO: 113497 - DNA, 20 bp, Artificial
  CRISPR gRNA sequence
gctatatgtattctgagaaa

SEQ ID NO: 113498 - DNA, 20 bp, Artificial
  CRISPR gRNA sequence
ctatatgtattctgagaaat

SEQ ID NO: 113499 - DNA, 20 bp, Artificial
  CRISPR gRNA sequence
tatgtattctgagaaatctt

SEQ ID NO: 113500 - DNA, 20 bp, Artificial
  CRISPR gRNA sequence
tgagaaatctttcttgatac

SEQ ID NO: 113501 - DNA, 20 bp, Artificial
  CRISPR gRNA sequence
agaaatctttcttgatacag

SEQ ID NO: 113502 - DNA, 20 bp, Artificial
  CRISPR gRNA sequence
tcttgatacagaatatgcaa

SEQ ID NO: 113503 - DNA, 20 bp, Artificial
  CRISPR gRNA sequence
cttgatacagaatatgcaag

SEQ ID NO: 113504 - DNA, 20 bp, Artificial
  CRISPR gRNA sequence
ttgatacagaatatgcaagc

SEQ ID NO: 113505 - DNA, 20 bp, Artificial
  CRISPR gRNA sequence
gatacagaatatgcaagcat

SEQ ID NO: 113506 - DNA, 20 bp, Artificial
  CRISPR gRNA sequence
atacagaatatgcaagcatt

SEQ ID NO: 113507 - DNA, 20 bp, Artificial
  CRISPR gRNA sequence
ggtgtagcaaaggggatttg

SEQ ID NO: 113508 - DNA, 20 bp, Artificial
  CRISPR gRNA sequence
gtgtagcaaaggggatttga

SEQ ID NO: 113509 - DNA, 20 bp, Artificial
  CRISPR gRNA sequence
gatttggaatggggaaataa

SEQ ID NO: 113510 - DNA, 20 bp, Artificial
  CRISPR gRNA sequence
atttggaatggggaaataag

SEQ ID NO: 113511 - DNA, 20 bp, Artificial
  CRISPR gRNA sequence
ggaatggggaaataagggaa

SEQ ID NO: 113512 - DNA, 20 bp, Artificial
  CRISPR gRNA sequence
gaatggggaaataagggaaa

SEQ ID NO: 113513 - DNA, 20 bp, Artificial
  CRISPR gRNA sequence
taaagtccttaaaaaagtaa

SEQ ID NO: 113514 - DNA, 20 bp, Artificial
  CRISPR gRNA sequence
aaaaaagtaaagtaaaggtt

SEQ ID NO: 113515 - DNA, 20 bp, Artificial
  CRISPR gRNA sequence
aaaaagtaaagtaaaggttc

SEQ ID NO: 113516 - DNA, 20 bp, Artificial
  CRISPR gRNA sequence
tcaatggacagtttaacaaa

SEQ ID NO: 113517 - DNA, 20 bp, Artificial
  CRISPR gRNA sequence
aatggacagtttaacaaaac

SEQ ID NO: 113518 - DNA, 20 bp, Artificial
  CRISPR gRNA sequence
aacaaaacttaggatttcaa

SEQ ID NO: 113519 - DNA, 20 bp, Artificial
  CRISPR gRNA sequence
acaaaacttaggatttcaat

SEQ ID NO: 113520 - DNA, 20 bp, Artificial
  CRISPR gRNA sequence
aggatttcaatgttcctggt

SEQ ID NO: 113521 - DNA, 20 bp, Artificial
  CRISPR gRNA sequence
ggatttcaatgttcctggtg

SEQ ID NO: 113522 - DNA, 20 bp, Artificial
  CRISPR gRNA sequence
caatgttcctggtgattcta

SEQ ID NO: 113523 - DNA, 20 bp, Artificial
  CRISPR gRNA sequence
aatgttcctggtgattctaa

SEQ ID NO: 113524 - DNA, 20 bp, Artificial
  CRISPR gRNA sequence
ctggtgattctaatacatta

SEQ ID NO: 113525 - DNA, 20 bp, Artificial
  CRISPR gRNA sequence
gtgattctaatacattagtg

SEQ ID NO: 113526 - DNA, 20 bp, Artificial
  CRISPR gRNA sequence
taatacattagtggtggtgg

SEQ ID NO: 113527 - DNA, 20 bp, Artificial
  CRISPR gRNA sequence
atacattagtggtggtggca

SEQ ID NO: 113528 - DNA, 20 bp, Artificial
  CRISPR gRNA sequence
gtggtggtggcagtggcggc

SEQ ID NO: 113529 - DNA, 20 bp, Artificial
  CRISPR gRNA sequence
taggaggaccttactatcta

SEQ ID NO: 113530 - DNA, 20 bp, Artificial
  CRISPR gRNA sequence
actatctaacctactcatct

SEQ ID NO: 113531 - DNA, 20 bp, Artificial
  CRISPR gRNA sequence
ctatctaacctactcatcta

SEQ ID NO: 113532 - DNA, 20 bp, Artificial
  CRISPR gRNA sequence
tctaacctactcatctagga

SEQ ID NO: 113533 - DNA, 20 bp, Artificial
  CRISPR gRNA sequence
acctactcatctaggacaga

SEQ ID NO: 113534 - DNA, 20 bp, Artificial
  CRISPR gRNA sequence
ctcatctaggacagaatgat

SEQ ID NO: 113535 - DNA, 20 bp, Artificial
  CRISPR gRNA sequence
atctaggacagaatgatctg

SEQ ID NO: 113536 - DNA, 20 bp, Artificial
  CRISPR gRNA sequence
ggacagaatgatctgttaac

SEQ ID NO: 113537 - DNA, 20 bp, Artificial
  CRISPR gRNA sequence
ttaactaattgctgttactt

SEQ ID NO: 113538 - DNA, 20 bp, Artificial
  CRISPR gRNA sequence
actaattgctgttacttgca

SEQ ID NO: 113539 - DNA, 20 bp, Artificial
  CRISPR gRNA sequence
attgctgttacttgcacata

SEQ ID NO: 113540 - DNA, 20 bp, Artificial
  CRISPR gRNA sequence
ctgttacttgcacatacttt

SEQ ID NO: 113541 - DNA, 20 bp, Artificial
  CRISPR gRNA sequence
ttacttgcacatactttcat

SEQ ID NO: 113542 - DNA, 20 bp, Artificial
  CRISPR gRNA sequence
cttgcacatactttcattaa

SEQ ID NO: 113543 - DNA, 20 bp, Artificial
  CRISPR gRNA sequence
gcacatactttcattaagtg

SEQ ID NO: 113544 - DNA, 20 bp, Artificial
  CRISPR gRNA sequence
cacatactttcattaagtgt

SEQ ID NO: 113545 - DNA, 20 bp, Artificial
  CRISPR gRNA sequence
tcattaagtgtgaatatttc

SEQ ID NO: 113546 - DNA, 20 bp, Artificial
  CRISPR gRNA sequence
cattaagtgtgaatatttca

SEQ ID NO: 113547 - DNA, 20 bp, Artificial
  CRISPR gRNA sequence
attaagtgtgaatatttcag

SEQ ID NO: 113548 - DNA, 20 bp, Artificial
  CRISPR gRNA sequence
agtgtgaatatttcagtcat

SEQ ID NO: 113549 - DNA, 20 bp, Artificial
  CRISPR gRNA sequence
cagtcatgaatattctgttc

SEQ ID NO: 113550 - DNA, 20 bp, Artificial
  CRISPR gRNA sequence
agtcatgaatattctgttct

SEQ ID NO: 113551 - DNA, 20 bp, Artificial
  CRISPR gRNA sequence
tgttctaagtaatttctgtc

SEQ ID NO: 113552 - DNA, 20 bp, Artificial
  CRISPR gRNA sequence
ttctaagtaatttctgtcaa

SEQ ID NO: 113553 - DNA, 20 bp, Artificial
  CRISPR gRNA sequence
taagtaatttctgtcaaaga

SEQ ID NO: 113554 - DNA, 20 bp, Artificial
  CRISPR gRNA sequence
agtaatttctgtcaaagata

SEQ ID NO: 113555 - DNA, 20 bp, Artificial
  CRISPR gRNA sequence
ctgtcaaagatagagtctga

SEQ ID NO: 113556 - DNA, 20 bp, Artificial
  CRISPR gRNA sequence
tgtcaaagatagagtctgaa

SEQ ID NO: 113557 - DNA, 20 bp, Artificial
  CRISPR gRNA sequence
tcaaagatagagtctgaaaa

SEQ ID NO: 113558 - DNA, 20 bp, Artificial
  CRISPR gRNA sequence
aaaatgaaaattttggacta

SEQ ID NO: 113559 - DNA, 20 bp, Artificial
  CRISPR gRNA sequence
tggactattccatggatcat

SEQ ID NO: 113560 - DNA, 20 bp, Artificial
  CRISPR gRNA sequence
ggactattccatggatcatt

SEQ ID NO: 113561 - DNA, 20 bp, Artificial
  CRISPR gRNA sequence
gactattccatggatcatta

SEQ ID NO: 113562 - DNA, 20 bp, Artificial
  CRISPR gRNA sequence
ttccatggatcattacagtt

SEQ ID NO: 113563 - DNA, 20 bp, Artificial
  CRISPR gRNA sequence
catggatcattacagtttac

SEQ ID NO: 113564 - DNA, 20 bp, Artificial
  CRISPR gRNA sequence
cagtttacttctaaagcact

SEQ ID NO: 113565 - DNA, 20 bp, Artificial
  CRISPR gRNA sequence
acttctaaagcacttttaaa

SEQ ID NO: 113566 - DNA, 20 bp, Artificial
  CRISPR gRNA sequence
cttctaaagcacttttaaag

SEQ ID NO: 113567 - DNA, 20 bp, Artificial
  CRISPR gRNA sequence
ctaaagcacttttaaagtgc

SEQ ID NO: 113568 - DNA, 20 bp, Artificial
  CRISPR gRNA sequence
taaagcacttttaaagtgct

SEQ ID NO: 113569 - DNA, 20 bp, Artificial
  CRISPR gRNA sequence
aagcacttttaaagtgcttc

SEQ ID NO: 113570 - DNA, 20 bp, Artificial
  CRISPR gRNA sequence
ttaaagtgcttccagaaagc

SEQ ID NO: 113571 - DNA, 20 bp, Artificial
  CRISPR gRNA sequence
taaagtgcttccagaaagca

SEQ ID NO: 113572 - DNA, 20 bp, Artificial
  CRISPR gRNA sequence
aaagtgcttccagaaagcat

SEQ ID NO: 113573 - DNA, 20 bp, Artificial
  CRISPR gRNA sequence
aagtgcttccagaaagcatt

SEQ ID NO: 113574 - DNA, 20 bp, Artificial
  CRISPR gRNA sequence
ccagaaagcattctattagg

SEQ ID NO: 113575 - DNA, 20 bp, Artificial
  CRISPR gRNA sequence
cagaaagcattctattaggt

SEQ ID NO: 113576 - DNA, 20 bp, Artificial
  CRISPR gRNA sequence
tattaggtatttttgtattg

SEQ ID NO: 113577 - DNA, 20 bp, Artificial
  CRISPR gRNA sequence
ttaggtatttttgtattggg

SEQ ID NO: 113578 - DNA, 20 bp, Artificial
  CRISPR gRNA sequence
ggtatttttgtattgggact

SEQ ID NO: 113579 - DNA, 20 bp, Artificial
  CRISPR gRNA sequence
ttgtattgggacttaagatg

SEQ ID NO: 113580 - DNA, 20 bp, Artificial
  CRISPR gRNA sequence
tgtattgggacttaagatgt

SEQ ID NO: 113581 - DNA, 20 bp, Artificial
  CRISPR gRNA sequence
gtattgggacttaagatgtg

SEQ ID NO: 113582 - DNA, 20 bp, Artificial
  CRISPR gRNA sequence
tattgggacttaagatgtga

SEQ ID NO: 113583 - DNA, 20 bp, Artificial
  CRISPR gRNA sequence
ggacttaagatgtgacagag

SEQ ID NO: 113584 - DNA, 20 bp, Artificial
  CRISPR gRNA sequence
aagatgtgacagagcacttg

SEQ ID NO: 113585 - DNA, 20 bp, Artificial
  CRISPR gRNA sequence
agatgtgacagagcacttgt

SEQ ID NO: 113586 - DNA, 20 bp, Artificial
  CRISPR gRNA sequence
gtagtgacctggctcctaca

SEQ ID NO: 113587 - DNA, 20 bp, Artificial
  CRISPR gRNA sequence
tagtgacctggctcctacag

SEQ ID NO: 113588 - DNA, 20 bp, Artificial
  CRISPR gRNA sequence
gctcctacagtagtctgttt

SEQ ID NO: 113589 - DNA, 20 bp, Artificial
  CRISPR gRNA sequence
ctacagtagtctgtttactc

SEQ ID NO: 113590 - DNA, 20 bp, Artificial
  CRISPR gRNA sequence
cagtagtctgtttactcata

SEQ ID NO: 113591 - DNA, 20 bp, Artificial
  CRISPR gRNA sequence
tttactcataggagcttgaa

SEQ ID NO: 113592 - DNA, 20 bp, Artificial
  CRISPR gRNA sequence
actcataggagcttgaaatt

SEQ ID NO: 113593 - DNA, 20 bp, Artificial
  CRISPR gRNA sequence
ctcataggagcttgaaattt

SEQ ID NO: 113594 - DNA, 20 bp, Artificial
  CRISPR gRNA sequence
ataggagcttgaaatttgta

SEQ ID NO: 113595 - DNA, 20 bp, Artificial
  CRISPR gRNA sequence
gaaatttgtacacttgactg

SEQ ID NO: 113596 - DNA, 20 bp, Artificial
  CRISPR gRNA sequence
aaatttgtacacttgactgc

SEQ ID NO: 113597 - DNA, 20 bp, Artificial
  CRISPR gRNA sequence
gtacacttgactgctctgtg

SEQ ID NO: 113598 - DNA, 20 bp, Artificial
  CRISPR gRNA sequence
tacacttgactgctctgtgt

SEQ ID NO: 113599 - DNA, 20 bp, Artificial
  CRISPR gRNA sequence
gactgctctgtgtaatttca

SEQ ID NO: 113600 - DNA, 20 bp, Artificial
  CRISPR gRNA sequence
actgctctgtgtaatttcaa

SEQ ID NO: 113601 - DNA, 20 bp, Artificial
  CRISPR gRNA sequence
ctctgtgtaatttcaatatt

SEQ ID NO: 113602 - DNA, 20 bp, Artificial
  CRISPR gRNA sequence
tgtgtaatttcaatatttgt

SEQ ID NO: 113603 - DNA, 20 bp, Artificial
  CRISPR gRNA sequence
tgtaatttcaatatttgttg

SEQ ID NO: 113604 - DNA, 20 bp, Artificial
  CRISPR gRNA sequence
caatatttgttgttgcttct

SEQ ID NO: 113605 - DNA, 20 bp, Artificial
  CRISPR gRNA sequence
aatatttgttgttgcttctg

SEQ ID NO: 113606 - DNA, 20 bp, Artificial
  CRISPR gRNA sequence
gttgttgcttctgataaagc

SEQ ID NO: 113607 - DNA, 20 bp, Artificial
  CRISPR gRNA sequence
ttgttgcttctgataaagct

SEQ ID NO: 113608 - DNA, 20 bp, Artificial
  CRISPR gRNA sequence
ttgcttctgataaagctaaa

SEQ ID NO: 113609 - DNA, 20 bp, Artificial
  CRISPR gRNA sequence
cttctgataaagctaaaata

SEQ ID NO: 113610 - DNA, 20 bp, Artificial
  CRISPR gRNA sequence
ctgataaagctaaaataacc

SEQ ID NO: 113611 - DNA, 20 bp, Artificial
  CRISPR gRNA sequence
tgataaagctaaaataacca

SEQ ID NO: 113612 - DNA, 20 bp, Artificial
  CRISPR gRNA sequence
ataaagctaaaataaccatg

SEQ ID NO: 113613 - DNA, 20 bp, Artificial
  CRISPR gRNA sequence
aaataaccatgtggatatta

SEQ ID NO: 113614 - DNA, 20 bp, Artificial
  CRISPR gRNA sequence
tagaggccagtgaggaattc

SEQ ID NO: 113615 - DNA, 20 bp, Artificial
  CRISPR gRNA sequence
caccatggagactgcaaact

SEQ ID NO: 113616 - DNA, 20 bp, Artificial
  CRISPR gRNA sequence
caaactgaccagaaagtgct

SEQ ID NO: 113617 - DNA, 20 bp, Artificial
  CRISPR gRNA sequence
accagaaagtgcttttaaga

SEQ ID NO: 113618 - DNA, 20 bp, Artificial
  CRISPR gRNA sequence
ttaagaaatctttagtagtg

SEQ ID NO: 113619 - DNA, 20 bp, Artificial
  CRISPR gRNA sequence
taagaaatctttagtagtga

SEQ ID NO: 113620 - DNA, 20 bp, Artificial
  CRISPR gRNA sequence
aagaaatctttagtagtgag

SEQ ID NO: 113621 - DNA, 20 bp, Artificial
  CRISPR gRNA sequence
agaaatctttagtagtgagt

SEQ ID NO: 113622 - DNA, 20 bp, Artificial
  CRISPR gRNA sequence
tagtagtgagtttaaacaac

SEQ ID NO: 113623 - DNA, 20 bp, Artificial
  CRISPR gRNA sequence
agtagtgagtttaaacaaca

SEQ ID NO: 113624 - DNA, 20 bp, Artificial
  CRISPR gRNA sequence
gtagtgagtttaaacaacaa

SEQ ID NO: 113625 - DNA, 20 bp, Artificial
  CRISPR gRNA sequence
aaacaacaaacatatctaga

SEQ ID NO: 113626 - DNA, 20 bp, Artificial
  CRISPR gRNA sequence
aacaacaaacatatctagaa

SEQ ID NO: 113627 - DNA, 20 bp, Artificial
  CRISPR gRNA sequence
gaattcacagagtaaaatga

SEQ ID NO: 113628 - DNA, 20 bp, Artificial
  CRISPR gRNA sequence
acagagtaaaatgagcagga

SEQ ID NO: 113629 - DNA, 20 bp, Artificial
  CRISPR gRNA sequence
gacatttcattttagcttga

SEQ ID NO: 113630 - DNA, 20 bp, Artificial
  CRISPR gRNA sequence
acatttcattttagcttgag

SEQ ID NO: 113631 - DNA, 20 bp, Artificial
  CRISPR gRNA sequence
cattttagcttgagagactg

SEQ ID NO: 113632 - DNA, 20 bp, Artificial
  CRISPR gRNA sequence
attttagcttgagagactgt

SEQ ID NO: 113633 - DNA, 20 bp, Artificial
  CRISPR gRNA sequence
tagcttgagagactgtaggg

SEQ ID NO: 113634 - DNA, 20 bp, Artificial
  CRISPR gRNA sequence
agcttgagagactgtaggga

SEQ ID NO: 113635 - DNA, 20 bp, Artificial
  CRISPR gRNA sequence
gcttgagagactgtagggaa

SEQ ID NO: 113636 - DNA, 20 bp, Artificial
  CRISPR gRNA sequence
gagagactgtagggaaaaaa

SEQ ID NO: 113637 - DNA, 20 bp, Artificial
  CRISPR gRNA sequence
agagactgtagggaaaaaag

SEQ ID NO: 113638 - DNA, 20 bp, Artificial
  CRISPR gRNA sequence
tagggaaaaaagggtcatcc

SEQ ID NO: 113639 - DNA, 20 bp, Artificial
  CRISPR gRNA sequence
tacataagcttccagagctg

SEQ ID NO: 113640 - DNA, 20 bp, Artificial
  CRISPR gRNA sequence
cataagcttccagagctgct

SEQ ID NO: 113641 - DNA, 20 bp, Artificial
  CRISPR gRNA sequence
ccagagctgcttgctaccca

SEQ ID NO: 113642 - DNA, 20 bp, Artificial
  CRISPR gRNA sequence
cagagctgcttgctacccag

SEQ ID NO: 113643 - DNA, 20 bp, Artificial
  CRISPR gRNA sequence
cttgctacccagcctcctag

SEQ ID NO: 113644 - DNA, 20 bp, Artificial
  CRISPR gRNA sequence
gctacccagcctcctagagt

SEQ ID NO: 113645 - DNA, 20 bp, Artificial
  CRISPR gRNA sequence
ctacccagcctcctagagtc

SEQ ID NO: 113646 - DNA, 20 bp, Artificial
  CRISPR gRNA sequence
cccagcctcctagagtcatt

SEQ ID NO: 113647 - DNA, 20 bp, Artificial
  CRISPR gRNA sequence
ctagagtcattgctgggtac

SEQ ID NO: 113648 - DNA, 20 bp, Artificial
  CRISPR gRNA sequence
gagtcattgctgggtacagt

SEQ ID NO: 113649 - DNA, 20 bp, Artificial
  CRISPR gRNA sequence
ctgggtacagtttgatttac

SEQ ID NO: 113650 - DNA, 20 bp, Artificial
  CRISPR gRNA sequence
ggtacagtttgatttacctt

SEQ ID NO: 113651 - DNA, 20 bp, Artificial
  CRISPR gRNA sequence
gatttaccttcttcacttta

SEQ ID NO: 113652 - DNA, 20 bp, Artificial
  CRISPR gRNA sequence
atttaccttcttcactttat

SEQ ID NO: 113653 - DNA, 20 bp, Artificial
  CRISPR gRNA sequence
accttcttcactttatttag

SEQ ID NO: 113654 - DNA, 20 bp, Artificial
  CRISPR gRNA sequence
ccttcttcactttatttaga

SEQ ID NO: 113655 - DNA, 20 bp, Artificial
  CRISPR gRNA sequence
cttcactttatttagaattt

SEQ ID NO: 113656 - DNA, 20 bp, Artificial
  CRISPR gRNA sequence
ttcactttatttagaatttg

SEQ ID NO: 113657 - DNA, 20 bp, Artificial
  CRISPR gRNA sequence
cactttatttagaatttgta

SEQ ID NO: 113658 - DNA, 20 bp, Artificial
  CRISPR gRNA sequence
actttatttagaatttgtac

SEQ ID NO: 113659 - DNA, 20 bp, Artificial
  CRISPR gRNA sequence
tatttagaatttgtactcaa

SEQ ID NO: 113660 - DNA, 20 bp, Artificial
  CRISPR gRNA sequence
atttagaatttgtactcaac

SEQ ID NO: 113661 - DNA, 20 bp, Artificial
  CRISPR gRNA sequence
tttagaatttgtactcaacc

SEQ ID NO: 113662 - DNA, 20 bp, Artificial
  CRISPR gRNA sequence
agaatttgtactcaaccacc

SEQ ID NO: 113663 - DNA, 20 bp, Artificial
  CRISPR gRNA sequence
gaatttgtactcaaccacca

SEQ ID NO: 113664 - DNA, 20 bp, Artificial
  CRISPR gRNA sequence
gtactcaaccaccatcacca

SEQ ID NO: 113665 - DNA, 20 bp, Artificial
  CRISPR gRNA sequence
tactcaaccaccatcaccac

SEQ ID NO: 113666 - DNA, 20 bp, Artificial
  CRISPR gRNA sequence
aaccaccatcaccaccatca

SEQ ID NO: 113667 - DNA, 20 bp, Artificial
  CRISPR gRNA sequence
tccctctcattgccttctct

SEQ ID NO: 113668 - DNA, 20 bp, Artificial
  CRISPR gRNA sequence
ccctctcattgccttctctc

SEQ ID NO: 113669 - DNA, 20 bp, Artificial
  CRISPR gRNA sequence
cctctcattgccttctctcc

SEQ ID NO: 113670 - DNA, 20 bp, Artificial
  CRISPR gRNA sequence
tcattgccttctctccagcc

SEQ ID NO: 113671 - DNA, 20 bp, Artificial
  CRISPR gRNA sequence
attgccttctctccagcctt

SEQ ID NO: 113672 - DNA, 20 bp, Artificial
  CRISPR gRNA sequence
ccttctctccagccttcact

SEQ ID NO: 113673 - DNA, 20 bp, Artificial
  CRISPR gRNA sequence
ctctccagccttcactacag

SEQ ID NO: 113674 - DNA, 20 bp, Artificial
  CRISPR gRNA sequence
tctccagccttcactacaga

SEQ ID NO: 113675 - DNA, 20 bp, Artificial
  CRISPR gRNA sequence
tccagccttcactacagacc

SEQ ID NO: 113676 - DNA, 20 bp, Artificial
  CRISPR gRNA sequence
cagccttcactacagaccat

SEQ ID NO: 113677 - DNA, 20 bp, Artificial
  CRISPR gRNA sequence
cactacagaccattcctgga

SEQ ID NO: 113678 - DNA, 20 bp, Artificial
  CRISPR gRNA sequence
actacagaccattcctggat

SEQ ID NO: 113679 - DNA, 20 bp, Artificial
  CRISPR gRNA sequence
cagaccattcctggattggt

SEQ ID NO: 113680 - DNA, 20 bp, Artificial
  CRISPR gRNA sequence
ctggattggtttaaacaggc

SEQ ID NO: 113681 - DNA, 20 bp, Artificial
  CRISPR gRNA sequence
gattggtttaaacaggcaac

SEQ ID NO: 113682 - DNA, 20 bp, Artificial
  CRISPR gRNA sequence
gtttaaacaggcaactaacc

SEQ ID NO: 113683 - DNA, 20 bp, Artificial
  CRISPR gRNA sequence
aaacaggcaactaaccttgc

SEQ ID NO: 113684 - DNA, 20 bp, Artificial
  CRISPR gRNA sequence
aacaggcaactaaccttgcc

SEQ ID NO: 113685 - DNA, 20 bp, Artificial
  CRISPR gRNA sequence
accttgccattatgattaaa

SEQ ID NO: 113686 - DNA, 20 bp, Artificial
  CRISPR gRNA sequence
gccattatgattaaatgttt

SEQ ID NO: 113687 - DNA, 20 bp, Artificial
  CRISPR gRNA sequence
ccattatgattaaatgtttg

SEQ ID NO: 113688 - DNA, 20 bp, Artificial
  CRISPR gRNA sequence
tgattaaatgtttgtcatgg

SEQ ID NO: 113689 - DNA, 20 bp, Artificial
  CRISPR gRNA sequence
aatgtttgtcatggatttag

SEQ ID NO: 113690 - DNA, 20 bp, Artificial
  CRISPR gRNA sequence
gtcatggatttagcccgtgt

SEQ ID NO: 113691 - DNA, 20 bp, Artificial
  CRISPR gRNA sequence
tcatggatttagcccgtgtt

SEQ ID NO: 113692 - DNA, 20 bp, Artificial
  CRISPR gRNA sequence
agcccgtgtttggtgacaaa

SEQ ID NO: 113693 - DNA, 20 bp, Artificial
  CRISPR gRNA sequence
gcccgtgtttggtgacaaat

SEQ ID NO: 113694 - DNA, 20 bp, Artificial
  CRISPR gRNA sequence
ggtgacaaatgccttatatc

SEQ ID NO: 113695 - DNA, 20 bp, Artificial
  CRISPR gRNA sequence
gtgacaaatgccttatatct

SEQ ID NO: 113696 - DNA, 20 bp, Artificial
  CRISPR gRNA sequence
atatctattgagacttctca

SEQ ID NO: 113697 - DNA, 20 bp, Artificial
  CRISPR gRNA sequence
tatctattgagacttctcaa

SEQ ID NO: 113698 - DNA, 20 bp, Artificial
  CRISPR gRNA sequence
ttgagacttctcaaagactc

SEQ ID NO: 113699 - DNA, 20 bp, Artificial
  CRISPR gRNA sequence
agacttctcaaagactctgg

SEQ ID NO: 113700 - DNA, 20 bp, Artificial
  CRISPR gRNA sequence
ctcaaagactctggatattc

SEQ ID NO: 113701 - DNA, 20 bp, Artificial
  CRISPR gRNA sequence
tcaaagactctggatattct

SEQ ID NO: 113702 - DNA, 20 bp, Artificial
  CRISPR gRNA sequence
aaagactctggatattctcc

SEQ ID NO: 113703 - DNA, 20 bp, Artificial
  CRISPR gRNA sequence
tggatattctccattatgtc

SEQ ID NO: 113704 - DNA, 20 bp, Artificial
  CRISPR gRNA sequence
gatattctccattatgtctg

SEQ ID NO: 113705 - DNA, 20 bp, Artificial
  CRISPR gRNA sequence
tccattatgtctgaccttaa

SEQ ID NO: 113706 - DNA, 20 bp, Artificial
  CRISPR gRNA sequence
cattatgtctgaccttaaag

SEQ ID NO: 113707 - DNA, 20 bp, Artificial
  CRISPR gRNA sequence
tgtctgaccttaaagtattg

SEQ ID NO: 113708 - DNA, 20 bp, Artificial
  CRISPR gRNA sequence
accttaaagtattgagcttg

SEQ ID NO: 113709 - DNA, 20 bp, Artificial
  CRISPR gRNA sequence
aaagtattgagcttggcatt

SEQ ID NO: 113710 - DNA, 20 bp, Artificial
  CRISPR gRNA sequence
aagtattgagcttggcattt

SEQ ID NO: 113711 - DNA, 20 bp, Artificial
  CRISPR gRNA sequence
agcttggcatttagtaacag

SEQ ID NO: 113712 - DNA, 20 bp, Artificial
  CRISPR gRNA sequence
ggcatttagtaacaggattc

SEQ ID NO: 113713 - DNA, 20 bp, Artificial
  CRISPR gRNA sequence
gcatttagtaacaggattca

SEQ ID NO: 113714 - DNA, 20 bp, Artificial
  CRISPR gRNA sequence
agtaacaggattcatagata

SEQ ID NO: 113715 - DNA, 20 bp, Artificial
  CRISPR gRNA sequence
gtaacaggattcatagatat

SEQ ID NO: 113716 - DNA, 20 bp, Artificial
  CRISPR gRNA sequence
atagatatttaaagataact

SEQ ID NO: 113717 - DNA, 20 bp, Artificial
  CRISPR gRNA sequence
aaagataacttgaggacttg

SEQ ID NO: 113718 - DNA, 20 bp, Artificial
  CRISPR gRNA sequence
aagataacttgaggacttga

SEQ ID NO: 113719 - DNA, 20 bp, Artificial
  CRISPR gRNA sequence
gaggacttgagacatatatt

SEQ ID NO: 113720 - DNA, 20 bp, Artificial
  CRISPR gRNA sequence
aggacttgagacatatattt

SEQ ID NO: 113721 - DNA, 20 bp, Artificial
  CRISPR gRNA sequence
gagacatatattttcttagt

SEQ ID NO: 113722 - DNA, 20 bp, Artificial
  CRISPR gRNA sequence
agacatatattttcttagtc

SEQ ID NO: 113723 - DNA, 20 bp, Artificial
  CRISPR gRNA sequence
tcttagtcttttctaccttt

SEQ ID NO: 113724 - DNA, 20 bp, Artificial
  CRISPR gRNA sequence
cttagtcttttctacctttt

SEQ ID NO: 113725 - DNA, 20 bp, Artificial
  CRISPR gRNA sequence
ttagtcttttctaccttttc

SEQ ID NO: 113726 - DNA, 20 bp, Artificial
  CRISPR gRNA sequence
agtcttttctaccttttcct

SEQ ID NO: 113727 - DNA, 20 bp, Artificial
  CRISPR gRNA sequence
gtcttttctaccttttcctt

SEQ ID NO: 113728 - DNA, 20 bp, Artificial
  CRISPR gRNA sequence
ttctaccttttccttttcta

SEQ ID NO: 113729 - DNA, 20 bp, Artificial
  CRISPR gRNA sequence
tctaccttttccttttctag

SEQ ID NO: 113730 - DNA, 20 bp, Artificial
  CRISPR gRNA sequence
ctaccttttccttttctagc

SEQ ID NO: 113731 - DNA, 20 bp, Artificial
  CRISPR gRNA sequence
taccttttccttttctagca

SEQ ID NO: 113732 - DNA, 20 bp, Artificial
  CRISPR gRNA sequence
ccttttccttttctagcaag

SEQ ID NO: 113733 - DNA, 20 bp, Artificial
  CRISPR gRNA sequence
ttccttttctagcaaggcag

SEQ ID NO: 113734 - DNA, 20 bp, Artificial
  CRISPR gRNA sequence
tccttttctagcaaggcagc

SEQ ID NO: 113735 - DNA, 20 bp, Artificial
  CRISPR gRNA sequence
ccttttctagcaaggcagca

SEQ ID NO: 113736 - DNA, 20 bp, Artificial
  CRISPR gRNA sequence
cttttctagcaaggcagcag

SEQ ID NO: 113737 - DNA, 20 bp, Artificial
  CRISPR gRNA sequence
ttctagcaaggcagcagaat

SEQ ID NO: 113738 - DNA, 20 bp, Artificial
  CRISPR gRNA sequence
tctagcaaggcagcagaata

SEQ ID NO: 113739 - DNA, 20 bp, Artificial
  CRISPR gRNA sequence
ctagcaaggcagcagaatag

SEQ ID NO: 113740 - DNA, 20 bp, Artificial
  CRISPR gRNA sequence
tagcaaggcagcagaatagt

SEQ ID NO: 113741 - DNA, 20 bp, Artificial
  CRISPR gRNA sequence
gcaaggcagcagaatagttc

SEQ ID NO: 113742 - DNA, 20 bp, Artificial
  CRISPR gRNA sequence
cagtgattgtcttttggtaa

SEQ ID NO: 113743 - DNA, 20 bp, Artificial
  CRISPR gRNA sequence
tcttttggtaaaaaccattt

SEQ ID NO: 113744 - DNA, 20 bp, Artificial
  CRISPR gRNA sequence
ttggtaaaaaccattttgtg

SEQ ID NO: 113745 - DNA, 20 bp, Artificial
  CRISPR gRNA sequence
tggtaaaaaccattttgtgt

SEQ ID NO: 113746 - DNA, 20 bp, Artificial
  CRISPR gRNA sequence
ggtaaaaaccattttgtgtc

SEQ ID NO: 113747 - DNA, 20 bp, Artificial
  CRISPR gRNA sequence
gtaaaaaccattttgtgtct

SEQ ID NO: 113748 - DNA, 20 bp, Artificial
  CRISPR gRNA sequence
tgtgtcttatgttatttcat

SEQ ID NO: 113749 - DNA, 20 bp, Artificial
  CRISPR gRNA sequence
gtgtcttatgttatttcatt

SEQ ID NO: 113750 - DNA, 20 bp, Artificial
  CRISPR gRNA sequence
tgtcttatgttatttcattg

SEQ ID NO: 113751 - DNA, 20 bp, Artificial
  CRISPR gRNA sequence
atgttatttcattgttctta

SEQ ID NO: 113752 - DNA, 20 bp, Artificial
  CRISPR gRNA sequence
tgttatttcattgttcttat

SEQ ID NO: 113753 - DNA, 20 bp, Artificial
  CRISPR gRNA sequence
tttcattgttcttattttat

SEQ ID NO: 113754 - DNA, 20 bp, Artificial
  CRISPR gRNA sequence
cattgttcttattttatttc

SEQ ID NO: 113755 - DNA, 20 bp, Artificial
  CRISPR gRNA sequence
attgttcttattttatttca

SEQ ID NO: 113756 - DNA, 20 bp, Artificial
  CRISPR gRNA sequence
ttcttattttatttcattct

SEQ ID NO: 113757 - DNA, 20 bp, Artificial
  CRISPR gRNA sequence
ttattttatttcattctagg

SEQ ID NO: 113758 - DNA, 20 bp, Artificial
  CRISPR gRNA sequence
attttatttcattctaggtc

SEQ ID NO: 113759 - DNA, 20 bp, Artificial
  CRISPR gRNA sequence
ttttatttcattctaggtcc

SEQ ID NO: 113760 - DNA, 20 bp, Artificial
  CRISPR gRNA sequence
tatttcattctaggtccaag

SEQ ID NO: 113761 - DNA, 20 bp, Artificial
  CRISPR gRNA sequence
atttcattctaggtccaagg

SEQ ID NO: 113762 - DNA, 20 bp, Artificial
  CRISPR gRNA sequence
tttcattctaggtccaaggg

SEQ ID NO: 113763 - DNA, 20 bp, Artificial
  CRISPR gRNA sequence
cattctaggtccaagggcag

SEQ ID NO: 113764 - DNA, 20 bp, Artificial
  CRISPR gRNA sequence
attctaggtccaagggcagc

SEQ ID NO: 113765 - DNA, 20 bp, Artificial
  CRISPR gRNA sequence
taggtccaagggcagccatt

SEQ ID NO: 113766 - DNA, 20 bp, Artificial
  CRISPR gRNA sequence
ggtccaagggcagccattaa

SEQ ID NO: 113767 - DNA, 20 bp, Artificial
  CRISPR gRNA sequence
atggtgcaggtcagtggagg

SEQ ID NO: 113768 - DNA, 20 bp, Artificial
  CRISPR gRNA sequence
atcacatcaactggccaacc

SEQ ID NO: 113769 - DNA, 20 bp, Artificial
  CRISPR gRNA sequence
gccaacccatcatggtccag

SEQ ID NO: 113770 - DNA, 20 bp, Artificial
  CRISPR gRNA sequence
tccctggtggacaaggtcaa

SEQ ID NO: 113771 - DNA, 20 bp, Artificial
  CRISPR gRNA sequence
gtggacaaggtcaaaccatc

SEQ ID NO: 113772 - DNA, 20 bp, Artificial
  CRISPR gRNA sequence
tttctggaacacagggtttg

SEQ ID NO: 113773 - DNA, 20 bp, Artificial
  CRISPR gRNA sequence
ctggaacacagggtttgcag

SEQ ID NO: 113774 - DNA, 20 bp, Artificial
  CRISPR gRNA sequence
tggaacacagggtttgcagc

SEQ ID NO: 113775 - DNA, 20 bp, Artificial
  CRISPR gRNA sequence
gaacacagggtttgcagcaa

SEQ ID NO: 113776 - DNA, 20 bp, Artificial
  CRISPR gRNA sequence
gcagcaagtgagtaatattt

SEQ ID NO: 113777 - DNA, 20 bp, Artificial
  CRISPR gRNA sequence
cagcaagtgagtaatattta

SEQ ID NO: 113778 - DNA, 20 bp, Artificial
  CRISPR gRNA sequence
aaaaatattgagcagtatat

SEQ ID NO: 113779 - DNA, 20 bp, Artificial
  CRISPR gRNA sequence
aaaatattgagcagtatatc

SEQ ID NO: 113780 - DNA, 20 bp, Artificial
  CRISPR gRNA sequence
agcagtatatcagaggagag

SEQ ID NO: 113781 - DNA, 20 bp, Artificial
  CRISPR gRNA sequence
caaagaatagattattacaa

SEQ ID NO: 113782 - DNA, 20 bp, Artificial
  CRISPR gRNA sequence
aaagaatagattattacaac

SEQ ID NO: 113783 - DNA, 20 bp, Artificial
  CRISPR gRNA sequence
ttacaacctatttgataatt

SEQ ID NO: 113784 - DNA, 20 bp, Artificial
  CRISPR gRNA sequence
caacctatttgataattgat

SEQ ID NO: 113785 - DNA, 20 bp, Artificial
  CRISPR gRNA sequence
tttgataattgatattgcat

SEQ ID NO: 113786 - DNA, 20 bp, Artificial
  CRISPR gRNA sequence
gataattgatattgcattta

SEQ ID NO: 113787 - DNA, 20 bp, Artificial
  CRISPR gRNA sequence
ataattgatattgcatttaa

SEQ ID NO: 113788 - DNA, 20 bp, Artificial
  CRISPR gRNA sequence
atattgcatttaactgcttc

SEQ ID NO: 113789 - DNA, 20 bp, Artificial
  CRISPR gRNA sequence
catttaactgcttcctaacc

SEQ ID NO: 113790 - DNA, 20 bp, Artificial
  CRISPR gRNA sequence
aactgcttcctaacccacat

SEQ ID NO: 113791 - DNA, 20 bp, Artificial
  CRISPR gRNA sequence
actgcttcctaacccacatt

SEQ ID NO: 113792 - DNA, 20 bp, Artificial
  CRISPR gRNA sequence
cttcctaacccacattttgc

SEQ ID NO: 113793 - DNA, 20 bp, Artificial
  CRISPR gRNA sequence
cctaacccacattttgcatt

SEQ ID NO: 113794 - DNA, 20 bp, Artificial
  CRISPR gRNA sequence
ctaacccacattttgcattc

SEQ ID NO: 113795 - DNA, 20 bp, Artificial
  CRISPR gRNA sequence
acccacattttgcattcagt

SEQ ID NO: 113796 - DNA, 20 bp, Artificial
  CRISPR gRNA sequence
tgcattcagttgattttctg

SEQ ID NO: 113797 - DNA, 20 bp, Artificial
  CRISPR gRNA sequence
gcattcagttgattttctgc

SEQ ID NO: 113798 - DNA, 20 bp, Artificial
  CRISPR gRNA sequence
cattcagttgattttctgcc

SEQ ID NO: 113799 - DNA, 20 bp, Artificial
  CRISPR gRNA sequence
agttgattttctgcctttat

SEQ ID NO: 113800 - DNA, 20 bp, Artificial
  CRISPR gRNA sequence
attttctgcctttatagtac

SEQ ID NO: 113801 - DNA, 20 bp, Artificial
  CRISPR gRNA sequence
tctgcctttatagtaccagt

SEQ ID NO: 113802 - DNA, 20 bp, Artificial
  CRISPR gRNA sequence
ctgcctttatagtaccagtg

SEQ ID NO: 113803 - DNA, 20 bp, Artificial
  CRISPR gRNA sequence
tgcctttatagtaccagtga

SEQ ID NO: 113804 - DNA, 20 bp, Artificial
  CRISPR gRNA sequence
cctttatagtaccagtgata

SEQ ID NO: 113805 - DNA, 20 bp, Artificial
  CRISPR gRNA sequence
tatagtaccagtgatataaa

SEQ ID NO: 113806 - DNA, 20 bp, Artificial
  CRISPR gRNA sequence
atagtaccagtgatataaac

SEQ ID NO: 113807 - DNA, 20 bp, Artificial
  CRISPR gRNA sequence
tagtaccagtgatataaact

SEQ ID NO: 113808 - DNA, 20 bp, Artificial
  CRISPR gRNA sequence
gaactatgcagaaattggac

SEQ ID NO: 113809 - DNA, 20 bp, Artificial
  CRISPR gRNA sequence
tgcagaaattggacagctcc

SEQ ID NO: 113810 - DNA, 20 bp, Artificial
  CRISPR gRNA sequence
gacagctccagtaatgacta

SEQ ID NO: 113811 - DNA, 20 bp, Artificial
  CRISPR gRNA sequence
cagtaatgactaagatatta

SEQ ID NO: 113812 - DNA, 20 bp, Artificial
  CRISPR gRNA sequence
agatattaggcatgatcttg

SEQ ID NO: 113813 - DNA, 20 bp, Artificial
  CRISPR gRNA sequence
ggcatgatcttgaattgctg

SEQ ID NO: 113814 - DNA, 20 bp, Artificial
  CRISPR gRNA sequence
gaattgctgtaaagtatatg

SEQ ID NO: 113815 - DNA, 20 bp, Artificial
  CRISPR gRNA sequence
aattgctgtaaagtatatga

SEQ ID NO: 113816 - DNA, 20 bp, Artificial
  CRISPR gRNA sequence
ctgtaaagtatatgaagagg

SEQ ID NO: 113817 - DNA, 20 bp, Artificial
  CRISPR gRNA sequence
taaagtatatgaagaggtta

SEQ ID NO: 113818 - DNA, 20 bp, Artificial
  CRISPR gRNA sequence
gaatctagtttatagtatat

SEQ ID NO: 113819 - DNA, 20 bp, Artificial
  CRISPR gRNA sequence
gtttatagtatattttattt

SEQ ID NO: 113820 - DNA, 20 bp, Artificial
  CRISPR gRNA sequence
atagtatattttattttaaa

SEQ ID NO: 113821 - DNA, 20 bp, Artificial
  CRISPR gRNA sequence
tagtatattttattttaaaa

SEQ ID NO: 113822 - DNA, 20 bp, Artificial
  CRISPR gRNA sequence
tattttaaaagaaacaaaaa

SEQ ID NO: 113823 - DNA, 20 bp, Artificial
  CRISPR gRNA sequence
attttaaaagaaacaaaaat

SEQ ID NO: 113824 - DNA, 20 bp, Artificial
  CRISPR gRNA sequence
ttttaaaagaaacaaaaatg

SEQ ID NO: 113825 - DNA, 20 bp, Artificial
  CRISPR gRNA sequence
taaaagaaacaaaaatgagt

SEQ ID NO: 113826 - DNA, 20 bp, Artificial
  CRISPR gRNA sequence
aaaagaaacaaaaatgagta

SEQ ID NO: 113827 - DNA, 20 bp, Artificial
  CRISPR gRNA sequence
aaagaaacaaaaatgagtat

SEQ ID NO: 113828 - DNA, 20 bp, Artificial
  CRISPR gRNA sequence
agaaagttagaaaaataaca

SEQ ID NO: 113829 - DNA, 20 bp, Artificial
  CRISPR gRNA sequence
gaaagttagaaaaataacaa

SEQ ID NO: 113830 - DNA, 20 bp, Artificial
  CRISPR gRNA sequence
gaaaaataacaaaacgagca

SEQ ID NO: 113831 - DNA, 20 bp, Artificial
  CRISPR gRNA sequence
attaagtagaaaactgacgt

SEQ ID NO: 113832 - DNA, 20 bp, Artificial
  CRISPR gRNA sequence
agtagaaaactgacgtatag

SEQ ID NO: 113833 - DNA, 20 bp, Artificial
  CRISPR gRNA sequence
acgtatagaaaggataaata

SEQ ID NO: 113834 - DNA, 20 bp, Artificial
  CRISPR gRNA sequence
gattgtttaagcagaccaat

SEQ ID NO: 113835 - DNA, 20 bp, Artificial
  CRISPR gRNA sequence
tttaagcagaccaataaaac

SEQ ID NO: 113836 - DNA, 20 bp, Artificial
  CRISPR gRNA sequence
aagcagaccaataaaacagg

SEQ ID NO: 113837 - DNA, 20 bp, Artificial
  CRISPR gRNA sequence
agcagaccaataaaacaggt

SEQ ID NO: 113838 - DNA, 20 bp, Artificial
  CRISPR gRNA sequence
aaacactgattgagaaacag

SEQ ID NO: 113839 - DNA, 20 bp, Artificial
  CRISPR gRNA sequence
attgagaaacagaaaacaaa

SEQ ID NO: 113840 - DNA, 20 bp, Artificial
  CRISPR gRNA sequence
agaaacagaaaacaaaagta

SEQ ID NO: 113841 - DNA, 20 bp, Artificial
  CRISPR gRNA sequence
aaggaaggccaggcgcagtg

SEQ ID NO: 113842 - DNA, 20 bp, Artificial
  CRISPR gRNA sequence
atgcctgtgatcccagcact

SEQ ID NO: 113843 - DNA, 20 bp, Artificial
  CRISPR gRNA sequence
tgatcccagcacttggggag

SEQ ID NO: 113844 - DNA, 20 bp, Artificial
  CRISPR gRNA sequence
ggggaggccaaggcaggtgg

SEQ ID NO: 113845 - DNA, 20 bp, Artificial
  CRISPR gRNA sequence
gggaggccaaggcaggtgga

SEQ ID NO: 113846 - DNA, 20 bp, Artificial
  CRISPR gRNA sequence
gaggccaggagttcaagacc

SEQ ID NO: 113847 - DNA, 20 bp, Artificial
  CRISPR gRNA sequence
aggccaggagttcaagacca

SEQ ID NO: 113848 - DNA, 20 bp, Artificial
  CRISPR gRNA sequence
aagaccagcctggccaacat

SEQ ID NO: 113849 - DNA, 20 bp, Artificial
  CRISPR gRNA sequence
gccaacatgacaaaacccca

SEQ ID NO: 113850 - DNA, 20 bp, Artificial
  CRISPR gRNA sequence
tactaaaaataaaaaattag

SEQ ID NO: 113851 - DNA, 20 bp, Artificial
  CRISPR gRNA sequence
ctaaaaataaaaaattagcc

SEQ ID NO: 113852 - DNA, 20 bp, Artificial
  CRISPR gRNA sequence
aaaataaaaaattagccggg

SEQ ID NO: 113853 - DNA, 20 bp, Artificial
  CRISPR gRNA sequence
gccgggcgtggtggcacgca

SEQ ID NO: 113854 - DNA, 20 bp, Artificial
  CRISPR gRNA sequence
taatcccagctacttggggg

SEQ ID NO: 113855 - DNA, 20 bp, Artificial
  CRISPR gRNA sequence
cttggggggttgaggcataa

SEQ ID NO: 113856 - DNA, 20 bp, Artificial
  CRISPR gRNA sequence
ggggggttgaggcataagat

SEQ ID NO: 113857 - DNA, 20 bp, Artificial
  CRISPR gRNA sequence
gggggttgaggcataagata

SEQ ID NO: 113858 - DNA, 20 bp, Artificial
  CRISPR gRNA sequence
aggcataagatatcttgaac

SEQ ID NO: 113859 - DNA, 20 bp, Artificial
  CRISPR gRNA sequence
gaacccaggaggcggaggtt

SEQ ID NO: 113860 - DNA, 20 bp, Artificial
  CRISPR gRNA sequence
aacccaggaggcggaggttg

SEQ ID NO: 113861 - DNA, 20 bp, Artificial
  CRISPR gRNA sequence
cagtaagccaagattgtgcc

SEQ ID NO: 113862 - DNA, 20 bp, Artificial
  CRISPR gRNA sequence
tgccactgcactccaggctg

SEQ ID NO: 113863 - DNA, 20 bp, Artificial
  CRISPR gRNA sequence
cactccaggctgggcaccag

SEQ ID NO: 113864 - DNA, 20 bp, Artificial
  CRISPR gRNA sequence
caggctgggcaccagagcaa

SEQ ID NO: 113865 - DNA, 20 bp, Artificial
  CRISPR gRNA sequence
ggcaccagagcaagattctg

SEQ ID NO: 113866 - DNA, 20 bp, Artificial
  CRISPR gRNA sequence
tgtctcaaaaaaaaagaaga

SEQ ID NO: 113867 - DNA, 20 bp, Artificial
  CRISPR gRNA sequence
tctcaaaaaaaaagaagaga

SEQ ID NO: 113868 - DNA, 20 bp, Artificial
  CRISPR gRNA sequence
aaaaaaaaagaagagattaa

SEQ ID NO: 113869 - DNA, 20 bp, Artificial
  CRISPR gRNA sequence
acagaaatatgtagaaatgt

SEQ ID NO: 113870 - DNA, 20 bp, Artificial
  CRISPR gRNA sequence
catacaactctgtggcatca

SEQ ID NO: 113871 - DNA, 20 bp, Artificial
  CRISPR gRNA sequence
tgtggcatcatattttaaaa

SEQ ID NO: 113872 - DNA, 20 bp, Artificial
  CRISPR gRNA sequence
tggcatcatattttaaaatt

SEQ ID NO: 113873 - DNA, 20 bp, Artificial
  CRISPR gRNA sequence
taaaattagatatttctcat

SEQ ID NO: 113874 - DNA, 20 bp, Artificial
  CRISPR gRNA sequence
aaaattagatatttctcatc

SEQ ID NO: 113875 - DNA, 20 bp, Artificial
  CRISPR gRNA sequence
aaattagatatttctcatcg

SEQ ID NO: 113876 - DNA, 20 bp, Artificial
  CRISPR gRNA sequence
gatatttctcatcgagatgg

SEQ ID NO: 113877 - DNA, 20 bp, Artificial
  CRISPR gRNA sequence
ctcatcgagatggcaaaaaa

SEQ ID NO: 113878 - DNA, 20 bp, Artificial
  CRISPR gRNA sequence
tcatcgagatggcaaaaaaa

SEQ ID NO: 113879 - DNA, 20 bp, Artificial
  CRISPR gRNA sequence
atcgagatggcaaaaaaaaa

SEQ ID NO: 113880 - DNA, 20 bp, Artificial
  CRISPR gRNA sequence
tatccactgttaggatggat

SEQ ID NO: 113881 - DNA, 20 bp, Artificial
  CRISPR gRNA sequence
ttaggatggatgtggagaaa

SEQ ID NO: 113882 - DNA, 20 bp, Artificial
  CRISPR gRNA sequence
ggatggatgtggagaaaaag

SEQ ID NO: 113883 - DNA, 20 bp, Artificial
  CRISPR gRNA sequence
atcattatttttggtaattt

SEQ ID NO: 113884 - DNA, 20 bp, Artificial
  CRISPR gRNA sequence
tttttggtaatttaaaactg

SEQ ID NO: 113885 - DNA, 20 bp, Artificial
  CRISPR gRNA sequence
ttggtaatttaaaactgtag

SEQ ID NO: 113886 - DNA, 20 bp, Artificial
  CRISPR gRNA sequence
tggtaatttaaaactgtaga

SEQ ID NO: 113887 - DNA, 20 bp, Artificial
  CRISPR gRNA sequence
ggtaatttaaaactgtagag

SEQ ID NO: 113888 - DNA, 20 bp, Artificial
  CRISPR gRNA sequence
gtaatttaaaactgtagagt

SEQ ID NO: 113889 - DNA, 20 bp, Artificial
  CRISPR gRNA sequence
aaaactgtagagttattttg

SEQ ID NO: 113890 - DNA, 20 bp, Artificial
  CRISPR gRNA sequence
aaactgtagagttattttgg

SEQ ID NO: 113891 - DNA, 20 bp, Artificial
  CRISPR gRNA sequence
tagagttattttggaaaggc

SEQ ID NO: 113892 - DNA, 20 bp, Artificial
  CRISPR gRNA sequence
ttttggaaaggcacctcact

SEQ ID NO: 113893 - DNA, 20 bp, Artificial
  CRISPR gRNA sequence
tggaaaggcacctcactatc

SEQ ID NO: 113894 - DNA, 20 bp, Artificial
  CRISPR gRNA sequence
ggaaaggcacctcactatct

SEQ ID NO: 113895 - DNA, 20 bp, Artificial
  CRISPR gRNA sequence
gaaaggcacctcactatctg

SEQ ID NO: 113896 - DNA, 20 bp, Artificial
  CRISPR gRNA sequence
actatctgttaaatacaatg

SEQ ID NO: 113897 - DNA, 20 bp, Artificial
  CRISPR gRNA sequence
tctgttaaatacaatgaata

SEQ ID NO: 113898 - DNA, 20 bp, Artificial
  CRISPR gRNA sequence
ttaaatacaatgaatatttg

SEQ ID NO: 113899 - DNA, 20 bp, Artificial
  CRISPR gRNA sequence
aatacaatgaatatttgagc

SEQ ID NO: 113900 - DNA, 20 bp, Artificial
  CRISPR gRNA sequence
gagctagcagtcccacttct

SEQ ID NO: 113901 - DNA, 20 bp, Artificial
  CRISPR gRNA sequence
agctagcagtcccacttctg

SEQ ID NO: 113902 - DNA, 20 bp, Artificial
  CRISPR gRNA sequence
gcagtcccacttctgagaat

SEQ ID NO: 113903 - DNA, 20 bp, Artificial
  CRISPR gRNA sequence
ctgagaatctgtcctatagg

SEQ ID NO: 113904 - DNA, 20 bp, Artificial
  CRISPR gRNA sequence
tgagaatctgtcctatagga

SEQ ID NO: 113905 - DNA, 20 bp, Artificial
  CRISPR gRNA sequence
agaatctgtcctataggaag

SEQ ID NO: 113906 - DNA, 20 bp, Artificial
  CRISPR gRNA sequence
tcctataggaagaaaagcat

SEQ ID NO: 113907 - DNA, 20 bp, Artificial
  CRISPR gRNA sequence
taggaagaaaagcatcaata

SEQ ID NO: 113908 - DNA, 20 bp, Artificial
  CRISPR gRNA sequence
caaagacacttttcatagca

SEQ ID NO: 113909 - DNA, 20 bp, Artificial
  CRISPR gRNA sequence
ttcatagcattgtactagca

SEQ ID NO: 113910 - DNA, 20 bp, Artificial
  CRISPR gRNA sequence
tcatagcattgtactagcaa

SEQ ID NO: 113911 - DNA, 20 bp, Artificial
  CRISPR gRNA sequence
catagcattgtactagcaaa

SEQ ID NO: 113912 - DNA, 20 bp, Artificial
  CRISPR gRNA sequence
atagcattgtactagcaaaa

SEQ ID NO: 113913 - DNA, 20 bp, Artificial
  CRISPR gRNA sequence
tactagcaaaaaataaaatt

SEQ ID NO: 113914 - DNA, 20 bp, Artificial
  CRISPR gRNA sequence
gcaaaaaataaaattgcaat

SEQ ID NO: 113915 - DNA, 20 bp, Artificial
  CRISPR gRNA sequence
caatctgagtgtccattaat

SEQ ID NO: 113916 - DNA, 20 bp, Artificial
  CRISPR gRNA sequence
agtgtccattaataagaata

SEQ ID NO: 113917 - DNA, 20 bp, Artificial
  CRISPR gRNA sequence
ataagaataaggaaatggtt

SEQ ID NO: 113918 - DNA, 20 bp, Artificial
  CRISPR gRNA sequence
gaataaatcataatatattc

SEQ ID NO: 113919 - DNA, 20 bp, Artificial
  CRISPR gRNA sequence
atagggaatattgcatcatc

SEQ ID NO: 113920 - DNA, 20 bp, Artificial
  CRISPR gRNA sequence
catcatcattaaaagaaatg

SEQ ID NO: 113921 - DNA, 20 bp, Artificial
  CRISPR gRNA sequence
aaagaaatgaactgttgact

SEQ ID NO: 113922 - DNA, 20 bp, Artificial
  CRISPR gRNA sequence
ttgacttggggtgggttaat

SEQ ID NO: 113923 - DNA, 20 bp, Artificial
  CRISPR gRNA sequence
acttggggtgggttaatatt

SEQ ID NO: 113924 - DNA, 20 bp, Artificial
  CRISPR gRNA sequence
ggggtgggttaatattgaaa

SEQ ID NO: 113925 - DNA, 20 bp, Artificial
  CRISPR gRNA sequence
gggtgggttaatattgaaat

SEQ ID NO: 113926 - DNA, 20 bp, Artificial
  CRISPR gRNA sequence
atattgaaatatttttagtg

SEQ ID NO: 113927 - DNA, 20 bp, Artificial
  CRISPR gRNA sequence
aaatatttttagtggaaata

SEQ ID NO: 113928 - DNA, 20 bp, Artificial
  CRISPR gRNA sequence
ttagtggaaataatttgcag

SEQ ID NO: 113929 - DNA, 20 bp, Artificial
  CRISPR gRNA sequence
tagtggaaataatttgcaga

SEQ ID NO: 113930 - DNA, 20 bp, Artificial
  CRISPR gRNA sequence
agtggaaataatttgcagag

SEQ ID NO: 113931 - DNA, 20 bp, Artificial
  CRISPR gRNA sequence
gtggaaataatttgcagaga

SEQ ID NO: 113932 - DNA, 20 bp, Artificial
  CRISPR gRNA sequence
gcagagaaatagtgtgtgat

SEQ ID NO: 113933 - DNA, 20 bp, Artificial
  CRISPR gRNA sequence
cagagaaatagtgtgtgatc

SEQ ID NO: 113934 - DNA, 20 bp, Artificial
  CRISPR gRNA sequence
atctttgtaattcataacca

SEQ ID NO: 113935 - DNA, 20 bp, Artificial
  CRISPR gRNA sequence
tgtaattcataaccaacccc

SEQ ID NO: 113936 - DNA, 20 bp, Artificial
  CRISPR gRNA sequence
gtaattcataaccaaccccc

SEQ ID NO: 113937 - DNA, 20 bp, Artificial
  CRISPR gRNA sequence
taattcataaccaacccccc

SEQ ID NO: 113938 - DNA, 20 bp, Artificial
  CRISPR gRNA sequence
ataaccaaccccccatgagt

SEQ ID NO: 113939 - DNA, 20 bp, Artificial
  CRISPR gRNA sequence
atagtcatggaaaagagagt

SEQ ID NO: 113940 - DNA, 20 bp, Artificial
  CRISPR gRNA sequence
tagtcatggaaaagagagta

SEQ ID NO: 113941 - DNA, 20 bp, Artificial
  CRISPR gRNA sequence
ttagttactctatctaaatg

SEQ ID NO: 113942 - DNA, 20 bp, Artificial
  CRISPR gRNA sequence
gttactctatctaaatgttt

SEQ ID NO: 113943 - DNA, 20 bp, Artificial
  CRISPR gRNA sequence
ctctatctaaatgtttatat

SEQ ID NO: 113944 - DNA, 20 bp, Artificial
  CRISPR gRNA sequence
tatctaaatgtttatattgt

SEQ ID NO: 113945 - DNA, 20 bp, Artificial
  CRISPR gRNA sequence
tctaaatgtttatattgttt

SEQ ID NO: 113946 - DNA, 20 bp, Artificial
  CRISPR gRNA sequence
aatgtttatattgtttcaac

SEQ ID NO: 113947 - DNA, 20 bp, Artificial
  CRISPR gRNA sequence
atattgtttcaacagttaca

SEQ ID NO: 113948 - DNA, 20 bp, Artificial
  CRISPR gRNA sequence
tattgtttcaacagttacag

SEQ ID NO: 113949 - DNA, 20 bp, Artificial
  CRISPR gRNA sequence
tttcaacagttacagcagtc

SEQ ID NO: 113950 - DNA, 20 bp, Artificial
  CRISPR gRNA sequence
caacagttacagcagtcata

SEQ ID NO: 113951 - DNA, 20 bp, Artificial
  CRISPR gRNA sequence
aacagttacagcagtcatat

SEQ ID NO: 113952 - DNA, 20 bp, Artificial
  CRISPR gRNA sequence
cagcagtcatattaatgtct

SEQ ID NO: 113953 - DNA, 20 bp, Artificial
  CRISPR gRNA sequence
atgtcttagttttctggagg

SEQ ID NO: 113954 - DNA, 20 bp, Artificial
  CRISPR gRNA sequence
agttttctggaggaatttaa

SEQ ID NO: 113955 - DNA, 20 bp, Artificial
  CRISPR gRNA sequence
gttttctggaggaatttaag

SEQ ID NO: 113956 - DNA, 20 bp, Artificial
  CRISPR gRNA sequence
tctggaggaatttaagttga

SEQ ID NO: 113957 - DNA, 20 bp, Artificial
  CRISPR gRNA sequence
ctggaggaatttaagttgaa

SEQ ID NO: 113958 - DNA, 20 bp, Artificial
  CRISPR gRNA sequence
tggaggaatttaagttgaaa

SEQ ID NO: 113959 - DNA, 20 bp, Artificial
  CRISPR gRNA sequence
gaggaatttaagttgaaaaa

SEQ ID NO: 113960 - DNA, 20 bp, Artificial
  CRISPR gRNA sequence
aagttgaaaaaagcagccat

SEQ ID NO: 113961 - DNA, 20 bp, Artificial
  CRISPR gRNA sequence
agttgaaaaaagcagccatg

SEQ ID NO: 113962 - DNA, 20 bp, Artificial
  CRISPR gRNA sequence
aaaaaagcagccatgatccc

SEQ ID NO: 113963 - DNA, 20 bp, Artificial
  CRISPR gRNA sequence
ctcataaatcaaacttgtac

SEQ ID NO: 113964 - DNA, 20 bp, Artificial
  CRISPR gRNA sequence
ataaatcaaacttgtacttt

SEQ ID NO: 113965 - DNA, 20 bp, Artificial
  CRISPR gRNA sequence
gtactttttgtgtattcttt

SEQ ID NO: 113966 - DNA, 20 bp, Artificial
  CRISPR gRNA sequence
tactttttgtgtattctttt

SEQ ID NO: 113967 - DNA, 20 bp, Artificial
  CRISPR gRNA sequence
tttgtgtattcttttgtgtt

SEQ ID NO: 113968 - DNA, 20 bp, Artificial
  CRISPR gRNA sequence
ttgtgtattcttttgtgttt

SEQ ID NO: 113969 - DNA, 20 bp, Artificial
  CRISPR gRNA sequence
tgtgtattcttttgtgtttt

SEQ ID NO: 113970 - DNA, 20 bp, Artificial
  CRISPR gRNA sequence
gtgtattcttttgtgttttt

SEQ ID NO: 113971 - DNA, 20 bp, Artificial
  CRISPR gRNA sequence
tgtattcttttgtgttttta

SEQ ID NO: 113972 - DNA, 20 bp, Artificial
  CRISPR gRNA sequence
ttttgtgtttttatgcataa

SEQ ID NO: 113973 - DNA, 20 bp, Artificial
  CRISPR gRNA sequence
ttgtgtttttatgcataatt

SEQ ID NO: 113974 - DNA, 20 bp, Artificial
  CRISPR gRNA sequence
tgtgtttttatgcataattt

SEQ ID NO: 113975 - DNA, 20 bp, Artificial
  CRISPR gRNA sequence
gtgtttttatgcataatttt

SEQ ID NO: 113976 - DNA, 20 bp, Artificial
  CRISPR gRNA sequence
tgtttttatgcataattttt

SEQ ID NO: 113977 - DNA, 20 bp, Artificial
  CRISPR gRNA sequence
ttatgcataatttttgggca

SEQ ID NO: 113978 - DNA, 20 bp, Artificial
  CRISPR gRNA sequence
tatgcataatttttgggcat

SEQ ID NO: 113979 - DNA, 20 bp, Artificial
  CRISPR gRNA sequence
atgcataatttttgggcata

SEQ ID NO: 113980 - DNA, 20 bp, Artificial
  CRISPR gRNA sequence
tgcataatttttgggcataa

SEQ ID NO: 113981 - DNA, 20 bp, Artificial
  CRISPR gRNA sequence
ttgggcataattgtaccatg

SEQ ID NO: 113982 - DNA, 20 bp, Artificial
  CRISPR gRNA sequence
tgggcataattgtaccatgc

SEQ ID NO: 113983 - DNA, 20 bp, Artificial
  CRISPR gRNA sequence
gggcataattgtaccatgca

SEQ ID NO: 113984 - DNA, 20 bp, Artificial
  CRISPR gRNA sequence
ggcataattgtaccatgcat

SEQ ID NO: 113985 - DNA, 20 bp, Artificial
  CRISPR gRNA sequence
taccatgcatgtggggttgt

SEQ ID NO: 113986 - DNA, 20 bp, Artificial
  CRISPR gRNA sequence
tgttttcatttttttttttt

SEQ ID NO: 113987 - DNA, 20 bp, Artificial
  CRISPR gRNA sequence
tcattttttttttttaattc

SEQ ID NO: 113988 - DNA, 20 bp, Artificial
  CRISPR gRNA sequence
cattttttttttttaattct

SEQ ID NO: 113989 - DNA, 20 bp, Artificial
  CRISPR gRNA sequence
attttttttttttaattctt

SEQ ID NO: 113990 - DNA, 20 bp, Artificial
  CRISPR gRNA sequence
tttttttttaattctttcat

SEQ ID NO: 113991 - DNA, 20 bp, Artificial
  CRISPR gRNA sequence
ttttttttaattctttcata

SEQ ID NO: 113992 - DNA, 20 bp, Artificial
  CRISPR gRNA sequence
tttttttaattctttcataa

SEQ ID NO: 113993 - DNA, 20 bp, Artificial
  CRISPR gRNA sequence
ttttttaattctttcataat

SEQ ID NO: 113994 - DNA, 20 bp, Artificial
  CRISPR gRNA sequence
tttttaattctttcataatg

SEQ ID NO: 113995 - DNA, 20 bp, Artificial
  CRISPR gRNA sequence
ttttaattctttcataatgt

SEQ ID NO: 113996 - DNA, 20 bp, Artificial
  CRISPR gRNA sequence
tttaattctttcataatgtt

SEQ ID NO: 113997 - DNA, 20 bp, Artificial
  CRISPR gRNA sequence
ttaattctttcataatgttc

SEQ ID NO: 113998 - DNA, 20 bp, Artificial
  CRISPR gRNA sequence
taattctttcataatgttca

SEQ ID NO: 113999 - DNA, 20 bp, Artificial
  CRISPR gRNA sequence
aattctttcataatgttcag

SEQ ID NO: 114000 - DNA, 20 bp, Artificial
  CRISPR gRNA sequence
attctttcataatgttcagt

SEQ ID NO: 114001 - DNA, 20 bp, Artificial
  CRISPR gRNA sequence
tttcataatgttcagtcaac

SEQ ID NO: 114002 - DNA, 20 bp, Artificial
  CRISPR gRNA sequence
tcataatgttcagtcaactt

SEQ ID NO: 114003 - DNA, 20 bp, Artificial
  CRISPR gRNA sequence
cataatgttcagtcaacttg

SEQ ID NO: 114004 - DNA, 20 bp, Artificial
  CRISPR gRNA sequence
ataatgttcagtcaacttga

SEQ ID NO: 114005 - DNA, 20 bp, Artificial
  CRISPR gRNA sequence
agtcaacttgatgaatcaga

SEQ ID NO: 114006 - DNA, 20 bp, Artificial
  CRISPR gRNA sequence
gatgaatcagaatttctaat

SEQ ID NO: 114007 - DNA, 20 bp, Artificial
  CRISPR gRNA sequence
atgaatcagaatttctaatt

SEQ ID NO: 114008 - DNA, 20 bp, Artificial
  CRISPR gRNA sequence
ctaatttataaaatatagtt

SEQ ID NO: 114009 - DNA, 20 bp, Artificial
  CRISPR gRNA sequence
taatttataaaatatagtta

SEQ ID NO: 114010 - DNA, 20 bp, Artificial
  CRISPR gRNA sequence
atttataaaatatagttaag

SEQ ID NO: 114011 - DNA, 20 bp, Artificial
  CRISPR gRNA sequence
ataaaatatagttaaggatt

SEQ ID NO: 114012 - DNA, 20 bp, Artificial
  CRISPR gRNA sequence
taaaatatagttaaggattt

SEQ ID NO: 114013 - DNA, 20 bp, Artificial
  CRISPR gRNA sequence
aggattttggttttcatttg

SEQ ID NO: 114014 - DNA, 20 bp, Artificial
  CRISPR gRNA sequence
tggttttcatttgcctttgt

SEQ ID NO: 114015 - DNA, 20 bp, Artificial
  CRISPR gRNA sequence
ggttttcatttgcctttgta

SEQ ID NO: 114016 - DNA, 20 bp, Artificial
  CRISPR gRNA sequence
gttttcatttgcctttgtag

SEQ ID NO: 114017 - DNA, 20 bp, Artificial
  CRISPR gRNA sequence
tcatttgcctttgtaggtaa

SEQ ID NO: 114018 - DNA, 20 bp, Artificial
  CRISPR gRNA sequence
catttgcctttgtaggtaaa

SEQ ID NO: 114019 - DNA, 20 bp, Artificial
  CRISPR gRNA sequence
atttgcctttgtaggtaaac

SEQ ID NO: 114020 - DNA, 20 bp, Artificial
  CRISPR gRNA sequence
gcctttgtaggtaaacattt

SEQ ID NO: 114021 - DNA, 20 bp, Artificial
  CRISPR gRNA sequence
cctttgtaggtaaacatttg

SEQ ID NO: 114022 - DNA, 20 bp, Artificial
  CRISPR gRNA sequence
tgtaggtaaacatttgggca

SEQ ID NO: 114023 - DNA, 20 bp, Artificial
  CRISPR gRNA sequence
gtaggtaaacatttgggcac

SEQ ID NO: 114024 - DNA, 20 bp, Artificial
  CRISPR gRNA sequence
taggtaaacatttgggcacg

SEQ ID NO: 114025 - DNA, 20 bp, Artificial
  CRISPR gRNA sequence
gggcacgatagttttatttt

SEQ ID NO: 114026 - DNA, 20 bp, Artificial
  CRISPR gRNA sequence
ggcacgatagttttattttt

SEQ ID NO: 114027 - DNA, 20 bp, Artificial
  CRISPR gRNA sequence
tatttttcaactgaattctc

SEQ ID NO: 114028 - DNA, 20 bp, Artificial
  CRISPR gRNA sequence
atttttcaactgaattctca

SEQ ID NO: 114029 - DNA, 20 bp, Artificial
  CRISPR gRNA sequence
tttttcaactgaattctcag

SEQ ID NO: 114030 - DNA, 20 bp, Artificial
  CRISPR gRNA sequence
ttcaactgaattctcaggat

SEQ ID NO: 114031 - DNA, 20 bp, Artificial
  CRISPR gRNA sequence
tcaactgaattctcaggata

SEQ ID NO: 114032 - DNA, 20 bp, Artificial
  CRISPR gRNA sequence
caactgaattctcaggataa

SEQ ID NO: 114033 - DNA, 20 bp, Artificial
  CRISPR gRNA sequence
aactgaattctcaggataat

SEQ ID NO: 114034 - DNA, 20 bp, Artificial
  CRISPR gRNA sequence
aattctcaggataatttctt

SEQ ID NO: 114035 - DNA, 20 bp, Artificial
  CRISPR gRNA sequence
tcaggataatttctttggat

SEQ ID NO: 114036 - DNA, 20 bp, Artificial
  CRISPR gRNA sequence
aggataatttctttggattg

SEQ ID NO: 114037 - DNA, 20 bp, Artificial
  CRISPR gRNA sequence
ctttggattggggattgctt

SEQ ID NO: 114038 - DNA, 20 bp, Artificial
  CRISPR gRNA sequence
tttggattggggattgcttg

SEQ ID NO: 114039 - DNA, 20 bp, Artificial
  CRISPR gRNA sequence
tggattggggattgcttggg

SEQ ID NO: 114040 - DNA, 20 bp, Artificial
  CRISPR gRNA sequence
ggattggggattgcttgggt

SEQ ID NO: 114041 - DNA, 20 bp, Artificial
  CRISPR gRNA sequence
gattggggattgcttgggta

SEQ ID NO: 114042 - DNA, 20 bp, Artificial
  CRISPR gRNA sequence
gggattgcttgggtaaaggg

SEQ ID NO: 114043 - DNA, 20 bp, Artificial
  CRISPR gRNA sequence
cttgggtaaagggtaagagt

SEQ ID NO: 114044 - DNA, 20 bp, Artificial
  CRISPR gRNA sequence
gggtaaagggtaagagtata

SEQ ID NO: 114045 - DNA, 20 bp, Artificial
  CRISPR gRNA sequence
ggtaaagggtaagagtatat

SEQ ID NO: 114046 - DNA, 20 bp, Artificial
  CRISPR gRNA sequence
gagcccactggcatattttt

SEQ ID NO: 114047 - DNA, 20 bp, Artificial
  CRISPR gRNA sequence
agcccactggcatatttttg

SEQ ID NO: 114048 - DNA, 20 bp, Artificial
  CRISPR gRNA sequence
gcatatttttgccaagatag

SEQ ID NO: 114049 - DNA, 20 bp, Artificial
  CRISPR gRNA sequence
ttgccaagatagaattgtac

SEQ ID NO: 114050 - DNA, 20 bp, Artificial
  CRISPR gRNA sequence
tgccaagatagaattgtact

SEQ ID NO: 114051 - DNA, 20 bp, Artificial
  CRISPR gRNA sequence
gccaagatagaattgtactt

SEQ ID NO: 114052 - DNA, 20 bp, Artificial
  CRISPR gRNA sequence
ccaagatagaattgtacttg

SEQ ID NO: 114053 - DNA, 20 bp, Artificial
  CRISPR gRNA sequence
tacttgggattaaaaatagt

SEQ ID NO: 114054 - DNA, 20 bp, Artificial
  CRISPR gRNA sequence
gggattaaaaatagttttca

SEQ ID NO: 114055 - DNA, 20 bp, Artificial
  CRISPR gRNA sequence
ggattaaaaatagttttcac

SEQ ID NO: 114056 - DNA, 20 bp, Artificial
  CRISPR gRNA sequence
aaaatagttttcacatttct

SEQ ID NO: 114057 - DNA, 20 bp, Artificial
  CRISPR gRNA sequence
tcacatttctctttgcataa

SEQ ID NO: 114058 - DNA, 20 bp, Artificial
  CRISPR gRNA sequence
cacatttctctttgcataaa

SEQ ID NO: 114059 - DNA, 20 bp, Artificial
  CRISPR gRNA sequence
acatttctctttgcataaat

SEQ ID NO: 114060 - DNA, 20 bp, Artificial
  CRISPR gRNA sequence
ctctttgcataaatatatga

SEQ ID NO: 114061 - DNA, 20 bp, Artificial
  CRISPR gRNA sequence
tctttgcataaatatatgag

SEQ ID NO: 114062 - DNA, 20 bp, Artificial
  CRISPR gRNA sequence
tttgcataaatatatgaggc

SEQ ID NO: 114063 - DNA, 20 bp, Artificial
  CRISPR gRNA sequence
tgcataaatatatgaggctt

SEQ ID NO: 114064 - DNA, 20 bp, Artificial
  CRISPR gRNA sequence
gcataaatatatgaggcttt

SEQ ID NO: 114065 - DNA, 20 bp, Artificial
  CRISPR gRNA sequence
cataaatatatgaggcttta

SEQ ID NO: 114066 - DNA, 20 bp, Artificial
  CRISPR gRNA sequence
taaatatcttttcagcatgt

SEQ ID NO: 114067 - DNA, 20 bp, Artificial
  CRISPR gRNA sequence
aaatatcttttcagcatgtg

SEQ ID NO: 114068 - DNA, 20 bp, Artificial
  CRISPR gRNA sequence
aatatcttttcagcatgtgc

SEQ ID NO: 114069 - DNA, 20 bp, Artificial
  CRISPR gRNA sequence
ttcagcatgtgctttccttg

SEQ ID NO: 114070 - DNA, 20 bp, Artificial
  CRISPR gRNA sequence
tcagcatgtgctttccttga

SEQ ID NO: 114071 - DNA, 20 bp, Artificial
  CRISPR gRNA sequence
cagcatgtgctttccttgat

SEQ ID NO: 114072 - DNA, 20 bp, Artificial
  CRISPR gRNA sequence
agcatgtgctttccttgatt

SEQ ID NO: 114073 - DNA, 20 bp, Artificial
  CRISPR gRNA sequence
tccttgattccctattgcta

SEQ ID NO: 114074 - DNA, 20 bp, Artificial
  CRISPR gRNA sequence
ccttgattccctattgctat

SEQ ID NO: 114075 - DNA, 20 bp, Artificial
  CRISPR gRNA sequence
cttgattccctattgctata

SEQ ID NO: 114076 - DNA, 20 bp, Artificial
  CRISPR gRNA sequence
gattccctattgctatatcc

SEQ ID NO: 114077 - DNA, 20 bp, Artificial
  CRISPR gRNA sequence
attccctattgctatatcct

SEQ ID NO: 114078 - DNA, 20 bp, Artificial
  CRISPR gRNA sequence
cctattgctatatcctttct

SEQ ID NO: 114079 - DNA, 20 bp, Artificial
  CRISPR gRNA sequence
ttgctatatcctttctgttc

SEQ ID NO: 114080 - DNA, 20 bp, Artificial
  CRISPR gRNA sequence
ctatatcctttctgttcttc

SEQ ID NO: 114081 - DNA, 20 bp, Artificial
  CRISPR gRNA sequence
tatcctttctgttcttctct

SEQ ID NO: 114082 - DNA, 20 bp, Artificial
  CRISPR gRNA sequence
tctgttcttctctctttgct

SEQ ID NO: 114083 - DNA, 20 bp, Artificial
  CRISPR gRNA sequence
ctgttcttctctctttgctt

SEQ ID NO: 114084 - DNA, 20 bp, Artificial
  CRISPR gRNA sequence
tgttcttctctctttgcttc

SEQ ID NO: 114085 - DNA, 20 bp, Artificial
  CRISPR gRNA sequence
ttcttctctctttgcttcct

SEQ ID NO: 114086 - DNA, 20 bp, Artificial
  CRISPR gRNA sequence
ttctctctttgcttcctctc

SEQ ID NO: 114087 - DNA, 20 bp, Artificial
  CRISPR gRNA sequence
ctctctttgcttcctctcca

SEQ ID NO: 114088 - DNA, 20 bp, Artificial
  CRISPR gRNA sequence
tctctttgcttcctctccag

SEQ ID NO: 114089 - DNA, 20 bp, Artificial
  CRISPR gRNA sequence
tctttgcttcctctccagtc

SEQ ID NO: 114090 - DNA, 20 bp, Artificial
  CRISPR gRNA sequence
tttgcttcctctccagtccc

SEQ ID NO: 114091 - DNA, 20 bp, Artificial
  CRISPR gRNA sequence
tgcttcctctccagtccccc

SEQ ID NO: 114092 - DNA, 20 bp, Artificial
  CRISPR gRNA sequence
gcttcctctccagtccccct

SEQ ID NO: 114093 - DNA, 20 bp, Artificial
  CRISPR gRNA sequence
cttcctctccagtccccctt

SEQ ID NO: 114094 - DNA, 20 bp, Artificial
  CRISPR gRNA sequence
cctctccagtcccccttgct

SEQ ID NO: 114095 - DNA, 20 bp, Artificial
  CRISPR gRNA sequence
ctctccagtcccccttgctg

SEQ ID NO: 114096 - DNA, 20 bp, Artificial
  CRISPR gRNA sequence
tccagtcccccttgctgcgc

SEQ ID NO: 114097 - DNA, 20 bp, Artificial
  CRISPR gRNA sequence
cagtcccccttgctgcgcct

SEQ ID NO: 114098 - DNA, 20 bp, Artificial
  CRISPR gRNA sequence
gctgcgccttctccactgtt

SEQ ID NO: 114099 - DNA, 20 bp, Artificial
  CRISPR gRNA sequence
ctgcgccttctccactgttg

SEQ ID NO: 114100 - DNA, 20 bp, Artificial
  CRISPR gRNA sequence
cgccttctccactgttgagt

SEQ ID NO: 114101 - DNA, 20 bp, Artificial
  CRISPR gRNA sequence
ctccactgttgagtagagac

SEQ ID NO: 114102 - DNA, 20 bp, Artificial
  CRISPR gRNA sequence
tccactgttgagtagagaca

SEQ ID NO: 114103 - DNA, 20 bp, Artificial
  CRISPR gRNA sequence
cactgttgagtagagacaat

SEQ ID NO: 114104 - DNA, 20 bp, Artificial
  CRISPR gRNA sequence
ttgagtagagacaatgtggt

SEQ ID NO: 114105 - DNA, 20 bp, Artificial
  CRISPR gRNA sequence
agtagagacaatgtggtata

SEQ ID NO: 114106 - DNA, 20 bp, Artificial
  CRISPR gRNA sequence
ggaacagtatactgtgagtg

SEQ ID NO: 114107 - DNA, 20 bp, Artificial
  CRISPR gRNA sequence
tgagtgtagtggtccaagct

SEQ ID NO: 114108 - DNA, 20 bp, Artificial
  CRISPR gRNA sequence
tcattaccaggtctgccatt

SEQ ID NO: 114109 - DNA, 20 bp, Artificial
  CRISPR gRNA sequence
cattaccaggtctgccatta

SEQ ID NO: 114110 - DNA, 20 bp, Artificial
  CRISPR gRNA sequence
attaccaggtctgccattaa

SEQ ID NO: 114111 - DNA, 20 bp, Artificial
  CRISPR gRNA sequence
ccaggtctgccattaaataa

SEQ ID NO: 114112 - DNA, 20 bp, Artificial
  CRISPR gRNA sequence
ccattaaataagcattctga

SEQ ID NO: 114113 - DNA, 20 bp, Artificial
  CRISPR gRNA sequence
aataagcattctgatcttgg

SEQ ID NO: 114114 - DNA, 20 bp, Artificial
  CRISPR gRNA sequence
tgatcttggccaagttattt

SEQ ID NO: 114115 - DNA, 20 bp, Artificial
  CRISPR gRNA sequence
atcttggccaagttatttaa

SEQ ID NO: 114116 - DNA, 20 bp, Artificial
  CRISPR gRNA sequence
ggccaagttatttaattgtc

SEQ ID NO: 114117 - DNA, 20 bp, Artificial
  CRISPR gRNA sequence
gccaagttatttaattgtcg

SEQ ID NO: 114118 - DNA, 20 bp, Artificial
  CRISPR gRNA sequence
tttaattgtcggtttgctca

SEQ ID NO: 114119 - DNA, 20 bp, Artificial
  CRISPR gRNA sequence
aattgtcggtttgctcatcc

SEQ ID NO: 114120 - DNA, 20 bp, Artificial
  CRISPR gRNA sequence
attgtcggtttgctcatcca

SEQ ID NO: 114121 - DNA, 20 bp, Artificial
  CRISPR gRNA sequence
tcggtttgctcatccaaaaa

SEQ ID NO: 114122 - DNA, 20 bp, Artificial
  CRISPR gRNA sequence
gctcatccaaaaataaaatt

SEQ ID NO: 114123 - DNA, 20 bp, Artificial
  CRISPR gRNA sequence
ctcatccaaaaataaaattt

SEQ ID NO: 114124 - DNA, 20 bp, Artificial
  CRISPR gRNA sequence
atccaaaaataaaatttata

SEQ ID NO: 114125 - DNA, 20 bp, Artificial
  CRISPR gRNA sequence
atatgagatgatatctaggg

SEQ ID NO: 114126 - DNA, 20 bp, Artificial
  CRISPR gRNA sequence
tatgagatgatatctagggt

SEQ ID NO: 114127 - DNA, 20 bp, Artificial
  CRISPR gRNA sequence
gggttcattctagctctaaa

SEQ ID NO: 114128 - DNA, 20 bp, Artificial
  CRISPR gRNA sequence
attctagctctaaattctgt

SEQ ID NO: 114129 - DNA, 20 bp, Artificial
  CRISPR gRNA sequence
tagctctaaattctgtgatt

SEQ ID NO: 114130 - DNA, 20 bp, Artificial
  CRISPR gRNA sequence
gctctaaattctgtgatttt

SEQ ID NO: 114131 - DNA, 20 bp, Artificial
  CRISPR gRNA sequence
taaattctgtgatttttatg

SEQ ID NO: 114132 - DNA, 20 bp, Artificial
  CRISPR gRNA sequence
aattctgtgatttttatggg

SEQ ID NO: 114133 - DNA, 20 bp, Artificial
  CRISPR gRNA sequence
tgtgatttttatggggtttt

SEQ ID NO: 114134 - DNA, 20 bp, Artificial
  CRISPR gRNA sequence
tgatttttatggggttttat

SEQ ID NO: 114135 - DNA, 20 bp, Artificial
  CRISPR gRNA sequence
ttatggggttttattttgct

SEQ ID NO: 114136 - DNA, 20 bp, Artificial
  CRISPR gRNA sequence
tatggggttttattttgcta

SEQ ID NO: 114137 - DNA, 20 bp, Artificial
  CRISPR gRNA sequence
atggggttttattttgctat

SEQ ID NO: 114138 - DNA, 20 bp, Artificial
  CRISPR gRNA sequence
tggggttttattttgctata

SEQ ID NO: 114139 - DNA, 20 bp, Artificial
  CRISPR gRNA sequence
tattttgctataaggaacct

SEQ ID NO: 114140 - DNA, 20 bp, Artificial
  CRISPR gRNA sequence
attttgctataaggaacctt

SEQ ID NO: 114141 - DNA, 20 bp, Artificial
  CRISPR gRNA sequence
ttttgctataaggaaccttc

SEQ ID NO: 114142 - DNA, 20 bp, Artificial
  CRISPR gRNA sequence
tgctataaggaaccttcaaa

SEQ ID NO: 114143 - DNA, 20 bp, Artificial
  CRISPR gRNA sequence
gctataaggaaccttcaaat

SEQ ID NO: 114144 - DNA, 20 bp, Artificial
  CRISPR gRNA sequence
ctataaggaaccttcaaata

SEQ ID NO: 114145 - DNA, 20 bp, Artificial
  CRISPR gRNA sequence
taaggaaccttcaaatagtt

SEQ ID NO: 114146 - DNA, 20 bp, Artificial
  CRISPR gRNA sequence
caaatagttatttccctgct

SEQ ID NO: 114147 - DNA, 20 bp, Artificial
  CRISPR gRNA sequence
aaatagttatttccctgctt

SEQ ID NO: 114148 - DNA, 20 bp, Artificial
  CRISPR gRNA sequence
tttccctgcttccaagtagg

SEQ ID NO: 114149 - DNA, 20 bp, Artificial
  CRISPR gRNA sequence
ccctgcttccaagtagggct

SEQ ID NO: 114150 - DNA, 20 bp, Artificial
  CRISPR gRNA sequence
cctgcttccaagtagggcta

SEQ ID NO: 114151 - DNA, 20 bp, Artificial
  CRISPR gRNA sequence
cttccaagtagggctataac

SEQ ID NO: 114152 - DNA, 20 bp, Artificial
  CRISPR gRNA sequence
ccaagtagggctataactaa

SEQ ID NO: 114153 - DNA, 20 bp, Artificial
  CRISPR gRNA sequence
caagtagggctataactaac

SEQ ID NO: 114154 - DNA, 20 bp, Artificial
  CRISPR gRNA sequence
taactaaccaagctgaaaaa

SEQ ID NO: 114155 - DNA, 20 bp, Artificial
  CRISPR gRNA sequence
accaagctgaaaaaaatata

SEQ ID NO: 114156 - DNA, 20 bp, Artificial
  CRISPR gRNA sequence
aaaaaaatatattctgttac

SEQ ID NO: 114157 - DNA, 20 bp, Artificial
  CRISPR gRNA sequence
tgttacgtaaataaagctct

SEQ ID NO: 114158 - DNA, 20 bp, Artificial
  CRISPR gRNA sequence
ttacgtaaataaagctctct

SEQ ID NO: 114159 - DNA, 20 bp, Artificial
  CRISPR gRNA sequence
cgtaaataaagctctctagg

SEQ ID NO: 114160 - DNA, 20 bp, Artificial
  CRISPR gRNA sequence
tctaggtgagattccatagc

SEQ ID NO: 114161 - DNA, 20 bp, Artificial
  CRISPR gRNA sequence
taggtgagattccatagcct

SEQ ID NO: 114162 - DNA, 20 bp, Artificial
  CRISPR gRNA sequence
ggtgagattccatagcctcc

SEQ ID NO: 114163 - DNA, 20 bp, Artificial
  CRISPR gRNA sequence
catagcctcccttacaatac

SEQ ID NO: 114164 - DNA, 20 bp, Artificial
  CRISPR gRNA sequence
ccttacaatacttaaggctt

SEQ ID NO: 114165 - DNA, 20 bp, Artificial
  CRISPR gRNA sequence
acaatacttaaggctttaat

SEQ ID NO: 114166 - DNA, 20 bp, Artificial
  CRISPR gRNA sequence
caatacttaaggctttaatc

SEQ ID NO: 114167 - DNA, 20 bp, Artificial
  CRISPR gRNA sequence
aaggctttaatcccctttgt

SEQ ID NO: 114168 - DNA, 20 bp, Artificial
  CRISPR gRNA sequence
aggctttaatcccctttgta

SEQ ID NO: 114169 - DNA, 20 bp, Artificial
  CRISPR gRNA sequence
taatcccctttgtataggag

SEQ ID NO: 114170 - DNA, 20 bp, Artificial
  CRISPR gRNA sequence
aatcccctttgtataggagt

SEQ ID NO: 114171 - DNA, 20 bp, Artificial
  CRISPR gRNA sequence
atcccctttgtataggagtt

SEQ ID NO: 114172 - DNA, 20 bp, Artificial
  CRISPR gRNA sequence
tgtataggagttttttttct

SEQ ID NO: 114173 - DNA, 20 bp, Artificial
  CRISPR gRNA sequence
gtataggagttttttttctc

SEQ ID NO: 114174 - DNA, 20 bp, Artificial
  CRISPR gRNA sequence
tataggagttttttttctca

SEQ ID NO: 114175 - DNA, 20 bp, Artificial
  CRISPR gRNA sequence
tttttctcattagtgttgag

SEQ ID NO: 114176 - DNA, 20 bp, Artificial
  CRISPR gRNA sequence
ttttctcattagtgttgagt

SEQ ID NO: 114177 - DNA, 20 bp, Artificial
  CRISPR gRNA sequence
tttctcattagtgttgagta

SEQ ID NO: 114178 - DNA, 20 bp, Artificial
  CRISPR gRNA sequence
ttctcattagtgttgagtag

SEQ ID NO: 114179 - DNA, 20 bp, Artificial
  CRISPR gRNA sequence
tctcattagtgttgagtagc

SEQ ID NO: 114180 - DNA, 20 bp, Artificial
  CRISPR gRNA sequence
ctcattagtgttgagtagcc

SEQ ID NO: 114181 - DNA, 20 bp, Artificial
  CRISPR gRNA sequence
tcattagtgttgagtagcca

SEQ ID NO: 114182 - DNA, 20 bp, Artificial
  CRISPR gRNA sequence
attagtgttgagtagccatt

SEQ ID NO: 114183 - DNA, 20 bp, Artificial
  CRISPR gRNA sequence
gtgttgagtagccatttttt

SEQ ID NO: 114184 - DNA, 20 bp, Artificial
  CRISPR gRNA sequence
agtagccattttttaaagaa

SEQ ID NO: 114185 - DNA, 20 bp, Artificial
  CRISPR gRNA sequence
tttaaagaagactacttctt

SEQ ID NO: 114186 - DNA, 20 bp, Artificial
  CRISPR gRNA sequence
ttaaagaagactacttctta

SEQ ID NO: 114187 - DNA, 20 bp, Artificial
  CRISPR gRNA sequence
taaagaagactacttcttaa

SEQ ID NO: 114188 - DNA, 20 bp, Artificial
  CRISPR gRNA sequence
aaagaagactacttcttaac

SEQ ID NO: 114189 - DNA, 20 bp, Artificial
  CRISPR gRNA sequence
aagaagactacttcttaacc

SEQ ID NO: 114190 - DNA, 20 bp, Artificial
  CRISPR gRNA sequence
cttcttaaccttttttgaat

SEQ ID NO: 114191 - DNA, 20 bp, Artificial
  CRISPR gRNA sequence
cttaaccttttttgaattgt

SEQ ID NO: 114192 - DNA, 20 bp, Artificial
  CRISPR gRNA sequence
ttaaccttttttgaattgta

SEQ ID NO: 114193 - DNA, 20 bp, Artificial
  CRISPR gRNA sequence
aaccttttttgaattgtatt

SEQ ID NO: 114194 - DNA, 20 bp, Artificial
  CRISPR gRNA sequence
accttttttgaattgtattc

SEQ ID NO: 114195 - DNA, 20 bp, Artificial
  CRISPR gRNA sequence
ttttgaattgtattctctat

SEQ ID NO: 114196 - DNA, 20 bp, Artificial
  CRISPR gRNA sequence
tttgaattgtattctctatt

SEQ ID NO: 114197 - DNA, 20 bp, Artificial
  CRISPR gRNA sequence
ttgaattgtattctctattt

SEQ ID NO: 114198 - DNA, 20 bp, Artificial
  CRISPR gRNA sequence
tgaattgtattctctatttt

SEQ ID NO: 114199 - DNA, 20 bp, Artificial
  CRISPR gRNA sequence
gaattgtattctctatttta

SEQ ID NO: 114200 - DNA, 20 bp, Artificial
  CRISPR gRNA sequence
aattgtattctctattttag

SEQ ID NO: 114201 - DNA, 20 bp, Artificial
  CRISPR gRNA sequence
tattctctattttagaatcc

SEQ ID NO: 114202 - DNA, 20 bp, Artificial
  CRISPR gRNA sequence
tctattttagaatcctagta

SEQ ID NO: 114203 - DNA, 20 bp, Artificial
  CRISPR gRNA sequence
tattttagaatcctagtaaa

SEQ ID NO: 114204 - DNA, 20 bp, Artificial
  CRISPR gRNA sequence
ttttagaatcctagtaaagc

SEQ ID NO: 114205 - DNA, 20 bp, Artificial
  CRISPR gRNA sequence
tagaatcctagtaaagcttg

SEQ ID NO: 114206 - DNA, 20 bp, Artificial
  CRISPR gRNA sequence
agaatcctagtaaagcttgc

SEQ ID NO: 114207 - DNA, 20 bp, Artificial
  CRISPR gRNA sequence
gaatcctagtaaagcttgca

SEQ ID NO: 114208 - DNA, 20 bp, Artificial
  CRISPR gRNA sequence
gtaaagcttgcaccctctaa

SEQ ID NO: 114209 - DNA, 20 bp, Artificial
  CRISPR gRNA sequence
gcaccctctaagaaaaagta

SEQ ID NO: 114210 - DNA, 20 bp, Artificial
  CRISPR gRNA sequence
caccctctaagaaaaagtag

SEQ ID NO: 114211 - DNA, 20 bp, Artificial
  CRISPR gRNA sequence
taagaaaaagtagagatgtc

SEQ ID NO: 114212 - DNA, 20 bp, Artificial
  CRISPR gRNA sequence
agaaaaagtagagatgtcca

SEQ ID NO: 114213 - DNA, 20 bp, Artificial
  CRISPR gRNA sequence
atgaaaaattctgcatataa

SEQ ID NO: 114214 - DNA, 20 bp, Artificial
  CRISPR gRNA sequence
tgcatataattttagattaa

SEQ ID NO: 114215 - DNA, 20 bp, Artificial
  CRISPR gRNA sequence
catataattttagattaaaa

SEQ ID NO: 114216 - DNA, 20 bp, Artificial
  CRISPR gRNA sequence
tagattaaaatccttggcct

SEQ ID NO: 114217 - DNA, 20 bp, Artificial
  CRISPR gRNA sequence
agattaaaatccttggcctg

SEQ ID NO: 114218 - DNA, 20 bp, Artificial
  CRISPR gRNA sequence
gattaaaatccttggcctga

SEQ ID NO: 114219 - DNA, 20 bp, Artificial
  CRISPR gRNA sequence
aaatccttggcctgagaaag

SEQ ID NO: 114220 - DNA, 20 bp, Artificial
  CRISPR gRNA sequence
ggcctgagaaagatactgga

SEQ ID NO: 114221 - DNA, 20 bp, Artificial
  CRISPR gRNA sequence
gcctgagaaagatactggaa

SEQ ID NO: 114222 - DNA, 20 bp, Artificial
  CRISPR gRNA sequence
agaaagatactggaaccaga

SEQ ID NO: 114223 - DNA, 20 bp, Artificial
  CRISPR gRNA sequence
gaaccagagagacagccaag

SEQ ID NO: 114224 - DNA, 20 bp, Artificial
  CRISPR gRNA sequence
gaagttggcatataataaaa

SEQ ID NO: 114225 - DNA, 20 bp, Artificial
  CRISPR gRNA sequence
gcatataataaaagtggtat

SEQ ID NO: 114226 - DNA, 20 bp, Artificial
  CRISPR gRNA sequence
aagaatgatacagaaaagaa

SEQ ID NO: 114227 - DNA, 20 bp, Artificial
  CRISPR gRNA sequence
atttctaattcatactgtat

SEQ ID NO: 114228 - DNA, 20 bp, Artificial
  CRISPR gRNA sequence
ctaattcatactgtatttta

SEQ ID NO: 114229 - DNA, 20 bp, Artificial
  CRISPR gRNA sequence
taattcatactgtattttaa

SEQ ID NO: 114230 - DNA, 20 bp, Artificial
  CRISPR gRNA sequence
attcatactgtattttaaaa

SEQ ID NO: 114231 - DNA, 20 bp, Artificial
  CRISPR gRNA sequence
atactgtattttaaaaaata

SEQ ID NO: 114232 - DNA, 20 bp, Artificial
  CRISPR gRNA sequence
tattttaaaaaatatttgct

SEQ ID NO: 114233 - DNA, 20 bp, Artificial
  CRISPR gRNA sequence
taaaaaatatttgctaggtg

SEQ ID NO: 114234 - DNA, 20 bp, Artificial
  CRISPR gRNA sequence
aaaaaatatttgctaggtgg

SEQ ID NO: 114235 - DNA, 20 bp, Artificial
  CRISPR gRNA sequence
aaaaatatttgctaggtgga

SEQ ID NO: 114236 - DNA, 20 bp, Artificial
  CRISPR gRNA sequence
gctaggtggattaaagatct

SEQ ID NO: 114237 - DNA, 20 bp, Artificial
  CRISPR gRNA sequence
ctaggtggattaaagatcta

SEQ ID NO: 114238 - DNA, 20 bp, Artificial
  CRISPR gRNA sequence
ggtggattaaagatctaaat

SEQ ID NO: 114239 - DNA, 20 bp, Artificial
  CRISPR gRNA sequence
aagatctaaatgtagaaaag

SEQ ID NO: 114240 - DNA, 20 bp, Artificial
  CRISPR gRNA sequence
aatgtagaaaagtaaacttg

SEQ ID NO: 114241 - DNA, 20 bp, Artificial
  CRISPR gRNA sequence
ggaaaattcaaaagaaaata

SEQ ID NO: 114242 - DNA, 20 bp, Artificial
  CRISPR gRNA sequence
gaaaattcaaaagaaaatat

SEQ ID NO: 114243 - DNA, 20 bp, Artificial
  CRISPR gRNA sequence
aaaagaaaatataagaattt

SEQ ID NO: 114244 - DNA, 20 bp, Artificial
  CRISPR gRNA sequence
ttatgctatagagaaggata

SEQ ID NO: 114245 - DNA, 20 bp, Artificial
  CRISPR gRNA sequence
tatgctatagagaaggatat

SEQ ID NO: 114246 - DNA, 20 bp, Artificial
  CRISPR gRNA sequence
atgctatagagaaggatatt

SEQ ID NO: 114247 - DNA, 20 bp, Artificial
  CRISPR gRNA sequence
tgctatagagaaggatattt

SEQ ID NO: 114248 - DNA, 20 bp, Artificial
  CRISPR gRNA sequence
tagagaaggatatttttaaa

SEQ ID NO: 114249 - DNA, 20 bp, Artificial
  CRISPR gRNA sequence
ttaaaaacaaattgactaaa

SEQ ID NO: 114250 - DNA, 20 bp, Artificial
  CRISPR gRNA sequence
taaaaacaaattgactaaaa

SEQ ID NO: 114251 - DNA, 20 bp, Artificial
  CRISPR gRNA sequence
aaaaacaaattgactaaaac

SEQ ID NO: 114252 - DNA, 20 bp, Artificial
  CRISPR gRNA sequence
aaaacaaattgactaaaaca

SEQ ID NO: 114253 - DNA, 20 bp, Artificial
  CRISPR gRNA sequence
actaaaacataatatgcatt

SEQ ID NO: 114254 - DNA, 20 bp, Artificial
  CRISPR gRNA sequence
aaacataatatgcattgaaa

SEQ ID NO: 114255 - DNA, 20 bp, Artificial
  CRISPR gRNA sequence
aaatacatcaaataaaagta

SEQ ID NO: 114256 - DNA, 20 bp, Artificial
  CRISPR gRNA sequence
ggaaaagatatttttaatac

SEQ ID NO: 114257 - DNA, 20 bp, Artificial
  CRISPR gRNA sequence
gaaaagatatttttaataca

SEQ ID NO: 114258 - DNA, 20 bp, Artificial
  CRISPR gRNA sequence
ttaatacatacaaccgagtt

SEQ ID NO: 114259 - DNA, 20 bp, Artificial
  CRISPR gRNA sequence
taatacatacaaccgagttt

SEQ ID NO: 114260 - DNA, 20 bp, Artificial
  CRISPR gRNA sequence
aatacatacaaccgagtttg

SEQ ID NO: 114261 - DNA, 20 bp, Artificial
  CRISPR gRNA sequence
atacatacaaccgagtttgt

SEQ ID NO: 114262 - DNA, 20 bp, Artificial
  CRISPR gRNA sequence
gtattcagaatatgtataaa

SEQ ID NO: 114263 - DNA, 20 bp, Artificial
  CRISPR gRNA sequence
tattcagaatatgtataaat

SEQ ID NO: 114264 - DNA, 20 bp, Artificial
  CRISPR gRNA sequence
agaatatgtataaataacgt

SEQ ID NO: 114265 - DNA, 20 bp, Artificial
  CRISPR gRNA sequence
atgtatttatacaaaaatag

SEQ ID NO: 114266 - DNA, 20 bp, Artificial
  CRISPR gRNA sequence
tgtatttatacaaaaatagg

SEQ ID NO: 114267 - DNA, 20 bp, Artificial
  CRISPR gRNA sequence
atacaaaaataggaaaatgg

SEQ ID NO: 114268 - DNA, 20 bp, Artificial
  CRISPR gRNA sequence
tacaaaaataggaaaatggg

SEQ ID NO: 114269 - DNA, 20 bp, Artificial
  CRISPR gRNA sequence
acagccaatataaacttaga

SEQ ID NO: 114270 - DNA, 20 bp, Artificial
  CRISPR gRNA sequence
agaaatgaagttggttcaca

SEQ ID NO: 114271 - DNA, 20 bp, Artificial
  CRISPR gRNA sequence
gaaatgaagttggttcacat

SEQ ID NO: 114272 - DNA, 20 bp, Artificial
  CRISPR gRNA sequence
gttcacataaccagataaat

SEQ ID NO: 114273 - DNA, 20 bp, Artificial
  CRISPR gRNA sequence
acataaccagataaatttgt

SEQ ID NO: 114274 - DNA, 20 bp, Artificial
  CRISPR gRNA sequence
gtttacttatttatttgcca

SEQ ID NO: 114275 - DNA, 20 bp, Artificial
  CRISPR gRNA sequence
tttacttatttatttgccaa

SEQ ID NO: 114276 - DNA, 20 bp, Artificial
  CRISPR gRNA sequence
acttatttatttgccaatac

SEQ ID NO: 114277 - DNA, 20 bp, Artificial
  CRISPR gRNA sequence
cttatttatttgccaatact

SEQ ID NO: 114278 - DNA, 20 bp, Artificial
  CRISPR gRNA sequence
atttatttgccaatactttc

SEQ ID NO: 114279 - DNA, 20 bp, Artificial
  CRISPR gRNA sequence
tttatttgccaatactttct

SEQ ID NO: 114280 - DNA, 20 bp, Artificial
  CRISPR gRNA sequence
atttgccaatactttctgaa

SEQ ID NO: 114281 - DNA, 20 bp, Artificial
  CRISPR gRNA sequence
tttgccaatactttctgaat

SEQ ID NO: 114282 - DNA, 20 bp, Artificial
  CRISPR gRNA sequence
gccaatactttctgaatgcc

SEQ ID NO: 114283 - DNA, 20 bp, Artificial
  CRISPR gRNA sequence
ccaatactttctgaatgcca

SEQ ID NO: 114284 - DNA, 20 bp, Artificial
  CRISPR gRNA sequence
tctgaatgccaattatgagc

SEQ ID NO: 114285 - DNA, 20 bp, Artificial
  CRISPR gRNA sequence
ctgaatgccaattatgagct

SEQ ID NO: 114286 - DNA, 20 bp, Artificial
  CRISPR gRNA sequence
tgaatgccaattatgagctg

SEQ ID NO: 114287 - DNA, 20 bp, Artificial
  CRISPR gRNA sequence
aatgccaattatgagctgag

SEQ ID NO: 114288 - DNA, 20 bp, Artificial
  CRISPR gRNA sequence
tgagctgagtatttggaaaa

SEQ ID NO: 114289 - DNA, 20 bp, Artificial
  CRISPR gRNA sequence
agtatttggaaaaaataatt

SEQ ID NO: 114290 - DNA, 20 bp, Artificial
  CRISPR gRNA sequence
ggaaaaaataattcagaaga

SEQ ID NO: 114291 - DNA, 20 bp, Artificial
  CRISPR gRNA sequence
gaaaaaataattcagaagac

SEQ ID NO: 114292 - DNA, 20 bp, Artificial
  CRISPR gRNA sequence
agaagacctaggcaatctat

SEQ ID NO: 114293 - DNA, 20 bp, Artificial
  CRISPR gRNA sequence
ggcaatctatcccctaacaa

SEQ ID NO: 114294 - DNA, 20 bp, Artificial
  CRISPR gRNA sequence
tcccctaacaaagtaggatc

SEQ ID NO: 114295 - DNA, 20 bp, Artificial
  CRISPR gRNA sequence
acaaagtaggatccatgaat

SEQ ID NO: 114296 - DNA, 20 bp, Artificial
  CRISPR gRNA sequence
taagacatggaacccattga

SEQ ID NO: 114297 - DNA, 20 bp, Artificial
  CRISPR gRNA sequence
agacatggaacccattgacc

SEQ ID NO: 114298 - DNA, 20 bp, Artificial
  CRISPR gRNA sequence
acctgtttttttcaccttcc

SEQ ID NO: 114299 - DNA, 20 bp, Artificial
  CRISPR gRNA sequence
tttttttcaccttccttcca

SEQ ID NO: 114300 - DNA, 20 bp, Artificial
  CRISPR gRNA sequence
ttttcaccttccttccatca

SEQ ID NO: 114301 - DNA, 20 bp, Artificial
  CRISPR gRNA sequence
tttcaccttccttccatcag

SEQ ID NO: 114302 - DNA, 20 bp, Artificial
  CRISPR gRNA sequence
ttcaccttccttccatcagt

SEQ ID NO: 114303 - DNA, 20 bp, Artificial
  CRISPR gRNA sequence
tcaccttccttccatcagta

SEQ ID NO: 114304 - DNA, 20 bp, Artificial
  CRISPR gRNA sequence
caccttccttccatcagtag

SEQ ID NO: 114305 - DNA, 20 bp, Artificial
  CRISPR gRNA sequence
accttccttccatcagtagt

SEQ ID NO: 114306 - DNA, 20 bp, Artificial
  CRISPR gRNA sequence
ccttccatcagtagtccttt

SEQ ID NO: 114307 - DNA, 20 bp, Artificial
  CRISPR gRNA sequence
cttccatcagtagtcctttt

SEQ ID NO: 114308 - DNA, 20 bp, Artificial
  CRISPR gRNA sequence
ccatcagtagtcctttttcc

SEQ ID NO: 114309 - DNA, 20 bp, Artificial
  CRISPR gRNA sequence
catcagtagtcctttttcct

SEQ ID NO: 114310 - DNA, 20 bp, Artificial
  CRISPR gRNA sequence
tttcctatcagctggtagac

SEQ ID NO: 114311 - DNA, 20 bp, Artificial
  CRISPR gRNA sequence
ttcctatcagctggtagact

SEQ ID NO: 114312 - DNA, 20 bp, Artificial
  CRISPR gRNA sequence
tcctatcagctggtagactt

SEQ ID NO: 114313 - DNA, 20 bp, Artificial
  CRISPR gRNA sequence
cctatcagctggtagacttt

SEQ ID NO: 114314 - DNA, 20 bp, Artificial
  CRISPR gRNA sequence
ctatcagctggtagactttg

SEQ ID NO: 114315 - DNA, 20 bp, Artificial
  CRISPR gRNA sequence
tcagctggtagactttgtga

SEQ ID NO: 114316 - DNA, 20 bp, Artificial
  CRISPR gRNA sequence
gtagactttgtgataactta

SEQ ID NO: 114317 - DNA, 20 bp, Artificial
  CRISPR gRNA sequence
tgtgataacttaaggttcta

SEQ ID NO: 114318 - DNA, 20 bp, Artificial
  CRISPR gRNA sequence
gtgataacttaaggttctag

SEQ ID NO: 114319 - DNA, 20 bp, Artificial
  CRISPR gRNA sequence
tgataacttaaggttctagg

SEQ ID NO: 114320 - DNA, 20 bp, Artificial
  CRISPR gRNA sequence
aaggttctaggcatgttctt

SEQ ID NO: 114321 - DNA, 20 bp, Artificial
  CRISPR gRNA sequence
aggttctaggcatgttcttc

SEQ ID NO: 114322 - DNA, 20 bp, Artificial
  CRISPR gRNA sequence
taggcatgttcttctttcca

SEQ ID NO: 114323 - DNA, 20 bp, Artificial
  CRISPR gRNA sequence
ggcatgttcttctttccaga

SEQ ID NO: 114324 - DNA, 20 bp, Artificial
  CRISPR gRNA sequence
ttctttccagaccaaggtgg

SEQ ID NO: 114325 - DNA, 20 bp, Artificial
  CRISPR gRNA sequence
ctttccagaccaaggtggtc

SEQ ID NO: 114326 - DNA, 20 bp, Artificial
  CRISPR gRNA sequence
tttccagaccaaggtggtcc

SEQ ID NO: 114327 - DNA, 20 bp, Artificial
  CRISPR gRNA sequence
tccagaccaaggtggtccca

SEQ ID NO: 114328 - DNA, 20 bp, Artificial
  CRISPR gRNA sequence
ccagaccaaggtggtcccaa

SEQ ID NO: 114329 - DNA, 20 bp, Artificial
  CRISPR gRNA sequence
cagaccaaggtggtcccaag

SEQ ID NO: 114330 - DNA, 20 bp, Artificial
  CRISPR gRNA sequence
aaattatggatggaaagtga

SEQ ID NO: 114331 - DNA, 20 bp, Artificial
  CRISPR gRNA sequence
tggatggaaagtgacctggc

SEQ ID NO: 114332 - DNA, 20 bp, Artificial
  CRISPR gRNA sequence
gctataaaaatctatctttc

SEQ ID NO: 114333 - DNA, 20 bp, Artificial
  CRISPR gRNA sequence
taaaaatctatctttctgaa

SEQ ID NO: 114334 - DNA, 20 bp, Artificial
  CRISPR gRNA sequence
tctttctgaaagtatcctcc

SEQ ID NO: 114335 - DNA, 20 bp, Artificial
  CRISPR gRNA sequence
tctgaaagtatcctccttcc

SEQ ID NO: 114336 - DNA, 20 bp, Artificial
  CRISPR gRNA sequence
ctgaaagtatcctccttcca

SEQ ID NO: 114337 - DNA, 20 bp, Artificial
  CRISPR gRNA sequence
tgaaagtatcctccttccag

SEQ ID NO: 114338 - DNA, 20 bp, Artificial
  CRISPR gRNA sequence
aaagtatcctccttccagac

SEQ ID NO: 114339 - DNA, 20 bp, Artificial
  CRISPR gRNA sequence
cttccagactgccatctatg

SEQ ID NO: 114340 - DNA, 20 bp, Artificial
  CRISPR gRNA sequence
ccagactgccatctatgttg

SEQ ID NO: 114341 - DNA, 20 bp, Artificial
  CRISPR gRNA sequence
cagactgccatctatgttga

SEQ ID NO: 114342 - DNA, 20 bp, Artificial
  CRISPR gRNA sequence
ccatctatgttgaagcaatg

SEQ ID NO: 114343 - DNA, 20 bp, Artificial
  CRISPR gRNA sequence
tgttgaagcaatgctcaaat

SEQ ID NO: 114344 - DNA, 20 bp, Artificial
  CRISPR gRNA sequence
aagcaatgctcaaataaaaa

SEQ ID NO: 114345 - DNA, 20 bp, Artificial
  CRISPR gRNA sequence
aaataaaaaaagtttgttga

SEQ ID NO: 114346 - DNA, 20 bp, Artificial
  CRISPR gRNA sequence
gttgatggaattaatggtca

SEQ ID NO: 114347 - DNA, 20 bp, Artificial
  CRISPR gRNA sequence
ttgatggaattaatggtcaa

SEQ ID NO: 114348 - DNA, 20 bp, Artificial
  CRISPR gRNA sequence
atggaattaatggtcaaaga

SEQ ID NO: 114349 - DNA, 20 bp, Artificial
  CRISPR gRNA sequence
atggtcaaagaagcaaagag

SEQ ID NO: 114350 - DNA, 20 bp, Artificial
  CRISPR gRNA sequence
cttagtactagccatgtatt

SEQ ID NO: 114351 - DNA, 20 bp, Artificial
  CRISPR gRNA sequence
agtactagccatgtattctg

SEQ ID NO: 114352 - DNA, 20 bp, Artificial
  CRISPR gRNA sequence
gtactagccatgtattctgg

SEQ ID NO: 114353 - DNA, 20 bp, Artificial
  CRISPR gRNA sequence
gccatgtattctggctttta

SEQ ID NO: 114354 - DNA, 20 bp, Artificial
  CRISPR gRNA sequence
tggcttttaagtttgggagg

SEQ ID NO: 114355 - DNA, 20 bp, Artificial
  CRISPR gRNA sequence
gcttttaagtttgggaggta

SEQ ID NO: 114356 - DNA, 20 bp, Artificial
  CRISPR gRNA sequence
ttaagtttgggaggtattct

SEQ ID NO: 114357 - DNA, 20 bp, Artificial
  CRISPR gRNA sequence
taagtttgggaggtattctt

SEQ ID NO: 114358 - DNA, 20 bp, Artificial
  CRISPR gRNA sequence
aagtttgggaggtattcttg

SEQ ID NO: 114359 - DNA, 20 bp, Artificial
  CRISPR gRNA sequence
agtttgggaggtattcttga

SEQ ID NO: 114360 - DNA, 20 bp, Artificial
  CRISPR gRNA sequence
gggaggtattcttgaatata

SEQ ID NO: 114361 - DNA, 20 bp, Artificial
  CRISPR gRNA sequence
ggaggtattcttgaatataa

SEQ ID NO: 114362 - DNA, 20 bp, Artificial
  CRISPR gRNA sequence
ttgaatataaaatacaagac

SEQ ID NO: 114363 - DNA, 20 bp, Artificial
  CRISPR gRNA sequence
gaatataaaatacaagacat

SEQ ID NO: 114364 - DNA, 20 bp, Artificial
  CRISPR gRNA sequence
aatataaaatacaagacatt

SEQ ID NO: 114365 - DNA, 20 bp, Artificial
  CRISPR gRNA sequence
tgagctatggggctctcctc

SEQ ID NO: 114366 - DNA, 20 bp, Artificial
  CRISPR gRNA sequence
gagctatggggctctcctca

SEQ ID NO: 114367 - DNA, 20 bp, Artificial
  CRISPR gRNA sequence
agctatggggctctcctcac

SEQ ID NO: 114368 - DNA, 20 bp, Artificial
  CRISPR gRNA sequence
tggggctctcctcactgctt

SEQ ID NO: 114369 - DNA, 20 bp, Artificial
  CRISPR gRNA sequence
tcctcactgctttctctttt

SEQ ID NO: 114370 - DNA, 20 bp, Artificial
  CRISPR gRNA sequence
ctcactgctttctcttttgc

SEQ ID NO: 114371 - DNA, 20 bp, Artificial
  CRISPR gRNA sequence
actgctttctcttttgcact

SEQ ID NO: 114372 - DNA, 20 bp, Artificial
  CRISPR gRNA sequence
ctttctcttttgcacttaaa

SEQ ID NO: 114373 - DNA, 20 bp, Artificial
  CRISPR gRNA sequence
tctcttttgcacttaaaaaa

SEQ ID NO: 114374 - DNA, 20 bp, Artificial
  CRISPR gRNA sequence
ctcttttgcacttaaaaaaa

SEQ ID NO: 114375 - DNA, 20 bp, Artificial
  CRISPR gRNA sequence
tcttttgcacttaaaaaaaa

SEQ ID NO: 114376 - DNA, 20 bp, Artificial
  CRISPR gRNA sequence
ttttgcacttaaaaaaaaaa

SEQ ID NO: 114377 - DNA, 20 bp, Artificial
  CRISPR gRNA sequence
ttgcacttaaaaaaaaaagt

SEQ ID NO: 114378 - DNA, 20 bp, Artificial
  CRISPR gRNA sequence
tgcacttaaaaaaaaaagtg

SEQ ID NO: 114379 - DNA, 20 bp, Artificial
  CRISPR gRNA sequence
gcacttaaaaaaaaaagtgt

SEQ ID NO: 114380 - DNA, 20 bp, Artificial
  CRISPR gRNA sequence
cacttaaaaaaaaaagtgtt

SEQ ID NO: 114381 - DNA, 20 bp, Artificial
  CRISPR gRNA sequence
aaaaaaaaaagtgttcacta

SEQ ID NO: 114382 - DNA, 20 bp, Artificial
  CRISPR gRNA sequence
aaaaaaaaagtgttcactag

SEQ ID NO: 114383 - DNA, 20 bp, Artificial
  CRISPR gRNA sequence
actagttatatgaaaatagg

SEQ ID NO: 114384 - DNA, 20 bp, Artificial
  CRISPR gRNA sequence
gttatatgaaaataggattt

SEQ ID NO: 114385 - DNA, 20 bp, Artificial
  CRISPR gRNA sequence
tatgaaaataggattttgta

SEQ ID NO: 114386 - DNA, 20 bp, Artificial
  CRISPR gRNA sequence
tgtacacccaacatttaaag

SEQ ID NO: 114387 - DNA, 20 bp, Artificial
  CRISPR gRNA sequence
gtacacccaacatttaaagg

SEQ ID NO: 114388 - DNA, 20 bp, Artificial
  CRISPR gRNA sequence
tacacccaacatttaaaggg

SEQ ID NO: 114389 - DNA, 20 bp, Artificial
  CRISPR gRNA sequence
aaagggttgtattgcagttt

SEQ ID NO: 114390 - DNA, 20 bp, Artificial
  CRISPR gRNA sequence
aagggttgtattgcagtttt

SEQ ID NO: 114391 - DNA, 20 bp, Artificial
  CRISPR gRNA sequence
tattgcagttttttagttcc

SEQ ID NO: 114392 - DNA, 20 bp, Artificial
  CRISPR gRNA sequence
cagttttttagttccaaaat

SEQ ID NO: 114393 - DNA, 20 bp, Artificial
  CRISPR gRNA sequence
tttagttccaaaatttagag

SEQ ID NO: 114394 - DNA, 20 bp, Artificial
  CRISPR gRNA sequence
ttagttccaaaatttagaga

SEQ ID NO: 114395 - DNA, 20 bp, Artificial
  CRISPR gRNA sequence
tagttccaaaatttagagaa

SEQ ID NO: 114396 - DNA, 20 bp, Artificial
  CRISPR gRNA sequence
agttccaaaatttagagaaa

SEQ ID NO: 114397 - DNA, 20 bp, Artificial
  CRISPR gRNA sequence
gttccaaaatttagagaaat

SEQ ID NO: 114398 - DNA, 20 bp, Artificial
  CRISPR gRNA sequence
caaaatttagagaaatattt

SEQ ID NO: 114399 - DNA, 20 bp, Artificial
  CRISPR gRNA sequence
agagaaatatttttcaagct

SEQ ID NO: 114400 - DNA, 20 bp, Artificial
  CRISPR gRNA sequence
gagaaatatttttcaagctt

SEQ ID NO: 114401 - DNA, 20 bp, Artificial
  CRISPR gRNA sequence
ttcaagcttcttgtcaggtt

SEQ ID NO: 114402 - DNA, 20 bp, Artificial
  CRISPR gRNA sequence
tcaagcttcttgtcaggttt

SEQ ID NO: 114403 - DNA, 20 bp, Artificial
  CRISPR gRNA sequence
caagcttcttgtcaggtttc

SEQ ID NO: 114404 - DNA, 20 bp, Artificial
  CRISPR gRNA sequence
aagcttcttgtcaggtttct

SEQ ID NO: 114405 - DNA, 20 bp, Artificial
  CRISPR gRNA sequence
cttgtcaggtttctgataac

SEQ ID NO: 114406 - DNA, 20 bp, Artificial
  CRISPR gRNA sequence
ttgtcaggtttctgataaca

SEQ ID NO: 114407 - DNA, 20 bp, Artificial
  CRISPR gRNA sequence
gtcaggtttctgataacact

SEQ ID NO: 114408 - DNA, 20 bp, Artificial
  CRISPR gRNA sequence
tcaggtttctgataacactc

SEQ ID NO: 114409 - DNA, 20 bp, Artificial
  CRISPR gRNA sequence
ctgataacactcctaataaa

SEQ ID NO: 114410 - DNA, 20 bp, Artificial
  CRISPR gRNA sequence
tgataacactcctaataaag

SEQ ID NO: 114411 - DNA, 20 bp, Artificial
  CRISPR gRNA sequence
ataacactcctaataaagtg

SEQ ID NO: 114412 - DNA, 20 bp, Artificial
  CRISPR gRNA sequence
ctaataaagtggctatagcc

SEQ ID NO: 114413 - DNA, 20 bp, Artificial
  CRISPR gRNA sequence
ataaagtggctatagccatt

SEQ ID NO: 114414 - DNA, 20 bp, Artificial
  CRISPR gRNA sequence
tagccattaaaaaaaagaaa

SEQ ID NO: 114415 - DNA, 20 bp, Artificial
  CRISPR gRNA sequence
aaaaaaagaaagaagataga

SEQ ID NO: 114416 - DNA, 20 bp, Artificial
  CRISPR gRNA sequence
ggatagcacacgatcccttg

SEQ ID NO: 114417 - DNA, 20 bp, Artificial
  CRISPR gRNA sequence
gatagcacacgatcccttgc

SEQ ID NO: 114418 - DNA, 20 bp, Artificial
  CRISPR gRNA sequence
gctttccataattgctttat

SEQ ID NO: 114419 - DNA, 20 bp, Artificial
  CRISPR gRNA sequence
ctttccataattgctttata

SEQ ID NO: 114420 - DNA, 20 bp, Artificial
  CRISPR gRNA sequence
tccataattgctttataagg

SEQ ID NO: 114421 - DNA, 20 bp, Artificial
  CRISPR gRNA sequence
ccataattgctttataaggt

SEQ ID NO: 114422 - DNA, 20 bp, Artificial
  CRISPR gRNA sequence
cataattgctttataaggtt

SEQ ID NO: 114423 - DNA, 20 bp, Artificial
  CRISPR gRNA sequence
ctttataaggtttagctatc

SEQ ID NO: 114424 - DNA, 20 bp, Artificial
  CRISPR gRNA sequence
tataaggtttagctatccaa

SEQ ID NO: 114425 - DNA, 20 bp, Artificial
  CRISPR gRNA sequence
ataaggtttagctatccaat

SEQ ID NO: 114426 - DNA, 20 bp, Artificial
  CRISPR gRNA sequence
taaggtttagctatccaatc

SEQ ID NO: 114427 - DNA, 20 bp, Artificial
  CRISPR gRNA sequence
agctatccaatcctaggacc

SEQ ID NO: 114428 - DNA, 20 bp, Artificial
  CRISPR gRNA sequence
gctatccaatcctaggacca

SEQ ID NO: 114429 - DNA, 20 bp, Artificial
  CRISPR gRNA sequence
tccaatcctaggaccaaata

SEQ ID NO: 114430 - DNA, 20 bp, Artificial
  CRISPR gRNA sequence
ggaccaaataggagatacaa

SEQ ID NO: 114431 - DNA, 20 bp, Artificial
  CRISPR gRNA sequence
aatcaacaaaaatttgacaa

SEQ ID NO: 114432 - DNA, 20 bp, Artificial
  CRISPR gRNA sequence
gacaaacattaatgacagta

SEQ ID NO: 114433 - DNA, 20 bp, Artificial
  CRISPR gRNA sequence
acaaacattaatgacagtag

SEQ ID NO: 114434 - DNA, 20 bp, Artificial
  CRISPR gRNA sequence
atgacagtagtgagtattgg

SEQ ID NO: 114435 - DNA, 20 bp, Artificial
  CRISPR gRNA sequence
gtaattggaaactaatagga

SEQ ID NO: 114436 - DNA, 20 bp, Artificial
  CRISPR gRNA sequence
gaaactaataggaggaatat

SEQ ID NO: 114437 - DNA, 20 bp, Artificial
  CRISPR gRNA sequence
ataggaggaatataatctgt

SEQ ID NO: 114438 - DNA, 20 bp, Artificial
  CRISPR gRNA sequence
tcacattgccttaattatct

SEQ ID NO: 114439 - DNA, 20 bp, Artificial
  CRISPR gRNA sequence
ccttaattatctattaccat

SEQ ID NO: 114440 - DNA, 20 bp, Artificial
  CRISPR gRNA sequence
aattatctattaccatataa

SEQ ID NO: 114441 - DNA, 20 bp, Artificial
  CRISPR gRNA sequence
attatctattaccatataac

SEQ ID NO: 114442 - DNA, 20 bp, Artificial
  CRISPR gRNA sequence
tctattaccatataacaaat

SEQ ID NO: 114443 - DNA, 20 bp, Artificial
  CRISPR gRNA sequence
ttaccatataacaaattatc

SEQ ID NO: 114444 - DNA, 20 bp, Artificial
  CRISPR gRNA sequence
ccatataacaaattatccta

SEQ ID NO: 114445 - DNA, 20 bp, Artificial
  CRISPR gRNA sequence
tcctagaagttagcagctta

SEQ ID NO: 114446 - DNA, 20 bp, Artificial
  CRISPR gRNA sequence
gaagttagcagcttaaaaca

SEQ ID NO: 114447 - DNA, 20 bp, Artificial
  CRISPR gRNA sequence
gcagcttaaaacaacaaaca

SEQ ID NO: 114448 - DNA, 20 bp, Artificial
  CRISPR gRNA sequence
aaaacaacaaacatttggcc

SEQ ID NO: 114449 - DNA, 20 bp, Artificial
  CRISPR gRNA sequence
aaacaacaaacatttggccg

SEQ ID NO: 114450 - DNA, 20 bp, Artificial
  CRISPR gRNA sequence
ggccggtgcggtggcccaca

SEQ ID NO: 114451 - DNA, 20 bp, Artificial
  CRISPR gRNA sequence
gccggtgcggtggcccacac

SEQ ID NO: 114452 - DNA, 20 bp, Artificial
  CRISPR gRNA sequence
taatcccagcactttgggtg

SEQ ID NO: 114453 - DNA, 20 bp, Artificial
  CRISPR gRNA sequence
tgggtggccgaggcgggtgg

SEQ ID NO: 114454 - DNA, 20 bp, Artificial
  CRISPR gRNA sequence
gggtggccgaggcgggtgga

SEQ ID NO: 114455 - DNA, 20 bp, Artificial
  CRISPR gRNA sequence
ggtggccgaggcgggtggat

SEQ ID NO: 114456 - DNA, 20 bp, Artificial
  CRISPR gRNA sequence
gttaacacagtgaaaccccg

SEQ ID NO: 114457 - DNA, 20 bp, Artificial
  CRISPR gRNA sequence
acacagtgaaaccccgtctc

SEQ ID NO: 114458 - DNA, 20 bp, Artificial
  CRISPR gRNA sequence
tactaaaaagacaaaaaaaa

SEQ ID NO: 114459 - DNA, 20 bp, Artificial
  CRISPR gRNA sequence
ctaaaaagacaaaaaaaaaa

SEQ ID NO: 114460 - DNA, 20 bp, Artificial
  CRISPR gRNA sequence
aaaagacaaaaaaaaaatta

SEQ ID NO: 114461 - DNA, 20 bp, Artificial
  CRISPR gRNA sequence
agccaggcgtgatggcggac

SEQ ID NO: 114462 - DNA, 20 bp, Artificial
  CRISPR gRNA sequence
tagtcccagctactcgggag

SEQ ID NO: 114463 - DNA, 20 bp, Artificial
  CRISPR gRNA sequence
ctcgggaggctgaggcagga

SEQ ID NO: 114464 - DNA, 20 bp, Artificial
  CRISPR gRNA sequence
gggaggctgaggcaggagaa

SEQ ID NO: 114465 - DNA, 20 bp, Artificial
  CRISPR gRNA sequence
aggcaggagaatggcatgaa

SEQ ID NO: 114466 - DNA, 20 bp, Artificial
  CRISPR gRNA sequence
gcagtgagccaagatcacac

SEQ ID NO: 114467 - DNA, 20 bp, Artificial
  CRISPR gRNA sequence
cagtgagccaagatcacacc

SEQ ID NO: 114468 - DNA, 20 bp, Artificial
  CRISPR gRNA sequence
cactccagcctgagccacag

SEQ ID NO: 114469 - DNA, 20 bp, Artificial
  CRISPR gRNA sequence
cagcctgagccacagagcga

SEQ ID NO: 114470 - DNA, 20 bp, Artificial
  CRISPR gRNA sequence
agccacagagcgacactccg

SEQ ID NO: 114471 - DNA, 20 bp, Artificial
  CRISPR gRNA sequence
cgtctccaaaaaaaaaaaaa

SEQ ID NO: 114472 - DNA, 20 bp, Artificial
  CRISPR gRNA sequence
caaaaaaaaaaaaaaaaaaa

SEQ ID NO: 114473 - DNA, 20 bp, Artificial
  CRISPR gRNA sequence
attttatagtttctgtgagt

SEQ ID NO: 114474 - DNA, 20 bp, Artificial
  CRISPR gRNA sequence
ttttatagtttctgtgagtt

SEQ ID NO: 114475 - DNA, 20 bp, Artificial
  CRISPR gRNA sequence
tatagtttctgtgagttagg

SEQ ID NO: 114476 - DNA, 20 bp, Artificial
  CRISPR gRNA sequence
atagtttctgtgagttagga

SEQ ID NO: 114477 - DNA, 20 bp, Artificial
  CRISPR gRNA sequence
tagtttctgtgagttaggaa

SEQ ID NO: 114478 - DNA, 20 bp, Artificial
  CRISPR gRNA sequence
ctgtgagttaggaatcctga

SEQ ID NO: 114479 - DNA, 20 bp, Artificial
  CRISPR gRNA sequence
tgtgagttaggaatcctgac

SEQ ID NO: 114480 - DNA, 20 bp, Artificial
  CRISPR gRNA sequence
tgagttaggaatcctgacac

SEQ ID NO: 114481 - DNA, 20 bp, Artificial
  CRISPR gRNA sequence
ggaatcctgacacagctgtg

SEQ ID NO: 114482 - DNA, 20 bp, Artificial
  CRISPR gRNA sequence
acacagctgtgttggattct

SEQ ID NO: 114483 - DNA, 20 bp, Artificial
  CRISPR gRNA sequence
tgttggattctttcaaggtc

SEQ ID NO: 114484 - DNA, 20 bp, Artificial
  CRISPR gRNA sequence
gattctttcaaggtcctctc

SEQ ID NO: 114485 - DNA, 20 bp, Artificial
  CRISPR gRNA sequence
tttcaaggtcctctcaaggc

SEQ ID NO: 114486 - DNA, 20 bp, Artificial
  CRISPR gRNA sequence
tcaaggtcctctcaaggccc

SEQ ID NO: 114487 - DNA, 20 bp, Artificial
  CRISPR gRNA sequence
caaggtcctctcaaggccct

SEQ ID NO: 114488 - DNA, 20 bp, Artificial
  CRISPR gRNA sequence
aaggtcctctcaaggccctt

SEQ ID NO: 114489 - DNA, 20 bp, Artificial
  CRISPR gRNA sequence
tcaaggcccttatcaaggtg

SEQ ID NO: 114490 - DNA, 20 bp, Artificial
  CRISPR gRNA sequence
aaggcccttatcaaggtgtt

SEQ ID NO: 114491 - DNA, 20 bp, Artificial
  CRISPR gRNA sequence
atcaaggtgttgtcctgggc

SEQ ID NO: 114492 - DNA, 20 bp, Artificial
  CRISPR gRNA sequence
tcaaggtgttgtcctgggct

SEQ ID NO: 114493 - DNA, 20 bp, Artificial
  CRISPR gRNA sequence
tcctgggctgcagtcacatt

SEQ ID NO: 114494 - DNA, 20 bp, Artificial
  CRISPR gRNA sequence
ggctgcagtcacatttgact

SEQ ID NO: 114495 - DNA, 20 bp, Artificial
  CRISPR gRNA sequence
cagtcacatttgactagagt

SEQ ID NO: 114496 - DNA, 20 bp, Artificial
  CRISPR gRNA sequence
gactagagtagaatacattt

SEQ ID NO: 114497 - DNA, 20 bp, Artificial
  CRISPR gRNA sequence
actagagtagaatacatttt

SEQ ID NO: 114498 - DNA, 20 bp, Artificial
  CRISPR gRNA sequence
gagtagaatacattttgggt

SEQ ID NO: 114499 - DNA, 20 bp, Artificial
  CRISPR gRNA sequence
tgggttttttctttgtttgt

SEQ ID NO: 114500 - DNA, 20 bp, Artificial
  CRISPR gRNA sequence
gggttttttctttgtttgtt

SEQ ID NO: 114501 - DNA, 20 bp, Artificial
  CRISPR gRNA sequence
ggttttttctttgtttgttt

SEQ ID NO: 114502 - DNA, 20 bp, Artificial
  CRISPR gRNA sequence
tttctttgtttgtttttttg

SEQ ID NO: 114503 - DNA, 20 bp, Artificial
  CRISPR gRNA sequence
ttctttgtttgtttttttga

SEQ ID NO: 114504 - DNA, 20 bp, Artificial
  CRISPR gRNA sequence
tctttgtttgtttttttgag

SEQ ID NO: 114505 - DNA, 20 bp, Artificial
  CRISPR gRNA sequence
ctttgtttgtttttttgaga

SEQ ID NO: 114506 - DNA, 20 bp, Artificial
  CRISPR gRNA sequence
tttgtttgtttttttgagac

SEQ ID NO: 114507 - DNA, 20 bp, Artificial
  CRISPR gRNA sequence
tgtttgtttttttgagacag

SEQ ID NO: 114508 - DNA, 20 bp, Artificial
  CRISPR gRNA sequence
gtttgtttttttgagacagt

SEQ ID NO: 114509 - DNA, 20 bp, Artificial
  CRISPR gRNA sequence
tttgtttttttgagacagtt

SEQ ID NO: 114510 - DNA, 20 bp, Artificial
  CRISPR gRNA sequence
gtttttttgagacagttact

SEQ ID NO: 114511 - DNA, 20 bp, Artificial
  CRISPR gRNA sequence
tttttttgagacagttactc

SEQ ID NO: 114512 - DNA, 20 bp, Artificial
  CRISPR gRNA sequence
ttttgagacagttactcgct

SEQ ID NO: 114513 - DNA, 20 bp, Artificial
  CRISPR gRNA sequence
tttgagacagttactcgctc

SEQ ID NO: 114514 - DNA, 20 bp, Artificial
  CRISPR gRNA sequence
ttgagacagttactcgctct

SEQ ID NO: 114515 - DNA, 20 bp, Artificial
  CRISPR gRNA sequence
tgagacagttactcgctctg

SEQ ID NO: 114516 - DNA, 20 bp, Artificial
  CRISPR gRNA sequence
gagacagttactcgctctgt

SEQ ID NO: 114517 - DNA, 20 bp, Artificial
  CRISPR gRNA sequence
agacagttactcgctctgtt

SEQ ID NO: 114518 - DNA, 20 bp, Artificial
  CRISPR gRNA sequence
ctcgctctgttgcctaggct

SEQ ID NO: 114519 - DNA, 20 bp, Artificial
  CRISPR gRNA sequence
gctctgttgcctaggctgga

SEQ ID NO: 114520 - DNA, 20 bp, Artificial
  CRISPR gRNA sequence
tgttgcctaggctggaatgc

SEQ ID NO: 114521 - DNA, 20 bp, Artificial
  CRISPR gRNA sequence
ttgcctaggctggaatgcag

SEQ ID NO: 114522 - DNA, 20 bp, Artificial
  CRISPR gRNA sequence
cctaggctggaatgcagtgg

SEQ ID NO: 114523 - DNA, 20 bp, Artificial
  CRISPR gRNA sequence
ggctggaatgcagtggtgcg

SEQ ID NO: 114524 - DNA, 20 bp, Artificial
  CRISPR gRNA sequence
gaatgcagtggtgcggatct

SEQ ID NO: 114525 - DNA, 20 bp, Artificial
  CRISPR gRNA sequence
ggctcactgcaacctctgcc

SEQ ID NO: 114526 - DNA, 20 bp, Artificial
  CRISPR gRNA sequence
gctcactgcaacctctgcct

SEQ ID NO: 114527 - DNA, 20 bp, Artificial
  CRISPR gRNA sequence
actgcaacctctgcctccca

SEQ ID NO: 114528 - DNA, 20 bp, Artificial
  CRISPR gRNA sequence
caacctctgcctcccaggct

SEQ ID NO: 114529 - DNA, 20 bp, Artificial
  CRISPR gRNA sequence
tgcctcccaggctcaaatga

SEQ ID NO: 114530 - DNA, 20 bp, Artificial
  CRISPR gRNA sequence
cctcccaggctcaaatgatc

SEQ ID NO: 114531 - DNA, 20 bp, Artificial
  CRISPR gRNA sequence
ccaggctcaaatgatcctcc

SEQ ID NO: 114532 - DNA, 20 bp, Artificial
  CRISPR gRNA sequence
aaatgatcctcccacctcag

SEQ ID NO: 114533 - DNA, 20 bp, Artificial
  CRISPR gRNA sequence
ccacctcagttccccaagta

SEQ ID NO: 114534 - DNA, 20 bp, Artificial
  CRISPR gRNA sequence
agttccccaagtagctggga

SEQ ID NO: 114535 - DNA, 20 bp, Artificial
  CRISPR gRNA sequence
cccaagtagctgggaccaca

SEQ ID NO: 114536 - DNA, 20 bp, Artificial
  CRISPR gRNA sequence
ggaccacaggcatgtcctac

SEQ ID NO: 114537 - DNA, 20 bp, Artificial
  CRISPR gRNA sequence
ccatgcctggataatttttg

SEQ ID NO: 114538 - DNA, 20 bp, Artificial
  CRISPR gRNA sequence
gataatttttgtatttttca

SEQ ID NO: 114539 - DNA, 20 bp, Artificial
  CRISPR gRNA sequence
ttgtatttttcagtagatac

SEQ ID NO: 114540 - DNA, 20 bp, Artificial
  CRISPR gRNA sequence
tgtatttttcagtagataca

SEQ ID NO: 114541 - DNA, 20 bp, Artificial
  CRISPR gRNA sequence
gtatttttcagtagatacag

SEQ ID NO: 114542 - DNA, 20 bp, Artificial
  CRISPR gRNA sequence
tatttttcagtagatacagg

SEQ ID NO: 114543 - DNA, 20 bp, Artificial
  CRISPR gRNA sequence
ttcagtagatacagggtttt

SEQ ID NO: 114544 - DNA, 20 bp, Artificial
  CRISPR gRNA sequence
tcagtagatacagggttttg

SEQ ID NO: 114545 - DNA, 20 bp, Artificial
  CRISPR gRNA sequence
cagtagatacagggttttgc

SEQ ID NO: 114546 - DNA, 20 bp, Artificial
  CRISPR gRNA sequence
agtagatacagggttttgcc

SEQ ID NO: 114547 - DNA, 20 bp, Artificial
  CRISPR gRNA sequence
tgccatgttgcccaggctgg

SEQ ID NO: 114548 - DNA, 20 bp, Artificial
  CRISPR gRNA sequence
gccatgttgcccaggctggt

SEQ ID NO: 114549 - DNA, 20 bp, Artificial
  CRISPR gRNA sequence
ccatgttgcccaggctggtc

SEQ ID NO: 114550 - DNA, 20 bp, Artificial
  CRISPR gRNA sequence
cccaggctggtctcgaactc

SEQ ID NO: 114551 - DNA, 20 bp, Artificial
  CRISPR gRNA sequence
gtctcgaactcctgacctaa

SEQ ID NO: 114552 - DNA, 20 bp, Artificial
  CRISPR gRNA sequence
gaactcctgacctaatctgc

SEQ ID NO: 114553 - DNA, 20 bp, Artificial
  CRISPR gRNA sequence
ctgacctaatctgctcgcct

SEQ ID NO: 114554 - DNA, 20 bp, Artificial
  CRISPR gRNA sequence
acctaatctgctcgcctcag

SEQ ID NO: 114555 - DNA, 20 bp, Artificial
  CRISPR gRNA sequence
atctgctcgcctcagcctcc

SEQ ID NO: 114556 - DNA, 20 bp, Artificial
  CRISPR gRNA sequence
ctcgcctcagcctcctgaag

SEQ ID NO: 114557 - DNA, 20 bp, Artificial
  CRISPR gRNA sequence
gcctcagcctcctgaagtgc

SEQ ID NO: 114558 - DNA, 20 bp, Artificial
  CRISPR gRNA sequence
agcctcctgaagtgctggga

SEQ ID NO: 114559 - DNA, 20 bp, Artificial
  CRISPR gRNA sequence
ctgaagtgctgggattatgg

SEQ ID NO: 114560 - DNA, 20 bp, Artificial
  CRISPR gRNA sequence
aagtgctgggattatgggca

SEQ ID NO: 114561 - DNA, 20 bp, Artificial
  CRISPR gRNA sequence
ggattatgggcataagccat

SEQ ID NO: 114562 - DNA, 20 bp, Artificial
  CRISPR gRNA sequence
tgggcataagccattgtacc

SEQ ID NO: 114563 - DNA, 20 bp, Artificial
  CRISPR gRNA sequence
tacccggctttcagcatttt

SEQ ID NO: 114564 - DNA, 20 bp, Artificial
  CRISPR gRNA sequence
tcagcatttttaatatatat

SEQ ID NO: 114565 - DNA, 20 bp, Artificial
  CRISPR gRNA sequence
cagcatttttaatatatata

SEQ ID NO: 114566 - DNA, 20 bp, Artificial
  CRISPR gRNA sequence
agcatttttaatatatatag

SEQ ID NO: 114567 - DNA, 20 bp, Artificial
  CRISPR gRNA sequence
ttaatatatatagtatttcc

SEQ ID NO: 114568 - DNA, 20 bp, Artificial
  CRISPR gRNA sequence
taatatatatagtatttcct

SEQ ID NO: 114569 - DNA, 20 bp, Artificial
  CRISPR gRNA sequence
aatatatatagtatttcctc

SEQ ID NO: 114570 - DNA, 20 bp, Artificial
  CRISPR gRNA sequence
atatatatagtatttcctct

SEQ ID NO: 114571 - DNA, 20 bp, Artificial
  CRISPR gRNA sequence
cctctgtaaaaaagtacttc

SEQ ID NO: 114572 - DNA, 20 bp, Artificial
  CRISPR gRNA sequence
ctctgtaaaaaagtacttca

SEQ ID NO: 114573 - DNA, 20 bp, Artificial
  CRISPR gRNA sequence
tgtaaaaaagtacttcatca

SEQ ID NO: 114574 - DNA, 20 bp, Artificial
  CRISPR gRNA sequence
taaaaaagtacttcatcatt

SEQ ID NO: 114575 - DNA, 20 bp, Artificial
  CRISPR gRNA sequence
catcattcaccaaaatggca

SEQ ID NO: 114576 - DNA, 20 bp, Artificial
  CRISPR gRNA sequence
atcattcaccaaaatggcaa

SEQ ID NO: 114577 - DNA, 20 bp, Artificial
  CRISPR gRNA sequence
accaaaatggcaagattaaa

SEQ ID NO: 114578 - DNA, 20 bp, Artificial
  CRISPR gRNA sequence
aaaaataataataaagcact

SEQ ID NO: 114579 - DNA, 20 bp, Artificial
  CRISPR gRNA sequence
tagagtgtattttatttttt

SEQ ID NO: 114580 - DNA, 20 bp, Artificial
  CRISPR gRNA sequence
agagtgtattttattttttt

SEQ ID NO: 114581 - DNA, 20 bp, Artificial
  CRISPR gRNA sequence
gagtgtattttattttttta

SEQ ID NO: 114582 - DNA, 20 bp, Artificial
  CRISPR gRNA sequence
tatttttttatttttttgag

SEQ ID NO: 114583 - DNA, 20 bp, Artificial
  CRISPR gRNA sequence
atttttttatttttttgaga

SEQ ID NO: 114584 - DNA, 20 bp, Artificial
  CRISPR gRNA sequence
tttttttatttttttgagac

SEQ ID NO: 114585 - DNA, 20 bp, Artificial
  CRISPR gRNA sequence
ttttatttttttgagacgga

SEQ ID NO: 114586 - DNA, 20 bp, Artificial
  CRISPR gRNA sequence
tttatttttttgagacggaa

SEQ ID NO: 114587 - DNA, 20 bp, Artificial
  CRISPR gRNA sequence
ttatttttttgagacggaat

SEQ ID NO: 114588 - DNA, 20 bp, Artificial
  CRISPR gRNA sequence
tatttttttgagacggaatc

SEQ ID NO: 114589 - DNA, 20 bp, Artificial
  CRISPR gRNA sequence
atttttttgagacggaatct

SEQ ID NO: 114590 - DNA, 20 bp, Artificial
  CRISPR gRNA sequence
tttttttgagacggaatctc

SEQ ID NO: 114591 - DNA, 20 bp, Artificial
  CRISPR gRNA sequence
ttttgagacggaatctcgct

SEQ ID NO: 114592 - DNA, 20 bp, Artificial
  CRISPR gRNA sequence
tttgagacggaatctcgctc

SEQ ID NO: 114593 - DNA, 20 bp, Artificial
  CRISPR gRNA sequence
ttgagacggaatctcgctct

SEQ ID NO: 114594 - DNA, 20 bp, Artificial
  CRISPR gRNA sequence
tgagacggaatctcgctctg

SEQ ID NO: 114595 - DNA, 20 bp, Artificial
  CRISPR gRNA sequence
gagacggaatctcgctctgt

SEQ ID NO: 114596 - DNA, 20 bp, Artificial
  CRISPR gRNA sequence
agacggaatctcgctctgtc

SEQ ID NO: 114597 - DNA, 20 bp, Artificial
  CRISPR gRNA sequence
gctctgtcgcccaggctgga

SEQ ID NO: 114598 - DNA, 20 bp, Artificial
  CRISPR gRNA sequence
tgtcgcccaggctggagtgc

SEQ ID NO: 114599 - DNA, 20 bp, Artificial
  CRISPR gRNA sequence
tcgcccaggctggagtgcag

SEQ ID NO: 114600 - DNA, 20 bp, Artificial
  CRISPR gRNA sequence
gagtgcagtggcgtgatctc

SEQ ID NO: 114601 - DNA, 20 bp, Artificial
  CRISPR gRNA sequence
ggctcactgcaacctccgcc

SEQ ID NO: 114602 - DNA, 20 bp, Artificial
  CRISPR gRNA sequence
actgcaacctccgcctccgg

SEQ ID NO: 114603 - DNA, 20 bp, Artificial
  CRISPR gRNA sequence
caacctccgcctccggttca

SEQ ID NO: 114604 - DNA, 20 bp, Artificial
  CRISPR gRNA sequence
cgcctccggttcaagtgatt

SEQ ID NO: 114605 - DNA, 20 bp, Artificial
  CRISPR gRNA sequence
cggttcaagtgattttccgg

SEQ ID NO: 114606 - DNA, 20 bp, Artificial
  CRISPR gRNA sequence
aagtgattttccggcctcag

SEQ ID NO: 114607 - DNA, 20 bp, Artificial
  CRISPR gRNA sequence
tccggcctcagtctcccaag

SEQ ID NO: 114608 - DNA, 20 bp, Artificial
  CRISPR gRNA sequence
ccggcctcagtctcccaagt

SEQ ID NO: 114609 - DNA, 20 bp, Artificial
  CRISPR gRNA sequence
cggcctcagtctcccaagta

SEQ ID NO: 114610 - DNA, 20 bp, Artificial
  CRISPR gRNA sequence
agtctcccaagtagctggga

SEQ ID NO: 114611 - DNA, 20 bp, Artificial
  CRISPR gRNA sequence
ccaagtagctgggattacag

SEQ ID NO: 114612 - DNA, 20 bp, Artificial
  CRISPR gRNA sequence
ggattacaggcatgcaccac

SEQ ID NO: 114613 - DNA, 20 bp, Artificial
  CRISPR gRNA sequence
caggcatgcaccaccatgcc

SEQ ID NO: 114614 - DNA, 20 bp, Artificial
  CRISPR gRNA sequence
atctttgtatttttagtaga

SEQ ID NO: 114615 - DNA, 20 bp, Artificial
  CRISPR gRNA sequence
tgtatttttagtagagacag

SEQ ID NO: 114616 - DNA, 20 bp, Artificial
  CRISPR gRNA sequence
gtatttttagtagagacagg

SEQ ID NO: 114617 - DNA, 20 bp, Artificial
  CRISPR gRNA sequence
tatttttagtagagacaggg

SEQ ID NO: 114618 - DNA, 20 bp, Artificial
  CRISPR gRNA sequence
ttagtagagacagggtttca

SEQ ID NO: 114619 - DNA, 20 bp, Artificial
  CRISPR gRNA sequence
tagtagagacagggtttcat

SEQ ID NO: 114620 - DNA, 20 bp, Artificial
  CRISPR gRNA sequence
agtagagacagggtttcatc

SEQ ID NO: 114621 - DNA, 20 bp, Artificial
  CRISPR gRNA sequence
gtagagacagggtttcatca

SEQ ID NO: 114622 - DNA, 20 bp, Artificial
  CRISPR gRNA sequence
catcatgttggccaggctgg

SEQ ID NO: 114623 - DNA, 20 bp, Artificial
  CRISPR gRNA sequence
atcatgttggccaggctggt

SEQ ID NO: 114624 - DNA, 20 bp, Artificial
  CRISPR gRNA sequence
gccaggctggtctcgaactc

SEQ ID NO: 114625 - DNA, 20 bp, Artificial
  CRISPR gRNA sequence
gtctcgaactcctgacctca

SEQ ID NO: 114626 - DNA, 20 bp, Artificial
  CRISPR gRNA sequence
gaactcctgacctcaagtga

SEQ ID NO: 114627 - DNA, 20 bp, Artificial
  CRISPR gRNA sequence
ctgacctcaagtgatccacc

SEQ ID NO: 114628 - DNA, 20 bp, Artificial
  CRISPR gRNA sequence
acctcaagtgatccacccac

SEQ ID NO: 114629 - DNA, 20 bp, Artificial
  CRISPR gRNA sequence
aagtgatccacccacctcgg

SEQ ID NO: 114630 - DNA, 20 bp, Artificial
  CRISPR gRNA sequence
ggccttccaaagtgcaagga

SEQ ID NO: 114631 - DNA, 20 bp, Artificial
  CRISPR gRNA sequence
ccaaagtgcaaggattacag

SEQ ID NO: 114632 - DNA, 20 bp, Artificial
  CRISPR gRNA sequence
caaagtgcaaggattacagg

SEQ ID NO: 114633 - DNA, 20 bp, Artificial
  CRISPR gRNA sequence
caggcgtgagccaccacacc

SEQ ID NO: 114634 - DNA, 20 bp, Artificial
  CRISPR gRNA sequence
taaatatgcatgcttttcaa

SEQ ID NO: 114635 - DNA, 20 bp, Artificial
  CRISPR gRNA sequence
aaatatgcatgcttttcaat

SEQ ID NO: 114636 - DNA, 20 bp, Artificial
  CRISPR gRNA sequence
aatatgcatgcttttcaata

SEQ ID NO: 114637 - DNA, 20 bp, Artificial
  CRISPR gRNA sequence
ttcaatatatataatcatac

SEQ ID NO: 114638 - DNA, 20 bp, Artificial
  CRISPR gRNA sequence
tcaatatatataatcatacc

SEQ ID NO: 114639 - DNA, 20 bp, Artificial
  CRISPR gRNA sequence
caatatatataatcatacca

SEQ ID NO: 114640 - DNA, 20 bp, Artificial
  CRISPR gRNA sequence
aatatatataatcataccac

SEQ ID NO: 114641 - DNA, 20 bp, Artificial
  CRISPR gRNA sequence
ctatctttcataaaaaccga

SEQ ID NO: 114642 - DNA, 20 bp, Artificial
  CRISPR gRNA sequence
tctttcataaaaaccgacat

SEQ ID NO: 114643 - DNA, 20 bp, Artificial
  CRISPR gRNA sequence
tcataaaaaccgacattgat

SEQ ID NO: 114644 - DNA, 20 bp, Artificial
  CRISPR gRNA sequence
cataaaaaccgacattgatt

SEQ ID NO: 114645 - DNA, 20 bp, Artificial
  CRISPR gRNA sequence
ataaaaaccgacattgattt

SEQ ID NO: 114646 - DNA, 20 bp, Artificial
  CRISPR gRNA sequence
atttgttaatatcaggtatc

SEQ ID NO: 114647 - DNA, 20 bp, Artificial
  CRISPR gRNA sequence
gttaatatcaggtatccaga

SEQ ID NO: 114648 - DNA, 20 bp, Artificial
  CRISPR gRNA sequence
ttaatatcaggtatccagac

SEQ ID NO: 114649 - DNA, 20 bp, Artificial
  CRISPR gRNA sequence
atatcaggtatccagacagt

SEQ ID NO: 114650 - DNA, 20 bp, Artificial
  CRISPR gRNA sequence
cctatttgtttcataaatgg

SEQ ID NO: 114651 - DNA, 20 bp, Artificial
  CRISPR gRNA sequence
tttgtttcataaatggaaaa

SEQ ID NO: 114652 - DNA, 20 bp, Artificial
  CRISPR gRNA sequence
gtttcataaatggaaaataa

SEQ ID NO: 114653 - DNA, 20 bp, Artificial
  CRISPR gRNA sequence
tttcataaatggaaaataag

SEQ ID NO: 114654 - DNA, 20 bp, Artificial
  CRISPR gRNA sequence
cataaatggaaaataagttg

SEQ ID NO: 114655 - DNA, 20 bp, Artificial
  CRISPR gRNA sequence
ataaatggaaaataagttgt

SEQ ID NO: 114656 - DNA, 20 bp, Artificial
  CRISPR gRNA sequence
tgtctacttcataatggagg

SEQ ID NO: 114657 - DNA, 20 bp, Artificial
  CRISPR gRNA sequence
cttcataatggagggcagag

SEQ ID NO: 114658 - DNA, 20 bp, Artificial
  CRISPR gRNA sequence
cataatggagggcagagcag

SEQ ID NO: 114659 - DNA, 20 bp, Artificial
  CRISPR gRNA sequence
ataatggagggcagagcagg

SEQ ID NO: 114660 - DNA, 20 bp, Artificial
  CRISPR gRNA sequence
cttttttcctcttcagaaca

SEQ ID NO: 114661 - DNA, 20 bp, Artificial
  CRISPR gRNA sequence
ttttttcctcttcagaacat

SEQ ID NO: 114662 - DNA, 20 bp, Artificial
  CRISPR gRNA sequence
ttttcctcttcagaacattt

SEQ ID NO: 114663 - DNA, 20 bp, Artificial
  CRISPR gRNA sequence
tttcctcttcagaacatttt

SEQ ID NO: 114664 - DNA, 20 bp, Artificial
  CRISPR gRNA sequence
ttcctcttcagaacattttc

SEQ ID NO: 114665 - DNA, 20 bp, Artificial
  CRISPR gRNA sequence
tcctcttcagaacattttct

SEQ ID NO: 114666 - DNA, 20 bp, Artificial
  CRISPR gRNA sequence
cctcttcagaacattttctg

SEQ ID NO: 114667 - DNA, 20 bp, Artificial
  CRISPR gRNA sequence
ctcttcagaacattttctgc

SEQ ID NO: 114668 - DNA, 20 bp, Artificial
  CRISPR gRNA sequence
ttcagaacattttctgcttt

SEQ ID NO: 114669 - DNA, 20 bp, Artificial
  CRISPR gRNA sequence
cagaacattttctgctttct

SEQ ID NO: 114670 - DNA, 20 bp, Artificial
  CRISPR gRNA sequence
agaacattttctgctttcta

SEQ ID NO: 114671 - DNA, 20 bp, Artificial
  CRISPR gRNA sequence
tctgctttctagagaaatgt

SEQ ID NO: 114672 - DNA, 20 bp, Artificial
  CRISPR gRNA sequence
ctgctttctagagaaatgtg

SEQ ID NO: 114673 - DNA, 20 bp, Artificial
  CRISPR gRNA sequence
tgctttctagagaaatgtgg

SEQ ID NO: 114674 - DNA, 20 bp, Artificial
  CRISPR gRNA sequence
ctttctagagaaatgtggat

SEQ ID NO: 114675 - DNA, 20 bp, Artificial
  CRISPR gRNA sequence
tctagagaaatgtggataac

SEQ ID NO: 114676 - DNA, 20 bp, Artificial
  CRISPR gRNA sequence
ctagagaaatgtggataact

SEQ ID NO: 114677 - DNA, 20 bp, Artificial
  CRISPR gRNA sequence
tagagaaatgtggataactc

SEQ ID NO: 114678 - DNA, 20 bp, Artificial
  CRISPR gRNA sequence
gagaaatgtggataactctc

SEQ ID NO: 114679 - DNA, 20 bp, Artificial
  CRISPR gRNA sequence
tcggggaccaaaggagacca

SEQ ID NO: 114680 - DNA, 20 bp, Artificial
  CRISPR gRNA sequence
ggggaccaaaggagaccagt

SEQ ID NO: 114681 - DNA, 20 bp, Artificial
  CRISPR gRNA sequence
tttttatgttcttttctgca

SEQ ID NO: 114682 - DNA, 20 bp, Artificial
  CRISPR gRNA sequence
ttttatgttcttttctgcag

SEQ ID NO: 114683 - DNA, 20 bp, Artificial
  CRISPR gRNA sequence
tttatgttcttttctgcaga

SEQ ID NO: 114684 - DNA, 20 bp, Artificial
  CRISPR gRNA sequence
ttatgttcttttctgcagat

SEQ ID NO: 114685 - DNA, 20 bp, Artificial
  CRISPR gRNA sequence
tatgttcttttctgcagata

SEQ ID NO: 114686 - DNA, 20 bp, Artificial
  CRISPR gRNA sequence
atgttcttttctgcagatac

SEQ ID NO: 114687 - DNA, 20 bp, Artificial
  CRISPR gRNA sequence
tgttcttttctgcagataca

SEQ ID NO: 114688 - DNA, 20 bp, Artificial
  CRISPR gRNA sequence
ttttctgcagatacagttgg

SEQ ID NO: 114689 - DNA, 20 bp, Artificial
  CRISPR gRNA sequence
ttctgcagatacagttggtc

SEQ ID NO: 114690 - DNA, 20 bp, Artificial
  CRISPR gRNA sequence
tctgcagatacagttggtcc

SEQ ID NO: 114691 - DNA, 20 bp, Artificial
  CRISPR gRNA sequence
ctgcagatacagttggtccc

SEQ ID NO: 114692 - DNA, 20 bp, Artificial
  CRISPR gRNA sequence
tgcagatacagttggtccca

SEQ ID NO: 114693 - DNA, 20 bp, Artificial
  CRISPR gRNA sequence
cagatacagttggtcccacc

SEQ ID NO: 114694 - DNA, 20 bp, Artificial
  CRISPR gRNA sequence
gtcccacctggacagatcca

SEQ ID NO: 114695 - DNA, 20 bp, Artificial
  CRISPR gRNA sequence
gacagatccagatccagggt

SEQ ID NO: 114696 - DNA, 20 bp, Artificial
  CRISPR gRNA sequence
tgcaggtgcagggccagcag

SEQ ID NO: 114697 - DNA, 20 bp, Artificial
  CRISPR gRNA sequence
tcactgctggccagactcag

SEQ ID NO: 114698 - DNA, 20 bp, Artificial
  CRISPR gRNA sequence
ctggccagactcaggtaatt

SEQ ID NO: 114699 - DNA, 20 bp, Artificial
  CRISPR gRNA sequence
gccagactcaggtaattcca

SEQ ID NO: 114700 - DNA, 20 bp, Artificial
  CRISPR gRNA sequence
aggtaattccactagctctg

SEQ ID NO: 114701 - DNA, 20 bp, Artificial
  CRISPR gRNA sequence
cactagctctgtcacacagg

SEQ ID NO: 114702 - DNA, 20 bp, Artificial
  CRISPR gRNA sequence
gctctgtcacacaggagcaa

SEQ ID NO: 114703 - DNA, 20 bp, Artificial
  CRISPR gRNA sequence
tgtcacacaggagcaaaact

SEQ ID NO: 114704 - DNA, 20 bp, Artificial
  CRISPR gRNA sequence
tcacacaggagcaaaactga

SEQ ID NO: 114705 - DNA, 20 bp, Artificial
  CRISPR gRNA sequence
atttggaagagtcagataac

SEQ ID NO: 114706 - DNA, 20 bp, Artificial
  CRISPR gRNA sequence
ggaagagtcagataactgag

SEQ ID NO: 114707 - DNA, 20 bp, Artificial
  CRISPR gRNA sequence
gaagagtcagataactgagt

SEQ ID NO: 114708 - DNA, 20 bp, Artificial
  CRISPR gRNA sequence
agtcagatatttcatgtata

SEQ ID NO: 114709 - DNA, 20 bp, Artificial
  CRISPR gRNA sequence
catgtatagcatgtatagta

SEQ ID NO: 114710 - DNA, 20 bp, Artificial
  CRISPR gRNA sequence
atgtatagcatgtatagtag

SEQ ID NO: 114711 - DNA, 20 bp, Artificial
  CRISPR gRNA sequence
ttggccgggcgcggtggctc

SEQ ID NO: 114712 - DNA, 20 bp, Artificial
  CRISPR gRNA sequence
tggccgggcgcggtggctca

SEQ ID NO: 114713 - DNA, 20 bp, Artificial
  CRISPR gRNA sequence
ggccgggcgcggtggctcat

SEQ ID NO: 114714 - DNA, 20 bp, Artificial
  CRISPR gRNA sequence
gccgggcgcggtggctcatg

SEQ ID NO: 114715 - DNA, 20 bp, Artificial
  CRISPR gRNA sequence
atgcctgtaatcccagcact

SEQ ID NO: 114716 - DNA, 20 bp, Artificial
  CRISPR gRNA sequence
taatcccagcactttgagag

SEQ ID NO: 114717 - DNA, 20 bp, Artificial
  CRISPR gRNA sequence
tgagaggccgaggcaagctg

SEQ ID NO: 114718 - DNA, 20 bp, Artificial
  CRISPR gRNA sequence
gagaggccgaggcaagctga

SEQ ID NO: 114719 - DNA, 20 bp, Artificial
  CRISPR gRNA sequence
agaggccgaggcaagctgat

SEQ ID NO: 114720 - DNA, 20 bp, Artificial
  CRISPR gRNA sequence
atcacaaggtcaagagatca

SEQ ID NO: 114721 - DNA, 20 bp, Artificial
  CRISPR gRNA sequence
gccaacatggtgaagccccg

SEQ ID NO: 114722 - DNA, 20 bp, Artificial
  CRISPR gRNA sequence
ggtgggcatggtggcgcatg

SEQ ID NO: 114723 - DNA, 20 bp, Artificial
  CRISPR gRNA sequence
taatcccagctactcgggag

SEQ ID NO: 114724 - DNA, 20 bp, Artificial
  CRISPR gRNA sequence
ctcgggaggctgaggcagag

SEQ ID NO: 114725 - DNA, 20 bp, Artificial
  CRISPR gRNA sequence
gggaggctgaggcagagaat

SEQ ID NO: 114726 - DNA, 20 bp, Artificial
  CRISPR gRNA sequence
aggcagagaatcgcttgaac

SEQ ID NO: 114727 - DNA, 20 bp, Artificial
  CRISPR gRNA sequence
gaacccaggaggcggaggtt

SEQ ID NO: 114728 - DNA, 20 bp, Artificial
  CRISPR gRNA sequence
aacccaggaggcggaggttg

SEQ ID NO: 114729 - DNA, 20 bp, Artificial
  CRISPR gRNA sequence
cagtgagctgagattgcgcc

SEQ ID NO: 114730 - DNA, 20 bp, Artificial
  CRISPR gRNA sequence
agattgcgccactgcactgc

SEQ ID NO: 114731 - DNA, 20 bp, Artificial
  CRISPR gRNA sequence
cgccactgcactgcactcca

SEQ ID NO: 114732 - DNA, 20 bp, Artificial
  CRISPR gRNA sequence
cactgcactccagcctggcg

SEQ ID NO: 114733 - DNA, 20 bp, Artificial
  CRISPR gRNA sequence
cactccagcctggcgacaga

SEQ ID NO: 114734 - DNA, 20 bp, Artificial
  CRISPR gRNA sequence
cagcctggcgacagagtgag

SEQ ID NO: 114735 - DNA, 20 bp, Artificial
  CRISPR gRNA sequence
gcgacagagtgagactctgt

SEQ ID NO: 114736 - DNA, 20 bp, Artificial
  CRISPR gRNA sequence
tgtctcaaaaaaataatttt

SEQ ID NO: 114737 - DNA, 20 bp, Artificial
  CRISPR gRNA sequence
tctcaaaaaaataatttttt

SEQ ID NO: 114738 - DNA, 20 bp, Artificial
  CRISPR gRNA sequence
aaaaaaataatttttttttt

SEQ ID NO: 114739 - DNA, 20 bp, Artificial
  CRISPR gRNA sequence
ttttttttaaggactacatc

SEQ ID NO: 114740 - DNA, 20 bp, Artificial
  CRISPR gRNA sequence
tttttttaaggactacatcg

SEQ ID NO: 114741 - DNA, 20 bp, Artificial
  CRISPR gRNA sequence
ttttttaaggactacatcgt

SEQ ID NO: 114742 - DNA, 20 bp, Artificial
  CRISPR gRNA sequence
tttttaaggactacatcgtt

SEQ ID NO: 114743 - DNA, 20 bp, Artificial
  CRISPR gRNA sequence
ttttaaggactacatcgttc

SEQ ID NO: 114744 - DNA, 20 bp, Artificial
  CRISPR gRNA sequence
tttaaggactacatcgttct

SEQ ID NO: 114745 - DNA, 20 bp, Artificial
  CRISPR gRNA sequence
ttaaggactacatcgttctt

SEQ ID NO: 114746 - DNA, 20 bp, Artificial
  CRISPR gRNA sequence
taaggactacatcgttcttt

SEQ ID NO: 114747 - DNA, 20 bp, Artificial
  CRISPR gRNA sequence
aaggactacatcgttctttg

SEQ ID NO: 114748 - DNA, 20 bp, Artificial
  CRISPR gRNA sequence
aggactacatcgttctttgt

SEQ ID NO: 114749 - DNA, 20 bp, Artificial
  CRISPR gRNA sequence
catcgttctttgttagtatc

SEQ ID NO: 114750 - DNA, 20 bp, Artificial
  CRISPR gRNA sequence
tttgttagtatctttgggat

SEQ ID NO: 114751 - DNA, 20 bp, Artificial
  CRISPR gRNA sequence
tgttagtatctttgggatct

SEQ ID NO: 114752 - DNA, 20 bp, Artificial
  CRISPR gRNA sequence
gttagtatctttgggatctg

SEQ ID NO: 114753 - DNA, 20 bp, Artificial
  CRISPR gRNA sequence
ttagtatctttgggatctgt

SEQ ID NO: 114754 - DNA, 20 bp, Artificial
  CRISPR gRNA sequence
gtatctttgggatctgttga

SEQ ID NO: 114755 - DNA, 20 bp, Artificial
  CRISPR gRNA sequence
tgggatctgttgaattgtgt

SEQ ID NO: 114756 - DNA, 20 bp, Artificial
  CRISPR gRNA sequence
gggatctgttgaattgtgtc

SEQ ID NO: 114757 - DNA, 20 bp, Artificial
  CRISPR gRNA sequence
ggatctgttgaattgtgtca

SEQ ID NO: 114758 - DNA, 20 bp, Artificial
  CRISPR gRNA sequence
ttgaattgtgtcattactta

SEQ ID NO: 114759 - DNA, 20 bp, Artificial
  CRISPR gRNA sequence
aattgtgtcattacttattt

SEQ ID NO: 114760 - DNA, 20 bp, Artificial
  CRISPR gRNA sequence
tgtcattacttatttcctcc

SEQ ID NO: 114761 - DNA, 20 bp, Artificial
  CRISPR gRNA sequence
cttatttcctccagacacag

SEQ ID NO: 114762 - DNA, 20 bp, Artificial
  CRISPR gRNA sequence
atttcctccagacacagcag

SEQ ID NO: 114763 - DNA, 20 bp, Artificial
  CRISPR gRNA sequence
tttcctccagacacagcagc

SEQ ID NO: 114764 - DNA, 20 bp, Artificial
  CRISPR gRNA sequence
cctccagacacagcagcaga

SEQ ID NO: 114765 - DNA, 20 bp, Artificial
  CRISPR gRNA sequence
ctccagacacagcagcagat

SEQ ID NO: 114766 - DNA, 20 bp, Artificial
  CRISPR gRNA sequence
cagacacagcagcagattgc

SEQ ID NO: 114767 - DNA, 20 bp, Artificial
  CRISPR gRNA sequence
ctgtccagggacagcaagtg

SEQ ID NO: 114768 - DNA, 20 bp, Artificial
  CRISPR gRNA sequence
tccagggacagcaagtggca

SEQ ID NO: 114769 - DNA, 20 bp, Artificial
  CRISPR gRNA sequence
ctgaagggcagaccatcgtc

SEQ ID NO: 114770 - DNA, 20 bp, Artificial
  CRISPR gRNA sequence
aagggcagaccatcgtctat

SEQ ID NO: 114771 - DNA, 20 bp, Artificial
  CRISPR gRNA sequence
tcaaccagttaatgcagatg

SEQ ID NO: 114772 - DNA, 20 bp, Artificial
  CRISPR gRNA sequence
atgcagatggcaccattctc

SEQ ID NO: 114773 - DNA, 20 bp, Artificial
  CRISPR gRNA sequence
tccagcaaggtaagtgtacc

SEQ ID NO: 114774 - DNA, 20 bp, Artificial
  CRISPR gRNA sequence
cagcaaggtaagtgtaccca

SEQ ID NO: 114775 - DNA, 20 bp, Artificial
  CRISPR gRNA sequence
ccctaggactttttggggca

SEQ ID NO: 114776 - DNA, 20 bp, Artificial
  CRISPR gRNA sequence
cctaggactttttggggcaa

SEQ ID NO: 114777 - DNA, 20 bp, Artificial
  CRISPR gRNA sequence
ggactttttggggcaacttt

SEQ ID NO: 114778 - DNA, 20 bp, Artificial
  CRISPR gRNA sequence
tttggggcaacttttttgtc

SEQ ID NO: 114779 - DNA, 20 bp, Artificial
  CRISPR gRNA sequence
ttggggcaacttttttgtcc

SEQ ID NO: 114780 - DNA, 20 bp, Artificial
  CRISPR gRNA sequence
tggggcaacttttttgtccc

SEQ ID NO: 114781 - DNA, 20 bp, Artificial
  CRISPR gRNA sequence
ggggcaacttttttgtccct

SEQ ID NO: 114782 - DNA, 20 bp, Artificial
  CRISPR gRNA sequence
gggcaacttttttgtccctt

SEQ ID NO: 114783 - DNA, 20 bp, Artificial
  CRISPR gRNA sequence
ttttgtcccttagacaactg

SEQ ID NO: 114784 - DNA, 20 bp, Artificial
  CRISPR gRNA sequence
tttgtcccttagacaactga

SEQ ID NO: 114785 - DNA, 20 bp, Artificial
  CRISPR gRNA sequence
ttgtcccttagacaactgac

SEQ ID NO: 114786 - DNA, 20 bp, Artificial
  CRISPR gRNA sequence
tgtcccttagacaactgaca

SEQ ID NO: 114787 - DNA, 20 bp, Artificial
  CRISPR gRNA sequence
gtcccttagacaactgacat

SEQ ID NO: 114788 - DNA, 20 bp, Artificial
  CRISPR gRNA sequence
tcccttagacaactgacatc

SEQ ID NO: 114789 - DNA, 20 bp, Artificial
  CRISPR gRNA sequence
agacaactgacatctttaga

SEQ ID NO: 114790 - DNA, 20 bp, Artificial
  CRISPR gRNA sequence
gacaactgacatctttagaa

SEQ ID NO: 114791 - DNA, 20 bp, Artificial
  CRISPR gRNA sequence
acatctttagaatttgagtg

SEQ ID NO: 114792 - DNA, 20 bp, Artificial
  CRISPR gRNA sequence
tagaatttgagtggtgaact

SEQ ID NO: 114793 - DNA, 20 bp, Artificial
  CRISPR gRNA sequence
agaatttgagtggtgaactt

SEQ ID NO: 114794 - DNA, 20 bp, Artificial
  CRISPR gRNA sequence
gaatttgagtggtgaacttg

SEQ ID NO: 114795 - DNA, 20 bp, Artificial
  CRISPR gRNA sequence
gagtggtgaacttgacacta

SEQ ID NO: 114796 - DNA, 20 bp, Artificial
  CRISPR gRNA sequence
agtggtgaacttgacactac

SEQ ID NO: 114797 - DNA, 20 bp, Artificial
  CRISPR gRNA sequence
gacactacatattttttgga

SEQ ID NO: 114798 - DNA, 20 bp, Artificial
  CRISPR gRNA sequence
acactacatattttttggac

SEQ ID NO: 114799 - DNA, 20 bp, Artificial
  CRISPR gRNA sequence
catattttttggacaaaaaa

SEQ ID NO: 114800 - DNA, 20 bp, Artificial
  CRISPR gRNA sequence
tttggacaaaaaaaaaaaag

SEQ ID NO: 114801 - DNA, 20 bp, Artificial
  CRISPR gRNA sequence
ttggacaaaaaaaaaaaaga

SEQ ID NO: 114802 - DNA, 20 bp, Artificial
  CRISPR gRNA sequence
tggacaaaaaaaaaaaagat

SEQ ID NO: 114803 - DNA, 20 bp, Artificial
  CRISPR gRNA sequence
ggacaaaaaaaaaaaagatt

SEQ ID NO: 114804 - DNA, 20 bp, Artificial
  CRISPR gRNA sequence
gacaaaaaaaaaaaagattt

SEQ ID NO: 114805 - DNA, 20 bp, Artificial
  CRISPR gRNA sequence
cctctagctctccattgatt

SEQ ID NO: 114806 - DNA, 20 bp, Artificial
  CRISPR gRNA sequence
ctctagctctccattgattg

SEQ ID NO: 114807 - DNA, 20 bp, Artificial
  CRISPR gRNA sequence
tagctctccattgattgttg

SEQ ID NO: 114808 - DNA, 20 bp, Artificial
  CRISPR gRNA sequence
gctctccattgattgttggt

SEQ ID NO: 114809 - DNA, 20 bp, Artificial
  CRISPR gRNA sequence
tccattgattgttggtttct

SEQ ID NO: 114810 - DNA, 20 bp, Artificial
  CRISPR gRNA sequence
cattgattgttggtttcttg

SEQ ID NO: 114811 - DNA, 20 bp, Artificial
  CRISPR gRNA sequence
attgttggtttcttgtcacc

SEQ ID NO: 114812 - DNA, 20 bp, Artificial
  CRISPR gRNA sequence
ttggtttcttgtcaccatct

SEQ ID NO: 114813 - DNA, 20 bp, Artificial
  CRISPR gRNA sequence
gtttcttgtcaccatctgtg

SEQ ID NO: 114814 - DNA, 20 bp, Artificial
  CRISPR gRNA sequence
cttgtcaccatctgtgacca

SEQ ID NO: 114815 - DNA, 20 bp, Artificial
  CRISPR gRNA sequence
ttgtcaccatctgtgaccaa

SEQ ID NO: 114816 - DNA, 20 bp, Artificial
  CRISPR gRNA sequence
gtcaccatctgtgaccaaca

SEQ ID NO: 114817 - DNA, 20 bp, Artificial
  CRISPR gRNA sequence
tcaccatctgtgaccaacag

SEQ ID NO: 114818 - DNA, 20 bp, Artificial
  CRISPR gRNA sequence
tgaccaacagtgattccatg

SEQ ID NO: 114819 - DNA, 20 bp, Artificial
  CRISPR gRNA sequence
catgtgtagcagtttctata

SEQ ID NO: 114820 - DNA, 20 bp, Artificial
  CRISPR gRNA sequence
ctatagtggttgctaatcta

SEQ ID NO: 114821 - DNA, 20 bp, Artificial
  CRISPR gRNA sequence
tatagtggttgctaatctag

SEQ ID NO: 114822 - DNA, 20 bp, Artificial
  CRISPR gRNA sequence
tagtggttgctaatctaggg

SEQ ID NO: 114823 - DNA, 20 bp, Artificial
  CRISPR gRNA sequence
ctaatctagggattgtgtaa

SEQ ID NO: 114824 - DNA, 20 bp, Artificial
  CRISPR gRNA sequence
atctagggattgtgtaagct

SEQ ID NO: 114825 - DNA, 20 bp, Artificial
  CRISPR gRNA sequence
gggattgtgtaagcttttag

SEQ ID NO: 114826 - DNA, 20 bp, Artificial
  CRISPR gRNA sequence
tgtaagcttttagggaagaa

SEQ ID NO: 114827 - DNA, 20 bp, Artificial
  CRISPR gRNA sequence
ttagggaagaagtgtttcta

SEQ ID NO: 114828 - DNA, 20 bp, Artificial
  CRISPR gRNA sequence
tagggaagaagtgtttctaa

SEQ ID NO: 114829 - DNA, 20 bp, Artificial
  CRISPR gRNA sequence
agggaagaagtgtttctaaa

SEQ ID NO: 114830 - DNA, 20 bp, Artificial
  CRISPR gRNA sequence
gggaagaagtgtttctaaac

SEQ ID NO: 114831 - DNA, 20 bp, Artificial
  CRISPR gRNA sequence
ctaaacagaagaatagaaat

SEQ ID NO: 114832 - DNA, 20 bp, Artificial
  CRISPR gRNA sequence
taaacagaagaatagaaata

SEQ ID NO: 114833 - DNA, 20 bp, Artificial
  CRISPR gRNA sequence
aacagaagaatagaaatagg

SEQ ID NO: 114834 - DNA, 20 bp, Artificial
  CRISPR gRNA sequence
attggtaaagagagaaatag

SEQ ID NO: 114835 - DNA, 20 bp, Artificial
  CRISPR gRNA sequence
gtaaagagagaaatagatca

SEQ ID NO: 114836 - DNA, 20 bp, Artificial
  CRISPR gRNA sequence
gctttagagtgctattgctg

SEQ ID NO: 114837 - DNA, 20 bp, Artificial
  CRISPR gRNA sequence
tagagtgctattgctgctta

SEQ ID NO: 114838 - DNA, 20 bp, Artificial
  CRISPR gRNA sequence
agagtgctattgctgcttat

SEQ ID NO: 114839 - DNA, 20 bp, Artificial
  CRISPR gRNA sequence
gagtgctattgctgcttatg

SEQ ID NO: 114840 - DNA, 20 bp, Artificial
  CRISPR gRNA sequence
ttgctgcttatgtttttttc

SEQ ID NO: 114841 - DNA, 20 bp, Artificial
  CRISPR gRNA sequence
ctgcttatgtttttttctgg

SEQ ID NO: 114842 - DNA, 20 bp, Artificial
  CRISPR gRNA sequence
cttatgtttttttctgggtc

SEQ ID NO: 114843 - DNA, 20 bp, Artificial
  CRISPR gRNA sequence
atgtttttttctgggtcatt

SEQ ID NO: 114844 - DNA, 20 bp, Artificial
  CRISPR gRNA sequence
tgtttttttctgggtcattc

SEQ ID NO: 114845 - DNA, 20 bp, Artificial
  CRISPR gRNA sequence
ttttctgggtcattccatta

SEQ ID NO: 114846 - DNA, 20 bp, Artificial
  CRISPR gRNA sequence
tttctgggtcattccattac

SEQ ID NO: 114847 - DNA, 20 bp, Artificial
  CRISPR gRNA sequence
ttctgggtcattccattact

SEQ ID NO: 114848 - DNA, 20 bp, Artificial
  CRISPR gRNA sequence
tctgggtcattccattactt

SEQ ID NO: 114849 - DNA, 20 bp, Artificial
  CRISPR gRNA sequence
ctgggtcattccattacttt

SEQ ID NO: 114850 - DNA, 20 bp, Artificial
  CRISPR gRNA sequence
tgggtcattccattacttta

SEQ ID NO: 114851 - DNA, 20 bp, Artificial
  CRISPR gRNA sequence
ggtcattccattactttaaa

SEQ ID NO: 114852 - DNA, 20 bp, Artificial
  CRISPR gRNA sequence
cattactttaaatgactatt

SEQ ID NO: 114853 - DNA, 20 bp, Artificial
  CRISPR gRNA sequence
ctttaaatgactattatgta

SEQ ID NO: 114854 - DNA, 20 bp, Artificial
  CRISPR gRNA sequence
taaatgactattatgtatac

SEQ ID NO: 114855 - DNA, 20 bp, Artificial
  CRISPR gRNA sequence
aaatgactattatgtataca

SEQ ID NO: 114856 - DNA, 20 bp, Artificial
  CRISPR gRNA sequence
aatgactattatgtatacag

SEQ ID NO: 114857 - DNA, 20 bp, Artificial
  CRISPR gRNA sequence
ttatgtatacagcactttta

SEQ ID NO: 114858 - DNA, 20 bp, Artificial
  CRISPR gRNA sequence
tgtatacagcacttttacta

SEQ ID NO: 114859 - DNA, 20 bp, Artificial
  CRISPR gRNA sequence
ttactaagaagggtcctcaa

SEQ ID NO: 114860 - DNA, 20 bp, Artificial
  CRISPR gRNA sequence
tactaagaagggtcctcaaa

SEQ ID NO: 114861 - DNA, 20 bp, Artificial
  CRISPR gRNA sequence
actaagaagggtcctcaaag

SEQ ID NO: 114862 - DNA, 20 bp, Artificial
  CRISPR gRNA sequence
ctaagaagggtcctcaaaga

SEQ ID NO: 114863 - DNA, 20 bp, Artificial
  CRISPR gRNA sequence
agaagggtcctcaaagagcc

SEQ ID NO: 114864 - DNA, 20 bp, Artificial
  CRISPR gRNA sequence
aaagagcctctagtctagta

SEQ ID NO: 114865 - DNA, 20 bp, Artificial
  CRISPR gRNA sequence
tagtctagtaagaaagacgt

SEQ ID NO: 114866 - DNA, 20 bp, Artificial
  CRISPR gRNA sequence
gtctagtaagaaagacgtga

SEQ ID NO: 114867 - DNA, 20 bp, Artificial
  CRISPR gRNA sequence
gtaagaaagacgtgaacaaa

SEQ ID NO: 114868 - DNA, 20 bp, Artificial
  CRISPR gRNA sequence
atggaagtatgttctaggaa

SEQ ID NO: 114869 - DNA, 20 bp, Artificial
  CRISPR gRNA sequence
taggaatagataacataaat

SEQ ID NO: 114870 - DNA, 20 bp, Artificial
  CRISPR gRNA sequence
ggaatagataacataaataa

SEQ ID NO: 114871 - DNA, 20 bp, Artificial
  CRISPR gRNA sequence
ggtctgggaggaggagtgca

SEQ ID NO: 114872 - DNA, 20 bp, Artificial
  CRISPR gRNA sequence
gtctgggaggaggagtgcag

SEQ ID NO: 114873 - DNA, 20 bp, Artificial
  CRISPR gRNA sequence
ggaggaggagtgcagaaact

SEQ ID NO: 114874 - DNA, 20 bp, Artificial
  CRISPR gRNA sequence
aacttgaaggcttttggaag

SEQ ID NO: 114875 - DNA, 20 bp, Artificial
  CRISPR gRNA sequence
gaaggcttttggaagcacct

SEQ ID NO: 114876 - DNA, 20 bp, Artificial
  CRISPR gRNA sequence
aaggcttttggaagcacctg

SEQ ID NO: 114877 - DNA, 20 bp, Artificial
  CRISPR gRNA sequence
ttggaagcacctgttagtca

SEQ ID NO: 114878 - DNA, 20 bp, Artificial
  CRISPR gRNA sequence
tggaagcacctgttagtcaa

SEQ ID NO: 114879 - DNA, 20 bp, Artificial
  CRISPR gRNA sequence
ggaagcacctgttagtcaaa

SEQ ID NO: 114880 - DNA, 20 bp, Artificial
  CRISPR gRNA sequence
gaagcacctgttagtcaaat

SEQ ID NO: 114881 - DNA, 20 bp, Artificial
  CRISPR gRNA sequence
ttagtcaaatagttaaatca

SEQ ID NO: 114882 - DNA, 20 bp, Artificial
  CRISPR gRNA sequence
gtcaaatagttaaatcaaaa

SEQ ID NO: 114883 - DNA, 20 bp, Artificial
  CRISPR gRNA sequence
aatcaaaaaaggacatcttt

SEQ ID NO: 114884 - DNA, 20 bp, Artificial
  CRISPR gRNA sequence
tgttagattccatgactttg

SEQ ID NO: 114885 - DNA, 20 bp, Artificial
  CRISPR gRNA sequence
gttagattccatgactttgt

SEQ ID NO: 114886 - DNA, 20 bp, Artificial
  CRISPR gRNA sequence
ttagattccatgactttgtg

SEQ ID NO: 114887 - DNA, 20 bp, Artificial
  CRISPR gRNA sequence
gattccatgactttgtgatt

SEQ ID NO: 114888 - DNA, 20 bp, Artificial
  CRISPR gRNA sequence
catgactttgtgattgcaaa

SEQ ID NO: 114889 - DNA, 20 bp, Artificial
  CRISPR gRNA sequence
tgtgattgcaaatttgcaat

SEQ ID NO: 114890 - DNA, 20 bp, Artificial
  CRISPR gRNA sequence
gtgattgcaaatttgcaata

SEQ ID NO: 114891 - DNA, 20 bp, Artificial
  CRISPR gRNA sequence
tgattgcaaatttgcaatat

SEQ ID NO: 114892 - DNA, 20 bp, Artificial
  CRISPR gRNA sequence
caaatttgcaatatacagga

SEQ ID NO: 114893 - DNA, 20 bp, Artificial
  CRISPR gRNA sequence
gcaatatacaggatccagag

SEQ ID NO: 114894 - DNA, 20 bp, Artificial
  CRISPR gRNA sequence
caatatacaggatccagaga

SEQ ID NO: 114895 - DNA, 20 bp, Artificial
  CRISPR gRNA sequence
actgtgtgctcttgtattac

SEQ ID NO: 114896 - DNA, 20 bp, Artificial
  CRISPR gRNA sequence
tgtgctcttgtattactcca

SEQ ID NO: 114897 - DNA, 20 bp, Artificial
  CRISPR gRNA sequence
ttgtattactccagggaggc

SEQ ID NO: 114898 - DNA, 20 bp, Artificial
  CRISPR gRNA sequence
gtattactccagggaggccc

SEQ ID NO: 114899 - DNA, 20 bp, Artificial
  CRISPR gRNA sequence
tattactccagggaggccct

SEQ ID NO: 114900 - DNA, 20 bp, Artificial
  CRISPR gRNA sequence
ctccagggaggccctgaact

SEQ ID NO: 114901 - DNA, 20 bp, Artificial
  CRISPR gRNA sequence
cagggaggccctgaactgga

SEQ ID NO: 114902 - DNA, 20 bp, Artificial
  CRISPR gRNA sequence
aactggattgagcccaggca

SEQ ID NO: 114903 - DNA, 20 bp, Artificial
  CRISPR gRNA sequence
gattgagcccaggcaagagc

SEQ ID NO: 114904 - DNA, 20 bp, Artificial
  CRISPR gRNA sequence
agcccaggcaagagctcaaa

SEQ ID NO: 114905 - DNA, 20 bp, Artificial
  CRISPR gRNA sequence
aaacagaatggtgaacaaat

SEQ ID NO: 114906 - DNA, 20 bp, Artificial
  CRISPR gRNA sequence
aagtgctgctattgatagtc

SEQ ID NO: 114907 - DNA, 20 bp, Artificial
  CRISPR gRNA sequence
ctattgatagtctggggact

SEQ ID NO: 114908 - DNA, 20 bp, Artificial
  CRISPR gRNA sequence
ttgatagtctggggacttgg

SEQ ID NO: 114909 - DNA, 20 bp, Artificial
  CRISPR gRNA sequence
atagtctggggacttggaat

SEQ ID NO: 114910 - DNA, 20 bp, Artificial
  CRISPR gRNA sequence
gggacttggaatgcttggtt

SEQ ID NO: 114911 - DNA, 20 bp, Artificial
  CRISPR gRNA sequence
ggaatgcttggtttaatttt

SEQ ID NO: 114912 - DNA, 20 bp, Artificial
  CRISPR gRNA sequence
gaatgcttggtttaatttta

SEQ ID NO: 114913 - DNA, 20 bp, Artificial
  CRISPR gRNA sequence
ggtttaattttaagttttaa

SEQ ID NO: 114914 - DNA, 20 bp, Artificial
  CRISPR gRNA sequence
gtttaattttaagttttaat

SEQ ID NO: 114915 - DNA, 20 bp, Artificial
  CRISPR gRNA sequence
aattttaagttttaatacta

SEQ ID NO: 114916 - DNA, 20 bp, Artificial
  CRISPR gRNA sequence
attttaagttttaatactac

SEQ ID NO: 114917 - DNA, 20 bp, Artificial
  CRISPR gRNA sequence
taagttttaatactacaact

SEQ ID NO: 114918 - DNA, 20 bp, Artificial
  CRISPR gRNA sequence
aagttttaatactacaactg

SEQ ID NO: 114919 - DNA, 20 bp, Artificial
  CRISPR gRNA sequence
agttttaatactacaactga

SEQ ID NO: 114920 - DNA, 20 bp, Artificial
  CRISPR gRNA sequence
taatactacaactgactcat

SEQ ID NO: 114921 - DNA, 20 bp, Artificial
  CRISPR gRNA sequence
aatactacaactgactcatt

SEQ ID NO: 114922 - DNA, 20 bp, Artificial
  CRISPR gRNA sequence
atactacaactgactcattg

SEQ ID NO: 114923 - DNA, 20 bp, Artificial
  CRISPR gRNA sequence
caactgactcattgtcagtt

SEQ ID NO: 114924 - DNA, 20 bp, Artificial
  CRISPR gRNA sequence
actcattgtcagtttgagat

SEQ ID NO: 114925 - DNA, 20 bp, Artificial
  CRISPR gRNA sequence
attgtcagtttgagataaac

SEQ ID NO: 114926 - DNA, 20 bp, Artificial
  CRISPR gRNA sequence
tcagtttgagataaacaaag

SEQ ID NO: 114927 - DNA, 20 bp, Artificial
  CRISPR gRNA sequence
gagataaacaaagtataagt

SEQ ID NO: 114928 - DNA, 20 bp, Artificial
  CRISPR gRNA sequence
agataaacaaagtataagtt

SEQ ID NO: 114929 - DNA, 20 bp, Artificial
  CRISPR gRNA sequence
taaaatctctgtcctgaagc

SEQ ID NO: 114930 - DNA, 20 bp, Artificial
  CRISPR gRNA sequence
aaaatctctgtcctgaagca

SEQ ID NO: 114931 - DNA, 20 bp, Artificial
  CRISPR gRNA sequence
aaatctctgtcctgaagcag

SEQ ID NO: 114932 - DNA, 20 bp, Artificial
  CRISPR gRNA sequence
tgtcctgaagcagattgctc

SEQ ID NO: 114933 - DNA, 20 bp, Artificial
  CRISPR gRNA sequence
tcctgaagcagattgctcat

SEQ ID NO: 114934 - DNA, 20 bp, Artificial
  CRISPR gRNA sequence
aagcagattgctcattatgt

SEQ ID NO: 114935 - DNA, 20 bp, Artificial
  CRISPR gRNA sequence
ctcattatgtacaagagcag

SEQ ID NO: 114936 - DNA, 20 bp, Artificial
  CRISPR gRNA sequence
attatgtacaagagcagtag

SEQ ID NO: 114937 - DNA, 20 bp, Artificial
  CRISPR gRNA sequence
tgtacaagagcagtaggtat

SEQ ID NO: 114938 - DNA, 20 bp, Artificial
  CRISPR gRNA sequence
tagtcagactgacctgtaga

SEQ ID NO: 114939 - DNA, 20 bp, Artificial
  CRISPR gRNA sequence
acctgtagaagaggaggcct

SEQ ID NO: 114940 - DNA, 20 bp, Artificial
  CRISPR gRNA sequence
tagaagaggaggcctccaaa

SEQ ID NO: 114941 - DNA, 20 bp, Artificial
  CRISPR gRNA sequence
caaaccttttcaccttttga

SEQ ID NO: 114942 - DNA, 20 bp, Artificial
  CRISPR gRNA sequence
ttcaccttttgaaaactgct

SEQ ID NO: 114943 - DNA, 20 bp, Artificial
  CRISPR gRNA sequence
tcaccttttgaaaactgcta

SEQ ID NO: 114944 - DNA, 20 bp, Artificial
  CRISPR gRNA sequence
caccttttgaaaactgctaa

SEQ ID NO: 114945 - DNA, 20 bp, Artificial
  CRISPR gRNA sequence
accttttgaaaactgctaag

SEQ ID NO: 114946 - DNA, 20 bp, Artificial
  CRISPR gRNA sequence
ttgaaaactgctaaggatag

SEQ ID NO: 114947 - DNA, 20 bp, Artificial
  CRISPR gRNA sequence
tgaaaactgctaaggataga

SEQ ID NO: 114948 - DNA, 20 bp, Artificial
  CRISPR gRNA sequence
gaaaactgctaaggatagag

SEQ ID NO: 114949 - DNA, 20 bp, Artificial
  CRISPR gRNA sequence
aaaactgctaaggatagagt

SEQ ID NO: 114950 - DNA, 20 bp, Artificial
  CRISPR gRNA sequence
ctaaggatagagttactcaa

SEQ ID NO: 114951 - DNA, 20 bp, Artificial
  CRISPR gRNA sequence
aggatagagttactcaaaac

SEQ ID NO: 114952 - DNA, 20 bp, Artificial
  CRISPR gRNA sequence
ctcaaaactgggacctagac

SEQ ID NO: 114953 - DNA, 20 bp, Artificial
  CRISPR gRNA sequence
aaaactgggacctagacagt

SEQ ID NO: 114954 - DNA, 20 bp, Artificial
  CRISPR gRNA sequence
ggacctagacagttaataga

SEQ ID NO: 114955 - DNA, 20 bp, Artificial
  CRISPR gRNA sequence
gacagttaatagaatttcaa

SEQ ID NO: 114956 - DNA, 20 bp, Artificial
  CRISPR gRNA sequence
atagaatttcaaagattgtg

SEQ ID NO: 114957 - DNA, 20 bp, Artificial
  CRISPR gRNA sequence
caaagattgtgattacttag

SEQ ID NO: 114958 - DNA, 20 bp, Artificial
  CRISPR gRNA sequence
aaagattgtgattacttaga

SEQ ID NO: 114959 - DNA, 20 bp, Artificial
  CRISPR gRNA sequence
tgattacttagattatatat

SEQ ID NO: 114960 - DNA, 20 bp, Artificial
  CRISPR gRNA sequence
cttagattatatatagcaca

SEQ ID NO: 114961 - DNA, 20 bp, Artificial
  CRISPR gRNA sequence
agattatatatagcacacca

SEQ ID NO: 114962 - DNA, 20 bp, Artificial
  CRISPR gRNA sequence
gattatatatagcacaccac

SEQ ID NO: 114963 - DNA, 20 bp, Artificial
  CRISPR gRNA sequence
tatatagcacaccacagtgg

SEQ ID NO: 114964 - DNA, 20 bp, Artificial
  CRISPR gRNA sequence
tttctccccttgtgtttttc

SEQ ID NO: 114965 - DNA, 20 bp, Artificial
  CRISPR gRNA sequence
ttctccccttgtgtttttca

SEQ ID NO: 114966 - DNA, 20 bp, Artificial
  CRISPR gRNA sequence
tctccccttgtgtttttcag

SEQ ID NO: 114967 - DNA, 20 bp, Artificial
  CRISPR gRNA sequence
ctccccttgtgtttttcagt

SEQ ID NO: 114968 - DNA, 20 bp, Artificial
  CRISPR gRNA sequence
tccccttgtgtttttcagtg

SEQ ID NO: 114969 - DNA, 20 bp, Artificial
  CRISPR gRNA sequence
cccttgtgtttttcagtgtg

SEQ ID NO: 114970 - DNA, 20 bp, Artificial
  CRISPR gRNA sequence
gtgtttttcagtgtgttttg

SEQ ID NO: 114971 - DNA, 20 bp, Artificial
  CRISPR gRNA sequence
tgtttttcagtgtgttttgc

SEQ ID NO: 114972 - DNA, 20 bp, Artificial
  CRISPR gRNA sequence
ttcagtgtgttttgccagga

SEQ ID NO: 114973 - DNA, 20 bp, Artificial
  CRISPR gRNA sequence
tcagtgtgttttgccaggat

SEQ ID NO: 114974 - DNA, 20 bp, Artificial
  CRISPR gRNA sequence
cagtgtgttttgccaggatc

SEQ ID NO: 114975 - DNA, 20 bp, Artificial
  CRISPR gRNA sequence
agtgtgttttgccaggatcg

SEQ ID NO: 114976 - DNA, 20 bp, Artificial
  CRISPR gRNA sequence
tgccaggatcggtgagtgta

SEQ ID NO: 114977 - DNA, 20 bp, Artificial
  CRISPR gRNA sequence
gccaggatcggtgagtgtat

SEQ ID NO: 114978 - DNA, 20 bp, Artificial
  CRISPR gRNA sequence
ccaggatcggtgagtgtata

SEQ ID NO: 114979 - DNA, 20 bp, Artificial
  CRISPR gRNA sequence
actatgttcccttctttctg

SEQ ID NO: 114980 - DNA, 20 bp, Artificial
  CRISPR gRNA sequence
tgttcccttctttctgttct

SEQ ID NO: 114981 - DNA, 20 bp, Artificial
  CRISPR gRNA sequence
ccttctttctgttctgtgtg

SEQ ID NO: 114982 - DNA, 20 bp, Artificial
  CRISPR gRNA sequence
ctttctgttctgtgtgcctg

SEQ ID NO: 114983 - DNA, 20 bp, Artificial
  CRISPR gRNA sequence
tttctgttctgtgtgcctgt

SEQ ID NO: 114984 - DNA, 20 bp, Artificial
  CRISPR gRNA sequence
tctgttctgtgtgcctgttt

SEQ ID NO: 114985 - DNA, 20 bp, Artificial
  CRISPR gRNA sequence
ctgttctgtgtgcctgtttt

SEQ ID NO: 114986 - DNA, 20 bp, Artificial
  CRISPR gRNA sequence
tgttctgtgtgcctgttttt

SEQ ID NO: 114987 - DNA, 20 bp, Artificial
  CRISPR gRNA sequence
ttctgtgtgcctgttttttg

SEQ ID NO: 114988 - DNA, 20 bp, Artificial
  CRISPR gRNA sequence
tgtgtgcctgttttttgttt

SEQ ID NO: 114989 - DNA, 20 bp, Artificial
  CRISPR gRNA sequence
tgtgcctgttttttgtttgt

SEQ ID NO: 114990 - DNA, 20 bp, Artificial
  CRISPR gRNA sequence
ttttttgtttgttttatgtt

SEQ ID NO: 114991 - DNA, 20 bp, Artificial
  CRISPR gRNA sequence
tttgtttgttttatgttttg

SEQ ID NO: 114992 - DNA, 20 bp, Artificial
  CRISPR gRNA sequence
ttgtttgttttatgttttgt

SEQ ID NO: 114993 - DNA, 20 bp, Artificial
  CRISPR gRNA sequence
tgtttgttttatgttttgtt

SEQ ID NO: 114994 - DNA, 20 bp, Artificial
  CRISPR gRNA sequence
gtttgttttatgttttgttt

SEQ ID NO: 114995 - DNA, 20 bp, Artificial
  CRISPR gRNA sequence
tttgttttatgttttgtttt

SEQ ID NO: 114996 - DNA, 20 bp, Artificial
  CRISPR gRNA sequence
gttttatgttttgttttctt

SEQ ID NO: 114997 - DNA, 20 bp, Artificial
  CRISPR gRNA sequence
ttttatgttttgttttctta

SEQ ID NO: 114998 - DNA, 20 bp, Artificial
  CRISPR gRNA sequence
tatgttttgttttcttaaag

SEQ ID NO: 114999 - DNA, 20 bp, Artificial
  CRISPR gRNA sequence
atgttttgttttcttaaagt

SEQ ID NO: 115000 - DNA, 20 bp, Artificial
  CRISPR gRNA sequence
tgttttgttttcttaaagtt

SEQ ID NO: 115001 - DNA, 20 bp, Artificial
  CRISPR gRNA sequence
tgttttcttaaagttacagt

SEQ ID NO: 115002 - DNA, 20 bp, Artificial
  CRISPR gRNA sequence
gttttcttaaagttacagtc

SEQ ID NO: 115003 - DNA, 20 bp, Artificial
  CRISPR gRNA sequence
ttttcttaaagttacagtcc

SEQ ID NO: 115004 - DNA, 20 bp, Artificial
  CRISPR gRNA sequence
tcttaaagttacagtccctg

SEQ ID NO: 115005 - DNA, 20 bp, Artificial
  CRISPR gRNA sequence
cttaaagttacagtccctgt

SEQ ID NO: 115006 - DNA, 20 bp, Artificial
  CRISPR gRNA sequence
ttaaagttacagtccctgtt

SEQ ID NO: 115007 - DNA, 20 bp, Artificial
  CRISPR gRNA sequence
aaagttacagtccctgtttc

SEQ ID NO: 115008 - DNA, 20 bp, Artificial
  CRISPR gRNA sequence
aagttacagtccctgtttca

SEQ ID NO: 115009 - DNA, 20 bp, Artificial
  CRISPR gRNA sequence
cagtccctgtttcaggcatg

SEQ ID NO: 115010 - DNA, 20 bp, Artificial
  CRISPR gRNA sequence
tttcaggcatgatcactatc

SEQ ID NO: 115011 - DNA, 20 bp, Artificial
  CRISPR gRNA sequence
caggcatgatcactatccca

SEQ ID NO: 115012 - DNA, 20 bp, Artificial
  CRISPR gRNA sequence
aggcatgatcactatcccag

SEQ ID NO: 115013 - DNA, 20 bp, Artificial
  CRISPR gRNA sequence
tcccagcagccagtttggca

SEQ ID NO: 115014 - DNA, 20 bp, Artificial
  CRISPR gRNA sequence
ggcaggagcacagattgttc

SEQ ID NO: 115015 - DNA, 20 bp, Artificial
  CRISPR gRNA sequence
gcaggagcacagattgttca

SEQ ID NO: 115016 - DNA, 20 bp, Artificial
  CRISPR gRNA sequence
ttcaaacaggagccaatacc

SEQ ID NO: 115017 - DNA, 20 bp, Artificial
  CRISPR gRNA sequence
aaacaggagccaataccaac

SEQ ID NO: 115018 - DNA, 20 bp, Artificial
  CRISPR gRNA sequence
tcactgtgacactaccagtg

SEQ ID NO: 115019 - DNA, 20 bp, Artificial
  CRISPR gRNA sequence
tgacactaccagtggcaggc

SEQ ID NO: 115020 - DNA, 20 bp, Artificial
  CRISPR gRNA sequence
ccagtggcaggcaatgtggt

SEQ ID NO: 115021 - DNA, 20 bp, Artificial
  CRISPR gRNA sequence
aggagggatggtcatggtaa

SEQ ID NO: 115022 - DNA, 20 bp, Artificial
  CRISPR gRNA sequence
ttcagctttgtctttgaaat

SEQ ID NO: 115023 - DNA, 20 bp, Artificial
  CRISPR gRNA sequence
tcagctttgtctttgaaatt

SEQ ID NO: 115024 - DNA, 20 bp, Artificial
  CRISPR gRNA sequence
cagctttgtctttgaaattt

SEQ ID NO: 115025 - DNA, 20 bp, Artificial
  CRISPR gRNA sequence
agctttgtctttgaaatttt

SEQ ID NO: 115026 - DNA, 20 bp, Artificial
  CRISPR gRNA sequence
tgtctttgaaattttcttga

SEQ ID NO: 115027 - DNA, 20 bp, Artificial
  CRISPR gRNA sequence
gtctttgaaattttcttgaa

SEQ ID NO: 115028 - DNA, 20 bp, Artificial
  CRISPR gRNA sequence
tctttgaaattttcttgaac

SEQ ID NO: 115029 - DNA, 20 bp, Artificial
  CRISPR gRNA sequence
tgaaattttcttgaacatgc

SEQ ID NO: 115030 - DNA, 20 bp, Artificial
  CRISPR gRNA sequence
gaaattttcttgaacatgca

SEQ ID NO: 115031 - DNA, 20 bp, Artificial
  CRISPR gRNA sequence
aaattttcttgaacatgcaa

SEQ ID NO: 115032 - DNA, 20 bp, Artificial
  CRISPR gRNA sequence
tcttgaacatgcaacttgat

SEQ ID NO: 115033 - DNA, 20 bp, Artificial
  CRISPR gRNA sequence
cttgaacatgcaacttgatg

SEQ ID NO: 115034 - DNA, 20 bp, Artificial
  CRISPR gRNA sequence
ttgaacatgcaacttgatgc

SEQ ID NO: 115035 - DNA, 20 bp, Artificial
  CRISPR gRNA sequence
gaacatgcaacttgatgcct

SEQ ID NO: 115036 - DNA, 20 bp, Artificial
  CRISPR gRNA sequence
aacatgcaacttgatgcctc

SEQ ID NO: 115037 - DNA, 20 bp, Artificial
  CRISPR gRNA sequence
gatgcctcctaaaatttatt

SEQ ID NO: 115038 - DNA, 20 bp, Artificial
  CRISPR gRNA sequence
atgcctcctaaaatttatta

SEQ ID NO: 115039 - DNA, 20 bp, Artificial
  CRISPR gRNA sequence
ctaaaatttattatgttgac

SEQ ID NO: 115040 - DNA, 20 bp, Artificial
  CRISPR gRNA sequence
aaatttattatgttgacctc

SEQ ID NO: 115041 - DNA, 20 bp, Artificial
  CRISPR gRNA sequence
attatgttgacctcttggga

SEQ ID NO: 115042 - DNA, 20 bp, Artificial
  CRISPR gRNA sequence
ttatgttgacctcttgggat

SEQ ID NO: 115043 - DNA, 20 bp, Artificial
  CRISPR gRNA sequence
tgttgacctcttgggattga

SEQ ID NO: 115044 - DNA, 20 bp, Artificial
  CRISPR gRNA sequence
acctcttgggattgagatcg

SEQ ID NO: 115045 - DNA, 20 bp, Artificial
  CRISPR gRNA sequence
ttgggattgagatcgatcct

SEQ ID NO: 115046 - DNA, 20 bp, Artificial
  CRISPR gRNA sequence
gggattgagatcgatcctta

SEQ ID NO: 115047 - DNA, 20 bp, Artificial
  CRISPR gRNA sequence
ggattgagatcgatccttaa

SEQ ID NO: 115048 - DNA, 20 bp, Artificial
  CRISPR gRNA sequence
agatcgatccttaaggcact

SEQ ID NO: 115049 - DNA, 20 bp, Artificial
  CRISPR gRNA sequence
aaggcactgtcggtaatcta

SEQ ID NO: 115050 - DNA, 20 bp, Artificial
  CRISPR gRNA sequence
aggcactgtcggtaatctac

SEQ ID NO: 115051 - DNA, 20 bp, Artificial
  CRISPR gRNA sequence
tcggtaatctactttgacaa

SEQ ID NO: 115052 - DNA, 20 bp, Artificial
  CRISPR gRNA sequence
ctttgacaataacattatga

SEQ ID NO: 115053 - DNA, 20 bp, Artificial
  CRISPR gRNA sequence
tgacaataacattatgacaa

SEQ ID NO: 115054 - DNA, 20 bp, Artificial
  CRISPR gRNA sequence
gacaataacattatgacaaa

SEQ ID NO: 115055 - DNA, 20 bp, Artificial
  CRISPR gRNA sequence
acaataacattatgacaaac

SEQ ID NO: 115056 - DNA, 20 bp, Artificial
  CRISPR gRNA sequence
tgacaaaccataattcattc

SEQ ID NO: 115057 - DNA, 20 bp, Artificial
  CRISPR gRNA sequence
attctgagcacctactatgt

SEQ ID NO: 115058 - DNA, 20 bp, Artificial
  CRISPR gRNA sequence
tgagcacctactatgtgcca

SEQ ID NO: 115059 - DNA, 20 bp, Artificial
  CRISPR gRNA sequence
agcacctactatgtgccagg

SEQ ID NO: 115060 - DNA, 20 bp, Artificial
  CRISPR gRNA sequence
ctatgtgccagggactattc

SEQ ID NO: 115061 - DNA, 20 bp, Artificial
  CRISPR gRNA sequence
tgtgccagggactattcacc

SEQ ID NO: 115062 - DNA, 20 bp, Artificial
  CRISPR gRNA sequence
ttcaccagggactattctag

SEQ ID NO: 115063 - DNA, 20 bp, Artificial
  CRISPR gRNA sequence
accagggactattctagatg

SEQ ID NO: 115064 - DNA, 20 bp, Artificial
  CRISPR gRNA sequence
ttctagatgctggagataaa

SEQ ID NO: 115065 - DNA, 20 bp, Artificial
  CRISPR gRNA sequence
tagatgctggagataaagca

SEQ ID NO: 115066 - DNA, 20 bp, Artificial
  CRISPR gRNA sequence
gatgctggagataaagcaat

SEQ ID NO: 115067 - DNA, 20 bp, Artificial
  CRISPR gRNA sequence
gagataaagcaatggataaa

SEQ ID NO: 115068 - DNA, 20 bp, Artificial
  CRISPR gRNA sequence
tatggaattcttttcagaat

SEQ ID NO: 115069 - DNA, 20 bp, Artificial
  CRISPR gRNA sequence
atggaattcttttcagaatt

SEQ ID NO: 115070 - DNA, 20 bp, Artificial
  CRISPR gRNA sequence
tggaattcttttcagaattc

SEQ ID NO: 115071 - DNA, 20 bp, Artificial
  CRISPR gRNA sequence
ttttcagaattcaaataacg

SEQ ID NO: 115072 - DNA, 20 bp, Artificial
  CRISPR gRNA sequence
ttcagaattcaaataacgaa

SEQ ID NO: 115073 - DNA, 20 bp, Artificial
  CRISPR gRNA sequence
tcagaattcaaataacgaag

SEQ ID NO: 115074 - DNA, 20 bp, Artificial
  CRISPR gRNA sequence
cagaattcaaataacgaagg

SEQ ID NO: 115075 - DNA, 20 bp, Artificial
  CRISPR gRNA sequence
agaattcaaataacgaaggg

SEQ ID NO: 115076 - DNA, 20 bp, Artificial
  CRISPR gRNA sequence
aaataacgaagggaattata

SEQ ID NO: 115077 - DNA, 20 bp, Artificial
  CRISPR gRNA sequence
tatactaatctttgagaagt

SEQ ID NO: 115078 - DNA, 20 bp, Artificial
  CRISPR gRNA sequence
atctttgagaagtggaaagt

SEQ ID NO: 115079 - DNA, 20 bp, Artificial
  CRISPR gRNA sequence
tgagaagtggaaagtagtat

SEQ ID NO: 115080 - DNA, 20 bp, Artificial
  CRISPR gRNA sequence
gagaagtggaaagtagtatt

SEQ ID NO: 115081 - DNA, 20 bp, Artificial
  CRISPR gRNA sequence
agaagtggaaagtagtattg

SEQ ID NO: 115082 - DNA, 20 bp, Artificial
  CRISPR gRNA sequence
cccatgatggacaaaataag

SEQ ID NO: 115083 - DNA, 20 bp, Artificial
  CRISPR gRNA sequence
aaaattagaaagattgtaat

SEQ ID NO: 115084 - DNA, 20 bp, Artificial
  CRISPR gRNA sequence
gaaagattgtaattgataga

SEQ ID NO: 115085 - DNA, 20 bp, Artificial
  CRISPR gRNA sequence
taattgatagagaaaccaaa

SEQ ID NO: 115086 - DNA, 20 bp, Artificial
  CRISPR gRNA sequence
atagagaaaccaaaaaaaaa

SEQ ID NO: 115087 - DNA, 20 bp, Artificial
  CRISPR gRNA sequence
ggaagataggaagatttggg

SEQ ID NO: 115088 - DNA, 20 bp, Artificial
  CRISPR gRNA sequence
gggtggtgtaactgaaagct

SEQ ID NO: 115089 - DNA, 20 bp, Artificial
  CRISPR gRNA sequence
ggtggtgtaactgaaagcta

SEQ ID NO: 115090 - DNA, 20 bp, Artificial
  CRISPR gRNA sequence
aaagctaaatcctcatatgt

SEQ ID NO: 115091 - DNA, 20 bp, Artificial
  CRISPR gRNA sequence
aatcctcatatgtcaaaata

SEQ ID NO: 115092 - DNA, 20 bp, Artificial
  CRISPR gRNA sequence
atatgtcaaaataggatgtt

SEQ ID NO: 115093 - DNA, 20 bp, Artificial
  CRISPR gRNA sequence
aaatgcataaattaagaatg

SEQ ID NO: 115094 - DNA, 20 bp, Artificial
  CRISPR gRNA sequence
agaatgagtaacagaagtct

SEQ ID NO: 115095 - DNA, 20 bp, Artificial
  CRISPR gRNA sequence
cacagaggtggaggaagcta

SEQ ID NO: 115096 - DNA, 20 bp, Artificial
  CRISPR gRNA sequence
tgaaaagaaacagaaccaac

SEQ ID NO: 115097 - DNA, 20 bp, Artificial
  CRISPR gRNA sequence
gctcagtggcatgcacctgt

SEQ ID NO: 115098 - DNA, 20 bp, Artificial
  CRISPR gRNA sequence
agtggcatgcacctgtagtc

SEQ ID NO: 115099 - DNA, 20 bp, Artificial
  CRISPR gRNA sequence
tagtcctagctacttgggag

SEQ ID NO: 115100 - DNA, 20 bp, Artificial
  CRISPR gRNA sequence
gctacttgggaggctaatcc

SEQ ID NO: 115101 - DNA, 20 bp, Artificial
  CRISPR gRNA sequence
cttgggaggctaatccagga

SEQ ID NO: 115102 - DNA, 20 bp, Artificial
  CRISPR gRNA sequence
gggaggctaatccaggagga

SEQ ID NO: 115103 - DNA, 20 bp, Artificial
  CRISPR gRNA sequence
ggaggctaatccaggaggat

SEQ ID NO: 115104 - DNA, 20 bp, Artificial
  CRISPR gRNA sequence
atccaggaggatggcttaag

SEQ ID NO: 115105 - DNA, 20 bp, Artificial
  CRISPR gRNA sequence
aagtccaggagtttgagctc

SEQ ID NO: 115106 - DNA, 20 bp, Artificial
  CRISPR gRNA sequence
agtccaggagtttgagctca

SEQ ID NO: 115107 - DNA, 20 bp, Artificial
  CRISPR gRNA sequence
gagctcagcctgggcaatgt

SEQ ID NO: 115108 - DNA, 20 bp, Artificial
  CRISPR gRNA sequence
agctcagcctgggcaatgta

SEQ ID NO: 115109 - DNA, 20 bp, Artificial
  CRISPR gRNA sequence
agcctgggcaatgtagagag

SEQ ID NO: 115110 - DNA, 20 bp, Artificial
  CRISPR gRNA sequence
ggcaatgtagagagacctcg

SEQ ID NO: 115111 - DNA, 20 bp, Artificial
  CRISPR gRNA sequence
gtttctacgaattgaatgaa

SEQ ID NO: 115112 - DNA, 20 bp, Artificial
  CRISPR gRNA sequence
ctacgaattgaatgaaaaat

SEQ ID NO: 115113 - DNA, 20 bp, Artificial
  CRISPR gRNA sequence
tacgaattgaatgaaaaata

SEQ ID NO: 115114 - DNA, 20 bp, Artificial
  CRISPR gRNA sequence
cgaattgaatgaaaaataaa

SEQ ID NO: 115115 - DNA, 20 bp, Artificial
  CRISPR gRNA sequence
aatgaaaaataaataatttt

SEQ ID NO: 115116 - DNA, 20 bp, Artificial
  CRISPR gRNA sequence
ttataaaagattcaatacag

SEQ ID NO: 115117 - DNA, 20 bp, Artificial
  CRISPR gRNA sequence
tataaaagattcaatacagt

SEQ ID NO: 115118 - DNA, 20 bp, Artificial
  CRISPR gRNA sequence
ataaaagattcaatacagtt

SEQ ID NO: 115119 - DNA, 20 bp, Artificial
  CRISPR gRNA sequence
taaaagattcaatacagtta

SEQ ID NO: 115120 - DNA, 20 bp, Artificial
  CRISPR gRNA sequence
aatacagttattcaaagcgg

SEQ ID NO: 115121 - DNA, 20 bp, Artificial
  CRISPR gRNA sequence
ttcaaagcggttgtatttgg

SEQ ID NO: 115122 - DNA, 20 bp, Artificial
  CRISPR gRNA sequence
aaagcggttgtatttgggaa

SEQ ID NO: 115123 - DNA, 20 bp, Artificial
  CRISPR gRNA sequence
tatttgggaaagagctgtgg

SEQ ID NO: 115124 - DNA, 20 bp, Artificial
  CRISPR gRNA sequence
gggaaagagctgtggggtac

SEQ ID NO: 115125 - DNA, 20 bp, Artificial
  CRISPR gRNA sequence
ggaaagagctgtggggtaca

SEQ ID NO: 115126 - DNA, 20 bp, Artificial
  CRISPR gRNA sequence
tggggtacaggactctgtta

SEQ ID NO: 115127 - DNA, 20 bp, Artificial
  CRISPR gRNA sequence
tgttacttgtttttacctac

SEQ ID NO: 115128 - DNA, 20 bp, Artificial
  CRISPR gRNA sequence
ttacttgtttttacctacat

SEQ ID NO: 115129 - DNA, 20 bp, Artificial
  CRISPR gRNA sequence
cttgtttttacctacattta

SEQ ID NO: 115130 - DNA, 20 bp, Artificial
  CRISPR gRNA sequence
gtttttacctacatttagta

SEQ ID NO: 115131 - DNA, 20 bp, Artificial
  CRISPR gRNA sequence
tttttacctacatttagtac

SEQ ID NO: 115132 - DNA, 20 bp, Artificial
  CRISPR gRNA sequence
ttacctacatttagtacagt

SEQ ID NO: 115133 - DNA, 20 bp, Artificial
  CRISPR gRNA sequence
tacctacatttagtacagtg

SEQ ID NO: 115134 - DNA, 20 bp, Artificial
  CRISPR gRNA sequence
acctacatttagtacagtgt

SEQ ID NO: 115135 - DNA, 20 bp, Artificial
  CRISPR gRNA sequence
cctacatttagtacagtgtt

SEQ ID NO: 115136 - DNA, 20 bp, Artificial
  CRISPR gRNA sequence
catttagtacagtgttttgg

SEQ ID NO: 115137 - DNA, 20 bp, Artificial
  CRISPR gRNA sequence
agtacagtgttttggtgttt

SEQ ID NO: 115138 - DNA, 20 bp, Artificial
  CRISPR gRNA sequence
gtacagtgttttggtgtttt

SEQ ID NO: 115139 - DNA, 20 bp, Artificial
  CRISPR gRNA sequence
tggtgttttttaagaaaaat

SEQ ID NO: 115140 - DNA, 20 bp, Artificial
  CRISPR gRNA sequence
ggtgttttttaagaaaaatt

SEQ ID NO: 115141 - DNA, 20 bp, Artificial
  CRISPR gRNA sequence
gtgttttttaagaaaaatta

SEQ ID NO: 115142 - DNA, 20 bp, Artificial
  CRISPR gRNA sequence
tttaagaaaaattaggattg

SEQ ID NO: 115143 - DNA, 20 bp, Artificial
  CRISPR gRNA sequence
ttaagaaaaattaggattga

SEQ ID NO: 115144 - DNA, 20 bp, Artificial
  CRISPR gRNA sequence
taagaaaaattaggattgaa

SEQ ID NO: 115145 - DNA, 20 bp, Artificial
  CRISPR gRNA sequence
aagaaaaattaggattgaat

SEQ ID NO: 115146 - DNA, 20 bp, Artificial
  CRISPR gRNA sequence
agaaaaattaggattgaatt

SEQ ID NO: 115147 - DNA, 20 bp, Artificial
  CRISPR gRNA sequence
ggattgaattataagttaac

SEQ ID NO: 115148 - DNA, 20 bp, Artificial
  CRISPR gRNA sequence
aattataagttaactattat

SEQ ID NO: 115149 - DNA, 20 bp, Artificial
  CRISPR gRNA sequence
taagttaactattattttta

SEQ ID NO: 115150 - DNA, 20 bp, Artificial
  CRISPR gRNA sequence
actattatttttataaatat

SEQ ID NO: 115151 - DNA, 20 bp, Artificial
  CRISPR gRNA sequence
ttatttttataaatataggc

SEQ ID NO: 115152 - DNA, 20 bp, Artificial
  CRISPR gRNA sequence
tttttataaatataggcatt

SEQ ID NO: 115153 - DNA, 20 bp, Artificial
  CRISPR gRNA sequence
ttataaatataggcatttag

SEQ ID NO: 115154 - DNA, 20 bp, Artificial
  CRISPR gRNA sequence
tataaatataggcatttagt

SEQ ID NO: 115155 - DNA, 20 bp, Artificial
  CRISPR gRNA sequence
ataaatataggcatttagta

SEQ ID NO: 115156 - DNA, 20 bp, Artificial
  CRISPR gRNA sequence
taaatataggcatttagtag

SEQ ID NO: 115157 - DNA, 20 bp, Artificial
  CRISPR gRNA sequence
agtagcacttggtctatcta

SEQ ID NO: 115158 - DNA, 20 bp, Artificial
  CRISPR gRNA sequence
gtagcacttggtctatctat

SEQ ID NO: 115159 - DNA, 20 bp, Artificial
  CRISPR gRNA sequence
ggtctatctatttttgtgct

SEQ ID NO: 115160 - DNA, 20 bp, Artificial
  CRISPR gRNA sequence
gtctatctatttttgtgctg

SEQ ID NO: 115161 - DNA, 20 bp, Artificial
  CRISPR gRNA sequence
tctatttttgtgctgttttt

SEQ ID NO: 115162 - DNA, 20 bp, Artificial
  CRISPR gRNA sequence
tttttgtgctgtttttttgt

SEQ ID NO: 115163 - DNA, 20 bp, Artificial
  CRISPR gRNA sequence
ttgtgctgtttttttgtctt

SEQ ID NO: 115164 - DNA, 20 bp, Artificial
  CRISPR gRNA sequence
tgtgctgtttttttgtctta

SEQ ID NO: 115165 - DNA, 20 bp, Artificial
  CRISPR gRNA sequence
gtgctgtttttttgtcttat

SEQ ID NO: 115166 - DNA, 20 bp, Artificial
  CRISPR gRNA sequence
tgctgtttttttgtcttatg

SEQ ID NO: 115167 - DNA, 20 bp, Artificial
  CRISPR gRNA sequence
tttttttgtcttatgactac

SEQ ID NO: 115168 - DNA, 20 bp, Artificial
  CRISPR gRNA sequence
ttttgtcttatgactactgt

SEQ ID NO: 115169 - DNA, 20 bp, Artificial
  CRISPR gRNA sequence
tttgtcttatgactactgtt

SEQ ID NO: 115170 - DNA, 20 bp, Artificial
  CRISPR gRNA sequence
ttgtcttatgactactgttc

SEQ ID NO: 115171 - DNA, 20 bp, Artificial
  CRISPR gRNA sequence
tgtcttatgactactgttcc

SEQ ID NO: 115172 - DNA, 20 bp, Artificial
  CRISPR gRNA sequence
gtcttatgactactgttcct

SEQ ID NO: 115173 - DNA, 20 bp, Artificial
  CRISPR gRNA sequence
tcttatgactactgttcctg

SEQ ID NO: 115174 - DNA, 20 bp, Artificial
  CRISPR gRNA sequence
atgactactgttcctgacca

SEQ ID NO: 115175 - DNA, 20 bp, Artificial
  CRISPR gRNA sequence
tgactactgttcctgaccat

SEQ ID NO: 115176 - DNA, 20 bp, Artificial
  CRISPR gRNA sequence
ctgttcctgaccattagatg

SEQ ID NO: 115177 - DNA, 20 bp, Artificial
  CRISPR gRNA sequence
ttcctgaccattagatggca

SEQ ID NO: 115178 - DNA, 20 bp, Artificial
  CRISPR gRNA sequence
ctgaccattagatggcagca

SEQ ID NO: 115179 - DNA, 20 bp, Artificial
  CRISPR gRNA sequence
accattagatggcagcagaa

SEQ ID NO: 115180 - DNA, 20 bp, Artificial
  CRISPR gRNA sequence
gatggcagcagaaatatcta

SEQ ID NO: 115181 - DNA, 20 bp, Artificial
  CRISPR gRNA sequence
gagccatgggtggacatgaa

SEQ ID NO: 115182 - DNA, 20 bp, Artificial
  CRISPR gRNA sequence
gggcatggttatatagtttc

SEQ ID NO: 115183 - DNA, 20 bp, Artificial
  CRISPR gRNA sequence
tatagtttctcagagtggca

SEQ ID NO: 115184 - DNA, 20 bp, Artificial
  CRISPR gRNA sequence
ctcagagtggcacctgaatc

SEQ ID NO: 115185 - DNA, 20 bp, Artificial
  CRISPR gRNA sequence
tcagagtggcacctgaatct

SEQ ID NO: 115186 - DNA, 20 bp, Artificial
  CRISPR gRNA sequence
agagtggcacctgaatctcc

SEQ ID NO: 115187 - DNA, 20 bp, Artificial
  CRISPR gRNA sequence
aatctcctatgacacagtca

SEQ ID NO: 115188 - DNA, 20 bp, Artificial
  CRISPR gRNA sequence
ctatgacacagtcatctggg

SEQ ID NO: 115189 - DNA, 20 bp, Artificial
  CRISPR gRNA sequence
tgacacagtcatctggggtg

SEQ ID NO: 115190 - DNA, 20 bp, Artificial
  CRISPR gRNA sequence
gggtgtttgtttaaagtgca

SEQ ID NO: 115191 - DNA, 20 bp, Artificial
  CRISPR gRNA sequence
gtttaaagtgcagatcttta

SEQ ID NO: 115192 - DNA, 20 bp, Artificial
  CRISPR gRNA sequence
tttaaagtgcagatctttag

SEQ ID NO: 115193 - DNA, 20 bp, Artificial
  CRISPR gRNA sequence
aaagtgcagatctttagtat

SEQ ID NO: 115194 - DNA, 20 bp, Artificial
  CRISPR gRNA sequence
aagtgcagatctttagtata

SEQ ID NO: 115195 - DNA, 20 bp, Artificial
  CRISPR gRNA sequence
tagtataaatttctccaggg

SEQ ID NO: 115196 - DNA, 20 bp, Artificial
  CRISPR gRNA sequence
agtataaatttctccaggga

SEQ ID NO: 115197 - DNA, 20 bp, Artificial
  CRISPR gRNA sequence
gtataaatttctccagggat

SEQ ID NO: 115198 - DNA, 20 bp, Artificial
  CRISPR gRNA sequence
ctccagggatccgcatttac

SEQ ID NO: 115199 - DNA, 20 bp, Artificial
  CRISPR gRNA sequence
tccagggatccgcatttacc

SEQ ID NO: 115200 - DNA, 20 bp, Artificial
  CRISPR gRNA sequence
cagggatccgcatttaccca

SEQ ID NO: 115201 - DNA, 20 bp, Artificial
  CRISPR gRNA sequence
acccaagtaccctataaaaa

SEQ ID NO: 115202 - DNA, 20 bp, Artificial
  CRISPR gRNA sequence
cccaagtaccctataaaaat

SEQ ID NO: 115203 - DNA, 20 bp, Artificial
  CRISPR gRNA sequence
taaaaattactttttgtggc

SEQ ID NO: 115204 - DNA, 20 bp, Artificial
  CRISPR gRNA sequence
ctttttgtggcatttacaaa

SEQ ID NO: 115205 - DNA, 20 bp, Artificial
  CRISPR gRNA sequence
tttgtggcatttacaaaaaa

SEQ ID NO: 115206 - DNA, 20 bp, Artificial
  CRISPR gRNA sequence
ttgtggcatttacaaaaaaa

SEQ ID NO: 115207 - DNA, 20 bp, Artificial
  CRISPR gRNA sequence
tgtggcatttacaaaaaaaa

SEQ ID NO: 115208 - DNA, 20 bp, Artificial
  CRISPR gRNA sequence
gtggcatttacaaaaaaaat

SEQ ID NO: 115209 - DNA, 20 bp, Artificial
  CRISPR gRNA sequence
tggcatttacaaaaaaaatg

SEQ ID NO: 115210 - DNA, 20 bp, Artificial
  CRISPR gRNA sequence
acaaaaaaaatggatgaaga

SEQ ID NO: 115211 - DNA, 20 bp, Artificial
  CRISPR gRNA sequence
caaaaaaaatggatgaagag

SEQ ID NO: 115212 - DNA, 20 bp, Artificial
  CRISPR gRNA sequence
tttctatgtccatacttcat

SEQ ID NO: 115213 - DNA, 20 bp, Artificial
  CRISPR gRNA sequence
ctatgtccatacttcatgcc

SEQ ID NO: 115214 - DNA, 20 bp, Artificial
  CRISPR gRNA sequence
tatgtccatacttcatgcca

SEQ ID NO: 115215 - DNA, 20 bp, Artificial
  CRISPR gRNA sequence
tgtccatacttcatgccacc

SEQ ID NO: 115216 - DNA, 20 bp, Artificial
  CRISPR gRNA sequence
catgccaccaataagctctg

SEQ ID NO: 115217 - DNA, 20 bp, Artificial
  CRISPR gRNA sequence
atgccaccaataagctctgg

SEQ ID NO: 115218 - DNA, 20 bp, Artificial
  CRISPR gRNA sequence
tggtttcctgttcacacaga

SEQ ID NO: 115219 - DNA, 20 bp, Artificial
  CRISPR gRNA sequence
gtttcctgttcacacagatg

SEQ ID NO: 115220 - DNA, 20 bp, Artificial
  CRISPR gRNA sequence
cctgttcacacagatggttc

SEQ ID NO: 115221 - DNA, 20 bp, Artificial
  CRISPR gRNA sequence
ctgttcacacagatggttcc

SEQ ID NO: 115222 - DNA, 20 bp, Artificial
  CRISPR gRNA sequence
ttcacacagatggttcctgg

SEQ ID NO: 115223 - DNA, 20 bp, Artificial
  CRISPR gRNA sequence
acacagatggttcctggggc

SEQ ID NO: 115224 - DNA, 20 bp, Artificial
  CRISPR gRNA sequence
ctggggctggctctgtgcct

SEQ ID NO: 115225 - DNA, 20 bp, Artificial
  CRISPR gRNA sequence
gggctggctctgtgcctgct

SEQ ID NO: 115226 - DNA, 20 bp, Artificial
  CRISPR gRNA sequence
gctctgtgcctgctatccaa

SEQ ID NO: 115227 - DNA, 20 bp, Artificial
  CRISPR gRNA sequence
tgtgcctgctatccaaagaa

SEQ ID NO: 115228 - DNA, 20 bp, Artificial
  CRISPR gRNA sequence
tgcctgctatccaaagaatc

SEQ ID NO: 115229 - DNA, 20 bp, Artificial
  CRISPR gRNA sequence
ctatccaaagaatccctcta

SEQ ID NO: 115230 - DNA, 20 bp, Artificial
  CRISPR gRNA sequence
tccaaagaatccctctacct

SEQ ID NO: 115231 - DNA, 20 bp, Artificial
  CRISPR gRNA sequence
tacctggagcagagatgctt

SEQ ID NO: 115232 - DNA, 20 bp, Artificial
  CRISPR gRNA sequence
cctggagcagagatgcttga

SEQ ID NO: 115233 - DNA, 20 bp, Artificial
  CRISPR gRNA sequence
gagcagagatgcttgaagaa

SEQ ID NO: 115234 - DNA, 20 bp, Artificial
  CRISPR gRNA sequence
gaagaagagcctctctacgt

SEQ ID NO: 115235 - DNA, 20 bp, Artificial
  CRISPR gRNA sequence
aagaagagcctctctacgtg

SEQ ID NO: 115236 - DNA, 20 bp, Artificial
  CRISPR gRNA sequence
tctacgtgaatgccaaacaa

SEQ ID NO: 115237 - DNA, 20 bp, Artificial
  CRISPR gRNA sequence
tacgtgaatgccaaacaata

SEQ ID NO: 115238 - DNA, 20 bp, Artificial
  CRISPR gRNA sequence
cgtgaatgccaaacaatacc

SEQ ID NO: 115239 - DNA, 20 bp, Artificial
  CRISPR gRNA sequence
ttaagaggaggcaagcccga

SEQ ID NO: 115240 - DNA, 20 bp, Artificial
  CRISPR gRNA sequence
aagaggaggcaagcccgagc

SEQ ID NO: 115241 - DNA, 20 bp, Artificial
  CRISPR gRNA sequence
agaggaggcaagcccgagct

SEQ ID NO: 115242 - DNA, 20 bp, Artificial
  CRISPR gRNA sequence
aactagaggcagaagggaaa

SEQ ID NO: 115243 - DNA, 20 bp, Artificial
  CRISPR gRNA sequence
gaggcagaagggaaaattcc

SEQ ID NO: 115244 - DNA, 20 bp, Artificial
  CRISPR gRNA sequence
caaaggagagaagggtatgt

SEQ ID NO: 115245 - DNA, 20 bp, Artificial
  CRISPR gRNA sequence
ggaaggatataggaaaggag

SEQ ID NO: 115246 - DNA, 20 bp, Artificial
  CRISPR gRNA sequence
tacttttgaaattatctttt

SEQ ID NO: 115247 - DNA, 20 bp, Artificial
  CRISPR gRNA sequence
cttttgaaattatcttttat

SEQ ID NO: 115248 - DNA, 20 bp, Artificial
  CRISPR gRNA sequence
ttgaaattatcttttatatg

SEQ ID NO: 115249 - DNA, 20 bp, Artificial
  CRISPR gRNA sequence
tgaaattatcttttatatgg

SEQ ID NO: 115250 - DNA, 20 bp, Artificial
  CRISPR gRNA sequence
gaaattatcttttatatggc

SEQ ID NO: 115251 - DNA, 20 bp, Artificial
  CRISPR gRNA sequence
aaattatcttttatatggct

SEQ ID NO: 115252 - DNA, 20 bp, Artificial
  CRISPR gRNA sequence
tcttttatatggcttgtttt

SEQ ID NO: 115253 - DNA, 20 bp, Artificial
  CRISPR gRNA sequence
ttatatggcttgttttctca

SEQ ID NO: 115254 - DNA, 20 bp, Artificial
  CRISPR gRNA sequence
tatatggcttgttttctcac

SEQ ID NO: 115255 - DNA, 20 bp, Artificial
  CRISPR gRNA sequence
atatggcttgttttctcacg

SEQ ID NO: 115256 - DNA, 20 bp, Artificial
  CRISPR gRNA sequence
tatggcttgttttctcacgt

SEQ ID NO: 115257 - DNA, 20 bp, Artificial
  CRISPR gRNA sequence
gttttctcacgtaccttcca

SEQ ID NO: 115258 - DNA, 20 bp, Artificial
  CRISPR gRNA sequence
ttttctcacgtaccttccaa

SEQ ID NO: 115259 - DNA, 20 bp, Artificial
  CRISPR gRNA sequence
tctcacgtaccttccaaaca

SEQ ID NO: 115260 - DNA, 20 bp, Artificial
  CRISPR gRNA sequence
ctcacgtaccttccaaacaa

SEQ ID NO: 115261 - DNA, 20 bp, Artificial
  CRISPR gRNA sequence
tcacgtaccttccaaacaat

SEQ ID NO: 115262 - DNA, 20 bp, Artificial
  CRISPR gRNA sequence
acgtaccttccaaacaattg

SEQ ID NO: 115263 - DNA, 20 bp, Artificial
  CRISPR gRNA sequence
ccaaacaattgacgttagat

SEQ ID NO: 115264 - DNA, 20 bp, Artificial
  CRISPR gRNA sequence
caaacaattgacgttagata

SEQ ID NO: 115265 - DNA, 20 bp, Artificial
  CRISPR gRNA sequence
acgttagatacttgttgtct

SEQ ID NO: 115266 - DNA, 20 bp, Artificial
  CRISPR gRNA sequence
gatacttgttgtctcttttg

SEQ ID NO: 115267 - DNA, 20 bp, Artificial
  CRISPR gRNA sequence
gttgtctcttttgtaagagt

SEQ ID NO: 115268 - DNA, 20 bp, Artificial
  CRISPR gRNA sequence
ttgtctcttttgtaagagtt

SEQ ID NO: 115269 - DNA, 20 bp, Artificial
  CRISPR gRNA sequence
tctcttttgtaagagttagc

SEQ ID NO: 115270 - DNA, 20 bp, Artificial
  CRISPR gRNA sequence
ttttgtaagagttagcattt

SEQ ID NO: 115271 - DNA, 20 bp, Artificial
  CRISPR gRNA sequence
ttgtaagagttagcatttgt

SEQ ID NO: 115272 - DNA, 20 bp, Artificial
  CRISPR gRNA sequence
tgtaagagttagcatttgtt

SEQ ID NO: 115273 - DNA, 20 bp, Artificial
  CRISPR gRNA sequence
gtaagagttagcatttgtta

SEQ ID NO: 115274 - DNA, 20 bp, Artificial
  CRISPR gRNA sequence
taagagttagcatttgttat

SEQ ID NO: 115275 - DNA, 20 bp, Artificial
  CRISPR gRNA sequence
gcatttgttattactaatat

SEQ ID NO: 115276 - DNA, 20 bp, Artificial
  CRISPR gRNA sequence
gttattactaatatgcagct

SEQ ID NO: 115277 - DNA, 20 bp, Artificial
  CRISPR gRNA sequence
ttattactaatatgcagctg

SEQ ID NO: 115278 - DNA, 20 bp, Artificial
  CRISPR gRNA sequence
ttactaatatgcagctgcag

SEQ ID NO: 115279 - DNA, 20 bp, Artificial
  CRISPR gRNA sequence
ctaatatgcagctgcagtta

SEQ ID NO: 115280 - DNA, 20 bp, Artificial
  CRISPR gRNA sequence
atatgcagctgcagttataa

SEQ ID NO: 115281 - DNA, 20 bp, Artificial
  CRISPR gRNA sequence
cagttataataacgaaaaca

SEQ ID NO: 115282 - DNA, 20 bp, Artificial
  CRISPR gRNA sequence
taataacgaaaacaaacagt

SEQ ID NO: 115283 - DNA, 20 bp, Artificial
  CRISPR gRNA sequence
aaataagatgttattccttt

SEQ ID NO: 115284 - DNA, 20 bp, Artificial
  CRISPR gRNA sequence
aataagatgttattcctttt

SEQ ID NO: 115285 - DNA, 20 bp, Artificial
  CRISPR gRNA sequence
ttccttttcatacataaaag

SEQ ID NO: 115286 - DNA, 20 bp, Artificial
  CRISPR gRNA sequence
cttttcatacataaaagtag

SEQ ID NO: 115287 - DNA, 20 bp, Artificial
  CRISPR gRNA sequence
ttcatacataaaagtagtcc

SEQ ID NO: 115288 - DNA, 20 bp, Artificial
  CRISPR gRNA sequence
tcatacataaaagtagtcca

SEQ ID NO: 115289 - DNA, 20 bp, Artificial
  CRISPR gRNA sequence
catacataaaagtagtccag

SEQ ID NO: 115290 - DNA, 20 bp, Artificial
  CRISPR gRNA sequence
atacataaaagtagtccaga

SEQ ID NO: 115291 - DNA, 20 bp, Artificial
  CRISPR gRNA sequence
tcctggactggtagcacatt

SEQ ID NO: 115292 - DNA, 20 bp, Artificial
  CRISPR gRNA sequence
gactggtagcacattttcac

SEQ ID NO: 115293 - DNA, 20 bp, Artificial
  CRISPR gRNA sequence
gtagcacattttcacagttc

SEQ ID NO: 115294 - DNA, 20 bp, Artificial
  CRISPR gRNA sequence
tcacagttctcaagacctgt

SEQ ID NO: 115295 - DNA, 20 bp, Artificial
  CRISPR gRNA sequence
cacagttctcaagacctgtt

SEQ ID NO: 115296 - DNA, 20 bp, Artificial
  CRISPR gRNA sequence
acagttctcaagacctgttt

SEQ ID NO: 115297 - DNA, 20 bp, Artificial
  CRISPR gRNA sequence
tcaagacctgtttcactgct

SEQ ID NO: 115298 - DNA, 20 bp, Artificial
  CRISPR gRNA sequence
aagacctgtttcactgcttt

SEQ ID NO: 115299 - DNA, 20 bp, Artificial
  CRISPR gRNA sequence
tttcactgctttaatattgc

SEQ ID NO: 115300 - DNA, 20 bp, Artificial
  CRISPR gRNA sequence
cactgctttaatattgctag

SEQ ID NO: 115301 - DNA, 20 bp, Artificial
  CRISPR gRNA sequence
actgctttaatattgctagt

SEQ ID NO: 115302 - DNA, 20 bp, Artificial
  CRISPR gRNA sequence
ctttaatattgctagtgtgc

SEQ ID NO: 115303 - DNA, 20 bp, Artificial
  CRISPR gRNA sequence
taatattgctagtgtgctgt

SEQ ID NO: 115304 - DNA, 20 bp, Artificial
  CRISPR gRNA sequence
aatattgctagtgtgctgtt

SEQ ID NO: 115305 - DNA, 20 bp, Artificial
  CRISPR gRNA sequence
atattgctagtgtgctgttc

SEQ ID NO: 115306 - DNA, 20 bp, Artificial
  CRISPR gRNA sequence
ctagtgtgctgttcatggtc

SEQ ID NO: 115307 - DNA, 20 bp, Artificial
  CRISPR gRNA sequence
gtgtgctgttcatggtccaa

SEQ ID NO: 115308 - DNA, 20 bp, Artificial
  CRISPR gRNA sequence
ttcatggtccaagattcctg

SEQ ID NO: 115309 - DNA, 20 bp, Artificial
  CRISPR gRNA sequence
atggtccaagattcctgctt

SEQ ID NO: 115310 - DNA, 20 bp, Artificial
  CRISPR gRNA sequence
ctgcttaggctccagcctag

SEQ ID NO: 115311 - DNA, 20 bp, Artificial
  CRISPR gRNA sequence
cttaggctccagcctaggaa

SEQ ID NO: 115312 - DNA, 20 bp, Artificial
  CRISPR gRNA sequence
aggctccagcctaggaagaa

SEQ ID NO: 115313 - DNA, 20 bp, Artificial
  CRISPR gRNA sequence
ggctccagcctaggaagaaa

SEQ ID NO: 115314 - DNA, 20 bp, Artificial
  CRISPR gRNA sequence
cagcctaggaagaaagggaa

SEQ ID NO: 115315 - DNA, 20 bp, Artificial
  CRISPR gRNA sequence
ggaagaaagggaacaagaaa

SEQ ID NO: 115316 - DNA, 20 bp, Artificial
  CRISPR gRNA sequence
tcttttttttttttttcctg

SEQ ID NO: 115317 - DNA, 20 bp, Artificial
  CRISPR gRNA sequence
cttttttttttttttcctga

SEQ ID NO: 115318 - DNA, 20 bp, Artificial
  CRISPR gRNA sequence
ttttttttttttttcctgag

SEQ ID NO: 115319 - DNA, 20 bp, Artificial
  CRISPR gRNA sequence
ttttttttttttcctgagac

SEQ ID NO: 115320 - DNA, 20 bp, Artificial
  CRISPR gRNA sequence
tttttttttttcctgagact

SEQ ID NO: 115321 - DNA, 20 bp, Artificial
  CRISPR gRNA sequence
ttttttttttcctgagactc

SEQ ID NO: 115322 - DNA, 20 bp, Artificial
  CRISPR gRNA sequence
tttttttttcctgagactca

SEQ ID NO: 115323 - DNA, 20 bp, Artificial
  CRISPR gRNA sequence
ttttttttcctgagactcag

SEQ ID NO: 115324 - DNA, 20 bp, Artificial
  CRISPR gRNA sequence
tttttttcctgagactcagt

SEQ ID NO: 115325 - DNA, 20 bp, Artificial
  CRISPR gRNA sequence
ttttttcctgagactcagtc

SEQ ID NO: 115326 - DNA, 20 bp, Artificial
  CRISPR gRNA sequence
tttttcctgagactcagtct

SEQ ID NO: 115327 - DNA, 20 bp, Artificial
  CRISPR gRNA sequence
ttttcctgagactcagtctt

SEQ ID NO: 115328 - DNA, 20 bp, Artificial
  CRISPR gRNA sequence
tttcctgagactcagtcttg

SEQ ID NO: 115329 - DNA, 20 bp, Artificial
  CRISPR gRNA sequence
ttcctgagactcagtcttgc

SEQ ID NO: 115330 - DNA, 20 bp, Artificial
  CRISPR gRNA sequence
tcctgagactcagtcttgct

SEQ ID NO: 115331 - DNA, 20 bp, Artificial
  CRISPR gRNA sequence
cctgagactcagtcttgctc

SEQ ID NO: 115332 - DNA, 20 bp, Artificial
  CRISPR gRNA sequence
ctgagactcagtcttgctct

SEQ ID NO: 115333 - DNA, 20 bp, Artificial
  CRISPR gRNA sequence
agactcagtcttgctctgtc

SEQ ID NO: 115334 - DNA, 20 bp, Artificial
  CRISPR gRNA sequence
agtcttgctctgtcatccag

SEQ ID NO: 115335 - DNA, 20 bp, Artificial
  CRISPR gRNA sequence
gctctgtcatccaggccgga

SEQ ID NO: 115336 - DNA, 20 bp, Artificial
  CRISPR gRNA sequence
ctctgtcatccaggccggag

SEQ ID NO: 115337 - DNA, 20 bp, Artificial
  CRISPR gRNA sequence
tgtcatccaggccggagtgc

SEQ ID NO: 115338 - DNA, 20 bp, Artificial
  CRISPR gRNA sequence
tcatccaggccggagtgcag

SEQ ID NO: 115339 - DNA, 20 bp, Artificial
  CRISPR gRNA sequence
agctcactgcaacctgcacc

SEQ ID NO: 115340 - DNA, 20 bp, Artificial
  CRISPR gRNA sequence
actgcaacctgcaccttcca

SEQ ID NO: 115341 - DNA, 20 bp, Artificial
  CRISPR gRNA sequence
caacctgcaccttccatgtt

SEQ ID NO: 115342 - DNA, 20 bp, Artificial
  CRISPR gRNA sequence
caccttccatgttcaagtga

SEQ ID NO: 115343 - DNA, 20 bp, Artificial
  CRISPR gRNA sequence
ccatgttcaagtgattctcc

SEQ ID NO: 115344 - DNA, 20 bp, Artificial
  CRISPR gRNA sequence
catgttcaagtgattctcct

SEQ ID NO: 115345 - DNA, 20 bp, Artificial
  CRISPR gRNA sequence
aagtgattctcctgcctcag

SEQ ID NO: 115346 - DNA, 20 bp, Artificial
  CRISPR gRNA sequence
tcctgcctcagcctcctgag

SEQ ID NO: 115347 - DNA, 20 bp, Artificial
  CRISPR gRNA sequence
ctgcctcagcctcctgagta

SEQ ID NO: 115348 - DNA, 20 bp, Artificial
  CRISPR gRNA sequence
cctcagcctcctgagtagct

SEQ ID NO: 115349 - DNA, 20 bp, Artificial
  CRISPR gRNA sequence
agcctcctgagtagctggga

SEQ ID NO: 115350 - DNA, 20 bp, Artificial
  CRISPR gRNA sequence
ctgagtagctgggattacag

SEQ ID NO: 115351 - DNA, 20 bp, Artificial
  CRISPR gRNA sequence
agtagctgggattacaggtg

SEQ ID NO: 115352 - DNA, 20 bp, Artificial
  CRISPR gRNA sequence
ggattacaggtgtgcgccac

SEQ ID NO: 115353 - DNA, 20 bp, Artificial
  CRISPR gRNA sequence
caggtgtgcgccaccacgcc

SEQ ID NO: 115354 - DNA, 20 bp, Artificial
  CRISPR gRNA sequence
atttttgtgtttttagtaga

SEQ ID NO: 115355 - DNA, 20 bp, Artificial
  CRISPR gRNA sequence
tttttgtgtttttagtagag

SEQ ID NO: 115356 - DNA, 20 bp, Artificial
  CRISPR gRNA sequence
ttgtgtttttagtagagacg

SEQ ID NO: 115357 - DNA, 20 bp, Artificial
  CRISPR gRNA sequence
tgtgtttttagtagagacgg

SEQ ID NO: 115358 - DNA, 20 bp, Artificial
  CRISPR gRNA sequence
gtgtttttagtagagacggg

SEQ ID NO: 115359 - DNA, 20 bp, Artificial
  CRISPR gRNA sequence
tgtttttagtagagacgggg

SEQ ID NO: 115360 - DNA, 20 bp, Artificial
  CRISPR gRNA sequence
ttagtagagacggggtttca

SEQ ID NO: 115361 - DNA, 20 bp, Artificial
  CRISPR gRNA sequence
tagtagagacggggtttcac

SEQ ID NO: 115362 - DNA, 20 bp, Artificial
  CRISPR gRNA sequence
agtagagacggggtttcacc

SEQ ID NO: 115363 - DNA, 20 bp, Artificial
  CRISPR gRNA sequence
gtagagacggggtttcacca

SEQ ID NO: 115364 - DNA, 20 bp, Artificial
  CRISPR gRNA sequence
caccatgttggccaggctgg

SEQ ID NO: 115365 - DNA, 20 bp, Artificial
  CRISPR gRNA sequence
accatgttggccaggctggt

SEQ ID NO: 115366 - DNA, 20 bp, Artificial
  CRISPR gRNA sequence
gccaggctggtctcgaactc

SEQ ID NO: 115367 - DNA, 20 bp, Artificial
  CRISPR gRNA sequence
gtctcgaactcctgacctca

SEQ ID NO: 115368 - DNA, 20 bp, Artificial
  CRISPR gRNA sequence
gaactcctgacctcaggtga

SEQ ID NO: 115369 - DNA, 20 bp, Artificial
  CRISPR gRNA sequence
ctgacctcaggtgatccacc

SEQ ID NO: 115370 - DNA, 20 bp, Artificial
  CRISPR gRNA sequence
acctcaggtgatccacctgc

SEQ ID NO: 115371 - DNA, 20 bp, Artificial
  CRISPR gRNA sequence
aggtgatccacctgcctggg

SEQ ID NO: 115372 - DNA, 20 bp, Artificial
  CRISPR gRNA sequence
cctgggcctcccaaagtgcc

SEQ ID NO: 115373 - DNA, 20 bp, Artificial
  CRISPR gRNA sequence
ggcctcccaaagtgccggga

SEQ ID NO: 115374 - DNA, 20 bp, Artificial
  CRISPR gRNA sequence
ccaaagtgccgggattatag

SEQ ID NO: 115375 - DNA, 20 bp, Artificial
  CRISPR gRNA sequence
taggcgtgagccaccatacc

SEQ ID NO: 115376 - DNA, 20 bp, Artificial
  CRISPR gRNA sequence
tctttcaaggaaactttgaa

SEQ ID NO: 115377 - DNA, 20 bp, Artificial
  CRISPR gRNA sequence
ctttcaaggaaactttgaag

SEQ ID NO: 115378 - DNA, 20 bp, Artificial
  CRISPR gRNA sequence
tttcaaggaaactttgaaga

SEQ ID NO: 115379 - DNA, 20 bp, Artificial
  CRISPR gRNA sequence
tcaaggaaactttgaagaag

SEQ ID NO: 115380 - DNA, 20 bp, Artificial
  CRISPR gRNA sequence
caaggaaactttgaagaagt

SEQ ID NO: 115381 - DNA, 20 bp, Artificial
  CRISPR gRNA sequence
aaggaaactttgaagaagtt

SEQ ID NO: 115382 - DNA, 20 bp, Artificial
  CRISPR gRNA sequence
tgaagaagttgtgtaccttc

SEQ ID NO: 115383 - DNA, 20 bp, Artificial
  CRISPR gRNA sequence
gaagaagttgtgtaccttcc

SEQ ID NO: 115384 - DNA, 20 bp, Artificial
  CRISPR gRNA sequence
aagaagttgtgtaccttcca

SEQ ID NO: 115385 - DNA, 20 bp, Artificial
  CRISPR gRNA sequence
tgtaccttccactagccgga

SEQ ID NO: 115386 - DNA, 20 bp, Artificial
  CRISPR gRNA sequence
ccactagccggaatttagtt

SEQ ID NO: 115387 - DNA, 20 bp, Artificial
  CRISPR gRNA sequence
cactagccggaatttagtta

SEQ ID NO: 115388 - DNA, 20 bp, Artificial
  CRISPR gRNA sequence
gccggaatttagttacctga

SEQ ID NO: 115389 - DNA, 20 bp, Artificial
  CRISPR gRNA sequence
agttacctgatcacacctaa

SEQ ID NO: 115390 - DNA, 20 bp, Artificial
  CRISPR gRNA sequence
gttacctgatcacacctaac

SEQ ID NO: 115391 - DNA, 20 bp, Artificial
  CRISPR gRNA sequence
cctgatcacacctaacatgc

SEQ ID NO: 115392 - DNA, 20 bp, Artificial
  CRISPR gRNA sequence
atcacacctaacatgcagat

SEQ ID NO: 115393 - DNA, 20 bp, Artificial
  CRISPR gRNA sequence
acatgcagataaggctagga

SEQ ID NO: 115394 - DNA, 20 bp, Artificial
  CRISPR gRNA sequence
ggaaagtccagcctggtgtg

SEQ ID NO: 115395 - DNA, 20 bp, Artificial
  CRISPR gRNA sequence
gtgtggtggcaaatgcctgt

SEQ ID NO: 115396 - DNA, 20 bp, Artificial
  CRISPR gRNA sequence
tagtcctacttggaaggcag

SEQ ID NO: 115397 - DNA, 20 bp, Artificial
  CRISPR gRNA sequence
cttggaaggcagaggcagga

SEQ ID NO: 115398 - DNA, 20 bp, Artificial
  CRISPR gRNA sequence
ggaaggcagaggcaggagga

SEQ ID NO: 115399 - DNA, 20 bp, Artificial
  CRISPR gRNA sequence
gaaggcagaggcaggaggat

SEQ ID NO: 115400 - DNA, 20 bp, Artificial
  CRISPR gRNA sequence
aaggctgcagtgattcatga

SEQ ID NO: 115401 - DNA, 20 bp, Artificial
  CRISPR gRNA sequence
cagtgattcatgatcatgcc

SEQ ID NO: 115402 - DNA, 20 bp, Artificial
  CRISPR gRNA sequence
atgatcatgccactgcagtc

SEQ ID NO: 115403 - DNA, 20 bp, Artificial
  CRISPR gRNA sequence
cagtccaacagcaagggtgt

SEQ ID NO: 115404 - DNA, 20 bp, Artificial
  CRISPR gRNA sequence
tttctagaaaataataataa

SEQ ID NO: 115405 - DNA, 20 bp, Artificial
  CRISPR gRNA sequence
ctagaaaataataataataa

SEQ ID NO: 115406 - DNA, 20 bp, Artificial
  CRISPR gRNA sequence
tagaaaataataataataaa

SEQ ID NO: 115407 - DNA, 20 bp, Artificial
  CRISPR gRNA sequence
gaaaataataataataaact

SEQ ID NO: 115408 - DNA, 20 bp, Artificial
  CRISPR gRNA sequence
taatgctaggaaagtctttt

SEQ ID NO: 115409 - DNA, 20 bp, Artificial
  CRISPR gRNA sequence
aatgctaggaaagtcttttt

SEQ ID NO: 115410 - DNA, 20 bp, Artificial
  CRISPR gRNA sequence
atgctaggaaagtcttttta

SEQ ID NO: 115411 - DNA, 20 bp, Artificial
  CRISPR gRNA sequence
ggaaagtctttttactgaac

SEQ ID NO: 115412 - DNA, 20 bp, Artificial
  CRISPR gRNA sequence
tttactgaacactcatttgc

SEQ ID NO: 115413 - DNA, 20 bp, Artificial
  CRISPR gRNA sequence
ttactgaacactcatttgct

SEQ ID NO: 115414 - DNA, 20 bp, Artificial
  CRISPR gRNA sequence
tactgaacactcatttgctc

SEQ ID NO: 115415 - DNA, 20 bp, Artificial
  CRISPR gRNA sequence
actgaacactcatttgctca

SEQ ID NO: 115416 - DNA, 20 bp, Artificial
  CRISPR gRNA sequence
ctgaacactcatttgctcaa

SEQ ID NO: 115417 - DNA, 20 bp, Artificial
  CRISPR gRNA sequence
aacactcatttgctcaaacg

SEQ ID NO: 115418 - DNA, 20 bp, Artificial
  CRISPR gRNA sequence
atttgctcaaacgaaatttg

SEQ ID NO: 115419 - DNA, 20 bp, Artificial
  CRISPR gRNA sequence
gctcaaacgaaatttggcct

SEQ ID NO: 115420 - DNA, 20 bp, Artificial
  CRISPR gRNA sequence
ctcaaacgaaatttggcctg

SEQ ID NO: 115421 - DNA, 20 bp, Artificial
  CRISPR gRNA sequence
aaacgaaatttggcctgtta

SEQ ID NO: 115422 - DNA, 20 bp, Artificial
  CRISPR gRNA sequence
ggcctgttattaaagcagag

SEQ ID NO: 115423 - DNA, 20 bp, Artificial
  CRISPR gRNA sequence
gcctgttattaaagcagagg

SEQ ID NO: 115424 - DNA, 20 bp, Artificial
  CRISPR gRNA sequence
ttattaaagcagaggaaagt

SEQ ID NO: 115425 - DNA, 20 bp, Artificial
  CRISPR gRNA sequence
ttaaagcagaggaaagtgta

SEQ ID NO: 115426 - DNA, 20 bp, Artificial
  CRISPR gRNA sequence
aagcagaggaaagtgtatat

SEQ ID NO: 115427 - DNA, 20 bp, Artificial
  CRISPR gRNA sequence
tgaagtgtaggtggtagtct

SEQ ID NO: 115428 - DNA, 20 bp, Artificial
  CRISPR gRNA sequence
ttattttttttaaaaaaaat

SEQ ID NO: 115429 - DNA, 20 bp, Artificial
  CRISPR gRNA sequence
ttttttttaaaaaaaattca

SEQ ID NO: 115430 - DNA, 20 bp, Artificial
  CRISPR gRNA sequence
tttttaaaaaaaattcatac

SEQ ID NO: 115431 - DNA, 20 bp, Artificial
  CRISPR gRNA sequence
ttttaaaaaaaattcatact

SEQ ID NO: 115432 - DNA, 20 bp, Artificial
  CRISPR gRNA sequence
tttaaaaaaaattcatacta

SEQ ID NO: 115433 - DNA, 20 bp, Artificial
  CRISPR gRNA sequence
ttaaaaaaaattcatactat

SEQ ID NO: 115434 - DNA, 20 bp, Artificial
  CRISPR gRNA sequence
taaaaaaaattcatactata

SEQ ID NO: 115435 - DNA, 20 bp, Artificial
  CRISPR gRNA sequence
aaaaaaaattcatactataa

SEQ ID NO: 115436 - DNA, 20 bp, Artificial
  CRISPR gRNA sequence
aaaaaaattcatactataag

SEQ ID NO: 115437 - DNA, 20 bp, Artificial
  CRISPR gRNA sequence
atactataagcattcacagt

SEQ ID NO: 115438 - DNA, 20 bp, Artificial
  CRISPR gRNA sequence
taagcattcacagtcttaca

SEQ ID NO: 115439 - DNA, 20 bp, Artificial
  CRISPR gRNA sequence
acagtcttacagtagttata

SEQ ID NO: 115440 - DNA, 20 bp, Artificial
  CRISPR gRNA sequence
acagtagttatatatggtta

SEQ ID NO: 115441 - DNA, 20 bp, Artificial
  CRISPR gRNA sequence
cagtagttatatatggttag

SEQ ID NO: 115442 - DNA, 20 bp, Artificial
  CRISPR gRNA sequence
tatatggttagctatattac

SEQ ID NO: 115443 - DNA, 20 bp, Artificial
  CRISPR gRNA sequence
gctatattacttactaggtg

SEQ ID NO: 115444 - DNA, 20 bp, Artificial
  CRISPR gRNA sequence
tattacttactaggtgtttt

SEQ ID NO: 115445 - DNA, 20 bp, Artificial
  CRISPR gRNA sequence
cttactaggtgttttctcca

SEQ ID NO: 115446 - DNA, 20 bp, Artificial
  CRISPR gRNA sequence
actaggtgttttctccaaag

SEQ ID NO: 115447 - DNA, 20 bp, Artificial
  CRISPR gRNA sequence
ctaggtgttttctccaaagc

SEQ ID NO: 115448 - DNA, 20 bp, Artificial
  CRISPR gRNA sequence
ggtgttttctccaaagcttc

SEQ ID NO: 115449 - DNA, 20 bp, Artificial
  CRISPR gRNA sequence
tctccaaagcttccatcgtc

SEQ ID NO: 115450 - DNA, 20 bp, Artificial
  CRISPR gRNA sequence
ctccaaagcttccatcgtca

SEQ ID NO: 115451 - DNA, 20 bp, Artificial
  CRISPR gRNA sequence
tccaaagcttccatcgtcat

SEQ ID NO: 115452 - DNA, 20 bp, Artificial
  CRISPR gRNA sequence
caaagcttccatcgtcattc

SEQ ID NO: 115453 - DNA, 20 bp, Artificial
  CRISPR gRNA sequence
ccatcgtcattctaagtcat

SEQ ID NO: 115454 - DNA, 20 bp, Artificial
  CRISPR gRNA sequence
catcgtcattctaagtcata

SEQ ID NO: 115455 - DNA, 20 bp, Artificial
  CRISPR gRNA sequence
taagtcataattgtcccttg

SEQ ID NO: 115456 - DNA, 20 bp, Artificial
  CRISPR gRNA sequence
agtcataattgtcccttgtg

SEQ ID NO: 115457 - DNA, 20 bp, Artificial
  CRISPR gRNA sequence
tcccttgtgactttgatccc

SEQ ID NO: 115458 - DNA, 20 bp, Artificial
  CRISPR gRNA sequence
gtgactttgatcccagctgt

SEQ ID NO: 115459 - DNA, 20 bp, Artificial
  CRISPR gRNA sequence
tgactttgatcccagctgtc

SEQ ID NO: 115460 - DNA, 20 bp, Artificial
  CRISPR gRNA sequence
tgatcccagctgtcttaaac

SEQ ID NO: 115461 - DNA, 20 bp, Artificial
  CRISPR gRNA sequence
gatcccagctgtcttaaact

SEQ ID NO: 115462 - DNA, 20 bp, Artificial
  CRISPR gRNA sequence
atcccagctgtcttaaactt

SEQ ID NO: 115463 - DNA, 20 bp, Artificial
  CRISPR gRNA sequence
tcttaaactttggagaatgg

SEQ ID NO: 115464 - DNA, 20 bp, Artificial
  CRISPR gRNA sequence
aaactttggagaatggaatt

SEQ ID NO: 115465 - DNA, 20 bp, Artificial
  CRISPR gRNA sequence
aactttggagaatggaattt

SEQ ID NO: 115466 - DNA, 20 bp, Artificial
  CRISPR gRNA sequence
tggagaatggaatttgtgca

SEQ ID NO: 115467 - DNA, 20 bp, Artificial
  CRISPR gRNA sequence
ggagaatggaatttgtgcac

SEQ ID NO: 115468 - DNA, 20 bp, Artificial
  CRISPR gRNA sequence
gagaatggaatttgtgcact

SEQ ID NO: 115469 - DNA, 20 bp, Artificial
  CRISPR gRNA sequence
gtgcactagataactgtgct

SEQ ID NO: 115470 - DNA, 20 bp, Artificial
  CRISPR gRNA sequence
tgcactagataactgtgctg

SEQ ID NO: 115471 - DNA, 20 bp, Artificial
  CRISPR gRNA sequence
gataactgtgctggttctgg

SEQ ID NO: 115472 - DNA, 20 bp, Artificial
  CRISPR gRNA sequence
tgctggttctggatagtatt

SEQ ID NO: 115473 - DNA, 20 bp, Artificial
  CRISPR gRNA sequence
gttctggatagtattaatag

SEQ ID NO: 115474 - DNA, 20 bp, Artificial
  CRISPR gRNA sequence
tggatagtattaatagttaa

SEQ ID NO: 115475 - DNA, 20 bp, Artificial
  CRISPR gRNA sequence
gatagtattaatagttaaat

SEQ ID NO: 115476 - DNA, 20 bp, Artificial
  CRISPR gRNA sequence
atagttaaatggttttattt

SEQ ID NO: 115477 - DNA, 20 bp, Artificial
  CRISPR gRNA sequence
aatggttttatttctcgttt

SEQ ID NO: 115478 - DNA, 20 bp, Artificial
  CRISPR gRNA sequence
tatttctcgttttagaaata

SEQ ID NO: 115479 - DNA, 20 bp, Artificial
  CRISPR gRNA sequence
atttctcgttttagaaatac

SEQ ID NO: 115480 - DNA, 20 bp, Artificial
  CRISPR gRNA sequence
tttctcgttttagaaatacc

SEQ ID NO: 115481 - DNA, 20 bp, Artificial
  CRISPR gRNA sequence
ctcgttttagaaatacctgc

SEQ ID NO: 115482 - DNA, 20 bp, Artificial
  CRISPR gRNA sequence
tcgttttagaaatacctgca

SEQ ID NO: 115483 - DNA, 20 bp, Artificial
  CRISPR gRNA sequence
gttttagaaatacctgcatg

SEQ ID NO: 115484 - DNA, 20 bp, Artificial
  CRISPR gRNA sequence
tagaaatacctgcatgagtc

SEQ ID NO: 115485 - DNA, 20 bp, Artificial
  CRISPR gRNA sequence
agaaatacctgcatgagtct

SEQ ID NO: 115486 - DNA, 20 bp, Artificial
  CRISPR gRNA sequence
gaaatacctgcatgagtctc

SEQ ID NO: 115487 - DNA, 20 bp, Artificial
  CRISPR gRNA sequence
catgagtctcggcaccgtca

SEQ ID NO: 115488 - DNA, 20 bp, Artificial
  CRISPR gRNA sequence
ggcaccgtcatgccatggca

SEQ ID NO: 115489 - DNA, 20 bp, Artificial
  CRISPR gRNA sequence
ttctctccaaaggaaaagga

SEQ ID NO: 115490 - DNA, 20 bp, Artificial
  CRISPR gRNA sequence
tctctccaaaggaaaaggat

SEQ ID NO: 115491 - DNA, 20 bp, Artificial
  CRISPR gRNA sequence
ctctccaaaggaaaaggata

SEQ ID NO: 115492 - DNA, 20 bp, Artificial
  CRISPR gRNA sequence
tctccaaaggaaaaggatag

SEQ ID NO: 115493 - DNA, 20 bp, Artificial
  CRISPR gRNA sequence
tccaaaggaaaaggatagtc

SEQ ID NO: 115494 - DNA, 20 bp, Artificial
  CRISPR gRNA sequence
caaaggaaaaggatagtccc

SEQ ID NO: 115495 - DNA, 20 bp, Artificial
  CRISPR gRNA sequence
tattcttctctttattacct

SEQ ID NO: 115496 - DNA, 20 bp, Artificial
  CRISPR gRNA sequence
attcttctctttattacctt

SEQ ID NO: 115497 - DNA, 20 bp, Artificial
  CRISPR gRNA sequence
ttcttctctttattaccttg

SEQ ID NO: 115498 - DNA, 20 bp, Artificial
  CRISPR gRNA sequence
ttctctttattaccttgtat

SEQ ID NO: 115499 - DNA, 20 bp, Artificial
  CRISPR gRNA sequence
ctctttattaccttgtattg

SEQ ID NO: 115500 - DNA, 20 bp, Artificial
  CRISPR gRNA sequence
tctttattaccttgtattga

SEQ ID NO: 115501 - DNA, 20 bp, Artificial
  CRISPR gRNA sequence
tttattaccttgtattgact

SEQ ID NO: 115502 - DNA, 20 bp, Artificial
  CRISPR gRNA sequence
tattaccttgtattgacttg

SEQ ID NO: 115503 - DNA, 20 bp, Artificial
  CRISPR gRNA sequence
attaccttgtattgacttga

SEQ ID NO: 115504 - DNA, 20 bp, Artificial
  CRISPR gRNA sequence
ttaccttgtattgacttgag

SEQ ID NO: 115505 - DNA, 20 bp, Artificial
  CRISPR gRNA sequence
ccttgtattgacttgagttg

SEQ ID NO: 115506 - DNA, 20 bp, Artificial
  CRISPR gRNA sequence
gtattgacttgagttgaagc

SEQ ID NO: 115507 - DNA, 20 bp, Artificial
  CRISPR gRNA sequence
tattgacttgagttgaagcc

SEQ ID NO: 115508 - DNA, 20 bp, Artificial
  CRISPR gRNA sequence
acttgagttgaagccttcag

SEQ ID NO: 115509 - DNA, 20 bp, Artificial
  CRISPR gRNA sequence
gagttgaagccttcagcagt

SEQ ID NO: 115510 - DNA, 20 bp, Artificial
  CRISPR gRNA sequence
agttgaagccttcagcagtg

SEQ ID NO: 115511 - DNA, 20 bp, Artificial
  CRISPR gRNA sequence
aagccttcagcagtgtcctc

SEQ ID NO: 115512 - DNA, 20 bp, Artificial
  CRISPR gRNA sequence
cagcagtgtcctcttgctat

SEQ ID NO: 115513 - DNA, 20 bp, Artificial
  CRISPR gRNA sequence
agcagtgtcctcttgctatt

SEQ ID NO: 115514 - DNA, 20 bp, Artificial
  CRISPR gRNA sequence
ttgctattttcctactctgg

SEQ ID NO: 115515 - DNA, 20 bp, Artificial
  CRISPR gRNA sequence
gctattttcctactctggga

SEQ ID NO: 115516 - DNA, 20 bp, Artificial
  CRISPR gRNA sequence
ctattttcctactctgggac

SEQ ID NO: 115517 - DNA, 20 bp, Artificial
  CRISPR gRNA sequence
ttttcctactctgggactac

SEQ ID NO: 115518 - DNA, 20 bp, Artificial
  CRISPR gRNA sequence
tcctactctgggactactca

SEQ ID NO: 115519 - DNA, 20 bp, Artificial
  CRISPR gRNA sequence
cctactctgggactactcac

SEQ ID NO: 115520 - DNA, 20 bp, Artificial
  CRISPR gRNA sequence
ctactctgggactactcaca

SEQ ID NO: 115521 - DNA, 20 bp, Artificial
  CRISPR gRNA sequence
ctctgggactactcacattc

SEQ ID NO: 115522 - DNA, 20 bp, Artificial
  CRISPR gRNA sequence
tgggactactcacattctct

SEQ ID NO: 115523 - DNA, 20 bp, Artificial
  CRISPR gRNA sequence
ggactactcacattctctaa

SEQ ID NO: 115524 - DNA, 20 bp, Artificial
  CRISPR gRNA sequence
ctcacattctctaaactgga

SEQ ID NO: 115525 - DNA, 20 bp, Artificial
  CRISPR gRNA sequence
acattctctaaactggatgc

SEQ ID NO: 115526 - DNA, 20 bp, Artificial
  CRISPR gRNA sequence
tctaaactggatgcaatctt

SEQ ID NO: 115527 - DNA, 20 bp, Artificial
  CRISPR gRNA sequence
taaactggatgcaatcttat

SEQ ID NO: 115528 - DNA, 20 bp, Artificial
  CRISPR gRNA sequence
aactggatgcaatcttatgt

SEQ ID NO: 115529 - DNA, 20 bp, Artificial
  CRISPR gRNA sequence
gatgcaatcttatgtctctt

SEQ ID NO: 115530 - DNA, 20 bp, Artificial
  CRISPR gRNA sequence
atgtctctttagattatctt

SEQ ID NO: 115531 - DNA, 20 bp, Artificial
  CRISPR gRNA sequence
tgtctctttagattatcttt

SEQ ID NO: 115532 - DNA, 20 bp, Artificial
  CRISPR gRNA sequence
tttagattatcttttatctt

SEQ ID NO: 115533 - DNA, 20 bp, Artificial
  CRISPR gRNA sequence
tagattatcttttatcttaa

SEQ ID NO: 115534 - DNA, 20 bp, Artificial
  CRISPR gRNA sequence
agattatcttttatcttaaa

SEQ ID NO: 115535 - DNA, 20 bp, Artificial
  CRISPR gRNA sequence
gattatcttttatcttaaaa

SEQ ID NO: 115536 - DNA, 20 bp, Artificial
  CRISPR gRNA sequence
tcttttatcttaaaaccact

SEQ ID NO: 115537 - DNA, 20 bp, Artificial
  CRISPR gRNA sequence
ttatcttaaaaccactaggc

SEQ ID NO: 115538 - DNA, 20 bp, Artificial
  CRISPR gRNA sequence
tatcttaaaaccactaggcc

SEQ ID NO: 115539 - DNA, 20 bp, Artificial
  CRISPR gRNA sequence
atcttaaaaccactaggcca

SEQ ID NO: 115540 - DNA, 20 bp, Artificial
  CRISPR gRNA sequence
tcttaaaaccactaggccag

SEQ ID NO: 115541 - DNA, 20 bp, Artificial
  CRISPR gRNA sequence
aaaaccactaggccagactt

SEQ ID NO: 115542 - DNA, 20 bp, Artificial
  CRISPR gRNA sequence
aaaccactaggccagacttg

SEQ ID NO: 115543 - DNA, 20 bp, Artificial
  CRISPR gRNA sequence
ggccagacttggtggctcat

SEQ ID NO: 115544 - DNA, 20 bp, Artificial
  CRISPR gRNA sequence
ggtggctcatgcctgtaatc

SEQ ID NO: 115545 - DNA, 20 bp, Artificial
  CRISPR gRNA sequence
gtggctcatgcctgtaatcc

SEQ ID NO: 115546 - DNA, 20 bp, Artificial
  CRISPR gRNA sequence
atgcctgtaatcccaacact

SEQ ID NO: 115547 - DNA, 20 bp, Artificial
  CRISPR gRNA sequence
taatcccaacactttgggag

SEQ ID NO: 115548 - DNA, 20 bp, Artificial
  CRISPR gRNA sequence
tgggaggctgaggtgggaag

SEQ ID NO: 115549 - DNA, 20 bp, Artificial
  CRISPR gRNA sequence
gggaggctgaggtgggaagc

SEQ ID NO: 115550 - DNA, 20 bp, Artificial
  CRISPR gRNA sequence
ggaggctgaggtgggaagcc

SEQ ID NO: 115551 - DNA, 20 bp, Artificial
  CRISPR gRNA sequence
aggtgggaagcccaggattt

SEQ ID NO: 115552 - DNA, 20 bp, Artificial
  CRISPR gRNA sequence
caagaccagcctgggcaaca

SEQ ID NO: 115553 - DNA, 20 bp, Artificial
  CRISPR gRNA sequence
aagaccagcctgggcaacat

SEQ ID NO: 115554 - DNA, 20 bp, Artificial
  CRISPR gRNA sequence
ggcaacatggcaaaactcca

SEQ ID NO: 115555 - DNA, 20 bp, Artificial
  CRISPR gRNA sequence
catctctacaaaaaaataca

SEQ ID NO: 115556 - DNA, 20 bp, Artificial
  CRISPR gRNA sequence
tacaaaaaaatacaaaaact

SEQ ID NO: 115557 - DNA, 20 bp, Artificial
  CRISPR gRNA sequence
caaaaaaatacaaaaactag

SEQ ID NO: 115558 - DNA, 20 bp, Artificial
  CRISPR gRNA sequence
gccaggcctggtgatgcatg

SEQ ID NO: 115559 - DNA, 20 bp, Artificial
  CRISPR gRNA sequence
gtgatgcatgcctgtagtcc

SEQ ID NO: 115560 - DNA, 20 bp, Artificial
  CRISPR gRNA sequence
tagtcccagctacttggagg

SEQ ID NO: 115561 - DNA, 20 bp, Artificial
  CRISPR gRNA sequence
cttggagggttgagatgctc

SEQ ID NO: 115562 - DNA, 20 bp, Artificial
  CRISPR gRNA sequence
ggagggttgagatgctcttc

SEQ ID NO: 115563 - DNA, 20 bp, Artificial
  CRISPR gRNA sequence
gagggttgagatgctcttcg

SEQ ID NO: 115564 - DNA, 20 bp, Artificial
  CRISPR gRNA sequence
agatgctcttcgtctttgtc

SEQ ID NO: 115565 - DNA, 20 bp, Artificial
  CRISPR gRNA sequence
ttcgtctttgtcacttatta

SEQ ID NO: 115566 - DNA, 20 bp, Artificial
  CRISPR gRNA sequence
cgtctttgtcacttattact

SEQ ID NO: 115567 - DNA, 20 bp, Artificial
  CRISPR gRNA sequence
gtctttgtcacttattacta

SEQ ID NO: 115568 - DNA, 20 bp, Artificial
  CRISPR gRNA sequence
tgtcacttattactattcat

SEQ ID NO: 115569 - DNA, 20 bp, Artificial
  CRISPR gRNA sequence
gtcacttattactattcatt

SEQ ID NO: 115570 - DNA, 20 bp, Artificial
  CRISPR gRNA sequence
tcacttattactattcattc

SEQ ID NO: 115571 - DNA, 20 bp, Artificial
  CRISPR gRNA sequence
attactattcattctttctt

SEQ ID NO: 115572 - DNA, 20 bp, Artificial
  CRISPR gRNA sequence
ttactattcattctttcttg

SEQ ID NO: 115573 - DNA, 20 bp, Artificial
  CRISPR gRNA sequence
ctattcattctttcttgaaa

SEQ ID NO: 115574 - DNA, 20 bp, Artificial
  CRISPR gRNA sequence
ttcattctttcttgaaaatc

SEQ ID NO: 115575 - DNA, 20 bp, Artificial
  CRISPR gRNA sequence
attctttcttgaaaatcaca

SEQ ID NO: 115576 - DNA, 20 bp, Artificial
  CRISPR gRNA sequence
tttcttgaaaatcacacttt

SEQ ID NO: 115577 - DNA, 20 bp, Artificial
  CRISPR gRNA sequence
tcttgaaaatcacacttttc

SEQ ID NO: 115578 - DNA, 20 bp, Artificial
  CRISPR gRNA sequence
cttgaaaatcacacttttct

SEQ ID NO: 115579 - DNA, 20 bp, Artificial
  CRISPR gRNA sequence
ttgaaaatcacacttttctt

SEQ ID NO: 115580 - DNA, 20 bp, Artificial
  CRISPR gRNA sequence
gaaaatcacacttttcttaa

SEQ ID NO: 115581 - DNA, 20 bp, Artificial
  CRISPR gRNA sequence
aaaatcacacttttcttaat

SEQ ID NO: 115582 - DNA, 20 bp, Artificial
  CRISPR gRNA sequence
ttcttaattttcaaggaaca

SEQ ID NO: 115583 - DNA, 20 bp, Artificial
  CRISPR gRNA sequence
tcttaattttcaaggaacaa

SEQ ID NO: 115584 - DNA, 20 bp, Artificial
  CRISPR gRNA sequence
cttaattttcaaggaacaag

SEQ ID NO: 115585 - DNA, 20 bp, Artificial
  CRISPR gRNA sequence
ttaattttcaaggaacaagt

SEQ ID NO: 115586 - DNA, 20 bp, Artificial
  CRISPR gRNA sequence
aattttcaaggaacaagttt

SEQ ID NO: 115587 - DNA, 20 bp, Artificial
  CRISPR gRNA sequence
attttcaaggaacaagtttt

SEQ ID NO: 115588 - DNA, 20 bp, Artificial
  CRISPR gRNA sequence
tcaaggaacaagttttattt

SEQ ID NO: 115589 - DNA, 20 bp, Artificial
  CRISPR gRNA sequence
caaggaacaagttttatttt

SEQ ID NO: 115590 - DNA, 20 bp, Artificial
  CRISPR gRNA sequence
aaggaacaagttttattttt

SEQ ID NO: 115591 - DNA, 20 bp, Artificial
  CRISPR gRNA sequence
tatttttattgaacaggttt

SEQ ID NO: 115592 - DNA, 20 bp, Artificial
  CRISPR gRNA sequence
atttttattgaacaggtttt

SEQ ID NO: 115593 - DNA, 20 bp, Artificial
  CRISPR gRNA sequence
tttttattgaacaggtttta

SEQ ID NO: 115594 - DNA, 20 bp, Artificial
  CRISPR gRNA sequence
ttattgaacaggttttatta

SEQ ID NO: 115595 - DNA, 20 bp, Artificial
  CRISPR gRNA sequence
tattgaacaggttttattac

SEQ ID NO: 115596 - DNA, 20 bp, Artificial
  CRISPR gRNA sequence
attgaacaggttttattacc

SEQ ID NO: 115597 - DNA, 20 bp, Artificial
  CRISPR gRNA sequence
ttgaacaggttttattaccc

SEQ ID NO: 115598 - DNA, 20 bp, Artificial
  CRISPR gRNA sequence
aacaggttttattaccccat

SEQ ID NO: 115599 - DNA, 20 bp, Artificial
  CRISPR gRNA sequence
tattaccccatcacaaatat

SEQ ID NO: 115600 - DNA, 20 bp, Artificial
  CRISPR gRNA sequence
attaccccatcacaaatata

SEQ ID NO: 115601 - DNA, 20 bp, Artificial
  CRISPR gRNA sequence
ttaccccatcacaaatataa

SEQ ID NO: 115602 - DNA, 20 bp, Artificial
  CRISPR gRNA sequence
ccccatcacaaatataattt

SEQ ID NO: 115603 - DNA, 20 bp, Artificial
  CRISPR gRNA sequence
gaatgtttacttttttccct

SEQ ID NO: 115604 - DNA, 20 bp, Artificial
  CRISPR gRNA sequence
aatgtttacttttttccctt

SEQ ID NO: 115605 - DNA, 20 bp, Artificial
  CRISPR gRNA sequence
acttttttcccttctaactg

SEQ ID NO: 115606 - DNA, 20 bp, Artificial
  CRISPR gRNA sequence
cttttttcccttctaactga

SEQ ID NO: 115607 - DNA, 20 bp, Artificial
  CRISPR gRNA sequence
ttttcccttctaactgatgt

SEQ ID NO: 115608 - DNA, 20 bp, Artificial
  CRISPR gRNA sequence
tttcccttctaactgatgtg

SEQ ID NO: 115609 - DNA, 20 bp, Artificial
  CRISPR gRNA sequence
ttcccttctaactgatgtga

SEQ ID NO: 115610 - DNA, 20 bp, Artificial
  CRISPR gRNA sequence
tcccttctaactgatgtgag

SEQ ID NO: 115611 - DNA, 20 bp, Artificial
  CRISPR gRNA sequence
cccttctaactgatgtgagc

SEQ ID NO: 115612 - DNA, 20 bp, Artificial
  CRISPR gRNA sequence
ccttctaactgatgtgagcc

SEQ ID NO: 115613 - DNA, 20 bp, Artificial
  CRISPR gRNA sequence
ctaactgatgtgagcctggt

SEQ ID NO: 115614 - DNA, 20 bp, Artificial
  CRISPR gRNA sequence
taactgatgtgagcctggtc

SEQ ID NO: 115615 - DNA, 20 bp, Artificial
  CRISPR gRNA sequence
actgatgtgagcctggtcta

SEQ ID NO: 115616 - DNA, 20 bp, Artificial
  CRISPR gRNA sequence
atgtgagcctggtctaatcc

SEQ ID NO: 115617 - DNA, 20 bp, Artificial
  CRISPR gRNA sequence
gtctaatcctctcttctttg

SEQ ID NO: 115618 - DNA, 20 bp, Artificial
  CRISPR gRNA sequence
atcctctcttctttggctta

SEQ ID NO: 115619 - DNA, 20 bp, Artificial
  CRISPR gRNA sequence
tcttctttggcttagattta

SEQ ID NO: 115620 - DNA, 20 bp, Artificial
  CRISPR gRNA sequence
ttctttggcttagatttata

SEQ ID NO: 115621 - DNA, 20 bp, Artificial
  CRISPR gRNA sequence
ctttggcttagatttataaa

SEQ ID NO: 115622 - DNA, 20 bp, Artificial
  CRISPR gRNA sequence
tttggcttagatttataaaa

SEQ ID NO: 115623 - DNA, 20 bp, Artificial
  CRISPR gRNA sequence
tggcttagatttataaaata

SEQ ID NO: 115624 - DNA, 20 bp, Artificial
  CRISPR gRNA sequence
ggcttagatttataaaatag

SEQ ID NO: 115625 - DNA, 20 bp, Artificial
  CRISPR gRNA sequence
gcttagatttataaaatagc

SEQ ID NO: 115626 - DNA, 20 bp, Artificial
  CRISPR gRNA sequence
agatttataaaatagctgct

SEQ ID NO: 115627 - DNA, 20 bp, Artificial
  CRISPR gRNA sequence
gatttataaaatagctgctt

SEQ ID NO: 115628 - DNA, 20 bp, Artificial
  CRISPR gRNA sequence
ataaaatagctgcttaattt

SEQ ID NO: 115629 - DNA, 20 bp, Artificial
  CRISPR gRNA sequence
taaaatagctgcttaatttg

SEQ ID NO: 115630 - DNA, 20 bp, Artificial
  CRISPR gRNA sequence
cttaatttggtttcccttct

SEQ ID NO: 115631 - DNA, 20 bp, Artificial
  CRISPR gRNA sequence
aatttggtttcccttcttcc

SEQ ID NO: 115632 - DNA, 20 bp, Artificial
  CRISPR gRNA sequence
atttggtttcccttcttcca

SEQ ID NO: 115633 - DNA, 20 bp, Artificial
  CRISPR gRNA sequence
ggtttcccttcttccacttt

SEQ ID NO: 115634 - DNA, 20 bp, Artificial
  CRISPR gRNA sequence
gtttcccttcttccactttt

SEQ ID NO: 115635 - DNA, 20 bp, Artificial
  CRISPR gRNA sequence
cccttcttccacttttgttc

SEQ ID NO: 115636 - DNA, 20 bp, Artificial
  CRISPR gRNA sequence
ccttcttccacttttgttcc

SEQ ID NO: 115637 - DNA, 20 bp, Artificial
  CRISPR gRNA sequence
cttccacttttgttcccctc

SEQ ID NO: 115638 - DNA, 20 bp, Artificial
  CRISPR gRNA sequence
ttccacttttgttcccctct

SEQ ID NO: 115639 - DNA, 20 bp, Artificial
  CRISPR gRNA sequence
ccacttttgttcccctctag

SEQ ID NO: 115640 - DNA, 20 bp, Artificial
  CRISPR gRNA sequence
cacttttgttcccctctagc

SEQ ID NO: 115641 - DNA, 20 bp, Artificial
  CRISPR gRNA sequence
ttgttcccctctagcctact

SEQ ID NO: 115642 - DNA, 20 bp, Artificial
  CRISPR gRNA sequence
tgttcccctctagcctactc

SEQ ID NO: 115643 - DNA, 20 bp, Artificial
  CRISPR gRNA sequence
gttcccctctagcctactct

SEQ ID NO: 115644 - DNA, 20 bp, Artificial
  CRISPR gRNA sequence
ttcccctctagcctactctc

SEQ ID NO: 115645 - DNA, 20 bp, Artificial
  CRISPR gRNA sequence
ccctctagcctactctccac

SEQ ID NO: 115646 - DNA, 20 bp, Artificial
  CRISPR gRNA sequence
tagcctactctccacatcct

SEQ ID NO: 115647 - DNA, 20 bp, Artificial
  CRISPR gRNA sequence
gcctactctccacatcctag

SEQ ID NO: 115648 - DNA, 20 bp, Artificial
  CRISPR gRNA sequence
ctctccacatcctagtgtga

SEQ ID NO: 115649 - DNA, 20 bp, Artificial
  CRISPR gRNA sequence
tccacatcctagtgtgatct

SEQ ID NO: 115650 - DNA, 20 bp, Artificial
  CRISPR gRNA sequence
cacatcctagtgtgatcttt

SEQ ID NO: 115651 - DNA, 20 bp, Artificial
  CRISPR gRNA sequence
gtgtgatctttttaaaatgt

SEQ ID NO: 115652 - DNA, 20 bp, Artificial
  CRISPR gRNA sequence
tttaaaatgtttatcctatc

SEQ ID NO: 115653 - DNA, 20 bp, Artificial
  CRISPR gRNA sequence
ttaaaatgtttatcctatca

SEQ ID NO: 115654 - DNA, 20 bp, Artificial
  CRISPR gRNA sequence
taaaatgtttatcctatcaa

SEQ ID NO: 115655 - DNA, 20 bp, Artificial
  CRISPR gRNA sequence
aaaatgtttatcctatcaag

SEQ ID NO: 115656 - DNA, 20 bp, Artificial
  CRISPR gRNA sequence
aaatgtttatcctatcaagt

SEQ ID NO: 115657 - DNA, 20 bp, Artificial
  CRISPR gRNA sequence
atcctatcaagtccctgttc

SEQ ID NO: 115658 - DNA, 20 bp, Artificial
  CRISPR gRNA sequence
tcctatcaagtccctgttct

SEQ ID NO: 115659 - DNA, 20 bp, Artificial
  CRISPR gRNA sequence
tcaagtccctgttctgctca

SEQ ID NO: 115660 - DNA, 20 bp, Artificial
  CRISPR gRNA sequence
ttctgctcaagctccttcaa

SEQ ID NO: 115661 - DNA, 20 bp, Artificial
  CRISPR gRNA sequence
tgctcaagctccttcaaccc

SEQ ID NO: 115662 - DNA, 20 bp, Artificial
  CRISPR gRNA sequence
ctcaagctccttcaacccct

SEQ ID NO: 115663 - DNA, 20 bp, Artificial
  CRISPR gRNA sequence
aagctccttcaacccctacc

SEQ ID NO: 115664 - DNA, 20 bp, Artificial
  CRISPR gRNA sequence
cttcaacccctaccctttcc

SEQ ID NO: 115665 - DNA, 20 bp, Artificial
  CRISPR gRNA sequence
caacccctaccctttcccat

SEQ ID NO: 115666 - DNA, 20 bp, Artificial
  CRISPR gRNA sequence
aacccctaccctttcccatt

SEQ ID NO: 115667 - DNA, 20 bp, Artificial
  CRISPR gRNA sequence
ccctttcccatttgcactta

SEQ ID NO: 115668 - DNA, 20 bp, Artificial
  CRISPR gRNA sequence
tcccatttgcacttagactg

SEQ ID NO: 115669 - DNA, 20 bp, Artificial
  CRISPR gRNA sequence
cccatttgcacttagactga

SEQ ID NO: 115670 - DNA, 20 bp, Artificial
  CRISPR gRNA sequence
ccatttgcacttagactgac

SEQ ID NO: 115671 - DNA, 20 bp, Artificial
  CRISPR gRNA sequence
gcacttagactgacatccaa

SEQ ID NO: 115672 - DNA, 20 bp, Artificial
  CRISPR gRNA sequence
cacttagactgacatccaaa

SEQ ID NO: 115673 - DNA, 20 bp, Artificial
  CRISPR gRNA sequence
agactgacatccaaagtgct

SEQ ID NO: 115674 - DNA, 20 bp, Artificial
  CRISPR gRNA sequence
gactgacatccaaagtgctt

SEQ ID NO: 115675 - DNA, 20 bp, Artificial
  CRISPR gRNA sequence
acatccaaagtgcttactac

SEQ ID NO: 115676 - DNA, 20 bp, Artificial
  CRISPR gRNA sequence
actactatgcccagcaaagc

SEQ ID NO: 115677 - DNA, 20 bp, Artificial
  CRISPR gRNA sequence
ctactatgcccagcaaagcc

SEQ ID NO: 115678 - DNA, 20 bp, Artificial
  CRISPR gRNA sequence
ctatgcccagcaaagcctta

SEQ ID NO: 115679 - DNA, 20 bp, Artificial
  CRISPR gRNA sequence
tgcccagcaaagccttacat

SEQ ID NO: 115680 - DNA, 20 bp, Artificial
  CRISPR gRNA sequence
acatgctccagctcctgtct

SEQ ID NO: 115681 - DNA, 20 bp, Artificial
  CRISPR gRNA sequence
catgctccagctcctgtcta

SEQ ID NO: 115682 - DNA, 20 bp, Artificial
  CRISPR gRNA sequence
cagctcctgtctacctctaa

SEQ ID NO: 115683 - DNA, 20 bp, Artificial
  CRISPR gRNA sequence
ctgtctacctctaactgcat

SEQ ID NO: 115684 - DNA, 20 bp, Artificial
  CRISPR gRNA sequence
tctacctctaactgcatttc

SEQ ID NO: 115685 - DNA, 20 bp, Artificial
  CRISPR gRNA sequence
cctctaactgcatttctact

SEQ ID NO: 115686 - DNA, 20 bp, Artificial
  CRISPR gRNA sequence
taactgcatttctacttctt

SEQ ID NO: 115687 - DNA, 20 bp, Artificial
  CRISPR gRNA sequence
actgcatttctacttcttgg

SEQ ID NO: 115688 - DNA, 20 bp, Artificial
  CRISPR gRNA sequence
catttctacttcttggtctc

SEQ ID NO: 115689 - DNA, 20 bp, Artificial
  CRISPR gRNA sequence
ctacttcttggtctctatgc

SEQ ID NO: 115690 - DNA, 20 bp, Artificial
  CRISPR gRNA sequence
tacttcttggtctctatgct

SEQ ID NO: 115691 - DNA, 20 bp, Artificial
  CRISPR gRNA sequence
cttcttggtctctatgctgc

SEQ ID NO: 115692 - DNA, 20 bp, Artificial
  CRISPR gRNA sequence
cttggtctctatgctgctgt

SEQ ID NO: 115693 - DNA, 20 bp, Artificial
  CRISPR gRNA sequence
ttggtctctatgctgctgtt

SEQ ID NO: 115694 - DNA, 20 bp, Artificial
  CRISPR gRNA sequence
ggtctctatgctgctgttta

SEQ ID NO: 115695 - DNA, 20 bp, Artificial
  CRISPR gRNA sequence
gtctctatgctgctgtttac

SEQ ID NO: 115696 - DNA, 20 bp, Artificial
  CRISPR gRNA sequence
tatgctgctgtttactgttc

SEQ ID NO: 115697 - DNA, 20 bp, Artificial
  CRISPR gRNA sequence
tgctgctgtttactgttcat

SEQ ID NO: 115698 - DNA, 20 bp, Artificial
  CRISPR gRNA sequence
ctgtttactgttcattggtc

SEQ ID NO: 115699 - DNA, 20 bp, Artificial
  CRISPR gRNA sequence
tttactgttcattggtctac

SEQ ID NO: 115700 - DNA, 20 bp, Artificial
  CRISPR gRNA sequence
actgttcattggtctacttc

SEQ ID NO: 115701 - DNA, 20 bp, Artificial
  CRISPR gRNA sequence
ctgttcattggtctacttcc

SEQ ID NO: 115702 - DNA, 20 bp, Artificial
  CRISPR gRNA sequence
ttcattggtctacttcctgc

SEQ ID NO: 115703 - DNA, 20 bp, Artificial
  CRISPR gRNA sequence
attggtctacttcctgccac

SEQ ID NO: 115704 - DNA, 20 bp, Artificial
  CRISPR gRNA sequence
gtctacttcctgccacgggt

SEQ ID NO: 115705 - DNA, 20 bp, Artificial
  CRISPR gRNA sequence
cttcctgccacgggtctttg

SEQ ID NO: 115706 - DNA, 20 bp, Artificial
  CRISPR gRNA sequence
cctgccacgggtctttgtcc

SEQ ID NO: 115707 - DNA, 20 bp, Artificial
  CRISPR gRNA sequence
ctgccacgggtctttgtcct

SEQ ID NO: 115708 - DNA, 20 bp, Artificial
  CRISPR gRNA sequence
ccacgggtctttgtccttag

SEQ ID NO: 115709 - DNA, 20 bp, Artificial
  CRISPR gRNA sequence
tgtccttagaattttcagtc

SEQ ID NO: 115710 - DNA, 20 bp, Artificial
  CRISPR gRNA sequence
gtccttagaattttcagtct

SEQ ID NO: 115711 - DNA, 20 bp, Artificial
  CRISPR gRNA sequence
tccttagaattttcagtctg

SEQ ID NO: 115712 - DNA, 20 bp, Artificial
  CRISPR gRNA sequence
agaattttcagtctgtatgc

SEQ ID NO: 115713 - DNA, 20 bp, Artificial
  CRISPR gRNA sequence
gaattttcagtctgtatgcc

SEQ ID NO: 115714 - DNA, 20 bp, Artificial
  CRISPR gRNA sequence
tcagtctgtatgccctttat

SEQ ID NO: 115715 - DNA, 20 bp, Artificial
  CRISPR gRNA sequence
cagtctgtatgccctttatc

SEQ ID NO: 115716 - DNA, 20 bp, Artificial
  CRISPR gRNA sequence
agtctgtatgccctttatct

SEQ ID NO: 115717 - DNA, 20 bp, Artificial
  CRISPR gRNA sequence
tatgccctttatctttttca

SEQ ID NO: 115718 - DNA, 20 bp, Artificial
  CRISPR gRNA sequence
tatctttttcatgcatgtct

SEQ ID NO: 115719 - DNA, 20 bp, Artificial
  CRISPR gRNA sequence
atctttttcatgcatgtcta

SEQ ID NO: 115720 - DNA, 20 bp, Artificial
  CRISPR gRNA sequence
tctttttcatgcatgtctat

SEQ ID NO: 115721 - DNA, 20 bp, Artificial
  CRISPR gRNA sequence
tttcatgcatgtctatctcc

SEQ ID NO: 115722 - DNA, 20 bp, Artificial
  CRISPR gRNA sequence
ttcatgcatgtctatctccc

SEQ ID NO: 115723 - DNA, 20 bp, Artificial
  CRISPR gRNA sequence
tcatgcatgtctatctccct

SEQ ID NO: 115724 - DNA, 20 bp, Artificial
  CRISPR gRNA sequence
catgcatgtctatctcccta

SEQ ID NO: 115725 - DNA, 20 bp, Artificial
  CRISPR gRNA sequence
atgcatgtctatctccctat

SEQ ID NO: 115726 - DNA, 20 bp, Artificial
  CRISPR gRNA sequence
tctccctatctgttaggtct

SEQ ID NO: 115727 - DNA, 20 bp, Artificial
  CRISPR gRNA sequence
cctatctgttaggtctgggt

SEQ ID NO: 115728 - DNA, 20 bp, Artificial
  CRISPR gRNA sequence
tctgttaggtctgggtttaa

SEQ ID NO: 115729 - DNA, 20 bp, Artificial
  CRISPR gRNA sequence
ttaggtctgggtttaattaa

SEQ ID NO: 115730 - DNA, 20 bp, Artificial
  CRISPR gRNA sequence
ggtctgggtttaattaaata

SEQ ID NO: 115731 - DNA, 20 bp, Artificial
  CRISPR gRNA sequence
ggtttaattaaataccctat

SEQ ID NO: 115732 - DNA, 20 bp, Artificial
  CRISPR gRNA sequence
aattaaataccctatctaga

SEQ ID NO: 115733 - DNA, 20 bp, Artificial
  CRISPR gRNA sequence
attaaataccctatctagaa

SEQ ID NO: 115734 - DNA, 20 bp, Artificial
  CRISPR gRNA sequence
aataccctatctagaataga

SEQ ID NO: 115735 - DNA, 20 bp, Artificial
  CRISPR gRNA sequence
tctagaatagatctcttctc

SEQ ID NO: 115736 - DNA, 20 bp, Artificial
  CRISPR gRNA sequence
gaatagatctcttctctctc

SEQ ID NO: 115737 - DNA, 20 bp, Artificial
  CRISPR gRNA sequence
ttctctctcagtatgttctt

SEQ ID NO: 115738 - DNA, 20 bp, Artificial
  CRISPR gRNA sequence
ctctctcagtatgttcttac

SEQ ID NO: 115739 - DNA, 20 bp, Artificial
  CRISPR gRNA sequence
tctctcagtatgttcttaca

SEQ ID NO: 115740 - DNA, 20 bp, Artificial
  CRISPR gRNA sequence
tctcagtatgttcttacaac

SEQ ID NO: 115741 - DNA, 20 bp, Artificial
  CRISPR gRNA sequence
tcagtatgttcttacaacat

SEQ ID NO: 115742 - DNA, 20 bp, Artificial
  CRISPR gRNA sequence
agtatgttcttacaacatct

SEQ ID NO: 115743 - DNA, 20 bp, Artificial
  CRISPR gRNA sequence
ttacaacatcttttcttttt

SEQ ID NO: 115744 - DNA, 20 bp, Artificial
  CRISPR gRNA sequence
acaacatcttttcttttttt

SEQ ID NO: 115745 - DNA, 20 bp, Artificial
  CRISPR gRNA sequence
caacatcttttctttttttg

SEQ ID NO: 115746 - DNA, 20 bp, Artificial
  CRISPR gRNA sequence
ttctttttttggaggcagtg

SEQ ID NO: 115747 - DNA, 20 bp, Artificial
  CRISPR gRNA sequence
tctttttttggaggcagtgg

SEQ ID NO: 115748 - DNA, 20 bp, Artificial
  CRISPR gRNA sequence
ctttttttggaggcagtggt

SEQ ID NO: 115749 - DNA, 20 bp, Artificial
  CRISPR gRNA sequence
tttttttggaggcagtggtg

SEQ ID NO: 115750 - DNA, 20 bp, Artificial
  CRISPR gRNA sequence
tttttggaggcagtggtgtg

SEQ ID NO: 115751 - DNA, 20 bp, Artificial
  CRISPR gRNA sequence
ttttggaggcagtggtgtga

SEQ ID NO: 115752 - DNA, 20 bp, Artificial
  CRISPR gRNA sequence
tttggaggcagtggtgtgat

SEQ ID NO: 115753 - DNA, 20 bp, Artificial
  CRISPR gRNA sequence
ttggaggcagtggtgtgatt

SEQ ID NO: 115754 - DNA, 20 bp, Artificial
  CRISPR gRNA sequence
tggaggcagtggtgtgatta

SEQ ID NO: 115755 - DNA, 20 bp, Artificial
  CRISPR gRNA sequence
ggaggcagtggtgtgattat

SEQ ID NO: 115756 - DNA, 20 bp, Artificial
  CRISPR gRNA sequence
gaggcagtggtgtgattatg

SEQ ID NO: 115757 - DNA, 20 bp, Artificial
  CRISPR gRNA sequence
tggctcactttagtcttgac

SEQ ID NO: 115758 - DNA, 20 bp, Artificial
  CRISPR gRNA sequence
actttagtcttgacctccca

SEQ ID NO: 115759 - DNA, 20 bp, Artificial
  CRISPR gRNA sequence
tagtcttgacctcccagctc

SEQ ID NO: 115760 - DNA, 20 bp, Artificial
  CRISPR gRNA sequence
agtcttgacctcccagctca

SEQ ID NO: 115761 - DNA, 20 bp, Artificial
  CRISPR gRNA sequence
gtcttgacctcccagctcaa

SEQ ID NO: 115762 - DNA, 20 bp, Artificial
  CRISPR gRNA sequence
gacctcccagctcaagtgat

SEQ ID NO: 115763 - DNA, 20 bp, Artificial
  CRISPR gRNA sequence
acctcccagctcaagtgatc

SEQ ID NO: 115764 - DNA, 20 bp, Artificial
  CRISPR gRNA sequence
ccagctcaagtgatcctccc

SEQ ID NO: 115765 - DNA, 20 bp, Artificial
  CRISPR gRNA sequence
aagtgatcctcccactttag

SEQ ID NO: 115766 - DNA, 20 bp, Artificial
  CRISPR gRNA sequence
ccactttaggctcccgagta

SEQ ID NO: 115767 - DNA, 20 bp, Artificial
  CRISPR gRNA sequence
taggctcccgagtagctggg

SEQ ID NO: 115768 - DNA, 20 bp, Artificial
  CRISPR gRNA sequence
aggctcccgagtagctggga

SEQ ID NO: 115769 - DNA, 20 bp, Artificial
  CRISPR gRNA sequence
ggctcccgagtagctgggac

SEQ ID NO: 115770 - DNA, 20 bp, Artificial
  CRISPR gRNA sequence
ccgagtagctgggactatag

SEQ ID NO: 115771 - DNA, 20 bp, Artificial
  CRISPR gRNA sequence
ggactatagccacgcaccac

SEQ ID NO: 115772 - DNA, 20 bp, Artificial
  CRISPR gRNA sequence
tagccacgcaccaccatgcc

SEQ ID NO: 115773 - DNA, 20 bp, Artificial
  CRISPR gRNA sequence
atttttaaattttttgtaga

SEQ ID NO: 115774 - DNA, 20 bp, Artificial
  CRISPR gRNA sequence
ttaaattttttgtagaaatg

SEQ ID NO: 115775 - DNA, 20 bp, Artificial
  CRISPR gRNA sequence
taaattttttgtagaaatgg

SEQ ID NO: 115776 - DNA, 20 bp, Artificial
  CRISPR gRNA sequence
aaattttttgtagaaatgga

SEQ ID NO: 115777 - DNA, 20 bp, Artificial
  CRISPR gRNA sequence
aattttttgtagaaatggag

SEQ ID NO: 115778 - DNA, 20 bp, Artificial
  CRISPR gRNA sequence
tttgtagaaatggagtctca

SEQ ID NO: 115779 - DNA, 20 bp, Artificial
  CRISPR gRNA sequence
ttgtagaaatggagtctcac

SEQ ID NO: 115780 - DNA, 20 bp, Artificial
  CRISPR gRNA sequence
tgtagaaatggagtctcact

SEQ ID NO: 115781 - DNA, 20 bp, Artificial
  CRISPR gRNA sequence
gtagaaatggagtctcactt

SEQ ID NO: 115782 - DNA, 20 bp, Artificial
  CRISPR gRNA sequence
tagaaatggagtctcacttt

SEQ ID NO: 115783 - DNA, 20 bp, Artificial
  CRISPR gRNA sequence
actttgttgcccaggcaggt

SEQ ID NO: 115784 - DNA, 20 bp, Artificial
  CRISPR gRNA sequence
tgttgcccaggcaggtctca

SEQ ID NO: 115785 - DNA, 20 bp, Artificial
  CRISPR gRNA sequence
gttgcccaggcaggtctcaa

SEQ ID NO: 115786 - DNA, 20 bp, Artificial
  CRISPR gRNA sequence
ttgcccaggcaggtctcaaa

SEQ ID NO: 115787 - DNA, 20 bp, Artificial
  CRISPR gRNA sequence
cccaggcaggtctcaaactc

SEQ ID NO: 115788 - DNA, 20 bp, Artificial
  CRISPR gRNA sequence
aaactcctaggctcaagcga

SEQ ID NO: 115789 - DNA, 20 bp, Artificial
  CRISPR gRNA sequence
ctaggctcaagcgatcctct

SEQ ID NO: 115790 - DNA, 20 bp, Artificial
  CRISPR gRNA sequence
ggctcaagcgatcctctcgc

SEQ ID NO: 115791 - DNA, 20 bp, Artificial
  CRISPR gRNA sequence
aagcgatcctctcgccttgg

SEQ ID NO: 115792 - DNA, 20 bp, Artificial
  CRISPR gRNA sequence
tcgccttggcctcccaaagt

SEQ ID NO: 115793 - DNA, 20 bp, Artificial
  CRISPR gRNA sequence
gccttggcctcccaaagtgc

SEQ ID NO: 115794 - DNA, 20 bp, Artificial
  CRISPR gRNA sequence
ggcctcccaaagtgctagga

SEQ ID NO: 115795 - DNA, 20 bp, Artificial
  CRISPR gRNA sequence
gcctcccaaagtgctaggat

SEQ ID NO: 115796 - DNA, 20 bp, Artificial
  CRISPR gRNA sequence
ccaaagtgctaggattacag

SEQ ID NO: 115797 - DNA, 20 bp, Artificial
  CRISPR gRNA sequence
ggattacaggcgcacaccat

SEQ ID NO: 115798 - DNA, 20 bp, Artificial
  CRISPR gRNA sequence
caggcgcacaccattgcact

SEQ ID NO: 115799 - DNA, 20 bp, Artificial
  CRISPR gRNA sequence
cacttggcccttttctttac

SEQ ID NO: 115800 - DNA, 20 bp, Artificial
  CRISPR gRNA sequence
ggcccttttctttacagtgt

SEQ ID NO: 115801 - DNA, 20 bp, Artificial
  CRISPR gRNA sequence
gcccttttctttacagtgta

SEQ ID NO: 115802 - DNA, 20 bp, Artificial
  CRISPR gRNA sequence
ttctttacagtgtaataata

SEQ ID NO: 115803 - DNA, 20 bp, Artificial
  CRISPR gRNA sequence
tctttacagtgtaataatat

SEQ ID NO: 115804 - DNA, 20 bp, Artificial
  CRISPR gRNA sequence
ctttacagtgtaataatatt

SEQ ID NO: 115805 - DNA, 20 bp, Artificial
  CRISPR gRNA sequence
tttacagtgtaataatattt

SEQ ID NO: 115806 - DNA, 20 bp, Artificial
  CRISPR gRNA sequence
tacagtgtaataatatttaa

SEQ ID NO: 115807 - DNA, 20 bp, Artificial
  CRISPR gRNA sequence
acagtgtaataatatttaag

SEQ ID NO: 115808 - DNA, 20 bp, Artificial
  CRISPR gRNA sequence
cagtgtaataatatttaagt

SEQ ID NO: 115809 - DNA, 20 bp, Artificial
  CRISPR gRNA sequence
aagttgttgaatttttcaag

SEQ ID NO: 115810 - DNA, 20 bp, Artificial
  CRISPR gRNA sequence
agttgttgaatttttcaaga

SEQ ID NO: 115811 - DNA, 20 bp, Artificial
  CRISPR gRNA sequence
ttgaatttttcaagattgtt

SEQ ID NO: 115812 - DNA, 20 bp, Artificial
  CRISPR gRNA sequence
aatttttcaagattgtttcc

SEQ ID NO: 115813 - DNA, 20 bp, Artificial
  CRISPR gRNA sequence
ttcaagattgtttccttcac

SEQ ID NO: 115814 - DNA, 20 bp, Artificial
  CRISPR gRNA sequence
tcaagattgtttccttcact

SEQ ID NO: 115815 - DNA, 20 bp, Artificial
  CRISPR gRNA sequence
caagattgtttccttcacta

SEQ ID NO: 115816 - DNA, 20 bp, Artificial
  CRISPR gRNA sequence
aagattgtttccttcactag

SEQ ID NO: 115817 - DNA, 20 bp, Artificial
  CRISPR gRNA sequence
tttccttcactagactgtaa

SEQ ID NO: 115818 - DNA, 20 bp, Artificial
  CRISPR gRNA sequence
ccttcactagactgtaagtt

SEQ ID NO: 115819 - DNA, 20 bp, Artificial
  CRISPR gRNA sequence
cttcactagactgtaagttg

SEQ ID NO: 115820 - DNA, 20 bp, Artificial
  CRISPR gRNA sequence
cactagactgtaagttgtat

SEQ ID NO: 115821 - DNA, 20 bp, Artificial
  CRISPR gRNA sequence
actagactgtaagttgtata

SEQ ID NO: 115822 - DNA, 20 bp, Artificial
  CRISPR gRNA sequence
gactgtaagttgtatagagg

SEQ ID NO: 115823 - DNA, 20 bp, Artificial
  CRISPR gRNA sequence
taagttgtatagagggtaga

SEQ ID NO: 115824 - DNA, 20 bp, Artificial
  CRISPR gRNA sequence
tatagagggtagaggattgt

SEQ ID NO: 115825 - DNA, 20 bp, Artificial
  CRISPR gRNA sequence
tttcgttctctgttatattt

SEQ ID NO: 115826 - DNA, 20 bp, Artificial
  CRISPR gRNA sequence
cgttctctgttatatttatt

SEQ ID NO: 115827 - DNA, 20 bp, Artificial
  CRISPR gRNA sequence
gttctctgttatatttattg

SEQ ID NO: 115828 - DNA, 20 bp, Artificial
  CRISPR gRNA sequence
tctgttatatttattggact

SEQ ID NO: 115829 - DNA, 20 bp, Artificial
  CRISPR gRNA sequence
tgttatatttattggactta

SEQ ID NO: 115830 - DNA, 20 bp, Artificial
  CRISPR gRNA sequence
ttatatttattggacttaat

SEQ ID NO: 115831 - DNA, 20 bp, Artificial
  CRISPR gRNA sequence
tatttattggacttaattct

SEQ ID NO: 115832 - DNA, 20 bp, Artificial
  CRISPR gRNA sequence
attggacttaattctattta

SEQ ID NO: 115833 - DNA, 20 bp, Artificial
  CRISPR gRNA sequence
ttggacttaattctatttaa

SEQ ID NO: 115834 - DNA, 20 bp, Artificial
  CRISPR gRNA sequence
gacttaattctatttaagta

SEQ ID NO: 115835 - DNA, 20 bp, Artificial
  CRISPR gRNA sequence
aattctatttaagtaagttg

SEQ ID NO: 115836 - DNA, 20 bp, Artificial
  CRISPR gRNA sequence
attctatttaagtaagttgt

SEQ ID NO: 115837 - DNA, 20 bp, Artificial
  CRISPR gRNA sequence
tatttaagtaagttgtattt

SEQ ID NO: 115838 - DNA, 20 bp, Artificial
  CRISPR gRNA sequence
tttaagtaagttgtatttaa

SEQ ID NO: 115839 - DNA, 20 bp, Artificial
  CRISPR gRNA sequence
aagtaagttgtatttaagta

SEQ ID NO: 115840 - DNA, 20 bp, Artificial
  CRISPR gRNA sequence
agtaagttgtatttaagtac

SEQ ID NO: 115841 - DNA, 20 bp, Artificial
  CRISPR gRNA sequence
tatttaagtactgacttaga

SEQ ID NO: 115842 - DNA, 20 bp, Artificial
  CRISPR gRNA sequence
aagtactgacttagatgtat

SEQ ID NO: 115843 - DNA, 20 bp, Artificial
  CRISPR gRNA sequence
agtactgacttagatgtatt

SEQ ID NO: 115844 - DNA, 20 bp, Artificial
  CRISPR gRNA sequence
acttagatgtatttgttggg

SEQ ID NO: 115845 - DNA, 20 bp, Artificial
  CRISPR gRNA sequence
agatgtatttgttgggttta

SEQ ID NO: 115846 - DNA, 20 bp, Artificial
  CRISPR gRNA sequence
gatgtatttgttgggtttag

SEQ ID NO: 115847 - DNA, 20 bp, Artificial
  CRISPR gRNA sequence
gttgggtttagtatccagtt

SEQ ID NO: 115848 - DNA, 20 bp, Artificial
  CRISPR gRNA sequence
ttgggtttagtatccagttc

SEQ ID NO: 115849 - DNA, 20 bp, Artificial
  CRISPR gRNA sequence
ggtttagtatccagttctga

SEQ ID NO: 115850 - DNA, 20 bp, Artificial
  CRISPR gRNA sequence
agtatccagttctgaaccaa

SEQ ID NO: 115851 - DNA, 20 bp, Artificial
  CRISPR gRNA sequence
gtatccagttctgaaccaag

SEQ ID NO: 115852 - DNA, 20 bp, Artificial
  CRISPR gRNA sequence
tgaaccaagcaatcagtgtt

SEQ ID NO: 115853 - DNA, 20 bp, Artificial
  CRISPR gRNA sequence
aaccaagcaatcagtgtttc

SEQ ID NO: 115854 - DNA, 20 bp, Artificial
  CRISPR gRNA sequence
cttgaattaatagattcctc

SEQ ID NO: 115855 - DNA, 20 bp, Artificial
  CRISPR gRNA sequence
ttgaattaatagattcctcc

SEQ ID NO: 115856 - DNA, 20 bp, Artificial
  CRISPR gRNA sequence
gaattaatagattcctccca

SEQ ID NO: 115857 - DNA, 20 bp, Artificial
  CRISPR gRNA sequence
aattaatagattcctcccat

SEQ ID NO: 115858 - DNA, 20 bp, Artificial
  CRISPR gRNA sequence
atagattcctcccatttgct

SEQ ID NO: 115859 - DNA, 20 bp, Artificial
  CRISPR gRNA sequence
ctcccatttgctgatactcc

SEQ ID NO: 115860 - DNA, 20 bp, Artificial
  CRISPR gRNA sequence
ccatttgctgatactccatt

SEQ ID NO: 115861 - DNA, 20 bp, Artificial
  CRISPR gRNA sequence
gctgatactccattctatat

SEQ ID NO: 115862 - DNA, 20 bp, Artificial
  CRISPR gRNA sequence
ctgatactccattctatatt

SEQ ID NO: 115863 - DNA, 20 bp, Artificial
  CRISPR gRNA sequence
atactccattctatattaac

SEQ ID NO: 115864 - DNA, 20 bp, Artificial
  CRISPR gRNA sequence
cattctatattaacatcaca

SEQ ID NO: 115865 - DNA, 20 bp, Artificial
  CRISPR gRNA sequence
tatattaacatcacattcca

SEQ ID NO: 115866 - DNA, 20 bp, Artificial
  CRISPR gRNA sequence
tattaacatcacattccact

SEQ ID NO: 115867 - DNA, 20 bp, Artificial
  CRISPR gRNA sequence
acatcacattccacttgcac

SEQ ID NO: 115868 - DNA, 20 bp, Artificial
  CRISPR gRNA sequence
cacttgcactattgcaatat

SEQ ID NO: 115869 - DNA, 20 bp, Artificial
  CRISPR gRNA sequence
gcactattgcaatatccatc

SEQ ID NO: 115870 - DNA, 20 bp, Artificial
  CRISPR gRNA sequence
cactattgcaatatccatca

SEQ ID NO: 115871 - DNA, 20 bp, Artificial
  CRISPR gRNA sequence
ttgcaatatccatcaaatta

SEQ ID NO: 115872 - DNA, 20 bp, Artificial
  CRISPR gRNA sequence
caatatccatcaaattaatc

SEQ ID NO: 115873 - DNA, 20 bp, Artificial
  CRISPR gRNA sequence
atctccagtctcctctaatt

SEQ ID NO: 115874 - DNA, 20 bp, Artificial
  CRISPR gRNA sequence
cagtctcctctaattggcct

SEQ ID NO: 115875 - DNA, 20 bp, Artificial
  CRISPR gRNA sequence
ctctaattggccttatatag

SEQ ID NO: 115876 - DNA, 20 bp, Artificial
  CRISPR gRNA sequence
taattggccttatatagtac

SEQ ID NO: 115877 - DNA, 20 bp, Artificial
  CRISPR gRNA sequence
attggccttatatagtactt

SEQ ID NO: 115878 - DNA, 20 bp, Artificial
  CRISPR gRNA sequence
gccttatatagtacttatac

SEQ ID NO: 115879 - DNA, 20 bp, Artificial
  CRISPR gRNA sequence
atatagtacttatacagtac

SEQ ID NO: 115880 - DNA, 20 bp, Artificial
  CRISPR gRNA sequence
tatagtacttatacagtaca

SEQ ID NO: 115881 - DNA, 20 bp, Artificial
  CRISPR gRNA sequence
atacagtacatggttaaagt

SEQ ID NO: 115882 - DNA, 20 bp, Artificial
  CRISPR gRNA sequence
tacagtacatggttaaagtg

SEQ ID NO: 115883 - DNA, 20 bp, Artificial
  CRISPR gRNA sequence
aagtgttttttttaacctgc

SEQ ID NO: 115884 - DNA, 20 bp, Artificial
  CRISPR gRNA sequence
tttttaacctgccagtcccc

SEQ ID NO: 115885 - DNA, 20 bp, Artificial
  CRISPR gRNA sequence
ttttaacctgccagtcccca

SEQ ID NO: 115886 - DNA, 20 bp, Artificial
  CRISPR gRNA sequence
tttaacctgccagtccccag

SEQ ID NO: 115887 - DNA, 20 bp, Artificial
  CRISPR gRNA sequence
ttaacctgccagtccccagg

SEQ ID NO: 115888 - DNA, 20 bp, Artificial
  CRISPR gRNA sequence
taacctgccagtccccaggt

SEQ ID NO: 115889 - DNA, 20 bp, Artificial
  CRISPR gRNA sequence
aacctgccagtccccaggtc

SEQ ID NO: 115890 - DNA, 20 bp, Artificial
  CRISPR gRNA sequence
acctgccagtccccaggtca

SEQ ID NO: 115891 - DNA, 20 bp, Artificial
  CRISPR gRNA sequence
ccagtccccaggtcaaggat

SEQ ID NO: 115892 - DNA, 20 bp, Artificial
  CRISPR gRNA sequence
ttaatagttctcatttctta

SEQ ID NO: 115893 - DNA, 20 bp, Artificial
  CRISPR gRNA sequence
atagttctcatttcttaact

SEQ ID NO: 115894 - DNA, 20 bp, Artificial
  CRISPR gRNA sequence
tcatttcttaactgcatcaa

SEQ ID NO: 115895 - DNA, 20 bp, Artificial
  CRISPR gRNA sequence
atttcttaactgcatcaaat

SEQ ID NO: 115896 - DNA, 20 bp, Artificial
  CRISPR gRNA sequence
cttaactgcatcaaatctca

SEQ ID NO: 115897 - DNA, 20 bp, Artificial
  CRISPR gRNA sequence
ttaactgcatcaaatctcaa

SEQ ID NO: 115898 - DNA, 20 bp, Artificial
  CRISPR gRNA sequence
aactgcatcaaatctcaaac

SEQ ID NO: 115899 - DNA, 20 bp, Artificial
  CRISPR gRNA sequence
actgcatcaaatctcaaact

SEQ ID NO: 115900 - DNA, 20 bp, Artificial
  CRISPR gRNA sequence
catcaaatctcaaactattt

SEQ ID NO: 115901 - DNA, 20 bp, Artificial
  CRISPR gRNA sequence
aaactatttctgtataacat

SEQ ID NO: 115902 - DNA, 20 bp, Artificial
  CRISPR gRNA sequence
tttctgtataacatctaagc

SEQ ID NO: 115903 - DNA, 20 bp, Artificial
  CRISPR gRNA sequence
ctgtataacatctaagcaac

SEQ ID NO: 115904 - DNA, 20 bp, Artificial
  CRISPR gRNA sequence
tgtataacatctaagcaact

SEQ ID NO: 115905 - DNA, 20 bp, Artificial
  CRISPR gRNA sequence
tataacatctaagcaacttt

SEQ ID NO: 115906 - DNA, 20 bp, Artificial
  CRISPR gRNA sequence
agcaactttgccttatcacc

SEQ ID NO: 115907 - DNA, 20 bp, Artificial
  CRISPR gRNA sequence
tgccttatcaccccctcaac

SEQ ID NO: 115908 - DNA, 20 bp, Artificial
  CRISPR gRNA sequence
gccttatcaccccctcaaca

SEQ ID NO: 115909 - DNA, 20 bp, Artificial
  CRISPR gRNA sequence
ccttatcaccccctcaacaa

SEQ ID NO: 115910 - DNA, 20 bp, Artificial
  CRISPR gRNA sequence
atcaccccctcaacaatcaa

SEQ ID NO: 115911 - DNA, 20 bp, Artificial
  CRISPR gRNA sequence
tcaccccctcaacaatcaaa

SEQ ID NO: 115912 - DNA, 20 bp, Artificial
  CRISPR gRNA sequence
aacaatcaaactaggtttcc

SEQ ID NO: 115913 - DNA, 20 bp, Artificial
  CRISPR gRNA sequence
ggtttcctcagtgtccccac

SEQ ID NO: 115914 - DNA, 20 bp, Artificial
  CRISPR gRNA sequence
cctcagtgtccccacacatg

SEQ ID NO: 115915 - DNA, 20 bp, Artificial
  CRISPR gRNA sequence
ctcagtgtccccacacatga

SEQ ID NO: 115916 - DNA, 20 bp, Artificial
  CRISPR gRNA sequence
agtgtccccacacatgaaca

SEQ ID NO: 115917 - DNA, 20 bp, Artificial
  CRISPR gRNA sequence
acaactctttcagtgctatt

SEQ ID NO: 115918 - DNA, 20 bp, Artificial
  CRISPR gRNA sequence
tttcagtgctattaatcctc

SEQ ID NO: 115919 - DNA, 20 bp, Artificial
  CRISPR gRNA sequence
tcagtgctattaatcctcac

SEQ ID NO: 115920 - DNA, 20 bp, Artificial
  CRISPR gRNA sequence
cagtgctattaatcctcacc

SEQ ID NO: 115921 - DNA, 20 bp, Artificial
  CRISPR gRNA sequence
agtgctattaatcctcacct

SEQ ID NO: 115922 - DNA, 20 bp, Artificial
  CRISPR gRNA sequence
ttaatcctcacctgtagtgt

SEQ ID NO: 115923 - DNA, 20 bp, Artificial
  CRISPR gRNA sequence
atcctcacctgtagtgtgag

SEQ ID NO: 115924 - DNA, 20 bp, Artificial
  CRISPR gRNA sequence
acctgtagtgtgagagcccc

SEQ ID NO: 115925 - DNA, 20 bp, Artificial
  CRISPR gRNA sequence
tagtgtgagagcccctcctt

SEQ ID NO: 115926 - DNA, 20 bp, Artificial
  CRISPR gRNA sequence
ctttctcattgctattcatt

SEQ ID NO: 115927 - DNA, 20 bp, Artificial
  CRISPR gRNA sequence
tctcattgctattcattcat

SEQ ID NO: 115928 - DNA, 20 bp, Artificial
  CRISPR gRNA sequence
ctcattgctattcattcata

SEQ ID NO: 115929 - DNA, 20 bp, Artificial
  CRISPR gRNA sequence
tcattgctattcattcataa

SEQ ID NO: 115930 - DNA, 20 bp, Artificial
  CRISPR gRNA sequence
attgctattcattcataacg

SEQ ID NO: 115931 - DNA, 20 bp, Artificial
  CRISPR gRNA sequence
ctattcattcataacggtgt

SEQ ID NO: 115932 - DNA, 20 bp, Artificial
  CRISPR gRNA sequence
ttcattcataacggtgtatg

SEQ ID NO: 115933 - DNA, 20 bp, Artificial
  CRISPR gRNA sequence
attcataacggtgtatgaat

SEQ ID NO: 115934 - DNA, 20 bp, Artificial
  CRISPR gRNA sequence
ataacggtgtatgaatgtgg

SEQ ID NO: 115935 - DNA, 20 bp, Artificial
  CRISPR gRNA sequence
acagctattgtggcaggagg

SEQ ID NO: 115936 - DNA, 20 bp, Artificial
  CRISPR gRNA sequence
ttgtggcaggagggcattgt

SEQ ID NO: 115937 - DNA, 20 bp, Artificial
  CRISPR gRNA sequence
tggcaggagggcattgtgcc

SEQ ID NO: 115938 - DNA, 20 bp, Artificial
  CRISPR gRNA sequence
tgccaggaactctcctcatt

SEQ ID NO: 115939 - DNA, 20 bp, Artificial
  CRISPR gRNA sequence
tcctcattctgtgtgctaac

SEQ ID NO: 115940 - DNA, 20 bp, Artificial
  CRISPR gRNA sequence
ctcattctgtgtgctaacaa

SEQ ID NO: 115941 - DNA, 20 bp, Artificial
  CRISPR gRNA sequence
attctgtgtgctaacaatat

SEQ ID NO: 115942 - DNA, 20 bp, Artificial
  CRISPR gRNA sequence
tgtgtgctaacaatatgatc

SEQ ID NO: 115943 - DNA, 20 bp, Artificial
  CRISPR gRNA sequence
tgtgctaacaatatgatctt

SEQ ID NO: 115944 - DNA, 20 bp, Artificial
  CRISPR gRNA sequence
acaatatgatcttggtcaat

SEQ ID NO: 115945 - DNA, 20 bp, Artificial
  CRISPR gRNA sequence
ggtcaattcagcctctttta

SEQ ID NO: 115946 - DNA, 20 bp, Artificial
  CRISPR gRNA sequence
gtcaattcagcctcttttat

SEQ ID NO: 115947 - DNA, 20 bp, Artificial
  CRISPR gRNA sequence
agcctcttttatttttatct

SEQ ID NO: 115948 - DNA, 20 bp, Artificial
  CRISPR gRNA sequence
ttttatttttatctgtaaag

SEQ ID NO: 115949 - DNA, 20 bp, Artificial
  CRISPR gRNA sequence
ttatttttatctgtaaagtg

SEQ ID NO: 115950 - DNA, 20 bp, Artificial
  CRISPR gRNA sequence
tatttttatctgtaaagtgg

SEQ ID NO: 115951 - DNA, 20 bp, Artificial
  CRISPR gRNA sequence
atttttatctgtaaagtgga

SEQ ID NO: 115952 - DNA, 20 bp, Artificial
  CRISPR gRNA sequence
tttttatctgtaaagtggaa

SEQ ID NO: 115953 - DNA, 20 bp, Artificial
  CRISPR gRNA sequence
ttatctgtaaagtggaatac

SEQ ID NO: 115954 - DNA, 20 bp, Artificial
  CRISPR gRNA sequence
tatctgtaaagtggaatact

SEQ ID NO: 115955 - DNA, 20 bp, Artificial
  CRISPR gRNA sequence
atctgtaaagtggaatactg

SEQ ID NO: 115956 - DNA, 20 bp, Artificial
  CRISPR gRNA sequence
tctgtaaagtggaatactgt

SEQ ID NO: 115957 - DNA, 20 bp, Artificial
  CRISPR gRNA sequence
taaagtggaatactgttgat

SEQ ID NO: 115958 - DNA, 20 bp, Artificial
  CRISPR gRNA sequence
ttgatacttcacagcaatgt

SEQ ID NO: 115959 - DNA, 20 bp, Artificial
  CRISPR gRNA sequence
atacttcacagcaatgttgt

SEQ ID NO: 115960 - DNA, 20 bp, Artificial
  CRISPR gRNA sequence
cacagcaatgttgtagggat

SEQ ID NO: 115961 - DNA, 20 bp, Artificial
  CRISPR gRNA sequence
acagcaatgttgtagggatt

SEQ ID NO: 115962 - DNA, 20 bp, Artificial
  CRISPR gRNA sequence
tagggatttcattcagtaat

SEQ ID NO: 115963 - DNA, 20 bp, Artificial
  CRISPR gRNA sequence
cattcagtaatccacattag

SEQ ID NO: 115964 - DNA, 20 bp, Artificial
  CRISPR gRNA sequence
attcagtaatccacattagg

SEQ ID NO: 115965 - DNA, 20 bp, Artificial
  CRISPR gRNA sequence
agtaatccacattaggcatc

SEQ ID NO: 115966 - DNA, 20 bp, Artificial
  CRISPR gRNA sequence
ggcatctgtgtagcaccata

SEQ ID NO: 115967 - DNA, 20 bp, Artificial
  CRISPR gRNA sequence
tgtagcaccatacctagtgc

SEQ ID NO: 115968 - DNA, 20 bp, Artificial
  CRISPR gRNA sequence
gtgcatggtgagttcagtaa

SEQ ID NO: 115969 - DNA, 20 bp, Artificial
  CRISPR gRNA sequence
agtaaatgctagttgttttt

SEQ ID NO: 115970 - DNA, 20 bp, Artificial
  CRISPR gRNA sequence
gttgtttttgctcattgttc

SEQ ID NO: 115971 - DNA, 20 bp, Artificial
  CRISPR gRNA sequence
tttttgctcattgttcaaga

SEQ ID NO: 115972 - DNA, 20 bp, Artificial
  CRISPR gRNA sequence
ttgctcattgttcaagaccc

SEQ ID NO: 115973 - DNA, 20 bp, Artificial
  CRISPR gRNA sequence
tgctcattgttcaagaccca

SEQ ID NO: 115974 - DNA, 20 bp, Artificial
  CRISPR gRNA sequence
gctcattgttcaagacccag

SEQ ID NO: 115975 - DNA, 20 bp, Artificial
  CRISPR gRNA sequence
ctcattgttcaagacccagt

SEQ ID NO: 115976 - DNA, 20 bp, Artificial
  CRISPR gRNA sequence
attgttcaagacccagttcc

SEQ ID NO: 115977 - DNA, 20 bp, Artificial
  CRISPR gRNA sequence
ttcaagacccagttccagtc

SEQ ID NO: 115978 - DNA, 20 bp, Artificial
  CRISPR gRNA sequence
aagacccagttccagtcttc

SEQ ID NO: 115979 - DNA, 20 bp, Artificial
  CRISPR gRNA sequence
cagtcttccatctccagaag

SEQ ID NO: 115980 - DNA, 20 bp, Artificial
  CRISPR gRNA sequence
ccatctccagaaggctttca

SEQ ID NO: 115981 - DNA, 20 bp, Artificial
  CRISPR gRNA sequence
catctccagaaggctttcag

SEQ ID NO: 115982 - DNA, 20 bp, Artificial
  CRISPR gRNA sequence
cagaaggctttcagcttttt

SEQ ID NO: 115983 - DNA, 20 bp, Artificial
  CRISPR gRNA sequence
tcagctttttctcagatcct

SEQ ID NO: 115984 - DNA, 20 bp, Artificial
  CRISPR gRNA sequence
cagctttttctcagatcctg

SEQ ID NO: 115985 - DNA, 20 bp, Artificial
  CRISPR gRNA sequence
agctttttctcagatcctgc

SEQ ID NO: 115986 - DNA, 20 bp, Artificial
  CRISPR gRNA sequence
tttctcagatcctgcctacc

SEQ ID NO: 115987 - DNA, 20 bp, Artificial
  CRISPR gRNA sequence
ttctcagatcctgcctacca

SEQ ID NO: 115988 - DNA, 20 bp, Artificial
  CRISPR gRNA sequence
tctcagatcctgcctaccaa

SEQ ID NO: 115989 - DNA, 20 bp, Artificial
  CRISPR gRNA sequence
ctcagatcctgcctaccaag

SEQ ID NO: 115990 - DNA, 20 bp, Artificial
  CRISPR gRNA sequence
tcagatcctgcctaccaagg

SEQ ID NO: 115991 - DNA, 20 bp, Artificial
  CRISPR gRNA sequence
agatcctgcctaccaaggct

SEQ ID NO: 115992 - DNA, 20 bp, Artificial
  CRISPR gRNA sequence
cctaccaaggcttcagagcc

SEQ ID NO: 115993 - DNA, 20 bp, Artificial
  CRISPR gRNA sequence
ccaaggcttcagagccttgg

SEQ ID NO: 115994 - DNA, 20 bp, Artificial
  CRISPR gRNA sequence
cagagccttggtatggggga

SEQ ID NO: 115995 - DNA, 20 bp, Artificial
  CRISPR gRNA sequence
agagccttggtatgggggaa

SEQ ID NO: 115996 - DNA, 20 bp, Artificial
  CRISPR gRNA sequence
ggtatgggggaactaaaggt

SEQ ID NO: 115997 - DNA, 20 bp, Artificial
  CRISPR gRNA sequence
gtatgggggaactaaaggtg

SEQ ID NO: 115998 - DNA, 20 bp, Artificial
  CRISPR gRNA sequence
aaggtggttcttgcggagtg

SEQ ID NO: 115999 - DNA, 20 bp, Artificial
  CRISPR gRNA sequence
ttgcggagtgttgcaaaaag

SEQ ID NO: 116000 - DNA, 20 bp, Artificial
  CRISPR gRNA sequence
gcggagtgttgcaaaaagct

SEQ ID NO: 116001 - DNA, 20 bp, Artificial
  CRISPR gRNA sequence
cggagtgttgcaaaaagctt

SEQ ID NO: 116002 - DNA, 20 bp, Artificial
  CRISPR gRNA sequence
caaaaagcttccaaggattt

SEQ ID NO: 116003 - DNA, 20 bp, Artificial
  CRISPR gRNA sequence
ccaaggatttatccttgtgt

SEQ ID NO: 116004 - DNA, 20 bp, Artificial
  CRISPR gRNA sequence
caaggatttatccttgtgtt

SEQ ID NO: 116005 - DNA, 20 bp, Artificial
  CRISPR gRNA sequence
atccttgtgttaacacggta

SEQ ID NO: 116006 - DNA, 20 bp, Artificial
  CRISPR gRNA sequence
tccttgtgttaacacggtag

SEQ ID NO: 116007 - DNA, 20 bp, Artificial
  CRISPR gRNA sequence
gtgttaacacggtaggtctt

SEQ ID NO: 116008 - DNA, 20 bp, Artificial
  CRISPR gRNA sequence
tgttaacacggtaggtctta

SEQ ID NO: 116009 - DNA, 20 bp, Artificial
  CRISPR gRNA sequence
acacggtaggtcttaagtga

SEQ ID NO: 116010 - DNA, 20 bp, Artificial
  CRISPR gRNA sequence
aagtgagaaacagcatatag

SEQ ID NO: 116011 - DNA, 20 bp, Artificial
  CRISPR gRNA sequence
agtgagaaacagcatataga

SEQ ID NO: 116012 - DNA, 20 bp, Artificial
  CRISPR gRNA sequence
agtggaaagaagatgaaatg

SEQ ID NO: 116013 - DNA, 20 bp, Artificial
  CRISPR gRNA sequence
gtggaaagaagatgaaatgg

SEQ ID NO: 116014 - DNA, 20 bp, Artificial
  CRISPR gRNA sequence
gggagttagcccttgctgga

SEQ ID NO: 116015 - DNA, 20 bp, Artificial
  CRISPR gRNA sequence
ggagttagcccttgctggac

SEQ ID NO: 116016 - DNA, 20 bp, Artificial
  CRISPR gRNA sequence
gcccttgctggactcctaac

SEQ ID NO: 116017 - DNA, 20 bp, Artificial
  CRISPR gRNA sequence
gctggactcctaactttctg

SEQ ID NO: 116018 - DNA, 20 bp, Artificial
  CRISPR gRNA sequence
ctggactcctaactttctga

SEQ ID NO: 116019 - DNA, 20 bp, Artificial
  CRISPR gRNA sequence
gactcctaactttctgaccc

SEQ ID NO: 116020 - DNA, 20 bp, Artificial
  CRISPR gRNA sequence
ctaactttctgaccctgacc

SEQ ID NO: 116021 - DNA, 20 bp, Artificial
  CRISPR gRNA sequence
actttctgaccctgacccta

SEQ ID NO: 116022 - DNA, 20 bp, Artificial
  CRISPR gRNA sequence
tctgaccctgaccctagtcc

SEQ ID NO: 116023 - DNA, 20 bp, Artificial
  CRISPR gRNA sequence
ctgaccctgaccctagtcca

SEQ ID NO: 116024 - DNA, 20 bp, Artificial
  CRISPR gRNA sequence
tgaccctgaccctagtccac

SEQ ID NO: 116025 - DNA, 20 bp, Artificial
  CRISPR gRNA sequence
accctgaccctagtccacgc

SEQ ID NO: 116026 - DNA, 20 bp, Artificial
  CRISPR gRNA sequence
accctagtccacgcaaatca

SEQ ID NO: 116027 - DNA, 20 bp, Artificial
  CRISPR gRNA sequence
gtccacgcaaatcactttac

SEQ ID NO: 116028 - DNA, 20 bp, Artificial
  CRISPR gRNA sequence
tacccatctggccttcagat

SEQ ID NO: 116029 - DNA, 20 bp, Artificial
  CRISPR gRNA sequence
acccatctggccttcagatt

SEQ ID NO: 116030 - DNA, 20 bp, Artificial
  CRISPR gRNA sequence
cccatctggccttcagattt

SEQ ID NO: 116031 - DNA, 20 bp, Artificial
  CRISPR gRNA sequence
gccttcagatttatctgtaa

SEQ ID NO: 116032 - DNA, 20 bp, Artificial
  CRISPR gRNA sequence
cagatttatctgtaaaacga

SEQ ID NO: 116033 - DNA, 20 bp, Artificial
  CRISPR gRNA sequence
agatttatctgtaaaacgag

SEQ ID NO: 116034 - DNA, 20 bp, Artificial
  CRISPR gRNA sequence
atctgtaaaacgagtacatt

SEQ ID NO: 116035 - DNA, 20 bp, Artificial
  CRISPR gRNA sequence
tctgtaaaacgagtacatta

SEQ ID NO: 116036 - DNA, 20 bp, Artificial
  CRISPR gRNA sequence
taaaacgagtacattaaagt

SEQ ID NO: 116037 - DNA, 20 bp, Artificial
  CRISPR gRNA sequence
aagtgtatagattctaatga

SEQ ID NO: 116038 - DNA, 20 bp, Artificial
  CRISPR gRNA sequence
taatgattctttctagccct

SEQ ID NO: 116039 - DNA, 20 bp, Artificial
  CRISPR gRNA sequence
atgattctttctagccctgc

SEQ ID NO: 116040 - DNA, 20 bp, Artificial
  CRISPR gRNA sequence
tttctagccctgctaagtac

SEQ ID NO: 116041 - DNA, 20 bp, Artificial
  CRISPR gRNA sequence
tctagccctgctaagtactc

SEQ ID NO: 116042 - DNA, 20 bp, Artificial
  CRISPR gRNA sequence
ctagccctgctaagtactca

SEQ ID NO: 116043 - DNA, 20 bp, Artificial
  CRISPR gRNA sequence
tagccctgctaagtactcag

SEQ ID NO: 116044 - DNA, 20 bp, Artificial
  CRISPR gRNA sequence
gccctgctaagtactcagta

SEQ ID NO: 116045 - DNA, 20 bp, Artificial
  CRISPR gRNA sequence
ctaagtactcagtatttaaa

SEQ ID NO: 116046 - DNA, 20 bp, Artificial
  CRISPR gRNA sequence
agtactcagtatttaaatga

SEQ ID NO: 116047 - DNA, 20 bp, Artificial
  CRISPR gRNA sequence
agtatttaaatgatgatcaa

SEQ ID NO: 116048 - DNA, 20 bp, Artificial
  CRISPR gRNA sequence
aaatgatgatcaaaaaacag

SEQ ID NO: 116049 - DNA, 20 bp, Artificial
  CRISPR gRNA sequence
aatgatgatcaaaaaacagt

SEQ ID NO: 116050 - DNA, 20 bp, Artificial
  CRISPR gRNA sequence
ctctgggtcttttccttaga

SEQ ID NO: 116051 - DNA, 20 bp, Artificial
  CRISPR gRNA sequence
tctgggtcttttccttagac

SEQ ID NO: 116052 - DNA, 20 bp, Artificial
  CRISPR gRNA sequence
tgggtcttttccttagacac

SEQ ID NO: 116053 - DNA, 20 bp, Artificial
  CRISPR gRNA sequence
ggtcttttccttagacacct

SEQ ID NO: 116054 - DNA, 20 bp, Artificial
  CRISPR gRNA sequence
ttccttagacacctgaatct

SEQ ID NO: 116055 - DNA, 20 bp, Artificial
  CRISPR gRNA sequence
tccttagacacctgaatctg

SEQ ID NO: 116056 - DNA, 20 bp, Artificial
  CRISPR gRNA sequence
ccttagacacctgaatctga

SEQ ID NO: 116057 - DNA, 20 bp, Artificial
  CRISPR gRNA sequence
cttagacacctgaatctgaa

SEQ ID NO: 116058 - DNA, 20 bp, Artificial
  CRISPR gRNA sequence
agacacctgaatctgaatac

SEQ ID NO: 116059 - DNA, 20 bp, Artificial
  CRISPR gRNA sequence
gacacctgaatctgaatact

SEQ ID NO: 116060 - DNA, 20 bp, Artificial
  CRISPR gRNA sequence
aatctgaatactcttaaccc

SEQ ID NO: 116061 - DNA, 20 bp, Artificial
  CRISPR gRNA sequence
aatactcttaacccttaagt

SEQ ID NO: 116062 - DNA, 20 bp, Artificial
  CRISPR gRNA sequence
ttaacccttaagtatagaga

SEQ ID NO: 116063 - DNA, 20 bp, Artificial
  CRISPR gRNA sequence
aacccttaagtatagagaac

SEQ ID NO: 116064 - DNA, 20 bp, Artificial
  CRISPR gRNA sequence
acccttaagtatagagaaca

SEQ ID NO: 116065 - DNA, 20 bp, Artificial
  CRISPR gRNA sequence
aagtatagagaacaacacaa

SEQ ID NO: 116066 - DNA, 20 bp, Artificial
  CRISPR gRNA sequence
agtatagagaacaacacaag

SEQ ID NO: 116067 - DNA, 20 bp, Artificial
  CRISPR gRNA sequence
ttaggaaagagatacactaa

SEQ ID NO: 116068 - DNA, 20 bp, Artificial
  CRISPR gRNA sequence
aggaaagagatacactaaca

SEQ ID NO: 116069 - DNA, 20 bp, Artificial
  CRISPR gRNA sequence
ggaaagagatacactaacag

SEQ ID NO: 116070 - DNA, 20 bp, Artificial
  CRISPR gRNA sequence
acagccctgcagtgtttcac

SEQ ID NO: 116071 - DNA, 20 bp, Artificial
  CRISPR gRNA sequence
cagtgtttcaccatggagtg

SEQ ID NO: 116072 - DNA, 20 bp, Artificial
  CRISPR gRNA sequence
caccatggagtgcaggccag

SEQ ID NO: 116073 - DNA, 20 bp, Artificial
  CRISPR gRNA sequence
accatggagtgcaggccaga

SEQ ID NO: 116074 - DNA, 20 bp, Artificial
  CRISPR gRNA sequence
taaattattttaagaataag

SEQ ID NO: 116075 - DNA, 20 bp, Artificial
  CRISPR gRNA sequence
aaattattttaagaataagg

SEQ ID NO: 116076 - DNA, 20 bp, Artificial
  CRISPR gRNA sequence
aattattttaagaataaggt

SEQ ID NO: 116077 - DNA, 20 bp, Artificial
  CRISPR gRNA sequence
ttttaagaataaggtttatt

SEQ ID NO: 116078 - DNA, 20 bp, Artificial
  CRISPR gRNA sequence
taagaataaggtttattgtc

SEQ ID NO: 116079 - DNA, 20 bp, Artificial
  CRISPR gRNA sequence
aagaataaggtttattgtct

SEQ ID NO: 116080 - DNA, 20 bp, Artificial
  CRISPR gRNA sequence
agaataaggtttattgtctc

SEQ ID NO: 116081 - DNA, 20 bp, Artificial
  CRISPR gRNA sequence
attgtctcttctttcctaat

SEQ ID NO: 116082 - DNA, 20 bp, Artificial
  CRISPR gRNA sequence
ttgtctcttctttcctaatg

SEQ ID NO: 116083 - DNA, 20 bp, Artificial
  CRISPR gRNA sequence
tctcttctttcctaatgggg

SEQ ID NO: 116084 - DNA, 20 bp, Artificial
  CRISPR gRNA sequence
ttctttcctaatggggctac

SEQ ID NO: 116085 - DNA, 20 bp, Artificial
  CRISPR gRNA sequence
ctttcctaatggggctacac

SEQ ID NO: 116086 - DNA, 20 bp, Artificial
  CRISPR gRNA sequence
tttcctaatggggctacact

SEQ ID NO: 116087 - DNA, 20 bp, Artificial
  CRISPR gRNA sequence
tcctaatggggctacacttt

SEQ ID NO: 116088 - DNA, 20 bp, Artificial
  CRISPR gRNA sequence
cctaatggggctacacttta

SEQ ID NO: 116089 - DNA, 20 bp, Artificial
  CRISPR gRNA sequence
ctaatggggctacactttaa

SEQ ID NO: 116090 - DNA, 20 bp, Artificial
  CRISPR gRNA sequence
atggggctacactttaagcc

SEQ ID NO: 116091 - DNA, 20 bp, Artificial
  CRISPR gRNA sequence
cactttaagccatgtatgca

SEQ ID NO: 116092 - DNA, 20 bp, Artificial
  CRISPR gRNA sequence
taagccatgtatgcagactt

SEQ ID NO: 116093 - DNA, 20 bp, Artificial
  CRISPR gRNA sequence
aagccatgtatgcagactta

SEQ ID NO: 116094 - DNA, 20 bp, Artificial
  CRISPR gRNA sequence
agccatgtatgcagacttaa

SEQ ID NO: 116095 - DNA, 20 bp, Artificial
  CRISPR gRNA sequence
aagatgtattacaagccttt

SEQ ID NO: 116096 - DNA, 20 bp, Artificial
  CRISPR gRNA sequence
agatgtattacaagcctttg

SEQ ID NO: 116097 - DNA, 20 bp, Artificial
  CRISPR gRNA sequence
caagcctttgatttacttgg

SEQ ID NO: 116098 - DNA, 20 bp, Artificial
  CRISPR gRNA sequence
tgatttacttggtaaagtta

SEQ ID NO: 116099 - DNA, 20 bp, Artificial
  CRISPR gRNA sequence
gatttacttggtaaagttat

SEQ ID NO: 116100 - DNA, 20 bp, Artificial
  CRISPR gRNA sequence
atttacttggtaaagttatg

SEQ ID NO: 116101 - DNA, 20 bp, Artificial
  CRISPR gRNA sequence
acttggtaaagttatgtgta

SEQ ID NO: 116102 - DNA, 20 bp, Artificial
  CRISPR gRNA sequence
cttggtaaagttatgtgtat

SEQ ID NO: 116103 - DNA, 20 bp, Artificial
  CRISPR gRNA sequence
ggtaaagttatgtgtattct

SEQ ID NO: 116104 - DNA, 20 bp, Artificial
  CRISPR gRNA sequence
gtaaagttatgtgtattctc

SEQ ID NO: 116105 - DNA, 20 bp, Artificial
  CRISPR gRNA sequence
tgtgtattctcttgggggga

SEQ ID NO: 116106 - DNA, 20 bp, Artificial
  CRISPR gRNA sequence
tcttggggggataagtagtg

SEQ ID NO: 116107 - DNA, 20 bp, Artificial
  CRISPR gRNA sequence
ttggggggataagtagtgag

SEQ ID NO: 116108 - DNA, 20 bp, Artificial
  CRISPR gRNA sequence
ggggggataagtagtgagag

SEQ ID NO: 116109 - DNA, 20 bp, Artificial
  CRISPR gRNA sequence
gggggataagtagtgagagc

SEQ ID NO: 116110 - DNA, 20 bp, Artificial
  CRISPR gRNA sequence
ctgttgcttttgcaaaggac

SEQ ID NO: 116111 - DNA, 20 bp, Artificial
  CRISPR gRNA sequence
ttgcttttgcaaaggacttt

SEQ ID NO: 116112 - DNA, 20 bp, Artificial
  CRISPR gRNA sequence
cttttgcaaaggactttaat

SEQ ID NO: 116113 - DNA, 20 bp, Artificial
  CRISPR gRNA sequence
ttgcaaaggactttaatcat

SEQ ID NO: 116114 - DNA, 20 bp, Artificial
  CRISPR gRNA sequence
tgcaaaggactttaatcatc

SEQ ID NO: 116115 - DNA, 20 bp, Artificial
  CRISPR gRNA sequence
gcaaaggactttaatcatca

SEQ ID NO: 116116 - DNA, 20 bp, Artificial
  CRISPR gRNA sequence
caaaggactttaatcatcat

SEQ ID NO: 116117 - DNA, 20 bp, Artificial
  CRISPR gRNA sequence
taatcatcatgtcatctttg

SEQ ID NO: 116118 - DNA, 20 bp, Artificial
  CRISPR gRNA sequence
aatcatcatgtcatctttgt

SEQ ID NO: 116119 - DNA, 20 bp, Artificial
  CRISPR gRNA sequence
atcatcatgtcatctttgtc

SEQ ID NO: 116120 - DNA, 20 bp, Artificial
  CRISPR gRNA sequence
tgtctctaggatccaaacca

SEQ ID NO: 116121 - DNA, 20 bp, Artificial
  CRISPR gRNA sequence
gtctctaggatccaaaccaa

SEQ ID NO: 116122 - DNA, 20 bp, Artificial
  CRISPR gRNA sequence
tctctaggatccaaaccaag

SEQ ID NO: 116123 - DNA, 20 bp, Artificial
  CRISPR gRNA sequence
taggatccaaaccaagccga

SEQ ID NO: 116124 - DNA, 20 bp, Artificial
  CRISPR gRNA sequence
ggatccaaaccaagccgatg

SEQ ID NO: 116125 - DNA, 20 bp, Artificial
  CRISPR gRNA sequence
accccacgccatgtgatgga

SEQ ID NO: 116126 - DNA, 20 bp, Artificial
  CRISPR gRNA sequence
atcaaggtcatgtttctcac

SEQ ID NO: 116127 - DNA, 20 bp, Artificial
  CRISPR gRNA sequence
ctcactgttccaggaaattg

SEQ ID NO: 116128 - DNA, 20 bp, Artificial
  CRISPR gRNA sequence
tcactgttccaggaaattga

SEQ ID NO: 116129 - DNA, 20 bp, Artificial
  CRISPR gRNA sequence
actgttccaggaaattgatc

SEQ ID NO: 116130 - DNA, 20 bp, Artificial
  CRISPR gRNA sequence
ttccaggaaattgatcaact

SEQ ID NO: 116131 - DNA, 20 bp, Artificial
  CRISPR gRNA sequence
caggaaattgatcaactctt

SEQ ID NO: 116132 - DNA, 20 bp, Artificial
  CRISPR gRNA sequence
atcaactcttccaatgggac

SEQ ID NO: 116133 - DNA, 20 bp, Artificial
  CRISPR gRNA sequence
ttccaatgggacattgatga

SEQ ID NO: 116134 - DNA, 20 bp, Artificial
  CRISPR gRNA sequence
ccaatgggacattgatgatc

SEQ ID NO: 116135 - DNA, 20 bp, Artificial
  CRISPR gRNA sequence
caatgggacattgatgatca

SEQ ID NO: 116136 - DNA, 20 bp, Artificial
  CRISPR gRNA sequence
atgatcacattctgcccttt

SEQ ID NO: 116137 - DNA, 20 bp, Artificial
  CRISPR gRNA sequence
tgccctttactacaggacag

SEQ ID NO: 116138 - DNA, 20 bp, Artificial
  CRISPR gRNA sequence
ccctttactacaggacagaa

SEQ ID NO: 116139 - DNA, 20 bp, Artificial
  CRISPR gRNA sequence
tactacaggacagaaaccac

SEQ ID NO: 116140 - DNA, 20 bp, Artificial
  CRISPR gRNA sequence
actacaggacagaaaccact

SEQ ID NO: 116141 - DNA, 20 bp, Artificial
  CRISPR gRNA sequence
ctacaggacagaaaccactt

SEQ ID NO: 116142 - DNA, 20 bp, Artificial
  CRISPR gRNA sequence
caggacagaaaccacttagt

SEQ ID NO: 116143 - DNA, 20 bp, Artificial
  CRISPR gRNA sequence
agtttttaataagtggctca

SEQ ID NO: 116144 - DNA, 20 bp, Artificial
  CRISPR gRNA sequence
gtttttaataagtggctcag

SEQ ID NO: 116145 - DNA, 20 bp, Artificial
  CRISPR gRNA sequence
ttaataagtggctcagtatt

SEQ ID NO: 116146 - DNA, 20 bp, Artificial
  CRISPR gRNA sequence
taataagtggctcagtatta

SEQ ID NO: 116147 - DNA, 20 bp, Artificial
  CRISPR gRNA sequence
aataagtggctcagtattac

SEQ ID NO: 116148 - DNA, 20 bp, Artificial
  CRISPR gRNA sequence
ataagtggctcagtattaca

SEQ ID NO: 116149 - DNA, 20 bp, Artificial
  CRISPR gRNA sequence
agtattacaattgcagcgat

SEQ ID NO: 116150 - DNA, 20 bp, Artificial
  CRISPR gRNA sequence
caattgcagcgatgcctggc

SEQ ID NO: 116151 - DNA, 20 bp, Artificial
  CRISPR gRNA sequence
cagcgatgcctggcaaattg

SEQ ID NO: 116152 - DNA, 20 bp, Artificial
  CRISPR gRNA sequence
gcaaattgaagttgcaagcc

SEQ ID NO: 116153 - DNA, 20 bp, Artificial
  CRISPR gRNA sequence
aagttgcaagcctttgtctt

SEQ ID NO: 116154 - DNA, 20 bp, Artificial
  CRISPR gRNA sequence
caagcctttgtcttactctt

SEQ ID NO: 116155 - DNA, 20 bp, Artificial
  CRISPR gRNA sequence
tgtcttactctttcagtcag

SEQ ID NO: 116156 - DNA, 20 bp, Artificial
  CRISPR gRNA sequence
gtcttactctttcagtcagg

SEQ ID NO: 116157 - DNA, 20 bp, Artificial
  CRISPR gRNA sequence
tcttactctttcagtcagga

SEQ ID NO: 116158 - DNA, 20 bp, Artificial
  CRISPR gRNA sequence
actctttcagtcaggaccta

SEQ ID NO: 116159 - DNA, 20 bp, Artificial
  CRISPR gRNA sequence
ctctttcagtcaggacctat

SEQ ID NO: 116160 - DNA, 20 bp, Artificial
  CRISPR gRNA sequence
tttcagtcaggacctatttc

SEQ ID NO: 116161 - DNA, 20 bp, Artificial
  CRISPR gRNA sequence
tcagtcaggacctatttcag

SEQ ID NO: 116162 - DNA, 20 bp, Artificial
  CRISPR gRNA sequence
cagtcaggacctatttcaga

SEQ ID NO: 116163 - DNA, 20 bp, Artificial
  CRISPR gRNA sequence
agtcaggacctatttcagac

SEQ ID NO: 116164 - DNA, 20 bp, Artificial
  CRISPR gRNA sequence
tttcagactgttgatgacat

SEQ ID NO: 116165 - DNA, 20 bp, Artificial
  CRISPR gRNA sequence
cagactgttgatgacattga

SEQ ID NO: 116166 - DNA, 20 bp, Artificial
  CRISPR gRNA sequence
agactgttgatgacattgac

SEQ ID NO: 116167 - DNA, 20 bp, Artificial
  CRISPR gRNA sequence
ttgatgacattgacatttca

SEQ ID NO: 116168 - DNA, 20 bp, Artificial
  CRISPR gRNA sequence
atgacattgacatttcatgg

SEQ ID NO: 116169 - DNA, 20 bp, Artificial
  CRISPR gRNA sequence
acatttcatggattcggatg

SEQ ID NO: 116170 - DNA, 20 bp, Artificial
  CRISPR gRNA sequence
catggattcggatgatgcaa

SEQ ID NO: 116171 - DNA, 20 bp, Artificial
  CRISPR gRNA sequence
atggattcggatgatgcaag

SEQ ID NO: 116172 - DNA, 20 bp, Artificial
  CRISPR gRNA sequence
ggatgatgcaaggagacaca

SEQ ID NO: 116173 - DNA, 20 bp, Artificial
  CRISPR gRNA sequence
accttgactggtgaagtcag

SEQ ID NO: 116174 - DNA, 20 bp, Artificial
  CRISPR gRNA sequence
ccttgactggtgaagtcagc

SEQ ID NO: 116175 - DNA, 20 bp, Artificial
  CRISPR gRNA sequence
gactggtgaagtcagccagc

SEQ ID NO: 116176 - DNA, 20 bp, Artificial
  CRISPR gRNA sequence
actggtgaagtcagccagcc

SEQ ID NO: 116177 - DNA, 20 bp, Artificial
  CRISPR gRNA sequence
gtgaagtcagccagccatct

SEQ ID NO: 116178 - DNA, 20 bp, Artificial
  CRISPR gRNA sequence
agcagggaagaacaaccttc

SEQ ID NO: 116179 - DNA, 20 bp, Artificial
  CRISPR gRNA sequence
ctcaaccaaaactgcaatca

SEQ ID NO: 116180 - DNA, 20 bp, Artificial
  CRISPR gRNA sequence
tcaaccaaaactgcaatcag

SEQ ID NO: 116181 - DNA, 20 bp, Artificial
  CRISPR gRNA sequence
aaccaaaactgcaatcagga

SEQ ID NO: 116182 - DNA, 20 bp, Artificial
  CRISPR gRNA sequence
caatcaggaaagcagcagcc

SEQ ID NO: 116183 - DNA, 20 bp, Artificial
  CRISPR gRNA sequence
cttcccatggaatctagaca

SEQ ID NO: 116184 - DNA, 20 bp, Artificial
  CRISPR gRNA sequence
cccatggaatctagacagca

SEQ ID NO: 116185 - DNA, 20 bp, Artificial
  CRISPR gRNA sequence
ccatggaatctagacagcat

SEQ ID NO: 116186 - DNA, 20 bp, Artificial
  CRISPR gRNA sequence
gacagcatttatccctctgg

SEQ ID NO: 116187 - DNA, 20 bp, Artificial
  CRISPR gRNA sequence
atccctctggtgggggaatc

SEQ ID NO: 116188 - DNA, 20 bp, Artificial
  CRISPR gRNA sequence
tccctctggtgggggaatct

SEQ ID NO: 116189 - DNA, 20 bp, Artificial
  CRISPR gRNA sequence
tggtgggggaatctcacact

SEQ ID NO: 116190 - DNA, 20 bp, Artificial
  CRISPR gRNA sequence
gtgggggaatctcacactga

SEQ ID NO: 116191 - DNA, 20 bp, Artificial
  CRISPR gRNA sequence
acactgactaactgaatgga

SEQ ID NO: 116192 - DNA, 20 bp, Artificial
  CRISPR gRNA sequence
actaactgaatggacgcttt

SEQ ID NO: 116193 - DNA, 20 bp, Artificial
  CRISPR gRNA sequence
actgaatggacgctttgtat

SEQ ID NO: 116194 - DNA, 20 bp, Artificial
  CRISPR gRNA sequence
aatggacgctttgtattcag

SEQ ID NO: 116195 - DNA, 20 bp, Artificial
  CRISPR gRNA sequence
tgtattcagagatggcttcc

SEQ ID NO: 116196 - DNA, 20 bp, Artificial
  CRISPR gRNA sequence
gtattcagagatggcttcca

SEQ ID NO: 116197 - DNA, 20 bp, Artificial
  CRISPR gRNA sequence
tattcagagatggcttccag

SEQ ID NO: 116198 - DNA, 20 bp, Artificial
  CRISPR gRNA sequence
agagatggcttccaggcaag

SEQ ID NO: 116199 - DNA, 20 bp, Artificial
  CRISPR gRNA sequence
ccaggcaaggaagttctatc

SEQ ID NO: 116200 - DNA, 20 bp, Artificial
  CRISPR gRNA sequence
caggcaaggaagttctatct

SEQ ID NO: 116201 - DNA, 20 bp, Artificial
  CRISPR gRNA sequence
tatcttgtgatacggaaaca

SEQ ID NO: 116202 - DNA, 20 bp, Artificial
  CRISPR gRNA sequence
tcttgtgatacggaaacaat

SEQ ID NO: 116203 - DNA, 20 bp, Artificial
  CRISPR gRNA sequence
gtgatacggaaacaataaat

SEQ ID NO: 116204 - DNA, 20 bp, Artificial
  CRISPR gRNA sequence
tgatacggaaacaataaatt

SEQ ID NO: 116205 - DNA, 20 bp, Artificial
  CRISPR gRNA sequence
ctgagatacattcttccaat

SEQ ID NO: 116206 - DNA, 20 bp, Artificial
  CRISPR gRNA sequence
agatacattcttccaatctg

SEQ ID NO: 116207 - DNA, 20 bp, Artificial
  CRISPR gRNA sequence
ttccaatctgtggtaataat

SEQ ID NO: 116208 - DNA, 20 bp, Artificial
  CRISPR gRNA sequence
ccaatctgtggtaataataa

SEQ ID NO: 116209 - DNA, 20 bp, Artificial
  CRISPR gRNA sequence
caatctgtggtaataataag

SEQ ID NO: 116210 - DNA, 20 bp, Artificial
  CRISPR gRNA sequence
tggtaataataagaattcct

SEQ ID NO: 116211 - DNA, 20 bp, Artificial
  CRISPR gRNA sequence
ctctctgcccagatggtagg

SEQ ID NO: 116212 - DNA, 20 bp, Artificial
  CRISPR gRNA sequence
tctgcccagatggtaggttg

SEQ ID NO: 116213 - DNA, 20 bp, Artificial
  CRISPR gRNA sequence
tgcccagatggtaggttgat

SEQ ID NO: 116214 - DNA, 20 bp, Artificial
  CRISPR gRNA sequence
cccagatggtaggttgatat

SEQ ID NO: 116215 - DNA, 20 bp, Artificial
  CRISPR gRNA sequence
atatttctggactctagcca

SEQ ID NO: 116216 - DNA, 20 bp, Artificial
  CRISPR gRNA sequence
ctggactctagccaagaaaa

SEQ ID NO: 116217 - DNA, 20 bp, Artificial
  CRISPR gRNA sequence
tggactctagccaagaaaaa

SEQ ID NO: 116218 - DNA, 20 bp, Artificial
  CRISPR gRNA sequence
gactctagccaagaaaaagc

SEQ ID NO: 116219 - DNA, 20 bp, Artificial
  CRISPR gRNA sequence
tagccaagaaaaagctaatt

SEQ ID NO: 116220 - DNA, 20 bp, Artificial
  CRISPR gRNA sequence
gccaagaaaaagctaattct

SEQ ID NO: 116221 - DNA, 20 bp, Artificial
  CRISPR gRNA sequence
attctggggatagaatgata

SEQ ID NO: 116222 - DNA, 20 bp, Artificial
  CRISPR gRNA sequence
tggggatagaatgataaaag

SEQ ID NO: 116223 - DNA, 20 bp, Artificial
  CRISPR gRNA sequence
gggatagaatgataaaagac

SEQ ID NO: 116224 - DNA, 20 bp, Artificial
  CRISPR gRNA sequence
aagcactaaaaatatacatt

SEQ ID NO: 116225 - DNA, 20 bp, Artificial
  CRISPR gRNA sequence
aaaatatacattgccgaatc

SEQ ID NO: 116226 - DNA, 20 bp, Artificial
  CRISPR gRNA sequence
ccgaatctctttttctagct

SEQ ID NO: 116227 - DNA, 20 bp, Artificial
  CRISPR gRNA sequence
tttttctagctttgaaaagt

SEQ ID NO: 116228 - DNA, 20 bp, Artificial
  CRISPR gRNA sequence
tttctagctttgaaaagttg

SEQ ID NO: 116229 - DNA, 20 bp, Artificial
  CRISPR gRNA sequence
ttctagctttgaaaagttgt

SEQ ID NO: 116230 - DNA, 20 bp, Artificial
  CRISPR gRNA sequence
tctagctttgaaaagttgtg

SEQ ID NO: 116231 - DNA, 20 bp, Artificial
  CRISPR gRNA sequence
ctagctttgaaaagttgtgg

SEQ ID NO: 116232 - DNA, 20 bp, Artificial
  CRISPR gRNA sequence
tagctttgaaaagttgtggc

SEQ ID NO: 116233 - DNA, 20 bp, Artificial
  CRISPR gRNA sequence
gctttgaaaagttgtggcct

SEQ ID NO: 116234 - DNA, 20 bp, Artificial
  CRISPR gRNA sequence
tgaaaagttgtggcctgctt

SEQ ID NO: 116235 - DNA, 20 bp, Artificial
  CRISPR gRNA sequence
gaaaagttgtggcctgcttg

SEQ ID NO: 116236 - DNA, 20 bp, Artificial
  CRISPR gRNA sequence
aaaagttgtggcctgcttgt

SEQ ID NO: 116237 - DNA, 20 bp, Artificial
  CRISPR gRNA sequence
tggcctgcttgtccctctgt

SEQ ID NO: 116238 - DNA, 20 bp, Artificial
  CRISPR gRNA sequence
cttgtccctctgttgactgg

SEQ ID NO: 116239 - DNA, 20 bp, Artificial
  CRISPR gRNA sequence
gtccctctgttgactggtca

SEQ ID NO: 116240 - DNA, 20 bp, Artificial
  CRISPR gRNA sequence
tccctctgttgactggtcat

SEQ ID NO: 116241 - DNA, 20 bp, Artificial
  CRISPR gRNA sequence
tgttgactggtcatctggac

SEQ ID NO: 116242 - DNA, 20 bp, Artificial
  CRISPR gRNA sequence
ttgactggtcatctggacca

SEQ ID NO: 116243 - DNA, 20 bp, Artificial
  CRISPR gRNA sequence
actggtcatctggaccatcg

SEQ ID NO: 116244 - DNA, 20 bp, Artificial
  CRISPR gRNA sequence
gtcatctggaccatcgtact

SEQ ID NO: 116245 - DNA, 20 bp, Artificial
  CRISPR gRNA sequence
gaccatcgtacttgctgtgg

SEQ ID NO: 116246 - DNA, 20 bp, Artificial
  CRISPR gRNA sequence
gctgtggctacttctaagac

SEQ ID NO: 116247 - DNA, 20 bp, Artificial
  CRISPR gRNA sequence
ctgtggctacttctaagaca

SEQ ID NO: 116248 - DNA, 20 bp, Artificial
  CRISPR gRNA sequence
tggctacttctaagacaatg

SEQ ID NO: 116249 - DNA, 20 bp, Artificial
  CRISPR gRNA sequence
cttctaagacaatgtagagg

SEQ ID NO: 116250 - DNA, 20 bp, Artificial
  CRISPR gRNA sequence
ctaagacaatgtagagggtt

SEQ ID NO: 116251 - DNA, 20 bp, Artificial
  CRISPR gRNA sequence
taagacaatgtagagggtta

SEQ ID NO: 116252 - DNA, 20 bp, Artificial
  CRISPR gRNA sequence
agacaatgtagagggttatt

SEQ ID NO: 116253 - DNA, 20 bp, Artificial
  CRISPR gRNA sequence
ttaaaccttgaaactgcctt

SEQ ID NO: 116254 - DNA, 20 bp, Artificial
  CRISPR gRNA sequence
aaccttgaaactgcctttcc

SEQ ID NO: 116255 - DNA, 20 bp, Artificial
  CRISPR gRNA sequence
gaaactgcctttcctaagta

SEQ ID NO: 116256 - DNA, 20 bp, Artificial
  CRISPR gRNA sequence
aaactgcctttcctaagtag

SEQ ID NO: 116257 - DNA, 20 bp, Artificial
  CRISPR gRNA sequence
cctttcctaagtagagaaca

SEQ ID NO: 116258 - DNA, 20 bp, Artificial
  CRISPR gRNA sequence
tcctaagtagagaacaagac

SEQ ID NO: 116259 - DNA, 20 bp, Artificial
  CRISPR gRNA sequence
cctaagtagagaacaagact

SEQ ID NO: 116260 - DNA, 20 bp, Artificial
  CRISPR gRNA sequence
ctaagtagagaacaagacta

SEQ ID NO: 116261 - DNA, 20 bp, Artificial
  CRISPR gRNA sequence
agtagagaacaagactattc

SEQ ID NO: 116262 - DNA, 20 bp, Artificial
  CRISPR gRNA sequence
ttcaacaacttctttgctga

SEQ ID NO: 116263 - DNA, 20 bp, Artificial
  CRISPR gRNA sequence
aacaacttctttgctgaagc

SEQ ID NO: 116264 - DNA, 20 bp, Artificial
  CRISPR gRNA sequence
ctttgctgaagcactgagga

SEQ ID NO: 116265 - DNA, 20 bp, Artificial
  CRISPR gRNA sequence
tttgctgaagcactgaggag

SEQ ID NO: 116266 - DNA, 20 bp, Artificial
  CRISPR gRNA sequence
tgctgaagcactgaggagat

SEQ ID NO: 116267 - DNA, 20 bp, Artificial
  CRISPR gRNA sequence
gctgaagcactgaggagatt

SEQ ID NO: 116268 - DNA, 20 bp, Artificial
  CRISPR gRNA sequence
ctgaagcactgaggagattt

SEQ ID NO: 116269 - DNA, 20 bp, Artificial
  CRISPR gRNA sequence
aagcactgaggagatttgta

SEQ ID NO: 116270 - DNA, 20 bp, Artificial
  CRISPR gRNA sequence
aggagatttgtaatactcct

SEQ ID NO: 116271 - DNA, 20 bp, Artificial
  CRISPR gRNA sequence
gtaatactcctaaaggaagg

SEQ ID NO: 116272 - DNA, 20 bp, Artificial
  CRISPR gRNA sequence
taatactcctaaaggaaggg

SEQ ID NO: 116273 - DNA, 20 bp, Artificial
  CRISPR gRNA sequence
ctaaaggaagggccaaacta

SEQ ID NO: 116274 - DNA, 20 bp, Artificial
  CRISPR gRNA sequence
aaggaagggccaaactagag

SEQ ID NO: 116275 - DNA, 20 bp, Artificial
  CRISPR gRNA sequence
gagattttcaatcatagact

SEQ ID NO: 116276 - DNA, 20 bp, Artificial
  CRISPR gRNA sequence
tcaatcatagactttgtgac

SEQ ID NO: 116277 - DNA, 20 bp, Artificial
  CRISPR gRNA sequence
caatcatagactttgtgaca

SEQ ID NO: 116278 - DNA, 20 bp, Artificial
  CRISPR gRNA sequence
aatcatagactttgtgacag

SEQ ID NO: 116279 - DNA, 20 bp, Artificial
  CRISPR gRNA sequence
tgtgacagcatttggggaac

SEQ ID NO: 116280 - DNA, 20 bp, Artificial
  CRISPR gRNA sequence
gtgacagcatttggggaact

SEQ ID NO: 116281 - DNA, 20 bp, Artificial
  CRISPR gRNA sequence
tgacagcatttggggaacta

SEQ ID NO: 116282 - DNA, 20 bp, Artificial
  CRISPR gRNA sequence
ggggaactaaaagattcatg

SEQ ID NO: 116283 - DNA, 20 bp, Artificial
  CRISPR gRNA sequence
gggaactaaaagattcatgt

SEQ ID NO: 116284 - DNA, 20 bp, Artificial
  CRISPR gRNA sequence
aaagattcatgtgtttcagc

SEQ ID NO: 116285 - DNA, 20 bp, Artificial
  CRISPR gRNA sequence
atgtgtttcagcctagtggg

SEQ ID NO: 116286 - DNA, 20 bp, Artificial
  CRISPR gRNA sequence
cagcctagtgggagagagtg

SEQ ID NO: 116287 - DNA, 20 bp, Artificial
  CRISPR gRNA sequence
agcctagtgggagagagtgg

SEQ ID NO: 116288 - DNA, 20 bp, Artificial
  CRISPR gRNA sequence
gtgggagagagtgggggaga

SEQ ID NO: 116289 - DNA, 20 bp, Artificial
  CRISPR gRNA sequence
tcatagagcacgattctcca

SEQ ID NO: 116290 - DNA, 20 bp, Artificial
  CRISPR gRNA sequence
tccagtggatggatacctgg

SEQ ID NO: 116291 - DNA, 20 bp, Artificial
  CRISPR gRNA sequence
cagtggatggatacctggaa

SEQ ID NO: 116292 - DNA, 20 bp, Artificial
  CRISPR gRNA sequence
gaatggatcattaagatgaa

SEQ ID NO: 116293 - DNA, 20 bp, Artificial
  CRISPR gRNA sequence
agatgaagagagtaattcac

SEQ ID NO: 116294 - DNA, 20 bp, Artificial
  CRISPR gRNA sequence
acatttactctagaaccttt

SEQ ID NO: 116295 - DNA, 20 bp, Artificial
  CRISPR gRNA sequence
actctagaacctttaacaag

SEQ ID NO: 116296 - DNA, 20 bp, Artificial
  CRISPR gRNA sequence
ctctagaacctttaacaagc

SEQ ID NO: 116297 - DNA, 20 bp, Artificial
  CRISPR gRNA sequence
tagaacctttaacaagcact

SEQ ID NO: 116298 - DNA, 20 bp, Artificial
  CRISPR gRNA sequence
gaacctttaacaagcactga

SEQ ID NO: 116299 - DNA, 20 bp, Artificial
  CRISPR gRNA sequence
taacaagcactgaaaggaag

SEQ ID NO: 116300 - DNA, 20 bp, Artificial
  CRISPR gRNA sequence
aacaagcactgaaaggaaga

SEQ ID NO: 116301 - DNA, 20 bp, Artificial
  CRISPR gRNA sequence
acaagcactgaaaggaagaa

SEQ ID NO: 116302 - DNA, 20 bp, Artificial
  CRISPR gRNA sequence
aaaggaagaagcctgagatt

SEQ ID NO: 116303 - DNA, 20 bp, Artificial
  CRISPR gRNA sequence
agatttgatccttgacaatt

SEQ ID NO: 116304 - DNA, 20 bp, Artificial
  CRISPR gRNA sequence
gatccttgacaatttctgga

SEQ ID NO: 116305 - DNA, 20 bp, Artificial
  CRISPR gRNA sequence
atccttgacaatttctggaa

SEQ ID NO: 116306 - DNA, 20 bp, Artificial
  CRISPR gRNA sequence
gacaatttctggaaagcact

SEQ ID NO: 116307 - DNA, 20 bp, Artificial
  CRISPR gRNA sequence
acaatttctggaaagcactg

SEQ ID NO: 116308 - DNA, 20 bp, Artificial
  CRISPR gRNA sequence
ctggaaagcactggtcagtc

SEQ ID NO: 116309 - DNA, 20 bp, Artificial
  CRISPR gRNA sequence
tggaaagcactggtcagtca

SEQ ID NO: 116310 - DNA, 20 bp, Artificial
  CRISPR gRNA sequence
gaaagcactggtcagtcaca

SEQ ID NO: 116311 - DNA, 20 bp, Artificial
  CRISPR gRNA sequence
gtcagtcacactgtcctgga

SEQ ID NO: 116312 - DNA, 20 bp, Artificial
  CRISPR gRNA sequence
tcctggacagagtccaagtt

SEQ ID NO: 116313 - DNA, 20 bp, Artificial
  CRISPR gRNA sequence
gacagagtccaagttaccca

SEQ ID NO: 116314 - DNA, 20 bp, Artificial
  CRISPR gRNA sequence
cccactaaagcttgaggtgg

SEQ ID NO: 116315 - DNA, 20 bp, Artificial
  CRISPR gRNA sequence
aagcttgaggtggatgttgg

SEQ ID NO: 116316 - DNA, 20 bp, Artificial
  CRISPR gRNA sequence
gaggtggatgttggcttcac

SEQ ID NO: 116317 - DNA, 20 bp, Artificial
  CRISPR gRNA sequence
aggtggatgttggcttcact

SEQ ID NO: 116318 - DNA, 20 bp, Artificial
  CRISPR gRNA sequence
gcttcactcctgcagcacaa

SEQ ID NO: 116319 - DNA, 20 bp, Artificial
  CRISPR gRNA sequence
cactcctgcagcacaatgct

SEQ ID NO: 116320 - DNA, 20 bp, Artificial
  CRISPR gRNA sequence
actcctgcagcacaatgctg

SEQ ID NO: 116321 - DNA, 20 bp, Artificial
  CRISPR gRNA sequence
ctgcagcacaatgctggccc

SEQ ID NO: 116322 - DNA, 20 bp, Artificial
  CRISPR gRNA sequence
cagcacaatgctggccctag

SEQ ID NO: 116323 - DNA, 20 bp, Artificial
  CRISPR gRNA sequence
gccctagaaagcgagcattt

SEQ ID NO: 116324 - DNA, 20 bp, Artificial
  CRISPR gRNA sequence
gaaagcgagcattttcattc

SEQ ID NO: 116325 - DNA, 20 bp, Artificial
  CRISPR gRNA sequence
tcattcttcccatggcagct

SEQ ID NO: 116326 - DNA, 20 bp, Artificial
  CRISPR gRNA sequence
cattcttcccatggcagctg

SEQ ID NO: 116327 - DNA, 20 bp, Artificial
  CRISPR gRNA sequence
attcttcccatggcagctga

SEQ ID NO: 116328 - DNA, 20 bp, Artificial
  CRISPR gRNA sequence
ttcccatggcagctgattct

SEQ ID NO: 116329 - DNA, 20 bp, Artificial
  CRISPR gRNA sequence
cccatggcagctgattcttt

SEQ ID NO: 116330 - DNA, 20 bp, Artificial
  CRISPR gRNA sequence
ccatggcagctgattctttg

SEQ ID NO: 116331 - DNA, 20 bp, Artificial
  CRISPR gRNA sequence
attctttggtgccagttttc

SEQ ID NO: 116332 - DNA, 20 bp, Artificial
  CRISPR gRNA sequence
tttggtgccagttttcatgt

SEQ ID NO: 116333 - DNA, 20 bp, Artificial
  CRISPR gRNA sequence
tggtgccagttttcatgttt

SEQ ID NO: 116334 - DNA, 20 bp, Artificial
  CRISPR gRNA sequence
ggtgccagttttcatgtttt

SEQ ID NO: 116335 - DNA, 20 bp, Artificial
  CRISPR gRNA sequence
gtgccagttttcatgttttc

SEQ ID NO: 116336 - DNA, 20 bp, Artificial
  CRISPR gRNA sequence
tcatgttttctccataggcc

SEQ ID NO: 116337 - DNA, 20 bp, Artificial
  CRISPR gRNA sequence
catgttttctccataggcct

SEQ ID NO: 116338 - DNA, 20 bp, Artificial
  CRISPR gRNA sequence
atgttttctccataggcctt

SEQ ID NO: 116339 - DNA, 20 bp, Artificial
  CRISPR gRNA sequence
tctccataggccttgtgcag

SEQ ID NO: 116340 - DNA, 20 bp, Artificial
  CRISPR gRNA sequence
ctccataggccttgtgcaga

SEQ ID NO: 116341 - DNA, 20 bp, Artificial
  CRISPR gRNA sequence
tccataggccttgtgcagaa

SEQ ID NO: 116342 - DNA, 20 bp, Artificial
  CRISPR gRNA sequence
cataggccttgtgcagaaag

SEQ ID NO: 116343 - DNA, 20 bp, Artificial
  CRISPR gRNA sequence
gtgcagaaaggttttctcat

SEQ ID NO: 116344 - DNA, 20 bp, Artificial
  CRISPR gRNA sequence
tgcagaaaggttttctcatt

SEQ ID NO: 116345 - DNA, 20 bp, Artificial
  CRISPR gRNA sequence
tctcattgcatccatactgt

SEQ ID NO: 116346 - DNA, 20 bp, Artificial
  CRISPR gRNA sequence
ctcattgcatccatactgtg

SEQ ID NO: 116347 - DNA, 20 bp, Artificial
  CRISPR gRNA sequence
tcattgcatccatactgtga

SEQ ID NO: 116348 - DNA, 20 bp, Artificial
  CRISPR gRNA sequence
attgcatccatactgtgaga

SEQ ID NO: 116349 - DNA, 20 bp, Artificial
  CRISPR gRNA sequence
catccatactgtgagaataa

SEQ ID NO: 116350 - DNA, 20 bp, Artificial
  CRISPR gRNA sequence
tgagaataaactgcagactg

SEQ ID NO: 116351 - DNA, 20 bp, Artificial
  CRISPR gRNA sequence
cagactgaaagaaacatgcc

SEQ ID NO: 116352 - DNA, 20 bp, Artificial
  CRISPR gRNA sequence
aaagaaacatgcctgcaggg

SEQ ID NO: 116353 - DNA, 20 bp, Artificial
  CRISPR gRNA sequence
cagggtcaggaactgggcca

SEQ ID NO: 116354 - DNA, 20 bp, Artificial
  CRISPR gRNA sequence
ggccactgttcccagaacgg

SEQ ID NO: 116355 - DNA, 20 bp, Artificial
  CRISPR gRNA sequence
ttcccagaacgggttgtgcc

SEQ ID NO: 116356 - DNA, 20 bp, Artificial
  CRISPR gRNA sequence
ccagaacgggttgtgcctca

SEQ ID NO: 116357 - DNA, 20 bp, Artificial
  CRISPR gRNA sequence
tgcctcagaaatctatttct

SEQ ID NO: 116358 - DNA, 20 bp, Artificial
  CRISPR gRNA sequence
agaaatctatttctctttta

SEQ ID NO: 116359 - DNA, 20 bp, Artificial
  CRISPR gRNA sequence
tttctcttttagatgttgaa

SEQ ID NO: 116360 - DNA, 20 bp, Artificial
  CRISPR gRNA sequence
ctcttttagatgttgaaccc

SEQ ID NO: 116361 - DNA, 20 bp, Artificial
  CRISPR gRNA sequence
tcttttagatgttgaaccct

SEQ ID NO: 116362 - DNA, 20 bp, Artificial
  CRISPR gRNA sequence
ttttagatgttgaaccctga

SEQ ID NO: 116363 - DNA, 20 bp, Artificial
  CRISPR gRNA sequence
ttagatgttgaaccctgaga

SEQ ID NO: 116364 - DNA, 20 bp, Artificial
  CRISPR gRNA sequence
tagatgttgaaccctgagag

SEQ ID NO: 116365 - DNA, 20 bp, Artificial
  CRISPR gRNA sequence
agatgttgaaccctgagaga

SEQ ID NO: 116366 - DNA, 20 bp, Artificial
  CRISPR gRNA sequence
gatgttgaaccctgagagaa

SEQ ID NO: 116367 - DNA, 20 bp, Artificial
  CRISPR gRNA sequence
aaccctgagagaactaagat

SEQ ID NO: 116368 - DNA, 20 bp, Artificial
  CRISPR gRNA sequence
agagaactaagatgatattt

SEQ ID NO: 116369 - DNA, 20 bp, Artificial
  CRISPR gRNA sequence
agatgatatttcagaagagt

SEQ ID NO: 116370 - DNA, 20 bp, Artificial
  CRISPR gRNA sequence
cagaagagttggctgccttc

SEQ ID NO: 116371 - DNA, 20 bp, Artificial
  CRISPR gRNA sequence
agaagagttggctgccttct

SEQ ID NO: 116372 - DNA, 20 bp, Artificial
  CRISPR gRNA sequence
gctgccttctctggaaacaa

SEQ ID NO: 116373 - DNA, 20 bp, Artificial
  CRISPR gRNA sequence
ccttctctggaaacaaggaa

SEQ ID NO: 116374 - DNA, 20 bp, Artificial
  CRISPR gRNA sequence
ctctggaaacaaggaaaacc

SEQ ID NO: 116375 - DNA, 20 bp, Artificial
  CRISPR gRNA sequence
tctggaaacaaggaaaaccc

SEQ ID NO: 116376 - DNA, 20 bp, Artificial
  CRISPR gRNA sequence
tggaaacaaggaaaacccaa

SEQ ID NO: 116377 - DNA, 20 bp, Artificial
  CRISPR gRNA sequence
gaaacaaggaaaacccaata

SEQ ID NO: 116378 - DNA, 20 bp, Artificial
  CRISPR gRNA sequence
cgaggaacattgggggttaa

SEQ ID NO: 116379 - DNA, 20 bp, Artificial
  CRISPR gRNA sequence
ggggttaaataccaagaata

SEQ ID NO: 116380 - DNA, 20 bp, Artificial
  CRISPR gRNA sequence
aataccaagaataaaaattg

SEQ ID NO: 116381 - DNA, 20 bp, Artificial
  CRISPR gRNA sequence
gttcttctttgacttcagct

SEQ ID NO: 116382 - DNA, 20 bp, Artificial
  CRISPR gRNA sequence
ttctttgacttcagcttaac

SEQ ID NO: 116383 - DNA, 20 bp, Artificial
  CRISPR gRNA sequence
ctttgacttcagcttaactg

SEQ ID NO: 116384 - DNA, 20 bp, Artificial
  CRISPR gRNA sequence
tttgacttcagcttaactgt

SEQ ID NO: 116385 - DNA, 20 bp, Artificial
  CRISPR gRNA sequence
tgacttcagcttaactgtat

SEQ ID NO: 116386 - DNA, 20 bp, Artificial
  CRISPR gRNA sequence
gacttcagcttaactgtatt

SEQ ID NO: 116387 - DNA, 20 bp, Artificial
  CRISPR gRNA sequence
acttcagcttaactgtatta

SEQ ID NO: 116388 - DNA, 20 bp, Artificial
  CRISPR gRNA sequence
cagcttaactgtattaagac

SEQ ID NO: 116389 - DNA, 20 bp, Artificial
  CRISPR gRNA sequence
agcttaactgtattaagaca

SEQ ID NO: 116390 - DNA, 20 bp, Artificial
  CRISPR gRNA sequence
aactgtattaagacagaaat

SEQ ID NO: 116391 - DNA, 20 bp, Artificial
  CRISPR gRNA sequence
actgtattaagacagaaatt

SEQ ID NO: 116392 - DNA, 20 bp, Artificial
  CRISPR gRNA sequence
tattaagacagaaattaagc

SEQ ID NO: 116393 - DNA, 20 bp, Artificial
  CRISPR gRNA sequence
agacagaaattaagccctct

SEQ ID NO: 116394 - DNA, 20 bp, Artificial
  CRISPR gRNA sequence
agccctctaaaaacaccaca

SEQ ID NO: 116395 - DNA, 20 bp, Artificial
  CRISPR gRNA sequence
taaaaacaccacaaagagag

SEQ ID NO: 116396 - DNA, 20 bp, Artificial
  CRISPR gRNA sequence
aaaacaccacaaagagagat

SEQ ID NO: 116397 - DNA, 20 bp, Artificial
  CRISPR gRNA sequence
taatgatagaaatagaggta

SEQ ID NO: 116398 - DNA, 20 bp, Artificial
  CRISPR gRNA sequence
tgcaaaggaaacaggaagtg

SEQ ID NO: 116399 - DNA, 20 bp, Artificial
  CRISPR gRNA sequence
ctagtcccagggatctggta

SEQ ID NO: 116400 - DNA, 20 bp, Artificial
  CRISPR gRNA sequence
gtcccagggatctggtaatc

SEQ ID NO: 116401 - DNA, 20 bp, Artificial
  CRISPR gRNA sequence
gtaatcgctcctggcttcca

SEQ ID NO: 116402 - DNA, 20 bp, Artificial
  CRISPR gRNA sequence
ctggcttccagatgtcaaag

SEQ ID NO: 116403 - DNA, 20 bp, Artificial
  CRISPR gRNA sequence
gcttccagatgtcaaaggac

SEQ ID NO: 116404 - DNA, 20 bp, Artificial
  CRISPR gRNA sequence
ccagatgtcaaaggactgat

SEQ ID NO: 116405 - DNA, 20 bp, Artificial
  CRISPR gRNA sequence
cagatgtcaaaggactgatc

SEQ ID NO: 116406 - DNA, 20 bp, Artificial
  CRISPR gRNA sequence
atcctttggtaagctcacta

SEQ ID NO: 116407 - DNA, 20 bp, Artificial
  CRISPR gRNA sequence
tggtaagctcactagaaact

SEQ ID NO: 116408 - DNA, 20 bp, Artificial
  CRISPR gRNA sequence
ggtaagctcactagaaactt

SEQ ID NO: 116409 - DNA, 20 bp, Artificial
  CRISPR gRNA sequence
gtaagctcactagaaacttc

SEQ ID NO: 116410 - DNA, 20 bp, Artificial
  CRISPR gRNA sequence
actagaaacttctagctcta

SEQ ID NO: 116411 - DNA, 20 bp, Artificial
  CRISPR gRNA sequence
gaaacttctagctctacaag

SEQ ID NO: 116412 - DNA, 20 bp, Artificial
  CRISPR gRNA sequence
ctagctctacaagagtttgg

SEQ ID NO: 116413 - DNA, 20 bp, Artificial
  CRISPR gRNA sequence
tagctctacaagagtttggg

SEQ ID NO: 116414 - DNA, 20 bp, Artificial
  CRISPR gRNA sequence
gctctacaagagtttgggat

SEQ ID NO: 116415 - DNA, 20 bp, Artificial
  CRISPR gRNA sequence
tacaagagtttgggatatta

SEQ ID NO: 116416 - DNA, 20 bp, Artificial
  CRISPR gRNA sequence
caagagtttgggatattaat

SEQ ID NO: 116417 - DNA, 20 bp, Artificial
  CRISPR gRNA sequence
gggatattaatgttattcag

SEQ ID NO: 116418 - DNA, 20 bp, Artificial
  CRISPR gRNA sequence
ggatattaatgttattcagt

SEQ ID NO: 116419 - DNA, 20 bp, Artificial
  CRISPR gRNA sequence
atgttattcagtaagtccca

SEQ ID NO: 116420 - DNA, 20 bp, Artificial
  CRISPR gRNA sequence
ttcagtaagtcccaagtttt

SEQ ID NO: 116421 - DNA, 20 bp, Artificial
  CRISPR gRNA sequence
agtaagtcccaagtttttca

SEQ ID NO: 116422 - DNA, 20 bp, Artificial
  CRISPR gRNA sequence
ttcagagaatagattactaa

SEQ ID NO: 116423 - DNA, 20 bp, Artificial
  CRISPR gRNA sequence
tcagagaatagattactaac

SEQ ID NO: 116424 - DNA, 20 bp, Artificial
  CRISPR gRNA sequence
cagagaatagattactaaca

SEQ ID NO: 116425 - DNA, 20 bp, Artificial
  CRISPR gRNA sequence
agagaatagattactaacaa

SEQ ID NO: 116426 - DNA, 20 bp, Artificial
  CRISPR gRNA sequence
ctaacaatgaggaatttata

SEQ ID NO: 116427 - DNA, 20 bp, Artificial
  CRISPR gRNA sequence
acaatgaggaatttatattc

SEQ ID NO: 116428 - DNA, 20 bp, Artificial
  CRISPR gRNA sequence
atattccttggttaatttag

SEQ ID NO: 116429 - DNA, 20 bp, Artificial
  CRISPR gRNA sequence
tattccttggttaatttagg

SEQ ID NO: 116430 - DNA, 20 bp, Artificial
  CRISPR gRNA sequence
cttggttaatttaggagtct

SEQ ID NO: 116431 - DNA, 20 bp, Artificial
  CRISPR gRNA sequence
ggttaatttaggagtctaag

SEQ ID NO: 116432 - DNA, 20 bp, Artificial
  CRISPR gRNA sequence
gttaatttaggagtctaaga

SEQ ID NO: 116433 - DNA, 20 bp, Artificial
  CRISPR gRNA sequence
atttaggagtctaagatgca

SEQ ID NO: 116434 - DNA, 20 bp, Artificial
  CRISPR gRNA sequence
aggagtctaagatgcagagt

SEQ ID NO: 116435 - DNA, 20 bp, Artificial
  CRISPR gRNA sequence
ggagtctaagatgcagagtt

SEQ ID NO: 116436 - DNA, 20 bp, Artificial
  CRISPR gRNA sequence
agatgcagagttcagaaaga

SEQ ID NO: 116437 - DNA, 20 bp, Artificial
  CRISPR gRNA sequence
agaaagaaattactcagacc

SEQ ID NO: 116438 - DNA, 20 bp, Artificial
  CRISPR gRNA sequence
ctcagacctaactttgagtg

SEQ ID NO: 116439 - DNA, 20 bp, Artificial
  CRISPR gRNA sequence
agacctaactttgagtgctt

SEQ ID NO: 116440 - DNA, 20 bp, Artificial
  CRISPR gRNA sequence
actttgagtgcttaagctgc

SEQ ID NO: 116441 - DNA, 20 bp, Artificial
  CRISPR gRNA sequence
tgagtgcttaagctgccaac

SEQ ID NO: 116442 - DNA, 20 bp, Artificial
  CRISPR gRNA sequence
gagtgcttaagctgccaaca

SEQ ID NO: 116443 - DNA, 20 bp, Artificial
  CRISPR gRNA sequence
agtgcttaagctgccaacag

SEQ ID NO: 116444 - DNA, 20 bp, Artificial
  CRISPR gRNA sequence
aagctgccaacagttagaag

SEQ ID NO: 116445 - DNA, 20 bp, Artificial
  CRISPR gRNA sequence
agctgccaacagttagaaga

SEQ ID NO: 116446 - DNA, 20 bp, Artificial
  CRISPR gRNA sequence
ccaacagttagaagatgcta

SEQ ID NO: 116447 - DNA, 20 bp, Artificial
  CRISPR gRNA sequence
gaagatgctatttatttgtg

SEQ ID NO: 116448 - DNA, 20 bp, Artificial
  CRISPR gRNA sequence
tttatttgtgtctgtaagtt

SEQ ID NO: 116449 - DNA, 20 bp, Artificial
  CRISPR gRNA sequence
atttgtgtctgtaagtttgt

SEQ ID NO: 116450 - DNA, 20 bp, Artificial
  CRISPR gRNA sequence
tttgtgtctgtaagtttgta

SEQ ID NO: 116451 - DNA, 20 bp, Artificial
  CRISPR gRNA sequence
gtgtctgtaagtttgtacat

SEQ ID NO: 116452 - DNA, 20 bp, Artificial
  CRISPR gRNA sequence
tgtctgtaagtttgtacata

SEQ ID NO: 116453 - DNA, 20 bp, Artificial
  CRISPR gRNA sequence
taagtttgtacatagtaatg

SEQ ID NO: 116454 - DNA, 20 bp, Artificial
  CRISPR gRNA sequence
gtacatagtaatgccagcct

SEQ ID NO: 116455 - DNA, 20 bp, Artificial
  CRISPR gRNA sequence
tacatagtaatgccagcctt

SEQ ID NO: 116456 - DNA, 20 bp, Artificial
  CRISPR gRNA sequence
gttgctgaattttttatttg

SEQ ID NO: 116457 - DNA, 20 bp, Artificial
  CRISPR gRNA sequence
ttgctgaattttttatttgg

SEQ ID NO: 116458 - DNA, 20 bp, Artificial
  CRISPR gRNA sequence
ctgaattttttatttggggg

SEQ ID NO: 116459 - DNA, 20 bp, Artificial
  CRISPR gRNA sequence
aattttttatttggggggag

SEQ ID NO: 116460 - DNA, 20 bp, Artificial
  CRISPR gRNA sequence
tttatttggggggagatgac

SEQ ID NO: 116461 - DNA, 20 bp, Artificial
  CRISPR gRNA sequence
ttatttggggggagatgact

SEQ ID NO: 116462 - DNA, 20 bp, Artificial
  CRISPR gRNA sequence
tatttggggggagatgactt

SEQ ID NO: 116463 - DNA, 20 bp, Artificial
  CRISPR gRNA sequence
atttggggggagatgacttt

SEQ ID NO: 116464 - DNA, 20 bp, Artificial
  CRISPR gRNA sequence
tttggggggagatgactttg

SEQ ID NO: 116465 - DNA, 20 bp, Artificial
  CRISPR gRNA sequence
ggggggagatgactttgaat

SEQ ID NO: 116466 - DNA, 20 bp, Artificial
  CRISPR gRNA sequence
gggggagatgactttgaatt

SEQ ID NO: 116467 - DNA, 20 bp, Artificial
  CRISPR gRNA sequence
tgaattttgtttgaaatgct

SEQ ID NO: 116468 - DNA, 20 bp, Artificial
  CRISPR gRNA sequence
gaattttgtttgaaatgctt

SEQ ID NO: 116469 - DNA, 20 bp, Artificial
  CRISPR gRNA sequence
aattttgtttgaaatgcttc

SEQ ID NO: 116470 - DNA, 20 bp, Artificial
  CRISPR gRNA sequence
tgtttgaaatgcttcagttg

SEQ ID NO: 116471 - DNA, 20 bp, Artificial
  CRISPR gRNA sequence
gtttgaaatgcttcagttgt

SEQ ID NO: 116472 - DNA, 20 bp, Artificial
  CRISPR gRNA sequence
tttgaaatgcttcagttgtc

SEQ ID NO: 116473 - DNA, 20 bp, Artificial
  CRISPR gRNA sequence
gaaatgcttcagttgtcatt

SEQ ID NO: 116474 - DNA, 20 bp, Artificial
  CRISPR gRNA sequence
aaatgcttcagttgtcattt

SEQ ID NO: 116475 - DNA, 20 bp, Artificial
  CRISPR gRNA sequence
cagttgtcattttgtcattg

SEQ ID NO: 116476 - DNA, 20 bp, Artificial
  CRISPR gRNA sequence
agttgtcattttgtcattgc

SEQ ID NO: 116477 - DNA, 20 bp, Artificial
  CRISPR gRNA sequence
tcattttgtcattgcatttc

SEQ ID NO: 116478 - DNA, 20 bp, Artificial
  CRISPR gRNA sequence
tgtcattgcatttcaaatag

SEQ ID NO: 116479 - DNA, 20 bp, Artificial
  CRISPR gRNA sequence
gtcattgcatttcaaatagc

SEQ ID NO: 116480 - DNA, 20 bp, Artificial
  CRISPR gRNA sequence
tcattgcatttcaaatagct

SEQ ID NO: 116481 - DNA, 20 bp, Artificial
  CRISPR gRNA sequence
catttcaaatagctcatgac

SEQ ID NO: 116482 - DNA, 20 bp, Artificial
  CRISPR gRNA sequence
caaatagctcatgacccttt

SEQ ID NO: 116483 - DNA, 20 bp, Artificial
  CRISPR gRNA sequence
aaatagctcatgaccctttt

SEQ ID NO: 116484 - DNA, 20 bp, Artificial
  CRISPR gRNA sequence
atgacccttttcttgtggtc

SEQ ID NO: 116485 - DNA, 20 bp, Artificial
  CRISPR gRNA sequence
ttcttgtggtcactttggca

SEQ ID NO: 116486 - DNA, 20 bp, Artificial
  CRISPR gRNA sequence
tcttgtggtcactttggcac

SEQ ID NO: 116487 - DNA, 20 bp, Artificial
  CRISPR gRNA sequence
cttgtggtcactttggcaca

SEQ ID NO: 116488 - DNA, 20 bp, Artificial
  CRISPR gRNA sequence
ttgtggtcactttggcacac

SEQ ID NO: 116489 - DNA, 20 bp, Artificial
  CRISPR gRNA sequence
gtggtcactttggcacacca

SEQ ID NO: 116490 - DNA, 20 bp, Artificial
  CRISPR gRNA sequence
tggtcactttggcacaccat

SEQ ID NO: 116491 - DNA, 20 bp, Artificial
  CRISPR gRNA sequence
tggcacaccatagtagccca

SEQ ID NO: 116492 - DNA, 20 bp, Artificial
  CRISPR gRNA sequence
ggcacaccatagtagcccac

SEQ ID NO: 116493 - DNA, 20 bp, Artificial
  CRISPR gRNA sequence
gcacaccatagtagcccaca

SEQ ID NO: 116494 - DNA, 20 bp, Artificial
  CRISPR gRNA sequence
acatttggattttttctttg

SEQ ID NO: 116495 - DNA, 20 bp, Artificial
  CRISPR gRNA sequence
ggattttttctttgatacta

SEQ ID NO: 116496 - DNA, 20 bp, Artificial
  CRISPR gRNA sequence
gattttttctttgatactag

SEQ ID NO: 116497 - DNA, 20 bp, Artificial
  CRISPR gRNA sequence
tttctttgatactagttctt

SEQ ID NO: 116498 - DNA, 20 bp, Artificial
  CRISPR gRNA sequence
ttctttgatactagttcttt

SEQ ID NO: 116499 - DNA, 20 bp, Artificial
  CRISPR gRNA sequence
tctttgatactagttctttt

SEQ ID NO: 116500 - DNA, 20 bp, Artificial
  CRISPR gRNA sequence
ctttgatactagttctttta

SEQ ID NO: 116501 - DNA, 20 bp, Artificial
  CRISPR gRNA sequence
tttgatactagttcttttat

SEQ ID NO: 116502 - DNA, 20 bp, Artificial
  CRISPR gRNA sequence
tgatactagttcttttattc

SEQ ID NO: 116503 - DNA, 20 bp, Artificial
  CRISPR gRNA sequence
gatactagttcttttattca

SEQ ID NO: 116504 - DNA, 20 bp, Artificial
  CRISPR gRNA sequence
atactagttcttttattcat

SEQ ID NO: 116505 - DNA, 20 bp, Artificial
  CRISPR gRNA sequence
gttcttttattcatttttat

SEQ ID NO: 116506 - DNA, 20 bp, Artificial
  CRISPR gRNA sequence
ttttattcatttttatttgt

SEQ ID NO: 116507 - DNA, 20 bp, Artificial
  CRISPR gRNA sequence
ttattcatttttatttgtga

SEQ ID NO: 116508 - DNA, 20 bp, Artificial
  CRISPR gRNA sequence
tattcatttttatttgtgac

SEQ ID NO: 116509 - DNA, 20 bp, Artificial
  CRISPR gRNA sequence
attcatttttatttgtgact

SEQ ID NO: 116510 - DNA, 20 bp, Artificial
  CRISPR gRNA sequence
ttcatttttatttgtgactg

SEQ ID NO: 116511 - DNA, 20 bp, Artificial
  CRISPR gRNA sequence
atttttatttgtgactgtag

SEQ ID NO: 116512 - DNA, 20 bp, Artificial
  CRISPR gRNA sequence
ttatttgtgactgtagtgat

SEQ ID NO: 116513 - DNA, 20 bp, Artificial
  CRISPR gRNA sequence
tatttgtgactgtagtgata

SEQ ID NO: 116514 - DNA, 20 bp, Artificial
  CRISPR gRNA sequence
atttgtgactgtagtgataa

SEQ ID NO: 116515 - DNA, 20 bp, Artificial
  CRISPR gRNA sequence
tttgtgactgtagtgataac

SEQ ID NO: 116516 - DNA, 20 bp, Artificial
  CRISPR gRNA sequence
gtgactgtagtgataacttt

SEQ ID NO: 116517 - DNA, 20 bp, Artificial
  CRISPR gRNA sequence
tgactgtagtgataacttta

SEQ ID NO: 116518 - DNA, 20 bp, Artificial
  CRISPR gRNA sequence
tagtgataactttacagatg

SEQ ID NO: 116519 - DNA, 20 bp, Artificial
  CRISPR gRNA sequence
tacagatggagaaagagtga

SEQ ID NO: 116520 - DNA, 20 bp, Artificial
  CRISPR gRNA sequence
acagatggagaaagagtgaa

SEQ ID NO: 116521 - DNA, 20 bp, Artificial
  CRISPR gRNA sequence
cagatggagaaagagtgaat

SEQ ID NO: 116522 - DNA, 20 bp, Artificial
  CRISPR gRNA sequence
gtttaatgcctagttatgca

SEQ ID NO: 116523 - DNA, 20 bp, Artificial
  CRISPR gRNA sequence
aatgcctagttatgcaactt

SEQ ID NO: 116524 - DNA, 20 bp, Artificial
  CRISPR gRNA sequence
atgcctagttatgcaacttg

SEQ ID NO: 116525 - DNA, 20 bp, Artificial
  CRISPR gRNA sequence
gttatgcaacttgagtgctt

SEQ ID NO: 116526 - DNA, 20 bp, Artificial
  CRISPR gRNA sequence
tgcaacttgagtgctttttt

SEQ ID NO: 116527 - DNA, 20 bp, Artificial
  CRISPR gRNA sequence
gagtgctttttttttttttt

SEQ ID NO: 116528 - DNA, 20 bp, Artificial
  CRISPR gRNA sequence
agtgcttttttttttttttg

SEQ ID NO: 116529 - DNA, 20 bp, Artificial
  CRISPR gRNA sequence
ttttttttttttgcaggata

SEQ ID NO: 116530 - DNA, 20 bp, Artificial
  CRISPR gRNA sequence
tttttttttttgcaggataa

SEQ ID NO: 116531 - DNA, 20 bp, Artificial
  CRISPR gRNA sequence
ttttttttttgcaggataat

SEQ ID NO: 116532 - DNA, 20 bp, Artificial
  CRISPR gRNA sequence
tttttttttgcaggataatt

SEQ ID NO: 116533 - DNA, 20 bp, Artificial
  CRISPR gRNA sequence
ttttttttgcaggataattt

SEQ ID NO: 116534 - DNA, 20 bp, Artificial
  CRISPR gRNA sequence
tttttttgcaggataatttt

SEQ ID NO: 116535 - DNA, 20 bp, Artificial
  CRISPR gRNA sequence
ttttttgcaggataatttta

SEQ ID NO: 116536 - DNA, 20 bp, Artificial
  CRISPR gRNA sequence
tttttgcaggataattttaa

SEQ ID NO: 116537 - DNA, 20 bp, Artificial
  CRISPR gRNA sequence
ttttgcaggataattttaag

SEQ ID NO: 116538 - DNA, 20 bp, Artificial
  CRISPR gRNA sequence
tttgcaggataattttaagt

SEQ ID NO: 116539 - DNA, 20 bp, Artificial
  CRISPR gRNA sequence
ttgcaggataattttaagtg

SEQ ID NO: 116540 - DNA, 20 bp, Artificial
  CRISPR gRNA sequence
tgcaggataattttaagtgt

SEQ ID NO: 116541 - DNA, 20 bp, Artificial
  CRISPR gRNA sequence
gcaggataattttaagtgta

SEQ ID NO: 116542 - DNA, 20 bp, Artificial
  CRISPR gRNA sequence
caggataattttaagtgtat

SEQ ID NO: 116543 - DNA, 20 bp, Artificial
  CRISPR gRNA sequence
taagtgtatatattttaact

SEQ ID NO: 116544 - DNA, 20 bp, Artificial
  CRISPR gRNA sequence
aagtgtatatattttaactg

SEQ ID NO: 116545 - DNA, 20 bp, Artificial
  CRISPR gRNA sequence
agtgtatatattttaactgc

SEQ ID NO: 116546 - DNA, 20 bp, Artificial
  CRISPR gRNA sequence
taactgcactggtacattga

SEQ ID NO: 116547 - DNA, 20 bp, Artificial
  CRISPR gRNA sequence
aactgcactggtacattgaa

SEQ ID NO: 116548 - DNA, 20 bp, Artificial
  CRISPR gRNA sequence
actgcactggtacattgaac

SEQ ID NO: 116549 - DNA, 20 bp, Artificial
  CRISPR gRNA sequence
cactggtacattgaacatgt

SEQ ID NO: 116550 - DNA, 20 bp, Artificial
  CRISPR gRNA sequence
gtacattgaacatgtcagtg

SEQ ID NO: 116551 - DNA, 20 bp, Artificial
  CRISPR gRNA sequence
aacatgtcagtgtcgatgcc

SEQ ID NO: 116552 - DNA, 20 bp, Artificial
  CRISPR gRNA sequence
gaccaacagagcattttgtg

SEQ ID NO: 116553 - DNA, 20 bp, Artificial
  CRISPR gRNA sequence
tgtggctatagggtgcctga

SEQ ID NO: 116554 - DNA, 20 bp, Artificial
  CRISPR gRNA sequence
gtggctatagggtgcctgat

SEQ ID NO: 116555 - DNA, 20 bp, Artificial
  CRISPR gRNA sequence
tggctatagggtgcctgata

SEQ ID NO: 116556 - DNA, 20 bp, Artificial
  CRISPR gRNA sequence
tagggtgcctgataataatg

SEQ ID NO: 116557 - DNA, 20 bp, Artificial
  CRISPR gRNA sequence
ataataatgtcttgattttt

SEQ ID NO: 116558 - DNA, 20 bp, Artificial
  CRISPR gRNA sequence
gatttttctttgggattcaa

SEQ ID NO: 116559 - DNA, 20 bp, Artificial
  CRISPR gRNA sequence
atttttctttgggattcaac

SEQ ID NO: 116560 - DNA, 20 bp, Artificial
  CRISPR gRNA sequence
ttctttgggattcaactata

SEQ ID NO: 116561 - DNA, 20 bp, Artificial
  CRISPR gRNA sequence
tctttgggattcaactatat

SEQ ID NO: 116562 - DNA, 20 bp, Artificial
  CRISPR gRNA sequence
ctttgggattcaactatatc

SEQ ID NO: 116563 - DNA, 20 bp, Artificial
  CRISPR gRNA sequence
tttgggattcaactatatcg

SEQ ID NO: 116564 - DNA, 20 bp, Artificial
  CRISPR gRNA sequence
tgggattcaactatatcgaa

SEQ ID NO: 116565 - DNA, 20 bp, Artificial
  CRISPR gRNA sequence
gggattcaactatatcgaag

SEQ ID NO: 116566 - DNA, 20 bp, Artificial
  CRISPR gRNA sequence
ggattcaactatatcgaagg

SEQ ID NO: 116567 - DNA, 20 bp, Artificial
  CRISPR gRNA sequence
aactatatcgaaggtttttc

SEQ ID NO: 116568 - DNA, 20 bp, Artificial
  CRISPR gRNA sequence
tatcgaaggtttttccccca

SEQ ID NO: 116569 - DNA, 20 bp, Artificial
  CRISPR gRNA sequence
ttcccccagcagtatggggg

SEQ ID NO: 116570 - DNA, 20 bp, Artificial
  CRISPR gRNA sequence
tcccccagcagtatgggggc

SEQ ID NO: 116571 - DNA, 20 bp, Artificial
  CRISPR gRNA sequence
cccccagcagtatgggggcg

SEQ ID NO: 116572 - DNA, 20 bp, Artificial
  CRISPR gRNA sequence
ccccagcagtatgggggcgt

SEQ ID NO: 116573 - DNA, 20 bp, Artificial
  CRISPR gRNA sequence
atgtcattgcaattgttatt

SEQ ID NO: 116574 - DNA, 20 bp, Artificial
  CRISPR gRNA sequence
caattgttattttttaaaat

SEQ ID NO: 116575 - DNA, 20 bp, Artificial
  CRISPR gRNA sequence
ttattttttaaaataaattt

SEQ ID NO: 116576 - DNA, 20 bp, Artificial
  CRISPR gRNA sequence
ttttttaaaataaatttata

SEQ ID NO: 116577 - DNA, 20 bp, Artificial
  CRISPR gRNA sequence
tttaaaataaatttataaaa

SEQ ID NO: 116578 - DNA, 20 bp, Artificial
  CRISPR gRNA sequence
ttaaaataaatttataaaaa

SEQ ID NO: 116579 - DNA, 20 bp, Artificial
  CRISPR gRNA sequence
taaaataaatttataaaaat

SEQ ID NO: 116580 - DNA, 20 bp, Artificial
  CRISPR gRNA sequence
aaaataaatttataaaaata

SEQ ID NO: 116581 - DNA, 20 bp, Artificial
  CRISPR gRNA sequence
aaataaatttataaaaataa

SEQ ID NO: 116582 - DNA, 20 bp, Artificial
  CRISPR gRNA sequence
ataaaaataaccgaaaagta

SEQ ID NO: 116583 - DNA, 20 bp, Artificial
  CRISPR gRNA sequence
taaaaataaccgaaaagtaa

SEQ ID NO: 116584 - DNA, 20 bp, Artificial
  CRISPR gRNA sequence
ttgaggaatctgcaactcct

SEQ ID NO: 116585 - DNA, 20 bp, Artificial
  CRISPR gRNA sequence
tgaggaatctgcaactcctg

SEQ ID NO: 116586 - DNA, 20 bp, Artificial
  CRISPR gRNA sequence
gaggaatctgcaactcctgg

SEQ ID NO: 116587 - DNA, 20 bp, Artificial
  CRISPR gRNA sequence
aggaatctgcaactcctggg

SEQ ID NO: 116588 - DNA, 20 bp, Artificial
  CRISPR gRNA sequence
caactcctgggttctagttt

SEQ ID NO: 116589 - DNA, 20 bp, Artificial
  CRISPR gRNA sequence
ctgggttctagtttgtgttt

SEQ ID NO: 116590 - DNA, 20 bp, Artificial
  CRISPR gRNA sequence
ggttctagtttgtgtttcca

SEQ ID NO: 116591 - DNA, 20 bp, Artificial
  CRISPR gRNA sequence
tagtttgtgtttccagtgtt

SEQ ID NO: 116592 - DNA, 20 bp, Artificial
  CRISPR gRNA sequence
gtttgtgtttccagtgttga

SEQ ID NO: 116593 - DNA, 20 bp, Artificial
  CRISPR gRNA sequence
gtgtttccagtgttgaaatt

SEQ ID NO: 116594 - DNA, 20 bp, Artificial
  CRISPR gRNA sequence
tgtttccagtgttgaaattt

SEQ ID NO: 116595 - DNA, 20 bp, Artificial
  CRISPR gRNA sequence
ccagtgttgaaattttgatc

SEQ ID NO: 116596 - DNA, 20 bp, Artificial
  CRISPR gRNA sequence
cagtgttgaaattttgatct

SEQ ID NO: 116597 - DNA, 20 bp, Artificial
  CRISPR gRNA sequence
aaattttgatctcccccgac

SEQ ID NO: 116598 - DNA, 20 bp, Artificial
  CRISPR gRNA sequence
tgatctcccccgacaagact

SEQ ID NO: 116599 - DNA, 20 bp, Artificial
  CRISPR gRNA sequence
gatctcccccgacaagactt

SEQ ID NO: 116600 - DNA, 20 bp, Artificial
  CRISPR gRNA sequence
atctcccccgacaagacttg

SEQ ID NO: 116601 - DNA, 20 bp, Artificial
  CRISPR gRNA sequence
ccccgacaagacttgtctgc

SEQ ID NO: 116602 - DNA, 20 bp, Artificial
  CRISPR gRNA sequence
gtctgcatggacggtgtctc

SEQ ID NO: 116603 - DNA, 20 bp, Artificial
  CRISPR gRNA sequence
tctgcatggacggtgtctct

SEQ ID NO: 116604 - DNA, 20 bp, Artificial
  CRISPR gRNA sequence
catggacggtgtctctgtaa

SEQ ID NO: 116605 - DNA, 20 bp, Artificial
  CRISPR gRNA sequence
tgtaaacagtatcaaacttg

SEQ ID NO: 116606 - DNA, 20 bp, Artificial
  CRISPR gRNA sequence
taaacagtatcaaacttgta

SEQ ID NO: 116607 - DNA, 20 bp, Artificial
  CRISPR gRNA sequence
gtaatgtctgagcctcttag

SEQ ID NO: 116608 - DNA, 20 bp, Artificial
  CRISPR gRNA sequence
taatgtctgagcctcttagc

SEQ ID NO: 116609 - DNA, 20 bp, Artificial
  CRISPR gRNA sequence
agcctcttagctttatctcc

SEQ ID NO: 116610 - DNA, 20 bp, Artificial
  CRISPR gRNA sequence
ttagctttatctccccttaa

SEQ ID NO: 116611 - DNA, 20 bp, Artificial
  CRISPR gRNA sequence
agctttatctccccttaatt

SEQ ID NO: 116612 - DNA, 20 bp, Artificial
  CRISPR gRNA sequence
gctttatctccccttaattt

SEQ ID NO: 116613 - DNA, 20 bp, Artificial
  CRISPR gRNA sequence
tatctccccttaatttcttc

SEQ ID NO: 116614 - DNA, 20 bp, Artificial
  CRISPR gRNA sequence
atctccccttaatttcttcc

SEQ ID NO: 116615 - DNA, 20 bp, Artificial
  CRISPR gRNA sequence
tctccccttaatttcttccc

SEQ ID NO: 116616 - DNA, 20 bp, Artificial
  CRISPR gRNA sequence
cccttaatttcttccctttt

SEQ ID NO: 116617 - DNA, 20 bp, Artificial
  CRISPR gRNA sequence
aatttcttcccttttggccc

SEQ ID NO: 116618 - DNA, 20 bp, Artificial
  CRISPR gRNA sequence
atttcttcccttttggccct

SEQ ID NO: 116619 - DNA, 20 bp, Artificial
  CRISPR gRNA sequence
cttcccttttggcccttcca

SEQ ID NO: 116620 - DNA, 20 bp, Artificial
  CRISPR gRNA sequence
ttcccttttggcccttccac

SEQ ID NO: 116621 - DNA, 20 bp, Artificial
  CRISPR gRNA sequence
cccttttggcccttccaccc

SEQ ID NO: 116622 - DNA, 20 bp, Artificial
  CRISPR gRNA sequence
ccttttggcccttccaccct

SEQ ID NO: 116623 - DNA, 20 bp, Artificial
  CRISPR gRNA sequence
ttggcccttccaccctgttg

SEQ ID NO: 116624 - DNA, 20 bp, Artificial
  CRISPR gRNA sequence
tggcccttccaccctgttga

SEQ ID NO: 116625 - DNA, 20 bp, Artificial
  CRISPR gRNA sequence
ggcccttccaccctgttgag

SEQ ID NO: 116626 - DNA, 20 bp, Artificial
  CRISPR gRNA sequence
gcccttccaccctgttgagg

SEQ ID NO: 116627 - DNA, 20 bp, Artificial
  CRISPR gRNA sequence
ccaccctgttgaggagattt

SEQ ID NO: 116628 - DNA, 20 bp, Artificial
  CRISPR gRNA sequence
caccctgttgaggagatttt

SEQ ID NO: 116629 - DNA, 20 bp, Artificial
  CRISPR gRNA sequence
ttgaggagattttttctgtc

SEQ ID NO: 116630 - DNA, 20 bp, Artificial
  CRISPR gRNA sequence
aggagattttttctgtcacc

SEQ ID NO: 116631 - DNA, 20 bp, Artificial
  CRISPR gRNA sequence
tttctgtcacctgcaggctg

SEQ ID NO: 116632 - DNA, 20 bp, Artificial
  CRISPR gRNA sequence
ttctgtcacctgcaggctga

SEQ ID NO: 116633 - DNA, 20 bp, Artificial
  CRISPR gRNA sequence
tctgtcacctgcaggctgat

SEQ ID NO: 116634 - DNA, 20 bp, Artificial
  CRISPR gRNA sequence
ctgtcacctgcaggctgatc

SEQ ID NO: 116635 - DNA, 20 bp, Artificial
  CRISPR gRNA sequence
tgtcacctgcaggctgatca

SEQ ID NO: 116636 - DNA, 20 bp, Artificial
  CRISPR gRNA sequence
tcacctgcaggctgatcata

SEQ ID NO: 116637 - DNA, 20 bp, Artificial
  CRISPR gRNA sequence
caggctgatcatacatttga

SEQ ID NO: 116638 - DNA, 20 bp, Artificial
  CRISPR gRNA sequence
atcatacatttgatgctact

SEQ ID NO: 116639 - DNA, 20 bp, Artificial
  CRISPR gRNA sequence
gatgctactactgaaagtgt

SEQ ID NO: 116640 - DNA, 20 bp, Artificial
  CRISPR gRNA sequence
atgctactactgaaagtgtt

SEQ ID NO: 116641 - DNA, 20 bp, Artificial
  CRISPR gRNA sequence
ctactgaaagtgtttatcaa

SEQ ID NO: 116642 - DNA, 20 bp, Artificial
  CRISPR gRNA sequence
ctgaaagtgtttatcaaaat

SEQ ID NO: 116643 - DNA, 20 bp, Artificial
  CRISPR gRNA sequence
aaagtgtttatcaaaatgtg

SEQ ID NO: 116644 - DNA, 20 bp, Artificial
  CRISPR gRNA sequence
atcaaaatgtgatgaagtaa

SEQ ID NO: 116645 - DNA, 20 bp, Artificial
  CRISPR gRNA sequence
tcaaaatgtgatgaagtaat

SEQ ID NO: 116646 - DNA, 20 bp, Artificial
  CRISPR gRNA sequence
catgaggaaaattagccgtt

SEQ ID NO: 116647 - DNA, 20 bp, Artificial
  CRISPR gRNA sequence
gccgttatcacaaaaacagc

SEQ ID NO: 116648 - DNA, 20 bp, Artificial
  CRISPR gRNA sequence
tcacaaaaacagccttaagt

SEQ ID NO: 116649 - DNA, 20 bp, Artificial
  CRISPR gRNA sequence
aagtattgtagaatttcagg

SEQ ID NO: 116650 - DNA, 20 bp, Artificial
  CRISPR gRNA sequence
agtattgtagaatttcaggt

SEQ ID NO: 116651 - DNA, 20 bp, Artificial
  CRISPR gRNA sequence
tagaatttcaggtagtgaag

SEQ ID NO: 116652 - DNA, 20 bp, Artificial
  CRISPR gRNA sequence
caggtagtgaagatgtacta

SEQ ID NO: 116653 - DNA, 20 bp, Artificial
  CRISPR gRNA sequence
aggtagtgaagatgtactat

SEQ ID NO: 116654 - DNA, 20 bp, Artificial
  CRISPR gRNA sequence
tttacgttttgttagatttt

SEQ ID NO: 116655 - DNA, 20 bp, Artificial
  CRISPR gRNA sequence
acgttttgttagattttgtt

SEQ ID NO: 116656 - DNA, 20 bp, Artificial
  CRISPR gRNA sequence
cgttttgttagattttgttt

SEQ ID NO: 116657 - DNA, 20 bp, Artificial
  CRISPR gRNA sequence
tgttagattttgttttggca

SEQ ID NO: 116658 - DNA, 20 bp, Artificial
  CRISPR gRNA sequence
gttagattttgttttggcag

SEQ ID NO: 116659 - DNA, 20 bp, Artificial
  CRISPR gRNA sequence
ttagattttgttttggcaga

SEQ ID NO: 116660 - DNA, 20 bp, Artificial
  CRISPR gRNA sequence
gattttgttttggcagaaga

SEQ ID NO: 116661 - DNA, 20 bp, Artificial
  CRISPR gRNA sequence
tgttttggcagaagaccaaa

SEQ ID NO: 116662 - DNA, 20 bp, Artificial
  CRISPR gRNA sequence
gttttggcagaagaccaaaa

SEQ ID NO: 116663 - DNA, 20 bp, Artificial
  CRISPR gRNA sequence
ttttggcagaagaccaaaac

SEQ ID NO: 116664 - DNA, 20 bp, Artificial
  CRISPR gRNA sequence
tggcagaagaccaaaacaaa

SEQ ID NO: 116665 - DNA, 20 bp, Artificial
  CRISPR gRNA sequence
ggcagaagaccaaaacaaaa

SEQ ID NO: 116666 - DNA, 20 bp, Artificial
  CRISPR gRNA sequence
gcagaagaccaaaacaaaag

SEQ ID NO: 116667 - DNA, 20 bp, Artificial
  CRISPR gRNA sequence
ttctgattgttaaaaatcca

SEQ ID NO: 116668 - DNA, 20 bp, Artificial
  CRISPR gRNA sequence
tctgattgttaaaaatccac

SEQ ID NO: 116669 - DNA, 20 bp, Artificial
  CRISPR gRNA sequence
ctgattgttaaaaatccaca

SEQ ID NO: 116670 - DNA, 20 bp, Artificial
  CRISPR gRNA sequence
tgattgttaaaaatccacag

SEQ ID NO: 116671 - DNA, 20 bp, Artificial
  CRISPR gRNA sequence
attgttaaaaatccacagca

SEQ ID NO: 116672 - DNA, 20 bp, Artificial
  CRISPR gRNA sequence
ttaaaaatccacagcatgct

SEQ ID NO: 116673 - DNA, 20 bp, Artificial
  CRISPR gRNA sequence
aaaatccacagcatgctcac

SEQ ID NO: 116674 - DNA, 20 bp, Artificial
  CRISPR gRNA sequence
accttgttactgttttacct

SEQ ID NO: 116675 - DNA, 20 bp, Artificial
  CRISPR gRNA sequence
gttactgttttaccttacgg

SEQ ID NO: 116676 - DNA, 20 bp, Artificial
  CRISPR gRNA sequence
ttactgttttaccttacggt

SEQ ID NO: 116677 - DNA, 20 bp, Artificial
  CRISPR gRNA sequence
ctgttttaccttacggtcgc

SEQ ID NO: 116678 - DNA, 20 bp, Artificial
  CRISPR gRNA sequence
ttttaccttacggtcgctgg

SEQ ID NO: 116679 - DNA, 20 bp, Artificial
  CRISPR gRNA sequence
taccttacggtcgctgggaa

SEQ ID NO: 116680 - DNA, 20 bp, Artificial
  CRISPR gRNA sequence
accttacggtcgctgggaat

SEQ ID NO: 116681 - DNA, 20 bp, Artificial
  CRISPR gRNA sequence
ccttacggtcgctgggaatc

SEQ ID NO: 116682 - DNA, 20 bp, Artificial
  CRISPR gRNA sequence
acggtcgctgggaatctaag

SEQ ID NO: 116683 - DNA, 20 bp, Artificial
  CRISPR gRNA sequence
cggtcgctgggaatctaagc

SEQ ID NO: 116684 - DNA, 20 bp, Artificial
  CRISPR gRNA sequence
ggaatctaagcaacaaagac

SEQ ID NO: 116685 - DNA, 20 bp, Artificial
  CRISPR gRNA sequence
agcaacaaagactagaagcc

SEQ ID NO: 116686 - DNA, 20 bp, Artificial
  CRISPR gRNA sequence
gaagcctccgatatgccatt

SEQ ID NO: 116687 - DNA, 20 bp, Artificial
  CRISPR gRNA sequence
cgatatgccattatcaacac

SEQ ID NO: 116688 - DNA, 20 bp, Artificial
  CRISPR gRNA sequence
tcaacacacaagagacaaac

SEQ ID NO: 116689 - DNA, 20 bp, Artificial
  CRISPR gRNA sequence
aatgatgagagcagtagacc

SEQ ID NO: 116690 - DNA, 20 bp, Artificial
  CRISPR gRNA sequence
ccctggcagatgagagagga

SEQ ID NO: 116691 - DNA, 20 bp, Artificial
  CRISPR gRNA sequence
gcagatgagagaggagaaac

SEQ ID NO: 116692 - DNA, 20 bp, Artificial
  CRISPR gRNA sequence
tccacaatgaaggaaaagca

SEQ ID NO: 116693 - DNA, 20 bp, Artificial
  CRISPR gRNA sequence
cacaatgaaggaaaagcact

SEQ ID NO: 116694 - DNA, 20 bp, Artificial
  CRISPR gRNA sequence
acagtatttgatagctttag

SEQ ID NO: 116695 - DNA, 20 bp, Artificial
  CRISPR gRNA sequence
gatagctttagtcaaactgt

SEQ ID NO: 116696 - DNA, 20 bp, Artificial
  CRISPR gRNA sequence
atagctttagtcaaactgtg

SEQ ID NO: 116697 - DNA, 20 bp, Artificial
  CRISPR gRNA sequence
tagtcaaactgtgcttgagt

SEQ ID NO: 116698 - DNA, 20 bp, Artificial
  CRISPR gRNA sequence
agtcaaactgtgcttgagtt

SEQ ID NO: 116699 - DNA, 20 bp, Artificial
  CRISPR gRNA sequence
gtcaaactgtgcttgagttt

SEQ ID NO: 116700 - DNA, 20 bp, Artificial
  CRISPR gRNA sequence
tgcttgagtttggcttagat

SEQ ID NO: 116701 - DNA, 20 bp, Artificial
  CRISPR gRNA sequence
gagtttggcttagatttatg

SEQ ID NO: 116702 - DNA, 20 bp, Artificial
  CRISPR gRNA sequence
agtttggcttagatttatgc

SEQ ID NO: 116703 - DNA, 20 bp, Artificial
  CRISPR gRNA sequence
ggcttagatttatgccagtg

SEQ ID NO: 116704 - DNA, 20 bp, Artificial
  CRISPR gRNA sequence
gcttagatttatgccagtgg

SEQ ID NO: 116705 - DNA, 20 bp, Artificial
  CRISPR gRNA sequence
agatttatgccagtggaacc

SEQ ID NO: 116706 - DNA, 20 bp, Artificial
  CRISPR gRNA sequence
gatttatgccagtggaacct

SEQ ID NO: 116707 - DNA, 20 bp, Artificial
  CRISPR gRNA sequence
atgccagtggaacctgtcct

SEQ ID NO: 116708 - DNA, 20 bp, Artificial
  CRISPR gRNA sequence
tgccagtggaacctgtcctt

SEQ ID NO: 116709 - DNA, 20 bp, Artificial
  CRISPR gRNA sequence
tccttaccaaattcagagat

SEQ ID NO: 116710 - DNA, 20 bp, Artificial
  CRISPR gRNA sequence
accaaattcagagatgaccc

SEQ ID NO: 116711 - DNA, 20 bp, Artificial
  CRISPR gRNA sequence
ccaaattcagagatgaccca

SEQ ID NO: 116712 - DNA, 20 bp, Artificial
  CRISPR gRNA sequence
agagatgacccaagattcta

SEQ ID NO: 116713 - DNA, 20 bp, Artificial
  CRISPR gRNA sequence
tactctgtggtatgagggaa

SEQ ID NO: 116714 - DNA, 20 bp, Artificial
  CRISPR gRNA sequence
ctctgtggtatgagggaaag

SEQ ID NO: 116715 - DNA, 20 bp, Artificial
  CRISPR gRNA sequence
tgtggtatgagggaaagacc

SEQ ID NO: 116716 - DNA, 20 bp, Artificial
  CRISPR gRNA sequence
tggtatgagggaaagacctc

SEQ ID NO: 116717 - DNA, 20 bp, Artificial
  CRISPR gRNA sequence
tcgatatttatctcacacca

SEQ ID NO: 116718 - DNA, 20 bp, Artificial
  CRISPR gRNA sequence
gatatttatctcacaccaac

SEQ ID NO: 116719 - DNA, 20 bp, Artificial
  CRISPR gRNA sequence
atctcacaccaacggcttta

SEQ ID NO: 116720 - DNA, 20 bp, Artificial
  CRISPR gRNA sequence
tctcacaccaacggctttat

SEQ ID NO: 116721 - DNA, 20 bp, Artificial
  CRISPR gRNA sequence
acaccaacggctttatcgta

SEQ ID NO: 116722 - DNA, 20 bp, Artificial
  CRISPR gRNA sequence
tatcgtaggagcgtcttcgc

SEQ ID NO: 116723 - DNA, 20 bp, Artificial
  CRISPR gRNA sequence
atcgtaggagcgtcttcgcc

SEQ ID NO: 116724 - DNA, 20 bp, Artificial
  CRISPR gRNA sequence
tcgtaggagcgtcttcgcct

SEQ ID NO: 116725 - DNA, 20 bp, Artificial
  CRISPR gRNA sequence
cgcctcccccgtttccagta

SEQ ID NO: 116726 - DNA, 20 bp, Artificial
  CRISPR gRNA sequence
gcctcccccgtttccagtag

SEQ ID NO: 116727 - DNA, 20 bp, Artificial
  CRISPR gRNA sequence
ccccgtttccagtagaaaag

SEQ ID NO: 116728 - DNA, 20 bp, Artificial
  CRISPR gRNA sequence
ccagtagaaaagacagcttt

SEQ ID NO: 116729 - DNA, 20 bp, Artificial
  CRISPR gRNA sequence
cagtagaaaagacagctttg

SEQ ID NO: 116730 - DNA, 20 bp, Artificial
  CRISPR gRNA sequence
tgctcctttgaaagcgcaga

SEQ ID NO: 116731 - DNA, 20 bp, Artificial
  CRISPR gRNA sequence
gctcctttgaaagcgcagac

SEQ ID NO: 116732 - DNA, 20 bp, Artificial
  CRISPR gRNA sequence
ctcctttgaaagcgcagacc

SEQ ID NO: 116733 - DNA, 20 bp, Artificial
  CRISPR gRNA sequence
ctttgaaagcgcagaccgcc

SEQ ID NO: 116734 - DNA, 20 bp, Artificial
  CRISPR gRNA sequence
tgaaagcgcagaccgccgca

SEQ ID NO: 116735 - DNA, 20 bp, Artificial
  CRISPR gRNA sequence
gaaagcgcagaccgccgcac

SEQ ID NO: 116736 - DNA, 20 bp, Artificial
  CRISPR gRNA sequence
aaagcgcagaccgccgcacc

SEQ ID NO: 116737 - DNA, 20 bp, Artificial
  CRISPR gRNA sequence
cagccccttctccccgggga

SEQ ID NO: 116738 - DNA, 20 bp, Artificial
  CRISPR gRNA sequence
ctccccggggaagtaggccc

SEQ ID NO: 116739 - DNA, 20 bp, Artificial
  CRISPR gRNA sequence
tccccggggaagtaggcccc

SEQ ID NO: 116740 - DNA, 20 bp, Artificial
  CRISPR gRNA sequence
cccggggaagtaggccccgc

SEQ ID NO: 116741 - DNA, 20 bp, Artificial
  CRISPR gRNA sequence
agaatgtgggaaggtggtgg

SEQ ID NO: 116742 - DNA, 20 bp, Artificial
  CRISPR gRNA sequence
aagtcgcttccgattggcgt

SEQ ID NO: 116743 - DNA, 20 bp, Artificial
  CRISPR gRNA sequence
ccgattggcgttgtcccaag

SEQ ID NO: 116744 - DNA, 20 bp, Artificial
  CRISPR gRNA sequence
cgattggcgttgtcccaagg

SEQ ID NO: 116745 - DNA, 20 bp, Artificial
  CRISPR gRNA sequence
gcgttgtcccaaggaagcct

SEQ ID NO: 116746 - DNA, 20 bp, Artificial
  CRISPR gRNA sequence
tcccaaggaagcctgcgcgg

SEQ ID NO: 116747 - DNA, 20 bp, Artificial
  CRISPR gRNA sequence
cgcggattgatcggcggcag

SEQ ID NO: 116748 - DNA, 20 bp, Artificial
  CRISPR gRNA sequence
atcggcggcaggcctccaat

SEQ ID NO: 116749 - DNA, 20 bp, Artificial
  CRISPR gRNA sequence
caatagagcctgctaggcgg

SEQ ID NO: 116750 - DNA, 20 bp, Artificial
  CRISPR gRNA sequence
ctaggcggattggctgctac

SEQ ID NO: 116751 - DNA, 20 bp, Artificial
  CRISPR gRNA sequence
ggcggattggctgctacgcg

SEQ ID NO: 116752 - DNA, 20 bp, Artificial
  CRISPR gRNA sequence
gctgctacgcggctgggccc

SEQ ID NO: 116753 - DNA, 20 bp, Artificial
  CRISPR gRNA sequence
ctacgcggctgggccctgtt

SEQ ID NO: 116754 - DNA, 20 bp, Artificial
  CRISPR gRNA sequence
cgcggctgggccctgtttcc

SEQ ID NO: 116755 - DNA, 20 bp, Artificial
  CRISPR gRNA sequence
ggccctgtttccggtaccta

SEQ ID NO: 116756 - DNA, 20 bp, Artificial
  CRISPR gRNA sequence
tttccggtacctaggcgggc

SEQ ID NO: 116757 - DNA, 20 bp, Artificial
  CRISPR gRNA sequence
ccggtacctaggcgggcagc

SEQ ID NO: 116758 - DNA, 20 bp, Artificial
  CRISPR gRNA sequence
cggtacctaggcgggcagcc

SEQ ID NO: 116759 - DNA, 20 bp, Artificial
  CRISPR gRNA sequence
ggcgggcagccatggtgacc

SEQ ID NO: 116760 - DNA, 20 bp, Artificial
  CRISPR gRNA sequence
tgtggcctgtggaggcccgc

SEQ ID NO: 116761 - DNA, 20 bp, Artificial
  CRISPR gRNA sequence
tggcctgtggaggcccgctt

SEQ ID NO: 116762 - DNA, 20 bp, Artificial
  CRISPR gRNA sequence
tggaggcccgcttggcggcg

SEQ ID NO: 116763 - DNA, 20 bp, Artificial
  CRISPR gRNA sequence
ggcggcgctgcttcccgacc

SEQ ID NO: 116764 - DNA, 20 bp, Artificial
  CRISPR gRNA sequence
gcggcgctgcttcccgacct

SEQ ID NO: 116765 - DNA, 20 bp, Artificial
  CRISPR gRNA sequence
cttcccgacctactggtctt

SEQ ID NO: 116766 - DNA, 20 bp, Artificial
  CRISPR gRNA sequence
cccgacctactggtctttcg

SEQ ID NO: 116767 - DNA, 20 bp, Artificial
  CRISPR gRNA sequence
ccgacctactggtctttcgg

SEQ ID NO: 116768 - DNA, 20 bp, Artificial
  CRISPR gRNA sequence
ctggtctttcggaagcctcg

SEQ ID NO: 116769 - DNA, 20 bp, Artificial
  CRISPR gRNA sequence
gtctttcggaagcctcgggg

SEQ ID NO: 116770 - DNA, 20 bp, Artificial
  CRISPR gRNA sequence
tcggaagcctcggggatggg

SEQ ID NO: 116771 - DNA, 20 bp, Artificial
  CRISPR gRNA sequence
cggaagcctcggggatggga

SEQ ID NO: 116772 - DNA, 20 bp, Artificial
  CRISPR gRNA sequence
ggaagcctcggggatgggaa

SEQ ID NO: 116773 - DNA, 20 bp, Artificial
  CRISPR gRNA sequence
ggggatgggaacccgagctc

SEQ ID NO: 116774 - DNA, 20 bp, Artificial
  CRISPR gRNA sequence
gccacggcccagggcgtcct

SEQ ID NO: 116775 - DNA, 20 bp, Artificial
  CRISPR gRNA sequence
ctaggcgtccatgtgacggg

SEQ ID NO: 116776 - DNA, 20 bp, Artificial
  CRISPR gRNA sequence
ggcgtccatgtgacgggtga

SEQ ID NO: 116777 - DNA, 20 bp, Artificial
  CRISPR gRNA sequence
gcacttaagtctcctggcct

SEQ ID NO: 116778 - DNA, 20 bp, Artificial
  CRISPR gRNA sequence
cacttaagtctcctggcctg

SEQ ID NO: 116779 - DNA, 20 bp, Artificial
  CRISPR gRNA sequence
aagtctcctggcctgcggga

SEQ ID NO: 116780 - DNA, 20 bp, Artificial
  CRISPR gRNA sequence
agtctcctggcctgcgggag

SEQ ID NO: 116781 - DNA, 20 bp, Artificial
  CRISPR gRNA sequence
ctggcctgcgggagaggcgg

SEQ ID NO: 116782 - DNA, 20 bp, Artificial
  CRISPR gRNA sequence
gcctgcgggagaggcggccg

SEQ ID NO: 116783 - DNA, 20 bp, Artificial
  CRISPR gRNA sequence
cgggagaggcggccgttggg

SEQ ID NO: 116784 - DNA, 20 bp, Artificial
  CRISPR gRNA sequence
ggtctaagcccctggaggcc

SEQ ID NO: 116785 - DNA, 20 bp, Artificial
  CRISPR gRNA sequence
agcccctggaggcctcgacg

SEQ ID NO: 116786 - DNA, 20 bp, Artificial
  CRISPR gRNA sequence
gaggcctcgacggttacagg

SEQ ID NO: 116787 - DNA, 20 bp, Artificial
  CRISPR gRNA sequence
gacggttacaggcctagcct

SEQ ID NO: 116788 - DNA, 20 bp, Artificial
  CRISPR gRNA sequence
caggcctagcctcccgcgag

SEQ ID NO: 116789 - DNA, 20 bp, Artificial
  CRISPR gRNA sequence
gcctcccgcgagctaaggca

SEQ ID NO: 116790 - DNA, 20 bp, Artificial
  CRISPR gRNA sequence
ccgcgagctaaggcacagtt

SEQ ID NO: 116791 - DNA, 20 bp, Artificial
  CRISPR gRNA sequence
aggcacagtttaacttcgtg

SEQ ID NO: 116792 - DNA, 20 bp, Artificial
  CRISPR gRNA sequence
aacttcgtgctgcggcttcc

SEQ ID NO: 116793 - DNA, 20 bp, Artificial
  CRISPR gRNA sequence
acttcgtgctgcggcttcct

SEQ ID NO: 116794 - DNA, 20 bp, Artificial
  CRISPR gRNA sequence
cgtgctgcggcttccttagg

SEQ ID NO: 116795 - DNA, 20 bp, Artificial
  CRISPR gRNA sequence
gtgctgcggcttccttagga

SEQ ID NO: 116796 - DNA, 20 bp, Artificial
  CRISPR gRNA sequence
cggcttccttaggaaacttt

SEQ ID NO: 116797 - DNA, 20 bp, Artificial
  CRISPR gRNA sequence
ccttaggaaactttgagtat

SEQ ID NO: 116798 - DNA, 20 bp, Artificial
  CRISPR gRNA sequence
cttaggaaactttgagtatc

SEQ ID NO: 116799 - DNA, 20 bp, Artificial
  CRISPR gRNA sequence
aggaaactttgagtatcttc

SEQ ID NO: 116800 - DNA, 20 bp, Artificial
  CRISPR gRNA sequence
ggaaactttgagtatcttcg

SEQ ID NO: 116801 - DNA, 20 bp, Artificial
  CRISPR gRNA sequence
tgagtatcttcgttttagcg

SEQ ID NO: 116802 - DNA, 20 bp, Artificial
  CRISPR gRNA sequence
gagtatcttcgttttagcgt

SEQ ID NO: 116803 - DNA, 20 bp, Artificial
  CRISPR gRNA sequence
agtatcttcgttttagcgtg

SEQ ID NO: 116804 - DNA, 20 bp, Artificial
  CRISPR gRNA sequence
cgttttagcgtgggaggaca

SEQ ID NO: 116805 - DNA, 20 bp, Artificial
  CRISPR gRNA sequence
gttttagcgtgggaggacat

SEQ ID NO: 116806 - DNA, 20 bp, Artificial
  CRISPR gRNA sequence
tagcgtgggaggacatcttt

SEQ ID NO: 116807 - DNA, 20 bp, Artificial
  CRISPR gRNA sequence
agcgtgggaggacatctttt

SEQ ID NO: 116808 - DNA, 20 bp, Artificial
  CRISPR gRNA sequence
gcgtgggaggacatcttttg

SEQ ID NO: 116809 - DNA, 20 bp, Artificial
  CRISPR gRNA sequence
ttgggatgaaccggctcagt

SEQ ID NO: 116810 - DNA, 20 bp, Artificial
  CRISPR gRNA sequence
tgggatgaaccggctcagtc

SEQ ID NO: 116811 - DNA, 20 bp, Artificial
  CRISPR gRNA sequence
gggatgaaccggctcagtcc

SEQ ID NO: 116812 - DNA, 20 bp, Artificial
  CRISPR gRNA sequence
ggatgaaccggctcagtcct

SEQ ID NO: 116813 - DNA, 20 bp, Artificial
  CRISPR gRNA sequence
agtccttgagctcaccccaa

SEQ ID NO: 116814 - DNA, 20 bp, Artificial
  CRISPR gRNA sequence
gagctcaccccaaagatgat

SEQ ID NO: 116815 - DNA, 20 bp, Artificial
  CRISPR gRNA sequence
agctcaccccaaagatgatg

SEQ ID NO: 116816 - DNA, 20 bp, Artificial
  CRISPR gRNA sequence
accccaaagatgatgaaatt

SEQ ID NO: 116817 - DNA, 20 bp, Artificial
  CRISPR gRNA sequence
aaactcagaggaaaggattt

SEQ ID NO: 116818 - DNA, 20 bp, Artificial
  CRISPR gRNA sequence
agaggaaaggatttttacag

SEQ ID NO: 116819 - DNA, 20 bp, Artificial
  CRISPR gRNA sequence
ttacaggaccacgccccggg

SEQ ID NO: 116820 - DNA, 20 bp, Artificial
  CRISPR gRNA sequence
tacaggaccacgccccgggc

SEQ ID NO: 116821 - DNA, 20 bp, Artificial
  CRISPR gRNA sequence
acaggaccacgccccgggct

SEQ ID NO: 116822 - DNA, 20 bp, Artificial
  CRISPR gRNA sequence
caggaccacgccccgggctt

SEQ ID NO: 116823 - DNA, 20 bp, Artificial
  CRISPR gRNA sequence
tgaacccgtttttcccaacc

SEQ ID NO: 116824 - DNA, 20 bp, Artificial
  CRISPR gRNA sequence
gaacccgtttttcccaaccc

SEQ ID NO: 116825 - DNA, 20 bp, Artificial
  CRISPR gRNA sequence
aacccgtttttcccaacccc

SEQ ID NO: 116826 - DNA, 20 bp, Artificial
  CRISPR gRNA sequence
ttcccaaccccgagcatttt

SEQ ID NO: 116827 - DNA, 20 bp, Artificial
  CRISPR gRNA sequence
tcccaaccccgagcattttc

SEQ ID NO: 116828 - DNA, 20 bp, Artificial
  CRISPR gRNA sequence
cccaaccccgagcattttct

SEQ ID NO: 116829 - DNA, 20 bp, Artificial
  CRISPR gRNA sequence
ccaaccccgagcattttcta

SEQ ID NO: 116830 - DNA, 20 bp, Artificial
  CRISPR gRNA sequence
tctattaagcgttctgtttc

SEQ ID NO: 116831 - DNA, 20 bp, Artificial
  CRISPR gRNA sequence
ctattaagcgttctgtttca

SEQ ID NO: 116832 - DNA, 20 bp, Artificial
  CRISPR gRNA sequence
tattaagcgttctgtttcaa

SEQ ID NO: 116833 - DNA, 20 bp, Artificial
  CRISPR gRNA sequence
ttaagcgttctgtttcaatt

SEQ ID NO: 116834 - DNA, 20 bp, Artificial
  CRISPR gRNA sequence
agcgttctgtttcaattatt

SEQ ID NO: 116835 - DNA, 20 bp, Artificial
  CRISPR gRNA sequence
tgtttcaattattttattcg

SEQ ID NO: 116836 - DNA, 20 bp, Artificial
  CRISPR gRNA sequence
tttcaattattttattcgtt

SEQ ID NO: 116837 - DNA, 20 bp, Artificial
  CRISPR gRNA sequence
caattattttattcgttcag

SEQ ID NO: 116838 - DNA, 20 bp, Artificial
  CRISPR gRNA sequence
aattattttattcgttcagt

SEQ ID NO: 116839 - DNA, 20 bp, Artificial
  CRISPR gRNA sequence
ttttattcgttcagttaatt

SEQ ID NO: 116840 - DNA, 20 bp, Artificial
  CRISPR gRNA sequence
tattcgttcagttaattcgt

SEQ ID NO: 116841 - DNA, 20 bp, Artificial
  CRISPR gRNA sequence
attcgttcagttaattcgtt

SEQ ID NO: 116842 - DNA, 20 bp, Artificial
  CRISPR gRNA sequence
ttcgttcagttaattcgttc

SEQ ID NO: 116843 - DNA, 20 bp, Artificial
  CRISPR gRNA sequence
gttcagttaattcgttcttg

SEQ ID NO: 116844 - DNA, 20 bp, Artificial
  CRISPR gRNA sequence
agttaattcgttcttggcgt

SEQ ID NO: 116845 - DNA, 20 bp, Artificial
  CRISPR gRNA sequence
attcgttcttggcgtcataa

SEQ ID NO: 116846 - DNA, 20 bp, Artificial
  CRISPR gRNA sequence
gttcttggcgtcataagtat

SEQ ID NO: 116847 - DNA, 20 bp, Artificial
  CRISPR gRNA sequence
ttggcgtcataagtatatgc

SEQ ID NO: 116848 - DNA, 20 bp, Artificial
  CRISPR gRNA sequence
ggcgtcataagtatatgccc

SEQ ID NO: 116849 - DNA, 20 bp, Artificial
  CRISPR gRNA sequence
gcgtcataagtatatgcccg

SEQ ID NO: 116850 - DNA, 20 bp, Artificial
  CRISPR gRNA sequence
ttctggccgtagctatctag

SEQ ID NO: 116851 - DNA, 20 bp, Artificial
  CRISPR gRNA sequence
tggccgtagctatctagcag

SEQ ID NO: 116852 - DNA, 20 bp, Artificial
  CRISPR gRNA sequence
gccgtagctatctagcagcc

SEQ ID NO: 116853 - DNA, 20 bp, Artificial
  CRISPR gRNA sequence
tctagcagccactccgcgag

SEQ ID NO: 116854 - DNA, 20 bp, Artificial
  CRISPR gRNA sequence
gcagccactccgcgagtcgt

SEQ ID NO: 116855 - DNA, 20 bp, Artificial
  CRISPR gRNA sequence
cgcgagtcgttcatttaaca

SEQ ID NO: 116856 - DNA, 20 bp, Artificial
  CRISPR gRNA sequence
atttaacaaatacttactct

SEQ ID NO: 116857 - DNA, 20 bp, Artificial
  CRISPR gRNA sequence
aacaaatacttactctgtgt

SEQ ID NO: 116858 - DNA, 20 bp, Artificial
  CRISPR gRNA sequence
acaaatacttactctgtgtc

SEQ ID NO: 116859 - DNA, 20 bp, Artificial
  CRISPR gRNA sequence
actctgtgtcagggatatga

SEQ ID NO: 116860 - DNA, 20 bp, Artificial
  CRISPR gRNA sequence
ctctgtgtcagggatatgaa

SEQ ID NO: 116861 - DNA, 20 bp, Artificial
  CRISPR gRNA sequence
tgtgtcagggatatgaagat

SEQ ID NO: 116862 - DNA, 20 bp, Artificial
  CRISPR gRNA sequence
tgtcagggatatgaagatgg

SEQ ID NO: 116863 - DNA, 20 bp, Artificial
  CRISPR gRNA sequence
tcctcactgtgtgagtggtt

SEQ ID NO: 116864 - DNA, 20 bp, Artificial
  CRISPR gRNA sequence
actgtgtgagtggttctcta

SEQ ID NO: 116865 - DNA, 20 bp, Artificial
  CRISPR gRNA sequence
tgtgagtggttctctagcca

SEQ ID NO: 116866 - DNA, 20 bp, Artificial
  CRISPR gRNA sequence
tctagccagacatgaggagg

SEQ ID NO: 116867 - DNA, 20 bp, Artificial
  CRISPR gRNA sequence
tagccagacatgaggaggga

SEQ ID NO: 116868 - DNA, 20 bp, Artificial
  CRISPR gRNA sequence
gccagacatgaggagggatc

SEQ ID NO: 116869 - DNA, 20 bp, Artificial
  CRISPR gRNA sequence
ttgtttcccatagctaggca

SEQ ID NO: 116870 - DNA, 20 bp, Artificial
  CRISPR gRNA sequence
tttcccatagctaggcagcc

SEQ ID NO: 116871 - DNA, 20 bp, Artificial
  CRISPR gRNA sequence
cccatagctaggcagcctaa

SEQ ID NO: 116872 - DNA, 20 bp, Artificial
  CRISPR gRNA sequence
ccatagctaggcagcctaag

SEQ ID NO: 116873 - DNA, 20 bp, Artificial
  CRISPR gRNA sequence
ggcagcctaagagagtaggg

SEQ ID NO: 116874 - DNA, 20 bp, Artificial
  CRISPR gRNA sequence
agagagtaggggaaagagct

SEQ ID NO: 116875 - DNA, 20 bp, Artificial
  CRISPR gRNA sequence
gctccagatgaaaagggcac

SEQ ID NO: 116876 - DNA, 20 bp, Artificial
  CRISPR gRNA sequence
cagatgaaaagggcaccatc

SEQ ID NO: 116877 - DNA, 20 bp, Artificial
  CRISPR gRNA sequence
cagctcttggaagcagagag

SEQ ID NO: 116878 - DNA, 20 bp, Artificial
  CRISPR gRNA sequence
ttggaagcagagagggtggt

SEQ ID NO: 116879 - DNA, 20 bp, Artificial
  CRISPR gRNA sequence
ggaagcagagagggtggtcc

SEQ ID NO: 116880 - DNA, 20 bp, Artificial
  CRISPR gRNA sequence
gaagcagagagggtggtcct

SEQ ID NO: 116881 - DNA, 20 bp, Artificial
  CRISPR gRNA sequence
tggattcccagtggcagcag

SEQ ID NO: 116882 - DNA, 20 bp, Artificial
  CRISPR gRNA sequence
ggattcccagtggcagcagc

SEQ ID NO: 116883 - DNA, 20 bp, Artificial
  CRISPR gRNA sequence
gattcccagtggcagcagca

SEQ ID NO: 116884 - DNA, 20 bp, Artificial
  CRISPR gRNA sequence
ccagtggcagcagcaaccaa

SEQ ID NO: 116885 - DNA, 20 bp, Artificial
  CRISPR gRNA sequence
gcccttagtagtttctaagt

SEQ ID NO: 116886 - DNA, 20 bp, Artificial
  CRISPR gRNA sequence
agtagtttctaagttacacc

SEQ ID NO: 116887 - DNA, 20 bp, Artificial
  CRISPR gRNA sequence
gtagtttctaagttacacca

SEQ ID NO: 116888 - DNA, 20 bp, Artificial
  CRISPR gRNA sequence
ctaagttacaccatgttaat

SEQ ID NO: 116889 - DNA, 20 bp, Artificial
  CRISPR gRNA sequence
taagttacaccatgttaatg

SEQ ID NO: 116890 - DNA, 20 bp, Artificial
  CRISPR gRNA sequence
agttacaccatgttaatgga

SEQ ID NO: 116891 - DNA, 20 bp, Artificial
  CRISPR gRNA sequence
caccatgttaatggataaag

SEQ ID NO: 116892 - DNA, 20 bp, Artificial
  CRISPR gRNA sequence
atggataaaggaattactca

SEQ ID NO: 116893 - DNA, 20 bp, Artificial
  CRISPR gRNA sequence
ctcagcttgaagggatctgt

SEQ ID NO: 116894 - DNA, 20 bp, Artificial
  CRISPR gRNA sequence
agcttgaagggatctgtttc

SEQ ID NO: 116895 - DNA, 20 bp, Artificial
  CRISPR gRNA sequence
gaagggatctgtttccttta

SEQ ID NO: 116896 - DNA, 20 bp, Artificial
  CRISPR gRNA sequence
aagggatctgtttcctttac

SEQ ID NO: 116897 - DNA, 20 bp, Artificial
  CRISPR gRNA sequence
tttcctttacactggcctga

SEQ ID NO: 116898 - DNA, 20 bp, Artificial
  CRISPR gRNA sequence
cctttacactggcctgatgt

SEQ ID NO: 116899 - DNA, 20 bp, Artificial
  CRISPR gRNA sequence
ctttacactggcctgatgtg

SEQ ID NO: 116900 - DNA, 20 bp, Artificial
  CRISPR gRNA sequence
tacactggcctgatgtgtgg

SEQ ID NO: 116901 - DNA, 20 bp, Artificial
  CRISPR gRNA sequence
acactggcctgatgtgtggg

SEQ ID NO: 116902 - DNA, 20 bp, Artificial
  CRISPR gRNA sequence
cactggcctgatgtgtgggg

SEQ ID NO: 116903 - DNA, 20 bp, Artificial
  CRISPR gRNA sequence
gcctgatgtgtggggagaaa

SEQ ID NO: 116904 - DNA, 20 bp, Artificial
  CRISPR gRNA sequence
atgtgtggggagaaaggggc

SEQ ID NO: 116905 - DNA, 20 bp, Artificial
  CRISPR gRNA sequence
aggatttggagttaacatcg

SEQ ID NO: 116906 - DNA, 20 bp, Artificial
  CRISPR gRNA sequence
ggatttggagttaacatcgt

SEQ ID NO: 116907 - DNA, 20 bp, Artificial
  CRISPR gRNA sequence
ggagttaacatcgtaatttc

SEQ ID NO: 116908 - DNA, 20 bp, Artificial
  CRISPR gRNA sequence
gagttaacatcgtaatttct

SEQ ID NO: 116909 - DNA, 20 bp, Artificial
  CRISPR gRNA sequence
acatcgtaatttctgctttg

SEQ ID NO: 116910 - DNA, 20 bp, Artificial
  CRISPR gRNA sequence
ctgctttgttggtcagggtt

SEQ ID NO: 116911 - DNA, 20 bp, Artificial
  CRISPR gRNA sequence
tgctttgttggtcagggttt

SEQ ID NO: 116912 - DNA, 20 bp, Artificial
  CRISPR gRNA sequence
ctttgttggtcagggtttac

SEQ ID NO: 116913 - DNA, 20 bp, Artificial
  CRISPR gRNA sequence
tgttggtcagggtttacagc

SEQ ID NO: 116914 - DNA, 20 bp, Artificial
  CRISPR gRNA sequence
gttggtcagggtttacagca

SEQ ID NO: 116915 - DNA, 20 bp, Artificial
  CRISPR gRNA sequence
ttggtcagggtttacagcat

SEQ ID NO: 116916 - DNA, 20 bp, Artificial
  CRISPR gRNA sequence
gtcagggtttacagcattaa

SEQ ID NO: 116917 - DNA, 20 bp, Artificial
  CRISPR gRNA sequence
acagcattaatggacaggtt

SEQ ID NO: 116918 - DNA, 20 bp, Artificial
  CRISPR gRNA sequence
cagcattaatggacaggttc

SEQ ID NO: 116919 - DNA, 20 bp, Artificial
  CRISPR gRNA sequence
atggacaggttcaccctgac

SEQ ID NO: 116920 - DNA, 20 bp, Artificial
  CRISPR gRNA sequence
accctgacctacaagtcgga

SEQ ID NO: 116921 - DNA, 20 bp, Artificial
  CRISPR gRNA sequence
acctacaagtcggaacgtga

SEQ ID NO: 116922 - DNA, 20 bp, Artificial
  CRISPR gRNA sequence
caagtcggaacgtgacatgg

SEQ ID NO: 116923 - DNA, 20 bp, Artificial
  CRISPR gRNA sequence
gcccatatcttcagttatta

SEQ ID NO: 116924 - DNA, 20 bp, Artificial
  CRISPR gRNA sequence
cagttattacattagtgaca

SEQ ID NO: 116925 - DNA, 20 bp, Artificial
  CRISPR gRNA sequence
agttattacattagtgacat

SEQ ID NO: 116926 - DNA, 20 bp, Artificial
  CRISPR gRNA sequence
ttacattagtgacatcgtgg

SEQ ID NO: 116927 - DNA, 20 bp, Artificial
  CRISPR gRNA sequence
cattagtgacatcgtggagc

SEQ ID NO: 116928 - DNA, 20 bp, Artificial
  CRISPR gRNA sequence
gtgacatcgtggagcgtgag

SEQ ID NO: 116929 - DNA, 20 bp, Artificial
  CRISPR gRNA sequence
tagggtaacaaggtgtggtg

SEQ ID NO: 116930 - DNA, 20 bp, Artificial
  CRISPR gRNA sequence
ggctcctgggggtttataaa

SEQ ID NO: 116931 - DNA, 20 bp, Artificial
  CRISPR gRNA sequence
ctgggggtttataaaagaag

SEQ ID NO: 116932 - DNA, 20 bp, Artificial
  CRISPR gRNA sequence
ggggtttataaaagaagggg

SEQ ID NO: 116933 - DNA, 20 bp, Artificial
  CRISPR gRNA sequence
ataaaagaagggggccagaa

SEQ ID NO: 116934 - DNA, 20 bp, Artificial
  CRISPR gRNA sequence
taaaagaagggggccagaag

SEQ ID NO: 116935 - DNA, 20 bp, Artificial
  CRISPR gRNA sequence
taaaacaggtaccaaagggt

SEQ ID NO: 116936 - DNA, 20 bp, Artificial
  CRISPR gRNA sequence
aaaacaggtaccaaagggtc

SEQ ID NO: 116937 - DNA, 20 bp, Artificial
  CRISPR gRNA sequence
aaacaggtaccaaagggtca

SEQ ID NO: 116938 - DNA, 20 bp, Artificial
  CRISPR gRNA sequence
ctttagcatcattcatcttt

SEQ ID NO: 116939 - DNA, 20 bp, Artificial
  CRISPR gRNA sequence
tagcatcattcatctttggt

SEQ ID NO: 116940 - DNA, 20 bp, Artificial
  CRISPR gRNA sequence
agcatcattcatctttggtt

SEQ ID NO: 116941 - DNA, 20 bp, Artificial
  CRISPR gRNA sequence
gcatcattcatctttggttt

SEQ ID NO: 116942 - DNA, 20 bp, Artificial
  CRISPR gRNA sequence
atctttggtttcttcaagtt

SEQ ID NO: 116943 - DNA, 20 bp, Artificial
  CRISPR gRNA sequence
tggtttcttcaagttgccac

SEQ ID NO: 116944 - DNA, 20 bp, Artificial
  CRISPR gRNA sequence
ggtttcttcaagttgccact

SEQ ID NO: 116945 - DNA, 20 bp, Artificial
  CRISPR gRNA sequence
gtttcttcaagttgccactg

SEQ ID NO: 116946 - DNA, 20 bp, Artificial
  CRISPR gRNA sequence
cttcaagttgccactgaaaa

SEQ ID NO: 116947 - DNA, 20 bp, Artificial
  CRISPR gRNA sequence
ttcaagttgccactgaaaag

SEQ ID NO: 116948 - DNA, 20 bp, Artificial
  CRISPR gRNA sequence
caagttgccactgaaaagct

SEQ ID NO: 116949 - DNA, 20 bp, Artificial
  CRISPR gRNA sequence
aagttgccactgaaaagcta

SEQ ID NO: 116950 - DNA, 20 bp, Artificial
  CRISPR gRNA sequence
ccactgaaaagctagacctt

SEQ ID NO: 116951 - DNA, 20 bp, Artificial
  CRISPR gRNA sequence
aaaagctagacctttgccta

SEQ ID NO: 116952 - DNA, 20 bp, Artificial
  CRISPR gRNA sequence
gacctttgcctattatctgc

SEQ ID NO: 116953 - DNA, 20 bp, Artificial
  CRISPR gRNA sequence
tgcctattatctgctaatct

SEQ ID NO: 116954 - DNA, 20 bp, Artificial
  CRISPR gRNA sequence
gcctattatctgctaatcta

SEQ ID NO: 116955 - DNA, 20 bp, Artificial
  CRISPR gRNA sequence
cctattatctgctaatctac

SEQ ID NO: 116956 - DNA, 20 bp, Artificial
  CRISPR gRNA sequence
ttatctgctaatctacccag

SEQ ID NO: 116957 - DNA, 20 bp, Artificial
  CRISPR gRNA sequence
tctgctaatctacccagtct

SEQ ID NO: 116958 - DNA, 20 bp, Artificial
  CRISPR gRNA sequence
ctaatctacccagtctcaca

SEQ ID NO: 116959 - DNA, 20 bp, Artificial
  CRISPR gRNA sequence
atctacccagtctcacattc

SEQ ID NO: 116960 - DNA, 20 bp, Artificial
  CRISPR gRNA sequence
cccagtctcacattctattg

SEQ ID NO: 116961 - DNA, 20 bp, Artificial
  CRISPR gRNA sequence
acattctattgactcattgt

SEQ ID NO: 116962 - DNA, 20 bp, Artificial
  CRISPR gRNA sequence
tattgactcattgttcaaag

SEQ ID NO: 116963 - DNA, 20 bp, Artificial
  CRISPR gRNA sequence
ttgactcattgttcaaaggg

SEQ ID NO: 116964 - DNA, 20 bp, Artificial
  CRISPR gRNA sequence
actcattgttcaaagggggg

SEQ ID NO: 116965 - DNA, 20 bp, Artificial
  CRISPR gRNA sequence
attgttcaaagggggggcag

SEQ ID NO: 116966 - DNA, 20 bp, Artificial
  CRISPR gRNA sequence
ttcaaagggggggcaggagg

SEQ ID NO: 116967 - DNA, 20 bp, Artificial
  CRISPR gRNA sequence
aaagggggggcaggaggagc

SEQ ID NO: 116968 - DNA, 20 bp, Artificial
  CRISPR gRNA sequence
atttcctttgcacatttgta

SEQ ID NO: 116969 - DNA, 20 bp, Artificial
  CRISPR gRNA sequence
cctttgcacatttgtatttt

SEQ ID NO: 116970 - DNA, 20 bp, Artificial
  CRISPR gRNA sequence
ctttgcacatttgtatttta

SEQ ID NO: 116971 - DNA, 20 bp, Artificial
  CRISPR gRNA sequence
tgcacatttgtattttattt

SEQ ID NO: 116972 - DNA, 20 bp, Artificial
  CRISPR gRNA sequence
gcacatttgtattttatttc

SEQ ID NO: 116973 - DNA, 20 bp, Artificial
  CRISPR gRNA sequence
cacatttgtattttatttca

SEQ ID NO: 116974 - DNA, 20 bp, Artificial
  CRISPR gRNA sequence
gtattttatttcaaaataaa

SEQ ID NO: 116975 - DNA, 20 bp, Artificial
  CRISPR gRNA sequence
tattttatttcaaaataaag

SEQ ID NO: 116976 - DNA, 20 bp, Artificial
  CRISPR gRNA sequence
tatttcaaaataaagtattc

SEQ ID NO: 116977 - DNA, 20 bp, Artificial
  CRISPR gRNA sequence
atttcaaaataaagtattct

SEQ ID NO: 116978 - DNA, 20 bp, Artificial
  CRISPR gRNA sequence
tttcaaaataaagtattctc

SEQ ID NO: 116979 - DNA, 20 bp, Artificial
  CRISPR gRNA sequence
caaaataaagtattctcttc

SEQ ID NO: 116980 - DNA, 20 bp, Artificial
  CRISPR gRNA sequence
aaaataaagtattctcttct

SEQ ID NO: 116981 - DNA, 20 bp, Artificial
  CRISPR gRNA sequence
tcttctaacaataacgtatc

SEQ ID NO: 116982 - DNA, 20 bp, Artificial
  CRISPR gRNA sequence
ttctaacaataacgtatctc

SEQ ID NO: 116983 - DNA, 20 bp, Artificial
  CRISPR gRNA sequence
ctaacaataacgtatctcaa

SEQ ID NO: 116984 - DNA, 20 bp, Artificial
  CRISPR gRNA sequence
taacaataacgtatctcaag

SEQ ID NO: 116985 - DNA, 20 bp, Artificial
  CRISPR gRNA sequence
acaataacgtatctcaagtg

SEQ ID NO: 116986 - DNA, 20 bp, Artificial
  CRISPR gRNA sequence
aagtgtgtattcagacaaaa

SEQ ID NO: 116987 - DNA, 20 bp, Artificial
  CRISPR gRNA sequence
agacaaaatttataaaacat

SEQ ID NO: 116988 - DNA, 20 bp, Artificial
  CRISPR gRNA sequence
ataaaacatctttttattat

SEQ ID NO: 116989 - DNA, 20 bp, Artificial
  CRISPR gRNA sequence
taaaacatctttttattatt

SEQ ID NO: 116990 - DNA, 20 bp, Artificial
  CRISPR gRNA sequence
tttattattatattttgatc

SEQ ID NO: 116991 - DNA, 20 bp, Artificial
  CRISPR gRNA sequence
ttattattatattttgatcc

SEQ ID NO: 116992 - DNA, 20 bp, Artificial
  CRISPR gRNA sequence
tattattatattttgatcct

SEQ ID NO: 116993 - DNA, 20 bp, Artificial
  CRISPR gRNA sequence
attattatattttgatcctg

SEQ ID NO: 116994 - DNA, 20 bp, Artificial
  CRISPR gRNA sequence
ttattatattttgatcctgt

SEQ ID NO: 116995 - DNA, 20 bp, Artificial
  CRISPR gRNA sequence
ttatattttgatcctgtgag

SEQ ID NO: 116996 - DNA, 20 bp, Artificial
  CRISPR gRNA sequence
tattttgatcctgtgaggaa

SEQ ID NO: 116997 - DNA, 20 bp, Artificial
  CRISPR gRNA sequence
tgatcctgtgaggaaggaat

SEQ ID NO: 116998 - DNA, 20 bp, Artificial
  CRISPR gRNA sequence
gatcctgtgaggaaggaata

SEQ ID NO: 116999 - DNA, 20 bp, Artificial
  CRISPR gRNA sequence
atcctgtgaggaaggaatag

SEQ ID NO: 117000 - DNA, 20 bp, Artificial
  CRISPR gRNA sequence
tgaggaaggaataggtgttt

SEQ ID NO: 117001 - DNA, 20 bp, Artificial
  CRISPR gRNA sequence
ttccttcctcacaggatcaa

SEQ ID NO: 117002 - DNA, 20 bp, Artificial
  CRISPR gRNA sequence
cttcctcacaggatcaaaat

SEQ ID NO: 117003 - DNA, 20 bp, Artificial
  CRISPR gRNA sequence
cctcacaggatcaaaatata

SEQ ID NO: 117004 - DNA, 20 bp, Artificial
  CRISPR gRNA sequence
ctcacaggatcaaaatataa

SEQ ID NO: 117005 - DNA, 20 bp, Artificial
  CRISPR gRNA sequence
acaggatcaaaatataataa

SEQ ID NO: 117006 - DNA, 20 bp, Artificial
  CRISPR gRNA sequence
tataaattttgtctgaatac

SEQ ID NO: 117007 - DNA, 20 bp, Artificial
  CRISPR gRNA sequence
ataaattttgtctgaataca

SEQ ID NO: 117008 - DNA, 20 bp, Artificial
  CRISPR gRNA sequence
taaattttgtctgaatacac

SEQ ID NO: 117009 - DNA, 20 bp, Artificial
  CRISPR gRNA sequence
tgtctgaatacacacttgag

SEQ ID NO: 117010 - DNA, 20 bp, Artificial
  CRISPR gRNA sequence
gtctgaatacacacttgaga

SEQ ID NO: 117011 - DNA, 20 bp, Artificial
  CRISPR gRNA sequence
tctgaatacacacttgagat

SEQ ID NO: 117012 - DNA, 20 bp, Artificial
  CRISPR gRNA sequence
aatacacacttgagatacgt

SEQ ID NO: 117013 - DNA, 20 bp, Artificial
  CRISPR gRNA sequence
gagatacgttattgttagaa

SEQ ID NO: 117014 - DNA, 20 bp, Artificial
  CRISPR gRNA sequence
agatacgttattgttagaag

SEQ ID NO: 117015 - DNA, 20 bp, Artificial
  CRISPR gRNA sequence
ttgttagaagagaatacttt

SEQ ID NO: 117016 - DNA, 20 bp, Artificial
  CRISPR gRNA sequence
ttagaagagaatactttatt

SEQ ID NO: 117017 - DNA, 20 bp, Artificial
  CRISPR gRNA sequence
gaagagaatactttattttg

SEQ ID NO: 117018 - DNA, 20 bp, Artificial
  CRISPR gRNA sequence
tattttgaaataaaatacaa

SEQ ID NO: 117019 - DNA, 20 bp, Artificial
  CRISPR gRNA sequence
attttgaaataaaatacaaa

SEQ ID NO: 117020 - DNA, 20 bp, Artificial
  CRISPR gRNA sequence
ttttgaaataaaatacaaat

SEQ ID NO: 117021 - DNA, 20 bp, Artificial
  CRISPR gRNA sequence
tgaaataaaatacaaatgtg

SEQ ID NO: 117022 - DNA, 20 bp, Artificial
  CRISPR gRNA sequence
gaaataaaatacaaatgtgc

SEQ ID NO: 117023 - DNA, 20 bp, Artificial
  CRISPR gRNA sequence
aaataaaatacaaatgtgca

SEQ ID NO: 117024 - DNA, 20 bp, Artificial
  CRISPR gRNA sequence
gctcctcctgcccccccttt

SEQ ID NO: 117025 - DNA, 20 bp, Artificial
  CRISPR gRNA sequence
ctcctgccccccctttgaac

SEQ ID NO: 117026 - DNA, 20 bp, Artificial
  CRISPR gRNA sequence
ctgccccccctttgaacaat

SEQ ID NO: 117027 - DNA, 20 bp, Artificial
  CRISPR gRNA sequence
ccccccctttgaacaatgag

SEQ ID NO: 117028 - DNA, 20 bp, Artificial
  CRISPR gRNA sequence
tgaacaatgagtcaatagaa

SEQ ID NO: 117029 - DNA, 20 bp, Artificial
  CRISPR gRNA sequence
gaacaatgagtcaatagaat

SEQ ID NO: 117030 - DNA, 20 bp, Artificial
  CRISPR gRNA sequence
aacaatgagtcaatagaatg

SEQ ID NO: 117031 - DNA, 20 bp, Artificial
  CRISPR gRNA sequence
ggtagattagcagataatag

SEQ ID NO: 117032 - DNA, 20 bp, Artificial
  CRISPR gRNA sequence
gcagataataggcaaaggtc

SEQ ID NO: 117033 - DNA, 20 bp, Artificial
  CRISPR gRNA sequence
gcttttcagtggcaacttga

SEQ ID NO: 117034 - DNA, 20 bp, Artificial
  CRISPR gRNA sequence
ttcagtggcaacttgaagaa

SEQ ID NO: 117035 - DNA, 20 bp, Artificial
  CRISPR gRNA sequence
tcagtggcaacttgaagaaa

SEQ ID NO: 117036 - DNA, 20 bp, Artificial
  CRISPR gRNA sequence
cagtggcaacttgaagaaac

SEQ ID NO: 117037 - DNA, 20 bp, Artificial
  CRISPR gRNA sequence
agtggcaacttgaagaaacc

SEQ ID NO: 117038 - DNA, 20 bp, Artificial
  CRISPR gRNA sequence
gaagaaaccaaagatgaatg

SEQ ID NO: 117039 - DNA, 20 bp, Artificial
  CRISPR gRNA sequence
aagaaaccaaagatgaatga

SEQ ID NO: 117040 - DNA, 20 bp, Artificial
  CRISPR gRNA sequence
aaggaatgaccctttggtac

SEQ ID NO: 117041 - DNA, 20 bp, Artificial
  CRISPR gRNA sequence
tggtacctgttttaaagtac

SEQ ID NO: 117042 - DNA, 20 bp, Artificial
  CRISPR gRNA sequence
ggtacctgttttaaagtact

SEQ ID NO: 117043 - DNA, 20 bp, Artificial
  CRISPR gRNA sequence
gtacctgttttaaagtactt

SEQ ID NO: 117044 - DNA, 20 bp, Artificial
  CRISPR gRNA sequence
ttttaaagtacttctggccc

SEQ ID NO: 117045 - DNA, 20 bp, Artificial
  CRISPR gRNA sequence
taaagtacttctggccccct

SEQ ID NO: 117046 - DNA, 20 bp, Artificial
  CRISPR gRNA sequence
aaagtacttctggccccctt

SEQ ID NO: 117047 - DNA, 20 bp, Artificial
  CRISPR gRNA sequence
aagtacttctggcccccttc

SEQ ID NO: 117048 - DNA, 20 bp, Artificial
  CRISPR gRNA sequence
ctggcccccttcttttataa

SEQ ID NO: 117049 - DNA, 20 bp, Artificial
  CRISPR gRNA sequence
tggcccccttcttttataaa

SEQ ID NO: 117050 - DNA, 20 bp, Artificial
  CRISPR gRNA sequence
gcccccttcttttataaacc

SEQ ID NO: 117051 - DNA, 20 bp, Artificial
  CRISPR gRNA sequence
cttttataaacccccaggag

SEQ ID NO: 117052 - DNA, 20 bp, Artificial
  CRISPR gRNA sequence
ttttataaacccccaggagc

SEQ ID NO: 117053 - DNA, 20 bp, Artificial
  CRISPR gRNA sequence
ttataaacccccaggagccc

SEQ ID NO: 117054 - DNA, 20 bp, Artificial
  CRISPR gRNA sequence
tataaacccccaggagccca

SEQ ID NO: 117055 - DNA, 20 bp, Artificial
  CRISPR gRNA sequence
ataaacccccaggagcccag

SEQ ID NO: 117056 - DNA, 20 bp, Artificial
  CRISPR gRNA sequence
taaacccccaggagcccagc

SEQ ID NO: 117057 - DNA, 20 bp, Artificial
  CRISPR gRNA sequence
gttaccctacaatgatcact

SEQ ID NO: 117058 - DNA, 20 bp, Artificial
  CRISPR gRNA sequence
ttaccctacaatgatcactc

SEQ ID NO: 117059 - DNA, 20 bp, Artificial
  CRISPR gRNA sequence
ccctacaatgatcactcacg

SEQ ID NO: 117060 - DNA, 20 bp, Artificial
  CRISPR gRNA sequence
caatgatcactcacgctcca

SEQ ID NO: 117061 - DNA, 20 bp, Artificial
  CRISPR gRNA sequence
acgctccacgatgtcactaa

SEQ ID NO: 117062 - DNA, 20 bp, Artificial
  CRISPR gRNA sequence
cacgatgtcactaatgtaat

SEQ ID NO: 117063 - DNA, 20 bp, Artificial
  CRISPR gRNA sequence
atgtaataactgaagatatg

SEQ ID NO: 117064 - DNA, 20 bp, Artificial
  CRISPR gRNA sequence
aagatatgggccagtttgtc

SEQ ID NO: 117065 - DNA, 20 bp, Artificial
  CRISPR gRNA sequence
gtccatgtcacgttccgact

SEQ ID NO: 117066 - DNA, 20 bp, Artificial
  CRISPR gRNA sequence
tccatgtcacgttccgactt

SEQ ID NO: 117067 - DNA, 20 bp, Artificial
  CRISPR gRNA sequence
cgacttgtaggtcagggtga

SEQ ID NO: 117068 - DNA, 20 bp, Artificial
  CRISPR gRNA sequence
gtaggtcagggtgaacctgt

SEQ ID NO: 117069 - DNA, 20 bp, Artificial
  CRISPR gRNA sequence
taggtcagggtgaacctgtc

SEQ ID NO: 117070 - DNA, 20 bp, Artificial
  CRISPR gRNA sequence
tccattaatgctgtaaaccc

SEQ ID NO: 117071 - DNA, 20 bp, Artificial
  CRISPR gRNA sequence
atgctgtaaaccctgaccaa

SEQ ID NO: 117072 - DNA, 20 bp, Artificial
  CRISPR gRNA sequence
taaaccctgaccaacaaagc

SEQ ID NO: 117073 - DNA, 20 bp, Artificial
  CRISPR gRNA sequence
accaacaaagcagaaattac

SEQ ID NO: 117074 - DNA, 20 bp, Artificial
  CRISPR gRNA sequence
cgatgttaactccaaatcct

SEQ ID NO: 117075 - DNA, 20 bp, Artificial
  CRISPR gRNA sequence
actccaaatcctaaactttt

SEQ ID NO: 117076 - DNA, 20 bp, Artificial
  CRISPR gRNA sequence
caaatcctaaactttttggc

SEQ ID NO: 117077 - DNA, 20 bp, Artificial
  CRISPR gRNA sequence
aactttttggcccctttctc

SEQ ID NO: 117078 - DNA, 20 bp, Artificial
  CRISPR gRNA sequence
tttggcccctttctccccac

SEQ ID NO: 117079 - DNA, 20 bp, Artificial
  CRISPR gRNA sequence
ttggcccctttctccccaca

SEQ ID NO: 117080 - DNA, 20 bp, Artificial
  CRISPR gRNA sequence
tggcccctttctccccacac

SEQ ID NO: 117081 - DNA, 20 bp, Artificial
  CRISPR gRNA sequence
ggcccctttctccccacaca

SEQ ID NO: 117082 - DNA, 20 bp, Artificial
  CRISPR gRNA sequence
gcccctttctccccacacat

SEQ ID NO: 117083 - DNA, 20 bp, Artificial
  CRISPR gRNA sequence
tctccccacacatcaggcca

SEQ ID NO: 117084 - DNA, 20 bp, Artificial
  CRISPR gRNA sequence
ctccccacacatcaggccag

SEQ ID NO: 117085 - DNA, 20 bp, Artificial
  CRISPR gRNA sequence
tccccacacatcaggccagt

SEQ ID NO: 117086 - DNA, 20 bp, Artificial
  CRISPR gRNA sequence
cccacacatcaggccagtgt

SEQ ID NO: 117087 - DNA, 20 bp, Artificial
  CRISPR gRNA sequence
caagctgagtaattccttta

SEQ ID NO: 117088 - DNA, 20 bp, Artificial
  CRISPR gRNA sequence
aagctgagtaattcctttat

SEQ ID NO: 117089 - DNA, 20 bp, Artificial
  CRISPR gRNA sequence
agtaattcctttatccatta

SEQ ID NO: 117090 - DNA, 20 bp, Artificial
  CRISPR gRNA sequence
ctttatccattaacatggtg

SEQ ID NO: 117091 - DNA, 20 bp, Artificial
  CRISPR gRNA sequence
tatccattaacatggtgtaa

SEQ ID NO: 117092 - DNA, 20 bp, Artificial
  CRISPR gRNA sequence
atccattaacatggtgtaac

SEQ ID NO: 117093 - DNA, 20 bp, Artificial
  CRISPR gRNA sequence
tccattaacatggtgtaact

SEQ ID NO: 117094 - DNA, 20 bp, Artificial
  CRISPR gRNA sequence
acatggtgtaacttagaaac

SEQ ID NO: 117095 - DNA, 20 bp, Artificial
  CRISPR gRNA sequence
agaaactactaagggccagg

SEQ ID NO: 117096 - DNA, 20 bp, Artificial
  CRISPR gRNA sequence
gaaactactaagggccaggt

SEQ ID NO: 117097 - DNA, 20 bp, Artificial
  CRISPR gRNA sequence
ctaagggccaggttggttgc

SEQ ID NO: 117098 - DNA, 20 bp, Artificial
  CRISPR gRNA sequence
agggccaggttggttgctgc

SEQ ID NO: 117099 - DNA, 20 bp, Artificial
  CRISPR gRNA sequence
gttgctgctgccactgggaa

SEQ ID NO: 117100 - DNA, 20 bp, Artificial
  CRISPR gRNA sequence
ctgctgccactgggaatcca

SEQ ID NO: 117101 - DNA, 20 bp, Artificial
  CRISPR gRNA sequence
ctgccactgggaatccaaag

SEQ ID NO: 117102 - DNA, 20 bp, Artificial
  CRISPR gRNA sequence
ccactgggaatccaaaggac

SEQ ID NO: 117103 - DNA, 20 bp, Artificial
  CRISPR gRNA sequence
ggaatccaaaggaccaccct

SEQ ID NO: 117104 - DNA, 20 bp, Artificial
  CRISPR gRNA sequence
tctgcttccaagagctggag

SEQ ID NO: 117105 - DNA, 20 bp, Artificial
  CRISPR gRNA sequence
tgcttccaagagctggagat

SEQ ID NO: 117106 - DNA, 20 bp, Artificial
  CRISPR gRNA sequence
cttccaagagctggagatgg

SEQ ID NO: 117107 - DNA, 20 bp, Artificial
  CRISPR gRNA sequence
ccaagagctggagatggtgc

SEQ ID NO: 117108 - DNA, 20 bp, Artificial
  CRISPR gRNA sequence
caagagctggagatggtgcc

SEQ ID NO: 117109 - DNA, 20 bp, Artificial
  CRISPR gRNA sequence
gagatggtgcccttttcatc

SEQ ID NO: 117110 - DNA, 20 bp, Artificial
  CRISPR gRNA sequence
ttcatctggagccagctctt

SEQ ID NO: 117111 - DNA, 20 bp, Artificial
  CRISPR gRNA sequence
tcatctggagccagctcttt

SEQ ID NO: 117112 - DNA, 20 bp, Artificial
  CRISPR gRNA sequence
catctggagccagctctttc

SEQ ID NO: 117113 - DNA, 20 bp, Artificial
  CRISPR gRNA sequence
atctggagccagctctttcc

SEQ ID NO: 117114 - DNA, 20 bp, Artificial
  CRISPR gRNA sequence
gagccagctctttcccctac

SEQ ID NO: 117115 - DNA, 20 bp, Artificial
  CRISPR gRNA sequence
tttcccctactctcttaggc

SEQ ID NO: 117116 - DNA, 20 bp, Artificial
  CRISPR gRNA sequence
tcccctactctcttaggctg

SEQ ID NO: 117117 - DNA, 20 bp, Artificial
  CRISPR gRNA sequence
cccctactctcttaggctgc

SEQ ID NO: 117118 - DNA, 20 bp, Artificial
  CRISPR gRNA sequence
ccctactctcttaggctgcc

SEQ ID NO: 117119 - DNA, 20 bp, Artificial
  CRISPR gRNA sequence
ctctcttaggctgcctagct

SEQ ID NO: 117120 - DNA, 20 bp, Artificial
  CRISPR gRNA sequence
tcttaggctgcctagctatg

SEQ ID NO: 117121 - DNA, 20 bp, Artificial
  CRISPR gRNA sequence
ttaggctgcctagctatggg

SEQ ID NO: 117122 - DNA, 20 bp, Artificial
  CRISPR gRNA sequence
aggctgcctagctatgggaa

SEQ ID NO: 117123 - DNA, 20 bp, Artificial
  CRISPR gRNA sequence
ggctgcctagctatgggaaa

SEQ ID NO: 117124 - DNA, 20 bp, Artificial
  CRISPR gRNA sequence
cctagctatgggaaacaata

SEQ ID NO: 117125 - DNA, 20 bp, Artificial
  CRISPR gRNA sequence
gctatgggaaacaataggat

SEQ ID NO: 117126 - DNA, 20 bp, Artificial
  CRISPR gRNA sequence
tgggaaacaataggatccct

SEQ ID NO: 117127 - DNA, 20 bp, Artificial
  CRISPR gRNA sequence
ctcatgtctggctagagaac

SEQ ID NO: 117128 - DNA, 20 bp, Artificial
  CRISPR gRNA sequence
atgtctggctagagaaccac

SEQ ID NO: 117129 - DNA, 20 bp, Artificial
  CRISPR gRNA sequence
gctagagaaccactcacaca

SEQ ID NO: 117130 - DNA, 20 bp, Artificial
  CRISPR gRNA sequence
gagaaccactcacacagtga

SEQ ID NO: 117131 - DNA, 20 bp, Artificial
  CRISPR gRNA sequence
acacagtgaggacaggcacc

SEQ ID NO: 117132 - DNA, 20 bp, Artificial
  CRISPR gRNA sequence
gtattacccatcttcatatc

SEQ ID NO: 117133 - DNA, 20 bp, Artificial
  CRISPR gRNA sequence
cccatcttcatatccctgac

SEQ ID NO: 117134 - DNA, 20 bp, Artificial
  CRISPR gRNA sequence
catatccctgacacagagta

SEQ ID NO: 117135 - DNA, 20 bp, Artificial
  CRISPR gRNA sequence
atatccctgacacagagtaa

SEQ ID NO: 117136 - DNA, 20 bp, Artificial
  CRISPR gRNA sequence
acacagagtaagtatttgtt

SEQ ID NO: 117137 - DNA, 20 bp, Artificial
  CRISPR gRNA sequence
gttaaatgaacgactcgcgg

SEQ ID NO: 117138 - DNA, 20 bp, Artificial
  CRISPR gRNA sequence
ttaaatgaacgactcgcgga

SEQ ID NO: 117139 - DNA, 20 bp, Artificial
  CRISPR gRNA sequence
aatgaacgactcgcggagtg

SEQ ID NO: 117140 - DNA, 20 bp, Artificial
  CRISPR gRNA sequence
gcggagtggctgctagatag

SEQ ID NO: 117141 - DNA, 20 bp, Artificial
  CRISPR gRNA sequence
ctagatagctacggccagaa

SEQ ID NO: 117142 - DNA, 20 bp, Artificial
  CRISPR gRNA sequence
gatagctacggccagaacaa

SEQ ID NO: 117143 - DNA, 20 bp, Artificial
  CRISPR gRNA sequence
cggccagaacaacggcgggc

SEQ ID NO: 117144 - DNA, 20 bp, Artificial
  CRISPR gRNA sequence
atgacgccaagaacgaatta

SEQ ID NO: 117145 - DNA, 20 bp, Artificial
  CRISPR gRNA sequence
tgacgccaagaacgaattaa

SEQ ID NO: 117146 - DNA, 20 bp, Artificial
  CRISPR gRNA sequence
actgaacgaataaaataatt

SEQ ID NO: 117147 - DNA, 20 bp, Artificial
  CRISPR gRNA sequence
aacgaataaaataattgaaa

SEQ ID NO: 117148 - DNA, 20 bp, Artificial
  CRISPR gRNA sequence
aaacagaacgcttaatagaa

SEQ ID NO: 117149 - DNA, 20 bp, Artificial
  CRISPR gRNA sequence
aatagaaaatgctcggggtt

SEQ ID NO: 117150 - DNA, 20 bp, Artificial
  CRISPR gRNA sequence
atagaaaatgctcggggttg

SEQ ID NO: 117151 - DNA, 20 bp, Artificial
  CRISPR gRNA sequence
ggggttgggaaaaacgggtt

SEQ ID NO: 117152 - DNA, 20 bp, Artificial
  CRISPR gRNA sequence
ggaaaaacgggttcaaagcc

SEQ ID NO: 117153 - DNA, 20 bp, Artificial
  CRISPR gRNA sequence
aaagcccggggcgtggtcct

SEQ ID NO: 117154 - DNA, 20 bp, Artificial
  CRISPR gRNA sequence
taaaaatcctttcctctgag

SEQ ID NO: 117155 - DNA, 20 bp, Artificial
  CRISPR gRNA sequence
tcctctgagtttcaatttca

SEQ ID NO: 117156 - DNA, 20 bp, Artificial
  CRISPR gRNA sequence
cctctgagtttcaatttcat

SEQ ID NO: 117157 - DNA, 20 bp, Artificial
  CRISPR gRNA sequence
ctctgagtttcaatttcatc

SEQ ID NO: 117158 - DNA, 20 bp, Artificial
  CRISPR gRNA sequence
tgagtttcaatttcatcatc

SEQ ID NO: 117159 - DNA, 20 bp, Artificial
  CRISPR gRNA sequence
agtttcaatttcatcatctt

SEQ ID NO: 117160 - DNA, 20 bp, Artificial
  CRISPR gRNA sequence
caatttcatcatctttgggg

SEQ ID NO: 117161 - DNA, 20 bp, Artificial
  CRISPR gRNA sequence
aatttcatcatctttggggt

SEQ ID NO: 117162 - DNA, 20 bp, Artificial
  CRISPR gRNA sequence
catcatctttggggtgagct

SEQ ID NO: 117163 - DNA, 20 bp, Artificial
  CRISPR gRNA sequence
atcatctttggggtgagctc

SEQ ID NO: 117164 - DNA, 20 bp, Artificial
  CRISPR gRNA sequence
tggggtgagctcaaggactg

SEQ ID NO: 117165 - DNA, 20 bp, Artificial
  CRISPR gRNA sequence
ggggtgagctcaaggactga

SEQ ID NO: 117166 - DNA, 20 bp, Artificial
  CRISPR gRNA sequence
gggtgagctcaaggactgag

SEQ ID NO: 117167 - DNA, 20 bp, Artificial
  CRISPR gRNA sequence
aaggactgagccggttcatc

SEQ ID NO: 117168 - DNA, 20 bp, Artificial
  CRISPR gRNA sequence
agccggttcatcccaaaaga

SEQ ID NO: 117169 - DNA, 20 bp, Artificial
  CRISPR gRNA sequence
atcccaaaagatgtcctccc

SEQ ID NO: 117170 - DNA, 20 bp, Artificial
  CRISPR gRNA sequence
ccacgctaaaacgaagatac

SEQ ID NO: 117171 - DNA, 20 bp, Artificial
  CRISPR gRNA sequence
aaacgaagatactcaaagtt

SEQ ID NO: 117172 - DNA, 20 bp, Artificial
  CRISPR gRNA sequence
aaagtttcctaaggaagccg

SEQ ID NO: 117173 - DNA, 20 bp, Artificial
  CRISPR gRNA sequence
cctaaggaagccgcagcacg

SEQ ID NO: 117174 - DNA, 20 bp, Artificial
  CRISPR gRNA sequence
ctaaggaagccgcagcacga

SEQ ID NO: 117175 - DNA, 20 bp, Artificial
  CRISPR gRNA sequence
aggaagccgcagcacgaagt

SEQ ID NO: 117176 - DNA, 20 bp, Artificial
  CRISPR gRNA sequence
aactgtgccttagctcgcgg

SEQ ID NO: 117177 - DNA, 20 bp, Artificial
  CRISPR gRNA sequence
tgccttagctcgcgggaggc

SEQ ID NO: 117178 - DNA, 20 bp, Artificial
  CRISPR gRNA sequence
agctcgcgggaggctaggcc

SEQ ID NO: 117179 - DNA, 20 bp, Artificial
  CRISPR gRNA sequence
gctcgcgggaggctaggcct

SEQ ID NO: 117180 - DNA, 20 bp, Artificial
  CRISPR gRNA sequence
gcgggaggctaggcctgtaa

SEQ ID NO: 117181 - DNA, 20 bp, Artificial
  CRISPR gRNA sequence
ggcctgtaaccgtcgaggcc

SEQ ID NO: 117182 - DNA, 20 bp, Artificial
  CRISPR gRNA sequence
taaccgtcgaggcctccagg

SEQ ID NO: 117183 - DNA, 20 bp, Artificial
  CRISPR gRNA sequence
caggggcttagacccaacgg

SEQ ID NO: 117184 - DNA, 20 bp, Artificial
  CRISPR gRNA sequence
agacccaacggccgcctctc

SEQ ID NO: 117185 - DNA, 20 bp, Artificial
  CRISPR gRNA sequence
gacccaacggccgcctctcc

SEQ ID NO: 117186 - DNA, 20 bp, Artificial
  CRISPR gRNA sequence
tcccgcaggccaggagactt

SEQ ID NO: 117187 - DNA, 20 bp, Artificial
  CRISPR gRNA sequence
ccgcaggccaggagacttaa

SEQ ID NO: 117188 - DNA, 20 bp, Artificial
  CRISPR gRNA sequence
aagtgcaagtgccggccgtc

SEQ ID NO: 117189 - DNA, 20 bp, Artificial
  CRISPR gRNA sequence
agtgcaagtgccggccgtcg

SEQ ID NO: 117190 - DNA, 20 bp, Artificial
  CRISPR gRNA sequence
acccgtcacatggacgccta

SEQ ID NO: 117191 - DNA, 20 bp, Artificial
  CRISPR gRNA sequence
ggaggacgccctgggccgtg

SEQ ID NO: 117192 - DNA, 20 bp, Artificial
  CRISPR gRNA sequence
ggccgtggcgagctcgggtt

SEQ ID NO: 117193 - DNA, 20 bp, Artificial
  CRISPR gRNA sequence
gggttcccatccccgaggct

SEQ ID NO: 117194 - DNA, 20 bp, Artificial
  CRISPR gRNA sequence
ccatccccgaggcttccgaa

SEQ ID NO: 117195 - DNA, 20 bp, Artificial
  CRISPR gRNA sequence
ccgaaagaccagtaggtcgg

SEQ ID NO: 117196 - DNA, 20 bp, Artificial
  CRISPR gRNA sequence
cgaaagaccagtaggtcggg

SEQ ID NO: 117197 - DNA, 20 bp, Artificial
  CRISPR gRNA sequence
cacaggccacagaggcggcg

SEQ ID NO: 117198 - DNA, 20 bp, Artificial
  CRISPR gRNA sequence
gccggtcaccatggctgccc

SEQ ID NO: 117199 - DNA, 20 bp, Artificial
  CRISPR gRNA sequence
cccgcctaggtaccggaaac

SEQ ID NO: 117200 - DNA, 20 bp, Artificial
  CRISPR gRNA sequence
ggtaccggaaacagggccca

SEQ ID NO: 117201 - DNA, 20 bp, Artificial
  CRISPR gRNA sequence
gcaggctctattggaggcct

SEQ ID NO: 117202 - DNA, 20 bp, Artificial
  CRISPR gRNA sequence
tattggaggcctgccgccga

SEQ ID NO: 117203 - DNA, 20 bp, Artificial
  CRISPR gRNA sequence
ttggaggcctgccgccgatc

SEQ ID NO: 117204 - DNA, 20 bp, Artificial
  CRISPR gRNA sequence
gaggcctgccgccgatcaat

SEQ ID NO: 117205 - DNA, 20 bp, Artificial
  CRISPR gRNA sequence
ccgccgatcaatccgcgcag

SEQ ID NO: 117206 - DNA, 20 bp, Artificial
  CRISPR gRNA sequence
ccttgggacaacgccaatcg

SEQ ID NO: 117207 - DNA, 20 bp, Artificial
  CRISPR gRNA sequence
cttgggacaacgccaatcgg

SEQ ID NO: 117208 - DNA, 20 bp, Artificial
  CRISPR gRNA sequence
gggacaacgccaatcggaag

SEQ ID NO: 117209 - DNA, 20 bp, Artificial
  CRISPR gRNA sequence
ggacaacgccaatcggaagc

SEQ ID NO: 117210 - DNA, 20 bp, Artificial
  CRISPR gRNA sequence
cagtcgccgccccaccacct

SEQ ID NO: 117211 - DNA, 20 bp, Artificial
  CRISPR gRNA sequence
agtcgccgccccaccacctt

SEQ ID NO: 117212 - DNA, 20 bp, Artificial
  CRISPR gRNA sequence
cccacattcttagcggggcc

SEQ ID NO: 117213 - DNA, 20 bp, Artificial
  CRISPR gRNA sequence
ccacattcttagcggggcct

SEQ ID NO: 117214 - DNA, 20 bp, Artificial
  CRISPR gRNA sequence
ttagcggggcctacttcccc

SEQ ID NO: 117215 - DNA, 20 bp, Artificial
  CRISPR gRNA sequence
agcggggcctacttccccgg

SEQ ID NO: 117216 - DNA, 20 bp, Artificial
  CRISPR gRNA sequence
gcggggcctacttccccggg

SEQ ID NO: 117217 - DNA, 20 bp, Artificial
  CRISPR gRNA sequence
cttccccggggagaaggggc

SEQ ID NO: 117218 - DNA, 20 bp, Artificial
  CRISPR gRNA sequence
ccccggggagaaggggctgg

SEQ ID NO: 117219 - DNA, 20 bp, Artificial
  CRISPR gRNA sequence
cccggggagaaggggctgga

SEQ ID NO: 117220 - DNA, 20 bp, Artificial
  CRISPR gRNA sequence
gaggtgcggcggtctgcgct

SEQ ID NO: 117221 - DNA, 20 bp, Artificial
  CRISPR gRNA sequence
cgctttcaaaggagcaaagc

SEQ ID NO: 117222 - DNA, 20 bp, Artificial
  CRISPR gRNA sequence
tcaaaggagcaaagctgtct

SEQ ID NO: 117223 - DNA, 20 bp, Artificial
  CRISPR gRNA sequence
caaaggagcaaagctgtctt

SEQ ID NO: 117224 - DNA, 20 bp, Artificial
  CRISPR gRNA sequence
aaaggagcaaagctgtcttt

SEQ ID NO: 117225 - DNA, 20 bp, Artificial
  CRISPR gRNA sequence
tcttttctactggaaacggg

SEQ ID NO: 117226 - DNA, 20 bp, Artificial
  CRISPR gRNA sequence
ttctactggaaacgggggag

SEQ ID NO: 117227 - DNA, 20 bp, Artificial
  CRISPR gRNA sequence
tctactggaaacgggggagg

SEQ ID NO: 117228 - DNA, 20 bp, Artificial
  CRISPR gRNA sequence
ctactggaaacgggggaggc

SEQ ID NO: 117229 - DNA, 20 bp, Artificial
  CRISPR gRNA sequence
tactggaaacgggggaggcg

SEQ ID NO: 117230 - DNA, 20 bp, Artificial
  CRISPR gRNA sequence
ctggaaacgggggaggcgaa

SEQ ID NO: 117231 - DNA, 20 bp, Artificial
  CRISPR gRNA sequence
gaaacgggggaggcgaagac

SEQ ID NO: 117232 - DNA, 20 bp, Artificial
  CRISPR gRNA sequence
ctacgataaagccgttggtg

SEQ ID NO: 117233 - DNA, 20 bp, Artificial
  CRISPR gRNA sequence
cgataaagccgttggtgtga

SEQ ID NO: 117234 - DNA, 20 bp, Artificial
  CRISPR gRNA sequence
gtgtgagataaatatcgaga

SEQ ID NO: 117235 - DNA, 20 bp, Artificial
  CRISPR gRNA sequence
tccctcataccacagagtag

SEQ ID NO: 117236 - DNA, 20 bp, Artificial
  CRISPR gRNA sequence
ccctcataccacagagtaga

SEQ ID NO: 117237 - DNA, 20 bp, Artificial
  CRISPR gRNA sequence
cctcataccacagagtagaa

SEQ ID NO: 117238 - DNA, 20 bp, Artificial
  CRISPR gRNA sequence
ataccacagagtagaatctt

SEQ ID NO: 117239 - DNA, 20 bp, Artificial
  CRISPR gRNA sequence
gggtcatctctgaatttggt

SEQ ID NO: 117240 - DNA, 20 bp, Artificial
  CRISPR gRNA sequence
ggtcatctctgaatttggta

SEQ ID NO: 117241 - DNA, 20 bp, Artificial
  CRISPR gRNA sequence
tgaatttggtaaggacaggt

SEQ ID NO: 117242 - DNA, 20 bp, Artificial
  CRISPR gRNA sequence
aatttggtaaggacaggttc

SEQ ID NO: 117243 - DNA, 20 bp, Artificial
  CRISPR gRNA sequence
ggtaaggacaggttccactg

SEQ ID NO: 117244 - DNA, 20 bp, Artificial
  CRISPR gRNA sequence
gtaaggacaggttccactgg

SEQ ID NO: 117245 - DNA, 20 bp, Artificial
  CRISPR gRNA sequence
cactggcataaatctaagcc

SEQ ID NO: 117246 - DNA, 20 bp, Artificial
  CRISPR gRNA sequence
gcataaatctaagccaaact

SEQ ID NO: 117247 - DNA, 20 bp, Artificial
  CRISPR gRNA sequence
agccaaactcaagcacagtt

SEQ ID NO: 117248 - DNA, 20 bp, Artificial
  CRISPR gRNA sequence
aagcacagtttgactaaagc

SEQ ID NO: 117249 - DNA, 20 bp, Artificial
  CRISPR gRNA sequence
gactaaagctatcaaatact

SEQ ID NO: 117250 - DNA, 20 bp, Artificial
  CRISPR gRNA sequence
actaaagctatcaaatactg

SEQ ID NO: 117251 - DNA, 20 bp, Artificial
  CRISPR gRNA sequence
aagctatcaaatactgtcag

SEQ ID NO: 117252 - DNA, 20 bp, Artificial
  CRISPR gRNA sequence
tcaaatactgtcagtgcttt

SEQ ID NO: 117253 - DNA, 20 bp, Artificial
  CRISPR gRNA sequence
tcagtgcttttccttcattg

SEQ ID NO: 117254 - DNA, 20 bp, Artificial
  CRISPR gRNA sequence
ttccttcattgtggagagtt

SEQ ID NO: 117255 - DNA, 20 bp, Artificial
  CRISPR gRNA sequence
tccttcattgtggagagttt

SEQ ID NO: 117256 - DNA, 20 bp, Artificial
  CRISPR gRNA sequence
ccttcattgtggagagtttc

SEQ ID NO: 117257 - DNA, 20 bp, Artificial
  CRISPR gRNA sequence
cttcattgtggagagtttct

SEQ ID NO: 117258 - DNA, 20 bp, Artificial
  CRISPR gRNA sequence
cattgtggagagtttctcct

SEQ ID NO: 117259 - DNA, 20 bp, Artificial
  CRISPR gRNA sequence
attgtggagagtttctcctc

SEQ ID NO: 117260 - DNA, 20 bp, Artificial
  CRISPR gRNA sequence
tggagagtttctcctctctc

SEQ ID NO: 117261 - DNA, 20 bp, Artificial
  CRISPR gRNA sequence
ctcctctctcatctgccagg

SEQ ID NO: 117262 - DNA, 20 bp, Artificial
  CRISPR gRNA sequence
tcctctctcatctgccaggg

SEQ ID NO: 117263 - DNA, 20 bp, Artificial
  CRISPR gRNA sequence
ctctctcatctgccagggca

SEQ ID NO: 117264 - DNA, 20 bp, Artificial
  CRISPR gRNA sequence
tctcatctgccagggcaggt

SEQ ID NO: 117265 - DNA, 20 bp, Artificial
  CRISPR gRNA sequence
tcatctgccagggcaggtct

SEQ ID NO: 117266 - DNA, 20 bp, Artificial
  CRISPR gRNA sequence
atctgccagggcaggtctac

SEQ ID NO: 117267 - DNA, 20 bp, Artificial
  CRISPR gRNA sequence
ccagggcaggtctactgctc

SEQ ID NO: 117268 - DNA, 20 bp, Artificial
  CRISPR gRNA sequence
ctgctctcatcattgagtgc

SEQ ID NO: 117269 - DNA, 20 bp, Artificial
  CRISPR gRNA sequence
ctctcatcattgagtgcttc

SEQ ID NO: 117270 - DNA, 20 bp, Artificial
  CRISPR gRNA sequence
tcatcattgagtgcttcctc

SEQ ID NO: 117271 - DNA, 20 bp, Artificial
  CRISPR gRNA sequence
atcattgagtgcttcctcgg

SEQ ID NO: 117272 - DNA, 20 bp, Artificial
  CRISPR gRNA sequence
agtgcttcctcgggctgttt

SEQ ID NO: 117273 - DNA, 20 bp, Artificial
  CRISPR gRNA sequence
cctcgggctgtttgtctctt

SEQ ID NO: 117274 - DNA, 20 bp, Artificial
  CRISPR gRNA sequence
ctcgggctgtttgtctcttg

SEQ ID NO: 117275 - DNA, 20 bp, Artificial
  CRISPR gRNA sequence
gggctgtttgtctcttgtgt

SEQ ID NO: 117276 - DNA, 20 bp, Artificial
  CRISPR gRNA sequence
tttgtctcttgtgtgttgat

SEQ ID NO: 117277 - DNA, 20 bp, Artificial
  CRISPR gRNA sequence
gtctcttgtgtgttgataat

SEQ ID NO: 117278 - DNA, 20 bp, Artificial
  CRISPR gRNA sequence
tctcttgtgtgttgataatg

SEQ ID NO: 117279 - DNA, 20 bp, Artificial
  CRISPR gRNA sequence
ttgtgtgttgataatggcat

SEQ ID NO: 117280 - DNA, 20 bp, Artificial
  CRISPR gRNA sequence
gtgtgttgataatggcatat

SEQ ID NO: 117281 - DNA, 20 bp, Artificial
  CRISPR gRNA sequence
tgtgttgataatggcatatc

SEQ ID NO: 117282 - DNA, 20 bp, Artificial
  CRISPR gRNA sequence
ataatggcatatcggaggct

SEQ ID NO: 117283 - DNA, 20 bp, Artificial
  CRISPR gRNA sequence
ctagtctttgttgcttagat

SEQ ID NO: 117284 - DNA, 20 bp, Artificial
  CRISPR gRNA sequence
tagtctttgttgcttagatt

SEQ ID NO: 117285 - DNA, 20 bp, Artificial
  CRISPR gRNA sequence
gtctttgttgcttagattcc

SEQ ID NO: 117286 - DNA, 20 bp, Artificial
  CRISPR gRNA sequence
tgttgcttagattcccagcg

SEQ ID NO: 117287 - DNA, 20 bp, Artificial
  CRISPR gRNA sequence
gttgcttagattcccagcga

SEQ ID NO: 117288 - DNA, 20 bp, Artificial
  CRISPR gRNA sequence
ttgcttagattcccagcgac

SEQ ID NO: 117289 - DNA, 20 bp, Artificial
  CRISPR gRNA sequence
cttagattcccagcgaccgt

SEQ ID NO: 117290 - DNA, 20 bp, Artificial
  CRISPR gRNA sequence
agattcccagcgaccgtaag

SEQ ID NO: 117291 - DNA, 20 bp, Artificial
  CRISPR gRNA sequence
gattcccagcgaccgtaagg

SEQ ID NO: 117292 - DNA, 20 bp, Artificial
  CRISPR gRNA sequence
ccagcgaccgtaaggtaaaa

SEQ ID NO: 117293 - DNA, 20 bp, Artificial
  CRISPR gRNA sequence
tggatttttaacaatcagaa

SEQ ID NO: 117294 - DNA, 20 bp, Artificial
  CRISPR gRNA sequence
ttaacaatcagaaaagtact

SEQ ID NO: 117295 - DNA, 20 bp, Artificial
  CRISPR gRNA sequence
taacaatcagaaaagtactt

SEQ ID NO: 117296 - DNA, 20 bp, Artificial
  CRISPR gRNA sequence
aacaatcagaaaagtacttt

SEQ ID NO: 117297 - DNA, 20 bp, Artificial
  CRISPR gRNA sequence
acaatcagaaaagtactttt

SEQ ID NO: 117298 - DNA, 20 bp, Artificial
  CRISPR gRNA sequence
ttgttttggtcttctgccaa

SEQ ID NO: 117299 - DNA, 20 bp, Artificial
  CRISPR gRNA sequence
tgttttggtcttctgccaaa

SEQ ID NO: 117300 - DNA, 20 bp, Artificial
  CRISPR gRNA sequence
gttttggtcttctgccaaaa

SEQ ID NO: 117301 - DNA, 20 bp, Artificial
  CRISPR gRNA sequence
ttttggtcttctgccaaaac

SEQ ID NO: 117302 - DNA, 20 bp, Artificial
  CRISPR gRNA sequence
tggtcttctgccaaaacaaa

SEQ ID NO: 117303 - DNA, 20 bp, Artificial
  CRISPR gRNA sequence
ggtcttctgccaaaacaaaa

SEQ ID NO: 117304 - DNA, 20 bp, Artificial
  CRISPR gRNA sequence
gtcttctgccaaaacaaaat

SEQ ID NO: 117305 - DNA, 20 bp, Artificial
  CRISPR gRNA sequence
ctgccaaaacaaaatctaac

SEQ ID NO: 117306 - DNA, 20 bp, Artificial
  CRISPR gRNA sequence
tgccaaaacaaaatctaaca

SEQ ID NO: 117307 - DNA, 20 bp, Artificial
  CRISPR gRNA sequence
ccaaaacaaaatctaacaaa

SEQ ID NO: 117308 - DNA, 20 bp, Artificial
  CRISPR gRNA sequence
acaaaacgtaaatagtacat

SEQ ID NO: 117309 - DNA, 20 bp, Artificial
  CRISPR gRNA sequence
cactacctgaaattctacaa

SEQ ID NO: 117310 - DNA, 20 bp, Artificial
  CRISPR gRNA sequence
actacctgaaattctacaat

SEQ ID NO: 117311 - DNA, 20 bp, Artificial
  CRISPR gRNA sequence
cctgaaattctacaatactt

SEQ ID NO: 117312 - DNA, 20 bp, Artificial
  CRISPR gRNA sequence
aaattctacaatacttaagg

SEQ ID NO: 117313 - DNA, 20 bp, Artificial
  CRISPR gRNA sequence
tacaatacttaaggctgttt

SEQ ID NO: 117314 - DNA, 20 bp, Artificial
  CRISPR gRNA sequence
caatacttaaggctgttttt

SEQ ID NO: 117315 - DNA, 20 bp, Artificial
  CRISPR gRNA sequence
aaggctgtttttgtgataac

SEQ ID NO: 117316 - DNA, 20 bp, Artificial
  CRISPR gRNA sequence
aggctgtttttgtgataacg

SEQ ID NO: 117317 - DNA, 20 bp, Artificial
  CRISPR gRNA sequence
tttttgtgataacggctaat

SEQ ID NO: 117318 - DNA, 20 bp, Artificial
  CRISPR gRNA sequence
ttgtgataacggctaatttt

SEQ ID NO: 117319 - DNA, 20 bp, Artificial
  CRISPR gRNA sequence
tgtgataacggctaattttc

SEQ ID NO: 117320 - DNA, 20 bp, Artificial
  CRISPR gRNA sequence
gtgataacggctaattttcc

SEQ ID NO: 117321 - DNA, 20 bp, Artificial
  CRISPR gRNA sequence
tgataacggctaattttcct

SEQ ID NO: 117322 - DNA, 20 bp, Artificial
  CRISPR gRNA sequence
attttcctcatggaattact

SEQ ID NO: 117323 - DNA, 20 bp, Artificial
  CRISPR gRNA sequence
tcctcatggaattacttcat

SEQ ID NO: 117324 - DNA, 20 bp, Artificial
  CRISPR gRNA sequence
cctcatggaattacttcatc

SEQ ID NO: 117325 - DNA, 20 bp, Artificial
  CRISPR gRNA sequence
ctcatggaattacttcatca

SEQ ID NO: 117326 - DNA, 20 bp, Artificial
  CRISPR gRNA sequence
atggaattacttcatcacat

SEQ ID NO: 117327 - DNA, 20 bp, Artificial
  CRISPR gRNA sequence
cttcatcacattttgataaa

SEQ ID NO: 117328 - DNA, 20 bp, Artificial
  CRISPR gRNA sequence
catcacattttgataaacac

SEQ ID NO: 117329 - DNA, 20 bp, Artificial
  CRISPR gRNA sequence
atcacattttgataaacact

SEQ ID NO: 117330 - DNA, 20 bp, Artificial
  CRISPR gRNA sequence
tgataaacactttcagtagt

SEQ ID NO: 117331 - DNA, 20 bp, Artificial
  CRISPR gRNA sequence
gataaacactttcagtagta

SEQ ID NO: 117332 - DNA, 20 bp, Artificial
  CRISPR gRNA sequence
ataaacactttcagtagtag

SEQ ID NO: 117333 - DNA, 20 bp, Artificial
  CRISPR gRNA sequence
tcagtagtagcatcaaatgt

SEQ ID NO: 117334 - DNA, 20 bp, Artificial
  CRISPR gRNA sequence
cagtagtagcatcaaatgta

SEQ ID NO: 117335 - DNA, 20 bp, Artificial
  CRISPR gRNA sequence
agtagtagcatcaaatgtat

SEQ ID NO: 117336 - DNA, 20 bp, Artificial
  CRISPR gRNA sequence
caggtgacagaaaaaatctc

SEQ ID NO: 117337 - DNA, 20 bp, Artificial
  CRISPR gRNA sequence
ctcaacagggtggaagggcc

SEQ ID NO: 117338 - DNA, 20 bp, Artificial
  CRISPR gRNA sequence
aacagggtggaagggccaaa

SEQ ID NO: 117339 - DNA, 20 bp, Artificial
  CRISPR gRNA sequence
aggggagataaagctaagag

SEQ ID NO: 117340 - DNA, 20 bp, Artificial
  CRISPR gRNA sequence
agaggctcagacattacaag

SEQ ID NO: 117341 - DNA, 20 bp, Artificial
  CRISPR gRNA sequence
agacattacaagtttgatac

SEQ ID NO: 117342 - DNA, 20 bp, Artificial
  CRISPR gRNA sequence
caagtttgatactgtttaca

SEQ ID NO: 117343 - DNA, 20 bp, Artificial
  CRISPR gRNA sequence
gatactgtttacagagacac

SEQ ID NO: 117344 - DNA, 20 bp, Artificial
  CRISPR gRNA sequence
atactgtttacagagacacc

SEQ ID NO: 117345 - DNA, 20 bp, Artificial
  CRISPR gRNA sequence
tttacagagacaccgtccat

SEQ ID NO: 117346 - DNA, 20 bp, Artificial
  CRISPR gRNA sequence
acagagacaccgtccatgca

SEQ ID NO: 117347 - DNA, 20 bp, Artificial
  CRISPR gRNA sequence
cagagacaccgtccatgcag

SEQ ID NO: 117348 - DNA, 20 bp, Artificial
  CRISPR gRNA sequence
gtcgggggagatcaaaattt

SEQ ID NO: 117349 - DNA, 20 bp, Artificial
  CRISPR gRNA sequence
tcgggggagatcaaaatttc

SEQ ID NO: 117350 - DNA, 20 bp, Artificial
  CRISPR gRNA sequence
caacactggaaacacaaact

SEQ ID NO: 117351 - DNA, 20 bp, Artificial
  CRISPR gRNA sequence
aacactggaaacacaaacta

SEQ ID NO: 117352 - DNA, 20 bp, Artificial
  CRISPR gRNA sequence
gaaacacaaactagaaccca

SEQ ID NO: 117353 - DNA, 20 bp, Artificial
  CRISPR gRNA sequence
gaacccaggagttgcagatt

SEQ ID NO: 117354 - DNA, 20 bp, Artificial
  CRISPR gRNA sequence
cagattcctcaaaagtcaca

SEQ ID NO: 117355 - DNA, 20 bp, Artificial
  CRISPR gRNA sequence
ctcaaaagtcacattacttt

SEQ ID NO: 117356 - DNA, 20 bp, Artificial
  CRISPR gRNA sequence
aaaagtcacattacttttcg

SEQ ID NO: 117357 - DNA, 20 bp, Artificial
  CRISPR gRNA sequence
cttttcggttatttttataa

SEQ ID NO: 117358 - DNA, 20 bp, Artificial
  CRISPR gRNA sequence
ttcggttatttttataaatt

SEQ ID NO: 117359 - DNA, 20 bp, Artificial
  CRISPR gRNA sequence
tcggttatttttataaattt

SEQ ID NO: 117360 - DNA, 20 bp, Artificial
  CRISPR gRNA sequence
cggttatttttataaattta

SEQ ID NO: 117361 - DNA, 20 bp, Artificial
  CRISPR gRNA sequence
ggttatttttataaatttat

SEQ ID NO: 117362 - DNA, 20 bp, Artificial
  CRISPR gRNA sequence
tttttataaatttattttaa

SEQ ID NO: 117363 - DNA, 20 bp, Artificial
  CRISPR gRNA sequence
ttataaatttattttaaaaa

SEQ ID NO: 117364 - DNA, 20 bp, Artificial
  CRISPR gRNA sequence
tataaatttattttaaaaaa

SEQ ID NO: 117365 - DNA, 20 bp, Artificial
  CRISPR gRNA sequence
ataaatttattttaaaaaat

SEQ ID NO: 117366 - DNA, 20 bp, Artificial
  CRISPR gRNA sequence
taaatttattttaaaaaata

SEQ ID NO: 117367 - DNA, 20 bp, Artificial
  CRISPR gRNA sequence
attttaaaaaataacaattg

SEQ ID NO: 117368 - DNA, 20 bp, Artificial
  CRISPR gRNA sequence
ttttaaaaaataacaattgc

SEQ ID NO: 117369 - DNA, 20 bp, Artificial
  CRISPR gRNA sequence
taaaaaataacaattgcaat

SEQ ID NO: 117370 - DNA, 20 bp, Artificial
  CRISPR gRNA sequence
aaaaaataacaattgcaatg

SEQ ID NO: 117371 - DNA, 20 bp, Artificial
  CRISPR gRNA sequence
aaaaataacaattgcaatga

SEQ ID NO: 117372 - DNA, 20 bp, Artificial
  CRISPR gRNA sequence
caatgacattaatgatcgat

SEQ ID NO: 117373 - DNA, 20 bp, Artificial
  CRISPR gRNA sequence
atgatcgatcacctgtacgc

SEQ ID NO: 117374 - DNA, 20 bp, Artificial
  CRISPR gRNA sequence
tacgcccccatactgctggg

SEQ ID NO: 117375 - DNA, 20 bp, Artificial
  CRISPR gRNA sequence
ctgggggaaaaaccttcgat

SEQ ID NO: 117376 - DNA, 20 bp, Artificial
  CRISPR gRNA sequence
ggggaaaaaccttcgatata

SEQ ID NO: 117377 - DNA, 20 bp, Artificial
  CRISPR gRNA sequence
cgatatagttgaatcccaaa

SEQ ID NO: 117378 - DNA, 20 bp, Artificial
  CRISPR gRNA sequence
gatatagttgaatcccaaag

SEQ ID NO: 117379 - DNA, 20 bp, Artificial
  CRISPR gRNA sequence
aatcccaaagaaaaatcaag

SEQ ID NO: 117380 - DNA, 20 bp, Artificial
  CRISPR gRNA sequence
ttatcaggcaccctatagcc

SEQ ID NO: 117381 - DNA, 20 bp, Artificial
  CRISPR gRNA sequence
tcaggcaccctatagccaca

SEQ ID NO: 117382 - DNA, 20 bp, Artificial
  CRISPR gRNA sequence
tagccacaaaatgctctgtt

SEQ ID NO: 117383 - DNA, 20 bp, Artificial
  CRISPR gRNA sequence
tgttggtccagtggcatcga

SEQ ID NO: 117384 - DNA, 20 bp, Artificial
  CRISPR gRNA sequence
ttggtccagtggcatcgaca

SEQ ID NO: 117385 - DNA, 20 bp, Artificial
  CRISPR gRNA sequence
gtccagtggcatcgacactg

SEQ ID NO: 117386 - DNA, 20 bp, Artificial
  CRISPR gRNA sequence
acatgttcaatgtaccagtg

SEQ ID NO: 117387 - DNA, 20 bp, Artificial
  CRISPR gRNA sequence
aatgtaccagtgcagttaaa

SEQ ID NO: 117388 - DNA, 20 bp, Artificial
  CRISPR gRNA sequence
aaatatatacacttaaaatt

SEQ ID NO: 117389 - DNA, 20 bp, Artificial
  CRISPR gRNA sequence
aaaattatcctgcaaaaaaa

SEQ ID NO: 117390 - DNA, 20 bp, Artificial
  CRISPR gRNA sequence
aaattatcctgcaaaaaaaa

SEQ ID NO: 117391 - DNA, 20 bp, Artificial
  CRISPR gRNA sequence
tcctgcaaaaaaaaaaaaaa

SEQ ID NO: 117392 - DNA, 20 bp, Artificial
  CRISPR gRNA sequence
caaaaaaaaaaaaaagcact

SEQ ID NO: 117393 - DNA, 20 bp, Artificial
  CRISPR gRNA sequence
aagttgcataactaggcatt

SEQ ID NO: 117394 - DNA, 20 bp, Artificial
  CRISPR gRNA sequence
cataactaggcattaaacca

SEQ ID NO: 117395 - DNA, 20 bp, Artificial
  CRISPR gRNA sequence
ggcattaaaccaattattca

SEQ ID NO: 117396 - DNA, 20 bp, Artificial
  CRISPR gRNA sequence
aaccaattattcattcatcc

SEQ ID NO: 117397 - DNA, 20 bp, Artificial
  CRISPR gRNA sequence
ttcattcatccattcactct

SEQ ID NO: 117398 - DNA, 20 bp, Artificial
  CRISPR gRNA sequence
attcatccattcactctttc

SEQ ID NO: 117399 - DNA, 20 bp, Artificial
  CRISPR gRNA sequence
atccattcactctttctcca

SEQ ID NO: 117400 - DNA, 20 bp, Artificial
  CRISPR gRNA sequence
actctttctccatctgtaaa

SEQ ID NO: 117401 - DNA, 20 bp, Artificial
  CRISPR gRNA sequence
tttctccatctgtaaagtta

SEQ ID NO: 117402 - DNA, 20 bp, Artificial
  CRISPR gRNA sequence
tctccatctgtaaagttatc

SEQ ID NO: 117403 - DNA, 20 bp, Artificial
  CRISPR gRNA sequence
ctccatctgtaaagttatca

SEQ ID NO: 117404 - DNA, 20 bp, Artificial
  CRISPR gRNA sequence
tccatctgtaaagttatcac

SEQ ID NO: 117405 - DNA, 20 bp, Artificial
  CRISPR gRNA sequence
catctgtaaagttatcacta

SEQ ID NO: 117406 - DNA, 20 bp, Artificial
  CRISPR gRNA sequence
taaagttatcactacagtca

SEQ ID NO: 117407 - DNA, 20 bp, Artificial
  CRISPR gRNA sequence
tcactacagtcacaaataaa

SEQ ID NO: 117408 - DNA, 20 bp, Artificial
  CRISPR gRNA sequence
cagtcacaaataaaaatgaa

SEQ ID NO: 117409 - DNA, 20 bp, Artificial
  CRISPR gRNA sequence
gtatcaaagaaaaaatccaa

SEQ ID NO: 117410 - DNA, 20 bp, Artificial
  CRISPR gRNA sequence
cccccactttgtgggctact

SEQ ID NO: 117411 - DNA, 20 bp, Artificial
  CRISPR gRNA sequence
tgtgggctactatggtgtgc

SEQ ID NO: 117412 - DNA, 20 bp, Artificial
  CRISPR gRNA sequence
gtgggctactatggtgtgcc

SEQ ID NO: 117413 - DNA, 20 bp, Artificial
  CRISPR gRNA sequence
tgggctactatggtgtgcca

SEQ ID NO: 117414 - DNA, 20 bp, Artificial
  CRISPR gRNA sequence
ctatggtgtgccaaagtgac

SEQ ID NO: 117415 - DNA, 20 bp, Artificial
  CRISPR gRNA sequence
tggtgtgccaaagtgaccac

SEQ ID NO: 117416 - DNA, 20 bp, Artificial
  CRISPR gRNA sequence
tttgaaatgcaatgacaaaa

SEQ ID NO: 117417 - DNA, 20 bp, Artificial
  CRISPR gRNA sequence
gaaatgcaatgacaaaatga

SEQ ID NO: 117418 - DNA, 20 bp, Artificial
  CRISPR gRNA sequence
aaatgcaatgacaaaatgac

SEQ ID NO: 117419 - DNA, 20 bp, Artificial
  CRISPR gRNA sequence
aagcatttcaaacaaaattc

SEQ ID NO: 117420 - DNA, 20 bp, Artificial
  CRISPR gRNA sequence
caaacaaaattcaaagtcat

SEQ ID NO: 117421 - DNA, 20 bp, Artificial
  CRISPR gRNA sequence
aaacaaaattcaaagtcatc

SEQ ID NO: 117422 - DNA, 20 bp, Artificial
  CRISPR gRNA sequence
aaagtcatctccccccaaat

SEQ ID NO: 117423 - DNA, 20 bp, Artificial
  CRISPR gRNA sequence
cccccaaataaaaaattcag

SEQ ID NO: 117424 - DNA, 20 bp, Artificial
  CRISPR gRNA sequence
agcaacaaggctggcattac

SEQ ID NO: 117425 - DNA, 20 bp, Artificial
  CRISPR gRNA sequence
gcattactatgtacaaactt

SEQ ID NO: 117426 - DNA, 20 bp, Artificial
  CRISPR gRNA sequence
ctatgtacaaacttacagac

SEQ ID NO: 117427 - DNA, 20 bp, Artificial
  CRISPR gRNA sequence
tgtacaaacttacagacaca

SEQ ID NO: 117428 - DNA, 20 bp, Artificial
  CRISPR gRNA sequence
acagacacaaataaatagca

SEQ ID NO: 117429 - DNA, 20 bp, Artificial
  CRISPR gRNA sequence
cagacacaaataaatagcat

SEQ ID NO: 117430 - DNA, 20 bp, Artificial
  CRISPR gRNA sequence
ctaactgttggcagcttaag

SEQ ID NO: 117431 - DNA, 20 bp, Artificial
  CRISPR gRNA sequence
taactgttggcagcttaagc

SEQ ID NO: 117432 - DNA, 20 bp, Artificial
  CRISPR gRNA sequence
actgttggcagcttaagcac

SEQ ID NO: 117433 - DNA, 20 bp, Artificial
  CRISPR gRNA sequence
ttggcagcttaagcactcaa

SEQ ID NO: 117434 - DNA, 20 bp, Artificial
  CRISPR gRNA sequence
gcagcttaagcactcaaagt

SEQ ID NO: 117435 - DNA, 20 bp, Artificial
  CRISPR gRNA sequence
aagcactcaaagttaggtct

SEQ ID NO: 117436 - DNA, 20 bp, Artificial
  CRISPR gRNA sequence
agcactcaaagttaggtctg

SEQ ID NO: 117437 - DNA, 20 bp, Artificial
  CRISPR gRNA sequence
aaagttaggtctgagtaatt

SEQ ID NO: 117438 - DNA, 20 bp, Artificial
  CRISPR gRNA sequence
ggtctgagtaatttctttct

SEQ ID NO: 117439 - DNA, 20 bp, Artificial
  CRISPR gRNA sequence
agtaatttctttctgaactc

SEQ ID NO: 117440 - DNA, 20 bp, Artificial
  CRISPR gRNA sequence
ctttctgaactctgcatctt

SEQ ID NO: 117441 - DNA, 20 bp, Artificial
  CRISPR gRNA sequence
tttctgaactctgcatctta

SEQ ID NO: 117442 - DNA, 20 bp, Artificial
  CRISPR gRNA sequence
tctgaactctgcatcttaga

SEQ ID NO: 117443 - DNA, 20 bp, Artificial
  CRISPR gRNA sequence
ctgaactctgcatcttagac

SEQ ID NO: 117444 - DNA, 20 bp, Artificial
  CRISPR gRNA sequence
tgaactctgcatcttagact

SEQ ID NO: 117445 - DNA, 20 bp, Artificial
  CRISPR gRNA sequence
aactctgcatcttagactcc

SEQ ID NO: 117446 - DNA, 20 bp, Artificial
  CRISPR gRNA sequence
tgcatcttagactcctaaat

SEQ ID NO: 117447 - DNA, 20 bp, Artificial
  CRISPR gRNA sequence
catcttagactcctaaatta

SEQ ID NO: 117448 - DNA, 20 bp, Artificial
  CRISPR gRNA sequence
agactcctaaattaaccaag

SEQ ID NO: 117449 - DNA, 20 bp, Artificial
  CRISPR gRNA sequence
gactcctaaattaaccaagg

SEQ ID NO: 117450 - DNA, 20 bp, Artificial
  CRISPR gRNA sequence
ctaaattaaccaaggaatat

SEQ ID NO: 117451 - DNA, 20 bp, Artificial
  CRISPR gRNA sequence
aattaaccaaggaatataaa

SEQ ID NO: 117452 - DNA, 20 bp, Artificial
  CRISPR gRNA sequence
accaaggaatataaattcct

SEQ ID NO: 117453 - DNA, 20 bp, Artificial
  CRISPR gRNA sequence
ctcattgttagtaatctatt

SEQ ID NO: 117454 - DNA, 20 bp, Artificial
  CRISPR gRNA sequence
attgttagtaatctattctc

SEQ ID NO: 117455 - DNA, 20 bp, Artificial
  CRISPR gRNA sequence
ttagtaatctattctctgaa

SEQ ID NO: 117456 - DNA, 20 bp, Artificial
  CRISPR gRNA sequence
gtaatctattctctgaaaaa

SEQ ID NO: 117457 - DNA, 20 bp, Artificial
  CRISPR gRNA sequence
ttctctgaaaaacttgggac

SEQ ID NO: 117458 - DNA, 20 bp, Artificial
  CRISPR gRNA sequence
tctgaaaaacttgggactta

SEQ ID NO: 117459 - DNA, 20 bp, Artificial
  CRISPR gRNA sequence
tgaaaaacttgggacttact

SEQ ID NO: 117460 - DNA, 20 bp, Artificial
  CRISPR gRNA sequence
aaaaacttgggacttactga

SEQ ID NO: 117461 - DNA, 20 bp, Artificial
  CRISPR gRNA sequence
gggacttactgaataacatt

SEQ ID NO: 117462 - DNA, 20 bp, Artificial
  CRISPR gRNA sequence
ggacttactgaataacatta

SEQ ID NO: 117463 - DNA, 20 bp, Artificial
  CRISPR gRNA sequence
actgaataacattaatatcc

SEQ ID NO: 117464 - DNA, 20 bp, Artificial
  CRISPR gRNA sequence
ctgaataacattaatatccc

SEQ ID NO: 117465 - DNA, 20 bp, Artificial
  CRISPR gRNA sequence
aataacattaatatcccaaa

SEQ ID NO: 117466 - DNA, 20 bp, Artificial
  CRISPR gRNA sequence
atatcccaaactcttgtaga

SEQ ID NO: 117467 - DNA, 20 bp, Artificial
  CRISPR gRNA sequence
ttgtagagctagaagtttct

SEQ ID NO: 117468 - DNA, 20 bp, Artificial
  CRISPR gRNA sequence
gtagagctagaagtttctag

SEQ ID NO: 117469 - DNA, 20 bp, Artificial
  CRISPR gRNA sequence
tagagctagaagtttctagt

SEQ ID NO: 117470 - DNA, 20 bp, Artificial
  CRISPR gRNA sequence
gaagtttctagtgagcttac

SEQ ID NO: 117471 - DNA, 20 bp, Artificial
  CRISPR gRNA sequence
ctagtgagcttaccaaagga

SEQ ID NO: 117472 - DNA, 20 bp, Artificial
  CRISPR gRNA sequence
tagtgagcttaccaaaggat

SEQ ID NO: 117473 - DNA, 20 bp, Artificial
  CRISPR gRNA sequence
gtgagcttaccaaaggatca

SEQ ID NO: 117474 - DNA, 20 bp, Artificial
  CRISPR gRNA sequence
accaaaggatcagtcctttg

SEQ ID NO: 117475 - DNA, 20 bp, Artificial
  CRISPR gRNA sequence
ccaaaggatcagtcctttga

SEQ ID NO: 117476 - DNA, 20 bp, Artificial
  CRISPR gRNA sequence
tgacatctggaagccaggag

SEQ ID NO: 117477 - DNA, 20 bp, Artificial
  CRISPR gRNA sequence
gacatctggaagccaggagc

SEQ ID NO: 117478 - DNA, 20 bp, Artificial
  CRISPR gRNA sequence
acatctggaagccaggagcg

SEQ ID NO: 117479 - DNA, 20 bp, Artificial
  CRISPR gRNA sequence
gaagccaggagcgattacca

SEQ ID NO: 117480 - DNA, 20 bp, Artificial
  CRISPR gRNA sequence
ccagatccctgggactagga

SEQ ID NO: 117481 - DNA, 20 bp, Artificial
  CRISPR gRNA sequence
ggactaggaatatttcactt

SEQ ID NO: 117482 - DNA, 20 bp, Artificial
  CRISPR gRNA sequence
ggaatatttcacttcctgtt

SEQ ID NO: 117483 - DNA, 20 bp, Artificial
  CRISPR gRNA sequence
cacttcctgtttcctttgca

SEQ ID NO: 117484 - DNA, 20 bp, Artificial
  CRISPR gRNA sequence
acttcctgtttcctttgcat

SEQ ID NO: 117485 - DNA, 20 bp, Artificial
  CRISPR gRNA sequence
cctgtttcctttgcatagct

SEQ ID NO: 117486 - DNA, 20 bp, Artificial
  CRISPR gRNA sequence
ctgtttcctttgcatagctc

SEQ ID NO: 117487 - DNA, 20 bp, Artificial
  CRISPR gRNA sequence
tttcctttgcatagctctgt

SEQ ID NO: 117488 - DNA, 20 bp, Artificial
  CRISPR gRNA sequence
cctttgcatagctctgtacc

SEQ ID NO: 117489 - DNA, 20 bp, Artificial
  CRISPR gRNA sequence
ctttgcatagctctgtacct

SEQ ID NO: 117490 - DNA, 20 bp, Artificial
  CRISPR gRNA sequence
tgcatagctctgtacctcta

SEQ ID NO: 117491 - DNA, 20 bp, Artificial
  CRISPR gRNA sequence
gcatagctctgtacctctat

SEQ ID NO: 117492 - DNA, 20 bp, Artificial
  CRISPR gRNA sequence
catagctctgtacctctatt

SEQ ID NO: 117493 - DNA, 20 bp, Artificial
  CRISPR gRNA sequence
tgtacctctatttctatcat

SEQ ID NO: 117494 - DNA, 20 bp, Artificial
  CRISPR gRNA sequence
tacctctatttctatcatta

SEQ ID NO: 117495 - DNA, 20 bp, Artificial
  CRISPR gRNA sequence
tatttctatcattacaatca

SEQ ID NO: 117496 - DNA, 20 bp, Artificial
  CRISPR gRNA sequence
tttctatcattacaatcatc

SEQ ID NO: 117497 - DNA, 20 bp, Artificial
  CRISPR gRNA sequence
ctatcattacaatcatctct

SEQ ID NO: 117498 - DNA, 20 bp, Artificial
  CRISPR gRNA sequence
tatcattacaatcatctctc

SEQ ID NO: 117499 - DNA, 20 bp, Artificial
  CRISPR gRNA sequence
tcattacaatcatctctctt

SEQ ID NO: 117500 - DNA, 20 bp, Artificial
  CRISPR gRNA sequence
caatcatctctctttgtggt

SEQ ID NO: 117501 - DNA, 20 bp, Artificial
  CRISPR gRNA sequence
tctttgtggtgtttttagag

SEQ ID NO: 117502 - DNA, 20 bp, Artificial
  CRISPR gRNA sequence
tttgtggtgtttttagaggg

SEQ ID NO: 117503 - DNA, 20 bp, Artificial
  CRISPR gRNA sequence
tgtggtgtttttagagggct

SEQ ID NO: 117504 - DNA, 20 bp, Artificial
  CRISPR gRNA sequence
gtggtgtttttagagggctt

SEQ ID NO: 117505 - DNA, 20 bp, Artificial
  CRISPR gRNA sequence
tggtgtttttagagggctta

SEQ ID NO: 117506 - DNA, 20 bp, Artificial
  CRISPR gRNA sequence
ttagagggcttaatttctgt

SEQ ID NO: 117507 - DNA, 20 bp, Artificial
  CRISPR gRNA sequence
tagagggcttaatttctgtc

SEQ ID NO: 117508 - DNA, 20 bp, Artificial
  CRISPR gRNA sequence
agagggcttaatttctgtct

SEQ ID NO: 117509 - DNA, 20 bp, Artificial
  CRISPR gRNA sequence
gagggcttaatttctgtctt

SEQ ID NO: 117510 - DNA, 20 bp, Artificial
  CRISPR gRNA sequence
aatttctgtcttaatacagt

SEQ ID NO: 117511 - DNA, 20 bp, Artificial
  CRISPR gRNA sequence
atttctgtcttaatacagtt

SEQ ID NO: 117512 - DNA, 20 bp, Artificial
  CRISPR gRNA sequence
ctgtcttaatacagttaagc

SEQ ID NO: 117513 - DNA, 20 bp, Artificial
  CRISPR gRNA sequence
tgtcttaatacagttaagct

SEQ ID NO: 117514 - DNA, 20 bp, Artificial
  CRISPR gRNA sequence
tcttaatacagttaagctga

SEQ ID NO: 117515 - DNA, 20 bp, Artificial
  CRISPR gRNA sequence
aatacagttaagctgaagtc

SEQ ID NO: 117516 - DNA, 20 bp, Artificial
  CRISPR gRNA sequence
atacagttaagctgaagtca

SEQ ID NO: 117517 - DNA, 20 bp, Artificial
  CRISPR gRNA sequence
agctgaagtcaaagaagaac

SEQ ID NO: 117518 - DNA, 20 bp, Artificial
  CRISPR gRNA sequence
aagtcaaagaagaaccaatt

SEQ ID NO: 117519 - DNA, 20 bp, Artificial
  CRISPR gRNA sequence
ttattcttggtatttaaccc

SEQ ID NO: 117520 - DNA, 20 bp, Artificial
  CRISPR gRNA sequence
tattcttggtatttaacccc

SEQ ID NO: 117521 - DNA, 20 bp, Artificial
  CRISPR gRNA sequence
attcttggtatttaaccccc

SEQ ID NO: 117522 - DNA, 20 bp, Artificial
  CRISPR gRNA sequence
ttcttggtatttaaccccca

SEQ ID NO: 117523 - DNA, 20 bp, Artificial
  CRISPR gRNA sequence
ttggtatttaacccccaatg

SEQ ID NO: 117524 - DNA, 20 bp, Artificial
  CRISPR gRNA sequence
ggtatttaacccccaatgtt

SEQ ID NO: 117525 - DNA, 20 bp, Artificial
  CRISPR gRNA sequence
gtatttaacccccaatgttc

SEQ ID NO: 117526 - DNA, 20 bp, Artificial
  CRISPR gRNA sequence
aacccccaatgttcctcgga

SEQ ID NO: 117527 - DNA, 20 bp, Artificial
  CRISPR gRNA sequence
acccccaatgttcctcggaa

SEQ ID NO: 117528 - DNA, 20 bp, Artificial
  CRISPR gRNA sequence
ctcggaattattgggttttc

SEQ ID NO: 117529 - DNA, 20 bp, Artificial
  CRISPR gRNA sequence
ggaattattgggttttcctt

SEQ ID NO: 117530 - DNA, 20 bp, Artificial
  CRISPR gRNA sequence
ttgggttttccttgtttcca

SEQ ID NO: 117531 - DNA, 20 bp, Artificial
  CRISPR gRNA sequence
ggttttccttgtttccagag

SEQ ID NO: 117532 - DNA, 20 bp, Artificial
  CRISPR gRNA sequence
tccttgtttccagagaaggc

SEQ ID NO: 117533 - DNA, 20 bp, Artificial
  CRISPR gRNA sequence
ccttgtttccagagaaggca

SEQ ID NO: 117534 - DNA, 20 bp, Artificial
  CRISPR gRNA sequence
cttgtttccagagaaggcag

SEQ ID NO: 117535 - DNA, 20 bp, Artificial
  CRISPR gRNA sequence
gtttccagagaaggcagcca

SEQ ID NO: 117536 - DNA, 20 bp, Artificial
  CRISPR gRNA sequence
tttccagagaaggcagccaa

SEQ ID NO: 117537 - DNA, 20 bp, Artificial
  CRISPR gRNA sequence
ccagagaaggcagccaactc

SEQ ID NO: 117538 - DNA, 20 bp, Artificial
  CRISPR gRNA sequence
cagagaaggcagccaactct

SEQ ID NO: 117539 - DNA, 20 bp, Artificial
  CRISPR gRNA sequence
ttctgaaatatcatcttagt

SEQ ID NO: 117540 - DNA, 20 bp, Artificial
  CRISPR gRNA sequence
ctgaaatatcatcttagttc

SEQ ID NO: 117541 - DNA, 20 bp, Artificial
  CRISPR gRNA sequence
tgaaatatcatcttagttct

SEQ ID NO: 117542 - DNA, 20 bp, Artificial
  CRISPR gRNA sequence
aaatatcatcttagttctct

SEQ ID NO: 117543 - DNA, 20 bp, Artificial
  CRISPR gRNA sequence
agttctctcagggttcaaca

SEQ ID NO: 117544 - DNA, 20 bp, Artificial
  CRISPR gRNA sequence
gttctctcagggttcaacat

SEQ ID NO: 117545 - DNA, 20 bp, Artificial
  CRISPR gRNA sequence
tctcagggttcaacatctaa

SEQ ID NO: 117546 - DNA, 20 bp, Artificial
  CRISPR gRNA sequence
tcagggttcaacatctaaaa

SEQ ID NO: 117547 - DNA, 20 bp, Artificial
  CRISPR gRNA sequence
agggttcaacatctaaaaga

SEQ ID NO: 117548 - DNA, 20 bp, Artificial
  CRISPR gRNA sequence
aacatctaaaagagaaatag

SEQ ID NO: 117549 - DNA, 20 bp, Artificial
  CRISPR gRNA sequence
aaagagaaatagatttctga

SEQ ID NO: 117550 - DNA, 20 bp, Artificial
  CRISPR gRNA sequence
ctgaggcacaacccgttctg

SEQ ID NO: 117551 - DNA, 20 bp, Artificial
  CRISPR gRNA sequence
tgaggcacaacccgttctgg

SEQ ID NO: 117552 - DNA, 20 bp, Artificial
  CRISPR gRNA sequence
aggcacaacccgttctggga

SEQ ID NO: 117553 - DNA, 20 bp, Artificial
  CRISPR gRNA sequence
tgggaacagtggcccagttc

SEQ ID NO: 117554 - DNA, 20 bp, Artificial
  CRISPR gRNA sequence
ggaacagtggcccagttcct

SEQ ID NO: 117555 - DNA, 20 bp, Artificial
  CRISPR gRNA sequence
ctgaccctgcaggcatgttt

SEQ ID NO: 117556 - DNA, 20 bp, Artificial
  CRISPR gRNA sequence
accctgcaggcatgtttctt

SEQ ID NO: 117557 - DNA, 20 bp, Artificial
  CRISPR gRNA sequence
caggcatgtttctttcagtc

SEQ ID NO: 117558 - DNA, 20 bp, Artificial
  CRISPR gRNA sequence
ctttcagtctgcagtttatt

SEQ ID NO: 117559 - DNA, 20 bp, Artificial
  CRISPR gRNA sequence
tttcagtctgcagtttattc

SEQ ID NO: 117560 - DNA, 20 bp, Artificial
  CRISPR gRNA sequence
tcagtctgcagtttattctc

SEQ ID NO: 117561 - DNA, 20 bp, Artificial
  CRISPR gRNA sequence
cagtctgcagtttattctca

SEQ ID NO: 117562 - DNA, 20 bp, Artificial
  CRISPR gRNA sequence
agtctgcagtttattctcac

SEQ ID NO: 117563 - DNA, 20 bp, Artificial
  CRISPR gRNA sequence
cagtttattctcacagtatg

SEQ ID NO: 117564 - DNA, 20 bp, Artificial
  CRISPR gRNA sequence
attctcacagtatggatgca

SEQ ID NO: 117565 - DNA, 20 bp, Artificial
  CRISPR gRNA sequence
ttctcacagtatggatgcaa

SEQ ID NO: 117566 - DNA, 20 bp, Artificial
  CRISPR gRNA sequence
tcacagtatggatgcaatga

SEQ ID NO: 117567 - DNA, 20 bp, Artificial
  CRISPR gRNA sequence
acagtatggatgcaatgaga

SEQ ID NO: 117568 - DNA, 20 bp, Artificial
  CRISPR gRNA sequence
tctgcacaaggcctatggag

SEQ ID NO: 117569 - DNA, 20 bp, Artificial
  CRISPR gRNA sequence
ctgcacaaggcctatggaga

SEQ ID NO: 117570 - DNA, 20 bp, Artificial
  CRISPR gRNA sequence
tgcacaaggcctatggagaa

SEQ ID NO: 117571 - DNA, 20 bp, Artificial
  CRISPR gRNA sequence
cacaaggcctatggagaaaa

SEQ ID NO: 117572 - DNA, 20 bp, Artificial
  CRISPR gRNA sequence
tggagaaaacatgaaaactg

SEQ ID NO: 117573 - DNA, 20 bp, Artificial
  CRISPR gRNA sequence
gcaccaaagaatcagctgcc

SEQ ID NO: 117574 - DNA, 20 bp, Artificial
  CRISPR gRNA sequence
ccatgggaagaatgaaaatg

SEQ ID NO: 117575 - DNA, 20 bp, Artificial
  CRISPR gRNA sequence
gctttctagggccagcattg

SEQ ID NO: 117576 - DNA, 20 bp, Artificial
  CRISPR gRNA sequence
tctagggccagcattgtgct

SEQ ID NO: 117577 - DNA, 20 bp, Artificial
  CRISPR gRNA sequence
ctagggccagcattgtgctg

SEQ ID NO: 117578 - DNA, 20 bp, Artificial
  CRISPR gRNA sequence
tagggccagcattgtgctgc

SEQ ID NO: 117579 - DNA, 20 bp, Artificial
  CRISPR gRNA sequence
gggccagcattgtgctgcag

SEQ ID NO: 117580 - DNA, 20 bp, Artificial
  CRISPR gRNA sequence
tgctgcaggagtgaagccaa

SEQ ID NO: 117581 - DNA, 20 bp, Artificial
  CRISPR gRNA sequence
caggagtgaagccaacatcc

SEQ ID NO: 117582 - DNA, 20 bp, Artificial
  CRISPR gRNA sequence
aagctttagtgggtaacttg

SEQ ID NO: 117583 - DNA, 20 bp, Artificial
  CRISPR gRNA sequence
tagtgggtaacttggactct

SEQ ID NO: 117584 - DNA, 20 bp, Artificial
  CRISPR gRNA sequence
agtgggtaacttggactctg

SEQ ID NO: 117585 - DNA, 20 bp, Artificial
  CRISPR gRNA sequence
gtgggtaacttggactctgt

SEQ ID NO: 117586 - DNA, 20 bp, Artificial
  CRISPR gRNA sequence
ggactctgtccaggacagtg

SEQ ID NO: 117587 - DNA, 20 bp, Artificial
  CRISPR gRNA sequence
gactctgtccaggacagtgt

SEQ ID NO: 117588 - DNA, 20 bp, Artificial
  CRISPR gRNA sequence
tgtccaggacagtgtgactg

SEQ ID NO: 117589 - DNA, 20 bp, Artificial
  CRISPR gRNA sequence
tccaggacagtgtgactgac

SEQ ID NO: 117590 - DNA, 20 bp, Artificial
  CRISPR gRNA sequence
accagtgctttccagaaatt

SEQ ID NO: 117591 - DNA, 20 bp, Artificial
  CRISPR gRNA sequence
tccagaaattgtcaaggatc

SEQ ID NO: 117592 - DNA, 20 bp, Artificial
  CRISPR gRNA sequence
ccagaaattgtcaaggatca

SEQ ID NO: 117593 - DNA, 20 bp, Artificial
  CRISPR gRNA sequence
cagaaattgtcaaggatcaa

SEQ ID NO: 117594 - DNA, 20 bp, Artificial
  CRISPR gRNA sequence
tcaaggatcaaatctcaggc

SEQ ID NO: 117595 - DNA, 20 bp, Artificial
  CRISPR gRNA sequence
aggcttcttcctttcagtgc

SEQ ID NO: 117596 - DNA, 20 bp, Artificial
  CRISPR gRNA sequence
cttcctttcagtgcttgtta

SEQ ID NO: 117597 - DNA, 20 bp, Artificial
  CRISPR gRNA sequence
ttcctttcagtgcttgttaa

SEQ ID NO: 117598 - DNA, 20 bp, Artificial
  CRISPR gRNA sequence
cctttcagtgcttgttaaag

SEQ ID NO: 117599 - DNA, 20 bp, Artificial
  CRISPR gRNA sequence
ctttcagtgcttgttaaagg

SEQ ID NO: 117600 - DNA, 20 bp, Artificial
  CRISPR gRNA sequence
tcagtgcttgttaaaggttc

SEQ ID NO: 117601 - DNA, 20 bp, Artificial
  CRISPR gRNA sequence
cagtgcttgttaaaggttct

SEQ ID NO: 117602 - DNA, 20 bp, Artificial
  CRISPR gRNA sequence
agtgcttgttaaaggttcta

SEQ ID NO: 117603 - DNA, 20 bp, Artificial
  CRISPR gRNA sequence
gttaaaggttctagagtaaa

SEQ ID NO: 117604 - DNA, 20 bp, Artificial
  CRISPR gRNA sequence
ttaaaggttctagagtaaat

SEQ ID NO: 117605 - DNA, 20 bp, Artificial
  CRISPR gRNA sequence
aaggttctagagtaaatgtg

SEQ ID NO: 117606 - DNA, 20 bp, Artificial
  CRISPR gRNA sequence
tagagtaaatgtgaattact

SEQ ID NO: 117607 - DNA, 20 bp, Artificial
  CRISPR gRNA sequence
gagtaaatgtgaattactct

SEQ ID NO: 117608 - DNA, 20 bp, Artificial
  CRISPR gRNA sequence
ctctcttcatcttaatgatc

SEQ ID NO: 117609 - DNA, 20 bp, Artificial
  CRISPR gRNA sequence
tcttcatcttaatgatccat

SEQ ID NO: 117610 - DNA, 20 bp, Artificial
  CRISPR gRNA sequence
ttcatcttaatgatccattc

SEQ ID NO: 117611 - DNA, 20 bp, Artificial
  CRISPR gRNA sequence
catcttaatgatccattcca

SEQ ID NO: 117612 - DNA, 20 bp, Artificial
  CRISPR gRNA sequence
atcttaatgatccattccag

SEQ ID NO: 117613 - DNA, 20 bp, Artificial
  CRISPR gRNA sequence
aatgatccattccaggtatc

SEQ ID NO: 117614 - DNA, 20 bp, Artificial
  CRISPR gRNA sequence
atgatccattccaggtatcc

SEQ ID NO: 117615 - DNA, 20 bp, Artificial
  CRISPR gRNA sequence
caggtatccatccactggag

SEQ ID NO: 117616 - DNA, 20 bp, Artificial
  CRISPR gRNA sequence
gagaatcgtgctctatgata

SEQ ID NO: 117617 - DNA, 20 bp, Artificial
  CRISPR gRNA sequence
tatgataacatacgggtata

SEQ ID NO: 117618 - DNA, 20 bp, Artificial
  CRISPR gRNA sequence
tgataacatacgggtataca

SEQ ID NO: 117619 - DNA, 20 bp, Artificial
  CRISPR gRNA sequence
tctctctctcttcctctccc

SEQ ID NO: 117620 - DNA, 20 bp, Artificial
  CRISPR gRNA sequence
tctctctcttcctctccccc

SEQ ID NO: 117621 - DNA, 20 bp, Artificial
  CRISPR gRNA sequence
tctctcttcctctcccccac

SEQ ID NO: 117622 - DNA, 20 bp, Artificial
  CRISPR gRNA sequence
tctcttcctctcccccactc

SEQ ID NO: 117623 - DNA, 20 bp, Artificial
  CRISPR gRNA sequence
tcttcctctcccccactctc

SEQ ID NO: 117624 - DNA, 20 bp, Artificial
  CRISPR gRNA sequence
ttcctctcccccactctctc

SEQ ID NO: 117625 - DNA, 20 bp, Artificial
  CRISPR gRNA sequence
cctctcccccactctctccc

SEQ ID NO: 117626 - DNA, 20 bp, Artificial
  CRISPR gRNA sequence
ctctcccccactctctccca

SEQ ID NO: 117627 - DNA, 20 bp, Artificial
  CRISPR gRNA sequence
tcccccactctctcccacta

SEQ ID NO: 117628 - DNA, 20 bp, Artificial
  CRISPR gRNA sequence
ccccactctctcccactagg

SEQ ID NO: 117629 - DNA, 20 bp, Artificial
  CRISPR gRNA sequence
tctcccactaggctgaaaca

SEQ ID NO: 117630 - DNA, 20 bp, Artificial
  CRISPR gRNA sequence
tcccactaggctgaaacaca

SEQ ID NO: 117631 - DNA, 20 bp, Artificial
  CRISPR gRNA sequence
ccactaggctgaaacacatg

SEQ ID NO: 117632 - DNA, 20 bp, Artificial
  CRISPR gRNA sequence
ggctgaaacacatgaatctt

SEQ ID NO: 117633 - DNA, 20 bp, Artificial
  CRISPR gRNA sequence
aaacacatgaatcttttagt

SEQ ID NO: 117634 - DNA, 20 bp, Artificial
  CRISPR gRNA sequence
ttagttccccaaatgctgtc

SEQ ID NO: 117635 - DNA, 20 bp, Artificial
  CRISPR gRNA sequence
tagttccccaaatgctgtca

SEQ ID NO: 117636 - DNA, 20 bp, Artificial
  CRISPR gRNA sequence
agttccccaaatgctgtcac

SEQ ID NO: 117637 - DNA, 20 bp, Artificial
  CRISPR gRNA sequence
gttccccaaatgctgtcaca

SEQ ID NO: 117638 - DNA, 20 bp, Artificial
  CRISPR gRNA sequence
cccaaatgctgtcacaaagt

SEQ ID NO: 117639 - DNA, 20 bp, Artificial
  CRISPR gRNA sequence
tcacaaagtctatgattgaa

SEQ ID NO: 117640 - DNA, 20 bp, Artificial
  CRISPR gRNA sequence
tgattgaaaatctctagttt

SEQ ID NO: 117641 - DNA, 20 bp, Artificial
  CRISPR gRNA sequence
aaaatctctagtttggccct

SEQ ID NO: 117642 - DNA, 20 bp, Artificial
  CRISPR gRNA sequence
tagtttggcccttcctttag

SEQ ID NO: 117643 - DNA, 20 bp, Artificial
  CRISPR gRNA sequence
gtttggcccttcctttagga

SEQ ID NO: 117644 - DNA, 20 bp, Artificial
  CRISPR gRNA sequence
ggcccttcctttaggagtat

SEQ ID NO: 117645 - DNA, 20 bp, Artificial
  CRISPR gRNA sequence
gcccttcctttaggagtatt

SEQ ID NO: 117646 - DNA, 20 bp, Artificial
  CRISPR gRNA sequence
cctttaggagtattacaaat

SEQ ID NO: 117647 - DNA, 20 bp, Artificial
  CRISPR gRNA sequence
ctttaggagtattacaaatc

SEQ ID NO: 117648 - DNA, 20 bp, Artificial
  CRISPR gRNA sequence
taggagtattacaaatctcc

SEQ ID NO: 117649 - DNA, 20 bp, Artificial
  CRISPR gRNA sequence
aggagtattacaaatctcct

SEQ ID NO: 117650 - DNA, 20 bp, Artificial
  CRISPR gRNA sequence
ggagtattacaaatctcctc

SEQ ID NO: 117651 - DNA, 20 bp, Artificial
  CRISPR gRNA sequence
caaatctcctcagtgcttca

SEQ ID NO: 117652 - DNA, 20 bp, Artificial
  CRISPR gRNA sequence
ctcagtgcttcagcaaagaa

SEQ ID NO: 117653 - DNA, 20 bp, Artificial
  CRISPR gRNA sequence
agtgcttcagcaaagaagtt

SEQ ID NO: 117654 - DNA, 20 bp, Artificial
  CRISPR gRNA sequence
cagcaaagaagttgttgaat

SEQ ID NO: 117655 - DNA, 20 bp, Artificial
  CRISPR gRNA sequence
agcaaagaagttgttgaata

SEQ ID NO: 117656 - DNA, 20 bp, Artificial
  CRISPR gRNA sequence
ttgaatagtcttgttctcta

SEQ ID NO: 117657 - DNA, 20 bp, Artificial
  CRISPR gRNA sequence
aatagtcttgttctctactt

SEQ ID NO: 117658 - DNA, 20 bp, Artificial
  CRISPR gRNA sequence
gttctctacttaggaaaggc

SEQ ID NO: 117659 - DNA, 20 bp, Artificial
  CRISPR gRNA sequence
ttctctacttaggaaaggca

SEQ ID NO: 117660 - DNA, 20 bp, Artificial
  CRISPR gRNA sequence
tctacttaggaaaggcagtt

SEQ ID NO: 117661 - DNA, 20 bp, Artificial
  CRISPR gRNA sequence
tacttaggaaaggcagtttc

SEQ ID NO: 117662 - DNA, 20 bp, Artificial
  CRISPR gRNA sequence
cttaggaaaggcagtttcaa

SEQ ID NO: 117663 - DNA, 20 bp, Artificial
  CRISPR gRNA sequence
aggaaaggcagtttcaaggt

SEQ ID NO: 117664 - DNA, 20 bp, Artificial
  CRISPR gRNA sequence
ggaaaggcagtttcaaggtt

SEQ ID NO: 117665 - DNA, 20 bp, Artificial
  CRISPR gRNA sequence
caaggtttaataaccctcta

SEQ ID NO: 117666 - DNA, 20 bp, Artificial
  CRISPR gRNA sequence
aaggtttaataaccctctac

SEQ ID NO: 117667 - DNA, 20 bp, Artificial
  CRISPR gRNA sequence
aataaccctctacattgtct

SEQ ID NO: 117668 - DNA, 20 bp, Artificial
  CRISPR gRNA sequence
ataaccctctacattgtctt

SEQ ID NO: 117669 - DNA, 20 bp, Artificial
  CRISPR gRNA sequence
tacattgtcttagaagtagc

SEQ ID NO: 117670 - DNA, 20 bp, Artificial
  CRISPR gRNA sequence
cattgtcttagaagtagcca

SEQ ID NO: 117671 - DNA, 20 bp, Artificial
  CRISPR gRNA sequence
tcttagaagtagccacagca

SEQ ID NO: 117672 - DNA, 20 bp, Artificial
  CRISPR gRNA sequence
agaagtagccacagcaagta

SEQ ID NO: 117673 - DNA, 20 bp, Artificial
  CRISPR gRNA sequence
gaagtagccacagcaagtac

SEQ ID NO: 117674 - DNA, 20 bp, Artificial
  CRISPR gRNA sequence
ttcaaagctagaaaaagaga

SEQ ID NO: 117675 - DNA, 20 bp, Artificial
  CRISPR gRNA sequence
tcaaagctagaaaaagagat

SEQ ID NO: 117676 - DNA, 20 bp, Artificial
  CRISPR gRNA sequence
caaagctagaaaaagagatt

SEQ ID NO: 117677 - DNA, 20 bp, Artificial
  CRISPR gRNA sequence
aaagctagaaaaagagattc

SEQ ID NO: 117678 - DNA, 20 bp, Artificial
  CRISPR gRNA sequence
gaaaaagagattcggcaatg

SEQ ID NO: 117679 - DNA, 20 bp, Artificial
  CRISPR gRNA sequence
ggcaatgtatatttttagtg

SEQ ID NO: 117680 - DNA, 20 bp, Artificial
  CRISPR gRNA sequence
ttagtgcttgagtcttttat

SEQ ID NO: 117681 - DNA, 20 bp, Artificial
  CRISPR gRNA sequence
tagtgcttgagtcttttatc

SEQ ID NO: 117682 - DNA, 20 bp, Artificial
  CRISPR gRNA sequence
agtgcttgagtcttttatca

SEQ ID NO: 117683 - DNA, 20 bp, Artificial
  CRISPR gRNA sequence
gtgcttgagtcttttatcat

SEQ ID NO: 117684 - DNA, 20 bp, Artificial
  CRISPR gRNA sequence
gagtcttttatcattctatc

SEQ ID NO: 117685 - DNA, 20 bp, Artificial
  CRISPR gRNA sequence
agtcttttatcattctatcc

SEQ ID NO: 117686 - DNA, 20 bp, Artificial
  CRISPR gRNA sequence
ttatcattctatccccagaa

SEQ ID NO: 117687 - DNA, 20 bp, Artificial
  CRISPR gRNA sequence
tatcattctatccccagaat

SEQ ID NO: 117688 - DNA, 20 bp, Artificial
  CRISPR gRNA sequence
atcattctatccccagaatt

SEQ ID NO: 117689 - DNA, 20 bp, Artificial
  CRISPR gRNA sequence
tcattctatccccagaatta

SEQ ID NO: 117690 - DNA, 20 bp, Artificial
  CRISPR gRNA sequence
tatccccagaattagctttt

SEQ ID NO: 117691 - DNA, 20 bp, Artificial
  CRISPR gRNA sequence
tccccagaattagctttttc

SEQ ID NO: 117692 - DNA, 20 bp, Artificial
  CRISPR gRNA sequence
gctttttcttggctagagtc

SEQ ID NO: 117693 - DNA, 20 bp, Artificial
  CRISPR gRNA sequence
tttcttggctagagtccaga

SEQ ID NO: 117694 - DNA, 20 bp, Artificial
  CRISPR gRNA sequence
ttcttggctagagtccagaa

SEQ ID NO: 117695 - DNA, 20 bp, Artificial
  CRISPR gRNA sequence
tcttggctagagtccagaaa

SEQ ID NO: 117696 - DNA, 20 bp, Artificial
  CRISPR gRNA sequence
cttggctagagtccagaaat

SEQ ID NO: 117697 - DNA, 20 bp, Artificial
  CRISPR gRNA sequence
ttggctagagtccagaaata

SEQ ID NO: 117698 - DNA, 20 bp, Artificial
  CRISPR gRNA sequence
ggctagagtccagaaatatc

SEQ ID NO: 117699 - DNA, 20 bp, Artificial
  CRISPR gRNA sequence
gctagagtccagaaatatca

SEQ ID NO: 117700 - DNA, 20 bp, Artificial
  CRISPR gRNA sequence
gagtccagaaatatcaacct

SEQ ID NO: 117701 - DNA, 20 bp, Artificial
  CRISPR gRNA sequence
ccatctgggcagagaggaat

SEQ ID NO: 117702 - DNA, 20 bp, Artificial
  CRISPR gRNA sequence
ggcagagaggaattcttatt

SEQ ID NO: 117703 - DNA, 20 bp, Artificial
  CRISPR gRNA sequence
ttattattaccacagattgg

SEQ ID NO: 117704 - DNA, 20 bp, Artificial
  CRISPR gRNA sequence
attattaccacagattggaa

SEQ ID NO: 117705 - DNA, 20 bp, Artificial
  CRISPR gRNA sequence
ttattaccacagattggaag

SEQ ID NO: 117706 - DNA, 20 bp, Artificial
  CRISPR gRNA sequence
ttaccacagattggaagaat

SEQ ID NO: 117707 - DNA, 20 bp, Artificial
  CRISPR gRNA sequence
ccacagattggaagaatgta

SEQ ID NO: 117708 - DNA, 20 bp, Artificial
  CRISPR gRNA sequence
gaagaatgtatctcaggaat

SEQ ID NO: 117709 - DNA, 20 bp, Artificial
  CRISPR gRNA sequence
aggaatttattgtttccgta

SEQ ID NO: 117710 - DNA, 20 bp, Artificial
  CRISPR gRNA sequence
attgtttccgtatcacaaga

SEQ ID NO: 117711 - DNA, 20 bp, Artificial
  CRISPR gRNA sequence
ttgtttccgtatcacaagat

SEQ ID NO: 117712 - DNA, 20 bp, Artificial
  CRISPR gRNA sequence
tttccgtatcacaagataga

SEQ ID NO: 117713 - DNA, 20 bp, Artificial
  CRISPR gRNA sequence
ccgtatcacaagatagaact

SEQ ID NO: 117714 - DNA, 20 bp, Artificial
  CRISPR gRNA sequence
cgtatcacaagatagaactt

SEQ ID NO: 117715 - DNA, 20 bp, Artificial
  CRISPR gRNA sequence
ccttgcctggaagccatctc

SEQ ID NO: 117716 - DNA, 20 bp, Artificial
  CRISPR gRNA sequence
cttgcctggaagccatctct

SEQ ID NO: 117717 - DNA, 20 bp, Artificial
  CRISPR gRNA sequence
gcctggaagccatctctgaa

SEQ ID NO: 117718 - DNA, 20 bp, Artificial
  CRISPR gRNA sequence
cctggaagccatctctgaat

SEQ ID NO: 117719 - DNA, 20 bp, Artificial
  CRISPR gRNA sequence
gaagccatctctgaatacaa

SEQ ID NO: 117720 - DNA, 20 bp, Artificial
  CRISPR gRNA sequence
tgaatacaaagcgtccattc

SEQ ID NO: 117721 - DNA, 20 bp, Artificial
  CRISPR gRNA sequence
aatacaaagcgtccattcag

SEQ ID NO: 117722 - DNA, 20 bp, Artificial
  CRISPR gRNA sequence
agttagtcagtgtgagattc

SEQ ID NO: 117723 - DNA, 20 bp, Artificial
  CRISPR gRNA sequence
gtcagtgtgagattccccca

SEQ ID NO: 117724 - DNA, 20 bp, Artificial
  CRISPR gRNA sequence
ccccaccagagggataaatg

SEQ ID NO: 117725 - DNA, 20 bp, Artificial
  CRISPR gRNA sequence
tctagattccatgggaagga

SEQ ID NO: 117726 - DNA, 20 bp, Artificial
  CRISPR gRNA sequence
gattccatgggaaggagtgg

SEQ ID NO: 117727 - DNA, 20 bp, Artificial
  CRISPR gRNA sequence
catgggaaggagtgggctgc

SEQ ID NO: 117728 - DNA, 20 bp, Artificial
  CRISPR gRNA sequence
ctgctttcctgattgcagtt

SEQ ID NO: 117729 - DNA, 20 bp, Artificial
  CRISPR gRNA sequence
ctttcctgattgcagttttg

SEQ ID NO: 117730 - DNA, 20 bp, Artificial
  CRISPR gRNA sequence
tcctgattgcagttttggtt

SEQ ID NO: 117731 - DNA, 20 bp, Artificial
  CRISPR gRNA sequence
cctgattgcagttttggttg

SEQ ID NO: 117732 - DNA, 20 bp, Artificial
  CRISPR gRNA sequence
ctgattgcagttttggttga

SEQ ID NO: 117733 - DNA, 20 bp, Artificial
  CRISPR gRNA sequence
attgcagttttggttgagaa

SEQ ID NO: 117734 - DNA, 20 bp, Artificial
  CRISPR gRNA sequence
cagttttggttgagaaggtt

SEQ ID NO: 117735 - DNA, 20 bp, Artificial
  CRISPR gRNA sequence
tggttgagaaggttgttctt

SEQ ID NO: 117736 - DNA, 20 bp, Artificial
  CRISPR gRNA sequence
ggttgagaaggttgttcttc

SEQ ID NO: 117737 - DNA, 20 bp, Artificial
  CRISPR gRNA sequence
gttgagaaggttgttcttcc

SEQ ID NO: 117738 - DNA, 20 bp, Artificial
  CRISPR gRNA sequence
agaaggttgttcttccctgc

SEQ ID NO: 117739 - DNA, 20 bp, Artificial
  CRISPR gRNA sequence
ttcttccctgctgagatggc

SEQ ID NO: 117740 - DNA, 20 bp, Artificial
  CRISPR gRNA sequence
ttccctgctgagatggctgg

SEQ ID NO: 117741 - DNA, 20 bp, Artificial
  CRISPR gRNA sequence
ccctgctgagatggctggct

SEQ ID NO: 117742 - DNA, 20 bp, Artificial
  CRISPR gRNA sequence
cctgctgagatggctggctg

SEQ ID NO: 117743 - DNA, 20 bp, Artificial
  CRISPR gRNA sequence
ctgagatggctggctgactt

SEQ ID NO: 117744 - DNA, 20 bp, Artificial
  CRISPR gRNA sequence
agatggctggctgacttcac

SEQ ID NO: 117745 - DNA, 20 bp, Artificial
  CRISPR gRNA sequence
gctgacttcaccagtcaagg

SEQ ID NO: 117746 - DNA, 20 bp, Artificial
  CRISPR gRNA sequence
acttcaccagtcaaggtaag

SEQ ID NO: 117747 - DNA, 20 bp, Artificial
  CRISPR gRNA sequence
caccagtcaaggtaagtgct

SEQ ID NO: 117748 - DNA, 20 bp, Artificial
  CRISPR gRNA sequence
accagtcaaggtaagtgctt

SEQ ID NO: 117749 - DNA, 20 bp, Artificial
  CRISPR gRNA sequence
tgtgtactgctggggtggca

SEQ ID NO: 117750 - DNA, 20 bp, Artificial
  CRISPR gRNA sequence
gtgtactgctggggtggcat

SEQ ID NO: 117751 - DNA, 20 bp, Artificial
  CRISPR gRNA sequence
tgtactgctggggtggcatg

SEQ ID NO: 117752 - DNA, 20 bp, Artificial
  CRISPR gRNA sequence
ctggggtggcatgtgtctcc

SEQ ID NO: 117753 - DNA, 20 bp, Artificial
  CRISPR gRNA sequence
gggtggcatgtgtctccttg

SEQ ID NO: 117754 - DNA, 20 bp, Artificial
  CRISPR gRNA sequence
cttgcatcatccgaatccat

SEQ ID NO: 117755 - DNA, 20 bp, Artificial
  CRISPR gRNA sequence
gcatcatccgaatccatgaa

SEQ ID NO: 117756 - DNA, 20 bp, Artificial
  CRISPR gRNA sequence
catcatccgaatccatgaaa

SEQ ID NO: 117757 - DNA, 20 bp, Artificial
  CRISPR gRNA sequence
aaataggtcctgactgaaag

SEQ ID NO: 117758 - DNA, 20 bp, Artificial
  CRISPR gRNA sequence
actgaaagagtaagacaaag

SEQ ID NO: 117759 - DNA, 20 bp, Artificial
  CRISPR gRNA sequence
aaagagtaagacaaaggctt

SEQ ID NO: 117760 - DNA, 20 bp, Artificial
  CRISPR gRNA sequence
gcaacttcaatttgccaggc

SEQ ID NO: 117761 - DNA, 20 bp, Artificial
  CRISPR gRNA sequence
caacttcaatttgccaggca

SEQ ID NO: 117762 - DNA, 20 bp, Artificial
  CRISPR gRNA sequence
caatttgccaggcatcgctg

SEQ ID NO: 117763 - DNA, 20 bp, Artificial
  CRISPR gRNA sequence
aatttgccaggcatcgctgc

SEQ ID NO: 117764 - DNA, 20 bp, Artificial
  CRISPR gRNA sequence
gccaggcatcgctgcaattg

SEQ ID NO: 117765 - DNA, 20 bp, Artificial
  CRISPR gRNA sequence
ccaggcatcgctgcaattgt

SEQ ID NO: 117766 - DNA, 20 bp, Artificial
  CRISPR gRNA sequence
caattgtaatactgagccac

SEQ ID NO: 117767 - DNA, 20 bp, Artificial
  CRISPR gRNA sequence
taatactgagccacttatta

SEQ ID NO: 117768 - DNA, 20 bp, Artificial
  CRISPR gRNA sequence
agccacttattaaaaactaa

SEQ ID NO: 117769 - DNA, 20 bp, Artificial
  CRISPR gRNA sequence
attaaaaactaagtggtttc

SEQ ID NO: 117770 - DNA, 20 bp, Artificial
  CRISPR gRNA sequence
ttaaaaactaagtggtttct

SEQ ID NO: 117771 - DNA, 20 bp, Artificial
  CRISPR gRNA sequence
aaaactaagtggtttctgtc

SEQ ID NO: 117772 - DNA, 20 bp, Artificial
  CRISPR gRNA sequence
agtggtttctgtcctgtagt

SEQ ID NO: 117773 - DNA, 20 bp, Artificial
  CRISPR gRNA sequence
ctgtcctgtagtaaagggca

SEQ ID NO: 117774 - DNA, 20 bp, Artificial
  CRISPR gRNA sequence
tgtcctgtagtaaagggcag

SEQ ID NO: 117775 - DNA, 20 bp, Artificial
  CRISPR gRNA sequence
tcctgtagtaaagggcagaa

SEQ ID NO: 117776 - DNA, 20 bp, Artificial
  CRISPR gRNA sequence
tagtaaagggcagaatgtga

SEQ ID NO: 117777 - DNA, 20 bp, Artificial
  CRISPR gRNA sequence
gaagagttgatcaatttcct

SEQ ID NO: 117778 - DNA, 20 bp, Artificial
  CRISPR gRNA sequence
atcaatttcctggaacagtg

SEQ ID NO: 117779 - DNA, 20 bp, Artificial
  CRISPR gRNA sequence
cctggaacagtgagaaacat

SEQ ID NO: 117780 - DNA, 20 bp, Artificial
  CRISPR gRNA sequence
ctggaacagtgagaaacatg

SEQ ID NO: 117781 - DNA, 20 bp, Artificial
  CRISPR gRNA sequence
gaacagtgagaaacatgacc

SEQ ID NO: 117782 - DNA, 20 bp, Artificial
  CRISPR gRNA sequence
gatcagctccatcacatggc

SEQ ID NO: 117783 - DNA, 20 bp, Artificial
  CRISPR gRNA sequence
atcagctccatcacatggcg

SEQ ID NO: 117784 - DNA, 20 bp, Artificial
  CRISPR gRNA sequence
catcacatggcgtggggtta

SEQ ID NO: 117785 - DNA, 20 bp, Artificial
  CRISPR gRNA sequence
ggacactcggatgatctgtg

SEQ ID NO: 117786 - DNA, 20 bp, Artificial
  CRISPR gRNA sequence
ggatgatctgtgtcattgct

SEQ ID NO: 117787 - DNA, 20 bp, Artificial
  CRISPR gRNA sequence
tgtcattgcttcttcatcgg

SEQ ID NO: 117788 - DNA, 20 bp, Artificial
  CRISPR gRNA sequence
cttcttcatcggcttggttt

SEQ ID NO: 117789 - DNA, 20 bp, Artificial
  CRISPR gRNA sequence
cttcatcggcttggtttgga

SEQ ID NO: 117790 - DNA, 20 bp, Artificial
  CRISPR gRNA sequence
ttcatcggcttggtttggat

SEQ ID NO: 117791 - DNA, 20 bp, Artificial
  CRISPR gRNA sequence
catcggcttggtttggatcc

SEQ ID NO: 117792 - DNA, 20 bp, Artificial
  CRISPR gRNA sequence
atcggcttggtttggatcct

SEQ ID NO: 117793 - DNA, 20 bp, Artificial
  CRISPR gRNA sequence
ggtttggatcctagagacaa

SEQ ID NO: 117794 - DNA, 20 bp, Artificial
  CRISPR gRNA sequence
gtttggatcctagagacaaa

SEQ ID NO: 117795 - DNA, 20 bp, Artificial
  CRISPR gRNA sequence
ggatcctagagacaaagatg

SEQ ID NO: 117796 - DNA, 20 bp, Artificial
  CRISPR gRNA sequence
gatcctagagacaaagatga

SEQ ID NO: 117797 - DNA, 20 bp, Artificial
  CRISPR gRNA sequence
gagacaaagatgacatgatg

SEQ ID NO: 117798 - DNA, 20 bp, Artificial
  CRISPR gRNA sequence
aagtcctttgcaaaagcaac

SEQ ID NO: 117799 - DNA, 20 bp, Artificial
  CRISPR gRNA sequence
tgcaaaagcaacaggaactc

SEQ ID NO: 117800 - DNA, 20 bp, Artificial
  CRISPR gRNA sequence
gcaaaagcaacaggaactca

SEQ ID NO: 117801 - DNA, 20 bp, Artificial
  CRISPR gRNA sequence
caaaagcaacaggaactcat

SEQ ID NO: 117802 - DNA, 20 bp, Artificial
  CRISPR gRNA sequence
atggctctcactacttatcc

SEQ ID NO: 117803 - DNA, 20 bp, Artificial
  CRISPR gRNA sequence
tcactacttatccccccaag

SEQ ID NO: 117804 - DNA, 20 bp, Artificial
  CRISPR gRNA sequence
actacttatccccccaagag

SEQ ID NO: 117805 - DNA, 20 bp, Artificial
  CRISPR gRNA sequence
cttatccccccaagagaata

SEQ ID NO: 117806 - DNA, 20 bp, Artificial
  CRISPR gRNA sequence
atccccccaagagaatacac

SEQ ID NO: 117807 - DNA, 20 bp, Artificial
  CRISPR gRNA sequence
tccccccaagagaatacaca

SEQ ID NO: 117808 - DNA, 20 bp, Artificial
  CRISPR gRNA sequence
taccaagtaaatcaaaggct

SEQ ID NO: 117809 - DNA, 20 bp, Artificial
  CRISPR gRNA sequence
accaagtaaatcaaaggctt

SEQ ID NO: 117810 - DNA, 20 bp, Artificial
  CRISPR gRNA sequence
ccaagtaaatcaaaggcttg

SEQ ID NO: 117811 - DNA, 20 bp, Artificial
  CRISPR gRNA sequence
gtaatacatcttaagtctgc

SEQ ID NO: 117812 - DNA, 20 bp, Artificial
  CRISPR gRNA sequence
taatacatcttaagtctgca

SEQ ID NO: 117813 - DNA, 20 bp, Artificial
  CRISPR gRNA sequence
aagtctgcatacatggctta

SEQ ID NO: 117814 - DNA, 20 bp, Artificial
  CRISPR gRNA sequence
agtctgcatacatggcttaa

SEQ ID NO: 117815 - DNA, 20 bp, Artificial
  CRISPR gRNA sequence
catacatggcttaaagtgta

SEQ ID NO: 117816 - DNA, 20 bp, Artificial
  CRISPR gRNA sequence
aaagtgtagccccattagga

SEQ ID NO: 117817 - DNA, 20 bp, Artificial
  CRISPR gRNA sequence
aagtgtagccccattaggaa

SEQ ID NO: 117818 - DNA, 20 bp, Artificial
  CRISPR gRNA sequence
ggaaagaagagacaataaac

SEQ ID NO: 117819 - DNA, 20 bp, Artificial
  CRISPR gRNA sequence
attcttaaaataatttaaag

SEQ ID NO: 117820 - DNA, 20 bp, Artificial
  CRISPR gRNA sequence
ttcttaaaataatttaaagt

SEQ ID NO: 117821 - DNA, 20 bp, Artificial
  CRISPR gRNA sequence
ttaaaataatttaaagtctg

SEQ ID NO: 117822 - DNA, 20 bp, Artificial
  CRISPR gRNA sequence
aaaataatttaaagtctggc

SEQ ID NO: 117823 - DNA, 20 bp, Artificial
  CRISPR gRNA sequence
aaataatttaaagtctggcc

SEQ ID NO: 117824 - DNA, 20 bp, Artificial
  CRISPR gRNA sequence
aaagtctggcctgcactcca

SEQ ID NO: 117825 - DNA, 20 bp, Artificial
  CRISPR gRNA sequence
aagtctggcctgcactccat

SEQ ID NO: 117826 - DNA, 20 bp, Artificial
  CRISPR gRNA sequence
gcctgcactccatggtgaaa

SEQ ID NO: 117827 - DNA, 20 bp, Artificial
  CRISPR gRNA sequence
cactccatggtgaaacactg

SEQ ID NO: 117828 - DNA, 20 bp, Artificial
  CRISPR gRNA sequence
catggtgaaacactgcaggg

SEQ ID NO: 117829 - DNA, 20 bp, Artificial
  CRISPR gRNA sequence
cagggctgttagtgtatctc

SEQ ID NO: 117830 - DNA, 20 bp, Artificial
  CRISPR gRNA sequence
ttagtgtatctctttcctaa

SEQ ID NO: 117831 - DNA, 20 bp, Artificial
  CRISPR gRNA sequence
gtgtatctctttcctaagaa

SEQ ID NO: 117832 - DNA, 20 bp, Artificial
  CRISPR gRNA sequence
tttcctaagaaccttgtgtt

SEQ ID NO: 117833 - DNA, 20 bp, Artificial
  CRISPR gRNA sequence
tcctaagaaccttgtgttgt

SEQ ID NO: 117834 - DNA, 20 bp, Artificial
  CRISPR gRNA sequence
cctaagaaccttgtgttgtt

SEQ ID NO: 117835 - DNA, 20 bp, Artificial
  CRISPR gRNA sequence
ctaagaaccttgtgttgttc

SEQ ID NO: 117836 - DNA, 20 bp, Artificial
  CRISPR gRNA sequence
agaaccttgtgttgttctct

SEQ ID NO: 117837 - DNA, 20 bp, Artificial
  CRISPR gRNA sequence
gtgttgttctctatacttaa

SEQ ID NO: 117838 - DNA, 20 bp, Artificial
  CRISPR gRNA sequence
tgttgttctctatacttaag

SEQ ID NO: 117839 - DNA, 20 bp, Artificial
  CRISPR gRNA sequence
ttctctatacttaagggtta

SEQ ID NO: 117840 - DNA, 20 bp, Artificial
  CRISPR gRNA sequence
tctatacttaagggttaaga

SEQ ID NO: 117841 - DNA, 20 bp, Artificial
  CRISPR gRNA sequence
tatacttaagggttaagagt

SEQ ID NO: 117842 - DNA, 20 bp, Artificial
  CRISPR gRNA sequence
tacttaagggttaagagtat

SEQ ID NO: 117843 - DNA, 20 bp, Artificial
  CRISPR gRNA sequence
aagggttaagagtattcaga

SEQ ID NO: 117844 - DNA, 20 bp, Artificial
  CRISPR gRNA sequence
agggttaagagtattcagat

SEQ ID NO: 117845 - DNA, 20 bp, Artificial
  CRISPR gRNA sequence
agagtattcagattcaggtg

SEQ ID NO: 117846 - DNA, 20 bp, Artificial
  CRISPR gRNA sequence
agattcaggtgtctaaggaa

SEQ ID NO: 117847 - DNA, 20 bp, Artificial
  CRISPR gRNA sequence
aggtgtctaaggaaaagacc

SEQ ID NO: 117848 - DNA, 20 bp, Artificial
  CRISPR gRNA sequence
aggaaaagacccagagaaac

SEQ ID NO: 117849 - DNA, 20 bp, Artificial
  CRISPR gRNA sequence
tatttttgtcactgtttttt

SEQ ID NO: 117850 - DNA, 20 bp, Artificial
  CRISPR gRNA sequence
ttgtcactgttttttgatca

SEQ ID NO: 117851 - DNA, 20 bp, Artificial
  CRISPR gRNA sequence
tgtcactgttttttgatcat

SEQ ID NO: 117852 - DNA, 20 bp, Artificial
  CRISPR gRNA sequence
gtcactgttttttgatcatc

SEQ ID NO: 117853 - DNA, 20 bp, Artificial
  CRISPR gRNA sequence
tcactgttttttgatcatca

SEQ ID NO: 117854 - DNA, 20 bp, Artificial
  CRISPR gRNA sequence
ttttttgatcatcatttaaa

SEQ ID NO: 117855 - DNA, 20 bp, Artificial
  CRISPR gRNA sequence
tttgatcatcatttaaatac

SEQ ID NO: 117856 - DNA, 20 bp, Artificial
  CRISPR gRNA sequence
ttgatcatcatttaaatact

SEQ ID NO: 117857 - DNA, 20 bp, Artificial
  CRISPR gRNA sequence
tgatcatcatttaaatactg

SEQ ID NO: 117858 - DNA, 20 bp, Artificial
  CRISPR gRNA sequence
gatcatcatttaaatactga

SEQ ID NO: 117859 - DNA, 20 bp, Artificial
  CRISPR gRNA sequence
atcatcatttaaatactgag

SEQ ID NO: 117860 - DNA, 20 bp, Artificial
  CRISPR gRNA sequence
aaatactgagtacttagcag

SEQ ID NO: 117861 - DNA, 20 bp, Artificial
  CRISPR gRNA sequence
aatactgagtacttagcagg

SEQ ID NO: 117862 - DNA, 20 bp, Artificial
  CRISPR gRNA sequence
agtacttagcagggctagaa

SEQ ID NO: 117863 - DNA, 20 bp, Artificial
  CRISPR gRNA sequence
agcagggctagaaagaatca

SEQ ID NO: 117864 - DNA, 20 bp, Artificial
  CRISPR gRNA sequence
gcagggctagaaagaatcat

SEQ ID NO: 117865 - DNA, 20 bp, Artificial
  CRISPR gRNA sequence
gaaagaatcattagaatcta

SEQ ID NO: 117866 - DNA, 20 bp, Artificial
  CRISPR gRNA sequence
gaatctatacactttaatgt

SEQ ID NO: 117867 - DNA, 20 bp, Artificial
  CRISPR gRNA sequence
tacactttaatgtactcgtt

SEQ ID NO: 117868 - DNA, 20 bp, Artificial
  CRISPR gRNA sequence
taatgtactcgttttacaga

SEQ ID NO: 117869 - DNA, 20 bp, Artificial
  CRISPR gRNA sequence
aatgtactcgttttacagat

SEQ ID NO: 117870 - DNA, 20 bp, Artificial
  CRISPR gRNA sequence
atgtactcgttttacagata

SEQ ID NO: 117871 - DNA, 20 bp, Artificial
  CRISPR gRNA sequence
gttttacagataaatctgaa

SEQ ID NO: 117872 - DNA, 20 bp, Artificial
  CRISPR gRNA sequence
tacagataaatctgaaggcc

SEQ ID NO: 117873 - DNA, 20 bp, Artificial
  CRISPR gRNA sequence
acagataaatctgaaggcca

SEQ ID NO: 117874 - DNA, 20 bp, Artificial
  CRISPR gRNA sequence
cagataaatctgaaggccag

SEQ ID NO: 117875 - DNA, 20 bp, Artificial
  CRISPR gRNA sequence
aaggccagatgggtaaagtg

SEQ ID NO: 117876 - DNA, 20 bp, Artificial
  CRISPR gRNA sequence
gcgtggactagggtcagggt

SEQ ID NO: 117877 - DNA, 20 bp, Artificial
  CRISPR gRNA sequence
cgtggactagggtcagggtc

SEQ ID NO: 117878 - DNA, 20 bp, Artificial
  CRISPR gRNA sequence
gggtcagggtcagaaagtta

SEQ ID NO: 117879 - DNA, 20 bp, Artificial
  CRISPR gRNA sequence
ggagtccagcaagggctaac

SEQ ID NO: 117880 - DNA, 20 bp, Artificial
  CRISPR gRNA sequence
actcccaaatctcctgactc

SEQ ID NO: 117881 - DNA, 20 bp, Artificial
  CRISPR gRNA sequence
ccaaatctcctgactcccat

SEQ ID NO: 117882 - DNA, 20 bp, Artificial
  CRISPR gRNA sequence
ctgactcccatttcatcttc

SEQ ID NO: 117883 - DNA, 20 bp, Artificial
  CRISPR gRNA sequence
actcccatttcatcttcttt

SEQ ID NO: 117884 - DNA, 20 bp, Artificial
  CRISPR gRNA sequence
ccatttcatcttctttccac

SEQ ID NO: 117885 - DNA, 20 bp, Artificial
  CRISPR gRNA sequence
catcttctttccactaaact

SEQ ID NO: 117886 - DNA, 20 bp, Artificial
  CRISPR gRNA sequence
atcttctttccactaaactc

SEQ ID NO: 117887 - DNA, 20 bp, Artificial
  CRISPR gRNA sequence
ctttccactaaactctatat

SEQ ID NO: 117888 - DNA, 20 bp, Artificial
  CRISPR gRNA sequence
tttccactaaactctatatg

SEQ ID NO: 117889 - DNA, 20 bp, Artificial
  CRISPR gRNA sequence
tccactaaactctatatgct

SEQ ID NO: 117890 - DNA, 20 bp, Artificial
  CRISPR gRNA sequence
ccactaaactctatatgctg

SEQ ID NO: 117891 - DNA, 20 bp, Artificial
  CRISPR gRNA sequence
cactaaactctatatgctgt

SEQ ID NO: 117892 - DNA, 20 bp, Artificial
  CRISPR gRNA sequence
aactctatatgctgtttctc

SEQ ID NO: 117893 - DNA, 20 bp, Artificial
  CRISPR gRNA sequence
tatatgctgtttctcactta

SEQ ID NO: 117894 - DNA, 20 bp, Artificial
  CRISPR gRNA sequence
tatgctgtttctcacttaag

SEQ ID NO: 117895 - DNA, 20 bp, Artificial
  CRISPR gRNA sequence
tttctcacttaagacctacc

SEQ ID NO: 117896 - DNA, 20 bp, Artificial
  CRISPR gRNA sequence
ctcacttaagacctaccgtg

SEQ ID NO: 117897 - DNA, 20 bp, Artificial
  CRISPR gRNA sequence
tcacttaagacctaccgtgt

SEQ ID NO: 117898 - DNA, 20 bp, Artificial
  CRISPR gRNA sequence
acttaagacctaccgtgtta

SEQ ID NO: 117899 - DNA, 20 bp, Artificial
  CRISPR gRNA sequence
aagacctaccgtgttaacac

SEQ ID NO: 117900 - DNA, 20 bp, Artificial
  CRISPR gRNA sequence
agacctaccgtgttaacaca

SEQ ID NO: 117901 - DNA, 20 bp, Artificial
  CRISPR gRNA sequence
ccgtgttaacacaaggataa

SEQ ID NO: 117902 - DNA, 20 bp, Artificial
  CRISPR gRNA sequence
acacaaggataaatccttgg

SEQ ID NO: 117903 - DNA, 20 bp, Artificial
  CRISPR gRNA sequence
ggaagctttttgcaacactc

SEQ ID NO: 117904 - DNA, 20 bp, Artificial
  CRISPR gRNA sequence
gaagctttttgcaacactcc

SEQ ID NO: 117905 - DNA, 20 bp, Artificial
  CRISPR gRNA sequence
tttgcaacactccgcaagaa

SEQ ID NO: 117906 - DNA, 20 bp, Artificial
  CRISPR gRNA sequence
ttgcaacactccgcaagaac

SEQ ID NO: 117907 - DNA, 20 bp, Artificial
  CRISPR gRNA sequence
tgcaacactccgcaagaacc

SEQ ID NO: 117908 - DNA, 20 bp, Artificial
  CRISPR gRNA sequence
gcaacactccgcaagaacca

SEQ ID NO: 117909 - DNA, 20 bp, Artificial
  CRISPR gRNA sequence
caacactccgcaagaaccac

SEQ ID NO: 117910 - DNA, 20 bp, Artificial
  CRISPR gRNA sequence
cgcaagaaccacctttagtt

SEQ ID NO: 117911 - DNA, 20 bp, Artificial
  CRISPR gRNA sequence
tagttcccccataccaaggc

SEQ ID NO: 117912 - DNA, 20 bp, Artificial
  CRISPR gRNA sequence
agttcccccataccaaggct

SEQ ID NO: 117913 - DNA, 20 bp, Artificial
  CRISPR gRNA sequence
gttcccccataccaaggctc

SEQ ID NO: 117914 - DNA, 20 bp, Artificial
  CRISPR gRNA sequence
ccccataccaaggctctgaa

SEQ ID NO: 117915 - DNA, 20 bp, Artificial
  CRISPR gRNA sequence
tgaagccttggtaggcagga

SEQ ID NO: 117916 - DNA, 20 bp, Artificial
  CRISPR gRNA sequence
aagccttggtaggcaggatc

SEQ ID NO: 117917 - DNA, 20 bp, Artificial
  CRISPR gRNA sequence
ggtaggcaggatctgagaaa

SEQ ID NO: 117918 - DNA, 20 bp, Artificial
  CRISPR gRNA sequence
gtaggcaggatctgagaaaa

SEQ ID NO: 117919 - DNA, 20 bp, Artificial
  CRISPR gRNA sequence
agaaaaagctgaaagccttc

SEQ ID NO: 117920 - DNA, 20 bp, Artificial
  CRISPR gRNA sequence
aaagccttctggagatggaa

SEQ ID NO: 117921 - DNA, 20 bp, Artificial
  CRISPR gRNA sequence
ctggagatggaagactggaa

SEQ ID NO: 117922 - DNA, 20 bp, Artificial
  CRISPR gRNA sequence
tggagatggaagactggaac

SEQ ID NO: 117923 - DNA, 20 bp, Artificial
  CRISPR gRNA sequence
gagatggaagactggaactg

SEQ ID NO: 117924 - DNA, 20 bp, Artificial
  CRISPR gRNA sequence
gaactgggtcttgaacaatg

SEQ ID NO: 117925 - DNA, 20 bp, Artificial
  CRISPR gRNA sequence
ggtcttgaacaatgagcaaa

SEQ ID NO: 117926 - DNA, 20 bp, Artificial
  CRISPR gRNA sequence
gaacaatgagcaaaaacaac

SEQ ID NO: 117927 - DNA, 20 bp, Artificial
  CRISPR gRNA sequence
aacaatgagcaaaaacaact

SEQ ID NO: 117928 - DNA, 20 bp, Artificial
  CRISPR gRNA sequence
gcatttactgaactcaccat

SEQ ID NO: 117929 - DNA, 20 bp, Artificial
  CRISPR gRNA sequence
actgaactcaccatgcacta

SEQ ID NO: 117930 - DNA, 20 bp, Artificial
  CRISPR gRNA sequence
ctgaactcaccatgcactag

SEQ ID NO: 117931 - DNA, 20 bp, Artificial
  CRISPR gRNA sequence
aactcaccatgcactaggta

SEQ ID NO: 117932 - DNA, 20 bp, Artificial
  CRISPR gRNA sequence
accatgcactaggtatggtg

SEQ ID NO: 117933 - DNA, 20 bp, Artificial
  CRISPR gRNA sequence
ggtatggtgctacacagatg

SEQ ID NO: 117934 - DNA, 20 bp, Artificial
  CRISPR gRNA sequence
cacagatgcctaatgtggat

SEQ ID NO: 117935 - DNA, 20 bp, Artificial
  CRISPR gRNA sequence
atgtggattactgaatgaaa

SEQ ID NO: 117936 - DNA, 20 bp, Artificial
  CRISPR gRNA sequence
ctgaatgaaatccctacaac

SEQ ID NO: 117937 - DNA, 20 bp, Artificial
  CRISPR gRNA sequence
aatgaaatccctacaacatt

SEQ ID NO: 117938 - DNA, 20 bp, Artificial
  CRISPR gRNA sequence
caacattgctgtgaagtatc

SEQ ID NO: 117939 - DNA, 20 bp, Artificial
  CRISPR gRNA sequence
ctgtgaagtatcaacagtat

SEQ ID NO: 117940 - DNA, 20 bp, Artificial
  CRISPR gRNA sequence
tgaagtatcaacagtattcc

SEQ ID NO: 117941 - DNA, 20 bp, Artificial
  CRISPR gRNA sequence
cactttacagataaaaataa

SEQ ID NO: 117942 - DNA, 20 bp, Artificial
  CRISPR gRNA sequence
tacagataaaaataaaagag

SEQ ID NO: 117943 - DNA, 20 bp, Artificial
  CRISPR gRNA sequence
acagataaaaataaaagagg

SEQ ID NO: 117944 - DNA, 20 bp, Artificial
  CRISPR gRNA sequence
cagataaaaataaaagaggc

SEQ ID NO: 117945 - DNA, 20 bp, Artificial
  CRISPR gRNA sequence
aattgaccaagatcatattg

SEQ ID NO: 117946 - DNA, 20 bp, Artificial
  CRISPR gRNA sequence
accaagatcatattgttagc

SEQ ID NO: 117947 - DNA, 20 bp, Artificial
  CRISPR gRNA sequence
ttagcacacagaatgaggag

SEQ ID NO: 117948 - DNA, 20 bp, Artificial
  CRISPR gRNA sequence
gcacacagaatgaggagagt

SEQ ID NO: 117949 - DNA, 20 bp, Artificial
  CRISPR gRNA sequence
ctggcacaatgccctcctgc

SEQ ID NO: 117950 - DNA, 20 bp, Artificial
  CRISPR gRNA sequence
gcacaatgccctcctgccac

SEQ ID NO: 117951 - DNA, 20 bp, Artificial
  CRISPR gRNA sequence
ctgccacaatagctgtcagg

SEQ ID NO: 117952 - DNA, 20 bp, Artificial
  CRISPR gRNA sequence
ccacaatagctgtcaggccc

SEQ ID NO: 117953 - DNA, 20 bp, Artificial
  CRISPR gRNA sequence
tcaggcccacattcatacac

SEQ ID NO: 117954 - DNA, 20 bp, Artificial
  CRISPR gRNA sequence
atacaccgttatgaatgaat

SEQ ID NO: 117955 - DNA, 20 bp, Artificial
  CRISPR gRNA sequence
tgaatgaatagcaatgagaa

SEQ ID NO: 117956 - DNA, 20 bp, Artificial
  CRISPR gRNA sequence
tcacactacaggtgaggatt

SEQ ID NO: 117957 - DNA, 20 bp, Artificial
  CRISPR gRNA sequence
acactacaggtgaggattaa

SEQ ID NO: 117958 - DNA, 20 bp, Artificial
  CRISPR gRNA sequence
caggtgaggattaatagcac

SEQ ID NO: 117959 - DNA, 20 bp, Artificial
  CRISPR gRNA sequence
atagcactgaaagagttgtt

SEQ ID NO: 117960 - DNA, 20 bp, Artificial
  CRISPR gRNA sequence
aaagagttgttagtgttcat

SEQ ID NO: 117961 - DNA, 20 bp, Artificial
  CRISPR gRNA sequence
ttagtgttcatgtgtgggga

SEQ ID NO: 117962 - DNA, 20 bp, Artificial
  CRISPR gRNA sequence
gtgttcatgtgtggggacac

SEQ ID NO: 117963 - DNA, 20 bp, Artificial
  CRISPR gRNA sequence
atgtgtggggacactgagga

SEQ ID NO: 117964 - DNA, 20 bp, Artificial
  CRISPR gRNA sequence
aggaaacctagtttgattgt

SEQ ID NO: 117965 - DNA, 20 bp, Artificial
  CRISPR gRNA sequence
gtttgattgttgagggggtg

SEQ ID NO: 117966 - DNA, 20 bp, Artificial
  CRISPR gRNA sequence
gattgttgagggggtgataa

SEQ ID NO: 117967 - DNA, 20 bp, Artificial
  CRISPR gRNA sequence
attgttgagggggtgataag

SEQ ID NO: 117968 - DNA, 20 bp, Artificial
  CRISPR gRNA sequence
ttgagggggtgataaggcaa

SEQ ID NO: 117969 - DNA, 20 bp, Artificial
  CRISPR gRNA sequence
agggggtgataaggcaaagt

SEQ ID NO: 117970 - DNA, 20 bp, Artificial
  CRISPR gRNA sequence
cttagatgttatacagaaat

SEQ ID NO: 117971 - DNA, 20 bp, Artificial
  CRISPR gRNA sequence
agatgttatacagaaatagt

SEQ ID NO: 117972 - DNA, 20 bp, Artificial
  CRISPR gRNA sequence
gatgttatacagaaatagtt

SEQ ID NO: 117973 - DNA, 20 bp, Artificial
  CRISPR gRNA sequence
tacagaaatagtttgagatt

SEQ ID NO: 117974 - DNA, 20 bp, Artificial
  CRISPR gRNA sequence
gagatttgatgcagttaaga

SEQ ID NO: 117975 - DNA, 20 bp, Artificial
  CRISPR gRNA sequence
agatttgatgcagttaagaa

SEQ ID NO: 117976 - DNA, 20 bp, Artificial
  CRISPR gRNA sequence
gatgcagttaagaaatgaga

SEQ ID NO: 117977 - DNA, 20 bp, Artificial
  CRISPR gRNA sequence
atgcagttaagaaatgagaa

SEQ ID NO: 117978 - DNA, 20 bp, Artificial
  CRISPR gRNA sequence
agaaatgagaactattaata

SEQ ID NO: 117979 - DNA, 20 bp, Artificial
  CRISPR gRNA sequence
ttaatagcatgcatccttga

SEQ ID NO: 117980 - DNA, 20 bp, Artificial
  CRISPR gRNA sequence
atagcatgcatccttgacct

SEQ ID NO: 117981 - DNA, 20 bp, Artificial
  CRISPR gRNA sequence
gacctggggactggcaggtt

SEQ ID NO: 117982 - DNA, 20 bp, Artificial
  CRISPR gRNA sequence
acctggggactggcaggtta

SEQ ID NO: 117983 - DNA, 20 bp, Artificial
  CRISPR gRNA sequence
gggactggcaggttaaaaaa

SEQ ID NO: 117984 - DNA, 20 bp, Artificial
  CRISPR gRNA sequence
gcaggttaaaaaaaacactt

SEQ ID NO: 117985 - DNA, 20 bp, Artificial
  CRISPR gRNA sequence
aaaaaaacactttaaccatg

SEQ ID NO: 117986 - DNA, 20 bp, Artificial
  CRISPR gRNA sequence
taaccatgtactgtataagt

SEQ ID NO: 117987 - DNA, 20 bp, Artificial
  CRISPR gRNA sequence
aaccatgtactgtataagta

SEQ ID NO: 117988 - DNA, 20 bp, Artificial
  CRISPR gRNA sequence
accatgtactgtataagtac

SEQ ID NO: 117989 - DNA, 20 bp, Artificial
  CRISPR gRNA sequence
tataagtactatataaggcc

SEQ ID NO: 117990 - DNA, 20 bp, Artificial
  CRISPR gRNA sequence
tataaggccaattagaggag

SEQ ID NO: 117991 - DNA, 20 bp, Artificial
  CRISPR gRNA sequence
gaggagactggagattaatt

SEQ ID NO: 117992 - DNA, 20 bp, Artificial
  CRISPR gRNA sequence
gagattaatttgatggatat

SEQ ID NO: 117993 - DNA, 20 bp, Artificial
  CRISPR gRNA sequence
atttgatggatattgcaata

SEQ ID NO: 117994 - DNA, 20 bp, Artificial
  CRISPR gRNA sequence
gatggatattgcaatagtgc

SEQ ID NO: 117995 - DNA, 20 bp, Artificial
  CRISPR gRNA sequence
atggatattgcaatagtgca

SEQ ID NO: 117996 - DNA, 20 bp, Artificial
  CRISPR gRNA sequence
caatagtgcaagtggaatgt

SEQ ID NO: 117997 - DNA, 20 bp, Artificial
  CRISPR gRNA sequence
atatagaatggagtatcagc

SEQ ID NO: 117998 - DNA, 20 bp, Artificial
  CRISPR gRNA sequence
ttaattcaagaaacactgat

SEQ ID NO: 117999 - DNA, 20 bp, Artificial
  CRISPR gRNA sequence
attcaagaaacactgattgc

SEQ ID NO: 118000 - DNA, 20 bp, Artificial
  CRISPR gRNA sequence
aagaaacactgattgcttgg

SEQ ID NO: 118001 - DNA, 20 bp, Artificial
  CRISPR gRNA sequence
attgcttggttcagaactgg

SEQ ID NO: 118002 - DNA, 20 bp, Artificial
  CRISPR gRNA sequence
cttggttcagaactggatac

SEQ ID NO: 118003 - DNA, 20 bp, Artificial
  CRISPR gRNA sequence
ggttcagaactggatactaa

SEQ ID NO: 118004 - DNA, 20 bp, Artificial
  CRISPR gRNA sequence
gttcagaactggatactaaa

SEQ ID NO: 118005 - DNA, 20 bp, Artificial
  CRISPR gRNA sequence
agaactggatactaaaccca

SEQ ID NO: 118006 - DNA, 20 bp, Artificial
  CRISPR gRNA sequence
gatactaaacccaacaaata

SEQ ID NO: 118007 - DNA, 20 bp, Artificial
  CRISPR gRNA sequence
aacccaacaaatacatctaa

SEQ ID NO: 118008 - DNA, 20 bp, Artificial
  CRISPR gRNA sequence
agtcagtacttaaatacaac

SEQ ID NO: 118009 - DNA, 20 bp, Artificial
  CRISPR gRNA sequence
aaatacaacttacttaaata

SEQ ID NO: 118010 - DNA, 20 bp, Artificial
  CRISPR gRNA sequence
aatacaacttacttaaatag

SEQ ID NO: 118011 - DNA, 20 bp, Artificial
  CRISPR gRNA sequence
acttaaatagaattaagtcc

SEQ ID NO: 118012 - DNA, 20 bp, Artificial
  CRISPR gRNA sequence
cttaaatagaattaagtcca

SEQ ID NO: 118013 - DNA, 20 bp, Artificial
  CRISPR gRNA sequence
aaatagaattaagtccaata

SEQ ID NO: 118014 - DNA, 20 bp, Artificial
  CRISPR gRNA sequence
aatagaattaagtccaataa

SEQ ID NO: 118015 - DNA, 20 bp, Artificial
  CRISPR gRNA sequence
agtccaataaatataacaga

SEQ ID NO: 118016 - DNA, 20 bp, Artificial
  CRISPR gRNA sequence
taccctctatacaacttaca

SEQ ID NO: 118017 - DNA, 20 bp, Artificial
  CRISPR gRNA sequence
ccctctatacaacttacagt

SEQ ID NO: 118018 - DNA, 20 bp, Artificial
  CRISPR gRNA sequence
tatacaacttacagtctagt

SEQ ID NO: 118019 - DNA, 20 bp, Artificial
  CRISPR gRNA sequence
tacaacttacagtctagtga

SEQ ID NO: 118020 - DNA, 20 bp, Artificial
  CRISPR gRNA sequence
acagtctagtgaaggaaaca

SEQ ID NO: 118021 - DNA, 20 bp, Artificial
  CRISPR gRNA sequence
cagtctagtgaaggaaacaa

SEQ ID NO: 118022 - DNA, 20 bp, Artificial
  CRISPR gRNA sequence
gtgaaggaaacaatcttgaa

SEQ ID NO: 118023 - DNA, 20 bp, Artificial
  CRISPR gRNA sequence
gaaaaattcaacaacttaaa

SEQ ID NO: 118024 - DNA, 20 bp, Artificial
  CRISPR gRNA sequence
aaaaattcaacaacttaaat

SEQ ID NO: 118025 - DNA, 20 bp, Artificial
  CRISPR gRNA sequence
aacaacttaaatattattac

SEQ ID NO: 118026 - DNA, 20 bp, Artificial
  CRISPR gRNA sequence
aaatattattacactgtaaa

SEQ ID NO: 118027 - DNA, 20 bp, Artificial
  CRISPR gRNA sequence
aatattattacactgtaaag

SEQ ID NO: 118028 - DNA, 20 bp, Artificial
  CRISPR gRNA sequence
ttacactgtaaagaaaaggg

SEQ ID NO: 118029 - DNA, 20 bp, Artificial
  CRISPR gRNA sequence
cactgtaaagaaaagggcca

SEQ ID NO: 118030 - DNA, 20 bp, Artificial
  CRISPR gRNA sequence
taaagaaaagggccaagtgc

SEQ ID NO: 118031 - DNA, 20 bp, Artificial
  CRISPR gRNA sequence
taatcctagcactttgggag

SEQ ID NO: 118032 - DNA, 20 bp, Artificial
  CRISPR gRNA sequence
gcactttgggaggccaaggc

SEQ ID NO: 118033 - DNA, 20 bp, Artificial
  CRISPR gRNA sequence
tgggaggccaaggcgagagg

SEQ ID NO: 118034 - DNA, 20 bp, Artificial
  CRISPR gRNA sequence
gggaggccaaggcgagagga

SEQ ID NO: 118035 - DNA, 20 bp, Artificial
  CRISPR gRNA sequence
ggaggccaaggcgagaggat

SEQ ID NO: 118036 - DNA, 20 bp, Artificial
  CRISPR gRNA sequence
gagcctaggagtttgagacc

SEQ ID NO: 118037 - DNA, 20 bp, Artificial
  CRISPR gRNA sequence
agcctaggagtttgagacct

SEQ ID NO: 118038 - DNA, 20 bp, Artificial
  CRISPR gRNA sequence
ggagtttgagacctgcctgg

SEQ ID NO: 118039 - DNA, 20 bp, Artificial
  CRISPR gRNA sequence
gagacctgcctgggcaacaa

SEQ ID NO: 118040 - DNA, 20 bp, Artificial
  CRISPR gRNA sequence
agacctgcctgggcaacaaa

SEQ ID NO: 118041 - DNA, 20 bp, Artificial
  CRISPR gRNA sequence
cctgggcaacaaagtgagac

SEQ ID NO: 118042 - DNA, 20 bp, Artificial
  CRISPR gRNA sequence
ggcaacaaagtgagactcca

SEQ ID NO: 118043 - DNA, 20 bp, Artificial
  CRISPR gRNA sequence
catttctacaaaaaatttaa

SEQ ID NO: 118044 - DNA, 20 bp, Artificial
  CRISPR gRNA sequence
ctacaaaaaatttaaaaatt

SEQ ID NO: 118045 - DNA, 20 bp, Artificial
  CRISPR gRNA sequence
tacaaaaaatttaaaaatta

SEQ ID NO: 118046 - DNA, 20 bp, Artificial
  CRISPR gRNA sequence
caaaaaatttaaaaattagc

SEQ ID NO: 118047 - DNA, 20 bp, Artificial
  CRISPR gRNA sequence
aaaaattagctgggcatggt

SEQ ID NO: 118048 - DNA, 20 bp, Artificial
  CRISPR gRNA sequence
aaaattagctgggcatggtg

SEQ ID NO: 118049 - DNA, 20 bp, Artificial
  CRISPR gRNA sequence
gctgggcatggtggtgcgtg

SEQ ID NO: 118050 - DNA, 20 bp, Artificial
  CRISPR gRNA sequence
ggcatggtggtgcgtggcta

SEQ ID NO: 118051 - DNA, 20 bp, Artificial
  CRISPR gRNA sequence
tagtcccagctactcgggag

SEQ ID NO: 118052 - DNA, 20 bp, Artificial
  CRISPR gRNA sequence
ctcgggagcctaaagtggga

SEQ ID NO: 118053 - DNA, 20 bp, Artificial
  CRISPR gRNA sequence
gggagcctaaagtgggagga

SEQ ID NO: 118054 - DNA, 20 bp, Artificial
  CRISPR gRNA sequence
aagtgggaggatcacttgag

SEQ ID NO: 118055 - DNA, 20 bp, Artificial
  CRISPR gRNA sequence
gagctgggaggtcaagacta

SEQ ID NO: 118056 - DNA, 20 bp, Artificial
  CRISPR gRNA sequence
agctgggaggtcaagactaa

SEQ ID NO: 118057 - DNA, 20 bp, Artificial
  CRISPR gRNA sequence
ggaggtcaagactaaagtga

SEQ ID NO: 118058 - DNA, 20 bp, Artificial
  CRISPR gRNA sequence
aagtgagccataatcacacc

SEQ ID NO: 118059 - DNA, 20 bp, Artificial
  CRISPR gRNA sequence
cctccaaaaaaagaaaagat

SEQ ID NO: 118060 - DNA, 20 bp, Artificial
  CRISPR gRNA sequence
caaaaaaagaaaagatgttg

SEQ ID NO: 118061 - DNA, 20 bp, Artificial
  CRISPR gRNA sequence
taagaacatactgagagaga

SEQ ID NO: 118062 - DNA, 20 bp, Artificial
  CRISPR gRNA sequence
agagagaagagatctattct

SEQ ID NO: 118063 - DNA, 20 bp, Artificial
  CRISPR gRNA sequence
ttctagatagggtatttaat

SEQ ID NO: 118064 - DNA, 20 bp, Artificial
  CRISPR gRNA sequence
tagatagggtatttaattaa

SEQ ID NO: 118065 - DNA, 20 bp, Artificial
  CRISPR gRNA sequence
gatagggtatttaattaaac

SEQ ID NO: 118066 - DNA, 20 bp, Artificial
  CRISPR gRNA sequence
aattaaacccagacctaaca

SEQ ID NO: 118067 - DNA, 20 bp, Artificial
  CRISPR gRNA sequence
attaaacccagacctaacag

SEQ ID NO: 118068 - DNA, 20 bp, Artificial
  CRISPR gRNA sequence
aacccagacctaacagatag

SEQ ID NO: 118069 - DNA, 20 bp, Artificial
  CRISPR gRNA sequence
acagatagggagatagacat

SEQ ID NO: 118070 - DNA, 20 bp, Artificial
  CRISPR gRNA sequence
aaaattctaaggacaaagac

SEQ ID NO: 118071 - DNA, 20 bp, Artificial
  CRISPR gRNA sequence
taaggacaaagacccgtggc

SEQ ID NO: 118072 - DNA, 20 bp, Artificial
  CRISPR gRNA sequence
aggacaaagacccgtggcag

SEQ ID NO: 118073 - DNA, 20 bp, Artificial
  CRISPR gRNA sequence
gaggtagacaggagctggag

SEQ ID NO: 118074 - DNA, 20 bp, Artificial
  CRISPR gRNA sequence
gagcatgtaaggctttgctg

SEQ ID NO: 118075 - DNA, 20 bp, Artificial
  CRISPR gRNA sequence
tgctgggcatagtagtaagc

SEQ ID NO: 118076 - DNA, 20 bp, Artificial
  CRISPR gRNA sequence
gctgggcatagtagtaagca

SEQ ID NO: 118077 - DNA, 20 bp, Artificial
  CRISPR gRNA sequence
ctgggcatagtagtaagcac

SEQ ID NO: 118078 - DNA, 20 bp, Artificial
  CRISPR gRNA sequence
ggcatagtagtaagcacttt

SEQ ID NO: 118079 - DNA, 20 bp, Artificial
  CRISPR gRNA sequence
tggatgtcagtctaagtgca

SEQ ID NO: 118080 - DNA, 20 bp, Artificial
  CRISPR gRNA sequence
ggatgtcagtctaagtgcaa

SEQ ID NO: 118081 - DNA, 20 bp, Artificial
  CRISPR gRNA sequence
gatgtcagtctaagtgcaaa

SEQ ID NO: 118082 - DNA, 20 bp, Artificial
  CRISPR gRNA sequence
agtgcaaatgggaaagggta

SEQ ID NO: 118083 - DNA, 20 bp, Artificial
  CRISPR gRNA sequence
aaggagcttgagcagaacag

SEQ ID NO: 118084 - DNA, 20 bp, Artificial
  CRISPR gRNA sequence
gagcagaacagggacttgat

SEQ ID NO: 118085 - DNA, 20 bp, Artificial
  CRISPR gRNA sequence
agcagaacagggacttgata

SEQ ID NO: 118086 - DNA, 20 bp, Artificial
  CRISPR gRNA sequence
gataggataaacattttaaa

SEQ ID NO: 118087 - DNA, 20 bp, Artificial
  CRISPR gRNA sequence
ataggataaacattttaaaa

SEQ ID NO: 118088 - DNA, 20 bp, Artificial
  CRISPR gRNA sequence
taaaaagatcacactaggat

SEQ ID NO: 118089 - DNA, 20 bp, Artificial
  CRISPR gRNA sequence
aaaaagatcacactaggatg

SEQ ID NO: 118090 - DNA, 20 bp, Artificial
  CRISPR gRNA sequence
aaaagatcacactaggatgt

SEQ ID NO: 118091 - DNA, 20 bp, Artificial
  CRISPR gRNA sequence
ggatgtggagagtaggctag

SEQ ID NO: 118092 - DNA, 20 bp, Artificial
  CRISPR gRNA sequence
gaggggaacaaaagtggaag

SEQ ID NO: 118093 - DNA, 20 bp, Artificial
  CRISPR gRNA sequence
agcagctattttataaatct

SEQ ID NO: 118094 - DNA, 20 bp, Artificial
  CRISPR gRNA sequence
ttttataaatctaagccaaa

SEQ ID NO: 118095 - DNA, 20 bp, Artificial
  CRISPR gRNA sequence
tataaatctaagccaaagaa

SEQ ID NO: 118096 - DNA, 20 bp, Artificial
  CRISPR gRNA sequence
ataaatctaagccaaagaag

SEQ ID NO: 118097 - DNA, 20 bp, Artificial
  CRISPR gRNA sequence
taaatctaagccaaagaaga

SEQ ID NO: 118098 - DNA, 20 bp, Artificial
  CRISPR gRNA sequence
agccaaagaagagaggatta

SEQ ID NO: 118099 - DNA, 20 bp, Artificial
  CRISPR gRNA sequence
gaccaggctcacatcagtta

SEQ ID NO: 118100 - DNA, 20 bp, Artificial
  CRISPR gRNA sequence
acatcagttagaagggaaaa

SEQ ID NO: 118101 - DNA, 20 bp, Artificial
  CRISPR gRNA sequence
gaagggaaaaaagtaaacat

SEQ ID NO: 118102 - DNA, 20 bp, Artificial
  CRISPR gRNA sequence
aaattatatttgtgatgggg

SEQ ID NO: 118103 - DNA, 20 bp, Artificial
  CRISPR gRNA sequence
tatttgtgatggggtaataa

SEQ ID NO: 118104 - DNA, 20 bp, Artificial
  CRISPR gRNA sequence
gtgatggggtaataaaacct

SEQ ID NO: 118105 - DNA, 20 bp, Artificial
  CRISPR gRNA sequence
tgatggggtaataaaacctg

SEQ ID NO: 118106 - DNA, 20 bp, Artificial
  CRISPR gRNA sequence
ttcaataaaaataaaacttg

SEQ ID NO: 118107 - DNA, 20 bp, Artificial
  CRISPR gRNA sequence
aataaaaataaaacttgttc

SEQ ID NO: 118108 - DNA, 20 bp, Artificial
  CRISPR gRNA sequence
gttccttgaaaattaagaaa

SEQ ID NO: 118109 - DNA, 20 bp, Artificial
  CRISPR gRNA sequence
ttccttgaaaattaagaaaa

SEQ ID NO: 118110 - DNA, 20 bp, Artificial
  CRISPR gRNA sequence
cttgaaaattaagaaaagtg

SEQ ID NO: 118111 - DNA, 20 bp, Artificial
  CRISPR gRNA sequence
gaaaattaagaaaagtgtga

SEQ ID NO: 118112 - DNA, 20 bp, Artificial
  CRISPR gRNA sequence
aaaattaagaaaagtgtgat

SEQ ID NO: 118113 - DNA, 20 bp, Artificial
  CRISPR gRNA sequence
agaaaagtgtgattttcaag

SEQ ID NO: 118114 - DNA, 20 bp, Artificial
  CRISPR gRNA sequence
tcaagaaagaatgaatagta

SEQ ID NO: 118115 - DNA, 20 bp, Artificial
  CRISPR gRNA sequence
caagaaagaatgaatagtaa

SEQ ID NO: 118116 - DNA, 20 bp, Artificial
  CRISPR gRNA sequence
aagaaagaatgaatagtaat

SEQ ID NO: 118117 - DNA, 20 bp, Artificial
  CRISPR gRNA sequence
aaccctccaagtagctggga

SEQ ID NO: 118118 - DNA, 20 bp, Artificial
  CRISPR gRNA sequence
caagtagctgggactacagg

SEQ ID NO: 118119 - DNA, 20 bp, Artificial
  CRISPR gRNA sequence
ggactacaggcatgcatcac

SEQ ID NO: 118120 - DNA, 20 bp, Artificial
  CRISPR gRNA sequence
caggcatgcatcaccaggcc

SEQ ID NO: 118121 - DNA, 20 bp, Artificial
  CRISPR gRNA sequence
gctagtttttgtattttttt

SEQ ID NO: 118122 - DNA, 20 bp, Artificial
  CRISPR gRNA sequence
gtttttgtatttttttgtag

SEQ ID NO: 118123 - DNA, 20 bp, Artificial
  CRISPR gRNA sequence
ttgtatttttttgtagagat

SEQ ID NO: 118124 - DNA, 20 bp, Artificial
  CRISPR gRNA sequence
tgtatttttttgtagagatg

SEQ ID NO: 118125 - DNA, 20 bp, Artificial
  CRISPR gRNA sequence
gtatttttttgtagagatgg

SEQ ID NO: 118126 - DNA, 20 bp, Artificial
  CRISPR gRNA sequence
tatttttttgtagagatgga

SEQ ID NO: 118127 - DNA, 20 bp, Artificial
  CRISPR gRNA sequence
ttttgtagagatggagtttt

SEQ ID NO: 118128 - DNA, 20 bp, Artificial
  CRISPR gRNA sequence
tttgtagagatggagttttg

SEQ ID NO: 118129 - DNA, 20 bp, Artificial
  CRISPR gRNA sequence
ttgtagagatggagttttgc

SEQ ID NO: 118130 - DNA, 20 bp, Artificial
  CRISPR gRNA sequence
tgtagagatggagttttgcc

SEQ ID NO: 118131 - DNA, 20 bp, Artificial
  CRISPR gRNA sequence
gtagagatggagttttgcca

SEQ ID NO: 118132 - DNA, 20 bp, Artificial
  CRISPR gRNA sequence
tagagatggagttttgccat

SEQ ID NO: 118133 - DNA, 20 bp, Artificial
  CRISPR gRNA sequence
tgccatgttgcccaggctgg

SEQ ID NO: 118134 - DNA, 20 bp, Artificial
  CRISPR gRNA sequence
gccatgttgcccaggctggt

SEQ ID NO: 118135 - DNA, 20 bp, Artificial
  CRISPR gRNA sequence
ccatgttgcccaggctggtc

SEQ ID NO: 118136 - DNA, 20 bp, Artificial
  CRISPR gRNA sequence
cccaggctggtcttgaaatc

SEQ ID NO: 118137 - DNA, 20 bp, Artificial
  CRISPR gRNA sequence
gtcttgaaatcctgggcttc

SEQ ID NO: 118138 - DNA, 20 bp, Artificial
  CRISPR gRNA sequence
gaaatcctgggcttcccacc

SEQ ID NO: 118139 - DNA, 20 bp, Artificial
  CRISPR gRNA sequence
aaatcctgggcttcccacct

SEQ ID NO: 118140 - DNA, 20 bp, Artificial
  CRISPR gRNA sequence
ggcttcccacctcagcctcc

SEQ ID NO: 118141 - DNA, 20 bp, Artificial
  CRISPR gRNA sequence
cccacctcagcctcccaaag

SEQ ID NO: 118142 - DNA, 20 bp, Artificial
  CRISPR gRNA sequence
ccacctcagcctcccaaagt

SEQ ID NO: 118143 - DNA, 20 bp, Artificial
  CRISPR gRNA sequence
agcctcccaaagtgttggga

SEQ ID NO: 118144 - DNA, 20 bp, Artificial
  CRISPR gRNA sequence
ccaaagtgttgggattacag

SEQ ID NO: 118145 - DNA, 20 bp, Artificial
  CRISPR gRNA sequence
ggattacaggcatgagccac

SEQ ID NO: 118146 - DNA, 20 bp, Artificial
  CRISPR gRNA sequence
caggcatgagccaccaagtc

SEQ ID NO: 118147 - DNA, 20 bp, Artificial
  CRISPR gRNA sequence
gcctagtggttttaagataa

SEQ ID NO: 118148 - DNA, 20 bp, Artificial
  CRISPR gRNA sequence
gtggttttaagataaaagat

SEQ ID NO: 118149 - DNA, 20 bp, Artificial
  CRISPR gRNA sequence
taagataaaagataatctaa

SEQ ID NO: 118150 - DNA, 20 bp, Artificial
  CRISPR gRNA sequence
aagataaaagataatctaaa

SEQ ID NO: 118151 - DNA, 20 bp, Artificial
  CRISPR gRNA sequence
agataaaagataatctaaag

SEQ ID NO: 118152 - DNA, 20 bp, Artificial
  CRISPR gRNA sequence
aagagacataagattgcatc

SEQ ID NO: 118153 - DNA, 20 bp, Artificial
  CRISPR gRNA sequence
catccagtttagagaatgtg

SEQ ID NO: 118154 - DNA, 20 bp, Artificial
  CRISPR gRNA sequence
agagaatgtgagtagtccca

SEQ ID NO: 118155 - DNA, 20 bp, Artificial
  CRISPR gRNA sequence
gagaatgtgagtagtcccag

SEQ ID NO: 118156 - DNA, 20 bp, Artificial
  CRISPR gRNA sequence
ctgaaggcttcaactcaagt

SEQ ID NO: 118157 - DNA, 20 bp, Artificial
  CRISPR gRNA sequence
aaggcttcaactcaagtcaa

SEQ ID NO: 118158 - DNA, 20 bp, Artificial
  CRISPR gRNA sequence
caactcaagtcaatacaagg

SEQ ID NO: 118159 - DNA, 20 bp, Artificial
  CRISPR gRNA sequence
aactcaagtcaatacaaggt

SEQ ID NO: 118160 - DNA, 20 bp, Artificial
  CRISPR gRNA sequence
aagtcaatacaaggtaataa

SEQ ID NO: 118161 - DNA, 20 bp, Artificial
  CRISPR gRNA sequence
cctacctgcatatggggact

SEQ ID NO: 118162 - DNA, 20 bp, Artificial
  CRISPR gRNA sequence
ctacctgcatatggggacta

SEQ ID NO: 118163 - DNA, 20 bp, Artificial
  CRISPR gRNA sequence
cctgcatatggggactatcc

SEQ ID NO: 118164 - DNA, 20 bp, Artificial
  CRISPR gRNA sequence
catatggggactatcctttt

SEQ ID NO: 118165 - DNA, 20 bp, Artificial
  CRISPR gRNA sequence
tccttttcctttggagagaa

SEQ ID NO: 118166 - DNA, 20 bp, Artificial
  CRISPR gRNA sequence
ttcctttggagagaaaaatc

SEQ ID NO: 118167 - DNA, 20 bp, Artificial
  CRISPR gRNA sequence
tcctttggagagaaaaatcg

SEQ ID NO: 118168 - DNA, 20 bp, Artificial
  CRISPR gRNA sequence
cctttggagagaaaaatcgt

SEQ ID NO: 118169 - DNA, 20 bp, Artificial
  CRISPR gRNA sequence
ctttggagagaaaaatcgtc

SEQ ID NO: 118170 - DNA, 20 bp, Artificial
  CRISPR gRNA sequence
tggagagaaaaatcgtccac

SEQ ID NO: 118171 - DNA, 20 bp, Artificial
  CRISPR gRNA sequence
ggagagaaaaatcgtccacc

SEQ ID NO: 118172 - DNA, 20 bp, Artificial
  CRISPR gRNA sequence
gagagaaaaatcgtccacct

SEQ ID NO: 118173 - DNA, 20 bp, Artificial
  CRISPR gRNA sequence
caccacgcttccgtgccatg

SEQ ID NO: 118174 - DNA, 20 bp, Artificial
  CRISPR gRNA sequence
accacgcttccgtgccatgg

SEQ ID NO: 118175 - DNA, 20 bp, Artificial
  CRISPR gRNA sequence
ccgtgccatggcatgacggt

SEQ ID NO: 118176 - DNA, 20 bp, Artificial
  CRISPR gRNA sequence
cgtgccatggcatgacggtg

SEQ ID NO: 118177 - DNA, 20 bp, Artificial
  CRISPR gRNA sequence
atgcaggtatttctaaaacg

SEQ ID NO: 118178 - DNA, 20 bp, Artificial
  CRISPR gRNA sequence
ctaaaacgagaaataaaacc

SEQ ID NO: 118179 - DNA, 20 bp, Artificial
  CRISPR gRNA sequence
taaaacgagaaataaaacca

SEQ ID NO: 118180 - DNA, 20 bp, Artificial
  CRISPR gRNA sequence
aaacgagaaataaaaccatt

SEQ ID NO: 118181 - DNA, 20 bp, Artificial
  CRISPR gRNA sequence
aactattaatactatccaga

SEQ ID NO: 118182 - DNA, 20 bp, Artificial
  CRISPR gRNA sequence
actattaatactatccagaa

SEQ ID NO: 118183 - DNA, 20 bp, Artificial
  CRISPR gRNA sequence
ttaatactatccagaaccag

SEQ ID NO: 118184 - DNA, 20 bp, Artificial
  CRISPR gRNA sequence
atactatccagaaccagcac

SEQ ID NO: 118185 - DNA, 20 bp, Artificial
  CRISPR gRNA sequence
tccagaaccagcacagttat

SEQ ID NO: 118186 - DNA, 20 bp, Artificial
  CRISPR gRNA sequence
tctagtgcacaaattccatt

SEQ ID NO: 118187 - DNA, 20 bp, Artificial
  CRISPR gRNA sequence
gtgcacaaattccattctcc

SEQ ID NO: 118188 - DNA, 20 bp, Artificial
  CRISPR gRNA sequence
cattctccaaagtttaagac

SEQ ID NO: 118189 - DNA, 20 bp, Artificial
  CRISPR gRNA sequence
tccaaagtttaagacagctg

SEQ ID NO: 118190 - DNA, 20 bp, Artificial
  CRISPR gRNA sequence
caaagtttaagacagctggg

SEQ ID NO: 118191 - DNA, 20 bp, Artificial
  CRISPR gRNA sequence
aagacagctgggatcaaagt

SEQ ID NO: 118192 - DNA, 20 bp, Artificial
  CRISPR gRNA sequence
agacagctgggatcaaagtc

SEQ ID NO: 118193 - DNA, 20 bp, Artificial
  CRISPR gRNA sequence
ggatcaaagtcacaagggac

SEQ ID NO: 118194 - DNA, 20 bp, Artificial
  CRISPR gRNA sequence
tgacttagaatgacgatgga

SEQ ID NO: 118195 - DNA, 20 bp, Artificial
  CRISPR gRNA sequence
agaatgacgatggaagcttt

SEQ ID NO: 118196 - DNA, 20 bp, Artificial
  CRISPR gRNA sequence
gaatgacgatggaagctttg

SEQ ID NO: 118197 - DNA, 20 bp, Artificial
  CRISPR gRNA sequence
tggagaaaacacctagtaag

SEQ ID NO: 118198 - DNA, 20 bp, Artificial
  CRISPR gRNA sequence
ggagaaaacacctagtaagt

SEQ ID NO: 118199 - DNA, 20 bp, Artificial
  CRISPR gRNA sequence
gagaaaacacctagtaagta

SEQ ID NO: 118200 - DNA, 20 bp, Artificial
  CRISPR gRNA sequence
gtaagtaatatagctaacca

SEQ ID NO: 118201 - DNA, 20 bp, Artificial
  CRISPR gRNA sequence
accatatataactactgtaa

SEQ ID NO: 118202 - DNA, 20 bp, Artificial
  CRISPR gRNA sequence
ctgtaagactgtgaatgctt

SEQ ID NO: 118203 - DNA, 20 bp, Artificial
  CRISPR gRNA sequence
taagactgtgaatgcttata

SEQ ID NO: 118204 - DNA, 20 bp, Artificial
  CRISPR gRNA sequence
tgaatgcttatagtatgaat

SEQ ID NO: 118205 - DNA, 20 bp, Artificial
  CRISPR gRNA sequence
atagtatgaattttttttaa

SEQ ID NO: 118206 - DNA, 20 bp, Artificial
  CRISPR gRNA sequence
tagtatgaattttttttaaa

SEQ ID NO: 118207 - DNA, 20 bp, Artificial
  CRISPR gRNA sequence
tttttaaaaaaaataacaga

SEQ ID NO: 118208 - DNA, 20 bp, Artificial
  CRISPR gRNA sequence
ttttaaaaaaaataacagac

SEQ ID NO: 118209 - DNA, 20 bp, Artificial
  CRISPR gRNA sequence
tttaaaaaaaataacagact

SEQ ID NO: 118210 - DNA, 20 bp, Artificial
  CRISPR gRNA sequence
ttaaaaaaaataacagacta

SEQ ID NO: 118211 - DNA, 20 bp, Artificial
  CRISPR gRNA sequence
taaaaaaaataacagactac

SEQ ID NO: 118212 - DNA, 20 bp, Artificial
  CRISPR gRNA sequence
aaaaaaaataacagactacc

SEQ ID NO: 118213 - DNA, 20 bp, Artificial
  CRISPR gRNA sequence
aaaaaaataacagactacca

SEQ ID NO: 118214 - DNA, 20 bp, Artificial
  CRISPR gRNA sequence
ccacctacacttcacaatat

SEQ ID NO: 118215 - DNA, 20 bp, Artificial
  CRISPR gRNA sequence
cacttcacaatatatacact

SEQ ID NO: 118216 - DNA, 20 bp, Artificial
  CRISPR gRNA sequence
cacaatatatacactttcct

SEQ ID NO: 118217 - DNA, 20 bp, Artificial
  CRISPR gRNA sequence
acaatatatacactttcctc

SEQ ID NO: 118218 - DNA, 20 bp, Artificial
  CRISPR gRNA sequence
tcctctgctttaataacagg

SEQ ID NO: 118219 - DNA, 20 bp, Artificial
  CRISPR gRNA sequence
cctctgctttaataacaggc

SEQ ID NO: 118220 - DNA, 20 bp, Artificial
  CRISPR gRNA sequence
ctctgctttaataacaggcc

SEQ ID NO: 118221 - DNA, 20 bp, Artificial
  CRISPR gRNA sequence
tgctttaataacaggccaaa

SEQ ID NO: 118222 - DNA, 20 bp, Artificial
  CRISPR gRNA sequence
ctttaataacaggccaaatt

SEQ ID NO: 118223 - DNA, 20 bp, Artificial
  CRISPR gRNA sequence
taataacaggccaaatttcg

SEQ ID NO: 118224 - DNA, 20 bp, Artificial
  CRISPR gRNA sequence
aataacaggccaaatttcgt

SEQ ID NO: 118225 - DNA, 20 bp, Artificial
  CRISPR gRNA sequence
ataacaggccaaatttcgtt

SEQ ID NO: 118226 - DNA, 20 bp, Artificial
  CRISPR gRNA sequence
cgtttgagcaaatgagtgtt

SEQ ID NO: 118227 - DNA, 20 bp, Artificial
  CRISPR gRNA sequence
gtttgagcaaatgagtgttc

SEQ ID NO: 118228 - DNA, 20 bp, Artificial
  CRISPR gRNA sequence
gagcaaatgagtgttcagta

SEQ ID NO: 118229 - DNA, 20 bp, Artificial
  CRISPR gRNA sequence
agcaaatgagtgttcagtaa

SEQ ID NO: 118230 - DNA, 20 bp, Artificial
  CRISPR gRNA sequence
agtaaaaagactttcctagc

SEQ ID NO: 118231 - DNA, 20 bp, Artificial
  CRISPR gRNA sequence
tcctagcattaaagtttatt

SEQ ID NO: 118232 - DNA, 20 bp, Artificial
  CRISPR gRNA sequence
cctagcattaaagtttatta

SEQ ID NO: 118233 - DNA, 20 bp, Artificial
  CRISPR gRNA sequence
ctagcattaaagtttattat

SEQ ID NO: 118234 - DNA, 20 bp, Artificial
  CRISPR gRNA sequence
gcattaaagtttattattat

SEQ ID NO: 118235 - DNA, 20 bp, Artificial
  CRISPR gRNA sequence
aagtttattattattatttt

SEQ ID NO: 118236 - DNA, 20 bp, Artificial
  CRISPR gRNA sequence
attattattattttctagaa

SEQ ID NO: 118237 - DNA, 20 bp, Artificial
  CRISPR gRNA sequence
ttattattattttctagaaa

SEQ ID NO: 118238 - DNA, 20 bp, Artificial
  CRISPR gRNA sequence
ttattattttctagaaacag

SEQ ID NO: 118239 - DNA, 20 bp, Artificial
  CRISPR gRNA sequence
ttattttctagaaacagggt

SEQ ID NO: 118240 - DNA, 20 bp, Artificial
  CRISPR gRNA sequence
ttttctagaaacagggtttc

SEQ ID NO: 118241 - DNA, 20 bp, Artificial
  CRISPR gRNA sequence
tctagaaacagggtttcact

SEQ ID NO: 118242 - DNA, 20 bp, Artificial
  CRISPR gRNA sequence
ctagaaacagggtttcactc

SEQ ID NO: 118243 - DNA, 20 bp, Artificial
  CRISPR gRNA sequence
tagaaacagggtttcactct

SEQ ID NO: 118244 - DNA, 20 bp, Artificial
  CRISPR gRNA sequence
gaaacagggtttcactctga

SEQ ID NO: 118245 - DNA, 20 bp, Artificial
  CRISPR gRNA sequence
cactctgacacccttgctgt

SEQ ID NO: 118246 - DNA, 20 bp, Artificial
  CRISPR gRNA sequence
actctgacacccttgctgtt

SEQ ID NO: 118247 - DNA, 20 bp, Artificial
  CRISPR gRNA sequence
tgacacccttgctgttggac

SEQ ID NO: 118248 - DNA, 20 bp, Artificial
  CRISPR gRNA sequence
acacccttgctgttggactg

SEQ ID NO: 118249 - DNA, 20 bp, Artificial
  CRISPR gRNA sequence
gctgttggactgcagtggca

SEQ ID NO: 118250 - DNA, 20 bp, Artificial
  CRISPR gRNA sequence
ctgttggactgcagtggcat

SEQ ID NO: 118251 - DNA, 20 bp, Artificial
  CRISPR gRNA sequence
ttggactgcagtggcatgat

SEQ ID NO: 118252 - DNA, 20 bp, Artificial
  CRISPR gRNA sequence
gactgcagtggcatgatcat

SEQ ID NO: 118253 - DNA, 20 bp, Artificial
  CRISPR gRNA sequence
cagtggcatgatcatgaatc

SEQ ID NO: 118254 - DNA, 20 bp, Artificial
  CRISPR gRNA sequence
cagccttgaattcctcggct

SEQ ID NO: 118255 - DNA, 20 bp, Artificial
  CRISPR gRNA sequence
gaattcctcggctcatgtga

SEQ ID NO: 118256 - DNA, 20 bp, Artificial
  CRISPR gRNA sequence
aattcctcggctcatgtgat

SEQ ID NO: 118257 - DNA, 20 bp, Artificial
  CRISPR gRNA sequence
ctcggctcatgtgatcctcc

SEQ ID NO: 118258 - DNA, 20 bp, Artificial
  CRISPR gRNA sequence
ggctcatgtgatcctcctgc

SEQ ID NO: 118259 - DNA, 20 bp, Artificial
  CRISPR gRNA sequence
atgtgatcctcctgcctctg

SEQ ID NO: 118260 - DNA, 20 bp, Artificial
  CRISPR gRNA sequence
ctgcctctgccttccaagta

SEQ ID NO: 118261 - DNA, 20 bp, Artificial
  CRISPR gRNA sequence
cctctgccttccaagtagga

SEQ ID NO: 118262 - DNA, 20 bp, Artificial
  CRISPR gRNA sequence
tgccttccaagtaggactac

SEQ ID NO: 118263 - DNA, 20 bp, Artificial
  CRISPR gRNA sequence
ccttccaagtaggactacag

SEQ ID NO: 118264 - DNA, 20 bp, Artificial
  CRISPR gRNA sequence
ccaagtaggactacaggcat

SEQ ID NO: 118265 - DNA, 20 bp, Artificial
  CRISPR gRNA sequence
caagtaggactacaggcatt

SEQ ID NO: 118266 - DNA, 20 bp, Artificial
  CRISPR gRNA sequence
caggcatttgccaccacacc

SEQ ID NO: 118267 - DNA, 20 bp, Artificial
  CRISPR gRNA sequence
gccaccacaccaggctggac

SEQ ID NO: 118268 - DNA, 20 bp, Artificial
  CRISPR gRNA sequence
ccaccacaccaggctggact

SEQ ID NO: 118269 - DNA, 20 bp, Artificial
  CRISPR gRNA sequence
gactttcctagccttatctg

SEQ ID NO: 118270 - DNA, 20 bp, Artificial
  CRISPR gRNA sequence
tcctagccttatctgcatgt

SEQ ID NO: 118271 - DNA, 20 bp, Artificial
  CRISPR gRNA sequence
cctagccttatctgcatgtt

SEQ ID NO: 118272 - DNA, 20 bp, Artificial
  CRISPR gRNA sequence
ctagccttatctgcatgtta

SEQ ID NO: 118273 - DNA, 20 bp, Artificial
  CRISPR gRNA sequence
gccttatctgcatgttaggt

SEQ ID NO: 118274 - DNA, 20 bp, Artificial
  CRISPR gRNA sequence
atctgcatgttaggtgtgat

SEQ ID NO: 118275 - DNA, 20 bp, Artificial
  CRISPR gRNA sequence
tctgcatgttaggtgtgatc

SEQ ID NO: 118276 - DNA, 20 bp, Artificial
  CRISPR gRNA sequence
catgttaggtgtgatcaggt

SEQ ID NO: 118277 - DNA, 20 bp, Artificial
  CRISPR gRNA sequence
ggtgtgatcaggtaactaaa

SEQ ID NO: 118278 - DNA, 20 bp, Artificial
  CRISPR gRNA sequence
aattccggctagtggaaggt

SEQ ID NO: 118279 - DNA, 20 bp, Artificial
  CRISPR gRNA sequence
cggctagtggaaggtacaca

SEQ ID NO: 118280 - DNA, 20 bp, Artificial
  CRISPR gRNA sequence
gtggaaggtacacaacttct

SEQ ID NO: 118281 - DNA, 20 bp, Artificial
  CRISPR gRNA sequence
cttcaaagtttccttgaaag

SEQ ID NO: 118282 - DNA, 20 bp, Artificial
  CRISPR gRNA sequence
ttcaaagtttccttgaaaga

SEQ ID NO: 118283 - DNA, 20 bp, Artificial
  CRISPR gRNA sequence
caaagtttccttgaaagaaa

SEQ ID NO: 118284 - DNA, 20 bp, Artificial
  CRISPR gRNA sequence
aaagtttccttgaaagaaag

SEQ ID NO: 118285 - DNA, 20 bp, Artificial
  CRISPR gRNA sequence
ccttgaaagaaagggtacct

SEQ ID NO: 118286 - DNA, 20 bp, Artificial
  CRISPR gRNA sequence
cttgaaagaaagggtacctg

SEQ ID NO: 118287 - DNA, 20 bp, Artificial
  CRISPR gRNA sequence
gaaagaaagggtacctggcc

SEQ ID NO: 118288 - DNA, 20 bp, Artificial
  CRISPR gRNA sequence
aaagaaagggtacctggccg

SEQ ID NO: 118289 - DNA, 20 bp, Artificial
  CRISPR gRNA sequence
gccgggtatggtggctcacg

SEQ ID NO: 118290 - DNA, 20 bp, Artificial
  CRISPR gRNA sequence
acgcctataatcccggcact

SEQ ID NO: 118291 - DNA, 20 bp, Artificial
  CRISPR gRNA sequence
taatcccggcactttgggag

SEQ ID NO: 118292 - DNA, 20 bp, Artificial
  CRISPR gRNA sequence
tgggaggcccaggcaggtgg

SEQ ID NO: 118293 - DNA, 20 bp, Artificial
  CRISPR gRNA sequence
gggaggcccaggcaggtgga

SEQ ID NO: 118294 - DNA, 20 bp, Artificial
  CRISPR gRNA sequence
ggaggcccaggcaggtggat

SEQ ID NO: 118295 - DNA, 20 bp, Artificial
  CRISPR gRNA sequence
aggtcaggagttcgagacca

SEQ ID NO: 118296 - DNA, 20 bp, Artificial
  CRISPR gRNA sequence
gagaccagcctggccaacat

SEQ ID NO: 118297 - DNA, 20 bp, Artificial
  CRISPR gRNA sequence
gccaacatggtgaaaccccg

SEQ ID NO: 118298 - DNA, 20 bp, Artificial
  CRISPR gRNA sequence
tactaaaaacacaaaaataa

SEQ ID NO: 118299 - DNA, 20 bp, Artificial
  CRISPR gRNA sequence
ctaaaaacacaaaaataagc

SEQ ID NO: 118300 - DNA, 20 bp, Artificial
  CRISPR gRNA sequence
aaaacacaaaaataagctgg

SEQ ID NO: 118301 - DNA, 20 bp, Artificial
  CRISPR gRNA sequence
ggcgtggtggcgcacacctg

SEQ ID NO: 118302 - DNA, 20 bp, Artificial
  CRISPR gRNA sequence
taatcccagctactcaggag

SEQ ID NO: 118303 - DNA, 20 bp, Artificial
  CRISPR gRNA sequence
ctcaggaggctgaggcagga

SEQ ID NO: 118304 - DNA, 20 bp, Artificial
  CRISPR gRNA sequence
aggaggctgaggcaggagaa

SEQ ID NO: 118305 - DNA, 20 bp, Artificial
  CRISPR gRNA sequence
aggcaggagaatcacttgaa

SEQ ID NO: 118306 - DNA, 20 bp, Artificial
  CRISPR gRNA sequence
gaacatggaaggtgcaggtt

SEQ ID NO: 118307 - DNA, 20 bp, Artificial
  CRISPR gRNA sequence
aacatggaaggtgcaggttg

SEQ ID NO: 118308 - DNA, 20 bp, Artificial
  CRISPR gRNA sequence
cagtgagctgagattgtgcc

SEQ ID NO: 118309 - DNA, 20 bp, Artificial
  CRISPR gRNA sequence
agattgtgccactgcactcc

SEQ ID NO: 118310 - DNA, 20 bp, Artificial
  CRISPR gRNA sequence
tgccactgcactccggcctg

SEQ ID NO: 118311 - DNA, 20 bp, Artificial
  CRISPR gRNA sequence
cactccggcctggatgacag

SEQ ID NO: 118312 - DNA, 20 bp, Artificial
  CRISPR gRNA sequence
cggcctggatgacagagcaa

SEQ ID NO: 118313 - DNA, 20 bp, Artificial
  CRISPR gRNA sequence
gatgacagagcaagactgag

SEQ ID NO: 118314 - DNA, 20 bp, Artificial
  CRISPR gRNA sequence
agtctcaggaaaaaaaaaaa

SEQ ID NO: 118315 - DNA, 20 bp, Artificial
  CRISPR gRNA sequence
aggaaaaaaaaaaaaaagaa

SEQ ID NO: 118316 - DNA, 20 bp, Artificial
  CRISPR gRNA sequence
tcttgttccctttcttccta

SEQ ID NO: 118317 - DNA, 20 bp, Artificial
  CRISPR gRNA sequence
cttgttccctttcttcctag

SEQ ID NO: 118318 - DNA, 20 bp, Artificial
  CRISPR gRNA sequence
ttgttccctttcttcctagg

SEQ ID NO: 118319 - DNA, 20 bp, Artificial
  CRISPR gRNA sequence
gttccctttcttcctaggct

SEQ ID NO: 118320 - DNA, 20 bp, Artificial
  CRISPR gRNA sequence
ttccctttcttcctaggctg

SEQ ID NO: 118321 - DNA, 20 bp, Artificial
  CRISPR gRNA sequence
cctttcttcctaggctggag

SEQ ID NO: 118322 - DNA, 20 bp, Artificial
  CRISPR gRNA sequence
tcttcctaggctggagccta

SEQ ID NO: 118323 - DNA, 20 bp, Artificial
  CRISPR gRNA sequence
cttcctaggctggagcctaa

SEQ ID NO: 118324 - DNA, 20 bp, Artificial
  CRISPR gRNA sequence
ttcctaggctggagcctaag

SEQ ID NO: 118325 - DNA, 20 bp, Artificial
  CRISPR gRNA sequence
cctaggctggagcctaagca

SEQ ID NO: 118326 - DNA, 20 bp, Artificial
  CRISPR gRNA sequence
ctaggctggagcctaagcag

SEQ ID NO: 118327 - DNA, 20 bp, Artificial
  CRISPR gRNA sequence
ggctggagcctaagcaggaa

SEQ ID NO: 118328 - DNA, 20 bp, Artificial
  CRISPR gRNA sequence
gagcctaagcaggaatcttg

SEQ ID NO: 118329 - DNA, 20 bp, Artificial
  CRISPR gRNA sequence
agcaggaatcttggaccatg

SEQ ID NO: 118330 - DNA, 20 bp, Artificial
  CRISPR gRNA sequence
ggaccatgaacagcacacta

SEQ ID NO: 118331 - DNA, 20 bp, Artificial
  CRISPR gRNA sequence
gaccatgaacagcacactag

SEQ ID NO: 118332 - DNA, 20 bp, Artificial
  CRISPR gRNA sequence
gcaatattaaagcagtgaaa

SEQ ID NO: 118333 - DNA, 20 bp, Artificial
  CRISPR gRNA sequence
aagcagtgaaacaggtcttg

SEQ ID NO: 118334 - DNA, 20 bp, Artificial
  CRISPR gRNA sequence
gagaactgtgaaaatgtgct

SEQ ID NO: 118335 - DNA, 20 bp, Artificial
  CRISPR gRNA sequence
agaactgtgaaaatgtgcta

SEQ ID NO: 118336 - DNA, 20 bp, Artificial
  CRISPR gRNA sequence
tgaaaatgtgctaccagtcc

SEQ ID NO: 118337 - DNA, 20 bp, Artificial
  CRISPR gRNA sequence
ccagtccaggataatttatc

SEQ ID NO: 118338 - DNA, 20 bp, Artificial
  CRISPR gRNA sequence
atctctggactacttttatg

SEQ ID NO: 118339 - DNA, 20 bp, Artificial
  CRISPR gRNA sequence
tctctggactacttttatgt

SEQ ID NO: 118340 - DNA, 20 bp, Artificial
  CRISPR gRNA sequence
tggactacttttatgtatga

SEQ ID NO: 118341 - DNA, 20 bp, Artificial
  CRISPR gRNA sequence
gactacttttatgtatgaaa

SEQ ID NO: 118342 - DNA, 20 bp, Artificial
  CRISPR gRNA sequence
cttttatgtatgaaaaggaa

SEQ ID NO: 118343 - DNA, 20 bp, Artificial
  CRISPR gRNA sequence
ttatgtatgaaaaggaataa

SEQ ID NO: 118344 - DNA, 20 bp, Artificial
  CRISPR gRNA sequence
tatgtatgaaaaggaataac

SEQ ID NO: 118345 - DNA, 20 bp, Artificial
  CRISPR gRNA sequence
atgtatgaaaaggaataaca

SEQ ID NO: 118346 - DNA, 20 bp, Artificial
  CRISPR gRNA sequence
tgtatgaaaaggaataacat

SEQ ID NO: 118347 - DNA, 20 bp, Artificial
  CRISPR gRNA sequence
atttaagccactgtttgttt

SEQ ID NO: 118348 - DNA, 20 bp, Artificial
  CRISPR gRNA sequence
tttaagccactgtttgtttt

SEQ ID NO: 118349 - DNA, 20 bp, Artificial
  CRISPR gRNA sequence
aagccactgtttgttttcgt

SEQ ID NO: 118350 - DNA, 20 bp, Artificial
  CRISPR gRNA sequence
agccactgtttgttttcgtt

SEQ ID NO: 118351 - DNA, 20 bp, Artificial
  CRISPR gRNA sequence
tttgttttcgttattataac

SEQ ID NO: 118352 - DNA, 20 bp, Artificial
  CRISPR gRNA sequence
gttttcgttattataactgc

SEQ ID NO: 118353 - DNA, 20 bp, Artificial
  CRISPR gRNA sequence
ttttcgttattataactgca

SEQ ID NO: 118354 - DNA, 20 bp, Artificial
  CRISPR gRNA sequence
tcgttattataactgcagct

SEQ ID NO: 118355 - DNA, 20 bp, Artificial
  CRISPR gRNA sequence
cgttattataactgcagctg

SEQ ID NO: 118356 - DNA, 20 bp, Artificial
  CRISPR gRNA sequence
gttattataactgcagctgc

SEQ ID NO: 118357 - DNA, 20 bp, Artificial
  CRISPR gRNA sequence
ttataactgcagctgcatat

SEQ ID NO: 118358 - DNA, 20 bp, Artificial
  CRISPR gRNA sequence
taactgcagctgcatattag

SEQ ID NO: 118359 - DNA, 20 bp, Artificial
  CRISPR gRNA sequence
cagctgcatattagtaataa

SEQ ID NO: 118360 - DNA, 20 bp, Artificial
  CRISPR gRNA sequence
catattagtaataacaaatg

SEQ ID NO: 118361 - DNA, 20 bp, Artificial
  CRISPR gRNA sequence
gtaataacaaatgctaactc

SEQ ID NO: 118362 - DNA, 20 bp, Artificial
  CRISPR gRNA sequence
actcttacaaaagagacaac

SEQ ID NO: 118363 - DNA, 20 bp, Artificial
  CRISPR gRNA sequence
ttacaaaagagacaacaagt

SEQ ID NO: 118364 - DNA, 20 bp, Artificial
  CRISPR gRNA sequence
acaaaagagacaacaagtat

SEQ ID NO: 118365 - DNA, 20 bp, Artificial
  CRISPR gRNA sequence
caaaagagacaacaagtatc

SEQ ID NO: 118366 - DNA, 20 bp, Artificial
  CRISPR gRNA sequence
acgtcaattgtttggaaggt

SEQ ID NO: 118367 - DNA, 20 bp, Artificial
  CRISPR gRNA sequence
tttggaaggtacgtgagaaa

SEQ ID NO: 118368 - DNA, 20 bp, Artificial
  CRISPR gRNA sequence
ggaaggtacgtgagaaaaca

SEQ ID NO: 118369 - DNA, 20 bp, Artificial
  CRISPR gRNA sequence
gaaggtacgtgagaaaacaa

SEQ ID NO: 118370 - DNA, 20 bp, Artificial
  CRISPR gRNA sequence
caaaagtagaaccctgctat

SEQ ID NO: 118371 - DNA, 20 bp, Artificial
  CRISPR gRNA sequence
aaaagtagaaccctgctatt

SEQ ID NO: 118372 - DNA, 20 bp, Artificial
  CRISPR gRNA sequence
ctattctcctttcctatatc

SEQ ID NO: 118373 - DNA, 20 bp, Artificial
  CRISPR gRNA sequence
ttctcctttcctatatcctt

SEQ ID NO: 118374 - DNA, 20 bp, Artificial
  CRISPR gRNA sequence
tcctttcctatatccttccc

SEQ ID NO: 118375 - DNA, 20 bp, Artificial
  CRISPR gRNA sequence
ctttcctatatccttcccaa

SEQ ID NO: 118376 - DNA, 20 bp, Artificial
  CRISPR gRNA sequence
tcctatatccttcccaatgt

SEQ ID NO: 118377 - DNA, 20 bp, Artificial
  CRISPR gRNA sequence
cctatatccttcccaatgtt

SEQ ID NO: 118378 - DNA, 20 bp, Artificial
  CRISPR gRNA sequence
ctatatccttcccaatgtta

SEQ ID NO: 118379 - DNA, 20 bp, Artificial
  CRISPR gRNA sequence
tatccttcccaatgttatac

SEQ ID NO: 118380 - DNA, 20 bp, Artificial
  CRISPR gRNA sequence
cccaatgttatacataccct

SEQ ID NO: 118381 - DNA, 20 bp, Artificial
  CRISPR gRNA sequence
ccaatgttatacataccctt

SEQ ID NO: 118382 - DNA, 20 bp, Artificial
  CRISPR gRNA sequence
tacatacccttctctccttt

SEQ ID NO: 118383 - DNA, 20 bp, Artificial
  CRISPR gRNA sequence
ctctcctttggaattttccc

SEQ ID NO: 118384 - DNA, 20 bp, Artificial
  CRISPR gRNA sequence
tctcctttggaattttccct

SEQ ID NO: 118385 - DNA, 20 bp, Artificial
  CRISPR gRNA sequence
tcctttggaattttcccttc

SEQ ID NO: 118386 - DNA, 20 bp, Artificial
  CRISPR gRNA sequence
ctttggaattttcccttctg

SEQ ID NO: 118387 - DNA, 20 bp, Artificial
  CRISPR gRNA sequence
tggaattttcccttctgcct

SEQ ID NO: 118388 - DNA, 20 bp, Artificial
  CRISPR gRNA sequence
ggaattttcccttctgcctc

SEQ ID NO: 118389 - DNA, 20 bp, Artificial
  CRISPR gRNA sequence
gaattttcccttctgcctct

SEQ ID NO: 118390 - DNA, 20 bp, Artificial
  CRISPR gRNA sequence
tcccttctgcctctagttta

SEQ ID NO: 118391 - DNA, 20 bp, Artificial
  CRISPR gRNA sequence
cccttctgcctctagtttag

SEQ ID NO: 118392 - DNA, 20 bp, Artificial
  CRISPR gRNA sequence
ccttctgcctctagtttagc

SEQ ID NO: 118393 - DNA, 20 bp, Artificial
  CRISPR gRNA sequence
ctgcctctagtttagctcgg

SEQ ID NO: 118394 - DNA, 20 bp, Artificial
  CRISPR gRNA sequence
tgcctctagtttagctcggg

SEQ ID NO: 118395 - DNA, 20 bp, Artificial
  CRISPR gRNA sequence
cctctagtttagctcgggct

SEQ ID NO: 118396 - DNA, 20 bp, Artificial
  CRISPR gRNA sequence
tagtttagctcgggcttgcc

SEQ ID NO: 118397 - DNA, 20 bp, Artificial
  CRISPR gRNA sequence
gtttagctcgggcttgcctc

SEQ ID NO: 118398 - DNA, 20 bp, Artificial
  CRISPR gRNA sequence
agctcgggcttgcctcctct

SEQ ID NO: 118399 - DNA, 20 bp, Artificial
  CRISPR gRNA sequence
gctcgggcttgcctcctctt

SEQ ID NO: 118400 - DNA, 20 bp, Artificial
  CRISPR gRNA sequence
gggcttgcctcctcttaaga

SEQ ID NO: 118401 - DNA, 20 bp, Artificial
  CRISPR gRNA sequence
gcctcctcttaagaatacgg

SEQ ID NO: 118402 - DNA, 20 bp, Artificial
  CRISPR gRNA sequence
cctcctcttaagaatacggt

SEQ ID NO: 118403 - DNA, 20 bp, Artificial
  CRISPR gRNA sequence
ctcttaagaatacggtggta

SEQ ID NO: 118404 - DNA, 20 bp, Artificial
  CRISPR gRNA sequence
ttaagaatacggtggtattg

SEQ ID NO: 118405 - DNA, 20 bp, Artificial
  CRISPR gRNA sequence
aagaatacggtggtattgtt

SEQ ID NO: 118406 - DNA, 20 bp, Artificial
  CRISPR gRNA sequence
agaatacggtggtattgttt

SEQ ID NO: 118407 - DNA, 20 bp, Artificial
  CRISPR gRNA sequence
tttggcattcacgtagagag

SEQ ID NO: 118408 - DNA, 20 bp, Artificial
  CRISPR gRNA sequence
ggcattcacgtagagaggct

SEQ ID NO: 118409 - DNA, 20 bp, Artificial
  CRISPR gRNA sequence
gcattcacgtagagaggctc

SEQ ID NO: 118410 - DNA, 20 bp, Artificial
  CRISPR gRNA sequence
acgtagagaggctcttcttc

SEQ ID NO: 118411 - DNA, 20 bp, Artificial
  CRISPR gRNA sequence
ttcttcaagcatctctgctc

SEQ ID NO: 118412 - DNA, 20 bp, Artificial
  CRISPR gRNA sequence
cttcaagcatctctgctcca

SEQ ID NO: 118413 - DNA, 20 bp, Artificial
  CRISPR gRNA sequence
ttcaagcatctctgctccag

SEQ ID NO: 118414 - DNA, 20 bp, Artificial
  CRISPR gRNA sequence
caagcatctctgctccaggt

SEQ ID NO: 118415 - DNA, 20 bp, Artificial
  CRISPR gRNA sequence
aagcatctctgctccaggta

SEQ ID NO: 118416 - DNA, 20 bp, Artificial
  CRISPR gRNA sequence
tgctccaggtagagggattc

SEQ ID NO: 118417 - DNA, 20 bp, Artificial
  CRISPR gRNA sequence
ctccaggtagagggattctt

SEQ ID NO: 118418 - DNA, 20 bp, Artificial
  CRISPR gRNA sequence
caggtagagggattctttgg

SEQ ID NO: 118419 - DNA, 20 bp, Artificial
  CRISPR gRNA sequence
tttggatagcaggcacagag

SEQ ID NO: 118420 - DNA, 20 bp, Artificial
  CRISPR gRNA sequence
tggatagcaggcacagagcc

SEQ ID NO: 118421 - DNA, 20 bp, Artificial
  CRISPR gRNA sequence
ggatagcaggcacagagcca

SEQ ID NO: 118422 - DNA, 20 bp, Artificial
  CRISPR gRNA sequence
gatagcaggcacagagccag

SEQ ID NO: 118423 - DNA, 20 bp, Artificial
  CRISPR gRNA sequence
tgtgaacaggaaaccagagc

SEQ ID NO: 118424 - DNA, 20 bp, Artificial
  CRISPR gRNA sequence
attggtggcatgaagtatgg

SEQ ID NO: 118425 - DNA, 20 bp, Artificial
  CRISPR gRNA sequence
ttggtggcatgaagtatgga

SEQ ID NO: 118426 - DNA, 20 bp, Artificial
  CRISPR gRNA sequence
gtggcatgaagtatggacat

SEQ ID NO: 118427 - DNA, 20 bp, Artificial
  CRISPR gRNA sequence
cttggttcctcttcatccat

SEQ ID NO: 118428 - DNA, 20 bp, Artificial
  CRISPR gRNA sequence
ttggttcctcttcatccatt

SEQ ID NO: 118429 - DNA, 20 bp, Artificial
  CRISPR gRNA sequence
ggttcctcttcatccatttt

SEQ ID NO: 118430 - DNA, 20 bp, Artificial
  CRISPR gRNA sequence
gttcctcttcatccattttt

SEQ ID NO: 118431 - DNA, 20 bp, Artificial
  CRISPR gRNA sequence
ctcttcatccattttttttg

SEQ ID NO: 118432 - DNA, 20 bp, Artificial
  CRISPR gRNA sequence
ttcatccattttttttgtaa

SEQ ID NO: 118433 - DNA, 20 bp, Artificial
  CRISPR gRNA sequence
catccattttttttgtaaat

SEQ ID NO: 118434 - DNA, 20 bp, Artificial
  CRISPR gRNA sequence
atccattttttttgtaaatg

SEQ ID NO: 118435 - DNA, 20 bp, Artificial
  CRISPR gRNA sequence
tttttgtaaatgccacaaaa

SEQ ID NO: 118436 - DNA, 20 bp, Artificial
  CRISPR gRNA sequence
ttttgtaaatgccacaaaaa

SEQ ID NO: 118437 - DNA, 20 bp, Artificial
  CRISPR gRNA sequence
tttgtaaatgccacaaaaag

SEQ ID NO: 118438 - DNA, 20 bp, Artificial
  CRISPR gRNA sequence
ttgtaaatgccacaaaaagt

SEQ ID NO: 118439 - DNA, 20 bp, Artificial
  CRISPR gRNA sequence
tgtaaatgccacaaaaagta

SEQ ID NO: 118440 - DNA, 20 bp, Artificial
  CRISPR gRNA sequence
gtaaatgccacaaaaagtaa

SEQ ID NO: 118441 - DNA, 20 bp, Artificial
  CRISPR gRNA sequence
taaatgccacaaaaagtaat

SEQ ID NO: 118442 - DNA, 20 bp, Artificial
  CRISPR gRNA sequence
ttatagggtacttgggtaaa

SEQ ID NO: 118443 - DNA, 20 bp, Artificial
  CRISPR gRNA sequence
tatagggtacttgggtaaat

SEQ ID NO: 118444 - DNA, 20 bp, Artificial
  CRISPR gRNA sequence
atagggtacttgggtaaatg

SEQ ID NO: 118445 - DNA, 20 bp, Artificial
  CRISPR gRNA sequence
tagggtacttgggtaaatgc

SEQ ID NO: 118446 - DNA, 20 bp, Artificial
  CRISPR gRNA sequence
gggtaaatgcggatccctgg

SEQ ID NO: 118447 - DNA, 20 bp, Artificial
  CRISPR gRNA sequence
ggtaaatgcggatccctgga

SEQ ID NO: 118448 - DNA, 20 bp, Artificial
  CRISPR gRNA sequence
gagaaatttatactaaagat

SEQ ID NO: 118449 - DNA, 20 bp, Artificial
  CRISPR gRNA sequence
atactaaagatctgcacttt

SEQ ID NO: 118450 - DNA, 20 bp, Artificial
  CRISPR gRNA sequence
tactaaagatctgcacttta

SEQ ID NO: 118451 - DNA, 20 bp, Artificial
  CRISPR gRNA sequence
aagatctgcactttaaacaa

SEQ ID NO: 118452 - DNA, 20 bp, Artificial
  CRISPR gRNA sequence
cactttaaacaaacacccca

SEQ ID NO: 118453 - DNA, 20 bp, Artificial
  CRISPR gRNA sequence
taaacaaacaccccagatga

SEQ ID NO: 118454 - DNA, 20 bp, Artificial
  CRISPR gRNA sequence
aaacaaacaccccagatgac

SEQ ID NO: 118455 - DNA, 20 bp, Artificial
  CRISPR gRNA sequence
aacaaacaccccagatgact

SEQ ID NO: 118456 - DNA, 20 bp, Artificial
  CRISPR gRNA sequence
tgtcataggagattcaggtg

SEQ ID NO: 118457 - DNA, 20 bp, Artificial
  CRISPR gRNA sequence
aggtgccactctgagaaact

SEQ ID NO: 118458 - DNA, 20 bp, Artificial
  CRISPR gRNA sequence
tgagaaactatataaccatg

SEQ ID NO: 118459 - DNA, 20 bp, Artificial
  CRISPR gRNA sequence
agaaactatataaccatgcc

SEQ ID NO: 118460 - DNA, 20 bp, Artificial
  CRISPR gRNA sequence
tataaccatgccctaattca

SEQ ID NO: 118461 - DNA, 20 bp, Artificial
  CRISPR gRNA sequence
attcatgtccacccatggct

SEQ ID NO: 118462 - DNA, 20 bp, Artificial
  CRISPR gRNA sequence
atgtccacccatggctctag

SEQ ID NO: 118463 - DNA, 20 bp, Artificial
  CRISPR gRNA sequence
tagatatttctgctgccatc

SEQ ID NO: 118464 - DNA, 20 bp, Artificial
  CRISPR gRNA sequence
gatatttctgctgccatcta

SEQ ID NO: 118465 - DNA, 20 bp, Artificial
  CRISPR gRNA sequence
ctgctgccatctaatggtca

SEQ ID NO: 118466 - DNA, 20 bp, Artificial
  CRISPR gRNA sequence
tgctgccatctaatggtcag

SEQ ID NO: 118467 - DNA, 20 bp, Artificial
  CRISPR gRNA sequence
ctgccatctaatggtcagga

SEQ ID NO: 118468 - DNA, 20 bp, Artificial
  CRISPR gRNA sequence
ccatctaatggtcaggaaca

SEQ ID NO: 118469 - DNA, 20 bp, Artificial
  CRISPR gRNA sequence
atggtcaggaacagtagtca

SEQ ID NO: 118470 - DNA, 20 bp, Artificial
  CRISPR gRNA sequence
ctaaatgcctatatttataa

SEQ ID NO: 118471 - DNA, 20 bp, Artificial
  CRISPR gRNA sequence
aatgcctatatttataaaaa

SEQ ID NO: 118472 - DNA, 20 bp, Artificial
  CRISPR gRNA sequence
tatttataaaaataatagtt

SEQ ID NO: 118473 - DNA, 20 bp, Artificial
  CRISPR gRNA sequence
ataaaaataatagttaactt

SEQ ID NO: 118474 - DNA, 20 bp, Artificial
  CRISPR gRNA sequence
taaaaataatagttaactta

SEQ ID NO: 118475 - DNA, 20 bp, Artificial
  CRISPR gRNA sequence
acttataattcaatcctaat

SEQ ID NO: 118476 - DNA, 20 bp, Artificial
  CRISPR gRNA sequence
ataattcaatcctaattttt

SEQ ID NO: 118477 - DNA, 20 bp, Artificial
  CRISPR gRNA sequence
taattcaatcctaatttttc

SEQ ID NO: 118478 - DNA, 20 bp, Artificial
  CRISPR gRNA sequence
aatcctaatttttcttaaaa

SEQ ID NO: 118479 - DNA, 20 bp, Artificial
  CRISPR gRNA sequence
atttttcttaaaaaacacca

SEQ ID NO: 118480 - DNA, 20 bp, Artificial
  CRISPR gRNA sequence
ttcttaaaaaacaccaaaac

SEQ ID NO: 118481 - DNA, 20 bp, Artificial
  CRISPR gRNA sequence
tcttaaaaaacaccaaaaca

SEQ ID NO: 118482 - DNA, 20 bp, Artificial
  CRISPR gRNA sequence
cttaaaaaacaccaaaacac

SEQ ID NO: 118483 - DNA, 20 bp, Artificial
  CRISPR gRNA sequence
ttaaaaaacaccaaaacact

SEQ ID NO: 118484 - DNA, 20 bp, Artificial
  CRISPR gRNA sequence
aaaaaacaccaaaacactgt

SEQ ID NO: 118485 - DNA, 20 bp, Artificial
  CRISPR gRNA sequence
aaaaacaccaaaacactgta

SEQ ID NO: 118486 - DNA, 20 bp, Artificial
  CRISPR gRNA sequence
tactaaatgtaggtaaaaac

SEQ ID NO: 118487 - DNA, 20 bp, Artificial
  CRISPR gRNA sequence
aatgtaggtaaaaacaagta

SEQ ID NO: 118488 - DNA, 20 bp, Artificial
  CRISPR gRNA sequence
taccccacagctctttccca

SEQ ID NO: 118489 - DNA, 20 bp, Artificial
  CRISPR gRNA sequence
tttcccaaatacaaccgctt

SEQ ID NO: 118490 - DNA, 20 bp, Artificial
  CRISPR gRNA sequence
tcccaaatacaaccgctttg

SEQ ID NO: 118491 - DNA, 20 bp, Artificial
  CRISPR gRNA sequence
cccaaatacaaccgctttga

SEQ ID NO: 118492 - DNA, 20 bp, Artificial
  CRISPR gRNA sequence
ccaaatacaaccgctttgaa

SEQ ID NO: 118493 - DNA, 20 bp, Artificial
  CRISPR gRNA sequence
tgaataactgtattgaatct

SEQ ID NO: 118494 - DNA, 20 bp, Artificial
  CRISPR gRNA sequence
gaataactgtattgaatctt

SEQ ID NO: 118495 - DNA, 20 bp, Artificial
  CRISPR gRNA sequence
aataactgtattgaatcttt

SEQ ID NO: 118496 - DNA, 20 bp, Artificial
  CRISPR gRNA sequence
tattgaatcttttataaaaa

SEQ ID NO: 118497 - DNA, 20 bp, Artificial
  CRISPR gRNA sequence
aatcttttataaaaattatt

SEQ ID NO: 118498 - DNA, 20 bp, Artificial
  CRISPR gRNA sequence
ttataaaaattatttatttt

SEQ ID NO: 118499 - DNA, 20 bp, Artificial
  CRISPR gRNA sequence
tataaaaattatttattttt

SEQ ID NO: 118500 - DNA, 20 bp, Artificial
  CRISPR gRNA sequence
ataaaaattatttatttttc

SEQ ID NO: 118501 - DNA, 20 bp, Artificial
  CRISPR gRNA sequence
taaaaattatttatttttca

SEQ ID NO: 118502 - DNA, 20 bp, Artificial
  CRISPR gRNA sequence
tttatttttcattcaattcg

SEQ ID NO: 118503 - DNA, 20 bp, Artificial
  CRISPR gRNA sequence
atttttcattcaattcgtag

SEQ ID NO: 118504 - DNA, 20 bp, Artificial
  CRISPR gRNA sequence
tttttcattcaattcgtaga

SEQ ID NO: 118505 - DNA, 20 bp, Artificial
  CRISPR gRNA sequence
ttcattcaattcgtagaaac

SEQ ID NO: 118506 - DNA, 20 bp, Artificial
  CRISPR gRNA sequence
tcattcaattcgtagaaacg

SEQ ID NO: 118507 - DNA, 20 bp, Artificial
  CRISPR gRNA sequence
cattcaattcgtagaaacga

SEQ ID NO: 118508 - DNA, 20 bp, Artificial
  CRISPR gRNA sequence
attcaattcgtagaaacgag

SEQ ID NO: 118509 - DNA, 20 bp, Artificial
  CRISPR gRNA sequence
aattcgtagaaacgaggtct

SEQ ID NO: 118510 - DNA, 20 bp, Artificial
  CRISPR gRNA sequence
gtagaaacgaggtctctcta

SEQ ID NO: 118511 - DNA, 20 bp, Artificial
  CRISPR gRNA sequence
tctacattgcccaggctgag

SEQ ID NO: 118512 - DNA, 20 bp, Artificial
  CRISPR gRNA sequence
tacattgcccaggctgagct

SEQ ID NO: 118513 - DNA, 20 bp, Artificial
  CRISPR gRNA sequence
cattgcccaggctgagctca

SEQ ID NO: 118514 - DNA, 20 bp, Artificial
  CRISPR gRNA sequence
cccaggctgagctcaaactc

SEQ ID NO: 118515 - DNA, 20 bp, Artificial
  CRISPR gRNA sequence
agctcaaactcctggactta

SEQ ID NO: 118516 - DNA, 20 bp, Artificial
  CRISPR gRNA sequence
aaactcctggacttaagcca

SEQ ID NO: 118517 - DNA, 20 bp, Artificial
  CRISPR gRNA sequence
ctggacttaagccatcctcc

SEQ ID NO: 118518 - DNA, 20 bp, Artificial
  CRISPR gRNA sequence
gacttaagccatcctcctgg

SEQ ID NO: 118519 - DNA, 20 bp, Artificial
  CRISPR gRNA sequence
aagccatcctcctggattag

SEQ ID NO: 118520 - DNA, 20 bp, Artificial
  CRISPR gRNA sequence
agccatcctcctggattagc

SEQ ID NO: 118521 - DNA, 20 bp, Artificial
  CRISPR gRNA sequence
ctggattagcctcccaagta

SEQ ID NO: 118522 - DNA, 20 bp, Artificial
  CRISPR gRNA sequence
gattagcctcccaagtagct

SEQ ID NO: 118523 - DNA, 20 bp, Artificial
  CRISPR gRNA sequence
gcctcccaagtagctaggac

SEQ ID NO: 118524 - DNA, 20 bp, Artificial
  CRISPR gRNA sequence
ccaagtagctaggactacag

SEQ ID NO: 118525 - DNA, 20 bp, Artificial
  CRISPR gRNA sequence
ggactacaggtgcatgccac

SEQ ID NO: 118526 - DNA, 20 bp, Artificial
  CRISPR gRNA sequence
caggtgcatgccactgagcc

SEQ ID NO: 118527 - DNA, 20 bp, Artificial
  CRISPR gRNA sequence
agccagggttggttctgttt

SEQ ID NO: 118528 - DNA, 20 bp, Artificial
  CRISPR gRNA sequence
gttctgtttcttttcatagc

SEQ ID NO: 118529 - DNA, 20 bp, Artificial
  CRISPR gRNA sequence
tgtttcttttcatagcttcc

SEQ ID NO: 118530 - DNA, 20 bp, Artificial
  CRISPR gRNA sequence
tttcttttcatagcttcctc

SEQ ID NO: 118531 - DNA, 20 bp, Artificial
  CRISPR gRNA sequence
cttttcatagcttcctccac

SEQ ID NO: 118532 - DNA, 20 bp, Artificial
  CRISPR gRNA sequence
ttttcatagcttcctccacc

SEQ ID NO: 118533 - DNA, 20 bp, Artificial
  CRISPR gRNA sequence
ttcatagcttcctccacctc

SEQ ID NO: 118534 - DNA, 20 bp, Artificial
  CRISPR gRNA sequence
tcatagcttcctccacctct

SEQ ID NO: 118535 - DNA, 20 bp, Artificial
  CRISPR gRNA sequence
catagcttcctccacctctg

SEQ ID NO: 118536 - DNA, 20 bp, Artificial
  CRISPR gRNA sequence
atagcttcctccacctctgt

SEQ ID NO: 118537 - DNA, 20 bp, Artificial
  CRISPR gRNA sequence
cctccacctctgtgcagact

SEQ ID NO: 118538 - DNA, 20 bp, Artificial
  CRISPR gRNA sequence
ctccacctctgtgcagactt

SEQ ID NO: 118539 - DNA, 20 bp, Artificial
  CRISPR gRNA sequence
cacctctgtgcagacttctg

SEQ ID NO: 118540 - DNA, 20 bp, Artificial
  CRISPR gRNA sequence
tgtgcagacttctgttactc

SEQ ID NO: 118541 - DNA, 20 bp, Artificial
  CRISPR gRNA sequence
tgcagacttctgttactcat

SEQ ID NO: 118542 - DNA, 20 bp, Artificial
  CRISPR gRNA sequence
ctgttactcattcttaattt

SEQ ID NO: 118543 - DNA, 20 bp, Artificial
  CRISPR gRNA sequence
tgttactcattcttaattta

SEQ ID NO: 118544 - DNA, 20 bp, Artificial
  CRISPR gRNA sequence
ttactcattcttaatttatg

SEQ ID NO: 118545 - DNA, 20 bp, Artificial
  CRISPR gRNA sequence
ctcattcttaatttatgcat

SEQ ID NO: 118546 - DNA, 20 bp, Artificial
  CRISPR gRNA sequence
attcttaatttatgcatttt

SEQ ID NO: 118547 - DNA, 20 bp, Artificial
  CRISPR gRNA sequence
ttaatttatgcattttaaca

SEQ ID NO: 118548 - DNA, 20 bp, Artificial
  CRISPR gRNA sequence
aatttatgcattttaacatc

SEQ ID NO: 118549 - DNA, 20 bp, Artificial
  CRISPR gRNA sequence
atttatgcattttaacatcc

SEQ ID NO: 118550 - DNA, 20 bp, Artificial
  CRISPR gRNA sequence
atgcattttaacatcctatt

SEQ ID NO: 118551 - DNA, 20 bp, Artificial
  CRISPR gRNA sequence
tgcattttaacatcctattt

SEQ ID NO: 118552 - DNA, 20 bp, Artificial
  CRISPR gRNA sequence
taacatcctattttgacata

SEQ ID NO: 118553 - DNA, 20 bp, Artificial
  CRISPR gRNA sequence
aacatcctattttgacatat

SEQ ID NO: 118554 - DNA, 20 bp, Artificial
  CRISPR gRNA sequence
acatcctattttgacatatg

SEQ ID NO: 118555 - DNA, 20 bp, Artificial
  CRISPR gRNA sequence
ttttgacatatgaggattta

SEQ ID NO: 118556 - DNA, 20 bp, Artificial
  CRISPR gRNA sequence
tgacatatgaggatttagct

SEQ ID NO: 118557 - DNA, 20 bp, Artificial
  CRISPR gRNA sequence
gacatatgaggatttagctt

SEQ ID NO: 118558 - DNA, 20 bp, Artificial
  CRISPR gRNA sequence
acatatgaggatttagcttt

SEQ ID NO: 118559 - DNA, 20 bp, Artificial
  CRISPR gRNA sequence
agctttcagttacaccaccc

SEQ ID NO: 118560 - DNA, 20 bp, Artificial
  CRISPR gRNA sequence
gctttcagttacaccaccca

SEQ ID NO: 118561 - DNA, 20 bp, Artificial
  CRISPR gRNA sequence
tcagttacaccacccaaatc

SEQ ID NO: 118562 - DNA, 20 bp, Artificial
  CRISPR gRNA sequence
cagttacaccacccaaatct

SEQ ID NO: 118563 - DNA, 20 bp, Artificial
  CRISPR gRNA sequence
agttacaccacccaaatctt

SEQ ID NO: 118564 - DNA, 20 bp, Artificial
  CRISPR gRNA sequence
caccacccaaatcttcctat

SEQ ID NO: 118565 - DNA, 20 bp, Artificial
  CRISPR gRNA sequence
cctatcttcccaatacattt

SEQ ID NO: 118566 - DNA, 20 bp, Artificial
  CRISPR gRNA sequence
ctatcttcccaatacattta

SEQ ID NO: 118567 - DNA, 20 bp, Artificial
  CRISPR gRNA sequence
tcttcccaatacatttacat

SEQ ID NO: 118568 - DNA, 20 bp, Artificial
  CRISPR gRNA sequence
cccaatacatttacatgaca

SEQ ID NO: 118569 - DNA, 20 bp, Artificial
  CRISPR gRNA sequence
ccaatacatttacatgacac

SEQ ID NO: 118570 - DNA, 20 bp, Artificial
  CRISPR gRNA sequence
acatgacactttttttttgg

SEQ ID NO: 118571 - DNA, 20 bp, Artificial
  CRISPR gRNA sequence
catgacactttttttttggt

SEQ ID NO: 118572 - DNA, 20 bp, Artificial
  CRISPR gRNA sequence
tttttttggtttctctatca

SEQ ID NO: 118573 - DNA, 20 bp, Artificial
  CRISPR gRNA sequence
ttttttggtttctctatcaa

SEQ ID NO: 118574 - DNA, 20 bp, Artificial
  CRISPR gRNA sequence
tttttggtttctctatcaat

SEQ ID NO: 118575 - DNA, 20 bp, Artificial
  CRISPR gRNA sequence
ttttggtttctctatcaatt

SEQ ID NO: 118576 - DNA, 20 bp, Artificial
  CRISPR gRNA sequence
tttggtttctctatcaatta

SEQ ID NO: 118577 - DNA, 20 bp, Artificial
  CRISPR gRNA sequence
ttggtttctctatcaattac

SEQ ID NO: 118578 - DNA, 20 bp, Artificial
  CRISPR gRNA sequence
tggtttctctatcaattaca

SEQ ID NO: 118579 - DNA, 20 bp, Artificial
  CRISPR gRNA sequence
ggtttctctatcaattacaa

SEQ ID NO: 118580 - DNA, 20 bp, Artificial
  CRISPR gRNA sequence
gtttctctatcaattacaat

SEQ ID NO: 118581 - DNA, 20 bp, Artificial
  CRISPR gRNA sequence
ctctatcaattacaatcttt

SEQ ID NO: 118582 - DNA, 20 bp, Artificial
  CRISPR gRNA sequence
tctatcaattacaatctttc

SEQ ID NO: 118583 - DNA, 20 bp, Artificial
  CRISPR gRNA sequence
tatcaattacaatctttcta

SEQ ID NO: 118584 - DNA, 20 bp, Artificial
  CRISPR gRNA sequence
tcaattacaatctttctaat

SEQ ID NO: 118585 - DNA, 20 bp, Artificial
  CRISPR gRNA sequence
caatctttctaatttttagc

SEQ ID NO: 118586 - DNA, 20 bp, Artificial
  CRISPR gRNA sequence
tctaatttttagcttatttc

SEQ ID NO: 118587 - DNA, 20 bp, Artificial
  CRISPR gRNA sequence
ctaatttttagcttatttct

SEQ ID NO: 118588 - DNA, 20 bp, Artificial
  CRISPR gRNA sequence
taatttttagcttatttctt

SEQ ID NO: 118589 - DNA, 20 bp, Artificial
  CRISPR gRNA sequence
atttttagcttatttcttat

SEQ ID NO: 118590 - DNA, 20 bp, Artificial
  CRISPR gRNA sequence
ttagcttatttcttattttg

SEQ ID NO: 118591 - DNA, 20 bp, Artificial
  CRISPR gRNA sequence
tagcttatttcttattttgt

SEQ ID NO: 118592 - DNA, 20 bp, Artificial
  CRISPR gRNA sequence
agcttatttcttattttgtc

SEQ ID NO: 118593 - DNA, 20 bp, Artificial
  CRISPR gRNA sequence
gcttatttcttattttgtcc

SEQ ID NO: 118594 - DNA, 20 bp, Artificial
  CRISPR gRNA sequence
atttcttattttgtccatca

SEQ ID NO: 118595 - DNA, 20 bp, Artificial
  CRISPR gRNA sequence
tttcttattttgtccatcat

SEQ ID NO: 118596 - DNA, 20 bp, Artificial
  CRISPR gRNA sequence
cttattttgtccatcatggg

SEQ ID NO: 118597 - DNA, 20 bp, Artificial
  CRISPR gRNA sequence
ttattttgtccatcatgggc

SEQ ID NO: 118598 - DNA, 20 bp, Artificial
  CRISPR gRNA sequence
attttgtccatcatgggcaa

SEQ ID NO: 118599 - DNA, 20 bp, Artificial
  CRISPR gRNA sequence
ttttgtccatcatgggcaat

SEQ ID NO: 118600 - DNA, 20 bp, Artificial
  CRISPR gRNA sequence
tgtccatcatgggcaatact

SEQ ID NO: 118601 - DNA, 20 bp, Artificial
  CRISPR gRNA sequence
gtccatcatgggcaatacta

SEQ ID NO: 118602 - DNA, 20 bp, Artificial
  CRISPR gRNA sequence
tccatcatgggcaatactac

SEQ ID NO: 118603 - DNA, 20 bp, Artificial
  CRISPR gRNA sequence
ctttccacttctcaaagatt

SEQ ID NO: 118604 - DNA, 20 bp, Artificial
  CRISPR gRNA sequence
tccacttctcaaagattagt

SEQ ID NO: 118605 - DNA, 20 bp, Artificial
  CRISPR gRNA sequence
ccacttctcaaagattagta

SEQ ID NO: 118606 - DNA, 20 bp, Artificial
  CRISPR gRNA sequence
cacttctcaaagattagtat

SEQ ID NO: 118607 - DNA, 20 bp, Artificial
  CRISPR gRNA sequence
ctcaaagattagtatataat

SEQ ID NO: 118608 - DNA, 20 bp, Artificial
  CRISPR gRNA sequence
tcaaagattagtatataatt

SEQ ID NO: 118609 - DNA, 20 bp, Artificial
  CRISPR gRNA sequence
aaagattagtatataattcc

SEQ ID NO: 118610 - DNA, 20 bp, Artificial
  CRISPR gRNA sequence
gtatataattcccttcgtta

SEQ ID NO: 118611 - DNA, 20 bp, Artificial
  CRISPR gRNA sequence
ccttcgttatttgaattctg

SEQ ID NO: 118612 - DNA, 20 bp, Artificial
  CRISPR gRNA sequence
cgttatttgaattctgaaaa

SEQ ID NO: 118613 - DNA, 20 bp, Artificial
  CRISPR gRNA sequence
gttatttgaattctgaaaag

SEQ ID NO: 118614 - DNA, 20 bp, Artificial
  CRISPR gRNA sequence
tttgaattctgaaaagaatt

SEQ ID NO: 118615 - DNA, 20 bp, Artificial
  CRISPR gRNA sequence
gaattctgaaaagaattcca

SEQ ID NO: 118616 - DNA, 20 bp, Artificial
  CRISPR gRNA sequence
aattctgaaaagaattccat

SEQ ID NO: 118617 - DNA, 20 bp, Artificial
  CRISPR gRNA sequence
tgaaaagaattccataaaat

SEQ ID NO: 118618 - DNA, 20 bp, Artificial
  CRISPR gRNA sequence
aaaagaattccataaaatca

SEQ ID NO: 118619 - DNA, 20 bp, Artificial
  CRISPR gRNA sequence
cataaaatcactatttatcc

SEQ ID NO: 118620 - DNA, 20 bp, Artificial
  CRISPR gRNA sequence
tttatccattgctttatctc

SEQ ID NO: 118621 - DNA, 20 bp, Artificial
  CRISPR gRNA sequence
atccattgctttatctccag

SEQ ID NO: 118622 - DNA, 20 bp, Artificial
  CRISPR gRNA sequence
tccattgctttatctccagc

SEQ ID NO: 118623 - DNA, 20 bp, Artificial
  CRISPR gRNA sequence
ctttatctccagcatctaga

SEQ ID NO: 118624 - DNA, 20 bp, Artificial
  CRISPR gRNA sequence
tatctccagcatctagaata

SEQ ID NO: 118625 - DNA, 20 bp, Artificial
  CRISPR gRNA sequence
atctccagcatctagaatag

SEQ ID NO: 118626 - DNA, 20 bp, Artificial
  CRISPR gRNA sequence
tctccagcatctagaatagt

SEQ ID NO: 118627 - DNA, 20 bp, Artificial
  CRISPR gRNA sequence
cagcatctagaatagtccct

SEQ ID NO: 118628 - DNA, 20 bp, Artificial
  CRISPR gRNA sequence
gaatagtccctggtgaatag

SEQ ID NO: 118629 - DNA, 20 bp, Artificial
  CRISPR gRNA sequence
gtgaatagtccctggcacat

SEQ ID NO: 118630 - DNA, 20 bp, Artificial
  CRISPR gRNA sequence
gcacatagtaggtgctcaga

SEQ ID NO: 118631 - DNA, 20 bp, Artificial
  CRISPR gRNA sequence
agaatgaattatggtttgtc

SEQ ID NO: 118632 - DNA, 20 bp, Artificial
  CRISPR gRNA sequence
tggtttgtcataatgttatt

SEQ ID NO: 118633 - DNA, 20 bp, Artificial
  CRISPR gRNA sequence
gtcataatgttattgtcaaa

SEQ ID NO: 118634 - DNA, 20 bp, Artificial
  CRISPR gRNA sequence
tcataatgttattgtcaaag

SEQ ID NO: 118635 - DNA, 20 bp, Artificial
  CRISPR gRNA sequence
ttgtcaaagtagattaccga

SEQ ID NO: 118636 - DNA, 20 bp, Artificial
  CRISPR gRNA sequence
tcaaagtagattaccgacag

SEQ ID NO: 118637 - DNA, 20 bp, Artificial
  CRISPR gRNA sequence
ccgacagtgccttaaggatc

SEQ ID NO: 118638 - DNA, 20 bp, Artificial
  CRISPR gRNA sequence
aaggatcgatctcaatccca

SEQ ID NO: 118639 - DNA, 20 bp, Artificial
  CRISPR gRNA sequence
aggatcgatctcaatcccaa

SEQ ID NO: 118640 - DNA, 20 bp, Artificial
  CRISPR gRNA sequence
aatcccaagaggtcaacata

SEQ ID NO: 118641 - DNA, 20 bp, Artificial
  CRISPR gRNA sequence
taggaggcatcaagttgcat

SEQ ID NO: 118642 - DNA, 20 bp, Artificial
  CRISPR gRNA sequence
aggaggcatcaagttgcatg

SEQ ID NO: 118643 - DNA, 20 bp, Artificial
  CRISPR gRNA sequence
ggaggcatcaagttgcatgt

SEQ ID NO: 118644 - DNA, 20 bp, Artificial
  CRISPR gRNA sequence
catgttcaagaaaatttcaa

SEQ ID NO: 118645 - DNA, 20 bp, Artificial
  CRISPR gRNA sequence
aagaaaatttcaaagacaaa

SEQ ID NO: 118646 - DNA, 20 bp, Artificial
  CRISPR gRNA sequence
caaagacaaagctgaaaaat

SEQ ID NO: 118647 - DNA, 20 bp, Artificial
  CRISPR gRNA sequence
aaagacaaagctgaaaaata

SEQ ID NO: 118648 - DNA, 20 bp, Artificial
  CRISPR gRNA sequence
aaaaatacattttcttacca

SEQ ID NO: 118649 - DNA, 20 bp, Artificial
  CRISPR gRNA sequence
tcttaccatgaccatccctc

SEQ ID NO: 118650 - DNA, 20 bp, Artificial
  CRISPR gRNA sequence
cttaccatgaccatccctcc

SEQ ID NO: 118651 - DNA, 20 bp, Artificial
  CRISPR gRNA sequence
ttaccatgaccatccctcct

SEQ ID NO: 118652 - DNA, 20 bp, Artificial
  CRISPR gRNA sequence
accatgaccatccctcctga

SEQ ID NO: 118653 - DNA, 20 bp, Artificial
  CRISPR gRNA sequence
ccatgaccatccctcctgaa

SEQ ID NO: 118654 - DNA, 20 bp, Artificial
  CRISPR gRNA sequence
ctgaattgaccacattgcct

SEQ ID NO: 118655 - DNA, 20 bp, Artificial
  CRISPR gRNA sequence
aattgaccacattgcctgcc

SEQ ID NO: 118656 - DNA, 20 bp, Artificial
  CRISPR gRNA sequence
accacattgcctgccactgg

SEQ ID NO: 118657 - DNA, 20 bp, Artificial
  CRISPR gRNA sequence
cctgccactggtagtgtcac

SEQ ID NO: 118658 - DNA, 20 bp, Artificial
  CRISPR gRNA sequence
ccactggtagtgtcacagtg

SEQ ID NO: 118659 - DNA, 20 bp, Artificial
  CRISPR gRNA sequence
gtagtgtcacagtgacagtc

SEQ ID NO: 118660 - DNA, 20 bp, Artificial
  CRISPR gRNA sequence
gcccactgctggttgtgttg

SEQ ID NO: 118661 - DNA, 20 bp, Artificial
  CRISPR gRNA sequence
cccactgctggttgtgttgg

SEQ ID NO: 118662 - DNA, 20 bp, Artificial
  CRISPR gRNA sequence
ctggttgtgttggtattggc

SEQ ID NO: 118663 - DNA, 20 bp, Artificial
  CRISPR gRNA sequence
gttgtgttggtattggctcc

SEQ ID NO: 118664 - DNA, 20 bp, Artificial
  CRISPR gRNA sequence
tgttggtattggctcctgtt

SEQ ID NO: 118665 - DNA, 20 bp, Artificial
  CRISPR gRNA sequence
gtattggctcctgtttgaac

SEQ ID NO: 118666 - DNA, 20 bp, Artificial
  CRISPR gRNA sequence
gctcctgtttgaacaatctg

SEQ ID NO: 118667 - DNA, 20 bp, Artificial
  CRISPR gRNA sequence
ctgtttgaacaatctgtgct

SEQ ID NO: 118668 - DNA, 20 bp, Artificial
  CRISPR gRNA sequence
tttgaacaatctgtgctcct

SEQ ID NO: 118669 - DNA, 20 bp, Artificial
  CRISPR gRNA sequence
gaacaatctgtgctcctgcc

SEQ ID NO: 118670 - DNA, 20 bp, Artificial
  CRISPR gRNA sequence
aacaatctgtgctcctgcca

SEQ ID NO: 118671 - DNA, 20 bp, Artificial
  CRISPR gRNA sequence
tgctcctgccaaactggctg

SEQ ID NO: 118672 - DNA, 20 bp, Artificial
  CRISPR gRNA sequence
ctgccaaactggctgctggg

SEQ ID NO: 118673 - DNA, 20 bp, Artificial
  CRISPR gRNA sequence
ccaaactggctgctgggata

SEQ ID NO: 118674 - DNA, 20 bp, Artificial
  CRISPR gRNA sequence
gctgctgggatagtgatcat

SEQ ID NO: 118675 - DNA, 20 bp, Artificial
  CRISPR gRNA sequence
ctgggatagtgatcatgcct

SEQ ID NO: 118676 - DNA, 20 bp, Artificial
  CRISPR gRNA sequence
ggatagtgatcatgcctgaa

SEQ ID NO: 118677 - DNA, 20 bp, Artificial
  CRISPR gRNA sequence
aaacagggactgtaacttta

SEQ ID NO: 118678 - DNA, 20 bp, Artificial
  CRISPR gRNA sequence
taactttaagaaaacaaaac

SEQ ID NO: 118679 - DNA, 20 bp, Artificial
  CRISPR gRNA sequence
taagaaaacaaaacataaaa

SEQ ID NO: 118680 - DNA, 20 bp, Artificial
  CRISPR gRNA sequence
aagaaaacaaaacataaaac

SEQ ID NO: 118681 - DNA, 20 bp, Artificial
  CRISPR gRNA sequence
agaaaacaaaacataaaaca

SEQ ID NO: 118682 - DNA, 20 bp, Artificial
  CRISPR gRNA sequence
gtccctcttctatctggtat

SEQ ID NO: 118683 - DNA, 20 bp, Artificial
  CRISPR gRNA sequence
ttctatctggtatacactca

SEQ ID NO: 118684 - DNA, 20 bp, Artificial
  CRISPR gRNA sequence
ctatctggtatacactcacc

SEQ ID NO: 118685 - DNA, 20 bp, Artificial
  CRISPR gRNA sequence
tatctggtatacactcaccg

SEQ ID NO: 118686 - DNA, 20 bp, Artificial
  CRISPR gRNA sequence
tctggtatacactcaccgat

SEQ ID NO: 118687 - DNA, 20 bp, Artificial
  CRISPR gRNA sequence
gtatacactcaccgatcctg

SEQ ID NO: 118688 - DNA, 20 bp, Artificial
  CRISPR gRNA sequence
accgatcctggcaaaacaca

SEQ ID NO: 118689 - DNA, 20 bp, Artificial
  CRISPR gRNA sequence
gcaaaacacactgaaaaaca

SEQ ID NO: 118690 - DNA, 20 bp, Artificial
  CRISPR gRNA sequence
aaaaacacaaggggagaaaa

SEQ ID NO: 118691 - DNA, 20 bp, Artificial
  CRISPR gRNA sequence
tcccactgtggtgtgctata

SEQ ID NO: 118692 - DNA, 20 bp, Artificial
  CRISPR gRNA sequence
ccactgtggtgtgctatata

SEQ ID NO: 118693 - DNA, 20 bp, Artificial
  CRISPR gRNA sequence
tggtgtgctatatataatct

SEQ ID NO: 118694 - DNA, 20 bp, Artificial
  CRISPR gRNA sequence
tatataatctaagtaatcac

SEQ ID NO: 118695 - DNA, 20 bp, Artificial
  CRISPR gRNA sequence
agtaatcacaatctttgaaa

SEQ ID NO: 118696 - DNA, 20 bp, Artificial
  CRISPR gRNA sequence
tgaaattctattaactgtct

SEQ ID NO: 118697 - DNA, 20 bp, Artificial
  CRISPR gRNA sequence
gaaattctattaactgtcta

SEQ ID NO: 118698 - DNA, 20 bp, Artificial
  CRISPR gRNA sequence
aaattctattaactgtctag

SEQ ID NO: 118699 - DNA, 20 bp, Artificial
  CRISPR gRNA sequence
tattaactgtctaggtccca

SEQ ID NO: 118700 - DNA, 20 bp, Artificial
  CRISPR gRNA sequence
ttaactgtctaggtcccagt

SEQ ID NO: 118701 - DNA, 20 bp, Artificial
  CRISPR gRNA sequence
actgtctaggtcccagtttt

SEQ ID NO: 118702 - DNA, 20 bp, Artificial
  CRISPR gRNA sequence
tctaggtcccagttttgagt

SEQ ID NO: 118703 - DNA, 20 bp, Artificial
  CRISPR gRNA sequence
ggtcccagttttgagtaact

SEQ ID NO: 118704 - DNA, 20 bp, Artificial
  CRISPR gRNA sequence
tgagtaactctatccttagc

SEQ ID NO: 118705 - DNA, 20 bp, Artificial
  CRISPR gRNA sequence
gagtaactctatccttagca

SEQ ID NO: 118706 - DNA, 20 bp, Artificial
  CRISPR gRNA sequence
agtaactctatccttagcag

SEQ ID NO: 118707 - DNA, 20 bp, Artificial
  CRISPR gRNA sequence
tatccttagcagttttcaaa

SEQ ID NO: 118708 - DNA, 20 bp, Artificial
  CRISPR gRNA sequence
tccttagcagttttcaaaag

SEQ ID NO: 118709 - DNA, 20 bp, Artificial
  CRISPR gRNA sequence
agcagttttcaaaaggtgaa

SEQ ID NO: 118710 - DNA, 20 bp, Artificial
  CRISPR gRNA sequence
gcagttttcaaaaggtgaaa

SEQ ID NO: 118711 - DNA, 20 bp, Artificial
  CRISPR gRNA sequence
tcaaaaggtgaaaaggtttg

SEQ ID NO: 118712 - DNA, 20 bp, Artificial
  CRISPR gRNA sequence
caaaaggtgaaaaggtttgg

SEQ ID NO: 118713 - DNA, 20 bp, Artificial
  CRISPR gRNA sequence
aaaaggtgaaaaggtttgga

SEQ ID NO: 118714 - DNA, 20 bp, Artificial
  CRISPR gRNA sequence
ggaggcctcctcttctacag

SEQ ID NO: 118715 - DNA, 20 bp, Artificial
  CRISPR gRNA sequence
gaggcctcctcttctacagg

SEQ ID NO: 118716 - DNA, 20 bp, Artificial
  CRISPR gRNA sequence
ctcttctacaggtcagtctg

SEQ ID NO: 118717 - DNA, 20 bp, Artificial
  CRISPR gRNA sequence
ttctacaggtcagtctgact

SEQ ID NO: 118718 - DNA, 20 bp, Artificial
  CRISPR gRNA sequence
ctacaggtcagtctgactac

SEQ ID NO: 118719 - DNA, 20 bp, Artificial
  CRISPR gRNA sequence
tacaggtcagtctgactaca

SEQ ID NO: 118720 - DNA, 20 bp, Artificial
  CRISPR gRNA sequence
caggtcagtctgactacagc

SEQ ID NO: 118721 - DNA, 20 bp, Artificial
  CRISPR gRNA sequence
actacagctatacctactgc

SEQ ID NO: 118722 - DNA, 20 bp, Artificial
  CRISPR gRNA sequence
cagctatacctactgctctt

SEQ ID NO: 118723 - DNA, 20 bp, Artificial
  CRISPR gRNA sequence
tacctactgctcttgtacat

SEQ ID NO: 118724 - DNA, 20 bp, Artificial
  CRISPR gRNA sequence
ctgctcttgtacataatgag

SEQ ID NO: 118725 - DNA, 20 bp, Artificial
  CRISPR gRNA sequence
ctcttgtacataatgagcaa

SEQ ID NO: 118726 - DNA, 20 bp, Artificial
  CRISPR gRNA sequence
ttgtacataatgagcaatct

SEQ ID NO: 118727 - DNA, 20 bp, Artificial
  CRISPR gRNA sequence
gtacataatgagcaatctgc

SEQ ID NO: 118728 - DNA, 20 bp, Artificial
  CRISPR gRNA sequence
tacataatgagcaatctgct

SEQ ID NO: 118729 - DNA, 20 bp, Artificial
  CRISPR gRNA sequence
cttcaggacagagattttaa

SEQ ID NO: 118730 - DNA, 20 bp, Artificial
  CRISPR gRNA sequence
caggacagagattttaaaac

SEQ ID NO: 118731 - DNA, 20 bp, Artificial
  CRISPR gRNA sequence
aggacagagattttaaaact

SEQ ID NO: 118732 - DNA, 20 bp, Artificial
  CRISPR gRNA sequence
taaaacttatactttgttta

SEQ ID NO: 118733 - DNA, 20 bp, Artificial
  CRISPR gRNA sequence
aaaacttatactttgtttat

SEQ ID NO: 118734 - DNA, 20 bp, Artificial
  CRISPR gRNA sequence
aaacttatactttgtttatc

SEQ ID NO: 118735 - DNA, 20 bp, Artificial
  CRISPR gRNA sequence
atactttgtttatctcaaac

SEQ ID NO: 118736 - DNA, 20 bp, Artificial
  CRISPR gRNA sequence
tactttgtttatctcaaact

SEQ ID NO: 118737 - DNA, 20 bp, Artificial
  CRISPR gRNA sequence
tgtttatctcaaactgacaa

SEQ ID NO: 118738 - DNA, 20 bp, Artificial
  CRISPR gRNA sequence
gtttatctcaaactgacaat

SEQ ID NO: 118739 - DNA, 20 bp, Artificial
  CRISPR gRNA sequence
tttatctcaaactgacaatg

SEQ ID NO: 118740 - DNA, 20 bp, Artificial
  CRISPR gRNA sequence
atctcaaactgacaatgagt

SEQ ID NO: 118741 - DNA, 20 bp, Artificial
  CRISPR gRNA sequence
tctcaaactgacaatgagtc

SEQ ID NO: 118742 - DNA, 20 bp, Artificial
  CRISPR gRNA sequence
aaactgacaatgagtcagtt

SEQ ID NO: 118743 - DNA, 20 bp, Artificial
  CRISPR gRNA sequence
acaatgagtcagttgtagta

SEQ ID NO: 118744 - DNA, 20 bp, Artificial
  CRISPR gRNA sequence
tagtattaaaacttaaaatt

SEQ ID NO: 118745 - DNA, 20 bp, Artificial
  CRISPR gRNA sequence
aaacttaaaattaaaccaag

SEQ ID NO: 118746 - DNA, 20 bp, Artificial
  CRISPR gRNA sequence
aaaattaaaccaagcattcc

SEQ ID NO: 118747 - DNA, 20 bp, Artificial
  CRISPR gRNA sequence
aaattaaaccaagcattcca

SEQ ID NO: 118748 - DNA, 20 bp, Artificial
  CRISPR gRNA sequence
aaccaagcattccaagtccc

SEQ ID NO: 118749 - DNA, 20 bp, Artificial
  CRISPR gRNA sequence
caagtccccagactatcaat

SEQ ID NO: 118750 - DNA, 20 bp, Artificial
  CRISPR gRNA sequence
tcaatagcagcacttgagga

SEQ ID NO: 118751 - DNA, 20 bp, Artificial
  CRISPR gRNA sequence
gaggatttgttcaccattct

SEQ ID NO: 118752 - DNA, 20 bp, Artificial
  CRISPR gRNA sequence
aggatttgttcaccattctg

SEQ ID NO: 118753 - DNA, 20 bp, Artificial
  CRISPR gRNA sequence
gttcaccattctgtttgagc

SEQ ID NO: 118754 - DNA, 20 bp, Artificial
  CRISPR gRNA sequence
ttcaccattctgtttgagct

SEQ ID NO: 118755 - DNA, 20 bp, Artificial
  CRISPR gRNA sequence
accattctgtttgagctctt

SEQ ID NO: 118756 - DNA, 20 bp, Artificial
  CRISPR gRNA sequence
tgtttgagctcttgcctggg

SEQ ID NO: 118757 - DNA, 20 bp, Artificial
  CRISPR gRNA sequence
tttgagctcttgcctgggct

SEQ ID NO: 118758 - DNA, 20 bp, Artificial
  CRISPR gRNA sequence
gagctcttgcctgggctcaa

SEQ ID NO: 118759 - DNA, 20 bp, Artificial
  CRISPR gRNA sequence
agctcttgcctgggctcaat

SEQ ID NO: 118760 - DNA, 20 bp, Artificial
  CRISPR gRNA sequence
ttgcctgggctcaatccagt

SEQ ID NO: 118761 - DNA, 20 bp, Artificial
  CRISPR gRNA sequence
gcctgggctcaatccagttc

SEQ ID NO: 118762 - DNA, 20 bp, Artificial
  CRISPR gRNA sequence
cctgggctcaatccagttca

SEQ ID NO: 118763 - DNA, 20 bp, Artificial
  CRISPR gRNA sequence
ggctcaatccagttcagggc

SEQ ID NO: 118764 - DNA, 20 bp, Artificial
  CRISPR gRNA sequence
aatccagttcagggcctccc

SEQ ID NO: 118765 - DNA, 20 bp, Artificial
  CRISPR gRNA sequence
agggcctccctggagtaata

SEQ ID NO: 118766 - DNA, 20 bp, Artificial
  CRISPR gRNA sequence
cctggagtaatacaagagca

SEQ ID NO: 118767 - DNA, 20 bp, Artificial
  CRISPR gRNA sequence
gagtaatacaagagcacaca

SEQ ID NO: 118768 - DNA, 20 bp, Artificial
  CRISPR gRNA sequence
gtgcactctctggatcctgt

SEQ ID NO: 118769 - DNA, 20 bp, Artificial
  CRISPR gRNA sequence
tctggatcctgtatattgca

SEQ ID NO: 118770 - DNA, 20 bp, Artificial
  CRISPR gRNA sequence
tggatcctgtatattgcaaa

SEQ ID NO: 118771 - DNA, 20 bp, Artificial
  CRISPR gRNA sequence
gatcctgtatattgcaaatt

SEQ ID NO: 118772 - DNA, 20 bp, Artificial
  CRISPR gRNA sequence
tatattgcaaatttgcaatc

SEQ ID NO: 118773 - DNA, 20 bp, Artificial
  CRISPR gRNA sequence
caaatttgcaatcacaaagt

SEQ ID NO: 118774 - DNA, 20 bp, Artificial
  CRISPR gRNA sequence
gcaatcacaaagtcatggaa

SEQ ID NO: 118775 - DNA, 20 bp, Artificial
  CRISPR gRNA sequence
caatcacaaagtcatggaat

SEQ ID NO: 118776 - DNA, 20 bp, Artificial
  CRISPR gRNA sequence
acaaagatgtccttttttga

SEQ ID NO: 118777 - DNA, 20 bp, Artificial
  CRISPR gRNA sequence
ttttgatttaactatttgac

SEQ ID NO: 118778 - DNA, 20 bp, Artificial
  CRISPR gRNA sequence
tttgatttaactatttgact

SEQ ID NO: 118779 - DNA, 20 bp, Artificial
  CRISPR gRNA sequence
ttgatttaactatttgacta

SEQ ID NO: 118780 - DNA, 20 bp, Artificial
  CRISPR gRNA sequence
tgatttaactatttgactaa

SEQ ID NO: 118781 - DNA, 20 bp, Artificial
  CRISPR gRNA sequence
gatttaactatttgactaac

SEQ ID NO: 118782 - DNA, 20 bp, Artificial
  CRISPR gRNA sequence
atttaactatttgactaaca

SEQ ID NO: 118783 - DNA, 20 bp, Artificial
  CRISPR gRNA sequence
aactatttgactaacaggtg

SEQ ID NO: 118784 - DNA, 20 bp, Artificial
  CRISPR gRNA sequence
actatttgactaacaggtgc

SEQ ID NO: 118785 - DNA, 20 bp, Artificial
  CRISPR gRNA sequence
tttgactaacaggtgcttcc

SEQ ID NO: 118786 - DNA, 20 bp, Artificial
  CRISPR gRNA sequence
gactaacaggtgcttccaaa

SEQ ID NO: 118787 - DNA, 20 bp, Artificial
  CRISPR gRNA sequence
actaacaggtgcttccaaaa

SEQ ID NO: 118788 - DNA, 20 bp, Artificial
  CRISPR gRNA sequence
acaggtgcttccaaaagcct

SEQ ID NO: 118789 - DNA, 20 bp, Artificial
  CRISPR gRNA sequence
ccaaaagccttcaagttcag

SEQ ID NO: 118790 - DNA, 20 bp, Artificial
  CRISPR gRNA sequence
caaaagccttcaagttcagt

SEQ ID NO: 118791 - DNA, 20 bp, Artificial
  CRISPR gRNA sequence
caagttcagtttctgcactc

SEQ ID NO: 118792 - DNA, 20 bp, Artificial
  CRISPR gRNA sequence
aagttcagtttctgcactcc

SEQ ID NO: 118793 - DNA, 20 bp, Artificial
  CRISPR gRNA sequence
agtttctgcactcctcctcc

SEQ ID NO: 118794 - DNA, 20 bp, Artificial
  CRISPR gRNA sequence
ctgcactcctcctcccagac

SEQ ID NO: 118795 - DNA, 20 bp, Artificial
  CRISPR gRNA sequence
tgcactcctcctcccagacc

SEQ ID NO: 118796 - DNA, 20 bp, Artificial
  CRISPR gRNA sequence
cactcctcctcccagaccaa

SEQ ID NO: 118797 - DNA, 20 bp, Artificial
  CRISPR gRNA sequence
ctcctcccagaccaaacatc

SEQ ID NO: 118798 - DNA, 20 bp, Artificial
  CRISPR gRNA sequence
ctcccagaccaaacatctat

SEQ ID NO: 118799 - DNA, 20 bp, Artificial
  CRISPR gRNA sequence
ccagaccaaacatctattat

SEQ ID NO: 118800 - DNA, 20 bp, Artificial
  CRISPR gRNA sequence
ttatttatgttatctattcc

SEQ ID NO: 118801 - DNA, 20 bp, Artificial
  CRISPR gRNA sequence
tttatgttatctattcctag

SEQ ID NO: 118802 - DNA, 20 bp, Artificial
  CRISPR gRNA sequence
atgttatctattcctagaac

SEQ ID NO: 118803 - DNA, 20 bp, Artificial
  CRISPR gRNA sequence
tgttatctattcctagaaca

SEQ ID NO: 118804 - DNA, 20 bp, Artificial
  CRISPR gRNA sequence
tctattcctagaacatactt

SEQ ID NO: 118805 - DNA, 20 bp, Artificial
  CRISPR gRNA sequence
ttcctagaacatacttccat

SEQ ID NO: 118806 - DNA, 20 bp, Artificial
  CRISPR gRNA sequence
ctagaacatacttccatgag

SEQ ID NO: 118807 - DNA, 20 bp, Artificial
  CRISPR gRNA sequence
gaacatacttccatgagggc

SEQ ID NO: 118808 - DNA, 20 bp, Artificial
  CRISPR gRNA sequence
ccatgagggccctgcattgt

SEQ ID NO: 118809 - DNA, 20 bp, Artificial
  CRISPR gRNA sequence
catgagggccctgcattgta

SEQ ID NO: 118810 - DNA, 20 bp, Artificial
  CRISPR gRNA sequence
cattgtatttatttgttcac

SEQ ID NO: 118811 - DNA, 20 bp, Artificial
  CRISPR gRNA sequence
tatttatttgttcacgtctt

SEQ ID NO: 118812 - DNA, 20 bp, Artificial
  CRISPR gRNA sequence
atttgttcacgtctttctta

SEQ ID NO: 118813 - DNA, 20 bp, Artificial
  CRISPR gRNA sequence
tttgttcacgtctttcttac

SEQ ID NO: 118814 - DNA, 20 bp, Artificial
  CRISPR gRNA sequence
gttcacgtctttcttactag

SEQ ID NO: 118815 - DNA, 20 bp, Artificial
  CRISPR gRNA sequence
ttcacgtctttcttactaga

SEQ ID NO: 118816 - DNA, 20 bp, Artificial
  CRISPR gRNA sequence
acgtctttcttactagacta

SEQ ID NO: 118817 - DNA, 20 bp, Artificial
  CRISPR gRNA sequence
tcttactagactagaggctc

SEQ ID NO: 118818 - DNA, 20 bp, Artificial
  CRISPR gRNA sequence
cttactagactagaggctct

SEQ ID NO: 118819 - DNA, 20 bp, Artificial
  CRISPR gRNA sequence
ttactagactagaggctctt

SEQ ID NO: 118820 - DNA, 20 bp, Artificial
  CRISPR gRNA sequence
actagactagaggctctttg

SEQ ID NO: 118821 - DNA, 20 bp, Artificial
  CRISPR gRNA sequence
ctagactagaggctctttga

SEQ ID NO: 118822 - DNA, 20 bp, Artificial
  CRISPR gRNA sequence
gactagaggctctttgagga

SEQ ID NO: 118823 - DNA, 20 bp, Artificial
  CRISPR gRNA sequence
gaggctctttgaggaccctt

SEQ ID NO: 118824 - DNA, 20 bp, Artificial
  CRISPR gRNA sequence
tttgaggacccttcttagta

SEQ ID NO: 118825 - DNA, 20 bp, Artificial
  CRISPR gRNA sequence
tgaggacccttcttagtaaa

SEQ ID NO: 118826 - DNA, 20 bp, Artificial
  CRISPR gRNA sequence
gaggacccttcttagtaaaa

SEQ ID NO: 118827 - DNA, 20 bp, Artificial
  CRISPR gRNA sequence
aggacccttcttagtaaaag

SEQ ID NO: 118828 - DNA, 20 bp, Artificial
  CRISPR gRNA sequence
cttagtaaaagtgctgtata

SEQ ID NO: 118829 - DNA, 20 bp, Artificial
  CRISPR gRNA sequence
ttagtaaaagtgctgtatac

SEQ ID NO: 118830 - DNA, 20 bp, Artificial
  CRISPR gRNA sequence
agtaaaagtgctgtatacat

SEQ ID NO: 118831 - DNA, 20 bp, Artificial
  CRISPR gRNA sequence
gtaaaagtgctgtatacata

SEQ ID NO: 118832 - DNA, 20 bp, Artificial
  CRISPR gRNA sequence
tatacataatagtcatttaa

SEQ ID NO: 118833 - DNA, 20 bp, Artificial
  CRISPR gRNA sequence
aaagtaatggaatgacccag

SEQ ID NO: 118834 - DNA, 20 bp, Artificial
  CRISPR gRNA sequence
aagtaatggaatgacccaga

SEQ ID NO: 118835 - DNA, 20 bp, Artificial
  CRISPR gRNA sequence
taaagccaacttgatttttg

SEQ ID NO: 118836 - DNA, 20 bp, Artificial
  CRISPR gRNA sequence
aagccaacttgatttttgat

SEQ ID NO: 118837 - DNA, 20 bp, Artificial
  CRISPR gRNA sequence
gatttttgatctatttctct

SEQ ID NO: 118838 - DNA, 20 bp, Artificial
  CRISPR gRNA sequence
atttttgatctatttctctc

SEQ ID NO: 118839 - DNA, 20 bp, Artificial
  CRISPR gRNA sequence
ttgatctatttctctcttta

SEQ ID NO: 118840 - DNA, 20 bp, Artificial
  CRISPR gRNA sequence
tgatctatttctctctttac

SEQ ID NO: 118841 - DNA, 20 bp, Artificial
  CRISPR gRNA sequence
gatctatttctctctttacc

SEQ ID NO: 118842 - DNA, 20 bp, Artificial
  CRISPR gRNA sequence
atctatttctctctttacca

SEQ ID NO: 118843 - DNA, 20 bp, Artificial
  CRISPR gRNA sequence
tttctctctttaccaatgaa

SEQ ID NO: 118844 - DNA, 20 bp, Artificial
  CRISPR gRNA sequence
ctctctttaccaatgaactc

SEQ ID NO: 118845 - DNA, 20 bp, Artificial
  CRISPR gRNA sequence
tctctttaccaatgaactcc

SEQ ID NO: 118846 - DNA, 20 bp, Artificial
  CRISPR gRNA sequence
tctttaccaatgaactccct

SEQ ID NO: 118847 - DNA, 20 bp, Artificial
  CRISPR gRNA sequence
tttaccaatgaactccctat

SEQ ID NO: 118848 - DNA, 20 bp, Artificial
  CRISPR gRNA sequence
taccaatgaactccctattt

SEQ ID NO: 118849 - DNA, 20 bp, Artificial
  CRISPR gRNA sequence
accaatgaactccctatttc

SEQ ID NO: 118850 - DNA, 20 bp, Artificial
  CRISPR gRNA sequence
ccaatgaactccctatttct

SEQ ID NO: 118851 - DNA, 20 bp, Artificial
  CRISPR gRNA sequence
cctatttctattcttctgtt

SEQ ID NO: 118852 - DNA, 20 bp, Artificial
  CRISPR gRNA sequence
tttctattcttctgtttaga

SEQ ID NO: 118853 - DNA, 20 bp, Artificial
  CRISPR gRNA sequence
ctattcttctgtttagaaac

SEQ ID NO: 118854 - DNA, 20 bp, Artificial
  CRISPR gRNA sequence
tattcttctgtttagaaaca

SEQ ID NO: 118855 - DNA, 20 bp, Artificial
  CRISPR gRNA sequence
ttcttctgtttagaaacact

SEQ ID NO: 118856 - DNA, 20 bp, Artificial
  CRISPR gRNA sequence
ttctgtttagaaacacttct

SEQ ID NO: 118857 - DNA, 20 bp, Artificial
  CRISPR gRNA sequence
ctgtttagaaacacttcttc

SEQ ID NO: 118858 - DNA, 20 bp, Artificial
  CRISPR gRNA sequence
tgtttagaaacacttcttcc

SEQ ID NO: 118859 - DNA, 20 bp, Artificial
  CRISPR gRNA sequence
tttagaaacacttcttccct

SEQ ID NO: 118860 - DNA, 20 bp, Artificial
  CRISPR gRNA sequence
agaaacacttcttccctaaa

SEQ ID NO: 118861 - DNA, 20 bp, Artificial
  CRISPR gRNA sequence
gaaacacttcttccctaaaa

SEQ ID NO: 118862 - DNA, 20 bp, Artificial
  CRISPR gRNA sequence
cttccctaaaagcttacaca

SEQ ID NO: 118863 - DNA, 20 bp, Artificial
  CRISPR gRNA sequence
ttccctaaaagcttacacaa

SEQ ID NO: 118864 - DNA, 20 bp, Artificial
  CRISPR gRNA sequence
ccctaaaagcttacacaatc

SEQ ID NO: 118865 - DNA, 20 bp, Artificial
  CRISPR gRNA sequence
cctaaaagcttacacaatcc

SEQ ID NO: 118866 - DNA, 20 bp, Artificial
  CRISPR gRNA sequence
aaagcttacacaatccctag

SEQ ID NO: 118867 - DNA, 20 bp, Artificial
  CRISPR gRNA sequence
acacaatccctagattagca

SEQ ID NO: 118868 - DNA, 20 bp, Artificial
  CRISPR gRNA sequence
cacaatccctagattagcaa

SEQ ID NO: 118869 - DNA, 20 bp, Artificial
  CRISPR gRNA sequence
gattagcaaccactatagaa

SEQ ID NO: 118870 - DNA, 20 bp, Artificial
  CRISPR gRNA sequence
gcaaccactatagaaactgc

SEQ ID NO: 118871 - DNA, 20 bp, Artificial
  CRISPR gRNA sequence
tagaaactgctacacatgga

SEQ ID NO: 118872 - DNA, 20 bp, Artificial
  CRISPR gRNA sequence
ctacacatggaatcactgtt

SEQ ID NO: 118873 - DNA, 20 bp, Artificial
  CRISPR gRNA sequence
cacatggaatcactgttggt

SEQ ID NO: 118874 - DNA, 20 bp, Artificial
  CRISPR gRNA sequence
ttggtcacagatggtgacaa

SEQ ID NO: 118875 - DNA, 20 bp, Artificial
  CRISPR gRNA sequence
gtcacagatggtgacaagaa

SEQ ID NO: 118876 - DNA, 20 bp, Artificial
  CRISPR gRNA sequence
gaggaaatcttttttttttt

SEQ ID NO: 118877 - DNA, 20 bp, Artificial
  CRISPR gRNA sequence
ttttttttttgtccaaaaaa

SEQ ID NO: 118878 - DNA, 20 bp, Artificial
  CRISPR gRNA sequence
tttttttttgtccaaaaaat

SEQ ID NO: 118879 - DNA, 20 bp, Artificial
  CRISPR gRNA sequence
ttttttttgtccaaaaaata

SEQ ID NO: 118880 - DNA, 20 bp, Artificial
  CRISPR gRNA sequence
tttttttgtccaaaaaatat

SEQ ID NO: 118881 - DNA, 20 bp, Artificial
  CRISPR gRNA sequence
ttttttgtccaaaaaatatg

SEQ ID NO: 118882 - DNA, 20 bp, Artificial
  CRISPR gRNA sequence
tttttgtccaaaaaatatgt

SEQ ID NO: 118883 - DNA, 20 bp, Artificial
  CRISPR gRNA sequence
ttttgtccaaaaaatatgta

SEQ ID NO: 118884 - DNA, 20 bp, Artificial
  CRISPR gRNA sequence
tttgtccaaaaaatatgtag

SEQ ID NO: 118885 - DNA, 20 bp, Artificial
  CRISPR gRNA sequence
ttgtccaaaaaatatgtagt

SEQ ID NO: 118886 - DNA, 20 bp, Artificial
  CRISPR gRNA sequence
tgtccaaaaaatatgtagtg

SEQ ID NO: 118887 - DNA, 20 bp, Artificial
  CRISPR gRNA sequence
gtccaaaaaatatgtagtgt

SEQ ID NO: 118888 - DNA, 20 bp, Artificial
  CRISPR gRNA sequence
tccaaaaaatatgtagtgtc

SEQ ID NO: 118889 - DNA, 20 bp, Artificial
  CRISPR gRNA sequence
accactcaaattctaaagat

SEQ ID NO: 118890 - DNA, 20 bp, Artificial
  CRISPR gRNA sequence
aaattctaaagatgtcagtt

SEQ ID NO: 118891 - DNA, 20 bp, Artificial
  CRISPR gRNA sequence
taaagatgtcagttgtctaa

SEQ ID NO: 118892 - DNA, 20 bp, Artificial
  CRISPR gRNA sequence
aagatgtcagttgtctaagg

SEQ ID NO: 118893 - DNA, 20 bp, Artificial
  CRISPR gRNA sequence
tctaagggacaaaaaagttg

SEQ ID NO: 118894 - DNA, 20 bp, Artificial
  CRISPR gRNA sequence
agggacaaaaaagttgcccc

SEQ ID NO: 118895 - DNA, 20 bp, Artificial
  CRISPR gRNA sequence
ccccaaaaagtcctagggaa

SEQ ID NO: 118896 - DNA, 20 bp, Artificial
  CRISPR gRNA sequence
gggaagcttatgggtacact

SEQ ID NO: 118897 - DNA, 20 bp, Artificial
  CRISPR gRNA sequence
atgggtacacttaccttgct

SEQ ID NO: 118898 - DNA, 20 bp, Artificial
  CRISPR gRNA sequence
tgggtacacttaccttgctg

SEQ ID NO: 118899 - DNA, 20 bp, Artificial
  CRISPR gRNA sequence
accttgctggagaatggtgc

SEQ ID NO: 118900 - DNA, 20 bp, Artificial
  CRISPR gRNA sequence
ccttgctggagaatggtgcc

SEQ ID NO: 118901 - DNA, 20 bp, Artificial
  CRISPR gRNA sequence
gctggagaatggtgccatct

SEQ ID NO: 118902 - DNA, 20 bp, Artificial
  CRISPR gRNA sequence
ctggagaatggtgccatctg

SEQ ID NO: 118903 - DNA, 20 bp, Artificial
  CRISPR gRNA sequence
gagaatggtgccatctgcat

SEQ ID NO: 118904 - DNA, 20 bp, Artificial
  CRISPR gRNA sequence
cattaactggttgatagacg

SEQ ID NO: 118905 - DNA, 20 bp, Artificial
  CRISPR gRNA sequence
actggttgatagacgatggt

SEQ ID NO: 118906 - DNA, 20 bp, Artificial
  CRISPR gRNA sequence
gttgatagacgatggtctgc

SEQ ID NO: 118907 - DNA, 20 bp, Artificial
  CRISPR gRNA sequence
atagacgatggtctgccctt

SEQ ID NO: 118908 - DNA, 20 bp, Artificial
  CRISPR gRNA sequence
cccttcagcagtctgtgcca

SEQ ID NO: 118909 - DNA, 20 bp, Artificial
  CRISPR gRNA sequence
cagcagtctgtgccacttgc

SEQ ID NO: 118910 - DNA, 20 bp, Artificial
  CRISPR gRNA sequence
agcagtctgtgccacttgct

SEQ ID NO: 118911 - DNA, 20 bp, Artificial
  CRISPR gRNA sequence
tgccacttgctgtccctgga

SEQ ID NO: 118912 - DNA, 20 bp, Artificial
  CRISPR gRNA sequence
gctgtccctggacagcaatc

SEQ ID NO: 118913 - DNA, 20 bp, Artificial
  CRISPR gRNA sequence
ctgtccctggacagcaatct

SEQ ID NO: 118914 - DNA, 20 bp, Artificial
  CRISPR gRNA sequence
tccctggacagcaatctgct

SEQ ID NO: 118915 - DNA, 20 bp, Artificial
  CRISPR gRNA sequence
gacagcaatctgctgctgtg

SEQ ID NO: 118916 - DNA, 20 bp, Artificial
  CRISPR gRNA sequence
ctgctgtgtctggaggaaat

SEQ ID NO: 118917 - DNA, 20 bp, Artificial
  CRISPR gRNA sequence
ctgtgtctggaggaaataag

SEQ ID NO: 118918 - DNA, 20 bp, Artificial
  CRISPR gRNA sequence
tgtctggaggaaataagtaa

SEQ ID NO: 118919 - DNA, 20 bp, Artificial
  CRISPR gRNA sequence
gaggaaataagtaatgacac

SEQ ID NO: 118920 - DNA, 20 bp, Artificial
  CRISPR gRNA sequence
aacagatcccaaagatacta

SEQ ID NO: 118921 - DNA, 20 bp, Artificial
  CRISPR gRNA sequence
acaaagaacgatgtagtcct

SEQ ID NO: 118922 - DNA, 20 bp, Artificial
  CRISPR gRNA sequence
aaaaaaaaaaattatttttt

SEQ ID NO: 118923 - DNA, 20 bp, Artificial
  CRISPR gRNA sequence
aaaaaaaaaattattttttt

SEQ ID NO: 118924 - DNA, 20 bp, Artificial
  CRISPR gRNA sequence
tttttttgagacagagtctc

SEQ ID NO: 118925 - DNA, 20 bp, Artificial
  CRISPR gRNA sequence
ttttgagacagagtctcact

SEQ ID NO: 118926 - DNA, 20 bp, Artificial
  CRISPR gRNA sequence
tttgagacagagtctcactc

SEQ ID NO: 118927 - DNA, 20 bp, Artificial
  CRISPR gRNA sequence
ttgagacagagtctcactct

SEQ ID NO: 118928 - DNA, 20 bp, Artificial
  CRISPR gRNA sequence
tgagacagagtctcactctg

SEQ ID NO: 118929 - DNA, 20 bp, Artificial
  CRISPR gRNA sequence
gagacagagtctcactctgt

SEQ ID NO: 118930 - DNA, 20 bp, Artificial
  CRISPR gRNA sequence
agacagagtctcactctgtc

SEQ ID NO: 118931 - DNA, 20 bp, Artificial
  CRISPR gRNA sequence
actctgtcgccaggctggag

SEQ ID NO: 118932 - DNA, 20 bp, Artificial
  CRISPR gRNA sequence
tgtcgccaggctggagtgca

SEQ ID NO: 118933 - DNA, 20 bp, Artificial
  CRISPR gRNA sequence
tcgccaggctggagtgcagt

SEQ ID NO: 118934 - DNA, 20 bp, Artificial
  CRISPR gRNA sequence
gagtgcagtgcagtggcgca

SEQ ID NO: 118935 - DNA, 20 bp, Artificial
  CRISPR gRNA sequence
agctcactgcaacctccgcc

SEQ ID NO: 118936 - DNA, 20 bp, Artificial
  CRISPR gRNA sequence
actgcaacctccgcctcctg

SEQ ID NO: 118937 - DNA, 20 bp, Artificial
  CRISPR gRNA sequence
caacctccgcctcctgggtt

SEQ ID NO: 118938 - DNA, 20 bp, Artificial
  CRISPR gRNA sequence
cgcctcctgggttcaagcga

SEQ ID NO: 118939 - DNA, 20 bp, Artificial
  CRISPR gRNA sequence
ctgggttcaagcgattctct

SEQ ID NO: 118940 - DNA, 20 bp, Artificial
  CRISPR gRNA sequence
ggttcaagcgattctctgcc

SEQ ID NO: 118941 - DNA, 20 bp, Artificial
  CRISPR gRNA sequence
aagcgattctctgcctcagc

SEQ ID NO: 118942 - DNA, 20 bp, Artificial
  CRISPR gRNA sequence
tctgcctcagcctcccgagt

SEQ ID NO: 118943 - DNA, 20 bp, Artificial
  CRISPR gRNA sequence
tgcctcagcctcccgagtag

SEQ ID NO: 118944 - DNA, 20 bp, Artificial
  CRISPR gRNA sequence
cctcagcctcccgagtagct

SEQ ID NO: 118945 - DNA, 20 bp, Artificial
  CRISPR gRNA sequence
agcctcccgagtagctggga

SEQ ID NO: 118946 - DNA, 20 bp, Artificial
  CRISPR gRNA sequence
ccgagtagctgggattacag

SEQ ID NO: 118947 - DNA, 20 bp, Artificial
  CRISPR gRNA sequence
ggattacaggcatgcgccac

SEQ ID NO: 118948 - DNA, 20 bp, Artificial
  CRISPR gRNA sequence
caggcatgcgccaccatgcc

SEQ ID NO: 118949 - DNA, 20 bp, Artificial
  CRISPR gRNA sequence
atttttgtattttgacgggg

SEQ ID NO: 118950 - DNA, 20 bp, Artificial
  CRISPR gRNA sequence
ttgtattttgacggggcttc

SEQ ID NO: 118951 - DNA, 20 bp, Artificial
  CRISPR gRNA sequence
tgtattttgacggggcttca

SEQ ID NO: 118952 - DNA, 20 bp, Artificial
  CRISPR gRNA sequence
gtattttgacggggcttcac

SEQ ID NO: 118953 - DNA, 20 bp, Artificial
  CRISPR gRNA sequence
tattttgacggggcttcacc

SEQ ID NO: 118954 - DNA, 20 bp, Artificial
  CRISPR gRNA sequence
tgacggggcttcaccatgtt

SEQ ID NO: 118955 - DNA, 20 bp, Artificial
  CRISPR gRNA sequence
gacggggcttcaccatgttg

SEQ ID NO: 118956 - DNA, 20 bp, Artificial
  CRISPR gRNA sequence
acggggcttcaccatgttgg

SEQ ID NO: 118957 - DNA, 20 bp, Artificial
  CRISPR gRNA sequence
caccatgttggccaggatgt

SEQ ID NO: 118958 - DNA, 20 bp, Artificial
  CRISPR gRNA sequence
accatgttggccaggatgtt

SEQ ID NO: 118959 - DNA, 20 bp, Artificial
  CRISPR gRNA sequence
gccaggatgttcttgatctc

SEQ ID NO: 118960 - DNA, 20 bp, Artificial
  CRISPR gRNA sequence
ttgatctcttgaccttgtga

SEQ ID NO: 118961 - DNA, 20 bp, Artificial
  CRISPR gRNA sequence
gatctcttgaccttgtgatc

SEQ ID NO: 118962 - DNA, 20 bp, Artificial
  CRISPR gRNA sequence
atctcttgaccttgtgatca

SEQ ID NO: 118963 - DNA, 20 bp, Artificial
  CRISPR gRNA sequence
ttgaccttgtgatcagcttg

SEQ ID NO: 118964 - DNA, 20 bp, Artificial
  CRISPR gRNA sequence
gaccttgtgatcagcttgcc

SEQ ID NO: 118965 - DNA, 20 bp, Artificial
  CRISPR gRNA sequence
accttgtgatcagcttgcct

SEQ ID NO: 118966 - DNA, 20 bp, Artificial
  CRISPR gRNA sequence
gtgatcagcttgcctcggcc

SEQ ID NO: 118967 - DNA, 20 bp, Artificial
  CRISPR gRNA sequence
tgatcagcttgcctcggcct

SEQ ID NO: 118968 - DNA, 20 bp, Artificial
  CRISPR gRNA sequence
gcctcggcctctcaaagtgc

SEQ ID NO: 118969 - DNA, 20 bp, Artificial
  CRISPR gRNA sequence
cctcggcctctcaaagtgct

SEQ ID NO: 118970 - DNA, 20 bp, Artificial
  CRISPR gRNA sequence
ggcctctcaaagtgctggga

SEQ ID NO: 118971 - DNA, 20 bp, Artificial
  CRISPR gRNA sequence
tcaaagtgctgggattacag

SEQ ID NO: 118972 - DNA, 20 bp, Artificial
  CRISPR gRNA sequence
aaagtgctgggattacaggc

SEQ ID NO: 118973 - DNA, 20 bp, Artificial
  CRISPR gRNA sequence
ggattacaggcatgagccac

SEQ ID NO: 118974 - DNA, 20 bp, Artificial
  CRISPR gRNA sequence
caggcatgagccaccgcgcc

SEQ ID NO: 118975 - DNA, 20 bp, Artificial
  CRISPR gRNA sequence
ttttatggttttcatcccct

SEQ ID NO: 118976 - DNA, 20 bp, Artificial
  CRISPR gRNA sequence
tttatggttttcatcccctt

SEQ ID NO: 118977 - DNA, 20 bp, Artificial
  CRISPR gRNA sequence
ttatggttttcatccccttt

SEQ ID NO: 118978 - DNA, 20 bp, Artificial
  CRISPR gRNA sequence
tatggttttcatcccctttt

SEQ ID NO: 118979 - DNA, 20 bp, Artificial
  CRISPR gRNA sequence
atggttttcatccccttttc

SEQ ID NO: 118980 - DNA, 20 bp, Artificial
  CRISPR gRNA sequence
tggttttcatccccttttct

SEQ ID NO: 118981 - DNA, 20 bp, Artificial
  CRISPR gRNA sequence
tcatccccttttctactata

SEQ ID NO: 118982 - DNA, 20 bp, Artificial
  CRISPR gRNA sequence
catccccttttctactatac

SEQ ID NO: 118983 - DNA, 20 bp, Artificial
  CRISPR gRNA sequence
atccccttttctactataca

SEQ ID NO: 118984 - DNA, 20 bp, Artificial
  CRISPR gRNA sequence
ttctactatacatgctatac

SEQ ID NO: 118985 - DNA, 20 bp, Artificial
  CRISPR gRNA sequence
tctactatacatgctataca

SEQ ID NO: 118986 - DNA, 20 bp, Artificial
  CRISPR gRNA sequence
ctactatacatgctatacat

SEQ ID NO: 118987 - DNA, 20 bp, Artificial
  CRISPR gRNA sequence
tactatacatgctatacatg

SEQ ID NO: 118988 - DNA, 20 bp, Artificial
  CRISPR gRNA sequence
ctatacatgctatacatgaa

SEQ ID NO: 118989 - DNA, 20 bp, Artificial
  CRISPR gRNA sequence
tacatgctatacatgaaata

SEQ ID NO: 118990 - DNA, 20 bp, Artificial
  CRISPR gRNA sequence
tacatgaaatatctgactca

SEQ ID NO: 118991 - DNA, 20 bp, Artificial
  CRISPR gRNA sequence
actcagttatctgactcttc

SEQ ID NO: 118992 - DNA, 20 bp, Artificial
  CRISPR gRNA sequence
agttatctgactcttccaaa

SEQ ID NO: 118993 - DNA, 20 bp, Artificial
  CRISPR gRNA sequence
tctgactcttccaaatcagt

SEQ ID NO: 118994 - DNA, 20 bp, Artificial
  CRISPR gRNA sequence
actcttccaaatcagttttg

SEQ ID NO: 118995 - DNA, 20 bp, Artificial
  CRISPR gRNA sequence
ttccaaatcagttttgctcc

SEQ ID NO: 118996 - DNA, 20 bp, Artificial
  CRISPR gRNA sequence
ccaaatcagttttgctcctg

SEQ ID NO: 118997 - DNA, 20 bp, Artificial
  CRISPR gRNA sequence
caaatcagttttgctcctgt

SEQ ID NO: 118998 - DNA, 20 bp, Artificial
  CRISPR gRNA sequence
tgctcctgtgtgacagagct

SEQ ID NO: 118999 - DNA, 20 bp, Artificial
  CRISPR gRNA sequence
gctcctgtgtgacagagcta

SEQ ID NO: 119000 - DNA, 20 bp, Artificial
  CRISPR gRNA sequence
ctcctgtgtgacagagctag

SEQ ID NO: 119001 - DNA, 20 bp, Artificial
  CRISPR gRNA sequence
ctgtgtgacagagctagtgg

SEQ ID NO: 119002 - DNA, 20 bp, Artificial
  CRISPR gRNA sequence
tgtgacagagctagtggaat

SEQ ID NO: 119003 - DNA, 20 bp, Artificial
  CRISPR gRNA sequence
gtggaattacctgagtctgg

SEQ ID NO: 119004 - DNA, 20 bp, Artificial
  CRISPR gRNA sequence
cctgagtctggccagcagtg

SEQ ID NO: 119005 - DNA, 20 bp, Artificial
  CRISPR gRNA sequence
agtctggccagcagtgacag

SEQ ID NO: 119006 - DNA, 20 bp, Artificial
  CRISPR gRNA sequence
gccagcagtgacagccgtct

SEQ ID NO: 119007 - DNA, 20 bp, Artificial
  CRISPR gRNA sequence
gggctgctggatgatgatct

SEQ ID NO: 119008 - DNA, 20 bp, Artificial
  CRISPR gRNA sequence
ctggatgatgatctgctggg

SEQ ID NO: 119009 - DNA, 20 bp, Artificial
  CRISPR gRNA sequence
gatgatgatctgctgggtct

SEQ ID NO: 119010 - DNA, 20 bp, Artificial
  CRISPR gRNA sequence
ctgggtctggccctgctggc

SEQ ID NO: 119011 - DNA, 20 bp, Artificial
  CRISPR gRNA sequence
ggtctggccctgctggccct

SEQ ID NO: 119012 - DNA, 20 bp, Artificial
  CRISPR gRNA sequence
gccctgctggccctgcacct

SEQ ID NO: 119013 - DNA, 20 bp, Artificial
  CRISPR gRNA sequence
ctggccctgcacctgcacag

SEQ ID NO: 119014 - DNA, 20 bp, Artificial
  CRISPR gRNA sequence
gccctgcacctgcacagcct

SEQ ID NO: 119015 - DNA, 20 bp, Artificial
  CRISPR gRNA sequence
cacctgcacagcctgtccac

SEQ ID NO: 119016 - DNA, 20 bp, Artificial
  CRISPR gRNA sequence
cacagcctgtccaccctgga

SEQ ID NO: 119017 - DNA, 20 bp, Artificial
  CRISPR gRNA sequence
tccaccctggatctggatct

SEQ ID NO: 119018 - DNA, 20 bp, Artificial
  CRISPR gRNA sequence
gatctggatctgtccaggtg

SEQ ID NO: 119019 - DNA, 20 bp, Artificial
  CRISPR gRNA sequence
gatctgtccaggtgggacca

SEQ ID NO: 119020 - DNA, 20 bp, Artificial
  CRISPR gRNA sequence
tccaggtgggaccaactgta

SEQ ID NO: 119021 - DNA, 20 bp, Artificial
  CRISPR gRNA sequence
tatctgcagaaaagaacata

SEQ ID NO: 119022 - DNA, 20 bp, Artificial
  CRISPR gRNA sequence
cagaaaagaacataaaaaaa

SEQ ID NO: 119023 - DNA, 20 bp, Artificial
  CRISPR gRNA sequence
tactctactgacactggtct

SEQ ID NO: 119024 - DNA, 20 bp, Artificial
  CRISPR gRNA sequence
tactgacactggtctccttt

SEQ ID NO: 119025 - DNA, 20 bp, Artificial
  CRISPR gRNA sequence
ctgacactggtctcctttgg

SEQ ID NO: 119026 - DNA, 20 bp, Artificial
  CRISPR gRNA sequence
acactggtctcctttggtcc

SEQ ID NO: 119027 - DNA, 20 bp, Artificial
  CRISPR gRNA sequence
gtctcctttggtccccgaga

SEQ ID NO: 119028 - DNA, 20 bp, Artificial
  CRISPR gRNA sequence
ctttggtccccgagagttat

SEQ ID NO: 119029 - DNA, 20 bp, Artificial
  CRISPR gRNA sequence
tggtccccgagagttatcca

SEQ ID NO: 119030 - DNA, 20 bp, Artificial
  CRISPR gRNA sequence
ggtccccgagagttatccac

SEQ ID NO: 119031 - DNA, 20 bp, Artificial
  CRISPR gRNA sequence
gtccccgagagttatccaca

SEQ ID NO: 119032 - DNA, 20 bp, Artificial
  CRISPR gRNA sequence
tccacatttctctagaaagc

SEQ ID NO: 119033 - DNA, 20 bp, Artificial
  CRISPR gRNA sequence
ctctagaaagcagaaaatgt

SEQ ID NO: 119034 - DNA, 20 bp, Artificial
  CRISPR gRNA sequence
tctagaaagcagaaaatgtt

SEQ ID NO: 119035 - DNA, 20 bp, Artificial
  CRISPR gRNA sequence
tagaaagcagaaaatgttct

SEQ ID NO: 119036 - DNA, 20 bp, Artificial
  CRISPR gRNA sequence
gaaagcagaaaatgttctga

SEQ ID NO: 119037 - DNA, 20 bp, Artificial
  CRISPR gRNA sequence
tgaagaggaaaaaagaagtc

SEQ ID NO: 119038 - DNA, 20 bp, Artificial
  CRISPR gRNA sequence
aagaggaaaaaagaagtcct

SEQ ID NO: 119039 - DNA, 20 bp, Artificial
  CRISPR gRNA sequence
ctctgccctccattatgaag

SEQ ID NO: 119040 - DNA, 20 bp, Artificial
  CRISPR gRNA sequence
tgccctccattatgaagtag

SEQ ID NO: 119041 - DNA, 20 bp, Artificial
  CRISPR gRNA sequence
ccctccattatgaagtagac

SEQ ID NO: 119042 - DNA, 20 bp, Artificial
  CRISPR gRNA sequence
cattatgaagtagacacaac

SEQ ID NO: 119043 - DNA, 20 bp, Artificial
  CRISPR gRNA sequence
tgaagtagacacaacttatt

SEQ ID NO: 119044 - DNA, 20 bp, Artificial
  CRISPR gRNA sequence
attttccatttatgaaacaa

SEQ ID NO: 119045 - DNA, 20 bp, Artificial
  CRISPR gRNA sequence
ttttccatttatgaaacaaa

SEQ ID NO: 119046 - DNA, 20 bp, Artificial
  CRISPR gRNA sequence
tccatttatgaaacaaatag

SEQ ID NO: 119047 - DNA, 20 bp, Artificial
  CRISPR gRNA sequence
ccatttatgaaacaaatagg

SEQ ID NO: 119048 - DNA, 20 bp, Artificial
  CRISPR gRNA sequence
catttatgaaacaaataggg

SEQ ID NO: 119049 - DNA, 20 bp, Artificial
  CRISPR gRNA sequence
atgaaacaaatagggaattt

SEQ ID NO: 119050 - DNA, 20 bp, Artificial
  CRISPR gRNA sequence
tgaaacaaatagggaatttc

SEQ ID NO: 119051 - DNA, 20 bp, Artificial
  CRISPR gRNA sequence
cgacactgtctggatacctg

SEQ ID NO: 119052 - DNA, 20 bp, Artificial
  CRISPR gRNA sequence
gacactgtctggatacctga

SEQ ID NO: 119053 - DNA, 20 bp, Artificial
  CRISPR gRNA sequence
tctggatacctgatattaac

SEQ ID NO: 119054 - DNA, 20 bp, Artificial
  CRISPR gRNA sequence
gatacctgatattaacaaat

SEQ ID NO: 119055 - DNA, 20 bp, Artificial
  CRISPR gRNA sequence
atattaacaaatcaatgtcg

SEQ ID NO: 119056 - DNA, 20 bp, Artificial
  CRISPR gRNA sequence
acaaatcaatgtcggttttt

SEQ ID NO: 119057 - DNA, 20 bp, Artificial
  CRISPR gRNA sequence
ttatgaaagatagcagtggt

SEQ ID NO: 119058 - DNA, 20 bp, Artificial
  CRISPR gRNA sequence
tatgaaagatagcagtggta

SEQ ID NO: 119059 - DNA, 20 bp, Artificial
  CRISPR gRNA sequence
atgaaagatagcagtggtat

SEQ ID NO: 119060 - DNA, 20 bp, Artificial
  CRISPR gRNA sequence
tgaaagatagcagtggtatg

SEQ ID NO: 119061 - DNA, 20 bp, Artificial
  CRISPR gRNA sequence
tatatattgaaaagcatgca

SEQ ID NO: 119062 - DNA, 20 bp, Artificial
  CRISPR gRNA sequence
aaaagcatgcatatttaaaa

SEQ ID NO: 119063 - DNA, 20 bp, Artificial
  CRISPR gRNA sequence
aaaatacactctgggctggg

SEQ ID NO: 119064 - DNA, 20 bp, Artificial
  CRISPR gRNA sequence
aaatacactctgggctgggt

SEQ ID NO: 119065 - DNA, 20 bp, Artificial
  CRISPR gRNA sequence
tgggctgggtgtggtggctc

SEQ ID NO: 119066 - DNA, 20 bp, Artificial
  CRISPR gRNA sequence
ggctgggtgtggtggctcac

SEQ ID NO: 119067 - DNA, 20 bp, Artificial
  CRISPR gRNA sequence
ggtgtggtggctcacgcctg

SEQ ID NO: 119068 - DNA, 20 bp, Artificial
  CRISPR gRNA sequence
acgcctgtaatccttgcact

SEQ ID NO: 119069 - DNA, 20 bp, Artificial
  CRISPR gRNA sequence
taatccttgcactttggaag

SEQ ID NO: 119070 - DNA, 20 bp, Artificial
  CRISPR gRNA sequence
gcactttggaaggccgaggt

SEQ ID NO: 119071 - DNA, 20 bp, Artificial
  CRISPR gRNA sequence
cactttggaaggccgaggtg

SEQ ID NO: 119072 - DNA, 20 bp, Artificial
  CRISPR gRNA sequence
tggaaggccgaggtgggtgg

SEQ ID NO: 119073 - DNA, 20 bp, Artificial
  CRISPR gRNA sequence
ggaaggccgaggtgggtgga

SEQ ID NO: 119074 - DNA, 20 bp, Artificial
  CRISPR gRNA sequence
gaaggccgaggtgggtggat

SEQ ID NO: 119075 - DNA, 20 bp, Artificial
  CRISPR gRNA sequence
gaggtcaggagttcgagacc

SEQ ID NO: 119076 - DNA, 20 bp, Artificial
  CRISPR gRNA sequence
aggtcaggagttcgagacca

SEQ ID NO: 119077 - DNA, 20 bp, Artificial
  CRISPR gRNA sequence
gagaccagcctggccaacat

SEQ ID NO: 119078 - DNA, 20 bp, Artificial
  CRISPR gRNA sequence
gccaacatgatgaaaccctg

SEQ ID NO: 119079 - DNA, 20 bp, Artificial
  CRISPR gRNA sequence
tctctactaaaaatacaaag

SEQ ID NO: 119080 - DNA, 20 bp, Artificial
  CRISPR gRNA sequence
tactaaaaatacaaagatta

SEQ ID NO: 119081 - DNA, 20 bp, Artificial
  CRISPR gRNA sequence
ctaaaaatacaaagattagc

SEQ ID NO: 119082 - DNA, 20 bp, Artificial
  CRISPR gRNA sequence
aaaatacaaagattagccgg

SEQ ID NO: 119083 - DNA, 20 bp, Artificial
  CRISPR gRNA sequence
gccgggcatggtggtgcatg

SEQ ID NO: 119084 - DNA, 20 bp, Artificial
  CRISPR gRNA sequence
taatcccagctacttgggag

SEQ ID NO: 119085 - DNA, 20 bp, Artificial
  CRISPR gRNA sequence
cttgggagactgaggccgga

SEQ ID NO: 119086 - DNA, 20 bp, Artificial
  CRISPR gRNA sequence
gggagactgaggccggaaaa

SEQ ID NO: 119087 - DNA, 20 bp, Artificial
  CRISPR gRNA sequence
ggagactgaggccggaaaat

SEQ ID NO: 119088 - DNA, 20 bp, Artificial
  CRISPR gRNA sequence
aggccggaaaatcacttgaa

SEQ ID NO: 119089 - DNA, 20 bp, Artificial
  CRISPR gRNA sequence
gaaccggaggcggaggttgc

SEQ ID NO: 119090 - DNA, 20 bp, Artificial
  CRISPR gRNA sequence
aaccggaggcggaggttgca

SEQ ID NO: 119091 - DNA, 20 bp, Artificial
  CRISPR gRNA sequence
cagtgagccgagatcacgcc

SEQ ID NO: 119092 - DNA, 20 bp, Artificial
  CRISPR gRNA sequence
cactccagcctgggcgacag

SEQ ID NO: 119093 - DNA, 20 bp, Artificial
  CRISPR gRNA sequence
cagcctgggcgacagagcga

SEQ ID NO: 119094 - DNA, 20 bp, Artificial
  CRISPR gRNA sequence
ggcgacagagcgagattccg

SEQ ID NO: 119095 - DNA, 20 bp, Artificial
  CRISPR gRNA sequence
cgtctcaaaaaaataaaaaa

SEQ ID NO: 119096 - DNA, 20 bp, Artificial
  CRISPR gRNA sequence
aaaaaaataaaaaaataaaa

SEQ ID NO: 119097 - DNA, 20 bp, Artificial
  CRISPR gRNA sequence
taaagtgctttattattatt

SEQ ID NO: 119098 - DNA, 20 bp, Artificial
  CRISPR gRNA sequence
aagtgctttattattatttt

SEQ ID NO: 119099 - DNA, 20 bp, Artificial
  CRISPR gRNA sequence
tattattattttttaatctt

SEQ ID NO: 119100 - DNA, 20 bp, Artificial
  CRISPR gRNA sequence
attattattttttaatcttg

SEQ ID NO: 119101 - DNA, 20 bp, Artificial
  CRISPR gRNA sequence
ttattattttttaatcttgc

SEQ ID NO: 119102 - DNA, 20 bp, Artificial
  CRISPR gRNA sequence
ttattttttaatcttgccat

SEQ ID NO: 119103 - DNA, 20 bp, Artificial
  CRISPR gRNA sequence
ttttttaatcttgccatttt

SEQ ID NO: 119104 - DNA, 20 bp, Artificial
  CRISPR gRNA sequence
tttaatcttgccattttggt

SEQ ID NO: 119105 - DNA, 20 bp, Artificial
  CRISPR gRNA sequence
ttaatcttgccattttggtg

SEQ ID NO: 119106 - DNA, 20 bp, Artificial
  CRISPR gRNA sequence
taatcttgccattttggtga

SEQ ID NO: 119107 - DNA, 20 bp, Artificial
  CRISPR gRNA sequence
aatcttgccattttggtgaa

SEQ ID NO: 119108 - DNA, 20 bp, Artificial
  CRISPR gRNA sequence
atcttgccattttggtgaat

SEQ ID NO: 119109 - DNA, 20 bp, Artificial
  CRISPR gRNA sequence
gccattttggtgaatgatga

SEQ ID NO: 119110 - DNA, 20 bp, Artificial
  CRISPR gRNA sequence
ccattttggtgaatgatgaa

SEQ ID NO: 119111 - DNA, 20 bp, Artificial
  CRISPR gRNA sequence
tggtgaatgatgaagtactt

SEQ ID NO: 119112 - DNA, 20 bp, Artificial
  CRISPR gRNA sequence
ggtgaatgatgaagtacttt

SEQ ID NO: 119113 - DNA, 20 bp, Artificial
  CRISPR gRNA sequence
gtgaatgatgaagtactttt

SEQ ID NO: 119114 - DNA, 20 bp, Artificial
  CRISPR gRNA sequence
ttttacagaggaaatactat

SEQ ID NO: 119115 - DNA, 20 bp, Artificial
  CRISPR gRNA sequence
tttacagaggaaatactata

SEQ ID NO: 119116 - DNA, 20 bp, Artificial
  CRISPR gRNA sequence
ttacagaggaaatactatat

SEQ ID NO: 119117 - DNA, 20 bp, Artificial
  CRISPR gRNA sequence
tacagaggaaatactatata

SEQ ID NO: 119118 - DNA, 20 bp, Artificial
  CRISPR gRNA sequence
acagaggaaatactatatat

SEQ ID NO: 119119 - DNA, 20 bp, Artificial
  CRISPR gRNA sequence
cagaggaaatactatatata

SEQ ID NO: 119120 - DNA, 20 bp, Artificial
  CRISPR gRNA sequence
tatatattaaaaatgctgaa

SEQ ID NO: 119121 - DNA, 20 bp, Artificial
  CRISPR gRNA sequence
aaaatgctgaaagccgggta

SEQ ID NO: 119122 - DNA, 20 bp, Artificial
  CRISPR gRNA sequence
aaagccgggtacaatggctt

SEQ ID NO: 119123 - DNA, 20 bp, Artificial
  CRISPR gRNA sequence
atgcccataatcccagcact

SEQ ID NO: 119124 - DNA, 20 bp, Artificial
  CRISPR gRNA sequence
tgcccataatcccagcactt

SEQ ID NO: 119125 - DNA, 20 bp, Artificial
  CRISPR gRNA sequence
caggaggctgaggcgagcag

SEQ ID NO: 119126 - DNA, 20 bp, Artificial
  CRISPR gRNA sequence
aggaggctgaggcgagcaga

SEQ ID NO: 119127 - DNA, 20 bp, Artificial
  CRISPR gRNA sequence
aggcgagcagattaggtcag

SEQ ID NO: 119128 - DNA, 20 bp, Artificial
  CRISPR gRNA sequence
ggtcaggagttcgagaccag

SEQ ID NO: 119129 - DNA, 20 bp, Artificial
  CRISPR gRNA sequence
gagaccagcctgggcaacat

SEQ ID NO: 119130 - DNA, 20 bp, Artificial
  CRISPR gRNA sequence
ggcaacatggcaaaaccctg

SEQ ID NO: 119131 - DNA, 20 bp, Artificial
  CRISPR gRNA sequence
tatctactgaaaaatacaaa

SEQ ID NO: 119132 - DNA, 20 bp, Artificial
  CRISPR gRNA sequence
ctgaaaaatacaaaaattat

SEQ ID NO: 119133 - DNA, 20 bp, Artificial
  CRISPR gRNA sequence
aaaaatacaaaaattatcca

SEQ ID NO: 119134 - DNA, 20 bp, Artificial
  CRISPR gRNA sequence
tccaggcatggtaggacatg

SEQ ID NO: 119135 - DNA, 20 bp, Artificial
  CRISPR gRNA sequence
tggtcccagctacttgggga

SEQ ID NO: 119136 - DNA, 20 bp, Artificial
  CRISPR gRNA sequence
cttggggaactgaggtggga

SEQ ID NO: 119137 - DNA, 20 bp, Artificial
  CRISPR gRNA sequence
ggggaactgaggtgggagga

SEQ ID NO: 119138 - DNA, 20 bp, Artificial
  CRISPR gRNA sequence
gggaactgaggtgggaggat

SEQ ID NO: 119139 - DNA, 20 bp, Artificial
  CRISPR gRNA sequence
aggtgggaggatcatttgag

SEQ ID NO: 119140 - DNA, 20 bp, Artificial
  CRISPR gRNA sequence
gagcctgggaggcagaggtt

SEQ ID NO: 119141 - DNA, 20 bp, Artificial
  CRISPR gRNA sequence
agcctgggaggcagaggttg

SEQ ID NO: 119142 - DNA, 20 bp, Artificial
  CRISPR gRNA sequence
ggaggcagaggttgcagtga

SEQ ID NO: 119143 - DNA, 20 bp, Artificial
  CRISPR gRNA sequence
cagtgagccaagatccgcac

SEQ ID NO: 119144 - DNA, 20 bp, Artificial
  CRISPR gRNA sequence
cattccagcctaggcaacag

SEQ ID NO: 119145 - DNA, 20 bp, Artificial
  CRISPR gRNA sequence
cagcctaggcaacagagcga

SEQ ID NO: 119146 - DNA, 20 bp, Artificial
  CRISPR gRNA sequence
ggcaacagagcgagtaactg

SEQ ID NO: 119147 - DNA, 20 bp, Artificial
  CRISPR gRNA sequence
tctcaaaaaaacaaacaaag

SEQ ID NO: 119148 - DNA, 20 bp, Artificial
  CRISPR gRNA sequence
aaaaaaacaaacaaagaaaa

SEQ ID NO: 119149 - DNA, 20 bp, Artificial
  CRISPR gRNA sequence
tactctagtcaaatgtgact

SEQ ID NO: 119150 - DNA, 20 bp, Artificial
  CRISPR gRNA sequence
ctctagtcaaatgtgactgc

SEQ ID NO: 119151 - DNA, 20 bp, Artificial
  CRISPR gRNA sequence
tagtcaaatgtgactgcagc

SEQ ID NO: 119152 - DNA, 20 bp, Artificial
  CRISPR gRNA sequence
gtcaaatgtgactgcagccc

SEQ ID NO: 119153 - DNA, 20 bp, Artificial
  CRISPR gRNA sequence
cagcccaggacaacaccttg

SEQ ID NO: 119154 - DNA, 20 bp, Artificial
  CRISPR gRNA sequence
gataagggccttgagaggac

SEQ ID NO: 119155 - DNA, 20 bp, Artificial
  CRISPR gRNA sequence
ataagggccttgagaggacc

SEQ ID NO: 119156 - DNA, 20 bp, Artificial
  CRISPR gRNA sequence
gagaggaccttgaaagaatc

SEQ ID NO: 119157 - DNA, 20 bp, Artificial
  CRISPR gRNA sequence
agaggaccttgaaagaatcc

SEQ ID NO: 119158 - DNA, 20 bp, Artificial
  CRISPR gRNA sequence
gaaagaatccaacacagctg

SEQ ID NO: 119159 - DNA, 20 bp, Artificial
  CRISPR gRNA sequence
aaagaatccaacacagctgt

SEQ ID NO: 119160 - DNA, 20 bp, Artificial
  CRISPR gRNA sequence
tgtcaggattcctaactcac

SEQ ID NO: 119161 - DNA, 20 bp, Artificial
  CRISPR gRNA sequence
ctaactcacagaaactataa

SEQ ID NO: 119162 - DNA, 20 bp, Artificial
  CRISPR gRNA sequence
actcacagaaactataaaat

SEQ ID NO: 119163 - DNA, 20 bp, Artificial
  CRISPR gRNA sequence
acagaaactataaaataaat

SEQ ID NO: 119164 - DNA, 20 bp, Artificial
  CRISPR gRNA sequence
taaaataaattttttttttt

SEQ ID NO: 119165 - DNA, 20 bp, Artificial
  CRISPR gRNA sequence
tttttttttttttttttttg

SEQ ID NO: 119166 - DNA, 20 bp, Artificial
  CRISPR gRNA sequence
ttttttttttttttttttgg

SEQ ID NO: 119167 - DNA, 20 bp, Artificial
  CRISPR gRNA sequence
tttttttttttttttttgga

SEQ ID NO: 119168 - DNA, 20 bp, Artificial
  CRISPR gRNA sequence
ttttttttttttttttggag

SEQ ID NO: 119169 - DNA, 20 bp, Artificial
  CRISPR gRNA sequence
tttttttttttttttggaga

SEQ ID NO: 119170 - DNA, 20 bp, Artificial
  CRISPR gRNA sequence
ttttttttttttttggagac

SEQ ID NO: 119171 - DNA, 20 bp, Artificial
  CRISPR gRNA sequence
tttttttttttttggagacg

SEQ ID NO: 119172 - DNA, 20 bp, Artificial
  CRISPR gRNA sequence
ttttttttttttggagacgg

SEQ ID NO: 119173 - DNA, 20 bp, Artificial
  CRISPR gRNA sequence
tttttttttttggagacgga

SEQ ID NO: 119174 - DNA, 20 bp, Artificial
  CRISPR gRNA sequence
ttttttttttggagacggag

SEQ ID NO: 119175 - DNA, 20 bp, Artificial
  CRISPR gRNA sequence
tttttttttggagacggagt

SEQ ID NO: 119176 - DNA, 20 bp, Artificial
  CRISPR gRNA sequence
ttttttttggagacggagtg

SEQ ID NO: 119177 - DNA, 20 bp, Artificial
  CRISPR gRNA sequence
tttttttggagacggagtgt

SEQ ID NO: 119178 - DNA, 20 bp, Artificial
  CRISPR gRNA sequence
ttttttggagacggagtgtc

SEQ ID NO: 119179 - DNA, 20 bp, Artificial
  CRISPR gRNA sequence
tttttggagacggagtgtcg

SEQ ID NO: 119180 - DNA, 20 bp, Artificial
  CRISPR gRNA sequence
ttttggagacggagtgtcgc

SEQ ID NO: 119181 - DNA, 20 bp, Artificial
  CRISPR gRNA sequence
tttggagacggagtgtcgct

SEQ ID NO: 119182 - DNA, 20 bp, Artificial
  CRISPR gRNA sequence
ttggagacggagtgtcgctc

SEQ ID NO: 119183 - DNA, 20 bp, Artificial
  CRISPR gRNA sequence
tggagacggagtgtcgctct

SEQ ID NO: 119184 - DNA, 20 bp, Artificial
  CRISPR gRNA sequence
ggagacggagtgtcgctctg

SEQ ID NO: 119185 - DNA, 20 bp, Artificial
  CRISPR gRNA sequence
gagacggagtgtcgctctgt

SEQ ID NO: 119186 - DNA, 20 bp, Artificial
  CRISPR gRNA sequence
tgtggctcaggctggagtgc

SEQ ID NO: 119187 - DNA, 20 bp, Artificial
  CRISPR gRNA sequence
tggctcaggctggagtgcag

SEQ ID NO: 119188 - DNA, 20 bp, Artificial
  CRISPR gRNA sequence
aggctggagtgcagtggtgt

SEQ ID NO: 119189 - DNA, 20 bp, Artificial
  CRISPR gRNA sequence
gagtgcagtggtgtgatctt

SEQ ID NO: 119190 - DNA, 20 bp, Artificial
  CRISPR gRNA sequence
ggctcactgcaagctccgcc

SEQ ID NO: 119191 - DNA, 20 bp, Artificial
  CRISPR gRNA sequence
gctcactgcaagctccgcct

SEQ ID NO: 119192 - DNA, 20 bp, Artificial
  CRISPR gRNA sequence
actgcaagctccgcctcctg

SEQ ID NO: 119193 - DNA, 20 bp, Artificial
  CRISPR gRNA sequence
caagctccgcctcctgggtt

SEQ ID NO: 119194 - DNA, 20 bp, Artificial
  CRISPR gRNA sequence
cgcctcctgggttcatgcca

SEQ ID NO: 119195 - DNA, 20 bp, Artificial
  CRISPR gRNA sequence
ctgggttcatgccattctcc

SEQ ID NO: 119196 - DNA, 20 bp, Artificial
  CRISPR gRNA sequence
ggttcatgccattctcctgc

SEQ ID NO: 119197 - DNA, 20 bp, Artificial
  CRISPR gRNA sequence
atgccattctcctgcctcag

SEQ ID NO: 119198 - DNA, 20 bp, Artificial
  CRISPR gRNA sequence
tcctgcctcagcctcccgag

SEQ ID NO: 119199 - DNA, 20 bp, Artificial
  CRISPR gRNA sequence
ctgcctcagcctcccgagta

SEQ ID NO: 119200 - DNA, 20 bp, Artificial
  CRISPR gRNA sequence
cctcagcctcccgagtagct

SEQ ID NO: 119201 - DNA, 20 bp, Artificial
  CRISPR gRNA sequence
agcctcccgagtagctggga

SEQ ID NO: 119202 - DNA, 20 bp, Artificial
  CRISPR gRNA sequence
ccgagtagctgggactacag

SEQ ID NO: 119203 - DNA, 20 bp, Artificial
  CRISPR gRNA sequence
ggactacaggcgtccgccat

SEQ ID NO: 119204 - DNA, 20 bp, Artificial
  CRISPR gRNA sequence
caggcgtccgccatcacgcc

SEQ ID NO: 119205 - DNA, 20 bp, Artificial
  CRISPR gRNA sequence
gcttaattttttttttgtct

SEQ ID NO: 119206 - DNA, 20 bp, Artificial
  CRISPR gRNA sequence
aattttttttttgtcttttt

SEQ ID NO: 119207 - DNA, 20 bp, Artificial
  CRISPR gRNA sequence
attttttttttgtcttttta

SEQ ID NO: 119208 - DNA, 20 bp, Artificial
  CRISPR gRNA sequence
tttttttgtctttttagtag

SEQ ID NO: 119209 - DNA, 20 bp, Artificial
  CRISPR gRNA sequence
ttttttgtctttttagtaga

SEQ ID NO: 119210 - DNA, 20 bp, Artificial
  CRISPR gRNA sequence
tttttgtctttttagtagag

SEQ ID NO: 119211 - DNA, 20 bp, Artificial
  CRISPR gRNA sequence
ttttgtctttttagtagaga

SEQ ID NO: 119212 - DNA, 20 bp, Artificial
  CRISPR gRNA sequence
tttgtctttttagtagagac

SEQ ID NO: 119213 - DNA, 20 bp, Artificial
  CRISPR gRNA sequence
ttgtctttttagtagagacg

SEQ ID NO: 119214 - DNA, 20 bp, Artificial
  CRISPR gRNA sequence
tgtctttttagtagagacgg

SEQ ID NO: 119215 - DNA, 20 bp, Artificial
  CRISPR gRNA sequence
gtctttttagtagagacggg

SEQ ID NO: 119216 - DNA, 20 bp, Artificial
  CRISPR gRNA sequence
tctttttagtagagacgggg

SEQ ID NO: 119217 - DNA, 20 bp, Artificial
  CRISPR gRNA sequence
tttagtagagacggggtttc

SEQ ID NO: 119218 - DNA, 20 bp, Artificial
  CRISPR gRNA sequence
ttagtagagacggggtttca

SEQ ID NO: 119219 - DNA, 20 bp, Artificial
  CRISPR gRNA sequence
tagtagagacggggtttcac

SEQ ID NO: 119220 - DNA, 20 bp, Artificial
  CRISPR gRNA sequence
agtagagacggggtttcact

SEQ ID NO: 119221 - DNA, 20 bp, Artificial
  CRISPR gRNA sequence
gtagagacggggtttcactg

SEQ ID NO: 119222 - DNA, 20 bp, Artificial
  CRISPR gRNA sequence
cactgtgttaaccaggatgg

SEQ ID NO: 119223 - DNA, 20 bp, Artificial
  CRISPR gRNA sequence
actgtgttaaccaggatggt

SEQ ID NO: 119224 - DNA, 20 bp, Artificial
  CRISPR gRNA sequence
tgttaaccaggatggtctcg

SEQ ID NO: 119225 - DNA, 20 bp, Artificial
  CRISPR gRNA sequence
accaggatggtctcgatctc

SEQ ID NO: 119226 - DNA, 20 bp, Artificial
  CRISPR gRNA sequence
gatctcctgaccttgtgatc

SEQ ID NO: 119227 - DNA, 20 bp, Artificial
  CRISPR gRNA sequence
ctgaccttgtgatccacccg

SEQ ID NO: 119228 - DNA, 20 bp, Artificial
  CRISPR gRNA sequence
accttgtgatccacccgcct

SEQ ID NO: 119229 - DNA, 20 bp, Artificial
  CRISPR gRNA sequence
gtgatccacccgcctcggcc

SEQ ID NO: 119230 - DNA, 20 bp, Artificial
  CRISPR gRNA sequence
tgatccacccgcctcggcca

SEQ ID NO: 119231 - DNA, 20 bp, Artificial
  CRISPR gRNA sequence
ggccacccaaagtgctggga

SEQ ID NO: 119232 - DNA, 20 bp, Artificial
  CRISPR gRNA sequence
ggattacaggtgtgggccac

SEQ ID NO: 119233 - DNA, 20 bp, Artificial
  CRISPR gRNA sequence
caggtgtgggccaccgcacc

SEQ ID NO: 119234 - DNA, 20 bp, Artificial
  CRISPR gRNA sequence
gttgttttaagctgctaact

SEQ ID NO: 119235 - DNA, 20 bp, Artificial
  CRISPR gRNA sequence
ttgttttaagctgctaactt

SEQ ID NO: 119236 - DNA, 20 bp, Artificial
  CRISPR gRNA sequence
ttttaagctgctaacttcta

SEQ ID NO: 119237 - DNA, 20 bp, Artificial
  CRISPR gRNA sequence
taagctgctaacttctagga

SEQ ID NO: 119238 - DNA, 20 bp, Artificial
  CRISPR gRNA sequence
aagctgctaacttctaggat

SEQ ID NO: 119239 - DNA, 20 bp, Artificial
  CRISPR gRNA sequence
agctgctaacttctaggata

SEQ ID NO: 119240 - DNA, 20 bp, Artificial
  CRISPR gRNA sequence
ctaacttctaggataatttg

SEQ ID NO: 119241 - DNA, 20 bp, Artificial
  CRISPR gRNA sequence
acttctaggataatttgtta

SEQ ID NO: 119242 - DNA, 20 bp, Artificial
  CRISPR gRNA sequence
ctaggataatttgttatatg

SEQ ID NO: 119243 - DNA, 20 bp, Artificial
  CRISPR gRNA sequence
taggataatttgttatatgg

SEQ ID NO: 119244 - DNA, 20 bp, Artificial
  CRISPR gRNA sequence
ggataatttgttatatggta

SEQ ID NO: 119245 - DNA, 20 bp, Artificial
  CRISPR gRNA sequence
gttatatggtaatagataat

SEQ ID NO: 119246 - DNA, 20 bp, Artificial
  CRISPR gRNA sequence
ttatatggtaatagataatt

SEQ ID NO: 119247 - DNA, 20 bp, Artificial
  CRISPR gRNA sequence
tatggtaatagataattaag

SEQ ID NO: 119248 - DNA, 20 bp, Artificial
  CRISPR gRNA sequence
aggcaatgtgacagattata

SEQ ID NO: 119249 - DNA, 20 bp, Artificial
  CRISPR gRNA sequence
tattcctcctattagtttcc

SEQ ID NO: 119250 - DNA, 20 bp, Artificial
  CRISPR gRNA sequence
ctcctattagtttccaatta

SEQ ID NO: 119251 - DNA, 20 bp, Artificial
  CRISPR gRNA sequence
ctattagtttccaattacca

SEQ ID NO: 119252 - DNA, 20 bp, Artificial
  CRISPR gRNA sequence
ttagtttccaattaccaata

SEQ ID NO: 119253 - DNA, 20 bp, Artificial
  CRISPR gRNA sequence
gtttccaattaccaatactc

SEQ ID NO: 119254 - DNA, 20 bp, Artificial
  CRISPR gRNA sequence
ccaattaccaatactcacta

SEQ ID NO: 119255 - DNA, 20 bp, Artificial
  CRISPR gRNA sequence
caattaccaatactcactac

SEQ ID NO: 119256 - DNA, 20 bp, Artificial
  CRISPR gRNA sequence
ccaatactcactactgtcat

SEQ ID NO: 119257 - DNA, 20 bp, Artificial
  CRISPR gRNA sequence
actactgtcattaatgtttg

SEQ ID NO: 119258 - DNA, 20 bp, Artificial
  CRISPR gRNA sequence
ctgtcattaatgtttgtcaa

SEQ ID NO: 119259 - DNA, 20 bp, Artificial
  CRISPR gRNA sequence
tcattaatgtttgtcaaatt

SEQ ID NO: 119260 - DNA, 20 bp, Artificial
  CRISPR gRNA sequence
atgtttgtcaaatttttgtt

SEQ ID NO: 119261 - DNA, 20 bp, Artificial
  CRISPR gRNA sequence
gtcaaatttttgttgattta

SEQ ID NO: 119262 - DNA, 20 bp, Artificial
  CRISPR gRNA sequence
tcaaatttttgttgatttaa

SEQ ID NO: 119263 - DNA, 20 bp, Artificial
  CRISPR gRNA sequence
ttgttgatttaatttgtatc

SEQ ID NO: 119264 - DNA, 20 bp, Artificial
  CRISPR gRNA sequence
tgttgatttaatttgtatct

SEQ ID NO: 119265 - DNA, 20 bp, Artificial
  CRISPR gRNA sequence
gttgatttaatttgtatctc

SEQ ID NO: 119266 - DNA, 20 bp, Artificial
  CRISPR gRNA sequence
ttgatttaatttgtatctcc

SEQ ID NO: 119267 - DNA, 20 bp, Artificial
  CRISPR gRNA sequence
atttaatttgtatctcctat

SEQ ID NO: 119268 - DNA, 20 bp, Artificial
  CRISPR gRNA sequence
aatttgtatctcctatttgg

SEQ ID NO: 119269 - DNA, 20 bp, Artificial
  CRISPR gRNA sequence
atttgtatctcctatttggt

SEQ ID NO: 119270 - DNA, 20 bp, Artificial
  CRISPR gRNA sequence
gtatctcctatttggtccta

SEQ ID NO: 119271 - DNA, 20 bp, Artificial
  CRISPR gRNA sequence
tatctcctatttggtcctag

SEQ ID NO: 119272 - DNA, 20 bp, Artificial
  CRISPR gRNA sequence
ctatttggtcctaggattgg

SEQ ID NO: 119273 - DNA, 20 bp, Artificial
  CRISPR gRNA sequence
tttggtcctaggattggata

SEQ ID NO: 119274 - DNA, 20 bp, Artificial
  CRISPR gRNA sequence
ggtcctaggattggatagct

SEQ ID NO: 119275 - DNA, 20 bp, Artificial
  CRISPR gRNA sequence
gtcctaggattggatagcta

SEQ ID NO: 119276 - DNA, 20 bp, Artificial
  CRISPR gRNA sequence
ggattggatagctaaacctt

SEQ ID NO: 119277 - DNA, 20 bp, Artificial
  CRISPR gRNA sequence
gatagctaaaccttataaag

SEQ ID NO: 119278 - DNA, 20 bp, Artificial
  CRISPR gRNA sequence
aaccttataaagcaattatg

SEQ ID NO: 119279 - DNA, 20 bp, Artificial
  CRISPR gRNA sequence
ataaagcaattatggaaagc

SEQ ID NO: 119280 - DNA, 20 bp, Artificial
  CRISPR gRNA sequence
taaagcaattatggaaagca

SEQ ID NO: 119281 - DNA, 20 bp, Artificial
  CRISPR gRNA sequence
tggaaagcaagggatcgtgt

SEQ ID NO: 119282 - DNA, 20 bp, Artificial
  CRISPR gRNA sequence
tccaaatctatcttctttct

SEQ ID NO: 119283 - DNA, 20 bp, Artificial
  CRISPR gRNA sequence
tcttctttcttttttttaat

SEQ ID NO: 119284 - DNA, 20 bp, Artificial
  CRISPR gRNA sequence
ctttcttttttttaatggct

SEQ ID NO: 119285 - DNA, 20 bp, Artificial
  CRISPR gRNA sequence
tttcttttttttaatggcta

SEQ ID NO: 119286 - DNA, 20 bp, Artificial
  CRISPR gRNA sequence
tcttttttttaatggctata

SEQ ID NO: 119287 - DNA, 20 bp, Artificial
  CRISPR gRNA sequence
cttttttttaatggctatag

SEQ ID NO: 119288 - DNA, 20 bp, Artificial
  CRISPR gRNA sequence
ttttttttaatggctatagc

SEQ ID NO: 119289 - DNA, 20 bp, Artificial
  CRISPR gRNA sequence
ttttttaatggctatagcca

SEQ ID NO: 119290 - DNA, 20 bp, Artificial
  CRISPR gRNA sequence
tttttaatggctatagccac

SEQ ID NO: 119291 - DNA, 20 bp, Artificial
  CRISPR gRNA sequence
ttttaatggctatagccact

SEQ ID NO: 119292 - DNA, 20 bp, Artificial
  CRISPR gRNA sequence
tttaatggctatagccactt

SEQ ID NO: 119293 - DNA, 20 bp, Artificial
  CRISPR gRNA sequence
ttaatggctatagccacttt

SEQ ID NO: 119294 - DNA, 20 bp, Artificial
  CRISPR gRNA sequence
taatggctatagccacttta

SEQ ID NO: 119295 - DNA, 20 bp, Artificial
  CRISPR gRNA sequence
aatggctatagccactttat

SEQ ID NO: 119296 - DNA, 20 bp, Artificial
  CRISPR gRNA sequence
atggctatagccactttatt

SEQ ID NO: 119297 - DNA, 20 bp, Artificial
  CRISPR gRNA sequence
tagccactttattaggagtg

SEQ ID NO: 119298 - DNA, 20 bp, Artificial
  CRISPR gRNA sequence
tattaggagtgttatcagaa

SEQ ID NO: 119299 - DNA, 20 bp, Artificial
  CRISPR gRNA sequence
attaggagtgttatcagaaa

SEQ ID NO: 119300 - DNA, 20 bp, Artificial
  CRISPR gRNA sequence
ttaggagtgttatcagaaac

SEQ ID NO: 119301 - DNA, 20 bp, Artificial
  CRISPR gRNA sequence
ggagtgttatcagaaacctg

SEQ ID NO: 119302 - DNA, 20 bp, Artificial
  CRISPR gRNA sequence
tcagaaacctgacaagaagc

SEQ ID NO: 119303 - DNA, 20 bp, Artificial
  CRISPR gRNA sequence
acaagaagcttgaaaaatat

SEQ ID NO: 119304 - DNA, 20 bp, Artificial
  CRISPR gRNA sequence
gaaaaatatttctctaaatt

SEQ ID NO: 119305 - DNA, 20 bp, Artificial
  CRISPR gRNA sequence
aaaaatatttctctaaattt

SEQ ID NO: 119306 - DNA, 20 bp, Artificial
  CRISPR gRNA sequence
ctctaaattttggaactaaa

SEQ ID NO: 119307 - DNA, 20 bp, Artificial
  CRISPR gRNA sequence
tctaaattttggaactaaaa

SEQ ID NO: 119308 - DNA, 20 bp, Artificial
  CRISPR gRNA sequence
taaattttggaactaaaaaa

SEQ ID NO: 119309 - DNA, 20 bp, Artificial
  CRISPR gRNA sequence
aattttggaactaaaaaact

SEQ ID NO: 119310 - DNA, 20 bp, Artificial
  CRISPR gRNA sequence
tggaactaaaaaactgcaat

SEQ ID NO: 119311 - DNA, 20 bp, Artificial
  CRISPR gRNA sequence
ggaactaaaaaactgcaata

SEQ ID NO: 119312 - DNA, 20 bp, Artificial
  CRISPR gRNA sequence
gaactaaaaaactgcaatac

SEQ ID NO: 119313 - DNA, 20 bp, Artificial
  CRISPR gRNA sequence
aaaaactgcaatacaaccct

SEQ ID NO: 119314 - DNA, 20 bp, Artificial
  CRISPR gRNA sequence
caatacaaccctttaaatgt

SEQ ID NO: 119315 - DNA, 20 bp, Artificial
  CRISPR gRNA sequence
taaatgttgggtgtacaaaa

SEQ ID NO: 119316 - DNA, 20 bp, Artificial
  CRISPR gRNA sequence
aaatgttgggtgtacaaaat

SEQ ID NO: 119317 - DNA, 20 bp, Artificial
  CRISPR gRNA sequence
aatgttgggtgtacaaaatc

SEQ ID NO: 119318 - DNA, 20 bp, Artificial
  CRISPR gRNA sequence
ggtgtacaaaatcctatttt

SEQ ID NO: 119319 - DNA, 20 bp, Artificial
  CRISPR gRNA sequence
ttttcatataactagtgaac

SEQ ID NO: 119320 - DNA, 20 bp, Artificial
  CRISPR gRNA sequence
tcatataactagtgaacact

SEQ ID NO: 119321 - DNA, 20 bp, Artificial
  CRISPR gRNA sequence
catataactagtgaacactt

SEQ ID NO: 119322 - DNA, 20 bp, Artificial
  CRISPR gRNA sequence
atataactagtgaacacttt

SEQ ID NO: 119323 - DNA, 20 bp, Artificial
  CRISPR gRNA sequence
gtgaacacttttttttttaa

SEQ ID NO: 119324 - DNA, 20 bp, Artificial
  CRISPR gRNA sequence
ttttttttaagtgcaaaaga

SEQ ID NO: 119325 - DNA, 20 bp, Artificial
  CRISPR gRNA sequence
tttttttaagtgcaaaagag

SEQ ID NO: 119326 - DNA, 20 bp, Artificial
  CRISPR gRNA sequence
ttttttaagtgcaaaagaga

SEQ ID NO: 119327 - DNA, 20 bp, Artificial
  CRISPR gRNA sequence
tttttaagtgcaaaagagaa

SEQ ID NO: 119328 - DNA, 20 bp, Artificial
  CRISPR gRNA sequence
ttttaagtgcaaaagagaaa

SEQ ID NO: 119329 - DNA, 20 bp, Artificial
  CRISPR gRNA sequence
tttaagtgcaaaagagaaag

SEQ ID NO: 119330 - DNA, 20 bp, Artificial
  CRISPR gRNA sequence
ttaagtgcaaaagagaaagc

SEQ ID NO: 119331 - DNA, 20 bp, Artificial
  CRISPR gRNA sequence
taagtgcaaaagagaaagca

SEQ ID NO: 119332 - DNA, 20 bp, Artificial
  CRISPR gRNA sequence
aagtgcaaaagagaaagcag

SEQ ID NO: 119333 - DNA, 20 bp, Artificial
  CRISPR gRNA sequence
agtgcaaaagagaaagcagt

SEQ ID NO: 119334 - DNA, 20 bp, Artificial
  CRISPR gRNA sequence
aaaatgtcttgtattttata

SEQ ID NO: 119335 - DNA, 20 bp, Artificial
  CRISPR gRNA sequence
gtattttatattcaagaata

SEQ ID NO: 119336 - DNA, 20 bp, Artificial
  CRISPR gRNA sequence
tattttatattcaagaatac

SEQ ID NO: 119337 - DNA, 20 bp, Artificial
  CRISPR gRNA sequence
tatattcaagaatacctccc

SEQ ID NO: 119338 - DNA, 20 bp, Artificial
  CRISPR gRNA sequence
atattcaagaatacctccca

SEQ ID NO: 119339 - DNA, 20 bp, Artificial
  CRISPR gRNA sequence
tattcaagaatacctcccaa

SEQ ID NO: 119340 - DNA, 20 bp, Artificial
  CRISPR gRNA sequence
aagaatacctcccaaactta

SEQ ID NO: 119341 - DNA, 20 bp, Artificial
  CRISPR gRNA sequence
ccaaacttaaaagccagaat

SEQ ID NO: 119342 - DNA, 20 bp, Artificial
  CRISPR gRNA sequence
aaaagccagaatacatggct

SEQ ID NO: 119343 - DNA, 20 bp, Artificial
  CRISPR gRNA sequence
aaagccagaatacatggcta

SEQ ID NO: 119344 - DNA, 20 bp, Artificial
  CRISPR gRNA sequence
gtactaagtaaccttctctt

SEQ ID NO: 119345 - DNA, 20 bp, Artificial
  CRISPR gRNA sequence
agtaaccttctctttgcttc

SEQ ID NO: 119346 - DNA, 20 bp, Artificial
  CRISPR gRNA sequence
ctctttgcttctttgaccat

SEQ ID NO: 119347 - DNA, 20 bp, Artificial
  CRISPR gRNA sequence
tctttgcttctttgaccatt

SEQ ID NO: 119348 - DNA, 20 bp, Artificial
  CRISPR gRNA sequence
tttgcttctttgaccattaa

SEQ ID NO: 119349 - DNA, 20 bp, Artificial
  CRISPR gRNA sequence
tgcttctttgaccattaatt

SEQ ID NO: 119350 - DNA, 20 bp, Artificial
  CRISPR gRNA sequence
gcttctttgaccattaattc

SEQ ID NO: 119351 - DNA, 20 bp, Artificial
  CRISPR gRNA sequence
cttctttgaccattaattcc

SEQ ID NO: 119352 - DNA, 20 bp, Artificial
  CRISPR gRNA sequence
ctttgaccattaattccatc

SEQ ID NO: 119353 - DNA, 20 bp, Artificial
  CRISPR gRNA sequence
tttgaccattaattccatca

SEQ ID NO: 119354 - DNA, 20 bp, Artificial
  CRISPR gRNA sequence
tgaccattaattccatcaac

SEQ ID NO: 119355 - DNA, 20 bp, Artificial
  CRISPR gRNA sequence
gaccattaattccatcaaca

SEQ ID NO: 119356 - DNA, 20 bp, Artificial
  CRISPR gRNA sequence
accattaattccatcaacaa

SEQ ID NO: 119357 - DNA, 20 bp, Artificial
  CRISPR gRNA sequence
attccatcaacaaacttttt

SEQ ID NO: 119358 - DNA, 20 bp, Artificial
  CRISPR gRNA sequence
catcaacaaactttttttat

SEQ ID NO: 119359 - DNA, 20 bp, Artificial
  CRISPR gRNA sequence
tttttatttgagcattgctt

SEQ ID NO: 119360 - DNA, 20 bp, Artificial
  CRISPR gRNA sequence
ttttatttgagcattgcttc

SEQ ID NO: 119361 - DNA, 20 bp, Artificial
  CRISPR gRNA sequence
tttatttgagcattgcttca

SEQ ID NO: 119362 - DNA, 20 bp, Artificial
  CRISPR gRNA sequence
ttatttgagcattgcttcaa

SEQ ID NO: 119363 - DNA, 20 bp, Artificial
  CRISPR gRNA sequence
tatttgagcattgcttcaac

SEQ ID NO: 119364 - DNA, 20 bp, Artificial
  CRISPR gRNA sequence
atttgagcattgcttcaaca

SEQ ID NO: 119365 - DNA, 20 bp, Artificial
  CRISPR gRNA sequence
tttgagcattgcttcaacat

SEQ ID NO: 119366 - DNA, 20 bp, Artificial
  CRISPR gRNA sequence
gagcattgcttcaacataga

SEQ ID NO: 119367 - DNA, 20 bp, Artificial
  CRISPR gRNA sequence
agcattgcttcaacatagat

SEQ ID NO: 119368 - DNA, 20 bp, Artificial
  CRISPR gRNA sequence
cttcaacatagatggcagtc

SEQ ID NO: 119369 - DNA, 20 bp, Artificial
  CRISPR gRNA sequence
caacatagatggcagtctgg

SEQ ID NO: 119370 - DNA, 20 bp, Artificial
  CRISPR gRNA sequence
aacatagatggcagtctgga

SEQ ID NO: 119371 - DNA, 20 bp, Artificial
  CRISPR gRNA sequence
gaaggaggatactttcagaa

SEQ ID NO: 119372 - DNA, 20 bp, Artificial
  CRISPR gRNA sequence
tcagaaagatagatttttat

SEQ ID NO: 119373 - DNA, 20 bp, Artificial
  CRISPR gRNA sequence
cagaaagatagatttttata

SEQ ID NO: 119374 - DNA, 20 bp, Artificial
  CRISPR gRNA sequence
agaaagatagatttttatag

SEQ ID NO: 119375 - DNA, 20 bp, Artificial
  CRISPR gRNA sequence
ttatagccaggtcactttcc

SEQ ID NO: 119376 - DNA, 20 bp, Artificial
  CRISPR gRNA sequence
tatagccaggtcactttcca

SEQ ID NO: 119377 - DNA, 20 bp, Artificial
  CRISPR gRNA sequence
atagccaggtcactttccat

SEQ ID NO: 119378 - DNA, 20 bp, Artificial
  CRISPR gRNA sequence
tagccaggtcactttccatc

SEQ ID NO: 119379 - DNA, 20 bp, Artificial
  CRISPR gRNA sequence
tccatccataatttcaactt

SEQ ID NO: 119380 - DNA, 20 bp, Artificial
  CRISPR gRNA sequence
ccatccataatttcaacttg

SEQ ID NO: 119381 - DNA, 20 bp, Artificial
  CRISPR gRNA sequence
catccataatttcaacttgg

SEQ ID NO: 119382 - DNA, 20 bp, Artificial
  CRISPR gRNA sequence
caacttgggaccaccttggt

SEQ ID NO: 119383 - DNA, 20 bp, Artificial
  CRISPR gRNA sequence
aacttgggaccaccttggtc

SEQ ID NO: 119384 - DNA, 20 bp, Artificial
  CRISPR gRNA sequence
gggaccaccttggtctggaa

SEQ ID NO: 119385 - DNA, 20 bp, Artificial
  CRISPR gRNA sequence
ggaccaccttggtctggaaa

SEQ ID NO: 119386 - DNA, 20 bp, Artificial
  CRISPR gRNA sequence
ggtctggaaagaagaacatg

SEQ ID NO: 119387 - DNA, 20 bp, Artificial
  CRISPR gRNA sequence
gtctggaaagaagaacatgc

SEQ ID NO: 119388 - DNA, 20 bp, Artificial
  CRISPR gRNA sequence
gaaagaagaacatgcctaga

SEQ ID NO: 119389 - DNA, 20 bp, Artificial
  CRISPR gRNA sequence
gaaccttaagttatcacaaa

SEQ ID NO: 119390 - DNA, 20 bp, Artificial
  CRISPR gRNA sequence
aagttatcacaaagtctacc

SEQ ID NO: 119391 - DNA, 20 bp, Artificial
  CRISPR gRNA sequence
agttatcacaaagtctacca

SEQ ID NO: 119392 - DNA, 20 bp, Artificial
  CRISPR gRNA sequence
tcacaaagtctaccagctga

SEQ ID NO: 119393 - DNA, 20 bp, Artificial
  CRISPR gRNA sequence
ccagctgataggaaaaagga

SEQ ID NO: 119394 - DNA, 20 bp, Artificial
  CRISPR gRNA sequence
ataggaaaaaggactactga

SEQ ID NO: 119395 - DNA, 20 bp, Artificial
  CRISPR gRNA sequence
ctgatggaaggaaggtgaaa

SEQ ID NO: 119396 - DNA, 20 bp, Artificial
  CRISPR gRNA sequence
atggaaggaaggtgaaaaaa

SEQ ID NO: 119397 - DNA, 20 bp, Artificial
  CRISPR gRNA sequence
catgtcttagagacattcat

SEQ ID NO: 119398 - DNA, 20 bp, Artificial
  CRISPR gRNA sequence
agagacattcatggatccta

SEQ ID NO: 119399 - DNA, 20 bp, Artificial
  CRISPR gRNA sequence
gagacattcatggatcctac

SEQ ID NO: 119400 - DNA, 20 bp, Artificial
  CRISPR gRNA sequence
atggatcctactttgttagg

SEQ ID NO: 119401 - DNA, 20 bp, Artificial
  CRISPR gRNA sequence
ctttgttaggggatagattg

SEQ ID NO: 119402 - DNA, 20 bp, Artificial
  CRISPR gRNA sequence
tgttaggggatagattgcct

SEQ ID NO: 119403 - DNA, 20 bp, Artificial
  CRISPR gRNA sequence
gttaggggatagattgccta

SEQ ID NO: 119404 - DNA, 20 bp, Artificial
  CRISPR gRNA sequence
ttaggggatagattgcctag

SEQ ID NO: 119405 - DNA, 20 bp, Artificial
  CRISPR gRNA sequence
ggggatagattgcctaggtc

SEQ ID NO: 119406 - DNA, 20 bp, Artificial
  CRISPR gRNA sequence
cctaggtcttctgaattatt

SEQ ID NO: 119407 - DNA, 20 bp, Artificial
  CRISPR gRNA sequence
ggtcttctgaattatttttt

SEQ ID NO: 119408 - DNA, 20 bp, Artificial
  CRISPR gRNA sequence
ctgaattattttttccaaat

SEQ ID NO: 119409 - DNA, 20 bp, Artificial
  CRISPR gRNA sequence
tgaattattttttccaaata

SEQ ID NO: 119410 - DNA, 20 bp, Artificial
  CRISPR gRNA sequence
aattattttttccaaatact

SEQ ID NO: 119411 - DNA, 20 bp, Artificial
  CRISPR gRNA sequence
ttttttccaaatactcagct

SEQ ID NO: 119412 - DNA, 20 bp, Artificial
  CRISPR gRNA sequence
tttccaaatactcagctcat

SEQ ID NO: 119413 - DNA, 20 bp, Artificial
  CRISPR gRNA sequence
ttccaaatactcagctcata

SEQ ID NO: 119414 - DNA, 20 bp, Artificial
  CRISPR gRNA sequence
tccaaatactcagctcataa

SEQ ID NO: 119415 - DNA, 20 bp, Artificial
  CRISPR gRNA sequence
ccaaatactcagctcataat

SEQ ID NO: 119416 - DNA, 20 bp, Artificial
  CRISPR gRNA sequence
caaatactcagctcataatt

SEQ ID NO: 119417 - DNA, 20 bp, Artificial
  CRISPR gRNA sequence
agctcataattggcattcag

SEQ ID NO: 119418 - DNA, 20 bp, Artificial
  CRISPR gRNA sequence
ataattggcattcagaaagt

SEQ ID NO: 119419 - DNA, 20 bp, Artificial
  CRISPR gRNA sequence
gcattcagaaagtattggca

SEQ ID NO: 119420 - DNA, 20 bp, Artificial
  CRISPR gRNA sequence
agaaagtattggcaaataaa

SEQ ID NO: 119421 - DNA, 20 bp, Artificial
  CRISPR gRNA sequence
gcaaataaataagtaaacaa

SEQ ID NO: 119422 - DNA, 20 bp, Artificial
  CRISPR gRNA sequence
atctggttatgtgaaccaac

SEQ ID NO: 119423 - DNA, 20 bp, Artificial
  CRISPR gRNA sequence
tctggttatgtgaaccaact

SEQ ID NO: 119424 - DNA, 20 bp, Artificial
  CRISPR gRNA sequence
gttatgtgaaccaacttcat

SEQ ID NO: 119425 - DNA, 20 bp, Artificial
  CRISPR gRNA sequence
tgtgaaccaacttcatttct

SEQ ID NO: 119426 - DNA, 20 bp, Artificial
  CRISPR gRNA sequence
catttctaagtttatattgg

SEQ ID NO: 119427 - DNA, 20 bp, Artificial
  CRISPR gRNA sequence
atttctaagtttatattggc

SEQ ID NO: 119428 - DNA, 20 bp, Artificial
  CRISPR gRNA sequence
ctaagtttatattggctgtt

SEQ ID NO: 119429 - DNA, 20 bp, Artificial
  CRISPR gRNA sequence
taagtttatattggctgtta

SEQ ID NO: 119430 - DNA, 20 bp, Artificial
  CRISPR gRNA sequence
agtttatattggctgttagg

SEQ ID NO: 119431 - DNA, 20 bp, Artificial
  CRISPR gRNA sequence
atattggctgttaggatttc

SEQ ID NO: 119432 - DNA, 20 bp, Artificial
  CRISPR gRNA sequence
tattggctgttaggatttcc

SEQ ID NO: 119433 - DNA, 20 bp, Artificial
  CRISPR gRNA sequence
gctgttaggatttcctcttc

SEQ ID NO: 119434 - DNA, 20 bp, Artificial
  CRISPR gRNA sequence
ttaggatttcctcttccatc

SEQ ID NO: 119435 - DNA, 20 bp, Artificial
  CRISPR gRNA sequence
ggatttcctcttccatctat

SEQ ID NO: 119436 - DNA, 20 bp, Artificial
  CRISPR gRNA sequence
cctcttccatctattcatat

SEQ ID NO: 119437 - DNA, 20 bp, Artificial
  CRISPR gRNA sequence
ctcttccatctattcatatt

SEQ ID NO: 119438 - DNA, 20 bp, Artificial
  CRISPR gRNA sequence
ttccatctattcatattctt

SEQ ID NO: 119439 - DNA, 20 bp, Artificial
  CRISPR gRNA sequence
ccatctattcatattcttcg

SEQ ID NO: 119440 - DNA, 20 bp, Artificial
  CRISPR gRNA sequence
catctattcatattcttcgc

SEQ ID NO: 119441 - DNA, 20 bp, Artificial
  CRISPR gRNA sequence
ttcatattcttcgcccattt

SEQ ID NO: 119442 - DNA, 20 bp, Artificial
  CRISPR gRNA sequence
atattcttcgcccattttcc

SEQ ID NO: 119443 - DNA, 20 bp, Artificial
  CRISPR gRNA sequence
ttcgcccattttcctatttt

SEQ ID NO: 119444 - DNA, 20 bp, Artificial
  CRISPR gRNA sequence
cgcccattttcctatttttg

SEQ ID NO: 119445 - DNA, 20 bp, Artificial
  CRISPR gRNA sequence
gcccattttcctatttttgt

SEQ ID NO: 119446 - DNA, 20 bp, Artificial
  CRISPR gRNA sequence
tcctatttttgtataaatac

SEQ ID NO: 119447 - DNA, 20 bp, Artificial
  CRISPR gRNA sequence
cctatttttgtataaataca

SEQ ID NO: 119448 - DNA, 20 bp, Artificial
  CRISPR gRNA sequence
ctatttttgtataaatacat

SEQ ID NO: 119449 - DNA, 20 bp, Artificial
  CRISPR gRNA sequence
tttttgtataaatacataaa

SEQ ID NO: 119450 - DNA, 20 bp, Artificial
  CRISPR gRNA sequence
ttgtataaatacataaacgt

SEQ ID NO: 119451 - DNA, 20 bp, Artificial
  CRISPR gRNA sequence
tgtataaatacataaacgtt

SEQ ID NO: 119452 - DNA, 20 bp, Artificial
  CRISPR gRNA sequence
gtataaatacataaacgtta

SEQ ID NO: 119453 - DNA, 20 bp, Artificial
  CRISPR gRNA sequence
tataaatacataaacgttat

SEQ ID NO: 119454 - DNA, 20 bp, Artificial
  CRISPR gRNA sequence
tttatacatattctgaatac

SEQ ID NO: 119455 - DNA, 20 bp, Artificial
  CRISPR gRNA sequence
atacatattctgaatacaaa

SEQ ID NO: 119456 - DNA, 20 bp, Artificial
  CRISPR gRNA sequence
tacatattctgaatacaaac

SEQ ID NO: 119457 - DNA, 20 bp, Artificial
  CRISPR gRNA sequence
tgaatacaaactcggttgta

SEQ ID NO: 119458 - DNA, 20 bp, Artificial
  CRISPR gRNA sequence
aatacaaactcggttgtatg

SEQ ID NO: 119459 - DNA, 20 bp, Artificial
  CRISPR gRNA sequence
ggttgtatgtattaaaaata

SEQ ID NO: 119460 - DNA, 20 bp, Artificial
  CRISPR gRNA sequence
tatgtattaaaaatatcttt

SEQ ID NO: 119461 - DNA, 20 bp, Artificial
  CRISPR gRNA sequence
aaaatatcttttccaagttt

SEQ ID NO: 119462 - DNA, 20 bp, Artificial
  CRISPR gRNA sequence
ttccaagttttcaccttgtt

SEQ ID NO: 119463 - DNA, 20 bp, Artificial
  CRISPR gRNA sequence
tccaagttttcaccttgttt

SEQ ID NO: 119464 - DNA, 20 bp, Artificial
  CRISPR gRNA sequence
ccaagttttcaccttgttta

SEQ ID NO: 119465 - DNA, 20 bp, Artificial
  CRISPR gRNA sequence
caagttttcaccttgtttac

SEQ ID NO: 119466 - DNA, 20 bp, Artificial
  CRISPR gRNA sequence
tcaccttgtttacttttatt

SEQ ID NO: 119467 - DNA, 20 bp, Artificial
  CRISPR gRNA sequence
caccttgtttacttttattt

SEQ ID NO: 119468 - DNA, 20 bp, Artificial
  CRISPR gRNA sequence
accttgtttacttttatttg

SEQ ID NO: 119469 - DNA, 20 bp, Artificial
  CRISPR gRNA sequence
gtttacttttatttgatgta

SEQ ID NO: 119470 - DNA, 20 bp, Artificial
  CRISPR gRNA sequence
tttacttttatttgatgtat

SEQ ID NO: 119471 - DNA, 20 bp, Artificial
  CRISPR gRNA sequence
acttttatttgatgtatttc

SEQ ID NO: 119472 - DNA, 20 bp, Artificial
  CRISPR gRNA sequence
cttttatttgatgtatttca

SEQ ID NO: 119473 - DNA, 20 bp, Artificial
  CRISPR gRNA sequence
ttatttgatgtatttcaatg

SEQ ID NO: 119474 - DNA, 20 bp, Artificial
  CRISPR gRNA sequence
tatttgatgtatttcaatgc

SEQ ID NO: 119475 - DNA, 20 bp, Artificial
  CRISPR gRNA sequence
atttgatgtatttcaatgca

SEQ ID NO: 119476 - DNA, 20 bp, Artificial
  CRISPR gRNA sequence
tttgatgtatttcaatgcat

SEQ ID NO: 119477 - DNA, 20 bp, Artificial
  CRISPR gRNA sequence
gatgtatttcaatgcatatt

SEQ ID NO: 119478 - DNA, 20 bp, Artificial
  CRISPR gRNA sequence
atgtatttcaatgcatatta

SEQ ID NO: 119479 - DNA, 20 bp, Artificial
  CRISPR gRNA sequence
caatgcatattatgttttag

SEQ ID NO: 119480 - DNA, 20 bp, Artificial
  CRISPR gRNA sequence
aatgcatattatgttttagt

SEQ ID NO: 119481 - DNA, 20 bp, Artificial
  CRISPR gRNA sequence
tgttttagtcaatttgtttt

SEQ ID NO: 119482 - DNA, 20 bp, Artificial
  CRISPR gRNA sequence
tagtcaatttgtttttaaaa

SEQ ID NO: 119483 - DNA, 20 bp, Artificial
  CRISPR gRNA sequence
agtcaatttgtttttaaaaa

SEQ ID NO: 119484 - DNA, 20 bp, Artificial
  CRISPR gRNA sequence
gtcaatttgtttttaaaaat

SEQ ID NO: 119485 - DNA, 20 bp, Artificial
  CRISPR gRNA sequence
gtttttaaaaatatccttct

SEQ ID NO: 119486 - DNA, 20 bp, Artificial
  CRISPR gRNA sequence
tttttaaaaatatccttctc

SEQ ID NO: 119487 - DNA, 20 bp, Artificial
  CRISPR gRNA sequence
ttaaaaatatccttctctat

SEQ ID NO: 119488 - DNA, 20 bp, Artificial
  CRISPR gRNA sequence
taaaaatatccttctctata

SEQ ID NO: 119489 - DNA, 20 bp, Artificial
  CRISPR gRNA sequence
aaaaatatccttctctatag

SEQ ID NO: 119490 - DNA, 20 bp, Artificial
  CRISPR gRNA sequence
aaaatatccttctctatagc

SEQ ID NO: 119491 - DNA, 20 bp, Artificial
  CRISPR gRNA sequence
ctctatagcataaaaattct

SEQ ID NO: 119492 - DNA, 20 bp, Artificial
  CRISPR gRNA sequence
tctatagcataaaaattctt

SEQ ID NO: 119493 - DNA, 20 bp, Artificial
  CRISPR gRNA sequence
tatagcataaaaattcttat

SEQ ID NO: 119494 - DNA, 20 bp, Artificial
  CRISPR gRNA sequence
tagcataaaaattcttatat

SEQ ID NO: 119495 - DNA, 20 bp, Artificial
  CRISPR gRNA sequence
ttatattttcttttgaattt

SEQ ID NO: 119496 - DNA, 20 bp, Artificial
  CRISPR gRNA sequence
atattttcttttgaattttc

SEQ ID NO: 119497 - DNA, 20 bp, Artificial
  CRISPR gRNA sequence
tattttcttttgaattttcc

SEQ ID NO: 119498 - DNA, 20 bp, Artificial
  CRISPR gRNA sequence
tcttttgaattttccaagtt

SEQ ID NO: 119499 - DNA, 20 bp, Artificial
  CRISPR gRNA sequence
cttttgaattttccaagttt

SEQ ID NO: 119500 - DNA, 20 bp, Artificial
  CRISPR gRNA sequence
ttttgaattttccaagttta

SEQ ID NO: 119501 - DNA, 20 bp, Artificial
  CRISPR gRNA sequence
ttgaattttccaagtttact

SEQ ID NO: 119502 - DNA, 20 bp, Artificial
  CRISPR gRNA sequence
tgaattttccaagtttactt

SEQ ID NO: 119503 - DNA, 20 bp, Artificial
  CRISPR gRNA sequence
gaattttccaagtttacttt

SEQ ID NO: 119504 - DNA, 20 bp, Artificial
  CRISPR gRNA sequence
aattttccaagtttactttt

SEQ ID NO: 119505 - DNA, 20 bp, Artificial
  CRISPR gRNA sequence
tccaagtttacttttctaca

SEQ ID NO: 119506 - DNA, 20 bp, Artificial
  CRISPR gRNA sequence
ccaagtttacttttctacat

SEQ ID NO: 119507 - DNA, 20 bp, Artificial
  CRISPR gRNA sequence
caagtttacttttctacatt

SEQ ID NO: 119508 - DNA, 20 bp, Artificial
  CRISPR gRNA sequence
acttttctacatttagatct

SEQ ID NO: 119509 - DNA, 20 bp, Artificial
  CRISPR gRNA sequence
cttttctacatttagatctt

SEQ ID NO: 119510 - DNA, 20 bp, Artificial
  CRISPR gRNA sequence
ttctacatttagatctttaa

SEQ ID NO: 119511 - DNA, 20 bp, Artificial
  CRISPR gRNA sequence
tctacatttagatctttaat

SEQ ID NO: 119512 - DNA, 20 bp, Artificial
  CRISPR gRNA sequence
ctacatttagatctttaatc

SEQ ID NO: 119513 - DNA, 20 bp, Artificial
  CRISPR gRNA sequence
tacatttagatctttaatcc

SEQ ID NO: 119514 - DNA, 20 bp, Artificial
  CRISPR gRNA sequence
catttagatctttaatccac

SEQ ID NO: 119515 - DNA, 20 bp, Artificial
  CRISPR gRNA sequence
agatctttaatccacctagc

SEQ ID NO: 119516 - DNA, 20 bp, Artificial
  CRISPR gRNA sequence
gatctttaatccacctagca

SEQ ID NO: 119517 - DNA, 20 bp, Artificial
  CRISPR gRNA sequence
taatccacctagcaaatatt

SEQ ID NO: 119518 - DNA, 20 bp, Artificial
  CRISPR gRNA sequence
aatccacctagcaaatattt

SEQ ID NO: 119519 - DNA, 20 bp, Artificial
  CRISPR gRNA sequence
atccacctagcaaatatttt

SEQ ID NO: 119520 - DNA, 20 bp, Artificial
  CRISPR gRNA sequence
gcaaatattttttaaaatac

SEQ ID NO: 119521 - DNA, 20 bp, Artificial
  CRISPR gRNA sequence
tttaaaatacagtatgaatt

SEQ ID NO: 119522 - DNA, 20 bp, Artificial
  CRISPR gRNA sequence
ttaaaatacagtatgaatta

SEQ ID NO: 119523 - DNA, 20 bp, Artificial
  CRISPR gRNA sequence
taaaatacagtatgaattag

SEQ ID NO: 119524 - DNA, 20 bp, Artificial
  CRISPR gRNA sequence
aaaatacagtatgaattaga

SEQ ID NO: 119525 - DNA, 20 bp, Artificial
  CRISPR gRNA sequence
aaatacagtatgaattagaa

SEQ ID NO: 119526 - DNA, 20 bp, Artificial
  CRISPR gRNA sequence
gaaatcagtttcttttctgt

SEQ ID NO: 119527 - DNA, 20 bp, Artificial
  CRISPR gRNA sequence
cttttctgtatcattcttca

SEQ ID NO: 119528 - DNA, 20 bp, Artificial
  CRISPR gRNA sequence
ttttctgtatcattcttcag

SEQ ID NO: 119529 - DNA, 20 bp, Artificial
  CRISPR gRNA sequence
ttctgtatcattcttcagcc

SEQ ID NO: 119530 - DNA, 20 bp, Artificial
  CRISPR gRNA sequence
tctgtatcattcttcagcca

SEQ ID NO: 119531 - DNA, 20 bp, Artificial
  CRISPR gRNA sequence
ctgtatcattcttcagccat

SEQ ID NO: 119532 - DNA, 20 bp, Artificial
  CRISPR gRNA sequence
tgtatcattcttcagccatt

SEQ ID NO: 119533 - DNA, 20 bp, Artificial
  CRISPR gRNA sequence
tatcattcttcagccatttc

SEQ ID NO: 119534 - DNA, 20 bp, Artificial
  CRISPR gRNA sequence
ttcagccatttcttcattga

SEQ ID NO: 119535 - DNA, 20 bp, Artificial
  CRISPR gRNA sequence
cagccatttcttcattgata

SEQ ID NO: 119536 - DNA, 20 bp, Artificial
  CRISPR gRNA sequence
agccatttcttcattgatat

SEQ ID NO: 119537 - DNA, 20 bp, Artificial
  CRISPR gRNA sequence
cttcattgatatgtttatac

SEQ ID NO: 119538 - DNA, 20 bp, Artificial
  CRISPR gRNA sequence
ttcattgatatgtttatacc

SEQ ID NO: 119539 - DNA, 20 bp, Artificial
  CRISPR gRNA sequence
cattgatatgtttataccac

SEQ ID NO: 119540 - DNA, 20 bp, Artificial
  CRISPR gRNA sequence
attgatatgtttataccact

SEQ ID NO: 119541 - DNA, 20 bp, Artificial
  CRISPR gRNA sequence
atatgtttataccactttta

SEQ ID NO: 119542 - DNA, 20 bp, Artificial
  CRISPR gRNA sequence
ataccacttttattatatgc

SEQ ID NO: 119543 - DNA, 20 bp, Artificial
  CRISPR gRNA sequence
taccacttttattatatgcc

SEQ ID NO: 119544 - DNA, 20 bp, Artificial
  CRISPR gRNA sequence
ttattatatgccaacttcca

SEQ ID NO: 119545 - DNA, 20 bp, Artificial
  CRISPR gRNA sequence
tattatatgccaacttccaa

SEQ ID NO: 119546 - DNA, 20 bp, Artificial
  CRISPR gRNA sequence
attatatgccaacttccaat

SEQ ID NO: 119547 - DNA, 20 bp, Artificial
  CRISPR gRNA sequence
ttatatgccaacttccaata

SEQ ID NO: 119548 - DNA, 20 bp, Artificial
  CRISPR gRNA sequence
tatgccaacttccaatattc

SEQ ID NO: 119549 - DNA, 20 bp, Artificial
  CRISPR gRNA sequence
ccaatattcttctatctatt

SEQ ID NO: 119550 - DNA, 20 bp, Artificial
  CRISPR gRNA sequence
caatattcttctatctattt

SEQ ID NO: 119551 - DNA, 20 bp, Artificial
  CRISPR gRNA sequence
ttctatctatttcttggctg

SEQ ID NO: 119552 - DNA, 20 bp, Artificial
  CRISPR gRNA sequence
ctatctatttcttggctgtc

SEQ ID NO: 119553 - DNA, 20 bp, Artificial
  CRISPR gRNA sequence
tatctatttcttggctgtct

SEQ ID NO: 119554 - DNA, 20 bp, Artificial
  CRISPR gRNA sequence
tctatttcttggctgtctct

SEQ ID NO: 119555 - DNA, 20 bp, Artificial
  CRISPR gRNA sequence
tttcttggctgtctctctgg

SEQ ID NO: 119556 - DNA, 20 bp, Artificial
  CRISPR gRNA sequence
cttggctgtctctctggttc

SEQ ID NO: 119557 - DNA, 20 bp, Artificial
  CRISPR gRNA sequence
ttggctgtctctctggttcc

SEQ ID NO: 119558 - DNA, 20 bp, Artificial
  CRISPR gRNA sequence
ggctgtctctctggttccag

SEQ ID NO: 119559 - DNA, 20 bp, Artificial
  CRISPR gRNA sequence
gctgtctctctggttccagt

SEQ ID NO: 119560 - DNA, 20 bp, Artificial
  CRISPR gRNA sequence
tctctctggttccagtatct

SEQ ID NO: 119561 - DNA, 20 bp, Artificial
  CRISPR gRNA sequence
tctggttccagtatctttct

SEQ ID NO: 119562 - DNA, 20 bp, Artificial
  CRISPR gRNA sequence
tggttccagtatctttctca

SEQ ID NO: 119563 - DNA, 20 bp, Artificial
  CRISPR gRNA sequence
gttccagtatctttctcagg

SEQ ID NO: 119564 - DNA, 20 bp, Artificial
  CRISPR gRNA sequence
cagtatctttctcaggccaa

SEQ ID NO: 119565 - DNA, 20 bp, Artificial
  CRISPR gRNA sequence
tctcaggccaaggattttaa

SEQ ID NO: 119566 - DNA, 20 bp, Artificial
  CRISPR gRNA sequence
ctcaggccaaggattttaat

SEQ ID NO: 119567 - DNA, 20 bp, Artificial
  CRISPR gRNA sequence
tcaggccaaggattttaatc

SEQ ID NO: 119568 - DNA, 20 bp, Artificial
  CRISPR gRNA sequence
aggccaaggattttaatcta

SEQ ID NO: 119569 - DNA, 20 bp, Artificial
  CRISPR gRNA sequence
taatctaaaattatatgcag

SEQ ID NO: 119570 - DNA, 20 bp, Artificial
  CRISPR gRNA sequence
aatctaaaattatatgcaga

SEQ ID NO: 119571 - DNA, 20 bp, Artificial
  CRISPR gRNA sequence
atctaaaattatatgcagaa

SEQ ID NO: 119572 - DNA, 20 bp, Artificial
  CRISPR gRNA sequence
aaattatatgcagaattttt

SEQ ID NO: 119573 - DNA, 20 bp, Artificial
  CRISPR gRNA sequence
tatgcagaatttttcatgag

SEQ ID NO: 119574 - DNA, 20 bp, Artificial
  CRISPR gRNA sequence
ttcatgagactggacatctc

SEQ ID NO: 119575 - DNA, 20 bp, Artificial
  CRISPR gRNA sequence
tcatgagactggacatctct

SEQ ID NO: 119576 - DNA, 20 bp, Artificial
  CRISPR gRNA sequence
catgagactggacatctcta

SEQ ID NO: 119577 - DNA, 20 bp, Artificial
  CRISPR gRNA sequence
atgagactggacatctctac

SEQ ID NO: 119578 - DNA, 20 bp, Artificial
  CRISPR gRNA sequence
gacatctctactttttctta

SEQ ID NO: 119579 - DNA, 20 bp, Artificial
  CRISPR gRNA sequence
tactttttcttagagggtgc

SEQ ID NO: 119580 - DNA, 20 bp, Artificial
  CRISPR gRNA sequence
ctttttcttagagggtgcaa

SEQ ID NO: 119581 - DNA, 20 bp, Artificial
  CRISPR gRNA sequence
tttcttagagggtgcaagct

SEQ ID NO: 119582 - DNA, 20 bp, Artificial
  CRISPR gRNA sequence
ttcttagagggtgcaagctt

SEQ ID NO: 119583 - DNA, 20 bp, Artificial
  CRISPR gRNA sequence
tcttagagggtgcaagcttt

SEQ ID NO: 119584 - DNA, 20 bp, Artificial
  CRISPR gRNA sequence
cttagagggtgcaagcttta

SEQ ID NO: 119585 - DNA, 20 bp, Artificial
  CRISPR gRNA sequence
ttagagggtgcaagctttac

SEQ ID NO: 119586 - DNA, 20 bp, Artificial
  CRISPR gRNA sequence
agagggtgcaagctttacta

SEQ ID NO: 119587 - DNA, 20 bp, Artificial
  CRISPR gRNA sequence
gagggtgcaagctttactag

SEQ ID NO: 119588 - DNA, 20 bp, Artificial
  CRISPR gRNA sequence
tactaggattctaaaataga

SEQ ID NO: 119589 - DNA, 20 bp, Artificial
  CRISPR gRNA sequence
actaggattctaaaatagag

SEQ ID NO: 119590 - DNA, 20 bp, Artificial
  CRISPR gRNA sequence
ctaggattctaaaatagaga

SEQ ID NO: 119591 - DNA, 20 bp, Artificial
  CRISPR gRNA sequence
ggattctaaaatagagaata

SEQ ID NO: 119592 - DNA, 20 bp, Artificial
  CRISPR gRNA sequence
taaaatagagaatacaattc

SEQ ID NO: 119593 - DNA, 20 bp, Artificial
  CRISPR gRNA sequence
aaatagagaatacaattcaa

SEQ ID NO: 119594 - DNA, 20 bp, Artificial
  CRISPR gRNA sequence
aaaaaaggttaagaagtagt

SEQ ID NO: 119595 - DNA, 20 bp, Artificial
  CRISPR gRNA sequence
agaagtagtcttctttaaaa

SEQ ID NO: 119596 - DNA, 20 bp, Artificial
  CRISPR gRNA sequence
ctttaaaaaatggctactca

SEQ ID NO: 119597 - DNA, 20 bp, Artificial
  CRISPR gRNA sequence
tttaaaaaatggctactcaa

SEQ ID NO: 119598 - DNA, 20 bp, Artificial
  CRISPR gRNA sequence
taaaaaatggctactcaaca

SEQ ID NO: 119599 - DNA, 20 bp, Artificial
  CRISPR gRNA sequence
aaaaaatggctactcaacac

SEQ ID NO: 119600 - DNA, 20 bp, Artificial
  CRISPR gRNA sequence
aaaaatggctactcaacact

SEQ ID NO: 119601 - DNA, 20 bp, Artificial
  CRISPR gRNA sequence
ctcaacactaatgagaaaaa

SEQ ID NO: 119602 - DNA, 20 bp, Artificial
  CRISPR gRNA sequence
aacactaatgagaaaaaaaa

SEQ ID NO: 119603 - DNA, 20 bp, Artificial
  CRISPR gRNA sequence
atgagaaaaaaaactcctat

SEQ ID NO: 119604 - DNA, 20 bp, Artificial
  CRISPR gRNA sequence
ctatacaaaggggattaaag

SEQ ID NO: 119605 - DNA, 20 bp, Artificial
  CRISPR gRNA sequence
tacaaaggggattaaagcct

SEQ ID NO: 119606 - DNA, 20 bp, Artificial
  CRISPR gRNA sequence
aagccttaagtattgtaagg

SEQ ID NO: 119607 - DNA, 20 bp, Artificial
  CRISPR gRNA sequence
aagtattgtaagggaggcta

SEQ ID NO: 119608 - DNA, 20 bp, Artificial
  CRISPR gRNA sequence
agtattgtaagggaggctat

SEQ ID NO: 119609 - DNA, 20 bp, Artificial
  CRISPR gRNA sequence
taagggaggctatggaatct

SEQ ID NO: 119610 - DNA, 20 bp, Artificial
  CRISPR gRNA sequence
tggaatctcacctagagagc

SEQ ID NO: 119611 - DNA, 20 bp, Artificial
  CRISPR gRNA sequence
acctagagagctttatttac

SEQ ID NO: 119612 - DNA, 20 bp, Artificial
  CRISPR gRNA sequence
gagagctttatttacgtaac

SEQ ID NO: 119613 - DNA, 20 bp, Artificial
  CRISPR gRNA sequence
tatttacgtaacagaatata

SEQ ID NO: 119614 - DNA, 20 bp, Artificial
  CRISPR gRNA sequence
atttacgtaacagaatatat

SEQ ID NO: 119615 - DNA, 20 bp, Artificial
  CRISPR gRNA sequence
tttacgtaacagaatatatt

SEQ ID NO: 119616 - DNA, 20 bp, Artificial
  CRISPR gRNA sequence
acgtaacagaatatattttt

SEQ ID NO: 119617 - DNA, 20 bp, Artificial
  CRISPR gRNA sequence
cgtaacagaatatatttttt

SEQ ID NO: 119618 - DNA, 20 bp, Artificial
  CRISPR gRNA sequence
ttttcagcttggttagttat

SEQ ID NO: 119619 - DNA, 20 bp, Artificial
  CRISPR gRNA sequence
tttcagcttggttagttata

SEQ ID NO: 119620 - DNA, 20 bp, Artificial
  CRISPR gRNA sequence
ttcagcttggttagttatag

SEQ ID NO: 119621 - DNA, 20 bp, Artificial
  CRISPR gRNA sequence
tcagcttggttagttatagc

SEQ ID NO: 119622 - DNA, 20 bp, Artificial
  CRISPR gRNA sequence
cagcttggttagttatagcc

SEQ ID NO: 119623 - DNA, 20 bp, Artificial
  CRISPR gRNA sequence
agcttggttagttatagccc

SEQ ID NO: 119624 - DNA, 20 bp, Artificial
  CRISPR gRNA sequence
ggttagttatagccctactt

SEQ ID NO: 119625 - DNA, 20 bp, Artificial
  CRISPR gRNA sequence
gttagttatagccctacttg

SEQ ID NO: 119626 - DNA, 20 bp, Artificial
  CRISPR gRNA sequence
gttatagccctacttggaag

SEQ ID NO: 119627 - DNA, 20 bp, Artificial
  CRISPR gRNA sequence
tagccctacttggaagcagg

SEQ ID NO: 119628 - DNA, 20 bp, Artificial
  CRISPR gRNA sequence
cttggaagcagggaaataac

SEQ ID NO: 119629 - DNA, 20 bp, Artificial
  CRISPR gRNA sequence
ggaagcagggaaataactat

SEQ ID NO: 119630 - DNA, 20 bp, Artificial
  CRISPR gRNA sequence
gaagcagggaaataactatt

SEQ ID NO: 119631 - DNA, 20 bp, Artificial
  CRISPR gRNA sequence
tttgaaggttccttatagca

SEQ ID NO: 119632 - DNA, 20 bp, Artificial
  CRISPR gRNA sequence
gaaggttccttatagcaaaa

SEQ ID NO: 119633 - DNA, 20 bp, Artificial
  CRISPR gRNA sequence
aaggttccttatagcaaaat

SEQ ID NO: 119634 - DNA, 20 bp, Artificial
  CRISPR gRNA sequence
cttatagcaaaataaaaccc

SEQ ID NO: 119635 - DNA, 20 bp, Artificial
  CRISPR gRNA sequence
atagcaaaataaaaccccat

SEQ ID NO: 119636 - DNA, 20 bp, Artificial
  CRISPR gRNA sequence
tagcaaaataaaaccccata

SEQ ID NO: 119637 - DNA, 20 bp, Artificial
  CRISPR gRNA sequence
agagctagaatgaaccctag

SEQ ID NO: 119638 - DNA, 20 bp, Artificial
  CRISPR gRNA sequence
gagctagaatgaaccctaga

SEQ ID NO: 119639 - DNA, 20 bp, Artificial
  CRISPR gRNA sequence
gaatgaaccctagatatcat

SEQ ID NO: 119640 - DNA, 20 bp, Artificial
  CRISPR gRNA sequence
gatatcatctcatataaatt

SEQ ID NO: 119641 - DNA, 20 bp, Artificial
  CRISPR gRNA sequence
atataaattttatttttgga

SEQ ID NO: 119642 - DNA, 20 bp, Artificial
  CRISPR gRNA sequence
tatttttggatgagcaaacc

SEQ ID NO: 119643 - DNA, 20 bp, Artificial
  CRISPR gRNA sequence
atttttggatgagcaaaccg

SEQ ID NO: 119644 - DNA, 20 bp, Artificial
  CRISPR gRNA sequence
tttttggatgagcaaaccga

SEQ ID NO: 119645 - DNA, 20 bp, Artificial
  CRISPR gRNA sequence
ttggatgagcaaaccgacaa

SEQ ID NO: 119646 - DNA, 20 bp, Artificial
  CRISPR gRNA sequence
tggatgagcaaaccgacaat

SEQ ID NO: 119647 - DNA, 20 bp, Artificial
  CRISPR gRNA sequence
ggatgagcaaaccgacaatt

SEQ ID NO: 119648 - DNA, 20 bp, Artificial
  CRISPR gRNA sequence
gatgagcaaaccgacaatta

SEQ ID NO: 119649 - DNA, 20 bp, Artificial
  CRISPR gRNA sequence
aataacttggccaagatcag

SEQ ID NO: 119650 - DNA, 20 bp, Artificial
  CRISPR gRNA sequence
ggccaagatcagaatgctta

SEQ ID NO: 119651 - DNA, 20 bp, Artificial
  CRISPR gRNA sequence
gccaagatcagaatgcttat

SEQ ID NO: 119652 - DNA, 20 bp, Artificial
  CRISPR gRNA sequence
atttaatggcagacctggta

SEQ ID NO: 119653 - DNA, 20 bp, Artificial
  CRISPR gRNA sequence
tttaatggcagacctggtaa

SEQ ID NO: 119654 - DNA, 20 bp, Artificial
  CRISPR gRNA sequence
aatggcagacctggtaatga

SEQ ID NO: 119655 - DNA, 20 bp, Artificial
  CRISPR gRNA sequence
atggcagacctggtaatgaa

SEQ ID NO: 119656 - DNA, 20 bp, Artificial
  CRISPR gRNA sequence
gtaatgaaagcttggaccac

SEQ ID NO: 119657 - DNA, 20 bp, Artificial
  CRISPR gRNA sequence
ggaccactacactcacagta

SEQ ID NO: 119658 - DNA, 20 bp, Artificial
  CRISPR gRNA sequence
gaccactacactcacagtat

SEQ ID NO: 119659 - DNA, 20 bp, Artificial
  CRISPR gRNA sequence
cactcacagtatactgttcc

SEQ ID NO: 119660 - DNA, 20 bp, Artificial
  CRISPR gRNA sequence
acagtatactgttcctaact

SEQ ID NO: 119661 - DNA, 20 bp, Artificial
  CRISPR gRNA sequence
ttcctaactataccacattg

SEQ ID NO: 119662 - DNA, 20 bp, Artificial
  CRISPR gRNA sequence
ctaactataccacattgtct

SEQ ID NO: 119663 - DNA, 20 bp, Artificial
  CRISPR gRNA sequence
actataccacattgtctcta

SEQ ID NO: 119664 - DNA, 20 bp, Artificial
  CRISPR gRNA sequence
taccacattgtctctactca

SEQ ID NO: 119665 - DNA, 20 bp, Artificial
  CRISPR gRNA sequence
tctctactcaacagtggaga

SEQ ID NO: 119666 - DNA, 20 bp, Artificial
  CRISPR gRNA sequence
tactcaacagtggagaaggc

SEQ ID NO: 119667 - DNA, 20 bp, Artificial
  CRISPR gRNA sequence
ctcaacagtggagaaggcgc

SEQ ID NO: 119668 - DNA, 20 bp, Artificial
  CRISPR gRNA sequence
aacagtggagaaggcgcagc

SEQ ID NO: 119669 - DNA, 20 bp, Artificial
  CRISPR gRNA sequence
gagaggaagcaaagagagaa

SEQ ID NO: 119670 - DNA, 20 bp, Artificial
  CRISPR gRNA sequence
aaaagatatttaaagcctca

SEQ ID NO: 119671 - DNA, 20 bp, Artificial
  CRISPR gRNA sequence
aaagcctcatatatttatgc

SEQ ID NO: 119672 - DNA, 20 bp, Artificial
  CRISPR gRNA sequence
aagcctcatatatttatgca

SEQ ID NO: 119673 - DNA, 20 bp, Artificial
  CRISPR gRNA sequence
atatatttatgcaaagagaa

SEQ ID NO: 119674 - DNA, 20 bp, Artificial
  CRISPR gRNA sequence
atgcaaagagaaatgtgaaa

SEQ ID NO: 119675 - DNA, 20 bp, Artificial
  CRISPR gRNA sequence
tgcaaagagaaatgtgaaaa

SEQ ID NO: 119676 - DNA, 20 bp, Artificial
  CRISPR gRNA sequence
tttttaatcccaagtacaat

SEQ ID NO: 119677 - DNA, 20 bp, Artificial
  CRISPR gRNA sequence
ttaatcccaagtacaattct

SEQ ID NO: 119678 - DNA, 20 bp, Artificial
  CRISPR gRNA sequence
taatcccaagtacaattcta

SEQ ID NO: 119679 - DNA, 20 bp, Artificial
  CRISPR gRNA sequence
aatcccaagtacaattctat

SEQ ID NO: 119680 - DNA, 20 bp, Artificial
  CRISPR gRNA sequence
atcccaagtacaattctatc

SEQ ID NO: 119681 - DNA, 20 bp, Artificial
  CRISPR gRNA sequence
tatcttggcaaaaatatgcc

SEQ ID NO: 119682 - DNA, 20 bp, Artificial
  CRISPR gRNA sequence
tcttggcaaaaatatgccag

SEQ ID NO: 119683 - DNA, 20 bp, Artificial
  CRISPR gRNA sequence
ggcaaaaatatgccagtggg

SEQ ID NO: 119684 - DNA, 20 bp, Artificial
  CRISPR gRNA sequence
gcaaaaatatgccagtgggc

SEQ ID NO: 119685 - DNA, 20 bp, Artificial
  CRISPR gRNA sequence
aaatatactcttacccttta

SEQ ID NO: 119686 - DNA, 20 bp, Artificial
  CRISPR gRNA sequence
ttaccctttacccaagcaat

SEQ ID NO: 119687 - DNA, 20 bp, Artificial
  CRISPR gRNA sequence
accctttacccaagcaatcc

SEQ ID NO: 119688 - DNA, 20 bp, Artificial
  CRISPR gRNA sequence
ccctttacccaagcaatccc

SEQ ID NO: 119689 - DNA, 20 bp, Artificial
  CRISPR gRNA sequence
tacccaagcaatccccaatc

SEQ ID NO: 119690 - DNA, 20 bp, Artificial
  CRISPR gRNA sequence
acccaagcaatccccaatcc

SEQ ID NO: 119691 - DNA, 20 bp, Artificial
  CRISPR gRNA sequence
cccaagcaatccccaatcca

SEQ ID NO: 119692 - DNA, 20 bp, Artificial
  CRISPR gRNA sequence
tcctgagaattcagttgaaa

SEQ ID NO: 119693 - DNA, 20 bp, Artificial
  CRISPR gRNA sequence
agaattcagttgaaaaataa

SEQ ID NO: 119694 - DNA, 20 bp, Artificial
  CRISPR gRNA sequence
agttgaaaaataaaactatc

SEQ ID NO: 119695 - DNA, 20 bp, Artificial
  CRISPR gRNA sequence
aaaaataaaactatcgtgcc

SEQ ID NO: 119696 - DNA, 20 bp, Artificial
  CRISPR gRNA sequence
tcgtgcccaaatgtttacct

SEQ ID NO: 119697 - DNA, 20 bp, Artificial
  CRISPR gRNA sequence
acctacaaaggcaaatgaaa

SEQ ID NO: 119698 - DNA, 20 bp, Artificial
  CRISPR gRNA sequence
cctacaaaggcaaatgaaaa

SEQ ID NO: 119699 - DNA, 20 bp, Artificial
  CRISPR gRNA sequence
caaaggcaaatgaaaaccaa

SEQ ID NO: 119700 - DNA, 20 bp, Artificial
  CRISPR gRNA sequence
aactatattttataaattag

SEQ ID NO: 119701 - DNA, 20 bp, Artificial
  CRISPR gRNA sequence
actatattttataaattaga

SEQ ID NO: 119702 - DNA, 20 bp, Artificial
  CRISPR gRNA sequence
tattttataaattagaaatt

SEQ ID NO: 119703 - DNA, 20 bp, Artificial
  CRISPR gRNA sequence
tataaattagaaattctgat

SEQ ID NO: 119704 - DNA, 20 bp, Artificial
  CRISPR gRNA sequence
ataaattagaaattctgatt

SEQ ID NO: 119705 - DNA, 20 bp, Artificial
  CRISPR gRNA sequence
taaattagaaattctgattc

SEQ ID NO: 119706 - DNA, 20 bp, Artificial
  CRISPR gRNA sequence
gaaattctgattcatcaagt

SEQ ID NO: 119707 - DNA, 20 bp, Artificial
  CRISPR gRNA sequence
tgattcatcaagttgactga

SEQ ID NO: 119708 - DNA, 20 bp, Artificial
  CRISPR gRNA sequence
attcatcaagttgactgaac

SEQ ID NO: 119709 - DNA, 20 bp, Artificial
  CRISPR gRNA sequence
atcaagttgactgaacatta

SEQ ID NO: 119710 - DNA, 20 bp, Artificial
  CRISPR gRNA sequence
actgaacattatgaaagaat

SEQ ID NO: 119711 - DNA, 20 bp, Artificial
  CRISPR gRNA sequence
aacattatgaaagaattaaa

SEQ ID NO: 119712 - DNA, 20 bp, Artificial
  CRISPR gRNA sequence
tgaaagaattaaaaaaaaaa

SEQ ID NO: 119713 - DNA, 20 bp, Artificial
  CRISPR gRNA sequence
aaaaaaaaaaatgaaaacac

SEQ ID NO: 119714 - DNA, 20 bp, Artificial
  CRISPR gRNA sequence
tgcccaaaaattatgcataa

SEQ ID NO: 119715 - DNA, 20 bp, Artificial
  CRISPR gRNA sequence
tgcataaaaacacaaaagaa

SEQ ID NO: 119716 - DNA, 20 bp, Artificial
  CRISPR gRNA sequence
gatttatgagcagtgggatc

SEQ ID NO: 119717 - DNA, 20 bp, Artificial
  CRISPR gRNA sequence
atttatgagcagtgggatca

SEQ ID NO: 119718 - DNA, 20 bp, Artificial
  CRISPR gRNA sequence
atgagcagtgggatcatggc

SEQ ID NO: 119719 - DNA, 20 bp, Artificial
  CRISPR gRNA sequence
tgagcagtgggatcatggct

SEQ ID NO: 119720 - DNA, 20 bp, Artificial
  CRISPR gRNA sequence
cttttttcaacttaaattcc

SEQ ID NO: 119721 - DNA, 20 bp, Artificial
  CRISPR gRNA sequence
ttttcaacttaaattcctcc

SEQ ID NO: 119722 - DNA, 20 bp, Artificial
  CRISPR gRNA sequence
tttcaacttaaattcctcca

SEQ ID NO: 119723 - DNA, 20 bp, Artificial
  CRISPR gRNA sequence
ttcaacttaaattcctccag

SEQ ID NO: 119724 - DNA, 20 bp, Artificial
  CRISPR gRNA sequence
tcaacttaaattcctccaga

SEQ ID NO: 119725 - DNA, 20 bp, Artificial
  CRISPR gRNA sequence
caacttaaattcctccagaa

SEQ ID NO: 119726 - DNA, 20 bp, Artificial
  CRISPR gRNA sequence
aacttaaattcctccagaaa

SEQ ID NO: 119727 - DNA, 20 bp, Artificial
  CRISPR gRNA sequence
aaattcctccagaaaactaa

SEQ ID NO: 119728 - DNA, 20 bp, Artificial
  CRISPR gRNA sequence
aattcctccagaaaactaag

SEQ ID NO: 119729 - DNA, 20 bp, Artificial
  CRISPR gRNA sequence
ctccagaaaactaagacatt

SEQ ID NO: 119730 - DNA, 20 bp, Artificial
  CRISPR gRNA sequence
cagaaaactaagacattaat

SEQ ID NO: 119731 - DNA, 20 bp, Artificial
  CRISPR gRNA sequence
agacattaatatgactgctg

SEQ ID NO: 119732 - DNA, 20 bp, Artificial
  CRISPR gRNA sequence
atatgactgctgtaactgtt

SEQ ID NO: 119733 - DNA, 20 bp, Artificial
  CRISPR gRNA sequence
ctgtaactgttgaaacaata

SEQ ID NO: 119734 - DNA, 20 bp, Artificial
  CRISPR gRNA sequence
taactgttgaaacaatataa

SEQ ID NO: 119735 - DNA, 20 bp, Artificial
  CRISPR gRNA sequence
ttgaaacaatataaacattt

SEQ ID NO: 119736 - DNA, 20 bp, Artificial
  CRISPR gRNA sequence
aaacaatataaacatttaga

SEQ ID NO: 119737 - DNA, 20 bp, Artificial
  CRISPR gRNA sequence
agatagagtaactaatagtt

SEQ ID NO: 119738 - DNA, 20 bp, Artificial
  CRISPR gRNA sequence
gatagagtaactaatagtta

SEQ ID NO: 119739 - DNA, 20 bp, Artificial
  CRISPR gRNA sequence
atagttatctcatactctct

SEQ ID NO: 119740 - DNA, 20 bp, Artificial
  CRISPR gRNA sequence
tctcatactctcttttccat

SEQ ID NO: 119741 - DNA, 20 bp, Artificial
  CRISPR gRNA sequence
atactctcttttccatgact

SEQ ID NO: 119742 - DNA, 20 bp, Artificial
  CRISPR gRNA sequence
tcttttccatgactataaac

SEQ ID NO: 119743 - DNA, 20 bp, Artificial
  CRISPR gRNA sequence
ttttccatgactataaacat

SEQ ID NO: 119744 - DNA, 20 bp, Artificial
  CRISPR gRNA sequence
ttccatgactataaacatat

SEQ ID NO: 119745 - DNA, 20 bp, Artificial
  CRISPR gRNA sequence
tccatgactataaacatata

SEQ ID NO: 119746 - DNA, 20 bp, Artificial
  CRISPR gRNA sequence
ccatgactataaacatatac

SEQ ID NO: 119747 - DNA, 20 bp, Artificial
  CRISPR gRNA sequence
catgactataaacatatact

SEQ ID NO: 119748 - DNA, 20 bp, Artificial
  CRISPR gRNA sequence
taaacatatactcatggggg

SEQ ID NO: 119749 - DNA, 20 bp, Artificial
  CRISPR gRNA sequence
atggggggttggttatgaat

SEQ ID NO: 119750 - DNA, 20 bp, Artificial
  CRISPR gRNA sequence
gttatgaattacaaagatga

SEQ ID NO: 119751 - DNA, 20 bp, Artificial
  CRISPR gRNA sequence
tgaattacaaagatgagatc

SEQ ID NO: 119752 - DNA, 20 bp, Artificial
  CRISPR gRNA sequence
caaagatgagatcacacact

SEQ ID NO: 119753 - DNA, 20 bp, Artificial
  CRISPR gRNA sequence
tttctctgcaaattatttcc

SEQ ID NO: 119754 - DNA, 20 bp, Artificial
  CRISPR gRNA sequence
ctctgcaaattatttccact

SEQ ID NO: 119755 - DNA, 20 bp, Artificial
  CRISPR gRNA sequence
tctgcaaattatttccacta

SEQ ID NO: 119756 - DNA, 20 bp, Artificial
  CRISPR gRNA sequence
tgcaaattatttccactaaa

SEQ ID NO: 119757 - DNA, 20 bp, Artificial
  CRISPR gRNA sequence
caaattatttccactaaaaa

SEQ ID NO: 119758 - DNA, 20 bp, Artificial
  CRISPR gRNA sequence
tttccactaaaaatatttca

SEQ ID NO: 119759 - DNA, 20 bp, Artificial
  CRISPR gRNA sequence
ccactaaaaatatttcaata

SEQ ID NO: 119760 - DNA, 20 bp, Artificial
  CRISPR gRNA sequence
cactaaaaatatttcaatat

SEQ ID NO: 119761 - DNA, 20 bp, Artificial
  CRISPR gRNA sequence
aaaatatttcaatattaacc

SEQ ID NO: 119762 - DNA, 20 bp, Artificial
  CRISPR gRNA sequence
caatattaacccaccccaag

SEQ ID NO: 119763 - DNA, 20 bp, Artificial
  CRISPR gRNA sequence
aatattaacccaccccaagt

SEQ ID NO: 119764 - DNA, 20 bp, Artificial
  CRISPR gRNA sequence
acccaccccaagtcaacagt

SEQ ID NO: 119765 - DNA, 20 bp, Artificial
  CRISPR gRNA sequence
atttcttttaatgatgatgc

SEQ ID NO: 119766 - DNA, 20 bp, Artificial
  CRISPR gRNA sequence
cttttaatgatgatgcaata

SEQ ID NO: 119767 - DNA, 20 bp, Artificial
  CRISPR gRNA sequence
ttttaatgatgatgcaatat

SEQ ID NO: 119768 - DNA, 20 bp, Artificial
  CRISPR gRNA sequence
ttaatgatgatgcaatattc

SEQ ID NO: 119769 - DNA, 20 bp, Artificial
  CRISPR gRNA sequence
taatgatgatgcaatattcc

SEQ ID NO: 119770 - DNA, 20 bp, Artificial
  CRISPR gRNA sequence
aatgatgatgcaatattccc

SEQ ID NO: 119771 - DNA, 20 bp, Artificial
  CRISPR gRNA sequence
atgatgatgcaatattccct

SEQ ID NO: 119772 - DNA, 20 bp, Artificial
  CRISPR gRNA sequence
cctatgaatatattatgatt

SEQ ID NO: 119773 - DNA, 20 bp, Artificial
  CRISPR gRNA sequence
tgaatatattatgatttatt

SEQ ID NO: 119774 - DNA, 20 bp, Artificial
  CRISPR gRNA sequence
tgatttattccaaccatttc

SEQ ID NO: 119775 - DNA, 20 bp, Artificial
  CRISPR gRNA sequence
attccaaccatttccttatt

SEQ ID NO: 119776 - DNA, 20 bp, Artificial
  CRISPR gRNA sequence
ttccaaccatttccttattc

SEQ ID NO: 119777 - DNA, 20 bp, Artificial
  CRISPR gRNA sequence
caaccatttccttattctta

SEQ ID NO: 119778 - DNA, 20 bp, Artificial
  CRISPR gRNA sequence
ccttattcttattaatggac

SEQ ID NO: 119779 - DNA, 20 bp, Artificial
  CRISPR gRNA sequence
cttattcttattaatggaca

SEQ ID NO: 119780 - DNA, 20 bp, Artificial
  CRISPR gRNA sequence
attcttattaatggacactc

SEQ ID NO: 119781 - DNA, 20 bp, Artificial
  CRISPR gRNA sequence
ttcttattaatggacactca

SEQ ID NO: 119782 - DNA, 20 bp, Artificial
  CRISPR gRNA sequence
ttattaatggacactcagat

SEQ ID NO: 119783 - DNA, 20 bp, Artificial
  CRISPR gRNA sequence
attaatggacactcagattg

SEQ ID NO: 119784 - DNA, 20 bp, Artificial
  CRISPR gRNA sequence
ttaatggacactcagattgc

SEQ ID NO: 119785 - DNA, 20 bp, Artificial
  CRISPR gRNA sequence
atggacactcagattgcaat

SEQ ID NO: 119786 - DNA, 20 bp, Artificial
  CRISPR gRNA sequence
agattgcaattttatttttt

SEQ ID NO: 119787 - DNA, 20 bp, Artificial
  CRISPR gRNA sequence
caattttattttttgctagt

SEQ ID NO: 119788 - DNA, 20 bp, Artificial
  CRISPR gRNA sequence
tattttttgctagtacaatg

SEQ ID NO: 119789 - DNA, 20 bp, Artificial
  CRISPR gRNA sequence
attttttgctagtacaatgc

SEQ ID NO: 119790 - DNA, 20 bp, Artificial
  CRISPR gRNA sequence
ttttttgctagtacaatgct

SEQ ID NO: 119791 - DNA, 20 bp, Artificial
  CRISPR gRNA sequence
tttgctagtacaatgctatg

SEQ ID NO: 119792 - DNA, 20 bp, Artificial
  CRISPR gRNA sequence
ttgctagtacaatgctatga

SEQ ID NO: 119793 - DNA, 20 bp, Artificial
  CRISPR gRNA sequence
tgctagtacaatgctatgaa

SEQ ID NO: 119794 - DNA, 20 bp, Artificial
  CRISPR gRNA sequence
gctagtacaatgctatgaaa

SEQ ID NO: 119795 - DNA, 20 bp, Artificial
  CRISPR gRNA sequence
ctagtacaatgctatgaaaa

SEQ ID NO: 119796 - DNA, 20 bp, Artificial
  CRISPR gRNA sequence
gtacaatgctatgaaaagtg

SEQ ID NO: 119797 - DNA, 20 bp, Artificial
  CRISPR gRNA sequence
tgaaaagtgtctttgtaatt

SEQ ID NO: 119798 - DNA, 20 bp, Artificial
  CRISPR gRNA sequence
tgtaatttccccctactatt

SEQ ID NO: 119799 - DNA, 20 bp, Artificial
  CRISPR gRNA sequence
gtaatttccccctactattg

SEQ ID NO: 119800 - DNA, 20 bp, Artificial
  CRISPR gRNA sequence
taatttccccctactattga

SEQ ID NO: 119801 - DNA, 20 bp, Artificial
  CRISPR gRNA sequence
ccccctactattgatgcttt

SEQ ID NO: 119802 - DNA, 20 bp, Artificial
  CRISPR gRNA sequence
cccctactattgatgctttt

SEQ ID NO: 119803 - DNA, 20 bp, Artificial
  CRISPR gRNA sequence
ctattgatgcttttcttcct

SEQ ID NO: 119804 - DNA, 20 bp, Artificial
  CRISPR gRNA sequence
ttgatgcttttcttcctata

SEQ ID NO: 119805 - DNA, 20 bp, Artificial
  CRISPR gRNA sequence
atgcttttcttcctatagga

SEQ ID NO: 119806 - DNA, 20 bp, Artificial
  CRISPR gRNA sequence
ttcttcctataggacagatt

SEQ ID NO: 119807 - DNA, 20 bp, Artificial
  CRISPR gRNA sequence
tcttcctataggacagattc

SEQ ID NO: 119808 - DNA, 20 bp, Artificial
  CRISPR gRNA sequence
cttcctataggacagattct

SEQ ID NO: 119809 - DNA, 20 bp, Artificial
  CRISPR gRNA sequence
ttcctataggacagattctc

SEQ ID NO: 119810 - DNA, 20 bp, Artificial
  CRISPR gRNA sequence
cctataggacagattctcag

SEQ ID NO: 119811 - DNA, 20 bp, Artificial
  CRISPR gRNA sequence
ctataggacagattctcaga

SEQ ID NO: 119812 - DNA, 20 bp, Artificial
  CRISPR gRNA sequence
taggacagattctcagaagt

SEQ ID NO: 119813 - DNA, 20 bp, Artificial
  CRISPR gRNA sequence
tcagaagtgggactgctagc

SEQ ID NO: 119814 - DNA, 20 bp, Artificial
  CRISPR gRNA sequence
agaagtgggactgctagctc

SEQ ID NO: 119815 - DNA, 20 bp, Artificial
  CRISPR gRNA sequence
ctagctcaaatattcattgt

SEQ ID NO: 119816 - DNA, 20 bp, Artificial
  CRISPR gRNA sequence
gctcaaatattcattgtatt

SEQ ID NO: 119817 - DNA, 20 bp, Artificial
  CRISPR gRNA sequence
aaatattcattgtatttaac

SEQ ID NO: 119818 - DNA, 20 bp, Artificial
  CRISPR gRNA sequence
attgtatttaacagatagtg

SEQ ID NO: 119819 - DNA, 20 bp, Artificial
  CRISPR gRNA sequence
tatttaacagatagtgaggt

SEQ ID NO: 119820 - DNA, 20 bp, Artificial
  CRISPR gRNA sequence
aacagatagtgaggtgcctt

SEQ ID NO: 119821 - DNA, 20 bp, Artificial
  CRISPR gRNA sequence
acagatagtgaggtgccttt

SEQ ID NO: 119822 - DNA, 20 bp, Artificial
  CRISPR gRNA sequence
tccaaaataactctacagtt

SEQ ID NO: 119823 - DNA, 20 bp, Artificial
  CRISPR gRNA sequence
ccaaaataactctacagttt

SEQ ID NO: 119824 - DNA, 20 bp, Artificial
  CRISPR gRNA sequence
caaaataactctacagtttt

SEQ ID NO: 119825 - DNA, 20 bp, Artificial
  CRISPR gRNA sequence
tacagttttaaattaccaaa

SEQ ID NO: 119826 - DNA, 20 bp, Artificial
  CRISPR gRNA sequence
cagttttaaattaccaaaaa

SEQ ID NO: 119827 - DNA, 20 bp, Artificial
  CRISPR gRNA sequence
taaattaccaaaaataatga

SEQ ID NO: 119828 - DNA, 20 bp, Artificial
  CRISPR gRNA sequence
aaattaccaaaaataatgat

SEQ ID NO: 119829 - DNA, 20 bp, Artificial
  CRISPR gRNA sequence
aattaccaaaaataatgatt

SEQ ID NO: 119830 - DNA, 20 bp, Artificial
  CRISPR gRNA sequence
ccaaaaataatgattaattc

SEQ ID NO: 119831 - DNA, 20 bp, Artificial
  CRISPR gRNA sequence
attctttttctccacatcca

SEQ ID NO: 119832 - DNA, 20 bp, Artificial
  CRISPR gRNA sequence
tttttctccacatccatcct

SEQ ID NO: 119833 - DNA, 20 bp, Artificial
  CRISPR gRNA sequence
tttctccacatccatcctaa

SEQ ID NO: 119834 - DNA, 20 bp, Artificial
  CRISPR gRNA sequence
ttctccacatccatcctaac

SEQ ID NO: 119835 - DNA, 20 bp, Artificial
  CRISPR gRNA sequence
tctccacatccatcctaaca

SEQ ID NO: 119836 - DNA, 20 bp, Artificial
  CRISPR gRNA sequence
ctccacatccatcctaacag

SEQ ID NO: 119837 - DNA, 20 bp, Artificial
  CRISPR gRNA sequence
tccacatccatcctaacagt

SEQ ID NO: 119838 - DNA, 20 bp, Artificial
  CRISPR gRNA sequence
cacatccatcctaacagtgg

SEQ ID NO: 119839 - DNA, 20 bp, Artificial
  CRISPR gRNA sequence
acagtggatataatgacttt

SEQ ID NO: 119840 - DNA, 20 bp, Artificial
  CRISPR gRNA sequence
tttgtttttttttgccatct

SEQ ID NO: 119841 - DNA, 20 bp, Artificial
  CRISPR gRNA sequence
ttgtttttttttgccatctc

SEQ ID NO: 119842 - DNA, 20 bp, Artificial
  CRISPR gRNA sequence
tgtttttttttgccatctcg

SEQ ID NO: 119843 - DNA, 20 bp, Artificial
  CRISPR gRNA sequence
gtttttttttgccatctcga

SEQ ID NO: 119844 - DNA, 20 bp, Artificial
  CRISPR gRNA sequence
tttttttttgccatctcgat

SEQ ID NO: 119845 - DNA, 20 bp, Artificial
  CRISPR gRNA sequence
ttttttgccatctcgatgag

SEQ ID NO: 119846 - DNA, 20 bp, Artificial
  CRISPR gRNA sequence
tttttgccatctcgatgaga

SEQ ID NO: 119847 - DNA, 20 bp, Artificial
  CRISPR gRNA sequence
ttttgccatctcgatgagaa

SEQ ID NO: 119848 - DNA, 20 bp, Artificial
  CRISPR gRNA sequence
tttgccatctcgatgagaaa

SEQ ID NO: 119849 - DNA, 20 bp, Artificial
  CRISPR gRNA sequence
ttgccatctcgatgagaaat

SEQ ID NO: 119850 - DNA, 20 bp, Artificial
  CRISPR gRNA sequence
tgccatctcgatgagaaata

SEQ ID NO: 119851 - DNA, 20 bp, Artificial
  CRISPR gRNA sequence
gccatctcgatgagaaatat

SEQ ID NO: 119852 - DNA, 20 bp, Artificial
  CRISPR gRNA sequence
ccatctcgatgagaaatatc

SEQ ID NO: 119853 - DNA, 20 bp, Artificial
  CRISPR gRNA sequence
gatgagaaatatctaatttt

SEQ ID NO: 119854 - DNA, 20 bp, Artificial
  CRISPR gRNA sequence
attttaaaatatgatgccac

SEQ ID NO: 119855 - DNA, 20 bp, Artificial
  CRISPR gRNA sequence
taaaatatgatgccacagag

SEQ ID NO: 119856 - DNA, 20 bp, Artificial
  CRISPR gRNA sequence
aaaatatgatgccacagagt

SEQ ID NO: 119857 - DNA, 20 bp, Artificial
  CRISPR gRNA sequence
aaatatgatgccacagagtt

SEQ ID NO: 119858 - DNA, 20 bp, Artificial
  CRISPR gRNA sequence
tatgtaacatttctacatat

SEQ ID NO: 119859 - DNA, 20 bp, Artificial
  CRISPR gRNA sequence
ctacatatttctgttaatct

SEQ ID NO: 119860 - DNA, 20 bp, Artificial
  CRISPR gRNA sequence
tacatatttctgttaatctc

SEQ ID NO: 119861 - DNA, 20 bp, Artificial
  CRISPR gRNA sequence
catatttctgttaatctctt

SEQ ID NO: 119862 - DNA, 20 bp, Artificial
  CRISPR gRNA sequence
ctgttaatctcttctttttt

SEQ ID NO: 119863 - DNA, 20 bp, Artificial
  CRISPR gRNA sequence
tgttaatctcttcttttttt

SEQ ID NO: 119864 - DNA, 20 bp, Artificial
  CRISPR gRNA sequence
ttaatctcttcttttttttt

SEQ ID NO: 119865 - DNA, 20 bp, Artificial
  CRISPR gRNA sequence
atctcttctttttttttgag

SEQ ID NO: 119866 - DNA, 20 bp, Artificial
  CRISPR gRNA sequence
ttctttttttttgagacaga

SEQ ID NO: 119867 - DNA, 20 bp, Artificial
  CRISPR gRNA sequence
ctttttttttgagacagaat

SEQ ID NO: 119868 - DNA, 20 bp, Artificial
  CRISPR gRNA sequence
tttttttttgagacagaatc

SEQ ID NO: 119869 - DNA, 20 bp, Artificial
  CRISPR gRNA sequence
tttttttgagacagaatctt

SEQ ID NO: 119870 - DNA, 20 bp, Artificial
  CRISPR gRNA sequence
ttttttgagacagaatcttg

SEQ ID NO: 119871 - DNA, 20 bp, Artificial
  CRISPR gRNA sequence
tttttgagacagaatcttgc

SEQ ID NO: 119872 - DNA, 20 bp, Artificial
  CRISPR gRNA sequence
ttttgagacagaatcttgct

SEQ ID NO: 119873 - DNA, 20 bp, Artificial
  CRISPR gRNA sequence
tttgagacagaatcttgctc

SEQ ID NO: 119874 - DNA, 20 bp, Artificial
  CRISPR gRNA sequence
ttgagacagaatcttgctct

SEQ ID NO: 119875 - DNA, 20 bp, Artificial
  CRISPR gRNA sequence
tgagacagaatcttgctctg

SEQ ID NO: 119876 - DNA, 20 bp, Artificial
  CRISPR gRNA sequence
gagacagaatcttgctctgg

SEQ ID NO: 119877 - DNA, 20 bp, Artificial
  CRISPR gRNA sequence
agacagaatcttgctctggt

SEQ ID NO: 119878 - DNA, 20 bp, Artificial
  CRISPR gRNA sequence
gctctggtgcccagcctgga

SEQ ID NO: 119879 - DNA, 20 bp, Artificial
  CRISPR gRNA sequence
ctctggtgcccagcctggag

SEQ ID NO: 119880 - DNA, 20 bp, Artificial
  CRISPR gRNA sequence
tggtgcccagcctggagtgc

SEQ ID NO: 119881 - DNA, 20 bp, Artificial
  CRISPR gRNA sequence
gtgcccagcctggagtgcag

SEQ ID NO: 119882 - DNA, 20 bp, Artificial
  CRISPR gRNA sequence
gagtgcagtggcacaatctt

SEQ ID NO: 119883 - DNA, 20 bp, Artificial
  CRISPR gRNA sequence
ggcttactgcaacctccgcc

SEQ ID NO: 119884 - DNA, 20 bp, Artificial
  CRISPR gRNA sequence
gcttactgcaacctccgcct

SEQ ID NO: 119885 - DNA, 20 bp, Artificial
  CRISPR gRNA sequence
actgcaacctccgcctcctg

SEQ ID NO: 119886 - DNA, 20 bp, Artificial
  CRISPR gRNA sequence
ctgcaacctccgcctcctgg

SEQ ID NO: 119887 - DNA, 20 bp, Artificial
  CRISPR gRNA sequence
caacctccgcctcctgggtt

SEQ ID NO: 119888 - DNA, 20 bp, Artificial
  CRISPR gRNA sequence
cgcctcctgggttcaagata

SEQ ID NO: 119889 - DNA, 20 bp, Artificial
  CRISPR gRNA sequence
ctgggttcaagatatcttat

SEQ ID NO: 119890 - DNA, 20 bp, Artificial
  CRISPR gRNA sequence
ggttcaagatatcttatgcc

SEQ ID NO: 119891 - DNA, 20 bp, Artificial
  CRISPR gRNA sequence
aagatatcttatgcctcaac

SEQ ID NO: 119892 - DNA, 20 bp, Artificial
  CRISPR gRNA sequence
atgcctcaaccccccaagta

SEQ ID NO: 119893 - DNA, 20 bp, Artificial
  CRISPR gRNA sequence
tgcctcaaccccccaagtag

SEQ ID NO: 119894 - DNA, 20 bp, Artificial
  CRISPR gRNA sequence
aaccccccaagtagctggga

SEQ ID NO: 119895 - DNA, 20 bp, Artificial
  CRISPR gRNA sequence
ggattacaggtgcgtgccac

SEQ ID NO: 119896 - DNA, 20 bp, Artificial
  CRISPR gRNA sequence
caggtgcgtgccaccacgcc

SEQ ID NO: 119897 - DNA, 20 bp, Artificial
  CRISPR gRNA sequence
attttttatttttagtagag

SEQ ID NO: 119898 - DNA, 20 bp, Artificial
  CRISPR gRNA sequence
tttatttttagtagagatgg

SEQ ID NO: 119899 - DNA, 20 bp, Artificial
  CRISPR gRNA sequence
ttatttttagtagagatggg

SEQ ID NO: 119900 - DNA, 20 bp, Artificial
  CRISPR gRNA sequence
tatttttagtagagatgggg

SEQ ID NO: 119901 - DNA, 20 bp, Artificial
  CRISPR gRNA sequence
atttttagtagagatggggt

SEQ ID NO: 119902 - DNA, 20 bp, Artificial
  CRISPR gRNA sequence
tttttagtagagatggggtt

SEQ ID NO: 119903 - DNA, 20 bp, Artificial
  CRISPR gRNA sequence
ttagtagagatggggttttg

SEQ ID NO: 119904 - DNA, 20 bp, Artificial
  CRISPR gRNA sequence
tagtagagatggggttttgt

SEQ ID NO: 119905 - DNA, 20 bp, Artificial
  CRISPR gRNA sequence
agtagagatggggttttgtc

SEQ ID NO: 119906 - DNA, 20 bp, Artificial
  CRISPR gRNA sequence
gtagagatggggttttgtca

SEQ ID NO: 119907 - DNA, 20 bp, Artificial
  CRISPR gRNA sequence
tgtcatgttggccaggctgg

SEQ ID NO: 119908 - DNA, 20 bp, Artificial
  CRISPR gRNA sequence
gtcatgttggccaggctggt

SEQ ID NO: 119909 - DNA, 20 bp, Artificial
  CRISPR gRNA sequence
tcatgttggccaggctggtc

SEQ ID NO: 119910 - DNA, 20 bp, Artificial
  CRISPR gRNA sequence
gccaggctggtcttgaactc

SEQ ID NO: 119911 - DNA, 20 bp, Artificial
  CRISPR gRNA sequence
gtcttgaactcctggcctca

SEQ ID NO: 119912 - DNA, 20 bp, Artificial
  CRISPR gRNA sequence
gaactcctggcctcaagtga

SEQ ID NO: 119913 - DNA, 20 bp, Artificial
  CRISPR gRNA sequence
aactcctggcctcaagtgat

SEQ ID NO: 119914 - DNA, 20 bp, Artificial
  CRISPR gRNA sequence
ctggcctcaagtgatccacc

SEQ ID NO: 119915 - DNA, 20 bp, Artificial
  CRISPR gRNA sequence
gcctcaagtgatccacctgc

SEQ ID NO: 119916 - DNA, 20 bp, Artificial
  CRISPR gRNA sequence
aagtgatccacctgccttgg

SEQ ID NO: 119917 - DNA, 20 bp, Artificial
  CRISPR gRNA sequence
ccttggcctccccaagtgct

SEQ ID NO: 119918 - DNA, 20 bp, Artificial
  CRISPR gRNA sequence
ggcctccccaagtgctggga

SEQ ID NO: 119919 - DNA, 20 bp, Artificial
  CRISPR gRNA sequence
gcctccccaagtgctgggat

SEQ ID NO: 119920 - DNA, 20 bp, Artificial
  CRISPR gRNA sequence
cccaagtgctgggatcacag

SEQ ID NO: 119921 - DNA, 20 bp, Artificial
  CRISPR gRNA sequence
ggatcacaggcatgagccac

SEQ ID NO: 119922 - DNA, 20 bp, Artificial
  CRISPR gRNA sequence
cgcctggccttcctttaatc

SEQ ID NO: 119923 - DNA, 20 bp, Artificial
  CRISPR gRNA sequence
gccttcctttaatctcttct

SEQ ID NO: 119924 - DNA, 20 bp, Artificial
  CRISPR gRNA sequence
cctttaatctcttctacatc

SEQ ID NO: 119925 - DNA, 20 bp, Artificial
  CRISPR gRNA sequence
ctttaatctcttctacatct

SEQ ID NO: 119926 - DNA, 20 bp, Artificial
  CRISPR gRNA sequence
taatctcttctacatctttg

SEQ ID NO: 119927 - DNA, 20 bp, Artificial
  CRISPR gRNA sequence
aatctcttctacatctttgc

SEQ ID NO: 119928 - DNA, 20 bp, Artificial
  CRISPR gRNA sequence
atctcttctacatctttgct

SEQ ID NO: 119929 - DNA, 20 bp, Artificial
  CRISPR gRNA sequence
ttctacatctttgcttactt

SEQ ID NO: 119930 - DNA, 20 bp, Artificial
  CRISPR gRNA sequence
ctacatctttgcttactttt

SEQ ID NO: 119931 - DNA, 20 bp, Artificial
  CRISPR gRNA sequence
tacatctttgcttacttttg

SEQ ID NO: 119932 - DNA, 20 bp, Artificial
  CRISPR gRNA sequence
catctttgcttacttttgtt

SEQ ID NO: 119933 - DNA, 20 bp, Artificial
  CRISPR gRNA sequence
tgcttacttttgttttctgt

SEQ ID NO: 119934 - DNA, 20 bp, Artificial
  CRISPR gRNA sequence
gcttacttttgttttctgtt

SEQ ID NO: 119935 - DNA, 20 bp, Artificial
  CRISPR gRNA sequence
cttacttttgttttctgttt

SEQ ID NO: 119936 - DNA, 20 bp, Artificial
  CRISPR gRNA sequence
acttttgttttctgtttctc

SEQ ID NO: 119937 - DNA, 20 bp, Artificial
  CRISPR gRNA sequence
cttttgttttctgtttctca

SEQ ID NO: 119938 - DNA, 20 bp, Artificial
  CRISPR gRNA sequence
ttgttttctgtttctcaatc

SEQ ID NO: 119939 - DNA, 20 bp, Artificial
  CRISPR gRNA sequence
tgttttctgtttctcaatca

SEQ ID NO: 119940 - DNA, 20 bp, Artificial
  CRISPR gRNA sequence
gttttctgtttctcaatcag

SEQ ID NO: 119941 - DNA, 20 bp, Artificial
  CRISPR gRNA sequence
ttttctgtttctcaatcagt

SEQ ID NO: 119942 - DNA, 20 bp, Artificial
  CRISPR gRNA sequence
tctgtttctcaatcagtgtt

SEQ ID NO: 119943 - DNA, 20 bp, Artificial
  CRISPR gRNA sequence
ctgtttctcaatcagtgttt

SEQ ID NO: 119944 - DNA, 20 bp, Artificial
  CRISPR gRNA sequence
tgtttctcaatcagtgtttc

SEQ ID NO: 119945 - DNA, 20 bp, Artificial
  CRISPR gRNA sequence
tttctcaatcagtgtttcaa

SEQ ID NO: 119946 - DNA, 20 bp, Artificial
  CRISPR gRNA sequence
ctcaatcagtgtttcaactg

SEQ ID NO: 119947 - DNA, 20 bp, Artificial
  CRISPR gRNA sequence
tcaatcagtgtttcaactgg

SEQ ID NO: 119948 - DNA, 20 bp, Artificial
  CRISPR gRNA sequence
aatcagtgtttcaactggat

SEQ ID NO: 119949 - DNA, 20 bp, Artificial
  CRISPR gRNA sequence
caactggatttacctgtttt

SEQ ID NO: 119950 - DNA, 20 bp, Artificial
  CRISPR gRNA sequence
aactggatttacctgtttta

SEQ ID NO: 119951 - DNA, 20 bp, Artificial
  CRISPR gRNA sequence
gatttacctgttttattggt

SEQ ID NO: 119952 - DNA, 20 bp, Artificial
  CRISPR gRNA sequence
acctgttttattggtctgct

SEQ ID NO: 119953 - DNA, 20 bp, Artificial
  CRISPR gRNA sequence
cctgttttattggtctgctt

SEQ ID NO: 119954 - DNA, 20 bp, Artificial
  CRISPR gRNA sequence
ttttattggtctgcttaaac

SEQ ID NO: 119955 - DNA, 20 bp, Artificial
  CRISPR gRNA sequence
tattggtctgcttaaacaat

SEQ ID NO: 119956 - DNA, 20 bp, Artificial
  CRISPR gRNA sequence
attggtctgcttaaacaatc

SEQ ID NO: 119957 - DNA, 20 bp, Artificial
  CRISPR gRNA sequence
ttggtctgcttaaacaatct

SEQ ID NO: 119958 - DNA, 20 bp, Artificial
  CRISPR gRNA sequence
gtctgcttaaacaatctaga

SEQ ID NO: 119959 - DNA, 20 bp, Artificial
  CRISPR gRNA sequence
cttaaacaatctagatttta

SEQ ID NO: 119960 - DNA, 20 bp, Artificial
  CRISPR gRNA sequence
aaacaatctagattttattt

SEQ ID NO: 119961 - DNA, 20 bp, Artificial
  CRISPR gRNA sequence
aacaatctagattttattta

SEQ ID NO: 119962 - DNA, 20 bp, Artificial
  CRISPR gRNA sequence
gattttatttatcctttcta

SEQ ID NO: 119963 - DNA, 20 bp, Artificial
  CRISPR gRNA sequence
tatttatcctttctatacgt

SEQ ID NO: 119964 - DNA, 20 bp, Artificial
  CRISPR gRNA sequence
atttatcctttctatacgtc

SEQ ID NO: 119965 - DNA, 20 bp, Artificial
  CRISPR gRNA sequence
tttatcctttctatacgtca

SEQ ID NO: 119966 - DNA, 20 bp, Artificial
  CRISPR gRNA sequence
atcctttctatacgtcagtt

SEQ ID NO: 119967 - DNA, 20 bp, Artificial
  CRISPR gRNA sequence
tcctttctatacgtcagttt

SEQ ID NO: 119968 - DNA, 20 bp, Artificial
  CRISPR gRNA sequence
tctatacgtcagttttctac

SEQ ID NO: 119969 - DNA, 20 bp, Artificial
  CRISPR gRNA sequence
ctatacgtcagttttctact

SEQ ID NO: 119970 - DNA, 20 bp, Artificial
  CRISPR gRNA sequence
tatacgtcagttttctactt

SEQ ID NO: 119971 - DNA, 20 bp, Artificial
  CRISPR gRNA sequence
tacgtcagttttctacttaa

SEQ ID NO: 119972 - DNA, 20 bp, Artificial
  CRISPR gRNA sequence
tctacttaattaatttggac

SEQ ID NO: 119973 - DNA, 20 bp, Artificial
  CRISPR gRNA sequence
ctacttaattaatttggacc

SEQ ID NO: 119974 - DNA, 20 bp, Artificial
  CRISPR gRNA sequence
tacttaattaatttggaccc

SEQ ID NO: 119975 - DNA, 20 bp, Artificial
  CRISPR gRNA sequence
cttaattaatttggacccac

SEQ ID NO: 119976 - DNA, 20 bp, Artificial
  CRISPR gRNA sequence
aattaatttggacccacttt

SEQ ID NO: 119977 - DNA, 20 bp, Artificial
  CRISPR gRNA sequence
attaatttggacccactttt

SEQ ID NO: 119978 - DNA, 20 bp, Artificial
  CRISPR gRNA sequence
atttggacccactttttgct

SEQ ID NO: 119979 - DNA, 20 bp, Artificial
  CRISPR gRNA sequence
ggacccactttttgctcgtt

SEQ ID NO: 119980 - DNA, 20 bp, Artificial
  CRISPR gRNA sequence
gacccactttttgctcgttt

SEQ ID NO: 119981 - DNA, 20 bp, Artificial
  CRISPR gRNA sequence
tttgctcgttttgttatttt

SEQ ID NO: 119982 - DNA, 20 bp, Artificial
  CRISPR gRNA sequence
ttgctcgttttgttattttt

SEQ ID NO: 119983 - DNA, 20 bp, Artificial
  CRISPR gRNA sequence
tgctcgttttgttatttttc

SEQ ID NO: 119984 - DNA, 20 bp, Artificial
  CRISPR gRNA sequence
gctcgttttgttatttttct

SEQ ID NO: 119985 - DNA, 20 bp, Artificial
  CRISPR gRNA sequence
ctcgttttgttatttttcta

SEQ ID NO: 119986 - DNA, 20 bp, Artificial
  CRISPR gRNA sequence
gttttgttatttttctaact

SEQ ID NO: 119987 - DNA, 20 bp, Artificial
  CRISPR gRNA sequence
tgttatttttctaactttct

SEQ ID NO: 119988 - DNA, 20 bp, Artificial
  CRISPR gRNA sequence
gttatttttctaactttcta

SEQ ID NO: 119989 - DNA, 20 bp, Artificial
  CRISPR gRNA sequence
ttatttttctaactttctaa

SEQ ID NO: 119990 - DNA, 20 bp, Artificial
  CRISPR gRNA sequence
tttttctaactttctaaata

SEQ ID NO: 119991 - DNA, 20 bp, Artificial
  CRISPR gRNA sequence
ttctaactttctaaatactc

SEQ ID NO: 119992 - DNA, 20 bp, Artificial
  CRISPR gRNA sequence
tctaactttctaaatactca

SEQ ID NO: 119993 - DNA, 20 bp, Artificial
  CRISPR gRNA sequence
ctaactttctaaatactcat

SEQ ID NO: 119994 - DNA, 20 bp, Artificial
  CRISPR gRNA sequence
taactttctaaatactcatt

SEQ ID NO: 119995 - DNA, 20 bp, Artificial
  CRISPR gRNA sequence
actttctaaatactcatttt

SEQ ID NO: 119996 - DNA, 20 bp, Artificial
  CRISPR gRNA sequence
tctaaatactcatttttgtt

SEQ ID NO: 119997 - DNA, 20 bp, Artificial
  CRISPR gRNA sequence
ctaaatactcatttttgttt

SEQ ID NO: 119998 - DNA, 20 bp, Artificial
  CRISPR gRNA sequence
taaatactcatttttgtttc

SEQ ID NO: 119999 - DNA, 20 bp, Artificial
  CRISPR gRNA sequence
aatactcatttttgtttctt

SEQ ID NO: 120000 - DNA, 20 bp, Artificial
  CRISPR gRNA sequence
atttttgtttcttttaaaat

SEQ ID NO: 120001 - DNA, 20 bp, Artificial
  CRISPR gRNA sequence
ttgtttcttttaaaataaaa

SEQ ID NO: 120002 - DNA, 20 bp, Artificial
  CRISPR gRNA sequence
tgtttcttttaaaataaaat

SEQ ID NO: 120003 - DNA, 20 bp, Artificial
  CRISPR gRNA sequence
gtttcttttaaaataaaata

SEQ ID NO: 120004 - DNA, 20 bp, Artificial
  CRISPR gRNA sequence
tttcttttaaaataaaatat

SEQ ID NO: 120005 - DNA, 20 bp, Artificial
  CRISPR gRNA sequence
cttttaaaataaaatatact

SEQ ID NO: 120006 - DNA, 20 bp, Artificial
  CRISPR gRNA sequence
ttttaaaataaaatatacta

SEQ ID NO: 120007 - DNA, 20 bp, Artificial
  CRISPR gRNA sequence
ttaaaataaaatatactata

SEQ ID NO: 120008 - DNA, 20 bp, Artificial
  CRISPR gRNA sequence
taaaataaaatatactataa

SEQ ID NO: 120009 - DNA, 20 bp, Artificial
  CRISPR gRNA sequence
aaaataaaatatactataaa

SEQ ID NO: 120010 - DNA, 20 bp, Artificial
  CRISPR gRNA sequence
aaataaaatatactataaac

SEQ ID NO: 120011 - DNA, 20 bp, Artificial
  CRISPR gRNA sequence
taaactagattctaacctct

SEQ ID NO: 120012 - DNA, 20 bp, Artificial
  CRISPR gRNA sequence
gattctaacctcttcatata

SEQ ID NO: 120013 - DNA, 20 bp, Artificial
  CRISPR gRNA sequence
taacctcttcatatacttta

SEQ ID NO: 120014 - DNA, 20 bp, Artificial
  CRISPR gRNA sequence
acctcttcatatactttaca

SEQ ID NO: 120015 - DNA, 20 bp, Artificial
  CRISPR gRNA sequence
ttcatatactttacagcaat

SEQ ID NO: 120016 - DNA, 20 bp, Artificial
  CRISPR gRNA sequence
catatactttacagcaattc

SEQ ID NO: 120017 - DNA, 20 bp, Artificial
  CRISPR gRNA sequence
atatactttacagcaattca

SEQ ID NO: 120018 - DNA, 20 bp, Artificial
  CRISPR gRNA sequence
tacagcaattcaagatcatg

SEQ ID NO: 120019 - DNA, 20 bp, Artificial
  CRISPR gRNA sequence
acagcaattcaagatcatgc

SEQ ID NO: 120020 - DNA, 20 bp, Artificial
  CRISPR gRNA sequence
cagcaattcaagatcatgcc

SEQ ID NO: 120021 - DNA, 20 bp, Artificial
  CRISPR gRNA sequence
aagatcatgcctaatatctt

SEQ ID NO: 120022 - DNA, 20 bp, Artificial
  CRISPR gRNA sequence
atatcttagtcattactgga

SEQ ID NO: 120023 - DNA, 20 bp, Artificial
  CRISPR gRNA sequence
agtcattactggagctgtcc

SEQ ID NO: 120024 - DNA, 20 bp, Artificial
  CRISPR gRNA sequence
gtcattactggagctgtcca

SEQ ID NO: 120025 - DNA, 20 bp, Artificial
  CRISPR gRNA sequence
ctggagctgtccaatttctg

SEQ ID NO: 120026 - DNA, 20 bp, Artificial
  CRISPR gRNA sequence
gagctgtccaatttctgcat

SEQ ID NO: 120027 - DNA, 20 bp, Artificial
  CRISPR gRNA sequence
tccaatttctgcatagttct

SEQ ID NO: 120028 - DNA, 20 bp, Artificial
  CRISPR gRNA sequence
ctgcatagttctagtttata

SEQ ID NO: 120029 - DNA, 20 bp, Artificial
  CRISPR gRNA sequence
tgcatagttctagtttatat

SEQ ID NO: 120030 - DNA, 20 bp, Artificial
  CRISPR gRNA sequence
catagttctagtttatatca

SEQ ID NO: 120031 - DNA, 20 bp, Artificial
  CRISPR gRNA sequence
tagtttatatcactggtact

SEQ ID NO: 120032 - DNA, 20 bp, Artificial
  CRISPR gRNA sequence
gtttatatcactggtactat

SEQ ID NO: 120033 - DNA, 20 bp, Artificial
  CRISPR gRNA sequence
atatcactggtactataaag

SEQ ID NO: 120034 - DNA, 20 bp, Artificial
  CRISPR gRNA sequence
tatcactggtactataaagg

SEQ ID NO: 120035 - DNA, 20 bp, Artificial
  CRISPR gRNA sequence
gtactataaaggcagaaaat

SEQ ID NO: 120036 - DNA, 20 bp, Artificial
  CRISPR gRNA sequence
taaaggcagaaaatcaactg

SEQ ID NO: 120037 - DNA, 20 bp, Artificial
  CRISPR gRNA sequence
aatgcaaaatgtgggttagg

SEQ ID NO: 120038 - DNA, 20 bp, Artificial
  CRISPR gRNA sequence
ggaagcagttaaatgcaata

SEQ ID NO: 120039 - DNA, 20 bp, Artificial
  CRISPR gRNA sequence
aatgcaatatcaattatcaa

SEQ ID NO: 120040 - DNA, 20 bp, Artificial
  CRISPR gRNA sequence
tcaaataggttgtaataatc

SEQ ID NO: 120041 - DNA, 20 bp, Artificial
  CRISPR gRNA sequence
taataatctattctttgaaa

SEQ ID NO: 120042 - DNA, 20 bp, Artificial
  CRISPR gRNA sequence
ttctttgaaacctctcctct

SEQ ID NO: 120043 - DNA, 20 bp, Artificial
  CRISPR gRNA sequence
tttgaaacctctcctctgat

SEQ ID NO: 120044 - DNA, 20 bp, Artificial
  CRISPR gRNA sequence
tgaaacctctcctctgatat

SEQ ID NO: 120045 - DNA, 20 bp, Artificial
  CRISPR gRNA sequence
gaaacctctcctctgatata

SEQ ID NO: 120046 - DNA, 20 bp, Artificial
  CRISPR gRNA sequence
aaacctctcctctgatatac

SEQ ID NO: 120047 - DNA, 20 bp, Artificial
  CRISPR gRNA sequence
tcctctgatatactgctcaa

SEQ ID NO: 120048 - DNA, 20 bp, Artificial
  CRISPR gRNA sequence
ctctgatatactgctcaata

SEQ ID NO: 120049 - DNA, 20 bp, Artificial
  CRISPR gRNA sequence
tgatatactgctcaatattt

SEQ ID NO: 120050 - DNA, 20 bp, Artificial
  CRISPR gRNA sequence
atatactgctcaatattttt

SEQ ID NO: 120051 - DNA, 20 bp, Artificial
  CRISPR gRNA sequence
ctcaatatttttaaatatta

SEQ ID NO: 120052 - DNA, 20 bp, Artificial
  CRISPR gRNA sequence
aatatttttaaatattactc

SEQ ID NO: 120053 - DNA, 20 bp, Artificial
  CRISPR gRNA sequence
ttaaatattactcacttgct

SEQ ID NO: 120054 - DNA, 20 bp, Artificial
  CRISPR gRNA sequence
taaatattactcacttgctg

SEQ ID NO: 120055 - DNA, 20 bp, Artificial
  CRISPR gRNA sequence
aaatattactcacttgctgc

SEQ ID NO: 120056 - DNA, 20 bp, Artificial
  CRISPR gRNA sequence
aatattactcacttgctgca

SEQ ID NO: 120057 - DNA, 20 bp, Artificial
  CRISPR gRNA sequence
ctcacttgctgcaaaccctg

SEQ ID NO: 120058 - DNA, 20 bp, Artificial
  CRISPR gRNA sequence
acttgctgcaaaccctgtgt

SEQ ID NO: 120059 - DNA, 20 bp, Artificial
  CRISPR gRNA sequence
gctgcaaaccctgtgttcca

SEQ ID NO: 120060 - DNA, 20 bp, Artificial
  CRISPR gRNA sequence
ctgcaaaccctgtgttccag

SEQ ID NO: 120061 - DNA, 20 bp, Artificial
  CRISPR gRNA sequence
caaaccctgtgttccagaaa

SEQ ID NO: 120062 - DNA, 20 bp, Artificial
  CRISPR gRNA sequence
tgttccagaaacaggtactt

SEQ ID NO: 120063 - DNA, 20 bp, Artificial
  CRISPR gRNA sequence
cagaaacaggtacttgcatg

SEQ ID NO: 120064 - DNA, 20 bp, Artificial
  CRISPR gRNA sequence
gcatgatggtttgaccttgt

SEQ ID NO: 120065 - DNA, 20 bp, Artificial
  CRISPR gRNA sequence
catgatggtttgaccttgtc

SEQ ID NO: 120066 - DNA, 20 bp, Artificial
  CRISPR gRNA sequence
gaccttgtccaccagggaca

SEQ ID NO: 120067 - DNA, 20 bp, Artificial
  CRISPR gRNA sequence
accttgtccaccagggacag

SEQ ID NO: 120068 - DNA, 20 bp, Artificial
  CRISPR gRNA sequence
gtccaccagggacagcctgg

SEQ ID NO: 120069 - DNA, 20 bp, Artificial
  CRISPR gRNA sequence
tccaccagggacagcctgga

SEQ ID NO: 120070 - DNA, 20 bp, Artificial
  CRISPR gRNA sequence
gaccatgatgggttggccag

SEQ ID NO: 120071 - DNA, 20 bp, Artificial
  CRISPR gRNA sequence
gccagttgatgtgattagct

SEQ ID NO: 120072 - DNA, 20 bp, Artificial
  CRISPR gRNA sequence
atgtgattagctggcctcca

SEQ ID NO: 120073 - DNA, 20 bp, Artificial
  CRISPR gRNA sequence
gctggcctccactgacctgc

SEQ ID NO: 120074 - DNA, 20 bp, Artificial
  CRISPR gRNA sequence
gcctccactgacctgcacca

SEQ ID NO: 120075 - DNA, 20 bp, Artificial
  CRISPR gRNA sequence
cactgacctgcaccattaat

SEQ ID NO: 120076 - DNA, 20 bp, Artificial
  CRISPR gRNA sequence
acctgcaccattaatggctg

SEQ ID NO: 120077 - DNA, 20 bp, Artificial
  CRISPR gRNA sequence
caccattaatggctgccctt

SEQ ID NO: 120078 - DNA, 20 bp, Artificial
  CRISPR gRNA sequence
atggctgcccttggacctag

SEQ ID NO: 120079 - DNA, 20 bp, Artificial
  CRISPR gRNA sequence
cccttggacctagaatgaaa

SEQ ID NO: 120080 - DNA, 20 bp, Artificial
  CRISPR gRNA sequence
ggacctagaatgaaataaaa

SEQ ID NO: 120081 - DNA, 20 bp, Artificial
  CRISPR gRNA sequence
gacctagaatgaaataaaat

SEQ ID NO: 120082 - DNA, 20 bp, Artificial
  CRISPR gRNA sequence
gaatgaaataaaataagaac

SEQ ID NO: 120083 - DNA, 20 bp, Artificial
  CRISPR gRNA sequence
ttaccaaaagacaatcactg

SEQ ID NO: 120084 - DNA, 20 bp, Artificial
  CRISPR gRNA sequence
taccaaaagacaatcactgg

SEQ ID NO: 120085 - DNA, 20 bp, Artificial
  CRISPR gRNA sequence
accaaaagacaatcactgga

SEQ ID NO: 120086 - DNA, 20 bp, Artificial
  CRISPR gRNA sequence
ccaaaagacaatcactggaa

SEQ ID NO: 120087 - DNA, 20 bp, Artificial
  CRISPR gRNA sequence
gaactattctgctgccttgc

SEQ ID NO: 120088 - DNA, 20 bp, Artificial
  CRISPR gRNA sequence
ttctgctgccttgctagaaa

SEQ ID NO: 120089 - DNA, 20 bp, Artificial
  CRISPR gRNA sequence
tgctgccttgctagaaaagg

SEQ ID NO: 120090 - DNA, 20 bp, Artificial
  CRISPR gRNA sequence
ctgccttgctagaaaaggaa

SEQ ID NO: 120091 - DNA, 20 bp, Artificial
  CRISPR gRNA sequence
ccttgctagaaaaggaaaag

SEQ ID NO: 120092 - DNA, 20 bp, Artificial
  CRISPR gRNA sequence
gctagaaaaggaaaaggtag

SEQ ID NO: 120093 - DNA, 20 bp, Artificial
  CRISPR gRNA sequence
ctagaaaaggaaaaggtaga

SEQ ID NO: 120094 - DNA, 20 bp, Artificial
  CRISPR gRNA sequence
gaaaaggaaaaggtagaaaa

SEQ ID NO: 120095 - DNA, 20 bp, Artificial
  CRISPR gRNA sequence
agaaaatatatgtctcaagt

SEQ ID NO: 120096 - DNA, 20 bp, Artificial
  CRISPR gRNA sequence
aagtcctcaagttatcttta

SEQ ID NO: 120097 - DNA, 20 bp, Artificial
  CRISPR gRNA sequence
aagttatctttaaatatcta

SEQ ID NO: 120098 - DNA, 20 bp, Artificial
  CRISPR gRNA sequence
tctttaaatatctatgaatc

SEQ ID NO: 120099 - DNA, 20 bp, Artificial
  CRISPR gRNA sequence
taaatatctatgaatcctgt

SEQ ID NO: 120100 - DNA, 20 bp, Artificial
  CRISPR gRNA sequence
aaatatctatgaatcctgtt

SEQ ID NO: 120101 - DNA, 20 bp, Artificial
  CRISPR gRNA sequence
aatatctatgaatcctgtta

SEQ ID NO: 120102 - DNA, 20 bp, Artificial
  CRISPR gRNA sequence
tgaatcctgttactaaatgc

SEQ ID NO: 120103 - DNA, 20 bp, Artificial
  CRISPR gRNA sequence
ttactaaatgccaagctcaa

SEQ ID NO: 120104 - DNA, 20 bp, Artificial
  CRISPR gRNA sequence
ctaaatgccaagctcaatac

SEQ ID NO: 120105 - DNA, 20 bp, Artificial
  CRISPR gRNA sequence
aatgccaagctcaatacttt

SEQ ID NO: 120106 - DNA, 20 bp, Artificial
  CRISPR gRNA sequence
aatactttaaggtcagacat

SEQ ID NO: 120107 - DNA, 20 bp, Artificial
  CRISPR gRNA sequence
taaggtcagacataatggag

SEQ ID NO: 120108 - DNA, 20 bp, Artificial
  CRISPR gRNA sequence
aaggtcagacataatggaga

SEQ ID NO: 120109 - DNA, 20 bp, Artificial
  CRISPR gRNA sequence
aggtcagacataatggagaa

SEQ ID NO: 120110 - DNA, 20 bp, Artificial
  CRISPR gRNA sequence
tgagaagtctcaatagatat

SEQ ID NO: 120111 - DNA, 20 bp, Artificial
  CRISPR gRNA sequence
gagaagtctcaatagatata

SEQ ID NO: 120112 - DNA, 20 bp, Artificial
  CRISPR gRNA sequence
agaagtctcaatagatataa

SEQ ID NO: 120113 - DNA, 20 bp, Artificial
  CRISPR gRNA sequence
aatagatataaggcatttgt

SEQ ID NO: 120114 - DNA, 20 bp, Artificial
  CRISPR gRNA sequence
gtcaccaaacacgggctaaa

SEQ ID NO: 120115 - DNA, 20 bp, Artificial
  CRISPR gRNA sequence
tcaccaaacacgggctaaat

SEQ ID NO: 120116 - DNA, 20 bp, Artificial
  CRISPR gRNA sequence
aatccatgacaaacatttaa

SEQ ID NO: 120117 - DNA, 20 bp, Artificial
  CRISPR gRNA sequence
aatcataatggcaaggttag

SEQ ID NO: 120118 - DNA, 20 bp, Artificial
  CRISPR gRNA sequence
atcataatggcaaggttagt

SEQ ID NO: 120119 - DNA, 20 bp, Artificial
  CRISPR gRNA sequence
gttgcctgtttaaaccaatc

SEQ ID NO: 120120 - DNA, 20 bp, Artificial
  CRISPR gRNA sequence
cctgtttaaaccaatccagg

SEQ ID NO: 120121 - DNA, 20 bp, Artificial
  CRISPR gRNA sequence
tttaaaccaatccaggaatg

SEQ ID NO: 120122 - DNA, 20 bp, Artificial
  CRISPR gRNA sequence
aaaccaatccaggaatggtc

SEQ ID NO: 120123 - DNA, 20 bp, Artificial
  CRISPR gRNA sequence
aaccaatccaggaatggtct

SEQ ID NO: 120124 - DNA, 20 bp, Artificial
  CRISPR gRNA sequence
tagtgaaggctggagagaag

SEQ ID NO: 120125 - DNA, 20 bp, Artificial
  CRISPR gRNA sequence
gagagaaggcaatgagaggg

SEQ ID NO: 120126 - DNA, 20 bp, Artificial
  CRISPR gRNA sequence
agtacaaattctaaataaag

SEQ ID NO: 120127 - DNA, 20 bp, Artificial
  CRISPR gRNA sequence
taaataaagtgaagaaggta

SEQ ID NO: 120128 - DNA, 20 bp, Artificial
  CRISPR gRNA sequence
aataaagtgaagaaggtaaa

SEQ ID NO: 120129 - DNA, 20 bp, Artificial
  CRISPR gRNA sequence
tacccagcaatgactctagg

SEQ ID NO: 120130 - DNA, 20 bp, Artificial
  CRISPR gRNA sequence
taggaggctgggtagcaagc

SEQ ID NO: 120131 - DNA, 20 bp, Artificial
  CRISPR gRNA sequence
ggaggctgggtagcaagcag

SEQ ID NO: 120132 - DNA, 20 bp, Artificial
  CRISPR gRNA sequence
ggtagcaagcagctctggaa

SEQ ID NO: 120133 - DNA, 20 bp, Artificial
  CRISPR gRNA sequence
tggaagcttatgtagaggat

SEQ ID NO: 120134 - DNA, 20 bp, Artificial
  CRISPR gRNA sequence
gaagcttatgtagaggatga

SEQ ID NO: 120135 - DNA, 20 bp, Artificial
  CRISPR gRNA sequence
atgtagaggatgaccctttt

SEQ ID NO: 120136 - DNA, 20 bp, Artificial
  CRISPR gRNA sequence
tgtagaggatgacccttttt

SEQ ID NO: 120137 - DNA, 20 bp, Artificial
  CRISPR gRNA sequence
ttttccctacagtctctcaa

SEQ ID NO: 120138 - DNA, 20 bp, Artificial
  CRISPR gRNA sequence
tttccctacagtctctcaag

SEQ ID NO: 120139 - DNA, 20 bp, Artificial
  CRISPR gRNA sequence
ttccctacagtctctcaagc

SEQ ID NO: 120140 - DNA, 20 bp, Artificial
  CRISPR gRNA sequence
tccctacagtctctcaagct

SEQ ID NO: 120141 - DNA, 20 bp, Artificial
  CRISPR gRNA sequence
ccctacagtctctcaagcta

SEQ ID NO: 120142 - DNA, 20 bp, Artificial
  CRISPR gRNA sequence
cctacagtctctcaagctaa

SEQ ID NO: 120143 - DNA, 20 bp, Artificial
  CRISPR gRNA sequence
cagtctctcaagctaaaatg

SEQ ID NO: 120144 - DNA, 20 bp, Artificial
  CRISPR gRNA sequence
tcaagctaaaatgaaatgtc

SEQ ID NO: 120145 - DNA, 20 bp, Artificial
  CRISPR gRNA sequence
aagctaaaatgaaatgtcaa

SEQ ID NO: 120146 - DNA, 20 bp, Artificial
  CRISPR gRNA sequence
aaatgaaatgtcaaatgtat

SEQ ID NO: 120147 - DNA, 20 bp, Artificial
  CRISPR gRNA sequence
tatcctgctcattttactct

SEQ ID NO: 120148 - DNA, 20 bp, Artificial
  CRISPR gRNA sequence
atcctgctcattttactctg

SEQ ID NO: 120149 - DNA, 20 bp, Artificial
  CRISPR gRNA sequence
tcctgctcattttactctgt

SEQ ID NO: 120150 - DNA, 20 bp, Artificial
  CRISPR gRNA sequence
ctcattttactctgtgaatt

SEQ ID NO: 120151 - DNA, 20 bp, Artificial
  CRISPR gRNA sequence
attttactctgtgaattcta

SEQ ID NO: 120152 - DNA, 20 bp, Artificial
  CRISPR gRNA sequence
tactctgtgaattctagata

SEQ ID NO: 120153 - DNA, 20 bp, Artificial
  CRISPR gRNA sequence
actctgtgaattctagatat

SEQ ID NO: 120154 - DNA, 20 bp, Artificial
  CRISPR gRNA sequence
ctctgtgaattctagatatg

SEQ ID NO: 120155 - DNA, 20 bp, Artificial
  CRISPR gRNA sequence
tgtgaattctagatatgttt

SEQ ID NO: 120156 - DNA, 20 bp, Artificial
  CRISPR gRNA sequence
tgaattctagatatgtttgt

SEQ ID NO: 120157 - DNA, 20 bp, Artificial
  CRISPR gRNA sequence
tagatatgtttgttgtttaa

SEQ ID NO: 120158 - DNA, 20 bp, Artificial
  CRISPR gRNA sequence
gatatgtttgttgtttaaac

SEQ ID NO: 120159 - DNA, 20 bp, Artificial
  CRISPR gRNA sequence
gttgtttaaactcactacta

SEQ ID NO: 120160 - DNA, 20 bp, Artificial
  CRISPR gRNA sequence
ttgtttaaactcactactaa

SEQ ID NO: 120161 - DNA, 20 bp, Artificial
  CRISPR gRNA sequence
tttaaactcactactaaaga

SEQ ID NO: 120162 - DNA, 20 bp, Artificial
  CRISPR gRNA sequence
aaactcactactaaagattt

SEQ ID NO: 120163 - DNA, 20 bp, Artificial
  CRISPR gRNA sequence
aactcactactaaagatttc

SEQ ID NO: 120164 - DNA, 20 bp, Artificial
  CRISPR gRNA sequence
actactaaagatttcttaaa

SEQ ID NO: 120165 - DNA, 20 bp, Artificial
  CRISPR gRNA sequence
ctaaagatttcttaaaagca

SEQ ID NO: 120166 - DNA, 20 bp, Artificial
  CRISPR gRNA sequence
aagatttcttaaaagcactt

SEQ ID NO: 120167 - DNA, 20 bp, Artificial
  CRISPR gRNA sequence
cttaaaagcactttctggtc

SEQ ID NO: 120168 - DNA, 20 bp, Artificial
  CRISPR gRNA sequence
ttaaaagcactttctggtca

SEQ ID NO: 120169 - DNA, 20 bp, Artificial
  CRISPR gRNA sequence
aaaagcactttctggtcagt

SEQ ID NO: 120170 - DNA, 20 bp, Artificial
  CRISPR gRNA sequence
aaagcactttctggtcagtt

SEQ ID NO: 120171 - DNA, 20 bp, Artificial
  CRISPR gRNA sequence
tctggtcagtttgcagtctc

SEQ ID NO: 120172 - DNA, 20 bp, Artificial
  CRISPR gRNA sequence
ctggtcagtttgcagtctcc

SEQ ID NO: 120173 - DNA, 20 bp, Artificial
  CRISPR gRNA sequence
tggtcagtttgcagtctcca

SEQ ID NO: 120174 - DNA, 20 bp, Artificial
  CRISPR gRNA sequence
gtcagtttgcagtctccatg

SEQ ID NO: 120175 - DNA, 20 bp, Artificial
  CRISPR gRNA sequence
gcagtctccatggtggaatt

SEQ ID NO: 120176 - DNA, 20 bp, Artificial
  CRISPR gRNA sequence
cagtctccatggtggaattc

SEQ ID NO: 120177 - DNA, 20 bp, Artificial
  CRISPR gRNA sequence
catggtggaattcctcactg

SEQ ID NO: 120178 - DNA, 20 bp, Artificial
  CRISPR gRNA sequence
ctcactggcctctataatat

SEQ ID NO: 120179 - DNA, 20 bp, Artificial
  CRISPR gRNA sequence
actggcctctataatatcca

SEQ ID NO: 120180 - DNA, 20 bp, Artificial
  CRISPR gRNA sequence
gcctctataatatccacatg

SEQ ID NO: 120181 - DNA, 20 bp, Artificial
  CRISPR gRNA sequence
tataatatccacatggttat

SEQ ID NO: 120182 - DNA, 20 bp, Artificial
  CRISPR gRNA sequence
taatatccacatggttattt

SEQ ID NO: 120183 - DNA, 20 bp, Artificial
  CRISPR gRNA sequence
ttttagctttatcagaagca

SEQ ID NO: 120184 - DNA, 20 bp, Artificial
  CRISPR gRNA sequence
tagctttatcagaagcaaca

SEQ ID NO: 120185 - DNA, 20 bp, Artificial
  CRISPR gRNA sequence
agctttatcagaagcaacaa

SEQ ID NO: 120186 - DNA, 20 bp, Artificial
  CRISPR gRNA sequence
gctttatcagaagcaacaac

SEQ ID NO: 120187 - DNA, 20 bp, Artificial
  CRISPR gRNA sequence
tatcagaagcaacaacaaat

SEQ ID NO: 120188 - DNA, 20 bp, Artificial
  CRISPR gRNA sequence
atcagaagcaacaacaaata

SEQ ID NO: 120189 - DNA, 20 bp, Artificial
  CRISPR gRNA sequence
tcagaagcaacaacaaatat

SEQ ID NO: 120190 - DNA, 20 bp, Artificial
  CRISPR gRNA sequence
aaattacacagagcagtcaa

SEQ ID NO: 120191 - DNA, 20 bp, Artificial
  CRISPR gRNA sequence
cacagagcagtcaagtgtac

SEQ ID NO: 120192 - DNA, 20 bp, Artificial
  CRISPR gRNA sequence
caagctcctatgagtaaaca

SEQ ID NO: 120193 - DNA, 20 bp, Artificial
  CRISPR gRNA sequence
aagctcctatgagtaaacag

SEQ ID NO: 120194 - DNA, 20 bp, Artificial
  CRISPR gRNA sequence
ctatgagtaaacagactact

SEQ ID NO: 120195 - DNA, 20 bp, Artificial
  CRISPR gRNA sequence
tgagtaaacagactactgta

SEQ ID NO: 120196 - DNA, 20 bp, Artificial
  CRISPR gRNA sequence
ctgtaggagccaggtcacta

SEQ ID NO: 120197 - DNA, 20 bp, Artificial
  CRISPR gRNA sequence
taggagccaggtcactacaa

SEQ ID NO: 120198 - DNA, 20 bp, Artificial
  CRISPR gRNA sequence
caagtgctctgtcacatctt

SEQ ID NO: 120199 - DNA, 20 bp, Artificial
  CRISPR gRNA sequence
tgtcacatcttaagtcccaa

SEQ ID NO: 120200 - DNA, 20 bp, Artificial
  CRISPR gRNA sequence
tcacatcttaagtcccaata

SEQ ID NO: 120201 - DNA, 20 bp, Artificial
  CRISPR gRNA sequence
aagtcccaatacaaaaatac

SEQ ID NO: 120202 - DNA, 20 bp, Artificial
  CRISPR gRNA sequence
agtcccaatacaaaaatacc

SEQ ID NO: 120203 - DNA, 20 bp, Artificial
  CRISPR gRNA sequence
atagaatgctttctggaagc

SEQ ID NO: 120204 - DNA, 20 bp, Artificial
  CRISPR gRNA sequence
tctggaagcactttaaaagt

SEQ ID NO: 120205 - DNA, 20 bp, Artificial
  CRISPR gRNA sequence
ctggaagcactttaaaagtg

SEQ ID NO: 120206 - DNA, 20 bp, Artificial
  CRISPR gRNA sequence
tggaagcactttaaaagtgc

SEQ ID NO: 120207 - DNA, 20 bp, Artificial
  CRISPR gRNA sequence
gaagcactttaaaagtgctt

SEQ ID NO: 120208 - DNA, 20 bp, Artificial
  CRISPR gRNA sequence
taaaagtgctttagaagtaa

SEQ ID NO: 120209 - DNA, 20 bp, Artificial
  CRISPR gRNA sequence
aaaagtgctttagaagtaaa

SEQ ID NO: 120210 - DNA, 20 bp, Artificial
  CRISPR gRNA sequence
aaagtgctttagaagtaaac

SEQ ID NO: 120211 - DNA, 20 bp, Artificial
  CRISPR gRNA sequence
tagaagtaaactgtaatgat

SEQ ID NO: 120212 - DNA, 20 bp, Artificial
  CRISPR gRNA sequence
agaagtaaactgtaatgatc

SEQ ID NO: 120213 - DNA, 20 bp, Artificial
  CRISPR gRNA sequence
gaagtaaactgtaatgatcc

SEQ ID NO: 120214 - DNA, 20 bp, Artificial
  CRISPR gRNA sequence
taatgatccatggaatagtc

SEQ ID NO: 120215 - DNA, 20 bp, Artificial
  CRISPR gRNA sequence
tcattttcagactctatctt

SEQ ID NO: 120216 - DNA, 20 bp, Artificial
  CRISPR gRNA sequence
cattttcagactctatcttt

SEQ ID NO: 120217 - DNA, 20 bp, Artificial
  CRISPR gRNA sequence
attttcagactctatctttg

SEQ ID NO: 120218 - DNA, 20 bp, Artificial
  CRISPR gRNA sequence
tcagactctatctttgacag

SEQ ID NO: 120219 - DNA, 20 bp, Artificial
  CRISPR gRNA sequence
cagactctatctttgacaga

SEQ ID NO: 120220 - DNA, 20 bp, Artificial
  CRISPR gRNA sequence
agactctatctttgacagaa

SEQ ID NO: 120221 - DNA, 20 bp, Artificial
  CRISPR gRNA sequence
tatctttgacagaaattact

SEQ ID NO: 120222 - DNA, 20 bp, Artificial
  CRISPR gRNA sequence
tctttgacagaaattactta

SEQ ID NO: 120223 - DNA, 20 bp, Artificial
  CRISPR gRNA sequence
tgacagaaattacttagaac

SEQ ID NO: 120224 - DNA, 20 bp, Artificial
  CRISPR gRNA sequence
gacagaaattacttagaaca

SEQ ID NO: 120225 - DNA, 20 bp, Artificial
  CRISPR gRNA sequence
acagaaattacttagaacag

SEQ ID NO: 120226 - DNA, 20 bp, Artificial
  CRISPR gRNA sequence
cttagaacagaatattcatg

SEQ ID NO: 120227 - DNA, 20 bp, Artificial
  CRISPR gRNA sequence
agaacagaatattcatgact

SEQ ID NO: 120228 - DNA, 20 bp, Artificial
  CRISPR gRNA sequence
gaacagaatattcatgactg

SEQ ID NO: 120229 - DNA, 20 bp, Artificial
  CRISPR gRNA sequence
atgactgaaatattcacact

SEQ ID NO: 120230 - DNA, 20 bp, Artificial
  CRISPR gRNA sequence
aaatattcacacttaatgaa

SEQ ID NO: 120231 - DNA, 20 bp, Artificial
  CRISPR gRNA sequence
acacttaatgaaagtatgtg

SEQ ID NO: 120232 - DNA, 20 bp, Artificial
  CRISPR gRNA sequence
aatgaaagtatgtgcaagta

SEQ ID NO: 120233 - DNA, 20 bp, Artificial
  CRISPR gRNA sequence
atgaaagtatgtgcaagtaa

SEQ ID NO: 120234 - DNA, 20 bp, Artificial
  CRISPR gRNA sequence
gttaacagatcattctgtcc

SEQ ID NO: 120235 - DNA, 20 bp, Artificial
  CRISPR gRNA sequence
acagatcattctgtcctaga

SEQ ID NO: 120236 - DNA, 20 bp, Artificial
  CRISPR gRNA sequence
tgtcctagatgagtaggtta

SEQ ID NO: 120237 - DNA, 20 bp, Artificial
  CRISPR gRNA sequence
tcctagatgagtaggttaga

SEQ ID NO: 120238 - DNA, 20 bp, Artificial
  CRISPR gRNA sequence
gatgagtaggttagatagta

SEQ ID NO: 120239 - DNA, 20 bp, Artificial
  CRISPR gRNA sequence
gatagtaaggtcctcctaca

SEQ ID NO: 120240 - DNA, 20 bp, Artificial
  CRISPR gRNA sequence
ctacaatcaccaccaccacc

SEQ ID NO: 120241 - DNA, 20 bp, Artificial
  CRISPR gRNA sequence
caatcaccaccaccaccgcc

SEQ ID NO: 120242 - DNA, 20 bp, Artificial
  CRISPR gRNA sequence
ccaccaccactaatgtatta

SEQ ID NO: 120243 - DNA, 20 bp, Artificial
  CRISPR gRNA sequence
atgtattagaatcaccagga

SEQ ID NO: 120244 - DNA, 20 bp, Artificial
  CRISPR gRNA sequence
gaatcaccaggaacattgaa

SEQ ID NO: 120245 - DNA, 20 bp, Artificial
  CRISPR gRNA sequence
aaatcctaagttttgttaaa

SEQ ID NO: 120246 - DNA, 20 bp, Artificial
  CRISPR gRNA sequence
agttttgttaaactgtccat

SEQ ID NO: 120247 - DNA, 20 bp, Artificial
  CRISPR gRNA sequence
tgttaaactgtccattgaga

SEQ ID NO: 120248 - DNA, 20 bp, Artificial
  CRISPR gRNA sequence
gttaaactgtccattgagaa

SEQ ID NO: 120249 - DNA, 20 bp, Artificial
  CRISPR gRNA sequence
ttaaactgtccattgagaac

SEQ ID NO: 120250 - DNA, 20 bp, Artificial
  CRISPR gRNA sequence
aactgtccattgagaacctt

SEQ ID NO: 120251 - DNA, 20 bp, Artificial
  CRISPR gRNA sequence
tccattgagaacctttactt

SEQ ID NO: 120252 - DNA, 20 bp, Artificial
  CRISPR gRNA sequence
agaacctttactttactttt

SEQ ID NO: 120253 - DNA, 20 bp, Artificial
  CRISPR gRNA sequence
tactttacttttttaaggac

SEQ ID NO: 120254 - DNA, 20 bp, Artificial
  CRISPR gRNA sequence
actttacttttttaaggact

SEQ ID NO: 120255 - DNA, 20 bp, Artificial
  CRISPR gRNA sequence
ctttacttttttaaggactt

SEQ ID NO: 120256 - DNA, 20 bp, Artificial
  CRISPR gRNA sequence
tacttttttaaggactttac

SEQ ID NO: 120257 - DNA, 20 bp, Artificial
  CRISPR gRNA sequence
acttttttaaggactttaca

SEQ ID NO: 120258 - DNA, 20 bp, Artificial
  CRISPR gRNA sequence
cttttttaaggactttacag

SEQ ID NO: 120259 - DNA, 20 bp, Artificial
  CRISPR gRNA sequence
ttttaaggactttacagcct

SEQ ID NO: 120260 - DNA, 20 bp, Artificial
  CRISPR gRNA sequence
tttaaggactttacagcctg

SEQ ID NO: 120261 - DNA, 20 bp, Artificial
  CRISPR gRNA sequence
ttaaggactttacagcctga

SEQ ID NO: 120262 - DNA, 20 bp, Artificial
  CRISPR gRNA sequence
taaggactttacagcctgac

SEQ ID NO: 120263 - DNA, 20 bp, Artificial
  CRISPR gRNA sequence
aaggactttacagcctgact

SEQ ID NO: 120264 - DNA, 20 bp, Artificial
  CRISPR gRNA sequence
aggactttacagcctgactc

SEQ ID NO: 120265 - DNA, 20 bp, Artificial
  CRISPR gRNA sequence
tacagcctgactctctcatg

SEQ ID NO: 120266 - DNA, 20 bp, Artificial
  CRISPR gRNA sequence
acagcctgactctctcatgc

SEQ ID NO: 120267 - DNA, 20 bp, Artificial
  CRISPR gRNA sequence
cagcctgactctctcatgct

SEQ ID NO: 120268 - DNA, 20 bp, Artificial
  CRISPR gRNA sequence
actctctcatgctatctctt

SEQ ID NO: 120269 - DNA, 20 bp, Artificial
  CRISPR gRNA sequence
tctcatgctatctctttccc

SEQ ID NO: 120270 - DNA, 20 bp, Artificial
  CRISPR gRNA sequence
tcatgctatctctttccctt

SEQ ID NO: 120271 - DNA, 20 bp, Artificial
  CRISPR gRNA sequence
atgctatctctttcccttat

SEQ ID NO: 120272 - DNA, 20 bp, Artificial
  CRISPR gRNA sequence
tctctttcccttatttcccc

SEQ ID NO: 120273 - DNA, 20 bp, Artificial
  CRISPR gRNA sequence
tttcccttatttccccattc

SEQ ID NO: 120274 - DNA, 20 bp, Artificial
  CRISPR gRNA sequence
tcccttatttccccattcca

SEQ ID NO: 120275 - DNA, 20 bp, Artificial
  CRISPR gRNA sequence
cccttatttccccattccaa

SEQ ID NO: 120276 - DNA, 20 bp, Artificial
  CRISPR gRNA sequence
ccttatttccccattccaaa

SEQ ID NO: 120277 - DNA, 20 bp, Artificial
  CRISPR gRNA sequence
atttccccattccaaatcaa

SEQ ID NO: 120278 - DNA, 20 bp, Artificial
  CRISPR gRNA sequence
tttccccattccaaatcaaa

SEQ ID NO: 120279 - DNA, 20 bp, Artificial
  CRISPR gRNA sequence
ccccattccaaatcaaatcc

SEQ ID NO: 120280 - DNA, 20 bp, Artificial
  CRISPR gRNA sequence
cccattccaaatcaaatccc

SEQ ID NO: 120281 - DNA, 20 bp, Artificial
  CRISPR gRNA sequence
caaatcaaatcccctttgct

SEQ ID NO: 120282 - DNA, 20 bp, Artificial
  CRISPR gRNA sequence
tgctacaccaaatgcttgca

SEQ ID NO: 120283 - DNA, 20 bp, Artificial
  CRISPR gRNA sequence
gctacaccaaatgcttgcat

SEQ ID NO: 120284 - DNA, 20 bp, Artificial
  CRISPR gRNA sequence
ctacaccaaatgcttgcata

SEQ ID NO: 120285 - DNA, 20 bp, Artificial
  CRISPR gRNA sequence
caccaaatgcttgcatattc

SEQ ID NO: 120286 - DNA, 20 bp, Artificial
  CRISPR gRNA sequence
gcatattctgtatcaagaaa

SEQ ID NO: 120287 - DNA, 20 bp, Artificial
  CRISPR gRNA sequence
catattctgtatcaagaaag

SEQ ID NO: 120288 - DNA, 20 bp, Artificial
  CRISPR gRNA sequence
tgtatcaagaaagatttctc

SEQ ID NO: 120289 - DNA, 20 bp, Artificial
  CRISPR gRNA sequence
tatcaagaaagatttctcag

SEQ ID NO: 120290 - DNA, 20 bp, Artificial
  CRISPR gRNA sequence
ctcagaatacatatagcaag

SEQ ID NO: 120291 - DNA, 20 bp, Artificial
  CRISPR gRNA sequence
tcagaatacatatagcaaga

SEQ ID NO: 120292 - DNA, 20 bp, Artificial
  CRISPR gRNA sequence
agaatacatatagcaagaat

SEQ ID NO: 120293 - DNA, 20 bp, Artificial
  CRISPR gRNA sequence
tttaaaattctcccaaaata

SEQ ID NO: 120294 - DNA, 20 bp, Artificial
  CRISPR gRNA sequence
aaaattctcccaaaataatc

SEQ ID NO: 120295 - DNA, 20 bp, Artificial
  CRISPR gRNA sequence
aaattctcccaaaataatca

SEQ ID NO: 120296 - DNA, 20 bp, Artificial
  CRISPR gRNA sequence
tcccaaaataatcagatccc

SEQ ID NO: 120297 - DNA, 20 bp, Artificial
  CRISPR gRNA sequence
ccaaaataatcagatcccta

SEQ ID NO: 120298 - DNA, 20 bp, Artificial
  CRISPR gRNA sequence
gaggaaaggtttctattatt

SEQ ID NO: 120299 - DNA, 20 bp, Artificial
  CRISPR gRNA sequence
ctattatttccataaagtgt

SEQ ID NO: 120300 - DNA, 20 bp, Artificial
  CRISPR gRNA sequence
tattatttccataaagtgtt

SEQ ID NO: 120301 - DNA, 20 bp, Artificial
  CRISPR gRNA sequence
ttatttccataaagtgtttc

SEQ ID NO: 120302 - DNA, 20 bp, Artificial
  CRISPR gRNA sequence
tttccataaagtgtttccac

SEQ ID NO: 120303 - DNA, 20 bp, Artificial
  CRISPR gRNA sequence
ccataaagtgtttccacttc

SEQ ID NO: 120304 - DNA, 20 bp, Artificial
  CRISPR gRNA sequence
cataaagtgtttccacttct

SEQ ID NO: 120305 - DNA, 20 bp, Artificial
  CRISPR gRNA sequence
ccacttcttttaaataaaat

SEQ ID NO: 120306 - DNA, 20 bp, Artificial
  CRISPR gRNA sequence
cacttcttttaaataaaatc

SEQ ID NO: 120307 - DNA, 20 bp, Artificial
  CRISPR gRNA sequence
cttttaaataaaatctatgt

SEQ ID NO: 120308 - DNA, 20 bp, Artificial
  CRISPR gRNA sequence
ttttaaataaaatctatgta

SEQ ID NO: 120309 - DNA, 20 bp, Artificial
  CRISPR gRNA sequence
ttaaataaaatctatgtaag

SEQ ID NO: 120310 - DNA, 20 bp, Artificial
  CRISPR gRNA sequence
taaataaaatctatgtaagt

SEQ ID NO: 120311 - DNA, 20 bp, Artificial
  CRISPR gRNA sequence
aaataaaatctatgtaagta

SEQ ID NO: 120312 - DNA, 20 bp, Artificial
  CRISPR gRNA sequence
aataaaatctatgtaagtag

SEQ ID NO: 120313 - DNA, 20 bp, Artificial
  CRISPR gRNA sequence
tgtaagtaggaaacacaagt

SEQ ID NO: 120314 - DNA, 20 bp, Artificial
  CRISPR gRNA sequence
taagatacagctattaataa

SEQ ID NO: 120315 - DNA, 20 bp, Artificial
  CRISPR gRNA sequence
aagatacagctattaataat

SEQ ID NO: 120316 - DNA, 20 bp, Artificial
  CRISPR gRNA sequence
agatacagctattaataatt

SEQ ID NO: 120317 - DNA, 20 bp, Artificial
  CRISPR gRNA sequence
ttaataattttctatctatt

SEQ ID NO: 120318 - DNA, 20 bp, Artificial
  CRISPR gRNA sequence
ataattttctatctattcat

SEQ ID NO: 120319 - DNA, 20 bp, Artificial
  CRISPR gRNA sequence
tctatctattcatcatctta

SEQ ID NO: 120320 - DNA, 20 bp, Artificial
  CRISPR gRNA sequence
ctatctattcatcatcttaa

SEQ ID NO: 120321 - DNA, 20 bp, Artificial
  CRISPR gRNA sequence
tatctattcatcatcttaat

SEQ ID NO: 120322 - DNA, 20 bp, Artificial
  CRISPR gRNA sequence
tctattcatcatcttaattt

SEQ ID NO: 120323 - DNA, 20 bp, Artificial
  CRISPR gRNA sequence
ttcatcatcttaatttcctc

SEQ ID NO: 120324 - DNA, 20 bp, Artificial
  CRISPR gRNA sequence
atcatcttaatttcctcccc

SEQ ID NO: 120325 - DNA, 20 bp, Artificial
  CRISPR gRNA sequence
aatttcctccccaattgatg

SEQ ID NO: 120326 - DNA, 20 bp, Artificial
  CRISPR gRNA sequence
atttcctccccaattgatgt

SEQ ID NO: 120327 - DNA, 20 bp, Artificial
  CRISPR gRNA sequence
cctccccaattgatgtgcta

SEQ ID NO: 120328 - DNA, 20 bp, Artificial
  CRISPR gRNA sequence
ctccccaattgatgtgctat

SEQ ID NO: 120329 - DNA, 20 bp, Artificial
  CRISPR gRNA sequence
cccaattgatgtgctattcg

SEQ ID NO: 120330 - DNA, 20 bp, Artificial
  CRISPR gRNA sequence
atgtgctattcgtgcacatg

SEQ ID NO: 120331 - DNA, 20 bp, Artificial
  CRISPR gRNA sequence
ttcgtgcacatgataaatga

SEQ ID NO: 120332 - DNA, 20 bp, Artificial
  CRISPR gRNA sequence
gtgcacatgataaatgattt

SEQ ID NO: 120333 - DNA, 20 bp, Artificial
  CRISPR gRNA sequence
gagactccaaagagctcact

SEQ ID NO: 120334 - DNA, 20 bp, Artificial
  CRISPR gRNA sequence
agactccaaagagctcactg

SEQ ID NO: 120335 - DNA, 20 bp, Artificial
  CRISPR gRNA sequence
caaagagctcactgtattta

SEQ ID NO: 120336 - DNA, 20 bp, Artificial
  CRISPR gRNA sequence
actgtatttacaacagaaaa

SEQ ID NO: 120337 - DNA, 20 bp, Artificial
  CRISPR gRNA sequence
tatttacaacagaaaaatgt

SEQ ID NO: 120338 - DNA, 20 bp, Artificial
  CRISPR gRNA sequence
acaacagaaaaatgttacaa

SEQ ID NO: 120339 - DNA, 20 bp, Artificial
  CRISPR gRNA sequence
caacagaaaaatgttacaaa

SEQ ID NO: 120340 - DNA, 20 bp, Artificial
  CRISPR gRNA sequence
caaagacacatgcatcaaac

SEQ ID NO: 120341 - DNA, 20 bp, Artificial
  CRISPR gRNA sequence
agagcatgttacattcctat

SEQ ID NO: 120342 - DNA, 20 bp, Artificial
  CRISPR gRNA sequence
cattcctattccacaagggg

SEQ ID NO: 120343 - DNA, 20 bp, Artificial
  CRISPR gRNA sequence
ctattccacaaggggttaat

SEQ ID NO: 120344 - DNA, 20 bp, Artificial
  CRISPR gRNA sequence
ttccacaaggggttaatgac

SEQ ID NO: 120345 - DNA, 20 bp, Artificial
  CRISPR gRNA sequence
cacaaggggttaatgacaat

SEQ ID NO: 120346 - DNA, 20 bp, Artificial
  CRISPR gRNA sequence
atgacaatccaaaatactgt

SEQ ID NO: 120347 - DNA, 20 bp, Artificial
  CRISPR gRNA sequence
ttttatatatgagtaagatg

SEQ ID NO: 120348 - DNA, 20 bp, Artificial
  CRISPR gRNA sequence
tatatatgagtaagatgaag

SEQ ID NO: 120349 - DNA, 20 bp, Artificial
  CRISPR gRNA sequence
atatatgagtaagatgaagc

SEQ ID NO: 120350 - DNA, 20 bp, Artificial
  CRISPR gRNA sequence
tatatgagtaagatgaagca

SEQ ID NO: 120351 - DNA, 20 bp, Artificial
  CRISPR gRNA sequence
acaagctgttggactgtgag

SEQ ID NO: 120352 - DNA, 20 bp, Artificial
  CRISPR gRNA sequence
ttggactgtgagatttgaac

SEQ ID NO: 120353 - DNA, 20 bp, Artificial
  CRISPR gRNA sequence
gactgtgagatttgaacaca

SEQ ID NO: 120354 - DNA, 20 bp, Artificial
  CRISPR gRNA sequence
tgagatttgaacacaatttt

SEQ ID NO: 120355 - DNA, 20 bp, Artificial
  CRISPR gRNA sequence
gaacacaattttggaatgcc

SEQ ID NO: 120356 - DNA, 20 bp, Artificial
  CRISPR gRNA sequence
aacacaattttggaatgcct

SEQ ID NO: 120357 - DNA, 20 bp, Artificial
  CRISPR gRNA sequence
tggaatgcctacaagctcag

SEQ ID NO: 120358 - DNA, 20 bp, Artificial
  CRISPR gRNA sequence
ggaatgcctacaagctcagt

SEQ ID NO: 120359 - DNA, 20 bp, Artificial
  CRISPR gRNA sequence
gaatgcctacaagctcagtt

SEQ ID NO: 120360 - DNA, 20 bp, Artificial
  CRISPR gRNA sequence
caagctcagtttctttcggc

SEQ ID NO: 120361 - DNA, 20 bp, Artificial
  CRISPR gRNA sequence
agtttctttcggcttaattt

SEQ ID NO: 120362 - DNA, 20 bp, Artificial
  CRISPR gRNA sequence
ctttcggcttaatttatgtt

SEQ ID NO: 120363 - DNA, 20 bp, Artificial
  CRISPR gRNA sequence
tttcggcttaatttatgttc

SEQ ID NO: 120364 - DNA, 20 bp, Artificial
  CRISPR gRNA sequence
tcggcttaatttatgttcaa

SEQ ID NO: 120365 - DNA, 20 bp, Artificial
  CRISPR gRNA sequence
cggcttaatttatgttcaaa

SEQ ID NO: 120366 - DNA, 20 bp, Artificial
  CRISPR gRNA sequence
ggcttaatttatgttcaaag

SEQ ID NO: 120367 - DNA, 20 bp, Artificial
  CRISPR gRNA sequence
aatttatgttcaaagttggc

SEQ ID NO: 120368 - DNA, 20 bp, Artificial
  CRISPR gRNA sequence
atttatgttcaaagttggct

SEQ ID NO: 120369 - DNA, 20 bp, Artificial
  CRISPR gRNA sequence
atgttcaaagttggctgtac

SEQ ID NO: 120370 - DNA, 20 bp, Artificial
  CRISPR gRNA sequence
tgttcaaagttggctgtaca

SEQ ID NO: 120371 - DNA, 20 bp, Artificial
  CRISPR gRNA sequence
aaagttggctgtacatcatt

SEQ ID NO: 120372 - DNA, 20 bp, Artificial
  CRISPR gRNA sequence
gctgtacatcattaccaaac

SEQ ID NO: 120373 - DNA, 20 bp, Artificial
  CRISPR gRNA sequence
tacatcattaccaaacacta

SEQ ID NO: 120374 - DNA, 20 bp, Artificial
  CRISPR gRNA sequence
ccaaacactattggtggcag

SEQ ID NO: 120375 - DNA, 20 bp, Artificial
  CRISPR gRNA sequence
ttggtggcaggggtaggggt

SEQ ID NO: 120376 - DNA, 20 bp, Artificial
  CRISPR gRNA sequence
gtggcaggggtaggggtggg

SEQ ID NO: 120377 - DNA, 20 bp, Artificial
  CRISPR gRNA sequence
aaaggataaagtgatgacaa

SEQ ID NO: 120378 - DNA, 20 bp, Artificial
  CRISPR gRNA sequence
tctgctggatgcttagcagc

SEQ ID NO: 120379 - DNA, 20 bp, Artificial
  CRISPR gRNA sequence
ctggatgcttagcagcacta

SEQ ID NO: 120380 - DNA, 20 bp, Artificial
  CRISPR gRNA sequence
gatgcttagcagcactagca

SEQ ID NO: 120381 - DNA, 20 bp, Artificial
  CRISPR gRNA sequence
agcagcactagcaataaagt

SEQ ID NO: 120382 - DNA, 20 bp, Artificial
  CRISPR gRNA sequence
gcagcactagcaataaagtg

SEQ ID NO: 120383 - DNA, 20 bp, Artificial
  CRISPR gRNA sequence
gcaataaagtgagatgccag

SEQ ID NO: 120384 - DNA, 20 bp, Artificial
  CRISPR gRNA sequence
tacattctagattctacttt

SEQ ID NO: 120385 - DNA, 20 bp, Artificial
  CRISPR gRNA sequence
cattctagattctactttga

SEQ ID NO: 120386 - DNA, 20 bp, Artificial
  CRISPR gRNA sequence
tagattctactttgaatcat

SEQ ID NO: 120387 - DNA, 20 bp, Artificial
  CRISPR gRNA sequence
gattctactttgaatcattt

SEQ ID NO: 120388 - DNA, 20 bp, Artificial
  CRISPR gRNA sequence
tactttgaatcatttctaat

SEQ ID NO: 120389 - DNA, 20 bp, Artificial
  CRISPR gRNA sequence
ctttgaatcatttctaattc

SEQ ID NO: 120390 - DNA, 20 bp, Artificial
  CRISPR gRNA sequence
tgaatcatttctaattcaat

SEQ ID NO: 120391 - DNA, 20 bp, Artificial
  CRISPR gRNA sequence
gaatcatttctaattcaatg

SEQ ID NO: 120392 - DNA, 20 bp, Artificial
  CRISPR gRNA sequence
aatcatttctaattcaatgg

SEQ ID NO: 120393 - DNA, 20 bp, Artificial
  CRISPR gRNA sequence
ctaattcaatggagggaaaa

SEQ ID NO: 120394 - DNA, 20 bp, Artificial
  CRISPR gRNA sequence
taattcaatggagggaaaaa

SEQ ID NO: 120395 - DNA, 20 bp, Artificial
  CRISPR gRNA sequence
attcaatggagggaaaaagt

SEQ ID NO: 120396 - DNA, 20 bp, Artificial
  CRISPR gRNA sequence
aatggagggaaaaagtaggg

SEQ ID NO: 120397 - DNA, 20 bp, Artificial
  CRISPR gRNA sequence
gccaatttctcaaaaataga

SEQ ID NO: 120398 - DNA, 20 bp, Artificial
  CRISPR gRNA sequence
ccaatttctcaaaaatagag

SEQ ID NO: 120399 - DNA, 20 bp, Artificial
  CRISPR gRNA sequence
ctcaaaaatagagttatttt

SEQ ID NO: 120400 - DNA, 20 bp, Artificial
  CRISPR gRNA sequence
tcaaaaatagagttatttta

SEQ ID NO: 120401 - DNA, 20 bp, Artificial
  CRISPR gRNA sequence
aaaaatagagttattttaat

SEQ ID NO: 120402 - DNA, 20 bp, Artificial
  CRISPR gRNA sequence
ttttaataaaagtaacctac

SEQ ID NO: 120403 - DNA, 20 bp, Artificial
  CRISPR gRNA sequence
taataaaagtaacctacata

SEQ ID NO: 120404 - DNA, 20 bp, Artificial
  CRISPR gRNA sequence
aataaaagtaacctacatac

SEQ ID NO: 120405 - DNA, 20 bp, Artificial
  CRISPR gRNA sequence
ataaaagtaacctacataca

SEQ ID NO: 120406 - DNA, 20 bp, Artificial
  CRISPR gRNA sequence
catacacagagtagactagt

SEQ ID NO: 120407 - DNA, 20 bp, Artificial
  CRISPR gRNA sequence
gtgctgctactcctgtgttt

SEQ ID NO: 120408 - DNA, 20 bp, Artificial
  CRISPR gRNA sequence
ctactcctgtgttttatagg

SEQ ID NO: 120409 - DNA, 20 bp, Artificial
  CRISPR gRNA sequence
ctcctgtgttttataggaac

SEQ ID NO: 120410 - DNA, 20 bp, Artificial
  CRISPR gRNA sequence
ctgtgttttataggaactgg

SEQ ID NO: 120411 - DNA, 20 bp, Artificial
  CRISPR gRNA sequence
tgttttataggaactggcca

SEQ ID NO: 120412 - DNA, 20 bp, Artificial
  CRISPR gRNA sequence
tataggaactggccaaatta

SEQ ID NO: 120413 - DNA, 20 bp, Artificial
  CRISPR gRNA sequence
ataggaactggccaaattag

SEQ ID NO: 120414 - DNA, 20 bp, Artificial
  CRISPR gRNA sequence
taggaactggccaaattaga

SEQ ID NO: 120415 - DNA, 20 bp, Artificial
  CRISPR gRNA sequence
gccaaattagaacccaattt

SEQ ID NO: 120416 - DNA, 20 bp, Artificial
  CRISPR gRNA sequence
gaacccaatttaggatactt

SEQ ID NO: 120417 - DNA, 20 bp, Artificial
  CRISPR gRNA sequence
aggatacttagccatacacg

SEQ ID NO: 120418 - DNA, 20 bp, Artificial
  CRISPR gRNA sequence
ggatacttagccatacacga

SEQ ID NO: 120419 - DNA, 20 bp, Artificial
  CRISPR gRNA sequence
agccatacacgatgctaaag

SEQ ID NO: 120420 - DNA, 20 bp, Artificial
  CRISPR gRNA sequence
gccatacacgatgctaaaga

SEQ ID NO: 120421 - DNA, 20 bp, Artificial
  CRISPR gRNA sequence
aagaactgtattgattaacc

SEQ ID NO: 120422 - DNA, 20 bp, Artificial
  CRISPR gRNA sequence
tattgattaaccaagaatta

SEQ ID NO: 120423 - DNA, 20 bp, Artificial
  CRISPR gRNA sequence
attaaccaagaattatcaca

SEQ ID NO: 120424 - DNA, 20 bp, Artificial
  CRISPR gRNA sequence
accaagaattatcacagtgg

SEQ ID NO: 120425 - DNA, 20 bp, Artificial
  CRISPR gRNA sequence
tcacagtggctttaacacct

SEQ ID NO: 120426 - DNA, 20 bp, Artificial
  CRISPR gRNA sequence
taacacctaagacttacaga

SEQ ID NO: 120427 - DNA, 20 bp, Artificial
  CRISPR gRNA sequence
aacacctaagacttacagaa

SEQ ID NO: 120428 - DNA, 20 bp, Artificial
  CRISPR gRNA sequence
acacctaagacttacagaaa

SEQ ID NO: 120429 - DNA, 20 bp, Artificial
  CRISPR gRNA sequence
agacttacagaaagcacatc

SEQ ID NO: 120430 - DNA, 20 bp, Artificial
  CRISPR gRNA sequence
acagaaagcacatcctgctt

SEQ ID NO: 120431 - DNA, 20 bp, Artificial
  CRISPR gRNA sequence
cagaaagcacatcctgcttc

SEQ ID NO: 120432 - DNA, 20 bp, Artificial
  CRISPR gRNA sequence
cttctgcctaaccaagaggt

SEQ ID NO: 120433 - DNA, 20 bp, Artificial
  CRISPR gRNA sequence
ctgcctaaccaagaggtatc

SEQ ID NO: 120434 - DNA, 20 bp, Artificial
  CRISPR gRNA sequence
tgcctaaccaagaggtatct

SEQ ID NO: 120435 - DNA, 20 bp, Artificial
  CRISPR gRNA sequence
cctaaccaagaggtatctgg

SEQ ID NO: 120436 - DNA, 20 bp, Artificial
  CRISPR gRNA sequence
accaagaggtatctggggta

SEQ ID NO: 120437 - DNA, 20 bp, Artificial
  CRISPR gRNA sequence
gggtaatctttgcagatcta

SEQ ID NO: 120438 - DNA, 20 bp, Artificial
  CRISPR gRNA sequence
tgcagatctagtaataagac

SEQ ID NO: 120439 - DNA, 20 bp, Artificial
  CRISPR gRNA sequence
gcagatctagtaataagaca

SEQ ID NO: 120440 - DNA, 20 bp, Artificial
  CRISPR gRNA sequence
cagatctagtaataagacag

SEQ ID NO: 120441 - DNA, 20 bp, Artificial
  CRISPR gRNA sequence
gtaataagacaggtcactat

SEQ ID NO: 120442 - DNA, 20 bp, Artificial
  CRISPR gRNA sequence
ttcccccaggaaaggtagtg

SEQ ID NO: 120443 - DNA, 20 bp, Artificial
  CRISPR gRNA sequence
ccccaggaaaggtagtggaa

SEQ ID NO: 120444 - DNA, 20 bp, Artificial
  CRISPR gRNA sequence
acaagagattaacaagattc

SEQ ID NO: 120445 - DNA, 20 bp, Artificial
  CRISPR gRNA sequence
acaagattcagtgcttagat

SEQ ID NO: 120446 - DNA, 20 bp, Artificial
  CRISPR gRNA sequence
agtgcttagataaaccttgc

SEQ ID NO: 120447 - DNA, 20 bp, Artificial
  CRISPR gRNA sequence
agataaaccttgccaagtgc

SEQ ID NO: 120448 - DNA, 20 bp, Artificial
  CRISPR gRNA sequence
gataaaccttgccaagtgca

SEQ ID NO: 120449 - DNA, 20 bp, Artificial
  CRISPR gRNA sequence
gccaagtgcaatgattattt

SEQ ID NO: 120450 - DNA, 20 bp, Artificial
  CRISPR gRNA sequence
ccaagtgcaatgattatttt

SEQ ID NO: 120451 - DNA, 20 bp, Artificial
  CRISPR gRNA sequence
tttttcagttgagttgcccc

SEQ ID NO: 120452 - DNA, 20 bp, Artificial
  CRISPR gRNA sequence
ttcagttgagttgccccttg

SEQ ID NO: 120453 - DNA, 20 bp, Artificial
  CRISPR gRNA sequence
tcagttgagttgccccttga

SEQ ID NO: 120454 - DNA, 20 bp, Artificial
  CRISPR gRNA sequence
cagttgagttgccccttgaa

SEQ ID NO: 120455 - DNA, 20 bp, Artificial
  CRISPR gRNA sequence
agttgagttgccccttgaat

SEQ ID NO: 120456 - DNA, 20 bp, Artificial
  CRISPR gRNA sequence
agttgccccttgaataaaaa

SEQ ID NO: 120457 - DNA, 20 bp, Artificial
  CRISPR gRNA sequence
ccccttgaataaaaataaag

SEQ ID NO: 120458 - DNA, 20 bp, Artificial
  CRISPR gRNA sequence
gaataaaaataaagcacagc

SEQ ID NO: 120459 - DNA, 20 bp, Artificial
  CRISPR gRNA sequence
aataaaaataaagcacagcc

SEQ ID NO: 120460 - DNA, 20 bp, Artificial
  CRISPR gRNA sequence
gcctagtttatgtgtgtctg

SEQ ID NO: 120461 - DNA, 20 bp, Artificial
  CRISPR gRNA sequence
gtttatgtgtgtctgtatat

SEQ ID NO: 120462 - DNA, 20 bp, Artificial
  CRISPR gRNA sequence
atgtgtgtctgtatatgtat

SEQ ID NO: 120463 - DNA, 20 bp, Artificial
  CRISPR gRNA sequence
tgtgtgtctgtatatgtata

SEQ ID NO: 120464 - DNA, 20 bp, Artificial
  CRISPR gRNA sequence
tatatgtatatatttccttc

SEQ ID NO: 120465 - DNA, 20 bp, Artificial
  CRISPR gRNA sequence
ccttctccattgtaacacaa

SEQ ID NO: 120466 - DNA, 20 bp, Artificial
  CRISPR gRNA sequence
cttctccattgtaacacaaa

SEQ ID NO: 120467 - DNA, 20 bp, Artificial
  CRISPR gRNA sequence
ctccattgtaacacaaatac

SEQ ID NO: 120468 - DNA, 20 bp, Artificial
  CRISPR gRNA sequence
tccattgtaacacaaataca

SEQ ID NO: 120469 - DNA, 20 bp, Artificial
  CRISPR gRNA sequence
cattgtaacacaaatacaca

SEQ ID NO: 120470 - DNA, 20 bp, Artificial
  CRISPR gRNA sequence
taacacaaatacacaaaatt

SEQ ID NO: 120471 - DNA, 20 bp, Artificial
  CRISPR gRNA sequence
ttaccatgcaattaattgga

SEQ ID NO: 120472 - DNA, 20 bp, Artificial
  CRISPR gRNA sequence
taccatgcaattaattggat

SEQ ID NO: 120473 - DNA, 20 bp, Artificial
  CRISPR gRNA sequence
accatgcaattaattggatc

SEQ ID NO: 120474 - DNA, 20 bp, Artificial
  CRISPR gRNA sequence
ccatgcaattaattggatca

SEQ ID NO: 120475 - DNA, 20 bp, Artificial
  CRISPR gRNA sequence
attggatcagagtgtgagcc

SEQ ID NO: 120476 - DNA, 20 bp, Artificial
  CRISPR gRNA sequence
gatcagagtgtgagccctga

SEQ ID NO: 120477 - DNA, 20 bp, Artificial
  CRISPR gRNA sequence
aataaattcttttttttttt

SEQ ID NO: 120478 - DNA, 20 bp, Artificial
  CRISPR gRNA sequence
ttttttttttttttgagacg

SEQ ID NO: 120479 - DNA, 20 bp, Artificial
  CRISPR gRNA sequence
ttttttttttttgagacgga

SEQ ID NO: 120480 - DNA, 20 bp, Artificial
  CRISPR gRNA sequence
tttttttttttgagacggag

SEQ ID NO: 120481 - DNA, 20 bp, Artificial
  CRISPR gRNA sequence
ttttttttttgagacggagt

SEQ ID NO: 120482 - DNA, 20 bp, Artificial
  CRISPR gRNA sequence
tttttttttgagacggagtc

SEQ ID NO: 120483 - DNA, 20 bp, Artificial
  CRISPR gRNA sequence
ttttttttgagacggagtct

SEQ ID NO: 120484 - DNA, 20 bp, Artificial
  CRISPR gRNA sequence
tttttttgagacggagtctc

SEQ ID NO: 120485 - DNA, 20 bp, Artificial
  CRISPR gRNA sequence
ttttttgagacggagtctcg

SEQ ID NO: 120486 - DNA, 20 bp, Artificial
  CRISPR gRNA sequence
tttttgagacggagtctcgc

SEQ ID NO: 120487 - DNA, 20 bp, Artificial
  CRISPR gRNA sequence
ttttgagacggagtctcgct

SEQ ID NO: 120488 - DNA, 20 bp, Artificial
  CRISPR gRNA sequence
tttgagacggagtctcgctc

SEQ ID NO: 120489 - DNA, 20 bp, Artificial
  CRISPR gRNA sequence
ttgagacggagtctcgctct

SEQ ID NO: 120490 - DNA, 20 bp, Artificial
  CRISPR gRNA sequence
tgagacggagtctcgctctg

SEQ ID NO: 120491 - DNA, 20 bp, Artificial
  CRISPR gRNA sequence
gagacggagtctcgctctgt

SEQ ID NO: 120492 - DNA, 20 bp, Artificial
  CRISPR gRNA sequence
agacggagtctcgctctgtc

SEQ ID NO: 120493 - DNA, 20 bp, Artificial
  CRISPR gRNA sequence
gctctgtcacccaggctgga

SEQ ID NO: 120494 - DNA, 20 bp, Artificial
  CRISPR gRNA sequence
tgtcacccaggctggagtgc

SEQ ID NO: 120495 - DNA, 20 bp, Artificial
  CRISPR gRNA sequence
tcacccaggctggagtgcag

SEQ ID NO: 120496 - DNA, 20 bp, Artificial
  CRISPR gRNA sequence
gagtgcagtggcgcaatctc

SEQ ID NO: 120497 - DNA, 20 bp, Artificial
  CRISPR gRNA sequence
tgctcactgcaagctctgcc

SEQ ID NO: 120498 - DNA, 20 bp, Artificial
  CRISPR gRNA sequence
ctcactgcaagctctgcctc

SEQ ID NO: 120499 - DNA, 20 bp, Artificial
  CRISPR gRNA sequence
actgcaagctctgcctcctg

SEQ ID NO: 120500 - DNA, 20 bp, Artificial
  CRISPR gRNA sequence
caagctctgcctcctgggtt

SEQ ID NO: 120501 - DNA, 20 bp, Artificial
  CRISPR gRNA sequence
tgcctcctgggttcacgcca

SEQ ID NO: 120502 - DNA, 20 bp, Artificial
  CRISPR gRNA sequence
cctcctgggttcacgccatt

SEQ ID NO: 120503 - DNA, 20 bp, Artificial
  CRISPR gRNA sequence
ctgggttcacgccattctcc

SEQ ID NO: 120504 - DNA, 20 bp, Artificial
  CRISPR gRNA sequence
ggttcacgccattctcctgc

SEQ ID NO: 120505 - DNA, 20 bp, Artificial
  CRISPR gRNA sequence
acgccattctcctgctccag

SEQ ID NO: 120506 - DNA, 20 bp, Artificial
  CRISPR gRNA sequence
tcctgctccagcctcccaag

SEQ ID NO: 120507 - DNA, 20 bp, Artificial
  CRISPR gRNA sequence
ctgctccagcctcccaagta

SEQ ID NO: 120508 - DNA, 20 bp, Artificial
  CRISPR gRNA sequence
ctccagcctcccaagtagct

SEQ ID NO: 120509 - DNA, 20 bp, Artificial
  CRISPR gRNA sequence
cagcctcccaagtagctggg

SEQ ID NO: 120510 - DNA, 20 bp, Artificial
  CRISPR gRNA sequence
ccaagtagctgggactacag

SEQ ID NO: 120511 - DNA, 20 bp, Artificial
  CRISPR gRNA sequence
ggactacaggtgcccgccac

SEQ ID NO: 120512 - DNA, 20 bp, Artificial
  CRISPR gRNA sequence
caggtgcccgccaccatgcc

SEQ ID NO: 120513 - DNA, 20 bp, Artificial
  CRISPR gRNA sequence
atttttttgtatttttagta

SEQ ID NO: 120514 - DNA, 20 bp, Artificial
  CRISPR gRNA sequence
ttttgtatttttagtagaga

SEQ ID NO: 120515 - DNA, 20 bp, Artificial
  CRISPR gRNA sequence
tttgtatttttagtagagac

SEQ ID NO: 120516 - DNA, 20 bp, Artificial
  CRISPR gRNA sequence
ttgtatttttagtagagaca

SEQ ID NO: 120517 - DNA, 20 bp, Artificial
  CRISPR gRNA sequence
tgtatttttagtagagacag

SEQ ID NO: 120518 - DNA, 20 bp, Artificial
  CRISPR gRNA sequence
gtatttttagtagagacagg

SEQ ID NO: 120519 - DNA, 20 bp, Artificial
  CRISPR gRNA sequence
tatttttagtagagacaggg

SEQ ID NO: 120520 - DNA, 20 bp, Artificial
  CRISPR gRNA sequence
ttagtagagacagggtttca

SEQ ID NO: 120521 - DNA, 20 bp, Artificial
  CRISPR gRNA sequence
tagtagagacagggtttcac

SEQ ID NO: 120522 - DNA, 20 bp, Artificial
  CRISPR gRNA sequence
agtagagacagggtttcacc

SEQ ID NO: 120523 - DNA, 20 bp, Artificial
  CRISPR gRNA sequence
gtagagacagggtttcacca

SEQ ID NO: 120524 - DNA, 20 bp, Artificial
  CRISPR gRNA sequence
caccatgtttgccaggatgg

SEQ ID NO: 120525 - DNA, 20 bp, Artificial
  CRISPR gRNA sequence
accatgtttgccaggatggt

SEQ ID NO: 120526 - DNA, 20 bp, Artificial
  CRISPR gRNA sequence
gccaggatggtctcgatctc

SEQ ID NO: 120527 - DNA, 20 bp, Artificial
  CRISPR gRNA sequence
ccaggatggtctcgatctcc

SEQ ID NO: 120528 - DNA, 20 bp, Artificial
  CRISPR gRNA sequence
gatctcctgacctcgtgatc

SEQ ID NO: 120529 - DNA, 20 bp, Artificial
  CRISPR gRNA sequence
ctgacctcgtgatccgcctg

SEQ ID NO: 120530 - DNA, 20 bp, Artificial
  CRISPR gRNA sequence
acctcgtgatccgcctgcct

SEQ ID NO: 120531 - DNA, 20 bp, Artificial
  CRISPR gRNA sequence
gtgatccgcctgcctcggcc

SEQ ID NO: 120532 - DNA, 20 bp, Artificial
  CRISPR gRNA sequence
cctcggcctcccaaagtgct

SEQ ID NO: 120533 - DNA, 20 bp, Artificial
  CRISPR gRNA sequence
ggcctcccaaagtgctggga

SEQ ID NO: 120534 - DNA, 20 bp, Artificial
  CRISPR gRNA sequence
ccaaagtgctgggattacag

SEQ ID NO: 120535 - DNA, 20 bp, Artificial
  CRISPR gRNA sequence
ggattacaggcgtgagccac

SEQ ID NO: 120536 - DNA, 20 bp, Artificial
  CRISPR gRNA sequence
caggcgtgagccaccgcgcc

SEQ ID NO: 120537 - DNA, 20 bp, Artificial
  CRISPR gRNA sequence
aataaattctaatgtcactt

SEQ ID NO: 120538 - DNA, 20 bp, Artificial
  CRISPR gRNA sequence
taatgtcacttataagaatt

SEQ ID NO: 120539 - DNA, 20 bp, Artificial
  CRISPR gRNA sequence
atgtcacttataagaatttc

SEQ ID NO: 120540 - DNA, 20 bp, Artificial
  CRISPR gRNA sequence
ataagaatttcttcctgtca

SEQ ID NO: 120541 - DNA, 20 bp, Artificial
  CRISPR gRNA sequence
taagaatttcttcctgtcac

SEQ ID NO: 120542 - DNA, 20 bp, Artificial
  CRISPR gRNA sequence
cttcctgtcacttataccat

SEQ ID NO: 120543 - DNA, 20 bp, Artificial
  CRISPR gRNA sequence
ttcctgtcacttataccatt

SEQ ID NO: 120544 - DNA, 20 bp, Artificial
  CRISPR gRNA sequence
cctgtcacttataccatttc

SEQ ID NO: 120545 - DNA, 20 bp, Artificial
  CRISPR gRNA sequence
ctgtcacttataccatttct

SEQ ID NO: 120546 - DNA, 20 bp, Artificial
  CRISPR gRNA sequence
tcacttataccatttctttt

SEQ ID NO: 120547 - DNA, 20 bp, Artificial
  CRISPR gRNA sequence
ataccatttcttttccaggc

SEQ ID NO: 120548 - DNA, 20 bp, Artificial
  CRISPR gRNA sequence
taccatttcttttccaggca

SEQ ID NO: 120549 - DNA, 20 bp, Artificial
  CRISPR gRNA sequence
cttttccaggcattctcaaa

SEQ ID NO: 120550 - DNA, 20 bp, Artificial
  CRISPR gRNA sequence
ttttccaggcattctcaaag

SEQ ID NO: 120551 - DNA, 20 bp, Artificial
  CRISPR gRNA sequence
ttccaggcattctcaaagaa

SEQ ID NO: 120552 - DNA, 20 bp, Artificial
  CRISPR gRNA sequence
tccaggcattctcaaagaaa

SEQ ID NO: 120553 - DNA, 20 bp, Artificial
  CRISPR gRNA sequence
ccaggcattctcaaagaaac

SEQ ID NO: 120554 - DNA, 20 bp, Artificial
  CRISPR gRNA sequence
caggcattctcaaagaaaca

SEQ ID NO: 120555 - DNA, 20 bp, Artificial
  CRISPR gRNA sequence
tcaaagaaacatgctagtca

SEQ ID NO: 120556 - DNA, 20 bp, Artificial
  CRISPR gRNA sequence
aaagaaacatgctagtcaaa

SEQ ID NO: 120557 - DNA, 20 bp, Artificial
  CRISPR gRNA sequence
gtcaaatccaattctcagaa

SEQ ID NO: 120558 - DNA, 20 bp, Artificial
  CRISPR gRNA sequence
tcagaaagttgatacggggt

SEQ ID NO: 120559 - DNA, 20 bp, Artificial
  CRISPR gRNA sequence
agaaagttgatacggggtct

SEQ ID NO: 120560 - DNA, 20 bp, Artificial
  CRISPR gRNA sequence
atacggggtctctatatgac

SEQ ID NO: 120561 - DNA, 20 bp, Artificial
  CRISPR gRNA sequence
tatatgacttggcatgaaat

SEQ ID NO: 120562 - DNA, 20 bp, Artificial
  CRISPR gRNA sequence
tatgacttggcatgaaatat

SEQ ID NO: 120563 - DNA, 20 bp, Artificial
  CRISPR gRNA sequence
ggcatgaaatattaggaaac

SEQ ID NO: 120564 - DNA, 20 bp, Artificial
  CRISPR gRNA sequence
gcatgaaatattaggaaact

SEQ ID NO: 120565 - DNA, 20 bp, Artificial
  CRISPR gRNA sequence
ggaaactggcatcttataag

SEQ ID NO: 120566 - DNA, 20 bp, Artificial
  CRISPR gRNA sequence
gcatcttataagcctcaaag

SEQ ID NO: 120567 - DNA, 20 bp, Artificial
  CRISPR gRNA sequence
ataagcctcaaagacaagtt

SEQ ID NO: 120568 - DNA, 20 bp, Artificial
  CRISPR gRNA sequence
taagcctcaaagacaagtta

SEQ ID NO: 120569 - DNA, 20 bp, Artificial
  CRISPR gRNA sequence
aaagacaagttagcagcatc

SEQ ID NO: 120570 - DNA, 20 bp, Artificial
  CRISPR gRNA sequence
gcagcatcaaagacatgcaa

SEQ ID NO: 120571 - DNA, 20 bp, Artificial
  CRISPR gRNA sequence
actttgccattcctactgga

SEQ ID NO: 120572 - DNA, 20 bp, Artificial
  CRISPR gRNA sequence
tgccattcctactggagatc

SEQ ID NO: 120573 - DNA, 20 bp, Artificial
  CRISPR gRNA sequence
gccattcctactggagatcc

SEQ ID NO: 120574 - DNA, 20 bp, Artificial
  CRISPR gRNA sequence
ccattcctactggagatcct

SEQ ID NO: 120575 - DNA, 20 bp, Artificial
  CRISPR gRNA sequence
ctactggagatcctaacaca

SEQ ID NO: 120576 - DNA, 20 bp, Artificial
  CRISPR gRNA sequence
ctggagatcctaacacaaac

SEQ ID NO: 120577 - DNA, 20 bp, Artificial
  CRISPR gRNA sequence
gagatcctaacacaaacagc

SEQ ID NO: 120578 - DNA, 20 bp, Artificial
  CRISPR gRNA sequence
acacaaacagcaccagacat

SEQ ID NO: 120579 - DNA, 20 bp, Artificial
  CRISPR gRNA sequence
atgcagtgctcacagagaat

SEQ ID NO: 120580 - DNA, 20 bp, Artificial
  CRISPR gRNA sequence
acagagaatcagagagggta

SEQ ID NO: 120581 - DNA, 20 bp, Artificial
  CRISPR gRNA sequence
cctggagggtctggacttgc

SEQ ID NO: 120582 - DNA, 20 bp, Artificial
  CRISPR gRNA sequence
gagggtctggacttgctggc

SEQ ID NO: 120583 - DNA, 20 bp, Artificial
  CRISPR gRNA sequence
gacttgctggcctgaggcgg

SEQ ID NO: 120584 - DNA, 20 bp, Artificial
  CRISPR gRNA sequence
gctggcctgaggcggatgcc

SEQ ID NO: 120585 - DNA, 20 bp, Artificial
  CRISPR gRNA sequence
ctggcctgaggcggatgcca

SEQ ID NO: 120586 - DNA, 20 bp, Artificial
  CRISPR gRNA sequence
gcctgaggcggatgccacct

SEQ ID NO: 120587 - DNA, 20 bp, Artificial
  CRISPR gRNA sequence
aggcggatgccacctgggcc

SEQ ID NO: 120588 - DNA, 20 bp, Artificial
  CRISPR gRNA sequence
ggcctcagtctgcaactgca

SEQ ID NO: 120589 - DNA, 20 bp, Artificial
  CRISPR gRNA sequence
agtctgcaactgcacagcag

SEQ ID NO: 120590 - DNA, 20 bp, Artificial
  CRISPR gRNA sequence
caactgcacagcagtgacac

SEQ ID NO: 120591 - DNA, 20 bp, Artificial
  CRISPR gRNA sequence
cacagcagtgacaccaccct

SEQ ID NO: 120592 - DNA, 20 bp, Artificial
  CRISPR gRNA sequence
ctgctgagaacaggaacagg

SEQ ID NO: 120593 - DNA, 20 bp, Artificial
  CRISPR gRNA sequence
ctgagaacaggaacaggaag

SEQ ID NO: 120594 - DNA, 20 bp, Artificial
  CRISPR gRNA sequence
agaacaggaacaggaagagc

SEQ ID NO: 120595 - DNA, 20 bp, Artificial
  CRISPR gRNA sequence
gaaatatgtcaggaaggaaa

SEQ ID NO: 120596 - DNA, 20 bp, Artificial
  CRISPR gRNA sequence
aaatatgtcaggaaggaaat

SEQ ID NO: 120597 - DNA, 20 bp, Artificial
  CRISPR gRNA sequence
aagacacagatcaccttacc

SEQ ID NO: 120598 - DNA, 20 bp, Artificial
  CRISPR gRNA sequence
acctcttggaggagagagac

SEQ ID NO: 120599 - DNA, 20 bp, Artificial
  CRISPR gRNA sequence
cctcttggaggagagagacg

SEQ ID NO: 120600 - DNA, 20 bp, Artificial
  CRISPR gRNA sequence
ttggaggagagagacggaag

SEQ ID NO: 120601 - DNA, 20 bp, Artificial
  CRISPR gRNA sequence
ggaggagagagacggaagcc

SEQ ID NO: 120602 - DNA, 20 bp, Artificial
  CRISPR gRNA sequence
gaggagagagacggaagcct

SEQ ID NO: 120603 - DNA, 20 bp, Artificial
  CRISPR gRNA sequence
aaggactttcaaaatgtaca

SEQ ID NO: 120604 - DNA, 20 bp, Artificial
  CRISPR gRNA sequence
tcaaaatgtacagactccct

SEQ ID NO: 120605 - DNA, 20 bp, Artificial
  CRISPR gRNA sequence
caaaatgtacagactcccta

SEQ ID NO: 120606 - DNA, 20 bp, Artificial
  CRISPR gRNA sequence
aaaatgtacagactccctat

SEQ ID NO: 120607 - DNA, 20 bp, Artificial
  CRISPR gRNA sequence
cctatattgaagctgttttg

SEQ ID NO: 120608 - DNA, 20 bp, Artificial
  CRISPR gRNA sequence
tattgaagctgttttgttga

SEQ ID NO: 120609 - DNA, 20 bp, Artificial
  CRISPR gRNA sequence
aagctgttttgttgaaggta

SEQ ID NO: 120610 - DNA, 20 bp, Artificial
  CRISPR gRNA sequence
ttttgttgaaggtagtagga

SEQ ID NO: 120611 - DNA, 20 bp, Artificial
  CRISPR gRNA sequence
tgttgaaggtagtaggatta

SEQ ID NO: 120612 - DNA, 20 bp, Artificial
  CRISPR gRNA sequence
gttgaaggtagtaggattaa

SEQ ID NO: 120613 - DNA, 20 bp, Artificial
  CRISPR gRNA sequence
ttgaaggtagtaggattaaa

SEQ ID NO: 120614 - DNA, 20 bp, Artificial
  CRISPR gRNA sequence
aaggtagtaggattaaagat

SEQ ID NO: 120615 - DNA, 20 bp, Artificial
  CRISPR gRNA sequence
aagatattagccctttgtct

SEQ ID NO: 120616 - DNA, 20 bp, Artificial
  CRISPR gRNA sequence
gccctttgtctccagagtgg

SEQ ID NO: 120617 - DNA, 20 bp, Artificial
  CRISPR gRNA sequence
tgtctccagagtggacctca

SEQ ID NO: 120618 - DNA, 20 bp, Artificial
  CRISPR gRNA sequence
gtctccagagtggacctcaa

SEQ ID NO: 120619 - DNA, 20 bp, Artificial
  CRISPR gRNA sequence
tctccagagtggacctcaaa

SEQ ID NO: 120620 - DNA, 20 bp, Artificial
  CRISPR gRNA sequence
cagagtggacctcaaaaatt

SEQ ID NO: 120621 - DNA, 20 bp, Artificial
  CRISPR gRNA sequence
aaaaatttgactcaaaaact

SEQ ID NO: 120622 - DNA, 20 bp, Artificial
  CRISPR gRNA sequence
gactcaaaaactcaaaacag

SEQ ID NO: 120623 - DNA, 20 bp, Artificial
  CRISPR gRNA sequence
actcaaaaactcaaaacagt

SEQ ID NO: 120624 - DNA, 20 bp, Artificial
  CRISPR gRNA sequence
aaaaactcaaaacagttgtc

SEQ ID NO: 120625 - DNA, 20 bp, Artificial
  CRISPR gRNA sequence
aaaacagttgtcatcattaa

SEQ ID NO: 120626 - DNA, 20 bp, Artificial
  CRISPR gRNA sequence
tcatcattaacacaaagatt

SEQ ID NO: 120627 - DNA, 20 bp, Artificial
  CRISPR gRNA sequence
acacaaagatttgtaatgca

SEQ ID NO: 120628 - DNA, 20 bp, Artificial
  CRISPR gRNA sequence
gtaatgcaatctttccctcc

SEQ ID NO: 120629 - DNA, 20 bp, Artificial
  CRISPR gRNA sequence
taatgcaatctttccctcca

SEQ ID NO: 120630 - DNA, 20 bp, Artificial
  CRISPR gRNA sequence
tccctccagaaacaggaatc

SEQ ID NO: 120631 - DNA, 20 bp, Artificial
  CRISPR gRNA sequence
ccctccagaaacaggaatct

SEQ ID NO: 120632 - DNA, 20 bp, Artificial
  CRISPR gRNA sequence
cctccagaaacaggaatctg

SEQ ID NO: 120633 - DNA, 20 bp, Artificial
  CRISPR gRNA sequence
cagaaacaggaatctgacac

SEQ ID NO: 120634 - DNA, 20 bp, Artificial
  CRISPR gRNA sequence
acacttctacttacacaatt

SEQ ID NO: 120635 - DNA, 20 bp, Artificial
  CRISPR gRNA sequence
ctacttacacaattgtttaa

SEQ ID NO: 120636 - DNA, 20 bp, Artificial
  CRISPR gRNA sequence
tacttacacaattgtttaat

SEQ ID NO: 120637 - DNA, 20 bp, Artificial
  CRISPR gRNA sequence
cttacacaattgtttaatgc

SEQ ID NO: 120638 - DNA, 20 bp, Artificial
  CRISPR gRNA sequence
acacaattgtttaatgccct

SEQ ID NO: 120639 - DNA, 20 bp, Artificial
  CRISPR gRNA sequence
cacaattgtttaatgccctt

SEQ ID NO: 120640 - DNA, 20 bp, Artificial
  CRISPR gRNA sequence
tttaatgccctttttatctc

SEQ ID NO: 120641 - DNA, 20 bp, Artificial
  CRISPR gRNA sequence
aatgccctttttatctcctc

SEQ ID NO: 120642 - DNA, 20 bp, Artificial
  CRISPR gRNA sequence
atgccctttttatctcctca

SEQ ID NO: 120643 - DNA, 20 bp, Artificial
  CRISPR gRNA sequence
tttatctcctcagatgagtt

SEQ ID NO: 120644 - DNA, 20 bp, Artificial
  CRISPR gRNA sequence
ttatctcctcagatgagttc

SEQ ID NO: 120645 - DNA, 20 bp, Artificial
  CRISPR gRNA sequence
tatctcctcagatgagttca

SEQ ID NO: 120646 - DNA, 20 bp, Artificial
  CRISPR gRNA sequence
atctcctcagatgagttcac

SEQ ID NO: 120647 - DNA, 20 bp, Artificial
  CRISPR gRNA sequence
tctcctcagatgagttcaca

SEQ ID NO: 120648 - DNA, 20 bp, Artificial
  CRISPR gRNA sequence
ctcagatgagttcacaagaa

SEQ ID NO: 120649 - DNA, 20 bp, Artificial
  CRISPR gRNA sequence
agatgagttcacaagaaaaa

SEQ ID NO: 120650 - DNA, 20 bp, Artificial
  CRISPR gRNA sequence
acaagaaaaaaatgattagg

SEQ ID NO: 120651 - DNA, 20 bp, Artificial
  CRISPR gRNA sequence
ggttttaatagccctgaaac

SEQ ID NO: 120652 - DNA, 20 bp, Artificial
  CRISPR gRNA sequence
taatagccctgaaactacca

SEQ ID NO: 120653 - DNA, 20 bp, Artificial
  CRISPR gRNA sequence
aatagccctgaaactaccat

SEQ ID NO: 120654 - DNA, 20 bp, Artificial
  CRISPR gRNA sequence
atagccctgaaactaccata

SEQ ID NO: 120655 - DNA, 20 bp, Artificial
  CRISPR gRNA sequence
aaactaccataaaaaattct

SEQ ID NO: 120656 - DNA, 20 bp, Artificial
  CRISPR gRNA sequence
ccataaaaaattctgggctt

SEQ ID NO: 120657 - DNA, 20 bp, Artificial
  CRISPR gRNA sequence
tgggcttaaatgcaatcacc

SEQ ID NO: 120658 - DNA, 20 bp, Artificial
  CRISPR gRNA sequence
ggcttaaatgcaatcaccaa

SEQ ID NO: 120659 - DNA, 20 bp, Artificial
  CRISPR gRNA sequence
aaatgcaatcaccaagaaag

SEQ ID NO: 120660 - DNA, 20 bp, Artificial
  CRISPR gRNA sequence
aatgcaatcaccaagaaagg

SEQ ID NO: 120661 - DNA, 20 bp, Artificial
  CRISPR gRNA sequence
atcactatgaaccgaaatca

SEQ ID NO: 120662 - DNA, 20 bp, Artificial
  CRISPR gRNA sequence
tgaaccgaaatcatcttcat

SEQ ID NO: 120663 - DNA, 20 bp, Artificial
  CRISPR gRNA sequence
catgacgtcaatgctctcat

SEQ ID NO: 120664 - DNA, 20 bp, Artificial
  CRISPR gRNA sequence
atgacgtcaatgctctcatg

SEQ ID NO: 120665 - DNA, 20 bp, Artificial
  CRISPR gRNA sequence
tcatgtcccaaaactaagat

SEQ ID NO: 120666 - DNA, 20 bp, Artificial
  CRISPR gRNA sequence
atgtcccaaaactaagattc

SEQ ID NO: 120667 - DNA, 20 bp, Artificial
  CRISPR gRNA sequence
agattcttttttttttaaac

SEQ ID NO: 120668 - DNA, 20 bp, Artificial
  CRISPR gRNA sequence
ttttttttttaaactttatt

SEQ ID NO: 120669 - DNA, 20 bp, Artificial
  CRISPR gRNA sequence
ttttttttaaactttattta

SEQ ID NO: 120670 - DNA, 20 bp, Artificial
  CRISPR gRNA sequence
tttttttaaactttatttat

SEQ ID NO: 120671 - DNA, 20 bp, Artificial
  CRISPR gRNA sequence
ttttttaaactttatttatg

SEQ ID NO: 120672 - DNA, 20 bp, Artificial
  CRISPR gRNA sequence
tttttaaactttatttatgt

SEQ ID NO: 120673 - DNA, 20 bp, Artificial
  CRISPR gRNA sequence
ttttaaactttatttatgta

SEQ ID NO: 120674 - DNA, 20 bp, Artificial
  CRISPR gRNA sequence
tttaaactttatttatgtac

SEQ ID NO: 120675 - DNA, 20 bp, Artificial
  CRISPR gRNA sequence
ttaaactttatttatgtact

SEQ ID NO: 120676 - DNA, 20 bp, Artificial
  CRISPR gRNA sequence
taaactttatttatgtactt

SEQ ID NO: 120677 - DNA, 20 bp, Artificial
  CRISPR gRNA sequence
aaactttatttatgtactta

SEQ ID NO: 120678 - DNA, 20 bp, Artificial
  CRISPR gRNA sequence
aactttatttatgtacttat

SEQ ID NO: 120679 - DNA, 20 bp, Artificial
  CRISPR gRNA sequence
tatttatgtacttattttga

SEQ ID NO: 120680 - DNA, 20 bp, Artificial
  CRISPR gRNA sequence
atttatgtacttattttgag

SEQ ID NO: 120681 - DNA, 20 bp, Artificial
  CRISPR gRNA sequence
tttatgtacttattttgaga

SEQ ID NO: 120682 - DNA, 20 bp, Artificial
  CRISPR gRNA sequence
atgtacttattttgagatgg

SEQ ID NO: 120683 - DNA, 20 bp, Artificial
  CRISPR gRNA sequence
tgtacttattttgagatggg

SEQ ID NO: 120684 - DNA, 20 bp, Artificial
  CRISPR gRNA sequence
attttgagatggggtcttgc

SEQ ID NO: 120685 - DNA, 20 bp, Artificial
  CRISPR gRNA sequence
ttttgagatggggtcttgct

SEQ ID NO: 120686 - DNA, 20 bp, Artificial
  CRISPR gRNA sequence
tgagatggggtcttgctgtt

SEQ ID NO: 120687 - DNA, 20 bp, Artificial
  CRISPR gRNA sequence
gagatggggtcttgctgttt

SEQ ID NO: 120688 - DNA, 20 bp, Artificial
  CRISPR gRNA sequence
agatggggtcttgctgtttt

SEQ ID NO: 120689 - DNA, 20 bp, Artificial
  CRISPR gRNA sequence
gctgttttgcccaggctggt

SEQ ID NO: 120690 - DNA, 20 bp, Artificial
  CRISPR gRNA sequence
ctgttttgcccaggctggtc

SEQ ID NO: 120691 - DNA, 20 bp, Artificial
  CRISPR gRNA sequence
ttttgcccaggctggtcttg

SEQ ID NO: 120692 - DNA, 20 bp, Artificial
  CRISPR gRNA sequence
tgcccaggctggtcttgaat

SEQ ID NO: 120693 - DNA, 20 bp, Artificial
  CRISPR gRNA sequence
gcccaggctggtcttgaatt

SEQ ID NO: 120694 - DNA, 20 bp, Artificial
  CRISPR gRNA sequence
cccaggctggtcttgaattc

SEQ ID NO: 120695 - DNA, 20 bp, Artificial
  CRISPR gRNA sequence
gtcttgaattcctgggctta

SEQ ID NO: 120696 - DNA, 20 bp, Artificial
  CRISPR gRNA sequence
gaattcctgggcttaagcca

SEQ ID NO: 120697 - DNA, 20 bp, Artificial
  CRISPR gRNA sequence
aattcctgggcttaagccaa

SEQ ID NO: 120698 - DNA, 20 bp, Artificial
  CRISPR gRNA sequence
ctgggcttaagccaaccttc

SEQ ID NO: 120699 - DNA, 20 bp, Artificial
  CRISPR gRNA sequence
ggcttaagccaaccttcctg

SEQ ID NO: 120700 - DNA, 20 bp, Artificial
  CRISPR gRNA sequence
aagccaaccttcctgtctca

SEQ ID NO: 120701 - DNA, 20 bp, Artificial
  CRISPR gRNA sequence
agccaaccttcctgtctcag

SEQ ID NO: 120702 - DNA, 20 bp, Artificial
  CRISPR gRNA sequence
cctgtctcagcctccagagt

SEQ ID NO: 120703 - DNA, 20 bp, Artificial
  CRISPR gRNA sequence
ctgtctcagcctccagagta

SEQ ID NO: 120704 - DNA, 20 bp, Artificial
  CRISPR gRNA sequence
tctcagcctccagagtagct

SEQ ID NO: 120705 - DNA, 20 bp, Artificial
  CRISPR gRNA sequence
agcctccagagtagctggga

SEQ ID NO: 120706 - DNA, 20 bp, Artificial
  CRISPR gRNA sequence
cagagtagctgggattacag

SEQ ID NO: 120707 - DNA, 20 bp, Artificial
  CRISPR gRNA sequence
ggattacaggcatgcagcac

SEQ ID NO: 120708 - DNA, 20 bp, Artificial
  CRISPR gRNA sequence
caggcatgcagcaccatgcc

SEQ ID NO: 120709 - DNA, 20 bp, Artificial
  CRISPR gRNA sequence
caaaactaagattatttcta

SEQ ID NO: 120710 - DNA, 20 bp, Artificial
  CRISPR gRNA sequence
aaaactaagattatttctac

SEQ ID NO: 120711 - DNA, 20 bp, Artificial
  CRISPR gRNA sequence
agattatttctacccaactg

SEQ ID NO: 120712 - DNA, 20 bp, Artificial
  CRISPR gRNA sequence
tttctacccaactggactgc

SEQ ID NO: 120713 - DNA, 20 bp, Artificial
  CRISPR gRNA sequence
ctacccaactggactgcttt

SEQ ID NO: 120714 - DNA, 20 bp, Artificial
  CRISPR gRNA sequence
tacccaactggactgcttta

SEQ ID NO: 120715 - DNA, 20 bp, Artificial
  CRISPR gRNA sequence
cccaactggactgctttaag

SEQ ID NO: 120716 - DNA, 20 bp, Artificial
  CRISPR gRNA sequence
gactgctttaagagccatgt

SEQ ID NO: 120717 - DNA, 20 bp, Artificial
  CRISPR gRNA sequence
ctttaagagccatgttttca

SEQ ID NO: 120718 - DNA, 20 bp, Artificial
  CRISPR gRNA sequence
taagagccatgttttcaatg

SEQ ID NO: 120719 - DNA, 20 bp, Artificial
  CRISPR gRNA sequence
aagagccatgttttcaatga

SEQ ID NO: 120720 - DNA, 20 bp, Artificial
  CRISPR gRNA sequence
agagccatgttttcaatgat

SEQ ID NO: 120721 - DNA, 20 bp, Artificial
  CRISPR gRNA sequence
tcaatgattcaaccttattt

SEQ ID NO: 120722 - DNA, 20 bp, Artificial
  CRISPR gRNA sequence
caatgattcaaccttatttt

SEQ ID NO: 120723 - DNA, 20 bp, Artificial
  CRISPR gRNA sequence
aatgattcaaccttattttt

SEQ ID NO: 120724 - DNA, 20 bp, Artificial
  CRISPR gRNA sequence
aaccttatttttacatccac

SEQ ID NO: 120725 - DNA, 20 bp, Artificial
  CRISPR gRNA sequence
atttttacatccactaatgg

SEQ ID NO: 120726 - DNA, 20 bp, Artificial
  CRISPR gRNA sequence
tttttacatccactaatggc

SEQ ID NO: 120727 - DNA, 20 bp, Artificial
  CRISPR gRNA sequence
ttacatccactaatggcaaa

SEQ ID NO: 120728 - DNA, 20 bp, Artificial
  CRISPR gRNA sequence
tacatccactaatggcaaat

SEQ ID NO: 120729 - DNA, 20 bp, Artificial
  CRISPR gRNA sequence
acatccactaatggcaaatt

SEQ ID NO: 120730 - DNA, 20 bp, Artificial
  CRISPR gRNA sequence
catccactaatggcaaattc

SEQ ID NO: 120731 - DNA, 20 bp, Artificial
  CRISPR gRNA sequence
atggcaaattctgaaagaat

SEQ ID NO: 120732 - DNA, 20 bp, Artificial
  CRISPR gRNA sequence
tgaaagaataaaaacccacc

SEQ ID NO: 120733 - DNA, 20 bp, Artificial
  CRISPR gRNA sequence
aaagaataaaaacccaccct

SEQ ID NO: 120734 - DNA, 20 bp, Artificial
  CRISPR gRNA sequence
cagggcactggtgtgaatgg

SEQ ID NO: 120735 - DNA, 20 bp, Artificial
  CRISPR gRNA sequence
gtgtgaatggagggcccttt

SEQ ID NO: 120736 - DNA, 20 bp, Artificial
  CRISPR gRNA sequence
tgtggaatcccttcctctaa

SEQ ID NO: 120737 - DNA, 20 bp, Artificial
  CRISPR gRNA sequence
gtggaatcccttcctctaaa

SEQ ID NO: 120738 - DNA, 20 bp, Artificial
  CRISPR gRNA sequence
tggaatcccttcctctaaaa

SEQ ID NO: 120739 - DNA, 20 bp, Artificial
  CRISPR gRNA sequence
cctctaaaaaggcagttgaa

SEQ ID NO: 120740 - DNA, 20 bp, Artificial
  CRISPR gRNA sequence
ctctaaaaaggcagttgaag

SEQ ID NO: 120741 - DNA, 20 bp, Artificial
  CRISPR gRNA sequence
taaaaaggcagttgaaggaa

SEQ ID NO: 120742 - DNA, 20 bp, Artificial
  CRISPR gRNA sequence
aaaaggcagttgaaggaaac

SEQ ID NO: 120743 - DNA, 20 bp, Artificial
  CRISPR gRNA sequence
aaggaaactgccagagccac

SEQ ID NO: 120744 - DNA, 20 bp, Artificial
  CRISPR gRNA sequence
ccagagccacagcagctgta

SEQ ID NO: 120745 - DNA, 20 bp, Artificial
  CRISPR gRNA sequence
tatggaagggaaagctatca

SEQ ID NO: 120746 - DNA, 20 bp, Artificial
  CRISPR gRNA sequence
tcaggggagttcgtctttga

SEQ ID NO: 120747 - DNA, 20 bp, Artificial
  CRISPR gRNA sequence
gtctttgatcattagacggg

SEQ ID NO: 120748 - DNA, 20 bp, Artificial
  CRISPR gRNA sequence
tgatcattagacgggaaaaa

SEQ ID NO: 120749 - DNA, 20 bp, Artificial
  CRISPR gRNA sequence
gatcattagacgggaaaaac

SEQ ID NO: 120750 - DNA, 20 bp, Artificial
  CRISPR gRNA sequence
atcattagacgggaaaaact

SEQ ID NO: 120751 - DNA, 20 bp, Artificial
  CRISPR gRNA sequence
gacgggaaaaactcatcatc

SEQ ID NO: 120752 - DNA, 20 bp, Artificial
  CRISPR gRNA sequence
atcatcaatactacctttcc

SEQ ID NO: 120753 - DNA, 20 bp, Artificial
  CRISPR gRNA sequence
cctttcccttccctactact

SEQ ID NO: 120754 - DNA, 20 bp, Artificial
  CRISPR gRNA sequence
tcccttccctactacttttc

SEQ ID NO: 120755 - DNA, 20 bp, Artificial
  CRISPR gRNA sequence
cccttccctactacttttct

SEQ ID NO: 120756 - DNA, 20 bp, Artificial
  CRISPR gRNA sequence
ccttccctactacttttcta

SEQ ID NO: 120757 - DNA, 20 bp, Artificial
  CRISPR gRNA sequence
ccctactacttttctatatt

SEQ ID NO: 120758 - DNA, 20 bp, Artificial
  CRISPR gRNA sequence
cctactacttttctatatta

SEQ ID NO: 120759 - DNA, 20 bp, Artificial
  CRISPR gRNA sequence
ctacttttctatattagcta

SEQ ID NO: 120760 - DNA, 20 bp, Artificial
  CRISPR gRNA sequence
cttttctatattagctaaat

SEQ ID NO: 120761 - DNA, 20 bp, Artificial
  CRISPR gRNA sequence
ttctatattagctaaattcc

SEQ ID NO: 120762 - DNA, 20 bp, Artificial
  CRISPR gRNA sequence
tctatattagctaaattcca

SEQ ID NO: 120763 - DNA, 20 bp, Artificial
  CRISPR gRNA sequence
ctatattagctaaattccat

SEQ ID NO: 120764 - DNA, 20 bp, Artificial
  CRISPR gRNA sequence
tatattagctaaattccatt

SEQ ID NO: 120765 - DNA, 20 bp, Artificial
  CRISPR gRNA sequence
tattagctaaattccatttt

SEQ ID NO: 120766 - DNA, 20 bp, Artificial
  CRISPR gRNA sequence
gctaaattccattttgaaaa

SEQ ID NO: 120767 - DNA, 20 bp, Artificial
  CRISPR gRNA sequence
aattccattttgaaaacaaa

SEQ ID NO: 120768 - DNA, 20 bp, Artificial
  CRISPR gRNA sequence
cattttgaaaacaaagtatt

SEQ ID NO: 120769 - DNA, 20 bp, Artificial
  CRISPR gRNA sequence
tgaaaacaaagtatttccaa

SEQ ID NO: 120770 - DNA, 20 bp, Artificial
  CRISPR gRNA sequence
gaaaacaaagtatttccaaa

SEQ ID NO: 120771 - DNA, 20 bp, Artificial
  CRISPR gRNA sequence
aaaacaaagtatttccaaaa

SEQ ID NO: 120772 - DNA, 20 bp, Artificial
  CRISPR gRNA sequence
ccaaaatatcaatcttggcc

SEQ ID NO: 120773 - DNA, 20 bp, Artificial
  CRISPR gRNA sequence
caaaatatcaatcttggcct

SEQ ID NO: 120774 - DNA, 20 bp, Artificial
  CRISPR gRNA sequence
ggcctaaggtcaaatagaaa

SEQ ID NO: 120775 - DNA, 20 bp, Artificial
  CRISPR gRNA sequence
gcctaaggtcaaatagaaac

SEQ ID NO: 120776 - DNA, 20 bp, Artificial
  CRISPR gRNA sequence
aggtcaaatagaaacataat

SEQ ID NO: 120777 - DNA, 20 bp, Artificial
  CRISPR gRNA sequence
ttttcttctggggtggggaa

SEQ ID NO: 120778 - DNA, 20 bp, Artificial
  CRISPR gRNA sequence
tttcttctggggtggggaaa

SEQ ID NO: 120779 - DNA, 20 bp, Artificial
  CRISPR gRNA sequence
ttcttctggggtggggaaaa

SEQ ID NO: 120780 - DNA, 20 bp, Artificial
  CRISPR gRNA sequence
tcttctggggtggggaaaaa

SEQ ID NO: 120781 - DNA, 20 bp, Artificial
  CRISPR gRNA sequence
cttctggggtggggaaaaaa

SEQ ID NO: 120782 - DNA, 20 bp, Artificial
  CRISPR gRNA sequence
ttctggggtggggaaaaaag

SEQ ID NO: 120783 - DNA, 20 bp, Artificial
  CRISPR gRNA sequence
ctggggtggggaaaaaagtg

SEQ ID NO: 120784 - DNA, 20 bp, Artificial
  CRISPR gRNA sequence
tggggtggggaaaaaagtga

SEQ ID NO: 120785 - DNA, 20 bp, Artificial
  CRISPR gRNA sequence
gggtggggaaaaaagtgaaa

SEQ ID NO: 120786 - DNA, 20 bp, Artificial
  CRISPR gRNA sequence
tactataataaacccaagca

SEQ ID NO: 120787 - DNA, 20 bp, Artificial
  CRISPR gRNA sequence
actataataaacccaagcat

SEQ ID NO: 120788 - DNA, 20 bp, Artificial
  CRISPR gRNA sequence
ctataataaacccaagcata

SEQ ID NO: 120789 - DNA, 20 bp, Artificial
  CRISPR gRNA sequence
taataaacccaagcataaag

SEQ ID NO: 120790 - DNA, 20 bp, Artificial
  CRISPR gRNA sequence
tgtataaattcaagaaagca

SEQ ID NO: 120791 - DNA, 20 bp, Artificial
  CRISPR gRNA sequence
aagaaagcaatctattaatt

SEQ ID NO: 120792 - DNA, 20 bp, Artificial
  CRISPR gRNA sequence
ttaattaggaataaaccagc

SEQ ID NO: 120793 - DNA, 20 bp, Artificial
  CRISPR gRNA sequence
attaggaataaaccagcagc

SEQ ID NO: 120794 - DNA, 20 bp, Artificial
  CRISPR gRNA sequence
ggaataaaccagcagcaggg

SEQ ID NO: 120795 - DNA, 20 bp, Artificial
  CRISPR gRNA sequence
ctttctagtatgtcttatcc

SEQ ID NO: 120796 - DNA, 20 bp, Artificial
  CRISPR gRNA sequence
tctagtatgtcttatccata

SEQ ID NO: 120797 - DNA, 20 bp, Artificial
  CRISPR gRNA sequence
ctagtatgtcttatccataa

SEQ ID NO: 120798 - DNA, 20 bp, Artificial
  CRISPR gRNA sequence
tagtatgtcttatccataag

SEQ ID NO: 120799 - DNA, 20 bp, Artificial
  CRISPR gRNA sequence
gtatgtcttatccataagaa

SEQ ID NO: 120800 - DNA, 20 bp, Artificial
  CRISPR gRNA sequence
atccataagaatggctgtct

SEQ ID NO: 120801 - DNA, 20 bp, Artificial
  CRISPR gRNA sequence
tccataagaatggctgtcta

SEQ ID NO: 120802 - DNA, 20 bp, Artificial
  CRISPR gRNA sequence
tctaaatattatcctaatgt

SEQ ID NO: 120803 - DNA, 20 bp, Artificial
  CRISPR gRNA sequence
aatattatcctaatgttaaa

SEQ ID NO: 120804 - DNA, 20 bp, Artificial
  CRISPR gRNA sequence
tcctaatgttaaaccagagc

SEQ ID NO: 120805 - DNA, 20 bp, Artificial
  CRISPR gRNA sequence
atgttaaaccagagcttttc

SEQ ID NO: 120806 - DNA, 20 bp, Artificial
  CRISPR gRNA sequence
aaccagagcttttctgaata

SEQ ID NO: 120807 - DNA, 20 bp, Artificial
  CRISPR gRNA sequence
ttctgaataaaaaatgtggc

SEQ ID NO: 120808 - DNA, 20 bp, Artificial
  CRISPR gRNA sequence
tctgaataaaaaatgtggca

SEQ ID NO: 120809 - DNA, 20 bp, Artificial
  CRISPR gRNA sequence
ctgaataaaaaatgtggcag

SEQ ID NO: 120810 - DNA, 20 bp, Artificial
  CRISPR gRNA sequence
tgaataaaaaatgtggcaga

SEQ ID NO: 120811 - DNA, 20 bp, Artificial
  CRISPR gRNA sequence
aataaaaaatgtggcagacc

SEQ ID NO: 120812 - DNA, 20 bp, Artificial
  CRISPR gRNA sequence
attggaagctatgttggttt

SEQ ID NO: 120813 - DNA, 20 bp, Artificial
  CRISPR gRNA sequence
ttggaagctatgttggtttg

SEQ ID NO: 120814 - DNA, 20 bp, Artificial
  CRISPR gRNA sequence
gaagctatgttggtttgtct

SEQ ID NO: 120815 - DNA, 20 bp, Artificial
  CRISPR gRNA sequence
tgttggtttgtctgttgtgg

SEQ ID NO: 120816 - DNA, 20 bp, Artificial
  CRISPR gRNA sequence
gtttgtctgttgtggccaaa

SEQ ID NO: 120817 - DNA, 20 bp, Artificial
  CRISPR gRNA sequence
gtctgttgtggccaaagact

SEQ ID NO: 120818 - DNA, 20 bp, Artificial
  CRISPR gRNA sequence
tctgttgtggccaaagactt

SEQ ID NO: 120819 - DNA, 20 bp, Artificial
  CRISPR gRNA sequence
ttgtggccaaagacttacta

SEQ ID NO: 120820 - DNA, 20 bp, Artificial
  CRISPR gRNA sequence
tggccaaagacttactaaat

SEQ ID NO: 120821 - DNA, 20 bp, Artificial
  CRISPR gRNA sequence
actaaatcacaagttagctc

SEQ ID NO: 120822 - DNA, 20 bp, Artificial
  CRISPR gRNA sequence
ctaaatcacaagttagctca

SEQ ID NO: 120823 - DNA, 20 bp, Artificial
  CRISPR gRNA sequence
aatcacaagttagctcaaac

SEQ ID NO: 120824 - DNA, 20 bp, Artificial
  CRISPR gRNA sequence
gctcaaacaagaagagaaaa

SEQ ID NO: 120825 - DNA, 20 bp, Artificial
  CRISPR gRNA sequence
aaacaagaagagaaaaagac

SEQ ID NO: 120826 - DNA, 20 bp, Artificial
  CRISPR gRNA sequence
taaagtccaaatttccatct

SEQ ID NO: 120827 - DNA, 20 bp, Artificial
  CRISPR gRNA sequence
aaagtccaaatttccatctg

SEQ ID NO: 120828 - DNA, 20 bp, Artificial
  CRISPR gRNA sequence
aagtccaaatttccatctga

SEQ ID NO: 120829 - DNA, 20 bp, Artificial
  CRISPR gRNA sequence
ccatctgaaaaccagactag

SEQ ID NO: 120830 - DNA, 20 bp, Artificial
  CRISPR gRNA sequence
catctgaaaaccagactaga

SEQ ID NO: 120831 - DNA, 20 bp, Artificial
  CRISPR gRNA sequence
aaaaccagactagatgtttt

SEQ ID NO: 120832 - DNA, 20 bp, Artificial
  CRISPR gRNA sequence
gatgtttttacttaaaatga

SEQ ID NO: 120833 - DNA, 20 bp, Artificial
  CRISPR gRNA sequence
ttacttaaaatgagataaaa

SEQ ID NO: 120834 - DNA, 20 bp, Artificial
  CRISPR gRNA sequence
tacttaaaatgagataaaag

SEQ ID NO: 120835 - DNA, 20 bp, Artificial
  CRISPR gRNA sequence
acttaaaatgagataaaaga

SEQ ID NO: 120836 - DNA, 20 bp, Artificial
  CRISPR gRNA sequence
cttaaaatgagataaaagag

SEQ ID NO: 120837 - DNA, 20 bp, Artificial
  CRISPR gRNA sequence
aaaatgagataaaagaggca

SEQ ID NO: 120838 - DNA, 20 bp, Artificial
  CRISPR gRNA sequence
aaatgagataaaagaggcaa

SEQ ID NO: 120839 - DNA, 20 bp, Artificial
  CRISPR gRNA sequence
actataaccaggcacccatg

SEQ ID NO: 120840 - DNA, 20 bp, Artificial
  CRISPR gRNA sequence
ctataaccaggcacccatga

SEQ ID NO: 120841 - DNA, 20 bp, Artificial
  CRISPR gRNA sequence
taaccaggcacccatgaaga

SEQ ID NO: 120842 - DNA, 20 bp, Artificial
  CRISPR gRNA sequence
taagtggtcatgggctagac

SEQ ID NO: 120843 - DNA, 20 bp, Artificial
  CRISPR gRNA sequence
agtggtcatgggctagacat

SEQ ID NO: 120844 - DNA, 20 bp, Artificial
  CRISPR gRNA sequence
gacatggcatttcagcacaa

SEQ ID NO: 120845 - DNA, 20 bp, Artificial
  CRISPR gRNA sequence
cagcacaagccatcagaccc

SEQ ID NO: 120846 - DNA, 20 bp, Artificial
  CRISPR gRNA sequence
agcacaagccatcagaccca

SEQ ID NO: 120847 - DNA, 20 bp, Artificial
  CRISPR gRNA sequence
acaagatctggtatctttca

SEQ ID NO: 120848 - DNA, 20 bp, Artificial
  CRISPR gRNA sequence
gtatctttcaaataattccc

SEQ ID NO: 120849 - DNA, 20 bp, Artificial
  CRISPR gRNA sequence
tcaaataattccccagggca

SEQ ID NO: 120850 - DNA, 20 bp, Artificial
  CRISPR gRNA sequence
caaataattccccagggcaa

SEQ ID NO: 120851 - DNA, 20 bp, Artificial
  CRISPR gRNA sequence
aaataattccccagggcaat

SEQ ID NO: 120852 - DNA, 20 bp, Artificial
  CRISPR gRNA sequence
cccagggcaatagaccaacc

SEQ ID NO: 120853 - DNA, 20 bp, Artificial
  CRISPR gRNA sequence
agtggtgctgttatcagttt

SEQ ID NO: 120854 - DNA, 20 bp, Artificial
  CRISPR gRNA sequence
ttatcagtttcattgctgta

SEQ ID NO: 120855 - DNA, 20 bp, Artificial
  CRISPR gRNA sequence
tcagtttcattgctgtaatg

SEQ ID NO: 120856 - DNA, 20 bp, Artificial
  CRISPR gRNA sequence
cattgctgtaatgtttaaag

SEQ ID NO: 120857 - DNA, 20 bp, Artificial
  CRISPR gRNA sequence
attgctgtaatgtttaaagc

SEQ ID NO: 120858 - DNA, 20 bp, Artificial
  CRISPR gRNA sequence
ctgtaatgtttaaagcagtt

SEQ ID NO: 120859 - DNA, 20 bp, Artificial
  CRISPR gRNA sequence
taatgtttaaagcagttttg

SEQ ID NO: 120860 - DNA, 20 bp, Artificial
  CRISPR gRNA sequence
aaagcagttttgcttccata

SEQ ID NO: 120861 - DNA, 20 bp, Artificial
  CRISPR gRNA sequence
aagcagttttgcttccatac

SEQ ID NO: 120862 - DNA, 20 bp, Artificial
  CRISPR gRNA sequence
tgcttccatacctgctgctg

SEQ ID NO: 120863 - DNA, 20 bp, Artificial
  CRISPR gRNA sequence
gcttccatacctgctgctga

SEQ ID NO: 120864 - DNA, 20 bp, Artificial
  CRISPR gRNA sequence
cttccatacctgctgctgaa

SEQ ID NO: 120865 - DNA, 20 bp, Artificial
  CRISPR gRNA sequence
ccatacctgctgctgaatct

SEQ ID NO: 120866 - DNA, 20 bp, Artificial
  CRISPR gRNA sequence
catacctgctgctgaatctg

SEQ ID NO: 120867 - DNA, 20 bp, Artificial
  CRISPR gRNA sequence
ctgctgaatctgtcctgcct

SEQ ID NO: 120868 - DNA, 20 bp, Artificial
  CRISPR gRNA sequence
ctgaatctgtcctgcctgga

SEQ ID NO: 120869 - DNA, 20 bp, Artificial
  CRISPR gRNA sequence
aatctgtcctgcctggacaa

SEQ ID NO: 120870 - DNA, 20 bp, Artificial
  CRISPR gRNA sequence
tcctgcctggacaacaatct

SEQ ID NO: 120871 - DNA, 20 bp, Artificial
  CRISPR gRNA sequence
cctggacaacaatctgctct

SEQ ID NO: 120872 - DNA, 20 bp, Artificial
  CRISPR gRNA sequence
gacaacaatctgctctgtcg

SEQ ID NO: 120873 - DNA, 20 bp, Artificial
  CRISPR gRNA sequence
ctctgtcgaactattgctgt

SEQ ID NO: 120874 - DNA, 20 bp, Artificial
  CRISPR gRNA sequence
tgtcgaactattgctgtttg

SEQ ID NO: 120875 - DNA, 20 bp, Artificial
  CRISPR gRNA sequence
tcgaactattgctgtttgct

SEQ ID NO: 120876 - DNA, 20 bp, Artificial
  CRISPR gRNA sequence
ttgctgtttgctgtatactg

SEQ ID NO: 120877 - DNA, 20 bp, Artificial
  CRISPR gRNA sequence
ctgtttgctgtatactgctc

SEQ ID NO: 120878 - DNA, 20 bp, Artificial
  CRISPR gRNA sequence
tttgctgtatactgctccat

SEQ ID NO: 120879 - DNA, 20 bp, Artificial
  CRISPR gRNA sequence
gctgtatactgctccatggt

SEQ ID NO: 120880 - DNA, 20 bp, Artificial
  CRISPR gRNA sequence
ctgtatactgctccatggtc

SEQ ID NO: 120881 - DNA, 20 bp, Artificial
  CRISPR gRNA sequence
tatactgctccatggtccct

SEQ ID NO: 120882 - DNA, 20 bp, Artificial
  CRISPR gRNA sequence
ctccatggtccctccaagtg

SEQ ID NO: 120883 - DNA, 20 bp, Artificial
  CRISPR gRNA sequence
catggtccctccaagtgaga

SEQ ID NO: 120884 - DNA, 20 bp, Artificial
  CRISPR gRNA sequence
caagtgagattcctgtccac

SEQ ID NO: 120885 - DNA, 20 bp, Artificial
  CRISPR gRNA sequence
ctgtccactctggagatcct

SEQ ID NO: 120886 - DNA, 20 bp, Artificial
  CRISPR gRNA sequence
tccactctggagatcctaga

SEQ ID NO: 120887 - DNA, 20 bp, Artificial
  CRISPR gRNA sequence
tggagatcctagaaggctgt

SEQ ID NO: 120888 - DNA, 20 bp, Artificial
  CRISPR gRNA sequence
gagatcctagaaggctgtga

SEQ ID NO: 120889 - DNA, 20 bp, Artificial
  CRISPR gRNA sequence
gaaggctgtgaggtacactc

SEQ ID NO: 120890 - DNA, 20 bp, Artificial
  CRISPR gRNA sequence
tgaggtacactcctgttaga

SEQ ID NO: 120891 - DNA, 20 bp, Artificial
  CRISPR gRNA sequence
ctgttagaaaggtggggaaa

SEQ ID NO: 120892 - DNA, 20 bp, Artificial
  CRISPR gRNA sequence
ttagaaaggtggggaaagaa

SEQ ID NO: 120893 - DNA, 20 bp, Artificial
  CRISPR gRNA sequence
gaaaggtggggaaagaaact

SEQ ID NO: 120894 - DNA, 20 bp, Artificial
  CRISPR gRNA sequence
aagtgagattgtcaataaag

SEQ ID NO: 120895 - DNA, 20 bp, Artificial
  CRISPR gRNA sequence
tcaataaaggccttaccaga

SEQ ID NO: 120896 - DNA, 20 bp, Artificial
  CRISPR gRNA sequence
accagacaattaacctggat

SEQ ID NO: 120897 - DNA, 20 bp, Artificial
  CRISPR gRNA sequence
ccagacaattaacctggata

SEQ ID NO: 120898 - DNA, 20 bp, Artificial
  CRISPR gRNA sequence
acctggataatttatcactg

SEQ ID NO: 120899 - DNA, 20 bp, Artificial
  CRISPR gRNA sequence
gataatttatcactgtactt

SEQ ID NO: 120900 - DNA, 20 bp, Artificial
  CRISPR gRNA sequence
atcactgtactttatttgca

SEQ ID NO: 120901 - DNA, 20 bp, Artificial
  CRISPR gRNA sequence
tcactgtactttatttgcaa

SEQ ID NO: 120902 - DNA, 20 bp, Artificial
  CRISPR gRNA sequence
tactttatttgcaagaaaac

SEQ ID NO: 120903 - DNA, 20 bp, Artificial
  CRISPR gRNA sequence
tatttgcaagaaaacaggat

SEQ ID NO: 120904 - DNA, 20 bp, Artificial
  CRISPR gRNA sequence
atttgcaagaaaacaggata

SEQ ID NO: 120905 - DNA, 20 bp, Artificial
  CRISPR gRNA sequence
tttgcaagaaaacaggatag

SEQ ID NO: 120906 - DNA, 20 bp, Artificial
  CRISPR gRNA sequence
gcaagaaaacaggataggag

SEQ ID NO: 120907 - DNA, 20 bp, Artificial
  CRISPR gRNA sequence
caagaaaacaggataggaga

SEQ ID NO: 120908 - DNA, 20 bp, Artificial
  CRISPR gRNA sequence
atattcagtatcatttttaa

SEQ ID NO: 120909 - DNA, 20 bp, Artificial
  CRISPR gRNA sequence
tattcagtatcatttttaac

SEQ ID NO: 120910 - DNA, 20 bp, Artificial
  CRISPR gRNA sequence
agtatcatttttaactggga

SEQ ID NO: 120911 - DNA, 20 bp, Artificial
  CRISPR gRNA sequence
ttaactgggattacatggca

SEQ ID NO: 120912 - DNA, 20 bp, Artificial
  CRISPR gRNA sequence
taactgggattacatggcac

SEQ ID NO: 120913 - DNA, 20 bp, Artificial
  CRISPR gRNA sequence
aactgggattacatggcaca

SEQ ID NO: 120914 - DNA, 20 bp, Artificial
  CRISPR gRNA sequence
actgggattacatggcacaa

SEQ ID NO: 120915 - DNA, 20 bp, Artificial
  CRISPR gRNA sequence
ggattacatggcacaatcat

SEQ ID NO: 120916 - DNA, 20 bp, Artificial
  CRISPR gRNA sequence
catggcacaatcataacaac

SEQ ID NO: 120917 - DNA, 20 bp, Artificial
  CRISPR gRNA sequence
ttttcacgtttctaaaatgc

SEQ ID NO: 120918 - DNA, 20 bp, Artificial
  CRISPR gRNA sequence
tcacgtttctaaaatgcttt

SEQ ID NO: 120919 - DNA, 20 bp, Artificial
  CRISPR gRNA sequence
cacgtttctaaaatgctttc

SEQ ID NO: 120920 - DNA, 20 bp, Artificial
  CRISPR gRNA sequence
acgtttctaaaatgctttca

SEQ ID NO: 120921 - DNA, 20 bp, Artificial
  CRISPR gRNA sequence
ctaaaatgctttcagtatac

SEQ ID NO: 120922 - DNA, 20 bp, Artificial
  CRISPR gRNA sequence
taaaatgctttcagtatact

SEQ ID NO: 120923 - DNA, 20 bp, Artificial
  CRISPR gRNA sequence
aaatgctttcagtatactgg

SEQ ID NO: 120924 - DNA, 20 bp, Artificial
  CRISPR gRNA sequence
tcagtatactggcaacctta

SEQ ID NO: 120925 - DNA, 20 bp, Artificial
  CRISPR gRNA sequence
cagtatactggcaaccttac

SEQ ID NO: 120926 - DNA, 20 bp, Artificial
  CRISPR gRNA sequence
agtatactggcaaccttacc

SEQ ID NO: 120927 - DNA, 20 bp, Artificial
  CRISPR gRNA sequence
gcaaccttacctttcaatac

SEQ ID NO: 120928 - DNA, 20 bp, Artificial
  CRISPR gRNA sequence
acctttcaatactgtcagag

SEQ ID NO: 120929 - DNA, 20 bp, Artificial
  CRISPR gRNA sequence
cctttcaatactgtcagagc

SEQ ID NO: 120930 - DNA, 20 bp, Artificial
  CRISPR gRNA sequence
tcaatactgtcagagcaata

SEQ ID NO: 120931 - DNA, 20 bp, Artificial
  CRISPR gRNA sequence
caatactgtcagagcaatac

SEQ ID NO: 120932 - DNA, 20 bp, Artificial
  CRISPR gRNA sequence
aatactgtcagagcaatact

SEQ ID NO: 120933 - DNA, 20 bp, Artificial
  CRISPR gRNA sequence
tcagagcaatacttgcacct

SEQ ID NO: 120934 - DNA, 20 bp, Artificial
  CRISPR gRNA sequence
gcacctaagagatactcgtt

SEQ ID NO: 120935 - DNA, 20 bp, Artificial
  CRISPR gRNA sequence
cacctaagagatactcgtta

SEQ ID NO: 120936 - DNA, 20 bp, Artificial
  CRISPR gRNA sequence
agagatactcgttaagctac

SEQ ID NO: 120937 - DNA, 20 bp, Artificial
  CRISPR gRNA sequence
gttaagctacatcactttga

SEQ ID NO: 120938 - DNA, 20 bp, Artificial
  CRISPR gRNA sequence
agctacatcactttgataca

SEQ ID NO: 120939 - DNA, 20 bp, Artificial
  CRISPR gRNA sequence
catcactttgatacaaggca

SEQ ID NO: 120940 - DNA, 20 bp, Artificial
  CRISPR gRNA sequence
tgatacaaggcatacctaac

SEQ ID NO: 120941 - DNA, 20 bp, Artificial
  CRISPR gRNA sequence
gatacaaggcatacctaaca

SEQ ID NO: 120942 - DNA, 20 bp, Artificial
  CRISPR gRNA sequence
atacaaggcatacctaacac

SEQ ID NO: 120943 - DNA, 20 bp, Artificial
  CRISPR gRNA sequence
acactgattttcaggtttgc

SEQ ID NO: 120944 - DNA, 20 bp, Artificial
  CRISPR gRNA sequence
attttcaggtttgcacatat

SEQ ID NO: 120945 - DNA, 20 bp, Artificial
  CRISPR gRNA sequence
tcaggtttgcacatatactt

SEQ ID NO: 120946 - DNA, 20 bp, Artificial
  CRISPR gRNA sequence
caggtttgcacatatacttt

SEQ ID NO: 120947 - DNA, 20 bp, Artificial
  CRISPR gRNA sequence
aggtttgcacatatacttta

SEQ ID NO: 120948 - DNA, 20 bp, Artificial
  CRISPR gRNA sequence
gcacatatactttagagaat

SEQ ID NO: 120949 - DNA, 20 bp, Artificial
  CRISPR gRNA sequence
cacatatactttagagaata

SEQ ID NO: 120950 - DNA, 20 bp, Artificial
  CRISPR gRNA sequence
tagagaataaagcttcttta

SEQ ID NO: 120951 - DNA, 20 bp, Artificial
  CRISPR gRNA sequence
agagaataaagcttctttaa

SEQ ID NO: 120952 - DNA, 20 bp, Artificial
  CRISPR gRNA sequence
gagaataaagcttctttaag

SEQ ID NO: 120953 - DNA, 20 bp, Artificial
  CRISPR gRNA sequence
ctttaagttgtaacacgtaa

SEQ ID NO: 120954 - DNA, 20 bp, Artificial
  CRISPR gRNA sequence
tttaagttgtaacacgtaat

SEQ ID NO: 120955 - DNA, 20 bp, Artificial
  CRISPR gRNA sequence
taagttgtaacacgtaattg

SEQ ID NO: 120956 - DNA, 20 bp, Artificial
  CRISPR gRNA sequence
aagttgtaacacgtaattgc

SEQ ID NO: 120957 - DNA, 20 bp, Artificial
  CRISPR gRNA sequence
agttgtaacacgtaattgct

SEQ ID NO: 120958 - DNA, 20 bp, Artificial
  CRISPR gRNA sequence
taacacgtaattgcttccca

SEQ ID NO: 120959 - DNA, 20 bp, Artificial
  CRISPR gRNA sequence
cttcccaccaaacatgttac

SEQ ID NO: 120960 - DNA, 20 bp, Artificial
  CRISPR gRNA sequence
cccaccaaacatgttactca

SEQ ID NO: 120961 - DNA, 20 bp, Artificial
  CRISPR gRNA sequence
ccaccaaacatgttactcag

SEQ ID NO: 120962 - DNA, 20 bp, Artificial
  CRISPR gRNA sequence
ctcaggtccactacatatgg

SEQ ID NO: 120963 - DNA, 20 bp, Artificial
  CRISPR gRNA sequence
aggtccactacatatggtag

SEQ ID NO: 120964 - DNA, 20 bp, Artificial
  CRISPR gRNA sequence
catatggtaggcaaaattta

SEQ ID NO: 120965 - DNA, 20 bp, Artificial
  CRISPR gRNA sequence
acccttctcatagactttaa

SEQ ID NO: 120966 - DNA, 20 bp, Artificial
  CRISPR gRNA sequence
cccttctcatagactttaag

SEQ ID NO: 120967 - DNA, 20 bp, Artificial
  CRISPR gRNA sequence
ctcatagactttaagagttg

SEQ ID NO: 120968 - DNA, 20 bp, Artificial
  CRISPR gRNA sequence
tcatagactttaagagttga

SEQ ID NO: 120969 - DNA, 20 bp, Artificial
  CRISPR gRNA sequence
atagactttaagagttgaag

SEQ ID NO: 120970 - DNA, 20 bp, Artificial
  CRISPR gRNA sequence
taagagttgaagatccactt

SEQ ID NO: 120971 - DNA, 20 bp, Artificial
  CRISPR gRNA sequence
aagagttgaagatccacttt

SEQ ID NO: 120972 - DNA, 20 bp, Artificial
  CRISPR gRNA sequence
agagttgaagatccactttt

SEQ ID NO: 120973 - DNA, 20 bp, Artificial
  CRISPR gRNA sequence
aagatccacttttaaaaata

SEQ ID NO: 120974 - DNA, 20 bp, Artificial
  CRISPR gRNA sequence
ttaaaaataaggatacaatt

SEQ ID NO: 120975 - DNA, 20 bp, Artificial
  CRISPR gRNA sequence
taaaaataaggatacaatta

SEQ ID NO: 120976 - DNA, 20 bp, Artificial
  CRISPR gRNA sequence
aaaaataaggatacaattag

SEQ ID NO: 120977 - DNA, 20 bp, Artificial
  CRISPR gRNA sequence
aaaataaggatacaattaga

SEQ ID NO: 120978 - DNA, 20 bp, Artificial
  CRISPR gRNA sequence
gataaactgaatgatatctg

SEQ ID NO: 120979 - DNA, 20 bp, Artificial
  CRISPR gRNA sequence
aatgatatctgagaaccttt

SEQ ID NO: 120980 - DNA, 20 bp, Artificial
  CRISPR gRNA sequence
agaacctttaataaagactt

SEQ ID NO: 120981 - DNA, 20 bp, Artificial
  CRISPR gRNA sequence
taataaagacttcattaaaa

SEQ ID NO: 120982 - DNA, 20 bp, Artificial
  CRISPR gRNA sequence
aataaagacttcattaaaaa

SEQ ID NO: 120983 - DNA, 20 bp, Artificial
  CRISPR gRNA sequence
ataaagacttcattaaaaaa

SEQ ID NO: 120984 - DNA, 20 bp, Artificial
  CRISPR gRNA sequence
cattaaaaaattaaaatgat

SEQ ID NO: 120985 - DNA, 20 bp, Artificial
  CRISPR gRNA sequence
attaaaaaattaaaatgata

SEQ ID NO: 120986 - DNA, 20 bp, Artificial
  CRISPR gRNA sequence
aaaaattaaaatgatataag

SEQ ID NO: 120987 - DNA, 20 bp, Artificial
  CRISPR gRNA sequence
aaatgatataagttagcaat

SEQ ID NO: 120988 - DNA, 20 bp, Artificial
  CRISPR gRNA sequence
gcaatcggcaattcatcttg

SEQ ID NO: 120989 - DNA, 20 bp, Artificial
  CRISPR gRNA sequence
atcttggaaatatgggaggg

SEQ ID NO: 120990 - DNA, 20 bp, Artificial
  CRISPR gRNA sequence
ggaaatatgggagggaggac

SEQ ID NO: 120991 - DNA, 20 bp, Artificial
  CRISPR gRNA sequence
gaaatatgggagggaggaca

SEQ ID NO: 120992 - DNA, 20 bp, Artificial
  CRISPR gRNA sequence
tctctctgatttttcactag

SEQ ID NO: 120993 - DNA, 20 bp, Artificial
  CRISPR gRNA sequence
ctctctgatttttcactagg

SEQ ID NO: 120994 - DNA, 20 bp, Artificial
  CRISPR gRNA sequence
tctctgatttttcactaggc

SEQ ID NO: 120995 - DNA, 20 bp, Artificial
  CRISPR gRNA sequence
tctgatttttcactaggccc

SEQ ID NO: 120996 - DNA, 20 bp, Artificial
  CRISPR gRNA sequence
tgatttttcactaggccctc

SEQ ID NO: 120997 - DNA, 20 bp, Artificial
  CRISPR gRNA sequence
atttttcactaggccctcat

SEQ ID NO: 120998 - DNA, 20 bp, Artificial
  CRISPR gRNA sequence
ttcactaggccctcataaat

SEQ ID NO: 120999 - DNA, 20 bp, Artificial
  CRISPR gRNA sequence
tcactaggccctcataaatt

SEQ ID NO: 121000 - DNA, 20 bp, Artificial
  CRISPR gRNA sequence
cactaggccctcataaattc

SEQ ID NO: 121001 - DNA, 20 bp, Artificial
  CRISPR gRNA sequence
actaggccctcataaattcc

SEQ ID NO: 121002 - DNA, 20 bp, Artificial
  CRISPR gRNA sequence
ggccctcataaattccaaca

SEQ ID NO: 121003 - DNA, 20 bp, Artificial
  CRISPR gRNA sequence
ataaattccaacatctgaat

SEQ ID NO: 121004 - DNA, 20 bp, Artificial
  CRISPR gRNA sequence
caacatctgaataataaaat

SEQ ID NO: 121005 - DNA, 20 bp, Artificial
  CRISPR gRNA sequence
aataataaaatgacgtgacc

SEQ ID NO: 121006 - DNA, 20 bp, Artificial
  CRISPR gRNA sequence
actgagctgctcattatcgt

SEQ ID NO: 121007 - DNA, 20 bp, Artificial
  CRISPR gRNA sequence
agctgctcattatcgtggca

SEQ ID NO: 121008 - DNA, 20 bp, Artificial
  CRISPR gRNA sequence
ctcattatcgtggcaaagta

SEQ ID NO: 121009 - DNA, 20 bp, Artificial
  CRISPR gRNA sequence
attatcgtggcaaagtacag

SEQ ID NO: 121010 - DNA, 20 bp, Artificial
  CRISPR gRNA sequence
tcgtggcaaagtacagtacc

SEQ ID NO: 121011 - DNA, 20 bp, Artificial
  CRISPR gRNA sequence
tccataaatccacacatgct

SEQ ID NO: 121012 - DNA, 20 bp, Artificial
  CRISPR gRNA sequence
cataaatccacacatgctgg

SEQ ID NO: 121013 - DNA, 20 bp, Artificial
  CRISPR gRNA sequence
gtggaattaatcatttgcaa

SEQ ID NO: 121014 - DNA, 20 bp, Artificial
  CRISPR gRNA sequence
atcatttgcaaggtgtctca

SEQ ID NO: 121015 - DNA, 20 bp, Artificial
  CRISPR gRNA sequence
gcaaggtgtctcaatacagt

SEQ ID NO: 121016 - DNA, 20 bp, Artificial
  CRISPR gRNA sequence
caaggtgtctcaatacagtg

SEQ ID NO: 121017 - DNA, 20 bp, Artificial
  CRISPR gRNA sequence
aatacagtgtgaaagaagaa

SEQ ID NO: 121018 - DNA, 20 bp, Artificial
  CRISPR gRNA sequence
tatgtccaagtacttagaaa

SEQ ID NO: 121019 - DNA, 20 bp, Artificial
  CRISPR gRNA sequence
agaaagaagtgtattgatat

SEQ ID NO: 121020 - DNA, 20 bp, Artificial
  CRISPR gRNA sequence
gaaagaagtgtattgatatc

SEQ ID NO: 121021 - DNA, 20 bp, Artificial
  CRISPR gRNA sequence
atatctaaaatttactttga

SEQ ID NO: 121022 - DNA, 20 bp, Artificial
  CRISPR gRNA sequence
aaatttactttgaaatgcat

SEQ ID NO: 121023 - DNA, 20 bp, Artificial
  CRISPR gRNA sequence
actttgaaatgcatcaaaaa

SEQ ID NO: 121024 - DNA, 20 bp, Artificial
  CRISPR gRNA sequence
ctttgaaatgcatcaaaaaa

SEQ ID NO: 121025 - DNA, 20 bp, Artificial
  CRISPR gRNA sequence
tgaaatgcatcaaaaaatgg

SEQ ID NO: 121026 - DNA, 20 bp, Artificial
  CRISPR gRNA sequence
gaaatgcatcaaaaaatgga

SEQ ID NO: 121027 - DNA, 20 bp, Artificial
  CRISPR gRNA sequence
aaatgcatcaaaaaatggat

SEQ ID NO: 121028 - DNA, 20 bp, Artificial
  CRISPR gRNA sequence
gtaaggcaattatagtaaga

SEQ ID NO: 121029 - DNA, 20 bp, Artificial
  CRISPR gRNA sequence
tagtaagatgttaatagacc

SEQ ID NO: 121030 - DNA, 20 bp, Artificial
  CRISPR gRNA sequence
atagaccctaactggcaggt

SEQ ID NO: 121031 - DNA, 20 bp, Artificial
  CRISPR gRNA sequence
actggcaggtatacaggtgt

SEQ ID NO: 121032 - DNA, 20 bp, Artificial
  CRISPR gRNA sequence
gcaggtatacaggtgtttat

SEQ ID NO: 121033 - DNA, 20 bp, Artificial
  CRISPR gRNA sequence
attttcaaattcctttgatt

SEQ ID NO: 121034 - DNA, 20 bp, Artificial
  CRISPR gRNA sequence
ttttcaaattcctttgattt

SEQ ID NO: 121035 - DNA, 20 bp, Artificial
  CRISPR gRNA sequence
tcaaattcctttgatttcac

SEQ ID NO: 121036 - DNA, 20 bp, Artificial
  CRISPR gRNA sequence
caaattcctttgatttcact

SEQ ID NO: 121037 - DNA, 20 bp, Artificial
  CRISPR gRNA sequence
aaattcctttgatttcactg

SEQ ID NO: 121038 - DNA, 20 bp, Artificial
  CRISPR gRNA sequence
ctttgatttcactgcacact

SEQ ID NO: 121039 - DNA, 20 bp, Artificial
  CRISPR gRNA sequence
tgatttcactgcacacttga

SEQ ID NO: 121040 - DNA, 20 bp, Artificial
  CRISPR gRNA sequence
gatttcactgcacacttgaa

SEQ ID NO: 121041 - DNA, 20 bp, Artificial
  CRISPR gRNA sequence
atttcactgcacacttgaaa

SEQ ID NO: 121042 - DNA, 20 bp, Artificial
  CRISPR gRNA sequence
cactgcacacttgaaaattc

SEQ ID NO: 121043 - DNA, 20 bp, Artificial
  CRISPR gRNA sequence
actgcacacttgaaaattct

SEQ ID NO: 121044 - DNA, 20 bp, Artificial
  CRISPR gRNA sequence
cacacttgaaaattcttatt

SEQ ID NO: 121045 - DNA, 20 bp, Artificial
  CRISPR gRNA sequence
gaaaattcttatttctagaa

SEQ ID NO: 121046 - DNA, 20 bp, Artificial
  CRISPR gRNA sequence
aaaattcttatttctagaat

SEQ ID NO: 121047 - DNA, 20 bp, Artificial
  CRISPR gRNA sequence
ttatttctagaataagaatt

SEQ ID NO: 121048 - DNA, 20 bp, Artificial
  CRISPR gRNA sequence
atttctagaataagaatttt

SEQ ID NO: 121049 - DNA, 20 bp, Artificial
  CRISPR gRNA sequence
tttctagaataagaattttg

SEQ ID NO: 121050 - DNA, 20 bp, Artificial
  CRISPR gRNA sequence
ctagaataagaattttgaga

SEQ ID NO: 121051 - DNA, 20 bp, Artificial
  CRISPR gRNA sequence
tagaataagaattttgagaa

SEQ ID NO: 121052 - DNA, 20 bp, Artificial
  CRISPR gRNA sequence
gaataagaattttgagaaat

SEQ ID NO: 121053 - DNA, 20 bp, Artificial
  CRISPR gRNA sequence
tgagaaattcttatttccca

SEQ ID NO: 121054 - DNA, 20 bp, Artificial
  CRISPR gRNA sequence
gagaaattcttatttcccaa

SEQ ID NO: 121055 - DNA, 20 bp, Artificial
  CRISPR gRNA sequence
agaaattcttatttcccaaa

SEQ ID NO: 121056 - DNA, 20 bp, Artificial
  CRISPR gRNA sequence
ttatttcccaaatgaatgtt

SEQ ID NO: 121057 - DNA, 20 bp, Artificial
  CRISPR gRNA sequence
atttcccaaatgaatgttgg

SEQ ID NO: 121058 - DNA, 20 bp, Artificial
  CRISPR gRNA sequence
tttcccaaatgaatgttgga

SEQ ID NO: 121059 - DNA, 20 bp, Artificial
  CRISPR gRNA sequence
cccaaatgaatgttggaatg

SEQ ID NO: 121060 - DNA, 20 bp, Artificial
  CRISPR gRNA sequence
ccaaatgaatgttggaatgt

SEQ ID NO: 121061 - DNA, 20 bp, Artificial
  CRISPR gRNA sequence
gaatgttaggaaaaatataa

SEQ ID NO: 121062 - DNA, 20 bp, Artificial
  CRISPR gRNA sequence
ggaaaaatataacaaaattt

SEQ ID NO: 121063 - DNA, 20 bp, Artificial
  CRISPR gRNA sequence
aatcaaaataaaaattaatc

SEQ ID NO: 121064 - DNA, 20 bp, Artificial
  CRISPR gRNA sequence
atcaaaataaaaattaatca

SEQ ID NO: 121065 - DNA, 20 bp, Artificial
  CRISPR gRNA sequence
atcaaccccattactcataa

SEQ ID NO: 121066 - DNA, 20 bp, Artificial
  CRISPR gRNA sequence
ctcataaccaaaatggatac

SEQ ID NO: 121067 - DNA, 20 bp, Artificial
  CRISPR gRNA sequence
ataaccaaaatggatacaac

SEQ ID NO: 121068 - DNA, 20 bp, Artificial
  CRISPR gRNA sequence
tgagccataaataacaggct

SEQ ID NO: 121069 - DNA, 20 bp, Artificial
  CRISPR gRNA sequence
tgtcatcacagcaagaggac

SEQ ID NO: 121070 - DNA, 20 bp, Artificial
  CRISPR gRNA sequence
gtggccatatggttctccaa

SEQ ID NO: 121071 - DNA, 20 bp, Artificial
  CRISPR gRNA sequence
tggccatatggttctccaaa

SEQ ID NO: 121072 - DNA, 20 bp, Artificial
  CRISPR gRNA sequence
tccaaagcactgcccttgat

SEQ ID NO: 121073 - DNA, 20 bp, Artificial
  CRISPR gRNA sequence
caaagcactgcccttgatct

SEQ ID NO: 121074 - DNA, 20 bp, Artificial
  CRISPR gRNA sequence
cccttgatctaatggaatgc

SEQ ID NO: 121075 - DNA, 20 bp, Artificial
  CRISPR gRNA sequence
gatctaatggaatgctcgct

SEQ ID NO: 121076 - DNA, 20 bp, Artificial
  CRISPR gRNA sequence
atctaatggaatgctcgcta

SEQ ID NO: 121077 - DNA, 20 bp, Artificial
  CRISPR gRNA sequence
atggaatgctcgctaggtaa

SEQ ID NO: 121078 - DNA, 20 bp, Artificial
  CRISPR gRNA sequence
gctaggtaaatttctagcta

SEQ ID NO: 121079 - DNA, 20 bp, Artificial
  CRISPR gRNA sequence
ggtaaatttctagctataat

SEQ ID NO: 121080 - DNA, 20 bp, Artificial
  CRISPR gRNA sequence
ctagctataatttggattta

SEQ ID NO: 121081 - DNA, 20 bp, Artificial
  CRISPR gRNA sequence
tagctataatttggatttac

SEQ ID NO: 121082 - DNA, 20 bp, Artificial
  CRISPR gRNA sequence
gctataatttggatttacat

SEQ ID NO: 121083 - DNA, 20 bp, Artificial
  CRISPR gRNA sequence
taatttggatttacatatag

SEQ ID NO: 121084 - DNA, 20 bp, Artificial
  CRISPR gRNA sequence
ggatttacatatagattggc

SEQ ID NO: 121085 - DNA, 20 bp, Artificial
  CRISPR gRNA sequence
gatttacatatagattggcc

SEQ ID NO: 121086 - DNA, 20 bp, Artificial
  CRISPR gRNA sequence
acatatagattggccaacag

SEQ ID NO: 121087 - DNA, 20 bp, Artificial
  CRISPR gRNA sequence
catatagattggccaacagg

SEQ ID NO: 121088 - DNA, 20 bp, Artificial
  CRISPR gRNA sequence
gccaacagggagcaaatata

SEQ ID NO: 121089 - DNA, 20 bp, Artificial
  CRISPR gRNA sequence
tctgatttttacaccagtct

SEQ ID NO: 121090 - DNA, 20 bp, Artificial
  CRISPR gRNA sequence
ctgatttttacaccagtctc

SEQ ID NO: 121091 - DNA, 20 bp, Artificial
  CRISPR gRNA sequence
tgatttttacaccagtctct

SEQ ID NO: 121092 - DNA, 20 bp, Artificial
  CRISPR gRNA sequence
atttttacaccagtctcttt

SEQ ID NO: 121093 - DNA, 20 bp, Artificial
  CRISPR gRNA sequence
ttacaccagtctctttggaa

SEQ ID NO: 121094 - DNA, 20 bp, Artificial
  CRISPR gRNA sequence
tacaccagtctctttggaat

SEQ ID NO: 121095 - DNA, 20 bp, Artificial
  CRISPR gRNA sequence
acaccagtctctttggaatt

SEQ ID NO: 121096 - DNA, 20 bp, Artificial
  CRISPR gRNA sequence
caccagtctctttggaattg

SEQ ID NO: 121097 - DNA, 20 bp, Artificial
  CRISPR gRNA sequence
tttggaattggttgactaag

SEQ ID NO: 121098 - DNA, 20 bp, Artificial
  CRISPR gRNA sequence
tggaattggttgactaagtc

SEQ ID NO: 121099 - DNA, 20 bp, Artificial
  CRISPR gRNA sequence
ggaattggttgactaagtct

SEQ ID NO: 121100 - DNA, 20 bp, Artificial
  CRISPR gRNA sequence
gaattggttgactaagtctg

SEQ ID NO: 121101 - DNA, 20 bp, Artificial
  CRISPR gRNA sequence
gttgactaagtctgctcctc

SEQ ID NO: 121102 - DNA, 20 bp, Artificial
  CRISPR gRNA sequence
actaagtctgctcctcagag

SEQ ID NO: 121103 - DNA, 20 bp, Artificial
  CRISPR gRNA sequence
agtctgctcctcagagattc

SEQ ID NO: 121104 - DNA, 20 bp, Artificial
  CRISPR gRNA sequence
ctcctcagagattctgggta

SEQ ID NO: 121105 - DNA, 20 bp, Artificial
  CRISPR gRNA sequence
ctcagagattctgggtatag

SEQ ID NO: 121106 - DNA, 20 bp, Artificial
  CRISPR gRNA sequence
agagattctgggtatagaat

SEQ ID NO: 121107 - DNA, 20 bp, Artificial
  CRISPR gRNA sequence
tgggtatagaatagaaaatc

SEQ ID NO: 121108 - DNA, 20 bp, Artificial
  CRISPR gRNA sequence
ggtatagaatagaaaatcag

SEQ ID NO: 121109 - DNA, 20 bp, Artificial
  CRISPR gRNA sequence
tcagccagactgtgagtctg

SEQ ID NO: 121110 - DNA, 20 bp, Artificial
  CRISPR gRNA sequence
cagccagactgtgagtctgt

SEQ ID NO: 121111 - DNA, 20 bp, Artificial
  CRISPR gRNA sequence
agccagactgtgagtctgtt

SEQ ID NO: 121112 - DNA, 20 bp, Artificial
  CRISPR gRNA sequence
tgagtctgttaggggcacta

SEQ ID NO: 121113 - DNA, 20 bp, Artificial
  CRISPR gRNA sequence
ttaggggcactaacaggctt

SEQ ID NO: 121114 - DNA, 20 bp, Artificial
  CRISPR gRNA sequence
ggggcactaacaggcttccc

SEQ ID NO: 121115 - DNA, 20 bp, Artificial
  CRISPR gRNA sequence
acaggcttccctaaattcta

SEQ ID NO: 121116 - DNA, 20 bp, Artificial
  CRISPR gRNA sequence
ccctaaattctatcttgtct

SEQ ID NO: 121117 - DNA, 20 bp, Artificial
  CRISPR gRNA sequence
cctaaattctatcttgtctc

SEQ ID NO: 121118 - DNA, 20 bp, Artificial
  CRISPR gRNA sequence
aattctatcttgtctctaat

SEQ ID NO: 121119 - DNA, 20 bp, Artificial
  CRISPR gRNA sequence
tatcttgtctctaatacaca

SEQ ID NO: 121120 - DNA, 20 bp, Artificial
  CRISPR gRNA sequence
tcttgtctctaatacacaat

SEQ ID NO: 121121 - DNA, 20 bp, Artificial
  CRISPR gRNA sequence
gtctctaatacacaatacat

SEQ ID NO: 121122 - DNA, 20 bp, Artificial
  CRISPR gRNA sequence
tctctaatacacaatacatt

SEQ ID NO: 121123 - DNA, 20 bp, Artificial
  CRISPR gRNA sequence
taatacacaatacatttatg

SEQ ID NO: 121124 - DNA, 20 bp, Artificial
  CRISPR gRNA sequence
atacacaatacatttatggc

SEQ ID NO: 121125 - DNA, 20 bp, Artificial
  CRISPR gRNA sequence
atggctataaactaataaaa

SEQ ID NO: 121126 - DNA, 20 bp, Artificial
  CRISPR gRNA sequence
tggctataaactaataaaat

SEQ ID NO: 121127 - DNA, 20 bp, Artificial
  CRISPR gRNA sequence
taaactaataaaattaaggt

SEQ ID NO: 121128 - DNA, 20 bp, Artificial
  CRISPR gRNA sequence
ataaaattaaggttatgatg

SEQ ID NO: 121129 - DNA, 20 bp, Artificial
  CRISPR gRNA sequence
aggttatgatgtaaacgaat

SEQ ID NO: 121130 - DNA, 20 bp, Artificial
  CRISPR gRNA sequence
tgatgtaaacgaatatatat

SEQ ID NO: 121131 - DNA, 20 bp, Artificial
  CRISPR gRNA sequence
catttatataaaatctccaa

SEQ ID NO: 121132 - DNA, 20 bp, Artificial
  CRISPR gRNA sequence
atataaaatctccaaaagac

SEQ ID NO: 121133 - DNA, 20 bp, Artificial
  CRISPR gRNA sequence
tataaaatctccaaaagaca

SEQ ID NO: 121134 - DNA, 20 bp, Artificial
  CRISPR gRNA sequence
caaaagacatcagtaatcta

SEQ ID NO: 121135 - DNA, 20 bp, Artificial
  CRISPR gRNA sequence
gagacagaaaatggatcagt

SEQ ID NO: 121136 - DNA, 20 bp, Artificial
  CRISPR gRNA sequence
cttgggagtggagaatacag

SEQ ID NO: 121137 - DNA, 20 bp, Artificial
  CRISPR gRNA sequence
gggagtggagaatacaggga

SEQ ID NO: 121138 - DNA, 20 bp, Artificial
  CRISPR gRNA sequence
ggagtggagaatacagggag

SEQ ID NO: 121139 - DNA, 20 bp, Artificial
  CRISPR gRNA sequence
actggcatggagccttagga

SEQ ID NO: 121140 - DNA, 20 bp, Artificial
  CRISPR gRNA sequence
gcatggagccttaggaacat

SEQ ID NO: 121141 - DNA, 20 bp, Artificial
  CRISPR gRNA sequence
aggaacattgtagggtgatg

SEQ ID NO: 121142 - DNA, 20 bp, Artificial
  CRISPR gRNA sequence
ggaacattgtagggtgatga

SEQ ID NO: 121143 - DNA, 20 bp, Artificial
  CRISPR gRNA sequence
tagggtgatgaaaatgtttt

SEQ ID NO: 121144 - DNA, 20 bp, Artificial
  CRISPR gRNA sequence
tatatcttcattgtggtagc

SEQ ID NO: 121145 - DNA, 20 bp, Artificial
  CRISPR gRNA sequence
atatcttcattgtggtagca

SEQ ID NO: 121146 - DNA, 20 bp, Artificial
  CRISPR gRNA sequence
tatcttcattgtggtagcag

SEQ ID NO: 121147 - DNA, 20 bp, Artificial
  CRISPR gRNA sequence
cattgtggtagcagttgcac

SEQ ID NO: 121148 - DNA, 20 bp, Artificial
  CRISPR gRNA sequence
attgtggtagcagttgcaca

SEQ ID NO: 121149 - DNA, 20 bp, Artificial
  CRISPR gRNA sequence
tggtagcagttgcacaggtg

SEQ ID NO: 121150 - DNA, 20 bp, Artificial
  CRISPR gRNA sequence
cacaggtgtacaaatttgtc

SEQ ID NO: 121151 - DNA, 20 bp, Artificial
  CRISPR gRNA sequence
gtcaaaactcatcaaaatac

SEQ ID NO: 121152 - DNA, 20 bp, Artificial
  CRISPR gRNA sequence
tcaaaactcatcaaaataca

SEQ ID NO: 121153 - DNA, 20 bp, Artificial
  CRISPR gRNA sequence
atcaaaatacacatttaaaa

SEQ ID NO: 121154 - DNA, 20 bp, Artificial
  CRISPR gRNA sequence
aaaattattatactttgttt

SEQ ID NO: 121155 - DNA, 20 bp, Artificial
  CRISPR gRNA sequence
aaattattatactttgtttc

SEQ ID NO: 121156 - DNA, 20 bp, Artificial
  CRISPR gRNA sequence
ttatactttgtttctaaagt

SEQ ID NO: 121157 - DNA, 20 bp, Artificial
  CRISPR gRNA sequence
tactttgtttctaaagtatc

SEQ ID NO: 121158 - DNA, 20 bp, Artificial
  CRISPR gRNA sequence
tgtttctaaagtatctctca

SEQ ID NO: 121159 - DNA, 20 bp, Artificial
  CRISPR gRNA sequence
gtttctaaagtatctctcaa

SEQ ID NO: 121160 - DNA, 20 bp, Artificial
  CRISPR gRNA sequence
tttctaaagtatctctcaat

SEQ ID NO: 121161 - DNA, 20 bp, Artificial
  CRISPR gRNA sequence
ctaaagtatctctcaataaa

SEQ ID NO: 121162 - DNA, 20 bp, Artificial
  CRISPR gRNA sequence
taaagtatctctcaataaat

SEQ ID NO: 121163 - DNA, 20 bp, Artificial
  CRISPR gRNA sequence
aagtatctctcaataaattg

SEQ ID NO: 121164 - DNA, 20 bp, Artificial
  CRISPR gRNA sequence
tcaataaattgattttaaaa

SEQ ID NO: 121165 - DNA, 20 bp, Artificial
  CRISPR gRNA sequence
aataaattgattttaaaaaa

SEQ ID NO: 121166 - DNA, 20 bp, Artificial
  CRISPR gRNA sequence
attttaaaaaataaggatca

SEQ ID NO: 121167 - DNA, 20 bp, Artificial
  CRISPR gRNA sequence
taaaaaataaggatcatgaa

SEQ ID NO: 121168 - DNA, 20 bp, Artificial
  CRISPR gRNA sequence
aaaaaataaggatcatgaaa

SEQ ID NO: 121169 - DNA, 20 bp, Artificial
  CRISPR gRNA sequence
aaaaataaggatcatgaaag

SEQ ID NO: 121170 - DNA, 20 bp, Artificial
  CRISPR gRNA sequence
ttaggtttcaacgcctcccc

SEQ ID NO: 121171 - DNA, 20 bp, Artificial
  CRISPR gRNA sequence
taggtttcaacgcctcccca

SEQ ID NO: 121172 - DNA, 20 bp, Artificial
  CRISPR gRNA sequence
aggtttcaacgcctccccaa

SEQ ID NO: 121173 - DNA, 20 bp, Artificial
  CRISPR gRNA sequence
ggtttcaacgcctccccaac

SEQ ID NO: 121174 - DNA, 20 bp, Artificial
  CRISPR gRNA sequence
caacgcctccccaactccaa

SEQ ID NO: 121175 - DNA, 20 bp, Artificial
  CRISPR gRNA sequence
aacgcctccccaactccaaa

SEQ ID NO: 121176 - DNA, 20 bp, Artificial
  CRISPR gRNA sequence
cccaactccaaatttccttc

SEQ ID NO: 121177 - DNA, 20 bp, Artificial
  CRISPR gRNA sequence
caaatttccttcttatatga

SEQ ID NO: 121178 - DNA, 20 bp, Artificial
  CRISPR gRNA sequence
ccttcttatatgagattttt

SEQ ID NO: 121179 - DNA, 20 bp, Artificial
  CRISPR gRNA sequence
cttcttatatgagatttttt

SEQ ID NO: 121180 - DNA, 20 bp, Artificial
  CRISPR gRNA sequence
cttatatgagattttttcct

SEQ ID NO: 121181 - DNA, 20 bp, Artificial
  CRISPR gRNA sequence
ttatatgagattttttcctt

SEQ ID NO: 121182 - DNA, 20 bp, Artificial
  CRISPR gRNA sequence
atatgagattttttccttga

SEQ ID NO: 121183 - DNA, 20 bp, Artificial
  CRISPR gRNA sequence
tatgagattttttccttgac

SEQ ID NO: 121184 - DNA, 20 bp, Artificial
  CRISPR gRNA sequence
tttccttgactaatatccag

SEQ ID NO: 121185 - DNA, 20 bp, Artificial
  CRISPR gRNA sequence
ttccttgactaatatccaga

SEQ ID NO: 121186 - DNA, 20 bp, Artificial
  CRISPR gRNA sequence
tccttgactaatatccagaa

SEQ ID NO: 121187 - DNA, 20 bp, Artificial
  CRISPR gRNA sequence
ccttgactaatatccagaag

SEQ ID NO: 121188 - DNA, 20 bp, Artificial
  CRISPR gRNA sequence
cttgactaatatccagaagt

SEQ ID NO: 121189 - DNA, 20 bp, Artificial
  CRISPR gRNA sequence
gactaatatccagaagttta

SEQ ID NO: 121190 - DNA, 20 bp, Artificial
  CRISPR gRNA sequence
actaatatccagaagtttac

SEQ ID NO: 121191 - DNA, 20 bp, Artificial
  CRISPR gRNA sequence
atatccagaagtttacatct

SEQ ID NO: 121192 - DNA, 20 bp, Artificial
  CRISPR gRNA sequence
acatctttacaagactaaat

SEQ ID NO: 121193 - DNA, 20 bp, Artificial
  CRISPR gRNA sequence
catctttacaagactaaata

SEQ ID NO: 121194 - DNA, 20 bp, Artificial
  CRISPR gRNA sequence
tacaagactaaatataactt

SEQ ID NO: 121195 - DNA, 20 bp, Artificial
  CRISPR gRNA sequence
acaagactaaatataacttg

SEQ ID NO: 121196 - DNA, 20 bp, Artificial
  CRISPR gRNA sequence
caagactaaatataacttga

SEQ ID NO: 121197 - DNA, 20 bp, Artificial
  CRISPR gRNA sequence
aatataacttgaagcacata

SEQ ID NO: 121198 - DNA, 20 bp, Artificial
  CRISPR gRNA sequence
gaagcacataatgactaata

SEQ ID NO: 121199 - DNA, 20 bp, Artificial
  CRISPR gRNA sequence
aagcacataatgactaatat

SEQ ID NO: 121200 - DNA, 20 bp, Artificial
  CRISPR gRNA sequence
atatatgtaacgtacagatt

SEQ ID NO: 121201 - DNA, 20 bp, Artificial
  CRISPR gRNA sequence
tcttcttaactagtttattc

SEQ ID NO: 121202 - DNA, 20 bp, Artificial
  CRISPR gRNA sequence
cttcttaactagtttattct

SEQ ID NO: 121203 - DNA, 20 bp, Artificial
  CRISPR gRNA sequence
ttcttaactagtttattctg

SEQ ID NO: 121204 - DNA, 20 bp, Artificial
  CRISPR gRNA sequence
cttaactagtttattctggt

SEQ ID NO: 121205 - DNA, 20 bp, Artificial
  CRISPR gRNA sequence
ttaactagtttattctggta

SEQ ID NO: 121206 - DNA, 20 bp, Artificial
  CRISPR gRNA sequence
aactagtttattctggtaat

SEQ ID NO: 121207 - DNA, 20 bp, Artificial
  CRISPR gRNA sequence
actagtttattctggtaata

SEQ ID NO: 121208 - DNA, 20 bp, Artificial
  CRISPR gRNA sequence
gtttattctggtaatacaaa

SEQ ID NO: 121209 - DNA, 20 bp, Artificial
  CRISPR gRNA sequence
attctggtaatacaaatgaa

SEQ ID NO: 121210 - DNA, 20 bp, Artificial
  CRISPR gRNA sequence
ttctggtaatacaaatgaac

SEQ ID NO: 121211 - DNA, 20 bp, Artificial
  CRISPR gRNA sequence
tggtaatacaaatgaaccaa

SEQ ID NO: 121212 - DNA, 20 bp, Artificial
  CRISPR gRNA sequence
gtaatacaaatgaaccaatt

SEQ ID NO: 121213 - DNA, 20 bp, Artificial
  CRISPR gRNA sequence
agcaatatttaaatttatac

SEQ ID NO: 121214 - DNA, 20 bp, Artificial
  CRISPR gRNA sequence
gcaatatttaaatttatact

SEQ ID NO: 121215 - DNA, 20 bp, Artificial
  CRISPR gRNA sequence
aaatttatactttgaagagt

SEQ ID NO: 121216 - DNA, 20 bp, Artificial
  CRISPR gRNA sequence
aatttatactttgaagagta

SEQ ID NO: 121217 - DNA, 20 bp, Artificial
  CRISPR gRNA sequence
atactttgaagagtatcaag

SEQ ID NO: 121218 - DNA, 20 bp, Artificial
  CRISPR gRNA sequence
tactttgaagagtatcaaga

SEQ ID NO: 121219 - DNA, 20 bp, Artificial
  CRISPR gRNA sequence
tgaagagtatcaagatttga

SEQ ID NO: 121220 - DNA, 20 bp, Artificial
  CRISPR gRNA sequence
gaagagtatcaagatttgaa

SEQ ID NO: 121221 - DNA, 20 bp, Artificial
  CRISPR gRNA sequence
aagagtatcaagatttgaag

SEQ ID NO: 121222 - DNA, 20 bp, Artificial
  CRISPR gRNA sequence
gaagagcagcttcaaatcta

SEQ ID NO: 121223 - DNA, 20 bp, Artificial
  CRISPR gRNA sequence
aagagcagcttcaaatctag

SEQ ID NO: 121224 - DNA, 20 bp, Artificial
  CRISPR gRNA sequence
caaatctagcagcaattctc

SEQ ID NO: 121225 - DNA, 20 bp, Artificial
  CRISPR gRNA sequence
aaatctagcagcaattctct

SEQ ID NO: 121226 - DNA, 20 bp, Artificial
  CRISPR gRNA sequence
gcagcaattctctctcacat

SEQ ID NO: 121227 - DNA, 20 bp, Artificial
  CRISPR gRNA sequence
tctctcacattaatgacaga

SEQ ID NO: 121228 - DNA, 20 bp, Artificial
  CRISPR gRNA sequence
tctcacattaatgacagagt

SEQ ID NO: 121229 - DNA, 20 bp, Artificial
  CRISPR gRNA sequence
tcacattaatgacagagtga

SEQ ID NO: 121230 - DNA, 20 bp, Artificial
  CRISPR gRNA sequence
acattaatgacagagtgatt

SEQ ID NO: 121231 - DNA, 20 bp, Artificial
  CRISPR gRNA sequence
atgacagagtgatttagcct

SEQ ID NO: 121232 - DNA, 20 bp, Artificial
  CRISPR gRNA sequence
agcctgtatcatgatattga

SEQ ID NO: 121233 - DNA, 20 bp, Artificial
  CRISPR gRNA sequence
gcctgtatcatgatattgat

SEQ ID NO: 121234 - DNA, 20 bp, Artificial
  CRISPR gRNA sequence
tatcatgatattgatactgt

SEQ ID NO: 121235 - DNA, 20 bp, Artificial
  CRISPR gRNA sequence
atactgttaatggttaatgc

SEQ ID NO: 121236 - DNA, 20 bp, Artificial
  CRISPR gRNA sequence
ttaatggttaatgctataag

SEQ ID NO: 121237 - DNA, 20 bp, Artificial
  CRISPR gRNA sequence
atggttaatgctataagcaa

SEQ ID NO: 121238 - DNA, 20 bp, Artificial
  CRISPR gRNA sequence
atgctataagcaactggctt

SEQ ID NO: 121239 - DNA, 20 bp, Artificial
  CRISPR gRNA sequence
taagcaactggcttcagtaa

SEQ ID NO: 121240 - DNA, 20 bp, Artificial
  CRISPR gRNA sequence
gcttcagtaaagtcatatgt

SEQ ID NO: 121241 - DNA, 20 bp, Artificial
  CRISPR gRNA sequence
cagtaaagtcatatgttcct

SEQ ID NO: 121242 - DNA, 20 bp, Artificial
  CRISPR gRNA sequence
agtaaagtcatatgttccta

SEQ ID NO: 121243 - DNA, 20 bp, Artificial
  CRISPR gRNA sequence
ctactactgtgagcttcagt

SEQ ID NO: 121244 - DNA, 20 bp, Artificial
  CRISPR gRNA sequence
ctactgtgagcttcagttag

SEQ ID NO: 121245 - DNA, 20 bp, Artificial
  CRISPR gRNA sequence
ctgtgagcttcagttagcaa

SEQ ID NO: 121246 - DNA, 20 bp, Artificial
  CRISPR gRNA sequence
tgagcttcagttagcaagac

SEQ ID NO: 121247 - DNA, 20 bp, Artificial
  CRISPR gRNA sequence
cagttagcaagactgcaata

SEQ ID NO: 121248 - DNA, 20 bp, Artificial
  CRISPR gRNA sequence
agttagcaagactgcaatac

SEQ ID NO: 121249 - DNA, 20 bp, Artificial
  CRISPR gRNA sequence
gcaagactgcaatacaattc

SEQ ID NO: 121250 - DNA, 20 bp, Artificial
  CRISPR gRNA sequence
caatacaattcgatagtctt

SEQ ID NO: 121251 - DNA, 20 bp, Artificial
  CRISPR gRNA sequence
gatagtctttcccaaagtgc

SEQ ID NO: 121252 - DNA, 20 bp, Artificial
  CRISPR gRNA sequence
tcccaaagtgcctctttgcc

SEQ ID NO: 121253 - DNA, 20 bp, Artificial
  CRISPR gRNA sequence
cccaaagtgcctctttgccc

SEQ ID NO: 121254 - DNA, 20 bp, Artificial
  CRISPR gRNA sequence
ccaaagtgcctctttgccca

SEQ ID NO: 121255 - DNA, 20 bp, Artificial
  CRISPR gRNA sequence
tttgcccaagattatgacaa

SEQ ID NO: 121256 - DNA, 20 bp, Artificial
  CRISPR gRNA sequence
tgcccaagattatgacaaac

SEQ ID NO: 121257 - DNA, 20 bp, Artificial
  CRISPR gRNA sequence
gcccaagattatgacaaact

SEQ ID NO: 121258 - DNA, 20 bp, Artificial
  CRISPR gRNA sequence
cccaagattatgacaaacta

SEQ ID NO: 121259 - DNA, 20 bp, Artificial
  CRISPR gRNA sequence
tgacaaactaagccagattt

SEQ ID NO: 121260 - DNA, 20 bp, Artificial
  CRISPR gRNA sequence
agccagatttagtctgtcta

SEQ ID NO: 121261 - DNA, 20 bp, Artificial
  CRISPR gRNA sequence
agtctgtctagctcttgctc

SEQ ID NO: 121262 - DNA, 20 bp, Artificial
  CRISPR gRNA sequence
gtctgtctagctcttgctct

SEQ ID NO: 121263 - DNA, 20 bp, Artificial
  CRISPR gRNA sequence
tctagctcttgctcttaaca

SEQ ID NO: 121264 - DNA, 20 bp, Artificial
  CRISPR gRNA sequence
gctcttgctcttaacacaaa

SEQ ID NO: 121265 - DNA, 20 bp, Artificial
  CRISPR gRNA sequence
ttgctcttaacacaaagttt

SEQ ID NO: 121266 - DNA, 20 bp, Artificial
  CRISPR gRNA sequence
gctcttaacacaaagttttg

SEQ ID NO: 121267 - DNA, 20 bp, Artificial
  CRISPR gRNA sequence
ctcttaacacaaagttttga

SEQ ID NO: 121268 - DNA, 20 bp, Artificial
  CRISPR gRNA sequence
ttaacacaaagttttgaatg

SEQ ID NO: 121269 - DNA, 20 bp, Artificial
  CRISPR gRNA sequence
aacacaaagttttgaatggt

SEQ ID NO: 121270 - DNA, 20 bp, Artificial
  CRISPR gRNA sequence
acacaaagttttgaatggtt

SEQ ID NO: 121271 - DNA, 20 bp, Artificial
  CRISPR gRNA sequence
tgaatggtttttcctcaaag

SEQ ID NO: 121272 - DNA, 20 bp, Artificial
  CRISPR gRNA sequence
gaatggtttttcctcaaaga

SEQ ID NO: 121273 - DNA, 20 bp, Artificial
  CRISPR gRNA sequence
aatggtttttcctcaaagag

SEQ ID NO: 121274 - DNA, 20 bp, Artificial
  CRISPR gRNA sequence
ttcctcaaagagagagaaac

SEQ ID NO: 121275 - DNA, 20 bp, Artificial
  CRISPR gRNA sequence
tcctcaaagagagagaaaca

SEQ ID NO: 121276 - DNA, 20 bp, Artificial
  CRISPR gRNA sequence
cctcaaagagagagaaacaa

SEQ ID NO: 121277 - DNA, 20 bp, Artificial
  CRISPR gRNA sequence
ctcaaagagagagaaacaaa

SEQ ID NO: 121278 - DNA, 20 bp, Artificial
  CRISPR gRNA sequence
aaagagagagaaacaaataa

SEQ ID NO: 121279 - DNA, 20 bp, Artificial
  CRISPR gRNA sequence
attctggctagcatgaaaat

SEQ ID NO: 121280 - DNA, 20 bp, Artificial
  CRISPR gRNA sequence
ttctggctagcatgaaaatt

SEQ ID NO: 121281 - DNA, 20 bp, Artificial
  CRISPR gRNA sequence
tggctagcatgaaaattctc

SEQ ID NO: 121282 - DNA, 20 bp, Artificial
  CRISPR gRNA sequence
gctagcatgaaaattctctt

SEQ ID NO: 121283 - DNA, 20 bp, Artificial
  CRISPR gRNA sequence
gcatgaaaattctcttccta

SEQ ID NO: 121284 - DNA, 20 bp, Artificial
  CRISPR gRNA sequence
tcttcctagtgcattctctt

SEQ ID NO: 121285 - DNA, 20 bp, Artificial
  CRISPR gRNA sequence
ttcctagtgcattctcttct

SEQ ID NO: 121286 - DNA, 20 bp, Artificial
  CRISPR gRNA sequence
cctagtgcattctcttctca

SEQ ID NO: 121287 - DNA, 20 bp, Artificial
  CRISPR gRNA sequence
ctagtgcattctcttctcag

SEQ ID NO: 121288 - DNA, 20 bp, Artificial
  CRISPR gRNA sequence
gtgcattctcttctcagtgc

SEQ ID NO: 121289 - DNA, 20 bp, Artificial
  CRISPR gRNA sequence
tcttctcagtgcaattctct

SEQ ID NO: 121290 - DNA, 20 bp, Artificial
  CRISPR gRNA sequence
ttctcagtgcaattctcttt

SEQ ID NO: 121291 - DNA, 20 bp, Artificial
  CRISPR gRNA sequence
ctcagtgcaattctctttgc

SEQ ID NO: 121292 - DNA, 20 bp, Artificial
  CRISPR gRNA sequence
tcagtgcaattctctttgcc

SEQ ID NO: 121293 - DNA, 20 bp, Artificial
  CRISPR gRNA sequence
agtgcaattctctttgcccc

SEQ ID NO: 121294 - DNA, 20 bp, Artificial
  CRISPR gRNA sequence
tctttgccccactattccaa

SEQ ID NO: 121295 - DNA, 20 bp, Artificial
  CRISPR gRNA sequence
tttgccccactattccaagg

SEQ ID NO: 121296 - DNA, 20 bp, Artificial
  CRISPR gRNA sequence
tgccccactattccaaggtg

SEQ ID NO: 121297 - DNA, 20 bp, Artificial
  CRISPR gRNA sequence
gccccactattccaaggtgc

SEQ ID NO: 121298 - DNA, 20 bp, Artificial
  CRISPR gRNA sequence
ccccactattccaaggtgca

SEQ ID NO: 121299 - DNA, 20 bp, Artificial
  CRISPR gRNA sequence
ttccaaggtgcaaaagctga

SEQ ID NO: 121300 - DNA, 20 bp, Artificial
  CRISPR gRNA sequence
caaggtgcaaaagctgagac

SEQ ID NO: 121301 - DNA, 20 bp, Artificial
  CRISPR gRNA sequence
agacttagccaaccacttac

SEQ ID NO: 121302 - DNA, 20 bp, Artificial
  CRISPR gRNA sequence
agccaaccacttactaggaa

SEQ ID NO: 121303 - DNA, 20 bp, Artificial
  CRISPR gRNA sequence
gccaaccacttactaggaac

SEQ ID NO: 121304 - DNA, 20 bp, Artificial
  CRISPR gRNA sequence
actaggaacccattctatgt

SEQ ID NO: 121305 - DNA, 20 bp, Artificial
  CRISPR gRNA sequence
ctaggaacccattctatgtg

SEQ ID NO: 121306 - DNA, 20 bp, Artificial
  CRISPR gRNA sequence
ggaacccattctatgtggac

SEQ ID NO: 121307 - DNA, 20 bp, Artificial
  CRISPR gRNA sequence
tatgtggacctacacaaact

SEQ ID NO: 121308 - DNA, 20 bp, Artificial
  CRISPR gRNA sequence
tgtggacctacacaaactcc

SEQ ID NO: 121309 - DNA, 20 bp, Artificial
  CRISPR gRNA sequence
cacaaactccaaagctaaaa

SEQ ID NO: 121310 - DNA, 20 bp, Artificial
  CRISPR gRNA sequence
caaagctaaaacctcttcag

SEQ ID NO: 121311 - DNA, 20 bp, Artificial
  CRISPR gRNA sequence
aaacctcttcagaaactcaa

SEQ ID NO: 121312 - DNA, 20 bp, Artificial
  CRISPR gRNA sequence
ttcagaaactcaactagtgt

SEQ ID NO: 121313 - DNA, 20 bp, Artificial
  CRISPR gRNA sequence
cagaaactcaactagtgtaa

SEQ ID NO: 121314 - DNA, 20 bp, Artificial
  CRISPR gRNA sequence
agaaactcaactagtgtaag

SEQ ID NO: 121315 - DNA, 20 bp, Artificial
  CRISPR gRNA sequence
aactagtgtaagcatatgaa

SEQ ID NO: 121316 - DNA, 20 bp, Artificial
  CRISPR gRNA sequence
gtgtaagcatatgaaaagcc

SEQ ID NO: 121317 - DNA, 20 bp, Artificial
  CRISPR gRNA sequence
tcacagttgataatcactac

SEQ ID NO: 121318 - DNA, 20 bp, Artificial
  CRISPR gRNA sequence
ataatcactaccaggcaaag

SEQ ID NO: 121319 - DNA, 20 bp, Artificial
  CRISPR gRNA sequence
ccaggcaaagcctagaacag

SEQ ID NO: 121320 - DNA, 20 bp, Artificial
  CRISPR gRNA sequence
gaacagtagctttttaactt

SEQ ID NO: 121321 - DNA, 20 bp, Artificial
  CRISPR gRNA sequence
tttaacttttttgaccacaa

SEQ ID NO: 121322 - DNA, 20 bp, Artificial
  CRISPR gRNA sequence
ttaacttttttgaccacaac

SEQ ID NO: 121323 - DNA, 20 bp, Artificial
  CRISPR gRNA sequence
taacttttttgaccacaacc

SEQ ID NO: 121324 - DNA, 20 bp, Artificial
  CRISPR gRNA sequence
aacttttttgaccacaaccc

SEQ ID NO: 121325 - DNA, 20 bp, Artificial
  CRISPR gRNA sequence
acttttttgaccacaaccct

SEQ ID NO: 121326 - DNA, 20 bp, Artificial
  CRISPR gRNA sequence
ttttgaccacaacccttagt

SEQ ID NO: 121327 - DNA, 20 bp, Artificial
  CRISPR gRNA sequence
tttgaccacaacccttagta

SEQ ID NO: 121328 - DNA, 20 bp, Artificial
  CRISPR gRNA sequence
ttgaccacaacccttagtaa

SEQ ID NO: 121329 - DNA, 20 bp, Artificial
  CRISPR gRNA sequence
tgaccacaacccttagtaag

SEQ ID NO: 121330 - DNA, 20 bp, Artificial
  CRISPR gRNA sequence
gaccacaacccttagtaaga

SEQ ID NO: 121331 - DNA, 20 bp, Artificial
  CRISPR gRNA sequence
accacaacccttagtaagaa

SEQ ID NO: 121332 - DNA, 20 bp, Artificial
  CRISPR gRNA sequence
agtaagaaacacatttcatt

SEQ ID NO: 121333 - DNA, 20 bp, Artificial
  CRISPR gRNA sequence
gtaagaaacacatttcatta

SEQ ID NO: 121334 - DNA, 20 bp, Artificial
  CRISPR gRNA sequence
cattatcacaactcagtgca

SEQ ID NO: 121335 - DNA, 20 bp, Artificial
  CRISPR gRNA sequence
attatcacaactcagtgcac

SEQ ID NO: 121336 - DNA, 20 bp, Artificial
  CRISPR gRNA sequence
tcacaactcagtgcacacat

SEQ ID NO: 121337 - DNA, 20 bp, Artificial
  CRISPR gRNA sequence
agtgcacacatgtataaagc

SEQ ID NO: 121338 - DNA, 20 bp, Artificial
  CRISPR gRNA sequence
aaatgaaagtttcatgaaac

SEQ ID NO: 121339 - DNA, 20 bp, Artificial
  CRISPR gRNA sequence
catgaaacagcatttacctt

SEQ ID NO: 121340 - DNA, 20 bp, Artificial
  CRISPR gRNA sequence
atgaaacagcatttaccttt

SEQ ID NO: 121341 - DNA, 20 bp, Artificial
  CRISPR gRNA sequence
acctttatacaacacaagat

SEQ ID NO: 121342 - DNA, 20 bp, Artificial
  CRISPR gRNA sequence
cctttatacaacacaagatg

SEQ ID NO: 121343 - DNA, 20 bp, Artificial
  CRISPR gRNA sequence
tatacaacacaagatgcact

SEQ ID NO: 121344 - DNA, 20 bp, Artificial
  CRISPR gRNA sequence
atacaacacaagatgcactt

SEQ ID NO: 121345 - DNA, 20 bp, Artificial
  CRISPR gRNA sequence
tacaacacaagatgcacttt

SEQ ID NO: 121346 - DNA, 20 bp, Artificial
  CRISPR gRNA sequence
tggtattttctattcttttt

SEQ ID NO: 121347 - DNA, 20 bp, Artificial
  CRISPR gRNA sequence
ggtattttctattctttttt

SEQ ID NO: 121348 - DNA, 20 bp, Artificial
  CRISPR gRNA sequence
gtattttctattcttttttt

SEQ ID NO: 121349 - DNA, 20 bp, Artificial
  CRISPR gRNA sequence
tctattcttttttttctttt

SEQ ID NO: 121350 - DNA, 20 bp, Artificial
  CRISPR gRNA sequence
ctattcttttttttctttta

SEQ ID NO: 121351 - DNA, 20 bp, Artificial
  CRISPR gRNA sequence
tattcttttttttcttttaa

SEQ ID NO: 121352 - DNA, 20 bp, Artificial
  CRISPR gRNA sequence
ttcttttttttcttttaaga

SEQ ID NO: 121353 - DNA, 20 bp, Artificial
  CRISPR gRNA sequence
ttttttttcttttaagagag

SEQ ID NO: 121354 - DNA, 20 bp, Artificial
  CRISPR gRNA sequence
ttttttcttttaagagaggg

SEQ ID NO: 121355 - DNA, 20 bp, Artificial
  CRISPR gRNA sequence
tttttcttttaagagagggg

SEQ ID NO: 121356 - DNA, 20 bp, Artificial
  CRISPR gRNA sequence
ttttcttttaagagaggggg

SEQ ID NO: 121357 - DNA, 20 bp, Artificial
  CRISPR gRNA sequence
tttcttttaagagagggggt

SEQ ID NO: 121358 - DNA, 20 bp, Artificial
  CRISPR gRNA sequence
ttcttttaagagagggggtc

SEQ ID NO: 121359 - DNA, 20 bp, Artificial
  CRISPR gRNA sequence
tcttttaagagagggggtct

SEQ ID NO: 121360 - DNA, 20 bp, Artificial
  CRISPR gRNA sequence
cttttaagagagggggtctc

SEQ ID NO: 121361 - DNA, 20 bp, Artificial
  CRISPR gRNA sequence
ttttaagagagggggtctcc

SEQ ID NO: 121362 - DNA, 20 bp, Artificial
  CRISPR gRNA sequence
ttaagagagggggtctccct

SEQ ID NO: 121363 - DNA, 20 bp, Artificial
  CRISPR gRNA sequence
taagagagggggtctcccta

SEQ ID NO: 121364 - DNA, 20 bp, Artificial
  CRISPR gRNA sequence
aagagagggggtctccctat

SEQ ID NO: 121365 - DNA, 20 bp, Artificial
  CRISPR gRNA sequence
agagagggggtctccctatg

SEQ ID NO: 121366 - DNA, 20 bp, Artificial
  CRISPR gRNA sequence
cctatgctacccaggctggt

SEQ ID NO: 121367 - DNA, 20 bp, Artificial
  CRISPR gRNA sequence
tgctacccaggctggtctca

SEQ ID NO: 121368 - DNA, 20 bp, Artificial
  CRISPR gRNA sequence
cccaggctggtctcaaactc

SEQ ID NO: 121369 - DNA, 20 bp, Artificial
  CRISPR gRNA sequence
gtctcaaactcctgagctca

SEQ ID NO: 121370 - DNA, 20 bp, Artificial
  CRISPR gRNA sequence
aaactcctgagctcaaagga

SEQ ID NO: 121371 - DNA, 20 bp, Artificial
  CRISPR gRNA sequence
ctgagctcaaaggattctcc

SEQ ID NO: 121372 - DNA, 20 bp, Artificial
  CRISPR gRNA sequence
agctcaaaggattctcccac

SEQ ID NO: 121373 - DNA, 20 bp, Artificial
  CRISPR gRNA sequence
aaaggattctcccacttcgg

SEQ ID NO: 121374 - DNA, 20 bp, Artificial
  CRISPR gRNA sequence
tcccacttcggcttcccaaa

SEQ ID NO: 121375 - DNA, 20 bp, Artificial
  CRISPR gRNA sequence
ccacttcggcttcccaaagt

SEQ ID NO: 121376 - DNA, 20 bp, Artificial
  CRISPR gRNA sequence
cggcttcccaaagtgctggg

SEQ ID NO: 121377 - DNA, 20 bp, Artificial
  CRISPR gRNA sequence
ggcttcccaaagtgctggga

SEQ ID NO: 121378 - DNA, 20 bp, Artificial
  CRISPR gRNA sequence
cccaaagtgctgggattaca

SEQ ID NO: 121379 - DNA, 20 bp, Artificial
  CRISPR gRNA sequence
ccaaagtgctgggattacag

SEQ ID NO: 121380 - DNA, 20 bp, Artificial
  CRISPR gRNA sequence
ggattacagtcgtgagccat

SEQ ID NO: 121381 - DNA, 20 bp, Artificial
  CRISPR gRNA sequence
cagtcgtgagccatcatcat

SEQ ID NO: 121382 - DNA, 20 bp, Artificial
  CRISPR gRNA sequence
gcagatattttctattctat

SEQ ID NO: 121383 - DNA, 20 bp, Artificial
  CRISPR gRNA sequence
tctattctattatttaaaaa

SEQ ID NO: 121384 - DNA, 20 bp, Artificial
  CRISPR gRNA sequence
ctattctattatttaaaaat

SEQ ID NO: 121385 - DNA, 20 bp, Artificial
  CRISPR gRNA sequence
tattctattatttaaaaatt

SEQ ID NO: 121386 - DNA, 20 bp, Artificial
  CRISPR gRNA sequence
ttctattatttaaaaattcc

SEQ ID NO: 121387 - DNA, 20 bp, Artificial
  CRISPR gRNA sequence
tattatttaaaaattcccag

SEQ ID NO: 121388 - DNA, 20 bp, Artificial
  CRISPR gRNA sequence
ttatttaaaaattcccagca

SEQ ID NO: 121389 - DNA, 20 bp, Artificial
  CRISPR gRNA sequence
tttaaaaattcccagcattg

SEQ ID NO: 121390 - DNA, 20 bp, Artificial
  CRISPR gRNA sequence
aaaaattcccagcattggct

SEQ ID NO: 121391 - DNA, 20 bp, Artificial
  CRISPR gRNA sequence
aaaattcccagcattggctc

SEQ ID NO: 121392 - DNA, 20 bp, Artificial
  CRISPR gRNA sequence
ccagcattggctcactcaat

SEQ ID NO: 121393 - DNA, 20 bp, Artificial
  CRISPR gRNA sequence
gctcactcaatttctttcac

SEQ ID NO: 121394 - DNA, 20 bp, Artificial
  CRISPR gRNA sequence
actcaatttctttcacaact

SEQ ID NO: 121395 - DNA, 20 bp, Artificial
  CRISPR gRNA sequence
aatttctttcacaactcaac

SEQ ID NO: 121396 - DNA, 20 bp, Artificial
  CRISPR gRNA sequence
ctttcacaactcaacaagtg

SEQ ID NO: 121397 - DNA, 20 bp, Artificial
  CRISPR gRNA sequence
tttcacaactcaacaagtgg

SEQ ID NO: 121398 - DNA, 20 bp, Artificial
  CRISPR gRNA sequence
tcacaactcaacaagtgggt

SEQ ID NO: 121399 - DNA, 20 bp, Artificial
  CRISPR gRNA sequence
cacaactcaacaagtgggtc

SEQ ID NO: 121400 - DNA, 20 bp, Artificial
  CRISPR gRNA sequence
acaactcaacaagtgggtcc

SEQ ID NO: 121401 - DNA, 20 bp, Artificial
  CRISPR gRNA sequence
aacaagtgggtcctgataga

SEQ ID NO: 121402 - DNA, 20 bp, Artificial
  CRISPR gRNA sequence
atagacgcttgatgaaagac

SEQ ID NO: 121403 - DNA, 20 bp, Artificial
  CRISPR gRNA sequence
gatgaaagactagactacaa

SEQ ID NO: 121404 - DNA, 20 bp, Artificial
  CRISPR gRNA sequence
atgaaagactagactacaac

SEQ ID NO: 121405 - DNA, 20 bp, Artificial
  CRISPR gRNA sequence
gactacaacaaagggctgtc

SEQ ID NO: 121406 - DNA, 20 bp, Artificial
  CRISPR gRNA sequence
caacaaagggctgtccagct

SEQ ID NO: 121407 - DNA, 20 bp, Artificial
  CRISPR gRNA sequence
tccagcttccccatcatcct

SEQ ID NO: 121408 - DNA, 20 bp, Artificial
  CRISPR gRNA sequence
ccccatcatcctacagattt

SEQ ID NO: 121409 - DNA, 20 bp, Artificial
  CRISPR gRNA sequence
cccatcatcctacagatttc

SEQ ID NO: 121410 - DNA, 20 bp, Artificial
  CRISPR gRNA sequence
cagatttctggattggagct

SEQ ID NO: 121411 - DNA, 20 bp, Artificial
  CRISPR gRNA sequence
ctggattggagctttctaat

SEQ ID NO: 121412 - DNA, 20 bp, Artificial
  CRISPR gRNA sequence
tggattggagctttctaatg

SEQ ID NO: 121413 - DNA, 20 bp, Artificial
  CRISPR gRNA sequence
gattggagctttctaatgca

SEQ ID NO: 121414 - DNA, 20 bp, Artificial
  CRISPR gRNA sequence
gagctttctaatgcacttct

SEQ ID NO: 121415 - DNA, 20 bp, Artificial
  CRISPR gRNA sequence
tctaatgcacttctctccac

SEQ ID NO: 121416 - DNA, 20 bp, Artificial
  CRISPR gRNA sequence
ctaatgcacttctctccact

SEQ ID NO: 121417 - DNA, 20 bp, Artificial
  CRISPR gRNA sequence
taatgcacttctctccacta

SEQ ID NO: 121418 - DNA, 20 bp, Artificial
  CRISPR gRNA sequence
atgcacttctctccactaat

SEQ ID NO: 121419 - DNA, 20 bp, Artificial
  CRISPR gRNA sequence
ctctccactaattatgtacc

SEQ ID NO: 121420 - DNA, 20 bp, Artificial
  CRISPR gRNA sequence
tctccactaattatgtacca

SEQ ID NO: 121421 - DNA, 20 bp, Artificial
  CRISPR gRNA sequence
tccactaattatgtaccatg

SEQ ID NO: 121422 - DNA, 20 bp, Artificial
  CRISPR gRNA sequence
cactaattatgtaccatgtg

SEQ ID NO: 121423 - DNA, 20 bp, Artificial
  CRISPR gRNA sequence
attatgtaccatgtgccaga

SEQ ID NO: 121424 - DNA, 20 bp, Artificial
  CRISPR gRNA sequence
tgtaccatgtgccagacact

SEQ ID NO: 121425 - DNA, 20 bp, Artificial
  CRISPR gRNA sequence
ttctgaaggttttaaaaata

SEQ ID NO: 121426 - DNA, 20 bp, Artificial
  CRISPR gRNA sequence
tgaaggttttaaaaataaaa

SEQ ID NO: 121427 - DNA, 20 bp, Artificial
  CRISPR gRNA sequence
aaggttttaaaaataaaaag

SEQ ID NO: 121428 - DNA, 20 bp, Artificial
  CRISPR gRNA sequence
taaaaataaaaagaaatctc

SEQ ID NO: 121429 - DNA, 20 bp, Artificial
  CRISPR gRNA sequence
aaaaataaaaagaaatctct

SEQ ID NO: 121430 - DNA, 20 bp, Artificial
  CRISPR gRNA sequence
aaaataaaaagaaatctctg

SEQ ID NO: 121431 - DNA, 20 bp, Artificial
  CRISPR gRNA sequence
tgacgaagattcaaacttca

SEQ ID NO: 121432 - DNA, 20 bp, Artificial
  CRISPR gRNA sequence
acgaagattcaaacttcaaa

SEQ ID NO: 121433 - DNA, 20 bp, Artificial
  CRISPR gRNA sequence
aaacttcaaagagtctttaa

SEQ ID NO: 121434 - DNA, 20 bp, Artificial
  CRISPR gRNA sequence
caaagagtctttaagtttag

SEQ ID NO: 121435 - DNA, 20 bp, Artificial
  CRISPR gRNA sequence
aaagagtctttaagtttagt

SEQ ID NO: 121436 - DNA, 20 bp, Artificial
  CRISPR gRNA sequence
taagtttagtaatggactaa

SEQ ID NO: 121437 - DNA, 20 bp, Artificial
  CRISPR gRNA sequence
aagtttagtaatggactaaa

SEQ ID NO: 121438 - DNA, 20 bp, Artificial
  CRISPR gRNA sequence
agtttagtaatggactaaaa

SEQ ID NO: 121439 - DNA, 20 bp, Artificial
  CRISPR gRNA sequence
agtaatggactaaaaaccta

SEQ ID NO: 121440 - DNA, 20 bp, Artificial
  CRISPR gRNA sequence
gtaatggactaaaaacctat

SEQ ID NO: 121441 - DNA, 20 bp, Artificial
  CRISPR gRNA sequence
aaaacctatactggaatcct

SEQ ID NO: 121442 - DNA, 20 bp, Artificial
  CRISPR gRNA sequence
tactggaatcctaagagata

SEQ ID NO: 121443 - DNA, 20 bp, Artificial
  CRISPR gRNA sequence
gaatcctaagagataaagtg

SEQ ID NO: 121444 - DNA, 20 bp, Artificial
  CRISPR gRNA sequence
agagataaagtgatatggga

SEQ ID NO: 121445 - DNA, 20 bp, Artificial
  CRISPR gRNA sequence
ggaggacagagatttgttcc

SEQ ID NO: 121446 - DNA, 20 bp, Artificial
  CRISPR gRNA sequence
gaggacagagatttgttcca

SEQ ID NO: 121447 - DNA, 20 bp, Artificial
  CRISPR gRNA sequence
gttccagctggggataaatc

SEQ ID NO: 121448 - DNA, 20 bp, Artificial
  CRISPR gRNA sequence
ttccagctggggataaatca

SEQ ID NO: 121449 - DNA, 20 bp, Artificial
  CRISPR gRNA sequence
cagctggggataaatcaaca

SEQ ID NO: 121450 - DNA, 20 bp, Artificial
  CRISPR gRNA sequence
gggataaatcaacaaggctt

SEQ ID NO: 121451 - DNA, 20 bp, Artificial
  CRISPR gRNA sequence
aaaaaaaaaaaggtactact

SEQ ID NO: 121452 - DNA, 20 bp, Artificial
  CRISPR gRNA sequence
aaaaaaaaaaggtactactt

SEQ ID NO: 121453 - DNA, 20 bp, Artificial
  CRISPR gRNA sequence
cttgaactttttttttcttt

SEQ ID NO: 121454 - DNA, 20 bp, Artificial
  CRISPR gRNA sequence
gaactttttttttctttgct

SEQ ID NO: 121455 - DNA, 20 bp, Artificial
  CRISPR gRNA sequence
aactttttttttctttgcta

SEQ ID NO: 121456 - DNA, 20 bp, Artificial
  CRISPR gRNA sequence
tttttttctttgctatcaga

SEQ ID NO: 121457 - DNA, 20 bp, Artificial
  CRISPR gRNA sequence
ttttttctttgctatcagag

SEQ ID NO: 121458 - DNA, 20 bp, Artificial
  CRISPR gRNA sequence
tttttctttgctatcagagg

SEQ ID NO: 121459 - DNA, 20 bp, Artificial
  CRISPR gRNA sequence
ttttctttgctatcagaggc

SEQ ID NO: 121460 - DNA, 20 bp, Artificial
  CRISPR gRNA sequence
tttctttgctatcagaggcc

SEQ ID NO: 121461 - DNA, 20 bp, Artificial
  CRISPR gRNA sequence
ttctttgctatcagaggcct

SEQ ID NO: 121462 - DNA, 20 bp, Artificial
  CRISPR gRNA sequence
tctttgctatcagaggcctg

SEQ ID NO: 121463 - DNA, 20 bp, Artificial
  CRISPR gRNA sequence
ctttgctatcagaggcctgc

SEQ ID NO: 121464 - DNA, 20 bp, Artificial
  CRISPR gRNA sequence
tttgctatcagaggcctgca

SEQ ID NO: 121465 - DNA, 20 bp, Artificial
  CRISPR gRNA sequence
tgctatcagaggcctgcagg

SEQ ID NO: 121466 - DNA, 20 bp, Artificial
  CRISPR gRNA sequence
gctatcagaggcctgcagga

SEQ ID NO: 121467 - DNA, 20 bp, Artificial
  CRISPR gRNA sequence
ctatcagaggcctgcaggat

SEQ ID NO: 121468 - DNA, 20 bp, Artificial
  CRISPR gRNA sequence
tcagaggcctgcaggatgaa

SEQ ID NO: 121469 - DNA, 20 bp, Artificial
  CRISPR gRNA sequence
caggatgaactggtcttaag

SEQ ID NO: 121470 - DNA, 20 bp, Artificial
  CRISPR gRNA sequence
gtcttaagtgtgagaaagat

SEQ ID NO: 121471 - DNA, 20 bp, Artificial
  CRISPR gRNA sequence
aagtgtgagaaagatttagc

SEQ ID NO: 121472 - DNA, 20 bp, Artificial
  CRISPR gRNA sequence
agtgtgagaaagatttagct

SEQ ID NO: 121473 - DNA, 20 bp, Artificial
  CRISPR gRNA sequence
agctatgtgatgatgtggag

SEQ ID NO: 121474 - DNA, 20 bp, Artificial
  CRISPR gRNA sequence
gctatgtgatgatgtggagg

SEQ ID NO: 121475 - DNA, 20 bp, Artificial
  CRISPR gRNA sequence
tgtgatgatgtggaggaagg

SEQ ID NO: 121476 - DNA, 20 bp, Artificial
  CRISPR gRNA sequence
caaatcaagagagcataaaa

SEQ ID NO: 121477 - DNA, 20 bp, Artificial
  CRISPR gRNA sequence
cagcatgtgaacagtggact

SEQ ID NO: 121478 - DNA, 20 bp, Artificial
  CRISPR gRNA sequence
agcatgtgaacagtggacta

SEQ ID NO: 121479 - DNA, 20 bp, Artificial
  CRISPR gRNA sequence
aacaggaaaaaaagcttggg

SEQ ID NO: 121480 - DNA, 20 bp, Artificial
  CRISPR gRNA sequence
ggggccacactactttctct

SEQ ID NO: 121481 - DNA, 20 bp, Artificial
  CRISPR gRNA sequence
gggccacactactttctctc

SEQ ID NO: 121482 - DNA, 20 bp, Artificial
  CRISPR gRNA sequence
ctttctctcaaaatgtcaga

SEQ ID NO: 121483 - DNA, 20 bp, Artificial
  CRISPR gRNA sequence
tctctcaaaatgtcagacaa

SEQ ID NO: 121484 - DNA, 20 bp, Artificial
  CRISPR gRNA sequence
ctctcaaaatgtcagacaaa

SEQ ID NO: 121485 - DNA, 20 bp, Artificial
  CRISPR gRNA sequence
tctcaaaatgtcagacaaag

SEQ ID NO: 121486 - DNA, 20 bp, Artificial
  CRISPR gRNA sequence
tcaaaatgtcagacaaagaa

SEQ ID NO: 121487 - DNA, 20 bp, Artificial
  CRISPR gRNA sequence
aaaatgtcagacaaagaaat

SEQ ID NO: 121488 - DNA, 20 bp, Artificial
  CRISPR gRNA sequence
ttctgcagactggtggaagc

SEQ ID NO: 121489 - DNA, 20 bp, Artificial
  CRISPR gRNA sequence
ctgcagactggtggaagctt

SEQ ID NO: 121490 - DNA, 20 bp, Artificial
  CRISPR gRNA sequence
tgcagactggtggaagcttg

SEQ ID NO: 121491 - DNA, 20 bp, Artificial
  CRISPR gRNA sequence
cagactggtggaagcttgta

SEQ ID NO: 121492 - DNA, 20 bp, Artificial
  CRISPR gRNA sequence
gtggaagcttgtaaggtatt

SEQ ID NO: 121493 - DNA, 20 bp, Artificial
  CRISPR gRNA sequence
gtaaggtatttagcaaaaaa

SEQ ID NO: 121494 - DNA, 20 bp, Artificial
  CRISPR gRNA sequence
taaggtatttagcaaaaaag

SEQ ID NO: 121495 - DNA, 20 bp, Artificial
  CRISPR gRNA sequence
agcaaaaaagttaccagatt

SEQ ID NO: 121496 - DNA, 20 bp, Artificial
  CRISPR gRNA sequence
gcaaaaaagttaccagatta

SEQ ID NO: 121497 - DNA, 20 bp, Artificial
  CRISPR gRNA sequence
ccagattataatgcctttta

SEQ ID NO: 121498 - DNA, 20 bp, Artificial
  CRISPR gRNA sequence
taatgccttttagaaagatg

SEQ ID NO: 121499 - DNA, 20 bp, Artificial
  CRISPR gRNA sequence
ttagaaagatgccaagcaaa

SEQ ID NO: 121500 - DNA, 20 bp, Artificial
  CRISPR gRNA sequence
tagaaagatgccaagcaaaa

SEQ ID NO: 121501 - DNA, 20 bp, Artificial
  CRISPR gRNA sequence
agaaagatgccaagcaaaag

SEQ ID NO: 121502 - DNA, 20 bp, Artificial
  CRISPR gRNA sequence
gaaagatgccaagcaaaagt

SEQ ID NO: 121503 - DNA, 20 bp, Artificial
  CRISPR gRNA sequence
agtgattttgaagtgaccag

SEQ ID NO: 121504 - DNA, 20 bp, Artificial
  CRISPR gRNA sequence
gtgattttgaagtgaccaga

SEQ ID NO: 121505 - DNA, 20 bp, Artificial
  CRISPR gRNA sequence
tgaagtgaccagaacatacc

SEQ ID NO: 121506 - DNA, 20 bp, Artificial
  CRISPR gRNA sequence
gaagtgaccagaacatacct

SEQ ID NO: 121507 - DNA, 20 bp, Artificial
  CRISPR gRNA sequence
aagtgaccagaacataccta

SEQ ID NO: 121508 - DNA, 20 bp, Artificial
  CRISPR gRNA sequence
tttttaaatactaaggttaa

SEQ ID NO: 121509 - DNA, 20 bp, Artificial
  CRISPR gRNA sequence
ttaaatactaaggttaaaac

SEQ ID NO: 121510 - DNA, 20 bp, Artificial
  CRISPR gRNA sequence
taaatactaaggttaaaaca

SEQ ID NO: 121511 - DNA, 20 bp, Artificial
  CRISPR gRNA sequence
aaatactaaggttaaaacat

SEQ ID NO: 121512 - DNA, 20 bp, Artificial
  CRISPR gRNA sequence
aatactaaggttaaaacatc

SEQ ID NO: 121513 - DNA, 20 bp, Artificial
  CRISPR gRNA sequence
aggttaaaacatctatttca

SEQ ID NO: 121514 - DNA, 20 bp, Artificial
  CRISPR gRNA sequence
aaacatctatttcaggtcag

SEQ ID NO: 121515 - DNA, 20 bp, Artificial
  CRISPR gRNA sequence
tttcaggtcaggacgcagtg

SEQ ID NO: 121516 - DNA, 20 bp, Artificial
  CRISPR gRNA sequence
caggtcaggacgcagtggct

SEQ ID NO: 121517 - DNA, 20 bp, Artificial
  CRISPR gRNA sequence
aggtcaggacgcagtggctc

SEQ ID NO: 121518 - DNA, 20 bp, Artificial
  CRISPR gRNA sequence
atgcctgtaatcccaacgtt

SEQ ID NO: 121519 - DNA, 20 bp, Artificial
  CRISPR gRNA sequence
taatcccaacgttttgggag

SEQ ID NO: 121520 - DNA, 20 bp, Artificial
  CRISPR gRNA sequence
tgggagaacaagaagggagg

SEQ ID NO: 121521 - DNA, 20 bp, Artificial
  CRISPR gRNA sequence
gggagaacaagaagggagga

SEQ ID NO: 121522 - DNA, 20 bp, Artificial
  CRISPR gRNA sequence
ggagaacaagaagggaggat

SEQ ID NO: 121523 - DNA, 20 bp, Artificial
  CRISPR gRNA sequence
gagcccaggagttccaggtt

SEQ ID NO: 121524 - DNA, 20 bp, Artificial
  CRISPR gRNA sequence
agcccaggagttccaggtta

SEQ ID NO: 121525 - DNA, 20 bp, Artificial
  CRISPR gRNA sequence
caggttagtgagctacgatt

SEQ ID NO: 121526 - DNA, 20 bp, Artificial
  CRISPR gRNA sequence
gtgagctacgattgcgccac

SEQ ID NO: 121527 - DNA, 20 bp, Artificial
  CRISPR gRNA sequence
cgattgcgccactgtactcc

SEQ ID NO: 121528 - DNA, 20 bp, Artificial
  CRISPR gRNA sequence
cgccactgtactccagcctg

SEQ ID NO: 121529 - DNA, 20 bp, Artificial
  CRISPR gRNA sequence
tactccagcctggatgacag

SEQ ID NO: 121530 - DNA, 20 bp, Artificial
  CRISPR gRNA sequence
cagcctggatgacagaggaa

SEQ ID NO: 121531 - DNA, 20 bp, Artificial
  CRISPR gRNA sequence
gatgacagaggaaagccctg

SEQ ID NO: 121532 - DNA, 20 bp, Artificial
  CRISPR gRNA sequence
tatccaaaaacaaacaaaaa

SEQ ID NO: 121533 - DNA, 20 bp, Artificial
  CRISPR gRNA sequence
caaaggcaaatatacatgtt

SEQ ID NO: 121534 - DNA, 20 bp, Artificial
  CRISPR gRNA sequence
tttagactacttaagctcta

SEQ ID NO: 121535 - DNA, 20 bp, Artificial
  CRISPR gRNA sequence
ttagactacttaagctctat

SEQ ID NO: 121536 - DNA, 20 bp, Artificial
  CRISPR gRNA sequence
tagactacttaagctctatc

SEQ ID NO: 121537 - DNA, 20 bp, Artificial
  CRISPR gRNA sequence
agactacttaagctctatca

SEQ ID NO: 121538 - DNA, 20 bp, Artificial
  CRISPR gRNA sequence
gactacttaagctctatcat

SEQ ID NO: 121539 - DNA, 20 bp, Artificial
  CRISPR gRNA sequence
cttaagctctatcatctcat

SEQ ID NO: 121540 - DNA, 20 bp, Artificial
  CRISPR gRNA sequence
aagctctatcatctcatctg

SEQ ID NO: 121541 - DNA, 20 bp, Artificial
  CRISPR gRNA sequence
agctctatcatctcatctgc

SEQ ID NO: 121542 - DNA, 20 bp, Artificial
  CRISPR gRNA sequence
tatcatctcatctgctaatg

SEQ ID NO: 121543 - DNA, 20 bp, Artificial
  CRISPR gRNA sequence
tcatctcatctgctaatgcg

SEQ ID NO: 121544 - DNA, 20 bp, Artificial
  CRISPR gRNA sequence
atctgctaatgcggataacg

SEQ ID NO: 121545 - DNA, 20 bp, Artificial
  CRISPR gRNA sequence
ctaatgcggataacgtgaca

SEQ ID NO: 121546 - DNA, 20 bp, Artificial
  CRISPR gRNA sequence
atgcggataacgtgacaatc

SEQ ID NO: 121547 - DNA, 20 bp, Artificial
  CRISPR gRNA sequence
agaaaatcacttaagcaaca

SEQ ID NO: 121548 - DNA, 20 bp, Artificial
  CRISPR gRNA sequence
aagcaacaatgaaaaactca

SEQ ID NO: 121549 - DNA, 20 bp, Artificial
  CRISPR gRNA sequence
agcaacaatgaaaaactcac

SEQ ID NO: 121550 - DNA, 20 bp, Artificial
  CRISPR gRNA sequence
accctaaaaagtgaaaataa

SEQ ID NO: 121551 - DNA, 20 bp, Artificial
  CRISPR gRNA sequence
aaaagtgaaaataaaacctg

SEQ ID NO: 121552 - DNA, 20 bp, Artificial
  CRISPR gRNA sequence
tccccgaagttttagtaatg

SEQ ID NO: 121553 - DNA, 20 bp, Artificial
  CRISPR gRNA sequence
tagtaatgaaagagcactgg

SEQ ID NO: 121554 - DNA, 20 bp, Artificial
  CRISPR gRNA sequence
agtaatgaaagagcactgga

SEQ ID NO: 121555 - DNA, 20 bp, Artificial
  CRISPR gRNA sequence
gtaatgaaagagcactggaa

SEQ ID NO: 121556 - DNA, 20 bp, Artificial
  CRISPR gRNA sequence
gaatacgagttttctgaaac

SEQ ID NO: 121557 - DNA, 20 bp, Artificial
  CRISPR gRNA sequence
tctgaaacctattagttgta

SEQ ID NO: 121558 - DNA, 20 bp, Artificial
  CRISPR gRNA sequence
ctgaaacctattagttgtat

SEQ ID NO: 121559 - DNA, 20 bp, Artificial
  CRISPR gRNA sequence
tgaaacctattagttgtata

SEQ ID NO: 121560 - DNA, 20 bp, Artificial
  CRISPR gRNA sequence
aaacctattagttgtataac

SEQ ID NO: 121561 - DNA, 20 bp, Artificial
  CRISPR gRNA sequence
ttagttgtataacattaaat

SEQ ID NO: 121562 - DNA, 20 bp, Artificial
  CRISPR gRNA sequence
gttgtataacattaaatgtg

SEQ ID NO: 121563 - DNA, 20 bp, Artificial
  CRISPR gRNA sequence
tataacattaaatgtgaatt

SEQ ID NO: 121564 - DNA, 20 bp, Artificial
  CRISPR gRNA sequence
aatgtgaatttagaaatggg

SEQ ID NO: 121565 - DNA, 20 bp, Artificial
  CRISPR gRNA sequence
agaaatgggcaccagatact

SEQ ID NO: 121566 - DNA, 20 bp, Artificial
  CRISPR gRNA sequence
gaaatgggcaccagatactt

SEQ ID NO: 121567 - DNA, 20 bp, Artificial
  CRISPR gRNA sequence
aagacctttatgtgccaggg

SEQ ID NO: 121568 - DNA, 20 bp, Artificial
  CRISPR gRNA sequence
agacctttatgtgccaggga

SEQ ID NO: 121569 - DNA, 20 bp, Artificial
  CRISPR gRNA sequence
tatgtgccagggaatgcact

SEQ ID NO: 121570 - DNA, 20 bp, Artificial
  CRISPR gRNA sequence
atgtgccagggaatgcacta

SEQ ID NO: 121571 - DNA, 20 bp, Artificial
  CRISPR gRNA sequence
tgtgccagggaatgcactag

SEQ ID NO: 121572 - DNA, 20 bp, Artificial
  CRISPR gRNA sequence
gatgattcacatgagtaaaa

SEQ ID NO: 121573 - DNA, 20 bp, Artificial
  CRISPR gRNA sequence
acatgagtaaaaataatttt

SEQ ID NO: 121574 - DNA, 20 bp, Artificial
  CRISPR gRNA sequence
tcagagtcctaggacaagtc

SEQ ID NO: 121575 - DNA, 20 bp, Artificial
  CRISPR gRNA sequence
cagagtcctaggacaagtct

SEQ ID NO: 121576 - DNA, 20 bp, Artificial
  CRISPR gRNA sequence
agagtcctaggacaagtctc

SEQ ID NO: 121577 - DNA, 20 bp, Artificial
  CRISPR gRNA sequence
ggacaagtctcctcttcatc

SEQ ID NO: 121578 - DNA, 20 bp, Artificial
  CRISPR gRNA sequence
ctcttcatccccaaagaact

SEQ ID NO: 121579 - DNA, 20 bp, Artificial
  CRISPR gRNA sequence
ttcatccccaaagaactcag

SEQ ID NO: 121580 - DNA, 20 bp, Artificial
  CRISPR gRNA sequence
catccccaaagaactcagcc

SEQ ID NO: 121581 - DNA, 20 bp, Artificial
  CRISPR gRNA sequence
atccccaaagaactcagcca

SEQ ID NO: 121582 - DNA, 20 bp, Artificial
  CRISPR gRNA sequence
agccactatcacggggcaga

SEQ ID NO: 121583 - DNA, 20 bp, Artificial
  CRISPR gRNA sequence
tcacggggcagaacccataa

SEQ ID NO: 121584 - DNA, 20 bp, Artificial
  CRISPR gRNA sequence
gttttttcaatcttaggaaa

SEQ ID NO: 121585 - DNA, 20 bp, Artificial
  CRISPR gRNA sequence
tttcaatcttaggaaaaaat

SEQ ID NO: 121586 - DNA, 20 bp, Artificial
  CRISPR gRNA sequence
ttcaatcttaggaaaaaata

SEQ ID NO: 121587 - DNA, 20 bp, Artificial
  CRISPR gRNA sequence
tcaatcttaggaaaaaatat

SEQ ID NO: 121588 - DNA, 20 bp, Artificial
  CRISPR gRNA sequence
caatcttaggaaaaaatata

SEQ ID NO: 121589 - DNA, 20 bp, Artificial
  CRISPR gRNA sequence
aatcttaggaaaaaatatag

SEQ ID NO: 121590 - DNA, 20 bp, Artificial
  CRISPR gRNA sequence
aggaaaaaatatagctctag

SEQ ID NO: 121591 - DNA, 20 bp, Artificial
  CRISPR gRNA sequence
ggaaaaaatatagctctaga

SEQ ID NO: 121592 - DNA, 20 bp, Artificial
  CRISPR gRNA sequence
tagatcccttctacttgaac

SEQ ID NO: 121593 - DNA, 20 bp, Artificial
  CRISPR gRNA sequence
gatcccttctacttgaacct

SEQ ID NO: 121594 - DNA, 20 bp, Artificial
  CRISPR gRNA sequence
ctacttgaacctccatacaa

SEQ ID NO: 121595 - DNA, 20 bp, Artificial
  CRISPR gRNA sequence
tacttgaacctccatacaaa

SEQ ID NO: 121596 - DNA, 20 bp, Artificial
  CRISPR gRNA sequence
cttgaacctccatacaaaat

SEQ ID NO: 121597 - DNA, 20 bp, Artificial
  CRISPR gRNA sequence
gaacctccatacaaaataat

SEQ ID NO: 121598 - DNA, 20 bp, Artificial
  CRISPR gRNA sequence
aacctccatacaaaataata

SEQ ID NO: 121599 - DNA, 20 bp, Artificial
  CRISPR gRNA sequence
catacaaaataataactgtt

SEQ ID NO: 121600 - DNA, 20 bp, Artificial
  CRISPR gRNA sequence
tttccaaaatattccttagc

SEQ ID NO: 121601 - DNA, 20 bp, Artificial
  CRISPR gRNA sequence
ccaaaatattccttagcaag

SEQ ID NO: 121602 - DNA, 20 bp, Artificial
  CRISPR gRNA sequence
caaaatattccttagcaaga

SEQ ID NO: 121603 - DNA, 20 bp, Artificial
  CRISPR gRNA sequence
cttagcaagatatacaagta

SEQ ID NO: 121604 - DNA, 20 bp, Artificial
  CRISPR gRNA sequence
agcaagatatacaagtattt

SEQ ID NO: 121605 - DNA, 20 bp, Artificial
  CRISPR gRNA sequence
gcaagatatacaagtatttt

SEQ ID NO: 121606 - DNA, 20 bp, Artificial
  CRISPR gRNA sequence
taccaactgggctttccccc

SEQ ID NO: 121607 - DNA, 20 bp, Artificial
  CRISPR gRNA sequence
accaactgggctttcccccc

SEQ ID NO: 121608 - DNA, 20 bp, Artificial
  CRISPR gRNA sequence
ccaactgggctttcccccct

SEQ ID NO: 121609 - DNA, 20 bp, Artificial
  CRISPR gRNA sequence
ggctttcccccctaaactat

SEQ ID NO: 121610 - DNA, 20 bp, Artificial
  CRISPR gRNA sequence
tcccccctaaactatcacaa

SEQ ID NO: 121611 - DNA, 20 bp, Artificial
  CRISPR gRNA sequence
cccccctaaactatcacaac

SEQ ID NO: 121612 - DNA, 20 bp, Artificial
  CRISPR gRNA sequence
ccccctaaactatcacaact

SEQ ID NO: 121613 - DNA, 20 bp, Artificial
  CRISPR gRNA sequence
aactatcacaactactgccc

SEQ ID NO: 121614 - DNA, 20 bp, Artificial
  CRISPR gRNA sequence
tcacaactactgcccacttc

SEQ ID NO: 121615 - DNA, 20 bp, Artificial
  CRISPR gRNA sequence
ctgcccacttccctatccca

SEQ ID NO: 121616 - DNA, 20 bp, Artificial
  CRISPR gRNA sequence
cccacttccctatcccatct

SEQ ID NO: 121617 - DNA, 20 bp, Artificial
  CRISPR gRNA sequence
ccctatcccatcttcctgcc

SEQ ID NO: 121618 - DNA, 20 bp, Artificial
  CRISPR gRNA sequence
cctatcccatcttcctgcct

SEQ ID NO: 121619 - DNA, 20 bp, Artificial
  CRISPR gRNA sequence
tcccatcttcctgcctccaa

SEQ ID NO: 121620 - DNA, 20 bp, Artificial
  CRISPR gRNA sequence
cctgcctccaacagtgtaat

SEQ ID NO: 121621 - DNA, 20 bp, Artificial
  CRISPR gRNA sequence
ctgcctccaacagtgtaatt

SEQ ID NO: 121622 - DNA, 20 bp, Artificial
  CRISPR gRNA sequence
cctccaacagtgtaatttga

SEQ ID NO: 121623 - DNA, 20 bp, Artificial
  CRISPR gRNA sequence
caacagtgtaatttgattcc

SEQ ID NO: 121624 - DNA, 20 bp, Artificial
  CRISPR gRNA sequence
gattcctctgcacatgcttt

SEQ ID NO: 121625 - DNA, 20 bp, Artificial
  CRISPR gRNA sequence
attcctctgcacatgctttt

SEQ ID NO: 121626 - DNA, 20 bp, Artificial
  CRISPR gRNA sequence
ctctgcacatgcttttcttc

SEQ ID NO: 121627 - DNA, 20 bp, Artificial
  CRISPR gRNA sequence
tgcacatgcttttcttctct

SEQ ID NO: 121628 - DNA, 20 bp, Artificial
  CRISPR gRNA sequence
cacatgcttttcttctcttc

SEQ ID NO: 121629 - DNA, 20 bp, Artificial
  CRISPR gRNA sequence
ttcttctcttcgagcaagct

SEQ ID NO: 121630 - DNA, 20 bp, Artificial
  CRISPR gRNA sequence
tcttctcttcgagcaagctc

SEQ ID NO: 121631 - DNA, 20 bp, Artificial
  CRISPR gRNA sequence
cttctcttcgagcaagctct

SEQ ID NO: 121632 - DNA, 20 bp, Artificial
  CRISPR gRNA sequence
ttctcttcgagcaagctctt

SEQ ID NO: 121633 - DNA, 20 bp, Artificial
  CRISPR gRNA sequence
ctcttcgagcaagctcttcc

SEQ ID NO: 121634 - DNA, 20 bp, Artificial
  CRISPR gRNA sequence
tcttcgagcaagctcttcca

SEQ ID NO: 121635 - DNA, 20 bp, Artificial
  CRISPR gRNA sequence
ttcgagcaagctcttccatc

SEQ ID NO: 121636 - DNA, 20 bp, Artificial
  CRISPR gRNA sequence
cgagcaagctcttccatctt

SEQ ID NO: 121637 - DNA, 20 bp, Artificial
  CRISPR gRNA sequence
gagcaagctcttccatcttt

SEQ ID NO: 121638 - DNA, 20 bp, Artificial
  CRISPR gRNA sequence
ttccatctttcctgtggaag

SEQ ID NO: 121639 - DNA, 20 bp, Artificial
  CRISPR gRNA sequence
ccatctttcctgtggaagaa

SEQ ID NO: 121640 - DNA, 20 bp, Artificial
  CRISPR gRNA sequence
catctttcctgtggaagaat

SEQ ID NO: 121641 - DNA, 20 bp, Artificial
  CRISPR gRNA sequence
tcctgtggaagaattaccat

SEQ ID NO: 121642 - DNA, 20 bp, Artificial
  CRISPR gRNA sequence
cctgtggaagaattaccatc

SEQ ID NO: 121643 - DNA, 20 bp, Artificial
  CRISPR gRNA sequence
ctgtggaagaattaccatca

SEQ ID NO: 121644 - DNA, 20 bp, Artificial
  CRISPR gRNA sequence
tggaagaattaccatcattc

SEQ ID NO: 121645 - DNA, 20 bp, Artificial
  CRISPR gRNA sequence
ccatcattcttcaaggccag

SEQ ID NO: 121646 - DNA, 20 bp, Artificial
  CRISPR gRNA sequence
ttcaaggccagtcaaaagtg

SEQ ID NO: 121647 - DNA, 20 bp, Artificial
  CRISPR gRNA sequence
caaggccagtcaaaagtgcg

SEQ ID NO: 121648 - DNA, 20 bp, Artificial
  CRISPR gRNA sequence
aaggccagtcaaaagtgcgg

SEQ ID NO: 121649 - DNA, 20 bp, Artificial
  CRISPR gRNA sequence
tcacggaggctagctcacgc

SEQ ID NO: 121650 - DNA, 20 bp, Artificial
  CRISPR gRNA sequence
cacggaggctagctcacgca

SEQ ID NO: 121651 - DNA, 20 bp, Artificial
  CRISPR gRNA sequence
acggaggctagctcacgcat

SEQ ID NO: 121652 - DNA, 20 bp, Artificial
  CRISPR gRNA sequence
gctcacgcatggatacttca

SEQ ID NO: 121653 - DNA, 20 bp, Artificial
  CRISPR gRNA sequence
acgcatggatacttcacagc

SEQ ID NO: 121654 - DNA, 20 bp, Artificial
  CRISPR gRNA sequence
cacagcaactgaacttggcc

SEQ ID NO: 121655 - DNA, 20 bp, Artificial
  CRISPR gRNA sequence
acagcaactgaacttggccc

SEQ ID NO: 121656 - DNA, 20 bp, Artificial
  CRISPR gRNA sequence
aacttggcccctttatagca

SEQ ID NO: 121657 - DNA, 20 bp, Artificial
  CRISPR gRNA sequence
ggcccctttatagcactaac

SEQ ID NO: 121658 - DNA, 20 bp, Artificial
  CRISPR gRNA sequence
gcccctttatagcactaacc

SEQ ID NO: 121659 - DNA, 20 bp, Artificial
  CRISPR gRNA sequence
tatagcactaaccgttaggt

SEQ ID NO: 121660 - DNA, 20 bp, Artificial
  CRISPR gRNA sequence
atagcactaaccgttaggta

SEQ ID NO: 121661 - DNA, 20 bp, Artificial
  CRISPR gRNA sequence
tagcactaaccgttaggtat

SEQ ID NO: 121662 - DNA, 20 bp, Artificial
  CRISPR gRNA sequence
accgttaggtattaactacc

SEQ ID NO: 121663 - DNA, 20 bp, Artificial
  CRISPR gRNA sequence
ggtattaactacctgttcac

SEQ ID NO: 121664 - DNA, 20 bp, Artificial
  CRISPR gRNA sequence
actacctgttcacctgtcaa

SEQ ID NO: 121665 - DNA, 20 bp, Artificial
  CRISPR gRNA sequence
cctgttcacctgtcaatttc

SEQ ID NO: 121666 - DNA, 20 bp, Artificial
  CRISPR gRNA sequence
ttcacctgtcaatttccatc

SEQ ID NO: 121667 - DNA, 20 bp, Artificial
  CRISPR gRNA sequence
acctgtcaatttccatcagg

SEQ ID NO: 121668 - DNA, 20 bp, Artificial
  CRISPR gRNA sequence
tcaatttccatcaggtaggc

SEQ ID NO: 121669 - DNA, 20 bp, Artificial
  CRISPR gRNA sequence
ccatcaggtaggcacagttc

SEQ ID NO: 121670 - DNA, 20 bp, Artificial
  CRISPR gRNA sequence
catcaggtaggcacagttct

SEQ ID NO: 121671 - DNA, 20 bp, Artificial
  CRISPR gRNA sequence
ttattgacctctacgtactc

SEQ ID NO: 121672 - DNA, 20 bp, Artificial
  CRISPR gRNA sequence
attgacctctacgtactccc

SEQ ID NO: 121673 - DNA, 20 bp, Artificial
  CRISPR gRNA sequence
ttgacctctacgtactccct

SEQ ID NO: 121674 - DNA, 20 bp, Artificial
  CRISPR gRNA sequence
acctctacgtactccctccc

SEQ ID NO: 121675 - DNA, 20 bp, Artificial
  CRISPR gRNA sequence
tacgtactccctccctaaca

SEQ ID NO: 121676 - DNA, 20 bp, Artificial
  CRISPR gRNA sequence
cgtactccctccctaacaca

SEQ ID NO: 121677 - DNA, 20 bp, Artificial
  CRISPR gRNA sequence
cctccctaacacacggatta

SEQ ID NO: 121678 - DNA, 20 bp, Artificial
  CRISPR gRNA sequence
cctaacacacggattatacc

SEQ ID NO: 121679 - DNA, 20 bp, Artificial
  CRISPR gRNA sequence
acacacggattatacctggc

SEQ ID NO: 121680 - DNA, 20 bp, Artificial
  CRISPR gRNA sequence
tacctggcatatactaactg

SEQ ID NO: 121681 - DNA, 20 bp, Artificial
  CRISPR gRNA sequence
gcatatactaactgctggat

SEQ ID NO: 121682 - DNA, 20 bp, Artificial
  CRISPR gRNA sequence
actgctggataattggttgc

SEQ ID NO: 121683 - DNA, 20 bp, Artificial
  CRISPR gRNA sequence
ctggataattggttgccaac

SEQ ID NO: 121684 - DNA, 20 bp, Artificial
  CRISPR gRNA sequence
gataattggttgccaacagc

SEQ ID NO: 121685 - DNA, 20 bp, Artificial
  CRISPR gRNA sequence
gttgccaacagcaacctctc

SEQ ID NO: 121686 - DNA, 20 bp, Artificial
  CRISPR gRNA sequence
ccaacagcaacctctcaccc

SEQ ID NO: 121687 - DNA, 20 bp, Artificial
  CRISPR gRNA sequence
tcaccctaaggaaaacccca

SEQ ID NO: 121688 - DNA, 20 bp, Artificial
  CRISPR gRNA sequence
accctaaggaaaaccccaca

SEQ ID NO: 121689 - DNA, 20 bp, Artificial
  CRISPR gRNA sequence
aggaaaaccccacaacactg

SEQ ID NO: 121690 - DNA, 20 bp, Artificial
  CRISPR gRNA sequence
ttagtttctaaacatctgct

SEQ ID NO: 121691 - DNA, 20 bp, Artificial
  CRISPR gRNA sequence
gtttctaaacatctgctgag

SEQ ID NO: 121692 - DNA, 20 bp, Artificial
  CRISPR gRNA sequence
ctaaacatctgctgagaaaa

SEQ ID NO: 121693 - DNA, 20 bp, Artificial
  CRISPR gRNA sequence
taaacatctgctgagaaaac

SEQ ID NO: 121694 - DNA, 20 bp, Artificial
  CRISPR gRNA sequence
aacatctgctgagaaaacgt

SEQ ID NO: 121695 - DNA, 20 bp, Artificial
  CRISPR gRNA sequence
ctgagaaaacgttaacacag

SEQ ID NO: 121696 - DNA, 20 bp, Artificial
  CRISPR gRNA sequence
agaaaacgttaacacaggac

SEQ ID NO: 121697 - DNA, 20 bp, Artificial
  CRISPR gRNA sequence
acacaggacttgaaagtgta

SEQ ID NO: 121698 - DNA, 20 bp, Artificial
  CRISPR gRNA sequence
gaaagtgtatcagaaaaaca

SEQ ID NO: 121699 - DNA, 20 bp, Artificial
  CRISPR gRNA sequence
aaagtgtatcagaaaaacat

SEQ ID NO: 121700 - DNA, 20 bp, Artificial
  CRISPR gRNA sequence
ggtcaagcctgacacaaagt

SEQ ID NO: 121701 - DNA, 20 bp, Artificial
  CRISPR gRNA sequence
acacaaagtaacatagaaag

SEQ ID NO: 121702 - DNA, 20 bp, Artificial
  CRISPR gRNA sequence
tactatattcccaagggagg

SEQ ID NO: 121703 - DNA, 20 bp, Artificial
  CRISPR gRNA sequence
tattcccaagggagggagat

SEQ ID NO: 121704 - DNA, 20 bp, Artificial
  CRISPR gRNA sequence
ccaagggagggagatttcac

SEQ ID NO: 121705 - DNA, 20 bp, Artificial
  CRISPR gRNA sequence
cacaaaatgagcagtggata

SEQ ID NO: 121706 - DNA, 20 bp, Artificial
  CRISPR gRNA sequence
acaaaatgagcagtggataa

SEQ ID NO: 121707 - DNA, 20 bp, Artificial
  CRISPR gRNA sequence
gtaatatgaacagcaagttg

SEQ ID NO: 121708 - DNA, 20 bp, Artificial
  CRISPR gRNA sequence
tgcagcctccggaaagaatg

SEQ ID NO: 121709 - DNA, 20 bp, Artificial
  CRISPR gRNA sequence
cggaaagaatgcgcaagggt

SEQ ID NO: 121710 - DNA, 20 bp, Artificial
  CRISPR gRNA sequence
ctaagagtgaggttccaggc

SEQ ID NO: 121711 - DNA, 20 bp, Artificial
  CRISPR gRNA sequence
taagagtgaggttccaggca

SEQ ID NO: 121712 - DNA, 20 bp, Artificial
  CRISPR gRNA sequence
agagtgaggttccaggcacc

SEQ ID NO: 121713 - DNA, 20 bp, Artificial
  CRISPR gRNA sequence
caggcaccgaatggactggt

SEQ ID NO: 121714 - DNA, 20 bp, Artificial
  CRISPR gRNA sequence
gtcttacagcccggacaaga

SEQ ID NO: 121715 - DNA, 20 bp, Artificial
  CRISPR gRNA sequence
acagcccggacaagaaacgg

SEQ ID NO: 121716 - DNA, 20 bp, Artificial
  CRISPR gRNA sequence
cagcccggacaagaaacgga

SEQ ID NO: 121717 - DNA, 20 bp, Artificial
  CRISPR gRNA sequence
ggttgggctccaagacggag

SEQ ID NO: 121718 - DNA, 20 bp, Artificial
  CRISPR gRNA sequence
gttgggctccaagacggagg

SEQ ID NO: 121719 - DNA, 20 bp, Artificial
  CRISPR gRNA sequence
ggctccaagacggaggtgtg

SEQ ID NO: 121720 - DNA, 20 bp, Artificial
  CRISPR gRNA sequence
caagacggaggtgtgcggtc

SEQ ID NO: 121721 - DNA, 20 bp, Artificial
  CRISPR gRNA sequence
ccactgcgaacggggcgggg

SEQ ID NO: 121722 - DNA, 20 bp, Artificial
  CRISPR gRNA sequence
cgaacggggcggggaagaga

SEQ ID NO: 121723 - DNA, 20 bp, Artificial
  CRISPR gRNA sequence
ggaggaggggcgcggcggag

SEQ ID NO: 121724 - DNA, 20 bp, Artificial
  CRISPR gRNA sequence
acggccccctctccccacca

SEQ ID NO: 121725 - DNA, 20 bp, Artificial
  CRISPR gRNA sequence
tccccaccagggagacagcg

SEQ ID NO: 121726 - DNA, 20 bp, Artificial
  CRISPR gRNA sequence
cccaccagggagacagcggg

SEQ ID NO: 121727 - DNA, 20 bp, Artificial
  CRISPR gRNA sequence
cgaggcgtgggcgggccagc

SEQ ID NO: 121728 - DNA, 20 bp, Artificial
  CRISPR gRNA sequence
ccagccgcacacgggacccc

SEQ ID NO: 121729 - DNA, 20 bp, Artificial
  CRISPR gRNA sequence
cccaggcctccctcccgacc

SEQ ID NO: 121730 - DNA, 20 bp, Artificial
  CRISPR gRNA sequence
cctcccgacctagaggggct

SEQ ID NO: 121731 - DNA, 20 bp, Artificial
  CRISPR gRNA sequence
ccgacctagaggggctgcag

SEQ ID NO: 121732 - DNA, 20 bp, Artificial
  CRISPR gRNA sequence
gaggggctgcagataagaca

SEQ ID NO: 121733 - DNA, 20 bp, Artificial
  CRISPR gRNA sequence
cagataagacagacccggct

SEQ ID NO: 121734 - DNA, 20 bp, Artificial
  CRISPR gRNA sequence
gctgggagcggggagcgggg

SEQ ID NO: 121735 - DNA, 20 bp, Artificial
  CRISPR gRNA sequence
ggagcggggagcggggggcg

SEQ ID NO: 121736 - DNA, 20 bp, Artificial
  CRISPR gRNA sequence
cctgtcccaagggccggaga

SEQ ID NO: 121737 - DNA, 20 bp, Artificial
  CRISPR gRNA sequence
ctgtcccaagggccggagag

SEQ ID NO: 121738 - DNA, 20 bp, Artificial
  CRISPR gRNA sequence
tcccaagggccggagagtgg

SEQ ID NO: 121739 - DNA, 20 bp, Artificial
  CRISPR gRNA sequence
aagtttgcggccagaacgac

SEQ ID NO: 121740 - DNA, 20 bp, Artificial
  CRISPR gRNA sequence
agtttgcggccagaacgacc

SEQ ID NO: 121741 - DNA, 20 bp, Artificial
  CRISPR gRNA sequence
gcggccagaacgaccaggag

SEQ ID NO: 121742 - DNA, 20 bp, Artificial
  CRISPR gRNA sequence
cggccagaacgaccaggagg

SEQ ID NO: 121743 - DNA, 20 bp, Artificial
  CRISPR gRNA sequence
gtgtagggccattcgtggcc

SEQ ID NO: 121744 - DNA, 20 bp, Artificial
  CRISPR gRNA sequence
gtggccccaggcctggggcc

SEQ ID NO: 121745 - DNA, 20 bp, Artificial
  CRISPR gRNA sequence
gggcctgagaacctgggcct

SEQ ID NO: 121746 - DNA, 20 bp, Artificial
  CRISPR gRNA sequence
agaacctgggcctgagtcgg

SEQ ID NO: 121747 - DNA, 20 bp, Artificial
  CRISPR gRNA sequence
ggcctgagtcggggaacagg

SEQ ID NO: 121748 - DNA, 20 bp, Artificial
  CRISPR gRNA sequence
agtcggggaacagggacgca

SEQ ID NO: 121749 - DNA, 20 bp, Artificial
  CRISPR gRNA sequence
ccaactggccctggcaccct

SEQ ID NO: 121750 - DNA, 20 bp, Artificial
  CRISPR gRNA sequence
gccctggcaccctgcgaggg

SEQ ID NO: 121751 - DNA, 20 bp, Artificial
  CRISPR gRNA sequence
gcaccctgcgagggtcggag

SEQ ID NO: 121752 - DNA, 20 bp, Artificial
  CRISPR gRNA sequence
cgagggtcggagccccgagg

SEQ ID NO: 121753 - DNA, 20 bp, Artificial
  CRISPR gRNA sequence
ctccccgaggcgccatcccc

SEQ ID NO: 121754 - DNA, 20 bp, Artificial
  CRISPR gRNA sequence
cccgaggcgccatccccgcg

SEQ ID NO: 121755 - DNA, 20 bp, Artificial
  CRISPR gRNA sequence
caggcctcggccgggagtgc

SEQ ID NO: 121756 - DNA, 20 bp, Artificial
  CRISPR gRNA sequence
ggccgggagtgccccgaggc

SEQ ID NO: 121757 - DNA, 20 bp, Artificial
  CRISPR gRNA sequence
gcaggccccgggccggggcc

SEQ ID NO: 121758 - DNA, 20 bp, Artificial
  CRISPR gRNA sequence
gccgcccggctcggctaggc

SEQ ID NO: 121759 - DNA, 20 bp, Artificial
  CRISPR gRNA sequence
ggctaggctcagctcgactc

SEQ ID NO: 121760 - DNA, 20 bp, Artificial
  CRISPR gRNA sequence
ggctcagctcgactccccgg

SEQ ID NO: 121761 - DNA, 20 bp, Artificial
  CRISPR gRNA sequence
agctcgactccccgggctcg

SEQ ID NO: 121762 - DNA, 20 bp, Artificial
  CRISPR gRNA sequence
gactccccgggctcgacggg

SEQ ID NO: 121763 - DNA, 20 bp, Artificial
  CRISPR gRNA sequence
cccgggctcgacgggcgcct

SEQ ID NO: 121764 - DNA, 20 bp, Artificial
  CRISPR gRNA sequence
gacgggcgcctgggcctctc

SEQ ID NO: 121765 - DNA, 20 bp, Artificial
  CRISPR gRNA sequence
ggcctctcctgagtggtcag

SEQ ID NO: 121766 - DNA, 20 bp, Artificial
  CRISPR gRNA sequence
tcctgagtggtcagcgagac

SEQ ID NO: 121767 - DNA, 20 bp, Artificial
  CRISPR gRNA sequence
ctgagtggtcagcgagaccc

SEQ ID NO: 121768 - DNA, 20 bp, Artificial
  CRISPR gRNA sequence
agtggtcagcgagacccgcc

SEQ ID NO: 121769 - DNA, 20 bp, Artificial
  CRISPR gRNA sequence
gggccggctctgggccgctg

SEQ ID NO: 121770 - DNA, 20 bp, Artificial
  CRISPR gRNA sequence
tgggccgctggatattggct

SEQ ID NO: 121771 - DNA, 20 bp, Artificial
  CRISPR gRNA sequence
ggccgctggatattggctcc

SEQ ID NO: 121772 - DNA, 20 bp, Artificial
  CRISPR gRNA sequence
gatattggctcctcacactc

SEQ ID NO: 121773 - DNA, 20 bp, Artificial
  CRISPR gRNA sequence
gctcctcacactcaccgtgc

SEQ ID NO: 121774 - DNA, 20 bp, Artificial
  CRISPR gRNA sequence
ctcacactcaccgtgcctcg

SEQ ID NO: 121775 - DNA, 20 bp, Artificial
  CRISPR gRNA sequence
acactcaccgtgcctcgctc

SEQ ID NO: 121776 - DNA, 20 bp, Artificial
  CRISPR gRNA sequence
accgtgcctcgctcccccgg

SEQ ID NO: 121777 - DNA, 20 bp, Artificial
  CRISPR gRNA sequence
gctcccccggttcgctgccc

SEQ ID NO: 121778 - DNA, 20 bp, Artificial
  CRISPR gRNA sequence
ccccggttcgctgcccgcgc

SEQ ID NO: 121779 - DNA, 20 bp, Artificial
  CRISPR gRNA sequence
gctgcccgcgctgattggct

SEQ ID NO: 121780 - DNA, 20 bp, Artificial
  CRISPR gRNA sequence
cccgcgctgattggctccag

SEQ ID NO: 121781 - DNA, 20 bp, Artificial
  CRISPR gRNA sequence
attggctccagtaccggact

SEQ ID NO: 121782 - DNA, 20 bp, Artificial
  CRISPR gRNA sequence
gctccagtaccggactccga

SEQ ID NO: 121783 - DNA, 20 bp, Artificial
  CRISPR gRNA sequence
cagtaccggactccgaaacc

SEQ ID NO: 121784 - DNA, 20 bp, Artificial
  CRISPR gRNA sequence
cgaaacccaatcagaggctc

SEQ ID NO: 121785 - DNA, 20 bp, Artificial
  CRISPR gRNA sequence
cagccgccgctgccgccgcc

SEQ ID NO: 121786 - DNA, 20 bp, Artificial
  CRISPR gRNA sequence
ccgccgccactgccgctgcc

SEQ ID NO: 121787 - DNA, 20 bp, Artificial
  CRISPR gRNA sequence
ccgctgcctagcaaaatggc

SEQ ID NO: 121788 - DNA, 20 bp, Artificial
  CRISPR gRNA sequence
cctagcaaaatggcgaaccc

SEQ ID NO: 121789 - DNA, 20 bp, Artificial
  CRISPR gRNA sequence
gcaaaatggcgaacccgaac

SEQ ID NO: 121790 - DNA, 20 bp, Artificial
  CRISPR gRNA sequence
cctccaaccgcctccgcgca

SEQ ID NO: 121791 - DNA, 20 bp, Artificial
  CRISPR gRNA sequence
caaccgcctccgcgcaggcg

SEQ ID NO: 121792 - DNA, 20 bp, Artificial
  CRISPR gRNA sequence
cgcgcaggcgcctctgaggc

SEQ ID NO: 121793 - DNA, 20 bp, Artificial
  CRISPR gRNA sequence
tgaggccacgcccactaact

SEQ ID NO: 121794 - DNA, 20 bp, Artificial
  CRISPR gRNA sequence
aggccacgcccactaactcc

SEQ ID NO: 121795 - DNA, 20 bp, Artificial
  CRISPR gRNA sequence
actccagttcagggatcgcc

SEQ ID NO: 121796 - DNA, 20 bp, Artificial
  CRISPR gRNA sequence
cagttcagggatcgccccac

SEQ ID NO: 121797 - DNA, 20 bp, Artificial
  CRISPR gRNA sequence
attaatctttaaaataattt

SEQ ID NO: 121798 - DNA, 20 bp, Artificial
  CRISPR gRNA sequence
taatctttaaaataatttta

SEQ ID NO: 121799 - DNA, 20 bp, Artificial
  CRISPR gRNA sequence
ctttaaaataattttagaga

SEQ ID NO: 121800 - DNA, 20 bp, Artificial
  CRISPR gRNA sequence
gagacagtatctgataatca

SEQ ID NO: 121801 - DNA, 20 bp, Artificial
  CRISPR gRNA sequence
gtatctgataatcaaagacc

SEQ ID NO: 121802 - DNA, 20 bp, Artificial
  CRISPR gRNA sequence
caaagaccaagtgcttttat

SEQ ID NO: 121803 - DNA, 20 bp, Artificial
  CRISPR gRNA sequence
aagtgcttttatcagttata

SEQ ID NO: 121804 - DNA, 20 bp, Artificial
  CRISPR gRNA sequence
ttatatagtgacacactgct

SEQ ID NO: 121805 - DNA, 20 bp, Artificial
  CRISPR gRNA sequence
agtgacacactgcttggatc

SEQ ID NO: 121806 - DNA, 20 bp, Artificial
  CRISPR gRNA sequence
gacacactgcttggatcaag

SEQ ID NO: 121807 - DNA, 20 bp, Artificial
  CRISPR gRNA sequence
tcaaaaatacactcataacg

SEQ ID NO: 121808 - DNA, 20 bp, Artificial
  CRISPR gRNA sequence
cactcataacgaagtatcaa

SEQ ID NO: 121809 - DNA, 20 bp, Artificial
  CRISPR gRNA sequence
gccttaaaattttgcatatt

SEQ ID NO: 121810 - DNA, 20 bp, Artificial
  CRISPR gRNA sequence
attttgcatatttggtaacc

SEQ ID NO: 121811 - DNA, 20 bp, Artificial
  CRISPR gRNA sequence
tttggtaacccagcaattca

SEQ ID NO: 121812 - DNA, 20 bp, Artificial
  CRISPR gRNA sequence
cccagcaattcaaagaattt

SEQ ID NO: 121813 - DNA, 20 bp, Artificial
  CRISPR gRNA sequence
attcaaagaatttaagaaaa

SEQ ID NO: 121814 - DNA, 20 bp, Artificial
  CRISPR gRNA sequence
agaatttaagaaaacagtca

SEQ ID NO: 121815 - DNA, 20 bp, Artificial
  CRISPR gRNA sequence
aaaacagtcatggatgtaca

SEQ ID NO: 121816 - DNA, 20 bp, Artificial
  CRISPR gRNA sequence
aaacagtcatggatgtacat

SEQ ID NO: 121817 - DNA, 20 bp, Artificial
  CRISPR gRNA sequence
tcatggatgtacatgggatt

SEQ ID NO: 121818 - DNA, 20 bp, Artificial
  CRISPR gRNA sequence
gatgtacatgggattcagtg

SEQ ID NO: 121819 - DNA, 20 bp, Artificial
  CRISPR gRNA sequence
gtgctgtttataactgtgaa

SEQ ID NO: 121820 - DNA, 20 bp, Artificial
  CRISPR gRNA sequence
taactgtgaaaagatgtaaa

SEQ ID NO: 121821 - DNA, 20 bp, Artificial
  CRISPR gRNA sequence
taaatagtcaaaatatccaa

SEQ ID NO: 121822 - DNA, 20 bp, Artificial
  CRISPR gRNA sequence
atagtcaaaatatccaatag

SEQ ID NO: 121823 - DNA, 20 bp, Artificial
  CRISPR gRNA sequence
agattaaatgaattatgatt

SEQ ID NO: 121824 - DNA, 20 bp, Artificial
  CRISPR gRNA sequence
tgaattatgattgagtcata

SEQ ID NO: 121825 - DNA, 20 bp, Artificial
  CRISPR gRNA sequence
attatgattgagtcatacag

SEQ ID NO: 121826 - DNA, 20 bp, Artificial
  CRISPR gRNA sequence
ataaaccaataaaaatgatg

SEQ ID NO: 121827 - DNA, 20 bp, Artificial
  CRISPR gRNA sequence
aaccaataaaaatgatgcag

SEQ ID NO: 121828 - DNA, 20 bp, Artificial
  CRISPR gRNA sequence
gcagaagactatgcatgacc

SEQ ID NO: 121829 - DNA, 20 bp, Artificial
  CRISPR gRNA sequence
agactatgcatgacctggaa

SEQ ID NO: 121830 - DNA, 20 bp, Artificial
  CRISPR gRNA sequence
gatgttcccaatatattgtt

SEQ ID NO: 121831 - DNA, 20 bp, Artificial
  CRISPR gRNA sequence
aatatattgttaagtgaaaa

SEQ ID NO: 121832 - DNA, 20 bp, Artificial
  CRISPR gRNA sequence
atattgttaagtgaaaaaag

SEQ ID NO: 121833 - DNA, 20 bp, Artificial
  CRISPR gRNA sequence
tattgttaagtgaaaaaagc

SEQ ID NO: 121834 - DNA, 20 bp, Artificial
  CRISPR gRNA sequence
gaaaaaagcaggttacaaaa

SEQ ID NO: 121835 - DNA, 20 bp, Artificial
  CRISPR gRNA sequence
caaaatggtatgcacaatat

SEQ ID NO: 121836 - DNA, 20 bp, Artificial
  CRISPR gRNA sequence
tttataaaaatatacatatt

SEQ ID NO: 121837 - DNA, 20 bp, Artificial
  CRISPR gRNA sequence
aaaaatatacatatttagca

SEQ ID NO: 121838 - DNA, 20 bp, Artificial
  CRISPR gRNA sequence
atacatatttagcaaagtaa

SEQ ID NO: 121839 - DNA, 20 bp, Artificial
  CRISPR gRNA sequence
tacatatttagcaaagtaaa

SEQ ID NO: 121840 - DNA, 20 bp, Artificial
  CRISPR gRNA sequence
atttatcaaaatattaacat

SEQ ID NO: 121841 - DNA, 20 bp, Artificial
  CRISPR gRNA sequence
taacattggttctttcaaca

SEQ ID NO: 121842 - DNA, 20 bp, Artificial
  CRISPR gRNA sequence
cattggttctttcaacatag

SEQ ID NO: 121843 - DNA, 20 bp, Artificial
  CRISPR gRNA sequence
attggttctttcaacatagt

SEQ ID NO: 121844 - DNA, 20 bp, Artificial
  CRISPR gRNA sequence
tatttgaatttactacaatg

SEQ ID NO: 121845 - DNA, 20 bp, Artificial
  CRISPR gRNA sequence
aatgaagtttgttttttaaa

SEQ ID NO: 121846 - DNA, 20 bp, Artificial
  CRISPR gRNA sequence
tgaagtttgttttttaaatg

SEQ ID NO: 121847 - DNA, 20 bp, Artificial
  CRISPR gRNA sequence
aagtttgttttttaaatgga

SEQ ID NO: 121848 - DNA, 20 bp, Artificial
  CRISPR gRNA sequence
tttgttttttaaatggagag

SEQ ID NO: 121849 - DNA, 20 bp, Artificial
  CRISPR gRNA sequence
ttgttttttaaatggagagt

SEQ ID NO: 121850 - DNA, 20 bp, Artificial
  CRISPR gRNA sequence
gttttttaaatggagagtag

SEQ ID NO: 121851 - DNA, 20 bp, Artificial
  CRISPR gRNA sequence
ttaaatggagagtaggagat

SEQ ID NO: 121852 - DNA, 20 bp, Artificial
  CRISPR gRNA sequence
taaatggagagtaggagatg

SEQ ID NO: 121853 - DNA, 20 bp, Artificial
  CRISPR gRNA sequence
ggacattattaacctctgat

SEQ ID NO: 121854 - DNA, 20 bp, Artificial
  CRISPR gRNA sequence
ttagcccacatatactccta

SEQ ID NO: 121855 - DNA, 20 bp, Artificial
  CRISPR gRNA sequence
tagcccacatatactcctaa

SEQ ID NO: 121856 - DNA, 20 bp, Artificial
  CRISPR gRNA sequence
atactcctaaaggctccttc

SEQ ID NO: 121857 - DNA, 20 bp, Artificial
  CRISPR gRNA sequence
cctaaaggctccttctggca

SEQ ID NO: 121858 - DNA, 20 bp, Artificial
  CRISPR gRNA sequence
gcaaagtaaatgtttctgtt

SEQ ID NO: 121859 - DNA, 20 bp, Artificial
  CRISPR gRNA sequence
gtttctgttcagcctatatc

SEQ ID NO: 121860 - DNA, 20 bp, Artificial
  CRISPR gRNA sequence
tttctgttcagcctatatct

SEQ ID NO: 121861 - DNA, 20 bp, Artificial
  CRISPR gRNA sequence
tgcttctaccttataaattt

SEQ ID NO: 121862 - DNA, 20 bp, Artificial
  CRISPR gRNA sequence
ataaatttgagtgtccttca

SEQ ID NO: 121863 - DNA, 20 bp, Artificial
  CRISPR gRNA sequence
tattcactccaacttccttt

SEQ ID NO: 121864 - DNA, 20 bp, Artificial
  CRISPR gRNA sequence
attcactccaacttcctttt

SEQ ID NO: 121865 - DNA, 20 bp, Artificial
  CRISPR gRNA sequence
cttttaggcaaactatacaa

SEQ ID NO: 121866 - DNA, 20 bp, Artificial
  CRISPR gRNA sequence
ttgatattaaaaacttaaaa

SEQ ID NO: 121867 - DNA, 20 bp, Artificial
  CRISPR gRNA sequence
acttaaaaaagaaatccctc

SEQ ID NO: 121868 - DNA, 20 bp, Artificial
  CRISPR gRNA sequence
tcaagttaattaacaccaaa

SEQ ID NO: 121869 - DNA, 20 bp, Artificial
  CRISPR gRNA sequence
ttaattaacaccaaaaagaa

SEQ ID NO: 121870 - DNA, 20 bp, Artificial
  CRISPR gRNA sequence
taacaccaaaaagaatagat

SEQ ID NO: 121871 - DNA, 20 bp, Artificial
  CRISPR gRNA sequence
acaaatcctcacttttcaaa

SEQ ID NO: 121872 - DNA, 20 bp, Artificial
  CRISPR gRNA sequence
ttttcaaaaagaaacaatcc

SEQ ID NO: 121873 - DNA, 20 bp, Artificial
  CRISPR gRNA sequence
acatactactaaattataca

SEQ ID NO: 121874 - DNA, 20 bp, Artificial
  CRISPR gRNA sequence
aaagttacattatttacgtt

SEQ ID NO: 121875 - DNA, 20 bp, Artificial
  CRISPR gRNA sequence
tatttacgtttagtttattg

SEQ ID NO: 121876 - DNA, 20 bp, Artificial
  CRISPR gRNA sequence
tttacgtttagtttattgca

SEQ ID NO: 121877 - DNA, 20 bp, Artificial
  CRISPR gRNA sequence
tttagtttattgcagagatg

SEQ ID NO: 121878 - DNA, 20 bp, Artificial
  CRISPR gRNA sequence
gtttattgcagagatgaaga

SEQ ID NO: 121879 - DNA, 20 bp, Artificial
  CRISPR gRNA sequence
cagagatgaagacagcatac

SEQ ID NO: 121880 - DNA, 20 bp, Artificial
  CRISPR gRNA sequence
agatgaagacagcatactag

SEQ ID NO: 121881 - DNA, 20 bp, Artificial
  CRISPR gRNA sequence
gaagacagcatactagaagt

SEQ ID NO: 121882 - DNA, 20 bp, Artificial
  CRISPR gRNA sequence
cttctatttcacaccgttca

SEQ ID NO: 121883 - DNA, 20 bp, Artificial
  CRISPR gRNA sequence
tcatccactcacccatgcaa

SEQ ID NO: 121884 - DNA, 20 bp, Artificial
  CRISPR gRNA sequence
catccactcacccatgcaaa

SEQ ID NO: 121885 - DNA, 20 bp, Artificial
  CRISPR gRNA sequence
caatgatgtctgatgtttct

SEQ ID NO: 121886 - DNA, 20 bp, Artificial
  CRISPR gRNA sequence
ctgatgtttcttggtttcca

SEQ ID NO: 121887 - DNA, 20 bp, Artificial
  CRISPR gRNA sequence
tcttggtttccatagtgtaa

SEQ ID NO: 121888 - DNA, 20 bp, Artificial
  CRISPR gRNA sequence
cttggtttccatagtgtaac

SEQ ID NO: 121889 - DNA, 20 bp, Artificial
  CRISPR gRNA sequence
aacttgacatttcaattaaa

SEQ ID NO: 121890 - DNA, 20 bp, Artificial
  CRISPR gRNA sequence
acttgacatttcaattaaaa

SEQ ID NO: 121891 - DNA, 20 bp, Artificial
  CRISPR gRNA sequence
tcaattaaaaaggtaaaatg

SEQ ID NO: 121892 - DNA, 20 bp, Artificial
  CRISPR gRNA sequence
aaaatgaagacatttaccat

SEQ ID NO: 121893 - DNA, 20 bp, Artificial
  CRISPR gRNA sequence
ctataaaactcctcttctgt

SEQ ID NO: 121894 - DNA, 20 bp, Artificial
  CRISPR gRNA sequence
ataaaactcctcttctgtaa

SEQ ID NO: 121895 - DNA, 20 bp, Artificial
  CRISPR gRNA sequence
tcttctgtaagagaatacta

SEQ ID NO: 121896 - DNA, 20 bp, Artificial
  CRISPR gRNA sequence
agagaatactatagtacttg

SEQ ID NO: 121897 - DNA, 20 bp, Artificial
  CRISPR gRNA sequence
aaaaatcatgtaccaaatga

SEQ ID NO: 121898 - DNA, 20 bp, Artificial
  CRISPR gRNA sequence
aaaatcatgtaccaaatgaa

SEQ ID NO: 121899 - DNA, 20 bp, Artificial
  CRISPR gRNA sequence
aaatcatgtaccaaatgaaa

SEQ ID NO: 121900 - DNA, 20 bp, Artificial
  CRISPR gRNA sequence
aatcatgtaccaaatgaaag

SEQ ID NO: 121901 - DNA, 20 bp, Artificial
  CRISPR gRNA sequence
aatgaaaggggcaccatttc

SEQ ID NO: 121902 - DNA, 20 bp, Artificial
  CRISPR gRNA sequence
tgaaaggggcaccatttcaa

SEQ ID NO: 121903 - DNA, 20 bp, Artificial
  CRISPR gRNA sequence
gggcaccatttcaagagcac

SEQ ID NO: 121904 - DNA, 20 bp, Artificial
  CRISPR gRNA sequence
ggcaccatttcaagagcact

SEQ ID NO: 121905 - DNA, 20 bp, Artificial
  CRISPR gRNA sequence
atgtaactcaaaaccaaatc

SEQ ID NO: 121906 - DNA, 20 bp, Artificial
  CRISPR gRNA sequence
aaccaaatctagtcttaaaa

SEQ ID NO: 121907 - DNA, 20 bp, Artificial
  CRISPR gRNA sequence
atctagtcttaaaaaagctc

SEQ ID NO: 121908 - DNA, 20 bp, Artificial
  CRISPR gRNA sequence
agtaactaaaactacattaa

SEQ ID NO: 121909 - DNA, 20 bp, Artificial
  CRISPR gRNA sequence
gtaactaaaactacattaac

SEQ ID NO: 121910 - DNA, 20 bp, Artificial
  CRISPR gRNA sequence
acattaacaggcacgatgaa

SEQ ID NO: 121911 - DNA, 20 bp, Artificial
  CRISPR gRNA sequence
aacagtgtaaacactgttaa

SEQ ID NO: 121912 - DNA, 20 bp, Artificial
  CRISPR gRNA sequence
acagtgtaaacactgttaat

SEQ ID NO: 121913 - DNA, 20 bp, Artificial
  CRISPR gRNA sequence
aaacactgttaatgggcacc

SEQ ID NO: 121914 - DNA, 20 bp, Artificial
  CRISPR gRNA sequence
ttaatgggcaccaagtttaa

SEQ ID NO: 121915 - DNA, 20 bp, Artificial
  CRISPR gRNA sequence
taatgggcaccaagtttaac

SEQ ID NO: 121916 - DNA, 20 bp, Artificial
  CRISPR gRNA sequence
aatgggcaccaagtttaaca

SEQ ID NO: 121917 - DNA, 20 bp, Artificial
  CRISPR gRNA sequence
gggcaccaagtttaacaggg

SEQ ID NO: 121918 - DNA, 20 bp, Artificial
  CRISPR gRNA sequence
aataataattttaataaata

SEQ ID NO: 121919 - DNA, 20 bp, Artificial
  CRISPR gRNA sequence
ttaataaatacagcaaatgc

SEQ ID NO: 121920 - DNA, 20 bp, Artificial
  CRISPR gRNA sequence
tacagcaaatgctagaaatc

SEQ ID NO: 121921 - DNA, 20 bp, Artificial
  CRISPR gRNA sequence
gcaaatgctagaaatctagc

SEQ ID NO: 121922 - DNA, 20 bp, Artificial
  CRISPR gRNA sequence
caaatgctagaaatctagct

SEQ ID NO: 121923 - DNA, 20 bp, Artificial
  CRISPR gRNA sequence
atctagctaggttatcatgc

SEQ ID NO: 121924 - DNA, 20 bp, Artificial
  CRISPR gRNA sequence
tctagctaggttatcatgca

SEQ ID NO: 121925 - DNA, 20 bp, Artificial
  CRISPR gRNA sequence
ttatcatgcaaggtataacc

SEQ ID NO: 121926 - DNA, 20 bp, Artificial
  CRISPR gRNA sequence
acaaactcaaatttataata

SEQ ID NO: 121927 - DNA, 20 bp, Artificial
  CRISPR gRNA sequence
caaactcaaatttataataa

SEQ ID NO: 121928 - DNA, 20 bp, Artificial
  CRISPR gRNA sequence
ctacccttatattttattaa

SEQ ID NO: 121929 - DNA, 20 bp, Artificial
  CRISPR gRNA sequence
tacccttatattttattaaa

SEQ ID NO: 121930 - DNA, 20 bp, Artificial
  CRISPR gRNA sequence
acccttatattttattaaaa

SEQ ID NO: 121931 - DNA, 20 bp, Artificial
  CRISPR gRNA sequence
gcaaacatcatgaattaacc

SEQ ID NO: 121932 - DNA, 20 bp, Artificial
  CRISPR gRNA sequence
gccgcttacttgaattacaa

SEQ ID NO: 121933 - DNA, 20 bp, Artificial
  CRISPR gRNA sequence
acatgattcaatatgaaaat

SEQ ID NO: 121934 - DNA, 20 bp, Artificial
  CRISPR gRNA sequence
aactgtctacaaatctctga

SEQ ID NO: 121935 - DNA, 20 bp, Artificial
  CRISPR gRNA sequence
attgcaatatacaatgcata

SEQ ID NO: 121936 - DNA, 20 bp, Artificial
  CRISPR gRNA sequence
ttgcaatatacaatgcatac

SEQ ID NO: 121937 - DNA, 20 bp, Artificial
  CRISPR gRNA sequence
gcaatatacaatgcatacag

SEQ ID NO: 121938 - DNA, 20 bp, Artificial
  CRISPR gRNA sequence
caatgcatacaggagtcata

SEQ ID NO: 121939 - DNA, 20 bp, Artificial
  CRISPR gRNA sequence
atgcatacaggagtcataca

SEQ ID NO: 121940 - DNA, 20 bp, Artificial
  CRISPR gRNA sequence
ctttaaaatcattcatgaaa

SEQ ID NO: 121941 - DNA, 20 bp, Artificial
  CRISPR gRNA sequence
cattcatgaaaaagattctc

SEQ ID NO: 121942 - DNA, 20 bp, Artificial
  CRISPR gRNA sequence
catgaaaaagattctcaagt

SEQ ID NO: 121943 - DNA, 20 bp, Artificial
  CRISPR gRNA sequence
gtcagaattaacacctcaat

SEQ ID NO: 121944 - DNA, 20 bp, Artificial
  CRISPR gRNA sequence
aattaacacctcaattagtc

SEQ ID NO: 121945 - DNA, 20 bp, Artificial
  CRISPR gRNA sequence
cacctcaattagtcaagcat

SEQ ID NO: 121946 - DNA, 20 bp, Artificial
  CRISPR gRNA sequence
acctcaattagtcaagcatc

SEQ ID NO: 121947 - DNA, 20 bp, Artificial
  CRISPR gRNA sequence
tcaattagtcaagcatcagg

SEQ ID NO: 121948 - DNA, 20 bp, Artificial
  CRISPR gRNA sequence
agcatcaggaagctacatta

SEQ ID NO: 121949 - DNA, 20 bp, Artificial
  CRISPR gRNA sequence
attacagctattaatataca

SEQ ID NO: 121950 - DNA, 20 bp, Artificial
  CRISPR gRNA sequence
acaaagatacatcttttcac

SEQ ID NO: 121951 - DNA, 20 bp, Artificial
  CRISPR gRNA sequence
tccttctgatgtctctgttc

SEQ ID NO: 121952 - DNA, 20 bp, Artificial
  CRISPR gRNA sequence
gtctctgttccagaatcata

SEQ ID NO: 121953 - DNA, 20 bp, Artificial
  CRISPR gRNA sequence
tccccattccatcatttctt

SEQ ID NO: 121954 - DNA, 20 bp, Artificial
  CRISPR gRNA sequence
aaactgaatttgctgaacac

SEQ ID NO: 121955 - DNA, 20 bp, Artificial
  CRISPR gRNA sequence
ttgctgaacaccagaaatct

SEQ ID NO: 121956 - DNA, 20 bp, Artificial
  CRISPR gRNA sequence
gaacaccagaaatctaagat

SEQ ID NO: 121957 - DNA, 20 bp, Artificial
  CRISPR gRNA sequence
aagattagaaaatttaaatt

SEQ ID NO: 121958 - DNA, 20 bp, Artificial
  CRISPR gRNA sequence
attagaaaatttaaattgag

SEQ ID NO: 121959 - DNA, 20 bp, Artificial
  CRISPR gRNA sequence
atttaaattgagcagaatta

SEQ ID NO: 121960 - DNA, 20 bp, Artificial
  CRISPR gRNA sequence
aattgagcagaattaaagaa

SEQ ID NO: 121961 - DNA, 20 bp, Artificial
  CRISPR gRNA sequence
attgagcagaattaaagaaa

SEQ ID NO: 121962 - DNA, 20 bp, Artificial
  CRISPR gRNA sequence
tgagcagaattaaagaaaag

SEQ ID NO: 121963 - DNA, 20 bp, Artificial
  CRISPR gRNA sequence
attaaagaaaaggagattaa

SEQ ID NO: 121964 - DNA, 20 bp, Artificial
  CRISPR gRNA sequence
atatgcatattataaaaatt

SEQ ID NO: 121965 - DNA, 20 bp, Artificial
  CRISPR gRNA sequence
ataaaaattcagtgaataaa

SEQ ID NO: 121966 - DNA, 20 bp, Artificial
  CRISPR gRNA sequence
gtgaataaaaagacaataac

SEQ ID NO: 121967 - DNA, 20 bp, Artificial
  CRISPR gRNA sequence
ccatttcttgtgtatctttc

SEQ ID NO: 121968 - DNA, 20 bp, Artificial
  CRISPR gRNA sequence
tatgcttatttttaactatt

SEQ ID NO: 121969 - DNA, 20 bp, Artificial
  CRISPR gRNA sequence
tgcttatttttaactattaa

SEQ ID NO: 121970 - DNA, 20 bp, Artificial
  CRISPR gRNA sequence
tatatactgttatctacatt

SEQ ID NO: 121971 - DNA, 20 bp, Artificial
  CRISPR gRNA sequence
attttaataaccttctttat

SEQ ID NO: 121972 - DNA, 20 bp, Artificial
  CRISPR gRNA sequence
ttttaataaccttctttatc

SEQ ID NO: 121973 - DNA, 20 bp, Artificial
  CRISPR gRNA sequence
cttctttatcaggtccttaa

SEQ ID NO: 121974 - DNA, 20 bp, Artificial
  CRISPR gRNA sequence
gttgaaattaactatatcaa

SEQ ID NO: 121975 - DNA, 20 bp, Artificial
  CRISPR gRNA sequence
aaaaaaaaaatttttttttt

SEQ ID NO: 121976 - DNA, 20 bp, Artificial
  CRISPR gRNA sequence
aaaaaattttttttttgaga

SEQ ID NO: 121977 - DNA, 20 bp, Artificial
  CRISPR gRNA sequence
aaaattttttttttgagaca

SEQ ID NO: 121978 - DNA, 20 bp, Artificial
  CRISPR gRNA sequence
cagagtctcactctattgcc

SEQ ID NO: 121979 - DNA, 20 bp, Artificial
  CRISPR gRNA sequence
agagtctcactctattgccc

SEQ ID NO: 121980 - DNA, 20 bp, Artificial
  CRISPR gRNA sequence
tctcactctattgcccaggc

SEQ ID NO: 121981 - DNA, 20 bp, Artificial
  CRISPR gRNA sequence
tcactctattgcccaggctg

SEQ ID NO: 121982 - DNA, 20 bp, Artificial
  CRISPR gRNA sequence
ctattgcccaggctggagtg

SEQ ID NO: 121983 - DNA, 20 bp, Artificial
  CRISPR gRNA sequence
ttgcccaggctggagtgcag

SEQ ID NO: 121984 - DNA, 20 bp, Artificial
  CRISPR gRNA sequence
ggagtgcagtggtgtgatct

SEQ ID NO: 121985 - DNA, 20 bp, Artificial
  CRISPR gRNA sequence
ctcactgcaacctccacctc

SEQ ID NO: 121986 - DNA, 20 bp, Artificial
  CRISPR gRNA sequence
tcactgcaacctccacctcc

SEQ ID NO: 121987 - DNA, 20 bp, Artificial
  CRISPR gRNA sequence
cactgcaacctccacctcca

SEQ ID NO: 121988 - DNA, 20 bp, Artificial
  CRISPR gRNA sequence
aacctccacctccagggttc

SEQ ID NO: 121989 - DNA, 20 bp, Artificial
  CRISPR gRNA sequence
ttcaagtgattctcctgcct

SEQ ID NO: 121990 - DNA, 20 bp, Artificial
  CRISPR gRNA sequence
attctcctgcctcagcctcc

SEQ ID NO: 121991 - DNA, 20 bp, Artificial
  CRISPR gRNA sequence
ctcctgcctcagcctccaag

SEQ ID NO: 121992 - DNA, 20 bp, Artificial
  CRISPR gRNA sequence
cctgcctcagcctccaagca

SEQ ID NO: 121993 - DNA, 20 bp, Artificial
  CRISPR gRNA sequence
ctgcctcagcctccaagcag

SEQ ID NO: 121994 - DNA, 20 bp, Artificial
  CRISPR gRNA sequence
tgcctcagcctccaagcaga

SEQ ID NO: 121995 - DNA, 20 bp, Artificial
  CRISPR gRNA sequence
gcctcagcctccaagcagag

SEQ ID NO: 121996 - DNA, 20 bp, Artificial
  CRISPR gRNA sequence
cctccaagcagaggggatta

SEQ ID NO: 121997 - DNA, 20 bp, Artificial
  CRISPR gRNA sequence
ctccaagcagaggggattac

SEQ ID NO: 121998 - DNA, 20 bp, Artificial
  CRISPR gRNA sequence
caggtacacgccatgacgcc

SEQ ID NO: 121999 - DNA, 20 bp, Artificial
  CRISPR gRNA sequence
ccagctaatttttgtatttt

SEQ ID NO: 122000 - DNA, 20 bp, Artificial
  CRISPR gRNA sequence
gctaatttttgtatttttag

SEQ ID NO: 122001 - DNA, 20 bp, Artificial
  CRISPR gRNA sequence
taatttttgtatttttagta

SEQ ID NO: 122002 - DNA, 20 bp, Artificial
  CRISPR gRNA sequence
ttttgtatttttagtagaga

SEQ ID NO: 122003 - DNA, 20 bp, Artificial
  CRISPR gRNA sequence
tttgtatttttagtagagac

SEQ ID NO: 122004 - DNA, 20 bp, Artificial
  CRISPR gRNA sequence
ttgtatttttagtagagaca

SEQ ID NO: 122005 - DNA, 20 bp, Artificial
  CRISPR gRNA sequence
gagacagggtttcaccatgt

SEQ ID NO: 122006 - DNA, 20 bp, Artificial
  CRISPR gRNA sequence
cagggtttcaccatgttggc

SEQ ID NO: 122007 - DNA, 20 bp, Artificial
  CRISPR gRNA sequence
agggtttcaccatgttggcc

SEQ ID NO: 122008 - DNA, 20 bp, Artificial
  CRISPR gRNA sequence
tttcaccatgttggccaggc

SEQ ID NO: 122009 - DNA, 20 bp, Artificial
  CRISPR gRNA sequence
tggtcttgaactcctgacct

SEQ ID NO: 122010 - DNA, 20 bp, Artificial
  CRISPR gRNA sequence
ggtcttgaactcctgacctc

SEQ ID NO: 122011 - DNA, 20 bp, Artificial
  CRISPR gRNA sequence
ctcaggtgatccacccacct

SEQ ID NO: 122012 - DNA, 20 bp, Artificial
  CRISPR gRNA sequence
tccacccacctcggcctccc

SEQ ID NO: 122013 - DNA, 20 bp, Artificial
  CRISPR gRNA sequence
ccacccacctcggcctccca

SEQ ID NO: 122014 - DNA, 20 bp, Artificial
  CRISPR gRNA sequence
acctcggcctcccaaggtgc

SEQ ID NO: 122015 - DNA, 20 bp, Artificial
  CRISPR gRNA sequence
cctcggcctcccaaggtgct

SEQ ID NO: 122016 - DNA, 20 bp, Artificial
  CRISPR gRNA sequence
ctcccaaggtgctgggatta

SEQ ID NO: 122017 - DNA, 20 bp, Artificial
  CRISPR gRNA sequence
tcccaaggtgctgggattac

SEQ ID NO: 122018 - DNA, 20 bp, Artificial
  CRISPR gRNA sequence
ggtgctgggattacaggcat

SEQ ID NO: 122019 - DNA, 20 bp, Artificial
  CRISPR gRNA sequence
gggattacaggcatgagcca

SEQ ID NO: 122020 - DNA, 20 bp, Artificial
  CRISPR gRNA sequence
ggattacaggcatgagccat

SEQ ID NO: 122021 - DNA, 20 bp, Artificial
  CRISPR gRNA sequence
gattacaggcatgagccatg

SEQ ID NO: 122022 - DNA, 20 bp, Artificial
  CRISPR gRNA sequence
tcgatacaatcaaatttttt

SEQ ID NO: 122023 - DNA, 20 bp, Artificial
  CRISPR gRNA sequence
ttttaagcatttaaaataca

SEQ ID NO: 122024 - DNA, 20 bp, Artificial
  CRISPR gRNA sequence
tttaagcatttaaaatacaa

SEQ ID NO: 122025 - DNA, 20 bp, Artificial
  CRISPR gRNA sequence
attttgttgttgaccgtctg

SEQ ID NO: 122026 - DNA, 20 bp, Artificial
  CRISPR gRNA sequence
gttgaccgtctgtggttatt

SEQ ID NO: 122027 - DNA, 20 bp, Artificial
  CRISPR gRNA sequence
accgtctgtggttattaagc

SEQ ID NO: 122028 - DNA, 20 bp, Artificial
  CRISPR gRNA sequence
tctgtggttattaagccagc

SEQ ID NO: 122029 - DNA, 20 bp, Artificial
  CRISPR gRNA sequence
ttattaagccagctggtaac

SEQ ID NO: 122030 - DNA, 20 bp, Artificial
  CRISPR gRNA sequence
taagccagctggtaactggt

SEQ ID NO: 122031 - DNA, 20 bp, Artificial
  CRISPR gRNA sequence
gctggtaactggttagctaa

SEQ ID NO: 122032 - DNA, 20 bp, Artificial
  CRISPR gRNA sequence
ttagctaaaagaaaaaaaat

SEQ ID NO: 122033 - DNA, 20 bp, Artificial
  CRISPR gRNA sequence
aaaagaaaaaaaattagtta

SEQ ID NO: 122034 - DNA, 20 bp, Artificial
  CRISPR gRNA sequence
aagaaaaaaaattagttaaa

SEQ ID NO: 122035 - DNA, 20 bp, Artificial
  CRISPR gRNA sequence
agaaaaaaaattagttaaag

SEQ ID NO: 122036 - DNA, 20 bp, Artificial
  CRISPR gRNA sequence
gaaaaaaaattagttaaaga

SEQ ID NO: 122037 - DNA, 20 bp, Artificial
  CRISPR gRNA sequence
atgaactatatctactttct

SEQ ID NO: 122038 - DNA, 20 bp, Artificial
  CRISPR gRNA sequence
tgaactatatctactttctt

SEQ ID NO: 122039 - DNA, 20 bp, Artificial
  CRISPR gRNA sequence
actttcttgggttgtatctt

SEQ ID NO: 122040 - DNA, 20 bp, Artificial
  CRISPR gRNA sequence
ctttcttgggttgtatctta

SEQ ID NO: 122041 - DNA, 20 bp, Artificial
  CRISPR gRNA sequence
tgtctcattacaattctgcc

SEQ ID NO: 122042 - DNA, 20 bp, Artificial
  CRISPR gRNA sequence
tctgcccggtatcaatgatg

SEQ ID NO: 122043 - DNA, 20 bp, Artificial
  CRISPR gRNA sequence
cggtatcaatgatgtagtct

SEQ ID NO: 122044 - DNA, 20 bp, Artificial
  CRISPR gRNA sequence
cctatctctaacatgtacct

SEQ ID NO: 122045 - DNA, 20 bp, Artificial
  CRISPR gRNA sequence
tgcccatgtgtacaaatctg

SEQ ID NO: 122046 - DNA, 20 bp, Artificial
  CRISPR gRNA sequence
catgtgtacaaatctgtaga

SEQ ID NO: 122047 - DNA, 20 bp, Artificial
  CRISPR gRNA sequence
gtacaaatctgtagacagac

SEQ ID NO: 122048 - DNA, 20 bp, Artificial
  CRISPR gRNA sequence
atctgtagacagactggatg

SEQ ID NO: 122049 - DNA, 20 bp, Artificial
  CRISPR gRNA sequence
attaaactacactacaccat

SEQ ID NO: 122050 - DNA, 20 bp, Artificial
  CRISPR gRNA sequence
ttaaactacactacaccatg

SEQ ID NO: 122051 - DNA, 20 bp, Artificial
  CRISPR gRNA sequence
ctacactacaccatgaggtt

SEQ ID NO: 122052 - DNA, 20 bp, Artificial
  CRISPR gRNA sequence
actacaccatgaggtttggc

SEQ ID NO: 122053 - DNA, 20 bp, Artificial
  CRISPR gRNA sequence
ctacaccatgaggtttggct

SEQ ID NO: 122054 - DNA, 20 bp, Artificial
  CRISPR gRNA sequence
acaccatgaggtttggctag

SEQ ID NO: 122055 - DNA, 20 bp, Artificial
  CRISPR gRNA sequence
gctaggagcaacatataact

SEQ ID NO: 122056 - DNA, 20 bp, Artificial
  CRISPR gRNA sequence
aggagcaacatataactgag

SEQ ID NO: 122057 - DNA, 20 bp, Artificial
  CRISPR gRNA sequence
acatataactgagcagcata

SEQ ID NO: 122058 - DNA, 20 bp, Artificial
  CRISPR gRNA sequence
gcagcatatagtttacatat

SEQ ID NO: 122059 - DNA, 20 bp, Artificial
  CRISPR gRNA sequence
atatgagaaatatatataat

SEQ ID NO: 122060 - DNA, 20 bp, Artificial
  CRISPR gRNA sequence
aatgagaaatttactcaaca

SEQ ID NO: 122061 - DNA, 20 bp, Artificial
  CRISPR gRNA sequence
tactcaatttaaaaaaaact

SEQ ID NO: 122062 - DNA, 20 bp, Artificial
  CRISPR gRNA sequence
ttgaaatttatttaaatcat

SEQ ID NO: 122063 - DNA, 20 bp, Artificial
  CRISPR gRNA sequence
tatgaatcttcaccaaaaac

SEQ ID NO: 122064 - DNA, 20 bp, Artificial
  CRISPR gRNA sequence
atgaatcttcaccaaaaact

SEQ ID NO: 122065 - DNA, 20 bp, Artificial
  CRISPR gRNA sequence
tgaatcttcaccaaaaacta

SEQ ID NO: 122066 - DNA, 20 bp, Artificial
  CRISPR gRNA sequence
gaatcttcaccaaaaactag

SEQ ID NO: 122067 - DNA, 20 bp, Artificial
  CRISPR gRNA sequence
tcaccaaaaactaggggcta

SEQ ID NO: 122068 - DNA, 20 bp, Artificial
  CRISPR gRNA sequence
aaactaggggctacagaact

SEQ ID NO: 122069 - DNA, 20 bp, Artificial
  CRISPR gRNA sequence
taggggctacagaactcagt

SEQ ID NO: 122070 - DNA, 20 bp, Artificial
  CRISPR gRNA sequence
cagaactcagtcagaactat

SEQ ID NO: 122071 - DNA, 20 bp, Artificial
  CRISPR gRNA sequence
tcagtcagaactatcagtga

SEQ ID NO: 122072 - DNA, 20 bp, Artificial
  CRISPR gRNA sequence
cagtcagaactatcagtgaa

SEQ ID NO: 122073 - DNA, 20 bp, Artificial
  CRISPR gRNA sequence
gtgaaaggttataatgtcta

SEQ ID NO: 122074 - DNA, 20 bp, Artificial
  CRISPR gRNA sequence
cactcactgacttcaaataa

SEQ ID NO: 122075 - DNA, 20 bp, Artificial
  CRISPR gRNA sequence
actcactgacttcaaataaa

SEQ ID NO: 122076 - DNA, 20 bp, Artificial
  CRISPR gRNA sequence
ctcactgacttcaaataaaa

SEQ ID NO: 122077 - DNA, 20 bp, Artificial
  CRISPR gRNA sequence
ataaaagggcatgaactgat

SEQ ID NO: 122078 - DNA, 20 bp, Artificial
  CRISPR gRNA sequence
ctgataagaactatttaaaa

SEQ ID NO: 122079 - DNA, 20 bp, Artificial
  CRISPR gRNA sequence
tgacattccaaaaataccat

SEQ ID NO: 122080 - DNA, 20 bp, Artificial
  CRISPR gRNA sequence
caaaaataccattagatact

SEQ ID NO: 122081 - DNA, 20 bp, Artificial
  CRISPR gRNA sequence
ttactaaatgcctcctctgt

SEQ ID NO: 122082 - DNA, 20 bp, Artificial
  CRISPR gRNA sequence
tcctctgtaagctcttcact

SEQ ID NO: 122083 - DNA, 20 bp, Artificial
  CRISPR gRNA sequence
ctcttcacttagtccatctg

SEQ ID NO: 122084 - DNA, 20 bp, Artificial
  CRISPR gRNA sequence
aattcccttttctcctttca

SEQ ID NO: 122085 - DNA, 20 bp, Artificial
  CRISPR gRNA sequence
cttttctcctttcatagcct

SEQ ID NO: 122086 - DNA, 20 bp, Artificial
  CRISPR gRNA sequence
ttttctcctttcatagcctg

SEQ ID NO: 122087 - DNA, 20 bp, Artificial
  CRISPR gRNA sequence
tctcctttcatagcctgagg

SEQ ID NO: 122088 - DNA, 20 bp, Artificial
  CRISPR gRNA sequence
ctcctttcatagcctgagga

SEQ ID NO: 122089 - DNA, 20 bp, Artificial
  CRISPR gRNA sequence
cctgaggaaggaaaaaaaaa

SEQ ID NO: 122090 - DNA, 20 bp, Artificial
  CRISPR gRNA sequence
gcttacttattgcctaaaat

SEQ ID NO: 122091 - DNA, 20 bp, Artificial
  CRISPR gRNA sequence
cttacttattgcctaaaatt

SEQ ID NO: 122092 - DNA, 20 bp, Artificial
  CRISPR gRNA sequence
tacttattgcctaaaattag

SEQ ID NO: 122093 - DNA, 20 bp, Artificial
  CRISPR gRNA sequence
cttctattattacaaactct

SEQ ID NO: 122094 - DNA, 20 bp, Artificial
  CRISPR gRNA sequence
ctattattacaaactctaag

SEQ ID NO: 122095 - DNA, 20 bp, Artificial
  CRISPR gRNA sequence
attattacaaactctaagca

SEQ ID NO: 122096 - DNA, 20 bp, Artificial
  CRISPR gRNA sequence
agagtatttattaacacttc

SEQ ID NO: 122097 - DNA, 20 bp, Artificial
  CRISPR gRNA sequence
cttctggttaattacatatg

SEQ ID NO: 122098 - DNA, 20 bp, Artificial
  CRISPR gRNA sequence
ctggttaattacatatgaag

SEQ ID NO: 122099 - DNA, 20 bp, Artificial
  CRISPR gRNA sequence
tggttaattacatatgaaga

SEQ ID NO: 122100 - DNA, 20 bp, Artificial
  CRISPR gRNA sequence
ttacatatgaagaaggcttt

SEQ ID NO: 122101 - DNA, 20 bp, Artificial
  CRISPR gRNA sequence
catatgaagaaggctttcag

SEQ ID NO: 122102 - DNA, 20 bp, Artificial
  CRISPR gRNA sequence
atatgaagaaggctttcaga

SEQ ID NO: 122103 - DNA, 20 bp, Artificial
  CRISPR gRNA sequence
agaaggctaacttttaatat

SEQ ID NO: 122104 - DNA, 20 bp, Artificial
  CRISPR gRNA sequence
tataagctgtaatcattaac

SEQ ID NO: 122105 - DNA, 20 bp, Artificial
  CRISPR gRNA sequence
agctgtaatcattaacaaga

SEQ ID NO: 122106 - DNA, 20 bp, Artificial
  CRISPR gRNA sequence
ctgtaatcattaacaagaca

SEQ ID NO: 122107 - DNA, 20 bp, Artificial
  CRISPR gRNA sequence
aatcattaacaagacagagt

SEQ ID NO: 122108 - DNA, 20 bp, Artificial
  CRISPR gRNA sequence
agacagagttagtaatgacc

SEQ ID NO: 122109 - DNA, 20 bp, Artificial
  CRISPR gRNA sequence
agagttagtaatgacctaga

SEQ ID NO: 122110 - DNA, 20 bp, Artificial
  CRISPR gRNA sequence
tagtaatgacctagaaagca

SEQ ID NO: 122111 - DNA, 20 bp, Artificial
  CRISPR gRNA sequence
cctagaaagcaaagtattta

SEQ ID NO: 122112 - DNA, 20 bp, Artificial
  CRISPR gRNA sequence
tctaattccacatcatatca

SEQ ID NO: 122113 - DNA, 20 bp, Artificial
  CRISPR gRNA sequence
ctaattccacatcatatcaa

SEQ ID NO: 122114 - DNA, 20 bp, Artificial
  CRISPR gRNA sequence
taattccacatcatatcaaa

SEQ ID NO: 122115 - DNA, 20 bp, Artificial
  CRISPR gRNA sequence
aattccacatcatatcaaag

SEQ ID NO: 122116 - DNA, 20 bp, Artificial
  CRISPR gRNA sequence
caaaggggtaactctactta

SEQ ID NO: 122117 - DNA, 20 bp, Artificial
  CRISPR gRNA sequence
ggtaactctacttacagatg

SEQ ID NO: 122118 - DNA, 20 bp, Artificial
  CRISPR gRNA sequence
aactctacttacagatgaag

SEQ ID NO: 122119 - DNA, 20 bp, Artificial
  CRISPR gRNA sequence
tgcaaaacaccaccaatatt

SEQ ID NO: 122120 - DNA, 20 bp, Artificial
  CRISPR gRNA sequence
tataaatctacaaatgatcc

SEQ ID NO: 122121 - DNA, 20 bp, Artificial
  CRISPR gRNA sequence
aatgatccaagtgatcactt

SEQ ID NO: 122122 - DNA, 20 bp, Artificial
  CRISPR gRNA sequence
ttaagtatatatatgtctct

SEQ ID NO: 122123 - DNA, 20 bp, Artificial
  CRISPR gRNA sequence
atatatgtctctcagccaac

SEQ ID NO: 122124 - DNA, 20 bp, Artificial
  CRISPR gRNA sequence
tatatgtctctcagccaact

SEQ ID NO: 122125 - DNA, 20 bp, Artificial
  CRISPR gRNA sequence
atgtctctcagccaactggg

SEQ ID NO: 122126 - DNA, 20 bp, Artificial
  CRISPR gRNA sequence
cagccaactgggcagtactg

SEQ ID NO: 122127 - DNA, 20 bp, Artificial
  CRISPR gRNA sequence
caactgggcagtactgtagc

SEQ ID NO: 122128 - DNA, 20 bp, Artificial
  CRISPR gRNA sequence
gggcagtactgtagcaagct

SEQ ID NO: 122129 - DNA, 20 bp, Artificial
  CRISPR gRNA sequence
gcagtactgtagcaagctga

SEQ ID NO: 122130 - DNA, 20 bp, Artificial
  CRISPR gRNA sequence
taaaaattcctaaattaatt

SEQ ID NO: 122131 - DNA, 20 bp, Artificial
  CRISPR gRNA sequence
ttaatttggccaaatacttc

SEQ ID NO: 122132 - DNA, 20 bp, Artificial
  CRISPR gRNA sequence
taatttggccaaatacttct

SEQ ID NO: 122133 - DNA, 20 bp, Artificial
  CRISPR gRNA sequence
tctaggttcctatgatactg

SEQ ID NO: 122134 - DNA, 20 bp, Artificial
  CRISPR gRNA sequence
aagatctgtaaaaataatgt

SEQ ID NO: 122135 - DNA, 20 bp, Artificial
  CRISPR gRNA sequence
agatctgtaaaaataatgtc

SEQ ID NO: 122136 - DNA, 20 bp, Artificial
  CRISPR gRNA sequence
tgcaaatatcactaatttaa

SEQ ID NO: 122137 - DNA, 20 bp, Artificial
  CRISPR gRNA sequence
gcaaatatcactaatttaat

SEQ ID NO: 122138 - DNA, 20 bp, Artificial
  CRISPR gRNA sequence
ttaatgggattcaaacacta

SEQ ID NO: 122139 - DNA, 20 bp, Artificial
  CRISPR gRNA sequence
attcaaacactaaagatatt

SEQ ID NO: 122140 - DNA, 20 bp, Artificial
  CRISPR gRNA sequence
atattaagaatatattttga

SEQ ID NO: 122141 - DNA, 20 bp, Artificial
  CRISPR gRNA sequence
gtaatgtgaatctgacacct

SEQ ID NO: 122142 - DNA, 20 bp, Artificial
  CRISPR gRNA sequence
tgtgaatctgacacctaagc

SEQ ID NO: 122143 - DNA, 20 bp, Artificial
  CRISPR gRNA sequence
ctgacacctaagctggcatg

SEQ ID NO: 122144 - DNA, 20 bp, Artificial
  CRISPR gRNA sequence
tttcacaaaatccattccta

SEQ ID NO: 122145 - DNA, 20 bp, Artificial
  CRISPR gRNA sequence
ttcacaaaatccattcctac

SEQ ID NO: 122146 - DNA, 20 bp, Artificial
  CRISPR gRNA sequence
aaaatccattcctacaggca

SEQ ID NO: 122147 - DNA, 20 bp, Artificial
  CRISPR gRNA sequence
ctacaggcaaagataaacct

SEQ ID NO: 122148 - DNA, 20 bp, Artificial
  CRISPR gRNA sequence
aaagataaacctaagaaata

SEQ ID NO: 122149 - DNA, 20 bp, Artificial
  CRISPR gRNA sequence
gataaacctaagaaatatag

SEQ ID NO: 122150 - DNA, 20 bp, Artificial
  CRISPR gRNA sequence
agaagaattcaatcaataat

SEQ ID NO: 122151 - DNA, 20 bp, Artificial
  CRISPR gRNA sequence
ttcctctttttattatctaa

SEQ ID NO: 122152 - DNA, 20 bp, Artificial
  CRISPR gRNA sequence
tacttctttgaaattaacaa

SEQ ID NO: 122153 - DNA, 20 bp, Artificial
  CRISPR gRNA sequence
ttctttgaaattaacaatag

SEQ ID NO: 122154 - DNA, 20 bp, Artificial
  CRISPR gRNA sequence
ttgaaattaacaatagcagc

SEQ ID NO: 122155 - DNA, 20 bp, Artificial
  CRISPR gRNA sequence
aaattaacaatagcagcaag

SEQ ID NO: 122156 - DNA, 20 bp, Artificial
  CRISPR gRNA sequence
cagcaagaagtaacattaat

SEQ ID NO: 122157 - DNA, 20 bp, Artificial
  CRISPR gRNA sequence
aatgagcactgaacattatt

SEQ ID NO: 122158 - DNA, 20 bp, Artificial
  CRISPR gRNA sequence
ccatccataattctatgata

SEQ ID NO: 122159 - DNA, 20 bp, Artificial
  CRISPR gRNA sequence
catccataattctatgatat

SEQ ID NO: 122160 - DNA, 20 bp, Artificial
  CRISPR gRNA sequence
ttctatgatataggtactat

SEQ ID NO: 122161 - DNA, 20 bp, Artificial
  CRISPR gRNA sequence
gtactattagcctcatttta

SEQ ID NO: 122162 - DNA, 20 bp, Artificial
  CRISPR gRNA sequence
attagcctcattttacagat

SEQ ID NO: 122163 - DNA, 20 bp, Artificial
  CRISPR gRNA sequence
ttagcctcattttacagatg

SEQ ID NO: 122164 - DNA, 20 bp, Artificial
  CRISPR gRNA sequence
attttacagatgaggaaacc

SEQ ID NO: 122165 - DNA, 20 bp, Artificial
  CRISPR gRNA sequence
ttttacagatgaggaaacca

SEQ ID NO: 122166 - DNA, 20 bp, Artificial
  CRISPR gRNA sequence
gatgaggaaaccaaggccta

SEQ ID NO: 122167 - DNA, 20 bp, Artificial
  CRISPR gRNA sequence
agtaattaaataatctgtcc

SEQ ID NO: 122168 - DNA, 20 bp, Artificial
  CRISPR gRNA sequence
gtaattaaataatctgtcca

SEQ ID NO: 122169 - DNA, 20 bp, Artificial
  CRISPR gRNA sequence
aaataatctgtccaaggcca

SEQ ID NO: 122170 - DNA, 20 bp, Artificial
  CRISPR gRNA sequence
aaggccacagaatttgcatg

SEQ ID NO: 122171 - DNA, 20 bp, Artificial
  CRISPR gRNA sequence
gccacagaatttgcatgtgg

SEQ ID NO: 122172 - DNA, 20 bp, Artificial
  CRISPR gRNA sequence
cacagaatttgcatgtggca

SEQ ID NO: 122173 - DNA, 20 bp, Artificial
  CRISPR gRNA sequence
gaatttgcatgtggcagagc

SEQ ID NO: 122174 - DNA, 20 bp, Artificial
  CRISPR gRNA sequence
aatttgcatgtggcagagct

SEQ ID NO: 122175 - DNA, 20 bp, Artificial
  CRISPR gRNA sequence
catgtggcagagctgggatt

SEQ ID NO: 122176 - DNA, 20 bp, Artificial
  CRISPR gRNA sequence
agagctgggattcagcctcc

SEQ ID NO: 122177 - DNA, 20 bp, Artificial
  CRISPR gRNA sequence
gctgggattcagcctcctgg

SEQ ID NO: 122178 - DNA, 20 bp, Artificial
  CRISPR gRNA sequence
ctcctggtagtctgaataca

SEQ ID NO: 122179 - DNA, 20 bp, Artificial
  CRISPR gRNA sequence
atcattatataactatgcta

SEQ ID NO: 122180 - DNA, 20 bp, Artificial
  CRISPR gRNA sequence
ttatataactatgctatagt

SEQ ID NO: 122181 - DNA, 20 bp, Artificial
  CRISPR gRNA sequence
gctatagttagtaataaaca

SEQ ID NO: 122182 - DNA, 20 bp, Artificial
  CRISPR gRNA sequence
ctatagttagtaataaacaa

SEQ ID NO: 122183 - DNA, 20 bp, Artificial
  CRISPR gRNA sequence
tatagttagtaataaacaaa

SEQ ID NO: 122184 - DNA, 20 bp, Artificial
  CRISPR gRNA sequence
tagtaataaacaaagggaaa

SEQ ID NO: 122185 - DNA, 20 bp, Artificial
  CRISPR gRNA sequence
aataaacaaagggaaaaaga

SEQ ID NO: 122186 - DNA, 20 bp, Artificial
  CRISPR gRNA sequence
ataaacaaagggaaaaagaa

SEQ ID NO: 122187 - DNA, 20 bp, Artificial
  CRISPR gRNA sequence
aaagaaaggactttctattt

SEQ ID NO: 122188 - DNA, 20 bp, Artificial
  CRISPR gRNA sequence
ctatttaagtactgtaatat

SEQ ID NO: 122189 - DNA, 20 bp, Artificial
  CRISPR gRNA sequence
ttaagtactgtaatataagt

SEQ ID NO: 122190 - DNA, 20 bp, Artificial
  CRISPR gRNA sequence
agtcagtgatccccaacccc

SEQ ID NO: 122191 - DNA, 20 bp, Artificial
  CRISPR gRNA sequence
gtcagtgatccccaaccccc

SEQ ID NO: 122192 - DNA, 20 bp, Artificial
  CRISPR gRNA sequence
gatccccaacccccaggctg

SEQ ID NO: 122193 - DNA, 20 bp, Artificial
  CRISPR gRNA sequence
cccccaggctgcagactgat

SEQ ID NO: 122194 - DNA, 20 bp, Artificial
  CRISPR gRNA sequence
tgcagactgatgagtgtccg

SEQ ID NO: 122195 - DNA, 20 bp, Artificial
  CRISPR gRNA sequence
atgagtgtccgtggcctgtt

SEQ ID NO: 122196 - DNA, 20 bp, Artificial
  CRISPR gRNA sequence
tccgtggcctgttaagaacc

SEQ ID NO: 122197 - DNA, 20 bp, Artificial
  CRISPR gRNA sequence
ctgttaagaacccagccaca

SEQ ID NO: 122198 - DNA, 20 bp, Artificial
  CRISPR gRNA sequence
ttaagaacccagccacacag

SEQ ID NO: 122199 - DNA, 20 bp, Artificial
  CRISPR gRNA sequence
taagaacccagccacacagc

SEQ ID NO: 122200 - DNA, 20 bp, Artificial
  CRISPR gRNA sequence
agaacccagccacacagcag

SEQ ID NO: 122201 - DNA, 20 bp, Artificial
  CRISPR gRNA sequence
gaacccagccacacagcagg

SEQ ID NO: 122202 - DNA, 20 bp, Artificial
  CRISPR gRNA sequence
ccagccacacagcaggaggt

SEQ ID NO: 122203 - DNA, 20 bp, Artificial
  CRISPR gRNA sequence
cagccacacagcaggaggtg

SEQ ID NO: 122204 - DNA, 20 bp, Artificial
  CRISPR gRNA sequence
agccacacagcaggaggtga

SEQ ID NO: 122205 - DNA, 20 bp, Artificial
  CRISPR gRNA sequence
cacagcaggaggtgagggtc

SEQ ID NO: 122206 - DNA, 20 bp, Artificial
  CRISPR gRNA sequence
gaggtgagggtctggtaatc

SEQ ID NO: 122207 - DNA, 20 bp, Artificial
  CRISPR gRNA sequence
gtaatccagcattaccacct

SEQ ID NO: 122208 - DNA, 20 bp, Artificial
  CRISPR gRNA sequence
taccacctgagctccgcctt

SEQ ID NO: 122209 - DNA, 20 bp, Artificial
  CRISPR gRNA sequence
acctgagctccgccttcggt

SEQ ID NO: 122210 - DNA, 20 bp, Artificial
  CRISPR gRNA sequence
agctccgccttcggtcagat

SEQ ID NO: 122211 - DNA, 20 bp, Artificial
  CRISPR gRNA sequence
tccgccttcggtcagatcag

SEQ ID NO: 122212 - DNA, 20 bp, Artificial
  CRISPR gRNA sequence
ggtcagatcagcggccacgt

SEQ ID NO: 122213 - DNA, 20 bp, Artificial
  CRISPR gRNA sequence
gcggccacgtgagattctca

SEQ ID NO: 122214 - DNA, 20 bp, Artificial
  CRISPR gRNA sequence
cggccacgtgagattctcat

SEQ ID NO: 122215 - DNA, 20 bp, Artificial
  CRISPR gRNA sequence
cgtgagattctcataggcgc

SEQ ID NO: 122216 - DNA, 20 bp, Artificial
  CRISPR gRNA sequence
ctattgtgaactgcgcatgc

SEQ ID NO: 122217 - DNA, 20 bp, Artificial
  CRISPR gRNA sequence
tattgtgaactgcgcatgca

SEQ ID NO: 122218 - DNA, 20 bp, Artificial
  CRISPR gRNA sequence
attgtgaactgcgcatgcaa

SEQ ID NO: 122219 - DNA, 20 bp, Artificial
  CRISPR gRNA sequence
aactgcgcatgcaagggatc

SEQ ID NO: 122220 - DNA, 20 bp, Artificial
  CRISPR gRNA sequence
actgcgcatgcaagggatct

SEQ ID NO: 122221 - DNA, 20 bp, Artificial
  CRISPR gRNA sequence
ctaggctgtgcgttccttat

SEQ ID NO: 122222 - DNA, 20 bp, Artificial
  CRISPR gRNA sequence
taactaatgcctgatgatct

SEQ ID NO: 122223 - DNA, 20 bp, Artificial
  CRISPR gRNA sequence
aactaatgcctgatgatctg

SEQ ID NO: 122224 - DNA, 20 bp, Artificial
  CRISPR gRNA sequence
taatgcctgatgatctgagg

SEQ ID NO: 122225 - DNA, 20 bp, Artificial
  CRISPR gRNA sequence
cctgatgatctgaggtggaa

SEQ ID NO: 122226 - DNA, 20 bp, Artificial
  CRISPR gRNA sequence
ggtggaacagtttcatcctg

SEQ ID NO: 122227 - DNA, 20 bp, Artificial
  CRISPR gRNA sequence
tcgcacccctcccctgaccc

SEQ ID NO: 122228 - DNA, 20 bp, Artificial
  CRISPR gRNA sequence
gcacccctcccctgacccca

SEQ ID NO: 122229 - DNA, 20 bp, Artificial
  CRISPR gRNA sequence
cctcccctgaccccagagcg

SEQ ID NO: 122230 - DNA, 20 bp, Artificial
  CRISPR gRNA sequence
aaaaattgctttccacaaaa

SEQ ID NO: 122231 - DNA, 20 bp, Artificial
  CRISPR gRNA sequence
aaaattgctttccacaaaac

SEQ ID NO: 122232 - DNA, 20 bp, Artificial
  CRISPR gRNA sequence
ctttccacaaaacaggtccc

SEQ ID NO: 122233 - DNA, 20 bp, Artificial
  CRISPR gRNA sequence
tccctggtgccaaaaatgtt

SEQ ID NO: 122234 - DNA, 20 bp, Artificial
  CRISPR gRNA sequence
ccctggtgccaaaaatgttg

SEQ ID NO: 122235 - DNA, 20 bp, Artificial
  CRISPR gRNA sequence
atgttgaggactgctgatat

SEQ ID NO: 122236 - DNA, 20 bp, Artificial
  CRISPR gRNA sequence
ataagcaattaaatacttct

SEQ ID NO: 122237 - DNA, 20 bp, Artificial
  CRISPR gRNA sequence
acaaaatgaatttttaaaac

SEQ ID NO: 122238 - DNA, 20 bp, Artificial
  CRISPR gRNA sequence
aaacaagtaatacatttaca

SEQ ID NO: 122239 - DNA, 20 bp, Artificial
  CRISPR gRNA sequence
aatgtctcttattttcttaa

SEQ ID NO: 122240 - DNA, 20 bp, Artificial
  CRISPR gRNA sequence
ttattttcttaaaagcacaa

SEQ ID NO: 122241 - DNA, 20 bp, Artificial
  CRISPR gRNA sequence
tattttcttaaaagcacaat

SEQ ID NO: 122242 - DNA, 20 bp, Artificial
  CRISPR gRNA sequence
attttcttaaaagcacaatg

SEQ ID NO: 122243 - DNA, 20 bp, Artificial
  CRISPR gRNA sequence
ttttcttaaaagcacaatgg

SEQ ID NO: 122244 - DNA, 20 bp, Artificial
  CRISPR gRNA sequence
cttaaaagcacaatgggggc

SEQ ID NO: 122245 - DNA, 20 bp, Artificial
  CRISPR gRNA sequence
ttaaaagcacaatgggggcc

SEQ ID NO: 122246 - DNA, 20 bp, Artificial
  CRISPR gRNA sequence
agcacaatgggggccgggca

SEQ ID NO: 122247 - DNA, 20 bp, Artificial
  CRISPR gRNA sequence
acaatgggggccgggcatgg

SEQ ID NO: 122248 - DNA, 20 bp, Artificial
  CRISPR gRNA sequence
gtggctcacacctgtaatcc

SEQ ID NO: 122249 - DNA, 20 bp, Artificial
  CRISPR gRNA sequence
cacctgtaatcccagcactt

SEQ ID NO: 122250 - DNA, 20 bp, Artificial
  CRISPR gRNA sequence
acctgtaatcccagcacttt

SEQ ID NO: 122251 - DNA, 20 bp, Artificial
  CRISPR gRNA sequence
ctgtaatcccagcactttgg

SEQ ID NO: 122252 - DNA, 20 bp, Artificial
  CRISPR gRNA sequence
tgtaatcccagcactttggg

SEQ ID NO: 122253 - DNA, 20 bp, Artificial
  CRISPR gRNA sequence
tcccagcactttgggaggcc

SEQ ID NO: 122254 - DNA, 20 bp, Artificial
  CRISPR gRNA sequence
cccagcactttgggaggccg

SEQ ID NO: 122255 - DNA, 20 bp, Artificial
  CRISPR gRNA sequence
agcactttgggaggccgagg

SEQ ID NO: 122256 - DNA, 20 bp, Artificial
  CRISPR gRNA sequence
gcactttgggaggccgaggc

SEQ ID NO: 122257 - DNA, 20 bp, Artificial
  CRISPR gRNA sequence
ctttgggaggccgaggcagg

SEQ ID NO: 122258 - DNA, 20 bp, Artificial
  CRISPR gRNA sequence
ccgaggcaggtggatcacct

SEQ ID NO: 122259 - DNA, 20 bp, Artificial
  CRISPR gRNA sequence
cgaggcaggtggatcacctg

SEQ ID NO: 122260 - DNA, 20 bp, Artificial
  CRISPR gRNA sequence
gcaggtggatcacctgaggt

SEQ ID NO: 122261 - DNA, 20 bp, Artificial
  CRISPR gRNA sequence
caggtggatcacctgaggtc

SEQ ID NO: 122262 - DNA, 20 bp, Artificial
  CRISPR gRNA sequence
ggtggatcacctgaggtcag

SEQ ID NO: 122263 - DNA, 20 bp, Artificial
  CRISPR gRNA sequence
tcacctgaggtcaggagttt

SEQ ID NO: 122264 - DNA, 20 bp, Artificial
  CRISPR gRNA sequence
tgaggtcaggagtttgagac

SEQ ID NO: 122265 - DNA, 20 bp, Artificial
  CRISPR gRNA sequence
tcaggagtttgagaccagcc

SEQ ID NO: 122266 - DNA, 20 bp, Artificial
  CRISPR gRNA sequence
tgagaccagcctggccaaca

SEQ ID NO: 122267 - DNA, 20 bp, Artificial
  CRISPR gRNA sequence
tctactaaaaatacaaaact

SEQ ID NO: 122268 - DNA, 20 bp, Artificial
  CRISPR gRNA sequence
ctaaaaatacaaaacttagc

SEQ ID NO: 122269 - DNA, 20 bp, Artificial
  CRISPR gRNA sequence
taaaaatacaaaacttagcc

SEQ ID NO: 122270 - DNA, 20 bp, Artificial
  CRISPR gRNA sequence
atacaaaacttagccaggca

SEQ ID NO: 122271 - DNA, 20 bp, Artificial
  CRISPR gRNA sequence
caaaacttagccaggcatgg

SEQ ID NO: 122272 - DNA, 20 bp, Artificial
  CRISPR gRNA sequence
gtggtgcacgcctgtaatcc

SEQ ID NO: 122273 - DNA, 20 bp, Artificial
  CRISPR gRNA sequence
cgcctgtaatcccagctact

SEQ ID NO: 122274 - DNA, 20 bp, Artificial
  CRISPR gRNA sequence
gcctgtaatcccagctactc

SEQ ID NO: 122275 - DNA, 20 bp, Artificial
  CRISPR gRNA sequence
ctgtaatcccagctactcag

SEQ ID NO: 122276 - DNA, 20 bp, Artificial
  CRISPR gRNA sequence
tgtaatcccagctactcagg

SEQ ID NO: 122277 - DNA, 20 bp, Artificial
  CRISPR gRNA sequence
tcccagctactcaggaggct

SEQ ID NO: 122278 - DNA, 20 bp, Artificial
  CRISPR gRNA sequence
cccagctactcaggaggctg

SEQ ID NO: 122279 - DNA, 20 bp, Artificial
  CRISPR gRNA sequence
agctactcaggaggctgagg

SEQ ID NO: 122280 - DNA, 20 bp, Artificial
  CRISPR gRNA sequence
gctactcaggaggctgaggc

SEQ ID NO: 122281 - DNA, 20 bp, Artificial
  CRISPR gRNA sequence
tactcaggaggctgaggcag

SEQ ID NO: 122282 - DNA, 20 bp, Artificial
  CRISPR gRNA sequence
ctcaggaggctgaggcagga

SEQ ID NO: 122283 - DNA, 20 bp, Artificial
  CRISPR gRNA sequence
gcaggagagttgcttgaacc

SEQ ID NO: 122284 - DNA, 20 bp, Artificial
  CRISPR gRNA sequence
caggagagttgcttgaaccc

SEQ ID NO: 122285 - DNA, 20 bp, Artificial
  CRISPR gRNA sequence
ggagagttgcttgaacccag

SEQ ID NO: 122286 - DNA, 20 bp, Artificial
  CRISPR gRNA sequence
gagagttgcttgaacccagg

SEQ ID NO: 122287 - DNA, 20 bp, Artificial
  CRISPR gRNA sequence
agttgcttgaacccaggagg

SEQ ID NO: 122288 - DNA, 20 bp, Artificial
  CRISPR gRNA sequence
ttgcttgaacccaggaggca

SEQ ID NO: 122289 - DNA, 20 bp, Artificial
  CRISPR gRNA sequence
tgcttgaacccaggaggcag

SEQ ID NO: 122290 - DNA, 20 bp, Artificial
  CRISPR gRNA sequence
aacccaggaggcagaggttg

SEQ ID NO: 122291 - DNA, 20 bp, Artificial
  CRISPR gRNA sequence
caggaggcagaggttgcagt

SEQ ID NO: 122292 - DNA, 20 bp, Artificial
  CRISPR gRNA sequence
ggcagaggttgcagtgagcc

SEQ ID NO: 122293 - DNA, 20 bp, Artificial
  CRISPR gRNA sequence
gagatcttgccactgtactc

SEQ ID NO: 122294 - DNA, 20 bp, Artificial
  CRISPR gRNA sequence
cttgccactgtactccagcc

SEQ ID NO: 122295 - DNA, 20 bp, Artificial
  CRISPR gRNA sequence
ttgccactgtactccagcct

SEQ ID NO: 122296 - DNA, 20 bp, Artificial
  CRISPR gRNA sequence
ctgtactccagcctgggcaa

SEQ ID NO: 122297 - DNA, 20 bp, Artificial
  CRISPR gRNA sequence
gtactccagcctgggcaaca

SEQ ID NO: 122298 - DNA, 20 bp, Artificial
  CRISPR gRNA sequence
tactccacctcaaaaaaaaa

SEQ ID NO: 122299 - DNA, 20 bp, Artificial
  CRISPR gRNA sequence
tccacctcaaaaaaaaaaag

SEQ ID NO: 122300 - DNA, 20 bp, Artificial
  CRISPR gRNA sequence
aaaaaaaagaagaaaaaaaa

SEQ ID NO: 122301 - DNA, 20 bp, Artificial
  CRISPR gRNA sequence
gaagaaaaaaaaaagcacaa

SEQ ID NO: 122302 - DNA, 20 bp, Artificial
  CRISPR gRNA sequence
aagaaaaaaaaaagcacaat

SEQ ID NO: 122303 - DNA, 20 bp, Artificial
  CRISPR gRNA sequence
gaaaaaaaaaagcacaatgg

SEQ ID NO: 122304 - DNA, 20 bp, Artificial
  CRISPR gRNA sequence
tttacctctctgaatttctg

SEQ ID NO: 122305 - DNA, 20 bp, Artificial
  CRISPR gRNA sequence
ttacctctctgaatttctga

SEQ ID NO: 122306 - DNA, 20 bp, Artificial
  CRISPR gRNA sequence
aatttctgaaggtataattt

SEQ ID NO: 122307 - DNA, 20 bp, Artificial
  CRISPR gRNA sequence
tttctgaaggtataatttca

SEQ ID NO: 122308 - DNA, 20 bp, Artificial
  CRISPR gRNA sequence
ttctgaaggtataatttcag

SEQ ID NO: 122309 - DNA, 20 bp, Artificial
  CRISPR gRNA sequence
gaggttccacataactgtca

SEQ ID NO: 122310 - DNA, 20 bp, Artificial
  CRISPR gRNA sequence
cacataactgtcaaagccta

SEQ ID NO: 122311 - DNA, 20 bp, Artificial
  CRISPR gRNA sequence
ataactgtcaaagcctaaag

SEQ ID NO: 122312 - DNA, 20 bp, Artificial
  CRISPR gRNA sequence
gtcaaagcctaaagtagaca

SEQ ID NO: 122313 - DNA, 20 bp, Artificial
  CRISPR gRNA sequence
agcctaaagtagacatagca

SEQ ID NO: 122314 - DNA, 20 bp, Artificial
  CRISPR gRNA sequence
cctaaagtagacatagcaaa

SEQ ID NO: 122315 - DNA, 20 bp, Artificial
  CRISPR gRNA sequence
ttgttttccgtttctcttga

SEQ ID NO: 122316 - DNA, 20 bp, Artificial
  CRISPR gRNA sequence
atggcacctttcacttgctt

SEQ ID NO: 122317 - DNA, 20 bp, Artificial
  CRISPR gRNA sequence
acattcttgaacacattctt

SEQ ID NO: 122318 - DNA, 20 bp, Artificial
  CRISPR gRNA sequence
ttggcatcttttgcaatctg

SEQ ID NO: 122319 - DNA, 20 bp, Artificial
  CRISPR gRNA sequence
ggcatcttttgcaatctgaa

SEQ ID NO: 122320 - DNA, 20 bp, Artificial
  CRISPR gRNA sequence
gcaatctgaagagaaaatca

SEQ ID NO: 122321 - DNA, 20 bp, Artificial
  CRISPR gRNA sequence
caatctgaagagaaaatcat

SEQ ID NO: 122322 - DNA, 20 bp, Artificial
  CRISPR gRNA sequence
agaaaatcataggtaaatta

SEQ ID NO: 122323 - DNA, 20 bp, Artificial
  CRISPR gRNA sequence
ctaacaacctacaaaaatga

SEQ ID NO: 122324 - DNA, 20 bp, Artificial
  CRISPR gRNA sequence
tacaaaaatgaaagcctatt

SEQ ID NO: 122325 - DNA, 20 bp, Artificial
  CRISPR gRNA sequence
aaaaatgaaagcctattcag

SEQ ID NO: 122326 - DNA, 20 bp, Artificial
  CRISPR gRNA sequence
aacacaatgtgtgctatcaa

SEQ ID NO: 122327 - DNA, 20 bp, Artificial
  CRISPR gRNA sequence
gctatcaaaagtccacacct

SEQ ID NO: 122328 - DNA, 20 bp, Artificial
  CRISPR gRNA sequence
tatcaaaagtccacacctca

SEQ ID NO: 122329 - DNA, 20 bp, Artificial
  CRISPR gRNA sequence
aaaagtccacacctcagagt

SEQ ID NO: 122330 - DNA, 20 bp, Artificial
  CRISPR gRNA sequence
acacctcagagtcagaataa

SEQ ID NO: 122331 - DNA, 20 bp, Artificial
  CRISPR gRNA sequence
cagaataaaagctcaaatac

SEQ ID NO: 122332 - DNA, 20 bp, Artificial
  CRISPR gRNA sequence
ataaaagctcaaatacaagt

SEQ ID NO: 122333 - DNA, 20 bp, Artificial
  CRISPR gRNA sequence
aaaagctcaaatacaagtga

SEQ ID NO: 122334 - DNA, 20 bp, Artificial
  CRISPR gRNA sequence
agctcaaatacaagtgagag

SEQ ID NO: 122335 - DNA, 20 bp, Artificial
  CRISPR gRNA sequence
gaagccttgacaactattta

SEQ ID NO: 122336 - DNA, 20 bp, Artificial
  CRISPR gRNA sequence
ttacagaaacaaatctaatt

SEQ ID NO: 122337 - DNA, 20 bp, Artificial
  CRISPR gRNA sequence
caaatctaatttagatgtaa

SEQ ID NO: 122338 - DNA, 20 bp, Artificial
  CRISPR gRNA sequence
aatctaatttagatgtaaaa

SEQ ID NO: 122339 - DNA, 20 bp, Artificial
  CRISPR gRNA sequence
tttagatgtaaaagagtgcc

SEQ ID NO: 122340 - DNA, 20 bp, Artificial
  CRISPR gRNA sequence
agatgtaaaagagtgcctgg

SEQ ID NO: 122341 - DNA, 20 bp, Artificial
  CRISPR gRNA sequence
gatgtaaaagagtgcctggc

SEQ ID NO: 122342 - DNA, 20 bp, Artificial
  CRISPR gRNA sequence
atgtaaaagagtgcctggca

SEQ ID NO: 122343 - DNA, 20 bp, Artificial
  CRISPR gRNA sequence
gtgactcatgcctgtaatcc

SEQ ID NO: 122344 - DNA, 20 bp, Artificial
  CRISPR gRNA sequence
tgcctgtaatcccagcactt

SEQ ID NO: 122345 - DNA, 20 bp, Artificial
  CRISPR gRNA sequence
gcctgtaatcccagcacttt

SEQ ID NO: 122346 - DNA, 20 bp, Artificial
  CRISPR gRNA sequence
ctgtaatcccagcactttgg

SEQ ID NO: 122347 - DNA, 20 bp, Artificial
  CRISPR gRNA sequence
tgtaatcccagcactttggg

SEQ ID NO: 122348 - DNA, 20 bp, Artificial
  CRISPR gRNA sequence
tcccagcactttgggaggcc

SEQ ID NO: 122349 - DNA, 20 bp, Artificial
  CRISPR gRNA sequence
cccagcactttgggaggccg

SEQ ID NO: 122350 - DNA, 20 bp, Artificial
  CRISPR gRNA sequence
agcactttgggaggccgagg

SEQ ID NO: 122351 - DNA, 20 bp, Artificial
  CRISPR gRNA sequence
gcactttgggaggccgaggc

SEQ ID NO: 122352 - DNA, 20 bp, Artificial
  CRISPR gRNA sequence
ctttgggaggccgaggcggg

SEQ ID NO: 122353 - DNA, 20 bp, Artificial
  CRISPR gRNA sequence
ccgaggcgggcggatgacct

SEQ ID NO: 122354 - DNA, 20 bp, Artificial
  CRISPR gRNA sequence
cgaggcgggcggatgacctg

SEQ ID NO: 122355 - DNA, 20 bp, Artificial
  CRISPR gRNA sequence
gcgggcggatgacctgaggt

SEQ ID NO: 122356 - DNA, 20 bp, Artificial
  CRISPR gRNA sequence
cgggcggatgacctgaggtc

SEQ ID NO: 122357 - DNA, 20 bp, Artificial
  CRISPR gRNA sequence
ggcggatgacctgaggtcag

SEQ ID NO: 122358 - DNA, 20 bp, Artificial
  CRISPR gRNA sequence
tgacctgaggtcaggagttc

SEQ ID NO: 122359 - DNA, 20 bp, Artificial
  CRISPR gRNA sequence
tgaggtcaggagttcaagac

SEQ ID NO: 122360 - DNA, 20 bp, Artificial
  CRISPR gRNA sequence
tcaggagttcaagaccagcc

SEQ ID NO: 122361 - DNA, 20 bp, Artificial
  CRISPR gRNA sequence
caagaccagcctggccaaca

SEQ ID NO: 122362 - DNA, 20 bp, Artificial
  CRISPR gRNA sequence
cgaaaccccatctctactaa

SEQ ID NO: 122363 - DNA, 20 bp, Artificial
  CRISPR gRNA sequence
ctactaaaagtacaaaaaat

SEQ ID NO: 122364 - DNA, 20 bp, Artificial
  CRISPR gRNA sequence
taaaagtacaaaaaattagc

SEQ ID NO: 122365 - DNA, 20 bp, Artificial
  CRISPR gRNA sequence
aaaagtacaaaaaattagct

SEQ ID NO: 122366 - DNA, 20 bp, Artificial
  CRISPR gRNA sequence
tacaaaaaattagctgggcg

SEQ ID NO: 122367 - DNA, 20 bp, Artificial
  CRISPR gRNA sequence
aaaaaattagctgggcgtgg

SEQ ID NO: 122368 - DNA, 20 bp, Artificial
  CRISPR gRNA sequence
aaattagctgggcgtggtgg

SEQ ID NO: 122369 - DNA, 20 bp, Artificial
  CRISPR gRNA sequence
aattagctgggcgtggtggc

SEQ ID NO: 122370 - DNA, 20 bp, Artificial
  CRISPR gRNA sequence
tgcctgtaattgctgctact

SEQ ID NO: 122371 - DNA, 20 bp, Artificial
  CRISPR gRNA sequence
gcctgtaattgctgctactc

SEQ ID NO: 122372 - DNA, 20 bp, Artificial
  CRISPR gRNA sequence
ctgtaattgctgctactcag

SEQ ID NO: 122373 - DNA, 20 bp, Artificial
  CRISPR gRNA sequence
tgtaattgctgctactcagg

SEQ ID NO: 122374 - DNA, 20 bp, Artificial
  CRISPR gRNA sequence
ttgctgctactcaggaggat

SEQ ID NO: 122375 - DNA, 20 bp, Artificial
  CRISPR gRNA sequence
tgctgctactcaggaggatg

SEQ ID NO: 122376 - DNA, 20 bp, Artificial
  CRISPR gRNA sequence
tgctactcaggaggatgagg

SEQ ID NO: 122377 - DNA, 20 bp, Artificial
  CRISPR gRNA sequence
gctactcaggaggatgaggc

SEQ ID NO: 122378 - DNA, 20 bp, Artificial
  CRISPR gRNA sequence
tactcaggaggatgaggcag

SEQ ID NO: 122379 - DNA, 20 bp, Artificial
  CRISPR gRNA sequence
gcaggagaattgcttgaacc

SEQ ID NO: 122380 - DNA, 20 bp, Artificial
  CRISPR gRNA sequence
caggagaattgcttgaaccc

SEQ ID NO: 122381 - DNA, 20 bp, Artificial
  CRISPR gRNA sequence
ggagaattgcttgaacccag

SEQ ID NO: 122382 - DNA, 20 bp, Artificial
  CRISPR gRNA sequence
gagaattgcttgaacccagg

SEQ ID NO: 122383 - DNA, 20 bp, Artificial
  CRISPR gRNA sequence
aattgcttgaacccaggagg

SEQ ID NO: 122384 - DNA, 20 bp, Artificial
  CRISPR gRNA sequence
ttgcttgaacccaggaggcg

SEQ ID NO: 122385 - DNA, 20 bp, Artificial
  CRISPR gRNA sequence
tgcttgaacccaggaggcgg

SEQ ID NO: 122386 - DNA, 20 bp, Artificial
  CRISPR gRNA sequence
aacccaggaggcggaggttg

SEQ ID NO: 122387 - DNA, 20 bp, Artificial
  CRISPR gRNA sequence
caggaggcggaggttgcagt

SEQ ID NO: 122388 - DNA, 20 bp, Artificial
  CRISPR gRNA sequence
ggcggaggttgcagtgagcc

SEQ ID NO: 122389 - DNA, 20 bp, Artificial
  CRISPR gRNA sequence
ggttgcagtgagccgagatt

SEQ ID NO: 122390 - DNA, 20 bp, Artificial
  CRISPR gRNA sequence
gagattgagccactgtactc

SEQ ID NO: 122391 - DNA, 20 bp, Artificial
  CRISPR gRNA sequence
agattgagccactgtactcc

SEQ ID NO: 122392 - DNA, 20 bp, Artificial
  CRISPR gRNA sequence
gagccactgtactccaggcc

SEQ ID NO: 122393 - DNA, 20 bp, Artificial
  CRISPR gRNA sequence
agccactgtactccaggcct

SEQ ID NO: 122394 - DNA, 20 bp, Artificial
  CRISPR gRNA sequence
gtactccaggcctgggcaaa

SEQ ID NO: 122395 - DNA, 20 bp, Artificial
  CRISPR gRNA sequence
actccaggcctgggcaaaaa

SEQ ID NO: 122396 - DNA, 20 bp, Artificial
  CRISPR gRNA sequence
caggcctgggcaaaaagagc

SEQ ID NO: 122397 - DNA, 20 bp, Artificial
  CRISPR gRNA sequence
aaaattaaaaaaattttaaa

SEQ ID NO: 122398 - DNA, 20 bp, Artificial
  CRISPR gRNA sequence
aattttaaaaagatataaaa

SEQ ID NO: 122399 - DNA, 20 bp, Artificial
  CRISPR gRNA sequence
agatataaaacagcaatcac

SEQ ID NO: 122400 - DNA, 20 bp, Artificial
  CRISPR gRNA sequence
tggatgttcctaccacccca

SEQ ID NO: 122401 - DNA, 20 bp, Artificial
  CRISPR gRNA sequence
gatgttcctaccaccccaca

SEQ ID NO: 122402 - DNA, 20 bp, Artificial
  CRISPR gRNA sequence
atgttcctaccaccccacag

SEQ ID NO: 122403 - DNA, 20 bp, Artificial
  CRISPR gRNA sequence
gatgaaaactcttaataacc

SEQ ID NO: 122404 - DNA, 20 bp, Artificial
  CRISPR gRNA sequence
tcttaataacccagtgcccc

SEQ ID NO: 122405 - DNA, 20 bp, Artificial
  CRISPR gRNA sequence
attccaccatgcatattttg

SEQ ID NO: 122406 - DNA, 20 bp, Artificial
  CRISPR gRNA sequence
ttccaccatgcatattttgt

SEQ ID NO: 122407 - DNA, 20 bp, Artificial
  CRISPR gRNA sequence
gcatattttgtgggcgacat

SEQ ID NO: 122408 - DNA, 20 bp, Artificial
  CRISPR gRNA sequence
taagtaccacttctctgccc

SEQ ID NO: 122409 - DNA, 20 bp, Artificial
  CRISPR gRNA sequence
ccctagcatttccatgaata

SEQ ID NO: 122410 - DNA, 20 bp, Artificial
  CRISPR gRNA sequence
atttccatgaataaagacac

SEQ ID NO: 122411 - DNA, 20 bp, Artificial
  CRISPR gRNA sequence
taaagacaccagaaaacaaa

SEQ ID NO: 122412 - DNA, 20 bp, Artificial
  CRISPR gRNA sequence
ccagaaaacaaaaagcaaaa

SEQ ID NO: 122413 - DNA, 20 bp, Artificial
  CRISPR gRNA sequence
cagaaaacaaaaagcaaaac

SEQ ID NO: 122414 - DNA, 20 bp, Artificial
  CRISPR gRNA sequence
ctaaaaaactgaattcacat

SEQ ID NO: 122415 - DNA, 20 bp, Artificial
  CRISPR gRNA sequence
taaaaaactgaattcacata

SEQ ID NO: 122416 - DNA, 20 bp, Artificial
  CRISPR gRNA sequence
aactgaattcacataaggct

SEQ ID NO: 122417 - DNA, 20 bp, Artificial
  CRISPR gRNA sequence
aattcacataaggcttggaa

SEQ ID NO: 122418 - DNA, 20 bp, Artificial
  CRISPR gRNA sequence
ttcacataaggcttggaaaa

SEQ ID NO: 122419 - DNA, 20 bp, Artificial
  CRISPR gRNA sequence
cacataaggcttggaaaaga

SEQ ID NO: 122420 - DNA, 20 bp, Artificial
  CRISPR gRNA sequence
aagagagaaatgataacata

SEQ ID NO: 122421 - DNA, 20 bp, Artificial
  CRISPR gRNA sequence
actttgacttttttattatt

SEQ ID NO: 122422 - DNA, 20 bp, Artificial
  CRISPR gRNA sequence
ctttgacttttttattattt

SEQ ID NO: 122423 - DNA, 20 bp, Artificial
  CRISPR gRNA sequence
tttttattatttgggataca

SEQ ID NO: 122424 - DNA, 20 bp, Artificial
  CRISPR gRNA sequence
ttatttgggatacacagtgt

SEQ ID NO: 122425 - DNA, 20 bp, Artificial
  CRISPR gRNA sequence
gggatacacagtgtcagata

SEQ ID NO: 122426 - DNA, 20 bp, Artificial
  CRISPR gRNA sequence
ggatacacagtgtcagatac

SEQ ID NO: 122427 - DNA, 20 bp, Artificial
  CRISPR gRNA sequence
cagtgtcagatacaggtttt

SEQ ID NO: 122428 - DNA, 20 bp, Artificial
  CRISPR gRNA sequence
caggttttgagtttactaaa

SEQ ID NO: 122429 - DNA, 20 bp, Artificial
  CRISPR gRNA sequence
tttactaaaaagcctgccta

SEQ ID NO: 122430 - DNA, 20 bp, Artificial
  CRISPR gRNA sequence
actaaaaagcctgcctaaag

SEQ ID NO: 122431 - DNA, 20 bp, Artificial
  CRISPR gRNA sequence
ataaaaacaatttttccctt

SEQ ID NO: 122432 - DNA, 20 bp, Artificial
  CRISPR gRNA sequence
taaaaacaatttttccctta

SEQ ID NO: 122433 - DNA, 20 bp, Artificial
  CRISPR gRNA sequence
aaaaacaatttttcccttaa

SEQ ID NO: 122434 - DNA, 20 bp, Artificial
  CRISPR gRNA sequence
caatttttcccttaagggtc

SEQ ID NO: 122435 - DNA, 20 bp, Artificial
  CRISPR gRNA sequence
aatttttcccttaagggtct

SEQ ID NO: 122436 - DNA, 20 bp, Artificial
  CRISPR gRNA sequence
atttttcccttaagggtctg

SEQ ID NO: 122437 - DNA, 20 bp, Artificial
  CRISPR gRNA sequence
gtctaaaaatgaaactccaa

SEQ ID NO: 122438 - DNA, 20 bp, Artificial
  CRISPR gRNA sequence
gaaactccaatggattaatc

SEQ ID NO: 122439 - DNA, 20 bp, Artificial
  CRISPR gRNA sequence
ggattaatcaagcaattgca

SEQ ID NO: 122440 - DNA, 20 bp, Artificial
  CRISPR gRNA sequence
aattgcaaagccacttgtaa

SEQ ID NO: 122441 - DNA, 20 bp, Artificial
  CRISPR gRNA sequence
gccatgcctattttccatac

SEQ ID NO: 122442 - DNA, 20 bp, Artificial
  CRISPR gRNA sequence
catgcctattttccatactg

SEQ ID NO: 122443 - DNA, 20 bp, Artificial
  CRISPR gRNA sequence
cctattttccatactggaga

SEQ ID NO: 122444 - DNA, 20 bp, Artificial
  CRISPR gRNA sequence
ccatactggagaaagtaaac

SEQ ID NO: 122445 - DNA, 20 bp, Artificial
  CRISPR gRNA sequence
aaacaagaactgcataaatg

SEQ ID NO: 122446 - DNA, 20 bp, Artificial
  CRISPR gRNA sequence
agaactgcataaatgcagtc

SEQ ID NO: 122447 - DNA, 20 bp, Artificial
  CRISPR gRNA sequence
ctgcataaatgcagtcaagc

SEQ ID NO: 122448 - DNA, 20 bp, Artificial
  CRISPR gRNA sequence
caagcaagataatataatgt

SEQ ID NO: 122449 - DNA, 20 bp, Artificial
  CRISPR gRNA sequence
ataatgtgagccacatatgt

SEQ ID NO: 122450 - DNA, 20 bp, Artificial
  CRISPR gRNA sequence
gtgagccacatatgtcagtt

SEQ ID NO: 122451 - DNA, 20 bp, Artificial
  CRISPR gRNA sequence
atatgtcagtttagattctc

SEQ ID NO: 122452 - DNA, 20 bp, Artificial
  CRISPR gRNA sequence
tgtcagtttagattctctag

SEQ ID NO: 122453 - DNA, 20 bp, Artificial
  CRISPR gRNA sequence
atatttaatttaacccaata

SEQ ID NO: 122454 - DNA, 20 bp, Artificial
  CRISPR gRNA sequence
aaattcttaccatttaaaca

SEQ ID NO: 122455 - DNA, 20 bp, Artificial
  CRISPR gRNA sequence
catagaatcaatttttaaat

SEQ ID NO: 122456 - DNA, 20 bp, Artificial
  CRISPR gRNA sequence
ttaattcttttcttcatact

SEQ ID NO: 122457 - DNA, 20 bp, Artificial
  CRISPR gRNA sequence
catactaagtcttcaaaatc

SEQ ID NO: 122458 - DNA, 20 bp, Artificial
  CRISPR gRNA sequence
atttacaacacatctccatt

SEQ ID NO: 122459 - DNA, 20 bp, Artificial
  CRISPR gRNA sequence
caacacatctccattcagac

SEQ ID NO: 122460 - DNA, 20 bp, Artificial
  CRISPR gRNA sequence
cattcagaccagccacattt

SEQ ID NO: 122461 - DNA, 20 bp, Artificial
  CRISPR gRNA sequence
attcagaccagccacatttc

SEQ ID NO: 122462 - DNA, 20 bp, Artificial
  CRISPR gRNA sequence
gccacatttcaggtgctcct

SEQ ID NO: 122463 - DNA, 20 bp, Artificial
  CRISPR gRNA sequence
ttcaggtgctcctgagcaca

SEQ ID NO: 122464 - DNA, 20 bp, Artificial
  CRISPR gRNA sequence
gctcctgagcacatggcttg

SEQ ID NO: 122465 - DNA, 20 bp, Artificial
  CRISPR gRNA sequence
gagcacatggcttgtggcta

SEQ ID NO: 122466 - DNA, 20 bp, Artificial
  CRISPR gRNA sequence
cttgtggctatggtactgac

SEQ ID NO: 122467 - DNA, 20 bp, Artificial
  CRISPR gRNA sequence
gtggctatggtactgaccag

SEQ ID NO: 122468 - DNA, 20 bp, Artificial
  CRISPR gRNA sequence
tatggtactgaccagcggca

SEQ ID NO: 122469 - DNA, 20 bp, Artificial
  CRISPR gRNA sequence
gtactgaccagcggcatagc

SEQ ID NO: 122470 - DNA, 20 bp, Artificial
  CRISPR gRNA sequence
gcggcatagctggtcataca

SEQ ID NO: 122471 - DNA, 20 bp, Artificial
  CRISPR gRNA sequence
tggtcatacatagcctatgt

SEQ ID NO: 122472 - DNA, 20 bp, Artificial
  CRISPR gRNA sequence
tagcctatgtaagcaataat

SEQ ID NO: 122473 - DNA, 20 bp, Artificial
  CRISPR gRNA sequence
cttttttttccttaaaacat

SEQ ID NO: 122474 - DNA, 20 bp, Artificial
  CRISPR gRNA sequence
ttttttttccttaaaacata

SEQ ID NO: 122475 - DNA, 20 bp, Artificial
  CRISPR gRNA sequence
ggacaaaattctcaaactgt

SEQ ID NO: 122476 - DNA, 20 bp, Artificial
  CRISPR gRNA sequence
attctcaaactgtaagttct

SEQ ID NO: 122477 - DNA, 20 bp, Artificial
  CRISPR gRNA sequence
caaactgtaagttctaagct

SEQ ID NO: 122478 - DNA, 20 bp, Artificial
  CRISPR gRNA sequence
agcttagtgatgtattttaa

SEQ ID NO: 122479 - DNA, 20 bp, Artificial
  CRISPR gRNA sequence
ttaatagcatatttatttgt

SEQ ID NO: 122480 - DNA, 20 bp, Artificial
  CRISPR gRNA sequence
gtaagctttattacttccat

SEQ ID NO: 122481 - DNA, 20 bp, Artificial
  CRISPR gRNA sequence
ctttttaaactataaaatga

SEQ ID NO: 122482 - DNA, 20 bp, Artificial
  CRISPR gRNA sequence
aatgacagaaaaattaccaa

SEQ ID NO: 122483 - DNA, 20 bp, Artificial
  CRISPR gRNA sequence
aaaacgtgtgaattttaatt

SEQ ID NO: 122484 - DNA, 20 bp, Artificial
  CRISPR gRNA sequence
tgtgaattttaattcagacc

SEQ ID NO: 122485 - DNA, 20 bp, Artificial
  CRISPR gRNA sequence
tttaattcagaccaagtgat

SEQ ID NO: 122486 - DNA, 20 bp, Artificial
  CRISPR gRNA sequence
aagtgatgagcaatgacaat

SEQ ID NO: 122487 - DNA, 20 bp, Artificial
  CRISPR gRNA sequence
gcaatgacaatgagttttaa

SEQ ID NO: 122488 - DNA, 20 bp, Artificial
  CRISPR gRNA sequence
caatgagttttaaaagttct

SEQ ID NO: 122489 - DNA, 20 bp, Artificial
  CRISPR gRNA sequence
tgagttttaaaagttctaag

SEQ ID NO: 122490 - DNA, 20 bp, Artificial
  CRISPR gRNA sequence
ctaagaagacaaaactactt

SEQ ID NO: 122491 - DNA, 20 bp, Artificial
  CRISPR gRNA sequence
atatcaatttaaatgtatct

SEQ ID NO: 122492 - DNA, 20 bp, Artificial
  CRISPR gRNA sequence
tatctataattatgtaaaaa

SEQ ID NO: 122493 - DNA, 20 bp, Artificial
  CRISPR gRNA sequence
aaatagctgtttccaaatac

SEQ ID NO: 122494 - DNA, 20 bp, Artificial
  CRISPR gRNA sequence
aatagctgtttccaaatacc

SEQ ID NO: 122495 - DNA, 20 bp, Artificial
  CRISPR gRNA sequence
ccaaataccaggatttgttt

SEQ ID NO: 122496 - DNA, 20 bp, Artificial
  CRISPR gRNA sequence
aattcttattacacctatat

SEQ ID NO: 122497 - DNA, 20 bp, Artificial
  CRISPR gRNA sequence
ctaaatttactgcaacatta

SEQ ID NO: 122498 - DNA, 20 bp, Artificial
  CRISPR gRNA sequence
aatttactgcaacattatag

SEQ ID NO: 122499 - DNA, 20 bp, Artificial
  CRISPR gRNA sequence
ctgcaacattatagaagtta

SEQ ID NO: 122500 - DNA, 20 bp, Artificial
  CRISPR gRNA sequence
cattatagaagttacagctt

SEQ ID NO: 122501 - DNA, 20 bp, Artificial
  CRISPR gRNA sequence
gaagttacagcttcagtcta

SEQ ID NO: 122502 - DNA, 20 bp, Artificial
  CRISPR gRNA sequence
cgcccgatctcgtctgatct

SEQ ID NO: 122503 - DNA, 20 bp, Artificial
  CRISPR gRNA sequence
ccgatctcgtctgatctcgg

SEQ ID NO: 122504 - DNA, 20 bp, Artificial
  CRISPR gRNA sequence
ctcgtctgatctcggaagct

SEQ ID NO: 122505 - DNA, 20 bp, Artificial
  CRISPR gRNA sequence
gtctgatctcggaagctaag

SEQ ID NO: 122506 - DNA, 20 bp, Artificial
  CRISPR gRNA sequence
tctgatctcggaagctaagc

SEQ ID NO: 122507 - DNA, 20 bp, Artificial
  CRISPR gRNA sequence
ctgatctcggaagctaagca

SEQ ID NO: 122508 - DNA, 20 bp, Artificial
  CRISPR gRNA sequence
tctcggaagctaagcagggt

SEQ ID NO: 122509 - DNA, 20 bp, Artificial
  CRISPR gRNA sequence
ctcggaagctaagcagggtc

SEQ ID NO: 122510 - DNA, 20 bp, Artificial
  CRISPR gRNA sequence
aagctaagcagggtcgggcc

SEQ ID NO: 122511 - DNA, 20 bp, Artificial
  CRISPR gRNA sequence
taagcagggtcgggcctggt

SEQ ID NO: 122512 - DNA, 20 bp, Artificial
  CRISPR gRNA sequence
ggtcgggcctggttagtact

SEQ ID NO: 122513 - DNA, 20 bp, Artificial
  CRISPR gRNA sequence
gggcctggttagtacttgga

SEQ ID NO: 122514 - DNA, 20 bp, Artificial
  CRISPR gRNA sequence
ggcctggttagtacttggat

SEQ ID NO: 122515 - DNA, 20 bp, Artificial
  CRISPR gRNA sequence
cctggttagtacttggatgg

SEQ ID NO: 122516 - DNA, 20 bp, Artificial
  CRISPR gRNA sequence
ggttagtacttggatgggag

SEQ ID NO: 122517 - DNA, 20 bp, Artificial
  CRISPR gRNA sequence
tacttggatgggagaagtta

SEQ ID NO: 122518 - DNA, 20 bp, Artificial
  CRISPR gRNA sequence
gatgggagaagttacagctt

SEQ ID NO: 122519 - DNA, 20 bp, Artificial
  CRISPR gRNA sequence
atgggagaagttacagcttc

SEQ ID NO: 122520 - DNA, 20 bp, Artificial
  CRISPR gRNA sequence
gagaagttacagcttcaggc

SEQ ID NO: 122521 - DNA, 20 bp, Artificial
  CRISPR gRNA sequence
agaagttacagcttcaggcc

SEQ ID NO: 122522 - DNA, 20 bp, Artificial
  CRISPR gRNA sequence
ttacagcttcaggccgggca

SEQ ID NO: 122523 - DNA, 20 bp, Artificial
  CRISPR gRNA sequence
cagcttcaggccgggcacag

SEQ ID NO: 122524 - DNA, 20 bp, Artificial
  CRISPR gRNA sequence
gtggctcgtgcctgtaatcc

SEQ ID NO: 122525 - DNA, 20 bp, Artificial
  CRISPR gRNA sequence
gtgcctgtaatcccagctac

SEQ ID NO: 122526 - DNA, 20 bp, Artificial
  CRISPR gRNA sequence
tgcctgtaatcccagctacc

SEQ ID NO: 122527 - DNA, 20 bp, Artificial
  CRISPR gRNA sequence
gcctgtaatcccagctacca

SEQ ID NO: 122528 - DNA, 20 bp, Artificial
  CRISPR gRNA sequence
cctgtaatcccagctaccag

SEQ ID NO: 122529 - DNA, 20 bp, Artificial
  CRISPR gRNA sequence
tgtaatcccagctaccaggg

SEQ ID NO: 122530 - DNA, 20 bp, Artificial
  CRISPR gRNA sequence
gtaatcccagctaccagggg

SEQ ID NO: 122531 - DNA, 20 bp, Artificial
  CRISPR gRNA sequence
cccagctaccaggggaggct

SEQ ID NO: 122532 - DNA, 20 bp, Artificial
  CRISPR gRNA sequence
ccagctaccaggggaggctg

SEQ ID NO: 122533 - DNA, 20 bp, Artificial
  CRISPR gRNA sequence
gctaccaggggaggctgagg

SEQ ID NO: 122534 - DNA, 20 bp, Artificial
  CRISPR gRNA sequence
ctaccaggggaggctgaggc

SEQ ID NO: 122535 - DNA, 20 bp, Artificial
  CRISPR gRNA sequence
accaggggaggctgaggcag

SEQ ID NO: 122536 - DNA, 20 bp, Artificial
  CRISPR gRNA sequence
gcaggagaatcgcttgaacc

SEQ ID NO: 122537 - DNA, 20 bp, Artificial
  CRISPR gRNA sequence
caggagaatcgcttgaacct

SEQ ID NO: 122538 - DNA, 20 bp, Artificial
  CRISPR gRNA sequence
ggagaatcgcttgaacctgg

SEQ ID NO: 122539 - DNA, 20 bp, Artificial
  CRISPR gRNA sequence
gagaatcgcttgaacctggg

SEQ ID NO: 122540 - DNA, 20 bp, Artificial
  CRISPR gRNA sequence
aatcgcttgaacctgggagg

SEQ ID NO: 122541 - DNA, 20 bp, Artificial
  CRISPR gRNA sequence
tcgcttgaacctgggaggtg

SEQ ID NO: 122542 - DNA, 20 bp, Artificial
  CRISPR gRNA sequence
cgcttgaacctgggaggtgg

SEQ ID NO: 122543 - DNA, 20 bp, Artificial
  CRISPR gRNA sequence
tgggaggtggaggttgcaat

SEQ ID NO: 122544 - DNA, 20 bp, Artificial
  CRISPR gRNA sequence
ggtggaggttgcaatgagcc

SEQ ID NO: 122545 - DNA, 20 bp, Artificial
  CRISPR gRNA sequence
gagatcacgccactgcactc

SEQ ID NO: 122546 - DNA, 20 bp, Artificial
  CRISPR gRNA sequence
cacgccactgcactccagcc

SEQ ID NO: 122547 - DNA, 20 bp, Artificial
  CRISPR gRNA sequence
acgccactgcactccagcct

SEQ ID NO: 122548 - DNA, 20 bp, Artificial
  CRISPR gRNA sequence
tgcactccagcctgggcaac

SEQ ID NO: 122549 - DNA, 20 bp, Artificial
  CRISPR gRNA sequence
cactccagcctgggcaacaa

SEQ ID NO: 122550 - DNA, 20 bp, Artificial
  CRISPR gRNA sequence
cgtctcaaaaaaaaaaaaaa

SEQ ID NO: 122551 - DNA, 20 bp, Artificial
  CRISPR gRNA sequence
aaaaaaaaaaaaaaaagtta

SEQ ID NO: 122552 - DNA, 20 bp, Artificial
  CRISPR gRNA sequence
cttcatacacccaaacctga

SEQ ID NO: 122553 - DNA, 20 bp, Artificial
  CRISPR gRNA sequence
aacgtacctattttttaaaa

SEQ ID NO: 122554 - DNA, 20 bp, Artificial
  CRISPR gRNA sequence
tacctattttttaaaacagt

SEQ ID NO: 122555 - DNA, 20 bp, Artificial
  CRISPR gRNA sequence
acctattttttaaaacagtc

SEQ ID NO: 122556 - DNA, 20 bp, Artificial
  CRISPR gRNA sequence
attttttaaaacagtcgggc

SEQ ID NO: 122557 - DNA, 20 bp, Artificial
  CRISPR gRNA sequence
ttttttaaaacagtcgggcc

SEQ ID NO: 122558 - DNA, 20 bp, Artificial
  CRISPR gRNA sequence
taaaacagtcgggccaggca

SEQ ID NO: 122559 - DNA, 20 bp, Artificial
  CRISPR gRNA sequence
aacagtcgggccaggcacag

SEQ ID NO: 122560 - DNA, 20 bp, Artificial
  CRISPR gRNA sequence
gtggctcatgtctataatcc

SEQ ID NO: 122561 - DNA, 20 bp, Artificial
  CRISPR gRNA sequence
tgtctataatcccagcactt

SEQ ID NO: 122562 - DNA, 20 bp, Artificial
  CRISPR gRNA sequence
ctataatcccagcactttgg

SEQ ID NO: 122563 - DNA, 20 bp, Artificial
  CRISPR gRNA sequence
tataatcccagcactttggt

SEQ ID NO: 122564 - DNA, 20 bp, Artificial
  CRISPR gRNA sequence
tcccagcactttggtaggcc

SEQ ID NO: 122565 - DNA, 20 bp, Artificial
  CRISPR gRNA sequence
cccagcactttggtaggcca

SEQ ID NO: 122566 - DNA, 20 bp, Artificial
  CRISPR gRNA sequence
agcactttggtaggccaagg

SEQ ID NO: 122567 - DNA, 20 bp, Artificial
  CRISPR gRNA sequence
ctttggtaggccaaggcgga

SEQ ID NO: 122568 - DNA, 20 bp, Artificial
  CRISPR gRNA sequence
ccaaggcggatggatcacct

SEQ ID NO: 122569 - DNA, 20 bp, Artificial
  CRISPR gRNA sequence
caaggcggatggatcacctg

SEQ ID NO: 122570 - DNA, 20 bp, Artificial
  CRISPR gRNA sequence
cggatggatcacctgaggtc

SEQ ID NO: 122571 - DNA, 20 bp, Artificial
  CRISPR gRNA sequence
gatggatcacctgaggtcga

SEQ ID NO: 122572 - DNA, 20 bp, Artificial
  CRISPR gRNA sequence
tcacctgaggtcgagagttc

SEQ ID NO: 122573 - DNA, 20 bp, Artificial
  CRISPR gRNA sequence
tgaggtcgagagttcaagac

SEQ ID NO: 122574 - DNA, 20 bp, Artificial
  CRISPR gRNA sequence
caagaccagcctgaccaaca

SEQ ID NO: 122575 - DNA, 20 bp, Artificial
  CRISPR gRNA sequence
agaccagcctgaccaacatg

SEQ ID NO: 122576 - DNA, 20 bp, Artificial
  CRISPR gRNA sequence
ttctaccaaaaatacaaaat

SEQ ID NO: 122577 - DNA, 20 bp, Artificial
  CRISPR gRNA sequence
accaaaaatacaaaattagc

SEQ ID NO: 122578 - DNA, 20 bp, Artificial
  CRISPR gRNA sequence
ccaaaaatacaaaattagct

SEQ ID NO: 122579 - DNA, 20 bp, Artificial
  CRISPR gRNA sequence
aatacaaaattagctgggca

SEQ ID NO: 122580 - DNA, 20 bp, Artificial
  CRISPR gRNA sequence
acaaaattagctgggcatgg

SEQ ID NO: 122581 - DNA, 20 bp, Artificial
  CRISPR gRNA sequence
gtggtgcacgcctgtaatcc

SEQ ID NO: 122582 - DNA, 20 bp, Artificial
  CRISPR gRNA sequence
cgcctgtaatcccagctact

SEQ ID NO: 122583 - DNA, 20 bp, Artificial
  CRISPR gRNA sequence
gcctgtaatcccagctactc

SEQ ID NO: 122584 - DNA, 20 bp, Artificial
  CRISPR gRNA sequence
ctgtaatcccagctactcgg

SEQ ID NO: 122585 - DNA, 20 bp, Artificial
  CRISPR gRNA sequence
tgtaatcccagctactcggg

SEQ ID NO: 122586 - DNA, 20 bp, Artificial
  CRISPR gRNA sequence
tcccagctactcgggaggct

SEQ ID NO: 122587 - DNA, 20 bp, Artificial
  CRISPR gRNA sequence
cccagctactcgggaggctg

SEQ ID NO: 122588 - DNA, 20 bp, Artificial
  CRISPR gRNA sequence
agctactcgggaggctgagg

SEQ ID NO: 122589 - DNA, 20 bp, Artificial
  CRISPR gRNA sequence
gctactcgggaggctgaggc

SEQ ID NO: 122590 - DNA, 20 bp, Artificial
  CRISPR gRNA sequence
tactcgggaggctgaggcag

SEQ ID NO: 122591 - DNA, 20 bp, Artificial
  CRISPR gRNA sequence
gcaggagaattgcttgaacc

SEQ ID NO: 122592 - DNA, 20 bp, Artificial
  CRISPR gRNA sequence
caggagaattgcttgaacct

SEQ ID NO: 122593 - DNA, 20 bp, Artificial
  CRISPR gRNA sequence
ggagaattgcttgaacctgg

SEQ ID NO: 122594 - DNA, 20 bp, Artificial
  CRISPR gRNA sequence
gagaattgcttgaacctggg

SEQ ID NO: 122595 - DNA, 20 bp, Artificial
  CRISPR gRNA sequence
aattgcttgaacctgggagg

SEQ ID NO: 122596 - DNA, 20 bp, Artificial
  CRISPR gRNA sequence
ttgcttgaacctgggaggcg

SEQ ID NO: 122597 - DNA, 20 bp, Artificial
  CRISPR gRNA sequence
tgcttgaacctgggaggcgg

SEQ ID NO: 122598 - DNA, 20 bp, Artificial
  CRISPR gRNA sequence
aacctgggaggcggaggttg

SEQ ID NO: 122599 - DNA, 20 bp, Artificial
  CRISPR gRNA sequence
tgggaggcggaggttgcagt

SEQ ID NO: 122600 - DNA, 20 bp, Artificial
  CRISPR gRNA sequence
gaggcggaggttgcagtgag

SEQ ID NO: 122601 - DNA, 20 bp, Artificial
  CRISPR gRNA sequence
ggcggaggttgcagtgagcg

SEQ ID NO: 122602 - DNA, 20 bp, Artificial
  CRISPR gRNA sequence
gagattgtaccattgcactc

SEQ ID NO: 122603 - DNA, 20 bp, Artificial
  CRISPR gRNA sequence
tgtaccattgcactccagcc

SEQ ID NO: 122604 - DNA, 20 bp, Artificial
  CRISPR gRNA sequence
tgcactccagcctggccaat

SEQ ID NO: 122605 - DNA, 20 bp, Artificial
  CRISPR gRNA sequence
cactccagcctggccaataa

SEQ ID NO: 122606 - DNA, 20 bp, Artificial
  CRISPR gRNA sequence
aaaaaaaaaaaaaaaaaaaa

SEQ ID NO: 122607 - DNA, 20 bp, Artificial
  CRISPR gRNA sequence
ctattttatctgcctccaat

SEQ ID NO: 122608 - DNA, 20 bp, Artificial
  CRISPR gRNA sequence
ttttatctgcctccaataag

SEQ ID NO: 122609 - DNA, 20 bp, Artificial
  CRISPR gRNA sequence
tttatctgcctccaataagt

SEQ ID NO: 122610 - DNA, 20 bp, Artificial
  CRISPR gRNA sequence
tatctgcctccaataagtgg

SEQ ID NO: 122611 - DNA, 20 bp, Artificial
  CRISPR gRNA sequence
tctgcctccaataagtggga

SEQ ID NO: 122612 - DNA, 20 bp, Artificial
  CRISPR gRNA sequence
tgcctccaataagtgggaga

SEQ ID NO: 122613 - DNA, 20 bp, Artificial
  CRISPR gRNA sequence
gcctccaataagtgggagag

SEQ ID NO: 122614 - DNA, 20 bp, Artificial
  CRISPR gRNA sequence
ctccaataagtgggagagag

SEQ ID NO: 122615 - DNA, 20 bp, Artificial
  CRISPR gRNA sequence
gtgggagagaggagaacatt

SEQ ID NO: 122616 - DNA, 20 bp, Artificial
  CRISPR gRNA sequence
tgggagagaggagaacattt

SEQ ID NO: 122617 - DNA, 20 bp, Artificial
  CRISPR gRNA sequence
gggagagaggagaacattta

SEQ ID NO: 122618 - DNA, 20 bp, Artificial
  CRISPR gRNA sequence
gagaacatttagggacatga

SEQ ID NO: 122619 - DNA, 20 bp, Artificial
  CRISPR gRNA sequence
ggacatgacagaattgaaaa

SEQ ID NO: 122620 - DNA, 20 bp, Artificial
  CRISPR gRNA sequence
gacatgacagaattgaaaat

SEQ ID NO: 122621 - DNA, 20 bp, Artificial
  CRISPR gRNA sequence
attgaaaatgggacactgtt

SEQ ID NO: 122622 - DNA, 20 bp, Artificial
  CRISPR gRNA sequence
ctgttcagtaactgtgtatg

SEQ ID NO: 122623 - DNA, 20 bp, Artificial
  CRISPR gRNA sequence
aactgtgtatgtagacatga

SEQ ID NO: 122624 - DNA, 20 bp, Artificial
  CRISPR gRNA sequence
agaaatatttgatttgctga

SEQ ID NO: 122625 - DNA, 20 bp, Artificial
  CRISPR gRNA sequence
gcctgaatgattgaaatcaa

SEQ ID NO: 122626 - DNA, 20 bp, Artificial
  CRISPR gRNA sequence
ccatgacctatgaattcatg

SEQ ID NO: 122627 - DNA, 20 bp, Artificial
  CRISPR gRNA sequence
gtgtttcccttgaaaaaacc

SEQ ID NO: 122628 - DNA, 20 bp, Artificial
  CRISPR gRNA sequence
ctacgttacctttcccgttt

SEQ ID NO: 122629 - DNA, 20 bp, Artificial
  CRISPR gRNA sequence
tacgttacctttcccgtttg

SEQ ID NO: 122630 - DNA, 20 bp, Artificial
  CRISPR gRNA sequence
tacctttcccgtttgaggta

SEQ ID NO: 122631 - DNA, 20 bp, Artificial
  CRISPR gRNA sequence
tatggcatttttcattatcc

SEQ ID NO: 122632 - DNA, 20 bp, Artificial
  CRISPR gRNA sequence
atcctagccacgtttgctat

SEQ ID NO: 122633 - DNA, 20 bp, Artificial
  CRISPR gRNA sequence
ctagccacgtttgctattgg

SEQ ID NO: 122634 - DNA, 20 bp, Artificial
  CRISPR gRNA sequence
atgatcattcatgctgtcct

SEQ ID NO: 122635 - DNA, 20 bp, Artificial
  CRISPR gRNA sequence
catgctgtcctcagtatcta

SEQ ID NO: 122636 - DNA, 20 bp, Artificial
  CRISPR gRNA sequence
tctaaagaaataaaaatatt

SEQ ID NO: 122637 - DNA, 20 bp, Artificial
  CRISPR gRNA sequence
ctaaagaaataaaaatattt

SEQ ID NO: 122638 - DNA, 20 bp, Artificial
  CRISPR gRNA sequence
aataaaaatatttaggtgta

SEQ ID NO: 122639 - DNA, 20 bp, Artificial
  CRISPR gRNA sequence
cttcttattatttctatttc

SEQ ID NO: 122640 - DNA, 20 bp, Artificial
  CRISPR gRNA sequence
ttattatttctatttcaaga

SEQ ID NO: 122641 - DNA, 20 bp, Artificial
  CRISPR gRNA sequence
caagatagaaaaaactacca

SEQ ID NO: 122642 - DNA, 20 bp, Artificial
  CRISPR gRNA sequence
aaaaaactaccaaagtgatc

SEQ ID NO: 122643 - DNA, 20 bp, Artificial
  CRISPR gRNA sequence
gatccagaataaaatcattc

SEQ ID NO: 122644 - DNA, 20 bp, Artificial
  CRISPR gRNA sequence
ttcacctcttaaccattatt

SEQ ID NO: 122645 - DNA, 20 bp, Artificial
  CRISPR gRNA sequence
tcacctcttaaccattattt

SEQ ID NO: 122646 - DNA, 20 bp, Artificial
  CRISPR gRNA sequence
cacctcttaaccattattta

SEQ ID NO: 122647 - DNA, 20 bp, Artificial
  CRISPR gRNA sequence
cttaaccattatttagggat

SEQ ID NO: 122648 - DNA, 20 bp, Artificial
  CRISPR gRNA sequence
ttaaccattatttagggatt

SEQ ID NO: 122649 - DNA, 20 bp, Artificial
  CRISPR gRNA sequence
ccattatttagggattagga

SEQ ID NO: 122650 - DNA, 20 bp, Artificial
  CRISPR gRNA sequence
tatttagggattaggatagc

SEQ ID NO: 122651 - DNA, 20 bp, Artificial
  CRISPR gRNA sequence
aagtctcttcataattttta

SEQ ID NO: 122652 - DNA, 20 bp, Artificial
  CRISPR gRNA sequence
gtctcttcataatttttaca

SEQ ID NO: 122653 - DNA, 20 bp, Artificial
  CRISPR gRNA sequence
cttcataatttttacagagc

SEQ ID NO: 122654 - DNA, 20 bp, Artificial
  CRISPR gRNA sequence
aactttttttttattaattt

SEQ ID NO: 122655 - DNA, 20 bp, Artificial
  CRISPR gRNA sequence
ttaatttcagactcactgcc

SEQ ID NO: 122656 - DNA, 20 bp, Artificial
  CRISPR gRNA sequence
tcttttctttcataaaatgt

SEQ ID NO: 122657 - DNA, 20 bp, Artificial
  CRISPR gRNA sequence
ccttttctcttacacatttt

SEQ ID NO: 122658 - DNA, 20 bp, Artificial
  CRISPR gRNA sequence
ttattcctcatttctcctat

SEQ ID NO: 122659 - DNA, 20 bp, Artificial
  CRISPR gRNA sequence
tgctacttaatgtcacgaat

SEQ ID NO: 122660 - DNA, 20 bp, Artificial
  CRISPR gRNA sequence
aatcagctttgtgtttccta

SEQ ID NO: 122661 - DNA, 20 bp, Artificial
  CRISPR gRNA sequence
gctttgtgtttcctacagct

SEQ ID NO: 122662 - DNA, 20 bp, Artificial
  CRISPR gRNA sequence
gtgtttcctacagcttggta

SEQ ID NO: 122663 - DNA, 20 bp, Artificial
  CRISPR gRNA sequence
gcttggtacagcaccttcca

SEQ ID NO: 122664 - DNA, 20 bp, Artificial
  CRISPR gRNA sequence
ttggtacagcaccttccaca

SEQ ID NO: 122665 - DNA, 20 bp, Artificial
  CRISPR gRNA sequence
gtacagcaccttccacagag

SEQ ID NO: 122666 - DNA, 20 bp, Artificial
  CRISPR gRNA sequence
tacagcaccttccacagagt

SEQ ID NO: 122667 - DNA, 20 bp, Artificial
  CRISPR gRNA sequence
taaatatttattatacgact

SEQ ID NO: 122668 - DNA, 20 bp, Artificial
  CRISPR gRNA sequence
cgacttagctataaaactta

SEQ ID NO: 122669 - DNA, 20 bp, Artificial
  CRISPR gRNA sequence
aacttacagaccgtaaccta

SEQ ID NO: 122670 - DNA, 20 bp, Artificial
  CRISPR gRNA sequence
tatggctccttcaatactgc

SEQ ID NO: 122671 - DNA, 20 bp, Artificial
  CRISPR gRNA sequence
tccttcaatactgctagatt

SEQ ID NO: 122672 - DNA, 20 bp, Artificial
  CRISPR gRNA sequence
cttcaatactgctagattaa

SEQ ID NO: 122673 - DNA, 20 bp, Artificial
  CRISPR gRNA sequence
ttcaatactgctagattaag

SEQ ID NO: 122674 - DNA, 20 bp, Artificial
  CRISPR gRNA sequence
ttgtatgtttctccaaaccc

SEQ ID NO: 122675 - DNA, 20 bp, Artificial
  CRISPR gRNA sequence
atataaactcatttatgtaa

SEQ ID NO: 122676 - DNA, 20 bp, Artificial
  CRISPR gRNA sequence
aagtctatataaaactttta

SEQ ID NO: 122677 - DNA, 20 bp, Artificial
  CRISPR gRNA sequence
aaacttttaaagttgatata

SEQ ID NO: 122678 - DNA, 20 bp, Artificial
  CRISPR gRNA sequence
aaagttgtcttgtctgtata

SEQ ID NO: 122679 - DNA, 20 bp, Artificial
  CRISPR gRNA sequence
agtttatataaaattcttta

SEQ ID NO: 122680 - DNA, 20 bp, Artificial
  CRISPR gRNA sequence
atataaaattctttaaagaa

SEQ ID NO: 122681 - DNA, 20 bp, Artificial
  CRISPR gRNA sequence
tctttaaagaatggaaaaac

SEQ ID NO: 122682 - DNA, 20 bp, Artificial
  CRISPR gRNA sequence
ggacttgattattactgatc

SEQ ID NO: 122683 - DNA, 20 bp, Artificial
  CRISPR gRNA sequence
ttgattattactgatccagt

SEQ ID NO: 122684 - DNA, 20 bp, Artificial
  CRISPR gRNA sequence
agttggcttactaatgtaac

SEQ ID NO: 122685 - DNA, 20 bp, Artificial
  CRISPR gRNA sequence
atgtaactagtttttgaaca

SEQ ID NO: 122686 - DNA, 20 bp, Artificial
  CRISPR gRNA sequence
aactagtttttgaacaaagc

SEQ ID NO: 122687 - DNA, 20 bp, Artificial
  CRISPR gRNA sequence
ctagtttttgaacaaagcta

SEQ ID NO: 122688 - DNA, 20 bp, Artificial
  CRISPR gRNA sequence
gtttttgaacaaagctagag

SEQ ID NO: 122689 - DNA, 20 bp, Artificial
  CRISPR gRNA sequence
gatccaactgttcatacaaa

SEQ ID NO: 122690 - DNA, 20 bp, Artificial
  CRISPR gRNA sequence
atccaactgttcatacaaaa

SEQ ID NO: 122691 - DNA, 20 bp, Artificial
  CRISPR gRNA sequence
tccaactgttcatacaaaaa

SEQ ID NO: 122692 - DNA, 20 bp, Artificial
  CRISPR gRNA sequence
cttttcaaattatataaatt

SEQ ID NO: 122693 - DNA, 20 bp, Artificial
  CRISPR gRNA sequence
tataaatttagctataactg

SEQ ID NO: 122694 - DNA, 20 bp, Artificial
  CRISPR gRNA sequence
agctataactgaagcttgcg

SEQ ID NO: 122695 - DNA, 20 bp, Artificial
  CRISPR gRNA sequence
catccttttatgactaaatg

SEQ ID NO: 122696 - DNA, 20 bp, Artificial
  CRISPR gRNA sequence
gactaaatgcagtatcctgt

SEQ ID NO: 122697 - DNA, 20 bp, Artificial
  CRISPR gRNA sequence
gcccactcttcatatgtact

SEQ ID NO: 122698 - DNA, 20 bp, Artificial
  CRISPR gRNA sequence
actcttcatatgtactaagt

SEQ ID NO: 122699 - DNA, 20 bp, Artificial
  CRISPR gRNA sequence
ctcttcatatgtactaagta

SEQ ID NO: 122700 - DNA, 20 bp, Artificial
  CRISPR gRNA sequence
cttcatatgtactaagtaag

SEQ ID NO: 122701 - DNA, 20 bp, Artificial
  CRISPR gRNA sequence
ttcatatgtactaagtaagg

SEQ ID NO: 122702 - DNA, 20 bp, Artificial
  CRISPR gRNA sequence
tatgtactaagtaaggaggc

SEQ ID NO: 122703 - DNA, 20 bp, Artificial
  CRISPR gRNA sequence
atgtactaagtaaggaggca

SEQ ID NO: 122704 - DNA, 20 bp, Artificial
  CRISPR gRNA sequence
agtaaggaggcaaggcactt

SEQ ID NO: 122705 - DNA, 20 bp, Artificial
  CRISPR gRNA sequence
tgtgtttaaaatgatgttat

SEQ ID NO: 122706 - DNA, 20 bp, Artificial
  CRISPR gRNA sequence
atttatttgaatatccgttt

SEQ ID NO: 122707 - DNA, 20 bp, Artificial
  CRISPR gRNA sequence
tttatttgaatatccgtttc

SEQ ID NO: 122708 - DNA, 20 bp, Artificial
  CRISPR gRNA sequence
caggatgaaattaatccctc

SEQ ID NO: 122709 - DNA, 20 bp, Artificial
  CRISPR gRNA sequence
atgaaattaatccctctggc

SEQ ID NO: 122710 - DNA, 20 bp, Artificial
  CRISPR gRNA sequence
tttttaaaaattttacaaat

SEQ ID NO: 122711 - DNA, 20 bp, Artificial
  CRISPR gRNA sequence
ttttaaaaattttacaaatc

SEQ ID NO: 122712 - DNA, 20 bp, Artificial
  CRISPR gRNA sequence
aaaaattttacaaatcaggc

SEQ ID NO: 122713 - DNA, 20 bp, Artificial
  CRISPR gRNA sequence
aaaattttacaaatcaggcc

SEQ ID NO: 122714 - DNA, 20 bp, Artificial
  CRISPR gRNA sequence
tttacaaatcaggccaggcg

SEQ ID NO: 122715 - DNA, 20 bp, Artificial
  CRISPR gRNA sequence
acaaatcaggccaggcgtgg

SEQ ID NO: 122716 - DNA, 20 bp, Artificial
  CRISPR gRNA sequence
gtggctcatgactataatcc

SEQ ID NO: 122717 - DNA, 20 bp, Artificial
  CRISPR gRNA sequence
tgactataatcccagcactt

SEQ ID NO: 122718 - DNA, 20 bp, Artificial
  CRISPR gRNA sequence
gactataatcccagcacttt

SEQ ID NO: 122719 - DNA, 20 bp, Artificial
  CRISPR gRNA sequence
ctataatcccagcactttgg

SEQ ID NO: 122720 - DNA, 20 bp, Artificial
  CRISPR gRNA sequence
tataatcccagcactttggg

SEQ ID NO: 122721 - DNA, 20 bp, Artificial
  CRISPR gRNA sequence
cccagcactttgggaggctg

SEQ ID NO: 122722 - DNA, 20 bp, Artificial
  CRISPR gRNA sequence
agcactttgggaggctgaag

SEQ ID NO: 122723 - DNA, 20 bp, Artificial
  CRISPR gRNA sequence
gcactttgggaggctgaagc

SEQ ID NO: 122724 - DNA, 20 bp, Artificial
  CRISPR gRNA sequence
ctttgggaggctgaagcagg

SEQ ID NO: 122725 - DNA, 20 bp, Artificial
  CRISPR gRNA sequence
ctgaagcaggcagatcatct

SEQ ID NO: 122726 - DNA, 20 bp, Artificial
  CRISPR gRNA sequence
tgaagcaggcagatcatctg

SEQ ID NO: 122727 - DNA, 20 bp, Artificial
  CRISPR gRNA sequence
ggcagatcatctgaggtcac

SEQ ID NO: 122728 - DNA, 20 bp, Artificial
  CRISPR gRNA sequence
tcatctgaggtcacgagttt

SEQ ID NO: 122729 - DNA, 20 bp, Artificial
  CRISPR gRNA sequence
tgaggtcacgagtttgagac

SEQ ID NO: 122730 - DNA, 20 bp, Artificial
  CRISPR gRNA sequence
tgagaccagcctgaccaaca

SEQ ID NO: 122731 - DNA, 20 bp, Artificial
  CRISPR gRNA sequence
tgtctctactaaaaaaaaat

SEQ ID NO: 122732 - DNA, 20 bp, Artificial
  CRISPR gRNA sequence
tctactaaaaaaaaattagc

SEQ ID NO: 122733 - DNA, 20 bp, Artificial
  CRISPR gRNA sequence
ctactaaaaaaaaattagct

SEQ ID NO: 122734 - DNA, 20 bp, Artificial
  CRISPR gRNA sequence
aaaaaaaaattagctgggca

SEQ ID NO: 122735 - DNA, 20 bp, Artificial
  CRISPR gRNA sequence
aaattagctgggcatggtgc

SEQ ID NO: 122736 - DNA, 20 bp, Artificial
  CRISPR gRNA sequence
aattagctgggcatggtgct

SEQ ID NO: 122737 - DNA, 20 bp, Artificial
  CRISPR gRNA sequence
gtgctgggcgcctgtgatct

SEQ ID NO: 122738 - DNA, 20 bp, Artificial
  CRISPR gRNA sequence
gcgcctgtgatctcagctaa

SEQ ID NO: 122739 - DNA, 20 bp, Artificial
  CRISPR gRNA sequence
cgcctgtgatctcagctaac

SEQ ID NO: 122740 - DNA, 20 bp, Artificial
  CRISPR gRNA sequence
ctgtgatctcagctaacggg

SEQ ID NO: 122741 - DNA, 20 bp, Artificial
  CRISPR gRNA sequence
tgtgatctcagctaacgggc

SEQ ID NO: 122742 - DNA, 20 bp, Artificial
  CRISPR gRNA sequence
tctcagctaacgggcaggct

SEQ ID NO: 122743 - DNA, 20 bp, Artificial
  CRISPR gRNA sequence
ctcagctaacgggcaggctg

SEQ ID NO: 122744 - DNA, 20 bp, Artificial
  CRISPR gRNA sequence
agctaacgggcaggctgagg

SEQ ID NO: 122745 - DNA, 20 bp, Artificial
  CRISPR gRNA sequence
gctaacgggcaggctgaggc

SEQ ID NO: 122746 - DNA, 20 bp, Artificial
  CRISPR gRNA sequence
taacgggcaggctgaggcag

SEQ ID NO: 122747 - DNA, 20 bp, Artificial
  CRISPR gRNA sequence
gcaggagaattgcttgaacc

SEQ ID NO: 122748 - DNA, 20 bp, Artificial
  CRISPR gRNA sequence
caggagaattgcttgaaccc

SEQ ID NO: 122749 - DNA, 20 bp, Artificial
  CRISPR gRNA sequence
ggagaattgcttgaacccag

SEQ ID NO: 122750 - DNA, 20 bp, Artificial
  CRISPR gRNA sequence
gagaattgcttgaacccagg

SEQ ID NO: 122751 - DNA, 20 bp, Artificial
  CRISPR gRNA sequence
aattgcttgaacccaggagg

SEQ ID NO: 122752 - DNA, 20 bp, Artificial
  CRISPR gRNA sequence
ttgcttgaacccaggaggcg

SEQ ID NO: 122753 - DNA, 20 bp, Artificial
  CRISPR gRNA sequence
tgcttgaacccaggaggcgg

SEQ ID NO: 122754 - DNA, 20 bp, Artificial
  CRISPR gRNA sequence
aacccaggaggcggaggttg

SEQ ID NO: 122755 - DNA, 20 bp, Artificial
  CRISPR gRNA sequence
caggaggcggaggttgcagt

SEQ ID NO: 122756 - DNA, 20 bp, Artificial
  CRISPR gRNA sequence
ggcggaggttgcagtgagcc

SEQ ID NO: 122757 - DNA, 20 bp, Artificial
  CRISPR gRNA sequence
aagattgtgccactgcactc

SEQ ID NO: 122758 - DNA, 20 bp, Artificial
  CRISPR gRNA sequence
tgtgccactgcactccagcc

SEQ ID NO: 122759 - DNA, 20 bp, Artificial
  CRISPR gRNA sequence
gtgccactgcactccagcct

SEQ ID NO: 122760 - DNA, 20 bp, Artificial
  CRISPR gRNA sequence
ctgcactccagcctgggcga

SEQ ID NO: 122761 - DNA, 20 bp, Artificial
  CRISPR gRNA sequence
gcactccagcctgggcgaca

SEQ ID NO: 122762 - DNA, 20 bp, Artificial
  CRISPR gRNA sequence
tccagcctgggcgacagagc

SEQ ID NO: 122763 - DNA, 20 bp, Artificial
  CRISPR gRNA sequence
tacaaaccaaaatgccacaa

SEQ ID NO: 122764 - DNA, 20 bp, Artificial
  CRISPR gRNA sequence
caaaagtaaattatttctga

SEQ ID NO: 122765 - DNA, 20 bp, Artificial
  CRISPR gRNA sequence
aaaagtaaattatttctgat

SEQ ID NO: 122766 - DNA, 20 bp, Artificial
  CRISPR gRNA sequence
tttttttttttttttttttt

SEQ ID NO: 122767 - DNA, 20 bp, Artificial
  CRISPR gRNA sequence
tttttttttttttttttttg

SEQ ID NO: 122768 - DNA, 20 bp, Artificial
  CRISPR gRNA sequence
tttttttttttttttggaga

SEQ ID NO: 122769 - DNA, 20 bp, Artificial
  CRISPR gRNA sequence
ttttttttttttttggagac

SEQ ID NO: 122770 - DNA, 20 bp, Artificial
  CRISPR gRNA sequence
tttttttttttttggagaca

SEQ ID NO: 122771 - DNA, 20 bp, Artificial
  CRISPR gRNA sequence
tcactttgcactttgtcacc

SEQ ID NO: 122772 - DNA, 20 bp, Artificial
  CRISPR gRNA sequence
cactttgcactttgtcaccc

SEQ ID NO: 122773 - DNA, 20 bp, Artificial
  CRISPR gRNA sequence
ttgcactttgtcacccaggc

SEQ ID NO: 122774 - DNA, 20 bp, Artificial
  CRISPR gRNA sequence
gcactttgtcacccaggctg

SEQ ID NO: 122775 - DNA, 20 bp, Artificial
  CRISPR gRNA sequence
gtcacccaggctggagtgtg

SEQ ID NO: 122776 - DNA, 20 bp, Artificial
  CRISPR gRNA sequence
acccaggctggagtgtgcag

SEQ ID NO: 122777 - DNA, 20 bp, Artificial
  CRISPR gRNA sequence
agtgtgcagtggtgcaaaca

SEQ ID NO: 122778 - DNA, 20 bp, Artificial
  CRISPR gRNA sequence
ggtgcaaacatggctcactg

SEQ ID NO: 122779 - DNA, 20 bp, Artificial
  CRISPR gRNA sequence
tcactgaagcctctacctcc

SEQ ID NO: 122780 - DNA, 20 bp, Artificial
  CRISPR gRNA sequence
agcctctacctcccagattc

SEQ ID NO: 122781 - DNA, 20 bp, Artificial
  CRISPR gRNA sequence
ttcaagcaatcctcccacct

SEQ ID NO: 122782 - DNA, 20 bp, Artificial
  CRISPR gRNA sequence
aatcctcccacctcagcccc

SEQ ID NO: 122783 - DNA, 20 bp, Artificial
  CRISPR gRNA sequence
acctcagcccccagccccct

SEQ ID NO: 122784 - DNA, 20 bp, Artificial
  CRISPR gRNA sequence
tcagcccccagccccctaag

SEQ ID NO: 122785 - DNA, 20 bp, Artificial
  CRISPR gRNA sequence
cccccagccccctaagtagc

SEQ ID NO: 122786 - DNA, 20 bp, Artificial
  CRISPR gRNA sequence
ccccagccccctaagtagct

SEQ ID NO: 122787 - DNA, 20 bp, Artificial
  CRISPR gRNA sequence
cccctaagtagctgggacta

SEQ ID NO: 122788 - DNA, 20 bp, Artificial
  CRISPR gRNA sequence
ccctaagtagctgggactac

SEQ ID NO: 122789 - DNA, 20 bp, Artificial
  CRISPR gRNA sequence
gactacaggtacatgccacc

SEQ ID NO: 122790 - DNA, 20 bp, Artificial
  CRISPR gRNA sequence
caggtacatgccaccaagca

SEQ ID NO: 122791 - DNA, 20 bp, Artificial
  CRISPR gRNA sequence
ctaattttttaatttttttg

SEQ ID NO: 122792 - DNA, 20 bp, Artificial
  CRISPR gRNA sequence
aattttttaatttttttgta

SEQ ID NO: 122793 - DNA, 20 bp, Artificial
  CRISPR gRNA sequence
attttttaatttttttgtag

SEQ ID NO: 122794 - DNA, 20 bp, Artificial
  CRISPR gRNA sequence
ttttaatttttttgtagagg

SEQ ID NO: 122795 - DNA, 20 bp, Artificial
  CRISPR gRNA sequence
tttaatttttttgtagaggt

SEQ ID NO: 122796 - DNA, 20 bp, Artificial
  CRISPR gRNA sequence
ttaatttttttgtagaggtg

SEQ ID NO: 122797 - DNA, 20 bp, Artificial
  CRISPR gRNA sequence
tggggtttcaccatgttgcc

SEQ ID NO: 122798 - DNA, 20 bp, Artificial
  CRISPR gRNA sequence
ggggtttcaccatgttgccc

SEQ ID NO: 122799 - DNA, 20 bp, Artificial
  CRISPR gRNA sequence
tttcaccatgttgcccaggc

SEQ ID NO: 122800 - DNA, 20 bp, Artificial
  CRISPR gRNA sequence
caggctggtctcgaactcct

SEQ ID NO: 122801 - DNA, 20 bp, Artificial
  CRISPR gRNA sequence
ggtctcgaactcctgagctc

SEQ ID NO: 122802 - DNA, 20 bp, Artificial
  CRISPR gRNA sequence
accttgccctcccaaactgc

SEQ ID NO: 122803 - DNA, 20 bp, Artificial
  CRISPR gRNA sequence
ccttgccctcccaaactgct

SEQ ID NO: 122804 - DNA, 20 bp, Artificial
  CRISPR gRNA sequence
ctcccaaactgctgggatta

SEQ ID NO: 122805 - DNA, 20 bp, Artificial
  CRISPR gRNA sequence
tcccaaactgctgggattat

SEQ ID NO: 122806 - DNA, 20 bp, Artificial
  CRISPR gRNA sequence
actgctgggattataggtgt

SEQ ID NO: 122807 - DNA, 20 bp, Artificial
  CRISPR gRNA sequence
ataggtgtgagcaccacact

SEQ ID NO: 122808 - DNA, 20 bp, Artificial
  CRISPR gRNA sequence
taccattctaatacctgaca

SEQ ID NO: 122809 - DNA, 20 bp, Artificial
  CRISPR gRNA sequence
ctaatacctgacatagttca

SEQ ID NO: 122810 - DNA, 20 bp, Artificial
  CRISPR gRNA sequence
gaaaaccaaaaataaatcat

SEQ ID NO: 122811 - DNA, 20 bp, Artificial
  CRISPR gRNA sequence
caaaaataaatcataagtgc

SEQ ID NO: 122812 - DNA, 20 bp, Artificial
  CRISPR gRNA sequence
cataagtgcaagaaatataa

SEQ ID NO: 122813 - DNA, 20 bp, Artificial
  CRISPR gRNA sequence
agtgcaagaaatataatagc

SEQ ID NO: 122814 - DNA, 20 bp, Artificial
  CRISPR gRNA sequence
caccctctaaataattattt

SEQ ID NO: 122815 - DNA, 20 bp, Artificial
  CRISPR gRNA sequence
tttcttatttaacatttaaa

SEQ ID NO: 122816 - DNA, 20 bp, Artificial
  CRISPR gRNA sequence
ttcttatttaacatttaaac

SEQ ID NO: 122817 - DNA, 20 bp, Artificial
  CRISPR gRNA sequence
ttatttaacatttaaacagg

SEQ ID NO: 122818 - DNA, 20 bp, Artificial
  CRISPR gRNA sequence
aagtcgataacaaattttaa

SEQ ID NO: 122819 - DNA, 20 bp, Artificial
  CRISPR gRNA sequence
aaattttaaaagaaactgta

SEQ ID NO: 122820 - DNA, 20 bp, Artificial
  CRISPR gRNA sequence
aaaagaaactgtacagattt

SEQ ID NO: 122821 - DNA, 20 bp, Artificial
  CRISPR gRNA sequence
aaactgtacagattttagac

SEQ ID NO: 122822 - DNA, 20 bp, Artificial
  CRISPR gRNA sequence
aactgtacagattttagaca

SEQ ID NO: 122823 - DNA, 20 bp, Artificial
  CRISPR gRNA sequence
ttagacaaggtgtattttta

SEQ ID NO: 122824 - DNA, 20 bp, Artificial
  CRISPR gRNA sequence
aaggtgtatttttatagtaa

SEQ ID NO: 122825 - DNA, 20 bp, Artificial
  CRISPR gRNA sequence
tttatagtaaaagtcttttc

SEQ ID NO: 122826 - DNA, 20 bp, Artificial
  CRISPR gRNA sequence
ttatagtaaaagtcttttca

SEQ ID NO: 122827 - DNA, 20 bp, Artificial
  CRISPR gRNA sequence
ttcaaggactcattcttttg

SEQ ID NO: 122828 - DNA, 20 bp, Artificial
  CRISPR gRNA sequence
aagactatttctaataaaaa

SEQ ID NO: 122829 - DNA, 20 bp, Artificial
  CRISPR gRNA sequence
tatttctaataaaaatagca

SEQ ID NO: 122830 - DNA, 20 bp, Artificial
  CRISPR gRNA sequence
aatagcatggtacgcctttt

SEQ ID NO: 122831 - DNA, 20 bp, Artificial
  CRISPR gRNA sequence
ttctcattgaaccgtaacac

SEQ ID NO: 122832 - DNA, 20 bp, Artificial
  CRISPR gRNA sequence
agattgtaaattttcctata

SEQ ID NO: 122833 - DNA, 20 bp, Artificial
  CRISPR gRNA sequence
aaattttcctataaagacac

SEQ ID NO: 122834 - DNA, 20 bp, Artificial
  CRISPR gRNA sequence
ttttcctataaagacacaag

SEQ ID NO: 122835 - DNA, 20 bp, Artificial
  CRISPR gRNA sequence
ctataaagacacaagtagcc

SEQ ID NO: 122836 - DNA, 20 bp, Artificial
  CRISPR gRNA sequence
tttctaacttgcttcaactt

SEQ ID NO: 122837 - DNA, 20 bp, Artificial
  CRISPR gRNA sequence
cttgcttcaacttgagaatt

SEQ ID NO: 122838 - DNA, 20 bp, Artificial
  CRISPR gRNA sequence
tgagaatttggttctaattg

SEQ ID NO: 122839 - DNA, 20 bp, Artificial
  CRISPR gRNA sequence
tgtggcttgcttaccatcat

SEQ ID NO: 122840 - DNA, 20 bp, Artificial
  CRISPR gRNA sequence
gtggcttgcttaccatcatg

SEQ ID NO: 122841 - DNA, 20 bp, Artificial
  CRISPR gRNA sequence
cataatgacttcctccaata

SEQ ID NO: 122842 - DNA, 20 bp, Artificial
  CRISPR gRNA sequence
acttcctccaatatagtctg

SEQ ID NO: 122843 - DNA, 20 bp, Artificial
  CRISPR gRNA sequence
ttcctccaatatagtctgca

SEQ ID NO: 122844 - DNA, 20 bp, Artificial
  CRISPR gRNA sequence
atatagtctgcagagattcc

SEQ ID NO: 122845 - DNA, 20 bp, Artificial
  CRISPR gRNA sequence
gtctgcagagattcctagtt

SEQ ID NO: 122846 - DNA, 20 bp, Artificial
  CRISPR gRNA sequence
tgcagagattcctagttgag

SEQ ID NO: 122847 - DNA, 20 bp, Artificial
  CRISPR gRNA sequence
tagttgagaagcatctgttg

SEQ ID NO: 122848 - DNA, 20 bp, Artificial
  CRISPR gRNA sequence
aactgtcaccatccatctat

SEQ ID NO: 122849 - DNA, 20 bp, Artificial
  CRISPR gRNA sequence
actgtcaccatccatctatg

SEQ ID NO: 122850 - DNA, 20 bp, Artificial
  CRISPR gRNA sequence
tgtcaccatccatctatgag

SEQ ID NO: 122851 - DNA, 20 bp, Artificial
  CRISPR gRNA sequence
tccatctatgaggagaaaaa

SEQ ID NO: 122852 - DNA, 20 bp, Artificial
  CRISPR gRNA sequence
cagtttttcaatacttttca

SEQ ID NO: 122853 - DNA, 20 bp, Artificial
  CRISPR gRNA sequence
caaagtactaacaaacgtaa

SEQ ID NO: 122854 - DNA, 20 bp, Artificial
  CRISPR gRNA sequence
tcaacacttataaactgtca

SEQ ID NO: 122855 - DNA, 20 bp, Artificial
  CRISPR gRNA sequence
caacacttataaactgtcac

SEQ ID NO: 122856 - DNA, 20 bp, Artificial
  CRISPR gRNA sequence
tgcatcaattatacttttca

SEQ ID NO: 122857 - DNA, 20 bp, Artificial
  CRISPR gRNA sequence
attatacttttcatagcctt

SEQ ID NO: 122858 - DNA, 20 bp, Artificial
  CRISPR gRNA sequence
catagccttaagcttactaa

SEQ ID NO: 122859 - DNA, 20 bp, Artificial
  CRISPR gRNA sequence
tagccttaagcttactaaaa

SEQ ID NO: 122860 - DNA, 20 bp, Artificial
  CRISPR gRNA sequence
aaaaaattaattattttttt

SEQ ID NO: 122861 - DNA, 20 bp, Artificial
  CRISPR gRNA sequence
aattaattatttttttgaga

SEQ ID NO: 122862 - DNA, 20 bp, Artificial
  CRISPR gRNA sequence
attaattatttttttgagac

SEQ ID NO: 122863 - DNA, 20 bp, Artificial
  CRISPR gRNA sequence
ttaattatttttttgagaca

SEQ ID NO: 122864 - DNA, 20 bp, Artificial
  CRISPR gRNA sequence
tgagacagggtcttactctg

SEQ ID NO: 122865 - DNA, 20 bp, Artificial
  CRISPR gRNA sequence
cagggtcttactctgtggcc

SEQ ID NO: 122866 - DNA, 20 bp, Artificial
  CRISPR gRNA sequence
agggtcttactctgtggccc

SEQ ID NO: 122867 - DNA, 20 bp, Artificial
  CRISPR gRNA sequence
tcttactctgtggcccaggc

SEQ ID NO: 122868 - DNA, 20 bp, Artificial
  CRISPR gRNA sequence
ttactctgtggcccaggctg

SEQ ID NO: 122869 - DNA, 20 bp, Artificial
  CRISPR gRNA sequence
ctgtggcccaggctggagtg

SEQ ID NO: 122870 - DNA, 20 bp, Artificial
  CRISPR gRNA sequence
tggcccaggctggagtgcag

SEQ ID NO: 122871 - DNA, 20 bp, Artificial
  CRISPR gRNA sequence
ggagtgcagtggcgtgatca

SEQ ID NO: 122872 - DNA, 20 bp, Artificial
  CRISPR gRNA sequence
ggcgtgatcacagctcactg

SEQ ID NO: 122873 - DNA, 20 bp, Artificial
  CRISPR gRNA sequence
tcactgcagaatccacctcc

SEQ ID NO: 122874 - DNA, 20 bp, Artificial
  CRISPR gRNA sequence
cactgcagaatccacctccc

SEQ ID NO: 122875 - DNA, 20 bp, Artificial
  CRISPR gRNA sequence
agaatccacctcccaggctg

SEQ ID NO: 122876 - DNA, 20 bp, Artificial
  CRISPR gRNA sequence
ctgaagcaatcctcccacct

SEQ ID NO: 122877 - DNA, 20 bp, Artificial
  CRISPR gRNA sequence
tcctcccacctcagcctcct

SEQ ID NO: 122878 - DNA, 20 bp, Artificial
  CRISPR gRNA sequence
tcccacctcagcctcctgag

SEQ ID NO: 122879 - DNA, 20 bp, Artificial
  CRISPR gRNA sequence
acctcagcctcctgagtagc

SEQ ID NO: 122880 - DNA, 20 bp, Artificial
  CRISPR gRNA sequence
cctcctgagtagctggacta

SEQ ID NO: 122881 - DNA, 20 bp, Artificial
  CRISPR gRNA sequence
ctcctgagtagctggactac

SEQ ID NO: 122882 - DNA, 20 bp, Artificial
  CRISPR gRNA sequence
caggcatgcaccaccatgcc

SEQ ID NO: 122883 - DNA, 20 bp, Artificial
  CRISPR gRNA sequence
ggccaatttttttgtatttt

SEQ ID NO: 122884 - DNA, 20 bp, Artificial
  CRISPR gRNA sequence
caatttttttgtatttttag

SEQ ID NO: 122885 - DNA, 20 bp, Artificial
  CRISPR gRNA sequence
atttttttgtatttttagca

SEQ ID NO: 122886 - DNA, 20 bp, Artificial
  CRISPR gRNA sequence
ttttgtatttttagcagaga

SEQ ID NO: 122887 - DNA, 20 bp, Artificial
  CRISPR gRNA sequence
tttgtatttttagcagagac

SEQ ID NO: 122888 - DNA, 20 bp, Artificial
  CRISPR gRNA sequence
ttgtatttttagcagagaca

SEQ ID NO: 122889 - DNA, 20 bp, Artificial
  CRISPR gRNA sequence
cagggttttgctatgttgcc

SEQ ID NO: 122890 - DNA, 20 bp, Artificial
  CRISPR gRNA sequence
agggttttgctatgttgccc

SEQ ID NO: 122891 - DNA, 20 bp, Artificial
  CRISPR gRNA sequence
ttttgctatgttgcccaggc

SEQ ID NO: 122892 - DNA, 20 bp, Artificial
  CRISPR gRNA sequence
ctatgttgcccaggctggtc

SEQ ID NO: 122893 - DNA, 20 bp, Artificial
  CRISPR gRNA sequence
ccaggctggtctggaactcc

SEQ ID NO: 122894 - DNA, 20 bp, Artificial
  CRISPR gRNA sequence
caggctggtctggaactcct

SEQ ID NO: 122895 - DNA, 20 bp, Artificial
  CRISPR gRNA sequence
ctcaaacaaaccacctacct

SEQ ID NO: 122896 - DNA, 20 bp, Artificial
  CRISPR gRNA sequence
cctcagcctcccaaaatgct

SEQ ID NO: 122897 - DNA, 20 bp, Artificial
  CRISPR gRNA sequence
ctcccaaaatgctgagatta

SEQ ID NO: 122898 - DNA, 20 bp, Artificial
  CRISPR gRNA sequence
tcccaaaatgctgagattac

SEQ ID NO: 122899 - DNA, 20 bp, Artificial
  CRISPR gRNA sequence
aatgctgagattacaggcat

SEQ ID NO: 122900 - DNA, 20 bp, Artificial
  CRISPR gRNA sequence
caggcatcagccaccgcaac

SEQ ID NO: 122901 - DNA, 20 bp, Artificial
  CRISPR gRNA sequence
ccagcctatatttcttgatt

SEQ ID NO: 122902 - DNA, 20 bp, Artificial
  CRISPR gRNA sequence
ccacaatttgtccacgattc

SEQ ID NO: 122903 - DNA, 20 bp, Artificial
  CRISPR gRNA sequence
tttccctatccatcttccat

SEQ ID NO: 122904 - DNA, 20 bp, Artificial
  CRISPR gRNA sequence
ccatcttccataagtgatat

SEQ ID NO: 122905 - DNA, 20 bp, Artificial
  CRISPR gRNA sequence
tccataagtgatataagcat

SEQ ID NO: 122906 - DNA, 20 bp, Artificial
  CRISPR gRNA sequence
ccataagtgatataagcata

SEQ ID NO: 122907 - DNA, 20 bp, Artificial
  CRISPR gRNA sequence
tgatataagcataaggccaa

SEQ ID NO: 122908 - DNA, 20 bp, Artificial
  CRISPR gRNA sequence
agcataaggccaatagcgac

SEQ ID NO: 122909 - DNA, 20 bp, Artificial
  CRISPR gRNA sequence
gcataaggccaatagcgaca

SEQ ID NO: 122910 - DNA, 20 bp, Artificial
  CRISPR gRNA sequence
gcgacaaggaaatgaatcta

SEQ ID NO: 122911 - DNA, 20 bp, Artificial
  CRISPR gRNA sequence
gcatatgcctctttcttttt

SEQ ID NO: 122912 - DNA, 20 bp, Artificial
  CRISPR gRNA sequence
aagtgcataatcttcaaata

SEQ ID NO: 122913 - DNA, 20 bp, Artificial
  CRISPR gRNA sequence
aatcttcaaatatagtacca

SEQ ID NO: 122914 - DNA, 20 bp, Artificial
  CRISPR gRNA sequence
atcttcaaatatagtaccac

SEQ ID NO: 122915 - DNA, 20 bp, Artificial
  CRISPR gRNA sequence
cttacaacctaatttatccc

SEQ ID NO: 122916 - DNA, 20 bp, Artificial
  CRISPR gRNA sequence
tttatccctggaatgatgat

SEQ ID NO: 122917 - DNA, 20 bp, Artificial
  CRISPR gRNA sequence
ccctggaatgatgatcagct

SEQ ID NO: 122918 - DNA, 20 bp, Artificial
  CRISPR gRNA sequence
gaatgatgatcagcttagta

SEQ ID NO: 122919 - DNA, 20 bp, Artificial
  CRISPR gRNA sequence
cagcttagtaaagctgtaca

SEQ ID NO: 122920 - DNA, 20 bp, Artificial
  CRISPR gRNA sequence
tacacagtgtcatgtacctg

SEQ ID NO: 122921 - DNA, 20 bp, Artificial
  CRISPR gRNA sequence
tacctgtagccccaactgct

SEQ ID NO: 122922 - DNA, 20 bp, Artificial
  CRISPR gRNA sequence
ctgtagccccaactgctcag

SEQ ID NO: 122923 - DNA, 20 bp, Artificial
  CRISPR gRNA sequence
ccccaactgctcagaagctg

SEQ ID NO: 122924 - DNA, 20 bp, Artificial
  CRISPR gRNA sequence
caactgctcagaagctgaag

SEQ ID NO: 122925 - DNA, 20 bp, Artificial
  CRISPR gRNA sequence
aactgctcagaagctgaagc

SEQ ID NO: 122926 - DNA, 20 bp, Artificial
  CRISPR gRNA sequence
ctgctcagaagctgaagcag

SEQ ID NO: 122927 - DNA, 20 bp, Artificial
  CRISPR gRNA sequence
tgctcagaagctgaagcagg

SEQ ID NO: 122928 - DNA, 20 bp, Artificial
  CRISPR gRNA sequence
ctgaagcaggaggactgctt

SEQ ID NO: 122929 - DNA, 20 bp, Artificial
  CRISPR gRNA sequence
caggaggactgcttgagctc

SEQ ID NO: 122930 - DNA, 20 bp, Artificial
  CRISPR gRNA sequence
ggaggactgcttgagctcaa

SEQ ID NO: 122931 - DNA, 20 bp, Artificial
  CRISPR gRNA sequence
ctgcttgagctcaagagttc

SEQ ID NO: 122932 - DNA, 20 bp, Artificial
  CRISPR gRNA sequence
tgagctcaagagttccagac

SEQ ID NO: 122933 - DNA, 20 bp, Artificial
  CRISPR gRNA sequence
tcaagagttccagaccagcc

SEQ ID NO: 122934 - DNA, 20 bp, Artificial
  CRISPR gRNA sequence
ccagaccagcctggtcaatg

SEQ ID NO: 122935 - DNA, 20 bp, Artificial
  CRISPR gRNA sequence
accagcctggtcaatgtagt

SEQ ID NO: 122936 - DNA, 20 bp, Artificial
  CRISPR gRNA sequence
tgtctcttaaaaaaaaaaat

SEQ ID NO: 122937 - DNA, 20 bp, Artificial
  CRISPR gRNA sequence
ttaaaaaaaaaaatcagctt

SEQ ID NO: 122938 - DNA, 20 bp, Artificial
  CRISPR gRNA sequence
aatcagcttaagtcatcaac

SEQ ID NO: 122939 - DNA, 20 bp, Artificial
  CRISPR gRNA sequence
tcacctgtatccatcacttc

SEQ ID NO: 122940 - DNA, 20 bp, Artificial
  CRISPR gRNA sequence
gaactttctttgctttctca

SEQ ID NO: 122941 - DNA, 20 bp, Artificial
  CRISPR gRNA sequence
ctttctttgctttctcatag

SEQ ID NO: 122942 - DNA, 20 bp, Artificial
  CRISPR gRNA sequence
ttctcatagaagttccaaaa

SEQ ID NO: 122943 - DNA, 20 bp, Artificial
  CRISPR gRNA sequence
tctccgttcaaactgttact

SEQ ID NO: 122944 - DNA, 20 bp, Artificial
  CRISPR gRNA sequence
ttcaaactgttacttggtat

SEQ ID NO: 122945 - DNA, 20 bp, Artificial
  CRISPR gRNA sequence
aaactgttacttggtataag

SEQ ID NO: 122946 - DNA, 20 bp, Artificial
  CRISPR gRNA sequence
tacttggtataagaagcatg

SEQ ID NO: 122947 - DNA, 20 bp, Artificial
  CRISPR gRNA sequence
tctctgcacaattctgtacc

SEQ ID NO: 122948 - DNA, 20 bp, Artificial
  CRISPR gRNA sequence
ctctgcacaattctgtaccc

SEQ ID NO: 122949 - DNA, 20 bp, Artificial
  CRISPR gRNA sequence
gcacaattctgtacccaggc

SEQ ID NO: 122950 - DNA, 20 bp, Artificial
  CRISPR gRNA sequence
tctgtacccaggcaagccaa

SEQ ID NO: 122951 - DNA, 20 bp, Artificial
  CRISPR gRNA sequence
aacccataaactcctgattc

SEQ ID NO: 122952 - DNA, 20 bp, Artificial
  CRISPR gRNA sequence
taaactcctgattctagtca

SEQ ID NO: 122953 - DNA, 20 bp, Artificial
  CRISPR gRNA sequence
aaactcctgattctagtcaa

SEQ ID NO: 122954 - DNA, 20 bp, Artificial
  CRISPR gRNA sequence
tttctctccccctgccaaat

SEQ ID NO: 122955 - DNA, 20 bp, Artificial
  CRISPR gRNA sequence
ttctctccccctgccaaatc

SEQ ID NO: 122956 - DNA, 20 bp, Artificial
  CRISPR gRNA sequence
tctctccccctgccaaatca

SEQ ID NO: 122957 - DNA, 20 bp, Artificial
  CRISPR gRNA sequence
tccccctgccaaatcagggc

SEQ ID NO: 122958 - DNA, 20 bp, Artificial
  CRISPR gRNA sequence
ccccctgccaaatcagggcc

SEQ ID NO: 122959 - DNA, 20 bp, Artificial
  CRISPR gRNA sequence
tgccaaatcagggccaggtg

SEQ ID NO: 122960 - DNA, 20 bp, Artificial
  CRISPR gRNA sequence
gtggctcatgcctgtaatcc

SEQ ID NO: 122961 - DNA, 20 bp, Artificial
  CRISPR gRNA sequence
tgcctgtaatcccagaactt

SEQ ID NO: 122962 - DNA, 20 bp, Artificial
  CRISPR gRNA sequence
gcctgtaatcccagaacttt

SEQ ID NO: 122963 - DNA, 20 bp, Artificial
  CRISPR gRNA sequence
tgtaatcccagaactttggg

SEQ ID NO: 122964 - DNA, 20 bp, Artificial
  CRISPR gRNA sequence
tcccagaactttgggaagcc

SEQ ID NO: 122965 - DNA, 20 bp, Artificial
  CRISPR gRNA sequence
cccagaactttgggaagcca

SEQ ID NO: 122966 - DNA, 20 bp, Artificial
  CRISPR gRNA sequence
agaactttgggaagccaagg

SEQ ID NO: 122967 - DNA, 20 bp, Artificial
  CRISPR gRNA sequence
gaactttgggaagccaaggt

SEQ ID NO: 122968 - DNA, 20 bp, Artificial
  CRISPR gRNA sequence
actttgggaagccaaggtgg

SEQ ID NO: 122969 - DNA, 20 bp, Artificial
  CRISPR gRNA sequence
ctttgggaagccaaggtggg

SEQ ID NO: 122970 - DNA, 20 bp, Artificial
  CRISPR gRNA sequence
gccaaggtgggaggatcact

SEQ ID NO: 122971 - DNA, 20 bp, Artificial
  CRISPR gRNA sequence
ccaaggtgggaggatcactt

SEQ ID NO: 122972 - DNA, 20 bp, Artificial
  CRISPR gRNA sequence
gtgggaggatcacttgggcc

SEQ ID NO: 122973 - DNA, 20 bp, Artificial
  CRISPR gRNA sequence
ggaggatcacttgggcccag

SEQ ID NO: 122974 - DNA, 20 bp, Artificial
  CRISPR gRNA sequence
tcacttgggcccagaagttc

SEQ ID NO: 122975 - DNA, 20 bp, Artificial
  CRISPR gRNA sequence
tgggcccagaagttcaagat

SEQ ID NO: 122976 - DNA, 20 bp, Artificial
  CRISPR gRNA sequence
ccagaagttcaagatcagcc

SEQ ID NO: 122977 - DNA, 20 bp, Artificial
  CRISPR gRNA sequence
cagaagttcaagatcagcct

SEQ ID NO: 122978 - DNA, 20 bp, Artificial
  CRISPR gRNA sequence
caagatcagcctgggcaaca

SEQ ID NO: 122979 - DNA, 20 bp, Artificial
  CRISPR gRNA sequence
atcagcctgggcaacacagt

SEQ ID NO: 122980 - DNA, 20 bp, Artificial
  CRISPR gRNA sequence
tctaaaaaaaaacaaaaatt

SEQ ID NO: 122981 - DNA, 20 bp, Artificial
  CRISPR gRNA sequence
aaaaacaaaaattaagaaat

SEQ ID NO: 122982 - DNA, 20 bp, Artificial
  CRISPR gRNA sequence
acaaaaattaagaaattagc

SEQ ID NO: 122983 - DNA, 20 bp, Artificial
  CRISPR gRNA sequence
caaaaattaagaaattagcc

SEQ ID NO: 122984 - DNA, 20 bp, Artificial
  CRISPR gRNA sequence
aagaaattagccaggcgttg

SEQ ID NO: 122985 - DNA, 20 bp, Artificial
  CRISPR gRNA sequence
ggcgttgtggcatgtgcctg

SEQ ID NO: 122986 - DNA, 20 bp, Artificial
  CRISPR gRNA sequence
gcctgtagtcctaactactt

SEQ ID NO: 122987 - DNA, 20 bp, Artificial
  CRISPR gRNA sequence
ctgtagtcctaactacttga

SEQ ID NO: 122988 - DNA, 20 bp, Artificial
  CRISPR gRNA sequence
tgtagtcctaactacttgag

SEQ ID NO: 122989 - DNA, 20 bp, Artificial
  CRISPR gRNA sequence
tcctaactacttgagaggct

SEQ ID NO: 122990 - DNA, 20 bp, Artificial
  CRISPR gRNA sequence
cctaactacttgagaggctg

SEQ ID NO: 122991 - DNA, 20 bp, Artificial
  CRISPR gRNA sequence
aactacttgagaggctgagg

SEQ ID NO: 122992 - DNA, 20 bp, Artificial
  CRISPR gRNA sequence
actacttgagaggctgaggt

SEQ ID NO: 122993 - DNA, 20 bp, Artificial
  CRISPR gRNA sequence
acttgagaggctgaggtggg

SEQ ID NO: 122994 - DNA, 20 bp, Artificial
  CRISPR gRNA sequence
ctgaggtgggaagatcactt

SEQ ID NO: 122995 - DNA, 20 bp, Artificial
  CRISPR gRNA sequence
gtgggaagatcacttgagcc

SEQ ID NO: 122996 - DNA, 20 bp, Artificial
  CRISPR gRNA sequence
tgggaagatcacttgagcct

SEQ ID NO: 122997 - DNA, 20 bp, Artificial
  CRISPR gRNA sequence
ggaagatcacttgagcctag

SEQ ID NO: 122998 - DNA, 20 bp, Artificial
  CRISPR gRNA sequence
gaagatcacttgagcctagg

SEQ ID NO: 122999 - DNA, 20 bp, Artificial
  CRISPR gRNA sequence
tcacttgagcctaggaggtt

SEQ ID NO: 123000 - DNA, 20 bp, Artificial
  CRISPR gRNA sequence
cacttgagcctaggaggttg

SEQ ID NO: 123001 - DNA, 20 bp, Artificial
  CRISPR gRNA sequence
agcctaggaggttgaggctg

SEQ ID NO: 123002 - DNA, 20 bp, Artificial
  CRISPR gRNA sequence
taggaggttgaggctgcagt

SEQ ID NO: 123003 - DNA, 20 bp, Artificial
  CRISPR gRNA sequence
gtgatcacaccactgcactc

SEQ ID NO: 123004 - DNA, 20 bp, Artificial
  CRISPR gRNA sequence
acaccactgcactccagcct

SEQ ID NO: 123005 - DNA, 20 bp, Artificial
  CRISPR gRNA sequence
ctgcactccagcctcagtga

SEQ ID NO: 123006 - DNA, 20 bp, Artificial
  CRISPR gRNA sequence
gcactccagcctcagtgaca

SEQ ID NO: 123007 - DNA, 20 bp, Artificial
  CRISPR gRNA sequence
ctccagcctcagtgacagag

SEQ ID NO: 123008 - DNA, 20 bp, Artificial
  CRISPR gRNA sequence
tccagcctcagtgacagagt

SEQ ID NO: 123009 - DNA, 20 bp, Artificial
  CRISPR gRNA sequence
ccagcctcagtgacagagtg

SEQ ID NO: 123010 - DNA, 20 bp, Artificial
  CRISPR gRNA sequence
cctcagtgacagagtggggt

SEQ ID NO: 123011 - DNA, 20 bp, Artificial
  CRISPR gRNA sequence
ctcagtgacagagtggggtc

SEQ ID NO: 123012 - DNA, 20 bp, Artificial
  CRISPR gRNA sequence
cagtgacagagtggggtcag

SEQ ID NO: 123013 - DNA, 20 bp, Artificial
  CRISPR gRNA sequence
agtgacagagtggggtcagg

SEQ ID NO: 123014 - DNA, 20 bp, Artificial
  CRISPR gRNA sequence
tgacagagtggggtcaggag

SEQ ID NO: 123015 - DNA, 20 bp, Artificial
  CRISPR gRNA sequence
gacagagtggggtcaggagg

SEQ ID NO: 123016 - DNA, 20 bp, Artificial
  CRISPR gRNA sequence
acagagtggggtcaggagga

SEQ ID NO: 123017 - DNA, 20 bp, Artificial
  CRISPR gRNA sequence
cagagtggggtcaggaggag

SEQ ID NO: 123018 - DNA, 20 bp, Artificial
  CRISPR gRNA sequence
gtggggtcaggaggaggggt

SEQ ID NO: 123019 - DNA, 20 bp, Artificial
  CRISPR gRNA sequence
tggggtcaggaggaggggtc

SEQ ID NO: 123020 - DNA, 20 bp, Artificial
  CRISPR gRNA sequence
ggtcaggaggaggggtcagg

SEQ ID NO: 123021 - DNA, 20 bp, Artificial
  CRISPR gRNA sequence
gtcaggaagatctatgtata

SEQ ID NO: 123022 - DNA, 20 bp, Artificial
  CRISPR gRNA sequence
ggaagatctatgtataaaga

SEQ ID NO: 123023 - DNA, 20 bp, Artificial
  CRISPR gRNA sequence
gaagatctatgtataaagat

SEQ ID NO: 123024 - DNA, 20 bp, Artificial
  CRISPR gRNA sequence
agataggaaaattacctgca

SEQ ID NO: 123025 - DNA, 20 bp, Artificial
  CRISPR gRNA sequence
ggaaaattacctgcacagac

SEQ ID NO: 123026 - DNA, 20 bp, Artificial
  CRISPR gRNA sequence
ttacctgcacagacaagaat

SEQ ID NO: 123027 - DNA, 20 bp, Artificial
  CRISPR gRNA sequence
acctgcacagacaagaataa

SEQ ID NO: 123028 - DNA, 20 bp, Artificial
  CRISPR gRNA sequence
taaaattcctattttaaaaa

SEQ ID NO: 123029 - DNA, 20 bp, Artificial
  CRISPR gRNA sequence
cctgcttaattaattttgct

SEQ ID NO: 123030 - DNA, 20 bp, Artificial
  CRISPR gRNA sequence
tgcttaattaattttgctga

SEQ ID NO: 123031 - DNA, 20 bp, Artificial
  CRISPR gRNA sequence
ttaattttgctgagagctaa

SEQ ID NO: 123032 - DNA, 20 bp, Artificial
  CRISPR gRNA sequence
ctgagagctaaaagaattcc

SEQ ID NO: 123033 - DNA, 20 bp, Artificial
  CRISPR gRNA sequence
gagagctaaaagaattccaa

SEQ ID NO: 123034 - DNA, 20 bp, Artificial
  CRISPR gRNA sequence
agagctaaaagaattccaag

SEQ ID NO: 123035 - DNA, 20 bp, Artificial
  CRISPR gRNA sequence
gagctaaaagaattccaaga

SEQ ID NO: 123036 - DNA, 20 bp, Artificial
  CRISPR gRNA sequence
taaaagaattccaagaggga

SEQ ID NO: 123037 - DNA, 20 bp, Artificial
  CRISPR gRNA sequence
gaattccaagagggaaagtc

SEQ ID NO: 123038 - DNA, 20 bp, Artificial
  CRISPR gRNA sequence
aagagggaaagtctggaaaa

SEQ ID NO: 123039 - DNA, 20 bp, Artificial
  CRISPR gRNA sequence
tctggaaaaaagtaaatcat

SEQ ID NO: 123040 - DNA, 20 bp, Artificial
  CRISPR gRNA sequence
aaaagtaaatcataagccct

SEQ ID NO: 123041 - DNA, 20 bp, Artificial
  CRISPR gRNA sequence
gtaaatcataagccctgagc

SEQ ID NO: 123042 - DNA, 20 bp, Artificial
  CRISPR gRNA sequence
tccattcaatttcaccaaca

SEQ ID NO: 123043 - DNA, 20 bp, Artificial
  CRISPR gRNA sequence
attcaatttcaccaacatgg

SEQ ID NO: 123044 - DNA, 20 bp, Artificial
  CRISPR gRNA sequence
ttcaccaacatggcagatcc

SEQ ID NO: 123045 - DNA, 20 bp, Artificial
  CRISPR gRNA sequence
accaacatggcagatcctag

SEQ ID NO: 123046 - DNA, 20 bp, Artificial
  CRISPR gRNA sequence
ccaacatggcagatcctaga

SEQ ID NO: 123047 - DNA, 20 bp, Artificial
  CRISPR gRNA sequence
caaatactactactcaaaat

SEQ ID NO: 123048 - DNA, 20 bp, Artificial
  CRISPR gRNA sequence
actcaaaataagatatctgt

SEQ ID NO: 123049 - DNA, 20 bp, Artificial
  CRISPR gRNA sequence
aaatgcattatctgaataaa

SEQ ID NO: 123050 - DNA, 20 bp, Artificial
  CRISPR gRNA sequence
cattatctgaataaaaagta

SEQ ID NO: 123051 - DNA, 20 bp, Artificial
  CRISPR gRNA sequence
taaaaagtatagcaaaaatc

SEQ ID NO: 123052 - DNA, 20 bp, Artificial
  CRISPR gRNA sequence
gtgtaattcatacatacttt

SEQ ID NO: 123053 - DNA, 20 bp, Artificial
  CRISPR gRNA sequence
tgtaattcatacatactttc

SEQ ID NO: 123054 - DNA, 20 bp, Artificial
  CRISPR gRNA sequence
acatactttcaggctgaaca

SEQ ID NO: 123055 - DNA, 20 bp, Artificial
  CRISPR gRNA sequence
aagaaatttgacccttcatt

SEQ ID NO: 123056 - DNA, 20 bp, Artificial
  CRISPR gRNA sequence
agaaatttgacccttcatta

SEQ ID NO: 123057 - DNA, 20 bp, Artificial
  CRISPR gRNA sequence
tttgacccttcattaaggcc

SEQ ID NO: 123058 - DNA, 20 bp, Artificial
  CRISPR gRNA sequence
ttgacccttcattaaggccc

SEQ ID NO: 123059 - DNA, 20 bp, Artificial
  CRISPR gRNA sequence
cttcattaaggcccaggacc

SEQ ID NO: 123060 - DNA, 20 bp, Artificial
  CRISPR gRNA sequence
tgttattaattgcaaaattt

SEQ ID NO: 123061 - DNA, 20 bp, Artificial
  CRISPR gRNA sequence
tttatttaatattaaaatac

SEQ ID NO: 123062 - DNA, 20 bp, Artificial
  CRISPR gRNA sequence
ttatttaatattaaaatact

SEQ ID NO: 123063 - DNA, 20 bp, Artificial
  CRISPR gRNA sequence
ttaatattaaaatactgggc

SEQ ID NO: 123064 - DNA, 20 bp, Artificial
  CRISPR gRNA sequence
taaaatactgggctagtttc

SEQ ID NO: 123065 - DNA, 20 bp, Artificial
  CRISPR gRNA sequence
aaaatactgggctagtttcc

SEQ ID NO: 123066 - DNA, 20 bp, Artificial
  CRISPR gRNA sequence
tttccaggtcttcaataaca

SEQ ID NO: 123067 - DNA, 20 bp, Artificial
  CRISPR gRNA sequence
tgtgatgcctaatataactg

SEQ ID NO: 123068 - DNA, 20 bp, Artificial
  CRISPR gRNA sequence
atgcctaatataactgtaga

SEQ ID NO: 123069 - DNA, 20 bp, Artificial
  CRISPR gRNA sequence
gcctaatataactgtagata

SEQ ID NO: 123070 - DNA, 20 bp, Artificial
  CRISPR gRNA sequence
acacatttctataatttata

SEQ ID NO: 123071 - DNA, 20 bp, Artificial
  CRISPR gRNA sequence
ataatttatatagttgttgt

SEQ ID NO: 123072 - DNA, 20 bp, Artificial
  CRISPR gRNA sequence
taatttatatagttgttgta

SEQ ID NO: 123073 - DNA, 20 bp, Artificial
  CRISPR gRNA sequence
aatttatatagttgttgtaa

SEQ ID NO: 123074 - DNA, 20 bp, Artificial
  CRISPR gRNA sequence
atttatatagttgttgtaag

SEQ ID NO: 123075 - DNA, 20 bp, Artificial
  CRISPR gRNA sequence
tttatatagttgttgtaagg

SEQ ID NO: 123076 - DNA, 20 bp, Artificial
  CRISPR gRNA sequence
atatagttgttgtaaggggg

SEQ ID NO: 123077 - DNA, 20 bp, Artificial
  CRISPR gRNA sequence
tgttgtaagggggtagaaaa

SEQ ID NO: 123078 - DNA, 20 bp, Artificial
  CRISPR gRNA sequence
ggggtagaaaatagaattta

SEQ ID NO: 123079 - DNA, 20 bp, Artificial
  CRISPR gRNA sequence
cctttaataatctgtgaaca

SEQ ID NO: 123080 - DNA, 20 bp, Artificial
  CRISPR gRNA sequence
ctttaataatctgtgaacat

SEQ ID NO: 123081 - DNA, 20 bp, Artificial
  CRISPR gRNA sequence
tttaataatctgtgaacata

SEQ ID NO: 123082 - DNA, 20 bp, Artificial
  CRISPR gRNA sequence
gggtacctatttgatacttt

SEQ ID NO: 123083 - DNA, 20 bp, Artificial
  CRISPR gRNA sequence
tacctatttgatacttttag

SEQ ID NO: 123084 - DNA, 20 bp, Artificial
  CRISPR gRNA sequence
tgatacttttagtagcctct

SEQ ID NO: 123085 - DNA, 20 bp, Artificial
  CRISPR gRNA sequence
tacttttagtagcctctaag

SEQ ID NO: 123086 - DNA, 20 bp, Artificial
  CRISPR gRNA sequence
cctctaagaagtaaacaaca

SEQ ID NO: 123087 - DNA, 20 bp, Artificial
  CRISPR gRNA sequence
taagaagtaaacaacaaagt

SEQ ID NO: 123088 - DNA, 20 bp, Artificial
  CRISPR gRNA sequence
cctactgatcccctgaaaat

SEQ ID NO: 123089 - DNA, 20 bp, Artificial
  CRISPR gRNA sequence
taacacaaataaatgtgaaa

SEQ ID NO: 123090 - DNA, 20 bp, Artificial
  CRISPR gRNA sequence
atcttaaaatgctaacatac

SEQ ID NO: 123091 - DNA, 20 bp, Artificial
  CRISPR gRNA sequence
tcttaaaatgctaacatact

SEQ ID NO: 123092 - DNA, 20 bp, Artificial
  CRISPR gRNA sequence
ttaaaatgctaacatactag

SEQ ID NO: 123093 - DNA, 20 bp, Artificial
  CRISPR gRNA sequence
aaaatgctaacatactagga

SEQ ID NO: 123094 - DNA, 20 bp, Artificial
  CRISPR gRNA sequence
actaggagagtatcctttaa

SEQ ID NO: 123095 - DNA, 20 bp, Artificial
  CRISPR gRNA sequence
gtatcctttaatagacatga

SEQ ID NO: 123096 - DNA, 20 bp, Artificial
  CRISPR gRNA sequence
acatgatggattttttttta

SEQ ID NO: 123097 - DNA, 20 bp, Artificial
  CRISPR gRNA sequence
atttttttttacagccataa

SEQ ID NO: 123098 - DNA, 20 bp, Artificial
  CRISPR gRNA sequence
tgatcaattatgatacctgt

SEQ ID NO: 123099 - DNA, 20 bp, Artificial
  CRISPR gRNA sequence
tatgatacctgtgagttgac

SEQ ID NO: 123100 - DNA, 20 bp, Artificial
  CRISPR gRNA sequence
actagcttttacaataacct

SEQ ID NO: 123101 - DNA, 20 bp, Artificial
  CRISPR gRNA sequence
ctagcttttacaataaccta

SEQ ID NO: 123102 - DNA, 20 bp, Artificial
  CRISPR gRNA sequence
gcttttacaataacctaagg

SEQ ID NO: 123103 - DNA, 20 bp, Artificial
  CRISPR gRNA sequence
acaataacctaaggaagatc

SEQ ID NO: 123104 - DNA, 20 bp, Artificial
  CRISPR gRNA sequence
caataacctaaggaagatca

SEQ ID NO: 123105 - DNA, 20 bp, Artificial
  CRISPR gRNA sequence
acctaaggaagatcaaggtg

SEQ ID NO: 123106 - DNA, 20 bp, Artificial
  CRISPR gRNA sequence
cctaaggaagatcaaggtgc

SEQ ID NO: 123107 - DNA, 20 bp, Artificial
  CRISPR gRNA sequence
taaggaagatcaaggtgcag

SEQ ID NO: 123108 - DNA, 20 bp, Artificial
  CRISPR gRNA sequence
gaagatcaaggtgcaggaga

SEQ ID NO: 123109 - DNA, 20 bp, Artificial
  CRISPR gRNA sequence
aagatcaaggtgcaggagac

SEQ ID NO: 123110 - DNA, 20 bp, Artificial
  CRISPR gRNA sequence
aggtgcaggagacaggacca

SEQ ID NO: 123111 - DNA, 20 bp, Artificial
  CRISPR gRNA sequence
tgcaggagacaggaccaaag

SEQ ID NO: 123112 - DNA, 20 bp, Artificial
  CRISPR gRNA sequence
caggaccaaagtggttgttt

SEQ ID NO: 123113 - DNA, 20 bp, Artificial
  CRISPR gRNA sequence
ggaccaaagtggttgtttca

SEQ ID NO: 123114 - DNA, 20 bp, Artificial
  CRISPR gRNA sequence
gttgtttcagagcctacaat

SEQ ID NO: 123115 - DNA, 20 bp, Artificial
  CRISPR gRNA sequence
ctacaattggaaacaaactt

SEQ ID NO: 123116 - DNA, 20 bp, Artificial
  CRISPR gRNA sequence
aattggaaacaaactttggt

SEQ ID NO: 123117 - DNA, 20 bp, Artificial
  CRISPR gRNA sequence
attggaaacaaactttggtt

SEQ ID NO: 123118 - DNA, 20 bp, Artificial
  CRISPR gRNA sequence
ttggaaacaaactttggttg

SEQ ID NO: 123119 - DNA, 20 bp, Artificial
  CRISPR gRNA sequence
tggaaacaaactttggttgg

SEQ ID NO: 123120 - DNA, 20 bp, Artificial
  CRISPR gRNA sequence
aaacaaactttggttggggg

SEQ ID NO: 123121 - DNA, 20 bp, Artificial
  CRISPR gRNA sequence
aacaaactttggttgggggt

SEQ ID NO: 123122 - DNA, 20 bp, Artificial
  CRISPR gRNA sequence
acaaactttggttgggggtg

SEQ ID NO: 123123 - DNA, 20 bp, Artificial
  CRISPR gRNA sequence
aaactttggttgggggtggg

SEQ ID NO: 123124 - DNA, 20 bp, Artificial
  CRISPR gRNA sequence
aactttggttgggggtgggg

SEQ ID NO: 123125 - DNA, 20 bp, Artificial
  CRISPR gRNA sequence
actttggttgggggtgggga

SEQ ID NO: 123126 - DNA, 20 bp, Artificial
  CRISPR gRNA sequence
ttggttgggggtggggaggg

SEQ ID NO: 123127 - DNA, 20 bp, Artificial
  CRISPR gRNA sequence
tggttgggggtggggagggc

SEQ ID NO: 123128 - DNA, 20 bp, Artificial
  CRISPR gRNA sequence
ttgggggtggggagggcagg

SEQ ID NO: 123129 - DNA, 20 bp, Artificial
  CRISPR gRNA sequence
ggggtggggagggcaggcgg

SEQ ID NO: 123130 - DNA, 20 bp, Artificial
  CRISPR gRNA sequence
gggtggggagggcaggcggt

SEQ ID NO: 123131 - DNA, 20 bp, Artificial
  CRISPR gRNA sequence
ggggagggcaggcggtgggt

SEQ ID NO: 123132 - DNA, 20 bp, Artificial
  CRISPR gRNA sequence
gggagggcaggcggtgggtt

SEQ ID NO: 123133 - DNA, 20 bp, Artificial
  CRISPR gRNA sequence
agggcaggcggtgggttggg

SEQ ID NO: 123134 - DNA, 20 bp, Artificial
  CRISPR gRNA sequence
cggtgggttgggaagaataa

SEQ ID NO: 123135 - DNA, 20 bp, Artificial
  CRISPR gRNA sequence
acagaaattctttcctgaat

SEQ ID NO: 123136 - DNA, 20 bp, Artificial
  CRISPR gRNA sequence
agtgtttacatgataccatt

SEQ ID NO: 123137 - DNA, 20 bp, Artificial
  CRISPR gRNA sequence
accattaagtcttttaaaat

SEQ ID NO: 123138 - DNA, 20 bp, Artificial
  CRISPR gRNA sequence
agtcttttaaaattggctat

SEQ ID NO: 123139 - DNA, 20 bp, Artificial
  CRISPR gRNA sequence
ttttaaaattggctatgagc

SEQ ID NO: 123140 - DNA, 20 bp, Artificial
  CRISPR gRNA sequence
caagacactgttcaaataac

SEQ ID NO: 123141 - DNA, 20 bp, Artificial
  CRISPR gRNA sequence
aagacactgttcaaataacc

SEQ ID NO: 123142 - DNA, 20 bp, Artificial
  CRISPR gRNA sequence
acactgttcaaataaccagg

SEQ ID NO: 123143 - DNA, 20 bp, Artificial
  CRISPR gRNA sequence
ttcaaataaccaggcggatc

SEQ ID NO: 123144 - DNA, 20 bp, Artificial
  CRISPR gRNA sequence
tcaaataaccaggcggatct

SEQ ID NO: 123145 - DNA, 20 bp, Artificial
  CRISPR gRNA sequence
aaataaccaggcggatctgg

SEQ ID NO: 123146 - DNA, 20 bp, Artificial
  CRISPR gRNA sequence
atctgggagatgaattaatt

SEQ ID NO: 123147 - DNA, 20 bp, Artificial
  CRISPR gRNA sequence
tagaaatataacacaaacaa

SEQ ID NO: 123148 - DNA, 20 bp, Artificial
  CRISPR gRNA sequence
taacacaaacaaaagtatta

SEQ ID NO: 123149 - DNA, 20 bp, Artificial
  CRISPR gRNA sequence
aacacaaacaaaagtattaa

SEQ ID NO: 123150 - DNA, 20 bp, Artificial
  CRISPR gRNA sequence
acaaaagtattaaaggaaaa

SEQ ID NO: 123151 - DNA, 20 bp, Artificial
  CRISPR gRNA sequence
catattatcttgtcatgcac

SEQ ID NO: 123152 - DNA, 20 bp, Artificial
  CRISPR gRNA sequence
atcttgtcatgcactggaat

SEQ ID NO: 123153 - DNA, 20 bp, Artificial
  CRISPR gRNA sequence
ttagcaacatgattatcatt

SEQ ID NO: 123154 - DNA, 20 bp, Artificial
  CRISPR gRNA sequence
atgattatcatttggactaa

SEQ ID NO: 123155 - DNA, 20 bp, Artificial
  CRISPR gRNA sequence
atcatttggactaacagcat

SEQ ID NO: 123156 - DNA, 20 bp, Artificial
  CRISPR gRNA sequence
gcattagcctcgctaaacct

SEQ ID NO: 123157 - DNA, 20 bp, Artificial
  CRISPR gRNA sequence
gctaaacctcagtcttctaa

SEQ ID NO: 123158 - DNA, 20 bp, Artificial
  CRISPR gRNA sequence
acctcagtcttctaaaagtg

SEQ ID NO: 123159 - DNA, 20 bp, Artificial
  CRISPR gRNA sequence
tcttctaaaagtgaagataa

SEQ ID NO: 123160 - DNA, 20 bp, Artificial
  CRISPR gRNA sequence
gtgaagataaaagtatttcc

SEQ ID NO: 123161 - DNA, 20 bp, Artificial
  CRISPR gRNA sequence
gaagataaaagtatttccta

SEQ ID NO: 123162 - DNA, 20 bp, Artificial
  CRISPR gRNA sequence
aaagtatttcctagagttgt

SEQ ID NO: 123163 - DNA, 20 bp, Artificial
  CRISPR gRNA sequence
agagttgtcagaattaaata

SEQ ID NO: 123164 - DNA, 20 bp, Artificial
  CRISPR gRNA sequence
tgtcagaattaaataaagac

SEQ ID NO: 123165 - DNA, 20 bp, Artificial
  CRISPR gRNA sequence
agaattaaataaagactaga

SEQ ID NO: 123166 - DNA, 20 bp, Artificial
  CRISPR gRNA sequence
taaagactagaaagctgcta

SEQ ID NO: 123167 - DNA, 20 bp, Artificial
  CRISPR gRNA sequence
gactagaaagctgctaaaga

SEQ ID NO: 123168 - DNA, 20 bp, Artificial
  CRISPR gRNA sequence
aagctgctaaagacagtgtt

SEQ ID NO: 123169 - DNA, 20 bp, Artificial
  CRISPR gRNA sequence
taaagacagtgtttggcacg

SEQ ID NO: 123170 - DNA, 20 bp, Artificial
  CRISPR gRNA sequence
ttggcacgtagtgtacccca

SEQ ID NO: 123171 - DNA, 20 bp, Artificial
  CRISPR gRNA sequence
atctcatcctccctcctttg

SEQ ID NO: 123172 - DNA, 20 bp, Artificial
  CRISPR gRNA sequence
ctcatcctccctcctttgaa

SEQ ID NO: 123173 - DNA, 20 bp, Artificial
  CRISPR gRNA sequence
atcctccctcctttgaagag

SEQ ID NO: 123174 - DNA, 20 bp, Artificial
  CRISPR gRNA sequence
tgcttaactgtatgtgtctt

SEQ ID NO: 123175 - DNA, 20 bp, Artificial
  CRISPR gRNA sequence
gtatgtgtcttcagttctgc

SEQ ID NO: 123176 - DNA, 20 bp, Artificial
  CRISPR gRNA sequence
gtcttcagttctgcaagttt

SEQ ID NO: 123177 - DNA, 20 bp, Artificial
  CRISPR gRNA sequence
ctaccattaaaatcctgccc

SEQ ID NO: 123178 - DNA, 20 bp, Artificial
  CRISPR gRNA sequence
cctgccccagactttaatcc

SEQ ID NO: 123179 - DNA, 20 bp, Artificial
  CRISPR gRNA sequence
aacaaatgttctgttcttta

SEQ ID NO: 123180 - DNA, 20 bp, Artificial
  CRISPR gRNA sequence
ttctgttctttaaagctcta

SEQ ID NO: 123181 - DNA, 20 bp, Artificial
  CRISPR gRNA sequence
ctttaaagctctatggcact

SEQ ID NO: 123182 - DNA, 20 bp, Artificial
  CRISPR gRNA sequence
cttagtacctttcactcaat

SEQ ID NO: 123183 - DNA, 20 bp, Artificial
  CRISPR gRNA sequence
tcaacctaatctttgatgct

SEQ ID NO: 123184 - DNA, 20 bp, Artificial
  CRISPR gRNA sequence
ctttgatgcttagaatatgc

SEQ ID NO: 123185 - DNA, 20 bp, Artificial
  CRISPR gRNA sequence
ccagccattcgcctatatat

SEQ ID NO: 123186 - DNA, 20 bp, Artificial
  CRISPR gRNA sequence
tcgcctatatataagaatga

SEQ ID NO: 123187 - DNA, 20 bp, Artificial
  CRISPR gRNA sequence
aatgatggaaaaaaacttgc

SEQ ID NO: 123188 - DNA, 20 bp, Artificial
  CRISPR gRNA sequence
aacttgctagatgcatccca

SEQ ID NO: 123189 - DNA, 20 bp, Artificial
  CRISPR gRNA sequence
acttgctagatgcatcccaa

SEQ ID NO: 123190 - DNA, 20 bp, Artificial
  CRISPR gRNA sequence
tgcatcccaaaggttttttc

SEQ ID NO: 123191 - DNA, 20 bp, Artificial
  CRISPR gRNA sequence
gcatcccaaaggttttttct

SEQ ID NO: 123192 - DNA, 20 bp, Artificial
  CRISPR gRNA sequence
tcctataaaaacttataaaa

SEQ ID NO: 123193 - DNA, 20 bp, Artificial
  CRISPR gRNA sequence
aaaacttataaaacagactg

SEQ ID NO: 123194 - DNA, 20 bp, Artificial
  CRISPR gRNA sequence
taaaacagactgtagattgt

SEQ ID NO: 123195 - DNA, 20 bp, Artificial
  CRISPR gRNA sequence
acagactgtagattgtcagt

SEQ ID NO: 123196 - DNA, 20 bp, Artificial
  CRISPR gRNA sequence
actgtagattgtcagtaagc

SEQ ID NO: 123197 - DNA, 20 bp, Artificial
  CRISPR gRNA sequence
ccagccaacaaatatttact

SEQ ID NO: 123198 - DNA, 20 bp, Artificial
  CRISPR gRNA sequence
ccaacaaatatttactgagt

SEQ ID NO: 123199 - DNA, 20 bp, Artificial
  CRISPR gRNA sequence
atatttactgagtgagcgct

SEQ ID NO: 123200 - DNA, 20 bp, Artificial
  CRISPR gRNA sequence
agtgagcgcttagtatttac

SEQ ID NO: 123201 - DNA, 20 bp, Artificial
  CRISPR gRNA sequence
gtgagcgcttagtatttacc

SEQ ID NO: 123202 - DNA, 20 bp, Artificial
  CRISPR gRNA sequence
accaggttcatgctatgtgc

SEQ ID NO: 123203 - DNA, 20 bp, Artificial
  CRISPR gRNA sequence
catgctatgtgctggtcacg

SEQ ID NO: 123204 - DNA, 20 bp, Artificial
  CRISPR gRNA sequence
ggtcacgtagctgtcaacaa

SEQ ID NO: 123205 - DNA, 20 bp, Artificial
  CRISPR gRNA sequence
cgtagctgtcaacaacagac

SEQ ID NO: 123206 - DNA, 20 bp, Artificial
  CRISPR gRNA sequence
gtagctgtcaacaacagaca

SEQ ID NO: 123207 - DNA, 20 bp, Artificial
  CRISPR gRNA sequence
acagacaaggtctctgtcct

SEQ ID NO: 123208 - DNA, 20 bp, Artificial
  CRISPR gRNA sequence
aggtctctgtcctcagcttg

SEQ ID NO: 123209 - DNA, 20 bp, Artificial
  CRISPR gRNA sequence
ggtctctgtcctcagcttgc

SEQ ID NO: 123210 - DNA, 20 bp, Artificial
  CRISPR gRNA sequence
aggacaaatgttacataacc

SEQ ID NO: 123211 - DNA, 20 bp, Artificial
  CRISPR gRNA sequence
ggacaaatgttacataacct

SEQ ID NO: 123212 - DNA, 20 bp, Artificial
  CRISPR gRNA sequence
acaaatgttacataacctgg

SEQ ID NO: 123213 - DNA, 20 bp, Artificial
  CRISPR gRNA sequence
caaatgttacataacctggg

SEQ ID NO: 123214 - DNA, 20 bp, Artificial
  CRISPR gRNA sequence
atgttacataacctgggagg

SEQ ID NO: 123215 - DNA, 20 bp, Artificial
  CRISPR gRNA sequence
tgttacataacctgggaggc

SEQ ID NO: 123216 - DNA, 20 bp, Artificial
  CRISPR gRNA sequence
gttacataacctgggaggca

SEQ ID NO: 123217 - DNA, 20 bp, Artificial
  CRISPR gRNA sequence
ataacctgggaggcagggtg

SEQ ID NO: 123218 - DNA, 20 bp, Artificial
  CRISPR gRNA sequence
taacctgggaggcagggtga

SEQ ID NO: 123219 - DNA, 20 bp, Artificial
  CRISPR gRNA sequence
aacctgggaggcagggtgaa

SEQ ID NO: 123220 - DNA, 20 bp, Artificial
  CRISPR gRNA sequence
acctgggaggcagggtgaag

SEQ ID NO: 123221 - DNA, 20 bp, Artificial
  CRISPR gRNA sequence
tgggaggcagggtgaagggg

SEQ ID NO: 123222 - DNA, 20 bp, Artificial
  CRISPR gRNA sequence
ggaggcagggtgaaggggta

SEQ ID NO: 123223 - DNA, 20 bp, Artificial
  CRISPR gRNA sequence
cagggtgaaggggtagagaa

SEQ ID NO: 123224 - DNA, 20 bp, Artificial
  CRISPR gRNA sequence
gggtgaaggggtagagaaca

SEQ ID NO: 123225 - DNA, 20 bp, Artificial
  CRISPR gRNA sequence
gggtagagaacagagcctat

SEQ ID NO: 123226 - DNA, 20 bp, Artificial
  CRISPR gRNA sequence
acagagcctattagtccttc

SEQ ID NO: 123227 - DNA, 20 bp, Artificial
  CRISPR gRNA sequence
cagagcctattagtccttcc

SEQ ID NO: 123228 - DNA, 20 bp, Artificial
  CRISPR gRNA sequence
ctattagtccttccaggaca

SEQ ID NO: 123229 - DNA, 20 bp, Artificial
  CRISPR gRNA sequence
tattagtccttccaggacac

SEQ ID NO: 123230 - DNA, 20 bp, Artificial
  CRISPR gRNA sequence
tccttccaggacacaggctc

SEQ ID NO: 123231 - DNA, 20 bp, Artificial
  CRISPR gRNA sequence
ggctctggaatcgaatcacc

SEQ ID NO: 123232 - DNA, 20 bp, Artificial
  CRISPR gRNA sequence
aattccctgccacttaccat

SEQ ID NO: 123233 - DNA, 20 bp, Artificial
  CRISPR gRNA sequence
ccatgagaccgtgaacaaac

SEQ ID NO: 123234 - DNA, 20 bp, Artificial
  CRISPR gRNA sequence
agaccgtgaacaaactggat

SEQ ID NO: 123235 - DNA, 20 bp, Artificial
  CRISPR gRNA sequence
tgaacaaactggatgagaac

SEQ ID NO: 123236 - DNA, 20 bp, Artificial
  CRISPR gRNA sequence
gagaacaagacttaacctcc

SEQ ID NO: 123237 - DNA, 20 bp, Artificial
  CRISPR gRNA sequence
agaacaagacttaacctccc

SEQ ID NO: 123238 - DNA, 20 bp, Artificial
  CRISPR gRNA sequence
taacctcccaggctcctgta

SEQ ID NO: 123239 - DNA, 20 bp, Artificial
  CRISPR gRNA sequence
aacctcccaggctcctgtac

SEQ ID NO: 123240 - DNA, 20 bp, Artificial
  CRISPR gRNA sequence
tcccaggctcctgtacaggt

SEQ ID NO: 123241 - DNA, 20 bp, Artificial
  CRISPR gRNA sequence
cccaggctcctgtacaggtt

SEQ ID NO: 123242 - DNA, 20 bp, Artificial
  CRISPR gRNA sequence
caggctcctgtacaggttag

SEQ ID NO: 123243 - DNA, 20 bp, Artificial
  CRISPR gRNA sequence
gttaggagctaatccatgta

SEQ ID NO: 123244 - DNA, 20 bp, Artificial
  CRISPR gRNA sequence
ggagctaatccatgtaaaga

SEQ ID NO: 123245 - DNA, 20 bp, Artificial
  CRISPR gRNA sequence
taatccatgtaaagacagca

SEQ ID NO: 123246 - DNA, 20 bp, Artificial
  CRISPR gRNA sequence
gtaaagacagcatagtacaa

SEQ ID NO: 123247 - DNA, 20 bp, Artificial
  CRISPR gRNA sequence
taaagacagcatagtacaat

SEQ ID NO: 123248 - DNA, 20 bp, Artificial
  CRISPR gRNA sequence
catagtacaatgggcatact

SEQ ID NO: 123249 - DNA, 20 bp, Artificial
  CRISPR gRNA sequence
gtacaatgggcatactcagt

SEQ ID NO: 123250 - DNA, 20 bp, Artificial
  CRISPR gRNA sequence
caatgggcatactcagtaag

SEQ ID NO: 123251 - DNA, 20 bp, Artificial
  CRISPR gRNA sequence
tactcagtaagtggtatata

SEQ ID NO: 123252 - DNA, 20 bp, Artificial
  CRISPR gRNA sequence
taaaataattacaaataatt

SEQ ID NO: 123253 - DNA, 20 bp, Artificial
  CRISPR gRNA sequence
acaaataattaagtaattgc

SEQ ID NO: 123254 - DNA, 20 bp, Artificial
  CRISPR gRNA sequence
attaagtaattgctagtgcc

SEQ ID NO: 123255 - DNA, 20 bp, Artificial
  CRISPR gRNA sequence
aattgctagtgccaagtacg

SEQ ID NO: 123256 - DNA, 20 bp, Artificial
  CRISPR gRNA sequence
gccaagtacgaagaaaaaca

SEQ ID NO: 123257 - DNA, 20 bp, Artificial
  CRISPR gRNA sequence
tgttttgttatgtgctatgt

SEQ ID NO: 123258 - DNA, 20 bp, Artificial
  CRISPR gRNA sequence
gctatgtgagtttactccaa

SEQ ID NO: 123259 - DNA, 20 bp, Artificial
  CRISPR gRNA sequence
ctatgtgagtttactccaaa

SEQ ID NO: 123260 - DNA, 20 bp, Artificial
  CRISPR gRNA sequence
tatgtgagtttactccaaaa

SEQ ID NO: 123261 - DNA, 20 bp, Artificial
  CRISPR gRNA sequence
tactccaaaagggacctcac

SEQ ID NO: 123262 - DNA, 20 bp, Artificial
  CRISPR gRNA sequence
aaaagggacctcactagtct

SEQ ID NO: 123263 - DNA, 20 bp, Artificial
  CRISPR gRNA sequence
aaagggacctcactagtctg

SEQ ID NO: 123264 - DNA, 20 bp, Artificial
  CRISPR gRNA sequence
aagggacctcactagtctga

SEQ ID NO: 123265 - DNA, 20 bp, Artificial
  CRISPR gRNA sequence
agggacctcactagtctgag

SEQ ID NO: 123266 - DNA, 20 bp, Artificial
  CRISPR gRNA sequence
cctcactagtctgaggggtc

SEQ ID NO: 123267 - DNA, 20 bp, Artificial
  CRISPR gRNA sequence
actagtctgaggggtcaaga

SEQ ID NO: 123268 - DNA, 20 bp, Artificial
  CRISPR gRNA sequence
ctagtctgaggggtcaagaa

SEQ ID NO: 123269 - DNA, 20 bp, Artificial
  CRISPR gRNA sequence
ggggtcaagaaaggctatct

SEQ ID NO: 123270 - DNA, 20 bp, Artificial
  CRISPR gRNA sequence
gggtcaagaaaggctatctt

SEQ ID NO: 123271 - DNA, 20 bp, Artificial
  CRISPR gRNA sequence
taggaaatgacattgaaaat

SEQ ID NO: 123272 - DNA, 20 bp, Artificial
  CRISPR gRNA sequence
gacattgaaaatgagactga

SEQ ID NO: 123273 - DNA, 20 bp, Artificial
  CRISPR gRNA sequence
aaatgagactgacagataaa

SEQ ID NO: 123274 - DNA, 20 bp, Artificial
  CRISPR gRNA sequence
actgacagataaacagaaat

SEQ ID NO: 123275 - DNA, 20 bp, Artificial
  CRISPR gRNA sequence
acagataaacagaaatcagt

SEQ ID NO: 123276 - DNA, 20 bp, Artificial
  CRISPR gRNA sequence
cagataaacagaaatcagtc

SEQ ID NO: 123277 - DNA, 20 bp, Artificial
  CRISPR gRNA sequence
acagaaatcagtcaggcaaa

SEQ ID NO: 123278 - DNA, 20 bp, Artificial
  CRISPR gRNA sequence
aaatcagtcaggcaaaaaga

SEQ ID NO: 123279 - DNA, 20 bp, Artificial
  CRISPR gRNA sequence
aatcagtcaggcaaaaagaa

SEQ ID NO: 123280 - DNA, 20 bp, Artificial
  CRISPR gRNA sequence
cagtcaggcaaaaagaaagg

SEQ ID NO: 123281 - DNA, 20 bp, Artificial
  CRISPR gRNA sequence
agtcaggcaaaaagaaaggt

SEQ ID NO: 123282 - DNA, 20 bp, Artificial
  CRISPR gRNA sequence
aaggtgggaaacgaatgttc

SEQ ID NO: 123283 - DNA, 20 bp, Artificial
  CRISPR gRNA sequence
aggtgggaaacgaatgttct

SEQ ID NO: 123284 - DNA, 20 bp, Artificial
  CRISPR gRNA sequence
tgggaaacgaatgttctagg

SEQ ID NO: 123285 - DNA, 20 bp, Artificial
  CRISPR gRNA sequence
ggaaacgaatgttctaggca

SEQ ID NO: 123286 - DNA, 20 bp, Artificial
  CRISPR gRNA sequence
tgttctaggcagagaaaacc

SEQ ID NO: 123287 - DNA, 20 bp, Artificial
  CRISPR gRNA sequence
gcagagaaaaccaagaaata

SEQ ID NO: 123288 - DNA, 20 bp, Artificial
  CRISPR gRNA sequence
aaaaccaagaaatacagtac

SEQ ID NO: 123289 - DNA, 20 bp, Artificial
  CRISPR gRNA sequence
accaagaaatacagtactgg

SEQ ID NO: 123290 - DNA, 20 bp, Artificial
  CRISPR gRNA sequence
gaaatacagtactggtggat

SEQ ID NO: 123291 - DNA, 20 bp, Artificial
  CRISPR gRNA sequence
atacagtactggtggattgg

SEQ ID NO: 123292 - DNA, 20 bp, Artificial
  CRISPR gRNA sequence
tacagtactggtggattgga

SEQ ID NO: 123293 - DNA, 20 bp, Artificial
  CRISPR gRNA sequence
ctggtggattggaaggcgct

SEQ ID NO: 123294 - DNA, 20 bp, Artificial
  CRISPR gRNA sequence
tggtggattggaaggcgcta

SEQ ID NO: 123295 - DNA, 20 bp, Artificial
  CRISPR gRNA sequence
gtggattggaaggcgctaag

SEQ ID NO: 123296 - DNA, 20 bp, Artificial
  CRISPR gRNA sequence
tggattggaaggcgctaagg

SEQ ID NO: 123297 - DNA, 20 bp, Artificial
  CRISPR gRNA sequence
ggattggaaggcgctaagga

SEQ ID NO: 123298 - DNA, 20 bp, Artificial
  CRISPR gRNA sequence
gattggaaggcgctaaggag

SEQ ID NO: 123299 - DNA, 20 bp, Artificial
  CRISPR gRNA sequence
ggaaggcgctaaggaggggc

SEQ ID NO: 123300 - DNA, 20 bp, Artificial
  CRISPR gRNA sequence
cgctaaggaggggctagatc

SEQ ID NO: 123301 - DNA, 20 bp, Artificial
  CRISPR gRNA sequence
taaggaggggctagatcaag

SEQ ID NO: 123302 - DNA, 20 bp, Artificial
  CRISPR gRNA sequence
gggctagatcaagcagtgtc

SEQ ID NO: 123303 - DNA, 20 bp, Artificial
  CRISPR gRNA sequence
ctagatcaagcagtgtccgg

SEQ ID NO: 123304 - DNA, 20 bp, Artificial
  CRISPR gRNA sequence
tcaagcagtgtccggtggac

SEQ ID NO: 123305 - DNA, 20 bp, Artificial
  CRISPR gRNA sequence
aagcagtgtccggtggacaa

SEQ ID NO: 123306 - DNA, 20 bp, Artificial
  CRISPR gRNA sequence
agcagtgtccggtggacaag

SEQ ID NO: 123307 - DNA, 20 bp, Artificial
  CRISPR gRNA sequence
cggtggacaagaggaaatca

SEQ ID NO: 123308 - DNA, 20 bp, Artificial
  CRISPR gRNA sequence
gtggacaagaggaaatcaaa

SEQ ID NO: 123309 - DNA, 20 bp, Artificial
  CRISPR gRNA sequence
agaggaaatcaaagagtttt

SEQ ID NO: 123310 - DNA, 20 bp, Artificial
  CRISPR gRNA sequence
ggaaatcaaagagttttaag

SEQ ID NO: 123311 - DNA, 20 bp, Artificial
  CRISPR gRNA sequence
aatcaaagagttttaagcag

SEQ ID NO: 123312 - DNA, 20 bp, Artificial
  CRISPR gRNA sequence
tcaaagagttttaagcagaa

SEQ ID NO: 123313 - DNA, 20 bp, Artificial
  CRISPR gRNA sequence
attaaaaaaaaaaatccctc

SEQ ID NO: 123314 - DNA, 20 bp, Artificial
  CRISPR gRNA sequence
aaaaaaaatccctctggcta

SEQ ID NO: 123315 - DNA, 20 bp, Artificial
  CRISPR gRNA sequence
aaatccctctggctacagtt

SEQ ID NO: 123316 - DNA, 20 bp, Artificial
  CRISPR gRNA sequence
cctctggctacagttcagta

SEQ ID NO: 123317 - DNA, 20 bp, Artificial
  CRISPR gRNA sequence
gttcagtacagaaaccgacc

SEQ ID NO: 123318 - DNA, 20 bp, Artificial
  CRISPR gRNA sequence
tcagtacagaaaccgacctg

SEQ ID NO: 123319 - DNA, 20 bp, Artificial
  CRISPR gRNA sequence
cagtacagaaaccgacctgg

SEQ ID NO: 123320 - DNA, 20 bp, Artificial
  CRISPR gRNA sequence
agtacagaaaccgacctgga

SEQ ID NO: 123321 - DNA, 20 bp, Artificial
  CRISPR gRNA sequence
gtacagaaaccgacctggag

SEQ ID NO: 123322 - DNA, 20 bp, Artificial
  CRISPR gRNA sequence
acagaaaccgacctggaggg

SEQ ID NO: 123323 - DNA, 20 bp, Artificial
  CRISPR gRNA sequence
gacctggaggggagcacaaa

SEQ ID NO: 123324 - DNA, 20 bp, Artificial
  CRISPR gRNA sequence
acctggaggggagcacaaat

SEQ ID NO: 123325 - DNA, 20 bp, Artificial
  CRISPR gRNA sequence
gaggggagcacaaataggca

SEQ ID NO: 123326 - DNA, 20 bp, Artificial
  CRISPR gRNA sequence
gggagcacaaataggcacag

SEQ ID NO: 123327 - DNA, 20 bp, Artificial
  CRISPR gRNA sequence
cacaaataggcacagaagac

SEQ ID NO: 123328 - DNA, 20 bp, Artificial
  CRISPR gRNA sequence
aataggcacagaagaccagt

SEQ ID NO: 123329 - DNA, 20 bp, Artificial
  CRISPR gRNA sequence
ataggcacagaagaccagtg

SEQ ID NO: 123330 - DNA, 20 bp, Artificial
  CRISPR gRNA sequence
cagtgaggactgcaatgctg

SEQ ID NO: 123331 - DNA, 20 bp, Artificial
  CRISPR gRNA sequence
gaggactgcaatgctgcagt

SEQ ID NO: 123332 - DNA, 20 bp, Artificial
  CRISPR gRNA sequence
aggactgcaatgctgcagtc

SEQ ID NO: 123333 - DNA, 20 bp, Artificial
  CRISPR gRNA sequence
ggactgcaatgctgcagtca

SEQ ID NO: 123334 - DNA, 20 bp, Artificial
  CRISPR gRNA sequence
tgcagtcagggcatgacttc

SEQ ID NO: 123335 - DNA, 20 bp, Artificial
  CRISPR gRNA sequence
gtcagggcatgacttcaagc

SEQ ID NO: 123336 - DNA, 20 bp, Artificial
  CRISPR gRNA sequence
aagcaagataatgatcattt

SEQ ID NO: 123337 - DNA, 20 bp, Artificial
  CRISPR gRNA sequence
gataatgatcattttagcat

SEQ ID NO: 123338 - DNA, 20 bp, Artificial
  CRISPR gRNA sequence
ataatgatcattttagcatc

SEQ ID NO: 123339 - DNA, 20 bp, Artificial
  CRISPR gRNA sequence
gatcattttagcatcaggtc

SEQ ID NO: 123340 - DNA, 20 bp, Artificial
  CRISPR gRNA sequence
atcattttagcatcaggtct

SEQ ID NO: 123341 - DNA, 20 bp, Artificial
  CRISPR gRNA sequence
ttttagcatcaggtctgggt

SEQ ID NO: 123342 - DNA, 20 bp, Artificial
  CRISPR gRNA sequence
ttagcatcaggtctgggtga

SEQ ID NO: 123343 - DNA, 20 bp, Artificial
  CRISPR gRNA sequence
tcaggtctgggtgagagcgc

SEQ ID NO: 123344 - DNA, 20 bp, Artificial
  CRISPR gRNA sequence
aggtctgggtgagagcgctg

SEQ ID NO: 123345 - DNA, 20 bp, Artificial
  CRISPR gRNA sequence
gggtgagagcgctggagatc

SEQ ID NO: 123346 - DNA, 20 bp, Artificial
  CRISPR gRNA sequence
gtgagagcgctggagatcaa

SEQ ID NO: 123347 - DNA, 20 bp, Artificial
  CRISPR gRNA sequence
agagcgctggagatcaagag

SEQ ID NO: 123348 - DNA, 20 bp, Artificial
  CRISPR gRNA sequence
gcgctggagatcaagagaag

SEQ ID NO: 123349 - DNA, 20 bp, Artificial
  CRISPR gRNA sequence
atcaagagaagcagaacaac

SEQ ID NO: 123350 - DNA, 20 bp, Artificial
  CRISPR gRNA sequence
agagaagcagaacaactaga

SEQ ID NO: 123351 - DNA, 20 bp, Artificial
  CRISPR gRNA sequence
agaacaactagacagctttt

SEQ ID NO: 123352 - DNA, 20 bp, Artificial
  CRISPR gRNA sequence
acaactagacagctttttag

SEQ ID NO: 123353 - DNA, 20 bp, Artificial
  CRISPR gRNA sequence
caactagacagctttttagt

SEQ ID NO: 123354 - DNA, 20 bp, Artificial
  CRISPR gRNA sequence
cagctttttagtaggtgact

SEQ ID NO: 123355 - DNA, 20 bp, Artificial
  CRISPR gRNA sequence
gtgacttggtgactgactga

SEQ ID NO: 123356 - DNA, 20 bp, Artificial
  CRISPR gRNA sequence
gacttggtgactgactgata

SEQ ID NO: 123357 - DNA, 20 bp, Artificial
  CRISPR gRNA sequence
gtgactgactgatagagata

SEQ ID NO: 123358 - DNA, 20 bp, Artificial
  CRISPR gRNA sequence
tgactgactgatagagatac

SEQ ID NO: 123359 - DNA, 20 bp, Artificial
  CRISPR gRNA sequence
ctgactgatagagatacagg

SEQ ID NO: 123360 - DNA, 20 bp, Artificial
  CRISPR gRNA sequence
gatagagatacaggaagacc

SEQ ID NO: 123361 - DNA, 20 bp, Artificial
  CRISPR gRNA sequence
atagagatacaggaagacca

SEQ ID NO: 123362 - DNA, 20 bp, Artificial
  CRISPR gRNA sequence
aggaagaccaaggataatgc

SEQ ID NO: 123363 - DNA, 20 bp, Artificial
  CRISPR gRNA sequence
ggaagaccaaggataatgct

SEQ ID NO: 123364 - DNA, 20 bp, Artificial
  CRISPR gRNA sequence
ggataatgctgggattcttg

SEQ ID NO: 123365 - DNA, 20 bp, Artificial
  CRISPR gRNA sequence
aatgctgggattcttgcagc

SEQ ID NO: 123366 - DNA, 20 bp, Artificial
  CRISPR gRNA sequence
tgctgggattcttgcagctg

SEQ ID NO: 123367 - DNA, 20 bp, Artificial
  CRISPR gRNA sequence
ctgggattcttgcagctgga

SEQ ID NO: 123368 - DNA, 20 bp, Artificial
  CRISPR gRNA sequence
gattcttgcagctggagaga

SEQ ID NO: 123369 - DNA, 20 bp, Artificial
  CRISPR gRNA sequence
cttgcagctggagagacaga

SEQ ID NO: 123370 - DNA, 20 bp, Artificial
  CRISPR gRNA sequence
gagacagacagctgtcaccg

SEQ ID NO: 123371 - DNA, 20 bp, Artificial
  CRISPR gRNA sequence
gacagacagctgtcaccgca

SEQ ID NO: 123372 - DNA, 20 bp, Artificial
  CRISPR gRNA sequence
acagctgtcaccgcagagaa

SEQ ID NO: 123373 - DNA, 20 bp, Artificial
  CRISPR gRNA sequence
cagctgtcaccgcagagaat

SEQ ID NO: 123374 - DNA, 20 bp, Artificial
  CRISPR gRNA sequence
tgtcaccgcagagaatggga

SEQ ID NO: 123375 - DNA, 20 bp, Artificial
  CRISPR gRNA sequence
gtcaccgcagagaatgggaa

SEQ ID NO: 123376 - DNA, 20 bp, Artificial
  CRISPR gRNA sequence
ccgcagagaatgggaaagga

SEQ ID NO: 123377 - DNA, 20 bp, Artificial
  CRISPR gRNA sequence
cgcagagaatgggaaaggaa

SEQ ID NO: 123378 - DNA, 20 bp, Artificial
  CRISPR gRNA sequence
gcagagaatgggaaaggaaa

SEQ ID NO: 123379 - DNA, 20 bp, Artificial
  CRISPR gRNA sequence
agagaatgggaaaggaaagg

SEQ ID NO: 123380 - DNA, 20 bp, Artificial
  CRISPR gRNA sequence
gagaatgggaaaggaaaggg

SEQ ID NO: 123381 - DNA, 20 bp, Artificial
  CRISPR gRNA sequence
agaatgggaaaggaaaggga

SEQ ID NO: 123382 - DNA, 20 bp, Artificial
  CRISPR gRNA sequence
gaatgggaaaggaaagggag

SEQ ID NO: 123383 - DNA, 20 bp, Artificial
  CRISPR gRNA sequence
atgggaaaggaaagggaggg

SEQ ID NO: 123384 - DNA, 20 bp, Artificial
  CRISPR gRNA sequence
aaggaaagggaggggagtgc

SEQ ID NO: 123385 - DNA, 20 bp, Artificial
  CRISPR gRNA sequence
aaagggaggggagtgctgga

SEQ ID NO: 123386 - DNA, 20 bp, Artificial
  CRISPR gRNA sequence
aggggagtgctggacagtgt

SEQ ID NO: 123387 - DNA, 20 bp, Artificial
  CRISPR gRNA sequence
agtgctggacagtgtaagcc

SEQ ID NO: 123388 - DNA, 20 bp, Artificial
  CRISPR gRNA sequence
ggacagtgtaagcctagctg

SEQ ID NO: 123389 - DNA, 20 bp, Artificial
  CRISPR gRNA sequence
tagctgaagctaatgaccgt

SEQ ID NO: 123390 - DNA, 20 bp, Artificial
  CRISPR gRNA sequence
agctaatgaccgtgagttta

SEQ ID NO: 123391 - DNA, 20 bp, Artificial
  CRISPR gRNA sequence
taatgaccgtgagtttacag

SEQ ID NO: 123392 - DNA, 20 bp, Artificial
  CRISPR gRNA sequence
ccgtgagtttacagtggtgc

SEQ ID NO: 123393 - DNA, 20 bp, Artificial
  CRISPR gRNA sequence
tacagtggtgccagtatgtc

SEQ ID NO: 123394 - DNA, 20 bp, Artificial
  CRISPR gRNA sequence
atgtccagtgtgacacttga

SEQ ID NO: 123395 - DNA, 20 bp, Artificial
  CRISPR gRNA sequence
tgtccagtgtgacacttgaa

SEQ ID NO: 123396 - DNA, 20 bp, Artificial
  CRISPR gRNA sequence
acacttgaaaggcctgatat

SEQ ID NO: 123397 - DNA, 20 bp, Artificial
  CRISPR gRNA sequence
ggcctgatatgagactacaa

SEQ ID NO: 123398 - DNA, 20 bp, Artificial
  CRISPR gRNA sequence
atatgagactacaaaagcca

SEQ ID NO: 123399 - DNA, 20 bp, Artificial
  CRISPR gRNA sequence
gactacaaaagccaaagtgt

SEQ ID NO: 123400 - DNA, 20 bp, Artificial
  CRISPR gRNA sequence
ccaaagtgttggatttcatc

SEQ ID NO: 123401 - DNA, 20 bp, Artificial
  CRISPR gRNA sequence
caaagtgttggatttcatcc

SEQ ID NO: 123402 - DNA, 20 bp, Artificial
  CRISPR gRNA sequence
ttggatttcatccaggtaat

SEQ ID NO: 123403 - DNA, 20 bp, Artificial
  CRISPR gRNA sequence
tggatttcatccaggtaatg

SEQ ID NO: 123404 - DNA, 20 bp, Artificial
  CRISPR gRNA sequence
tttcatccaggtaatgaggc

SEQ ID NO: 123405 - DNA, 20 bp, Artificial
  CRISPR gRNA sequence
catccaggtaatgaggctgg

SEQ ID NO: 123406 - DNA, 20 bp, Artificial
  CRISPR gRNA sequence
tccaggtaatgaggctggaa

SEQ ID NO: 123407 - DNA, 20 bp, Artificial
  CRISPR gRNA sequence
gtaatgaggctggaagagca

SEQ ID NO: 123408 - DNA, 20 bp, Artificial
  CRISPR gRNA sequence
ggctggaagagcacagcatg

SEQ ID NO: 123409 - DNA, 20 bp, Artificial
  CRISPR gRNA sequence
gctggaagagcacagcatgt

SEQ ID NO: 123410 - DNA, 20 bp, Artificial
  CRISPR gRNA sequence
acagcatgtaggataatgac

SEQ ID NO: 123411 - DNA, 20 bp, Artificial
  CRISPR gRNA sequence
cagcatgtaggataatgaca

SEQ ID NO: 123412 - DNA, 20 bp, Artificial
  CRISPR gRNA sequence
agcatgtaggataatgacaa

SEQ ID NO: 123413 - DNA, 20 bp, Artificial
  CRISPR gRNA sequence
gcatgtaggataatgacaag

SEQ ID NO: 123414 - DNA, 20 bp, Artificial
  CRISPR gRNA sequence
aggataatgacaaggggaca

SEQ ID NO: 123415 - DNA, 20 bp, Artificial
  CRISPR gRNA sequence
taatgacaaggggacacgga

SEQ ID NO: 123416 - DNA, 20 bp, Artificial
  CRISPR gRNA sequence
cacggacagtgatgaatcgt

SEQ ID NO: 123417 - DNA, 20 bp, Artificial
  CRISPR gRNA sequence
agtgatgaatcgttagactc

SEQ ID NO: 123418 - DNA, 20 bp, Artificial
  CRISPR gRNA sequence
gtgatgaatcgttagactca

SEQ ID NO: 123419 - DNA, 20 bp, Artificial
  CRISPR gRNA sequence
actcaaggaactgataaata

SEQ ID NO: 123420 - DNA, 20 bp, Artificial
  CRISPR gRNA sequence
ggaactgataaatatggaca

SEQ ID NO: 123421 - DNA, 20 bp, Artificial
  CRISPR gRNA sequence
aactgataaatatggacaaa

SEQ ID NO: 123422 - DNA, 20 bp, Artificial
  CRISPR gRNA sequence
tgataaatatggacaaagag

SEQ ID NO: 123423 - DNA, 20 bp, Artificial
  CRISPR gRNA sequence
taatgactattctcattatt

SEQ ID NO: 123424 - DNA, 20 bp, Artificial
  CRISPR gRNA sequence
tcattatttagttgaattga

SEQ ID NO: 123425 - DNA, 20 bp, Artificial
  CRISPR gRNA sequence
aaaatattatttgaaataaa

SEQ ID NO: 123426 - DNA, 20 bp, Artificial
  CRISPR gRNA sequence
aaatattatttgaaataaac

SEQ ID NO: 123427 - DNA, 20 bp, Artificial
  CRISPR gRNA sequence
tattatttgaaataaacagg

SEQ ID NO: 123428 - DNA, 20 bp, Artificial
  CRISPR gRNA sequence
tatttgaaataaacaggtag

SEQ ID NO: 123429 - DNA, 20 bp, Artificial
  CRISPR gRNA sequence
atttgaaataaacaggtagt

SEQ ID NO: 123430 - DNA, 20 bp, Artificial
  CRISPR gRNA sequence
aaatctttatttttttgatg

SEQ ID NO: 123431 - DNA, 20 bp, Artificial
  CRISPR gRNA sequence
atatctcatgcaatgttcac

SEQ ID NO: 123432 - DNA, 20 bp, Artificial
  CRISPR gRNA sequence
atgttcacaagcctgtgacg

SEQ ID NO: 123433 - DNA, 20 bp, Artificial
  CRISPR gRNA sequence
tgttcacaagcctgtgacgc

SEQ ID NO: 123434 - DNA, 20 bp, Artificial
  CRISPR gRNA sequence
cacaagcctgtgacgcaggt

SEQ ID NO: 123435 - DNA, 20 bp, Artificial
  CRISPR gRNA sequence
gtgacgcaggtgagaaaact

SEQ ID NO: 123436 - DNA, 20 bp, Artificial
  CRISPR gRNA sequence
tgacgcaggtgagaaaactg

SEQ ID NO: 123437 - DNA, 20 bp, Artificial
  CRISPR gRNA sequence
gtgagaaaactgaggtacat

SEQ ID NO: 123438 - DNA, 20 bp, Artificial
  CRISPR gRNA sequence
tgagaaaactgaggtacatg

SEQ ID NO: 123439 - DNA, 20 bp, Artificial
  CRISPR gRNA sequence
atgaggctaatgatttgcct

SEQ ID NO: 123440 - DNA, 20 bp, Artificial
  CRISPR gRNA sequence
tgaggctaatgatttgcctg

SEQ ID NO: 123441 - DNA, 20 bp, Artificial
  CRISPR gRNA sequence
atgatttgcctgaggtgaca

SEQ ID NO: 123442 - DNA, 20 bp, Artificial
  CRISPR gRNA sequence
gcctgaggtgacacagtaaa

SEQ ID NO: 123443 - DNA, 20 bp, Artificial
  CRISPR gRNA sequence
cctgaggtgacacagtaaat

SEQ ID NO: 123444 - DNA, 20 bp, Artificial
  CRISPR gRNA sequence
cagtaaatgggactgaaatc

SEQ ID NO: 123445 - DNA, 20 bp, Artificial
  CRISPR gRNA sequence
agtaaatgggactgaaatcc

SEQ ID NO: 123446 - DNA, 20 bp, Artificial
  CRISPR gRNA sequence
gtaaatgggactgaaatcca

SEQ ID NO: 123447 - DNA, 20 bp, Artificial
  CRISPR gRNA sequence
gggactgaaatccagggcct

SEQ ID NO: 123448 - DNA, 20 bp, Artificial
  CRISPR gRNA sequence
cagatgccaactactctcta

SEQ ID NO: 123449 - DNA, 20 bp, Artificial
  CRISPR gRNA sequence
ctctctacagcattcctgcc

SEQ ID NO: 123450 - DNA, 20 bp, Artificial
  CRISPR gRNA sequence
tctacagcattcctgcctgg

SEQ ID NO: 123451 - DNA, 20 bp, Artificial
  CRISPR gRNA sequence
ctgcctggtagtttttcata

SEQ ID NO: 123452 - DNA, 20 bp, Artificial
  CRISPR gRNA sequence
atttgtcccttttacattct

SEQ ID NO: 123453 - DNA, 20 bp, Artificial
  CRISPR gRNA sequence
tttgtcccttttacattcta

SEQ ID NO: 123454 - DNA, 20 bp, Artificial
  CRISPR gRNA sequence
tacactgaaaacactgaaat

SEQ ID NO: 123455 - DNA, 20 bp, Artificial
  CRISPR gRNA sequence
ctgaaattagcttctcaaac

SEQ ID NO: 123456 - DNA, 20 bp, Artificial
  CRISPR gRNA sequence
tgaaattagcttctcaaacc

SEQ ID NO: 123457 - DNA, 20 bp, Artificial
  CRISPR gRNA sequence
attagcttctcaaaccagga

SEQ ID NO: 123458 - DNA, 20 bp, Artificial
  CRISPR gRNA sequence
caaaccaggatggtgtttgt

SEQ ID NO: 123459 - DNA, 20 bp, Artificial
  CRISPR gRNA sequence
ccaggatggtgtttgtgaga

SEQ ID NO: 123460 - DNA, 20 bp, Artificial
  CRISPR gRNA sequence
atggtgtttgtgagatggtt

SEQ ID NO: 123461 - DNA, 20 bp, Artificial
  CRISPR gRNA sequence
gtgtttgtgagatggttaag

SEQ ID NO: 123462 - DNA, 20 bp, Artificial
  CRISPR gRNA sequence
gatggttaagaagtgcaccc

SEQ ID NO: 123463 - DNA, 20 bp, Artificial
  CRISPR gRNA sequence
aagaagtgcaccctggacga

SEQ ID NO: 123464 - DNA, 20 bp, Artificial
  CRISPR gRNA sequence
agtgcaccctggacgacggt

SEQ ID NO: 123465 - DNA, 20 bp, Artificial
  CRISPR gRNA sequence
gtgcaccctggacgacggtg

SEQ ID NO: 123466 - DNA, 20 bp, Artificial
  CRISPR gRNA sequence
gcaccctggacgacggtgag

SEQ ID NO: 123467 - DNA, 20 bp, Artificial
  CRISPR gRNA sequence
tggacgacggtgaggagcac

SEQ ID NO: 123468 - DNA, 20 bp, Artificial
  CRISPR gRNA sequence
cggtgaggagcactggctct

SEQ ID NO: 123469 - DNA, 20 bp, Artificial
  CRISPR gRNA sequence
ggtgaggagcactggctctt

SEQ ID NO: 123470 - DNA, 20 bp, Artificial
  CRISPR gRNA sequence
ggctcttaggaccgatttcg

SEQ ID NO: 123471 - DNA, 20 bp, Artificial
  CRISPR gRNA sequence
gctcttaggaccgatttcgt

SEQ ID NO: 123472 - DNA, 20 bp, Artificial
  CRISPR gRNA sequence
ggaccgatttcgtgggtttg

SEQ ID NO: 123473 - DNA, 20 bp, Artificial
  CRISPR gRNA sequence
gatttcgtgggtttgaagct

SEQ ID NO: 123474 - DNA, 20 bp, Artificial
  CRISPR gRNA sequence
aagcttggctccccatttat

SEQ ID NO: 123475 - DNA, 20 bp, Artificial
  CRISPR gRNA sequence
atgagctctctttgtgtttt

SEQ ID NO: 123476 - DNA, 20 bp, Artificial
  CRISPR gRNA sequence
tttcagcttccccattttta

SEQ ID NO: 123477 - DNA, 20 bp, Artificial
  CRISPR gRNA sequence
ttttaaagtgatgttgctat

SEQ ID NO: 123478 - DNA, 20 bp, Artificial
  CRISPR gRNA sequence
tttaaagtgatgttgctatg

SEQ ID NO: 123479 - DNA, 20 bp, Artificial
  CRISPR gRNA sequence
aaagtgatgttgctatgagg

SEQ ID NO: 123480 - DNA, 20 bp, Artificial
  CRISPR gRNA sequence
tgaggaagctattgtataaa

SEQ ID NO: 123481 - DNA, 20 bp, Artificial
  CRISPR gRNA sequence
gctattgtataaaaagcacc

SEQ ID NO: 123482 - DNA, 20 bp, Artificial
  CRISPR gRNA sequence
tgtataaaaagcacctagca

SEQ ID NO: 123483 - DNA, 20 bp, Artificial
  CRISPR gRNA sequence
aaaagcacctagcaaagtgc

SEQ ID NO: 123484 - DNA, 20 bp, Artificial
  CRISPR gRNA sequence
ctagcaaagtgcaagataca

SEQ ID NO: 123485 - DNA, 20 bp, Artificial
  CRISPR gRNA sequence
caaagtgcaagatacatagt

SEQ ID NO: 123486 - DNA, 20 bp, Artificial
  CRISPR gRNA sequence
gaacttaacaaatgtaatct

SEQ ID NO: 123487 - DNA, 20 bp, Artificial
  CRISPR gRNA sequence
tagtattgccccctcaaata

SEQ ID NO: 123488 - DNA, 20 bp, Artificial
  CRISPR gRNA sequence
tacggttctcattattcttc

SEQ ID NO: 123489 - DNA, 20 bp, Artificial
  CRISPR gRNA sequence
acggttctcattattcttcc

SEQ ID NO: 123490 - DNA, 20 bp, Artificial
  CRISPR gRNA sequence
gttctcattattcttccagg

SEQ ID NO: 123491 - DNA, 20 bp, Artificial
  CRISPR gRNA sequence
tctcattattcttccaggca

SEQ ID NO: 123492 - DNA, 20 bp, Artificial
  CRISPR gRNA sequence
ttacccttttacctgttttc

SEQ ID NO: 123493 - DNA, 20 bp, Artificial
  CRISPR gRNA sequence
tacccttttacctgttttct

SEQ ID NO: 123494 - DNA, 20 bp, Artificial
  CRISPR gRNA sequence
tacattccttttatctatct

SEQ ID NO: 123495 - DNA, 20 bp, Artificial
  CRISPR gRNA sequence
acattccttttatctatctg

SEQ ID NO: 123496 - DNA, 20 bp, Artificial
  CRISPR gRNA sequence
ccttttatctatctgaggat

SEQ ID NO: 123497 - DNA, 20 bp, Artificial
  CRISPR gRNA sequence
tgaggataagaaataataca

SEQ ID NO: 123498 - DNA, 20 bp, Artificial
  CRISPR gRNA sequence
gtatcttcaatcctccttac

SEQ ID NO: 123499 - DNA, 20 bp, Artificial
  CRISPR gRNA sequence
cactcttccttaaacatgct

SEQ ID NO: 123500 - DNA, 20 bp, Artificial
  CRISPR gRNA sequence
catgcttagtctccctcatt

SEQ ID NO: 123501 - DNA, 20 bp, Artificial
  CRISPR gRNA sequence
agtctccctcattaagcata

SEQ ID NO: 123502 - DNA, 20 bp, Artificial
  CRISPR gRNA sequence
ctccctcattaagcatacag

SEQ ID NO: 123503 - DNA, 20 bp, Artificial
  CRISPR gRNA sequence
attaagcatacagaagtaca

SEQ ID NO: 123504 - DNA, 20 bp, Artificial
  CRISPR gRNA sequence
taagcatacagaagtacaca

SEQ ID NO: 123505 - DNA, 20 bp, Artificial
  CRISPR gRNA sequence
ttctgccccatacccttgcc

SEQ ID NO: 123506 - DNA, 20 bp, Artificial
  CRISPR gRNA sequence
agctaccattcttgccctga

SEQ ID NO: 123507 - DNA, 20 bp, Artificial
  CRISPR gRNA sequence
ttcttgccctgacagttgtt

SEQ ID NO: 123508 - DNA, 20 bp, Artificial
  CRISPR gRNA sequence
tgtactttttaaccccaacc

SEQ ID NO: 123509 - DNA, 20 bp, Artificial
  CRISPR gRNA sequence
cagaatgaaaccactcttaa

SEQ ID NO: 123510 - DNA, 20 bp, Artificial
  CRISPR gRNA sequence
aaaccactcttaaaagctgc

SEQ ID NO: 123511 - DNA, 20 bp, Artificial
  CRISPR gRNA sequence
tcctacttgactgttctttg

SEQ ID NO: 123512 - DNA, 20 bp, Artificial
  CRISPR gRNA sequence
ttgactgttctttgtagtgc

SEQ ID NO: 123513 - DNA, 20 bp, Artificial
  CRISPR gRNA sequence
actcgccacacatttatgct

SEQ ID NO: 123514 - DNA, 20 bp, Artificial
  CRISPR gRNA sequence
ctctcctactctgatttcca

SEQ ID NO: 123515 - DNA, 20 bp, Artificial
  CRISPR gRNA sequence
accccctaattgtttcaccc

SEQ ID NO: 123516 - DNA, 20 bp, Artificial
  CRISPR gRNA sequence
ccccctaattgtttcaccca

SEQ ID NO: 123517 - DNA, 20 bp, Artificial
  CRISPR gRNA sequence
caatattctgcttgccactc

SEQ ID NO: 123518 - DNA, 20 bp, Artificial
  CRISPR gRNA sequence
actcaagcaacccatgcctg

SEQ ID NO: 123519 - DNA, 20 bp, Artificial
  CRISPR gRNA sequence
ctcaagcaacccatgcctgt

SEQ ID NO: 123520 - DNA, 20 bp, Artificial
  CRISPR gRNA sequence
tcaagcaacccatgcctgta

SEQ ID NO: 123521 - DNA, 20 bp, Artificial
  CRISPR gRNA sequence
gcatgtctaatatctcatca

SEQ ID NO: 123522 - DNA, 20 bp, Artificial
  CRISPR gRNA sequence
tatctcatcacggcaaattt

SEQ ID NO: 123523 - DNA, 20 bp, Artificial
  CRISPR gRNA sequence
tcacggcaaatttaagatat

SEQ ID NO: 123524 - DNA, 20 bp, Artificial
  CRISPR gRNA sequence
cacggcaaatttaagatatt

SEQ ID NO: 123525 - DNA, 20 bp, Artificial
  CRISPR gRNA sequence
ccttgccccattccctgcaa

SEQ ID NO: 123526 - DNA, 20 bp, Artificial
  CRISPR gRNA sequence
cttgccccattccctgcaac

SEQ ID NO: 123527 - DNA, 20 bp, Artificial
  CRISPR gRNA sequence
ttgccccattccctgcaacg

SEQ ID NO: 123528 - DNA, 20 bp, Artificial
  CRISPR gRNA sequence
cccattccctgcaacgggga

SEQ ID NO: 123529 - DNA, 20 bp, Artificial
  CRISPR gRNA sequence
ccattccctgcaacggggaa

SEQ ID NO: 123530 - DNA, 20 bp, Artificial
  CRISPR gRNA sequence
attccctgcaacggggaaag

SEQ ID NO: 123531 - DNA, 20 bp, Artificial
  CRISPR gRNA sequence
ttccctgcaacggggaaagg

SEQ ID NO: 123532 - DNA, 20 bp, Artificial
  CRISPR gRNA sequence
tccctgcaacggggaaagga

SEQ ID NO: 123533 - DNA, 20 bp, Artificial
  CRISPR gRNA sequence
cctgcaacggggaaaggagg

SEQ ID NO: 123534 - DNA, 20 bp, Artificial
  CRISPR gRNA sequence
tccactactgtaattctact

SEQ ID NO: 123535 - DNA, 20 bp, Artificial
  CRISPR gRNA sequence
actactgtaattctactaag

SEQ ID NO: 123536 - DNA, 20 bp, Artificial
  CRISPR gRNA sequence
aattctactaagaagaatac

SEQ ID NO: 123537 - DNA, 20 bp, Artificial
  CRISPR gRNA sequence
taccagcccttcactctgcc

SEQ ID NO: 123538 - DNA, 20 bp, Artificial
  CRISPR gRNA sequence
ctctgcccagccaaatatac

SEQ ID NO: 123539 - DNA, 20 bp, Artificial
  CRISPR gRNA sequence
caaatataccagcatcatct

SEQ ID NO: 123540 - DNA, 20 bp, Artificial
  CRISPR gRNA sequence
aaatataccagcatcatctt

SEQ ID NO: 123541 - DNA, 20 bp, Artificial
  CRISPR gRNA sequence
taggttcttccatctccttc

SEQ ID NO: 123542 - DNA, 20 bp, Artificial
  CRISPR gRNA sequence
acctctttaaaaatgtctcc

SEQ ID NO: 123543 - DNA, 20 bp, Artificial
  CRISPR gRNA sequence
tttccctttcctatttccac

SEQ ID NO: 123544 - DNA, 20 bp, Artificial
  CRISPR gRNA sequence
atttccactggattaccacc

SEQ ID NO: 123545 - DNA, 20 bp, Artificial
  CRISPR gRNA sequence
ccatcttaacatattgttat

SEQ ID NO: 123546 - DNA, 20 bp, Artificial
  CRISPR gRNA sequence
gactaatctcaccacaacac

SEQ ID NO: 123547 - DNA, 20 bp, Artificial
  CRISPR gRNA sequence
tactcttgaacctattctca

SEQ ID NO: 123548 - DNA, 20 bp, Artificial
  CRISPR gRNA sequence
actcttgaacctattctcaa

SEQ ID NO: 123549 - DNA, 20 bp, Artificial
  CRISPR gRNA sequence
cctattctcaaaggttccta

SEQ ID NO: 123550 - DNA, 20 bp, Artificial
  CRISPR gRNA sequence
ctattctcaaaggttcctaa

SEQ ID NO: 123551 - DNA, 20 bp, Artificial
  CRISPR gRNA sequence
tcattttcatgacttcacat

SEQ ID NO: 123552 - DNA, 20 bp, Artificial
  CRISPR gRNA sequence
ttttcatgacttcacatgag

SEQ ID NO: 123553 - DNA, 20 bp, Artificial
  CRISPR gRNA sequence
cctacttttctctatcttca

SEQ ID NO: 123554 - DNA, 20 bp, Artificial
  CRISPR gRNA sequence
gttaataaaaatctttgtgc

SEQ ID NO: 123555 - DNA, 20 bp, Artificial
  CRISPR gRNA sequence
gtgctagaatgtgctttatt

SEQ ID NO: 123556 - DNA, 20 bp, Artificial
  CRISPR gRNA sequence
tgctagaatgtgctttattt

SEQ ID NO: 123557 - DNA, 20 bp, Artificial
  CRISPR gRNA sequence
gctagaatgtgctttattta

SEQ ID NO: 123558 - DNA, 20 bp, Artificial
  CRISPR gRNA sequence
tgctttatttagggatcact

SEQ ID NO: 123559 - DNA, 20 bp, Artificial
  CRISPR gRNA sequence
tgagtgcacttctttcattt

SEQ ID NO: 123560 - DNA, 20 bp, Artificial
  CRISPR gRNA sequence
gagtgcacttctttcatttt

SEQ ID NO: 123561 - DNA, 20 bp, Artificial
  CRISPR gRNA sequence
gtgcacttctttcattttag

SEQ ID NO: 123562 - DNA, 20 bp, Artificial
  CRISPR gRNA sequence
cttctttcattttaggagtg

SEQ ID NO: 123563 - DNA, 20 bp, Artificial
  CRISPR gRNA sequence
ttttaggagtgaagcgacca

SEQ ID NO: 123564 - DNA, 20 bp, Artificial
  CRISPR gRNA sequence
agtgaagcgaccacagctca

SEQ ID NO: 123565 - DNA, 20 bp, Artificial
  CRISPR gRNA sequence
gaagcgaccacagctcaaag

SEQ ID NO: 123566 - DNA, 20 bp, Artificial
  CRISPR gRNA sequence
aaagaagctgtaacacaccc

SEQ ID NO: 123567 - DNA, 20 bp, Artificial
  CRISPR gRNA sequence
aagaagctgtaacacacccg

SEQ ID NO: 123568 - DNA, 20 bp, Artificial
  CRISPR gRNA sequence
ctgtaacacacccgaggtta

SEQ ID NO: 123569 - DNA, 20 bp, Artificial
  CRISPR gRNA sequence
cacacccgaggttacagata

SEQ ID NO: 123570 - DNA, 20 bp, Artificial
  CRISPR gRNA sequence
acccgaggttacagatatag

SEQ ID NO: 123571 - DNA, 20 bp, Artificial
  CRISPR gRNA sequence
tacagatatagtagcacatc

SEQ ID NO: 123572 - DNA, 20 bp, Artificial
  CRISPR gRNA sequence
cacatccagaattaaatatc

SEQ ID NO: 123573 - DNA, 20 bp, Artificial
  CRISPR gRNA sequence
catccagaattaaatatcca

SEQ ID NO: 123574 - DNA, 20 bp, Artificial
  CRISPR gRNA sequence
atccagaattaaatatccag

SEQ ID NO: 123575 - DNA, 20 bp, Artificial
  CRISPR gRNA sequence
tccagaattaaatatccaga

SEQ ID NO: 123576 - DNA, 20 bp, Artificial
  CRISPR gRNA sequence
ccagaattaaatatccagag

SEQ ID NO: 123577 - DNA, 20 bp, Artificial
  CRISPR gRNA sequence
attaaatatccagaggggac

SEQ ID NO: 123578 - DNA, 20 bp, Artificial
  CRISPR gRNA sequence
tctttcctacattatccttt

SEQ ID NO: 123579 - DNA, 20 bp, Artificial
  CRISPR gRNA sequence
ttatcctttgagatctaccc

SEQ ID NO: 123580 - DNA, 20 bp, Artificial
  CRISPR gRNA sequence
actcccgatcccctaaactt

SEQ ID NO: 123581 - DNA, 20 bp, Artificial
  CRISPR gRNA sequence
taagttgcccatcctgccat

SEQ ID NO: 123582 - DNA, 20 bp, Artificial
  CRISPR gRNA sequence
aagttgcccatcctgccatc

SEQ ID NO: 123583 - DNA, 20 bp, Artificial
  CRISPR gRNA sequence
tgccatcaggcttttgcttt

SEQ ID NO: 123584 - DNA, 20 bp, Artificial
  CRISPR gRNA sequence
ccactcccaccctctatttc

SEQ ID NO: 123585 - DNA, 20 bp, Artificial
  CRISPR gRNA sequence
cactcccaccctctatttca

SEQ ID NO: 123586 - DNA, 20 bp, Artificial
  CRISPR gRNA sequence
ccaccctctatttcaaggct

SEQ ID NO: 123587 - DNA, 20 bp, Artificial
  CRISPR gRNA sequence
tctatttcaaggctcagttc

SEQ ID NO: 123588 - DNA, 20 bp, Artificial
  CRISPR gRNA sequence
ctatttcaaggctcagttca

SEQ ID NO: 123589 - DNA, 20 bp, Artificial
  CRISPR gRNA sequence
aaggctcagttcaaggtctg

SEQ ID NO: 123590 - DNA, 20 bp, Artificial
  CRISPR gRNA sequence
aggctcagttcaaggtctgc

SEQ ID NO: 123591 - DNA, 20 bp, Artificial
  CRISPR gRNA sequence
gatccctctgtgacattccc

SEQ ID NO: 123592 - DNA, 20 bp, Artificial
  CRISPR gRNA sequence
ctgtgacattcccaagtacc

SEQ ID NO: 123593 - DNA, 20 bp, Artificial
  CRISPR gRNA sequence
tgtgacattcccaagtaccc

SEQ ID NO: 123594 - DNA, 20 bp, Artificial
  CRISPR gRNA sequence
ttcccatatctactgcactt

SEQ ID NO: 123595 - DNA, 20 bp, Artificial
  CRISPR gRNA sequence
cccatatctactgcacttaa

SEQ ID NO: 123596 - DNA, 20 bp, Artificial
  CRISPR gRNA sequence
tatctactgcacttaagagt

SEQ ID NO: 123597 - DNA, 20 bp, Artificial
  CRISPR gRNA sequence
agagttagcattttccattc

SEQ ID NO: 123598 - DNA, 20 bp, Artificial
  CRISPR gRNA sequence
gagttagcattttccattct

SEQ ID NO: 123599 - DNA, 20 bp, Artificial
  CRISPR gRNA sequence
tctgggcataactgtcccct

SEQ ID NO: 123600 - DNA, 20 bp, Artificial
  CRISPR gRNA sequence
cccctaagtattcaattaat

SEQ ID NO: 123601 - DNA, 20 bp, Artificial
  CRISPR gRNA sequence
tattcaattaattggctaaa

SEQ ID NO: 123602 - DNA, 20 bp, Artificial
  CRISPR gRNA sequence
caattaattggctaaacaga

SEQ ID NO: 123603 - DNA, 20 bp, Artificial
  CRISPR gRNA sequence
ctaaacagacagccccttta

SEQ ID NO: 123604 - DNA, 20 bp, Artificial
  CRISPR gRNA sequence
acagacagcccctttacagc

SEQ ID NO: 123605 - DNA, 20 bp, Artificial
  CRISPR gRNA sequence
cagacagcccctttacagct

SEQ ID NO: 123606 - DNA, 20 bp, Artificial
  CRISPR gRNA sequence
cagcccctttacagctggga

SEQ ID NO: 123607 - DNA, 20 bp, Artificial
  CRISPR gRNA sequence
agcccctttacagctgggac

SEQ ID NO: 123608 - DNA, 20 bp, Artificial
  CRISPR gRNA sequence
agctgggacaggctaccctg

SEQ ID NO: 123609 - DNA, 20 bp, Artificial
  CRISPR gRNA sequence
aggctaccctgtagcctcaa

SEQ ID NO: 123610 - DNA, 20 bp, Artificial
  CRISPR gRNA sequence
cctgtagcctcaacagcact

SEQ ID NO: 123611 - DNA, 20 bp, Artificial
  CRISPR gRNA sequence
ctgtagcctcaacagcactt

SEQ ID NO: 123612 - DNA, 20 bp, Artificial
  CRISPR gRNA sequence
tgtagcctcaacagcactta

SEQ ID NO: 123613 - DNA, 20 bp, Artificial
  CRISPR gRNA sequence
caacagcacttagggaccca

SEQ ID NO: 123614 - DNA, 20 bp, Artificial
  CRISPR gRNA sequence
aacagcacttagggacccat

SEQ ID NO: 123615 - DNA, 20 bp, Artificial
  CRISPR gRNA sequence
ccatgggaaataatatatgc

SEQ ID NO: 123616 - DNA, 20 bp, Artificial
  CRISPR gRNA sequence
tgggaaataatatatgcaag

SEQ ID NO: 123617 - DNA, 20 bp, Artificial
  CRISPR gRNA sequence
atatgcaagaagctgaaaat

SEQ ID NO: 123618 - DNA, 20 bp, Artificial
  CRISPR gRNA sequence
tatgcaagaagctgaaaata

SEQ ID NO: 123619 - DNA, 20 bp, Artificial
  CRISPR gRNA sequence
gcaagaagctgaaaataagg

SEQ ID NO: 123620 - DNA, 20 bp, Artificial
  CRISPR gRNA sequence
agctgaaaataaggaagcaa

SEQ ID NO: 123621 - DNA, 20 bp, Artificial
  CRISPR gRNA sequence
gctgaaaataaggaagcaac

SEQ ID NO: 123622 - DNA, 20 bp, Artificial
  CRISPR gRNA sequence
aataaggaagcaacaggaat

SEQ ID NO: 123623 - DNA, 20 bp, Artificial
  CRISPR gRNA sequence
aaggaagcaacaggaatgag

SEQ ID NO: 123624 - DNA, 20 bp, Artificial
  CRISPR gRNA sequence
ggaagcaacaggaatgagca

SEQ ID NO: 123625 - DNA, 20 bp, Artificial
  CRISPR gRNA sequence
gaagcaacaggaatgagcag

SEQ ID NO: 123626 - DNA, 20 bp, Artificial
  CRISPR gRNA sequence
gagcagaggtactgtctgtc

SEQ ID NO: 123627 - DNA, 20 bp, Artificial
  CRISPR gRNA sequence
ttgaaatgcattcattctac

SEQ ID NO: 123628 - DNA, 20 bp, Artificial
  CRISPR gRNA sequence
tgaaatgcattcattctacc

SEQ ID NO: 123629 - DNA, 20 bp, Artificial
  CRISPR gRNA sequence
ttcattctaccaggcacctc

SEQ ID NO: 123630 - DNA, 20 bp, Artificial
  CRISPR gRNA sequence
caggcacctccagtataaat

SEQ ID NO: 123631 - DNA, 20 bp, Artificial
  CRISPR gRNA sequence
attggttacaattttatttc

SEQ ID NO: 123632 - DNA, 20 bp, Artificial
  CRISPR gRNA sequence
aatctaattaacaaccaaaa

SEQ ID NO: 123633 - DNA, 20 bp, Artificial
  CRISPR gRNA sequence
ttactgtcatgaaatactgt

SEQ ID NO: 123634 - DNA, 20 bp, Artificial
  CRISPR gRNA sequence
tactgtcagaaccgtgttgt

SEQ ID NO: 123635 - DNA, 20 bp, Artificial
  CRISPR gRNA sequence
tgtcagaaccgtgttgtcag

SEQ ID NO: 123636 - DNA, 20 bp, Artificial
  CRISPR gRNA sequence
ccgtgttgtcagtggtgctg

SEQ ID NO: 123637 - DNA, 20 bp, Artificial
  CRISPR gRNA sequence
ctgaagaacacctatctaaa

SEQ ID NO: 123638 - DNA, 20 bp, Artificial
  CRISPR gRNA sequence
tgaagaacacctatctaaaa

SEQ ID NO: 123639 - DNA, 20 bp, Artificial
  CRISPR gRNA sequence
tctttgtgatttcaacctaa

SEQ ID NO: 123640 - DNA, 20 bp, Artificial
  CRISPR gRNA sequence
cctaaaagataaacatctat

SEQ ID NO: 123641 - DNA, 20 bp, Artificial
  CRISPR gRNA sequence
ctaaaagataaacatctatt

SEQ ID NO: 123642 - DNA, 20 bp, Artificial
  CRISPR gRNA sequence
taggacctaacatctatcaa

SEQ ID NO: 123643 - DNA, 20 bp, Artificial
  CRISPR gRNA sequence
tacatcaaatgtatcactta

SEQ ID NO: 123644 - DNA, 20 bp, Artificial
  CRISPR gRNA sequence
acatcaaatgtatcacttat

SEQ ID NO: 123645 - DNA, 20 bp, Artificial
  CRISPR gRNA sequence
ctttttttctcataaaatta

SEQ ID NO: 123646 - DNA, 20 bp, Artificial
  CRISPR gRNA sequence
ttttttctcataaaattaaa

SEQ ID NO: 123647 - DNA, 20 bp, Artificial
  CRISPR gRNA sequence
tttttctcataaaattaaag

SEQ ID NO: 123648 - DNA, 20 bp, Artificial
  CRISPR gRNA sequence
ttttctcataaaattaaaga

SEQ ID NO: 123649 - DNA, 20 bp, Artificial
  CRISPR gRNA sequence
tgactactattcttaatcaa

SEQ ID NO: 123650 - DNA, 20 bp, Artificial
  CRISPR gRNA sequence
actactattcttaatcaatg

SEQ ID NO: 123651 - DNA, 20 bp, Artificial
  CRISPR gRNA sequence
ttcttaatcaatggagtaca

SEQ ID NO: 123652 - DNA, 20 bp, Artificial
  CRISPR gRNA sequence
atggagtacatggtataaaa

SEQ ID NO: 123653 - DNA, 20 bp, Artificial
  CRISPR gRNA sequence
atggtataaaatagtataaa

SEQ ID NO: 123654 - DNA, 20 bp, Artificial
  CRISPR gRNA sequence
tggtataaaatagtataaaa

SEQ ID NO: 123655 - DNA, 20 bp, Artificial
  CRISPR gRNA sequence
ataaatgtttgttgacttga

SEQ ID NO: 123656 - DNA, 20 bp, Artificial
  CRISPR gRNA sequence
ttgacttgaaagatttattt

SEQ ID NO: 123657 - DNA, 20 bp, Artificial
  CRISPR gRNA sequence
gacttgaaagatttattttg

SEQ ID NO: 123658 - DNA, 20 bp, Artificial
  CRISPR gRNA sequence
attttggagaacttaaaaac

SEQ ID NO: 123659 - DNA, 20 bp, Artificial
  CRISPR gRNA sequence
ttaaaaacaagttaattcca

SEQ ID NO: 123660 - DNA, 20 bp, Artificial
  CRISPR gRNA sequence
taaaaacaagttaattccat

SEQ ID NO: 123661 - DNA, 20 bp, Artificial
  CRISPR gRNA sequence
aaaaacaagttaattccatg

SEQ ID NO: 123662 - DNA, 20 bp, Artificial
  CRISPR gRNA sequence
acaagttaattccatgggga

SEQ ID NO: 123663 - DNA, 20 bp, Artificial
  CRISPR gRNA sequence
caagttaattccatggggaa

SEQ ID NO: 123664 - DNA, 20 bp, Artificial
  CRISPR gRNA sequence
agttaattccatggggaaag

SEQ ID NO: 123665 - DNA, 20 bp, Artificial
  CRISPR gRNA sequence
tccatggggaaaggagaaaa

SEQ ID NO: 123666 - DNA, 20 bp, Artificial
  CRISPR gRNA sequence
ttccaacataaccctgaatt

SEQ ID NO: 123667 - DNA, 20 bp, Artificial
  CRISPR gRNA sequence
attcattacaatacaccaaa

SEQ ID NO: 123668 - DNA, 20 bp, Artificial
  CRISPR gRNA sequence
ttcattacaatacaccaaaa

SEQ ID NO: 123669 - DNA, 20 bp, Artificial
  CRISPR gRNA sequence
tcattacaatacaccaaaaa

SEQ ID NO: 123670 - DNA, 20 bp, Artificial
  CRISPR gRNA sequence
gaccaaattatataatatgc

SEQ ID NO: 123671 - DNA, 20 bp, Artificial
  CRISPR gRNA sequence
ccaaattatataatatgcaa

SEQ ID NO: 123672 - DNA, 20 bp, Artificial
  CRISPR gRNA sequence
tacttaaaacattaacactc

SEQ ID NO: 123673 - DNA, 20 bp, Artificial
  CRISPR gRNA sequence
cccttatcatcttaattttt

SEQ ID NO: 123674 - DNA, 20 bp, Artificial
  CRISPR gRNA sequence
tcatcttaattttttggtga

SEQ ID NO: 123675 - DNA, 20 bp, Artificial
  CRISPR gRNA sequence
gatggttttcttaaatgttt

SEQ ID NO: 123676 - DNA, 20 bp, Artificial
  CRISPR gRNA sequence
tggttttcttaaatgtttca

SEQ ID NO: 123677 - DNA, 20 bp, Artificial
  CRISPR gRNA sequence
aaatgtttcagagtaacatt

SEQ ID NO: 123678 - DNA, 20 bp, Artificial
  CRISPR gRNA sequence
agtaacatttagacattcta

SEQ ID NO: 123679 - DNA, 20 bp, Artificial
  CRISPR gRNA sequence
atttagacattctatagctc

SEQ ID NO: 123680 - DNA, 20 bp, Artificial
  CRISPR gRNA sequence
ttagacattctatagctcaa

SEQ ID NO: 123681 - DNA, 20 bp, Artificial
  CRISPR gRNA sequence
tagacattctatagctcaag

SEQ ID NO: 123682 - DNA, 20 bp, Artificial
  CRISPR gRNA sequence
gacattctatagctcaagag

SEQ ID NO: 123683 - DNA, 20 bp, Artificial
  CRISPR gRNA sequence
acattctatagctcaagagg

SEQ ID NO: 123684 - DNA, 20 bp, Artificial
  CRISPR gRNA sequence
agaggaggaaaaaattatct

SEQ ID NO: 123685 - DNA, 20 bp, Artificial
  CRISPR gRNA sequence
gaatataatgcttttcaatt

SEQ ID NO: 123686 - DNA, 20 bp, Artificial
  CRISPR gRNA sequence
tgcttttcaattaagaatct

SEQ ID NO: 123687 - DNA, 20 bp, Artificial
  CRISPR gRNA sequence
tctcagattatactgtaatg

SEQ ID NO: 123688 - DNA, 20 bp, Artificial
  CRISPR gRNA sequence
atgaagatacattctgcact

SEQ ID NO: 123689 - DNA, 20 bp, Artificial
  CRISPR gRNA sequence
aagatacattctgcactgag

SEQ ID NO: 123690 - DNA, 20 bp, Artificial
  CRISPR gRNA sequence
gcactgagaagatatcaaaa

SEQ ID NO: 123691 - DNA, 20 bp, Artificial
  CRISPR gRNA sequence
atcaaaaaagcaacacaatc

SEQ ID NO: 123692 - DNA, 20 bp, Artificial
  CRISPR gRNA sequence
gacccttatttataattttg

SEQ ID NO: 123693 - DNA, 20 bp, Artificial
  CRISPR gRNA sequence
tgactaaaattgcatcgaaa

SEQ ID NO: 123694 - DNA, 20 bp, Artificial
  CRISPR gRNA sequence
attgcatcgaaatagcactt

SEQ ID NO: 123695 - DNA, 20 bp, Artificial
  CRISPR gRNA sequence
tagcacttcagtctcactgt

SEQ ID NO: 123696 - DNA, 20 bp, Artificial
  CRISPR gRNA sequence
agcacttcagtctcactgta

SEQ ID NO: 123697 - DNA, 20 bp, Artificial
  CRISPR gRNA sequence
gtctcactgtaaggcataaa

SEQ ID NO: 123698 - DNA, 20 bp, Artificial
  CRISPR gRNA sequence
gcataaatagctgaacaaat

SEQ ID NO: 123699 - DNA, 20 bp, Artificial
  CRISPR gRNA sequence
agtaccaattgctgtgttac

SEQ ID NO: 123700 - DNA, 20 bp, Artificial
  CRISPR gRNA sequence
atttgctccattctttctca

SEQ ID NO: 123701 - DNA, 20 bp, Artificial
  CRISPR gRNA sequence
tttgctccattctttctcaa

SEQ ID NO: 123702 - DNA, 20 bp, Artificial
  CRISPR gRNA sequence
tctcaaaggaaacaattaaa

SEQ ID NO: 123703 - DNA, 20 bp, Artificial
  CRISPR gRNA sequence
ctcaaaggaaacaattaaat

SEQ ID NO: 123704 - DNA, 20 bp, Artificial
  CRISPR gRNA sequence
tcaaaggaaacaattaaatg

SEQ ID NO: 123705 - DNA, 20 bp, Artificial
  CRISPR gRNA sequence
caaaggaaacaattaaatgg

SEQ ID NO: 123706 - DNA, 20 bp, Artificial
  CRISPR gRNA sequence
aaggaaacaattaaatgggg

SEQ ID NO: 123707 - DNA, 20 bp, Artificial
  CRISPR gRNA sequence
aggaaacaattaaatggggg

SEQ ID NO: 123708 - DNA, 20 bp, Artificial
  CRISPR gRNA sequence
ggaaacaattaaatggggga

SEQ ID NO: 123709 - DNA, 20 bp, Artificial
  CRISPR gRNA sequence
gaaacaattaaatgggggag

SEQ ID NO: 123710 - DNA, 20 bp, Artificial
  CRISPR gRNA sequence
acaattaaatgggggagggg

SEQ ID NO: 123711 - DNA, 20 bp, Artificial
  CRISPR gRNA sequence
caattaaatgggggaggggt

SEQ ID NO: 123712 - DNA, 20 bp, Artificial
  CRISPR gRNA sequence
aaaacaaaaacacatccttt

SEQ ID NO: 123713 - DNA, 20 bp, Artificial
  CRISPR gRNA sequence
tcctttcagtgttaatttta

SEQ ID NO: 123714 - DNA, 20 bp, Artificial
  CRISPR gRNA sequence
cctttcagtgttaattttaa

SEQ ID NO: 123715 - DNA, 20 bp, Artificial
  CRISPR gRNA sequence
ctttcagtgttaattttaaa

SEQ ID NO: 123716 - DNA, 20 bp, Artificial
  CRISPR gRNA sequence
ttcagtgttaattttaaagg

SEQ ID NO: 123717 - DNA, 20 bp, Artificial
  CRISPR gRNA sequence
agtgttaattttaaagggag

SEQ ID NO: 123718 - DNA, 20 bp, Artificial
  CRISPR gRNA sequence
agatatactgatacgcatcc

SEQ ID NO: 123719 - DNA, 20 bp, Artificial
  CRISPR gRNA sequence
acgcatccaagcatgaaatc

SEQ ID NO: 123720 - DNA, 20 bp, Artificial
  CRISPR gRNA sequence
caagcatgaaatctagcaaa

SEQ ID NO: 123721 - DNA, 20 bp, Artificial
  CRISPR gRNA sequence
gcatgaaatctagcaaatag

SEQ ID NO: 123722 - DNA, 20 bp, Artificial
  CRISPR gRNA sequence
gcaaatagcagaaaaaattg

SEQ ID NO: 123723 - DNA, 20 bp, Artificial
  CRISPR gRNA sequence
aattgtagccactgaattga

SEQ ID NO: 123724 - DNA, 20 bp, Artificial
  CRISPR gRNA sequence
aagtttttaatgccactaaa

SEQ ID NO: 123725 - DNA, 20 bp, Artificial
  CRISPR gRNA sequence
agtttttaatgccactaaaa

SEQ ID NO: 123726 - DNA, 20 bp, Artificial
  CRISPR gRNA sequence
ttaatgccactaaaaaggtc

SEQ ID NO: 123727 - DNA, 20 bp, Artificial
  CRISPR gRNA sequence
taatgccactaaaaaggtcc

SEQ ID NO: 123728 - DNA, 20 bp, Artificial
  CRISPR gRNA sequence
tgccactaaaaaggtccagg

SEQ ID NO: 123729 - DNA, 20 bp, Artificial
  CRISPR gRNA sequence
gacgtttgctataatattaa

SEQ ID NO: 123730 - DNA, 20 bp, Artificial
  CRISPR gRNA sequence
aatttcttttcaaatattaa

SEQ ID NO: 123731 - DNA, 20 bp, Artificial
  CRISPR gRNA sequence
cctctaaccccaaaactgct

SEQ ID NO: 123732 - DNA, 20 bp, Artificial
  CRISPR gRNA sequence
aaccccaaaactgctcagaa

SEQ ID NO: 123733 - DNA, 20 bp, Artificial
  CRISPR gRNA sequence
gaaaagtccttccttgtaac

SEQ ID NO: 123734 - DNA, 20 bp, Artificial
  CRISPR gRNA sequence
acgagaaatgttatttttta

SEQ ID NO: 123735 - DNA, 20 bp, Artificial
  CRISPR gRNA sequence
gagaaatgttattttttaaa

SEQ ID NO: 123736 - DNA, 20 bp, Artificial
  CRISPR gRNA sequence
aagagtgtctttgaaaaaat

SEQ ID NO: 123737 - DNA, 20 bp, Artificial
  CRISPR gRNA sequence
tctttgaaaaaataagccct

SEQ ID NO: 123738 - DNA, 20 bp, Artificial
  CRISPR gRNA sequence
ccctcagaacacttaaaaca

SEQ ID NO: 123739 - DNA, 20 bp, Artificial
  CRISPR gRNA sequence
cctcagaacacttaaaacat

SEQ ID NO: 123740 - DNA, 20 bp, Artificial
  CRISPR gRNA sequence
tcagaacacttaaaacatgg

SEQ ID NO: 123741 - DNA, 20 bp, Artificial
  CRISPR gRNA sequence
ctatatttatgtattttgct

SEQ ID NO: 123742 - DNA, 20 bp, Artificial
  CRISPR gRNA sequence
tttatgtattttgcttggaa

SEQ ID NO: 123743 - DNA, 20 bp, Artificial
  CRISPR gRNA sequence
ttatgtattttgcttggaat

SEQ ID NO: 123744 - DNA, 20 bp, Artificial
  CRISPR gRNA sequence
atgtattttgcttggaatgg

SEQ ID NO: 123745 - DNA, 20 bp, Artificial
  CRISPR gRNA sequence
gtattttgcttggaatggga

SEQ ID NO: 123746 - DNA, 20 bp, Artificial
  CRISPR gRNA sequence
tattttgcttggaatgggag

SEQ ID NO: 123747 - DNA, 20 bp, Artificial
  CRISPR gRNA sequence
attttgcttggaatgggaga

SEQ ID NO: 123748 - DNA, 20 bp, Artificial
  CRISPR gRNA sequence
ttttgcttggaatgggagag

SEQ ID NO: 123749 - DNA, 20 bp, Artificial
  CRISPR gRNA sequence
tttgcttggaatgggagagg

SEQ ID NO: 123750 - DNA, 20 bp, Artificial
  CRISPR gRNA sequence
ttgcttggaatgggagaggg

SEQ ID NO: 123751 - DNA, 20 bp, Artificial
  CRISPR gRNA sequence
tggaatgggagaggggggtg

SEQ ID NO: 123752 - DNA, 20 bp, Artificial
  CRISPR gRNA sequence
ggaatgggagaggggggtgt

SEQ ID NO: 123753 - DNA, 20 bp, Artificial
  CRISPR gRNA sequence
atgggagaggggggtgtggg

SEQ ID NO: 123754 - DNA, 20 bp, Artificial
  CRISPR gRNA sequence
tgggagaggggggtgtgggc

SEQ ID NO: 123755 - DNA, 20 bp, Artificial
  CRISPR gRNA sequence
gggagaggggggtgtgggca

SEQ ID NO: 123756 - DNA, 20 bp, Artificial
  CRISPR gRNA sequence
gagaggggggtgtgggcagg

SEQ ID NO: 123757 - DNA, 20 bp, Artificial
  CRISPR gRNA sequence
accacactcactcacccaaa

SEQ ID NO: 123758 - DNA, 20 bp, Artificial
  CRISPR gRNA sequence
actcacccaaatagttgatt

SEQ ID NO: 123759 - DNA, 20 bp, Artificial
  CRISPR gRNA sequence
tagttgattcagtatatatt

SEQ ID NO: 123760 - DNA, 20 bp, Artificial
  CRISPR gRNA sequence
attcagtatatatttagact

SEQ ID NO: 123761 - DNA, 20 bp, Artificial
  CRISPR gRNA sequence
tatttagactcagtacatta

SEQ ID NO: 123762 - DNA, 20 bp, Artificial
  CRISPR gRNA sequence
aaaaacactgtcacctcata

SEQ ID NO: 123763 - DNA, 20 bp, Artificial
  CRISPR gRNA sequence
catatggtgtatattttctt

SEQ ID NO: 123764 - DNA, 20 bp, Artificial
  CRISPR gRNA sequence
atatggtgtatattttctta

SEQ ID NO: 123765 - DNA, 20 bp, Artificial
  CRISPR gRNA sequence
tatggtgtatattttcttaa

SEQ ID NO: 123766 - DNA, 20 bp, Artificial
  CRISPR gRNA sequence
ggtgtatattttcttaaggg

SEQ ID NO: 123767 - DNA, 20 bp, Artificial
  CRISPR gRNA sequence
gtgtatattttcttaagggc

SEQ ID NO: 123768 - DNA, 20 bp, Artificial
  CRISPR gRNA sequence
gggcaggttgatatatgtaa

SEQ ID NO: 123769 - DNA, 20 bp, Artificial
  CRISPR gRNA sequence
gttgatatatgtaaaagctc

SEQ ID NO: 123770 - DNA, 20 bp, Artificial
  CRISPR gRNA sequence
ttgatatatgtaaaagctca

SEQ ID NO: 123771 - DNA, 20 bp, Artificial
  CRISPR gRNA sequence
tgatatatgtaaaagctcaa

SEQ ID NO: 123772 - DNA, 20 bp, Artificial
  CRISPR gRNA sequence
atacatctgtttaatgtttt

SEQ ID NO: 123773 - DNA, 20 bp, Artificial
  CRISPR gRNA sequence
agaaatgcaaatttgtatcc

SEQ ID NO: 123774 - DNA, 20 bp, Artificial
  CRISPR gRNA sequence
tgcaaatttgtatccaagaa

SEQ ID NO: 123775 - DNA, 20 bp, Artificial
  CRISPR gRNA sequence
aaatttgtatccaagaaaag

SEQ ID NO: 123776 - DNA, 20 bp, Artificial
  CRISPR gRNA sequence
tttgtatccaagaaaagcag

SEQ ID NO: 123777 - DNA, 20 bp, Artificial
  CRISPR gRNA sequence
ttcctccaccctccattctt

SEQ ID NO: 123778 - DNA, 20 bp, Artificial
  CRISPR gRNA sequence
cattctttggcatcaacaac

SEQ ID NO: 123779 - DNA, 20 bp, Artificial
  CRISPR gRNA sequence
ttctttggcatcaacaacca

SEQ ID NO: 123780 - DNA, 20 bp, Artificial
  CRISPR gRNA sequence
cagagttttgcatcaatata

SEQ ID NO: 123781 - DNA, 20 bp, Artificial
  CRISPR gRNA sequence
tatacagtaatccttaaatt

SEQ ID NO: 123782 - DNA, 20 bp, Artificial
  CRISPR gRNA sequence
taatccttaaattaagatac

SEQ ID NO: 123783 - DNA, 20 bp, Artificial
  CRISPR gRNA sequence
atccttaaattaagatacaa

SEQ ID NO: 123784 - DNA, 20 bp, Artificial
  CRISPR gRNA sequence
attaagatacaagagcaatg

SEQ ID NO: 123785 - DNA, 20 bp, Artificial
  CRISPR gRNA sequence
ttaagatacaagagcaatgc

SEQ ID NO: 123786 - DNA, 20 bp, Artificial
  CRISPR gRNA sequence
taagatacaagagcaatgca

SEQ ID NO: 123787 - DNA, 20 bp, Artificial
  CRISPR gRNA sequence
gatacaagagcaatgcaggg

SEQ ID NO: 123788 - DNA, 20 bp, Artificial
  CRISPR gRNA sequence
atacaagagcaatgcaggga

SEQ ID NO: 123789 - DNA, 20 bp, Artificial
  CRISPR gRNA sequence
gaaggaataatttgcctttt

SEQ ID NO: 123790 - DNA, 20 bp, Artificial
  CRISPR gRNA sequence
aaggaataatttgcctttta

SEQ ID NO: 123791 - DNA, 20 bp, Artificial
  CRISPR gRNA sequence
atttgccttttaaggaattt

SEQ ID NO: 123792 - DNA, 20 bp, Artificial
  CRISPR gRNA sequence
caaataaaccccccactgat

SEQ ID NO: 123793 - DNA, 20 bp, Artificial
  CRISPR gRNA sequence
catcactttatgttgctgat

SEQ ID NO: 123794 - DNA, 20 bp, Artificial
  CRISPR gRNA sequence
tgctgattagtttccatact

SEQ ID NO: 123795 - DNA, 20 bp, Artificial
  CRISPR gRNA sequence
ctgattagtttccatactaa

SEQ ID NO: 123796 - DNA, 20 bp, Artificial
  CRISPR gRNA sequence
gattagtttccatactaaga

SEQ ID NO: 123797 - DNA, 20 bp, Artificial
  CRISPR gRNA sequence
taagagagatgaaaccaccc

SEQ ID NO: 123798 - DNA, 20 bp, Artificial
  CRISPR gRNA sequence
gaaaccaccccagtgatttg

SEQ ID NO: 123799 - DNA, 20 bp, Artificial
  CRISPR gRNA sequence
tagcacgaaccacgcaacta

SEQ ID NO: 123800 - DNA, 20 bp, Artificial
  CRISPR gRNA sequence
agcacgaaccacgcaactat

SEQ ID NO: 123801 - DNA, 20 bp, Artificial
  CRISPR gRNA sequence
gcacgaaccacgcaactatg

SEQ ID NO: 123802 - DNA, 20 bp, Artificial
  CRISPR gRNA sequence
acgcaactatggggtccatg

SEQ ID NO: 123803 - DNA, 20 bp, Artificial
  CRISPR gRNA sequence
cgcaactatggggtccatgc

SEQ ID NO: 123804 - DNA, 20 bp, Artificial
  CRISPR gRNA sequence
actatggggtccatgcgggt

SEQ ID NO: 123805 - DNA, 20 bp, Artificial
  CRISPR gRNA sequence
atggggtccatgcgggttag

SEQ ID NO: 123806 - DNA, 20 bp, Artificial
  CRISPR gRNA sequence
tggggtccatgcgggttagt

SEQ ID NO: 123807 - DNA, 20 bp, Artificial
  CRISPR gRNA sequence
agtgggatgccattttttta

SEQ ID NO: 123808 - DNA, 20 bp, Artificial
  CRISPR gRNA sequence
gtgggatgccatttttttaa

SEQ ID NO: 123809 - DNA, 20 bp, Artificial
  CRISPR gRNA sequence
tgccatttttttaaaggtcg

SEQ ID NO: 123810 - DNA, 20 bp, Artificial
  CRISPR gRNA sequence
gccatttttttaaaggtcgc

SEQ ID NO: 123811 - DNA, 20 bp, Artificial
  CRISPR gRNA sequence
ccttgtttaaattatcctgt

SEQ ID NO: 123812 - DNA, 20 bp, Artificial
  CRISPR gRNA sequence
ttgtttaaattatcctgtta

SEQ ID NO: 123813 - DNA, 20 bp, Artificial
  CRISPR gRNA sequence
attatcctgttagagtgctt

SEQ ID NO: 123814 - DNA, 20 bp, Artificial
  CRISPR gRNA sequence
ttatcctgttagagtgcttt

SEQ ID NO: 123815 - DNA, 20 bp, Artificial
  CRISPR gRNA sequence
cctgttagagtgctttgggc

SEQ ID NO: 123816 - DNA, 20 bp, Artificial
  CRISPR gRNA sequence
ttgggcgagattacgatttg

SEQ ID NO: 123817 - DNA, 20 bp, Artificial
  CRISPR gRNA sequence
tgggcgagattacgatttgt

SEQ ID NO: 123818 - DNA, 20 bp, Artificial
  CRISPR gRNA sequence
tctgtaattctttgttctct

SEQ ID NO: 123819 - DNA, 20 bp, Artificial
  CRISPR gRNA sequence
ctctaagactaccgttcttt

SEQ ID NO: 123820 - DNA, 20 bp, Artificial
  CRISPR gRNA sequence
tctaagactaccgttcttta

SEQ ID NO: 123821 - DNA, 20 bp, Artificial
  CRISPR gRNA sequence
accactaatgattaaaacct

SEQ ID NO: 123822 - DNA, 20 bp, Artificial
  CRISPR gRNA sequence
taaaaccttagtccaatccg

SEQ ID NO: 123823 - DNA, 20 bp, Artificial
  CRISPR gRNA sequence
aaaaccttagtccaatccga

SEQ ID NO: 123824 - DNA, 20 bp, Artificial
  CRISPR gRNA sequence
aaaccttagtccaatccgaa

SEQ ID NO: 123825 - DNA, 20 bp, Artificial
  CRISPR gRNA sequence
aagggcttccttcccacctt

SEQ ID NO: 123826 - DNA, 20 bp, Artificial
  CRISPR gRNA sequence
agggcttccttcccaccttc

SEQ ID NO: 123827 - DNA, 20 bp, Artificial
  CRISPR gRNA sequence
gggcttccttcccaccttcg

SEQ ID NO: 123828 - DNA, 20 bp, Artificial
  CRISPR gRNA sequence
ttccttcccaccttcggggc

SEQ ID NO: 123829 - DNA, 20 bp, Artificial
  CRISPR gRNA sequence
tcccaccttcggggcaagta

SEQ ID NO: 123830 - DNA, 20 bp, Artificial
  CRISPR gRNA sequence
cccaccttcggggcaagtac

SEQ ID NO: 123831 - DNA, 20 bp, Artificial
  CRISPR gRNA sequence
ccaccttcggggcaagtaca

SEQ ID NO: 123832 - DNA, 20 bp, Artificial
  CRISPR gRNA sequence
gtacagggaccgcaaaccgc

SEQ ID NO: 123833 - DNA, 20 bp, Artificial
  CRISPR gRNA sequence
agggaccgcaaaccgccaga

SEQ ID NO: 123834 - DNA, 20 bp, Artificial
  CRISPR gRNA sequence
tgcattctttacgcgcaaac

SEQ ID NO: 123835 - DNA, 20 bp, Artificial
  CRISPR gRNA sequence
gcattctttacgcgcaaacc

SEQ ID NO: 123836 - DNA, 20 bp, Artificial
  CRISPR gRNA sequence
tttacgcgcaaaccaggctg

SEQ ID NO: 123837 - DNA, 20 bp, Artificial
  CRISPR gRNA sequence
ttacgcgcaaaccaggctgc

SEQ ID NO: 123838 - DNA, 20 bp, Artificial
  CRISPR gRNA sequence
tacgcgcaaaccaggctgcg

SEQ ID NO: 123839 - DNA, 20 bp, Artificial
  CRISPR gRNA sequence
gcgcaaaccaggctgcgggg

SEQ ID NO: 123840 - DNA, 20 bp, Artificial
  CRISPR gRNA sequence
accaggctgcggggaagcta

SEQ ID NO: 123841 - DNA, 20 bp, Artificial
  CRISPR gRNA sequence
gccatgccttcctccccacg

SEQ ID NO: 123842 - DNA, 20 bp, Artificial
  CRISPR gRNA sequence
ccatgccttcctccccacgc

SEQ ID NO: 123843 - DNA, 20 bp, Artificial
  CRISPR gRNA sequence
ttcctccccacgcaggtgcc

SEQ ID NO: 123844 - DNA, 20 bp, Artificial
  CRISPR gRNA sequence
tcctccccacgcaggtgcct

SEQ ID NO: 123845 - DNA, 20 bp, Artificial
  CRISPR gRNA sequence
tccccacgcaggtgcctggg

SEQ ID NO: 123846 - DNA, 20 bp, Artificial
  CRISPR gRNA sequence
cgcaggtgcctgggtggccc

SEQ ID NO: 123847 - DNA, 20 bp, Artificial
  CRISPR gRNA sequence
cctgggtggccccggcccca

SEQ ID NO: 123848 - DNA, 20 bp, Artificial
  CRISPR gRNA sequence
gtggccccggccccacggcc

SEQ ID NO: 123849 - DNA, 20 bp, Artificial
  CRISPR gRNA sequence
ccggccccacggcctggtcc

SEQ ID NO: 123850 - DNA, 20 bp, Artificial
  CRISPR gRNA sequence
gcctggtcccggcgacctgt

SEQ ID NO: 123851 - DNA, 20 bp, Artificial
  CRISPR gRNA sequence
cggcgacctgtcagccctgc

SEQ ID NO: 123852 - DNA, 20 bp, Artificial
  CRISPR gRNA sequence
cctgtcagccctgcgagtgc

SEQ ID NO: 123853 - DNA, 20 bp, Artificial
  CRISPR gRNA sequence
ctgtcagccctgcgagtgcc

SEQ ID NO: 123854 - DNA, 20 bp, Artificial
  CRISPR gRNA sequence
gtcagccctgcgagtgccag

SEQ ID NO: 123855 - DNA, 20 bp, Artificial
  CRISPR gRNA sequence
tcagccctgcgagtgccagg

SEQ ID NO: 123856 - DNA, 20 bp, Artificial
  CRISPR gRNA sequence
gagtgccaggaggccgcccc

SEQ ID NO: 123857 - DNA, 20 bp, Artificial
  CRISPR gRNA sequence
gtgccaggaggccgccccca

SEQ ID NO: 123858 - DNA, 20 bp, Artificial
  CRISPR gRNA sequence
agcgcatcccctgactcgcc

SEQ ID NO: 123859 - DNA, 20 bp, Artificial
  CRISPR gRNA sequence
cctgactcgcccggccgccc

SEQ ID NO: 123860 - DNA, 20 bp, Artificial
  CRISPR gRNA sequence
cctgcctcccacccgccgcg

SEQ ID NO: 123861 - DNA, 20 bp, Artificial
  CRISPR gRNA sequence
cccacccgccgcgcggcccc

SEQ ID NO: 123862 - DNA, 20 bp, Artificial
  CRISPR gRNA sequence
ccacccgccgcgcggccccc

SEQ ID NO: 123863 - DNA, 20 bp, Artificial
  CRISPR gRNA sequence
cgcgcggcccccgggatgtg

SEQ ID NO: 123864 - DNA, 20 bp, Artificial
  CRISPR gRNA sequence
gcgcggcccccgggatgtgc

SEQ ID NO: 123865 - DNA, 20 bp, Artificial
  CRISPR gRNA sequence
cggcccccgggatgtgcggg

SEQ ID NO: 123866 - DNA, 20 bp, Artificial
  CRISPR gRNA sequence
ccgggatgtgcgggcagaca

SEQ ID NO: 123867 - DNA, 20 bp, Artificial
  CRISPR gRNA sequence
tgtgcgggcagacaaagcgc

SEQ ID NO: 123868 - DNA, 20 bp, Artificial
  CRISPR gRNA sequence
gtgcgggcagacaaagcgcc

SEQ ID NO: 123869 - DNA, 20 bp, Artificial
  CRISPR gRNA sequence
caaagcgccgggccccgcca

SEQ ID NO: 123870 - DNA, 20 bp, Artificial
  CRISPR gRNA sequence
cgggccccgccacagccccg

SEQ ID NO: 123871 - DNA, 20 bp, Artificial
  CRISPR gRNA sequence
gggccccgccacagccccgc

SEQ ID NO: 123872 - DNA, 20 bp, Artificial
  CRISPR gRNA sequence
ccccgccacagccccgcggg

SEQ ID NO: 123873 - DNA, 20 bp, Artificial
  CRISPR gRNA sequence
cccgccacagccccgcgggc

SEQ ID NO: 123874 - DNA, 20 bp, Artificial
  CRISPR gRNA sequence
cgccacagccccgcgggcgg

SEQ ID NO: 123875 - DNA, 20 bp, Artificial
  CRISPR gRNA sequence
gccacagccccgcgggcggg

SEQ ID NO: 123876 - DNA, 20 bp, Artificial
  CRISPR gRNA sequence
cacagccccgcgggcgggag

SEQ ID NO: 123877 - DNA, 20 bp, Artificial
  CRISPR gRNA sequence
acagccccgcgggcgggagg

SEQ ID NO: 123878 - DNA, 20 bp, Artificial
  CRISPR gRNA sequence
cagccccgcgggcgggagga

SEQ ID NO: 123879 - DNA, 20 bp, Artificial
  CRISPR gRNA sequence
gggcgggaggagggcgcccc

SEQ ID NO: 123880 - DNA, 20 bp, Artificial
  CRISPR gRNA sequence
ggcgggaggagggcgccccc

SEQ ID NO: 123881 - DNA, 20 bp, Artificial
  CRISPR gRNA sequence
gcgggaggagggcgcccccg

SEQ ID NO: 123882 - DNA, 20 bp, Artificial
  CRISPR gRNA sequence
ccggggactcgcgccgccgc

SEQ ID NO: 123883 - DNA, 20 bp, Artificial
  CRISPR gRNA sequence
cggggactcgcgccgccgcc

SEQ ID NO: 123884 - DNA, 20 bp, Artificial
  CRISPR gRNA sequence
ggggactcgcgccgccgccg

SEQ ID NO: 123885 - DNA, 20 bp, Artificial
  CRISPR gRNA sequence
tcgcgccgccgccggggcta

SEQ ID NO: 123886 - DNA, 20 bp, Artificial
  CRISPR gRNA sequence
cgcgccgccgccggggctac

SEQ ID NO: 123887 - DNA, 20 bp, Artificial
  CRISPR gRNA sequence
gcgccgccgccggggctacg

SEQ ID NO: 123888 - DNA, 20 bp, Artificial
  CRISPR gRNA sequence
cgccgccggggctacggggc

SEQ ID NO: 123889 - DNA, 20 bp, Artificial
  CRISPR gRNA sequence
gccgccggggctacggggcc

SEQ ID NO: 123890 - DNA, 20 bp, Artificial
  CRISPR gRNA sequence
ccgccggggctacggggcca

SEQ ID NO: 123891 - DNA, 20 bp, Artificial
  CRISPR gRNA sequence
ggggctacggggccagggcc

SEQ ID NO: 123892 - DNA, 20 bp, Artificial
  CRISPR gRNA sequence
gggctacggggccagggccc

SEQ ID NO: 123893 - DNA, 20 bp, Artificial
  CRISPR gRNA sequence
gggccgcgtctcccgcccct

SEQ ID NO: 123894 - DNA, 20 bp, Artificial
  CRISPR gRNA sequence
cgcgtctcccgcccctcggc

SEQ ID NO: 123895 - DNA, 20 bp, Artificial
  CRISPR gRNA sequence
ggccggctccccgcacaaaa

SEQ ID NO: 123896 - DNA, 20 bp, Artificial
  CRISPR gRNA sequence
ccggctccccgcacaaaatg

SEQ ID NO: 123897 - DNA, 20 bp, Artificial
  CRISPR gRNA sequence
ctccccgcacaaaatggagc

SEQ ID NO: 123898 - DNA, 20 bp, Artificial
  CRISPR gRNA sequence
cgcacaaaatggagccggcc

SEQ ID NO: 123899 - DNA, 20 bp, Artificial
  CRISPR gRNA sequence
gcacaaaatggagccggccc

SEQ ID NO: 123900 - DNA, 20 bp, Artificial
  CRISPR gRNA sequence
agccggcccgggacgccgtc

SEQ ID NO: 123901 - DNA, 20 bp, Artificial
  CRISPR gRNA sequence
ccggcccgggacgccgtcga

SEQ ID NO: 123902 - DNA, 20 bp, Artificial
  CRISPR gRNA sequence
gcccgggacgccgtcgagag

SEQ ID NO: 123903 - DNA, 20 bp, Artificial
  CRISPR gRNA sequence
cccgggacgccgtcgagagc

SEQ ID NO: 123904 - DNA, 20 bp, Artificial
  CRISPR gRNA sequence
ccgggacgccgtcgagagcg

SEQ ID NO: 123905 - DNA, 20 bp, Artificial
  CRISPR gRNA sequence
tcgagagcggggccccgacg

SEQ ID NO: 123906 - DNA, 20 bp, Artificial
  CRISPR gRNA sequence
ggggccccgacgcagccccg

SEQ ID NO: 123907 - DNA, 20 bp, Artificial
  CRISPR gRNA sequence
gcagccccgcggcccctcct

SEQ ID NO: 123908 - DNA, 20 bp, Artificial
  CRISPR gRNA sequence
ccgcggcccctcctcggccc

SEQ ID NO: 123909 - DNA, 20 bp, Artificial
  CRISPR gRNA sequence
cgcggcccctcctcggcccc

SEQ ID NO: 123910 - DNA, 20 bp, Artificial
  CRISPR gRNA sequence
cccctcctcggccccgggcc

SEQ ID NO: 123911 - DNA, 20 bp, Artificial
  CRISPR gRNA sequence
cctcctcggccccgggcccg

SEQ ID NO: 123912 - DNA, 20 bp, Artificial
  CRISPR gRNA sequence
gccccgggcccggagctcaa

SEQ ID NO: 123913 - DNA, 20 bp, Artificial
  CRISPR gRNA sequence
ccgggcccggagctcaacgg

SEQ ID NO: 123914 - DNA, 20 bp, Artificial
  CRISPR gRNA sequence
gcccggagctcaacggcggc

SEQ ID NO: 123915 - DNA, 20 bp, Artificial
  CRISPR gRNA sequence
cccggagctcaacggcggcg

SEQ ID NO: 123916 - DNA, 20 bp, Artificial
  CRISPR gRNA sequence
ccggagctcaacggcggcga

SEQ ID NO: 123917 - DNA, 20 bp, Artificial
  CRISPR gRNA sequence
agctcaacggcggcgagggt

SEQ ID NO: 123918 - DNA, 20 bp, Artificial
  CRISPR gRNA sequence
gctcaacggcggcgagggtg

SEQ ID NO: 123919 - DNA, 20 bp, Artificial
  CRISPR gRNA sequence
caacggcggcgagggtgagg

SEQ ID NO: 123920 - DNA, 20 bp, Artificial
  CRISPR gRNA sequence
gcggcgagggtgaggtggcc

SEQ ID NO: 123921 - DNA, 20 bp, Artificial
  CRISPR gRNA sequence
gcccgcgtcccgccgctcct

SEQ ID NO: 123922 - DNA, 20 bp, Artificial
  CRISPR gRNA sequence
cgtcccgccgctcctcagcc

SEQ ID NO: 123923 - DNA, 20 bp, Artificial
  CRISPR gRNA sequence
gctcctcagcccggcgcaca

SEQ ID NO: 123924 - DNA, 20 bp, Artificial
  CRISPR gRNA sequence
tcctcagcccggcgcacaaa

SEQ ID NO: 123925 - DNA, 20 bp, Artificial
  CRISPR gRNA sequence
gcgcacaaagagccgcgccg

SEQ ID NO: 123926 - DNA, 20 bp, Artificial
  CRISPR gRNA sequence
gcggccccgcgcccgctccc

SEQ ID NO: 123927 - DNA, 20 bp, Artificial
  CRISPR gRNA sequence
cccgcgcccgctccccggcc

SEQ ID NO: 123928 - DNA, 20 bp, Artificial
  CRISPR gRNA sequence
ctccccggcccggcccgctg

SEQ ID NO: 123929 - DNA, 20 bp, Artificial
  CRISPR gRNA sequence
tccccggcccggcccgctgc

SEQ ID NO: 123930 - DNA, 20 bp, Artificial
  CRISPR gRNA sequence
cccggcccggcccgctgcgg

SEQ ID NO: 123931 - DNA, 20 bp, Artificial
  CRISPR gRNA sequence
ggcccggcccgctgcgggag

SEQ ID NO: 123932 - DNA, 20 bp, Artificial
  CRISPR gRNA sequence
ccgctgcgggagcggcctcg

SEQ ID NO: 123933 - DNA, 20 bp, Artificial
  CRISPR gRNA sequence
cgctgcgggagcggcctcgc

SEQ ID NO: 123934 - DNA, 20 bp, Artificial
  CRISPR gRNA sequence
cgggagcggcctcgcaggcg

SEQ ID NO: 123935 - DNA, 20 bp, Artificial
  CRISPR gRNA sequence
gggagcggcctcgcaggcgc

SEQ ID NO: 123936 - DNA, 20 bp, Artificial
  CRISPR gRNA sequence
ggagcggcctcgcaggcgcg

SEQ ID NO: 123937 - DNA, 20 bp, Artificial
  CRISPR gRNA sequence
ggcctcgcaggcgcggggcc

SEQ ID NO: 123938 - DNA, 20 bp, Artificial
  CRISPR gRNA sequence
gcaggcgcggggcccggcct

SEQ ID NO: 123939 - DNA, 20 bp, Artificial
  CRISPR gRNA sequence
gggcccggcctcggcccgcg

SEQ ID NO: 123940 - DNA, 20 bp, Artificial
  CRISPR gRNA sequence
ggcccggcctcggcccgcgc

SEQ ID NO: 123941 - DNA, 20 bp, Artificial
  CRISPR gRNA sequence
cccggcctcggcccgcgcgg

SEQ ID NO: 123942 - DNA, 20 bp, Artificial
  CRISPR gRNA sequence
ccggcctcggcccgcgcggg

SEQ ID NO: 123943 - DNA, 20 bp, Artificial
  CRISPR gRNA sequence
cggcctcggcccgcgcggga

SEQ ID NO: 123944 - DNA, 20 bp, Artificial
  CRISPR gRNA sequence
cctcggcccgcgcgggaggg

SEQ ID NO: 123945 - DNA, 20 bp, Artificial
  CRISPR gRNA sequence
ctcggcccgcgcgggagggc

SEQ ID NO: 123946 - DNA, 20 bp, Artificial
  CRISPR gRNA sequence
cggcccgcgcgggagggcgg

SEQ ID NO: 123947 - DNA, 20 bp, Artificial
  CRISPR gRNA sequence
ggcccgcgcgggagggcggg

SEQ ID NO: 123948 - DNA, 20 bp, Artificial
  CRISPR gRNA sequence
cgcgcgggagggcgggaggc

SEQ ID NO: 123949 - DNA, 20 bp, Artificial
  CRISPR gRNA sequence
gggcgggaggctagtgcccc

SEQ ID NO: 123950 - DNA, 20 bp, Artificial
  CRISPR gRNA sequence
gaggctagtgcccccggccg

SEQ ID NO: 123951 - DNA, 20 bp, Artificial
  CRISPR gRNA sequence
gctagtgcccccggccgcgg

SEQ ID NO: 123952 - DNA, 20 bp, Artificial
  CRISPR gRNA sequence
gcccccggccgcggcggcgt

SEQ ID NO: 123953 - DNA, 20 bp, Artificial
  CRISPR gRNA sequence
cccggccgcggcggcgttgg

SEQ ID NO: 123954 - DNA, 20 bp, Artificial
  CRISPR gRNA sequence
ggccgcggcggcgttggcgg

SEQ ID NO: 123955 - DNA, 20 bp, Artificial
  CRISPR gRNA sequence
gccgcggcggcgttggcggc

SEQ ID NO: 123956 - DNA, 20 bp, Artificial
  CRISPR gRNA sequence
ccgcggcggcgttggcggcg

SEQ ID NO: 123957 - DNA, 20 bp, Artificial
  CRISPR gRNA sequence
ggcggcgttggcggcgggga

SEQ ID NO: 123958 - DNA, 20 bp, Artificial
  CRISPR gRNA sequence
gttggcggcggggacggcgc

SEQ ID NO: 123959 - DNA, 20 bp, Artificial
  CRISPR gRNA sequence
ttggcggcggggacggcgcc

SEQ ID NO: 123960 - DNA, 20 bp, Artificial
  CRISPR gRNA sequence
ggcggcggggacggcgccgg

SEQ ID NO: 123961 - DNA, 20 bp, Artificial
  CRISPR gRNA sequence
gcggcggggacggcgccggg

SEQ ID NO: 123962 - DNA, 20 bp, Artificial
  CRISPR gRNA sequence
ggcggggacggcgccgggag

SEQ ID NO: 123963 - DNA, 20 bp, Artificial
  CRISPR gRNA sequence
gggacggcgccgggaggaga

SEQ ID NO: 123964 - DNA, 20 bp, Artificial
  CRISPR gRNA sequence
aggagacggacatttcattc

SEQ ID NO: 123965 - DNA, 20 bp, Artificial
  CRISPR gRNA sequence
cggacatttcattcgagcta

SEQ ID NO: 123966 - DNA, 20 bp, Artificial
  CRISPR gRNA sequence
acatttcattcgagctaaag

SEQ ID NO: 123967 - DNA, 20 bp, Artificial
  CRISPR gRNA sequence
atttcattcgagctaaagtg

SEQ ID NO: 123968 - DNA, 20 bp, Artificial
  CRISPR gRNA sequence
cattcgagctaaagtggagt

SEQ ID NO: 123969 - DNA, 20 bp, Artificial
  CRISPR gRNA sequence
gagctaaagtggagtcggtt

SEQ ID NO: 123970 - DNA, 20 bp, Artificial
  CRISPR gRNA sequence
agctaaagtggagtcggttt

SEQ ID NO: 123971 - DNA, 20 bp, Artificial
  CRISPR gRNA sequence
ctaaagtggagtcggtttag

SEQ ID NO: 123972 - DNA, 20 bp, Artificial
  CRISPR gRNA sequence
gtcggtttaggagcgatcat

SEQ ID NO: 123973 - DNA, 20 bp, Artificial
  CRISPR gRNA sequence
ttaggagcgatcattggccg

SEQ ID NO: 123974 - DNA, 20 bp, Artificial
  CRISPR gRNA sequence
gagcgatcattggccgaagc

SEQ ID NO: 123975 - DNA, 20 bp, Artificial
  CRISPR gRNA sequence
cgagacacaaacctccaatg

SEQ ID NO: 123976 - DNA, 20 bp, Artificial
  CRISPR gRNA sequence
acaaacctccaatgcagccc

SEQ ID NO: 123977 - DNA, 20 bp, Artificial
  CRISPR gRNA sequence
acctccaatgcagccctggt

SEQ ID NO: 123978 - DNA, 20 bp, Artificial
  CRISPR gRNA sequence
ggttggctcccgtctccaat

SEQ ID NO: 123979 - DNA, 20 bp, Artificial
  CRISPR gRNA sequence
cccgtctccaatcggctgtt

SEQ ID NO: 123980 - DNA, 20 bp, Artificial
  CRISPR gRNA sequence
tctccaatcggctgtttggt

SEQ ID NO: 123981 - DNA, 20 bp, Artificial
  CRISPR gRNA sequence
caatcggctgtttggttgga

SEQ ID NO: 123982 - DNA, 20 bp, Artificial
  CRISPR gRNA sequence
ctgtttggttggacagaaaa

SEQ ID NO: 123983 - DNA, 20 bp, Artificial
  CRISPR gRNA sequence
ttggacagaaaatggctgcg

SEQ ID NO: 123984 - DNA, 20 bp, Artificial
  CRISPR gRNA sequence
tggacagaaaatggctgcga

SEQ ID NO: 123985 - DNA, 20 bp, Artificial
  CRISPR gRNA sequence
gaaaatggctgcgaaggaac

SEQ ID NO: 123986 - DNA, 20 bp, Artificial
  CRISPR gRNA sequence
ggctgcgaaggaaccagtcc

SEQ ID NO: 123987 - DNA, 20 bp, Artificial
  CRISPR gRNA sequence
cgaaggaaccagtcccagcg

SEQ ID NO: 123988 - DNA, 20 bp, Artificial
  CRISPR gRNA sequence
aaggaaccagtcccagcgcg

SEQ ID NO: 123989 - DNA, 20 bp, Artificial
  CRISPR gRNA sequence
ccagcgcggagctccgcttc

SEQ ID NO: 123990 - DNA, 20 bp, Artificial
  CRISPR gRNA sequence
cagcgcggagctccgcttcc

SEQ ID NO: 123991 - DNA, 20 bp, Artificial
  CRISPR gRNA sequence
ggagctccgcttccaggact

SEQ ID NO: 123992 - DNA, 20 bp, Artificial
  CRISPR gRNA sequence
ggcctcccctccctccgccg

SEQ ID NO: 123993 - DNA, 20 bp, Artificial
  CRISPR gRNA sequence
gcctcccctccctccgccgc

SEQ ID NO: 123994 - DNA, 20 bp, Artificial
  CRISPR gRNA sequence
ccgccgcgggccgcttccct

SEQ ID NO: 123995 - DNA, 20 bp, Artificial
  CRISPR gRNA sequence
gcccgcgcgcccgcccgccg

SEQ ID NO: 123996 - DNA, 20 bp, Artificial
  CRISPR gRNA sequence
gggcggggcggggccgcggc

SEQ ID NO: 123997 - DNA, 20 bp, Artificial
  CRISPR gRNA sequence
cggggcggggccgcggcggg

SEQ ID NO: 123998 - DNA, 20 bp, Artificial
  CRISPR gRNA sequence
ggggcggggccgcggcgggc

SEQ ID NO: 123999 - DNA, 20 bp, Artificial
  CRISPR gRNA sequence
ggccgcggcgggcgggcgcg

SEQ ID NO: 124000 - DNA, 20 bp, Artificial
  CRISPR gRNA sequence
gccgcggcgggcgggcgcgc

SEQ ID NO: 124001 - DNA, 20 bp, Artificial
  CRISPR gRNA sequence
gcggcgggcgggcgcgcggg

SEQ ID NO: 124002 - DNA, 20 bp, Artificial
  CRISPR gRNA sequence
gggcgggcgcgcgggcggcg

SEQ ID NO: 124003 - DNA, 20 bp, Artificial
  CRISPR gRNA sequence
gcgggcgcgcgggcggcgcg

SEQ ID NO: 124004 - DNA, 20 bp, Artificial
  CRISPR gRNA sequence
cgggcgcgcgggcggcgcgg

SEQ ID NO: 124005 - DNA, 20 bp, Artificial
  CRISPR gRNA sequence
gggcgcgcgggcggcgcgga

SEQ ID NO: 124006 - DNA, 20 bp, Artificial
  CRISPR gRNA sequence
gcgcgcgggcggcgcggagg

SEQ ID NO: 124007 - DNA, 20 bp, Artificial
  CRISPR gRNA sequence
cgcgcgggcggcgcggaggg

SEQ ID NO: 124008 - DNA, 20 bp, Artificial
  CRISPR gRNA sequence
gcgcgggcggcgcggaggga

SEQ ID NO: 124009 - DNA, 20 bp, Artificial
  CRISPR gRNA sequence
cggagggagggtgtcgcgcc

SEQ ID NO: 124010 - DNA, 20 bp, Artificial
  CRISPR gRNA sequence
ggagggagggtgtcgcgccg

SEQ ID NO: 124011 - DNA, 20 bp, Artificial
  CRISPR gRNA sequence
gagggagggtgtcgcgccga

SEQ ID NO: 124012 - DNA, 20 bp, Artificial
  CRISPR gRNA sequence
ggagggtgtcgcgccgaggg

SEQ ID NO: 124013 - DNA, 20 bp, Artificial
  CRISPR gRNA sequence
gggtgtcgcgccgagggaag

SEQ ID NO: 124014 - DNA, 20 bp, Artificial
  CRISPR gRNA sequence
gcgccgagggaagcggcccg

SEQ ID NO: 124015 - DNA, 20 bp, Artificial
  CRISPR gRNA sequence
ccgagggaagcggcccgcgg

SEQ ID NO: 124016 - DNA, 20 bp, Artificial
  CRISPR gRNA sequence
gagggaagcggcccgcggcg

SEQ ID NO: 124017 - DNA, 20 bp, Artificial
  CRISPR gRNA sequence
agggaagcggcccgcggcgg

SEQ ID NO: 124018 - DNA, 20 bp, Artificial
  CRISPR gRNA sequence
gggaagcggcccgcggcgga

SEQ ID NO: 124019 - DNA, 20 bp, Artificial
  CRISPR gRNA sequence
gaagcggcccgcggcggagg

SEQ ID NO: 124020 - DNA, 20 bp, Artificial
  CRISPR gRNA sequence
aagcggcccgcggcggaggg

SEQ ID NO: 124021 - DNA, 20 bp, Artificial
  CRISPR gRNA sequence
agcggcccgcggcggaggga

SEQ ID NO: 124022 - DNA, 20 bp, Artificial
  CRISPR gRNA sequence
gcggcccgcggcggagggag

SEQ ID NO: 124023 - DNA, 20 bp, Artificial
  CRISPR gRNA sequence
ggcccgcggcggagggaggg

SEQ ID NO: 124024 - DNA, 20 bp, Artificial
  CRISPR gRNA sequence
gcccgcggcggagggagggg

SEQ ID NO: 124025 - DNA, 20 bp, Artificial
  CRISPR gRNA sequence
cggcggagggaggggaggcc

SEQ ID NO: 124026 - DNA, 20 bp, Artificial
  CRISPR gRNA sequence
agggaggggaggccgagtcc

SEQ ID NO: 124027 - DNA, 20 bp, Artificial
  CRISPR gRNA sequence
gaggggaggccgagtcctgg

SEQ ID NO: 124028 - DNA, 20 bp, Artificial
  CRISPR gRNA sequence
gggaggccgagtcctggaag

SEQ ID NO: 124029 - DNA, 20 bp, Artificial
  CRISPR gRNA sequence
gaggccgagtcctggaagcg

SEQ ID NO: 124030 - DNA, 20 bp, Artificial
  CRISPR gRNA sequence
ctggaagcggagctccgcgc

SEQ ID NO: 124031 - DNA, 20 bp, Artificial
  CRISPR gRNA sequence
tggaagcggagctccgcgct

SEQ ID NO: 124032 - DNA, 20 bp, Artificial
  CRISPR gRNA sequence
gcggagctccgcgctgggac

SEQ ID NO: 124033 - DNA, 20 bp, Artificial
  CRISPR gRNA sequence
cgctgggactggttccttcg

SEQ ID NO: 124034 - DNA, 20 bp, Artificial
  CRISPR gRNA sequence
ccattttctgtccaaccaaa

SEQ ID NO: 124035 - DNA, 20 bp, Artificial
  CRISPR gRNA sequence
tgtccaaccaaacagccgat

SEQ ID NO: 124036 - DNA, 20 bp, Artificial
  CRISPR gRNA sequence
tccaaccaaacagccgattg

SEQ ID NO: 124037 - DNA, 20 bp, Artificial
  CRISPR gRNA sequence
accaaacagccgattggaga

SEQ ID NO: 124038 - DNA, 20 bp, Artificial
  CRISPR gRNA sequence
ccaaacagccgattggagac

SEQ ID NO: 124039 - DNA, 20 bp, Artificial
  CRISPR gRNA sequence
aaacagccgattggagacgg

SEQ ID NO: 124040 - DNA, 20 bp, Artificial
  CRISPR gRNA sequence
gattggagacgggagccaac

SEQ ID NO: 124041 - DNA, 20 bp, Artificial
  CRISPR gRNA sequence
attggagacgggagccaacc

SEQ ID NO: 124042 - DNA, 20 bp, Artificial
  CRISPR gRNA sequence
ttggagacgggagccaacca

SEQ ID NO: 124043 - DNA, 20 bp, Artificial
  CRISPR gRNA sequence
ggagccaaccagggctgcat

SEQ ID NO: 124044 - DNA, 20 bp, Artificial
  CRISPR gRNA sequence
agccaaccagggctgcattg

SEQ ID NO: 124045 - DNA, 20 bp, Artificial
  CRISPR gRNA sequence
gccaaccagggctgcattgg

SEQ ID NO: 124046 - DNA, 20 bp, Artificial
  CRISPR gRNA sequence
tggaggtttgtgtctcgctt

SEQ ID NO: 124047 - DNA, 20 bp, Artificial
  CRISPR gRNA sequence
ctcctaaaccgactccactt

SEQ ID NO: 124048 - DNA, 20 bp, Artificial
  CRISPR gRNA sequence
atgaaatgtccgtctcctcc

SEQ ID NO: 124049 - DNA, 20 bp, Artificial
  CRISPR gRNA sequence
ccccgccgccaacgccgccg

SEQ ID NO: 124050 - DNA, 20 bp, Artificial
  CRISPR gRNA sequence
gccgccaacgccgccgcggc

SEQ ID NO: 124051 - DNA, 20 bp, Artificial
  CRISPR gRNA sequence
ccgccaacgccgccgcggcc

SEQ ID NO: 124052 - DNA, 20 bp, Artificial
  CRISPR gRNA sequence
cgccaacgccgccgcggccg

SEQ ID NO: 124053 - DNA, 20 bp, Artificial
  CRISPR gRNA sequence
gccaacgccgccgcggccgg

SEQ ID NO: 124054 - DNA, 20 bp, Artificial
  CRISPR gRNA sequence
gccgccgcggccgggggcac

SEQ ID NO: 124055 - DNA, 20 bp, Artificial
  CRISPR gRNA sequence
tagcctcccgccctcccgcg

SEQ ID NO: 124056 - DNA, 20 bp, Artificial
  CRISPR gRNA sequence
agcctcccgccctcccgcgc

SEQ ID NO: 124057 - DNA, 20 bp, Artificial
  CRISPR gRNA sequence
cccgccctcccgcgcgggcc

SEQ ID NO: 124058 - DNA, 20 bp, Artificial
  CRISPR gRNA sequence
ccgccctcccgcgcgggccg

SEQ ID NO: 124059 - DNA, 20 bp, Artificial
  CRISPR gRNA sequence
cctcccgcgcgggccgaggc

SEQ ID NO: 124060 - DNA, 20 bp, Artificial
  CRISPR gRNA sequence
ctcccgcgcgggccgaggcc

SEQ ID NO: 124061 - DNA, 20 bp, Artificial
  CRISPR gRNA sequence
aggccgggccccgcgcctgc

SEQ ID NO: 124062 - DNA, 20 bp, Artificial
  CRISPR gRNA sequence
ggccgggccccgcgcctgcg

SEQ ID NO: 124063 - DNA, 20 bp, Artificial
  CRISPR gRNA sequence
cgcctgcgaggccgctcccg

SEQ ID NO: 124064 - DNA, 20 bp, Artificial
  CRISPR gRNA sequence
ctgcgaggccgctcccgcag

SEQ ID NO: 124065 - DNA, 20 bp, Artificial
  CRISPR gRNA sequence
tgcgaggccgctcccgcagc

SEQ ID NO: 124066 - DNA, 20 bp, Artificial
  CRISPR gRNA sequence
aggccgctcccgcagcgggc

SEQ ID NO: 124067 - DNA, 20 bp, Artificial
  CRISPR gRNA sequence
ggccgctcccgcagcgggcc

SEQ ID NO: 124068 - DNA, 20 bp, Artificial
  CRISPR gRNA sequence
gctcccgcagcgggccgggc

SEQ ID NO: 124069 - DNA, 20 bp, Artificial
  CRISPR gRNA sequence
ctcccgcagcgggccgggcc

SEQ ID NO: 124070 - DNA, 20 bp, Artificial
  CRISPR gRNA sequence
tcccgcagcgggccgggccg

SEQ ID NO: 124071 - DNA, 20 bp, Artificial
  CRISPR gRNA sequence
ccgcagcgggccgggccggg

SEQ ID NO: 124072 - DNA, 20 bp, Artificial
  CRISPR gRNA sequence
cagcgggccgggccggggag

SEQ ID NO: 124073 - DNA, 20 bp, Artificial
  CRISPR gRNA sequence
agcgggccgggccggggagc

SEQ ID NO: 124074 - DNA, 20 bp, Artificial
  CRISPR gRNA sequence
gccgggccggggagcgggcg

SEQ ID NO: 124075 - DNA, 20 bp, Artificial
  CRISPR gRNA sequence
ccgggccggggagcgggcgc

SEQ ID NO: 124076 - DNA, 20 bp, Artificial
  CRISPR gRNA sequence
cgggccggggagcgggcgcg

SEQ ID NO: 124077 - DNA, 20 bp, Artificial
  CRISPR gRNA sequence
ggggagcgggcgcggggccg

SEQ ID NO: 124078 - DNA, 20 bp, Artificial
  CRISPR gRNA sequence
gcgggcgcggggccgcggcg

SEQ ID NO: 124079 - DNA, 20 bp, Artificial
  CRISPR gRNA sequence
cggcgcggctctttgtgcgc

SEQ ID NO: 124080 - DNA, 20 bp, Artificial
  CRISPR gRNA sequence
ggcgcggctctttgtgcgcc

SEQ ID NO: 124081 - DNA, 20 bp, Artificial
  CRISPR gRNA sequence
ggctctttgtgcgccgggct

SEQ ID NO: 124082 - DNA, 20 bp, Artificial
  CRISPR gRNA sequence
gctctttgtgcgccgggctg

SEQ ID NO: 124083 - DNA, 20 bp, Artificial
  CRISPR gRNA sequence
tctttgtgcgccgggctgag

SEQ ID NO: 124084 - DNA, 20 bp, Artificial
  CRISPR gRNA sequence
ttgtgcgccgggctgaggag

SEQ ID NO: 124085 - DNA, 20 bp, Artificial
  CRISPR gRNA sequence
tgcgccgggctgaggagcgg

SEQ ID NO: 124086 - DNA, 20 bp, Artificial
  CRISPR gRNA sequence
gcgccgggctgaggagcggc

SEQ ID NO: 124087 - DNA, 20 bp, Artificial
  CRISPR gRNA sequence
ggctgaggagcggcgggacg

SEQ ID NO: 124088 - DNA, 20 bp, Artificial
  CRISPR gRNA sequence
gctgaggagcggcgggacgc

SEQ ID NO: 124089 - DNA, 20 bp, Artificial
  CRISPR gRNA sequence
aggagcggcgggacgcgggc

SEQ ID NO: 124090 - DNA, 20 bp, Artificial
  CRISPR gRNA sequence
ggagcggcgggacgcgggcc

SEQ ID NO: 124091 - DNA, 20 bp, Artificial
  CRISPR gRNA sequence
acctcaccctcgccgccgtt

SEQ ID NO: 124092 - DNA, 20 bp, Artificial
  CRISPR gRNA sequence
ccctcgccgccgttgagctc

SEQ ID NO: 124093 - DNA, 20 bp, Artificial
  CRISPR gRNA sequence
cctcgccgccgttgagctcc

SEQ ID NO: 124094 - DNA, 20 bp, Artificial
  CRISPR gRNA sequence
ccgccgttgagctccgggcc

SEQ ID NO: 124095 - DNA, 20 bp, Artificial
  CRISPR gRNA sequence
cgccgttgagctccgggccc

SEQ ID NO: 124096 - DNA, 20 bp, Artificial
  CRISPR gRNA sequence
gccgttgagctccgggcccg

SEQ ID NO: 124097 - DNA, 20 bp, Artificial
  CRISPR gRNA sequence
tgagctccgggcccggggcc

SEQ ID NO: 124098 - DNA, 20 bp, Artificial
  CRISPR gRNA sequence
gagctccgggcccggggccg

SEQ ID NO: 124099 - DNA, 20 bp, Artificial
  CRISPR gRNA sequence
gctccgggcccggggccgag

SEQ ID NO: 124100 - DNA, 20 bp, Artificial
  CRISPR gRNA sequence
ctccgggcccggggccgagg

SEQ ID NO: 124101 - DNA, 20 bp, Artificial
  CRISPR gRNA sequence
tccgggcccggggccgagga

SEQ ID NO: 124102 - DNA, 20 bp, Artificial
  CRISPR gRNA sequence
ccgggcccggggccgaggag

SEQ ID NO: 124103 - DNA, 20 bp, Artificial
  CRISPR gRNA sequence
ccggggccgaggaggggccg

SEQ ID NO: 124104 - DNA, 20 bp, Artificial
  CRISPR gRNA sequence
cggggccgaggaggggccgc

SEQ ID NO: 124105 - DNA, 20 bp, Artificial
  CRISPR gRNA sequence
ggggccgaggaggggccgcg

SEQ ID NO: 124106 - DNA, 20 bp, Artificial
  CRISPR gRNA sequence
gaggggccgcggggctgcgt

SEQ ID NO: 124107 - DNA, 20 bp, Artificial
  CRISPR gRNA sequence
aggggccgcggggctgcgtc

SEQ ID NO: 124108 - DNA, 20 bp, Artificial
  CRISPR gRNA sequence
ggggccgcggggctgcgtcg

SEQ ID NO: 124109 - DNA, 20 bp, Artificial
  CRISPR gRNA sequence
cgtcggggccccgctctcga

SEQ ID NO: 124110 - DNA, 20 bp, Artificial
  CRISPR gRNA sequence
ccccgctctcgacggcgtcc

SEQ ID NO: 124111 - DNA, 20 bp, Artificial
  CRISPR gRNA sequence
cccgctctcgacggcgtccc

SEQ ID NO: 124112 - DNA, 20 bp, Artificial
  CRISPR gRNA sequence
ctctcgacggcgtcccgggc

SEQ ID NO: 124113 - DNA, 20 bp, Artificial
  CRISPR gRNA sequence
cgggccggctccattttgtg

SEQ ID NO: 124114 - DNA, 20 bp, Artificial
  CRISPR gRNA sequence
gggccggctccattttgtgc

SEQ ID NO: 124115 - DNA, 20 bp, Artificial
  CRISPR gRNA sequence
ggccggctccattttgtgcg

SEQ ID NO: 124116 - DNA, 20 bp, Artificial
  CRISPR gRNA sequence
ccggctccattttgtgcggg

SEQ ID NO: 124117 - DNA, 20 bp, Artificial
  CRISPR gRNA sequence
ctccattttgtgcggggagc

SEQ ID NO: 124118 - DNA, 20 bp, Artificial
  CRISPR gRNA sequence
ttttgtgcggggagccggcc

SEQ ID NO: 124119 - DNA, 20 bp, Artificial
  CRISPR gRNA sequence
tttgtgcggggagccggccg

SEQ ID NO: 124120 - DNA, 20 bp, Artificial
  CRISPR gRNA sequence
ttgtgcggggagccggccga

SEQ ID NO: 124121 - DNA, 20 bp, Artificial
  CRISPR gRNA sequence
tgtgcggggagccggccgag

SEQ ID NO: 124122 - DNA, 20 bp, Artificial
  CRISPR gRNA sequence
gcggggagccggccgagggg

SEQ ID NO: 124123 - DNA, 20 bp, Artificial
  CRISPR gRNA sequence
cggggagccggccgaggggc

SEQ ID NO: 124124 - DNA, 20 bp, Artificial
  CRISPR gRNA sequence
gggagccggccgaggggcgg

SEQ ID NO: 124125 - DNA, 20 bp, Artificial
  CRISPR gRNA sequence
cggccgaggggcgggagacg

SEQ ID NO: 124126 - DNA, 20 bp, Artificial
  CRISPR gRNA sequence
gaggggcgggagacgcggcc

SEQ ID NO: 124127 - DNA, 20 bp, Artificial
  CRISPR gRNA sequence
aggggcgggagacgcggccc

SEQ ID NO: 124128 - DNA, 20 bp, Artificial
  CRISPR gRNA sequence
gggagacgcggcccgggccc

SEQ ID NO: 124129 - DNA, 20 bp, Artificial
  CRISPR gRNA sequence
cggcccgggccctggccccg

SEQ ID NO: 124130 - DNA, 20 bp, Artificial
  CRISPR gRNA sequence
gggccctggccccgtagccc

SEQ ID NO: 124131 - DNA, 20 bp, Artificial
  CRISPR gRNA sequence
ccctggccccgtagccccgg

SEQ ID NO: 124132 - DNA, 20 bp, Artificial
  CRISPR gRNA sequence
tggccccgtagccccggcgg

SEQ ID NO: 124133 - DNA, 20 bp, Artificial
  CRISPR gRNA sequence
cgtagccccggcggcggcgc

SEQ ID NO: 124134 - DNA, 20 bp, Artificial
  CRISPR gRNA sequence
ccggcggcggcgcgagtccc

SEQ ID NO: 124135 - DNA, 20 bp, Artificial
  CRISPR gRNA sequence
cggcggcggcgcgagtcccc

SEQ ID NO: 124136 - DNA, 20 bp, Artificial
  CRISPR gRNA sequence
ggcggcggcgcgagtccccg

SEQ ID NO: 124137 - DNA, 20 bp, Artificial
  CRISPR gRNA sequence
gcggcggcgcgagtccccgg

SEQ ID NO: 124138 - DNA, 20 bp, Artificial
  CRISPR gRNA sequence
gggcgccctcctcccgcccg

SEQ ID NO: 124139 - DNA, 20 bp, Artificial
  CRISPR gRNA sequence
ggcgccctcctcccgcccgc

SEQ ID NO: 124140 - DNA, 20 bp, Artificial
  CRISPR gRNA sequence
gcgccctcctcccgcccgcg

SEQ ID NO: 124141 - DNA, 20 bp, Artificial
  CRISPR gRNA sequence
tcctcccgcccgcggggctg

SEQ ID NO: 124142 - DNA, 20 bp, Artificial
  CRISPR gRNA sequence
tcccgcccgcggggctgtgg

SEQ ID NO: 124143 - DNA, 20 bp, Artificial
  CRISPR gRNA sequence
cccgcccgcggggctgtggc

SEQ ID NO: 124144 - DNA, 20 bp, Artificial
  CRISPR gRNA sequence
ccgcccgcggggctgtggcg

SEQ ID NO: 124145 - DNA, 20 bp, Artificial
  CRISPR gRNA sequence
cgcggggctgtggcggggcc

SEQ ID NO: 124146 - DNA, 20 bp, Artificial
  CRISPR gRNA sequence
ctttgtctgcccgcacatcc

SEQ ID NO: 124147 - DNA, 20 bp, Artificial
  CRISPR gRNA sequence
tttgtctgcccgcacatccc

SEQ ID NO: 124148 - DNA, 20 bp, Artificial
  CRISPR gRNA sequence
ttgtctgcccgcacatcccg

SEQ ID NO: 124149 - DNA, 20 bp, Artificial
  CRISPR gRNA sequence
tgtctgcccgcacatcccgg

SEQ ID NO: 124150 - DNA, 20 bp, Artificial
  CRISPR gRNA sequence
cgcacatcccgggggccgcg

SEQ ID NO: 124151 - DNA, 20 bp, Artificial
  CRISPR gRNA sequence
acatcccgggggccgcgcgg

SEQ ID NO: 124152 - DNA, 20 bp, Artificial
  CRISPR gRNA sequence
catcccgggggccgcgcggc

SEQ ID NO: 124153 - DNA, 20 bp, Artificial
  CRISPR gRNA sequence
cccgggggccgcgcggcggg

SEQ ID NO: 124154 - DNA, 20 bp, Artificial
  CRISPR gRNA sequence
ccgggggccgcgcggcgggt

SEQ ID NO: 124155 - DNA, 20 bp, Artificial
  CRISPR gRNA sequence
gggggccgcgcggcgggtgg

SEQ ID NO: 124156 - DNA, 20 bp, Artificial
  CRISPR gRNA sequence
ggggccgcgcggcgggtggg

SEQ ID NO: 124157 - DNA, 20 bp, Artificial
  CRISPR gRNA sequence
gccgcgcggcgggtgggagg

SEQ ID NO: 124158 - DNA, 20 bp, Artificial
  CRISPR gRNA sequence
ccgcgcggcgggtgggaggc

SEQ ID NO: 124159 - DNA, 20 bp, Artificial
  CRISPR gRNA sequence
ggcgggtgggaggcaggcgt

SEQ ID NO: 124160 - DNA, 20 bp, Artificial
  CRISPR gRNA sequence
gcgggtgggaggcaggcgtt

SEQ ID NO: 124161 - DNA, 20 bp, Artificial
  CRISPR gRNA sequence
tgggaggcaggcgttgggcg

SEQ ID NO: 124162 - DNA, 20 bp, Artificial
  CRISPR gRNA sequence
gggaggcaggcgttgggcgc

SEQ ID NO: 124163 - DNA, 20 bp, Artificial
  CRISPR gRNA sequence
ggaggcaggcgttgggcgcg

SEQ ID NO: 124164 - DNA, 20 bp, Artificial
  CRISPR gRNA sequence
gcaggcgttgggcgcggggc

SEQ ID NO: 124165 - DNA, 20 bp, Artificial
  CRISPR gRNA sequence
caggcgttgggcgcggggcc

SEQ ID NO: 124166 - DNA, 20 bp, Artificial
  CRISPR gRNA sequence
aggcgttgggcgcggggccg

SEQ ID NO: 124167 - DNA, 20 bp, Artificial
  CRISPR gRNA sequence
cgttgggcgcggggccgggg

SEQ ID NO: 124168 - DNA, 20 bp, Artificial
  CRISPR gRNA sequence
gggcgcggggccggggcggc

SEQ ID NO: 124169 - DNA, 20 bp, Artificial
  CRISPR gRNA sequence
ggcgcggggccggggcggcc

SEQ ID NO: 124170 - DNA, 20 bp, Artificial
  CRISPR gRNA sequence
cggggccggggcggccgggc

SEQ ID NO: 124171 - DNA, 20 bp, Artificial
  CRISPR gRNA sequence
gccggggcggccgggcgagt

SEQ ID NO: 124172 - DNA, 20 bp, Artificial
  CRISPR gRNA sequence
ccggggcggccgggcgagtc

SEQ ID NO: 124173 - DNA, 20 bp, Artificial
  CRISPR gRNA sequence
cggggcggccgggcgagtca

SEQ ID NO: 124174 - DNA, 20 bp, Artificial
  CRISPR gRNA sequence
ggggcggccgggcgagtcag

SEQ ID NO: 124175 - DNA, 20 bp, Artificial
  CRISPR gRNA sequence
gcgagtcaggggatgcgctc

SEQ ID NO: 124176 - DNA, 20 bp, Artificial
  CRISPR gRNA sequence
cgagtcaggggatgcgctct

SEQ ID NO: 124177 - DNA, 20 bp, Artificial
  CRISPR gRNA sequence
gagtcaggggatgcgctctg

SEQ ID NO: 124178 - DNA, 20 bp, Artificial
  CRISPR gRNA sequence
agtcaggggatgcgctctgg

SEQ ID NO: 124179 - DNA, 20 bp, Artificial
  CRISPR gRNA sequence
caggggatgcgctctggggg

SEQ ID NO: 124180 - DNA, 20 bp, Artificial
  CRISPR gRNA sequence
gcgctctgggggcggcctcc

SEQ ID NO: 124181 - DNA, 20 bp, Artificial
  CRISPR gRNA sequence
gggcggcctcctggcactcg

SEQ ID NO: 124182 - DNA, 20 bp, Artificial
  CRISPR gRNA sequence
ggcggcctcctggcactcgc

SEQ ID NO: 124183 - DNA, 20 bp, Artificial
  CRISPR gRNA sequence
gcggcctcctggcactcgca

SEQ ID NO: 124184 - DNA, 20 bp, Artificial
  CRISPR gRNA sequence
cctggcactcgcagggctga

SEQ ID NO: 124185 - DNA, 20 bp, Artificial
  CRISPR gRNA sequence
ctggcactcgcagggctgac

SEQ ID NO: 124186 - DNA, 20 bp, Artificial
  CRISPR gRNA sequence
tcgcagggctgacaggtcgc

SEQ ID NO: 124187 - DNA, 20 bp, Artificial
  CRISPR gRNA sequence
cgcagggctgacaggtcgcc

SEQ ID NO: 124188 - DNA, 20 bp, Artificial
  CRISPR gRNA sequence
ggctgacaggtcgccgggac

SEQ ID NO: 124189 - DNA, 20 bp, Artificial
  CRISPR gRNA sequence
gctgacaggtcgccgggacc

SEQ ID NO: 124190 - DNA, 20 bp, Artificial
  CRISPR gRNA sequence
aggtcgccgggaccaggccg

SEQ ID NO: 124191 - DNA, 20 bp, Artificial
  CRISPR gRNA sequence
ggtcgccgggaccaggccgt

SEQ ID NO: 124192 - DNA, 20 bp, Artificial
  CRISPR gRNA sequence
gtcgccgggaccaggccgtg

SEQ ID NO: 124193 - DNA, 20 bp, Artificial
  CRISPR gRNA sequence
ccgggaccaggccgtggggc

SEQ ID NO: 124194 - DNA, 20 bp, Artificial
  CRISPR gRNA sequence
cgggaccaggccgtggggcc

SEQ ID NO: 124195 - DNA, 20 bp, Artificial
  CRISPR gRNA sequence
gggaccaggccgtggggccg

SEQ ID NO: 124196 - DNA, 20 bp, Artificial
  CRISPR gRNA sequence
gccgtggggccggggccacc

SEQ ID NO: 124197 - DNA, 20 bp, Artificial
  CRISPR gRNA sequence
ccgtggggccggggccaccc

SEQ ID NO: 124198 - DNA, 20 bp, Artificial
  CRISPR gRNA sequence
gggccacccaggcacctgcg

SEQ ID NO: 124199 - DNA, 20 bp, Artificial
  CRISPR gRNA sequence
ggccacccaggcacctgcgt

SEQ ID NO: 124200 - DNA, 20 bp, Artificial
  CRISPR gRNA sequence
gccacccaggcacctgcgtg

SEQ ID NO: 124201 - DNA, 20 bp, Artificial
  CRISPR gRNA sequence
cacccaggcacctgcgtggg

SEQ ID NO: 124202 - DNA, 20 bp, Artificial
  CRISPR gRNA sequence
acccaggcacctgcgtgggg

SEQ ID NO: 124203 - DNA, 20 bp, Artificial
  CRISPR gRNA sequence
caggcacctgcgtggggagg

SEQ ID NO: 124204 - DNA, 20 bp, Artificial
  CRISPR gRNA sequence
aggcacctgcgtggggagga

SEQ ID NO: 124205 - DNA, 20 bp, Artificial
  CRISPR gRNA sequence
cctgcgtggggaggaaggca

SEQ ID NO: 124206 - DNA, 20 bp, Artificial
  CRISPR gRNA sequence
tggggaggaaggcatggctt

SEQ ID NO: 124207 - DNA, 20 bp, Artificial
  CRISPR gRNA sequence
gcatggctttagcttccccg

SEQ ID NO: 124208 - DNA, 20 bp, Artificial
  CRISPR gRNA sequence
gctttagcttccccgcagcc

SEQ ID NO: 124209 - DNA, 20 bp, Artificial
  CRISPR gRNA sequence
cgcagcctggtttgcgcgta

SEQ ID NO: 124210 - DNA, 20 bp, Artificial
  CRISPR gRNA sequence
tggtttgcgcgtaaagaatg

SEQ ID NO: 124211 - DNA, 20 bp, Artificial
  CRISPR gRNA sequence
gcgtaaagaatgcagccatc

SEQ ID NO: 124212 - DNA, 20 bp, Artificial
  CRISPR gRNA sequence
taaagaatgcagccatctgg

SEQ ID NO: 124213 - DNA, 20 bp, Artificial
  CRISPR gRNA sequence
tgcagccatctggcggtttg

SEQ ID NO: 124214 - DNA, 20 bp, Artificial
  CRISPR gRNA sequence
cggtccctgtacttgccccg

SEQ ID NO: 124215 - DNA, 20 bp, Artificial
  CRISPR gRNA sequence
ggtccctgtacttgccccga

SEQ ID NO: 124216 - DNA, 20 bp, Artificial
  CRISPR gRNA sequence
ccctgtacttgccccgaagg

SEQ ID NO: 124217 - DNA, 20 bp, Artificial
  CRISPR gRNA sequence
cctgtacttgccccgaaggt

SEQ ID NO: 124218 - DNA, 20 bp, Artificial
  CRISPR gRNA sequence
gtacttgccccgaaggtggg

SEQ ID NO: 124219 - DNA, 20 bp, Artificial
  CRISPR gRNA sequence
tacttgccccgaaggtggga

SEQ ID NO: 124220 - DNA, 20 bp, Artificial
  CRISPR gRNA sequence
ttgccccgaaggtgggaagg

SEQ ID NO: 124221 - DNA, 20 bp, Artificial
  CRISPR gRNA sequence
aaggtgggaaggaagccctt

SEQ ID NO: 124222 - DNA, 20 bp, Artificial
  CRISPR gRNA sequence
gggaaggaagcccttcggat

SEQ ID NO: 124223 - DNA, 20 bp, Artificial
  CRISPR gRNA sequence
gaagcccttcggattggact

SEQ ID NO: 124224 - DNA, 20 bp, Artificial
  CRISPR gRNA sequence
aagcccttcggattggacta

SEQ ID NO: 124225 - DNA, 20 bp, Artificial
  CRISPR gRNA sequence
tggactaaggttttaatcat

SEQ ID NO: 124226 - DNA, 20 bp, Artificial
  CRISPR gRNA sequence
actaaggttttaatcattag

SEQ ID NO: 124227 - DNA, 20 bp, Artificial
  CRISPR gRNA sequence
aaggttttaatcattagtgg

SEQ ID NO: 124228 - DNA, 20 bp, Artificial
  CRISPR gRNA sequence
aggttttaatcattagtggt

SEQ ID NO: 124229 - DNA, 20 bp, Artificial
  CRISPR gRNA sequence
gttttaatcattagtggtgg

SEQ ID NO: 124230 - DNA, 20 bp, Artificial
  CRISPR gRNA sequence
ttttaatcattagtggtggg

SEQ ID NO: 124231 - DNA, 20 bp, Artificial
  CRISPR gRNA sequence
taatcattagtggtgggagg

SEQ ID NO: 124232 - DNA, 20 bp, Artificial
  CRISPR gRNA sequence
aatcattagtggtgggaggc

SEQ ID NO: 124233 - DNA, 20 bp, Artificial
  CRISPR gRNA sequence
tcattagtggtgggaggcgg

SEQ ID NO: 124234 - DNA, 20 bp, Artificial
  CRISPR gRNA sequence
cattagtggtgggaggcggg

SEQ ID NO: 124235 - DNA, 20 bp, Artificial
  CRISPR gRNA sequence
gtgggaggcgggaggatatg

SEQ ID NO: 124236 - DNA, 20 bp, Artificial
  CRISPR gRNA sequence
tgggaggcgggaggatatgc

SEQ ID NO: 124237 - DNA, 20 bp, Artificial
  CRISPR gRNA sequence
gggaggcgggaggatatgca

SEQ ID NO: 124238 - DNA, 20 bp, Artificial
  CRISPR gRNA sequence
ggaggatatgcagggcctta

SEQ ID NO: 124239 - DNA, 20 bp, Artificial
  CRISPR gRNA sequence
atatgcagggccttaaagaa

SEQ ID NO: 124240 - DNA, 20 bp, Artificial
  CRISPR gRNA sequence
tgcagggccttaaagaacgg

SEQ ID NO: 124241 - DNA, 20 bp, Artificial
  CRISPR gRNA sequence
gccttaaagaacggtagtct

SEQ ID NO: 124242 - DNA, 20 bp, Artificial
  CRISPR gRNA sequence
cttaaagaacggtagtctta

SEQ ID NO: 124243 - DNA, 20 bp, Artificial
  CRISPR gRNA sequence
aacggtagtcttagagaaca

SEQ ID NO: 124244 - DNA, 20 bp, Artificial
  CRISPR gRNA sequence
tcttagagaacaaagaatta

SEQ ID NO: 124245 - DNA, 20 bp, Artificial
  CRISPR gRNA sequence
ttagagaacaaagaattaca

SEQ ID NO: 124246 - DNA, 20 bp, Artificial
  CRISPR gRNA sequence
acaaatcgtaatctcgccca

SEQ ID NO: 124247 - DNA, 20 bp, Artificial
  CRISPR gRNA sequence
tctcgcccaaagcactctaa

SEQ ID NO: 124248 - DNA, 20 bp, Artificial
  CRISPR gRNA sequence
ctcgcccaaagcactctaac

SEQ ID NO: 124249 - DNA, 20 bp, Artificial
  CRISPR gRNA sequence
tctaacaggataatttaaac

SEQ ID NO: 124250 - DNA, 20 bp, Artificial
  CRISPR gRNA sequence
ctaacaggataatttaaaca

SEQ ID NO: 124251 - DNA, 20 bp, Artificial
  CRISPR gRNA sequence
caggataatttaaacaaggt

SEQ ID NO: 124252 - DNA, 20 bp, Artificial
  CRISPR gRNA sequence
aggataatttaaacaaggtt

SEQ ID NO: 124253 - DNA, 20 bp, Artificial
  CRISPR gRNA sequence
ataatttaaacaaggttagg

SEQ ID NO: 124254 - DNA, 20 bp, Artificial
  CRISPR gRNA sequence
gcctgcgacctttaaaaaaa

SEQ ID NO: 124255 - DNA, 20 bp, Artificial
  CRISPR gRNA sequence
tggcatcccactaacccgca

SEQ ID NO: 124256 - DNA, 20 bp, Artificial
  CRISPR gRNA sequence
actaacccgcatggacccca

SEQ ID NO: 124257 - DNA, 20 bp, Artificial
  CRISPR gRNA sequence
gcatggaccccatagttgcg

SEQ ID NO: 124258 - DNA, 20 bp, Artificial
  CRISPR gRNA sequence
tggttcgtgctacaaatcac

SEQ ID NO: 124259 - DNA, 20 bp, Artificial
  CRISPR gRNA sequence
ggttcgtgctacaaatcact

SEQ ID NO: 124260 - DNA, 20 bp, Artificial
  CRISPR gRNA sequence
gttcgtgctacaaatcactg

SEQ ID NO: 124261 - DNA, 20 bp, Artificial
  CRISPR gRNA sequence
cgtgctacaaatcactgggg

SEQ ID NO: 124262 - DNA, 20 bp, Artificial
  CRISPR gRNA sequence
tggggtggtttcatctctct

SEQ ID NO: 124263 - DNA, 20 bp, Artificial
  CRISPR gRNA sequence
tggtttcatctctcttagta

SEQ ID NO: 124264 - DNA, 20 bp, Artificial
  CRISPR gRNA sequence
ctcttagtatggaaactaat

SEQ ID NO: 124265 - DNA, 20 bp, Artificial
  CRISPR gRNA sequence
ggaaactaatcagcaacata

SEQ ID NO: 124266 - DNA, 20 bp, Artificial
  CRISPR gRNA sequence
tcagcaacataaagtgatga

SEQ ID NO: 124267 - DNA, 20 bp, Artificial
  CRISPR gRNA sequence
cataaagtgatgaaagcaaa

SEQ ID NO: 124268 - DNA, 20 bp, Artificial
  CRISPR gRNA sequence
gaaagcaaacggatcaatat

SEQ ID NO: 124269 - DNA, 20 bp, Artificial
  CRISPR gRNA sequence
agcaaacggatcaatatcag

SEQ ID NO: 124270 - DNA, 20 bp, Artificial
  CRISPR gRNA sequence
tcaatatcagtggcactaat

SEQ ID NO: 124271 - DNA, 20 bp, Artificial
  CRISPR gRNA sequence
atatcagtggcactaatcag

SEQ ID NO: 124272 - DNA, 20 bp, Artificial
  CRISPR gRNA sequence
tatcagtggcactaatcagt

SEQ ID NO: 124273 - DNA, 20 bp, Artificial
  CRISPR gRNA sequence
atcagtggcactaatcagtg

SEQ ID NO: 124274 - DNA, 20 bp, Artificial
  CRISPR gRNA sequence
tcagtggcactaatcagtgg

SEQ ID NO: 124275 - DNA, 20 bp, Artificial
  CRISPR gRNA sequence
cagtggcactaatcagtggg

SEQ ID NO: 124276 - DNA, 20 bp, Artificial
  CRISPR gRNA sequence
cagtggggggtttatttgta

SEQ ID NO: 124277 - DNA, 20 bp, Artificial
  CRISPR gRNA sequence
gtttatttgtaaagtattga

SEQ ID NO: 124278 - DNA, 20 bp, Artificial
  CRISPR gRNA sequence
gtttaaccaaaattccttaa

SEQ ID NO: 124279 - DNA, 20 bp, Artificial
  CRISPR gRNA sequence
tttaaccaaaattccttaaa

SEQ ID NO: 124280 - DNA, 20 bp, Artificial
  CRISPR gRNA sequence
ttgctcttgtatcttaattt

SEQ ID NO: 124281 - DNA, 20 bp, Artificial
  CRISPR gRNA sequence
tgctcttgtatcttaattta

SEQ ID NO: 124282 - DNA, 20 bp, Artificial
  CRISPR gRNA sequence
tgtatattgatgcaaaactc

SEQ ID NO: 124283 - DNA, 20 bp, Artificial
  CRISPR gRNA sequence
aactctggttgttgatgcca

SEQ ID NO: 124284 - DNA, 20 bp, Artificial
  CRISPR gRNA sequence
tggttgttgatgccaaagaa

SEQ ID NO: 124285 - DNA, 20 bp, Artificial
  CRISPR gRNA sequence
gttgttgatgccaaagaatg

SEQ ID NO: 124286 - DNA, 20 bp, Artificial
  CRISPR gRNA sequence
ttgttgatgccaaagaatgg

SEQ ID NO: 124287 - DNA, 20 bp, Artificial
  CRISPR gRNA sequence
tgttgatgccaaagaatgga

SEQ ID NO: 124288 - DNA, 20 bp, Artificial
  CRISPR gRNA sequence
tgatgccaaagaatggaggg

SEQ ID NO: 124289 - DNA, 20 bp, Artificial
  CRISPR gRNA sequence
atgccaaagaatggagggtg

SEQ ID NO: 124290 - DNA, 20 bp, Artificial
  CRISPR gRNA sequence
tgccaaagaatggagggtgg

SEQ ID NO: 124291 - DNA, 20 bp, Artificial
  CRISPR gRNA sequence
caaagaatggagggtggagg

SEQ ID NO: 124292 - DNA, 20 bp, Artificial
  CRISPR gRNA sequence
aaagaatggagggtggagga

SEQ ID NO: 124293 - DNA, 20 bp, Artificial
  CRISPR gRNA sequence
aagaatggagggtggaggaa

SEQ ID NO: 124294 - DNA, 20 bp, Artificial
  CRISPR gRNA sequence
gaagggactactgcttttct

SEQ ID NO: 124295 - DNA, 20 bp, Artificial
  CRISPR gRNA sequence
gcatttcttaaaacattaaa

SEQ ID NO: 124296 - DNA, 20 bp, Artificial
  CRISPR gRNA sequence
acagatgtatgcattccctt

SEQ ID NO: 124297 - DNA, 20 bp, Artificial
  CRISPR gRNA sequence
acatatatcaacctgccctt

SEQ ID NO: 124298 - DNA, 20 bp, Artificial
  CRISPR gRNA sequence
taagaaaatatacaccatat

SEQ ID NO: 124299 - DNA, 20 bp, Artificial
  CRISPR gRNA sequence
aagaaaatatacaccatatg

SEQ ID NO: 124300 - DNA, 20 bp, Artificial
  CRISPR gRNA sequence
atatacaccatatgaggtga

SEQ ID NO: 124301 - DNA, 20 bp, Artificial
  CRISPR gRNA sequence
gtgtttttctttaatgtact

SEQ ID NO: 124302 - DNA, 20 bp, Artificial
  CRISPR gRNA sequence
tatatactgaatcaactatt

SEQ ID NO: 124303 - DNA, 20 bp, Artificial
  CRISPR gRNA sequence
atatactgaatcaactattt

SEQ ID NO: 124304 - DNA, 20 bp, Artificial
  CRISPR gRNA sequence
actgaatcaactatttgggt

SEQ ID NO: 124305 - DNA, 20 bp, Artificial
  CRISPR gRNA sequence
aatcaactatttgggtgagt

SEQ ID NO: 124306 - DNA, 20 bp, Artificial
  CRISPR gRNA sequence
actatttgggtgagtgagtg

SEQ ID NO: 124307 - DNA, 20 bp, Artificial
  CRISPR gRNA sequence
ttgggtgagtgagtgtggtg

SEQ ID NO: 124308 - DNA, 20 bp, Artificial
  CRISPR gRNA sequence
acacccccctctcccattcc

SEQ ID NO: 124309 - DNA, 20 bp, Artificial
  CRISPR gRNA sequence
ccaagcaaaatacataaata

SEQ ID NO: 124310 - DNA, 20 bp, Artificial
  CRISPR gRNA sequence
aaatatagctcccatgtttt

SEQ ID NO: 124311 - DNA, 20 bp, Artificial
  CRISPR gRNA sequence
tcccatgttttaagtgttct

SEQ ID NO: 124312 - DNA, 20 bp, Artificial
  CRISPR gRNA sequence
cccatgttttaagtgttctg

SEQ ID NO: 124313 - DNA, 20 bp, Artificial
  CRISPR gRNA sequence
ccatgttttaagtgttctga

SEQ ID NO: 124314 - DNA, 20 bp, Artificial
  CRISPR gRNA sequence
tctgagggcttattttttca

SEQ ID NO: 124315 - DNA, 20 bp, Artificial
  CRISPR gRNA sequence
aaaataacatttctcgttac

SEQ ID NO: 124316 - DNA, 20 bp, Artificial
  CRISPR gRNA sequence
aaataacatttctcgttaca

SEQ ID NO: 124317 - DNA, 20 bp, Artificial
  CRISPR gRNA sequence
taacatttctcgttacaagg

SEQ ID NO: 124318 - DNA, 20 bp, Artificial
  CRISPR gRNA sequence
aacatttctcgttacaagga

SEQ ID NO: 124319 - DNA, 20 bp, Artificial
  CRISPR gRNA sequence
ttacaaggaaggacttttct

SEQ ID NO: 124320 - DNA, 20 bp, Artificial
  CRISPR gRNA sequence
caaggaaggacttttctgag

SEQ ID NO: 124321 - DNA, 20 bp, Artificial
  CRISPR gRNA sequence
aggacttttctgagcagttt

SEQ ID NO: 124322 - DNA, 20 bp, Artificial
  CRISPR gRNA sequence
ggacttttctgagcagtttt

SEQ ID NO: 124323 - DNA, 20 bp, Artificial
  CRISPR gRNA sequence
gacttttctgagcagttttg

SEQ ID NO: 124324 - DNA, 20 bp, Artificial
  CRISPR gRNA sequence
tttctgagcagttttggggt

SEQ ID NO: 124325 - DNA, 20 bp, Artificial
  CRISPR gRNA sequence
tctgagcagttttggggtta

SEQ ID NO: 124326 - DNA, 20 bp, Artificial
  CRISPR gRNA sequence
ctgagcagttttggggttag

SEQ ID NO: 124327 - DNA, 20 bp, Artificial
  CRISPR gRNA sequence
ggatactattaatatttgaa

SEQ ID NO: 124328 - DNA, 20 bp, Artificial
  CRISPR gRNA sequence
ataaattacttttaatatta

SEQ ID NO: 124329 - DNA, 20 bp, Artificial
  CRISPR gRNA sequence
ttaatattatagcaaacgtc

SEQ ID NO: 124330 - DNA, 20 bp, Artificial
  CRISPR gRNA sequence
atattatagcaaacgtcaag

SEQ ID NO: 124331 - DNA, 20 bp, Artificial
  CRISPR gRNA sequence
gtcaagcagtttttgctacc

SEQ ID NO: 124332 - DNA, 20 bp, Artificial
  CRISPR gRNA sequence
ttttgctacctggacctttt

SEQ ID NO: 124333 - DNA, 20 bp, Artificial
  CRISPR gRNA sequence
tgctacctggacctttttag

SEQ ID NO: 124334 - DNA, 20 bp, Artificial
  CRISPR gRNA sequence
ggcattaaaaactttcaatt

SEQ ID NO: 124335 - DNA, 20 bp, Artificial
  CRISPR gRNA sequence
attaaaaactttcaattcag

SEQ ID NO: 124336 - DNA, 20 bp, Artificial
  CRISPR gRNA sequence
caattttttctgctatttgc

SEQ ID NO: 124337 - DNA, 20 bp, Artificial
  CRISPR gRNA sequence
tatttgctagatttcatgct

SEQ ID NO: 124338 - DNA, 20 bp, Artificial
  CRISPR gRNA sequence
tttcatgcttggatgcgtat

SEQ ID NO: 124339 - DNA, 20 bp, Artificial
  CRISPR gRNA sequence
ccctttaaaattaacactga

SEQ ID NO: 124340 - DNA, 20 bp, Artificial
  CRISPR gRNA sequence
cctttaaaattaacactgaa

SEQ ID NO: 124341 - DNA, 20 bp, Artificial
  CRISPR gRNA sequence
gaaaggatgtgtttttgttt

SEQ ID NO: 124342 - DNA, 20 bp, Artificial
  CRISPR gRNA sequence
cccatttaattgtttccttt

SEQ ID NO: 124343 - DNA, 20 bp, Artificial
  CRISPR gRNA sequence
tttaattgtttcctttgaga

SEQ ID NO: 124344 - DNA, 20 bp, Artificial
  CRISPR gRNA sequence
ttgtttcctttgagaaagaa

SEQ ID NO: 124345 - DNA, 20 bp, Artificial
  CRISPR gRNA sequence
gtttcctttgagaaagaatg

SEQ ID NO: 124346 - DNA, 20 bp, Artificial
  CRISPR gRNA sequence
tgagaaagaatggagcaaat

SEQ ID NO: 124347 - DNA, 20 bp, Artificial
  CRISPR gRNA sequence
gagaaatgaaacttgtaaca

SEQ ID NO: 124348 - DNA, 20 bp, Artificial
  CRISPR gRNA sequence
gaaacttgtaacacagcaat

SEQ ID NO: 124349 - DNA, 20 bp, Artificial
  CRISPR gRNA sequence
gcaattggtactaatttgtt

SEQ ID NO: 124350 - DNA, 20 bp, Artificial
  CRISPR gRNA sequence
gttcagctatttatgcctta

SEQ ID NO: 124351 - DNA, 20 bp, Artificial
  CRISPR gRNA sequence
agctatttatgccttacagt

SEQ ID NO: 124352 - DNA, 20 bp, Artificial
  CRISPR gRNA sequence
tatgccttacagtgagactg

SEQ ID NO: 124353 - DNA, 20 bp, Artificial
  CRISPR gRNA sequence
gtgctatttcgatgcaattt

SEQ ID NO: 124354 - DNA, 20 bp, Artificial
  CRISPR gRNA sequence
gatgcaattttagtcaaaaa

SEQ ID NO: 124355 - DNA, 20 bp, Artificial
  CRISPR gRNA sequence
gcaattttagtcaaaaatgg

SEQ ID NO: 124356 - DNA, 20 bp, Artificial
  CRISPR gRNA sequence
ggtgcttcaaaattataaat

SEQ ID NO: 124357 - DNA, 20 bp, Artificial
  CRISPR gRNA sequence
gtgcttcaaaattataaata

SEQ ID NO: 124358 - DNA, 20 bp, Artificial
  CRISPR gRNA sequence
tgcttcaaaattataaataa

SEQ ID NO: 124359 - DNA, 20 bp, Artificial
  CRISPR gRNA sequence
ttgcttttttgatatcttct

SEQ ID NO: 124360 - DNA, 20 bp, Artificial
  CRISPR gRNA sequence
tttttgatatcttctcagtg

SEQ ID NO: 124361 - DNA, 20 bp, Artificial
  CRISPR gRNA sequence
tgcagaatgtatcttcatta

SEQ ID NO: 124362 - DNA, 20 bp, Artificial
  CRISPR gRNA sequence
tcttcattacagtataatct

SEQ ID NO: 124363 - DNA, 20 bp, Artificial
  CRISPR gRNA sequence
atctgagattcttaattgaa

SEQ ID NO: 124364 - DNA, 20 bp, Artificial
  CRISPR gRNA sequence
attgaaaagcattatattct

SEQ ID NO: 124365 - DNA, 20 bp, Artificial
  CRISPR gRNA sequence
gataattttttcctcctctt

SEQ ID NO: 124366 - DNA, 20 bp, Artificial
  CRISPR gRNA sequence
tttttcctcctcttgagcta

SEQ ID NO: 124367 - DNA, 20 bp, Artificial
  CRISPR gRNA sequence
aatgttactctgaaacattt

SEQ ID NO: 124368 - DNA, 20 bp, Artificial
  CRISPR gRNA sequence
aaaaccatcaccaaaaaatt

SEQ ID NO: 124369 - DNA, 20 bp, Artificial
  CRISPR gRNA sequence
caccaaaaaattaagatgat

SEQ ID NO: 124370 - DNA, 20 bp, Artificial
  CRISPR gRNA sequence
accaaaaaattaagatgata

SEQ ID NO: 124371 - DNA, 20 bp, Artificial
  CRISPR gRNA sequence
ccaaaaaattaagatgataa

SEQ ID NO: 124372 - DNA, 20 bp, Artificial
  CRISPR gRNA sequence
caaaaaattaagatgataag

SEQ ID NO: 124373 - DNA, 20 bp, Artificial
  CRISPR gRNA sequence
aaggggtgtgtttgcatctt

SEQ ID NO: 124374 - DNA, 20 bp, Artificial
  CRISPR gRNA sequence
atcttgagtgttaatgtttt

SEQ ID NO: 124375 - DNA, 20 bp, Artificial
  CRISPR gRNA sequence
tgttaatgttttaagtaatt

SEQ ID NO: 124376 - DNA, 20 bp, Artificial
  CRISPR gRNA sequence
taatttagatgtataatttt

SEQ ID NO: 124377 - DNA, 20 bp, Artificial
  CRISPR gRNA sequence
ctcttgcatattatataatt

SEQ ID NO: 124378 - DNA, 20 bp, Artificial
  CRISPR gRNA sequence
tatataatttggtccctttt

SEQ ID NO: 124379 - DNA, 20 bp, Artificial
  CRISPR gRNA sequence
atgaatgtttatgatgaata

SEQ ID NO: 124380 - DNA, 20 bp, Artificial
  CRISPR gRNA sequence
atgatgaatatggctaaatt

SEQ ID NO: 124381 - DNA, 20 bp, Artificial
  CRISPR gRNA sequence
tgatgaatatggctaaattc

SEQ ID NO: 124382 - DNA, 20 bp, Artificial
  CRISPR gRNA sequence
gatgaatatggctaaattca

SEQ ID NO: 124383 - DNA, 20 bp, Artificial
  CRISPR gRNA sequence
ggctaaattcagggttatgt

SEQ ID NO: 124384 - DNA, 20 bp, Artificial
  CRISPR gRNA sequence
tccattttctcctttcccca

SEQ ID NO: 124385 - DNA, 20 bp, Artificial
  CRISPR gRNA sequence
catggaattaacttgttttt

SEQ ID NO: 124386 - DNA, 20 bp, Artificial
  CRISPR gRNA sequence
ttctccaaaataaatctttc

SEQ ID NO: 124387 - DNA, 20 bp, Artificial
  CRISPR gRNA sequence
tcaagtcaacaaacatttat

SEQ ID NO: 124388 - DNA, 20 bp, Artificial
  CRISPR gRNA sequence
caagtcaacaaacatttatt

SEQ ID NO: 124389 - DNA, 20 bp, Artificial
  CRISPR gRNA sequence
taccatgtactccattgatt

SEQ ID NO: 124390 - DNA, 20 bp, Artificial
  CRISPR gRNA sequence
tgtactccattgattaagaa

SEQ ID NO: 124391 - DNA, 20 bp, Artificial
  CRISPR gRNA sequence
actccattgattaagaatag

SEQ ID NO: 124392 - DNA, 20 bp, Artificial
  CRISPR gRNA sequence
aatagtagtcaaaattatac

SEQ ID NO: 124393 - DNA, 20 bp, Artificial
  CRISPR gRNA sequence
caagccctctttaattttat

SEQ ID NO: 124394 - DNA, 20 bp, Artificial
  CRISPR gRNA sequence
ctttaattttatgagaaaaa

SEQ ID NO: 124395 - DNA, 20 bp, Artificial
  CRISPR gRNA sequence
ttatgagaaaaaaagcctat

SEQ ID NO: 124396 - DNA, 20 bp, Artificial
  CRISPR gRNA sequence
tgatgtatttttactattga

SEQ ID NO: 124397 - DNA, 20 bp, Artificial
  CRISPR gRNA sequence
tttttactattgatagatgt

SEQ ID NO: 124398 - DNA, 20 bp, Artificial
  CRISPR gRNA sequence
ttttactattgatagatgtt

SEQ ID NO: 124399 - DNA, 20 bp, Artificial
  CRISPR gRNA sequence
tgatagatgttaggtcctaa

SEQ ID NO: 124400 - DNA, 20 bp, Artificial
  CRISPR gRNA sequence
cctaatagatgtttatcttt

SEQ ID NO: 124401 - DNA, 20 bp, Artificial
  CRISPR gRNA sequence
ctaatagatgtttatctttt

SEQ ID NO: 124402 - DNA, 20 bp, Artificial
  CRISPR gRNA sequence
tcttttaggttgaaatcaca

SEQ ID NO: 124403 - DNA, 20 bp, Artificial
  CRISPR gRNA sequence
taggttgaaatcacaaagat

SEQ ID NO: 124404 - DNA, 20 bp, Artificial
  CRISPR gRNA sequence
acaaagattagacacctttt

SEQ ID NO: 124405 - DNA, 20 bp, Artificial
  CRISPR gRNA sequence
agattagacacctttttaga

SEQ ID NO: 124406 - DNA, 20 bp, Artificial
  CRISPR gRNA sequence
gattagacacctttttagat

SEQ ID NO: 124407 - DNA, 20 bp, Artificial
  CRISPR gRNA sequence
ctttttagataggtgttctt

SEQ ID NO: 124408 - DNA, 20 bp, Artificial
  CRISPR gRNA sequence
cttcagcaccactgacaaca

SEQ ID NO: 124409 - DNA, 20 bp, Artificial
  CRISPR gRNA sequence
cactgacaacacggttctga

SEQ ID NO: 124410 - DNA, 20 bp, Artificial
  CRISPR gRNA sequence
gttctgacagtatttcatga

SEQ ID NO: 124411 - DNA, 20 bp, Artificial
  CRISPR gRNA sequence
tgacagtatttcatgacagt

SEQ ID NO: 124412 - DNA, 20 bp, Artificial
  CRISPR gRNA sequence
gtaagtatattttaccattt

SEQ ID NO: 124413 - DNA, 20 bp, Artificial
  CRISPR gRNA sequence
ttaccattttggttgttaat

SEQ ID NO: 124414 - DNA, 20 bp, Artificial
  CRISPR gRNA sequence
ggttgttaattagatttgaa

SEQ ID NO: 124415 - DNA, 20 bp, Artificial
  CRISPR gRNA sequence
aattagatttgaatagtaat

SEQ ID NO: 124416 - DNA, 20 bp, Artificial
  CRISPR gRNA sequence
agatttgaatagtaattggc

SEQ ID NO: 124417 - DNA, 20 bp, Artificial
  CRISPR gRNA sequence
aaattgtaaccaatttatac

SEQ ID NO: 124418 - DNA, 20 bp, Artificial
  CRISPR gRNA sequence
attgtaaccaatttatactg

SEQ ID NO: 124419 - DNA, 20 bp, Artificial
  CRISPR gRNA sequence
ttgtaaccaatttatactgg

SEQ ID NO: 124420 - DNA, 20 bp, Artificial
  CRISPR gRNA sequence
caatttatactggaggtgcc

SEQ ID NO: 124421 - DNA, 20 bp, Artificial
  CRISPR gRNA sequence
tttatactggaggtgcctgg

SEQ ID NO: 124422 - DNA, 20 bp, Artificial
  CRISPR gRNA sequence
tggtagaatgaatgcatttc

SEQ ID NO: 124423 - DNA, 20 bp, Artificial
  CRISPR gRNA sequence
gaatgaatgcatttcaagtc

SEQ ID NO: 124424 - DNA, 20 bp, Artificial
  CRISPR gRNA sequence
gaatgcatttcaagtctaga

SEQ ID NO: 124425 - DNA, 20 bp, Artificial
  CRISPR gRNA sequence
gcatttcaagtctagacaga

SEQ ID NO: 124426 - DNA, 20 bp, Artificial
  CRISPR gRNA sequence
tcctgttgcttccttatttt

SEQ ID NO: 124427 - DNA, 20 bp, Artificial
  CRISPR gRNA sequence
cttgcatatattatttccca

SEQ ID NO: 124428 - DNA, 20 bp, Artificial
  CRISPR gRNA sequence
ttgcatatattatttcccat

SEQ ID NO: 124429 - DNA, 20 bp, Artificial
  CRISPR gRNA sequence
attatttcccatgggtccct

SEQ ID NO: 124430 - DNA, 20 bp, Artificial
  CRISPR gRNA sequence
atgggtccctaagtgctgtt

SEQ ID NO: 124431 - DNA, 20 bp, Artificial
  CRISPR gRNA sequence
tgggtccctaagtgctgttg

SEQ ID NO: 124432 - DNA, 20 bp, Artificial
  CRISPR gRNA sequence
cctaagtgctgttgaggcta

SEQ ID NO: 124433 - DNA, 20 bp, Artificial
  CRISPR gRNA sequence
ctaagtgctgttgaggctac

SEQ ID NO: 124434 - DNA, 20 bp, Artificial
  CRISPR gRNA sequence
taagtgctgttgaggctaca

SEQ ID NO: 124435 - DNA, 20 bp, Artificial
  CRISPR gRNA sequence
gtgctgttgaggctacaggg

SEQ ID NO: 124436 - DNA, 20 bp, Artificial
  CRISPR gRNA sequence
ggctacagggtagcctgtcc

SEQ ID NO: 124437 - DNA, 20 bp, Artificial
  CRISPR gRNA sequence
ggtagcctgtcccagctgta

SEQ ID NO: 124438 - DNA, 20 bp, Artificial
  CRISPR gRNA sequence
gtagcctgtcccagctgtaa

SEQ ID NO: 124439 - DNA, 20 bp, Artificial
  CRISPR gRNA sequence
tagcctgtcccagctgtaaa

SEQ ID NO: 124440 - DNA, 20 bp, Artificial
  CRISPR gRNA sequence
agcctgtcccagctgtaaag

SEQ ID NO: 124441 - DNA, 20 bp, Artificial
  CRISPR gRNA sequence
ctgtaaaggggctgtctgtt

SEQ ID NO: 124442 - DNA, 20 bp, Artificial
  CRISPR gRNA sequence
tagccaattaattgaatact

SEQ ID NO: 124443 - DNA, 20 bp, Artificial
  CRISPR gRNA sequence
agccaattaattgaatactt

SEQ ID NO: 124444 - DNA, 20 bp, Artificial
  CRISPR gRNA sequence
gccaattaattgaatactta

SEQ ID NO: 124445 - DNA, 20 bp, Artificial
  CRISPR gRNA sequence
ccaattaattgaatacttag

SEQ ID NO: 124446 - DNA, 20 bp, Artificial
  CRISPR gRNA sequence
ttaattgaatacttagggga

SEQ ID NO: 124447 - DNA, 20 bp, Artificial
  CRISPR gRNA sequence
acttaggggacagttatgcc

SEQ ID NO: 124448 - DNA, 20 bp, Artificial
  CRISPR gRNA sequence
ggggacagttatgcccagaa

SEQ ID NO: 124449 - DNA, 20 bp, Artificial
  CRISPR gRNA sequence
aatggaaaatgctaactctt

SEQ ID NO: 124450 - DNA, 20 bp, Artificial
  CRISPR gRNA sequence
aaaatgctaactcttaagtg

SEQ ID NO: 124451 - DNA, 20 bp, Artificial
  CRISPR gRNA sequence
atgctaactcttaagtgcag

SEQ ID NO: 124452 - DNA, 20 bp, Artificial
  CRISPR gRNA sequence
actcttaagtgcagtagata

SEQ ID NO: 124453 - DNA, 20 bp, Artificial
  CRISPR gRNA sequence
ctcttaagtgcagtagatat

SEQ ID NO: 124454 - DNA, 20 bp, Artificial
  CRISPR gRNA sequence
ttaagtgcagtagatatggg

SEQ ID NO: 124455 - DNA, 20 bp, Artificial
  CRISPR gRNA sequence
agtgcagtagatatgggaag

SEQ ID NO: 124456 - DNA, 20 bp, Artificial
  CRISPR gRNA sequence
tgcagtagatatgggaagaa

SEQ ID NO: 124457 - DNA, 20 bp, Artificial
  CRISPR gRNA sequence
cagtagatatgggaagaaga

SEQ ID NO: 124458 - DNA, 20 bp, Artificial
  CRISPR gRNA sequence
agtagatatgggaagaagag

SEQ ID NO: 124459 - DNA, 20 bp, Artificial
  CRISPR gRNA sequence
atatgggaagaagagaggca

SEQ ID NO: 124460 - DNA, 20 bp, Artificial
  CRISPR gRNA sequence
gggaagaagagaggcatggt

SEQ ID NO: 124461 - DNA, 20 bp, Artificial
  CRISPR gRNA sequence
gaagagaggcatggtgagcc

SEQ ID NO: 124462 - DNA, 20 bp, Artificial
  CRISPR gRNA sequence
aagagaggcatggtgagcct

SEQ ID NO: 124463 - DNA, 20 bp, Artificial
  CRISPR gRNA sequence
gcatggtgagcctgggtact

SEQ ID NO: 124464 - DNA, 20 bp, Artificial
  CRISPR gRNA sequence
catggtgagcctgggtactt

SEQ ID NO: 124465 - DNA, 20 bp, Artificial
  CRISPR gRNA sequence
ctgggtacttgggaatgtca

SEQ ID NO: 124466 - DNA, 20 bp, Artificial
  CRISPR gRNA sequence
gggtacttgggaatgtcaca

SEQ ID NO: 124467 - DNA, 20 bp, Artificial
  CRISPR gRNA sequence
ggtacttgggaatgtcacag

SEQ ID NO: 124468 - DNA, 20 bp, Artificial
  CRISPR gRNA sequence
gtacttgggaatgtcacaga

SEQ ID NO: 124469 - DNA, 20 bp, Artificial
  CRISPR gRNA sequence
aatgtcacagagggatcctg

SEQ ID NO: 124470 - DNA, 20 bp, Artificial
  CRISPR gRNA sequence
gatcctgcagaccttgaact

SEQ ID NO: 124471 - DNA, 20 bp, Artificial
  CRISPR gRNA sequence
ccttgaactgagccttgaaa

SEQ ID NO: 124472 - DNA, 20 bp, Artificial
  CRISPR gRNA sequence
ttgaactgagccttgaaata

SEQ ID NO: 124473 - DNA, 20 bp, Artificial
  CRISPR gRNA sequence
tgaactgagccttgaaatag

SEQ ID NO: 124474 - DNA, 20 bp, Artificial
  CRISPR gRNA sequence
gaactgagccttgaaataga

SEQ ID NO: 124475 - DNA, 20 bp, Artificial
  CRISPR gRNA sequence
ctgagccttgaaatagaggg

SEQ ID NO: 124476 - DNA, 20 bp, Artificial
  CRISPR gRNA sequence
tgagccttgaaatagagggt

SEQ ID NO: 124477 - DNA, 20 bp, Artificial
  CRISPR gRNA sequence
agccttgaaatagagggtgg

SEQ ID NO: 124478 - DNA, 20 bp, Artificial
  CRISPR gRNA sequence
cttgaaatagagggtgggag

SEQ ID NO: 124479 - DNA, 20 bp, Artificial
  CRISPR gRNA sequence
aatagagggtgggagtggat

SEQ ID NO: 124480 - DNA, 20 bp, Artificial
  CRISPR gRNA sequence
agggtgggagtggattggtg

SEQ ID NO: 124481 - DNA, 20 bp, Artificial
  CRISPR gRNA sequence
gggtgggagtggattggtga

SEQ ID NO: 124482 - DNA, 20 bp, Artificial
  CRISPR gRNA sequence
ggtgggagtggattggtgaa

SEQ ID NO: 124483 - DNA, 20 bp, Artificial
  CRISPR gRNA sequence
ttggtgaagggtgtcaccaa

SEQ ID NO: 124484 - DNA, 20 bp, Artificial
  CRISPR gRNA sequence
aagggtgtcaccaaaagcaa

SEQ ID NO: 124485 - DNA, 20 bp, Artificial
  CRISPR gRNA sequence
caccaaaagcaaaagcctga

SEQ ID NO: 124486 - DNA, 20 bp, Artificial
  CRISPR gRNA sequence
caaaagcaaaagcctgatgg

SEQ ID NO: 124487 - DNA, 20 bp, Artificial
  CRISPR gRNA sequence
aaaagcaaaagcctgatggc

SEQ ID NO: 124488 - DNA, 20 bp, Artificial
  CRISPR gRNA sequence
gcaaaagcctgatggcagga

SEQ ID NO: 124489 - DNA, 20 bp, Artificial
  CRISPR gRNA sequence
caaaagcctgatggcaggat

SEQ ID NO: 124490 - DNA, 20 bp, Artificial
  CRISPR gRNA sequence
gatggcaggatgggcaactt

SEQ ID NO: 124491 - DNA, 20 bp, Artificial
  CRISPR gRNA sequence
caggatgggcaacttaagtt

SEQ ID NO: 124492 - DNA, 20 bp, Artificial
  CRISPR gRNA sequence
aggatgggcaacttaagttt

SEQ ID NO: 124493 - DNA, 20 bp, Artificial
  CRISPR gRNA sequence
ggatgggcaacttaagttta

SEQ ID NO: 124494 - DNA, 20 bp, Artificial
  CRISPR gRNA sequence
gatgggcaacttaagtttag

SEQ ID NO: 124495 - DNA, 20 bp, Artificial
  CRISPR gRNA sequence
gcaacttaagtttaggggat

SEQ ID NO: 124496 - DNA, 20 bp, Artificial
  CRISPR gRNA sequence
caacttaagtttaggggatc

SEQ ID NO: 124497 - DNA, 20 bp, Artificial
  CRISPR gRNA sequence
acttaagtttaggggatcgg

SEQ ID NO: 124498 - DNA, 20 bp, Artificial
  CRISPR gRNA sequence
taagtttaggggatcgggag

SEQ ID NO: 124499 - DNA, 20 bp, Artificial
  CRISPR gRNA sequence
agtttaggggatcgggagta

SEQ ID NO: 124500 - DNA, 20 bp, Artificial
  CRISPR gRNA sequence
gtttaggggatcgggagtag

SEQ ID NO: 124501 - DNA, 20 bp, Artificial
  CRISPR gRNA sequence
ggatcgggagtagaggtgca

SEQ ID NO: 124502 - DNA, 20 bp, Artificial
  CRISPR gRNA sequence
gggagtagaggtgcatggtc

SEQ ID NO: 124503 - DNA, 20 bp, Artificial
  CRISPR gRNA sequence
ggagtagaggtgcatggtcc

SEQ ID NO: 124504 - DNA, 20 bp, Artificial
  CRISPR gRNA sequence
gagtagaggtgcatggtcca

SEQ ID NO: 124505 - DNA, 20 bp, Artificial
  CRISPR gRNA sequence
tagaggtgcatggtccaggg

SEQ ID NO: 124506 - DNA, 20 bp, Artificial
  CRISPR gRNA sequence
atggtccagggtagatctca

SEQ ID NO: 124507 - DNA, 20 bp, Artificial
  CRISPR gRNA sequence
tggtccagggtagatctcaa

SEQ ID NO: 124508 - DNA, 20 bp, Artificial
  CRISPR gRNA sequence
gtagatctcaaaggataatg

SEQ ID NO: 124509 - DNA, 20 bp, Artificial
  CRISPR gRNA sequence
tagatctcaaaggataatgt

SEQ ID NO: 124510 - DNA, 20 bp, Artificial
  CRISPR gRNA sequence
tctcaaaggataatgtagga

SEQ ID NO: 124511 - DNA, 20 bp, Artificial
  CRISPR gRNA sequence
tcaaaggataatgtaggaaa

SEQ ID NO: 124512 - DNA, 20 bp, Artificial
  CRISPR gRNA sequence
aggataatgtaggaaagaga

SEQ ID NO: 124513 - DNA, 20 bp, Artificial
  CRISPR gRNA sequence
gagaaagcacttgtcccctc

SEQ ID NO: 124514 - DNA, 20 bp, Artificial
  CRISPR gRNA sequence
cccctctggatatttaattc

SEQ ID NO: 124515 - DNA, 20 bp, Artificial
  CRISPR gRNA sequence
tgctactatatctgtaacct

SEQ ID NO: 124516 - DNA, 20 bp, Artificial
  CRISPR gRNA sequence
gctactatatctgtaacctc

SEQ ID NO: 124517 - DNA, 20 bp, Artificial
  CRISPR gRNA sequence
ctgtaacctcgggtgtgtta

SEQ ID NO: 124518 - DNA, 20 bp, Artificial
  CRISPR gRNA sequence
gggtgtgttacagcttcttt

SEQ ID NO: 124519 - DNA, 20 bp, Artificial
  CRISPR gRNA sequence
gttacagcttctttgagctg

SEQ ID NO: 124520 - DNA, 20 bp, Artificial
  CRISPR gRNA sequence
tcgcttcactcctaaaatga

SEQ ID NO: 124521 - DNA, 20 bp, Artificial
  CRISPR gRNA sequence
cttcactcctaaaatgaaag

SEQ ID NO: 124522 - DNA, 20 bp, Artificial
  CRISPR gRNA sequence
taaaatgaaagaagtgcact

SEQ ID NO: 124523 - DNA, 20 bp, Artificial
  CRISPR gRNA sequence
cactcagtgatccctaaata

SEQ ID NO: 124524 - DNA, 20 bp, Artificial
  CRISPR gRNA sequence
tccctaaataaagcacattc

SEQ ID NO: 124525 - DNA, 20 bp, Artificial
  CRISPR gRNA sequence
ataaagcacattctagcaca

SEQ ID NO: 124526 - DNA, 20 bp, Artificial
  CRISPR gRNA sequence
aaagatttttattaaccatg

SEQ ID NO: 124527 - DNA, 20 bp, Artificial
  CRISPR gRNA sequence
atttttattaaccatgaaga

SEQ ID NO: 124528 - DNA, 20 bp, Artificial
  CRISPR gRNA sequence
ttttattaaccatgaagata

SEQ ID NO: 124529 - DNA, 20 bp, Artificial
  CRISPR gRNA sequence
ttaaccatgaagatagagaa

SEQ ID NO: 124530 - DNA, 20 bp, Artificial
  CRISPR gRNA sequence
accatgaagatagagaaaag

SEQ ID NO: 124531 - DNA, 20 bp, Artificial
  CRISPR gRNA sequence
ccatgaagatagagaaaagt

SEQ ID NO: 124532 - DNA, 20 bp, Artificial
  CRISPR gRNA sequence
gatagagaaaagtaggaaac

SEQ ID NO: 124533 - DNA, 20 bp, Artificial
  CRISPR gRNA sequence
agaaaagtaggaaacaagtt

SEQ ID NO: 124534 - DNA, 20 bp, Artificial
  CRISPR gRNA sequence
aagtaggaaacaagtttggt

SEQ ID NO: 124535 - DNA, 20 bp, Artificial
  CRISPR gRNA sequence
agtaggaaacaagtttggtt

SEQ ID NO: 124536 - DNA, 20 bp, Artificial
  CRISPR gRNA sequence
atgtgcgatctgctcatgtg

SEQ ID NO: 124537 - DNA, 20 bp, Artificial
  CRISPR gRNA sequence
tcatgtgaagtcatgaaaat

SEQ ID NO: 124538 - DNA, 20 bp, Artificial
  CRISPR gRNA sequence
catgtgaagtcatgaaaatg

SEQ ID NO: 124539 - DNA, 20 bp, Artificial
  CRISPR gRNA sequence
gaagtcatgaaaatgaggtt

SEQ ID NO: 124540 - DNA, 20 bp, Artificial
  CRISPR gRNA sequence
aatgaggtttggatttgaca

SEQ ID NO: 124541 - DNA, 20 bp, Artificial
  CRISPR gRNA sequence
atgaggtttggatttgacac

SEQ ID NO: 124542 - DNA, 20 bp, Artificial
  CRISPR gRNA sequence
aggtttggatttgacacagg

SEQ ID NO: 124543 - DNA, 20 bp, Artificial
  CRISPR gRNA sequence
gatttgacacaggaagcctt

SEQ ID NO: 124544 - DNA, 20 bp, Artificial
  CRISPR gRNA sequence
atttgacacaggaagccttt

SEQ ID NO: 124545 - DNA, 20 bp, Artificial
  CRISPR gRNA sequence
ggaagcctttaggaaccttt

SEQ ID NO: 124546 - DNA, 20 bp, Artificial
  CRISPR gRNA sequence
cctttaggaacctttgagaa

SEQ ID NO: 124547 - DNA, 20 bp, Artificial
  CRISPR gRNA sequence
ctttaggaacctttgagaat

SEQ ID NO: 124548 - DNA, 20 bp, Artificial
  CRISPR gRNA sequence
gaacctttgagaataggttc

SEQ ID NO: 124549 - DNA, 20 bp, Artificial
  CRISPR gRNA sequence
acctttgagaataggttcaa

SEQ ID NO: 124550 - DNA, 20 bp, Artificial
  CRISPR gRNA sequence
tgagaataggttcaagagta

SEQ ID NO: 124551 - DNA, 20 bp, Artificial
  CRISPR gRNA sequence
taggttcaagagtatagaac

SEQ ID NO: 124552 - DNA, 20 bp, Artificial
  CRISPR gRNA sequence
agagtatagaactggtgttg

SEQ ID NO: 124553 - DNA, 20 bp, Artificial
  CRISPR gRNA sequence
tatagaactggtgttgtggt

SEQ ID NO: 124554 - DNA, 20 bp, Artificial
  CRISPR gRNA sequence
aactggtgttgtggtgagat

SEQ ID NO: 124555 - DNA, 20 bp, Artificial
  CRISPR gRNA sequence
tagtcttataacaatatgtt

SEQ ID NO: 124556 - DNA, 20 bp, Artificial
  CRISPR gRNA sequence
cttataacaatatgttaaga

SEQ ID NO: 124557 - DNA, 20 bp, Artificial
  CRISPR gRNA sequence
ttataacaatatgttaagat

SEQ ID NO: 124558 - DNA, 20 bp, Artificial
  CRISPR gRNA sequence
aacaatatgttaagatgggc

SEQ ID NO: 124559 - DNA, 20 bp, Artificial
  CRISPR gRNA sequence
acaatatgttaagatgggct

SEQ ID NO: 124560 - DNA, 20 bp, Artificial
  CRISPR gRNA sequence
atatgttaagatgggctggg

SEQ ID NO: 124561 - DNA, 20 bp, Artificial
  CRISPR gRNA sequence
agatgggctgggtggtaatc

SEQ ID NO: 124562 - DNA, 20 bp, Artificial
  CRISPR gRNA sequence
tgggctgggtggtaatccag

SEQ ID NO: 124563 - DNA, 20 bp, Artificial
  CRISPR gRNA sequence
gggtggtaatccagtggaaa

SEQ ID NO: 124564 - DNA, 20 bp, Artificial
  CRISPR gRNA sequence
ggtggtaatccagtggaaat

SEQ ID NO: 124565 - DNA, 20 bp, Artificial
  CRISPR gRNA sequence
gtaatccagtggaaatagga

SEQ ID NO: 124566 - DNA, 20 bp, Artificial
  CRISPR gRNA sequence
taatccagtggaaataggaa

SEQ ID NO: 124567 - DNA, 20 bp, Artificial
  CRISPR gRNA sequence
aatccagtggaaataggaaa

SEQ ID NO: 124568 - DNA, 20 bp, Artificial
  CRISPR gRNA sequence
cagtggaaataggaaaggga

SEQ ID NO: 124569 - DNA, 20 bp, Artificial
  CRISPR gRNA sequence
taggaaagggaaagcatatc

SEQ ID NO: 124570 - DNA, 20 bp, Artificial
  CRISPR gRNA sequence
aggaaagggaaagcatatct

SEQ ID NO: 124571 - DNA, 20 bp, Artificial
  CRISPR gRNA sequence
gaaagggaaagcatatctag

SEQ ID NO: 124572 - DNA, 20 bp, Artificial
  CRISPR gRNA sequence
atatctaggagacattttta

SEQ ID NO: 124573 - DNA, 20 bp, Artificial
  CRISPR gRNA sequence
atctaggagacatttttaaa

SEQ ID NO: 124574 - DNA, 20 bp, Artificial
  CRISPR gRNA sequence
tctaggagacatttttaaag

SEQ ID NO: 124575 - DNA, 20 bp, Artificial
  CRISPR gRNA sequence
agacatttttaaagaggtaa

SEQ ID NO: 124576 - DNA, 20 bp, Artificial
  CRISPR gRNA sequence
tttttaaagaggtaatagat

SEQ ID NO: 124577 - DNA, 20 bp, Artificial
  CRISPR gRNA sequence
ttttaaagaggtaatagatg

SEQ ID NO: 124578 - DNA, 20 bp, Artificial
  CRISPR gRNA sequence
taaagaggtaatagatgagg

SEQ ID NO: 124579 - DNA, 20 bp, Artificial
  CRISPR gRNA sequence
aagaggtaatagatgaggta

SEQ ID NO: 124580 - DNA, 20 bp, Artificial
  CRISPR gRNA sequence
aatagatgaggtagagcttg

SEQ ID NO: 124581 - DNA, 20 bp, Artificial
  CRISPR gRNA sequence
atagatgaggtagagcttga

SEQ ID NO: 124582 - DNA, 20 bp, Artificial
  CRISPR gRNA sequence
agatgaggtagagcttgaag

SEQ ID NO: 124583 - DNA, 20 bp, Artificial
  CRISPR gRNA sequence
gaggtagagcttgaaggaga

SEQ ID NO: 124584 - DNA, 20 bp, Artificial
  CRISPR gRNA sequence
gtagagcttgaaggagatgg

SEQ ID NO: 124585 - DNA, 20 bp, Artificial
  CRISPR gRNA sequence
tgaaggagatggaagaacct

SEQ ID NO: 124586 - DNA, 20 bp, Artificial
  CRISPR gRNA sequence
ggaagaacctaagatgatgc

SEQ ID NO: 124587 - DNA, 20 bp, Artificial
  CRISPR gRNA sequence
taagatgatgctggtatatt

SEQ ID NO: 124588 - DNA, 20 bp, Artificial
  CRISPR gRNA sequence
atgatgctggtatatttggc

SEQ ID NO: 124589 - DNA, 20 bp, Artificial
  CRISPR gRNA sequence
tgatgctggtatatttggct

SEQ ID NO: 124590 - DNA, 20 bp, Artificial
  CRISPR gRNA sequence
tgctggtatatttggctggg

SEQ ID NO: 124591 - DNA, 20 bp, Artificial
  CRISPR gRNA sequence
ctggtatatttggctgggca

SEQ ID NO: 124592 - DNA, 20 bp, Artificial
  CRISPR gRNA sequence
atatttggctgggcagagtg

SEQ ID NO: 124593 - DNA, 20 bp, Artificial
  CRISPR gRNA sequence
tatttggctgggcagagtga

SEQ ID NO: 124594 - DNA, 20 bp, Artificial
  CRISPR gRNA sequence
atttggctgggcagagtgaa

SEQ ID NO: 124595 - DNA, 20 bp, Artificial
  CRISPR gRNA sequence
ggctgggcagagtgaagggc

SEQ ID NO: 124596 - DNA, 20 bp, Artificial
  CRISPR gRNA sequence
tgaagggctggtattcttct

SEQ ID NO: 124597 - DNA, 20 bp, Artificial
  CRISPR gRNA sequence
agggctggtattcttcttag

SEQ ID NO: 124598 - DNA, 20 bp, Artificial
  CRISPR gRNA sequence
tattcttcttagtagaatta

SEQ ID NO: 124599 - DNA, 20 bp, Artificial
  CRISPR gRNA sequence
tcttcttagtagaattacag

SEQ ID NO: 124600 - DNA, 20 bp, Artificial
  CRISPR gRNA sequence
tcttagtagaattacagtag

SEQ ID NO: 124601 - DNA, 20 bp, Artificial
  CRISPR gRNA sequence
agtagaattacagtagtgga

SEQ ID NO: 124602 - DNA, 20 bp, Artificial
  CRISPR gRNA sequence
gtagaattacagtagtggaa

SEQ ID NO: 124603 - DNA, 20 bp, Artificial
  CRISPR gRNA sequence
tagaattacagtagtggaaa

SEQ ID NO: 124604 - DNA, 20 bp, Artificial
  CRISPR gRNA sequence
tctccctcctttccccgttg

SEQ ID NO: 124605 - DNA, 20 bp, Artificial
  CRISPR gRNA sequence
ctccctcctttccccgttgc

SEQ ID NO: 124606 - DNA, 20 bp, Artificial
  CRISPR gRNA sequence
tccctcctttccccgttgca

SEQ ID NO: 124607 - DNA, 20 bp, Artificial
  CRISPR gRNA sequence
cctttccccgttgcagggaa

SEQ ID NO: 124608 - DNA, 20 bp, Artificial
  CRISPR gRNA sequence
ctttccccgttgcagggaat

SEQ ID NO: 124609 - DNA, 20 bp, Artificial
  CRISPR gRNA sequence
tttccccgttgcagggaatg

SEQ ID NO: 124610 - DNA, 20 bp, Artificial
  CRISPR gRNA sequence
cccgttgcagggaatggggc

SEQ ID NO: 124611 - DNA, 20 bp, Artificial
  CRISPR gRNA sequence
ccgttgcagggaatggggca

SEQ ID NO: 124612 - DNA, 20 bp, Artificial
  CRISPR gRNA sequence
tatcttaaatttgccgtgat

SEQ ID NO: 124613 - DNA, 20 bp, Artificial
  CRISPR gRNA sequence
aatttgccgtgatgagatat

SEQ ID NO: 124614 - DNA, 20 bp, Artificial
  CRISPR gRNA sequence
gagatattagacatgcccta

SEQ ID NO: 124615 - DNA, 20 bp, Artificial
  CRISPR gRNA sequence
agatattagacatgccctac

SEQ ID NO: 124616 - DNA, 20 bp, Artificial
  CRISPR gRNA sequence
ttagacatgccctacaggca

SEQ ID NO: 124617 - DNA, 20 bp, Artificial
  CRISPR gRNA sequence
tagacatgccctacaggcat

SEQ ID NO: 124618 - DNA, 20 bp, Artificial
  CRISPR gRNA sequence
cctacaggcatgggttgctt

SEQ ID NO: 124619 - DNA, 20 bp, Artificial
  CRISPR gRNA sequence
acaggcatgggttgcttgag

SEQ ID NO: 124620 - DNA, 20 bp, Artificial
  CRISPR gRNA sequence
gcatgggttgcttgagtggc

SEQ ID NO: 124621 - DNA, 20 bp, Artificial
  CRISPR gRNA sequence
tgggttgcttgagtggcaag

SEQ ID NO: 124622 - DNA, 20 bp, Artificial
  CRISPR gRNA sequence
ttgagtggcaagcagaatat

SEQ ID NO: 124623 - DNA, 20 bp, Artificial
  CRISPR gRNA sequence
ggcaagcagaatattggttg

SEQ ID NO: 124624 - DNA, 20 bp, Artificial
  CRISPR gRNA sequence
cagaatattggttgtagatt

SEQ ID NO: 124625 - DNA, 20 bp, Artificial
  CRISPR gRNA sequence
gttgtagatttggcatttat

SEQ ID NO: 124626 - DNA, 20 bp, Artificial
  CRISPR gRNA sequence
agatttggcatttataagca

SEQ ID NO: 124627 - DNA, 20 bp, Artificial
  CRISPR gRNA sequence
tttggcatttataagcatag

SEQ ID NO: 124628 - DNA, 20 bp, Artificial
  CRISPR gRNA sequence
ataagcatagaagtgatatt

SEQ ID NO: 124629 - DNA, 20 bp, Artificial
  CRISPR gRNA sequence
gcatagaagtgatatttagt

SEQ ID NO: 124630 - DNA, 20 bp, Artificial
  CRISPR gRNA sequence
tgatatttagtgagttcatt

SEQ ID NO: 124631 - DNA, 20 bp, Artificial
  CRISPR gRNA sequence
agtgagttcattaagaaaat

SEQ ID NO: 124632 - DNA, 20 bp, Artificial
  CRISPR gRNA sequence
gtgagttcattaagaaaata

SEQ ID NO: 124633 - DNA, 20 bp, Artificial
  CRISPR gRNA sequence
tgagttcattaagaaaataa

SEQ ID NO: 124634 - DNA, 20 bp, Artificial
  CRISPR gRNA sequence
gttcattaagaaaataaggg

SEQ ID NO: 124635 - DNA, 20 bp, Artificial
  CRISPR gRNA sequence
attaagaaaataagggaaga

SEQ ID NO: 124636 - DNA, 20 bp, Artificial
  CRISPR gRNA sequence
taagaaaataagggaagaaa

SEQ ID NO: 124637 - DNA, 20 bp, Artificial
  CRISPR gRNA sequence
gaaaataagggaagaaagag

SEQ ID NO: 124638 - DNA, 20 bp, Artificial
  CRISPR gRNA sequence
aaaataagggaagaaagaga

SEQ ID NO: 124639 - DNA, 20 bp, Artificial
  CRISPR gRNA sequence
aagaaagagaaggataacct

SEQ ID NO: 124640 - DNA, 20 bp, Artificial
  CRISPR gRNA sequence
agaaagagaaggataacctt

SEQ ID NO: 124641 - DNA, 20 bp, Artificial
  CRISPR gRNA sequence
ataaccttgggtgaaacaat

SEQ ID NO: 124642 - DNA, 20 bp, Artificial
  CRISPR gRNA sequence
taaccttgggtgaaacaatt

SEQ ID NO: 124643 - DNA, 20 bp, Artificial
  CRISPR gRNA sequence
aaccttgggtgaaacaatta

SEQ ID NO: 124644 - DNA, 20 bp, Artificial
  CRISPR gRNA sequence
accttgggtgaaacaattag

SEQ ID NO: 124645 - DNA, 20 bp, Artificial
  CRISPR gRNA sequence
ccttgggtgaaacaattagg

SEQ ID NO: 124646 - DNA, 20 bp, Artificial
  CRISPR gRNA sequence
tgggtgaaacaattaggggg

SEQ ID NO: 124647 - DNA, 20 bp, Artificial
  CRISPR gRNA sequence
gggtgaaacaattagggggt

SEQ ID NO: 124648 - DNA, 20 bp, Artificial
  CRISPR gRNA sequence
ggtgaaacaattagggggtg

SEQ ID NO: 124649 - DNA, 20 bp, Artificial
  CRISPR gRNA sequence
tgaaacaattagggggtggg

SEQ ID NO: 124650 - DNA, 20 bp, Artificial
  CRISPR gRNA sequence
gaaacaattagggggtgggg

SEQ ID NO: 124651 - DNA, 20 bp, Artificial
  CRISPR gRNA sequence
caattagggggtggggagga

SEQ ID NO: 124652 - DNA, 20 bp, Artificial
  CRISPR gRNA sequence
aattagggggtggggaggaa

SEQ ID NO: 124653 - DNA, 20 bp, Artificial
  CRISPR gRNA sequence
gggaggaaaggatattgctt

SEQ ID NO: 124654 - DNA, 20 bp, Artificial
  CRISPR gRNA sequence
aaggatattgctttggaaat

SEQ ID NO: 124655 - DNA, 20 bp, Artificial
  CRISPR gRNA sequence
ggatattgctttggaaatca

SEQ ID NO: 124656 - DNA, 20 bp, Artificial
  CRISPR gRNA sequence
tattgctttggaaatcagag

SEQ ID NO: 124657 - DNA, 20 bp, Artificial
  CRISPR gRNA sequence
attgctttggaaatcagagt

SEQ ID NO: 124658 - DNA, 20 bp, Artificial
  CRISPR gRNA sequence
tgctttggaaatcagagtag

SEQ ID NO: 124659 - DNA, 20 bp, Artificial
  CRISPR gRNA sequence
ctttggaaatcagagtagga

SEQ ID NO: 124660 - DNA, 20 bp, Artificial
  CRISPR gRNA sequence
tcagagtaggagagaattcc

SEQ ID NO: 124661 - DNA, 20 bp, Artificial
  CRISPR gRNA sequence
gaattccaagcataaatgtg

SEQ ID NO: 124662 - DNA, 20 bp, Artificial
  CRISPR gRNA sequence
tccaagcataaatgtgtggc

SEQ ID NO: 124663 - DNA, 20 bp, Artificial
  CRISPR gRNA sequence
aagcataaatgtgtggcgag

SEQ ID NO: 124664 - DNA, 20 bp, Artificial
  CRISPR gRNA sequence
cataaatgtgtggcgagtag

SEQ ID NO: 124665 - DNA, 20 bp, Artificial
  CRISPR gRNA sequence
aatgtgtggcgagtagtagc

SEQ ID NO: 124666 - DNA, 20 bp, Artificial
  CRISPR gRNA sequence
gagtagtagccagcactaca

SEQ ID NO: 124667 - DNA, 20 bp, Artificial
  CRISPR gRNA sequence
gtagccagcactacaaagaa

SEQ ID NO: 124668 - DNA, 20 bp, Artificial
  CRISPR gRNA sequence
cagcactacaaagaacagtc

SEQ ID NO: 124669 - DNA, 20 bp, Artificial
  CRISPR gRNA sequence
cactacaaagaacagtcaag

SEQ ID NO: 124670 - DNA, 20 bp, Artificial
  CRISPR gRNA sequence
actacaaagaacagtcaagt

SEQ ID NO: 124671 - DNA, 20 bp, Artificial
  CRISPR gRNA sequence
aaagaacagtcaagtaggat

SEQ ID NO: 124672 - DNA, 20 bp, Artificial
  CRISPR gRNA sequence
aagaacagtcaagtaggatg

SEQ ID NO: 124673 - DNA, 20 bp, Artificial
  CRISPR gRNA sequence
cagtcaagtaggatgaggac

SEQ ID NO: 124674 - DNA, 20 bp, Artificial
  CRISPR gRNA sequence
taggatgaggacaagatcac

SEQ ID NO: 124675 - DNA, 20 bp, Artificial
  CRISPR gRNA sequence
gatgaggacaagatcactgg

SEQ ID NO: 124676 - DNA, 20 bp, Artificial
  CRISPR gRNA sequence
caagatcactggcagctttt

SEQ ID NO: 124677 - DNA, 20 bp, Artificial
  CRISPR gRNA sequence
agatcactggcagcttttaa

SEQ ID NO: 124678 - DNA, 20 bp, Artificial
  CRISPR gRNA sequence
tcactggcagcttttaagag

SEQ ID NO: 124679 - DNA, 20 bp, Artificial
  CRISPR gRNA sequence
ttttaagagtggtttcattc

SEQ ID NO: 124680 - DNA, 20 bp, Artificial
  CRISPR gRNA sequence
tttaagagtggtttcattct

SEQ ID NO: 124681 - DNA, 20 bp, Artificial
  CRISPR gRNA sequence
agagtggtttcattctgggt

SEQ ID NO: 124682 - DNA, 20 bp, Artificial
  CRISPR gRNA sequence
gagtggtttcattctgggtt

SEQ ID NO: 124683 - DNA, 20 bp, Artificial
  CRISPR gRNA sequence
agtggtttcattctgggttg

SEQ ID NO: 124684 - DNA, 20 bp, Artificial
  CRISPR gRNA sequence
cattctgggttggggttaaa

SEQ ID NO: 124685 - DNA, 20 bp, Artificial
  CRISPR gRNA sequence
ggggttaaaaagtacatgtt

SEQ ID NO: 124686 - DNA, 20 bp, Artificial
  CRISPR gRNA sequence
gggttaaaaagtacatgttc

SEQ ID NO: 124687 - DNA, 20 bp, Artificial
  CRISPR gRNA sequence
gttaaaaagtacatgttcag

SEQ ID NO: 124688 - DNA, 20 bp, Artificial
  CRISPR gRNA sequence
tacatgttcaggagtttaaa

SEQ ID NO: 124689 - DNA, 20 bp, Artificial
  CRISPR gRNA sequence
acatgttcaggagtttaaat

SEQ ID NO: 124690 - DNA, 20 bp, Artificial
  CRISPR gRNA sequence
caggagtttaaataggaatg

SEQ ID NO: 124691 - DNA, 20 bp, Artificial
  CRISPR gRNA sequence
ggagtttaaataggaatgaa

SEQ ID NO: 124692 - DNA, 20 bp, Artificial
  CRISPR gRNA sequence
gagtttaaataggaatgaag

SEQ ID NO: 124693 - DNA, 20 bp, Artificial
  CRISPR gRNA sequence
agaggtgtcttaacaactgt

SEQ ID NO: 124694 - DNA, 20 bp, Artificial
  CRISPR gRNA sequence
gaggtgtcttaacaactgtc

SEQ ID NO: 124695 - DNA, 20 bp, Artificial
  CRISPR gRNA sequence
aggtgtcttaacaactgtca

SEQ ID NO: 124696 - DNA, 20 bp, Artificial
  CRISPR gRNA sequence
gtcttaacaactgtcagggc

SEQ ID NO: 124697 - DNA, 20 bp, Artificial
  CRISPR gRNA sequence
aacaactgtcagggcaagaa

SEQ ID NO: 124698 - DNA, 20 bp, Artificial
  CRISPR gRNA sequence
aactgtcagggcaagaatgg

SEQ ID NO: 124699 - DNA, 20 bp, Artificial
  CRISPR gRNA sequence
gtcagggcaagaatggtagc

SEQ ID NO: 124700 - DNA, 20 bp, Artificial
  CRISPR gRNA sequence
tcagggcaagaatggtagct

SEQ ID NO: 124701 - DNA, 20 bp, Artificial
  CRISPR gRNA sequence
ggcaagaatggtagctaggc

SEQ ID NO: 124702 - DNA, 20 bp, Artificial
  CRISPR gRNA sequence
gcaagaatggtagctaggca

SEQ ID NO: 124703 - DNA, 20 bp, Artificial
  CRISPR gRNA sequence
caagaatggtagctaggcaa

SEQ ID NO: 124704 - DNA, 20 bp, Artificial
  CRISPR gRNA sequence
atggtagctaggcaagggta

SEQ ID NO: 124705 - DNA, 20 bp, Artificial
  CRISPR gRNA sequence
tggtagctaggcaagggtat

SEQ ID NO: 124706 - DNA, 20 bp, Artificial
  CRISPR gRNA sequence
ggtagctaggcaagggtatg

SEQ ID NO: 124707 - DNA, 20 bp, Artificial
  CRISPR gRNA sequence
agctaggcaagggtatgggg

SEQ ID NO: 124708 - DNA, 20 bp, Artificial
  CRISPR gRNA sequence
caagggtatggggcagaatt

SEQ ID NO: 124709 - DNA, 20 bp, Artificial
  CRISPR gRNA sequence
tgtacttctgtatgcttaat

SEQ ID NO: 124710 - DNA, 20 bp, Artificial
  CRISPR gRNA sequence
gtacttctgtatgcttaatg

SEQ ID NO: 124711 - DNA, 20 bp, Artificial
  CRISPR gRNA sequence
tacttctgtatgcttaatga

SEQ ID NO: 124712 - DNA, 20 bp, Artificial
  CRISPR gRNA sequence
cttctgtatgcttaatgagg

SEQ ID NO: 124713 - DNA, 20 bp, Artificial
  CRISPR gRNA sequence
tatgcttaatgagggagact

SEQ ID NO: 124714 - DNA, 20 bp, Artificial
  CRISPR gRNA sequence
gagggagactaagcatgttt

SEQ ID NO: 124715 - DNA, 20 bp, Artificial
  CRISPR gRNA sequence
agggagactaagcatgttta

SEQ ID NO: 124716 - DNA, 20 bp, Artificial
  CRISPR gRNA sequence
gagactaagcatgtttaagg

SEQ ID NO: 124717 - DNA, 20 bp, Artificial
  CRISPR gRNA sequence
gactaagcatgtttaaggaa

SEQ ID NO: 124718 - DNA, 20 bp, Artificial
  CRISPR gRNA sequence
agcatgtttaaggaagagtg

SEQ ID NO: 124719 - DNA, 20 bp, Artificial
  CRISPR gRNA sequence
gcatgtttaaggaagagtga

SEQ ID NO: 124720 - DNA, 20 bp, Artificial
  CRISPR gRNA sequence
atgtttaaggaagagtgaag

SEQ ID NO: 124721 - DNA, 20 bp, Artificial
  CRISPR gRNA sequence
ttaaggaagagtgaaggagc

SEQ ID NO: 124722 - DNA, 20 bp, Artificial
  CRISPR gRNA sequence
ggaagagtgaaggagctggt

SEQ ID NO: 124723 - DNA, 20 bp, Artificial
  CRISPR gRNA sequence
gaagagtgaaggagctggta

SEQ ID NO: 124724 - DNA, 20 bp, Artificial
  CRISPR gRNA sequence
agagtgaaggagctggtaag

SEQ ID NO: 124725 - DNA, 20 bp, Artificial
  CRISPR gRNA sequence
gagtgaaggagctggtaagg

SEQ ID NO: 124726 - DNA, 20 bp, Artificial
  CRISPR gRNA sequence
ggagctggtaaggaggattg

SEQ ID NO: 124727 - DNA, 20 bp, Artificial
  CRISPR gRNA sequence
ggaggattgaagatacatta

SEQ ID NO: 124728 - DNA, 20 bp, Artificial
  CRISPR gRNA sequence
ggattgaagatacattatag

SEQ ID NO: 124729 - DNA, 20 bp, Artificial
  CRISPR gRNA sequence
attgaagatacattatagaa

SEQ ID NO: 124730 - DNA, 20 bp, Artificial
  CRISPR gRNA sequence
ttgaagatacattatagaag

SEQ ID NO: 124731 - DNA, 20 bp, Artificial
  CRISPR gRNA sequence
tttgtattatttcttatcct

SEQ ID NO: 124732 - DNA, 20 bp, Artificial
  CRISPR gRNA sequence
tattatttcttatcctcaga

SEQ ID NO: 124733 - DNA, 20 bp, Artificial
  CRISPR gRNA sequence
tcttatcctcagatagataa

SEQ ID NO: 124734 - DNA, 20 bp, Artificial
  CRISPR gRNA sequence
cttatcctcagatagataaa

SEQ ID NO: 124735 - DNA, 20 bp, Artificial
  CRISPR gRNA sequence
tagataaaaggaatgtaacc

SEQ ID NO: 124736 - DNA, 20 bp, Artificial
  CRISPR gRNA sequence
aaggaatgtaacccagaaaa

SEQ ID NO: 124737 - DNA, 20 bp, Artificial
  CRISPR gRNA sequence
aggaatgtaacccagaaaac

SEQ ID NO: 124738 - DNA, 20 bp, Artificial
  CRISPR gRNA sequence
gtaacccagaaaacaggtaa

SEQ ID NO: 124739 - DNA, 20 bp, Artificial
  CRISPR gRNA sequence
taacccagaaaacaggtaaa

SEQ ID NO: 124740 - DNA, 20 bp, Artificial
  CRISPR gRNA sequence
aacccagaaaacaggtaaaa

SEQ ID NO: 124741 - DNA, 20 bp, Artificial
  CRISPR gRNA sequence
aacaggtaaaagggtaaatt

SEQ ID NO: 124742 - DNA, 20 bp, Artificial
  CRISPR gRNA sequence
caggtaaaagggtaaattaa

SEQ ID NO: 124743 - DNA, 20 bp, Artificial
  CRISPR gRNA sequence
ggtaaaagggtaaattaaga

SEQ ID NO: 124744 - DNA, 20 bp, Artificial
  CRISPR gRNA sequence
taaaagggtaaattaagaga

SEQ ID NO: 124745 - DNA, 20 bp, Artificial
  CRISPR gRNA sequence
aagggtaaattaagagagag

SEQ ID NO: 124746 - DNA, 20 bp, Artificial
  CRISPR gRNA sequence
gagagagaagaatctctgcc

SEQ ID NO: 124747 - DNA, 20 bp, Artificial
  CRISPR gRNA sequence
agagaagaatctctgcctgg

SEQ ID NO: 124748 - DNA, 20 bp, Artificial
  CRISPR gRNA sequence
tctctgcctggaagaataat

SEQ ID NO: 124749 - DNA, 20 bp, Artificial
  CRISPR gRNA sequence
gaataatgagaaccgtattt

SEQ ID NO: 124750 - DNA, 20 bp, Artificial
  CRISPR gRNA sequence
aataatgagaaccgtatttg

SEQ ID NO: 124751 - DNA, 20 bp, Artificial
  CRISPR gRNA sequence
ataatgagaaccgtatttga

SEQ ID NO: 124752 - DNA, 20 bp, Artificial
  CRISPR gRNA sequence
taatgagaaccgtatttgag

SEQ ID NO: 124753 - DNA, 20 bp, Artificial
  CRISPR gRNA sequence
aatgagaaccgtatttgagg

SEQ ID NO: 124754 - DNA, 20 bp, Artificial
  CRISPR gRNA sequence
gtatttgagggggcaatact

SEQ ID NO: 124755 - DNA, 20 bp, Artificial
  CRISPR gRNA sequence
atactaagattacatttgtt

SEQ ID NO: 124756 - DNA, 20 bp, Artificial
  CRISPR gRNA sequence
ctatgtatcttgcactttgc

SEQ ID NO: 124757 - DNA, 20 bp, Artificial
  CRISPR gRNA sequence
tatgtatcttgcactttgct

SEQ ID NO: 124758 - DNA, 20 bp, Artificial
  CRISPR gRNA sequence
gctaggtgctttttatacaa

SEQ ID NO: 124759 - DNA, 20 bp, Artificial
  CRISPR gRNA sequence
tttatacaatagcttcctca

SEQ ID NO: 124760 - DNA, 20 bp, Artificial
  CRISPR gRNA sequence
tagcaacatcactttaaaaa

SEQ ID NO: 124761 - DNA, 20 bp, Artificial
  CRISPR gRNA sequence
agcaacatcactttaaaaat

SEQ ID NO: 124762 - DNA, 20 bp, Artificial
  CRISPR gRNA sequence
gcaacatcactttaaaaatg

SEQ ID NO: 124763 - DNA, 20 bp, Artificial
  CRISPR gRNA sequence
acatcactttaaaaatgggg

SEQ ID NO: 124764 - DNA, 20 bp, Artificial
  CRISPR gRNA sequence
atggggaagctgaaaacaca

SEQ ID NO: 124765 - DNA, 20 bp, Artificial
  CRISPR gRNA sequence
ggggaagctgaaaacacaaa

SEQ ID NO: 124766 - DNA, 20 bp, Artificial
  CRISPR gRNA sequence
ggaagctgaaaacacaaaga

SEQ ID NO: 124767 - DNA, 20 bp, Artificial
  CRISPR gRNA sequence
acacaaagagagctcataaa

SEQ ID NO: 124768 - DNA, 20 bp, Artificial
  CRISPR gRNA sequence
cacaaagagagctcataaat

SEQ ID NO: 124769 - DNA, 20 bp, Artificial
  CRISPR gRNA sequence
acaaagagagctcataaatg

SEQ ID NO: 124770 - DNA, 20 bp, Artificial
  CRISPR gRNA sequence
aaagagagctcataaatggg

SEQ ID NO: 124771 - DNA, 20 bp, Artificial
  CRISPR gRNA sequence
gagctcataaatggggagcc

SEQ ID NO: 124772 - DNA, 20 bp, Artificial
  CRISPR gRNA sequence
aagcttcaaacccacgaaat

SEQ ID NO: 124773 - DNA, 20 bp, Artificial
  CRISPR gRNA sequence
aaacccacgaaatcggtcct

SEQ ID NO: 124774 - DNA, 20 bp, Artificial
  CRISPR gRNA sequence
acccacgaaatcggtcctaa

SEQ ID NO: 124775 - DNA, 20 bp, Artificial
  CRISPR gRNA sequence
acgaaatcggtcctaagagc

SEQ ID NO: 124776 - DNA, 20 bp, Artificial
  CRISPR gRNA sequence
cagtgctcctcaccgtcgtc

SEQ ID NO: 124777 - DNA, 20 bp, Artificial
  CRISPR gRNA sequence
agtgctcctcaccgtcgtcc

SEQ ID NO: 124778 - DNA, 20 bp, Artificial
  CRISPR gRNA sequence
gtgctcctcaccgtcgtcca

SEQ ID NO: 124779 - DNA, 20 bp, Artificial
  CRISPR gRNA sequence
ccatctcacaaacaccatcc

SEQ ID NO: 124780 - DNA, 20 bp, Artificial
  CRISPR gRNA sequence
cacaaacaccatcctggttt

SEQ ID NO: 124781 - DNA, 20 bp, Artificial
  CRISPR gRNA sequence
aaacaccatcctggtttgag

SEQ ID NO: 124782 - DNA, 20 bp, Artificial
  CRISPR gRNA sequence
ctggtttgagaagctaattt

SEQ ID NO: 124783 - DNA, 20 bp, Artificial
  CRISPR gRNA sequence
gaagctaatttcagtgtttt

SEQ ID NO: 124784 - DNA, 20 bp, Artificial
  CRISPR gRNA sequence
cagtgttttcagtgtataat

SEQ ID NO: 124785 - DNA, 20 bp, Artificial
  CRISPR gRNA sequence
tgttttcagtgtataatcag

SEQ ID NO: 124786 - DNA, 20 bp, Artificial
  CRISPR gRNA sequence
cagtgtataatcagtagcct

SEQ ID NO: 124787 - DNA, 20 bp, Artificial
  CRISPR gRNA sequence
tcagtagccttagaatgtaa

SEQ ID NO: 124788 - DNA, 20 bp, Artificial
  CRISPR gRNA sequence
cagtagccttagaatgtaaa

SEQ ID NO: 124789 - DNA, 20 bp, Artificial
  CRISPR gRNA sequence
agtagccttagaatgtaaaa

SEQ ID NO: 124790 - DNA, 20 bp, Artificial
  CRISPR gRNA sequence
aatgtaaaagggacaaatta

SEQ ID NO: 124791 - DNA, 20 bp, Artificial
  CRISPR gRNA sequence
gtaaaagggacaaattaaag

SEQ ID NO: 124792 - DNA, 20 bp, Artificial
  CRISPR gRNA sequence
aaagggacaaattaaagaag

SEQ ID NO: 124793 - DNA, 20 bp, Artificial
  CRISPR gRNA sequence
aagggacaaattaaagaagt

SEQ ID NO: 124794 - DNA, 20 bp, Artificial
  CRISPR gRNA sequence
aaattaaagaagtaggtgta

SEQ ID NO: 124795 - DNA, 20 bp, Artificial
  CRISPR gRNA sequence
aagactgtatgaaaaactac

SEQ ID NO: 124796 - DNA, 20 bp, Artificial
  CRISPR gRNA sequence
agactgtatgaaaaactacc

SEQ ID NO: 124797 - DNA, 20 bp, Artificial
  CRISPR gRNA sequence
ctgtatgaaaaactaccagg

SEQ ID NO: 124798 - DNA, 20 bp, Artificial
  CRISPR gRNA sequence
tgtatgaaaaactaccaggc

SEQ ID NO: 124799 - DNA, 20 bp, Artificial
  CRISPR gRNA sequence
actaccaggcaggaatgctg

SEQ ID NO: 124800 - DNA, 20 bp, Artificial
  CRISPR gRNA sequence
taccaggcaggaatgctgta

SEQ ID NO: 124801 - DNA, 20 bp, Artificial
  CRISPR gRNA sequence
ccaggcaggaatgctgtaga

SEQ ID NO: 124802 - DNA, 20 bp, Artificial
  CRISPR gRNA sequence
ggcaggaatgctgtagagag

SEQ ID NO: 124803 - DNA, 20 bp, Artificial
  CRISPR gRNA sequence
ggaatgctgtagagagtagt

SEQ ID NO: 124804 - DNA, 20 bp, Artificial
  CRISPR gRNA sequence
gtagagagtagttggcatct

SEQ ID NO: 124805 - DNA, 20 bp, Artificial
  CRISPR gRNA sequence
tagagagtagttggcatctg

SEQ ID NO: 124806 - DNA, 20 bp, Artificial
  CRISPR gRNA sequence
gtagttggcatctgaggccc

SEQ ID NO: 124807 - DNA, 20 bp, Artificial
  CRISPR gRNA sequence
gcatctgaggccctggattt

SEQ ID NO: 124808 - DNA, 20 bp, Artificial
  CRISPR gRNA sequence
tcccatttactgtgtcacct

SEQ ID NO: 124809 - DNA, 20 bp, Artificial
  CRISPR gRNA sequence
cccatttactgtgtcacctc

SEQ ID NO: 124810 - DNA, 20 bp, Artificial
  CRISPR gRNA sequence
tgtcacctcaggcaaatcat

SEQ ID NO: 124811 - DNA, 20 bp, Artificial
  CRISPR gRNA sequence
atcattagcctcatgtacct

SEQ ID NO: 124812 - DNA, 20 bp, Artificial
  CRISPR gRNA sequence
cagttttctcacctgcgtca

SEQ ID NO: 124813 - DNA, 20 bp, Artificial
  CRISPR gRNA sequence
agttttctcacctgcgtcac

SEQ ID NO: 124814 - DNA, 20 bp, Artificial
  CRISPR gRNA sequence
caggcttgtgaacattgcat

SEQ ID NO: 124815 - DNA, 20 bp, Artificial
  CRISPR gRNA sequence
tgaacattgcatgagatatt

SEQ ID NO: 124816 - DNA, 20 bp, Artificial
  CRISPR gRNA sequence
cattgcatgagatatttaga

SEQ ID NO: 124817 - DNA, 20 bp, Artificial
  CRISPR gRNA sequence
ttcaataaatgtaaacatta

SEQ ID NO: 124818 - DNA, 20 bp, Artificial
  CRISPR gRNA sequence
caataaatgtaaacattaaa

SEQ ID NO: 124819 - DNA, 20 bp, Artificial
  CRISPR gRNA sequence
aataaatgtaaacattaaag

SEQ ID NO: 124820 - DNA, 20 bp, Artificial
  CRISPR gRNA sequence
ataaatgtaaacattaaaga

SEQ ID NO: 124821 - DNA, 20 bp, Artificial
  CRISPR gRNA sequence
aatgtaaacattaaagaggg

SEQ ID NO: 124822 - DNA, 20 bp, Artificial
  CRISPR gRNA sequence
aagagggcagtatttgtttg

SEQ ID NO: 124823 - DNA, 20 bp, Artificial
  CRISPR gRNA sequence
ttgtttgtggaacaaattat

SEQ ID NO: 124824 - DNA, 20 bp, Artificial
  CRISPR gRNA sequence
tgtggaacaaattattagca

SEQ ID NO: 124825 - DNA, 20 bp, Artificial
  CRISPR gRNA sequence
ttattagcatagtttaaata

SEQ ID NO: 124826 - DNA, 20 bp, Artificial
  CRISPR gRNA sequence
acggctacatcaaaaaaata

SEQ ID NO: 124827 - DNA, 20 bp, Artificial
  CRISPR gRNA sequence
tcaaaaaaataaagatttat

SEQ ID NO: 124828 - DNA, 20 bp, Artificial
  CRISPR gRNA sequence
ttatttcaaataatattttc

SEQ ID NO: 124829 - DNA, 20 bp, Artificial
  CRISPR gRNA sequence
tgtcaattcaactaaataat

SEQ ID NO: 124830 - DNA, 20 bp, Artificial
  CRISPR gRNA sequence
attcaactaaataatgagaa

SEQ ID NO: 124831 - DNA, 20 bp, Artificial
  CRISPR gRNA sequence
agtcattaaaatgaatttat

SEQ ID NO: 124832 - DNA, 20 bp, Artificial
  CRISPR gRNA sequence
gtcattaaaatgaatttatt

SEQ ID NO: 124833 - DNA, 20 bp, Artificial
  CRISPR gRNA sequence
cactctttgtccatatttat

SEQ ID NO: 124834 - DNA, 20 bp, Artificial
  CRISPR gRNA sequence
tccatatttatcagttcctt

SEQ ID NO: 124835 - DNA, 20 bp, Artificial
  CRISPR gRNA sequence
tcctacatgctgtgctcttc

SEQ ID NO: 124836 - DNA, 20 bp, Artificial
  CRISPR gRNA sequence
gctcttccagcctcattacc

SEQ ID NO: 124837 - DNA, 20 bp, Artificial
  CRISPR gRNA sequence
ctggatgaaatccaacactt

SEQ ID NO: 124838 - DNA, 20 bp, Artificial
  CRISPR gRNA sequence
atccaacactttggcttttg

SEQ ID NO: 124839 - DNA, 20 bp, Artificial
  CRISPR gRNA sequence
tggcttttgtagtctcatat

SEQ ID NO: 124840 - DNA, 20 bp, Artificial
  CRISPR gRNA sequence
ggcttttgtagtctcatatc

SEQ ID NO: 124841 - DNA, 20 bp, Artificial
  CRISPR gRNA sequence
agtctcatatcaggcctttc

SEQ ID NO: 124842 - DNA, 20 bp, Artificial
  CRISPR gRNA sequence
aggcctttcaagtgtcacac

SEQ ID NO: 124843 - DNA, 20 bp, Artificial
  CRISPR gRNA sequence
aagtgtcacactggacatac

SEQ ID NO: 124844 - DNA, 20 bp, Artificial
  CRISPR gRNA sequence
ctggcaccactgtaaactca

SEQ ID NO: 124845 - DNA, 20 bp, Artificial
  CRISPR gRNA sequence
cactgtaaactcacggtcat

SEQ ID NO: 124846 - DNA, 20 bp, Artificial
  CRISPR gRNA sequence
aaactcacggtcattagctt

SEQ ID NO: 124847 - DNA, 20 bp, Artificial
  CRISPR gRNA sequence
tcacggtcattagcttcagc

SEQ ID NO: 124848 - DNA, 20 bp, Artificial
  CRISPR gRNA sequence
cacggtcattagcttcagct

SEQ ID NO: 124849 - DNA, 20 bp, Artificial
  CRISPR gRNA sequence
tcagctaggcttacactgtc

SEQ ID NO: 124850 - DNA, 20 bp, Artificial
  CRISPR gRNA sequence
ctttcctttcccattctctg

SEQ ID NO: 124851 - DNA, 20 bp, Artificial
  CRISPR gRNA sequence
tttcccattctctgcggtga

SEQ ID NO: 124852 - DNA, 20 bp, Artificial
  CRISPR gRNA sequence
gtgacagctgtctgtctctc

SEQ ID NO: 124853 - DNA, 20 bp, Artificial
  CRISPR gRNA sequence
ctgtctgtctctccagctgc

SEQ ID NO: 124854 - DNA, 20 bp, Artificial
  CRISPR gRNA sequence
ctctccagctgcaagaatcc

SEQ ID NO: 124855 - DNA, 20 bp, Artificial
  CRISPR gRNA sequence
aagaatcccagcattatcct

SEQ ID NO: 124856 - DNA, 20 bp, Artificial
  CRISPR gRNA sequence
tggtcttcctgtatctctat

SEQ ID NO: 124857 - DNA, 20 bp, Artificial
  CRISPR gRNA sequence
cttcctgtatctctatcagt

SEQ ID NO: 124858 - DNA, 20 bp, Artificial
  CRISPR gRNA sequence
atctctatcagtcagtcacc

SEQ ID NO: 124859 - DNA, 20 bp, Artificial
  CRISPR gRNA sequence
tcaccaagtcacctactaaa

SEQ ID NO: 124860 - DNA, 20 bp, Artificial
  CRISPR gRNA sequence
tcacctactaaaaagctgtc

SEQ ID NO: 124861 - DNA, 20 bp, Artificial
  CRISPR gRNA sequence
gttctgcttctcttgatctc

SEQ ID NO: 124862 - DNA, 20 bp, Artificial
  CRISPR gRNA sequence
tgatctccagcgctctcacc

SEQ ID NO: 124863 - DNA, 20 bp, Artificial
  CRISPR gRNA sequence
aatgatcattatcttgcttg

SEQ ID NO: 124864 - DNA, 20 bp, Artificial
  CRISPR gRNA sequence
ttgaagtcatgccctgactg

SEQ ID NO: 124865 - DNA, 20 bp, Artificial
  CRISPR gRNA sequence
atgccctgactgcagcattg

SEQ ID NO: 124866 - DNA, 20 bp, Artificial
  CRISPR gRNA sequence
tgcagcattgcagtcctcac

SEQ ID NO: 124867 - DNA, 20 bp, Artificial
  CRISPR gRNA sequence
tgcctatttgtgctcccctc

SEQ ID NO: 124868 - DNA, 20 bp, Artificial
  CRISPR gRNA sequence
gcctatttgtgctcccctcc

SEQ ID NO: 124869 - DNA, 20 bp, Artificial
  CRISPR gRNA sequence
atttgtgctcccctccaggt

SEQ ID NO: 124870 - DNA, 20 bp, Artificial
  CRISPR gRNA sequence
tcggtttctgtactgaactg

SEQ ID NO: 124871 - DNA, 20 bp, Artificial
  CRISPR gRNA sequence
tttctgtactgaactgtagc

SEQ ID NO: 124872 - DNA, 20 bp, Artificial
  CRISPR gRNA sequence
tctgtactgaactgtagcca

SEQ ID NO: 124873 - DNA, 20 bp, Artificial
  CRISPR gRNA sequence
ctgtactgaactgtagccag

SEQ ID NO: 124874 - DNA, 20 bp, Artificial
  CRISPR gRNA sequence
tgtactgaactgtagccaga

SEQ ID NO: 124875 - DNA, 20 bp, Artificial
  CRISPR gRNA sequence
tttgatttcctcttgtccac

SEQ ID NO: 124876 - DNA, 20 bp, Artificial
  CRISPR gRNA sequence
ccaccggacactgcttgatc

SEQ ID NO: 124877 - DNA, 20 bp, Artificial
  CRISPR gRNA sequence
tgcttgatctagcccctcct

SEQ ID NO: 124878 - DNA, 20 bp, Artificial
  CRISPR gRNA sequence
cttagcgccttccaatccac

SEQ ID NO: 124879 - DNA, 20 bp, Artificial
  CRISPR gRNA sequence
tccaccagtactgtatttct

SEQ ID NO: 124880 - DNA, 20 bp, Artificial
  CRISPR gRNA sequence
atttcttggttttctctgcc

SEQ ID NO: 124881 - DNA, 20 bp, Artificial
  CRISPR gRNA sequence
actgatttctgtttatctgt

SEQ ID NO: 124882 - DNA, 20 bp, Artificial
  CRISPR gRNA sequence
cattttcaatgtcatttcct

SEQ ID NO: 124883 - DNA, 20 bp, Artificial
  CRISPR gRNA sequence
ttcaatgtcatttcctaaga

SEQ ID NO: 124884 - DNA, 20 bp, Artificial
  CRISPR gRNA sequence
gatagcctttcttgacccct

SEQ ID NO: 124885 - DNA, 20 bp, Artificial
  CRISPR gRNA sequence
cctttcttgacccctcagac

SEQ ID NO: 124886 - DNA, 20 bp, Artificial
  CRISPR gRNA sequence
tcttgacccctcagactagt

SEQ ID NO: 124887 - DNA, 20 bp, Artificial
  CRISPR gRNA sequence
cttgacccctcagactagtg

SEQ ID NO: 124888 - DNA, 20 bp, Artificial
  CRISPR gRNA sequence
cagactagtgaggtcccttt

SEQ ID NO: 124889 - DNA, 20 bp, Artificial
  CRISPR gRNA sequence
gactagtgaggtcccttttg

SEQ ID NO: 124890 - DNA, 20 bp, Artificial
  CRISPR gRNA sequence
ccttttggagtaaactcaca

SEQ ID NO: 124891 - DNA, 20 bp, Artificial
  CRISPR gRNA sequence
tctttgtttttcttcgtact

SEQ ID NO: 124892 - DNA, 20 bp, Artificial
  CRISPR gRNA sequence
tttttcttcgtacttggcac

SEQ ID NO: 124893 - DNA, 20 bp, Artificial
  CRISPR gRNA sequence
attatttgtaattattttaa

SEQ ID NO: 124894 - DNA, 20 bp, Artificial
  CRISPR gRNA sequence
agctatatataccacttact

SEQ ID NO: 124895 - DNA, 20 bp, Artificial
  CRISPR gRNA sequence
tgtactatgctgtctttaca

SEQ ID NO: 124896 - DNA, 20 bp, Artificial
  CRISPR gRNA sequence
tatgctgtctttacatggat

SEQ ID NO: 124897 - DNA, 20 bp, Artificial
  CRISPR gRNA sequence
ggattagctcctaacctgta

SEQ ID NO: 124898 - DNA, 20 bp, Artificial
  CRISPR gRNA sequence
gattagctcctaacctgtac

SEQ ID NO: 124899 - DNA, 20 bp, Artificial
  CRISPR gRNA sequence
ttagctcctaacctgtacag

SEQ ID NO: 124900 - DNA, 20 bp, Artificial
  CRISPR gRNA sequence
tcctaacctgtacaggagcc

SEQ ID NO: 124901 - DNA, 20 bp, Artificial
  CRISPR gRNA sequence
cctaacctgtacaggagcct

SEQ ID NO: 124902 - DNA, 20 bp, Artificial
  CRISPR gRNA sequence
taacctgtacaggagcctgg

SEQ ID NO: 124903 - DNA, 20 bp, Artificial
  CRISPR gRNA sequence
aacctgtacaggagcctggg

SEQ ID NO: 124904 - DNA, 20 bp, Artificial
  CRISPR gRNA sequence
gtacaggagcctgggaggtt

SEQ ID NO: 124905 - DNA, 20 bp, Artificial
  CRISPR gRNA sequence
ggttaagtcttgttctcatc

SEQ ID NO: 124906 - DNA, 20 bp, Artificial
  CRISPR gRNA sequence
gttctcatccagtttgttca

SEQ ID NO: 124907 - DNA, 20 bp, Artificial
  CRISPR gRNA sequence
ccagtttgttcacggtctca

SEQ ID NO: 124908 - DNA, 20 bp, Artificial
  CRISPR gRNA sequence
tttgttcacggtctcatggt

SEQ ID NO: 124909 - DNA, 20 bp, Artificial
  CRISPR gRNA sequence
gttcacggtctcatggtaag

SEQ ID NO: 124910 - DNA, 20 bp, Artificial
  CRISPR gRNA sequence
cacggtctcatggtaagtgg

SEQ ID NO: 124911 - DNA, 20 bp, Artificial
  CRISPR gRNA sequence
acggtctcatggtaagtggc

SEQ ID NO: 124912 - DNA, 20 bp, Artificial
  CRISPR gRNA sequence
cggtctcatggtaagtggca

SEQ ID NO: 124913 - DNA, 20 bp, Artificial
  CRISPR gRNA sequence
aagtggcagggaattcaaac

SEQ ID NO: 124914 - DNA, 20 bp, Artificial
  CRISPR gRNA sequence
agtggcagggaattcaaact

SEQ ID NO: 124915 - DNA, 20 bp, Artificial
  CRISPR gRNA sequence
caaactaggtgattcgattc

SEQ ID NO: 124916 - DNA, 20 bp, Artificial
  CRISPR gRNA sequence
aactaggtgattcgattcca

SEQ ID NO: 124917 - DNA, 20 bp, Artificial
  CRISPR gRNA sequence
cgattccagagcctgtgtcc

SEQ ID NO: 124918 - DNA, 20 bp, Artificial
  CRISPR gRNA sequence
ttccagagcctgtgtcctgg

SEQ ID NO: 124919 - DNA, 20 bp, Artificial
  CRISPR gRNA sequence
tccagagcctgtgtcctgga

SEQ ID NO: 124920 - DNA, 20 bp, Artificial
  CRISPR gRNA sequence
ctgtgtcctggaaggactaa

SEQ ID NO: 124921 - DNA, 20 bp, Artificial
  CRISPR gRNA sequence
tgtgtcctggaaggactaat

SEQ ID NO: 124922 - DNA, 20 bp, Artificial
  CRISPR gRNA sequence
taccccttcaccctgcctcc

SEQ ID NO: 124923 - DNA, 20 bp, Artificial
  CRISPR gRNA sequence
accccttcaccctgcctccc

SEQ ID NO: 124924 - DNA, 20 bp, Artificial
  CRISPR gRNA sequence
ttatgtaacatttgtcctgc

SEQ ID NO: 124925 - DNA, 20 bp, Artificial
  CRISPR gRNA sequence
taacatttgtcctgcaagct

SEQ ID NO: 124926 - DNA, 20 bp, Artificial
  CRISPR gRNA sequence
aacatttgtcctgcaagctg

SEQ ID NO: 124927 - DNA, 20 bp, Artificial
  CRISPR gRNA sequence
tttgtcctgcaagctgagga

SEQ ID NO: 124928 - DNA, 20 bp, Artificial
  CRISPR gRNA sequence
tgtcctgcaagctgaggaca

SEQ ID NO: 124929 - DNA, 20 bp, Artificial
  CRISPR gRNA sequence
gagaccttgtctgttgttga

SEQ ID NO: 124930 - DNA, 20 bp, Artificial
  CRISPR gRNA sequence
gttgttgacagctacgtgac

SEQ ID NO: 124931 - DNA, 20 bp, Artificial
  CRISPR gRNA sequence
acagctacgtgaccagcaca

SEQ ID NO: 124932 - DNA, 20 bp, Artificial
  CRISPR gRNA sequence
accagcacatagcatgaacc

SEQ ID NO: 124933 - DNA, 20 bp, Artificial
  CRISPR gRNA sequence
gcatgaacctggtaaatact

SEQ ID NO: 124934 - DNA, 20 bp, Artificial
  CRISPR gRNA sequence
gtaaatactaagcgctcact

SEQ ID NO: 124935 - DNA, 20 bp, Artificial
  CRISPR gRNA sequence
ctcactcagtaaatatttgt

SEQ ID NO: 124936 - DNA, 20 bp, Artificial
  CRISPR gRNA sequence
ctcagtaaatatttgttggc

SEQ ID NO: 124937 - DNA, 20 bp, Artificial
  CRISPR gRNA sequence
gctggcttactgacaatcta

SEQ ID NO: 124938 - DNA, 20 bp, Artificial
  CRISPR gRNA sequence
caatctacagtctgttttat

SEQ ID NO: 124939 - DNA, 20 bp, Artificial
  CRISPR gRNA sequence
gtctgttttataagttttta

SEQ ID NO: 124940 - DNA, 20 bp, Artificial
  CRISPR gRNA sequence
tctgttttataagtttttat

SEQ ID NO: 124941 - DNA, 20 bp, Artificial
  CRISPR gRNA sequence
taagtttttataggatgttt

SEQ ID NO: 124942 - DNA, 20 bp, Artificial
  CRISPR gRNA sequence
tttataggatgttttagacc

SEQ ID NO: 124943 - DNA, 20 bp, Artificial
  CRISPR gRNA sequence
ttagacctagaaaaaacctt

SEQ ID NO: 124944 - DNA, 20 bp, Artificial
  CRISPR gRNA sequence
tagacctagaaaaaaccttt

SEQ ID NO: 124945 - DNA, 20 bp, Artificial
  CRISPR gRNA sequence
aaaaacctttgggatgcatc

SEQ ID NO: 124946 - DNA, 20 bp, Artificial
  CRISPR gRNA sequence
acctttgggatgcatctagc

SEQ ID NO: 124947 - DNA, 20 bp, Artificial
  CRISPR gRNA sequence
ttttccatcattcttatata

SEQ ID NO: 124948 - DNA, 20 bp, Artificial
  CRISPR gRNA sequence
tttccatcattcttatatat

SEQ ID NO: 124949 - DNA, 20 bp, Artificial
  CRISPR gRNA sequence
cattcttatatataggcgaa

SEQ ID NO: 124950 - DNA, 20 bp, Artificial
  CRISPR gRNA sequence
cttatatataggcgaatggc

SEQ ID NO: 124951 - DNA, 20 bp, Artificial
  CRISPR gRNA sequence
gcgaatggctggcatattct

SEQ ID NO: 124952 - DNA, 20 bp, Artificial
  CRISPR gRNA sequence
ctggcatattctaagcatca

SEQ ID NO: 124953 - DNA, 20 bp, Artificial
  CRISPR gRNA sequence
atattctaagcatcaaagat

SEQ ID NO: 124954 - DNA, 20 bp, Artificial
  CRISPR gRNA sequence
tattctaagcatcaaagatt

SEQ ID NO: 124955 - DNA, 20 bp, Artificial
  CRISPR gRNA sequence
aaagattaggttgacttatt

SEQ ID NO: 124956 - DNA, 20 bp, Artificial
  CRISPR gRNA sequence
taggttgacttattgagtga

SEQ ID NO: 124957 - DNA, 20 bp, Artificial
  CRISPR gRNA sequence
aggttgacttattgagtgaa

SEQ ID NO: 124958 - DNA, 20 bp, Artificial
  CRISPR gRNA sequence
cttattgagtgaaaggtact

SEQ ID NO: 124959 - DNA, 20 bp, Artificial
  CRISPR gRNA sequence
gtgaaaggtactaagtgcca

SEQ ID NO: 124960 - DNA, 20 bp, Artificial
  CRISPR gRNA sequence
gaaaggtactaagtgccata

SEQ ID NO: 124961 - DNA, 20 bp, Artificial
  CRISPR gRNA sequence
ctaagtgccatagagcttta

SEQ ID NO: 124962 - DNA, 20 bp, Artificial
  CRISPR gRNA sequence
tgccatagagctttaaagaa

SEQ ID NO: 124963 - DNA, 20 bp, Artificial
  CRISPR gRNA sequence
gaacatttgtttttgaattg

SEQ ID NO: 124964 - DNA, 20 bp, Artificial
  CRISPR gRNA sequence
atttgtttttgaattgcaga

SEQ ID NO: 124965 - DNA, 20 bp, Artificial
  CRISPR gRNA sequence
tttgtttttgaattgcagaa

SEQ ID NO: 124966 - DNA, 20 bp, Artificial
  CRISPR gRNA sequence
gaattgcagaaaggataaat

SEQ ID NO: 124967 - DNA, 20 bp, Artificial
  CRISPR gRNA sequence
tgcagaaaggataaatcaga

SEQ ID NO: 124968 - DNA, 20 bp, Artificial
  CRISPR gRNA sequence
aggataaatcagaaagatta

SEQ ID NO: 124969 - DNA, 20 bp, Artificial
  CRISPR gRNA sequence
ggataaatcagaaagattaa

SEQ ID NO: 124970 - DNA, 20 bp, Artificial
  CRISPR gRNA sequence
ataaatcagaaagattaaag

SEQ ID NO: 124971 - DNA, 20 bp, Artificial
  CRISPR gRNA sequence
taaatcagaaagattaaagg

SEQ ID NO: 124972 - DNA, 20 bp, Artificial
  CRISPR gRNA sequence
tcagaaagattaaaggagga

SEQ ID NO: 124973 - DNA, 20 bp, Artificial
  CRISPR gRNA sequence
agaaagattaaaggaggata

SEQ ID NO: 124974 - DNA, 20 bp, Artificial
  CRISPR gRNA sequence
taaaggaggatagagaacac

SEQ ID NO: 124975 - DNA, 20 bp, Artificial
  CRISPR gRNA sequence
aaaggaggatagagaacact

SEQ ID NO: 124976 - DNA, 20 bp, Artificial
  CRISPR gRNA sequence
gatagagaacactgggatta

SEQ ID NO: 124977 - DNA, 20 bp, Artificial
  CRISPR gRNA sequence
agaacactgggattaaagtc

SEQ ID NO: 124978 - DNA, 20 bp, Artificial
  CRISPR gRNA sequence
gaacactgggattaaagtct

SEQ ID NO: 124979 - DNA, 20 bp, Artificial
  CRISPR gRNA sequence
aacactgggattaaagtctg

SEQ ID NO: 124980 - DNA, 20 bp, Artificial
  CRISPR gRNA sequence
actgggattaaagtctgggg

SEQ ID NO: 124981 - DNA, 20 bp, Artificial
  CRISPR gRNA sequence
ctgggattaaagtctggggc

SEQ ID NO: 124982 - DNA, 20 bp, Artificial
  CRISPR gRNA sequence
agtctggggcaggattttaa

SEQ ID NO: 124983 - DNA, 20 bp, Artificial
  CRISPR gRNA sequence
ctggggcaggattttaatgg

SEQ ID NO: 124984 - DNA, 20 bp, Artificial
  CRISPR gRNA sequence
ggcaggattttaatggtaga

SEQ ID NO: 124985 - DNA, 20 bp, Artificial
  CRISPR gRNA sequence
ggattttaatggtagaaaga

SEQ ID NO: 124986 - DNA, 20 bp, Artificial
  CRISPR gRNA sequence
attttaatggtagaaagaca

SEQ ID NO: 124987 - DNA, 20 bp, Artificial
  CRISPR gRNA sequence
ttttaatggtagaaagacag

SEQ ID NO: 124988 - DNA, 20 bp, Artificial
  CRISPR gRNA sequence
aatggtagaaagacagagga

SEQ ID NO: 124989 - DNA, 20 bp, Artificial
  CRISPR gRNA sequence
atggtagaaagacagaggaa

SEQ ID NO: 124990 - DNA, 20 bp, Artificial
  CRISPR gRNA sequence
gtagaaagacagaggaaagg

SEQ ID NO: 124991 - DNA, 20 bp, Artificial
  CRISPR gRNA sequence
aaagacagaggaaaggaaga

SEQ ID NO: 124992 - DNA, 20 bp, Artificial
  CRISPR gRNA sequence
gacagaggaaaggaagacag

SEQ ID NO: 124993 - DNA, 20 bp, Artificial
  CRISPR gRNA sequence
acagaggaaaggaagacaga

SEQ ID NO: 124994 - DNA, 20 bp, Artificial
  CRISPR gRNA sequence
agacagaaggcgtgaaatga

SEQ ID NO: 124995 - DNA, 20 bp, Artificial
  CRISPR gRNA sequence
agaaggcgtgaaatgataga

SEQ ID NO: 124996 - DNA, 20 bp, Artificial
  CRISPR gRNA sequence
tgatagaaagctaaaacttg

SEQ ID NO: 124997 - DNA, 20 bp, Artificial
  CRISPR gRNA sequence
agctaaaacttgcagaactg

SEQ ID NO: 124998 - DNA, 20 bp, Artificial
  CRISPR gRNA sequence
tgcagaactgaagacacata

SEQ ID NO: 124999 - DNA, 20 bp, Artificial
  CRISPR gRNA sequence
aactgaagacacatacagtt

SEQ ID NO: 125000 - DNA, 20 bp, Artificial
  CRISPR gRNA sequence
tgaagacacatacagttaag

SEQ ID NO: 125001 - DNA, 20 bp, Artificial
  CRISPR gRNA sequence
acagttaagcagatgatgtg

SEQ ID NO: 125002 - DNA, 20 bp, Artificial
  CRISPR gRNA sequence
tgatgtgcggcttctcttca

SEQ ID NO: 125003 - DNA, 20 bp, Artificial
  CRISPR gRNA sequence
gatgtgcggcttctcttcaa

SEQ ID NO: 125004 - DNA, 20 bp, Artificial
  CRISPR gRNA sequence
tgtgcggcttctcttcaaag

SEQ ID NO: 125005 - DNA, 20 bp, Artificial
  CRISPR gRNA sequence
gtgcggcttctcttcaaagg

SEQ ID NO: 125006 - DNA, 20 bp, Artificial
  CRISPR gRNA sequence
tgcggcttctcttcaaagga

SEQ ID NO: 125007 - DNA, 20 bp, Artificial
  CRISPR gRNA sequence
cggcttctcttcaaaggagg

SEQ ID NO: 125008 - DNA, 20 bp, Artificial
  CRISPR gRNA sequence
ggcttctcttcaaaggaggg

SEQ ID NO: 125009 - DNA, 20 bp, Artificial
  CRISPR gRNA sequence
ctcttcaaaggagggaggat

SEQ ID NO: 125010 - DNA, 20 bp, Artificial
  CRISPR gRNA sequence
aggatgagatcgaatgtctg

SEQ ID NO: 125011 - DNA, 20 bp, Artificial
  CRISPR gRNA sequence
ggatgagatcgaatgtctgt

SEQ ID NO: 125012 - DNA, 20 bp, Artificial
  CRISPR gRNA sequence
gatgagatcgaatgtctgtg

SEQ ID NO: 125013 - DNA, 20 bp, Artificial
  CRISPR gRNA sequence
tacgtgccaaacactgtctt

SEQ ID NO: 125014 - DNA, 20 bp, Artificial
  CRISPR gRNA sequence
gtgccaaacactgtctttag

SEQ ID NO: 125015 - DNA, 20 bp, Artificial
  CRISPR gRNA sequence
cactgtctttagcagctttc

SEQ ID NO: 125016 - DNA, 20 bp, Artificial
  CRISPR gRNA sequence
ttatttaattctgacaactc

SEQ ID NO: 125017 - DNA, 20 bp, Artificial
  CRISPR gRNA sequence
tatttaattctgacaactct

SEQ ID NO: 125018 - DNA, 20 bp, Artificial
  CRISPR gRNA sequence
aatacttttatcttcacttt

SEQ ID NO: 125019 - DNA, 20 bp, Artificial
  CRISPR gRNA sequence
acttttatcttcacttttag

SEQ ID NO: 125020 - DNA, 20 bp, Artificial
  CRISPR gRNA sequence
atcttcacttttagaagact

SEQ ID NO: 125021 - DNA, 20 bp, Artificial
  CRISPR gRNA sequence
tcttcacttttagaagactg

SEQ ID NO: 125022 - DNA, 20 bp, Artificial
  CRISPR gRNA sequence
acttttagaagactgaggtt

SEQ ID NO: 125023 - DNA, 20 bp, Artificial
  CRISPR gRNA sequence
ttagaagactgaggtttagc

SEQ ID NO: 125024 - DNA, 20 bp, Artificial
  CRISPR gRNA sequence
tagaagactgaggtttagcg

SEQ ID NO: 125025 - DNA, 20 bp, Artificial
  CRISPR gRNA sequence
tttagcgaggctaatgctgt

SEQ ID NO: 125026 - DNA, 20 bp, Artificial
  CRISPR gRNA sequence
gataatcatgttgctaattc

SEQ ID NO: 125027 - DNA, 20 bp, Artificial
  CRISPR gRNA sequence
tgctaattccagtgcatgac

SEQ ID NO: 125028 - DNA, 20 bp, Artificial
  CRISPR gRNA sequence
ttctaaattaattcatctcc

SEQ ID NO: 125029 - DNA, 20 bp, Artificial
  CRISPR gRNA sequence
attcatctcccagatccgcc

SEQ ID NO: 125030 - DNA, 20 bp, Artificial
  CRISPR gRNA sequence
gatccgcctggttatttgaa

SEQ ID NO: 125031 - DNA, 20 bp, Artificial
  CRISPR gRNA sequence
tttgaacagtgtcttgctca

SEQ ID NO: 125032 - DNA, 20 bp, Artificial
  CRISPR gRNA sequence
ttgctcatagccaattttaa

SEQ ID NO: 125033 - DNA, 20 bp, Artificial
  CRISPR gRNA sequence
gccaattttaaaagacttaa

SEQ ID NO: 125034 - DNA, 20 bp, Artificial
  CRISPR gRNA sequence
gtatcatgtaaacactcatt

SEQ ID NO: 125035 - DNA, 20 bp, Artificial
  CRISPR gRNA sequence
tatcatgtaaacactcattc

SEQ ID NO: 125036 - DNA, 20 bp, Artificial
  CRISPR gRNA sequence
atgtaaacactcattcagga

SEQ ID NO: 125037 - DNA, 20 bp, Artificial
  CRISPR gRNA sequence
gccctccccacccccaacca

SEQ ID NO: 125038 - DNA, 20 bp, Artificial
  CRISPR gRNA sequence
ccaaagtttgtttccaattg

SEQ ID NO: 125039 - DNA, 20 bp, Artificial
  CRISPR gRNA sequence
caaagtttgtttccaattgt

SEQ ID NO: 125040 - DNA, 20 bp, Artificial
  CRISPR gRNA sequence
aggctctgaaacaaccactt

SEQ ID NO: 125041 - DNA, 20 bp, Artificial
  CRISPR gRNA sequence
tcctgcaccttgatcttcct

SEQ ID NO: 125042 - DNA, 20 bp, Artificial
  CRISPR gRNA sequence
cctgcaccttgatcttcctt

SEQ ID NO: 125043 - DNA, 20 bp, Artificial
  CRISPR gRNA sequence
tcttccttaggttattgtaa

SEQ ID NO: 125044 - DNA, 20 bp, Artificial
  CRISPR gRNA sequence
ccttaggttattgtaaaagc

SEQ ID NO: 125045 - DNA, 20 bp, Artificial
  CRISPR gRNA sequence
tgtaaaagctagtcaactca

SEQ ID NO: 125046 - DNA, 20 bp, Artificial
  CRISPR gRNA sequence
gtaaaagctagtcaactcac

SEQ ID NO: 125047 - DNA, 20 bp, Artificial
  CRISPR gRNA sequence
cataattgatcattctttta

SEQ ID NO: 125048 - DNA, 20 bp, Artificial
  CRISPR gRNA sequence
aaaatccatcatgtctatta

SEQ ID NO: 125049 - DNA, 20 bp, Artificial
  CRISPR gRNA sequence
aaatccatcatgtctattaa

SEQ ID NO: 125050 - DNA, 20 bp, Artificial
  CRISPR gRNA sequence
tctattaaaggatactctcc

SEQ ID NO: 125051 - DNA, 20 bp, Artificial
  CRISPR gRNA sequence
aggatactctcctagtatgt

SEQ ID NO: 125052 - DNA, 20 bp, Artificial
  CRISPR gRNA sequence
tcctagtatgttagcatttt

SEQ ID NO: 125053 - DNA, 20 bp, Artificial
  CRISPR gRNA sequence
ttagcattttaagatcaaaa

SEQ ID NO: 125054 - DNA, 20 bp, Artificial
  CRISPR gRNA sequence
tcaaaatagcatttgatttt

SEQ ID NO: 125055 - DNA, 20 bp, Artificial
  CRISPR gRNA sequence
caaaatagcatttgattttt

SEQ ID NO: 125056 - DNA, 20 bp, Artificial
  CRISPR gRNA sequence
tgtttcacatttatttgtgt

SEQ ID NO: 125057 - DNA, 20 bp, Artificial
  CRISPR gRNA sequence
acatttatttgtgttagttt

SEQ ID NO: 125058 - DNA, 20 bp, Artificial
  CRISPR gRNA sequence
ttatttgtgttagtttaaga

SEQ ID NO: 125059 - DNA, 20 bp, Artificial
  CRISPR gRNA sequence
tatttgtgttagtttaagat

SEQ ID NO: 125060 - DNA, 20 bp, Artificial
  CRISPR gRNA sequence
atttgtgttagtttaagatg

SEQ ID NO: 125061 - DNA, 20 bp, Artificial
  CRISPR gRNA sequence
ttgtgttagtttaagatggg

SEQ ID NO: 125062 - DNA, 20 bp, Artificial
  CRISPR gRNA sequence
tgtgttagtttaagatgggg

SEQ ID NO: 125063 - DNA, 20 bp, Artificial
  CRISPR gRNA sequence
gtgttagtttaagatgggga

SEQ ID NO: 125064 - DNA, 20 bp, Artificial
  CRISPR gRNA sequence
ttagtttaagatggggaggg

SEQ ID NO: 125065 - DNA, 20 bp, Artificial
  CRISPR gRNA sequence
attgttatttacattttata

SEQ ID NO: 125066 - DNA, 20 bp, Artificial
  CRISPR gRNA sequence
tatatggaaatacatttaat

SEQ ID NO: 125067 - DNA, 20 bp, Artificial
  CRISPR gRNA sequence
atggaaatacatttaattgg

SEQ ID NO: 125068 - DNA, 20 bp, Artificial
  CRISPR gRNA sequence
tggaaatacatttaattggc

SEQ ID NO: 125069 - DNA, 20 bp, Artificial
  CRISPR gRNA sequence
ggaaatacatttaattggca

SEQ ID NO: 125070 - DNA, 20 bp, Artificial
  CRISPR gRNA sequence
ttggcagggatgcttatttt

SEQ ID NO: 125071 - DNA, 20 bp, Artificial
  CRISPR gRNA sequence
tggcagggatgcttattttc

SEQ ID NO: 125072 - DNA, 20 bp, Artificial
  CRISPR gRNA sequence
ggcagggatgcttattttca

SEQ ID NO: 125073 - DNA, 20 bp, Artificial
  CRISPR gRNA sequence
gcagggatgcttattttcag

SEQ ID NO: 125074 - DNA, 20 bp, Artificial
  CRISPR gRNA sequence
gatgcttattttcaggggat

SEQ ID NO: 125075 - DNA, 20 bp, Artificial
  CRISPR gRNA sequence
gcttattttcaggggatcag

SEQ ID NO: 125076 - DNA, 20 bp, Artificial
  CRISPR gRNA sequence
cttattttcaggggatcagt

SEQ ID NO: 125077 - DNA, 20 bp, Artificial
  CRISPR gRNA sequence
tattttcaggggatcagtag

SEQ ID NO: 125078 - DNA, 20 bp, Artificial
  CRISPR gRNA sequence
ttttcaggggatcagtagga

SEQ ID NO: 125079 - DNA, 20 bp, Artificial
  CRISPR gRNA sequence
caggggatcagtaggagagt

SEQ ID NO: 125080 - DNA, 20 bp, Artificial
  CRISPR gRNA sequence
atcagtaggagagtcagaat

SEQ ID NO: 125081 - DNA, 20 bp, Artificial
  CRISPR gRNA sequence
tcagtaggagagtcagaatc

SEQ ID NO: 125082 - DNA, 20 bp, Artificial
  CRISPR gRNA sequence
tgactttgttgtttacttct

SEQ ID NO: 125083 - DNA, 20 bp, Artificial
  CRISPR gRNA sequence
actttgttgtttacttctta

SEQ ID NO: 125084 - DNA, 20 bp, Artificial
  CRISPR gRNA sequence
ctttgttgtttacttcttag

SEQ ID NO: 125085 - DNA, 20 bp, Artificial
  CRISPR gRNA sequence
tacttcttagaggctactaa

SEQ ID NO: 125086 - DNA, 20 bp, Artificial
  CRISPR gRNA sequence
aggctactaaaagtatcaaa

SEQ ID NO: 125087 - DNA, 20 bp, Artificial
  CRISPR gRNA sequence
ggctactaaaagtatcaaat

SEQ ID NO: 125088 - DNA, 20 bp, Artificial
  CRISPR gRNA sequence
aaataggtaccctatgttca

SEQ ID NO: 125089 - DNA, 20 bp, Artificial
  CRISPR gRNA sequence
cctatgttcacagattatta

SEQ ID NO: 125090 - DNA, 20 bp, Artificial
  CRISPR gRNA sequence
ctatgttcacagattattaa

SEQ ID NO: 125091 - DNA, 20 bp, Artificial
  CRISPR gRNA sequence
tacaacaactatataaatta

SEQ ID NO: 125092 - DNA, 20 bp, Artificial
  CRISPR gRNA sequence
tagaaatgtgtctctatcta

SEQ ID NO: 125093 - DNA, 20 bp, Artificial
  CRISPR gRNA sequence
gtctctatctacagttatat

SEQ ID NO: 125094 - DNA, 20 bp, Artificial
  CRISPR gRNA sequence
tctctatctacagttatatt

SEQ ID NO: 125095 - DNA, 20 bp, Artificial
  CRISPR gRNA sequence
tacagttatattaggcatca

SEQ ID NO: 125096 - DNA, 20 bp, Artificial
  CRISPR gRNA sequence
atattaggcatcacagtcaa

SEQ ID NO: 125097 - DNA, 20 bp, Artificial
  CRISPR gRNA sequence
cacagtcaacagatgcatga

SEQ ID NO: 125098 - DNA, 20 bp, Artificial
  CRISPR gRNA sequence
aaagaaatgccgtgttattg

SEQ ID NO: 125099 - DNA, 20 bp, Artificial
  CRISPR gRNA sequence
atgccgtgttattgaagacc

SEQ ID NO: 125100 - DNA, 20 bp, Artificial
  CRISPR gRNA sequence
gttattgaagacctggaaac

SEQ ID NO: 125101 - DNA, 20 bp, Artificial
  CRISPR gRNA sequence
tgaagacctggaaactagcc

SEQ ID NO: 125102 - DNA, 20 bp, Artificial
  CRISPR gRNA sequence
aatattaaataaaaattcaa

SEQ ID NO: 125103 - DNA, 20 bp, Artificial
  CRISPR gRNA sequence
tattaaataaaaattcaaca

SEQ ID NO: 125104 - DNA, 20 bp, Artificial
  CRISPR gRNA sequence
aaataaaaattcaacagaga

SEQ ID NO: 125105 - DNA, 20 bp, Artificial
  CRISPR gRNA sequence
ataaaaattcaacagagatg

SEQ ID NO: 125106 - DNA, 20 bp, Artificial
  CRISPR gRNA sequence
aaaattcaacagagatggag

SEQ ID NO: 125107 - DNA, 20 bp, Artificial
  CRISPR gRNA sequence
ggagaagacatgtgttatac

SEQ ID NO: 125108 - DNA, 20 bp, Artificial
  CRISPR gRNA sequence
gagaagacatgtgttataca

SEQ ID NO: 125109 - DNA, 20 bp, Artificial
  CRISPR gRNA sequence
attttgcaattaataacatt

SEQ ID NO: 125110 - DNA, 20 bp, Artificial
  CRISPR gRNA sequence
taataacattaagtttatac

SEQ ID NO: 125111 - DNA, 20 bp, Artificial
  CRISPR gRNA sequence
aataacattaagtttatact

SEQ ID NO: 125112 - DNA, 20 bp, Artificial
  CRISPR gRNA sequence
attaagtttatactgggtcc

SEQ ID NO: 125113 - DNA, 20 bp, Artificial
  CRISPR gRNA sequence
ttaagtttatactgggtcct

SEQ ID NO: 125114 - DNA, 20 bp, Artificial
  CRISPR gRNA sequence
ctgggtcctgggccttaatg

SEQ ID NO: 125115 - DNA, 20 bp, Artificial
  CRISPR gRNA sequence
tgggtcctgggccttaatga

SEQ ID NO: 125116 - DNA, 20 bp, Artificial
  CRISPR gRNA sequence
gggtcctgggccttaatgaa

SEQ ID NO: 125117 - DNA, 20 bp, Artificial
  CRISPR gRNA sequence
aagggtcaaatttctttgtt

SEQ ID NO: 125118 - DNA, 20 bp, Artificial
  CRISPR gRNA sequence
aatttctttgttcagcctga

SEQ ID NO: 125119 - DNA, 20 bp, Artificial
  CRISPR gRNA sequence
tttttgctatactttttatt

SEQ ID NO: 125120 - DNA, 20 bp, Artificial
  CRISPR gRNA sequence
atttaacattttttcactca

SEQ ID NO: 125121 - DNA, 20 bp, Artificial
  CRISPR gRNA sequence
actcacagatatcttatttt

SEQ ID NO: 125122 - DNA, 20 bp, Artificial
  CRISPR gRNA sequence
cacagatatcttattttgag

SEQ ID NO: 125123 - DNA, 20 bp, Artificial
  CRISPR gRNA sequence
agatatcttattttgagtag

SEQ ID NO: 125124 - DNA, 20 bp, Artificial
  CRISPR gRNA sequence
gagtagtagtatttgcaaaa

SEQ ID NO: 125125 - DNA, 20 bp, Artificial
  CRISPR gRNA sequence
agtagtatttgcaaaacaga

SEQ ID NO: 125126 - DNA, 20 bp, Artificial
  CRISPR gRNA sequence
ttgcaaaacagaaagccttc

SEQ ID NO: 125127 - DNA, 20 bp, Artificial
  CRISPR gRNA sequence
tgcaaaacagaaagccttct

SEQ ID NO: 125128 - DNA, 20 bp, Artificial
  CRISPR gRNA sequence
ccttctaggatctgccatgt

SEQ ID NO: 125129 - DNA, 20 bp, Artificial
  CRISPR gRNA sequence
gccatgttggtgaaattgaa

SEQ ID NO: 125130 - DNA, 20 bp, Artificial
  CRISPR gRNA sequence
catgttggtgaaattgaatg

SEQ ID NO: 125131 - DNA, 20 bp, Artificial
  CRISPR gRNA sequence
ttggtgaaattgaatggagc

SEQ ID NO: 125132 - DNA, 20 bp, Artificial
  CRISPR gRNA sequence
gaaattgaatggagccagct

SEQ ID NO: 125133 - DNA, 20 bp, Artificial
  CRISPR gRNA sequence
aaattgaatggagccagctc

SEQ ID NO: 125134 - DNA, 20 bp, Artificial
  CRISPR gRNA sequence
aattgaatggagccagctca

SEQ ID NO: 125135 - DNA, 20 bp, Artificial
  CRISPR gRNA sequence
gcttatgatttacttttttc

SEQ ID NO: 125136 - DNA, 20 bp, Artificial
  CRISPR gRNA sequence
tttttccagactttccctct

SEQ ID NO: 125137 - DNA, 20 bp, Artificial
  CRISPR gRNA sequence
tttccctcttggaattcttt

SEQ ID NO: 125138 - DNA, 20 bp, Artificial
  CRISPR gRNA sequence
cttggaattcttttagctct

SEQ ID NO: 125139 - DNA, 20 bp, Artificial
  CRISPR gRNA sequence
agctctcagcaaaattaatt

SEQ ID NO: 125140 - DNA, 20 bp, Artificial
  CRISPR gRNA sequence
tctcagcaaaattaattaag

SEQ ID NO: 125141 - DNA, 20 bp, Artificial
  CRISPR gRNA sequence
ctcagcaaaattaattaagc

SEQ ID NO: 125142 - DNA, 20 bp, Artificial
  CRISPR gRNA sequence
taagcaggctttttttaaaa

SEQ ID NO: 125143 - DNA, 20 bp, Artificial
  CRISPR gRNA sequence
aagcaggctttttttaaaat

SEQ ID NO: 125144 - DNA, 20 bp, Artificial
  CRISPR gRNA sequence
aactcttattcttgtctgtg

SEQ ID NO: 125145 - DNA, 20 bp, Artificial
  CRISPR gRNA sequence
actcttattcttgtctgtgc

SEQ ID NO: 125146 - DNA, 20 bp, Artificial
  CRISPR gRNA sequence
aattttcctatctttataca

SEQ ID NO: 125147 - DNA, 20 bp, Artificial
  CRISPR gRNA sequence
cctgaccccactctgtcact

SEQ ID NO: 125148 - DNA, 20 bp, Artificial
  CRISPR gRNA sequence
ctgaccccactctgtcactg

SEQ ID NO: 125149 - DNA, 20 bp, Artificial
  CRISPR gRNA sequence
ccccactctgtcactgaggc

SEQ ID NO: 125150 - DNA, 20 bp, Artificial
  CRISPR gRNA sequence
ccactctgtcactgaggctg

SEQ ID NO: 125151 - DNA, 20 bp, Artificial
  CRISPR gRNA sequence
ctgtcactgaggctggagtg

SEQ ID NO: 125152 - DNA, 20 bp, Artificial
  CRISPR gRNA sequence
tcactgaggctggagtgcag

SEQ ID NO: 125153 - DNA, 20 bp, Artificial
  CRISPR gRNA sequence
ggagtgcagtggtgtgatca

SEQ ID NO: 125154 - DNA, 20 bp, Artificial
  CRISPR gRNA sequence
ggtgtgatcacagctcactg

SEQ ID NO: 125155 - DNA, 20 bp, Artificial
  CRISPR gRNA sequence
tcactgcagcctcaacctcc

SEQ ID NO: 125156 - DNA, 20 bp, Artificial
  CRISPR gRNA sequence
cactgcagcctcaacctcct

SEQ ID NO: 125157 - DNA, 20 bp, Artificial
  CRISPR gRNA sequence
agcctcaacctcctaggctc

SEQ ID NO: 125158 - DNA, 20 bp, Artificial
  CRISPR gRNA sequence
ctcaagtgatcttcccacct

SEQ ID NO: 125159 - DNA, 20 bp, Artificial
  CRISPR gRNA sequence
tcttcccacctcagcctctc

SEQ ID NO: 125160 - DNA, 20 bp, Artificial
  CRISPR gRNA sequence
tcccacctcagcctctcaag

SEQ ID NO: 125161 - DNA, 20 bp, Artificial
  CRISPR gRNA sequence
acctcagcctctcaagtagt

SEQ ID NO: 125162 - DNA, 20 bp, Artificial
  CRISPR gRNA sequence
cctcagcctctcaagtagtt

SEQ ID NO: 125163 - DNA, 20 bp, Artificial
  CRISPR gRNA sequence
ctctcaagtagttaggacta

SEQ ID NO: 125164 - DNA, 20 bp, Artificial
  CRISPR gRNA sequence
tctcaagtagttaggactac

SEQ ID NO: 125165 - DNA, 20 bp, Artificial
  CRISPR gRNA sequence
caggcacatgccacaacgcc

SEQ ID NO: 125166 - DNA, 20 bp, Artificial
  CRISPR gRNA sequence
tcttaatttttgtttttttt

SEQ ID NO: 125167 - DNA, 20 bp, Artificial
  CRISPR gRNA sequence
ttaatttttgttttttttta

SEQ ID NO: 125168 - DNA, 20 bp, Artificial
  CRISPR gRNA sequence
tttttgtttttttttagaga

SEQ ID NO: 125169 - DNA, 20 bp, Artificial
  CRISPR gRNA sequence
ttttgtttttttttagagac

SEQ ID NO: 125170 - DNA, 20 bp, Artificial
  CRISPR gRNA sequence
tttgtttttttttagagaca

SEQ ID NO: 125171 - DNA, 20 bp, Artificial
  CRISPR gRNA sequence
cagggtctcactgtgttgcc

SEQ ID NO: 125172 - DNA, 20 bp, Artificial
  CRISPR gRNA sequence
agggtctcactgtgttgccc

SEQ ID NO: 125173 - DNA, 20 bp, Artificial
  CRISPR gRNA sequence
ccaggctgatcttgaacttc

SEQ ID NO: 125174 - DNA, 20 bp, Artificial
  CRISPR gRNA sequence
caggctgatcttgaacttct

SEQ ID NO: 125175 - DNA, 20 bp, Artificial
  CRISPR gRNA sequence
gatcttgaacttctgggccc

SEQ ID NO: 125176 - DNA, 20 bp, Artificial
  CRISPR gRNA sequence
cccaagtgatcctcccacct

SEQ ID NO: 125177 - DNA, 20 bp, Artificial
  CRISPR gRNA sequence
cctcccaccttggcttccca

SEQ ID NO: 125178 - DNA, 20 bp, Artificial
  CRISPR gRNA sequence
accttggcttcccaaagttc

SEQ ID NO: 125179 - DNA, 20 bp, Artificial
  CRISPR gRNA sequence
ccttggcttcccaaagttct

SEQ ID NO: 125180 - DNA, 20 bp, Artificial
  CRISPR gRNA sequence
ttcccaaagttctgggatta

SEQ ID NO: 125181 - DNA, 20 bp, Artificial
  CRISPR gRNA sequence
tcccaaagttctgggattac

SEQ ID NO: 125182 - DNA, 20 bp, Artificial
  CRISPR gRNA sequence
agttctgggattacaggcat

SEQ ID NO: 125183 - DNA, 20 bp, Artificial
  CRISPR gRNA sequence
ttacaggcatgagccacacc

SEQ ID NO: 125184 - DNA, 20 bp, Artificial
  CRISPR gRNA sequence
agccacacctggccctgatt

SEQ ID NO: 125185 - DNA, 20 bp, Artificial
  CRISPR gRNA sequence
cacacctggccctgatttgg

SEQ ID NO: 125186 - DNA, 20 bp, Artificial
  CRISPR gRNA sequence
acacctggccctgatttggc

SEQ ID NO: 125187 - DNA, 20 bp, Artificial
  CRISPR gRNA sequence
cacctggccctgatttggca

SEQ ID NO: 125188 - DNA, 20 bp, Artificial
  CRISPR gRNA sequence
acctggccctgatttggcag

SEQ ID NO: 125189 - DNA, 20 bp, Artificial
  CRISPR gRNA sequence
cctggccctgatttggcagg

SEQ ID NO: 125190 - DNA, 20 bp, Artificial
  CRISPR gRNA sequence
tggccctgatttggcagggg

SEQ ID NO: 125191 - DNA, 20 bp, Artificial
  CRISPR gRNA sequence
gccctgatttggcaggggga

SEQ ID NO: 125192 - DNA, 20 bp, Artificial
  CRISPR gRNA sequence
agagaaaattaacctttgac

SEQ ID NO: 125193 - DNA, 20 bp, Artificial
  CRISPR gRNA sequence
aattaacctttgactagaat

SEQ ID NO: 125194 - DNA, 20 bp, Artificial
  CRISPR gRNA sequence
attaacctttgactagaatc

SEQ ID NO: 125195 - DNA, 20 bp, Artificial
  CRISPR gRNA sequence
taacctttgactagaatcag

SEQ ID NO: 125196 - DNA, 20 bp, Artificial
  CRISPR gRNA sequence
tgactagaatcaggagttta

SEQ ID NO: 125197 - DNA, 20 bp, Artificial
  CRISPR gRNA sequence
gactagaatcaggagtttat

SEQ ID NO: 125198 - DNA, 20 bp, Artificial
  CRISPR gRNA sequence
ttatgggttcattcaaaaca

SEQ ID NO: 125199 - DNA, 20 bp, Artificial
  CRISPR gRNA sequence
tatgggttcattcaaaacat

SEQ ID NO: 125200 - DNA, 20 bp, Artificial
  CRISPR gRNA sequence
tcaaaacatgggtgtacttt

SEQ ID NO: 125201 - DNA, 20 bp, Artificial
  CRISPR gRNA sequence
gggtgtacttttggcttgcc

SEQ ID NO: 125202 - DNA, 20 bp, Artificial
  CRISPR gRNA sequence
ggtgtacttttggcttgcct

SEQ ID NO: 125203 - DNA, 20 bp, Artificial
  CRISPR gRNA sequence
acttttggcttgcctgggta

SEQ ID NO: 125204 - DNA, 20 bp, Artificial
  CRISPR gRNA sequence
tgcctgggtacagaattgtg

SEQ ID NO: 125205 - DNA, 20 bp, Artificial
  CRISPR gRNA sequence
cctgggtacagaattgtgca

SEQ ID NO: 125206 - DNA, 20 bp, Artificial
  CRISPR gRNA sequence
atccgcatgcttcttatacc

SEQ ID NO: 125207 - DNA, 20 bp, Artificial
  CRISPR gRNA sequence
atgcttcttataccaagtaa

SEQ ID NO: 125208 - DNA, 20 bp, Artificial
  CRISPR gRNA sequence
ataccaagtaacagtttgaa

SEQ ID NO: 125209 - DNA, 20 bp, Artificial
  CRISPR gRNA sequence
accaagtaacagtttgaacg

SEQ ID NO: 125210 - DNA, 20 bp, Artificial
  CRISPR gRNA sequence
aacggagacattgtctattt

SEQ ID NO: 125211 - DNA, 20 bp, Artificial
  CRISPR gRNA sequence
gtctattttggaacttctat

SEQ ID NO: 125212 - DNA, 20 bp, Artificial
  CRISPR gRNA sequence
attttggaacttctatgaga

SEQ ID NO: 125213 - DNA, 20 bp, Artificial
  CRISPR gRNA sequence
ggaacttctatgagaaagca

SEQ ID NO: 125214 - DNA, 20 bp, Artificial
  CRISPR gRNA sequence
cttctatgagaaagcaaaga

SEQ ID NO: 125215 - DNA, 20 bp, Artificial
  CRISPR gRNA sequence
agaaagcaaagaaagttcgc

SEQ ID NO: 125216 - DNA, 20 bp, Artificial
  CRISPR gRNA sequence
aagcaaagaaagttcgcaag

SEQ ID NO: 125217 - DNA, 20 bp, Artificial
  CRISPR gRNA sequence
agcaaagaaagttcgcaagc

SEQ ID NO: 125218 - DNA, 20 bp, Artificial
  CRISPR gRNA sequence
caaagaaagttcgcaagcag

SEQ ID NO: 125219 - DNA, 20 bp, Artificial
  CRISPR gRNA sequence
aagttcgcaagcaggagcaa

SEQ ID NO: 125220 - DNA, 20 bp, Artificial
  CRISPR gRNA sequence
agttcgcaagcaggagcaaa

SEQ ID NO: 125221 - DNA, 20 bp, Artificial
  CRISPR gRNA sequence
agcaggagcaaaaggaaaat

SEQ ID NO: 125222 - DNA, 20 bp, Artificial
  CRISPR gRNA sequence
gcaggagcaaaaggaaaatc

SEQ ID NO: 125223 - DNA, 20 bp, Artificial
  CRISPR gRNA sequence
caggagcaaaaggaaaatca

SEQ ID NO: 125224 - DNA, 20 bp, Artificial
  CRISPR gRNA sequence
gcaaaaggaaaatcagggtt

SEQ ID NO: 125225 - DNA, 20 bp, Artificial
  CRISPR gRNA sequence
aaaggaaaatcagggtttag

SEQ ID NO: 125226 - DNA, 20 bp, Artificial
  CRISPR gRNA sequence
aaggaaaatcagggtttagc

SEQ ID NO: 125227 - DNA, 20 bp, Artificial
  CRISPR gRNA sequence
ggaaaatcagggtttagcag

SEQ ID NO: 125228 - DNA, 20 bp, Artificial
  CRISPR gRNA sequence
aaaatcagggtttagcagga

SEQ ID NO: 125229 - DNA, 20 bp, Artificial
  CRISPR gRNA sequence
tcagggtttagcaggagagc

SEQ ID NO: 125230 - DNA, 20 bp, Artificial
  CRISPR gRNA sequence
gggtttagcaggagagctgg

SEQ ID NO: 125231 - DNA, 20 bp, Artificial
  CRISPR gRNA sequence
agcaggagagctggaagtga

SEQ ID NO: 125232 - DNA, 20 bp, Artificial
  CRISPR gRNA sequence
agagctggaagtgatggata

SEQ ID NO: 125233 - DNA, 20 bp, Artificial
  CRISPR gRNA sequence
gagctggaagtgatggatac

SEQ ID NO: 125234 - DNA, 20 bp, Artificial
  CRISPR gRNA sequence
tgatggatacaggtgaattc

SEQ ID NO: 125235 - DNA, 20 bp, Artificial
  CRISPR gRNA sequence
tgaattccagttgatgactt

SEQ ID NO: 125236 - DNA, 20 bp, Artificial
  CRISPR gRNA sequence
ttaagctgattttttttttt

SEQ ID NO: 125237 - DNA, 20 bp, Artificial
  CRISPR gRNA sequence
aagctgatttttttttttaa

SEQ ID NO: 125238 - DNA, 20 bp, Artificial
  CRISPR gRNA sequence
tgatttttttttttaagaga

SEQ ID NO: 125239 - DNA, 20 bp, Artificial
  CRISPR gRNA sequence
gatttttttttttaagagac

SEQ ID NO: 125240 - DNA, 20 bp, Artificial
  CRISPR gRNA sequence
caggttctcactacattgac

SEQ ID NO: 125241 - DNA, 20 bp, Artificial
  CRISPR gRNA sequence
aggttctcactacattgacc

SEQ ID NO: 125242 - DNA, 20 bp, Artificial
  CRISPR gRNA sequence
tctcactacattgaccaggc

SEQ ID NO: 125243 - DNA, 20 bp, Artificial
  CRISPR gRNA sequence
ctacattgaccaggctggtc

SEQ ID NO: 125244 - DNA, 20 bp, Artificial
  CRISPR gRNA sequence
caggctggtctggaactctt

SEQ ID NO: 125245 - DNA, 20 bp, Artificial
  CRISPR gRNA sequence
ggtctggaactcttgagctc

SEQ ID NO: 125246 - DNA, 20 bp, Artificial
  CRISPR gRNA sequence
ctggaactcttgagctcaag

SEQ ID NO: 125247 - DNA, 20 bp, Artificial
  CRISPR gRNA sequence
ctcaagcagtcctcctgctt

SEQ ID NO: 125248 - DNA, 20 bp, Artificial
  CRISPR gRNA sequence
gtcctcctgcttcagcttct

SEQ ID NO: 125249 - DNA, 20 bp, Artificial
  CRISPR gRNA sequence
ctcctgcttcagcttctgag

SEQ ID NO: 125250 - DNA, 20 bp, Artificial
  CRISPR gRNA sequence
tgcttcagcttctgagcagt

SEQ ID NO: 125251 - DNA, 20 bp, Artificial
  CRISPR gRNA sequence
gcttcagcttctgagcagtt

SEQ ID NO: 125252 - DNA, 20 bp, Artificial
  CRISPR gRNA sequence
cttcagcttctgagcagttg

SEQ ID NO: 125253 - DNA, 20 bp, Artificial
  CRISPR gRNA sequence
cttctgagcagttggggcta

SEQ ID NO: 125254 - DNA, 20 bp, Artificial
  CRISPR gRNA sequence
ttctgagcagttggggctac

SEQ ID NO: 125255 - DNA, 20 bp, Artificial
  CRISPR gRNA sequence
caggtacatgacactgtgta

SEQ ID NO: 125256 - DNA, 20 bp, Artificial
  CRISPR gRNA sequence
acactgtgtacagctttact

SEQ ID NO: 125257 - DNA, 20 bp, Artificial
  CRISPR gRNA sequence
tactaagctgatcatcattc

SEQ ID NO: 125258 - DNA, 20 bp, Artificial
  CRISPR gRNA sequence
actaagctgatcatcattcc

SEQ ID NO: 125259 - DNA, 20 bp, Artificial
  CRISPR gRNA sequence
ctaagctgatcatcattcca

SEQ ID NO: 125260 - DNA, 20 bp, Artificial
  CRISPR gRNA sequence
tcatcattccagggataaat

SEQ ID NO: 125261 - DNA, 20 bp, Artificial
  CRISPR gRNA sequence
catcattccagggataaatt

SEQ ID NO: 125262 - DNA, 20 bp, Artificial
  CRISPR gRNA sequence
ccagggataaattaggttgt

SEQ ID NO: 125263 - DNA, 20 bp, Artificial
  CRISPR gRNA sequence
ggataaattaggttgtaagt

SEQ ID NO: 125264 - DNA, 20 bp, Artificial
  CRISPR gRNA sequence
gataaattaggttgtaagtc

SEQ ID NO: 125265 - DNA, 20 bp, Artificial
  CRISPR gRNA sequence
ataaattaggttgtaagtca

SEQ ID NO: 125266 - DNA, 20 bp, Artificial
  CRISPR gRNA sequence
ttgtaagtcagggttgcctg

SEQ ID NO: 125267 - DNA, 20 bp, Artificial
  CRISPR gRNA sequence
tgcctgtggtactatatttg

SEQ ID NO: 125268 - DNA, 20 bp, Artificial
  CRISPR gRNA sequence
ttgaagattatgcacttaaa

SEQ ID NO: 125269 - DNA, 20 bp, Artificial
  CRISPR gRNA sequence
agattatgcacttaaaaaga

SEQ ID NO: 125270 - DNA, 20 bp, Artificial
  CRISPR gRNA sequence
attatgcacttaaaaagaaa

SEQ ID NO: 125271 - DNA, 20 bp, Artificial
  CRISPR gRNA sequence
ttatgcacttaaaaagaaag

SEQ ID NO: 125272 - DNA, 20 bp, Artificial
  CRISPR gRNA sequence
aaagaaagaggcatatgctt

SEQ ID NO: 125273 - DNA, 20 bp, Artificial
  CRISPR gRNA sequence
attcatttccttgtcgctat

SEQ ID NO: 125274 - DNA, 20 bp, Artificial
  CRISPR gRNA sequence
ccttatgcttatatcactta

SEQ ID NO: 125275 - DNA, 20 bp, Artificial
  CRISPR gRNA sequence
tatgcttatatcacttatgg

SEQ ID NO: 125276 - DNA, 20 bp, Artificial
  CRISPR gRNA sequence
cttatatcacttatggaaga

SEQ ID NO: 125277 - DNA, 20 bp, Artificial
  CRISPR gRNA sequence
tatcacttatggaagatgga

SEQ ID NO: 125278 - DNA, 20 bp, Artificial
  CRISPR gRNA sequence
atcacttatggaagatggat

SEQ ID NO: 125279 - DNA, 20 bp, Artificial
  CRISPR gRNA sequence
tcacttatggaagatggata

SEQ ID NO: 125280 - DNA, 20 bp, Artificial
  CRISPR gRNA sequence
gatagggaaatcttgaatcg

SEQ ID NO: 125281 - DNA, 20 bp, Artificial
  CRISPR gRNA sequence
cttgaatcgtggacaaattg

SEQ ID NO: 125282 - DNA, 20 bp, Artificial
  CRISPR gRNA sequence
ttgaatcgtggacaaattgt

SEQ ID NO: 125283 - DNA, 20 bp, Artificial
  CRISPR gRNA sequence
atcgtggacaaattgtggga

SEQ ID NO: 125284 - DNA, 20 bp, Artificial
  CRISPR gRNA sequence
tgtgggaaagtttccaaatc

SEQ ID NO: 125285 - DNA, 20 bp, Artificial
  CRISPR gRNA sequence
agtttccaaatcaagaaata

SEQ ID NO: 125286 - DNA, 20 bp, Artificial
  CRISPR gRNA sequence
gtttccaaatcaagaaatat

SEQ ID NO: 125287 - DNA, 20 bp, Artificial
  CRISPR gRNA sequence
ccaaatcaagaaatataggc

SEQ ID NO: 125288 - DNA, 20 bp, Artificial
  CRISPR gRNA sequence
caagaaatataggctggttg

SEQ ID NO: 125289 - DNA, 20 bp, Artificial
  CRISPR gRNA sequence
gaaatataggctggttgcgg

SEQ ID NO: 125290 - DNA, 20 bp, Artificial
  CRISPR gRNA sequence
gtggctgatgcctgtaatct

SEQ ID NO: 125291 - DNA, 20 bp, Artificial
  CRISPR gRNA sequence
tgcctgtaatctcagcattt

SEQ ID NO: 125292 - DNA, 20 bp, Artificial
  CRISPR gRNA sequence
gcctgtaatctcagcatttt

SEQ ID NO: 125293 - DNA, 20 bp, Artificial
  CRISPR gRNA sequence
ctgtaatctcagcattttgg

SEQ ID NO: 125294 - DNA, 20 bp, Artificial
  CRISPR gRNA sequence
tgtaatctcagcattttggg

SEQ ID NO: 125295 - DNA, 20 bp, Artificial
  CRISPR gRNA sequence
tctcagcattttgggaggct

SEQ ID NO: 125296 - DNA, 20 bp, Artificial
  CRISPR gRNA sequence
ctcagcattttgggaggctg

SEQ ID NO: 125297 - DNA, 20 bp, Artificial
  CRISPR gRNA sequence
agcattttgggaggctgagg

SEQ ID NO: 125298 - DNA, 20 bp, Artificial
  CRISPR gRNA sequence
gcattttgggaggctgaggt

SEQ ID NO: 125299 - DNA, 20 bp, Artificial
  CRISPR gRNA sequence
ttttgggaggctgaggtagg

SEQ ID NO: 125300 - DNA, 20 bp, Artificial
  CRISPR gRNA sequence
ctgaggtaggtggtttgttt

SEQ ID NO: 125301 - DNA, 20 bp, Artificial
  CRISPR gRNA sequence
gtaggtggtttgtttgagcc

SEQ ID NO: 125302 - DNA, 20 bp, Artificial
  CRISPR gRNA sequence
taggtggtttgtttgagccc

SEQ ID NO: 125303 - DNA, 20 bp, Artificial
  CRISPR gRNA sequence
ggtggtttgtttgagcccag

SEQ ID NO: 125304 - DNA, 20 bp, Artificial
  CRISPR gRNA sequence
ttgtttgagcccaggagttc

SEQ ID NO: 125305 - DNA, 20 bp, Artificial
  CRISPR gRNA sequence
tgagcccaggagttccagac

SEQ ID NO: 125306 - DNA, 20 bp, Artificial
  CRISPR gRNA sequence
ccaggagttccagaccagcc

SEQ ID NO: 125307 - DNA, 20 bp, Artificial
  CRISPR gRNA sequence
caggagttccagaccagcct

SEQ ID NO: 125308 - DNA, 20 bp, Artificial
  CRISPR gRNA sequence
ccagaccagcctgggcaaca

SEQ ID NO: 125309 - DNA, 20 bp, Artificial
  CRISPR gRNA sequence
tgctaaaaatacaaaaaaat

SEQ ID NO: 125310 - DNA, 20 bp, Artificial
  CRISPR gRNA sequence
aaaaatacaaaaaaattggc

SEQ ID NO: 125311 - DNA, 20 bp, Artificial
  CRISPR gRNA sequence
aaaatacaaaaaaattggcc

SEQ ID NO: 125312 - DNA, 20 bp, Artificial
  CRISPR gRNA sequence
acaaaaaaattggccaggca

SEQ ID NO: 125313 - DNA, 20 bp, Artificial
  CRISPR gRNA sequence
aaaaaattggccaggcatgg

SEQ ID NO: 125314 - DNA, 20 bp, Artificial
  CRISPR gRNA sequence
ggcatggtggtgcatgcctg

SEQ ID NO: 125315 - DNA, 20 bp, Artificial
  CRISPR gRNA sequence
ggtggtgcatgcctgtagtc

SEQ ID NO: 125316 - DNA, 20 bp, Artificial
  CRISPR gRNA sequence
atgcctgtagtccagctact

SEQ ID NO: 125317 - DNA, 20 bp, Artificial
  CRISPR gRNA sequence
tgcctgtagtccagctactc

SEQ ID NO: 125318 - DNA, 20 bp, Artificial
  CRISPR gRNA sequence
cctgtagtccagctactcag

SEQ ID NO: 125319 - DNA, 20 bp, Artificial
  CRISPR gRNA sequence
ctgtagtccagctactcagg

SEQ ID NO: 125320 - DNA, 20 bp, Artificial
  CRISPR gRNA sequence
gtccagctactcaggaggct

SEQ ID NO: 125321 - DNA, 20 bp, Artificial
  CRISPR gRNA sequence
tccagctactcaggaggctg

SEQ ID NO: 125322 - DNA, 20 bp, Artificial
  CRISPR gRNA sequence
agctactcaggaggctgagg

SEQ ID NO: 125323 - DNA, 20 bp, Artificial
  CRISPR gRNA sequence
gctactcaggaggctgaggt

SEQ ID NO: 125324 - DNA, 20 bp, Artificial
  CRISPR gRNA sequence
tactcaggaggctgaggtgg

SEQ ID NO: 125325 - DNA, 20 bp, Artificial
  CRISPR gRNA sequence
actcaggaggctgaggtggg

SEQ ID NO: 125326 - DNA, 20 bp, Artificial
  CRISPR gRNA sequence
ctgaggtgggaggattgctt

SEQ ID NO: 125327 - DNA, 20 bp, Artificial
  CRISPR gRNA sequence
gtgggaggattgcttcagcc

SEQ ID NO: 125328 - DNA, 20 bp, Artificial
  CRISPR gRNA sequence
tgggaggattgcttcagcct

SEQ ID NO: 125329 - DNA, 20 bp, Artificial
  CRISPR gRNA sequence
ggaggattgcttcagcctgg

SEQ ID NO: 125330 - DNA, 20 bp, Artificial
  CRISPR gRNA sequence
gaggattgcttcagcctggg

SEQ ID NO: 125331 - DNA, 20 bp, Artificial
  CRISPR gRNA sequence
gattgcttcagcctgggagg

SEQ ID NO: 125332 - DNA, 20 bp, Artificial
  CRISPR gRNA sequence
agcctgggaggtggattctg

SEQ ID NO: 125333 - DNA, 20 bp, Artificial
  CRISPR gRNA sequence
tgggaggtggattctgcagt

SEQ ID NO: 125334 - DNA, 20 bp, Artificial
  CRISPR gRNA sequence
gtgatcacgccactgcactc

SEQ ID NO: 125335 - DNA, 20 bp, Artificial
  CRISPR gRNA sequence
cacgccactgcactccagcc

SEQ ID NO: 125336 - DNA, 20 bp, Artificial
  CRISPR gRNA sequence
acgccactgcactccagcct

SEQ ID NO: 125337 - DNA, 20 bp, Artificial
  CRISPR gRNA sequence
ctgcactccagcctgggcca

SEQ ID NO: 125338 - DNA, 20 bp, Artificial
  CRISPR gRNA sequence
gcactccagcctgggccaca

SEQ ID NO: 125339 - DNA, 20 bp, Artificial
  CRISPR gRNA sequence
tccagcctgggccacagagt

SEQ ID NO: 125340 - DNA, 20 bp, Artificial
  CRISPR gRNA sequence
aaataattaattttttaaaa

SEQ ID NO: 125341 - DNA, 20 bp, Artificial
  CRISPR gRNA sequence
aagaaatataaattctcttt

SEQ ID NO: 125342 - DNA, 20 bp, Artificial
  CRISPR gRNA sequence
aatataaattctcttttagt

SEQ ID NO: 125343 - DNA, 20 bp, Artificial
  CRISPR gRNA sequence
aattctcttttagtaagctt

SEQ ID NO: 125344 - DNA, 20 bp, Artificial
  CRISPR gRNA sequence
attctcttttagtaagctta

SEQ ID NO: 125345 - DNA, 20 bp, Artificial
  CRISPR gRNA sequence
agtaagcttaaggctatgaa

SEQ ID NO: 125346 - DNA, 20 bp, Artificial
  CRISPR gRNA sequence
attgatgcatcatcctgtga

SEQ ID NO: 125347 - DNA, 20 bp, Artificial
  CRISPR gRNA sequence
atcatcctgtgacagtttat

SEQ ID NO: 125348 - DNA, 20 bp, Artificial
  CRISPR gRNA sequence
gttgaatctgttacgtttgt

SEQ ID NO: 125349 - DNA, 20 bp, Artificial
  CRISPR gRNA sequence
acgtttgttagtactttgaa

SEQ ID NO: 125350 - DNA, 20 bp, Artificial
  CRISPR gRNA sequence
aaaaactgtttttctcctca

SEQ ID NO: 125351 - DNA, 20 bp, Artificial
  CRISPR gRNA sequence
actgtttttctcctcataga

SEQ ID NO: 125352 - DNA, 20 bp, Artificial
  CRISPR gRNA sequence
tttttctcctcatagatgga

SEQ ID NO: 125353 - DNA, 20 bp, Artificial
  CRISPR gRNA sequence
tcctcatagatggatggtga

SEQ ID NO: 125354 - DNA, 20 bp, Artificial
  CRISPR gRNA sequence
ggatggtgacagttctacaa

SEQ ID NO: 125355 - DNA, 20 bp, Artificial
  CRISPR gRNA sequence
tacaacagatgcttctcaac

SEQ ID NO: 125356 - DNA, 20 bp, Artificial
  CRISPR gRNA sequence
acaacagatgcttctcaact

SEQ ID NO: 125357 - DNA, 20 bp, Artificial
  CRISPR gRNA sequence
ttctcaactaggaatctctg

SEQ ID NO: 125358 - DNA, 20 bp, Artificial
  CRISPR gRNA sequence
ggaatctctgcagactatat

SEQ ID NO: 125359 - DNA, 20 bp, Artificial
  CRISPR gRNA sequence
aatctctgcagactatattg

SEQ ID NO: 125360 - DNA, 20 bp, Artificial
  CRISPR gRNA sequence
atctctgcagactatattgg

SEQ ID NO: 125361 - DNA, 20 bp, Artificial
  CRISPR gRNA sequence
tctgcagactatattggagg

SEQ ID NO: 125362 - DNA, 20 bp, Artificial
  CRISPR gRNA sequence
gaggaagtcattatgttata

SEQ ID NO: 125363 - DNA, 20 bp, Artificial
  CRISPR gRNA sequence
tatgttatacagcctcatga

SEQ ID NO: 125364 - DNA, 20 bp, Artificial
  CRISPR gRNA sequence
ttatacagcctcatgatggt

SEQ ID NO: 125365 - DNA, 20 bp, Artificial
  CRISPR gRNA sequence
acagcctcatgatggtaagc

SEQ ID NO: 125366 - DNA, 20 bp, Artificial
  CRISPR gRNA sequence
gatggtaagcaagccacaat

SEQ ID NO: 125367 - DNA, 20 bp, Artificial
  CRISPR gRNA sequence
acaattagaaccaaattctc

SEQ ID NO: 125368 - DNA, 20 bp, Artificial
  CRISPR gRNA sequence
agaaccaaattctcaagttg

SEQ ID NO: 125369 - DNA, 20 bp, Artificial
  CRISPR gRNA sequence
ccaaattctcaagttgaagc

SEQ ID NO: 125370 - DNA, 20 bp, Artificial
  CRISPR gRNA sequence
attctcaagttgaagcaagt

SEQ ID NO: 125371 - DNA, 20 bp, Artificial
  CRISPR gRNA sequence
tcaagttgaagcaagttaga

SEQ ID NO: 125372 - DNA, 20 bp, Artificial
  CRISPR gRNA sequence
agttgaagcaagttagaaag

SEQ ID NO: 125373 - DNA, 20 bp, Artificial
  CRISPR gRNA sequence
aagtggacatttcattaata

SEQ ID NO: 125374 - DNA, 20 bp, Artificial
  CRISPR gRNA sequence
atttcattaatatggtgttc

SEQ ID NO: 125375 - DNA, 20 bp, Artificial
  CRISPR gRNA sequence
tttcattaatatggtgttct

SEQ ID NO: 125376 - DNA, 20 bp, Artificial
  CRISPR gRNA sequence
ctaggctacttgtgtcttta

SEQ ID NO: 125377 - DNA, 20 bp, Artificial
  CRISPR gRNA sequence
taggctacttgtgtctttat

SEQ ID NO: 125378 - DNA, 20 bp, Artificial
  CRISPR gRNA sequence
aaatttacaatcttgtgtta

SEQ ID NO: 125379 - DNA, 20 bp, Artificial
  CRISPR gRNA sequence
atcttgtgttacggttcaat

SEQ ID NO: 125380 - DNA, 20 bp, Artificial
  CRISPR gRNA sequence
tgtgttacggttcaatgaga

SEQ ID NO: 125381 - DNA, 20 bp, Artificial
  CRISPR gRNA sequence
gttcaatgagaaagtctaaa

SEQ ID NO: 125382 - DNA, 20 bp, Artificial
  CRISPR gRNA sequence
ttcaatgagaaagtctaaaa

SEQ ID NO: 125383 - DNA, 20 bp, Artificial
  CRISPR gRNA sequence
gcgtaccatgctatttttat

SEQ ID NO: 125384 - DNA, 20 bp, Artificial
  CRISPR gRNA sequence
catgctatttttattagaaa

SEQ ID NO: 125385 - DNA, 20 bp, Artificial
  CRISPR gRNA sequence
ttattagaaatagtcttcaa

SEQ ID NO: 125386 - DNA, 20 bp, Artificial
  CRISPR gRNA sequence
gaaatagtcttcaaaagaat

SEQ ID NO: 125387 - DNA, 20 bp, Artificial
  CRISPR gRNA sequence
caaaagaatgagtccttgaa

SEQ ID NO: 125388 - DNA, 20 bp, Artificial
  CRISPR gRNA sequence
caccttgtctaaaatctgta

SEQ ID NO: 125389 - DNA, 20 bp, Artificial
  CRISPR gRNA sequence
ttcctgtttaaatgttaaat

SEQ ID NO: 125390 - DNA, 20 bp, Artificial
  CRISPR gRNA sequence
agaaatttataatcaattga

SEQ ID NO: 125391 - DNA, 20 bp, Artificial
  CRISPR gRNA sequence
gaaatttataatcaattgat

SEQ ID NO: 125392 - DNA, 20 bp, Artificial
  CRISPR gRNA sequence
aaatttataatcaattgata

SEQ ID NO: 125393 - DNA, 20 bp, Artificial
  CRISPR gRNA sequence
gggtaactaaaataattatt

SEQ ID NO: 125394 - DNA, 20 bp, Artificial
  CRISPR gRNA sequence
gtaactaaaataattattta

SEQ ID NO: 125395 - DNA, 20 bp, Artificial
  CRISPR gRNA sequence
taactaaaataattatttag

SEQ ID NO: 125396 - DNA, 20 bp, Artificial
  CRISPR gRNA sequence
aactaaaataattatttaga

SEQ ID NO: 125397 - DNA, 20 bp, Artificial
  CRISPR gRNA sequence
aaaataattatttagagggt

SEQ ID NO: 125398 - DNA, 20 bp, Artificial
  CRISPR gRNA sequence
tagagggtgagttaaatttc

SEQ ID NO: 125399 - DNA, 20 bp, Artificial
  CRISPR gRNA sequence
ttgcacttatgatttatttt

SEQ ID NO: 125400 - DNA, 20 bp, Artificial
  CRISPR gRNA sequence
atattaactttgaactatgt

SEQ ID NO: 125401 - DNA, 20 bp, Artificial
  CRISPR gRNA sequence
tattaactttgaactatgtc

SEQ ID NO: 125402 - DNA, 20 bp, Artificial
  CRISPR gRNA sequence
ctttgaactatgtcaggtat

SEQ ID NO: 125403 - DNA, 20 bp, Artificial
  CRISPR gRNA sequence
aactatgtcaggtattagaa

SEQ ID NO: 125404 - DNA, 20 bp, Artificial
  CRISPR gRNA sequence
tatgtcaggtattagaatgg

SEQ ID NO: 125405 - DNA, 20 bp, Artificial
  CRISPR gRNA sequence
aggtattagaatggtagtgt

SEQ ID NO: 125406 - DNA, 20 bp, Artificial
  CRISPR gRNA sequence
ttagaatggtagtgttggct

SEQ ID NO: 125407 - DNA, 20 bp, Artificial
  CRISPR gRNA sequence
atggtagtgttggctcagtg

SEQ ID NO: 125408 - DNA, 20 bp, Artificial
  CRISPR gRNA sequence
ggtgctcacacctataatcc

SEQ ID NO: 125409 - DNA, 20 bp, Artificial
  CRISPR gRNA sequence
gctcacacctataatcccag

SEQ ID NO: 125410 - DNA, 20 bp, Artificial
  CRISPR gRNA sequence
cacctataatcccagcagtt

SEQ ID NO: 125411 - DNA, 20 bp, Artificial
  CRISPR gRNA sequence
acctataatcccagcagttt

SEQ ID NO: 125412 - DNA, 20 bp, Artificial
  CRISPR gRNA sequence
ctataatcccagcagtttgg

SEQ ID NO: 125413 - DNA, 20 bp, Artificial
  CRISPR gRNA sequence
tataatcccagcagtttggg

SEQ ID NO: 125414 - DNA, 20 bp, Artificial
  CRISPR gRNA sequence
ataatcccagcagtttggga

SEQ ID NO: 125415 - DNA, 20 bp, Artificial
  CRISPR gRNA sequence
tcccagcagtttgggagggc

SEQ ID NO: 125416 - DNA, 20 bp, Artificial
  CRISPR gRNA sequence
cccagcagtttgggagggca

SEQ ID NO: 125417 - DNA, 20 bp, Artificial
  CRISPR gRNA sequence
agcagtttgggagggcaagg

SEQ ID NO: 125418 - DNA, 20 bp, Artificial
  CRISPR gRNA sequence
gcagtttgggagggcaaggt

SEQ ID NO: 125419 - DNA, 20 bp, Artificial
  CRISPR gRNA sequence
gtttgggagggcaaggtggg

SEQ ID NO: 125420 - DNA, 20 bp, Artificial
  CRISPR gRNA sequence
gcaaggtgggcagatcactt

SEQ ID NO: 125421 - DNA, 20 bp, Artificial
  CRISPR gRNA sequence
gtgggcagatcacttgagct

SEQ ID NO: 125422 - DNA, 20 bp, Artificial
  CRISPR gRNA sequence
tgggcagatcacttgagctc

SEQ ID NO: 125423 - DNA, 20 bp, Artificial
  CRISPR gRNA sequence
ggcagatcacttgagctcag

SEQ ID NO: 125424 - DNA, 20 bp, Artificial
  CRISPR gRNA sequence
tcacttgagctcaggagttc

SEQ ID NO: 125425 - DNA, 20 bp, Artificial
  CRISPR gRNA sequence
tgagctcaggagttcgagac

SEQ ID NO: 125426 - DNA, 20 bp, Artificial
  CRISPR gRNA sequence
tcaggagttcgagaccagcc

SEQ ID NO: 125427 - DNA, 20 bp, Artificial
  CRISPR gRNA sequence
caggagttcgagaccagcct

SEQ ID NO: 125428 - DNA, 20 bp, Artificial
  CRISPR gRNA sequence
cgagaccagcctgggcaaca

SEQ ID NO: 125429 - DNA, 20 bp, Artificial
  CRISPR gRNA sequence
ctacaaaaaaattaaaaaat

SEQ ID NO: 125430 - DNA, 20 bp, Artificial
  CRISPR gRNA sequence
attaaaaaattagctgtgct

SEQ ID NO: 125431 - DNA, 20 bp, Artificial
  CRISPR gRNA sequence
aaaaaattagctgtgcttgg

SEQ ID NO: 125432 - DNA, 20 bp, Artificial
  CRISPR gRNA sequence
tgcttggtggcatgtacctg

SEQ ID NO: 125433 - DNA, 20 bp, Artificial
  CRISPR gRNA sequence
gtggcatgtacctgtagtcc

SEQ ID NO: 125434 - DNA, 20 bp, Artificial
  CRISPR gRNA sequence
tacctgtagtcccagctact

SEQ ID NO: 125435 - DNA, 20 bp, Artificial
  CRISPR gRNA sequence
acctgtagtcccagctactt

SEQ ID NO: 125436 - DNA, 20 bp, Artificial
  CRISPR gRNA sequence
cctgtagtcccagctactta

SEQ ID NO: 125437 - DNA, 20 bp, Artificial
  CRISPR gRNA sequence
ctgtagtcccagctacttag

SEQ ID NO: 125438 - DNA, 20 bp, Artificial
  CRISPR gRNA sequence
tgtagtcccagctacttagg

SEQ ID NO: 125439 - DNA, 20 bp, Artificial
  CRISPR gRNA sequence
gtcccagctacttagggggc

SEQ ID NO: 125440 - DNA, 20 bp, Artificial
  CRISPR gRNA sequence
tcccagctacttagggggct

SEQ ID NO: 125441 - DNA, 20 bp, Artificial
  CRISPR gRNA sequence
cccagctacttagggggctg

SEQ ID NO: 125442 - DNA, 20 bp, Artificial
  CRISPR gRNA sequence
ccagctacttagggggctgg

SEQ ID NO: 125443 - DNA, 20 bp, Artificial
  CRISPR gRNA sequence
tacttagggggctgggggct

SEQ ID NO: 125444 - DNA, 20 bp, Artificial
  CRISPR gRNA sequence
acttagggggctgggggctg

SEQ ID NO: 125445 - DNA, 20 bp, Artificial
  CRISPR gRNA sequence
tagggggctgggggctgagg

SEQ ID NO: 125446 - DNA, 20 bp, Artificial
  CRISPR gRNA sequence
agggggctgggggctgaggt

SEQ ID NO: 125447 - DNA, 20 bp, Artificial
  CRISPR gRNA sequence
ggggctgggggctgaggtgg

SEQ ID NO: 125448 - DNA, 20 bp, Artificial
  CRISPR gRNA sequence
gggctgggggctgaggtggg

SEQ ID NO: 125449 - DNA, 20 bp, Artificial
  CRISPR gRNA sequence
gtgggaggattgcttgaatc

SEQ ID NO: 125450 - DNA, 20 bp, Artificial
  CRISPR gRNA sequence
tgggaggattgcttgaatct

SEQ ID NO: 125451 - DNA, 20 bp, Artificial
  CRISPR gRNA sequence
ggaggattgcttgaatctgg

SEQ ID NO: 125452 - DNA, 20 bp, Artificial
  CRISPR gRNA sequence
gaggattgcttgaatctggg

SEQ ID NO: 125453 - DNA, 20 bp, Artificial
  CRISPR gRNA sequence
gattgcttgaatctgggagg

SEQ ID NO: 125454 - DNA, 20 bp, Artificial
  CRISPR gRNA sequence
ttgcttgaatctgggaggta

SEQ ID NO: 125455 - DNA, 20 bp, Artificial
  CRISPR gRNA sequence
tgcttgaatctgggaggtag

SEQ ID NO: 125456 - DNA, 20 bp, Artificial
  CRISPR gRNA sequence
aatctgggaggtagaggctt

SEQ ID NO: 125457 - DNA, 20 bp, Artificial
  CRISPR gRNA sequence
tgggaggtagaggcttcagt

SEQ ID NO: 125458 - DNA, 20 bp, Artificial
  CRISPR gRNA sequence
gtttgcaccactgcacactc

SEQ ID NO: 125459 - DNA, 20 bp, Artificial
  CRISPR gRNA sequence
caccactgcacactccagcc

SEQ ID NO: 125460 - DNA, 20 bp, Artificial
  CRISPR gRNA sequence
accactgcacactccagcct

SEQ ID NO: 125461 - DNA, 20 bp, Artificial
  CRISPR gRNA sequence
acactccagcctgggtgaca

SEQ ID NO: 125462 - DNA, 20 bp, Artificial
  CRISPR gRNA sequence
agcctgggtgacaaagtgca

SEQ ID NO: 125463 - DNA, 20 bp, Artificial
  CRISPR gRNA sequence
tgggtgacaaagtgcaaagt

SEQ ID NO: 125464 - DNA, 20 bp, Artificial
  CRISPR gRNA sequence
caaaaaaaaaaaaaaaaaaa

SEQ ID NO: 125465 - DNA, 20 bp, Artificial
  CRISPR gRNA sequence
aaaaaaaaaaaaaaaaaaaa

SEQ ID NO: 125466 - DNA, 20 bp, Artificial
  CRISPR gRNA sequence
aaaaaaaaaaaaaaaaaagg

SEQ ID NO: 125467 - DNA, 20 bp, Artificial
  CRISPR gRNA sequence
aaaaaaaggcagtgttatgt

SEQ ID NO: 125468 - DNA, 20 bp, Artificial
  CRISPR gRNA sequence
gcagtgttatgttggcctat

SEQ ID NO: 125469 - DNA, 20 bp, Artificial
  CRISPR gRNA sequence
tcagaaataatttacttttg

SEQ ID NO: 125470 - DNA, 20 bp, Artificial
  CRISPR gRNA sequence
aatttacttttgtggcattt

SEQ ID NO: 125471 - DNA, 20 bp, Artificial
  CRISPR gRNA sequence
ttttattttttatttttttt

SEQ ID NO: 125472 - DNA, 20 bp, Artificial
  CRISPR gRNA sequence
attttttattttttttgaga

SEQ ID NO: 125473 - DNA, 20 bp, Artificial
  CRISPR gRNA sequence
tttttattttttttgagatg

SEQ ID NO: 125474 - DNA, 20 bp, Artificial
  CRISPR gRNA sequence
tggagtcttgctctgtcgcc

SEQ ID NO: 125475 - DNA, 20 bp, Artificial
  CRISPR gRNA sequence
ggagtcttgctctgtcgccc

SEQ ID NO: 125476 - DNA, 20 bp, Artificial
  CRISPR gRNA sequence
tcttgctctgtcgcccaggc

SEQ ID NO: 125477 - DNA, 20 bp, Artificial
  CRISPR gRNA sequence
ttgctctgtcgcccaggctg

SEQ ID NO: 125478 - DNA, 20 bp, Artificial
  CRISPR gRNA sequence
ctgtcgcccaggctggagtg

SEQ ID NO: 125479 - DNA, 20 bp, Artificial
  CRISPR gRNA sequence
tcgcccaggctggagtgcag

SEQ ID NO: 125480 - DNA, 20 bp, Artificial
  CRISPR gRNA sequence
ggagtgcagtggcacaatct

SEQ ID NO: 125481 - DNA, 20 bp, Artificial
  CRISPR gRNA sequence
tcactgcaacctccgcctcc

SEQ ID NO: 125482 - DNA, 20 bp, Artificial
  CRISPR gRNA sequence
cactgcaacctccgcctcct

SEQ ID NO: 125483 - DNA, 20 bp, Artificial
  CRISPR gRNA sequence
aacctccgcctcctgggttc

SEQ ID NO: 125484 - DNA, 20 bp, Artificial
  CRISPR gRNA sequence
ttcaagcaattctcctgcct

SEQ ID NO: 125485 - DNA, 20 bp, Artificial
  CRISPR gRNA sequence
tcctgcctcagcctgcccgt

SEQ ID NO: 125486 - DNA, 20 bp, Artificial
  CRISPR gRNA sequence
cctcagcctgcccgttagct

SEQ ID NO: 125487 - DNA, 20 bp, Artificial
  CRISPR gRNA sequence
ctgcccgttagctgagatca

SEQ ID NO: 125488 - DNA, 20 bp, Artificial
  CRISPR gRNA sequence
tgcccgttagctgagatcac

SEQ ID NO: 125489 - DNA, 20 bp, Artificial
  CRISPR gRNA sequence
tagctgagatcacaggcgcc

SEQ ID NO: 125490 - DNA, 20 bp, Artificial
  CRISPR gRNA sequence
caggcgcccagcaccatgcc

SEQ ID NO: 125491 - DNA, 20 bp, Artificial
  CRISPR gRNA sequence
atgcccagctaatttttttt

SEQ ID NO: 125492 - DNA, 20 bp, Artificial
  CRISPR gRNA sequence
cccagctaatttttttttag

SEQ ID NO: 125493 - DNA, 20 bp, Artificial
  CRISPR gRNA sequence
cagctaatttttttttagta

SEQ ID NO: 125494 - DNA, 20 bp, Artificial
  CRISPR gRNA sequence
taatttttttttagtagaga

SEQ ID NO: 125495 - DNA, 20 bp, Artificial
  CRISPR gRNA sequence
aatttttttttagtagagac

SEQ ID NO: 125496 - DNA, 20 bp, Artificial
  CRISPR gRNA sequence
atttttttttagtagagaca

SEQ ID NO: 125497 - DNA, 20 bp, Artificial
  CRISPR gRNA sequence
gagacagggtttcgctgtgt

SEQ ID NO: 125498 - DNA, 20 bp, Artificial
  CRISPR gRNA sequence
cagggtttcgctgtgttggt

SEQ ID NO: 125499 - DNA, 20 bp, Artificial
  CRISPR gRNA sequence
agggtttcgctgtgttggtc

SEQ ID NO: 125500 - DNA, 20 bp, Artificial
  CRISPR gRNA sequence
tttcgctgtgttggtcaggc

SEQ ID NO: 125501 - DNA, 20 bp, Artificial
  CRISPR gRNA sequence
tggtctcaaactcgtgacct

SEQ ID NO: 125502 - DNA, 20 bp, Artificial
  CRISPR gRNA sequence
ctcagatgatctgcctgctt

SEQ ID NO: 125503 - DNA, 20 bp, Artificial
  CRISPR gRNA sequence
ctgcctgcttcagcctccca

SEQ ID NO: 125504 - DNA, 20 bp, Artificial
  CRISPR gRNA sequence
gcttcagcctcccaaagtgc

SEQ ID NO: 125505 - DNA, 20 bp, Artificial
  CRISPR gRNA sequence
cttcagcctcccaaagtgct

SEQ ID NO: 125506 - DNA, 20 bp, Artificial
  CRISPR gRNA sequence
ctcccaaagtgctgggatta

SEQ ID NO: 125507 - DNA, 20 bp, Artificial
  CRISPR gRNA sequence
agtgctgggattatagtcat

SEQ ID NO: 125508 - DNA, 20 bp, Artificial
  CRISPR gRNA sequence
tagtcatgagccaccacgcc

SEQ ID NO: 125509 - DNA, 20 bp, Artificial
  CRISPR gRNA sequence
ttgtaaaatttttaaaaatt

SEQ ID NO: 125510 - DNA, 20 bp, Artificial
  CRISPR gRNA sequence
taaaaattgagatatatttt

SEQ ID NO: 125511 - DNA, 20 bp, Artificial
  CRISPR gRNA sequence
aaattgagatatatttttag

SEQ ID NO: 125512 - DNA, 20 bp, Artificial
  CRISPR gRNA sequence
tatttttagaagaaacttgc

SEQ ID NO: 125513 - DNA, 20 bp, Artificial
  CRISPR gRNA sequence
tttttagaagaaacttgcca

SEQ ID NO: 125514 - DNA, 20 bp, Artificial
  CRISPR gRNA sequence
ttttagaagaaacttgccag

SEQ ID NO: 125515 - DNA, 20 bp, Artificial
  CRISPR gRNA sequence
tttagaagaaacttgccaga

SEQ ID NO: 125516 - DNA, 20 bp, Artificial
  CRISPR gRNA sequence
ggattaatttcatcctgaaa

SEQ ID NO: 125517 - DNA, 20 bp, Artificial
  CRISPR gRNA sequence
aacgtaaattgaatcaactt

SEQ ID NO: 125518 - DNA, 20 bp, Artificial
  CRISPR gRNA sequence
aagtgccttgcctccttact

SEQ ID NO: 125519 - DNA, 20 bp, Artificial
  CRISPR gRNA sequence
ctccttacttagtacatatg

SEQ ID NO: 125520 - DNA, 20 bp, Artificial
  CRISPR gRNA sequence
ccttacttagtacatatgaa

SEQ ID NO: 125521 - DNA, 20 bp, Artificial
  CRISPR gRNA sequence
tacttagtacatatgaagag

SEQ ID NO: 125522 - DNA, 20 bp, Artificial
  CRISPR gRNA sequence
acttagtacatatgaagagt

SEQ ID NO: 125523 - DNA, 20 bp, Artificial
  CRISPR gRNA sequence
tagtacatatgaagagtggg

SEQ ID NO: 125524 - DNA, 20 bp, Artificial
  CRISPR gRNA sequence
aagagtgggcagtttactta

SEQ ID NO: 125525 - DNA, 20 bp, Artificial
  CRISPR gRNA sequence
agagtgggcagtttacttac

SEQ ID NO: 125526 - DNA, 20 bp, Artificial
  CRISPR gRNA sequence
tacttacaggatactgcatt

SEQ ID NO: 125527 - DNA, 20 bp, Artificial
  CRISPR gRNA sequence
gatactgcatttagtcataa

SEQ ID NO: 125528 - DNA, 20 bp, Artificial
  CRISPR gRNA sequence
atactgcatttagtcataaa

SEQ ID NO: 125529 - DNA, 20 bp, Artificial
  CRISPR gRNA sequence
tagtcataaaaggatgttat

SEQ ID NO: 125530 - DNA, 20 bp, Artificial
  CRISPR gRNA sequence
ggatgttattggtactgcgc

SEQ ID NO: 125531 - DNA, 20 bp, Artificial
  CRISPR gRNA sequence
tattggtactgcgcaagctt

SEQ ID NO: 125532 - DNA, 20 bp, Artificial
  CRISPR gRNA sequence
tactgcgcaagcttcagtta

SEQ ID NO: 125533 - DNA, 20 bp, Artificial
  CRISPR gRNA sequence
ctaaatttatataatttgaa

SEQ ID NO: 125534 - DNA, 20 bp, Artificial
  CRISPR gRNA sequence
aaagtccctttttgtatgaa

SEQ ID NO: 125535 - DNA, 20 bp, Artificial
  CRISPR gRNA sequence
tccctttttgtatgaacagt

SEQ ID NO: 125536 - DNA, 20 bp, Artificial
  CRISPR gRNA sequence
gaacagttggatcactgctc

SEQ ID NO: 125537 - DNA, 20 bp, Artificial
  CRISPR gRNA sequence
ctctagctttgttcaaaaac

SEQ ID NO: 125538 - DNA, 20 bp, Artificial
  CRISPR gRNA sequence
tgttcaaaaactagttacat

SEQ ID NO: 125539 - DNA, 20 bp, Artificial
  CRISPR gRNA sequence
caaaaactagttacattagt

SEQ ID NO: 125540 - DNA, 20 bp, Artificial
  CRISPR gRNA sequence
agttacattagtaagccaac

SEQ ID NO: 125541 - DNA, 20 bp, Artificial
  CRISPR gRNA sequence
cattagtaagccaactggat

SEQ ID NO: 125542 - DNA, 20 bp, Artificial
  CRISPR gRNA sequence
caactggatcagtaataatc

SEQ ID NO: 125543 - DNA, 20 bp, Artificial
  CRISPR gRNA sequence
ggatcagtaataatcaagtc

SEQ ID NO: 125544 - DNA, 20 bp, Artificial
  CRISPR gRNA sequence
tccagtttttccattcttta

SEQ ID NO: 125545 - DNA, 20 bp, Artificial
  CRISPR gRNA sequence
aattttatataaactttata

SEQ ID NO: 125546 - DNA, 20 bp, Artificial
  CRISPR gRNA sequence
tatataaactttatacagac

SEQ ID NO: 125547 - DNA, 20 bp, Artificial
  CRISPR gRNA sequence
caactttatatcaactttaa

SEQ ID NO: 125548 - DNA, 20 bp, Artificial
  CRISPR gRNA sequence
tcaactttaaaagttttata

SEQ ID NO: 125549 - DNA, 20 bp, Artificial
  CRISPR gRNA sequence
atatagacttttacataaat

SEQ ID NO: 125550 - DNA, 20 bp, Artificial
  CRISPR gRNA sequence
taaatgagtttatataaact

SEQ ID NO: 125551 - DNA, 20 bp, Artificial
  CRISPR gRNA sequence
aaatgagtttatataaactt

SEQ ID NO: 125552 - DNA, 20 bp, Artificial
  CRISPR gRNA sequence
agtttatataaacttgggtt

SEQ ID NO: 125553 - DNA, 20 bp, Artificial
  CRISPR gRNA sequence
tttatataaacttgggtttg

SEQ ID NO: 125554 - DNA, 20 bp, Artificial
  CRISPR gRNA sequence
aaacatacaacctcttaatc

SEQ ID NO: 125555 - DNA, 20 bp, Artificial
  CRISPR gRNA sequence
catacaacctcttaatctag

SEQ ID NO: 125556 - DNA, 20 bp, Artificial
  CRISPR gRNA sequence
ctcttaatctagcagtattg

SEQ ID NO: 125557 - DNA, 20 bp, Artificial
  CRISPR gRNA sequence
tcttaatctagcagtattga

SEQ ID NO: 125558 - DNA, 20 bp, Artificial
  CRISPR gRNA sequence
ttaatctagcagtattgaag

SEQ ID NO: 125559 - DNA, 20 bp, Artificial
  CRISPR gRNA sequence
tagcagtattgaaggagcca

SEQ ID NO: 125560 - DNA, 20 bp, Artificial
  CRISPR gRNA sequence
agcagtattgaaggagccat

SEQ ID NO: 125561 - DNA, 20 bp, Artificial
  CRISPR gRNA sequence
attgaaggagccataggtta

SEQ ID NO: 125562 - DNA, 20 bp, Artificial
  CRISPR gRNA sequence
agccataggttacggtctgt

SEQ ID NO: 125563 - DNA, 20 bp, Artificial
  CRISPR gRNA sequence
gttacggtctgtaagtttta

SEQ ID NO: 125564 - DNA, 20 bp, Artificial
  CRISPR gRNA sequence
ggtctgtaagttttatagct

SEQ ID NO: 125565 - DNA, 20 bp, Artificial
  CRISPR gRNA sequence
gtcgtataataaatatttat

SEQ ID NO: 125566 - DNA, 20 bp, Artificial
  CRISPR gRNA sequence
atttatgagtacctactctg

SEQ ID NO: 125567 - DNA, 20 bp, Artificial
  CRISPR gRNA sequence
tatgagtacctactctgtgg

SEQ ID NO: 125568 - DNA, 20 bp, Artificial
  CRISPR gRNA sequence
atgagtacctactctgtgga

SEQ ID NO: 125569 - DNA, 20 bp, Artificial
  CRISPR gRNA sequence
tctgtggaaggtgctgtacc

SEQ ID NO: 125570 - DNA, 20 bp, Artificial
  CRISPR gRNA sequence
gaaggtgctgtaccaagctg

SEQ ID NO: 125571 - DNA, 20 bp, Artificial
  CRISPR gRNA sequence
aaggtgctgtaccaagctgt

SEQ ID NO: 125572 - DNA, 20 bp, Artificial
  CRISPR gRNA sequence
accaagctgtaggaaacaca

SEQ ID NO: 125573 - DNA, 20 bp, Artificial
  CRISPR gRNA sequence
caaagctgattcgtgacatt

SEQ ID NO: 125574 - DNA, 20 bp, Artificial
  CRISPR gRNA sequence
agctgattcgtgacattaag

SEQ ID NO: 125575 - DNA, 20 bp, Artificial
  CRISPR gRNA sequence
attaagtagcaaaaatctaa

SEQ ID NO: 125576 - DNA, 20 bp, Artificial
  CRISPR gRNA sequence
ttaagtagcaaaaatctaat

SEQ ID NO: 125577 - DNA, 20 bp, Artificial
  CRISPR gRNA sequence
aagtagcaaaaatctaatag

SEQ ID NO: 125578 - DNA, 20 bp, Artificial
  CRISPR gRNA sequence
aaaaatctaataggagaaat

SEQ ID NO: 125579 - DNA, 20 bp, Artificial
  CRISPR gRNA sequence
aaaatctaataggagaaatg

SEQ ID NO: 125580 - DNA, 20 bp, Artificial
  CRISPR gRNA sequence
taaaaattctaaaaatgtgt

SEQ ID NO: 125581 - DNA, 20 bp, Artificial
  CRISPR gRNA sequence
aaaattctaaaaatgtgtaa

SEQ ID NO: 125582 - DNA, 20 bp, Artificial
  CRISPR gRNA sequence
tctaaaaatgtgtaagagaa

SEQ ID NO: 125583 - DNA, 20 bp, Artificial
  CRISPR gRNA sequence
ctaaaaatgtgtaagagaaa

SEQ ID NO: 125584 - DNA, 20 bp, Artificial
  CRISPR gRNA sequence
aatgtgtaagagaaaaggca

SEQ ID NO: 125585 - DNA, 20 bp, Artificial
  CRISPR gRNA sequence
tgtgtaagagaaaaggcata

SEQ ID NO: 125586 - DNA, 20 bp, Artificial
  CRISPR gRNA sequence
gtaagagaaaaggcatagag

SEQ ID NO: 125587 - DNA, 20 bp, Artificial
  CRISPR gRNA sequence
gaagcacttacattttatga

SEQ ID NO: 125588 - DNA, 20 bp, Artificial
  CRISPR gRNA sequence
acttacattttatgaaagaa

SEQ ID NO: 125589 - DNA, 20 bp, Artificial
  CRISPR gRNA sequence
gaaagaaaagatcatttttg

SEQ ID NO: 125590 - DNA, 20 bp, Artificial
  CRISPR gRNA sequence
aaagaaaagatcatttttga

SEQ ID NO: 125591 - DNA, 20 bp, Artificial
  CRISPR gRNA sequence
gaaaagatcatttttgaagg

SEQ ID NO: 125592 - DNA, 20 bp, Artificial
  CRISPR gRNA sequence
gatcatttttgaaggtggta

SEQ ID NO: 125593 - DNA, 20 bp, Artificial
  CRISPR gRNA sequence
tcatttttgaaggtggtatg

SEQ ID NO: 125594 - DNA, 20 bp, Artificial
  CRISPR gRNA sequence
gtggtatggagatgttattt

SEQ ID NO: 125595 - DNA, 20 bp, Artificial
  CRISPR gRNA sequence
gagatgttatttgagatttt

SEQ ID NO: 125596 - DNA, 20 bp, Artificial
  CRISPR gRNA sequence
gatgttatttgagatttttg

SEQ ID NO: 125597 - DNA, 20 bp, Artificial
  CRISPR gRNA sequence
tatttgagatttttggagaa

SEQ ID NO: 125598 - DNA, 20 bp, Artificial
  CRISPR gRNA sequence
atttgagatttttggagaat

SEQ ID NO: 125599 - DNA, 20 bp, Artificial
  CRISPR gRNA sequence
gagatttttggagaatgggc

SEQ ID NO: 125600 - DNA, 20 bp, Artificial
  CRISPR gRNA sequence
atttttggagaatgggcaag

SEQ ID NO: 125601 - DNA, 20 bp, Artificial
  CRISPR gRNA sequence
tttttggagaatgggcaagt

SEQ ID NO: 125602 - DNA, 20 bp, Artificial
  CRISPR gRNA sequence
agaatgggcaagtaggattt

SEQ ID NO: 125603 - DNA, 20 bp, Artificial
  CRISPR gRNA sequence
atgggcaagtaggattttag

SEQ ID NO: 125604 - DNA, 20 bp, Artificial
  CRISPR gRNA sequence
tgggcaagtaggattttagc

SEQ ID NO: 125605 - DNA, 20 bp, Artificial
  CRISPR gRNA sequence
ggattttagcaggtatattt

SEQ ID NO: 125606 - DNA, 20 bp, Artificial
  CRISPR gRNA sequence
gattttagcaggtatatttg

SEQ ID NO: 125607 - DNA, 20 bp, Artificial
  CRISPR gRNA sequence
caggtatatttgaggataaa

SEQ ID NO: 125608 - DNA, 20 bp, Artificial
  CRISPR gRNA sequence
tttgaggataaaaagtgttc

SEQ ID NO: 125609 - DNA, 20 bp, Artificial
  CRISPR gRNA sequence
ttgaggataaaaagtgttct

SEQ ID NO: 125610 - DNA, 20 bp, Artificial
  CRISPR gRNA sequence
aggataaaaagtgttctagg

SEQ ID NO: 125611 - DNA, 20 bp, Artificial
  CRISPR gRNA sequence
taaaaagtgttctaggcagt

SEQ ID NO: 125612 - DNA, 20 bp, Artificial
  CRISPR gRNA sequence
gtctgaaattaataaaaaaa

SEQ ID NO: 125613 - DNA, 20 bp, Artificial
  CRISPR gRNA sequence
aaattaataaaaaaaaagtt

SEQ ID NO: 125614 - DNA, 20 bp, Artificial
  CRISPR gRNA sequence
ataaaaaaaaagttcagttc

SEQ ID NO: 125615 - DNA, 20 bp, Artificial
  CRISPR gRNA sequence
ctggctctgtaaaaattatg

SEQ ID NO: 125616 - DNA, 20 bp, Artificial
  CRISPR gRNA sequence
ggctctgtaaaaattatgaa

SEQ ID NO: 125617 - DNA, 20 bp, Artificial
  CRISPR gRNA sequence
ctatcctaatccctaaataa

SEQ ID NO: 125618 - DNA, 20 bp, Artificial
  CRISPR gRNA sequence
ctaatccctaaataatggtt

SEQ ID NO: 125619 - DNA, 20 bp, Artificial
  CRISPR gRNA sequence
aatccctaaataatggttaa

SEQ ID NO: 125620 - DNA, 20 bp, Artificial
  CRISPR gRNA sequence
atccctaaataatggttaag

SEQ ID NO: 125621 - DNA, 20 bp, Artificial
  CRISPR gRNA sequence
ataatggttaagaggtgaac

SEQ ID NO: 125622 - DNA, 20 bp, Artificial
  CRISPR gRNA sequence
gaaccagaatgattttattc

SEQ ID NO: 125623 - DNA, 20 bp, Artificial
  CRISPR gRNA sequence
gattttattctggatcactt

SEQ ID NO: 125624 - DNA, 20 bp, Artificial
  CRISPR gRNA sequence
tttattctggatcactttgg

SEQ ID NO: 125625 - DNA, 20 bp, Artificial
  CRISPR gRNA sequence
tagttttttctatcttgaaa

SEQ ID NO: 125626 - DNA, 20 bp, Artificial
  CRISPR gRNA sequence
tatcttgaaatagaaataat

SEQ ID NO: 125627 - DNA, 20 bp, Artificial
  CRISPR gRNA sequence
cttgaaatagaaataataag

SEQ ID NO: 125628 - DNA, 20 bp, Artificial
  CRISPR gRNA sequence
cctaaatatttttatttctt

SEQ ID NO: 125629 - DNA, 20 bp, Artificial
  CRISPR gRNA sequence
tttttatttctttagatact

SEQ ID NO: 125630 - DNA, 20 bp, Artificial
  CRISPR gRNA sequence
ttttatttctttagatactg

SEQ ID NO: 125631 - DNA, 20 bp, Artificial
  CRISPR gRNA sequence
atttctttagatactgagga

SEQ ID NO: 125632 - DNA, 20 bp, Artificial
  CRISPR gRNA sequence
ggacagcatgaatgatcatg

SEQ ID NO: 125633 - DNA, 20 bp, Artificial
  CRISPR gRNA sequence
aatgatcatgaagacacaaa

SEQ ID NO: 125634 - DNA, 20 bp, Artificial
  CRISPR gRNA sequence
tgaagacacaaatggttcaa

SEQ ID NO: 125635 - DNA, 20 bp, Artificial
  CRISPR gRNA sequence
gacacaaatggttcaaaaga

SEQ ID NO: 125636 - DNA, 20 bp, Artificial
  CRISPR gRNA sequence
aatggttcaaaagaaagttt

SEQ ID NO: 125637 - DNA, 20 bp, Artificial
  CRISPR gRNA sequence
tggttcaaaagaaagtttca

SEQ ID NO: 125638 - DNA, 20 bp, Artificial
  CRISPR gRNA sequence
aaaagaaagtttcagagaac

SEQ ID NO: 125639 - DNA, 20 bp, Artificial
  CRISPR gRNA sequence
acaagatatatatcttccaa

SEQ ID NO: 125640 - DNA, 20 bp, Artificial
  CRISPR gRNA sequence
atatcttccaatagcaaacg

SEQ ID NO: 125641 - DNA, 20 bp, Artificial
  CRISPR gRNA sequence
cttccaatagcaaacgtggc

SEQ ID NO: 125642 - DNA, 20 bp, Artificial
  CRISPR gRNA sequence
ttccaatagcaaacgtggct

SEQ ID NO: 125643 - DNA, 20 bp, Artificial
  CRISPR gRNA sequence
gaaaaatgccatacctcaaa

SEQ ID NO: 125644 - DNA, 20 bp, Artificial
  CRISPR gRNA sequence
aaaaatgccatacctcaaac

SEQ ID NO: 125645 - DNA, 20 bp, Artificial
  CRISPR gRNA sequence
atgccatacctcaaacggga

SEQ ID NO: 125646 - DNA, 20 bp, Artificial
  CRISPR gRNA sequence
tgccatacctcaaacgggaa

SEQ ID NO: 125647 - DNA, 20 bp, Artificial
  CRISPR gRNA sequence
ctcaaacgggaaaggtaacg

SEQ ID NO: 125648 - DNA, 20 bp, Artificial
  CRISPR gRNA sequence
caaacgggaaaggtaacgta

SEQ ID NO: 125649 - DNA, 20 bp, Artificial
  CRISPR gRNA sequence
aaacgggaaaggtaacgtag

SEQ ID NO: 125650 - DNA, 20 bp, Artificial
  CRISPR gRNA sequence
acgggaaaggtaacgtagag

SEQ ID NO: 125651 - DNA, 20 bp, Artificial
  CRISPR gRNA sequence
acgtagaggagaaatttaac

SEQ ID NO: 125652 - DNA, 20 bp, Artificial
  CRISPR gRNA sequence
cgtagaggagaaatttaact

SEQ ID NO: 125653 - DNA, 20 bp, Artificial
  CRISPR gRNA sequence
aaatttaactaggttttttc

SEQ ID NO: 125654 - DNA, 20 bp, Artificial
  CRISPR gRNA sequence
aatttaactaggttttttca

SEQ ID NO: 125655 - DNA, 20 bp, Artificial
  CRISPR gRNA sequence
atttaactaggttttttcaa

SEQ ID NO: 125656 - DNA, 20 bp, Artificial
  CRISPR gRNA sequence
cacgaaactacatgaattca

SEQ ID NO: 125657 - DNA, 20 bp, Artificial
  CRISPR gRNA sequence
acgaaactacatgaattcat

SEQ ID NO: 125658 - DNA, 20 bp, Artificial
  CRISPR gRNA sequence
ctacatgaattcataggtca

SEQ ID NO: 125659 - DNA, 20 bp, Artificial
  CRISPR gRNA sequence
tacatgaattcataggtcat

SEQ ID NO: 125660 - DNA, 20 bp, Artificial
  CRISPR gRNA sequence
gaattcataggtcatgggta

SEQ ID NO: 125661 - DNA, 20 bp, Artificial
  CRISPR gRNA sequence
tcataggtcatgggtacagt

SEQ ID NO: 125662 - DNA, 20 bp, Artificial
  CRISPR gRNA sequence
agctgttgatttcaatcatt

SEQ ID NO: 125663 - DNA, 20 bp, Artificial
  CRISPR gRNA sequence
gctgttgatttcaatcattc

SEQ ID NO: 125664 - DNA, 20 bp, Artificial
  CRISPR gRNA sequence
atttcaatcattcaggcttt

SEQ ID NO: 125665 - DNA, 20 bp, Artificial
  CRISPR gRNA sequence
ttctttcatgtctacataca

SEQ ID NO: 125666 - DNA, 20 bp, Artificial
  CRISPR gRNA sequence
ctacatacacagttactgaa

SEQ ID NO: 125667 - DNA, 20 bp, Artificial
  CRISPR gRNA sequence
ttctcctctctcccacttat

SEQ ID NO: 125668 - DNA, 20 bp, Artificial
  CRISPR gRNA sequence
ctcctctctcccacttattg

SEQ ID NO: 125669 - DNA, 20 bp, Artificial
  CRISPR gRNA sequence
tcctctctcccacttattgg

SEQ ID NO: 125670 - DNA, 20 bp, Artificial
  CRISPR gRNA sequence
tctctcccacttattggagg

SEQ ID NO: 125671 - DNA, 20 bp, Artificial
  CRISPR gRNA sequence
cttattggaggcagataaaa

SEQ ID NO: 125672 - DNA, 20 bp, Artificial
  CRISPR gRNA sequence
gaggcagataaaatagaatt

SEQ ID NO: 125673 - DNA, 20 bp, Artificial
  CRISPR gRNA sequence
tttttttttttttttttttt

SEQ ID NO: 125674 - DNA, 20 bp, Artificial
  CRISPR gRNA sequence
tttttttttttttttttttt

SEQ ID NO: 125675 - DNA, 20 bp, Artificial
  CRISPR gRNA sequence
tttttttttttttttttttg

SEQ ID NO: 125676 - DNA, 20 bp, Artificial
  CRISPR gRNA sequence
tttttttttttttttgggga

SEQ ID NO: 125677 - DNA, 20 bp, Artificial
  CRISPR gRNA sequence
tttttttttttttggggaca

SEQ ID NO: 125678 - DNA, 20 bp, Artificial
  CRISPR gRNA sequence
ggacagagtttcactcttat

SEQ ID NO: 125679 - DNA, 20 bp, Artificial
  CRISPR gRNA sequence
agagtttcactcttattggc

SEQ ID NO: 125680 - DNA, 20 bp, Artificial
  CRISPR gRNA sequence
gagtttcactcttattggcc

SEQ ID NO: 125681 - DNA, 20 bp, Artificial
  CRISPR gRNA sequence
ttcactcttattggccaggc

SEQ ID NO: 125682 - DNA, 20 bp, Artificial
  CRISPR gRNA sequence
cactcttattggccaggctg

SEQ ID NO: 125683 - DNA, 20 bp, Artificial
  CRISPR gRNA sequence
ttggccaggctggagtgcaa

SEQ ID NO: 125684 - DNA, 20 bp, Artificial
  CRISPR gRNA sequence
tcactgcaacctccgcctcc

SEQ ID NO: 125685 - DNA, 20 bp, Artificial
  CRISPR gRNA sequence
cactgcaacctccgcctccc

SEQ ID NO: 125686 - DNA, 20 bp, Artificial
  CRISPR gRNA sequence
aacctccgcctcccaggttc

SEQ ID NO: 125687 - DNA, 20 bp, Artificial
  CRISPR gRNA sequence
ttcaagcaattctcctgcct

SEQ ID NO: 125688 - DNA, 20 bp, Artificial
  CRISPR gRNA sequence
ttctcctgcctcagcctccc

SEQ ID NO: 125689 - DNA, 20 bp, Artificial
  CRISPR gRNA sequence
tcctgcctcagcctcccgag

SEQ ID NO: 125690 - DNA, 20 bp, Artificial
  CRISPR gRNA sequence
gcctcagcctcccgagtagc

SEQ ID NO: 125691 - DNA, 20 bp, Artificial
  CRISPR gRNA sequence
cctcagcctcccgagtagct

SEQ ID NO: 125692 - DNA, 20 bp, Artificial
  CRISPR gRNA sequence
ctcccgagtagctgggatta

SEQ ID NO: 125693 - DNA, 20 bp, Artificial
  CRISPR gRNA sequence
tcccgagtagctgggattac

SEQ ID NO: 125694 - DNA, 20 bp, Artificial
  CRISPR gRNA sequence
caggcgtgcaccaccatgcc

SEQ ID NO: 125695 - DNA, 20 bp, Artificial
  CRISPR gRNA sequence
cccagctaattttgtatttt

SEQ ID NO: 125696 - DNA, 20 bp, Artificial
  CRISPR gRNA sequence
agctaattttgtatttttgg

SEQ ID NO: 125697 - DNA, 20 bp, Artificial
  CRISPR gRNA sequence
ttttgtatttttggtagaaa

SEQ ID NO: 125698 - DNA, 20 bp, Artificial
  CRISPR gRNA sequence
tttgtatttttggtagaaat

SEQ ID NO: 125699 - DNA, 20 bp, Artificial
  CRISPR gRNA sequence
ttgtatttttggtagaaatg

SEQ ID NO: 125700 - DNA, 20 bp, Artificial
  CRISPR gRNA sequence
gaaatggggtttctccatgt

SEQ ID NO: 125701 - DNA, 20 bp, Artificial
  CRISPR gRNA sequence
tggggtttctccatgttggt

SEQ ID NO: 125702 - DNA, 20 bp, Artificial
  CRISPR gRNA sequence
ggggtttctccatgttggtc

SEQ ID NO: 125703 - DNA, 20 bp, Artificial
  CRISPR gRNA sequence
tttctccatgttggtcaggc

SEQ ID NO: 125704 - DNA, 20 bp, Artificial
  CRISPR gRNA sequence
tggtcttgaactctcgacct

SEQ ID NO: 125705 - DNA, 20 bp, Artificial
  CRISPR gRNA sequence
ggtcttgaactctcgacctc

SEQ ID NO: 125706 - DNA, 20 bp, Artificial
  CRISPR gRNA sequence
ctcaggtgatccatccgcct

SEQ ID NO: 125707 - DNA, 20 bp, Artificial
  CRISPR gRNA sequence
ccatccgccttggcctacca

SEQ ID NO: 125708 - DNA, 20 bp, Artificial
  CRISPR gRNA sequence
gccttggcctaccaaagtgc

SEQ ID NO: 125709 - DNA, 20 bp, Artificial
  CRISPR gRNA sequence
ccttggcctaccaaagtgct

SEQ ID NO: 125710 - DNA, 20 bp, Artificial
  CRISPR gRNA sequence
ctaccaaagtgctgggatta

SEQ ID NO: 125711 - DNA, 20 bp, Artificial
  CRISPR gRNA sequence
agtgctgggattatagacat

SEQ ID NO: 125712 - DNA, 20 bp, Artificial
  CRISPR gRNA sequence
tagacatgagccactgtgcc

SEQ ID NO: 125713 - DNA, 20 bp, Artificial
  CRISPR gRNA sequence
ggcccgactgttttaaaaaa

SEQ ID NO: 125714 - DNA, 20 bp, Artificial
  CRISPR gRNA sequence
gcccgactgttttaaaaaat

SEQ ID NO: 125715 - DNA, 20 bp, Artificial
  CRISPR gRNA sequence
ttaaaaaataggtacgttgt

SEQ ID NO: 125716 - DNA, 20 bp, Artificial
  CRISPR gRNA sequence
aggtacgttgtcagaactat

SEQ ID NO: 125717 - DNA, 20 bp, Artificial
  CRISPR gRNA sequence
ggtacgttgtcagaactatc

SEQ ID NO: 125718 - DNA, 20 bp, Artificial
  CRISPR gRNA sequence
gttgtcagaactatcaggtt

SEQ ID NO: 125719 - DNA, 20 bp, Artificial
  CRISPR gRNA sequence
ttgtcagaactatcaggttt

SEQ ID NO: 125720 - DNA, 20 bp, Artificial
  CRISPR gRNA sequence
ctatcaggtttgggtgtatg

SEQ ID NO: 125721 - DNA, 20 bp, Artificial
  CRISPR gRNA sequence
taactttttttttttttttt

SEQ ID NO: 125722 - DNA, 20 bp, Artificial
  CRISPR gRNA sequence
ttttttttttttttttgaga

SEQ ID NO: 125723 - DNA, 20 bp, Artificial
  CRISPR gRNA sequence
ttttttttttttttgagacg

SEQ ID NO: 125724 - DNA, 20 bp, Artificial
  CRISPR gRNA sequence
ggagtttcgctcttgttgcc

SEQ ID NO: 125725 - DNA, 20 bp, Artificial
  CRISPR gRNA sequence
gagtttcgctcttgttgccc

SEQ ID NO: 125726 - DNA, 20 bp, Artificial
  CRISPR gRNA sequence
ttcgctcttgttgcccaggc

SEQ ID NO: 125727 - DNA, 20 bp, Artificial
  CRISPR gRNA sequence
cgctcttgttgcccaggctg

SEQ ID NO: 125728 - DNA, 20 bp, Artificial
  CRISPR gRNA sequence
ttgttgcccaggctggagtg

SEQ ID NO: 125729 - DNA, 20 bp, Artificial
  CRISPR gRNA sequence
ttgcccaggctggagtgcag

SEQ ID NO: 125730 - DNA, 20 bp, Artificial
  CRISPR gRNA sequence
ggagtgcagtggcgtgatct

SEQ ID NO: 125731 - DNA, 20 bp, Artificial
  CRISPR gRNA sequence
tcattgcaacctccacctcc

SEQ ID NO: 125732 - DNA, 20 bp, Artificial
  CRISPR gRNA sequence
cattgcaacctccacctccc

SEQ ID NO: 125733 - DNA, 20 bp, Artificial
  CRISPR gRNA sequence
aacctccacctcccaggttc

SEQ ID NO: 125734 - DNA, 20 bp, Artificial
  CRISPR gRNA sequence
ttcaagcgattctcctgcct

SEQ ID NO: 125735 - DNA, 20 bp, Artificial
  CRISPR gRNA sequence
tctcctgcctcagcctcccc

SEQ ID NO: 125736 - DNA, 20 bp, Artificial
  CRISPR gRNA sequence
cctgcctcagcctcccctgg

SEQ ID NO: 125737 - DNA, 20 bp, Artificial
  CRISPR gRNA sequence
cctcagcctcccctggtagc

SEQ ID NO: 125738 - DNA, 20 bp, Artificial
  CRISPR gRNA sequence
ctcagcctcccctggtagct

SEQ ID NO: 125739 - DNA, 20 bp, Artificial
  CRISPR gRNA sequence
tcccctggtagctgggatta

SEQ ID NO: 125740 - DNA, 20 bp, Artificial
  CRISPR gRNA sequence
cccctggtagctgggattac

SEQ ID NO: 125741 - DNA, 20 bp, Artificial
  CRISPR gRNA sequence
gtagctgggattacaggcac

SEQ ID NO: 125742 - DNA, 20 bp, Artificial
  CRISPR gRNA sequence
caggcacgagccactgtgcc

SEQ ID NO: 125743 - DNA, 20 bp, Artificial
  CRISPR gRNA sequence
gagccactgtgcccggcctg

SEQ ID NO: 125744 - DNA, 20 bp, Artificial
  CRISPR gRNA sequence
agctgtaacttctcccatcc

SEQ ID NO: 125745 - DNA, 20 bp, Artificial
  CRISPR gRNA sequence
tctcccatccaagtactaac

SEQ ID NO: 125746 - DNA, 20 bp, Artificial
  CRISPR gRNA sequence
ctcccatccaagtactaacc

SEQ ID NO: 125747 - DNA, 20 bp, Artificial
  CRISPR gRNA sequence
taaccaggcccgaccctgct

SEQ ID NO: 125748 - DNA, 20 bp, Artificial
  CRISPR gRNA sequence
cccgaccctgcttagcttcc

SEQ ID NO: 125749 - DNA, 20 bp, Artificial
  CRISPR gRNA sequence
ccctgcttagcttccgagat

SEQ ID NO: 125750 - DNA, 20 bp, Artificial
  CRISPR gRNA sequence
cttagcttccgagatcagac

SEQ ID NO: 125751 - DNA, 20 bp, Artificial
  CRISPR gRNA sequence
cttccgagatcagacgagat

SEQ ID NO: 125752 - DNA, 20 bp, Artificial
  CRISPR gRNA sequence
ttccgagatcagacgagatc

SEQ ID NO: 125753 - DNA, 20 bp, Artificial
  CRISPR gRNA sequence
cagacgagatcgggcgcgtt

SEQ ID NO: 125754 - DNA, 20 bp, Artificial
  CRISPR gRNA sequence
agacgagatcgggcgcgttc

SEQ ID NO: 125755 - DNA, 20 bp, Artificial
  CRISPR gRNA sequence
gacgagatcgggcgcgttca

SEQ ID NO: 125756 - DNA, 20 bp, Artificial
  CRISPR gRNA sequence
gagatcgggcgcgttcaggg

SEQ ID NO: 125757 - DNA, 20 bp, Artificial
  CRISPR gRNA sequence
cgggcgcgttcagggtggta

SEQ ID NO: 125758 - DNA, 20 bp, Artificial
  CRISPR gRNA sequence
cgttcagggtggtatggccg

SEQ ID NO: 125759 - DNA, 20 bp, Artificial
  CRISPR gRNA sequence
ggtggtatggccgtagactg

SEQ ID NO: 125760 - DNA, 20 bp, Artificial
  CRISPR gRNA sequence
ctgtaacttctataatgttg

SEQ ID NO: 125761 - DNA, 20 bp, Artificial
  CRISPR gRNA sequence
ctataatgttgcagtaaatt

SEQ ID NO: 125762 - DNA, 20 bp, Artificial
  CRISPR gRNA sequence
tataatgttgcagtaaattt

SEQ ID NO: 125763 - DNA, 20 bp, Artificial
  CRISPR gRNA sequence
gcagtaaatttaggtcgtat

SEQ ID NO: 125764 - DNA, 20 bp, Artificial
  CRISPR gRNA sequence
taggtcgtattggtctgata

SEQ ID NO: 125765 - DNA, 20 bp, Artificial
  CRISPR gRNA sequence
aggtcgtattggtctgatat

SEQ ID NO: 125766 - DNA, 20 bp, Artificial
  CRISPR gRNA sequence
tggtctgatataggtgtaat

SEQ ID NO: 125767 - DNA, 20 bp, Artificial
  CRISPR gRNA sequence
gaattttccaaaacaaatcc

SEQ ID NO: 125768 - DNA, 20 bp, Artificial
  CRISPR gRNA sequence
ccaaaacaaatcctggtatt

SEQ ID NO: 125769 - DNA, 20 bp, Artificial
  CRISPR gRNA sequence
caaatcctggtatttggaaa

SEQ ID NO: 125770 - DNA, 20 bp, Artificial
  CRISPR gRNA sequence
cagctatttttacataatta

SEQ ID NO: 125771 - DNA, 20 bp, Artificial
  CRISPR gRNA sequence
tttacataattatagatact

SEQ ID NO: 125772 - DNA, 20 bp, Artificial
  CRISPR gRNA sequence
aattgatatttttttttctt

SEQ ID NO: 125773 - DNA, 20 bp, Artificial
  CRISPR gRNA sequence
tgatatttttttttcttaag

SEQ ID NO: 125774 - DNA, 20 bp, Artificial
  CRISPR gRNA sequence
cttaagtagttttgtcttct

SEQ ID NO: 125775 - DNA, 20 bp, Artificial
  CRISPR gRNA sequence
cattgtcattgctcatcact

SEQ ID NO: 125776 - DNA, 20 bp, Artificial
  CRISPR gRNA sequence
cgttttatatcattttctat

SEQ ID NO: 125777 - DNA, 20 bp, Artificial
  CRISPR gRNA sequence
gtaatttttctgtcatttta

SEQ ID NO: 125778 - DNA, 20 bp, Artificial
  CRISPR gRNA sequence
ctgtcattttatagtttaaa

SEQ ID NO: 125779 - DNA, 20 bp, Artificial
  CRISPR gRNA sequence
ttatagtttaaaaagactta

SEQ ID NO: 125780 - DNA, 20 bp, Artificial
  CRISPR gRNA sequence
tagtttaaaaagacttatgg

SEQ ID NO: 125781 - DNA, 20 bp, Artificial
  CRISPR gRNA sequence
aaagacttatggaagtaata

SEQ ID NO: 125782 - DNA, 20 bp, Artificial
  CRISPR gRNA sequence
tgctattaaaatacatcact

SEQ ID NO: 125783 - DNA, 20 bp, Artificial
  CRISPR gRNA sequence
ttaaaatacatcactaagct

SEQ ID NO: 125784 - DNA, 20 bp, Artificial
  CRISPR gRNA sequence
atcactaagcttagaactta

SEQ ID NO: 125785 - DNA, 20 bp, Artificial
  CRISPR gRNA sequence
aagcttagaacttacagttt

SEQ ID NO: 125786 - DNA, 20 bp, Artificial
  CRISPR gRNA sequence
gaattttgtccttatgtttt

SEQ ID NO: 125787 - DNA, 20 bp, Artificial
  CRISPR gRNA sequence
aattttgtccttatgtttta

SEQ ID NO: 125788 - DNA, 20 bp, Artificial
  CRISPR gRNA sequence
cttatgttttaaggaaaaaa

SEQ ID NO: 125789 - DNA, 20 bp, Artificial
  CRISPR gRNA sequence
aatgctgattattgcttaca

SEQ ID NO: 125790 - DNA, 20 bp, Artificial
  CRISPR gRNA sequence
atgctgattattgcttacat

SEQ ID NO: 125791 - DNA, 20 bp, Artificial
  CRISPR gRNA sequence
ttacataggctatgtatgac

SEQ ID NO: 125792 - DNA, 20 bp, Artificial
  CRISPR gRNA sequence
tgtatgaccagctatgccgc

SEQ ID NO: 125793 - DNA, 20 bp, Artificial
  CRISPR gRNA sequence
tgaccagctatgccgctggt

SEQ ID NO: 125794 - DNA, 20 bp, Artificial
  CRISPR gRNA sequence
tatgccgctggtcagtacca

SEQ ID NO: 125795 - DNA, 20 bp, Artificial
  CRISPR gRNA sequence
ctggtcagtaccatagccac

SEQ ID NO: 125796 - DNA, 20 bp, Artificial
  CRISPR gRNA sequence
atagccacaagccatgtgct

SEQ ID NO: 125797 - DNA, 20 bp, Artificial
  CRISPR gRNA sequence
tagccacaagccatgtgctc

SEQ ID NO: 125798 - DNA, 20 bp, Artificial
  CRISPR gRNA sequence
gccacaagccatgtgctcag

SEQ ID NO: 125799 - DNA, 20 bp, Artificial
  CRISPR gRNA sequence
gctcaggagcacctgaaatg

SEQ ID NO: 125800 - DNA, 20 bp, Artificial
  CRISPR gRNA sequence
aggagcacctgaaatgtggc

SEQ ID NO: 125801 - DNA, 20 bp, Artificial
  CRISPR gRNA sequence
tgaaatgtggctggtctgaa

SEQ ID NO: 125802 - DNA, 20 bp, Artificial
  CRISPR gRNA sequence
aaatgtggctggtctgaatg

SEQ ID NO: 125803 - DNA, 20 bp, Artificial
  CRISPR gRNA sequence
gtgttgtaaatttgaaacac

SEQ ID NO: 125804 - DNA, 20 bp, Artificial
  CRISPR gRNA sequence
atttgaaacaccagattttg

SEQ ID NO: 125805 - DNA, 20 bp, Artificial
  CRISPR gRNA sequence
aacaccagattttgaagact

SEQ ID NO: 125806 - DNA, 20 bp, Artificial
  CRISPR gRNA sequence
gattttgaagacttagtatg

SEQ ID NO: 125807 - DNA, 20 bp, Artificial
  CRISPR gRNA sequence
tgaagacttagtatgaagaa

SEQ ID NO: 125808 - DNA, 20 bp, Artificial
  CRISPR gRNA sequence
aaattgattctatgtttaaa

SEQ ID NO: 125809 - DNA, 20 bp, Artificial
  CRISPR gRNA sequence
tgattctatgtttaaatggt

SEQ ID NO: 125810 - DNA, 20 bp, Artificial
  CRISPR gRNA sequence
atgtttaaatggtaagaatt

SEQ ID NO: 125811 - DNA, 20 bp, Artificial
  CRISPR gRNA sequence
tggtaagaatttggctatat

SEQ ID NO: 125812 - DNA, 20 bp, Artificial
  CRISPR gRNA sequence
ggtaagaatttggctatatt

SEQ ID NO: 125813 - DNA, 20 bp, Artificial
  CRISPR gRNA sequence
taattttattttattttata

SEQ ID NO: 125814 - DNA, 20 bp, Artificial
  CRISPR gRNA sequence
attttattttatatggctac

SEQ ID NO: 125815 - DNA, 20 bp, Artificial
  CRISPR gRNA sequence
tttattttatatggctacta

SEQ ID NO: 125816 - DNA, 20 bp, Artificial
  CRISPR gRNA sequence
agaatctaaactgacatatg

SEQ ID NO: 125817 - DNA, 20 bp, Artificial
  CRISPR gRNA sequence
cttgcttgactgcatttatg

SEQ ID NO: 125818 - DNA, 20 bp, Artificial
  CRISPR gRNA sequence
cagttcttgtttactttctc

SEQ ID NO: 125819 - DNA, 20 bp, Artificial
  CRISPR gRNA sequence
cttgtttactttctccagta

SEQ ID NO: 125820 - DNA, 20 bp, Artificial
  CRISPR gRNA sequence
actttctccagtatggaaaa

SEQ ID NO: 125821 - DNA, 20 bp, Artificial
  CRISPR gRNA sequence
ctttctccagtatggaaaat

SEQ ID NO: 125822 - DNA, 20 bp, Artificial
  CRISPR gRNA sequence
tccagtatggaaaataggca

SEQ ID NO: 125823 - DNA, 20 bp, Artificial
  CRISPR gRNA sequence
agtatggaaaataggcatgg

SEQ ID NO: 125824 - DNA, 20 bp, Artificial
  CRISPR gRNA sequence
gaaaataggcatggcggtga

SEQ ID NO: 125825 - DNA, 20 bp, Artificial
  CRISPR gRNA sequence
ataggcatggcggtgaaaga

SEQ ID NO: 125826 - DNA, 20 bp, Artificial
  CRISPR gRNA sequence
cggtgaaagacagtgtgttt

SEQ ID NO: 125827 - DNA, 20 bp, Artificial
  CRISPR gRNA sequence
tgaaagacagtgtgtttcgg

SEQ ID NO: 125828 - DNA, 20 bp, Artificial
  CRISPR gRNA sequence
gaaagacagtgtgtttcggc

SEQ ID NO: 125829 - DNA, 20 bp, Artificial
  CRISPR gRNA sequence
aaagacagtgtgtttcggca

SEQ ID NO: 125830 - DNA, 20 bp, Artificial
  CRISPR gRNA sequence
agacagtgtgtttcggcagg

SEQ ID NO: 125831 - DNA, 20 bp, Artificial
  CRISPR gRNA sequence
tgtgtttcggcagggagttt

SEQ ID NO: 125832 - DNA, 20 bp, Artificial
  CRISPR gRNA sequence
gtttcggcagggagtttgag

SEQ ID NO: 125833 - DNA, 20 bp, Artificial
  CRISPR gRNA sequence
ttgagtggtattgctgttac

SEQ ID NO: 125834 - DNA, 20 bp, Artificial
  CRISPR gRNA sequence
agtggtattgctgttacaag

SEQ ID NO: 125835 - DNA, 20 bp, Artificial
  CRISPR gRNA sequence
caattgcttgattaatccat

SEQ ID NO: 125836 - DNA, 20 bp, Artificial
  CRISPR gRNA sequence
attgcttgattaatccattg

SEQ ID NO: 125837 - DNA, 20 bp, Artificial
  CRISPR gRNA sequence
atccattggagtttcatttt

SEQ ID NO: 125838 - DNA, 20 bp, Artificial
  CRISPR gRNA sequence
ggagtttcatttttagaccc

SEQ ID NO: 125839 - DNA, 20 bp, Artificial
  CRISPR gRNA sequence
tttttagaccccagaccctt

SEQ ID NO: 125840 - DNA, 20 bp, Artificial
  CRISPR gRNA sequence
ttttagaccccagaccctta

SEQ ID NO: 125841 - DNA, 20 bp, Artificial
  CRISPR gRNA sequence
tttagaccccagacccttaa

SEQ ID NO: 125842 - DNA, 20 bp, Artificial
  CRISPR gRNA sequence
gaaaaattgtttttataatg

SEQ ID NO: 125843 - DNA, 20 bp, Artificial
  CRISPR gRNA sequence
aaattgtttttataatgaag

SEQ ID NO: 125844 - DNA, 20 bp, Artificial
  CRISPR gRNA sequence
ttgtttttataatgaagtgg

SEQ ID NO: 125845 - DNA, 20 bp, Artificial
  CRISPR gRNA sequence
gtggcagatgtgtgcttctt

SEQ ID NO: 125846 - DNA, 20 bp, Artificial
  CRISPR gRNA sequence
tggcagatgtgtgcttcttt

SEQ ID NO: 125847 - DNA, 20 bp, Artificial
  CRISPR gRNA sequence
cagatgtgtgcttctttagg

SEQ ID NO: 125848 - DNA, 20 bp, Artificial
  CRISPR gRNA sequence
agatgtgtgcttctttaggc

SEQ ID NO: 125849 - DNA, 20 bp, Artificial
  CRISPR gRNA sequence
gcttctttaggcaggctttt

SEQ ID NO: 125850 - DNA, 20 bp, Artificial
  CRISPR gRNA sequence
gtgtatcccaaataataaaa

SEQ ID NO: 125851 - DNA, 20 bp, Artificial
  CRISPR gRNA sequence
cccaaataataaaaaagtca

SEQ ID NO: 125852 - DNA, 20 bp, Artificial
  CRISPR gRNA sequence
ttatcatttctctcttttcc

SEQ ID NO: 125853 - DNA, 20 bp, Artificial
  CRISPR gRNA sequence
ttccaagccttatgtgaatt

SEQ ID NO: 125854 - DNA, 20 bp, Artificial
  CRISPR gRNA sequence
cttatgtgaattcagttttt

SEQ ID NO: 125855 - DNA, 20 bp, Artificial
  CRISPR gRNA sequence
ctgttttgctttttgttttc

SEQ ID NO: 125856 - DNA, 20 bp, Artificial
  CRISPR gRNA sequence
ttttctggtgtctttattca

SEQ ID NO: 125857 - DNA, 20 bp, Artificial
  CRISPR gRNA sequence
gtctttattcatggaaatgc

SEQ ID NO: 125858 - DNA, 20 bp, Artificial
  CRISPR gRNA sequence
tctttattcatggaaatgct

SEQ ID NO: 125859 - DNA, 20 bp, Artificial
  CRISPR gRNA sequence
ctttattcatggaaatgcta

SEQ ID NO: 125860 - DNA, 20 bp, Artificial
  CRISPR gRNA sequence
tattcatggaaatgctaggg

SEQ ID NO: 125861 - DNA, 20 bp, Artificial
  CRISPR gRNA sequence
ttcatggaaatgctagggca

SEQ ID NO: 125862 - DNA, 20 bp, Artificial
  CRISPR gRNA sequence
atggaaatgctagggcagag

SEQ ID NO: 125863 - DNA, 20 bp, Artificial
  CRISPR gRNA sequence
gaaatgctagggcagagaag

SEQ ID NO: 125864 - DNA, 20 bp, Artificial
  CRISPR gRNA sequence
tgtcgcccacaaaatatgca

SEQ ID NO: 125865 - DNA, 20 bp, Artificial
  CRISPR gRNA sequence
cgcccacaaaatatgcatgg

SEQ ID NO: 125866 - DNA, 20 bp, Artificial
  CRISPR gRNA sequence
acaaaatatgcatggtggaa

SEQ ID NO: 125867 - DNA, 20 bp, Artificial
  CRISPR gRNA sequence
gcatggtggaatggattttc

SEQ ID NO: 125868 - DNA, 20 bp, Artificial
  CRISPR gRNA sequence
catggtggaatggattttcc

SEQ ID NO: 125869 - DNA, 20 bp, Artificial
  CRISPR gRNA sequence
atggtggaatggattttcca

SEQ ID NO: 125870 - DNA, 20 bp, Artificial
  CRISPR gRNA sequence
tggtggaatggattttccag

SEQ ID NO: 125871 - DNA, 20 bp, Artificial
  CRISPR gRNA sequence
aatggattttccaggggcac

SEQ ID NO: 125872 - DNA, 20 bp, Artificial
  CRISPR gRNA sequence
atggattttccaggggcact

SEQ ID NO: 125873 - DNA, 20 bp, Artificial
  CRISPR gRNA sequence
tccaggggcactgggttatt

SEQ ID NO: 125874 - DNA, 20 bp, Artificial
  CRISPR gRNA sequence
caggggcactgggttattaa

SEQ ID NO: 125875 - DNA, 20 bp, Artificial
  CRISPR gRNA sequence
ttaagagttttcatcctctg

SEQ ID NO: 125876 - DNA, 20 bp, Artificial
  CRISPR gRNA sequence
taagagttttcatcctctgt

SEQ ID NO: 125877 - DNA, 20 bp, Artificial
  CRISPR gRNA sequence
aagagttttcatcctctgtg

SEQ ID NO: 125878 - DNA, 20 bp, Artificial
  CRISPR gRNA sequence
agttttcatcctctgtgggg

SEQ ID NO: 125879 - DNA, 20 bp, Artificial
  CRISPR gRNA sequence
tttcatcctctgtggggtgg

SEQ ID NO: 125880 - DNA, 20 bp, Artificial
  CRISPR gRNA sequence
ttcatcctctgtggggtggt

SEQ ID NO: 125881 - DNA, 20 bp, Artificial
  CRISPR gRNA sequence
tgtggggtggtaggaacatc

SEQ ID NO: 125882 - DNA, 20 bp, Artificial
  CRISPR gRNA sequence
atttttttaatttttttttt

SEQ ID NO: 125883 - DNA, 20 bp, Artificial
  CRISPR gRNA sequence
ttttaattttttttttgaga

SEQ ID NO: 125884 - DNA, 20 bp, Artificial
  CRISPR gRNA sequence
ttaattttttttttgagacg

SEQ ID NO: 125885 - DNA, 20 bp, Artificial
  CRISPR gRNA sequence
ggagtctcgctctttttgcc

SEQ ID NO: 125886 - DNA, 20 bp, Artificial
  CRISPR gRNA sequence
gagtctcgctctttttgccc

SEQ ID NO: 125887 - DNA, 20 bp, Artificial
  CRISPR gRNA sequence
tcgctctttttgcccaggcc

SEQ ID NO: 125888 - DNA, 20 bp, Artificial
  CRISPR gRNA sequence
gctctttttgcccaggcctg

SEQ ID NO: 125889 - DNA, 20 bp, Artificial
  CRISPR gRNA sequence
ttttgcccaggcctggagta

SEQ ID NO: 125890 - DNA, 20 bp, Artificial
  CRISPR gRNA sequence
tgcccaggcctggagtacag

SEQ ID NO: 125891 - DNA, 20 bp, Artificial
  CRISPR gRNA sequence
ggagtacagtggctcaatct

SEQ ID NO: 125892 - DNA, 20 bp, Artificial
  CRISPR gRNA sequence
tcactgcaacctccgcctcc

SEQ ID NO: 125893 - DNA, 20 bp, Artificial
  CRISPR gRNA sequence
cactgcaacctccgcctcct

SEQ ID NO: 125894 - DNA, 20 bp, Artificial
  CRISPR gRNA sequence
aacctccgcctcctgggttc

SEQ ID NO: 125895 - DNA, 20 bp, Artificial
  CRISPR gRNA sequence
ttctcctgcctcatcctcct

SEQ ID NO: 125896 - DNA, 20 bp, Artificial
  CRISPR gRNA sequence
tcctgcctcatcctcctgag

SEQ ID NO: 125897 - DNA, 20 bp, Artificial
  CRISPR gRNA sequence
tgcctcatcctcctgagtag

SEQ ID NO: 125898 - DNA, 20 bp, Artificial
  CRISPR gRNA sequence
ctcctgagtagcagcaatta

SEQ ID NO: 125899 - DNA, 20 bp, Artificial
  CRISPR gRNA sequence
tcctgagtagcagcaattac

SEQ ID NO: 125900 - DNA, 20 bp, Artificial
  CRISPR gRNA sequence
caggcacctgccaccacgcc

SEQ ID NO: 125901 - DNA, 20 bp, Artificial
  CRISPR gRNA sequence
cagctaattttttgtacttt

SEQ ID NO: 125902 - DNA, 20 bp, Artificial
  CRISPR gRNA sequence
ctaattttttgtacttttag

SEQ ID NO: 125903 - DNA, 20 bp, Artificial
  CRISPR gRNA sequence
aattttttgtacttttagta

SEQ ID NO: 125904 - DNA, 20 bp, Artificial
  CRISPR gRNA sequence
ttttgtacttttagtagaga

SEQ ID NO: 125905 - DNA, 20 bp, Artificial
  CRISPR gRNA sequence
tttgtacttttagtagagat

SEQ ID NO: 125906 - DNA, 20 bp, Artificial
  CRISPR gRNA sequence
ttgtacttttagtagagatg

SEQ ID NO: 125907 - DNA, 20 bp, Artificial
  CRISPR gRNA sequence
gagatggggtttcgccatgt

SEQ ID NO: 125908 - DNA, 20 bp, Artificial
  CRISPR gRNA sequence
tggggtttcgccatgttggc

SEQ ID NO: 125909 - DNA, 20 bp, Artificial
  CRISPR gRNA sequence
ggggtttcgccatgttggcc

SEQ ID NO: 125910 - DNA, 20 bp, Artificial
  CRISPR gRNA sequence
tttcgccatgttggccaggc

SEQ ID NO: 125911 - DNA, 20 bp, Artificial
  CRISPR gRNA sequence
tggtcttgaactcctgacct

SEQ ID NO: 125912 - DNA, 20 bp, Artificial
  CRISPR gRNA sequence
ggtcttgaactcctgacctc

SEQ ID NO: 125913 - DNA, 20 bp, Artificial
  CRISPR gRNA sequence
ctcaggtcatccgcccgcct

SEQ ID NO: 125914 - DNA, 20 bp, Artificial
  CRISPR gRNA sequence
ccgcccgcctcggcctccca

SEQ ID NO: 125915 - DNA, 20 bp, Artificial
  CRISPR gRNA sequence
gcctcggcctcccaaagtgc

SEQ ID NO: 125916 - DNA, 20 bp, Artificial
  CRISPR gRNA sequence
cctcggcctcccaaagtgct

SEQ ID NO: 125917 - DNA, 20 bp, Artificial
  CRISPR gRNA sequence
ctcccaaagtgctgggatta

SEQ ID NO: 125918 - DNA, 20 bp, Artificial
  CRISPR gRNA sequence
tcccaaagtgctgggattac

SEQ ID NO: 125919 - DNA, 20 bp, Artificial
  CRISPR gRNA sequence
agtgctgggattacaggcat

SEQ ID NO: 125920 - DNA, 20 bp, Artificial
  CRISPR gRNA sequence
acaggcatgagtcaccctgc

SEQ ID NO: 125921 - DNA, 20 bp, Artificial
  CRISPR gRNA sequence
caggcatgagtcaccctgcc

SEQ ID NO: 125922 - DNA, 20 bp, Artificial
  CRISPR gRNA sequence
gcactcttttacatctaaat

SEQ ID NO: 125923 - DNA, 20 bp, Artificial
  CRISPR gRNA sequence
attagatttgtttctgtaaa

SEQ ID NO: 125924 - DNA, 20 bp, Artificial
  CRISPR gRNA sequence
tgtttctgtaaatagttgtc

SEQ ID NO: 125925 - DNA, 20 bp, Artificial
  CRISPR gRNA sequence
gtttctgtaaatagttgtca

SEQ ID NO: 125926 - DNA, 20 bp, Artificial
  CRISPR gRNA sequence
ggcttctctcacttgtattt

SEQ ID NO: 125927 - DNA, 20 bp, Artificial
  CRISPR gRNA sequence
tgagcttttattctgactct

SEQ ID NO: 125928 - DNA, 20 bp, Artificial
  CRISPR gRNA sequence
gagcttttattctgactctg

SEQ ID NO: 125929 - DNA, 20 bp, Artificial
  CRISPR gRNA sequence
tttattctgactctgaggtg

SEQ ID NO: 125930 - DNA, 20 bp, Artificial
  CRISPR gRNA sequence
tctgaggtgtggacttttga

SEQ ID NO: 125931 - DNA, 20 bp, Artificial
  CRISPR gRNA sequence
taatgttataacatatattt

SEQ ID NO: 125932 - DNA, 20 bp, Artificial
  CRISPR gRNA sequence
atgttataacatatatttaa

SEQ ID NO: 125933 - DNA, 20 bp, Artificial
  CRISPR gRNA sequence
catatatttaagagattaaa

SEQ ID NO: 125934 - DNA, 20 bp, Artificial
  CRISPR gRNA sequence
taagagattaaatagtcata

SEQ ID NO: 125935 - DNA, 20 bp, Artificial
  CRISPR gRNA sequence
gattaaatagtcataaagtg

SEQ ID NO: 125936 - DNA, 20 bp, Artificial
  CRISPR gRNA sequence
tgaagatgtgttcttctgaa

SEQ ID NO: 125937 - DNA, 20 bp, Artificial
  CRISPR gRNA sequence
gaagatgtgttcttctgaat

SEQ ID NO: 125938 - DNA, 20 bp, Artificial
  CRISPR gRNA sequence
tgaataggctttcatttttg

SEQ ID NO: 125939 - DNA, 20 bp, Artificial
  CRISPR gRNA sequence
gaataggctttcatttttgt

SEQ ID NO: 125940 - DNA, 20 bp, Artificial
  CRISPR gRNA sequence
ctttcatttttgtaggttgt

SEQ ID NO: 125941 - DNA, 20 bp, Artificial
  CRISPR gRNA sequence
tttcatttttgtaggttgtt

SEQ ID NO: 125942 - DNA, 20 bp, Artificial
  CRISPR gRNA sequence
catttttgtaggttgttagg

SEQ ID NO: 125943 - DNA, 20 bp, Artificial
  CRISPR gRNA sequence
atttttgtaggttgttagga

SEQ ID NO: 125944 - DNA, 20 bp, Artificial
  CRISPR gRNA sequence
gtaggttgttaggaaggtga

SEQ ID NO: 125945 - DNA, 20 bp, Artificial
  CRISPR gRNA sequence
tgttaggaaggtgatggtta

SEQ ID NO: 125946 - DNA, 20 bp, Artificial
  CRISPR gRNA sequence
tttacctatgattttctctt

SEQ ID NO: 125947 - DNA, 20 bp, Artificial
  CRISPR gRNA sequence
attttctcttcagattgcaa

SEQ ID NO: 125948 - DNA, 20 bp, Artificial
  CRISPR gRNA sequence
tcagattgcaaaagatgcca

SEQ ID NO: 125949 - DNA, 20 bp, Artificial
  CRISPR gRNA sequence
agatgccaaagaatgtgttc

SEQ ID NO: 125950 - DNA, 20 bp, Artificial
  CRISPR gRNA sequence
gaatgtgttcaagaatgtgt

SEQ ID NO: 125951 - DNA, 20 bp, Artificial
  CRISPR gRNA sequence
gtgttcaagaatgtgtaagt

SEQ ID NO: 125952 - DNA, 20 bp, Artificial
  CRISPR gRNA sequence
gaatgtgtaagtgagttcat

SEQ ID NO: 125953 - DNA, 20 bp, Artificial
  CRISPR gRNA sequence
catcagttttataacatctg

SEQ ID NO: 125954 - DNA, 20 bp, Artificial
  CRISPR gRNA sequence
agttttataacatctgaagc

SEQ ID NO: 125955 - DNA, 20 bp, Artificial
  CRISPR gRNA sequence
ataacatctgaagcaagtga

SEQ ID NO: 125956 - DNA, 20 bp, Artificial
  CRISPR gRNA sequence
taacatctgaagcaagtgaa

SEQ ID NO: 125957 - DNA, 20 bp, Artificial
  CRISPR gRNA sequence
agcaagtgaaaggtgccatc

SEQ ID NO: 125958 - DNA, 20 bp, Artificial
  CRISPR gRNA sequence
caagtgaaaggtgccatcaa

SEQ ID NO: 125959 - DNA, 20 bp, Artificial
  CRISPR gRNA sequence
aaaggtgccatcaagagaaa

SEQ ID NO: 125960 - DNA, 20 bp, Artificial
  CRISPR gRNA sequence
gagaaacggaaaacaatcaa

SEQ ID NO: 125961 - DNA, 20 bp, Artificial
  CRISPR gRNA sequence
gaaacggaaaacaatcaatg

SEQ ID NO: 125962 - DNA, 20 bp, Artificial
  CRISPR gRNA sequence
acggaaaacaatcaatggag

SEQ ID NO: 125963 - DNA, 20 bp, Artificial
  CRISPR gRNA sequence
tctctttgctatgtctactt

SEQ ID NO: 125964 - DNA, 20 bp, Artificial
  CRISPR gRNA sequence
ctctttgctatgtctacttt

SEQ ID NO: 125965 - DNA, 20 bp, Artificial
  CRISPR gRNA sequence
atgtctactttaggctttga

SEQ ID NO: 125966 - DNA, 20 bp, Artificial
  CRISPR gRNA sequence
tttaggctttgacagttatg

SEQ ID NO: 125967 - DNA, 20 bp, Artificial
  CRISPR gRNA sequence
aacctctgaaattatacctt

SEQ ID NO: 125968 - DNA, 20 bp, Artificial
  CRISPR gRNA sequence
aaattataccttcagaaatt

SEQ ID NO: 125969 - DNA, 20 bp, Artificial
  CRISPR gRNA sequence
attataccttcagaaattca

SEQ ID NO: 125970 - DNA, 20 bp, Artificial
  CRISPR gRNA sequence
tataccttcagaaattcaga

SEQ ID NO: 125971 - DNA, 20 bp, Artificial
  CRISPR gRNA sequence
ataccttcagaaattcagag

SEQ ID NO: 125972 - DNA, 20 bp, Artificial
  CRISPR gRNA sequence
tttttcttcttttttttttt

SEQ ID NO: 125973 - DNA, 20 bp, Artificial
  CRISPR gRNA sequence
ttttcttctttttttttttg

SEQ ID NO: 125974 - DNA, 20 bp, Artificial
  CRISPR gRNA sequence
tcttctttttttttttgagg

SEQ ID NO: 125975 - DNA, 20 bp, Artificial
  CRISPR gRNA sequence
ttctttttttttttgaggtg

SEQ ID NO: 125976 - DNA, 20 bp, Artificial
  CRISPR gRNA sequence
tggagtatcgctctgttgcc

SEQ ID NO: 125977 - DNA, 20 bp, Artificial
  CRISPR gRNA sequence
ggagtatcgctctgttgccc

SEQ ID NO: 125978 - DNA, 20 bp, Artificial
  CRISPR gRNA sequence
tatcgctctgttgcccaggc

SEQ ID NO: 125979 - DNA, 20 bp, Artificial
  CRISPR gRNA sequence
tcgctctgttgcccaggctg

SEQ ID NO: 125980 - DNA, 20 bp, Artificial
  CRISPR gRNA sequence
ctgttgcccaggctggagta

SEQ ID NO: 125981 - DNA, 20 bp, Artificial
  CRISPR gRNA sequence
ttgcccaggctggagtacag

SEQ ID NO: 125982 - DNA, 20 bp, Artificial
  CRISPR gRNA sequence
ccaggctggagtacagtggc

SEQ ID NO: 125983 - DNA, 20 bp, Artificial
  CRISPR gRNA sequence
ggagtacagtggcaagatct

SEQ ID NO: 125984 - DNA, 20 bp, Artificial
  CRISPR gRNA sequence
tcactgcaacctctgcctcc

SEQ ID NO: 125985 - DNA, 20 bp, Artificial
  CRISPR gRNA sequence
cactgcaacctctgcctcct

SEQ ID NO: 125986 - DNA, 20 bp, Artificial
  CRISPR gRNA sequence
aacctctgcctcctgggttc

SEQ ID NO: 125987 - DNA, 20 bp, Artificial
  CRISPR gRNA sequence
ttcaagcaactctcctgcct

SEQ ID NO: 125988 - DNA, 20 bp, Artificial
  CRISPR gRNA sequence
ctctcctgcctcagcctcct

SEQ ID NO: 125989 - DNA, 20 bp, Artificial
  CRISPR gRNA sequence
tcctgcctcagcctcctgag

SEQ ID NO: 125990 - DNA, 20 bp, Artificial
  CRISPR gRNA sequence
gcctcagcctcctgagtagc

SEQ ID NO: 125991 - DNA, 20 bp, Artificial
  CRISPR gRNA sequence
cctcagcctcctgagtagct

SEQ ID NO: 125992 - DNA, 20 bp, Artificial
  CRISPR gRNA sequence
ctcctgagtagctgggatta

SEQ ID NO: 125993 - DNA, 20 bp, Artificial
  CRISPR gRNA sequence
tcctgagtagctgggattac

SEQ ID NO: 125994 - DNA, 20 bp, Artificial
  CRISPR gRNA sequence
caggcgtgcaccaccatgcc

SEQ ID NO: 125995 - DNA, 20 bp, Artificial
  CRISPR gRNA sequence
gtgcaccaccatgcctggct

SEQ ID NO: 125996 - DNA, 20 bp, Artificial
  CRISPR gRNA sequence
ctggctaagttttgtatttt

SEQ ID NO: 125997 - DNA, 20 bp, Artificial
  CRISPR gRNA sequence
gctaagttttgtatttttag

SEQ ID NO: 125998 - DNA, 20 bp, Artificial
  CRISPR gRNA sequence
taagttttgtatttttagta

SEQ ID NO: 125999 - DNA, 20 bp, Artificial
  CRISPR gRNA sequence
ttttgtatttttagtagaga

SEQ ID NO: 126000 - DNA, 20 bp, Artificial
  CRISPR gRNA sequence
tttgtatttttagtagagac

SEQ ID NO: 126001 - DNA, 20 bp, Artificial
  CRISPR gRNA sequence
ttgtatttttagtagagacg

SEQ ID NO: 126002 - DNA, 20 bp, Artificial
  CRISPR gRNA sequence
tgtatttttagtagagacgg

SEQ ID NO: 126003 - DNA, 20 bp, Artificial
  CRISPR gRNA sequence
agacgggggttacaccatgt

SEQ ID NO: 126004 - DNA, 20 bp, Artificial
  CRISPR gRNA sequence
gggggttacaccatgttggc

SEQ ID NO: 126005 - DNA, 20 bp, Artificial
  CRISPR gRNA sequence
ggggttacaccatgttggcc

SEQ ID NO: 126006 - DNA, 20 bp, Artificial
  CRISPR gRNA sequence
ttacaccatgttggccaggc

SEQ ID NO: 126007 - DNA, 20 bp, Artificial
  CRISPR gRNA sequence
tggtctcaaactcctgacct

SEQ ID NO: 126008 - DNA, 20 bp, Artificial
  CRISPR gRNA sequence
ggtctcaaactcctgacctc

SEQ ID NO: 126009 - DNA, 20 bp, Artificial
  CRISPR gRNA sequence
ctcaggtgatccacctgcct

SEQ ID NO: 126010 - DNA, 20 bp, Artificial
  CRISPR gRNA sequence
ccacctgcctcggcctccca

SEQ ID NO: 126011 - DNA, 20 bp, Artificial
  CRISPR gRNA sequence
gcctcggcctcccaaagtgc

SEQ ID NO: 126012 - DNA, 20 bp, Artificial
  CRISPR gRNA sequence
cctcggcctcccaaagtgct

SEQ ID NO: 126013 - DNA, 20 bp, Artificial
  CRISPR gRNA sequence
ctcccaaagtgctgggatta

SEQ ID NO: 126014 - DNA, 20 bp, Artificial
  CRISPR gRNA sequence
tcccaaagtgctgggattac

SEQ ID NO: 126015 - DNA, 20 bp, Artificial
  CRISPR gRNA sequence
agtgctgggattacaggtgt

SEQ ID NO: 126016 - DNA, 20 bp, Artificial
  CRISPR gRNA sequence
caggtgtgagccaccatgcc

SEQ ID NO: 126017 - DNA, 20 bp, Artificial
  CRISPR gRNA sequence
ccggcccccattgtgctttt

SEQ ID NO: 126018 - DNA, 20 bp, Artificial
  CRISPR gRNA sequence
cattgtgcttttaagaaaat

SEQ ID NO: 126019 - DNA, 20 bp, Artificial
  CRISPR gRNA sequence
ttgtgcttttaagaaaataa

SEQ ID NO: 126020 - DNA, 20 bp, Artificial
  CRISPR gRNA sequence
tgttttaaaaattcattttg

SEQ ID NO: 126021 - DNA, 20 bp, Artificial
  CRISPR gRNA sequence
gtaaattatgtaacatttct

SEQ ID NO: 126022 - DNA, 20 bp, Artificial
  CRISPR gRNA sequence
aattatgtaacatttctcag

SEQ ID NO: 126023 - DNA, 20 bp, Artificial
  CRISPR gRNA sequence
aagtatttaattgcttatat

SEQ ID NO: 126024 - DNA, 20 bp, Artificial
  CRISPR gRNA sequence
tatttaattgcttatatcag

SEQ ID NO: 126025 - DNA, 20 bp, Artificial
  CRISPR gRNA sequence
tcagcagtcctcaacatttt

SEQ ID NO: 126026 - DNA, 20 bp, Artificial
  CRISPR gRNA sequence
gtcctcaacatttttggcac

SEQ ID NO: 126027 - DNA, 20 bp, Artificial
  CRISPR gRNA sequence
tcctcaacatttttggcacc

SEQ ID NO: 126028 - DNA, 20 bp, Artificial
  CRISPR gRNA sequence
cctcaacatttttggcacca

SEQ ID NO: 126029 - DNA, 20 bp, Artificial
  CRISPR gRNA sequence
ggcaccagggacctgttttg

SEQ ID NO: 126030 - DNA, 20 bp, Artificial
  CRISPR gRNA sequence
ccagggacctgttttgtgga

SEQ ID NO: 126031 - DNA, 20 bp, Artificial
  CRISPR gRNA sequence
aaagcaatttttccacgctc

SEQ ID NO: 126032 - DNA, 20 bp, Artificial
  CRISPR gRNA sequence
aagcaatttttccacgctct

SEQ ID NO: 126033 - DNA, 20 bp, Artificial
  CRISPR gRNA sequence
agcaatttttccacgctctg

SEQ ID NO: 126034 - DNA, 20 bp, Artificial
  CRISPR gRNA sequence
atttttccacgctctggggt

SEQ ID NO: 126035 - DNA, 20 bp, Artificial
  CRISPR gRNA sequence
tttttccacgctctggggtc

SEQ ID NO: 126036 - DNA, 20 bp, Artificial
  CRISPR gRNA sequence
ttttccacgctctggggtca

SEQ ID NO: 126037 - DNA, 20 bp, Artificial
  CRISPR gRNA sequence
tttccacgctctggggtcag

SEQ ID NO: 126038 - DNA, 20 bp, Artificial
  CRISPR gRNA sequence
tccacgctctggggtcaggg

SEQ ID NO: 126039 - DNA, 20 bp, Artificial
  CRISPR gRNA sequence
ccacgctctggggtcagggg

SEQ ID NO: 126040 - DNA, 20 bp, Artificial
  CRISPR gRNA sequence
cacgctctggggtcagggga

SEQ ID NO: 126041 - DNA, 20 bp, Artificial
  CRISPR gRNA sequence
acgctctggggtcaggggag

SEQ ID NO: 126042 - DNA, 20 bp, Artificial
  CRISPR gRNA sequence
tggggtcaggggaggggtgc

SEQ ID NO: 126043 - DNA, 20 bp, Artificial
  CRISPR gRNA sequence
ggggtcaggggaggggtgcg

SEQ ID NO: 126044 - DNA, 20 bp, Artificial
  CRISPR gRNA sequence
gggtcaggggaggggtgcga

SEQ ID NO: 126045 - DNA, 20 bp, Artificial
  CRISPR gRNA sequence
ggtcaggggaggggtgcgag

SEQ ID NO: 126046 - DNA, 20 bp, Artificial
  CRISPR gRNA sequence
caggggaggggtgcgagggg

SEQ ID NO: 126047 - DNA, 20 bp, Artificial
  CRISPR gRNA sequence
ggaggggtgcgaggggtaga

SEQ ID NO: 126048 - DNA, 20 bp, Artificial
  CRISPR gRNA sequence
gtgcgaggggtagatggctt

SEQ ID NO: 126049 - DNA, 20 bp, Artificial
  CRISPR gRNA sequence
tgcgaggggtagatggcttc

SEQ ID NO: 126050 - DNA, 20 bp, Artificial
  CRISPR gRNA sequence
aggatgaaactgttccacct

SEQ ID NO: 126051 - DNA, 20 bp, Artificial
  CRISPR gRNA sequence
actgttccacctcagatcat

SEQ ID NO: 126052 - DNA, 20 bp, Artificial
  CRISPR gRNA sequence
ctgttccacctcagatcatc

SEQ ID NO: 126053 - DNA, 20 bp, Artificial
  CRISPR gRNA sequence
cacctcagatcatcaggcat

SEQ ID NO: 126054 - DNA, 20 bp, Artificial
  CRISPR gRNA sequence
tcagatcatcaggcattagt

SEQ ID NO: 126055 - DNA, 20 bp, Artificial
  CRISPR gRNA sequence
ggcattagttagattctcat

SEQ ID NO: 126056 - DNA, 20 bp, Artificial
  CRISPR gRNA sequence
gcattagttagattctcata

SEQ ID NO: 126057 - DNA, 20 bp, Artificial
  CRISPR gRNA sequence
agattctcataaggaacgca

SEQ ID NO: 126058 - DNA, 20 bp, Artificial
  CRISPR gRNA sequence
ctcataaggaacgcacagcc

SEQ ID NO: 126059 - DNA, 20 bp, Artificial
  CRISPR gRNA sequence
gcctagatcccttgcatgcg

SEQ ID NO: 126060 - DNA, 20 bp, Artificial
  CRISPR gRNA sequence
cttgcatgcgcagttcacaa

SEQ ID NO: 126061 - DNA, 20 bp, Artificial
  CRISPR gRNA sequence
ttgcatgcgcagttcacaat

SEQ ID NO: 126062 - DNA, 20 bp, Artificial
  CRISPR gRNA sequence
tgcatgcgcagttcacaata

SEQ ID NO: 126063 - DNA, 20 bp, Artificial
  CRISPR gRNA sequence
cgcagttcacaatagggttc

SEQ ID NO: 126064 - DNA, 20 bp, Artificial
  CRISPR gRNA sequence
aatagggttccagcgcctat

SEQ ID NO: 126065 - DNA, 20 bp, Artificial
  CRISPR gRNA sequence
gcgcctatgagaatctcacg

SEQ ID NO: 126066 - DNA, 20 bp, Artificial
  CRISPR gRNA sequence
cgtggccgctgatctgaccg

SEQ ID NO: 126067 - DNA, 20 bp, Artificial
  CRISPR gRNA sequence
gtggccgctgatctgaccga

SEQ ID NO: 126068 - DNA, 20 bp, Artificial
  CRISPR gRNA sequence
gccgctgatctgaccgaagg

SEQ ID NO: 126069 - DNA, 20 bp, Artificial
  CRISPR gRNA sequence
cgctgatctgaccgaaggcg

SEQ ID NO: 126070 - DNA, 20 bp, Artificial
  CRISPR gRNA sequence
atctgaccgaaggcggagct

SEQ ID NO: 126071 - DNA, 20 bp, Artificial
  CRISPR gRNA sequence
tctgaccgaaggcggagctc

SEQ ID NO: 126072 - DNA, 20 bp, Artificial
  CRISPR gRNA sequence
gaccgaaggcggagctcagg

SEQ ID NO: 126073 - DNA, 20 bp, Artificial
  CRISPR gRNA sequence
cggagctcaggtggtaatgc

SEQ ID NO: 126074 - DNA, 20 bp, Artificial
  CRISPR gRNA sequence
aggtggtaatgctggattac

SEQ ID NO: 126075 - DNA, 20 bp, Artificial
  CRISPR gRNA sequence
gaccctcacctcctgctgtg

SEQ ID NO: 126076 - DNA, 20 bp, Artificial
  CRISPR gRNA sequence
ctcacctcctgctgtgtggc

SEQ ID NO: 126077 - DNA, 20 bp, Artificial
  CRISPR gRNA sequence
tcacctcctgctgtgtggct

SEQ ID NO: 126078 - DNA, 20 bp, Artificial
  CRISPR gRNA sequence
ctgtgtggctgggttcttaa

SEQ ID NO: 126079 - DNA, 20 bp, Artificial
  CRISPR gRNA sequence
tgtgtggctgggttcttaac

SEQ ID NO: 126080 - DNA, 20 bp, Artificial
  CRISPR gRNA sequence
gctgggttcttaacaggcca

SEQ ID NO: 126081 - DNA, 20 bp, Artificial
  CRISPR gRNA sequence
aacaggccacggacactcat

SEQ ID NO: 126082 - DNA, 20 bp, Artificial
  CRISPR gRNA sequence
cacggacactcatcagtctg

SEQ ID NO: 126083 - DNA, 20 bp, Artificial
  CRISPR gRNA sequence
acactcatcagtctgcagcc

SEQ ID NO: 126084 - DNA, 20 bp, Artificial
  CRISPR gRNA sequence
cactcatcagtctgcagcct

SEQ ID NO: 126085 - DNA, 20 bp, Artificial
  CRISPR gRNA sequence
actcatcagtctgcagcctg

SEQ ID NO: 126086 - DNA, 20 bp, Artificial
  CRISPR gRNA sequence
ctcatcagtctgcagcctgg

SEQ ID NO: 126087 - DNA, 20 bp, Artificial
  CRISPR gRNA sequence
tcagtctgcagcctgggggt

SEQ ID NO: 126088 - DNA, 20 bp, Artificial
  CRISPR gRNA sequence
cagtctgcagcctgggggtt

SEQ ID NO: 126089 - DNA, 20 bp, Artificial
  CRISPR gRNA sequence
agtctgcagcctgggggttg

SEQ ID NO: 126090 - DNA, 20 bp, Artificial
  CRISPR gRNA sequence
gggatcactgacttatatta

SEQ ID NO: 126091 - DNA, 20 bp, Artificial
  CRISPR gRNA sequence
cttatattacagtacttaaa

SEQ ID NO: 126092 - DNA, 20 bp, Artificial
  CRISPR gRNA sequence
tattacagtacttaaataga

SEQ ID NO: 126093 - DNA, 20 bp, Artificial
  CRISPR gRNA sequence
cctttgtttattactaacta

SEQ ID NO: 126094 - DNA, 20 bp, Artificial
  CRISPR gRNA sequence
gtttattactaactatagca

SEQ ID NO: 126095 - DNA, 20 bp, Artificial
  CRISPR gRNA sequence
gcatagttatataatgattt

SEQ ID NO: 126096 - DNA, 20 bp, Artificial
  CRISPR gRNA sequence
catagttatataatgattta

SEQ ID NO: 126097 - DNA, 20 bp, Artificial
  CRISPR gRNA sequence
atagttatataatgatttaa

SEQ ID NO: 126098 - DNA, 20 bp, Artificial
  CRISPR gRNA sequence
tatataatgatttaagggca

SEQ ID NO: 126099 - DNA, 20 bp, Artificial
  CRISPR gRNA sequence
aagggcacagactttgtatt

SEQ ID NO: 126100 - DNA, 20 bp, Artificial
  CRISPR gRNA sequence
agactttgtattcagactac

SEQ ID NO: 126101 - DNA, 20 bp, Artificial
  CRISPR gRNA sequence
gactttgtattcagactacc

SEQ ID NO: 126102 - DNA, 20 bp, Artificial
  CRISPR gRNA sequence
ctttgtattcagactaccag

SEQ ID NO: 126103 - DNA, 20 bp, Artificial
  CRISPR gRNA sequence
tttgtattcagactaccagg

SEQ ID NO: 126104 - DNA, 20 bp, Artificial
  CRISPR gRNA sequence
actaccaggaggctgaatcc

SEQ ID NO: 126105 - DNA, 20 bp, Artificial
  CRISPR gRNA sequence
tctgccacatgcaaattctg

SEQ ID NO: 126106 - DNA, 20 bp, Artificial
  CRISPR gRNA sequence
acatgcaaattctgtggcct

SEQ ID NO: 126107 - DNA, 20 bp, Artificial
  CRISPR gRNA sequence
gcaaattctgtggccttgga

SEQ ID NO: 126108 - DNA, 20 bp, Artificial
  CRISPR gRNA sequence
gacagattatttaattactt

SEQ ID NO: 126109 - DNA, 20 bp, Artificial
  CRISPR gRNA sequence
acagattatttaattacttt

SEQ ID NO: 126110 - DNA, 20 bp, Artificial
  CRISPR gRNA sequence
tatttaattactttaggcct

SEQ ID NO: 126111 - DNA, 20 bp, Artificial
  CRISPR gRNA sequence
ggtttcctcatctgtaaaat

SEQ ID NO: 126112 - DNA, 20 bp, Artificial
  CRISPR gRNA sequence
gtttcctcatctgtaaaatg

SEQ ID NO: 126113 - DNA, 20 bp, Artificial
  CRISPR gRNA sequence
catctgtaaaatgaggctaa

SEQ ID NO: 126114 - DNA, 20 bp, Artificial
  CRISPR gRNA sequence
ggctaatagtacctatatca

SEQ ID NO: 126115 - DNA, 20 bp, Artificial
  CRISPR gRNA sequence
gtacctatatcatagaatta

SEQ ID NO: 126116 - DNA, 20 bp, Artificial
  CRISPR gRNA sequence
ctatatcatagaattatgga

SEQ ID NO: 126117 - DNA, 20 bp, Artificial
  CRISPR gRNA sequence
ggatggtactaaataatgtt

SEQ ID NO: 126118 - DNA, 20 bp, Artificial
  CRISPR gRNA sequence
tgctgctattgttaatttca

SEQ ID NO: 126119 - DNA, 20 bp, Artificial
  CRISPR gRNA sequence
tgctattgttaatttcaaag

SEQ ID NO: 126120 - DNA, 20 bp, Artificial
  CRISPR gRNA sequence
tattgttaatttcaaagaag

SEQ ID NO: 126121 - DNA, 20 bp, Artificial
  CRISPR gRNA sequence
tttcaaagaagtagcattaa

SEQ ID NO: 126122 - DNA, 20 bp, Artificial
  CRISPR gRNA sequence
caaagaagtagcattaaaag

SEQ ID NO: 126123 - DNA, 20 bp, Artificial
  CRISPR gRNA sequence
gaagtagcattaaaagtagt

SEQ ID NO: 126124 - DNA, 20 bp, Artificial
  CRISPR gRNA sequence
aagtagcattaaaagtagta

SEQ ID NO: 126125 - DNA, 20 bp, Artificial
  CRISPR gRNA sequence
agcattaaaagtagtaaggt

SEQ ID NO: 126126 - DNA, 20 bp, Artificial
  CRISPR gRNA sequence
cattaaaagtagtaaggttg

SEQ ID NO: 126127 - DNA, 20 bp, Artificial
  CRISPR gRNA sequence
gtagtaaggttggagtcttt

SEQ ID NO: 126128 - DNA, 20 bp, Artificial
  CRISPR gRNA sequence
ggagtcttttagataataaa

SEQ ID NO: 126129 - DNA, 20 bp, Artificial
  CRISPR gRNA sequence
agtcttttagataataaaaa

SEQ ID NO: 126130 - DNA, 20 bp, Artificial
  CRISPR gRNA sequence
gtcttttagataataaaaag

SEQ ID NO: 126131 - DNA, 20 bp, Artificial
  CRISPR gRNA sequence
ttttagataataaaaagagg

SEQ ID NO: 126132 - DNA, 20 bp, Artificial
  CRISPR gRNA sequence
tttagataataaaaagagga

SEQ ID NO: 126133 - DNA, 20 bp, Artificial
  CRISPR gRNA sequence
ttgaattcttctatatttct

SEQ ID NO: 126134 - DNA, 20 bp, Artificial
  CRISPR gRNA sequence
tgaattcttctatatttctt

SEQ ID NO: 126135 - DNA, 20 bp, Artificial
  CRISPR gRNA sequence
cttaggtttatctttgcctg

SEQ ID NO: 126136 - DNA, 20 bp, Artificial
  CRISPR gRNA sequence
ttaggtttatctttgcctgt

SEQ ID NO: 126137 - DNA, 20 bp, Artificial
  CRISPR gRNA sequence
tttatctttgcctgtaggaa

SEQ ID NO: 126138 - DNA, 20 bp, Artificial
  CRISPR gRNA sequence
gtaggaatggattttgtgaa

SEQ ID NO: 126139 - DNA, 20 bp, Artificial
  CRISPR gRNA sequence
ggaatggattttgtgaaaag

SEQ ID NO: 126140 - DNA, 20 bp, Artificial
  CRISPR gRNA sequence
ggattttgtgaaaagcagtt

SEQ ID NO: 126141 - DNA, 20 bp, Artificial
  CRISPR gRNA sequence
ttgtgaaaagcagttgagtt

SEQ ID NO: 126142 - DNA, 20 bp, Artificial
  CRISPR gRNA sequence
gcatatttatttccacatgc

SEQ ID NO: 126143 - DNA, 20 bp, Artificial
  CRISPR gRNA sequence
tttatttccacatgccagct

SEQ ID NO: 126144 - DNA, 20 bp, Artificial
  CRISPR gRNA sequence
ttatttccacatgccagctt

SEQ ID NO: 126145 - DNA, 20 bp, Artificial
  CRISPR gRNA sequence
ccacatgccagcttaggtgt

SEQ ID NO: 126146 - DNA, 20 bp, Artificial
  CRISPR gRNA sequence
aaatatattcttaatatctt

SEQ ID NO: 126147 - DNA, 20 bp, Artificial
  CRISPR gRNA sequence
gtgtttgaatcccattaaat

SEQ ID NO: 126148 - DNA, 20 bp, Artificial
  CRISPR gRNA sequence
ttaaattagtgatatttgca

SEQ ID NO: 126149 - DNA, 20 bp, Artificial
  CRISPR gRNA sequence
atatttgcatggaataattg

SEQ ID NO: 126150 - DNA, 20 bp, Artificial
  CRISPR gRNA sequence
tttgcatggaataattgaag

SEQ ID NO: 126151 - DNA, 20 bp, Artificial
  CRISPR gRNA sequence
ttgcatggaataattgaagt

SEQ ID NO: 126152 - DNA, 20 bp, Artificial
  CRISPR gRNA sequence
tggaataattgaagtaggaa

SEQ ID NO: 126153 - DNA, 20 bp, Artificial
  CRISPR gRNA sequence
aattcctgacattattttta

SEQ ID NO: 126154 - DNA, 20 bp, Artificial
  CRISPR gRNA sequence
acattatttttacagatctt

SEQ ID NO: 126155 - DNA, 20 bp, Artificial
  CRISPR gRNA sequence
tttacagatcttcagtatca

SEQ ID NO: 126156 - DNA, 20 bp, Artificial
  CRISPR gRNA sequence
ttacagatcttcagtatcat

SEQ ID NO: 126157 - DNA, 20 bp, Artificial
  CRISPR gRNA sequence
tcttcagtatcataggaacc

SEQ ID NO: 126158 - DNA, 20 bp, Artificial
  CRISPR gRNA sequence
tcagtatcataggaacctag

SEQ ID NO: 126159 - DNA, 20 bp, Artificial
  CRISPR gRNA sequence
cataggaacctagaagtatt

SEQ ID NO: 126160 - DNA, 20 bp, Artificial
  CRISPR gRNA sequence
agtatttggccaaattaatt

SEQ ID NO: 126161 - DNA, 20 bp, Artificial
  CRISPR gRNA sequence
gtatttggccaaattaattt

SEQ ID NO: 126162 - DNA, 20 bp, Artificial
  CRISPR gRNA sequence
atttaggaatttttaactct

SEQ ID NO: 126163 - DNA, 20 bp, Artificial
  CRISPR gRNA sequence
ttttaactctcagcttgcta

SEQ ID NO: 126164 - DNA, 20 bp, Artificial
  CRISPR gRNA sequence
cagcttgctacagtactgcc

SEQ ID NO: 126165 - DNA, 20 bp, Artificial
  CRISPR gRNA sequence
ttgctacagtactgcccagt

SEQ ID NO: 126166 - DNA, 20 bp, Artificial
  CRISPR gRNA sequence
acagtactgcccagttggct

SEQ ID NO: 126167 - DNA, 20 bp, Artificial
  CRISPR gRNA sequence
agtactgcccagttggctga

SEQ ID NO: 126168 - DNA, 20 bp, Artificial
  CRISPR gRNA sequence
tgagagacatatatatactt

SEQ ID NO: 126169 - DNA, 20 bp, Artificial
  CRISPR gRNA sequence
tatatacttaagtgatcact

SEQ ID NO: 126170 - DNA, 20 bp, Artificial
  CRISPR gRNA sequence
gtgatcacttggatcatttg

SEQ ID NO: 126171 - DNA, 20 bp, Artificial
  CRISPR gRNA sequence
tggatcatttgtagatttat

SEQ ID NO: 126172 - DNA, 20 bp, Artificial
  CRISPR gRNA sequence
tagatttataagctcaatat

SEQ ID NO: 126173 - DNA, 20 bp, Artificial
  CRISPR gRNA sequence
atttataagctcaatattgg

SEQ ID NO: 126174 - DNA, 20 bp, Artificial
  CRISPR gRNA sequence
tcaatattggtggtgttttg

SEQ ID NO: 126175 - DNA, 20 bp, Artificial
  CRISPR gRNA sequence
ttgcagacttcttcatctgt

SEQ ID NO: 126176 - DNA, 20 bp, Artificial
  CRISPR gRNA sequence
cagacttcttcatctgtaag

SEQ ID NO: 126177 - DNA, 20 bp, Artificial
  CRISPR gRNA sequence
gacttcttcatctgtaagta

SEQ ID NO: 126178 - DNA, 20 bp, Artificial
  CRISPR gRNA sequence
gttacccctttgatatgatg

SEQ ID NO: 126179 - DNA, 20 bp, Artificial
  CRISPR gRNA sequence
cctttgatatgatgtggaat

SEQ ID NO: 126180 - DNA, 20 bp, Artificial
  CRISPR gRNA sequence
tctgtaaatactttgctttc

SEQ ID NO: 126181 - DNA, 20 bp, Artificial
  CRISPR gRNA sequence
ctgtaaatactttgctttct

SEQ ID NO: 126182 - DNA, 20 bp, Artificial
  CRISPR gRNA sequence
ctctgtcttgttaatgatta

SEQ ID NO: 126183 - DNA, 20 bp, Artificial
  CRISPR gRNA sequence
atgattacagcttatattaa

SEQ ID NO: 126184 - DNA, 20 bp, Artificial
  CRISPR gRNA sequence
ttacagcttatattaaaagt

SEQ ID NO: 126185 - DNA, 20 bp, Artificial
  CRISPR gRNA sequence
attaaaagttagccttctga

SEQ ID NO: 126186 - DNA, 20 bp, Artificial
  CRISPR gRNA sequence
cttcttcatatgtaattaac

SEQ ID NO: 126187 - DNA, 20 bp, Artificial
  CRISPR gRNA sequence
cttcatatgtaattaaccag

SEQ ID NO: 126188 - DNA, 20 bp, Artificial
  CRISPR gRNA sequence
gtgttaataaatactctgct

SEQ ID NO: 126189 - DNA, 20 bp, Artificial
  CRISPR gRNA sequence
gttaataaatactctgctta

SEQ ID NO: 126190 - DNA, 20 bp, Artificial
  CRISPR gRNA sequence
ctgcttagagtttgtaataa

SEQ ID NO: 126191 - DNA, 20 bp, Artificial
  CRISPR gRNA sequence
cttagagtttgtaataatag

SEQ ID NO: 126192 - DNA, 20 bp, Artificial
  CRISPR gRNA sequence
ataatagaagctcctaattt

SEQ ID NO: 126193 - DNA, 20 bp, Artificial
  CRISPR gRNA sequence
taatagaagctcctaatttt

SEQ ID NO: 126194 - DNA, 20 bp, Artificial
  CRISPR gRNA sequence
agctcctaattttaggcaat

SEQ ID NO: 126195 - DNA, 20 bp, Artificial
  CRISPR gRNA sequence
cctaattttaggcaataagt

SEQ ID NO: 126196 - DNA, 20 bp, Artificial
  CRISPR gRNA sequence
aataagtaagcatttgcatt

SEQ ID NO: 126197 - DNA, 20 bp, Artificial
  CRISPR gRNA sequence
aagtaagcatttgcatttgg

SEQ ID NO: 126198 - DNA, 20 bp, Artificial
  CRISPR gRNA sequence
agacaatttcatttgaatat

SEQ ID NO: 126199 - DNA, 20 bp, Artificial
  CRISPR gRNA sequence
actttttttttttccttcct

SEQ ID NO: 126200 - DNA, 20 bp, Artificial
  CRISPR gRNA sequence
ctttttttttttccttcctc

SEQ ID NO: 126201 - DNA, 20 bp, Artificial
  CRISPR gRNA sequence
tttccttcctcaggctatga

SEQ ID NO: 126202 - DNA, 20 bp, Artificial
  CRISPR gRNA sequence
ttccttcctcaggctatgaa

SEQ ID NO: 126203 - DNA, 20 bp, Artificial
  CRISPR gRNA sequence
ccttcctcaggctatgaaag

SEQ ID NO: 126204 - DNA, 20 bp, Artificial
  CRISPR gRNA sequence
ctcaggctatgaaaggagaa

SEQ ID NO: 126205 - DNA, 20 bp, Artificial
  CRISPR gRNA sequence
tcaggctatgaaaggagaaa

SEQ ID NO: 126206 - DNA, 20 bp, Artificial
  CRISPR gRNA sequence
caggctatgaaaggagaaaa

SEQ ID NO: 126207 - DNA, 20 bp, Artificial
  CRISPR gRNA sequence
atgaaaggagaaaagggaat

SEQ ID NO: 126208 - DNA, 20 bp, Artificial
  CRISPR gRNA sequence
aaaggagaaaagggaattgg

SEQ ID NO: 126209 - DNA, 20 bp, Artificial
  CRISPR gRNA sequence
aggagaaaagggaattggtg

SEQ ID NO: 126210 - DNA, 20 bp, Artificial
  CRISPR gRNA sequence
agaaaagggaattggtggag

SEQ ID NO: 126211 - DNA, 20 bp, Artificial
  CRISPR gRNA sequence
gggaattggtggagcagtca

SEQ ID NO: 126212 - DNA, 20 bp, Artificial
  CRISPR gRNA sequence
tggtggagcagtcacagcta

SEQ ID NO: 126213 - DNA, 20 bp, Artificial
  CRISPR gRNA sequence
ggagcagtcacagctacaga

SEQ ID NO: 126214 - DNA, 20 bp, Artificial
  CRISPR gRNA sequence
gtcacagctacagatggact

SEQ ID NO: 126215 - DNA, 20 bp, Artificial
  CRISPR gRNA sequence
agctacagatggactaagtg

SEQ ID NO: 126216 - DNA, 20 bp, Artificial
  CRISPR gRNA sequence
ctacagatggactaagtgaa

SEQ ID NO: 126217 - DNA, 20 bp, Artificial
  CRISPR gRNA sequence
tggactaagtgaagagctta

SEQ ID NO: 126218 - DNA, 20 bp, Artificial
  CRISPR gRNA sequence
gactaagtgaagagcttaca

SEQ ID NO: 126219 - DNA, 20 bp, Artificial
  CRISPR gRNA sequence
actaagtgaagagcttacag

SEQ ID NO: 126220 - DNA, 20 bp, Artificial
  CRISPR gRNA sequence
taagtgaagagcttacagag

SEQ ID NO: 126221 - DNA, 20 bp, Artificial
  CRISPR gRNA sequence
aagtgaagagcttacagagg

SEQ ID NO: 126222 - DNA, 20 bp, Artificial
  CRISPR gRNA sequence
gagcttacagaggaggcatt

SEQ ID NO: 126223 - DNA, 20 bp, Artificial
  CRISPR gRNA sequence
ttacagaggaggcatttagt

SEQ ID NO: 126224 - DNA, 20 bp, Artificial
  CRISPR gRNA sequence
agtaagcattgttataatac

SEQ ID NO: 126225 - DNA, 20 bp, Artificial
  CRISPR gRNA sequence
ttgttataatacaagtcatg

SEQ ID NO: 126226 - DNA, 20 bp, Artificial
  CRISPR gRNA sequence
atacaagtcatgtagattgt

SEQ ID NO: 126227 - DNA, 20 bp, Artificial
  CRISPR gRNA sequence
tgttagcaatgattcatact

SEQ ID NO: 126228 - DNA, 20 bp, Artificial
  CRISPR gRNA sequence
gattcatactaagtatctaa

SEQ ID NO: 126229 - DNA, 20 bp, Artificial
  CRISPR gRNA sequence
taagtatctaatggtatttt

SEQ ID NO: 126230 - DNA, 20 bp, Artificial
  CRISPR gRNA sequence
taatggtatttttggaatgt

SEQ ID NO: 126231 - DNA, 20 bp, Artificial
  CRISPR gRNA sequence
tggtatttttggaatgtcag

SEQ ID NO: 126232 - DNA, 20 bp, Artificial
  CRISPR gRNA sequence
atttttggaatgtcagcagt

SEQ ID NO: 126233 - DNA, 20 bp, Artificial
  CRISPR gRNA sequence
cagcagtgagtattttgaca

SEQ ID NO: 126234 - DNA, 20 bp, Artificial
  CRISPR gRNA sequence
tgacaaagcactattttaaa

SEQ ID NO: 126235 - DNA, 20 bp, Artificial
  CRISPR gRNA sequence
ctattttaaatagttcttat

SEQ ID NO: 126236 - DNA, 20 bp, Artificial
  CRISPR gRNA sequence
agttcatgcccttttatttg

SEQ ID NO: 126237 - DNA, 20 bp, Artificial
  CRISPR gRNA sequence
catgcccttttatttgaagt

SEQ ID NO: 126238 - DNA, 20 bp, Artificial
  CRISPR gRNA sequence
cccttttatttgaagtcagt

SEQ ID NO: 126239 - DNA, 20 bp, Artificial
  CRISPR gRNA sequence
atttgaagtcagtgagtgat

SEQ ID NO: 126240 - DNA, 20 bp, Artificial
  CRISPR gRNA sequence
aagtcagtgagtgataagtg

SEQ ID NO: 126241 - DNA, 20 bp, Artificial
  CRISPR gRNA sequence
agtgagtgataagtgtagaa

SEQ ID NO: 126242 - DNA, 20 bp, Artificial
  CRISPR gRNA sequence
tgtagaaaagtttaattctg

SEQ ID NO: 126243 - DNA, 20 bp, Artificial
  CRISPR gRNA sequence
acattataacctttcactga

SEQ ID NO: 126244 - DNA, 20 bp, Artificial
  CRISPR gRNA sequence
tttcactgatagttctgact

SEQ ID NO: 126245 - DNA, 20 bp, Artificial
  CRISPR gRNA sequence
atagttctgactgagttctg

SEQ ID NO: 126246 - DNA, 20 bp, Artificial
  CRISPR gRNA sequence
tgactgagttctgtagcccc

SEQ ID NO: 126247 - DNA, 20 bp, Artificial
  CRISPR gRNA sequence
gttctgtagcccctagtttt

SEQ ID NO: 126248 - DNA, 20 bp, Artificial
  CRISPR gRNA sequence
gtagcccctagtttttggtg

SEQ ID NO: 126249 - DNA, 20 bp, Artificial
  CRISPR gRNA sequence
tttttggtgaagattcatat

SEQ ID NO: 126250 - DNA, 20 bp, Artificial
  CRISPR gRNA sequence
tggtgaagattcatatgaga

SEQ ID NO: 126251 - DNA, 20 bp, Artificial
  CRISPR gRNA sequence
ggtgaagattcatatgagat

SEQ ID NO: 126252 - DNA, 20 bp, Artificial
  CRISPR gRNA sequence
tcatatgagataggaatatt

SEQ ID NO: 126253 - DNA, 20 bp, Artificial
  CRISPR gRNA sequence
catatgagataggaatatta

SEQ ID NO: 126254 - DNA, 20 bp, Artificial
  CRISPR gRNA sequence
gagataggaatattaaggaa

SEQ ID NO: 126255 - DNA, 20 bp, Artificial
  CRISPR gRNA sequence
gatttaaataaatttcaact

SEQ ID NO: 126256 - DNA, 20 bp, Artificial
  CRISPR gRNA sequence
aactcagttttttttaaatt

SEQ ID NO: 126257 - DNA, 20 bp, Artificial
  CRISPR gRNA sequence
tgagtatcatgttgtcatat

SEQ ID NO: 126258 - DNA, 20 bp, Artificial
  CRISPR gRNA sequence
ttgtcatattggtgaaataa

SEQ ID NO: 126259 - DNA, 20 bp, Artificial
  CRISPR gRNA sequence
tgtcatattggtgaaataaa

SEQ ID NO: 126260 - DNA, 20 bp, Artificial
  CRISPR gRNA sequence
gtcatattggtgaaataaaa

SEQ ID NO: 126261 - DNA, 20 bp, Artificial
  CRISPR gRNA sequence
tgaaataaaagggctatgtt

SEQ ID NO: 126262 - DNA, 20 bp, Artificial
  CRISPR gRNA sequence
tatgtaaactatatgctgct

SEQ ID NO: 126263 - DNA, 20 bp, Artificial
  CRISPR gRNA sequence
gctcagttatatgttgctcc

SEQ ID NO: 126264 - DNA, 20 bp, Artificial
  CRISPR gRNA sequence
ttgctcctagccaaacctca

SEQ ID NO: 126265 - DNA, 20 bp, Artificial
  CRISPR gRNA sequence
cctagccaaacctcatggtg

SEQ ID NO: 126266 - DNA, 20 bp, Artificial
  CRISPR gRNA sequence
ccaaacctcatggtgtagtg

SEQ ID NO: 126267 - DNA, 20 bp, Artificial
  CRISPR gRNA sequence
agtgtagtttaatcatgaat

SEQ ID NO: 126268 - DNA, 20 bp, Artificial
  CRISPR gRNA sequence
catgaatcagaaacttcatc

SEQ ID NO: 126269 - DNA, 20 bp, Artificial
  CRISPR gRNA sequence
aacttcatccagtctgtcta

SEQ ID NO: 126270 - DNA, 20 bp, Artificial
  CRISPR gRNA sequence
tgtctacagatttgtacaca

SEQ ID NO: 126271 - DNA, 20 bp, Artificial
  CRISPR gRNA sequence
gtctacagatttgtacacat

SEQ ID NO: 126272 - DNA, 20 bp, Artificial
  CRISPR gRNA sequence
tacagatttgtacacatggg

SEQ ID NO: 126273 - DNA, 20 bp, Artificial
  CRISPR gRNA sequence
gatttgtacacatgggcagt

SEQ ID NO: 126274 - DNA, 20 bp, Artificial
  CRISPR gRNA sequence
gtacacatgggcagttagct

SEQ ID NO: 126275 - DNA, 20 bp, Artificial
  CRISPR gRNA sequence
tacacatgggcagttagcta

SEQ ID NO: 126276 - DNA, 20 bp, Artificial
  CRISPR gRNA sequence
cagttagctaaggtacatgt

SEQ ID NO: 126277 - DNA, 20 bp, Artificial
  CRISPR gRNA sequence
gttagctaaggtacatgtta

SEQ ID NO: 126278 - DNA, 20 bp, Artificial
  CRISPR gRNA sequence
gctaaggtacatgttagaga

SEQ ID NO: 126279 - DNA, 20 bp, Artificial
  CRISPR gRNA sequence
ctaaggtacatgttagagat

SEQ ID NO: 126280 - DNA, 20 bp, Artificial
  CRISPR gRNA sequence
aaacgcaatataaaataatg

SEQ ID NO: 126281 - DNA, 20 bp, Artificial
  CRISPR gRNA sequence
atataaaataatgtggtttt

SEQ ID NO: 126282 - DNA, 20 bp, Artificial
  CRISPR gRNA sequence
tataaaataatgtggttttt

SEQ ID NO: 126283 - DNA, 20 bp, Artificial
  CRISPR gRNA sequence
ataaaataatgtggttttta

SEQ ID NO: 126284 - DNA, 20 bp, Artificial
  CRISPR gRNA sequence
ttagggaacattttttaaaa

SEQ ID NO: 126285 - DNA, 20 bp, Artificial
  CRISPR gRNA sequence
cattttttaaaatggaaaat

SEQ ID NO: 126286 - DNA, 20 bp, Artificial
  CRISPR gRNA sequence
ttttttaaaatggaaaattg

SEQ ID NO: 126287 - DNA, 20 bp, Artificial
  CRISPR gRNA sequence
tttttaaaatggaaaattgg

SEQ ID NO: 126288 - DNA, 20 bp, Artificial
  CRISPR gRNA sequence
gaggatttattattttgtcc

SEQ ID NO: 126289 - DNA, 20 bp, Artificial
  CRISPR gRNA sequence
caagactacatcattgatac

SEQ ID NO: 126290 - DNA, 20 bp, Artificial
  CRISPR gRNA sequence
aagactacatcattgatacc

SEQ ID NO: 126291 - DNA, 20 bp, Artificial
  CRISPR gRNA sequence
actacatcattgataccggg

SEQ ID NO: 126292 - DNA, 20 bp, Artificial
  CRISPR gRNA sequence
ataccgggcagaattgtaat

SEQ ID NO: 126293 - DNA, 20 bp, Artificial
  CRISPR gRNA sequence
gaattgtaatgagacattaa

SEQ ID NO: 126294 - DNA, 20 bp, Artificial
  CRISPR gRNA sequence
gacattaatggtacaacctt

SEQ ID NO: 126295 - DNA, 20 bp, Artificial
  CRISPR gRNA sequence
acaaccttaagatacaaccc

SEQ ID NO: 126296 - DNA, 20 bp, Artificial
  CRISPR gRNA sequence
ccttaagatacaacccaaga

SEQ ID NO: 126297 - DNA, 20 bp, Artificial
  CRISPR gRNA sequence
taagatacaacccaagaaag

SEQ ID NO: 126298 - DNA, 20 bp, Artificial
  CRISPR gRNA sequence
acaacccaagaaagtagata

SEQ ID NO: 126299 - DNA, 20 bp, Artificial
  CRISPR gRNA sequence
ttaactaattttttttcttt

SEQ ID NO: 126300 - DNA, 20 bp, Artificial
  CRISPR gRNA sequence
ttttttttcttttagctaac

SEQ ID NO: 126301 - DNA, 20 bp, Artificial
  CRISPR gRNA sequence
tcttttagctaaccagttac

SEQ ID NO: 126302 - DNA, 20 bp, Artificial
  CRISPR gRNA sequence
ttagctaaccagttaccagc

SEQ ID NO: 126303 - DNA, 20 bp, Artificial
  CRISPR gRNA sequence
accagctggcttaataacca

SEQ ID NO: 126304 - DNA, 20 bp, Artificial
  CRISPR gRNA sequence
gctggcttaataaccacaga

SEQ ID NO: 126305 - DNA, 20 bp, Artificial
  CRISPR gRNA sequence
cggtcaacaacaaaatgtta

SEQ ID NO: 126306 - DNA, 20 bp, Artificial
  CRISPR gRNA sequence
tttacacaacatcatatcaa

SEQ ID NO: 126307 - DNA, 20 bp, Artificial
  CRISPR gRNA sequence
ttacacaacatcatatcaac

SEQ ID NO: 126308 - DNA, 20 bp, Artificial
  CRISPR gRNA sequence
caacatcatatcaacaggta

SEQ ID NO: 126309 - DNA, 20 bp, Artificial
  CRISPR gRNA sequence
aaaaaatttgattgtatcga

SEQ ID NO: 126310 - DNA, 20 bp, Artificial
  CRISPR gRNA sequence
aaaaatttgattgtatcgac

SEQ ID NO: 126311 - DNA, 20 bp, Artificial
  CRISPR gRNA sequence
aaaatttgattgtatcgaca

SEQ ID NO: 126312 - DNA, 20 bp, Artificial
  CRISPR gRNA sequence
attgtatcgacagggcccca

SEQ ID NO: 126313 - DNA, 20 bp, Artificial
  CRISPR gRNA sequence
atggctcatgcctgtaatcc

SEQ ID NO: 126314 - DNA, 20 bp, Artificial
  CRISPR gRNA sequence
tgcctgtaatcccagcacct

SEQ ID NO: 126315 - DNA, 20 bp, Artificial
  CRISPR gRNA sequence
gcctgtaatcccagcacctt

SEQ ID NO: 126316 - DNA, 20 bp, Artificial
  CRISPR gRNA sequence
ctgtaatcccagcaccttgg

SEQ ID NO: 126317 - DNA, 20 bp, Artificial
  CRISPR gRNA sequence
tgtaatcccagcaccttggg

SEQ ID NO: 126318 - DNA, 20 bp, Artificial
  CRISPR gRNA sequence
tcccagcaccttgggaggcc

SEQ ID NO: 126319 - DNA, 20 bp, Artificial
  CRISPR gRNA sequence
cccagcaccttgggaggccg

SEQ ID NO: 126320 - DNA, 20 bp, Artificial
  CRISPR gRNA sequence
agcaccttgggaggccgagg

SEQ ID NO: 126321 - DNA, 20 bp, Artificial
  CRISPR gRNA sequence
gcaccttgggaggccgaggt

SEQ ID NO: 126322 - DNA, 20 bp, Artificial
  CRISPR gRNA sequence
ccttgggaggccgaggtggg

SEQ ID NO: 126323 - DNA, 20 bp, Artificial
  CRISPR gRNA sequence
ccgaggtgggtggatcacct

SEQ ID NO: 126324 - DNA, 20 bp, Artificial
  CRISPR gRNA sequence
cgaggtgggtggatcacctg

SEQ ID NO: 126325 - DNA, 20 bp, Artificial
  CRISPR gRNA sequence
gtgggtggatcacctgaggt

SEQ ID NO: 126326 - DNA, 20 bp, Artificial
  CRISPR gRNA sequence
tgggtggatcacctgaggtc

SEQ ID NO: 126327 - DNA, 20 bp, Artificial
  CRISPR gRNA sequence
ggtggatcacctgaggtcag

SEQ ID NO: 126328 - DNA, 20 bp, Artificial
  CRISPR gRNA sequence
tcacctgaggtcaggagttc

SEQ ID NO: 126329 - DNA, 20 bp, Artificial
  CRISPR gRNA sequence
tgaggtcaggagttcaagac

SEQ ID NO: 126330 - DNA, 20 bp, Artificial
  CRISPR gRNA sequence
tcaggagttcaagaccagcc

SEQ ID NO: 126331 - DNA, 20 bp, Artificial
  CRISPR gRNA sequence
caagaccagcctggccaaca

SEQ ID NO: 126332 - DNA, 20 bp, Artificial
  CRISPR gRNA sequence
tctactaaaaatacaaaaat

SEQ ID NO: 126333 - DNA, 20 bp, Artificial
  CRISPR gRNA sequence
ctaaaaatacaaaaattagc

SEQ ID NO: 126334 - DNA, 20 bp, Artificial
  CRISPR gRNA sequence
taaaaatacaaaaattagct

SEQ ID NO: 126335 - DNA, 20 bp, Artificial
  CRISPR gRNA sequence
caaaaattagctgggcgtca

SEQ ID NO: 126336 - DNA, 20 bp, Artificial
  CRISPR gRNA sequence
tacctgtaatcccctctgct

SEQ ID NO: 126337 - DNA, 20 bp, Artificial
  CRISPR gRNA sequence
cctgtaatcccctctgcttg

SEQ ID NO: 126338 - DNA, 20 bp, Artificial
  CRISPR gRNA sequence
ctgtaatcccctctgcttgg

SEQ ID NO: 126339 - DNA, 20 bp, Artificial
  CRISPR gRNA sequence
atcccctctgcttggaggct

SEQ ID NO: 126340 - DNA, 20 bp, Artificial
  CRISPR gRNA sequence
tcccctctgcttggaggctg

SEQ ID NO: 126341 - DNA, 20 bp, Artificial
  CRISPR gRNA sequence
cctctgcttggaggctgagg

SEQ ID NO: 126342 - DNA, 20 bp, Artificial
  CRISPR gRNA sequence
ctctgcttggaggctgaggc

SEQ ID NO: 126343 - DNA, 20 bp, Artificial
  CRISPR gRNA sequence
ctgcttggaggctgaggcag

SEQ ID NO: 126344 - DNA, 20 bp, Artificial
  CRISPR gRNA sequence
caggagaatcacttgaaccc

SEQ ID NO: 126345 - DNA, 20 bp, Artificial
  CRISPR gRNA sequence
ggagaatcacttgaaccctg

SEQ ID NO: 126346 - DNA, 20 bp, Artificial
  CRISPR gRNA sequence
gagaatcacttgaaccctgg

SEQ ID NO: 126347 - DNA, 20 bp, Artificial
  CRISPR gRNA sequence
aatcacttgaaccctggagg

SEQ ID NO: 126348 - DNA, 20 bp, Artificial
  CRISPR gRNA sequence
tcacttgaaccctggaggtg

SEQ ID NO: 126349 - DNA, 20 bp, Artificial
  CRISPR gRNA sequence
cacttgaaccctggaggtgg

SEQ ID NO: 126350 - DNA, 20 bp, Artificial
  CRISPR gRNA sequence
aaccctggaggtggaggttg

SEQ ID NO: 126351 - DNA, 20 bp, Artificial
  CRISPR gRNA sequence
ctggaggtggaggttgcagt

SEQ ID NO: 126352 - DNA, 20 bp, Artificial
  CRISPR gRNA sequence
ggtggaggttgcagtgagct

SEQ ID NO: 126353 - DNA, 20 bp, Artificial
  CRISPR gRNA sequence
gagatcacaccactgcactc

SEQ ID NO: 126354 - DNA, 20 bp, Artificial
  CRISPR gRNA sequence
cacaccactgcactccagcc

SEQ ID NO: 126355 - DNA, 20 bp, Artificial
  CRISPR gRNA sequence
acaccactgcactccagcct

SEQ ID NO: 126356 - DNA, 20 bp, Artificial
  CRISPR gRNA sequence
ctgcactccagcctgggcaa

SEQ ID NO: 126357 - DNA, 20 bp, Artificial
  CRISPR gRNA sequence
gcactccagcctgggcaata

SEQ ID NO: 126358 - DNA, 20 bp, Artificial
  CRISPR gRNA sequence
tccagcctgggcaatagagt

SEQ ID NO: 126359 - DNA, 20 bp, Artificial
  CRISPR gRNA sequence
ttttattatatctattgata

SEQ ID NO: 126360 - DNA, 20 bp, Artificial
  CRISPR gRNA sequence
gttaatttcaacatgctatt

SEQ ID NO: 126361 - DNA, 20 bp, Artificial
  CRISPR gRNA sequence
ttaatttcaacatgctatta

SEQ ID NO: 126362 - DNA, 20 bp, Artificial
  CRISPR gRNA sequence
atgctattaaggacctgata

SEQ ID NO: 126363 - DNA, 20 bp, Artificial
  CRISPR gRNA sequence
ctattaaggacctgataaag

SEQ ID NO: 126364 - DNA, 20 bp, Artificial
  CRISPR gRNA sequence
tattaaggacctgataaaga

SEQ ID NO: 126365 - DNA, 20 bp, Artificial
  CRISPR gRNA sequence
aaaattgtgttttctcaatg

SEQ ID NO: 126366 - DNA, 20 bp, Artificial
  CRISPR gRNA sequence
tgttttctcaatgtagataa

SEQ ID NO: 126367 - DNA, 20 bp, Artificial
  CRISPR gRNA sequence
tcaatgtagataacagtata

SEQ ID NO: 126368 - DNA, 20 bp, Artificial
  CRISPR gRNA sequence
agtatatagtgttctcttaa

SEQ ID NO: 126369 - DNA, 20 bp, Artificial
  CRISPR gRNA sequence
ttctcttaatagttaaaaat

SEQ ID NO: 126370 - DNA, 20 bp, Artificial
  CRISPR gRNA sequence
agcatatgttcatatttgca

SEQ ID NO: 126371 - DNA, 20 bp, Artificial
  CRISPR gRNA sequence
gcatatgttcatatttgcat

SEQ ID NO: 126372 - DNA, 20 bp, Artificial
  CRISPR gRNA sequence
atatgttcatatttgcatag

SEQ ID NO: 126373 - DNA, 20 bp, Artificial
  CRISPR gRNA sequence
atatttgcataggagatttc

SEQ ID NO: 126374 - DNA, 20 bp, Artificial
  CRISPR gRNA sequence
ttgcataggagatttctaga

SEQ ID NO: 126375 - DNA, 20 bp, Artificial
  CRISPR gRNA sequence
agatttctagaaagatacac

SEQ ID NO: 126376 - DNA, 20 bp, Artificial
  CRISPR gRNA sequence
ctagaaagatacacaagaaa

SEQ ID NO: 126377 - DNA, 20 bp, Artificial
  CRISPR gRNA sequence
tagaaagatacacaagaaat

SEQ ID NO: 126378 - DNA, 20 bp, Artificial
  CRISPR gRNA sequence
gatacacaagaaatgggaat

SEQ ID NO: 126379 - DNA, 20 bp, Artificial
  CRISPR gRNA sequence
gaatttttataatatgcata

SEQ ID NO: 126380 - DNA, 20 bp, Artificial
  CRISPR gRNA sequence
caatttaaattttctaatct

SEQ ID NO: 126381 - DNA, 20 bp, Artificial
  CRISPR gRNA sequence
attttctaatcttagatttc

SEQ ID NO: 126382 - DNA, 20 bp, Artificial
  CRISPR gRNA sequence
aatcttagatttctggtgtt

SEQ ID NO: 126383 - DNA, 20 bp, Artificial
  CRISPR gRNA sequence
tttctggtgttcagcaaatt

SEQ ID NO: 126384 - DNA, 20 bp, Artificial
  CRISPR gRNA sequence
aattcagttttcatgatctg

SEQ ID NO: 126385 - DNA, 20 bp, Artificial
  CRISPR gRNA sequence
ttcatgatctgaagaaatga

SEQ ID NO: 126386 - DNA, 20 bp, Artificial
  CRISPR gRNA sequence
gatctgaagaaatgatggaa

SEQ ID NO: 126387 - DNA, 20 bp, Artificial
  CRISPR gRNA sequence
atctgaagaaatgatggaat

SEQ ID NO: 126388 - DNA, 20 bp, Artificial
  CRISPR gRNA sequence
tctgaagaaatgatggaatg

SEQ ID NO: 126389 - DNA, 20 bp, Artificial
  CRISPR gRNA sequence
tgaagaaatgatggaatggg

SEQ ID NO: 126390 - DNA, 20 bp, Artificial
  CRISPR gRNA sequence
aaatgatggaatggggagtg

SEQ ID NO: 126391 - DNA, 20 bp, Artificial
  CRISPR gRNA sequence
atgatggaatggggagtgta

SEQ ID NO: 126392 - DNA, 20 bp, Artificial
  CRISPR gRNA sequence
aatggggagtgtagagaaat

SEQ ID NO: 126393 - DNA, 20 bp, Artificial
  CRISPR gRNA sequence
tggggagtgtagagaaatga

SEQ ID NO: 126394 - DNA, 20 bp, Artificial
  CRISPR gRNA sequence
aatgagagtctgtatgattc

SEQ ID NO: 126395 - DNA, 20 bp, Artificial
  CRISPR gRNA sequence
gagtctgtatgattctggaa

SEQ ID NO: 126396 - DNA, 20 bp, Artificial
  CRISPR gRNA sequence
gtctgtatgattctggaaca

SEQ ID NO: 126397 - DNA, 20 bp, Artificial
  CRISPR gRNA sequence
tgattctggaacagagacat

SEQ ID NO: 126398 - DNA, 20 bp, Artificial
  CRISPR gRNA sequence
ttctggaacagagacatcag

SEQ ID NO: 126399 - DNA, 20 bp, Artificial
  CRISPR gRNA sequence
tctggaacagagacatcaga

SEQ ID NO: 126400 - DNA, 20 bp, Artificial
  CRISPR gRNA sequence
gaacagagacatcagaagga

SEQ ID NO: 126401 - DNA, 20 bp, Artificial
  CRISPR gRNA sequence
gagacatcagaaggaaagac

SEQ ID NO: 126402 - DNA, 20 bp, Artificial
  CRISPR gRNA sequence
cagaaggaaagactggtgaa

SEQ ID NO: 126403 - DNA, 20 bp, Artificial
  CRISPR gRNA sequence
gatgtatctttgtatattaa

SEQ ID NO: 126404 - DNA, 20 bp, Artificial
  CRISPR gRNA sequence
gtatattaatagctgtaatg

SEQ ID NO: 126405 - DNA, 20 bp, Artificial
  CRISPR gRNA sequence
ttcctgatgcttgactaatt

SEQ ID NO: 126406 - DNA, 20 bp, Artificial
  CRISPR gRNA sequence
tcctgatgcttgactaattg

SEQ ID NO: 126407 - DNA, 20 bp, Artificial
  CRISPR gRNA sequence
tgaggtgttaattctgactt

SEQ ID NO: 126408 - DNA, 20 bp, Artificial
  CRISPR gRNA sequence
ctttttcatgaatgatttta

SEQ ID NO: 126409 - DNA, 20 bp, Artificial
  CRISPR gRNA sequence
aatgattttaaagaaaaatt

SEQ ID NO: 126410 - DNA, 20 bp, Artificial
  CRISPR gRNA sequence
aaagaaaaatttggatttta

SEQ ID NO: 126411 - DNA, 20 bp, Artificial
  CRISPR gRNA sequence
aagaaaaatttggattttaa

SEQ ID NO: 126412 - DNA, 20 bp, Artificial
  CRISPR gRNA sequence
aaaatatttttgttttgtac

SEQ ID NO: 126413 - DNA, 20 bp, Artificial
  CRISPR gRNA sequence
aatatttttgttttgtacga

SEQ ID NO: 126414 - DNA, 20 bp, Artificial
  CRISPR gRNA sequence
atattgcaatttattactgt

SEQ ID NO: 126415 - DNA, 20 bp, Artificial
  CRISPR gRNA sequence
attgcaatttattactgtca

SEQ ID NO: 126416 - DNA, 20 bp, Artificial
  CRISPR gRNA sequence
ttattactgtcagagatttg

SEQ ID NO: 126417 - DNA, 20 bp, Artificial
  CRISPR gRNA sequence
tactgtcagagatttgtaga

SEQ ID NO: 126418 - DNA, 20 bp, Artificial
  CRISPR gRNA sequence
tcatgttacttttgtaattc

SEQ ID NO: 126419 - DNA, 20 bp, Artificial
  CRISPR gRNA sequence
gttacttttgtaattcaagt

SEQ ID NO: 126420 - DNA, 20 bp, Artificial
  CRISPR gRNA sequence
acttttgtaattcaagtaag

SEQ ID NO: 126421 - DNA, 20 bp, Artificial
  CRISPR gRNA sequence
ttgtaattcaagtaagcggc

SEQ ID NO: 126422 - DNA, 20 bp, Artificial
  CRISPR gRNA sequence
tgtaattcaagtaagcggct

SEQ ID NO: 126423 - DNA, 20 bp, Artificial
  CRISPR gRNA sequence
ttgcccttttaataaaatat

SEQ ID NO: 126424 - DNA, 20 bp, Artificial
  CRISPR gRNA sequence
tgcccttttaataaaatata

SEQ ID NO: 126425 - DNA, 20 bp, Artificial
  CRISPR gRNA sequence
gcccttttaataaaatataa

SEQ ID NO: 126426 - DNA, 20 bp, Artificial
  CRISPR gRNA sequence
cttttaataaaatataaggg

SEQ ID NO: 126427 - DNA, 20 bp, Artificial
  CRISPR gRNA sequence
tttaataaaatataagggta

SEQ ID NO: 126428 - DNA, 20 bp, Artificial
  CRISPR gRNA sequence
gtagagttcattttgaatgc

SEQ ID NO: 126429 - DNA, 20 bp, Artificial
  CRISPR gRNA sequence
gttgcctttattataaattt

SEQ ID NO: 126430 - DNA, 20 bp, Artificial
  CRISPR gRNA sequence
ttataaatttgagtttgtct

SEQ ID NO: 126431 - DNA, 20 bp, Artificial
  CRISPR gRNA sequence
ttataccttgcatgataacc

SEQ ID NO: 126432 - DNA, 20 bp, Artificial
  CRISPR gRNA sequence
accttgcatgataacctagc

SEQ ID NO: 126433 - DNA, 20 bp, Artificial
  CRISPR gRNA sequence
tgataacctagctagatttc

SEQ ID NO: 126434 - DNA, 20 bp, Artificial
  CRISPR gRNA sequence
tattaaaattattatttttt

SEQ ID NO: 126435 - DNA, 20 bp, Artificial
  CRISPR gRNA sequence
tttttttggtaaaacattaa

SEQ ID NO: 126436 - DNA, 20 bp, Artificial
  CRISPR gRNA sequence
tggtaaaacattaatagttt

SEQ ID NO: 126437 - DNA, 20 bp, Artificial
  CRISPR gRNA sequence
taaaacattaatagtttaag

SEQ ID NO: 126438 - DNA, 20 bp, Artificial
  CRISPR gRNA sequence
tttaaaaaatgtaattgaat

SEQ ID NO: 126439 - DNA, 20 bp, Artificial
  CRISPR gRNA sequence
taattgaataagtgtgaatg

SEQ ID NO: 126440 - DNA, 20 bp, Artificial
  CRISPR gRNA sequence
ttgaataagtgtgaatgcag

SEQ ID NO: 126441 - DNA, 20 bp, Artificial
  CRISPR gRNA sequence
attgtctgccctgttaaact

SEQ ID NO: 126442 - DNA, 20 bp, Artificial
  CRISPR gRNA sequence
ttaaacttggtgcccattaa

SEQ ID NO: 126443 - DNA, 20 bp, Artificial
  CRISPR gRNA sequence
gttcatcgtgcctgttaatg

SEQ ID NO: 126444 - DNA, 20 bp, Artificial
  CRISPR gRNA sequence
cgtgcctgttaatgtagttt

SEQ ID NO: 126445 - DNA, 20 bp, Artificial
  CRISPR gRNA sequence
gttaatgtagttttagttac

SEQ ID NO: 126446 - DNA, 20 bp, Artificial
  CRISPR gRNA sequence
taatgtagttttagttactg

SEQ ID NO: 126447 - DNA, 20 bp, Artificial
  CRISPR gRNA sequence
ttagttactggagctttttt

SEQ ID NO: 126448 - DNA, 20 bp, Artificial
  CRISPR gRNA sequence
tactggagcttttttaagac

SEQ ID NO: 126449 - DNA, 20 bp, Artificial
  CRISPR gRNA sequence
agcttttttaagactagatt

SEQ ID NO: 126450 - DNA, 20 bp, Artificial
  CRISPR gRNA sequence
ttaagactagatttggtttt

SEQ ID NO: 126451 - DNA, 20 bp, Artificial
  CRISPR gRNA sequence
tggttttgagttacattttt

SEQ ID NO: 126452 - DNA, 20 bp, Artificial
  CRISPR gRNA sequence
gagttacatttttaagaatg

SEQ ID NO: 126453 - DNA, 20 bp, Artificial
  CRISPR gRNA sequence
agttacatttttaagaatgt

SEQ ID NO: 126454 - DNA, 20 bp, Artificial
  CRISPR gRNA sequence
aagaatgtgggaatatattt

SEQ ID NO: 126455 - DNA, 20 bp, Artificial
  CRISPR gRNA sequence
gaatatatttaagtttaatg

SEQ ID NO: 126456 - DNA, 20 bp, Artificial
  CRISPR gRNA sequence
atttaagtttaatgtagtcc

SEQ ID NO: 126457 - DNA, 20 bp, Artificial
  CRISPR gRNA sequence
tagtcctagtgctcttgaaa

SEQ ID NO: 126458 - DNA, 20 bp, Artificial
  CRISPR gRNA sequence
gaaatggtgcccctttcatt

SEQ ID NO: 126459 - DNA, 20 bp, Artificial
  CRISPR gRNA sequence
ttttttcaaatcatatcttc

SEQ ID NO: 126460 - DNA, 20 bp, Artificial
  CRISPR gRNA sequence
aatcatatcttcaagtacta

SEQ ID NO: 126461 - DNA, 20 bp, Artificial
  CRISPR gRNA sequence
agtactatagtattctctta

SEQ ID NO: 126462 - DNA, 20 bp, Artificial
  CRISPR gRNA sequence
actatagtattctcttacag

SEQ ID NO: 126463 - DNA, 20 bp, Artificial
  CRISPR gRNA sequence
tatagtattctcttacagaa

SEQ ID NO: 126464 - DNA, 20 bp, Artificial
  CRISPR gRNA sequence
atagtattctcttacagaag

SEQ ID NO: 126465 - DNA, 20 bp, Artificial
  CRISPR gRNA sequence
agtattctcttacagaagag

SEQ ID NO: 126466 - DNA, 20 bp, Artificial
  CRISPR gRNA sequence
cttacagaagaggagtttta

SEQ ID NO: 126467 - DNA, 20 bp, Artificial
  CRISPR gRNA sequence
agaggagttttatagtctga

SEQ ID NO: 126468 - DNA, 20 bp, Artificial
  CRISPR gRNA sequence
acctttttaattgaaatgtc

SEQ ID NO: 126469 - DNA, 20 bp, Artificial
  CRISPR gRNA sequence
tcaagtttcctgttacacta

SEQ ID NO: 126470 - DNA, 20 bp, Artificial
  CRISPR gRNA sequence
cctgttacactatggaaacc

SEQ ID NO: 126471 - DNA, 20 bp, Artificial
  CRISPR gRNA sequence
ctatggaaaccaagaaacat

SEQ ID NO: 126472 - DNA, 20 bp, Artificial
  CRISPR gRNA sequence
atcagacatcattgcgtgta

SEQ ID NO: 126473 - DNA, 20 bp, Artificial
  CRISPR gRNA sequence
gcgtgtacagaccttttgca

SEQ ID NO: 126474 - DNA, 20 bp, Artificial
  CRISPR gRNA sequence
cgtgtacagaccttttgcat

SEQ ID NO: 126475 - DNA, 20 bp, Artificial
  CRISPR gRNA sequence
tacagaccttttgcatgggt

SEQ ID NO: 126476 - DNA, 20 bp, Artificial
  CRISPR gRNA sequence
agaccttttgcatgggtgag

SEQ ID NO: 126477 - DNA, 20 bp, Artificial
  CRISPR gRNA sequence
gcatgggtgagtggatgaaa

SEQ ID NO: 126478 - DNA, 20 bp, Artificial
  CRISPR gRNA sequence
atgggtgagtggatgaaatg

SEQ ID NO: 126479 - DNA, 20 bp, Artificial
  CRISPR gRNA sequence
tgagtggatgaaatggagaa

SEQ ID NO: 126480 - DNA, 20 bp, Artificial
  CRISPR gRNA sequence
agtggatgaaatggagaaca

SEQ ID NO: 126481 - DNA, 20 bp, Artificial
  CRISPR gRNA sequence
gatgaaatggagaacagagt

SEQ ID NO: 126482 - DNA, 20 bp, Artificial
  CRISPR gRNA sequence
aacagagtgagtgctgtgaa

SEQ ID NO: 126483 - DNA, 20 bp, Artificial
  CRISPR gRNA sequence
gtgctgtgaacggtgtgaaa

SEQ ID NO: 126484 - DNA, 20 bp, Artificial
  CRISPR gRNA sequence
ctgtgaacggtgtgaaatag

SEQ ID NO: 126485 - DNA, 20 bp, Artificial
  CRISPR gRNA sequence
gtgaaatagaagccaacttc

SEQ ID NO: 126486 - DNA, 20 bp, Artificial
  CRISPR gRNA sequence
taatgtaactttgtataatt

SEQ ID NO: 126487 - DNA, 20 bp, Artificial
  CRISPR gRNA sequence
tgtaactttgtataatttag

SEQ ID NO: 126488 - DNA, 20 bp, Artificial
  CRISPR gRNA sequence
ataatttagtagtatgtact

SEQ ID NO: 126489 - DNA, 20 bp, Artificial
  CRISPR gRNA sequence
ttggattgtttctttttgaa

SEQ ID NO: 126490 - DNA, 20 bp, Artificial
  CRISPR gRNA sequence
attgtttctttttgaaaagt

SEQ ID NO: 126491 - DNA, 20 bp, Artificial
  CRISPR gRNA sequence
ttgtttctttttgaaaagtg

SEQ ID NO: 126492 - DNA, 20 bp, Artificial
  CRISPR gRNA sequence
attttctcatctattctttt

SEQ ID NO: 126493 - DNA, 20 bp, Artificial
  CRISPR gRNA sequence
tttttggtgttaattaactt

SEQ ID NO: 126494 - DNA, 20 bp, Artificial
  CRISPR gRNA sequence
ttttggtgttaattaacttg

SEQ ID NO: 126495 - DNA, 20 bp, Artificial
  CRISPR gRNA sequence
tttggtgttaattaacttga

SEQ ID NO: 126496 - DNA, 20 bp, Artificial
  CRISPR gRNA sequence
acttgagggatttctttttt

SEQ ID NO: 126497 - DNA, 20 bp, Artificial
  CRISPR gRNA sequence
tatcaaaaattgctattgta

SEQ ID NO: 126498 - DNA, 20 bp, Artificial
  CRISPR gRNA sequence
ctattgtatagtttgcctaa

SEQ ID NO: 126499 - DNA, 20 bp, Artificial
  CRISPR gRNA sequence
tattgtatagtttgcctaaa

SEQ ID NO: 126500 - DNA, 20 bp, Artificial
  CRISPR gRNA sequence
tgtatagtttgcctaaaagg

SEQ ID NO: 126501 - DNA, 20 bp, Artificial
  CRISPR gRNA sequence
tagtttgcctaaaaggaagt

SEQ ID NO: 126502 - DNA, 20 bp, Artificial
  CRISPR gRNA sequence
gtttgcctaaaaggaagttg

SEQ ID NO: 126503 - DNA, 20 bp, Artificial
  CRISPR gRNA sequence
tggagtgaatatcatctttg

SEQ ID NO: 126504 - DNA, 20 bp, Artificial
  CRISPR gRNA sequence
ggagtgaatatcatctttga

SEQ ID NO: 126505 - DNA, 20 bp, Artificial
  CRISPR gRNA sequence
tgaaggacactcaaatttat

SEQ ID NO: 126506 - DNA, 20 bp, Artificial
  CRISPR gRNA sequence
gaaggacactcaaatttata

SEQ ID NO: 126507 - DNA, 20 bp, Artificial
  CRISPR gRNA sequence
ggacactcaaatttataagg

SEQ ID NO: 126508 - DNA, 20 bp, Artificial
  CRISPR gRNA sequence
cactcaaatttataaggtag

SEQ ID NO: 126509 - DNA, 20 bp, Artificial
  CRISPR gRNA sequence
ataaggtagaagcaatttcc

SEQ ID NO: 126510 - DNA, 20 bp, Artificial
  CRISPR gRNA sequence
tagaagcaatttcccagata

SEQ ID NO: 126511 - DNA, 20 bp, Artificial
  CRISPR gRNA sequence
agaagcaatttcccagatat

SEQ ID NO: 126512 - DNA, 20 bp, Artificial
  CRISPR gRNA sequence
tttcccagatataggctgaa

SEQ ID NO: 126513 - DNA, 20 bp, Artificial
  CRISPR gRNA sequence
aacagaaacatttactttgc

SEQ ID NO: 126514 - DNA, 20 bp, Artificial
  CRISPR gRNA sequence
agaaacatttactttgccag

SEQ ID NO: 126515 - DNA, 20 bp, Artificial
  CRISPR gRNA sequence
gaaacatttactttgccaga

SEQ ID NO: 126516 - DNA, 20 bp, Artificial
  CRISPR gRNA sequence
aacatttactttgccagaag

SEQ ID NO: 126517 - DNA, 20 bp, Artificial
  CRISPR gRNA sequence
actttgccagaaggagcctt

SEQ ID NO: 126518 - DNA, 20 bp, Artificial
  CRISPR gRNA sequence
ctttgccagaaggagccttt

SEQ ID NO: 126519 - DNA, 20 bp, Artificial
  CRISPR gRNA sequence
ttgccagaaggagcctttag

SEQ ID NO: 126520 - DNA, 20 bp, Artificial
  CRISPR gRNA sequence
ggagcctttaggagtatatg

SEQ ID NO: 126521 - DNA, 20 bp, Artificial
  CRISPR gRNA sequence
gagcctttaggagtatatgt

SEQ ID NO: 126522 - DNA, 20 bp, Artificial
  CRISPR gRNA sequence
aggagtatatgtgggctaat

SEQ ID NO: 126523 - DNA, 20 bp, Artificial
  CRISPR gRNA sequence
gagtatatgtgggctaatca

SEQ ID NO: 126524 - DNA, 20 bp, Artificial
  CRISPR gRNA sequence
agtatatgtgggctaatcag

SEQ ID NO: 126525 - DNA, 20 bp, Artificial
  CRISPR gRNA sequence
ttaaaaaacaaacttcattg

SEQ ID NO: 126526 - DNA, 20 bp, Artificial
  CRISPR gRNA sequence
ttcattgtagtaaattcaaa

SEQ ID NO: 126527 - DNA, 20 bp, Artificial
  CRISPR gRNA sequence
tcattgtagtaaattcaaat

SEQ ID NO: 126528 - DNA, 20 bp, Artificial
  CRISPR gRNA sequence
taaattcaaataggaaaaaa

SEQ ID NO: 126529 - DNA, 20 bp, Artificial
  CRISPR gRNA sequence
aaattcaaataggaaaaaat

SEQ ID NO: 126530 - DNA, 20 bp, Artificial
  CRISPR gRNA sequence
aattcaaataggaaaaaatg

SEQ ID NO: 126531 - DNA, 20 bp, Artificial
  CRISPR gRNA sequence
attcaaataggaaaaaatgg

SEQ ID NO: 126532 - DNA, 20 bp, Artificial
  CRISPR gRNA sequence
tcaaataggaaaaaatgggg

SEQ ID NO: 126533 - DNA, 20 bp, Artificial
  CRISPR gRNA sequence
aataggaaaaaatgggggag

SEQ ID NO: 126534 - DNA, 20 bp, Artificial
  CRISPR gRNA sequence
gaaaaaatgggggagtagtt

SEQ ID NO: 126535 - DNA, 20 bp, Artificial
  CRISPR gRNA sequence
gagtagttaagcaaaatcaa

SEQ ID NO: 126536 - DNA, 20 bp, Artificial
  CRISPR gRNA sequence
cagtcatcctactatgttga

SEQ ID NO: 126537 - DNA, 20 bp, Artificial
  CRISPR gRNA sequence
tatgtatatttttataaaaa

SEQ ID NO: 126538 - DNA, 20 bp, Artificial
  CRISPR gRNA sequence
atgtatatttttataaaaat

SEQ ID NO: 126539 - DNA, 20 bp, Artificial
  CRISPR gRNA sequence
tttttcacttaacaatatat

SEQ ID NO: 126540 - DNA, 20 bp, Artificial
  CRISPR gRNA sequence
ttttcacttaacaatatatt

SEQ ID NO: 126541 - DNA, 20 bp, Artificial
  CRISPR gRNA sequence
tatattgggaacatcttttc

SEQ ID NO: 126542 - DNA, 20 bp, Artificial
  CRISPR gRNA sequence
atattgggaacatcttttcc

SEQ ID NO: 126543 - DNA, 20 bp, Artificial
  CRISPR gRNA sequence
catcttttccaggtcatgca

SEQ ID NO: 126544 - DNA, 20 bp, Artificial
  CRISPR gRNA sequence
gtcttctgcatcatttttat

SEQ ID NO: 126545 - DNA, 20 bp, Artificial
  CRISPR gRNA sequence
taattcatttaatcttctat

SEQ ID NO: 126546 - DNA, 20 bp, Artificial
  CRISPR gRNA sequence
tgactatttacatcttttca

SEQ ID NO: 126547 - DNA, 20 bp, Artificial
  CRISPR gRNA sequence
catcttttcacagttataaa

SEQ ID NO: 126548 - DNA, 20 bp, Artificial
  CRISPR gRNA sequence
tcttaaattctttgaattgc

SEQ ID NO: 126549 - DNA, 20 bp, Artificial
  CRISPR gRNA sequence
cttaaattctttgaattgct

SEQ ID NO: 126550 - DNA, 20 bp, Artificial
  CRISPR gRNA sequence
taccaaatatgcaaaatttt

SEQ ID NO: 126551 - DNA, 20 bp, Artificial
  CRISPR gRNA sequence
accaaatatgcaaaatttta

SEQ ID NO: 126552 - DNA, 20 bp, Artificial
  CRISPR gRNA sequence
ggcttttgatacttcgttat

SEQ ID NO: 126553 - DNA, 20 bp, Artificial
  CRISPR gRNA sequence
ttcgttatgagtgtattttt

SEQ ID NO: 126554 - DNA, 20 bp, Artificial
  CRISPR gRNA sequence
agatattttccacttgatcc

SEQ ID NO: 126555 - DNA, 20 bp, Artificial
  CRISPR gRNA sequence
tattttccacttgatccaag

SEQ ID NO: 126556 - DNA, 20 bp, Artificial
  CRISPR gRNA sequence
tgtcactatataactgataa

SEQ ID NO: 126557 - DNA, 20 bp, Artificial
  CRISPR gRNA sequence
atataactgataaaagcact

SEQ ID NO: 126558 - DNA, 20 bp, Artificial
  CRISPR gRNA sequence
agcacttggtctttgattat

SEQ ID NO: 126559 - DNA, 20 bp, Artificial
  CRISPR gRNA sequence
ctgtctctaaaattatttta

SEQ ID NO: 126560 - DNA, 20 bp, Artificial
  CRISPR gRNA sequence
ttaaagattaatatttgttc

SEQ ID NO: 126561 - DNA, 20 bp, Artificial
  CRISPR gRNA sequence
aagattaatatttgttcaag

SEQ ID NO: 126562 - DNA, 20 bp, Artificial
  CRISPR gRNA sequence
gattaatatttgttcaagta

SEQ ID NO: 126563 - DNA, 20 bp, Artificial
  CRISPR gRNA sequence
atttgttcaagtagagaatg

SEQ ID NO: 126564 - DNA, 20 bp, Artificial
  CRISPR gRNA sequence
agtagagaatgaagataaaa

SEQ ID NO: 126565 - DNA, 20 bp, Artificial
  CRISPR gRNA sequence
gtagagaatgaagataaaaa

SEQ ID NO: 126566 - DNA, 20 bp, Artificial
  CRISPR gRNA sequence
tgaagataaaaaaggaattt

SEQ ID NO: 126567 - DNA, 20 bp, Artificial
  CRISPR gRNA sequence
gaagataaaaaaggaatttg

SEQ ID NO: 126568 - DNA, 20 bp, Artificial
  CRISPR gRNA sequence
ataaaaaaggaatttgaggc

SEQ ID NO: 126569 - DNA, 20 bp, Artificial
  CRISPR gRNA sequence
taaaaaaggaatttgaggcc

SEQ ID NO: 126570 - DNA, 20 bp, Artificial
  CRISPR gRNA sequence
aaggaatttgaggccaggta

SEQ ID NO: 126571 - DNA, 20 bp, Artificial
  CRISPR gRNA sequence
aggaatttgaggccaggtat

SEQ ID NO: 126572 - DNA, 20 bp, Artificial
  CRISPR gRNA sequence
ggaatttgaggccaggtatg

SEQ ID NO: 126573 - DNA, 20 bp, Artificial
  CRISPR gRNA sequence
gttatatagtgacacactgc

SEQ ID NO: 126574 - DNA, 20 bp, Artificial
  CRISPR gRNA sequence
tttggtaacccagcaattca

SEQ ID NO: 126575 - DNA, 20 bp, Artificial
  CRISPR gRNA sequence
aagaatttaagaaaacagtc

SEQ ID NO: 126576 - DNA, 20 bp, Artificial
  CRISPR gRNA sequence
aaaacagtcatggatgtaca

SEQ ID NO: 126577 - DNA, 20 bp, Artificial
  CRISPR gRNA sequence
aatatccaatagaagattaa

SEQ ID NO: 126578 - DNA, 20 bp, Artificial
  CRISPR gRNA sequence
gaagattaaatgaattatga

SEQ ID NO: 126579 - DNA, 20 bp, Artificial
  CRISPR gRNA sequence
attatgattgagtcatacag

SEQ ID NO: 126580 - DNA, 20 bp, Artificial
  CRISPR gRNA sequence
cattggttctttcaacatag

SEQ ID NO: 126581 - DNA, 20 bp, Artificial
  CRISPR gRNA sequence
actcccccattttttcctat

SEQ ID NO: 126582 - DNA, 20 bp, Artificial
  CRISPR gRNA sequence
tgaagtttgttttttaaatg

SEQ ID NO: 126583 - DNA, 20 bp, Artificial
  CRISPR gRNA sequence
attgcttctaccttataaat

SEQ ID NO: 126584 - DNA, 20 bp, Artificial
  CRISPR gRNA sequence
tcaagttaattaacaccaaa

SEQ ID NO: 126585 - DNA, 20 bp, Artificial
  CRISPR gRNA sequence
ataaaactcctcttctgtaa

SEQ ID NO: 126586 - DNA, 20 bp, Artificial
  CRISPR gRNA sequence
ttattaaaagggcaaacatc

SEQ ID NO: 126587 - DNA, 20 bp, Artificial
  CRISPR gRNA sequence
gaattaacccagccgcttac

SEQ ID NO: 126588 - DNA, 20 bp, Artificial
  CRISPR gRNA sequence
ttgcaatatacaatgcatac

SEQ ID NO: 126589 - DNA, 20 bp, Artificial
  CRISPR gRNA sequence
catgaaaaagattctcaagt

SEQ ID NO: 126590 - DNA, 20 bp, Artificial
  CRISPR gRNA sequence
tccttctgatgtctctgttc

SEQ ID NO: 126591 - DNA, 20 bp, Artificial
  CRISPR gRNA sequence
atttcttcagatcatgaaaa

SEQ ID NO: 126592 - DNA, 20 bp, Artificial
  CRISPR gRNA sequence
attagaaaatttaaattgag

SEQ ID NO: 126593 - DNA, 20 bp, Artificial
  CRISPR gRNA sequence
atgcatattataaaaattca

SEQ ID NO: 126594 - DNA, 20 bp, Artificial
  CRISPR gRNA sequence
aaaaaattttttttttgaga

SEQ ID NO: 126595 - DNA, 20 bp, Artificial
  CRISPR gRNA sequence
tctcactctattgcccaggc

SEQ ID NO: 126596 - DNA, 20 bp, Artificial
  CRISPR gRNA sequence
ctcactgcaacctccacctc

SEQ ID NO: 126597 - DNA, 20 bp, Artificial
  CRISPR gRNA sequence
tgcctcagcctccaagcaga

SEQ ID NO: 126598 - DNA, 20 bp, Artificial
  CRISPR gRNA sequence
ttttgtatttttagtagaga

SEQ ID NO: 126599 - DNA, 20 bp, Artificial
  CRISPR gRNA sequence
acctcggcctcccaaggtgc

SEQ ID NO: 126600 - DNA, 20 bp, Artificial
  CRISPR gRNA sequence
aatgaactatatctactttc

SEQ ID NO: 126601 - DNA, 20 bp, Artificial
  CRISPR gRNA sequence
tgtacaaatctgtagacaga

SEQ ID NO: 126602 - DNA, 20 bp, Artificial
  CRISPR gRNA sequence
gatactcaatttaaaaaaaa

SEQ ID NO: 126603 - DNA, 20 bp, Artificial
  CRISPR gRNA sequence
ccttaatattcctatctcat

SEQ ID NO: 126604 - DNA, 20 bp, Artificial
  CRISPR gRNA sequence
gtgaaaggttataatgtcta

SEQ ID NO: 126605 - DNA, 20 bp, Artificial
  CRISPR gRNA sequence
aataccattagatacttagt

SEQ ID NO: 126606 - DNA, 20 bp, Artificial
  CRISPR gRNA sequence
ctattattacaaactctaag

SEQ ID NO: 126607 - DNA, 20 bp, Artificial
  CRISPR gRNA sequence
agctgtaatcattaacaaga

SEQ ID NO: 126608 - DNA, 20 bp, Artificial
  CRISPR gRNA sequence
ctaattccacatcatatcaa

SEQ ID NO: 126609 - DNA, 20 bp, Artificial
  CRISPR gRNA sequence
gggcagtactgtagcaagct

SEQ ID NO: 126610 - DNA, 20 bp, Artificial
  CRISPR gRNA sequence
agatctgtaaaaataatgtc

SEQ ID NO: 126611 - DNA, 20 bp, Artificial
  CRISPR gRNA sequence
tgcaaatatcactaatttaa

SEQ ID NO: 126612 - DNA, 20 bp, Artificial
  CRISPR gRNA sequence
attcaaacactaaagatatt

SEQ ID NO: 126613 - DNA, 20 bp, Artificial
  CRISPR gRNA sequence
gaatatattttgaaagtaat

SEQ ID NO: 126614 - DNA, 20 bp, Artificial
  CRISPR gRNA sequence
gataaacctaagaaatatag

SEQ ID NO: 126615 - DNA, 20 bp, Artificial
  CRISPR gRNA sequence
aaataatctgtccaaggcca

SEQ ID NO: 126616 - DNA, 20 bp, Artificial
  CRISPR gRNA sequence
gaatttgcatgtggcagagc

SEQ ID NO: 126617 - DNA, 20 bp, Artificial
  CRISPR gRNA sequence
ggattcagcctcctggtagt

SEQ ID NO: 126618 - DNA, 20 bp, Artificial
  CRISPR gRNA sequence
aacccccaggctgcagactg

SEQ ID NO: 126619 - DNA, 20 bp, Artificial
  CRISPR gRNA sequence
ccagccacacagcaggaggt

SEQ ID NO: 126620 - DNA, 20 bp, Artificial
  CRISPR gRNA sequence
tattgtgaactgcgcatgca

SEQ ID NO: 126621 - DNA, 20 bp, Artificial
  CRISPR gRNA sequence
ctaggctgtgcgttccttat

SEQ ID NO: 126622 - DNA, 20 bp, Artificial
  CRISPR gRNA sequence
gttacataatttactacaaa

SEQ ID NO: 126623 - DNA, 20 bp, Artificial
  CRISPR gRNA sequence
actttgggaggccgaggcag

SEQ ID NO: 126624 - DNA, 20 bp, Artificial
  CRISPR gRNA sequence
caggtggatcacctgaggtc

SEQ ID NO: 126625 - DNA, 20 bp, Artificial
  CRISPR gRNA sequence
tactcaggaggctgaggcag

SEQ ID NO: 126626 - DNA, 20 bp, Artificial
  CRISPR gRNA sequence
gagatattttatttacctct

SEQ ID NO: 126627 - DNA, 20 bp, Artificial
  CRISPR gRNA sequence
cctaaagtagacatagcaaa

SEQ ID NO: 126628 - DNA, 20 bp, Artificial
  CRISPR gRNA sequence
gctatcaaaagtccacacct

SEQ ID NO: 126629 - DNA, 20 bp, Artificial
  CRISPR gRNA sequence
aaaagtccacacctcagagt

SEQ ID NO: 126630 - DNA, 20 bp, Artificial
  CRISPR gRNA sequence
caaatctaatttagatgtaa

SEQ ID NO: 126631 - DNA, 20 bp, Artificial
  CRISPR gRNA sequence
agatgtaaaagagtgcctgg

SEQ ID NO: 126632 - DNA, 20 bp, Artificial
  CRISPR gRNA sequence
actttgggaggccgaggcgg

SEQ ID NO: 126633 - DNA, 20 bp, Artificial
  CRISPR gRNA sequence
cgggcggatgacctgaggtc

SEQ ID NO: 126634 - DNA, 20 bp, Artificial
  CRISPR gRNA sequence
ctgtaattgctgctactcag

SEQ ID NO: 126635 - DNA, 20 bp, Artificial
  CRISPR gRNA sequence
tactcaggaggatgaggcag

SEQ ID NO: 126636 - DNA, 20 bp, Artificial
  CRISPR gRNA sequence
aagatataaaacagcaatca

SEQ ID NO: 126637 - DNA, 20 bp, Artificial
  CRISPR gRNA sequence
gatgttcctaccaccccaca

SEQ ID NO: 126638 - DNA, 20 bp, Artificial
  CRISPR gRNA sequence
ttctctgccctagcatttcc

SEQ ID NO: 126639 - DNA, 20 bp, Artificial
  CRISPR gRNA sequence
gcaaaacaggaactaaaaaa

SEQ ID NO: 126640 - DNA, 20 bp, Artificial
  CRISPR gRNA sequence
actttgacttttttattatt

SEQ ID NO: 126641 - DNA, 20 bp, Artificial
  CRISPR gRNA sequence
cacagtgtcagatacaggtt

SEQ ID NO: 126642 - DNA, 20 bp, Artificial
  CRISPR gRNA sequence
ataaaaacaatttttccctt

SEQ ID NO: 126643 - DNA, 20 bp, Artificial
  CRISPR gRNA sequence
caatttttcccttaagggtc

SEQ ID NO: 126644 - DNA, 20 bp, Artificial
  CRISPR gRNA sequence
ggtctaaaaatgaaactcca

SEQ ID NO: 126645 - DNA, 20 bp, Artificial
  CRISPR gRNA sequence
aaattcttaccatttaaaca

SEQ ID NO: 126646 - DNA, 20 bp, Artificial
  CRISPR gRNA sequence
tagaaaatgatataaaacgt

SEQ ID NO: 126647 - DNA, 20 bp, Artificial
  CRISPR gRNA sequence
ccaagtgatgagcaatgaca

SEQ ID NO: 126648 - DNA, 20 bp, Artificial
  CRISPR gRNA sequence
aaatagctgtttccaaatac

SEQ ID NO: 126649 - DNA, 20 bp, Artificial
  CRISPR gRNA sequence
gtctgatctcggaagctaag

SEQ ID NO: 126650 - DNA, 20 bp, Artificial
  CRISPR gRNA sequence
gggtcgggcctggttagtac

SEQ ID NO: 126651 - DNA, 20 bp, Artificial
  CRISPR gRNA sequence
accaggggaggctgaggcag

SEQ ID NO: 126652 - DNA, 20 bp, Artificial
  CRISPR gRNA sequence
cagcactttggtaggccaag

SEQ ID NO: 126653 - DNA, 20 bp, Artificial
  CRISPR gRNA sequence
actttggtaggccaaggcgg

SEQ ID NO: 126654 - DNA, 20 bp, Artificial
  CRISPR gRNA sequence
cggatggatcacctgaggtc

SEQ ID NO: 126655 - DNA, 20 bp, Artificial
  CRISPR gRNA sequence
tactcgggaggctgaggcag

SEQ ID NO: 126656 - DNA, 20 bp, Artificial
  CRISPR gRNA sequence
tgcactccagcctggccaat

SEQ ID NO: 126657 - DNA, 20 bp, Artificial
  CRISPR gRNA sequence
gagaacatttagggacatga

SEQ ID NO: 126658 - DNA, 20 bp, Artificial
  CRISPR gRNA sequence
atatttgatttgctgaaagc

SEQ ID NO: 126659 - DNA, 20 bp, Artificial
  CRISPR gRNA sequence
gctaactgtacccatgacct

SEQ ID NO: 126660 - DNA, 20 bp, Artificial
  CRISPR gRNA sequence
aaaaaactaccaaagtgatc

SEQ ID NO: 126661 - DNA, 20 bp, Artificial
  CRISPR gRNA sequence
tcacctcttaaccattattt

SEQ ID NO: 126662 - DNA, 20 bp, Artificial
  CRISPR gRNA sequence
cttaaccattatttagggat

SEQ ID NO: 126663 - DNA, 20 bp, Artificial
  CRISPR gRNA sequence
ccttttctcttacacatttt

SEQ ID NO: 126664 - DNA, 20 bp, Artificial
  CRISPR gRNA sequence
gatttttgctacttaatgtc

SEQ ID NO: 126665 - DNA, 20 bp, Artificial
  CRISPR gRNA sequence
gcttggtacagcaccttcca

SEQ ID NO: 126666 - DNA, 20 bp, Artificial
  CRISPR gRNA sequence
agtttatataaaattcttta

SEQ ID NO: 126667 - DNA, 20 bp, Artificial
  CRISPR gRNA sequence
tgtgtttaaaatgatgttat

SEQ ID NO: 126668 - DNA, 20 bp, Artificial
  CRISPR gRNA sequence
tgttatcagaattaatttat

SEQ ID NO: 126669 - DNA, 20 bp, Artificial
  CRISPR gRNA sequence
atttatttgaatatccgttt

SEQ ID NO: 126670 - DNA, 20 bp, Artificial
  CRISPR gRNA sequence
caggcagatcatctgaggtc

SEQ ID NO: 126671 - DNA, 20 bp, Artificial
  CRISPR gRNA sequence
taacgggcaggctgaggcag

SEQ ID NO: 126672 - DNA, 20 bp, Artificial
  CRISPR gRNA sequence
tttttttttttttttggaga

SEQ ID NO: 126673 - DNA, 20 bp, Artificial
  CRISPR gRNA sequence
ttgcactttgtcacccaggc

SEQ ID NO: 126674 - DNA, 20 bp, Artificial
  CRISPR gRNA sequence
ttttaatttttttgtagagg

SEQ ID NO: 126675 - DNA, 20 bp, Artificial
  CRISPR gRNA sequence
accttgccctcccaaactgc

SEQ ID NO: 126676 - DNA, 20 bp, Artificial
  CRISPR gRNA sequence
gacatagttcaaagttaata

SEQ ID NO: 126677 - DNA, 20 bp, Artificial
  CRISPR gRNA sequence
tttctaacttgcttcaactt

SEQ ID NO: 126678 - DNA, 20 bp, Artificial
  CRISPR gRNA sequence
tcaacacttataaactgtca

SEQ ID NO: 126679 - DNA, 20 bp, Artificial
  CRISPR gRNA sequence
tagccttaagcttactaaaa

SEQ ID NO: 126680 - DNA, 20 bp, Artificial
  CRISPR gRNA sequence
aattaattatttttttgaga

SEQ ID NO: 126681 - DNA, 20 bp, Artificial
  CRISPR gRNA sequence
tcttactctgtggcccaggc

SEQ ID NO: 126682 - DNA, 20 bp, Artificial
  CRISPR gRNA sequence
ggcgtgatcacagctcactg

SEQ ID NO: 126683 - DNA, 20 bp, Artificial
  CRISPR gRNA sequence
aatcctcccacctcagcctc

SEQ ID NO: 126684 - DNA, 20 bp, Artificial
  CRISPR gRNA sequence
ttttgtatttttagcagaga

SEQ ID NO: 126685 - DNA, 20 bp, Artificial
  CRISPR gRNA sequence
aggccaatagcgacaaggaa

SEQ ID NO: 126686 - DNA, 20 bp, Artificial
  CRISPR gRNA sequence
cttacaacctaatttatccc

SEQ ID NO: 126687 - DNA, 20 bp, Artificial
  CRISPR gRNA sequence
caggaggactgcttgagctc

SEQ ID NO: 126688 - DNA, 20 bp, Artificial
  CRISPR gRNA sequence
aatcagcttaagtcatcaac

SEQ ID NO: 126689 - DNA, 20 bp, Artificial
  CRISPR gRNA sequence
ttacttggtataagaagcat

SEQ ID NO: 126690 - DNA, 20 bp, Artificial
  CRISPR gRNA sequence
gccaaaagtacacccatgtt

SEQ ID NO: 126691 - DNA, 20 bp, Artificial
  CRISPR gRNA sequence
actttgggaagccaaggtgg

SEQ ID NO: 126692 - DNA, 20 bp, Artificial
  CRISPR gRNA sequence
ctgcactccagcctcagtga

SEQ ID NO: 126693 - DNA, 20 bp, Artificial
  CRISPR gRNA sequence
ctccagcctcagtgacagag

SEQ ID NO: 126694 - DNA, 20 bp, Artificial
  CRISPR gRNA sequence
gacagagtggggtcaggagg

SEQ ID NO: 126695 - DNA, 20 bp, Artificial
  CRISPR gRNA sequence
ggaaaattacctgcacagac

SEQ ID NO: 126696 - DNA, 20 bp, Artificial
  CRISPR gRNA sequence
ttacctgcacagacaagaat

SEQ ID NO: 126697 - DNA, 20 bp, Artificial
  CRISPR gRNA sequence
ttaattttgctgagagctaa

SEQ ID NO: 126698 - DNA, 20 bp, Artificial
  CRISPR gRNA sequence
ctactcaaaataagatatct

SEQ ID NO: 126699 - DNA, 20 bp, Artificial
  CRISPR gRNA sequence
aaaaatgttaaatgcattat

SEQ ID NO: 126700 - DNA, 20 bp, Artificial
  CRISPR gRNA sequence
acatgtcttctccatctctg

SEQ ID NO: 126701 - DNA, 20 bp, Artificial
  CRISPR gRNA sequence
aatttatatagttgttgtaa

SEQ ID NO: 126702 - DNA, 20 bp, Artificial
  CRISPR gRNA sequence
tgttgtaagggggtagaaaa

SEQ ID NO: 126703 - DNA, 20 bp, Artificial
  CRISPR gRNA sequence
cctttaataatctgtgaaca

SEQ ID NO: 126704 - DNA, 20 bp, Artificial
  CRISPR gRNA sequence
ttaaaatgctaacatactag

SEQ ID NO: 126705 - DNA, 20 bp, Artificial
  CRISPR gRNA sequence
agtatcctttaatagacatg

SEQ ID NO: 126706 - DNA, 20 bp, Artificial
  CRISPR gRNA sequence
atttttttttacagccataa

SEQ ID NO: 126707 - DNA, 20 bp, Artificial
  CRISPR gRNA sequence
aatgatcaattatgatacct

SEQ ID NO: 126708 - DNA, 20 bp, Artificial
  CRISPR gRNA sequence
attggaaacaaactttggtt

SEQ ID NO: 126709 - DNA, 20 bp, Artificial
  CRISPR gRNA sequence
gggggtggggagggcaggcg

SEQ ID NO: 126710 - DNA, 20 bp, Artificial
  CRISPR gRNA sequence
agggcaggcggtgggttggg

SEQ ID NO: 126711 - DNA, 20 bp, Artificial
  CRISPR gRNA sequence
agaataacagaaattctttc

SEQ ID NO: 126712 - DNA, 20 bp, Artificial
  CRISPR gRNA sequence
taacagaaattctttcctga

SEQ ID NO: 126713 - DNA, 20 bp, Artificial
  CRISPR gRNA sequence
gacactgttcaaataaccag

SEQ ID NO: 126714 - DNA, 20 bp, Artificial
  CRISPR gRNA sequence
taaccaggcggatctgggag

SEQ ID NO: 126715 - DNA, 20 bp, Artificial
  CRISPR gRNA sequence
catattatcttgtcatgcac

SEQ ID NO: 126716 - DNA, 20 bp, Artificial
  CRISPR gRNA sequence
gtgaagataaaagtatttcc

SEQ ID NO: 126717 - DNA, 20 bp, Artificial
  CRISPR gRNA sequence
aaagtatttcctagagttgt

SEQ ID NO: 126718 - DNA, 20 bp, Artificial
  CRISPR gRNA sequence
tcaacctaatctttgatgct

SEQ ID NO: 126719 - DNA, 20 bp, Artificial
  CRISPR gRNA sequence
ccagccattcgcctatatat

SEQ ID NO: 126720 - DNA, 20 bp, Artificial
  CRISPR gRNA sequence
agccagccaacaaatattta

SEQ ID NO: 126721 - DNA, 20 bp, Artificial
  CRISPR gRNA sequence
atgttacataacctgggagg

SEQ ID NO: 126722 - DNA, 20 bp, Artificial
  CRISPR gRNA sequence
taacctgggaggcagggtga

SEQ ID NO: 126723 - DNA, 20 bp, Artificial
  CRISPR gRNA sequence
tccttccaggacacaggctc

SEQ ID NO: 126724 - DNA, 20 bp, Artificial
  CRISPR gRNA sequence
ccaggacacaggctctggaa

SEQ ID NO: 126725 - DNA, 20 bp, Artificial
  CRISPR gRNA sequence
ctggaatcgaatcacctagt

SEQ ID NO: 126726 - DNA, 20 bp, Artificial
  CRISPR gRNA sequence
accatgagaccgtgaacaaa

SEQ ID NO: 126727 - DNA, 20 bp, Artificial
  CRISPR gRNA sequence
gatgttttgttatgtgctat

SEQ ID NO: 126728 - DNA, 20 bp, Artificial
  CRISPR gRNA sequence
aaagggacctcactagtctg

SEQ ID NO: 126729 - DNA, 20 bp, Artificial
  CRISPR gRNA sequence
ggcaaaaagaaaggtgggaa

SEQ ID NO: 126730 - DNA, 20 bp, Artificial
  CRISPR gRNA sequence
aaccaagaaatacagtactg

SEQ ID NO: 126731 - DNA, 20 bp, Artificial
  CRISPR gRNA sequence
cggtggacaagaggaaatca

SEQ ID NO: 126732 - DNA, 20 bp, Artificial
  CRISPR gRNA sequence
tgatcattttagcatcaggt

SEQ ID NO: 126733 - DNA, 20 bp, Artificial
  CRISPR gRNA sequence
gatagagatacaggaagacc

SEQ ID NO: 126734 - DNA, 20 bp, Artificial
  CRISPR gRNA sequence
aggaagaccaaggataatgc

SEQ ID NO: 126735 - DNA, 20 bp, Artificial
  CRISPR gRNA sequence
gacagacagctgtcaccgca

SEQ ID NO: 126736 - DNA, 20 bp, Artificial
  CRISPR gRNA sequence
gaatgggaaaggaaagggag

SEQ ID NO: 126737 - DNA, 20 bp, Artificial
  CRISPR gRNA sequence
cctagctgaagctaatgacc

SEQ ID NO: 126738 - DNA, 20 bp, Artificial
  CRISPR gRNA sequence
agactacaaaagccaaagtg

SEQ ID NO: 126739 - DNA, 20 bp, Artificial
  CRISPR gRNA sequence
ggctggaagagcacagcatg

SEQ ID NO: 126740 - DNA, 20 bp, Artificial
  CRISPR gRNA sequence
acaaggggacacggacagtg

SEQ ID NO: 126741 - DNA, 20 bp, Artificial
  CRISPR gRNA sequence
ggaactgataaatatggaca

SEQ ID NO: 126742 - DNA, 20 bp, Artificial
  CRISPR gRNA sequence
tgactattctcattatttag

SEQ ID NO: 126743 - DNA, 20 bp, Artificial
  CRISPR gRNA sequence
tcattatttagttgaattga

SEQ ID NO: 126744 - DNA, 20 bp, Artificial
  CRISPR gRNA sequence
ctgaaattagcttctcaaac

SEQ ID NO: 126745 - DNA, 20 bp, Artificial
  CRISPR gRNA sequence
tggctcttaggaccgatttc

SEQ ID NO: 126746 - DNA, 20 bp, Artificial
  CRISPR gRNA sequence
tttacccttttacctgtttt

SEQ ID NO: 126747 - DNA, 20 bp, Artificial
  CRISPR gRNA sequence
tacattccttttatctatct

SEQ ID NO: 126748 - DNA, 20 bp, Artificial
  CRISPR gRNA sequence
tgtactttttaaccccaacc

SEQ ID NO: 126749 - DNA, 20 bp, Artificial
  CRISPR gRNA sequence
actcgccacacatttatgct

SEQ ID NO: 126750 - DNA, 20 bp, Artificial
  CRISPR gRNA sequence
actactgtaattctactaag

SEQ ID NO: 126751 - DNA, 20 bp, Artificial
  CRISPR gRNA sequence
ctttccctttcctatttcca

SEQ ID NO: 126752 - DNA, 20 bp, Artificial
  CRISPR gRNA sequence
gttaataaaaatctttgtgc

SEQ ID NO: 126753 - DNA, 20 bp, Artificial
  CRISPR gRNA sequence
tgctagaatgtgctttattt

SEQ ID NO: 126754 - DNA, 20 bp, Artificial
  CRISPR gRNA sequence
tgtgctttatttagggatca

SEQ ID NO: 126755 - DNA, 20 bp, Artificial
  CRISPR gRNA sequence
gagtgcacttctttcatttt

SEQ ID NO: 126756 - DNA, 20 bp, Artificial
  CRISPR gRNA sequence
tacagatatagtagcacatc

SEQ ID NO: 126757 - DNA, 20 bp, Artificial
  CRISPR gRNA sequence
aaggctcagttcaaggtctg

SEQ ID NO: 126758 - DNA, 20 bp, Artificial
  CRISPR gRNA sequence
ttcccatatctactgcactt

SEQ ID NO: 126759 - DNA, 20 bp, Artificial
  CRISPR gRNA sequence
gctgaaaataaggaagcaac

SEQ ID NO: 126760 - DNA, 20 bp, Artificial
  CRISPR gRNA sequence
tgactactattcttaatcaa

SEQ ID NO: 126761 - DNA, 20 bp, Artificial
  CRISPR gRNA sequence
ttccatggggaaaggagaaa

SEQ ID NO: 126762 - DNA, 20 bp, Artificial
  CRISPR gRNA sequence
atggattttccaacataacc

SEQ ID NO: 126763 - DNA, 20 bp, Artificial
  CRISPR gRNA sequence
gatggttttcttaaatgttt

SEQ ID NO: 126764 - DNA, 20 bp, Artificial
  CRISPR gRNA sequence
agaggaggaaaaaattatct

SEQ ID NO: 126765 - DNA, 20 bp, Artificial
  CRISPR gRNA sequence
gaatataatgcttttcaatt

SEQ ID NO: 126766 - DNA, 20 bp, Artificial
  CRISPR gRNA sequence
aggaaacaattaaatggggg

SEQ ID NO: 126767 - DNA, 20 bp, Artificial
  CRISPR gRNA sequence
acaattaaatgggggagggg

SEQ ID NO: 126768 - DNA, 20 bp, Artificial
  CRISPR gRNA sequence
agcagaaaaaattgtagcca

SEQ ID NO: 126769 - DNA, 20 bp, Artificial
  CRISPR gRNA sequence
acgagaaatgttatttttta

SEQ ID NO: 126770 - DNA, 20 bp, Artificial
  CRISPR gRNA sequence
ctatatttatgtattttgct

SEQ ID NO: 126771 - DNA, 20 bp, Artificial
  CRISPR gRNA sequence
ttttgcttggaatgggagag

SEQ ID NO: 126772 - DNA, 20 bp, Artificial
  CRISPR gRNA sequence
gggagaggggggtgtgggca

SEQ ID NO: 126773 - DNA, 20 bp, Artificial
  CRISPR gRNA sequence
tgatatatgtaaaagctcaa

SEQ ID NO: 126774 - DNA, 20 bp, Artificial
  CRISPR gRNA sequence
cattctttggcatcaacaac

SEQ ID NO: 126775 - DNA, 20 bp, Artificial
  CRISPR gRNA sequence
atacaagagcaatgcaggga

SEQ ID NO: 126776 - DNA, 20 bp, Artificial
  CRISPR gRNA sequence
aaggaataatttgcctttta

SEQ ID NO: 126777 - DNA, 20 bp, Artificial
  CRISPR gRNA sequence
tagcacgaaccacgcaacta

SEQ ID NO: 126778 - DNA, 20 bp, Artificial
  CRISPR gRNA sequence
cacgcaactatggggtccat

SEQ ID NO: 126779 - DNA, 20 bp, Artificial
  CRISPR gRNA sequence
atggggtccatgcgggttag

SEQ ID NO: 126780 - DNA, 20 bp, Artificial
  CRISPR gRNA sequence
ccttgtttaaattatcctgt

SEQ ID NO: 126781 - DNA, 20 bp, Artificial
  CRISPR gRNA sequence
tttgggcgagattacgattt

SEQ ID NO: 126782 - DNA, 20 bp, Artificial
  CRISPR gRNA sequence
cttcctccccacgcaggtgc

SEQ ID NO: 126783 - DNA, 20 bp, Artificial
  CRISPR gRNA sequence
cccggcgacctgtcagccct

SEQ ID NO: 126784 - DNA, 20 bp, Artificial
  CRISPR gRNA sequence
cccacccgccgcgcggcccc

SEQ ID NO: 126785 - DNA, 20 bp, Artificial
  CRISPR gRNA sequence
gcccggagctcaacggcggc

SEQ ID NO: 126786 - DNA, 20 bp, Artificial
  CRISPR gRNA sequence
acatttcattcgagctaaag

SEQ ID NO: 126787 - DNA, 20 bp, Artificial
  CRISPR gRNA sequence
gcgcgcgggcggcgcggagg

SEQ ID NO: 126788 - DNA, 20 bp, Artificial
  CRISPR gRNA sequence
cgcggcggagggaggggagg

SEQ ID NO: 126789 - DNA, 20 bp, Artificial
  CRISPR gRNA sequence
taaaccgactccactttagc

SEQ ID NO: 126790 - DNA, 20 bp, Artificial
  CRISPR gRNA sequence
cccgtagccccggcggcggc

SEQ ID NO: 126791 - DNA, 20 bp, Artificial
  CRISPR gRNA sequence
cacatcccgggggccgcgcg

SEQ ID NO: 126792 - DNA, 20 bp, Artificial
  CRISPR gRNA sequence
cgcggggccggggcggccgg

SEQ ID NO: 126793 - DNA, 20 bp, Artificial
  CRISPR gRNA sequence
cggggcggccgggcgagtca

SEQ ID NO: 126794 - DNA, 20 bp, Artificial
  CRISPR gRNA sequence
cgcagcctggtttgcgcgta

SEQ ID NO: 126795 - DNA, 20 bp, Artificial
  CRISPR gRNA sequence
gaaggtgggaaggaagccct

SEQ ID NO: 126796 - DNA, 20 bp, Artificial
  CRISPR gRNA sequence
tcattagtggtgggaggcgg

SEQ ID NO: 126797 - DNA, 20 bp, Artificial
  CRISPR gRNA sequence
aacggtagtcttagagaaca

SEQ ID NO: 126798 - DNA, 20 bp, Artificial
  CRISPR gRNA sequence
tctcgcccaaagcactctaa

SEQ ID NO: 126799 - DNA, 20 bp, Artificial
  CRISPR gRNA sequence
tggttcgtgctacaaatcac

SEQ ID NO: 126800 - DNA, 20 bp, Artificial
  CRISPR gRNA sequence
acataaagtgatgaaagcaa

SEQ ID NO: 126801 - DNA, 20 bp, Artificial
  CRISPR gRNA sequence
atcagtggcactaatcagtg

SEQ ID NO: 126802 - DNA, 20 bp, Artificial
  CRISPR gRNA sequence
ttgctcttgtatcttaattt

SEQ ID NO: 126803 - DNA, 20 bp, Artificial
  CRISPR gRNA sequence
aactctggttgttgatgcca

SEQ ID NO: 126804 - DNA, 20 bp, Artificial
  CRISPR gRNA sequence
gttgttgatgccaaagaatg

SEQ ID NO: 126805 - DNA, 20 bp, Artificial
  CRISPR gRNA sequence
ggaagggactactgcttttc

SEQ ID NO: 126806 - DNA, 20 bp, Artificial
  CRISPR gRNA sequence
cagtgtttttctttaatgta

SEQ ID NO: 126807 - DNA, 20 bp, Artificial
  CRISPR gRNA sequence
gtactgagtctaaatatata

SEQ ID NO: 126808 - DNA, 20 bp, Artificial
  CRISPR gRNA sequence
atatatactgaatcaactat

SEQ ID NO: 126809 - DNA, 20 bp, Artificial
  CRISPR gRNA sequence
atactgaatcaactatttgg

SEQ ID NO: 126810 - DNA, 20 bp, Artificial
  CRISPR gRNA sequence
tgaatcaactatttgggtga

SEQ ID NO: 126811 - DNA, 20 bp, Artificial
  CRISPR gRNA sequence
aggacttttctgagcagttt

SEQ ID NO: 126812 - DNA, 20 bp, Artificial
  CRISPR gRNA sequence
tctgagcagttttggggtta

SEQ ID NO: 126813 - DNA, 20 bp, Artificial
  CRISPR gRNA sequence
ctatttgctagatttcatgc

SEQ ID NO: 126814 - DNA, 20 bp, Artificial
  CRISPR gRNA sequence
ccctttaaaattaacactga

SEQ ID NO: 126815 - DNA, 20 bp, Artificial
  CRISPR gRNA sequence
tttaattgtttcctttgaga

SEQ ID NO: 126816 - DNA, 20 bp, Artificial
  CRISPR gRNA sequence
ggtgcttcaaaattataaat

SEQ ID NO: 126817 - DNA, 20 bp, Artificial
  CRISPR gRNA sequence
tttttgatatcttctcagtg

SEQ ID NO: 126818 - DNA, 20 bp, Artificial
  CRISPR gRNA sequence
tttttcctcctcttgagcta

SEQ ID NO: 126819 - DNA, 20 bp, Artificial
  CRISPR gRNA sequence
accaaaaaattaagatgata

SEQ ID NO: 126820 - DNA, 20 bp, Artificial
  CRISPR gRNA sequence
ataaggggtgtgtttgcatc

SEQ ID NO: 126821 - DNA, 20 bp, Artificial
  CRISPR gRNA sequence
tccctttttggtgtattgta

SEQ ID NO: 126822 - DNA, 20 bp, Artificial
  CRISPR gRNA sequence
tattgtaatgaatgtttatg

SEQ ID NO: 126823 - DNA, 20 bp, Artificial
  CRISPR gRNA sequence
atgatgaatatggctaaatt

SEQ ID NO: 126824 - DNA, 20 bp, Artificial
  CRISPR gRNA sequence
tccattttctcctttcccca

SEQ ID NO: 126825 - DNA, 20 bp, Artificial
  CRISPR gRNA sequence
ttcaagtcaacaaacattta

SEQ ID NO: 126826 - DNA, 20 bp, Artificial
  CRISPR gRNA sequence
taccatgtactccattgatt

SEQ ID NO: 126827 - DNA, 20 bp, Artificial
  CRISPR gRNA sequence
attttggttgttaattagat

SEQ ID NO: 126828 - DNA, 20 bp, Artificial
  CRISPR gRNA sequence
tttatactggaggtgcctgg

SEQ ID NO: 126829 - DNA, 20 bp, Artificial
  CRISPR gRNA sequence
tactggaggtgcctggtaga

SEQ ID NO: 126830 - DNA, 20 bp, Artificial
  CRISPR gRNA sequence
tcttgcatatattatttccc

SEQ ID NO: 126831 - DNA, 20 bp, Artificial
  CRISPR gRNA sequence
cctaagtgctgttgaggcta

SEQ ID NO: 126832 - DNA, 20 bp, Artificial
  CRISPR gRNA sequence
ctgtctgtttagccaattaa

SEQ ID NO: 126833 - DNA, 20 bp, Artificial
  CRISPR gRNA sequence
acttaggggacagttatgcc

SEQ ID NO: 126834 - DNA, 20 bp, Artificial
  CRISPR gRNA sequence
agaagagaggcatggtgagc

SEQ ID NO: 126835 - DNA, 20 bp, Artificial
  CRISPR gRNA sequence
catggtgagcctgggtactt

SEQ ID NO: 126836 - DNA, 20 bp, Artificial
  CRISPR gRNA sequence
ggtacttgggaatgtcacag

SEQ ID NO: 126837 - DNA, 20 bp, Artificial
  CRISPR gRNA sequence
ttgaactgagccttgaaata

SEQ ID NO: 126838 - DNA, 20 bp, Artificial
  CRISPR gRNA sequence
tgagccttgaaatagagggt

SEQ ID NO: 126839 - DNA, 20 bp, Artificial
  CRISPR gRNA sequence
ccttgaaatagagggtggga

SEQ ID NO: 126840 - DNA, 20 bp, Artificial
  CRISPR gRNA sequence
agggtgggagtggattggtg

SEQ ID NO: 126841 - DNA, 20 bp, Artificial
  CRISPR gRNA sequence
caaaagcaaaagcctgatgg

SEQ ID NO: 126842 - DNA, 20 bp, Artificial
  CRISPR gRNA sequence
ggatgggcaacttaagttta

SEQ ID NO: 126843 - DNA, 20 bp, Artificial
  CRISPR gRNA sequence
caacttaagtttaggggatc

SEQ ID NO: 126844 - DNA, 20 bp, Artificial
  CRISPR gRNA sequence
gggagtagaggtgcatggtc

SEQ ID NO: 126845 - DNA, 20 bp, Artificial
  CRISPR gRNA sequence
atggtccagggtagatctca

SEQ ID NO: 126846 - DNA, 20 bp, Artificial
  CRISPR gRNA sequence
agagaaagcacttgtcccct

SEQ ID NO: 126847 - DNA, 20 bp, Artificial
  CRISPR gRNA sequence
tcccctctggatatttaatt

SEQ ID NO: 126848 - DNA, 20 bp, Artificial
  CRISPR gRNA sequence
gtgctactatatctgtaacc

SEQ ID NO: 126849 - DNA, 20 bp, Artificial
  CRISPR gRNA sequence
tgaagtcatgaaaatgaggt

SEQ ID NO: 126850 - DNA, 20 bp, Artificial
  CRISPR gRNA sequence
ggaagcctttaggaaccttt

SEQ ID NO: 126851 - DNA, 20 bp, Artificial
  CRISPR gRNA sequence
gaacctttgagaataggttc

SEQ ID NO: 126852 - DNA, 20 bp, Artificial
  CRISPR gRNA sequence
taacaatatgttaagatggg

SEQ ID NO: 126853 - DNA, 20 bp, Artificial
  CRISPR gRNA sequence
tgctggtatatttggctggg

SEQ ID NO: 126854 - DNA, 20 bp, Artificial
  CRISPR gRNA sequence
agggctggtattcttcttag

SEQ ID NO: 126855 - DNA, 20 bp, Artificial
  CRISPR gRNA sequence
tccctcctttccccgttgca

SEQ ID NO: 126856 - DNA, 20 bp, Artificial
  CRISPR gRNA sequence
gttgcagggaatggggcaag

SEQ ID NO: 126857 - DNA, 20 bp, Artificial
  CRISPR gRNA sequence
attagacatgccctacaggc

SEQ ID NO: 126858 - DNA, 20 bp, Artificial
  CRISPR gRNA sequence
gccctacaggcatgggttgc

SEQ ID NO: 126859 - DNA, 20 bp, Artificial
  CRISPR gRNA sequence
tgggttgcttgagtggcaag

SEQ ID NO: 126860 - DNA, 20 bp, Artificial
  CRISPR gRNA sequence
aagcatagaagtgatattta

SEQ ID NO: 126861 - DNA, 20 bp, Artificial
  CRISPR gRNA sequence
gaaaataagggaagaaagag

SEQ ID NO: 126862 - DNA, 20 bp, Artificial
  CRISPR gRNA sequence
gaagaaagagaaggataacc

SEQ ID NO: 126863 - DNA, 20 bp, Artificial
  CRISPR gRNA sequence
aaccttgggtgaaacaatta

SEQ ID NO: 126864 - DNA, 20 bp, Artificial
  CRISPR gRNA sequence
caattagggggtggggagga

SEQ ID NO: 126865 - DNA, 20 bp, Artificial
  CRISPR gRNA sequence
aaggatattgctttggaaat

SEQ ID NO: 126866 - DNA, 20 bp, Artificial
  CRISPR gRNA sequence
ctttggaaatcagagtagga

SEQ ID NO: 126867 - DNA, 20 bp, Artificial
  CRISPR gRNA sequence
attccaagcataaatgtgtg

SEQ ID NO: 126868 - DNA, 20 bp, Artificial
  CRISPR gRNA sequence
cactacaaagaacagtcaag

SEQ ID NO: 126869 - DNA, 20 bp, Artificial
  CRISPR gRNA sequence
caagatcactggcagctttt

SEQ ID NO: 126870 - DNA, 20 bp, Artificial
  CRISPR gRNA sequence
cttttaagagtggtttcatt

SEQ ID NO: 126871 - DNA, 20 bp, Artificial
  CRISPR gRNA sequence
agagtggtttcattctgggt

SEQ ID NO: 126872 - DNA, 20 bp, Artificial
  CRISPR gRNA sequence
gggttaaaaagtacatgttc

SEQ ID NO: 126873 - DNA, 20 bp, Artificial
  CRISPR gRNA sequence
acatgttcaggagtttaaat

SEQ ID NO: 126874 - DNA, 20 bp, Artificial
  CRISPR gRNA sequence
gtcttaacaactgtcagggc

SEQ ID NO: 126875 - DNA, 20 bp, Artificial
  CRISPR gRNA sequence
ggcaagaatggtagctaggc

SEQ ID NO: 126876 - DNA, 20 bp, Artificial
  CRISPR gRNA sequence
agctaggcaagggtatgggg

SEQ ID NO: 126877 - DNA, 20 bp, Artificial
  CRISPR gRNA sequence
gagactaagcatgtttaagg

SEQ ID NO: 126878 - DNA, 20 bp, Artificial
  CRISPR gRNA sequence
agagtgaaggagctggtaag

SEQ ID NO: 126879 - DNA, 20 bp, Artificial
  CRISPR gRNA sequence
ttgaagatacattatagaag

SEQ ID NO: 126880 - DNA, 20 bp, Artificial
  CRISPR gRNA sequence
cttatcctcagatagataaa

SEQ ID NO: 126881 - DNA, 20 bp, Artificial
  CRISPR gRNA sequence
gtaacccagaaaacaggtaa

SEQ ID NO: 126882 - DNA, 20 bp, Artificial
  CRISPR gRNA sequence
aagggtaaattaagagagag

SEQ ID NO: 126883 - DNA, 20 bp, Artificial
  CRISPR gRNA sequence
agagaagaatctctgcctgg

SEQ ID NO: 126884 - DNA, 20 bp, Artificial
  CRISPR gRNA sequence
cagtgctcctcaccgtcgtc

SEQ ID NO: 126885 - DNA, 20 bp, Artificial
  CRISPR gRNA sequence
cagtgtataatcagtagcct

SEQ ID NO: 126886 - DNA, 20 bp, Artificial
  CRISPR gRNA sequence
tgtatgaaaaactaccaggc

SEQ ID NO: 126887 - DNA, 20 bp, Artificial
  CRISPR gRNA sequence
taccaggcaggaatgctgta

SEQ ID NO: 126888 - DNA, 20 bp, Artificial
  CRISPR gRNA sequence
agtagttggcatctgaggcc

SEQ ID NO: 126889 - DNA, 20 bp, Artificial
  CRISPR gRNA sequence
ttatttcaaataatattttc

SEQ ID NO: 126890 - DNA, 20 bp, Artificial
  CRISPR gRNA sequence
tgtcaattcaactaaataat

SEQ ID NO: 126891 - DNA, 20 bp, Artificial
  CRISPR gRNA sequence
taatgagaatagtcattaaa

SEQ ID NO: 126892 - DNA, 20 bp, Artificial
  CRISPR gRNA sequence
agtcattaaaatgaatttat

SEQ ID NO: 126893 - DNA, 20 bp, Artificial
  CRISPR gRNA sequence
tgtccatatttatcagttcc

SEQ ID NO: 126894 - DNA, 20 bp, Artificial
  CRISPR gRNA sequence
tgctcttccagcctcattac

SEQ ID NO: 126895 - DNA, 20 bp, Artificial
  CRISPR gRNA sequence
ctgtctgtctctccagctgc

SEQ ID NO: 126896 - DNA, 20 bp, Artificial
  CRISPR gRNA sequence
ctgtactgaactgtagccag

SEQ ID NO: 126897 - DNA, 20 bp, Artificial
  CRISPR gRNA sequence
cagactagtgaggtcccttt

SEQ ID NO: 126898 - DNA, 20 bp, Artificial
  CRISPR gRNA sequence
atagctatatataccactta

SEQ ID NO: 126899 - DNA, 20 bp, Artificial
  CRISPR gRNA sequence
ttgtactatgctgtctttac

SEQ ID NO: 126900 - DNA, 20 bp, Artificial
  CRISPR gRNA sequence
cggtctcatggtaagtggca

SEQ ID NO: 126901 - DNA, 20 bp, Artificial
  CRISPR gRNA sequence
gtctgttttataagttttta

SEQ ID NO: 126902 - DNA, 20 bp, Artificial
  CRISPR gRNA sequence
ttagacctagaaaaaacctt

SEQ ID NO: 126903 - DNA, 20 bp, Artificial
  CRISPR gRNA sequence
tccatcattcttatatatag

SEQ ID NO: 126904 - DNA, 20 bp, Artificial
  CRISPR gRNA sequence
tcaaagattaggttgactta

SEQ ID NO: 126905 - DNA, 20 bp, Artificial
  CRISPR gRNA sequence
aaagaacagaacatttgttt

SEQ ID NO: 126906 - DNA, 20 bp, Artificial
  CRISPR gRNA sequence
atttgtttttgaattgcaga

SEQ ID NO: 126907 - DNA, 20 bp, Artificial
  CRISPR gRNA sequence
ataaatcagaaagattaaag

SEQ ID NO: 126908 - DNA, 20 bp, Artificial
  CRISPR gRNA sequence
taaaggaggatagagaacac

SEQ ID NO: 126909 - DNA, 20 bp, Artificial
  CRISPR gRNA sequence
actgggattaaagtctgggg

SEQ ID NO: 126910 - DNA, 20 bp, Artificial
  CRISPR gRNA sequence
cggcttctcttcaaaggagg

SEQ ID NO: 126911 - DNA, 20 bp, Artificial
  CRISPR gRNA sequence
tcaaaggagggaggatgaga

SEQ ID NO: 126912 - DNA, 20 bp, Artificial
  CRISPR gRNA sequence
aggatgagatcgaatgtctg

SEQ ID NO: 126913 - DNA, 20 bp, Artificial
  CRISPR gRNA sequence
atgtaaacactcattcagga

SEQ ID NO: 126914 - DNA, 20 bp, Artificial
  CRISPR gRNA sequence
aaaatccatcatgtctatta

SEQ ID NO: 126915 - DNA, 20 bp, Artificial
  CRISPR gRNA sequence
ttgtgttagtttaagatggg

SEQ ID NO: 126916 - DNA, 20 bp, Artificial
  CRISPR gRNA sequence
tggaaatacatttaattggc

SEQ ID NO: 126917 - DNA, 20 bp, Artificial
  CRISPR gRNA sequence
ggcagggatgcttattttca

SEQ ID NO: 126918 - DNA, 20 bp, Artificial
  CRISPR gRNA sequence
tattttcaggggatcagtag

SEQ ID NO: 126919 - DNA, 20 bp, Artificial
  CRISPR gRNA sequence
caggggatcagtaggagagt

SEQ ID NO: 126920 - DNA, 20 bp, Artificial
  CRISPR gRNA sequence
ttaataacattaagtttata

SEQ ID NO: 126921 - DNA, 20 bp, Artificial
  CRISPR gRNA sequence
ctgggtcctgggccttaatg

SEQ ID NO: 126922 - DNA, 20 bp, Artificial
  CRISPR gRNA sequence
tgttcagcctgaaagtatgt

SEQ ID NO: 126923 - DNA, 20 bp, Artificial
  CRISPR gRNA sequence
tcactcacagatatcttatt

SEQ ID NO: 126924 - DNA, 20 bp, Artificial
  CRISPR gRNA sequence
ttgcaaaacagaaagccttc

SEQ ID NO: 126925 - DNA, 20 bp, Artificial
  CRISPR gRNA sequence
gatctgccatgttggtgaaa

SEQ ID NO: 126926 - DNA, 20 bp, Artificial
  CRISPR gRNA sequence
tttttccagactttccctct

SEQ ID NO: 126927 - DNA, 20 bp, Artificial
  CRISPR gRNA sequence
aagcaggctttttttaaaat

SEQ ID NO: 126928 - DNA, 20 bp, Artificial
  CRISPR gRNA sequence
ccccactctgtcactgaggc

SEQ ID NO: 126929 - DNA, 20 bp, Artificial
  CRISPR gRNA sequence
tttttgtttttttttagaga

SEQ ID NO: 126930 - DNA, 20 bp, Artificial
  CRISPR gRNA sequence
accttggcttcccaaagttc

SEQ ID NO: 126931 - DNA, 20 bp, Artificial
  CRISPR gRNA sequence
agagaaaattaacctttgac

SEQ ID NO: 126932 - DNA, 20 bp, Artificial
  CRISPR gRNA sequence
attaacctttgactagaatc

SEQ ID NO: 126933 - DNA, 20 bp, Artificial
  CRISPR gRNA sequence
ttgactagaatcaggagttt

SEQ ID NO: 126934 - DNA, 20 bp, Artificial
  CRISPR gRNA sequence
tttatgggttcattcaaaac

SEQ ID NO: 126935 - DNA, 20 bp, Artificial
  CRISPR gRNA sequence
tgggtgtacttttggcttgc

SEQ ID NO: 126936 - DNA, 20 bp, Artificial
  CRISPR gRNA sequence
acttttggcttgcctgggta

SEQ ID NO: 126937 - DNA, 20 bp, Artificial
  CRISPR gRNA sequence
cctgggtacagaattgtgca

SEQ ID NO: 126938 - DNA, 20 bp, Artificial
  CRISPR gRNA sequence
agcaggagcaaaaggaaaat

SEQ ID NO: 126939 - DNA, 20 bp, Artificial
  CRISPR gRNA sequence
tagcaggagagctggaagtg

SEQ ID NO: 126940 - DNA, 20 bp, Artificial
  CRISPR gRNA sequence
gctggaagtgatggatacag

SEQ ID NO: 126941 - DNA, 20 bp, Artificial
  CRISPR gRNA sequence
actaagctgatcatcattcc

SEQ ID NO: 126942 - DNA, 20 bp, Artificial
  CRISPR gRNA sequence
ggataaattaggttgtaagt

SEQ ID NO: 126943 - DNA, 20 bp, Artificial
  CRISPR gRNA sequence
gcttatatcacttatggaag

SEQ ID NO: 126944 - DNA, 20 bp, Artificial
  CRISPR gRNA sequence
ggaagatggatagggaaatc

SEQ ID NO: 126945 - DNA, 20 bp, Artificial
  CRISPR gRNA sequence
taggtggtttgtttgagccc

SEQ ID NO: 126946 - DNA, 20 bp, Artificial
  CRISPR gRNA sequence
tactcaggaggctgaggtgg

SEQ ID NO: 126947 - DNA, 20 bp, Artificial
  CRISPR gRNA sequence
ggattgcttcagcctgggag

SEQ ID NO: 126948 - DNA, 20 bp, Artificial
  CRISPR gRNA sequence
ctgcactccagcctgggcca

SEQ ID NO: 126949 - DNA, 20 bp, Artificial
  CRISPR gRNA sequence
cctgtgacagtttataagtg

SEQ ID NO: 126950 - DNA, 20 bp, Artificial
  CRISPR gRNA sequence
aactgtttttctcctcatag

SEQ ID NO: 126951 - DNA, 20 bp, Artificial
  CRISPR gRNA sequence
acaacagatgcttctcaact

SEQ ID NO: 126952 - DNA, 20 bp, Artificial
  CRISPR gRNA sequence
ttattagaaatagtcttcaa

SEQ ID NO: 126953 - DNA, 20 bp, Artificial
  CRISPR gRNA sequence
tagaaatagtcttcaaaaga

SEQ ID NO: 126954 - DNA, 20 bp, Artificial
  CRISPR gRNA sequence
agaaatttataatcaattga

SEQ ID NO: 126955 - DNA, 20 bp, Artificial
  CRISPR gRNA sequence
gtaactaaaataattattta

SEQ ID NO: 126956 - DNA, 20 bp, Artificial
  CRISPR gRNA sequence
ctaaaataattatttagagg

SEQ ID NO: 126957 - DNA, 20 bp, Artificial
  CRISPR gRNA sequence
ctttgaactatgtcaggtat

SEQ ID NO: 126958 - DNA, 20 bp, Artificial
  CRISPR gRNA sequence
tgggcagatcacttgagctc

SEQ ID NO: 126959 - DNA, 20 bp, Artificial
  CRISPR gRNA sequence
ggggctgggggctgaggtgg

SEQ ID NO: 126960 - DNA, 20 bp, Artificial
  CRISPR gRNA sequence
ggctgaggtgggaggattgc

SEQ ID NO: 126961 - DNA, 20 bp, Artificial
  CRISPR gRNA sequence
gcaccactgcacactccagc

SEQ ID NO: 126962 - DNA, 20 bp, Artificial
  CRISPR gRNA sequence
attttttattttttttgaga

SEQ ID NO: 126963 - DNA, 20 bp, Artificial
  CRISPR gRNA sequence
tcttgctctgtcgcccaggc

SEQ ID NO: 126964 - DNA, 20 bp, Artificial
  CRISPR gRNA sequence
ctcactgcaacctccgcctc

SEQ ID NO: 126965 - DNA, 20 bp, Artificial
  CRISPR gRNA sequence
taatttttttttagtagaga

SEQ ID NO: 126966 - DNA, 20 bp, Artificial
  CRISPR gRNA sequence
gcttcagcctcccaaagtgc

SEQ ID NO: 126967 - DNA, 20 bp, Artificial
  CRISPR gRNA sequence
ttttagaagaaacttgccag

SEQ ID NO: 126968 - DNA, 20 bp, Artificial
  CRISPR gRNA sequence
gggattaatttcatcctgaa

SEQ ID NO: 126969 - DNA, 20 bp, Artificial
  CRISPR gRNA sequence
taaacacataaaaacgtaaa

SEQ ID NO: 126970 - DNA, 20 bp, Artificial
  CRISPR gRNA sequence
ctccttacttagtacatatg

SEQ ID NO: 126971 - DNA, 20 bp, Artificial
  CRISPR gRNA sequence
aagagtgggcagtttactta

SEQ ID NO: 126972 - DNA, 20 bp, Artificial
  CRISPR gRNA sequence
gatactgcatttagtcataa

SEQ ID NO: 126973 - DNA, 20 bp, Artificial
  CRISPR gRNA sequence
gtccctttttgtatgaacag

SEQ ID NO: 126974 - DNA, 20 bp, Artificial
  CRISPR gRNA sequence
tagttacattagtaagccaa

SEQ ID NO: 126975 - DNA, 20 bp, Artificial
  CRISPR gRNA sequence
tccagtttttccattcttta

SEQ ID NO: 126976 - DNA, 20 bp, Artificial
  CRISPR gRNA sequence
ttatatagacttttacataa

SEQ ID NO: 126977 - DNA, 20 bp, Artificial
  CRISPR gRNA sequence
ataaatgagtttatataaac

SEQ ID NO: 126978 - DNA, 20 bp, Artificial
  CRISPR gRNA sequence
aagtcgtataataaatattt

SEQ ID NO: 126979 - DNA, 20 bp, Artificial
  CRISPR gRNA sequence
aaaatctaataggagaaatg

SEQ ID NO: 126980 - DNA, 20 bp, Artificial
  CRISPR gRNA sequence
gatgttatttgagatttttg

SEQ ID NO: 126981 - DNA, 20 bp, Artificial
  CRISPR gRNA sequence
atttttggagaatgggcaag

SEQ ID NO: 126982 - DNA, 20 bp, Artificial
  CRISPR gRNA sequence
ggattttagcaggtatattt

SEQ ID NO: 126983 - DNA, 20 bp, Artificial
  CRISPR gRNA sequence
gataaaaagtgttctaggca

SEQ ID NO: 126984 - DNA, 20 bp, Artificial
  CRISPR gRNA sequence
ataatggttaagaggtgaac

SEQ ID NO: 126985 - DNA, 20 bp, Artificial
  CRISPR gRNA sequence
tgaaccagaatgattttatt

SEQ ID NO: 126986 - DNA, 20 bp, Artificial
  CRISPR gRNA sequence
ctttagatactgaggacagc

SEQ ID NO: 126987 - DNA, 20 bp, Artificial
  CRISPR gRNA sequence
cttccaatagcaaacgtggc

SEQ ID NO: 126988 - DNA, 20 bp, Artificial
  CRISPR gRNA sequence
caagggaaacacgaaactac

SEQ ID NO: 126989 - DNA, 20 bp, Artificial
  CRISPR gRNA sequence
actacatgaattcataggtc

SEQ ID NO: 126990 - DNA, 20 bp, Artificial
  CRISPR gRNA sequence
cttattggaggcagataaaa

SEQ ID NO: 126991 - DNA, 20 bp, Artificial
  CRISPR gRNA sequence
tttttttttttttttgggga

SEQ ID NO: 126992 - DNA, 20 bp, Artificial
  CRISPR gRNA sequence
ttcactcttattggccaggc

SEQ ID NO: 126993 - DNA, 20 bp, Artificial
  CRISPR gRNA sequence
aattctcctgcctcagcctc

SEQ ID NO: 126994 - DNA, 20 bp, Artificial
  CRISPR gRNA sequence
gcctcagcctcccgagtagc

SEQ ID NO: 126995 - DNA, 20 bp, Artificial
  CRISPR gRNA sequence
ttttgtatttttggtagaaa

SEQ ID NO: 126996 - DNA, 20 bp, Artificial
  CRISPR gRNA sequence
gccttggcctaccaaagtgc

SEQ ID NO: 126997 - DNA, 20 bp, Artificial
  CRISPR gRNA sequence
cgttgtcagaactatcaggt

SEQ ID NO: 126998 - DNA, 20 bp, Artificial
  CRISPR gRNA sequence
ttttttttttttttttgaga

SEQ ID NO: 126999 - DNA, 20 bp, Artificial
  CRISPR gRNA sequence
ttcgctcttgttgcccaggc

SEQ ID NO: 127000 - DNA, 20 bp, Artificial
  CRISPR gRNA sequence
cctcagcctcccctggtagc

SEQ ID NO: 127001 - DNA, 20 bp, Artificial
  CRISPR gRNA sequence
cagacgagatcgggcgcgtt

SEQ ID NO: 127002 - DNA, 20 bp, Artificial
  CRISPR gRNA sequence
tggtctgatataggtgtaat

SEQ ID NO: 127003 - DNA, 20 bp, Artificial
  CRISPR gRNA sequence
gtcattgctcatcacttggt

SEQ ID NO: 127004 - DNA, 20 bp, Artificial
  CRISPR gRNA sequence
aagcttagaacttacagttt

SEQ ID NO: 127005 - DNA, 20 bp, Artificial
  CRISPR gRNA sequence
gcacctgaaatgtggctggt

SEQ ID NO: 127006 - DNA, 20 bp, Artificial
  CRISPR gRNA sequence
tgaagacttagtatgaagaa

SEQ ID NO: 127007 - DNA, 20 bp, Artificial
  CRISPR gRNA sequence
tgattctatgtttaaatggt

SEQ ID NO: 127008 - DNA, 20 bp, Artificial
  CRISPR gRNA sequence
atggtaagaatttggctata

SEQ ID NO: 127009 - DNA, 20 bp, Artificial
  CRISPR gRNA sequence
tttattttatatggctacta

SEQ ID NO: 127010 - DNA, 20 bp, Artificial
  CRISPR gRNA sequence
aaagacagtgtgtttcggca

SEQ ID NO: 127011 - DNA, 20 bp, Artificial
  CRISPR gRNA sequence
agtgtgtttcggcagggagt

SEQ ID NO: 127012 - DNA, 20 bp, Artificial
  CRISPR gRNA sequence
caattgcttgattaatccat

SEQ ID NO: 127013 - DNA, 20 bp, Artificial
  CRISPR gRNA sequence
ctctcttttccaagccttat

SEQ ID NO: 127014 - DNA, 20 bp, Artificial
  CRISPR gRNA sequence
cgcccacaaaatatgcatgg

SEQ ID NO: 127015 - DNA, 20 bp, Artificial
  CRISPR gRNA sequence
cacaaaatatgcatggtgga

SEQ ID NO: 127016 - DNA, 20 bp, Artificial
  CRISPR gRNA sequence
gaatggattttccaggggca

SEQ ID NO: 127017 - DNA, 20 bp, Artificial
  CRISPR gRNA sequence
tccaggggcactgggttatt

SEQ ID NO: 127018 - DNA, 20 bp, Artificial
  CRISPR gRNA sequence
ttaagagttttcatcctctg

SEQ ID NO: 127019 - DNA, 20 bp, Artificial
  CRISPR gRNA sequence
ttttaattttttttttgaga

SEQ ID NO: 127020 - DNA, 20 bp, Artificial
  CRISPR gRNA sequence
tcgctctttttgcccaggcc

SEQ ID NO: 127021 - DNA, 20 bp, Artificial
  CRISPR gRNA sequence
ctcactgcaacctccgcctc

SEQ ID NO: 127022 - DNA, 20 bp, Artificial
  CRISPR gRNA sequence
aattctcctgcctcatcctc

SEQ ID NO: 127023 - DNA, 20 bp, Artificial
  CRISPR gRNA sequence
ttttgtacttttagtagaga

SEQ ID NO: 127024 - DNA, 20 bp, Artificial
  CRISPR gRNA sequence
gcctcggcctcccaaagtgc

SEQ ID NO: 127025 - DNA, 20 bp, Artificial
  CRISPR gRNA sequence
aaagtgctgggattacaggc

SEQ ID NO: 127026 - DNA, 20 bp, Artificial
  CRISPR gRNA sequence
taaagtgaagatgtgttctt

SEQ ID NO: 127027 - DNA, 20 bp, Artificial
  CRISPR gRNA sequence
tcagattgcaaaagatgcca

SEQ ID NO: 127028 - DNA, 20 bp, Artificial
  CRISPR gRNA sequence
agatgccaaagaatgtgttc

SEQ ID NO: 127029 - DNA, 20 bp, Artificial
  CRISPR gRNA sequence
atgtgttcaagaatgtgtaa

SEQ ID NO: 127030 - DNA, 20 bp, Artificial
  CRISPR gRNA sequence
tcttctttttttttttgagg

SEQ ID NO: 127031 - DNA, 20 bp, Artificial
  CRISPR gRNA sequence
tatcgctctgttgcccaggc

SEQ ID NO: 127032 - DNA, 20 bp, Artificial
  CRISPR gRNA sequence
ctcactgcaacctctgcctc

SEQ ID NO: 127033 - DNA, 20 bp, Artificial
  CRISPR gRNA sequence
aactctcctgcctcagcctc

SEQ ID NO: 127034 - DNA, 20 bp, Artificial
  CRISPR gRNA sequence
gcctcagcctcctgagtagc

SEQ ID NO: 127035 - DNA, 20 bp, Artificial
  CRISPR gRNA sequence
tttgtatttttagtagagac

SEQ ID NO: 127036 - DNA, 20 bp, Artificial
  CRISPR gRNA sequence
gcctcggcctcccaaagtgc

SEQ ID NO: 127037 - DNA, 20 bp, Artificial
  CRISPR gRNA sequence
aaagcaatttttccacgctc

SEQ ID NO: 127038 - DNA, 20 bp, Artificial
  CRISPR gRNA sequence
ccacgctctggggtcagggg

SEQ ID NO: 127039 - DNA, 20 bp, Artificial
  CRISPR gRNA sequence
ggggtcaggggaggggtgcg

SEQ ID NO: 127040 - DNA, 20 bp, Artificial
  CRISPR gRNA sequence
gtgcgaggggtagatggctt

SEQ ID NO: 127041 - DNA, 20 bp, Artificial
  CRISPR gRNA sequence
cttgcatgcgcagttcacaa

SEQ ID NO: 127042 - DNA, 20 bp, Artificial
  CRISPR gRNA sequence
aatagggttccagcgcctat

SEQ ID NO: 127043 - DNA, 20 bp, Artificial
  CRISPR gRNA sequence
gcggagctcaggtggtaatg

SEQ ID NO: 127044 - DNA, 20 bp, Artificial
  CRISPR gRNA sequence
cctcacctcctgctgtgtgg

SEQ ID NO: 127045 - DNA, 20 bp, Artificial
  CRISPR gRNA sequence
cactcatcagtctgcagcct

SEQ ID NO: 127046 - DNA, 20 bp, Artificial
  CRISPR gRNA sequence
cagtctgcagcctgggggtt

SEQ ID NO: 127047 - DNA, 20 bp, Artificial
  CRISPR gRNA sequence
gtattcagactaccaggagg

SEQ ID NO: 127048 - DNA, 20 bp, Artificial
  CRISPR gRNA sequence
ggctaatagtacctatatca

SEQ ID NO: 127049 - DNA, 20 bp, Artificial
  CRISPR gRNA sequence
agtacctatatcatagaatt

SEQ ID NO: 127050 - DNA, 20 bp, Artificial
  CRISPR gRNA sequence
agcattaaaagtagtaaggt

SEQ ID NO: 127051 - DNA, 20 bp, Artificial
  CRISPR gRNA sequence
atcatatgtcttattattga

SEQ ID NO: 127052 - DNA, 20 bp, Artificial
  CRISPR gRNA sequence
ttaggtttatctttgcctgt

SEQ ID NO: 127053 - DNA, 20 bp, Artificial
  CRISPR gRNA sequence
gtttatctttgcctgtagga

SEQ ID NO: 127054 - DNA, 20 bp, Artificial
  CRISPR gRNA sequence
atggattttgtgaaaagcag

SEQ ID NO: 127055 - DNA, 20 bp, Artificial
  CRISPR gRNA sequence
attcttaatatctttagtgt

SEQ ID NO: 127056 - DNA, 20 bp, Artificial
  CRISPR gRNA sequence
ttaaattagtgatatttgca

SEQ ID NO: 127057 - DNA, 20 bp, Artificial
  CRISPR gRNA sequence
tggaataattgaagtaggaa

SEQ ID NO: 127058 - DNA, 20 bp, Artificial
  CRISPR gRNA sequence
gtatttggccaaattaattt

SEQ ID NO: 127059 - DNA, 20 bp, Artificial
  CRISPR gRNA sequence
atatatacttaagtgatcac

SEQ ID NO: 127060 - DNA, 20 bp, Artificial
  CRISPR gRNA sequence
cagacttcttcatctgtaag

SEQ ID NO: 127061 - DNA, 20 bp, Artificial
  CRISPR gRNA sequence
gttacccctttgatatgatg

SEQ ID NO: 127062 - DNA, 20 bp, Artificial
  CRISPR gRNA sequence
cctttgatatgatgtggaat

SEQ ID NO: 127063 - DNA, 20 bp, Artificial
  CRISPR gRNA sequence
gtgttaataaatactctgct

SEQ ID NO: 127064 - DNA, 20 bp, Artificial
  CRISPR gRNA sequence
catttggaagacaatttcat

SEQ ID NO: 127065 - DNA, 20 bp, Artificial
  CRISPR gRNA sequence
caggctatgaaaggagaaaa

SEQ ID NO: 127066 - DNA, 20 bp, Artificial
  CRISPR gRNA sequence
taagtatctaatggtatttt

SEQ ID NO: 127067 - DNA, 20 bp, Artificial
  CRISPR gRNA sequence
gtatttttggaatgtcagca

SEQ ID NO: 127068 - DNA, 20 bp, Artificial
  CRISPR gRNA sequence
tgcccttttatttgaagtca

SEQ ID NO: 127069 - DNA, 20 bp, Artificial
  CRISPR gRNA sequence
cctttcactgatagttctga

SEQ ID NO: 127070 - DNA, 20 bp, Artificial
  CRISPR gRNA sequence
ggtgaagattcatatgagat

SEQ ID NO: 127071 - DNA, 20 bp, Artificial
  CRISPR gRNA sequence
tcaactcagttttttttaaa

SEQ ID NO: 127072 - DNA, 20 bp, Artificial
  CRISPR gRNA sequence
ggtgaaataaaagggctatg

SEQ ID NO: 127073 - DNA, 20 bp, Artificial
  CRISPR gRNA sequence
tggtgtagtgtagtttaatc

SEQ ID NO: 127074 - DNA, 20 bp, Artificial
  CRISPR gRNA sequence
ttttttaaaatggaaaattg

SEQ ID NO: 127075 - DNA, 20 bp, Artificial
  CRISPR gRNA sequence
actacatcattgataccggg

SEQ ID NO: 127076 - DNA, 20 bp, Artificial
  CRISPR gRNA sequence
cagcaccttgggaggccgag

SEQ ID NO: 127077 - DNA, 20 bp, Artificial
  CRISPR gRNA sequence
accttgggaggccgaggtgg

SEQ ID NO: 127078 - DNA, 20 bp, Artificial
  CRISPR gRNA sequence
tgggtggatcacctgaggtc

SEQ ID NO: 127079 - DNA, 20 bp, Artificial
  CRISPR gRNA sequence
ctgcttggaggctgaggcag

SEQ ID NO: 127080 - DNA, 20 bp, Artificial
  CRISPR gRNA sequence
ctgcactccagcctgggcaa

SEQ ID NO: 127081 - DNA, 20 bp, Artificial
  CRISPR gRNA sequence
tagaaagatacacaagaaat

SEQ ID NO: 127082 - DNA, 20 bp, Artificial
  CRISPR gRNA sequence
tgttattgtctttttattca

SEQ ID NO: 127083 - DNA, 20 bp, Artificial
  CRISPR gRNA sequence
ttcatgatctgaagaaatga

SEQ ID NO: 127084 - DNA, 20 bp, Artificial
  CRISPR gRNA sequence
tctgaagaaatgatggaatg

SEQ ID NO: 127085 - DNA, 20 bp, Artificial
  CRISPR gRNA sequence
aatggggagtgtagagaaat

SEQ ID NO: 127086 - DNA, 20 bp, Artificial
  CRISPR gRNA sequence
tgaggtgttaattctgactt

SEQ ID NO: 127087 - DNA, 20 bp, Artificial
  CRISPR gRNA sequence
ctgacttgagaatctttttc

SEQ ID NO: 127088 - DNA, 20 bp, Artificial
  CRISPR gRNA sequence
gaatgattttaaagaaaaat

SEQ ID NO: 127089 - DNA, 20 bp, Artificial
  CRISPR gRNA sequence
aaaatatttttgttttgtac

SEQ ID NO: 127090 - DNA, 20 bp, Artificial
  CRISPR gRNA sequence
gacagtttcttattttcata

SEQ ID NO: 127091 - DNA, 20 bp, Artificial
  CRISPR gRNA sequence
tttgtaattcaagtaagcgg

SEQ ID NO: 127092 - DNA, 20 bp, Artificial
  CRISPR gRNA sequence
ttgcccttttaataaaatat

SEQ ID NO: 127093 - DNA, 20 bp, Artificial
  CRISPR gRNA sequence
cttttaataaaatataaggg

SEQ ID NO: 127094 - DNA, 20 bp, Artificial
  CRISPR gRNA sequence
atataagggtagagttcatt

SEQ ID NO: 127095 - DNA, 20 bp, Artificial
  CRISPR gRNA sequence
aagttgcctttattataaat

SEQ ID NO: 127096 - DNA, 20 bp, Artificial
  CRISPR gRNA sequence
catttttttaaaaaatgtaa

SEQ ID NO: 127097 - DNA, 20 bp, Artificial
  CRISPR gRNA sequence
aaaaatgtaattgaataagt

SEQ ID NO: 127098 - DNA, 20 bp, Artificial
  CRISPR gRNA sequence
ttttaagactagatttggtt

SEQ ID NO: 127099 - DNA, 20 bp, Artificial
  CRISPR gRNA sequence
tggttttgagttacattttt

SEQ ID NO: 127100 - DNA, 20 bp, Artificial
  CRISPR gRNA sequence
agttacatttttaagaatgt

SEQ ID NO: 127101 - DNA, 20 bp, Artificial
  CRISPR gRNA sequence
atagtattctcttacagaag

SEQ ID NO: 127102 - DNA, 20 bp, Artificial
  CRISPR gRNA sequence
tgcgtgtacagaccttttgc

SEQ ID NO: 127103 - DNA, 20 bp, Artificial
  CRISPR gRNA sequence
tgtacagaccttttgcatgg

SEQ ID NO: 127104 - DNA, 20 bp, Artificial
  CRISPR gRNA sequence
cagaccttttgcatgggtga

SEQ ID NO: 127105 - DNA, 20 bp, Artificial
  CRISPR gRNA sequence
tgagtggatgaaatggagaa

SEQ ID NO: 127106 - DNA, 20 bp, Artificial
  CRISPR gRNA sequence
tggatgaaatggagaacaga

SEQ ID NO: 127107 - DNA, 20 bp, Artificial
  CRISPR gRNA sequence
tataatttagtagtatgtac

SEQ ID NO: 127108 - DNA, 20 bp, Artificial
  CRISPR gRNA sequence
attgtttctttttgaaaagt

SEQ ID NO: 127109 - DNA, 20 bp, Artificial
  CRISPR gRNA sequence
ttttggtgttaattaacttg

SEQ ID NO: 127110 - DNA, 20 bp, Artificial
  CRISPR gRNA sequence
tagtttgcctaaaaggaagt

SEQ ID NO: 127111 - DNA, 20 bp, Artificial
  CRISPR gRNA sequence
ttgcctaaaaggaagttgga

SEQ ID NO: 127112 - DNA, 20 bp, Artificial
  CRISPR gRNA sequence
ctttgccagaaggagccttt

SEQ ID NO: 127113 - DNA, 20 bp, Artificial
  CRISPR gRNA sequence
attcaaataggaaaaaatgg

SEQ ID NO: 127114 - DNA, 20 bp, Artificial
  CRISPR gRNA sequence
ataattcatttaatcttcta

SEQ ID NO: 127115 - DNA, 20 bp, Artificial
  CRISPR gRNA sequence
cagttataaacagcacttca

SEQ ID NO: 127116 - DNA, 20 bp, Artificial
  CRISPR gRNA sequence
tgactgttttcttaaattct

SEQ ID NO: 127117 - DNA, 20 bp, Artificial
  CRISPR gRNA sequence
ttcttaaattctttgaattg

SEQ ID NO: 127118 - DNA, 20 bp, Artificial
  CRISPR gRNA sequence
aaggcttttgatacttcgtt

SEQ ID NO: 127119 - DNA, 20 bp, Artificial
  CRISPR gRNA sequence
gattaatatttgttcaagta

SEQ ID NO: 127120 - DNA, 20 bp, Artificial
  CRISPR gRNA sequence
gtagagaatgaagataaaaa

SEQ ID NO: 127121 - DNA, 20 bp, Artificial
  CRISPR gRNA sequence
aaggaatttgaggccaggta

SEQ ID NO: 127122 - DNA, 20 bp, Artificial
  CRISPR gRNA sequence
gtatctgataatcaaagacc

SEQ ID NO: 127123 - DNA, 20 bp, Artificial
  CRISPR gRNA sequence
ttatcagttatatagtgaca

SEQ ID NO: 127124 - DNA, 20 bp, Artificial
  CRISPR gRNA sequence
gaaaacagtcatggatgtac

SEQ ID NO: 127125 - DNA, 20 bp, Artificial
  CRISPR gRNA sequence
gtacatgggattcagtgaag

SEQ ID NO: 127126 - DNA, 20 bp, Artificial
  CRISPR gRNA sequence
aaatagtcaaaatatccaat

SEQ ID NO: 127127 - DNA, 20 bp, Artificial
  CRISPR gRNA sequence
ccaatagaagattaaatgaa

SEQ ID NO: 127128 - DNA, 20 bp, Artificial
  CRISPR gRNA sequence
tttcaacatagtaggatgac

SEQ ID NO: 127129 - DNA, 20 bp, Artificial
  CRISPR gRNA sequence
catagtaggatgactgttga

SEQ ID NO: 127130 - DNA, 20 bp, Artificial
  CRISPR gRNA sequence
cctatttgaatttactacaa

SEQ ID NO: 127131 - DNA, 20 bp, Artificial
  CRISPR gRNA sequence
tttgaatttactacaatgaa

SEQ ID NO: 127132 - DNA, 20 bp, Artificial
  CRISPR gRNA sequence
gagatgaggacattattaac

SEQ ID NO: 127133 - DNA, 20 bp, Artificial
  CRISPR gRNA sequence
aaggctccttctggcaaagt

SEQ ID NO: 127134 - DNA, 20 bp, Artificial
  CRISPR gRNA sequence
tgttcagcctatatctggga

SEQ ID NO: 127135 - DNA, 20 bp, Artificial
  CRISPR gRNA sequence
attatacaaagttacattat

SEQ ID NO: 127136 - DNA, 20 bp, Artificial
  CRISPR gRNA sequence
acaaagttacattatttacg

SEQ ID NO: 127137 - DNA, 20 bp, Artificial
  CRISPR gRNA sequence
atgaagacagcatactagaa

SEQ ID NO: 127138 - DNA, 20 bp, Artificial
  CRISPR gRNA sequence
tctgtacacgcaatgatgtc

SEQ ID NO: 127139 - DNA, 20 bp, Artificial
  CRISPR gRNA sequence
cgcaatgatgtctgatgttt

SEQ ID NO: 127140 - DNA, 20 bp, Artificial
  CRISPR gRNA sequence
gaatactatagtacttgaag

SEQ ID NO: 127141 - DNA, 20 bp, Artificial
  CRISPR gRNA sequence
gtaaacactgttaatgggca

SEQ ID NO: 127142 - DNA, 20 bp, Artificial
  CRISPR gRNA sequence
agtttaacagggcagacaat

SEQ ID NO: 127143 - DNA, 20 bp, Artificial
  CRISPR gRNA sequence
tacattttttaaaaaaatga

SEQ ID NO: 127144 - DNA, 20 bp, Artificial
  CRISPR gRNA sequence
aatgatgctgcttaaactat

SEQ ID NO: 127145 - DNA, 20 bp, Artificial
  CRISPR gRNA sequence
caaacatcatgaattaaccc

SEQ ID NO: 127146 - DNA, 20 bp, Artificial
  CRISPR gRNA sequence
ttacttgaattacaaaagta

SEQ ID NO: 127147 - DNA, 20 bp, Artificial
  CRISPR gRNA sequence
ttctttaaaatcattcatga

SEQ ID NO: 127148 - DNA, 20 bp, Artificial
  CRISPR gRNA sequence
atttgctgaacaccagaaat

SEQ ID NO: 127149 - DNA, 20 bp, Artificial
  CRISPR gRNA sequence
attgagcagaattaaagaaa

SEQ ID NO: 127150 - DNA, 20 bp, Artificial
  CRISPR gRNA sequence
tctcctatgcaaatatgaac

SEQ ID NO: 127151 - DNA, 20 bp, Artificial
  CRISPR gRNA sequence
aacctccacctccagggttc

SEQ ID NO: 127152 - DNA, 20 bp, Artificial
  CRISPR gRNA sequence
ctgcctcagcctccaagcag

SEQ ID NO: 127153 - DNA, 20 bp, Artificial
  CRISPR gRNA sequence
ttttgtatttttagtagaga

SEQ ID NO: 127154 - DNA, 20 bp, Artificial
  CRISPR gRNA sequence
cacctcggcctcccaaggtg

SEQ ID NO: 127155 - DNA, 20 bp, Artificial
  CRISPR gRNA sequence
aaaaaccacattattttata

SEQ ID NO: 127156 - DNA, 20 bp, Artificial
  CRISPR gRNA sequence
aaatctgtagacagactgga

SEQ ID NO: 127157 - DNA, 20 bp, Artificial
  CRISPR gRNA sequence
gtagacagactggatgaagt

SEQ ID NO: 127158 - DNA, 20 bp, Artificial
  CRISPR gRNA sequence
gactggatgaagtttctgat

SEQ ID NO: 127159 - DNA, 20 bp, Artificial
  CRISPR gRNA sequence
gattaaactacactacacca

SEQ ID NO: 127160 - DNA, 20 bp, Artificial
  CRISPR gRNA sequence
caacatataactgagcagca

SEQ ID NO: 127161 - DNA, 20 bp, Artificial
  CRISPR gRNA sequence
agttgaaatttatttaaatc

SEQ ID NO: 127162 - DNA, 20 bp, Artificial
  CRISPR gRNA sequence
ctgataagaactatttaaaa

SEQ ID NO: 127163 - DNA, 20 bp, Artificial
  CRISPR gRNA sequence
ctacatgacttgtattataa

SEQ ID NO: 127164 - DNA, 20 bp, Artificial
  CRISPR gRNA sequence
tgaaattgtcttccaaatgc

SEQ ID NO: 127165 - DNA, 20 bp, Artificial
  CRISPR gRNA sequence
cttacttattgcctaaaatt

SEQ ID NO: 127166 - DNA, 20 bp, Artificial
  CRISPR gRNA sequence
tctggttaattacatatgaa

SEQ ID NO: 127167 - DNA, 20 bp, Artificial
  CRISPR gRNA sequence
tctgcaaaacaccaccaata

SEQ ID NO: 127168 - DNA, 20 bp, Artificial
  CRISPR gRNA sequence
atgcaaatatcactaattta

SEQ ID NO: 127169 - DNA, 20 bp, Artificial
  CRISPR gRNA sequence
gaaataaatatgctgaactc

SEQ ID NO: 127170 - DNA, 20 bp, Artificial
  CRISPR gRNA sequence
aattcaatcaataataagac

SEQ ID NO: 127171 - DNA, 20 bp, Artificial
  CRISPR gRNA sequence
agaatttgcatgtggcagag

SEQ ID NO: 127172 - DNA, 20 bp, Artificial
  CRISPR gRNA sequence
tcggtcagatcagcggccac

SEQ ID NO: 127173 - DNA, 20 bp, Artificial
  CRISPR gRNA sequence
tgcctgatgatctgaggtgg

SEQ ID NO: 127174 - DNA, 20 bp, Artificial
  CRISPR gRNA sequence
ctgaccccagagcgtggaaa

SEQ ID NO: 127175 - DNA, 20 bp, Artificial
  CRISPR gRNA sequence
caggtggatcacctgaggtc

SEQ ID NO: 127176 - DNA, 20 bp, Artificial
  CRISPR gRNA sequence
tcaggaggctgaggcaggag

SEQ ID NO: 127177 - DNA, 20 bp, Artificial
  CRISPR gRNA sequence
agcaaagagaatatcttctc

SEQ ID NO: 127178 - DNA, 20 bp, Artificial
  CRISPR gRNA sequence
aagagaatatcttctccatt

SEQ ID NO: 127179 - DNA, 20 bp, Artificial
  CRISPR gRNA sequence
tatcttctccattgattgtt

SEQ ID NO: 127180 - DNA, 20 bp, Artificial
  CRISPR gRNA sequence
ttctcttgatggcacctttc

SEQ ID NO: 127181 - DNA, 20 bp, Artificial
  CRISPR gRNA sequence
tcaggaggatgaggcaggag

SEQ ID NO: 127182 - DNA, 20 bp, Artificial
  CRISPR gRNA sequence
gaggcggaggttgcagtgag

SEQ ID NO: 127183 - DNA, 20 bp, Artificial
  CRISPR gRNA sequence
actaaaaaactgaattcaca

SEQ ID NO: 127184 - DNA, 20 bp, Artificial
  CRISPR gRNA sequence
tgggatacacagtgtcagat

SEQ ID NO: 127185 - DNA, 20 bp, Artificial
  CRISPR gRNA sequence
cacagtgtcagatacaggtt

SEQ ID NO: 127186 - DNA, 20 bp, Artificial
  CRISPR gRNA sequence
gggtctaaaaatgaaactcc

SEQ ID NO: 127187 - DNA, 20 bp, Artificial
  CRISPR gRNA sequence
atataatgtgagccacatat

SEQ ID NO: 127188 - DNA, 20 bp, Artificial
  CRISPR gRNA sequence
atgtgagccacatatgtcag

SEQ ID NO: 127189 - DNA, 20 bp, Artificial
  CRISPR gRNA sequence
catactaagtcttcaaaatc

SEQ ID NO: 127190 - DNA, 20 bp, Artificial
  CRISPR gRNA sequence
atttcaggtgctcctgagca

SEQ ID NO: 127191 - DNA, 20 bp, Artificial
  CRISPR gRNA sequence
atgtaagcaataatcagcat

SEQ ID NO: 127192 - DNA, 20 bp, Artificial
  CRISPR gRNA sequence
aaattctcaaactgtaagtt

SEQ ID NO: 127193 - DNA, 20 bp, Artificial
  CRISPR gRNA sequence
ttttaatagcatatttattt

SEQ ID NO: 127194 - DNA, 20 bp, Artificial
  CRISPR gRNA sequence
ccaagtgatgagcaatgaca

SEQ ID NO: 127195 - DNA, 20 bp, Artificial
  CRISPR gRNA sequence
atctataattatgtaaaaat

SEQ ID NO: 127196 - DNA, 20 bp, Artificial
  CRISPR gRNA sequence
aaaatagctgtttccaaata

SEQ ID NO: 127197 - DNA, 20 bp, Artificial
  CRISPR gRNA sequence
agctgtttccaaataccagg

SEQ ID NO: 127198 - DNA, 20 bp, Artificial
  CRISPR gRNA sequence
tactgcaacattatagaagt

SEQ ID NO: 127199 - DNA, 20 bp, Artificial
  CRISPR gRNA sequence
agtacttggatgggagaagt

SEQ ID NO: 127200 - DNA, 20 bp, Artificial
  CRISPR gRNA sequence
aggggaggctgaggcaggag

SEQ ID NO: 127201 - DNA, 20 bp, Artificial
  CRISPR gRNA sequence
tcaaaaaaaaaaaaaaaagt

SEQ ID NO: 127202 - DNA, 20 bp, Artificial
  CRISPR gRNA sequence
tcgggaggctgaggcaggag

SEQ ID NO: 127203 - DNA, 20 bp, Artificial
  CRISPR gRNA sequence
gaggcggaggttgcagtgag

SEQ ID NO: 127204 - DNA, 20 bp, Artificial
  CRISPR gRNA sequence
tatgtagacatgaaagaaat

SEQ ID NO: 127205 - DNA, 20 bp, Artificial
  CRISPR gRNA sequence
atttgatttgctgaaagcct

SEQ ID NO: 127206 - DNA, 20 bp, Artificial
  CRISPR gRNA sequence
acccatgacctatgaattca

SEQ ID NO: 127207 - DNA, 20 bp, Artificial
  CRISPR gRNA sequence
acctatgaattcatgtagtt

SEQ ID NO: 127208 - DNA, 20 bp, Artificial
  CRISPR gRNA sequence
tttctcctctacgttacctt

SEQ ID NO: 127209 - DNA, 20 bp, Artificial
  CRISPR gRNA sequence
ggcatttttcattatcctag

SEQ ID NO: 127210 - DNA, 20 bp, Artificial
  CRISPR gRNA sequence
gaaataaaaatatttaggtg

SEQ ID NO: 127211 - DNA, 20 bp, Artificial
  CRISPR gRNA sequence
ttcacctcttaaccattatt

SEQ ID NO: 127212 - DNA, 20 bp, Artificial
  CRISPR gRNA sequence
tcttttctttcataaaatgt

SEQ ID NO: 127213 - DNA, 20 bp, Artificial
  CRISPR gRNA sequence
tattattcctcatttctcct

SEQ ID NO: 127214 - DNA, 20 bp, Artificial
  CRISPR gRNA sequence
tttgctacttaatgtcacga

SEQ ID NO: 127215 - DNA, 20 bp, Artificial
  CRISPR gRNA sequence
cttaatgtcacgaatcagct

SEQ ID NO: 127216 - DNA, 20 bp, Artificial
  CRISPR gRNA sequence
cgaatcagctttgtgtttcc

SEQ ID NO: 127217 - DNA, 20 bp, Artificial
  CRISPR gRNA sequence
cctatggctccttcaatact

SEQ ID NO: 127218 - DNA, 20 bp, Artificial
  CRISPR gRNA sequence
tactgctagattaagaggtt

SEQ ID NO: 127219 - DNA, 20 bp, Artificial
  CRISPR gRNA sequence
ggttgtatgtttctccaaac

SEQ ID NO: 127220 - DNA, 20 bp, Artificial
  CRISPR gRNA sequence
ataaagttgtcttgtctgta

SEQ ID NO: 127221 - DNA, 20 bp, Artificial
  CRISPR gRNA sequence
ttaaagaatggaaaaactgg

SEQ ID NO: 127222 - DNA, 20 bp, Artificial
  CRISPR gRNA sequence
acttgattattactgatcca

SEQ ID NO: 127223 - DNA, 20 bp, Artificial
  CRISPR gRNA sequence
ccagttggcttactaatgta

SEQ ID NO: 127224 - DNA, 20 bp, Artificial
  CRISPR gRNA sequence
tatataaatttagctataac

SEQ ID NO: 127225 - DNA, 20 bp, Artificial
  CRISPR gRNA sequence
gtaaggaggcaaggcactta

SEQ ID NO: 127226 - DNA, 20 bp, Artificial
  CRISPR gRNA sequence
ggcacttaagttgattcaat

SEQ ID NO: 127227 - DNA, 20 bp, Artificial
  CRISPR gRNA sequence
ttgattcaatttacgttttt

SEQ ID NO: 127228 - DNA, 20 bp, Artificial
  CRISPR gRNA sequence
cagaattaatttatttgaat

SEQ ID NO: 127229 - DNA, 20 bp, Artificial
  CRISPR gRNA sequence
ggatgaaattaatccctctg

SEQ ID NO: 127230 - DNA, 20 bp, Artificial
  CRISPR gRNA sequence
caggcagatcatctgaggtc

SEQ ID NO: 127231 - DNA, 20 bp, Artificial
  CRISPR gRNA sequence
cgggcaggctgaggcaggag

SEQ ID NO: 127232 - DNA, 20 bp, Artificial
  CRISPR gRNA sequence
gaggcggaggttgcagtgag

SEQ ID NO: 127233 - DNA, 20 bp, Artificial
  CRISPR gRNA sequence
gctcactgaagcctctacct

SEQ ID NO: 127234 - DNA, 20 bp, Artificial
  CRISPR gRNA sequence
ttttaatttttttgtagagg

SEQ ID NO: 127235 - DNA, 20 bp, Artificial
  CRISPR gRNA sequence
caccttgccctcccaaactg

SEQ ID NO: 127236 - DNA, 20 bp, Artificial
  CRISPR gRNA sequence
attattttagttaccctatc

SEQ ID NO: 127237 - DNA, 20 bp, Artificial
  CRISPR gRNA sequence
acaaattttaaaagaaactg

SEQ ID NO: 127238 - DNA, 20 bp, Artificial
  CRISPR gRNA sequence
ctttctcattgaaccgtaac

SEQ ID NO: 127239 - DNA, 20 bp, Artificial
  CRISPR gRNA sequence
aatgaaatgtccactttcta

SEQ ID NO: 127240 - DNA, 20 bp, Artificial
  CRISPR gRNA sequence
cttgagaatttggttctaat

SEQ ID NO: 127241 - DNA, 20 bp, Artificial
  CRISPR gRNA sequence
agaatttggttctaattgtg

SEQ ID NO: 127242 - DNA, 20 bp, Artificial
  CRISPR gRNA sequence
acttcctccaatatagtctg

SEQ ID NO: 127243 - DNA, 20 bp, Artificial
  CRISPR gRNA sequence
catccatctatgaggagaaa

SEQ ID NO: 127244 - DNA, 20 bp, Artificial
  CRISPR gRNA sequence
ttcaaagtactaacaaacgt

SEQ ID NO: 127245 - DNA, 20 bp, Artificial
  CRISPR gRNA sequence
caattatacttttcatagcc

SEQ ID NO: 127246 - DNA, 20 bp, Artificial
  CRISPR gRNA sequence
ttttgtatttttagcagaga

SEQ ID NO: 127247 - DNA, 20 bp, Artificial
  CRISPR gRNA sequence
tacctcagcctcccaaaatg

SEQ ID NO: 127248 - DNA, 20 bp, Artificial
  CRISPR gRNA sequence
caccgcaaccagcctatatt

SEQ ID NO: 127249 - DNA, 20 bp, Artificial
  CRISPR gRNA sequence
gaaactttcccacaatttgt

SEQ ID NO: 127250 - DNA, 20 bp, Artificial
  CRISPR gRNA sequence
tcccacaatttgtccacgat

SEQ ID NO: 127251 - DNA, 20 bp, Artificial
  CRISPR gRNA sequence
aatttatccctggaatgatg

SEQ ID NO: 127252 - DNA, 20 bp, Artificial
  CRISPR gRNA sequence
ctcagaagctgaagcaggag

SEQ ID NO: 127253 - DNA, 20 bp, Artificial
  CRISPR gRNA sequence
cctgtctcttaaaaaaaaaa

SEQ ID NO: 127254 - DNA, 20 bp, Artificial
  CRISPR gRNA sequence
cttccagctctcctgctaaa

SEQ ID NO: 127255 - DNA, 20 bp, Artificial
  CRISPR gRNA sequence
aaccctgattttccttttgc

SEQ ID NO: 127256 - DNA, 20 bp, Artificial
  CRISPR gRNA sequence
tgctcctgcttgcgaacttt

SEQ ID NO: 127257 - DNA, 20 bp, Artificial
  CRISPR gRNA sequence
gttacttggtataagaagca

SEQ ID NO: 127258 - DNA, 20 bp, Artificial
  CRISPR gRNA sequence
caggcaagccaaaagtacac

SEQ ID NO: 127259 - DNA, 20 bp, Artificial
  CRISPR gRNA sequence
ttttgaatgaacccataaac

SEQ ID NO: 127260 - DNA, 20 bp, Artificial
  CRISPR gRNA sequence
aaattcctattttaaaaaaa

SEQ ID NO: 127261 - DNA, 20 bp, Artificial
  CRISPR gRNA sequence
caccaacatggcagatccta

SEQ ID NO: 127262 - DNA, 20 bp, Artificial
  CRISPR gRNA sequence
atggcagatcctagaaggct

SEQ ID NO: 127263 - DNA, 20 bp, Artificial
  CRISPR gRNA sequence
atttaatattaaaatactgg

SEQ ID NO: 127264 - DNA, 20 bp, Artificial
  CRISPR gRNA sequence
agtaaacaacaaagtcagtg

SEQ ID NO: 127265 - DNA, 20 bp, Artificial
  CRISPR gRNA sequence
gagtatcctttaatagacat

SEQ ID NO: 127266 - DNA, 20 bp, Artificial
  CRISPR gRNA sequence
attatgatacctgtgagttg

SEQ ID NO: 127267 - DNA, 20 bp, Artificial
  CRISPR gRNA sequence
gcaggagacaggaccaaagt

SEQ ID NO: 127268 - DNA, 20 bp, Artificial
  CRISPR gRNA sequence
acagaaattctttcctgaat

SEQ ID NO: 127269 - DNA, 20 bp, Artificial
  CRISPR gRNA sequence
aaacaaaagtattaaaggaa

SEQ ID NO: 127270 - DNA, 20 bp, Artificial
  CRISPR gRNA sequence
gtcatgcactggaattagca

SEQ ID NO: 127271 - DNA, 20 bp, Artificial
  CRISPR gRNA sequence
gactagaaagctgctaaaga

SEQ ID NO: 127272 - DNA, 20 bp, Artificial
  CRISPR gRNA sequence
ttgaagagaagccgcacatc

SEQ ID NO: 127273 - DNA, 20 bp, Artificial
  CRISPR gRNA sequence
ctgtatgtgtcttcagttct

SEQ ID NO: 127274 - DNA, 20 bp, Artificial
  CRISPR gRNA sequence
gtgtcttcagttctgcaagt

SEQ ID NO: 127275 - DNA, 20 bp, Artificial
  CRISPR gRNA sequence
tctctatcctcctttaatct

SEQ ID NO: 127276 - DNA, 20 bp, Artificial
  CRISPR gRNA sequence
caataagtcaacctaatctt

SEQ ID NO: 127277 - DNA, 20 bp, Artificial
  CRISPR gRNA sequence
aaacttgctagatgcatccc

SEQ ID NO: 127278 - DNA, 20 bp, Artificial
  CRISPR gRNA sequence
taaaaacttataaaacagac

SEQ ID NO: 127279 - DNA, 20 bp, Artificial
  CRISPR gRNA sequence
ccaacaaatatttactgagt

SEQ ID NO: 127280 - DNA, 20 bp, Artificial
  CRISPR gRNA sequence
caacagacaaggtctctgtc

SEQ ID NO: 127281 - DNA, 20 bp, Artificial
  CRISPR gRNA sequence
caggctctggaatcgaatca

SEQ ID NO: 127282 - DNA, 20 bp, Artificial
  CRISPR gRNA sequence
ccaagtacgaagaaaaacaa

SEQ ID NO: 127283 - DNA, 20 bp, Artificial
  CRISPR gRNA sequence
gatgttttgttatgtgctat

SEQ ID NO: 127284 - DNA, 20 bp, Artificial
  CRISPR gRNA sequence
aaaccaagaaatacagtact

SEQ ID NO: 127285 - DNA, 20 bp, Artificial
  CRISPR gRNA sequence
cggtggacaagaggaaatca

SEQ ID NO: 127286 - DNA, 20 bp, Artificial
  CRISPR gRNA sequence
caagagaagcagaacaacta

SEQ ID NO: 127287 - DNA, 20 bp, Artificial
  CRISPR gRNA sequence
caggaagaccaaggataatg

SEQ ID NO: 127288 - DNA, 20 bp, Artificial
  CRISPR gRNA sequence
cctagctgaagctaatgacc

SEQ ID NO: 127289 - DNA, 20 bp, Artificial
  CRISPR gRNA sequence
gagactacaaaagccaaagt

SEQ ID NO: 127290 - DNA, 20 bp, Artificial
  CRISPR gRNA sequence
caaacaaatactgccctctt

SEQ ID NO: 127291 - DNA, 20 bp, Artificial
  CRISPR gRNA sequence
aaaactgaggtacatgaggc

SEQ ID NO: 127292 - DNA, 20 bp, Artificial
  CRISPR gRNA sequence
tctctacagcattcctgcct

SEQ ID NO: 127293 - DNA, 20 bp, Artificial
  CRISPR gRNA sequence
tcccttttacattctaaggc

SEQ ID NO: 127294 - DNA, 20 bp, Artificial
  CRISPR gRNA sequence
tatacactgaaaacactgaa

SEQ ID NO: 127295 - DNA, 20 bp, Artificial
  CRISPR gRNA sequence
attagcttctcaaaccagga

SEQ ID NO: 127296 - DNA, 20 bp, Artificial
  CRISPR gRNA sequence
tgaggagcactggctcttag

SEQ ID NO: 127297 - DNA, 20 bp, Artificial
  CRISPR gRNA sequence
tggctcttaggaccgatttc

SEQ ID NO: 127298 - DNA, 20 bp, Artificial
  CRISPR gRNA sequence
taggaccgatttcgtgggtt

SEQ ID NO: 127299 - DNA, 20 bp, Artificial
  CRISPR gRNA sequence
tccccatttatgagctctct

SEQ ID NO: 127300 - DNA, 20 bp, Artificial
  CRISPR gRNA sequence
ttatgagctctctttgtgtt

SEQ ID NO: 127301 - DNA, 20 bp, Artificial
  CRISPR gRNA sequence
gttctcattattcttccagg

SEQ ID NO: 127302 - DNA, 20 bp, Artificial
  CRISPR gRNA sequence
ctctcttaatttaccctttt

SEQ ID NO: 127303 - DNA, 20 bp, Artificial
  CRISPR gRNA sequence
tctgaggataagaaataata

SEQ ID NO: 127304 - DNA, 20 bp, Artificial
  CRISPR gRNA sequence
gctccttcactcttccttaa

SEQ ID NO: 127305 - DNA, 20 bp, Artificial
  CRISPR gRNA sequence
ggctactactcgccacacat

SEQ ID NO: 127306 - DNA, 20 bp, Artificial
  CRISPR gRNA sequence
atgcttggaattctctccta

SEQ ID NO: 127307 - DNA, 20 bp, Artificial
  CRISPR gRNA sequence
tcctttcctccccaccccct

SEQ ID NO: 127308 - DNA, 20 bp, Artificial
  CRISPR gRNA sequence
gaactcactaaatatcactt

SEQ ID NO: 127309 - DNA, 20 bp, Artificial
  CRISPR gRNA sequence
tgccaaatctacaaccaata

SEQ ID NO: 127310 - DNA, 20 bp, Artificial
  CRISPR gRNA sequence
tccctgcaacggggaaagga

SEQ ID NO: 127311 - DNA, 20 bp, Artificial
  CRISPR gRNA sequence
tctttaaaaatgtctcctag

SEQ ID NO: 127312 - DNA, 20 bp, Artificial
  CRISPR gRNA sequence
gctttccctttcctatttcc

SEQ ID NO: 127313 - DNA, 20 bp, Artificial
  CRISPR gRNA sequence
acctattctcaaaggttcct

SEQ ID NO: 127314 - DNA, 20 bp, Artificial
  CRISPR gRNA sequence
cgcacatttaacctaaccaa

SEQ ID NO: 127315 - DNA, 20 bp, Artificial
  CRISPR gRNA sequence
ataaaaatctttgtgctaga

SEQ ID NO: 127316 - DNA, 20 bp, Artificial
  CRISPR gRNA sequence
attaaatatccagaggggac

SEQ ID NO: 127317 - DNA, 20 bp, Artificial
  CRISPR gRNA sequence
ttaagttgcccatcctgcca

SEQ ID NO: 127318 - DNA, 20 bp, Artificial
  CRISPR gRNA sequence
tgcccatcctgccatcaggc

SEQ ID NO: 127319 - DNA, 20 bp, Artificial
  CRISPR gRNA sequence
tctaaaaaggtgtctaatct

SEQ ID NO: 127320 - DNA, 20 bp, Artificial
  CRISPR gRNA sequence
atacatcaaatgtatcactt

SEQ ID NO: 127321 - DNA, 20 bp, Artificial
  CRISPR gRNA sequence
ttttttctcataaaattaaa

SEQ ID NO: 127322 - DNA, 20 bp, Artificial
  CRISPR gRNA sequence
agtataaaaaggcacccaat

SEQ ID NO: 127323 - DNA, 20 bp, Artificial
  CRISPR gRNA sequence
caataaatgtttgttgactt

SEQ ID NO: 127324 - DNA, 20 bp, Artificial
  CRISPR gRNA sequence
attccatggggaaaggagaa

SEQ ID NO: 127325 - DNA, 20 bp, Artificial
  CRISPR gRNA sequence
tatcatcttaattttttggt

SEQ ID NO: 127326 - DNA, 20 bp, Artificial
  CRISPR gRNA sequence
tttttggtgatggttttctt

SEQ ID NO: 127327 - DNA, 20 bp, Artificial
  CRISPR gRNA sequence
gaaaaaattatctgagaata

SEQ ID NO: 127328 - DNA, 20 bp, Artificial
  CRISPR gRNA sequence
aatgcttttcaattaagaat

SEQ ID NO: 127329 - DNA, 20 bp, Artificial
  CRISPR gRNA sequence
ttagtaccaattgctgtgtt

SEQ ID NO: 127330 - DNA, 20 bp, Artificial
  CRISPR gRNA sequence
aaaattgtagccactgaatt

SEQ ID NO: 127331 - DNA, 20 bp, Artificial
  CRISPR gRNA sequence
aaaaaggtccaggtagcaaa

SEQ ID NO: 127332 - DNA, 20 bp, Artificial
  CRISPR gRNA sequence
tccaggtagcaaaaactgct

SEQ ID NO: 127333 - DNA, 20 bp, Artificial
  CRISPR gRNA sequence
atgggagctatatttatgta

SEQ ID NO: 127334 - DNA, 20 bp, Artificial
  CRISPR gRNA sequence
ccacactcactcacccaaat

SEQ ID NO: 127335 - DNA, 20 bp, Artificial
  CRISPR gRNA sequence
aagctcaagggaatgcatac

SEQ ID NO: 127336 - DNA, 20 bp, Artificial
  CRISPR gRNA sequence
agggaatgcatacatctgtt

SEQ ID NO: 127337 - DNA, 20 bp, Artificial
  CRISPR gRNA sequence
cattctttggcatcaacaac

SEQ ID NO: 127338 - DNA, 20 bp, Artificial
  CRISPR gRNA sequence
tactttacaaataaaccccc

SEQ ID NO: 127339 - DNA, 20 bp, Artificial
  CRISPR gRNA sequence
gattagtgccactgatattg

SEQ ID NO: 127340 - DNA, 20 bp, Artificial
  CRISPR gRNA sequence
agtgccactgatattgatcc

SEQ ID NO: 127341 - DNA, 20 bp, Artificial
  CRISPR gRNA sequence
ttgctttcatcactttatgt

SEQ ID NO: 127342 - DNA, 20 bp, Artificial
  CRISPR gRNA sequence
ttcatcactttatgttgctg

SEQ ID NO: 127343 - DNA, 20 bp, Artificial
  CRISPR gRNA sequence
taagagagatgaaaccaccc

SEQ ID NO: 127344 - DNA, 20 bp, Artificial
  CRISPR gRNA sequence
aaaggtcgcaggctacctaa

SEQ ID NO: 127345 - DNA, 20 bp, Artificial
  CRISPR gRNA sequence
ttgtttaaattatcctgtta

SEQ ID NO: 127346 - DNA, 20 bp, Artificial
  CRISPR gRNA sequence
atcctgttagagtgctttgg

SEQ ID NO: 127347 - DNA, 20 bp, Artificial
  CRISPR gRNA sequence
ttagagtgctttgggcgaga

SEQ ID NO: 127348 - DNA, 20 bp, Artificial
  CRISPR gRNA sequence
atcctcccgcctcccaccac

SEQ ID NO: 127349 - DNA, 20 bp, Artificial
  CRISPR gRNA sequence
taaaaccttagtccaatccg

SEQ ID NO: 127350 - DNA, 20 bp, Artificial
  CRISPR gRNA sequence
ttcattcgagctaaagtgga

SEQ ID NO: 127351 - DNA, 20 bp, Artificial
  CRISPR gRNA sequence
gttggctcccgtctccaatc

SEQ ID NO: 127352 - DNA, 20 bp, Artificial
  CRISPR gRNA sequence
gaaccagtcccagcgcggag

SEQ ID NO: 127353 - DNA, 20 bp, Artificial
  CRISPR gRNA sequence
cctcccctccctccgccgcg

SEQ ID NO: 127354 - DNA, 20 bp, Artificial
  CRISPR gRNA sequence
cattttctgtccaaccaaac

SEQ ID NO: 127355 - DNA, 20 bp, Artificial
  CRISPR gRNA sequence
gagccaaccagggctgcatt

SEQ ID NO: 127356 - DNA, 20 bp, Artificial
  CRISPR gRNA sequence
ggctgcattggaggtttgtg

SEQ ID NO: 127357 - DNA, 20 bp, Artificial
  CRISPR gRNA sequence
cgcggggctgtggcggggcc

SEQ ID NO: 127358 - DNA, 20 bp, Artificial
  CRISPR gRNA sequence
cacctgcgtggggaggaagg

SEQ ID NO: 127359 - DNA, 20 bp, Artificial
  CRISPR gRNA sequence
cgtggggaggaaggcatggc

SEQ ID NO: 127360 - DNA, 20 bp, Artificial
  CRISPR gRNA sequence
tggctttagcttccccgcag

SEQ ID NO: 127361 - DNA, 20 bp, Artificial
  CRISPR gRNA sequence
cgtaaagaatgcagccatct

SEQ ID NO: 127362 - DNA, 20 bp, Artificial
  CRISPR gRNA sequence
cgaaggtgggaaggaagccc

SEQ ID NO: 127363 - DNA, 20 bp, Artificial
  CRISPR gRNA sequence
ggaagcccttcggattggac

SEQ ID NO: 127364 - DNA, 20 bp, Artificial
  CRISPR gRNA sequence
ttcgtgctacaaatcactgg

SEQ ID NO: 127365 - DNA, 20 bp, Artificial
  CRISPR gRNA sequence
atcagtggcactaatcagtg

SEQ ID NO: 127366 - DNA, 20 bp, Artificial
  CRISPR gRNA sequence
gggtttatttgtaaagtatt

SEQ ID NO: 127367 - DNA, 20 bp, Artificial
  CRISPR gRNA sequence
attgctcttgtatcttaatt

SEQ ID NO: 127368 - DNA, 20 bp, Artificial
  CRISPR gRNA sequence
tggagggtggaggaagggac

SEQ ID NO: 127369 - DNA, 20 bp, Artificial
  CRISPR gRNA sequence
aaacagatgtatgcattccc

SEQ ID NO: 127370 - DNA, 20 bp, Artificial
  CRISPR gRNA sequence
atatacaccatatgaggtga

SEQ ID NO: 127371 - DNA, 20 bp, Artificial
  CRISPR gRNA sequence
aaaatacataaatatagctc

SEQ ID NO: 127372 - DNA, 20 bp, Artificial
  CRISPR gRNA sequence
tcccatgttttaagtgttct

SEQ ID NO: 127373 - DNA, 20 bp, Artificial
  CRISPR gRNA sequence
tacaaggaaggacttttctg

SEQ ID NO: 127374 - DNA, 20 bp, Artificial
  CRISPR gRNA sequence
taatattatagcaaacgtca

SEQ ID NO: 127375 - DNA, 20 bp, Artificial
  CRISPR gRNA sequence
tacaattttttctgctattt

SEQ ID NO: 127376 - DNA, 20 bp, Artificial
  CRISPR gRNA sequence
tttctgctatttgctagatt

SEQ ID NO: 127377 - DNA, 20 bp, Artificial
  CRISPR gRNA sequence
ttaaaattaacactgaaagg

SEQ ID NO: 127378 - DNA, 20 bp, Artificial
  CRISPR gRNA sequence
ttaacactgaaaggatgtgt

SEQ ID NO: 127379 - DNA, 20 bp, Artificial
  CRISPR gRNA sequence
atcctacccctcccccattt

SEQ ID NO: 127380 - DNA, 20 bp, Artificial
  CRISPR gRNA sequence
gcaattttagtcaaaaatgg

SEQ ID NO: 127381 - DNA, 20 bp, Artificial
  CRISPR gRNA sequence
ttcaaaattataaataaggg

SEQ ID NO: 127382 - DNA, 20 bp, Artificial
  CRISPR gRNA sequence
ataaataagggtcttgattg

SEQ ID NO: 127383 - DNA, 20 bp, Artificial
  CRISPR gRNA sequence
tatcttcattacagtataat

SEQ ID NO: 127384 - DNA, 20 bp, Artificial
  CRISPR gRNA sequence
aaaaattaagatgataaggg

SEQ ID NO: 127385 - DNA, 20 bp, Artificial
  CRISPR gRNA sequence
tgtgtttgcatcttgagtgt

SEQ ID NO: 127386 - DNA, 20 bp, Artificial
  CRISPR gRNA sequence
cctttttggtgtattgtaat

SEQ ID NO: 127387 - DNA, 20 bp, Artificial
  CRISPR gRNA sequence
ctcctttccccatggaatta

SEQ ID NO: 127388 - DNA, 20 bp, Artificial
  CRISPR gRNA sequence
ctattttataccatgtactc

SEQ ID NO: 127389 - DNA, 20 bp, Artificial
  CRISPR gRNA sequence
gatagatgttaggtcctaat

SEQ ID NO: 127390 - DNA, 20 bp, Artificial
  CRISPR gRNA sequence
tatcttttaggttgaaatca

SEQ ID NO: 127391 - DNA, 20 bp, Artificial
  CRISPR gRNA sequence
ttttaccattttggttgtta

SEQ ID NO: 127392 - DNA, 20 bp, Artificial
  CRISPR gRNA sequence
acagtacctctgctcattcc

SEQ ID NO: 127393 - DNA, 20 bp, Artificial
  CRISPR gRNA sequence
attcctgttgcttccttatt

SEQ ID NO: 127394 - DNA, 20 bp, Artificial
  CRISPR gRNA sequence
gtcccagctgtaaaggggct

SEQ ID NO: 127395 - DNA, 20 bp, Artificial
  CRISPR gRNA sequence
gccttgaaatagagggtggg

SEQ ID NO: 127396 - DNA, 20 bp, Artificial
  CRISPR gRNA sequence
ctgatggcaggatgggcaac

SEQ ID NO: 127397 - DNA, 20 bp, Artificial
  CRISPR gRNA sequence
atctgtaacctcgggtgtgt

SEQ ID NO: 127398 - DNA, 20 bp, Artificial
  CRISPR gRNA sequence
ttacagcttctttgagctgt

SEQ ID NO: 127399 - DNA, 20 bp, Artificial
  CRISPR gRNA sequence
aaataaagcacattctagca

SEQ ID NO: 127400 - DNA, 20 bp, Artificial
  CRISPR gRNA sequence
aagatagagaaaagtaggaa

SEQ ID NO: 127401 - DNA, 20 bp, Artificial
  CRISPR gRNA sequence
ctcatgtgaagtcatgaaaa

SEQ ID NO: 127402 - DNA, 20 bp, Artificial
  CRISPR gRNA sequence
gtgaagtcatgaaaatgagg

SEQ ID NO: 127403 - DNA, 20 bp, Artificial
  CRISPR gRNA sequence
agtatagaactggtgttgtg

SEQ ID NO: 127404 - DNA, 20 bp, Artificial
  CRISPR gRNA sequence
taaagaggtaatagatgagg

SEQ ID NO: 127405 - DNA, 20 bp, Artificial
  CRISPR gRNA sequence
agacatgccctacaggcatg

SEQ ID NO: 127406 - DNA, 20 bp, Artificial
  CRISPR gRNA sequence
gtggcaagcagaatattggt

SEQ ID NO: 127407 - DNA, 20 bp, Artificial
  CRISPR gRNA sequence
agggggtggggaggaaagga

SEQ ID NO: 127408 - DNA, 20 bp, Artificial
  CRISPR gRNA sequence
aggatgaggacaagatcact

SEQ ID NO: 127409 - DNA, 20 bp, Artificial
  CRISPR gRNA sequence
gatcactggcagcttttaag

SEQ ID NO: 127410 - DNA, 20 bp, Artificial
  CRISPR gRNA sequence
gggttaaaaagtacatgttc

SEQ ID NO: 127411 - DNA, 20 bp, Artificial
  CRISPR gRNA sequence
ggcaagggtatggggcagaa

SEQ ID NO: 127412 - DNA, 20 bp, Artificial
  CRISPR gRNA sequence
atatatctctgtgtacttct

SEQ ID NO: 127413 - DNA, 20 bp, Artificial
  CRISPR gRNA sequence
tgcttaatgagggagactaa

SEQ ID NO: 127414 - DNA, 20 bp, Artificial
  CRISPR gRNA sequence
aagagtgaaggagctggtaa

SEQ ID NO: 127415 - DNA, 20 bp, Artificial
  CRISPR gRNA sequence
ccgtatttgagggggcaata

SEQ ID NO: 127416 - DNA, 20 bp, Artificial
  CRISPR gRNA sequence
tatgtatcttgcactttgct

SEQ ID NO: 127417 - DNA, 20 bp, Artificial
  CRISPR gRNA sequence
ttgctaggtgctttttatac

SEQ ID NO: 127418 - DNA, 20 bp, Artificial
  CRISPR gRNA sequence
gagagctcataaatggggag

SEQ ID NO: 127419 - DNA, 20 bp, Artificial
  CRISPR gRNA sequence
aaccatctcacaaacaccat

SEQ ID NO: 127420 - DNA, 20 bp, Artificial
  CRISPR gRNA sequence
ctggtttgagaagctaattt

SEQ ID NO: 127421 - DNA, 20 bp, Artificial
  CRISPR gRNA sequence
gagtagttggcatctgaggc

SEQ ID NO: 127422 - DNA, 20 bp, Artificial
  CRISPR gRNA sequence
aaatcattagcctcatgtac

SEQ ID NO: 127423 - DNA, 20 bp, Artificial
  CRISPR gRNA sequence
tcagttttctcacctgcgtc

SEQ ID NO: 127424 - DNA, 20 bp, Artificial
  CRISPR gRNA sequence
taaacattaaagagggcagt

SEQ ID NO: 127425 - DNA, 20 bp, Artificial
  CRISPR gRNA sequence
tttgtggaacaaattattag

SEQ ID NO: 127426 - DNA, 20 bp, Artificial
  CRISPR gRNA sequence
atacggctacatcaaaaaaa

SEQ ID NO: 127427 - DNA, 20 bp, Artificial
  CRISPR gRNA sequence
taaagatttattagcccact

SEQ ID NO: 127428 - DNA, 20 bp, Artificial
  CRISPR gRNA sequence
tagtcattaaaatgaattta

SEQ ID NO: 127429 - DNA, 20 bp, Artificial
  CRISPR gRNA sequence
atttatcagttccttgagtc

SEQ ID NO: 127430 - DNA, 20 bp, Artificial
  CRISPR gRNA sequence
acctggatgaaatccaacac

SEQ ID NO: 127431 - DNA, 20 bp, Artificial
  CRISPR gRNA sequence
accactgtaaactcacggtc

SEQ ID NO: 127432 - DNA, 20 bp, Artificial
  CRISPR gRNA sequence
ctcacggtcattagcttcag

SEQ ID NO: 127433 - DNA, 20 bp, Artificial
  CRISPR gRNA sequence
actaaaaagctgtctagttg

SEQ ID NO: 127434 - DNA, 20 bp, Artificial
  CRISPR gRNA sequence
tgatgctaaaatgatcatta

SEQ ID NO: 127435 - DNA, 20 bp, Artificial
  CRISPR gRNA sequence
ctatttgtgctcccctccag

SEQ ID NO: 127436 - DNA, 20 bp, Artificial
  CRISPR gRNA sequence
tctgtactgaactgtagcca

SEQ ID NO: 127437 - DNA, 20 bp, Artificial
  CRISPR gRNA sequence
cagagggattttttttttta

SEQ ID NO: 127438 - DNA, 20 bp, Artificial
  CRISPR gRNA sequence
ttttaatgtgatttgtgctc

SEQ ID NO: 127439 - DNA, 20 bp, Artificial
  CRISPR gRNA sequence
gtgctcttctgcttaaaact

SEQ ID NO: 127440 - DNA, 20 bp, Artificial
  CRISPR gRNA sequence
atttcctcttgtccaccgga

SEQ ID NO: 127441 - DNA, 20 bp, Artificial
  CRISPR gRNA sequence
aatccaccagtactgtattt

SEQ ID NO: 127442 - DNA, 20 bp, Artificial
  CRISPR gRNA sequence
tggttttctctgcctagaac

SEQ ID NO: 127443 - DNA, 20 bp, Artificial
  CRISPR gRNA sequence
tcccacctttctttttgcct

SEQ ID NO: 127444 - DNA, 20 bp, Artificial
  CRISPR gRNA sequence
tttctttttgcctgactgat

SEQ ID NO: 127445 - DNA, 20 bp, Artificial
  CRISPR gRNA sequence
catagcacataacaaaacat

SEQ ID NO: 127446 - DNA, 20 bp, Artificial
  CRISPR gRNA sequence
attgtactatgctgtcttta

SEQ ID NO: 127447 - DNA, 20 bp, Artificial
  CRISPR gRNA sequence
gaggttaagtcttgttctca

SEQ ID NO: 127448 - DNA, 20 bp, Artificial
  CRISPR gRNA sequence
agtggcagggaattcaaact

SEQ ID NO: 127449 - DNA, 20 bp, Artificial
  CRISPR gRNA sequence
cagggaattcaaactaggtg

SEQ ID NO: 127450 - DNA, 20 bp, Artificial
  CRISPR gRNA sequence
cactcagtaaatatttgttg

SEQ ID NO: 127451 - DNA, 20 bp, Artificial
  CRISPR gRNA sequence
tggcttactgacaatctaca

SEQ ID NO: 127452 - DNA, 20 bp, Artificial
  CRISPR gRNA sequence
gacaatctacagtctgtttt

SEQ ID NO: 127453 - DNA, 20 bp, Artificial
  CRISPR gRNA sequence
ctgttttataagtttttata

SEQ ID NO: 127454 - DNA, 20 bp, Artificial
  CRISPR gRNA sequence
aaacctttgggatgcatcta

SEQ ID NO: 127455 - DNA, 20 bp, Artificial
  CRISPR gRNA sequence
ggctggcatattctaagcat

SEQ ID NO: 127456 - DNA, 20 bp, Artificial
  CRISPR gRNA sequence
gtgaaaggtactaagtgcca

SEQ ID NO: 127457 - DNA, 20 bp, Artificial
  CRISPR gRNA sequence
agagctttaaagaacagaac

SEQ ID NO: 127458 - DNA, 20 bp, Artificial
  CRISPR gRNA sequence
attgcagaaaggataaatca

SEQ ID NO: 127459 - DNA, 20 bp, Artificial
  CRISPR gRNA sequence
ttaaaggaggatagagaaca

SEQ ID NO: 127460 - DNA, 20 bp, Artificial
  CRISPR gRNA sequence
cactgggattaaagtctggg

SEQ ID NO: 127461 - DNA, 20 bp, Artificial
  CRISPR gRNA sequence
atacagttaagcagatgatg

SEQ ID NO: 127462 - DNA, 20 bp, Artificial
  CRISPR gRNA sequence
acgtgccaaacactgtcttt

SEQ ID NO: 127463 - DNA, 20 bp, Artificial
  CRISPR gRNA sequence
tatcttcacttttagaagac

SEQ ID NO: 127464 - DNA, 20 bp, Artificial
  CRISPR gRNA sequence
ttccagtgcatgacaagata

SEQ ID NO: 127465 - DNA, 20 bp, Artificial
  CRISPR gRNA sequence
aaacttttttcctttaatac

SEQ ID NO: 127466 - DNA, 20 bp, Artificial
  CRISPR gRNA sequence
ctgccctccccacccccaac

SEQ ID NO: 127467 - DNA, 20 bp, Artificial
  CRISPR gRNA sequence
cctccccacccccaaccaaa

SEQ ID NO: 127468 - DNA, 20 bp, Artificial
  CRISPR gRNA sequence
cattttaagatcaaaatagc

SEQ ID NO: 127469 - DNA, 20 bp, Artificial
  CRISPR gRNA sequence
aatagcatttgatttttggg

SEQ ID NO: 127470 - DNA, 20 bp, Artificial
  CRISPR gRNA sequence
actgtttcacatttatttgt

SEQ ID NO: 127471 - DNA, 20 bp, Artificial
  CRISPR gRNA sequence
gaaatacatttaattggcag

SEQ ID NO: 127472 - DNA, 20 bp, Artificial
  CRISPR gRNA sequence
cagaatcaggtcactgactt

SEQ ID NO: 127473 - DNA, 20 bp, Artificial
  CRISPR gRNA sequence
tcaaataggtaccctatgtt

SEQ ID NO: 127474 - DNA, 20 bp, Artificial
  CRISPR gRNA sequence
aaattttgcaattaataaca

SEQ ID NO: 127475 - DNA, 20 bp, Artificial
  CRISPR gRNA sequence
tgaaagtatgtatgaattac

SEQ ID NO: 127476 - DNA, 20 bp, Artificial
  CRISPR gRNA sequence
gaaattgaatggagccagct

SEQ ID NO: 127477 - DNA, 20 bp, Artificial
  CRISPR gRNA sequence
gaatggagccagctcagggc

SEQ ID NO: 127478 - DNA, 20 bp, Artificial
  CRISPR gRNA sequence
ctctcagcaaaattaattaa

SEQ ID NO: 127479 - DNA, 20 bp, Artificial
  CRISPR gRNA sequence
cgcctggctaatttcttaat

SEQ ID NO: 127480 - DNA, 20 bp, Artificial
  CRISPR gRNA sequence
ggcccaagtgatcctcccac

SEQ ID NO: 127481 - DNA, 20 bp, Artificial
  CRISPR gRNA sequence
caccttggcttcccaaagtt

SEQ ID NO: 127482 - DNA, 20 bp, Artificial
  CRISPR gRNA sequence
caggcatgagccacacctgg

SEQ ID NO: 127483 - DNA, 20 bp, Artificial
  CRISPR gRNA sequence
attaacctttgactagaatc

SEQ ID NO: 127484 - DNA, 20 bp, Artificial
  CRISPR gRNA sequence
attcaaaacatgggtgtact

SEQ ID NO: 127485 - DNA, 20 bp, Artificial
  CRISPR gRNA sequence
cagaattgtgcagagaatcc

SEQ ID NO: 127486 - DNA, 20 bp, Artificial
  CRISPR gRNA sequence
gcatgcttcttataccaagt

SEQ ID NO: 127487 - DNA, 20 bp, Artificial
  CRISPR gRNA sequence
agcaggagcaaaaggaaaat

SEQ ID NO: 127488 - DNA, 20 bp, Artificial
  CRISPR gRNA sequence
gaattccagttgatgactta

SEQ ID NO: 127489 - DNA, 20 bp, Artificial
  CRISPR gRNA sequence
ctcttgagctcaagcagtcc

SEQ ID NO: 127490 - DNA, 20 bp, Artificial
  CRISPR gRNA sequence
agctcaagcagtcctcctgc

SEQ ID NO: 127491 - DNA, 20 bp, Artificial
  CRISPR gRNA sequence
tacaggtacatgacactgtg

SEQ ID NO: 127492 - DNA, 20 bp, Artificial
  CRISPR gRNA sequence
gttgcctgtggtactatatt

SEQ ID NO: 127493 - DNA, 20 bp, Artificial
  CRISPR gRNA sequence
gcacttaaaaagaaagaggc

SEQ ID NO: 127494 - DNA, 20 bp, Artificial
  CRISPR gRNA sequence
aaaaagaaagaggcatatgc

SEQ ID NO: 127495 - DNA, 20 bp, Artificial
  CRISPR gRNA sequence
tttccttgtcgctattggcc

SEQ ID NO: 127496 - DNA, 20 bp, Artificial
  CRISPR gRNA sequence
gaatcgtggacaaattgtgg

SEQ ID NO: 127497 - DNA, 20 bp, Artificial
  CRISPR gRNA sequence
cattttgggaggctgaggta

SEQ ID NO: 127498 - DNA, 20 bp, Artificial
  CRISPR gRNA sequence
ttgggaggctgaggtaggtg

SEQ ID NO: 127499 - DNA, 20 bp, Artificial
  CRISPR gRNA sequence
ctactcaggaggctgaggtg

SEQ ID NO: 127500 - DNA, 20 bp, Artificial
  CRISPR gRNA sequence
tcaggaggctgaggtgggag

SEQ ID NO: 127501 - DNA, 20 bp, Artificial
  CRISPR gRNA sequence
aggattgcttcagcctggga

SEQ ID NO: 127502 - DNA, 20 bp, Artificial
  CRISPR gRNA sequence
gaaatataaattctctttta

SEQ ID NO: 127503 - DNA, 20 bp, Artificial
  CRISPR gRNA sequence
taattgatgcatcatcctgt

SEQ ID NO: 127504 - DNA, 20 bp, Artificial
  CRISPR gRNA sequence
gtttataagtgttgaatctg

SEQ ID NO: 127505 - DNA, 20 bp, Artificial
  CRISPR gRNA sequence
tactttgaaaagtattgaaa

SEQ ID NO: 127506 - DNA, 20 bp, Artificial
  CRISPR gRNA sequence
gatggtgacagttctacaac

SEQ ID NO: 127507 - DNA, 20 bp, Artificial
  CRISPR gRNA sequence
tacaccttgtctaaaatctg

SEQ ID NO: 127508 - DNA, 20 bp, Artificial
  CRISPR gRNA sequence
tttaaaatttgttatcgact

SEQ ID NO: 127509 - DNA, 20 bp, Artificial
  CRISPR gRNA sequence
agctattatatttcttgcac

SEQ ID NO: 127510 - DNA, 20 bp, Artificial
  CRISPR gRNA sequence
tcttgcacttatgatttatt

SEQ ID NO: 127511 - DNA, 20 bp, Artificial
  CRISPR gRNA sequence
gtgctcacacctataatccc

SEQ ID NO: 127512 - DNA, 20 bp, Artificial
  CRISPR gRNA sequence
caaaaaaattaaaaaattag

SEQ ID NO: 127513 - DNA, 20 bp, Artificial
  CRISPR gRNA sequence
gggggctgggggctgaggtg

SEQ ID NO: 127514 - DNA, 20 bp, Artificial
  CRISPR gRNA sequence
gctgggggctgaggtgggag

SEQ ID NO: 127515 - DNA, 20 bp, Artificial
  CRISPR gRNA sequence
attgcttgaatctgggaggt

SEQ ID NO: 127516 - DNA, 20 bp, Artificial
  CRISPR gRNA sequence
gaggtagaggcttcagtgag

SEQ ID NO: 127517 - DNA, 20 bp, Artificial
  CRISPR gRNA sequence
ataatttacttttgtggcat

SEQ ID NO: 127518 - DNA, 20 bp, Artificial
  CRISPR gRNA sequence
taatttttttttagtagaga

SEQ ID NO: 127519 - DNA, 20 bp, Artificial
  CRISPR gRNA sequence
ctcgtgacctcagatgatct

SEQ ID NO: 127520 - DNA, 20 bp, Artificial
  CRISPR gRNA sequence
tgcttcagcctcccaaagtg

SEQ ID NO: 127521 - DNA, 20 bp, Artificial
  CRISPR gRNA sequence
gtcatgagccaccacgcctg

SEQ ID NO: 127522 - DNA, 20 bp, Artificial
  CRISPR gRNA sequence
tttttagaagaaacttgcca

SEQ ID NO: 127523 - DNA, 20 bp, Artificial
  CRISPR gRNA sequence
cttagtacatatgaagagtg

SEQ ID NO: 127524 - DNA, 20 bp, Artificial
  CRISPR gRNA sequence
aaggatgttattggtactgc

SEQ ID NO: 127525 - DNA, 20 bp, Artificial
  CRISPR gRNA sequence
atgaacagttggatcactgc

SEQ ID NO: 127526 - DNA, 20 bp, Artificial
  CRISPR gRNA sequence
ctggatcagtaataatcaag

SEQ ID NO: 127527 - DNA, 20 bp, Artificial
  CRISPR gRNA sequence
gacaactttatatcaacttt

SEQ ID NO: 127528 - DNA, 20 bp, Artificial
  CRISPR gRNA sequence
ttatatagacttttacataa

SEQ ID NO: 127529 - DNA, 20 bp, Artificial
  CRISPR gRNA sequence
ataaatgagtttatataaac

SEQ ID NO: 127530 - DNA, 20 bp, Artificial
  CRISPR gRNA sequence
ggagccataggttacggtct

SEQ ID NO: 127531 - DNA, 20 bp, Artificial
  CRISPR gRNA sequence
ccaagctgtaggaaacacaa

SEQ ID NO: 127532 - DNA, 20 bp, Artificial
  CRISPR gRNA sequence
aggtggtatggagatgttat

SEQ ID NO: 127533 - DNA, 20 bp, Artificial
  CRISPR gRNA sequence
gatttttggagaatgggcaa

SEQ ID NO: 127534 - DNA, 20 bp, Artificial
  CRISPR gRNA sequence
aatggttaagaggtgaacca

SEQ ID NO: 127535 - DNA, 20 bp, Artificial
  CRISPR gRNA sequence
attttattctggatcacttt

SEQ ID NO: 127536 - DNA, 20 bp, Artificial
  CRISPR gRNA sequence
atcttgaaatagaaataata

SEQ ID NO: 127537 - DNA, 20 bp, Artificial
  CRISPR gRNA sequence
aagacacaaatggttcaaaa

SEQ ID NO: 127538 - DNA, 20 bp, Artificial
  CRISPR gRNA sequence
aacgtagaggagaaatttaa

SEQ ID NO: 127539 - DNA, 20 bp, Artificial
  CRISPR gRNA sequence
aggtcatgggtacagttagc

SEQ ID NO: 127540 - DNA, 20 bp, Artificial
  CRISPR gRNA sequence
tagctgttgatttcaatcat

SEQ ID NO: 127541 - DNA, 20 bp, Artificial
  CRISPR gRNA sequence
ggcagataaaatagaattta

SEQ ID NO: 127542 - DNA, 20 bp, Artificial
  CRISPR gRNA sequence
tttttttttttttttgggga

SEQ ID NO: 127543 - DNA, 20 bp, Artificial
  CRISPR gRNA sequence
tgcctcagcctcccgagtag

SEQ ID NO: 127544 - DNA, 20 bp, Artificial
  CRISPR gRNA sequence
ttttgtatttttggtagaaa

SEQ ID NO: 127545 - DNA, 20 bp, Artificial
  CRISPR gRNA sequence
cgccttggcctaccaaagtg

SEQ ID NO: 127546 - DNA, 20 bp, Artificial
  CRISPR gRNA sequence
tgagccactgtgcctggccc

SEQ ID NO: 127547 - DNA, 20 bp, Artificial
  CRISPR gRNA sequence
taggtacgttgtcagaacta

SEQ ID NO: 127548 - DNA, 20 bp, Artificial
  CRISPR gRNA sequence
ttttttttttttttttgaga

SEQ ID NO: 127549 - DNA, 20 bp, Artificial
  CRISPR gRNA sequence
aacctccacctcccaggttc

SEQ ID NO: 127550 - DNA, 20 bp, Artificial
  CRISPR gRNA sequence
gcctcagcctcccctggtag

SEQ ID NO: 127551 - DNA, 20 bp, Artificial
  CRISPR gRNA sequence
caagtactaaccaggcccga

SEQ ID NO: 127552 - DNA, 20 bp, Artificial
  CRISPR gRNA sequence
actaaccaggcccgaccctg

SEQ ID NO: 127553 - DNA, 20 bp, Artificial
  CRISPR gRNA sequence
attgatatttttttttctta

SEQ ID NO: 127554 - DNA, 20 bp, Artificial
  CRISPR gRNA sequence
cttggtctgaattaaaattc

SEQ ID NO: 127555 - DNA, 20 bp, Artificial
  CRISPR gRNA sequence
tggtaatttttctgtcattt

SEQ ID NO: 127556 - DNA, 20 bp, Artificial
  CRISPR gRNA sequence
aaaaagacttatggaagtaa

SEQ ID NO: 127557 - DNA, 20 bp, Artificial
  CRISPR gRNA sequence
tatgctattaaaatacatca

SEQ ID NO: 127558 - DNA, 20 bp, Artificial
  CRISPR gRNA sequence
acatcactaagcttagaact

SEQ ID NO: 127559 - DNA, 20 bp, Artificial
  CRISPR gRNA sequence
acagtttgagaattttgtcc

SEQ ID NO: 127560 - DNA, 20 bp, Artificial
  CRISPR gRNA sequence
taaggaaaaaaaagcacaaa

SEQ ID NO: 127561 - DNA, 20 bp, Artificial
  CRISPR gRNA sequence
aaaaaagcacaaatgctgat

SEQ ID NO: 127562 - DNA, 20 bp, Artificial
  CRISPR gRNA sequence
atgtgttgtaaatttgaaac

SEQ ID NO: 127563 - DNA, 20 bp, Artificial
  CRISPR gRNA sequence
attaaaatttctcatttaaa

SEQ ID NO: 127564 - DNA, 20 bp, Artificial
  CRISPR gRNA sequence
ttctcatttaaaaattgatt

SEQ ID NO: 127565 - DNA, 20 bp, Artificial
  CRISPR gRNA sequence
atgtggctcacattatatta

SEQ ID NO: 127566 - DNA, 20 bp, Artificial
  CRISPR gRNA sequence
cttgactgcatttatgcagt

SEQ ID NO: 127567 - DNA, 20 bp, Artificial
  CRISPR gRNA sequence
aggcatggcggtgaaagaca

SEQ ID NO: 127568 - DNA, 20 bp, Artificial
  CRISPR gRNA sequence
aaagacagtgtgtttcggca

SEQ ID NO: 127569 - DNA, 20 bp, Artificial
  CRISPR gRNA sequence
tgagtggtattgctgttaca

SEQ ID NO: 127570 - DNA, 20 bp, Artificial
  CRISPR gRNA sequence
gctgttacaagtggctttgc

SEQ ID NO: 127571 - DNA, 20 bp, Artificial
  CRISPR gRNA sequence
ttacaagtggctttgcaatt

SEQ ID NO: 127572 - DNA, 20 bp, Artificial
  CRISPR gRNA sequence
caattgcttgattaatccat

SEQ ID NO: 127573 - DNA, 20 bp, Artificial
  CRISPR gRNA sequence
ccccagacccttaagggaaa

SEQ ID NO: 127574 - DNA, 20 bp, Artificial
  CRISPR gRNA sequence
tttataatgaagtggcagat

SEQ ID NO: 127575 - DNA, 20 bp, Artificial
  CRISPR gRNA sequence
gcagatgtgtgcttctttag

SEQ ID NO: 127576 - DNA, 20 bp, Artificial
  CRISPR gRNA sequence
ttttccaagccttatgtgaa

SEQ ID NO: 127577 - DNA, 20 bp, Artificial
  CRISPR gRNA sequence
tgtgaattcagttttttagt

SEQ ID NO: 127578 - DNA, 20 bp, Artificial
  CRISPR gRNA sequence
attcagttttttagttcctg

SEQ ID NO: 127579 - DNA, 20 bp, Artificial
  CRISPR gRNA sequence
tttttagttcctgttttgct

SEQ ID NO: 127580 - DNA, 20 bp, Artificial
  CRISPR gRNA sequence
ccacaaaatatgcatggtgg

SEQ ID NO: 127581 - DNA, 20 bp, Artificial
  CRISPR gRNA sequence
tccaggggcactgggttatt

SEQ ID NO: 127582 - DNA, 20 bp, Artificial
  CRISPR gRNA sequence
tgtggggtggtaggaacatc

SEQ ID NO: 127583 - DNA, 20 bp, Artificial
  CRISPR gRNA sequence
tggtaggaacatccagtgat

SEQ ID NO: 127584 - DNA, 20 bp, Artificial
  CRISPR gRNA sequence
ttttgtacttttagtagaga

SEQ ID NO: 127585 - DNA, 20 bp, Artificial
  CRISPR gRNA sequence
cgcctcggcctcccaaagtg

SEQ ID NO: 127586 - DNA, 20 bp, Artificial
  CRISPR gRNA sequence
aggcactcttttacatctaa

SEQ ID NO: 127587 - DNA, 20 bp, Artificial
  CRISPR gRNA sequence
ctcttttacatctaaattag

SEQ ID NO: 127588 - DNA, 20 bp, Artificial
  CRISPR gRNA sequence
ttgtttctgtaaatagttgt

SEQ ID NO: 127589 - DNA, 20 bp, Artificial
  CRISPR gRNA sequence
aaggcttctctcacttgtat

SEQ ID NO: 127590 - DNA, 20 bp, Artificial
  CRISPR gRNA sequence
taatgttataacatatattt

SEQ ID NO: 127591 - DNA, 20 bp, Artificial
  CRISPR gRNA sequence
gtgaagatgtgttcttctga

SEQ ID NO: 127592 - DNA, 20 bp, Artificial
  CRISPR gRNA sequence
gttgttaggaaggtgatggt

SEQ ID NO: 127593 - DNA, 20 bp, Artificial
  CRISPR gRNA sequence
ttatagtttctgtaatttac

SEQ ID NO: 127594 - DNA, 20 bp, Artificial
  CRISPR gRNA sequence
aatttacctatgattttctc

SEQ ID NO: 127595 - DNA, 20 bp, Artificial
  CRISPR gRNA sequence
aagaatgtgtaagtgagttc

SEQ ID NO: 127596 - DNA, 20 bp, Artificial
  CRISPR gRNA sequence
ttctctttgctatgtctact

SEQ ID NO: 127597 - DNA, 20 bp, Artificial
  CRISPR gRNA sequence
ggtaaataaaatatctccca

SEQ ID NO: 127598 - DNA, 20 bp, Artificial
  CRISPR gRNA sequence
tgcctcagcctcctgagtag

SEQ ID NO: 127599 - DNA, 20 bp, Artificial
  CRISPR gRNA sequence
gcgtgcaccaccatgcctgg

SEQ ID NO: 127600 - DNA, 20 bp, Artificial
  CRISPR gRNA sequence
tgcctcggcctcccaaagtg

SEQ ID NO: 127601 - DNA, 20 bp, Artificial
  CRISPR gRNA sequence
gccaccatgcccggccccca

SEQ ID NO: 127602 - DNA, 20 bp, Artificial
  CRISPR gRNA sequence
tttaactttgtaaatgtatt

SEQ ID NO: 127603 - DNA, 20 bp, Artificial
  CRISPR gRNA sequence
aacatttctcagaagtattt

SEQ ID NO: 127604 - DNA, 20 bp, Artificial
  CRISPR gRNA sequence
caacatttttggcaccaggg

SEQ ID NO: 127605 - DNA, 20 bp, Artificial
  CRISPR gRNA sequence
ggggaggggtgcgaggggta

SEQ ID NO: 127606 - DNA, 20 bp, Artificial
  CRISPR gRNA sequence
cctcagatcatcaggcatta

SEQ ID NO: 127607 - DNA, 20 bp, Artificial
  CRISPR gRNA sequence
ggcggagctcaggtggtaat

SEQ ID NO: 127608 - DNA, 20 bp, Artificial
  CRISPR gRNA sequence
agaaagtcctttctttttcc

SEQ ID NO: 127609 - DNA, 20 bp, Artificial
  CRISPR gRNA sequence
ctaactatagcatagttata

SEQ ID NO: 127610 - DNA, 20 bp, Artificial
  CRISPR gRNA sequence
atgcaaattctgtggccttg

SEQ ID NO: 127611 - DNA, 20 bp, Artificial
  CRISPR gRNA sequence
attatttaattactttaggc

SEQ ID NO: 127612 - DNA, 20 bp, Artificial
  CRISPR gRNA sequence
ggtataatcatatgtcttat

SEQ ID NO: 127613 - DNA, 20 bp, Artificial
  CRISPR gRNA sequence
attgaattcttctatatttc

SEQ ID NO: 127614 - DNA, 20 bp, Artificial
  CRISPR gRNA sequence
ggtttatctttgcctgtagg

SEQ ID NO: 127615 - DNA, 20 bp, Artificial
  CRISPR gRNA sequence
cagcatatttatttccacat

SEQ ID NO: 127616 - DNA, 20 bp, Artificial
  CRISPR gRNA sequence
ttccacatgccagcttaggt

SEQ ID NO: 127617 - DNA, 20 bp, Artificial
  CRISPR gRNA sequence
aaatatattcttaatatctt

SEQ ID NO: 127618 - DNA, 20 bp, Artificial
  CRISPR gRNA sequence
taatttaggaatttttaact

SEQ ID NO: 127619 - DNA, 20 bp, Artificial
  CRISPR gRNA sequence
aagtgatcacttggatcatt

SEQ ID NO: 127620 - DNA, 20 bp, Artificial
  CRISPR gRNA sequence
atttataagctcaatattgg

SEQ ID NO: 127621 - DNA, 20 bp, Artificial
  CRISPR gRNA sequence
tttatttttatctgtaaata

SEQ ID NO: 127622 - DNA, 20 bp, Artificial
  CRISPR gRNA sequence
cattactaactctgtcttgt

SEQ ID NO: 127623 - DNA, 20 bp, Artificial
  CRISPR gRNA sequence
aactctgtcttgttaatgat

SEQ ID NO: 127624 - DNA, 20 bp, Artificial
  CRISPR gRNA sequence
accagaagtgttaataaata

SEQ ID NO: 127625 - DNA, 20 bp, Artificial
  CRISPR gRNA sequence
gtgttaataaatactctgct

SEQ ID NO: 127626 - DNA, 20 bp, Artificial
  CRISPR gRNA sequence
agctacagatggactaagtg

SEQ ID NO: 127627 - DNA, 20 bp, Artificial
  CRISPR gRNA sequence
cattgttataatacaagtca

SEQ ID NO: 127628 - DNA, 20 bp, Artificial
  CRISPR gRNA sequence
caagtcatgtagattgttag

SEQ ID NO: 127629 - DNA, 20 bp, Artificial
  CRISPR gRNA sequence
tcagtgagtgataagtgtag

SEQ ID NO: 127630 - DNA, 20 bp, Artificial
  CRISPR gRNA sequence
tctgactgagttctgtagcc

SEQ ID NO: 127631 - DNA, 20 bp, Artificial
  CRISPR gRNA sequence
ctgtagcccctagtttttgg

SEQ ID NO: 127632 - DNA, 20 bp, Artificial
  CRISPR gRNA sequence
atgagataggaatattaagg

SEQ ID NO: 127633 - DNA, 20 bp, Artificial
  CRISPR gRNA sequence
aaagtttgtaatataaaatc

SEQ ID NO: 127634 - DNA, 20 bp, Artificial
  CRISPR gRNA sequence
atgatttaaataaatttcaa

SEQ ID NO: 127635 - DNA, 20 bp, Artificial
  CRISPR gRNA sequence
agccaaacctcatggtgtag

SEQ ID NO: 127636 - DNA, 20 bp, Artificial
  CRISPR gRNA sequence
gaaacttcatccagtctgtc

SEQ ID NO: 127637 - DNA, 20 bp, Artificial
  CRISPR gRNA sequence
aaaaacgcaatataaaataa

SEQ ID NO: 127638 - DNA, 20 bp, Artificial
  CRISPR gRNA sequence
attttttaaaatggaaaatt

SEQ ID NO: 127639 - DNA, 20 bp, Artificial
  CRISPR gRNA sequence
ttttagctaaccagttacca

SEQ ID NO: 127640 - DNA, 20 bp, Artificial
  CRISPR gRNA sequence
gacggtcaacaacaaaatgt

SEQ ID NO: 127641 - DNA, 20 bp, Artificial
  CRISPR gRNA sequence
ggtacagtcctttgtatttt

SEQ ID NO: 127642 - DNA, 20 bp, Artificial
  CRISPR gRNA sequence
gtattttaaatgcttaaaaa

SEQ ID NO: 127643 - DNA, 20 bp, Artificial
  CRISPR gRNA sequence
tggcgtgtacctgtaatccc

SEQ ID NO: 127644 - DNA, 20 bp, Artificial
  CRISPR gRNA sequence
gataaagaaggttattaaaa

SEQ ID NO: 127645 - DNA, 20 bp, Artificial
  CRISPR gRNA sequence
gcatatgttcatatttgcat

SEQ ID NO: 127646 - DNA, 20 bp, Artificial
  CRISPR gRNA sequence
ctcaatttaaattttctaat

SEQ ID NO: 127647 - DNA, 20 bp, Artificial
  CRISPR gRNA sequence
gatttctggtgttcagcaaa

SEQ ID NO: 127648 - DNA, 20 bp, Artificial
  CRISPR gRNA sequence
gtgtagagaaatgagagtct

SEQ ID NO: 127649 - DNA, 20 bp, Artificial
  CRISPR gRNA sequence
ttgtatattaatagctgtaa

SEQ ID NO: 127650 - DNA, 20 bp, Artificial
  CRISPR gRNA sequence
atagctgtaatgtagcttcc

SEQ ID NO: 127651 - DNA, 20 bp, Artificial
  CRISPR gRNA sequence
gacttgagaatctttttcat

SEQ ID NO: 127652 - DNA, 20 bp, Artificial
  CRISPR gRNA sequence
tgaatgattttaaagaaaaa

SEQ ID NO: 127653 - DNA, 20 bp, Artificial
  CRISPR gRNA sequence
ttttaaaggtattaaaatat

SEQ ID NO: 127654 - DNA, 20 bp, Artificial
  CRISPR gRNA sequence
aaaatatttttgttttgtac

SEQ ID NO: 127655 - DNA, 20 bp, Artificial
  CRISPR gRNA sequence
atattgcaatttattactgt

SEQ ID NO: 127656 - DNA, 20 bp, Artificial
  CRISPR gRNA sequence
attactgtcagagatttgta

SEQ ID NO: 127657 - DNA, 20 bp, Artificial
  CRISPR gRNA sequence
taagcggctgggttaattca

SEQ ID NO: 127658 - DNA, 20 bp, Artificial
  CRISPR gRNA sequence
aagttgcctttattataaat

SEQ ID NO: 127659 - DNA, 20 bp, Artificial
  CRISPR gRNA sequence
ataccttgcatgataaccta

SEQ ID NO: 127660 - DNA, 20 bp, Artificial
  CRISPR gRNA sequence
tatttttttggtaaaacatt

SEQ ID NO: 127661 - DNA, 20 bp, Artificial
  CRISPR gRNA sequence
ttaaacttggtgcccattaa

SEQ ID NO: 127662 - DNA, 20 bp, Artificial
  CRISPR gRNA sequence
ctgttcatcgtgcctgttaa

SEQ ID NO: 127663 - DNA, 20 bp, Artificial
  CRISPR gRNA sequence
gttaatgtagttttagttac

SEQ ID NO: 127664 - DNA, 20 bp, Artificial
  CRISPR gRNA sequence
gttactggagcttttttaag

SEQ ID NO: 127665 - DNA, 20 bp, Artificial
  CRISPR gRNA sequence
ggagcttttttaagactaga

SEQ ID NO: 127666 - DNA, 20 bp, Artificial
  CRISPR gRNA sequence
ttaagaatgtgggaatatat

SEQ ID NO: 127667 - DNA, 20 bp, Artificial
  CRISPR gRNA sequence
tggtgcccctttcatttggt

SEQ ID NO: 127668 - DNA, 20 bp, Artificial
  CRISPR gRNA sequence
atagtattctcttacagaag

SEQ ID NO: 127669 - DNA, 20 bp, Artificial
  CRISPR gRNA sequence
ttacctttttaattgaaatg

SEQ ID NO: 127670 - DNA, 20 bp, Artificial
  CRISPR gRNA sequence
gtataatttagtagtatgta

SEQ ID NO: 127671 - DNA, 20 bp, Artificial
  CRISPR gRNA sequence
aatttagtagtatgtacttg

SEQ ID NO: 127672 - DNA, 20 bp, Artificial
  CRISPR gRNA sequence
gattgtttctttttgaaaag

SEQ ID NO: 127673 - DNA, 20 bp, Artificial
  CRISPR gRNA sequence
tttttggtgttaattaactt

SEQ ID NO: 127674 - DNA, 20 bp, Artificial
  CRISPR gRNA sequence
taacttgagggatttctttt

SEQ ID NO: 127675 - DNA, 20 bp, Artificial
  CRISPR gRNA sequence
aatatcaaaaattgctattg

SEQ ID NO: 127676 - DNA, 20 bp, Artificial
  CRISPR gRNA sequence
attgtgcataccattttgta

SEQ ID NO: 127677 - DNA, 20 bp, Artificial
  CRISPR gRNA sequence
tagtcttctgcatcattttt

SEQ ID NO: 127678 - DNA, 20 bp, Artificial
  CRISPR gRNA sequence
tgaatcccatgtacatccat

SEQ ID NO: 127679 - DNA, 20 bp, Artificial
  CRISPR gRNA sequence
ttaccaaatatgcaaaattt

SEQ ID NO: 127680 - DNA, 20 bp, Artificial
  CRISPR gRNA sequence
aactgataaaagcacttggt

SEQ ID NO: 127681 - DNA, 20 bp, Artificial
  CRISPR gRNA sequence
tactgtctctaaaattattt

SEQ ID NO: 127682 - DNA, 20 bp, Artificial
  CRISPR gRNA sequence
atttggtaacccagcaattc

SEQ ID NO: 127683 - DNA, 20 bp, Artificial
  CRISPR gRNA sequence
acccagcaattcaaagaatt

SEQ ID NO: 127684 - DNA, 20 bp, Artificial
  CRISPR gRNA sequence
aattatgattgagtcataca

SEQ ID NO: 127685 - DNA, 20 bp, Artificial
  CRISPR gRNA sequence
tttgatattaaaaacttaaa

SEQ ID NO: 127686 - DNA, 20 bp, Artificial
  CRISPR gRNA sequence
ctcaagttaattaacaccaa

SEQ ID NO: 127687 - DNA, 20 bp, Artificial
  CRISPR gRNA sequence
ttaacaccaaaaagaataga

SEQ ID NO: 127688 - DNA, 20 bp, Artificial
  CRISPR gRNA sequence
tacaaatcctcacttttcaa

SEQ ID NO: 127689 - DNA, 20 bp, Artificial
  CRISPR gRNA sequence
tataaaactcctcttctgta

SEQ ID NO: 127690 - DNA, 20 bp, Artificial
  CRISPR gRNA sequence
tttaataaatacagcaaatg

SEQ ID NO: 127691 - DNA, 20 bp, Artificial
  CRISPR gRNA sequence
aacatgattcaatatgaaaa

SEQ ID NO: 127692 - DNA, 20 bp, Artificial
  CRISPR gRNA sequence
tcatgaaaaagattctcaag

SEQ ID NO: 127693 - DNA, 20 bp, Artificial
  CRISPR gRNA sequence
ttccttctgatgtctctgtt

SEQ ID NO: 127694 - DNA, 20 bp, Artificial
  CRISPR gRNA sequence
aaaactgaatttgctgaaca

SEQ ID NO: 127695 - DNA, 20 bp, Artificial
  CRISPR gRNA sequence
tgaacaccagaaatctaaga

SEQ ID NO: 127696 - DNA, 20 bp, Artificial
  CRISPR gRNA sequence
gattagaaaatttaaattga

SEQ ID NO: 127697 - DNA, 20 bp, Artificial
  CRISPR gRNA sequence
aatttaaattgagcagaatt

SEQ ID NO: 127698 - DNA, 20 bp, Artificial
  CRISPR gRNA sequence
cccatttcttgtgtatcttt

SEQ ID NO: 127699 - DNA, 20 bp, Artificial
  CRISPR gRNA sequence
ctatatactgttatctacat

SEQ ID NO: 127700 - DNA, 20 bp, Artificial
  CRISPR gRNA sequence
agctggtaactggttagcta

SEQ ID NO: 127701 - DNA, 20 bp, Artificial
  CRISPR gRNA sequence
agcagcatatagtttacata

SEQ ID NO: 127702 - DNA, 20 bp, Artificial
  CRISPR gRNA sequence
catatgagaaatatatataa

SEQ ID NO: 127703 - DNA, 20 bp, Artificial
  CRISPR gRNA sequence
agtgaaaggttataatgtct

SEQ ID NO: 127704 - DNA, 20 bp, Artificial
  CRISPR gRNA sequence
aagacagagttagtaatgac

SEQ ID NO: 127705 - DNA, 20 bp, Artificial
  CRISPR gRNA sequence
gattcaaacactaaagatat

SEQ ID NO: 127706 - DNA, 20 bp, Artificial
  CRISPR gRNA sequence
cctacaggcaaagataaacc

SEQ ID NO: 127707 - DNA, 20 bp, Artificial
  CRISPR gRNA sequence
agataaacctaagaaatata

SEQ ID NO: 127708 - DNA, 20 bp, Artificial
  CRISPR gRNA sequence
taaataatctgtccaaggcc

SEQ ID NO: 127709 - DNA, 20 bp, Artificial
  CRISPR gRNA sequence
ttagtaataaacaaagggaa

SEQ ID NO: 127710 - DNA, 20 bp, Artificial
  CRISPR gRNA sequence
tctaggctgtgcgttcctta

SEQ ID NO: 127711 - DNA, 20 bp, Artificial
  CRISPR gRNA sequence
tataagcaattaaatacttc

SEQ ID NO: 127712 - DNA, 20 bp, Artificial
  CRISPR gRNA sequence
ctccacctcaaaaaaaaaaa

SEQ ID NO: 127713 - DNA, 20 bp, Artificial
  CRISPR gRNA sequence
gcctaaagtagacatagcaa

SEQ ID NO: 127714 - DNA, 20 bp, Artificial
  CRISPR gRNA sequence
tggcatcttttgcaatctga

SEQ ID NO: 127715 - DNA, 20 bp, Artificial
  CRISPR gRNA sequence
gagaaaatcataggtaaatt

SEQ ID NO: 127716 - DNA, 20 bp, Artificial
  CRISPR gRNA sequence
caaaagtccacacctcagag

SEQ ID NO: 127717 - DNA, 20 bp, Artificial
  CRISPR gRNA sequence
agaagccttgacaactattt

SEQ ID NO: 127718 - DNA, 20 bp, Artificial
  CRISPR gRNA sequence
ctactcaggaggatgaggca

SEQ ID NO: 127719 - DNA, 20 bp, Artificial
  CRISPR gRNA sequence
catttccatgaataaagaca

SEQ ID NO: 127720 - DNA, 20 bp, Artificial
  CRISPR gRNA sequence
tcacataaggcttggaaaag

SEQ ID NO: 127721 - DNA, 20 bp, Artificial
  CRISPR gRNA sequence
ccatgcctattttccatact

SEQ ID NO: 127722 - DNA, 20 bp, Artificial
  CRISPR gRNA sequence
caaattcttaccatttaaac

SEQ ID NO: 127723 - DNA, 20 bp, Artificial
  CRISPR gRNA sequence
acatagaatcaatttttaaa

SEQ ID NO: 127724 - DNA, 20 bp, Artificial
  CRISPR gRNA sequence
tctttttaaactataaaatg

SEQ ID NO: 127725 - DNA, 20 bp, Artificial
  CRISPR gRNA sequence
aaatgacagaaaaattacca

SEQ ID NO: 127726 - DNA, 20 bp, Artificial
  CRISPR gRNA sequence
tctaagaagacaaaactact

SEQ ID NO: 127727 - DNA, 20 bp, Artificial
  CRISPR gRNA sequence
taccaggggaggctgaggca

SEQ ID NO: 127728 - DNA, 20 bp, Artificial
  CRISPR gRNA sequence
aagaccagcctgaccaacat

SEQ ID NO: 127729 - DNA, 20 bp, Artificial
  CRISPR gRNA sequence
ctactcgggaggctgaggca

SEQ ID NO: 127730 - DNA, 20 bp, Artificial
  CRISPR gRNA sequence
ggagaacatttagggacatg

SEQ ID NO: 127731 - DNA, 20 bp, Artificial
  CRISPR gRNA sequence
taactgtgtatgtagacatg

SEQ ID NO: 127732 - DNA, 20 bp, Artificial
  CRISPR gRNA sequence
tcatgctgtcctcagtatct

SEQ ID NO: 127733 - DNA, 20 bp, Artificial
  CRISPR gRNA sequence
cttattatttctatttcaag

SEQ ID NO: 127734 - DNA, 20 bp, Artificial
  CRISPR gRNA sequence
gaaaaaactaccaaagtgat

SEQ ID NO: 127735 - DNA, 20 bp, Artificial
  CRISPR gRNA sequence
gccttttctcttacacattt

SEQ ID NO: 127736 - DNA, 20 bp, Artificial
  CRISPR gRNA sequence
aagtttatataaaattcttt

SEQ ID NO: 127737 - DNA, 20 bp, Artificial
  CRISPR gRNA sequence
atgtgtttaaaatgatgtta

SEQ ID NO: 127738 - DNA, 20 bp, Artificial
  CRISPR gRNA sequence
ctaacgggcaggctgaggca

SEQ ID NO: 127739 - DNA, 20 bp, Artificial
  CRISPR gRNA sequence
ccaaaaataaatcataagtg

SEQ ID NO: 127740 - DNA, 20 bp, Artificial
  CRISPR gRNA sequence
aagtgcaagaaatataatag

SEQ ID NO: 127741 - DNA, 20 bp, Artificial
  CRISPR gRNA sequence
gaagtcgataacaaatttta

SEQ ID NO: 127742 - DNA, 20 bp, Artificial
  CRISPR gRNA sequence
ctttctaacttgcttcaact

SEQ ID NO: 127743 - DNA, 20 bp, Artificial
  CRISPR gRNA sequence
ctgtcaccatccatctatga

SEQ ID NO: 127744 - DNA, 20 bp, Artificial
  CRISPR gRNA sequence
atagccttaagcttactaaa

SEQ ID NO: 127745 - DNA, 20 bp, Artificial
  CRISPR gRNA sequence
tggcgtgatcacagctcact

SEQ ID NO: 127746 - DNA, 20 bp, Artificial
  CRISPR gRNA sequence
ctctaaaaaaaaacaaaaat

SEQ ID NO: 127747 - DNA, 20 bp, Artificial
  CRISPR gRNA sequence
aggaaaattacctgcacaga

SEQ ID NO: 127748 - DNA, 20 bp, Artificial
  CRISPR gRNA sequence
attaattttgctgagagcta

SEQ ID NO: 127749 - DNA, 20 bp, Artificial
  CRISPR gRNA sequence
tacatactttcaggctgaac

SEQ ID NO: 127750 - DNA, 20 bp, Artificial
  CRISPR gRNA sequence
tatatagttgttgtaagggg

SEQ ID NO: 127751 - DNA, 20 bp, Artificial
  CRISPR gRNA sequence
ttgttgtaagggggtagaaa

SEQ ID NO: 127752 - DNA, 20 bp, Artificial
  CRISPR gRNA sequence
gatttttttttacagccata

SEQ ID NO: 127753 - DNA, 20 bp, Artificial
  CRISPR gRNA sequence
gagggcaggcggtgggttgg

SEQ ID NO: 127754 - DNA, 20 bp, Artificial
  CRISPR gRNA sequence
gcggtgggttgggaagaata

SEQ ID NO: 127755 - DNA, 20 bp, Artificial
  CRISPR gRNA sequence
gatctgggagatgaattaat

SEQ ID NO: 127756 - DNA, 20 bp, Artificial
  CRISPR gRNA sequence
aaaagtatttcctagagttg

SEQ ID NO: 127757 - DNA, 20 bp, Artificial
  CRISPR gRNA sequence
ttgtcagaattaaataaaga

SEQ ID NO: 127758 - DNA, 20 bp, Artificial
  CRISPR gRNA sequence
gtcaacctaatctttgatgc

SEQ ID NO: 127759 - DNA, 20 bp, Artificial
  CRISPR gRNA sequence
gccagccattcgcctatata

SEQ ID NO: 127760 - DNA, 20 bp, Artificial
  CRISPR gRNA sequence
taattgctagtgccaagtac

SEQ ID NO: 127761 - DNA, 20 bp, Artificial
  CRISPR gRNA sequence
acctcactagtctgaggggt

SEQ ID NO: 127762 - DNA, 20 bp, Artificial
  CRISPR gRNA sequence
aaaatgagactgacagataa

SEQ ID NO: 127763 - DNA, 20 bp, Artificial
  CRISPR gRNA sequence
aacagaaatcagtcaggcaa

SEQ ID NO: 127764 - DNA, 20 bp, Artificial
  CRISPR gRNA sequence
gggaaacgaatgttctaggc

SEQ ID NO: 127765 - DNA, 20 bp, Artificial
  CRISPR gRNA sequence
atgttctaggcagagaaaac

SEQ ID NO: 127766 - DNA, 20 bp, Artificial
  CRISPR gRNA sequence
ccctctggctacagttcagt

SEQ ID NO: 127767 - DNA, 20 bp, Artificial
  CRISPR gRNA sequence
agacagacagctgtcaccgc

SEQ ID NO: 127768 - DNA, 20 bp, Artificial
  CRISPR gRNA sequence
ctcattatttagttgaattg

SEQ ID NO: 127769 - DNA, 20 bp, Artificial
  CRISPR gRNA sequence
tcacaagcctgtgacgcagg

SEQ ID NO: 127770 - DNA, 20 bp, Artificial
  CRISPR gRNA sequence
tccttttatctatctgagga

SEQ ID NO: 127771 - DNA, 20 bp, Artificial
  CRISPR gRNA sequence
atgtactttttaaccccaac

SEQ ID NO: 127772 - DNA, 20 bp, Artificial
  CRISPR gRNA sequence
cactactgtaattctactaa

SEQ ID NO: 127773 - DNA, 20 bp, Artificial
  CRISPR gRNA sequence
ggttaataaaaatctttgtg

SEQ ID NO: 127774 - DNA, 20 bp, Artificial
  CRISPR gRNA sequence
ttacagatatagtagcacat

SEQ ID NO: 127775 - DNA, 20 bp, Artificial
  CRISPR gRNA sequence
aagttaattccatggggaaa

SEQ ID NO: 127776 - DNA, 20 bp, Artificial
  CRISPR gRNA sequence
aagaggaggaaaaaattatc

SEQ ID NO: 127777 - DNA, 20 bp, Artificial
  CRISPR gRNA sequence
agaatataatgcttttcaat

SEQ ID NO: 127778 - DNA, 20 bp, Artificial
  CRISPR gRNA sequence
agcatgaaatctagcaaata

SEQ ID NO: 127779 - DNA, 20 bp, Artificial
  CRISPR gRNA sequence
tcctctaaccccaaaactgc

SEQ ID NO: 127780 - DNA, 20 bp, Artificial
  CRISPR gRNA sequence
agaaaagtccttccttgtaa

SEQ ID NO: 127781 - DNA, 20 bp, Artificial
  CRISPR gRNA sequence
atatttagactcagtacatt

SEQ ID NO: 127782 - DNA, 20 bp, Artificial
  CRISPR gRNA sequence
catacatctgtttaatgttt

SEQ ID NO: 127783 - DNA, 20 bp, Artificial
  CRISPR gRNA sequence
aagaaatgcaaatttgtatc

SEQ ID NO: 127784 - DNA, 20 bp, Artificial
  CRISPR gRNA sequence
ccaatcggctgtttggttgg

SEQ ID NO: 127785 - DNA, 20 bp, Artificial
  CRISPR gRNA sequence
ccgcagcctggtttgcgcgt

SEQ ID NO: 127786 - DNA, 20 bp, Artificial
  CRISPR gRNA sequence
gaacggtagtcttagagaac

SEQ ID NO: 127787 - DNA, 20 bp, Artificial
  CRISPR gRNA sequence
aaactctggttgttgatgcc

SEQ ID NO: 127788 - DNA, 20 bp, Artificial
  CRISPR gRNA sequence
tacatatatcaacctgccct

SEQ ID NO: 127789 - DNA, 20 bp, Artificial
  CRISPR gRNA sequence
aggatactattaatatttga

SEQ ID NO: 127790 - DNA, 20 bp, Artificial
  CRISPR gRNA sequence
ccccatttaattgtttcctt

SEQ ID NO: 127791 - DNA, 20 bp, Artificial
  CRISPR gRNA sequence
atttaattgtttcctttgag

SEQ ID NO: 127792 - DNA, 20 bp, Artificial
  CRISPR gRNA sequence
ttgagaaagaatggagcaaa

SEQ ID NO: 127793 - DNA, 20 bp, Artificial
  CRISPR gRNA sequence
ttttttgatatcttctcagt

SEQ ID NO: 127794 - DNA, 20 bp, Artificial
  CRISPR gRNA sequence
ttttttcctcctcttgagct

SEQ ID NO: 127795 - DNA, 20 bp, Artificial
  CRISPR gRNA sequence
aaatgttactctgaaacatt

SEQ ID NO: 127796 - DNA, 20 bp, Artificial
  CRISPR gRNA sequence
ataccatgtactccattgat

SEQ ID NO: 127797 - DNA, 20 bp, Artificial
  CRISPR gRNA sequence
acaagccctctttaatttta

SEQ ID NO: 127798 - DNA, 20 bp, Artificial
  CRISPR gRNA sequence
atttatactggaggtgcctg

SEQ ID NO: 127799 - DNA, 20 bp, Artificial
  CRISPR gRNA sequence
tacttaggggacagttatgc

SEQ ID NO: 127800 - DNA, 20 bp, Artificial
  CRISPR gRNA sequence
ctcaaaggataatgtaggaa

SEQ ID NO: 127801 - DNA, 20 bp, Artificial
  CRISPR gRNA sequence
tttttattaaccatgaagat

SEQ ID NO: 127802 - DNA, 20 bp, Artificial
  CRISPR gRNA sequence
aggaagcctttaggaacctt

SEQ ID NO: 127803 - DNA, 20 bp, Artificial
  CRISPR gRNA sequence
aagggctggtattcttctta

SEQ ID NO: 127804 - DNA, 20 bp, Artificial
  CRISPR gRNA sequence
atgggttgcttgagtggcaa

SEQ ID NO: 127805 - DNA, 20 bp, Artificial
  CRISPR gRNA sequence
gtgatatttagtgagttcat

SEQ ID NO: 127806 - DNA, 20 bp, Artificial
  CRISPR gRNA sequence
agttcattaagaaaataagg

SEQ ID NO: 127807 - DNA, 20 bp, Artificial
  CRISPR gRNA sequence
gctttggaaatcagagtagg

SEQ ID NO: 127808 - DNA, 20 bp, Artificial
  CRISPR gRNA sequence
tgtcttaacaactgtcaggg

SEQ ID NO: 127809 - DNA, 20 bp, Artificial
  CRISPR gRNA sequence
tagctaggcaagggtatggg

SEQ ID NO: 127810 - DNA, 20 bp, Artificial
  CRISPR gRNA sequence
atagataaaaggaatgtaac

SEQ ID NO: 127811 - DNA, 20 bp, Artificial
  CRISPR gRNA sequence
aaagggtaaattaagagaga

SEQ ID NO: 127812 - DNA, 20 bp, Artificial
  CRISPR gRNA sequence
gagagaagaatctctgcctg

SEQ ID NO: 127813 - DNA, 20 bp, Artificial
  CRISPR gRNA sequence
tcagtgtataatcagtagcc

SEQ ID NO: 127814 - DNA, 20 bp, Artificial
  CRISPR gRNA sequence
gtgaacattgcatgagatat

SEQ ID NO: 127815 - DNA, 20 bp, Artificial
  CRISPR gRNA sequence
tttatttcaaataatatttt

SEQ ID NO: 127816 - DNA, 20 bp, Artificial
  CRISPR gRNA sequence
ctgtcaattcaactaaataa

SEQ ID NO: 127817 - DNA, 20 bp, Artificial
  CRISPR gRNA sequence
gctgtctgtctctccagctg

SEQ ID NO: 127818 - DNA, 20 bp, Artificial
  CRISPR gRNA sequence
ttttataggatgttttagac

SEQ ID NO: 127819 - DNA, 20 bp, Artificial
  CRISPR gRNA sequence
agaacatttgtttttgaatt

SEQ ID NO: 127820 - DNA, 20 bp, Artificial
  CRISPR gRNA sequence
tgaattgcagaaaggataaa

SEQ ID NO: 127821 - DNA, 20 bp, Artificial
  CRISPR gRNA sequence
tctggggcaggattttaatg

SEQ ID NO: 127822 - DNA, 20 bp, Artificial
  CRISPR gRNA sequence
aagacagaaggcgtgaaatg

SEQ ID NO: 127823 - DNA, 20 bp, Artificial
  CRISPR gRNA sequence
catgtaaacactcattcagg

SEQ ID NO: 127824 - DNA, 20 bp, Artificial
  CRISPR gRNA sequence
tcaggggatcagtaggagag

SEQ ID NO: 127825 - DNA, 20 bp, Artificial
  CRISPR gRNA sequence
ttacaacaactatataaatt

SEQ ID NO: 127826 - DNA, 20 bp, Artificial
  CRISPR gRNA sequence
tcacagtcaacagatgcatg

SEQ ID NO: 127827 - DNA, 20 bp, Artificial
  CRISPR gRNA sequence
tgagtagtagtatttgcaaa

SEQ ID NO: 127828 - DNA, 20 bp, Artificial
  CRISPR gRNA sequence
ggccctgatttggcaggggg

SEQ ID NO: 127829 - DNA, 20 bp, Artificial
  CRISPR gRNA sequence
gagagaaaattaacctttga

SEQ ID NO: 127830 - DNA, 20 bp, Artificial
  CRISPR gRNA sequence
tacttttggcttgcctgggt

SEQ ID NO: 127831 - DNA, 20 bp, Artificial
  CRISPR gRNA sequence
gcctgggtacagaattgtgc

SEQ ID NO: 127832 - DNA, 20 bp, Artificial
  CRISPR gRNA sequence
tgtctattttggaacttcta

SEQ ID NO: 127833 - DNA, 20 bp, Artificial
  CRISPR gRNA sequence
tggaacttctatgagaaagc

SEQ ID NO: 127834 - DNA, 20 bp, Artificial
  CRISPR gRNA sequence
tttgaagattatgcacttaa

SEQ ID NO: 127835 - DNA, 20 bp, Artificial
  CRISPR gRNA sequence
ttgtgggaaagtttccaaat

SEQ ID NO: 127836 - DNA, 20 bp, Artificial
  CRISPR gRNA sequence
aaaataattaattttttaaa

SEQ ID NO: 127837 - DNA, 20 bp, Artificial
  CRISPR gRNA sequence
aattctcaagttgaagcaag

SEQ ID NO: 127838 - DNA, 20 bp, Artificial
  CRISPR gRNA sequence
aatcttgtgttacggttcaa

SEQ ID NO: 127839 - DNA, 20 bp, Artificial
  CRISPR gRNA sequence
ggcgtaccatgctattttta

SEQ ID NO: 127840 - DNA, 20 bp, Artificial
  CRISPR gRNA sequence
tttattagaaatagtcttca

SEQ ID NO: 127841 - DNA, 20 bp, Artificial
  CRISPR gRNA sequence
cttcctgtttaaatgttaaa

SEQ ID NO: 127842 - DNA, 20 bp, Artificial
  CRISPR gRNA sequence
actttgaactatgtcaggta

SEQ ID NO: 127843 - DNA, 20 bp, Artificial
  CRISPR gRNA sequence
ggcagtgttatgttggccta

SEQ ID NO: 127844 - DNA, 20 bp, Artificial
  CRISPR gRNA sequence
aaaattgagatatattttta

SEQ ID NO: 127845 - DNA, 20 bp, Artificial
  CRISPR gRNA sequence
gtccagtttttccattcttt

SEQ ID NO: 127846 - DNA, 20 bp, Artificial
  CRISPR gRNA sequence
gtttatataaacttgggttt

SEQ ID NO: 127847 - DNA, 20 bp, Artificial
  CRISPR gRNA sequence
taagtagcaaaaatctaata

SEQ ID NO: 127848 - DNA, 20 bp, Artificial
  CRISPR gRNA sequence
aaaaattctaaaaatgtgta

SEQ ID NO: 127849 - DNA, 20 bp, Artificial
  CRISPR gRNA sequence
agaagcacttacattttatg

SEQ ID NO: 127850 - DNA, 20 bp, Artificial
  CRISPR gRNA sequence
agatgttatttgagattttt

SEQ ID NO: 127851 - DNA, 20 bp, Artificial
  CRISPR gRNA sequence
aataatggttaagaggtgaa

SEQ ID NO: 127852 - DNA, 20 bp, Artificial
  CRISPR gRNA sequence
gtagttttttctatcttgaa

SEQ ID NO: 127853 - DNA, 20 bp, Artificial
  CRISPR gRNA sequence
atgaagacacaaatggttca

SEQ ID NO: 127854 - DNA, 20 bp, Artificial
  CRISPR gRNA sequence
aacgggaaaggtaacgtaga

SEQ ID NO: 127855 - DNA, 20 bp, Artificial
  CRISPR gRNA sequence
acttattggaggcagataaa

SEQ ID NO: 127856 - DNA, 20 bp, Artificial
  CRISPR gRNA sequence
cagctaattttgtatttttg

SEQ ID NO: 127857 - DNA, 20 bp, Artificial
  CRISPR gRNA sequence
ttggtctgatataggtgtaa

SEQ ID NO: 127858 - DNA, 20 bp, Artificial
  CRISPR gRNA sequence
taagcttagaacttacagtt

SEQ ID NO: 127859 - DNA, 20 bp, Artificial
  CRISPR gRNA sequence
agattttgaagacttagtat

SEQ ID NO: 127860 - DNA, 20 bp, Artificial
  CRISPR gRNA sequence
ttgaagacttagtatgaaga

SEQ ID NO: 127861 - DNA, 20 bp, Artificial
  CRISPR gRNA sequence
ttgattctatgtttaaatgg

SEQ ID NO: 127862 - DNA, 20 bp, Artificial
  CRISPR gRNA sequence
ttttattttatatggctact

SEQ ID NO: 127863 - DNA, 20 bp, Artificial
  CRISPR gRNA sequence
ttcagattgcaaaagatgcc

SEQ ID NO: 127864 - DNA, 20 bp, Artificial
  CRISPR gRNA sequence
aagatgccaaagaatgtgtt

SEQ ID NO: 127865 - DNA, 20 bp, Artificial
  CRISPR gRNA sequence
gcaagtgaaaggtgccatca

SEQ ID NO: 127866 - DNA, 20 bp, Artificial
  CRISPR gRNA sequence
gaacctctgaaattatacct

SEQ ID NO: 127867 - DNA, 20 bp, Artificial
  CRISPR gRNA sequence
cccggcccccattgtgcttt

SEQ ID NO: 127868 - DNA, 20 bp, Artificial
  CRISPR gRNA sequence
caatagggttccagcgccta

SEQ ID NO: 127869 - DNA, 20 bp, Artificial
  CRISPR gRNA sequence
acttatattacagtacttaa

SEQ ID NO: 127870 - DNA, 20 bp, Artificial
  CRISPR gRNA sequence
aggctaatagtacctatatc

SEQ ID NO: 127871 - DNA, 20 bp, Artificial
  CRISPR gRNA sequence
atggaataattgaagtagga

SEQ ID NO: 127872 - DNA, 20 bp, Artificial
  CRISPR gRNA sequence
ccctttgatatgatgtggaa

SEQ ID NO: 127873 - DNA, 20 bp, Artificial
  CRISPR gRNA sequence
tccttcctcaggctatgaaa

SEQ ID NO: 127874 - DNA, 20 bp, Artificial
  CRISPR gRNA sequence
gaagtcagtgagtgataagt

SEQ ID NO: 127875 - DNA, 20 bp, Artificial
  CRISPR gRNA sequence
tagtgtagtttaatcatgaa

SEQ ID NO: 127876 - DNA, 20 bp, Artificial
  CRISPR gRNA sequence
gactacatcattgataccgg

SEQ ID NO: 127877 - DNA, 20 bp, Artificial
  CRISPR gRNA sequence
tacaaccttaagatacaacc

SEQ ID NO: 127878 - DNA, 20 bp, Artificial
  CRISPR gRNA sequence
tctgcttggaggctgaggca

SEQ ID NO: 127879 - DNA, 20 bp, Artificial
  CRISPR gRNA sequence
catatttgcataggagattt

SEQ ID NO: 127880 - DNA, 20 bp, Artificial
  CRISPR gRNA sequence
gagatttctagaaagataca

SEQ ID NO: 127881 - DNA, 20 bp, Artificial
  CRISPR gRNA sequence
aaattcagttttcatgatct

SEQ ID NO: 127882 - DNA, 20 bp, Artificial
  CRISPR gRNA sequence
aatgatggaatggggagtgt

SEQ ID NO: 127883 - DNA, 20 bp, Artificial
  CRISPR gRNA sequence
ttgaggtgttaattctgact

SEQ ID NO: 127884 - DNA, 20 bp, Artificial
  CRISPR gRNA sequence
tctttttcatgaatgatttt

SEQ ID NO: 127885 - DNA, 20 bp, Artificial
  CRISPR gRNA sequence
ttggttttgagttacatttt

SEQ ID NO: 127886 - DNA, 20 bp, Artificial
  CRISPR gRNA sequence
tcctgttacactatggaaac

SEQ ID NO: 127887 - DNA, 20 bp, Artificial
  CRISPR gRNA sequence
atttcccagatataggctga

SEQ ID NO: 127888 - DNA, 20 bp, Artificial
  CRISPR gRNA sequence
agattaatatttgttcaagt

SEQ ID NO: 127889 - DNA, 20 bp, Artificial
  CRISPR gRNA sequence
cagcaattcaaagaatttaa

SEQ ID NO: 127890 - DNA, 20 bp, Artificial
  CRISPR gRNA sequence
caatagcaatttttgatatt

SEQ ID NO: 127891 - DNA, 20 bp, Artificial
  CRISPR gRNA sequence
agacatttaccatcagacta

SEQ ID NO: 127892 - DNA, 20 bp, Artificial
  CRISPR gRNA sequence
acattcttaaaaatgtaact

SEQ ID NO: 127893 - DNA, 20 bp, Artificial
  CRISPR gRNA sequence
cttaaaaaagctccagtaac

SEQ ID NO: 127894 - DNA, 20 bp, Artificial
  CRISPR gRNA sequence
cagagcaacaaactctcgta

SEQ ID NO: 127895 - DNA, 20 bp, Artificial
  CRISPR gRNA sequence
ccatcatttcttcagatcat

SEQ ID NO: 127896 - DNA, 20 bp, Artificial
  CRISPR gRNA sequence
tatactgttatctacattga

SEQ ID NO: 127897 - DNA, 20 bp, Artificial
  CRISPR gRNA sequence
cattttaaaaaatgttccct

SEQ ID NO: 127898 - DNA, 20 bp, Artificial
  CRISPR gRNA sequence
aacatgatactcaatttaaa

SEQ ID NO: 127899 - DNA, 20 bp, Artificial
  CRISPR gRNA sequence
atctcatatgaatcttcacc

SEQ ID NO: 127900 - DNA, 20 bp, Artificial
  CRISPR gRNA sequence
cttacagatgaagaagtctg

SEQ ID NO: 127901 - DNA, 20 bp, Artificial
  CRISPR gRNA sequence
cgtggaaaaattgctttcca

SEQ ID NO: 127902 - DNA, 20 bp, Artificial
  CRISPR gRNA sequence
tttactacaaaatgaatttt

SEQ ID NO: 127903 - DNA, 20 bp, Artificial
  CRISPR gRNA sequence
ccccgtctctactaaaaata

SEQ ID NO: 127904 - DNA, 20 bp, Artificial
  CRISPR gRNA sequence
ttcacttgcttcagatgtta

SEQ ID NO: 127905 - DNA, 20 bp, Artificial
  CRISPR gRNA sequence
aaaaaaattttaaaaagata

SEQ ID NO: 127906 - DNA, 20 bp, Artificial
  CRISPR gRNA sequence
cctaccaccccacagaggat

SEQ ID NO: 127907 - DNA, 20 bp, Artificial
  CRISPR gRNA sequence
ttccatgaataaagacacca

SEQ ID NO: 127908 - DNA, 20 bp, Artificial
  CRISPR gRNA sequence
agacaccagaaaacaaaaag

SEQ ID NO: 127909 - DNA, 20 bp, Artificial
  CRISPR gRNA sequence
aaaaagcaaaacaggaacta

SEQ ID NO: 127910 - DNA, 20 bp, Artificial
  CRISPR gRNA sequence
cacatctgccacttcattat

SEQ ID NO: 127911 - DNA, 20 bp, Artificial
  CRISPR gRNA sequence
catttgtgcttttttttcct

SEQ ID NO: 127912 - DNA, 20 bp, Artificial
  CRISPR gRNA sequence
attaccaatagaaaatgata

SEQ ID NO: 127913 - DNA, 20 bp, Artificial
  CRISPR gRNA sequence
ttttaaaagttctaagaaga

SEQ ID NO: 127914 - DNA, 20 bp, Artificial
  CRISPR gRNA sequence
ctgacaacgtacctattttt

SEQ ID NO: 127915 - DNA, 20 bp, Artificial
  CRISPR gRNA sequence
caaaaaaaaaaaaaaaaaaa

SEQ ID NO: 127916 - DNA, 20 bp, Artificial
  CRISPR gRNA sequence
tagtttcgtgtttcccttga

SEQ ID NO: 127917 - DNA, 20 bp, Artificial
  CRISPR gRNA sequence
tatttctatttcaagataga

SEQ ID NO: 127918 - DNA, 20 bp, Artificial
  CRISPR gRNA sequence
tttattatacgacttagcta

SEQ ID NO: 127919 - DNA, 20 bp, Artificial
  CRISPR gRNA sequence
catttatgtaaaagtctata

SEQ ID NO: 127920 - DNA, 20 bp, Artificial
  CRISPR gRNA sequence
taaaattctttaaagaatgg

SEQ ID NO: 127921 - DNA, 20 bp, Artificial
  CRISPR gRNA sequence
gttcaaagttaatattgaat

SEQ ID NO: 127922 - DNA, 20 bp, Artificial
  CRISPR gRNA sequence
caccatccatctatgaggag

SEQ ID NO: 127923 - DNA, 20 bp, Artificial
  CRISPR gRNA sequence
gtgagaccctgtctctaaaa

SEQ ID NO: 127924 - DNA, 20 bp, Artificial
  CRISPR gRNA sequence
atttatcctttctgcaattc

SEQ ID NO: 127925 - DNA, 20 bp, Artificial
  CRISPR gRNA sequence
tatatataagaatgatggaa

SEQ ID NO: 127926 - DNA, 20 bp, Artificial
  CRISPR gRNA sequence
ccaaaggttttttctaggtc

SEQ ID NO: 127927 - DNA, 20 bp, Artificial
  CRISPR gRNA sequence
ctaggtctaaaacatcctat

SEQ ID NO: 127928 - DNA, 20 bp, Artificial
  CRISPR gRNA sequence
aaacatcctataaaaactta

SEQ ID NO: 127929 - DNA, 20 bp, Artificial
  CRISPR gRNA sequence
tgctagtgccaagtacgaag

SEQ ID NO: 127930 - DNA, 20 bp, Artificial
  CRISPR gRNA sequence
aaacgaatgttctaggcaga

SEQ ID NO: 127931 - DNA, 20 bp, Artificial
  CRISPR gRNA sequence
caagcctgtgacgcaggtga

SEQ ID NO: 127932 - DNA, 20 bp, Artificial
  CRISPR gRNA sequence
aaggctactgattatacact

SEQ ID NO: 127933 - DNA, 20 bp, Artificial
  CRISPR gRNA sequence
agatttattttggagaactt

SEQ ID NO: 127934 - DNA, 20 bp, Artificial
  CRISPR gRNA sequence
aattatacatctaaattact

SEQ ID NO: 127935 - DNA, 20 bp, Artificial
  CRISPR gRNA sequence
atgggggaggggtaggatgc

SEQ ID NO: 127936 - DNA, 20 bp, Artificial
  CRISPR gRNA sequence
gaggggtaggatgccaaaac

SEQ ID NO: 127937 - DNA, 20 bp, Artificial
  CRISPR gRNA sequence
actaaaaaggtccaggtagc

SEQ ID NO: 127938 - DNA, 20 bp, Artificial
  CRISPR gRNA sequence
ttaatagtatcctctaaccc

SEQ ID NO: 127939 - DNA, 20 bp, Artificial
  CRISPR gRNA sequence
aaataagccctcagaacact

SEQ ID NO: 127940 - DNA, 20 bp, Artificial
  CRISPR gRNA sequence
ttagactcagtacattaaag

SEQ ID NO: 127941 - DNA, 20 bp, Artificial
  CRISPR gRNA sequence
cgcctcccaccactaatgat

SEQ ID NO: 127942 - DNA, 20 bp, Artificial
  CRISPR gRNA sequence
aggattactgtatattgatg

SEQ ID NO: 127943 - DNA, 20 bp, Artificial
  CRISPR gRNA sequence
ggatacaaatttgcatttct

SEQ ID NO: 127944 - DNA, 20 bp, Artificial
  CRISPR gRNA sequence
tggacctttttagtggcatt

SEQ ID NO: 127945 - DNA, 20 bp, Artificial
  CRISPR gRNA sequence
tgttactctgaaacatttaa

SEQ ID NO: 127946 - DNA, 20 bp, Artificial
  CRISPR gRNA sequence
gataaaaggaatgtaaccca

SEQ ID NO: 127947 - DNA, 20 bp, Artificial
  CRISPR gRNA sequence
actttaaaaatggggaagct

SEQ ID NO: 127948 - DNA, 20 bp, Artificial
  CRISPR gRNA sequence
gtaggtgtaaagactgtatg

SEQ ID NO: 127949 - DNA, 20 bp, Artificial
  CRISPR gRNA sequence
gtgatttgtgctcttctgct

SEQ ID NO: 127950 - DNA, 20 bp, Artificial
  CRISPR gRNA sequence
taaactcacatagcacataa

SEQ ID NO: 127951 - DNA, 20 bp, Artificial
  CRISPR gRNA sequence
taggatgttttagacctaga

SEQ ID NO: 127952 - DNA, 20 bp, Artificial
  CRISPR gRNA sequence
ggcgtgaaatgatagaaagc

SEQ ID NO: 127953 - DNA, 20 bp, Artificial
  CRISPR gRNA sequence
attttgagtagtagtatttg

SEQ ID NO: 127954 - DNA, 20 bp, Artificial
  CRISPR gRNA sequence
caggagtttatgggttcatt

SEQ ID NO: 127955 - DNA, 20 bp, Artificial
  CRISPR gRNA sequence
gaccagcctgggcaacatag

SEQ ID NO: 127956 - DNA, 20 bp, Artificial
  CRISPR gRNA sequence
tagtactttgaaaagtattg

SEQ ID NO: 127957 - DNA, 20 bp, Artificial
  CRISPR gRNA sequence
taacatcattttaaacacat

SEQ ID NO: 127958 - DNA, 20 bp, Artificial
  CRISPR gRNA sequence
tcactgctctagctttgttc

SEQ ID NO: 127959 - DNA, 20 bp, Artificial
  CRISPR gRNA sequence
taggtgtaataagaattttc

SEQ ID NO: 127960 - DNA, 20 bp, Artificial
  CRISPR gRNA sequence
ttttgtcttcttagaacttt

SEQ ID NO: 127961 - DNA, 20 bp, Artificial
  CRISPR gRNA sequence
ggcaggctttttagtaaact

SEQ ID NO: 127962 - DNA, 20 bp, Artificial
  CRISPR gRNA sequence
aggtgccatcaagagaaacg

SEQ ID NO: 127963 - DNA, 20 bp, Artificial
  CRISPR gRNA sequence
tgttagagataggaaaattg

SEQ ID NO: 127964 - DNA, 20 bp, Artificial
  CRISPR gRNA sequence
taaaattattatttttttgg

SEQ ID NO: 127965 - DNA, 20 bp, Artificial
  CRISPR gRNA sequence
catctcctactctccattta

SEQ ID NO: 127966 - DNA, 20 bp, Artificial
  CRISPR gRNA sequence
gcctcaaattccttttttat

SEQ ID NO: 127967 - DNA, 20 bp, Artificial
  CRISPR gRNA sequence
aaattccttttttatcttca

SEQ ID NO: 127968 - DNA, 20 bp, Artificial
  CRISPR gRNA sequence
cttttttatcttcattctct

SEQ ID NO: 127969 - DNA, 20 bp, Artificial
  CRISPR gRNA sequence
ttttatcttcattctctact

SEQ ID NO: 127970 - DNA, 20 bp, Artificial
  CRISPR gRNA sequence
tttatcttcattctctactt

SEQ ID NO: 127971 - DNA, 20 bp, Artificial
  CRISPR gRNA sequence
ttatcttcattctctacttg

SEQ ID NO: 127972 - DNA, 20 bp, Artificial
  CRISPR gRNA sequence
tatcttcattctctacttga

SEQ ID NO: 127973 - DNA, 20 bp, Artificial
  CRISPR gRNA sequence
atcttcattctctacttgaa

SEQ ID NO: 127974 - DNA, 20 bp, Artificial
  CRISPR gRNA sequence
tcttcattctctacttgaac

SEQ ID NO: 127975 - DNA, 20 bp, Artificial
  CRISPR gRNA sequence
cattctctacttgaacaaat

SEQ ID NO: 127976 - DNA, 20 bp, Artificial
  CRISPR gRNA sequence
attctctacttgaacaaata

SEQ ID NO: 127977 - DNA, 20 bp, Artificial
  CRISPR gRNA sequence
tctacttgaacaaatattaa

SEQ ID NO: 127978 - DNA, 20 bp, Artificial
  CRISPR gRNA sequence
tacttgaacaaatattaatc

SEQ ID NO: 127979 - DNA, 20 bp, Artificial
  CRISPR gRNA sequence
cttgaacaaatattaatctt

SEQ ID NO: 127980 - DNA, 20 bp, Artificial
  CRISPR gRNA sequence
gaacaaatattaatctttaa

SEQ ID NO: 127981 - DNA, 20 bp, Artificial
  CRISPR gRNA sequence
aacaaatattaatctttaaa

SEQ ID NO: 127982 - DNA, 20 bp, Artificial
  CRISPR gRNA sequence
atctttaaaataattttaga

SEQ ID NO: 127983 - DNA, 20 bp, Artificial
  CRISPR gRNA sequence
taaaataattttagagacag

SEQ ID NO: 127984 - DNA, 20 bp, Artificial
  CRISPR gRNA sequence
aaaataattttagagacagt

SEQ ID NO: 127985 - DNA, 20 bp, Artificial
  CRISPR gRNA sequence
aaataattttagagacagta

SEQ ID NO: 127986 - DNA, 20 bp, Artificial
  CRISPR gRNA sequence
tagagacagtatctgataat

SEQ ID NO: 127987 - DNA, 20 bp, Artificial
  CRISPR gRNA sequence
agagacagtatctgataatc

SEQ ID NO: 127988 - DNA, 20 bp, Artificial
  CRISPR gRNA sequence
gagacagtatctgataatca

SEQ ID NO: 127989 - DNA, 20 bp, Artificial
  CRISPR gRNA sequence
ataatcaaagaccaagtgct

SEQ ID NO: 127990 - DNA, 20 bp, Artificial
  CRISPR gRNA sequence
ttatcagttatatagtgaca

SEQ ID NO: 127991 - DNA, 20 bp, Artificial
  CRISPR gRNA sequence
tatcagttatatagtgacac

SEQ ID NO: 127992 - DNA, 20 bp, Artificial
  CRISPR gRNA sequence
atcagttatatagtgacaca

SEQ ID NO: 127993 - DNA, 20 bp, Artificial
  CRISPR gRNA sequence
tcagttatatagtgacacac

SEQ ID NO: 127994 - DNA, 20 bp, Artificial
  CRISPR gRNA sequence
tatagtgacacactgcttgg

SEQ ID NO: 127995 - DNA, 20 bp, Artificial
  CRISPR gRNA sequence
cttggatcaagtggaaaata

SEQ ID NO: 127996 - DNA, 20 bp, Artificial
  CRISPR gRNA sequence
ggatcaagtggaaaatatct

SEQ ID NO: 127997 - DNA, 20 bp, Artificial
  CRISPR gRNA sequence
gatcaagtggaaaatatctc

SEQ ID NO: 127998 - DNA, 20 bp, Artificial
  CRISPR gRNA sequence
aaaaatacactcataacgaa

SEQ ID NO: 127999 - DNA, 20 bp, Artificial
  CRISPR gRNA sequence
ataacgaagtatcaaaagcc

SEQ ID NO: 128000 - DNA, 20 bp, Artificial
  CRISPR gRNA sequence
aaaattttgcatatttggta

SEQ ID NO: 128001 - DNA, 20 bp, Artificial
  CRISPR gRNA sequence
aaattttgcatatttggtaa

SEQ ID NO: 128002 - DNA, 20 bp, Artificial
  CRISPR gRNA sequence
tgcatatttggtaacccagc

SEQ ID NO: 128003 - DNA, 20 bp, Artificial
  CRISPR gRNA sequence
gcatatttggtaacccagca

SEQ ID NO: 128004 - DNA, 20 bp, Artificial
  CRISPR gRNA sequence
catatttggtaacccagcaa

SEQ ID NO: 128005 - DNA, 20 bp, Artificial
  CRISPR gRNA sequence
ggtaacccagcaattcaaag

SEQ ID NO: 128006 - DNA, 20 bp, Artificial
  CRISPR gRNA sequence
gtaacccagcaattcaaaga

SEQ ID NO: 128007 - DNA, 20 bp, Artificial
  CRISPR gRNA sequence
aaagaatttaagaaaacagt

SEQ ID NO: 128008 - DNA, 20 bp, Artificial
  CRISPR gRNA sequence
aagaaaacagtcatggatgt

SEQ ID NO: 128009 - DNA, 20 bp, Artificial
  CRISPR gRNA sequence
agaaaacagtcatggatgta

SEQ ID NO: 128010 - DNA, 20 bp, Artificial
  CRISPR gRNA sequence
agtgaagtgctgtttataac

SEQ ID NO: 128011 - DNA, 20 bp, Artificial
  CRISPR gRNA sequence
tttataactgtgaaaagatg

SEQ ID NO: 128012 - DNA, 20 bp, Artificial
  CRISPR gRNA sequence
ataactgtgaaaagatgtaa

SEQ ID NO: 128013 - DNA, 20 bp, Artificial
  CRISPR gRNA sequence
taactgtgaaaagatgtaaa

SEQ ID NO: 128014 - DNA, 20 bp, Artificial
  CRISPR gRNA sequence
tgaaaagatgtaaatagtca

SEQ ID NO: 128015 - DNA, 20 bp, Artificial
  CRISPR gRNA sequence
aatgaattatgattgagtca

SEQ ID NO: 128016 - DNA, 20 bp, Artificial
  CRISPR gRNA sequence
tgattgagtcatacagcaga

SEQ ID NO: 128017 - DNA, 20 bp, Artificial
  CRISPR gRNA sequence
agtcatacagcagaataata

SEQ ID NO: 128018 - DNA, 20 bp, Artificial
  CRISPR gRNA sequence
tgcatgacctggaaaagatg

SEQ ID NO: 128019 - DNA, 20 bp, Artificial
  CRISPR gRNA sequence
gaaaagatgttcccaatata

SEQ ID NO: 128020 - DNA, 20 bp, Artificial
  CRISPR gRNA sequence
ccaatatattgttaagtgaa

SEQ ID NO: 128021 - DNA, 20 bp, Artificial
  CRISPR gRNA sequence
ttaagtgaaaaaagcaggtt

SEQ ID NO: 128022 - DNA, 20 bp, Artificial
  CRISPR gRNA sequence
agtgaaaaaagcaggttaca

SEQ ID NO: 128023 - DNA, 20 bp, Artificial
  CRISPR gRNA sequence
caaaatggtatgcacaatat

SEQ ID NO: 128024 - DNA, 20 bp, Artificial
  CRISPR gRNA sequence
ttataaaaatatacatattt

SEQ ID NO: 128025 - DNA, 20 bp, Artificial
  CRISPR gRNA sequence
tataaaaatatacatattta

SEQ ID NO: 128026 - DNA, 20 bp, Artificial
  CRISPR gRNA sequence
ataaaaatatacatatttag

SEQ ID NO: 128027 - DNA, 20 bp, Artificial
  CRISPR gRNA sequence
taaaaatatacatatttagc

SEQ ID NO: 128028 - DNA, 20 bp, Artificial
  CRISPR gRNA sequence
agcaaagtaaaaggacaaat

SEQ ID NO: 128029 - DNA, 20 bp, Artificial
  CRISPR gRNA sequence
gcaaagtaaaaggacaaatg

SEQ ID NO: 128030 - DNA, 20 bp, Artificial
  CRISPR gRNA sequence
atcaaaatattaacattggt

SEQ ID NO: 128031 - DNA, 20 bp, Artificial
  CRISPR gRNA sequence
tcaaaatattaacattggtt

SEQ ID NO: 128032 - DNA, 20 bp, Artificial
  CRISPR gRNA sequence
acattggttctttcaacata

SEQ ID NO: 128033 - DNA, 20 bp, Artificial
  CRISPR gRNA sequence
gttctttcaacatagtagga

SEQ ID NO: 128034 - DNA, 20 bp, Artificial
  CRISPR gRNA sequence
tttcaacatagtaggatgac

SEQ ID NO: 128035 - DNA, 20 bp, Artificial
  CRISPR gRNA sequence
tcaacatagtaggatgactg

SEQ ID NO: 128036 - DNA, 20 bp, Artificial
  CRISPR gRNA sequence
caacatagtaggatgactgt

SEQ ID NO: 128037 - DNA, 20 bp, Artificial
  CRISPR gRNA sequence
aacatagtaggatgactgtt

SEQ ID NO: 128038 - DNA, 20 bp, Artificial
  CRISPR gRNA sequence
ttgattttgcttaactactc

SEQ ID NO: 128039 - DNA, 20 bp, Artificial
  CRISPR gRNA sequence
attttgcttaactactcccc

SEQ ID NO: 128040 - DNA, 20 bp, Artificial
  CRISPR gRNA sequence
tgcttaactactcccccatt

SEQ ID NO: 128041 - DNA, 20 bp, Artificial
  CRISPR gRNA sequence
gcttaactactcccccattt

SEQ ID NO: 128042 - DNA, 20 bp, Artificial
  CRISPR gRNA sequence
cttaactactcccccatttt

SEQ ID NO: 128043 - DNA, 20 bp, Artificial
  CRISPR gRNA sequence
aactactcccccattttttc

SEQ ID NO: 128044 - DNA, 20 bp, Artificial
  CRISPR gRNA sequence
actactcccccattttttcc

SEQ ID NO: 128045 - DNA, 20 bp, Artificial
  CRISPR gRNA sequence
ctcccccattttttcctatt

SEQ ID NO: 128046 - DNA, 20 bp, Artificial
  CRISPR gRNA sequence
ccccattttttcctatttga

SEQ ID NO: 128047 - DNA, 20 bp, Artificial
  CRISPR gRNA sequence
tttcctatttgaatttacta

SEQ ID NO: 128048 - DNA, 20 bp, Artificial
  CRISPR gRNA sequence
ttcctatttgaatttactac

SEQ ID NO: 128049 - DNA, 20 bp, Artificial
  CRISPR gRNA sequence
tcctatttgaatttactaca

SEQ ID NO: 128050 - DNA, 20 bp, Artificial
  CRISPR gRNA sequence
cctatttgaatttactacaa

SEQ ID NO: 128051 - DNA, 20 bp, Artificial
  CRISPR gRNA sequence
ctatttgaatttactacaat

SEQ ID NO: 128052 - DNA, 20 bp, Artificial
  CRISPR gRNA sequence
tttgaatttactacaatgaa

SEQ ID NO: 128053 - DNA, 20 bp, Artificial
  CRISPR gRNA sequence
gaatttactacaatgaagtt

SEQ ID NO: 128054 - DNA, 20 bp, Artificial
  CRISPR gRNA sequence
aatttactacaatgaagttt

SEQ ID NO: 128055 - DNA, 20 bp, Artificial
  CRISPR gRNA sequence
actacaatgaagtttgtttt

SEQ ID NO: 128056 - DNA, 20 bp, Artificial
  CRISPR gRNA sequence
ctacaatgaagtttgttttt

SEQ ID NO: 128057 - DNA, 20 bp, Artificial
  CRISPR gRNA sequence
caatgaagtttgttttttaa

SEQ ID NO: 128058 - DNA, 20 bp, Artificial
  CRISPR gRNA sequence
gttttttaaatggagagtag

SEQ ID NO: 128059 - DNA, 20 bp, Artificial
  CRISPR gRNA sequence
ttttttaaatggagagtagg

SEQ ID NO: 128060 - DNA, 20 bp, Artificial
  CRISPR gRNA sequence
tttaaatggagagtaggaga

SEQ ID NO: 128061 - DNA, 20 bp, Artificial
  CRISPR gRNA sequence
ttaaatggagagtaggagat

SEQ ID NO: 128062 - DNA, 20 bp, Artificial
  CRISPR gRNA sequence
taaatggagagtaggagatg

SEQ ID NO: 128063 - DNA, 20 bp, Artificial
  CRISPR gRNA sequence
aaatggagagtaggagatga

SEQ ID NO: 128064 - DNA, 20 bp, Artificial
  CRISPR gRNA sequence
aatggagagtaggagatgag

SEQ ID NO: 128065 - DNA, 20 bp, Artificial
  CRISPR gRNA sequence
ttaacctctgattagcccac

SEQ ID NO: 128066 - DNA, 20 bp, Artificial
  CRISPR gRNA sequence
acctctgattagcccacata

SEQ ID NO: 128067 - DNA, 20 bp, Artificial
  CRISPR gRNA sequence
tgattagcccacatatactc

SEQ ID NO: 128068 - DNA, 20 bp, Artificial
  CRISPR gRNA sequence
attagcccacatatactcct

SEQ ID NO: 128069 - DNA, 20 bp, Artificial
  CRISPR gRNA sequence
gcccacatatactcctaaag

SEQ ID NO: 128070 - DNA, 20 bp, Artificial
  CRISPR gRNA sequence
ctaaaggctccttctggcaa

SEQ ID NO: 128071 - DNA, 20 bp, Artificial
  CRISPR gRNA sequence
aaggctccttctggcaaagt

SEQ ID NO: 128072 - DNA, 20 bp, Artificial
  CRISPR gRNA sequence
cttctggcaaagtaaatgtt

SEQ ID NO: 128073 - DNA, 20 bp, Artificial
  CRISPR gRNA sequence
ctggcaaagtaaatgtttct

SEQ ID NO: 128074 - DNA, 20 bp, Artificial
  CRISPR gRNA sequence
tggcaaagtaaatgtttctg

SEQ ID NO: 128075 - DNA, 20 bp, Artificial
  CRISPR gRNA sequence
gcaaagtaaatgtttctgtt

SEQ ID NO: 128076 - DNA, 20 bp, Artificial
  CRISPR gRNA sequence
ctgttcagcctatatctggg

SEQ ID NO: 128077 - DNA, 20 bp, Artificial
  CRISPR gRNA sequence
tgttcagcctatatctggga

SEQ ID NO: 128078 - DNA, 20 bp, Artificial
  CRISPR gRNA sequence
ttcagcctatatctgggaaa

SEQ ID NO: 128079 - DNA, 20 bp, Artificial
  CRISPR gRNA sequence
agcctatatctgggaaattg

SEQ ID NO: 128080 - DNA, 20 bp, Artificial
  CRISPR gRNA sequence
tatctgggaaattgcttcta

SEQ ID NO: 128081 - DNA, 20 bp, Artificial
  CRISPR gRNA sequence
ggaaattgcttctaccttat

SEQ ID NO: 128082 - DNA, 20 bp, Artificial
  CRISPR gRNA sequence
cttctaccttataaatttga

SEQ ID NO: 128083 - DNA, 20 bp, Artificial
  CRISPR gRNA sequence
ctaccttataaatttgagtg

SEQ ID NO: 128084 - DNA, 20 bp, Artificial
  CRISPR gRNA sequence
taccttataaatttgagtgt

SEQ ID NO: 128085 - DNA, 20 bp, Artificial
  CRISPR gRNA sequence
ccttataaatttgagtgtcc

SEQ ID NO: 128086 - DNA, 20 bp, Artificial
  CRISPR gRNA sequence
ataaatttgagtgtccttca

SEQ ID NO: 128087 - DNA, 20 bp, Artificial
  CRISPR gRNA sequence
taaatttgagtgtccttcaa

SEQ ID NO: 128088 - DNA, 20 bp, Artificial
  CRISPR gRNA sequence
gagtgtccttcaaagatgat

SEQ ID NO: 128089 - DNA, 20 bp, Artificial
  CRISPR gRNA sequence
agtgtccttcaaagatgata

SEQ ID NO: 128090 - DNA, 20 bp, Artificial
  CRISPR gRNA sequence
caaagatgatattcactcca

SEQ ID NO: 128091 - DNA, 20 bp, Artificial
  CRISPR gRNA sequence
aaagatgatattcactccaa

SEQ ID NO: 128092 - DNA, 20 bp, Artificial
  CRISPR gRNA sequence
actccaacttccttttaggc

SEQ ID NO: 128093 - DNA, 20 bp, Artificial
  CRISPR gRNA sequence
caacttccttttaggcaaac

SEQ ID NO: 128094 - DNA, 20 bp, Artificial
  CRISPR gRNA sequence
ccttttaggcaaactataca

SEQ ID NO: 128095 - DNA, 20 bp, Artificial
  CRISPR gRNA sequence
cttttaggcaaactatacaa

SEQ ID NO: 128096 - DNA, 20 bp, Artificial
  CRISPR gRNA sequence
ttaggcaaactatacaatag

SEQ ID NO: 128097 - DNA, 20 bp, Artificial
  CRISPR gRNA sequence
taggcaaactatacaatagc

SEQ ID NO: 128098 - DNA, 20 bp, Artificial
  CRISPR gRNA sequence
aggcaaactatacaatagca

SEQ ID NO: 128099 - DNA, 20 bp, Artificial
  CRISPR gRNA sequence
ggcaaactatacaatagcaa

SEQ ID NO: 128100 - DNA, 20 bp, Artificial
  CRISPR gRNA sequence
tacaatagcaatttttgata

SEQ ID NO: 128101 - DNA, 20 bp, Artificial
  CRISPR gRNA sequence
ttgatattaaaaacttaaaa

SEQ ID NO: 128102 - DNA, 20 bp, Artificial
  CRISPR gRNA sequence
tgatattaaaaacttaaaaa

SEQ ID NO: 128103 - DNA, 20 bp, Artificial
  CRISPR gRNA sequence
gatattaaaaacttaaaaaa

SEQ ID NO: 128104 - DNA, 20 bp, Artificial
  CRISPR gRNA sequence
atattaaaaacttaaaaaag

SEQ ID NO: 128105 - DNA, 20 bp, Artificial
  CRISPR gRNA sequence
aaaacttaaaaaagaaatcc

SEQ ID NO: 128106 - DNA, 20 bp, Artificial
  CRISPR gRNA sequence
aaaaaagaaatccctcaagt

SEQ ID NO: 128107 - DNA, 20 bp, Artificial
  CRISPR gRNA sequence
aaaaagaaatccctcaagtt

SEQ ID NO: 128108 - DNA, 20 bp, Artificial
  CRISPR gRNA sequence
aagttaattaacaccaaaaa

SEQ ID NO: 128109 - DNA, 20 bp, Artificial
  CRISPR gRNA sequence
attaacaccaaaaagaatag

SEQ ID NO: 128110 - DNA, 20 bp, Artificial
  CRISPR gRNA sequence
acaccaaaaagaatagatga

SEQ ID NO: 128111 - DNA, 20 bp, Artificial
  CRISPR gRNA sequence
acttttcaaaaagaaacaat

SEQ ID NO: 128112 - DNA, 20 bp, Artificial
  CRISPR gRNA sequence
ttcaaaaagaaacaatccaa

SEQ ID NO: 128113 - DNA, 20 bp, Artificial
  CRISPR gRNA sequence
tcaaaaagaaacaatccaag

SEQ ID NO: 128114 - DNA, 20 bp, Artificial
  CRISPR gRNA sequence
caaaaagaaacaatccaagt

SEQ ID NO: 128115 - DNA, 20 bp, Artificial
  CRISPR gRNA sequence
aaaaagaaacaatccaagta

SEQ ID NO: 128116 - DNA, 20 bp, Artificial
  CRISPR gRNA sequence
ctaaattatacaaagttaca

SEQ ID NO: 128117 - DNA, 20 bp, Artificial
  CRISPR gRNA sequence
aattatacaaagttacatta

SEQ ID NO: 128118 - DNA, 20 bp, Artificial
  CRISPR gRNA sequence
tacaaagttacattatttac

SEQ ID NO: 128119 - DNA, 20 bp, Artificial
  CRISPR gRNA sequence
cattatttacgtttagttta

SEQ ID NO: 128120 - DNA, 20 bp, Artificial
  CRISPR gRNA sequence
tttacgtttagtttattgca

SEQ ID NO: 128121 - DNA, 20 bp, Artificial
  CRISPR gRNA sequence
acgtttagtttattgcagag

SEQ ID NO: 128122 - DNA, 20 bp, Artificial
  CRISPR gRNA sequence
cgtttagtttattgcagaga

SEQ ID NO: 128123 - DNA, 20 bp, Artificial
  CRISPR gRNA sequence
agtttattgcagagatgaag

SEQ ID NO: 128124 - DNA, 20 bp, Artificial
  CRISPR gRNA sequence
gtttattgcagagatgaaga

SEQ ID NO: 128125 - DNA, 20 bp, Artificial
  CRISPR gRNA sequence
attgcagagatgaagacagc

SEQ ID NO: 128126 - DNA, 20 bp, Artificial
  CRISPR gRNA sequence
ttgcagagatgaagacagca

SEQ ID NO: 128127 - DNA, 20 bp, Artificial
  CRISPR gRNA sequence
cagagatgaagacagcatac

SEQ ID NO: 128128 - DNA, 20 bp, Artificial
  CRISPR gRNA sequence
gaagttggcttctatttcac

SEQ ID NO: 128129 - DNA, 20 bp, Artificial
  CRISPR gRNA sequence
gcttctatttcacaccgttc

SEQ ID NO: 128130 - DNA, 20 bp, Artificial
  CRISPR gRNA sequence
ctatttcacaccgttcacag

SEQ ID NO: 128131 - DNA, 20 bp, Artificial
  CRISPR gRNA sequence
tatttcacaccgttcacagc

SEQ ID NO: 128132 - DNA, 20 bp, Artificial
  CRISPR gRNA sequence
tttcacaccgttcacagcac

SEQ ID NO: 128133 - DNA, 20 bp, Artificial
  CRISPR gRNA sequence
cacaccgttcacagcactca

SEQ ID NO: 128134 - DNA, 20 bp, Artificial
  CRISPR gRNA sequence
acaccgttcacagcactcac

SEQ ID NO: 128135 - DNA, 20 bp, Artificial
  CRISPR gRNA sequence
acagcactcactctgttctc

SEQ ID NO: 128136 - DNA, 20 bp, Artificial
  CRISPR gRNA sequence
actctgttctccatttcatc

SEQ ID NO: 128137 - DNA, 20 bp, Artificial
  CRISPR gRNA sequence
tgttctccatttcatccact

SEQ ID NO: 128138 - DNA, 20 bp, Artificial
  CRISPR gRNA sequence
ttctccatttcatccactca

SEQ ID NO: 128139 - DNA, 20 bp, Artificial
  CRISPR gRNA sequence
tccatttcatccactcaccc

SEQ ID NO: 128140 - DNA, 20 bp, Artificial
  CRISPR gRNA sequence
catttcatccactcacccat

SEQ ID NO: 128141 - DNA, 20 bp, Artificial
  CRISPR gRNA sequence
catccactcacccatgcaaa

SEQ ID NO: 128142 - DNA, 20 bp, Artificial
  CRISPR gRNA sequence
atccactcacccatgcaaaa

SEQ ID NO: 128143 - DNA, 20 bp, Artificial
  CRISPR gRNA sequence
acccatgcaaaaggtctgta

SEQ ID NO: 128144 - DNA, 20 bp, Artificial
  CRISPR gRNA sequence
tacacgcaatgatgtctgat

SEQ ID NO: 128145 - DNA, 20 bp, Artificial
  CRISPR gRNA sequence
atgtttcttggtttccatag

SEQ ID NO: 128146 - DNA, 20 bp, Artificial
  CRISPR gRNA sequence
cttggtttccatagtgtaac

SEQ ID NO: 128147 - DNA, 20 bp, Artificial
  CRISPR gRNA sequence
ttggtttccatagtgtaaca

SEQ ID NO: 128148 - DNA, 20 bp, Artificial
  CRISPR gRNA sequence
ggtttccatagtgtaacagg

SEQ ID NO: 128149 - DNA, 20 bp, Artificial
  CRISPR gRNA sequence
gtttccatagtgtaacagga

SEQ ID NO: 128150 - DNA, 20 bp, Artificial
  CRISPR gRNA sequence
ccatagtgtaacaggaaact

SEQ ID NO: 128151 - DNA, 20 bp, Artificial
  CRISPR gRNA sequence
catagtgtaacaggaaactt

SEQ ID NO: 128152 - DNA, 20 bp, Artificial
  CRISPR gRNA sequence
gacatttcaattaaaaaggt

SEQ ID NO: 128153 - DNA, 20 bp, Artificial
  CRISPR gRNA sequence
acatttcaattaaaaaggta

SEQ ID NO: 128154 - DNA, 20 bp, Artificial
  CRISPR gRNA sequence
caattaaaaaggtaaaatga

SEQ ID NO: 128155 - DNA, 20 bp, Artificial
  CRISPR gRNA sequence
aattaaaaaggtaaaatgaa

SEQ ID NO: 128156 - DNA, 20 bp, Artificial
  CRISPR gRNA sequence
aaaaggtaaaatgaagacat

SEQ ID NO: 128157 - DNA, 20 bp, Artificial
  CRISPR gRNA sequence
accatcagactataaaactc

SEQ ID NO: 128158 - DNA, 20 bp, Artificial
  CRISPR gRNA sequence
ccatcagactataaaactcc

SEQ ID NO: 128159 - DNA, 20 bp, Artificial
  CRISPR gRNA sequence
taaaactcctcttctgtaag

SEQ ID NO: 128160 - DNA, 20 bp, Artificial
  CRISPR gRNA sequence
ctcttctgtaagagaatact

SEQ ID NO: 128161 - DNA, 20 bp, Artificial
  CRISPR gRNA sequence
ttctgtaagagaatactata

SEQ ID NO: 128162 - DNA, 20 bp, Artificial
  CRISPR gRNA sequence
ctgtaagagaatactatagt

SEQ ID NO: 128163 - DNA, 20 bp, Artificial
  CRISPR gRNA sequence
tgtaagagaatactatagta

SEQ ID NO: 128164 - DNA, 20 bp, Artificial
  CRISPR gRNA sequence
taagagaatactatagtact

SEQ ID NO: 128165 - DNA, 20 bp, Artificial
  CRISPR gRNA sequence
tagtacttgaagatatgatt

SEQ ID NO: 128166 - DNA, 20 bp, Artificial
  CRISPR gRNA sequence
gaagatatgatttgaaaaaa

SEQ ID NO: 128167 - DNA, 20 bp, Artificial
  CRISPR gRNA sequence
aagatatgatttgaaaaaaa

SEQ ID NO: 128168 - DNA, 20 bp, Artificial
  CRISPR gRNA sequence
gaaaaaaaatcatgtaccaa

SEQ ID NO: 128169 - DNA, 20 bp, Artificial
  CRISPR gRNA sequence
aaaaaaaatcatgtaccaaa

SEQ ID NO: 128170 - DNA, 20 bp, Artificial
  CRISPR gRNA sequence
caagagcactaggactacat

SEQ ID NO: 128171 - DNA, 20 bp, Artificial
  CRISPR gRNA sequence
aagagcactaggactacatt

SEQ ID NO: 128172 - DNA, 20 bp, Artificial
  CRISPR gRNA sequence
ggactacattaaacttaaat

SEQ ID NO: 128173 - DNA, 20 bp, Artificial
  CRISPR gRNA sequence
cattaaacttaaatatattc

SEQ ID NO: 128174 - DNA, 20 bp, Artificial
  CRISPR gRNA sequence
aacttaaatatattcccaca

SEQ ID NO: 128175 - DNA, 20 bp, Artificial
  CRISPR gRNA sequence
aaatatattcccacattctt

SEQ ID NO: 128176 - DNA, 20 bp, Artificial
  CRISPR gRNA sequence
aatatattcccacattctta

SEQ ID NO: 128177 - DNA, 20 bp, Artificial
  CRISPR gRNA sequence
ccacattcttaaaaatgtaa

SEQ ID NO: 128178 - DNA, 20 bp, Artificial
  CRISPR gRNA sequence
ttaaaaatgtaactcaaaac

SEQ ID NO: 128179 - DNA, 20 bp, Artificial
  CRISPR gRNA sequence
aaaaatgtaactcaaaacca

SEQ ID NO: 128180 - DNA, 20 bp, Artificial
  CRISPR gRNA sequence
aaaatgtaactcaaaaccaa

SEQ ID NO: 128181 - DNA, 20 bp, Artificial
  CRISPR gRNA sequence
aaaaccaaatctagtcttaa

SEQ ID NO: 128182 - DNA, 20 bp, Artificial
  CRISPR gRNA sequence
gtcttaaaaaagctccagta

SEQ ID NO: 128183 - DNA, 20 bp, Artificial
  CRISPR gRNA sequence
aaaaaagctccagtaactaa

SEQ ID NO: 128184 - DNA, 20 bp, Artificial
  CRISPR gRNA sequence
aaaaagctccagtaactaaa

SEQ ID NO: 128185 - DNA, 20 bp, Artificial
  CRISPR gRNA sequence
cagtaactaaaactacatta

SEQ ID NO: 128186 - DNA, 20 bp, Artificial
  CRISPR gRNA sequence
aaactacattaacaggcacg

SEQ ID NO: 128187 - DNA, 20 bp, Artificial
  CRISPR gRNA sequence
cattaacaggcacgatgaac

SEQ ID NO: 128188 - DNA, 20 bp, Artificial
  CRISPR gRNA sequence
acaggcacgatgaacagtgt

SEQ ID NO: 128189 - DNA, 20 bp, Artificial
  CRISPR gRNA sequence
ttaatgggcaccaagtttaa

SEQ ID NO: 128190 - DNA, 20 bp, Artificial
  CRISPR gRNA sequence
atgggcaccaagtttaacag

SEQ ID NO: 128191 - DNA, 20 bp, Artificial
  CRISPR gRNA sequence
aacagggcagacaatatttg

SEQ ID NO: 128192 - DNA, 20 bp, Artificial
  CRISPR gRNA sequence
acagggcagacaatatttgc

SEQ ID NO: 128193 - DNA, 20 bp, Artificial
  CRISPR gRNA sequence
gcttctgcattcacacttat

SEQ ID NO: 128194 - DNA, 20 bp, Artificial
  CRISPR gRNA sequence
cttctgcattcacacttatt

SEQ ID NO: 128195 - DNA, 20 bp, Artificial
  CRISPR gRNA sequence
ctgcattcacacttattcaa

SEQ ID NO: 128196 - DNA, 20 bp, Artificial
  CRISPR gRNA sequence
tgcattcacacttattcaat

SEQ ID NO: 128197 - DNA, 20 bp, Artificial
  CRISPR gRNA sequence
cattcacacttattcaatta

SEQ ID NO: 128198 - DNA, 20 bp, Artificial
  CRISPR gRNA sequence
acacttattcaattacattt

SEQ ID NO: 128199 - DNA, 20 bp, Artificial
  CRISPR gRNA sequence
attcaattacattttttaaa

SEQ ID NO: 128200 - DNA, 20 bp, Artificial
  CRISPR gRNA sequence
ttcaattacattttttaaaa

SEQ ID NO: 128201 - DNA, 20 bp, Artificial
  CRISPR gRNA sequence
aattacattttttaaaaaaa

SEQ ID NO: 128202 - DNA, 20 bp, Artificial
  CRISPR gRNA sequence
cattttttaaaaaaatgatg

SEQ ID NO: 128203 - DNA, 20 bp, Artificial
  CRISPR gRNA sequence
tttaaaaaaatgatgctgct

SEQ ID NO: 128204 - DNA, 20 bp, Artificial
  CRISPR gRNA sequence
ttaaaaaaatgatgctgctt

SEQ ID NO: 128205 - DNA, 20 bp, Artificial
  CRISPR gRNA sequence
taaaaaaatgatgctgctta

SEQ ID NO: 128206 - DNA, 20 bp, Artificial
  CRISPR gRNA sequence
aaaaaaatgatgctgcttaa

SEQ ID NO: 128207 - DNA, 20 bp, Artificial
  CRISPR gRNA sequence
aaaaaatgatgctgcttaaa

SEQ ID NO: 128208 - DNA, 20 bp, Artificial
  CRISPR gRNA sequence
cttaaactattaatgtttta

SEQ ID NO: 128209 - DNA, 20 bp, Artificial
  CRISPR gRNA sequence
aaactattaatgttttacca

SEQ ID NO: 128210 - DNA, 20 bp, Artificial
  CRISPR gRNA sequence
aactattaatgttttaccaa

SEQ ID NO: 128211 - DNA, 20 bp, Artificial
  CRISPR gRNA sequence
ttaatgttttaccaaaaaaa

SEQ ID NO: 128212 - DNA, 20 bp, Artificial
  CRISPR gRNA sequence
atgttttaccaaaaaaataa

SEQ ID NO: 128213 - DNA, 20 bp, Artificial
  CRISPR gRNA sequence
taccaaaaaaataataattt

SEQ ID NO: 128214 - DNA, 20 bp, Artificial
  CRISPR gRNA sequence
accaaaaaaataataatttt

SEQ ID NO: 128215 - DNA, 20 bp, Artificial
  CRISPR gRNA sequence
ccaaaaaaataataatttta

SEQ ID NO: 128216 - DNA, 20 bp, Artificial
  CRISPR gRNA sequence
taataaatacagcaaatgct

SEQ ID NO: 128217 - DNA, 20 bp, Artificial
  CRISPR gRNA sequence
aataaatacagcaaatgcta

SEQ ID NO: 128218 - DNA, 20 bp, Artificial
  CRISPR gRNA sequence
ataaatacagcaaatgctag

SEQ ID NO: 128219 - DNA, 20 bp, Artificial
  CRISPR gRNA sequence
gaaatctagctaggttatca

SEQ ID NO: 128220 - DNA, 20 bp, Artificial
  CRISPR gRNA sequence
gctaggttatcatgcaaggt

SEQ ID NO: 128221 - DNA, 20 bp, Artificial
  CRISPR gRNA sequence
ggttatcatgcaaggtataa

SEQ ID NO: 128222 - DNA, 20 bp, Artificial
  CRISPR gRNA sequence
tcatgcaaggtataaccaag

SEQ ID NO: 128223 - DNA, 20 bp, Artificial
  CRISPR gRNA sequence
aaatttataataaaggcaac

SEQ ID NO: 128224 - DNA, 20 bp, Artificial
  CRISPR gRNA sequence
ataataaaggcaacttgcat

SEQ ID NO: 128225 - DNA, 20 bp, Artificial
  CRISPR gRNA sequence
taataaaggcaacttgcatt

SEQ ID NO: 128226 - DNA, 20 bp, Artificial
  CRISPR gRNA sequence
gcattcaaaatgaactctac

SEQ ID NO: 128227 - DNA, 20 bp, Artificial
  CRISPR gRNA sequence
cattcaaaatgaactctacc

SEQ ID NO: 128228 - DNA, 20 bp, Artificial
  CRISPR gRNA sequence
aaaatgaactctacccttat

SEQ ID NO: 128229 - DNA, 20 bp, Artificial
  CRISPR gRNA sequence
tacccttatattttattaaa

SEQ ID NO: 128230 - DNA, 20 bp, Artificial
  CRISPR gRNA sequence
cccttatattttattaaaag

SEQ ID NO: 128231 - DNA, 20 bp, Artificial
  CRISPR gRNA sequence
atattttattaaaagggcaa

SEQ ID NO: 128232 - DNA, 20 bp, Artificial
  CRISPR gRNA sequence
tattttattaaaagggcaaa

SEQ ID NO: 128233 - DNA, 20 bp, Artificial
  CRISPR gRNA sequence
tattaaaagggcaaacatca

SEQ ID NO: 128234 - DNA, 20 bp, Artificial
  CRISPR gRNA sequence
attaaaagggcaaacatcat

SEQ ID NO: 128235 - DNA, 20 bp, Artificial
  CRISPR gRNA sequence
ttaaaagggcaaacatcatg

SEQ ID NO: 128236 - DNA, 20 bp, Artificial
  CRISPR gRNA sequence
aaagggcaaacatcatgaat

SEQ ID NO: 128237 - DNA, 20 bp, Artificial
  CRISPR gRNA sequence
acccagccgcttacttgaat

SEQ ID NO: 128238 - DNA, 20 bp, Artificial
  CRISPR gRNA sequence
acttgaattacaaaagtaac

SEQ ID NO: 128239 - DNA, 20 bp, Artificial
  CRISPR gRNA sequence
cttgaattacaaaagtaaca

SEQ ID NO: 128240 - DNA, 20 bp, Artificial
  CRISPR gRNA sequence
gaattacaaaagtaacatga

SEQ ID NO: 128241 - DNA, 20 bp, Artificial
  CRISPR gRNA sequence
aattacaaaagtaacatgat

SEQ ID NO: 128242 - DNA, 20 bp, Artificial
  CRISPR gRNA sequence
caaaagtaacatgattcaat

SEQ ID NO: 128243 - DNA, 20 bp, Artificial
  CRISPR gRNA sequence
aatatgaaaataagaaactg

SEQ ID NO: 128244 - DNA, 20 bp, Artificial
  CRISPR gRNA sequence
tctacaaatctctgacagta

SEQ ID NO: 128245 - DNA, 20 bp, Artificial
  CRISPR gRNA sequence
caaatctctgacagtaataa

SEQ ID NO: 128246 - DNA, 20 bp, Artificial
  CRISPR gRNA sequence
tgacagtaataaattgcaat

SEQ ID NO: 128247 - DNA, 20 bp, Artificial
  CRISPR gRNA sequence
acagtaataaattgcaatat

SEQ ID NO: 128248 - DNA, 20 bp, Artificial
  CRISPR gRNA sequence
caatatacaatgcatacagg

SEQ ID NO: 128249 - DNA, 20 bp, Artificial
  CRISPR gRNA sequence
tcgtacaaaacaaaaatatt

SEQ ID NO: 128250 - DNA, 20 bp, Artificial
  CRISPR gRNA sequence
gtacaaaacaaaaatatttt

SEQ ID NO: 128251 - DNA, 20 bp, Artificial
  CRISPR gRNA sequence
taatacctttaaaatccaaa

SEQ ID NO: 128252 - DNA, 20 bp, Artificial
  CRISPR gRNA sequence
aatacctttaaaatccaaat

SEQ ID NO: 128253 - DNA, 20 bp, Artificial
  CRISPR gRNA sequence
atacctttaaaatccaaatt

SEQ ID NO: 128254 - DNA, 20 bp, Artificial
  CRISPR gRNA sequence
taaaatccaaatttttcttt

SEQ ID NO: 128255 - DNA, 20 bp, Artificial
  CRISPR gRNA sequence
aaaatccaaatttttcttta

SEQ ID NO: 128256 - DNA, 20 bp, Artificial
  CRISPR gRNA sequence
aaatccaaatttttctttaa

SEQ ID NO: 128257 - DNA, 20 bp, Artificial
  CRISPR gRNA sequence
ttctttaaaatcattcatga

SEQ ID NO: 128258 - DNA, 20 bp, Artificial
  CRISPR gRNA sequence
tctttaaaatcattcatgaa

SEQ ID NO: 128259 - DNA, 20 bp, Artificial
  CRISPR gRNA sequence
ctttaaaatcattcatgaaa

SEQ ID NO: 128260 - DNA, 20 bp, Artificial
  CRISPR gRNA sequence
tttaaaatcattcatgaaaa

SEQ ID NO: 128261 - DNA, 20 bp, Artificial
  CRISPR gRNA sequence
taaaatcattcatgaaaaag

SEQ ID NO: 128262 - DNA, 20 bp, Artificial
  CRISPR gRNA sequence
aaaatcattcatgaaaaaga

SEQ ID NO: 128263 - DNA, 20 bp, Artificial
  CRISPR gRNA sequence
aaatcattcatgaaaaagat

SEQ ID NO: 128264 - DNA, 20 bp, Artificial
  CRISPR gRNA sequence
atgaaaaagattctcaagtc

SEQ ID NO: 128265 - DNA, 20 bp, Artificial
  CRISPR gRNA sequence
tcaagtcagaattaacacct

SEQ ID NO: 128266 - DNA, 20 bp, Artificial
  CRISPR gRNA sequence
aagtcagaattaacacctca

SEQ ID NO: 128267 - DNA, 20 bp, Artificial
  CRISPR gRNA sequence
acacctcaattagtcaagca

SEQ ID NO: 128268 - DNA, 20 bp, Artificial
  CRISPR gRNA sequence
aattagtcaagcatcaggaa

SEQ ID NO: 128269 - DNA, 20 bp, Artificial
  CRISPR gRNA sequence
gtcaagcatcaggaagctac

SEQ ID NO: 128270 - DNA, 20 bp, Artificial
  CRISPR gRNA sequence
cattacagctattaatatac

SEQ ID NO: 128271 - DNA, 20 bp, Artificial
  CRISPR gRNA sequence
cagctattaatatacaaaga

SEQ ID NO: 128272 - DNA, 20 bp, Artificial
  CRISPR gRNA sequence
ttaatatacaaagatacatc

SEQ ID NO: 128273 - DNA, 20 bp, Artificial
  CRISPR gRNA sequence
atatacaaagatacatcttt

SEQ ID NO: 128274 - DNA, 20 bp, Artificial
  CRISPR gRNA sequence
ttcaccagtctttccttctg

SEQ ID NO: 128275 - DNA, 20 bp, Artificial
  CRISPR gRNA sequence
tcaccagtctttccttctga

SEQ ID NO: 128276 - DNA, 20 bp, Artificial
  CRISPR gRNA sequence
caccagtctttccttctgat

SEQ ID NO: 128277 - DNA, 20 bp, Artificial
  CRISPR gRNA sequence
accagtctttccttctgatg

SEQ ID NO: 128278 - DNA, 20 bp, Artificial
  CRISPR gRNA sequence
tccttctgatgtctctgttc

SEQ ID NO: 128279 - DNA, 20 bp, Artificial
  CRISPR gRNA sequence
ccttctgatgtctctgttcc

SEQ ID NO: 128280 - DNA, 20 bp, Artificial
  CRISPR gRNA sequence
cttctgatgtctctgttcca

SEQ ID NO: 128281 - DNA, 20 bp, Artificial
  CRISPR gRNA sequence
ctgatgtctctgttccagaa

SEQ ID NO: 128282 - DNA, 20 bp, Artificial
  CRISPR gRNA sequence
tgatgtctctgttccagaat

SEQ ID NO: 128283 - DNA, 20 bp, Artificial
  CRISPR gRNA sequence
atgtctctgttccagaatca

SEQ ID NO: 128284 - DNA, 20 bp, Artificial
  CRISPR gRNA sequence
tgttccagaatcatacagac

SEQ ID NO: 128285 - DNA, 20 bp, Artificial
  CRISPR gRNA sequence
ttccagaatcatacagactc

SEQ ID NO: 128286 - DNA, 20 bp, Artificial
  CRISPR gRNA sequence
cagaatcatacagactctca

SEQ ID NO: 128287 - DNA, 20 bp, Artificial
  CRISPR gRNA sequence
tcatttctctacactcccca

SEQ ID NO: 128288 - DNA, 20 bp, Artificial
  CRISPR gRNA sequence
atttctctacactccccatt

SEQ ID NO: 128289 - DNA, 20 bp, Artificial
  CRISPR gRNA sequence
ctctacactccccattccat

SEQ ID NO: 128290 - DNA, 20 bp, Artificial
  CRISPR gRNA sequence
tctacactccccattccatc

SEQ ID NO: 128291 - DNA, 20 bp, Artificial
  CRISPR gRNA sequence
tacactccccattccatcat

SEQ ID NO: 128292 - DNA, 20 bp, Artificial
  CRISPR gRNA sequence
cactccccattccatcattt

SEQ ID NO: 128293 - DNA, 20 bp, Artificial
  CRISPR gRNA sequence
cccattccatcatttcttca

SEQ ID NO: 128294 - DNA, 20 bp, Artificial
  CRISPR gRNA sequence
catcatttcttcagatcatg

SEQ ID NO: 128295 - DNA, 20 bp, Artificial
  CRISPR gRNA sequence
cttcagatcatgaaaactga

SEQ ID NO: 128296 - DNA, 20 bp, Artificial
  CRISPR gRNA sequence
ttcagatcatgaaaactgaa

SEQ ID NO: 128297 - DNA, 20 bp, Artificial
  CRISPR gRNA sequence
cagatcatgaaaactgaatt

SEQ ID NO: 128298 - DNA, 20 bp, Artificial
  CRISPR gRNA sequence
agatcatgaaaactgaattt

SEQ ID NO: 128299 - DNA, 20 bp, Artificial
  CRISPR gRNA sequence
aatttgctgaacaccagaaa

SEQ ID NO: 128300 - DNA, 20 bp, Artificial
  CRISPR gRNA sequence
gctgaacaccagaaatctaa

SEQ ID NO: 128301 - DNA, 20 bp, Artificial
  CRISPR gRNA sequence
ctgaacaccagaaatctaag

SEQ ID NO: 128302 - DNA, 20 bp, Artificial
  CRISPR gRNA sequence
aacaccagaaatctaagatt

SEQ ID NO: 128303 - DNA, 20 bp, Artificial
  CRISPR gRNA sequence
agattagaaaatttaaattg

SEQ ID NO: 128304 - DNA, 20 bp, Artificial
  CRISPR gRNA sequence
gaaaatttaaattgagcaga

SEQ ID NO: 128305 - DNA, 20 bp, Artificial
  CRISPR gRNA sequence
aaattgagcagaattaaaga

SEQ ID NO: 128306 - DNA, 20 bp, Artificial
  CRISPR gRNA sequence
aattgagcagaattaaagaa

SEQ ID NO: 128307 - DNA, 20 bp, Artificial
  CRISPR gRNA sequence
agcagaattaaagaaaagga

SEQ ID NO: 128308 - DNA, 20 bp, Artificial
  CRISPR gRNA sequence
aagaaaaggagattaaaagt

SEQ ID NO: 128309 - DNA, 20 bp, Artificial
  CRISPR gRNA sequence
aaagtaccatatgcatatta

SEQ ID NO: 128310 - DNA, 20 bp, Artificial
  CRISPR gRNA sequence
taaaaattcagtgaataaaa

SEQ ID NO: 128311 - DNA, 20 bp, Artificial
  CRISPR gRNA sequence
agtgaataaaaagacaataa

SEQ ID NO: 128312 - DNA, 20 bp, Artificial
  CRISPR gRNA sequence
attcccatttcttgtgtatc

SEQ ID NO: 128313 - DNA, 20 bp, Artificial
  CRISPR gRNA sequence
ccatttcttgtgtatctttc

SEQ ID NO: 128314 - DNA, 20 bp, Artificial
  CRISPR gRNA sequence
cttgtgtatctttctagaaa

SEQ ID NO: 128315 - DNA, 20 bp, Artificial
  CRISPR gRNA sequence
ttgtgtatctttctagaaat

SEQ ID NO: 128316 - DNA, 20 bp, Artificial
  CRISPR gRNA sequence
gtgtatctttctagaaatct

SEQ ID NO: 128317 - DNA, 20 bp, Artificial
  CRISPR gRNA sequence
tgtatctttctagaaatctc

SEQ ID NO: 128318 - DNA, 20 bp, Artificial
  CRISPR gRNA sequence
tctagaaatctcctatgcaa

SEQ ID NO: 128319 - DNA, 20 bp, Artificial
  CRISPR gRNA sequence
ctagaaatctcctatgcaaa

SEQ ID NO: 128320 - DNA, 20 bp, Artificial
  CRISPR gRNA sequence
tagaaatctcctatgcaaat

SEQ ID NO: 128321 - DNA, 20 bp, Artificial
  CRISPR gRNA sequence
gaaatctcctatgcaaatat

SEQ ID NO: 128322 - DNA, 20 bp, Artificial
  CRISPR gRNA sequence
ctatgcaaatatgaacatat

SEQ ID NO: 128323 - DNA, 20 bp, Artificial
  CRISPR gRNA sequence
tgcaaatatgaacatatgct

SEQ ID NO: 128324 - DNA, 20 bp, Artificial
  CRISPR gRNA sequence
atttttaactattaagagaa

SEQ ID NO: 128325 - DNA, 20 bp, Artificial
  CRISPR gRNA sequence
tttttaactattaagagaac

SEQ ID NO: 128326 - DNA, 20 bp, Artificial
  CRISPR gRNA sequence
ttaactattaagagaacact

SEQ ID NO: 128327 - DNA, 20 bp, Artificial
  CRISPR gRNA sequence
taactattaagagaacacta

SEQ ID NO: 128328 - DNA, 20 bp, Artificial
  CRISPR gRNA sequence
aactattaagagaacactat

SEQ ID NO: 128329 - DNA, 20 bp, Artificial
  CRISPR gRNA sequence
actattaagagaacactata

SEQ ID NO: 128330 - DNA, 20 bp, Artificial
  CRISPR gRNA sequence
ttaagagaacactatatact

SEQ ID NO: 128331 - DNA, 20 bp, Artificial
  CRISPR gRNA sequence
agagaacactatatactgtt

SEQ ID NO: 128332 - DNA, 20 bp, Artificial
  CRISPR gRNA sequence
tatactgttatctacattga

SEQ ID NO: 128333 - DNA, 20 bp, Artificial
  CRISPR gRNA sequence
ttatctacattgagaaaaca

SEQ ID NO: 128334 - DNA, 20 bp, Artificial
  CRISPR gRNA sequence
tctacattgagaaaacacaa

SEQ ID NO: 128335 - DNA, 20 bp, Artificial
  CRISPR gRNA sequence
cattgagaaaacacaatttt

SEQ ID NO: 128336 - DNA, 20 bp, Artificial
  CRISPR gRNA sequence
agaaaacacaattttaataa

SEQ ID NO: 128337 - DNA, 20 bp, Artificial
  CRISPR gRNA sequence
taataaccttctttatcagg

SEQ ID NO: 128338 - DNA, 20 bp, Artificial
  CRISPR gRNA sequence
aataaccttctttatcaggt

SEQ ID NO: 128339 - DNA, 20 bp, Artificial
  CRISPR gRNA sequence
ataaccttctttatcaggtc

SEQ ID NO: 128340 - DNA, 20 bp, Artificial
  CRISPR gRNA sequence
ctttatcaggtccttaatag

SEQ ID NO: 128341 - DNA, 20 bp, Artificial
  CRISPR gRNA sequence
tttatcaggtccttaatagc

SEQ ID NO: 128342 - DNA, 20 bp, Artificial
  CRISPR gRNA sequence
tatcaggtccttaatagcat

SEQ ID NO: 128343 - DNA, 20 bp, Artificial
  CRISPR gRNA sequence
atcaggtccttaatagcatg

SEQ ID NO: 128344 - DNA, 20 bp, Artificial
  CRISPR gRNA sequence
tcaggtccttaatagcatgt

SEQ ID NO: 128345 - DNA, 20 bp, Artificial
  CRISPR gRNA sequence
aatagcatgttgaaattaac

SEQ ID NO: 128346 - DNA, 20 bp, Artificial
  CRISPR gRNA sequence
atagcatgttgaaattaact

SEQ ID NO: 128347 - DNA, 20 bp, Artificial
  CRISPR gRNA sequence
aaattaactatatcaataga

SEQ ID NO: 128348 - DNA, 20 bp, Artificial
  CRISPR gRNA sequence
actatatcaatagatataat

SEQ ID NO: 128349 - DNA, 20 bp, Artificial
  CRISPR gRNA sequence
tatcaatagatataataaaa

SEQ ID NO: 128350 - DNA, 20 bp, Artificial
  CRISPR gRNA sequence
tttttttgagacagagtctc

SEQ ID NO: 128351 - DNA, 20 bp, Artificial
  CRISPR gRNA sequence
ttttttgagacagagtctca

SEQ ID NO: 128352 - DNA, 20 bp, Artificial
  CRISPR gRNA sequence
tttttgagacagagtctcac

SEQ ID NO: 128353 - DNA, 20 bp, Artificial
  CRISPR gRNA sequence
ttttgagacagagtctcact

SEQ ID NO: 128354 - DNA, 20 bp, Artificial
  CRISPR gRNA sequence
tttgagacagagtctcactc

SEQ ID NO: 128355 - DNA, 20 bp, Artificial
  CRISPR gRNA sequence
ttgagacagagtctcactct

SEQ ID NO: 128356 - DNA, 20 bp, Artificial
  CRISPR gRNA sequence
tgagacagagtctcactcta

SEQ ID NO: 128357 - DNA, 20 bp, Artificial
  CRISPR gRNA sequence
gagacagagtctcactctat

SEQ ID NO: 128358 - DNA, 20 bp, Artificial
  CRISPR gRNA sequence
agacagagtctcactctatt

SEQ ID NO: 128359 - DNA, 20 bp, Artificial
  CRISPR gRNA sequence
actctattgcccaggctgga

SEQ ID NO: 128360 - DNA, 20 bp, Artificial
  CRISPR gRNA sequence
tattgcccaggctggagtgc

SEQ ID NO: 128361 - DNA, 20 bp, Artificial
  CRISPR gRNA sequence
ttgcccaggctggagtgcag

SEQ ID NO: 128362 - DNA, 20 bp, Artificial
  CRISPR gRNA sequence
cccaggctggagtgcagtgg

SEQ ID NO: 128363 - DNA, 20 bp, Artificial
  CRISPR gRNA sequence
gagtgcagtggtgtgatctc

SEQ ID NO: 128364 - DNA, 20 bp, Artificial
  CRISPR gRNA sequence
agctcactgcaacctccacc

SEQ ID NO: 128365 - DNA, 20 bp, Artificial
  CRISPR gRNA sequence
actgcaacctccacctccag

SEQ ID NO: 128366 - DNA, 20 bp, Artificial
  CRISPR gRNA sequence
caacctccacctccagggtt

SEQ ID NO: 128367 - DNA, 20 bp, Artificial
  CRISPR gRNA sequence
cacctccagggttcaagtga

SEQ ID NO: 128368 - DNA, 20 bp, Artificial
  CRISPR gRNA sequence
cagggttcaagtgattctcc

SEQ ID NO: 128369 - DNA, 20 bp, Artificial
  CRISPR gRNA sequence
aagtgattctcctgcctcag

SEQ ID NO: 128370 - DNA, 20 bp, Artificial
  CRISPR gRNA sequence
tcctgcctcagcctccaagc

SEQ ID NO: 128371 - DNA, 20 bp, Artificial
  CRISPR gRNA sequence
ctgcctcagcctccaagcag

SEQ ID NO: 128372 - DNA, 20 bp, Artificial
  CRISPR gRNA sequence
cctcagcctccaagcagagg

SEQ ID NO: 128373 - DNA, 20 bp, Artificial
  CRISPR gRNA sequence
agcctccaagcagaggggat

SEQ ID NO: 128374 - DNA, 20 bp, Artificial
  CRISPR gRNA sequence
caagcagaggggattacagg

SEQ ID NO: 128375 - DNA, 20 bp, Artificial
  CRISPR gRNA sequence
caggtacacgccatgacgcc

SEQ ID NO: 128376 - DNA, 20 bp, Artificial
  CRISPR gRNA sequence
atttttgtatttttagtaga

SEQ ID NO: 128377 - DNA, 20 bp, Artificial
  CRISPR gRNA sequence
ttgtatttttagtagagaca

SEQ ID NO: 128378 - DNA, 20 bp, Artificial
  CRISPR gRNA sequence
tgtatttttagtagagacag

SEQ ID NO: 128379 - DNA, 20 bp, Artificial
  CRISPR gRNA sequence
gtatttttagtagagacagg

SEQ ID NO: 128380 - DNA, 20 bp, Artificial
  CRISPR gRNA sequence
tatttttagtagagacaggg

SEQ ID NO: 128381 - DNA, 20 bp, Artificial
  CRISPR gRNA sequence
ttagtagagacagggtttca

SEQ ID NO: 128382 - DNA, 20 bp, Artificial
  CRISPR gRNA sequence
tagtagagacagggtttcac

SEQ ID NO: 128383 - DNA, 20 bp, Artificial
  CRISPR gRNA sequence
agtagagacagggtttcacc

SEQ ID NO: 128384 - DNA, 20 bp, Artificial
  CRISPR gRNA sequence
gtagagacagggtttcacca

SEQ ID NO: 128385 - DNA, 20 bp, Artificial
  CRISPR gRNA sequence
caccatgttggccaggctgg

SEQ ID NO: 128386 - DNA, 20 bp, Artificial
  CRISPR gRNA sequence
accatgttggccaggctggt

SEQ ID NO: 128387 - DNA, 20 bp, Artificial
  CRISPR gRNA sequence
gccaggctggtcttgaactc

SEQ ID NO: 128388 - DNA, 20 bp, Artificial
  CRISPR gRNA sequence
gtcttgaactcctgacctca

SEQ ID NO: 128389 - DNA, 20 bp, Artificial
  CRISPR gRNA sequence
gaactcctgacctcaggtga

SEQ ID NO: 128390 - DNA, 20 bp, Artificial
  CRISPR gRNA sequence
aactcctgacctcaggtgat

SEQ ID NO: 128391 - DNA, 20 bp, Artificial
  CRISPR gRNA sequence
ctgacctcaggtgatccacc

SEQ ID NO: 128392 - DNA, 20 bp, Artificial
  CRISPR gRNA sequence
acctcaggtgatccacccac

SEQ ID NO: 128393 - DNA, 20 bp, Artificial
  CRISPR gRNA sequence
aggtgatccacccacctcgg

SEQ ID NO: 128394 - DNA, 20 bp, Artificial
  CRISPR gRNA sequence
ggcctcccaaggtgctggga

SEQ ID NO: 128395 - DNA, 20 bp, Artificial
  CRISPR gRNA sequence
ccaaggtgctgggattacag

SEQ ID NO: 128396 - DNA, 20 bp, Artificial
  CRISPR gRNA sequence
ggattacaggcatgagccat

SEQ ID NO: 128397 - DNA, 20 bp, Artificial
  CRISPR gRNA sequence
caggcatgagccatggggcc

SEQ ID NO: 128398 - DNA, 20 bp, Artificial
  CRISPR gRNA sequence
tcgatacaatcaaatttttt

SEQ ID NO: 128399 - DNA, 20 bp, Artificial
  CRISPR gRNA sequence
tttaagcatttaaaatacaa

SEQ ID NO: 128400 - DNA, 20 bp, Artificial
  CRISPR gRNA sequence
ttaagcatttaaaatacaaa

SEQ ID NO: 128401 - DNA, 20 bp, Artificial
  CRISPR gRNA sequence
taagcatttaaaatacaaag

SEQ ID NO: 128402 - DNA, 20 bp, Artificial
  CRISPR gRNA sequence
aagcatttaaaatacaaagg

SEQ ID NO: 128403 - DNA, 20 bp, Artificial
  CRISPR gRNA sequence
agcatttaaaatacaaagga

SEQ ID NO: 128404 - DNA, 20 bp, Artificial
  CRISPR gRNA sequence
aaaatacaaaggactgtacc

SEQ ID NO: 128405 - DNA, 20 bp, Artificial
  CRISPR gRNA sequence
aaatacaaaggactgtacct

SEQ ID NO: 128406 - DNA, 20 bp, Artificial
  CRISPR gRNA sequence
tacctgttgatatgatgttg

SEQ ID NO: 128407 - DNA, 20 bp, Artificial
  CRISPR gRNA sequence
ttgatatgatgttgtgtaaa

SEQ ID NO: 128408 - DNA, 20 bp, Artificial
  CRISPR gRNA sequence
atatgatgttgtgtaaacca

SEQ ID NO: 128409 - DNA, 20 bp, Artificial
  CRISPR gRNA sequence
tgtaaaccataacattttgt

SEQ ID NO: 128410 - DNA, 20 bp, Artificial
  CRISPR gRNA sequence
tgttgttgaccgtctgtggt

SEQ ID NO: 128411 - DNA, 20 bp, Artificial
  CRISPR gRNA sequence
gttgttgaccgtctgtggtt

SEQ ID NO: 128412 - DNA, 20 bp, Artificial
  CRISPR gRNA sequence
ttgttgaccgtctgtggtta

SEQ ID NO: 128413 - DNA, 20 bp, Artificial
  CRISPR gRNA sequence
ttgaccgtctgtggttatta

SEQ ID NO: 128414 - DNA, 20 bp, Artificial
  CRISPR gRNA sequence
accgtctgtggttattaagc

SEQ ID NO: 128415 - DNA, 20 bp, Artificial
  CRISPR gRNA sequence
tggttattaagccagctggt

SEQ ID NO: 128416 - DNA, 20 bp, Artificial
  CRISPR gRNA sequence
ttaagccagctggtaactgg

SEQ ID NO: 128417 - DNA, 20 bp, Artificial
  CRISPR gRNA sequence
agccagctggtaactggtta

SEQ ID NO: 128418 - DNA, 20 bp, Artificial
  CRISPR gRNA sequence
gtaactggttagctaaaaga

SEQ ID NO: 128419 - DNA, 20 bp, Artificial
  CRISPR gRNA sequence
gttagctaaaagaaaaaaaa

SEQ ID NO: 128420 - DNA, 20 bp, Artificial
  CRISPR gRNA sequence
gctaaaagaaaaaaaattag

SEQ ID NO: 128421 - DNA, 20 bp, Artificial
  CRISPR gRNA sequence
aaagaaaaaaaattagttaa

SEQ ID NO: 128422 - DNA, 20 bp, Artificial
  CRISPR gRNA sequence
gttaaagagggaaatgaact

SEQ ID NO: 128423 - DNA, 20 bp, Artificial
  CRISPR gRNA sequence
aagagggaaatgaactatat

SEQ ID NO: 128424 - DNA, 20 bp, Artificial
  CRISPR gRNA sequence
tatctactttcttgggttgt

SEQ ID NO: 128425 - DNA, 20 bp, Artificial
  CRISPR gRNA sequence
ctttcttgggttgtatctta

SEQ ID NO: 128426 - DNA, 20 bp, Artificial
  CRISPR gRNA sequence
tcttgggttgtatcttaagg

SEQ ID NO: 128427 - DNA, 20 bp, Artificial
  CRISPR gRNA sequence
cttgggttgtatcttaaggt

SEQ ID NO: 128428 - DNA, 20 bp, Artificial
  CRISPR gRNA sequence
ttgggttgtatcttaaggtt

SEQ ID NO: 128429 - DNA, 20 bp, Artificial
  CRISPR gRNA sequence
gggttgtatcttaaggttgt

SEQ ID NO: 128430 - DNA, 20 bp, Artificial
  CRISPR gRNA sequence
ggttgtatcttaaggttgta

SEQ ID NO: 128431 - DNA, 20 bp, Artificial
  CRISPR gRNA sequence
tatcttaaggttgtaccatt

SEQ ID NO: 128432 - DNA, 20 bp, Artificial
  CRISPR gRNA sequence
aaggttgtaccattaatgtc

SEQ ID NO: 128433 - DNA, 20 bp, Artificial
  CRISPR gRNA sequence
aggttgtaccattaatgtct

SEQ ID NO: 128434 - DNA, 20 bp, Artificial
  CRISPR gRNA sequence
taccattaatgtctcattac

SEQ ID NO: 128435 - DNA, 20 bp, Artificial
  CRISPR gRNA sequence
atgtctcattacaattctgc

SEQ ID NO: 128436 - DNA, 20 bp, Artificial
  CRISPR gRNA sequence
attacaattctgcccggtat

SEQ ID NO: 128437 - DNA, 20 bp, Artificial
  CRISPR gRNA sequence
caattctgcccggtatcaat

SEQ ID NO: 128438 - DNA, 20 bp, Artificial
  CRISPR gRNA sequence
tgcccggtatcaatgatgta

SEQ ID NO: 128439 - DNA, 20 bp, Artificial
  CRISPR gRNA sequence
cccggtatcaatgatgtagt

SEQ ID NO: 128440 - DNA, 20 bp, Artificial
  CRISPR gRNA sequence
ggacaaaataataaatcctc

SEQ ID NO: 128441 - DNA, 20 bp, Artificial
  CRISPR gRNA sequence
gacaaaataataaatcctcc

SEQ ID NO: 128442 - DNA, 20 bp, Artificial
  CRISPR gRNA sequence
caattttccattttaaaaaa

SEQ ID NO: 128443 - DNA, 20 bp, Artificial
  CRISPR gRNA sequence
tccattttaaaaaatgttcc

SEQ ID NO: 128444 - DNA, 20 bp, Artificial
  CRISPR gRNA sequence
ccattttaaaaaatgttccc

SEQ ID NO: 128445 - DNA, 20 bp, Artificial
  CRISPR gRNA sequence
cattttaaaaaatgttccct

SEQ ID NO: 128446 - DNA, 20 bp, Artificial
  CRISPR gRNA sequence
taaaaaatgttccctaaaaa

SEQ ID NO: 128447 - DNA, 20 bp, Artificial
  CRISPR gRNA sequence
aaaaaatgttccctaaaaac

SEQ ID NO: 128448 - DNA, 20 bp, Artificial
  CRISPR gRNA sequence
aaaaatgttccctaaaaacc

SEQ ID NO: 128449 - DNA, 20 bp, Artificial
  CRISPR gRNA sequence
cctaaaaaccacattatttt

SEQ ID NO: 128450 - DNA, 20 bp, Artificial
  CRISPR gRNA sequence
aaaaccacattattttatat

SEQ ID NO: 128451 - DNA, 20 bp, Artificial
  CRISPR gRNA sequence
ttttatattgcgtttttcaa

SEQ ID NO: 128452 - DNA, 20 bp, Artificial
  CRISPR gRNA sequence
tatattgcgtttttcaattt

SEQ ID NO: 128453 - DNA, 20 bp, Artificial
  CRISPR gRNA sequence
atattgcgtttttcaatttt

SEQ ID NO: 128454 - DNA, 20 bp, Artificial
  CRISPR gRNA sequence
tattgcgtttttcaattttc

SEQ ID NO: 128455 - DNA, 20 bp, Artificial
  CRISPR gRNA sequence
cgtttttcaattttcctatc

SEQ ID NO: 128456 - DNA, 20 bp, Artificial
  CRISPR gRNA sequence
ttcaattttcctatctctaa

SEQ ID NO: 128457 - DNA, 20 bp, Artificial
  CRISPR gRNA sequence
tcaattttcctatctctaac

SEQ ID NO: 128458 - DNA, 20 bp, Artificial
  CRISPR gRNA sequence
caattttcctatctctaaca

SEQ ID NO: 128459 - DNA, 20 bp, Artificial
  CRISPR gRNA sequence
aattttcctatctctaacat

SEQ ID NO: 128460 - DNA, 20 bp, Artificial
  CRISPR gRNA sequence
tcctatctctaacatgtacc

SEQ ID NO: 128461 - DNA, 20 bp, Artificial
  CRISPR gRNA sequence
cctatctctaacatgtacct

SEQ ID NO: 128462 - DNA, 20 bp, Artificial
  CRISPR gRNA sequence
ctatctctaacatgtacctt

SEQ ID NO: 128463 - DNA, 20 bp, Artificial
  CRISPR gRNA sequence
tctctaacatgtaccttagc

SEQ ID NO: 128464 - DNA, 20 bp, Artificial
  CRISPR gRNA sequence
taacatgtaccttagctaac

SEQ ID NO: 128465 - DNA, 20 bp, Artificial
  CRISPR gRNA sequence
acatgtaccttagctaactg

SEQ ID NO: 128466 - DNA, 20 bp, Artificial
  CRISPR gRNA sequence
agctaactgcccatgtgtac

SEQ ID NO: 128467 - DNA, 20 bp, Artificial
  CRISPR gRNA sequence
gctaactgcccatgtgtaca

SEQ ID NO: 128468 - DNA, 20 bp, Artificial
  CRISPR gRNA sequence
actgcccatgtgtacaaatc

SEQ ID NO: 128469 - DNA, 20 bp, Artificial
  CRISPR gRNA sequence
cccatgtgtacaaatctgta

SEQ ID NO: 128470 - DNA, 20 bp, Artificial
  CRISPR gRNA sequence
tagacagactggatgaagtt

SEQ ID NO: 128471 - DNA, 20 bp, Artificial
  CRISPR gRNA sequence
gatgaagtttctgattcatg

SEQ ID NO: 128472 - DNA, 20 bp, Artificial
  CRISPR gRNA sequence
ctgattcatgattaaactac

SEQ ID NO: 128473 - DNA, 20 bp, Artificial
  CRISPR gRNA sequence
tgattcatgattaaactaca

SEQ ID NO: 128474 - DNA, 20 bp, Artificial
  CRISPR gRNA sequence
attcatgattaaactacact

SEQ ID NO: 128475 - DNA, 20 bp, Artificial
  CRISPR gRNA sequence
atgattaaactacactacac

SEQ ID NO: 128476 - DNA, 20 bp, Artificial
  CRISPR gRNA sequence
aactacactacaccatgagg

SEQ ID NO: 128477 - DNA, 20 bp, Artificial
  CRISPR gRNA sequence
cactacaccatgaggtttgg

SEQ ID NO: 128478 - DNA, 20 bp, Artificial
  CRISPR gRNA sequence
caccatgaggtttggctagg

SEQ ID NO: 128479 - DNA, 20 bp, Artificial
  CRISPR gRNA sequence
ggctaggagcaacatataac

SEQ ID NO: 128480 - DNA, 20 bp, Artificial
  CRISPR gRNA sequence
gctaggagcaacatataact

SEQ ID NO: 128481 - DNA, 20 bp, Artificial
  CRISPR gRNA sequence
ggagcaacatataactgagc

SEQ ID NO: 128482 - DNA, 20 bp, Artificial
  CRISPR gRNA sequence
agcagcatatagtttacata

SEQ ID NO: 128483 - DNA, 20 bp, Artificial
  CRISPR gRNA sequence
acatatgagaaatatatata

SEQ ID NO: 128484 - DNA, 20 bp, Artificial
  CRISPR gRNA sequence
catatgagaaatatatataa

SEQ ID NO: 128485 - DNA, 20 bp, Artificial
  CRISPR gRNA sequence
actcaacatagcccttttat

SEQ ID NO: 128486 - DNA, 20 bp, Artificial
  CRISPR gRNA sequence
ctcaacatagcccttttatt

SEQ ID NO: 128487 - DNA, 20 bp, Artificial
  CRISPR gRNA sequence
aacatagcccttttatttca

SEQ ID NO: 128488 - DNA, 20 bp, Artificial
  CRISPR gRNA sequence
ttatttcaccaatatgacaa

SEQ ID NO: 128489 - DNA, 20 bp, Artificial
  CRISPR gRNA sequence
tatttcaccaatatgacaac

SEQ ID NO: 128490 - DNA, 20 bp, Artificial
  CRISPR gRNA sequence
atttcaccaatatgacaaca

SEQ ID NO: 128491 - DNA, 20 bp, Artificial
  CRISPR gRNA sequence
tttcaccaatatgacaacat

SEQ ID NO: 128492 - DNA, 20 bp, Artificial
  CRISPR gRNA sequence
caccaatatgacaacatgat

SEQ ID NO: 128493 - DNA, 20 bp, Artificial
  CRISPR gRNA sequence
accaatatgacaacatgata

SEQ ID NO: 128494 - DNA, 20 bp, Artificial
  CRISPR gRNA sequence
aatttaaaaaaaactgagtt

SEQ ID NO: 128495 - DNA, 20 bp, Artificial
  CRISPR gRNA sequence
aaaaaaaactgagttgaaat

SEQ ID NO: 128496 - DNA, 20 bp, Artificial
  CRISPR gRNA sequence
aaaaaaactgagttgaaatt

SEQ ID NO: 128497 - DNA, 20 bp, Artificial
  CRISPR gRNA sequence
agttgaaatttatttaaatc

SEQ ID NO: 128498 - DNA, 20 bp, Artificial
  CRISPR gRNA sequence
aaatttatttaaatcataag

SEQ ID NO: 128499 - DNA, 20 bp, Artificial
  CRISPR gRNA sequence
atttaaatcataagatttta

SEQ ID NO: 128500 - DNA, 20 bp, Artificial
  CRISPR gRNA sequence
tttaaatcataagattttat

SEQ ID NO: 128501 - DNA, 20 bp, Artificial
  CRISPR gRNA sequence
aaatcataagattttatatt

SEQ ID NO: 128502 - DNA, 20 bp, Artificial
  CRISPR gRNA sequence
aatcataagattttatatta

SEQ ID NO: 128503 - DNA, 20 bp, Artificial
  CRISPR gRNA sequence
tatattacaaacttttcctt

SEQ ID NO: 128504 - DNA, 20 bp, Artificial
  CRISPR gRNA sequence
atattacaaacttttcctta

SEQ ID NO: 128505 - DNA, 20 bp, Artificial
  CRISPR gRNA sequence
tattacaaacttttccttaa

SEQ ID NO: 128506 - DNA, 20 bp, Artificial
  CRISPR gRNA sequence
caaacttttccttaatattc

SEQ ID NO: 128507 - DNA, 20 bp, Artificial
  CRISPR gRNA sequence
ttccttaatattcctatctc

SEQ ID NO: 128508 - DNA, 20 bp, Artificial
  CRISPR gRNA sequence
tccttaatattcctatctca

SEQ ID NO: 128509 - DNA, 20 bp, Artificial
  CRISPR gRNA sequence
ccttaatattcctatctcat

SEQ ID NO: 128510 - DNA, 20 bp, Artificial
  CRISPR gRNA sequence
cttaatattcctatctcata

SEQ ID NO: 128511 - DNA, 20 bp, Artificial
  CRISPR gRNA sequence
aatattcctatctcatatga

SEQ ID NO: 128512 - DNA, 20 bp, Artificial
  CRISPR gRNA sequence
atattcctatctcatatgaa

SEQ ID NO: 128513 - DNA, 20 bp, Artificial
  CRISPR gRNA sequence
ctatctcatatgaatcttca

SEQ ID NO: 128514 - DNA, 20 bp, Artificial
  CRISPR gRNA sequence
tctcatatgaatcttcacca

SEQ ID NO: 128515 - DNA, 20 bp, Artificial
  CRISPR gRNA sequence
atatgaatcttcaccaaaaa

SEQ ID NO: 128516 - DNA, 20 bp, Artificial
  CRISPR gRNA sequence
caccaaaaactaggggctac

SEQ ID NO: 128517 - DNA, 20 bp, Artificial
  CRISPR gRNA sequence
accaaaaactaggggctaca

SEQ ID NO: 128518 - DNA, 20 bp, Artificial
  CRISPR gRNA sequence
ggggctacagaactcagtca

SEQ ID NO: 128519 - DNA, 20 bp, Artificial
  CRISPR gRNA sequence
cagaactcagtcagaactat

SEQ ID NO: 128520 - DNA, 20 bp, Artificial
  CRISPR gRNA sequence
agtcagaactatcagtgaaa

SEQ ID NO: 128521 - DNA, 20 bp, Artificial
  CRISPR gRNA sequence
tcagtgaaaggttataatgt

SEQ ID NO: 128522 - DNA, 20 bp, Artificial
  CRISPR gRNA sequence
taatgtctacagaattaaac

SEQ ID NO: 128523 - DNA, 20 bp, Artificial
  CRISPR gRNA sequence
cagaattaaacttttctaca

SEQ ID NO: 128524 - DNA, 20 bp, Artificial
  CRISPR gRNA sequence
aacttttctacacttatcac

SEQ ID NO: 128525 - DNA, 20 bp, Artificial
  CRISPR gRNA sequence
ttctacacttatcactcact

SEQ ID NO: 128526 - DNA, 20 bp, Artificial
  CRISPR gRNA sequence
tctacacttatcactcactg

SEQ ID NO: 128527 - DNA, 20 bp, Artificial
  CRISPR gRNA sequence
ctacacttatcactcactga

SEQ ID NO: 128528 - DNA, 20 bp, Artificial
  CRISPR gRNA sequence
tacacttatcactcactgac

SEQ ID NO: 128529 - DNA, 20 bp, Artificial
  CRISPR gRNA sequence
cacttatcactcactgactt

SEQ ID NO: 128530 - DNA, 20 bp, Artificial
  CRISPR gRNA sequence
atcactcactgacttcaaat

SEQ ID NO: 128531 - DNA, 20 bp, Artificial
  CRISPR gRNA sequence
tcactcactgacttcaaata

SEQ ID NO: 128532 - DNA, 20 bp, Artificial
  CRISPR gRNA sequence
actgacttcaaataaaaggg

SEQ ID NO: 128533 - DNA, 20 bp, Artificial
  CRISPR gRNA sequence
acttcaaataaaagggcatg

SEQ ID NO: 128534 - DNA, 20 bp, Artificial
  CRISPR gRNA sequence
caaataaaagggcatgaact

SEQ ID NO: 128535 - DNA, 20 bp, Artificial
  CRISPR gRNA sequence
aaataaaagggcatgaactg

SEQ ID NO: 128536 - DNA, 20 bp, Artificial
  CRISPR gRNA sequence
ataagaactatttaaaatag

SEQ ID NO: 128537 - DNA, 20 bp, Artificial
  CRISPR gRNA sequence
tttaaaatagtgctttgtca

SEQ ID NO: 128538 - DNA, 20 bp, Artificial
  CRISPR gRNA sequence
aaaatagtgctttgtcaaaa

SEQ ID NO: 128539 - DNA, 20 bp, Artificial
  CRISPR gRNA sequence
aaatagtgctttgtcaaaat

SEQ ID NO: 128540 - DNA, 20 bp, Artificial
  CRISPR gRNA sequence
tgtcaaaatactcactgctg

SEQ ID NO: 128541 - DNA, 20 bp, Artificial
  CRISPR gRNA sequence
gtcaaaatactcactgctga

SEQ ID NO: 128542 - DNA, 20 bp, Artificial
  CRISPR gRNA sequence
tcaaaatactcactgctgac

SEQ ID NO: 128543 - DNA, 20 bp, Artificial
  CRISPR gRNA sequence
actgctgacattccaaaaat

SEQ ID NO: 128544 - DNA, 20 bp, Artificial
  CRISPR gRNA sequence
ctgacattccaaaaatacca

SEQ ID NO: 128545 - DNA, 20 bp, Artificial
  CRISPR gRNA sequence
acattccaaaaataccatta

SEQ ID NO: 128546 - DNA, 20 bp, Artificial
  CRISPR gRNA sequence
caaaaataccattagatact

SEQ ID NO: 128547 - DNA, 20 bp, Artificial
  CRISPR gRNA sequence
gatacttagtatgaatcatt

SEQ ID NO: 128548 - DNA, 20 bp, Artificial
  CRISPR gRNA sequence
agtatgaatcattgctaaca

SEQ ID NO: 128549 - DNA, 20 bp, Artificial
  CRISPR gRNA sequence
gtatgaatcattgctaacaa

SEQ ID NO: 128550 - DNA, 20 bp, Artificial
  CRISPR gRNA sequence
ctaacaatctacatgacttg

SEQ ID NO: 128551 - DNA, 20 bp, Artificial
  CRISPR gRNA sequence
acaatctacatgacttgtat

SEQ ID NO: 128552 - DNA, 20 bp, Artificial
  CRISPR gRNA sequence
catgacttgtattataacaa

SEQ ID NO: 128553 - DNA, 20 bp, Artificial
  CRISPR gRNA sequence
gtattataacaatgcttact

SEQ ID NO: 128554 - DNA, 20 bp, Artificial
  CRISPR gRNA sequence
tattataacaatgcttacta

SEQ ID NO: 128555 - DNA, 20 bp, Artificial
  CRISPR gRNA sequence
taacaatgcttactaaatgc

SEQ ID NO: 128556 - DNA, 20 bp, Artificial
  CRISPR gRNA sequence
actaaatgcctcctctgtaa

SEQ ID NO: 128557 - DNA, 20 bp, Artificial
  CRISPR gRNA sequence
ctaaatgcctcctctgtaag

SEQ ID NO: 128558 - DNA, 20 bp, Artificial
  CRISPR gRNA sequence
aatgcctcctctgtaagctc

SEQ ID NO: 128559 - DNA, 20 bp, Artificial
  CRISPR gRNA sequence
ctctgtaagctcttcactta

SEQ ID NO: 128560 - DNA, 20 bp, Artificial
  CRISPR gRNA sequence
tgtaagctcttcacttagtc

SEQ ID NO: 128561 - DNA, 20 bp, Artificial
  CRISPR gRNA sequence
taagctcttcacttagtcca

SEQ ID NO: 128562 - DNA, 20 bp, Artificial
  CRISPR gRNA sequence
ttcacttagtccatctgtag

SEQ ID NO: 128563 - DNA, 20 bp, Artificial
  CRISPR gRNA sequence
cacttagtccatctgtagct

SEQ ID NO: 128564 - DNA, 20 bp, Artificial
  CRISPR gRNA sequence
acttagtccatctgtagctg

SEQ ID NO: 128565 - DNA, 20 bp, Artificial
  CRISPR gRNA sequence
agtccatctgtagctgtgac

SEQ ID NO: 128566 - DNA, 20 bp, Artificial
  CRISPR gRNA sequence
gtccatctgtagctgtgact

SEQ ID NO: 128567 - DNA, 20 bp, Artificial
  CRISPR gRNA sequence
tagctgtgactgctccacca

SEQ ID NO: 128568 - DNA, 20 bp, Artificial
  CRISPR gRNA sequence
tgactgctccaccaattccc

SEQ ID NO: 128569 - DNA, 20 bp, Artificial
  CRISPR gRNA sequence
ctccaccaattcccttttct

SEQ ID NO: 128570 - DNA, 20 bp, Artificial
  CRISPR gRNA sequence
caccaattcccttttctcct

SEQ ID NO: 128571 - DNA, 20 bp, Artificial
  CRISPR gRNA sequence
ccttttctcctttcatagcc

SEQ ID NO: 128572 - DNA, 20 bp, Artificial
  CRISPR gRNA sequence
ttctcctttcatagcctgag

SEQ ID NO: 128573 - DNA, 20 bp, Artificial
  CRISPR gRNA sequence
tctcctttcatagcctgagg

SEQ ID NO: 128574 - DNA, 20 bp, Artificial
  CRISPR gRNA sequence
ctcctttcatagcctgagga

SEQ ID NO: 128575 - DNA, 20 bp, Artificial
  CRISPR gRNA sequence
tcctttcatagcctgaggaa

SEQ ID NO: 128576 - DNA, 20 bp, Artificial
  CRISPR gRNA sequence
ctttcatagcctgaggaagg

SEQ ID NO: 128577 - DNA, 20 bp, Artificial
  CRISPR gRNA sequence
tcatagcctgaggaaggaaa

SEQ ID NO: 128578 - DNA, 20 bp, Artificial
  CRISPR gRNA sequence
catagcctgaggaaggaaaa

SEQ ID NO: 128579 - DNA, 20 bp, Artificial
  CRISPR gRNA sequence
atagcctgaggaaggaaaaa

SEQ ID NO: 128580 - DNA, 20 bp, Artificial
  CRISPR gRNA sequence
aggaaggaaaaaaaaaaagt

SEQ ID NO: 128581 - DNA, 20 bp, Artificial
  CRISPR gRNA sequence
atattcaaatgaaattgtct

SEQ ID NO: 128582 - DNA, 20 bp, Artificial
  CRISPR gRNA sequence
aaatgaaattgtcttccaaa

SEQ ID NO: 128583 - DNA, 20 bp, Artificial
  CRISPR gRNA sequence
tcttccaaatgcaaatgctt

SEQ ID NO: 128584 - DNA, 20 bp, Artificial
  CRISPR gRNA sequence
ccaaatgcaaatgcttactt

SEQ ID NO: 128585 - DNA, 20 bp, Artificial
  CRISPR gRNA sequence
caaatgcaaatgcttactta

SEQ ID NO: 128586 - DNA, 20 bp, Artificial
  CRISPR gRNA sequence
acttattgcctaaaattagg

SEQ ID NO: 128587 - DNA, 20 bp, Artificial
  CRISPR gRNA sequence
cttattgcctaaaattagga

SEQ ID NO: 128588 - DNA, 20 bp, Artificial
  CRISPR gRNA sequence
attgcctaaaattaggagct

SEQ ID NO: 128589 - DNA, 20 bp, Artificial
  CRISPR gRNA sequence
ttgcctaaaattaggagctt

SEQ ID NO: 128590 - DNA, 20 bp, Artificial
  CRISPR gRNA sequence
cctaaaattaggagcttcta

SEQ ID NO: 128591 - DNA, 20 bp, Artificial
  CRISPR gRNA sequence
aaattaggagcttctattat

SEQ ID NO: 128592 - DNA, 20 bp, Artificial
  CRISPR gRNA sequence
ggagcttctattattacaaa

SEQ ID NO: 128593 - DNA, 20 bp, Artificial
  CRISPR gRNA sequence
ctattattacaaactctaag

SEQ ID NO: 128594 - DNA, 20 bp, Artificial
  CRISPR gRNA sequence
tattattacaaactctaagc

SEQ ID NO: 128595 - DNA, 20 bp, Artificial
  CRISPR gRNA sequence
ttattacaaactctaagcag

SEQ ID NO: 128596 - DNA, 20 bp, Artificial
  CRISPR gRNA sequence
ttacaaactctaagcagagt

SEQ ID NO: 128597 - DNA, 20 bp, Artificial
  CRISPR gRNA sequence
caaactctaagcagagtatt

SEQ ID NO: 128598 - DNA, 20 bp, Artificial
  CRISPR gRNA sequence
taagcagagtatttattaac

SEQ ID NO: 128599 - DNA, 20 bp, Artificial
  CRISPR gRNA sequence
agcagagtatttattaacac

SEQ ID NO: 128600 - DNA, 20 bp, Artificial
  CRISPR gRNA sequence
attaacacttctggttaatt

SEQ ID NO: 128601 - DNA, 20 bp, Artificial
  CRISPR gRNA sequence
ttaacacttctggttaatta

SEQ ID NO: 128602 - DNA, 20 bp, Artificial
  CRISPR gRNA sequence
acacttctggttaattacat

SEQ ID NO: 128603 - DNA, 20 bp, Artificial
  CRISPR gRNA sequence
ctggttaattacatatgaag

SEQ ID NO: 128604 - DNA, 20 bp, Artificial
  CRISPR gRNA sequence
tggttaattacatatgaaga

SEQ ID NO: 128605 - DNA, 20 bp, Artificial
  CRISPR gRNA sequence
gttaattacatatgaagaag

SEQ ID NO: 128606 - DNA, 20 bp, Artificial
  CRISPR gRNA sequence
attacatatgaagaaggctt

SEQ ID NO: 128607 - DNA, 20 bp, Artificial
  CRISPR gRNA sequence
catatgaagaaggctttcag

SEQ ID NO: 128608 - DNA, 20 bp, Artificial
  CRISPR gRNA sequence
tcagaaggctaacttttaat

SEQ ID NO: 128609 - DNA, 20 bp, Artificial
  CRISPR gRNA sequence
cagaaggctaacttttaata

SEQ ID NO: 128610 - DNA, 20 bp, Artificial
  CRISPR gRNA sequence
agaaggctaacttttaatat

SEQ ID NO: 128611 - DNA, 20 bp, Artificial
  CRISPR gRNA sequence
acttttaatataagctgtaa

SEQ ID NO: 128612 - DNA, 20 bp, Artificial
  CRISPR gRNA sequence
ttaatataagctgtaatcat

SEQ ID NO: 128613 - DNA, 20 bp, Artificial
  CRISPR gRNA sequence
taatataagctgtaatcatt

SEQ ID NO: 128614 - DNA, 20 bp, Artificial
  CRISPR gRNA sequence
aatataagctgtaatcatta

SEQ ID NO: 128615 - DNA, 20 bp, Artificial
  CRISPR gRNA sequence
atataagctgtaatcattaa

SEQ ID NO: 128616 - DNA, 20 bp, Artificial
  CRISPR gRNA sequence
taatcattaacaagacagag

SEQ ID NO: 128617 - DNA, 20 bp, Artificial
  CRISPR gRNA sequence
acaagacagagttagtaatg

SEQ ID NO: 128618 - DNA, 20 bp, Artificial
  CRISPR gRNA sequence
gtaatgacctagaaagcaaa

SEQ ID NO: 128619 - DNA, 20 bp, Artificial
  CRISPR gRNA sequence
gaaagcaaagtatttacaga

SEQ ID NO: 128620 - DNA, 20 bp, Artificial
  CRISPR gRNA sequence
acagataaaaataaattatt

SEQ ID NO: 128621 - DNA, 20 bp, Artificial
  CRISPR gRNA sequence
cagataaaaataaattattc

SEQ ID NO: 128622 - DNA, 20 bp, Artificial
  CRISPR gRNA sequence
ttctaattccacatcatatc

SEQ ID NO: 128623 - DNA, 20 bp, Artificial
  CRISPR gRNA sequence
taattccacatcatatcaaa

SEQ ID NO: 128624 - DNA, 20 bp, Artificial
  CRISPR gRNA sequence
attccacatcatatcaaagg

SEQ ID NO: 128625 - DNA, 20 bp, Artificial
  CRISPR gRNA sequence
cacatcatatcaaaggggta

SEQ ID NO: 128626 - DNA, 20 bp, Artificial
  CRISPR gRNA sequence
tacttacagatgaagaagtc

SEQ ID NO: 128627 - DNA, 20 bp, Artificial
  CRISPR gRNA sequence
cttacagatgaagaagtctg

SEQ ID NO: 128628 - DNA, 20 bp, Artificial
  CRISPR gRNA sequence
acagatgaagaagtctgcaa

SEQ ID NO: 128629 - DNA, 20 bp, Artificial
  CRISPR gRNA sequence
cagatgaagaagtctgcaaa

SEQ ID NO: 128630 - DNA, 20 bp, Artificial
  CRISPR gRNA sequence
caaaacaccaccaatattga

SEQ ID NO: 128631 - DNA, 20 bp, Artificial
  CRISPR gRNA sequence
agcttataaatctacaaatg

SEQ ID NO: 128632 - DNA, 20 bp, Artificial
  CRISPR gRNA sequence
ataaatctacaaatgatcca

SEQ ID NO: 128633 - DNA, 20 bp, Artificial
  CRISPR gRNA sequence
taaatctacaaatgatccaa

SEQ ID NO: 128634 - DNA, 20 bp, Artificial
  CRISPR gRNA sequence
caaatgatccaagtgatcac

SEQ ID NO: 128635 - DNA, 20 bp, Artificial
  CRISPR gRNA sequence
aagtatatatatgtctctca

SEQ ID NO: 128636 - DNA, 20 bp, Artificial
  CRISPR gRNA sequence
agtatatatatgtctctcag

SEQ ID NO: 128637 - DNA, 20 bp, Artificial
  CRISPR gRNA sequence
tcagccaactgggcagtact

SEQ ID NO: 128638 - DNA, 20 bp, Artificial
  CRISPR gRNA sequence
agccaactgggcagtactgt

SEQ ID NO: 128639 - DNA, 20 bp, Artificial
  CRISPR gRNA sequence
ggcagtactgtagcaagctg

SEQ ID NO: 128640 - DNA, 20 bp, Artificial
  CRISPR gRNA sequence
tagcaagctgagagttaaaa

SEQ ID NO: 128641 - DNA, 20 bp, Artificial
  CRISPR gRNA sequence
agagttaaaaattcctaaat

SEQ ID NO: 128642 - DNA, 20 bp, Artificial
  CRISPR gRNA sequence
aaaattcctaaattaatttg

SEQ ID NO: 128643 - DNA, 20 bp, Artificial
  CRISPR gRNA sequence
ctaaattaatttggccaaat

SEQ ID NO: 128644 - DNA, 20 bp, Artificial
  CRISPR gRNA sequence
aattaatttggccaaatact

SEQ ID NO: 128645 - DNA, 20 bp, Artificial
  CRISPR gRNA sequence
atttggccaaatacttctag

SEQ ID NO: 128646 - DNA, 20 bp, Artificial
  CRISPR gRNA sequence
ggccaaatacttctaggttc

SEQ ID NO: 128647 - DNA, 20 bp, Artificial
  CRISPR gRNA sequence
gccaaatacttctaggttcc

SEQ ID NO: 128648 - DNA, 20 bp, Artificial
  CRISPR gRNA sequence
ctaggttcctatgatactga

SEQ ID NO: 128649 - DNA, 20 bp, Artificial
  CRISPR gRNA sequence
taggttcctatgatactgaa

SEQ ID NO: 128650 - DNA, 20 bp, Artificial
  CRISPR gRNA sequence
ggttcctatgatactgaaga

SEQ ID NO: 128651 - DNA, 20 bp, Artificial
  CRISPR gRNA sequence
ctatgatactgaagatctgt

SEQ ID NO: 128652 - DNA, 20 bp, Artificial
  CRISPR gRNA sequence
tgatactgaagatctgtaaa

SEQ ID NO: 128653 - DNA, 20 bp, Artificial
  CRISPR gRNA sequence
aagatctgtaaaaataatgt

SEQ ID NO: 128654 - DNA, 20 bp, Artificial
  CRISPR gRNA sequence
taaaaataatgtcaggaatt

SEQ ID NO: 128655 - DNA, 20 bp, Artificial
  CRISPR gRNA sequence
acacattcttttcctacttc

SEQ ID NO: 128656 - DNA, 20 bp, Artificial
  CRISPR gRNA sequence
cacattcttttcctacttca

SEQ ID NO: 128657 - DNA, 20 bp, Artificial
  CRISPR gRNA sequence
ttttcctacttcaattattc

SEQ ID NO: 128658 - DNA, 20 bp, Artificial
  CRISPR gRNA sequence
ttcctacttcaattattcca

SEQ ID NO: 128659 - DNA, 20 bp, Artificial
  CRISPR gRNA sequence
tcctacttcaattattccat

SEQ ID NO: 128660 - DNA, 20 bp, Artificial
  CRISPR gRNA sequence
cctacttcaattattccatg

SEQ ID NO: 128661 - DNA, 20 bp, Artificial
  CRISPR gRNA sequence
ctacttcaattattccatgc

SEQ ID NO: 128662 - DNA, 20 bp, Artificial
  CRISPR gRNA sequence
cttcaattattccatgcaaa

SEQ ID NO: 128663 - DNA, 20 bp, Artificial
  CRISPR gRNA sequence
caattattccatgcaaatat

SEQ ID NO: 128664 - DNA, 20 bp, Artificial
  CRISPR gRNA sequence
aattattccatgcaaatatc

SEQ ID NO: 128665 - DNA, 20 bp, Artificial
  CRISPR gRNA sequence
ttccatgcaaatatcactaa

SEQ ID NO: 128666 - DNA, 20 bp, Artificial
  CRISPR gRNA sequence
catgcaaatatcactaattt

SEQ ID NO: 128667 - DNA, 20 bp, Artificial
  CRISPR gRNA sequence
atttaatgggattcaaacac

SEQ ID NO: 128668 - DNA, 20 bp, Artificial
  CRISPR gRNA sequence
aatgggattcaaacactaaa

SEQ ID NO: 128669 - DNA, 20 bp, Artificial
  CRISPR gRNA sequence
atgggattcaaacactaaag

SEQ ID NO: 128670 - DNA, 20 bp, Artificial
  CRISPR gRNA sequence
aaacactaaagatattaaga

SEQ ID NO: 128671 - DNA, 20 bp, Artificial
  CRISPR gRNA sequence
aagatattaagaatatattt

SEQ ID NO: 128672 - DNA, 20 bp, Artificial
  CRISPR gRNA sequence
agaatatattttgaaagtaa

SEQ ID NO: 128673 - DNA, 20 bp, Artificial
  CRISPR gRNA sequence
tgaaagtaatgtgaatctga

SEQ ID NO: 128674 - DNA, 20 bp, Artificial
  CRISPR gRNA sequence
gaaagtaatgtgaatctgac

SEQ ID NO: 128675 - DNA, 20 bp, Artificial
  CRISPR gRNA sequence
aaagtaatgtgaatctgaca

SEQ ID NO: 128676 - DNA, 20 bp, Artificial
  CRISPR gRNA sequence
acacctaagctggcatgtgg

SEQ ID NO: 128677 - DNA, 20 bp, Artificial
  CRISPR gRNA sequence
agctggcatgtggaaataaa

SEQ ID NO: 128678 - DNA, 20 bp, Artificial
  CRISPR gRNA sequence
gcatgtggaaataaatatgc

SEQ ID NO: 128679 - DNA, 20 bp, Artificial
  CRISPR gRNA sequence
aactcaactgcttttcacaa

SEQ ID NO: 128680 - DNA, 20 bp, Artificial
  CRISPR gRNA sequence
aactgcttttcacaaaatcc

SEQ ID NO: 128681 - DNA, 20 bp, Artificial
  CRISPR gRNA sequence
cttttcacaaaatccattcc

SEQ ID NO: 128682 - DNA, 20 bp, Artificial
  CRISPR gRNA sequence
ttcacaaaatccattcctac

SEQ ID NO: 128683 - DNA, 20 bp, Artificial
  CRISPR gRNA sequence
tcacaaaatccattcctaca

SEQ ID NO: 128684 - DNA, 20 bp, Artificial
  CRISPR gRNA sequence
cacaaaatccattcctacag

SEQ ID NO: 128685 - DNA, 20 bp, Artificial
  CRISPR gRNA sequence
acaaaatccattcctacagg

SEQ ID NO: 128686 - DNA, 20 bp, Artificial
  CRISPR gRNA sequence
ctacaggcaaagataaacct

SEQ ID NO: 128687 - DNA, 20 bp, Artificial
  CRISPR gRNA sequence
caggcaaagataaacctaag

SEQ ID NO: 128688 - DNA, 20 bp, Artificial
  CRISPR gRNA sequence
agaaatatagaagaattcaa

SEQ ID NO: 128689 - DNA, 20 bp, Artificial
  CRISPR gRNA sequence
aatcaataataagacatatg

SEQ ID NO: 128690 - DNA, 20 bp, Artificial
  CRISPR gRNA sequence
taccttcctctttttattat

SEQ ID NO: 128691 - DNA, 20 bp, Artificial
  CRISPR gRNA sequence
cctctttttattatctaaaa

SEQ ID NO: 128692 - DNA, 20 bp, Artificial
  CRISPR gRNA sequence
ctctttttattatctaaaag

SEQ ID NO: 128693 - DNA, 20 bp, Artificial
  CRISPR gRNA sequence
tttttattatctaaaagact

SEQ ID NO: 128694 - DNA, 20 bp, Artificial
  CRISPR gRNA sequence
tttattatctaaaagactcc

SEQ ID NO: 128695 - DNA, 20 bp, Artificial
  CRISPR gRNA sequence
ttattatctaaaagactcca

SEQ ID NO: 128696 - DNA, 20 bp, Artificial
  CRISPR gRNA sequence
tattatctaaaagactccaa

SEQ ID NO: 128697 - DNA, 20 bp, Artificial
  CRISPR gRNA sequence
attatctaaaagactccaac

SEQ ID NO: 128698 - DNA, 20 bp, Artificial
  CRISPR gRNA sequence
ttatctaaaagactccaacc

SEQ ID NO: 128699 - DNA, 20 bp, Artificial
  CRISPR gRNA sequence
tctaaaagactccaacctta

SEQ ID NO: 128700 - DNA, 20 bp, Artificial
  CRISPR gRNA sequence
aaagactccaaccttactac

SEQ ID NO: 128701 - DNA, 20 bp, Artificial
  CRISPR gRNA sequence
caaccttactacttttaatg

SEQ ID NO: 128702 - DNA, 20 bp, Artificial
  CRISPR gRNA sequence
actacttttaatgctacttc

SEQ ID NO: 128703 - DNA, 20 bp, Artificial
  CRISPR gRNA sequence
ctacttttaatgctacttct

SEQ ID NO: 128704 - DNA, 20 bp, Artificial
  CRISPR gRNA sequence
cttttaatgctacttctttg

SEQ ID NO: 128705 - DNA, 20 bp, Artificial
  CRISPR gRNA sequence
ttaatgctacttctttgaaa

SEQ ID NO: 128706 - DNA, 20 bp, Artificial
  CRISPR gRNA sequence
taatgctacttctttgaaat

SEQ ID NO: 128707 - DNA, 20 bp, Artificial
  CRISPR gRNA sequence
aatgctacttctttgaaatt

SEQ ID NO: 128708 - DNA, 20 bp, Artificial
  CRISPR gRNA sequence
atgctacttctttgaaatta

SEQ ID NO: 128709 - DNA, 20 bp, Artificial
  CRISPR gRNA sequence
cttctttgaaattaacaata

SEQ ID NO: 128710 - DNA, 20 bp, Artificial
  CRISPR gRNA sequence
ctttgaaattaacaatagca

SEQ ID NO: 128711 - DNA, 20 bp, Artificial
  CRISPR gRNA sequence
tttgaaattaacaatagcag

SEQ ID NO: 128712 - DNA, 20 bp, Artificial
  CRISPR gRNA sequence
tgaaattaacaatagcagca

SEQ ID NO: 128713 - DNA, 20 bp, Artificial
  CRISPR gRNA sequence
gaaattaacaatagcagcaa

SEQ ID NO: 128714 - DNA, 20 bp, Artificial
  CRISPR gRNA sequence
aaattaacaatagcagcaag

SEQ ID NO: 128715 - DNA, 20 bp, Artificial
  CRISPR gRNA sequence
acaatagcagcaagaagtaa

SEQ ID NO: 128716 - DNA, 20 bp, Artificial
  CRISPR gRNA sequence
atgagcactgaacattattt

SEQ ID NO: 128717 - DNA, 20 bp, Artificial
  CRISPR gRNA sequence
aacattatttagtaccatcc

SEQ ID NO: 128718 - DNA, 20 bp, Artificial
  CRISPR gRNA sequence
tttagtaccatccataattc

SEQ ID NO: 128719 - DNA, 20 bp, Artificial
  CRISPR gRNA sequence
agtaccatccataattctat

SEQ ID NO: 128720 - DNA, 20 bp, Artificial
  CRISPR gRNA sequence
gtaccatccataattctatg

SEQ ID NO: 128721 - DNA, 20 bp, Artificial
  CRISPR gRNA sequence
tatgatataggtactattag

SEQ ID NO: 128722 - DNA, 20 bp, Artificial
  CRISPR gRNA sequence
tgatataggtactattagcc

SEQ ID NO: 128723 - DNA, 20 bp, Artificial
  CRISPR gRNA sequence
ttagcctcattttacagatg

SEQ ID NO: 128724 - DNA, 20 bp, Artificial
  CRISPR gRNA sequence
gcctcattttacagatgagg

SEQ ID NO: 128725 - DNA, 20 bp, Artificial
  CRISPR gRNA sequence
attttacagatgaggaaacc

SEQ ID NO: 128726 - DNA, 20 bp, Artificial
  CRISPR gRNA sequence
tacagatgaggaaaccaagg

SEQ ID NO: 128727 - DNA, 20 bp, Artificial
  CRISPR gRNA sequence
acagatgaggaaaccaaggc

SEQ ID NO: 128728 - DNA, 20 bp, Artificial
  CRISPR gRNA sequence
cagatgaggaaaccaaggcc

SEQ ID NO: 128729 - DNA, 20 bp, Artificial
  CRISPR gRNA sequence
aagtaattaaataatctgtc

SEQ ID NO: 128730 - DNA, 20 bp, Artificial
  CRISPR gRNA sequence
aataatctgtccaaggccac

SEQ ID NO: 128731 - DNA, 20 bp, Artificial
  CRISPR gRNA sequence
tccaaggccacagaatttgc

SEQ ID NO: 128732 - DNA, 20 bp, Artificial
  CRISPR gRNA sequence
gcatgtggcagagctgggat

SEQ ID NO: 128733 - DNA, 20 bp, Artificial
  CRISPR gRNA sequence
catgtggcagagctgggatt

SEQ ID NO: 128734 - DNA, 20 bp, Artificial
  CRISPR gRNA sequence
ggattcagcctcctggtagt

SEQ ID NO: 128735 - DNA, 20 bp, Artificial
  CRISPR gRNA sequence
agcctcctggtagtctgaat

SEQ ID NO: 128736 - DNA, 20 bp, Artificial
  CRISPR gRNA sequence
ctggtagtctgaatacaaag

SEQ ID NO: 128737 - DNA, 20 bp, Artificial
  CRISPR gRNA sequence
gtagtctgaatacaaagtct

SEQ ID NO: 128738 - DNA, 20 bp, Artificial
  CRISPR gRNA sequence
aatacaaagtctgtgccctt

SEQ ID NO: 128739 - DNA, 20 bp, Artificial
  CRISPR gRNA sequence
tgcccttaaatcattatata

SEQ ID NO: 128740 - DNA, 20 bp, Artificial
  CRISPR gRNA sequence
aaatcattatataactatgc

SEQ ID NO: 128741 - DNA, 20 bp, Artificial
  CRISPR gRNA sequence
aatcattatataactatgct

SEQ ID NO: 128742 - DNA, 20 bp, Artificial
  CRISPR gRNA sequence
tataactatgctatagttag

SEQ ID NO: 128743 - DNA, 20 bp, Artificial
  CRISPR gRNA sequence
tgctatagttagtaataaac

SEQ ID NO: 128744 - DNA, 20 bp, Artificial
  CRISPR gRNA sequence
tagttagtaataaacaaagg

SEQ ID NO: 128745 - DNA, 20 bp, Artificial
  CRISPR gRNA sequence
gtaataaacaaagggaaaaa

SEQ ID NO: 128746 - DNA, 20 bp, Artificial
  CRISPR gRNA sequence
tctatttaagtactgtaata

SEQ ID NO: 128747 - DNA, 20 bp, Artificial
  CRISPR gRNA sequence
ctatttaagtactgtaatat

SEQ ID NO: 128748 - DNA, 20 bp, Artificial
  CRISPR gRNA sequence
tatttaagtactgtaatata

SEQ ID NO: 128749 - DNA, 20 bp, Artificial
  CRISPR gRNA sequence
tttaagtactgtaatataag

SEQ ID NO: 128750 - DNA, 20 bp, Artificial
  CRISPR gRNA sequence
aagtactgtaatataagtca

SEQ ID NO: 128751 - DNA, 20 bp, Artificial
  CRISPR gRNA sequence
agtactgtaatataagtcag

SEQ ID NO: 128752 - DNA, 20 bp, Artificial
  CRISPR gRNA sequence
taatataagtcagtgatccc

SEQ ID NO: 128753 - DNA, 20 bp, Artificial
  CRISPR gRNA sequence
cagactgatgagtgtccgtg

SEQ ID NO: 128754 - DNA, 20 bp, Artificial
  CRISPR gRNA sequence
atgagtgtccgtggcctgtt

SEQ ID NO: 128755 - DNA, 20 bp, Artificial
  CRISPR gRNA sequence
ttaagaacccagccacacag

SEQ ID NO: 128756 - DNA, 20 bp, Artificial
  CRISPR gRNA sequence
agaacccagccacacagcag

SEQ ID NO: 128757 - DNA, 20 bp, Artificial
  CRISPR gRNA sequence
gtaatccagcattaccacct

SEQ ID NO: 128758 - DNA, 20 bp, Artificial
  CRISPR gRNA sequence
ccacctgagctccgccttcg

SEQ ID NO: 128759 - DNA, 20 bp, Artificial
  CRISPR gRNA sequence
agctccgccttcggtcagat

SEQ ID NO: 128760 - DNA, 20 bp, Artificial
  CRISPR gRNA sequence
cgccttcggtcagatcagcg

SEQ ID NO: 128761 - DNA, 20 bp, Artificial
  CRISPR gRNA sequence
cggtcagatcagcggccacg

SEQ ID NO: 128762 - DNA, 20 bp, Artificial
  CRISPR gRNA sequence
ggtcagatcagcggccacgt

SEQ ID NO: 128763 - DNA, 20 bp, Artificial
  CRISPR gRNA sequence
tcataggcgctggaacccta

SEQ ID NO: 128764 - DNA, 20 bp, Artificial
  CRISPR gRNA sequence
ataggcgctggaaccctatt

SEQ ID NO: 128765 - DNA, 20 bp, Artificial
  CRISPR gRNA sequence
gaaccctattgtgaactgcg

SEQ ID NO: 128766 - DNA, 20 bp, Artificial
  CRISPR gRNA sequence
ttgtgaactgcgcatgcaag

SEQ ID NO: 128767 - DNA, 20 bp, Artificial
  CRISPR gRNA sequence
tgaactgcgcatgcaaggga

SEQ ID NO: 128768 - DNA, 20 bp, Artificial
  CRISPR gRNA sequence
cgcatgcaagggatctaggc

SEQ ID NO: 128769 - DNA, 20 bp, Artificial
  CRISPR gRNA sequence
ggctgtgcgttccttatgag

SEQ ID NO: 128770 - DNA, 20 bp, Artificial
  CRISPR gRNA sequence
tgcgttccttatgagaatct

SEQ ID NO: 128771 - DNA, 20 bp, Artificial
  CRISPR gRNA sequence
cttatgagaatctaactaat

SEQ ID NO: 128772 - DNA, 20 bp, Artificial
  CRISPR gRNA sequence
atgagaatctaactaatgcc

SEQ ID NO: 128773 - DNA, 20 bp, Artificial
  CRISPR gRNA sequence
tgagaatctaactaatgcct

SEQ ID NO: 128774 - DNA, 20 bp, Artificial
  CRISPR gRNA sequence
actaatgcctgatgatctga

SEQ ID NO: 128775 - DNA, 20 bp, Artificial
  CRISPR gRNA sequence
atgcctgatgatctgaggtg

SEQ ID NO: 128776 - DNA, 20 bp, Artificial
  CRISPR gRNA sequence
atgatctgaggtggaacagt

SEQ ID NO: 128777 - DNA, 20 bp, Artificial
  CRISPR gRNA sequence
aggtggaacagtttcatcct

SEQ ID NO: 128778 - DNA, 20 bp, Artificial
  CRISPR gRNA sequence
catcctgaagccatctaccc

SEQ ID NO: 128779 - DNA, 20 bp, Artificial
  CRISPR gRNA sequence
atcctgaagccatctacccc

SEQ ID NO: 128780 - DNA, 20 bp, Artificial
  CRISPR gRNA sequence
aagccatctacccctcgcac

SEQ ID NO: 128781 - DNA, 20 bp, Artificial
  CRISPR gRNA sequence
cccctcgcacccctcccctg

SEQ ID NO: 128782 - DNA, 20 bp, Artificial
  CRISPR gRNA sequence
gcacccctcccctgacccca

SEQ ID NO: 128783 - DNA, 20 bp, Artificial
  CRISPR gRNA sequence
ccctgaccccagagcgtgga

SEQ ID NO: 128784 - DNA, 20 bp, Artificial
  CRISPR gRNA sequence
accccagagcgtggaaaaat

SEQ ID NO: 128785 - DNA, 20 bp, Artificial
  CRISPR gRNA sequence
ctttccacaaaacaggtccc

SEQ ID NO: 128786 - DNA, 20 bp, Artificial
  CRISPR gRNA sequence
tccacaaaacaggtccctgg

SEQ ID NO: 128787 - DNA, 20 bp, Artificial
  CRISPR gRNA sequence
ccacaaaacaggtccctggt

SEQ ID NO: 128788 - DNA, 20 bp, Artificial
  CRISPR gRNA sequence
cacaaaacaggtccctggtg

SEQ ID NO: 128789 - DNA, 20 bp, Artificial
  CRISPR gRNA sequence
gtgccaaaaatgttgaggac

SEQ ID NO: 128790 - DNA, 20 bp, Artificial
  CRISPR gRNA sequence
aggactgctgatataagcaa

SEQ ID NO: 128791 - DNA, 20 bp, Artificial
  CRISPR gRNA sequence
ctgatataagcaattaaata

SEQ ID NO: 128792 - DNA, 20 bp, Artificial
  CRISPR gRNA sequence
atataagcaattaaatactt

SEQ ID NO: 128793 - DNA, 20 bp, Artificial
  CRISPR gRNA sequence
aatacttctgagaaatgtta

SEQ ID NO: 128794 - DNA, 20 bp, Artificial
  CRISPR gRNA sequence
ctgagaaatgttacataatt

SEQ ID NO: 128795 - DNA, 20 bp, Artificial
  CRISPR gRNA sequence
tgagaaatgttacataattt

SEQ ID NO: 128796 - DNA, 20 bp, Artificial
  CRISPR gRNA sequence
agaaatgttacataatttac

SEQ ID NO: 128797 - DNA, 20 bp, Artificial
  CRISPR gRNA sequence
cataatttactacaaaatga

SEQ ID NO: 128798 - DNA, 20 bp, Artificial
  CRISPR gRNA sequence
actacaaaatgaatttttaa

SEQ ID NO: 128799 - DNA, 20 bp, Artificial
  CRISPR gRNA sequence
ctacaaaatgaatttttaaa

SEQ ID NO: 128800 - DNA, 20 bp, Artificial
  CRISPR gRNA sequence
caaaatgaatttttaaaaca

SEQ ID NO: 128801 - DNA, 20 bp, Artificial
  CRISPR gRNA sequence
ttaaaacaagtaatacattt

SEQ ID NO: 128802 - DNA, 20 bp, Artificial
  CRISPR gRNA sequence
taaaacaagtaatacattta

SEQ ID NO: 128803 - DNA, 20 bp, Artificial
  CRISPR gRNA sequence
aaaacaagtaatacatttac

SEQ ID NO: 128804 - DNA, 20 bp, Artificial
  CRISPR gRNA sequence
aaacaagtaatacatttaca

SEQ ID NO: 128805 - DNA, 20 bp, Artificial
  CRISPR gRNA sequence
acaaagttaaaataaataat

SEQ ID NO: 128806 - DNA, 20 bp, Artificial
  CRISPR gRNA sequence
caaagttaaaataaataatg

SEQ ID NO: 128807 - DNA, 20 bp, Artificial
  CRISPR gRNA sequence
aaataaataatgtctcttat

SEQ ID NO: 128808 - DNA, 20 bp, Artificial
  CRISPR gRNA sequence
ttattttcttaaaagcacaa

SEQ ID NO: 128809 - DNA, 20 bp, Artificial
  CRISPR gRNA sequence
attttcttaaaagcacaatg

SEQ ID NO: 128810 - DNA, 20 bp, Artificial
  CRISPR gRNA sequence
ttttcttaaaagcacaatgg

SEQ ID NO: 128811 - DNA, 20 bp, Artificial
  CRISPR gRNA sequence
tcttaaaagcacaatggggg

SEQ ID NO: 128812 - DNA, 20 bp, Artificial
  CRISPR gRNA sequence
cttaaaagcacaatgggggc

SEQ ID NO: 128813 - DNA, 20 bp, Artificial
  CRISPR gRNA sequence
ttaaaagcacaatgggggcc

SEQ ID NO: 128814 - DNA, 20 bp, Artificial
  CRISPR gRNA sequence
aaaagcacaatgggggccgg

SEQ ID NO: 128815 - DNA, 20 bp, Artificial
  CRISPR gRNA sequence
aaagcacaatgggggccggg

SEQ ID NO: 128816 - DNA, 20 bp, Artificial
  CRISPR gRNA sequence
acacctgtaatcccagcact

SEQ ID NO: 128817 - DNA, 20 bp, Artificial
  CRISPR gRNA sequence
taatcccagcactttgggag

SEQ ID NO: 128818 - DNA, 20 bp, Artificial
  CRISPR gRNA sequence
tgggaggccgaggcaggtgg

SEQ ID NO: 128819 - DNA, 20 bp, Artificial
  CRISPR gRNA sequence
gggaggccgaggcaggtgga

SEQ ID NO: 128820 - DNA, 20 bp, Artificial
  CRISPR gRNA sequence
ggaggccgaggcaggtggat

SEQ ID NO: 128821 - DNA, 20 bp, Artificial
  CRISPR gRNA sequence
aggtcaggagtttgagacca

SEQ ID NO: 128822 - DNA, 20 bp, Artificial
  CRISPR gRNA sequence
gagaccagcctggccaacat

SEQ ID NO: 128823 - DNA, 20 bp, Artificial
  CRISPR gRNA sequence
agaccagcctggccaacatg

SEQ ID NO: 128824 - DNA, 20 bp, Artificial
  CRISPR gRNA sequence
gccaacatggtgtaaccccc

SEQ ID NO: 128825 - DNA, 20 bp, Artificial
  CRISPR gRNA sequence
tactaaaaatacaaaactta

SEQ ID NO: 128826 - DNA, 20 bp, Artificial
  CRISPR gRNA sequence
ctaaaaatacaaaacttagc

SEQ ID NO: 128827 - DNA, 20 bp, Artificial
  CRISPR gRNA sequence
aaaatacaaaacttagccag

SEQ ID NO: 128828 - DNA, 20 bp, Artificial
  CRISPR gRNA sequence
agccaggcatggtggtgcac

SEQ ID NO: 128829 - DNA, 20 bp, Artificial
  CRISPR gRNA sequence
gccaggcatggtggtgcacg

SEQ ID NO: 128830 - DNA, 20 bp, Artificial
  CRISPR gRNA sequence
taatcccagctactcaggag

SEQ ID NO: 128831 - DNA, 20 bp, Artificial
  CRISPR gRNA sequence
ctcaggaggctgaggcagga

SEQ ID NO: 128832 - DNA, 20 bp, Artificial
  CRISPR gRNA sequence
aggaggctgaggcaggagag

SEQ ID NO: 128833 - DNA, 20 bp, Artificial
  CRISPR gRNA sequence
aggcaggagagttgcttgaa

SEQ ID NO: 128834 - DNA, 20 bp, Artificial
  CRISPR gRNA sequence
cttgaacccaggaggcagag

SEQ ID NO: 128835 - DNA, 20 bp, Artificial
  CRISPR gRNA sequence
gaacccaggaggcagaggtt

SEQ ID NO: 128836 - DNA, 20 bp, Artificial
  CRISPR gRNA sequence
aacccaggaggcagaggttg

SEQ ID NO: 128837 - DNA, 20 bp, Artificial
  CRISPR gRNA sequence
cagtgagccgagatcttgcc

SEQ ID NO: 128838 - DNA, 20 bp, Artificial
  CRISPR gRNA sequence
gccactgtactccagcctgg

SEQ ID NO: 128839 - DNA, 20 bp, Artificial
  CRISPR gRNA sequence
ccactgtactccagcctggg

SEQ ID NO: 128840 - DNA, 20 bp, Artificial
  CRISPR gRNA sequence
tactccagcctgggcaacag

SEQ ID NO: 128841 - DNA, 20 bp, Artificial
  CRISPR gRNA sequence
cagcctgggcaacagagcga

SEQ ID NO: 128842 - DNA, 20 bp, Artificial
  CRISPR gRNA sequence
ggcaacagagcgatactcca

SEQ ID NO: 128843 - DNA, 20 bp, Artificial
  CRISPR gRNA sequence
cacctcaaaaaaaaaaagaa

SEQ ID NO: 128844 - DNA, 20 bp, Artificial
  CRISPR gRNA sequence
aaaaaaaaaaagaagaaaaa

SEQ ID NO: 128845 - DNA, 20 bp, Artificial
  CRISPR gRNA sequence
tatttacctctctgaatttc

SEQ ID NO: 128846 - DNA, 20 bp, Artificial
  CRISPR gRNA sequence
atttacctctctgaatttct

SEQ ID NO: 128847 - DNA, 20 bp, Artificial
  CRISPR gRNA sequence
tttacctctctgaatttctg

SEQ ID NO: 128848 - DNA, 20 bp, Artificial
  CRISPR gRNA sequence
acctctctgaatttctgaag

SEQ ID NO: 128849 - DNA, 20 bp, Artificial
  CRISPR gRNA sequence
cctctctgaatttctgaagg

SEQ ID NO: 128850 - DNA, 20 bp, Artificial
  CRISPR gRNA sequence
tctgaatttctgaaggtata

SEQ ID NO: 128851 - DNA, 20 bp, Artificial
  CRISPR gRNA sequence
tgaatttctgaaggtataat

SEQ ID NO: 128852 - DNA, 20 bp, Artificial
  CRISPR gRNA sequence
aatttctgaaggtataattt

SEQ ID NO: 128853 - DNA, 20 bp, Artificial
  CRISPR gRNA sequence
ctgaaggtataatttcagag

SEQ ID NO: 128854 - DNA, 20 bp, Artificial
  CRISPR gRNA sequence
tgaaggtataatttcagagg

SEQ ID NO: 128855 - DNA, 20 bp, Artificial
  CRISPR gRNA sequence
aaggtataatttcagaggtt

SEQ ID NO: 128856 - DNA, 20 bp, Artificial
  CRISPR gRNA sequence
cagaggttccacataactgt

SEQ ID NO: 128857 - DNA, 20 bp, Artificial
  CRISPR gRNA sequence
agaggttccacataactgtc

SEQ ID NO: 128858 - DNA, 20 bp, Artificial
  CRISPR gRNA sequence
cacataactgtcaaagccta

SEQ ID NO: 128859 - DNA, 20 bp, Artificial
  CRISPR gRNA sequence
tcaaagcctaaagtagacat

SEQ ID NO: 128860 - DNA, 20 bp, Artificial
  CRISPR gRNA sequence
aagtagacatagcaaagaga

SEQ ID NO: 128861 - DNA, 20 bp, Artificial
  CRISPR gRNA sequence
ctccattgattgttttccgt

SEQ ID NO: 128862 - DNA, 20 bp, Artificial
  CRISPR gRNA sequence
tccattgattgttttccgtt

SEQ ID NO: 128863 - DNA, 20 bp, Artificial
  CRISPR gRNA sequence
cattgattgttttccgtttc

SEQ ID NO: 128864 - DNA, 20 bp, Artificial
  CRISPR gRNA sequence
attgttttccgtttctcttg

SEQ ID NO: 128865 - DNA, 20 bp, Artificial
  CRISPR gRNA sequence
ttttccgtttctcttgatgg

SEQ ID NO: 128866 - DNA, 20 bp, Artificial
  CRISPR gRNA sequence
tccgtttctcttgatggcac

SEQ ID NO: 128867 - DNA, 20 bp, Artificial
  CRISPR gRNA sequence
ccgtttctcttgatggcacc

SEQ ID NO: 128868 - DNA, 20 bp, Artificial
  CRISPR gRNA sequence
cgtttctcttgatggcacct

SEQ ID NO: 128869 - DNA, 20 bp, Artificial
  CRISPR gRNA sequence
ctcttgatggcacctttcac

SEQ ID NO: 128870 - DNA, 20 bp, Artificial
  CRISPR gRNA sequence
tcttgatggcacctttcact

SEQ ID NO: 128871 - DNA, 20 bp, Artificial
  CRISPR gRNA sequence
ttgatggcacctttcacttg

SEQ ID NO: 128872 - DNA, 20 bp, Artificial
  CRISPR gRNA sequence
gatggcacctttcacttgct

SEQ ID NO: 128873 - DNA, 20 bp, Artificial
  CRISPR gRNA sequence
atggcacctttcacttgctt

SEQ ID NO: 128874 - DNA, 20 bp, Artificial
  CRISPR gRNA sequence
tcacttgcttcagatgttat

SEQ ID NO: 128875 - DNA, 20 bp, Artificial
  CRISPR gRNA sequence
cacttgcttcagatgttata

SEQ ID NO: 128876 - DNA, 20 bp, Artificial
  CRISPR gRNA sequence
acttgcttcagatgttataa

SEQ ID NO: 128877 - DNA, 20 bp, Artificial
  CRISPR gRNA sequence
gcttcagatgttataaaact

SEQ ID NO: 128878 - DNA, 20 bp, Artificial
  CRISPR gRNA sequence
cttcagatgttataaaactg

SEQ ID NO: 128879 - DNA, 20 bp, Artificial
  CRISPR gRNA sequence
cagatgttataaaactgatg

SEQ ID NO: 128880 - DNA, 20 bp, Artificial
  CRISPR gRNA sequence
agatgttataaaactgatga

SEQ ID NO: 128881 - DNA, 20 bp, Artificial
  CRISPR gRNA sequence
taaaactgatgaactcactt

SEQ ID NO: 128882 - DNA, 20 bp, Artificial
  CRISPR gRNA sequence
atgaactcacttacacattc

SEQ ID NO: 128883 - DNA, 20 bp, Artificial
  CRISPR gRNA sequence
acttacacattcttgaacac

SEQ ID NO: 128884 - DNA, 20 bp, Artificial
  CRISPR gRNA sequence
acacattcttgaacacattc

SEQ ID NO: 128885 - DNA, 20 bp, Artificial
  CRISPR gRNA sequence
cacattcttgaacacattct

SEQ ID NO: 128886 - DNA, 20 bp, Artificial
  CRISPR gRNA sequence
ttgaacacattctttggcat

SEQ ID NO: 128887 - DNA, 20 bp, Artificial
  CRISPR gRNA sequence
gaacacattctttggcatct

SEQ ID NO: 128888 - DNA, 20 bp, Artificial
  CRISPR gRNA sequence
aacacattctttggcatctt

SEQ ID NO: 128889 - DNA, 20 bp, Artificial
  CRISPR gRNA sequence
tttggcatcttttgcaatct

SEQ ID NO: 128890 - DNA, 20 bp, Artificial
  CRISPR gRNA sequence
tggcatcttttgcaatctga

SEQ ID NO: 128891 - DNA, 20 bp, Artificial
  CRISPR gRNA sequence
ggcatcttttgcaatctgaa

SEQ ID NO: 128892 - DNA, 20 bp, Artificial
  CRISPR gRNA sequence
gcatcttttgcaatctgaag

SEQ ID NO: 128893 - DNA, 20 bp, Artificial
  CRISPR gRNA sequence
ttgcaatctgaagagaaaat

SEQ ID NO: 128894 - DNA, 20 bp, Artificial
  CRISPR gRNA sequence
tgcaatctgaagagaaaatc

SEQ ID NO: 128895 - DNA, 20 bp, Artificial
  CRISPR gRNA sequence
gcaatctgaagagaaaatca

SEQ ID NO: 128896 - DNA, 20 bp, Artificial
  CRISPR gRNA sequence
caatctgaagagaaaatcat

SEQ ID NO: 128897 - DNA, 20 bp, Artificial
  CRISPR gRNA sequence
aagagaaaatcataggtaaa

SEQ ID NO: 128898 - DNA, 20 bp, Artificial
  CRISPR gRNA sequence
cagaaactataaccatcacc

SEQ ID NO: 128899 - DNA, 20 bp, Artificial
  CRISPR gRNA sequence
taaccatcaccttcctaaca

SEQ ID NO: 128900 - DNA, 20 bp, Artificial
  CRISPR gRNA sequence
cctaacaacctacaaaaatg

SEQ ID NO: 128901 - DNA, 20 bp, Artificial
  CRISPR gRNA sequence
ctaacaacctacaaaaatga

SEQ ID NO: 128902 - DNA, 20 bp, Artificial
  CRISPR gRNA sequence
acaacctacaaaaatgaaag

SEQ ID NO: 128903 - DNA, 20 bp, Artificial
  CRISPR gRNA sequence
caaaaatgaaagcctattca

SEQ ID NO: 128904 - DNA, 20 bp, Artificial
  CRISPR gRNA sequence
ttcagaagaacacatcttca

SEQ ID NO: 128905 - DNA, 20 bp, Artificial
  CRISPR gRNA sequence
agaagaacacatcttcactt

SEQ ID NO: 128906 - DNA, 20 bp, Artificial
  CRISPR gRNA sequence
cactttatgactatttaatc

SEQ ID NO: 128907 - DNA, 20 bp, Artificial
  CRISPR gRNA sequence
actttatgactatttaatct

SEQ ID NO: 128908 - DNA, 20 bp, Artificial
  CRISPR gRNA sequence
tatgactatttaatctctta

SEQ ID NO: 128909 - DNA, 20 bp, Artificial
  CRISPR gRNA sequence
atgactatttaatctcttaa

SEQ ID NO: 128910 - DNA, 20 bp, Artificial
  CRISPR gRNA sequence
tgactatttaatctcttaaa

SEQ ID NO: 128911 - DNA, 20 bp, Artificial
  CRISPR gRNA sequence
tttaatctcttaaatatatg

SEQ ID NO: 128912 - DNA, 20 bp, Artificial
  CRISPR gRNA sequence
aatctcttaaatatatgtta

SEQ ID NO: 128913 - DNA, 20 bp, Artificial
  CRISPR gRNA sequence
atctcttaaatatatgttat

SEQ ID NO: 128914 - DNA, 20 bp, Artificial
  CRISPR gRNA sequence
ttaaatatatgttataacat

SEQ ID NO: 128915 - DNA, 20 bp, Artificial
  CRISPR gRNA sequence
aaatatatgttataacatta

SEQ ID NO: 128916 - DNA, 20 bp, Artificial
  CRISPR gRNA sequence
aatatatgttataacattaa

SEQ ID NO: 128917 - DNA, 20 bp, Artificial
  CRISPR gRNA sequence
taacattaacacaatgtgtg

SEQ ID NO: 128918 - DNA, 20 bp, Artificial
  CRISPR gRNA sequence
acacaatgtgtgctatcaaa

SEQ ID NO: 128919 - DNA, 20 bp, Artificial
  CRISPR gRNA sequence
tcaaaagtccacacctcaga

SEQ ID NO: 128920 - DNA, 20 bp, Artificial
  CRISPR gRNA sequence
agagtcagaataaaagctca

SEQ ID NO: 128921 - DNA, 20 bp, Artificial
  CRISPR gRNA sequence
aaatacaagtgagagaagcc

SEQ ID NO: 128922 - DNA, 20 bp, Artificial
  CRISPR gRNA sequence
gacaactatttacagaaaca

SEQ ID NO: 128923 - DNA, 20 bp, Artificial
  CRISPR gRNA sequence
acaactatttacagaaacaa

SEQ ID NO: 128924 - DNA, 20 bp, Artificial
  CRISPR gRNA sequence
tttacagaaacaaatctaat

SEQ ID NO: 128925 - DNA, 20 bp, Artificial
  CRISPR gRNA sequence
acagaaacaaatctaattta

SEQ ID NO: 128926 - DNA, 20 bp, Artificial
  CRISPR gRNA sequence
cagaaacaaatctaatttag

SEQ ID NO: 128927 - DNA, 20 bp, Artificial
  CRISPR gRNA sequence
atttagatgtaaaagagtgc

SEQ ID NO: 128928 - DNA, 20 bp, Artificial
  CRISPR gRNA sequence
agatgtaaaagagtgcctgg

SEQ ID NO: 128929 - DNA, 20 bp, Artificial
  CRISPR gRNA sequence
gatgtaaaagagtgcctggc

SEQ ID NO: 128930 - DNA, 20 bp, Artificial
  CRISPR gRNA sequence
gcagggtgactcatgcctgt

SEQ ID NO: 128931 - DNA, 20 bp, Artificial
  CRISPR gRNA sequence
atgcctgtaatcccagcact

SEQ ID NO: 128932 - DNA, 20 bp, Artificial
  CRISPR gRNA sequence
taatcccagcactttgggag

SEQ ID NO: 128933 - DNA, 20 bp, Artificial
  CRISPR gRNA sequence
tgggaggccgaggcgggcgg

SEQ ID NO: 128934 - DNA, 20 bp, Artificial
  CRISPR gRNA sequence
gggaggccgaggcgggcgga

SEQ ID NO: 128935 - DNA, 20 bp, Artificial
  CRISPR gRNA sequence
ggaggccgaggcgggcggat

SEQ ID NO: 128936 - DNA, 20 bp, Artificial
  CRISPR gRNA sequence
aggtcaggagttcaagacca

SEQ ID NO: 128937 - DNA, 20 bp, Artificial
  CRISPR gRNA sequence
aagaccagcctggccaacat

SEQ ID NO: 128938 - DNA, 20 bp, Artificial
  CRISPR gRNA sequence
gccaacatggcgaaacccca

SEQ ID NO: 128939 - DNA, 20 bp, Artificial
  CRISPR gRNA sequence
tactaaaagtacaaaaaatt

SEQ ID NO: 128940 - DNA, 20 bp, Artificial
  CRISPR gRNA sequence
ctaaaagtacaaaaaattag

SEQ ID NO: 128941 - DNA, 20 bp, Artificial
  CRISPR gRNA sequence
aaagtacaaaaaattagctg

SEQ ID NO: 128942 - DNA, 20 bp, Artificial
  CRISPR gRNA sequence
gctgggcgtggtggcaggtg

SEQ ID NO: 128943 - DNA, 20 bp, Artificial
  CRISPR gRNA sequence
ggcgtggtggcaggtgcctg

SEQ ID NO: 128944 - DNA, 20 bp, Artificial
  CRISPR gRNA sequence
taattgctgctactcaggag

SEQ ID NO: 128945 - DNA, 20 bp, Artificial
  CRISPR gRNA sequence
ctgctactcaggaggatgag

SEQ ID NO: 128946 - DNA, 20 bp, Artificial
  CRISPR gRNA sequence
ctactcaggaggatgaggca

SEQ ID NO: 128947 - DNA, 20 bp, Artificial
  CRISPR gRNA sequence
ctcaggaggatgaggcagga

SEQ ID NO: 128948 - DNA, 20 bp, Artificial
  CRISPR gRNA sequence
aggaggatgaggcaggagaa

SEQ ID NO: 128949 - DNA, 20 bp, Artificial
  CRISPR gRNA sequence
cttgaacccaggaggcggag

SEQ ID NO: 128950 - DNA, 20 bp, Artificial
  CRISPR gRNA sequence
gaacccaggaggcggaggtt

SEQ ID NO: 128951 - DNA, 20 bp, Artificial
  CRISPR gRNA sequence
aacccaggaggcggaggttg

SEQ ID NO: 128952 - DNA, 20 bp, Artificial
  CRISPR gRNA sequence
cagtgagccgagattgagcc

SEQ ID NO: 128953 - DNA, 20 bp, Artificial
  CRISPR gRNA sequence
agccactgtactccaggcct

SEQ ID NO: 128954 - DNA, 20 bp, Artificial
  CRISPR gRNA sequence
tactccaggcctgggcaaaa

SEQ ID NO: 128955 - DNA, 20 bp, Artificial
  CRISPR gRNA sequence
caggcctgggcaaaaagagc

SEQ ID NO: 128956 - DNA, 20 bp, Artificial
  CRISPR gRNA sequence
ggcaaaaagagcgagactcc

SEQ ID NO: 128957 - DNA, 20 bp, Artificial
  CRISPR gRNA sequence
cgtctcaaaaaaaaaattaa

SEQ ID NO: 128958 - DNA, 20 bp, Artificial
  CRISPR gRNA sequence
aaaaaaaaaattaaaaaaat

SEQ ID NO: 128959 - DNA, 20 bp, Artificial
  CRISPR gRNA sequence
aaaaaattttaaaaagatat

SEQ ID NO: 128960 - DNA, 20 bp, Artificial
  CRISPR gRNA sequence
taaaaagatataaaacagca

SEQ ID NO: 128961 - DNA, 20 bp, Artificial
  CRISPR gRNA sequence
aaaaagatataaaacagcaa

SEQ ID NO: 128962 - DNA, 20 bp, Artificial
  CRISPR gRNA sequence
aaaagatataaaacagcaat

SEQ ID NO: 128963 - DNA, 20 bp, Artificial
  CRISPR gRNA sequence
gatgttcctaccaccccaca

SEQ ID NO: 128964 - DNA, 20 bp, Artificial
  CRISPR gRNA sequence
ctaccaccccacagaggatg

SEQ ID NO: 128965 - DNA, 20 bp, Artificial
  CRISPR gRNA sequence
ccaccccacagaggatgaaa

SEQ ID NO: 128966 - DNA, 20 bp, Artificial
  CRISPR gRNA sequence
ttaataacccagtgcccctg

SEQ ID NO: 128967 - DNA, 20 bp, Artificial
  CRISPR gRNA sequence
aataacccagtgcccctgga

SEQ ID NO: 128968 - DNA, 20 bp, Artificial
  CRISPR gRNA sequence
ataacccagtgcccctggaa

SEQ ID NO: 128969 - DNA, 20 bp, Artificial
  CRISPR gRNA sequence
gaaaatccattccaccatgc

SEQ ID NO: 128970 - DNA, 20 bp, Artificial
  CRISPR gRNA sequence
caccatgcatattttgtggg

SEQ ID NO: 128971 - DNA, 20 bp, Artificial
  CRISPR gRNA sequence
tgtgggcgacataagtacca

SEQ ID NO: 128972 - DNA, 20 bp, Artificial
  CRISPR gRNA sequence
gtgggcgacataagtaccac

SEQ ID NO: 128973 - DNA, 20 bp, Artificial
  CRISPR gRNA sequence
tgggcgacataagtaccact

SEQ ID NO: 128974 - DNA, 20 bp, Artificial
  CRISPR gRNA sequence
ctctgccctagcatttccat

SEQ ID NO: 128975 - DNA, 20 bp, Artificial
  CRISPR gRNA sequence
tctgccctagcatttccatg

SEQ ID NO: 128976 - DNA, 20 bp, Artificial
  CRISPR gRNA sequence
tgccctagcatttccatgaa

SEQ ID NO: 128977 - DNA, 20 bp, Artificial
  CRISPR gRNA sequence
ccctagcatttccatgaata

SEQ ID NO: 128978 - DNA, 20 bp, Artificial
  CRISPR gRNA sequence
gcatttccatgaataaagac

SEQ ID NO: 128979 - DNA, 20 bp, Artificial
  CRISPR gRNA sequence
ccatgaataaagacaccaga

SEQ ID NO: 128980 - DNA, 20 bp, Artificial
  CRISPR gRNA sequence
catgaataaagacaccagaa

SEQ ID NO: 128981 - DNA, 20 bp, Artificial
  CRISPR gRNA sequence
aaaaactgaattcacataag

SEQ ID NO: 128982 - DNA, 20 bp, Artificial
  CRISPR gRNA sequence
aattcacataaggcttggaa

SEQ ID NO: 128983 - DNA, 20 bp, Artificial
  CRISPR gRNA sequence
acataaggcttggaaaagag

SEQ ID NO: 128984 - DNA, 20 bp, Artificial
  CRISPR gRNA sequence
ggaaaagagagaaatgataa

SEQ ID NO: 128985 - DNA, 20 bp, Artificial
  CRISPR gRNA sequence
gaaaagagagaaatgataac

SEQ ID NO: 128986 - DNA, 20 bp, Artificial
  CRISPR gRNA sequence
tgacttttttattatttggg

SEQ ID NO: 128987 - DNA, 20 bp, Artificial
  CRISPR gRNA sequence
gacttttttattatttggga

SEQ ID NO: 128988 - DNA, 20 bp, Artificial
  CRISPR gRNA sequence
acttttttattatttgggat

SEQ ID NO: 128989 - DNA, 20 bp, Artificial
  CRISPR gRNA sequence
ttttattatttgggatacac

SEQ ID NO: 128990 - DNA, 20 bp, Artificial
  CRISPR gRNA sequence
tttattatttgggatacaca

SEQ ID NO: 128991 - DNA, 20 bp, Artificial
  CRISPR gRNA sequence
ttattatttgggatacacag

SEQ ID NO: 128992 - DNA, 20 bp, Artificial
  CRISPR gRNA sequence
tattatttgggatacacagt

SEQ ID NO: 128993 - DNA, 20 bp, Artificial
  CRISPR gRNA sequence
attatttgggatacacagtg

SEQ ID NO: 128994 - DNA, 20 bp, Artificial
  CRISPR gRNA sequence
ttatttgggatacacagtgt

SEQ ID NO: 128995 - DNA, 20 bp, Artificial
  CRISPR gRNA sequence
tttgggatacacagtgtcag

SEQ ID NO: 128996 - DNA, 20 bp, Artificial
  CRISPR gRNA sequence
gggatacacagtgtcagata

SEQ ID NO: 128997 - DNA, 20 bp, Artificial
  CRISPR gRNA sequence
ggatacacagtgtcagatac

SEQ ID NO: 128998 - DNA, 20 bp, Artificial
  CRISPR gRNA sequence
tgagtttactaaaaagcctg

SEQ ID NO: 128999 - DNA, 20 bp, Artificial
  CRISPR gRNA sequence
gagtttactaaaaagcctgc

SEQ ID NO: 129000 - DNA, 20 bp, Artificial
  CRISPR gRNA sequence
agtttactaaaaagcctgcc

SEQ ID NO: 129001 - DNA, 20 bp, Artificial
  CRISPR gRNA sequence
actaaaaagcctgcctaaag

SEQ ID NO: 129002 - DNA, 20 bp, Artificial
  CRISPR gRNA sequence
ctaaaaagcctgcctaaaga

SEQ ID NO: 129003 - DNA, 20 bp, Artificial
  CRISPR gRNA sequence
aaaagcctgcctaaagaagc

SEQ ID NO: 129004 - DNA, 20 bp, Artificial
  CRISPR gRNA sequence
cctaaagaagcacacatctg

SEQ ID NO: 129005 - DNA, 20 bp, Artificial
  CRISPR gRNA sequence
aagaagcacacatctgccac

SEQ ID NO: 129006 - DNA, 20 bp, Artificial
  CRISPR gRNA sequence
ccacttcattataaaaacaa

SEQ ID NO: 129007 - DNA, 20 bp, Artificial
  CRISPR gRNA sequence
cattataaaaacaatttttc

SEQ ID NO: 129008 - DNA, 20 bp, Artificial
  CRISPR gRNA sequence
attataaaaacaatttttcc

SEQ ID NO: 129009 - DNA, 20 bp, Artificial
  CRISPR gRNA sequence
taaaaacaatttttccctta

SEQ ID NO: 129010 - DNA, 20 bp, Artificial
  CRISPR gRNA sequence
ttcccttaagggtctggggt

SEQ ID NO: 129011 - DNA, 20 bp, Artificial
  CRISPR gRNA sequence
tcccttaagggtctggggtc

SEQ ID NO: 129012 - DNA, 20 bp, Artificial
  CRISPR gRNA sequence
cccttaagggtctggggtct

SEQ ID NO: 129013 - DNA, 20 bp, Artificial
  CRISPR gRNA sequence
ccttaagggtctggggtcta

SEQ ID NO: 129014 - DNA, 20 bp, Artificial
  CRISPR gRNA sequence
aagggtctggggtctaaaaa

SEQ ID NO: 129015 - DNA, 20 bp, Artificial
  CRISPR gRNA sequence
agggtctggggtctaaaaat

SEQ ID NO: 129016 - DNA, 20 bp, Artificial
  CRISPR gRNA sequence
gggtctaaaaatgaaactcc

SEQ ID NO: 129017 - DNA, 20 bp, Artificial
  CRISPR gRNA sequence
aaaatgaaactccaatggat

SEQ ID NO: 129018 - DNA, 20 bp, Artificial
  CRISPR gRNA sequence
caatggattaatcaagcaat

SEQ ID NO: 129019 - DNA, 20 bp, Artificial
  CRISPR gRNA sequence
atcaagcaattgcaaagcca

SEQ ID NO: 129020 - DNA, 20 bp, Artificial
  CRISPR gRNA sequence
caaagccacttgtaacagca

SEQ ID NO: 129021 - DNA, 20 bp, Artificial
  CRISPR gRNA sequence
gtaacagcaataccactcaa

SEQ ID NO: 129022 - DNA, 20 bp, Artificial
  CRISPR gRNA sequence
taacagcaataccactcaaa

SEQ ID NO: 129023 - DNA, 20 bp, Artificial
  CRISPR gRNA sequence
aaactccctgccgaaacaca

SEQ ID NO: 129024 - DNA, 20 bp, Artificial
  CRISPR gRNA sequence
cctgccgaaacacactgtct

SEQ ID NO: 129025 - DNA, 20 bp, Artificial
  CRISPR gRNA sequence
ccgaaacacactgtctttca

SEQ ID NO: 129026 - DNA, 20 bp, Artificial
  CRISPR gRNA sequence
tctttcaccgccatgcctat

SEQ ID NO: 129027 - DNA, 20 bp, Artificial
  CRISPR gRNA sequence
tcaccgccatgcctattttc

SEQ ID NO: 129028 - DNA, 20 bp, Artificial
  CRISPR gRNA sequence
caccgccatgcctattttcc

SEQ ID NO: 129029 - DNA, 20 bp, Artificial
  CRISPR gRNA sequence
accgccatgcctattttcca

SEQ ID NO: 129030 - DNA, 20 bp, Artificial
  CRISPR gRNA sequence
ttttccatactggagaaagt

SEQ ID NO: 129031 - DNA, 20 bp, Artificial
  CRISPR gRNA sequence
tccatactggagaaagtaaa

SEQ ID NO: 129032 - DNA, 20 bp, Artificial
  CRISPR gRNA sequence
ccatactggagaaagtaaac

SEQ ID NO: 129033 - DNA, 20 bp, Artificial
  CRISPR gRNA sequence
catactggagaaagtaaaca

SEQ ID NO: 129034 - DNA, 20 bp, Artificial
  CRISPR gRNA sequence
gagaaagtaaacaagaactg

SEQ ID NO: 129035 - DNA, 20 bp, Artificial
  CRISPR gRNA sequence
cataaatgcagtcaagcaag

SEQ ID NO: 129036 - DNA, 20 bp, Artificial
  CRISPR gRNA sequence
agattctctagtagccatat

SEQ ID NO: 129037 - DNA, 20 bp, Artificial
  CRISPR gRNA sequence
gattctctagtagccatata

SEQ ID NO: 129038 - DNA, 20 bp, Artificial
  CRISPR gRNA sequence
tctagtagccatataaaata

SEQ ID NO: 129039 - DNA, 20 bp, Artificial
  CRISPR gRNA sequence
tagtagccatataaaataaa

SEQ ID NO: 129040 - DNA, 20 bp, Artificial
  CRISPR gRNA sequence
gtagccatataaaataaaat

SEQ ID NO: 129041 - DNA, 20 bp, Artificial
  CRISPR gRNA sequence
attttaatatatttaattta

SEQ ID NO: 129042 - DNA, 20 bp, Artificial
  CRISPR gRNA sequence
taatatatttaatttaaccc

SEQ ID NO: 129043 - DNA, 20 bp, Artificial
  CRISPR gRNA sequence
aatatatttaatttaaccca

SEQ ID NO: 129044 - DNA, 20 bp, Artificial
  CRISPR gRNA sequence
atatatttaatttaacccaa

SEQ ID NO: 129045 - DNA, 20 bp, Artificial
  CRISPR gRNA sequence
aatttaacccaatatagcca

SEQ ID NO: 129046 - DNA, 20 bp, Artificial
  CRISPR gRNA sequence
atttaacccaatatagccaa

SEQ ID NO: 129047 - DNA, 20 bp, Artificial
  CRISPR gRNA sequence
aacccaatatagccaaattc

SEQ ID NO: 129048 - DNA, 20 bp, Artificial
  CRISPR gRNA sequence
acccaatatagccaaattct

SEQ ID NO: 129049 - DNA, 20 bp, Artificial
  CRISPR gRNA sequence
ttaccatttaaacatagaat

SEQ ID NO: 129050 - DNA, 20 bp, Artificial
  CRISPR gRNA sequence
accatttaaacatagaatca

SEQ ID NO: 129051 - DNA, 20 bp, Artificial
  CRISPR gRNA sequence
ccatttaaacatagaatcaa

SEQ ID NO: 129052 - DNA, 20 bp, Artificial
  CRISPR gRNA sequence
aaacatagaatcaattttta

SEQ ID NO: 129053 - DNA, 20 bp, Artificial
  CRISPR gRNA sequence
aacatagaatcaatttttaa

SEQ ID NO: 129054 - DNA, 20 bp, Artificial
  CRISPR gRNA sequence
ttaaatgagaaattttaatt

SEQ ID NO: 129055 - DNA, 20 bp, Artificial
  CRISPR gRNA sequence
taaatgagaaattttaattc

SEQ ID NO: 129056 - DNA, 20 bp, Artificial
  CRISPR gRNA sequence
aaatgagaaattttaattct

SEQ ID NO: 129057 - DNA, 20 bp, Artificial
  CRISPR gRNA sequence
aatgagaaattttaattctt

SEQ ID NO: 129058 - DNA, 20 bp, Artificial
  CRISPR gRNA sequence
taattcttttcttcatacta

SEQ ID NO: 129059 - DNA, 20 bp, Artificial
  CRISPR gRNA sequence
aattcttttcttcatactaa

SEQ ID NO: 129060 - DNA, 20 bp, Artificial
  CRISPR gRNA sequence
attcttttcttcatactaag

SEQ ID NO: 129061 - DNA, 20 bp, Artificial
  CRISPR gRNA sequence
ttttcttcatactaagtctt

SEQ ID NO: 129062 - DNA, 20 bp, Artificial
  CRISPR gRNA sequence
ttcttcatactaagtcttca

SEQ ID NO: 129063 - DNA, 20 bp, Artificial
  CRISPR gRNA sequence
tcttcatactaagtcttcaa

SEQ ID NO: 129064 - DNA, 20 bp, Artificial
  CRISPR gRNA sequence
cttcatactaagtcttcaaa

SEQ ID NO: 129065 - DNA, 20 bp, Artificial
  CRISPR gRNA sequence
ttcatactaagtcttcaaaa

SEQ ID NO: 129066 - DNA, 20 bp, Artificial
  CRISPR gRNA sequence
catactaagtcttcaaaatc

SEQ ID NO: 129067 - DNA, 20 bp, Artificial
  CRISPR gRNA sequence
atactaagtcttcaaaatct

SEQ ID NO: 129068 - DNA, 20 bp, Artificial
  CRISPR gRNA sequence
agtcttcaaaatctggtgtt

SEQ ID NO: 129069 - DNA, 20 bp, Artificial
  CRISPR gRNA sequence
caaaatctggtgtttcaaat

SEQ ID NO: 129070 - DNA, 20 bp, Artificial
  CRISPR gRNA sequence
aaaatctggtgtttcaaatt

SEQ ID NO: 129071 - DNA, 20 bp, Artificial
  CRISPR gRNA sequence
gtgtttcaaatttacaacac

SEQ ID NO: 129072 - DNA, 20 bp, Artificial
  CRISPR gRNA sequence
caaatttacaacacatctcc

SEQ ID NO: 129073 - DNA, 20 bp, Artificial
  CRISPR gRNA sequence
aaatttacaacacatctcca

SEQ ID NO: 129074 - DNA, 20 bp, Artificial
  CRISPR gRNA sequence
acaacacatctccattcaga

SEQ ID NO: 129075 - DNA, 20 bp, Artificial
  CRISPR gRNA sequence
caacacatctccattcagac

SEQ ID NO: 129076 - DNA, 20 bp, Artificial
  CRISPR gRNA sequence
cattcagaccagccacattt

SEQ ID NO: 129077 - DNA, 20 bp, Artificial
  CRISPR gRNA sequence
agaccagccacatttcaggt

SEQ ID NO: 129078 - DNA, 20 bp, Artificial
  CRISPR gRNA sequence
caggtgctcctgagcacatg

SEQ ID NO: 129079 - DNA, 20 bp, Artificial
  CRISPR gRNA sequence
aggtgctcctgagcacatgg

SEQ ID NO: 129080 - DNA, 20 bp, Artificial
  CRISPR gRNA sequence
ctgagcacatggcttgtggc

SEQ ID NO: 129081 - DNA, 20 bp, Artificial
  CRISPR gRNA sequence
agcacatggcttgtggctat

SEQ ID NO: 129082 - DNA, 20 bp, Artificial
  CRISPR gRNA sequence
gtggctatggtactgaccag

SEQ ID NO: 129083 - DNA, 20 bp, Artificial
  CRISPR gRNA sequence
tggctatggtactgaccagc

SEQ ID NO: 129084 - DNA, 20 bp, Artificial
  CRISPR gRNA sequence
tggtactgaccagcggcata

SEQ ID NO: 129085 - DNA, 20 bp, Artificial
  CRISPR gRNA sequence
accagcggcatagctggtca

SEQ ID NO: 129086 - DNA, 20 bp, Artificial
  CRISPR gRNA sequence
gtcatacatagcctatgtaa

SEQ ID NO: 129087 - DNA, 20 bp, Artificial
  CRISPR gRNA sequence
tgtaagcaataatcagcatt

SEQ ID NO: 129088 - DNA, 20 bp, Artificial
  CRISPR gRNA sequence
gtgcttttttttccttaaaa

SEQ ID NO: 129089 - DNA, 20 bp, Artificial
  CRISPR gRNA sequence
tgcttttttttccttaaaac

SEQ ID NO: 129090 - DNA, 20 bp, Artificial
  CRISPR gRNA sequence
ttttttccttaaaacataag

SEQ ID NO: 129091 - DNA, 20 bp, Artificial
  CRISPR gRNA sequence
tttttccttaaaacataagg

SEQ ID NO: 129092 - DNA, 20 bp, Artificial
  CRISPR gRNA sequence
ttttccttaaaacataagga

SEQ ID NO: 129093 - DNA, 20 bp, Artificial
  CRISPR gRNA sequence
tttccttaaaacataaggac

SEQ ID NO: 129094 - DNA, 20 bp, Artificial
  CRISPR gRNA sequence
ttccttaaaacataaggaca

SEQ ID NO: 129095 - DNA, 20 bp, Artificial
  CRISPR gRNA sequence
tccttaaaacataaggacaa

SEQ ID NO: 129096 - DNA, 20 bp, Artificial
  CRISPR gRNA sequence
ccttaaaacataaggacaaa

SEQ ID NO: 129097 - DNA, 20 bp, Artificial
  CRISPR gRNA sequence
cttaaaacataaggacaaaa

SEQ ID NO: 129098 - DNA, 20 bp, Artificial
  CRISPR gRNA sequence
aaaacataaggacaaaattc

SEQ ID NO: 129099 - DNA, 20 bp, Artificial
  CRISPR gRNA sequence
aaacataaggacaaaattct

SEQ ID NO: 129100 - DNA, 20 bp, Artificial
  CRISPR gRNA sequence
tcaaactgtaagttctaagc

SEQ ID NO: 129101 - DNA, 20 bp, Artificial
  CRISPR gRNA sequence
aaactgtaagttctaagctt

SEQ ID NO: 129102 - DNA, 20 bp, Artificial
  CRISPR gRNA sequence
taagttctaagcttagtgat

SEQ ID NO: 129103 - DNA, 20 bp, Artificial
  CRISPR gRNA sequence
taagcttagtgatgtatttt

SEQ ID NO: 129104 - DNA, 20 bp, Artificial
  CRISPR gRNA sequence
agcttagtgatgtattttaa

SEQ ID NO: 129105 - DNA, 20 bp, Artificial
  CRISPR gRNA sequence
agtgatgtattttaatagca

SEQ ID NO: 129106 - DNA, 20 bp, Artificial
  CRISPR gRNA sequence
gtgatgtattttaatagcat

SEQ ID NO: 129107 - DNA, 20 bp, Artificial
  CRISPR gRNA sequence
taatagcatatttatttgta

SEQ ID NO: 129108 - DNA, 20 bp, Artificial
  CRISPR gRNA sequence
aatagcatatttatttgtaa

SEQ ID NO: 129109 - DNA, 20 bp, Artificial
  CRISPR gRNA sequence
atagcatatttatttgtaag

SEQ ID NO: 129110 - DNA, 20 bp, Artificial
  CRISPR gRNA sequence
atttgtaagctttattactt

SEQ ID NO: 129111 - DNA, 20 bp, Artificial
  CRISPR gRNA sequence
tttgtaagctttattacttc

SEQ ID NO: 129112 - DNA, 20 bp, Artificial
  CRISPR gRNA sequence
gtaagctttattacttccat

SEQ ID NO: 129113 - DNA, 20 bp, Artificial
  CRISPR gRNA sequence
taagctttattacttccata

SEQ ID NO: 129114 - DNA, 20 bp, Artificial
  CRISPR gRNA sequence
tattacttccataagtcttt

SEQ ID NO: 129115 - DNA, 20 bp, Artificial
  CRISPR gRNA sequence
attacttccataagtctttt

SEQ ID NO: 129116 - DNA, 20 bp, Artificial
  CRISPR gRNA sequence
ttacttccataagtcttttt

SEQ ID NO: 129117 - DNA, 20 bp, Artificial
  CRISPR gRNA sequence
cttccataagtctttttaaa

SEQ ID NO: 129118 - DNA, 20 bp, Artificial
  CRISPR gRNA sequence
ccataagtctttttaaacta

SEQ ID NO: 129119 - DNA, 20 bp, Artificial
  CRISPR gRNA sequence
cataagtctttttaaactat

SEQ ID NO: 129120 - DNA, 20 bp, Artificial
  CRISPR gRNA sequence
tttaaactataaaatgacag

SEQ ID NO: 129121 - DNA, 20 bp, Artificial
  CRISPR gRNA sequence
ttaaactataaaatgacaga

SEQ ID NO: 129122 - DNA, 20 bp, Artificial
  CRISPR gRNA sequence
taaactataaaatgacagaa

SEQ ID NO: 129123 - DNA, 20 bp, Artificial
  CRISPR gRNA sequence
aaactataaaatgacagaaa

SEQ ID NO: 129124 - DNA, 20 bp, Artificial
  CRISPR gRNA sequence
aactataaaatgacagaaaa

SEQ ID NO: 129125 - DNA, 20 bp, Artificial
  CRISPR gRNA sequence
taaaatgacagaaaaattac

SEQ ID NO: 129126 - DNA, 20 bp, Artificial
  CRISPR gRNA sequence
ccaatagaaaatgatataaa

SEQ ID NO: 129127 - DNA, 20 bp, Artificial
  CRISPR gRNA sequence
taattcagaccaagtgatga

SEQ ID NO: 129128 - DNA, 20 bp, Artificial
  CRISPR gRNA sequence
aattcagaccaagtgatgag

SEQ ID NO: 129129 - DNA, 20 bp, Artificial
  CRISPR gRNA sequence
attcagaccaagtgatgagc

SEQ ID NO: 129130 - DNA, 20 bp, Artificial
  CRISPR gRNA sequence
agaccaagtgatgagcaatg

SEQ ID NO: 129131 - DNA, 20 bp, Artificial
  CRISPR gRNA sequence
taaaagttctaagaagacaa

SEQ ID NO: 129132 - DNA, 20 bp, Artificial
  CRISPR gRNA sequence
aaaagttctaagaagacaaa

SEQ ID NO: 129133 - DNA, 20 bp, Artificial
  CRISPR gRNA sequence
aaagttctaagaagacaaaa

SEQ ID NO: 129134 - DNA, 20 bp, Artificial
  CRISPR gRNA sequence
taagaagacaaaactactta

SEQ ID NO: 129135 - DNA, 20 bp, Artificial
  CRISPR gRNA sequence
agaagacaaaactacttaag

SEQ ID NO: 129136 - DNA, 20 bp, Artificial
  CRISPR gRNA sequence
cttaagaaaaaaaaatatca

SEQ ID NO: 129137 - DNA, 20 bp, Artificial
  CRISPR gRNA sequence
aagaaaaaaaaatatcaatt

SEQ ID NO: 129138 - DNA, 20 bp, Artificial
  CRISPR gRNA sequence
agaaaaaaaaatatcaattt

SEQ ID NO: 129139 - DNA, 20 bp, Artificial
  CRISPR gRNA sequence
aaatgtatcttagtatctat

SEQ ID NO: 129140 - DNA, 20 bp, Artificial
  CRISPR gRNA sequence
aatgtatcttagtatctata

SEQ ID NO: 129141 - DNA, 20 bp, Artificial
  CRISPR gRNA sequence
agtatctataattatgtaaa

SEQ ID NO: 129142 - DNA, 20 bp, Artificial
  CRISPR gRNA sequence
gtatctataattatgtaaaa

SEQ ID NO: 129143 - DNA, 20 bp, Artificial
  CRISPR gRNA sequence
taattatgtaaaaatagctg

SEQ ID NO: 129144 - DNA, 20 bp, Artificial
  CRISPR gRNA sequence
tgtaaaaatagctgtttcca

SEQ ID NO: 129145 - DNA, 20 bp, Artificial
  CRISPR gRNA sequence
tttccaaataccaggatttg

SEQ ID NO: 129146 - DNA, 20 bp, Artificial
  CRISPR gRNA sequence
ccaaataccaggatttgttt

SEQ ID NO: 129147 - DNA, 20 bp, Artificial
  CRISPR gRNA sequence
caaataccaggatttgtttt

SEQ ID NO: 129148 - DNA, 20 bp, Artificial
  CRISPR gRNA sequence
gttttggaaaattcttatta

SEQ ID NO: 129149 - DNA, 20 bp, Artificial
  CRISPR gRNA sequence
ttttggaaaattcttattac

SEQ ID NO: 129150 - DNA, 20 bp, Artificial
  CRISPR gRNA sequence
tggaaaattcttattacacc

SEQ ID NO: 129151 - DNA, 20 bp, Artificial
  CRISPR gRNA sequence
ggaaaattcttattacacct

SEQ ID NO: 129152 - DNA, 20 bp, Artificial
  CRISPR gRNA sequence
gaaaattcttattacaccta

SEQ ID NO: 129153 - DNA, 20 bp, Artificial
  CRISPR gRNA sequence
ttattacacctatatcagac

SEQ ID NO: 129154 - DNA, 20 bp, Artificial
  CRISPR gRNA sequence
attacacctatatcagacca

SEQ ID NO: 129155 - DNA, 20 bp, Artificial
  CRISPR gRNA sequence
ttacacctatatcagaccaa

SEQ ID NO: 129156 - DNA, 20 bp, Artificial
  CRISPR gRNA sequence
cacctatatcagaccaatac

SEQ ID NO: 129157 - DNA, 20 bp, Artificial
  CRISPR gRNA sequence
tatcagaccaatacgaccta

SEQ ID NO: 129158 - DNA, 20 bp, Artificial
  CRISPR gRNA sequence
aatttactgcaacattatag

SEQ ID NO: 129159 - DNA, 20 bp, Artificial
  CRISPR gRNA sequence
actgcaacattatagaagtt

SEQ ID NO: 129160 - DNA, 20 bp, Artificial
  CRISPR gRNA sequence
ctgcaacattatagaagtta

SEQ ID NO: 129161 - DNA, 20 bp, Artificial
  CRISPR gRNA sequence
caacattatagaagttacag

SEQ ID NO: 129162 - DNA, 20 bp, Artificial
  CRISPR gRNA sequence
tagaagttacagcttcagtc

SEQ ID NO: 129163 - DNA, 20 bp, Artificial
  CRISPR gRNA sequence
cagcttcagtctacggccat

SEQ ID NO: 129164 - DNA, 20 bp, Artificial
  CRISPR gRNA sequence
cagtctacggccataccacc

SEQ ID NO: 129165 - DNA, 20 bp, Artificial
  CRISPR gRNA sequence
agtctacggccataccaccc

SEQ ID NO: 129166 - DNA, 20 bp, Artificial
  CRISPR gRNA sequence
cggccataccaccctgaacg

SEQ ID NO: 129167 - DNA, 20 bp, Artificial
  CRISPR gRNA sequence
aacgcgcccgatctcgtctg

SEQ ID NO: 129168 - DNA, 20 bp, Artificial
  CRISPR gRNA sequence
gtctgatctcggaagctaag

SEQ ID NO: 129169 - DNA, 20 bp, Artificial
  CRISPR gRNA sequence
atctcggaagctaagcaggg

SEQ ID NO: 129170 - DNA, 20 bp, Artificial
  CRISPR gRNA sequence
ggaagctaagcagggtcggg

SEQ ID NO: 129171 - DNA, 20 bp, Artificial
  CRISPR gRNA sequence
agcagggtcgggcctggtta

SEQ ID NO: 129172 - DNA, 20 bp, Artificial
  CRISPR gRNA sequence
gttagtacttggatgggaga

SEQ ID NO: 129173 - DNA, 20 bp, Artificial
  CRISPR gRNA sequence
gtacttggatgggagaagtt

SEQ ID NO: 129174 - DNA, 20 bp, Artificial
  CRISPR gRNA sequence
ggatgggagaagttacagct

SEQ ID NO: 129175 - DNA, 20 bp, Artificial
  CRISPR gRNA sequence
gatgggagaagttacagctt

SEQ ID NO: 129176 - DNA, 20 bp, Artificial
  CRISPR gRNA sequence
cagcttcaggccgggcacag

SEQ ID NO: 129177 - DNA, 20 bp, Artificial
  CRISPR gRNA sequence
caggccgggcacagtggctc

SEQ ID NO: 129178 - DNA, 20 bp, Artificial
  CRISPR gRNA sequence
aggccgggcacagtggctcg

SEQ ID NO: 129179 - DNA, 20 bp, Artificial
  CRISPR gRNA sequence
gtgcctgtaatcccagctac

SEQ ID NO: 129180 - DNA, 20 bp, Artificial
  CRISPR gRNA sequence
taatcccagctaccagggga

SEQ ID NO: 129181 - DNA, 20 bp, Artificial
  CRISPR gRNA sequence
ccaggggaggctgaggcagg

SEQ ID NO: 129182 - DNA, 20 bp, Artificial
  CRISPR gRNA sequence
aggcaggagaatcgcttgaa

SEQ ID NO: 129183 - DNA, 20 bp, Artificial
  CRISPR gRNA sequence
gaacctgggaggtggaggtt

SEQ ID NO: 129184 - DNA, 20 bp, Artificial
  CRISPR gRNA sequence
aacctgggaggtggaggttg

SEQ ID NO: 129185 - DNA, 20 bp, Artificial
  CRISPR gRNA sequence
ggaggtggaggttgcaatga

SEQ ID NO: 129186 - DNA, 20 bp, Artificial
  CRISPR gRNA sequence
caatgagccgagatcacgcc

SEQ ID NO: 129187 - DNA, 20 bp, Artificial
  CRISPR gRNA sequence
cactccagcctgggcaacaa

SEQ ID NO: 129188 - DNA, 20 bp, Artificial
  CRISPR gRNA sequence
cagcctgggcaacaagagcg

SEQ ID NO: 129189 - DNA, 20 bp, Artificial
  CRISPR gRNA sequence
ggcaacaagagcgaaactcc

SEQ ID NO: 129190 - DNA, 20 bp, Artificial
  CRISPR gRNA sequence
cgtctcaaaaaaaaaaaaaa

SEQ ID NO: 129191 - DNA, 20 bp, Artificial
  CRISPR gRNA sequence
aaaaaaaaaaaaaaaagtta

SEQ ID NO: 129192 - DNA, 20 bp, Artificial
  CRISPR gRNA sequence
cagcttcatacacccaaacc

SEQ ID NO: 129193 - DNA, 20 bp, Artificial
  CRISPR gRNA sequence
catacacccaaacctgatag

SEQ ID NO: 129194 - DNA, 20 bp, Artificial
  CRISPR gRNA sequence
atacacccaaacctgatagt

SEQ ID NO: 129195 - DNA, 20 bp, Artificial
  CRISPR gRNA sequence
atagttctgacaacgtacct

SEQ ID NO: 129196 - DNA, 20 bp, Artificial
  CRISPR gRNA sequence
tgacaacgtacctatttttt

SEQ ID NO: 129197 - DNA, 20 bp, Artificial
  CRISPR gRNA sequence
acaacgtacctattttttaa

SEQ ID NO: 129198 - DNA, 20 bp, Artificial
  CRISPR gRNA sequence
ttttttaaaacagtcgggcc

SEQ ID NO: 129199 - DNA, 20 bp, Artificial
  CRISPR gRNA sequence
tttaaaacagtcgggccagg

SEQ ID NO: 129200 - DNA, 20 bp, Artificial
  CRISPR gRNA sequence
ttaaaacagtcgggccaggc

SEQ ID NO: 129201 - DNA, 20 bp, Artificial
  CRISPR gRNA sequence
taaaacagtcgggccaggca

SEQ ID NO: 129202 - DNA, 20 bp, Artificial
  CRISPR gRNA sequence
aaaacagtcgggccaggcac

SEQ ID NO: 129203 - DNA, 20 bp, Artificial
  CRISPR gRNA sequence
aaacagtcgggccaggcaca

SEQ ID NO: 129204 - DNA, 20 bp, Artificial
  CRISPR gRNA sequence
atgtctataatcccagcact

SEQ ID NO: 129205 - DNA, 20 bp, Artificial
  CRISPR gRNA sequence
taatcccagcactttggtag

SEQ ID NO: 129206 - DNA, 20 bp, Artificial
  CRISPR gRNA sequence
tggtaggccaaggcggatgg

SEQ ID NO: 129207 - DNA, 20 bp, Artificial
  CRISPR gRNA sequence
ggtaggccaaggcggatgga

SEQ ID NO: 129208 - DNA, 20 bp, Artificial
  CRISPR gRNA sequence
gtaggccaaggcggatggat

SEQ ID NO: 129209 - DNA, 20 bp, Artificial
  CRISPR gRNA sequence
aggtcgagagttcaagacca

SEQ ID NO: 129210 - DNA, 20 bp, Artificial
  CRISPR gRNA sequence
aagaccagcctgaccaacat

SEQ ID NO: 129211 - DNA, 20 bp, Artificial
  CRISPR gRNA sequence
accaacatggagaaacccca

SEQ ID NO: 129212 - DNA, 20 bp, Artificial
  CRISPR gRNA sequence
ctaccaaaaatacaaaatta

SEQ ID NO: 129213 - DNA, 20 bp, Artificial
  CRISPR gRNA sequence
taccaaaaatacaaaattag

SEQ ID NO: 129214 - DNA, 20 bp, Artificial
  CRISPR gRNA sequence
ccaaaaatacaaaattagct

SEQ ID NO: 129215 - DNA, 20 bp, Artificial
  CRISPR gRNA sequence
gctgggcatggtggtgcacg

SEQ ID NO: 129216 - DNA, 20 bp, Artificial
  CRISPR gRNA sequence
ggcatggtggtgcacgcctg

SEQ ID NO: 129217 - DNA, 20 bp, Artificial
  CRISPR gRNA sequence
taatcccagctactcgggag

SEQ ID NO: 129218 - DNA, 20 bp, Artificial
  CRISPR gRNA sequence
ctcgggaggctgaggcagga

SEQ ID NO: 129219 - DNA, 20 bp, Artificial
  CRISPR gRNA sequence
gggaggctgaggcaggagaa

SEQ ID NO: 129220 - DNA, 20 bp, Artificial
  CRISPR gRNA sequence
aggcaggagaattgcttgaa

SEQ ID NO: 129221 - DNA, 20 bp, Artificial
  CRISPR gRNA sequence
cttgaacctgggaggcggag

SEQ ID NO: 129222 - DNA, 20 bp, Artificial
  CRISPR gRNA sequence
gaacctgggaggcggaggtt

SEQ ID NO: 129223 - DNA, 20 bp, Artificial
  CRISPR gRNA sequence
aacctgggaggcggaggttg

SEQ ID NO: 129224 - DNA, 20 bp, Artificial
  CRISPR gRNA sequence
ggaggcggaggttgcagtga

SEQ ID NO: 129225 - DNA, 20 bp, Artificial
  CRISPR gRNA sequence
cagtgagcggagattgtacc

SEQ ID NO: 129226 - DNA, 20 bp, Artificial
  CRISPR gRNA sequence
taccattgcactccagcctg

SEQ ID NO: 129227 - DNA, 20 bp, Artificial
  CRISPR gRNA sequence
cactccagcctggccaataa

SEQ ID NO: 129228 - DNA, 20 bp, Artificial
  CRISPR gRNA sequence
cagcctggccaataagagtg

SEQ ID NO: 129229 - DNA, 20 bp, Artificial
  CRISPR gRNA sequence
gccaataagagtgaaactct

SEQ ID NO: 129230 - DNA, 20 bp, Artificial
  CRISPR gRNA sequence
tgtccccaaaaaaaaaaaaa

SEQ ID NO: 129231 - DNA, 20 bp, Artificial
  CRISPR gRNA sequence
tccccaaaaaaaaaaaaaaa

SEQ ID NO: 129232 - DNA, 20 bp, Artificial
  CRISPR gRNA sequence
aattctattttatctgcctc

SEQ ID NO: 129233 - DNA, 20 bp, Artificial
  CRISPR gRNA sequence
tattttatctgcctccaata

SEQ ID NO: 129234 - DNA, 20 bp, Artificial
  CRISPR gRNA sequence
ttttatctgcctccaataag

SEQ ID NO: 129235 - DNA, 20 bp, Artificial
  CRISPR gRNA sequence
tatctgcctccaataagtgg

SEQ ID NO: 129236 - DNA, 20 bp, Artificial
  CRISPR gRNA sequence
atctgcctccaataagtggg

SEQ ID NO: 129237 - DNA, 20 bp, Artificial
  CRISPR gRNA sequence
tctgcctccaataagtggga

SEQ ID NO: 129238 - DNA, 20 bp, Artificial
  CRISPR gRNA sequence
cctccaataagtgggagaga

SEQ ID NO: 129239 - DNA, 20 bp, Artificial
  CRISPR gRNA sequence
caataagtgggagagaggag

SEQ ID NO: 129240 - DNA, 20 bp, Artificial
  CRISPR gRNA sequence
agggacatgacagaattgaa

SEQ ID NO: 129241 - DNA, 20 bp, Artificial
  CRISPR gRNA sequence
gggacatgacagaattgaaa

SEQ ID NO: 129242 - DNA, 20 bp, Artificial
  CRISPR gRNA sequence
aaaatgggacactgttcagt

SEQ ID NO: 129243 - DNA, 20 bp, Artificial
  CRISPR gRNA sequence
ttcagtaactgtgtatgtag

SEQ ID NO: 129244 - DNA, 20 bp, Artificial
  CRISPR gRNA sequence
agtaactgtgtatgtagaca

SEQ ID NO: 129245 - DNA, 20 bp, Artificial
  CRISPR gRNA sequence
tgtatgtagacatgaaagaa

SEQ ID NO: 129246 - DNA, 20 bp, Artificial
  CRISPR gRNA sequence
gatttgctgaaagcctgaat

SEQ ID NO: 129247 - DNA, 20 bp, Artificial
  CRISPR gRNA sequence
atttgctgaaagcctgaatg

SEQ ID NO: 129248 - DNA, 20 bp, Artificial
  CRISPR gRNA sequence
gctgaaagcctgaatgattg

SEQ ID NO: 129249 - DNA, 20 bp, Artificial
  CRISPR gRNA sequence
ctgaaagcctgaatgattga

SEQ ID NO: 129250 - DNA, 20 bp, Artificial
  CRISPR gRNA sequence
aaagcctgaatgattgaaat

SEQ ID NO: 129251 - DNA, 20 bp, Artificial
  CRISPR gRNA sequence
aatgattgaaatcaacagct

SEQ ID NO: 129252 - DNA, 20 bp, Artificial
  CRISPR gRNA sequence
aaatcaacagctaactgtac

SEQ ID NO: 129253 - DNA, 20 bp, Artificial
  CRISPR gRNA sequence
actgtacccatgacctatga

SEQ ID NO: 129254 - DNA, 20 bp, Artificial
  CRISPR gRNA sequence
tacccatgacctatgaattc

SEQ ID NO: 129255 - DNA, 20 bp, Artificial
  CRISPR gRNA sequence
tgaattcatgtagtttcgtg

SEQ ID NO: 129256 - DNA, 20 bp, Artificial
  CRISPR gRNA sequence
atgtagtttcgtgtttccct

SEQ ID NO: 129257 - DNA, 20 bp, Artificial
  CRISPR gRNA sequence
cgtgtttcccttgaaaaaac

SEQ ID NO: 129258 - DNA, 20 bp, Artificial
  CRISPR gRNA sequence
gtgtttcccttgaaaaaacc

SEQ ID NO: 129259 - DNA, 20 bp, Artificial
  CRISPR gRNA sequence
cccttgaaaaaacctagtta

SEQ ID NO: 129260 - DNA, 20 bp, Artificial
  CRISPR gRNA sequence
ccttgaaaaaacctagttaa

SEQ ID NO: 129261 - DNA, 20 bp, Artificial
  CRISPR gRNA sequence
gaaaaaacctagttaaattt

SEQ ID NO: 129262 - DNA, 20 bp, Artificial
  CRISPR gRNA sequence
aaaaaacctagttaaatttc

SEQ ID NO: 129263 - DNA, 20 bp, Artificial
  CRISPR gRNA sequence
gttaaatttctcctctacgt

SEQ ID NO: 129264 - DNA, 20 bp, Artificial
  CRISPR gRNA sequence
aatttctcctctacgttacc

SEQ ID NO: 129265 - DNA, 20 bp, Artificial
  CRISPR gRNA sequence
ctcctctacgttacctttcc

SEQ ID NO: 129266 - DNA, 20 bp, Artificial
  CRISPR gRNA sequence
tcctctacgttacctttccc

SEQ ID NO: 129267 - DNA, 20 bp, Artificial
  CRISPR gRNA sequence
ctctacgttacctttcccgt

SEQ ID NO: 129268 - DNA, 20 bp, Artificial
  CRISPR gRNA sequence
tacgttacctttcccgtttg

SEQ ID NO: 129269 - DNA, 20 bp, Artificial
  CRISPR gRNA sequence
cgttacctttcccgtttgag

SEQ ID NO: 129270 - DNA, 20 bp, Artificial
  CRISPR gRNA sequence
cctttcccgtttgaggtatg

SEQ ID NO: 129271 - DNA, 20 bp, Artificial
  CRISPR gRNA sequence
tcccgtttgaggtatggcat

SEQ ID NO: 129272 - DNA, 20 bp, Artificial
  CRISPR gRNA sequence
cccgtttgaggtatggcatt

SEQ ID NO: 129273 - DNA, 20 bp, Artificial
  CRISPR gRNA sequence
ccgtttgaggtatggcattt

SEQ ID NO: 129274 - DNA, 20 bp, Artificial
  CRISPR gRNA sequence
gaggtatggcatttttcatt

SEQ ID NO: 129275 - DNA, 20 bp, Artificial
  CRISPR gRNA sequence
aggtatggcatttttcatta

SEQ ID NO: 129276 - DNA, 20 bp, Artificial
  CRISPR gRNA sequence
ttcattatcctagccacgtt

SEQ ID NO: 129277 - DNA, 20 bp, Artificial
  CRISPR gRNA sequence
tcattatcctagccacgttt

SEQ ID NO: 129278 - DNA, 20 bp, Artificial
  CRISPR gRNA sequence
cattatcctagccacgtttg

SEQ ID NO: 129279 - DNA, 20 bp, Artificial
  CRISPR gRNA sequence
attatcctagccacgtttgc

SEQ ID NO: 129280 - DNA, 20 bp, Artificial
  CRISPR gRNA sequence
tcctagccacgtttgctatt

SEQ ID NO: 129281 - DNA, 20 bp, Artificial
  CRISPR gRNA sequence
gccacgtttgctattggaag

SEQ ID NO: 129282 - DNA, 20 bp, Artificial
  CRISPR gRNA sequence
gctattggaagatatatatc

SEQ ID NO: 129283 - DNA, 20 bp, Artificial
  CRISPR gRNA sequence
ctattggaagatatatatct

SEQ ID NO: 129284 - DNA, 20 bp, Artificial
  CRISPR gRNA sequence
ttggaagatatatatcttgt

SEQ ID NO: 129285 - DNA, 20 bp, Artificial
  CRISPR gRNA sequence
gaagatatatatcttgttct

SEQ ID NO: 129286 - DNA, 20 bp, Artificial
  CRISPR gRNA sequence
gttctctgaaactttctttt

SEQ ID NO: 129287 - DNA, 20 bp, Artificial
  CRISPR gRNA sequence
ttctctgaaactttcttttg

SEQ ID NO: 129288 - DNA, 20 bp, Artificial
  CRISPR gRNA sequence
tctgaaactttcttttgaac

SEQ ID NO: 129289 - DNA, 20 bp, Artificial
  CRISPR gRNA sequence
tgaaactttcttttgaacca

SEQ ID NO: 129290 - DNA, 20 bp, Artificial
  CRISPR gRNA sequence
aaactttcttttgaaccatt

SEQ ID NO: 129291 - DNA, 20 bp, Artificial
  CRISPR gRNA sequence
tcttttgaaccatttgtgtc

SEQ ID NO: 129292 - DNA, 20 bp, Artificial
  CRISPR gRNA sequence
cttttgaaccatttgtgtct

SEQ ID NO: 129293 - DNA, 20 bp, Artificial
  CRISPR gRNA sequence
ttttgaaccatttgtgtctt

SEQ ID NO: 129294 - DNA, 20 bp, Artificial
  CRISPR gRNA sequence
ttgaaccatttgtgtcttca

SEQ ID NO: 129295 - DNA, 20 bp, Artificial
  CRISPR gRNA sequence
tgaaccatttgtgtcttcat

SEQ ID NO: 129296 - DNA, 20 bp, Artificial
  CRISPR gRNA sequence
gaaccatttgtgtcttcatg

SEQ ID NO: 129297 - DNA, 20 bp, Artificial
  CRISPR gRNA sequence
aaccatttgtgtcttcatga

SEQ ID NO: 129298 - DNA, 20 bp, Artificial
  CRISPR gRNA sequence
gtgtcttcatgatcattcat

SEQ ID NO: 129299 - DNA, 20 bp, Artificial
  CRISPR gRNA sequence
tgtcttcatgatcattcatg

SEQ ID NO: 129300 - DNA, 20 bp, Artificial
  CRISPR gRNA sequence
catgatcattcatgctgtcc

SEQ ID NO: 129301 - DNA, 20 bp, Artificial
  CRISPR gRNA sequence
atgatcattcatgctgtcct

SEQ ID NO: 129302 - DNA, 20 bp, Artificial
  CRISPR gRNA sequence
atgctgtcctcagtatctaa

SEQ ID NO: 129303 - DNA, 20 bp, Artificial
  CRISPR gRNA sequence
tcctcagtatctaaagaaat

SEQ ID NO: 129304 - DNA, 20 bp, Artificial
  CRISPR gRNA sequence
agtatctaaagaaataaaaa

SEQ ID NO: 129305 - DNA, 20 bp, Artificial
  CRISPR gRNA sequence
aagaaataaaaatatttagg

SEQ ID NO: 129306 - DNA, 20 bp, Artificial
  CRISPR gRNA sequence
aggtgtaaagcttcttatta

SEQ ID NO: 129307 - DNA, 20 bp, Artificial
  CRISPR gRNA sequence
ggtgtaaagcttcttattat

SEQ ID NO: 129308 - DNA, 20 bp, Artificial
  CRISPR gRNA sequence
cttattatttctatttcaag

SEQ ID NO: 129309 - DNA, 20 bp, Artificial
  CRISPR gRNA sequence
ttattatttctatttcaaga

SEQ ID NO: 129310 - DNA, 20 bp, Artificial
  CRISPR gRNA sequence
attatttctatttcaagata

SEQ ID NO: 129311 - DNA, 20 bp, Artificial
  CRISPR gRNA sequence
ttatttctatttcaagatag

SEQ ID NO: 129312 - DNA, 20 bp, Artificial
  CRISPR gRNA sequence
tttctatttcaagatagaaa

SEQ ID NO: 129313 - DNA, 20 bp, Artificial
  CRISPR gRNA sequence
ctatttcaagatagaaaaaa

SEQ ID NO: 129314 - DNA, 20 bp, Artificial
  CRISPR gRNA sequence
tatttcaagatagaaaaaac

SEQ ID NO: 129315 - DNA, 20 bp, Artificial
  CRISPR gRNA sequence
tttcaagatagaaaaaacta

SEQ ID NO: 129316 - DNA, 20 bp, Artificial
  CRISPR gRNA sequence
caagatagaaaaaactacca

SEQ ID NO: 129317 - DNA, 20 bp, Artificial
  CRISPR gRNA sequence
aagatagaaaaaactaccaa

SEQ ID NO: 129318 - DNA, 20 bp, Artificial
  CRISPR gRNA sequence
ccaaagtgatccagaataaa

SEQ ID NO: 129319 - DNA, 20 bp, Artificial
  CRISPR gRNA sequence
tggttcacctcttaaccatt

SEQ ID NO: 129320 - DNA, 20 bp, Artificial
  CRISPR gRNA sequence
gttcacctcttaaccattat

SEQ ID NO: 129321 - DNA, 20 bp, Artificial
  CRISPR gRNA sequence
acctcttaaccattatttag

SEQ ID NO: 129322 - DNA, 20 bp, Artificial
  CRISPR gRNA sequence
ttaaccattatttagggatt

SEQ ID NO: 129323 - DNA, 20 bp, Artificial
  CRISPR gRNA sequence
aaccattatttagggattag

SEQ ID NO: 129324 - DNA, 20 bp, Artificial
  CRISPR gRNA sequence
accattatttagggattagg

SEQ ID NO: 129325 - DNA, 20 bp, Artificial
  CRISPR gRNA sequence
tttagggattaggatagcaa

SEQ ID NO: 129326 - DNA, 20 bp, Artificial
  CRISPR gRNA sequence
agggattaggatagcaagtc

SEQ ID NO: 129327 - DNA, 20 bp, Artificial
  CRISPR gRNA sequence
gggattaggatagcaagtct

SEQ ID NO: 129328 - DNA, 20 bp, Artificial
  CRISPR gRNA sequence
ggatagcaagtctcttcata

SEQ ID NO: 129329 - DNA, 20 bp, Artificial
  CRISPR gRNA sequence
ttcataatttttacagagcc

SEQ ID NO: 129330 - DNA, 20 bp, Artificial
  CRISPR gRNA sequence
cataatttttacagagccag

SEQ ID NO: 129331 - DNA, 20 bp, Artificial
  CRISPR gRNA sequence
ataatttttacagagccaga

SEQ ID NO: 129332 - DNA, 20 bp, Artificial
  CRISPR gRNA sequence
ttacagagccagaactgaac

SEQ ID NO: 129333 - DNA, 20 bp, Artificial
  CRISPR gRNA sequence
tacagagccagaactgaact

SEQ ID NO: 129334 - DNA, 20 bp, Artificial
  CRISPR gRNA sequence
acagagccagaactgaactt

SEQ ID NO: 129335 - DNA, 20 bp, Artificial
  CRISPR gRNA sequence
cagagccagaactgaacttt

SEQ ID NO: 129336 - DNA, 20 bp, Artificial
  CRISPR gRNA sequence
aactttttttttattaattt

SEQ ID NO: 129337 - DNA, 20 bp, Artificial
  CRISPR gRNA sequence
tttttttattaatttcagac

SEQ ID NO: 129338 - DNA, 20 bp, Artificial
  CRISPR gRNA sequence
ttttttattaatttcagact

SEQ ID NO: 129339 - DNA, 20 bp, Artificial
  CRISPR gRNA sequence
tttttattaatttcagactc

SEQ ID NO: 129340 - DNA, 20 bp, Artificial
  CRISPR gRNA sequence
ttttattaatttcagactca

SEQ ID NO: 129341 - DNA, 20 bp, Artificial
  CRISPR gRNA sequence
tttattaatttcagactcac

SEQ ID NO: 129342 - DNA, 20 bp, Artificial
  CRISPR gRNA sequence
ttattaatttcagactcact

SEQ ID NO: 129343 - DNA, 20 bp, Artificial
  CRISPR gRNA sequence
tattaatttcagactcactg

SEQ ID NO: 129344 - DNA, 20 bp, Artificial
  CRISPR gRNA sequence
attaatttcagactcactgc

SEQ ID NO: 129345 - DNA, 20 bp, Artificial
  CRISPR gRNA sequence
ttaatttcagactcactgcc

SEQ ID NO: 129346 - DNA, 20 bp, Artificial
  CRISPR gRNA sequence
atttcagactcactgcctag

SEQ ID NO: 129347 - DNA, 20 bp, Artificial
  CRISPR gRNA sequence
cagactcactgcctagaaca

SEQ ID NO: 129348 - DNA, 20 bp, Artificial
  CRISPR gRNA sequence
agactcactgcctagaacac

SEQ ID NO: 129349 - DNA, 20 bp, Artificial
  CRISPR gRNA sequence
actgcctagaacacttttta

SEQ ID NO: 129350 - DNA, 20 bp, Artificial
  CRISPR gRNA sequence
cctagaacactttttatcct

SEQ ID NO: 129351 - DNA, 20 bp, Artificial
  CRISPR gRNA sequence
gaacactttttatcctcaaa

SEQ ID NO: 129352 - DNA, 20 bp, Artificial
  CRISPR gRNA sequence
tttatcctcaaatatacctg

SEQ ID NO: 129353 - DNA, 20 bp, Artificial
  CRISPR gRNA sequence
ttatcctcaaatatacctgc

SEQ ID NO: 129354 - DNA, 20 bp, Artificial
  CRISPR gRNA sequence
tatcctcaaatatacctgct

SEQ ID NO: 129355 - DNA, 20 bp, Artificial
  CRISPR gRNA sequence
atcctcaaatatacctgcta

SEQ ID NO: 129356 - DNA, 20 bp, Artificial
  CRISPR gRNA sequence
tcctcaaatatacctgctaa

SEQ ID NO: 129357 - DNA, 20 bp, Artificial
  CRISPR gRNA sequence
aaatatacctgctaaaatcc

SEQ ID NO: 129358 - DNA, 20 bp, Artificial
  CRISPR gRNA sequence
ctaaaatcctacttgcccat

SEQ ID NO: 129359 - DNA, 20 bp, Artificial
  CRISPR gRNA sequence
aaatcctacttgcccattct

SEQ ID NO: 129360 - DNA, 20 bp, Artificial
  CRISPR gRNA sequence
cttgcccattctccaaaaat

SEQ ID NO: 129361 - DNA, 20 bp, Artificial
  CRISPR gRNA sequence
gcccattctccaaaaatctc

SEQ ID NO: 129362 - DNA, 20 bp, Artificial
  CRISPR gRNA sequence
cccattctccaaaaatctca

SEQ ID NO: 129363 - DNA, 20 bp, Artificial
  CRISPR gRNA sequence
tccaaaaatctcaaataaca

SEQ ID NO: 129364 - DNA, 20 bp, Artificial
  CRISPR gRNA sequence
caaaaatctcaaataacatc

SEQ ID NO: 129365 - DNA, 20 bp, Artificial
  CRISPR gRNA sequence
aaataacatctccataccac

SEQ ID NO: 129366 - DNA, 20 bp, Artificial
  CRISPR gRNA sequence
cataccaccttcaaaaatga

SEQ ID NO: 129367 - DNA, 20 bp, Artificial
  CRISPR gRNA sequence
caaaaatgatcttttctttc

SEQ ID NO: 129368 - DNA, 20 bp, Artificial
  CRISPR gRNA sequence
aaaaatgatcttttctttca

SEQ ID NO: 129369 - DNA, 20 bp, Artificial
  CRISPR gRNA sequence
ttctttcataaaatgtaagt

SEQ ID NO: 129370 - DNA, 20 bp, Artificial
  CRISPR gRNA sequence
tctttcataaaatgtaagtg

SEQ ID NO: 129371 - DNA, 20 bp, Artificial
  CRISPR gRNA sequence
ctttcataaaatgtaagtgc

SEQ ID NO: 129372 - DNA, 20 bp, Artificial
  CRISPR gRNA sequence
tttcataaaatgtaagtgct

SEQ ID NO: 129373 - DNA, 20 bp, Artificial
  CRISPR gRNA sequence
tcataaaatgtaagtgcttc

SEQ ID NO: 129374 - DNA, 20 bp, Artificial
  CRISPR gRNA sequence
cataaaatgtaagtgcttct

SEQ ID NO: 129375 - DNA, 20 bp, Artificial
  CRISPR gRNA sequence
ataaaatgtaagtgcttctc

SEQ ID NO: 129376 - DNA, 20 bp, Artificial
  CRISPR gRNA sequence
ctctatgccttttctcttac

SEQ ID NO: 129377 - DNA, 20 bp, Artificial
  CRISPR gRNA sequence
tctatgccttttctcttaca

SEQ ID NO: 129378 - DNA, 20 bp, Artificial
  CRISPR gRNA sequence
tatgccttttctcttacaca

SEQ ID NO: 129379 - DNA, 20 bp, Artificial
  CRISPR gRNA sequence
tgccttttctcttacacatt

SEQ ID NO: 129380 - DNA, 20 bp, Artificial
  CRISPR gRNA sequence
ttctcttacacatttttaga

SEQ ID NO: 129381 - DNA, 20 bp, Artificial
  CRISPR gRNA sequence
tctcttacacatttttagaa

SEQ ID NO: 129382 - DNA, 20 bp, Artificial
  CRISPR gRNA sequence
ctcttacacatttttagaat

SEQ ID NO: 129383 - DNA, 20 bp, Artificial
  CRISPR gRNA sequence
tcttacacatttttagaatt

SEQ ID NO: 129384 - DNA, 20 bp, Artificial
  CRISPR gRNA sequence
ttacacatttttagaatttt

SEQ ID NO: 129385 - DNA, 20 bp, Artificial
  CRISPR gRNA sequence
acacatttttagaattttta

SEQ ID NO: 129386 - DNA, 20 bp, Artificial
  CRISPR gRNA sequence
cacatttttagaatttttat

SEQ ID NO: 129387 - DNA, 20 bp, Artificial
  CRISPR gRNA sequence
ttagaatttttattattcct

SEQ ID NO: 129388 - DNA, 20 bp, Artificial
  CRISPR gRNA sequence
tagaatttttattattcctc

SEQ ID NO: 129389 - DNA, 20 bp, Artificial
  CRISPR gRNA sequence
agaatttttattattcctca

SEQ ID NO: 129390 - DNA, 20 bp, Artificial
  CRISPR gRNA sequence
gaatttttattattcctcat

SEQ ID NO: 129391 - DNA, 20 bp, Artificial
  CRISPR gRNA sequence
ttattattcctcatttctcc

SEQ ID NO: 129392 - DNA, 20 bp, Artificial
  CRISPR gRNA sequence
tattattcctcatttctcct

SEQ ID NO: 129393 - DNA, 20 bp, Artificial
  CRISPR gRNA sequence
attattcctcatttctccta

SEQ ID NO: 129394 - DNA, 20 bp, Artificial
  CRISPR gRNA sequence
ttattcctcatttctcctat

SEQ ID NO: 129395 - DNA, 20 bp, Artificial
  CRISPR gRNA sequence
ttcctcatttctcctattag

SEQ ID NO: 129396 - DNA, 20 bp, Artificial
  CRISPR gRNA sequence
ctcatttctcctattagatt

SEQ ID NO: 129397 - DNA, 20 bp, Artificial
  CRISPR gRNA sequence
atttctcctattagattttt

SEQ ID NO: 129398 - DNA, 20 bp, Artificial
  CRISPR gRNA sequence
ctcctattagatttttgcta

SEQ ID NO: 129399 - DNA, 20 bp, Artificial
  CRISPR gRNA sequence
tcctattagatttttgctac

SEQ ID NO: 129400 - DNA, 20 bp, Artificial
  CRISPR gRNA sequence
ctattagatttttgctactt

SEQ ID NO: 129401 - DNA, 20 bp, Artificial
  CRISPR gRNA sequence
ttagatttttgctacttaat

SEQ ID NO: 129402 - DNA, 20 bp, Artificial
  CRISPR gRNA sequence
gatttttgctacttaatgtc

SEQ ID NO: 129403 - DNA, 20 bp, Artificial
  CRISPR gRNA sequence
ttgctacttaatgtcacgaa

SEQ ID NO: 129404 - DNA, 20 bp, Artificial
  CRISPR gRNA sequence
tgctacttaatgtcacgaat

SEQ ID NO: 129405 - DNA, 20 bp, Artificial
  CRISPR gRNA sequence
gctacttaatgtcacgaatc

SEQ ID NO: 129406 - DNA, 20 bp, Artificial
  CRISPR gRNA sequence
ctacttaatgtcacgaatca

SEQ ID NO: 129407 - DNA, 20 bp, Artificial
  CRISPR gRNA sequence
cttaatgtcacgaatcagct

SEQ ID NO: 129408 - DNA, 20 bp, Artificial
  CRISPR gRNA sequence
aatgtcacgaatcagctttg

SEQ ID NO: 129409 - DNA, 20 bp, Artificial
  CRISPR gRNA sequence
atgtcacgaatcagctttgt

SEQ ID NO: 129410 - DNA, 20 bp, Artificial
  CRISPR gRNA sequence
tgtgtttcctacagcttggt

SEQ ID NO: 129411 - DNA, 20 bp, Artificial
  CRISPR gRNA sequence
gtgtttcctacagcttggta

SEQ ID NO: 129412 - DNA, 20 bp, Artificial
  CRISPR gRNA sequence
tgtttcctacagcttggtac

SEQ ID NO: 129413 - DNA, 20 bp, Artificial
  CRISPR gRNA sequence
cctacagcttggtacagcac

SEQ ID NO: 129414 - DNA, 20 bp, Artificial
  CRISPR gRNA sequence
ctacagcttggtacagcacc

SEQ ID NO: 129415 - DNA, 20 bp, Artificial
  CRISPR gRNA sequence
cagcttggtacagcaccttc

SEQ ID NO: 129416 - DNA, 20 bp, Artificial
  CRISPR gRNA sequence
ggtacagcaccttccacaga

SEQ ID NO: 129417 - DNA, 20 bp, Artificial
  CRISPR gRNA sequence
gtacagcaccttccacagag

SEQ ID NO: 129418 - DNA, 20 bp, Artificial
  CRISPR gRNA sequence
ccacagagtaggtactcata

SEQ ID NO: 129419 - DNA, 20 bp, Artificial
  CRISPR gRNA sequence
cacagagtaggtactcataa

SEQ ID NO: 129420 - DNA, 20 bp, Artificial
  CRISPR gRNA sequence
ataaatatttattatacgac

SEQ ID NO: 129421 - DNA, 20 bp, Artificial
  CRISPR gRNA sequence
attatacgacttagctataa

SEQ ID NO: 129422 - DNA, 20 bp, Artificial
  CRISPR gRNA sequence
ttatacgacttagctataaa

SEQ ID NO: 129423 - DNA, 20 bp, Artificial
  CRISPR gRNA sequence
tacgacttagctataaaact

SEQ ID NO: 129424 - DNA, 20 bp, Artificial
  CRISPR gRNA sequence
agctataaaacttacagacc

SEQ ID NO: 129425 - DNA, 20 bp, Artificial
  CRISPR gRNA sequence
gctataaaacttacagaccg

SEQ ID NO: 129426 - DNA, 20 bp, Artificial
  CRISPR gRNA sequence
taaaacttacagaccgtaac

SEQ ID NO: 129427 - DNA, 20 bp, Artificial
  CRISPR gRNA sequence
acagaccgtaacctatggct

SEQ ID NO: 129428 - DNA, 20 bp, Artificial
  CRISPR gRNA sequence
cagaccgtaacctatggctc

SEQ ID NO: 129429 - DNA, 20 bp, Artificial
  CRISPR gRNA sequence
tggctccttcaatactgcta

SEQ ID NO: 129430 - DNA, 20 bp, Artificial
  CRISPR gRNA sequence
cttcaatactgctagattaa

SEQ ID NO: 129431 - DNA, 20 bp, Artificial
  CRISPR gRNA sequence
caatactgctagattaagag

SEQ ID NO: 129432 - DNA, 20 bp, Artificial
  CRISPR gRNA sequence
aatactgctagattaagagg

SEQ ID NO: 129433 - DNA, 20 bp, Artificial
  CRISPR gRNA sequence
ctagattaagaggttgtatg

SEQ ID NO: 129434 - DNA, 20 bp, Artificial
  CRISPR gRNA sequence
gattaagaggttgtatgttt

SEQ ID NO: 129435 - DNA, 20 bp, Artificial
  CRISPR gRNA sequence
agaggttgtatgtttctcca

SEQ ID NO: 129436 - DNA, 20 bp, Artificial
  CRISPR gRNA sequence
tatgtttctccaaacccaag

SEQ ID NO: 129437 - DNA, 20 bp, Artificial
  CRISPR gRNA sequence
ctccaaacccaagtttatat

SEQ ID NO: 129438 - DNA, 20 bp, Artificial
  CRISPR gRNA sequence
tccaaacccaagtttatata

SEQ ID NO: 129439 - DNA, 20 bp, Artificial
  CRISPR gRNA sequence
caaacccaagtttatataaa

SEQ ID NO: 129440 - DNA, 20 bp, Artificial
  CRISPR gRNA sequence
atataaactcatttatgtaa

SEQ ID NO: 129441 - DNA, 20 bp, Artificial
  CRISPR gRNA sequence
tataaactcatttatgtaaa

SEQ ID NO: 129442 - DNA, 20 bp, Artificial
  CRISPR gRNA sequence
atttatgtaaaagtctatat

SEQ ID NO: 129443 - DNA, 20 bp, Artificial
  CRISPR gRNA sequence
atgtaaaagtctatataaaa

SEQ ID NO: 129444 - DNA, 20 bp, Artificial
  CRISPR gRNA sequence
tgtaaaagtctatataaaac

SEQ ID NO: 129445 - DNA, 20 bp, Artificial
  CRISPR gRNA sequence
tataaaacttttaaagttga

SEQ ID NO: 129446 - DNA, 20 bp, Artificial
  CRISPR gRNA sequence
ttaaagttgatataaagttg

SEQ ID NO: 129447 - DNA, 20 bp, Artificial
  CRISPR gRNA sequence
taaagttgatataaagttgt

SEQ ID NO: 129448 - DNA, 20 bp, Artificial
  CRISPR gRNA sequence
aaagttgatataaagttgtc

SEQ ID NO: 129449 - DNA, 20 bp, Artificial
  CRISPR gRNA sequence
aagttgatataaagttgtct

SEQ ID NO: 129450 - DNA, 20 bp, Artificial
  CRISPR gRNA sequence
atataaagttgtcttgtctg

SEQ ID NO: 129451 - DNA, 20 bp, Artificial
  CRISPR gRNA sequence
tcttgtctgtataaagttta

SEQ ID NO: 129452 - DNA, 20 bp, Artificial
  CRISPR gRNA sequence
gtctgtataaagtttatata

SEQ ID NO: 129453 - DNA, 20 bp, Artificial
  CRISPR gRNA sequence
tctgtataaagtttatataa

SEQ ID NO: 129454 - DNA, 20 bp, Artificial
  CRISPR gRNA sequence
tataaagtttatataaaatt

SEQ ID NO: 129455 - DNA, 20 bp, Artificial
  CRISPR gRNA sequence
atataaaattctttaaagaa

SEQ ID NO: 129456 - DNA, 20 bp, Artificial
  CRISPR gRNA sequence
tataaaattctttaaagaat

SEQ ID NO: 129457 - DNA, 20 bp, Artificial
  CRISPR gRNA sequence
tttaaagaatggaaaaactg

SEQ ID NO: 129458 - DNA, 20 bp, Artificial
  CRISPR gRNA sequence
taaagaatggaaaaactgga

SEQ ID NO: 129459 - DNA, 20 bp, Artificial
  CRISPR gRNA sequence
aaagaatggaaaaactggac

SEQ ID NO: 129460 - DNA, 20 bp, Artificial
  CRISPR gRNA sequence
aagaatggaaaaactggact

SEQ ID NO: 129461 - DNA, 20 bp, Artificial
  CRISPR gRNA sequence
gacttgattattactgatcc

SEQ ID NO: 129462 - DNA, 20 bp, Artificial
  CRISPR gRNA sequence
gattattactgatccagttg

SEQ ID NO: 129463 - DNA, 20 bp, Artificial
  CRISPR gRNA sequence
attattactgatccagttgg

SEQ ID NO: 129464 - DNA, 20 bp, Artificial
  CRISPR gRNA sequence
ttactgatccagttggctta

SEQ ID NO: 129465 - DNA, 20 bp, Artificial
  CRISPR gRNA sequence
ctgatccagttggcttacta

SEQ ID NO: 129466 - DNA, 20 bp, Artificial
  CRISPR gRNA sequence
atccagttggcttactaatg

SEQ ID NO: 129467 - DNA, 20 bp, Artificial
  CRISPR gRNA sequence
gcttactaatgtaactagtt

SEQ ID NO: 129468 - DNA, 20 bp, Artificial
  CRISPR gRNA sequence
actaatgtaactagtttttg

SEQ ID NO: 129469 - DNA, 20 bp, Artificial
  CRISPR gRNA sequence
ctaatgtaactagtttttga

SEQ ID NO: 129470 - DNA, 20 bp, Artificial
  CRISPR gRNA sequence
atgtaactagtttttgaaca

SEQ ID NO: 129471 - DNA, 20 bp, Artificial
  CRISPR gRNA sequence
gtttttgaacaaagctagag

SEQ ID NO: 129472 - DNA, 20 bp, Artificial
  CRISPR gRNA sequence
ttgaacaaagctagagcagt

SEQ ID NO: 129473 - DNA, 20 bp, Artificial
  CRISPR gRNA sequence
tgaacaaagctagagcagtg

SEQ ID NO: 129474 - DNA, 20 bp, Artificial
  CRISPR gRNA sequence
gaacaaagctagagcagtga

SEQ ID NO: 129475 - DNA, 20 bp, Artificial
  CRISPR gRNA sequence
aacaaagctagagcagtgat

SEQ ID NO: 129476 - DNA, 20 bp, Artificial
  CRISPR gRNA sequence
gagcagtgatccaactgttc

SEQ ID NO: 129477 - DNA, 20 bp, Artificial
  CRISPR gRNA sequence
ttcatacaaaaagggacttt

SEQ ID NO: 129478 - DNA, 20 bp, Artificial
  CRISPR gRNA sequence
atacaaaaagggacttttca

SEQ ID NO: 129479 - DNA, 20 bp, Artificial
  CRISPR gRNA sequence
ttcaaattatataaatttag

SEQ ID NO: 129480 - DNA, 20 bp, Artificial
  CRISPR gRNA sequence
tcaaattatataaatttagc

SEQ ID NO: 129481 - DNA, 20 bp, Artificial
  CRISPR gRNA sequence
caaattatataaatttagct

SEQ ID NO: 129482 - DNA, 20 bp, Artificial
  CRISPR gRNA sequence
aaattatataaatttagcta

SEQ ID NO: 129483 - DNA, 20 bp, Artificial
  CRISPR gRNA sequence
tataaatttagctataactg

SEQ ID NO: 129484 - DNA, 20 bp, Artificial
  CRISPR gRNA sequence
agctataactgaagcttgcg

SEQ ID NO: 129485 - DNA, 20 bp, Artificial
  CRISPR gRNA sequence
gctataactgaagcttgcgc

SEQ ID NO: 129486 - DNA, 20 bp, Artificial
  CRISPR gRNA sequence
taactgaagcttgcgcagta

SEQ ID NO: 129487 - DNA, 20 bp, Artificial
  CRISPR gRNA sequence
aagcttgcgcagtaccaata

SEQ ID NO: 129488 - DNA, 20 bp, Artificial
  CRISPR gRNA sequence
gcgcagtaccaataacatcc

SEQ ID NO: 129489 - DNA, 20 bp, Artificial
  CRISPR gRNA sequence
cgcagtaccaataacatcct

SEQ ID NO: 129490 - DNA, 20 bp, Artificial
  CRISPR gRNA sequence
ttatgactaaatgcagtatc

SEQ ID NO: 129491 - DNA, 20 bp, Artificial
  CRISPR gRNA sequence
tatgactaaatgcagtatcc

SEQ ID NO: 129492 - DNA, 20 bp, Artificial
  CRISPR gRNA sequence
atgactaaatgcagtatcct

SEQ ID NO: 129493 - DNA, 20 bp, Artificial
  CRISPR gRNA sequence
tgactaaatgcagtatcctg

SEQ ID NO: 129494 - DNA, 20 bp, Artificial
  CRISPR gRNA sequence
aatgcagtatcctgtaagta

SEQ ID NO: 129495 - DNA, 20 bp, Artificial
  CRISPR gRNA sequence
taagtaaactgcccactctt

SEQ ID NO: 129496 - DNA, 20 bp, Artificial
  CRISPR gRNA sequence
cccactcttcatatgtacta

SEQ ID NO: 129497 - DNA, 20 bp, Artificial
  CRISPR gRNA sequence
ttcatatgtactaagtaagg

SEQ ID NO: 129498 - DNA, 20 bp, Artificial
  CRISPR gRNA sequence
catatgtactaagtaaggag

SEQ ID NO: 129499 - DNA, 20 bp, Artificial
  CRISPR gRNA sequence
atatgtactaagtaaggagg

SEQ ID NO: 129500 - DNA, 20 bp, Artificial
  CRISPR gRNA sequence
agtaaggaggcaaggcactt

SEQ ID NO: 129501 - DNA, 20 bp, Artificial
  CRISPR gRNA sequence
aagttgattcaatttacgtt

SEQ ID NO: 129502 - DNA, 20 bp, Artificial
  CRISPR gRNA sequence
agttgattcaatttacgttt

SEQ ID NO: 129503 - DNA, 20 bp, Artificial
  CRISPR gRNA sequence
attcaatttacgtttttatg

SEQ ID NO: 129504 - DNA, 20 bp, Artificial
  CRISPR gRNA sequence
aatttacgtttttatgtgtt

SEQ ID NO: 129505 - DNA, 20 bp, Artificial
  CRISPR gRNA sequence
acgtttttatgtgtttaaaa

SEQ ID NO: 129506 - DNA, 20 bp, Artificial
  CRISPR gRNA sequence
cgtttttatgtgtttaaaat

SEQ ID NO: 129507 - DNA, 20 bp, Artificial
  CRISPR gRNA sequence
ttatgtgtttaaaatgatgt

SEQ ID NO: 129508 - DNA, 20 bp, Artificial
  CRISPR gRNA sequence
tatgtgtttaaaatgatgtt

SEQ ID NO: 129509 - DNA, 20 bp, Artificial
  CRISPR gRNA sequence
atgtgtttaaaatgatgtta

SEQ ID NO: 129510 - DNA, 20 bp, Artificial
  CRISPR gRNA sequence
tgtgtttaaaatgatgttat

SEQ ID NO: 129511 - DNA, 20 bp, Artificial
  CRISPR gRNA sequence
aaaatgatgttatcagaatt

SEQ ID NO: 129512 - DNA, 20 bp, Artificial
  CRISPR gRNA sequence
aaatgatgttatcagaatta

SEQ ID NO: 129513 - DNA, 20 bp, Artificial
  CRISPR gRNA sequence
tcagaattaatttatttgaa

SEQ ID NO: 129514 - DNA, 20 bp, Artificial
  CRISPR gRNA sequence
atttatttgaatatccgttt

SEQ ID NO: 129515 - DNA, 20 bp, Artificial
  CRISPR gRNA sequence
atttgaatatccgtttcagg

SEQ ID NO: 129516 - DNA, 20 bp, Artificial
  CRISPR gRNA sequence
tttgaatatccgtttcagga

SEQ ID NO: 129517 - DNA, 20 bp, Artificial
  CRISPR gRNA sequence
gaatatccgtttcaggatga

SEQ ID NO: 129518 - DNA, 20 bp, Artificial
  CRISPR gRNA sequence
aatatccgtttcaggatgaa

SEQ ID NO: 129519 - DNA, 20 bp, Artificial
  CRISPR gRNA sequence
caggatgaaattaatccctc

SEQ ID NO: 129520 - DNA, 20 bp, Artificial
  CRISPR gRNA sequence
aggatgaaattaatccctct

SEQ ID NO: 129521 - DNA, 20 bp, Artificial
  CRISPR gRNA sequence
atccctctggcaagtttctt

SEQ ID NO: 129522 - DNA, 20 bp, Artificial
  CRISPR gRNA sequence
tggcaagtttcttctaaaaa

SEQ ID NO: 129523 - DNA, 20 bp, Artificial
  CRISPR gRNA sequence
gcaagtttcttctaaaaata

SEQ ID NO: 129524 - DNA, 20 bp, Artificial
  CRISPR gRNA sequence
cttctaaaaatatatctcaa

SEQ ID NO: 129525 - DNA, 20 bp, Artificial
  CRISPR gRNA sequence
ttctaaaaatatatctcaat

SEQ ID NO: 129526 - DNA, 20 bp, Artificial
  CRISPR gRNA sequence
ctaaaaatatatctcaattt

SEQ ID NO: 129527 - DNA, 20 bp, Artificial
  CRISPR gRNA sequence
taaaaatatatctcaatttt

SEQ ID NO: 129528 - DNA, 20 bp, Artificial
  CRISPR gRNA sequence
aaaatatatctcaattttta

SEQ ID NO: 129529 - DNA, 20 bp, Artificial
  CRISPR gRNA sequence
aatttttaaaaattttacaa

SEQ ID NO: 129530 - DNA, 20 bp, Artificial
  CRISPR gRNA sequence
ttaaaaattttacaaatcag

SEQ ID NO: 129531 - DNA, 20 bp, Artificial
  CRISPR gRNA sequence
taaaaattttacaaatcagg

SEQ ID NO: 129532 - DNA, 20 bp, Artificial
  CRISPR gRNA sequence
aaaaattttacaaatcaggc

SEQ ID NO: 129533 - DNA, 20 bp, Artificial
  CRISPR gRNA sequence
aaaattttacaaatcaggcc

SEQ ID NO: 129534 - DNA, 20 bp, Artificial
  CRISPR gRNA sequence
tacaaatcaggccaggcgtg

SEQ ID NO: 129535 - DNA, 20 bp, Artificial
  CRISPR gRNA sequence
acaaatcaggccaggcgtgg

SEQ ID NO: 129536 - DNA, 20 bp, Artificial
  CRISPR gRNA sequence
caaatcaggccaggcgtggt

SEQ ID NO: 129537 - DNA, 20 bp, Artificial
  CRISPR gRNA sequence
atgactataatcccagcact

SEQ ID NO: 129538 - DNA, 20 bp, Artificial
  CRISPR gRNA sequence
taatcccagcactttgggag

SEQ ID NO: 129539 - DNA, 20 bp, Artificial
  CRISPR gRNA sequence
tgggaggctgaagcaggcag

SEQ ID NO: 129540 - DNA, 20 bp, Artificial
  CRISPR gRNA sequence
gggaggctgaagcaggcaga

SEQ ID NO: 129541 - DNA, 20 bp, Artificial
  CRISPR gRNA sequence
ggaggctgaagcaggcagat

SEQ ID NO: 129542 - DNA, 20 bp, Artificial
  CRISPR gRNA sequence
aagcaggcagatcatctgag

SEQ ID NO: 129543 - DNA, 20 bp, Artificial
  CRISPR gRNA sequence
aggtcacgagtttgagacca

SEQ ID NO: 129544 - DNA, 20 bp, Artificial
  CRISPR gRNA sequence
gagaccagcctgaccaacac

SEQ ID NO: 129545 - DNA, 20 bp, Artificial
  CRISPR gRNA sequence
agaccagcctgaccaacaca

SEQ ID NO: 129546 - DNA, 20 bp, Artificial
  CRISPR gRNA sequence
accaacacagcgaaaccctg

SEQ ID NO: 129547 - DNA, 20 bp, Artificial
  CRISPR gRNA sequence
tctctactaaaaaaaaatta

SEQ ID NO: 129548 - DNA, 20 bp, Artificial
  CRISPR gRNA sequence
tactaaaaaaaaattagctg

SEQ ID NO: 129549 - DNA, 20 bp, Artificial
  CRISPR gRNA sequence
ctaaaaaaaaattagctggg

SEQ ID NO: 129550 - DNA, 20 bp, Artificial
  CRISPR gRNA sequence
aaaaaaaattagctgggcat

SEQ ID NO: 129551 - DNA, 20 bp, Artificial
  CRISPR gRNA sequence
gctgggcatggtgctgggcg

SEQ ID NO: 129552 - DNA, 20 bp, Artificial
  CRISPR gRNA sequence
ggcatggtgctgggcgcctg

SEQ ID NO: 129553 - DNA, 20 bp, Artificial
  CRISPR gRNA sequence
ggcgcctgtgatctcagcta

SEQ ID NO: 129554 - DNA, 20 bp, Artificial
  CRISPR gRNA sequence
tgatctcagctaacgggcag

SEQ ID NO: 129555 - DNA, 20 bp, Artificial
  CRISPR gRNA sequence
agctaacgggcaggctgagg

SEQ ID NO: 129556 - DNA, 20 bp, Artificial
  CRISPR gRNA sequence
acgggcaggctgaggcagga

SEQ ID NO: 129557 - DNA, 20 bp, Artificial
  CRISPR gRNA sequence
aggcaggagaattgcttgaa

SEQ ID NO: 129558 - DNA, 20 bp, Artificial
  CRISPR gRNA sequence
cttgaacccaggaggcggag

SEQ ID NO: 129559 - DNA, 20 bp, Artificial
  CRISPR gRNA sequence
gaacccaggaggcggaggtt

SEQ ID NO: 129560 - DNA, 20 bp, Artificial
  CRISPR gRNA sequence
aacccaggaggcggaggttg

SEQ ID NO: 129561 - DNA, 20 bp, Artificial
  CRISPR gRNA sequence
cagtgagccaagattgtgcc

SEQ ID NO: 129562 - DNA, 20 bp, Artificial
  CRISPR gRNA sequence
tgccactgcactccagcctg

SEQ ID NO: 129563 - DNA, 20 bp, Artificial
  CRISPR gRNA sequence
cactccagcctgggcgacag

SEQ ID NO: 129564 - DNA, 20 bp, Artificial
  CRISPR gRNA sequence
cagcctgggcgacagagcaa

SEQ ID NO: 129565 - DNA, 20 bp, Artificial
  CRISPR gRNA sequence
ggcgacagagcaagactcca

SEQ ID NO: 129566 - DNA, 20 bp, Artificial
  CRISPR gRNA sequence
catctcaaaaaaaataaaaa

SEQ ID NO: 129567 - DNA, 20 bp, Artificial
  CRISPR gRNA sequence
aaaaaaaataaaaaataaaa

SEQ ID NO: 129568 - DNA, 20 bp, Artificial
  CRISPR gRNA sequence
tttttacaaaccaaaatgcc

SEQ ID NO: 129569 - DNA, 20 bp, Artificial
  CRISPR gRNA sequence
ttttacaaaccaaaatgcca

SEQ ID NO: 129570 - DNA, 20 bp, Artificial
  CRISPR gRNA sequence
tttacaaaccaaaatgccac

SEQ ID NO: 129571 - DNA, 20 bp, Artificial
  CRISPR gRNA sequence
ttacaaaccaaaatgccaca

SEQ ID NO: 129572 - DNA, 20 bp, Artificial
  CRISPR gRNA sequence
tacaaaccaaaatgccacaa

SEQ ID NO: 129573 - DNA, 20 bp, Artificial
  CRISPR gRNA sequence
acaaaccaaaatgccacaaa

SEQ ID NO: 129574 - DNA, 20 bp, Artificial
  CRISPR gRNA sequence
caaaccaaaatgccacaaaa

SEQ ID NO: 129575 - DNA, 20 bp, Artificial
  CRISPR gRNA sequence
tttctgataggccaacataa

SEQ ID NO: 129576 - DNA, 20 bp, Artificial
  CRISPR gRNA sequence
ctgataggccaacataacac

SEQ ID NO: 129577 - DNA, 20 bp, Artificial
  CRISPR gRNA sequence
tgataggccaacataacact

SEQ ID NO: 129578 - DNA, 20 bp, Artificial
  CRISPR gRNA sequence
ataggccaacataacactgc

SEQ ID NO: 129579 - DNA, 20 bp, Artificial
  CRISPR gRNA sequence
cctttttttttttttttttt

SEQ ID NO: 129580 - DNA, 20 bp, Artificial
  CRISPR gRNA sequence
tttttttttttttttttttg

SEQ ID NO: 129581 - DNA, 20 bp, Artificial
  CRISPR gRNA sequence
ttttttttttttttttttgg

SEQ ID NO: 129582 - DNA, 20 bp, Artificial
  CRISPR gRNA sequence
tttttttttttttttttgga

SEQ ID NO: 129583 - DNA, 20 bp, Artificial
  CRISPR gRNA sequence
ttttttttttttttttggag

SEQ ID NO: 129584 - DNA, 20 bp, Artificial
  CRISPR gRNA sequence
tttttttttttttttggaga

SEQ ID NO: 129585 - DNA, 20 bp, Artificial
  CRISPR gRNA sequence
ttttttttttttttggagac

SEQ ID NO: 129586 - DNA, 20 bp, Artificial
  CRISPR gRNA sequence
tttttttttttttggagaca

SEQ ID NO: 129587 - DNA, 20 bp, Artificial
  CRISPR gRNA sequence
ttttttttttttggagacag

SEQ ID NO: 129588 - DNA, 20 bp, Artificial
  CRISPR gRNA sequence
tttttttttttggagacagg

SEQ ID NO: 129589 - DNA, 20 bp, Artificial
  CRISPR gRNA sequence
ttttttttttggagacaggg

SEQ ID NO: 129590 - DNA, 20 bp, Artificial
  CRISPR gRNA sequence
tttttttttggagacagggt

SEQ ID NO: 129591 - DNA, 20 bp, Artificial
  CRISPR gRNA sequence
ttttttttggagacagggtc

SEQ ID NO: 129592 - DNA, 20 bp, Artificial
  CRISPR gRNA sequence
tttttttggagacagggtct

SEQ ID NO: 129593 - DNA, 20 bp, Artificial
  CRISPR gRNA sequence
ttttttggagacagggtctc

SEQ ID NO: 129594 - DNA, 20 bp, Artificial
  CRISPR gRNA sequence
tttttggagacagggtctca

SEQ ID NO: 129595 - DNA, 20 bp, Artificial
  CRISPR gRNA sequence
ttttggagacagggtctcac

SEQ ID NO: 129596 - DNA, 20 bp, Artificial
  CRISPR gRNA sequence
tttggagacagggtctcact

SEQ ID NO: 129597 - DNA, 20 bp, Artificial
  CRISPR gRNA sequence
ttggagacagggtctcactt

SEQ ID NO: 129598 - DNA, 20 bp, Artificial
  CRISPR gRNA sequence
tggagacagggtctcacttt

SEQ ID NO: 129599 - DNA, 20 bp, Artificial
  CRISPR gRNA sequence
ggagacagggtctcactttg

SEQ ID NO: 129600 - DNA, 20 bp, Artificial
  CRISPR gRNA sequence
gagacagggtctcactttgc

SEQ ID NO: 129601 - DNA, 20 bp, Artificial
  CRISPR gRNA sequence
actttgcactttgtcaccca

SEQ ID NO: 129602 - DNA, 20 bp, Artificial
  CRISPR gRNA sequence
tgcactttgtcacccaggct

SEQ ID NO: 129603 - DNA, 20 bp, Artificial
  CRISPR gRNA sequence
gcactttgtcacccaggctg

SEQ ID NO: 129604 - DNA, 20 bp, Artificial
  CRISPR gRNA sequence
cactttgtcacccaggctgg

SEQ ID NO: 129605 - DNA, 20 bp, Artificial
  CRISPR gRNA sequence
tgtcacccaggctggagtgt

SEQ ID NO: 129606 - DNA, 20 bp, Artificial
  CRISPR gRNA sequence
gtcacccaggctggagtgtg

SEQ ID NO: 129607 - DNA, 20 bp, Artificial
  CRISPR gRNA sequence
tcacccaggctggagtgtgc

SEQ ID NO: 129608 - DNA, 20 bp, Artificial
  CRISPR gRNA sequence
gagtgtgcagtggtgcaaac

SEQ ID NO: 129609 - DNA, 20 bp, Artificial
  CRISPR gRNA sequence
actgaagcctctacctccca

SEQ ID NO: 129610 - DNA, 20 bp, Artificial
  CRISPR gRNA sequence
aagcctctacctcccagatt

SEQ ID NO: 129611 - DNA, 20 bp, Artificial
  CRISPR gRNA sequence
tacctcccagattcaagcaa

SEQ ID NO: 129612 - DNA, 20 bp, Artificial
  CRISPR gRNA sequence
cctcccagattcaagcaatc

SEQ ID NO: 129613 - DNA, 20 bp, Artificial
  CRISPR gRNA sequence
ccagattcaagcaatcctcc

SEQ ID NO: 129614 - DNA, 20 bp, Artificial
  CRISPR gRNA sequence
aagcaatcctcccacctcag

SEQ ID NO: 129615 - DNA, 20 bp, Artificial
  CRISPR gRNA sequence
ccacctcagcccccagcccc

SEQ ID NO: 129616 - DNA, 20 bp, Artificial
  CRISPR gRNA sequence
agcccccagccccctaagta

SEQ ID NO: 129617 - DNA, 20 bp, Artificial
  CRISPR gRNA sequence
agtagctgggactacaggta

SEQ ID NO: 129618 - DNA, 20 bp, Artificial
  CRISPR gRNA sequence
ggactacaggtacatgccac

SEQ ID NO: 129619 - DNA, 20 bp, Artificial
  CRISPR gRNA sequence
caggtacatgccaccaagca

SEQ ID NO: 129620 - DNA, 20 bp, Artificial
  CRISPR gRNA sequence
attttttaatttttttgtag

SEQ ID NO: 129621 - DNA, 20 bp, Artificial
  CRISPR gRNA sequence
tttaatttttttgtagaggt

SEQ ID NO: 129622 - DNA, 20 bp, Artificial
  CRISPR gRNA sequence
ttaatttttttgtagaggtg

SEQ ID NO: 129623 - DNA, 20 bp, Artificial
  CRISPR gRNA sequence
taatttttttgtagaggtgg

SEQ ID NO: 129624 - DNA, 20 bp, Artificial
  CRISPR gRNA sequence
aatttttttgtagaggtggg

SEQ ID NO: 129625 - DNA, 20 bp, Artificial
  CRISPR gRNA sequence
atttttttgtagaggtgggg

SEQ ID NO: 129626 - DNA, 20 bp, Artificial
  CRISPR gRNA sequence
ttttgtagaggtggggtttc

SEQ ID NO: 129627 - DNA, 20 bp, Artificial
  CRISPR gRNA sequence
tttgtagaggtggggtttca

SEQ ID NO: 129628 - DNA, 20 bp, Artificial
  CRISPR gRNA sequence
ttgtagaggtggggtttcac

SEQ ID NO: 129629 - DNA, 20 bp, Artificial
  CRISPR gRNA sequence
tgtagaggtggggtttcacc

SEQ ID NO: 129630 - DNA, 20 bp, Artificial
  CRISPR gRNA sequence
gtagaggtggggtttcacca

SEQ ID NO: 129631 - DNA, 20 bp, Artificial
  CRISPR gRNA sequence
tagaggtggggtttcaccat

SEQ ID NO: 129632 - DNA, 20 bp, Artificial
  CRISPR gRNA sequence
caccatgttgcccaggctgg

SEQ ID NO: 129633 - DNA, 20 bp, Artificial
  CRISPR gRNA sequence
accatgttgcccaggctggt

SEQ ID NO: 129634 - DNA, 20 bp, Artificial
  CRISPR gRNA sequence
cccaggctggtctcgaactc

SEQ ID NO: 129635 - DNA, 20 bp, Artificial
  CRISPR gRNA sequence
gtctcgaactcctgagctca

SEQ ID NO: 129636 - DNA, 20 bp, Artificial
  CRISPR gRNA sequence
gaactcctgagctcaagtga

SEQ ID NO: 129637 - DNA, 20 bp, Artificial
  CRISPR gRNA sequence
ctgagctcaagtgatctgcc

SEQ ID NO: 129638 - DNA, 20 bp, Artificial
  CRISPR gRNA sequence
agctcaagtgatctgcccac

SEQ ID NO: 129639 - DNA, 20 bp, Artificial
  CRISPR gRNA sequence
aagtgatctgcccaccttgc

SEQ ID NO: 129640 - DNA, 20 bp, Artificial
  CRISPR gRNA sequence
cccaccttgccctcccaaac

SEQ ID NO: 129641 - DNA, 20 bp, Artificial
  CRISPR gRNA sequence
gccctcccaaactgctggga

SEQ ID NO: 129642 - DNA, 20 bp, Artificial
  CRISPR gRNA sequence
ccctcccaaactgctgggat

SEQ ID NO: 129643 - DNA, 20 bp, Artificial
  CRISPR gRNA sequence
ccaaactgctgggattatag

SEQ ID NO: 129644 - DNA, 20 bp, Artificial
  CRISPR gRNA sequence
ctgggattataggtgtgagc

SEQ ID NO: 129645 - DNA, 20 bp, Artificial
  CRISPR gRNA sequence
ggattataggtgtgagcacc

SEQ ID NO: 129646 - DNA, 20 bp, Artificial
  CRISPR gRNA sequence
taggtgtgagcaccacactg

SEQ ID NO: 129647 - DNA, 20 bp, Artificial
  CRISPR gRNA sequence
agccaacactaccattctaa

SEQ ID NO: 129648 - DNA, 20 bp, Artificial
  CRISPR gRNA sequence
ccattctaatacctgacata

SEQ ID NO: 129649 - DNA, 20 bp, Artificial
  CRISPR gRNA sequence
taatacctgacatagttcaa

SEQ ID NO: 129650 - DNA, 20 bp, Artificial
  CRISPR gRNA sequence
atacctgacatagttcaaag

SEQ ID NO: 129651 - DNA, 20 bp, Artificial
  CRISPR gRNA sequence
acatagttcaaagttaatat

SEQ ID NO: 129652 - DNA, 20 bp, Artificial
  CRISPR gRNA sequence
aaagttaatattgaatgaaa

SEQ ID NO: 129653 - DNA, 20 bp, Artificial
  CRISPR gRNA sequence
atattgaatgaaaaccaaaa

SEQ ID NO: 129654 - DNA, 20 bp, Artificial
  CRISPR gRNA sequence
aatgaaaaccaaaaataaat

SEQ ID NO: 129655 - DNA, 20 bp, Artificial
  CRISPR gRNA sequence
gaaatttaactcaccctcta

SEQ ID NO: 129656 - DNA, 20 bp, Artificial
  CRISPR gRNA sequence
aactcaccctctaaataatt

SEQ ID NO: 129657 - DNA, 20 bp, Artificial
  CRISPR gRNA sequence
actcaccctctaaataatta

SEQ ID NO: 129658 - DNA, 20 bp, Artificial
  CRISPR gRNA sequence
accctctaaataattatttt

SEQ ID NO: 129659 - DNA, 20 bp, Artificial
  CRISPR gRNA sequence
taaataattattttagttac

SEQ ID NO: 129660 - DNA, 20 bp, Artificial
  CRISPR gRNA sequence
aataattattttagttaccc

SEQ ID NO: 129661 - DNA, 20 bp, Artificial
  CRISPR gRNA sequence
ttttagttaccctatcaatt

SEQ ID NO: 129662 - DNA, 20 bp, Artificial
  CRISPR gRNA sequence
tagttaccctatcaattgat

SEQ ID NO: 129663 - DNA, 20 bp, Artificial
  CRISPR gRNA sequence
agttaccctatcaattgatt

SEQ ID NO: 129664 - DNA, 20 bp, Artificial
  CRISPR gRNA sequence
gttaccctatcaattgatta

SEQ ID NO: 129665 - DNA, 20 bp, Artificial
  CRISPR gRNA sequence
ccctatcaattgattataaa

SEQ ID NO: 129666 - DNA, 20 bp, Artificial
  CRISPR gRNA sequence
tcaattgattataaatttct

SEQ ID NO: 129667 - DNA, 20 bp, Artificial
  CRISPR gRNA sequence
attataaatttcttatttaa

SEQ ID NO: 129668 - DNA, 20 bp, Artificial
  CRISPR gRNA sequence
taaatttcttatttaacatt

SEQ ID NO: 129669 - DNA, 20 bp, Artificial
  CRISPR gRNA sequence
cttatttaacatttaaacag

SEQ ID NO: 129670 - DNA, 20 bp, Artificial
  CRISPR gRNA sequence
ttatttaacatttaaacagg

SEQ ID NO: 129671 - DNA, 20 bp, Artificial
  CRISPR gRNA sequence
atttaacatttaaacaggaa

SEQ ID NO: 129672 - DNA, 20 bp, Artificial
  CRISPR gRNA sequence
tttaacatttaaacaggaag

SEQ ID NO: 129673 - DNA, 20 bp, Artificial
  CRISPR gRNA sequence
aacatttaaacaggaagtcg

SEQ ID NO: 129674 - DNA, 20 bp, Artificial
  CRISPR gRNA sequence
acatttaaacaggaagtcga

SEQ ID NO: 129675 - DNA, 20 bp, Artificial
  CRISPR gRNA sequence
aaacaggaagtcgataacaa

SEQ ID NO: 129676 - DNA, 20 bp, Artificial
  CRISPR gRNA sequence
aacaggaagtcgataacaaa

SEQ ID NO: 129677 - DNA, 20 bp, Artificial
  CRISPR gRNA sequence
taaaagaaactgtacagatt

SEQ ID NO: 129678 - DNA, 20 bp, Artificial
  CRISPR gRNA sequence
aaaagaaactgtacagattt

SEQ ID NO: 129679 - DNA, 20 bp, Artificial
  CRISPR gRNA sequence
aaagaaactgtacagatttt

SEQ ID NO: 129680 - DNA, 20 bp, Artificial
  CRISPR gRNA sequence
tacagattttagacaaggtg

SEQ ID NO: 129681 - DNA, 20 bp, Artificial
  CRISPR gRNA sequence
tagacaaggtgtatttttat

SEQ ID NO: 129682 - DNA, 20 bp, Artificial
  CRISPR gRNA sequence
agacaaggtgtatttttata

SEQ ID NO: 129683 - DNA, 20 bp, Artificial
  CRISPR gRNA sequence
gacaaggtgtatttttatag

SEQ ID NO: 129684 - DNA, 20 bp, Artificial
  CRISPR gRNA sequence
ttatagtaaaagtcttttca

SEQ ID NO: 129685 - DNA, 20 bp, Artificial
  CRISPR gRNA sequence
tatagtaaaagtcttttcaa

SEQ ID NO: 129686 - DNA, 20 bp, Artificial
  CRISPR gRNA sequence
atagtaaaagtcttttcaag

SEQ ID NO: 129687 - DNA, 20 bp, Artificial
  CRISPR gRNA sequence
tagtaaaagtcttttcaagg

SEQ ID NO: 129688 - DNA, 20 bp, Artificial
  CRISPR gRNA sequence
ttcaaggactcattcttttg

SEQ ID NO: 129689 - DNA, 20 bp, Artificial
  CRISPR gRNA sequence
tcaaggactcattcttttga

SEQ ID NO: 129690 - DNA, 20 bp, Artificial
  CRISPR gRNA sequence
caaggactcattcttttgaa

SEQ ID NO: 129691 - DNA, 20 bp, Artificial
  CRISPR gRNA sequence
aaggactcattcttttgaag

SEQ ID NO: 129692 - DNA, 20 bp, Artificial
  CRISPR gRNA sequence
attcttttgaagactatttc

SEQ ID NO: 129693 - DNA, 20 bp, Artificial
  CRISPR gRNA sequence
ttttgaagactatttctaat

SEQ ID NO: 129694 - DNA, 20 bp, Artificial
  CRISPR gRNA sequence
ttgaagactatttctaataa

SEQ ID NO: 129695 - DNA, 20 bp, Artificial
  CRISPR gRNA sequence
tgaagactatttctaataaa

SEQ ID NO: 129696 - DNA, 20 bp, Artificial
  CRISPR gRNA sequence
gaagactatttctaataaaa

SEQ ID NO: 129697 - DNA, 20 bp, Artificial
  CRISPR gRNA sequence
aagactatttctaataaaaa

SEQ ID NO: 129698 - DNA, 20 bp, Artificial
  CRISPR gRNA sequence
tttctaataaaaatagcatg

SEQ ID NO: 129699 - DNA, 20 bp, Artificial
  CRISPR gRNA sequence
ctaataaaaatagcatggta

SEQ ID NO: 129700 - DNA, 20 bp, Artificial
  CRISPR gRNA sequence
taataaaaatagcatggtac

SEQ ID NO: 129701 - DNA, 20 bp, Artificial
  CRISPR gRNA sequence
ataaaaatagcatggtacgc

SEQ ID NO: 129702 - DNA, 20 bp, Artificial
  CRISPR gRNA sequence
tttagactttctcattgaac

SEQ ID NO: 129703 - DNA, 20 bp, Artificial
  CRISPR gRNA sequence
ttagactttctcattgaacc

SEQ ID NO: 129704 - DNA, 20 bp, Artificial
  CRISPR gRNA sequence
tagactttctcattgaaccg

SEQ ID NO: 129705 - DNA, 20 bp, Artificial
  CRISPR gRNA sequence
agactttctcattgaaccgt

SEQ ID NO: 129706 - DNA, 20 bp, Artificial
  CRISPR gRNA sequence
gactttctcattgaaccgta

SEQ ID NO: 129707 - DNA, 20 bp, Artificial
  CRISPR gRNA sequence
tctcattgaaccgtaacaca

SEQ ID NO: 129708 - DNA, 20 bp, Artificial
  CRISPR gRNA sequence
ctcattgaaccgtaacacaa

SEQ ID NO: 129709 - DNA, 20 bp, Artificial
  CRISPR gRNA sequence
tcattgaaccgtaacacaag

SEQ ID NO: 129710 - DNA, 20 bp, Artificial
  CRISPR gRNA sequence
attgaaccgtaacacaagat

SEQ ID NO: 129711 - DNA, 20 bp, Artificial
  CRISPR gRNA sequence
aaccgtaacacaagattgta

SEQ ID NO: 129712 - DNA, 20 bp, Artificial
  CRISPR gRNA sequence
taaattttcctataaagaca

SEQ ID NO: 129713 - DNA, 20 bp, Artificial
  CRISPR gRNA sequence
tcctataaagacacaagtag

SEQ ID NO: 129714 - DNA, 20 bp, Artificial
  CRISPR gRNA sequence
cctataaagacacaagtagc

SEQ ID NO: 129715 - DNA, 20 bp, Artificial
  CRISPR gRNA sequence
ctataaagacacaagtagcc

SEQ ID NO: 129716 - DNA, 20 bp, Artificial
  CRISPR gRNA sequence
taaagacacaagtagcctag

SEQ ID NO: 129717 - DNA, 20 bp, Artificial
  CRISPR gRNA sequence
gaacaccatattaatgaaat

SEQ ID NO: 129718 - DNA, 20 bp, Artificial
  CRISPR gRNA sequence
atgaaatgtccactttctaa

SEQ ID NO: 129719 - DNA, 20 bp, Artificial
  CRISPR gRNA sequence
tctaacttgcttcaacttga

SEQ ID NO: 129720 - DNA, 20 bp, Artificial
  CRISPR gRNA sequence
ctaacttgcttcaacttgag

SEQ ID NO: 129721 - DNA, 20 bp, Artificial
  CRISPR gRNA sequence
taacttgcttcaacttgaga

SEQ ID NO: 129722 - DNA, 20 bp, Artificial
  CRISPR gRNA sequence
acttgcttcaacttgagaat

SEQ ID NO: 129723 - DNA, 20 bp, Artificial
  CRISPR gRNA sequence
gcttcaacttgagaatttgg

SEQ ID NO: 129724 - DNA, 20 bp, Artificial
  CRISPR gRNA sequence
cttcaacttgagaatttggt

SEQ ID NO: 129725 - DNA, 20 bp, Artificial
  CRISPR gRNA sequence
caacttgagaatttggttct

SEQ ID NO: 129726 - DNA, 20 bp, Artificial
  CRISPR gRNA sequence
aacttgagaatttggttcta

SEQ ID NO: 129727 - DNA, 20 bp, Artificial
  CRISPR gRNA sequence
gagaatttggttctaattgt

SEQ ID NO: 129728 - DNA, 20 bp, Artificial
  CRISPR gRNA sequence
agaatttggttctaattgtg

SEQ ID NO: 129729 - DNA, 20 bp, Artificial
  CRISPR gRNA sequence
ggttctaattgtggcttgct

SEQ ID NO: 129730 - DNA, 20 bp, Artificial
  CRISPR gRNA sequence
gttctaattgtggcttgctt

SEQ ID NO: 129731 - DNA, 20 bp, Artificial
  CRISPR gRNA sequence
taattgtggcttgcttacca

SEQ ID NO: 129732 - DNA, 20 bp, Artificial
  CRISPR gRNA sequence
attgtggcttgcttaccatc

SEQ ID NO: 129733 - DNA, 20 bp, Artificial
  CRISPR gRNA sequence
tggcttgcttaccatcatga

SEQ ID NO: 129734 - DNA, 20 bp, Artificial
  CRISPR gRNA sequence
gcttaccatcatgaggctgt

SEQ ID NO: 129735 - DNA, 20 bp, Artificial
  CRISPR gRNA sequence
cttaccatcatgaggctgta

SEQ ID NO: 129736 - DNA, 20 bp, Artificial
  CRISPR gRNA sequence
accatcatgaggctgtataa

SEQ ID NO: 129737 - DNA, 20 bp, Artificial
  CRISPR gRNA sequence
ccatcatgaggctgtataac

SEQ ID NO: 129738 - DNA, 20 bp, Artificial
  CRISPR gRNA sequence
tataacataatgacttcctc

SEQ ID NO: 129739 - DNA, 20 bp, Artificial
  CRISPR gRNA sequence
cctccaatatagtctgcaga

SEQ ID NO: 129740 - DNA, 20 bp, Artificial
  CRISPR gRNA sequence
ctccaatatagtctgcagag

SEQ ID NO: 129741 - DNA, 20 bp, Artificial
  CRISPR gRNA sequence
caatatagtctgcagagatt

SEQ ID NO: 129742 - DNA, 20 bp, Artificial
  CRISPR gRNA sequence
cagagattcctagttgagaa

SEQ ID NO: 129743 - DNA, 20 bp, Artificial
  CRISPR gRNA sequence
ctagttgagaagcatctgtt

SEQ ID NO: 129744 - DNA, 20 bp, Artificial
  CRISPR gRNA sequence
gttgagaagcatctgttgta

SEQ ID NO: 129745 - DNA, 20 bp, Artificial
  CRISPR gRNA sequence
agaagcatctgttgtagaac

SEQ ID NO: 129746 - DNA, 20 bp, Artificial
  CRISPR gRNA sequence
ttgtagaactgtcaccatcc

SEQ ID NO: 129747 - DNA, 20 bp, Artificial
  CRISPR gRNA sequence
tagaactgtcaccatccatc

SEQ ID NO: 129748 - DNA, 20 bp, Artificial
  CRISPR gRNA sequence
tcaccatccatctatgagga

SEQ ID NO: 129749 - DNA, 20 bp, Artificial
  CRISPR gRNA sequence
tgaggagaaaaacagttttt

SEQ ID NO: 129750 - DNA, 20 bp, Artificial
  CRISPR gRNA sequence
ttcaatacttttcaaagtac

SEQ ID NO: 129751 - DNA, 20 bp, Artificial
  CRISPR gRNA sequence
tcaatacttttcaaagtact

SEQ ID NO: 129752 - DNA, 20 bp, Artificial
  CRISPR gRNA sequence
caatacttttcaaagtacta

SEQ ID NO: 129753 - DNA, 20 bp, Artificial
  CRISPR gRNA sequence
aatacttttcaaagtactaa

SEQ ID NO: 129754 - DNA, 20 bp, Artificial
  CRISPR gRNA sequence
ttcaaagtactaacaaacgt

SEQ ID NO: 129755 - DNA, 20 bp, Artificial
  CRISPR gRNA sequence
tcaaagtactaacaaacgta

SEQ ID NO: 129756 - DNA, 20 bp, Artificial
  CRISPR gRNA sequence
caaagtactaacaaacgtaa

SEQ ID NO: 129757 - DNA, 20 bp, Artificial
  CRISPR gRNA sequence
aaagtactaacaaacgtaac

SEQ ID NO: 129758 - DNA, 20 bp, Artificial
  CRISPR gRNA sequence
acaaacgtaacagattcaac

SEQ ID NO: 129759 - DNA, 20 bp, Artificial
  CRISPR gRNA sequence
aacacttataaactgtcaca

SEQ ID NO: 129760 - DNA, 20 bp, Artificial
  CRISPR gRNA sequence
ataaactgtcacaggatgat

SEQ ID NO: 129761 - DNA, 20 bp, Artificial
  CRISPR gRNA sequence
taaactgtcacaggatgatg

SEQ ID NO: 129762 - DNA, 20 bp, Artificial
  CRISPR gRNA sequence
tcacaggatgatgcatcaat

SEQ ID NO: 129763 - DNA, 20 bp, Artificial
  CRISPR gRNA sequence
tacttttcatagccttaagc

SEQ ID NO: 129764 - DNA, 20 bp, Artificial
  CRISPR gRNA sequence
ttcatagccttaagcttact

SEQ ID NO: 129765 - DNA, 20 bp, Artificial
  CRISPR gRNA sequence
tcatagccttaagcttacta

SEQ ID NO: 129766 - DNA, 20 bp, Artificial
  CRISPR gRNA sequence
catagccttaagcttactaa

SEQ ID NO: 129767 - DNA, 20 bp, Artificial
  CRISPR gRNA sequence
atagccttaagcttactaaa

SEQ ID NO: 129768 - DNA, 20 bp, Artificial
  CRISPR gRNA sequence
aagcttactaaaagagaatt

SEQ ID NO: 129769 - DNA, 20 bp, Artificial
  CRISPR gRNA sequence
agcttactaaaagagaattt

SEQ ID NO: 129770 - DNA, 20 bp, Artificial
  CRISPR gRNA sequence
actaaaagagaatttatatt

SEQ ID NO: 129771 - DNA, 20 bp, Artificial
  CRISPR gRNA sequence
ctaaaagagaatttatattt

SEQ ID NO: 129772 - DNA, 20 bp, Artificial
  CRISPR gRNA sequence
aaagagaatttatatttctt

SEQ ID NO: 129773 - DNA, 20 bp, Artificial
  CRISPR gRNA sequence
atatttcttttttaaaaaat

SEQ ID NO: 129774 - DNA, 20 bp, Artificial
  CRISPR gRNA sequence
tatttcttttttaaaaaatt

SEQ ID NO: 129775 - DNA, 20 bp, Artificial
  CRISPR gRNA sequence
cttttttaaaaaattaatta

SEQ ID NO: 129776 - DNA, 20 bp, Artificial
  CRISPR gRNA sequence
ttttttaaaaaattaattat

SEQ ID NO: 129777 - DNA, 20 bp, Artificial
  CRISPR gRNA sequence
ttttaaaaaattaattattt

SEQ ID NO: 129778 - DNA, 20 bp, Artificial
  CRISPR gRNA sequence
tttaaaaaattaattatttt

SEQ ID NO: 129779 - DNA, 20 bp, Artificial
  CRISPR gRNA sequence
ttaaaaaattaattattttt

SEQ ID NO: 129780 - DNA, 20 bp, Artificial
  CRISPR gRNA sequence
taaaaaattaattatttttt

SEQ ID NO: 129781 - DNA, 20 bp, Artificial
  CRISPR gRNA sequence
aaaaaattaattattttttt

SEQ ID NO: 129782 - DNA, 20 bp, Artificial
  CRISPR gRNA sequence
aaaaattaattatttttttg

SEQ ID NO: 129783 - DNA, 20 bp, Artificial
  CRISPR gRNA sequence
attatttttttgagacaggg

SEQ ID NO: 129784 - DNA, 20 bp, Artificial
  CRISPR gRNA sequence
tttttttgagacagggtctt

SEQ ID NO: 129785 - DNA, 20 bp, Artificial
  CRISPR gRNA sequence
ttttgagacagggtcttact

SEQ ID NO: 129786 - DNA, 20 bp, Artificial
  CRISPR gRNA sequence
tttgagacagggtcttactc

SEQ ID NO: 129787 - DNA, 20 bp, Artificial
  CRISPR gRNA sequence
ttgagacagggtcttactct

SEQ ID NO: 129788 - DNA, 20 bp, Artificial
  CRISPR gRNA sequence
tgagacagggtcttactctg

SEQ ID NO: 129789 - DNA, 20 bp, Artificial
  CRISPR gRNA sequence
gagacagggtcttactctgt

SEQ ID NO: 129790 - DNA, 20 bp, Artificial
  CRISPR gRNA sequence
agacagggtcttactctgtg

SEQ ID NO: 129791 - DNA, 20 bp, Artificial
  CRISPR gRNA sequence
actctgtggcccaggctgga

SEQ ID NO: 129792 - DNA, 20 bp, Artificial
  CRISPR gRNA sequence
ctctgtggcccaggctggag

SEQ ID NO: 129793 - DNA, 20 bp, Artificial
  CRISPR gRNA sequence
tgtggcccaggctggagtgc

SEQ ID NO: 129794 - DNA, 20 bp, Artificial
  CRISPR gRNA sequence
tggcccaggctggagtgcag

SEQ ID NO: 129795 - DNA, 20 bp, Artificial
  CRISPR gRNA sequence
gagtgcagtggcgtgatcac

SEQ ID NO: 129796 - DNA, 20 bp, Artificial
  CRISPR gRNA sequence
actgcagaatccacctccca

SEQ ID NO: 129797 - DNA, 20 bp, Artificial
  CRISPR gRNA sequence
cagaatccacctcccaggct

SEQ ID NO: 129798 - DNA, 20 bp, Artificial
  CRISPR gRNA sequence
ccaggctgaagcaatcctcc

SEQ ID NO: 129799 - DNA, 20 bp, Artificial
  CRISPR gRNA sequence
aagcaatcctcccacctcag

SEQ ID NO: 129800 - DNA, 20 bp, Artificial
  CRISPR gRNA sequence
ccacctcagcctcctgagta

SEQ ID NO: 129801 - DNA, 20 bp, Artificial
  CRISPR gRNA sequence
agcctcctgagtagctggac

SEQ ID NO: 129802 - DNA, 20 bp, Artificial
  CRISPR gRNA sequence
ctgagtagctggactacagg

SEQ ID NO: 129803 - DNA, 20 bp, Artificial
  CRISPR gRNA sequence
agtagctggactacaggcat

SEQ ID NO: 129804 - DNA, 20 bp, Artificial
  CRISPR gRNA sequence
gactacaggcatgcaccacc

SEQ ID NO: 129805 - DNA, 20 bp, Artificial
  CRISPR gRNA sequence
caggcatgcaccaccatgcc

SEQ ID NO: 129806 - DNA, 20 bp, Artificial
  CRISPR gRNA sequence
gccaatttttttgtattttt

SEQ ID NO: 129807 - DNA, 20 bp, Artificial
  CRISPR gRNA sequence
ttttgtatttttagcagaga

SEQ ID NO: 129808 - DNA, 20 bp, Artificial
  CRISPR gRNA sequence
tttgtatttttagcagagac

SEQ ID NO: 129809 - DNA, 20 bp, Artificial
  CRISPR gRNA sequence
ttgtatttttagcagagaca

SEQ ID NO: 129810 - DNA, 20 bp, Artificial
  CRISPR gRNA sequence
tgtatttttagcagagacag

SEQ ID NO: 129811 - DNA, 20 bp, Artificial
  CRISPR gRNA sequence
gtatttttagcagagacagg

SEQ ID NO: 129812 - DNA, 20 bp, Artificial
  CRISPR gRNA sequence
tatttttagcagagacaggg

SEQ ID NO: 129813 - DNA, 20 bp, Artificial
  CRISPR gRNA sequence
ttagcagagacagggttttg

SEQ ID NO: 129814 - DNA, 20 bp, Artificial
  CRISPR gRNA sequence
tagcagagacagggttttgc

SEQ ID NO: 129815 - DNA, 20 bp, Artificial
  CRISPR gRNA sequence
agcagagacagggttttgct

SEQ ID NO: 129816 - DNA, 20 bp, Artificial
  CRISPR gRNA sequence
gcagagacagggttttgcta

SEQ ID NO: 129817 - DNA, 20 bp, Artificial
  CRISPR gRNA sequence
tgctatgttgcccaggctgg

SEQ ID NO: 129818 - DNA, 20 bp, Artificial
  CRISPR gRNA sequence
gctatgttgcccaggctggt

SEQ ID NO: 129819 - DNA, 20 bp, Artificial
  CRISPR gRNA sequence
ctatgttgcccaggctggtc

SEQ ID NO: 129820 - DNA, 20 bp, Artificial
  CRISPR gRNA sequence
tgttgcccaggctggtctgg

SEQ ID NO: 129821 - DNA, 20 bp, Artificial
  CRISPR gRNA sequence
cccaggctggtctggaactc

SEQ ID NO: 129822 - DNA, 20 bp, Artificial
  CRISPR gRNA sequence
gtctggaactcctgggctca

SEQ ID NO: 129823 - DNA, 20 bp, Artificial
  CRISPR gRNA sequence
gaactcctgggctcaaacaa

SEQ ID NO: 129824 - DNA, 20 bp, Artificial
  CRISPR gRNA sequence
ctgggctcaaacaaaccacc

SEQ ID NO: 129825 - DNA, 20 bp, Artificial
  CRISPR gRNA sequence
ggctcaaacaaaccacctac

SEQ ID NO: 129826 - DNA, 20 bp, Artificial
  CRISPR gRNA sequence
aaacaaaccacctacctcag

SEQ ID NO: 129827 - DNA, 20 bp, Artificial
  CRISPR gRNA sequence
cctcagcctcccaaaatgct

SEQ ID NO: 129828 - DNA, 20 bp, Artificial
  CRISPR gRNA sequence
agcctcccaaaatgctgaga

SEQ ID NO: 129829 - DNA, 20 bp, Artificial
  CRISPR gRNA sequence
ccaaaatgctgagattacag

SEQ ID NO: 129830 - DNA, 20 bp, Artificial
  CRISPR gRNA sequence
agattacaggcatcagccac

SEQ ID NO: 129831 - DNA, 20 bp, Artificial
  CRISPR gRNA sequence
caggcatcagccaccgcaac

SEQ ID NO: 129832 - DNA, 20 bp, Artificial
  CRISPR gRNA sequence
tatttcttgatttggaaact

SEQ ID NO: 129833 - DNA, 20 bp, Artificial
  CRISPR gRNA sequence
cttgatttggaaactttccc

SEQ ID NO: 129834 - DNA, 20 bp, Artificial
  CRISPR gRNA sequence
ttgatttggaaactttccca

SEQ ID NO: 129835 - DNA, 20 bp, Artificial
  CRISPR gRNA sequence
gatttggaaactttcccaca

SEQ ID NO: 129836 - DNA, 20 bp, Artificial
  CRISPR gRNA sequence
atttggaaactttcccacaa

SEQ ID NO: 129837 - DNA, 20 bp, Artificial
  CRISPR gRNA sequence
ggaaactttcccacaatttg

SEQ ID NO: 129838 - DNA, 20 bp, Artificial
  CRISPR gRNA sequence
gaaactttcccacaatttgt

SEQ ID NO: 129839 - DNA, 20 bp, Artificial
  CRISPR gRNA sequence
tcccacaatttgtccacgat

SEQ ID NO: 129840 - DNA, 20 bp, Artificial
  CRISPR gRNA sequence
cccacaatttgtccacgatt

SEQ ID NO: 129841 - DNA, 20 bp, Artificial
  CRISPR gRNA sequence
ccacaatttgtccacgattc

SEQ ID NO: 129842 - DNA, 20 bp, Artificial
  CRISPR gRNA sequence
gtccacgattcaagatttcc

SEQ ID NO: 129843 - DNA, 20 bp, Artificial
  CRISPR gRNA sequence
tccacgattcaagatttccc

SEQ ID NO: 129844 - DNA, 20 bp, Artificial
  CRISPR gRNA sequence
aagatttccctatccatctt

SEQ ID NO: 129845 - DNA, 20 bp, Artificial
  CRISPR gRNA sequence
ccctatccatcttccataag

SEQ ID NO: 129846 - DNA, 20 bp, Artificial
  CRISPR gRNA sequence
cctatccatcttccataagt

SEQ ID NO: 129847 - DNA, 20 bp, Artificial
  CRISPR gRNA sequence
tccatcttccataagtgata

SEQ ID NO: 129848 - DNA, 20 bp, Artificial
  CRISPR gRNA sequence
ccataagtgatataagcata

SEQ ID NO: 129849 - DNA, 20 bp, Artificial
  CRISPR gRNA sequence
cataagtgatataagcataa

SEQ ID NO: 129850 - DNA, 20 bp, Artificial
  CRISPR gRNA sequence
aagcatatgcctctttcttt

SEQ ID NO: 129851 - DNA, 20 bp, Artificial
  CRISPR gRNA sequence
tttctttttaagtgcataat

SEQ ID NO: 129852 - DNA, 20 bp, Artificial
  CRISPR gRNA sequence
tctttttaagtgcataatct

SEQ ID NO: 129853 - DNA, 20 bp, Artificial
  CRISPR gRNA sequence
ctttttaagtgcataatctt

SEQ ID NO: 129854 - DNA, 20 bp, Artificial
  CRISPR gRNA sequence
tttttaagtgcataatcttc

SEQ ID NO: 129855 - DNA, 20 bp, Artificial
  CRISPR gRNA sequence
tttaagtgcataatcttcaa

SEQ ID NO: 129856 - DNA, 20 bp, Artificial
  CRISPR gRNA sequence
ttaagtgcataatcttcaaa

SEQ ID NO: 129857 - DNA, 20 bp, Artificial
  CRISPR gRNA sequence
taagtgcataatcttcaaat

SEQ ID NO: 129858 - DNA, 20 bp, Artificial
  CRISPR gRNA sequence
aagtgcataatcttcaaata

SEQ ID NO: 129859 - DNA, 20 bp, Artificial
  CRISPR gRNA sequence
agtgcataatcttcaaatat

SEQ ID NO: 129860 - DNA, 20 bp, Artificial
  CRISPR gRNA sequence
caaatatagtaccacaggca

SEQ ID NO: 129861 - DNA, 20 bp, Artificial
  CRISPR gRNA sequence
aaatatagtaccacaggcaa

SEQ ID NO: 129862 - DNA, 20 bp, Artificial
  CRISPR gRNA sequence
acttacaacctaatttatcc

SEQ ID NO: 129863 - DNA, 20 bp, Artificial
  CRISPR gRNA sequence
acaacctaatttatccctgg

SEQ ID NO: 129864 - DNA, 20 bp, Artificial
  CRISPR gRNA sequence
caacctaatttatccctgga

SEQ ID NO: 129865 - DNA, 20 bp, Artificial
  CRISPR gRNA sequence
atttatccctggaatgatga

SEQ ID NO: 129866 - DNA, 20 bp, Artificial
  CRISPR gRNA sequence
atccctggaatgatgatcag

SEQ ID NO: 129867 - DNA, 20 bp, Artificial
  CRISPR gRNA sequence
tccctggaatgatgatcagc

SEQ ID NO: 129868 - DNA, 20 bp, Artificial
  CRISPR gRNA sequence
gaatgatgatcagcttagta

SEQ ID NO: 129869 - DNA, 20 bp, Artificial
  CRISPR gRNA sequence
agtaaagctgtacacagtgt

SEQ ID NO: 129870 - DNA, 20 bp, Artificial
  CRISPR gRNA sequence
gtaaagctgtacacagtgtc

SEQ ID NO: 129871 - DNA, 20 bp, Artificial
  CRISPR gRNA sequence
tacacagtgtcatgtacctg

SEQ ID NO: 129872 - DNA, 20 bp, Artificial
  CRISPR gRNA sequence
tagccccaactgctcagaag

SEQ ID NO: 129873 - DNA, 20 bp, Artificial
  CRISPR gRNA sequence
ctcagaagctgaagcaggag

SEQ ID NO: 129874 - DNA, 20 bp, Artificial
  CRISPR gRNA sequence
agaagctgaagcaggaggac

SEQ ID NO: 129875 - DNA, 20 bp, Artificial
  CRISPR gRNA sequence
aagcaggaggactgcttgag

SEQ ID NO: 129876 - DNA, 20 bp, Artificial
  CRISPR gRNA sequence
cttgagctcaagagttccag

SEQ ID NO: 129877 - DNA, 20 bp, Artificial
  CRISPR gRNA sequence
gagctcaagagttccagacc

SEQ ID NO: 129878 - DNA, 20 bp, Artificial
  CRISPR gRNA sequence
agctcaagagttccagacca

SEQ ID NO: 129879 - DNA, 20 bp, Artificial
  CRISPR gRNA sequence
aagagttccagaccagcctg

SEQ ID NO: 129880 - DNA, 20 bp, Artificial
  CRISPR gRNA sequence
cagaccagcctggtcaatgt

SEQ ID NO: 129881 - DNA, 20 bp, Artificial
  CRISPR gRNA sequence
gtcaatgtagtgagaacctg

SEQ ID NO: 129882 - DNA, 20 bp, Artificial
  CRISPR gRNA sequence
tctcttaaaaaaaaaaatca

SEQ ID NO: 129883 - DNA, 20 bp, Artificial
  CRISPR gRNA sequence
ttaaaaaaaaaaatcagctt

SEQ ID NO: 129884 - DNA, 20 bp, Artificial
  CRISPR gRNA sequence
aaaaaaaaaaatcagcttaa

SEQ ID NO: 129885 - DNA, 20 bp, Artificial
  CRISPR gRNA sequence
aaaaaaaaaatcagcttaag

SEQ ID NO: 129886 - DNA, 20 bp, Artificial
  CRISPR gRNA sequence
aagtcatcaactggaattca

SEQ ID NO: 129887 - DNA, 20 bp, Artificial
  CRISPR gRNA sequence
agtcatcaactggaattcac

SEQ ID NO: 129888 - DNA, 20 bp, Artificial
  CRISPR gRNA sequence
gaattcacctgtatccatca

SEQ ID NO: 129889 - DNA, 20 bp, Artificial
  CRISPR gRNA sequence
acctgtatccatcacttcca

SEQ ID NO: 129890 - DNA, 20 bp, Artificial
  CRISPR gRNA sequence
tatccatcacttccagctct

SEQ ID NO: 129891 - DNA, 20 bp, Artificial
  CRISPR gRNA sequence
ccagctctcctgctaaaccc

SEQ ID NO: 129892 - DNA, 20 bp, Artificial
  CRISPR gRNA sequence
cagctctcctgctaaaccct

SEQ ID NO: 129893 - DNA, 20 bp, Artificial
  CRISPR gRNA sequence
tcctgctaaaccctgatttt

SEQ ID NO: 129894 - DNA, 20 bp, Artificial
  CRISPR gRNA sequence
ctgctaaaccctgattttcc

SEQ ID NO: 129895 - DNA, 20 bp, Artificial
  CRISPR gRNA sequence
ctaaaccctgattttccttt

SEQ ID NO: 129896 - DNA, 20 bp, Artificial
  CRISPR gRNA sequence
aaccctgattttccttttgc

SEQ ID NO: 129897 - DNA, 20 bp, Artificial
  CRISPR gRNA sequence
attttccttttgctcctgct

SEQ ID NO: 129898 - DNA, 20 bp, Artificial
  CRISPR gRNA sequence
tccttttgctcctgcttgcg

SEQ ID NO: 129899 - DNA, 20 bp, Artificial
  CRISPR gRNA sequence
ccttttgctcctgcttgcga

SEQ ID NO: 129900 - DNA, 20 bp, Artificial
  CRISPR gRNA sequence
cttttgctcctgcttgcgaa

SEQ ID NO: 129901 - DNA, 20 bp, Artificial
  CRISPR gRNA sequence
ttgctcctgcttgcgaactt

SEQ ID NO: 129902 - DNA, 20 bp, Artificial
  CRISPR gRNA sequence
tgctcctgcttgcgaacttt

SEQ ID NO: 129903 - DNA, 20 bp, Artificial
  CRISPR gRNA sequence
gctcctgcttgcgaactttc

SEQ ID NO: 129904 - DNA, 20 bp, Artificial
  CRISPR gRNA sequence
ctcctgcttgcgaactttct

SEQ ID NO: 129905 - DNA, 20 bp, Artificial
  CRISPR gRNA sequence
ctgcttgcgaactttctttg

SEQ ID NO: 129906 - DNA, 20 bp, Artificial
  CRISPR gRNA sequence
cttgcgaactttctttgctt

SEQ ID NO: 129907 - DNA, 20 bp, Artificial
  CRISPR gRNA sequence
gcgaactttctttgctttct

SEQ ID NO: 129908 - DNA, 20 bp, Artificial
  CRISPR gRNA sequence
cgaactttctttgctttctc

SEQ ID NO: 129909 - DNA, 20 bp, Artificial
  CRISPR gRNA sequence
tctttgctttctcatagaag

SEQ ID NO: 129910 - DNA, 20 bp, Artificial
  CRISPR gRNA sequence
ctttgctttctcatagaagt

SEQ ID NO: 129911 - DNA, 20 bp, Artificial
  CRISPR gRNA sequence
tttgctttctcatagaagtt

SEQ ID NO: 129912 - DNA, 20 bp, Artificial
  CRISPR gRNA sequence
tgctttctcatagaagttcc

SEQ ID NO: 129913 - DNA, 20 bp, Artificial
  CRISPR gRNA sequence
gctttctcatagaagttcca

SEQ ID NO: 129914 - DNA, 20 bp, Artificial
  CRISPR gRNA sequence
ctttctcatagaagttccaa

SEQ ID NO: 129915 - DNA, 20 bp, Artificial
  CRISPR gRNA sequence
tctcatagaagttccaaaat

SEQ ID NO: 129916 - DNA, 20 bp, Artificial
  CRISPR gRNA sequence
ctcatagaagttccaaaata

SEQ ID NO: 129917 - DNA, 20 bp, Artificial
  CRISPR gRNA sequence
tcatagaagttccaaaatag

SEQ ID NO: 129918 - DNA, 20 bp, Artificial
  CRISPR gRNA sequence
atagaagttccaaaatagac

SEQ ID NO: 129919 - DNA, 20 bp, Artificial
  CRISPR gRNA sequence
caaaatagacaatgtctccg

SEQ ID NO: 129920 - DNA, 20 bp, Artificial
  CRISPR gRNA sequence
cgttcaaactgttacttggt

SEQ ID NO: 129921 - DNA, 20 bp, Artificial
  CRISPR gRNA sequence
aaactgttacttggtataag

SEQ ID NO: 129922 - DNA, 20 bp, Artificial
  CRISPR gRNA sequence
ttacttggtataagaagcat

SEQ ID NO: 129923 - DNA, 20 bp, Artificial
  CRISPR gRNA sequence
cttggtataagaagcatgcg

SEQ ID NO: 129924 - DNA, 20 bp, Artificial
  CRISPR gRNA sequence
ggtataagaagcatgcggat

SEQ ID NO: 129925 - DNA, 20 bp, Artificial
  CRISPR gRNA sequence
gtataagaagcatgcggatt

SEQ ID NO: 129926 - DNA, 20 bp, Artificial
  CRISPR gRNA sequence
tctgcacaattctgtaccca

SEQ ID NO: 129927 - DNA, 20 bp, Artificial
  CRISPR gRNA sequence
tgcacaattctgtacccagg

SEQ ID NO: 129928 - DNA, 20 bp, Artificial
  CRISPR gRNA sequence
cacaattctgtacccaggca

SEQ ID NO: 129929 - DNA, 20 bp, Artificial
  CRISPR gRNA sequence
tgtacccaggcaagccaaaa

SEQ ID NO: 129930 - DNA, 20 bp, Artificial
  CRISPR gRNA sequence
tacccaggcaagccaaaagt

SEQ ID NO: 129931 - DNA, 20 bp, Artificial
  CRISPR gRNA sequence
tgaatgaacccataaactcc

SEQ ID NO: 129932 - DNA, 20 bp, Artificial
  CRISPR gRNA sequence
gaatgaacccataaactcct

SEQ ID NO: 129933 - DNA, 20 bp, Artificial
  CRISPR gRNA sequence
aatgaacccataaactcctg

SEQ ID NO: 129934 - DNA, 20 bp, Artificial
  CRISPR gRNA sequence
ctgattctagtcaaaggtta

SEQ ID NO: 129935 - DNA, 20 bp, Artificial
  CRISPR gRNA sequence
attctagtcaaaggttaatt

SEQ ID NO: 129936 - DNA, 20 bp, Artificial
  CRISPR gRNA sequence
tagtcaaaggttaattttct

SEQ ID NO: 129937 - DNA, 20 bp, Artificial
  CRISPR gRNA sequence
gtcaaaggttaattttctct

SEQ ID NO: 129938 - DNA, 20 bp, Artificial
  CRISPR gRNA sequence
attttctctccccctgccaa

SEQ ID NO: 129939 - DNA, 20 bp, Artificial
  CRISPR gRNA sequence
tctctccccctgccaaatca

SEQ ID NO: 129940 - DNA, 20 bp, Artificial
  CRISPR gRNA sequence
ctctccccctgccaaatcag

SEQ ID NO: 129941 - DNA, 20 bp, Artificial
  CRISPR gRNA sequence
tctccccctgccaaatcagg

SEQ ID NO: 129942 - DNA, 20 bp, Artificial
  CRISPR gRNA sequence
tccccctgccaaatcagggc

SEQ ID NO: 129943 - DNA, 20 bp, Artificial
  CRISPR gRNA sequence
cccctgccaaatcagggcca

SEQ ID NO: 129944 - DNA, 20 bp, Artificial
  CRISPR gRNA sequence
ccaaatcagggccaggtgtg

SEQ ID NO: 129945 - DNA, 20 bp, Artificial
  CRISPR gRNA sequence
atgcctgtaatcccagaact

SEQ ID NO: 129946 - DNA, 20 bp, Artificial
  CRISPR gRNA sequence
taatcccagaactttgggaa

SEQ ID NO: 129947 - DNA, 20 bp, Artificial
  CRISPR gRNA sequence
tgggaagccaaggtgggagg

SEQ ID NO: 129948 - DNA, 20 bp, Artificial
  CRISPR gRNA sequence
gggaagccaaggtgggagga

SEQ ID NO: 129949 - DNA, 20 bp, Artificial
  CRISPR gRNA sequence
ggaagccaaggtgggaggat

SEQ ID NO: 129950 - DNA, 20 bp, Artificial
  CRISPR gRNA sequence
gggcccagaagttcaagatc

SEQ ID NO: 129951 - DNA, 20 bp, Artificial
  CRISPR gRNA sequence
ggcccagaagttcaagatca

SEQ ID NO: 129952 - DNA, 20 bp, Artificial
  CRISPR gRNA sequence
aagatcagcctgggcaacac

SEQ ID NO: 129953 - DNA, 20 bp, Artificial
  CRISPR gRNA sequence
ggcaacacagtgagaccctg

SEQ ID NO: 129954 - DNA, 20 bp, Artificial
  CRISPR gRNA sequence
tctctaaaaaaaaacaaaaa

SEQ ID NO: 129955 - DNA, 20 bp, Artificial
  CRISPR gRNA sequence
taaaaaaaaacaaaaattaa

SEQ ID NO: 129956 - DNA, 20 bp, Artificial
  CRISPR gRNA sequence
aaaaaaaacaaaaattaaga

SEQ ID NO: 129957 - DNA, 20 bp, Artificial
  CRISPR gRNA sequence
agaaattagccaggcgttgt

SEQ ID NO: 129958 - DNA, 20 bp, Artificial
  CRISPR gRNA sequence
gccaggcgttgtggcatgtg

SEQ ID NO: 129959 - DNA, 20 bp, Artificial
  CRISPR gRNA sequence
tggcatgtgcctgtagtcct

SEQ ID NO: 129960 - DNA, 20 bp, Artificial
  CRISPR gRNA sequence
tagtcctaactacttgagag

SEQ ID NO: 129961 - DNA, 20 bp, Artificial
  CRISPR gRNA sequence
actacttgagaggctgaggt

SEQ ID NO: 129962 - DNA, 20 bp, Artificial
  CRISPR gRNA sequence
cttgagaggctgaggtggga

SEQ ID NO: 129963 - DNA, 20 bp, Artificial
  CRISPR gRNA sequence
gagaggctgaggtgggaaga

SEQ ID NO: 129964 - DNA, 20 bp, Artificial
  CRISPR gRNA sequence
agaggctgaggtgggaagat

SEQ ID NO: 129965 - DNA, 20 bp, Artificial
  CRISPR gRNA sequence
aggtgggaagatcacttgag

SEQ ID NO: 129966 - DNA, 20 bp, Artificial
  CRISPR gRNA sequence
gagcctaggaggttgaggct

SEQ ID NO: 129967 - DNA, 20 bp, Artificial
  CRISPR gRNA sequence
agcctaggaggttgaggctg

SEQ ID NO: 129968 - DNA, 20 bp, Artificial
  CRISPR gRNA sequence
ggaggttgaggctgcagtga

SEQ ID NO: 129969 - DNA, 20 bp, Artificial
  CRISPR gRNA sequence
aggctgcagtgagctgtgat

SEQ ID NO: 129970 - DNA, 20 bp, Artificial
  CRISPR gRNA sequence
cagtgagctgtgatcacacc

SEQ ID NO: 129971 - DNA, 20 bp, Artificial
  CRISPR gRNA sequence
tgatcacaccactgcactcc

SEQ ID NO: 129972 - DNA, 20 bp, Artificial
  CRISPR gRNA sequence
cactccagcctcagtgacag

SEQ ID NO: 129973 - DNA, 20 bp, Artificial
  CRISPR gRNA sequence
cagcctcagtgacagagtgg

SEQ ID NO: 129974 - DNA, 20 bp, Artificial
  CRISPR gRNA sequence
agtgacagagtggggtcagg

SEQ ID NO: 129975 - DNA, 20 bp, Artificial
  CRISPR gRNA sequence
tgtataaagataggaaaatt

SEQ ID NO: 129976 - DNA, 20 bp, Artificial
  CRISPR gRNA sequence
cctgcacagacaagaataag

SEQ ID NO: 129977 - DNA, 20 bp, Artificial
  CRISPR gRNA sequence
cacagacaagaataagagtt

SEQ ID NO: 129978 - DNA, 20 bp, Artificial
  CRISPR gRNA sequence
aaattcctattttaaaaaaa

SEQ ID NO: 129979 - DNA, 20 bp, Artificial
  CRISPR gRNA sequence
ctattttaaaaaaagcctgc

SEQ ID NO: 129980 - DNA, 20 bp, Artificial
  CRISPR gRNA sequence
ttttaaaaaaagcctgctta

SEQ ID NO: 129981 - DNA, 20 bp, Artificial
  CRISPR gRNA sequence
taaaaaaagcctgcttaatt

SEQ ID NO: 129982 - DNA, 20 bp, Artificial
  CRISPR gRNA sequence
aaaaaaagcctgcttaatta

SEQ ID NO: 129983 - DNA, 20 bp, Artificial
  CRISPR gRNA sequence
aaaaaagcctgcttaattaa

SEQ ID NO: 129984 - DNA, 20 bp, Artificial
  CRISPR gRNA sequence
cttaattaattttgctgaga

SEQ ID NO: 129985 - DNA, 20 bp, Artificial
  CRISPR gRNA sequence
aattaattttgctgagagct

SEQ ID NO: 129986 - DNA, 20 bp, Artificial
  CRISPR gRNA sequence
attaattttgctgagagcta

SEQ ID NO: 129987 - DNA, 20 bp, Artificial
  CRISPR gRNA sequence
attttgctgagagctaaaag

SEQ ID NO: 129988 - DNA, 20 bp, Artificial
  CRISPR gRNA sequence
tgctgagagctaaaagaatt

SEQ ID NO: 129989 - DNA, 20 bp, Artificial
  CRISPR gRNA sequence
gctgagagctaaaagaattc

SEQ ID NO: 129990 - DNA, 20 bp, Artificial
  CRISPR gRNA sequence
ctgagagctaaaagaattcc

SEQ ID NO: 129991 - DNA, 20 bp, Artificial
  CRISPR gRNA sequence
agagctaaaagaattccaag

SEQ ID NO: 129992 - DNA, 20 bp, Artificial
  CRISPR gRNA sequence
aaagaattccaagagggaaa

SEQ ID NO: 129993 - DNA, 20 bp, Artificial
  CRISPR gRNA sequence
caagagggaaagtctggaaa

SEQ ID NO: 129994 - DNA, 20 bp, Artificial
  CRISPR gRNA sequence
gaaaaaagtaaatcataagc

SEQ ID NO: 129995 - DNA, 20 bp, Artificial
  CRISPR gRNA sequence
agctggctccattcaatttc

SEQ ID NO: 129996 - DNA, 20 bp, Artificial
  CRISPR gRNA sequence
gctccattcaatttcaccaa

SEQ ID NO: 129997 - DNA, 20 bp, Artificial
  CRISPR gRNA sequence
cattcaatttcaccaacatg

SEQ ID NO: 129998 - DNA, 20 bp, Artificial
  CRISPR gRNA sequence
aatttcaccaacatggcaga

SEQ ID NO: 129999 - DNA, 20 bp, Artificial
  CRISPR gRNA sequence
caccaacatggcagatccta

SEQ ID NO: 130000 - DNA, 20 bp, Artificial
  CRISPR gRNA sequence
accaacatggcagatcctag

SEQ ID NO: 130001 - DNA, 20 bp, Artificial
  CRISPR gRNA sequence
gaaggctttctgttttgcaa

SEQ ID NO: 130002 - DNA, 20 bp, Artificial
  CRISPR gRNA sequence
tctgttttgcaaatactact

SEQ ID NO: 130003 - DNA, 20 bp, Artificial
  CRISPR gRNA sequence
ctgttttgcaaatactacta

SEQ ID NO: 130004 - DNA, 20 bp, Artificial
  CRISPR gRNA sequence
tgttttgcaaatactactac

SEQ ID NO: 130005 - DNA, 20 bp, Artificial
  CRISPR gRNA sequence
ttttgcaaatactactactc

SEQ ID NO: 130006 - DNA, 20 bp, Artificial
  CRISPR gRNA sequence
tgcaaatactactactcaaa

SEQ ID NO: 130007 - DNA, 20 bp, Artificial
  CRISPR gRNA sequence
gcaaatactactactcaaaa

SEQ ID NO: 130008 - DNA, 20 bp, Artificial
  CRISPR gRNA sequence
caaatactactactcaaaat

SEQ ID NO: 130009 - DNA, 20 bp, Artificial
  CRISPR gRNA sequence
ctactcaaaataagatatct

SEQ ID NO: 130010 - DNA, 20 bp, Artificial
  CRISPR gRNA sequence
ctcaaaataagatatctgtg

SEQ ID NO: 130011 - DNA, 20 bp, Artificial
  CRISPR gRNA sequence
aaaataagatatctgtgagt

SEQ ID NO: 130012 - DNA, 20 bp, Artificial
  CRISPR gRNA sequence
tgagtgaaaaaatgttaaat

SEQ ID NO: 130013 - DNA, 20 bp, Artificial
  CRISPR gRNA sequence
aatgcattatctgaataaaa

SEQ ID NO: 130014 - DNA, 20 bp, Artificial
  CRISPR gRNA sequence
tctgaataaaaagtatagca

SEQ ID NO: 130015 - DNA, 20 bp, Artificial
  CRISPR gRNA sequence
aataaaaagtatagcaaaaa

SEQ ID NO: 130016 - DNA, 20 bp, Artificial
  CRISPR gRNA sequence
atacatactttcaggctgaa

SEQ ID NO: 130017 - DNA, 20 bp, Artificial
  CRISPR gRNA sequence
tcaggctgaacaaagaaatt

SEQ ID NO: 130018 - DNA, 20 bp, Artificial
  CRISPR gRNA sequence
caggctgaacaaagaaattt

SEQ ID NO: 130019 - DNA, 20 bp, Artificial
  CRISPR gRNA sequence
aggctgaacaaagaaatttg

SEQ ID NO: 130020 - DNA, 20 bp, Artificial
  CRISPR gRNA sequence
aacaaagaaatttgaccctt

SEQ ID NO: 130021 - DNA, 20 bp, Artificial
  CRISPR gRNA sequence
gacccttcattaaggcccag

SEQ ID NO: 130022 - DNA, 20 bp, Artificial
  CRISPR gRNA sequence
acccttcattaaggcccagg

SEQ ID NO: 130023 - DNA, 20 bp, Artificial
  CRISPR gRNA sequence
cattaaggcccaggacccag

SEQ ID NO: 130024 - DNA, 20 bp, Artificial
  CRISPR gRNA sequence
attaaggcccaggacccagt

SEQ ID NO: 130025 - DNA, 20 bp, Artificial
  CRISPR gRNA sequence
aggcccaggacccagtataa

SEQ ID NO: 130026 - DNA, 20 bp, Artificial
  CRISPR gRNA sequence
aatgttattaattgcaaaat

SEQ ID NO: 130027 - DNA, 20 bp, Artificial
  CRISPR gRNA sequence
atgttattaattgcaaaatt

SEQ ID NO: 130028 - DNA, 20 bp, Artificial
  CRISPR gRNA sequence
ttaattgcaaaattttagtc

SEQ ID NO: 130029 - DNA, 20 bp, Artificial
  CRISPR gRNA sequence
attgcaaaattttagtcctt

SEQ ID NO: 130030 - DNA, 20 bp, Artificial
  CRISPR gRNA sequence
caaaattttagtccttgtat

SEQ ID NO: 130031 - DNA, 20 bp, Artificial
  CRISPR gRNA sequence
tagtccttgtataacacatg

SEQ ID NO: 130032 - DNA, 20 bp, Artificial
  CRISPR gRNA sequence
agtccttgtataacacatgt

SEQ ID NO: 130033 - DNA, 20 bp, Artificial
  CRISPR gRNA sequence
gtccttgtataacacatgtc

SEQ ID NO: 130034 - DNA, 20 bp, Artificial
  CRISPR gRNA sequence
gtataacacatgtcttctcc

SEQ ID NO: 130035 - DNA, 20 bp, Artificial
  CRISPR gRNA sequence
tataacacatgtcttctcca

SEQ ID NO: 130036 - DNA, 20 bp, Artificial
  CRISPR gRNA sequence
ctccatctctgttgaatttt

SEQ ID NO: 130037 - DNA, 20 bp, Artificial
  CRISPR gRNA sequence
tccatctctgttgaattttt

SEQ ID NO: 130038 - DNA, 20 bp, Artificial
  CRISPR gRNA sequence
catctctgttgaatttttat

SEQ ID NO: 130039 - DNA, 20 bp, Artificial
  CRISPR gRNA sequence
tgttgaatttttatttaata

SEQ ID NO: 130040 - DNA, 20 bp, Artificial
  CRISPR gRNA sequence
ttgaatttttatttaatatt

SEQ ID NO: 130041 - DNA, 20 bp, Artificial
  CRISPR gRNA sequence
aatttttatttaatattaaa

SEQ ID NO: 130042 - DNA, 20 bp, Artificial
  CRISPR gRNA sequence
ttatttaatattaaaatact

SEQ ID NO: 130043 - DNA, 20 bp, Artificial
  CRISPR gRNA sequence
tatttaatattaaaatactg

SEQ ID NO: 130044 - DNA, 20 bp, Artificial
  CRISPR gRNA sequence
atttaatattaaaatactgg

SEQ ID NO: 130045 - DNA, 20 bp, Artificial
  CRISPR gRNA sequence
tttaatattaaaatactggg

SEQ ID NO: 130046 - DNA, 20 bp, Artificial
  CRISPR gRNA sequence
aatattaaaatactgggcta

SEQ ID NO: 130047 - DNA, 20 bp, Artificial
  CRISPR gRNA sequence
atattaaaatactgggctag

SEQ ID NO: 130048 - DNA, 20 bp, Artificial
  CRISPR gRNA sequence
aaatactgggctagtttcca

SEQ ID NO: 130049 - DNA, 20 bp, Artificial
  CRISPR gRNA sequence
ggctagtttccaggtcttca

SEQ ID NO: 130050 - DNA, 20 bp, Artificial
  CRISPR gRNA sequence
gtttccaggtcttcaataac

SEQ ID NO: 130051 - DNA, 20 bp, Artificial
  CRISPR gRNA sequence
ccaggtcttcaataacacgg

SEQ ID NO: 130052 - DNA, 20 bp, Artificial
  CRISPR gRNA sequence
caggtcttcaataacacggc

SEQ ID NO: 130053 - DNA, 20 bp, Artificial
  CRISPR gRNA sequence
caataacacggcatttcttt

SEQ ID NO: 130054 - DNA, 20 bp, Artificial
  CRISPR gRNA sequence
aataacacggcatttctttc

SEQ ID NO: 130055 - DNA, 20 bp, Artificial
  CRISPR gRNA sequence
ctttcatgcatctgttgact

SEQ ID NO: 130056 - DNA, 20 bp, Artificial
  CRISPR gRNA sequence
tttcatgcatctgttgactg

SEQ ID NO: 130057 - DNA, 20 bp, Artificial
  CRISPR gRNA sequence
tcatgcatctgttgactgtg

SEQ ID NO: 130058 - DNA, 20 bp, Artificial
  CRISPR gRNA sequence
catgcatctgttgactgtga

SEQ ID NO: 130059 - DNA, 20 bp, Artificial
  CRISPR gRNA sequence
atgcatctgttgactgtgat

SEQ ID NO: 130060 - DNA, 20 bp, Artificial
  CRISPR gRNA sequence
ttgactgtgatgcctaatat

SEQ ID NO: 130061 - DNA, 20 bp, Artificial
  CRISPR gRNA sequence
actgtgatgcctaatataac

SEQ ID NO: 130062 - DNA, 20 bp, Artificial
  CRISPR gRNA sequence
tgatgcctaatataactgta

SEQ ID NO: 130063 - DNA, 20 bp, Artificial
  CRISPR gRNA sequence
atataactgtagatagagac

SEQ ID NO: 130064 - DNA, 20 bp, Artificial
  CRISPR gRNA sequence
tagatagagacacatttcta

SEQ ID NO: 130065 - DNA, 20 bp, Artificial
  CRISPR gRNA sequence
ctataatttatatagttgtt

SEQ ID NO: 130066 - DNA, 20 bp, Artificial
  CRISPR gRNA sequence
tataatttatatagttgttg

SEQ ID NO: 130067 - DNA, 20 bp, Artificial
  CRISPR gRNA sequence
taatttatatagttgttgta

SEQ ID NO: 130068 - DNA, 20 bp, Artificial
  CRISPR gRNA sequence
atatagttgttgtaaggggg

SEQ ID NO: 130069 - DNA, 20 bp, Artificial
  CRISPR gRNA sequence
tatagttgttgtaagggggt

SEQ ID NO: 130070 - DNA, 20 bp, Artificial
  CRISPR gRNA sequence
ttgtaagggggtagaaaata

SEQ ID NO: 130071 - DNA, 20 bp, Artificial
  CRISPR gRNA sequence
taagggggtagaaaatagaa

SEQ ID NO: 130072 - DNA, 20 bp, Artificial
  CRISPR gRNA sequence
acagacctttaataatctgt

SEQ ID NO: 130073 - DNA, 20 bp, Artificial
  CRISPR gRNA sequence
cagacctttaataatctgtg

SEQ ID NO: 130074 - DNA, 20 bp, Artificial
  CRISPR gRNA sequence
taataatctgtgaacatagg

SEQ ID NO: 130075 - DNA, 20 bp, Artificial
  CRISPR gRNA sequence
aataatctgtgaacataggg

SEQ ID NO: 130076 - DNA, 20 bp, Artificial
  CRISPR gRNA sequence
ataatctgtgaacatagggt

SEQ ID NO: 130077 - DNA, 20 bp, Artificial
  CRISPR gRNA sequence
tgaacatagggtacctattt

SEQ ID NO: 130078 - DNA, 20 bp, Artificial
  CRISPR gRNA sequence
tttgatacttttagtagcct

SEQ ID NO: 130079 - DNA, 20 bp, Artificial
  CRISPR gRNA sequence
gatacttttagtagcctcta

SEQ ID NO: 130080 - DNA, 20 bp, Artificial
  CRISPR gRNA sequence
atacttttagtagcctctaa

SEQ ID NO: 130081 - DNA, 20 bp, Artificial
  CRISPR gRNA sequence
ttagtagcctctaagaagta

SEQ ID NO: 130082 - DNA, 20 bp, Artificial
  CRISPR gRNA sequence
tagtagcctctaagaagtaa

SEQ ID NO: 130083 - DNA, 20 bp, Artificial
  CRISPR gRNA sequence
agtagcctctaagaagtaaa

SEQ ID NO: 130084 - DNA, 20 bp, Artificial
  CRISPR gRNA sequence
gtagcctctaagaagtaaac

SEQ ID NO: 130085 - DNA, 20 bp, Artificial
  CRISPR gRNA sequence
taagaagtaaacaacaaagt

SEQ ID NO: 130086 - DNA, 20 bp, Artificial
  CRISPR gRNA sequence
agaagtaaacaacaaagtca

SEQ ID NO: 130087 - DNA, 20 bp, Artificial
  CRISPR gRNA sequence
attctgactctcctactgat

SEQ ID NO: 130088 - DNA, 20 bp, Artificial
  CRISPR gRNA sequence
tgactctcctactgatcccc

SEQ ID NO: 130089 - DNA, 20 bp, Artificial
  CRISPR gRNA sequence
actctcctactgatcccctg

SEQ ID NO: 130090 - DNA, 20 bp, Artificial
  CRISPR gRNA sequence
tcctactgatcccctgaaaa

SEQ ID NO: 130091 - DNA, 20 bp, Artificial
  CRISPR gRNA sequence
ctactgatcccctgaaaata

SEQ ID NO: 130092 - DNA, 20 bp, Artificial
  CRISPR gRNA sequence
ctgatcccctgaaaataagc

SEQ ID NO: 130093 - DNA, 20 bp, Artificial
  CRISPR gRNA sequence
atcccctgaaaataagcatc

SEQ ID NO: 130094 - DNA, 20 bp, Artificial
  CRISPR gRNA sequence
aaaataagcatccctgccaa

SEQ ID NO: 130095 - DNA, 20 bp, Artificial
  CRISPR gRNA sequence
ccaattaaatgtatttccat

SEQ ID NO: 130096 - DNA, 20 bp, Artificial
  CRISPR gRNA sequence
aatgtatttccatataaaat

SEQ ID NO: 130097 - DNA, 20 bp, Artificial
  CRISPR gRNA sequence
ccatataaaatgtaaataac

SEQ ID NO: 130098 - DNA, 20 bp, Artificial
  CRISPR gRNA sequence
catataaaatgtaaataaca

SEQ ID NO: 130099 - DNA, 20 bp, Artificial
  CRISPR gRNA sequence
cccatcttaaactaacacaa

SEQ ID NO: 130100 - DNA, 20 bp, Artificial
  CRISPR gRNA sequence
aaactaacacaaataaatgt

SEQ ID NO: 130101 - DNA, 20 bp, Artificial
  CRISPR gRNA sequence
aactaacacaaataaatgtg

SEQ ID NO: 130102 - DNA, 20 bp, Artificial
  CRISPR gRNA sequence
acacaaataaatgtgaaaca

SEQ ID NO: 130103 - DNA, 20 bp, Artificial
  CRISPR gRNA sequence
ttttgatcttaaaatgctaa

SEQ ID NO: 130104 - DNA, 20 bp, Artificial
  CRISPR gRNA sequence
tgatcttaaaatgctaacat

SEQ ID NO: 130105 - DNA, 20 bp, Artificial
  CRISPR gRNA sequence
gatcttaaaatgctaacata

SEQ ID NO: 130106 - DNA, 20 bp, Artificial
  CRISPR gRNA sequence
atcttaaaatgctaacatac

SEQ ID NO: 130107 - DNA, 20 bp, Artificial
  CRISPR gRNA sequence
aaaatgctaacatactagga

SEQ ID NO: 130108 - DNA, 20 bp, Artificial
  CRISPR gRNA sequence
aaatgctaacatactaggag

SEQ ID NO: 130109 - DNA, 20 bp, Artificial
  CRISPR gRNA sequence
acatactaggagagtatcct

SEQ ID NO: 130110 - DNA, 20 bp, Artificial
  CRISPR gRNA sequence
ggagagtatcctttaataga

SEQ ID NO: 130111 - DNA, 20 bp, Artificial
  CRISPR gRNA sequence
taatagacatgatggatttt

SEQ ID NO: 130112 - DNA, 20 bp, Artificial
  CRISPR gRNA sequence
aatagacatgatggattttt

SEQ ID NO: 130113 - DNA, 20 bp, Artificial
  CRISPR gRNA sequence
atagacatgatggatttttt

SEQ ID NO: 130114 - DNA, 20 bp, Artificial
  CRISPR gRNA sequence
ttttttacagccataaaaga

SEQ ID NO: 130115 - DNA, 20 bp, Artificial
  CRISPR gRNA sequence
tttttacagccataaaagaa

SEQ ID NO: 130116 - DNA, 20 bp, Artificial
  CRISPR gRNA sequence
ttttacagccataaaagaat

SEQ ID NO: 130117 - DNA, 20 bp, Artificial
  CRISPR gRNA sequence
tttacagccataaaagaatg

SEQ ID NO: 130118 - DNA, 20 bp, Artificial
  CRISPR gRNA sequence
ttacagccataaaagaatga

SEQ ID NO: 130119 - DNA, 20 bp, Artificial
  CRISPR gRNA sequence
tacagccataaaagaatgat

SEQ ID NO: 130120 - DNA, 20 bp, Artificial
  CRISPR gRNA sequence
acagccataaaagaatgatc

SEQ ID NO: 130121 - DNA, 20 bp, Artificial
  CRISPR gRNA sequence
cagccataaaagaatgatca

SEQ ID NO: 130122 - DNA, 20 bp, Artificial
  CRISPR gRNA sequence
tgatacctgtgagttgacta

SEQ ID NO: 130123 - DNA, 20 bp, Artificial
  CRISPR gRNA sequence
tgagttgactagcttttaca

SEQ ID NO: 130124 - DNA, 20 bp, Artificial
  CRISPR gRNA sequence
actagcttttacaataacct

SEQ ID NO: 130125 - DNA, 20 bp, Artificial
  CRISPR gRNA sequence
gcttttacaataacctaagg

SEQ ID NO: 130126 - DNA, 20 bp, Artificial
  CRISPR gRNA sequence
ttacaataacctaaggaaga

SEQ ID NO: 130127 - DNA, 20 bp, Artificial
  CRISPR gRNA sequence
tacaataacctaaggaagat

SEQ ID NO: 130128 - DNA, 20 bp, Artificial
  CRISPR gRNA sequence
acaataacctaaggaagatc

SEQ ID NO: 130129 - DNA, 20 bp, Artificial
  CRISPR gRNA sequence
caataacctaaggaagatca

SEQ ID NO: 130130 - DNA, 20 bp, Artificial
  CRISPR gRNA sequence
aggaagatcaaggtgcagga

SEQ ID NO: 130131 - DNA, 20 bp, Artificial
  CRISPR gRNA sequence
tttcagagcctacaattgga

SEQ ID NO: 130132 - DNA, 20 bp, Artificial
  CRISPR gRNA sequence
cagagcctacaattggaaac

SEQ ID NO: 130133 - DNA, 20 bp, Artificial
  CRISPR gRNA sequence
agagcctacaattggaaaca

SEQ ID NO: 130134 - DNA, 20 bp, Artificial
  CRISPR gRNA sequence
caattggaaacaaactttgg

SEQ ID NO: 130135 - DNA, 20 bp, Artificial
  CRISPR gRNA sequence
gaaacaaactttggttgggg

SEQ ID NO: 130136 - DNA, 20 bp, Artificial
  CRISPR gRNA sequence
tggttgggggtggggagggc

SEQ ID NO: 130137 - DNA, 20 bp, Artificial
  CRISPR gRNA sequence
ggttgggggtggggagggca

SEQ ID NO: 130138 - DNA, 20 bp, Artificial
  CRISPR gRNA sequence
gttgggggtggggagggcag
